United States Patent 7,618,814 (MICRORNA-RELATED NUCLEIC ACIDS AND USES THEREOF) - sequence listing, part 6

SEQ ID NO: 196941 - RNA, 32 nt, Human
gggagccggcgcgcaccagccuagcgaucggc

SEQ ID NO: 196942 - RNA, 23 nt, Human
gggagccgggaaucggggccugc

SEQ ID NO: 196943 - RNA, 19 nt, Human
gggagccgggcugccgcag

SEQ ID NO: 196944 - RNA, 32 nt, Human
gggagccggggcagggcagaggugaacuugaa

SEQ ID NO: 196945 - RNA, 19 nt, Human
gggagccggggcggggcgg

SEQ ID NO: 196946 - RNA, 18 nt, Human
gggagccggggcugggag

SEQ ID NO: 196947 - RNA, 32 nt, Human
gggagccggggugggaaccaggagaaaggggu

SEQ ID NO: 196948 - RNA, 32 nt, Human
gggagccguggagggaacuuucccaguccccg

SEQ ID NO: 196949 - RNA, 32 nt, Human
gggagccguguuuggcagugcagagguagcga

SEQ ID NO: 196950 - RNA, 32 nt, Human
gggagccuaguggagagcagacguggcuuuuu

SEQ ID NO: 196951 - RNA, 21 nt, Human
gggagccucaggagggcucug

SEQ ID NO: 196952 - RNA, 32 nt, Human
gggagccucagguucucucaggggcagcaaag

SEQ ID NO: 196953 - RNA, 32 nt, Human
gggagccuccagccacaaguucccuguccuua

SEQ ID NO: 196954 - RNA, 25 nt, Human
gggagccuccaguagcccucagaga

SEQ ID NO: 196955 - RNA, 32 nt, Human
gggagccucugccugagugugcaccaggccca

SEQ ID NO: 196956 - RNA, 20 nt, Human
gggagccucuguucucugcg

SEQ ID NO: 196957 - RNA, 24 nt, Human
gggagccugaggcaggcggaucau

SEQ ID NO: 196958 - RNA, 32 nt, Human
gggagccugcacuccggagggcuguaccuuua

SEQ ID NO: 196959 - RNA, 32 nt, Human
gggagccugcagcaggcacaucugacccaucc

SEQ ID NO: 196960 - RNA, 32 nt, Human
gggagccugccuggcuucuacuuacugccagg

SEQ ID NO: 196961 - RNA, 32 nt, Human
gggagccugggaggucaaggcugcagugagcc

SEQ ID NO: 196962 - RNA, 32 nt, Human
gggagccugggccccuuccagccgugggcaaa

SEQ ID NO: 196963 - RNA, 32 nt, Human
gggagccugggcuggaagaggcagcaaaaggg

SEQ ID NO: 196964 - RNA, 23 nt, Human
gggagccuggggcaggagaauca

SEQ ID NO: 196965 - RNA, 32 nt, Human
gggagccugguucagacacagcucuuccaggg

SEQ ID NO: 196966 - RNA, 32 nt, Human
gggagccuguagucccagcuacacgggaggcu

SEQ ID NO: 196967 - RNA, 32 nt, Human
gggagccuguagucccagcuacucaggaggcu

SEQ ID NO: 196968 - RNA, 32 nt, Human
gggagccuguagucccagcuacucaggaugcu

SEQ ID NO: 196969 - RNA, 32 nt, Human
gggagccugugagccccaggcacuuugcauca

SEQ ID NO: 196970 - RNA, 32 nt, Human
gggagccugugcccucccugcccagucgcuuu

SEQ ID NO: 196971 - RNA, 25 nt, Human
gggagccugugcuggucccgggcgu

SEQ ID NO: 196972 - RNA, 19 nt, Human
gggagccuguggccugcag

SEQ ID NO: 196973 - RNA, 19 nt, Human
gggagccuguggcuggaga

SEQ ID NO: 196974 - RNA, 32 nt, Human
gggagccuguucugucuugcaucuuccaugac

SEQ ID NO: 196975 - RNA, 32 nt, Human
gggagccuucucaguccucucucccuccaguc

SEQ ID NO: 196976 - RNA, 19 nt, Human
gggagccuuggauggggug

SEQ ID NO: 196977 - RNA, 19 nt, Human
gggagcgaagcgguggcug

SEQ ID NO: 196978 - RNA, 32 nt, Human
gggagcgaaggaggggacggggagaaagaagc

SEQ ID NO: 196979 - RNA, 25 nt, Human
gggagcgacccucaaggccacccag

SEQ ID NO: 196980 - RNA, 32 nt, Human
gggagcgagagggagagcaaaagaaggaaagg

SEQ ID NO: 196981 - RNA, 32 nt, Human
gggagcgagcacgucgcuccgcaccgcucuuc

SEQ ID NO: 196982 - RNA, 32 nt, Human
gggagcgaggucagaggagccggcauggguug

SEQ ID NO: 196983 - RNA, 32 nt, Human
gggagcgaggugguuguuccugggguccgagg

SEQ ID NO: 196984 - RNA, 32 nt, Human
gggagcgcagagccacagucagaccuguccca

SEQ ID NO: 196985 - RNA, 32 nt, Human
gggagcgcagaggcgacggcccccaugccggc

SEQ ID NO: 196986 - RNA, 17 nt, Human
gggagcgccggccgcgg

SEQ ID NO: 196987 - RNA, 32 nt, Human
gggagcgcgagaccagccugaccaacauggag

SEQ ID NO: 196988 - RNA, 23 nt, Human
gggagcgcgcggcagcggggcgg

SEQ ID NO: 196989 - RNA, 32 nt, Human
gggagcgcggaaugugaggcuuggcgggccgc

SEQ ID NO: 196990 - RNA, 32 nt, Human
gggagcgcgggcucacaugacuggccgcgcga

SEQ ID NO: 196991 - RNA, 32 nt, Human
gggagcgcgggguccccgcgcccagccgggcc

SEQ ID NO: 196992 - RNA, 28 nt, Human
gggagcgcggugggggcagcgggcgcgg

SEQ ID NO: 196993 - RNA, 32 nt, Human
gggagcgcuggggucgccugggccacaggcac

SEQ ID NO: 196994 - RNA, 32 nt, Human
gggagcggaagaggcccaggaggcugggugag

SEQ ID NO: 196995 - RNA, 22 nt, Human
gggagcggaagcgcggccgcgg

SEQ ID NO: 196996 - RNA, 32 nt, Human
gggagcggaaggcggagacagcgagacuggcc

SEQ ID NO: 196997 - RNA, 32 nt, Human
gggagcggagcuuggcccugcgcccugugcag

SEQ ID NO: 196998 - RNA, 32 nt, Human
gggagcggcggagacucagccccaccagccuc

SEQ ID NO: 196999 - RNA, 25 nt, Human
gggagcggcggcagcggcggcgcgg

SEQ ID NO: 197000 - RNA, 21 nt, Human
gggagcggcggcagcuggcug

SEQ ID NO: 197001 - RNA, 21 nt, Human
gggagcggcggcggcggccgg

SEQ ID NO: 197002 - RNA, 32 nt, Human
gggagcggcgggcggcgagcagaggagcuaac

SEQ ID NO: 197003 - RNA, 32 nt, Human
gggagcgggaauggguggaggccgggggaaua

SEQ ID NO: 197004 - RNA, 21 nt, Human
gggagcgggaggcagcugcgg

SEQ ID NO: 197005 - RNA, 24 nt, Human
gggagcgggagggcagaggugagg

SEQ ID NO: 197006 - RNA, 32 nt, Human
gggagcgggccaccgguccugccgcucuccug

SEQ ID NO: 197007 - RNA, 32 nt, Human
gggagcgggccgcggcgacggcggcggcgcug

SEQ ID NO: 197008 - RNA, 23 nt, Human
gggagcgggcggagcgggggcgg

SEQ ID NO: 197009 - RNA, 18 nt, Human
gggagcgggcggcggcug

SEQ ID NO: 197010 - RNA, 21 nt, Human
gggagcgggcggcggcugcgg

SEQ ID NO: 197011 - RNA, 20 nt, Human
gggagcggggaccccggaga

SEQ ID NO: 197012 - RNA, 24 nt, Human
gggagcggggacccgagccugcag

SEQ ID NO: 197013 - RNA, 32 nt, Human
gggagcggggcugcuggagagagcggggaacu

SEQ ID NO: 197014 - RNA, 18 nt, Human
gggagcggggcugggagg

SEQ ID NO: 197015 - RNA, 20 nt, Human
gggagcgggucgcggggcgg

SEQ ID NO: 197016 - RNA, 32 nt, Human
gggagcggugcggccaaggaggaagcagugcu

SEQ ID NO: 197017 - RNA, 26 nt, Human
gggagcgguggcggcggcagaggcgg

SEQ ID NO: 197018 - RNA, 23 nt, Human
gggagcgguggcucacaccugua

SEQ ID NO: 197019 - RNA, 17 nt, Human
gggagcgguggcugaga

SEQ ID NO: 197020 - RNA, 18 nt, Human
gggagcgguggcugagga

SEQ ID NO: 197021 - RNA, 32 nt, Human
gggagcguaggggccgggaaagaggcacaagg

SEQ ID NO: 197022 - RNA, 32 nt, Human
gggagcuaaacaucaccaucaucuagagcggg

SEQ ID NO: 197023 - RNA, 32 nt, Human
gggagcuaagaccaggagggggcugggcgcug

SEQ ID NO: 197024 - RNA, 32 nt, Human
gggagcuaaggugggagaauugcuugagcuug

SEQ ID NO: 197025 - RNA, 32 nt, Human
gggagcuacaaacccaccaauaaaacugauau

SEQ ID NO: 197026 - RNA, 19 nt, Human
gggagcuagccagcuucag

SEQ ID NO: 197027 - RNA, 20 nt, Human
gggagcuagccagcuucaga

SEQ ID NO: 197028 - RNA, 32 nt, Human
gggagcuagugccugcucacacauuuuccaaa

SEQ ID NO: 197029 - RNA, 23 nt, Human
gggagcuauagggaccucaggga

SEQ ID NO: 197030 - RNA, 32 nt, Human
gggagcucaccagcaaacgccacugcagacga

SEQ ID NO: 197031 - RNA, 21 nt, Human
gggagcucagcggggaccgag

SEQ ID NO: 197032 - RNA, 32 nt, Human
gggagcucagcuuccaggguccugggccugcu

SEQ ID NO: 197033 - RNA, 32 nt, Human
gggagcucagggcaaaggccaggcuagcgcgg

SEQ ID NO: 197034 - RNA, 23 nt, Human
gggagcucaggggaacgcccgag

SEQ ID NO: 197035 - RNA, 32 nt, Human
gggagcucaguggaauuguaccgccuguacuu

SEQ ID NO: 197036 - RNA, 32 nt, Human
gggagcucauggugcugucugccuccucuuag

SEQ ID NO: 197037 - RNA, 23 nt, Human
gggagcuccagccaggcagcgag

SEQ ID NO: 197038 - RNA, 32 nt, Human
gggagcuccauauacuccuauaacuccuaaag

SEQ ID NO: 197039 - RNA, 32 nt, Human
gggagcucccuccaaucaguuucccaccgagc

SEQ ID NO: 197040 - RNA, 32 nt, Human
gggagcucgagaccagccugaccaacauggcg

SEQ ID NO: 197041 - RNA, 32 nt, Human
gggagcucgagaccagccuggccaacauggug

SEQ ID NO: 197042 - RNA, 20 nt, Human
gggagcucgcgcagggaucg

SEQ ID NO: 197043 - RNA, 23 nt, Human
gggagcucgcgccggagcccgag

SEQ ID NO: 197044 - RNA, 32 nt, Human
gggagcucggcccauccaccucuugggguacc

SEQ ID NO: 197045 - RNA, 25 nt, Human
gggagcucggcggcggcgggcgcgg

SEQ ID NO: 197046 - RNA, 32 nt, Human
gggagcucugcaccacgagcuucagucacccc

SEQ ID NO: 197047 - RNA, 32 nt, Human
gggagcucuuucuuacauuucccuuggagggu

SEQ ID NO: 197048 - RNA, 32 nt, Human
gggagcucuuugagccuuucugucucauuugg

SEQ ID NO: 197049 - RNA, 32 nt, Human
gggagcugagagaaggcacugagagggacagu

SEQ ID NO: 197050 - RNA, 19 nt, Human
gggagcugagcgcagcaga

SEQ ID NO: 197051 - RNA, 32 nt, Human
gggagcugagcugaguggcucuaaaaugucuu

SEQ ID NO: 197052 - RNA, 32 nt, Human
gggagcugaggcaggagaaucgguugaaucca

SEQ ID NO: 197053 - RNA, 22 nt, Human
gggagcugaggcgggcggauca

SEQ ID NO: 197054 - RNA, 20 nt, Human
gggagcugaggcugaggaga

SEQ ID NO: 197055 - RNA, 32 nt, Human
gggagcugagucuccagagggugcuuugggga

SEQ ID NO: 197056 - RNA, 32 nt, Human
gggagcugcagagagaacaagaccugagacua

SEQ ID NO: 197057 - RNA, 32 nt, Human
gggagcugcaggaacaggaaaaagagaccuuc

SEQ ID NO: 197058 - RNA, 32 nt, Human
gggagcugcaggaggcagagaaguaccacucu

SEQ ID NO: 197059 - RNA, 32 nt, Human
gggagcugccagcccagggcucagcuucccau

SEQ ID NO: 197060 - RNA, 32 nt, Human
gggagcugccgggaguuggagccugcggaguu

SEQ ID NO: 197061 - RNA, 32 nt, Human
gggagcugccggucccacucugucuuugccua

SEQ ID NO: 197062 - RNA, 32 nt, Human
gggagcugccugcucacaggcacuuugggacc

SEQ ID NO: 197063 - RNA, 32 nt, Human
gggagcugccuggcuucucugccuccagccuu

SEQ ID NO: 197064 - RNA, 23 nt, Human
gggagcugccuguucagcuccag

SEQ ID NO: 197065 - RNA, 32 nt, Human
gggagcugcggucuccggccauggcccccgcu

SEQ ID NO: 197066 - RNA, 32 nt, Human
gggagcugcguuggaggagagagccaggggcu

SEQ ID NO: 197067 - RNA, 32 nt, Human
gggagcugcugggcuagguccagauccgcucc

SEQ ID NO: 197068 - RNA, 19 nt, Human
gggagcuggaaaacuuccu

SEQ ID NO: 197069 - RNA, 32 nt, Human
gggagcuggaauggggagcaaugagaggaggg

SEQ ID NO: 197070 - RNA, 20 nt, Human
gggagcuggacaguggagug

SEQ ID NO: 197071 - RNA, 32 nt, Human
gggagcuggagguucugcgggagcagcuggcc

SEQ ID NO: 197072 - RNA, 32 nt, Human
gggagcuggcagagcgcagggaagaaguucca

SEQ ID NO: 197073 - RNA, 17 nt, Human
gggagcuggcggacucc

SEQ ID NO: 197074 - RNA, 21 nt, Human
gggagcuggcugagcgccggg

SEQ ID NO: 197075 - RNA, 29 nt, Human
gggagcuggcugcagacacccacucaguc

SEQ ID NO: 197076 - RNA, 32 nt, Human
gggagcugggagggagcagugcaccugccagc

SEQ ID NO: 197077 - RNA, 32 nt, Human
gggagcugggaugcagugggagaggggacacg

SEQ ID NO: 197078 - RNA, 32 nt, Human
gggagcugggccuccccucauccucuguaacu

SEQ ID NO: 197079 - RNA, 32 nt, Human
gggagcugggccuggucucacccuggaggcac

SEQ ID NO: 197080 - RNA, 32 nt, Human
gggagcuggggaucuggauuccugguucccug

SEQ ID NO: 197081 - RNA, 32 nt, Human
gggagcugggggcagagggcggugccaagugc

SEQ ID NO: 197082 - RNA, 32 nt, Human
gggagcuggucuccagccaggugagcaacaac

SEQ ID NO: 197083 - RNA, 22 nt, Human
gggagcugguggccagacccag

SEQ ID NO: 197084 - RNA, 18 nt, Human
gggagcuguagcggggug

SEQ ID NO: 197085 - RNA, 32 nt, Human
gggagcugucagcaaggagcagguaagugagc

SEQ ID NO: 197086 - RNA, 32 nt, Human
gggagcuguccagccaggucuggugcugaagu

SEQ ID NO: 197087 - RNA, 32 nt, Human
gggagcugugaccuccccaacgcucaccccuc

SEQ ID NO: 197088 - RNA, 32 nt, Human
gggagcuguggcuaaaggaaguggaggggccg

SEQ ID NO: 197089 - RNA, 19 nt, Human
gggagcuguggcuggcaga

SEQ ID NO: 197090 - RNA, 32 nt, Human
gggagcugugggaagccacagcagaaauggaa

SEQ ID NO: 197091 - RNA, 32 nt, Human
gggagcugugugaccauagaaagugacguguu

SEQ ID NO: 197092 - RNA, 22 nt, Human
gggagcugugugccaguuccag

SEQ ID NO: 197093 - RNA, 32 nt, Human
gggagcugugugucuccgccagagucacagca

SEQ ID NO: 197094 - RNA, 20 nt, Human
gggagcuguucuagcuccag

SEQ ID NO: 197095 - RNA, 32 nt, Human
gggagcuguuuaucuucugccugucaggcagg

SEQ ID NO: 197096 - RNA, 32 nt, Human
gggagcuguuuaucuucugccugucaggcugg

SEQ ID NO: 197097 - RNA, 16 nt, Human
gggagcuuccagguca

SEQ ID NO: 197098 - RNA, 32 nt, Human
gggagcuuccaggucacagucagauucaaaga

SEQ ID NO: 197099 - RNA, 32 nt, Human
gggagcuuccccauccucccugccuuccccag

SEQ ID NO: 197100 - RNA, 23 nt, Human
gggagcuucggcagggccugcag

SEQ ID NO: 197101 - RNA, 32 nt, Human
gggagcuucucccuuccuuccaucuuccucuc

SEQ ID NO: 197102 - RNA, 32 nt, Human
gggagcuucucuucucaacaggccuugcgagg

SEQ ID NO: 197103 - RNA, 32 nt, Human
gggagcuucuuuggaccuuggagcacacagag

SEQ ID NO: 197104 - RNA, 21 nt, Human
gggagcuugaaaaaaugcaga

SEQ ID NO: 197105 - RNA, 32 nt, Human
gggagcuugaggcucauuggaagaggacgauc

SEQ ID NO: 197106 - RNA, 25 nt, Human
gggagcuugcacuaugcagcuccag

SEQ ID NO: 197107 - RNA, 19 nt, Human
gggagcuugccacacucuu

SEQ ID NO: 197108 - RNA, 32 nt, Human
gggagcuugccaggaacccaguggccagggag

SEQ ID NO: 197109 - RNA, 32 nt, Human
gggagcuuugccaacaggagguuuugaaccau

SEQ ID NO: 197110 - RNA, 32 nt, Human
gggagcuuugccugggaccugaaccuggagca

SEQ ID NO: 197111 - RNA, 20 nt, Human
gggagcuuuggagaauucug

SEQ ID NO: 197112 - RNA, 24 nt, Human
gggaggaaaagaggaggagacgga

SEQ ID NO: 197113 - RNA, 32 nt, Human
gggaggaaaagaggaggagacggaggagaacu

SEQ ID NO: 197114 - RNA, 32 nt, Human
gggaggaaagaaugccugcguggugcagcuac

SEQ ID NO: 197115 - RNA, 18 nt, Human
gggaggaaagcuggaagg

SEQ ID NO: 197116 - RNA, 21 nt, Human
gggaggaaaggggccuggagg

SEQ ID NO: 197117 - RNA, 20 nt, Human
gggaggaacccggugggagg

SEQ ID NO: 197118 - RNA, 32 nt, Human
gggaggaagaggaggaagaggaaggggagagg

SEQ ID NO: 197119 - RNA, 32 nt, Human
gggaggaagaggaggaggaggaggaggcuggg

SEQ ID NO: 197120 - RNA, 32 nt, Human
gggaggaagcacagcuguuggggaagggccag

SEQ ID NO: 197121 - RNA, 17 nt, Human
gggaggaagcugaugaa

SEQ ID NO: 197122 - RNA, 32 nt, Human
gggaggaaggaaggaaggaagggcggcgugga

SEQ ID NO: 197123 - RNA, 32 nt, Human
gggaggaaggcggugagagaggcgggggccuc

SEQ ID NO: 197124 - RNA, 19 nt, Human
gggaggaagggcugggagg

SEQ ID NO: 197125 - RNA, 32 nt, Human
gggaggaaggggcaauuuuccagugaugaaau

SEQ ID NO: 197126 - RNA, 32 nt, Human
gggaggaaggggcaggaggaaggguugagguu

SEQ ID NO: 197127 - RNA, 18 nt, Human
gggaggaaggugguauca

SEQ ID NO: 197128 - RNA, 23 nt, Human
gggaggaagugggaacagggagg

SEQ ID NO: 197129 - RNA, 32 nt, Human
gggaggaagugggaacagggaggugggaggug

SEQ ID NO: 197130 - RNA, 19 nt, Human
gggaggaaguggggaggag

SEQ ID NO: 197131 - RNA, 20 nt, Human
gggaggaaucccuuggggga

SEQ ID NO: 197132 - RNA, 32 nt, Human
gggaggaaucuauuccugucauggucuagugc

SEQ ID NO: 197133 - RNA, 32 nt, Human
gggaggacagagccgguuuccguggcaacccu

SEQ ID NO: 197134 - RNA, 32 nt, Human
gggaggacagcuagcccagcugccuugggcug

SEQ ID NO: 197135 - RNA, 30 nt, Human
gggaggacaggaaggcagccugggacauuu

SEQ ID NO: 197136 - RNA, 32 nt, Human
gggaggacauuuggccagcugguggcugggag

SEQ ID NO: 197137 - RNA, 32 nt, Human
gggaggacauuuucauagccuccuacagugag

SEQ ID NO: 197138 - RNA, 32 nt, Human
gggaggaccaccugaggucaagaguucgagac

SEQ ID NO: 197139 - RNA, 32 nt, Human
gggaggaccagagacgaagggcuuggaaggag

SEQ ID NO: 197140 - RNA, 32 nt, Human
gggaggaccccaaucuaggcccaagagggaaa

SEQ ID NO: 197141 - RNA, 32 nt, Human
gggaggacccugggguggagggugagggauuc

SEQ ID NO: 197142 - RNA, 32 nt, Human
gggaggaccgcuaacuggugcaccuuguccuu

SEQ ID NO: 197143 - RNA, 22 nt, Human
gggaggaccggaggaccgagga

SEQ ID NO: 197144 - RNA, 23 nt, Human
gggaggacgaagcgaguggauca

SEQ ID NO: 197145 - RNA, 23 nt, Human
gggaggacgaggcggguggauca

SEQ ID NO: 197146 - RNA, 32 nt, Human
gggaggacgccaggcugcacacggugaaugug

SEQ ID NO: 197147 - RNA, 32 nt, Human
gggaggacgcgaggccccggcccagccauggc

SEQ ID NO: 197148 - RNA, 32 nt, Human
gggaggacucacugacauaccuaccuucaaga

SEQ ID NO: 197149 - RNA, 32 nt, Human
gggaggacucugcugcuucuuaagcuccagcg

SEQ ID NO: 197150 - RNA, 22 nt, Human
gggaggacugcuugaggccagg

SEQ ID NO: 197151 - RNA, 32 nt, Human
gggaggacuggaccaggcaguggcugcagagg

SEQ ID NO: 197152 - RNA, 31 nt, Human
gggaggagaaaugcuacuggcauuuagugga

SEQ ID NO: 197153 - RNA, 32 nt, Human
gggaggagaaggaggaagagggggaggaggaa

SEQ ID NO: 197154 - RNA, 32 nt, Human
gggaggagaauguccuggaagggcaggacucu

SEQ ID NO: 197155 - RNA, 22 nt, Human
gggaggagacagggcuggggga

SEQ ID NO: 197156 - RNA, 19 nt, Human
gggaggagacaugguagag

SEQ ID NO: 197157 - RNA, 22 nt, Human
gggaggagaccugaucccaggg

SEQ ID NO: 197158 - RNA, 18 nt, Human
gggaggagacgggcggga

SEQ ID NO: 197159 - RNA, 18 nt, Human
gggaggagacugaggaga

SEQ ID NO: 197160 - RNA, 18 nt, Human
gggaggagagaagacaga

SEQ ID NO: 197161 - RNA, 32 nt, Human
gggaggagagaagggggcagagucuucccuac

SEQ ID NO: 197162 - RNA, 32 nt, Human
gggaggagagaagguagagcuguucuuaaauu

SEQ ID NO: 197163 - RNA, 32 nt, Human
gggaggagagacgggcccugcucacagacuag

SEQ ID NO: 197164 - RNA, 19 nt, Human
gggaggagagagcggcaga

SEQ ID NO: 197165 - RNA, 20 nt, Human
gggaggagagauggacgaga

SEQ ID NO: 197166 - RNA, 32 nt, Human
gggaggagagcaucaucacuuuccauuagcug

SEQ ID NO: 197167 - RNA, 17 nt, Human
gggaggagagcugagga

SEQ ID NO: 197168 - RNA, 18 nt, Human
gggaggagaggaggaagg

SEQ ID NO: 197169 - RNA, 18 nt, Human
gggaggagaggagggcga

SEQ ID NO: 197170 - RNA, 32 nt, Human
gggaggagaggaugcagagggaagggaagaga

SEQ ID NO: 197171 - RNA, 17 nt, Human
gggaggagaggcuggga

SEQ ID NO: 197172 - RNA, 18 nt, Human
gggaggagagggcagagg

SEQ ID NO: 197173 - RNA, 18 nt, Human
gggaggagagggcggagg

SEQ ID NO: 197174 - RNA, 18 nt, Human
gggaggagaggguggaga

SEQ ID NO: 197175 - RNA, 16 nt, Human
gggaggagaggugaga

SEQ ID NO: 197176 - RNA, 32 nt, Human
gggaggagagguggagagcggacagaggggcu

SEQ ID NO: 197177 - RNA, 19 nt, Human
gggaggagaguaaaggaga

SEQ ID NO: 197178 - RNA, 20 nt, Human
gggaggagaguaaaugaaga

SEQ ID NO: 197179 - RNA, 18 nt, Human
gggaggagaguuaugaga

SEQ ID NO: 197180 - RNA, 23 nt, Human
gggcaugguggcacaugccugua

SEQ ID NO: 197181 - RNA, 23 nt, Human
gggcaugguggcacgugccugua

SEQ ID NO: 197182 - RNA, 23 nt, Human
gggcaugguggcaggugccugua

SEQ ID NO: 197183 - RNA, 23 nt, Human
gggcaugguggcaugugccugua

SEQ ID NO: 197184 - RNA, 23 nt, Human
gggcaugguggcccaugccugua

SEQ ID NO: 197185 - RNA, 23 nt, Human
gggcaugguggcgagugccugua

SEQ ID NO: 197186 - RNA, 23 nt, Human
gggcaugguggcgcaugccugua

SEQ ID NO: 197187 - RNA, 23 nt, Human
gggcaugguggcgcaugccugug

SEQ ID NO: 197188 - RNA, 23 nt, Human
gggcaugguggcgggugccugua

SEQ ID NO: 197189 - RNA, 23 nt, Human
gggcaugguggcucacaccugua

SEQ ID NO: 197190 - RNA, 23 nt, Human
gggcaugguggcucacgccugua

SEQ ID NO: 197191 - RNA, 23 nt, Human
gggcaugguggcucacgcuugua

SEQ ID NO: 197192 - RNA, 23 nt, Human
gggcaugguggcucauaccugua

SEQ ID NO: 197193 - RNA, 32 nt, Human
gggcaugguggcucaugccugccuguaauccc

SEQ ID NO: 197194 - RNA, 23 nt, Human
gggcaugguggcucaugccugua

SEQ ID NO: 197195 - RNA, 23 nt, Human
gggcaugguggcuuacaucugua

SEQ ID NO: 197196 - RNA, 23 nt, Human
gggcaugguggcuuacgccugua

SEQ ID NO: 197197 - RNA, 23 nt, Human
gggcaugguggcuugcaccugua

SEQ ID NO: 197198 - RNA, 23 nt, Human
gggcaugguggugcaugccugua

SEQ ID NO: 197199 - RNA, 23 nt, Human
gggcauggugguguguaccugua

SEQ ID NO: 197200 - RNA, 32 nt, Human
gggcaugguguaauccuaacacuuugggaggc

SEQ ID NO: 197201 - RNA, 29 nt, Human
gggcauguggauacuggcucucuccuugu

SEQ ID NO: 197202 - RNA, 29 nt, Human
gggcaugugggcugaggcaggcuugccca

SEQ ID NO: 197203 - RNA, 32 nt, Human
gggcauguggucaagaugcauaccucaugaau

SEQ ID NO: 197204 - RNA, 32 nt, Human
gggcaugugugagggaagcugcaugggugggu

SEQ ID NO: 197205 - RNA, 24 nt, Human
gggcaugugugccugcagcuggga

SEQ ID NO: 197206 - RNA, 32 nt, Human
gggcaugugugucuauuucuagagcaggaaga

SEQ ID NO: 197207 - RNA, 32 nt, Human
gggcauguuaaagggaugacugugcauuccag

SEQ ID NO: 197208 - RNA, 32 nt, Human
gggcauguucuucucaugaugaugacugcaac

SEQ ID NO: 197209 - RNA, 32 nt, Human
gggcauuauacaacaaauaaucuaggauuuau

SEQ ID NO: 197210 - RNA, 32 nt, Human
gggcauuaucagugaacuacucugagauuuac

SEQ ID NO: 197211 - RNA, 32 nt, Human
gggcauucaaagaagcuagacugagaacgccu

SEQ ID NO: 197212 - RNA, 32 nt, Human
gggcauucacagugggcaugcuauccacccuc

SEQ ID NO: 197213 - RNA, 32 nt, Human
gggcauucacgucaguucucugaccccgccgu

SEQ ID NO: 197214 - RNA, 32 nt, Human
gggcauucccagagaggaagggccgcugugca

SEQ ID NO: 197215 - RNA, 32 nt, Human
gggcauucuucgggggugcaucagagggaggg

SEQ ID NO: 197216 - RNA, 21 nt, Human
gggcauuucaggcuccugcug

SEQ ID NO: 197217 - RNA, 17 nt, Human
gggcauuucaguggcag

SEQ ID NO: 197218 - RNA, 18 nt, Human
gggcauuucuggaggcag

SEQ ID NO: 197219 - RNA, 32 nt, Human
gggcauuuggaugagguugaggugagaucagg

SEQ ID NO: 197220 - RNA, 32 nt, Human
gggccaaaaucaaucuuaaacgggagggguaa

SEQ ID NO: 197221 - RNA, 31 nt, Human
gggccaaacaacacggccgggaggcggccgc

SEQ ID NO: 197222 - RNA, 32 nt, Human
gggccaaacccccaguggcugggccucugugu

SEQ ID NO: 197223 - RNA, 32 nt, Human
gggccaaaggaucaguugagaaacaguuaagg

SEQ ID NO: 197224 - RNA, 32 nt, Human
gggccaacauggugaaaccccaucucuacaaa

SEQ ID NO: 197225 - RNA, 32 nt, Human
gggccaacauggugaaaccccaucucugcuaa

SEQ ID NO: 197226 - RNA, 32 nt, Human
gggccaacauuauuucugaagacuucauuauu

SEQ ID NO: 197227 - RNA, 32 nt, Human
gggccaaccccuggccugcugcugugcuucag

SEQ ID NO: 197228 - RNA, 32 nt, Human
gggccaagaaaaugagcuugguuuccaacggg

SEQ ID NO: 197229 - RNA, 32 nt, Human
gggccaagagguuaaggcuacagugagcuaug

SEQ ID NO: 197230 - RNA, 32 nt, Human
gggccaagauccccgggaaagcauagccgugc

SEQ ID NO: 197231 - RNA, 32 nt, Human
gggccaagcacaaagguuccagugagcgcaug

SEQ ID NO: 197232 - RNA, 32 nt, Human
gggccaagcccgcuaccuccuguaagaggacu

SEQ ID NO: 197233 - RNA, 25 nt, Human
gggccaagccgggaccaccccgaga

SEQ ID NO: 197234 - RNA, 32 nt, Human
gggccaagccuccucaacuaugaccucaaccg

SEQ ID NO: 197235 - RNA, 28 nt, Human
gggccaagccuggaugggugcucagagg

SEQ ID NO: 197236 - RNA, 32 nt, Human
gggccaaggaaugggggcaggagaggaaacag

SEQ ID NO: 197237 - RNA, 32 nt, Human
gggccaaggacaauugggagggcagcaggcag

SEQ ID NO: 197238 - RNA, 32 nt, Human
gggccaaggaccugagaccugaaggguugacu

SEQ ID NO: 197239 - RNA, 19 nt, Human
gggccaaggacucugcuga

SEQ ID NO: 197240 - RNA, 32 nt, Human
gggccaaggagaaaggcaugaaucuucccugu

SEQ ID NO: 197241 - RNA, 32 nt, Human
gggccaaggagauuaagaagaaaacgacuuuc

SEQ ID NO: 197242 - RNA, 32 nt, Human
gggccaaggaugccaccccacccucagcugua

SEQ ID NO: 197243 - RNA, 32 nt, Human
gggccaaggcaaaggggaagcauucacagacc

SEQ ID NO: 197244 - RNA, 18 nt, Human
gggccaaggcagcccugg

SEQ ID NO: 197245 - RNA, 32 nt, Human
gggccaaggccacugggggaccugccacacug

SEQ ID NO: 197246 - RNA, 32 nt, Human
gggccaagggaaaugcuguuggugagaaucga

SEQ ID NO: 197247 - RNA, 24 nt, Human
gggccaagggaaggcuaucagaga

SEQ ID NO: 197248 - RNA, 32 nt, Human
gggccaagggaucugggugggcauuuuuaacu

SEQ ID NO: 197249 - RNA, 22 nt, Human
gggccaagggcagagggggcug

SEQ ID NO: 197250 - RNA, 32 nt, Human
gggccaagggccaggacuucccgucacaauuu

SEQ ID NO: 197251 - RNA, 32 nt, Human
gggccaaggggugcuugcgccacccacguccc

SEQ ID NO: 197252 - RNA, 22 nt, Human
gggccaaggucgcucaugguca

SEQ ID NO: 197253 - RNA, 19 nt, Human
gggccaaggucugggggug

SEQ ID NO: 197254 - RNA, 25 nt, Human
gggccaaggucuggucacccagagg

SEQ ID NO: 197255 - RNA, 24 nt, Human
gggccaagucagcccaucgagaga

SEQ ID NO: 197256 - RNA, 32 nt, Human
gggccaagucuuagggcaucacaaacagccca

SEQ ID NO: 197257 - RNA, 22 nt, Human
gggccaaguggcauauccagag

SEQ ID NO: 197258 - RNA, 32 nt, Human
gggccaaucccugcccagucagcuggggucug

SEQ ID NO: 197259 - RNA, 32 nt, Human
gggccaauucacagaaacagaugugaggucag

SEQ ID NO: 197260 - RNA, 32 nt, Human
gggccacaagaccagaugagccaguuuaucgu

SEQ ID NO: 197261 - RNA, 32 nt, Human
gggccacacaggugaugcuguaccccugacaa

SEQ ID NO: 197262 - RNA, 24 nt, Human
gggccacacagugagacuccgucu

SEQ ID NO: 197263 - RNA, 32 nt, Human
gggccacacaugcauacacaugcacacucaga

SEQ ID NO: 197264 - RNA, 32 nt, Human
gggccacaccucagugccaaagaccccauggg

SEQ ID NO: 197265 - RNA, 32 nt, Human
gggccacacgagggccuggugccggugagggg

SEQ ID NO: 197266 - RNA, 32 nt, Human
gggccacacugcaaccucagcuuaacaugaau

SEQ ID NO: 197267 - RNA, 17 nt, Human
gggccacagaacccgug

SEQ ID NO: 197268 - RNA, 24 nt, Human
gggccacagaaugagacuccaucu

SEQ ID NO: 197269 - RNA, 32 nt, Human
gggccacagaauuucuuagaaagcuuugauua

SEQ ID NO: 197270 - RNA, 32 nt, Human
gggccacagagaccagccuccgggaagggguc

SEQ ID NO: 197271 - RNA, 32 nt, Human
gggccacagaggagauggaggcaaacaccuuc

SEQ ID NO: 197272 - RNA, 24 nt, Human
gggccacagauggucaucagggga

SEQ ID NO: 197273 - RNA, 20 nt, Human
gggccacagcaccugggcac

SEQ ID NO: 197274 - RNA, 32 nt, Human
gggccacagcagagagacacagcaugggcagu

SEQ ID NO: 197275 - RNA, 24 nt, Human
gggccacagcccuuuuagggcauu

SEQ ID NO: 197276 - RNA, 22 nt, Human
gggccacagcugcuucagcaga

SEQ ID NO: 197277 - RNA, 21 nt, Human
gggccacagcuuaaacagcuu

SEQ ID NO: 197278 - RNA, 32 nt, Human
gggccacaggacgucuguccuccagucacagg

SEQ ID NO: 197279 - RNA, 32 nt, Human
gggccacagggagggaggggagauggaggccc

SEQ ID NO: 197280 - RNA, 18 nt, Human
gggccacagggugggcug

SEQ ID NO: 197281 - RNA, 32 nt, Human
gggccacaggguggggucauagggucacuuca

SEQ ID NO: 197282 - RNA, 20 nt, Human
gggccacagguccuccuaca

SEQ ID NO: 197283 - RNA, 31 nt, Human
gggccacaguuucagcagaccaucaggugaa

SEQ ID NO: 197284 - RNA, 31 nt, Human
gggccacaguuucaguacuucagccucagug

SEQ ID NO: 197285 - RNA, 32 nt, Human
gggccacaucccgggucuccucccucugcgau

SEQ ID NO: 197286 - RNA, 32 nt, Human
gggccacaucucugcaccuuccaggcucugaa

SEQ ID NO: 197287 - RNA, 18 nt, Human
gggccacaucugcccaug

SEQ ID NO: 197288 - RNA, 32 nt, Human
gggccacaucuucugccccuucucagccuccc

SEQ ID NO: 197289 - RNA, 32 nt, Human
gggccacaugacaaagccccaucucuacaaaa

SEQ ID NO: 197290 - RNA, 32 nt, Human
gggccacaugcacacacagccuagcugccccc

SEQ ID NO: 197291 - RNA, 32 nt, Human
gggccacaugcugacccagccccacauccaca

SEQ ID NO: 197292 - RNA, 22 nt, Human
gggccacauggcagcccagggg

SEQ ID NO: 197293 - RNA, 32 nt, Human
gggccacaugguggccccgcugugucuggggu

SEQ ID NO: 197294 - RNA, 32 nt, Human
gggccacauucucaguuccugggauugaaaac

SEQ ID NO: 197295 - RNA, 32 nt, Human
gggccacauugggcucacagaccucagccugg

SEQ ID NO: 197296 - RNA, 32 nt, Human
gggccaccaccagugugcagcaggacauccua

SEQ ID NO: 197297 - RNA, 23 nt, Human
gggccaccagaagcaggccucga

SEQ ID NO: 197298 - RNA, 19 nt, Human
gggccaccaggaccaaagc

SEQ ID NO: 197299 - RNA, 32 nt, Human
gggccaccaggagggagccaagacaaugcaaa

SEQ ID NO: 197300 - RNA, 32 nt, Human
gggccaccaggaguucaagaccagcccgggca

SEQ ID NO: 197301 - RNA, 32 nt, Human
gggccaccaggaucagccaggagggcguucuu

SEQ ID NO: 197302 - RNA, 22 nt, Human
gggccaccaugcacucaauaaa

SEQ ID NO: 197303 - RNA, 32 nt, Human
gggccacccacuugcuggacagucugagccaa

SEQ ID NO: 197304 - RNA, 32 nt, Human
gggccaccccacucccuuccgcuugcagcuuc

SEQ ID NO: 197305 - RNA, 22 nt, Human
gggccacccggcucagcccgug

SEQ ID NO: 197306 - RNA, 32 nt, Human
gggccacccucagagcucacacauccacgaac

SEQ ID NO: 197307 - RNA, 32 nt, Human
gggccacccuggaauggggcaggggaagggca

SEQ ID NO: 197308 - RNA, 32 nt, Human
gggccacccuugccagugacuccaaguggaac

SEQ ID NO: 197309 - RNA, 32 nt, Human
gggccaccgagcugcccuggaugggcugcugg

SEQ ID NO: 197310 - RNA, 32 nt, Human
gggccaccgccuugcccagccuggaugccauc

SEQ ID NO: 197311 - RNA, 19 nt, Human
gggccaccggcggcuucga

SEQ ID NO: 197312 - RNA, 19 nt, Human
gggccaccgucuccaagga

SEQ ID NO: 197313 - RNA, 32 nt, Human
gggccaccuccaggcugcaggggcgggucacu

SEQ ID NO: 197314 - RNA, 32 nt, Human
gggccaccugaaaguucuauucccaggacuaa

SEQ ID NO: 197315 - RNA, 32 nt, Human
gggccaccuggccuuucaguuacuugaguuug

SEQ ID NO: 197316 - RNA, 32 nt, Human
gggccaccugggagauagcagggggcacagag

SEQ ID NO: 197317 - RNA, 32 nt, Human
gggccaccugguguguggagguggcgggaggg

SEQ ID NO: 197318 - RNA, 22 nt, Human
gggccaccuuugccaaccucga

SEQ ID NO: 197319 - RNA, 18 nt, Human
gggccacgccggccacac

SEQ ID NO: 197320 - RNA, 32 nt, Human
gggccacggcacuccagccugggugacagagu

SEQ ID NO: 197321 - RNA, 18 nt, Human
gggccacggcaggggggc

SEQ ID NO: 197322 - RNA, 22 nt, Human
gggccacgggcucgcgggcacu

SEQ ID NO: 197323 - RNA, 18 nt, Human
gggccacggggaggggac

SEQ ID NO: 197324 - RNA, 32 nt, Human
gggccacggggaggggaccgggaagcgcuggg

SEQ ID NO: 197325 - RNA, 32 nt, Human
gggccacgugccccggaagcagguguguccag

SEQ ID NO: 197326 - RNA, 32 nt, Human
gggccacuaagccacacuuucccuucauccug

SEQ ID NO: 197327 - RNA, 32 nt, Human
gggccacuacacuccagccugggugacagaga

SEQ ID NO: 197328 - RNA, 32 nt, Human
gggccacucuccccucccucuuccuuccccca

SEQ ID NO: 197329 - RNA, 32 nt, Human
gggccacugcaaagauuccagccuggguccag

SEQ ID NO: 197330 - RNA, 32 nt, Human
gggccacugcacuccacccugggcgacagagu

SEQ ID NO: 197331 - RNA, 32 nt, Human
gggccacugcacuccagccuggaugacagagu

SEQ ID NO: 197332 - RNA, 32 nt, Human
gggccacugcacuccagcuugggugacagagc

SEQ ID NO: 197333 - RNA, 32 nt, Human
gggccacugcacucuagccuggcaacagagca

SEQ ID NO: 197334 - RNA, 32 nt, Human
gggccacugcacugcagccugugugacaaagg

SEQ ID NO: 197335 - RNA, 32 nt, Human
gggccacugcacugggugauucacgugugccc

SEQ ID NO: 197336 - RNA, 32 nt, Human
gggccacugcagaugacucuccuuugaaauga

SEQ ID NO: 197337 - RNA, 20 nt, Human
gggccacuggaugucugccu

SEQ ID NO: 197338 - RNA, 32 nt, Human
gggccacuggggaaucugaggggugaugggag

SEQ ID NO: 197339 - RNA, 21 nt, Human
gggccacuguccucagaugac

SEQ ID NO: 197340 - RNA, 32 nt, Human
gggccacuuggcuuucuuuugcuguauuguuu

SEQ ID NO: 197341 - RNA, 32 nt, Human
gggccagaaauguucagcagcauuaagaagag

SEQ ID NO: 197342 - RNA, 23 nt, Human
gggccagaagaggcccccaggga

SEQ ID NO: 197343 - RNA, 22 nt, Human
gggccagaagcccguccuccua

SEQ ID NO: 197344 - RNA, 32 nt, Human
gggccagaaggccaugaacuggaaggagagcu

SEQ ID NO: 197345 - RNA, 23 nt, Human
gggccagacaggcucuuccuggg

SEQ ID NO: 197346 - RNA, 32 nt, Human
gggccagaccuuccuccagacuccagcccacc

SEQ ID NO: 197347 - RNA, 32 nt, Human
gggccagagagggagcccgagccaggccaucu

SEQ ID NO: 197348 - RNA, 28 nt, Human
gggccagagauuauaaguuugacacaac

SEQ ID NO: 197349 - RNA, 22 nt, Human
gggccagagcaggcagaacagg

SEQ ID NO: 197350 - RNA, 21 nt, Human
gggccagagcgggcaggaggu

SEQ ID NO: 197351 - RNA, 20 nt, Human
gggccagaggcagaacccug

SEQ ID NO: 197352 - RNA, 19 nt, Human
gggccagagucugugugga

SEQ ID NO: 197353 - RNA, 32 nt, Human
gggccagcaaagucccucccauauucaaagag

SEQ ID NO: 197354 - RNA, 24 nt, Human
gggccagcacgggccuucccggag

SEQ ID NO: 197355 - RNA, 32 nt, Human
gggccagcacuggaggggcccacccacaugac

SEQ ID NO: 197356 - RNA, 32 nt, Human
gggccagcacuguggacuccuccugggacagg

SEQ ID NO: 197357 - RNA, 23 nt, Human
gggccagcagauucucccagagg

SEQ ID NO: 197358 - RNA, 22 nt, Human
gggccagcagcagacccugggc

SEQ ID NO: 197359 - RNA, 20 nt, Human
gggccagcagcagcuccagc

SEQ ID NO: 197360 - RNA, 18 nt, Human
gggccagcagcagggagg

SEQ ID NO: 197361 - RNA, 19 nt, Human
gggccagcagcagguaggu

SEQ ID NO: 197362 - RNA, 18 nt, Human
gggccagcagcggcaggc

SEQ ID NO: 197363 - RNA, 32 nt, Human
gggccagcagggaggugggcauggcagggaau

SEQ ID NO: 197364 - RNA, 22 nt, Human
gggccagcagguucugcugagg

SEQ ID NO: 197365 - RNA, 32 nt, Human
gggccagcagugagacuaugagccaagcaaag

SEQ ID NO: 197366 - RNA, 21 nt, Human
gggccagcauacuccgugagg

SEQ ID NO: 197367 - RNA, 32 nt, Human
gggccagcauggugaaaccccgucucuacuaa

SEQ ID NO: 197368 - RNA, 32 nt, Human
gggccagccagcccugcgggccuccgugcucc

SEQ ID NO: 197369 - RNA, 32 nt, Human
gggccagccccuccacacaucucccuaaguca

SEQ ID NO: 197370 - RNA, 23 nt, Human
gggccagcccuggcuggcaugga

SEQ ID NO: 197371 - RNA, 32 nt, Human
gggccagccgggccacgagaaagaaagugaau

SEQ ID NO: 197372 - RNA, 22 nt, Human
gggccagccgggcugcugcaga

SEQ ID NO: 197373 - RNA, 32 nt, Human
gggccagccggugggugaacccugccagccac

SEQ ID NO: 197374 - RNA, 32 nt, Human
gggccagccucgugcugggcucugcccugggc

SEQ ID NO: 197375 - RNA, 23 nt, Human
gggccagcgaguccaagccggcu

SEQ ID NO: 197376 - RNA, 20 nt, Human
gggccagcgcagggcucagg

SEQ ID NO: 197377 - RNA, 32 nt, Human
gggccagcggggcugcucacccaccucuugug

SEQ ID NO: 197378 - RNA, 19 nt, Human
gggccagcgguauugcuga

SEQ ID NO: 197379 - RNA, 32 nt, Human
gggccagcucaaggugggcacgggggcccaga

SEQ ID NO: 197380 - RNA, 32 nt, Human
gggccagcucagggaggaccugccugggagcu

SEQ ID NO: 197381 - RNA, 25 nt, Human
gggccagcucaguggaccgugugga

SEQ ID NO: 197382 - RNA, 32 nt, Human
gggccagcuccagccucugccccagaccuuaa

SEQ ID NO: 197383 - RNA, 20 nt, Human
gggccagcuccaggcuaguu

SEQ ID NO: 197384 - RNA, 20 nt, Human
gggccagcucgcuccaggga

SEQ ID NO: 197385 - RNA, 21 nt, Human
gggccagcucgcugcucaggc

SEQ ID NO: 197386 - RNA, 32 nt, Human
gggccagcucugccccagcccugagaggggug

SEQ ID NO: 197387 - RNA, 32 nt, Human
gggccagcucuuaaaauaagaaagcugagacu

SEQ ID NO: 197388 - RNA, 32 nt, Human
gggccagcugauaccaaccaacuggccuguau

SEQ ID NO: 197389 - RNA, 32 nt, Human
gggccagcugccugugccugccaugggccagc

SEQ ID NO: 197390 - RNA, 32 nt, Human
gggccagcugcgccgcggcucacagcugacga

SEQ ID NO: 197391 - RNA, 32 nt, Human
gggccagcuucuuccuccuaaccacuuguuug

SEQ ID NO: 197392 - RNA, 18 nt, Human
gggccaggacacccagug

SEQ ID NO: 197393 - RNA, 32 nt, Human
gggccaggaccccuccacaugcaccugcuagu

SEQ ID NO: 197394 - RNA, 32 nt, Human
gggccaggacgcccagccacagcaagcccugu

SEQ ID NO: 197395 - RNA, 21 nt, Human
gggccaggacggggcggcagg

SEQ ID NO: 197396 - RNA, 32 nt, Human
gggccaggacucagucucagagccaaggagag

SEQ ID NO: 197397 - RNA, 32 nt, Human
gggccaggacuucagccugccuccgagggucc

SEQ ID NO: 197398 - RNA, 32 nt, Human
gggccaggagccagggggugacugggguggcu

SEQ ID NO: 197399 - RNA, 32 nt, Human
gggccaggagcuugaaggaacugugaaauaaa

SEQ ID NO: 197400 - RNA, 19 nt, Human
gggccaggauccccaggga

SEQ ID NO: 197401 - RNA, 23 nt, Human
gggccaggaugcucccccaggga

SEQ ID NO: 197402 - RNA, 22 nt, Human
gggccaggcacacccucagagg

SEQ ID NO: 197403 - RNA, 32 nt, Human
gggccaggcaccucccucacaggacaaucaga

SEQ ID NO: 197404 - RNA, 22 nt, Human
gggccaggcaggcagcuugagg

SEQ ID NO: 197405 - RNA, 32 nt, Human
gggccaggcagucgugguugcagaaggagcaa

SEQ ID NO: 197406 - RNA, 32 nt, Human
gggccaggcagugcuggagugcguuugcuggc

SEQ ID NO: 197407 - RNA, 32 nt, Human
gggccaggccacugccuuuuguccucagugac

SEQ ID NO: 197408 - RNA, 22 nt, Human
gggccaggccauggccaagggg

SEQ ID NO: 197409 - RNA, 25 nt, Human
gggccaggccgggccaggagccugc

SEQ ID NO: 197410 - RNA, 22 nt, Human
gggccaggccugggcccaggga

SEQ ID NO: 197411 - RNA, 32 nt, Human
gggccaggcucacaccuguaauccuaaguaac

SEQ ID NO: 197412 - RNA, 32 nt, Human
gggccaggcugcaggaagaagacaaaggcagc

SEQ ID NO: 197413 - RNA, 32 nt, Human
gggccagggaaaggcggggucagggcgggguu

SEQ ID NO: 197414 - RNA, 32 nt, Human
gggccagggagcagcaagccagcugggacuga

SEQ ID NO: 197415 - RNA, 32 nt, Human
gggccagggagguugaggcugcagugagcuau

SEQ ID NO: 197416 - RNA, 32 nt, Human
gggccagggcagacaaaauaagagugagcugg

SEQ ID NO: 197417 - RNA, 25 nt, Human
gggccagggcggcggcccccaggga

SEQ ID NO: 197418 - RNA, 18 nt, Human
gggccagggcucugagga

SEQ ID NO: 197419 - RNA, 32 nt, Human
gggccagggcugcugccugccagccugggguc

SEQ ID NO: 197420 - RNA, 32 nt, Human
gggccagggcuggauggacagacaccuccccc

SEQ ID NO: 197421 - RNA, 32 nt, Human
gggccagggcuggggcacgaggguaccuucac

SEQ ID NO: 197422 - RNA, 32 nt, Human
gggccaggggagaagcagucaccccuguguag

SEQ ID NO: 197423 - RNA, 31 nt, Human
gggccaggggagagagaagaggaucagcagu

SEQ ID NO: 197424 - RNA, 32 nt, Human
gggccaggggagagagaagaggaucagcagug

SEQ ID NO: 197425 - RNA, 17 nt, Human
gggccaggggccucuga

SEQ ID NO: 197426 - RNA, 32 nt, Human
gggccagggggugggagggagaaugggcacag

SEQ ID NO: 197427 - RNA, 32 nt, Human
gggccagggucagggacccucugccucuggca

SEQ ID NO: 197428 - RNA, 32 nt, Human
gggccagggugaggguggggcuggagacgacg

SEQ ID NO: 197429 - RNA, 32 nt, Human
gggccagguacgguucuucacagcagauauag

SEQ ID NO: 197430 - RNA, 32 nt, Human
gggccaggucaccaaggcuaucauccaaggca

SEQ ID NO: 197431 - RNA, 19 nt, Human
gggccagguccuacucaca

SEQ ID NO: 197432 - RNA, 21 nt, Human
gggccaggugacagugaagcu

SEQ ID NO: 197433 - RNA, 32 nt, Human
gggccaggugccugagauugauguuccauccu

SEQ ID NO: 197434 - RNA, 21 nt, Human
gggccaggugcuuccugccag

SEQ ID NO: 197435 - RNA, 32 nt, Human
gggccaggugcuuccugccagcaaagaugagu

SEQ ID NO: 197436 - RNA, 32 nt, Human
gggccaggugggaacaguguguccucugcccc

SEQ ID NO: 197437 - RNA, 32 nt, Human
gggccaggugggaccugaaagcaaagacaaug

SEQ ID NO: 197438 - RNA, 18 nt, Human
gggccagguguggggcug

SEQ ID NO: 197439 - RNA, 19 nt, Human
gggccagguuagggccuuc

SEQ ID NO: 197440 - RNA, 32 nt, Human
gggccaguaggugggaaguagcuuaaacaaug

SEQ ID NO: 197441 - RNA, 21 nt, Human
gggccagucccugcccuccca

SEQ ID NO: 197442 - RNA, 32 nt, Human
gggccagucucaaacuccugacgucaagugau

SEQ ID NO: 197443 - RNA, 32 nt, Human
gggccagucucgaacuccugacgucaagugau

SEQ ID NO: 197444 - RNA, 32 nt, Human
gggccagucugcaggcggagagagucggacgg

SEQ ID NO: 197445 - RNA, 20 nt, Human
gggccagugaagcucaggca

SEQ ID NO: 197446 - RNA, 24 nt, Human
gggccagugaaggcugcccagaga

SEQ ID NO: 197447 - RNA, 32 nt, Human
gggccagugacagagaaggcagaggggagugu

SEQ ID NO: 197448 - RNA, 32 nt, Human
gggccagugcucaugguggccucucugugccu

SEQ ID NO: 197449 - RNA, 32 nt, Human
gggccaguggcacgcuaggccaugucuggucc

SEQ ID NO: 197450 - RNA, 32 nt, Human
gggccaguggggaggagcaggagccugagccu

SEQ ID NO: 197451 - RNA, 18 nt, Human
gggccaguggggccagcu

SEQ ID NO: 197452 - RNA, 24 nt, Human
gggccaguggggccagcucaggga

SEQ ID NO: 197453 - RNA, 21 nt, Human
gggccaguggugccucaggca

SEQ ID NO: 197454 - RNA, 32 nt, Human
gggccagugucaggccagcaggugcagggaca

SEQ ID NO: 197455 - RNA, 32 nt, Human
gggccaguucuagaaagucugaugucucaaag

SEQ ID NO: 197456 - RNA, 32 nt, Human
gggccaguugggggagugcgggguggagagag

SEQ ID NO: 197457 - RNA, 32 nt, Human
gggccaguuuuguuuaaggaucaaagagacaa

SEQ ID NO: 197458 - RNA, 21 nt, Human
gggccauaggcgacccaggga

SEQ ID NO: 197459 - RNA, 32 nt, Human
gggccaucacccagggacagcgggugacugug

SEQ ID NO: 197460 - RNA, 21 nt, Human
gggccaucagcgaacugggcc

SEQ ID NO: 197461 - RNA, 32 nt, Human
gggccauccagccauguucucacuuugguuua

SEQ ID NO: 197462 - RNA, 32 nt, Human
gggccauccucuuucugcuccucgacacacgc

SEQ ID NO: 197463 - RNA, 32 nt, Human
gggccaucguggguucccugagcccagccagc

SEQ ID NO: 197464 - RNA, 21 nt, Human
gggccaucuggaccaaaggug

SEQ ID NO: 197465 - RNA, 23 nt, Human
gggccaucugggccauucagaga

SEQ ID NO: 197466 - RNA, 31 nt, Human
gggccaugacucucugggaccuugccacagc

SEQ ID NO: 197467 - RNA, 32 nt, Human
gggccaugacucucugggaccuugccacagcc

SEQ ID NO: 197468 - RNA, 18 nt, Human
gggccaugagcccugcca

SEQ ID NO: 197469 - RNA, 32 nt, Human
gggccaugcagcaggcaggccauggccugcuc

SEQ ID NO: 197470 - RNA, 32 nt, Human
gggccaugcccagccagguuggcuucccuggg

SEQ ID NO: 197471 - RNA, 23 nt, Human
gggccaugcccguuguccuauug

SEQ ID NO: 197472 - RNA, 32 nt, Human
gggccaugcccugaguguuuucuucacauggc

SEQ ID NO: 197473 - RNA, 32 nt, Human
gggccaugcuuuccuuuucuuccuucuuucuc

SEQ ID NO: 197474 - RNA, 32 nt, Human
gggccauggcagggaggggagccuucuggaag

SEQ ID NO: 197475 - RNA, 32 nt, Human
gggccauggccaaggcccugccacgcacgccc

SEQ ID NO: 197476 - RNA, 20 nt, Human
gggccauggcugggcuccca

SEQ ID NO: 197477 - RNA, 32 nt, Human
gggccaugggccgaggccuggcauucacguuc

SEQ ID NO: 197478 - RNA, 32 nt, Human
gggccaugggguggugcuucccuggaccagaa

SEQ ID NO: 197479 - RNA, 30 nt, Human
gggccaugggugucaucuccuaccucagcc

SEQ ID NO: 197480 - RNA, 21 nt, Human
gggccaugguggagggcacuu

SEQ ID NO: 197481 - RNA, 32 nt, Human
gggccauguggccagggaacccuucaugaaac

SEQ ID NO: 197482 - RNA, 32 nt, Human
gggccauuagauuuggaggcuaccucaccugg

SEQ ID NO: 197483 - RNA, 32 nt, Human
gggccauucaucuacaaccaaguccugaugga

SEQ ID NO: 197484 - RNA, 32 nt, Human
gggccauucauuucuauaggcaaagaaagcuc

SEQ ID NO: 197485 - RNA, 32 nt, Human
gggccauucccugggacucucacuccugcacu

SEQ ID NO: 197486 - RNA, 32 nt, Human
gggccauucuccuuagcuucuggcuuucaacu

SEQ ID NO: 197487 - RNA, 19 nt, Human
gggccauuggacucaggua

SEQ ID NO: 197488 - RNA, 32 nt, Human
gggccauuggggagcacagggccaggcugggg

SEQ ID NO: 197489 - RNA, 32 nt, Human
gggcccaaaugagagaaugguacuuagggaug

SEQ ID NO: 197490 - RNA, 32 nt, Human
gggcccaacgcgcaugcugggcgcccggguga

SEQ ID NO: 197491 - RNA, 32 nt, Human
gggcccaacucccaccugccugggcgaaucuc

SEQ ID NO: 197492 - RNA, 32 nt, Human
gggcccaagagcugcacucacacuccuacaac

SEQ ID NO: 197493 - RNA, 32 nt, Human
gggcccaagaguucgagaccagccugggcaac

SEQ ID NO: 197494 - RNA, 24 nt, Human
gggcccaagcagguguggggccuc

SEQ ID NO: 197495 - RNA, 23 nt, Human
gggcccaagcgauccuccugccu

SEQ ID NO: 197496 - RNA, 32 nt, Human
gggcccaaggagccaugagucuuaggcuugac

SEQ ID NO: 197497 - RNA, 32 nt, Human
gggcccaauuccuggccuuggagcucaaaucu

SEQ ID NO: 197498 - RNA, 32 nt, Human
gggcccacaaagucaaggcugcagugagcugu

SEQ ID NO: 197499 - RNA, 32 nt, Human
gggcccacacaguuaaccagcccauuucucca

SEQ ID NO: 197500 - RNA, 19 nt, Human
gggcccacacccccuuccu

SEQ ID NO: 197501 - RNA, 32 nt, Human
gggcccacacuuagaaggaccccacacuuggu

SEQ ID NO: 197502 - RNA, 21 nt, Human
gggcccacagcccccacccca

SEQ ID NO: 197503 - RNA, 32 nt, Human
gggcccacagccgccgcgccggccggcggggc

SEQ ID NO: 197504 - RNA, 32 nt, Human
gggcccacagccgcuccgccucccggcccgca

SEQ ID NO: 197505 - RNA, 32 nt, Human
gggcccacaugcugacacagacucacucagag

SEQ ID NO: 197506 - RNA, 32 nt, Human
gggcccaccaugucgggguaugguuguaggcc

SEQ ID NO: 197507 - RNA, 32 nt, Human
gggcccaccgccucccaccacaccugccaccu

SEQ ID NO: 197508 - RNA, 18 nt, Human
gggcccaccuccaaggga

SEQ ID NO: 197509 - RNA, 32 nt, Human
gggcccagaaagggguuuccagcugggggcac

SEQ ID NO: 197510 - RNA, 32 nt, Human
gggcccagaacagucccaccugugcugcuaug

SEQ ID NO: 197511 - RNA, 32 nt, Human
gggcccagaacugccuuccauucaauggggaa

SEQ ID NO: 197512 - RNA, 32 nt, Human
gggcccagaauggccccacucuguucccaagc

SEQ ID NO: 197513 - RNA, 32 nt, Human
gggcccagacccaagaggagagggugguccgc

SEQ ID NO: 197514 - RNA, 32 nt, Human
gggcccagaccuacacuuggagcccaggucca

SEQ ID NO: 197515 - RNA, 32 nt, Human
gggcccagacuggcccacguccccaugccugg

SEQ ID NO: 197516 - RNA, 32 nt, Human
gggcccagagagagccgcggccgggagcucgc

SEQ ID NO: 197517 - RNA, 32 nt, Human
gggcccagagagagcuguccgccagugcauca

SEQ ID NO: 197518 - RNA, 22 nt, Human
gggcccagagaggcugggucuc

SEQ ID NO: 197519 - RNA, 19 nt, Human
gggcccagagccagcucag

SEQ ID NO: 197520 - RNA, 18 nt, Human
gggcccagaggcugggcc

SEQ ID NO: 197521 - RNA, 32 nt, Human
gggcccagagucagagggcagccccuggcuca

SEQ ID NO: 197522 - RNA, 32 nt, Human
gggcccagaguuucucccugagucgcuguugc

SEQ ID NO: 197523 - RNA, 32 nt, Human
gggcccagcaccaaggugaugggacucuccuc

SEQ ID NO: 197524 - RNA, 19 nt, Human
gggcccagcaccagcucag

SEQ ID NO: 197525 - RNA, 32 nt, Human
gggcccagcacuagaggaagacaaggaucccg

SEQ ID NO: 197526 - RNA, 32 nt, Human
gggcccagcacuccccgcucuggacuagcagu

SEQ ID NO: 197527 - RNA, 32 nt, Human
gggcccagcaggcggggguuugagcccuggac

SEQ ID NO: 197528 - RNA, 18 nt, Human
gggcccagcagggggcag

SEQ ID NO: 197529 - RNA, 32 nt, Human
gggcccagccacugcacuucaccggaugccgu

SEQ ID NO: 197530 - RNA, 32 nt, Human
gggcccagcccgaggaggcacucaggguuagg

SEQ ID NO: 197531 - RNA, 32 nt, Human
gggcccagcccgcccggggcaggaugaccaag

SEQ ID NO: 197532 - RNA, 19 nt, Human
gggcccagcccugccucag

SEQ ID NO: 197533 - RNA, 32 nt, Human
gggcccagccuccgcucccgcucucugucggu

SEQ ID NO: 197534 - RNA, 32 nt, Human
gggcccagcgcagugccucaugccuguaaucc

SEQ ID NO: 197535 - RNA, 32 nt, Human
gggcccaggaacagccugaggccaccacccag

SEQ ID NO: 197536 - RNA, 32 nt, Human
gggcccaggaacugagacuagggcuuucucau

SEQ ID NO: 197537 - RNA, 32 nt, Human
gggcccaggaacugucaucagagcagaaauca

SEQ ID NO: 197538 - RNA, 32 nt, Human
gggcccaggagagagaagcagggagggagaga

SEQ ID NO: 197539 - RNA, 32 nt, Human
gggcccaggagauggagguugcggugaguggg

SEQ ID NO: 197540 - RNA, 32 nt, Human
gggcccaggagauugagaccagccugggcaac

SEQ ID NO: 197541 - RNA, 17 nt, Human
gggcccaggagccggcu

SEQ ID NO: 197542 - RNA, 32 nt, Human
gggcccaggaggcagcuggguugcauggagag

SEQ ID NO: 197543 - RNA, 32 nt, Human
gggcccaggaggucaagccugcagcgagcuga

SEQ ID NO: 197544 - RNA, 32 nt, Human
gggcccaggaggucaaggcuucagugagccau

SEQ ID NO: 197545 - RNA, 32 nt, Human
gggcccaggaggucgaggcugcggugagccau

SEQ ID NO: 197546 - RNA, 32 nt, Human
gggcccaggagguggagguugcagugagccga

SEQ ID NO: 197547 - RNA, 32 nt, Human
gggcccaggaguucaacgcugcagugagcuau

SEQ ID NO: 197548 - RNA, 32 nt, Human
gggcccaggaguucaaggccagccugggcaac

SEQ ID NO: 197549 - RNA, 32 nt, Human
gggcccaggaguucaaggcugcagugagcuau

SEQ ID NO: 197550 - RNA, 32 nt, Human
gggcccaggaguuugaggcugcagugagccau

SEQ ID NO: 197551 - RNA, 32 nt, Human
gggcccaggauuccgggaagcuggagauucca

SEQ ID NO: 197552 - RNA, 32 nt, Human
gggcccaggcagcacagaggagcugugaaccc

SEQ ID NO: 197553 - RNA, 32 nt, Human
gggcccaggccccugcccagcugcagucuccc

SEQ ID NO: 197554 - RNA, 32 nt, Human
gggcccaggccuggcccuccacacuucauucu

SEQ ID NO: 197555 - RNA, 32 nt, Human
gggcccaggccugggccagaagcuguugacca

SEQ ID NO: 197556 - RNA, 32 nt, Human
gggcccaggcuagagugcaguggcgugagcuc

SEQ ID NO: 197557 - RNA, 20 nt, Human
gggcccaggcuuggggacuc

SEQ ID NO: 197558 - RNA, 22 nt, Human
gggcccagggagcccccagagg

SEQ ID NO: 197559 - RNA, 32 nt, Human
gggcccagggaggauggggagggaguggccca

SEQ ID NO: 197560 - RNA, 21 nt, Human
gggcccagggccacccagagg

SEQ ID NO: 197561 - RNA, 20 nt, Human
gggcccagggcucugggccu

SEQ ID NO: 197562 - RNA, 32 nt, Human
gggcccagguccaaaucacagagcuggggcga

SEQ ID NO: 197563 - RNA, 17 nt, Human
gggcccaggucugggcc

SEQ ID NO: 197564 - RNA, 21 nt, Human
gggcccaggugggcgggcuuc

SEQ ID NO: 197565 - RNA, 20 nt, Human
gggcccaggugugcugggcc

SEQ ID NO: 197566 - RNA, 32 nt, Human
gggcccagguguugaaccccuacccagacgcc

SEQ ID NO: 197567 - RNA, 32 nt, Human
gggcccaguagaaauggucuuguaauaugcua

SEQ ID NO: 197568 - RNA, 19 nt, Human
gggcccagucuucuguggg

SEQ ID NO: 197569 - RNA, 23 nt, Human
gggcccaguguuuugccacucag

SEQ ID NO: 197570 - RNA, 21 nt, Human
gggcccaguucagggggguug

SEQ ID NO: 197571 - RNA, 32 nt, Human
gggcccauaaacaacaggagccuuuuguuccg

SEQ ID NO: 197572 - RNA, 32 nt, Human
gggcccaucccccuguccacccaguguccacu

SEQ ID NO: 197573 - RNA, 32 nt, Human
gggcccaucucagggcugcacuggccccuagu

SEQ ID NO: 197574 - RNA, 32 nt, Human
gggcccaucuuacauccucucucuccaaguuu

SEQ ID NO: 197575 - RNA, 32 nt, Human
gggcccaugacuuggcauuagcauguuccaaa

SEQ ID NO: 197576 - RNA, 32 nt, Human
gggcccaugagguuguggcuggcuuaggcagc

SEQ ID NO: 197577 - RNA, 32 nt, Human
gggcccaugccccaaggagcccuucagagccc

SEQ ID NO: 197578 - RNA, 32 nt, Human
gggcccaugucugacccuggggacucucaacu

SEQ ID NO: 197579 - RNA, 31 nt, Human
gggcccauguggcccaucacacagaagauuc

SEQ ID NO: 197580 - RNA, 32 nt, Human
gggcccaugugguugggcucuuccuccuccag

SEQ ID NO: 197581 - RNA, 21 nt, Human
gggcccauucaggacacaggg

SEQ ID NO: 197582 - RNA, 32 nt, Human
gggccccaaagcucugaggccuaggagacugc

SEQ ID NO: 197583 - RNA, 32 nt, Human
gggccccaacuuguauuucuagcagcagaucu

SEQ ID NO: 197584 - RNA, 31 nt, Human
gggccccaagugucugacucgcaaaggcccu

SEQ ID NO: 197585 - RNA, 32 nt, Human
gggccccacaaacaccacaaacaccuuuucca

SEQ ID NO: 197586 - RNA, 32 nt, Human
gggccccacagcuucagacugaggaucuaggg

SEQ ID NO: 197587 - RNA, 32 nt, Human
gggccccacuggaggggcaggcugcguggagg

SEQ ID NO: 197588 - RNA, 32 nt, Human
gggccccacuucugagcacagagcagagacag

SEQ ID NO: 197589 - RNA, 19 nt, Human
gggccccagagccccgcac

SEQ ID NO: 197590 - RNA, 32 nt, Human
gggccccagaguccuggaagugcacugugcag

SEQ ID NO: 197591 - RNA, 21 nt, Human
gggccccagcagagcaggcag

SEQ ID NO: 197592 - RNA, 18 nt, Human
gggccccagcagcuucga

SEQ ID NO: 197593 - RNA, 21 nt, Human
gggccccagcaggcccagcca

SEQ ID NO: 197594 - RNA, 20 nt, Human
gggccccagcaguucuggac

SEQ ID NO: 197595 - RNA, 32 nt, Human
gggccccagccacgugucucaggggcucccac

SEQ ID NO: 197596 - RNA, 22 nt, Human
gggccccagcccaggucugcac

SEQ ID NO: 197597 - RNA, 23 nt, Human
gggccccagcccaggucugcacu

SEQ ID NO: 197598 - RNA, 32 nt, Human
gggccccagcccuccugcuccuuagggccugg

SEQ ID NO: 197599 - RNA, 32 nt, Human
gggccccagccucuccccuccucuuggccucc

SEQ ID NO: 197600 - RNA, 22 nt, Human
gggccccagcggugggagugca

SEQ ID NO: 197601 - RNA, 32 nt, Human
gggccccagcuggccagccuggcgauggggaa

SEQ ID NO: 197602 - RNA, 23 nt, Human
gggccccagcugggccugccccu

SEQ ID NO: 197603 - RNA, 32 nt, Human
gggccccaggaggcaggggagcccagcugucg

SEQ ID NO: 197604 - RNA, 32 nt, Human
gggccccaggaggcgagucugaguggaaccug

SEQ ID NO: 197605 - RNA, 32 nt, Human
gggccccaggaggcugggggagaagugcacgc

SEQ ID NO: 197606 - RNA, 32 nt, Human
gggccccaggcagggcaggaggugguggaaac

SEQ ID NO: 197607 - RNA, 32 nt, Human
gggccccagggaacuaaagggugugggucagg

SEQ ID NO: 197608 - RNA, 32 nt, Human
gggccccaggugggagacccaacagugggugc

SEQ ID NO: 197609 - RNA, 32 nt, Human
gggccccagugaacuccauaucagguauauac

SEQ ID NO: 197610 - RNA, 32 nt, Human
gggccccaguguccugguaauuuauaggacug

SEQ ID NO: 197611 - RNA, 22 nt, Human
gggccccauccccccagcuggg

SEQ ID NO: 197612 - RNA, 32 nt, Human
gggccccauccugggcagaggggccuggggcu

SEQ ID NO: 197613 - RNA, 32 nt, Human
gggccccaugcuaggcuugccugggugugaga

SEQ ID NO: 197614 - RNA, 32 nt, Human
gggccccauggcagcuccugaccuuggguccu

SEQ ID NO: 197615 - RNA, 21 nt, Human
gggccccauuccagaccaguu

SEQ ID NO: 197616 - RNA, 24 nt, Human
gggcccccaaacugucacagaaag

SEQ ID NO: 197617 - RNA, 32 nt, Human
gggcccccaaguuuugagagaacugggcuuuc

SEQ ID NO: 197618 - RNA, 21 nt, Human
gggcccccaccauucacuuuu

SEQ ID NO: 197619 - RNA, 32 nt, Human
gggcccccagccugugccuugcugccacagua

SEQ ID NO: 197620 - RNA, 19 nt, Human
gggcccccaggcucaagca

SEQ ID NO: 197621 - RNA, 18 nt, Human
gggcccccauguccagcu

SEQ ID NO: 197622 - RNA, 24 nt, Human
gggccccccacuuccccccaaggg

SEQ ID NO: 197623 - RNA, 18 nt, Human
gggcccccgccccccagc

SEQ ID NO: 197624 - RNA, 19 nt, Human
gggcccccgccggcgcgcu

SEQ ID NO: 197625 - RNA, 32 nt, Human
gggcccccguagucccagcuacucaggaggcu

SEQ ID NO: 197626 - RNA, 21 nt, Human
gggcccccuaaccccacccca

SEQ ID NO: 197627 - RNA, 32 nt, Human
gggcccccuaacccucuuguggcuccaguuau

SEQ ID NO: 197628 - RNA, 21 nt, Human
gggcccccucacgccugccuu

SEQ ID NO: 197629 - RNA, 32 nt, Human
gggcccccuccccacauggcccucgcucuguc

SEQ ID NO: 197630 - RNA, 32 nt, Human
gggcccccuccuggcucaaaaauggcugcaac

SEQ ID NO: 197631 - RNA, 32 nt, Human
gggcccccuccugugaccucaggguuuggccc

SEQ ID NO: 197632 - RNA, 32 nt, Human
gggcccccugcacugccugguccagaaggggu

SEQ ID NO: 197633 - RNA, 22 nt, Human
gggccccgagcaggcccagacc

SEQ ID NO: 197634 - RNA, 24 nt, Human
gggccccggagccgcgcugccucu

SEQ ID NO: 197635 - RNA, 32 nt, Human
gggccccggagguagagguugcagugagcuga

SEQ ID NO: 197636 - RNA, 32 nt, Human
gggccccggccugucuaugauccugccuccac

SEQ ID NO: 197637 - RNA, 32 nt, Human
gggccccgggacagaguuuucccagaccuggc

SEQ ID NO: 197638 - RNA, 24 nt, Human
gggccccgggacccugccugccuc

SEQ ID NO: 197639 - RNA, 32 nt, Human
gggccccggggcaggcucucucuccccagcag

SEQ ID NO: 197640 - RNA, 18 nt, Human
gggccccgggucugggcc

SEQ ID NO: 197641 - RNA, 32 nt, Human
gggccccguccaggcagccucaguccaggcuc

SEQ ID NO: 197642 - RNA, 32 nt, Human
gggccccguggaacuccagccugcgccaccac

SEQ ID NO: 197643 - RNA, 32 nt, Human
gggccccgugguuccuggagaaagcaggacgc

SEQ ID NO: 197644 - RNA, 32 nt, Human
gggccccguguccacaggaggccaccucggug

SEQ ID NO: 197645 - RNA, 32 nt, Human
gggccccucaggcagagauggaccaggcggug

SEQ ID NO: 197646 - RNA, 32 nt, Human
gggccccucccaggagcucuuggcuguugcug

SEQ ID NO: 197647 - RNA, 21 nt, Human
gggccccucccaggcucagca

SEQ ID NO: 197648 - RNA, 16 nt, Human
gggccccucgcuccca

SEQ ID NO: 197649 - RNA, 32 nt, Human
gggccccucucacccacaacuggaccaggucc

SEQ ID NO: 197650 - RNA, 32 nt, Human
gggccccucucuguccugccucuuuucaccug

SEQ ID NO: 197651 - RNA, 32 nt, Human
gggccccugcagccacccaacgucaccuccag

SEQ ID NO: 197652 - RNA, 32 nt, Human
gggccccugcagccggacaccagcuccagggu

SEQ ID NO: 197653 - RNA, 19 nt, Human
gggccccugccaucgggcu

SEQ ID NO: 197654 - RNA, 32 nt, Human
gggccccugccccucaccuucuccuucuugau

SEQ ID NO: 197655 - RNA, 32 nt, Human
gggccccuggacacagggagcagacccucugc

SEQ ID NO: 197656 - RNA, 32 nt, Human
gggccccuggagucccagcuacucgggaggcu

SEQ ID NO: 197657 - RNA, 32 nt, Human
gggccccuggccccgccugccugccacccugc

SEQ ID NO: 197658 - RNA, 32 nt, Human
gggccccugggaaugacuccuggaccuccacc

SEQ ID NO: 197659 - RNA, 28 nt, Human
gggccccugggagcagcccccaggcggg

SEQ ID NO: 197660 - RNA, 32 nt, Human
gggccccugggcaguggguuuugggcaaauuc

SEQ ID NO: 197661 - RNA, 32 nt, Human
gggccccuggggaggagggagggugggcggua

SEQ ID NO: 197662 - RNA, 32 nt, Human
gggccccugggggaucugagggccuguggccc

SEQ ID NO: 197663 - RNA, 32 nt, Human
gggccccuguaaucccagcuacucgggaggcu

SEQ ID NO: 197664 - RNA, 32 nt, Human
gggccccuguaaucccagcuacucgggagguu

SEQ ID NO: 197665 - RNA, 32 nt, Human
gggccccuguaaucccagcuacuugggaggcu

SEQ ID NO: 197666 - RNA, 32 nt, Human
gggccccuguagucccagcuacucaggaggcu

SEQ ID NO: 197667 - RNA, 32 nt, Human
gggccccuguagucccagcuacucgggaggcu

SEQ ID NO: 197668 - RNA, 32 nt, Human
gggccccuguccuccagccugaccagcccugg

SEQ ID NO: 197669 - RNA, 32 nt, Human
gggccccugugaccccuccuuucuuccuccaa

SEQ ID NO: 197670 - RNA, 21 nt, Human
gggccccuguggcccccacgg

SEQ ID NO: 197671 - RNA, 32 nt, Human
gggccccuguucucccccuuagagcuccaucc

SEQ ID NO: 197672 - RNA, 32 nt, Human
gggccccuuacacuccacagucccggucccgc

SEQ ID NO: 197673 - RNA, 32 nt, Human
gggccccuuccagccgugggcaaacccugaag

SEQ ID NO: 197674 - RNA, 21 nt, Human
gggccccuugcucuccagcaa

SEQ ID NO: 197675 - RNA, 20 nt, Human
gggccccuuucgccugcuuc

SEQ ID NO: 197676 - RNA, 23 nt, Human
gggccccuuucuuucuucugagg

SEQ ID NO: 197677 - RNA, 32 nt, Human
gggccccuuugcugcacgugacaugcaauuca

SEQ ID NO: 197678 - RNA, 32 nt, Human
gggcccgaacaugcacacgugcagccuauaug

SEQ ID NO: 197679 - RNA, 21 nt, Human
gggcccgaccccccugggccu

SEQ ID NO: 197680 - RNA, 23 nt, Human
gggcccgagagcagguccacacc

SEQ ID NO: 197681 - RNA, 24 nt, Human
gggcccgagcuacaggucugcucc

SEQ ID NO: 197682 - RNA, 32 nt, Human
gggcccgaggaccagggaagacccccuuuccu

SEQ ID NO: 197683 - RNA, 32 nt, Human
gggcccgcagccgccucccacgccaggcuguc

SEQ ID NO: 197684 - RNA, 32 nt, Human
gggcccgccagccaucagccaggguuggccua

SEQ ID NO: 197685 - RNA, 32 nt, Human
gggcccgccucagcuccuggcagaagcugucg

SEQ ID NO: 197686 - RNA, 24 nt, Human
gggcccgccuggcagaacugagcu

SEQ ID NO: 197687 - RNA, 32 nt, Human
gggcccgcguggugccuccugaggcggccccc

SEQ ID NO: 197688 - RNA, 32 nt, Human
gggcccgcugccuccaguuggggcacccacau

SEQ ID NO: 197689 - RNA, 32 nt, Human
gggcccgcugcucuccaugcgggagccggcgc

SEQ ID NO: 197690 - RNA, 32 nt, Human
gggcccggaaugcggcucucugacccucucug

SEQ ID NO: 197691 - RNA, 20 nt, Human
gggcccggacacuugggacc

SEQ ID NO: 197692 - RNA, 18 nt, Human
gggcccggacaugggguc

SEQ ID NO: 197693 - RNA, 21 nt, Human
gggcccggaccagcccccagc

SEQ ID NO: 197694 - RNA, 19 nt, Human
gggcccggagcccggagcc

SEQ ID NO: 197695 - RNA, 21 nt, Human
gggcccggagccuccagcagg

SEQ ID NO: 197696 - RNA, 18 nt, Human
gggcccggaggcugagcc

SEQ ID NO: 197697 - RNA, 21 nt, Human
gggcccggaggucaagauggu

SEQ ID NO: 197698 - RNA, 20 nt, Human
gggcccggcaccuccugcug

SEQ ID NO: 197699 - RNA, 19 nt, Human
gggcccggcagggaggcag

SEQ ID NO: 197700 - RNA, 22 nt, Human
gggcccggcauugccugaggcc

SEQ ID NO: 197701 - RNA, 19 nt, Human
gggcccggccagcagaggg

SEQ ID NO: 197702 - RNA, 21 nt, Human
gggcccggccucccugcggcc

SEQ ID NO: 197703 - RNA, 32 nt, Human
gggcccggcgcagaggauugaggaggagggau

SEQ ID NO: 197704 - RNA, 21 nt, Human
gggcccggcgccccccgggcc

SEQ ID NO: 197705 - RNA, 20 nt, Human
gggcccggcgugcugggccu

SEQ ID NO: 197706 - RNA, 20 nt, Human
gggcccggcuccccgggccu

SEQ ID NO: 197707 - RNA, 20 nt, Human
gggcccggcuccggcggcag

SEQ ID NO: 197708 - RNA, 32 nt, Human
gggcccggcucugcauggccccggcugcugac

SEQ ID NO: 197709 - RNA, 22 nt, Human
gggcccggcucuggggccccca

SEQ ID NO: 197710 - RNA, 21 nt, Human
gggcccggcugacugcgccuc

SEQ ID NO: 197711 - RNA, 32 nt, Human
gggcccggcugggggagggcagcucugggcac

SEQ ID NO: 197712 - RNA, 32 nt, Human
gggcccggcuuuucaggcuugcccucaccagc

SEQ ID NO: 197713 - RNA, 19 nt, Human
gggcccgggaagcgcggug

SEQ ID NO: 197714 - RNA, 19 nt, Human
gggcccgggaggcagaccu

SEQ ID NO: 197715 - RNA, 32 nt, Human
gggcccgggaggcagaccugcccuaaggguga

SEQ ID NO: 197716 - RNA, 32 nt, Human
gggcccgggaggcagagguugcagugagccga

SEQ ID NO: 197717 - RNA, 32 nt, Human
gggcccgggaggucaagguugcagugagcugu

SEQ ID NO: 197718 - RNA, 32 nt, Human
gggcccgggagguggagguugcagugagcuga

SEQ ID NO: 197719 - RNA, 32 nt, Human
gggcccgggagguggagguugcagugagucaa

SEQ ID NO: 197720 - RNA, 32 nt, Human
gggcccgggaguuugaaguugcagugagcuau

SEQ ID NO: 197721 - RNA, 23 nt, Human
gggcccgggcacaccugcacucu

SEQ ID NO: 197722 - RNA, 21 nt, Human
gggcccgggcaggccagcuuc

SEQ ID NO: 197723 - RNA, 20 nt, Human
gggcccgggccaccgggccc

SEQ ID NO: 197724 - RNA, 23 nt, Human
gggcccgggcccaccuuggacuc

SEQ ID NO: 197725 - RNA, 21 nt, Human
gggcccgggcccaggcgccuc

SEQ ID NO: 197726 - RNA, 24 nt, Human
gggcccgggcccgggggaucccag

SEQ ID NO: 197727 - RNA, 21 nt, Human
gggcccgggccggacagccuc

SEQ ID NO: 197728 - RNA, 18 nt, Human
gggcccgggcggggagcc

SEQ ID NO: 197729 - RNA, 18 nt, Human
gggcccgggcucuggacc

SEQ ID NO: 197730 - RNA, 19 nt, Human
gggcccgggcucuggaccu

SEQ ID NO: 197731 - RNA, 18 nt, Human
gggcccgggcugcgggcc

SEQ ID NO: 197732 - RNA, 21 nt, Human
gggcccgggcugggaccagcc

SEQ ID NO: 197733 - RNA, 32 nt, Human
gggcccggggagacaguuguguggugugugca

SEQ ID NO: 197734 - RNA, 19 nt, Human
gggcccggggccacgggcu

SEQ ID NO: 197735 - RNA, 19 nt, Human
gggcccggggcgccugccu

SEQ ID NO: 197736 - RNA, 20 nt, Human
gggcccgggggccugagccu

SEQ ID NO: 197737 - RNA, 17 nt, Human
gggcccgggggcgggaa

SEQ ID NO: 197738 - RNA, 20 nt, Human
gggcccgggguccacagagg

SEQ ID NO: 197739 - RNA, 32 nt, Human
gggcccgggucugagagaggggagacagccug

SEQ ID NO: 197740 - RNA, 19 nt, Human
gggcccgggugccggggcc

SEQ ID NO: 197741 - RNA, 21 nt, Human
gggcccggguugguggcccuc

SEQ ID NO: 197742 - RNA, 19 nt, Human
gggcccgguagcugggccc

SEQ ID NO: 197743 - RNA, 32 nt, Human
gggcccggugccuguagcaaacaccaccaagu

SEQ ID NO: 197744 - RNA, 32 nt, Human
gggcccguccuccucagcacucaggccaaccc

SEQ ID NO: 197745 - RNA, 32 nt, Human
gggcccgucuuccucgcgucuccucggggagc

SEQ ID NO: 197746 - RNA, 20 nt, Human
gggcccgugggaugggccuc

SEQ ID NO: 197747 - RNA, 32 nt, Human
gggcccguugucucccuggcccucaaggcucc

SEQ ID NO: 197748 - RNA, 32 nt, Human
gggcccuaagaguucgucucucaccugggggc

SEQ ID NO: 197749 - RNA, 32 nt, Human
gggcccuacagccucacuuccccagccucacc

SEQ ID NO: 197750 - RNA, 21 nt, Human
gggcccuagaggagcugcacc

SEQ ID NO: 197751 - RNA, 32 nt, Human
gggcccuaggcaggaagcuggcuucugggaga

SEQ ID NO: 197752 - RNA, 32 nt, Human
gggcccuagugccucuguuccugaauuacaua

SEQ ID NO: 197753 - RNA, 32 nt, Human
gggcccucaaagcucauuuuaucuaauuguga

SEQ ID NO: 197754 - RNA, 20 nt, Human
gggcccucaauguccacaaa

SEQ ID NO: 197755 - RNA, 32 nt, Human
gggcccucacggagaggaagggaaggaaggag

SEQ ID NO: 197756 - RNA, 32 nt, Human
gggcccucacuggccugucccugcugcagcgc

SEQ ID NO: 197757 - RNA, 21 nt, Human
gggcccucagaggaaaggcag

SEQ ID NO: 197758 - RNA, 32 nt, Human
gggcccucagggccaucucccgaggcccgguu

SEQ ID NO: 197759 - RNA, 31 nt, Human
gggcccucaguaaauaccuggaggaauguga

SEQ ID NO: 197760 - RNA, 20 nt, Human
gggcccuccagagccugcag

SEQ ID NO: 197761 - RNA, 32 nt, Human
gggcccuccccagcuacucgggaggcugaggc

SEQ ID NO: 197762 - RNA, 32 nt, Human
gggcccuccgcucuccccuccgcuccccuccc

SEQ ID NO: 197763 - RNA, 22 nt, Human
gggcccuccuccccuccuugca

SEQ ID NO: 197764 - RNA, 22 nt, Human
gggcccuccucuccuccucaca

SEQ ID NO: 197765 - RNA, 32 nt, Human
gggcccuccugcacuccacaugaugaggucag

SEQ ID NO: 197766 - RNA, 32 nt, Human
gggcccuccugccugcaggaucaugcccacca

SEQ ID NO: 197767 - RNA, 18 nt, Human
gggcccucggcccugaug

SEQ ID NO: 197768 - RNA, 32 nt, Human
gggcccucuaccaagaaccauggcagucaggg

SEQ ID NO: 197769 - RNA, 32 nt, Human
gggcccucuccucugcugacucugccguuucu

SEQ ID NO: 197770 - RNA, 22 nt, Human
gggcccucugcagaccaggcug

SEQ ID NO: 197771 - RNA, 32 nt, Human
gggcccucugcagaccaggcugagauggagga

SEQ ID NO: 197772 - RNA, 32 nt, Human
gggcccucugcagcccagccuuuccuuccguc

SEQ ID NO: 197773 - RNA, 32 nt, Human
gggcccucugcagcccauccuuuccuuccguc

SEQ ID NO: 197774 - RNA, 19 nt, Human
gggcccucugcguccagcu

SEQ ID NO: 197775 - RNA, 32 nt, Human
gggcccucuucuacucuccauuuaggccuguu

SEQ ID NO: 197776 - RNA, 32 nt, Human
gggcccugaacccauuuuccuccccuguccca

SEQ ID NO: 197777 - RNA, 20 nt, Human
gggcccugaaggcucaggca

SEQ ID NO: 197778 - RNA, 32 nt, Human
gggcccugaauacuucucugaccuccuuucua

SEQ ID NO: 197779 - RNA, 32 nt, Human
gggcccugaccaucuucuccucccagggccac

SEQ ID NO: 197780 - RNA, 32 nt, Human
gggcccugaggaccccagggcagcacuggaaa

SEQ ID NO: 197781 - RNA, 32 nt, Human
gggcccugaggaugcacggugccuggggcucc

SEQ ID NO: 197782 - RNA, 32 nt, Human
gggcccugcaccuggccagcggugccgcgugg

SEQ ID NO: 197783 - RNA, 32 nt, Human
gggcccugcagcccagccuguguuguaaccuc

SEQ ID NO: 197784 - RNA, 32 nt, Human
gggcccugcaggcaggucuguggguucuggca

SEQ ID NO: 197785 - RNA, 32 nt, Human
gggcccugcagggggccauggagaagcugcag

SEQ ID NO: 197786 - RNA, 22 nt, Human
gggcccugcccauggccucaau

SEQ ID NO: 197787 - RNA, 32 nt, Human
gggcccugccgacccccugccugcgcccccag

SEQ ID NO: 197788 - RNA, 32 nt, Human
gggcccugccuccccguuacccuccuucccug

SEQ ID NO: 197789 - RNA, 30 nt, Human
gggcccugccucuccaugccuguaggagcu

SEQ ID NO: 197790 - RNA, 31 nt, Human
gggcccugccucugccuguucuucuggaaug

SEQ ID NO: 197791 - RNA, 20 nt, Human
gggcccugccucuuccugag

SEQ ID NO: 197792 - RNA, 32 nt, Human
gggcccugcugccucugcuccuugccauugga

SEQ ID NO: 197793 - RNA, 32 nt, Human
gggcccugcuggcagggacuugcaguggauuc

SEQ ID NO: 197794 - RNA, 22 nt, Human
gggcccugcuuugcaggggggc

SEQ ID NO: 197795 - RNA, 32 nt, Human
gggcccugcuuuuuguggcaaggccuguucug

SEQ ID NO: 197796 - RNA, 32 nt, Human
gggcccuggaauccaagaaaccuuuuuggcgc

SEQ ID NO: 197797 - RNA, 22 nt, Human
gggcccuggacguggcggcaga

SEQ ID NO: 197798 - RNA, 23 nt, Human
gggcccuggacguugagcccaga

SEQ ID NO: 197799 - RNA, 18 nt, Human
gggcccuggagggcgcgg

SEQ ID NO: 197800 - RNA, 32 nt, Human
gggcccuggaggucaaggcugcagugagucaa

SEQ ID NO: 197801 - RNA, 32 nt, Human
gggcccuggccuggcccgggugcaggcugcau

SEQ ID NO: 197802 - RNA, 32 nt, Human
gggcccugggaccccugcuccagcccgaauga

SEQ ID NO: 197803 - RNA, 32 nt, Human
gggcccugggaggaguguuugcacuguggaaa

SEQ ID NO: 197804 - RNA, 32 nt, Human
gggcccugggcccuggcagcgccgcauccgug

SEQ ID NO: 197805 - RNA, 32 nt, Human
gggcccugggcuggugccuccccucccuagag

SEQ ID NO: 197806 - RNA, 32 nt, Human
gggcccuggggacacugucaccagagacccca

SEQ ID NO: 197807 - RNA, 32 nt, Human
gggcccuggggcccuggcuggcaggaguuggc

SEQ ID NO: 197808 - RNA, 19 nt, Human
gggcccuggggccugggcc

SEQ ID NO: 197809 - RNA, 32 nt, Human
gggcccuggggugggguaggcagaugggccaa

SEQ ID NO: 197810 - RNA, 32 nt, Human
gggcccugguacugaagacgcgguccgggucg

SEQ ID NO: 197811 - RNA, 32 nt, Human
gggcccuguccuggcccaggccucugcccucu

SEQ ID NO: 197812 - RNA, 32 nt, Human
gggcccugucugcaauacaccugcaggaagag

SEQ ID NO: 197813 - RNA, 32 nt, Human
gggcccuguggcucuggcagccccaggccaug

SEQ ID NO: 197814 - RNA, 23 nt, Human
gggcccuuaccuaauccccaccc

SEQ ID NO: 197815 - RNA, 26 nt, Human
gggcccuuagggaggaggaggcgaga

SEQ ID NO: 197816 - RNA, 32 nt, Human
gggcccuucccugggucucugcacugacuccc

SEQ ID NO: 197817 - RNA, 32 nt, Human
gggcccuuccuggcuaggacuguggaggggag

SEQ ID NO: 197818 - RNA, 32 nt, Human
gggcccuuggucuggcucuccugggccuccag

SEQ ID NO: 197819 - RNA, 32 nt, Human
gggcccuugguuguggugcgaggcggcugccc

SEQ ID NO: 197820 - RNA, 32 nt, Human
gggcccuugguuuauuucacuccaguccugaa

SEQ ID NO: 197821 - RNA, 32 nt, Human
gggcccuugugcuuccuguggguggggugagg

SEQ ID NO: 197822 - RNA, 21 nt, Human
gggcccuuuacccucagcagg

SEQ ID NO: 197823 - RNA, 32 nt, Human
gggcccuuuccaaguaggcucuggguguccua

SEQ ID NO: 197824 - RNA, 32 nt, Human
gggcccuuuccccaucgcgccugggccugcuc

SEQ ID NO: 197825 - RNA, 32 nt, Human
gggccgaagauaugcucaugugguguugagga

SEQ ID NO: 197826 - RNA, 32 nt, Human
gggccgaagggaggggacagagggcccuggaa

SEQ ID NO: 197827 - RNA, 32 nt, Human
gggccgagagcugacccgcaagaagggcaucc

SEQ ID NO: 197828 - RNA, 23 nt, Human
gggccgagaggggugcccggagg

SEQ ID NO: 197829 - RNA, 32 nt, Human
gggccgagcccgaggggaagaaccuggcccgu

SEQ ID NO: 197830 - RNA, 25 nt, Human
gggccgagccggggccgccucggga

SEQ ID NO: 197831 - RNA, 25 nt, Human
gggccgagcgcggggcacccggggg

SEQ ID NO: 197832 - RNA, 21 nt, Human
gggccgagcggagcccaggga

SEQ ID NO: 197833 - RNA, 23 nt, Human
gggccgagcggcccaccuagugg

SEQ ID NO: 197834 - RNA, 32 nt, Human
gggccgagcugcaggccggaccggagccggau

SEQ ID NO: 197835 - RNA, 32 nt, Human
gggccgaggagagagcggccgccacccggccc

SEQ ID NO: 197836 - RNA, 32 nt, Human
gggccgaggaggaggaggaggaggaggaggag

SEQ ID NO: 197837 - RNA, 32 nt, Human
gggccgaggccgcggcggaggccgcggcuggu

SEQ ID NO: 197838 - RNA, 16 nt, Human
gggccgaggccugggc

SEQ ID NO: 197839 - RNA, 19 nt, Human
gggccgagggcgggagcug

SEQ ID NO: 197840 - RNA, 22 nt, Human
gggccgagguggcagggggcug

SEQ ID NO: 197841 - RNA, 24 nt, Human
gggccgauuccggagugggacuga

SEQ ID NO: 197842 - RNA, 32 nt, Human
gggccgauugaugacaucaucaccuccucuuc

SEQ ID NO: 197843 - RNA, 32 nt, Human
gggccgauuucagcaggaguucagagggcuua

SEQ ID NO: 197844 - RNA, 32 nt, Human
gggccgcaagccccaaauggaaaacuguuuuu

SEQ ID NO: 197845 - RNA, 32 nt, Human
gggccgcaaugcucccuccuucccagggucca

SEQ ID NO: 197846 - RNA, 32 nt, Human
gggccgcacaugcacgccgcagcaccagcugc

SEQ ID NO: 197847 - RNA, 19 nt, Human
gggccgcacgagcuggcug

SEQ ID NO: 197848 - RNA, 32 nt, Human
gggccgcacucgcagccccaagccuucuucug

SEQ ID NO: 197849 - RNA, 32 nt, Human
gggccgcacugaggcucgggcgcgcggggaca

SEQ ID NO: 197850 - RNA, 32 nt, Human
gggccgcagagcaguaccaguccguggccugu

SEQ ID NO: 197851 - RNA, 32 nt, Human
gggccgcagaggauccaucacagacggauacu

SEQ ID NO: 197852 - RNA, 32 nt, Human
gggccgcagcccccugcugcccgcacacaaca

SEQ ID NO: 197853 - RNA, 20 nt, Human
gggccgcagucagcgggcgc

SEQ ID NO: 197854 - RNA, 25 nt, Human
gggccgcaucauccgggagcugccc

SEQ ID NO: 197855 - RNA, 20 nt, Human
gggccgccacggccuggcug

SEQ ID NO: 197856 - RNA, 17 nt, Human
gggccgccauccugccu

SEQ ID NO: 197857 - RNA, 32 nt, Human
gggccgcccagccugagccaugcgccccaacg

SEQ ID NO: 197858 - RNA, 32 nt, Human
gggccgccccucuccccuggccgcuaagcagc

SEQ ID NO: 197859 - RNA, 23 nt, Human
gggccgcccgcgcuccccaugaa

SEQ ID NO: 197860 - RNA, 32 nt, Human
gggccgcccgggacgcugaggcggcggcggcg

SEQ ID NO: 197861 - RNA, 15 nt, Human
gggccgccgccgccu

SEQ ID NO: 197862 - RNA, 21 nt, Human
gggccgccgccugcccuggag

SEQ ID NO: 197863 - RNA, 18 nt, Human
gggccgccgggcaccgag

SEQ ID NO: 197864 - RNA, 32 nt, Human
gggccgccuacugccccugccuaugcccacgg

SEQ ID NO: 197865 - RNA, 32 nt, Human
gggccgccucccucuucucuccaggcaggugg

SEQ ID NO: 197866 - RNA, 32 nt, Human
gggccgccucgucuccgcuccugggggaccgc

SEQ ID NO: 197867 - RNA, 32 nt, Human
gggccgccuggaccaggcuguccuugaccugc

SEQ ID NO: 197868 - RNA, 32 nt, Human
gggccgccuuaacccuugcucccuucccuucu

SEQ ID NO: 197869 - RNA, 32 nt, Human
gggccgcgcagggaggaugacacugauguccc

SEQ ID NO: 197870 - RNA, 32 nt, Human
gggccgcgcagguagugucccugcacuucuug

SEQ ID NO: 197871 - RNA, 23 nt, Human
gggccgcgccgcggcggggggug

SEQ ID NO: 197872 - RNA, 32 nt, Human
gggccgcgcucccucccuaccugggugcccuc

SEQ ID NO: 197873 - RNA, 32 nt, Human
gggccgcgcucggcgcuggccugcugccccgg

SEQ ID NO: 197874 - RNA, 18 nt, Human
gggccgcggagggggcug

SEQ ID NO: 197875 - RNA, 32 nt, Human
gggccgcggaggugggacgcgaugcaguggcc

SEQ ID NO: 197876 - RNA, 32 nt, Human
gggccgcggggagggggaggaggggcaggugc

SEQ ID NO: 197877 - RNA, 32 nt, Human
gggccgcggggucauggcugggccgcggggcg

SEQ ID NO: 197878 - RNA, 18 nt, Human
gggccgcggucggggcug

SEQ ID NO: 197879 - RNA, 32 nt, Human
gggccgcguggugccaucaacccucugccucc

SEQ ID NO: 197880 - RNA, 32 nt, Human
gggccgcucccagggccaugaggaagcggcgg

SEQ ID NO: 197881 - RNA, 22 nt, Human
gggccgcuccggggggccucaa

SEQ ID NO: 197882 - RNA, 32 nt, Human
gggccgcucggcggcaccuccacacccgcccc

SEQ ID NO: 197883 - RNA, 32 nt, Human
gggccgcucugugcuggcgccugcuggccacu

SEQ ID NO: 197884 - RNA, 32 nt, Human
gggccgcugagcuccccaccggccaacggggc

SEQ ID NO: 197885 - RNA, 32 nt, Human
gggccgcugcacuccagccugggggacagagc

SEQ ID NO: 197886 - RNA, 32 nt, Human
gggccgcugccacccaccucccugccuccagg

SEQ ID NO: 197887 - RNA, 32 nt, Human
gggccgcugcgcuggagaauugaagggggcgg

SEQ ID NO: 197888 - RNA, 32 nt, Human
gggccgcugcugucuggugcccugugagcugu

SEQ ID NO: 197889 - RNA, 32 nt, Human
gggccgcuggaaaggccaggcccaguggcuac

SEQ ID NO: 197890 - RNA, 32 nt, Human
gggccgcuggagccuccgccugcuuccuccag

SEQ ID NO: 197891 - RNA, 32 nt, Human
gggccgcugggcaggcggcgaggacuuggccg

SEQ ID NO: 197892 - RNA, 32 nt, Human
gggccgcugggucucucuuuguggacuuguac

SEQ ID NO: 197893 - RNA, 24 nt, Human
gggccggaacggggagggcgagug

SEQ ID NO: 197894 - RNA, 17 nt, Human
gggccggaaguggggug

SEQ ID NO: 197895 - RNA, 32 nt, Human
gggccggacaccuaggcugagcccucagguga

SEQ ID NO: 197896 - RNA, 32 nt, Human
gggccggacgggagguggcggagguggcggcg

SEQ ID NO: 197897 - RNA, 21 nt, Human
gggccggacgggcgggcgcgg

SEQ ID NO: 197898 - RNA, 32 nt, Human
gggccggacuccccggcguucccuucaccaca

SEQ ID NO: 197899 - RNA, 32 nt, Human
gggccggacuuccagcccccagagcccucucc

SEQ ID NO: 197900 - RNA, 20 nt, Human
gggccggagaaggggcgacg

SEQ ID NO: 197901 - RNA, 32 nt, Human
gggccggagaggagcucacugucuguccuuuu

SEQ ID NO: 197902 - RNA, 22 nt, Human
gggccggagcagagagcaccca

SEQ ID NO: 197903 - RNA, 32 nt, Human
gggccggagcggagcggcgccgccaccgccgc

SEQ ID NO: 197904 - RNA, 21 nt, Human
gggccggagcggcgggcgcgg

SEQ ID NO: 197905 - RNA, 21 nt, Human
gggccggagcgggggcgggug

SEQ ID NO: 197906 - RNA, 32 nt, Human
gggccggaggaaccgagguguugccagugcua

SEQ ID NO: 197907 - RNA, 24 nt, Human
gggccggaugaggaggaacugcgu

SEQ ID NO: 197908 - RNA, 32 nt, Human
gggccggaugaggcagggcagagcagacugau

SEQ ID NO: 197909 - RNA, 32 nt, Human
gggccggcaauggcgggcgcaguuucgcucuu

SEQ ID NO: 197910 - RNA, 32 nt, Human
gggccggcagcaaggacacagaugcagccaca

SEQ ID NO: 197911 - RNA, 32 nt, Human
gggccggcauuuccucccacugagccucugcc

SEQ ID NO: 197912 - RNA, 32 nt, Human
gggccggccagccuugcacugugggggcuggu

SEQ ID NO: 197913 - RNA, 22 nt, Human
gggccggcccccagcugggagg

SEQ ID NO: 197914 - RNA, 32 nt, Human
gggccggccgcgcagacuuucuccccaccccu

SEQ ID NO: 197915 - RNA, 18 nt, Human
gggccggccugggggcug

SEQ ID NO: 197916 - RNA, 32 nt, Human
gggccggcgauggggaugcgggagcacuacgc

SEQ ID NO: 197917 - RNA, 22 nt, Human
gggccggcgcccuggggggcug

SEQ ID NO: 197918 - RNA, 20 nt, Human
gggccggcgcgggagggcug

SEQ ID NO: 197919 - RNA, 18 nt, Human
gggccggcggcggggcgg

SEQ ID NO: 197920 - RNA, 20 nt, Human
gggccggcgggcgggggcug

SEQ ID NO: 197921 - RNA, 17 nt, Human
gggccggcggggcgcgg

SEQ ID NO: 197922 - RNA, 32 nt, Human
gggccggcgggggcuggggaggggguaaguuu

SEQ ID NO: 197923 - RNA, 32 nt, Human
gggccggcuccggagaaguuagacccucggag

SEQ ID NO: 197924 - RNA, 32 nt, Human
gggccggcugaccaggaaccugggcgagcagc

SEQ ID NO: 197925 - RNA, 32 nt, Human
gggccggcugggcuggggguugcccuggccag

SEQ ID NO: 197926 - RNA, 32 nt, Human
gggccggcuuugcgcaggugcacaguacucgc

SEQ ID NO: 197927 - RNA, 32 nt, Human
gggccgggacagcuuuccucucagucauuguu

SEQ ID NO: 197928 - RNA, 32 nt, Human
gggccgggaccaagggcaccaugucguccggg

SEQ ID NO: 197929 - RNA, 20 nt, Human
gggccgggacuccggccgca

SEQ ID NO: 197930 - RNA, 21 nt, Human
gggccgggagccugcccuccu

SEQ ID NO: 197931 - RNA, 21 nt, Human
gggccgggaggaugcgcggug

SEQ ID NO: 197932 - RNA, 19 nt, Human
gggccgggcagaggggcag

SEQ ID NO: 197933 - RNA, 26 nt, Human
gggccgggccauucgcgacccggagg

SEQ ID NO: 197934 - RNA, 23 nt, Human
gggccgggccgaggucccggggg

SEQ ID NO: 197935 - RNA, 16 nt, Human
gggccgggccgggcca

SEQ ID NO: 197936 - RNA, 22 nt, Human
gggccgggccgggccacgggga

SEQ ID NO: 197937 - RNA, 18 nt, Human
gggccgggcggggcgcgg

SEQ ID NO: 197938 - RNA, 20 nt, Human
gggccgggcuccccuggcgg

SEQ ID NO: 197939 - RNA, 19 nt, Human
gggccgggcuccgccccag

SEQ ID NO: 197940 - RNA, 21 nt, Human
gggccgggcuggccaauggga

SEQ ID NO: 197941 - RNA, 25 nt, Human
gggccgggcuggggccgcccggggg

SEQ ID NO: 197942 - RNA, 32 nt, Human
gggccggggagagggugcgggugcaggcgggg

SEQ ID NO: 197943 - RNA, 18 nt, Human
gggccggggaggggguug

SEQ ID NO: 197944 - RNA, 32 nt, Human
gggccggggccagagcucgcgugucggcggga

SEQ ID NO: 197945 - RNA, 21 nt, Human
gggccggggccagcaaagucc

SEQ ID NO: 197946 - RNA, 32 nt, Human
gggccggggccagcugcucgcgcucggcucgg

SEQ ID NO: 197947 - RNA, 32 nt, Human
gggccggggccgcggcagguaggccggccgcg

SEQ ID NO: 197948 - RNA, 19 nt, Human
gggccggggcugcuguggg

SEQ ID NO: 197949 - RNA, 32 nt, Human
gggccggggcugggaggccugcacgccugggu

SEQ ID NO: 197950 - RNA, 21 nt, Human
gggccggggcugggcgcggug

SEQ ID NO: 197951 - RNA, 32 nt, Human
gggccggggcugggggcgcagcgcggccggcg

SEQ ID NO: 197952 - RNA, 32 nt, Human
gggccggggcuguucccuuagcagaacggcuc

SEQ ID NO: 197953 - RNA, 20 nt, Human
gggccgggggaggggcgcgg

SEQ ID NO: 197954 - RNA, 32 nt, Human
gggccgggggcagcacggccuggcuuucccac

SEQ ID NO: 197955 - RNA, 20 nt, Human
gggccgggggcggcgggcgg

SEQ ID NO: 197956 - RNA, 32 nt, Human
gggccgggggcggggccgggacugggggcggg

SEQ ID NO: 197957 - RNA, 32 nt, Human
gggccgggggcugagcggcgcccgcugggguc

SEQ ID NO: 197958 - RNA, 32 nt, Human
gggccgggggcugaggcgggagcgaggacacg

SEQ ID NO: 197959 - RNA, 17 nt, Human
gggccggggggcggcgg

SEQ ID NO: 197960 - RNA, 20 nt, Human
gggccggguagaggcucgag

SEQ ID NO: 197961 - RNA, 32 nt, Human
gggccgggugggagguggcaguagucuuagcc

SEQ ID NO: 197962 - RNA, 20 nt, Human
gggccggguuucagcuccgg

SEQ ID NO: 197963 - RNA, 32 nt, Human
gggccgguacaagauacuuccucuucagcugg

SEQ ID NO: 197964 - RNA, 32 nt, Human
gggccgguagcggcgggagcugcacuggccag

SEQ ID NO: 197965 - RNA, 32 nt, Human
gggccguauuccugccacucugcuccgccuca

SEQ ID NO: 197966 - RNA, 32 nt, Human
gggccgucagcaauaccucugagugcccggau

SEQ ID NO: 197967 - RNA, 19 nt, Human
gggccgucaggacacggga

SEQ ID NO: 197968 - RNA, 32 nt, Human
gggccgucugcacuucuguuccagguuuuucu

SEQ ID NO: 197969 - RNA, 32 nt, Human
gggccgugaauugcagcaggaggcagauuuau

SEQ ID NO: 197970 - RNA, 32 nt, Human
gggccgugagccaaggccugggccuggccaag

SEQ ID NO: 197971 - RNA, 32 nt, Human
gggccgugagcucuauuucuacccaggcugcu

SEQ ID NO: 197972 - RNA, 32 nt, Human
gggccgugcagagcagcaccuccaucaggcug

SEQ ID NO: 197973 - RNA, 32 nt, Human
gggccgugcccagggcgguggcugugagucua

SEQ ID NO: 197974 - RNA, 32 nt, Human
gggccgugcccaggggcccacagggaacccug

SEQ ID NO: 197975 - RNA, 32 nt, Human
gggccguggagccacaguacguggcggcgccu

SEQ ID NO: 197976 - RNA, 20 nt, Human
gggccgugggagggggguug

SEQ ID NO: 197977 - RNA, 23 nt, Human
gggccgugggggccagggacacu

SEQ ID NO: 197978 - RNA, 32 nt, Human
gggccgugugcucugggcagugguuccuuggg

SEQ ID NO: 197979 - RNA, 20 nt, Human
gggccguuguuguggggcug

SEQ ID NO: 197980 - RNA, 32 nt, Human
gggccuaaagcccacuccugggggucuccugc

SEQ ID NO: 197981 - RNA, 32 nt, Human
gggccuaagugccacccuccucccuccaagcc

SEQ ID NO: 197982 - RNA, 32 nt, Human
gggccuacacugccuccucccacgccgugcuu

SEQ ID NO: 197983 - RNA, 22 nt, Human
gggccuacgacgccgaugugga

SEQ ID NO: 197984 - RNA, 32 nt, Human
gggccuacuagagucugaacagcuguaaucua

SEQ ID NO: 197985 - RNA, 32 nt, Human
gggccuagaggagagagcagagcccagaaaug

SEQ ID NO: 197986 - RNA, 21 nt, Human
gggccuagauugcacaaggug

SEQ ID NO: 197987 - RNA, 22 nt, Human
gggccuagcaagcgcccagcgg

SEQ ID NO: 197988 - RNA, 32 nt, Human
gggccuagccuugagcaguguugccucaucca

SEQ ID NO: 197989 - RNA, 16 nt, Human
gggccuagcgcaccaa

SEQ ID NO: 197990 - RNA, 32 nt, Human
gggccuaggccaagggcucaaggacaacaaga

SEQ ID NO: 197991 - RNA, 32 nt, Human
gggccuagguacugugcuggggucgcacagcc

SEQ ID NO: 197992 - RNA, 32 nt, Human
gggccuaguuuuaauaaugaggccaguagcac

SEQ ID NO: 197993 - RNA, 32 nt, Human
gggccuauguacaaauaugugcuugcacucag

SEQ ID NO: 197994 - RNA, 32 nt, Human
gggccuauucuuguaaguuucaguuagcauuu

SEQ ID NO: 197995 - RNA, 32 nt, Human
gggccuauuucuacuuucauuuuguauuucug

SEQ ID NO: 197996 - RNA, 32 nt, Human
gggccucaaugcagcugaucacuuggggcagu

SEQ ID NO: 197997 - RNA, 32 nt, Human
gggccucacaacucgugaccucagcuauggcc

SEQ ID NO: 197998 - RNA, 32 nt, Human
gggccucacaugccaggucaccaggucaccgu

SEQ ID NO: 197999 - RNA, 20 nt, Human
gggccucaccaccccuggag

SEQ ID NO: 198000 - RNA, 19 nt, Human
gggccucaccauccgggaa

SEQ ID NO: 198001 - RNA, 32 nt, Human
gggccucagacucugaacuucccucaagugcc

SEQ ID NO: 198002 - RNA, 24 nt, Human
gggccucagagaugcaucugggag

SEQ ID NO: 198003 - RNA, 28 nt, Human
gggccucagagccgaguguggcugggaa

SEQ ID NO: 198004 - RNA, 23 nt, Human
gggccucagagccugaccugaga

SEQ ID NO: 198005 - RNA, 18 nt, Human
gggccucagagcgucugg

SEQ ID NO: 198006 - RNA, 21 nt, Human
gggccucagaggggccugggg

SEQ ID NO: 198007 - RNA, 20 nt, Human
gggccucagccccucugcug

SEQ ID NO: 198008 - RNA, 32 nt, Human
gggccucagccgccccagaggccugcuuaggg

SEQ ID NO: 198009 - RNA, 32 nt, Human
gggccucaggcagcaguggacaguggccagga

SEQ ID NO: 198010 - RNA, 32 nt, Human
gggccucaggcccugaggauacggggcucccg

SEQ ID NO: 198011 - RNA, 21 nt, Human
gggccucaggcgccgccggga

SEQ ID NO: 198012 - RNA, 24 nt, Human
gggccucagggacaggccuggaaa

SEQ ID NO: 198013 - RNA, 24 nt, Human
gggccucagggagcugcugagggg

SEQ ID NO: 198014 - RNA, 32 nt, Human
gggccucagggcacccuccccaccuagcccuc

SEQ ID NO: 198015 - RNA, 17 nt, Human
gggccucaggggggcag

SEQ ID NO: 198016 - RNA, 22 nt, Human
gggccucaggguguuccgggga

SEQ ID NO: 198017 - RNA, 21 nt, Human
gggccucagguagccagggaa

SEQ ID NO: 198018 - RNA, 32 nt, Human
gggccucaguagccucuugagggaagugggac

SEQ ID NO: 198019 - RNA, 18 nt, Human
gggccucagugggggcug

SEQ ID NO: 198020 - RNA, 32 nt, Human
gggccucaguuucccuccucugccaaacgagg

SEQ ID NO: 198021 - RNA, 32 nt, Human
gggccucauaaggagcuguguggucuuggagg

SEQ ID NO: 198022 - RNA, 32 nt, Human
gggccucauacagggauaucaaaauacccuuu

SEQ ID NO: 198023 - RNA, 32 nt, Human
gggccucaucaucugcauuaacauuagcauca

SEQ ID NO: 198024 - RNA, 32 nt, Human
gggccucaucccuucucucccagguagcagaa

SEQ ID NO: 198025 - RNA, 32 nt, Human
gggccucauggcuguuccccagccccucucau

SEQ ID NO: 198026 - RNA, 32 nt, Human
gggccucauucugccaaagcuggaccaaggcu

SEQ ID NO: 198027 - RNA, 32 nt, Human
gggccucauugauggggagucucaguggaugu

SEQ ID NO: 198028 - RNA, 32 nt, Human
gggccucauuuuaauguucagugagaaguaaa

SEQ ID NO: 198029 - RNA, 20 nt, Human
gggccuccaaccuucugccc

SEQ ID NO: 198030 - RNA, 20 nt, Human
gggccuccaagcuggugccc

SEQ ID NO: 198031 - RNA, 32 nt, Human
gggccuccacacugccuggcagaacauaccac

SEQ ID NO: 198032 - RNA, 24 nt, Human
gggccuccaccgacaccugcuucu

SEQ ID NO: 198033 - RNA, 32 nt, Human
gggccuccaccucugugcagggcacagaaggc

SEQ ID NO: 198034 - RNA, 21 nt, Human
gggccuccacgcaugcgcacc

SEQ ID NO: 198035 - RNA, 24 nt, Human
gggccuccacgccagcgccgggaa

SEQ ID NO: 198036 - RNA, 20 nt, Human
gggccuccacgucccugccc

SEQ ID NO: 198037 - RNA, 21 nt, Human
gggccuccacuuggccugacc

SEQ ID NO: 198038 - RNA, 21 nt, Human
gggccuccagaacuccuguuu

SEQ ID NO: 198039 - RNA, 32 nt, Human
gggccuccagcaggcagaggagaucaugacca

SEQ ID NO: 198040 - RNA, 22 nt, Human
gggccuccaggauuugccugca

SEQ ID NO: 198041 - RNA, 19 nt, Human
gggccuccaggugcuggaa

SEQ ID NO: 198042 - RNA, 23 nt, Human
gggccuccaguaguuccugcgcc

SEQ ID NO: 198043 - RNA, 19 nt, Human
gggccuccauuaucugcac

SEQ ID NO: 198044 - RNA, 32 nt, Human
gggccucccaaaacgcuggaacuacaagugug

SEQ ID NO: 198045 - RNA, 32 nt, Human
gggccucccaaagugcugggauuagaggcaug

SEQ ID NO: 198046 - RNA, 17 nt, Human
gggccucccagugcaaa

SEQ ID NO: 198047 - RNA, 32 nt, Human
gggccuccccagcugccugggcuugaccggcg

SEQ ID NO: 198048 - RNA, 21 nt, Human
gggccuccccaggugugcacc

SEQ ID NO: 198049 - RNA, 32 nt, Human
gggccuccccuaccucaaaccccagcugggcc

SEQ ID NO: 198050 - RNA, 23 nt, Human
gggccuccccuccauccugcacc

SEQ ID NO: 198051 - RNA, 19 nt, Human
gggccucccggcacccacc

SEQ ID NO: 198052 - RNA, 26 nt, Human
gggccucccggcucuggcgccgggga

SEQ ID NO: 198053 - RNA, 21 nt, Human
gggccucccuccgucugcgcc

SEQ ID NO: 198054 - RNA, 32 nt, Human
gggccuccggaacccccagcaggcugggcuua

SEQ ID NO: 198055 - RNA, 23 nt, Human
gggccuccgggacuccccccgca

SEQ ID NO: 198056 - RNA, 21 nt, Human
gggccuccuaccgucuggacc

SEQ ID NO: 198057 - RNA, 32 nt, Human
gggccuccuaggggauccucaggcggccccca

SEQ ID NO: 198058 - RNA, 32 nt, Human
gggccuccucgcaaaugcccaggcccugcauu

SEQ ID NO: 198059 - RNA, 32 nt, Human
gggccuccucuccuagacccuuagcuugugac

SEQ ID NO: 198060 - RNA, 21 nt, Human
gggccuccucuccuccucuca

SEQ ID NO: 198061 - RNA, 20 nt, Human
gggccuccugcgcccucacc

SEQ ID NO: 198062 - RNA, 18 nt, Human
gggccuccugcuccagcu

SEQ ID NO: 198063 - RNA, 32 nt, Human
gggccuccugcucucgucccuggcccucccug

SEQ ID NO: 198064 - RNA, 32 nt, Human
gggccuccugcuucuaauucaggcucugccac

SEQ ID NO: 198065 - RNA, 32 nt, Human
gggccuccuggacuacaggagaugcugucacu

SEQ ID NO: 198066 - RNA, 32 nt, Human
gggccuccuguaaucccagcuacuugggaggc

SEQ ID NO: 198067 - RNA, 32 nt, Human
gggccuccuuccuccccugccugcagcuggcu

SEQ ID NO: 198068 - RNA, 32 nt, Human
gggccucgaccugugacucacacccaguggac

SEQ ID NO: 198069 - RNA, 32 nt, Human
gggccucgauguuccaggcacuguccuaggca

SEQ ID NO: 198070 - RNA, 32 nt, Human
gggccucgcagcccucuccgagcagggcuggu

SEQ ID NO: 198071 - RNA, 22 nt, Human
gggccucggacuuagcugggag

SEQ ID NO: 198072 - RNA, 27 nt, Human
gggccucggagccgccuccgccgggag

SEQ ID NO: 198073 - RNA, 22 nt, Human
gggccucggcuuccgcaggaag

SEQ ID NO: 198074 - RNA, 24 nt, Human
gggccucggggagagggguggaag

SEQ ID NO: 198075 - RNA, 22 nt, Human
gggccucggguguggccagaga

SEQ ID NO: 198076 - RNA, 23 nt, Human
gggccucgugcgggggccgggag

SEQ ID NO: 198077 - RNA, 32 nt, Human
gggccucguuucucccucugggaacagccaaa

SEQ ID NO: 198078 - RNA, 32 nt, Human
gggccucuacugccugucgcuggaccacccgg

SEQ ID NO: 198079 - RNA, 32 nt, Human
gggccucuccaccuacucacauggcaaauccc

SEQ ID NO: 198080 - RNA, 31 nt, Human
gggccucuccucaaggagagauggagggaua

SEQ ID NO: 198081 - RNA, 32 nt, Human
gggccucuccucaaggagagauggagggauac

SEQ ID NO: 198082 - RNA, 32 nt, Human
gggccucuccucacucagagggugaugggguc

SEQ ID NO: 198083 - RNA, 32 nt, Human
gggccucuccugcccucugcucugccuggagu

SEQ ID NO: 198084 - RNA, 32 nt, Human
gggccucuccuggggccuggcuuuggcuggag

SEQ ID NO: 198085 - RNA, 32 nt, Human
gggccucucugcagaccucuucccaggagacc

SEQ ID NO: 198086 - RNA, 32 nt, Human
gggccucucugcccguggagugcaggagcgaa

SEQ ID NO: 198087 - RNA, 32 nt, Human
gggccucucugccucgcccaccccucagcccu

SEQ ID NO: 198088 - RNA, 32 nt, Human
gggccucugaagccugggccaggcucucccgc

SEQ ID NO: 198089 - RNA, 32 nt, Human
gggccucugaauauaacccacacccagcguag

SEQ ID NO: 198090 - RNA, 32 nt, Human
gggccucugagcaggugcaggcuguggugggc

SEQ ID NO: 198091 - RNA, 32 nt, Human
gggccucugaggaggagggaaaaagugaagga

SEQ ID NO: 198092 - RNA, 32 nt, Human
gggccucugcauucuacgccagggacuagacg

SEQ ID NO: 198093 - RNA, 18 nt, Human
gggccucugcccugaaca

SEQ ID NO: 198094 - RNA, 17 nt, Human
gggccucugcgcggcug

SEQ ID NO: 198095 - RNA, 32 nt, Human
gggccucugcucccaugcucauaccucuucuu

SEQ ID NO: 198096 - RNA, 32 nt, Human
gggccucugcuccccugggaccuccugucuca

SEQ ID NO: 198097 - RNA, 32 nt, Human
gggccucuggauggcccugcccugacuggggc

SEQ ID NO: 198098 - RNA, 32 nt, Human
gggccucuggcaccuucaagggcaucaucagc

SEQ ID NO: 198099 - RNA, 20 nt, Human
gggccucuggcagccucacc

SEQ ID NO: 198100 - RNA, 32 nt, Human
gggccucuggccuggcugaguucacagcccag

SEQ ID NO: 198101 - RNA, 32 nt, Human
gggccucugggcagaggaugcaauggcacgga

SEQ ID NO: 198102 - RNA, 32 nt, Human
gggccucuggggcugcccacccuaccugcccu

SEQ ID NO: 198103 - RNA, 19 nt, Human
gggccucugggguggggug

SEQ ID NO: 198104 - RNA, 23 nt, Human
gggccucugguggcggucgggaa

SEQ ID NO: 198105 - RNA, 32 nt, Human
gggccucuguaaccuuccacccccucugcgga

SEQ ID NO: 198106 - RNA, 32 nt, Human
gggccucuguccucacgguccugggccugccu

SEQ ID NO: 198107 - RNA, 32 nt, Human
gggccucugucuccaucucugcccuuugaaac

SEQ ID NO: 198108 - RNA, 32 nt, Human
gggccucugugucacccacuccugggugcgug

SEQ ID NO: 198109 - RNA, 32 nt, Human
gggccucuuccccucaccuggcccuuggauuu

SEQ ID NO: 198110 - RNA, 32 nt, Human
gggccucuugcggucccuucuuacucacacac

SEQ ID NO: 198111 - RNA, 32 nt, Human
gggccucuugcuuccugcaaccccuugcuggc

SEQ ID NO: 198112 - RNA, 32 nt, Human
gggccucuuucaucugugcucuuccaggaugc

SEQ ID NO: 198113 - RNA, 32 nt, Human
gggccugaauuccugacuuugccugcacgcau

SEQ ID NO: 198114 - RNA, 32 nt, Human
gggccugacaucuucugcccugguccccuuuc

SEQ ID NO: 198115 - RNA, 32 nt, Human
gggccugaccuccaguccugcuggccugcucu

SEQ ID NO: 198116 - RNA, 32 nt, Human
gggccugagaaaagaaugggagggggcuauua

SEQ ID NO: 198117 - RNA, 32 nt, Human
gggccugagaaaagcucauacaugccucaugu

SEQ ID NO: 198118 - RNA, 32 nt, Human
gggccugagaauucacauuucccacuggugau

SEQ ID NO: 198119 - RNA, 32 nt, Human
gggccugagaucuugagagacagggucucacu

SEQ ID NO: 198120 - RNA, 32 nt, Human
gggccugagcaggauugagggagccaggggag

SEQ ID NO: 198121 - RNA, 32 nt, Human
gggccugagcugucugucucguuucuguccgc

SEQ ID NO: 198122 - RNA, 32 nt, Human
gggccugaggagagaggggaaggguacagaga

SEQ ID NO: 198123 - RNA, 20 nt, Human
gggccugaggaggccacagg

SEQ ID NO: 198124 - RNA, 32 nt, Human
gggccugagugccagcccuggcagacugagga

SEQ ID NO: 198125 - RNA, 32 nt, Human
gggccugauuguuuccuguaaccaggauacag

SEQ ID NO: 198126 - RNA, 21 nt, Human
gggccugcaaauggagugggg

SEQ ID NO: 198127 - RNA, 32 nt, Human
gggccugcacacacaggguguugaggaaccac

SEQ ID NO: 198128 - RNA, 32 nt, Human
gggccugcacaggaaaaacagagccaaagaca

SEQ ID NO: 198129 - RNA, 22 nt, Human
gggccugcagcucagaggguca

SEQ ID NO: 198130 - RNA, 32 nt, Human
gggccugcagcucccuucuccugggacuuaga

SEQ ID NO: 198131 - RNA, 22 nt, Human
gggccugcaggccauccuggga

SEQ ID NO: 198132 - RNA, 32 nt, Human
gggccugcaguuggcagaagggucccgggccc

SEQ ID NO: 198133 - RNA, 32 nt, Human
gggccugcaguuuccaucacccacugcaacca

SEQ ID NO: 198134 - RNA, 17 nt, Human
gggccugcauuaagugg

SEQ ID NO: 198135 - RNA, 32 nt, Human
gggccugcauuccauccgcucugcagccccaa

SEQ ID NO: 198136 - RNA, 32 nt, Human
gggccugcauuugagaauaagggugucacuag

SEQ ID NO: 198137 - RNA, 22 nt, Human
gggccugccacaggggcacaag

SEQ ID NO: 198138 - RNA, 22 nt, Human
gggccugccacaugggcacaag

SEQ ID NO: 198139 - RNA, 32 nt, Human
gggccugccaggacuagacagaaguggggcgg

SEQ ID NO: 198140 - RNA, 32 nt, Human
gggccugccauagaaaagucacaucccugagg

SEQ ID NO: 198141 - RNA, 32 nt, Human
gggccugccaugagcucuccgccgcccgcccg

SEQ ID NO: 198142 - RNA, 21 nt, Human
gggccugcccugagcucacca

SEQ ID NO: 198143 - RNA, 32 nt, Human
gggccugccugggcagucugucuccgggccag

SEQ ID NO: 198144 - RNA, 20 nt, Human
gggccugcggaggcgguggc

SEQ ID NO: 198145 - RNA, 32 nt, Human
gggccugcggaggggaagcccacccacaaugc

SEQ ID NO: 198146 - RNA, 17 nt, Human
gggccugcgugaguggg

SEQ ID NO: 198147 - RNA, 23 nt, Human
gggccugcuaggagcccacacgg

SEQ ID NO: 198148 - RNA, 32 nt, Human
gggccugcucugacagggcccaugucccacaa

SEQ ID NO: 198149 - RNA, 18 nt, Human
gggccugcugaggugggg

SEQ ID NO: 198150 - RNA, 32 nt, Human
gggccugcugcggggagguccacccacuuccg

SEQ ID NO: 198151 - RNA, 32 nt, Human
gggccugcuggaguuccggccugggcaccagc

SEQ ID NO: 198152 - RNA, 20 nt, Human
gggccugcuggggagugggg

SEQ ID NO: 198153 - RNA, 32 nt, Human
gggccugcuggggccucugcuccagggccuca

SEQ ID NO: 198154 - RNA, 19 nt, Human
gggccugcugggggugggg

SEQ ID NO: 198155 - RNA, 32 nt, Human
gggccugcuuucuccuuugucugucuugggcu

SEQ ID NO: 198156 - RNA, 19 nt, Human
gggccuggaaagcgcagug

SEQ ID NO: 198157 - RNA, 32 nt, Human
gggccuggaacccagcccugaggacauccugc

SEQ ID NO: 198158 - RNA, 32 nt, Human
gggccuggaagaggcgcggggacagggcacuc

SEQ ID NO: 198159 - RNA, 32 nt, Human
gggccuggaauguaaacagccacugggguaca

SEQ ID NO: 198160 - RNA, 19 nt, Human
gggccuggacacagaugac

SEQ ID NO: 198161 - RNA, 21 nt, Human
gggccuggacuccccacccca

SEQ ID NO: 198162 - RNA, 32 nt, Human
gggccuggacugcaggccugaccugcucccug

SEQ ID NO: 198163 - RNA, 20 nt, Human
gggccuggagagcagcagug

SEQ ID NO: 198164 - RNA, 32 nt, Human
gggccuggagcagcccgaggcacugcagcaga

SEQ ID NO: 198165 - RNA, 32 nt, Human
gggccuggagcaguaugagcagaugcugaaga

SEQ ID NO: 198166 - RNA, 32 nt, Human
gggccuggagccaugggcugggugggcgggcg

SEQ ID NO: 198167 - RNA, 32 nt, Human
gggccuggagcugggaccugcccauaggcauc

SEQ ID NO: 198168 - RNA, 23 nt, Human
gggccuggagcugggagucucaa

SEQ ID NO: 198169 - RNA, 32 nt, Human
gggccuggagcuuggcuuguauccaaguguau

SEQ ID NO: 198170 - RNA, 32 nt, Human
gggccuggaggcacccuacaagagcugacuuu

SEQ ID NO: 198171 - RNA, 32 nt, Human
gggccuggagugacggcgggcgaggaagaaaa

SEQ ID NO: 198172 - RNA, 32 nt, Human
gggccuggaguuugggaugcaggcuuguuaaa

SEQ ID NO: 198173 - RNA, 32 nt, Human
gggccuggcaugcaacagguccuuggaguggc

SEQ ID NO: 198174 - RNA, 24 nt, Human
gggccuggccaagcccccaagagg

SEQ ID NO: 198175 - RNA, 20 nt, Human
gggccuggccacacacuucc

SEQ ID NO: 198176 - RNA, 32 nt, Human
gggccuggccaggacagugucaguucccagag

SEQ ID NO: 198177 - RNA, 21 nt, Human
gggccuggccccacuguguug

SEQ ID NO: 198178 - RNA, 24 nt, Human
gggccuggccuacuuugagaucca

SEQ ID NO: 198179 - RNA, 32 nt, Human
gggccuggccuccuggguucuuugcugaaauu

SEQ ID NO: 198180 - RNA, 22 nt, Human
gggccuggccucucccuucuca

SEQ ID NO: 198181 - RNA, 32 nt, Human
gggccuggcgggggaggcaggggugagaggau

SEQ ID NO: 198182 - RNA, 32 nt, Human
gggccuggcuucugaggcugaauggacuccgu

SEQ ID NO: 198183 - RNA, 21 nt, Human
gggccugggaaacuagguucc

SEQ ID NO: 198184 - RNA, 32 nt, Human
gggccugggaaacuagguucccagggguugag

SEQ ID NO: 198185 - RNA, 32 nt, Human
gggccugggaaaggaaaaccagggauagcuau

SEQ ID NO: 198186 - RNA, 22 nt, Human
gggccugggaaucuaaguggga

SEQ ID NO: 198187 - RNA, 32 nt, Human
gggccugggaauuggccauguguuaauuuauu

SEQ ID NO: 198188 - RNA, 32 nt, Human
gggccugggacccugcuccgccccgcgcuccc

SEQ ID NO: 198189 - RNA, 32 nt, Human
gggccugggaggagccgagaccagccuuuuac

SEQ ID NO: 198190 - RNA, 32 nt, Human
gggccugggaggcauagguugcagugagccga

SEQ ID NO: 198191 - RNA, 32 nt, Human
gggccugggaggcggagguugcagugagccga

SEQ ID NO: 198192 - RNA, 32 nt, Human
gggccugggaggucgaggcugcagugagcugu

SEQ ID NO: 198193 - RNA, 32 nt, Human
gggccugggagguggugggagggagaaggaag

SEQ ID NO: 198194 - RNA, 24 nt, Human
gggccugggcagcagguguggcca

SEQ ID NO: 198195 - RNA, 32 nt, Human
gggccugggcaggcagccacagagggcauguu

SEQ ID NO: 198196 - RNA, 23 nt, Human
gggccugggcagucaggcuccag

SEQ ID NO: 198197 - RNA, 32 nt, Human
gggccugggcaucaggcagggugcaggugggg

SEQ ID NO: 198198 - RNA, 32 nt, Human
gggccugggccagacaugcuaauuucagagag

SEQ ID NO: 198199 - RNA, 21 nt, Human
gggccugggccagggccccag

SEQ ID NO: 198200 - RNA, 21 nt, Human
gggccugggccauccauucca

SEQ ID NO: 198201 - RNA, 21 nt, Human
gggccugggcccaggagccag

SEQ ID NO: 198202 - RNA, 22 nt, Human
gggccugggcccgcggacccca

SEQ ID NO: 198203 - RNA, 32 nt, Human
gggccugggccguuaucuccccacaaccccca

SEQ ID NO: 198204 - RNA, 18 nt, Human
gggccugggccucagagg

SEQ ID NO: 198205 - RNA, 21 nt, Human
gggccugggcugcaaaggagc

SEQ ID NO: 198206 - RNA, 32 nt, Human
gggccugggcuggcuggcaucccugggucgau

SEQ ID NO: 198207 - RNA, 32 nt, Human
gggccuggggcagacuuaggaucaggauaaag

SEQ ID NO: 198208 - RNA, 21 nt, Human
gggccuggggcagggggguca

SEQ ID NO: 198209 - RNA, 18 nt, Human
gggccuggggccaagagg

SEQ ID NO: 198210 - RNA, 32 nt, Human
gggccuggggccugagagaauuggcucaauaa

SEQ ID NO: 198211 - RNA, 32 nt, Human
gggccuggggccugggcuucgggcgcggcguu

SEQ ID NO: 198212 - RNA, 24 nt, Human
gggccuggggcuccgaaauuccaa

SEQ ID NO: 198213 - RNA, 32 nt, Human
gggccuggggcuccuuucuccagccagcaaug

SEQ ID NO: 198214 - RNA, 32 nt, Human
gggccugggggcugggcuggaccagggcgugg

SEQ ID NO: 198215 - RNA, 32 nt, Human
gggccugggggugggaggaugggacuuaggua

SEQ ID NO: 198216 - RNA, 32 nt, Human
gggccuggguagcugggcccagacaaaccacc

SEQ ID NO: 198217 - RNA, 20 nt, Human
gggccuggguucaagccucc

SEQ ID NO: 198218 - RNA, 32 nt, Human
gggccuggucaccacaauuagagcuugaugcc

SEQ ID NO: 198219 - RNA, 32 nt, Human
gggccugguccuagcccugccucggccacugu

SEQ ID NO: 198220 - RNA, 32 nt, Human
gggccugguccugaggagggcuuggagcgggc

SEQ ID NO: 198221 - RNA, 32 nt, Human
gggccugguccugagggcaggacagggguuug

SEQ ID NO: 198222 - RNA, 32 nt, Human
gggccuggugcuggacgccaaugcccuccccc

SEQ ID NO: 198223 - RNA, 32 nt, Human
gggccugguggagaaggaggugcuggcugcga

SEQ ID NO: 198224 - RNA, 23 nt, Human
gggccugguggcucacaccugua

SEQ ID NO: 198225 - RNA, 32 nt, Human
gggccuggugucuccccucccccaccacccgg

SEQ ID NO: 198226 - RNA, 32 nt, Human
gggccugguguggaaccagggagcugugggaa

SEQ ID NO: 198227 - RNA, 32 nt, Human
gggccuguagccaccaguucauaggugccaag

SEQ ID NO: 198228 - RNA, 31 nt, Human
gggccuguagggcaacccaugccaacugcgg

SEQ ID NO: 198229 - RNA, 18 nt, Human
gggccuguaggggcgggg

SEQ ID NO: 198230 - RNA, 32 nt, Human
gggccuguaucucagaagggaggggcacagcu

SEQ ID NO: 198231 - RNA, 19 nt, Human
gggccuguaugagacagga

SEQ ID NO: 198232 - RNA, 18 nt, Human
gggccuguauguuuaugg

SEQ ID NO: 198233 - RNA, 32 nt, Human
gggccugucaugggguggagggaugggggagg

SEQ ID NO: 198234 - RNA, 32 nt, Human
gggccugucauugguauuuggccaaggccugc

SEQ ID NO: 198235 - RNA, 32 nt, Human
gggccugucgacgggcccucgugugggaagcc

SEQ ID NO: 198236 - RNA, 23 nt, Human
gggccugucuccagggccaggcu

SEQ ID NO: 198237 - RNA, 19 nt, Human
gggccugugaagguuagga

SEQ ID NO: 198238 - RNA, 18 nt, Human
gggccugugagugcagga

SEQ ID NO: 198239 - RNA, 20 nt, Human
gggccugugauuggauggga

SEQ ID NO: 198240 - RNA, 19 nt, Human
gggccugugcaccgguggg

SEQ ID NO: 198241 - RNA, 17 nt, Human
gggccugugcagcuggg

SEQ ID NO: 198242 - RNA, 32 nt, Human
gggccugugcaucuucuguauguaggaggugg

SEQ ID NO: 198243 - RNA, 32 nt, Human
gggccugugccgcacuagccucccucuccucu

SEQ ID NO: 198244 - RNA, 19 nt, Human
gggccugugccuggggagg

SEQ ID NO: 198245 - RNA, 20 nt, Human
gggccugugccugggugaga

SEQ ID NO: 198246 - RNA, 19 nt, Human
gggccugugcggggcgcgg

SEQ ID NO: 198247 - RNA, 20 nt, Human
gggccugugcugcagucggg

SEQ ID NO: 198248 - RNA, 32 nt, Human
gggccugugcugggaaccaucuggaccuuugc

SEQ ID NO: 198249 - RNA, 20 nt, Human
gggccugugcuggggauggg

SEQ ID NO: 198250 - RNA, 20 nt, Human
gggccugugcuuccagcggg

SEQ ID NO: 198251 - RNA, 18 nt, Human
gggccuguggagaguggg

SEQ ID NO: 198252 - RNA, 19 nt, Human
gggccuguggccuggggga

SEQ ID NO: 198253 - RNA, 18 nt, Human
gggccugugggagcgggg

SEQ ID NO: 198254 - RNA, 19 nt, Human
gggccugugggcuguggga

SEQ ID NO: 198255 - RNA, 20 nt, Human
gggccuguggggugccugga

SEQ ID NO: 198256 - RNA, 32 nt, Human
gggccuguggggugccuggaggugaucuuuga

SEQ ID NO: 198257 - RNA, 17 nt, Human
gggccugugggguugga

SEQ ID NO: 198258 - RNA, 19 nt, Human
gggccuguguaagaauggg

SEQ ID NO: 198259 - RNA, 20 nt, Human
gggccuguguaauuguagga

SEQ ID NO: 198260 - RNA, 20 nt, Human
gggccuguguagccaguggg

SEQ ID NO: 198261 - RNA, 20 nt, Human
gggccugugucgggcguggg

SEQ ID NO: 198262 - RNA, 32 nt, Human
gggccugugucuugagccuggagggagacugc

SEQ ID NO: 198263 - RNA, 32 nt, Human
gggccugugugaugucccugaggcagaagagc

SEQ ID NO: 198264 - RNA, 20 nt, Human
gggccugugugugggugggg

SEQ ID NO: 198265 - RNA, 18 nt, Human
gggccuguguucugaggg

SEQ ID NO: 198266 - RNA, 18 nt, Human
gggccuguguugcuggga

SEQ ID NO: 198267 - RNA, 32 nt, Human
gggccuguuccuggcccgcagccgccaccuac

SEQ ID NO: 198268 - RNA, 32 nt, Human
gggccuguucugcaguuggacagacagagccc

SEQ ID NO: 198269 - RNA, 20 nt, Human
gggccuguugagggcaggga

SEQ ID NO: 198270 - RNA, 20 nt, Human
gggccuguuggaggcuggga

SEQ ID NO: 198271 - RNA, 18 nt, Human
gggccuguuggggcgggg

SEQ ID NO: 198272 - RNA, 19 nt, Human
gggccuguuugauaaagga

SEQ ID NO: 198273 - RNA, 18 nt, Human
gggccuguuuggugagga

SEQ ID NO: 198274 - RNA, 32 nt, Human
gggccuguuuucucccuccugacccugcaucu

SEQ ID NO: 198275 - RNA, 32 nt, Human
gggccuuagguugagcugaugggggaaggaca

SEQ ID NO: 198276 - RNA, 20 nt, Human
gggccuuagugccucagaga

SEQ ID NO: 198277 - RNA, 32 nt, Human
gggccuucacaguuugauuccauucucagcuc

SEQ ID NO: 198278 - RNA, 32 nt, Human
gggccuucacuaccaagggacucucuucaucu

SEQ ID NO: 198279 - RNA, 32 nt, Human
gggccuuccagaagcgccagcagcagcagagc

SEQ ID NO: 198280 - RNA, 32 nt, Human
gggccuuccagugaucuggaccaggaagacgg

SEQ ID NO: 198281 - RNA, 32 nt, Human
gggccuuccaugggcauggccguugccucucu

SEQ ID NO: 198282 - RNA, 32 nt, Human
gggccuuccggaagggucgacgagaugaguuc

SEQ ID NO: 198283 - RNA, 32 nt, Human
gggccuuccuccagccccuccucucccuccuc

SEQ ID NO: 198284 - RNA, 32 nt, Human
gggccuuccuccuccagguuggguuccacucc

SEQ ID NO: 198285 - RNA, 32 nt, Human
gggccuuccugagacacauucagagaaggauc

SEQ ID NO: 198286 - RNA, 24 nt, Human
gggccuucgggaggaggaggcgga

SEQ ID NO: 198287 - RNA, 32 nt, Human
gggccuucuagacugucuucuaugauccugcc

SEQ ID NO: 198288 - RNA, 32 nt, Human
gggccuucucaaugccuccaccuagaaguuga

SEQ ID NO: 198289 - RNA, 32 nt, Human
gggccuucuccagacaucugugcucagcagau

SEQ ID NO: 198290 - RNA, 32 nt, Human
gggccuucucccagggugugcucggugggcag

SEQ ID NO: 198291 - RNA, 32 nt, Human
gggccuucucugaccccugccugagcuguucc

SEQ ID NO: 198292 - RNA, 32 nt, Human
gggccuucugccaccuuugccucccagggugc

SEQ ID NO: 198293 - RNA, 32 nt, Human
gggccuucugccugcugaccauaacagugcca

SEQ ID NO: 198294 - RNA, 32 nt, Human
gggccuucuuucucaucucugucuuuaccaua

SEQ ID NO: 198295 - RNA, 32 nt, Human
gggccuugagcagaauugagaaggaaauaccc

SEQ ID NO: 198296 - RNA, 19 nt, Human
gggccuugcagaggggcag

SEQ ID NO: 198297 - RNA, 32 nt, Human
gggccuugccagagcuccucuccagucaaggc

SEQ ID NO: 198298 - RNA, 32 nt, Human
gggccuugccuagugggccuuccuucccaggu

SEQ ID NO: 198299 - RNA, 32 nt, Human
gggccuugcgucccuguuuggccagagcaagg

SEQ ID NO: 198300 - RNA, 32 nt, Human
gggccuugcucaagguccccagcuucagcccc

SEQ ID NO: 198301 - RNA, 32 nt, Human
gggccuugcucugagcacaggugacagaucau

SEQ ID NO: 198302 - RNA, 32 nt, Human
gggccuugggagcccauguucaaggcaggacc

SEQ ID NO: 198303 - RNA, 32 nt, Human
gggccuugggcuguaggaugacaacacuuuga

SEQ ID NO: 198304 - RNA, 22 nt, Human
gggccuuguccacguccaggaa

SEQ ID NO: 198305 - RNA, 32 nt, Human
gggccuugucuagccccugccucugcgccccc

SEQ ID NO: 198306 - RNA, 32 nt, Human
gggccuuguugaacagauccacacugcucuaa

SEQ ID NO: 198307 - RNA, 32 nt, Human
gggccuuuaggggcacguucgccugcugaccg

SEQ ID NO: 198308 - RNA, 22 nt, Human
gggccuuucucggggccggaga

SEQ ID NO: 198309 - RNA, 32 nt, Human
gggccuuugagcugcugacuuucagcuggaac

SEQ ID NO: 198310 - RNA, 32 nt, Human
gggccuuugaggacaggagcuguaaggaugau

SEQ ID NO: 198311 - RNA, 32 nt, Human
gggccuuugcacugcaacaucaugccucugaa

SEQ ID NO: 198312 - RNA, 32 nt, Human
gggccuuugcaucccugcacuccuggacgugu

SEQ ID NO: 198313 - RNA, 20 nt, Human
gggccuuugccagcagcaag

SEQ ID NO: 198314 - RNA, 32 nt, Human
gggccuuuggagaggggagugcagggcaccac

SEQ ID NO: 198315 - RNA, 32 nt, Human
gggccuuugucuagggaagggacugguaggga

SEQ ID NO: 198316 - RNA, 32 nt, Human
gggcgaaaacugaagugcaaucagggccaaga

SEQ ID NO: 198317 - RNA, 24 nt, Human
gggcgaaagggugagacuccaucu

SEQ ID NO: 198318 - RNA, 22 nt, Human
gggcgaaaguaagacucugucu

SEQ ID NO: 198319 - RNA, 32 nt, Human
gggcgaaccagcuccgcuccggaggggucugc

SEQ ID NO: 198320 - RNA, 32 nt, Human
gggcgaacuaugagaauggccucugacgaugg

SEQ ID NO: 198321 - RNA, 21 nt, Human
gggcgaagagagggcugaacc

SEQ ID NO: 198322 - RNA, 32 nt, Human
gggcgaagagaucuacccgucucccucccucc

SEQ ID NO: 198323 - RNA, 32 nt, Human
gggcgaagaggaggaggaaggggaggacgaug

SEQ ID NO: 198324 - RNA, 32 nt, Human
gggcgaagcuuuggugacagacggagaguggg

SEQ ID NO: 198325 - RNA, 22 nt, Human
gggcgaaggacccggcgcugcg

SEQ ID NO: 198326 - RNA, 32 nt, Human
gggcgaaguccacuguccuccuuggcggcaaa

SEQ ID NO: 198327 - RNA, 32 nt, Human
gggcgaaucucacggaccugaccucagaggug

SEQ ID NO: 198328 - RNA, 24 nt, Human
gggcgacaaagcaagacucugucu

SEQ ID NO: 198329 - RNA, 24 nt, Human
gggcgacaaagcaagacuuuguuu

SEQ ID NO: 198330 - RNA, 24 nt, Human
gggcgacaaagugagacucugucu

SEQ ID NO: 198331 - RNA, 22 nt, Human
gggcgacaaagugggacugucu

SEQ ID NO: 198332 - RNA, 25 nt, Human
gggcgacaagagcaagacucugucu

SEQ ID NO: 198333 - RNA, 25 nt, Human
gggcgacaagagcgaaacucugucu

SEQ ID NO: 198334 - RNA, 25 nt, Human
gggcgacaagagcgagacucugucu

SEQ ID NO: 198335 - RNA, 24 nt, Human
gggcgacacagugagacucugucu

SEQ ID NO: 198336 - RNA, 32 nt, Human
gggcgacacgagggccgcggugcaguguccga

SEQ ID NO: 198337 - RNA, 32 nt, Human
gggcgacacggugaaaccccgucccuacuaaa

SEQ ID NO: 198338 - RNA, 24 nt, Human
gggcgacagaaugagacucugucu

SEQ ID NO: 198339 - RNA, 32 nt, Human
gggcgacagagcaagacucccucucaggaaag

SEQ ID NO: 198340 - RNA, 24 nt, Human
gggcgacagagcaagacucugacu

SEQ ID NO: 198341 - RNA, 22 nt, Human
gggcgacagagcaagacucugu

SEQ ID NO: 198342 - RNA, 24 nt, Human
gggcgacagagcaagacucugucu

SEQ ID NO: 198343 - RNA, 24 nt, Human
gggcgacagagcaaggcucugucu

SEQ ID NO: 198344 - RNA, 23 nt, Human
gggcgacagagcgaaacucuguc

SEQ ID NO: 198345 - RNA, 22 nt, Human
gggcgacagagcgagacucugu

SEQ ID NO: 198346 - RNA, 24 nt, Human
gggcgacagagcgagacucugucu

SEQ ID NO: 198347 - RNA, 24 nt, Human
gggcgacagagcgagacuuuggcu

SEQ ID NO: 198348 - RNA, 24 nt, Human
gggcgacagagcgagacuuuguuu

SEQ ID NO: 198349 - RNA, 24 nt, Human
gggcgacagagcgagauucugccu

SEQ ID NO: 198350 - RNA, 32 nt, Human
gggcgacagagcgagauucugccucaaaaaua

SEQ ID NO: 198351 - RNA, 24 nt, Human
gggcgacagagcgagauucugucu

SEQ ID NO: 198352 - RNA, 24 nt, Human
gggcgacagagggagacucugucu

SEQ ID NO: 198353 - RNA, 24 nt, Human
gggcgacagaguaagacuguguuu

SEQ ID NO: 198354 - RNA, 22 nt, Human
gggcgacagagugacccugccu

SEQ ID NO: 198355 - RNA, 24 nt, Human
gggcgacagagugagacccugucu

SEQ ID NO: 198356 - RNA, 24 nt, Human
gggcgacagagugagacccuguuu

SEQ ID NO: 198357 - RNA, 23 nt, Human
gggcgacagagugagacgcuguu

SEQ ID NO: 198358 - RNA, 24 nt, Human
gggcgacagagugagacuccaucu

SEQ ID NO: 198359 - RNA, 22 nt, Human
gggcgacagagugagacucccu

SEQ ID NO: 198360 - RNA, 23 nt, Human
gggcgacagagugagacuccguc

SEQ ID NO: 198361 - RNA, 24 nt, Human
gggcgacagagugagacuccgucu

SEQ ID NO: 198362 - RNA, 24 nt, Human
gggcgacagagugagacuccuucu

SEQ ID NO: 198363 - RNA, 24 nt, Human
gggcgacagagugagacucggucu

SEQ ID NO: 198364 - RNA, 24 nt, Human
gggcgacagagugagacucugccu

SEQ ID NO: 198365 - RNA, 24 nt, Human
gggcgacagagugagacucugucu

SEQ ID NO: 198366 - RNA, 24 nt, Human
gggcgacagagugagacuucgacu

SEQ ID NO: 198367 - RNA, 24 nt, Human
gggcgacagagugagacuuugucu

SEQ ID NO: 198368 - RNA, 24 nt, Human
gggcgacagagugagagucugucu

SEQ ID NO: 198369 - RNA, 28 nt, Human
gggcgacagagugagugagacucugucu

SEQ ID NO: 198370 - RNA, 25 nt, Human
gggcgacaggagcaagacucugucu

SEQ ID NO: 198371 - RNA, 24 nt, Human
gggcgacagggugagacccugucu

SEQ ID NO: 198372 - RNA, 24 nt, Human
gggcgacagggugagacuccaucu

SEQ ID NO: 198373 - RNA, 24 nt, Human
gggcgacagucugagacucugucu

SEQ ID NO: 198374 - RNA, 24 nt, Human
gggcgacagugcaagacucugucu

SEQ ID NO: 198375 - RNA, 32 nt, Human
gggcgacauggcuccgucuccacagcggggcu

SEQ ID NO: 198376 - RNA, 21 nt, Human
gggcgaccgagcggggccggc

SEQ ID NO: 198377 - RNA, 28 nt, Human
gggcgaccgcaguucucucuccagggug

SEQ ID NO: 198378 - RNA, 32 nt, Human
gggcgaccucacugcugaugacuuugccccua

SEQ ID NO: 198379 - RNA, 24 nt, Human
gggcgaccuccuuggccaagucug

SEQ ID NO: 198380 - RNA, 24 nt, Human
gggcgacggagcgagacucugucu

SEQ ID NO: 198381 - RNA, 24 nt, Human
gggcgacggagugagacccugucu

SEQ ID NO: 198382 - RNA, 32 nt, Human
gggcgacucaugccucugccucagugggccug

SEQ ID NO: 198383 - RNA, 32 nt, Human
gggcgacuguagucccagcuacucgcgagacu

SEQ ID NO: 198384 - RNA, 32 nt, Human
gggcgagaaaaggaucgcaggagccaggcccu

SEQ ID NO: 198385 - RNA, 32 nt, Human
gggcgagagccccagcccugacccucgguccu

SEQ ID NO: 198386 - RNA, 22 nt, Human
gggcgagagugagacuccgucu

SEQ ID NO: 198387 - RNA, 18 nt, Human
gggcgagcaugggggcug

SEQ ID NO: 198388 - RNA, 32 nt, Human
gggcgagccgagugaagaccugguccuguaga

SEQ ID NO: 198389 - RNA, 32 nt, Human
gggcgagccuaguagcuccugcaggcaggggc

SEQ ID NO: 198390 - RNA, 19 nt, Human
gggcgagcgagagccgggc

SEQ ID NO: 198391 - RNA, 32 nt, Human
gggcgagcgagggagaggagggagagggggag

SEQ ID NO: 198392 - RNA, 32 nt, Human
gggcgagcugggaggcaggaggcagcggccug

SEQ ID NO: 198393 - RNA, 32 nt, Human
gggcgaggaaggagggugcugggggagucagg

SEQ ID NO: 198394 - RNA, 32 nt, Human
gggcgaggacuucgcguuucaggggagggccc

SEQ ID NO: 198395 - RNA, 32 nt, Human
gggcgaggccuaggaagagggucauucuuaag

SEQ ID NO: 198396 - RNA, 32 nt, Human
gggcgagggaggaggaagaagcggaggaggcg

SEQ ID NO: 198397 - RNA, 32 nt, Human
gggcgagggcagcaggggacccagaggugaug

SEQ ID NO: 198398 - RNA, 32 nt, Human
gggcgaggggcagaggccaucagaacugcccg

SEQ ID NO: 198399 - RNA, 32 nt, Human
gggcgaggggcugaggucacaccucgggcacc

SEQ ID NO: 198400 - RNA, 32 nt, Human
gggcgagggguccgggcugagcugcgggccgg

SEQ ID NO: 198401 - RNA, 32 nt, Human
gggcgaguagggagugggggagguggguccaa

SEQ ID NO: 198402 - RNA, 32 nt, Human
gggcgagucuuccuccuuguccuaguuacugc

SEQ ID NO: 198403 - RNA, 32 nt, Human
gggcgagugccacccugacagccccaaggaac

SEQ ID NO: 198404 - RNA, 24 nt, Human
gggcgauagagcaagacucugucu

SEQ ID NO: 198405 - RNA, 24 nt, Human
gggcgauagagugagacucagccu

SEQ ID NO: 198406 - RNA, 32 nt, Human
gggcgauagcaugcaggcugugucugcaccag

SEQ ID NO: 198407 - RNA, 32 nt, Human
gggcgaugaggaaugccauugcagccuagaaa

SEQ ID NO: 198408 - RNA, 32 nt, Human
gggcgaugccuaggggcgaugcugugccugug

SEQ ID NO: 198409 - RNA, 24 nt, Human
gggcgauggagugagacuccaucu

SEQ ID NO: 198410 - RNA, 32 nt, Human
gggcgauugccugggaagccugacagggcggc

SEQ ID NO: 198411 - RNA, 19 nt, Human
gggcgcaacccaccugguc

SEQ ID NO: 198412 - RNA, 32 nt, Human
gggcgcaaggcagacggucuccagccacgaua

SEQ ID NO: 198413 - RNA, 32 nt, Human
gggcgcaagguggcggagggcaguguggguuc

SEQ ID NO: 198414 - RNA, 32 nt, Human
gggcgcacaagccugcacuguccguauagaau

SEQ ID NO: 198415 - RNA, 32 nt, Human
gggcgcacacaucagcagccucaccagcugug

SEQ ID NO: 198416 - RNA, 20 nt, Human
gggcgcacggagggccgggc

SEQ ID NO: 198417 - RNA, 20 nt, Human
gggcgcagcagcuggaacgg

SEQ ID NO: 198418 - RNA, 32 nt, Human
gggcgcagcaguacuuugagaaaauggacgcu

SEQ ID NO: 198419 - RNA, 23 nt, Human
gggcgcagcccuagccuaggaag

SEQ ID NO: 198420 - RNA, 32 nt, Human
gggcgcagccgcgguggcugggcgcggagugu

SEQ ID NO: 198421 - RNA, 32 nt, Human
gggcgcagccuccugaguagcugggaggacag

SEQ ID NO: 198422 - RNA, 32 nt, Human
gggcgcagcgcuccagccauggcgcguucgcu

SEQ ID NO: 198423 - RNA, 32 nt, Human
gggcgcaggaagcagggcgccgcagccugucg

SEQ ID NO: 198424 - RNA, 21 nt, Human
gggcgcagugcgcugcugcca

SEQ ID NO: 198425 - RNA, 23 nt, Human
gggcgcaguggcucacaccugua

SEQ ID NO: 198426 - RNA, 23 nt, Human
gggcgcaguggcucaugccugua

SEQ ID NO: 198427 - RNA, 20 nt, Human
gggcgcaugcgcaagggggc

SEQ ID NO: 198428 - RNA, 32 nt, Human
gggcgcauguugaucgcugguucaguccaggc

SEQ ID NO: 198429 - RNA, 18 nt, Human
gggcgccaaggccggcug

SEQ ID NO: 198430 - RNA, 32 nt, Human
gggcgccacaugcucauggccagaaucuuaaa

SEQ ID NO: 198431 - RNA, 23 nt, Human
gggcgccagcagguggcgcugga

SEQ ID NO: 198432 - RNA, 24 nt, Human
gggcgccagcuucaacgggggcag

SEQ ID NO: 198433 - RNA, 32 nt, Human
gggcgccagugaggaggaagggaaggcgguuc

SEQ ID NO: 198434 - RNA, 32 nt, Human
gggcgccauuugagccucaucucuggcuuccc

SEQ ID NO: 198435 - RNA, 19 nt, Human
gggcgcccacagaaggggc

SEQ ID NO: 198436 - RNA, 19 nt, Human
gggcgcccagacucaggua

SEQ ID NO: 198437 - RNA, 32 nt, Human
gggcgcccagcacugguucagugaacagcauu

SEQ ID NO: 198438 - RNA, 32 nt, Human
gggcgcccagcccaggccugguggagggggag

SEQ ID NO: 198439 - RNA, 32 nt, Human
gggcgccccagccauggcccucaggagcuccc

SEQ ID NO: 198440 - RNA, 32 nt, Human
gggcgcccguaaucccagcuacucgggaggcu

SEQ ID NO: 198441 - RNA, 20 nt, Human
gggcgcccugaggcaagggg

SEQ ID NO: 198442 - RNA, 32 nt, Human
gggcgcccugcuccccucagaucagucaggag

SEQ ID NO: 198443 - RNA, 32 nt, Human
gggcgccgcaaaccacacuggacuccggcccc

SEQ ID NO: 198444 - RNA, 32 nt, Human
gggcgccgcacacgcacccacccacccaccca

SEQ ID NO: 198445 - RNA, 21 nt, Human
gggcgccgccuccggcacugc

SEQ ID NO: 198446 - RNA, 21 nt, Human
gggcgccgcgccgaggggcug

SEQ ID NO: 198447 - RNA, 32 nt, Human
gggcgccggacccuggcccugcccugggugcu

SEQ ID NO: 198448 - RNA, 32 nt, Human
gggcgccggaguggagaaaggagccagcggug

SEQ ID NO: 198449 - RNA, 32 nt, Human
gggcgccggcacuccgguccccgccgcucccc

SEQ ID NO: 198450 - RNA, 32 nt, Human
gggcgccuaaaaucccagcuacucgggagacu

SEQ ID NO: 198451 - RNA, 32 nt, Human
gggcgccuauaaucccagcuacuugggaggcc

SEQ ID NO: 198452 - RNA, 32 nt, Human
gggcgccuauaaucccagcuacuugggaggcu

SEQ ID NO: 198453 - RNA, 32 nt, Human
gggcgccuauaaucccagcuauucuggaggcu

SEQ ID NO: 198454 - RNA, 32 nt, Human
gggcgccucacacucagaaccucauaccccag

SEQ ID NO: 198455 - RNA, 32 nt, Human
gggcgccucccuuucccugcucugccugcggg

SEQ ID NO: 198456 - RNA, 20 nt, Human
gggcgccuccucccgacuga

SEQ ID NO: 198457 - RNA, 32 nt, Human
gggcgccucuagucccagcuacccgggaggcu

SEQ ID NO: 198458 - RNA, 18 nt, Human
gggcgccucucugugcca

SEQ ID NO: 198459 - RNA, 32 nt, Human
gggcgccucuuuccuuucucgcccccuuucau

SEQ ID NO: 198460 - RNA, 32 nt, Human
gggcgccugaggaggaggaggagaagcggaug

SEQ ID NO: 198461 - RNA, 32 nt, Human
gggcgccugcagcucagcugaacuuggcgacc

SEQ ID NO: 198462 - RNA, 32 nt, Human
gggcgccugcagucucagcuacucgggaggcu

SEQ ID NO: 198463 - RNA, 20 nt, Human
gggcgccugcccagcaggag

SEQ ID NO: 198464 - RNA, 22 nt, Human
gggcgccugcggcgaacaggag

SEQ ID NO: 198465 - RNA, 32 nt, Human
gggcgccuggagccacacagggauccggagcc

SEQ ID NO: 198466 - RNA, 25 nt, Human
gggcgccuggguccugcgaaggagc

SEQ ID NO: 198467 - RNA, 32 nt, Human
gggcgccuggucagggagguuuguacaagccu

SEQ ID NO: 198468 - RNA, 32 nt, Human
gggcgccuguaauaucagcuacuugggagacu

SEQ ID NO: 198469 - RNA, 32 nt, Human
gggcgccuguaaucacagcuacuugggaggcu

SEQ ID NO: 198470 - RNA, 32 nt, Human
gggcgccuguaauccaagcuacuggggaggcu

SEQ ID NO: 198471 - RNA, 32 nt, Human
gggcgccuguaaucccaacuacucaggaggcu

SEQ ID NO: 198472 - RNA, 32 nt, Human
gggcgccuguaaucccagauacucaggaggcu

SEQ ID NO: 198473 - RNA, 32 nt, Human
gggcgccuguaaucccagccacuccagaggcu

SEQ ID NO: 198474 - RNA, 32 nt, Human
gggcgccuguaaucccagcuaaucaggaagcu

SEQ ID NO: 198475 - RNA, 32 nt, Human
gggcgccuguaaucccagcuaaucaggaggcu

SEQ ID NO: 198476 - RNA, 32 nt, Human
gggcgccuguaaucccagcuacucaagaggcu

SEQ ID NO: 198477 - RNA, 32 nt, Human
gggcgccuguaaucccagcuacucagaaggcu

SEQ ID NO: 198478 - RNA, 32 nt, Human
gggcgccuguaaucccagcuacucaggagaau

SEQ ID NO: 198479 - RNA, 32 nt, Human
gggcgccuguaaucccagcuacucaggaggcu

SEQ ID NO: 198480 - RNA, 32 nt, Human
gggcgccuguaaucccagcuacucgggaagcu

SEQ ID NO: 198481 - RNA, 32 nt, Human
gggcgccuguaaucccagcuacucgggaggcu

SEQ ID NO: 198482 - RNA, 32 nt, Human
gggcgccuguaaucccagcuacucgggagguu

SEQ ID NO: 198483 - RNA, 32 nt, Human
gggcgccuguaaucccagcuacugagggggcu

SEQ ID NO: 198484 - RNA, 32 nt, Human
gggcgccuguaaucccagcuacuggggaggcu

SEQ ID NO: 198485 - RNA, 32 nt, Human
gggcgccuguaaucccagcuacuugggaagcu

SEQ ID NO: 198486 - RNA, 32 nt, Human
gggcgccuguaaucccagcuacuugggaggcu

SEQ ID NO: 198487 - RNA, 32 nt, Human
gggcgccuguaaucccagcuacuuggguggcu

SEQ ID NO: 198488 - RNA, 32 nt, Human
gggcgccuguaaucccagcuaggaggcugaga

SEQ ID NO: 198489 - RNA, 32 nt, Human
gggcgccuguaaucccagcugcucaggaggcu

SEQ ID NO: 198490 - RNA, 32 nt, Human
gggcgccuguaaucccagcugcuggggaagcu

SEQ ID NO: 198491 - RNA, 32 nt, Human
gggcgccuguaaucccagguacucaggaggcu

SEQ ID NO: 198492 - RNA, 32 nt, Human
gggcgccuguaaucccaguuacucgggaggcu

SEQ ID NO: 198493 - RNA, 32 nt, Human
gggcgccuguaauccuagcugcuugggaggcu

SEQ ID NO: 198494 - RNA, 32 nt, Human
gggcgccuguaaucucagcuacuugggaggcu

SEQ ID NO: 198495 - RNA, 32 nt, Human
gggcgccuguaauuccagcuacucaggaggcu

SEQ ID NO: 198496 - RNA, 32 nt, Human
gggcgccuguaauuccagcuacucaggagucu

SEQ ID NO: 198497 - RNA, 32 nt, Human
gggcgccuguaauuccagcuacucaggggguu

SEQ ID NO: 198498 - RNA, 32 nt, Human
gggcgccuguaauuccagcuacucgggaggcu

SEQ ID NO: 198499 - RNA, 32 nt, Human
gggcgccuguaauuccagcuacucuggaagcu

SEQ ID NO: 198500 - RNA, 32 nt, Human
gggcgccuguagccccagcuacucgggaggcu

SEQ ID NO: 198501 - RNA, 32 nt, Human
gggcgccuguagccccagcuacuugggaggcu

SEQ ID NO: 198502 - RNA, 32 nt, Human
gggcgccuguagucccagcuacgugggaggcu

SEQ ID NO: 198503 - RNA, 32 nt, Human
gggcgccuguagucccagcuacucaggaggcu

SEQ ID NO: 198504 - RNA, 32 nt, Human
gggcgccuguagucccagcuacucgggagacu

SEQ ID NO: 198505 - RNA, 32 nt, Human
gggcgccuguagucccagcuacucgggaggcu

SEQ ID NO: 198506 - RNA, 32 nt, Human
gggcgccuguagucccagcuacucggggcgcu

SEQ ID NO: 198507 - RNA, 32 nt, Human
gggcgccuguagucccagcuacucugaagacu

SEQ ID NO: 198508 - RNA, 32 nt, Human
gggcgccuguagucccagcuacucuggaggcu

SEQ ID NO: 198509 - RNA, 32 nt, Human
gggcgccuguagucccagcuacuggggaggcu

SEQ ID NO: 198510 - RNA, 32 nt, Human
gggcgccuguagucccagcuacuuggaaggcu

SEQ ID NO: 198511 - RNA, 32 nt, Human
gggcgccuguagucccagcuacuugggaagcu

SEQ ID NO: 198512 - RNA, 32 nt, Human
gggcgccuguagucccagcuacuugggaggca

SEQ ID NO: 198513 - RNA, 32 nt, Human
gggcgccuguagucccagcuacuugggaggcu

SEQ ID NO: 198514 - RNA, 32 nt, Human
gggcgccuguagucccagcuacuugguaggcu

SEQ ID NO: 198515 - RNA, 32 nt, Human
gggcgccuguagucccagcuaugcgagaggcu

SEQ ID NO: 198516 - RNA, 32 nt, Human
gggcgccuguagucccagcuauucgggaggcu

SEQ ID NO: 198517 - RNA, 32 nt, Human
gggcgccuguagucccagcuauuugggaggcu

SEQ ID NO: 198518 - RNA, 32 nt, Human
gggcgccuguagucccagcugcucgggaggcu

SEQ ID NO: 198519 - RNA, 32 nt, Human
gggcgccuguagucucagcuacucgggaggcu

SEQ ID NO: 198520 - RNA, 32 nt, Human
gggcgccuguaguuccagcuacucgggaggcu

SEQ ID NO: 198521 - RNA, 32 nt, Human
gggcgccuguaguucuagcuacucuggaggcu

SEQ ID NO: 198522 - RNA, 32 nt, Human
gggcgccuguaucccagcuacucgggaggcug

SEQ ID NO: 198523 - RNA, 32 nt, Human
gggcgccuguauucccagcuacucgggaggcu

SEQ ID NO: 198524 - RNA, 32 nt, Human
gggcgccuguauucccagcuacuggggaggcu

SEQ ID NO: 198525 - RNA, 32 nt, Human
gggcgccuguauucccagcuucucgggaggcu

SEQ ID NO: 198526 - RNA, 32 nt, Human
gggcgccuguggucccagcuacucgggaggcu

SEQ ID NO: 198527 - RNA, 32 nt, Human
gggcgccuguggucccagcuacuggggaggcu

SEQ ID NO: 198528 - RNA, 32 nt, Human
gggcgccugugguccuagcuacucgggaggcu

SEQ ID NO: 198529 - RNA, 32 nt, Human
gggcgccuguuaucccagcuacuugggaggcu

SEQ ID NO: 198530 - RNA, 32 nt, Human
gggcgccuguucucuguccggaccagccagcg

SEQ ID NO: 198531 - RNA, 32 nt, Human
gggcgccuuuagucgcagcuacuggggaggcu

SEQ ID NO: 198532 - RNA, 23 nt, Human
gggcgcgagagcggcgcuggggg

SEQ ID NO: 198533 - RNA, 22 nt, Human
gggcgcgagcaauacucaggca

SEQ ID NO: 198534 - RNA, 32 nt, Human
gggcgcgagccgcggcggcgccgcugcgggag

SEQ ID NO: 198535 - RNA, 32 nt, Human
gggcgcgaggcugaagccacugggauuugacg

SEQ ID NO: 198536 - RNA, 32 nt, Human
gggcgcgauggcggaggcuguacugagggucg

SEQ ID NO: 198537 - RNA, 22 nt, Human
gggcgcgcaccccagcauucca

SEQ ID NO: 198538 - RNA, 21 nt, Human
gggcgcgcaguagagcagcag

SEQ ID NO: 198539 - RNA, 32 nt, Human
gggcgcgccgccucugccccgcggcgagggug

SEQ ID NO: 198540 - RNA, 32 nt, Human
gggcgcgccucugcacuaacucaggccaggua

SEQ ID NO: 198541 - RNA, 18 nt, Human
gggcgcgcggcggggcgg

SEQ ID NO: 198542 - RNA, 19 nt, Human
gggcgcgcggggccugcgg

SEQ ID NO: 198543 - RNA, 32 nt, Human
gggcgcgcuagugcucguuguagccuuuugcu

SEQ ID NO: 198544 - RNA, 18 nt, Human
gggcgcgcucccuccuua

SEQ ID NO: 198545 - RNA, 20 nt, Human
gggcgcgcucugcaaagggg

SEQ ID NO: 198546 - RNA, 32 nt, Human
gggcgcgcugggaugucacagaguuggaguca

SEQ ID NO: 198547 - RNA, 32 nt, Human
gggcgcgcuuucucccugcgggucucaguaau

SEQ ID NO: 198548 - RNA, 32 nt, Human
gggcgcggaccagacagaccucgggucaggcc

SEQ ID NO: 198549 - RNA, 32 nt, Human
gggcgcggaggaugaggccgcugccuggcgcu

SEQ ID NO: 198550 - RNA, 32 nt, Human
gggcgcggcaccgcaccgcucccuucaccuug

SEQ ID NO: 198551 - RNA, 32 nt, Human
gggcgcggccuccggcggaggagggaacagcu

SEQ ID NO: 198552 - RNA, 32 nt, Human
gggcgcgggagagagcgcgggcggccgccggg

SEQ ID NO: 198553 - RNA, 22 nt, Human
gggcgcgggaggaggaaguaga

SEQ ID NO: 198554 - RNA, 32 nt, Human
gggcgcgggaggaggaaguagagcccgggacc

SEQ ID NO: 198555 - RNA, 32 nt, Human
gggcgcgggaguacgcgagagcagggaugggg

SEQ ID NO: 198556 - RNA, 32 nt, Human
gggcgcgggagugagagagggugagucagcca

SEQ ID NO: 198557 - RNA, 32 nt, Human
gggcgcgguaagagguggcggcgggcagaggg

SEQ ID NO: 198558 - RNA, 23 nt, Human
gggcgcgguggcucaagccugua

SEQ ID NO: 198559 - RNA, 23 nt, Human
gggcgcgguggcucacaccugua

SEQ ID NO: 198560 - RNA, 23 nt, Human
gggcgcgguggcucacaucugua

SEQ ID NO: 198561 - RNA, 23 nt, Human
gggcgcgguggcucacgccugua

SEQ ID NO: 198562 - RNA, 23 nt, Human
gggcgcgguggcucaucccugua

SEQ ID NO: 198563 - RNA, 23 nt, Human
gggcgcgguggcucaugccugua

SEQ ID NO: 198564 - RNA, 23 nt, Human
gggcgcgguggcucaugcuugua

SEQ ID NO: 198565 - RNA, 23 nt, Human
gggcgcgguggcucgugcuugua

SEQ ID NO: 198566 - RNA, 23 nt, Human
gggcgcgguggcuuaugccugua

SEQ ID NO: 198567 - RNA, 23 nt, Human
gggcgcggugguucaugccugua

SEQ ID NO: 198568 - RNA, 32 nt, Human
gggcgcguggaggaggaggaaaaggagggaaa

SEQ ID NO: 198569 - RNA, 32 nt, Human
gggcgcgugguuuucccaucucaucccuggag

SEQ ID NO: 198570 - RNA, 32 nt, Human
gggcgcuagccuggcccgacugggcgaguccc

SEQ ID NO: 198571 - RNA, 32 nt, Human
gggcgcucacugagcaccaugugucaucacag

SEQ ID NO: 198572 - RNA, 32 nt, Human
gggcgcucagaggcgguugugagcagugcaga

SEQ ID NO: 198573 - RNA, 20 nt, Human
gggcgcucagugacaagggc

SEQ ID NO: 198574 - RNA, 19 nt, Human
gggcgcuccaagaagaggc

SEQ ID NO: 198575 - RNA, 19 nt, Human
gggcgcucccagaaggagc

SEQ ID NO: 198576 - RNA, 32 nt, Human
gggcgcucccagagcaaacgaggucccugaga

SEQ ID NO: 198577 - RNA, 21 nt, Human
gggcgcuccccggccacaggc

SEQ ID NO: 198578 - RNA, 22 nt, Human
gggcgcuccccugagcccgggc

SEQ ID NO: 198579 - RNA, 26 nt, Human
gggcgcuccgggcucugagcccgcag

SEQ ID NO: 198580 - RNA, 21 nt, Human
gggcgcuccucaggcaaaggg

SEQ ID NO: 198581 - RNA, 32 nt, Human
gggcgcuccucccagcuguaccggccacugca

SEQ ID NO: 198582 - RNA, 18 nt, Human
gggcgcucgcagggggca

SEQ ID NO: 198583 - RNA, 20 nt, Human
gggcgcucggaccaggcagc

SEQ ID NO: 198584 - RNA, 32 nt, Human
gggcgcucuccucacccccacgucuccugggu

SEQ ID NO: 198585 - RNA, 32 nt, Human
gggcgcucucugaggacagagcugguggggcg

SEQ ID NO: 198586 - RNA, 32 nt, Human
gggcgcucuggcccucccuuccuuaagcccag

SEQ ID NO: 198587 - RNA, 32 nt, Human
gggcgcugagccaggggcaggcgcuggaaaca

SEQ ID NO: 198588 - RNA, 32 nt, Human
gggcgcugaggcaggagaaucgcucgaaccca

SEQ ID NO: 198589 - RNA, 19 nt, Human
gggcgcugcagaggggcug

SEQ ID NO: 198590 - RNA, 32 nt, Human
gggcgcugcgugggcccugcacuugcugaggu

SEQ ID NO: 198591 - RNA, 32 nt, Human
gggcgcuggccacgucgcccugggugaccuuc

SEQ ID NO: 198592 - RNA, 23 nt, Human
gggcgcuggccuaccuccugagg

SEQ ID NO: 198593 - RNA, 32 nt, Human
gggcgcugggagaagcggggcagcgcugagcc

SEQ ID NO: 198594 - RNA, 32 nt, Human
gggcgcugggaggccggcgcggcggcugggag

SEQ ID NO: 198595 - RNA, 32 nt, Human
gggcgcuggggaaucuuccuccccagcccccg

SEQ ID NO: 198596 - RNA, 32 nt, Human
gggcgcuggggcccaacugcucugcuccguau

SEQ ID NO: 198597 - RNA, 32 nt, Human
gggcgcugguaaucccagcuacucagguggcu

SEQ ID NO: 198598 - RNA, 32 nt, Human
gggcgcugguugggcuuggagcucaggcugcu

SEQ ID NO: 198599 - RNA, 32 nt, Human
gggcgcuguccgacgccugccccaccaugucc

SEQ ID NO: 198600 - RNA, 32 nt, Human
gggcgcugugagaguaucaagagguacugagg

SEQ ID NO: 198601 - RNA, 19 nt, Human
gggcgcugugaguggggug

SEQ ID NO: 198602 - RNA, 32 nt, Human
gggcgcugugcgucuccaguccgggaccgaag

SEQ ID NO: 198603 - RNA, 23 nt, Human
gggcgcuguggcucacaccugua

SEQ ID NO: 198604 - RNA, 32 nt, Human
gggcgcuguucuugcaaggauccucuguugaa

SEQ ID NO: 198605 - RNA, 32 nt, Human
gggcgcuugaguugcugagaugcaaggaauuc

SEQ ID NO: 198606 - RNA, 24 nt, Human
gggcgcuugccaagggccaggcug

SEQ ID NO: 198607 - RNA, 16 nt, Human
gggcggaacacacuug

SEQ ID NO: 198608 - RNA, 32 nt, Human
gggcggaagaggaggaggaggaggaggaaggg

SEQ ID NO: 198609 - RNA, 32 nt, Human
gggcggaaggaggagagguguugcgguuugcc

SEQ ID NO: 198610 - RNA, 32 nt, Human
gggcggaaggcagcugcacagagcagggccac

SEQ ID NO: 198611 - RNA, 32 nt, Human
gggcggaagggccuguggacagcccacccagg

SEQ ID NO: 198612 - RNA, 32 nt, Human
gggcggacaacaaacgacauuuccuuugggac

SEQ ID NO: 198613 - RNA, 17 nt, Human
gggcggaccgcggcagg

SEQ ID NO: 198614 - RNA, 32 nt, Human
gggcggagaacaagucggcuguggagaugcgg

SEQ ID NO: 198615 - RNA, 20 nt, Human
gggcggagacugcggggcgg

SEQ ID NO: 198616 - RNA, 32 nt, Human
gggcggagagagaaggaaggaggugguugugc

SEQ ID NO: 198617 - RNA, 19 nt, Human
gggcggagagagggggcag

SEQ ID NO: 198618 - RNA, 18 nt, Human
gggcggagagggggacag

SEQ ID NO: 198619 - RNA, 32 nt, Human
gggcggagcugaggacaggccuuggcuggucc

SEQ ID NO: 198620 - RNA, 24 nt, Human
gggcggaggagacccaggaagcug

SEQ ID NO: 198621 - RNA, 32 nt, Human
gggcggaggcggcggccagggaggaagcggag

SEQ ID NO: 198622 - RNA, 21 nt, Human
gggcggaggcggcgggagcgg

SEQ ID NO: 198623 - RNA, 21 nt, Human
gggcggaggcggcgggcgagg

SEQ ID NO: 198624 - RNA, 32 nt, Human
gggcggagggaggagagcagguuucagauccu

SEQ ID NO: 198625 - RNA, 32 nt, Human
gggcggaggggaggggcagggggcggugccac

SEQ ID NO: 198626 - RNA, 19 nt, Human
gggcggagguugcagugag

SEQ ID NO: 198627 - RNA, 32 nt, Human
gggcggagugcggggcagaggggugggggcug

SEQ ID NO: 198628 - RNA, 32 nt, Human
gggcggaguuuccaagauaacagcuauugugu

SEQ ID NO: 198629 - RNA, 22 nt, Human
gggcggaucaccugaggucagg

SEQ ID NO: 198630 - RNA, 20 nt, Human
gggcggaucacgaggucagg

SEQ ID NO: 198631 - RNA, 22 nt, Human
gggcggaucagcagaggucagg

SEQ ID NO: 198632 - RNA, 22 nt, Human
gggcggaucgcuugagcccagg

SEQ ID NO: 198633 - RNA, 22 nt, Human
gggcggaucgguugagcucagg

SEQ ID NO: 198634 - RNA, 32 nt, Human
gggcggaucucccuggccagcagggaugggag

SEQ ID NO: 198635 - RNA, 32 nt, Human
gggcggauggagccucaccacgccugaguccc

SEQ ID NO: 198636 - RNA, 22 nt, Human
gggcggauugccugagcucagg

SEQ ID NO: 198637 - RNA, 32 nt, Human
gggcggcagagcuggagugacgggagcuagug

SEQ ID NO: 198638 - RNA, 24 nt, Human
gggcggcagagugagacucugucu

SEQ ID NO: 198639 - RNA, 20 nt, Human
gggcggcagcagcagcuucc

SEQ ID NO: 198640 - RNA, 32 nt, Human
gggcggcaggaucagagugaaagcagaggcgu

SEQ ID NO: 198641 - RNA, 32 nt, Human
gggcggcagggcagugccacggcuggcugcag

SEQ ID NO: 198642 - RNA, 32 nt, Human
gggcggcaucggucagaagcaccaagacugag

SEQ ID NO: 198643 - RNA, 20 nt, Human
gggcggccacaauuucgcgc

SEQ ID NO: 198644 - RNA, 21 nt, Human
gggcggccacagauuacacug

SEQ ID NO: 198645 - RNA, 23 nt, Human
gggcggccagagcagcacagcug

SEQ ID NO: 198646 - RNA, 32 nt, Human
gggcggccauggagcugggcagcugcuucaag

SEQ ID NO: 198647 - RNA, 18 nt, Human
gggcggccauucgggcag

SEQ ID NO: 198648 - RNA, 32 nt, Human
gggcggcccagccucugagucccguggggccc

SEQ ID NO: 198649 - RNA, 32 nt, Human
gggcggccccuggacgaaggucugaaucccga

SEQ ID NO: 198650 - RNA, 19 nt, Human
gggcggcccggcaagcagc

SEQ ID NO: 198651 - RNA, 32 nt, Human
gggcggcccuggaggagacggaggccgcgggu

SEQ ID NO: 198652 - RNA, 18 nt, Human
gggcggcccuggccgggg

SEQ ID NO: 198653 - RNA, 23 nt, Human
gggcggccgaaaggggggcggug

SEQ ID NO: 198654 - RNA, 22 nt, Human
gggcggccgaggcaggaagcug

SEQ ID NO: 198655 - RNA, 32 nt, Human
gggcggccuacaaggcagcccagaaucuacug

SEQ ID NO: 198656 - RNA, 32 nt, Human
gggcggccugagaagauauuauggcugcugcc

SEQ ID NO: 198657 - RNA, 32 nt, Human
gggcggccugcaggaaccugcuccagguggac

SEQ ID NO: 198658 - RNA, 32 nt, Human
gggcggcgagauuguuuuuggugauuuggauu

SEQ ID NO: 198659 - RNA, 32 nt, Human
gggcggcgcacgagcaggagcgcccacggagc

SEQ ID NO: 198660 - RNA, 20 nt, Human
gggcggcgcgagggaggcug

SEQ ID NO: 198661 - RNA, 32 nt, Human
gggcggcggcgccgaggggaggagagcggccc

SEQ ID NO: 198662 - RNA, 32 nt, Human
gggcggcggcgccgggggcaugcgggugagcc

SEQ ID NO: 198663 - RNA, 32 nt, Human
gggcggcggcggccgaggcugaaggaagaugg

SEQ ID NO: 198664 - RNA, 21 nt, Human
gggcggcggcggcggcugcgg

SEQ ID NO: 198665 - RNA, 25 nt, Human
gggcggcggcggcggugggaggagg

SEQ ID NO: 198666 - RNA, 32 nt, Human
gggcggcggcgggguguguguccucuguuaag

SEQ ID NO: 198667 - RNA, 32 nt, Human
gggcggcggcuccugcuggaugcagcuccuug

SEQ ID NO: 198668 - RNA, 17 nt, Human
gggcggcgggccugcag

SEQ ID NO: 198669 - RNA, 32 nt, Human
gggcggcgggcggcgagcgggggaagauggcg

SEQ ID NO: 198670 - RNA, 32 nt, Human
gggcggcgggcggcugggucugugcauuucug

SEQ ID NO: 198671 - RNA, 32 nt, Human
gggcggcggugcagcccagcagccuggagaug

SEQ ID NO: 198672 - RNA, 32 nt, Human
gggcggcggugcuggagguugcggcggcggcu

SEQ ID NO: 198673 - RNA, 32 nt, Human
gggcggcgucacugcacccuccgccaggcucc

SEQ ID NO: 198674 - RNA, 32 nt, Human
gggcggcgugggaggcugggccgcagugagug

SEQ ID NO: 198675 - RNA, 32 nt, Human
gggcggcuauaaucccagccacucgggaggcu

SEQ ID NO: 198676 - RNA, 18 nt, Human
gggcggcucggggcccag

SEQ ID NO: 198677 - RNA, 32 nt, Human
gggcggcugaaagcuggaggggccaagacuga

SEQ ID NO: 198678 - RNA, 32 nt, Human
gggcggcugagacgcaagacuugcuugaaccc

SEQ ID NO: 198679 - RNA, 32 nt, Human
gggcggcugcagcugcugccuccacuucccua

SEQ ID NO: 198680 - RNA, 23 nt, Human
gggcggcugcguagcuguggucc

SEQ ID NO: 198681 - RNA, 32 nt, Human
gggcggcuggagccccugcacacacaauggaa

SEQ ID NO: 198682 - RNA, 32 nt, Human
gggcggcuggcgcgcacuacacgcuugggaac

SEQ ID NO: 198683 - RNA, 32 nt, Human
gggcggcugggcaggcggcaggaaugcugcgc

SEQ ID NO: 198684 - RNA, 32 nt, Human
gggcggcuugcuguccagccugugugggggcc

SEQ ID NO: 198685 - RNA, 23 nt, Human
gggcggcuugucccaggcugcug

SEQ ID NO: 198686 - RNA, 32 nt, Human
gggcgggaagcgaagaggcgggcgggccagcg

SEQ ID NO: 198687 - RNA, 18 nt, Human
gggcgggaaggggcacgg

SEQ ID NO: 198688 - RNA, 32 nt, Human
gggcgggaaggugcucccuggauauacucugu

SEQ ID NO: 198689 - RNA, 32 nt, Human
gggcgggacagcggcccccuggagggggcagu

SEQ ID NO: 198690 - RNA, 32 nt, Human
gggcgggacaugcacacaaugugaaacagaca

SEQ ID NO: 198691 - RNA, 32 nt, Human
gggcgggacuccucccuggggguggggcuccu

SEQ ID NO: 198692 - RNA, 32 nt, Human
gggcgggagaagaaugaauccucugagguccc

SEQ ID NO: 198693 - RNA, 32 nt, Human
gggcgggagagaggaagagaggggagcgcggu

SEQ ID NO: 198694 - RNA, 32 nt, Human
gggcgggagcgggggcgagggagcaggagcgg

SEQ ID NO: 198695 - RNA, 19 nt, Human
gggcgggagcucggcgcgg

SEQ ID NO: 198696 - RNA, 18 nt, Human
gggcgggaggaggcgcgg

SEQ ID NO: 198697 - RNA, 21 nt, Human
gggcgggaggaguggcagcgg

SEQ ID NO: 198698 - RNA, 32 nt, Human
gggcgggagggagggaguggaggagccgggga

SEQ ID NO: 198699 - RNA, 22 nt, Human
gggcgggagggcguaguggcgg

SEQ ID NO: 198700 - RNA, 32 nt, Human
gggcgggaggggcgcgccauggaggcgccggg

SEQ ID NO: 198701 - RNA, 32 nt, Human
gggcgggcacagaaccagccuccugaauucca

SEQ ID NO: 198702 - RNA, 18 nt, Human
gggcgggcagcagcuccc

SEQ ID NO: 198703 - RNA, 32 nt, Human
gggcgggcaggaagcccucucccaagaucgag

SEQ ID NO: 198704 - RNA, 32 nt, Human
gggcgggcaggaccccgucuccccaggugucg

SEQ ID NO: 198705 - RNA, 32 nt, Human
gggcgggcagggagguauuuauuuauuuauuc

SEQ ID NO: 198706 - RNA, 32 nt, Human
gggcgggcaguggauaguaagacuuacugcag

SEQ ID NO: 198707 - RNA, 32 nt, Human
gggcgggccaggacaucagcgccgaccuggac

SEQ ID NO: 198708 - RNA, 32 nt, Human
gggcgggccauggcggcgaaccugagccggaa

SEQ ID NO: 198709 - RNA, 32 nt, Human
gggcgggccucugggcagaggaugcaauggca

SEQ ID NO: 198710 - RNA, 20 nt, Human
gggcgggcgcaagggggcgg

SEQ ID NO: 198711 - RNA, 32 nt, Human
gggcgggcgcgccgggccuggggaaggggcgg

SEQ ID NO: 198712 - RNA, 21 nt, Human
gggcgggcgcggggggcgcgg

SEQ ID NO: 198713 - RNA, 32 nt, Human
gggcgggcggccgggagccauggagcgcggcc

SEQ ID NO: 198714 - RNA, 32 nt, Human
gggcgggcggcgcggaguagguggcggcggcc

SEQ ID NO: 198715 - RNA, 32 nt, Human
gggcgggcggggagcugccucggguggccucg

SEQ ID NO: 198716 - RNA, 24 nt, Human
gggcgggcggugggcggggcgcgg

SEQ ID NO: 198717 - RNA, 32 nt, Human
gggcgggcuccaggcuccagccagaacuuuac

SEQ ID NO: 198718 - RNA, 32 nt, Human
gggcgggcugaggagacgcucucuccacggcu

SEQ ID NO: 198719 - RNA, 32 nt, Human
gggcgggcuggcucuuuugcagcuugugauuu

SEQ ID NO: 198720 - RNA, 32 nt, Human
gggcgggcuuuuggcaggcagaucuuacuagu

SEQ ID NO: 198721 - RNA, 32 nt, Human
gggcggggaaauucauauccccuguucgucuc

SEQ ID NO: 198722 - RNA, 32 nt, Human
gggcggggaccgagcuagcggagccagcgcag

SEQ ID NO: 198723 - RNA, 32 nt, Human
gggcggggagaagggaaggacucgaugguacc

SEQ ID NO: 198724 - RNA, 32 nt, Human
gggcggggagaagggcuagcauccccauccaa

SEQ ID NO: 198725 - RNA, 32 nt, Human
gggcggggagagaggcgcgaggcggcagacac

SEQ ID NO: 198726 - RNA, 32 nt, Human
gggcggggagcacaggccguguccgcucgcuu

SEQ ID NO: 198727 - RNA, 32 nt, Human
gggcggggagcagacucgggggccaaggccca

SEQ ID NO: 198728 - RNA, 32 nt, Human
gggcggggagcggagcuuccuccucugagggc

SEQ ID NO: 198729 - RNA, 17 nt, Human
gggcggggagggggcag

SEQ ID NO: 198730 - RNA, 17 nt, Human
gggcggggaggggggug

SEQ ID NO: 198731 - RNA, 32 nt, Human
gggcggggcagauggcgagggagcggggcgag

SEQ ID NO: 198732 - RNA, 21 nt, Human
gggcggggcaggaccgaccuc

SEQ ID NO: 198733 - RNA, 17 nt, Human
gggcggggcaggggcag

SEQ ID NO: 198734 - RNA, 18 nt, Human
gggcggggccgggcccgg

SEQ ID NO: 198735 - RNA, 15 nt, Human
gggcggggccucuga

SEQ ID NO: 198736 - RNA, 32 nt, Human
gggcggggcgcgcggugacagcgcgggguugg

SEQ ID NO: 198737 - RNA, 32 nt, Human
gggcggggcugagagaggguaucagggacagg

SEQ ID NO: 198738 - RNA, 32 nt, Human
gggcggggcuucccugaccugaaggcgucggg

SEQ ID NO: 198739 - RNA, 32 nt, Human
gggcgggggcaggcauggacagcugggccaug

SEQ ID NO: 198740 - RNA, 16 nt, Human
gggcgggggcggggug

SEQ ID NO: 198741 - RNA, 32 nt, Human
gggcgggguagggaugcagcugugcugcauuc

SEQ ID NO: 198742 - RNA, 21 nt, Human
gggcgggguaggggagggcag

SEQ ID NO: 198743 - RNA, 17 nt, Human
gggcggggugggggcag

SEQ ID NO: 198744 - RNA, 32 nt, Human
gggcggggugugaggcgcugcggacgggguug

SEQ ID NO: 198745 - RNA, 32 nt, Human
gggcgggugccacaccugugcgggcaagggcg

SEQ ID NO: 198746 - RNA, 32 nt, Human
gggcgggugugcaggcucacaggcucuggaaa

SEQ ID NO: 198747 - RNA, 32 nt, Human
gggcgguagaggggagguugggguuggagcag

SEQ ID NO: 198748 - RNA, 32 nt, Human
gggcgguccgggguggugggaaagcgccaagc

SEQ ID NO: 198749 - RNA, 32 nt, Human
gggcggucggugcucccugcuuuccaggguuc

SEQ ID NO: 198750 - RNA, 32 nt, Human
gggcggugacauauuggaccagaagaggcacu

SEQ ID NO: 198751 - RNA, 21 nt, Human
gggcggugccggcgccggaga

SEQ ID NO: 198752 - RNA, 32 nt, Human
gggcgguggagguggugaggaggaucuuuaaa

SEQ ID NO: 198753 - RNA, 32 nt, Human
gggcggugggaggcggcggcggcggcggcgcu

SEQ ID NO: 198754 - RNA, 32 nt, Human
gggcggugggcagggugcagcagugagcaaaa

SEQ ID NO: 198755 - RNA, 32 nt, Human
gggcggugggugggaugguggagcagccuggg

SEQ ID NO: 198756 - RNA, 32 nt, Human
gggcgguguccaggggcgguuccagugaucag

SEQ ID NO: 198757 - RNA, 32 nt, Human
gggcggugugggcucuggaagugcauggucca

SEQ ID NO: 198758 - RNA, 32 nt, Human
gggcggugugugugccaugucacagcauggcc

SEQ ID NO: 198759 - RNA, 32 nt, Human
gggcgguucuagcucuucccacccucacugcg

SEQ ID NO: 198760 - RNA, 32 nt, Human
gggcgguuuaaccauuugaggcuuuuccuucu

SEQ ID NO: 198761 - RNA, 32 nt, Human
gggcguacggagguggcagcugugggaggagg

SEQ ID NO: 198762 - RNA, 23 nt, Human
gggcguaguggcacaugccugua

SEQ ID NO: 198763 - RNA, 23 nt, Human
gggcguaguggugcaugccugua

SEQ ID NO: 198764 - RNA, 32 nt, Human
gggcguaguuccuaauccccuuuccgggcagc

SEQ ID NO: 198765 - RNA, 16 nt, Human
gggcgucacguggcag

SEQ ID NO: 198766 - RNA, 18 nt, Human
gggcgucagcagcggcgg

SEQ ID NO: 198767 - RNA, 20 nt, Human
gggcgucagggauccugcug

SEQ ID NO: 198768 - RNA, 32 nt, Human
gggcgucaguuuucucuggcucgcuccccuuu

SEQ ID NO: 198769 - RNA, 20 nt, Human
gggcguccagaaggccaggc

SEQ ID NO: 198770 - RNA, 24 nt, Human
gggcgucccaagagccgcuggcug

SEQ ID NO: 198771 - RNA, 24 nt, Human
gggcgucccaagagcugcuggcug

SEQ ID NO: 198772 - RNA, 32 nt, Human
gggcgucccacuggcucugaucuugcuuccug

SEQ ID NO: 198773 - RNA, 24 nt, Human
gggcgucccgaaagcggcuggcug

SEQ ID NO: 198774 - RNA, 24 nt, Human
gggcgucccgagagcaguuggcug

SEQ ID NO: 198775 - RNA, 25 nt, Human
gggcgucccgagagccggcuggcug

SEQ ID NO: 198776 - RNA, 23 nt, Human
gggcgucccgagagcggcuggcu

SEQ ID NO: 198777 - RNA, 23 nt, Human
gggcgucccgagcgagcuggcug

SEQ ID NO: 198778 - RNA, 25 nt, Human
gggcgucccggaacacggcuggcug

SEQ ID NO: 198779 - RNA, 25 nt, Human
gggcgucccggaagauggcuggcug

SEQ ID NO: 198780 - RNA, 24 nt, Human
gggcgucccggaagcagcugguug

SEQ ID NO: 198781 - RNA, 32 nt, Human
gggcgucccucuccucucuccccagucucuag

SEQ ID NO: 198782 - RNA, 18 nt, Human
gggcguccgcgguggcug

SEQ ID NO: 198783 - RNA, 32 nt, Human
gggcgucuagggccucgcuucaagguuacuga

SEQ ID NO: 198784 - RNA, 20 nt, Human
gggcgucuccgcggcuacug

SEQ ID NO: 198785 - RNA, 32 nt, Human
gggcgucugcagcugcccugcccgugcccgcc

SEQ ID NO: 198786 - RNA, 32 nt, Human
gggcgucuugguugaaucuuuugcuacaaacc

SEQ ID NO: 198787 - RNA, 32 nt, Human
gggcgugagccaccgcgcccagcuucuggaaa

SEQ ID NO: 198788 - RNA, 32 nt, Human
gggcgugaggcgaggaaggagggguguuaggc

SEQ ID NO: 198789 - RNA, 32 nt, Human
gggcgugaugcugcuggcacugguuggguacc

SEQ ID NO: 198790 - RNA, 32 nt, Human
gggcgugcagcuccgaagcucuuuggaccuag

SEQ ID NO: 198791 - RNA, 32 nt, Human
gggcgugccucuaguuccagcuacucgggagu

SEQ ID NO: 198792 - RNA, 16 nt, Human
gggcgugcuccaggca

SEQ ID NO: 198793 - RNA, 32 nt, Human
gggcgugcucucucagacacacaacucagcua

SEQ ID NO: 198794 - RNA, 32 nt, Human
gggcgugcugggaucucgaggcggggccucug

SEQ ID NO: 198795 - RNA, 32 nt, Human
gggcguggaagagacuggccgcgcacaugcgu

SEQ ID NO: 198796 - RNA, 32 nt, Human
gggcguggaagcucugcaucccuucucccaua

SEQ ID NO: 198797 - RNA, 32 nt, Human
gggcguggagacggcgggggagguggaggugc

SEQ ID NO: 198798 - RNA, 32 nt, Human
gggcguggagagaauucuucuguggguccucu

SEQ ID NO: 198799 - RNA, 23 nt, Human
gggcguggaggcucaugccugua

SEQ ID NO: 198800 - RNA, 17 nt, Human
gggcguggaguggcgug

SEQ ID NO: 198801 - RNA, 23 nt, Human
gggcguggcggcacaugccugua

SEQ ID NO: 198802 - RNA, 32 nt, Human
gggcguggcggggaggaggaggaggacaagga

SEQ ID NO: 198803 - RNA, 32 nt, Human
gggcguggcugcugugucuguguguugugggg

SEQ ID NO: 198804 - RNA, 32 nt, Human
gggcguggcuuccuggugaugggaagggucuu

SEQ ID NO: 198805 - RNA, 32 nt, Human
gggcgugggaggcagaagacacugaagaauuu

SEQ ID NO: 198806 - RNA, 32 nt, Human
gggcgugggagggagagaggcggggaaaagca

SEQ ID NO: 198807 - RNA, 32 nt, Human
gggcguggggcgcgcugcggagcggagccgcg

SEQ ID NO: 198808 - RNA, 23 nt, Human
gggcgugguagcgggugccugua

SEQ ID NO: 198809 - RNA, 23 nt, Human
gggcgugguagcucaugccugua

SEQ ID NO: 198810 - RNA, 23 nt, Human
gggcguggugacacgugccugua

SEQ ID NO: 198811 - RNA, 32 nt, Human
gggcguggugcaugccuguaaucccagccacu

SEQ ID NO: 198812 - RNA, 32 nt, Human
gggcgugguggacugaaaggccccgaggucac

SEQ ID NO: 198813 - RNA, 32 nt, Human
gggcgugguggaggaaggggugcuggaacaau

SEQ ID NO: 198814 - RNA, 23 nt, Human
gggcgugguggcacacgccugua

SEQ ID NO: 198815 - RNA, 23 nt, Human
gggcgugguggcacacuccugua

SEQ ID NO: 198816 - RNA, 23 nt, Human
gggcgugguggcacaugccugua

SEQ ID NO: 198817 - RNA, 23 nt, Human
gggcgugguggcacauuccugua

SEQ ID NO: 198818 - RNA, 23 nt, Human
gggcgugguggcacgcaccugua

SEQ ID NO: 198819 - RNA, 23 nt, Human
gggcgugguggcacgcgccugua

SEQ ID NO: 198820 - RNA, 23 nt, Human
gggcgugguggcaggcaccugua

SEQ ID NO: 198821 - RNA, 23 nt, Human
gggcgugguggcaggcgccugua

SEQ ID NO: 198822 - RNA, 23 nt, Human
gggcgugguggcaggugccugua

SEQ ID NO: 198823 - RNA, 23 nt, Human
gggcgugguggcgcaugccugua

SEQ ID NO: 198824 - RNA, 23 nt, Human
gggcgugguggcgcgugccugug

SEQ ID NO: 198825 - RNA, 23 nt, Human
gggcgugguggcgggagccugua

SEQ ID NO: 198826 - RNA, 23 nt, Human
gggcgugguggcgggcaccugua

SEQ ID NO: 198827 - RNA, 23 nt, Human
gggcgugguggcgggccccugua

SEQ ID NO: 198828 - RNA, 23 nt, Human
gggcgugguggcgggcgccugua

SEQ ID NO: 198829 - RNA, 23 nt, Human
gggcgugguggcgggugccugua

SEQ ID NO: 198830 - RNA, 23 nt, Human
gggcgugguggcgugugccugua

SEQ ID NO: 198831 - RNA, 23 nt, Human
gggcgugguggcucaagccugua

SEQ ID NO: 198832 - RNA, 23 nt, Human
gggcgugguggcucacaccugua

SEQ ID NO: 198833 - RNA, 23 nt, Human
gggcgugguggcucacacuugua

SEQ ID NO: 198834 - RNA, 23 nt, Human
gggcgugguggcucacgccugua

SEQ ID NO: 198835 - RNA, 20 nt, Human
gggcgugguggcucaugccu

SEQ ID NO: 198836 - RNA, 23 nt, Human
gggcgugguggcucaugccugua

SEQ ID NO: 198837 - RNA, 23 nt, Human
gggcgugguggcuccugccugua

SEQ ID NO: 198838 - RNA, 23 nt, Human
gggcgugguggcucucgccugua

SEQ ID NO: 198839 - RNA, 23 nt, Human
gggcgugguggcuggugccugua

SEQ ID NO: 198840 - RNA, 32 nt, Human
gggcguggugggcacccguaaucccagcuacu

SEQ ID NO: 198841 - RNA, 32 nt, Human
gggcguggugggcgccuguaaucccagcugcu

SEQ ID NO: 198842 - RNA, 23 nt, Human
gggcgugguggugcaugccugua

SEQ ID NO: 198843 - RNA, 23 nt, Human
gggcgugguggugcucaccugua

SEQ ID NO: 198844 - RNA, 23 nt, Human
gggcgugguggugggcaccugua

SEQ ID NO: 198845 - RNA, 23 nt, Human
gggcguggugguggguacuugua

SEQ ID NO: 198846 - RNA, 23 nt, Human
gggcguggugguucacgccugua

SEQ ID NO: 198847 - RNA, 32 nt, Human
gggcgugugcaggaguuugacaguggccugcu

SEQ ID NO: 198848 - RNA, 18 nt, Human
gggcgugugcucugcggg

SEQ ID NO: 198849 - RNA, 32 nt, Human
gggcgugugguuuccuguugucucaccuuuaa

SEQ ID NO: 198850 - RNA, 32 nt, Human
gggcgugugucgucccagcuacuugugaggcu

SEQ ID NO: 198851 - RNA, 32 nt, Human
gggcguucagggucccucagcugcagugugaa

SEQ ID NO: 198852 - RNA, 32 nt, Human
gggcguugagcacagcgcgggccaggccgaac

SEQ ID NO: 198853 - RNA, 32 nt, Human
gggcguugccuggguucuugggagagagggga

SEQ ID NO: 198854 - RNA, 21 nt, Human
gggcguuuaggacugggcguc

SEQ ID NO: 198855 - RNA, 32 nt, Human
gggcguuugagaccagccuggucaacauggcg

SEQ ID NO: 198856 - RNA, 32 nt, Human
gggcguuuguuuuauucuugguguuuucagug

SEQ ID NO: 198857 - RNA, 32 nt, Human
gggcuaaacaacugggacucuggagagucugu

SEQ ID NO: 198858 - RNA, 32 nt, Human
gggcuaaagaggaaggaggggaggaggucgcu

SEQ ID NO: 198859 - RNA, 32 nt, Human
gggcuaaagaggaggacgaagaaaagcagagc

SEQ ID NO: 198860 - RNA, 23 nt, Human
gggcuaaagcaggagggacgacc

SEQ ID NO: 198861 - RNA, 20 nt, Human
gggcuaaagucauccaguga

SEQ ID NO: 198862 - RNA, 31 nt, Human
gggcuaaaguugugucuuaugccaagcggaa

SEQ ID NO: 198863 - RNA, 32 nt, Human
gggcuaaaugcugcuaucauaggcauccauau

SEQ ID NO: 198864 - RNA, 32 nt, Human
gggcuaaaugugacaaaccgagaagauggcca

SEQ ID NO: 198865 - RNA, 32 nt, Human
gggcuaacauaguccucacacagggcugagaa

SEQ ID NO: 198866 - RNA, 32 nt, Human
gggcuaaccaauauuuucaaaagaacuucauc

SEQ ID NO: 198867 - RNA, 32 nt, Human
gggcuaaccagcuccugauggccugagccagg

SEQ ID NO: 198868 - RNA, 32 nt, Human
gggcuaacccccagaauacugguaggggccaa

SEQ ID NO: 198869 - RNA, 32 nt, Human
gggcuaaggcaggcacacaguggcggagaaga

SEQ ID NO: 198870 - RNA, 32 nt, Human
gggcuaagggcugcucaguuuccuucagcggg

SEQ ID NO: 198871 - RNA, 32 nt, Human
gggcuaagggggaggguuucaaagggagcgca

SEQ ID NO: 198872 - RNA, 27 nt, Human
gggcuaaguauuaggccuucccaggga

SEQ ID NO: 198873 - RNA, 32 nt, Human
gggcuaagucagccaggcaggcugucaggccc

SEQ ID NO: 198874 - RNA, 32 nt, Human
gggcuacaaaggacccuaacugugggacucag

SEQ ID NO: 198875 - RNA, 20 nt, Human
gggcuacacaguaguuccaa

SEQ ID NO: 198876 - RNA, 24 nt, Human
gggcuacagagcgagacucuaccu

SEQ ID NO: 198877 - RNA, 24 nt, Human
gggcuacagagugaaacucugucu

SEQ ID NO: 198878 - RNA, 24 nt, Human
gggcuacagagugagacuccaucu

SEQ ID NO: 198879 - RNA, 24 nt, Human
gggcuacagagugagacuccgucu

SEQ ID NO: 198880 - RNA, 32 nt, Human
gggcuacagaugucugcucucuggaccccacg

SEQ ID NO: 198881 - RNA, 32 nt, Human
gggcuacagcuaugcgccaccaugcccagcua

SEQ ID NO: 198882 - RNA, 32 nt, Human
gggcuacaggcagcuggagaaaggggcccagc

SEQ ID NO: 198883 - RNA, 32 nt, Human
gggcuacaggcauauaccaccaugcccaacua

SEQ ID NO: 198884 - RNA, 32 nt, Human
gggcuacagucucuuguccuggacccuguagg

SEQ ID NO: 198885 - RNA, 32 nt, Human
gggcuacauagugagaccacaucucuacuaga

SEQ ID NO: 198886 - RNA, 32 nt, Human
gggcuacauccagcaacauccucaaggucuuc

SEQ ID NO: 198887 - RNA, 32 nt, Human
gggcuacauccuggcucggugggaucugacga

SEQ ID NO: 198888 - RNA, 32 nt, Human
gggcuacaugacgaaacuccaucucuaucaaa

SEQ ID NO: 198889 - RNA, 32 nt, Human
gggcuacccaagcagaaaccccacauuucaag

SEQ ID NO: 198890 - RNA, 32 nt, Human
gggcuacccacugcuuacucagggaccaggca

SEQ ID NO: 198891 - RNA, 27 nt, Human
gggcuaccuaggacccagcccagcuug

SEQ ID NO: 198892 - RNA, 28 nt, Human
gggcuaccuagggacccagcucaacuug

SEQ ID NO: 198893 - RNA, 32 nt, Human
gggcuaccugggugguugaggggacugacauu

SEQ ID NO: 198894 - RNA, 32 nt, Human
gggcuaccuguuaggaacaugaauaccuuaca

SEQ ID NO: 198895 - RNA, 32 nt, Human
gggcuaccuucuccgauuggauuugcauuugu

SEQ ID NO: 198896 - RNA, 32 nt, Human
gggcuacgagcugcucauccagaaguuccuca

SEQ ID NO: 198897 - RNA, 32 nt, Human
gggcuacucagccucagguagcuggugccaga

SEQ ID NO: 198898 - RNA, 32 nt, Human
gggcuacuccacccuguccaccauggaccgca

SEQ ID NO: 198899 - RNA, 32 nt, Human
gggcuacugcagggaccugagccacaucgccg

SEQ ID NO: 198900 - RNA, 32 nt, Human
gggcuacugcagggaccugagccacaucgcug

SEQ ID NO: 198901 - RNA, 32 nt, Human
gggcuacugcagggaccugagccacauugcca

SEQ ID NO: 198902 - RNA, 32 nt, Human
gggcuagaacucuccaaggucuugcccccggc

SEQ ID NO: 198903 - RNA, 32 nt, Human
gggcuagagaaguaaagaucagcuggaaguca

SEQ ID NO: 198904 - RNA, 32 nt, Human
gggcuagagacaagcaccagccugcaguggag

SEQ ID NO: 198905 - RNA, 20 nt, Human
gggcuagagagcaccugaca

SEQ ID NO: 198906 - RNA, 32 nt, Human
gggcuagagaggacuaaggaaaacagagagag

SEQ ID NO: 198907 - RNA, 32 nt, Human
gggcuagagcaggucuucaucaugccuugucu

SEQ ID NO: 198908 - RNA, 32 nt, Human
gggcuagaggacagagaaagagaauagaauga

SEQ ID NO: 198909 - RNA, 32 nt, Human
gggcuagagguggaggaggcaguccugggaau

SEQ ID NO: 198910 - RNA, 32 nt, Human
gggcuagcagaggccggcccuggccaucggga

SEQ ID NO: 198911 - RNA, 17 nt, Human
gggcuagcagcagaggc

SEQ ID NO: 198912 - RNA, 32 nt, Human
gggcuagccucaaacuccugggcucaagcgau

SEQ ID NO: 198913 - RNA, 19 nt, Human
gggcuagcuucucacagca

SEQ ID NO: 198914 - RNA, 22 nt, Human
gggcuaggaaaaggcgcagugg

SEQ ID NO: 198915 - RNA, 26 nt, Human
gggcuaggaaugccgccauccgggga

SEQ ID NO: 198916 - RNA, 18 nt, Human
gggcuaggaggcucgggc

SEQ ID NO: 198917 - RNA, 32 nt, Human
gggcuaggaugagagacagagggugugauggu

SEQ ID NO: 198918 - RNA, 24 nt, Human
gggcuaggcagugugaccuaggga

SEQ ID NO: 198919 - RNA, 32 nt, Human
gggcuaggcugcagccugccuccuggggacuc

SEQ ID NO: 198920 - RNA, 22 nt, Human
gggcuaggcuggagcccaggga

SEQ ID NO: 198921 - RNA, 32 nt, Human
gggcuagggacugagggcuacuuuuggaaaga

SEQ ID NO: 198922 - RNA, 32 nt, Human
gggcuagggagguggcuggagcuucugcccug

SEQ ID NO: 198923 - RNA, 21 nt, Human
gggcuagggcagaagccugug

SEQ ID NO: 198924 - RNA, 19 nt, Human
gggcuaggggagggggcug

SEQ ID NO: 198925 - RNA, 32 nt, Human
gggcuagguguggcucaugccuguaaucccag

SEQ ID NO: 198926 - RNA, 32 nt, Human
gggcuaggugugguggcucaggccuguaaucc

SEQ ID NO: 198927 - RNA, 32 nt, Human
gggcuagucucgaacuccugaccucaggugau

SEQ ID NO: 198928 - RNA, 32 nt, Human
gggcuagucucgaacuccugaccugaagcgau

SEQ ID NO: 198929 - RNA, 32 nt, Human
gggcuagucuguucuucccggacaucuucugg

SEQ ID NO: 198930 - RNA, 32 nt, Human
gggcuaucgagaggagcucacugugggauggg

SEQ ID NO: 198931 - RNA, 32 nt, Human
gggcuaucugagggugugaugggugaagcugu

SEQ ID NO: 198932 - RNA, 32 nt, Human
gggcuaucuugcucccccuuccacugugggca

SEQ ID NO: 198933 - RNA, 32 nt, Human
gggcuaugaaggaguccucuuaaguuugauag

SEQ ID NO: 198934 - RNA, 32 nt, Human
gggcuaugacacccucuuuggggcucuauggu

SEQ ID NO: 198935 - RNA, 32 nt, Human
gggcuaugcaccugcaggcacguguguaugca

SEQ ID NO: 198936 - RNA, 32 nt, Human
gggcuaugccuaggcaaacuacuaacaugcau

SEQ ID NO: 198937 - RNA, 32 nt, Human
gggcuauggaaagggagacuguuucagaggac

SEQ ID NO: 198938 - RNA, 32 nt, Human
gggcuaugucccuucuggaggcucaagggaug

SEQ ID NO: 198939 - RNA, 32 nt, Human
gggcuaugucccuucuggaggcuuaagggaug

SEQ ID NO: 198940 - RNA, 32 nt, Human
gggcuauguuuuucauucuuuugaggcugguu

SEQ ID NO: 198941 - RNA, 32 nt, Human
gggcuauuccucuccacccagaaggcugggaa

SEQ ID NO: 198942 - RNA, 31 nt, Human
gggcuauugcuucucccuugcuucaaagaau

SEQ ID NO: 198943 - RNA, 32 nt, Human
gggcucaaaagaugacacgcgccagagcugga

SEQ ID NO: 198944 - RNA, 32 nt, Human
gggcucaaacuaaauucaaagaaguacuuuau

SEQ ID NO: 198945 - RNA, 32 nt, Human
gggcucaaagauccucccgccuuggucuccca

SEQ ID NO: 198946 - RNA, 23 nt, Human
gggcucaagagauccuccugccu

SEQ ID NO: 198947 - RNA, 23 nt, Human
gggcucaagaggccacuuaggga

SEQ ID NO: 198948 - RNA, 32 nt, Human
gggcucaagaugaaugggagggagagauuuga

SEQ ID NO: 198949 - RNA, 21 nt, Human
gggcucaagcaacucuuccac

SEQ ID NO: 198950 - RNA, 23 nt, Human
gggcucaagcaagccuccugccu

SEQ ID NO: 198951 - RNA, 23 nt, Human
gggcucaagcaauccuccugccu

SEQ ID NO: 198952 - RNA, 23 nt, Human
gggcucaagcaauccuccugucu

SEQ ID NO: 198953 - RNA, 23 nt, Human
gggcucaagcaauucuucugccu

SEQ ID NO: 198954 - RNA, 23 nt, Human
gggcucaagcaauuuuccugccu

SEQ ID NO: 198955 - RNA, 32 nt, Human
gggcucaagccuggcccuggcccgcagcacac

SEQ ID NO: 198956 - RNA, 32 nt, Human
gggcucaagccuguauuccagcacuuugggag

SEQ ID NO: 198957 - RNA, 23 nt, Human
gggcucaagcgacccuccugccu

SEQ ID NO: 198958 - RNA, 23 nt, Human
gggcucaagcgauccucccaccu

SEQ ID NO: 198959 - RNA, 23 nt, Human
gggcucaagcgauccuccugccu

SEQ ID NO: 198960 - RNA, 23 nt, Human
gggcucaagcgauccuccuggcu

SEQ ID NO: 198961 - RNA, 23 nt, Human
gggcucaagcgauccuucugccu

SEQ ID NO: 198962 - RNA, 22 nt, Human
gggcucaaggauccuccugccu

SEQ ID NO: 198963 - RNA, 23 nt, Human
gggcucaagggauccuccugccu

SEQ ID NO: 198964 - RNA, 21 nt, Human
gggcucaagugauucuuccac

SEQ ID NO: 198965 - RNA, 32 nt, Human
gggcucaagugucaaaggaggcucccuaccuu

SEQ ID NO: 198966 - RNA, 22 nt, Human
gggcucaaguucucauuccauu

SEQ ID NO: 198967 - RNA, 32 nt, Human
gggcucaaugauucuccugucucagccuccca

SEQ ID NO: 198968 - RNA, 22 nt, Human
gggcucacaacuucucuucacu

SEQ ID NO: 198969 - RNA, 21 nt, Human
gggcucacaccuguaauccca

SEQ ID NO: 198970 - RNA, 32 nt, Human
gggcucacaccuguaaucccagcacuuuggga

SEQ ID NO: 198971 - RNA, 32 nt, Human
gggcucacacuggccuccagggcugugcaacu

SEQ ID NO: 198972 - RNA, 32 nt, Human
gggcucacagucugguagaggaagcacaugaa

SEQ ID NO: 198973 - RNA, 32 nt, Human
gggcucacaucuccuuccucuggccaguccac

SEQ ID NO: 198974 - RNA, 32 nt, Human
gggcucaccucccugguucaagcgauuguccc

SEQ ID NO: 198975 - RNA, 32 nt, Human
gggcucaccuguguuuccucaguggcuccacc

SEQ ID NO: 198976 - RNA, 32 nt, Human
gggcucacgccugaaaucccagcacuuuggga

SEQ ID NO: 198977 - RNA, 32 nt, Human
gggcucacgccugcaaucccagagcuuuggga

SEQ ID NO: 198978 - RNA, 32 nt, Human
gggcucacgccuguaaucccaacacuuuggga

SEQ ID NO: 198979 - RNA, 32 nt, Human
gggcucacgccuguaaucccagcacuuuggga

SEQ ID NO: 198980 - RNA, 32 nt, Human
gggcucacgccuguaaucucagcacuuuggga

SEQ ID NO: 198981 - RNA, 32 nt, Human
gggcucacugauaaaacucaucagucccaccc

SEQ ID NO: 198982 - RNA, 32 nt, Human
gggcucacugcaaccuccgccucccugguuca

SEQ ID NO: 198983 - RNA, 32 nt, Human
gggcucacugcaaccuccuccuccuggauuca

SEQ ID NO: 198984 - RNA, 32 nt, Human
gggcucacugcaaccucugccucccggguucc

SEQ ID NO: 198985 - RNA, 32 nt, Human
gggcucacugcaaccucugccuuccagguuca

SEQ ID NO: 198986 - RNA, 32 nt, Human
gggcucacugcaaccuucaccuccagguucaa

SEQ ID NO: 198987 - RNA, 32 nt, Human
gggcucacugcaagcuccggcucccggguuca

SEQ ID NO: 198988 - RNA, 32 nt, Human
gggcucacugcagccucaaccucccagguuca

SEQ ID NO: 198989 - RNA, 32 nt, Human
gggcucacugcagccuugaccucccaggcuca

SEQ ID NO: 198990 - RNA, 32 nt, Human
gggcucacugcaggcuguggagaggucaugcu

SEQ ID NO: 198991 - RNA, 32 nt, Human
gggcucacugcauagacaccccauaccccagg

SEQ ID NO: 198992 - RNA, 32 nt, Human
gggcucagaagcaggggccacagcuggaguaa

SEQ ID NO: 198993 - RNA, 32 nt, Human
gggcucagacaccagcaacagccucuugggau

SEQ ID NO: 198994 - RNA, 32 nt, Human
gggcucagagagucccagcccuaaggguguga

SEQ ID NO: 198995 - RNA, 32 nt, Human
gggcucagcaaugccauuucaguggcuuccca

SEQ ID NO: 198996 - RNA, 32 nt, Human
gggcucagcccaggcagccagcuuugggcuga

SEQ ID NO: 198997 - RNA, 22 nt, Human
gggcucagcggggacagcuccu

SEQ ID NO: 198998 - RNA, 19 nt, Human
gggcucagcucaguccccu

SEQ ID NO: 198999 - RNA, 32 nt, Human
gggcucagcucaguccccuugucuguccuccc

SEQ ID NO: 199000 - RNA, 24 nt, Human
gggcucagcuuggcugccugccuc

SEQ ID NO: 199001 - RNA, 20 nt, Human
gggcucaggacccagcccag

SEQ ID NO: 199002 - RNA, 32 nt, Human
gggcucaggaggucuggaucugugaugagauc

SEQ ID NO: 199003 - RNA, 32 nt, Human
gggcucaggaggucuggaucugugaugagaug

SEQ ID NO: 199004 - RNA, 32 nt, Human
gggcucaggagucggagaccagccugggcaac

SEQ ID NO: 199005 - RNA, 17 nt, Human
gggcucaggaguggggu

SEQ ID NO: 199006 - RNA, 25 nt, Human
gggcucaggcccugggcucugaacc

SEQ ID NO: 199007 - RNA, 32 nt, Human
gggcucaggcuggugugggaugcagccggccg

SEQ ID NO: 199008 - RNA, 28 nt, Human
gggcucagggcugcugccuuccuguccu

SEQ ID NO: 199009 - RNA, 20 nt, Human
gggcucagggggccacaagg

SEQ ID NO: 199010 - RNA, 32 nt, Human
gggcucagggggccacaaggaggcaggucggg

SEQ ID NO: 199011 - RNA, 32 nt, Human
gggcucaggguuggccagcuugcagaggagca

SEQ ID NO: 199012 - RNA, 32 nt, Human
gggcucagguuccaagacucagcugccuaauc

SEQ ID NO: 199013 - RNA, 32 nt, Human
gggcucagucaccccgagagugcacagugcua

SEQ ID NO: 199014 - RNA, 19 nt, Human
gggcucagugcagggaggc

SEQ ID NO: 199015 - RNA, 17 nt, Human
gggcucaguggaggcag

SEQ ID NO: 199016 - RNA, 23 nt, Human
gggcucaguggcucacaccugua

SEQ ID NO: 199017 - RNA, 23 nt, Human
gggcucaguggcucaugccugua

SEQ ID NO: 199018 - RNA, 25 nt, Human
gggcucaguggggcuucucuucccu

SEQ ID NO: 199019 - RNA, 32 nt, Human
gggcucauaccuguaaucccggcacuuuggga

SEQ ID NO: 199020 - RNA, 32 nt, Human
gggcucaucacuggccuggggagggcuugaca

SEQ ID NO: 199021 - RNA, 32 nt, Human
gggcucaugccuguaaucccagcacuuuggga

SEQ ID NO: 199022 - RNA, 24 nt, Human
gggcucauggcuccaggcggcagg

SEQ ID NO: 199023 - RNA, 25 nt, Human
gggcucaugugauccucccaccuca

SEQ ID NO: 199024 - RNA, 32 nt, Human
gggcucaugugucuuccgucuuuuggaaggag

SEQ ID NO: 199025 - RNA, 24 nt, Human
gggcucauucuucuuggcucacca

SEQ ID NO: 199026 - RNA, 32 nt, Human
gggcucauugcaaccuccgccucccggcuuca

SEQ ID NO: 199027 - RNA, 32 nt, Human
gggcucauugcaaccucugccucccggguuca

SEQ ID NO: 199028 - RNA, 20 nt, Human
gggcuccaacuccuccuugc

SEQ ID NO: 199029 - RNA, 32 nt, Human
gggcuccaacuggguacagccugggugcaguu

SEQ ID NO: 199030 - RNA, 32 nt, Human
gggcuccaagccaggaaaggugaacagaaacc

SEQ ID NO: 199031 - RNA, 32 nt, Human
gggcuccaagccccagcguggggaagggcccu

SEQ ID NO: 199032 - RNA, 32 nt, Human
gggcuccacaaggcagcucagacuuggcaagg

SEQ ID NO: 199033 - RNA, 25 nt, Human
gggcuccacagcgguccggcggcgg

SEQ ID NO: 199034 - RNA, 32 nt, Human
gggcuccaccagacccugaugcugcuacguau

SEQ ID NO: 199035 - RNA, 32 nt, Human
gggcuccaccagcuccacauccugggcagaca

SEQ ID NO: 199036 - RNA, 32 nt, Human
gggcuccaccugcucacccgccugcagaucug

SEQ ID NO: 199037 - RNA, 21 nt, Human
gggcuccacucgucugccccu

SEQ ID NO: 199038 - RNA, 32 nt, Human
gggcuccagaaacuaccugggcucggccgacc

SEQ ID NO: 199039 - RNA, 22 nt, Human
gggcuccagacacaccugaaca

SEQ ID NO: 199040 - RNA, 32 nt, Human
gggcuccagagucccucggucucaggucaugg

SEQ ID NO: 199041 - RNA, 32 nt, Human
gggcuccagcagcuccagcccagagcacucgg

SEQ ID NO: 199042 - RNA, 32 nt, Human
gggcuccagcaggaguggaggcuggucugggc

SEQ ID NO: 199043 - RNA, 32 nt, Human
gggcuccagcaggaguggaggcuggucugggg

SEQ ID NO: 199044 - RNA, 32 nt, Human
gggcuccagcugugacccagacuccgccagga

SEQ ID NO: 199045 - RNA, 32 nt, Human
gggcuccagcuuaaaggagagcagaggggguc

SEQ ID NO: 199046 - RNA, 32 nt, Human
gggcuccaggcggcugcggcagcucugguaac

SEQ ID NO: 199047 - RNA, 32 nt, Human
gggcuccagggacuggaguguaaugcucggug

SEQ ID NO: 199048 - RNA, 32 nt, Human
gggcuccagggugggacagggugggcgggggu

SEQ ID NO: 199049 - RNA, 32 nt, Human
gggcuccaguguuuagagaaggacagucagag

SEQ ID NO: 199050 - RNA, 32 nt, Human
gggcuccaugucugcuuagaggcugccaugcu

SEQ ID NO: 199051 - RNA, 32 nt, Human
gggcuccauugauucauuccuuccucacucaa

SEQ ID NO: 199052 - RNA, 32 nt, Human
gggcuccauuucuuggacuuaaaaugcauuau

SEQ ID NO: 199053 - RNA, 32 nt, Human
gggcucccaaaguacugggauuacaggcauga

SEQ ID NO: 199054 - RNA, 32 nt, Human
gggcucccaaagugcugggauuacagacguga

SEQ ID NO: 199055 - RNA, 32 nt, Human
gggcucccaaagugcugggauuacagauguga

SEQ ID NO: 199056 - RNA, 32 nt, Human
gggcucccaaagugcugggauuacaggcguga

SEQ ID NO: 199057 - RNA, 32 nt, Human
gggcucccaaagugcugggauuauagguguga

SEQ ID NO: 199058 - RNA, 32 nt, Human
gggcucccaaaguguugggauuacaggcauga

SEQ ID NO: 199059 - RNA, 32 nt, Human
gggcucccaaaguguugggauuacaggcguga

SEQ ID NO: 199060 - RNA, 32 nt, Human
gggcucccaaaguguugggauuacaggugugu

SEQ ID NO: 199061 - RNA, 32 nt, Human
gggcucccaacaugcuggcauuacagguauga

SEQ ID NO: 199062 - RNA, 23 nt, Human
gggcucccacagcacccugccuc

SEQ ID NO: 199063 - RNA, 32 nt, Human
gggcucccacugucugccccagggugcggagu

SEQ ID NO: 199064 - RNA, 32 nt, Human
gggcucccacuugccaugggacucgcagcugg

SEQ ID NO: 199065 - RNA, 32 nt, Human
gggcucccaguucaggaugggccacagggcgu

SEQ ID NO: 199066 - RNA, 32 nt, Human
gggcucccauccucaucucucuccuugacugg

SEQ ID NO: 199067 - RNA, 32 nt, Human
gggcucccauucugguagagggagacagucua

SEQ ID NO: 199068 - RNA, 32 nt, Human
gggcuccccagccugucagacccuugcuggcu

SEQ ID NO: 199069 - RNA, 32 nt, Human
gggcuccccagccuguggggcuggcuuccuug

SEQ ID NO: 199070 - RNA, 22 nt, Human
gggcucccccugcccagcgcuc

SEQ ID NO: 199071 - RNA, 21 nt, Human
gggcucccccugccugccucu

SEQ ID NO: 199072 - RNA, 32 nt, Human
gggcucccccuucauggccucugcaccuccac

SEQ ID NO: 199073 - RNA, 19 nt, Human
gggcuccccgcagcccccu

SEQ ID NO: 199074 - RNA, 32 nt, Human
gggcuccccucgggcccagcguggcgcagggg

SEQ ID NO: 199075 - RNA, 32 nt, Human
gggcuccccugcuccuuucccuucccuguacu

SEQ ID NO: 199076 - RNA, 28 nt, Human
gggcuccccugugcugccuagcucgucu

SEQ ID NO: 199077 - RNA, 32 nt, Human
gggcucccuucccaccucucucacuccuugaa

SEQ ID NO: 199078 - RNA, 20 nt, Human
gggcuccgagagggggcgac

SEQ ID NO: 199079 - RNA, 19 nt, Human
gggcuccgcagaggagcag

SEQ ID NO: 199080 - RNA, 32 nt, Human
gggcuccgccacugcaugcucccgccggaccg

SEQ ID NO: 199081 - RNA, 32 nt, Human
gggcuccgcuuuggggaggggcagcagguuua

SEQ ID NO: 199082 - RNA, 32 nt, Human
gggcuccggagagcagcaggaagcacucccag

SEQ ID NO: 199083 - RNA, 32 nt, Human
gggcuccggccugggauguuucugaacuuugg

SEQ ID NO: 199084 - RNA, 32 nt, Human
gggcuccgggcggcagaggcugaggugucagg

SEQ ID NO: 199085 - RNA, 21 nt, Human
gggcuccggucccggcggcag

SEQ ID NO: 199086 - RNA, 32 nt, Human
gggcuccuaaagugcugggauuacaggcguga

SEQ ID NO: 199087 - RNA, 32 nt, Human
gggcuccuaacaguguaacuuauugugucccc

SEQ ID NO: 199088 - RNA, 32 nt, Human
gggcuccuagcggggaaaaggaaggggauaac

SEQ ID NO: 199089 - RNA, 32 nt, Human
gggcuccuaucaggcugggugugcgagugucc

SEQ ID NO: 199090 - RNA, 32 nt, Human
gggcuccucacuugccaguaggggcggccggg

SEQ ID NO: 199091 - RNA, 32 nt, Human
gggcuccucauugcucccaucugccucugcug

SEQ ID NO: 199092 - RNA, 32 nt, Human
gggcuccuccacccuuuugucuucauacugca

SEQ ID NO: 199093 - RNA, 32 nt, Human
gggcuccuccaggacaagggcacacaacuggu

SEQ ID NO: 199094 - RNA, 32 nt, Human
gggcuccucuacugcacaagggccagucccca

SEQ ID NO: 199095 - RNA, 32 nt, Human
gggcuccucuacuggaucuacacucuguccca

SEQ ID NO: 199096 - RNA, 32 nt, Human
gggcuccucucuucccaguaggggcggccggg

SEQ ID NO: 199097 - RNA, 32 nt, Human
gggcuccucucuucccaguaggggcggcuggg

SEQ ID NO: 199098 - RNA, 32 nt, Human
gggcuccugacuguagcaggugguagggcugg

SEQ ID NO: 199099 - RNA, 32 nt, Human
gggcuccugaugcuggccaggaguggugcuag

SEQ ID NO: 199100 - RNA, 20 nt, Human
gggcuccugauuucucuuca

SEQ ID NO: 199101 - RNA, 18 nt, Human
gggcuccugcauccagcu

SEQ ID NO: 199102 - RNA, 32 nt, Human
gggcuccugccugagguccucagaaucccacu

SEQ ID NO: 199103 - RNA, 32 nt, Human
gggcuccugccugcuccuccuguguuagcucu

SEQ ID NO: 199104 - RNA, 19 nt, Human
gggcuccuggcagcccccu

SEQ ID NO: 199105 - RNA, 32 nt, Human
gggcuccuggcaggaggaccuggaguuuucag

SEQ ID NO: 199106 - RNA, 32 nt, Human
gggcuccuggcuccugccccuugcacaccacc

SEQ ID NO: 199107 - RNA, 32 nt, Human
gggcuccugggaacagggcucagaggcaggcg

SEQ ID NO: 199108 - RNA, 32 nt, Human
gggcuccuggggacccaggacaccuggccacg

SEQ ID NO: 199109 - RNA, 32 nt, Human
gggcuccuggggacgaggaguguggggcaccu

SEQ ID NO: 199110 - RNA, 32 nt, Human
gggcuccuggggagccacuggggagggggugg

SEQ ID NO: 199111 - RNA, 32 nt, Human
gggcuccuguagucccagcuacucaggaggcu

SEQ ID NO: 199112 - RNA, 32 nt, Human
gggcuccuguagucccagcuacucaggauucu

SEQ ID NO: 199113 - RNA, 32 nt, Human
gggcuccuguagucccagcuacuugggaggcu

SEQ ID NO: 199114 - RNA, 32 nt, Human
gggcuccugucucacacuaucucccugcccuc

SEQ ID NO: 199115 - RNA, 32 nt, Human
gggcuccuugcuggugggcaguggguuguaaa

SEQ ID NO: 199116 - RNA, 32 nt, Human
gggcucgaaccugaauguucucuucgcugugg

SEQ ID NO: 199117 - RNA, 32 nt, Human
gggcucgagcggcggcggccucaggccggggg

SEQ ID NO: 199118 - RNA, 32 nt, Human
gggcucgagggcccugagggagcggcaccuag

SEQ ID NO: 199119 - RNA, 32 nt, Human
gggcucgagucccggcccgagcgcggcgucgg

SEQ ID NO: 199120 - RNA, 21 nt, Human
gggcucgaucuuggcucacca

SEQ ID NO: 199121 - RNA, 19 nt, Human
gggcucgccugcucagcuc

SEQ ID NO: 199122 - RNA, 32 nt, Human
gggcucgcggagccaggucuccaccucugggc

SEQ ID NO: 199123 - RNA, 32 nt, Human
gggcucgcucugagaggacgcggcggcagcgg

SEQ ID NO: 199124 - RNA, 32 nt, Human
gggcucggccgcccccucccacaucagucucc

SEQ ID NO: 199125 - RNA, 19 nt, Human
gggcucggcgggggcgcgg

SEQ ID NO: 199126 - RNA, 32 nt, Human
gggcucgggacaacuucugggguggggugcaa

SEQ ID NO: 199127 - RNA, 20 nt, Human
gggcucgggacuggccacca

SEQ ID NO: 199128 - RNA, 32 nt, Human
gggcucgggagaguccuugaguacggagaccg

SEQ ID NO: 199129 - RNA, 18 nt, Human
gggcucgggcuccggcuc

SEQ ID NO: 199130 - RNA, 23 nt, Human
gggcucgggcuccgggggcggcg

SEQ ID NO: 199131 - RNA, 21 nt, Human
gggcucgggcucuggggccgc

SEQ ID NO: 199132 - RNA, 19 nt, Human
gggcucgggcuuugucacc

SEQ ID NO: 199133 - RNA, 22 nt, Human
gggcucggggcagggacucacc

SEQ ID NO: 199134 - RNA, 32 nt, Human
gggcucggggugcuuugggugccuggaauugg

SEQ ID NO: 199135 - RNA, 32 nt, Human
gggcucguacuagaaagccacaggagaggucg

SEQ ID NO: 199136 - RNA, 19 nt, Human
gggcucgucaguagggcug

SEQ ID NO: 199137 - RNA, 20 nt, Human
gggcucgugcaggagaacug

SEQ ID NO: 199138 - RNA, 32 nt, Human
gggcucgugcugugcuucauucaccucuccau

SEQ ID NO: 199139 - RNA, 32 nt, Human
gggcucuaacagugcuuacugcagccuugugu

SEQ ID NO: 199140 - RNA, 32 nt, Human
gggcucuacagggcagcagagcagagcaaaag

SEQ ID NO: 199141 - RNA, 32 nt, Human
gggcucuaccuccccuggccugggugaguugg

SEQ ID NO: 199142 - RNA, 32 nt, Human
gggcucuacugaggccucuccccugggggcuc

SEQ ID NO: 199143 - RNA, 32 nt, Human
gggcucuagggagggggcuguggcugcugggg

SEQ ID NO: 199144 - RNA, 32 nt, Human
gggcucucacaugggguaggggagccauacuc

SEQ ID NO: 199145 - RNA, 32 nt, Human
gggcucuccagaaacggagcccaucuaaccaa

SEQ ID NO: 199146 - RNA, 32 nt, Human
gggcucucccccaggauuuugguguuuugacu

SEQ ID NO: 199147 - RNA, 32 nt, Human
gggcucuccuccucgcggcggaugggugaccu

SEQ ID NO: 199148 - RNA, 32 nt, Human
gggcucucggggaaggugucgggggcccccua

SEQ ID NO: 199149 - RNA, 32 nt, Human
gggcucucucagaaacuucaggagauguuaga

SEQ ID NO: 199150 - RNA, 32 nt, Human
gggcucucuccacgauucuggcuguuugccca

SEQ ID NO: 199151 - RNA, 32 nt, Human
gggcucucucccccagcuucuacaccugggcu

SEQ ID NO: 199152 - RNA, 22 nt, Human
gggcucucuccugggcucagca

SEQ ID NO: 199153 - RNA, 32 nt, Human
gggcucucugcucucuccuuagggagcucgag

SEQ ID NO: 199154 - RNA, 32 nt, Human
gggcucucuugggcuuuauccaugucuuuaga

SEQ ID NO: 199155 - RNA, 32 nt, Human
gggcucugaaacaugagugugcaucagaauca

SEQ ID NO: 199156 - RNA, 20 nt, Human
gggcucugacccaagugggg

SEQ ID NO: 199157 - RNA, 32 nt, Human
gggcucugacucugaucccucccagggagccu

SEQ ID NO: 199158 - RNA, 32 nt, Human
gggcucugagaaaaacuggagcugaucucaag

SEQ ID NO: 199159 - RNA, 32 nt, Human
gggcucugagagguggagucgggguggcagcg

SEQ ID NO: 199160 - RNA, 32 nt, Human
gggcucugagccaggggaggggagggagcgag

SEQ ID NO: 199161 - RNA, 26 nt, Human
gggcucugaggagugggcgcugggag

SEQ ID NO: 199162 - RNA, 18 nt, Human
gggcucugaugggggcug

SEQ ID NO: 199163 - RNA, 32 nt, Human
gggcucugcaauuccccucugcugcugucccu

SEQ ID NO: 199164 - RNA, 21 nt, Human
gggcucugccuccuaccaaga

SEQ ID NO: 199165 - RNA, 32 nt, Human
gggcucugcuacugcuggcgcucaucacagcc

SEQ ID NO: 199166 - RNA, 32 nt, Human
gggcucugcucggaaaucguccuggcccaacu

SEQ ID NO: 199167 - RNA, 32 nt, Human
gggcucugcucucuccccgccugcuuccccuc

SEQ ID NO: 199168 - RNA, 32 nt, Human
gggcucugcugagaaggaaggcagcccaggag

SEQ ID NO: 199169 - RNA, 32 nt, Human
gggcucugcuggccaaauggggccacagacca

SEQ ID NO: 199170 - RNA, 32 nt, Human
gggcucugcuucugccaggaccacaccgaggg

SEQ ID NO: 199171 - RNA, 32 nt, Human
gggcucuggaaaccacauggcuucaccugucc

SEQ ID NO: 199172 - RNA, 32 nt, Human
gggcucuggcauuugacuaccuuacuuugagu

SEQ ID NO: 199173 - RNA, 32 nt, Human
gggcucuggccaacccucagaaacccucacaa

SEQ ID NO: 199174 - RNA, 32 nt, Human
gggcucuggcucagguugcagacagcugagaa

SEQ ID NO: 199175 - RNA, 21 nt, Human
gggcucugggaggggagagac

SEQ ID NO: 199176 - RNA, 32 nt, Human
gggcucugggcgcuccuggcuccaguccggug

SEQ ID NO: 199177 - RNA, 32 nt, Human
gggcucuggggaggggaaggcagcaagccugu

SEQ ID NO: 199178 - RNA, 32 nt, Human
gggcucugggggcagagguggcaggaauggug

SEQ ID NO: 199179 - RNA, 19 nt, Human
gggcucuggggguggggug

SEQ ID NO: 199180 - RNA, 24 nt, Human
gggcucugggugacgcaugccucu

SEQ ID NO: 199181 - RNA, 32 nt, Human
gggcucugggugugugcgcuuggcgugcaggg

SEQ ID NO: 199182 - RNA, 32 nt, Human
gggcucuggguugggguaggggaagggagggu

SEQ ID NO: 199183 - RNA, 23 nt, Human
gggcucuggucuccacagauggc

SEQ ID NO: 199184 - RNA, 32 nt, Human
gggcucugucagccgccaccucugggaaagag

SEQ ID NO: 199185 - RNA, 32 nt, Human
gggcucuguccaggugccuggccagucagcag

SEQ ID NO: 199186 - RNA, 32 nt, Human
gggcucugugggcucccccugcuccacaggua

SEQ ID NO: 199187 - RNA, 32 nt, Human
gggcucugugggcucccccugggcucuguggg

SEQ ID NO: 199188 - RNA, 32 nt, Human
gggcucuguguccagcucucauggcccagggc

SEQ ID NO: 199189 - RNA, 32 nt, Human
gggcucuguuuuauugacauuuuccuuccuug

SEQ ID NO: 199190 - RNA, 32 nt, Human
gggcucuucagcccuccugggagcucaguggc

SEQ ID NO: 199191 - RNA, 22 nt, Human
gggcucuucaguuaaaaagggg

SEQ ID NO: 199192 - RNA, 32 nt, Human
gggcucuucccgccggguccucccuccccaga

SEQ ID NO: 199193 - RNA, 32 nt, Human
gggcucuuccgccugugguucccaccaugcuc

SEQ ID NO: 199194 - RNA, 32 nt, Human
gggcucuucuacugccagggcuuggcuccacc

SEQ ID NO: 199195 - RNA, 23 nt, Human
gggcucuucuggcagggggucug

SEQ ID NO: 199196 - RNA, 32 nt, Human
gggcucuugccuggccuaggccugguuccugg

SEQ ID NO: 199197 - RNA, 25 nt, Human
gggcucuugcgucuccagcucacca

SEQ ID NO: 199198 - RNA, 32 nt, Human
gggcucuuggaugagcugcucuccauucuaga

SEQ ID NO: 199199 - RNA, 32 nt, Human
gggcucuuguuggccgcacguggcagugcagc

SEQ ID NO: 199200 - RNA, 18 nt, Human
gggcucuuuggcugaaga

SEQ ID NO: 199201 - RNA, 32 nt, Human
gggcugaaaucauuuguucuccuucacauuga

SEQ ID NO: 199202 - RNA, 32 nt, Human
gggcugaaaugagccagugccccaggucugcu

SEQ ID NO: 199203 - RNA, 32 nt, Human
gggcugaacagcugcauucgagacugguggag

SEQ ID NO: 199204 - RNA, 20 nt, Human
gggcugaagcgaaggggggu

SEQ ID NO: 199205 - RNA, 32 nt, Human
gggcugaaggaggcgggggugguguagggccc

SEQ ID NO: 199206 - RNA, 32 nt, Human
gggcugaaggaucaugggugccaagucucugc

SEQ ID NO: 199207 - RNA, 32 nt, Human
gggcugaaggcaggggccacucacaggccagg

SEQ ID NO: 199208 - RNA, 32 nt, Human
gggcugaagguugaagaggugagcacggccaa

SEQ ID NO: 199209 - RNA, 32 nt, Human
gggcugacagugagaggaugcagcccgguguc

SEQ ID NO: 199210 - RNA, 32 nt, Human
gggcugaccacagccugagaaagaaggucugg

SEQ ID NO: 199211 - RNA, 32 nt, Human
gggcugaccccagcuuccaggggacugucacu

SEQ ID NO: 199212 - RNA, 19 nt, Human
gggcugacccgagcuccag

SEQ ID NO: 199213 - RNA, 21 nt, Human
gggcugacccuucagcaacgg

SEQ ID NO: 199214 - RNA, 20 nt, Human
gggcugacgauggggggcug

SEQ ID NO: 199215 - RNA, 19 nt, Human
gggcugacgcuaacaggag

SEQ ID NO: 199216 - RNA, 21 nt, Human
gggcugacgucgcgcugggaa

SEQ ID NO: 199217 - RNA, 32 nt, Human
gggcugacuccaggaccuccaggaugaggcag

SEQ ID NO: 199218 - RNA, 32 nt, Human
gggcugacugggugggggcagcucccagcgag

SEQ ID NO: 199219 - RNA, 26 nt, Human
gggcugacuuggcucugggaucacca

SEQ ID NO: 199220 - RNA, 19 nt, Human
gggcugagaaaggggcagg

SEQ ID NO: 199221 - RNA, 32 nt, Human
gggcugagagcauguaccagaucaagaaugag

SEQ ID NO: 199222 - RNA, 22 nt, Human
gggcugagaggggagggggcgg

SEQ ID NO: 199223 - RNA, 32 nt, Human
gggcugagaggguggacgaguucagguuuguu

SEQ ID NO: 199224 - RNA, 32 nt, Human
gggcugagcagcacuggcauugaaaaauauaa

SEQ ID NO: 199225 - RNA, 32 nt, Human
gggcugagcccagccuccaucuuugccucuca

SEQ ID NO: 199226 - RNA, 32 nt, Human
gggcugagccuuccuuaugaugacuuuguucu

SEQ ID NO: 199227 - RNA, 17 nt, Human
gggcugagcgcacucuu

SEQ ID NO: 199228 - RNA, 32 nt, Human
gggcugaggaagcacagcagcaucuucaaaca

SEQ ID NO: 199229 - RNA, 32 nt, Human
gggcugaggagagaaaagggugauuagcgugg

SEQ ID NO: 199230 - RNA, 32 nt, Human
gggcugaggaggaggagcagggggugcugcgu

SEQ ID NO: 199231 - RNA, 32 nt, Human
gggcugaggaggguucagaggauuguggucuc

SEQ ID NO: 199232 - RNA, 32 nt, Human
gggcugaggcaccugcagucacccacacucug

SEQ ID NO: 199233 - RNA, 20 nt, Human
gggcugaggcagguggauca

SEQ ID NO: 199234 - RNA, 32 nt, Human
gggcugaggcaggugguagggcuggcacuuau

SEQ ID NO: 199235 - RNA, 32 nt, Human
gggcugaggccacagccgcaucuugucaggcu

SEQ ID NO: 199236 - RNA, 32 nt, Human
gggcugaggccugcuggacagauggcuggcca

SEQ ID NO: 199237 - RNA, 32 nt, Human
gggcugaggccugcuuugugucggcagggucu

SEQ ID NO: 199238 - RNA, 32 nt, Human
gggcugaggcuggacaauggugugaacccagg

SEQ ID NO: 199239 - RNA, 20 nt, Human
gggcugagggcaauucuguc

SEQ ID NO: 199240 - RNA, 32 nt, Human
gggcugagggccuggaggugggcucgcacccc

SEQ ID NO: 199241 - RNA, 32 nt, Human
gggcugagggccuuguggaggauggucggugg

SEQ ID NO: 199242 - RNA, 32 nt, Human
gggcugaggggcugcaaggagaaguugcaucc

SEQ ID NO: 199243 - RNA, 32 nt, Human
gggcugaggggugggagggagggcagagcucu

SEQ ID NO: 199244 - RNA, 32 nt, Human
gggcugaggucucccugguagaacuaagggag

SEQ ID NO: 199245 - RNA, 32 nt, Human
gggcugagguuagaaggugcagagcguggaag

SEQ ID NO: 199246 - RNA, 32 nt, Human
gggcugagucacccuccaugcccacccgucau

SEQ ID NO: 199247 - RNA, 18 nt, Human
gggcugaguggggggucc

SEQ ID NO: 199248 - RNA, 32 nt, Human
gggcugaguggggucgggugaggcagagguca

SEQ ID NO: 199249 - RNA, 21 nt, Human
gggcugaguucuuccagguca

SEQ ID NO: 199250 - RNA, 32 nt, Human
gggcugauaccuccuugcucuuccuagaugcc

SEQ ID NO: 199251 - RNA, 32 nt, Human
gggcugauccugccucagcuguguggccaugu

SEQ ID NO: 199252 - RNA, 32 nt, Human
gggcugaucucgaacuccugaccucaagugau

SEQ ID NO: 199253 - RNA, 32 nt, Human
gggcugauuguauuuaccuucuaccucuuggc

SEQ ID NO: 199254 - RNA, 19 nt, Human
gggcugcaaagcggggggc

SEQ ID NO: 199255 - RNA, 32 nt, Human
gggcugcaagcuggaggguggugcaggccuug

SEQ ID NO: 199256 - RNA, 32 nt, Human
gggcugcaagggcuguuccuccaccuuucugu

SEQ ID NO: 199257 - RNA, 32 nt, Human
gggcugcaaugccaccagagaacgugauguca

SEQ ID NO: 199258 - RNA, 32 nt, Human
gggcugcacagcccugaggggucagugcuggg

SEQ ID NO: 199259 - RNA, 32 nt, Human
gggcugcaccugcaucuucugaucaccuggcc

SEQ ID NO: 199260 - RNA, 32 nt, Human
gggcugcaccugccaggaccuaauguucuuag

SEQ ID NO: 199261 - RNA, 32 nt, Human
gggcugcacgcagggacuugcccacaucuucu

SEQ ID NO: 199262 - RNA, 18 nt, Human
gggcugcacgcggcuggc

SEQ ID NO: 199263 - RNA, 32 nt, Human
gggcugcacgcuccccuccauccccaucggcc

SEQ ID NO: 199264 - RNA, 32 nt, Human
gggcugcacucagcaggcugcuugagugggag

SEQ ID NO: 199265 - RNA, 32 nt, Human
gggcugcacugagcuugucuucaggaaaccag

SEQ ID NO: 199266 - RNA, 23 nt, Human
gggcugcacuggaacaacacaga

SEQ ID NO: 199267 - RNA, 20 nt, Human
gggcugcacugugagcgcug

SEQ ID NO: 199268 - RNA, 32 nt, Human
gggcugcagaccugcacagccugucacagcau

SEQ ID NO: 199269 - RNA, 32 nt, Human
gggcugcagagccuggaccaaugcccagaauc

SEQ ID NO: 199270 - RNA, 32 nt, Human
gggcugcagaguggucagggcacggaaagcca

SEQ ID NO: 199271 - RNA, 18 nt, Human
gggcugcagcacgcggug

SEQ ID NO: 199272 - RNA, 32 nt, Human
gggcugcagcaugggcagaaaacgcugaccug

SEQ ID NO: 199273 - RNA, 32 nt, Human
gggcugcagggcugcgggcgcuugguucggcc

SEQ ID NO: 199274 - RNA, 32 nt, Human
gggcugcagggugcuugcuucggaacaagcuc

SEQ ID NO: 199275 - RNA, 32 nt, Human
gggcugcagugagccgagauugugccacugca

SEQ ID NO: 199276 - RNA, 32 nt, Human
gggcugcaugcgaaugugguuugcuaagaagg

SEQ ID NO: 199277 - RNA, 25 nt, Human
gggcugcauggaccucagggggcug

SEQ ID NO: 199278 - RNA, 32 nt, Human
gggcugccaaaaaggccaccugugcuucacca

SEQ ID NO: 199279 - RNA, 32 nt, Human
gggcugccaccagcucuccacccuccugguuc

SEQ ID NO: 199280 - RNA, 32 nt, Human
gggcugccagaagagagagaggcagagagcag

SEQ ID NO: 199281 - RNA, 19 nt, Human
gggcugccagccucaggca

SEQ ID NO: 199282 - RNA, 32 nt, Human
gggcugccaggaacaggaggcgugggaaacuc

SEQ ID NO: 199283 - RNA, 18 nt, Human
gggcugccaggcuggcug

SEQ ID NO: 199284 - RNA, 24 nt, Human
gggcugcccagcuggacagauggc

SEQ ID NO: 199285 - RNA, 22 nt, Human
gggcugcccccacccgaaagac

SEQ ID NO: 199286 - RNA, 20 nt, Human
gggcugccccgcagaggggc

SEQ ID NO: 199287 - RNA, 32 nt, Human
gggcugccccucagagaugguggggagggucu

SEQ ID NO: 199288 - RNA, 32 nt, Human
gggcugcccuccugcuggacacucaggacagc

SEQ ID NO: 199289 - RNA, 32 nt, Human
gggcugcccugagucugggacuucugccucca

SEQ ID NO: 199290 - RNA, 32 nt, Human
gggcugcccugugguccagucugaggcccuuu

SEQ ID NO: 199291 - RNA, 18 nt, Human
gggcugccgaggggaggc

SEQ ID NO: 199292 - RNA, 32 nt, Human
gggcugccgcaggcacacaggccagagcuucg

SEQ ID NO: 199293 - RNA, 18 nt, Human
gggcugccgggggcgcgg

SEQ ID NO: 199294 - RNA, 24 nt, Human
gggcugccguggcugcagaugcca

SEQ ID NO: 199295 - RNA, 32 nt, Human
gggcugccucaagggguuguccacgcagguug

SEQ ID NO: 199296 - RNA, 32 nt, Human
gggcugccucagucuucagugcugauuguguc

SEQ ID NO: 199297 - RNA, 32 nt, Human
gggcugccucugaauccuuucucuaaccagag

SEQ ID NO: 199298 - RNA, 32 nt, Human
gggcugccuggcagagagccuugcuguuuaca

SEQ ID NO: 199299 - RNA, 32 nt, Human
gggcugcgacgcccucccugguggagcaacag

SEQ ID NO: 199300 - RNA, 19 nt, Human
gggcugcgagccgggaggc

SEQ ID NO: 199301 - RNA, 20 nt, Human
gggcugcgagcgcggagggc

SEQ ID NO: 199302 - RNA, 19 nt, Human
gggcugcgaggucaggcug

SEQ ID NO: 199303 - RNA, 19 nt, Human
gggcugcgcaggcgggaag

SEQ ID NO: 199304 - RNA, 20 nt, Human
gggcugcgccuccggggcug

SEQ ID NO: 199305 - RNA, 20 nt, Human
gggcugcgcgcccaggucug

SEQ ID NO: 199306 - RNA, 19 nt, Human
gggcugcgcgcuggcgcug

SEQ ID NO: 199307 - RNA, 20 nt, Human
gggcugcgcgcugggagcug

SEQ ID NO: 199308 - RNA, 18 nt, Human
gggcugcgcggcggaggc

SEQ ID NO: 199309 - RNA, 22 nt, Human
gggcugcgcgggccgcccaggg

SEQ ID NO: 199310 - RNA, 19 nt, Human
gggcugcgcggggccgggc

SEQ ID NO: 199311 - RNA, 32 nt, Human
gggcugcgcgucuccagccucugcacacacau

SEQ ID NO: 199312 - RNA, 20 nt, Human
gggcugcgcuagcugggcug

SEQ ID NO: 199313 - RNA, 32 nt, Human
gggcugcgcuggggagguuguggugcagcuga

SEQ ID NO: 199314 - RNA, 19 nt, Human
gggcugcgcuguccagcug

SEQ ID NO: 199315 - RNA, 19 nt, Human
gggcugcggagaggcgggc

SEQ ID NO: 199316 - RNA, 21 nt, Human
gggcugcggaggggcgcgcug

SEQ ID NO: 199317 - RNA, 20 nt, Human
gggcugcggcaguaaaguug

SEQ ID NO: 199318 - RNA, 19 nt, Human
gggcugcggccccgggcug

SEQ ID NO: 199319 - RNA, 19 nt, Human
gggcugcggccccgggucc

SEQ ID NO: 199320 - RNA, 20 nt, Human
gggcugcggccuaggggucc

SEQ ID NO: 199321 - RNA, 21 nt, Human
gggcugcggcggcggcggcug

SEQ ID NO: 199322 - RNA, 19 nt, Human
gggcugcggcggcugaggc

SEQ ID NO: 199323 - RNA, 20 nt, Human
gggcugcggcguacaggcug

SEQ ID NO: 199324 - RNA, 19 nt, Human
gggcugcggcucgaggcca

SEQ ID NO: 199325 - RNA, 20 nt, Human
gggcugcggcucugaggcug

SEQ ID NO: 199326 - RNA, 20 nt, Human
gggcugcggcuguggggcug

SEQ ID NO: 199327 - RNA, 32 nt, Human
gggcugcggcuuguacugccucuuguccugua

SEQ ID NO: 199328 - RNA, 17 nt, Human
gggcugcgggaggcggc

SEQ ID NO: 199329 - RNA, 32 nt, Human
gggcugcgggaggcggggguuggcgugccuga

SEQ ID NO: 199330 - RNA, 17 nt, Human
gggcugcgggcagaggc

SEQ ID NO: 199331 - RNA, 19 nt, Human
gggcugcgggcggcggggc

SEQ ID NO: 199332 - RNA, 19 nt, Human
gggcugcgggcuccaggca

SEQ ID NO: 199333 - RNA, 21 nt, Human
gggcugcggggaagaggggcu

SEQ ID NO: 199334 - RNA, 19 nt, Human
gggcugcggggcagggcug

SEQ ID NO: 199335 - RNA, 20 nt, Human
gggcugcggggucaggggcu

SEQ ID NO: 199336 - RNA, 19 nt, Human
gggcugcggguggggcgcg

SEQ ID NO: 199337 - RNA, 19 nt, Human
gggcugcggguuagggggc

SEQ ID NO: 199338 - RNA, 32 nt, Human
gggcugcgguaggccagcggugggcuggcggu

SEQ ID NO: 199339 - RNA, 21 nt, Human
gggcugcggugcccagaggcu

SEQ ID NO: 199340 - RNA, 17 nt, Human
gggcugcgguggaggcu

SEQ ID NO: 199341 - RNA, 21 nt, Human
gggcugcguacgucagagcug

SEQ ID NO: 199342 - RNA, 24 nt, Human
gggcugcguacgugcaggaggcgc

SEQ ID NO: 199343 - RNA, 19 nt, Human
gggcugcguaggggagcug

SEQ ID NO: 199344 - RNA, 18 nt, Human
gggcugcgucaaggucug

SEQ ID NO: 199345 - RNA, 21 nt, Human
gggcugcgucugcaaaggggc

SEQ ID NO: 199346 - RNA, 19 nt, Human
gggcugcgugauguggcug

SEQ ID NO: 199347 - RNA, 21 nt, Human
gggcugcgugcacacuggcug

SEQ ID NO: 199348 - RNA, 18 nt, Human
gggcugcgugcaguaagc

SEQ ID NO: 199349 - RNA, 20 nt, Human
gggcugcgugcagugggagc

SEQ ID NO: 199350 - RNA, 19 nt, Human
gggcugcgugcauugaggc

SEQ ID NO: 199351 - RNA, 18 nt, Human
gggcugcgugccgggggc

SEQ ID NO: 199352 - RNA, 32 nt, Human
gggcugcguggaacaggcgcaggugugugaug

SEQ ID NO: 199353 - RNA, 18 nt, Human
gggcugcguggcacagcu

SEQ ID NO: 199354 - RNA, 21 nt, Human
gggcugcguggggagggggcu

SEQ ID NO: 199355 - RNA, 20 nt, Human
gggcugcgugugggaggcug

SEQ ID NO: 199356 - RNA, 19 nt, Human
gggcugcguuugggagcug

SEQ ID NO: 199357 - RNA, 32 nt, Human
gggcugcuacagugaccaggacuuucuggcca

SEQ ID NO: 199358 - RNA, 32 nt, Human
gggcugcucacuucccaucaccucucacagcc

SEQ ID NO: 199359 - RNA, 20 nt, Human
gggcugcucagccucaggca

SEQ ID NO: 199360 - RNA, 32 nt, Human
gggcugcucagggcagcugccgaagguggagc

SEQ ID NO: 199361 - RNA, 22 nt, Human
gggcugcucagugccugccucu

SEQ ID NO: 199362 - RNA, 32 nt, Human
gggcugcucagugccugccucugacaaaauua

SEQ ID NO: 199363 - RNA, 25 nt, Human
gggcugcuccccaacaccugccucu

SEQ ID NO: 199364 - RNA, 32 nt, Human
gggcugcuccccugggcccagcuccccucccu

SEQ ID NO: 199365 - RNA, 32 nt, Human
gggcugcucccucuccgugcucugccuggugg

SEQ ID NO: 199366 - RNA, 32 nt, Human
gggcugcucggaggcagaggcagcaagaggcg

SEQ ID NO: 199367 - RNA, 31 nt, Human
gggcugcucggagucaccuguuggaauggac

SEQ ID NO: 199368 - RNA, 32 nt, Human
gggcugcucucgaacuccugaccucaggugau

SEQ ID NO: 199369 - RNA, 20 nt, Human
gggcugcucucgaggggggc

SEQ ID NO: 199370 - RNA, 25 nt, Human
gggcugcucuuaagcagggggccug

SEQ ID NO: 199371 - RNA, 19 nt, Human
gggcugcugaggagaccug

SEQ ID NO: 199372 - RNA, 32 nt, Human
gggcugcugcagcugcaugggugccugcugcu

SEQ ID NO: 199373 - RNA, 19 nt, Human
gggcugcugccuggggggc

SEQ ID NO: 199374 - RNA, 31 nt, Human
gggcugcugcuacuggagccugcguggaagg

SEQ ID NO: 199375 - RNA, 32 nt, Human
gggcugcugcucccccuucuuucugucuuucc

SEQ ID NO: 199376 - RNA, 21 nt, Human
gggcugcuggaggccagacug

SEQ ID NO: 199377 - RNA, 32 nt, Human
gggcugcuggcuccugcccugcuuccugugau

SEQ ID NO: 199378 - RNA, 32 nt, Human
gggcugcugggagcguagccacgucugcucca

SEQ ID NO: 199379 - RNA, 32 nt, Human
gggcugcuggugggaaaugggagccagggcag

SEQ ID NO: 199380 - RNA, 19 nt, Human
gggcugcugugcaggcggc

SEQ ID NO: 199381 - RNA, 32 nt, Human
gggcugcuucuccaccucccccaaacccugcu

SEQ ID NO: 199382 - RNA, 32 nt, Human
gggcugcuugaguguggccccaccuccuggga

SEQ ID NO: 199383 - RNA, 32 nt, Human
gggcugcuuugcuuugggagguucuuguuggu

SEQ ID NO: 199384 - RNA, 19 nt, Human
gggcuggaaaagccggcgc

SEQ ID NO: 199385 - RNA, 32 nt, Human
gggcuggaagaggauggcagaggcugcugggc

SEQ ID NO: 199386 - RNA, 17 nt, Human
gggcuggaagaggcggc

SEQ ID NO: 199387 - RNA, 21 nt, Human
gggcuggaagaggcggcggcg

SEQ ID NO: 199388 - RNA, 22 nt, Human
gggcuggaaggaagucacggug

SEQ ID NO: 199389 - RNA, 32 nt, Human
gggcuggaaggacaggccugcccaugcaggag

SEQ ID NO: 199390 - RNA, 22 nt, Human
gggcuggaauaggaagccagug

SEQ ID NO: 199391 - RNA, 32 nt, Human
gggcuggaaugauuucagcucacugcaaccuu

SEQ ID NO: 199392 - RNA, 32 nt, Human
gggcuggacaaggaagcagagagcagaagaaa

SEQ ID NO: 199393 - RNA, 32 nt, Human
gggcuggacacgguuguggauccagagaagag

SEQ ID NO: 199394 - RNA, 21 nt, Human
gggcuggacaggacacacucu

SEQ ID NO: 199395 - RNA, 19 nt, Human
gggcuggacagggcaaggu

SEQ ID NO: 199396 - RNA, 21 nt, Human
gggcuggacgaggaggcgacg

SEQ ID NO: 199397 - RNA, 19 nt, Human
gggcuggacggggacgagg

SEQ ID NO: 199398 - RNA, 32 nt, Human
gggcuggacucuuccugcaggaaaggcugggc

SEQ ID NO: 199399 - RNA, 32 nt, Human
gggcuggacuggacgccucuccccgcccggcc

SEQ ID NO: 199400 - RNA, 32 nt, Human
gggcuggagaaggcagacccacccuuaaucug

SEQ ID NO: 199401 - RNA, 32 nt, Human
gggcuggagacucagcguguguuuggcaaccg

SEQ ID NO: 199402 - RNA, 32 nt, Human
gggcuggagagggagagaggagcggaagcuga

SEQ ID NO: 199403 - RNA, 32 nt, Human
gggcuggagagggggaggccuucgggaagagg

SEQ ID NO: 199404 - RNA, 32 nt, Human
gggcuggagaggguggcaggcagugguugugg

SEQ ID NO: 199405 - RNA, 32 nt, Human
gggcuggagcccagagagggagugagaugaca

SEQ ID NO: 199406 - RNA, 32 nt, Human
gggcuggagcccagcaggagccgggaacugcc

SEQ ID NO: 199407 - RNA, 32 nt, Human
gggcuggagccgcgggaccagcgccugaggug

SEQ ID NO: 199408 - RNA, 32 nt, Human
gggcuggagcggggaucugaugaaaaggucag

SEQ ID NO: 199409 - RNA, 32 nt, Human
gggcuggaggcagagaguguaagugugcagcc

SEQ ID NO: 199410 - RNA, 32 nt, Human
gggcuggaggccagaggugucagcaacacugu

SEQ ID NO: 199411 - RNA, 23 nt, Human
gggcuggaggccggcgucgggga

SEQ ID NO: 199412 - RNA, 32 nt, Human
gggcuggaggcuggggcaggaacauggauccu

SEQ ID NO: 199413 - RNA, 32 nt, Human
gggcuggagggcugugugugguccuucccugg

SEQ ID NO: 199414 - RNA, 32 nt, Human
gggcuggaggggaagaggggccccgaggaugg

SEQ ID NO: 199415 - RNA, 32 nt, Human
gggcuggaggggcaguguugcuguucauagau

SEQ ID NO: 199416 - RNA, 20 nt, Human
gggcuggagggggcagagug

SEQ ID NO: 199417 - RNA, 17 nt, Human
gggcuggaggggggcag

SEQ ID NO: 199418 - RNA, 32 nt, Human
gggcuggaggugcugguagcugaggggacggg

SEQ ID NO: 199419 - RNA, 32 nt, Human
gggcuggaggugggggugggggcagccaaguc

SEQ ID NO: 199420 - RNA, 32 nt, Human
gggcuggaguucagguccugccccagagaaau

SEQ ID NO: 199421 - RNA, 32 nt, Human
gggcuggauagcuucccagcacccucagagcc

SEQ ID NO: 199422 - RNA, 21 nt, Human
gggcuggaucggcgaccggug

SEQ ID NO: 199423 - RNA, 32 nt, Human
gggcuggaucugggggcuagcagugaguaccc

SEQ ID NO: 199424 - RNA, 25 nt, Human
gggcuggauggaguggggugcggug

SEQ ID NO: 199425 - RNA, 19 nt, Human
gggcuggaugggacgcagg

SEQ ID NO: 199426 - RNA, 32 nt, Human
gggcuggauuuggagccaggguccagguugua

SEQ ID NO: 199427 - RNA, 32 nt, Human
gggcuggcaacuuagagguggggagcagagaa

SEQ ID NO: 199428 - RNA, 22 nt, Human
gggcuggcaaggcccccggagg

SEQ ID NO: 199429 - RNA, 32 nt, Human
gggcuggcaaggggauauucagcucugcaaag

SEQ ID NO: 199430 - RNA, 32 nt, Human
gggcuggcaccugggcacagugcuuccaggua

SEQ ID NO: 199431 - RNA, 20 nt, Human
gggcuggcaccugggcgcgg

SEQ ID NO: 199432 - RNA, 32 nt, Human
gggcuggcacucgauaccucuggcaagaggau

SEQ ID NO: 199433 - RNA, 20 nt, Human
gggcuggcagaggacaggug

SEQ ID NO: 199434 - RNA, 19 nt, Human
gggcuggcagaggggacag

SEQ ID NO: 199435 - RNA, 32 nt, Human
gggcuggccaucgccucgcacagcgugugccu

SEQ ID NO: 199436 - RNA, 21 nt, Human
gggcuggccggaggggcaggu

SEQ ID NO: 199437 - RNA, 32 nt, Human
gggcuggccucgaacuccugaccccaggugau

SEQ ID NO: 199438 - RNA, 20 nt, Human
gggcuggcgggggcgcugug

SEQ ID NO: 199439 - RNA, 32 nt, Human
gggcuggcgguacccacccagcccaagggagu

SEQ ID NO: 199440 - RNA, 32 nt, Human
gggcuggcguccaaggauuugagcccugucga

SEQ ID NO: 199441 - RNA, 32 nt, Human
gggcuggcucugcgcccugccuaccuguccag

SEQ ID NO: 199442 - RNA, 32 nt, Human
gggcuggcugagagccgcaggagcagcaggcu

SEQ ID NO: 199443 - RNA, 32 nt, Human
gggcuggcuggcucagugggcagcagggacag

SEQ ID NO: 199444 - RNA, 32 nt, Human
gggcuggcugugguggagaauguagcgcaacc

SEQ ID NO: 199445 - RNA, 32 nt, Human
gggcuggcuuugugcccuaaccccugggaugc

SEQ ID NO: 199446 - RNA, 23 nt, Human
gggcuggcuuuugaggggcgcgg

SEQ ID NO: 199447 - RNA, 30 nt, Human
gggcugggaagccagaaggacgaugcugag

SEQ ID NO: 199448 - RNA, 22 nt, Human
gggcugggaaugaagcgaugua

SEQ ID NO: 199449 - RNA, 32 nt, Human
gggcugggaauggaggggagaauuucuagggg

SEQ ID NO: 199450 - RNA, 22 nt, Human
gggcugggaauggggacacggu

SEQ ID NO: 199451 - RNA, 20 nt, Human
gggcugggaccagccccuag

SEQ ID NO: 199452 - RNA, 32 nt, Human
gggcugggacccggggaagguuugagggcccu

SEQ ID NO: 199453 - RNA, 32 nt, Human
gggcugggacugcugcuggggugcaggugagg

SEQ ID NO: 199454 - RNA, 32 nt, Human
gggcugggagaggcagacccacccuuaaucug

SEQ ID NO: 199455 - RNA, 32 nt, Human
gggcugggagcagaggucgcggagguggcgag

SEQ ID NO: 199456 - RNA, 32 nt, Human
gggcugggaggcggcggcggcggcucgggcug

SEQ ID NO: 199457 - RNA, 32 nt, Human
gggcugggagggagagaccggagcagcgccag

SEQ ID NO: 199458 - RNA, 32 nt, Human
gggcugggagggagagcccugggagcccaggg

SEQ ID NO: 199459 - RNA, 18 nt, Human
gggcugggauggggacgg

SEQ ID NO: 199460 - RNA, 32 nt, Human
gggcugggcaccaccagugugugggcagcacc

SEQ ID NO: 199461 - RNA, 32 nt, Human
gggcugggcaggacccucccacacaccugcac

SEQ ID NO: 199462 - RNA, 19 nt, Human
gggcugggcaggggcggug

SEQ ID NO: 199463 - RNA, 32 nt, Human
gggcugggcaggggcgguggaggacucaggaa

SEQ ID NO: 199464 - RNA, 32 nt, Human
gggcugggcagguccuggggaggcugagacug

SEQ ID NO: 199465 - RNA, 20 nt, Human
gggcugggcccacccaggga

SEQ ID NO: 199466 - RNA, 20 nt, Human
gggcugggcccagcgaggug

SEQ ID NO: 199467 - RNA, 32 nt, Human
gggcugggccuggagugaagcuggaagggcua

SEQ ID NO: 199468 - RNA, 19 nt, Human
gggcugggcgcggggccgg

SEQ ID NO: 199469 - RNA, 19 nt, Human
gggcugggcgcggggcgcg

SEQ ID NO: 199470 - RNA, 20 nt, Human
gggcugggcggcggcggcgg

SEQ ID NO: 199471 - RNA, 32 nt, Human
gggcugggcggcggggacagcggggacggcac

SEQ ID NO: 199472 - RNA, 21 nt, Human
gggcugggcggggcgccggug

SEQ ID NO: 199473 - RNA, 32 nt, Human
gggcugggcuccaggccagcauccagguccag

SEQ ID NO: 199474 - RNA, 20 nt, Human
gggcugggcucugggcggug

SEQ ID NO: 199475 - RNA, 32 nt, Human
gggcugggcugcagguccuggcguugugcugg

SEQ ID NO: 199476 - RNA, 32 nt, Human
gggcugggcuguagaagaguuguuggggaagg

SEQ ID NO: 199477 - RNA, 32 nt, Human
gggcuggggaaagacggcaccgggaaacucug

SEQ ID NO: 199478 - RNA, 32 nt, Human
gggcuggggaaggacguggcucugaagacgga

SEQ ID NO: 199479 - RNA, 21 nt, Human
gggcuggggagcaggcaggug

SEQ ID NO: 199480 - RNA, 19 nt, Human
gggcuggggagcucaggca

SEQ ID NO: 199481 - RNA, 32 nt, Human
gggcuggggagcucaguucccauugcuugugc

SEQ ID NO: 199482 - RNA, 18 nt, Human
gggcuggggagggggcug

SEQ ID NO: 199483 - RNA, 16 nt, Human
gggcuggggagggggu

SEQ ID NO: 199484 - RNA, 32 nt, Human
gggcuggggagugucauggggguggggacagg

SEQ ID NO: 199485 - RNA, 32 nt, Human
gggcuggggauggaugggagggaaggggaggg

SEQ ID NO: 199486 - RNA, 32 nt, Human
gggcuggggcacccuccgacggcagagccucc

SEQ ID NO: 199487 - RNA, 32 nt, Human
gggcuggggcagagaaaggaagggaacuggag

SEQ ID NO: 199488 - RNA, 32 nt, Human
gggcuggggcaggaggggagugaggcagguga

SEQ ID NO: 199489 - RNA, 32 nt, Human
gggcuggggccccagaggugggcuagguguaa

SEQ ID NO: 199490 - RNA, 21 nt, Human
gggcuggggccgggcgcagug

SEQ ID NO: 199491 - RNA, 32 nt, Human
gggcuggggccuggcccccuccugucuuccuc

SEQ ID NO: 199492 - RNA, 32 nt, Human
gggcuggggcggagcuggggucugggcagugc

SEQ ID NO: 199493 - RNA, 18 nt, Human
gggcuggggcggcggcgg

SEQ ID NO: 199494 - RNA, 32 nt, Human
gggcuggggcucugguguagaccauggaccaa

SEQ ID NO: 199495 - RNA, 32 nt, Human
gggcuggggcugagcagcgauccugcuuuguc

SEQ ID NO: 199496 - RNA, 32 nt, Human
gggcuggggcugggagcacacacgcugggacc

SEQ ID NO: 199497 - RNA, 32 nt, Human
gggcuggggcuggggcugguuagaccacuucu

SEQ ID NO: 199498 - RNA, 32 nt, Human
gggcugggggacacgggcacucacuggaugga

SEQ ID NO: 199499 - RNA, 19 nt, Human
gggcugggggaggcgggug

SEQ ID NO: 199500 - RNA, 32 nt, Human
gggcugggggccuggagugucucacuuggggg

SEQ ID NO: 199501 - RNA, 19 nt, Human
gggcuggggggaggaggca

SEQ ID NO: 199502 - RNA, 17 nt, Human
gggcuggggguggggug

SEQ ID NO: 199503 - RNA, 32 nt, Human
gggcugggggugggugggcagggcuuuaugcc

SEQ ID NO: 199504 - RNA, 23 nt, Human
gggcuggggguuggucuuggaaa

SEQ ID NO: 199505 - RNA, 17 nt, Human
gggcuggggucaggggg

SEQ ID NO: 199506 - RNA, 32 nt, Human
gggcuggggugagcucagggaggggaagagga

SEQ ID NO: 199507 - RNA, 32 nt, Human
gggcuggggugagggcuggugguuggugaaag

SEQ ID NO: 199508 - RNA, 20 nt, Human
gggcugggguggagggcggg

SEQ ID NO: 199509 - RNA, 32 nt, Human
gggcugggguggcaauggcgguuuggucccuc

SEQ ID NO: 199510 - RNA, 32 nt, Human
gggcuggguaccaaugcugcaggucaacagcu

SEQ ID NO: 199511 - RNA, 32 nt, Human
gggcuggguggaggagagaguggcacccucug

SEQ ID NO: 199512 - RNA, 32 nt, Human
gggcuggguggagguguggcugggcugggggc

SEQ ID NO: 199513 - RNA, 20 nt, Human
gggcugggugggaggcggug

SEQ ID NO: 199514 - RNA, 18 nt, Human
gggcuggguggggcgcca

SEQ ID NO: 199515 - RNA, 18 nt, Human
gggcuggguuaccugggc

SEQ ID NO: 199516 - RNA, 32 nt, Human
gggcugguacccaggccuggagcagcgguaca

SEQ ID NO: 199517 - RNA, 32 nt, Human
gggcugguagguggggcgagacuugcuggcuu

SEQ ID NO: 199518 - RNA, 32 nt, Human
gggcuggucaguugcauccagagaugccuccc

SEQ ID NO: 199519 - RNA, 32 nt, Human
gggcuggucaucuuugcaggucccgacacuaa

SEQ ID NO: 199520 - RNA, 32 nt, Human
gggcugguccagcggcggcggaggcuggcgcu

SEQ ID NO: 199521 - RNA, 32 nt, Human
gggcuggucgaagccugaagccgcaguauguc

SEQ ID NO: 199522 - RNA, 32 nt, Human
gggcuggucuaaaacuccugaccucaagugau

SEQ ID NO: 199523 - RNA, 32 nt, Human
gggcuggucucaaacuccuaaggucauccacc

SEQ ID NO: 199524 - RNA, 32 nt, Human
gggcuggucucaaacuccugaccucaagugau

SEQ ID NO: 199525 - RNA, 32 nt, Human
gggcuggucucaaacuccugaccuccggugau

SEQ ID NO: 199526 - RNA, 32 nt, Human
gggcuggucucaaacuccugaccucuggugau

SEQ ID NO: 199527 - RNA, 32 nt, Human
gggcuggucucaaacuccugaccucuugaucc

SEQ ID NO: 199528 - RNA, 32 nt, Human
gggcuggucucgaacucccaaccucaggugau

SEQ ID NO: 199529 - RNA, 32 nt, Human
gggcuggucucgaacucccgaccucaagugau

SEQ ID NO: 199530 - RNA, 32 nt, Human
gggcuggucucgaacucccgaccucaggugau

SEQ ID NO: 199531 - RNA, 32 nt, Human
gggcuggucucgaacuccuaaccucaagugau

SEQ ID NO: 199532 - RNA, 32 nt, Human
gggcuggucucgaacuccugaccacagguaau

SEQ ID NO: 199533 - RNA, 32 nt, Human
gggcuggucucgaacuccugaccucaggugau

SEQ ID NO: 199534 - RNA, 32 nt, Human
gggcuggucucgaacuccugaccuuaaaugag

SEQ ID NO: 199535 - RNA, 32 nt, Human
gggcuggucucgaacucuugaccucgggugau

SEQ ID NO: 199536 - RNA, 32 nt, Human
gggcuggucucugacaggcucagcuggagagg

SEQ ID NO: 199537 - RNA, 32 nt, Human
gggcuggucucuggagcuguucugccagagug

SEQ ID NO: 199538 - RNA, 24 nt, Human
gggcuggucuuagauaggaaugca

SEQ ID NO: 199539 - RNA, 32 nt, Human
gggcuggucuugaacuccugaccucaaguaau

SEQ ID NO: 199540 - RNA, 32 nt, Human
gggcuggucuugaacuccugaccucagguaau

SEQ ID NO: 199541 - RNA, 32 nt, Human
gggcuggucuugaacuccugacuucaagugau

SEQ ID NO: 199542 - RNA, 32 nt, Human
gggcuggucuugaacuccugagcucaagugau

SEQ ID NO: 199543 - RNA, 32 nt, Human
gggcuggucuugaacuuccgaccucaggugau

SEQ ID NO: 199544 - RNA, 32 nt, Human
gggcuggugagcgccccuguccccagccccca

SEQ ID NO: 199545 - RNA, 32 nt, Human
gggcuggugaggccggcccugccccucccuag

SEQ ID NO: 199546 - RNA, 32 nt, Human
gggcuggugagguuggggagaaaggaagagcu

SEQ ID NO: 199547 - RNA, 20 nt, Human
gggcuggugccacgccccag

SEQ ID NO: 199548 - RNA, 20 nt, Human
gggcuggugcccggcccagg

SEQ ID NO: 199549 - RNA, 32 nt, Human
gggcuggugcucauggcacuuccuucuugcuc

SEQ ID NO: 199550 - RNA, 18 nt, Human
gggcugguggcuggggga

SEQ ID NO: 199551 - RNA, 20 nt, Human
gggcuggugggcaggggggu

SEQ ID NO: 199552 - RNA, 32 nt, Human
gggcuggugggguggaggaugcugaguggugg

SEQ ID NO: 199553 - RNA, 20 nt, Human
gggcuggugucaggcccagg

SEQ ID NO: 199554 - RNA, 32 nt, Human
gggcuggugucagugagaaaaauuuaucaaug

SEQ ID NO: 199555 - RNA, 32 nt, Human
gggcuggugugggcuugggauccuccugguga

SEQ ID NO: 199556 - RNA, 20 nt, Human
gggcuggugugugggagcug

SEQ ID NO: 199557 - RNA, 19 nt, Human
gggcugguuaggcccagca

SEQ ID NO: 199558 - RNA, 32 nt, Human
gggcugguuccuucuagaggcuccagcggagg

SEQ ID NO: 199559 - RNA, 32 nt, Human
gggcugguugagggucauacagaaagucagug

SEQ ID NO: 199560 - RNA, 32 nt, Human
gggcugguuucaaacuccugaccucaguugau

SEQ ID NO: 199561 - RNA, 32 nt, Human
gggcugguuucuccucuuggcccuggccuaca

SEQ ID NO: 199562 - RNA, 32 nt, Human
gggcuguaaaaucuguccccagaacuggagag

SEQ ID NO: 199563 - RNA, 21 nt, Human
gggcuguaagcaagcucaggc

SEQ ID NO: 199564 - RNA, 21 nt, Human
gggcuguacauccagcuacag

SEQ ID NO: 199565 - RNA, 22 nt, Human
gggcuguacauccagcuacaga

SEQ ID NO: 199566 - RNA, 32 nt, Human
gggcuguaggagcuuguuuagcccaccugcau

SEQ ID NO: 199567 - RNA, 32 nt, Human
gggcuguagggagggcagggggaggagaguau

SEQ ID NO: 199568 - RNA, 21 nt, Human
gggcuguagggggaggcagug

SEQ ID NO: 199569 - RNA, 32 nt, Human
gggcuguaggucgcugugcugugugauccccc

SEQ ID NO: 199570 - RNA, 21 nt, Human
gggcuguauugaagugggcug

SEQ ID NO: 199571 - RNA, 32 nt, Human
gggcuguauuuggaagaagaggcgcugccucc

SEQ ID NO: 199572 - RNA, 32 nt, Human
gggcuguauuuggagaucaugggcugauucca

SEQ ID NO: 199573 - RNA, 32 nt, Human
gggcugucaaaaccaggguaaccuccuacaug

SEQ ID NO: 199574 - RNA, 32 nt, Human
gggcugucaauaacccccuuccucacuggcca

SEQ ID NO: 199575 - RNA, 19 nt, Human
gggcuguccaggcaaugac

SEQ ID NO: 199576 - RNA, 32 nt, Human
gggcuguccaugcacuccagcacacagcccgg

SEQ ID NO: 199577 - RNA, 19 nt, Human
gggcuguccccacacugac

SEQ ID NO: 199578 - RNA, 20 nt, Human
gggcugucccucugggcggc

SEQ ID NO: 199579 - RNA, 18 nt, Human
gggcuguccugggggcug

SEQ ID NO: 199580 - RNA, 32 nt, Human
gggcugucgcccaggccuaagugagucgugug

SEQ ID NO: 199581 - RNA, 19 nt, Human
gggcugucgucacgacgac

SEQ ID NO: 199582 - RNA, 32 nt, Human
gggcugucuaacugauggucaggaagaacuuc

SEQ ID NO: 199583 - RNA, 32 nt, Human
gggcugucugcagaaacccccaucaagagcug

SEQ ID NO: 199584 - RNA, 32 nt, Human
gggcugucuuauccacauuuggcuccaccucu

SEQ ID NO: 199585 - RNA, 32 nt, Human
gggcugucuuccuagcuugcagacaagugccu

SEQ ID NO: 199586 - RNA, 32 nt, Human
gggcugucuuggucacugcugagacccacagg

SEQ ID NO: 199587 - RNA, 20 nt, Human
gggcugugagagggaggcug

SEQ ID NO: 199588 - RNA, 19 nt, Human
gggcugugagaggggccgg

SEQ ID NO: 199589 - RNA, 18 nt, Human
gggcugugaggagggcug

SEQ ID NO: 199590 - RNA, 19 nt, Human
gggcugugaugaguggcug

SEQ ID NO: 199591 - RNA, 21 nt, Human
gggcugugcacccccagcggg

SEQ ID NO: 199592 - RNA, 32 nt, Human
gggcugugcaccugccucccacugacccagac

SEQ ID NO: 199593 - RNA, 21 nt, Human
gggcugugcagaagggggcug

SEQ ID NO: 199594 - RNA, 32 nt, Human
gggcugugccagcucccagagcuucggaagaa

SEQ ID NO: 199595 - RNA, 32 nt, Human
gggcugugcccaggccacagagcagcugcagg

SEQ ID NO: 199596 - RNA, 19 nt, Human
gggcugugccgcagagcug

SEQ ID NO: 199597 - RNA, 19 nt, Human
gggcugugccguggagcug

SEQ ID NO: 199598 - RNA, 32 nt, Human
gggcugugccugaggcuggcugggggcaggac

SEQ ID NO: 199599 - RNA, 19 nt, Human
gggcugugcuagggaccug

SEQ ID NO: 199600 - RNA, 19 nt, Human
gggcugugcugaggggcug

SEQ ID NO: 199601 - RNA, 22 nt, Human
gggcugugcuggggccagacug

SEQ ID NO: 199602 - RNA, 16 nt, Human
gggcuguggaggcgac

SEQ ID NO: 199603 - RNA, 18 nt, Human
gggcuguggcaaaggcug

SEQ ID NO: 199604 - RNA, 32 nt, Human
gggcuguggcacgugggcggagacugaguggc

SEQ ID NO: 199605 - RNA, 20 nt, Human
gggcuguggcgugggggcug

SEQ ID NO: 199606 - RNA, 20 nt, Human
gggcugugggaagggggcug

SEQ ID NO: 199607 - RNA, 32 nt, Human
gggcugugggacuggcuggaggccugccugug

SEQ ID NO: 199608 - RNA, 21 nt, Human
gggcugugggcaggggaccug

SEQ ID NO: 199609 - RNA, 18 nt, Human
gggcugugggcggagcug

SEQ ID NO: 199610 - RNA, 32 nt, Human
gggcugugggcgugagaccugccccuccucuc

SEQ ID NO: 199611 - RNA, 32 nt, Human
gggcugugggcuucugggucugugccgacaaa

SEQ ID NO: 199612 - RNA, 20 nt, Human
gggcugugggguaggggcug

SEQ ID NO: 199613 - RNA, 32 nt, Human
gggcuguggugaggaugaaggggucuggcagc

SEQ ID NO: 199614 - RNA, 21 nt, Human
gggcugugucagaauuaugua

SEQ ID NO: 199615 - RNA, 32 nt, Human
gggcugugucugggugagggauggcgggguac

SEQ ID NO: 199616 - RNA, 19 nt, Human
gggcugugugaaggcacug

SEQ ID NO: 199617 - RNA, 32 nt, Human
gggcugugugaucucuucaggguggggugguc

SEQ ID NO: 199618 - RNA, 20 nt, Human
gggcugugugugggaggcug

SEQ ID NO: 199619 - RNA, 32 nt, Human
gggcuguuagcucggcugggcacgggcggcuc

SEQ ID NO: 199620 - RNA, 32 nt, Human
gggcuguuccugggccuggcucuuacaggcuc

SEQ ID NO: 199621 - RNA, 32 nt, Human
gggcuguucugagcuuuaggcaagagaagaga

SEQ ID NO: 199622 - RNA, 32 nt, Human
gggcuguucugggcaccuggaagcacaguggg

SEQ ID NO: 199623 - RNA, 32 nt, Human
gggcuguuggcugggggcaugggggaggcucu

SEQ ID NO: 199624 - RNA, 32 nt, Human
gggcuguugguggagguuguacugugguacca

SEQ ID NO: 199625 - RNA, 32 nt, Human
gggcuuaaaagaaccccaguaccgacuaagca

SEQ ID NO: 199626 - RNA, 32 nt, Human
gggcuuaaagcccgcugcuccuuuucgguaga

SEQ ID NO: 199627 - RNA, 32 nt, Human
gggcuuaaaucaugggcuaucucuccacagcc

SEQ ID NO: 199628 - RNA, 32 nt, Human
gggcuuaaaucucaaacuuuguuaggaguaac

SEQ ID NO: 199629 - RNA, 32 nt, Human
gggcuuaacacaugaaauggguggcacagauc

SEQ ID NO: 199630 - RNA, 23 nt, Human
gggcuuaagcaauccuccugccu

SEQ ID NO: 199631 - RNA, 32 nt, Human
gggcuuaaguggguugcuuccaggcagaagca

SEQ ID NO: 199632 - RNA, 32 nt, Human
gggcuuacaacaaaagcaguucuuccuaaggc

SEQ ID NO: 199633 - RNA, 32 nt, Human
gggcuuaccuaccuuucuacugcaucauauuc

SEQ ID NO: 199634 - RNA, 32 nt, Human
gggcuuacugacaguugcccagaucugaaggg

SEQ ID NO: 199635 - RNA, 32 nt, Human
gggcuuagcaccacccaccaaauguucuuuuc

SEQ ID NO: 199636 - RNA, 32 nt, Human
gggcuuaggaaaacaauccaacucccuagccc

SEQ ID NO: 199637 - RNA, 32 nt, Human
gggcuuauggguggagguugggaagaggauga

SEQ ID NO: 199638 - RNA, 32 nt, Human
gggcuucaaccagggacauccaaaccggaagc

SEQ ID NO: 199639 - RNA, 32 nt, Human
gggcuucaaguggucacaaagaggguggcugu

SEQ ID NO: 199640 - RNA, 31 nt, Human
gggcuucacagcuugaguuaaccuugcuuuu

SEQ ID NO: 199641 - RNA, 32 nt, Human
gggcuucacaguuuacaaagcgcuuucucaua

SEQ ID NO: 199642 - RNA, 32 nt, Human
gggcuucacaugccacuggaaacaacagacuc

SEQ ID NO: 199643 - RNA, 32 nt, Human
gggcuucacccaggaugacguacaggcugcag

SEQ ID NO: 199644 - RNA, 23 nt, Human
gggcuucagaauucagccugagg

SEQ ID NO: 199645 - RNA, 32 nt, Human
gggcuucagaauucagccugagggcaaugggg

SEQ ID NO: 199646 - RNA, 21 nt, Human
gggcuucagaggauuuggaga

SEQ ID NO: 199647 - RNA, 32 nt, Human
gggcuucagaguggguuggaaaaauggaggug

SEQ ID NO: 199648 - RNA, 32 nt, Human
gggcuucagaugcguccauguccugguaaugg

SEQ ID NO: 199649 - RNA, 32 nt, Human
gggcuucagauuccccaucugaauauaauaga

SEQ ID NO: 199650 - RNA, 32 nt, Human
gggcuucagcagccacaccagcccagcccagc

SEQ ID NO: 199651 - RNA, 32 nt, Human
gggcuucagcaggagcccuggacucaucauca

SEQ ID NO: 199652 - RNA, 23 nt, Human
gggcuucagccaggugcucgaga

SEQ ID NO: 199653 - RNA, 32 nt, Human
gggcuucagccugucccgggguugccugaggc

SEQ ID NO: 199654 - RNA, 21 nt, Human
gggcuucagcgaggcgggagg

SEQ ID NO: 199655 - RNA, 22 nt, Human
gggcuucagcgggaggcagcag

SEQ ID NO: 199656 - RNA, 18 nt, Human
gggcuucaggacgcggga

SEQ ID NO: 199657 - RNA, 32 nt, Human
gggcuucaucccugugaaggcacagggccugc

SEQ ID NO: 199658 - RNA, 32 nt, Human
gggcuucauccuuccagggaggagaagaggga

SEQ ID NO: 199659 - RNA, 32 nt, Human
gggcuuccacauuaaggugauccgggaccaga

SEQ ID NO: 199660 - RNA, 32 nt, Human
gggcuuccagccuccagaacugugagaaauaa

SEQ ID NO: 199661 - RNA, 21 nt, Human
gggcuuccccgcugccgggaa

SEQ ID NO: 199662 - RNA, 32 nt, Human
gggcuuccccuccaaaggaccuucugcagugg

SEQ ID NO: 199663 - RNA, 32 nt, Human
gggcuucccucgcuucccgguauuguuugcaa

SEQ ID NO: 199664 - RNA, 17 nt, Human
gggcuuccgcagccccc

SEQ ID NO: 199665 - RNA, 18 nt, Human
gggcuuccgcagcccccu

SEQ ID NO: 199666 - RNA, 32 nt, Human
gggcuuccgcugggacuaggaucagggugugg

SEQ ID NO: 199667 - RNA, 32 nt, Human
gggcuuccugcaggcauccucaguccacacuu

SEQ ID NO: 199668 - RNA, 21 nt, Human
gggcuuccugcccccuccuug

SEQ ID NO: 199669 - RNA, 32 nt, Human
gggcuuccugccgucccccgacugccucauuc

SEQ ID NO: 199670 - RNA, 25 nt, Human
gggcuuccuuucucggggcugggaa

SEQ ID NO: 199671 - RNA, 22 nt, Human
gggcuuccuuuggggccgggaa

SEQ ID NO: 199672 - RNA, 32 nt, Human
gggcuucgagaaagggcccggcaggaggagaa

SEQ ID NO: 199673 - RNA, 32 nt, Human
gggcuucgcuuccuuagccuugcucaggugca

SEQ ID NO: 199674 - RNA, 23 nt, Human
gggcuucggcagucggcuggggg

SEQ ID NO: 199675 - RNA, 25 nt, Human
gggcuucggccuccggcgucgggaa

SEQ ID NO: 199676 - RNA, 21 nt, Human
gggcuucgggggcaccgggga

SEQ ID NO: 199677 - RNA, 32 nt, Human
gggcuucuaccaccauccccugaauugggaau

SEQ ID NO: 199678 - RNA, 32 nt, Human
gggcuucucagcgggucaagugcaguaccugg

SEQ ID NO: 199679 - RNA, 32 nt, Human
gggcuucucagcuccccucccuuccagcccag

SEQ ID NO: 199680 - RNA, 30 nt, Human
gggcuucuccacgcuuugcuccuggcuugu

SEQ ID NO: 199681 - RNA, 32 nt, Human
gggcuucuccccucgcugcugcacccuggcuu

SEQ ID NO: 199682 - RNA, 32 nt, Human
gggcuucucucauccaugcuggaauuucauuu

SEQ ID NO: 199683 - RNA, 32 nt, Human
gggcuucucugggagcucuccaguggcacugc

SEQ ID NO: 199684 - RNA, 32 nt, Human
gggcuucugcaaccgcuuuccacggguuccac

SEQ ID NO: 199685 - RNA, 32 nt, Human
gggcuucugcaggcuucagccauccacuucac

SEQ ID NO: 199686 - RNA, 32 nt, Human
gggcuucugcgcuguuguuggggaagggaccc

SEQ ID NO: 199687 - RNA, 32 nt, Human
gggcuucugcucuucucaccagaaagaacauu

SEQ ID NO: 199688 - RNA, 32 nt, Human
gggcuucuggaaagcuagaggcugggcugagc

SEQ ID NO: 199689 - RNA, 17 nt, Human
gggcuucuggauggaca

SEQ ID NO: 199690 - RNA, 32 nt, Human
gggcuucugggcagacucuggucaagaagcau

SEQ ID NO: 199691 - RNA, 23 nt, Human
gggcuucugggcaggcucacgca

SEQ ID NO: 199692 - RNA, 32 nt, Human
gggcuucugggccagccaugcccacgccccuc

SEQ ID NO: 199693 - RNA, 21 nt, Human
gggcuucuggggcguugggaa

SEQ ID NO: 199694 - RNA, 32 nt, Human
gggcuucuguaauuccagcuacuugggaggcu

SEQ ID NO: 199695 - RNA, 32 nt, Human
gggcuucuucuccccuucuuccuuuccccuuu

SEQ ID NO: 199696 - RNA, 23 nt, Human
gggcuucuuuuccgcaaaugcca

SEQ ID NO: 199697 - RNA, 32 nt, Human
gggcuugaaguaggagcccagcaaagaaccac

SEQ ID NO: 199698 - RNA, 32 nt, Human
gggcuugaagugaaggaacagaggcagggggu

SEQ ID NO: 199699 - RNA, 32 nt, Human
gggcuugaggaucaaaugaggggcuccaccca

SEQ ID NO: 199700 - RNA, 32 nt, Human
gggcuugaggggugauggaggcagguuccccu

SEQ ID NO: 199701 - RNA, 32 nt, Human
gggcuugagucucugcaguggggcugagcccg

SEQ ID NO: 199702 - RNA, 32 nt, Human
gggcuugaucuccauucucugcuuugcugcau

SEQ ID NO: 199703 - RNA, 32 nt, Human
gggcuugaugggcuugucuuccaggcacaccc

SEQ ID NO: 199704 - RNA, 32 nt, Human
gggcuugauuccugccuaucccugccagauac

SEQ ID NO: 199705 - RNA, 32 nt, Human
gggcuugauuuguuuagacugaaggaagacgu

SEQ ID NO: 199706 - RNA, 32 nt, Human
gggcuugcaacuuagcucacaccugaccaauc

SEQ ID NO: 199707 - RNA, 32 nt, Human
gggcuugcccccgugugguccucggagcggcc

SEQ ID NO: 199708 - RNA, 32 nt, Human
gggcuugcccuccaccuuggacuuggaagaag

SEQ ID NO: 199709 - RNA, 32 nt, Human
gggcuugccggccagacuucucuccccugcgg

SEQ ID NO: 199710 - RNA, 32 nt, Human
gggcuugcuccugcaaccaguaucuccuugga

SEQ ID NO: 199711 - RNA, 32 nt, Human
gggcuugcugggaagagaggcgaagccagguc

SEQ ID NO: 199712 - RNA, 21 nt, Human
gggcuugcugggccucugaga

SEQ ID NO: 199713 - RNA, 32 nt, Human
gggcuuggaaggagacaggaauggggcgagga

SEQ ID NO: 199714 - RNA, 19 nt, Human
gggcuuggagaaggggcug

SEQ ID NO: 199715 - RNA, 32 nt, Human
gggcuuggagcagccuugcucaccacuguguc

SEQ ID NO: 199716 - RNA, 32 nt, Human
gggcuuggaguggggcuggugcccgggacaga

SEQ ID NO: 199717 - RNA, 32 nt, Human
gggcuuggcaggggcccagcuggggcugggcc

SEQ ID NO: 199718 - RNA, 32 nt, Human
gggcuuggcgaaugcacgucugccugagaacc

SEQ ID NO: 199719 - RNA, 32 nt, Human
gggcuuggcggaggacccagaauggcacugag

SEQ ID NO: 199720 - RNA, 32 nt, Human
gggcuuggcuggggcuuccugcccugagcgcg

SEQ ID NO: 199721 - RNA, 18 nt, Human
gggcuugggacccuggag

SEQ ID NO: 199722 - RNA, 32 nt, Human
gggcuugggagccuacgagguugcagucugga

SEQ ID NO: 199723 - RNA, 32 nt, Human
gggcuugggaugauuauaacggguggucuccu

SEQ ID NO: 199724 - RNA, 32 nt, Human
gggcuugggauguuaacaggagccaaaaggag

SEQ ID NO: 199725 - RNA, 32 nt, Human
gggcuuggggaaagccuguuccucucugacuc

SEQ ID NO: 199726 - RNA, 32 nt, Human
gggcuuggggagggagguucaccugaggagga

SEQ ID NO: 199727 - RNA, 32 nt, Human
gggcuuggggccugagcgcaguggcucaugcc

SEQ ID NO: 199728 - RNA, 32 nt, Human
gggcuuggggcuguggugagcaugaagugaaa

SEQ ID NO: 199729 - RNA, 32 nt, Human
gggcuugggggcagucaggaggaagcuggcca

SEQ ID NO: 199730 - RNA, 32 nt, Human
gggcuugggugaggaagggggcacaggagccg

SEQ ID NO: 199731 - RNA, 32 nt, Human
gggcuugggugcgaguccaggcaaggcaggac

SEQ ID NO: 199732 - RNA, 32 nt, Human
gggcuuggucucaaggacucacugauuacaua

SEQ ID NO: 199733 - RNA, 23 nt, Human
gggcuugguggcucaugccugua

SEQ ID NO: 199734 - RNA, 32 nt, Human
gggcuugugcauuucccagccaugucugguuc

SEQ ID NO: 199735 - RNA, 32 nt, Human
gggcuugugccucacuaccggccuccuauucu

SEQ ID NO: 199736 - RNA, 32 nt, Human
gggcuuguugagaagaggggugcccagccuga

SEQ ID NO: 199737 - RNA, 32 nt, Human
gggcuuguugcagucagcaggugugggcuuag

SEQ ID NO: 199738 - RNA, 32 nt, Human
gggcuuguugccuccccucucugagcccccau

SEQ ID NO: 199739 - RNA, 32 nt, Human
gggcuuuacauacauugaccuuccauucacug

SEQ ID NO: 199740 - RNA, 32 nt, Human
gggcuuuagccaagccaccuacugccaggaau

SEQ ID NO: 199741 - RNA, 32 nt, Human
gggcuuuagccuccccugaccaucugcucaug

SEQ ID NO: 199742 - RNA, 32 nt, Human
gggcuuuaggaucaggcugaauaugaggacaa

SEQ ID NO: 199743 - RNA, 32 nt, Human
gggcuuuaucuauuuggcuuuugaagccccug

SEQ ID NO: 199744 - RNA, 32 nt, Human
gggcuuuccccauaucuucucucccccaccuu

SEQ ID NO: 199745 - RNA, 32 nt, Human
gggcuuuccuauccucccaaagacucagcucc

SEQ ID NO: 199746 - RNA, 20 nt, Human
gggcuuuccugcaggggggu

SEQ ID NO: 199747 - RNA, 32 nt, Human
gggcuuucuggaacugcuggcuggguugcugc

SEQ ID NO: 199748 - RNA, 32 nt, Human
gggcuuucuggcccccuuccucaccucuucca

SEQ ID NO: 199749 - RNA, 24 nt, Human
gggcuuugcagccugcagaugcca

SEQ ID NO: 199750 - RNA, 32 nt, Human
gggcuuugcagggcggccagugcagugaugcc

SEQ ID NO: 199751 - RNA, 32 nt, Human
gggcuuugccuagggguggguugcccuguaua

SEQ ID NO: 199752 - RNA, 32 nt, Human
gggcuuugcucaccacuuuagcucaggacucu

SEQ ID NO: 199753 - RNA, 32 nt, Human
gggcuuugcugaagucucaggcugccgagagc

SEQ ID NO: 199754 - RNA, 32 nt, Human
gggcuuugcugaggcccagcuggugcugaccc

SEQ ID NO: 199755 - RNA, 23 nt, Human
gggcuuugcuggcuucccagaga

SEQ ID NO: 199756 - RNA, 32 nt, Human
gggcuuugcuggguccaucacagaagagucuc

SEQ ID NO: 199757 - RNA, 32 nt, Human
gggcuuuggcaacuauggugcucaggugauua

SEQ ID NO: 199758 - RNA, 32 nt, Human
gggcuuuggccugggcagcuuccacuuucugc

SEQ ID NO: 199759 - RNA, 22 nt, Human
gggcuuuggggucuucuggaaa

SEQ ID NO: 199760 - RNA, 32 nt, Human
gggcuuuggguauaaaggagggggauucuacg

SEQ ID NO: 199761 - RNA, 32 nt, Human
gggcuuugguuccuggcuucugggagccuuuu

SEQ ID NO: 199762 - RNA, 23 nt, Human
gggcuuugucuguucucuucauu

SEQ ID NO: 199763 - RNA, 32 nt, Human
gggcuuugugccagaccaucucuaacuuaauc

SEQ ID NO: 199764 - RNA, 32 nt, Human
gggcuuugugccucaaaccccaaggagaccau

SEQ ID NO: 199765 - RNA, 32 nt, Human
gggcuuuguggaugcccagcuggugcugaccc

SEQ ID NO: 199766 - RNA, 32 nt, Human
gggcuuuuagccacagcuguuuuaagacuucu

SEQ ID NO: 199767 - RNA, 32 nt, Human
gggcuuuuauccaccuugaaucccuauccucc

SEQ ID NO: 199768 - RNA, 32 nt, Human
gggcuuuucuguagcauaaaagaacaguucau

SEQ ID NO: 199769 - RNA, 32 nt, Human
gggcuuuuggggagaugaagagccaagaaguc

SEQ ID NO: 199770 - RNA, 32 nt, Human
gggcuuuuggggauggggcagcaaaguuggga

SEQ ID NO: 199771 - RNA, 21 nt, Human
gggcuuuuguaucucuucauu

SEQ ID NO: 199772 - RNA, 32 nt, Human
gggcuuuugugccaggagugggugggacacag

SEQ ID NO: 199773 - RNA, 21 nt, Human
gggcuuuuguuaucuuucacu

SEQ ID NO: 199774 - RNA, 32 nt, Human
gggcuuuuucaugucuguaacaugguauuggc

SEQ ID NO: 199775 - RNA, 32 nt, Human
gggcuuuuucuaaagaggauggcagaacuucc

SEQ ID NO: 199776 - RNA, 32 nt, Human
gggcuuuuucucucaugcauucccuggccugg

SEQ ID NO: 199777 - RNA, 32 nt, Human
ggggaaaaacaguauaucaccauuggguagag

SEQ ID NO: 199778 - RNA, 32 nt, Human
ggggaaaacgggcagucugcucugcugcucug

SEQ ID NO: 199779 - RNA, 22 nt, Human
ggggaaaacucauggucacgaa

SEQ ID NO: 199780 - RNA, 23 nt, Human
ggggaaaacuucaaagagccgga

SEQ ID NO: 199781 - RNA, 32 nt, Human
ggggaaaagaugauucugggucuuucccuuga

SEQ ID NO: 199782 - RNA, 19 nt, Human
ggggaaaaggggggcgcug

SEQ ID NO: 199783 - RNA, 19 nt, Human
ggggaaaauaaagagcaga

SEQ ID NO: 199784 - RNA, 24 nt, Human
ggggaaaauccccgaagaggcaga

SEQ ID NO: 199785 - RNA, 32 nt, Human
ggggaaaauggcggcguccucccuggaacaga

SEQ ID NO: 199786 - RNA, 19 nt, Human
ggggaaaauguuuugguuu

SEQ ID NO: 199787 - RNA, 32 nt, Human
ggggaaaauugcccucaauugagaaccacugg

SEQ ID NO: 199788 - RNA, 31 nt, Human
ggggaaacacuuuucacugcagaguuugcuu

SEQ ID NO: 199789 - RNA, 32 nt, Human
ggggaaacaugauagaggaaggaaguugguug

SEQ ID NO: 199790 - RNA, 21 nt, Human
ggggaaaccccgucucuacua

SEQ ID NO: 199791 - RNA, 32 nt, Human
ggggaaacccuccaccuccuugcaggcuuguu

SEQ ID NO: 199792 - RNA, 32 nt, Human
ggggaaacgggcuggugcaguggugucaucuu

SEQ ID NO: 199793 - RNA, 32 nt, Human
ggggaaacugaggcccagggaggagaguaacu

SEQ ID NO: 199794 - RNA, 32 nt, Human
ggggaaagagaagcccagacaaacagcagaug

SEQ ID NO: 199795 - RNA, 32 nt, Human
ggggaaagaggaucuuccagcucugcaaaaac

SEQ ID NO: 199796 - RNA, 32 nt, Human
ggggaaagagggaggaaggggaggggccucca

SEQ ID NO: 199797 - RNA, 21 nt, Human
ggggaaagagggauucuaggg

SEQ ID NO: 199798 - RNA, 20 nt, Human
ggggaaagcagccaugcucc

SEQ ID NO: 199799 - RNA, 32 nt, Human
ggggaaagcagcugugugugauagcuuggaag

SEQ ID NO: 199800 - RNA, 32 nt, Human
ggggaaagcugaggcaggagaauugcuucaau

SEQ ID NO: 199801 - RNA, 32 nt, Human
ggggaaaggaagggaagggagggaggucuguu

SEQ ID NO: 199802 - RNA, 32 nt, Human
ggggaaaggagagggcggaaaaggaccagcgg

SEQ ID NO: 199803 - RNA, 32 nt, Human
ggggaaaggaggugggggcggggaguauugaa

SEQ ID NO: 199804 - RNA, 32 nt, Human
ggggaaagggaagucugaagcucaguuggcca

SEQ ID NO: 199805 - RNA, 32 nt, Human
ggggaaagggagcacacggggaggacguuggg

SEQ ID NO: 199806 - RNA, 32 nt, Human
ggggaaagggggugggacagggacucggggcu

SEQ ID NO: 199807 - RNA, 21 nt, Human
ggggaaaguccuuuuuugccc

SEQ ID NO: 199808 - RNA, 32 nt, Human
ggggucuggcuccccuccucuggcagagguuu

SEQ ID NO: 199809 - RNA, 32 nt, Human
ggggucuggcuugcccccucccugggccucca

SEQ ID NO: 199810 - RNA, 32 nt, Human
ggggucugggcagucccuccucuccccagugu

SEQ ID NO: 199811 - RNA, 32 nt, Human
ggggucuggggcaucccuggagcucagaagcc

SEQ ID NO: 199812 - RNA, 32 nt, Human
ggggucuggggccuggagagacccucccaccc

SEQ ID NO: 199813 - RNA, 32 nt, Human
ggggucugguaccagcccuagaacucagcguu

SEQ ID NO: 199814 - RNA, 32 nt, Human
ggggucugucccuucccaagcaagacauuugu

SEQ ID NO: 199815 - RNA, 19 nt, Human
ggggucugugcuccagguc

SEQ ID NO: 199816 - RNA, 32 nt, Human
ggggucuguggcugcugggcuggcggggcgca

SEQ ID NO: 199817 - RNA, 32 nt, Human
ggggucuguggcuggagggagcugggaugcag

SEQ ID NO: 199818 - RNA, 32 nt, Human
ggggucuuccucuguugcccaggcuggagugc

SEQ ID NO: 199819 - RNA, 32 nt, Human
ggggucuucuccugaagccugacuccauggga

SEQ ID NO: 199820 - RNA, 21 nt, Human
ggggucuugaagagggggcag

SEQ ID NO: 199821 - RNA, 32 nt, Human
ggggucuugcccugucacccaggcugggguac

SEQ ID NO: 199822 - RNA, 32 nt, Human
ggggucuuuacucauuuauuuuauggguaaag

SEQ ID NO: 199823 - RNA, 32 nt, Human
ggggugaaaaauuggcccuuguaugggaggug

SEQ ID NO: 199824 - RNA, 19 nt, Human
ggggugaaagugagggagg

SEQ ID NO: 199825 - RNA, 32 nt, Human
ggggugaacaugugcaggaacagcuagaggcc

SEQ ID NO: 199826 - RNA, 32 nt, Human
ggggugaaggggacccaggccugugacagcca

SEQ ID NO: 199827 - RNA, 32 nt, Human
ggggugaaucagaccccauuccugccuucggg

SEQ ID NO: 199828 - RNA, 32 nt, Human
ggggugaaucaucaguccuggggaagaaccca

SEQ ID NO: 199829 - RNA, 21 nt, Human
ggggugacaaucucagcucca

SEQ ID NO: 199830 - RNA, 32 nt, Human
ggggugacaccaggacacagggacagguucug

SEQ ID NO: 199831 - RNA, 32 nt, Human
ggggugacagaggcauucaagccagacuccau

SEQ ID NO: 199832 - RNA, 32 nt, Human
ggggugacagcgaaacgugagaccauccaguu

SEQ ID NO: 199833 - RNA, 21 nt, Human
ggggugaccggugaggggagg

SEQ ID NO: 199834 - RNA, 31 nt, Human
ggggugacgccuucugggccugccacuguuc

SEQ ID NO: 199835 - RNA, 32 nt, Human
ggggugacugccucugagucauuguguuuuuc

SEQ ID NO: 199836 - RNA, 32 nt, Human
ggggugacuggguagaggccaggagaaaggaa

SEQ ID NO: 199837 - RNA, 32 nt, Human
ggggugacuucugcuuugguccuuccaccacc

SEQ ID NO: 199838 - RNA, 32 nt, Human
ggggugagaagacaagaugaagaaaagccuua

SEQ ID NO: 199839 - RNA, 32 nt, Human
ggggugagagaagaggguucuuaucgcgucuc

SEQ ID NO: 199840 - RNA, 20 nt, Human
ggggugagagaggagacaga

SEQ ID NO: 199841 - RNA, 32 nt, Human
ggggugagagcauucuugcaucaugugagauc

SEQ ID NO: 199842 - RNA, 32 nt, Human
ggggugagaggaggcccaggaggagagagagc

SEQ ID NO: 199843 - RNA, 32 nt, Human
ggggugagaggcaagggaagugauagcauuaa

SEQ ID NO: 199844 - RNA, 32 nt, Human
ggggugagagggcacggcucuccucugccagu

SEQ ID NO: 199845 - RNA, 32 nt, Human
ggggugaggaaggguaaggggcagggcugguu

SEQ ID NO: 199846 - RNA, 32 nt, Human
ggggugaggagagagcaagagggcagggguga

SEQ ID NO: 199847 - RNA, 32 nt, Human
ggggugaggcaugucuuuccagaacuuucccu

SEQ ID NO: 199848 - RNA, 32 nt, Human
ggggugaggccagccaagucccuguguuacga

SEQ ID NO: 199849 - RNA, 32 nt, Human
ggggugagggagaaggaggagagagcccaugu

SEQ ID NO: 199850 - RNA, 32 nt, Human
ggggugagggggaaugcccuuccaauauggcu

SEQ ID NO: 199851 - RNA, 17 nt, Human
ggggugaggggggccgg

SEQ ID NO: 199852 - RNA, 32 nt, Human
ggggugagucaccacaccccaccccuuggcac

SEQ ID NO: 199853 - RNA, 32 nt, Human
ggggugagugugaaaggugcugauggcccuca

SEQ ID NO: 199854 - RNA, 32 nt, Human
ggggugaguuuucugugcuacaagcaccuguc

SEQ ID NO: 199855 - RNA, 32 nt, Human
ggggugauaugagagcgagcccagggaaggac

SEQ ID NO: 199856 - RNA, 27 nt, Human
ggggugauauguauacuuuugcuucac

SEQ ID NO: 199857 - RNA, 32 nt, Human
ggggugauggaugaugaaccuggcaagucaca

SEQ ID NO: 199858 - RNA, 24 nt, Human
ggggugauggcaggggaguggagg

SEQ ID NO: 199859 - RNA, 32 nt, Human
ggggugauggccagggcaggcugggagggaca

SEQ ID NO: 199860 - RNA, 32 nt, Human
ggggugauggggaauaggagggcaggggugag

SEQ ID NO: 199861 - RNA, 32 nt, Human
ggggugauggugcugguagguucugguaauuu

SEQ ID NO: 199862 - RNA, 32 nt, Human
ggggugaugguguaauuguuaaccucauuucc

SEQ ID NO: 199863 - RNA, 32 nt, Human
ggggugauuuggaaaagaagaccuggguggaa

SEQ ID NO: 199864 - RNA, 32 nt, Human
ggggugcaagcuuggggcuccgucuggugcug

SEQ ID NO: 199865 - RNA, 32 nt, Human
ggggugcaaggcagagaggccaagccagccug

SEQ ID NO: 199866 - RNA, 31 nt, Human
ggggugcaaguguccaccaaaccagauaggc

SEQ ID NO: 199867 - RNA, 32 nt, Human
ggggugcaaguguccaccaaaccagauaggca

SEQ ID NO: 199868 - RNA, 32 nt, Human
ggggugcacagcccugugggagcagcuuggcu

SEQ ID NO: 199869 - RNA, 32 nt, Human
ggggugcacaguccacagcugaagagcaaggu

SEQ ID NO: 199870 - RNA, 32 nt, Human
ggggugcagaaaagggguccucgaggcggagc

SEQ ID NO: 199871 - RNA, 18 nt, Human
ggggugcagccccuggca

SEQ ID NO: 199872 - RNA, 23 nt, Human
ggggugcagcgcuucacaaugcu

SEQ ID NO: 199873 - RNA, 32 nt, Human
ggggugcagcuggucuggauaauagcuuacag

SEQ ID NO: 199874 - RNA, 32 nt, Human
ggggugcagcuggucuggauagauagcuuaca

SEQ ID NO: 199875 - RNA, 18 nt, Human
ggggugcagcugucaggu

SEQ ID NO: 199876 - RNA, 32 nt, Human
ggggugcaggaauuuauccugccugcagguga

SEQ ID NO: 199877 - RNA, 32 nt, Human
ggggugcaggcgggcagcacugagggacccug

SEQ ID NO: 199878 - RNA, 17 nt, Human
ggggugcagugagcuca

SEQ ID NO: 199879 - RNA, 32 nt, Human
ggggugcauagcucggagaugcagucccccug

SEQ ID NO: 199880 - RNA, 32 nt, Human
ggggugccaaguuuggggagcagccccuggcu

SEQ ID NO: 199881 - RNA, 32 nt, Human
ggggugccacaugucucagaucugccauuguc

SEQ ID NO: 199882 - RNA, 16 nt, Human
ggggugccacgccuuc

SEQ ID NO: 199883 - RNA, 32 nt, Human
ggggugccacugcugccuggacugcuggugca

SEQ ID NO: 199884 - RNA, 32 nt, Human
ggggugccagggccuggcuggguccagcggcu

SEQ ID NO: 199885 - RNA, 32 nt, Human
ggggugcccagcccggcacccagcgcuuucgc

SEQ ID NO: 199886 - RNA, 32 nt, Human
ggggugcccagcugccugucagacccugagga

SEQ ID NO: 199887 - RNA, 32 nt, Human
ggggugccccuccaccuuccucuggaauccaa

SEQ ID NO: 199888 - RNA, 32 nt, Human
ggggugccccucuccuucuuagcuaucauugc

SEQ ID NO: 199889 - RNA, 32 nt, Human
ggggugccucggccccuccagccccgggccgg

SEQ ID NO: 199890 - RNA, 32 nt, Human
ggggugccuggcaggcucacccccaggggccg

SEQ ID NO: 199891 - RNA, 32 nt, Human
ggggugcgcacagcagcaggcuuucuguaccc

SEQ ID NO: 199892 - RNA, 18 nt, Human
ggggugcgcaccuggaug

SEQ ID NO: 199893 - RNA, 32 nt, Human
ggggugcgcuuguaaucccagcuacucaggag

SEQ ID NO: 199894 - RNA, 32 nt, Human
ggggugcgcuuguaaucccagcuacucgggag

SEQ ID NO: 199895 - RNA, 32 nt, Human
ggggugcggagcgggacuuggagcagccgccg

SEQ ID NO: 199896 - RNA, 32 nt, Human
ggggugcggcaggagcaggaacagagacucug

SEQ ID NO: 199897 - RNA, 32 nt, Human
ggggugcggggaggggaaggacgccuccaagc

SEQ ID NO: 199898 - RNA, 19 nt, Human
ggggugcggggccagcuca

SEQ ID NO: 199899 - RNA, 17 nt, Human
ggggugcguuaguguca

SEQ ID NO: 199900 - RNA, 32 nt, Human
ggggugcuagagguggggcaugguggcuggaa

SEQ ID NO: 199901 - RNA, 32 nt, Human
ggggugcucaaaggauuuaaaggaguucuaau

SEQ ID NO: 199902 - RNA, 32 nt, Human
ggggugcuccuggccuggaguggguggaggcc

SEQ ID NO: 199903 - RNA, 32 nt, Human
ggggugcucggcagugcugaaggagccuggga

SEQ ID NO: 199904 - RNA, 32 nt, Human
ggggugcucugcccucuacccuugggccaccu

SEQ ID NO: 199905 - RNA, 32 nt, Human
ggggugcugcccgggcaggccauguuggggag

SEQ ID NO: 199906 - RNA, 32 nt, Human
ggggugcugccugggcaggccauguuggggag

SEQ ID NO: 199907 - RNA, 32 nt, Human
ggggugcugcugacccagcccugcugcugcuc

SEQ ID NO: 199908 - RNA, 32 nt, Human
ggggugcugcuggcccuccugcaggccuucug

SEQ ID NO: 199909 - RNA, 32 nt, Human
ggggugcuggggcaccugggccgcaucccuug

SEQ ID NO: 199910 - RNA, 32 nt, Human
ggggugcuuucugcccagugggucuuggcaua

SEQ ID NO: 199911 - RNA, 32 nt, Human
gggguggaaaggacagagcccaggcgaccuag

SEQ ID NO: 199912 - RNA, 32 nt, Human
gggguggaaaguugaacuccaugucugaggac

SEQ ID NO: 199913 - RNA, 32 nt, Human
gggguggaacacagcauuuugucaagcacugu

SEQ ID NO: 199914 - RNA, 32 nt, Human
gggguggaagugcucccuucugugggcuccag

SEQ ID NO: 199915 - RNA, 32 nt, Human
gggguggaaguguggugacacagugaauggga

SEQ ID NO: 199916 - RNA, 32 nt, Human
gggguggacaacauucaacacugcagaauggg

SEQ ID NO: 199917 - RNA, 21 nt, Human
gggguggacaccacucaggga

SEQ ID NO: 199918 - RNA, 32 nt, Human
gggguggagagguggggugggguggggugugg

SEQ ID NO: 199919 - RNA, 32 nt, Human
gggguggagccgggggaaggguggggagggga

SEQ ID NO: 199920 - RNA, 32 nt, Human
gggguggagcgggggagucggccucgccagug

SEQ ID NO: 199921 - RNA, 32 nt, Human
gggguggagcuggaggagucucagcuggauga

SEQ ID NO: 199922 - RNA, 32 nt, Human
gggguggaggaagagcuuuggggaagaugagg

SEQ ID NO: 199923 - RNA, 32 nt, Human
gggguggaggcugggcugggcccugugggcug

SEQ ID NO: 199924 - RNA, 32 nt, Human
gggguggaggcuggggccacacugcgggacag

SEQ ID NO: 199925 - RNA, 32 nt, Human
gggguggagggcagaggagaaacugcgucagg

SEQ ID NO: 199926 - RNA, 16 nt, Human
gggguggagggccuuc

SEQ ID NO: 199927 - RNA, 32 nt, Human
gggguggaggggaauuagucugucccagcuag

SEQ ID NO: 199928 - RNA, 32 nt, Human
gggguggaggguggaggagggagcaggaacag

SEQ ID NO: 199929 - RNA, 32 nt, Human
gggguggagggugggacacaugaggauguaua

SEQ ID NO: 199930 - RNA, 19 nt, Human
gggguggagguugcaguga

SEQ ID NO: 199931 - RNA, 32 nt, Human
gggguggauugggaggugaguggaggagaguc

SEQ ID NO: 199932 - RNA, 32 nt, Human
gggguggcacaggggucccacagcaggucuuc

SEQ ID NO: 199933 - RNA, 32 nt, Human
gggguggcaggcaggguggggcacugugagcu

SEQ ID NO: 199934 - RNA, 32 nt, Human
gggguggccacaucggcuuccuggaagggcug

SEQ ID NO: 199935 - RNA, 32 nt, Human
gggguggccaugagauucagcccuguggaggu

SEQ ID NO: 199936 - RNA, 32 nt, Human
gggguggccugccagacccaggaguggagggc

SEQ ID NO: 199937 - RNA, 20 nt, Human
gggguggcgggucgggggga

SEQ ID NO: 199938 - RNA, 32 nt, Human
gggguggcguuugggaacuugugcccccuaaa

SEQ ID NO: 199939 - RNA, 17 nt, Human
gggguggcuccuggcca

SEQ ID NO: 199940 - RNA, 25 nt, Human
gggguggcuguuggaggaagggagg

SEQ ID NO: 199941 - RNA, 32 nt, Human
gggguggcuuauggcuucuuuauccucugauu

SEQ ID NO: 199942 - RNA, 32 nt, Human
ggggugggaacccaggagguggaguggcuggg

SEQ ID NO: 199943 - RNA, 32 nt, Human
ggggugggaaccuggggugugguuccagaaau

SEQ ID NO: 199944 - RNA, 32 nt, Human
ggggugggaaggugcagagagggcaggaggga

SEQ ID NO: 199945 - RNA, 22 nt, Human
ggggugggagagaagauacaga

SEQ ID NO: 199946 - RNA, 32 nt, Human
ggggugggagagaauauuugagggagggcugg

SEQ ID NO: 199947 - RNA, 32 nt, Human
ggggugggagaggagguagauggggaagaaau

SEQ ID NO: 199948 - RNA, 32 nt, Human
ggggugggagcaagggacagggagcagggcag

SEQ ID NO: 199949 - RNA, 32 nt, Human
ggggugggagccaaaaagaguugagaggccag

SEQ ID NO: 199950 - RNA, 32 nt, Human
ggggugggagcuguugccgaagcugccacagc

SEQ ID NO: 199951 - RNA, 32 nt, Human
ggggugggaggcagcaggggucagccugggca

SEQ ID NO: 199952 - RNA, 32 nt, Human
ggggugggaggggcuucccguuauccacgagg

SEQ ID NO: 199953 - RNA, 32 nt, Human
ggggugggagugaaugcuaaaagcagaucguc

SEQ ID NO: 199954 - RNA, 32 nt, Human
ggggugggaguggggagcaggaauugcacuca

SEQ ID NO: 199955 - RNA, 32 nt, Human
ggggugggaucggggagcaggaagccuguggg

SEQ ID NO: 199956 - RNA, 32 nt, Human
ggggugggaucuuccccggaaguuuugguuaa

SEQ ID NO: 199957 - RNA, 32 nt, Human
ggggugggauggccagaggaggggacaguguu

SEQ ID NO: 199958 - RNA, 19 nt, Human
ggggugggcaggggcgcgg

SEQ ID NO: 199959 - RNA, 32 nt, Human
ggggugggcgcgaaggaagugggacgaggcua

SEQ ID NO: 199960 - RNA, 32 nt, Human
ggggugggcguugccuggguucuugggagaga

SEQ ID NO: 199961 - RNA, 32 nt, Human
ggggugggcucuucaacaucucaggcuguggc

SEQ ID NO: 199962 - RNA, 32 nt, Human
ggggugggcugcagaacggggugggaacuggg

SEQ ID NO: 199963 - RNA, 32 nt, Human
ggggugggcuggaguccucuccagagaggcuc

SEQ ID NO: 199964 - RNA, 32 nt, Human
gggguggggaagagagacgucagcgggaccug

SEQ ID NO: 199965 - RNA, 32 nt, Human
gggguggggacccagaguuagcaguggggaug

SEQ ID NO: 199966 - RNA, 32 nt, Human
gggguggggacugccaagccacccuaagaccu

SEQ ID NO: 199967 - RNA, 32 nt, Human
gggguggggaggacaaggggguggguaagggg

SEQ ID NO: 199968 - RNA, 32 nt, Human
gggguggggagggagaaggugguagcuuaugu

SEQ ID NO: 199969 - RNA, 32 nt, Human
gggguggggaugaagaauugacugggagcuga

SEQ ID NO: 199970 - RNA, 31 nt, Human
gggguggggcagagagaauacugacagcaga

SEQ ID NO: 199971 - RNA, 32 nt, Human
gggguggggccagccaaucagcgaucagacuc

SEQ ID NO: 199972 - RNA, 32 nt, Human
gggguggggccccagccgagaucacagcgcga

SEQ ID NO: 199973 - RNA, 32 nt, Human
gggguggggccccagcuggagguuauaaaaca

SEQ ID NO: 199974 - RNA, 32 nt, Human
gggguggggccuaggacucugcauuucuuaca

SEQ ID NO: 199975 - RNA, 32 nt, Human
gggguggggcucaccuguccucuuaagggaag

SEQ ID NO: 199976 - RNA, 32 nt, Human
gggguggggcuggacgucaggagccaagaugg

SEQ ID NO: 199977 - RNA, 32 nt, Human
gggguggggcugggaccacagguggcuucucu

SEQ ID NO: 199978 - RNA, 32 nt, Human
gggguggggcugugggggcagcugggguugga

SEQ ID NO: 199979 - RNA, 32 nt, Human
ggggugggggcaggcaggaggcauggauggga

SEQ ID NO: 199980 - RNA, 32 nt, Human
ggggugggggcaggggacucugggcaguaugu

SEQ ID NO: 199981 - RNA, 32 nt, Human
ggggugggggcugggugcaguggcucacaccu

SEQ ID NO: 199982 - RNA, 16 nt, Human
gggguggggggcucuc

SEQ ID NO: 199983 - RNA, 32 nt, Human
gggguggggguauguugggaggcguggcggga

SEQ ID NO: 199984 - RNA, 32 nt, Human
ggggugggggucccugagcucauguggugccc

SEQ ID NO: 199985 - RNA, 32 nt, Human
ggggugggggugccaggugagguggagcauuc

SEQ ID NO: 199986 - RNA, 32 nt, Human
gggguggggguggagugggggcuuccaggugg

SEQ ID NO: 199987 - RNA, 32 nt, Human
gggguggggguggaucacuugaggucaggagu

SEQ ID NO: 199988 - RNA, 32 nt, Human
gggguggggugaggcccggcuagccuccucuc

SEQ ID NO: 199989 - RNA, 32 nt, Human
gggguggggugaggggauggagagggagggcu

SEQ ID NO: 199990 - RNA, 32 nt, Human
gggguggggugagguaggaccggcggagaggu

SEQ ID NO: 199991 - RNA, 32 nt, Human
gggguggggugaguccaaagaagcacgggcug

SEQ ID NO: 199992 - RNA, 32 nt, Human
gggguggggugucuggggcagcugcaguggcu

SEQ ID NO: 199993 - RNA, 32 nt, Human
gggguggguacugaggccugcucaggcccugg

SEQ ID NO: 199994 - RNA, 32 nt, Human
ggggugggugagagagacaggcagcucggauu

SEQ ID NO: 199995 - RNA, 32 nt, Human
ggggugggugagguguggggagcccagccccu

SEQ ID NO: 199996 - RNA, 32 nt, Human
ggggugggugcccgaagguugcaugauggaau

SEQ ID NO: 199997 - RNA, 32 nt, Human
ggggugggugccugggugggugccuggcugug

SEQ ID NO: 199998 - RNA, 32 nt, Human
gggguggguggaggaggagggcacgugucugc

SEQ ID NO: 199999 - RNA, 32 nt, Human
ggggugggugggcagaggacgggguaauguga

SEQ ID NO: 200000 - RNA, 32 nt, Human
gggguggguggggccaggaggaagauggcggc

SEQ ID NO: 200001 - RNA, 32 nt, Human
ggggugggugguggccugggaggcagggccug

SEQ ID NO: 200002 - RNA, 19 nt, Human
gggguggugccaagggugg

SEQ ID NO: 200003 - RNA, 32 nt, Human
gggguggugccacugcgcuccagccuggggga

SEQ ID NO: 200004 - RNA, 32 nt, Human
gggguggugcugcugcuaugagcugcaccauc

SEQ ID NO: 200005 - RNA, 32 nt, Human
gggguggugcuggaguccaggugacaguuccu

SEQ ID NO: 200006 - RNA, 22 nt, Human
ggggugguggagagauggaagg

SEQ ID NO: 200007 - RNA, 32 nt, Human
gggguggugggcaguggggaauagaugguuga

SEQ ID NO: 200008 - RNA, 32 nt, Human
ggggugguggggcgggggcccggugcuggccg

SEQ ID NO: 200009 - RNA, 18 nt, Human
gggguggugggggugcug

SEQ ID NO: 200010 - RNA, 25 nt, Human
ggggugguggucaacgggagggagg

SEQ ID NO: 200011 - RNA, 17 nt, Human
ggggugguguagggccc

SEQ ID NO: 200012 - RNA, 17 nt, Human
ggggugguuaaagggag

SEQ ID NO: 200013 - RNA, 32 nt, Human
ggggugguugaggcuaaguugggaucuaggag

SEQ ID NO: 200014 - RNA, 32 nt, Human
gggguguagaugggggaacugugaauacuuga

SEQ ID NO: 200015 - RNA, 32 nt, Human
gggguguagugaggacccacggggagccuggg

SEQ ID NO: 200016 - RNA, 32 nt, Human
ggggugucaaaccugcagccaccagcuucuga

SEQ ID NO: 200017 - RNA, 18 nt, Human
ggggugucacagacccuc

SEQ ID NO: 200018 - RNA, 32 nt, Human
ggggugucauuuaucaaccucucuccagccca

SEQ ID NO: 200019 - RNA, 32 nt, Human
gggguguccugggcagggaaggucagugucac

SEQ ID NO: 200020 - RNA, 16 nt, Human
gggguguccuguccuc

SEQ ID NO: 200021 - RNA, 32 nt, Human
ggggugucucagggugggcagugggggugggg

SEQ ID NO: 200022 - RNA, 18 nt, Human
ggggugucucggggcccu

SEQ ID NO: 200023 - RNA, 32 nt, Human
ggggugucugccucucugcagguguucaccac

SEQ ID NO: 200024 - RNA, 32 nt, Human
ggggugugaauggugggcgggagcagcuaugu

SEQ ID NO: 200025 - RNA, 32 nt, Human
ggggugugccuguagucccagcuacuugagag

SEQ ID NO: 200026 - RNA, 32 nt, Human
ggggugugcucugggugggaggagcagcguac

SEQ ID NO: 200027 - RNA, 32 nt, Human
ggggugugcugcugcugcuccccagcccacca

SEQ ID NO: 200028 - RNA, 32 nt, Human
gggguguggaagggcaagcugcaccaaagacg

SEQ ID NO: 200029 - RNA, 32 nt, Human
gggguguggagcagccaagauggagccggcag

SEQ ID NO: 200030 - RNA, 32 nt, Human
gggguguggcaggaggacaggaaugcagugga

SEQ ID NO: 200031 - RNA, 32 nt, Human
ggggugugggaaggguaccacagaucaggccg

SEQ ID NO: 200032 - RNA, 32 nt, Human
ggggugugggcuagguuauaaggaagugguac

SEQ ID NO: 200033 - RNA, 16 nt, Human
gggguguggggcccuc

SEQ ID NO: 200034 - RNA, 32 nt, Human
gggguguggggugugggcuggaagcacuggcu

SEQ ID NO: 200035 - RNA, 32 nt, Human
ggggugugggugaccugcccucaaaccuugcc

SEQ ID NO: 200036 - RNA, 32 nt, Human
gggguguggugcuggcuagaggucccugcccc

SEQ ID NO: 200037 - RNA, 19 nt, Human
gggguguguaacaggguca

SEQ ID NO: 200038 - RNA, 20 nt, Human
gggguguguaugaagggggg

SEQ ID NO: 200039 - RNA, 22 nt, Human
ggggugugucccacaaacgcug

SEQ ID NO: 200040 - RNA, 29 nt, Human
ggggugugucuguaggugucucugggccu

SEQ ID NO: 200041 - RNA, 21 nt, Human
ggggugugugagugaaggggg

SEQ ID NO: 200042 - RNA, 32 nt, Human
ggggugugugggcugccucagcuggcagaggg

SEQ ID NO: 200043 - RNA, 32 nt, Human
ggggugugugggcugucucagcuggcagaggg

SEQ ID NO: 200044 - RNA, 32 nt, Human
gggguguguguaggcuucagagacaugggauc

SEQ ID NO: 200045 - RNA, 32 nt, Human
gggguguuccagggugcauguuuccuucccau

SEQ ID NO: 200046 - RNA, 32 nt, Human
gggguguucccucugcugaugauggaugcccc

SEQ ID NO: 200047 - RNA, 32 nt, Human
gggguguucugguuuugagaacggcagaccca

SEQ ID NO: 200048 - RNA, 32 nt, Human
gggguguugagugaggggugacccaggaagaa

SEQ ID NO: 200049 - RNA, 21 nt, Human
gggguguugcggagaagggag

SEQ ID NO: 200050 - RNA, 32 nt, Human
gggguguugcuggagcagaugagauaaaaucc

SEQ ID NO: 200051 - RNA, 32 nt, Human
gggguguuuuucucccccuccccuguccccgc

SEQ ID NO: 200052 - RNA, 32 nt, Human
gggguuaaaaguuauaagacagcagugauacc

SEQ ID NO: 200053 - RNA, 32 nt, Human
gggguuaauaaauggcuuauccuucucuccaa

SEQ ID NO: 200054 - RNA, 23 nt, Human
gggguuaauccguauucugcggg

SEQ ID NO: 200055 - RNA, 32 nt, Human
gggguuacagugagcuguggucacaccacugu

SEQ ID NO: 200056 - RNA, 17 nt, Human
gggguuaccuccaugug

SEQ ID NO: 200057 - RNA, 32 nt, Human
gggguuaggaagggagaggcagcucuuccuuc

SEQ ID NO: 200058 - RNA, 32 nt, Human
gggguuagggcaaaacauucaaacuucaucag

SEQ ID NO: 200059 - RNA, 20 nt, Human
gggguuauuucugugccaga

SEQ ID NO: 200060 - RNA, 32 nt, Human
gggguucaagcaauccucccaccucaacccac

SEQ ID NO: 200061 - RNA, 32 nt, Human
gggguucaagcgauccucccaccucagccucc

SEQ ID NO: 200062 - RNA, 19 nt, Human
gggguucacauagggcccc

SEQ ID NO: 200063 - RNA, 21 nt, Human
gggguucacauagggccccag

SEQ ID NO: 200064 - RNA, 32 nt, Human
gggguucaccuugccugcugccuagacaaagc

SEQ ID NO: 200065 - RNA, 32 nt, Human
gggguucaggaauccgugcauguggccagggc

SEQ ID NO: 200066 - RNA, 32 nt, Human
gggguucaugaggcaagaguggauggagccug

SEQ ID NO: 200067 - RNA, 22 nt, Human
gggguuccaggucuccaguggg

SEQ ID NO: 200068 - RNA, 32 nt, Human
gggguuccaugaguuaucaugaauuuuaaagu

SEQ ID NO: 200069 - RNA, 32 nt, Human
gggguucccaggagccaugcguggccugcaga

SEQ ID NO: 200070 - RNA, 32 nt, Human
gggguucccaucaucccucccugauauuguau

SEQ ID NO: 200071 - RNA, 22 nt, Human
gggguucccuacuucgaaucca

SEQ ID NO: 200072 - RNA, 32 nt, Human
gggguuccuccaccgucagggcccaggcuccu

SEQ ID NO: 200073 - RNA, 32 nt, Human
gggguuccucuaaccagaaccagcuuccuagc

SEQ ID NO: 200074 - RNA, 32 nt, Human
gggguuccugcucugccccugcccguccccac

SEQ ID NO: 200075 - RNA, 32 nt, Human
gggguucuagaaaauauagguuccuauaauaa

SEQ ID NO: 200076 - RNA, 32 nt, Human
gggguucucccagaagugaggggccuuucccu

SEQ ID NO: 200077 - RNA, 32 nt, Human
gggguucucuugguuuugucauguggaaagug

SEQ ID NO: 200078 - RNA, 32 nt, Human
gggguucuggaagacggcagagcugccgccau

SEQ ID NO: 200079 - RNA, 32 nt, Human
gggguucuggggaccagggaggugcagguguc

SEQ ID NO: 200080 - RNA, 32 nt, Human
gggguucuguacuaauuuccauggccgguggc

SEQ ID NO: 200081 - RNA, 32 nt, Human
gggguucuuagaacuuuuugugguguguguug

SEQ ID NO: 200082 - RNA, 18 nt, Human
gggguugacacaaugcug

SEQ ID NO: 200083 - RNA, 32 nt, Human
gggguugacgaaggagaagcauucagagggca

SEQ ID NO: 200084 - RNA, 32 nt, Human
gggguugagccccagcugagccgagggcucgc

SEQ ID NO: 200085 - RNA, 32 nt, Human
gggguugagcuggcaccccgggaugugaugua

SEQ ID NO: 200086 - RNA, 32 nt, Human
gggguugaugccagacaucaccagguuguaga

SEQ ID NO: 200087 - RNA, 23 nt, Human
gggguugcacagacagacccugu

SEQ ID NO: 200088 - RNA, 17 nt, Human
gggguugcacuggucug

SEQ ID NO: 200089 - RNA, 32 nt, Human
gggguugcagagcucaggagccaguccuggcc

SEQ ID NO: 200090 - RNA, 32 nt, Human
gggguugcagugaccugagauugcgccauugc

SEQ ID NO: 200091 - RNA, 32 nt, Human
gggguugcagugagccaagaucacaccacugc

SEQ ID NO: 200092 - RNA, 32 nt, Human
gggguugcagugagccaagaucgugccacugc

SEQ ID NO: 200093 - RNA, 32 nt, Human
gggguugcagugagccgagaucacaccacugc

SEQ ID NO: 200094 - RNA, 32 nt, Human
gggguugcagugagccgagaucuggccauugc

SEQ ID NO: 200095 - RNA, 32 nt, Human
gggguugcagugagccgagauugcgccacugc

SEQ ID NO: 200096 - RNA, 32 nt, Human
gggguugcagugagcugagacggugucacugc

SEQ ID NO: 200097 - RNA, 32 nt, Human
gggguugcagugagucgagaucgccccauugu

SEQ ID NO: 200098 - RNA, 32 nt, Human
gggguugcaguggcuuggggguaggugccaug

SEQ ID NO: 200099 - RNA, 17 nt, Human
gggguugccacacaaca

SEQ ID NO: 200100 - RNA, 32 nt, Human
gggguugccaucccgggguacaugucaccagu

SEQ ID NO: 200101 - RNA, 32 nt, Human
gggguugccgaggcaaccuccaagucccagau

SEQ ID NO: 200102 - RNA, 32 nt, Human
gggguugccugggaccagguccucagaaacug

SEQ ID NO: 200103 - RNA, 32 nt, Human
gggguugcgucugaggccugcccccugggcug

SEQ ID NO: 200104 - RNA, 32 nt, Human
gggguugcuccuggaugcugucugggaggcuu

SEQ ID NO: 200105 - RNA, 20 nt, Human
gggguuggaagagccgucug

SEQ ID NO: 200106 - RNA, 32 nt, Human
gggguuggagccagcgaccgucgguagcagca

SEQ ID NO: 200107 - RNA, 32 nt, Human
gggguuggaggugagaaucccagguaggguag

SEQ ID NO: 200108 - RNA, 32 nt, Human
gggguuggagugagccaggacugugacacugc

SEQ ID NO: 200109 - RNA, 32 nt, Human
gggguuggauguguauagacaaaaagaauuau

SEQ ID NO: 200110 - RNA, 32 nt, Human
gggguuggcaccucugccccgacagaaugggg

SEQ ID NO: 200111 - RNA, 32 nt, Human
gggguuggcucccacagcuuuuggcaguuccu

SEQ ID NO: 200112 - RNA, 32 nt, Human
gggguuggcuucccuggcaugauggacaaagg

SEQ ID NO: 200113 - RNA, 22 nt, Human
gggguugggaagcacagucugg

SEQ ID NO: 200114 - RNA, 32 nt, Human
gggguugggaggaaggugggaaugguuaauag

SEQ ID NO: 200115 - RNA, 32 nt, Human
gggguuggggacacauagacacccucagugga

SEQ ID NO: 200116 - RNA, 32 nt, Human
gggguuggggcgcggaggaggagcagcagcgg

SEQ ID NO: 200117 - RNA, 32 nt, Human
gggguugggggcugugucucuccaucccuuag

SEQ ID NO: 200118 - RNA, 32 nt, Human
gggguuggggguggaggucuagaggugagcuc

SEQ ID NO: 200119 - RNA, 32 nt, Human
gggguugggguggagggugcggcccggaguug

SEQ ID NO: 200120 - RNA, 23 nt, Human
gggguuggguguacggguucugu

SEQ ID NO: 200121 - RNA, 32 nt, Human
gggguugguaacaccuggaaagaaggacucuu

SEQ ID NO: 200122 - RNA, 32 nt, Human
gggguugguagcagagaaagagaagagaacag

SEQ ID NO: 200123 - RNA, 32 nt, Human
gggguuggucaaggccaccucugccucuaguc

SEQ ID NO: 200124 - RNA, 32 nt, Human
gggguugguggaggguggaggcaguucugcca

SEQ ID NO: 200125 - RNA, 20 nt, Human
gggguugguucuucagguca

SEQ ID NO: 200126 - RNA, 32 nt, Human
gggguuguaaauuccagguguuacacugaccu

SEQ ID NO: 200127 - RNA, 32 nt, Human
gggguuguagugagccaaguucgugccaucgg

SEQ ID NO: 200128 - RNA, 32 nt, Human
gggguugugaggacucuggggaagaaaagcca

SEQ ID NO: 200129 - RNA, 20 nt, Human
gggguugugauccagcucca

SEQ ID NO: 200130 - RNA, 32 nt, Human
gggguugugggguggaggcuggcagcugaaag

SEQ ID NO: 200131 - RNA, 32 nt, Human
gggguuguggguggucagggagagguagggug

SEQ ID NO: 200132 - RNA, 32 nt, Human
gggguuguggugagccgagacugugucauugc

SEQ ID NO: 200133 - RNA, 32 nt, Human
gggguuguggugagccgugaucaugccauugc

SEQ ID NO: 200134 - RNA, 32 nt, Human
gggguugugugugguuucuuucuuuugaauuu

SEQ ID NO: 200135 - RNA, 32 nt, Human
gggguuguucuauacaccuguguccuuacccc

SEQ ID NO: 200136 - RNA, 32 nt, Human
gggguuguugugagccaagauugcaccacggc

SEQ ID NO: 200137 - RNA, 32 nt, Human
gggguuucaaugcuguugggaaccaggaaggu

SEQ ID NO: 200138 - RNA, 32 nt, Human
gggguuucaccaugguagccaggcuggucuca

SEQ ID NO: 200139 - RNA, 18 nt, Human
gggguuucaccauguugg

SEQ ID NO: 200140 - RNA, 32 nt, Human
gggguuucaccauguuggucaggauggucuca

SEQ ID NO: 200141 - RNA, 32 nt, Human
gggguuucaccauguuggucaggauggucuug

SEQ ID NO: 200142 - RNA, 32 nt, Human
gggguuucaccauguuggucaggcuggucuug

SEQ ID NO: 200143 - RNA, 20 nt, Human
gggguuucacccgggcccuc

SEQ ID NO: 200144 - RNA, 32 nt, Human
gggguuucacccuauuggucaggcuggucuug

SEQ ID NO: 200145 - RNA, 32 nt, Human
gggguuucacuauauuggccaggcuggucucg

SEQ ID NO: 200146 - RNA, 32 nt, Human
gggguuucacucugucacccaggcugggaauu

SEQ ID NO: 200147 - RNA, 32 nt, Human
gggguuucagugagcugagaucaugccacugc

SEQ ID NO: 200148 - RNA, 32 nt, Human
gggguuuccuucaaacucuuggcuccaccuag

SEQ ID NO: 200149 - RNA, 32 nt, Human
gggguuucgccagguuggccaggcuggucuug

SEQ ID NO: 200150 - RNA, 32 nt, Human
gggguuucgccauguuacacuggcugguguug

SEQ ID NO: 200151 - RNA, 32 nt, Human
gggguuucguccuguuacccaggcugguuuug

SEQ ID NO: 200152 - RNA, 32 nt, Human
gggguuucuagacuggggccuggccaccccuu

SEQ ID NO: 200153 - RNA, 32 nt, Human
gggguuucuccacauuggucaggcuggucuug

SEQ ID NO: 200154 - RNA, 32 nt, Human
gggguuucuccacguuggccaggcuggucuca

SEQ ID NO: 200155 - RNA, 32 nt, Human
gggguuucuccauauuggucaggcuggucuug

SEQ ID NO: 200156 - RNA, 32 nt, Human
gggguuucuccaugguggucaggcuggucucg

SEQ ID NO: 200157 - RNA, 32 nt, Human
gggguuucuccaugucggucaggcuggucucg

SEQ ID NO: 200158 - RNA, 32 nt, Human
gggguuucuccauguuagucaggcuggucucc

SEQ ID NO: 200159 - RNA, 32 nt, Human
gggguuucuccauguuggccaggcuggucuug

SEQ ID NO: 200160 - RNA, 32 nt, Human
gggguuucuccauguuggucaggcuggccucg

SEQ ID NO: 200161 - RNA, 32 nt, Human
gggguuucuccauguuggucaggcuggucuca

SEQ ID NO: 200162 - RNA, 32 nt, Human
gggguuucuccauguuggucaggcuggucucg

SEQ ID NO: 200163 - RNA, 32 nt, Human
gggguuucuccauguuggucaggcuggucucu

SEQ ID NO: 200164 - RNA, 32 nt, Human
gggguuucuccauguuggucaggcuggucuga

SEQ ID NO: 200165 - RNA, 32 nt, Human
gggguuucuccauguuggucaggcuggucuua

SEQ ID NO: 200166 - RNA, 32 nt, Human
gggguuucuccauguuggucaggcuggucuuc

SEQ ID NO: 200167 - RNA, 32 nt, Human
gggguuucuccauguuggucaggcuggucuug

SEQ ID NO: 200168 - RNA, 32 nt, Human
gggguuucuccauguuucccaggcuggucuca

SEQ ID NO: 200169 - RNA, 32 nt, Human
gggguuucugccuuugcuucucuugucauucu

SEQ ID NO: 200170 - RNA, 31 nt, Human
gggguuugacuucucccagcgcagaugagag

SEQ ID NO: 200171 - RNA, 32 nt, Human
gggguuugaguggagguauggagccagagagg

SEQ ID NO: 200172 - RNA, 32 nt, Human
gggguuugggagucaggccugggcaggacccu

SEQ ID NO: 200173 - RNA, 32 nt, Human
gggguuuggggagcuuggccgauucgucuauc

SEQ ID NO: 200174 - RNA, 32 nt, Human
gggguuugguaaugagaaaccaggacaggcca

SEQ ID NO: 200175 - RNA, 32 nt, Human
gggguuugucaugggggaacugcccuuuaaau

SEQ ID NO: 200176 - RNA, 32 nt, Human
gggguuuguugaugaaccuccacccccacccc

SEQ ID NO: 200177 - RNA, 32 nt, Human
gggguuuuccuugagcguugcccauuacuuua

SEQ ID NO: 200178 - RNA, 32 nt, Human
gggguuuucuaugugaaacacaugccaguuuu

SEQ ID NO: 200179 - RNA, 32 nt, Human
gggguuuucuguccauccugugcaguauuugg

SEQ ID NO: 200180 - RNA, 32 nt, Human
gggguuuugguagaauuggaccuacucuagga

SEQ ID NO: 200181 - RNA, 32 nt, Human
gggguuuuugcugucccuccccucagcgccga

SEQ ID NO: 200182 - RNA, 32 nt, Human
ggguaaaacuaggacacagaaaacauugggaa

SEQ ID NO: 200183 - RNA, 32 nt, Human
ggguaaaaugagcucagggggcagugaggugc

SEQ ID NO: 200184 - RNA, 32 nt, Human
ggguaaacaggcucuguauccguggcagcggc

SEQ ID NO: 200185 - RNA, 32 nt, Human
ggguaaagagaaaaggagggagaagggaagga

SEQ ID NO: 200186 - RNA, 32 nt, Human
ggguaaagguaaaaaugagauuuggaauagug

SEQ ID NO: 200187 - RNA, 32 nt, Human
ggguaaaguaccaccugcuacucagaaagcua

SEQ ID NO: 200188 - RNA, 32 nt, Human
ggguaaaucucuucugcggaaucucagaaagu

SEQ ID NO: 200189 - RNA, 32 nt, Human
ggguaaauuauauacauauauguaugaaugua

SEQ ID NO: 200190 - RNA, 32 nt, Human
ggguaaauucucagauuuccaaacugcuguac

SEQ ID NO: 200191 - RNA, 32 nt, Human
ggguaacaaagugagacccccaucucuacaaa

SEQ ID NO: 200192 - RNA, 23 nt, Human
ggguaacaaagugagaccucccu

SEQ ID NO: 200193 - RNA, 32 nt, Human
ggguaacacagcaacggagaacagaugcaggu

SEQ ID NO: 200194 - RNA, 32 nt, Human
ggguaacacagcccuggauucucccagauauu

SEQ ID NO: 200195 - RNA, 32 nt, Human
ggguaacacagguccugcuguggccuuuccuu

SEQ ID NO: 200196 - RNA, 32 nt, Human
ggguaacacccugggaguuuuaguagcuugag

SEQ ID NO: 200197 - RNA, 32 nt, Human
ggguaacaccucaaaccuauggauucauucac

SEQ ID NO: 200198 - RNA, 32 nt, Human
ggguaacacuuccaaauaugggaggaaaggac

SEQ ID NO: 200199 - RNA, 32 nt, Human
ggguaacagacccaaaagccgaugggacggcc

SEQ ID NO: 200200 - RNA, 24 nt, Human
ggguaacagagcaagacucugucu

SEQ ID NO: 200201 - RNA, 22 nt, Human
ggguaacagagcgagacuuucu

SEQ ID NO: 200202 - RNA, 24 nt, Human
ggguaacagagggagacucugucu

SEQ ID NO: 200203 - RNA, 24 nt, Human
ggguaacagagugagacuccaucu

SEQ ID NO: 200204 - RNA, 22 nt, Human
ggguaacagagugagacugucu

SEQ ID NO: 200205 - RNA, 22 nt, Human
ggguaacagcgagacucugucu

SEQ ID NO: 200206 - RNA, 32 nt, Human
ggguaacaggcagagauuggaacaguuuggag

SEQ ID NO: 200207 - RNA, 32 nt, Human
ggguaacaggcagaggcuggaacaguuuggag

SEQ ID NO: 200208 - RNA, 32 nt, Human
ggguaacaggcagagguuagaacaauuuggag

SEQ ID NO: 200209 - RNA, 32 nt, Human
ggguaacaggcagagguuggaacaguuuggag

SEQ ID NO: 200210 - RNA, 24 nt, Human
ggguaacauagugagacccuaucu

SEQ ID NO: 200211 - RNA, 32 nt, Human
ggguaacaucacaguagauucgucuucuggau

SEQ ID NO: 200212 - RNA, 32 nt, Human
ggguaacauggccagaccccaucucuauuuau

SEQ ID NO: 200213 - RNA, 32 nt, Human
ggguaacauggugaaaucccauaucuacaaaa

SEQ ID NO: 200214 - RNA, 32 nt, Human
ggguaaccagcagaagguaacagaacgaggcu

SEQ ID NO: 200215 - RNA, 32 nt, Human
ggguaacccugccuuguucugucauccagggc

SEQ ID NO: 200216 - RNA, 32 nt, Human
ggguaaccuugauauuuguauuuuaauaguac

SEQ ID NO: 200217 - RNA, 21 nt, Human
ggguaacggaacagccaccua

SEQ ID NO: 200218 - RNA, 31 nt, Human
ggguaacggcgagcgcguggggccaagaaag

SEQ ID NO: 200219 - RNA, 32 nt, Human
ggguaacggcuccugggccucucccgggucaa

SEQ ID NO: 200220 - RNA, 32 nt, Human
ggguaacggucgcuggugaguuuaaaugagca

SEQ ID NO: 200221 - RNA, 32 nt, Human
ggguaacuggaggcggggccagggccucagcg

SEQ ID NO: 200222 - RNA, 32 nt, Human
ggguaagaaagggcacauggcacaguuaaagu

SEQ ID NO: 200223 - RNA, 32 nt, Human
ggguaagacauucugggguuucuugaaucuug

SEQ ID NO: 200224 - RNA, 32 nt, Human
ggguaagacuaaaucuguaagcucuuugaaac

SEQ ID NO: 200225 - RNA, 24 nt, Human
ggguaagagagcgagacucugccu

SEQ ID NO: 200226 - RNA, 32 nt, Human
ggguaagaggggcuggcucucagucccugccu

SEQ ID NO: 200227 - RNA, 32 nt, Human
ggguaagcuaacugggcggagguggaggugca

SEQ ID NO: 200228 - RNA, 32 nt, Human
ggguaagcuagagagaaaaagaaagaacuguc

SEQ ID NO: 200229 - RNA, 32 nt, Human
ggguaaggacagugggauuuaugugaacauca

SEQ ID NO: 200230 - RNA, 32 nt, Human
ggguaaggacuugccagagaacuacaacgagg

SEQ ID NO: 200231 - RNA, 22 nt, Human
ggguaaggaggcucccaucccg

SEQ ID NO: 200232 - RNA, 32 nt, Human
ggguaagggcacauguggaagcaaagaaaccu

SEQ ID NO: 200233 - RNA, 32 nt, Human
ggguaagggcagugccugcugugccuguuggc

SEQ ID NO: 200234 - RNA, 20 nt, Human
ggguaagggggcuucugaug

SEQ ID NO: 200235 - RNA, 32 nt, Human
ggguaagggucuucccuugagcuccagggggu

SEQ ID NO: 200236 - RNA, 32 nt, Human
ggguaaggugucccucggaucuguccucuucg

SEQ ID NO: 200237 - RNA, 32 nt, Human
ggguaagugguuuucuucucugcuuggcaguu

SEQ ID NO: 200238 - RNA, 32 nt, Human
ggguaaguguccccucauuuuagagaaagauc

SEQ ID NO: 200239 - RNA, 32 nt, Human
ggguaauauauugugacaauuuuugcaacuua

SEQ ID NO: 200240 - RNA, 32 nt, Human
ggguaauauggcaaaaccccaucucuacuaaa

SEQ ID NO: 200241 - RNA, 32 nt, Human
ggguaaucaucuuuacuucugguuccugaaau

SEQ ID NO: 200242 - RNA, 32 nt, Human
ggguaauggagaugaccaguccacacugauaa

SEQ ID NO: 200243 - RNA, 18 nt, Human
ggguaaugugaaggccca

SEQ ID NO: 200244 - RNA, 32 nt, Human
ggguaauuggcuucucaguccugaaggacuau

SEQ ID NO: 200245 - RNA, 22 nt, Human
ggguacaaaggucuggccuccu

SEQ ID NO: 200246 - RNA, 32 nt, Human
ggguacaacagcuuuggaauacauucugguuu

SEQ ID NO: 200247 - RNA, 32 nt, Human
ggguacaaccaccaugacaacugccgggaggg

SEQ ID NO: 200248 - RNA, 32 nt, Human
ggguacacauuuccuaucuuccuccagcuucc

SEQ ID NO: 200249 - RNA, 20 nt, Human
ggguacagaagaggcuucag

SEQ ID NO: 200250 - RNA, 32 nt, Human
ggguacagaugggcauaggugcagugagugca

SEQ ID NO: 200251 - RNA, 32 nt, Human
ggguacagcaggcagggacuaugcugaagugg

SEQ ID NO: 200252 - RNA, 32 nt, Human
ggguacagccucccuccuggcugcuuucacgg

SEQ ID NO: 200253 - RNA, 21 nt, Human
ggguacaggaagcugugugca

SEQ ID NO: 200254 - RNA, 32 nt, Human
ggguacaggaggaggacgccgcagaggugcgu

SEQ ID NO: 200255 - RNA, 32 nt, Human
ggguacaggggcugcgcagaguuuguccccga

SEQ ID NO: 200256 - RNA, 32 nt, Human
ggguacaggugauuggcugagcacagacugcg

SEQ ID NO: 200257 - RNA, 32 nt, Human
ggguacaggugggcacaagugcagaaggugca

SEQ ID NO: 200258 - RNA, 32 nt, Human
ggguacaggugggcauaggugcagugagugca

SEQ ID NO: 200259 - RNA, 32 nt, Human
ggguacaguuguucaggcugugcacugcacaa

SEQ ID NO: 200260 - RNA, 22 nt, Human
ggguacauaugugaacauucca

SEQ ID NO: 200261 - RNA, 32 nt, Human
ggguacaucacucagccuuucuggacccaauu

SEQ ID NO: 200262 - RNA, 32 nt, Human
ggguaccaacagcugcucgcuguucccauguc

SEQ ID NO: 200263 - RNA, 32 nt, Human
ggguaccaagcacuuugcagacugcuuuaccu

SEQ ID NO: 200264 - RNA, 32 nt, Human
ggguaccacaaaccgcaugggaugucuaggaa

SEQ ID NO: 200265 - RNA, 32 nt, Human
ggguaccaggagcugaggagugugagcgugcc

SEQ ID NO: 200266 - RNA, 20 nt, Human
ggguacccccgcggcugggc

SEQ ID NO: 200267 - RNA, 20 nt, Human
ggguaccccuccacagcgac

SEQ ID NO: 200268 - RNA, 32 nt, Human
ggguaccgggcgcgggcagagcgcggcggcgc

SEQ ID NO: 200269 - RNA, 32 nt, Human
ggguaccgucuucucccuauucccucucucuc

SEQ ID NO: 200270 - RNA, 32 nt, Human
ggguaccuauaaucccagcuacucgggaggcu

SEQ ID NO: 200271 - RNA, 32 nt, Human
ggguaccuauaaucccagcuacuugggaggcu

SEQ ID NO: 200272 - RNA, 32 nt, Human
ggguaccucauuuugucccuugacuuuagugu

SEQ ID NO: 200273 - RNA, 32 nt, Human
ggguaccuguaaucccagcuacuagggaggcu

SEQ ID NO: 200274 - RNA, 32 nt, Human
ggguaccuguaaucccagcuacucaggaggcu

SEQ ID NO: 200275 - RNA, 32 nt, Human
ggguaccuguaaucccagcuacucgggaggcu

SEQ ID NO: 200276 - RNA, 32 nt, Human
ggguaccuguaaucccagcuacuugggaggcu

SEQ ID NO: 200277 - RNA, 32 nt, Human
ggguaccuguaaucccaguuacuuuggaggcu

SEQ ID NO: 200278 - RNA, 32 nt, Human
ggguaccuguagucccagcuacuagggaggcu

SEQ ID NO: 200279 - RNA, 32 nt, Human
ggguaccuguagucccagcuacuccggaggcu

SEQ ID NO: 200280 - RNA, 32 nt, Human
ggguacgaagggaggacaagugcagugucgug

SEQ ID NO: 200281 - RNA, 32 nt, Human
ggguacguucaagaggaaggugccucgugaac

SEQ ID NO: 200282 - RNA, 32 nt, Human
ggguacuaggcaguuuccaaaguagcauggua

SEQ ID NO: 200283 - RNA, 32 nt, Human
ggguacuccaggucucuccaaacugcuauaua

SEQ ID NO: 200284 - RNA, 32 nt, Human
ggguacucugacugcaacaucuuucaccccau

SEQ ID NO: 200285 - RNA, 32 nt, Human
ggguacugcccauccagcacccaugucaugcc

SEQ ID NO: 200286 - RNA, 32 nt, Human
ggguacugggccucaacgggaaccugagacag

SEQ ID NO: 200287 - RNA, 32 nt, Human
ggguacuggggccugccgcauccuguccuguc

SEQ ID NO: 200288 - RNA, 32 nt, Human
ggguacugggucccccucagcacccuccacag

SEQ ID NO: 200289 - RNA, 32 nt, Human
ggguacugguaguaccagcuacucgagaggcu

SEQ ID NO: 200290 - RNA, 32 nt, Human
ggguacuguguuacugccugggugguaggauc

SEQ ID NO: 200291 - RNA, 32 nt, Human
ggguacuguuacugugaugcuauugacuuagu

SEQ ID NO: 200292 - RNA, 18 nt, Human
ggguacuuagaggcccag

SEQ ID NO: 200293 - RNA, 22 nt, Human
ggguacuucguagacucugccu

SEQ ID NO: 200294 - RNA, 32 nt, Human
ggguacuugguacuuaguuugcauuuacuauc

SEQ ID NO: 200295 - RNA, 32 nt, Human
ggguacuugguggggacggaggagcuagggac

SEQ ID NO: 200296 - RNA, 32 nt, Human
ggguacuuugguagccugaguggucuuuuuca

SEQ ID NO: 200297 - RNA, 32 nt, Human
ggguagaaaacuucaaggaaaauaagugaaau

SEQ ID NO: 200298 - RNA, 32 nt, Human
ggguagaaagagacucucguguggagguuaca

SEQ ID NO: 200299 - RNA, 32 nt, Human
ggguagaagagauuccagaaucaucaucugug

SEQ ID NO: 200300 - RNA, 32 nt, Human
ggguagaagcggaagccaggggcagaggcugg

SEQ ID NO: 200301 - RNA, 20 nt, Human
ggguagaaggcaaagcugcc

SEQ ID NO: 200302 - RNA, 32 nt, Human
ggguagaaggcggagccggagccccggaaccc

SEQ ID NO: 200303 - RNA, 32 nt, Human
ggguagacccuccagccccaauagcccuagua

SEQ ID NO: 200304 - RNA, 32 nt, Human
ggguagaccuaaggguguuuguuagucucaaa

SEQ ID NO: 200305 - RNA, 32 nt, Human
ggguagagacgggguuucaccguguuagccaa

SEQ ID NO: 200306 - RNA, 19 nt, Human
ggguagaggaaaggcucca

SEQ ID NO: 200307 - RNA, 32 nt, Human
ggguagaggagaagguugaagcuguggagcua

SEQ ID NO: 200308 - RNA, 32 nt, Human
ggguagaggccaggagaaaggaaagaguugua

SEQ ID NO: 200309 - RNA, 32 nt, Human
ggguagaggcuucuuagauucucccagcaucc

SEQ ID NO: 200310 - RNA, 21 nt, Human
ggguagagggacauccaggga

SEQ ID NO: 200311 - RNA, 32 nt, Human
ggguagagucagugacagggaggcagcccucc

SEQ ID NO: 200312 - RNA, 32 nt, Human
ggguagagucauggccucgagcacaggugacc

SEQ ID NO: 200313 - RNA, 32 nt, Human
ggguagagucucccaagccaaaauuuugacau

SEQ ID NO: 200314 - RNA, 32 nt, Human
ggguagauaagaaaugacucugggagaggauu

SEQ ID NO: 200315 - RNA, 22 nt, Human
ggguagaucacuugaggucagg

SEQ ID NO: 200316 - RNA, 32 nt, Human
ggguagcaacagcaucuuccacaguuuuccaa

SEQ ID NO: 200317 - RNA, 32 nt, Human
ggguagcaaucuuguugccacaugugcagcaa

SEQ ID NO: 200318 - RNA, 32 nt, Human
ggguagcacaucaaaauggugaugaaccuggc

SEQ ID NO: 200319 - RNA, 18 nt, Human
ggguagcagcagaggcag

SEQ ID NO: 200320 - RNA, 32 nt, Human
ggguagcagcuggugggacacugaucugugag

SEQ ID NO: 200321 - RNA, 32 nt, Human
ggguagcaggugccuggagucucagguggcug

SEQ ID NO: 200322 - RNA, 32 nt, Human
ggguagcagugucucaagaguggucaaaagcu

SEQ ID NO: 200323 - RNA, 32 nt, Human
ggguagcauaugggaacuucaucucuaauuuu

SEQ ID NO: 200324 - RNA, 32 nt, Human
ggguagcauggcagaggcuggagaggauuaac

SEQ ID NO: 200325 - RNA, 32 nt, Human
ggguagccagaggcuggggcggcuguggagcc

SEQ ID NO: 200326 - RNA, 32 nt, Human
ggguagccagguguuacaaaggugcugcuccu

SEQ ID NO: 200327 - RNA, 32 nt, Human
ggguagcccauguuaugugacuaucuuuauga

SEQ ID NO: 200328 - RNA, 32 nt, Human
ggguagccuggaacagggagacgguguggaga

SEQ ID NO: 200329 - RNA, 32 nt, Human
ggguagccugggauuaggccucaucaucaucc

SEQ ID NO: 200330 - RNA, 32 nt, Human
ggguagcugggagcucuggucagucccaguga

SEQ ID NO: 200331 - RNA, 32 nt, Human
ggguaggaagggugggaagggagaagcagaca

SEQ ID NO: 200332 - RNA, 32 nt, Human
ggguaggaaugagcaaguugggaauuuuagac

SEQ ID NO: 200333 - RNA, 32 nt, Human
ggguaggagaacagccauuccacauguguucc

SEQ ID NO: 200334 - RNA, 21 nt, Human
ggguaggagacagcugggagg

SEQ ID NO: 200335 - RNA, 32 nt, Human
ggguaggagagagaggccuaagaggcucacug

SEQ ID NO: 200336 - RNA, 21 nt, Human
ggguaggaggcagggccgcug

SEQ ID NO: 200337 - RNA, 32 nt, Human
ggguaggagggccaggcaaaguucaccagcuu

SEQ ID NO: 200338 - RNA, 32 nt, Human
ggguaggaggggcguuagagccagcagggacc

SEQ ID NO: 200339 - RNA, 32 nt, Human
ggguaggagggugggaaggaaacaaccauguc

SEQ ID NO: 200340 - RNA, 32 nt, Human
ggguaggagugcaacccaggagcaacgcucaa

SEQ ID NO: 200341 - RNA, 32 nt, Human
ggguaggagugggcguggcggagccagcuccg

SEQ ID NO: 200342 - RNA, 32 nt, Human
ggguaggcaagaggaauagaaaagggaagaau

SEQ ID NO: 200343 - RNA, 32 nt, Human
ggguaggcagcaaagaagaaagagugcgauau

SEQ ID NO: 200344 - RNA, 32 nt, Human
ggguaggcaggcacagagugcugucugcugag

SEQ ID NO: 200345 - RNA, 32 nt, Human
ggguaggcagugccugcuucugcuccaucagg

SEQ ID NO: 200346 - RNA, 32 nt, Human
ggguaggccaaguggagguaucagggacgucg

SEQ ID NO: 200347 - RNA, 32 nt, Human
ggguaggccuguagacuaacgcuguuuacacc

SEQ ID NO: 200348 - RNA, 32 nt, Human
ggguaggcugagucaugaaagggacaucauua

SEQ ID NO: 200349 - RNA, 31 nt, Human
ggguagggaauacuggagauauuuguacaga

SEQ ID NO: 200350 - RNA, 21 nt, Human
ggguagggagacaagcagcag

SEQ ID NO: 200351 - RNA, 32 nt, Human
ggguagggagagaagcugagaccaggaccggu

SEQ ID NO: 200352 - RNA, 32 nt, Human
ggguagggagagaguaucaggagcucaguguu

SEQ ID NO: 200353 - RNA, 32 nt, Human
ggguagggagagaguaucaggagcucaguuuu

SEQ ID NO: 200354 - RNA, 32 nt, Human
ggguagggagcugucuaauccaagucccaggc

SEQ ID NO: 200355 - RNA, 32 nt, Human
ggguagggcacaccuccccacagccacccucc

SEQ ID NO: 200356 - RNA, 32 nt, Human
ggguagggccuguucccaccacccuagcugga

SEQ ID NO: 200357 - RNA, 32 nt, Human
ggguagggcugaaaguccuaaccuucuaaucc

SEQ ID NO: 200358 - RNA, 32 nt, Human
ggguaggggaagcccagggugggcagggggug

SEQ ID NO: 200359 - RNA, 32 nt, Human
ggguaggggcaucauuucagugagaaucagau

SEQ ID NO: 200360 - RNA, 32 nt, Human
ggguaggggccaggccccuccaggccgucacu

SEQ ID NO: 200361 - RNA, 32 nt, Human
ggguaggggccaggcuagccugagugcaccca

SEQ ID NO: 200362 - RNA, 32 nt, Human
ggguaggggcugggaacagugugcaaggcagc

SEQ ID NO: 200363 - RNA, 32 nt, Human
ggguaggggugaggguauaaguagaucagagu

SEQ ID NO: 200364 - RNA, 31 nt, Human
ggguagggguuucagccccacccucaggaag

SEQ ID NO: 200365 - RNA, 32 nt, Human
ggguagggguuucagccccacccucaggaaga

SEQ ID NO: 200366 - RNA, 32 nt, Human
ggguagggucucucaguaaaucaagucccuua

SEQ ID NO: 200367 - RNA, 32 nt, Human
ggguaggugagguguugggcaguugugggaac

SEQ ID NO: 200368 - RNA, 32 nt, Human
ggguagguucuggaggcucaagcaacaaggag

SEQ ID NO: 200369 - RNA, 32 nt, Human
ggguagguuuguuuggaacagaaaucaaagac

SEQ ID NO: 200370 - RNA, 32 nt, Human
ggguaguacccagccugcuccccgaguccagc

SEQ ID NO: 200371 - RNA, 32 nt, Human
ggguagucacauuaauagaagauucaugagug

SEQ ID NO: 200372 - RNA, 19 nt, Human
ggguaguccgcccccuccu

SEQ ID NO: 200373 - RNA, 32 nt, Human
ggguagugaaggaauaaugagagaaggcaggc

SEQ ID NO: 200374 - RNA, 32 nt, Human
ggguagugagcgguguuucaggaugugagggc

SEQ ID NO: 200375 - RNA, 32 nt, Human
ggguagugaggauagagaaaaaguguuugucu

SEQ ID NO: 200376 - RNA, 30 nt, Human
ggguagugccuguaaucagaaaacaacuua

SEQ ID NO: 200377 - RNA, 32 nt, Human
ggguaguggagggauuuuguccccagcagugg

SEQ ID NO: 200378 - RNA, 32 nt, Human
ggguaguggggaggucagggaggcggggccaa

SEQ ID NO: 200379 - RNA, 32 nt, Human
ggguaguuagcuauuucugggugacccagucu

SEQ ID NO: 200380 - RNA, 32 nt, Human
ggguaguuccugcugugagugguuacagcuga

SEQ ID NO: 200381 - RNA, 32 nt, Human
ggguaguuggggucccagaaagccggggguag

SEQ ID NO: 200382 - RNA, 32 nt, Human
ggguaguuuaucaauccucccgccucauccuu

SEQ ID NO: 200383 - RNA, 32 nt, Human
ggguaguuucuccagucuccccagucuguugg

SEQ ID NO: 200384 - RNA, 32 nt, Human
ggguaguuuucuaucugucaugggcucuagca

SEQ ID NO: 200385 - RNA, 32 nt, Human
ggguauaagccccagcccugcucauucccacu

SEQ ID NO: 200386 - RNA, 32 nt, Human
ggguauagacccaggagaggaagguuaagaga

SEQ ID NO: 200387 - RNA, 32 nt, Human
ggguauagaguauagaggcuauuucuauaauu

SEQ ID NO: 200388 - RNA, 32 nt, Human
ggguauauucacacgauggaaucccagacugc

SEQ ID NO: 200389 - RNA, 31 nt, Human
ggguaucacagcugugucagugccauggccc

SEQ ID NO: 200390 - RNA, 32 nt, Human
ggguaucagcaacuguccucaucagucuccau

SEQ ID NO: 200391 - RNA, 32 nt, Human
ggguaucccuuuaggauggaacuagguccugg

SEQ ID NO: 200392 - RNA, 32 nt, Human
ggguauccugacuguuggaccccugguccagg

SEQ ID NO: 200393 - RNA, 32 nt, Human
ggguaucgucgugggacuuggaaauuuguugu

SEQ ID NO: 200394 - RNA, 32 nt, Human
ggguaucuccaccucuccaacacaagcucaau

SEQ ID NO: 200395 - RNA, 32 nt, Human
ggguaucuggacaacagagaugccaugauauc

SEQ ID NO: 200396 - RNA, 32 nt, Human
ggguaucugugccuugcccucccugagagggg

SEQ ID NO: 200397 - RNA, 32 nt, Human
ggguaucuucauagcagccuaggaaaccuuaa

SEQ ID NO: 200398 - RNA, 32 nt, Human
ggguaucuuggcugaaaauuuuguuuuacaua

SEQ ID NO: 200399 - RNA, 28 nt, Human
ggguaucuuggugcugccuguauugguc

SEQ ID NO: 200400 - RNA, 32 nt, Human
ggguaucuuuucaacuuuaauagagacuauuc

SEQ ID NO: 200401 - RNA, 32 nt, Human
ggguaugcaagccuaaaucuuuguacacuuug

SEQ ID NO: 200402 - RNA, 31 nt, Human
ggguaugcagucuucugacaucccacagagc

SEQ ID NO: 200403 - RNA, 32 nt, Human
ggguaugcguggguguauguuugggaagaaaa

SEQ ID NO: 200404 - RNA, 32 nt, Human
ggguaugcuucaugaccuguguuuuggugagu

SEQ ID NO: 200405 - RNA, 32 nt, Human
ggguaugggaaugagcacauaacacuauggac

SEQ ID NO: 200406 - RNA, 32 nt, Human
ggguauggggugaagcuucuucugcugucucu

SEQ ID NO: 200407 - RNA, 32 nt, Human
ggguaugggugaguggcagagggguaaggaga

SEQ ID NO: 200408 - RNA, 32 nt, Human
ggguauggucuugagccaguaaucuuuguacu

SEQ ID NO: 200409 - RNA, 23 nt, Human
ggguauggugacucaugccugua

SEQ ID NO: 200410 - RNA, 23 nt, Human
ggguaugguggcacaugccugua

SEQ ID NO: 200411 - RNA, 23 nt, Human
ggguaugguggcucacaacugua

SEQ ID NO: 200412 - RNA, 23 nt, Human
ggguaugguggcucaugccugua

SEQ ID NO: 200413 - RNA, 23 nt, Human
ggguauggugguacaugccugua

SEQ ID NO: 200414 - RNA, 18 nt, Human
ggguauggugguggugga

SEQ ID NO: 200415 - RNA, 32 nt, Human
ggguauguaaugggguggaauuacugguucau

SEQ ID NO: 200416 - RNA, 32 nt, Human
ggguaugugguggaugccagggcgugcuccag

SEQ ID NO: 200417 - RNA, 32 nt, Human
ggguauguucuucauagguagugcuugugucu

SEQ ID NO: 200418 - RNA, 32 nt, Human
ggguauuaugaauaauaucacaggguguacag

SEQ ID NO: 200419 - RNA, 32 nt, Human
ggguauucagagugggcugggccccugggcga

SEQ ID NO: 200420 - RNA, 32 nt, Human
ggguauucagaugccaccuacaugcuuauuuu

SEQ ID NO: 200421 - RNA, 32 nt, Human
ggguauugagagccagugggcuuuuguguagc

SEQ ID NO: 200422 - RNA, 31 nt, Human
ggguauuggacaauuuguagcuaagacuccc

SEQ ID NO: 200423 - RNA, 32 nt, Human
ggguauuggggaaggcaggaaagggaaaagga

SEQ ID NO: 200424 - RNA, 32 nt, Human
ggguauuugccuggcuuuguugcuucucuauc

SEQ ID NO: 200425 - RNA, 25 nt, Human
ggguauuuuucuuggggguggagua

SEQ ID NO: 200426 - RNA, 32 nt, Human
gggucaaagaaggaggaggaggguggggagcu

SEQ ID NO: 200427 - RNA, 32 nt, Human
gggucaacaaauuuuugugucugugaggggcc

SEQ ID NO: 200428 - RNA, 32 nt, Human
gggucaaccaggaagugaaggauuggaagaga

SEQ ID NO: 200429 - RNA, 32 nt, Human
gggucaacccuguaauuccagcacuuugggag

SEQ ID NO: 200430 - RNA, 23 nt, Human
gggucaagauagcagcagcaggu

SEQ ID NO: 200431 - RNA, 32 nt, Human
gggucaagcagaagaggaaggcagggauccca

SEQ ID NO: 200432 - RNA, 32 nt, Human
gggucaagcagaggaggaaggcagggguacca

SEQ ID NO: 200433 - RNA, 32 nt, Human
gggucaagcaguggaggaaggcagggauccca

SEQ ID NO: 200434 - RNA, 32 nt, Human
gggucaagccugcucugccacaggguuggaug

SEQ ID NO: 200435 - RNA, 32 nt, Human
gggucaaggagaggaggaagacagggauccua

SEQ ID NO: 200436 - RNA, 19 nt, Human
gggucaaggcagaggcagg

SEQ ID NO: 200437 - RNA, 32 nt, Human
gggucaaggugguaagcugugcagugaaguca

SEQ ID NO: 200438 - RNA, 32 nt, Human
gggucaagucagagggcucuaccuggaaggac

SEQ ID NO: 200439 - RNA, 32 nt, Human
gggucaagugaucuuuaugggaugccuauuua

SEQ ID NO: 200440 - RNA, 32 nt, Human
gggucaaguucaguacuugguaauaagacaaa

SEQ ID NO: 200441 - RNA, 32 nt, Human
gggucaaguuugggugacuggugcagaguuac

SEQ ID NO: 200442 - RNA, 32 nt, Human
gggucacaacagcaauugcguuucuaaaacau

SEQ ID NO: 200443 - RNA, 19 nt, Human
gggucacaagaggcuccag

SEQ ID NO: 200444 - RNA, 31 nt, Human
gggucacacagcuaaagccgaggugaccagu

SEQ ID NO: 200445 - RNA, 32 nt, Human
gggucacaccuguaaucccagcacuuugggag

SEQ ID NO: 200446 - RNA, 32 nt, Human
gggucacacugggucugggggcucccuggagc

SEQ ID NO: 200447 - RNA, 32 nt, Human
gggucacagagggagccgcaggguuggcagcg

SEQ ID NO: 200448 - RNA, 32 nt, Human
gggucacagcuggucuguguguccaguucccu

SEQ ID NO: 200449 - RNA, 32 nt, Human
gggucacagggacagugcagagccaggaccag

SEQ ID NO: 200450 - RNA, 32 nt, Human
gggucacaggucagggagguccuggccgucca

SEQ ID NO: 200451 - RNA, 32 nt, Human
gggucacagguuaccgucucuuucagcucacc

SEQ ID NO: 200452 - RNA, 32 nt, Human
gggucacagucucccugaaggagcugcagagu

SEQ ID NO: 200453 - RNA, 32 nt, Human
gggucacagugauagggccacccuggauggga

SEQ ID NO: 200454 - RNA, 32 nt, Human
gggucacaucuguaaucucagcucuuuggaag

SEQ ID NO: 200455 - RNA, 32 nt, Human
gggucacaugaacagauguugcaguguaccug

SEQ ID NO: 200456 - RNA, 32 nt, Human
gggucacaugacaaagccccaucucuacaaaa

SEQ ID NO: 200457 - RNA, 31 nt, Human
gggucacaugagagagaacaaauggcugugg

SEQ ID NO: 200458 - RNA, 17 nt, Human
gggucaccaagugcaag

SEQ ID NO: 200459 - RNA, 21 nt, Human
gggucaccagcugagauguca

SEQ ID NO: 200460 - RNA, 32 nt, Human
gggucaccagcugagaugucaccugcuuuauu

SEQ ID NO: 200461 - RNA, 32 nt, Human
gggucacccaaauagcugagugcaguccuugc

SEQ ID NO: 200462 - RNA, 32 nt, Human
gggucacccagucacauugggaagggcuguga

SEQ ID NO: 200463 - RNA, 32 nt, Human
gggucacccugcagguucccauaaaaacgauu

SEQ ID NO: 200464 - RNA, 32 nt, Human
gggucacccugcuucuugcccugcugugugug

SEQ ID NO: 200465 - RNA, 32 nt, Human
gggucacccuuguggggccuggacaugacgca

SEQ ID NO: 200466 - RNA, 32 nt, Human
gggucaccugggaagagucugcagagccuuug

SEQ ID NO: 200467 - RNA, 21 nt, Human
gggucacgcagcuuccuggug

SEQ ID NO: 200468 - RNA, 32 nt, Human
gggucacgccuguaaucccagcacuuugggag

SEQ ID NO: 200469 - RNA, 18 nt, Human
gggucacgcggcgggcac

SEQ ID NO: 200470 - RNA, 32 nt, Human
gggucacggcggcggggagagguggagccgcg

SEQ ID NO: 200471 - RNA, 32 nt, Human
gggucacuccagcccgggccucccagaacacc

SEQ ID NO: 200472 - RNA, 32 nt, Human
gggucacuccugggggaugacggcguggacga

SEQ ID NO: 200473 - RNA, 32 nt, Human
gggucacugaaccacugcuucucuuccgaaag

SEQ ID NO: 200474 - RNA, 32 nt, Human
gggucacugaaccacugcuucucuuuugaaag

SEQ ID NO: 200475 - RNA, 32 nt, Human
gggucacugcaaacuccgccucccagguucac

SEQ ID NO: 200476 - RNA, 32 nt, Human
gggucacugcaaccuccgccucccggguucaa

SEQ ID NO: 200477 - RNA, 32 nt, Human
gggucacugcaaccucuaccuccaggguucaa

SEQ ID NO: 200478 - RNA, 32 nt, Human
gggucacugcaaccucugccuccuggguucaa

SEQ ID NO: 200479 - RNA, 32 nt, Human
gggucacugcaagcucugccucccaaguucau

SEQ ID NO: 200480 - RNA, 32 nt, Human
gggucacugcagcugccuggaccugcugaccg

SEQ ID NO: 200481 - RNA, 32 nt, Human
gggucacuuuaaaaacuacuagcuucaacuac

SEQ ID NO: 200482 - RNA, 32 nt, Human
gggucagaagagagggugaguccuccagaacu

SEQ ID NO: 200483 - RNA, 32 nt, Human
gggucagaagauuccugaagcugggguuggug

SEQ ID NO: 200484 - RNA, 32 nt, Human
gggucagaagcagggacuggggcaggcgagcc

SEQ ID NO: 200485 - RNA, 32 nt, Human
gggucagaccaacagccaguguccucagaugg

SEQ ID NO: 200486 - RNA, 32 nt, Human
gggucagaccaccauccggguacucuaagucc

SEQ ID NO: 200487 - RNA, 32 nt, Human
gggucagagcuagagaccuacagggaagagua

SEQ ID NO: 200488 - RNA, 31 nt, Human
gggucagaggagagagacugaauuggacuaa

SEQ ID NO: 200489 - RNA, 32 nt, Human
gggucagaggucaggaaggagaaccuggggag

SEQ ID NO: 200490 - RNA, 32 nt, Human
gggucagaugcugcugugagaggcacagagcc

SEQ ID NO: 200491 - RNA, 32 nt, Human
gggucagaugcuguggacucugggaccugcag

SEQ ID NO: 200492 - RNA, 32 nt, Human
gggucagauggagagaccucuagggagaaaga

SEQ ID NO: 200493 - RNA, 20 nt, Human
gggucagauucggcggcagg

SEQ ID NO: 200494 - RNA, 32 nt, Human
gggucagcagagcccaggaggcgacacugccc

SEQ ID NO: 200495 - RNA, 19 nt, Human
gggucagcagagcugccau

SEQ ID NO: 200496 - RNA, 32 nt, Human
gggucagcagaggggcgcucacgcucucgcca

SEQ ID NO: 200497 - RNA, 32 nt, Human
gggucagcaggcagagacagggccaaggcccc

SEQ ID NO: 200498 - RNA, 32 nt, Human
gggucagcaguggaaugaagggccuuagaacc

SEQ ID NO: 200499 - RNA, 19 nt, Human
gggucagcauggaaauuca

SEQ ID NO: 200500 - RNA, 32 nt, Human
gggucagccagagguuccuccaggcaggagcu

SEQ ID NO: 200501 - RNA, 32 nt, Human
gggucagcccaagauucuucagucuggacuau

SEQ ID NO: 200502 - RNA, 32 nt, Human
gggucagccugcugugcccacacacacccacu

SEQ ID NO: 200503 - RNA, 32 nt, Human
gggucagccuuccgggaacuggagucugucuc

SEQ ID NO: 200504 - RNA, 20 nt, Human
gggucagcucuggauucaua

SEQ ID NO: 200505 - RNA, 32 nt, Human
gggucagcucuuccuuauguuccugaaggaaa

SEQ ID NO: 200506 - RNA, 32 nt, Human
gggucaggaaggaaggagaggcuuuuccagaa

SEQ ID NO: 200507 - RNA, 32 nt, Human
gggucaggagagaaugggggaggaggcgguca

SEQ ID NO: 200508 - RNA, 32 nt, Human
gggucaggaguucgagaccacccuggacaaua

SEQ ID NO: 200509 - RNA, 32 nt, Human
gggucaggcauuggucugacuugcugugaaga

SEQ ID NO: 200510 - RNA, 32 nt, Human
gggucaggccgccagccggaggcugcaccaga

SEQ ID NO: 200511 - RNA, 22 nt, Human
gggucagggaagacugggccuc

SEQ ID NO: 200512 - RNA, 32 nt, Human
gggucagggaaggagcauggacuggggucagu

SEQ ID NO: 200513 - RNA, 20 nt, Human
gggucagggaaugagccagg

SEQ ID NO: 200514 - RNA, 22 nt, Human
gggucagggaccuccucagcag

SEQ ID NO: 200515 - RNA, 21 nt, Human
gggucagggagauugcagaag

SEQ ID NO: 200516 - RNA, 20 nt, Human
gggucagggaggaaagcugg

SEQ ID NO: 200517 - RNA, 21 nt, Human
gggucagggaggaaaggcaga

SEQ ID NO: 200518 - RNA, 23 nt, Human
gggucagggaggaaaggcagaag

SEQ ID NO: 200519 - RNA, 21 nt, Human
gggucagggaggaggaacggu

SEQ ID NO: 200520 - RNA, 32 nt, Human
gggucagggaggaggaacggugggggugggca

SEQ ID NO: 200521 - RNA, 22 nt, Human
gggucagggaggggucuagagg

SEQ ID NO: 200522 - RNA, 32 nt, Human
gggucagggagguggagacacugcugaaauca

SEQ ID NO: 200523 - RNA, 32 nt, Human
gggucagggaugagccaagggaagagagacag

SEQ ID NO: 200524 - RNA, 32 nt, Human
gggucagggccaagcccucagcaucugcuccu

SEQ ID NO: 200525 - RNA, 23 nt, Human
gggucagggcuggagggcacagg

SEQ ID NO: 200526 - RNA, 32 nt, Human
gggucagggcuggagggcacaggcagagggca

SEQ ID NO: 200527 - RNA, 19 nt, Human
gggucaggggacagcuucu

SEQ ID NO: 200528 - RNA, 32 nt, Human
gggucagggggccacagagaaggggcagcuga

SEQ ID NO: 200529 - RNA, 32 nt, Human
gggucagggguuguuucuaccugcuuugucua

SEQ ID NO: 200530 - RNA, 23 nt, Human
gggucagggugcugaggcaacag

SEQ ID NO: 200531 - RNA, 20 nt, Human
gggucaggguggggcaacag

SEQ ID NO: 200532 - RNA, 32 nt, Human
gggucagguagagugagcuggggagggaagug

SEQ ID NO: 200533 - RNA, 23 nt, Human
gggucaggugucgaaccagcagg

SEQ ID NO: 200534 - RNA, 32 nt, Human
gggucagucuccaaacuggaguuugguggcua

SEQ ID NO: 200535 - RNA, 32 nt, Human
gggucaguuaaugcuacaguuacuguauagca

SEQ ID NO: 200536 - RNA, 32 nt, Human
gggucaguuagaaccagaguauggagagucug

SEQ ID NO: 200537 - RNA, 32 nt, Human
gggucaguugaugcaaggaagggaaacaagga

SEQ ID NO: 200538 - RNA, 32 nt, Human
gggucauaaagaggaggagaaacagggugagu

SEQ ID NO: 200539 - RNA, 32 nt, Human
gggucauagggucacuucaccugacccaggcc

SEQ ID NO: 200540 - RNA, 32 nt, Human
gggucaucacccaggcucuggggcugaggagg

SEQ ID NO: 200541 - RNA, 32 nt, Human
gggucaucugacaucaggagaaucacuugaac

SEQ ID NO: 200542 - RNA, 32 nt, Human
gggucaugcacugagguccacagaccuacugc

SEQ ID NO: 200543 - RNA, 32 nt, Human
gggucauggaaauguguauuuucuccaaaccu

SEQ ID NO: 200544 - RNA, 32 nt, Human
gggucaugggcccugagcuggcccaggagacc

SEQ ID NO: 200545 - RNA, 32 nt, Human
gggucauguuuugugguuaauucccccacaua

SEQ ID NO: 200546 - RNA, 32 nt, Human
gggucauuacuuuuugcaauagcacacucaaa

SEQ ID NO: 200547 - RNA, 32 nt, Human
gggucauuguagccucaaccucccaggcucca

SEQ ID NO: 200548 - RNA, 32 nt, Human
gggucauugugcugguaaaagccucuauuacg

SEQ ID NO: 200549 - RNA, 32 nt, Human
gggucauuuggugccaaacauggaggugggca

SEQ ID NO: 200550 - RNA, 32 nt, Human
ggguccaaaaugucaaaggacucugcaugcug

SEQ ID NO: 200551 - RNA, 32 nt, Human
ggguccaaacacuccucuuccuccaggucauu

SEQ ID NO: 200552 - RNA, 32 nt, Human
ggguccaaagggcacuccugcccacgcccagg

SEQ ID NO: 200553 - RNA, 23 nt, Human
ggguccaacgaagccccaugagc

SEQ ID NO: 200554 - RNA, 25 nt, Human
ggguccaagccccagcucuuccacu

SEQ ID NO: 200555 - RNA, 32 nt, Human
ggguccacagucacucuuugugccucaguuua

SEQ ID NO: 200556 - RNA, 22 nt, Human
ggguccacauagaaaagcaaga

SEQ ID NO: 200557 - RNA, 32 nt, Human
ggguccaccaccccaaaccccuccacgaagac

SEQ ID NO: 200558 - RNA, 32 nt, Human
ggguccacguuucuccccggcuccucugggcu

SEQ ID NO: 200559 - RNA, 32 nt, Human
ggguccagaacagggaugucuaccugguaaua

SEQ ID NO: 200560 - RNA, 32 nt, Human
ggguccagaaggagggggugaccuccggccag

SEQ ID NO: 200561 - RNA, 32 nt, Human
ggguccagagagaagggagugggugggcaggg

SEQ ID NO: 200562 - RNA, 32 nt, Human
ggguccagagccuaauuuauauucacuauccu

SEQ ID NO: 200563 - RNA, 32 nt, Human
ggguccagagccucgugagaggucaccgggau

SEQ ID NO: 200564 - RNA, 32 nt, Human
ggguccagagucucacucuguugcccaggcug

SEQ ID NO: 200565 - RNA, 32 nt, Human
ggguccagaugguccaggcccucuccauggac

SEQ ID NO: 200566 - RNA, 32 nt, Human
ggguccagccuggcuagaguuagaaggcagac

SEQ ID NO: 200567 - RNA, 32 nt, Human
ggguccagcuacucaggaggccaaggugggag

SEQ ID NO: 200568 - RNA, 32 nt, Human
ggguccagcuacucgggaggcugaggcaggag

SEQ ID NO: 200569 - RNA, 32 nt, Human
ggguccagcucuguucagggugggacuccagg

SEQ ID NO: 200570 - RNA, 32 nt, Human
ggguccagcuuauccugggugcucugugauca

SEQ ID NO: 200571 - RNA, 23 nt, Human
ggguccaggagcaccucugucca

SEQ ID NO: 200572 - RNA, 32 nt, Human
ggguccaggagguggaggcugcagugagcuau

SEQ ID NO: 200573 - RNA, 32 nt, Human
ggguccaggccacccccucagccuccacagcc

SEQ ID NO: 200574 - RNA, 15 nt, Human
ggguccagggcccuc

SEQ ID NO: 200575 - RNA, 16 nt, Human
ggguccagggccucuc

SEQ ID NO: 200576 - RNA, 18 nt, Human
ggguccaggggccucuga

SEQ ID NO: 200577 - RNA, 32 nt, Human
ggguccaggguagaaaaacaauaaccaguggg

SEQ ID NO: 200578 - RNA, 32 nt, Human
ggguccaggucaccagccugacugcacacagc

SEQ ID NO: 200579 - RNA, 32 nt, Human
ggguccagucauugcugcugggcacagcgagg

SEQ ID NO: 200580 - RNA, 32 nt, Human
ggguccagugcucaguuucuaaccucacacag

SEQ ID NO: 200581 - RNA, 32 nt, Human
ggguccaguggaggaagaaggaaggagaggcu

SEQ ID NO: 200582 - RNA, 23 nt, Human
ggguccaguggcucacaccugua

SEQ ID NO: 200583 - RNA, 32 nt, Human
ggguccaucagcaguuuuucuuccugcauuua

SEQ ID NO: 200584 - RNA, 32 nt, Human
ggguccauccagggggacccucuccuuucugu

SEQ ID NO: 200585 - RNA, 32 nt, Human
ggguccaucucuaggggccuucccucccaggu

SEQ ID NO: 200586 - RNA, 32 nt, Human
ggguccauuucucuuggauguaaaggaguccu

SEQ ID NO: 200587 - RNA, 32 nt, Human
gggucccaaauacacacccgaguccugccaaa

SEQ ID NO: 200588 - RNA, 32 nt, Human
gggucccaacccccucccucugcuggaguuuc

SEQ ID NO: 200589 - RNA, 32 nt, Human
gggucccacacaggaugguccuuguaggagac

SEQ ID NO: 200590 - RNA, 32 nt, Human
gggucccaccagacuucugcccaccaggccua

SEQ ID NO: 200591 - RNA, 17 nt, Human
gggucccacccagugga

SEQ ID NO: 200592 - RNA, 32 nt, Human
gggucccacugccuguccagccuggcucccuu

SEQ ID NO: 200593 - RNA, 19 nt, Human
gggucccagaagggggcag

SEQ ID NO: 200594 - RNA, 31 nt, Human
gggucccagagaguuuggaguguaggauucc

SEQ ID NO: 200595 - RNA, 32 nt, Human
gggucccagagccugcucugugcacugacccc

SEQ ID NO: 200596 - RNA, 32 nt, Human
gggucccagccuggccaccagcuucccucugc

SEQ ID NO: 200597 - RNA, 23 nt, Human
gggucccagcgauucuccugccu

SEQ ID NO: 200598 - RNA, 32 nt, Human
gggucccagcgugcccuggccuuggcuuuucg

SEQ ID NO: 200599 - RNA, 32 nt, Human
gggucccagcuacucaggaggcugagguugga

SEQ ID NO: 200600 - RNA, 32 nt, Human
gggucccagcugugugauuaagaagucaacug

SEQ ID NO: 200601 - RNA, 32 nt, Human
gggucccagguaagcuggcaagaggaaagggc

SEQ ID NO: 200602 - RNA, 32 nt, Human
gggucccaguguucccuccacucccgaguggc

SEQ ID NO: 200603 - RNA, 32 nt, Human
gggucccauauaggugagggaagccugaaaaa

SEQ ID NO: 200604 - RNA, 23 nt, Human
gggucccauguccagcugccucu

SEQ ID NO: 200605 - RNA, 32 nt, Human
ggguccccagaccucugcucccagagcucaug

SEQ ID NO: 200606 - RNA, 32 nt, Human
ggguccccagcccaggagguggcuggauugca

SEQ ID NO: 200607 - RNA, 32 nt, Human
ggguccccaucaccugcuucacggccaucccu

SEQ ID NO: 200608 - RNA, 18 nt, Human
gggucccccaggacagua

SEQ ID NO: 200609 - RNA, 32 nt, Human
gggucccccgcggggcccucgcgugcggucac

SEQ ID NO: 200610 - RNA, 32 nt, Human
gggucccccuggggcccucuuuacugucacgu

SEQ ID NO: 200611 - RNA, 32 nt, Human
gggucccccuucccugccgucaucagguuccc

SEQ ID NO: 200612 - RNA, 24 nt, Human
gggucccccuugcugucugccucu

SEQ ID NO: 200613 - RNA, 32 nt, Human
ggguccccgagcucugcagcgagcccugggac

SEQ ID NO: 200614 - RNA, 32 nt, Human
ggguccccgggcgaacagaggcugcgguggac

SEQ ID NO: 200615 - RNA, 16 nt, Human
ggguccccgggugcag

SEQ ID NO: 200616 - RNA, 32 nt, Human
ggguccccuccagccagcucuuuggcggcagc

SEQ ID NO: 200617 - RNA, 32 nt, Human
ggguccccuccaggaaccaaggaguggcccuc

SEQ ID NO: 200618 - RNA, 32 nt, Human
ggguccccuccccagcucccuugggaaggaca

SEQ ID NO: 200619 - RNA, 32 nt, Human
ggguccccuccccuccugcugcucuggagugc

SEQ ID NO: 200620 - RNA, 32 nt, Human
ggguccccuccccucucagcauuuccuugucc

SEQ ID NO: 200621 - RNA, 32 nt, Human
ggguccccucucccucucccugcaauguccuu

SEQ ID NO: 200622 - RNA, 32 nt, Human
ggguccccugcaaccucccaucaaaggaugac

SEQ ID NO: 200623 - RNA, 22 nt, Human
ggguccccugcccaccugccuc

SEQ ID NO: 200624 - RNA, 32 nt, Human
ggguccccuugcugcugugggcucccuguccc

SEQ ID NO: 200625 - RNA, 32 nt, Human
gggucccgcagaagaaaacauggcugccaaag

SEQ ID NO: 200626 - RNA, 32 nt, Human
gggucccgcuggcuguccccuugucggccuga

SEQ ID NO: 200627 - RNA, 32 nt, Human
gggucccguccgcaccggcacccggcccagcc

SEQ ID NO: 200628 - RNA, 32 nt, Human
gggucccuagagugguccugcagcagccccug

SEQ ID NO: 200629 - RNA, 32 nt, Human
gggucccuccacccuugucuccugugcggcca

SEQ ID NO: 200630 - RNA, 32 nt, Human
gggucccucccucccuccuucccaaagcagau

SEQ ID NO: 200631 - RNA, 32 nt, Human
gggucccucuuuugggguacaaaggaaaggac

SEQ ID NO: 200632 - RNA, 32 nt, Human
gggucccugcagcgcuuccucccgcagccccc

SEQ ID NO: 200633 - RNA, 32 nt, Human
gggucccugccugguguucaccccagaagcua

SEQ ID NO: 200634 - RNA, 32 nt, Human
gggucccugcuggcauuccuucucuguacuag

SEQ ID NO: 200635 - RNA, 32 nt, Human
gggucccuggcgaggcagacgcugcgggugga

SEQ ID NO: 200636 - RNA, 32 nt, Human
gggucccugggcaacagucccuaggcuaagac

SEQ ID NO: 200637 - RNA, 32 nt, Human
gggucccuguccccacccuugugcacucacau

SEQ ID NO: 200638 - RNA, 32 nt, Human
gggucccuguccuccuauccugacuccugccc

SEQ ID NO: 200639 - RNA, 32 nt, Human
gggucccugucuuucucaacaggcagccccag

SEQ ID NO: 200640 - RNA, 32 nt, Human
gggucccuuacuagagagguugagugaauuug

SEQ ID NO: 200641 - RNA, 23 nt, Human
gggucccuuccauuucccaucca

SEQ ID NO: 200642 - RNA, 32 nt, Human
gggucccuuggacuggccuccuuguucaugac

SEQ ID NO: 200643 - RNA, 32 nt, Human
gggucccuugucugggaguggggugaagagcc

SEQ ID NO: 200644 - RNA, 32 nt, Human
gggucccuuugugagugucucagucuagaggu

SEQ ID NO: 200645 - RNA, 32 nt, Human
ggguccgaaauaaucuucuguguccuucaguu

SEQ ID NO: 200646 - RNA, 21 nt, Human
ggguccgaagcaucucaguca

SEQ ID NO: 200647 - RNA, 32 nt, Human
ggguccgaagcaucucagucacacgccuccac

SEQ ID NO: 200648 - RNA, 32 nt, Human
ggguccgagagggaagcuggcugggcuggcug

SEQ ID NO: 200649 - RNA, 24 nt, Human
ggguccgcacugcucugccuaaga

SEQ ID NO: 200650 - RNA, 25 nt, Human
ggguccgcggcugcucugccuggga

SEQ ID NO: 200651 - RNA, 25 nt, Human
ggguccggccggacggugucgggag

SEQ ID NO: 200652 - RNA, 30 nt, Human
ggguccggccucucccugccuguggccccu

SEQ ID NO: 200653 - RNA, 32 nt, Human
ggguccggccucucccugccuguggccccucc

SEQ ID NO: 200654 - RNA, 32 nt, Human
ggguccggcugacugcagagccugugugugag

SEQ ID NO: 200655 - RNA, 32 nt, Human
ggguccgggugccuucccagggguuagaggau

SEQ ID NO: 200656 - RNA, 18 nt, Human
ggguccgucugaguggga

SEQ ID NO: 200657 - RNA, 32 nt, Human
ggguccgugaagcccaggccaggcagccaaau

SEQ ID NO: 200658 - RNA, 32 nt, Human
ggguccgugcuuugccucccccggcuccgagg

SEQ ID NO: 200659 - RNA, 32 nt, Human
ggguccuaauggcagcagaaccacugacagag

SEQ ID NO: 200660 - RNA, 32 nt, Human
ggguccuaauuuuccuccugucuaacuggagg

SEQ ID NO: 200661 - RNA, 32 nt, Human
ggguccuagccaccggugucuccuucuacauc

SEQ ID NO: 200662 - RNA, 32 nt, Human
ggguccuagcccagugcuucuccaacacugaa

SEQ ID NO: 200663 - RNA, 32 nt, Human
ggguccucagcccuccugccugggcuauggcu

SEQ ID NO: 200664 - RNA, 32 nt, Human
ggguccucaguggauguaggcugggcgccgcg

SEQ ID NO: 200665 - RNA, 32 nt, Human
ggguccucccacccucucuccucccaccccac

SEQ ID NO: 200666 - RNA, 32 nt, Human
ggguccuccugagucccguagccucauuucuu

SEQ ID NO: 200667 - RNA, 32 nt, Human
ggguccucgggcaugaacgcgagcccaaagug

SEQ ID NO: 200668 - RNA, 32 nt, Human
ggguccucucuaucuagcuccagccucucgcc

SEQ ID NO: 200669 - RNA, 32 nt, Human
ggguccucugcccucugcaggugaccucauca

SEQ ID NO: 200670 - RNA, 32 nt, Human
ggguccucuugguucugccugcagccugccug

SEQ ID NO: 200671 - RNA, 32 nt, Human
ggguccugaauccacucuccuaucaccuuugg

SEQ ID NO: 200672 - RNA, 16 nt, Human
ggguccugaccugggg

SEQ ID NO: 200673 - RNA, 32 nt, Human
ggguccugagcaccugcuucaugaaggaagau

SEQ ID NO: 200674 - RNA, 32 nt, Human
ggguccugagggagagcugcagugagaaguug

SEQ ID NO: 200675 - RNA, 32 nt, Human
ggguccugagucuccagagcucggugaggcgu

SEQ ID NO: 200676 - RNA, 32 nt, Human
ggguccugaugccucuguuuccaaacaaggua

SEQ ID NO: 200677 - RNA, 32 nt, Human
ggguccugcagccucaauagccuggagagcaa

SEQ ID NO: 200678 - RNA, 32 nt, Human
ggguccugccaguuccaggagggccaugucug

SEQ ID NO: 200679 - RNA, 32 nt, Human
ggguccugcccgaggucuccauccucgguuuc

SEQ ID NO: 200680 - RNA, 32 nt, Human
ggguccugcucaccaucuguaccccuggcuug

SEQ ID NO: 200681 - RNA, 32 nt, Human
ggguccugcugugccaucucccugugcgccug

SEQ ID NO: 200682 - RNA, 32 nt, Human
ggguccuggagucccgccgccugcugcccggc

SEQ ID NO: 200683 - RNA, 32 nt, Human
ggguccuggcgcggggaagggguggaagggug

SEQ ID NO: 200684 - RNA, 32 nt, Human
ggguccugggagguggucgcccugcagugcaa

SEQ ID NO: 200685 - RNA, 32 nt, Human
ggguccugggcccggugaccgcaggccucagc

SEQ ID NO: 200686 - RNA, 32 nt, Human
ggguccugggcugggauagcucaacaggaagu

SEQ ID NO: 200687 - RNA, 21 nt, Human
ggguccuggggcaccugccuu

SEQ ID NO: 200688 - RNA, 32 nt, Human
ggguccuggguccuagaccaggacuuccugug

SEQ ID NO: 200689 - RNA, 22 nt, Human
ggguccugugagcgccgccucu

SEQ ID NO: 200690 - RNA, 25 nt, Human
ggguccugugcuggcuccugccccu

SEQ ID NO: 200691 - RNA, 32 nt, Human
ggguccugugugucgugcauuguugauagauu

SEQ ID NO: 200692 - RNA, 32 nt, Human
ggguccuucaaguuagcucaggaggcuuggaa

SEQ ID NO: 200693 - RNA, 30 nt, Human
ggguccuucaggccaccuccccaaugagcc

SEQ ID NO: 200694 - RNA, 32 nt, Human
ggguccuugcccagucagauggugugccaguc

SEQ ID NO: 200695 - RNA, 32 nt, Human
ggguccuugcgcgccgcggcucagggaggagc

SEQ ID NO: 200696 - RNA, 32 nt, Human
ggguccuuggagaaguggaggugugcauggug

SEQ ID NO: 200697 - RNA, 32 nt, Human
ggguccuuggcaggccugagggccagugggga

SEQ ID NO: 200698 - RNA, 32 nt, Human
ggguccuuggucccaucuaccuccucuucauc

SEQ ID NO: 200699 - RNA, 32 nt, Human
ggguccuugucccaucugccuuuggcagaggg

SEQ ID NO: 200700 - RNA, 32 nt, Human
ggguccuugugagcuccuuaucuguaggaugu

SEQ ID NO: 200701 - RNA, 32 nt, Human
ggguccuugugccaguccuccccuuuuugugu

SEQ ID NO: 200702 - RNA, 32 nt, Human
ggguccuugugucccugccgcugaagaauggg

SEQ ID NO: 200703 - RNA, 24 nt, Human
ggguccuuuucccacucuuccacu

SEQ ID NO: 200704 - RNA, 32 nt, Human
gggucgaaggccagugcuccaggccuucuuca

SEQ ID NO: 200705 - RNA, 32 nt, Human
gggucgaccccauacagagaacucagcuugaa

SEQ ID NO: 200706 - RNA, 24 nt, Human
gggucgagcgccugagauccuguu

SEQ ID NO: 200707 - RNA, 32 nt, Human
gggucgaggcugcuuccguuuccaucccggac

SEQ ID NO: 200708 - RNA, 32 nt, Human
gggucgagugcggcucaagccuguaaucccag

SEQ ID NO: 200709 - RNA, 32 nt, Human
gggucgaucacugaggucaggaguucgagacu

SEQ ID NO: 200710 - RNA, 32 nt, Human
gggucgaugggugcuccucucccugcaggcug

SEQ ID NO: 200711 - RNA, 20 nt, Human
gggucgcaccgggcuagcug

SEQ ID NO: 200712 - RNA, 18 nt, Human
gggucgcagcccaggccc

SEQ ID NO: 200713 - RNA, 21 nt, Human
gggucgcagcgagcucugccu

SEQ ID NO: 200714 - RNA, 32 nt, Human
gggucgccacuccucugcuacacagcacggcu

SEQ ID NO: 200715 - RNA, 32 nt, Human
gggucgccacugcacccagccugugucuucca

SEQ ID NO: 200716 - RNA, 18 nt, Human
gggucgccccgccggcgc

SEQ ID NO: 200717 - RNA, 32 nt, Human
gggucgcgcggcugugugugaggagugagccu

SEQ ID NO: 200718 - RNA, 18 nt, Human
gggucgcggaggaggcag

SEQ ID NO: 200719 - RNA, 32 nt, Human
gggucgcucuccgcuguuuccucugccaccau

SEQ ID NO: 200720 - RNA, 32 nt, Human
gggucgcugcagccucaaccuccugggcucaa

SEQ ID NO: 200721 - RNA, 32 nt, Human
gggucggauucugccaguuucugcucugcagc

SEQ ID NO: 200722 - RNA, 32 nt, Human
gggucggccgcaauccagccugggcggagccg

SEQ ID NO: 200723 - RNA, 32 nt, Human
gggucggccucuuccuccugaucagcuccaga

SEQ ID NO: 200724 - RNA, 32 nt, Human
gggucggcucgugcucaucauccugugcuccg

SEQ ID NO: 200725 - RNA, 32 nt, Human
gggucgggagggagguauauugggaggagggu

SEQ ID NO: 200726 - RNA, 32 nt, Human
gggucgggaguggugagggaaggguggcgcau

SEQ ID NO: 200727 - RNA, 19 nt, Human
gggucgggcgcggaggcuc

SEQ ID NO: 200728 - RNA, 32 nt, Human
gggucgggcugggccagcugggguagagcgga

SEQ ID NO: 200729 - RNA, 32 nt, Human
gggucggggacugaggcaguagagggaggcga

SEQ ID NO: 200730 - RNA, 32 nt, Human
gggucggggcggaucagcuuucccugggcaca

SEQ ID NO: 200731 - RNA, 32 nt, Human
gggucggggucugaggcuugggcgcugccugg

SEQ ID NO: 200732 - RNA, 23 nt, Human
gggucggguaggaccccuacugg

SEQ ID NO: 200733 - RNA, 32 nt, Human
gggucggucaucuauuucccagacacaggaaa

SEQ ID NO: 200734 - RNA, 19 nt, Human
gggucguccucccccagca

SEQ ID NO: 200735 - RNA, 32 nt, Human
gggucgucuaagugagaggaaaagggagaggg

SEQ ID NO: 200736 - RNA, 22 nt, Human
gggucgucuggccugcuugcug

SEQ ID NO: 200737 - RNA, 19 nt, Human
gggucgugcgggcugacug

SEQ ID NO: 200738 - RNA, 18 nt, Human
gggucguggcucagguca

SEQ ID NO: 200739 - RNA, 32 nt, Human
gggucgugugugagacgcaugugcuccacccc

SEQ ID NO: 200740 - RNA, 32 nt, Human
gggucuacaggcacaacugcugccucacaaca

SEQ ID NO: 200741 - RNA, 32 nt, Human
gggucuaccuuccugaaucauuuuuaggaguc

SEQ ID NO: 200742 - RNA, 32 nt, Human
gggucuagaggaaugaguguccaggcagaguu

SEQ ID NO: 200743 - RNA, 32 nt, Human
gggucuaggcagcaguggauggugcaggggaa

SEQ ID NO: 200744 - RNA, 32 nt, Human
gggucuaugaguagcuguguaugaauaaauau

SEQ ID NO: 200745 - RNA, 22 nt, Human
gggucucaaccccuccccacca

SEQ ID NO: 200746 - RNA, 32 nt, Human
gggucucaccauguuguccagccuggucucaa

SEQ ID NO: 200747 - RNA, 32 nt, Human
gggucucaccugucaguuguuugcugaguuua

SEQ ID NO: 200748 - RNA, 32 nt, Human
gggucucaccugucgcuggagugcaguggugu

SEQ ID NO: 200749 - RNA, 32 nt, Human
gggucucacugucacccagucuggaguggagu

SEQ ID NO: 200750 - RNA, 24 nt, Human
gggucucagagcgagagcugcgga

SEQ ID NO: 200751 - RNA, 32 nt, Human
gggucucaggcuggcgauucaccccgucuccg

SEQ ID NO: 200752 - RNA, 32 nt, Human
gggucucagggaccuguguccuuccgccucca

SEQ ID NO: 200753 - RNA, 19 nt, Human
gggucucagggcccuggga

SEQ ID NO: 200754 - RNA, 32 nt, Human
gggucucaggggugccuggugaauucugcacu

SEQ ID NO: 200755 - RNA, 32 nt, Human
gggucucagguaugaguggcagagggagcagu

SEQ ID NO: 200756 - RNA, 32 nt, Human
gggucucaguuucuucaucugggaaaugggga

SEQ ID NO: 200757 - RNA, 32 nt, Human
gggucucaguuuuccccaucuggacccuugcg

SEQ ID NO: 200758 - RNA, 19 nt, Human
gggucuccacaagaggggc

SEQ ID NO: 200759 - RNA, 32 nt, Human
gggucuccacgaggacagaggcugcuuuggac

SEQ ID NO: 200760 - RNA, 32 nt, Human
gggucuccauggugggggucucucaccuucuu

SEQ ID NO: 200761 - RNA, 32 nt, Human
gggucucccagagugaacuuggugcucuaagu

SEQ ID NO: 200762 - RNA, 21 nt, Human
gggucuccccucaccccugca

SEQ ID NO: 200763 - RNA, 32 nt, Human
gggucucccgcuuccuccuccugcuccaaggg

SEQ ID NO: 200764 - RNA, 22 nt, Human
gggucucccucagggccgggag

SEQ ID NO: 200765 - RNA, 32 nt, Human
gggucucccucccucacuucugcccuuucccu

SEQ ID NO: 200766 - RNA, 18 nt, Human
gggucucccucuguugcc

SEQ ID NO: 200767 - RNA, 32 nt, Human
gggucucccuggcaauggccacagccuccagg

SEQ ID NO: 200768 - RNA, 32 nt, Human
gggucuccgccgcucgggacccggcuaggcgg

SEQ ID NO: 200769 - RNA, 32 nt, Human
gggucuccgggggagggcagaggcuuugcccu

SEQ ID NO: 200770 - RNA, 32 nt, Human
gggucuccuccccucaugucucccaggggguc

SEQ ID NO: 200771 - RNA, 32 nt, Human
gggucuccuccuccucguuugcugccuccucc

SEQ ID NO: 200772 - RNA, 32 nt, Human
gggucuccuccuccucuuccuucaucgcuucu

SEQ ID NO: 200773 - RNA, 32 nt, Human
gggucuccucuccccagccagaaaccccaaag

SEQ ID NO: 200774 - RNA, 32 nt, Human
gggucuccugcugggguccugaugccucuguu

SEQ ID NO: 200775 - RNA, 32 nt, Human
gggucuccuggaccuugacagagcagcuaacu

SEQ ID NO: 200776 - RNA, 32 nt, Human
gggucuccuggguaagggaagcaagagcagac

SEQ ID NO: 200777 - RNA, 22 nt, Human
gggucucgacccuggaccuccu

SEQ ID NO: 200778 - RNA, 32 nt, Human
gggucucgcuuugucaccuaagcuggagugca

SEQ ID NO: 200779 - RNA, 21 nt, Human
gggucucggcuugccaggaag

SEQ ID NO: 200780 - RNA, 23 nt, Human
gggucucggggcgggcgccgcgg

SEQ ID NO: 200781 - RNA, 20 nt, Human
gggucucggggcucuggaga

SEQ ID NO: 200782 - RNA, 32 nt, Human
gggucucuaccuggucuccaucaacagagcca

SEQ ID NO: 200783 - RNA, 32 nt, Human
gggucucucaaagacacagguccuguccccug

SEQ ID NO: 200784 - RNA, 32 nt, Human
gggucucucaccuucuugacccucucuccauc

SEQ ID NO: 200785 - RNA, 21 nt, Human
gggucucuccucucccuugca

SEQ ID NO: 200786 - RNA, 32 nt, Human
gggucucucuccuagcugcuacccaggaccuc

SEQ ID NO: 200787 - RNA, 21 nt, Human
gggucucuggggggcuggaga

SEQ ID NO: 200788 - RNA, 32 nt, Human
gggucucugucacccaggcuggagugcagugc

SEQ ID NO: 200789 - RNA, 32 nt, Human
gggucucugucgcccaggcuggggugcagugg

SEQ ID NO: 200790 - RNA, 22 nt, Human
gggucucuuauccaucccugca

SEQ ID NO: 200791 - RNA, 32 nt, Human
gggucucuucacuuugaugagugacaugaaca

SEQ ID NO: 200792 - RNA, 32 nt, Human
gggucucuucuaccugcauucuaaaacauuca

SEQ ID NO: 200793 - RNA, 32 nt, Human
gggucugaaagcucgcuugagaauaggaaacu

SEQ ID NO: 200794 - RNA, 32 nt, Human
gggucugacaguaacagaaaccucagcacugg

SEQ ID NO: 200795 - RNA, 31 nt, Human
gggucugagcaccucccucaugcagacagag

SEQ ID NO: 200796 - RNA, 32 nt, Human
gggucugagccaagccccucgacuccucacug

SEQ ID NO: 200797 - RNA, 32 nt, Human
gggucugagccccagcugaagggacugagccu

SEQ ID NO: 200798 - RNA, 31 nt, Human
gggucugaggagagagaauggccagagagug

SEQ ID NO: 200799 - RNA, 19 nt, Human
gggucugaggccugggaga

SEQ ID NO: 200800 - RNA, 32 nt, Human
gggucugaggggagagaagcacaccaggggcg

SEQ ID NO: 200801 - RNA, 32 nt, Human
gggucugaggggcaggggaggcccauaucuug

SEQ ID NO: 200802 - RNA, 32 nt, Human
gggucugagucaucuccuccuagaguggguca

SEQ ID NO: 200803 - RNA, 32 nt, Human
gggucugcaacuuuggaaaacuccucuucaca

SEQ ID NO: 200804 - RNA, 32 nt, Human
gggucugcaagugccccucagcaggaacagcu

SEQ ID NO: 200805 - RNA, 32 nt, Human
gggucugcacuccuugcugucuucccagcacc

SEQ ID NO: 200806 - RNA, 32 nt, Human
gggucugcagugagcuaucuaugauggcacca

SEQ ID NO: 200807 - RNA, 32 nt, Human
gggucugcaucacugccaucagaaagguuacu

SEQ ID NO: 200808 - RNA, 32 nt, Human
gggucugccccaggacuccuggguggaccucc

SEQ ID NO: 200809 - RNA, 21 nt, Human
gggucugccccucccuucuca

SEQ ID NO: 200810 - RNA, 32 nt, Human
gggucugccucucccagcccacugacucaaau

SEQ ID NO: 200811 - RNA, 25 nt, Human
gggucugccugguccuugagccccu

SEQ ID NO: 200812 - RNA, 32 nt, Human
gggucugcggggacacagggaaggcggacggc

SEQ ID NO: 200813 - RNA, 32 nt, Human
gggucugcuaccugccgggauaagguggccca

SEQ ID NO: 200814 - RNA, 32 nt, Human
gggucugcucaccccaacacaugccuucccuc

SEQ ID NO: 200815 - RNA, 32 nt, Human
gggucugcuccugggaauggggugggagccac

SEQ ID NO: 200816 - RNA, 32 nt, Human
gggucugcucuaagcugcagcaagagaaacug

SEQ ID NO: 200817 - RNA, 32 nt, Human
gggucugcugccccagccuggcagcaggaacc

SEQ ID NO: 200818 - RNA, 32 nt, Human
gggucugcuuaacugccaagagcagguccugg

SEQ ID NO: 200819 - RNA, 32 nt, Human
gggucugcuuggagaggccaaaauucagggug

SEQ ID NO: 200820 - RNA, 32 nt, Human
gggucuggaacaccaggcugagguccugauca

SEQ ID NO: 200821 - RNA, 32 nt, Human
gggucuggaagggccuucucuccaagcuggga

SEQ ID NO: 200822 - RNA, 32 nt, Human
gggucuggaggaggggacaugaggugagaggu

SEQ ID NO: 200823 - RNA, 32 nt, Human
gggucuggcacccugcagcccagguccccacu

SEQ ID NO: 200824 - RNA, 32 nt, Human
gggucuggcggacgcgucccaccccaggcucu

SEQ ID NO: 200825 - RNA, 32 nt, Human
gggucuggcuugcccaggcuggagugcggugg

SEQ ID NO: 200826 - RNA, 32 nt, Human
gggucuggcuugcccccucccugggccuccau

SEQ ID NO: 200827 - RNA, 32 nt, Human
gggucugggaccccgcucagcauggcugcagg

SEQ ID NO: 200828 - RNA, 32 nt, Human
gggucugggacgcaguugggagugcaaagggc

SEQ ID NO: 200829 - RNA, 24 nt, Human
gggucugggcagcaccucugguca

SEQ ID NO: 200830 - RNA, 32 nt, Human
gggucugggcagggcaguagaggucagaaggg

SEQ ID NO: 200831 - RNA, 21 nt, Human
gggucugggcagggcugggca

SEQ ID NO: 200832 - RNA, 32 nt, Human
gggucugggcagucccuccucuccccaguguc

SEQ ID NO: 200833 - RNA, 32 nt, Human
gggucugggcccacccuucacaacugccuuuc

SEQ ID NO: 200834 - RNA, 32 nt, Human
gggucuggggcaucccuggagcucagaagcca

SEQ ID NO: 200835 - RNA, 32 nt, Human
gggucugggggccccgcugggguggaggccca

SEQ ID NO: 200836 - RNA, 18 nt, Human
gggucugggggccucuga

SEQ ID NO: 200837 - RNA, 32 nt, Human
gggucuggggugcagcccugccagcaucaaga

SEQ ID NO: 200838 - RNA, 32 nt, Human
gggucuggucccacgccgccucugcucagacc

SEQ ID NO: 200839 - RNA, 32 nt, Human
gggucugguccuggggaagguuugggggcggg

SEQ ID NO: 200840 - RNA, 23 nt, Human
gggucugguggcucaugccugua

SEQ ID NO: 200841 - RNA, 32 nt, Human
gggucugguggggacugaauucccuggcccug

SEQ ID NO: 200842 - RNA, 32 nt, Human
gggucugucaguggcaggaggccgugcugugu

SEQ ID NO: 200843 - RNA, 32 nt, Human
gggucugucuuccuuaucaucgggguggcagc

SEQ ID NO: 200844 - RNA, 32 nt, Human
gggucugugaaucugggcucucccuccaugcu

SEQ ID NO: 200845 - RNA, 32 nt, Human
gggucugugcugcuguuacuguuaaccauuua

SEQ ID NO: 200846 - RNA, 18 nt, Human
gggucuguggcugggagg

SEQ ID NO: 200847 - RNA, 32 nt, Human
gggucuguggguggugauggaggagggacuca

SEQ ID NO: 200848 - RNA, 32 nt, Human
gggucuguggguuccaaaguccuggccaccug

SEQ ID NO: 200849 - RNA, 32 nt, Human
gggucuguuccuucuugagccugccugcaggg

SEQ ID NO: 200850 - RNA, 32 nt, Human
gggucuguugccuaggcgggagugcaguggca

SEQ ID NO: 200851 - RNA, 32 nt, Human
gggucuguuucucagcaucauggaugcagggg

SEQ ID NO: 200852 - RNA, 25 nt, Human
gggucuuaggagguauggucggaga

SEQ ID NO: 200853 - RNA, 32 nt, Human
gggucuucaaccuguggcgacaggaggcaggg

SEQ ID NO: 200854 - RNA, 32 nt, Human
gggucuucauuuucucuuauuuuguuuucucu

SEQ ID NO: 200855 - RNA, 32 nt, Human
gggucuucccgguaccggcaggccgcggcggg

SEQ ID NO: 200856 - RNA, 32 nt, Human
gggucuuccguguuagacagugucacauaaua

SEQ ID NO: 200857 - RNA, 32 nt, Human
gggucuuccucuuccccucuuuaccauccccc

SEQ ID NO: 200858 - RNA, 32 nt, Human
gggucuuccugguccccaccuccuggggccga

SEQ ID NO: 200859 - RNA, 32 nt, Human
gggucuuccugucacccaggcuggaguacagu

SEQ ID NO: 200860 - RNA, 32 nt, Human
gggucuucgaaacccucuccccacagccccuc

SEQ ID NO: 200861 - RNA, 23 nt, Human
gggucuucuacucccucccugca

SEQ ID NO: 200862 - RNA, 32 nt, Human
gggucuucuguggaagaugcagaaggaggaag

SEQ ID NO: 200863 - RNA, 32 nt, Human
gggucuugacuggagugcaguggugcgaucgu

SEQ ID NO: 200864 - RNA, 16 nt, Human
gggucuugagcccagg

SEQ ID NO: 200865 - RNA, 32 nt, Human
gggucuugaugagcuuccggguuuauggauuc

SEQ ID NO: 200866 - RNA, 32 nt, Human
gggucuugaugaggacagaaguuuagaguagg

SEQ ID NO: 200867 - RNA, 32 nt, Human
gggucuugcaagcagccuccugggcagucgua

SEQ ID NO: 200868 - RNA, 32 nt, Human
gggucuugccuuuucaauuccuguguuuuggu

SEQ ID NO: 200869 - RNA, 32 nt, Human
gggucuugcuucuguggcccaggcuggagugc

SEQ ID NO: 200870 - RNA, 32 nt, Human
gggucuuggagaggaaggacuuagggaggcag

SEQ ID NO: 200871 - RNA, 32 nt, Human
gggucuuggccuggaaccuuccagagaggagg

SEQ ID NO: 200872 - RNA, 29 nt, Human
gggucuuggcugcugccuuacuucccaga

SEQ ID NO: 200873 - RNA, 32 nt, Human
gggucuuggcugcugccuuacuucccagaggc

SEQ ID NO: 200874 - RNA, 32 nt, Human
gggucuugggacacccuccaguaccuggcuca

SEQ ID NO: 200875 - RNA, 32 nt, Human
gggucuugguccaccuuccagcacaaggagcu

SEQ ID NO: 200876 - RNA, 32 nt, Human
gggucuugguguccuaguaaagaauguucacg

SEQ ID NO: 200877 - RNA, 20 nt, Human
gggucuuguacauacuguaa

SEQ ID NO: 200878 - RNA, 32 nt, Human
gggucuuguccaccauucccaggacucugcca

SEQ ID NO: 200879 - RNA, 32 nt, Human
gggucuuucacccaggcuggagugcagugcug

SEQ ID NO: 200880 - RNA, 32 nt, Human
gggucuuucaggaagagacaccagccugucuc

SEQ ID NO: 200881 - RNA, 32 nt, Human
gggucuuucuaccuagucaugagggcagggau

SEQ ID NO: 200882 - RNA, 32 nt, Human
gggucuuugaacacaccucucuccuuuccuuu

SEQ ID NO: 200883 - RNA, 32 nt, Human
gggucuuugcacauccugcucuuuccgccugg

SEQ ID NO: 200884 - RNA, 32 nt, Human
gggucuuugcccacucuuguuucgcuuuggag

SEQ ID NO: 200885 - RNA, 32 nt, Human
gggucuuugcccucucccuuguggcuccuguc

SEQ ID NO: 200886 - RNA, 32 nt, Human
gggucuuugcuuccccagccagccucuccuca

SEQ ID NO: 200887 - RNA, 32 nt, Human
gggugaaaacucagaagaaagcucagaguuga

SEQ ID NO: 200888 - RNA, 32 nt, Human
gggugaaaaguauggcagugggagacuaagau

SEQ ID NO: 200889 - RNA, 32 nt, Human
gggugaaaccucccauuggccaaaggacacgg

SEQ ID NO: 200890 - RNA, 32 nt, Human
gggugaaaucuucuccccaugacuauguuuuc

SEQ ID NO: 200891 - RNA, 32 nt, Human
gggugaacacacaggcuggcugcucugggcag

SEQ ID NO: 200892 - RNA, 32 nt, Human
gggugaacagaaugggcggcugugcugggagu

SEQ ID NO: 200893 - RNA, 32 nt, Human
gggugaacaggaaaugccuuguggaaacagga

SEQ ID NO: 200894 - RNA, 32 nt, Human
gggugaacaucuuuccaguaaccagguagucc

SEQ ID NO: 200895 - RNA, 32 nt, Human
gggugaacugaggggaguagagggagagggca

SEQ ID NO: 200896 - RNA, 32 nt, Human
gggugaacugauugaggaagggucuauugucu

SEQ ID NO: 200897 - RNA, 32 nt, Human
gggugaagcauuauggucuaaugauucaaaug

SEQ ID NO: 200898 - RNA, 20 nt, Human
gggugaagccagagguggcu

SEQ ID NO: 200899 - RNA, 32 nt, Human
gggugaagccagggagggagacaggagggcag

SEQ ID NO: 200900 - RNA, 23 nt, Human
gggugaagccaucccaaggcuga

SEQ ID NO: 200901 - RNA, 32 nt, Human
gggugaaggagaggacugaugagaagggcuug

SEQ ID NO: 200902 - RNA, 24 nt, Human
gggugaaggagugagacccugucu

SEQ ID NO: 200903 - RNA, 32 nt, Human
gggugaaggcaaggaacaaccaccuggccucc

SEQ ID NO: 200904 - RNA, 32 nt, Human
gggugaaggcccagagaccagcagaacggcau

SEQ ID NO: 200905 - RNA, 32 nt, Human
gggugaagggcacggguccuuguuuuuggguu

SEQ ID NO: 200906 - RNA, 32 nt, Human
gggugaaguaaaauaguaugaacaauuaagag

SEQ ID NO: 200907 - RNA, 32 nt, Human
gggugaagucgcagcuucacuuacaccagcug

SEQ ID NO: 200908 - RNA, 32 nt, Human
gggugaaguuggcaggggagagcuugacacuu

SEQ ID NO: 200909 - RNA, 32 nt, Human
gggugaauggaaugagcuggagcuugaacaaa

SEQ ID NO: 200910 - RNA, 32 nt, Human
gggugaauguggagagcacauggccaugucuu

SEQ ID NO: 200911 - RNA, 32 nt, Human
gggugaauguucauaugcucccaauucacguu

SEQ ID NO: 200912 - RNA, 32 nt, Human
gggugaauguugcucccuucgauacacagaug

SEQ ID NO: 200913 - RNA, 24 nt, Human
gggugacaaagcaagacccugucu

SEQ ID NO: 200914 - RNA, 24 nt, Human
gggugacaaagcaagacuccaucu

SEQ ID NO: 200915 - RNA, 24 nt, Human
gggugacaaagcaagacugugucu

SEQ ID NO: 200916 - RNA, 24 nt, Human
gggugacaaagcaagauucugucu

SEQ ID NO: 200917 - RNA, 30 nt, Human
gggugacaaagcaagauucugucucgaaac

SEQ ID NO: 200918 - RNA, 24 nt, Human
gggugacaaaguaagacccugccu

SEQ ID NO: 200919 - RNA, 24 nt, Human
gggugacaaaguaagacccugucu

SEQ ID NO: 200920 - RNA, 24 nt, Human
gggugacaaagucagacuccaucu

SEQ ID NO: 200921 - RNA, 23 nt, Human
gggugacaaagugagacccuguc

SEQ ID NO: 200922 - RNA, 24 nt, Human
gggugacaaagugagacccugucu

SEQ ID NO: 200923 - RNA, 24 nt, Human
gggugacaaagugagacuccaucu

SEQ ID NO: 200924 - RNA, 22 nt, Human
gggugacaaagugagacucccu

SEQ ID NO: 200925 - RNA, 23 nt, Human
gggugacaaagugagacuccguc

SEQ ID NO: 200926 - RNA, 24 nt, Human
gggugacaaagugagacucuaucu

SEQ ID NO: 200927 - RNA, 25 nt, Human
gggugacaagaauaaaggcucugcc

SEQ ID NO: 200928 - RNA, 21 nt, Human
gggugacaagaguaucuaccu

SEQ ID NO: 200929 - RNA, 25 nt, Human
gggugacaagagugagaccccgucu

SEQ ID NO: 200930 - RNA, 25 nt, Human
gggugacaagagugagacuccgucu

SEQ ID NO: 200931 - RNA, 32 nt, Human
gggugacaaguaccuucugccuccuccauucu

SEQ ID NO: 200932 - RNA, 32 nt, Human
gggugacaaguggucaaggagcuguggccaca

SEQ ID NO: 200933 - RNA, 32 nt, Human
gggugacaaugcacacaugcugggcaaaaggg

SEQ ID NO: 200934 - RNA, 32 nt, Human
gggugacacagcaagaccccaucuccacaaac

SEQ ID NO: 200935 - RNA, 24 nt, Human
gggugacacagcaagacuccaucu

SEQ ID NO: 200936 - RNA, 24 nt, Human
gggugacacagcgagacuccgucu

SEQ ID NO: 200937 - RNA, 23 nt, Human
gggugacacagugagacccuguc

SEQ ID NO: 200938 - RNA, 24 nt, Human
gggugacagaacaagacucugucu

SEQ ID NO: 200939 - RNA, 22 nt, Human
gggugacagaacaagacugucu

SEQ ID NO: 200940 - RNA, 24 nt, Human
gggugacagaaccagacccugucu

SEQ ID NO: 200941 - RNA, 24 nt, Human
gggugacagaacgagacuccaccu

SEQ ID NO: 200942 - RNA, 24 nt, Human
gggugacagaacgagacuccgucu

SEQ ID NO: 200943 - RNA, 24 nt, Human
gggugacagaacgagacucugucu

SEQ ID NO: 200944 - RNA, 24 nt, Human
gggugacagaaggaggcucugccu

SEQ ID NO: 200945 - RNA, 32 nt, Human
gggugacagaagugggacaggagaaguuuucc

SEQ ID NO: 200946 - RNA, 24 nt, Human
gggugacagaauaagaccccgucu

SEQ ID NO: 200947 - RNA, 23 nt, Human
gggugacagaauaagacccucuu

SEQ ID NO: 200948 - RNA, 24 nt, Human
gggugacagaaugagaccccgucu

SEQ ID NO: 200949 - RNA, 22 nt, Human
gggugacagaaugagaccccug

SEQ ID NO: 200950 - RNA, 24 nt, Human
gggugacagaaugagacccuguuu

SEQ ID NO: 200951 - RNA, 22 nt, Human
gggugacagaaugagacucugu

SEQ ID NO: 200952 - RNA, 24 nt, Human
gggugacagaaugugacucugucu

SEQ ID NO: 200953 - RNA, 24 nt, Human
gggugacagaccgagacccugucu

SEQ ID NO: 200954 - RNA, 24 nt, Human
gggugacagaccgagacucugucu

SEQ ID NO: 200955 - RNA, 24 nt, Human
gggugacagacuaagacuccgucu

SEQ ID NO: 200956 - RNA, 24 nt, Human
gggugacagagaaagacccugucu

SEQ ID NO: 200957 - RNA, 24 nt, Human
gggugacagagaaggacuccgucu

SEQ ID NO: 200958 - RNA, 28 nt, Human
gggugacagagacagugagacucugucu

SEQ ID NO: 200959 - RNA, 24 nt, Human
gggugacagagagagacccugucu

SEQ ID NO: 200960 - RNA, 24 nt, Human
gggugacagagagagacuccgucu

SEQ ID NO: 200961 - RNA, 24 nt, Human
gggugacagagagauacccugucu

SEQ ID NO: 200962 - RNA, 24 nt, Human
gggugacagagcaaaacugugucu

SEQ ID NO: 200963 - RNA, 23 nt, Human
gggugacagagcaagaccccguc

SEQ ID NO: 200964 - RNA, 22 nt, Human
gggugacagagcaagacccugu

SEQ ID NO: 200965 - RNA, 24 nt, Human
gggugacagagcaagacccugucu

SEQ ID NO: 200966 - RNA, 24 nt, Human
gggugacagagcaagacccuguuu

SEQ ID NO: 200967 - RNA, 22 nt, Human
gggugacagagcaagaccuucu

SEQ ID NO: 200968 - RNA, 24 nt, Human
gggugacagagcaagacuacaucu

SEQ ID NO: 200969 - RNA, 24 nt, Human
gggugacagagcaagacuccaucu

SEQ ID NO: 200970 - RNA, 24 nt, Human
gggugacagagcaagacuccgccu

SEQ ID NO: 200971 - RNA, 23 nt, Human
gggugacagagcaagacuccguc

SEQ ID NO: 200972 - RNA, 24 nt, Human
gggugacagagcaagacuccgucu

SEQ ID NO: 200973 - RNA, 20 nt, Human
gggugacagagcaagacucu

SEQ ID NO: 200974 - RNA, 24 nt, Human
gggugacagagcaagacucugccu

SEQ ID NO: 200975 - RNA, 24 nt, Human
gggugacagagcaagacucugucu

SEQ ID NO: 200976 - RNA, 24 nt, Human
gggugacagagcaagacugcguuu

SEQ ID NO: 200977 - RNA, 24 nt, Human
gggugacagagcaagacugugucu

SEQ ID NO: 200978 - RNA, 22 nt, Human
gggugacagagcaagacuuccu

SEQ ID NO: 200979 - RNA, 24 nt, Human
gggugacagagcaagacuuggucu

SEQ ID NO: 200980 - RNA, 21 nt, Human
gggugacagagcaagagucug

SEQ ID NO: 200981 - RNA, 24 nt, Human
gggugacagagcaagaucuugucu

SEQ ID NO: 200982 - RNA, 22 nt, Human
gggugacagagcaagauuccgu

SEQ ID NO: 200983 - RNA, 24 nt, Human
gggugacagagcaagauuccgucu

SEQ ID NO: 200984 - RNA, 28 nt, Human
gggugacagagcaagugagacccugucu

SEQ ID NO: 200985 - RNA, 24 nt, Human
gggugacagagcaauacccugucu

SEQ ID NO: 200986 - RNA, 24 nt, Human
gggugacagagcaggacccugucu

SEQ ID NO: 200987 - RNA, 22 nt, Human
gggugacagagccacuccgucu

SEQ ID NO: 200988 - RNA, 24 nt, Human
gggugacagagccagacuccaucu

SEQ ID NO: 200989 - RNA, 24 nt, Human
gggugacagagccagacuccgucu

SEQ ID NO: 200990 - RNA, 24 nt, Human
gggugacagagccagacucugucu

SEQ ID NO: 200991 - RNA, 24 nt, Human
gggugacagagcgaaacuccaucu

SEQ ID NO: 200992 - RNA, 24 nt, Human
gggugacagagcgagaaucagucu

SEQ ID NO: 200993 - RNA, 24 nt, Human
gggugacagagcgagaccaugucu

SEQ ID NO: 200994 - RNA, 20 nt, Human
gggugacagagcgagacccu

SEQ ID NO: 200995 - RNA, 24 nt, Human
gggugacagagcgagacccugucu

SEQ ID NO: 200996 - RNA, 22 nt, Human
gggugacagagcgagaccgucu

SEQ ID NO: 200997 - RNA, 24 nt, Human
gggugacagagcgagaccuugucu

SEQ ID NO: 200998 - RNA, 19 nt, Human
gggugacagagcgagacuc

SEQ ID NO: 200999 - RNA, 24 nt, Human
gggugacagagcgagacucagucu

SEQ ID NO: 201000 - RNA, 24 nt, Human
gggugacagagcgagacuccaccu

SEQ ID NO: 201001 - RNA, 24 nt, Human
gggugacagagcgagacuccaucu

SEQ ID NO: 201002 - RNA, 22 nt, Human
gggugacagagcgagacuccgu

SEQ ID NO: 201003 - RNA, 24 nt, Human
gggugacagagcgagacuccgucu

SEQ ID NO: 201004 - RNA, 24 nt, Human
gggugacagagcgagacucuaucu

SEQ ID NO: 201005 - RNA, 24 nt, Human
gggugacagagcgagacucuggcu

SEQ ID NO: 201006 - RNA, 24 nt, Human
gggugacagagcgagacucugucu

SEQ ID NO: 201007 - RNA, 24 nt, Human
gggugacagagcgagacugcgucu

SEQ ID NO: 201008 - RNA, 22 nt, Human
gggugacagagcgagacugucu

SEQ ID NO: 201009 - RNA, 24 nt, Human
gggugacagagcgagacugugucu

SEQ ID NO: 201010 - RNA, 24 nt, Human
gggugacagagcgagacuguguuu

SEQ ID NO: 201011 - RNA, 24 nt, Human
gggugacagagcgagacuuugucu

SEQ ID NO: 201012 - RNA, 26 nt, Human
gggugacagagcgugagacuccgucu

SEQ ID NO: 201013 - RNA, 24 nt, Human
gggugacagagcuagacucugucu

SEQ ID NO: 201014 - RNA, 21 nt, Human
gggugacagaggcucucuccu

SEQ ID NO: 201015 - RNA, 24 nt, Human
gggugacagagggaaacuccaucu

SEQ ID NO: 201016 - RNA, 24 nt, Human
gggugacagagggagacccugucu

SEQ ID NO: 201017 - RNA, 24 nt, Human
gggugacagagggagacuccaucu

SEQ ID NO: 201018 - RNA, 24 nt, Human
gggugacagagggagacuccgucu

SEQ ID NO: 201019 - RNA, 24 nt, Human
gggugacagagggagacucugucu

SEQ ID NO: 201020 - RNA, 24 nt, Human
gggugacagaguaacacucugucu

SEQ ID NO: 201021 - RNA, 24 nt, Human
gggugacagaguaagacccuaucu

SEQ ID NO: 201022 - RNA, 24 nt, Human
gggugacagaguaagacccugucu

SEQ ID NO: 201023 - RNA, 24 nt, Human
gggugacagaguaagacuccaugu

SEQ ID NO: 201024 - RNA, 24 nt, Human
gggugacagaguaagacuccgucu

SEQ ID NO: 201025 - RNA, 24 nt, Human
gggugacagaguaggugcucugcu

SEQ ID NO: 201026 - RNA, 24 nt, Human
gggugacagagucagacccugucu

SEQ ID NO: 201027 - RNA, 23 nt, Human
gggugacagagucagacuccguc

SEQ ID NO: 201028 - RNA, 24 nt, Human
gggugacagagugaaacuccaucu

SEQ ID NO: 201029 - RNA, 24 nt, Human
gggugacagagugagacacugucu

SEQ ID NO: 201030 - RNA, 24 nt, Human
gggugacagagugagacagucucc

SEQ ID NO: 201031 - RNA, 24 nt, Human
gggugacagagugagaccauguuu

SEQ ID NO: 201032 - RNA, 21 nt, Human
gggugacagagugagaccccc

SEQ ID NO: 201033 - RNA, 22 nt, Human
gggugacagagugagacccccu

SEQ ID NO: 201034 - RNA, 24 nt, Human
gggugacagagugagacccgugcu

SEQ ID NO: 201035 - RNA, 20 nt, Human
gggugacagagugagacccu

SEQ ID NO: 201036 - RNA, 24 nt, Human
gggugacagagugagacccuaucu

SEQ ID NO: 201037 - RNA, 21 nt, Human
gggugacagagugagacccug

SEQ ID NO: 201038 - RNA, 24 nt, Human
gggugacagagugagacccugccu

SEQ ID NO: 201039 - RNA, 24 nt, Human
gggugacagagugagacccuggcu

SEQ ID NO: 201040 - RNA, 23 nt, Human
gggugacagagugagacccuguc

SEQ ID NO: 201041 - RNA, 24 nt, Human
gggugacagagugagacccugucu

SEQ ID NO: 201042 - RNA, 23 nt, Human
gggugacagagugagacccuguu

SEQ ID NO: 201043 - RNA, 22 nt, Human
gggugacagagugagaccgucu

SEQ ID NO: 201044 - RNA, 24 nt, Human
gggugacagagugagaccuggucu

SEQ ID NO: 201045 - RNA, 20 nt, Human
gggugacagagugagacgcc

SEQ ID NO: 201046 - RNA, 24 nt, Human
gggugacagagugagacucagucu

SEQ ID NO: 201047 - RNA, 24 nt, Human
gggugacagagugagacuccaacu

SEQ ID NO: 201048 - RNA, 24 nt, Human
gggugacagagugagacuccaccu

SEQ ID NO: 201049 - RNA, 23 nt, Human
gggugacagagugagacuccauc

SEQ ID NO: 201050 - RNA, 24 nt, Human
gggugacagagugagacuccaucu

SEQ ID NO: 201051 - RNA, 24 nt, Human
gggugacagagugagacuccgacu

SEQ ID NO: 201052 - RNA, 24 nt, Human
gggugacagagugagacuccgccu

SEQ ID NO: 201053 - RNA, 24 nt, Human
gggugacagagugagacuccgucu

SEQ ID NO: 201054 - RNA, 24 nt, Human
gggugacagagugagacuccguuu

SEQ ID NO: 201055 - RNA, 24 nt, Human
gggugacagagugagacucugucu

SEQ ID NO: 201056 - RNA, 24 nt, Human
gggugacagagugagacucuguuu

SEQ ID NO: 201057 - RNA, 24 nt, Human
gggugacagagugagacucuuguc

SEQ ID NO: 201058 - RNA, 22 nt, Human
gggugacagagugagacugucu

SEQ ID NO: 201059 - RNA, 24 nt, Human
gggugacagagugagauccugucu

SEQ ID NO: 201060 - RNA, 23 nt, Human
gggugacagagugagaucugccu

SEQ ID NO: 201061 - RNA, 24 nt, Human
gggugacagagugagaugcuaucu

SEQ ID NO: 201062 - RNA, 24 nt, Human
gggugacagagugagauuccgccu

SEQ ID NO: 201063 - RNA, 24 nt, Human
gggugacagagugagauuccgucu

SEQ ID NO: 201064 - RNA, 24 nt, Human
gggugacagagugagauucugucu

SEQ ID NO: 201065 - RNA, 32 nt, Human
gggugacagagugagauucugucucaaaagca

SEQ ID NO: 201066 - RNA, 24 nt, Human
gggugacagagugaggcccugucu

SEQ ID NO: 201067 - RNA, 22 nt, Human
gggugacagagugaggcugucu

SEQ ID NO: 201068 - RNA, 28 nt, Human
gggugacagagugagugagacuccaucu

SEQ ID NO: 201069 - RNA, 26 nt, Human
gggugacagagugagugagacucugc

SEQ ID NO: 201070 - RNA, 24 nt, Human
gggugacagagugauacuccaucu

SEQ ID NO: 201071 - RNA, 22 nt, Human
gggugacagagugauacugucu

SEQ ID NO: 201072 - RNA, 24 nt, Human
gggugacagagugggacuccaucu

SEQ ID NO: 201073 - RNA, 24 nt, Human
gggugacagauccagacucugucu

SEQ ID NO: 201074 - RNA, 28 nt, Human
gggugacagauuaagcaagacucugucu

SEQ ID NO: 201075 - RNA, 32 nt, Human
gggugacagcaugguaaugaaggacagugagg

SEQ ID NO: 201076 - RNA, 22 nt, Human
gggugacagcgagacccugucu

SEQ ID NO: 201077 - RNA, 24 nt, Human
gggugacagcgcgagacuccaucu

SEQ ID NO: 201078 - RNA, 22 nt, Human
gggugacagcuagacccugucu

SEQ ID NO: 201079 - RNA, 24 nt, Human
gggugacagggcaagacccugucu

SEQ ID NO: 201080 - RNA, 24 nt, Human
gggugacagggcgagacucugucu

SEQ ID NO: 201081 - RNA, 24 nt, Human
gggugacagggugagacccugucu

SEQ ID NO: 201082 - RNA, 24 nt, Human
gggugacagggugagacucugucu

SEQ ID NO: 201083 - RNA, 32 nt, Human
gggugacagucaagucacaaucaagccuggug

SEQ ID NO: 201084 - RNA, 22 nt, Human
gggugacagugaaacuccaucu

SEQ ID NO: 201085 - RNA, 24 nt, Human
gggugacagugcgagacccugucu

SEQ ID NO: 201086 - RNA, 24 nt, Human
gggugacagugugagacccagccu

SEQ ID NO: 201087 - RNA, 24 nt, Human
gggugacagugugagacucugucu

SEQ ID NO: 201088 - RNA, 32 nt, Human
gggugacagugugagauucugucucagaaaaa

SEQ ID NO: 201089 - RNA, 20 nt, Human
gggugacauagagcauucua

SEQ ID NO: 201090 - RNA, 24 nt, Human
gggugacauagcaagacccugucu

SEQ ID NO: 201091 - RNA, 31 nt, Human
gggugacauagcuagaaaguggagaagcuca

SEQ ID NO: 201092 - RNA, 32 nt, Human
gggugacauauguaaucccagcacuuugggag

SEQ ID NO: 201093 - RNA, 26 nt, Human
gggugacauggugagaccuugucucc

SEQ ID NO: 201094 - RNA, 29 nt, Human
gggugaccaacggggccccagggcuccua

SEQ ID NO: 201095 - RNA, 18 nt, Human
gggugaccccaccgccua

SEQ ID NO: 201096 - RNA, 15 nt, Human
gggugaccccucaca

SEQ ID NO: 201097 - RNA, 20 nt, Human
gggugaccccuucaucucca

SEQ ID NO: 201098 - RNA, 32 nt, Human
gggugaccugcuuccccaaaggccaacagcau

SEQ ID NO: 201099 - RNA, 32 nt, Human
gggugaccuggaauucgaauucuguuucccuu

SEQ ID NO: 201100 - RNA, 22 nt, Human
gggugaccuggcagccgccccu

SEQ ID NO: 201101 - RNA, 23 nt, Human
gggugacgagugaaacuccaucu

SEQ ID NO: 201102 - RNA, 23 nt, Human
gggugacgagugagacuccaucu

SEQ ID NO: 201103 - RNA, 21 nt, Human
gggugacgauaagaccaccua

SEQ ID NO: 201104 - RNA, 24 nt, Human
gggugacggagugagacuccaucu

SEQ ID NO: 201105 - RNA, 32 nt, Human
gggugacugacuggccugggccuggggugggg

SEQ ID NO: 201106 - RNA, 24 nt, Human
gggugacugagcaagacucugccu

SEQ ID NO: 201107 - RNA, 24 nt, Human
gggugacugagcgagacucugucu

SEQ ID NO: 201108 - RNA, 32 nt, Human
gggugacugcaaccacugccucccagguucaa

SEQ ID NO: 201109 - RNA, 32 nt, Human
gggugacugcagcugcucagcuccccuccccc

SEQ ID NO: 201110 - RNA, 32 nt, Human
gggugacugccucugagucauuguguuuuuca

SEQ ID NO: 201111 - RNA, 25 nt, Human
gggugacuggcccagaaugaugcuu

SEQ ID NO: 201112 - RNA, 32 nt, Human
gggugacuguagucucagcuacucgggaggau

SEQ ID NO: 201113 - RNA, 32 nt, Human
gggugacuuccuggucaccaaggcagugcaug

SEQ ID NO: 201114 - RNA, 17 nt, Human
gggugagaaacuggaua

SEQ ID NO: 201115 - RNA, 32 nt, Human
gggugagaacagauguuccucuggccuucuug

SEQ ID NO: 201116 - RNA, 21 nt, Human
gggugagaaccugccuuccua

SEQ ID NO: 201117 - RNA, 32 nt, Human
gggugagaagggcagggguguccugaugcaaa

SEQ ID NO: 201118 - RNA, 32 nt, Human
gggugagaccccaagagacagccugggccggu

SEQ ID NO: 201119 - RNA, 32 nt, Human
gggugagacgcuggcccuccuuacagccuaga

SEQ ID NO: 201120 - RNA, 32 nt, Human
gggugagagagaagcugggagagcagagaaaa

SEQ ID NO: 201121 - RNA, 32 nt, Human
gggugagagaggaagcaaggagagggugugug

SEQ ID NO: 201122 - RNA, 32 nt, Human
gggugagagguucccgcggcucagggaagaug

SEQ ID NO: 201123 - RNA, 32 nt, Human
gggugagauccccagcccugugagccuguagg

SEQ ID NO: 201124 - RNA, 32 nt, Human
gggugagcagagccuggagccccgggcaggca

SEQ ID NO: 201125 - RNA, 32 nt, Human
gggugagcagaggcauuuaucuccauguuaac

SEQ ID NO: 201126 - RNA, 32 nt, Human
gggugagcgaggucaccaugccagcuucccag

SEQ ID NO: 201127 - RNA, 32 nt, Human
gggugagcucacaaccaccauucagucaagug

SEQ ID NO: 201128 - RNA, 32 nt, Human
gggugagcuggcagggacacacugccuuuggg

SEQ ID NO: 201129 - RNA, 23 nt, Human
gggugagcugugaguggggcuga

SEQ ID NO: 201130 - RNA, 32 nt, Human
gggugagcugugggggaggccaguuacaaggu

SEQ ID NO: 201131 - RNA, 32 nt, Human
gggugaggaccaaggaccuggcuggucacuuc

SEQ ID NO: 201132 - RNA, 32 nt, Human
gggugaggacuggagagcaccagcacuggaac

SEQ ID NO: 201133 - RNA, 32 nt, Human
gggugaggagcugccagucauguccagaugga

SEQ ID NO: 201134 - RNA, 32 nt, Human
gggugaggaggaagaggaggaggaagaggagg

SEQ ID NO: 201135 - RNA, 32 nt, Human
gggugaggaggcgacagagggagaggaggaag

SEQ ID NO: 201136 - RNA, 23 nt, Human
gggugaggaggucgcgccggaag

SEQ ID NO: 201137 - RNA, 32 nt, Human
gggugaggagguggaaggagccggguggaugc

SEQ ID NO: 201138 - RNA, 32 nt, Human
gggugaggccugagggagggaggcgcauggaa

SEQ ID NO: 201139 - RNA, 32 nt, Human
gggugaggcgaugugaacaaaggucugugaaa

SEQ ID NO: 201140 - RNA, 20 nt, Human
gggugaggcggcgagggcgg

SEQ ID NO: 201141 - RNA, 19 nt, Human
gggugaggcggcggcgcgg

SEQ ID NO: 201142 - RNA, 32 nt, Human
gggugaggcuaggaguuggcuaguguguaugu

SEQ ID NO: 201143 - RNA, 32 nt, Human
gggugaggcuugccagggaaacuccuaagugg

SEQ ID NO: 201144 - RNA, 32 nt, Human
gggugagggacagcacagcagagguguggcuu

SEQ ID NO: 201145 - RNA, 32 nt, Human
gggugagggaggacaggccaguagggggaggg

SEQ ID NO: 201146 - RNA, 32 nt, Human
gggugagggcaggcuggcugcucugacaccau

SEQ ID NO: 201147 - RNA, 32 nt, Human
gggugagggcaucccugcuggggagaaaccuc

SEQ ID NO: 201148 - RNA, 32 nt, Human
gggugagggccaccuccacacccacccccucu

SEQ ID NO: 201149 - RNA, 32 nt, Human
gggugagggcggagcugaagugacagcggagg

SEQ ID NO: 201150 - RNA, 32 nt, Human
gggugagggcuggcccuaaacaucugccuaau

SEQ ID NO: 201151 - RNA, 32 nt, Human
gggugaggggauggaggaaggcgaguuuucag

SEQ ID NO: 201152 - RNA, 32 nt, Human
gggugagggggaagaauacggggguucccaga

SEQ ID NO: 201153 - RNA, 32 nt, Human
gggugagggguucuccucugaggugcuugcaa

SEQ ID NO: 201154 - RNA, 32 nt, Human
gggugaggugacaucucauccccucacugaag

SEQ ID NO: 201155 - RNA, 32 nt, Human
gggugaggugacccuugaccuccugggaucgc

SEQ ID NO: 201156 - RNA, 32 nt, Human
gggugagguggagggggugguccucaguccaa

SEQ ID NO: 201157 - RNA, 23 nt, Human
gggugagguuggugugagacuga

SEQ ID NO: 201158 - RNA, 32 nt, Human
gggugagguuggugugagacugacggugccuc

SEQ ID NO: 201159 - RNA, 32 nt, Human
gggugaguccgucucaggucucgacaauuagc

SEQ ID NO: 201160 - RNA, 32 nt, Human
gggugagucuguuuuccucucuggaccucagu

SEQ ID NO: 201161 - RNA, 32 nt, Human
gggugaguguuagcuggcuaggguugcuggaa

SEQ ID NO: 201162 - RNA, 32 nt, Human
gggugauaaaugggcuagagaggcagaggaag

SEQ ID NO: 201163 - RNA, 25 nt, Human
gggugauaagagugagacucugucu

SEQ ID NO: 201164 - RNA, 32 nt, Human
gggugauacaagagauucuguugguuguucag

SEQ ID NO: 201165 - RNA, 24 nt, Human
gggugauagaacaagacccugucu

SEQ ID NO: 201166 - RNA, 24 nt, Human
gggugauagagcaagacccuaucu

SEQ ID NO: 201167 - RNA, 22 nt, Human
gggugauagcccagacucugcc

SEQ ID NO: 201168 - RNA, 32 nt, Human
gggugauagccucgaggagacuggggcugcca

SEQ ID NO: 201169 - RNA, 32 nt, Human
gggugauagggagggcagccagaaaagacagc

SEQ ID NO: 201170 - RNA, 15 nt, Human
gggugauagggcccu

SEQ ID NO: 201171 - RNA, 32 nt, Human
gggugauaugcugauuuucauugugcacaugg

SEQ ID NO: 201172 - RNA, 32 nt, Human
gggugaucagaugccagcaccauguuuucauu

SEQ ID NO: 201173 - RNA, 32 nt, Human
gggugaucugcugaccuuguucacucaugaag

SEQ ID NO: 201174 - RNA, 32 nt, Human
gggugaugagacaguuauacuuucaacugcca

SEQ ID NO: 201175 - RNA, 20 nt, Human
gggugaugcagaggccacag

SEQ ID NO: 201176 - RNA, 23 nt, Human
gggugaugcagaggccacaggug

SEQ ID NO: 201177 - RNA, 32 nt, Human
gggugaugcagggacugaggggaacccuggga

SEQ ID NO: 201178 - RNA, 32 nt, Human
gggugaugccaucuacccugccccuguccacc

SEQ ID NO: 201179 - RNA, 24 nt, Human
gggugauggagcaagacuccaucu

SEQ ID NO: 201180 - RNA, 32 nt, Human
gggugauggccuucccccucuuggccgggacg

SEQ ID NO: 201181 - RNA, 25 nt, Human
gggugaugggagugagacccugucu

SEQ ID NO: 201182 - RNA, 31 nt, Human
gggugaugggcagcacaggaggcccguccug

SEQ ID NO: 201183 - RNA, 32 nt, Human
gggugauguggaaucugcuuuuugaaaccugc

SEQ ID NO: 201184 - RNA, 30 nt, Human
gggugauguggaccccggagcuggcaauuc

SEQ ID NO: 201185 - RNA, 32 nt, Human
gggugauguucugcaagguguggcuuuggcug

SEQ ID NO: 201186 - RNA, 32 nt, Human
gggugauuacaggcaccagugcagugaugauu

SEQ ID NO: 201187 - RNA, 32 nt, Human
gggugauucaguccagugauuggguuuguggc

SEQ ID NO: 201188 - RNA, 32 nt, Human
gggugauucucaguguccucuggucauugcuc

SEQ ID NO: 201189 - RNA, 32 nt, Human
gggugauuuagggaaguggaaaagcaagauac

SEQ ID NO: 201190 - RNA, 32 nt, Human
gggugauuuguugauuggcaaugaggauaaaa

SEQ ID NO: 201191 - RNA, 32 nt, Human
gggugauuuugaaaugggacaaucuuuuaaug

SEQ ID NO: 201192 - RNA, 32 nt, Human
gggugcaaacaugacugggaccuaagagccag

SEQ ID NO: 201193 - RNA, 32 nt, Human
gggugcaaagcaguaauuagucaaaguucaac

SEQ ID NO: 201194 - RNA, 32 nt, Human
gggugcaaggagcaaggacggggccaaggucg

SEQ ID NO: 201195 - RNA, 23 nt, Human
gggugcaauggcucaugccugua

SEQ ID NO: 201196 - RNA, 32 nt, Human
gggugcaccauggacauguguacauugagguu

SEQ ID NO: 201197 - RNA, 32 nt, Human
gggugcaccuauuaugggaggcuggagugcaa

SEQ ID NO: 201198 - RNA, 32 nt, Human
gggugcaccuuuucucuuuacugugacucacc

SEQ ID NO: 201199 - RNA, 32 nt, Human
gggugcagaaaccucuugccuccagauuuggg

SEQ ID NO: 201200 - RNA, 20 nt, Human
gggugcagacagcacaguca

SEQ ID NO: 201201 - RNA, 32 nt, Human
gggugcagagaccugagggcuugagguugccu

SEQ ID NO: 201202 - RNA, 32 nt, Human
gggugcagagguggaggcccggggagaggcac

SEQ ID NO: 201203 - RNA, 32 nt, Human
gggugcagaugaugccugggcagauguggagg

SEQ ID NO: 201204 - RNA, 22 nt, Human
gggugcagauuuccaacauuca

SEQ ID NO: 201205 - RNA, 20 nt, Human
gggugcagcacaccaacaug

SEQ ID NO: 201206 - RNA, 20 nt, Human
gggugcagcacaccagcaug

SEQ ID NO: 201207 - RNA, 20 nt, Human
gggugcagcacuggaccccu

SEQ ID NO: 201208 - RNA, 16 nt, Human
gggugcagcaggcuca

SEQ ID NO: 201209 - RNA, 19 nt, Human
gggugcagcccccggguua

SEQ ID NO: 201210 - RNA, 32 nt, Human
gggugcagccccuggcagacugacaguguggc

SEQ ID NO: 201211 - RNA, 20 nt, Human
gggugcagcgcaccagcaug

SEQ ID NO: 201212 - RNA, 20 nt, Human
gggugcagcgcccacuguca

SEQ ID NO: 201213 - RNA, 32 nt, Human
gggugcagcggacuugcuccagccugggugag

SEQ ID NO: 201214 - RNA, 23 nt, Human
gggugcagcggcucaugccugua

SEQ ID NO: 201215 - RNA, 32 nt, Human
gggugcaggaaaccauccagaaugcugcuucc

SEQ ID NO: 201216 - RNA, 32 nt, Human
gggugcaggacgccuggucugccuuguggguc

SEQ ID NO: 201217 - RNA, 32 nt, Human
gggugcaggagacagagaggggcugggggcgu

SEQ ID NO: 201218 - RNA, 32 nt, Human
gggugcaggagcagaagguggggaggguuaua

SEQ ID NO: 201219 - RNA, 32 nt, Human
gggugcaggagccagugucuguugucgggacu

SEQ ID NO: 201220 - RNA, 32 nt, Human
gggugcaggagcgcagaggccaugcucugcca

SEQ ID NO: 201221 - RNA, 32 nt, Human
gggugcaggcaugcacacacacgauggaauau

SEQ ID NO: 201222 - RNA, 18 nt, Human
gggugcaggcuucaggca

SEQ ID NO: 201223 - RNA, 22 nt, Human
gggugcagggaccaagauguca

SEQ ID NO: 201224 - RNA, 32 nt, Human
gggugcaggggaggggcgggagguggagcagg

SEQ ID NO: 201225 - RNA, 22 nt, Human
gggugcaggggcccccgaccuc

SEQ ID NO: 201226 - RNA, 23 nt, Human
gggugcaguggcucacaccugua

SEQ ID NO: 201227 - RNA, 22 nt, Human
gggugcaguggcucacacugua

SEQ ID NO: 201228 - RNA, 23 nt, Human
gggugcaguggcucacgccugua

SEQ ID NO: 201229 - RNA, 20 nt, Human
gggugcaguggcucauaccu

SEQ ID NO: 201230 - RNA, 23 nt, Human
gggugcaguggcucaugccugua

SEQ ID NO: 201231 - RNA, 23 nt, Human
gggugcaguggcucaugccugug

SEQ ID NO: 201232 - RNA, 21 nt, Human
gggugcaguggcucgccugua

SEQ ID NO: 201233 - RNA, 23 nt, Human
gggugcaguggcuuaugcuugua

SEQ ID NO: 201234 - RNA, 32 nt, Human
gggugcauauacguagagucugaacaggugcu

SEQ ID NO: 201235 - RNA, 32 nt, Human
gggugcaucccuggacaucagcucuucauuau

SEQ ID NO: 201236 - RNA, 32 nt, Human
gggugcaugcaugucccccacccuccacaguc

SEQ ID NO: 201237 - RNA, 32 nt, Human
gggugcaugccuggaaucccagcuacuugaga

SEQ ID NO: 201238 - RNA, 32 nt, Human
gggugcauuuuccucucauuauugagaacugu

SEQ ID NO: 201239 - RNA, 19 nt, Human
gggugccaagaguccagcu

SEQ ID NO: 201240 - RNA, 32 nt, Human
gggugccacacuuaggcugagcugcagguuuu

SEQ ID NO: 201241 - RNA, 32 nt, Human
gggugccacugaggcagcggagggaggcagga

SEQ ID NO: 201242 - RNA, 32 nt, Human
gggugccacugaugggggaugagggaaggccc

SEQ ID NO: 201243 - RNA, 32 nt, Human
gggugccagaacucaagguucaguggacacau

SEQ ID NO: 201244 - RNA, 31 nt, Human
gggugccagagaggcggaagaggaggccuga

SEQ ID NO: 201245 - RNA, 32 nt, Human
gggugccagagccuggggcuccugggcugcag

SEQ ID NO: 201246 - RNA, 32 nt, Human
gggugccaggagagcaggccacagugcuaaga

SEQ ID NO: 201247 - RNA, 32 nt, Human
gggugcccacacugagugaggaagggaaugga

SEQ ID NO: 201248 - RNA, 17 nt, Human
gggugcccagacagggg

SEQ ID NO: 201249 - RNA, 32 nt, Human
gggugcccauggagccucagaaaugccacccg

SEQ ID NO: 201250 - RNA, 32 nt, Human
gggugccccagccuuggugaggacaguguugg

SEQ ID NO: 201251 - RNA, 24 nt, Human
gggugcccccuagggcgacaggag

SEQ ID NO: 201252 - RNA, 32 nt, Human
gggugccccgaggaggaggguggguggguccu

SEQ ID NO: 201253 - RNA, 32 nt, Human
gggugccccuccaccuuccucuggaauccaag

SEQ ID NO: 201254 - RNA, 28 nt, Human
gggugcccgggaugagccucauccggaa

SEQ ID NO: 201255 - RNA, 21 nt, Human
gggugcccgggcccugggccc

SEQ ID NO: 201256 - RNA, 32 nt, Human
gggugcccguaaucccagcuacucaggaggcu

SEQ ID NO: 201257 - RNA, 32 nt, Human
gggugcccuagacuuaguccuuaucuuguccu

SEQ ID NO: 201258 - RNA, 32 nt, Human
gggugcccuccagaccuggggacugagugggg

SEQ ID NO: 201259 - RNA, 32 nt, Human
gggugcccuccagagaggggcugcuaccuccc

SEQ ID NO: 201260 - RNA, 32 nt, Human
gggugcccuccaggaaccaaggggcgguucuc

SEQ ID NO: 201261 - RNA, 19 nt, Human
gggugccgaggcucaggca

SEQ ID NO: 201262 - RNA, 32 nt, Human
gggugccggccacaccugaagugccagcauuu

SEQ ID NO: 201263 - RNA, 32 nt, Human
gggugccgggacuccggccgcagugucgccgc

SEQ ID NO: 201264 - RNA, 15 nt, Human
gggugccgggcccuu

SEQ ID NO: 201265 - RNA, 20 nt, Human
gggugccggggccucugaug

SEQ ID NO: 201266 - RNA, 23 nt, Human
gggugccguggcucaugccugua

SEQ ID NO: 201267 - RNA, 32 nt, Human
gggugccuauagucccagcuacucuggaggcu

SEQ ID NO: 201268 - RNA, 32 nt, Human
gggugccuccagccugagacaucaggggagag

SEQ ID NO: 201269 - RNA, 32 nt, Human
gggugccucccaggaccugggagcugacucua

SEQ ID NO: 201270 - RNA, 31 nt, Human
gggugccucucggaggagccuguguccaccu

SEQ ID NO: 201271 - RNA, 32 nt, Human
gggugccugaagcuauagugcaaugguuccca

SEQ ID NO: 201272 - RNA, 32 nt, Human
gggugccugcagccuuccacuccugccccgcc

SEQ ID NO: 201273 - RNA, 20 nt, Human
gggugccugcaggggagcug

SEQ ID NO: 201274 - RNA, 32 nt, Human
gggugccugccccucacugugcaucucuggga

SEQ ID NO: 201275 - RNA, 32 nt, Human
gggugccugccuggggcuuggggcucuguacg

SEQ ID NO: 201276 - RNA, 32 nt, Human
gggugccugcucuccuugcccugggccagccc

SEQ ID NO: 201277 - RNA, 32 nt, Human
gggugccugcugcugauaacauucggauggag

SEQ ID NO: 201278 - RNA, 32 nt, Human
gggugccugcuguccgucccgcuuucauguua

SEQ ID NO: 201279 - RNA, 32 nt, Human
gggugccuggagucccagcuacucgggaggcu

SEQ ID NO: 201280 - RNA, 32 nt, Human
gggugccugggccuccccaggagcuguggacu

SEQ ID NO: 201281 - RNA, 32 nt, Human
gggugccuguaaccccagcuacuugggaggcu

SEQ ID NO: 201282 - RNA, 32 nt, Human
gggugccuguaaccucagcuacuugggaggcu

SEQ ID NO: 201283 - RNA, 32 nt, Human
gggugccuguaaucagcuacucgggaggcuga

SEQ ID NO: 201284 - RNA, 32 nt, Human
gggugccuguaauccaacuacccaggaggcug

SEQ ID NO: 201285 - RNA, 32 nt, Human
gggugccuguaaucccagauacucaggaggcu

SEQ ID NO: 201286 - RNA, 32 nt, Human
gggugccuguaaucccagauagucaggaggcu

SEQ ID NO: 201287 - RNA, 20 nt, Human
gggugccuguaaucccagcu

SEQ ID NO: 201288 - RNA, 32 nt, Human
gggugccuguaaucccagcuacaugggagccu

SEQ ID NO: 201289 - RNA, 32 nt, Human
gggugccuguaaucccagcuacgugggaggcu

SEQ ID NO: 201290 - RNA, 32 nt, Human
gggugccuguaaucccagcuacucaagaggcu

SEQ ID NO: 201291 - RNA, 32 nt, Human
gggugccuguaaucccagcuacucaggaggca

SEQ ID NO: 201292 - RNA, 32 nt, Human
gggugccuguaaucccagcuacucaggaggcu

SEQ ID NO: 201293 - RNA, 32 nt, Human
gggugccuguaaucccagcuacucgggagacu

SEQ ID NO: 201294 - RNA, 32 nt, Human
gggugccuguaaucccagcuacucgggaggcu

SEQ ID NO: 201295 - RNA, 32 nt, Human
gggugccuguaaucccagcuacucgggagguu

SEQ ID NO: 201296 - RNA, 32 nt, Human
gggugccuguaaucccagcuacuggggaggcu

SEQ ID NO: 201297 - RNA, 32 nt, Human
gggugccuguaaucccagcuacuugggaagcu

SEQ ID NO: 201298 - RNA, 32 nt, Human
gggugccuguaaucccagcuacuugggaggca

SEQ ID NO: 201299 - RNA, 32 nt, Human
gggugccuguaaucccagcuacuugggaggcu

SEQ ID NO: 201300 - RNA, 32 nt, Human
gggugccuguaaucccagcuauucaggaggcu

SEQ ID NO: 201301 - RNA, 32 nt, Human
gggugccuguaaucccagcuccuugggaggcu

SEQ ID NO: 201302 - RNA, 32 nt, Human
gggugccuguaaucccagcuucuuaggaggcu

SEQ ID NO: 201303 - RNA, 20 nt, Human
gggugccuguaaucccaguu

SEQ ID NO: 201304 - RNA, 32 nt, Human
gggugccuguaaucccaguuacucaggaggcu

SEQ ID NO: 201305 - RNA, 32 nt, Human
gggugccuguaaucccaguuacuugggaggcu

SEQ ID NO: 201306 - RNA, 20 nt, Human
gggugccuguaaucccggcu

SEQ ID NO: 201307 - RNA, 32 nt, Human
gggugccuguaaucccggcuacucaggaggcu

SEQ ID NO: 201308 - RNA, 32 nt, Human
gggugccuguaauccuagcuacuugggaggcu

SEQ ID NO: 201309 - RNA, 32 nt, Human
gggugccuguaaucucagcuacucgggaggcu

SEQ ID NO: 201310 - RNA, 32 nt, Human
gggugccuguaaucucagcuacuugagaggcu

SEQ ID NO: 201311 - RNA, 32 nt, Human
gggugccuguaauuccagccacucgagaggcu

SEQ ID NO: 201312 - RNA, 20 nt, Human
gggugccuguagucccagcu

SEQ ID NO: 201313 - RNA, 32 nt, Human
gggugccuguagucccagcuacucaggaggcu

SEQ ID NO: 201314 - RNA, 32 nt, Human
gggugccuguagucccagcuacucgggaggcu

SEQ ID NO: 201315 - RNA, 32 nt, Human
gggugccuguagucccagcuacucuggaggcu

SEQ ID NO: 201316 - RNA, 32 nt, Human
gggugccuguagucccagcuacuugggaggcu

SEQ ID NO: 201317 - RNA, 32 nt, Human
gggugccuguagucccagcuauuugggaggcu

SEQ ID NO: 201318 - RNA, 32 nt, Human
gggugccuguagucccagcugcucgggaggcu

SEQ ID NO: 201319 - RNA, 32 nt, Human
gggugccuguaguuccagcuacuugggaggcu

SEQ ID NO: 201320 - RNA, 32 nt, Human
gggugccuguauugccagcuacucggaaggcu

SEQ ID NO: 201321 - RNA, 32 nt, Human
gggugccuguggucccagcuacucgggacgcu

SEQ ID NO: 201322 - RNA, 32 nt, Human
gggugccuguggucccagcuacuggggaggcu

SEQ ID NO: 201323 - RNA, 32 nt, Human
gggugccuguggucccagcugcucggaaggcu

SEQ ID NO: 201324 - RNA, 32 nt, Human
gggugccuguggucccagcugcuugggaggcu

SEQ ID NO: 201325 - RNA, 32 nt, Human
gggugccuuuagucccagcucuuugggaagcu

SEQ ID NO: 201326 - RNA, 32 nt, Human
gggugccuuucugucuugcuuccagggggcug

SEQ ID NO: 201327 - RNA, 32 nt, Human
gggugccuuuggugaggacugcacacccuccu

SEQ ID NO: 201328 - RNA, 32 nt, Human
gggugcgaccaagcccuggcuccagcucuagc

SEQ ID NO: 201329 - RNA, 17 nt, Human
gggugcgagggggccag

SEQ ID NO: 201330 - RNA, 23 nt, Human
gggugcgcgcucggcgccgggag

SEQ ID NO: 201331 - RNA, 32 nt, Human
gggugcgcucagagacacgggcaagcaugccu

SEQ ID NO: 201332 - RNA, 32 nt, Human
gggugcgcucagucacuggugccugagaggaa

SEQ ID NO: 201333 - RNA, 17 nt, Human
gggugcgcuccaauuca

SEQ ID NO: 201334 - RNA, 32 nt, Human
gggugcgcuccgacagcucaaguucacgcggg

SEQ ID NO: 201335 - RNA, 32 nt, Human
gggugcgcuggugaaguggcccagggaagugc

SEQ ID NO: 201336 - RNA, 32 nt, Human
gggugcgcuguggcucaugccuguaauccuag

SEQ ID NO: 201337 - RNA, 32 nt, Human
gggugcgcuuguaaucccagcuacucaggagg

SEQ ID NO: 201338 - RNA, 32 nt, Human
gggugcgcuuguaaucccagcuacucgggagg

SEQ ID NO: 201339 - RNA, 32 nt, Human
gggugcggacggcggaggcggcgggacugguc

SEQ ID NO: 201340 - RNA, 32 nt, Human
gggugcggagagagcaccuuuuugcuuuucga

SEQ ID NO: 201341 - RNA, 32 nt, Human
gggugcggagccgccgguggcccagccgcuca

SEQ ID NO: 201342 - RNA, 32 nt, Human
gggugcggaugcagccugcaaucccagcuacu

SEQ ID NO: 201343 - RNA, 32 nt, Human
gggugcggcagggcaggagcuuggcagagaga

SEQ ID NO: 201344 - RNA, 32 nt, Human
gggugcggcgcgggugggggagggcggacccg

SEQ ID NO: 201345 - RNA, 32 nt, Human
gggugcgggccgagcccgaggggaagaaccug

SEQ ID NO: 201346 - RNA, 32 nt, Human
gggugcgggcugggguuuucuccugggcguca

SEQ ID NO: 201347 - RNA, 32 nt, Human
gggugcggggcaguucacucugucucccaggc

SEQ ID NO: 201348 - RNA, 23 nt, Human
gggugcgguggcgcgugccugug

SEQ ID NO: 201349 - RNA, 23 nt, Human
gggugcgguggcucacaccugua

SEQ ID NO: 201350 - RNA, 23 nt, Human
gggugcgguggcucaccccugua

SEQ ID NO: 201351 - RNA, 23 nt, Human
gggugcgguggcucacgccugua

SEQ ID NO: 201352 - RNA, 23 nt, Human
gggugcgguggcucacgucugua

SEQ ID NO: 201353 - RNA, 23 nt, Human
gggugcgguggcucaggccugua

SEQ ID NO: 201354 - RNA, 20 nt, Human
gggugcgguggcucaugccu

SEQ ID NO: 201355 - RNA, 21 nt, Human
gggugcgguggcucaugccug

SEQ ID NO: 201356 - RNA, 23 nt, Human
gggugcgguggcucaugccugua

SEQ ID NO: 201357 - RNA, 23 nt, Human
gggugcgguggcucccgccugua

SEQ ID NO: 201358 - RNA, 23 nt, Human
gggugcgguggcucucgccugua

SEQ ID NO: 201359 - RNA, 23 nt, Human
gggugcggugguucacaccugua

SEQ ID NO: 201360 - RNA, 32 nt, Human
gggugcuacaggcuugucuuucuaagugacau

SEQ ID NO: 201361 - RNA, 32 nt, Human
gggugcuaccucaguguuguaguuucugauac

SEQ ID NO: 201362 - RNA, 32 nt, Human
gggugcuagagcuguuuagagagggccuguug

SEQ ID NO: 201363 - RNA, 32 nt, Human
gggugcuaucagagccucucccacaccacuau

SEQ ID NO: 201364 - RNA, 17 nt, Human
gggugcuauucugugaa

SEQ ID NO: 201365 - RNA, 32 nt, Human
gggugcucacgcccccggcauguggccgcccu

SEQ ID NO: 201366 - RNA, 32 nt, Human
gggugcucagcagagcgugagccaccagggaa

SEQ ID NO: 201367 - RNA, 32 nt, Human
gggugcucaggaaaugauuuucaaccaacuuc

SEQ ID NO: 201368 - RNA, 32 nt, Human
gggugcucagggcugacacguccaccccagug

SEQ ID NO: 201369 - RNA, 32 nt, Human
gggugcuccggcagggcaggaugggaaggcgu

SEQ ID NO: 201370 - RNA, 32 nt, Human
gggugcuccugccuuaggucugaggcccuguc

SEQ ID NO: 201371 - RNA, 32 nt, Human
gggugcuccugcucugcacuccagaaacaccc

SEQ ID NO: 201372 - RNA, 32 nt, Human
gggugcucuacaccucagguuaccaggccuga

SEQ ID NO: 201373 - RNA, 17 nt, Human
gggugcucucccugcag

SEQ ID NO: 201374 - RNA, 32 nt, Human
gggugcucuccucuugagcucagcuucugauu

SEQ ID NO: 201375 - RNA, 32 nt, Human
gggugcucugggcuggagcgagggccagguuu

SEQ ID NO: 201376 - RNA, 19 nt, Human
gggugcucuggguggggug

SEQ ID NO: 201377 - RNA, 32 nt, Human
gggugcucugggugggguggcccagugacuug

SEQ ID NO: 201378 - RNA, 32 nt, Human
gggugcucuguuuccccaccguucccaggugu

SEQ ID NO: 201379 - RNA, 21 nt, Human
gggugcucuucccccuccuua

SEQ ID NO: 201380 - RNA, 32 nt, Human
gggugcucuuucucugugccugcuccuuauga

SEQ ID NO: 201381 - RNA, 18 nt, Human
gggugcugaaggcuccag

SEQ ID NO: 201382 - RNA, 32 nt, Human
gggugcugacacagucccucugggagagcucu

SEQ ID NO: 201383 - RNA, 20 nt, Human
gggugcugagauuacaggug

SEQ ID NO: 201384 - RNA, 32 nt, Human
gggugcugagauuacaggugugagccacccug

SEQ ID NO: 201385 - RNA, 18 nt, Human
gggugcugagcccgcucc

SEQ ID NO: 201386 - RNA, 32 nt, Human
gggugcugaggcgggaggauuacuugagccca

SEQ ID NO: 201387 - RNA, 32 nt, Human
gggugcugagggagcgccagagugcgcuacgg

SEQ ID NO: 201388 - RNA, 32 nt, Human
gggugcugagugcagggggugccuucaccugg

SEQ ID NO: 201389 - RNA, 22 nt, Human
gggugcugaguugggugauuuc

SEQ ID NO: 201390 - RNA, 32 nt, Human
gggugcugccacuccagcaggcgucgguucaa

SEQ ID NO: 201391 - RNA, 32 nt, Human
gggugcugccagcugcucccaaugugccgaug

SEQ ID NO: 201392 - RNA, 17 nt, Human
gggugcugcgcggcggc

SEQ ID NO: 201393 - RNA, 32 nt, Human
gggugcugcuuuguucucaggcugcuccucca

SEQ ID NO: 201394 - RNA, 32 nt, Human
gggugcuggacacaguguuggggaagacugug

SEQ ID NO: 201395 - RNA, 32 nt, Human
gggugcuggagggagagcucggggcccagccc

SEQ ID NO: 201396 - RNA, 32 nt, Human
gggugcuggaugguagagaauuuugucaguca

SEQ ID NO: 201397 - RNA, 32 nt, Human
gggugcuggcagcccucccucgcucuuggugc

SEQ ID NO: 201398 - RNA, 32 nt, Human
gggugcugggagaggguugggggcagggggca

SEQ ID NO: 201399 - RNA, 32 nt, Human
gggugcugggauuacagacgugagccaccacc

SEQ ID NO: 201400 - RNA, 18 nt, Human
gggugcugggauuacagg

SEQ ID NO: 201401 - RNA, 32 nt, Human
gggugcugggauuacaggcaucagccacugca

SEQ ID NO: 201402 - RNA, 20 nt, Human
gggugcugggauuacaggug

SEQ ID NO: 201403 - RNA, 32 nt, Human
gggugcugggauuacaggugugagccaccaug

SEQ ID NO: 201404 - RNA, 32 nt, Human
gggugcuggggaggggcugguaggagggaggg

SEQ ID NO: 201405 - RNA, 32 nt, Human
gggugcuggggaugcauccaaagugguugucu

SEQ ID NO: 201406 - RNA, 16 nt, Human
gggugcuggggcccuu

SEQ ID NO: 201407 - RNA, 32 nt, Human
gggugcuggucccugcccccugccccaccccu

SEQ ID NO: 201408 - RNA, 32 nt, Human
gggugcuggugugucuuggugccuggacuuga

SEQ ID NO: 201409 - RNA, 32 nt, Human
gggugcugugagccaccuccagccucgggugg

SEQ ID NO: 201410 - RNA, 23 nt, Human
gggugcuguggcucacgccugua

SEQ ID NO: 201411 - RNA, 32 nt, Human
gggugcuguguugagucagcaggcauggggug

SEQ ID NO: 201412 - RNA, 32 nt, Human
gggugcuuaccucccugcuaggcaugcagggg

SEQ ID NO: 201413 - RNA, 20 nt, Human
gggugcuuagcuccagagca

SEQ ID NO: 201414 - RNA, 32 nt, Human
gggugcuuccaagagaacaucagaggucauca

SEQ ID NO: 201415 - RNA, 32 nt, Human
gggugcuugguggaagucagcagggcaucugg

SEQ ID NO: 201416 - RNA, 32 nt, Human
gggugcuuguaguuccagcuacucaggaggcu

SEQ ID NO: 201417 - RNA, 32 nt, Human
gggugcuuucuugagcccccaguucucugucc

SEQ ID NO: 201418 - RNA, 32 nt, Human
ggguggaaaauggcagagcugcagauguuacu

SEQ ID NO: 201419 - RNA, 32 nt, Human
ggguggaacaagaccagagauccagagcaaaa

SEQ ID NO: 201420 - RNA, 32 nt, Human
ggguggaacacgaggucaggaguucgagauca

SEQ ID NO: 201421 - RNA, 32 nt, Human
ggguggaagaggagaggguggaaggggaauaa

SEQ ID NO: 201422 - RNA, 32 nt, Human
ggguggaagagggaguagcugauuucuuugaa

SEQ ID NO: 201423 - RNA, 32 nt, Human
ggguggaaggagugccuggcccuggggaggac

SEQ ID NO: 201424 - RNA, 31 nt, Human
ggguggaagggacccuccucacuggauggug

SEQ ID NO: 201425 - RNA, 32 nt, Human
ggguggaagggagcagguucccaaugaagccc

SEQ ID NO: 201426 - RNA, 32 nt, Human
ggguggaagggagggucagggaagaaacccac

SEQ ID NO: 201427 - RNA, 32 nt, Human
ggguggaaugcaugugugggggcagagguuau

SEQ ID NO: 201428 - RNA, 32 nt, Human
ggguggaauuccaggguugagagacuccccug

SEQ ID NO: 201429 - RNA, 32 nt, Human
ggguggacagaacaaggcccugucucuauuuu

SEQ ID NO: 201430 - RNA, 32 nt, Human
ggguggacaggcugagccccucccaacagcag

SEQ ID NO: 201431 - RNA, 32 nt, Human
ggguggaccccauccagucuguugaaggccug

SEQ ID NO: 201432 - RNA, 32 nt, Human
ggguggacgauggacagccagagcaggaaggu

SEQ ID NO: 201433 - RNA, 32 nt, Human
ggguggacgucucagugcacacgcaggaacau

SEQ ID NO: 201434 - RNA, 32 nt, Human
ggguggacugaccggucuucugaccucuggcu

SEQ ID NO: 201435 - RNA, 32 nt, Human
ggguggacugagucccacucagcuucagguag

SEQ ID NO: 201436 - RNA, 32 nt, Human
ggguggacuuuaagcauggugacagaugguau

SEQ ID NO: 201437 - RNA, 32 nt, Human
ggguggagagagacauaaaucuggccuacgug

SEQ ID NO: 201438 - RNA, 32 nt, Human
ggguggagaggugggguggggugggguguggu

SEQ ID NO: 201439 - RNA, 32 nt, Human
ggguggagaguccugcaucauagccaccaaau

SEQ ID NO: 201440 - RNA, 18 nt, Human
ggguggagaugccgccua

SEQ ID NO: 201441 - RNA, 32 nt, Human
ggguggagcacuguggacugaaugccuguguc

SEQ ID NO: 201442 - RNA, 32 nt, Human
ggguggaggaagaggaagggccaaacuagcug

SEQ ID NO: 201443 - RNA, 32 nt, Human
ggguggaggaagagggcaggcgaggcgggaag

SEQ ID NO: 201444 - RNA, 32 nt, Human
ggguggaggagcuacggcgccgccggcgggag

SEQ ID NO: 201445 - RNA, 32 nt, Human
ggguggaggaguuccuggagaaggacaggagg

SEQ ID NO: 201446 - RNA, 32 nt, Human
ggguggaggauaacaggguagauucacuugug

SEQ ID NO: 201447 - RNA, 19 nt, Human
ggguggaggcgccauccua

SEQ ID NO: 201448 - RNA, 32 nt, Human
ggguggaggggaagggugggucucaguuagca

SEQ ID NO: 201449 - RNA, 17 nt, Human
ggguggaggggagggac

SEQ ID NO: 201450 - RNA, 16 nt, Human
ggguggaggggccgga

SEQ ID NO: 201451 - RNA, 32 nt, Human
ggguggagguccugggugggcuaaggcgugag

SEQ ID NO: 201452 - RNA, 32 nt, Human
ggguggaggugugggagcugaugggagaauga

SEQ ID NO: 201453 - RNA, 19 nt, Human
ggguggagguugcagugag

SEQ ID NO: 201454 - RNA, 32 nt, Human
ggguggaguaagggggagacugaugcuagucc

SEQ ID NO: 201455 - RNA, 32 nt, Human
ggguggaguugagugugcucugggcuuggaca

SEQ ID NO: 201456 - RNA, 32 nt, Human
ggguggaucaaaaggaacuguccuucagccca

SEQ ID NO: 201457 - RNA, 20 nt, Human
ggguggaucacaagcucagg

SEQ ID NO: 201458 - RNA, 22 nt, Human
ggguggaucacaugaggccagg

SEQ ID NO: 201459 - RNA, 22 nt, Human
ggguggaucacccgaggucagg

SEQ ID NO: 201460 - RNA, 22 nt, Human
ggguggaucaccugaggccagg

SEQ ID NO: 201461 - RNA, 20 nt, Human
ggguggaucaccugagguca

SEQ ID NO: 201462 - RNA, 21 nt, Human
ggguggaucaccugaggucag

SEQ ID NO: 201463 - RNA, 22 nt, Human
ggguggaucaccugaggucagg

SEQ ID NO: 201464 - RNA, 20 nt, Human
ggguggaucacgaggucagg

SEQ ID NO: 201465 - RNA, 20 nt, Human
ggguggaucacuuaagguca

SEQ ID NO: 201466 - RNA, 20 nt, Human
ggguggaucacuugagauca

SEQ ID NO: 201467 - RNA, 22 nt, Human
ggguggaucacuugagaucagg

SEQ ID NO: 201468 - RNA, 20 nt, Human
ggguggaucacuugaggcca

SEQ ID NO: 201469 - RNA, 22 nt, Human
ggguggaucacuugaggccagg

SEQ ID NO: 201470 - RNA, 22 nt, Human
ggguggaucacuugaggccggg

SEQ ID NO: 201471 - RNA, 22 nt, Human
ggguggaucacuugaggucagg

SEQ ID NO: 201472 - RNA, 22 nt, Human
ggguggaucacuugagguuagg

SEQ ID NO: 201473 - RNA, 19 nt, Human
ggguggaucaugaggucag

SEQ ID NO: 201474 - RNA, 20 nt, Human
ggguggaucaugaggucagg

SEQ ID NO: 201475 - RNA, 32 nt, Human
ggguggaucaugaggucaggaggaucaugagg

SEQ ID NO: 201476 - RNA, 22 nt, Human
ggguggaucgcuugagcacagg

SEQ ID NO: 201477 - RNA, 32 nt, Human
ggguggaugaggguuuaugguccucugaucau

SEQ ID NO: 201478 - RNA, 32 nt, Human
ggguggaugauaccauuuccugaccccguuuu

SEQ ID NO: 201479 - RNA, 32 nt, Human
ggguggauggagaagagguugcugauuaaaau

SEQ ID NO: 201480 - RNA, 32 nt, Human
ggguggauggugcuugccgcguaucauggcug

SEQ ID NO: 201481 - RNA, 29 nt, Human
ggguggauguugugugugcuggggagggg

SEQ ID NO: 201482 - RNA, 22 nt, Human
ggguggauuaccugaggucagg

SEQ ID NO: 201483 - RNA, 22 nt, Human
ggguggauugcuugaacccagg

SEQ ID NO: 201484 - RNA, 21 nt, Human
ggguggauugcuugagcccag

SEQ ID NO: 201485 - RNA, 22 nt, Human
ggguggauugcuugagcccagg

SEQ ID NO: 201486 - RNA, 22 nt, Human
ggguggauugcuugaggccagg

SEQ ID NO: 201487 - RNA, 22 nt, Human
ggguggauugcuugaugccagg

SEQ ID NO: 201488 - RNA, 32 nt, Human
ggguggcaagaggauuuuugaccuggauuuau

SEQ ID NO: 201489 - RNA, 32 nt, Human
ggguggcacacagcagucuuugugccagaacu

SEQ ID NO: 201490 - RNA, 32 nt, Human
ggguggcacagccuggcuugagugguggcaug

SEQ ID NO: 201491 - RNA, 31 nt, Human
ggguggcacaggggucccacagcaggucuuc

SEQ ID NO: 201492 - RNA, 32 nt, Human
ggguggcaccugccaggccaagggucagggug

SEQ ID NO: 201493 - RNA, 32 nt, Human
ggguggcaccugccucucccaccuccagucuu

SEQ ID NO: 201494 - RNA, 19 nt, Human
ggguggcacggaggggcug

SEQ ID NO: 201495 - RNA, 32 nt, Human
ggguggcacugagcuaugagucccggggaugg

SEQ ID NO: 201496 - RNA, 32 nt, Human
ggguggcacugccacaucccacuggcagaaac

SEQ ID NO: 201497 - RNA, 32 nt, Human
ggguggcagaagcagcaggugacaggagcagg

SEQ ID NO: 201498 - RNA, 24 nt, Human
ggguggcagagcgagacccugucu

SEQ ID NO: 201499 - RNA, 32 nt, Human
ggguggcagaggagaagaaucgcuugaaccug

SEQ ID NO: 201500 - RNA, 32 nt, Human
ggguggcagaggauuguuuggccaggucugug

SEQ ID NO: 201501 - RNA, 32 nt, Human
ggguggcagaggucucuuugcuucauucagcc

SEQ ID NO: 201502 - RNA, 24 nt, Human
ggguggcagagugagacccugucu

SEQ ID NO: 201503 - RNA, 24 nt, Human
ggguggcagagugagacucugucu

SEQ ID NO: 201504 - RNA, 32 nt, Human
ggguggcagcagccagaggaggaauauggcgc

SEQ ID NO: 201505 - RNA, 32 nt, Human
ggguggcagccccaggcucuuugcauaauccu

SEQ ID NO: 201506 - RNA, 32 nt, Human
ggguggcagcgcccagccuggccccaagcaug

SEQ ID NO: 201507 - RNA, 32 nt, Human
ggguggcagggacuggagucaguuggagagug

SEQ ID NO: 201508 - RNA, 32 nt, Human
ggguggcauccaggcugcccguguguugcacc

SEQ ID NO: 201509 - RNA, 32 nt, Human
ggguggccaaggggcguuuccucugcuuuugg

SEQ ID NO: 201510 - RNA, 32 nt, Human
ggguggccacaccucuaucccggcuuuggugc

SEQ ID NO: 201511 - RNA, 19 nt, Human
ggguggccaccccuccuua

SEQ ID NO: 201512 - RNA, 32 nt, Human
ggguggccacgucacaaccucugaucucagac

SEQ ID NO: 201513 - RNA, 32 nt, Human
ggguggccagaaacuaaacagcaaaagcaaag

SEQ ID NO: 201514 - RNA, 32 nt, Human
ggguggccagaagucccugcgguccuacuggc

SEQ ID NO: 201515 - RNA, 32 nt, Human
ggguggccagccaagaggacguggggcaggug

SEQ ID NO: 201516 - RNA, 32 nt, Human
ggguggccagggguggugagggcaguucugca

SEQ ID NO: 201517 - RNA, 24 nt, Human
ggguggccaguuuccauguggcuu

SEQ ID NO: 201518 - RNA, 20 nt, Human
ggguggcccacccauuucca

SEQ ID NO: 201519 - RNA, 32 nt, Human
ggguggccccuccagugcgcuccccagagcag

SEQ ID NO: 201520 - RNA, 32 nt, Human
ggguggcccuggaauguguagaagggguguca

SEQ ID NO: 201521 - RNA, 32 nt, Human
ggguggcccuggcagaaccacugccugaagaa

SEQ ID NO: 201522 - RNA, 23 nt, Human
ggguggccgaggcaggaagauca

SEQ ID NO: 201523 - RNA, 32 nt, Human
ggguggccuccaggccaagggcuugggcccca

SEQ ID NO: 201524 - RNA, 32 nt, Human
ggguggccuccccucugucugccugguggagg

SEQ ID NO: 201525 - RNA, 32 nt, Human
ggguggccugggcggaggcuaugguggggcca

SEQ ID NO: 201526 - RNA, 32 nt, Human
ggguggccuugggaggagagggccaggcuguc

SEQ ID NO: 201527 - RNA, 32 nt, Human
ggguggcgcgccugccuuuucuaguuuuauac

SEQ ID NO: 201528 - RNA, 32 nt, Human
ggguggcggccaggaggaaaggcagaaagggg

SEQ ID NO: 201529 - RNA, 32 nt, Human
ggguggcggcccuggggauggggaaggagcag

SEQ ID NO: 201530 - RNA, 32 nt, Human
ggguggcggcuccggcggaugucaggaaugcu

SEQ ID NO: 201531 - RNA, 32 nt, Human
ggguggcgugugugugccacauauuuccccgu

SEQ ID NO: 201532 - RNA, 32 nt, Human
ggguggcuacagugucaauggaggaucugggg

SEQ ID NO: 201533 - RNA, 32 nt, Human
ggguggcuaugcaggaaggagccaaagagggg

SEQ ID NO: 201534 - RNA, 18 nt, Human
ggguggcucacacacucu

SEQ ID NO: 201535 - RNA, 32 nt, Human
ggguggcucauuuccuggccgcuccugggcuu

SEQ ID NO: 201536 - RNA, 32 nt, Human
ggguggcucggcucgggaggcuugggacccca

SEQ ID NO: 201537 - RNA, 32 nt, Human
ggguggcucugccucaucacccagcaagccug

SEQ ID NO: 201538 - RNA, 32 nt, Human
ggguggcucugggagcaguugugcugcgggcu

SEQ ID NO: 201539 - RNA, 32 nt, Human
ggguggcucuguccuaccuccacucucugccc

SEQ ID NO: 201540 - RNA, 32 nt, Human
ggguggcugaccccaugcucagccucuagggg

SEQ ID NO: 201541 - RNA, 32 nt, Human
ggguggcugcagauggagcagcuuggacuuua

SEQ ID NO: 201542 - RNA, 19 nt, Human
ggguggcugcccucagggg

SEQ ID NO: 201543 - RNA, 21 nt, Human
ggguggcugcgucugaaggcu

SEQ ID NO: 201544 - RNA, 32 nt, Human
ggguggcugcugcuucccuugugcacuugggu

SEQ ID NO: 201545 - RNA, 32 nt, Human
ggguggcuggcagaggggacccccaggagccu

SEQ ID NO: 201546 - RNA, 32 nt, Human
ggguggcugggaggggaagggaagggagaggc

SEQ ID NO: 201547 - RNA, 20 nt, Human
ggguggcugggguaggggcu

SEQ ID NO: 201548 - RNA, 16 nt, Human
ggguggcugggugggg

SEQ ID NO: 201549 - RNA, 32 nt, Human
ggguggcuguggggcguggcaggaggggccua

SEQ ID NO: 201550 - RNA, 32 nt, Human
ggguggcuuccaagccucacuucuccaguguu

SEQ ID NO: 201551 - RNA, 32 nt, Human
ggguggcuuccaguggucuucagucugucgug

SEQ ID NO: 201552 - RNA, 27 nt, Human
gggugggaaagacucaaaggggcgcuu

SEQ ID NO: 201553 - RNA, 32 nt, Human
gggugggaaaggcuuuaucagguaucaucaac

SEQ ID NO: 201554 - RNA, 32 nt, Human
gggugggaagagggccaucugccugaauguaa

SEQ ID NO: 201555 - RNA, 32 nt, Human
gggugggaagggaagagagggauaagaaaaua

SEQ ID NO: 201556 - RNA, 21 nt, Human
gggugggaagggagaagcaga

SEQ ID NO: 201557 - RNA, 32 nt, Human
gggugggaagggagccuucucaguccucucuc

SEQ ID NO: 201558 - RNA, 32 nt, Human
gggugggaaguguggcugguaaccuggcagcc

SEQ ID NO: 201559 - RNA, 32 nt, Human
gggugggaauuguucaagaaaaaccugggaga

SEQ ID NO: 201560 - RNA, 32 nt, Human
gggugggaccacugcaagcucgagaccuugcu

SEQ ID NO: 201561 - RNA, 32 nt, Human
gggugggacucugcagggguguccuuguccac

SEQ ID NO: 201562 - RNA, 32 nt, Human
gggugggagacagggcuuuuucucucccucug

SEQ ID NO: 201563 - RNA, 32 nt, Human
gggugggagagaagaaaagggaaagaagcuga

SEQ ID NO: 201564 - RNA, 32 nt, Human
gggugggagagccagagcaaagaggcagagau

SEQ ID NO: 201565 - RNA, 32 nt, Human
gggugggagaggagguagauggggaagaaaua

SEQ ID NO: 201566 - RNA, 32 nt, Human
gggugggagagggaagaggagagaaaagacag

SEQ ID NO: 201567 - RNA, 32 nt, Human
gggugggagagggaagcaaugaggaggaucuc

SEQ ID NO: 201568 - RNA, 32 nt, Human
gggugggagaggggagaggagagaguuuggga

SEQ ID NO: 201569 - RNA, 32 nt, Human
gggugggagagugcuacagucuguaugucugu

SEQ ID NO: 201570 - RNA, 32 nt, Human
gggugggagcaguuugaaggaguaagccuggu

SEQ ID NO: 201571 - RNA, 32 nt, Human
gggugggaggagaaggaggaagaggaggaagg

SEQ ID NO: 201572 - RNA, 32 nt, Human
gggugggaggagccagcggccggggagguucu

SEQ ID NO: 201573 - RNA, 32 nt, Human
gggugggaggggacuccaggaggagggaccag

SEQ ID NO: 201574 - RNA, 32 nt, Human
gggugggagggugggagggugggggaacacaa

SEQ ID NO: 201575 - RNA, 32 nt, Human
gggugggagggugggccauggagggcaucuga

SEQ ID NO: 201576 - RNA, 32 nt, Human
gggugggagggugggggaacacaaagagaaaa

SEQ ID NO: 201577 - RNA, 32 nt, Human
gggugggaggguggguacaggccagggauauu

SEQ ID NO: 201578 - RNA, 19 nt, Human
gggugggaggucccggagu

SEQ ID NO: 201579 - RNA, 32 nt, Human
gggugggagguggcaguagucuuagccugugc

SEQ ID NO: 201580 - RNA, 32 nt, Human
gggugggaucggggagcaggaagccugugggc

SEQ ID NO: 201581 - RNA, 32 nt, Human
gggugggaugggaggggguagagggagccagg

SEQ ID NO: 201582 - RNA, 32 nt, Human
gggugggauguggccuuuuggcuggucccguc

SEQ ID NO: 201583 - RNA, 32 nt, Human
gggugggcaaaugcagaagggagccagugucg

SEQ ID NO: 201584 - RNA, 32 nt, Human
gggugggcacccgucaggcugaccagaaggug

SEQ ID NO: 201585 - RNA, 32 nt, Human
gggugggcagagccaccaggaacccagacacc

SEQ ID NO: 201586 - RNA, 19 nt, Human
gggugggcaggcucagaca

SEQ ID NO: 201587 - RNA, 32 nt, Human
gggugggcagggaugcacaaggcucuacucca

SEQ ID NO: 201588 - RNA, 32 nt, Human
gggugggcagggcugggagaacuuuguacagu

SEQ ID NO: 201589 - RNA, 18 nt, Human
gggugggcaggggggcug

SEQ ID NO: 201590 - RNA, 32 nt, Human
gggugggcagucaggguugcaggacuguaaua

SEQ ID NO: 201591 - RNA, 32 nt, Human
gggugggcauagccaaggggguuccagggccg

SEQ ID NO: 201592 - RNA, 32 nt, Human
gggugggcauggaacaggaugggcagagaaag

SEQ ID NO: 201593 - RNA, 32 nt, Human
gggugggccacagccauggugggaguggccug

SEQ ID NO: 201594 - RNA, 32 nt, Human
gggugggccauggagggcaucugaauacagga

SEQ ID NO: 201595 - RNA, 21 nt, Human
gggugggcccacgcugggagg

SEQ ID NO: 201596 - RNA, 32 nt, Human
gggugggcccucaguggugaagcaccgcugcc

SEQ ID NO: 201597 - RNA, 32 nt, Human
gggugggccuagaaaguguccucagcccugcc

SEQ ID NO: 201598 - RNA, 20 nt, Human
gggugggccucaaccaccug

SEQ ID NO: 201599 - RNA, 25 nt, Human
gggugggcgaacccagagggacgcu

SEQ ID NO: 201600 - RNA, 32 nt, Human
gggugggcgaccugggcgggucccaggcacug

SEQ ID NO: 201601 - RNA, 32 nt, Human
gggugggcgcggcaucuucagcgacucuucga

SEQ ID NO: 201602 - RNA, 32 nt, Human
gggugggcgugggccgcacagcgcggcagggc

SEQ ID NO: 201603 - RNA, 21 nt, Human
gggugggcguuuggggcccuc

SEQ ID NO: 201604 - RNA, 32 nt, Human
gggugggcucagcuccagggagaggccaccca

SEQ ID NO: 201605 - RNA, 19 nt, Human
gggugggcugcagcuuccu

SEQ ID NO: 201606 - RNA, 32 nt, Human
gggugggcugggugggguggggaugagggccc

SEQ ID NO: 201607 - RNA, 17 nt, Human
gggugggcuucaggcca

SEQ ID NO: 201608 - RNA, 32 nt, Human
gggugggcuuggcugcagccgccagccccgug

SEQ ID NO: 201609 - RNA, 32 nt, Human
gggugggcuuuggucuuagcacuuuccuucuc

SEQ ID NO: 201610 - RNA, 32 nt, Human
ggguggggaaacucuuaacaccuuccagauac

SEQ ID NO: 201611 - RNA, 32 nt, Human
ggguggggaaaggggcaaaaagaaugaucuua

SEQ ID NO: 201612 - RNA, 32 nt, Human
ggguggggaagagagacgucagcgggaccuga

SEQ ID NO: 201613 - RNA, 32 nt, Human
ggguggggaaggaggucacagccaagaaaacu

SEQ ID NO: 201614 - RNA, 32 nt, Human
ggguggggaaggcugagcaaagggggagcagc

SEQ ID NO: 201615 - RNA, 32 nt, Human
ggguggggaaggggugucucaccugagcugac

SEQ ID NO: 201616 - RNA, 32 nt, Human
ggguggggacaggccagugacgaagagaggga

SEQ ID NO: 201617 - RNA, 32 nt, Human
ggguggggaccagcuggccacauggugcugcu

SEQ ID NO: 201618 - RNA, 32 nt, Human
ggguggggagaaaagacuuuaagggaggagag

SEQ ID NO: 201619 - RNA, 20 nt, Human
ggguggggagaaccacacua

SEQ ID NO: 201620 - RNA, 32 nt, Human
ggguggggagaagcaugaagcagugagcagag

SEQ ID NO: 201621 - RNA, 32 nt, Human
ggguggggagaaggggaggaggccucggccgg

SEQ ID NO: 201622 - RNA, 32 nt, Human
ggguggggagagaggguggaggguuuuauaaa

SEQ ID NO: 201623 - RNA, 32 nt, Human
ggguggggagagcacucucagcagggaacggc

SEQ ID NO: 201624 - RNA, 32 nt, Human
ggguggggagccaaggguggacuuuaagcaug

SEQ ID NO: 201625 - RNA, 32 nt, Human
ggguggggagcuggcagggcagaggagguagu

SEQ ID NO: 201626 - RNA, 32 nt, Human
ggguggggagcuggggcaagaugaggcaccag

SEQ ID NO: 201627 - RNA, 32 nt, Human
ggguggggaggcaggugagaccacucacggca

SEQ ID NO: 201628 - RNA, 32 nt, Human
ggguggggaggcaucccauccagccucagagg

SEQ ID NO: 201629 - RNA, 32 nt, Human
ggguggggaggcgagagcagcuuagccuccuc

SEQ ID NO: 201630 - RNA, 32 nt, Human
ggguggggaugaagaauugacugggagcugag

SEQ ID NO: 201631 - RNA, 32 nt, Human
ggguggggcagccccaagccuccuggggaggc

SEQ ID NO: 201632 - RNA, 32 nt, Human
ggguggggccagaugggagggagcugguggga

SEQ ID NO: 201633 - RNA, 32 nt, Human
ggguggggcccacuccaugaagacagcaguca

SEQ ID NO: 201634 - RNA, 32 nt, Human
ggguggggcccagggaggauggggagggagug

SEQ ID NO: 201635 - RNA, 32 nt, Human
ggguggggccuguaugugcccucugcccucag

SEQ ID NO: 201636 - RNA, 32 nt, Human
ggguggggcuccugccugcuccauggagcaga

SEQ ID NO: 201637 - RNA, 32 nt, Human
ggguggggcugcaggcagucuacuggcaggac

SEQ ID NO: 201638 - RNA, 32 nt, Human
gggugggggaacaaaccccuaugcacuuuucu

SEQ ID NO: 201639 - RNA, 32 nt, Human
gggugggggaggaucacggggucaggagaucg

SEQ ID NO: 201640 - RNA, 32 nt, Human
gggugggggaggcaggaggaggcugagcguag

SEQ ID NO: 201641 - RNA, 32 nt, Human
gggugggggagggagagggcaguuuguaguau

SEQ ID NO: 201642 - RNA, 32 nt, Human
gggugggggcagccuccaccuccuggauucaa

SEQ ID NO: 201643 - RNA, 32 nt, Human
gggugggggcauuggucacauaugaccaguaa

SEQ ID NO: 201644 - RNA, 32 nt, Human
gggugggggccagaggauucagggccggaggu

SEQ ID NO: 201645 - RNA, 32 nt, Human
gggugggggccucgcauucagugcgaguggcu

SEQ ID NO: 201646 - RNA, 32 nt, Human
gggugggggcuacuaugcugggaaaggccagg

SEQ ID NO: 201647 - RNA, 32 nt, Human
gggugggggcuagagaggaagcagggaguauc

SEQ ID NO: 201648 - RNA, 32 nt, Human
gggugggggcuggggcggcagguguccucguc

SEQ ID NO: 201649 - RNA, 32 nt, Human
gggugggggcuguccugcucaccugugugccc

SEQ ID NO: 201650 - RNA, 32 nt, Human
gggugggggcuguggcccugcccuuggcacca

SEQ ID NO: 201651 - RNA, 31 nt, Human
gggugggggcuucucccucuacccagggcug

SEQ ID NO: 201652 - RNA, 32 nt, Human
gggugggggucugccauucccucccccaggcc

SEQ ID NO: 201653 - RNA, 32 nt, Human
gggugggggugagggcagaaccagccgaggga

SEQ ID NO: 201654 - RNA, 32 nt, Human
gggugggggugaggucauauaguucaaacuaa

SEQ ID NO: 201655 - RNA, 32 nt, Human
ggguggggguggaucacuugaggucaggaguu

SEQ ID NO: 201656 - RNA, 32 nt, Human
gggugggguacaaccaccaugacaacugccgg

SEQ ID NO: 201657 - RNA, 32 nt, Human
gggugggguacacagacacagggugggggugg

SEQ ID NO: 201658 - RNA, 32 nt, Human
gggugggguaggcagaugggccaaggugacca

SEQ ID NO: 201659 - RNA, 32 nt, Human
ggguggggucauagggucacuucaccugaccc

SEQ ID NO: 201660 - RNA, 32 nt, Human
ggguggggucuggaacuugucggguuggacag

SEQ ID NO: 201661 - RNA, 20 nt, Human
ggguggggugaguggaagaa

SEQ ID NO: 201662 - RNA, 32 nt, Human
ggguggggugggaguagguagagcugagaaua

SEQ ID NO: 201663 - RNA, 32 nt, Human
ggguggggugggggcagaggagaggcggauac

SEQ ID NO: 201664 - RNA, 32 nt, Human
gggugggguggggguguauuccuugggggaug

SEQ ID NO: 201665 - RNA, 32 nt, Human
gggugggguuucaccugcgaacaucagacuga

SEQ ID NO: 201666 - RNA, 32 nt, Human
ggguggguaagcccaggauuugcacaugaccu

SEQ ID NO: 201667 - RNA, 32 nt, Human
ggguggguauccagauggucccaugaguaggg

SEQ ID NO: 201668 - RNA, 32 nt, Human
gggugggucaccagcagaagaagccgaacccc

SEQ ID NO: 201669 - RNA, 32 nt, Human
gggugggucugccucucccagcccacugacuc

SEQ ID NO: 201670 - RNA, 32 nt, Human
gggugggugcugcugagggauugggcuucuag

SEQ ID NO: 201671 - RNA, 32 nt, Human
ggguggguggagcuggggagggcaugggcagg

SEQ ID NO: 201672 - RNA, 32 nt, Human
ggguggguggagggguuugcagugugggaaug

SEQ ID NO: 201673 - RNA, 32 nt, Human
ggguggguggggagcuuuuggggaggacaggu

SEQ ID NO: 201674 - RNA, 32 nt, Human
ggguggguggguagguagacaguuugaugaua

SEQ ID NO: 201675 - RNA, 32 nt, Human
ggguggguggguggauaucuuaauuuuuauuu

SEQ ID NO: 201676 - RNA, 32 nt, Human
ggguggguggguggggaagaaaugggcccagc

SEQ ID NO: 201677 - RNA, 32 nt, Human
gggugggugguggaggcugcgagggugcacgg

SEQ ID NO: 201678 - RNA, 32 nt, Human
ggguggguguggggacgcgggagccagugucg

SEQ ID NO: 201679 - RNA, 32 nt, Human
gggugggugugugguccauguucagcguucua

SEQ ID NO: 201680 - RNA, 22 nt, Human
gggugguagugugacccugccu

SEQ ID NO: 201681 - RNA, 32 nt, Human
ggguggucaacagaaaccccaucccugcccau

SEQ ID NO: 201682 - RNA, 19 nt, Human
ggguggucaggaaccaccu

SEQ ID NO: 201683 - RNA, 32 nt, Human
gggugguccuguuucuagacauggaagcuuag

SEQ ID NO: 201684 - RNA, 32 nt, Human
ggguggucucaaacuccugaccugaggcgauc

SEQ ID NO: 201685 - RNA, 32 nt, Human
ggguggucucaaacuccugggcucaagcgaac

SEQ ID NO: 201686 - RNA, 32 nt, Human
ggguggucucaaacuccugggcucaagugauc

SEQ ID NO: 201687 - RNA, 32 nt, Human
ggguggucucaaacuccugugcucaagugacc

SEQ ID NO: 201688 - RNA, 32 nt, Human
ggguggucuguaacuccugagcucagaugauc

SEQ ID NO: 201689 - RNA, 32 nt, Human
ggguggucuuuagcacaaagacuugcaugcag

SEQ ID NO: 201690 - RNA, 32 nt, Human
ggguggugaccccaggagggaggcaggggagg

SEQ ID NO: 201691 - RNA, 32 nt, Human
ggguggugcaccuggcagggguccuugaguga

SEQ ID NO: 201692 - RNA, 32 nt, Human
ggguggugcaggcucccaaacucaggcuuuca

SEQ ID NO: 201693 - RNA, 32 nt, Human
ggguggugccacugcgcuccagccugggggag

SEQ ID NO: 201694 - RNA, 32 nt, Human
ggguggugccuggccugggaggucaguggaua

SEQ ID NO: 201695 - RNA, 32 nt, Human
ggguggugcuauaauguggcacuggaucuuga

SEQ ID NO: 201696 - RNA, 19 nt, Human
gggugguggagaggagagg

SEQ ID NO: 201697 - RNA, 32 nt, Human
gggugguggaggcagccuucagugagcaugga

SEQ ID NO: 201698 - RNA, 32 nt, Human
gggugguggaggcugcgagggugcacggccgg

SEQ ID NO: 201699 - RNA, 32 nt, Human
gggugguggaggugggcaguggcaccaugacg

SEQ ID NO: 201700 - RNA, 21 nt, Human
ggguggugggaugaugucaua

SEQ ID NO: 201701 - RNA, 32 nt, Human
ggguggugggcgucugaaaagucgccaccaug

SEQ ID NO: 201702 - RNA, 32 nt, Human
gggugguggggugggagcuacuagauagaaca

SEQ ID NO: 201703 - RNA, 31 nt, Human
ggguggugggugggguggggugggcauggaa

SEQ ID NO: 201704 - RNA, 32 nt, Human
ggguggugguggugguggaggugcagaagaag

SEQ ID NO: 201705 - RNA, 32 nt, Human
ggguggugguuccaaugagacagggcacacca

SEQ ID NO: 201706 - RNA, 32 nt, Human
ggguggugugccaggaccucaggcugggccuu

SEQ ID NO: 201707 - RNA, 32 nt, Human
gggugguuauguuugcaugcuuaagcacacau

SEQ ID NO: 201708 - RNA, 20 nt, Human
gggugguuggggauggggug

SEQ ID NO: 201709 - RNA, 32 nt, Human
gggugguuguaaggcuggauugaaauaugcau

SEQ ID NO: 201710 - RNA, 32 nt, Human
gggugguugucuauuugucugucuucagucuu

SEQ ID NO: 201711 - RNA, 32 nt, Human
ggguguaaaaccagagauuauuuguaugcuca

SEQ ID NO: 201712 - RNA, 23 nt, Human
ggguguagaccggaauccugcug

SEQ ID NO: 201713 - RNA, 32 nt, Human
ggguguagagagaauggaggggaccaaaaaga

SEQ ID NO: 201714 - RNA, 32 nt, Human
ggguguaggaagaggggugagggguaguuuuu

SEQ ID NO: 201715 - RNA, 17 nt, Human
ggguguaggagggggug

SEQ ID NO: 201716 - RNA, 32 nt, Human
ggguguagguuucugaggugugccauuggggc

SEQ ID NO: 201717 - RNA, 23 nt, Human
ggguguaguggcucacgccugua

SEQ ID NO: 201718 - RNA, 23 nt, Human
ggguguaguggcucaugccugua

SEQ ID NO: 201719 - RNA, 23 nt, Human
ggguguaguggcucaugcuugua

SEQ ID NO: 201720 - RNA, 32 nt, Human
gggugucaaaagaaauugcucucugaugaggc

SEQ ID NO: 201721 - RNA, 32 nt, Human
gggugucaacucccuggaaaacagugaaguga

SEQ ID NO: 201722 - RNA, 32 nt, Human
gggugucacacagcaggcacacagcaggggcu

SEQ ID NO: 201723 - RNA, 20 nt, Human
gggugucacagagccugccg

SEQ ID NO: 201724 - RNA, 23 nt, Human
gggugucacccagucccacaagc

SEQ ID NO: 201725 - RNA, 32 nt, Human
gggugucagcccugaaggagaacucacuucag

SEQ ID NO: 201726 - RNA, 17 nt, Human
gggugucaggaaggcag

SEQ ID NO: 201727 - RNA, 32 nt, Human
gggugucaggacagugaggcugagaugacaga

SEQ ID NO: 201728 - RNA, 23 nt, Human
gggugucauugugcauaccugua

SEQ ID NO: 201729 - RNA, 32 nt, Human
ggguguccaggcucccauccauggcccagccc

SEQ ID NO: 201730 - RNA, 32 nt, Human
ggguguccaguuacaggagcugagcacacugg

SEQ ID NO: 201731 - RNA, 32 nt, Human
ggguguccaugugcacccggccuggaugccag

SEQ ID NO: 201732 - RNA, 18 nt, Human
gggugucccaggagcccu

SEQ ID NO: 201733 - RNA, 17 nt, Human
gggugucccggagcccu

SEQ ID NO: 201734 - RNA, 32 nt, Human
gggugucccugggagcccuggaaaugugcaua

SEQ ID NO: 201735 - RNA, 24 nt, Human
ggguguccgaguugccgccggaga

SEQ ID NO: 201736 - RNA, 17 nt, Human
ggguguccggggacccu

SEQ ID NO: 201737 - RNA, 32 nt, Human
ggguguccucaccccuucccuggccucugggc

SEQ ID NO: 201738 - RNA, 32 nt, Human
ggguguccugcaccggggccugggcaggaggg

SEQ ID NO: 201739 - RNA, 32 nt, Human
ggguguccugcagugguguugaagcucugggg

SEQ ID NO: 201740 - RNA, 32 nt, Human
ggguguccugggcugaauuuccugggcacuuc

SEQ ID NO: 201741 - RNA, 32 nt, Human
ggguguccuguugauugaggggagacagcaug

SEQ ID NO: 201742 - RNA, 32 nt, Human
gggugucgagcccucuggcagaggguuaaccu

SEQ ID NO: 201743 - RNA, 32 nt, Human
gggugucgcaguuaaagucagaggagacaagc

SEQ ID NO: 201744 - RNA, 32 nt, Human
gggugucuauguccaagucaccccuacucagc

SEQ ID NO: 201745 - RNA, 19 nt, Human
gggugucucagggucccuc

SEQ ID NO: 201746 - RNA, 32 nt, Human
gggugucucagguucuguguguccuugugugc

SEQ ID NO: 201747 - RNA, 32 nt, Human
gggugucucuagccugcagagugcagugagug

SEQ ID NO: 201748 - RNA, 18 nt, Human
gggugucugcccccuccu

SEQ ID NO: 201749 - RNA, 32 nt, Human
gggugucugccucuucccuccaccuccucccc

SEQ ID NO: 201750 - RNA, 32 nt, Human
gggugucugcuagccucaaccuccuggggcag

SEQ ID NO: 201751 - RNA, 19 nt, Human
gggugucuggccucagaga

SEQ ID NO: 201752 - RNA, 32 nt, Human
gggugucuguauccugcaggaggacgccccua

SEQ ID NO: 201753 - RNA, 32 nt, Human
gggugucuuguccugucccagggccaaacccc

SEQ ID NO: 201754 - RNA, 32 nt, Human
gggugucuuuucucccugggccuggugaccuc

SEQ ID NO: 201755 - RNA, 23 nt, Human
gggugugaagaggaggagggaga

SEQ ID NO: 201756 - RNA, 32 nt, Human
gggugugacucugaggaagccuuuuuaauucu

SEQ ID NO: 201757 - RNA, 32 nt, Human
gggugugacugauucccagccuguggcagggc

SEQ ID NO: 201758 - RNA, 21 nt, Human
gggugugagacggcggggcgg

SEQ ID NO: 201759 - RNA, 32 nt, Human
gggugugagaugggugccuccccucugccucc

SEQ ID NO: 201760 - RNA, 32 nt, Human
gggugugagccagggagguguggaagucaccu

SEQ ID NO: 201761 - RNA, 32 nt, Human
gggugugagccucccuucuccucaagccggag

SEQ ID NO: 201762 - RNA, 32 nt, Human
gggugugaggccccagccuggagccaggcacu

SEQ ID NO: 201763 - RNA, 32 nt, Human
gggugugaggccuggccugggcccagaugcug

SEQ ID NO: 201764 - RNA, 32 nt, Human
gggugugaguggggugguugggaguggugcca

SEQ ID NO: 201765 - RNA, 32 nt, Human
gggugugcaaccugggcuccucugccucacug

SEQ ID NO: 201766 - RNA, 32 nt, Human
gggugugcagagcugagguugccacacaccug

SEQ ID NO: 201767 - RNA, 32 nt, Human
gggugugccaggagaagggcaugaagcgagga

SEQ ID NO: 201768 - RNA, 23 nt, Human
gggugugcccugcaccugccucu

SEQ ID NO: 201769 - RNA, 19 nt, Human
gggugugccgggcuggcug

SEQ ID NO: 201770 - RNA, 32 nt, Human
gggugugccuguagucccagcuacuugagagg

SEQ ID NO: 201771 - RNA, 32 nt, Human
gggugugcgcugaacuuugggccccgcgggag

SEQ ID NO: 201772 - RNA, 32 nt, Human
ggguguggaagaggaaagugugaagcaaggga

SEQ ID NO: 201773 - RNA, 24 nt, Human
ggguguggaagggcaagcugcacc

SEQ ID NO: 201774 - RNA, 32 nt, Human
ggguguggacccagacguggaguggagugauu

SEQ ID NO: 201775 - RNA, 32 nt, Human
ggguguggagagaaucaggugagccacagagc

SEQ ID NO: 201776 - RNA, 19 nt, Human
ggguguggaggaagggagg

SEQ ID NO: 201777 - RNA, 32 nt, Human
ggguguggaggaggggaagggaggaaugggcc

SEQ ID NO: 201778 - RNA, 32 nt, Human
ggguguggaggcagugggaugaacugggggac

SEQ ID NO: 201779 - RNA, 32 nt, Human
ggguguggagugaaagagucacuguggugggg

SEQ ID NO: 201780 - RNA, 32 nt, Human
ggguguggaguggggaggagccugggcagccu

SEQ ID NO: 201781 - RNA, 21 nt, Human
ggguguggauaagacucugcc

SEQ ID NO: 201782 - RNA, 32 nt, Human
ggguguggccccagggcgguucuuggauguaa

SEQ ID NO: 201783 - RNA, 23 nt, Human
ggguguggcggugcacgccugua

SEQ ID NO: 201784 - RNA, 19 nt, Human
ggguguggcgguugccgua

SEQ ID NO: 201785 - RNA, 32 nt, Human
ggguguggcugggccugucacccuggggcccu

SEQ ID NO: 201786 - RNA, 32 nt, Human
ggguguggcuucuguggcuuucauuugaguau

SEQ ID NO: 201787 - RNA, 31 nt, Human
gggugugggagcagagaaaauugugaaagug

SEQ ID NO: 201788 - RNA, 32 nt, Human
ggguguggggaaaugaguuuucuuugauaguu

SEQ ID NO: 201789 - RNA, 32 nt, Human
ggguguggggaucagacaggcuuuuguaugug

SEQ ID NO: 201790 - RNA, 32 nt, Human
gggugugggggcccugggugaaugcugcugcc

SEQ ID NO: 201791 - RNA, 18 nt, Human
ggguguggggguggagug

SEQ ID NO: 201792 - RNA, 32 nt, Human
ggguguggggucuggcuuuguacauaacucau

SEQ ID NO: 201793 - RNA, 17 nt, Human
gggugugggguggggug

SEQ ID NO: 201794 - RNA, 32 nt, Human
ggguguggggugugggcuggaagcacuggcuc

SEQ ID NO: 201795 - RNA, 23 nt, Human
gggugugguagugcaugccugua

SEQ ID NO: 201796 - RNA, 32 nt, Human
ggguguggucucucagcuguucugcccucaua

SEQ ID NO: 201797 - RNA, 23 nt, Human
ggguguggugacucacagccgua

SEQ ID NO: 201798 - RNA, 32 nt, Human
ggguguggugcuggcuagaggucccugccccu

SEQ ID NO: 201799 - RNA, 32 nt, Human
gggugugguggaggggaaggccacgugcucca

SEQ ID NO: 201800 - RNA, 23 nt, Human
gggugugguggcaaaugccugua

SEQ ID NO: 201801 - RNA, 23 nt, Human
gggugugguggcacacaccagua

SEQ ID NO: 201802 - RNA, 23 nt, Human
gggugugguggcacacaccugua

SEQ ID NO: 201803 - RNA, 23 nt, Human
gggugugguggcacacgccugua

SEQ ID NO: 201804 - RNA, 23 nt, Human
gggugugguggcacaugccugua

SEQ ID NO: 201805 - RNA, 23 nt, Human
gggugugguggcacuucucugua

SEQ ID NO: 201806 - RNA, 23 nt, Human
gggugugguggcagacaccugug

SEQ ID NO: 201807 - RNA, 23 nt, Human
gggugugguggcaggcaccugua

SEQ ID NO: 201808 - RNA, 23 nt, Human
gggugugguggcaugcaccugua

SEQ ID NO: 201809 - RNA, 23 nt, Human
gggugugguggcaugcaucugua

SEQ ID NO: 201810 - RNA, 23 nt, Human
gggugugguggcgagcaccugua

SEQ ID NO: 201811 - RNA, 23 nt, Human
gggugugguggcgcacgccugua

SEQ ID NO: 201812 - RNA, 23 nt, Human
gggugugguggcgcaugccugua

SEQ ID NO: 201813 - RNA, 23 nt, Human
gggugugguggcgcgugcuugua

SEQ ID NO: 201814 - RNA, 23 nt, Human
gggugugguggcgggcgccugua

SEQ ID NO: 201815 - RNA, 23 nt, Human
gggugugguggcgggugccugua

SEQ ID NO: 201816 - RNA, 23 nt, Human
gggugugguggcgugcgccugua

SEQ ID NO: 201817 - RNA, 23 nt, Human
gggugugguggcucacaccugua

SEQ ID NO: 201818 - RNA, 23 nt, Human
gggugugguggcucacgccugua

SEQ ID NO: 201819 - RNA, 23 nt, Human
gggugugguggcucaugccugua

SEQ ID NO: 201820 - RNA, 20 nt, Human
gggugugguggcugaugccu

SEQ ID NO: 201821 - RNA, 23 nt, Human
gggugugguggcuggcgccugua

SEQ ID NO: 201822 - RNA, 32 nt, Human
ggguguggugggcaccuguaguuccagcuacu

SEQ ID NO: 201823 - RNA, 23 nt, Human
ggguguggugguaggcaccugua

SEQ ID NO: 201824 - RNA, 22 nt, Human
gggugugguggugcacaccugu

SEQ ID NO: 201825 - RNA, 23 nt, Human
gggugugguggugcaugccugua

SEQ ID NO: 201826 - RNA, 22 nt, Human
gggugugguggugggcaccugu

SEQ ID NO: 201827 - RNA, 23 nt, Human
gggugugguggugggcaccugua

SEQ ID NO: 201828 - RNA, 23 nt, Human
gggugugguggugggcaccugug

SEQ ID NO: 201829 - RNA, 23 nt, Human
ggguguggugguucacaccugua

SEQ ID NO: 201830 - RNA, 23 nt, Human
ggguguggugucgggcaccugua

SEQ ID NO: 201831 - RNA, 23 nt, Human
gggugugguguugaguaucugua

SEQ ID NO: 201832 - RNA, 23 nt, Human
gggugugguguugggcaccugua

SEQ ID NO: 201833 - RNA, 32 nt, Human
ggguguguaccacugccucuggcuuuauuuug

SEQ ID NO: 201834 - RNA, 18 nt, Human
ggguguguagguggggag

SEQ ID NO: 201835 - RNA, 21 nt, Human
ggguguguauccaucuggcug

SEQ ID NO: 201836 - RNA, 20 nt, Human
ggguguguaucuuaauguug

SEQ ID NO: 201837 - RNA, 32 nt, Human
gggugugugaguggcuaugauccuaguugucc

SEQ ID NO: 201838 - RNA, 32 nt, Human
gggugugugcugcguucacagguguuucugcg

SEQ ID NO: 201839 - RNA, 32 nt, Human
ggguguguuugcucuuuuccaugcccaugcaa

SEQ ID NO: 201840 - RNA, 32 nt, Human
ggguguguuugggaagcagcugcccacagcuc

SEQ ID NO: 201841 - RNA, 32 nt, Human
ggguguuagagaaugagagggaaagagagaga

SEQ ID NO: 201842 - RNA, 32 nt, Human
ggguguuagcacugugguggucucugguccac

SEQ ID NO: 201843 - RNA, 32 nt, Human
ggguguuagcuccaaagagaugccauugcuga

SEQ ID NO: 201844 - RNA, 32 nt, Human
ggguguucagaggcagcaccaccacacaguca

SEQ ID NO: 201845 - RNA, 32 nt, Human
ggguguucccagcagcccuggcuugggggcuu

SEQ ID NO: 201846 - RNA, 32 nt, Human
ggguguuccggcagggcaggaugggaaggcgu

SEQ ID NO: 201847 - RNA, 32 nt, Human
ggguguuccucagagaucccccaaacuggggu

SEQ ID NO: 201848 - RNA, 32 nt, Human
ggguguucgagaagaccagggaagggacccuu

SEQ ID NO: 201849 - RNA, 18 nt, Human
ggguguucgcggggcccu

SEQ ID NO: 201850 - RNA, 32 nt, Human
ggguguugagccacucugacucagccaauaau

SEQ ID NO: 201851 - RNA, 32 nt, Human
ggguguugccagguguggcuggggaagggucu

SEQ ID NO: 201852 - RNA, 32 nt, Human
ggguguugcuuuuccucuuaagggccucagaa

SEQ ID NO: 201853 - RNA, 32 nt, Human
ggguguugggaugggauaucagaggaagaagc

SEQ ID NO: 201854 - RNA, 32 nt, Human
ggguguugggggagacaggagagagaucccac

SEQ ID NO: 201855 - RNA, 24 nt, Human
ggguguugguucagaauggcacuu

SEQ ID NO: 201856 - RNA, 32 nt, Human
ggguguugucugcagaaccaccaccuugaaag

SEQ ID NO: 201857 - RNA, 32 nt, Human
ggguguuguucuggcccucaccugccggcgcc

SEQ ID NO: 201858 - RNA, 19 nt, Human
ggguguuguugaagggagg

SEQ ID NO: 201859 - RNA, 21 nt, Human
ggguguuguuuucuccugagg

SEQ ID NO: 201860 - RNA, 32 nt, Human
ggguguuucuaaagcaacuccccaccaaccuc

SEQ ID NO: 201861 - RNA, 32 nt, Human
ggguguuuucagaaagaugaagaagaaaacau

SEQ ID NO: 201862 - RNA, 32 nt, Human
ggguguuuucauuuuggguuuguuucuucuac

SEQ ID NO: 201863 - RNA, 32 nt, Human
ggguuaaaaacauuuuggaaaauaugauuuua

SEQ ID NO: 201864 - RNA, 32 nt, Human
ggguuaaaaagcuaccuauugaauacuauguu

SEQ ID NO: 201865 - RNA, 32 nt, Human
ggguuaaagcugccuccagccucaggagcagu

SEQ ID NO: 201866 - RNA, 22 nt, Human
ggguuaaauucccuuggucuuu

SEQ ID NO: 201867 - RNA, 32 nt, Human
ggguuaacaucuguguuaggggaggucaccuu

SEQ ID NO: 201868 - RNA, 32 nt, Human
ggguuaagagcaggacguuugagguugcacag

SEQ ID NO: 201869 - RNA, 32 nt, Human
ggguuaagagcucagaguucagacagguccaa

SEQ ID NO: 201870 - RNA, 31 nt, Human
ggguuaagugagaggagacuguacuuuguuu

SEQ ID NO: 201871 - RNA, 32 nt, Human
ggguuaauacagaugacccagaccugacauua

SEQ ID NO: 201872 - RNA, 32 nt, Human
ggguuaaugucagguaagaaacuugaguggac

SEQ ID NO: 201873 - RNA, 32 nt, Human
ggguuaauuacugccauuccuuucuaagugug

SEQ ID NO: 201874 - RNA, 32 nt, Human
ggguuacaccuguaaucccagcacuuugggag

SEQ ID NO: 201875 - RNA, 19 nt, Human
ggguuacaggcaugagcca

SEQ ID NO: 201876 - RNA, 32 nt, Human
ggguuacaggcaugcaccaccaugccuggcua

SEQ ID NO: 201877 - RNA, 20 nt, Human
ggguuaccccacaagggggc

SEQ ID NO: 201878 - RNA, 32 nt, Human
ggguuacccugggcacuggccuagagccucac

SEQ ID NO: 201879 - RNA, 24 nt, Human
ggguuacggagugagacuccgucu

SEQ ID NO: 201880 - RNA, 32 nt, Human
ggguuacgggcagaggagaaagcacaugccaa

SEQ ID NO: 201881 - RNA, 32 nt, Human
ggguuacugcaaccucugccccucgggauuca

SEQ ID NO: 201882 - RNA, 32 nt, Human
ggguuacuggaagccgggacugcuagggcugg

SEQ ID NO: 201883 - RNA, 32 nt, Human
ggguuagacccuguucagagguguggccaauu

SEQ ID NO: 201884 - RNA, 32 nt, Human
ggguuagaccuacagggggucuggcugguguu

SEQ ID NO: 201885 - RNA, 32 nt, Human
ggguuagagccaagcugcacaauuuaauauau

SEQ ID NO: 201886 - RNA, 32 nt, Human
ggguuagaguccauuuacaaagcugccaggaa

SEQ ID NO: 201887 - RNA, 32 nt, Human
ggguuagcagaugccagcagugccugcccgug

SEQ ID NO: 201888 - RNA, 32 nt, Human
ggguuagcagcugcugcauuuccccggcuggc

SEQ ID NO: 201889 - RNA, 32 nt, Human
ggguuagcauuuugcauuagcacuucgaaaua

SEQ ID NO: 201890 - RNA, 32 nt, Human
ggguuagcuugucccuccccucccucuucagc

SEQ ID NO: 201891 - RNA, 32 nt, Human
ggguuaggaagggagaggcagcucuuccuuca

SEQ ID NO: 201892 - RNA, 32 nt, Human
ggguuaggacuacuuaaccucuauucccacuc

SEQ ID NO: 201893 - RNA, 32 nt, Human
ggguuaggagggagcagaugagcccaggauga

SEQ ID NO: 201894 - RNA, 32 nt, Human
ggguuagggaaagcggaggaggaaagcgaggg

SEQ ID NO: 201895 - RNA, 32 nt, Human
ggguuaggggauaaugggagggaaggcagauu

SEQ ID NO: 201896 - RNA, 31 nt, Human
ggguuauacagacagaauaccagccuuuuaa

SEQ ID NO: 201897 - RNA, 32 nt, Human
ggguuauauacuccuagguccugggacagaau

SEQ ID NO: 201898 - RNA, 32 nt, Human
ggguuauaucuggcuucucuccagaccugcuu

SEQ ID NO: 201899 - RNA, 32 nt, Human
ggguuauauuggagagccagucuucugcgguu

SEQ ID NO: 201900 - RNA, 32 nt, Human
ggguuaucaguugcuggcugugccugagcagc

SEQ ID NO: 201901 - RNA, 32 nt, Human
ggguuaucuccucucauacaucaagccccaga

SEQ ID NO: 201902 - RNA, 32 nt, Human
ggguuaugaaaagaagcucagagcagagcacc

SEQ ID NO: 201903 - RNA, 32 nt, Human
ggguuaugaacccaguguagagaccacccacc

SEQ ID NO: 201904 - RNA, 32 nt, Human
ggguuaugagagagccucaaaagagagggcaa

SEQ ID NO: 201905 - RNA, 32 nt, Human
ggguuauguguaugugccauuuaugugagugu

SEQ ID NO: 201906 - RNA, 32 nt, Human
ggguuauuaugccacaucuccaugaaaaugca

SEQ ID NO: 201907 - RNA, 31 nt, Human
ggguuauuuaguaaaguuuguugaaaacaaa

SEQ ID NO: 201908 - RNA, 21 nt, Human
ggguucaaaaacucccccacu

SEQ ID NO: 201909 - RNA, 23 nt, Human
ggguucaaacaauucuccugccu

SEQ ID NO: 201910 - RNA, 32 nt, Human
ggguucaaacaauucugucucugccucccaag

SEQ ID NO: 201911 - RNA, 23 nt, Human
ggguucaaacaauuuuccugccu

SEQ ID NO: 201912 - RNA, 23 nt, Human
ggguucaaacgauucuccuaccu

SEQ ID NO: 201913 - RNA, 23 nt, Human
ggguucaaacgauuguccugccu

SEQ ID NO: 201914 - RNA, 23 nt, Human
ggguucaaccgauucuccugccu

SEQ ID NO: 201915 - RNA, 23 nt, Human
ggguucaagagacucuccugccu

SEQ ID NO: 201916 - RNA, 23 nt, Human
ggguucaagagauucuccugccu

SEQ ID NO: 201917 - RNA, 23 nt, Human
ggguucaagcaagucuccugccu

SEQ ID NO: 201918 - RNA, 23 nt, Human
ggguucaagcaauccucccaccu

SEQ ID NO: 201919 - RNA, 23 nt, Human
ggguucaagcaauccuccugccu

SEQ ID NO: 201920 - RNA, 23 nt, Human
ggguucaagcaauucuccagccu

SEQ ID NO: 201921 - RNA, 21 nt, Human
ggguucaagcaauucucccau

SEQ ID NO: 201922 - RNA, 21 nt, Human
ggguucaagcaauucuccuac

SEQ ID NO: 201923 - RNA, 23 nt, Human
ggguucaagcaauucuccuaccu

SEQ ID NO: 201924 - RNA, 23 nt, Human
ggguucaagcaauucuccugccu

SEQ ID NO: 201925 - RNA, 23 nt, Human
ggguucaagcaauucuccugucu

SEQ ID NO: 201926 - RNA, 32 nt, Human
ggguucaagcaauucuguggcuucagccuccg

SEQ ID NO: 201927 - RNA, 23 nt, Human
ggguucaagcaauucuucugccu

SEQ ID NO: 201928 - RNA, 21 nt, Human
ggguucaagcaguucucccgc

SEQ ID NO: 201929 - RNA, 32 nt, Human
ggguucaagccaccccagaggauuccuugcua

SEQ ID NO: 201930 - RNA, 23 nt, Human
ggguucaagccauucuccucccu

SEQ ID NO: 201931 - RNA, 22 nt, Human
ggguucaagcgauccucccacu

SEQ ID NO: 201932 - RNA, 23 nt, Human
ggguucaagcgauccuccugccu

SEQ ID NO: 201933 - RNA, 23 nt, Human
ggguucaagcgauuacucccacu

SEQ ID NO: 201934 - RNA, 23 nt, Human
ggguucaagcgauuauccugccu

SEQ ID NO: 201935 - RNA, 23 nt, Human
ggguucaagcgauuccccugccu

SEQ ID NO: 201936 - RNA, 23 nt, Human
ggguucaagcgauuccucugccu

SEQ ID NO: 201937 - RNA, 23 nt, Human
ggguucaagcgauucuccagccu

SEQ ID NO: 201938 - RNA, 21 nt, Human
ggguucaagcgauucucccac

SEQ ID NO: 201939 - RNA, 22 nt, Human
ggguucaagcgauucucccacc

SEQ ID NO: 201940 - RNA, 21 nt, Human
ggguucaagcgauucucccgc

SEQ ID NO: 201941 - RNA, 21 nt, Human
ggguucaagcgauucuccuac

SEQ ID NO: 201942 - RNA, 23 nt, Human
ggguucaagcgauucuccuaccu

SEQ ID NO: 201943 - RNA, 23 nt, Human
ggguucaagcgauucuccugccu

SEQ ID NO: 201944 - RNA, 23 nt, Human
ggguucaagcgauuguccugccu

SEQ ID NO: 201945 - RNA, 22 nt, Human
ggguucaaggauucuccugccu

SEQ ID NO: 201946 - RNA, 23 nt, Human
ggguucaagggauucuccugccu

SEQ ID NO: 201947 - RNA, 21 nt, Human
ggguucaagugacccucccac

SEQ ID NO: 201948 - RNA, 21 nt, Human
ggguucaagugauccucccac

SEQ ID NO: 201949 - RNA, 21 nt, Human
ggguucaagugauucucccac

SEQ ID NO: 201950 - RNA, 21 nt, Human
ggguucaagugauucuuccac

SEQ ID NO: 201951 - RNA, 23 nt, Human
ggguucaaucgauucuccugccu

SEQ ID NO: 201952 - RNA, 32 nt, Human
ggguucaauuucauucuucuucauaugaauau

SEQ ID NO: 201953 - RNA, 32 nt, Human
ggguucacaagaaagauccucgcuacugacau

SEQ ID NO: 201954 - RNA, 32 nt, Human
ggguucacaagcaauucucaugccucagccuc

SEQ ID NO: 201955 - RNA, 32 nt, Human
ggguucacaagucacauucaggggcugagucc

SEQ ID NO: 201956 - RNA, 32 nt, Human
ggguucacagaauccuggcagcagcuccaguc

SEQ ID NO: 201957 - RNA, 32 nt, Human
ggguucacugcaaccuccgccucuuggguuca

SEQ ID NO: 201958 - RNA, 32 nt, Human
ggguucacugcaaccucugccuccagguucaa

SEQ ID NO: 201959 - RNA, 32 nt, Human
ggguucacugcaaccucugccuccugggcuca

SEQ ID NO: 201960 - RNA, 32 nt, Human
ggguucagacuucacacugugaguucagacuc

SEQ ID NO: 201961 - RNA, 32 nt, Human
ggguucagaguuuccgucagaugcagugaaau

SEQ ID NO: 201962 - RNA, 32 nt, Human
ggguucagcugaccaaguagcagagaagucuu

SEQ ID NO: 201963 - RNA, 32 nt, Human
ggguucagggucggagggagaagauggcuuuc

SEQ ID NO: 201964 - RNA, 23 nt, Human
ggguucaggugauucuccucccu

SEQ ID NO: 201965 - RNA, 32 nt, Human
ggguucaguaguuugggaagggagcuggggga

SEQ ID NO: 201966 - RNA, 32 nt, Human
ggguucaguggaaauguuuggaacucugaagg

SEQ ID NO: 201967 - RNA, 23 nt, Human
ggguucaguucugcuccuccacu

SEQ ID NO: 201968 - RNA, 32 nt, Human
ggguucaugcuggagaaaagcuuuagagugua

SEQ ID NO: 201969 - RNA, 32 nt, Human
ggguucaugggaacaggggcgggugugacuug

SEQ ID NO: 201970 - RNA, 32 nt, Human
ggguuccaaccauaggaacacacugaugcuca

SEQ ID NO: 201971 - RNA, 23 nt, Human
ggguuccaacgauucuccugccu

SEQ ID NO: 201972 - RNA, 32 nt, Human
ggguuccaaucgagucaagaaaagccuggggu

SEQ ID NO: 201973 - RNA, 23 nt, Human
ggguuccagcaauucuccugccu

SEQ ID NO: 201974 - RNA, 22 nt, Human
ggguuccagcagccuggggcag

SEQ ID NO: 201975 - RNA, 23 nt, Human
ggguuccagcgauucuccugccu

SEQ ID NO: 201976 - RNA, 32 nt, Human
ggguuccaggaagcugggaagggagaugucag

SEQ ID NO: 201977 - RNA, 32 nt, Human
ggguuccagggacugguggagguggauggcag

SEQ ID NO: 201978 - RNA, 21 nt, Human
ggguuccagggccacccagug

SEQ ID NO: 201979 - RNA, 32 nt, Human
ggguuccaggguggggcucaggaggggagcgg

SEQ ID NO: 201980 - RNA, 32 nt, Human
ggguuccaguuacacagccacagccuggaagc

SEQ ID NO: 201981 - RNA, 31 nt, Human
ggguuccaguuucagaguucucauuauuacu

SEQ ID NO: 201982 - RNA, 32 nt, Human
ggguuccauuuaggagcuuucuagaaaguuga

SEQ ID NO: 201983 - RNA, 32 nt, Human
ggguucccaauacaaaaauaccuacugcugag

SEQ ID NO: 201984 - RNA, 32 nt, Human
ggguucccagacugaauugucagugagcggag

SEQ ID NO: 201985 - RNA, 22 nt, Human
ggguucccaggccaccuccucu

SEQ ID NO: 201986 - RNA, 32 nt, Human
ggguucccaggccaccuccucuguucugaggc

SEQ ID NO: 201987 - RNA, 32 nt, Human
ggguucccauuuucgcuuuccucugguuugaa

SEQ ID NO: 201988 - RNA, 22 nt, Human
ggguuccccaucgucugccccu

SEQ ID NO: 201989 - RNA, 24 nt, Human
ggguuccccccuccccccaccuuu

SEQ ID NO: 201990 - RNA, 23 nt, Human
ggguucccccucccaugccccuc

SEQ ID NO: 201991 - RNA, 32 nt, Human
ggguucccccuucccuuuucuccuucccuacu

SEQ ID NO: 201992 - RNA, 23 nt, Human
ggguuccccggcaccccagccuc

SEQ ID NO: 201993 - RNA, 23 nt, Human
ggguuccccggccaggccuccuc

SEQ ID NO: 201994 - RNA, 22 nt, Human
ggguuccccugcuuccaaccuc

SEQ ID NO: 201995 - RNA, 32 nt, Human
ggguuccccuuccuucuagagcagaaaaggga

SEQ ID NO: 201996 - RNA, 28 nt, Human
ggguucccgucugcugccucucggagag

SEQ ID NO: 201997 - RNA, 32 nt, Human
ggguucccucaagaggaagugagcggugcugu

SEQ ID NO: 201998 - RNA, 32 nt, Human
ggguucccucacugcuagucagcuucuuuugg

SEQ ID NO: 201999 - RNA, 21 nt, Human
ggguucccucagcccagcccu

SEQ ID NO: 202000 - RNA, 32 nt, Human
ggguucccucauuaccccucugggcuuagucc

SEQ ID NO: 202001 - RNA, 21 nt, Human
ggguucccuucgcccagcucu

SEQ ID NO: 202002 - RNA, 25 nt, Human
ggguucccuucuugggccugccucu

SEQ ID NO: 202003 - RNA, 32 nt, Human
ggguuccucacuucccaguaggggcggccggg

SEQ ID NO: 202004 - RNA, 32 nt, Human
ggguuccucagaccaucuccuucauucugggc

SEQ ID NO: 202005 - RNA, 32 nt, Human
ggguuccuccagccaggcucucagggaagguc

SEQ ID NO: 202006 - RNA, 32 nt, Human
ggguuccucccaggagcucuggagguacagga

SEQ ID NO: 202007 - RNA, 32 nt, Human
ggguuccucccaggauacgcccgagcggaaga

SEQ ID NO: 202008 - RNA, 21 nt, Human
ggguuccugaccccugccccu

SEQ ID NO: 202009 - RNA, 32 nt, Human
ggguuccugauaguccugugaccaugcggaag

SEQ ID NO: 202010 - RNA, 22 nt, Human
ggguuccugcagcagcuggagg

SEQ ID NO: 202011 - RNA, 32 nt, Human
ggguuccuggcgggcguuucugaaaagcaaag

SEQ ID NO: 202012 - RNA, 23 nt, Human
ggguuccugggcccaccugcucu

SEQ ID NO: 202013 - RNA, 32 nt, Human
ggguuccuuccaccauauaacccacacccaga

SEQ ID NO: 202014 - RNA, 32 nt, Human
ggguucgagguggaggcugcagcugaaggugg

SEQ ID NO: 202015 - RNA, 32 nt, Human
ggguucgcacaucuaaggaggagaagaagcau

SEQ ID NO: 202016 - RNA, 32 nt, Human
ggguucgcauucucucuuucuuuuccucuuuc

SEQ ID NO: 202017 - RNA, 32 nt, Human
ggguucgcggguucuccgccucagcuuccuag

SEQ ID NO: 202018 - RNA, 23 nt, Human
ggguucgggcaauucuccugccu

SEQ ID NO: 202019 - RNA, 32 nt, Human
ggguucgugccuccuagccuaggaaacuuaaa

SEQ ID NO: 202020 - RNA, 32 nt, Human
ggguucuaaaggacagcaccagcgggacagcc

SEQ ID NO: 202021 - RNA, 32 nt, Human
ggguucuagauuugaacucugcugugaaguga

SEQ ID NO: 202022 - RNA, 32 nt, Human
ggguucucaccgagcccuugacugccuggaua

SEQ ID NO: 202023 - RNA, 32 nt, Human
ggguucucaggccaucccguuggggcugucgc

SEQ ID NO: 202024 - RNA, 18 nt, Human
ggguucucaggcuggcug

SEQ ID NO: 202025 - RNA, 32 nt, Human
ggguucucaguaggaaugcuggugcugucuaa

SEQ ID NO: 202026 - RNA, 32 nt, Human
ggguucucagugcuuucuacugcacagagugg

SEQ ID NO: 202027 - RNA, 32 nt, Human
ggguucuccaccugccccagagcuucucaagg

SEQ ID NO: 202028 - RNA, 32 nt, Human
ggguucuccgccucagcuuccuaguagcuggg

SEQ ID NO: 202029 - RNA, 32 nt, Human
ggguucuccucggaacagagggcagaugaggc

SEQ ID NO: 202030 - RNA, 32 nt, Human
ggguucuccugccucacccucccgaguagcug

SEQ ID NO: 202031 - RNA, 32 nt, Human
ggguucucguggccgcggcagcgcggucucug

SEQ ID NO: 202032 - RNA, 32 nt, Human
ggguucucuagcucugaccucugggugacccc

SEQ ID NO: 202033 - RNA, 32 nt, Human
ggguucucucacccucuuucucuuuccuuccc

SEQ ID NO: 202034 - RNA, 32 nt, Human
ggguucucuccccuccuuccuguuccucuuau

SEQ ID NO: 202035 - RNA, 32 nt, Human
ggguucucugguuugcugccuccugaccacau

SEQ ID NO: 202036 - RNA, 32 nt, Human
ggguucugcagcuguaaggaacucccagguca

SEQ ID NO: 202037 - RNA, 32 nt, Human
ggguucugccuagucaacguuauuugucgucc

SEQ ID NO: 202038 - RNA, 32 nt, Human
ggguucugcucagaccauaggaggccaaccca

SEQ ID NO: 202039 - RNA, 32 nt, Human
ggguucuggcgucccucuccccaaaauccuca

SEQ ID NO: 202040 - RNA, 32 nt, Human
ggguucugggagaggcaggugaauguccuaag

SEQ ID NO: 202041 - RNA, 32 nt, Human
ggguucuguagggucaggaaggggcggcuggc

SEQ ID NO: 202042 - RNA, 32 nt, Human
ggguucugucaugaagggaguagcaccuuuug

SEQ ID NO: 202043 - RNA, 32 nt, Human
ggguucugucuugccuucauguggaccuucau

SEQ ID NO: 202044 - RNA, 32 nt, Human
ggguucuguggaguguccagagaccuuggguu

SEQ ID NO: 202045 - RNA, 32 nt, Human
ggguucuguuucuccccuuggcugccuguaag

SEQ ID NO: 202046 - RNA, 32 nt, Human
ggguucuuaccaggaugggcucugaagauaag

SEQ ID NO: 202047 - RNA, 32 nt, Human
ggguucuuacuccguagcccaggcuggagugc

SEQ ID NO: 202048 - RNA, 32 nt, Human
ggguucuucgggugugaucauauaucauaaag

SEQ ID NO: 202049 - RNA, 32 nt, Human
ggguucuucuucguccucuguccucugcccag

SEQ ID NO: 202050 - RNA, 32 nt, Human
ggguucuucuuugagccaacuguuuucacaga

SEQ ID NO: 202051 - RNA, 32 nt, Human
ggguucuugaugucuacucugcaugaagcccu

SEQ ID NO: 202052 - RNA, 32 nt, Human
ggguucuugcagcuggcaccagcccucccggc

SEQ ID NO: 202053 - RNA, 32 nt, Human
ggguucuuggccaggcuguaggugguggcuca

SEQ ID NO: 202054 - RNA, 32 nt, Human
ggguucuugggcaguggcugugggagcaggaa

SEQ ID NO: 202055 - RNA, 31 nt, Human
ggguugaacguugcaacuaggguggagauca

SEQ ID NO: 202056 - RNA, 32 nt, Human
ggguugaagaaagcggagggcagccgccugcg

SEQ ID NO: 202057 - RNA, 32 nt, Human
ggguugaagggagggggaaggcaggccagaag

SEQ ID NO: 202058 - RNA, 32 nt, Human
ggguugaccuucuccccuucuggcuuuccacc

SEQ ID NO: 202059 - RNA, 32 nt, Human
ggguugacugucuagaaaggaggaaucagagg

SEQ ID NO: 202060 - RNA, 32 nt, Human
ggguugagacacgccccugcccucucuccuuu

SEQ ID NO: 202061 - RNA, 32 nt, Human
ggguugagcagaggagaaaaucagacagaugg

SEQ ID NO: 202062 - RNA, 32 nt, Human
ggguugagccucuacuuucuucuugccaccuu

SEQ ID NO: 202063 - RNA, 32 nt, Human
ggguugagccugggugggaggguaccaggagu

SEQ ID NO: 202064 - RNA, 32 nt, Human
ggguugagcuuagugauccucucucaaaccac

SEQ ID NO: 202065 - RNA, 32 nt, Human
ggguugaggaagagauaagucaggagcaaaaa

SEQ ID NO: 202066 - RNA, 20 nt, Human
ggguugaggcuggccauguc

SEQ ID NO: 202067 - RNA, 18 nt, Human
ggguugaggggccccguc

SEQ ID NO: 202068 - RNA, 22 nt, Human
ggguugagggguccuuucuguc

SEQ ID NO: 202069 - RNA, 19 nt, Human
ggguugagggugucuuguc

SEQ ID NO: 202070 - RNA, 32 nt, Human
ggguugaggugcuucuccccacucugcucucg

SEQ ID NO: 202071 - RNA, 32 nt, Human
ggguugaugggggaggcguggggaagggaaag

SEQ ID NO: 202072 - RNA, 23 nt, Human
ggguugaugugggguucaggaug

SEQ ID NO: 202073 - RNA, 32 nt, Human
ggguugauguggguugccaguuagggaugugg

SEQ ID NO: 202074 - RNA, 20 nt, Human
ggguugcaacccaacucugu

SEQ ID NO: 202075 - RNA, 32 nt, Human
ggguugcaggaggaggagcugggcagggccug

SEQ ID NO: 202076 - RNA, 32 nt, Human
ggguugcaggccauggaggagggaccuccacu

SEQ ID NO: 202077 - RNA, 20 nt, Human
ggguugcaggcccgggccuc

SEQ ID NO: 202078 - RNA, 32 nt, Human
ggguugcagugagccgagaucacaccacugca

SEQ ID NO: 202079 - RNA, 32 nt, Human
ggguugcagugagccgagaucaugccacugca

SEQ ID NO: 202080 - RNA, 32 nt, Human
ggguugcagugagccgagaucuggccauugca

SEQ ID NO: 202081 - RNA, 32 nt, Human
ggguugcagugagccgagaugucaccacugcc

SEQ ID NO: 202082 - RNA, 32 nt, Human
ggguugcagugagccgagauugcgccacugca

SEQ ID NO: 202083 - RNA, 32 nt, Human
ggguugcaguugguugagugggcaguugacau

SEQ ID NO: 202084 - RNA, 32 nt, Human
ggguugcaucagccuccucugccugcagcucc

SEQ ID NO: 202085 - RNA, 32 nt, Human
ggguugcaucccucggaagagcgaaggaauga

SEQ ID NO: 202086 - RNA, 32 nt, Human
ggguugcauuauugauuugauucucaguuugg

SEQ ID NO: 202087 - RNA, 32 nt, Human
ggguugccagaggcccuggagggaaggacagu

SEQ ID NO: 202088 - RNA, 32 nt, Human
ggguugcccaggguggagugcaguggcaggau

SEQ ID NO: 202089 - RNA, 32 nt, Human
ggguugcccgggagggguggcgggagcggucc

SEQ ID NO: 202090 - RNA, 32 nt, Human
ggguugcccuuggcuucuccucccucuacuca

SEQ ID NO: 202091 - RNA, 31 nt, Human
ggguugccucuuuucugccaugugggaagag

SEQ ID NO: 202092 - RNA, 32 nt, Human
ggguugccugcagggacuuuugcucugcuguc

SEQ ID NO: 202093 - RNA, 32 nt, Human
ggguugccugggaacagucucuccccaagauc

SEQ ID NO: 202094 - RNA, 32 nt, Human
ggguugccugggaccagguccucagaaacugu

SEQ ID NO: 202095 - RNA, 32 nt, Human
ggguugcgccccggaggcggaucucaggcacc

SEQ ID NO: 202096 - RNA, 32 nt, Human
ggguugcugggucauagggcagguguaauuuu

SEQ ID NO: 202097 - RNA, 32 nt, Human
ggguugcuugagcucaggaguuugagaccagc

SEQ ID NO: 202098 - RNA, 32 nt, Human
ggguugcuugagcucaggaguuugagaccagg

SEQ ID NO: 202099 - RNA, 32 nt, Human
ggguugcuugagcuccggagcuugagaccagc

SEQ ID NO: 202100 - RNA, 32 nt, Human
ggguugcuugggccacugcccucuccacaccc

SEQ ID NO: 202101 - RNA, 32 nt, Human
ggguuggaagucagggaggcuaauuuggggaa

SEQ ID NO: 202102 - RNA, 32 nt, Human
ggguuggaauccagccccaccucuuuuaugcc

SEQ ID NO: 202103 - RNA, 32 nt, Human
ggguuggagaggagguguggucucagcaggcg

SEQ ID NO: 202104 - RNA, 32 nt, Human
ggguuggagcagcccuccugugccugaggcca

SEQ ID NO: 202105 - RNA, 32 nt, Human
ggguuggagcagucucuccggaaggggagggg

SEQ ID NO: 202106 - RNA, 32 nt, Human
ggguuggaggcuggggaccuaagguaagcacc

SEQ ID NO: 202107 - RNA, 32 nt, Human
ggguuggaggucuggacagggagcccaguccc

SEQ ID NO: 202108 - RNA, 32 nt, Human
ggguuggauaccuguggugugacaccuucugc

SEQ ID NO: 202109 - RNA, 32 nt, Human
ggguuggauccagugguuagguuuuagaaagg

SEQ ID NO: 202110 - RNA, 19 nt, Human
ggguuggauggcggcagga

SEQ ID NO: 202111 - RNA, 19 nt, Human
ggguuggauguccaagaug

SEQ ID NO: 202112 - RNA, 21 nt, Human
ggguuggauuaucucaagaug

SEQ ID NO: 202113 - RNA, 32 nt, Human
ggguuggauuugcuguucuugccugcagggcc

SEQ ID NO: 202114 - RNA, 32 nt, Human
ggguuggcacagaaguccugucugagguccua

SEQ ID NO: 202115 - RNA, 32 nt, Human
ggguuggcaguggagagcaggcuggagaggag

SEQ ID NO: 202116 - RNA, 32 nt, Human
ggguuggccucuuccuccuccccugccaggcc

SEQ ID NO: 202117 - RNA, 18 nt, Human
ggguuggcggggcggggg

SEQ ID NO: 202118 - RNA, 32 nt, Human
ggguuggcuugggacugggagagaaaggaagu

SEQ ID NO: 202119 - RNA, 25 nt, Human
ggguugggacccagcaagggcacuu

SEQ ID NO: 202120 - RNA, 32 nt, Human
ggguugggagaaagguggcggugcuuucggag

SEQ ID NO: 202121 - RNA, 32 nt, Human
ggguugggagcuugggcaggccagcuucaccc

SEQ ID NO: 202122 - RNA, 32 nt, Human
ggguugggaggugaccagggguccccauugug

SEQ ID NO: 202123 - RNA, 32 nt, Human
ggguugggaugggggugugggcaggggaaaac

SEQ ID NO: 202124 - RNA, 32 nt, Human
ggguugggaugguccaugagugaacagucuug

SEQ ID NO: 202125 - RNA, 32 nt, Human
ggguugggccagggaagggugugcaaaaacua

SEQ ID NO: 202126 - RNA, 32 nt, Human
ggguugggccggaagguggaagagccugccaa

SEQ ID NO: 202127 - RNA, 32 nt, Human
ggguugggccuacuucucaccugggccuaucu

SEQ ID NO: 202128 - RNA, 32 nt, Human
ggguugggcugcaggccuggccgugagcgggg

SEQ ID NO: 202129 - RNA, 32 nt, Human
ggguuggggagcaggccagauggagguggugg

SEQ ID NO: 202130 - RNA, 32 nt, Human
ggguuggggagggugauuuaugaccaaguaga

SEQ ID NO: 202131 - RNA, 32 nt, Human
ggguuggggcaggccagagcaaggcggucuca

SEQ ID NO: 202132 - RNA, 32 nt, Human
ggguuggggcugggacucuggaggcuccuccc

SEQ ID NO: 202133 - RNA, 32 nt, Human
ggguuggggguggaggucuagaggugagcuca

SEQ ID NO: 202134 - RNA, 17 nt, Human
ggguuggggguggggug

SEQ ID NO: 202135 - RNA, 32 nt, Human
ggguuggggguggucagagcauugugggaggg

SEQ ID NO: 202136 - RNA, 32 nt, Human
ggguuggggugaggccacaugcggaggggcgg

SEQ ID NO: 202137 - RNA, 32 nt, Human
ggguugggguugggacuggagcuggccuuggg

SEQ ID NO: 202138 - RNA, 32 nt, Human
ggguugggugggaaggaaggcuggggguuuug

SEQ ID NO: 202139 - RNA, 19 nt, Human
ggguuggguguccaagaug

SEQ ID NO: 202140 - RNA, 32 nt, Human
ggguuggguuccugaaugcaccauaaucgcug

SEQ ID NO: 202141 - RNA, 18 nt, Human
ggguugguaauucaggau

SEQ ID NO: 202142 - RNA, 32 nt, Human
ggguuggugagguuccgcugagggcggccggg

SEQ ID NO: 202143 - RNA, 32 nt, Human
ggguuggugccuggcacugguguugcuccauu

SEQ ID NO: 202144 - RNA, 32 nt, Human
ggguugguguguuuccccuuguguaccagagc

SEQ ID NO: 202145 - RNA, 32 nt, Human
ggguugguugggggaggaaguggggaggagug

SEQ ID NO: 202146 - RNA, 32 nt, Human
ggguuguaaacaugugguaguaccagaguauu

SEQ ID NO: 202147 - RNA, 20 nt, Human
ggguuguauacagacucugu

SEQ ID NO: 202148 - RNA, 32 nt, Human
ggguugucacuuaaguuuggagugcaguggca

SEQ ID NO: 202149 - RNA, 32 nt, Human
ggguugucagcaggugagugccgugcucugac

SEQ ID NO: 202150 - RNA, 32 nt, Human
ggguugucaggcggagcugguaggggagcugc

SEQ ID NO: 202151 - RNA, 32 nt, Human
ggguuguccaggguguccucagucucuaugug

SEQ ID NO: 202152 - RNA, 24 nt, Human
ggguuguccuuccccccagcaaau

SEQ ID NO: 202153 - RNA, 32 nt, Human
ggguugucuuucuccucuccuacauccauuuc

SEQ ID NO: 202154 - RNA, 32 nt, Human
ggguugucuuugcaugggugggggacuucccg

SEQ ID NO: 202155 - RNA, 32 nt, Human
ggguugugaaauggggugucuccuuccaggau

SEQ ID NO: 202156 - RNA, 32 nt, Human
ggguugugccuguaaucccagcuacuugggag

SEQ ID NO: 202157 - RNA, 20 nt, Human
ggguugugcgcagaaggcug

SEQ ID NO: 202158 - RNA, 32 nt, Human
ggguugugggcuggcggggcugugggaagggg

SEQ ID NO: 202159 - RNA, 32 nt, Human
ggguugugggggcagagggggucugugaaucu

SEQ ID NO: 202160 - RNA, 32 nt, Human
ggguuguggggugagaggaugugaguggccgg

SEQ ID NO: 202161 - RNA, 32 nt, Human
ggguugugggguggaggcuggcagcugaaaga

SEQ ID NO: 202162 - RNA, 31 nt, Human
ggguuguggguggucagggagagguagggug

SEQ ID NO: 202163 - RNA, 32 nt, Human
ggguuguggguggucagggagagguagggugg

SEQ ID NO: 202164 - RNA, 32 nt, Human
ggguuguggguuucuguucagugagaacgcaa

SEQ ID NO: 202165 - RNA, 32 nt, Human
ggguuguggugagccgagacugugucauugca

SEQ ID NO: 202166 - RNA, 32 nt, Human
ggguuguggugagggaaaaugcagugagggga

SEQ ID NO: 202167 - RNA, 32 nt, Human
ggguuguguggaaggagauuugggagaaggga

SEQ ID NO: 202168 - RNA, 32 nt, Human
ggguuguuaccugccugucucucccagcuucu

SEQ ID NO: 202169 - RNA, 32 nt, Human
ggguuguuaggcuuuucugccugcuccugcuu

SEQ ID NO: 202170 - RNA, 32 nt, Human
ggguuguugagugaggggagcgugggaugggg

SEQ ID NO: 202171 - RNA, 32 nt, Human
ggguuguugcgggaucucacaggcuuuaaacc

SEQ ID NO: 202172 - RNA, 32 nt, Human
ggguuguugcugcuuugcuucguguuuucuuc

SEQ ID NO: 202173 - RNA, 32 nt, Human
ggguuguuugguuuugguuuucacugucucug

SEQ ID NO: 202174 - RNA, 32 nt, Human
ggguuuaaaaggagauuugaugccauggcaaa

SEQ ID NO: 202175 - RNA, 23 nt, Human
ggguuuaagcaauucuccugccu

SEQ ID NO: 202176 - RNA, 23 nt, Human
ggguuuaagcgauucuccugccu

SEQ ID NO: 202177 - RNA, 32 nt, Human
ggguuuaggaugaaccauuuuaaggaugccaa

SEQ ID NO: 202178 - RNA, 32 nt, Human
ggguuuaggggcugggacacucacagccccag

SEQ ID NO: 202179 - RNA, 32 nt, Human
ggguuuagucccugccucaccuuggggaugga

SEQ ID NO: 202180 - RNA, 32 nt, Human
ggguuuauagggggaggaggaggcaggugguc

SEQ ID NO: 202181 - RNA, 32 nt, Human
ggguuuauaucuucccuuugagcagcauucua

SEQ ID NO: 202182 - RNA, 32 nt, Human
ggguuuaucaucagaaggagagagacccgagg

SEQ ID NO: 202183 - RNA, 32 nt, Human
ggguuuaugacugccaaguuugcccaguacag

SEQ ID NO: 202184 - RNA, 20 nt, Human
ggguuucaccauauugguca

SEQ ID NO: 202185 - RNA, 20 nt, Human
ggguuucaccauguugccca

SEQ ID NO: 202186 - RNA, 20 nt, Human
ggguuucaccauguugcuca

SEQ ID NO: 202187 - RNA, 20 nt, Human
ggguuucaccauguuggcca

SEQ ID NO: 202188 - RNA, 20 nt, Human
ggguuucaccauguugucca

SEQ ID NO: 202189 - RNA, 32 nt, Human
ggguuucacccagcuacucaggaggcugaggc

SEQ ID NO: 202190 - RNA, 32 nt, Human
ggguuucacccuguugcccaggcuaucucaaa

SEQ ID NO: 202191 - RNA, 20 nt, Human
ggguuucaccguguuggcca

SEQ ID NO: 202192 - RNA, 32 nt, Human
ggguuucacugagggguagaaguggcucucag

SEQ ID NO: 202193 - RNA, 32 nt, Human
ggguuucacuguguuggcccagcuggucucaa

SEQ ID NO: 202194 - RNA, 24 nt, Human
ggguuucagagaauaggccgggag

SEQ ID NO: 202195 - RNA, 32 nt, Human
ggguuucagagcagagcuccuggccagagcgu

SEQ ID NO: 202196 - RNA, 21 nt, Human
ggguuucagaguggccggaga

SEQ ID NO: 202197 - RNA, 32 nt, Human
ggguuucagaucuggcuuuuguuaacauuuug

SEQ ID NO: 202198 - RNA, 32 nt, Human
ggguuucagcaacucagugucacagaauaaaa

SEQ ID NO: 202199 - RNA, 32 nt, Human
ggguuucaggcccugaagguucuugaggaucu

SEQ ID NO: 202200 - RNA, 32 nt, Human
ggguuucauguuucaccguguuguccaggcug

SEQ ID NO: 202201 - RNA, 32 nt, Human
ggguuuccagagagagucaugcuggaggagaa

SEQ ID NO: 202202 - RNA, 32 nt, Human
ggguuuccaggcccccugccccuuccccacaa

SEQ ID NO: 202203 - RNA, 32 nt, Human
ggguuucccagaccagggguucagaggagacu

SEQ ID NO: 202204 - RNA, 32 nt, Human
ggguuuccccuauguccaaugacuguagacgg

SEQ ID NO: 202205 - RNA, 32 nt, Human
ggguuuccguuuugguucccuuucauacagag

SEQ ID NO: 202206 - RNA, 32 nt, Human
ggguuuccuaggacccaguuccucauguaagg

SEQ ID NO: 202207 - RNA, 18 nt, Human
ggguuuccugaaguggga

SEQ ID NO: 202208 - RNA, 32 nt, Human
ggguuuccuggaccacccacugcuucucccca

SEQ ID NO: 202209 - RNA, 32 nt, Human
ggguuuccugguguuuccucugacucuagugc

SEQ ID NO: 202210 - RNA, 32 nt, Human
ggguuuccuucugcuucacucuuuccuucccc

SEQ ID NO: 202211 - RNA, 24 nt, Human
ggguuucgggaagguguugaggaa

SEQ ID NO: 202212 - RNA, 32 nt, Human
ggguuucggguuucaccauguuggccagguug

SEQ ID NO: 202213 - RNA, 32 nt, Human
ggguuucuacagcugcuccccacuuucucgga

SEQ ID NO: 202214 - RNA, 32 nt, Human
ggguuucuagccccagaucuagccggguugag

SEQ ID NO: 202215 - RNA, 32 nt, Human
ggguuucucacaccccauaugucugucccuug

SEQ ID NO: 202216 - RNA, 32 nt, Human
ggguuucucauuuccuccuguggcuacauagu

SEQ ID NO: 202217 - RNA, 20 nt, Human
ggguuucuccauguugguca

SEQ ID NO: 202218 - RNA, 32 nt, Human
ggguuucucccaggauaggugaaaggguuaaa

SEQ ID NO: 202219 - RNA, 32 nt, Human
ggguuucugaaugucugugaauuucagagguc

SEQ ID NO: 202220 - RNA, 32 nt, Human
ggguuucugucugagccugagguuugcucucu

SEQ ID NO: 202221 - RNA, 32 nt, Human
ggguuucuuccauguugcccaggcuggucucg

SEQ ID NO: 202222 - RNA, 32 nt, Human
ggguuucuucccacucagggcaaggaagagaa

SEQ ID NO: 202223 - RNA, 32 nt, Human
ggguuucuuccucugaaaaggaaugaacacgg

SEQ ID NO: 202224 - RNA, 32 nt, Human
ggguuucuuuguccucaagguacuguucuguu

SEQ ID NO: 202225 - RNA, 32 nt, Human
ggguuucuuuucugcugggccaaggcgcuuug

SEQ ID NO: 202226 - RNA, 32 nt, Human
ggguuugaagccaggaggagagaugcagucuu

SEQ ID NO: 202227 - RNA, 18 nt, Human
ggguuugacaaccacuua

SEQ ID NO: 202228 - RNA, 32 nt, Human
ggguuugaguugaggaccaaagugccauagcg

SEQ ID NO: 202229 - RNA, 32 nt, Human
ggguuugauucugaaaucuuucuaccuguugc

SEQ ID NO: 202230 - RNA, 32 nt, Human
ggguuugcaaaagcagaucaccaauauguacc

SEQ ID NO: 202231 - RNA, 32 nt, Human
ggguuugcaaaauuuuguaaacuuuuuguguu

SEQ ID NO: 202232 - RNA, 32 nt, Human
ggguuugcacuccugugagaaucuaaugccuc

SEQ ID NO: 202233 - RNA, 31 nt, Human
ggguuugcaguuuucugaguaggugaguuuu

SEQ ID NO: 202234 - RNA, 32 nt, Human
ggguuugcauucuccccuuggcuauuuaacca

SEQ ID NO: 202235 - RNA, 16 nt, Human
ggguuugccauugcua

SEQ ID NO: 202236 - RNA, 32 nt, Human
ggguuugcuggguggguaugggggagggggag

SEQ ID NO: 202237 - RNA, 32 nt, Human
ggguuugcuguuguuauugaucaucuggcuac

SEQ ID NO: 202238 - RNA, 32 nt, Human
ggguuugcuuugagagaaagugggugcagaau

SEQ ID NO: 202239 - RNA, 32 nt, Human
ggguuuggagcagcccugccccucgcugugaa

SEQ ID NO: 202240 - RNA, 32 nt, Human
ggguuuggagcuuauuugaauggaagagguca

SEQ ID NO: 202241 - RNA, 32 nt, Human
ggguuuggaggcggccgccaggcccaggcccg

SEQ ID NO: 202242 - RNA, 21 nt, Human
ggguuuggcaaaacucaggca

SEQ ID NO: 202243 - RNA, 32 nt, Human
ggguuuggcaaugggaaggcaaacaaauuuaa

SEQ ID NO: 202244 - RNA, 32 nt, Human
ggguuugggauugacacuggaggcagauaguu

SEQ ID NO: 202245 - RNA, 32 nt, Human
ggguuugggcgaaguuggaugugcaaacaacu

SEQ ID NO: 202246 - RNA, 32 nt, Human
ggguuuggggagcaggaggcagacauguguug

SEQ ID NO: 202247 - RNA, 32 nt, Human
ggguuuggggucggggacagagcagugaccau

SEQ ID NO: 202248 - RNA, 32 nt, Human
ggguuugggugaggccuggaggcuucagaggu

SEQ ID NO: 202249 - RNA, 32 nt, Human
ggguuugggugugggugcacacaaagcaagca

SEQ ID NO: 202250 - RNA, 32 nt, Human
ggguuugguaccccuuccuggcuucagaaaga

SEQ ID NO: 202251 - RNA, 32 nt, Human
ggguuugguuuaccuauuaaaccaucauugac

SEQ ID NO: 202252 - RNA, 32 nt, Human
ggguuugguuuugucuaggcagccucuggcca

SEQ ID NO: 202253 - RNA, 32 nt, Human
ggguuuguaccagaggaggaggcuggggugga

SEQ ID NO: 202254 - RNA, 32 nt, Human
ggguuuguagggacaugaucagcauccugauu

SEQ ID NO: 202255 - RNA, 32 nt, Human
ggguuuguagggguccucaagugccuuuguga

SEQ ID NO: 202256 - RNA, 32 nt, Human
ggguuuguccucugaugagaaucuaaugucgc

SEQ ID NO: 202257 - RNA, 32 nt, Human
ggguuugucugucccugacuucugccucugag

SEQ ID NO: 202258 - RNA, 31 nt, Human
ggguuugucuucugugugccuguguccucau

SEQ ID NO: 202259 - RNA, 32 nt, Human
ggguuugugccgugcugcuuuccaaauaggua

SEQ ID NO: 202260 - RNA, 32 nt, Human
ggguuugugcgugugugucugcuuagcggucu

SEQ ID NO: 202261 - RNA, 31 nt, Human
ggguuuguuucuucuacuaugccaagcuggu

SEQ ID NO: 202262 - RNA, 18 nt, Human
ggguuuuacagggcccuu

SEQ ID NO: 202263 - RNA, 32 nt, Human
ggguuuuaccacugcacgaccaucuggcucuc

SEQ ID NO: 202264 - RNA, 25 nt, Human
ggguuuuacuggcuggugcugggaa

SEQ ID NO: 202265 - RNA, 32 nt, Human
ggguuuuagacugaacuucgguguuuucuuga

SEQ ID NO: 202266 - RNA, 32 nt, Human
ggguuuuaguggcauugccuuccuucacuaaa

SEQ ID NO: 202267 - RNA, 32 nt, Human
ggguuuucaaucuuggauuggagguggggguu

SEQ ID NO: 202268 - RNA, 32 nt, Human
ggguuuucacaucucuguacugugccugccuc

SEQ ID NO: 202269 - RNA, 32 nt, Human
ggguuuucaccaugguggccaggcuggucucg

SEQ ID NO: 202270 - RNA, 21 nt, Human
ggguuuucaccauguuggcca

SEQ ID NO: 202271 - RNA, 21 nt, Human
ggguuuucaccauguugguca

SEQ ID NO: 202272 - RNA, 32 nt, Human
ggguuuucaguauuuguaagcauuucagcaga

SEQ ID NO: 202273 - RNA, 32 nt, Human
ggguuuucaguuauugcaaagaaaugaagaga

SEQ ID NO: 202274 - RNA, 32 nt, Human
ggguuuuccugauacugggauuccgggauucc

SEQ ID NO: 202275 - RNA, 32 nt, Human
ggguuuucuccucaucaaaagcauuucuuaag

SEQ ID NO: 202276 - RNA, 32 nt, Human
ggguuuucucgccgagucuccuggggcggucc

SEQ ID NO: 202277 - RNA, 32 nt, Human
ggguuuucucuugcccaauccccaccuaauaa

SEQ ID NO: 202278 - RNA, 32 nt, Human
ggguuuucuuaccaagcaucccugaccuccug

SEQ ID NO: 202279 - RNA, 32 nt, Human
ggguuuucuuucuccuccuccaaccuuggcgg

SEQ ID NO: 202280 - RNA, 32 nt, Human
ggguuuugagcagguugggguauggugccugu

SEQ ID NO: 202281 - RNA, 32 nt, Human
ggguuuugagccacugcugcugcugccauugu

SEQ ID NO: 202282 - RNA, 32 nt, Human
ggguuuugaggaggccacagagccaacagcuu

SEQ ID NO: 202283 - RNA, 32 nt, Human
ggguuuugauauuggcuuagcugccagucucc

SEQ ID NO: 202284 - RNA, 32 nt, Human
ggguuuuggaugggaagggaaggguggcuguc

SEQ ID NO: 202285 - RNA, 32 nt, Human
ggguuuuggcauagccuguguuugcagugaga

SEQ ID NO: 202286 - RNA, 32 nt, Human
ggguuuuuagggggauuaaaugaaguauacag

SEQ ID NO: 202287 - RNA, 32 nt, Human
ggguuuuuccaucaggagcaaauggaauccag

SEQ ID NO: 202288 - RNA, 19 nt, Human
ggguuuuuucuacacuguc

SEQ ID NO: 202289 - RNA, 32 nt, Human
gguaaaaacuguuaacacuaaccugaaguuuu

SEQ ID NO: 202290 - RNA, 32 nt, Human
gguaaaaaggccccaacauagcuguauuuaua

SEQ ID NO: 202291 - RNA, 32 nt, Human
gguaaaaauguucuccccuucuguggauuguu

SEQ ID NO: 202292 - RNA, 32 nt, Human
gguaaaacacagauuuuugggcuccacuccaa

SEQ ID NO: 202293 - RNA, 32 nt, Human
gguaaaacaugcuggugaaccagggguguuga

SEQ ID NO: 202294 - RNA, 32 nt, Human
gguaaaaccacgaagggagggaagggaaguca

SEQ ID NO: 202295 - RNA, 32 nt, Human
gguaaaaccacuacccucagagagagccaaaa

SEQ ID NO: 202296 - RNA, 21 nt, Human
gguaaaaccccaucucuacua

SEQ ID NO: 202297 - RNA, 21 nt, Human
gguaaaaccccauuucuacua

SEQ ID NO: 202298 - RNA, 21 nt, Human
gguaaaaccccgucucuacua

SEQ ID NO: 202299 - RNA, 21 nt, Human
gguaaaacccugucucuacua

SEQ ID NO: 202300 - RNA, 32 nt, Human
gguaaaacggaggaggugcgggacgcggagac

SEQ ID NO: 202301 - RNA, 32 nt, Human
gguaaaacuggagacugggggaaagugacuac

SEQ ID NO: 202302 - RNA, 32 nt, Human
gguaaaagagcugagggcucucuucagggagc

SEQ ID NO: 202303 - RNA, 32 nt, Human
gguaaaagcaccaggggguuaaucuuggcuca

SEQ ID NO: 202304 - RNA, 32 nt, Human
gguaaaagcuuucugcaaagcuuuucugcucc

SEQ ID NO: 202305 - RNA, 32 nt, Human
gguaaaaggaaaggaaggaaggaaaaagcagc

SEQ ID NO: 202306 - RNA, 32 nt, Human
gguaaaaggagaaacugagagguguccugcag

SEQ ID NO: 202307 - RNA, 32 nt, Human
gguaaaagucaucuaaggaggcguugucugga

SEQ ID NO: 202308 - RNA, 32 nt, Human
gguaaaauccaaaggaagauguuuacccucuu

SEQ ID NO: 202309 - RNA, 32 nt, Human
gguaaaaucuagauccuaucuaaaaauaugua

SEQ ID NO: 202310 - RNA, 32 nt, Human
gguaaaaucucuucugucacacacagaugaac

SEQ ID NO: 202311 - RNA, 32 nt, Human
gguaaacaaagacaugggauuuucuuacauga

SEQ ID NO: 202312 - RNA, 32 nt, Human
gguaaacacaaaucaugucaauaaagguaguc

SEQ ID NO: 202313 - RNA, 32 nt, Human
gguaaacaggcaggagccagguugugcagugc

SEQ ID NO: 202314 - RNA, 32 nt, Human
gguaaaccaagaaucuagggaguggccaaacu

SEQ ID NO: 202315 - RNA, 20 nt, Human
gguaaaccccaucucuacua

SEQ ID NO: 202316 - RNA, 32 nt, Human
gguaaacuccuuauaaaaagcaaauaccugga

SEQ ID NO: 202317 - RNA, 32 nt, Human
gguaaacugaugcuuucagauccaucgguuua

SEQ ID NO: 202318 - RNA, 32 nt, Human
gguaaacuguaagcccacacuuaaccuuguca

SEQ ID NO: 202319 - RNA, 32 nt, Human
gguaaacuucauugaggaggugauguuuaaac

SEQ ID NO: 202320 - RNA, 32 nt, Human
gguaaacuugagcaucuuuucacuuuccagua

SEQ ID NO: 202321 - RNA, 32 nt, Human
gguaaagaaagaaggaaggagggaggaaagga

SEQ ID NO: 202322 - RNA, 32 nt, Human
gguaaagaaauggugucuauguagacuuaaua

SEQ ID NO: 202323 - RNA, 32 nt, Human
gguaaagagaaaaggagggagaagggaaggaa

SEQ ID NO: 202324 - RNA, 32 nt, Human
gguaaagagagggacuguaggaaguagaaaug

SEQ ID NO: 202325 - RNA, 32 nt, Human
gguaaagcaagaaaacucaagcugcagcugga

SEQ ID NO: 202326 - RNA, 32 nt, Human
gguaaagcaguuagcuagcaccuggcacaugg

SEQ ID NO: 202327 - RNA, 32 nt, Human
gguaaagccauccucccgccucagccuuucga

SEQ ID NO: 202328 - RNA, 32 nt, Human
gguaaagccauugggagguaaugaggguggag

SEQ ID NO: 202329 - RNA, 32 nt, Human
gguaaagccauuucguccucuccaguuugggg

SEQ ID NO: 202330 - RNA, 20 nt, Human
gguaaagcuaaguacuauug

SEQ ID NO: 202331 - RNA, 32 nt, Human
gguaaagcuuagcagagaaucaugggagcuaa

SEQ ID NO: 202332 - RNA, 32 nt, Human
gguaaaggaaagagcagguguggggguuaagc

SEQ ID NO: 202333 - RNA, 32 nt, Human
gguaaaggagaaaauaaugggaaagugcuugu

SEQ ID NO: 202334 - RNA, 31 nt, Human
gguaaaggcaugucucccauuugggaacuga

SEQ ID NO: 202335 - RNA, 32 nt, Human
gguaaaggcucaggcuguuaguagccgcagag

SEQ ID NO: 202336 - RNA, 32 nt, Human
gguaaagggaccagagagaaggagucaccugc

SEQ ID NO: 202337 - RNA, 32 nt, Human
gguaaaguaaggggagaaagugaagugacuuc

SEQ ID NO: 202338 - RNA, 32 nt, Human
gguaaaguaauaugacuaauuucuccaguuga

SEQ ID NO: 202339 - RNA, 32 nt, Human
gguaaagucaauguacacuuccuccuuauugg

SEQ ID NO: 202340 - RNA, 32 nt, Human
gguaaaguuaucauuuccucagucuuuucuuu

SEQ ID NO: 202341 - RNA, 32 nt, Human
gguaaauaaaguggguccuggaaucuuuuagg

SEQ ID NO: 202342 - RNA, 32 nt, Human
gguaaauaugucugagaagaaacggugcaaga

SEQ ID NO: 202343 - RNA, 32 nt, Human
gguaaauauuccagaauccauaugaaauucau

SEQ ID NO: 202344 - RNA, 32 nt, Human
gguaaauccaagagaaaugauccuauccaaag

SEQ ID NO: 202345 - RNA, 32 nt, Human
gguaaauguucuguugugauuguuaacauucc

SEQ ID NO: 202346 - RNA, 32 nt, Human
gguaacaaagugagacccccaucucuacaaaa

SEQ ID NO: 202347 - RNA, 32 nt, Human
gguaacaagaggagcaggaagcaaggccagcc

SEQ ID NO: 202348 - RNA, 32 nt, Human
gguaacaauggguggucuucugauuuuuauuu

SEQ ID NO: 202349 - RNA, 20 nt, Human
gguaacaauuaaaauuuuaa

SEQ ID NO: 202350 - RNA, 32 nt, Human
gguaacaccaaaacagaaugggugcagacgcu

SEQ ID NO: 202351 - RNA, 32 nt, Human
gguaacaccacugcacuccaaccugggcaaca

SEQ ID NO: 202352 - RNA, 18 nt, Human
gguaacacccccacccca

SEQ ID NO: 202353 - RNA, 32 nt, Human
gguaacagaagagaagacuguggagccagcua

SEQ ID NO: 202354 - RNA, 32 nt, Human
gguaacagacuggagugaggagacugaggaga

SEQ ID NO: 202355 - RNA, 21 nt, Human
gguaacagagugagacugucu

SEQ ID NO: 202356 - RNA, 32 nt, Human
gguaacagauggagcuccuuccuagcuaggga

SEQ ID NO: 202357 - RNA, 32 nt, Human
gguaacaggcugggugcaauggcucacaccua

SEQ ID NO: 202358 - RNA, 32 nt, Human
gguaacagggcacaccccucuaguuucauggg

SEQ ID NO: 202359 - RNA, 32 nt, Human
gguaacauacugcacacauuguucugcauguu

SEQ ID NO: 202360 - RNA, 32 nt, Human
gguaacaucaucaggccgggugcaguggcucc

SEQ ID NO: 202361 - RNA, 32 nt, Human
gguaacaugcagcuuuuuccucucauagcauu

SEQ ID NO: 202362 - RNA, 32 nt, Human
gguaacauggccagaccccaucucuauuuaua

SEQ ID NO: 202363 - RNA, 32 nt, Human
gguaaccagcuaacucuugggcucaggcaccc

SEQ ID NO: 202364 - RNA, 32 nt, Human
gguaacccaaccgguaccacagauccgguucc

SEQ ID NO: 202365 - RNA, 32 nt, Human
gguaaccccaaaccuccaaaacuccugccccu

SEQ ID NO: 202366 - RNA, 32 nt, Human
gguaaccccagccauggaccgucaguggcugg

SEQ ID NO: 202367 - RNA, 32 nt, Human
gguaacccggccccucuggcccuucccucaag

SEQ ID NO: 202368 - RNA, 32 nt, Human
gguaacccuuacacuccugguuugagacagua

SEQ ID NO: 202369 - RNA, 24 nt, Human
gguaaccggagugcugguaucuaa

SEQ ID NO: 202370 - RNA, 32 nt, Human
gguaaccgggacccgugcucugcuccugucgc

SEQ ID NO: 202371 - RNA, 32 nt, Human
ggugaauuuuuaaucagcaauauugccugugc

SEQ ID NO: 202372 - RNA, 32 nt, Human
ggugacaaaggaaugagugaaugaguaaggag

SEQ ID NO: 202373 - RNA, 32 nt, Human
ggugacaaagugucacaggugugaugcauuac

SEQ ID NO: 202374 - RNA, 20 nt, Human
ggugacaacagaggggguag

SEQ ID NO: 202375 - RNA, 32 nt, Human
ggugacaagaggagacagggacagguucuguc

SEQ ID NO: 202376 - RNA, 32 nt, Human
ggugacacacuaugguauuugaguguuuuaag

SEQ ID NO: 202377 - RNA, 32 nt, Human
ggugacacagagccggcccuguccucgguucu

SEQ ID NO: 202378 - RNA, 32 nt, Human
ggugacacauggcugcauuuugaaggacagau

SEQ ID NO: 202379 - RNA, 21 nt, Human
ggugacacccaccccagggug

SEQ ID NO: 202380 - RNA, 32 nt, Human
ggugacaccugagaauuccucccucucacccc

SEQ ID NO: 202381 - RNA, 32 nt, Human
ggugacacgaggacacagggacagguucuauc

SEQ ID NO: 202382 - RNA, 19 nt, Human
ggugacacgaggggacuga

SEQ ID NO: 202383 - RNA, 32 nt, Human
ggugacacucagggauguggucaucaacuucu

SEQ ID NO: 202384 - RNA, 32 nt, Human
ggugacacugcacucgccucacuagggagcug

SEQ ID NO: 202385 - RNA, 32 nt, Human
ggugacacuggcauugcuggguggugaugccc

SEQ ID NO: 202386 - RNA, 32 nt, Human
ggugacacugggaggugggagggccaggccaa

SEQ ID NO: 202387 - RNA, 23 nt, Human
ggugacagaaugagacccugucu

SEQ ID NO: 202388 - RNA, 23 nt, Human
ggugacagaaugagacucuaucu

SEQ ID NO: 202389 - RNA, 20 nt, Human
ggugacagaauguucugccu

SEQ ID NO: 202390 - RNA, 23 nt, Human
ggugacagacagagacucugucu

SEQ ID NO: 202391 - RNA, 23 nt, Human
ggugacagagcaagacccugucu

SEQ ID NO: 202392 - RNA, 21 nt, Human
ggugacagagcaagacuacau

SEQ ID NO: 202393 - RNA, 23 nt, Human
ggugacagagcaagacuccaucu

SEQ ID NO: 202394 - RNA, 23 nt, Human
ggugacagagcaagacuccggcu

SEQ ID NO: 202395 - RNA, 32 nt, Human
ggugacagagccaaauggggcugcaguugcug

SEQ ID NO: 202396 - RNA, 23 nt, Human
ggugacagagcgagacccugucu

SEQ ID NO: 202397 - RNA, 23 nt, Human
ggugacagagcgagacuccaucu

SEQ ID NO: 202398 - RNA, 23 nt, Human
ggugacagagcgagacuccgucu

SEQ ID NO: 202399 - RNA, 23 nt, Human
ggugacagagggagacucucuca

SEQ ID NO: 202400 - RNA, 23 nt, Human
ggugacagagugagaaccugucu

SEQ ID NO: 202401 - RNA, 23 nt, Human
ggugacagagugagacccugucu

SEQ ID NO: 202402 - RNA, 23 nt, Human
ggugacagagugagaccucgucu

SEQ ID NO: 202403 - RNA, 23 nt, Human
ggugacagagugagacuccaccu

SEQ ID NO: 202404 - RNA, 23 nt, Human
ggugacagagugagacuccaucc

SEQ ID NO: 202405 - RNA, 23 nt, Human
ggugacagagugagacuccaucu

SEQ ID NO: 202406 - RNA, 23 nt, Human
ggugacagagugagacuccgucu

SEQ ID NO: 202407 - RNA, 23 nt, Human
ggugacagagugagacucugucu

SEQ ID NO: 202408 - RNA, 25 nt, Human
ggugacagcaggucugagguugcau

SEQ ID NO: 202409 - RNA, 25 nt, Human
ggugacagcuacgcuggagugcagu

SEQ ID NO: 202410 - RNA, 19 nt, Human
ggugacagcugacucugcc

SEQ ID NO: 202411 - RNA, 32 nt, Human
ggugacagcugcaagccagggaugaagaaaga

SEQ ID NO: 202412 - RNA, 32 nt, Human
ggugacaggaaggcugggagcagcuuuguuaa

SEQ ID NO: 202413 - RNA, 32 nt, Human
ggugacaggcccaggaaccaaugcuacucauu

SEQ ID NO: 202414 - RNA, 32 nt, Human
ggugacaggccugggccucugcaacugcccug

SEQ ID NO: 202415 - RNA, 32 nt, Human
ggugacaggcuggccugcagucagcaucauug

SEQ ID NO: 202416 - RNA, 20 nt, Human
ggugacagggagccugcagg

SEQ ID NO: 202417 - RNA, 19 nt, Human
ggugacagggguuccugga

SEQ ID NO: 202418 - RNA, 32 nt, Human
ggugacaggugaccgcacacaugugggugcca

SEQ ID NO: 202419 - RNA, 32 nt, Human
ggugacagugaugaaaggaaugcuugaucuga

SEQ ID NO: 202420 - RNA, 32 nt, Human
ggugacaguuccugaaggggcuucugggaaau

SEQ ID NO: 202421 - RNA, 32 nt, Human
ggugacaguuuccugaggagagggguguaucc

SEQ ID NO: 202422 - RNA, 32 nt, Human
ggugacauauguaaucccagcacuuugggagg

SEQ ID NO: 202423 - RNA, 32 nt, Human
ggugacauccacaaaugcaguuuuagaagcag

SEQ ID NO: 202424 - RNA, 32 nt, Human
ggugacaugacacaggcagagcagaguggcac

SEQ ID NO: 202425 - RNA, 32 nt, Human
ggugacaugagaacaccgacccagggaauggg

SEQ ID NO: 202426 - RNA, 32 nt, Human
ggugacaugauuugguuagaagcacaagcaaa

SEQ ID NO: 202427 - RNA, 32 nt, Human
ggugacauggugccaucaggaggcggcugcug

SEQ ID NO: 202428 - RNA, 32 nt, Human
ggugacauuuauuuugacaaguuuuaggcauc

SEQ ID NO: 202429 - RNA, 22 nt, Human
ggugaccaaaggccuggcuaca

SEQ ID NO: 202430 - RNA, 24 nt, Human
ggugaccaacgggagggcuucuca

SEQ ID NO: 202431 - RNA, 32 nt, Human
ggugaccaagaggcagaagagcagagcagucg

SEQ ID NO: 202432 - RNA, 32 nt, Human
ggugaccaaggcaggaggaucucuugaggcca

SEQ ID NO: 202433 - RNA, 16 nt, Human
ggugaccacacuucca

SEQ ID NO: 202434 - RNA, 32 nt, Human
ggugaccacagcugcaguuagggaagggagcc

SEQ ID NO: 202435 - RNA, 32 nt, Human
ggugaccacauuaagcccaguauuccaguugg

SEQ ID NO: 202436 - RNA, 32 nt, Human
ggugaccacuuaauugcuuuccugccuccuug

SEQ ID NO: 202437 - RNA, 32 nt, Human
ggugaccagcuguccuaguuugcccaggacuc

SEQ ID NO: 202438 - RNA, 32 nt, Human
ggugaccaggguaccccaggaggcaugaugug

SEQ ID NO: 202439 - RNA, 32 nt, Human
ggugaccauacagcuagggcugaggaugggaa

SEQ ID NO: 202440 - RNA, 32 nt, Human
ggugacccaagaggcaggguuggggccuggac

SEQ ID NO: 202441 - RNA, 32 nt, Human
ggugacccacagcucugggccucuuuuugccc

SEQ ID NO: 202442 - RNA, 32 nt, Human
ggugacccacugcuucagcugguugaccuccc

SEQ ID NO: 202443 - RNA, 32 nt, Human
ggugacccaggaagaacgugucagagacagug

SEQ ID NO: 202444 - RNA, 32 nt, Human
ggugaccccaacagcacagagaacagccaacg

SEQ ID NO: 202445 - RNA, 32 nt, Human
ggugaccccagaguucuucagaccugugucug

SEQ ID NO: 202446 - RNA, 32 nt, Human
ggugaccccagccucaucuucuaggccuuuuc

SEQ ID NO: 202447 - RNA, 32 nt, Human
ggugaccccucagccaacagcccuaacauuug

SEQ ID NO: 202448 - RNA, 32 nt, Human
ggugaccccugccauuuaccagcagcccuggc

SEQ ID NO: 202449 - RNA, 32 nt, Human
ggugaccccugcccucagcucucaccagcgac

SEQ ID NO: 202450 - RNA, 32 nt, Human
ggugaccccuuuucagcuucugcugggcuggg

SEQ ID NO: 202451 - RNA, 32 nt, Human
ggugacccgggcccugaccuucucccucuucc

SEQ ID NO: 202452 - RNA, 18 nt, Human
ggugacccuacccuugag

SEQ ID NO: 202453 - RNA, 32 nt, Human
ggugacccuguggagcauugagccaugccagc

SEQ ID NO: 202454 - RNA, 32 nt, Human
ggugacccuuacacuucagccucccaaguagc

SEQ ID NO: 202455 - RNA, 32 nt, Human
ggugaccgagaggaggaguagagugugcccuu

SEQ ID NO: 202456 - RNA, 32 nt, Human
ggugaccgaggguggcacagccuggcuugagu

SEQ ID NO: 202457 - RNA, 20 nt, Human
ggugaccgcagccccuugga

SEQ ID NO: 202458 - RNA, 19 nt, Human
ggugaccgccaccacgccc

SEQ ID NO: 202459 - RNA, 32 nt, Human
ggugaccggccaccccagggcagucccccagc

SEQ ID NO: 202460 - RNA, 32 nt, Human
ggugaccuaggcagcauuagaaucacuuauuu

SEQ ID NO: 202461 - RNA, 30 nt, Human
ggugaccuaguagaguguaauggggaaggg

SEQ ID NO: 202462 - RNA, 32 nt, Human
ggugaccuccugucacucacugaggccaucag

SEQ ID NO: 202463 - RNA, 32 nt, Human
ggugaccugcagagacuuccugccuggaacuc

SEQ ID NO: 202464 - RNA, 32 nt, Human
ggugaccugcagcccggcccaccagccgccac

SEQ ID NO: 202465 - RNA, 32 nt, Human
ggugaccugcccucaaaccuugccugccaccu

SEQ ID NO: 202466 - RNA, 32 nt, Human
ggugaccugccuggucccugacucugcaagcc

SEQ ID NO: 202467 - RNA, 32 nt, Human
ggugaccugcucaugucagcuucuuccccuuu

SEQ ID NO: 202468 - RNA, 32 nt, Human
ggugaccugcuggcccucagaucaauggucgu

SEQ ID NO: 202469 - RNA, 32 nt, Human
ggugaccuggccagaggggcuggugaggggca

SEQ ID NO: 202470 - RNA, 32 nt, Human
ggugaccugggcccaagucucucaucagcccc

SEQ ID NO: 202471 - RNA, 32 nt, Human
ggugaccuguaaguugcagaggaggguggagu

SEQ ID NO: 202472 - RNA, 32 nt, Human
ggugaccugugcgccuagccugcgcagggaau

SEQ ID NO: 202473 - RNA, 32 nt, Human
ggugaccuguucucuagcugugaucuuaccac

SEQ ID NO: 202474 - RNA, 32 nt, Human
ggugaccuguucugugcuugaaugugcugaau

SEQ ID NO: 202475 - RNA, 24 nt, Human
ggugaccuucuggaugccuuuaac

SEQ ID NO: 202476 - RNA, 32 nt, Human
ggugacgacucuugcgcgcacacacacauaca

SEQ ID NO: 202477 - RNA, 17 nt, Human
ggugacgaugaccaccu

SEQ ID NO: 202478 - RNA, 31 nt, Human
ggugacgaugcccucucagccaacacugcca

SEQ ID NO: 202479 - RNA, 32 nt, Human
ggugacgaugcucugguucuccggcgucgggg

SEQ ID NO: 202480 - RNA, 32 nt, Human
ggugacgccguggccgcagggucuccauuuug

SEQ ID NO: 202481 - RNA, 18 nt, Human
ggugacgcgagcucugcc

SEQ ID NO: 202482 - RNA, 32 nt, Human
ggugacgcugcccagacucacaagagcucggg

SEQ ID NO: 202483 - RNA, 32 nt, Human
ggugacggccuaaaaagugaccaucuagacau

SEQ ID NO: 202484 - RNA, 21 nt, Human
ggugacgggcacucacuccca

SEQ ID NO: 202485 - RNA, 32 nt, Human
ggugacggugaucucggggugggcaggacucc

SEQ ID NO: 202486 - RNA, 32 nt, Human
ggugacguccaggucacaggcugcagcgaggu

SEQ ID NO: 202487 - RNA, 32 nt, Human
ggugacguuuuccagagcaacagugugacgug

SEQ ID NO: 202488 - RNA, 32 nt, Human
ggugacguuuucuaucagacgugcucccuccc

SEQ ID NO: 202489 - RNA, 32 nt, Human
ggugacuaaggugacuuuguauauucaucuua

SEQ ID NO: 202490 - RNA, 32 nt, Human
ggugacuaggcuuaggugagaucgugagggug

SEQ ID NO: 202491 - RNA, 32 nt, Human
ggugacuagggagggauuaggaaauuagaggu

SEQ ID NO: 202492 - RNA, 32 nt, Human
ggugacucaagaaguuguuuaagccuaggccu

SEQ ID NO: 202493 - RNA, 23 nt, Human
ggugacucacaccuauaauccca

SEQ ID NO: 202494 - RNA, 20 nt, Human
ggugacucacaccuguaauc

SEQ ID NO: 202495 - RNA, 20 nt, Human
ggugacucacgccugucauc

SEQ ID NO: 202496 - RNA, 20 nt, Human
ggugacucacgucuguaauc

SEQ ID NO: 202497 - RNA, 23 nt, Human
ggugacucauaccuguaauccca

SEQ ID NO: 202498 - RNA, 20 nt, Human
ggugacucaugccuguaauc

SEQ ID NO: 202499 - RNA, 23 nt, Human
ggugacucaugccuguaauccca

SEQ ID NO: 202500 - RNA, 32 nt, Human
ggugacucaugccuguaaucccugcacuuugg

SEQ ID NO: 202501 - RNA, 20 nt, Human
ggugacucaugcuuguaauc

SEQ ID NO: 202502 - RNA, 32 nt, Human
ggugacuccagccucuuucuccuggaggucac

SEQ ID NO: 202503 - RNA, 32 nt, Human
ggugacuccaugauggacgaucuugcucccag

SEQ ID NO: 202504 - RNA, 20 nt, Human
ggugacucgcaccuguaauc

SEQ ID NO: 202505 - RNA, 20 nt, Human
ggugacucucugcccuugga

SEQ ID NO: 202506 - RNA, 21 nt, Human
ggugacucucugcccuuggac

SEQ ID NO: 202507 - RNA, 32 nt, Human
ggugacucuggaggaagaggugggcccccgug

SEQ ID NO: 202508 - RNA, 23 nt, Human
ggugacucuuguacucccuugag

SEQ ID NO: 202509 - RNA, 32 nt, Human
ggugacugaauuugggccucuuguacaguuaa

SEQ ID NO: 202510 - RNA, 32 nt, Human
ggugacugagacaaacugccagcugccacugg

SEQ ID NO: 202511 - RNA, 32 nt, Human
ggugacugagaggcucaggacagagcauugca

SEQ ID NO: 202512 - RNA, 32 nt, Human
ggugacugaggcggguggauugcuugagccca

SEQ ID NO: 202513 - RNA, 31 nt, Human
ggugacugccucugagucauuguguuuuuca

SEQ ID NO: 202514 - RNA, 32 nt, Human
ggugacuggcccagccgcaccgcgucucccgc

SEQ ID NO: 202515 - RNA, 32 nt, Human
ggugacuggcuuuucguucuguguucuuggcu

SEQ ID NO: 202516 - RNA, 21 nt, Human
ggugacugggaggccuugaac

SEQ ID NO: 202517 - RNA, 32 nt, Human
ggugacugguucuucaggaacugugaaggugg

SEQ ID NO: 202518 - RNA, 18 nt, Human
ggugacugucuacacgca

SEQ ID NO: 202519 - RNA, 32 nt, Human
ggugacugucuccuggaaauguuaugcagcuc

SEQ ID NO: 202520 - RNA, 32 nt, Human
ggugacugugcacuccaguucucuccagauga

SEQ ID NO: 202521 - RNA, 20 nt, Human
ggugacuguggcagcgggag

SEQ ID NO: 202522 - RNA, 20 nt, Human
ggugacuucaucucuucgaa

SEQ ID NO: 202523 - RNA, 32 nt, Human
ggugacuuccaagagugacuccgucggaggaa

SEQ ID NO: 202524 - RNA, 32 nt, Human
ggugacuuccaucaagcuauacauacccuucu

SEQ ID NO: 202525 - RNA, 32 nt, Human
ggugacuuccucgccucucccaccccaugcau

SEQ ID NO: 202526 - RNA, 21 nt, Human
ggugacuucucagagccugaa

SEQ ID NO: 202527 - RNA, 32 nt, Human
ggugacuucucccuccccggccucagguuugc

SEQ ID NO: 202528 - RNA, 32 nt, Human
ggugacuucuguuuuggaggugaaguggaaga

SEQ ID NO: 202529 - RNA, 19 nt, Human
ggugacuugaaacccugag

SEQ ID NO: 202530 - RNA, 20 nt, Human
ggugacuuucacccugcaac

SEQ ID NO: 202531 - RNA, 21 nt, Human
ggugacuuucaugugcuugaa

SEQ ID NO: 202532 - RNA, 21 nt, Human
ggugacuuucugaugacugaa

SEQ ID NO: 202533 - RNA, 20 nt, Human
ggugacuuugaagacuugga

SEQ ID NO: 202534 - RNA, 22 nt, Human
ggugacuuugguagcccuugag

SEQ ID NO: 202535 - RNA, 23 nt, Human
ggugacuuugguagcccuugagc

SEQ ID NO: 202536 - RNA, 32 nt, Human
ggugacuuuucuugaugcaaagcucugauucc

SEQ ID NO: 202537 - RNA, 32 nt, Human
ggugagaaacccuacaaaugugcucaauguga

SEQ ID NO: 202538 - RNA, 32 nt, Human
ggugagaaauacagcucccacaguugugcucu

SEQ ID NO: 202539 - RNA, 32 nt, Human
ggugagaaccuggguugcagacaggaaucuua

SEQ ID NO: 202540 - RNA, 32 nt, Human
ggugagaagaggcagacagugacgaugguagg

SEQ ID NO: 202541 - RNA, 32 nt, Human
ggugagaagagugaugaccauccuuuuccuua

SEQ ID NO: 202542 - RNA, 32 nt, Human
ggugagaagccgcuucccagacugucagggcc

SEQ ID NO: 202543 - RNA, 32 nt, Human
ggugagaauggggaggcaagaucucagggaca

SEQ ID NO: 202544 - RNA, 32 nt, Human
ggugagacagaggguggggaggauagugucug

SEQ ID NO: 202545 - RNA, 32 nt, Human
ggugagacccagccggggaagccucuccaacu

SEQ ID NO: 202546 - RNA, 21 nt, Human
ggugagaccccaucucuacua

SEQ ID NO: 202547 - RNA, 32 nt, Human
ggugagaccccucccuuccagaauccaggccc

SEQ ID NO: 202548 - RNA, 32 nt, Human
ggugagaccccuggcaguugccuacaccccug

SEQ ID NO: 202549 - RNA, 32 nt, Human
ggugagacccuccauguaugauuauuaugaca

SEQ ID NO: 202550 - RNA, 32 nt, Human
ggugagacccuuguuggcagccagacaagggu

SEQ ID NO: 202551 - RNA, 32 nt, Human
ggugagaccuguccgcccaccuucccuccacu

SEQ ID NO: 202552 - RNA, 32 nt, Human
ggugagacuucagagccuguucccucuccucc

SEQ ID NO: 202553 - RNA, 32 nt, Human
ggugagagaaagagggaggagugagagagaac

SEQ ID NO: 202554 - RNA, 32 nt, Human
ggugagagaaguacaaagguugcagugcugag

SEQ ID NO: 202555 - RNA, 32 nt, Human
ggugagagacacauuccccucgcugcucccaa

SEQ ID NO: 202556 - RNA, 32 nt, Human
ggugagagaccagaaagcaauggaggccggag

SEQ ID NO: 202557 - RNA, 19 nt, Human
ggugagagagacucuggcu

SEQ ID NO: 202558 - RNA, 32 nt, Human
ggugagagagcgagacagguggcaagaaccau

SEQ ID NO: 202559 - RNA, 32 nt, Human
ggugagagaggaagcaaggagagggugugugu

SEQ ID NO: 202560 - RNA, 32 nt, Human
ggugagagaggcccugaagauagaagccaggc

SEQ ID NO: 202561 - RNA, 32 nt, Human
ggugagagcuaucaacuguggcacgguucauu

SEQ ID NO: 202562 - RNA, 32 nt, Human
ggugagagcugguaaucccagcuacucaugag

SEQ ID NO: 202563 - RNA, 32 nt, Human
ggugagagcuucaccugucccuccuggcuugu

SEQ ID NO: 202564 - RNA, 32 nt, Human
ggugagaggaaggggagcggcuccugugcauu

SEQ ID NO: 202565 - RNA, 32 nt, Human
ggugagaggagaaaggagcuuaucccccagac

SEQ ID NO: 202566 - RNA, 32 nt, Human
ggugagaggagaaggagggagggaaaaggggu

SEQ ID NO: 202567 - RNA, 32 nt, Human
ggugagaggaugacacgucugccggcuccuug

SEQ ID NO: 202568 - RNA, 32 nt, Human
ggugagaggauuccuugaggccaggguucgag

SEQ ID NO: 202569 - RNA, 32 nt, Human
ggugagaggccagugcccugccccacccugga

SEQ ID NO: 202570 - RNA, 32 nt, Human
ggugagaggcggcugaagaguugcuguauucu

SEQ ID NO: 202571 - RNA, 32 nt, Human
ggugagagugugugucuuugcacacacagugc

SEQ ID NO: 202572 - RNA, 32 nt, Human
ggugagauggccuuggguugcccuuggcuucu

SEQ ID NO: 202573 - RNA, 20 nt, Human
ggugagcaauaaaguaucug

SEQ ID NO: 202574 - RNA, 19 nt, Human
ggugagcacguccaucuca

SEQ ID NO: 202575 - RNA, 32 nt, Human
ggugagcacugcagccucccugggcauucccu

SEQ ID NO: 202576 - RNA, 23 nt, Human
ggugagcagaucaccugagguca

SEQ ID NO: 202577 - RNA, 32 nt, Human
ggugagcagcuggaggccggacaguguucguc

SEQ ID NO: 202578 - RNA, 32 nt, Human
ggugagcaugguguccccacagcccaggccac

SEQ ID NO: 202579 - RNA, 32 nt, Human
ggugagccaaggacaaccacacagaaagccag

SEQ ID NO: 202580 - RNA, 19 nt, Human
ggugagccagaggguucca

SEQ ID NO: 202581 - RNA, 32 nt, Human
ggugagcccaauggcuagagggcucugcucca

SEQ ID NO: 202582 - RNA, 32 nt, Human
ggugagccccaguuuccagggcagcugauuga

SEQ ID NO: 202583 - RNA, 32 nt, Human
ggugagccccugcaagguggggugggugugcu

SEQ ID NO: 202584 - RNA, 32 nt, Human
ggugagccgaagccacacaggagccauggaag

SEQ ID NO: 202585 - RNA, 32 nt, Human
ggugagccuccugguguagaguucuuuugucu

SEQ ID NO: 202586 - RNA, 32 nt, Human
ggugagccuuacuucucuuccugggcuagccu

SEQ ID NO: 202587 - RNA, 32 nt, Human
ggugagcgaguuucacucugaugcaacagaaa

SEQ ID NO: 202588 - RNA, 19 nt, Human
ggugagcgcuguaaucuga

SEQ ID NO: 202589 - RNA, 32 nt, Human
ggugagcggacccgcgcuggggugcggggcag

SEQ ID NO: 202590 - RNA, 23 nt, Human
ggugagcggaucaccugaaguca

SEQ ID NO: 202591 - RNA, 23 nt, Human
ggugagcggaucaccugagguca

SEQ ID NO: 202592 - RNA, 32 nt, Human
ggugagcggggcccacccugcccagcucaggg

SEQ ID NO: 202593 - RNA, 32 nt, Human
ggugagcgucuggcgcaggucuggacccuuug

SEQ ID NO: 202594 - RNA, 32 nt, Human
ggugagcuauauggaguuaagcauuuuuauac

SEQ ID NO: 202595 - RNA, 32 nt, Human
ggugagcucacugucaucgcgcauccacuuga

SEQ ID NO: 202596 - RNA, 32 nt, Human
ggugagcucugccccaucagcccuuggagauu

SEQ ID NO: 202597 - RNA, 32 nt, Human
ggugagcugaguagcuggguuucuggaggaua

SEQ ID NO: 202598 - RNA, 32 nt, Human
ggugagcuggcaccagcuccuguggaauguuu

SEQ ID NO: 202599 - RNA, 32 nt, Human
ggugagcuggggaaggaagugagcauggccuc

SEQ ID NO: 202600 - RNA, 21 nt, Human
ggugaggaaacacugaccaua

SEQ ID NO: 202601 - RNA, 22 nt, Human
ggugaggaaacugcgacuggga

SEQ ID NO: 202602 - RNA, 32 nt, Human
ggugaggaaagaaauaaauaagugauucuaau

SEQ ID NO: 202603 - RNA, 32 nt, Human
ggugaggaacgccacagacagagccacccuag

SEQ ID NO: 202604 - RNA, 32 nt, Human
ggugaggaaggguuuaaccucacuggaaggaa

SEQ ID NO: 202605 - RNA, 32 nt, Human
ggugaggaauacuguaucuaucauucaacaag

SEQ ID NO: 202606 - RNA, 32 nt, Human
ggugaggacacagcaggcccaggaccauggcu

SEQ ID NO: 202607 - RNA, 32 nt, Human
ggugaggacacauugccccaugagacaguccc

SEQ ID NO: 202608 - RNA, 21 nt, Human
ggugaggacgggaucugugga

SEQ ID NO: 202609 - RNA, 32 nt, Human
ggugaggacuccauccuccuguuccauucauc

SEQ ID NO: 202610 - RNA, 32 nt, Human
ggugaggacucugccuccuugccugccuacaa

SEQ ID NO: 202611 - RNA, 32 nt, Human
ggugaggacucugccuggggcucugcugaugg

SEQ ID NO: 202612 - RNA, 32 nt, Human
ggugaggacugcaccuuaaccugggcacuggg

SEQ ID NO: 202613 - RNA, 32 nt, Human
ggugaggacuugacuuuccucccagagcucag

SEQ ID NO: 202614 - RNA, 32 nt, Human
ggugaggagacccuguccuaaauuuaaaauaa

SEQ ID NO: 202615 - RNA, 32 nt, Human
ggugaggagcuugccuagagucaguccaggag

SEQ ID NO: 202616 - RNA, 32 nt, Human
ggugaggaggaagaggaggaggaagaggagga

SEQ ID NO: 202617 - RNA, 32 nt, Human
ggugaggaggcagagaguggugcaggcugggu

SEQ ID NO: 202618 - RNA, 32 nt, Human
ggugaggaggcaggaagcaccuccgguuggag

SEQ ID NO: 202619 - RNA, 32 nt, Human
ggugaggaggggcggagcuuccagaacaaagg

SEQ ID NO: 202620 - RNA, 23 nt, Human
ggugaggcaagaagcucugggga

SEQ ID NO: 202621 - RNA, 32 nt, Human
ggugaggcaggaagguuucaguucaguggaga

SEQ ID NO: 202622 - RNA, 32 nt, Human
ggugaggcagggcugaaaacugcccuugggcu

SEQ ID NO: 202623 - RNA, 32 nt, Human
ggugaggcauagggaauguggggaagaggcuu

SEQ ID NO: 202624 - RNA, 32 nt, Human
ggugaggcccgugguagagaucauucugaaca

SEQ ID NO: 202625 - RNA, 32 nt, Human
ggugaggcggagcagagguuuaauggaggugu

SEQ ID NO: 202626 - RNA, 32 nt, Human
ggugaggcuccggaucucaggagcagcccuga

SEQ ID NO: 202627 - RNA, 32 nt, Human
ggugaggcugggaggaggaagacugagguaga

SEQ ID NO: 202628 - RNA, 32 nt, Human
ggugaggcugggcccuuccugcugggaaaagc

SEQ ID NO: 202629 - RNA, 32 nt, Human
ggugaggcuggugccaucugucugcuucagac

SEQ ID NO: 202630 - RNA, 21 nt, Human
ggugagggaacuaaaccugug

SEQ ID NO: 202631 - RNA, 32 nt, Human
ggugagggaagacgccuuucuccuccaaccca

SEQ ID NO: 202632 - RNA, 32 nt, Human
ggugagggaauccagacucccuucucucaagg

SEQ ID NO: 202633 - RNA, 32 nt, Human
ggugagggaccacuugggacagaggaagcaau

SEQ ID NO: 202634 - RNA, 32 nt, Human
ggugagggagaaagaagaccaagugugugaac

SEQ ID NO: 202635 - RNA, 32 nt, Human
ggugagggaggcauuucauuccagagcagaag

SEQ ID NO: 202636 - RNA, 32 nt, Human
ggugagggagggccaagccaggaggauuuguc

SEQ ID NO: 202637 - RNA, 22 nt, Human
ggugagggaggggccccaggag

SEQ ID NO: 202638 - RNA, 31 nt, Human
ggugagggcaaaggauuuguuuuucaaauua

SEQ ID NO: 202639 - RNA, 32 nt, Human
ggugagggcuguaaguggcgcgauucgcggca

SEQ ID NO: 202640 - RNA, 32 nt, Human
ggugaggggagggagagcauuaggaaaaacag

SEQ ID NO: 202641 - RNA, 19 nt, Human
ggugaggggccaggaucca

SEQ ID NO: 202642 - RNA, 32 nt, Human
ggugaggggcccgagguggcagaggaaggggg

SEQ ID NO: 202643 - RNA, 18 nt, Human
ggugaggggcuccugcca

SEQ ID NO: 202644 - RNA, 32 nt, Human
ggugaggggugugaggccccagccuggagcca

SEQ ID NO: 202645 - RNA, 32 nt, Human
ggugagggucagcaggaaaacaugaacaaaug

SEQ ID NO: 202646 - RNA, 32 nt, Human
ggugagggucaucuucacgagcaaagagaacc

SEQ ID NO: 202647 - RNA, 32 nt, Human
ggugagggucuccagccucagggccuggcuuc

SEQ ID NO: 202648 - RNA, 32 nt, Human
ggugagggugagaaugaggugggagcuggugg

SEQ ID NO: 202649 - RNA, 32 nt, Human
ggugagggugagcagagauguguguggacauc

SEQ ID NO: 202650 - RNA, 32 nt, Human
ggugagggugugagccccgggcugauggccuc

SEQ ID NO: 202651 - RNA, 32 nt, Human
ggugaggguuuaaacagacagaaagacagaca

SEQ ID NO: 202652 - RNA, 32 nt, Human
ggugagguauuuucacugcccucccuggagag

SEQ ID NO: 202653 - RNA, 32 nt, Human
ggugagguccaaagaggagagcuguucagcuu

SEQ ID NO: 202654 - RNA, 32 nt, Human
ggugaggugaguguggcgcucaaggagcagca

SEQ ID NO: 202655 - RNA, 32 nt, Human
ggugaggugguguuugccugcggucccagcua

SEQ ID NO: 202656 - RNA, 20 nt, Human
ggugagguucucagccacca

SEQ ID NO: 202657 - RNA, 32 nt, Human
ggugaguaacuugcccauuucuccacagagac

SEQ ID NO: 202658 - RNA, 32 nt, Human
ggugagucccacuugagcgcuuccuguugaau

SEQ ID NO: 202659 - RNA, 32 nt, Human
ggugaguccuucagaacgcucuacucuggaag

SEQ ID NO: 202660 - RNA, 32 nt, Human
ggugagucuaggacagauuuuacguggagagu

SEQ ID NO: 202661 - RNA, 32 nt, Human
ggugagucuguggccuucucuccagggccccc

SEQ ID NO: 202662 - RNA, 32 nt, Human
ggugagucuugacucccuuccaacacagaugc

SEQ ID NO: 202663 - RNA, 32 nt, Human
ggugagucuuuuccuguggagguuuggucucc

SEQ ID NO: 202664 - RNA, 32 nt, Human
ggugagugauccucccacaguggacuuccaaa

SEQ ID NO: 202665 - RNA, 32 nt, Human
ggugagugccuguaaucacagcuacuugggag

SEQ ID NO: 202666 - RNA, 32 nt, Human
ggugagugccuguaaucccagcuacucgggag

SEQ ID NO: 202667 - RNA, 32 nt, Human
ggugagugccuguaaucccagcuacuugggag

SEQ ID NO: 202668 - RNA, 32 nt, Human
ggugagugccuguaaucucaguuacucaggag

SEQ ID NO: 202669 - RNA, 32 nt, Human
ggugagugccuguagucccagcuacucaggag

SEQ ID NO: 202670 - RNA, 32 nt, Human
ggugagugcuggcauggcucuaccucccaacc

SEQ ID NO: 202671 - RNA, 32 nt, Human
ggugaguggagguagaaaaaugaugagaaaug

SEQ ID NO: 202672 - RNA, 32 nt, Human
ggugaguggggaggggcuuuccugagccugga

SEQ ID NO: 202673 - RNA, 32 nt, Human
ggugaguguggcugggggugcagagagcgcac

SEQ ID NO: 202674 - RNA, 32 nt, Human
ggugaguguguauuuacuguaguuuugccuga

SEQ ID NO: 202675 - RNA, 32 nt, Human
ggugaguguugugacaggcucagaccugaucc

SEQ ID NO: 202676 - RNA, 32 nt, Human
ggugaguugaaggaaugggauauggagccaca

SEQ ID NO: 202677 - RNA, 32 nt, Human
ggugaguugaguguggcugggagagugggagg

SEQ ID NO: 202678 - RNA, 32 nt, Human
ggugaguugggagcacguuccugcacguggcu

SEQ ID NO: 202679 - RNA, 23 nt, Human
ggugaguuuugccagccauggcc

SEQ ID NO: 202680 - RNA, 32 nt, Human
ggugaguuuuggccuuggcaugguuggcaugg

SEQ ID NO: 202681 - RNA, 32 nt, Human
ggugauaaaaagagcacucuugagugggugcc

SEQ ID NO: 202682 - RNA, 32 nt, Human
ggugauaauaaaaacuugucugugauauggug

SEQ ID NO: 202683 - RNA, 32 nt, Human
ggugauaaucuccccuuccucuucuugaugga

SEQ ID NO: 202684 - RNA, 32 nt, Human
ggugauaauggucuuccuggaagaaaaggaga

SEQ ID NO: 202685 - RNA, 32 nt, Human
ggugauaccucaccccuguaaucccagcacuu

SEQ ID NO: 202686 - RNA, 32 nt, Human
ggugauacuguacuccagccugagcaacagag

SEQ ID NO: 202687 - RNA, 32 nt, Human
ggugauacuucugcugguuucuuuaccuucug

SEQ ID NO: 202688 - RNA, 22 nt, Human
ggugauagagcaagacucuguc

SEQ ID NO: 202689 - RNA, 32 nt, Human
ggugauaggcuuccacacaggucuccagaagc

SEQ ID NO: 202690 - RNA, 32 nt, Human
ggugauagggucucgcucugucaccaggcugg

SEQ ID NO: 202691 - RNA, 32 nt, Human
ggugauauuuaauaugcauguauguaucuaaa

SEQ ID NO: 202692 - RNA, 32 nt, Human
ggugaucaagccugcucaggugaccccacuca

SEQ ID NO: 202693 - RNA, 32 nt, Human
ggugaucagauaagcuccagcccaaauggaac

SEQ ID NO: 202694 - RNA, 32 nt, Human
ggugaucagaugcagaagcauuacacaguggc

SEQ ID NO: 202695 - RNA, 18 nt, Human
ggugaucagcaggggcag

SEQ ID NO: 202696 - RNA, 32 nt, Human
ggugaucaucuugucccuucucugccuuagug

SEQ ID NO: 202697 - RNA, 32 nt, Human
ggugaucauucgagagcagacagaaggggagu

SEQ ID NO: 202698 - RNA, 22 nt, Human
ggugauccacaugacucugccu

SEQ ID NO: 202699 - RNA, 20 nt, Human
ggugauccacccaccuucca

SEQ ID NO: 202700 - RNA, 32 nt, Human
ggugaucccagccagggccccgagcgcagagg

SEQ ID NO: 202701 - RNA, 32 nt, Human
ggugauccccuccuggugguaacagcacaccu

SEQ ID NO: 202702 - RNA, 32 nt, Human
ggugauccgcuggccucggccucccagagugc

SEQ ID NO: 202703 - RNA, 32 nt, Human
ggugaucgccuauuacugacagucucauugua

SEQ ID NO: 202704 - RNA, 32 nt, Human
ggugaucugcauuuucauaauaaaguguccua

SEQ ID NO: 202705 - RNA, 32 nt, Human
ggugaucugcccuccuuggccucccagagugc

SEQ ID NO: 202706 - RNA, 32 nt, Human
ggugaucugccgaccagaggccuuaaacucug

SEQ ID NO: 202707 - RNA, 32 nt, Human
ggugaucugccugccuuggccucccagauugc

SEQ ID NO: 202708 - RNA, 32 nt, Human
ggugaucuucccacucagacuccugcguagcu

SEQ ID NO: 202709 - RNA, 32 nt, Human
ggugaugaacuccaagcugggcuuggacgugg

SEQ ID NO: 202710 - RNA, 32 nt, Human
ggugaugacaucugccaccucugccacuaccc

SEQ ID NO: 202711 - RNA, 32 nt, Human
ggugaugacuccuacaucuaaguggccccucc

SEQ ID NO: 202712 - RNA, 29 nt, Human
ggugaugagacacccuagggaaaucacuc

SEQ ID NO: 202713 - RNA, 32 nt, Human
ggugaugaggaagugggagcucagggaggacc

SEQ ID NO: 202714 - RNA, 32 nt, Human
ggugaugaugcgcaggucucauugguuucauu

SEQ ID NO: 202715 - RNA, 32 nt, Human
ggugaugcacagaugucacugggaaacccaaa

SEQ ID NO: 202716 - RNA, 32 nt, Human
ggugaugcacugugcccagccauuccaggauu

SEQ ID NO: 202717 - RNA, 19 nt, Human
ggugaugccagggauucca

SEQ ID NO: 202718 - RNA, 32 nt, Human
ggugaugccuaacuuuuccagcaaagaugaug

SEQ ID NO: 202719 - RNA, 32 nt, Human
ggugaugcucaggcucugccaccgucggcaac

SEQ ID NO: 202720 - RNA, 32 nt, Human
ggugaugcugagaagcagagggcgcccucaga

SEQ ID NO: 202721 - RNA, 29 nt, Human
ggugaugcugccucucuguggaucccugg

SEQ ID NO: 202722 - RNA, 32 nt, Human
ggugaugcuguuguugcuggucuagagacuau

SEQ ID NO: 202723 - RNA, 32 nt, Human
ggugaugcuuguuugcaaauugcccacucgug

SEQ ID NO: 202724 - RNA, 32 nt, Human
ggugauggaaucaaaaagaacuucuccauccu

SEQ ID NO: 202725 - RNA, 32 nt, Human
ggugauggcagccauggacacaggccagagag

SEQ ID NO: 202726 - RNA, 32 nt, Human
ggugauggcugcaguccaguuuugugaugcug

SEQ ID NO: 202727 - RNA, 32 nt, Human
ggugauggggcagggcugggucucaguauccu

SEQ ID NO: 202728 - RNA, 32 nt, Human
ggugaugguauuugaagguagggccuuuagga

SEQ ID NO: 202729 - RNA, 32 nt, Human
ggugauggucccauuaaacuuccacucugcaa

SEQ ID NO: 202730 - RNA, 32 nt, Human
ggugauguauuuuugucuucuuccccuuugcc

SEQ ID NO: 202731 - RNA, 32 nt, Human
ggugaugucuguaaucccagcaguuugcaaac

SEQ ID NO: 202732 - RNA, 32 nt, Human
ggugaugugagucugggcugggccacaggucc

SEQ ID NO: 202733 - RNA, 32 nt, Human
ggugauguuaccacagucccauuugucugcag

SEQ ID NO: 202734 - RNA, 32 nt, Human
ggugauuaaagaaaauuacucuucaagacuga

SEQ ID NO: 202735 - RNA, 32 nt, Human
ggugauucauggcucugugaauuugaggugaa

SEQ ID NO: 202736 - RNA, 32 nt, Human
ggugauucauuugcagcaaaauacuggcuugu

SEQ ID NO: 202737 - RNA, 32 nt, Human
ggugauucucaccucugccugcuuaugugggg

SEQ ID NO: 202738 - RNA, 32 nt, Human
ggugauucucuucuaugccucucuccaacgcc

SEQ ID NO: 202739 - RNA, 32 nt, Human
ggugauugcugcugggaugguggugaaugacu

SEQ ID NO: 202740 - RNA, 32 nt, Human
ggugauuggcugcugcagcccacccccuagcc

SEQ ID NO: 202741 - RNA, 32 nt, Human
ggugauugguccugcugccaucucacugauga

SEQ ID NO: 202742 - RNA, 32 nt, Human
ggugauugugccacugcacuccagccugggcg

SEQ ID NO: 202743 - RNA, 18 nt, Human
ggugauuuaugcccugaa

SEQ ID NO: 202744 - RNA, 32 nt, Human
ggugauuucuauuuucuucuguauacuuuucu

SEQ ID NO: 202745 - RNA, 32 nt, Human
ggugauuucugauuuugacaugaccuugagca

SEQ ID NO: 202746 - RNA, 32 nt, Human
ggugauuugugaaacaguugcugugaacuuuc

SEQ ID NO: 202747 - RNA, 19 nt, Human
ggugcaaacacagcucucu

SEQ ID NO: 202748 - RNA, 19 nt, Human
ggugcaaacauagcucccu

SEQ ID NO: 202749 - RNA, 32 nt, Human
ggugcaaaccuccagccccugcccguuucucu

SEQ ID NO: 202750 - RNA, 32 nt, Human
ggugcaaagacccugagguugaaguguccugg

SEQ ID NO: 202751 - RNA, 32 nt, Human
ggugcaaaggaaaggugggugagggaagcaga

SEQ ID NO: 202752 - RNA, 32 nt, Human
ggugcaacccacagcaaagcccugaccugacc

SEQ ID NO: 202753 - RNA, 32 nt, Human
ggugcaacgggggccucacagcacagagugac

SEQ ID NO: 202754 - RNA, 32 nt, Human
ggugcaacgguucagaacagcaaccaaauaaa

SEQ ID NO: 202755 - RNA, 32 nt, Human
ggugcaacuucuaagaguuuuccuguaaguaa

SEQ ID NO: 202756 - RNA, 32 nt, Human
ggugcaacuucugcuucauucucucuuugacu

SEQ ID NO: 202757 - RNA, 32 nt, Human
ggugcaagaaaauuuauguucucacaaaacua

SEQ ID NO: 202758 - RNA, 22 nt, Human
ggugcaagagacagagccccca

SEQ ID NO: 202759 - RNA, 32 nt, Human
ggugcaagcgaacuuagugacuccuugaggug

SEQ ID NO: 202760 - RNA, 32 nt, Human
ggugcaaggcuggagaaugggguaugauggcu

SEQ ID NO: 202761 - RNA, 32 nt, Human
ggugcaagggccucuuucaaaaugaacccacu

SEQ ID NO: 202762 - RNA, 32 nt, Human
ggugcaagucucccccugcaccccucccccag

SEQ ID NO: 202763 - RNA, 24 nt, Human
ggugcaagugauuguccugccuca

SEQ ID NO: 202764 - RNA, 32 nt, Human
ggugcaagugguagggacaagcagugaggugg

SEQ ID NO: 202765 - RNA, 20 nt, Human
ggugcaaguguagcauguca

SEQ ID NO: 202766 - RNA, 32 nt, Human
ggugcaauaagaauuuagggagaaauguuguu

SEQ ID NO: 202767 - RNA, 32 nt, Human
ggugcaaucucacugcaagcucugccucccag

SEQ ID NO: 202768 - RNA, 32 nt, Human
ggugcaaugacugcagcaccuccugggcuuac

SEQ ID NO: 202769 - RNA, 32 nt, Human
ggugcaaugggggagcuggcagaggagagaga

SEQ ID NO: 202770 - RNA, 32 nt, Human
ggugcaauguucuugagagguggggaccuaau

SEQ ID NO: 202771 - RNA, 32 nt, Human
ggugcacacagcaggugcagugcugucaccug

SEQ ID NO: 202772 - RNA, 32 nt, Human
ggugcacacaucugucccauguaugcagugag

SEQ ID NO: 202773 - RNA, 32 nt, Human
ggugcacaccuguaaucccagcuacucaggag

SEQ ID NO: 202774 - RNA, 32 nt, Human
ggugcacaccuguaaucccagcuacucgggag

SEQ ID NO: 202775 - RNA, 32 nt, Human
ggugcacaccuguaaucccagcuacuugggag

SEQ ID NO: 202776 - RNA, 32 nt, Human
ggugcacaccuguaaucccaguuacucaggag

SEQ ID NO: 202777 - RNA, 32 nt, Human
ggugcacagcaagacugauaaccacagugucc

SEQ ID NO: 202778 - RNA, 32 nt, Human
ggugcacaggacaaauaaaaacaaauaauuuc

SEQ ID NO: 202779 - RNA, 32 nt, Human
ggugcacaggucccucccaccugggcccuggg

SEQ ID NO: 202780 - RNA, 32 nt, Human
ggugcacaucuguaaucccaguuacuugggag

SEQ ID NO: 202781 - RNA, 32 nt, Human
ggugcaccacugccgucauuucagcuucuggc

SEQ ID NO: 202782 - RNA, 32 nt, Human
ggugcaccacugcgugaccuccaggcagccac

SEQ ID NO: 202783 - RNA, 32 nt, Human
ggugcaccaucuuccuccauuugacuuuuuaa

SEQ ID NO: 202784 - RNA, 32 nt, Human
ggugcaccauuaauaaccagcacuaguccaac

SEQ ID NO: 202785 - RNA, 32 nt, Human
ggugcacccaggcugcagggugaggccaggca

SEQ ID NO: 202786 - RNA, 32 nt, Human
ggugcacccugaccccauucagcagaaauugc

SEQ ID NO: 202787 - RNA, 32 nt, Human
ggugcaccgucuuccuccauuugacuuuuuaa

SEQ ID NO: 202788 - RNA, 32 nt, Human
ggugcaccugcuuugaaaaacaguuuggcagu

SEQ ID NO: 202789 - RNA, 18 nt, Human
ggugcaccuguaguccca

SEQ ID NO: 202790 - RNA, 32 nt, Human
ggugcacgccuguaacccagcuacucaggagg

SEQ ID NO: 202791 - RNA, 32 nt, Human
ggugcacgccuguaaucccagcuacucaggag

SEQ ID NO: 202792 - RNA, 32 nt, Human
ggugcacgccuguaaucccagcuacucgggag

SEQ ID NO: 202793 - RNA, 32 nt, Human
ggugcacgccuguaauccccagauacucggga

SEQ ID NO: 202794 - RNA, 32 nt, Human
ggugcacgccuguaaucucagcuacuugggag

SEQ ID NO: 202795 - RNA, 32 nt, Human
ggugcacgccugugaucccagcuacucgggag

SEQ ID NO: 202796 - RNA, 32 nt, Human
ggugcacgccuuuaaucccagcuacucgggag

SEQ ID NO: 202797 - RNA, 32 nt, Human
ggugcacgcuuguaaucccagcuacucaggag

SEQ ID NO: 202798 - RNA, 32 nt, Human
ggugcacgucuguaaucccagcugcucgggag

SEQ ID NO: 202799 - RNA, 32 nt, Human
ggugcacuaagccguagcggcagcagcagcca

SEQ ID NO: 202800 - RNA, 32 nt, Human
ggugcacuacagccucuuuccccgugucccgu

SEQ ID NO: 202801 - RNA, 32 nt, Human
ggugcacucagcugcacugcccagagcuguga

SEQ ID NO: 202802 - RNA, 32 nt, Human
ggugcacucagcugcccagggccucugggaca

SEQ ID NO: 202803 - RNA, 32 nt, Human
ggugcacuccuguaaucccagcuacucagaag

SEQ ID NO: 202804 - RNA, 32 nt, Human
ggugcagaagcagcaggaggcacuugaggagc

SEQ ID NO: 202805 - RNA, 32 nt, Human
ggugcagaagugaccgcggagacucugcuuca

SEQ ID NO: 202806 - RNA, 32 nt, Human
ggugcagaccaaacuuuaacaccuuuagccuu

SEQ ID NO: 202807 - RNA, 32 nt, Human
ggugcagacccaugggauccaaagggaaguug

SEQ ID NO: 202808 - RNA, 32 nt, Human
ggugcagacguggaacgcggaggcagggagag

SEQ ID NO: 202809 - RNA, 19 nt, Human
ggugcagacguuuaaccca

SEQ ID NO: 202810 - RNA, 32 nt, Human
ggugcagacugccccgugcucuggcuugcagc

SEQ ID NO: 202811 - RNA, 27 nt, Human
ggugcagagaagcuggacuucuguggg

SEQ ID NO: 202812 - RNA, 22 nt, Human
ggugcagagcaagacucugucu

SEQ ID NO: 202813 - RNA, 32 nt, Human
ggugcagcacuuccagcgggacacgcugugcg

SEQ ID NO: 202814 - RNA, 32 nt, Human
ggugcagcagagacccagguggcuguggggug

SEQ ID NO: 202815 - RNA, 32 nt, Human
ggugcagcagagccgagccggccgcgcuccga

SEQ ID NO: 202816 - RNA, 32 nt, Human
ggugcagcaggcggcgggaugcggcggggcgg

SEQ ID NO: 202817 - RNA, 32 nt, Human
ggugcagcagugagcaaaacucuugccccacg

SEQ ID NO: 202818 - RNA, 20 nt, Human
ggugcagcaguggaacaucu

SEQ ID NO: 202819 - RNA, 32 nt, Human
ggugcagccagccugcuccgagcuccccugca

SEQ ID NO: 202820 - RNA, 32 nt, Human
ggugcagccagcugcucagagagaccuggccu

SEQ ID NO: 202821 - RNA, 32 nt, Human
ggugcagcccagcagccuggagaugucagcac

SEQ ID NO: 202822 - RNA, 32 nt, Human
ggugcagcccagggucaggcccuucagagcca

SEQ ID NO: 202823 - RNA, 26 nt, Human
ggugcagcccccggcauugaccuccu

SEQ ID NO: 202824 - RNA, 32 nt, Human
ggugcagccccuggcagacugacaguguggcc

SEQ ID NO: 202825 - RNA, 20 nt, Human
ggugcagcccucgaccuccu

SEQ ID NO: 202826 - RNA, 32 nt, Human
ggugcagccgcugcucaaagaaaaugaacggc

SEQ ID NO: 202827 - RNA, 32 nt, Human
ggugcagccguuuuggaaaauagccuggcauu

SEQ ID NO: 202828 - RNA, 18 nt, Human
ggugcagccuagccuccu

SEQ ID NO: 202829 - RNA, 32 nt, Human
ggugcagcggacuugcuccagccugggugagg

SEQ ID NO: 202830 - RNA, 32 nt, Human
ggugcagcuccugucugcuuucccucgccucc

SEQ ID NO: 202831 - RNA, 32 nt, Human
ggugcagcugaccucccuccccuugugcagac

SEQ ID NO: 202832 - RNA, 32 nt, Human
ggugcaggaagcuucaucugaagauguccugg

SEQ ID NO: 202833 - RNA, 32 nt, Human
ggugcaggagaacagcucugugauaccauuua

SEQ ID NO: 202834 - RNA, 32 nt, Human
ggugcaggagccaagaccugaggguggaagug

SEQ ID NO: 202835 - RNA, 18 nt, Human
ggugcaggccaaccucuu

SEQ ID NO: 202836 - RNA, 19 nt, Human
ggugcaggccaccaugccc

SEQ ID NO: 202837 - RNA, 32 nt, Human
ggugcaggccuguaaucccagcuacucgggag

SEQ ID NO: 202838 - RNA, 32 nt, Human
ggugcaggcugcauggccgggcggggcggugu

SEQ ID NO: 202839 - RNA, 32 nt, Human
ggugcaggcuuagucuuaagccuccaaaggcc

SEQ ID NO: 202840 - RNA, 32 nt, Human
ggugcagggaagcacuccacacccucacccag

SEQ ID NO: 202841 - RNA, 32 nt, Human
ggugcagggacuucccuuugcaagggguaaca

SEQ ID NO: 202842 - RNA, 32 nt, Human
ggugcagggagggagaggcaggggagagagaa

SEQ ID NO: 202843 - RNA, 32 nt, Human
ggugcagggcagcagggcagccagugaaccac

SEQ ID NO: 202844 - RNA, 32 nt, Human
ggugcagggcagcagggggcacagugaagugc

SEQ ID NO: 202845 - RNA, 32 nt, Human
ggugcagggccuucccggggagccacagaauc

SEQ ID NO: 202846 - RNA, 32 nt, Human
ggugcagggcuagacacgaagcuuaaacuauu

SEQ ID NO: 202847 - RNA, 32 nt, Human
ggugcaggggaggggcgggagguggagcaggg

SEQ ID NO: 202848 - RNA, 32 nt, Human
ggugcaggucaucacaggacggcuccugggca

SEQ ID NO: 202849 - RNA, 22 nt, Human
ggugcaguagcucaugccugua

SEQ ID NO: 202850 - RNA, 32 nt, Human
ggugcaguaggugcaggugagcacaggugcag

SEQ ID NO: 202851 - RNA, 32 nt, Human
ggugcaguaguguggaguggaugaguguucca

SEQ ID NO: 202852 - RNA, 32 nt, Human
ggugcagucacuucuguaggcuucaagaggcu

SEQ ID NO: 202853 - RNA, 32 nt, Human
ggugcaguccaggaguauggaguagggcagaa

SEQ ID NO: 202854 - RNA, 32 nt, Human
ggugcaguccugcaccuuucucccucucugga

SEQ ID NO: 202855 - RNA, 32 nt, Human
ggugcagucgggaagggagaugugacggauga

SEQ ID NO: 202856 - RNA, 32 nt, Human
ggugcagucuguuucuccccuagacucugggc

SEQ ID NO: 202857 - RNA, 32 nt, Human
ggugcagugagcuaugauugcaccauugcacc

SEQ ID NO: 202858 - RNA, 21 nt, Human
ggugcagugccggcccagcua

SEQ ID NO: 202859 - RNA, 19 nt, Human
ggugcagugcguucauuca

SEQ ID NO: 202860 - RNA, 23 nt, Human
ggugcagugcugucaccuggcug

SEQ ID NO: 202861 - RNA, 22 nt, Human
ggugcagugcuguguguaucua

SEQ ID NO: 202862 - RNA, 19 nt, Human
ggugcaguggcagcgggag

SEQ ID NO: 202863 - RNA, 22 nt, Human
ggugcaguggcccaugccugua

SEQ ID NO: 202864 - RNA, 22 nt, Human
ggugcaguggcucacaccugua

SEQ ID NO: 202865 - RNA, 22 nt, Human
ggugcaguggcucacaccugug

SEQ ID NO: 202866 - RNA, 22 nt, Human
ggugcaguggcucacaucugua

SEQ ID NO: 202867 - RNA, 22 nt, Human
ggugcaguggcucacgccugua

SEQ ID NO: 202868 - RNA, 22 nt, Human
ggugcaguggcucacuccugua

SEQ ID NO: 202869 - RNA, 22 nt, Human
ggugcaguggcucaggccugua

SEQ ID NO: 202870 - RNA, 22 nt, Human
ggugcaguggcucaugccugua

SEQ ID NO: 202871 - RNA, 32 nt, Human
ggugcaguggcucgccuguaaucccagcacuu

SEQ ID NO: 202872 - RNA, 22 nt, Human
ggugcaguggcuuacaccugua

SEQ ID NO: 202873 - RNA, 22 nt, Human
ggugcagugguucaugccugua

SEQ ID NO: 202874 - RNA, 22 nt, Human
ggugcagugugcuguccagaga

SEQ ID NO: 202875 - RNA, 32 nt, Human
ggugcaguuggaauagccaccugcugagcuuu

SEQ ID NO: 202876 - RNA, 32 nt, Human
ggugcauacccccagcgugguuuuggagaugg

SEQ ID NO: 202877 - RNA, 32 nt, Human
ggugcauaccuguaaucccagcuacucgggaa

SEQ ID NO: 202878 - RNA, 32 nt, Human
ggugcauauaccacugccccgcugcaggcuga

SEQ ID NO: 202879 - RNA, 21 nt, Human
ggugcaucaagaguuuuuuca

SEQ ID NO: 202880 - RNA, 32 nt, Human
ggugcaucacuugaggccaggaguucgagacc

SEQ ID NO: 202881 - RNA, 32 nt, Human
ggugcauccacgcacccccacccugggacuuu

SEQ ID NO: 202882 - RNA, 32 nt, Human
ggugcauccacucagggcagccaguguuggug

SEQ ID NO: 202883 - RNA, 32 nt, Human
ggugcaucucuuuuaaggauugguaauuacgc

SEQ ID NO: 202884 - RNA, 32 nt, Human
ggugcaugauacaaggagagguugucaucugg

SEQ ID NO: 202885 - RNA, 32 nt, Human
ggugcaugccaguaaucccagcuacuugggag

SEQ ID NO: 202886 - RNA, 32 nt, Human
ggugcaugcccguaaucccagcuacucgggag

SEQ ID NO: 202887 - RNA, 32 nt, Human
ggugcaugccgggacggcgguggguggugcau

SEQ ID NO: 202888 - RNA, 32 nt, Human
ggugcaugccgggcauagcacaugugucccug

SEQ ID NO: 202889 - RNA, 20 nt, Human
ggugcaugccuauaauccca

SEQ ID NO: 202890 - RNA, 32 nt, Human
ggugcaugccuauaaucccagcuacucaggag

SEQ ID NO: 202891 - RNA, 32 nt, Human
ggugcaugccuauaaucccagguacuugggag

SEQ ID NO: 202892 - RNA, 32 nt, Human
ggugcaugccugaaaucccagcuacuugggag

SEQ ID NO: 202893 - RNA, 32 nt, Human
ggugcaugccugcaaucccagcuacucagagg

SEQ ID NO: 202894 - RNA, 32 nt, Human
ggugcaugccuggaaucccagcuacuugagag

SEQ ID NO: 202895 - RNA, 32 nt, Human
ggugcaugccuguaaccccagcuacucgggaa

SEQ ID NO: 202896 - RNA, 32 nt, Human
ggugcaugccuguaacuccagauacuugggau

SEQ ID NO: 202897 - RNA, 32 nt, Human
ggugcaugccuguaauccaagauacucaggag

SEQ ID NO: 202898 - RNA, 32 nt, Human
ggugcaugccuguaauccagcuacuugggagg

SEQ ID NO: 202899 - RNA, 20 nt, Human
ggugcaugccuguaauccca

SEQ ID NO: 202900 - RNA, 32 nt, Human
ggugcaugccuguaaucccacuacuggggugg

SEQ ID NO: 202901 - RNA, 32 nt, Human
ggugcaugccuguaaucccagccacucaggag

SEQ ID NO: 202902 - RNA, 32 nt, Human
ggugcaugccuguaaucccagcuacccugaag

SEQ ID NO: 202903 - RNA, 32 nt, Human
ggugcaugccuguaaucccagcuacuagggag

SEQ ID NO: 202904 - RNA, 32 nt, Human
ggugcaugccuguaaucccagcuacucaggag

SEQ ID NO: 202905 - RNA, 32 nt, Human
ggugcaugccuguaaucccagcuacucgggag

SEQ ID NO: 202906 - RNA, 32 nt, Human
ggugcaugccuguaaucccagcuacucuggag

SEQ ID NO: 202907 - RNA, 32 nt, Human
ggugcaugccuguaaucccagcuacuuggaag

SEQ ID NO: 202908 - RNA, 32 nt, Human
ggugcaugccuguaaucccagcuacuugggag

SEQ ID NO: 202909 - RNA, 32 nt, Human
ggugcaugccuguaaucccagcugcucaggag

SEQ ID NO: 202910 - RNA, 32 nt, Human
ggugcaugccuguaaucccagcugcuggggag

SEQ ID NO: 202911 - RNA, 32 nt, Human
ggugcaugccuguaaucccagcugcuugggag

SEQ ID NO: 202912 - RNA, 32 nt, Human
ggugcaugccuguaaucccagcuucuugggag

SEQ ID NO: 202913 - RNA, 32 nt, Human
ggugcaugccuguaaucccaguuacucaggag

SEQ ID NO: 202914 - RNA, 32 nt, Human
ggugcaugccuguaaucccaguuacuccagag

SEQ ID NO: 202915 - RNA, 32 nt, Human
ggugcaugccuguaaucccugcuacuugggag

SEQ ID NO: 202916 - RNA, 32 nt, Human
ggugcaugccuguaauccuagcuacucaggag

SEQ ID NO: 202917 - RNA, 32 nt, Human
ggugcaugccuguaauccuagcuacucgggag

SEQ ID NO: 202918 - RNA, 32 nt, Human
ggugcaugccuguaauccuagcugcuugggug

SEQ ID NO: 202919 - RNA, 32 nt, Human
ggugcaugccuguaaucucagcuacucgggag

SEQ ID NO: 202920 - RNA, 32 nt, Human
ggugcaugccuguaaucucagcuacuugggag

SEQ ID NO: 202921 - RNA, 32 nt, Human
ggugcaugccuguaaucucagcugcuccggag

SEQ ID NO: 202922 - RNA, 32 nt, Human
ggugcaugccuguaauuccagcggcuuggaag

SEQ ID NO: 202923 - RNA, 32 nt, Human
ggugcaugccuguagucacagcuacuugggag

SEQ ID NO: 202924 - RNA, 32 nt, Human
ggugcaugccuguagucccaacuacucaggag

SEQ ID NO: 202925 - RNA, 32 nt, Human
ggugcaugccuguagucccagcuacucaggag

SEQ ID NO: 202926 - RNA, 32 nt, Human
ggugcaugccuguagucccagcuacucgggag

SEQ ID NO: 202927 - RNA, 32 nt, Human
ggugcaugccuguagucccagcuacucuggag

SEQ ID NO: 202928 - RNA, 32 nt, Human
ggugcaugccuguagucccagcuacuugagug

SEQ ID NO: 202929 - RNA, 32 nt, Human
ggugcaugccuguagucccagcuacuugggag

SEQ ID NO: 202930 - RNA, 32 nt, Human
ggugcaugccuguagucccagcuacuugggau

SEQ ID NO: 202931 - RNA, 32 nt, Human
ggugcaugccuguagucccagcugcucaggag

SEQ ID NO: 202932 - RNA, 32 nt, Human
ggugcaugccuguagucccagguacucaggag

SEQ ID NO: 202933 - RNA, 32 nt, Human
ggugcaugccuguagucccgguuacucgggag

SEQ ID NO: 202934 - RNA, 32 nt, Human
ggugcaugccuguaguccuagcuauuugggag

SEQ ID NO: 202935 - RNA, 32 nt, Human
ggugcaugccuguagucucagcuacucaggag

SEQ ID NO: 202936 - RNA, 32 nt, Human
ggugcaugccuguaguuccagcuacucaggac

SEQ ID NO: 202937 - RNA, 32 nt, Human
ggugcaugccuguaguuccagcuacucaggag

SEQ ID NO: 202938 - RNA, 32 nt, Human
ggugcaugccuguaguuccagcuacuugggag

SEQ ID NO: 202939 - RNA, 32 nt, Human
ggugcaugccuguaguugcagcuacucauggg

SEQ ID NO: 202940 - RNA, 32 nt, Human
ggugcaugccuguaucccagcuacuugggagg

SEQ ID NO: 202941 - RNA, 32 nt, Human
ggugcaugccuguauucccagcuacucaggag

SEQ ID NO: 202942 - RNA, 32 nt, Human
ggugcaugccuguauucucagcuacucgggag

SEQ ID NO: 202943 - RNA, 32 nt, Human
ggugcaugccugucauccaagcuacucaagag

SEQ ID NO: 202944 - RNA, 32 nt, Human
ggugcaugccugucaucccagcuacuccagag

SEQ ID NO: 202945 - RNA, 32 nt, Human
ggugcaugccugugaucccaacuacucgggag

SEQ ID NO: 202946 - RNA, 32 nt, Human
ggugcaugccugugauccuagcugcuggggag

SEQ ID NO: 202947 - RNA, 32 nt, Human
ggugcaugccugugauccuggcuacuucagag

SEQ ID NO: 202948 - RNA, 32 nt, Human
ggugcaugccugugauuccagcuacuugggag

SEQ ID NO: 202949 - RNA, 32 nt, Human
ggugcaugccuguggucccagcuacucaggag

SEQ ID NO: 202950 - RNA, 32 nt, Human
ggugcaugccuguggucccagcuacuugggag

SEQ ID NO: 202951 - RNA, 32 nt, Human
ggugcaugccuguggucucagcuacuugggag

SEQ ID NO: 202952 - RNA, 32 nt, Human
ggugcaugccuguugucccagcuacucaggag

SEQ ID NO: 202953 - RNA, 32 nt, Human
ggugcaugcuuauaaucccagcuacuugggag

SEQ ID NO: 202954 - RNA, 32 nt, Human
ggugcaugcuuguaaucccagcuacucagaag

SEQ ID NO: 202955 - RNA, 32 nt, Human
ggugcaugcuuguaauccuagcuacucaagag

SEQ ID NO: 202956 - RNA, 32 nt, Human
ggugcauggacucguaaagcugcuagggcccc

SEQ ID NO: 202957 - RNA, 32 nt, Human
ggugcauggagaaaaaggaagacccguacucu

SEQ ID NO: 202958 - RNA, 21 nt, Human
ggugcauggggcaggcgggag

SEQ ID NO: 202959 - RNA, 32 nt, Human
ggugcauguauaccuguguaacaaaccugcau

SEQ ID NO: 202960 - RNA, 32 nt, Human
ggugcaugucacagagagacaguucucaguca

SEQ ID NO: 202961 - RNA, 32 nt, Human
ggugcaugucagaugaucauauccaauucaua

SEQ ID NO: 202962 - RNA, 19 nt, Human
ggugcaugugccacacuca

SEQ ID NO: 202963 - RNA, 32 nt, Human
ggugcauuaaggagcucauggaagaugaggca

SEQ ID NO: 202964 - RNA, 32 nt, Human
ggugcauucuguuuccucuugaucucaaagca

SEQ ID NO: 202965 - RNA, 32 nt, Human
ggugcauugccuguagucccagcuacuuggga

SEQ ID NO: 202966 - RNA, 32 nt, Human
ggugcauugugccaccagcaggccacagcugu

SEQ ID NO: 202967 - RNA, 22 nt, Human
ggugccaaaaauacacgucuuu

SEQ ID NO: 202968 - RNA, 19 nt, Human
ggugccaaauggagugaag

SEQ ID NO: 202969 - RNA, 18 nt, Human
ggugccaaccagcuguca

SEQ ID NO: 202970 - RNA, 32 nt, Human
ggugccaagaaugagcacuguacuguggcagu

SEQ ID NO: 202971 - RNA, 32 nt, Human
ggugccaaggaaaugaggauggaggaaggaau

SEQ ID NO: 202972 - RNA, 32 nt, Human
ggugccaaggagaaaaauggccaguuaggauc

SEQ ID NO: 202973 - RNA, 32 nt, Human
ggugccaaugcauuccagccuggaugauggag

SEQ ID NO: 202974 - RNA, 32 nt, Human
ggugccaaugugcccuggcaccccugcagagg

SEQ ID NO: 202975 - RNA, 32 nt, Human
ggugccaauuucuuuuccuccuggggcauccu

SEQ ID NO: 202976 - RNA, 22 nt, Human
ggugccacaggcagcccuggga

SEQ ID NO: 202977 - RNA, 32 nt, Human
ggugccacagggcgggguucaggcugggguau

SEQ ID NO: 202978 - RNA, 32 nt, Human
ggugccaccaccaaagcacucuucccacccua

SEQ ID NO: 202979 - RNA, 20 nt, Human
ggugccaccaggcccaggga

SEQ ID NO: 202980 - RNA, 32 nt, Human
ggugccacccacugcacuggggccagcuggga

SEQ ID NO: 202981 - RNA, 32 nt, Human
ggugccacccucgccucacagccccggccccc

SEQ ID NO: 202982 - RNA, 32 nt, Human
ggugccacccucucccugccaggggccugggg

SEQ ID NO: 202983 - RNA, 23 nt, Human
ggugccaccggguuccccagggg

SEQ ID NO: 202984 - RNA, 32 nt, Human
ggugccacuacacuccagccuggguaaaagag

SEQ ID NO: 202985 - RNA, 32 nt, Human
ggugccacugcacuccaaccugggggacagag

SEQ ID NO: 202986 - RNA, 32 nt, Human
ggugccacugcacuccagaugaguacagaaga

SEQ ID NO: 202987 - RNA, 32 nt, Human
ggugccacugcacuccagccuaggugacagag

SEQ ID NO: 202988 - RNA, 32 nt, Human
ggugccacugcacuccagccuggcgacagagc

SEQ ID NO: 202989 - RNA, 32 nt, Human
ggugccacugcacuccagccugggcaacagag

SEQ ID NO: 202990 - RNA, 32 nt, Human
ggugccacugcacuccagccugggcgaaagag

SEQ ID NO: 202991 - RNA, 32 nt, Human
ggugccacugcacuccagccugggggacagag

SEQ ID NO: 202992 - RNA, 32 nt, Human
ggugccacugcacuccagccugggugacagag

SEQ ID NO: 202993 - RNA, 32 nt, Human
ggugccacugcacuccagccuggguggcagag

SEQ ID NO: 202994 - RNA, 32 nt, Human
ggugccacugcacuccagcuuaggugacagag

SEQ ID NO: 202995 - RNA, 32 nt, Human
ggugccacugcacuccagcuugggugacagag

SEQ ID NO: 202996 - RNA, 32 nt, Human
ggugccacugcacuccaguauggaugacauag

SEQ ID NO: 202997 - RNA, 32 nt, Human
ggugccacugcacuccagucugggcaacagag

SEQ ID NO: 202998 - RNA, 32 nt, Human
ggugccacugcacucuaaccugggcgacagag

SEQ ID NO: 202999 - RNA, 32 nt, Human
ggugccacugcacuucagccugggcaacagag

SEQ ID NO: 203000 - RNA, 32 nt, Human
ggugccacugcauuccagccugggcaacagag

SEQ ID NO: 203001 - RNA, 32 nt, Human
ggugccacugcauuccagccugggugacagaa

SEQ ID NO: 203002 - RNA, 24 nt, Human
ggugccacugccuguggguugcug

SEQ ID NO: 203003 - RNA, 32 nt, Human
ggugccacugcgcuccagccugggggaggggg

SEQ ID NO: 203004 - RNA, 32 nt, Human
ggugccacuggacuccagccugggagacagaa

SEQ ID NO: 203005 - RNA, 23 nt, Human
ggugccacuguaagguucucuca

SEQ ID NO: 203006 - RNA, 32 nt, Human
ggugccacuguacuccagccugggugauagga

SEQ ID NO: 203007 - RNA, 32 nt, Human
ggugccacuguaguccggccugggcaacagau

SEQ ID NO: 203008 - RNA, 32 nt, Human
ggugccagaacacgcagcugcccacacgcaag

SEQ ID NO: 203009 - RNA, 32 nt, Human
ggugccagaagcagcgaggagcuucagcuucc

SEQ ID NO: 203010 - RNA, 32 nt, Human
ggugccagagggcagggagcucgccuggggag

SEQ ID NO: 203011 - RNA, 32 nt, Human
ggugccagaguccucauguggcuuggaggaaa

SEQ ID NO: 203012 - RNA, 32 nt, Human
ggugccagagugagacacagcaggacccuucc

SEQ ID NO: 203013 - RNA, 32 nt, Human
ggugccagcaggggacacagacugcaaagaga

SEQ ID NO: 203014 - RNA, 23 nt, Human
ggugccagcccccuuggcccccu

SEQ ID NO: 203015 - RNA, 32 nt, Human
ggugccagccugacugagaagaggacgcuccc

SEQ ID NO: 203016 - RNA, 32 nt, Human
ggugccagccuucuccccagugagaacaguuu

SEQ ID NO: 203017 - RNA, 32 nt, Human
ggugccagcuacuuggaaggcugagguaggag

SEQ ID NO: 203018 - RNA, 32 nt, Human
ggugccaggacugggagggaaaguccagggcc

SEQ ID NO: 203019 - RNA, 23 nt, Human
ggugccaggaguucuagaccagc

SEQ ID NO: 203020 - RNA, 32 nt, Human
ggugccaggaguucuagaccagccuggccaac

SEQ ID NO: 203021 - RNA, 32 nt, Human
ggugccaggauggugggagaacuccgcuacag

SEQ ID NO: 203022 - RNA, 32 nt, Human
ggugccaggcagugcugagagcaguggggcau

SEQ ID NO: 203023 - RNA, 32 nt, Human
ggugccagggcccaccaugucgggguaugguu

SEQ ID NO: 203024 - RNA, 32 nt, Human
ggugccagguucuccccuugagcuccugcucc

SEQ ID NO: 203025 - RNA, 32 nt, Human
ggugccagugucgccccgccuccgggguagaa

SEQ ID NO: 203026 - RNA, 32 nt, Human
ggugccaucagcaggaggcacugugaagcacc

SEQ ID NO: 203027 - RNA, 32 nt, Human
ggugccaucgcacucuagccuggggaauagag

SEQ ID NO: 203028 - RNA, 21 nt, Human
ggugccaucgggggccugcug

SEQ ID NO: 203029 - RNA, 32 nt, Human
ggugccaucuccccaugguucauguggagcca

SEQ ID NO: 203030 - RNA, 32 nt, Human
ggugccaucugaagcccccuucccagguuucu

SEQ ID NO: 203031 - RNA, 32 nt, Human
ggugccaucugucugcuucagaccaccucagg

SEQ ID NO: 203032 - RNA, 22 nt, Human
ggugccaugaccccugcuuucu

SEQ ID NO: 203033 - RNA, 32 nt, Human
ggugccaugagcugagcucagugaguggagcu

SEQ ID NO: 203034 - RNA, 32 nt, Human
ggugccauucuuaugagccaaaaguuugucau

SEQ ID NO: 203035 - RNA, 32 nt, Human
ggugccauugaacuccagucugggcuauucag

SEQ ID NO: 203036 - RNA, 32 nt, Human
ggugccauugcaggugcccccuccaggccuga

SEQ ID NO: 203037 - RNA, 32 nt, Human
ggugccauugcccuccagccugggcaagaacu

SEQ ID NO: 203038 - RNA, 32 nt, Human
ggugccauugcucuccagccugggcgacaaga

SEQ ID NO: 203039 - RNA, 32 nt, Human
ggugcccaacagccuggcaucuucuuguuucu

SEQ ID NO: 203040 - RNA, 21 nt, Human
ggugcccaaugccuguucucu

SEQ ID NO: 203041 - RNA, 32 nt, Human
ggugcccacacugccgcuccagccuuccuggc

SEQ ID NO: 203042 - RNA, 32 nt, Human
ggugcccacagccgucuggcucagggacucca

SEQ ID NO: 203043 - RNA, 32 nt, Human
ggugcccacaguuggagcccaggggccauguu

SEQ ID NO: 203044 - RNA, 21 nt, Human
ggugcccacaucagcuccuca

SEQ ID NO: 203045 - RNA, 20 nt, Human
ggugcccacaucagcuccuu

SEQ ID NO: 203046 - RNA, 32 nt, Human
ggugcccaccaccaccccuggcuaaauuugua

SEQ ID NO: 203047 - RNA, 32 nt, Human
ggugcccaccauguuugcacuuuuaauaacuc

SEQ ID NO: 203048 - RNA, 32 nt, Human
ggugcccacccagcuacuggggaggcugaguc

SEQ ID NO: 203049 - RNA, 32 nt, Human
ggugcccagcucagggcagccagguggcucau

SEQ ID NO: 203050 - RNA, 32 nt, Human
ggugcccagcugcuugggaggcugagguagga

SEQ ID NO: 203051 - RNA, 32 nt, Human
ggugcccaggacgcaugggcucugaugggaag

SEQ ID NO: 203052 - RNA, 32 nt, Human
ggugcccagguggaggugcaguggggguaagg

SEQ ID NO: 203053 - RNA, 22 nt, Human
ggugcccaguuggccuuggaaa

SEQ ID NO: 203054 - RNA, 32 nt, Human
ggugcccauccagcccaggucccaggaucccu

SEQ ID NO: 203055 - RNA, 32 nt, Human
ggugcccaucuucucucuccuagagcccauac

SEQ ID NO: 203056 - RNA, 32 nt, Human
ggugcccaugaagaggagauuggccagugaga

SEQ ID NO: 203057 - RNA, 32 nt, Human
ggugcccaugaccacaaaguguagcagccucc

SEQ ID NO: 203058 - RNA, 26 nt, Human
ggugcccauuucuugggggcuuucca

SEQ ID NO: 203059 - RNA, 32 nt, Human
ggugccccaaaggacaaucucuaaagggguaa

SEQ ID NO: 203060 - RNA, 23 nt, Human
ggugccccacacagggcucucca

SEQ ID NO: 203061 - RNA, 32 nt, Human
ggugccccaccuuuuaaagcaauuaccguaag

SEQ ID NO: 203062 - RNA, 32 nt, Human
ggugccccagagacaggagcacaagugggauc

SEQ ID NO: 203063 - RNA, 32 nt, Human
ggugccccagcacgguggugcccaagccaacc

SEQ ID NO: 203064 - RNA, 32 nt, Human
ggugccccagccgccgcccaggaccaucaagc

SEQ ID NO: 203065 - RNA, 32 nt, Human
ggugccccaggucuguuaugggcacgggcugu

SEQ ID NO: 203066 - RNA, 32 nt, Human
ggugccccaucuagcugggugcaggggucacu

SEQ ID NO: 203067 - RNA, 17 nt, Human
ggugcccccacgagugg

SEQ ID NO: 203068 - RNA, 32 nt, Human
ggugcccccuuucugccagcaguucugguucu

SEQ ID NO: 203069 - RNA, 32 nt, Human
ggugccccguuggaaagcagauauuucccgga

SEQ ID NO: 203070 - RNA, 32 nt, Human
ggugccccuccaccuuccucuggaauccaagu

SEQ ID NO: 203071 - RNA, 32 nt, Human
ggugccccuggccuggccagcagugaauguag

SEQ ID NO: 203072 - RNA, 32 nt, Human
ggugccccugugagccucgaccuugcccccuc

SEQ ID NO: 203073 - RNA, 32 nt, Human
ggugcccgccaccacaccagccuaauuuuugu

SEQ ID NO: 203074 - RNA, 20 nt, Human
ggugcccgggcccugggccc

SEQ ID NO: 203075 - RNA, 22 nt, Human
ggugcccgggcggcagcggcag

SEQ ID NO: 203076 - RNA, 16 nt, Human
ggugcccguaauccca

SEQ ID NO: 203077 - RNA, 32 nt, Human
ggugcccguagaucugggaggccaggcuggca

SEQ ID NO: 203078 - RNA, 32 nt, Human
ggugcccgucauggaagaggcggccaugcugu

SEQ ID NO: 203079 - RNA, 32 nt, Human
ggugcccgucugcugaugugcccagccugugc

SEQ ID NO: 203080 - RNA, 32 nt, Human
ggugcccucacaggccaauagggaagccgagg

SEQ ID NO: 203081 - RNA, 32 nt, Human
ggugcccucagagccaccucugccugugaucg

SEQ ID NO: 203082 - RNA, 17 nt, Human
ggugcccucggguucag

SEQ ID NO: 203083 - RNA, 32 nt, Human
ggugcccucugccucuucaccccacaagaagc

SEQ ID NO: 203084 - RNA, 32 nt, Human
ggugcccugcagcugugccaguugggccacag

SEQ ID NO: 203085 - RNA, 32 nt, Human
ggugcccugccugcccuccugguacuguuguc

SEQ ID NO: 203086 - RNA, 32 nt, Human
ggugcccugccuggccccacccaugcucaggg

SEQ ID NO: 203087 - RNA, 22 nt, Human
ggugcccuggugagagcuccuu

SEQ ID NO: 203088 - RNA, 32 nt, Human
ggugcccugucccagccccagguccugugcag

SEQ ID NO: 203089 - RNA, 32 nt, Human
ggugcccugugcagggugccaccacagccuca

SEQ ID NO: 203090 - RNA, 32 nt, Human
ggugcccuucugucuguccacgucugccuagg

SEQ ID NO: 203091 - RNA, 32 nt, Human
ggugccgagcugccucaccagggagggccuug

SEQ ID NO: 203092 - RNA, 21 nt, Human
ggugccgaugggaccaggcug

SEQ ID NO: 203093 - RNA, 32 nt, Human
ggugccgcagaggaggugggaaagacgcuuuu

SEQ ID NO: 203094 - RNA, 32 nt, Human
ggugccgcagcacugcaccagcuucgccuugc

SEQ ID NO: 203095 - RNA, 32 nt, Human
ggugccgcaggcugggcuugcuaauaaagacc

SEQ ID NO: 203096 - RNA, 32 nt, Human
ggugccgcauuccugcacucagaagucugcag

SEQ ID NO: 203097 - RNA, 32 nt, Human
ggugccgccugcccgucucucucccauggagc

SEQ ID NO: 203098 - RNA, 32 nt, Human
ggugccgcuccagcuacucaggaggcugaggc

SEQ ID NO: 203099 - RNA, 32 nt, Human
ggugccgcugucaggagcagagccaggcccag

SEQ ID NO: 203100 - RNA, 32 nt, Human
ggugccggagccggagcggggagccaggcugc

SEQ ID NO: 203101 - RNA, 32 nt, Human
ggugccggaggcaggguucgggugcguagucg

SEQ ID NO: 203102 - RNA, 32 nt, Human
ggugccggcaucuccccuagcucaccaggccu

SEQ ID NO: 203103 - RNA, 32 nt, Human
ggugccggcggcccggagcagcgcggcccgcg

SEQ ID NO: 203104 - RNA, 32 nt, Human
ggugccggcugaggcagaggagaaacuauggg

SEQ ID NO: 203105 - RNA, 21 nt, Human
ggugccgggacuccggccgca

SEQ ID NO: 203106 - RNA, 18 nt, Human
ggugccggggguggggug

SEQ ID NO: 203107 - RNA, 32 nt, Human
ggugccggugccuguccccgggggcgccaugg

SEQ ID NO: 203108 - RNA, 23 nt, Human
ggugccgguggcggcggcggggg

SEQ ID NO: 203109 - RNA, 32 nt, Human
ggugccguccggcugcucagcugcuggcugga

SEQ ID NO: 203110 - RNA, 22 nt, Human
ggugccguggcucacaccugua

SEQ ID NO: 203111 - RNA, 22 nt, Human
ggugccguggcucacaucugua

SEQ ID NO: 203112 - RNA, 32 nt, Human
ggugccguugcacuccagccgggcaacaaggg

SEQ ID NO: 203113 - RNA, 21 nt, Human
ggugccuaacgguucugcuca

SEQ ID NO: 203114 - RNA, 32 nt, Human
ggugccuaccacacaggaaaccuugaagaaaa

SEQ ID NO: 203115 - RNA, 17 nt, Human
ggugccuacucauugua

SEQ ID NO: 203116 - RNA, 32 nt, Human
ggugccuacuucucauugucugauuucucauu

SEQ ID NO: 203117 - RNA, 32 nt, Human
ggugccuaguggaccucagacauggcucagcc

SEQ ID NO: 203118 - RNA, 16 nt, Human
ggugccuauaauccca

SEQ ID NO: 203119 - RNA, 32 nt, Human
ggugccuauagucccagcuacucuggaggcug

SEQ ID NO: 203120 - RNA, 24 nt, Human
ggugccuauauucaaggcucuuuc

SEQ ID NO: 203121 - RNA, 22 nt, Human
ggugccuaugcaaguucauuua

SEQ ID NO: 203122 - RNA, 32 nt, Human
ggugccuauuuauuggggaucugcauuccccg

SEQ ID NO: 203123 - RNA, 32 nt, Human
ggugccucaagaggaagauagacaggaggagg

SEQ ID NO: 203124 - RNA, 20 nt, Human
ggugccucacaucuguaauc

SEQ ID NO: 203125 - RNA, 20 nt, Human
ggugccucacgccuguaauc

SEQ ID NO: 203126 - RNA, 23 nt, Human
ggugccucacgccuguaauccca

SEQ ID NO: 203127 - RNA, 31 nt, Human
ggugccucagagagagacaagucuggaugag

SEQ ID NO: 203128 - RNA, 32 nt, Human
ggugccucagcagauaccagagcuuauucuua

SEQ ID NO: 203129 - RNA, 32 nt, Human
ggugccucaguccauggucaccaucgacacgu

SEQ ID NO: 203130 - RNA, 32 nt, Human
ggugccucagugccaagucaggagcugcuugu

SEQ ID NO: 203131 - RNA, 20 nt, Human
ggugccucaugccuguaauc

SEQ ID NO: 203132 - RNA, 32 nt, Human
ggugccuccacucagcucaauuccaguuuucu

SEQ ID NO: 203133 - RNA, 32 nt, Human
ggugccuccagccagagcucccugcgcucgcu

SEQ ID NO: 203134 - RNA, 32 nt, Human
ggugccuccagccucaacagugggcauggaca

SEQ ID NO: 203135 - RNA, 32 nt, Human
ggugccuccagccugagacaucaggggagagc

SEQ ID NO: 203136 - RNA, 32 nt, Human
ggugccucccccaacccccacacccaugcaga

SEQ ID NO: 203137 - RNA, 32 nt, Human
ggugccuccgccauagcuucugucgcuccauc

SEQ ID NO: 203138 - RNA, 23 nt, Human
ggugccucgcagggccucucuua

SEQ ID NO: 203139 - RNA, 32 nt, Human
ggugccucucguccaugcuccugggccccagc

SEQ ID NO: 203140 - RNA, 32 nt, Human
ggugccucucuggcccuccacugacuauaccc

SEQ ID NO: 203141 - RNA, 32 nt, Human
ggugccucucuggcccuccacugacuguaccc

SEQ ID NO: 203142 - RNA, 32 nt, Human
ggugccucugcagagagaucccugccugggac

SEQ ID NO: 203143 - RNA, 32 nt, Human
ggugccucugccauagcuucugucgccugugc

SEQ ID NO: 203144 - RNA, 32 nt, Human
ggugccucuuccacucuggagugaaguuaaug

SEQ ID NO: 203145 - RNA, 32 nt, Human
ggugccugaggcugaauggcuccaccccuccc

SEQ ID NO: 203146 - RNA, 32 nt, Human
ggugccugagucgcacagucucucccacccga

SEQ ID NO: 203147 - RNA, 32 nt, Human
ggugccugagucugcacgcuggcuucugaccc

SEQ ID NO: 203148 - RNA, 32 nt, Human
ggugccugcagauuacauucuccugggauucu

SEQ ID NO: 203149 - RNA, 32 nt, Human
ggugccugcagcaggagccaggaacgcccggc

SEQ ID NO: 203150 - RNA, 32 nt, Human
ggugccugcagccucuugucugguugaggacu

SEQ ID NO: 203151 - RNA, 32 nt, Human
ggugccugcaggaguccuggggccagcuggcc

SEQ ID NO: 203152 - RNA, 32 nt, Human
ggugccugcccaggauggguaggaaaugcuga

SEQ ID NO: 203153 - RNA, 21 nt, Human
ggugccugccccagccucuca

SEQ ID NO: 203154 - RNA, 32 nt, Human
ggugccugccuguaauccagcuacucaggagg

SEQ ID NO: 203155 - RNA, 32 nt, Human
ggugccugcuagccucaaucccccgaaguggg

SEQ ID NO: 203156 - RNA, 32 nt, Human
ggugccugcuguggcacagagcugggaaggcc

SEQ ID NO: 203157 - RNA, 32 nt, Human
ggugccuggagccagaggucggggaguaagca

SEQ ID NO: 203158 - RNA, 32 nt, Human
ggugccuggagucccagcuacucgggaggcug

SEQ ID NO: 203159 - RNA, 18 nt, Human
ggugccuggccugugcca

SEQ ID NO: 203160 - RNA, 32 nt, Human
ggugccugggagggcugcugcaguggggucug

SEQ ID NO: 203161 - RNA, 32 nt, Human
ggugccugggaggugggugugggggugguggg

SEQ ID NO: 203162 - RNA, 32 nt, Human
ggugccugggcuagggcugcaggcuggcuggc

SEQ ID NO: 203163 - RNA, 32 nt, Human
ggugccugggcuggguguggggcagggccugg

SEQ ID NO: 203164 - RNA, 32 nt, Human
ggugccugguuccucuggguugggagaggggc

SEQ ID NO: 203165 - RNA, 32 nt, Human
ggugccuguaaccccagcuacuugggaggcug

SEQ ID NO: 203166 - RNA, 32 nt, Human
ggugccuguaacucauuagacguacugaggca

SEQ ID NO: 203167 - RNA, 15 nt, Human
ggugccuguaauccc

SEQ ID NO: 203168 - RNA, 16 nt, Human
ggugccuguaauccca

SEQ ID NO: 203169 - RNA, 32 nt, Human
ggugccuguaaucccagcuacaugggagccug

SEQ ID NO: 203170 - RNA, 32 nt, Human
ggugccuguaaucccagcuacgugggaggcug

SEQ ID NO: 203171 - RNA, 32 nt, Human
ggugccuguaaucccagcuacucgggagacug

SEQ ID NO: 203172 - RNA, 32 nt, Human
ggugccuguaaucccagcuacucgggaggcug

SEQ ID NO: 203173 - RNA, 32 nt, Human
ggugccuguaaucccagcuacucgggagguug

SEQ ID NO: 203174 - RNA, 32 nt, Human
ggugccuguaaucccagcuacuggggaaagcu

SEQ ID NO: 203175 - RNA, 32 nt, Human
ggugccuguaaucccagcuacuggggaggcug

SEQ ID NO: 203176 - RNA, 32 nt, Human
ggugccuguaaucccagcuacuugagagucug

SEQ ID NO: 203177 - RNA, 32 nt, Human
ggugccuguaaucccagcuacuugggaagcug

SEQ ID NO: 203178 - RNA, 32 nt, Human
ggugccuguaaucccagcuacuugggagacug

SEQ ID NO: 203179 - RNA, 32 nt, Human
ggugccuguaaucccagcuacuugggaggcag

SEQ ID NO: 203180 - RNA, 32 nt, Human
ggugccuguaaucccagcuacuugggaggccg

SEQ ID NO: 203181 - RNA, 32 nt, Human
ggugccuguaaucccagcuacuugggaggcug

SEQ ID NO: 203182 - RNA, 32 nt, Human
ggugccuguaaucccagcuauucaggaggcug

SEQ ID NO: 203183 - RNA, 32 nt, Human
ggugccuguaaucccagcuccuugggaggcua

SEQ ID NO: 203184 - RNA, 16 nt, Human
ggugccuguaauccua

SEQ ID NO: 203185 - RNA, 16 nt, Human
ggugccuguaaucuca

SEQ ID NO: 203186 - RNA, 16 nt, Human
ggugccuguaauucca

SEQ ID NO: 203187 - RNA, 20 nt, Human
ggugccuguaggcuauggua

SEQ ID NO: 203188 - RNA, 16 nt, Human
ggugccuguaguccca

SEQ ID NO: 203189 - RNA, 32 nt, Human
ggugccuguagucccagccacuugggagucug

SEQ ID NO: 203190 - RNA, 32 nt, Human
ggugccuguagucccagcuacucaggaggcug

SEQ ID NO: 203191 - RNA, 32 nt, Human
ggugccuguagucccagcuacucgggaagcug

SEQ ID NO: 203192 - RNA, 32 nt, Human
ggugccuguagucccagcuacucgggaggcug

SEQ ID NO: 203193 - RNA, 32 nt, Human
ggugccuguagucccagcuacucuggaggcug

SEQ ID NO: 203194 - RNA, 32 nt, Human
ggugccuguagucccagcuacuugggacaccg

SEQ ID NO: 203195 - RNA, 32 nt, Human
ggugccuguagucccagcuacuugggaggcug

SEQ ID NO: 203196 - RNA, 32 nt, Human
ggugccuguagucccagcuagucgggaggcug

SEQ ID NO: 203197 - RNA, 32 nt, Human
ggugccuguagucccagcuaucugggaggcug

SEQ ID NO: 203198 - RNA, 32 nt, Human
ggugccuguagucccagcuauuugggaggcug

SEQ ID NO: 203199 - RNA, 32 nt, Human
ggugccuguagucccagcugcucgggaggcug

SEQ ID NO: 203200 - RNA, 32 nt, Human
ggugccuguccucuccugccuccugggauuca

SEQ ID NO: 203201 - RNA, 20 nt, Human
ggugccugugagcucaucuc

SEQ ID NO: 203202 - RNA, 32 nt, Human
ggugccugugagcucaucucccaggaugguga

SEQ ID NO: 203203 - RNA, 24 nt, Human
ggugccugugcuugaagguugcug

SEQ ID NO: 203204 - RNA, 32 nt, Human
ggugccuguggucccagcuacuggggaggcug

SEQ ID NO: 203205 - RNA, 32 nt, Human
ggugccuguggucccagcugcucggaaggcug

SEQ ID NO: 203206 - RNA, 32 nt, Human
ggugccuguggucccagcugcucgggaggcug

SEQ ID NO: 203207 - RNA, 32 nt, Human
ggugccuguggucccagcugcuugggaggcug

SEQ ID NO: 203208 - RNA, 20 nt, Human
ggugccuucagaggcucucu

SEQ ID NO: 203209 - RNA, 24 nt, Human
ggugccuucagggaaaguuuucuu

SEQ ID NO: 203210 - RNA, 32 nt, Human
ggugccuugcagagagacucacagcaacucuc

SEQ ID NO: 203211 - RNA, 32 nt, Human
ggugccuuuagucccagcucuuugggaagcug

SEQ ID NO: 203212 - RNA, 32 nt, Human
ggugcgaagcccagaggaggcggcuugggauc

SEQ ID NO: 203213 - RNA, 32 nt, Human
ggugcgacucucucccuuccucauccaccucu

SEQ ID NO: 203214 - RNA, 32 nt, Human
ggugcgagaguggcgggacugggugaagagug

SEQ ID NO: 203215 - RNA, 32 nt, Human
ggugcgagccacugcaccuggcccacauuuuu

SEQ ID NO: 203216 - RNA, 32 nt, Human
ggugcgagcccagauggcgagccccaggggau

SEQ ID NO: 203217 - RNA, 32 nt, Human
ggugcgagccuguaauuccagcuacuuggagg

SEQ ID NO: 203218 - RNA, 20 nt, Human
ggugcgauaaagaagaggac

SEQ ID NO: 203219 - RNA, 32 nt, Human
ggugcgaucuccaggcuuuuguccucaaaacc

SEQ ID NO: 203220 - RNA, 32 nt, Human
ggugcgauggcagagcgcggcccccgccgcug

SEQ ID NO: 203221 - RNA, 18 nt, Human
ggugcgauucuccugccu

SEQ ID NO: 203222 - RNA, 32 nt, Human
ggugcgcacagcccuugucggugccccggccc

SEQ ID NO: 203223 - RNA, 32 nt, Human
ggugcgcaccaccacacccggcuaguuucugu

SEQ ID NO: 203224 - RNA, 32 nt, Human
ggugcgcaccuggaugcuggauggggacggcu

SEQ ID NO: 203225 - RNA, 32 nt, Human
ggugcgcaccuguaaucccagccacucagaag

SEQ ID NO: 203226 - RNA, 32 nt, Human
ggugcgcaccuguaaucccagcuacuuggaag

SEQ ID NO: 203227 - RNA, 32 nt, Human
ggugcgcaccuguaaucccagcuacuugggag

SEQ ID NO: 203228 - RNA, 32 nt, Human
ggugcgcaccuguaauuccagcuacucgggag

SEQ ID NO: 203229 - RNA, 20 nt, Human
ggugcgcacgaccauaccca

SEQ ID NO: 203230 - RNA, 32 nt, Human
ggugcgcagaagacuggaggaggcggagcgcc

SEQ ID NO: 203231 - RNA, 32 nt, Human
ggugcgcagcgccgaggaaaagaauggggagg

SEQ ID NO: 203232 - RNA, 32 nt, Human
ggugcgcaggaguggcuggcuuugccuuguuc

SEQ ID NO: 203233 - RNA, 32 nt, Human
ggugcgcaguagcgggccuggccagcggcucg

SEQ ID NO: 203234 - RNA, 21 nt, Human
ggugcgccaaaagcuuuuuca

SEQ ID NO: 203235 - RNA, 32 nt, Human
ggugcgccugaguuccagcuacucaggaggcu

SEQ ID NO: 203236 - RNA, 32 nt, Human
ggugcgccugugcagcccucccagguggagua

SEQ ID NO: 203237 - RNA, 32 nt, Human
ggugcgcgcauguaaucccagcuacucgggag

SEQ ID NO: 203238 - RNA, 32 nt, Human
ggugcgcgccuguaaucccagcuacucaggag

SEQ ID NO: 203239 - RNA, 32 nt, Human
ggugcgcgcugucgcaaccugcccucauccug

SEQ ID NO: 203240 - RNA, 32 nt, Human
ggugcgcggggugcuccugggguggaggccuc

SEQ ID NO: 203241 - RNA, 31 nt, Human
ggugcgcucgcucagcaccuacucggccgcc

SEQ ID NO: 203242 - RNA, 32 nt, Human
ggugcgcugagcugcaacuucuuacuucccua

SEQ ID NO: 203243 - RNA, 32 nt, Human
ggugcgcuguggacacagcaguccgcggaauu

SEQ ID NO: 203244 - RNA, 32 nt, Human
ggugcgcuguggaucaagacacuuugguauga

SEQ ID NO: 203245 - RNA, 18 nt, Human
ggugcgcuuguaauccca

SEQ ID NO: 203246 - RNA, 32 nt, Human
ggugcgcuuguaaucccagcuacucaggaggc

SEQ ID NO: 203247 - RNA, 32 nt, Human
ggugcgcuuguaaucccagcuacucgggaggc

SEQ ID NO: 203248 - RNA, 32 nt, Human
ggugcggaaagccaggcaguugggacagaggu

SEQ ID NO: 203249 - RNA, 32 nt, Human
ggugcggacaguucagacucagcaguccuguu

SEQ ID NO: 203250 - RNA, 32 nt, Human
ggugcggagggagucccugaaacuucucccaa

SEQ ID NO: 203251 - RNA, 32 nt, Human
ggugcggaggggagucagagacccccggaugg

SEQ ID NO: 203252 - RNA, 32 nt, Human
ggugcggcagagagaggaaggcagggaggugc

SEQ ID NO: 203253 - RNA, 25 nt, Human
ggugcggcagggacacccgaccaca

SEQ ID NO: 203254 - RNA, 32 nt, Human
ggugcggcccaaggcccagcuggugcuggcug

SEQ ID NO: 203255 - RNA, 32 nt, Human
ggugcggccugguccggggaggagaacaugcc

SEQ ID NO: 203256 - RNA, 18 nt, Human
ggugcggcgcacgggcgg

SEQ ID NO: 203257 - RNA, 32 nt, Human
ggugcggcggugcuggagguugcggcggcggc

SEQ ID NO: 203258 - RNA, 32 nt, Human
ggugcggcgugaagaugcccuuuuuacccguu

SEQ ID NO: 203259 - RNA, 32 nt, Human
ggugcgggccgccaccacugcuccuugacucu

SEQ ID NO: 203260 - RNA, 32 nt, Human
ggugcgggcuccgaauucuuuccaauagucug

SEQ ID NO: 203261 - RNA, 32 nt, Human
ggugcggggagugucucugaggugaggccggg

SEQ ID NO: 203262 - RNA, 31 nt, Human
ggugcggggcugucucccggcugggacucgc

SEQ ID NO: 203263 - RNA, 32 nt, Human
ggugcgggggaggaggaggaggacgccgcggu

SEQ ID NO: 203264 - RNA, 32 nt, Human
ggugcggggugcuuucuccacccccacacucc

SEQ ID NO: 203265 - RNA, 32 nt, Human
ggugcggguggaguacugggaggcaggaggug

SEQ ID NO: 203266 - RNA, 32 nt, Human
ggugcggucuccccucuccaaaugccaccucu

SEQ ID NO: 203267 - RNA, 32 nt, Human
ggugcgguggaggcggccuugcgguggugcuu

SEQ ID NO: 203268 - RNA, 22 nt, Human
ggugcgguggcacgugccugua

SEQ ID NO: 203269 - RNA, 22 nt, Human
ggugcgguggcucaagccugua

SEQ ID NO: 203270 - RNA, 22 nt, Human
ggugcgguggcucacaccugua

SEQ ID NO: 203271 - RNA, 22 nt, Human
ggugcgguggcucacgccugua

SEQ ID NO: 203272 - RNA, 22 nt, Human
ggugcgguggcucacgucugua

SEQ ID NO: 203273 - RNA, 22 nt, Human
ggugcgguggcucacuccugua

SEQ ID NO: 203274 - RNA, 22 nt, Human
ggugcgguggcucauaccugua

SEQ ID NO: 203275 - RNA, 20 nt, Human
ggugcgguggcucaugccug

SEQ ID NO: 203276 - RNA, 22 nt, Human
ggugcgguggcucaugccugua

SEQ ID NO: 203277 - RNA, 22 nt, Human
ggugcgguggcucccgccugug

SEQ ID NO: 203278 - RNA, 22 nt, Human
ggugcgguggcucguaccugua

SEQ ID NO: 203279 - RNA, 32 nt, Human
ggugcgucuaagaugagggggccaggcggugg

SEQ ID NO: 203280 - RNA, 32 nt, Human
ggugcgucuguguuagcuucaaaggaaguugg

SEQ ID NO: 203281 - RNA, 18 nt, Human
ggugcgugacagugggag

SEQ ID NO: 203282 - RNA, 32 nt, Human
ggugcgugccuguaaucccaacuacuugggag

SEQ ID NO: 203283 - RNA, 32 nt, Human
ggugcgugccuguaaucccagcuacucaggag

SEQ ID NO: 203284 - RNA, 32 nt, Human
ggugcgugccuguaaucccagcuacucgggag

SEQ ID NO: 203285 - RNA, 32 nt, Human
ggugcgugccuguaaucccagcuacucggggg

SEQ ID NO: 203286 - RNA, 32 nt, Human
ggugcgugccuguagccucagcuacucgggug

SEQ ID NO: 203287 - RNA, 32 nt, Human
ggugcgugccuguagucccagcuacucagggc

SEQ ID NO: 203288 - RNA, 32 nt, Human
ggugcgugccuguagucccagcuacucgggag

SEQ ID NO: 203289 - RNA, 32 nt, Human
ggugcgugccuguagucccagcuacuuaggag

SEQ ID NO: 203290 - RNA, 32 nt, Human
ggugcgugccuguagucccagcuacuugggag

SEQ ID NO: 203291 - RNA, 32 nt, Human
ggugcgugccuguagucucagcuacucaggag

SEQ ID NO: 203292 - RNA, 32 nt, Human
ggugcgugccuguagugccagcuacucaggag

SEQ ID NO: 203293 - RNA, 32 nt, Human
ggugcgugccuguaguuccagcuacuugggag

SEQ ID NO: 203294 - RNA, 32 nt, Human
ggugcgugccuguauucccggccacucgggag

SEQ ID NO: 203295 - RNA, 32 nt, Human
ggugcgugccugugaucccagcugcucaggag

SEQ ID NO: 203296 - RNA, 32 nt, Human
ggugcguggagguggagccugcggcuggagua

SEQ ID NO: 203297 - RNA, 23 nt, Human
ggugcguggaucaccugagguca

SEQ ID NO: 203298 - RNA, 32 nt, Human
ggugcguguccccauucccugcaacagcaaau

SEQ ID NO: 203299 - RNA, 32 nt, Human
ggugcguguucacaaagcaaauauggccugua

SEQ ID NO: 203300 - RNA, 32 nt, Human
ggugcguugcagaauggugccuguggcaugau

SEQ ID NO: 203301 - RNA, 32 nt, Human
ggugcuaacacccccuucccagccucugggaa

SEQ ID NO: 203302 - RNA, 32 nt, Human
ggugcuaaguacuaccccuucaucuuccaugg

SEQ ID NO: 203303 - RNA, 32 nt, Human
ggugcuaauguaaaugguacuuaaacauuuuu

SEQ ID NO: 203304 - RNA, 32 nt, Human
ggugcuaauugcuuggaucuccuucauuagga

SEQ ID NO: 203305 - RNA, 32 nt, Human
ggugcuaccaaggaagagagcacacagauaag

SEQ ID NO: 203306 - RNA, 32 nt, Human
ggugcuaccuguuuggggcaaauguucaaaaa

SEQ ID NO: 203307 - RNA, 32 nt, Human
ggugcuacgaccagggugagaauaaagacguc

SEQ ID NO: 203308 - RNA, 32 nt, Human
ggugcuacugaacaugacagcuucuugucaug

SEQ ID NO: 203309 - RNA, 32 nt, Human
ggugcuagaaguucaggugagaacagggcaga

SEQ ID NO: 203310 - RNA, 32 nt, Human
ggugcuagcagcuucagcggaacagggugaga

SEQ ID NO: 203311 - RNA, 32 nt, Human
ggugcuagcuucccuuaaucuuccagcagcaa

SEQ ID NO: 203312 - RNA, 32 nt, Human
ggugcuaggauuacaggcaugagccaccgcac

SEQ ID NO: 203313 - RNA, 32 nt, Human
ggugcuaggauuauaggcuugagccaccaugc

SEQ ID NO: 203314 - RNA, 32 nt, Human
ggugcuaguuggucaacccugccugcauacau

SEQ ID NO: 203315 - RNA, 20 nt, Human
ggugcuauucuuuccugagg

SEQ ID NO: 203316 - RNA, 32 nt, Human
ggugcucaauuaaacauuacuguuuuccaugc

SEQ ID NO: 203317 - RNA, 21 nt, Human
ggugcucacaauugucucuca

SEQ ID NO: 203318 - RNA, 31 nt, Human
ggugcucacagcuguaaucccagcacuuuga

SEQ ID NO: 203319 - RNA, 32 nt, Human
ggugcucacagcuguaaucccagcacuuugag

SEQ ID NO: 203320 - RNA, 32 nt, Human
ggugcucacccaggccccgugucagucuucua

SEQ ID NO: 203321 - RNA, 32 nt, Human
ggugcucaccucuaccuccuguccucaggccg

SEQ ID NO: 203322 - RNA, 21 nt, Human
ggugcucacgagagagccuuu

SEQ ID NO: 203323 - RNA, 19 nt, Human
ggugcucacgccuguaauc

SEQ ID NO: 203324 - RNA, 32 nt, Human
ggugcucagagcaguguuucguguguguuuua

SEQ ID NO: 203325 - RNA, 32 nt, Human
ggugcucagcuggucugcacugaacgcaaccg

SEQ ID NO: 203326 - RNA, 32 nt, Human
ggugcucaggaacagguagaugaauuuugacu

SEQ ID NO: 203327 - RNA, 32 nt, Human
ggugcucaggaggcugaggcaggagaguggac

SEQ ID NO: 203328 - RNA, 21 nt, Human
ggugcucaggagggcuccuca

SEQ ID NO: 203329 - RNA, 22 nt, Human
ggugcucaggcugggcucucca

SEQ ID NO: 203330 - RNA, 32 nt, Human
ggugcucauaaguugcccagcccagggggaaa

SEQ ID NO: 203331 - RNA, 32 nt, Human
ggugcucauccaggggcccagaacagucccac

SEQ ID NO: 203332 - RNA, 32 nt, Human
ggugcucaucuagcugcuacuacuuucccuuc

SEQ ID NO: 203333 - RNA, 23 nt, Human
ggugcucaugaggugucuuugca

SEQ ID NO: 203334 - RNA, 32 nt, Human
ggugcucaugccaggcugacggguccagugcg

SEQ ID NO: 203335 - RNA, 24 nt, Human
ggugcucauggaggaggaccugau

SEQ ID NO: 203336 - RNA, 32 nt, Human
ggugcucauuccacacugguuagauacuucag

SEQ ID NO: 203337 - RNA, 32 nt, Human
ggugcucccacuccagggcccagcacaucucc

SEQ ID NO: 203338 - RNA, 32 nt, Human
ggugcucccagcugcccccaggacacugcccg

SEQ ID NO: 203339 - RNA, 32 nt, Human
ggugcucccagcugcccuccugcuucgggccu

SEQ ID NO: 203340 - RNA, 32 nt, Human
ggugcucccgcagcuucgccuccucucgucuu

SEQ ID NO: 203341 - RNA, 17 nt, Human
ggugcucccgcagggaa

SEQ ID NO: 203342 - RNA, 32 nt, Human
ggugcucccugagaugccagcaccugaacgac

SEQ ID NO: 203343 - RNA, 32 nt, Human
ggugcucccuggaagauggaucuugccuugug

SEQ ID NO: 203344 - RNA, 32 nt, Human
ggugcucccuucacacacccaggcuggagaga

SEQ ID NO: 203345 - RNA, 32 nt, Human
ggugcucccuuucugccagcaguucugguucu

SEQ ID NO: 203346 - RNA, 24 nt, Human
ggugcuccguggggaggguuucuu

SEQ ID NO: 203347 - RNA, 23 nt, Human
ggugcuccucggagcgggacuga

SEQ ID NO: 203348 - RNA, 32 nt, Human
ggugcuccugaacagaagauuuggcccucauu

SEQ ID NO: 203349 - RNA, 32 nt, Human
ggugcuccugccaccucccaccucucugaggg

SEQ ID NO: 203350 - RNA, 32 nt, Human
ggugcuccuuucccccuucuuuuauacaaguu

SEQ ID NO: 203351 - RNA, 32 nt, Human
ggugcucgccuguaaucccagcuacuugggag

SEQ ID NO: 203352 - RNA, 32 nt, Human
ggugcucggguguggagcuggagccauguguc

SEQ ID NO: 203353 - RNA, 22 nt, Human
ggugcucgugccgcucugcuca

SEQ ID NO: 203354 - RNA, 32 nt, Human
ggugcucucuucuccccacugugcccguccgc

SEQ ID NO: 203355 - RNA, 32 nt, Human
ggugcucugacccucacuccuucuucugaccc

SEQ ID NO: 203356 - RNA, 32 nt, Human
ggugcucuggaaauguugaggguggguuuuua

SEQ ID NO: 203357 - RNA, 22 nt, Human
ggugcucuuaaaaucucucuca

SEQ ID NO: 203358 - RNA, 32 nt, Human
ggugcucuucugcugggggacugaggcuggcc

SEQ ID NO: 203359 - RNA, 32 nt, Human
ggugcucuugcagccagggugagagcagccca

SEQ ID NO: 203360 - RNA, 32 nt, Human
ggugcucuugggauugcaaccagcgcaagcag

SEQ ID NO: 203361 - RNA, 18 nt, Human
ggugcucuuuuuugcuca

SEQ ID NO: 203362 - RNA, 17 nt, Human
ggugcugaaggcuccag

SEQ ID NO: 203363 - RNA, 32 nt, Human
ggugcugacaucuaugugcuagcugccucauc

SEQ ID NO: 203364 - RNA, 32 nt, Human
ggugcugaccaaaaaugucucaaagucaacag

SEQ ID NO: 203365 - RNA, 32 nt, Human
ggugcugacugaggccugcuucccccuccccc

SEQ ID NO: 203366 - RNA, 32 nt, Human
ggugcugacuucaaaguugccuggugaaggaa

SEQ ID NO: 203367 - RNA, 32 nt, Human
ggugcugagacuacaggugugagccaccacuc

SEQ ID NO: 203368 - RNA, 19 nt, Human
ggugcugagagugugggug

SEQ ID NO: 203369 - RNA, 32 nt, Human
ggugcugagauuacaggcgugagccaccgugc

SEQ ID NO: 203370 - RNA, 32 nt, Human
ggugcugagauuacaggugugagccacccugc

SEQ ID NO: 203371 - RNA, 32 nt, Human
ggugcugagauuacauguaugagccacugcac

SEQ ID NO: 203372 - RNA, 32 nt, Human
ggugcugagcccucaccucccuguuccaggcu

SEQ ID NO: 203373 - RNA, 22 nt, Human
ggugcugaggcggcggcugcgg

SEQ ID NO: 203374 - RNA, 32 nt, Human
ggugcugagggcaagagguggggaggagguca

SEQ ID NO: 203375 - RNA, 32 nt, Human
ggugcugaggucucagggaagcugguaacacu

SEQ ID NO: 203376 - RNA, 32 nt, Human
ggugcugauccaggaaccucugcugggggagu

SEQ ID NO: 203377 - RNA, 32 nt, Human
ggugcugaugaaaacugaggcagcagccuggu

SEQ ID NO: 203378 - RNA, 21 nt, Human
ggugcugauggagggcgggag

SEQ ID NO: 203379 - RNA, 32 nt, Human
ggugcugaugugugugcaugagcuguauguac

SEQ ID NO: 203380 - RNA, 32 nt, Human
ggugcugauuuagaggcaaaauugcagaauaa

SEQ ID NO: 203381 - RNA, 19 nt, Human
ggugcugcaacaaaaggag

SEQ ID NO: 203382 - RNA, 32 nt, Human
ggugcugcacucacuucugcccccuggggagu

SEQ ID NO: 203383 - RNA, 32 nt, Human
ggugcugcagcccucggcaguggggucaggcc

SEQ ID NO: 203384 - RNA, 32 nt, Human
ggugcugcaggaguguccugcccaugccccag

SEQ ID NO: 203385 - RNA, 32 nt, Human
ggugcugcaggaugacuggagcuguuccacgc

SEQ ID NO: 203386 - RNA, 32 nt, Human
ggugcugcaguggccauucuuguaguuauagc

SEQ ID NO: 203387 - RNA, 32 nt, Human
ggugcugcaguucaguaggaaaaagaaaugca

SEQ ID NO: 203388 - RNA, 32 nt, Human
ggugcugcauguggcccugcccacugugcuca

SEQ ID NO: 203389 - RNA, 32 nt, Human
ggugcugccacucacccccaccugaugagagg

SEQ ID NO: 203390 - RNA, 32 nt, Human
ggugcugccaguuggguggagaugucuagggg

SEQ ID NO: 203391 - RNA, 32 nt, Human
ggugcugccaucuucucuccccaccacccuuu

SEQ ID NO: 203392 - RNA, 24 nt, Human
ggugcugcccagcagccccugaga

SEQ ID NO: 203393 - RNA, 32 nt, Human
ggugcugcccagugccuugccugcugagcugg

SEQ ID NO: 203394 - RNA, 32 nt, Human
ggugcugccccagccaggaucuggucgcugcc

SEQ ID NO: 203395 - RNA, 32 nt, Human
ggugcugcccugcguggcugccagcuggccca

SEQ ID NO: 203396 - RNA, 22 nt, Human
ggugcugccggggcagcgggag

SEQ ID NO: 203397 - RNA, 32 nt, Human
ggugcugccgguggagcuucaggucuugauag

SEQ ID NO: 203398 - RNA, 32 nt, Human
ggugcugccuugcuucuguauuuccuuggauu

SEQ ID NO: 203399 - RNA, 32 nt, Human
ggugcugcgaggggaaggaaaagggaggcagc

SEQ ID NO: 203400 - RNA, 32 nt, Human
ggugcugcucaccgucuuccuccuccuggucu

SEQ ID NO: 203401 - RNA, 22 nt, Human
ggugcugcuccggcagcggcag

SEQ ID NO: 203402 - RNA, 31 nt, Human
ggugcugcucugucugggccagcuguugugu

SEQ ID NO: 203403 - RNA, 22 nt, Human
ggugcugcugcugauccgggga

SEQ ID NO: 203404 - RNA, 32 nt, Human
ggugcugcuggcuccccgccaccagcugggcc

SEQ ID NO: 203405 - RNA, 32 nt, Human
ggugcugcugucucuccuccagcaaggaaaca

SEQ ID NO: 203406 - RNA, 32 nt, Human
ggugcugcuuccaggaagauggaguagauaua

SEQ ID NO: 203407 - RNA, 30 nt, Human
ggugcuggaagccagacggaacaguguugg

SEQ ID NO: 203408 - RNA, 32 nt, Human
ggugcuggaaggcugguuagucugggaggagc

SEQ ID NO: 203409 - RNA, 32 nt, Human
ggugcuggaauuacaggcgugagccaccgcgc

SEQ ID NO: 203410 - RNA, 32 nt, Human
ggugcuggaauuacaggugugagccacugugc

SEQ ID NO: 203411 - RNA, 32 nt, Human
ggugcuggacuacccuugccuagauuuaaggc

SEQ ID NO: 203412 - RNA, 32 nt, Human
ggugcuggagcaguuccucacuauccugcccc

SEQ ID NO: 203413 - RNA, 23 nt, Human
ggugcuggcaggugcuggcggga

SEQ ID NO: 203414 - RNA, 22 nt, Human
ggugcuggcgguguggcggggg

SEQ ID NO: 203415 - RNA, 32 nt, Human
ggugcuggcuuuggugacaucacaaggccccu

SEQ ID NO: 203416 - RNA, 32 nt, Human
ggugcugggaaccugcuagcugagcacuucca

SEQ ID NO: 203417 - RNA, 32 nt, Human
ggugcugggacugcagggagagggcugugagg

SEQ ID NO: 203418 - RNA, 25 nt, Human
ggugcugggagacugagccuguggg

SEQ ID NO: 203419 - RNA, 32 nt, Human
ggugcugggaggagggagagggaggucacugg

SEQ ID NO: 203420 - RNA, 32 nt, Human
ggugcugggauuacaagcgugagccaccgcac

SEQ ID NO: 203421 - RNA, 23 nt, Human
ggugcugggauuacagacgugag

SEQ ID NO: 203422 - RNA, 32 nt, Human
ggugcugggauuacagacgugagccaccaccc

SEQ ID NO: 203423 - RNA, 32 nt, Human
ggugcugggauuacaggcacgagccacugugc

SEQ ID NO: 203424 - RNA, 32 nt, Human
ggugcugggauuacaggcauaagcuaccacgc

SEQ ID NO: 203425 - RNA, 32 nt, Human
ggugcugggauuacaggcaucagccacugcac

SEQ ID NO: 203426 - RNA, 23 nt, Human
ggugcugggauuacaggcaugag

SEQ ID NO: 203427 - RNA, 32 nt, Human
ggugcugggauuacaggcaugagccaccgugc

SEQ ID NO: 203428 - RNA, 19 nt, Human
ggugcugggauuacaggug

SEQ ID NO: 203429 - RNA, 32 nt, Human
ggugcugggauuacaggugugagccaccacac

SEQ ID NO: 203430 - RNA, 32 nt, Human
ggugcugggauuacaggugugagccaccaugc

SEQ ID NO: 203431 - RNA, 32 nt, Human
ggugcugggauuauaggcgugagccaccgcgc

SEQ ID NO: 203432 - RNA, 32 nt, Human
ggugcugggauuauaggcgugagccacugugc

SEQ ID NO: 203433 - RNA, 32 nt, Human
ggugcugggauugcagacgugagccaccacag

SEQ ID NO: 203434 - RNA, 32 nt, Human
ggugcugggauugcaggccugagccaccgcgc

SEQ ID NO: 203435 - RNA, 23 nt, Human
ggugcugggauugcaggcgugag

SEQ ID NO: 203436 - RNA, 32 nt, Human
ggugcugggauugcaggcgugagccaccaugc

SEQ ID NO: 203437 - RNA, 32 nt, Human
ggugcugggcuuuagagaacaugggaaggcgg

SEQ ID NO: 203438 - RNA, 18 nt, Human
ggugcuggggagugggag

SEQ ID NO: 203439 - RNA, 32 nt, Human
ggugcuggggcaaggccaucagcuucagagac

SEQ ID NO: 203440 - RNA, 32 nt, Human
ggugcugggguuacagguaugagccaccacac

SEQ ID NO: 203441 - RNA, 32 nt, Human
ggugcuggguaggccuuccuggucucuggccg

SEQ ID NO: 203442 - RNA, 32 nt, Human
ggugcugguacugagcccugaggagcccgggc

SEQ ID NO: 203443 - RNA, 32 nt, Human
ggugcugguaggagugguuggagagacuugcg

SEQ ID NO: 203444 - RNA, 32 nt, Human
ggugcuggucaccaggccacagcccaaggcag

SEQ ID NO: 203445 - RNA, 32 nt, Human
ggugcugguccuccucccuccuggccucgacc

SEQ ID NO: 203446 - RNA, 32 nt, Human
ggugcuggucuugggccaguucucccacgacg

SEQ ID NO: 203447 - RNA, 32 nt, Human
ggugcuggugagaacccagaaggagagucagc

SEQ ID NO: 203448 - RNA, 32 nt, Human
ggugcuggugcugcgccauccuuugugugccc

SEQ ID NO: 203449 - RNA, 20 nt, Human
ggugcugguggaggcagcgg

SEQ ID NO: 203450 - RNA, 32 nt, Human
ggugcugguggaggcagcggagcagaggcuca

SEQ ID NO: 203451 - RNA, 19 nt, Human
ggugcuggugggcugggag

SEQ ID NO: 203452 - RNA, 32 nt, Human
ggugcuggugguugugguggcagaugauauua

SEQ ID NO: 203453 - RNA, 32 nt, Human
ggugcuggugugucuuggugccuggacuugag

SEQ ID NO: 203454 - RNA, 32 nt, Human
ggugcuguagaggcccuggugcagaaaguggg

SEQ ID NO: 203455 - RNA, 32 nt, Human
ggugcugucaucugauccucaucacaacucau

SEQ ID NO: 203456 - RNA, 32 nt, Human
ggugcugugcagggcucccggaggacaggacc

SEQ ID NO: 203457 - RNA, 32 nt, Human
ggugcugugcugcuccacaaggcaaaacaaga

SEQ ID NO: 203458 - RNA, 19 nt, Human
ggugcugugggguuggaga

SEQ ID NO: 203459 - RNA, 32 nt, Human
ggugcugugggguuggagagcacuuggcccug

SEQ ID NO: 203460 - RNA, 32 nt, Human
ggugcuguggugagcuggccacuccagagcug

SEQ ID NO: 203461 - RNA, 32 nt, Human
ggugcugugguuuugucccuugccuuccugcc

SEQ ID NO: 203462 - RNA, 32 nt, Human
ggugcugugugcacggcagccuagccaguggg

SEQ ID NO: 203463 - RNA, 19 nt, Human
ggugcuguuacucaacuca

SEQ ID NO: 203464 - RNA, 32 nt, Human
ggugcuguucuugagcagcuugaccaccccaa

SEQ ID NO: 203465 - RNA, 32 nt, Human
ggugcuuaaggaguaaaauaauauguuccugg

SEQ ID NO: 203466 - RNA, 32 nt, Human
ggugcuucaguaaacccacgaauaaaagcagu

SEQ ID NO: 203467 - RNA, 32 nt, Human
ggugcuucccuuuuucuccucacaaggaggug

SEQ ID NO: 203468 - RNA, 32 nt, Human
ggugcuucucacuggacuuggugggaugcaug

SEQ ID NO: 203469 - RNA, 32 nt, Human
ggugcuucucauuuauucuuaaagcuacuggu

SEQ ID NO: 203470 - RNA, 24 nt, Human
ggugcuucuggaagucucugcuca

SEQ ID NO: 203471 - RNA, 32 nt, Human
ggugcuucuggccuccgugcucugcuucaccu

SEQ ID NO: 203472 - RNA, 32 nt, Human
ggugcuucuuccucuuuuccaggcucuggaga

SEQ ID NO: 203473 - RNA, 32 nt, Human
ggugcuucuugcaaaccaacccccugccugaa

SEQ ID NO: 203474 - RNA, 32 nt, Human
ggugcuugcuuucuccagccaucggagaccag

SEQ ID NO: 203475 - RNA, 32 nt, Human
ggugcuugggaccuuauuccuccagggagcag

SEQ ID NO: 203476 - RNA, 32 nt, Human
ggugcuuguaaucccagcuacuugggaggcug

SEQ ID NO: 203477 - RNA, 32 nt, Human
ggugcuuguuucucccucugccaugauuguaa

SEQ ID NO: 203478 - RNA, 32 nt, Human
ggugcuuuaaaacucaaaggcucuuuucagag

SEQ ID NO: 203479 - RNA, 32 nt, Human
ggugcuuucacacccacaucaaugcuccagac

SEQ ID NO: 203480 - RNA, 32 nt, Human
ggugcuuucacucaaccaagggggccacagca

SEQ ID NO: 203481 - RNA, 32 nt, Human
ggugcuuuccucaaccuccugcaccaccucca

SEQ ID NO: 203482 - RNA, 32 nt, Human
ggugcuuucucaguugaggagaggugggguua

SEQ ID NO: 203483 - RNA, 32 nt, Human
ggugcuuucuuuccucaucuccccacucccca

SEQ ID NO: 203484 - RNA, 19 nt, Human
ggugcuuucuuuuaguuca

SEQ ID NO: 203485 - RNA, 32 nt, Human
ggugcuuugggcucuccuuccuucucagacaa

SEQ ID NO: 203486 - RNA, 32 nt, Human
gguggaaacagccuguuuuucccauuuaaaca

SEQ ID NO: 203487 - RNA, 22 nt, Human
gguggaaacccagaacugcuga

SEQ ID NO: 203488 - RNA, 21 nt, Human
gguggaaacuaaggaccuagg

SEQ ID NO: 203489 - RNA, 32 nt, Human
gguggaaagagauagcagguggugcuaauuca

SEQ ID NO: 203490 - RNA, 23 nt, Human
gguggaaagauaagaagcagagg

SEQ ID NO: 203491 - RNA, 32 nt, Human
gguggaaagauggcccaggaauuugaggcuac

SEQ ID NO: 203492 - RNA, 32 nt, Human
gguggaaaggaagugaugucagugagugagcu

SEQ ID NO: 203493 - RNA, 32 nt, Human
gguggaaauagcaaaaacaaggcccaggcugg

SEQ ID NO: 203494 - RNA, 32 nt, Human
gguggaacagggucuccucuccccagccagaa

SEQ ID NO: 203495 - RNA, 20 nt, Human
gguggaacauccaguuccua

SEQ ID NO: 203496 - RNA, 32 nt, Human
gguggaaccagccccuccagccugggguccaa

SEQ ID NO: 203497 - RNA, 32 nt, Human
gguggaacugcaauuuaagcucagggagucug

SEQ ID NO: 203498 - RNA, 32 nt, Human
gguggaacuucccaggaggggaagggacagac

SEQ ID NO: 203499 - RNA, 32 nt, Human
gguggaagagaagaacuuugacuggccggcag

SEQ ID NO: 203500 - RNA, 32 nt, Human
gguggaagagacagugugggcugagagcagag

SEQ ID NO: 203501 - RNA, 32 nt, Human
gguggaagagcuuuuuaaucacuugcuuuuua

SEQ ID NO: 203502 - RNA, 32 nt, Human
gguggaagcuaaaggaacuugggcauucaggg

SEQ ID NO: 203503 - RNA, 32 nt, Human
gguggaagcugcagugagccaagaucacacca

SEQ ID NO: 203504 - RNA, 32 nt, Human
gguggaaggaaaguacacagaacuagacgcac

SEQ ID NO: 203505 - RNA, 32 nt, Human
gguggaaggacagagugcuggggacaagaacg

SEQ ID NO: 203506 - RNA, 32 nt, Human
gguggaaggagaagggcaggguggaaaaaguu

SEQ ID NO: 203507 - RNA, 32 nt, Human
gguggaaggagaaggggaagcaagcaccuucu

SEQ ID NO: 203508 - RNA, 20 nt, Human
gguggaaggcgcggaccuga

SEQ ID NO: 203509 - RNA, 32 nt, Human
gguggaaggcgcggaccugacagcauuccaau

SEQ ID NO: 203510 - RNA, 32 nt, Human
gguggaaggcuggagggcaggggugaggaggg

SEQ ID NO: 203511 - RNA, 32 nt, Human
gguggaagggccuguggcugcaaguuccugcc

SEQ ID NO: 203512 - RNA, 32 nt, Human
gguggaagguagucugagccacugccuuuccc

SEQ ID NO: 203513 - RNA, 21 nt, Human
gguggaaggugggaacagagg

SEQ ID NO: 203514 - RNA, 32 nt, Human
gguggaaguggauguggaggagugaccagacc

SEQ ID NO: 203515 - RNA, 32 nt, Human
gguggaauccacccaguuuugucugcuagcca

SEQ ID NO: 203516 - RNA, 32 nt, Human
gguggaauuugaacacuucucacuuuuuauug

SEQ ID NO: 203517 - RNA, 32 nt, Human
gguggacaaagucaacuuccacauguuugacg

SEQ ID NO: 203518 - RNA, 32 nt, Human
gguggacaaguuggggccagagaugauggcag

SEQ ID NO: 203519 - RNA, 32 nt, Human
gguggacaccaaggggcgagugugugacuagg

SEQ ID NO: 203520 - RNA, 32 nt, Human
gguggacaccuguaaucccagcuacucaggug

SEQ ID NO: 203521 - RNA, 32 nt, Human
gguggacacggaucugcugggcucugccuuaa

SEQ ID NO: 203522 - RNA, 32 nt, Human
gguggacagacaccucccuccaacuggcauuu

SEQ ID NO: 203523 - RNA, 32 nt, Human
gguggacagauggguagauguggcaggcaugu

SEQ ID NO: 203524 - RNA, 32 nt, Human
gguggacagcuaucaaccacuuauaacugagc

SEQ ID NO: 203525 - RNA, 32 nt, Human
gguggacagcugucuccugggguggguuggua

SEQ ID NO: 203526 - RNA, 32 nt, Human
gguggacaggcagagucugcaccugccgccug

SEQ ID NO: 203527 - RNA, 32 nt, Human
gguggacaucgucucugccacuccugacccag

SEQ ID NO: 203528 - RNA, 32 nt, Human
gguggacaugagaagcauuggcaucaggguaa

SEQ ID NO: 203529 - RNA, 32 nt, Human
gguggaccaggauauggaaaccaagguggugg

SEQ ID NO: 203530 - RNA, 32 nt, Human
gguggacccacacauugucuccacuccgaagc

SEQ ID NO: 203531 - RNA, 32 nt, Human
gguggacccacuggccugucagucucaauaaa

SEQ ID NO: 203532 - RNA, 32 nt, Human
gguggacccaggaggaguggcaggugguggcg

SEQ ID NO: 203533 - RNA, 32 nt, Human
gguggacccagggaacagccacuccccuccac

SEQ ID NO: 203534 - RNA, 21 nt, Human
gguggacccaucaggacccca

SEQ ID NO: 203535 - RNA, 23 nt, Human
gguggaccgcugcugaguccagg

SEQ ID NO: 203536 - RNA, 32 nt, Human
gguggaccuaaauuccuuaucauauccuuuau

SEQ ID NO: 203537 - RNA, 32 nt, Human
gguggaccugccgccaugcaggacgguaacuu

SEQ ID NO: 203538 - RNA, 32 nt, Human
gguggaccuggaccccucagagaugcucgacu

SEQ ID NO: 203539 - RNA, 32 nt, Human
gguggacgccuguaaucccagcuacuugggag

SEQ ID NO: 203540 - RNA, 18 nt, Human
gguggacgcugggccccg

SEQ ID NO: 203541 - RNA, 32 nt, Human
gguggacggcagggaucagggagccaggagcg

SEQ ID NO: 203542 - RNA, 19 nt, Human
gguggacuagacaaaguug

SEQ ID NO: 203543 - RNA, 20 nt, Human
gguggacuauguuaguaguu

SEQ ID NO: 203544 - RNA, 32 nt, Human
gguggacucacggcugcugggccccacgucaa

SEQ ID NO: 203545 - RNA, 21 nt, Human
gguggacucuaacaguaguug

SEQ ID NO: 203546 - RNA, 32 nt, Human
gguggacucucugcggcuucugagcacggagg

SEQ ID NO: 203547 - RNA, 18 nt, Human
gguggacugacuguguug

SEQ ID NO: 203548 - RNA, 22 nt, Human
gguggacugagccucacuucca

SEQ ID NO: 203549 - RNA, 32 nt, Human
gguggacugcagaggagagggauucagucuuc

SEQ ID NO: 203550 - RNA, 32 nt, Human
gguggacugugcccuucuuucccuucagagaa

SEQ ID NO: 203551 - RNA, 32 nt, Human
gguggacuucacuagugaaugucagugguaag

SEQ ID NO: 203552 - RNA, 32 nt, Human
gguggacuuggaggaggaacggcaagggccgg

SEQ ID NO: 203553 - RNA, 32 nt, Human
gguggagaaagagaaaggaaaugaagucccag

SEQ ID NO: 203554 - RNA, 19 nt, Human
gguggagaaagcauauccc

SEQ ID NO: 203555 - RNA, 32 nt, Human
gguggagaaagccagaaaacagaucuggaggc

SEQ ID NO: 203556 - RNA, 21 nt, Human
gguggagaaaguaaucuccuu

SEQ ID NO: 203557 - RNA, 21 nt, Human
gguggagaaagugagggccgu

SEQ ID NO: 203558 - RNA, 20 nt, Human
gguggagaacguggaccuga

SEQ ID NO: 203559 - RNA, 32 nt, Human
gguggagaagaagaaagccgaaguccuugaaa

SEQ ID NO: 203560 - RNA, 32 nt, Human
gguggagaagagagaagaggaagaggaagagg

SEQ ID NO: 203561 - RNA, 21 nt, Human
gguggagaaggagggggguga

SEQ ID NO: 203562 - RNA, 21 nt, Human
gguggagaaggaucaaccuga

SEQ ID NO: 203563 - RNA, 32 nt, Human
gguggagaaggggagcgcaggagcuccggcaa

SEQ ID NO: 203564 - RNA, 32 nt, Human
gguggagaaguagagagagggcaacagcuucc

SEQ ID NO: 203565 - RNA, 32 nt, Human
gguggagaauucaggagguguggccagugccc

SEQ ID NO: 203566 - RNA, 32 nt, Human
gguggagacagaaaaguauacauggauuuggc

SEQ ID NO: 203567 - RNA, 20 nt, Human
gguggagacucagccugaga

SEQ ID NO: 203568 - RNA, 32 nt, Human
gguggagagacacaccugcuccaauuucccca

SEQ ID NO: 203569 - RNA, 21 nt, Human
gguggagagacagcccacccu

SEQ ID NO: 203570 - RNA, 32 nt, Human
gguggagagagcuguggcugaggccuacccug

SEQ ID NO: 203571 - RNA, 18 nt, Human
gguggagagaggauucua

SEQ ID NO: 203572 - RNA, 22 nt, Human
gguggagagagggcaggaccug

SEQ ID NO: 203573 - RNA, 32 nt, Human
gguggagagauggaagggcaucagguguaggg

SEQ ID NO: 203574 - RNA, 32 nt, Human
gguggagagcaucuucccugacuucuuugccu

SEQ ID NO: 203575 - RNA, 32 nt, Human
gguggagagccgcggcccugaccacgaccaca

SEQ ID NO: 203576 - RNA, 32 nt, Human
gguggagagggaggggauaagagaggugcaug

SEQ ID NO: 203577 - RNA, 32 nt, Human
gguggagauacuaagcugucuguuauauuucc

SEQ ID NO: 203578 - RNA, 32 nt, Human
gguggagaucagaagccagggauuagagauug

SEQ ID NO: 203579 - RNA, 32 nt, Human
gguggagaugggcaccugcagcuuugccuuuu

SEQ ID NO: 203580 - RNA, 32 nt, Human
gguggagaugggggcggagggagcuggagcug

SEQ ID NO: 203581 - RNA, 32 nt, Human
gguggagauucccugucuucugagcccgagcc

SEQ ID NO: 203582 - RNA, 32 nt, Human
gguggagcacacugggaagcugugggccacgg

SEQ ID NO: 203583 - RNA, 32 nt, Human
gguggagcagaggggcucccucaccccgggca

SEQ ID NO: 203584 - RNA, 32 nt, Human
gguggagcagcagcucaagguccaggauauag

SEQ ID NO: 203585 - RNA, 20 nt, Human
gguggagcagguaggacuga

SEQ ID NO: 203586 - RNA, 32 nt, Human
gguggagcagguggacuggaguuucucuugag

SEQ ID NO: 203587 - RNA, 32 nt, Human
gguggagccaauucaccagcaggucccggcag

SEQ ID NO: 203588 - RNA, 32 nt, Human
gguggagccagagggagcccagugagugccgg

SEQ ID NO: 203589 - RNA, 32 nt, Human
gguggagccagccacugcaaauccuuuguguc

SEQ ID NO: 203590 - RNA, 32 nt, Human
gguggagcccauacccugccuucccugagggc

SEQ ID NO: 203591 - RNA, 32 nt, Human
gguggagccucagggccagggcaggcaggagc

SEQ ID NO: 203592 - RNA, 32 nt, Human
gguggagcggccuuuguugucuucccauuuag

SEQ ID NO: 203593 - RNA, 32 nt, Human
gguggagcgguggagggcgucacuggguuucg

SEQ ID NO: 203594 - RNA, 32 nt, Human
gguggagcguccaguggagaagaaggaagcga

SEQ ID NO: 203595 - RNA, 32 nt, Human
gguggagcguucaccagugaccuggaaggccc

SEQ ID NO: 203596 - RNA, 32 nt, Human
gguggagcugaagagccaagaggcucagaguc

SEQ ID NO: 203597 - RNA, 32 nt, Human
gguggagcugaagagccaggaggcucagaguc

SEQ ID NO: 203598 - RNA, 32 nt, Human
gguggagcugagaagaggaggaggugggggcu

SEQ ID NO: 203599 - RNA, 32 nt, Human
gguggagcuggggagggcaugggcaggccagc

SEQ ID NO: 203600 - RNA, 32 nt, Human
gguggagcugugacuggcugagcugcuguggc

SEQ ID NO: 203601 - RNA, 18 nt, Human
gguggagcuugcagugag

SEQ ID NO: 203602 - RNA, 32 nt, Human
gguggaggaacugcccuggccuagagaccaga

SEQ ID NO: 203603 - RNA, 32 nt, Human
gguggaggaaggcucugucacuccaggcauau

SEQ ID NO: 203604 - RNA, 31 nt, Human
gguggaggaagggcguccaugccaaggcccc

SEQ ID NO: 203605 - RNA, 32 nt, Human
gguggaggaagugcgaagccaugugaaggugc

SEQ ID NO: 203606 - RNA, 32 nt, Human
gguggaggaauagacuucuaguucauucuggg

SEQ ID NO: 203607 - RNA, 22 nt, Human
gguggaggagaaggggcccuga

SEQ ID NO: 203608 - RNA, 22 nt, Human
gguggaggagaauccggaccug

SEQ ID NO: 203609 - RNA, 32 nt, Human
gguggaggagcugagggagggagccauggaag

SEQ ID NO: 203610 - RNA, 32 nt, Human
gguggaggaggaggaggaagagguggaggagg

SEQ ID NO: 203611 - RNA, 32 nt, Human
gguggaggaggaggaggaggaggaaggcaaag

SEQ ID NO: 203612 - RNA, 32 nt, Human
gguggaggaggaggaggaggaggaggaggugg

SEQ ID NO: 203613 - RNA, 32 nt, Human
gguggaggaggaggaggaggaggugguggagg

SEQ ID NO: 203614 - RNA, 32 nt, Human
gguggaggaggaggaguuccucagggaguuug

SEQ ID NO: 203615 - RNA, 32 nt, Human
gguggaggaggaggcagagaggaguggagggc

SEQ ID NO: 203616 - RNA, 19 nt, Human
gguggaggaggagggucug

SEQ ID NO: 203617 - RNA, 32 nt, Human
gguggaggcaacagguuuuacugaugguguug

SEQ ID NO: 203618 - RNA, 21 nt, Human
gguggaggcagccuucaguga

SEQ ID NO: 203619 - RNA, 19 nt, Human
gguggaggccaggguucca

SEQ ID NO: 203620 - RNA, 32 nt, Human
gguggaggcccaggaaugggcgggcaggacac

SEQ ID NO: 203621 - RNA, 32 nt, Human
gguggaggcccaggcguugcuaggauugcauc

SEQ ID NO: 203622 - RNA, 31 nt, Human
gguggaggcccugcugggccugguccgcagc

SEQ ID NO: 203623 - RNA, 32 nt, Human
gguggaggccgaccaguagcugcagaccaggg

SEQ ID NO: 203624 - RNA, 32 nt, Human
gguggaggccucuguccuccacuuugaggcuc

SEQ ID NO: 203625 - RNA, 32 nt, Human
gguggaggcggcggaggcggcggcggaggcgg

SEQ ID NO: 203626 - RNA, 32 nt, Human
gguggaggcugcagcugaagguggcaggaacc

SEQ ID NO: 203627 - RNA, 32 nt, Human
gguggaggcuuagguagccggaccugccugcc

SEQ ID NO: 203628 - RNA, 32 nt, Human
gguggagggaaaauaauugauagaagaccaga

SEQ ID NO: 203629 - RNA, 32 nt, Human
gguggagggaaagcacuuugaagggaaguaag

SEQ ID NO: 203630 - RNA, 32 nt, Human
gguggagggaaggaaggagggagccggggagu

SEQ ID NO: 203631 - RNA, 32 nt, Human
gguggagggcgcgucagccacgggugggccuu

SEQ ID NO: 203632 - RNA, 21 nt, Human
gguggagggcggggcccugau

SEQ ID NO: 203633 - RNA, 32 nt, Human
gguggagggcugccaggaaacauggugcaagu

SEQ ID NO: 203634 - RNA, 32 nt, Human
gguggaggggaaaugagaguugcugguagcag

SEQ ID NO: 203635 - RNA, 21 nt, Human
gguggaggggaaggaccuuga

SEQ ID NO: 203636 - RNA, 19 nt, Human
gguggaggggcaggauucc

SEQ ID NO: 203637 - RNA, 21 nt, Human
gguggagggggaaugacagau

SEQ ID NO: 203638 - RNA, 32 nt, Human
gguggaggggugugggaaagaaaccagccaua

SEQ ID NO: 203639 - RNA, 18 nt, Human
gguggaggguggagaccu

SEQ ID NO: 203640 - RNA, 32 nt, Human
gguggagguaaggaagagucugguggggaguu

SEQ ID NO: 203641 - RNA, 32 nt, Human
gguggagguaggggccaaagaggcuuacacga

SEQ ID NO: 203642 - RNA, 32 nt, Human
gguggagguaguaaaggccauggccaugcaga

SEQ ID NO: 203643 - RNA, 32 nt, Human
gguggaggugagggggugagccuggaccugug

SEQ ID NO: 203644 - RNA, 21 nt, Human
gguggagguggaaaacgugau

SEQ ID NO: 203645 - RNA, 32 nt, Human
gguggaggugguggcagcagagguauuaugga

SEQ ID NO: 203646 - RNA, 32 nt, Human
gguggaggugugggguaugcaccugagcuccu

SEQ ID NO: 203647 - RNA, 32 nt, Human
gguggagguugaggccgugacuccaggggcau

SEQ ID NO: 203648 - RNA, 18 nt, Human
gguggagguugcagugag

SEQ ID NO: 203649 - RNA, 32 nt, Human
gguggagguugcagugagcugagaucgcacca

SEQ ID NO: 203650 - RNA, 32 nt, Human
gguggaguaggcacagauggaaaacugcugcc

SEQ ID NO: 203651 - RNA, 23 nt, Human
gguggagucagaaaccaaaguga

SEQ ID NO: 203652 - RNA, 32 nt, Human
gguggagucccagagcugcacaggguuuggcc

SEQ ID NO: 203653 - RNA, 26 nt, Human
gguggaguccugaaggagggccugau

SEQ ID NO: 203654 - RNA, 32 nt, Human
gguggagucucagaguccagggacugggagga

SEQ ID NO: 203655 - RNA, 32 nt, Human
gguggagucuugcugucuccccggcuggagcg

SEQ ID NO: 203656 - RNA, 32 nt, Human
gguggagugggcagaggugcaagagagggaug

SEQ ID NO: 203657 - RNA, 32 nt, Human
gguggaguggggagcuggcuucugcuggccag

SEQ ID NO: 203658 - RNA, 32 nt, Human
gguggaguucuagccccaucgccgacacgccc

SEQ ID NO: 203659 - RNA, 32 nt, Human
gguggaguucuuagcuauccuuggcuuucugu

SEQ ID NO: 203660 - RNA, 32 nt, Human
gguggaguuucagugagaauaaacgugucugc

SEQ ID NO: 203661 - RNA, 28 nt, Human
gguggauagagugcugccucuauccaca

SEQ ID NO: 203662 - RNA, 32 nt, Human
gguggauauucaaccagccccaccgccuaccc

SEQ ID NO: 203663 - RNA, 32 nt, Human
gguggaucaauugaggccaggaguuugagacc

SEQ ID NO: 203664 - RNA, 32 nt, Human
gguggaucacaaggucaggagaucgaaaccau

SEQ ID NO: 203665 - RNA, 32 nt, Human
gguggaucacaaggucaggagaucgagaccau

SEQ ID NO: 203666 - RNA, 32 nt, Human
gguggaucacccaaggucaggaguuugagacc

SEQ ID NO: 203667 - RNA, 32 nt, Human
gguggaucaccugaggccaggaagaccagccu

SEQ ID NO: 203668 - RNA, 32 nt, Human
gguggaucaccugaggccaggaguucaagacc

SEQ ID NO: 203669 - RNA, 32 nt, Human
gguggaucaccugaggccaggaguucgagacc

SEQ ID NO: 203670 - RNA, 32 nt, Human
gguggaucaccugaggccagguguuugagauc

SEQ ID NO: 203671 - RNA, 32 nt, Human
gguggaucaccugaggccgggaauuugagacc

SEQ ID NO: 203672 - RNA, 21 nt, Human
gguggaucaccugaggucagg

SEQ ID NO: 203673 - RNA, 21 nt, Human
gguggaucaccugagguuagg

SEQ ID NO: 203674 - RNA, 19 nt, Human
gguggaucacgaggucagg

SEQ ID NO: 203675 - RNA, 32 nt, Human
gguggaucacuugaagccaggaauucaagacg

SEQ ID NO: 203676 - RNA, 21 nt, Human
gguggaucacuugagcccagg

SEQ ID NO: 203677 - RNA, 21 nt, Human
gguggaucacuugagcucagg

SEQ ID NO: 203678 - RNA, 32 nt, Human
gguggaucacuugaggccaggaauucgagacc

SEQ ID NO: 203679 - RNA, 32 nt, Human
gguggaucacuugaggccaggaguucaagacc

SEQ ID NO: 203680 - RNA, 32 nt, Human
gguggaucacuugaggccaggaguucgagacc

SEQ ID NO: 203681 - RNA, 32 nt, Human
gguggaucacuugaggccaggaguuugaaacc

SEQ ID NO: 203682 - RNA, 32 nt, Human
gguggaucacuugaggccaggaguuugagacc

SEQ ID NO: 203683 - RNA, 21 nt, Human
gguggaucacuugaggucggg

SEQ ID NO: 203684 - RNA, 21 nt, Human
gguggaucaucugaggucagg

SEQ ID NO: 203685 - RNA, 19 nt, Human
gguggaucaugaggucagg

SEQ ID NO: 203686 - RNA, 32 nt, Human
gguggaucaugugaggccaggaguucgagaau

SEQ ID NO: 203687 - RNA, 23 nt, Human
gguggaucauuuaccaggaucca

SEQ ID NO: 203688 - RNA, 32 nt, Human
gguggaucauuugaggccaggaauucaagacc

SEQ ID NO: 203689 - RNA, 32 nt, Human
gguggaucauuugaggccaggaguucgauacc

SEQ ID NO: 203690 - RNA, 21 nt, Human
gguggaucccuugagcucagg

SEQ ID NO: 203691 - RNA, 32 nt, Human
gguggauccugcucccuguccacguccugugc

SEQ ID NO: 203692 - RNA, 20 nt, Human
gguggaucgcuugagccagg

SEQ ID NO: 203693 - RNA, 21 nt, Human
gguggaucgcuugagcccagg

SEQ ID NO: 203694 - RNA, 21 nt, Human
gguggaucgcuugagcucagg

SEQ ID NO: 203695 - RNA, 32 nt, Human
gguggaucgcuugaggccaggaauucgagacc

SEQ ID NO: 203696 - RNA, 32 nt, Human
gguggaucgcuugaggccaggaguucaagacc

SEQ ID NO: 203697 - RNA, 32 nt, Human
gguggaucucaguaaggagguagaguagauuu

SEQ ID NO: 203698 - RNA, 21 nt, Human
gguggaucucuugagcccagg

SEQ ID NO: 203699 - RNA, 32 nt, Human
gguggaugaagugguggacugccccuccacac

SEQ ID NO: 203700 - RNA, 32 nt, Human
gguggaugagacacaauuuccuauccagcaga

SEQ ID NO: 203701 - RNA, 32 nt, Human
gguggaugcagaggccaguccauauaccaccc

SEQ ID NO: 203702 - RNA, 32 nt, Human
gguggaugccuauaaucccagcuacucagaag

SEQ ID NO: 203703 - RNA, 32 nt, Human
gguggauggaugggugaggagggaucuccaua

SEQ ID NO: 203704 - RNA, 32 nt, Human
gguggauggccacuggcagugauggggaugga

SEQ ID NO: 203705 - RNA, 32 nt, Human
gguggauggggaggccagagggagcaaugagg

SEQ ID NO: 203706 - RNA, 32 nt, Human
gguggauggugcucauaaaaggccccagucgg

SEQ ID NO: 203707 - RNA, 32 nt, Human
gguggauguggcagcugagaucuacagggggc

SEQ ID NO: 203708 - RNA, 32 nt, Human
gguggauguuguugggggcuccagccuggagg

SEQ ID NO: 203709 - RNA, 18 nt, Human
gguggauuaccaguauug

SEQ ID NO: 203710 - RNA, 32 nt, Human
gguggauucacugguuggagugcguguuuucu

SEQ ID NO: 203711 - RNA, 32 nt, Human
gguggauucagcagaaggcaagaugguuauaa

SEQ ID NO: 203712 - RNA, 21 nt, Human
gguggauugccugaggucagg

SEQ ID NO: 203713 - RNA, 21 nt, Human
gguggauugcuugaacccagg

SEQ ID NO: 203714 - RNA, 21 nt, Human
gguggauugcuugagccaagg

SEQ ID NO: 203715 - RNA, 21 nt, Human
gguggauugcuugagcccagg

SEQ ID NO: 203716 - RNA, 21 nt, Human
gguggauugcuugagcucggg

SEQ ID NO: 203717 - RNA, 21 nt, Human
gguggauugcuugagcugagg

SEQ ID NO: 203718 - RNA, 32 nt, Human
gguggauugcuugaggccaggaguuagagacc

SEQ ID NO: 203719 - RNA, 21 nt, Human
gguggauugcuuugaggccag

SEQ ID NO: 203720 - RNA, 32 nt, Human
gguggauuuagaggaauccuggcuuucauuuu

SEQ ID NO: 203721 - RNA, 32 nt, Human
gguggauuuccacggcuucaucccuggcucca

SEQ ID NO: 203722 - RNA, 18 nt, Human
gguggauuugggcccagg

SEQ ID NO: 203723 - RNA, 23 nt, Human
gguggcaaagugagacccugucu

SEQ ID NO: 203724 - RNA, 32 nt, Human
gguggcaacuucuccuccugcggccgggagcg

SEQ ID NO: 203725 - RNA, 32 nt, Human
gguggcaagaagaucgggaagacugaguaggg

SEQ ID NO: 203726 - RNA, 32 nt, Human
gguggcaagguguuaaccucagaagaugaaua

SEQ ID NO: 203727 - RNA, 32 nt, Human
gguggcacagccuggcuugagugguggcaugu

SEQ ID NO: 203728 - RNA, 32 nt, Human
gguggcaccacugcacuccagccugggugaca

SEQ ID NO: 203729 - RNA, 32 nt, Human
gguggcaccacugcccuccagccuggaugaca

SEQ ID NO: 203730 - RNA, 32 nt, Human
gguggcaccacugccgucauuucagcuucugg

SEQ ID NO: 203731 - RNA, 32 nt, Human
gguggcaccacugccuucauuucagcuuccgg

SEQ ID NO: 203732 - RNA, 32 nt, Human
gguggcacccaggugagugacaucccaguuga

SEQ ID NO: 203733 - RNA, 32 nt, Human
gguggcaccgguggcccuggcugcaguucugg

SEQ ID NO: 203734 - RNA, 21 nt, Human
gguggcacgcaccugaucgca

SEQ ID NO: 203735 - RNA, 32 nt, Human
gguggcacuacugccaucauuucagcuucugg

SEQ ID NO: 203736 - RNA, 32 nt, Human
gguggcacuccaaccuccuccuaaaggcuggc

SEQ ID NO: 203737 - RNA, 32 nt, Human
gguggcacuguccacaaaucggcuucucugca

SEQ ID NO: 203738 - RNA, 32 nt, Human
gguggcagaaaaucacucccugcucaucauaa

SEQ ID NO: 203739 - RNA, 32 nt, Human
gguggcagaagaugcgauugacuggggcgacu

SEQ ID NO: 203740 - RNA, 32 nt, Human
gguggcagagaggcuccccuggggcugugggg

SEQ ID NO: 203741 - RNA, 32 nt, Human
gguggcagagggcagggucaucacccucuagc

SEQ ID NO: 203742 - RNA, 17 nt, Human
gguggcagcagaggcag

SEQ ID NO: 203743 - RNA, 32 nt, Human
gguggcagcaguguuggcaaggaggacucuga

SEQ ID NO: 203744 - RNA, 32 nt, Human
gguggcagcccagcucccaguucuuucccucu

SEQ ID NO: 203745 - RNA, 32 nt, Human
gguggcagccccggagccggggaaugugaaga

SEQ ID NO: 203746 - RNA, 17 nt, Human
gguggcagcggcugcag

SEQ ID NO: 203747 - RNA, 32 nt, Human
gguggcagcuucucccccuuccuucccacccc

SEQ ID NO: 203748 - RNA, 32 nt, Human
gguggcagcuugugccagagugacacaggcuu

SEQ ID NO: 203749 - RNA, 32 nt, Human
gguggcaggaagggacaagcuguggagcuggc

SEQ ID NO: 203750 - RNA, 32 nt, Human
gguggcaggaaggggcagccugggcucuggga

SEQ ID NO: 203751 - RNA, 32 nt, Human
gguggcaggacucaggcaugcagaggguagca

SEQ ID NO: 203752 - RNA, 32 nt, Human
gguggcaggagcugggggagaggacucucccc

SEQ ID NO: 203753 - RNA, 32 nt, Human
gguggcaggaggggugaaagaggagacacggc

SEQ ID NO: 203754 - RNA, 32 nt, Human
gguggcaggaguggcugugggagcagcagugg

SEQ ID NO: 203755 - RNA, 16 nt, Human
gguggcaggccaggga

SEQ ID NO: 203756 - RNA, 32 nt, Human
gguggcaggcgccguggcagggauccuggagc

SEQ ID NO: 203757 - RNA, 32 nt, Human
gguggcagggaggagagcaagagguggcugaa

SEQ ID NO: 203758 - RNA, 32 nt, Human
gguggcagggaggcggcguugcgguggcugca

SEQ ID NO: 203759 - RNA, 32 nt, Human
gguggcagggauggagguuacgcaugggcuca

SEQ ID NO: 203760 - RNA, 32 nt, Human
gguggcaggggcauuauagccugguggacaug

SEQ ID NO: 203761 - RNA, 32 nt, Human
gguggcagggggcuggcaugucagcacugccc

SEQ ID NO: 203762 - RNA, 32 nt, Human
gguggcagguauaacauggccauggacacucu

SEQ ID NO: 203763 - RNA, 32 nt, Human
gguggcaggugcaucugggcuugggggcuucu

SEQ ID NO: 203764 - RNA, 32 nt, Human
gguggcagugacugauguuugucucuagcuaa

SEQ ID NO: 203765 - RNA, 32 nt, Human
gguggcagugccuggggagauccgaggcuaug

SEQ ID NO: 203766 - RNA, 32 nt, Human
gguggcagugcugcgcggggcucccagccaau

SEQ ID NO: 203767 - RNA, 20 nt, Human
gguggcaguggaguagggaa

SEQ ID NO: 203768 - RNA, 32 nt, Human
gguggcaguuacugauagccaagcagauuuuu

SEQ ID NO: 203769 - RNA, 32 nt, Human
gguggcauacaucucagaacguggagaaugau

SEQ ID NO: 203770 - RNA, 32 nt, Human
gguggcauacgccuguaguccuagccacucag

SEQ ID NO: 203771 - RNA, 32 nt, Human
gguggcauaugcuggggguagggguagcauug

SEQ ID NO: 203772 - RNA, 28 nt, Human
gguggcauccaaccugccucauucggcc

SEQ ID NO: 203773 - RNA, 32 nt, Human
gguggcauccccugcccaugccuaccacccgc

SEQ ID NO: 203774 - RNA, 32 nt, Human
gguggcaugagcugcagcugcagcaguggcag

SEQ ID NO: 203775 - RNA, 32 nt, Human
gguggcaugagcugugugaagcgccucuaaau

SEQ ID NO: 203776 - RNA, 32 nt, Human
gguggcaugcaucugugcucccagcuccucac

SEQ ID NO: 203777 - RNA, 32 nt, Human
gguggcaugccuguguucccagcuacucagga

SEQ ID NO: 203778 - RNA, 32 nt, Human
gguggcaugggagaugucugugcuuggaggua

SEQ ID NO: 203779 - RNA, 32 nt, Human
gguggcaugucggucaggcacagcaggguccu

SEQ ID NO: 203780 - RNA, 32 nt, Human
gguggcauucuguuuugugaaaggaggaagga

SEQ ID NO: 203781 - RNA, 32 nt, Human
gguggcauuuugaaagagcgcugggcaagcag

SEQ ID NO: 203782 - RNA, 32 nt, Human
gguggccaaacccgagcugaaggaucccaucc

SEQ ID NO: 203783 - RNA, 32 nt, Human
gguggccaacagcuuccuggcugccaucuuuc

SEQ ID NO: 203784 - RNA, 32 nt, Human
gguggccaagguaggagaaucgcuugagcuca

SEQ ID NO: 203785 - RNA, 19 nt, Human
gguggccaauccagguggg

SEQ ID NO: 203786 - RNA, 20 nt, Human
gguggccacagggggccuga

SEQ ID NO: 203787 - RNA, 22 nt, Human
gguggccacggggaggccucuu

SEQ ID NO: 203788 - RNA, 32 nt, Human
gguggccacuuauaugaaccaagggaggaguc

SEQ ID NO: 203789 - RNA, 32 nt, Human
gguggccacuuauaugaaccaagggagggguc

SEQ ID NO: 203790 - RNA, 23 nt, Human
gguggccagaucaccugagguca

SEQ ID NO: 203791 - RNA, 32 nt, Human
gguggccagcccgcagagguggggugcugggg

SEQ ID NO: 203792 - RNA, 32 nt, Human
gguggccagcuacucaggaggcugaggcagga

SEQ ID NO: 203793 - RNA, 32 nt, Human
gguggccagcuccucacuuggcugagguccag

SEQ ID NO: 203794 - RNA, 32 nt, Human
gguggccagcugguuugggggauuugggccau

SEQ ID NO: 203795 - RNA, 32 nt, Human
gguggccagcuugccaguaccugagccggucg

SEQ ID NO: 203796 - RNA, 32 nt, Human
gguggccagggccagagcaggcggcccgcggg

SEQ ID NO: 203797 - RNA, 32 nt, Human
gguggccagucguauaccaucccuggaaggau

SEQ ID NO: 203798 - RNA, 32 nt, Human
gguggccaugccacucaugguugcuauggccg

SEQ ID NO: 203799 - RNA, 19 nt, Human
gguggccaugguaccgggg

SEQ ID NO: 203800 - RNA, 32 nt, Human
gguggcccaagugcucuugguggcccagcuug

SEQ ID NO: 203801 - RNA, 32 nt, Human
gguggcccacagacugcuguugcuuauagucc

SEQ ID NO: 203802 - RNA, 20 nt, Human
gguggcccacaucuguaauc

SEQ ID NO: 203803 - RNA, 23 nt, Human
gguggcccacgccuguaauccca

SEQ ID NO: 203804 - RNA, 32 nt, Human
gguggcccaggagaagucaggaagggagccca

SEQ ID NO: 203805 - RNA, 32 nt, Human
gguggcccagggagugugaggcugcagccuca

SEQ ID NO: 203806 - RNA, 20 nt, Human
gguggcccaugccuguaauc

SEQ ID NO: 203807 - RNA, 32 nt, Human
gguggccccacggccccuacaggcuggcccug

SEQ ID NO: 203808 - RNA, 22 nt, Human
gguggcccccugcccgauccac

SEQ ID NO: 203809 - RNA, 32 nt, Human
gguggccccgagagagccagggccauggaggc

SEQ ID NO: 203810 - RNA, 32 nt, Human
gguggccccugccugugucccucagcucccag

SEQ ID NO: 203811 - RNA, 32 nt, Human
gguggcccuccagugcuggcagguggccucac

SEQ ID NO: 203812 - RNA, 32 nt, Human
gguggcccuccccucaauuccacaccccagac

SEQ ID NO: 203813 - RNA, 32 nt, Human
gguggcccugaucccgaugacucugaaacaug

SEQ ID NO: 203814 - RNA, 32 nt, Human
gguggcccuggaucuuguggcugcaaucgguu

SEQ ID NO: 203815 - RNA, 32 nt, Human
gguggcccuuugggcucccuguccaggauuug

SEQ ID NO: 203816 - RNA, 32 nt, Human
gguggccgacugcugcuagcggccugccgcca

SEQ ID NO: 203817 - RNA, 18 nt, Human
gguggccgcccaccaggg

SEQ ID NO: 203818 - RNA, 32 nt, Human
gguggccgccuguaaucccagcuacucaggag

SEQ ID NO: 203819 - RNA, 32 nt, Human
gguggccggcagaaguuugccaucccaaaaau

SEQ ID NO: 203820 - RNA, 21 nt, Human
gguggccgggugugguggcuu

SEQ ID NO: 203821 - RNA, 32 nt, Human
gguggccguccugagggggaagugagaagggc

SEQ ID NO: 203822 - RNA, 32 nt, Human
gguggccgugcaauaaauaucugccgugaaca

SEQ ID NO: 203823 - RNA, 32 nt, Human
gguggccucaaaggaggcccugucccagccac

SEQ ID NO: 203824 - RNA, 32 nt, Human
gguggccucaagagcacacagagaagggaaga

SEQ ID NO: 203825 - RNA, 28 nt, Human
gguggccuccagggugccuccaccugac

SEQ ID NO: 203826 - RNA, 32 nt, Human
gguggccucccuugccuggugccugagugaag

SEQ ID NO: 203827 - RNA, 32 nt, Human
gguggccucggaggcaggcucuggagcugcuu

SEQ ID NO: 203828 - RNA, 32 nt, Human
gguggccucuccaagcccugguggugcugggg

SEQ ID NO: 203829 - RNA, 32 nt, Human
gguggccucugcaggccuaggugcagcuccuc

SEQ ID NO: 203830 - RNA, 32 nt, Human
gguggccugaagccugggggccaggcugccag

SEQ ID NO: 203831 - RNA, 32 nt, Human
gguggccugcacuccucagcuugugcugcccg

SEQ ID NO: 203832 - RNA, 32 nt, Human
gguggccugccagcacagccagugccaucagg

SEQ ID NO: 203833 - RNA, 32 nt, Human
gguggccuggagcagcagcccaugcuacucuc

SEQ ID NO: 203834 - RNA, 32 nt, Human
gguggccuggcuucaggggaagacaggagcca

SEQ ID NO: 203835 - RNA, 32 nt, Human
gguggccugggagcugcuuucuccccacuggc

SEQ ID NO: 203836 - RNA, 32 nt, Human
gguggccugggaggcagggccugggcagggcu

SEQ ID NO: 203837 - RNA, 32 nt, Human
gguggccugggcggaggcuaugguggggccag

SEQ ID NO: 203838 - RNA, 32 nt, Human
gguggccuggggacuggagggaccaggaugcu

SEQ ID NO: 203839 - RNA, 32 nt, Human
gguggccuguaaucccagcuacuugggaggcu

SEQ ID NO: 203840 - RNA, 32 nt, Human
gguggccuguagucccagcuaucccagagguc

SEQ ID NO: 203841 - RNA, 32 nt, Human
gguggccuguagugucagcuacucggaaggcu

SEQ ID NO: 203842 - RNA, 32 nt, Human
gguggccuucaggcuggacggcgcgggucagc

SEQ ID NO: 203843 - RNA, 32 nt, Human
gguggccuuccucuugcaguugaggccggcgc

SEQ ID NO: 203844 - RNA, 21 nt, Human
gguggccuuggugcuggcuuc

SEQ ID NO: 203845 - RNA, 32 nt, Human
gguggccuuuccugcugacacuccacgagcug

SEQ ID NO: 203846 - RNA, 32 nt, Human
gguggccuuugucacuuccuucugccuuccaa

SEQ ID NO: 203847 - RNA, 32 nt, Human
gguggcgacccacagcccugguaaucgcucgc

SEQ ID NO: 203848 - RNA, 20 nt, Human
gguggcgaguaaaagcugca

SEQ ID NO: 203849 - RNA, 32 nt, Human
gguggcgcaugccuauagucucagccuccaga

SEQ ID NO: 203850 - RNA, 20 nt, Human
gguggcgcaugccuguaguc

SEQ ID NO: 203851 - RNA, 21 nt, Human
gguggcgcaugccuguagucc

SEQ ID NO: 203852 - RNA, 32 nt, Human
gguggcgccauggacguggcccuaaacgcugu

SEQ ID NO: 203853 - RNA, 32 nt, Human
gguggcgcgcggugaggagagcgcggcgcccc

SEQ ID NO: 203854 - RNA, 32 nt, Human
gguggcgcuggaggcagcagcggcuggagcgg

SEQ ID NO: 203855 - RNA, 32 nt, Human
gguggcggaggggguggcucucacagggccca

SEQ ID NO: 203856 - RNA, 32 nt, Human
gguggcggaggugagaggauugcccgaaccca

SEQ ID NO: 203857 - RNA, 32 nt, Human
gguggcggcgggcagaggugaugucugggagc

SEQ ID NO: 203858 - RNA, 23 nt, Human
gguggcgggauggggagcagcuu

SEQ ID NO: 203859 - RNA, 32 nt, Human
gguggcggggcugcaagagccgggccuggccu

SEQ ID NO: 203860 - RNA, 32 nt, Human
gguggcggucaccuguaacccaagcuacuugg

SEQ ID NO: 203861 - RNA, 32 nt, Human
gguggcggugccuggggagauccgaggcuaug

SEQ ID NO: 203862 - RNA, 32 nt, Human
gguggcgguggaaguuaagggagucaggggcu

SEQ ID NO: 203863 - RNA, 32 nt, Human
gguggcgguggaggaggcggggcggcgggggc

SEQ ID NO: 203864 - RNA, 32 nt, Human
gguggcgguggaggggagaugggggcagggac

SEQ ID NO: 203865 - RNA, 32 nt, Human
gguggcgguggcugagcagaggacccggcggg

SEQ ID NO: 203866 - RNA, 32 nt, Human
gguggcgguuccauccuguacugcucccagcu

SEQ ID NO: 203867 - RNA, 32 nt, Human
gguggcgucuacccacccucccuucuagcaga

SEQ ID NO: 203868 - RNA, 32 nt, Human
gguggcgugcgcccgcacaaaggcgccgcguu

SEQ ID NO: 203869 - RNA, 32 nt, Human
gguggcuaaggcagauagacugcuugaaccca

SEQ ID NO: 203870 - RNA, 32 nt, Human
gguggcuacagccuuugugcuuuuaagagugg

SEQ ID NO: 203871 - RNA, 32 nt, Human
gguggcuacuacuucagguucuugccucagaa

SEQ ID NO: 203872 - RNA, 32 nt, Human
gguggcuacucugugccagagccuggggcucu

SEQ ID NO: 203873 - RNA, 32 nt, Human
gguggcuagacugcuacggcagcuucucugau

SEQ ID NO: 203874 - RNA, 32 nt, Human
gguggcuaggguggauggaucgcuugagccca

SEQ ID NO: 203875 - RNA, 32 nt, Human
gguggcuaugcucaccccaucucccuugagag

SEQ ID NO: 203876 - RNA, 20 nt, Human
gguggcucaagccuguaauc

SEQ ID NO: 203877 - RNA, 32 nt, Human
gguggcucacacaccucuaaucucagcgcuug

SEQ ID NO: 203878 - RNA, 32 nt, Human
gguggcucacacacucucauucacacacacaa

SEQ ID NO: 203879 - RNA, 23 nt, Human
gguggcucacacaggagaaucac

SEQ ID NO: 203880 - RNA, 23 nt, Human
gguggcucacacccauaauccca

SEQ ID NO: 203881 - RNA, 32 nt, Human
gguggcucacacccgacguaaucccagcacgu

SEQ ID NO: 203882 - RNA, 23 nt, Human
gguggcucacaccuauaauccca

SEQ ID NO: 203883 - RNA, 23 nt, Human
gguggcucacaccugcaauccca

SEQ ID NO: 203884 - RNA, 23 nt, Human
gguggcucacaccuguaacccca

SEQ ID NO: 203885 - RNA, 32 nt, Human
gguggcucacaccuguaauaaucccagcacuu

SEQ ID NO: 203886 - RNA, 20 nt, Human
gguggcucacaccuguaauc

SEQ ID NO: 203887 - RNA, 22 nt, Human
gguggcucacaccuguaauccc

SEQ ID NO: 203888 - RNA, 23 nt, Human
gguggcucacaccuguaauccca

SEQ ID NO: 203889 - RNA, 32 nt, Human
gguggcucacaccuguaaucccugcacuuugg

SEQ ID NO: 203890 - RNA, 23 nt, Human
gguggcucacaccuguaaucuca

SEQ ID NO: 203891 - RNA, 20 nt, Human
gguggcucacaccugucauc

SEQ ID NO: 203892 - RNA, 20 nt, Human
gguggcucacaccugugauc

SEQ ID NO: 203893 - RNA, 23 nt, Human
gguggcucacaccugugauccca

SEQ ID NO: 203894 - RNA, 32 nt, Human
gguggcucacaccuguggucucagccucccga

SEQ ID NO: 203895 - RNA, 19 nt, Human
gguggcucacaccuuaauc

SEQ ID NO: 203896 - RNA, 23 nt, Human
gguggcucacacguguaauccca

SEQ ID NO: 203897 - RNA, 23 nt, Human
gguggcucacacuuauaauccca

SEQ ID NO: 203898 - RNA, 20 nt, Human
gguggcucacacuuguaauc

SEQ ID NO: 203899 - RNA, 23 nt, Human
gguggcucacacuuguaauccca

SEQ ID NO: 203900 - RNA, 20 nt, Human
gguggcucacauguguaauc

SEQ ID NO: 203901 - RNA, 20 nt, Human
gguggcucaccccuguaauc

SEQ ID NO: 203902 - RNA, 23 nt, Human
gguggcucaccccuguaauccca

SEQ ID NO: 203903 - RNA, 32 nt, Human
gguggcucacccuagauuguggcccagaucuc

SEQ ID NO: 203904 - RNA, 20 nt, Human
gguggcucaccucuguaauc

SEQ ID NO: 203905 - RNA, 32 nt, Human
gguggcucaccuguaaucccagcacuuuggga

SEQ ID NO: 203906 - RNA, 23 nt, Human
gguggcucacgcauguaauccca

SEQ ID NO: 203907 - RNA, 23 nt, Human
gguggcucacgcccguaauccca

SEQ ID NO: 203908 - RNA, 22 nt, Human
gguggcucacgccuauaauccc

SEQ ID NO: 203909 - RNA, 23 nt, Human
gguggcucacgccuauaauccca

SEQ ID NO: 203910 - RNA, 23 nt, Human
gguggcucacgccuguaacccca

SEQ ID NO: 203911 - RNA, 23 nt, Human
gguggcucacgccuguaaccuca

SEQ ID NO: 203912 - RNA, 20 nt, Human
gguggcucacgccuguaauc

SEQ ID NO: 203913 - RNA, 22 nt, Human
gguggcucacgccuguaauccc

SEQ ID NO: 203914 - RNA, 23 nt, Human
gguggcucacgccuguaauccca

SEQ ID NO: 203915 - RNA, 32 nt, Human
gguggcucacgccuguaaucccugcauuuugg

SEQ ID NO: 203916 - RNA, 23 nt, Human
gguggcucacgccuguaaucuca

SEQ ID NO: 203917 - RNA, 20 nt, Human
gguggcucacgccuguaauu

SEQ ID NO: 203918 - RNA, 21 nt, Human
gguggcucacgccuguagucc

SEQ ID NO: 203919 - RNA, 23 nt, Human
gguggcucacgccugucauccca

SEQ ID NO: 203920 - RNA, 32 nt, Human
gguggcucacgccugugauaccagcacuuuug

SEQ ID NO: 203921 - RNA, 23 nt, Human
gguggcucacgccugugauccca

SEQ ID NO: 203922 - RNA, 32 nt, Human
gguggcucacgccugugauccuagcacuuugg

SEQ ID NO: 203923 - RNA, 20 nt, Human
gguggcucacgcuuguaauc

SEQ ID NO: 203924 - RNA, 23 nt, Human
gguggcucacgcuuguaauccca

SEQ ID NO: 203925 - RNA, 20 nt, Human
gguggcucacgucuauaauc

SEQ ID NO: 203926 - RNA, 20 nt, Human
gguggcucacgucuguaauc

SEQ ID NO: 203927 - RNA, 20 nt, Human
gguggcucacuccuguaauc

SEQ ID NO: 203928 - RNA, 23 nt, Human
gguggcucacuccuguaauccca

SEQ ID NO: 203929 - RNA, 20 nt, Human
gguggcucaggccuguaauc

SEQ ID NO: 203930 - RNA, 32 nt, Human
gguggcucaguuaaggaaugagaagauagagg

SEQ ID NO: 203931 - RNA, 20 nt, Human
gguggcucauaccuguaauc

SEQ ID NO: 203932 - RNA, 23 nt, Human
gguggcucauaccuguaauccca

SEQ ID NO: 203933 - RNA, 23 nt, Human
gguggcucauacguguaauccca

SEQ ID NO: 203934 - RNA, 23 nt, Human
gguggcucaucccuguaauccca

SEQ ID NO: 203935 - RNA, 32 nt, Human
gguggcucaugccaguaauugcagccucccuu

SEQ ID NO: 203936 - RNA, 20 nt, Human
gguggcucaugccuauaauc

SEQ ID NO: 203937 - RNA, 23 nt, Human
gguggcucaugccuauaauccca

SEQ ID NO: 203938 - RNA, 20 nt, Human
gguggcucaugccuauaauu

SEQ ID NO: 203939 - RNA, 23 nt, Human
gguggcucaugccuauuauccca

SEQ ID NO: 203940 - RNA, 23 nt, Human
gguggcucaugccuccaauccca

SEQ ID NO: 203941 - RNA, 20 nt, Human
gguggcucaugccucuaauc

SEQ ID NO: 203942 - RNA, 23 nt, Human
gguggcucaugccuguaaaccca

SEQ ID NO: 203943 - RNA, 20 nt, Human
gguggcucaugccuguaauc

SEQ ID NO: 203944 - RNA, 21 nt, Human
gguggcucaugccuguaaucc

SEQ ID NO: 203945 - RNA, 22 nt, Human
gguggcucaugccuguaauccc

SEQ ID NO: 203946 - RNA, 23 nt, Human
gguggcucaugccuguaauccca

SEQ ID NO: 203947 - RNA, 32 nt, Human
gguggcucaugccuguaaucccugcaauuugg

SEQ ID NO: 203948 - RNA, 32 nt, Human
gguggcucaugccuguaaucccugcacuuugg

SEQ ID NO: 203949 - RNA, 23 nt, Human
gguggcucaugccuguaaucgca

SEQ ID NO: 203950 - RNA, 23 nt, Human
gguggcucaugccuguaaucuca

SEQ ID NO: 203951 - RNA, 20 nt, Human
gguggcucaugccuguaguc

SEQ ID NO: 203952 - RNA, 21 nt, Human
gguggcucaugccuguagucc

SEQ ID NO: 203953 - RNA, 32 nt, Human
gguggcucaugccuguaguccuagcacuuugg

SEQ ID NO: 203954 - RNA, 32 nt, Human
gguggcucaugccuguauccagcacuuuggga

SEQ ID NO: 203955 - RNA, 23 nt, Human
gguggcucaugccugugauccca

SEQ ID NO: 203956 - RNA, 32 nt, Human
gguggcucaugccugugauccuagcacuuugc

SEQ ID NO: 203957 - RNA, 32 nt, Human
gguggcucaugccugugauccuagcacuuugg

SEQ ID NO: 203958 - RNA, 21 nt, Human
gguggcucaugccuguggucc

SEQ ID NO: 203959 - RNA, 23 nt, Human
gguggcucaugccuuuaauccca

SEQ ID NO: 203960 - RNA, 23 nt, Human
gguggcucaugcuuguaauccca

SEQ ID NO: 203961 - RNA, 32 nt, Human
gguggcucccaggaugccggcggcaguagcag

SEQ ID NO: 203962 - RNA, 32 nt, Human
gguggcucccuuuucaggacuagggcuuucuc

SEQ ID NO: 203963 - RNA, 32 nt, Human
gguggcuccuaugguaggaaggaugaccaggu

SEQ ID NO: 203964 - RNA, 32 nt, Human
gguggcuccugccugugauccuagcacuuugg

SEQ ID NO: 203965 - RNA, 23 nt, Human
gguggcucgugccuguaauccca

SEQ ID NO: 203966 - RNA, 21 nt, Human
gguggcucgugccuguagucc

SEQ ID NO: 203967 - RNA, 23 nt, Human
gguggcucucgccuauaauccca

SEQ ID NO: 203968 - RNA, 23 nt, Human
gguggcucucgccuguaauccca

SEQ ID NO: 203969 - RNA, 32 nt, Human
gguggcucucgggcggggguguugcgguggcu

SEQ ID NO: 203970 - RNA, 31 nt, Human
gguggcucuuccccaccuugccagcaggcuc

SEQ ID NO: 203971 - RNA, 21 nt, Human
gguggcucuugccuguagucc

SEQ ID NO: 203972 - RNA, 21 nt, Human
gguggcugacccaggauugca

SEQ ID NO: 203973 - RNA, 32 nt, Human
gguggcugacccagucccugggggaagcccug

SEQ ID NO: 203974 - RNA, 32 nt, Human
gguggcugagcaacacauucccaaguguaaga

SEQ ID NO: 203975 - RNA, 32 nt, Human
gguggcugaggcaagagaauugcuugaacccg

SEQ ID NO: 203976 - RNA, 32 nt, Human
gguggcugaggcaggagggauugcuugaaccu

SEQ ID NO: 203977 - RNA, 32 nt, Human
gguggcugaggcauaagaauugcuugagccug

SEQ ID NO: 203978 - RNA, 32 nt, Human
gguggcugaggcaugagaaucacuugaaccca

SEQ ID NO: 203979 - RNA, 21 nt, Human
gguggcugaugccuguaaucc

SEQ ID NO: 203980 - RNA, 32 nt, Human
gguggcugaugucgccacaguaccaugagguu

SEQ ID NO: 203981 - RNA, 32 nt, Human
gguggcugcacugucgcccagcagcgaguaaa

SEQ ID NO: 203982 - RNA, 32 nt, Human
gguggcugcagccucagagcccucccagguug

SEQ ID NO: 203983 - RNA, 21 nt, Human
gguggcugcaggucugagaca

SEQ ID NO: 203984 - RNA, 15 nt, Human
gguggcugccaggga

SEQ ID NO: 203985 - RNA, 32 nt, Human
gguggcugccucagggcagggugccuggcgga

SEQ ID NO: 203986 - RNA, 32 nt, Human
gguggcugccuguaaucccagcuacuccagaa

SEQ ID NO: 203987 - RNA, 32 nt, Human
gguggcugcgcaggguggagggaguggccagc

SEQ ID NO: 203988 - RNA, 20 nt, Human
gguggcugcgugugguggcu

SEQ ID NO: 203989 - RNA, 32 nt, Human
gguggcugcguuuuggaaggggacccagagag

SEQ ID NO: 203990 - RNA, 32 nt, Human
gguggcugcugaggccuugguggacagaggau

SEQ ID NO: 203991 - RNA, 32 nt, Human
gguggcugcugugcugugccuagaugcacgau

SEQ ID NO: 203992 - RNA, 21 nt, Human
gguggcugcuuugcagggcuu

SEQ ID NO: 203993 - RNA, 32 nt, Human
gguggcugcuuugcagggcuuuggcuguuacc

SEQ ID NO: 203994 - RNA, 32 nt, Human
gguggcuggaaaaagcaaacaaacaaacaaag

SEQ ID NO: 203995 - RNA, 32 nt, Human
gguggcuggcgugcugggcauggggccugcuc

SEQ ID NO: 203996 - RNA, 32 nt, Human
gguggcugggaagugaaacggagccagcggcu

SEQ ID NO: 203997 - RNA, 32 nt, Human
gguggcugggagagggauaguguuaggagaaa

SEQ ID NO: 203998 - RNA, 32 nt, Human
gguggcugggaggggguguggugggaaaaagu

SEQ ID NO: 203999 - RNA, 18 nt, Human
gguggcugggagguggcu

SEQ ID NO: 204000 - RNA, 20 nt, Human
gguggcugggcgugguggcu

SEQ ID NO: 204001 - RNA, 32 nt, Human
gguggcugggcugugguagugggcauaggcag

SEQ ID NO: 204002 - RNA, 32 nt, Human
gguggcuggggcuggagccaggaaaggcuuga

SEQ ID NO: 204003 - RNA, 32 nt, Human
gguggcugggggcagcaagggagcagcaaggc

SEQ ID NO: 204004 - RNA, 32 nt, Human
gguggcugggguggcagcugaucaugucagga

SEQ ID NO: 204005 - RNA, 32 nt, Human
gguggcugggucugugaaaaacaguggacagc

SEQ ID NO: 204006 - RNA, 18 nt, Human
gguggcugugcagguggc

SEQ ID NO: 204007 - RNA, 32 nt, Human
gguggcugugggcagugagcggaugugacugg

SEQ ID NO: 204008 - RNA, 20 nt, Human
gguggcuuacaccuguaauc

SEQ ID NO: 204009 - RNA, 20 nt, Human
gguggcuuacgccuguaauc

SEQ ID NO: 204010 - RNA, 21 nt, Human
gguggcuuacgccuguaaucc

SEQ ID NO: 204011 - RNA, 21 nt, Human
gguggcuuacgcuuguagucc

SEQ ID NO: 204012 - RNA, 21 nt, Human
gguggcuuaugccuguaaucc

SEQ ID NO: 204013 - RNA, 32 nt, Human
gguggcuuaugccuguaaucccugcacuuugg

SEQ ID NO: 204014 - RNA, 32 nt, Human
gguggcuucaugccucccuucucccagcucag

SEQ ID NO: 204015 - RNA, 32 nt, Human
gguggcuucuccugacuggcaggaugaccuua

SEQ ID NO: 204016 - RNA, 32 nt, Human
gguggcuucuguaaucccaggacuuugggagg

SEQ ID NO: 204017 - RNA, 32 nt, Human
gguggcuucuuugguugcuggcaguggcagca

SEQ ID NO: 204018 - RNA, 32 nt, Human
gguggcuugagguggaggagugauaugguuug

SEQ ID NO: 204019 - RNA, 32 nt, Human
gguggcuugugcuuguugucccggcuacuugg

SEQ ID NO: 204020 - RNA, 32 nt, Human
gguggcuuuccugcucuaaagcauuuugaugu

SEQ ID NO: 204021 - RNA, 23 nt, Human
gguggcuuuggugguugguucca

SEQ ID NO: 204022 - RNA, 32 nt, Human
gguggcuuugugaacaaagcauagcgguacag

SEQ ID NO: 204023 - RNA, 32 nt, Human
gguggcuuuuccuagaccccaaagaggugaau

SEQ ID NO: 204024 - RNA, 23 nt, Human
ggugggaaaucgucaggagccca

SEQ ID NO: 204025 - RNA, 32 nt, Human
ggugggaacauggucacccccacucugcauac

SEQ ID NO: 204026 - RNA, 32 nt, Human
ggugggaagagaagggagucagcucugacagc

SEQ ID NO: 204027 - RNA, 32 nt, Human
ggugggaagccuguaaucccagcuacuuggga

SEQ ID NO: 204028 - RNA, 19 nt, Human
ggugggaagcugaguccca

SEQ ID NO: 204029 - RNA, 32 nt, Human
ggugggaagcuggcaaucugcaccuuggggcc

SEQ ID NO: 204030 - RNA, 32 nt, Human
ggugggaaggcagagcaucaggagggaacagg

SEQ ID NO: 204031 - RNA, 32 nt, Human
ggugggaagugaugcagagagcccacccgugc

SEQ ID NO: 204032 - RNA, 32 nt, Human
ggugggaaguggggcuaggucuugccaacucc

SEQ ID NO: 204033 - RNA, 32 nt, Human
ggugggaauggaguggaggagggacuuccuuc

SEQ ID NO: 204034 - RNA, 32 nt, Human
ggugggaaugggggauguggagacugagcugu

SEQ ID NO: 204035 - RNA, 32 nt, Human
ggugggaaugugcugcuguuccgugagccuug

SEQ ID NO: 204036 - RNA, 32 nt, Human
ggugggacaaaaggggagaauuuggaagccag

SEQ ID NO: 204037 - RNA, 32 nt, Human
ggugggacaaaguuagaauugccugaagauca

SEQ ID NO: 204038 - RNA, 32 nt, Human
ggugggacaacaaagaggacaccauuuuucca

SEQ ID NO: 204039 - RNA, 20 nt, Human
ggugggacacccuucccugg

SEQ ID NO: 204040 - RNA, 32 nt, Human
ggugggacagagguggagacaggugcagugac

SEQ ID NO: 204041 - RNA, 32 nt, Human
ggugggacagggguucugcagcuguaaggaac

SEQ ID NO: 204042 - RNA, 21 nt, Human
ggugggaccaagcgaaauucc

SEQ ID NO: 204043 - RNA, 21 nt, Human
ggugggaccaaggagaugcca

SEQ ID NO: 204044 - RNA, 21 nt, Human
ggugggaccaccccucuuuca

SEQ ID NO: 204045 - RNA, 18 nt, Human
ggugggaccacccggcca

SEQ ID NO: 204046 - RNA, 23 nt, Human
ggugggaccagaaaucuuuauga

SEQ ID NO: 204047 - RNA, 32 nt, Human
ggugggaccaggaacucuacuauuaagggacg

SEQ ID NO: 204048 - RNA, 24 nt, Human
ggugggaccagggccaggguucca

SEQ ID NO: 204049 - RNA, 18 nt, Human
ggugggaccagggcucca

SEQ ID NO: 204050 - RNA, 20 nt, Human
ggugggaccauacagcccca

SEQ ID NO: 204051 - RNA, 21 nt, Human
ggugggacccacccaccccca

SEQ ID NO: 204052 - RNA, 18 nt, Human
ggugggacccagguaacc

SEQ ID NO: 204053 - RNA, 19 nt, Human
ggugggaccccaagcucca

SEQ ID NO: 204054 - RNA, 20 nt, Human
ggugggacccgcagccucca

SEQ ID NO: 204055 - RNA, 32 nt, Human
ggugggacccgggcgggcuccgggagggggcc

SEQ ID NO: 204056 - RNA, 32 nt, Human
ggugggacccucaaggacaggcuguagcccuc

SEQ ID NO: 204057 - RNA, 32 nt, Human
ggugggacccuccaugaaauggauggcacaaa

SEQ ID NO: 204058 - RNA, 18 nt, Human
ggugggaccucuuauucu

SEQ ID NO: 204059 - RNA, 32 nt, Human
ggugggacgggacugcagccucccagaggccc

SEQ ID NO: 204060 - RNA, 18 nt, Human
ggugggacuaggaacuca

SEQ ID NO: 204061 - RNA, 32 nt, Human
ggugggacucagcucagagucaguuuucagaa

SEQ ID NO: 204062 - RNA, 19 nt, Human
ggugggacuccagaauucc

SEQ ID NO: 204063 - RNA, 32 nt, Human
ggugggacuccagcucguguguccucauggag

SEQ ID NO: 204064 - RNA, 32 nt, Human
ggugggacuccaggugaauuacugaaccucug

SEQ ID NO: 204065 - RNA, 18 nt, Human
ggugggacucuugaucca

SEQ ID NO: 204066 - RNA, 32 nt, Human
ggugggacuucuaacagaucagccugaagaag

SEQ ID NO: 204067 - RNA, 32 nt, Human
ggugggacuugccggccaugaagaggaccuug

SEQ ID NO: 204068 - RNA, 32 nt, Human
ggugggagaaaagaaaguggguuaucaagggu

SEQ ID NO: 204069 - RNA, 32 nt, Human
ggugggagaaucgcuuaaccccagaaguuuga

SEQ ID NO: 204070 - RNA, 32 nt, Human
ggugggagaauggguguaggaggcaggcccca

SEQ ID NO: 204071 - RNA, 20 nt, Human
ggugggagacaggaguucca

SEQ ID NO: 204072 - RNA, 32 nt, Human
ggugggagagagaagcagagcgagagagagga

SEQ ID NO: 204073 - RNA, 32 nt, Human
ggugggagagagucaggcaggagccgaggccg

SEQ ID NO: 204074 - RNA, 32 nt, Human
ggugggagaggaagaaaguugggguucuccag

SEQ ID NO: 204075 - RNA, 32 nt, Human
ggugggagaggacggcggagggcagagcccgc

SEQ ID NO: 204076 - RNA, 32 nt, Human
ggugggagcaagggacagggagcagggcaggg

SEQ ID NO: 204077 - RNA, 32 nt, Human
ggugggagcaggaaggcuguuggggaaggaag

SEQ ID NO: 204078 - RNA, 32 nt, Human
ggugggagccaccgcacccagccugcaggucu

SEQ ID NO: 204079 - RNA, 32 nt, Human
ggugggagcccaguuggggagggagugaggag

SEQ ID NO: 204080 - RNA, 32 nt, Human
ggugggagccuguggcuuauggcuucacuuac

SEQ ID NO: 204081 - RNA, 32 nt, Human
ggugggaggaaaggaaagaagcaacagucacc

SEQ ID NO: 204082 - RNA, 32 nt, Human
ggugggaggagaaggaggaagaggaggaaggc

SEQ ID NO: 204083 - RNA, 32 nt, Human
ggugggaggaucaauugaggccagaguuugaa

SEQ ID NO: 204084 - RNA, 32 nt, Human
ggugggaggaucccuugaggccacaaguuuga

SEQ ID NO: 204085 - RNA, 23 nt, Human
ggugggaggauuacuggauccca

SEQ ID NO: 204086 - RNA, 32 nt, Human
ggugggaggauugcuugagccuaggaggucga

SEQ ID NO: 204087 - RNA, 32 nt, Human
ggugggaggauugcuugagccuaggaguugaa

SEQ ID NO: 204088 - RNA, 32 nt, Human
ggugggaggauugcuugaggccagccugggca

SEQ ID NO: 204089 - RNA, 32 nt, Human
ggugggaggauuggagguuggugggauagggg

SEQ ID NO: 204090 - RNA, 32 nt, Human
ggugggaggcacggggaagguuuuggaguaga

SEQ ID NO: 204091 - RNA, 32 nt, Human
ggugggagggagaaggaagggaagaaagggga

SEQ ID NO: 204092 - RNA, 32 nt, Human
ggugggagggaggaagaacggaagggagggaa

SEQ ID NO: 204093 - RNA, 21 nt, Human
ggugggagggcaucuucugug

SEQ ID NO: 204094 - RNA, 32 nt, Human
ggugggagggccuguccacacccuggaucccc

SEQ ID NO: 204095 - RNA, 32 nt, Human
ggugggagggcugagguggcacaggcugcucc

SEQ ID NO: 204096 - RNA, 32 nt, Human
ggugggaggggaaaacgcaucuuguuaauuau

SEQ ID NO: 204097 - RNA, 32 nt, Human
ggugggagggggcaacccccaguagcuuugcc

SEQ ID NO: 204098 - RNA, 32 nt, Human
ggugggaggggugggacagagguggagacagg

SEQ ID NO: 204099 - RNA, 32 nt, Human
ggugggaggugggagaggaagguggaguacua

SEQ ID NO: 204100 - RNA, 32 nt, Human
ggugggauccacacagcucagaacagcuggau

SEQ ID NO: 204101 - RNA, 23 nt, Human
ggugggaucgccacaggauuuca

SEQ ID NO: 204102 - RNA, 32 nt, Human
ggugggaucuagaugaccucuugaaauugucc

SEQ ID NO: 204103 - RNA, 22 nt, Human
ggugggaucugaccuuguguga

SEQ ID NO: 204104 - RNA, 32 nt, Human
ggugggauggcacugaaggccagcagacaggc

SEQ ID NO: 204105 - RNA, 32 nt, Human
ggugggauggcugaacugggggcccacugugg

SEQ ID NO: 204106 - RNA, 32 nt, Human
ggugggauggggaagaccaggagcagagucga

SEQ ID NO: 204107 - RNA, 32 nt, Human
ggugggaugggugucccuguccccagcccacc

SEQ ID NO: 204108 - RNA, 32 nt, Human
ggugggcaaggcacuugugagaaccaagaaug

SEQ ID NO: 204109 - RNA, 32 nt, Human
ggugggcaaggcagucagcaucaccagcaaua

SEQ ID NO: 204110 - RNA, 21 nt, Human
ggugggcaagggccccuaaga

SEQ ID NO: 204111 - RNA, 32 nt, Human
ggugggcacagccugcacgugcccggcccugc

SEQ ID NO: 204112 - RNA, 24 nt, Human
ggugggcacagccuggcagugugg

SEQ ID NO: 204113 - RNA, 32 nt, Human
ggugggcaccuguaaucccagauacucgggag

SEQ ID NO: 204114 - RNA, 32 nt, Human
ggugggcaccuguaaucccagcuacucaggag

SEQ ID NO: 204115 - RNA, 32 nt, Human
ggugggcaccuguaaucccagcuacucgggag

SEQ ID NO: 204116 - RNA, 32 nt, Human
ggugggcaccuguaaucccagcuacuuggaag

SEQ ID NO: 204117 - RNA, 32 nt, Human
ggugggcaccuguaaucccagcuacuugggag

SEQ ID NO: 204118 - RNA, 32 nt, Human
ggugggcaccuguaaucccagguacucgggag

SEQ ID NO: 204119 - RNA, 32 nt, Human
ggugggcaccuguaaucccaguuacucgggag

SEQ ID NO: 204120 - RNA, 32 nt, Human
ggugggcaccuguagucccagcaacucgggag

SEQ ID NO: 204121 - RNA, 32 nt, Human
ggugggcacgcaccaccuuccuucccuggcac

SEQ ID NO: 204122 - RNA, 19 nt, Human
ggugggcacguccacccca

SEQ ID NO: 204123 - RNA, 32 nt, Human
ggugggcacugagagacaagauuccugggccc

SEQ ID NO: 204124 - RNA, 32 nt, Human
ggugggcacugaggcacagaggaggccaagga

SEQ ID NO: 204125 - RNA, 21 nt, Human
ggugggcacugccagccguga

SEQ ID NO: 204126 - RNA, 32 nt, Human
ggugggcacugguaaucccagguacucaagag

SEQ ID NO: 204127 - RNA, 32 nt, Human
ggugggcagacagugaccucucuagguguguc

SEQ ID NO: 204128 - RNA, 32 nt, Human
ggugggcagccugggggaggcuuuccucgcaa

SEQ ID NO: 204129 - RNA, 32 nt, Human
ggugggcagcgcacuccagucuucccaggcua

SEQ ID NO: 204130 - RNA, 32 nt, Human
ggugggcagcuuuucugcuuuuucccuuccuc

SEQ ID NO: 204131 - RNA, 32 nt, Human
ggugggcaggcagguguucuguguugacgaga

SEQ ID NO: 204132 - RNA, 32 nt, Human
ggugggcagggacgagugaagugguuggggug

SEQ ID NO: 204133 - RNA, 32 nt, Human
ggugggcagggaggggucccagaggguagagc

SEQ ID NO: 204134 - RNA, 32 nt, Human
ggugggcagggcugugcaggucucaguaagga

SEQ ID NO: 204135 - RNA, 32 nt, Human
ggugggcaggggccucaugacaagcgacaagu

SEQ ID NO: 204136 - RNA, 32 nt, Human
ggugggcagggugcagcagugagcaaaacucu

SEQ ID NO: 204137 - RNA, 32 nt, Human
ggugggcagggugggagggaugcacgcguaug

SEQ ID NO: 204138 - RNA, 20 nt, Human
ggugggcaguaggaccacca

SEQ ID NO: 204139 - RNA, 32 nt, Human
ggugggcagugcagugggguggaguaagaaag

SEQ ID NO: 204140 - RNA, 32 nt, Human
ggugggcauagccucugugccugguggggucc

SEQ ID NO: 204141 - RNA, 32 nt, Human
ggugggcaugccacccucacacacacagcugg

SEQ ID NO: 204142 - RNA, 32 nt, Human
ggugggcaugcugggcaggcuugggggugaca

SEQ ID NO: 204143 - RNA, 32 nt, Human
ggugggcaugcuguccacuguguggugcuagg

SEQ ID NO: 204144 - RNA, 32 nt, Human
ggugggcauggaacaggaugggcagagaaagg

SEQ ID NO: 204145 - RNA, 32 nt, Human
ggugggccaggggcuucccagucugcacuuag

SEQ ID NO: 204146 - RNA, 32 nt, Human
ggugggccagucuguggaucagagaugcacca

SEQ ID NO: 204147 - RNA, 32 nt, Human
ggugggccagugcugcccagguuugugugucu

SEQ ID NO: 204148 - RNA, 32 nt, Human
ggugggcccagccagcuccugggguccccgcc

SEQ ID NO: 204149 - RNA, 32 nt, Human
ggugggcccagccugcccuuccuuccuccagc

SEQ ID NO: 204150 - RNA, 32 nt, Human
ggugggcccaggagggaacaggagccugagcc

SEQ ID NO: 204151 - RNA, 32 nt, Human
ggugggcccuggacaggugugugguccugcug

SEQ ID NO: 204152 - RNA, 19 nt, Human
ggugggccgcaggcgggaa

SEQ ID NO: 204153 - RNA, 32 nt, Human
ggugggccucugccuucucuucuguuuggcca

SEQ ID NO: 204154 - RNA, 32 nt, Human
ggugggccugaggggccugggcucagagucca

SEQ ID NO: 204155 - RNA, 32 nt, Human
ggugggccugcucucuguagacugaauucagc

SEQ ID NO: 204156 - RNA, 32 nt, Human
ggugggccugggaggaagauguuuacauuuuu

SEQ ID NO: 204157 - RNA, 32 nt, Human
ggugggcgccggggcucccgggaaucuaccuu

SEQ ID NO: 204158 - RNA, 32 nt, Human
ggugggcgccuguaaucccagccacuccagag

SEQ ID NO: 204159 - RNA, 32 nt, Human
ggugggcgccuguaaucccagcuacucagaag

SEQ ID NO: 204160 - RNA, 32 nt, Human
ggugggcgccuguaaucccagcuacucaggag

SEQ ID NO: 204161 - RNA, 32 nt, Human
ggugggcgccuguaaucccagcuacucgggag

SEQ ID NO: 204162 - RNA, 32 nt, Human
ggugggcgccuguaaucccagcuacuugggag

SEQ ID NO: 204163 - RNA, 32 nt, Human
ggugggcgccuguaaucccagcugcucaggag

SEQ ID NO: 204164 - RNA, 32 nt, Human
ggugggcgccuguaaucccaguuacucgggag

SEQ ID NO: 204165 - RNA, 32 nt, Human
ggugggcgccuguaaucucagcuacuugggag

SEQ ID NO: 204166 - RNA, 32 nt, Human
ggugggcgccuguaauuccagcuacucaggag

SEQ ID NO: 204167 - RNA, 32 nt, Human
ggugggcgccuguaauuccagcuacucagggg

SEQ ID NO: 204168 - RNA, 32 nt, Human
ggugggcgccuguaauuccagcuacucgggag

SEQ ID NO: 204169 - RNA, 32 nt, Human
ggugggcgccuguagucccagcagcuugggag

SEQ ID NO: 204170 - RNA, 32 nt, Human
ggugggcgcggauccaggguaagggguuaagg

SEQ ID NO: 204171 - RNA, 32 nt, Human
ggugggcggaggcaaagggggagccaggggcg

SEQ ID NO: 204172 - RNA, 32 nt, Human
ggugggcggagggagaccgggaggcacgggcg

SEQ ID NO: 204173 - RNA, 32 nt, Human
ggugggcggcaccauuguccagcagcugaguu

SEQ ID NO: 204174 - RNA, 32 nt, Human
ggugggcggcggcggcgaaaggggacggcaac

SEQ ID NO: 204175 - RNA, 32 nt, Human
ggugggcggcucauggugccacagccccuggc

SEQ ID NO: 204176 - RNA, 32 nt, Human
ggugggcggcugccuuuccuauacaguuuguc

SEQ ID NO: 204177 - RNA, 32 nt, Human
ggugggcggggagggaaggaagggagcgggcg

SEQ ID NO: 204178 - RNA, 32 nt, Human
ggugggcguagggcuggccagugccuuggccu

SEQ ID NO: 204179 - RNA, 31 nt, Human
ggugggcugaagaacuaccuguuggguacug

SEQ ID NO: 204180 - RNA, 32 nt, Human
ggugggcugcacucucaccuggaggcuccggg

SEQ ID NO: 204181 - RNA, 32 nt, Human
ggugggcuggacuucuaccugcccucaagggu

SEQ ID NO: 204182 - RNA, 32 nt, Human
ggugggcuguucagcuuccugcugcuggggcc

SEQ ID NO: 204183 - RNA, 32 nt, Human
ggugggcuucacuaaggaaauggggaagguuu

SEQ ID NO: 204184 - RNA, 32 nt, Human
ggugggcuuccaagguccugggugcagccggg

SEQ ID NO: 204185 - RNA, 22 nt, Human
gguggggaaaugaauccucccu

SEQ ID NO: 204186 - RNA, 21 nt, Human
gguggggaacuagcaguaguu

SEQ ID NO: 204187 - RNA, 32 nt, Human
gguggggaagccgccuccacccagggggcgug

SEQ ID NO: 204188 - RNA, 32 nt, Human
gguggggaagccggggagggcaguugaggacc

SEQ ID NO: 204189 - RNA, 32 nt, Human
gguggggacccauggucuguggaacugggaaa

SEQ ID NO: 204190 - RNA, 32 nt, Human
gguggggacggaggggaaagggaagccugggu

SEQ ID NO: 204191 - RNA, 32 nt, Human
gguggggacuccugagcccagccugggggcca

SEQ ID NO: 204192 - RNA, 32 nt, Human
gguggggacuccuguccuucauucagcucauc

SEQ ID NO: 204193 - RNA, 32 nt, Human
gguggggagaagcaugaagcagugagcagagc

SEQ ID NO: 204194 - RNA, 32 nt, Human
gguggggagagcuagcccaggccaggggucaa

SEQ ID NO: 204195 - RNA, 32 nt, Human
gguggggagagcuugcccucccucuuaagcug

SEQ ID NO: 204196 - RNA, 32 nt, Human
gguggggagagggaagaugggccccaccagcu

SEQ ID NO: 204197 - RNA, 32 nt, Human
gguggggagauuccggccuggagcucccaggg

SEQ ID NO: 204198 - RNA, 32 nt, Human
gguggggagcagcccagccucugugaucuucu

SEQ ID NO: 204199 - RNA, 32 nt, Human
gguggggagccccagccccggggccgcggggg

SEQ ID NO: 204200 - RNA, 32 nt, Human
gguggggaggagggauccaggguggggugaag

SEQ ID NO: 204201 - RNA, 32 nt, Human
gguggggaggcaucugcuccaacuggugcggg

SEQ ID NO: 204202 - RNA, 32 nt, Human
gguggggaggcucuuuaggcucaggagaagca

SEQ ID NO: 204203 - RNA, 32 nt, Human
gguggggaggcugaacuguuucugcuaagaga

SEQ ID NO: 204204 - RNA, 32 nt, Human
gguggggagggagagagagggagggagaggga

SEQ ID NO: 204205 - RNA, 32 nt, Human
gguggggagggagggagaggccgccacccccg

SEQ ID NO: 204206 - RNA, 32 nt, Human
gguggggagggagggagguuucagacuccagu

SEQ ID NO: 204207 - RNA, 32 nt, Human
gguggggagggcauauuuacaguuuuucccac

SEQ ID NO: 204208 - RNA, 32 nt, Human
gguggggaggggcaugaggcgcucgcaggcac

SEQ ID NO: 204209 - RNA, 32 nt, Human
gguggggagggugguuuacaggggugcucugu

SEQ ID NO: 204210 - RNA, 32 nt, Human
gguggggaguggacacuugcuucuucaguucu

SEQ ID NO: 204211 - RNA, 32 nt, Human
gguggggaugcagaacaacuggaacucuccua

SEQ ID NO: 204212 - RNA, 32 nt, Human
gguggggauggggacagaggacauaggggacu

SEQ ID NO: 204213 - RNA, 32 nt, Human
gguggggcacacacaaccagggagugccacgc

SEQ ID NO: 204214 - RNA, 32 nt, Human
gguggggcacugacugaacuggaacccaucga

SEQ ID NO: 204215 - RNA, 32 nt, Human
gguggggcaggcggagguugcaguaagccaag

SEQ ID NO: 204216 - RNA, 32 nt, Human
gguggggcagggagguggggguugggggagua

SEQ ID NO: 204217 - RNA, 32 nt, Human
gguggggcaguggagguugaggagaauguaua

SEQ ID NO: 204218 - RNA, 32 nt, Human
gguggggcaguggucccaauaggagacaaagg

SEQ ID NO: 204219 - RNA, 32 nt, Human
gguggggcaugguggggauuccagcaucugcg

SEQ ID NO: 204220 - RNA, 20 nt, Human
gguggggccagcgcugaaca

SEQ ID NO: 204221 - RNA, 32 nt, Human
gguggggcccagaacccugggagccaggaagg

SEQ ID NO: 204222 - RNA, 32 nt, Human
gguggggccccuccuccuccugagcuguaagg

SEQ ID NO: 204223 - RNA, 32 nt, Human
gguggggccuccaggugcagcuguggauggaa

SEQ ID NO: 204224 - RNA, 32 nt, Human
gguggggccuucuccccugcugccagaaccgc

SEQ ID NO: 204225 - RNA, 32 nt, Human
gguggggcgcagaagagaggggagcccuucuc

SEQ ID NO: 204226 - RNA, 32 nt, Human
gguggggcgcuggccucggugagggcacagca

SEQ ID NO: 204227 - RNA, 19 nt, Human
gguggggcggcagcgggag

SEQ ID NO: 204228 - RNA, 32 nt, Human
gguggggcgugcugggacuaugaagaguuacu

SEQ ID NO: 204229 - RNA, 32 nt, Human
gguggggcuaugccccuuggaguaaauacagc

SEQ ID NO: 204230 - RNA, 32 nt, Human
gguggggcuaugccccuuggaguaaauacggc

SEQ ID NO: 204231 - RNA, 32 nt, Human
gguggggcucagcaggaagugggaccagugcc

SEQ ID NO: 204232 - RNA, 32 nt, Human
gguggggcugccaggggagaccccgggagccg

SEQ ID NO: 204233 - RNA, 32 nt, Human
gguggggcugcggcucuggccucccaggccca

SEQ ID NO: 204234 - RNA, 32 nt, Human
gguggggcuggcugcccuuagggcauagagac

SEQ ID NO: 204235 - RNA, 32 nt, Human
ggugggggaagggccaggcagagcaggaagcc

SEQ ID NO: 204236 - RNA, 32 nt, Human
ggugggggagcuggggaagggugcaggcggga

SEQ ID NO: 204237 - RNA, 32 nt, Human
ggugggggaggcagggcaggagguuggagcag

SEQ ID NO: 204238 - RNA, 32 nt, Human
ggugggggagggagggagggaguuggcaguuu

SEQ ID NO: 204239 - RNA, 32 nt, Human
ggugggggauuagauguugacacugccugggg

SEQ ID NO: 204240 - RNA, 22 nt, Human
ggugggggccaccaaaaaccca

SEQ ID NO: 204241 - RNA, 32 nt, Human
ggugggggccugugggccagaggacuccauga

SEQ ID NO: 204242 - RNA, 32 nt, Human
ggugggggcgacuggccuuuuucccaugugug

SEQ ID NO: 204243 - RNA, 32 nt, Human
ggugggggcucagccaaugcugcccagccuga

SEQ ID NO: 204244 - RNA, 32 nt, Human
ggugggggcuccugcccuccuccaacaaccca

SEQ ID NO: 204245 - RNA, 32 nt, Human
ggugggggcugccuagugggaguuaggaccac

SEQ ID NO: 204246 - RNA, 32 nt, Human
ggugggggcugggggaagaggcuggcagaagu

SEQ ID NO: 204247 - RNA, 19 nt, Human
gguggggggccaggaucca

SEQ ID NO: 204248 - RNA, 32 nt, Human
gguggggguagaaaugucuuuuucuauugugu

SEQ ID NO: 204249 - RNA, 25 nt, Human
ggugggggucagguggacucuggga

SEQ ID NO: 204250 - RNA, 32 nt, Human
gguggggguccaggcuggaggggcccaaugua

SEQ ID NO: 204251 - RNA, 21 nt, Human
gguggggguugcaggacucca

SEQ ID NO: 204252 - RNA, 32 nt, Human
gguggggguugugugagagagagccagcgaag

SEQ ID NO: 204253 - RNA, 32 nt, Human
ggugggguagguggggaguaguguggccaggg

SEQ ID NO: 204254 - RNA, 32 nt, Human
gguggggucagggaggaaaggcagaagcuggg

SEQ ID NO: 204255 - RNA, 32 nt, Human
gguggggucaggggccagagugcaggggaggg

SEQ ID NO: 204256 - RNA, 32 nt, Human
gguggggugaagcccguggccacaggaggcuu

SEQ ID NO: 204257 - RNA, 32 nt, Human
gguggggugagguuggggcgauggccuuugga

SEQ ID NO: 204258 - RNA, 32 nt, Human
gguggggugcaggagacagagaggggcugggg

SEQ ID NO: 204259 - RNA, 32 nt, Human
ggugggguggggucauggguuuuguuguuuuu

SEQ ID NO: 204260 - RNA, 32 nt, Human
ggugggguggguggggucgggugguggagagg

SEQ ID NO: 204261 - RNA, 17 nt, Human
ggugggguguccagcac

SEQ ID NO: 204262 - RNA, 32 nt, Human
ggugggguuccccugggccaaacagugauuug

SEQ ID NO: 204263 - RNA, 32 nt, Human
ggugggguuguucaccucuguacagaccaucu

SEQ ID NO: 204264 - RNA, 32 nt, Human
ggugggguuucauguuucaccguguuguccag

SEQ ID NO: 204265 - RNA, 32 nt, Human
gguggguaccuguaaucccagcuacucaggag

SEQ ID NO: 204266 - RNA, 32 nt, Human
gguggguaccuguaaucccagcuacucgggag

SEQ ID NO: 204267 - RNA, 32 nt, Human
gguggguaccuguaaucccagcuacuugggag

SEQ ID NO: 204268 - RNA, 32 nt, Human
gguggguaccuguaaucccaguuacuuuggag

SEQ ID NO: 204269 - RNA, 24 nt, Human
gguggguacgagagggcuucuuca

SEQ ID NO: 204270 - RNA, 32 nt, Human
gguggguagacagaggagugaaccccaaaggu

SEQ ID NO: 204271 - RNA, 32 nt, Human
gguggguagaucaccugaggucgggaguucaa

SEQ ID NO: 204272 - RNA, 32 nt, Human
gguggguagaucaucugaggucaggaauucaa

SEQ ID NO: 204273 - RNA, 32 nt, Human
gguggguaggagagggaaagccagagugugau

SEQ ID NO: 204274 - RNA, 32 nt, Human
gguggguaguuucuuuuggaaaguacugugag

SEQ ID NO: 204275 - RNA, 32 nt, Human
gguggguauggagccagcuuaaagagaccugc

SEQ ID NO: 204276 - RNA, 23 nt, Human
ggugggucacgccuguaauccca

SEQ ID NO: 204277 - RNA, 18 nt, Human
ggugggucagcccuugaa

SEQ ID NO: 204278 - RNA, 32 nt, Human
ggugggucagccugggcugggaggcagccccg

SEQ ID NO: 204279 - RNA, 32 nt, Human
ggugggucgcccauggcgagauuagugcccuu

SEQ ID NO: 204280 - RNA, 32 nt, Human
ggugggucggucccggggaugcagcgcggggg

SEQ ID NO: 204281 - RNA, 32 nt, Human
ggugggucuaggcaggggaaauuggggugcca

SEQ ID NO: 204282 - RNA, 32 nt, Human
ggugggucucacgccacugggcucaagaugau

SEQ ID NO: 204283 - RNA, 32 nt, Human
ggugggucugaaucuagcaccaugacggaacu

SEQ ID NO: 204284 - RNA, 32 nt, Human
ggugggucuggccaauggagaugggacaggaa

SEQ ID NO: 204285 - RNA, 32 nt, Human
ggugggucuuggagaggaaggacuuagggagg

SEQ ID NO: 204286 - RNA, 32 nt, Human
ggugggugaaggccuggcuggaagagggugaa

SEQ ID NO: 204287 - RNA, 31 nt, Human
ggugggugacuucaagccuccaaagaccaga

SEQ ID NO: 204288 - RNA, 32 nt, Human
ggugggugagacagaggguggggaggauagug

SEQ ID NO: 204289 - RNA, 32 nt, Human
ggugggugagcagcaugggcuuugaggagcug

SEQ ID NO: 204290 - RNA, 32 nt, Human
ggugggugccuaggccugggcaguggauggcc

SEQ ID NO: 204291 - RNA, 32 nt, Human
ggugggugccuccccuccccucuuugucacuu

SEQ ID NO: 204292 - RNA, 32 nt, Human
ggugggugccuguaaccucagcuacuugggag

SEQ ID NO: 204293 - RNA, 32 nt, Human
ggugggugccuguaaucccagauacucaggag

SEQ ID NO: 204294 - RNA, 32 nt, Human
ggugggugccuguaaucccagcuacaugggag

SEQ ID NO: 204295 - RNA, 32 nt, Human
ggugggugccuguaaucccagcuacucaagag

SEQ ID NO: 204296 - RNA, 32 nt, Human
ggugggugccuguaaucccagcuacucaggag

SEQ ID NO: 204297 - RNA, 32 nt, Human
ggugggugccuguaaucccagcuacucgggag

SEQ ID NO: 204298 - RNA, 32 nt, Human
ggugggugccuguaaucccagcuacuugggaa

SEQ ID NO: 204299 - RNA, 32 nt, Human
ggugggugccuguaaucccagcuacuugggag

SEQ ID NO: 204300 - RNA, 32 nt, Human
ggugggugccuguaaucccagcuucuuaggag

SEQ ID NO: 204301 - RNA, 32 nt, Human
ggugggugccuguaaucccaguuacuugggag

SEQ ID NO: 204302 - RNA, 32 nt, Human
ggugggugccuguaauccuagcuacuugggag

SEQ ID NO: 204303 - RNA, 32 nt, Human
ggugggugccuguaaucucagcuacucgggag

SEQ ID NO: 204304 - RNA, 32 nt, Human
ggugggugccuguaguaccagcuauuuuaaag

SEQ ID NO: 204305 - RNA, 32 nt, Human
ggugggugccuguagucccagcuacucgggag

SEQ ID NO: 204306 - RNA, 32 nt, Human
ggugggugccuguagucccagcuacucuggag

SEQ ID NO: 204307 - RNA, 32 nt, Human
ggugggugccuguagucccagcuacuugggag

SEQ ID NO: 204308 - RNA, 32 nt, Human
ggugggugccuguaguuccagcuacuugggag

SEQ ID NO: 204309 - RNA, 32 nt, Human
gguggguggagcaguggugggagaagacugga

SEQ ID NO: 204310 - RNA, 20 nt, Human
gguggguggaucaccugagg

SEQ ID NO: 204311 - RNA, 32 nt, Human
gguggguggaucaccugaggucagggguucga

SEQ ID NO: 204312 - RNA, 32 nt, Human
gguggguggaucaccugaggucgggaguucga

SEQ ID NO: 204313 - RNA, 23 nt, Human
gguggguggaucacuugaggcca

SEQ ID NO: 204314 - RNA, 32 nt, Human
gguggguggaucaucugaggucaggaguucga

SEQ ID NO: 204315 - RNA, 32 nt, Human
gguggguggaucaucugaggucaggaguuuga

SEQ ID NO: 204316 - RNA, 32 nt, Human
gguggguggaucgccugaggucggggguuuga

SEQ ID NO: 204317 - RNA, 32 nt, Human
gguggguggggaccugugucagguguggauag

SEQ ID NO: 204318 - RNA, 32 nt, Human
gguggguggggucgggugguggagaggccuua

SEQ ID NO: 204319 - RNA, 32 nt, Human
gguggguggggugaaggaggaggcaggugggc

SEQ ID NO: 204320 - RNA, 32 nt, Human
gguggguggguauggagccagcuuaaagagac

SEQ ID NO: 204321 - RNA, 31 nt, Human
gguggguggguggauaucuuaauuuuuauuu

SEQ ID NO: 204322 - RNA, 32 nt, Human
gguggguggguuguuucugccgcucuguuugc

SEQ ID NO: 204323 - RNA, 32 nt, Human
gguggguggucacugagaccacucccuccccc

SEQ ID NO: 204324 - RNA, 32 nt, Human
gguggguggugcaggcuggauauaucacagaa

SEQ ID NO: 204325 - RNA, 32 nt, Human
gguggguggugcuugcuauaugcuuaccuuuu

SEQ ID NO: 204326 - RNA, 32 nt, Human
gguggguguggggucaaugcagugaggcucuc

SEQ ID NO: 204327 - RNA, 32 nt, Human
gguggguguuggagccccugagacaggggaua

SEQ ID NO: 204328 - RNA, 32 nt, Human
gguggguugggccugagaaccagggcacgggu

SEQ ID NO: 204329 - RNA, 32 nt, Human
gguggguuggugaaucuaucucaggccacugc

SEQ ID NO: 204330 - RNA, 22 nt, Human
gguggguuugggggaagggagg

SEQ ID NO: 204331 - RNA, 32 nt, Human
gguggguuuuccuauguucuugugauagugaa

SEQ ID NO: 204332 - RNA, 32 nt, Human
ggugguaaaaaucuuaguucaugugaagaaau

SEQ ID NO: 204333 - RNA, 32 nt, Human
ggugguaaacaacaaaggugauuucagauggc

SEQ ID NO: 204334 - RNA, 32 nt, Human
ggugguaaaggcauuuauaguccuuacuccag

SEQ ID NO: 204335 - RNA, 32 nt, Human
ggugguaaaggccaauaacucuucaggcugcc

SEQ ID NO: 204336 - RNA, 32 nt, Human
ggugguaacaugggcuucugucauuuucugaa

SEQ ID NO: 204337 - RNA, 32 nt, Human
ggugguaaggcaaggguaaaaggggagggagg

SEQ ID NO: 204338 - RNA, 32 nt, Human
ggugguaagggaggguaaagcagagagaaugu

SEQ ID NO: 204339 - RNA, 32 nt, Human
ggugguaaucagcagaccagaugcccagcaac

SEQ ID NO: 204340 - RNA, 32 nt, Human
ggugguaaugggagguagauugauaugauaaa

SEQ ID NO: 204341 - RNA, 32 nt, Human
ggugguacaacgcgaaggugugggaaggccgc

SEQ ID NO: 204342 - RNA, 32 nt, Human
ggugguacaugguggcagggacaggaccacac

SEQ ID NO: 204343 - RNA, 32 nt, Human
ggugguacccccuucucuccccagccccaugu

SEQ ID NO: 204344 - RNA, 32 nt, Human
ggugguagcacauaccuguaaucccagcuacu

SEQ ID NO: 204345 - RNA, 32 nt, Human
ggugguagcauacaccuguaguccuagcuacu

SEQ ID NO: 204346 - RNA, 32 nt, Human
ggugguagccaucaagcacuucccaggaucug

SEQ ID NO: 204347 - RNA, 23 nt, Human
ggugguaggaucaccugagguca

SEQ ID NO: 204348 - RNA, 32 nt, Human
ggugguaggcaaaggccagggggcaggugggg

SEQ ID NO: 204349 - RNA, 32 nt, Human
ggugguaguggugggagggaaaccaugucuug

SEQ ID NO: 204350 - RNA, 32 nt, Human
ggugguaguuuccgcagagcugugaaguuugg

SEQ ID NO: 204351 - RNA, 32 nt, Human
ggugguaugcaccuguagucccggcuacucag

SEQ ID NO: 204352 - RNA, 32 nt, Human
gguggucaaugauagaaagugccuaaacaucc

SEQ ID NO: 204353 - RNA, 32 nt, Human
gguggucagcccgccucggccucccagagugc

SEQ ID NO: 204354 - RNA, 32 nt, Human
gguggucaggaacaggggcagcucacgguggc

SEQ ID NO: 204355 - RNA, 32 nt, Human
gguggucaggagacagauucuagggaaagugc

SEQ ID NO: 204356 - RNA, 24 nt, Human
gguggucaggagagaaggccugau

SEQ ID NO: 204357 - RNA, 32 nt, Human
gguggucaggcagcuggagcagaaguggaaau

SEQ ID NO: 204358 - RNA, 22 nt, Human
gguggucagggaaggcuucuca

SEQ ID NO: 204359 - RNA, 32 nt, Human
gguggucaguaguucaagaccaggcuggccaa

SEQ ID NO: 204360 - RNA, 32 nt, Human
gguggucauagagcauuaaaccaaauaugagg

SEQ ID NO: 204361 - RNA, 32 nt, Human
gguggucauccaguaagcuaagguuaauuuau

SEQ ID NO: 204362 - RNA, 32 nt, Human
gguggucaugccaugagcagccuuauggagag

SEQ ID NO: 204363 - RNA, 22 nt, Human
gguggucaugccuguaauccca

SEQ ID NO: 204364 - RNA, 32 nt, Human
gguggucauggaggcaguuuuggugggauaga

SEQ ID NO: 204365 - RNA, 32 nt, Human
gguggucauggcagaggaggaagaugagggca

SEQ ID NO: 204366 - RNA, 32 nt, Human
gguggucauggcuggcacagggcucagguaca

SEQ ID NO: 204367 - RNA, 32 nt, Human
ggugguccaguaccuggcugagcugcugaagc

SEQ ID NO: 204368 - RNA, 20 nt, Human
gguggucccugcagaggggc

SEQ ID NO: 204369 - RNA, 27 nt, Human
ggugguccgcaaaaccucugccugaga

SEQ ID NO: 204370 - RNA, 26 nt, Human
ggugguccgcaaacaucugccugaga

SEQ ID NO: 204371 - RNA, 27 nt, Human
ggugguccgcaacagcccugccugaga

SEQ ID NO: 204372 - RNA, 27 nt, Human
ggugguccgcagaaucucugccugaga

SEQ ID NO: 204373 - RNA, 32 nt, Human
ggugguccgcgcugccccugcccugccucugu

SEQ ID NO: 204374 - RNA, 32 nt, Human
ggugguccugagcgccccuccuggccacgccg

SEQ ID NO: 204375 - RNA, 32 nt, Human
gguggucgugugugugcggaguccacggaagc

SEQ ID NO: 204376 - RNA, 32 nt, Human
gguggucuccacccugguucauaagaggcuaa

SEQ ID NO: 204377 - RNA, 32 nt, Human
gguggucuccggcuccuccuugcggcgcugac

SEQ ID NO: 204378 - RNA, 32 nt, Human
gguggucugaagcagacagggaaugggagagg

SEQ ID NO: 204379 - RNA, 32 nt, Human
gguggucugacugcacugucuccaucuuaugc

SEQ ID NO: 204380 - RNA, 32 nt, Human
gguggucuggaggcagcuccacgucacacagu

SEQ ID NO: 204381 - RNA, 32 nt, Human
gguggugaacaggguggauguggcguggcucc

SEQ ID NO: 204382 - RNA, 19 nt, Human
gguggugacaggcagcagg

SEQ ID NO: 204383 - RNA, 32 nt, Human
gguggugacaugugccuguaaucccagcuacu

SEQ ID NO: 204384 - RNA, 32 nt, Human
gguggugaccucccaccucuggucugguuaag

SEQ ID NO: 204385 - RNA, 32 nt, Human
gguggugagacaggccagcgugcaugacagug

SEQ ID NO: 204386 - RNA, 32 nt, Human
gguggugagagggacagaccaggcaggcugac

SEQ ID NO: 204387 - RNA, 32 nt, Human
gguggugagauggugccuccugcccucuccuc

SEQ ID NO: 204388 - RNA, 32 nt, Human
gguggugagccccaccagaugagcacagagug

SEQ ID NO: 204389 - RNA, 32 nt, Human
gguggugaggagggaaaggcagucagauucca

SEQ ID NO: 204390 - RNA, 32 nt, Human
gguggugaggcucaguuaccccugggcuuagg

SEQ ID NO: 204391 - RNA, 32 nt, Human
gguggugaugcuuaccugggaggcagagggug

SEQ ID NO: 204392 - RNA, 32 nt, Human
gguggugaugcuuugaacagggcccagguggg

SEQ ID NO: 204393 - RNA, 32 nt, Human
gguggugauggaggagggacucagggagaggc

SEQ ID NO: 204394 - RNA, 32 nt, Human
gguggugauucuggccauggccccucugccaa

SEQ ID NO: 204395 - RNA, 32 nt, Human
gguggugcagaugaccccguguacucggggcu

SEQ ID NO: 204396 - RNA, 20 nt, Human
gguggugcaugccuguaauc

SEQ ID NO: 204397 - RNA, 32 nt, Human
gguggugcaugccuguaaucccugcuacuugg

SEQ ID NO: 204398 - RNA, 32 nt, Human
gguggugccacugcacuccaaccugggggaca

SEQ ID NO: 204399 - RNA, 32 nt, Human
gguggugccacugcgcuccagccugggggagg

SEQ ID NO: 204400 - RNA, 32 nt, Human
gguggugccacuggcagagcugggaagucagg

SEQ ID NO: 204401 - RNA, 32 nt, Human
gguggugccccucugccugccugccccacugu

SEQ ID NO: 204402 - RNA, 32 nt, Human
gguggugcccugagccucgagcugcucucugu

SEQ ID NO: 204403 - RNA, 32 nt, Human
gguggugcggucuccaggccucccaggauucu

SEQ ID NO: 204404 - RNA, 32 nt, Human
gguggugcuccugguggcaguggcucucuggc

SEQ ID NO: 204405 - RNA, 32 nt, Human
gguggugcugcugcugcuucugaggcacuggg

SEQ ID NO: 204406 - RNA, 32 nt, Human
gguggugcuggagguggcugcagagagccacu

SEQ ID NO: 204407 - RNA, 32 nt, Human
ggugguggacauguucaggagcuguuugccug

SEQ ID NO: 204408 - RNA, 32 nt, Human
ggugguggagcagagcagccaucuuuuaagug

SEQ ID NO: 204409 - RNA, 32 nt, Human
ggugguggaggaggaggaggaggaggaaggca

SEQ ID NO: 204410 - RNA, 32 nt, Human
ggugguggaggcagccuucagugagcauggag

SEQ ID NO: 204411 - RNA, 32 nt, Human
ggugguggaggccaauacuuugccaaaccacg

SEQ ID NO: 204412 - RNA, 21 nt, Human
ggugguggaggcgcucucuca

SEQ ID NO: 204413 - RNA, 32 nt, Human
ggugguggaggcggcggaggcggcggcggagg

SEQ ID NO: 204414 - RNA, 32 nt, Human
ggugguggaguugcuggagguagaggagcuau

SEQ ID NO: 204415 - RNA, 32 nt, Human
ggugguggcacacgccuguaaucccagcuacu

SEQ ID NO: 204416 - RNA, 32 nt, Human
ggugguggcacgggcccucccucccagcgcuc

SEQ ID NO: 204417 - RNA, 32 nt, Human
ggugguggcauuugccccaugcccucaacgcg

SEQ ID NO: 204418 - RNA, 32 nt, Human
ggugguggccaucacuauuccugguggggcuu

SEQ ID NO: 204419 - RNA, 32 nt, Human
ggugguggccuguaaucccagcuacuugggag

SEQ ID NO: 204420 - RNA, 20 nt, Human
ggugguggcggcagaggagg

SEQ ID NO: 204421 - RNA, 32 nt, Human
ggugguggcgggagcagcgggagcagccggaa

SEQ ID NO: 204422 - RNA, 32 nt, Human
ggugguggcucacaucuguaaucccagcacuu

SEQ ID NO: 204423 - RNA, 32 nt, Human
ggugguggcucacgccuguaaucccagcaagu

SEQ ID NO: 204424 - RNA, 32 nt, Human
ggugguggcucacgccuguaaucccagcacuu

SEQ ID NO: 204425 - RNA, 32 nt, Human
ggugguggcucaugccuguaaucccagcacuu

SEQ ID NO: 204426 - RNA, 32 nt, Human
ggugguggcuuugccuuggauauuccucuucc

SEQ ID NO: 204427 - RNA, 32 nt, Human
gguggugggaagaaggaaggugggaagaagga

SEQ ID NO: 204428 - RNA, 32 nt, Human
gguggugggaaguagcugaagcaaagaaggaa

SEQ ID NO: 204429 - RNA, 32 nt, Human
gguggugggcaggcucgguaggcgggaaaggc

SEQ ID NO: 204430 - RNA, 32 nt, Human
gguggugggccaggccagcagugcuguggcca

SEQ ID NO: 204431 - RNA, 32 nt, Human
gguggugggcgauuguuguucuuaauucuucu

SEQ ID NO: 204432 - RNA, 32 nt, Human
gguggugggcuacucuggaggcccuugaggac

SEQ ID NO: 204433 - RNA, 32 nt, Human
ggugguggggagcagaggggcaggaccugcag

SEQ ID NO: 204434 - RNA, 32 nt, Human
ggugguggggccucaccuugaagagggaaguc

SEQ ID NO: 204435 - RNA, 32 nt, Human
ggugguggucccugggugggucagguagggca

SEQ ID NO: 204436 - RNA, 32 nt, Human
gguggugguggauagcaucacaagaaacgagc

SEQ ID NO: 204437 - RNA, 32 nt, Human
gguggugguggccgccuguaaucccagcuacu

SEQ ID NO: 204438 - RNA, 32 nt, Human
ggugguggugggcaccuguagucccagguacu

SEQ ID NO: 204439 - RNA, 32 nt, Human
ggugguggugucugucagacacacacaggucg

SEQ ID NO: 204440 - RNA, 32 nt, Human
gguggugguguuucuguuugaagaaacugaca

SEQ ID NO: 204441 - RNA, 32 nt, Human
gguggugucacaggauggugggggcggggcag

SEQ ID NO: 204442 - RNA, 32 nt, Human
gguggugucagugccauuaucuagcacccuga

SEQ ID NO: 204443 - RNA, 32 nt, Human
gguggugugcaccuguaguaaucccagcuacu

SEQ ID NO: 204444 - RNA, 32 nt, Human
gguggugugccuguagucccagcuacuuggga

SEQ ID NO: 204445 - RNA, 32 nt, Human
gguggugugccuguaguccuaguuacuuggga

SEQ ID NO: 204446 - RNA, 32 nt, Human
ggugguuacacaguugaccucugccuggcucc

SEQ ID NO: 204447 - RNA, 32 nt, Human
ggugguucaagauggcggcgcccaguggcacu

SEQ ID NO: 204448 - RNA, 32 nt, Human
ggugguucacaccucuaaucccugcacuuugg

SEQ ID NO: 204449 - RNA, 20 nt, Human
ggugguucacaccuguaauc

SEQ ID NO: 204450 - RNA, 23 nt, Human
ggugguucacaccuguaauccca

SEQ ID NO: 204451 - RNA, 23 nt, Human
ggugguucacgccuguaauccca

SEQ ID NO: 204452 - RNA, 32 nt, Human
ggugguucagccaagacagauguagacagagu

SEQ ID NO: 204453 - RNA, 32 nt, Human
ggugguucagccccuucuccaaccccuucaua

SEQ ID NO: 204454 - RNA, 32 nt, Human
ggugguucaggucuucccaguacucugggagc

SEQ ID NO: 204455 - RNA, 23 nt, Human
ggugguucaugccuguaauccca

SEQ ID NO: 204456 - RNA, 32 nt, Human
ggugguuccagcauccugccugccgccgccug

SEQ ID NO: 204457 - RNA, 32 nt, Human
ggugguuccugcccagcaugcccagcuccucc

SEQ ID NO: 204458 - RNA, 32 nt, Human
ggugguuccugggggaacagagacuggagaug

SEQ ID NO: 204459 - RNA, 32 nt, Human
ggugguucucaccuggggcuauaguaaaauca

SEQ ID NO: 204460 - RNA, 32 nt, Human
ggugguucuggcucagggucucagguugcauu

SEQ ID NO: 204461 - RNA, 32 nt, Human
ggugguugacuugugccuggcugcaguagcag

SEQ ID NO: 204462 - RNA, 32 nt, Human
ggugguugaggcaggaggauuguuugagcgag

SEQ ID NO: 204463 - RNA, 32 nt, Human
ggugguugagggugacuuuuccugcugccugg

SEQ ID NO: 204464 - RNA, 32 nt, Human
ggugguugcauccaaguaucugucuuucuuua

SEQ ID NO: 204465 - RNA, 32 nt, Human
ggugguugcucugucccucuagaagccucugc

SEQ ID NO: 204466 - RNA, 32 nt, Human
ggugguugcugaaggcuggaguggguguggca

SEQ ID NO: 204467 - RNA, 32 nt, Human
ggugguuggccagcccugccuucugcaugaga

SEQ ID NO: 204468 - RNA, 32 nt, Human
ggugguuggcucucccucuccucucucccucu

SEQ ID NO: 204469 - RNA, 32 nt, Human
ggugguugguuuucuccagagaagaacccuug

SEQ ID NO: 204470 - RNA, 23 nt, Human
ggugguuuacgaaguccucugga

SEQ ID NO: 204471 - RNA, 22 nt, Human
ggugguuucaccauguugguca

SEQ ID NO: 204472 - RNA, 32 nt, Human
ggugguuuccuuccucuucaggcagccaggcc

SEQ ID NO: 204473 - RNA, 32 nt, Human
gguguaaaaccucacaguaaacaucuuacaga

SEQ ID NO: 204474 - RNA, 32 nt, Human
gguguaaaccuacagccagcagcagucuggag

SEQ ID NO: 204475 - RNA, 32 nt, Human
gguguaaagcuggcccugccuccugggaagau

SEQ ID NO: 204476 - RNA, 32 nt, Human
gguguaaagggucuucugagcugcaguggcaa

SEQ ID NO: 204477 - RNA, 32 nt, Human
gguguaaauacccagugugcuuaugagucagu

SEQ ID NO: 204478 - RNA, 32 nt, Human
gguguaaaucaccacaccugggcugcuuuauu

SEQ ID NO: 204479 - RNA, 32 nt, Human
gguguaacuuaugugacucuagugcuuaacag

SEQ ID NO: 204480 - RNA, 32 nt, Human
gguguaagucaagcucuugaauauaacuggug

SEQ ID NO: 204481 - RNA, 32 nt, Human
gguguacacccacuguaacauuaggcguaauu

SEQ ID NO: 204482 - RNA, 32 nt, Human
gguguacagagcaugcaggccaugucugccag

SEQ ID NO: 204483 - RNA, 32 nt, Human
gguguacagcggacacauucaggaugagguga

SEQ ID NO: 204484 - RNA, 32 nt, Human
gguguacauauuauuucauuacccagguaaua

SEQ ID NO: 204485 - RNA, 32 nt, Human
gguguacaugcagcuacucgggaggcugaggc

SEQ ID NO: 204486 - RNA, 32 nt, Human
gguguaccauaccugagagcaccaggaagucg

SEQ ID NO: 204487 - RNA, 32 nt, Human
gguguacgauaaccaagagccacugagagagg

SEQ ID NO: 204488 - RNA, 32 nt, Human
gguguacgccuguaaucccagugacuugggag

SEQ ID NO: 204489 - RNA, 32 nt, Human
gguguacuguacguacacaggugcuggucgau

SEQ ID NO: 204490 - RNA, 23 nt, Human
gguguagaaacaaagggccuaau

SEQ ID NO: 204491 - RNA, 32 nt, Human
gguguagacgcugcuggccagcccuccccagc

SEQ ID NO: 204492 - RNA, 17 nt, Human
gguguagagagaagcuu

SEQ ID NO: 204493 - RNA, 32 nt, Human
gguguagagcaaggaagcacuucuucccaaga

SEQ ID NO: 204494 - RNA, 32 nt, Human
gguguagaugucugugucugugagaugccuuu

SEQ ID NO: 204495 - RNA, 32 nt, Human
gguguagcacagaagaaagaccuguguccuag

SEQ ID NO: 204496 - RNA, 32 nt, Human
gguguagcagcaguugaucagacugaaaaacg

SEQ ID NO: 204497 - RNA, 32 nt, Human
gguguagcugugaaaaucaucagaacucuuca

SEQ ID NO: 204498 - RNA, 32 nt, Human
gguguaggaacaaccucaguucugugaaaggc

SEQ ID NO: 204499 - RNA, 32 nt, Human
gguguaggagugcugaugagaggcagaggcuc

SEQ ID NO: 204500 - RNA, 32 nt, Human
gguguagggaccccuugaggggccaagcugac

SEQ ID NO: 204501 - RNA, 32 nt, Human
gguguagggcccagagaagcagaacagcccag

SEQ ID NO: 204502 - RNA, 32 nt, Human
gguguaggggccugugcccuuccagggccagu

SEQ ID NO: 204503 - RNA, 32 nt, Human
gguguaggggcugggagcuuggaggggguugu

SEQ ID NO: 204504 - RNA, 18 nt, Human
gguguagguucaugccca

SEQ ID NO: 204505 - RNA, 23 nt, Human
gguguagucugugucucugcgga

SEQ ID NO: 204506 - RNA, 32 nt, Human
gguguagugcacaccuguaaucccagguacuc

SEQ ID NO: 204507 - RNA, 32 nt, Human
gguguagugcaggcaggguggggaaaggacgg

SEQ ID NO: 204508 - RNA, 22 nt, Human
gguguagugccucaugccugua

SEQ ID NO: 204509 - RNA, 32 nt, Human
gguguagugccugucuccuacuucauucggaa

SEQ ID NO: 204510 - RNA, 22 nt, Human
gguguaguggcucacaccugua

SEQ ID NO: 204511 - RNA, 22 nt, Human
gguguaguggcucacgccugua

SEQ ID NO: 204512 - RNA, 22 nt, Human
gguguaguggcucaugccugua

SEQ ID NO: 204513 - RNA, 22 nt, Human
gguguaguuaccagaugaugaa

SEQ ID NO: 204514 - RNA, 32 nt, Human
gguguaucucacaaugcaaagacaugcuggcu

SEQ ID NO: 204515 - RNA, 32 nt, Human
gguguaugccuguaaucccagcuacucgggag

SEQ ID NO: 204516 - RNA, 32 nt, Human
gguguaugccuguagucccagccacucagaag

SEQ ID NO: 204517 - RNA, 32 nt, Human
gguguaugccuguagucccugcuacuugggag

SEQ ID NO: 204518 - RNA, 32 nt, Human
gguguaugcucacgccuccuguucuuucuuaa

SEQ ID NO: 204519 - RNA, 32 nt, Human
gguguaugggguagauggguggagagggaggg

SEQ ID NO: 204520 - RNA, 32 nt, Human
gguguaugggguccccaaaaggugcccgucaa

SEQ ID NO: 204521 - RNA, 29 nt, Human
gguguauggguguguguggguggguguga

SEQ ID NO: 204522 - RNA, 32 nt, Human
gguguauugagucugaagaggaugugcugugg

SEQ ID NO: 204523 - RNA, 32 nt, Human
gguguauugagucugaugaggaugugcugugg

SEQ ID NO: 204524 - RNA, 32 nt, Human
gguguauuuaccuuccuucccuuccugcuccc

SEQ ID NO: 204525 - RNA, 32 nt, Human
ggugucaagcaugagucaggcugagccugacu

SEQ ID NO: 204526 - RNA, 32 nt, Human
ggugucaagccccauucccucucuacucuuga

SEQ ID NO: 204527 - RNA, 32 nt, Human
ggugucaagcuccucaauaaacuugucuccac

SEQ ID NO: 204528 - RNA, 32 nt, Human
ggugucaccagccuguuuagccaaguagcuuu

SEQ ID NO: 204529 - RNA, 32 nt, Human
ggugucacccaggcuggagugcagugguguga

SEQ ID NO: 204530 - RNA, 23 nt, Human
ggugucaccuccguuggauagag

SEQ ID NO: 204531 - RNA, 20 nt, Human
ggugucaccuugggcgcgag

SEQ ID NO: 204532 - RNA, 32 nt, Human
ggugucacugcacuccagccugggugacagug

SEQ ID NO: 204533 - RNA, 32 nt, Human
ggugucacugccagcaccaggcacugcuuuca

SEQ ID NO: 204534 - RNA, 32 nt, Human
ggugucacuuccccuucccacccucacaucug

SEQ ID NO: 204535 - RNA, 23 nt, Human
ggugucacuuucaggcgaguagu

SEQ ID NO: 204536 - RNA, 32 nt, Human
ggugucagagguaggggaaccaggggcaagcu

SEQ ID NO: 204537 - RNA, 32 nt, Human
ggugucagccaccgcacccagccuggaguggc

SEQ ID NO: 204538 - RNA, 32 nt, Human
ggugucagccuaugucuuuauauugucaagau

SEQ ID NO: 204539 - RNA, 32 nt, Human
ggugucagcuacucgggaggcugaggcaggag

SEQ ID NO: 204540 - RNA, 32 nt, Human
ggugucaggccugcugcccuugccuuguccuc

SEQ ID NO: 204541 - RNA, 32 nt, Human
ggugucaggcugggguuagugagcagguuaca

SEQ ID NO: 204542 - RNA, 32 nt, Human
ggugucagggaaggaggaaccagcaagaccug

SEQ ID NO: 204543 - RNA, 32 nt, Human
ggugucagggcggggcagggguccccaguccu

SEQ ID NO: 204544 - RNA, 19 nt, Human
ggugucagugauggcuugg

SEQ ID NO: 204545 - RNA, 20 nt, Human
ggugucaguggcggcggcag

SEQ ID NO: 204546 - RNA, 32 nt, Human
ggugucaucagggaggaccugaugugcggggu

SEQ ID NO: 204547 - RNA, 32 nt, Human
ggugucauccaccuccuguccugcugcccugu

SEQ ID NO: 204548 - RNA, 24 nt, Human
ggugucaucguagguggccaccua

SEQ ID NO: 204549 - RNA, 25 nt, Human
ggugucaugaagaaaguucuguuca

SEQ ID NO: 204550 - RNA, 32 nt, Human
ggugucauuucuucuuuucccuguggcaucgu

SEQ ID NO: 204551 - RNA, 32 nt, Human
gguguccaaaaaucgacagccacugagaccgg

SEQ ID NO: 204552 - RNA, 32 nt, Human
gguguccaaacuuggggcuucccaggcaccug

SEQ ID NO: 204553 - RNA, 32 nt, Human
gguguccaacuggcccuauuuagaugauaaag

SEQ ID NO: 204554 - RNA, 32 nt, Human
gguguccaaggaugauauguacucccacccca

SEQ ID NO: 204555 - RNA, 32 nt, Human
gguguccacaugcacguguauauguauaucug

SEQ ID NO: 204556 - RNA, 19 nt, Human
gguguccacugacaaggag

SEQ ID NO: 204557 - RNA, 32 nt, Human
gguguccagacccugggauggggccuccggag

SEQ ID NO: 204558 - RNA, 32 nt, Human
gguguccaggagcuggaacccagagagcgucc

SEQ ID NO: 204559 - RNA, 32 nt, Human
gguguccaggcagaggaaacaggaaauguggc

SEQ ID NO: 204560 - RNA, 32 nt, Human
gguguccaggcucugccaggggagaggaaggu

SEQ ID NO: 204561 - RNA, 16 nt, Human
gguguccaggguccuc

SEQ ID NO: 204562 - RNA, 32 nt, Human
gguguccagugaaaauaaaaaugcaugccccu

SEQ ID NO: 204563 - RNA, 32 nt, Human
gguguccauccuuuccccaucccugccuccug

SEQ ID NO: 204564 - RNA, 32 nt, Human
gguguccaucuacaguaaaccccaccauuacc

SEQ ID NO: 204565 - RNA, 32 nt, Human
gguguccaucuucuugcuguugaggacccuga

SEQ ID NO: 204566 - RNA, 23 nt, Human
gguguccauggaacuuccucucu

SEQ ID NO: 204567 - RNA, 32 nt, Human
ggugucccagggacucugucagugccuucagc

SEQ ID NO: 204568 - RNA, 32 nt, Human
ggugucccagggacugugugcucaggagcacu

SEQ ID NO: 204569 - RNA, 25 nt, Human
ggugucccaguugggagcucgcuca

SEQ ID NO: 204570 - RNA, 32 nt, Human
gguguccccugaucccuucuuccaaauauaaa

SEQ ID NO: 204571 - RNA, 32 nt, Human
gguguccccuuguggguuuuccuggcacacag

SEQ ID NO: 204572 - RNA, 18 nt, Human
ggugucccggaaaggggc

SEQ ID NO: 204573 - RNA, 22 nt, Human
ggugucccucggggguucucuc

SEQ ID NO: 204574 - RNA, 32 nt, Human
ggugucccugaggagagggaggugggugcgcg

SEQ ID NO: 204575 - RNA, 32 nt, Human
ggugucccugccuggcccuccucuggucacuu

SEQ ID NO: 204576 - RNA, 32 nt, Human
ggugucccuuucuccuccccuaguguccuuaa

SEQ ID NO: 204577 - RNA, 32 nt, Human
gguguccgagaggcugguguaugcacugcuca

SEQ ID NO: 204578 - RNA, 32 nt, Human
gguguccguggguccgucugcccagccaucug

SEQ ID NO: 204579 - RNA, 32 nt, Human
gguguccuaaggagacuccuggaagcugaaug

SEQ ID NO: 204580 - RNA, 32 nt, Human
gguguccuaccugaacuccaaguucucaccau

SEQ ID NO: 204581 - RNA, 32 nt, Human
gguguccuagccagcuucccuucaccuggugu

SEQ ID NO: 204582 - RNA, 32 nt, Human
gguguccuccagccucucuggaugcuccaugg

SEQ ID NO: 204583 - RNA, 32 nt, Human
gguguccuccaucccccagugccuucacaucu

SEQ ID NO: 204584 - RNA, 32 nt, Human
gguguccuccuucaucccaggcugccaggcua

SEQ ID NO: 204585 - RNA, 32 nt, Human
gguguccucuguccaggccaucauggccucca

SEQ ID NO: 204586 - RNA, 32 nt, Human
gguguccugacugaagcacaggccauagcccc

SEQ ID NO: 204587 - RNA, 32 nt, Human
gguguccugcacugcauccugccuccuugcug

SEQ ID NO: 204588 - RNA, 32 nt, Human
gguguccugccagugguacuuucacagcuggg

SEQ ID NO: 204589 - RNA, 32 nt, Human
gguguccugggcagcaccaugaaugccuuuac

SEQ ID NO: 204590 - RNA, 32 nt, Human
gguguccugggcugugugggaccucagcaagg

SEQ ID NO: 204591 - RNA, 32 nt, Human
gguguccuucugaaaugcaugcccuguggcac

SEQ ID NO: 204592 - RNA, 18 nt, Human
gguguccuucugcacccu

SEQ ID NO: 204593 - RNA, 32 nt, Human
gguguccuugagaugcucacauuacugcccgg

SEQ ID NO: 204594 - RNA, 32 nt, Human
gguguccuuuggaggcaugguggaugaaaggc

SEQ ID NO: 204595 - RNA, 24 nt, Human
ggugucgaucuccugaccucguga

SEQ ID NO: 204596 - RNA, 32 nt, Human
ggugucgcccacccuucuuccccgggcaggcc

SEQ ID NO: 204597 - RNA, 23 nt, Human
ggugucgccugcucuggcugagu

SEQ ID NO: 204598 - RNA, 21 nt, Human
ggugucgcguacgggcuuccc

SEQ ID NO: 204599 - RNA, 32 nt, Human
ggugucgcucugcuggccuggccggcaacccc

SEQ ID NO: 204600 - RNA, 32 nt, Human
ggugucgcuuguaaucucagcuacuugggaga

SEQ ID NO: 204601 - RNA, 32 nt, Human
ggugucggauugcagugcgcucgcugaggcuc

SEQ ID NO: 204602 - RNA, 32 nt, Human
ggugucggccuagacacuuggaaauuguauuc

SEQ ID NO: 204603 - RNA, 32 nt, Human
ggugucggggaccugggcgcagauucauuccc

SEQ ID NO: 204604 - RNA, 18 nt, Human
ggugucggggggcggggg

SEQ ID NO: 204605 - RNA, 32 nt, Human
ggugucguuuagaucaggguaaggcagucagg

SEQ ID NO: 204606 - RNA, 32 nt, Human
ggugucuagaaacuuuuaaggggccgguucaa

SEQ ID NO: 204607 - RNA, 31 nt, Human
ggugucuaggcugaaggaguuggagaccuug

SEQ ID NO: 204608 - RNA, 32 nt, Human
ggugucuauaauuguagcacauggagaaagca

SEQ ID NO: 204609 - RNA, 20 nt, Human
ggugucucacaucuguaauc

SEQ ID NO: 204610 - RNA, 32 nt, Human
ggugucucacccuguugcccaggcuggaauac

SEQ ID NO: 204611 - RNA, 32 nt, Human
ggugucucccacgucuguguucuuauuugcag

SEQ ID NO: 204612 - RNA, 32 nt, Human
ggugucucccggguacagauggagucgucccg

SEQ ID NO: 204613 - RNA, 19 nt, Human
ggugucuccuucuacaucc

SEQ ID NO: 204614 - RNA, 32 nt, Human
ggugucucuagccugcagagugcagugaguga

SEQ ID NO: 204615 - RNA, 32 nt, Human
ggugucucucuacguugcccaggcuggucucg

SEQ ID NO: 204616 - RNA, 32 nt, Human
ggugucucugcagcuggccuccggagccuucc

SEQ ID NO: 204617 - RNA, 32 nt, Human
ggugucucuguacccgcggcuccugagucagu

SEQ ID NO: 204618 - RNA, 32 nt, Human
ggugucugaagugccuugggggcacccucauu

SEQ ID NO: 204619 - RNA, 32 nt, Human
ggugucugacccaccagcagugcaaugggcag

SEQ ID NO: 204620 - RNA, 32 nt, Human
ggugucugagaaccuccagcuucaccuccuuu

SEQ ID NO: 204621 - RNA, 32 nt, Human
ggugucugaggguugagguugcaguccuggaa

SEQ ID NO: 204622 - RNA, 32 nt, Human
ggugucugcaccuccuuucccucucuccaucu

SEQ ID NO: 204623 - RNA, 29 nt, Human
ggugucugcaugugugugugggugugaau

SEQ ID NO: 204624 - RNA, 32 nt, Human
ggugucugccacacccaaguucccaggcccug

SEQ ID NO: 204625 - RNA, 19 nt, Human
ggugucugcccccucuuua

SEQ ID NO: 204626 - RNA, 31 nt, Human
ggugucugccucucggagucugugcacaucu

SEQ ID NO: 204627 - RNA, 31 nt, Human
ggugucugccucucugcagguguucaccaca

SEQ ID NO: 204628 - RNA, 32 nt, Human
ggugucugcuagccucaaccuccuggggcagg

SEQ ID NO: 204629 - RNA, 32 nt, Human
ggugucugcuccaucagaccuggagcuuccaa

SEQ ID NO: 204630 - RNA, 32 nt, Human
ggugucugcuggcuccuccuugcucgccugcu

SEQ ID NO: 204631 - RNA, 32 nt, Human
ggugucuggagccgggccuggugacaggcauc

SEQ ID NO: 204632 - RNA, 32 nt, Human
ggugucuggccugaggucaauggugcaaagga

SEQ ID NO: 204633 - RNA, 32 nt, Human
ggugucuggggcaggaggaggccaacucacug

SEQ ID NO: 204634 - RNA, 32 nt, Human
ggugucuggguguuuggagguggccccguucu

SEQ ID NO: 204635 - RNA, 16 nt, Human
ggugucuguaauccca

SEQ ID NO: 204636 - RNA, 32 nt, Human
ggugucuguaaucccagcugugggagguugag

SEQ ID NO: 204637 - RNA, 32 nt, Human
ggugucugucuaggaaggaaggggugauugac

SEQ ID NO: 204638 - RNA, 32 nt, Human
ggugucugucucaggguacggugcaggcacag

SEQ ID NO: 204639 - RNA, 18 nt, Human
ggugucugucucuggcug

SEQ ID NO: 204640 - RNA, 32 nt, Human
ggugucuguggacccugcuucugaaguacaug

SEQ ID NO: 204641 - RNA, 32 nt, Human
ggugucuguggagcacccugcccucaccacag

SEQ ID NO: 204642 - RNA, 32 nt, Human
ggugucuucccgggcccugccagacccugcuc

SEQ ID NO: 204643 - RNA, 32 nt, Human
ggugucuuccuucagcccaugcccaccugguc

SEQ ID NO: 204644 - RNA, 32 nt, Human
ggugucuugugaaaggagggcaagcaaaagug

SEQ ID NO: 204645 - RNA, 32 nt, Human
ggugucuuucuuuccuuccuccuucuucucuc

SEQ ID NO: 204646 - RNA, 32 nt, Human
ggugucuuugaucaggaugacaugugccauuu

SEQ ID NO: 204647 - RNA, 17 nt, Human
ggugugaaaaccaucua

SEQ ID NO: 204648 - RNA, 32 nt, Human
ggugugaaaagcuugcagaaccagacagagaa

SEQ ID NO: 204649 - RNA, 32 nt, Human
ggugugaaccaccacacccagcccacuucugc

SEQ ID NO: 204650 - RNA, 32 nt, Human
ggugugaacccgggaggcagagcuugugguga

SEQ ID NO: 204651 - RNA, 32 nt, Human
ggugugaacugugguuuaacuguuuucuugua

SEQ ID NO: 204652 - RNA, 32 nt, Human
ggugugaaugcuguaccuuucugacaauaaau

SEQ ID NO: 204653 - RNA, 32 nt, Human
ggugugacacagccacagcagaggcaaggggu

SEQ ID NO: 204654 - RNA, 32 nt, Human
ggugugacaucucuguuauuguuuccagucaa

SEQ ID NO: 204655 - RNA, 32 nt, Human
ggugugacccucaggaagguuaagucaggagu

SEQ ID NO: 204656 - RNA, 32 nt, Human
ggugugacucgggagcugcacacaccugggug

SEQ ID NO: 204657 - RNA, 32 nt, Human
ggugugacugauucccagccuguggcagggcg

SEQ ID NO: 204658 - RNA, 32 nt, Human
ggugugagagagcauggcccagacaagcagcu

SEQ ID NO: 204659 - RNA, 32 nt, Human
ggugugagagggacagcucacgaggcuuggac

SEQ ID NO: 204660 - RNA, 32 nt, Human
ggugugagagugagggaagaggaagcuggaac

SEQ ID NO: 204661 - RNA, 32 nt, Human
ggugugagagugagggcagagggagcuggagc

SEQ ID NO: 204662 - RNA, 32 nt, Human
ggugugagagugaguggcgugcugggcaugaa

SEQ ID NO: 204663 - RNA, 32 nt, Human
ggugugagccaccacacccagccaacauuuuc

SEQ ID NO: 204664 - RNA, 32 nt, Human
ggugugagccaccacacccagccaauuagggc

SEQ ID NO: 204665 - RNA, 32 nt, Human
ggugugagccaccacacccagccaugaaucag

SEQ ID NO: 204666 - RNA, 32 nt, Human
ggugugagccaccacacccagcccaggcucau

SEQ ID NO: 204667 - RNA, 32 nt, Human
ggugugagccaccacacccagccucuauaucc

SEQ ID NO: 204668 - RNA, 32 nt, Human
ggugugagccaccacacccagccucuguaguu

SEQ ID NO: 204669 - RNA, 32 nt, Human
ggugugagccaccacacccggcccaacugcca

SEQ ID NO: 204670 - RNA, 32 nt, Human
ggugugagccaccacacccggccuauauuguu

SEQ ID NO: 204671 - RNA, 32 nt, Human
ggugugagccaccacacccggccuuaucuccu

SEQ ID NO: 204672 - RNA, 32 nt, Human
ggugugagccaccacacugggccaaugcuuaa

SEQ ID NO: 204673 - RNA, 32 nt, Human
ggugugagccaccacagccagccuaaaaauaa

SEQ ID NO: 204674 - RNA, 32 nt, Human
ggugugagccaccacauccagccuaacuuaca

SEQ ID NO: 204675 - RNA, 32 nt, Human
ggugugagccaccacgcccggccaagaacuuu

SEQ ID NO: 204676 - RNA, 19 nt, Human
ggugugagccaccaggccc

SEQ ID NO: 204677 - RNA, 32 nt, Human
ggugugagccacugcacccagccugugauguu

SEQ ID NO: 204678 - RNA, 32 nt, Human
ggugugagccacugcacccggccuccaagcca

SEQ ID NO: 204679 - RNA, 32 nt, Human
ggugugagccacugcaccuggccaugguuagu

SEQ ID NO: 204680 - RNA, 32 nt, Human
ggugugagccacugcaccuggccuccuuaaau

SEQ ID NO: 204681 - RNA, 32 nt, Human
ggugugagccacugcaccuggccuggagcuca

SEQ ID NO: 204682 - RNA, 32 nt, Human
ggugugagccacugccuggccuggccguaggu

SEQ ID NO: 204683 - RNA, 32 nt, Human
ggugugagccacugcgcccagccugaaucauu

SEQ ID NO: 204684 - RNA, 32 nt, Human
ggugugagccgcugggcccagccugguuaucu

SEQ ID NO: 204685 - RNA, 32 nt, Human
ggugugagccuguaaucccagcuacucagaag

SEQ ID NO: 204686 - RNA, 32 nt, Human
ggugugaggauagaauuucgaacaccaagagu

SEQ ID NO: 204687 - RNA, 32 nt, Human
ggugugaggccccagccuggagccaggcacug

SEQ ID NO: 204688 - RNA, 32 nt, Human
ggugugaggcggccucacagggccgggugggc

SEQ ID NO: 204689 - RNA, 32 nt, Human
ggugugagucugucaugagagcuguccugaau

SEQ ID NO: 204690 - RNA, 32 nt, Human
ggugugagugagcucuccagaauggcacaugg

SEQ ID NO: 204691 - RNA, 32 nt, Human
ggugugagugcagauauugcacugugucaccu

SEQ ID NO: 204692 - RNA, 23 nt, Human
ggugugaucuagaacagggcuca

SEQ ID NO: 204693 - RNA, 22 nt, Human
ggugugauggcucaugccugua

SEQ ID NO: 204694 - RNA, 22 nt, Human
ggugugauggugcaugccugua

SEQ ID NO: 204695 - RNA, 32 nt, Human
ggugugauugcacuccagcccaggggacaaug

SEQ ID NO: 204696 - RNA, 32 nt, Human
ggugugcacacaggccagugagcgguggccga

SEQ ID NO: 204697 - RNA, 32 nt, Human
ggugugcaccaccacagcuggcuaauucuauu

SEQ ID NO: 204698 - RNA, 32 nt, Human
ggugugcaccacugcucuucuuauggaguagc

SEQ ID NO: 204699 - RNA, 32 nt, Human
ggugugcaccuguaaucccagcuacucaggag

SEQ ID NO: 204700 - RNA, 32 nt, Human
ggugugcaccuguaaucccagcuacucgggag

SEQ ID NO: 204701 - RNA, 32 nt, Human
ggugugcaccuguaaucccagcuacuugggag

SEQ ID NO: 204702 - RNA, 32 nt, Human
ggugugcaccuguaaucccggcuacucggggg

SEQ ID NO: 204703 - RNA, 32 nt, Human
ggugugcaccuguaaucucagcuacucgggag

SEQ ID NO: 204704 - RNA, 32 nt, Human
ggugugcaccuguaauuccagcuacucgggag

SEQ ID NO: 204705 - RNA, 32 nt, Human
ggugugcacgugcacacaugugcacguuugua

SEQ ID NO: 204706 - RNA, 32 nt, Human
ggugugcagagcaagggagagugaaggaagcc

SEQ ID NO: 204707 - RNA, 22 nt, Human
ggugugcagaggaaagcugcau

SEQ ID NO: 204708 - RNA, 32 nt, Human
ggugugcagauggggaggggguacuggccuug

SEQ ID NO: 204709 - RNA, 32 nt, Human
ggugugcagcaacugcccuggagccccagccc

SEQ ID NO: 204710 - RNA, 32 nt, Human
ggugugcagcuauuugagggacuaagggaugg

SEQ ID NO: 204711 - RNA, 32 nt, Human
ggugugcagggcaggucagggaagggcagggu

SEQ ID NO: 204712 - RNA, 32 nt, Human
ggugugcaggggcagagaaggaagggaccagg

SEQ ID NO: 204713 - RNA, 24 nt, Human
ggugugcaguggccccauccagca

SEQ ID NO: 204714 - RNA, 32 nt, Human
ggugugcaguguccugacuguaagaucaaguc

SEQ ID NO: 204715 - RNA, 32 nt, Human
ggugugcaucuguaaucccagcuacuugggag

SEQ ID NO: 204716 - RNA, 32 nt, Human
ggugugcaucuguaaucccggcuacuugggag

SEQ ID NO: 204717 - RNA, 32 nt, Human
ggugugcauggauggagggugccugaggcugc

SEQ ID NO: 204718 - RNA, 32 nt, Human
ggugugccaagaggagguggguagaugggagu

SEQ ID NO: 204719 - RNA, 32 nt, Human
ggugugccacaggcugcaagcugcagggaauu

SEQ ID NO: 204720 - RNA, 32 nt, Human
ggugugccaggccacuuugguaucagaaauug

SEQ ID NO: 204721 - RNA, 32 nt, Human
ggugugccccaagugauccucccaccucucaa

SEQ ID NO: 204722 - RNA, 32 nt, Human
ggugugcccuggaggcuuagguuggucugagg

SEQ ID NO: 204723 - RNA, 32 nt, Human
ggugugcccuggggugccauggcugcuauucg

SEQ ID NO: 204724 - RNA, 32 nt, Human
ggugugccgcaaugagagucaaucucuauuga

SEQ ID NO: 204725 - RNA, 18 nt, Human
ggugugccuguaguccca

SEQ ID NO: 204726 - RNA, 32 nt, Human
ggugugcgccuauaaucccagcuacucaggag

SEQ ID NO: 204727 - RNA, 32 nt, Human
ggugugcgccuguaaucccagcuacuccggga

SEQ ID NO: 204728 - RNA, 32 nt, Human
ggugugcgccuguaaucccagcuacucgggag

SEQ ID NO: 204729 - RNA, 32 nt, Human
ggugugcgccuguaaucccagcuacucuggag

SEQ ID NO: 204730 - RNA, 32 nt, Human
ggugugcgccuguaaucccagcuacuugggag

SEQ ID NO: 204731 - RNA, 32 nt, Human
ggugugcgccuguaaucucagcuacucaagag

SEQ ID NO: 204732 - RNA, 32 nt, Human
ggugugcgccuguaauuccagcuacucgggag

SEQ ID NO: 204733 - RNA, 20 nt, Human
ggugugcgccuguaguccca

SEQ ID NO: 204734 - RNA, 32 nt, Human
ggugugcggggagggagccagggagugggugu

SEQ ID NO: 204735 - RNA, 32 nt, Human
ggugugcgugucuuuggggcauggaaguuggg

SEQ ID NO: 204736 - RNA, 32 nt, Human
ggugugcgugugugugcuugugugugcgcacg

SEQ ID NO: 204737 - RNA, 32 nt, Human
ggugugcucacugauccgccuccagggccacc

SEQ ID NO: 204738 - RNA, 32 nt, Human
ggugugcucacugugggggccaguuucuccuc

SEQ ID NO: 204739 - RNA, 32 nt, Human
ggugugcucccaggacuggcaugacagguguc

SEQ ID NO: 204740 - RNA, 32 nt, Human
ggugugcugaugugggaaguguuuacacaugg

SEQ ID NO: 204741 - RNA, 32 nt, Human
ggugugcugccugucugagcaagcuucccuag

SEQ ID NO: 204742 - RNA, 32 nt, Human
ggugugcugcugcugcuccccagcccaccagu

SEQ ID NO: 204743 - RNA, 32 nt, Human
ggugugcugggccccucucaggggcacuggcc

SEQ ID NO: 204744 - RNA, 32 nt, Human
ggugugcuggugcuggcgcugcugggucaggg

SEQ ID NO: 204745 - RNA, 32 nt, Human
ggugugcuguagcuccagccgggaugaggacu

SEQ ID NO: 204746 - RNA, 32 nt, Human
ggugugcugugggggucagacuccugaggcuc

SEQ ID NO: 204747 - RNA, 32 nt, Human
ggugugcuguuaggugaaagacuugcucagcu

SEQ ID NO: 204748 - RNA, 32 nt, Human
ggugugcuuccugcagagaugccucuggaguc

SEQ ID NO: 204749 - RNA, 32 nt, Human
gguguggaauggccuuccucucuaggugccug

SEQ ID NO: 204750 - RNA, 32 nt, Human
gguguggaccaugcugccuuguggagcuggga

SEQ ID NO: 204751 - RNA, 32 nt, Human
gguguggaccucuaggggcugucuccuccagg

SEQ ID NO: 204752 - RNA, 32 nt, Human
gguguggagagggaggcccaacagugaggagu

SEQ ID NO: 204753 - RNA, 32 nt, Human
gguguggagcagagcucgggaacucacagaaa

SEQ ID NO: 204754 - RNA, 32 nt, Human
gguguggagcagcaucccuggcuuccacccac

SEQ ID NO: 204755 - RNA, 32 nt, Human
gguguggagggaaaggcuuacacacaugugau

SEQ ID NO: 204756 - RNA, 32 nt, Human
gguguggaguggagagugacaggaaugugggg

SEQ ID NO: 204757 - RNA, 32 nt, Human
gguguggaguugaaugggcauggccaugagug

SEQ ID NO: 204758 - RNA, 32 nt, Human
gguguggaucccuagaugggagccggggaugg

SEQ ID NO: 204759 - RNA, 32 nt, Human
gguguggcagccaucucuccucccaggggucc

SEQ ID NO: 204760 - RNA, 32 nt, Human
gguguggcccucaggccuggugcugccuugga

SEQ ID NO: 204761 - RNA, 16 nt, Human
gguguggccugagaua

SEQ ID NO: 204762 - RNA, 32 nt, Human
gguguggccuucggguugacaugagaaagguc

SEQ ID NO: 204763 - RNA, 32 nt, Human
gguguggcucaugaaaucacagagcucagaga

SEQ ID NO: 204764 - RNA, 32 nt, Human
gguguggcugaaacggcaguugcucaagagca

SEQ ID NO: 204765 - RNA, 24 nt, Human
gguguggcugacucugagcccagg

SEQ ID NO: 204766 - RNA, 32 nt, Human
gguguggcugagccccagagccccagaaaccu

SEQ ID NO: 204767 - RNA, 18 nt, Human
gguguggcugcagcgggg

SEQ ID NO: 204768 - RNA, 32 nt, Human
gguguggcugcugaagccccacagcugugggc

SEQ ID NO: 204769 - RNA, 32 nt, Human
gguguggcuucccugcucacacccacacuggc

SEQ ID NO: 204770 - RNA, 32 nt, Human
gguguggcuuuguacaugcagaagaaugcuau

SEQ ID NO: 204771 - RNA, 32 nt, Human
ggugugggaacuuccccacggauggcggugga

SEQ ID NO: 204772 - RNA, 32 nt, Human
ggugugggaaggcagaagucccagggauccug

SEQ ID NO: 204773 - RNA, 32 nt, Human
ggugugggacaggcacuggccucagaccgggg

SEQ ID NO: 204774 - RNA, 32 nt, Human
ggugugggagagagaccugggcccgccagagg

SEQ ID NO: 204775 - RNA, 32 nt, Human
ggugugggaggaaaggcuccaucccccgcccc

SEQ ID NO: 204776 - RNA, 32 nt, Human
ggugugggaggaggccaccagauucagaauuc

SEQ ID NO: 204777 - RNA, 32 nt, Human
ggugugggaggcagaggugcugacguucugga

SEQ ID NO: 204778 - RNA, 32 nt, Human
ggugugggaguagccaccagccucccacugac

SEQ ID NO: 204779 - RNA, 32 nt, Human
ggugugggaucuggggagagcggcuggagaaa

SEQ ID NO: 204780 - RNA, 32 nt, Human
ggugugggaugaagccgacgaggggcucaguc

SEQ ID NO: 204781 - RNA, 32 nt, Human
ggugugggcaaggcccaggaaucuggagcauc

SEQ ID NO: 204782 - RNA, 20 nt, Human
ggugugggcagggcugguuc

SEQ ID NO: 204783 - RNA, 32 nt, Human
ggugugggcagugggaggcaagagugaagcag

SEQ ID NO: 204784 - RNA, 32 nt, Human
ggugugggcccaggcagggcuggggugugcug

SEQ ID NO: 204785 - RNA, 21 nt, Human
ggugugggcccuaaauucacu

SEQ ID NO: 204786 - RNA, 32 nt, Human
ggugugggccuguaaucgcagcuacucaggaa

SEQ ID NO: 204787 - RNA, 32 nt, Human
ggugugggcugagucccgggagccaaagggca

SEQ ID NO: 204788 - RNA, 22 nt, Human
gguguggggaagaggugggguu

SEQ ID NO: 204789 - RNA, 32 nt, Human
gguguggggaggacggggcaggacgcugcagc

SEQ ID NO: 204790 - RNA, 32 nt, Human
gguguggggcccuggauggcagcucuggccca

SEQ ID NO: 204791 - RNA, 32 nt, Human
gguguggggcucugcugggcuucucuugagca

SEQ ID NO: 204792 - RNA, 32 nt, Human
gguguggggcugggcauggucacuccugcugg

SEQ ID NO: 204793 - RNA, 32 nt, Human
gguguggggcuggguauggucacuccugcugg

SEQ ID NO: 204794 - RNA, 32 nt, Human
ggugugggggagccguuaggccucccaggucc

SEQ ID NO: 204795 - RNA, 32 nt, Human
ggugugggguuccguucucccuuccccuccca

SEQ ID NO: 204796 - RNA, 32 nt, Human
gguguggguagaggcuuuaagcauuaagagga

SEQ ID NO: 204797 - RNA, 32 nt, Human
ggugugggugcaauguggguguuuacacacau

SEQ ID NO: 204798 - RNA, 32 nt, Human
gguguggguggaagggcugggugucgaaauca

SEQ ID NO: 204799 - RNA, 20 nt, Human
gguguggguguccacgccca

SEQ ID NO: 204800 - RNA, 32 nt, Human
gguguggguguggguguaucugcugaguaagg

SEQ ID NO: 204801 - RNA, 32 nt, Human
gguguggguuacugggugcaggaugaacuguc

SEQ ID NO: 204802 - RNA, 32 nt, Human
gguguggguucgagaccuuccucugccaguuc

SEQ ID NO: 204803 - RNA, 22 nt, Human
ggugugguagcaggugccugua

SEQ ID NO: 204804 - RNA, 22 nt, Human
ggugugguagcgcacaccugua

SEQ ID NO: 204805 - RNA, 22 nt, Human
ggugugguaggaugcaccugua

SEQ ID NO: 204806 - RNA, 32 nt, Human
ggugugguagugcgugccugugaucccagcua

SEQ ID NO: 204807 - RNA, 32 nt, Human
gguguggucacucucaauucacuggcaaaugc

SEQ ID NO: 204808 - RNA, 32 nt, Human
gguguggucgaggcuccugaaagagaaagggc

SEQ ID NO: 204809 - RNA, 22 nt, Human
gguguggugacucaugccugua

SEQ ID NO: 204810 - RNA, 32 nt, Human
gguguggugcugcucccucaccuccaaaagag

SEQ ID NO: 204811 - RNA, 32 nt, Human
ggugugguggaagaggggaugagggaaagaaa

SEQ ID NO: 204812 - RNA, 19 nt, Human
ggugugguggacgccugug

SEQ ID NO: 204813 - RNA, 22 nt, Human
ggugugguggcacacaccagua

SEQ ID NO: 204814 - RNA, 22 nt, Human
ggugugguggcacaggccugua

SEQ ID NO: 204815 - RNA, 22 nt, Human
ggugugguggcacaugccugua

SEQ ID NO: 204816 - RNA, 22 nt, Human
ggugugguggcacgcaccagua

SEQ ID NO: 204817 - RNA, 22 nt, Human
ggugugguggcacgcaucugua

SEQ ID NO: 204818 - RNA, 22 nt, Human
ggugugguggcacgcgccugua

SEQ ID NO: 204819 - RNA, 22 nt, Human
ggugugguggcaggugcuugua

SEQ ID NO: 204820 - RNA, 22 nt, Human
ggugugguggcaugcgccugua

SEQ ID NO: 204821 - RNA, 22 nt, Human
ggugugguggcaugugccugug

SEQ ID NO: 204822 - RNA, 22 nt, Human
ggugugguggcccacgccugua

SEQ ID NO: 204823 - RNA, 22 nt, Human
ggugugguggcgcaagccugua

SEQ ID NO: 204824 - RNA, 22 nt, Human
ggugugguggcgcacaccugua

SEQ ID NO: 204825 - RNA, 22 nt, Human
ggugugguggcgcauaccugua

SEQ ID NO: 204826 - RNA, 22 nt, Human
ggugugguggcgcaugccugua

SEQ ID NO: 204827 - RNA, 22 nt, Human
ggugugguggcgcaugucugua

SEQ ID NO: 204828 - RNA, 22 nt, Human
ggugugguggcgggcgccugua

SEQ ID NO: 204829 - RNA, 22 nt, Human
ggugugguggcgggcgccugug

SEQ ID NO: 204830 - RNA, 22 nt, Human
ggugugguggcgugcgccugua

SEQ ID NO: 204831 - RNA, 22 nt, Human
ggugugguggcgugugccugug

SEQ ID NO: 204832 - RNA, 22 nt, Human
ggugugguggcucaagccugua

SEQ ID NO: 204833 - RNA, 22 nt, Human
ggugugguggcucacaccugua

SEQ ID NO: 204834 - RNA, 22 nt, Human
ggugugguggcucacaucugua

SEQ ID NO: 204835 - RNA, 22 nt, Human
ggugugguggcucacgcaugua

SEQ ID NO: 204836 - RNA, 22 nt, Human
ggugugguggcucacgccugua

SEQ ID NO: 204837 - RNA, 22 nt, Human
ggugugguggcucacgccugug

SEQ ID NO: 204838 - RNA, 24 nt, Human
ggugugguggcucacgcuuaugua

SEQ ID NO: 204839 - RNA, 22 nt, Human
ggugugguggcucacgucugua

SEQ ID NO: 204840 - RNA, 22 nt, Human
ggugugguggcucacuccugua

SEQ ID NO: 204841 - RNA, 22 nt, Human
ggugugguggcucaggccugua

SEQ ID NO: 204842 - RNA, 22 nt, Human
ggugugguggcucaugccugua

SEQ ID NO: 204843 - RNA, 22 nt, Human
ggugugguggcuccgaccugua

SEQ ID NO: 204844 - RNA, 22 nt, Human
ggugugguggcugacaucugua

SEQ ID NO: 204845 - RNA, 22 nt, Human
ggugugguggcuuaccccugua

SEQ ID NO: 204846 - RNA, 22 nt, Human
ggugugguggcuuacgccugua

SEQ ID NO: 204847 - RNA, 22 nt, Human
ggugugguggcuuaugccugua

SEQ ID NO: 204848 - RNA, 32 nt, Human
ggugugguggcuuuaaucccagcacuuuggga

SEQ ID NO: 204849 - RNA, 19 nt, Human
gguguggugggcaccugua

SEQ ID NO: 204850 - RNA, 32 nt, Human
ggugugguggggacccgggagugggucucacu

SEQ ID NO: 204851 - RNA, 22 nt, Human
ggugugguggggugcaccugua

SEQ ID NO: 204852 - RNA, 22 nt, Human
gguguggugguacacgccugua

SEQ ID NO: 204853 - RNA, 22 nt, Human
ggugugguggugcacaccugua

SEQ ID NO: 204854 - RNA, 22 nt, Human
ggugugguggugcaugccugua

SEQ ID NO: 204855 - RNA, 22 nt, Human
ggugugguggugcgcaccugug

SEQ ID NO: 204856 - RNA, 25 nt, Human
gguguggugguggcucacgccugua

SEQ ID NO: 204857 - RNA, 32 nt, Human
gguguggugguggcucacgccuguaaucccag

SEQ ID NO: 204858 - RNA, 22 nt, Human
ggugugguggugggcaccugua

SEQ ID NO: 204859 - RNA, 22 nt, Human
gguguggugguggguaccugua

SEQ ID NO: 204860 - RNA, 22 nt, Human
ggugugguggugugcaccugua

SEQ ID NO: 204861 - RNA, 22 nt, Human
gguguggugguucaugccugua

SEQ ID NO: 204862 - RNA, 32 nt, Human
ggugugguguccagcuguuaccagcuucugag

SEQ ID NO: 204863 - RNA, 32 nt, Human
ggugugguguccugccugucugccccagccca

SEQ ID NO: 204864 - RNA, 32 nt, Human
gguguguaccacugccucuggcuuuauuuugc

SEQ ID NO: 204865 - RNA, 20 nt, Human
gguguguagagaaaagcugc

SEQ ID NO: 204866 - RNA, 32 nt, Human
gguguguagugaucucagcucacugcaagcuc

SEQ ID NO: 204867 - RNA, 32 nt, Human
gguguguauguccaguccccagccaggcucug

SEQ ID NO: 204868 - RNA, 32 nt, Human
ggugugucacugcauccauugccaccuccugu

SEQ ID NO: 204869 - RNA, 32 nt, Human
ggugugucauuuccugcugcuuccagcuccau

SEQ ID NO: 204870 - RNA, 32 nt, Human
ggugugucauuuccuuuaauaggaccagggac

SEQ ID NO: 204871 - RNA, 32 nt, Human
gguguguccaaguccucccaaaggacagcagu

SEQ ID NO: 204872 - RNA, 32 nt, Human
ggugugucccaggagucggagaagcuggaaag

SEQ ID NO: 204873 - RNA, 32 nt, Human
ggugugucugugcugcccccuccagggcaggg

SEQ ID NO: 204874 - RNA, 32 nt, Human
ggugugucuguucucuccucugucccaggugc

SEQ ID NO: 204875 - RNA, 32 nt, Human
ggugugugaauuccuaccccgaacuggaagcc

SEQ ID NO: 204876 - RNA, 32 nt, Human
ggugugugacaucacaggccuggacauggcca

SEQ ID NO: 204877 - RNA, 32 nt, Human
ggugugugaccuggggaugguggagggucacc

SEQ ID NO: 204878 - RNA, 32 nt, Human
ggugugugacuauaaucccagcuacucgggag

SEQ ID NO: 204879 - RNA, 32 nt, Human
ggugugugacugcuguauguaucuuaucuuga

SEQ ID NO: 204880 - RNA, 32 nt, Human
ggugugugacuguaaucccagcuacucaggag

SEQ ID NO: 204881 - RNA, 32 nt, Human
ggugugugccuauaaucccagcuacucaggag

SEQ ID NO: 204882 - RNA, 32 nt, Human
ggugugugccuauaaucccagcuacuugggag

SEQ ID NO: 204883 - RNA, 32 nt, Human
ggugugugccuguaaucccagcuacucaggag

SEQ ID NO: 204884 - RNA, 32 nt, Human
ggugugugccuguaaucccagcuacucgggag

SEQ ID NO: 204885 - RNA, 32 nt, Human
ggugugugccuguaaucccggcuacuugggag

SEQ ID NO: 204886 - RNA, 32 nt, Human
ggugugugccuguaauccuagcuacucgggag

SEQ ID NO: 204887 - RNA, 32 nt, Human
ggugugugccuguaaugccagcuacucaggag

SEQ ID NO: 204888 - RNA, 32 nt, Human
ggugugugccuguaauuccagcuacucgggag

SEQ ID NO: 204889 - RNA, 32 nt, Human
ggugugugccuguagucccagcuacuauggag

SEQ ID NO: 204890 - RNA, 32 nt, Human
ggugugugccuguagucccagcuacuggcgag

SEQ ID NO: 204891 - RNA, 32 nt, Human
ggugugugccuguagucccagcuacuugugag

SEQ ID NO: 204892 - RNA, 32 nt, Human
ggugugugccuguaguccuagcugcuugggag

SEQ ID NO: 204893 - RNA, 32 nt, Human
ggugugugccuguagucucagcuacuugggag

SEQ ID NO: 204894 - RNA, 32 nt, Human
ggugugugccuguaguuccagcuacucaggag

SEQ ID NO: 204895 - RNA, 32 nt, Human
ggugugugccuguauuccuagcuacuuugaug

SEQ ID NO: 204896 - RNA, 32 nt, Human
ggugugugcuaccucacccagcuaauuucuaa

SEQ ID NO: 204897 - RNA, 32 nt, Human
ggugugugcucugucugucugucuuugucugu

SEQ ID NO: 204898 - RNA, 32 nt, Human
ggugugugcugcuaugacaucucuccagagcc

SEQ ID NO: 204899 - RNA, 32 nt, Human
ggugugugcuuguaaucccagcuacuugggag

SEQ ID NO: 204900 - RNA, 32 nt, Human
gguguguggagggucccugaugccgcuucccg

SEQ ID NO: 204901 - RNA, 32 nt, Human
gguguguggagguggcgggaggggucagugac

SEQ ID NO: 204902 - RNA, 21 nt, Human
gguguguggcaaguacuuuca

SEQ ID NO: 204903 - RNA, 32 nt, Human
gguguguggccaggcugcagagcugcgugccg

SEQ ID NO: 204904 - RNA, 32 nt, Human
gguguguggggucaggccagccacuuuccucc

SEQ ID NO: 204905 - RNA, 32 nt, Human
ggugugugucuguaaucccagcuacucggccu

SEQ ID NO: 204906 - RNA, 32 nt, Human
ggugugugucuguaaucccagcuacucgggag

SEQ ID NO: 204907 - RNA, 29 nt, Human
ggugugugucugugucuagggaaugcugg

SEQ ID NO: 204908 - RNA, 32 nt, Human
ggugugugucuuggugcauuggaaaaggaguc

SEQ ID NO: 204909 - RNA, 22 nt, Human
ggugugugugcauggggggcug

SEQ ID NO: 204910 - RNA, 32 nt, Human
ggugugugugccacccuuguccucuguccucu

SEQ ID NO: 204911 - RNA, 32 nt, Human
gguguguuacaggacccagcuggcccagcugc

SEQ ID NO: 204912 - RNA, 32 nt, Human
gguguguugcauuugagagaaggcaagaagaa

SEQ ID NO: 204913 - RNA, 32 nt, Human
gguguguugguaaacaguuuggaaaaguggcg

SEQ ID NO: 204914 - RNA, 32 nt, Human
gguguguuucagucaggaagcaucuaaauaug

SEQ ID NO: 204915 - RNA, 32 nt, Human
guaaucccagcacuuugggaggccaggaguuc

SEQ ID NO: 204916 - RNA, 32 nt, Human
guaaucccagcacuuugggaggcccagacugg

SEQ ID NO: 204917 - RNA, 32 nt, Human
guaaucccagcacuuugggaggccgugauggg

SEQ ID NO: 204918 - RNA, 32 nt, Human
guaaucccagcacuuugggaggccguggcggg

SEQ ID NO: 204919 - RNA, 32 nt, Human
guaaucccagcacuuugggaggccgugguggg

SEQ ID NO: 204920 - RNA, 32 nt, Human
guaaucccagcacuuugggaggcucagguggg

SEQ ID NO: 204921 - RNA, 32 nt, Human
guaaucccagcacuuugggaggcugaagcagg

SEQ ID NO: 204922 - RNA, 32 nt, Human
guaaucccagcacuuugggaggcugaaguggg

SEQ ID NO: 204923 - RNA, 32 nt, Human
guaaucccagcacuuugggaggcugagaaggg

SEQ ID NO: 204924 - RNA, 32 nt, Human
guaaucccagcacuuugggaggcugagacagg

SEQ ID NO: 204925 - RNA, 32 nt, Human
guaaucccagcacuuugggaggcugagacccg

SEQ ID NO: 204926 - RNA, 32 nt, Human
guaaucccagcacuuugggaggcugagacggg

SEQ ID NO: 204927 - RNA, 32 nt, Human
guaaucccagcacuuugggaggcugagauggg

SEQ ID NO: 204928 - RNA, 32 nt, Human
guaaucccagcacuuugggaggcugagaugug

SEQ ID NO: 204929 - RNA, 32 nt, Human
guaaucccagcacuuugggaggcugagcaagg

SEQ ID NO: 204930 - RNA, 32 nt, Human
guaaucccagcacuuugggaggcugagcugga

SEQ ID NO: 204931 - RNA, 32 nt, Human
guaaucccagcacuuugggaggcugaggaagg

SEQ ID NO: 204932 - RNA, 32 nt, Human
guaaucccagcacuuugggaggcugaggacag

SEQ ID NO: 204933 - RNA, 32 nt, Human
guaaucccagcacuuugggaggcugaggagag

SEQ ID NO: 204934 - RNA, 32 nt, Human
guaaucccagcacuuugggaggcugaggaggg

SEQ ID NO: 204935 - RNA, 29 nt, Human
guaaucccagcacuuugggaggcugaggc

SEQ ID NO: 204936 - RNA, 32 nt, Human
guaaucccagcacuuugggaggcugaggcaag

SEQ ID NO: 204937 - RNA, 32 nt, Human
guaaucccagcacuuugggaggcugaggcagg

SEQ ID NO: 204938 - RNA, 32 nt, Human
guaaucccagcacuuugggaggcugaggcugg

SEQ ID NO: 204939 - RNA, 32 nt, Human
guaaucccagcacuuugggaggcugagggggu

SEQ ID NO: 204940 - RNA, 32 nt, Human
guaaucccagcacuuugggaggcugagguagg

SEQ ID NO: 204941 - RNA, 32 nt, Human
guaaucccagcacuuugggaggcugaggugag

SEQ ID NO: 204942 - RNA, 32 nt, Human
guaaucccagcacuuugggaggcugaggugga

SEQ ID NO: 204943 - RNA, 32 nt, Human
guaaucccagcacuuugggaggcugagguggg

SEQ ID NO: 204944 - RNA, 32 nt, Human
guaaucccagcacuuugggaggcugcagcggg

SEQ ID NO: 204945 - RNA, 32 nt, Human
guaaucccagcacuuugggaggucaagguggg

SEQ ID NO: 204946 - RNA, 32 nt, Human
guaaucccagcacuuugggagucugaggugag

SEQ ID NO: 204947 - RNA, 32 nt, Human
guaaucccagcacuuugggagucugagguggg

SEQ ID NO: 204948 - RNA, 32 nt, Human
guaaucccagcacuuugggaugccauggcggg

SEQ ID NO: 204949 - RNA, 32 nt, Human
guaaucccagcacuuugggaugcugaagugag

SEQ ID NO: 204950 - RNA, 32 nt, Human
guaaucccagcacuuugggaugcugaggcggg

SEQ ID NO: 204951 - RNA, 32 nt, Human
guaaucccagcacuuugggauuacucccaggc

SEQ ID NO: 204952 - RNA, 32 nt, Human
guaaucccagcacuuugggauuacucccaguc

SEQ ID NO: 204953 - RNA, 32 nt, Human
guaaucccagcacuuugggauuacucccgggc

SEQ ID NO: 204954 - RNA, 32 nt, Human
guaaucccagcacuuuggggagcugaggcggg

SEQ ID NO: 204955 - RNA, 32 nt, Human
guaaucccagcacuuugggugggugaggcagg

SEQ ID NO: 204956 - RNA, 32 nt, Human
guaaucccagcacuuugugaggcugagguggg

SEQ ID NO: 204957 - RNA, 32 nt, Human
guaaucccagcacuuuguggggcugagggaga

SEQ ID NO: 204958 - RNA, 32 nt, Human
guaaucccagcacuuuugaggcugaggcgggc

SEQ ID NO: 204959 - RNA, 32 nt, Human
guaaucccagcacuuuugggaggcugagguug

SEQ ID NO: 204960 - RNA, 32 nt, Human
guaaucccagcauuugggaggcugaugugggu

SEQ ID NO: 204961 - RNA, 32 nt, Human
guaaucccagccaaggcuggcagaucacuuga

SEQ ID NO: 204962 - RNA, 19 nt, Human
guaaucccagcuacauggg

SEQ ID NO: 204963 - RNA, 19 nt, Human
guaaucccagcuacguggg

SEQ ID NO: 204964 - RNA, 32 nt, Human
guaaucccagcuacucggaggcugaggcacaa

SEQ ID NO: 204965 - RNA, 19 nt, Human
guaaucccagcuacucggg

SEQ ID NO: 204966 - RNA, 18 nt, Human
guaaucccagcuacuggg

SEQ ID NO: 204967 - RNA, 19 nt, Human
guaaucccagcuacuucgg

SEQ ID NO: 204968 - RNA, 19 nt, Human
guaaucccagcuacuuggg

SEQ ID NO: 204969 - RNA, 19 nt, Human
guaaucccagcuacuuugg

SEQ ID NO: 204970 - RNA, 19 nt, Human
guaaucccagcuccuuggg

SEQ ID NO: 204971 - RNA, 19 nt, Human
guaaucccagcugcuuggg

SEQ ID NO: 204972 - RNA, 32 nt, Human
guaaucccagcugcuugggaggcugaggcagg

SEQ ID NO: 204973 - RNA, 32 nt, Human
guaaucccagcugcuugggaggcugaggcagu

SEQ ID NO: 204974 - RNA, 32 nt, Human
guaaucccagcugcuugggaggcugagggcag

SEQ ID NO: 204975 - RNA, 32 nt, Human
guaaucccagcugcuugggaggcugagguagg

SEQ ID NO: 204976 - RNA, 19 nt, Human
guaaucccagcuucuuggg

SEQ ID NO: 204977 - RNA, 32 nt, Human
guaaucccagggugcugagauuacagguguga

SEQ ID NO: 204978 - RNA, 18 nt, Human
guaaucccaguacuuggg

SEQ ID NO: 204979 - RNA, 32 nt, Human
guaaucccagugcuuugggaggccaaggcagg

SEQ ID NO: 204980 - RNA, 19 nt, Human
guaaucccaguuacuuggg

SEQ ID NO: 204981 - RNA, 32 nt, Human
guaaucccaucaucuacucaggaggcugaggc

SEQ ID NO: 204982 - RNA, 32 nt, Human
guaaucccgccacugcacucuagccuggguga

SEQ ID NO: 204983 - RNA, 32 nt, Human
guaaucccgguauuugggaggcugaggcagaa

SEQ ID NO: 204984 - RNA, 19 nt, Human
guaaucccugcuacuuggg

SEQ ID NO: 204985 - RNA, 32 nt, Human
guaauccgagcuacucaggagcugaggcagaa

SEQ ID NO: 204986 - RNA, 32 nt, Human
guaauccucccaccccagccucccagguagcu

SEQ ID NO: 204987 - RNA, 32 nt, Human
guaauccugcaaucacuucugaccaggaguua

SEQ ID NO: 204988 - RNA, 31 nt, Human
guaauccugggguugguauguaggaggucua

SEQ ID NO: 204989 - RNA, 32 nt, Human
guaauccuuaccuguauacagugcagagccuu

SEQ ID NO: 204990 - RNA, 32 nt, Human
guaaucguuauguguguauauguaugugugua

SEQ ID NO: 204991 - RNA, 32 nt, Human
guaaucuaccccuucagaacacuggggaugaa

SEQ ID NO: 204992 - RNA, 32 nt, Human
guaaucucaaagaagcugcaaaguggauggau

SEQ ID NO: 204993 - RNA, 31 nt, Human
guaaucucaauaaauguggauugaaguuuuu

SEQ ID NO: 204994 - RNA, 32 nt, Human
guaaucucacuacacaggaggcugaggcagga

SEQ ID NO: 204995 - RNA, 19 nt, Human
guaaucucagcuacuuggg

SEQ ID NO: 204996 - RNA, 32 nt, Human
guaaucucagcuacuugggaggcugggcagaa

SEQ ID NO: 204997 - RNA, 32 nt, Human
guaaucuccauccaccauaggauagaguuaaa

SEQ ID NO: 204998 - RNA, 32 nt, Human
guaaucucuuucucuugcuuuuucuuucuuuc

SEQ ID NO: 204999 - RNA, 31 nt, Human
guaaucugacuucucacuuccuaaguucccu

SEQ ID NO: 205000 - RNA, 32 nt, Human
guaaucugauuugaauguuauaguugauaaua

SEQ ID NO: 205001 - RNA, 32 nt, Human
guaaucugcuuagagccacacagcuaugagua

SEQ ID NO: 205002 - RNA, 32 nt, Human
guaaucuuuacaagcauagcugccugcacucu

SEQ ID NO: 205003 - RNA, 32 nt, Human
guaaucuuuuaaccaguuuccuccuuaacagg

SEQ ID NO: 205004 - RNA, 32 nt, Human
guaaugaaacaaagaguucaagaaauaaguuu

SEQ ID NO: 205005 - RNA, 32 nt, Human
guaaugaagguaaacugagguaaugagagggg

SEQ ID NO: 205006 - RNA, 32 nt, Human
guaaugaccuggcugcucagccgggcccucac

SEQ ID NO: 205007 - RNA, 32 nt, Human
guaaugaggauguggagggcuggcucaaugcg

SEQ ID NO: 205008 - RNA, 32 nt, Human
guaaugaggugcagagguguggggaagaccug

SEQ ID NO: 205009 - RNA, 32 nt, Human
guaaugauacacagugaauucuuuuugacaaa

SEQ ID NO: 205010 - RNA, 32 nt, Human
guaaugaucacuuuggaagauuuccuuugcau

SEQ ID NO: 205011 - RNA, 32 nt, Human
guaaugaucugcaagucccggagagcaacagc

SEQ ID NO: 205012 - RNA, 32 nt, Human
guaaugaugaacacuuuacuauuugcuaacuu

SEQ ID NO: 205013 - RNA, 32 nt, Human
guaaugauggccucucucaaaagagaaaaaca

SEQ ID NO: 205014 - RNA, 32 nt, Human
guaaugauugaggauggggacugguuuguauc

SEQ ID NO: 205015 - RNA, 32 nt, Human
guaaugauuucuucuuuuccuauugaccagua

SEQ ID NO: 205016 - RNA, 32 nt, Human
guaaugcaaaauacuugaagcugcaguagcuu

SEQ ID NO: 205017 - RNA, 32 nt, Human
guaaugcagcucguuggguggcugaggcaggc

SEQ ID NO: 205018 - RNA, 32 nt, Human
guaaugcaggauuagaagaagcagagcucuag

SEQ ID NO: 205019 - RNA, 32 nt, Human
guaaugcagguguaggcaagagccagggcuag

SEQ ID NO: 205020 - RNA, 32 nt, Human
guaaugcagugcugugaccauagcccacugca

SEQ ID NO: 205021 - RNA, 21 nt, Human
guaaugcauaucauuagcccu

SEQ ID NO: 205022 - RNA, 32 nt, Human
guaaugccacucccacaaucucaggccuggua

SEQ ID NO: 205023 - RNA, 32 nt, Human
guaaugccuaucucuuggucuauuaaggaaag

SEQ ID NO: 205024 - RNA, 32 nt, Human
guaaugccucaguucauuuucaguuguuugau

SEQ ID NO: 205025 - RNA, 32 nt, Human
guaaugccuccugccugccucuuucaagaugg

SEQ ID NO: 205026 - RNA, 28 nt, Human
guaaugccuuggcugcucucagccccca

SEQ ID NO: 205027 - RNA, 32 nt, Human
guaaugcgcguccagauuucugaccucaugcu

SEQ ID NO: 205028 - RNA, 32 nt, Human
guaaugcuuauguauaaacauguauguaauau

SEQ ID NO: 205029 - RNA, 32 nt, Human
guaaugcuuucugguauacuucagaggcucca

SEQ ID NO: 205030 - RNA, 32 nt, Human
guaauggaaaacaaauucuuaugacuuugugg

SEQ ID NO: 205031 - RNA, 32 nt, Human
guaauggaaaaguguugccugccaccacccuc

SEQ ID NO: 205032 - RNA, 32 nt, Human
guaauggaagaagaggucagagagggagauuu

SEQ ID NO: 205033 - RNA, 32 nt, Human
guaauggagaaaggagcagucagcauucuucc

SEQ ID NO: 205034 - RNA, 32 nt, Human
guaauggagaagcaggcauagacagauucaga

SEQ ID NO: 205035 - RNA, 32 nt, Human
guaaugggauucacagcuucuggggauuagga

SEQ ID NO: 205036 - RNA, 32 nt, Human
guaaugguaaacacugguguguuuugaaguug

SEQ ID NO: 205037 - RNA, 32 nt, Human
guaauggugcuguucucgcucuucguggauua

SEQ ID NO: 205038 - RNA, 32 nt, Human
guaaugguggaggugugggcagaggagggagg

SEQ ID NO: 205039 - RNA, 32 nt, Human
guaaugguggccuggggcuucugaggcuucug

SEQ ID NO: 205040 - RNA, 32 nt, Human
guaaugguucuuuacacaucagucacaaguua

SEQ ID NO: 205041 - RNA, 32 nt, Human
guaaugguuggguuuaggaugaaccauuuuaa

SEQ ID NO: 205042 - RNA, 32 nt, Human
guaauguagggguugugagcacagacuuuggu

SEQ ID NO: 205043 - RNA, 32 nt, Human
guaauguaugucuacuggugggagacugugag

SEQ ID NO: 205044 - RNA, 32 nt, Human
guaauguauuguuauucagugcaaaauuauug

SEQ ID NO: 205045 - RNA, 32 nt, Human
guaaugugaucucacuguggcuuuuguuuuca

SEQ ID NO: 205046 - RNA, 32 nt, Human
guaauguugcaauaugaaccucccauugggcc

SEQ ID NO: 205047 - RNA, 32 nt, Human
guaauguuucuuaauucuccucuccuuucuua

SEQ ID NO: 205048 - RNA, 32 nt, Human
guaauuaacucauguacagccucauccuguau

SEQ ID NO: 205049 - RNA, 32 nt, Human
guaauuaaugauuuuauguuugguuacucuac

SEQ ID NO: 205050 - RNA, 32 nt, Human
guaauuaauugauccuugaugugauguucuuu

SEQ ID NO: 205051 - RNA, 32 nt, Human
guaauuacaguggaaugaguacuggacaagga

SEQ ID NO: 205052 - RNA, 32 nt, Human
guaauuaccauuuguugaacacauuaaugcua

SEQ ID NO: 205053 - RNA, 32 nt, Human
guaauuacuaaauuaugaggcuuugcuuuuug

SEQ ID NO: 205054 - RNA, 32 nt, Human
guaauuacuggccacaaaauaccaggugccag

SEQ ID NO: 205055 - RNA, 32 nt, Human
guaauuagaucuuuucuccaccugcaagaauc

SEQ ID NO: 205056 - RNA, 32 nt, Human
guaauuagcccggcuaauuuuguauuuuuagu

SEQ ID NO: 205057 - RNA, 32 nt, Human
guaauuauaauuuauaucaaaacguuugucaa

SEQ ID NO: 205058 - RNA, 32 nt, Human
guaauuauaguucuguuaccaagaauaaauaa

SEQ ID NO: 205059 - RNA, 32 nt, Human
guaauuaugagaggcugucauauaucaaagca

SEQ ID NO: 205060 - RNA, 32 nt, Human
guaauuaugauggcugagaaaugauucauuug

SEQ ID NO: 205061 - RNA, 32 nt, Human
guaauuauugauggcucugccugcuuaggacu

SEQ ID NO: 205062 - RNA, 32 nt, Human
guaauucaaaaauaggaaucuuuggcugcaaa

SEQ ID NO: 205063 - RNA, 32 nt, Human
guaauucagguuugaacccuuaggcuugugga

SEQ ID NO: 205064 - RNA, 32 nt, Human
guaauuccagcuacuuggaggcugaggcggga

SEQ ID NO: 205065 - RNA, 19 nt, Human
guaauuccagcuacuuggg

SEQ ID NO: 205066 - RNA, 32 nt, Human
guaauuccuguaaugucagauuuugauuuuac

SEQ ID NO: 205067 - RNA, 32 nt, Human
guaauuccuuccucucccuuguucccaaguag

SEQ ID NO: 205068 - RNA, 32 nt, Human
guaauucuauuaauagaaacagcuguguaaag

SEQ ID NO: 205069 - RNA, 32 nt, Human
guaauucugcugucucagccuccugcguagcu

SEQ ID NO: 205070 - RNA, 32 nt, Human
guaauucuucaccucuuuucucagcucccugc

SEQ ID NO: 205071 - RNA, 32 nt, Human
guaauucuuccucuucguucuucaccuggguu

SEQ ID NO: 205072 - RNA, 32 nt, Human
guaauucuucuccuuugucaaaugguauuuuu

SEQ ID NO: 205073 - RNA, 32 nt, Human
guaauugaggaaaaacugacagaugcuuuugc

SEQ ID NO: 205074 - RNA, 32 nt, Human
guaauugaguccauuuucaaguguggucaaga

SEQ ID NO: 205075 - RNA, 32 nt, Human
guaauugaucuuuccuuccuuccagagaaaga

SEQ ID NO: 205076 - RNA, 32 nt, Human
guaauugcaccacugcacuccagccuggguga

SEQ ID NO: 205077 - RNA, 32 nt, Human
guaauugcaucacugcacuccaaccugggcaa

SEQ ID NO: 205078 - RNA, 32 nt, Human
guaauugcauuugcuuuuguaauucuuaauga

SEQ ID NO: 205079 - RNA, 32 nt, Human
guaauuggagugaaagggcagagacccuggaa

SEQ ID NO: 205080 - RNA, 32 nt, Human
guaauuggcuaugaaguacuguggcagagcug

SEQ ID NO: 205081 - RNA, 32 nt, Human
guaauuggcugcgucuggcuaauucuaagcac

SEQ ID NO: 205082 - RNA, 32 nt, Human
guaauugggaaacuguucauuugaggauaaaa

SEQ ID NO: 205083 - RNA, 32 nt, Human
guaauugggagcacaaggggccucccaaaaag

SEQ ID NO: 205084 - RNA, 32 nt, Human
guaauuguaaccuuucaaaugaguuacgugaa

SEQ ID NO: 205085 - RNA, 32 nt, Human
guaauugucacuucuguugauuguacuccuga

SEQ ID NO: 205086 - RNA, 31 nt, Human
guaauugucauaucuuuacauguggauuaug

SEQ ID NO: 205087 - RNA, 32 nt, Human
guaauugucugagucugugcacguacuuuuag

SEQ ID NO: 205088 - RNA, 32 nt, Human
guaauugugaguaacucaccacuuuagcaggu

SEQ ID NO: 205089 - RNA, 31 nt, Human
guaauugugauuuaccugugccaaaggugcu

SEQ ID NO: 205090 - RNA, 32 nt, Human
guaauuguguuuugggggaaaguggggaauuu

SEQ ID NO: 205091 - RNA, 32 nt, Human
guaauuguugguuaucuuaaaacaucuguucu

SEQ ID NO: 205092 - RNA, 32 nt, Human
guaauuuaaaugguuccucuugaagcucaaau

SEQ ID NO: 205093 - RNA, 32 nt, Human
guaauuuaacaucaugauuaccaccuucgaag

SEQ ID NO: 205094 - RNA, 32 nt, Human
guaauuuaacuaaggcacaauggacuuguuua

SEQ ID NO: 205095 - RNA, 32 nt, Human
guaauuuacaaaccucucagcacuaauuagug

SEQ ID NO: 205096 - RNA, 32 nt, Human
guaauuuauagaacaaauauuugauaagcucc

SEQ ID NO: 205097 - RNA, 32 nt, Human
guaauuucacuuuagaagguuguauuaccuuc

SEQ ID NO: 205098 - RNA, 32 nt, Human
guaauuucauuccuuaacuuccuuuuccccac

SEQ ID NO: 205099 - RNA, 32 nt, Human
guaauuuccuuucuuuuuaaaccauaaauuag

SEQ ID NO: 205100 - RNA, 32 nt, Human
guaauuucugcacuucgcacuugagagaaggc

SEQ ID NO: 205101 - RNA, 32 nt, Human
guaauuucuuuggcaaccuuccuccucccuua

SEQ ID NO: 205102 - RNA, 32 nt, Human
guaauuugagaacuccuucaauuauauugacu

SEQ ID NO: 205103 - RNA, 32 nt, Human
guaauuugcauauaucuuuaauuauuucugug

SEQ ID NO: 205104 - RNA, 32 nt, Human
guaauuugcccagcugcuaacugugaagcaaa

SEQ ID NO: 205105 - RNA, 32 nt, Human
guaauuuggcaaagaucaaaaggcuaguauga

SEQ ID NO: 205106 - RNA, 32 nt, Human
guaauuuuaucuaaauuacagugcaguuuagu

SEQ ID NO: 205107 - RNA, 32 nt, Human
guaauuuuguguauucuuauuuacuuaacauu

SEQ ID NO: 205108 - RNA, 32 nt, Human
guacaaaaauuagcuggaugugguggugggcg

SEQ ID NO: 205109 - RNA, 32 nt, Human
guacaaaaauuagcugggcaugauggcacgca

SEQ ID NO: 205110 - RNA, 32 nt, Human
guacaaaaauuagcugggcgugguggcgcaca

SEQ ID NO: 205111 - RNA, 32 nt, Human
guacaaaaauuagcugggugugguggugcgug

SEQ ID NO: 205112 - RNA, 32 nt, Human
guacaaaaauuagcuggguguguuggcacaug

SEQ ID NO: 205113 - RNA, 32 nt, Human
guacaaaaauuagucagguaugguggcaugua

SEQ ID NO: 205114 - RNA, 32 nt, Human
guacaaaagacuucucucagaagauuaaacau

SEQ ID NO: 205115 - RNA, 30 nt, Human
guacaaaagcuucaaucagaaucacugugc

SEQ ID NO: 205116 - RNA, 32 nt, Human
guacaaaaggaaaaggagaaguuggaggugga

SEQ ID NO: 205117 - RNA, 32 nt, Human
guacaaaaguuagcuggucgugguggugcggg

SEQ ID NO: 205118 - RNA, 32 nt, Human
guacaaaaguuagucaggcaugguggcacaca

SEQ ID NO: 205119 - RNA, 32 nt, Human
guacaaaauaagauggccugggcagaguuggu

SEQ ID NO: 205120 - RNA, 32 nt, Human
guacaaaaucuguuccagggagcugcuuuugu

SEQ ID NO: 205121 - RNA, 32 nt, Human
guacaaaaugagucaggggaggccgugaagaa

SEQ ID NO: 205122 - RNA, 32 nt, Human
guacaaacacauucauguuucuuuuugucucc

SEQ ID NO: 205123 - RNA, 32 nt, Human
guacaaacagugcacacacaugaacauucauu

SEQ ID NO: 205124 - RNA, 32 nt, Human
guacaaaccagcugccucacuucuguuucaca

SEQ ID NO: 205125 - RNA, 32 nt, Human
guacaaacugaaaaagacaaaauaaguaaagc

SEQ ID NO: 205126 - RNA, 32 nt, Human
guacaaagugauaggaguagagcugugaauga

SEQ ID NO: 205127 - RNA, 32 nt, Human
guacaaauccuuguaaauaccccacacccucc

SEQ ID NO: 205128 - RNA, 32 nt, Human
guacaaaugcauuuuugguaacuuuccuccua

SEQ ID NO: 205129 - RNA, 32 nt, Human
guacaaauugucacucauuugaugacaccugg

SEQ ID NO: 205130 - RNA, 32 nt, Human
guacaacaauuagcagggcaugguggugcacg

SEQ ID NO: 205131 - RNA, 32 nt, Human
guacaacaucuuacgggaagagcauaguauuu

SEQ ID NO: 205132 - RNA, 32 nt, Human
guacaacaugcuacuuugcugaauacgguaga

SEQ ID NO: 205133 - RNA, 32 nt, Human
guacaaccaccaccaucuaguuccaaacauuu

SEQ ID NO: 205134 - RNA, 32 nt, Human
guacaacuaacgcaaccaagugugcuaaaaau

SEQ ID NO: 205135 - RNA, 32 nt, Human
guacaacuaacuauuugcauauaaugugauuu

SEQ ID NO: 205136 - RNA, 32 nt, Human
guacaacuccugugagggcuggagucuugggg

SEQ ID NO: 205137 - RNA, 32 nt, Human
guacaacugaggcugcagccagggccaauggg

SEQ ID NO: 205138 - RNA, 32 nt, Human
guacaagaaagaggcgguuucugcucuuaggg

SEQ ID NO: 205139 - RNA, 32 nt, Human
guacaagagaaaacggaagagagaggaaauga

SEQ ID NO: 205140 - RNA, 32 nt, Human
guacaagaguaguaucacauucacaggaugaa

SEQ ID NO: 205141 - RNA, 32 nt, Human
guacaagauauaauguaacuugcuguuuuagc

SEQ ID NO: 205142 - RNA, 32 nt, Human
guacaagauggaaaauccccuaccccucaaaa

SEQ ID NO: 205143 - RNA, 32 nt, Human
guacaagaugugggugauggaggggcuguuuc

SEQ ID NO: 205144 - RNA, 32 nt, Human
guacaagcaugcaccaacaguccuuaguuuug

SEQ ID NO: 205145 - RNA, 32 nt, Human
guacaagccaucaaggaggcaaaggagcagca

SEQ ID NO: 205146 - RNA, 32 nt, Human
guacaaggacaguuguguuacauggauauauu

SEQ ID NO: 205147 - RNA, 32 nt, Human
guacaagggcaaagacacuacagcugccugaa

SEQ ID NO: 205148 - RNA, 32 nt, Human
guacaagggcaggccagguaaggcuugggugu

SEQ ID NO: 205149 - RNA, 32 nt, Human
guacaaggggcccagugcuggccacacagcag

SEQ ID NO: 205150 - RNA, 32 nt, Human
guacaagguauuuacacauacaacuucauaua

SEQ ID NO: 205151 - RNA, 32 nt, Human
guacaagucaguaagccuuagggaaggugagu

SEQ ID NO: 205152 - RNA, 32 nt, Human
guacaaguccugggcaccuccucuuugccucc

SEQ ID NO: 205153 - RNA, 32 nt, Human
guacaagugcugucccgccccacugguggcuc

SEQ ID NO: 205154 - RNA, 32 nt, Human
guacaauauaaccucucaucucaggcuauuuu

SEQ ID NO: 205155 - RNA, 32 nt, Human
guacaauauuagagaaaggacaggcuuuuuau

SEQ ID NO: 205156 - RNA, 32 nt, Human
guacaaucacauaauuuugaaaauccauguag

SEQ ID NO: 205157 - RNA, 32 nt, Human
guacaaucuggagcccacagcugucggucaga

SEQ ID NO: 205158 - RNA, 32 nt, Human
guacaaugcaugcaucacagacuguauuugau

SEQ ID NO: 205159 - RNA, 32 nt, Human
guacaauggcacaaacacugcucacugcagcc

SEQ ID NO: 205160 - RNA, 32 nt, Human
guacaauggcgugaucucagcucacucugcaa

SEQ ID NO: 205161 - RNA, 32 nt, Human
guacaauuauacauuaauggcuguaaugugaa

SEQ ID NO: 205162 - RNA, 32 nt, Human
guacaauuucaauaaauaucuggacuuacugg

SEQ ID NO: 205163 - RNA, 32 nt, Human
guacacacaagaaggugggcugggcacuugga

SEQ ID NO: 205164 - RNA, 32 nt, Human
guacacacagaggcacaugugcacgcacacac

SEQ ID NO: 205165 - RNA, 22 nt, Human
guacacaccaccacgcccagcu

SEQ ID NO: 205166 - RNA, 32 nt, Human
guacacaccaugcccacauacaacauaccuau

SEQ ID NO: 205167 - RNA, 21 nt, Human
guacacaccugggccccaacu

SEQ ID NO: 205168 - RNA, 21 nt, Human
guacacaccuguaaucccagc

SEQ ID NO: 205169 - RNA, 22 nt, Human
guacacaccuguaaucccagcu

SEQ ID NO: 205170 - RNA, 21 nt, Human
guacacaccuguagucccagc

SEQ ID NO: 205171 - RNA, 22 nt, Human
guacacaccuguagucccagcu

SEQ ID NO: 205172 - RNA, 22 nt, Human
guacacaccuguggucccagcu

SEQ ID NO: 205173 - RNA, 32 nt, Human
guacacagaaucagaaaagauuauaaaagaaa

SEQ ID NO: 205174 - RNA, 32 nt, Human
guacacagauucacaacucauucagaacugua

SEQ ID NO: 205175 - RNA, 32 nt, Human
guacacagggcugcgcugucucuggcugcaga

SEQ ID NO: 205176 - RNA, 32 nt, Human
guacacaguagcagcugucaacagggccuacu

SEQ ID NO: 205177 - RNA, 32 nt, Human
guacacagugccuugcccauaauagguacuca

SEQ ID NO: 205178 - RNA, 32 nt, Human
guacacaucggucugauuauuuuguuuguuuu

SEQ ID NO: 205179 - RNA, 32 nt, Human
guacacaucuguccuauaucaaccuuaccacu

SEQ ID NO: 205180 - RNA, 31 nt, Human
guacacaugaacaaggccaguccuccauuuc

SEQ ID NO: 205181 - RNA, 32 nt, Human
guacacaugccuccuagaaacuacacuauggg

SEQ ID NO: 205182 - RNA, 32 nt, Human
guacacauuuccuaucuuccuccagcuuccag

SEQ ID NO: 205183 - RNA, 32 nt, Human
guacaccacuacacuccagccugggcaacaga

SEQ ID NO: 205184 - RNA, 32 nt, Human
guacaccauggaaaccccaucccugcuccuaa

SEQ ID NO: 205185 - RNA, 32 nt, Human
guacaccauggugguucaggcugcaguggcuc

SEQ ID NO: 205186 - RNA, 32 nt, Human
guacacccacccaaguacugaggugugacgcg

SEQ ID NO: 205187 - RNA, 32 nt, Human
guacacccaccugccucucuggcuccagaagc

SEQ ID NO: 205188 - RNA, 32 nt, Human
guacaccugaggcugcucacgucucacgccca

SEQ ID NO: 205189 - RNA, 24 nt, Human
guacaccugcaccauccagagaga

SEQ ID NO: 205190 - RNA, 32 nt, Human
guacaccugcugggaccacugaucucagaguu

SEQ ID NO: 205191 - RNA, 32 nt, Human
guacaccuguaauuccagcuacuugggaggcu

SEQ ID NO: 205192 - RNA, 32 nt, Human
guacaccuguagucucagcuacuuaggaggcu

SEQ ID NO: 205193 - RNA, 32 nt, Human
guacaccuguggucccagcuacucuggaggcu

SEQ ID NO: 205194 - RNA, 32 nt, Human
guacaccuguggucccagcuauuugggaggcu

SEQ ID NO: 205195 - RNA, 32 nt, Human
guacaccuuccagauggcacagcacuuuccca

SEQ ID NO: 205196 - RNA, 22 nt, Human
guacaccuuccucuccagaaga

SEQ ID NO: 205197 - RNA, 32 nt, Human
guacaccuugaauuaaguucuuaaacacaucu

SEQ ID NO: 205198 - RNA, 22 nt, Human
guacacgccuauaaucccagcu

SEQ ID NO: 205199 - RNA, 22 nt, Human
guacacgccuguaaucccagcu

SEQ ID NO: 205200 - RNA, 22 nt, Human
guacacgccuguaguccuagcu

SEQ ID NO: 205201 - RNA, 32 nt, Human
guacacgcuggaugccucucuccauccacccc

SEQ ID NO: 205202 - RNA, 32 nt, Human
guacacggauucaagacucaccaacgggcggg

SEQ ID NO: 205203 - RNA, 32 nt, Human
guacacgucugucaucccagcagcucuuaagg

SEQ ID NO: 205204 - RNA, 32 nt, Human
guacacucacugcgcccuuucugcugcuuggu

SEQ ID NO: 205205 - RNA, 32 nt, Human
guacacuccagccugggcaacaaugcgagauu

SEQ ID NO: 205206 - RNA, 32 nt, Human
guacacuccguaacuuccgaaaccuuauuucg

SEQ ID NO: 205207 - RNA, 32 nt, Human
guacacucucgcugugcugucauucuauauga

SEQ ID NO: 205208 - RNA, 32 nt, Human
guacacugaagccacaggcugguggccauguu

SEQ ID NO: 205209 - RNA, 32 nt, Human
guacacugaagccccugcuccacagaguagau

SEQ ID NO: 205210 - RNA, 32 nt, Human
guacacugacuuuggggccuggguguuggggu

SEQ ID NO: 205211 - RNA, 32 nt, Human
guacacugagggggcccaggccaggcuuugua

SEQ ID NO: 205212 - RNA, 29 nt, Human
guacacuggcugcugccuauccugucccu

SEQ ID NO: 205213 - RNA, 32 nt, Human
guacacuuuuccacuuucaaaaccuauuuuaa

SEQ ID NO: 205214 - RNA, 32 nt, Human
guacagaaaugguucuccguguggugggagga

SEQ ID NO: 205215 - RNA, 32 nt, Human
guacagaaauuagcugggugugauggcacaca

SEQ ID NO: 205216 - RNA, 32 nt, Human
guacagaacagcuccugagccagguggacaug

SEQ ID NO: 205217 - RNA, 32 nt, Human
guacagaagaaacccaguuccaaaaagguccc

SEQ ID NO: 205218 - RNA, 32 nt, Human
guacagaagucagaacuuuggguugggaauga

SEQ ID NO: 205219 - RNA, 32 nt, Human
guacagaauaggaacuucagaggcuuuguuua

SEQ ID NO: 205220 - RNA, 32 nt, Human
guacagaauuuuaucuacaguacugugagaca

SEQ ID NO: 205221 - RNA, 32 nt, Human
guacagacacuucacuuagccuagggggccuu

SEQ ID NO: 205222 - RNA, 32 nt, Human
guacagacauaguggcuugcagacccugaccc

SEQ ID NO: 205223 - RNA, 32 nt, Human
guacagacaugugcucuggggaauucugagga

SEQ ID NO: 205224 - RNA, 32 nt, Human
guacagacauuauuuccacucugguggauaag

SEQ ID NO: 205225 - RNA, 32 nt, Human
guacagacgggauguggccaggagaacagagc

SEQ ID NO: 205226 - RNA, 32 nt, Human
guacagacguaugcuuauuuuaaaauuuuauc

SEQ ID NO: 205227 - RNA, 32 nt, Human
guacagagaccagcucagucgucagagaaacc

SEQ ID NO: 205228 - RNA, 32 nt, Human
guacagagagcaucaaaaucaggucagaaaaa

SEQ ID NO: 205229 - RNA, 32 nt, Human
guacagagaugaacagaaaacuuuuucuuuau

SEQ ID NO: 205230 - RNA, 20 nt, Human
guacagagauuacuuggaga

SEQ ID NO: 205231 - RNA, 32 nt, Human
guacagagccagcaccaccaucugaugcccag

SEQ ID NO: 205232 - RNA, 31 nt, Human
guacagaggaaacucaagccuuaaauguuua

SEQ ID NO: 205233 - RNA, 32 nt, Human
guacagagggcaccugaacacggggcucucag

SEQ ID NO: 205234 - RNA, 32 nt, Human
guacagagucacaaccugagucuuuaguggaa

SEQ ID NO: 205235 - RNA, 32 nt, Human
guacagaugaaugugugugguaagaucuuuag

SEQ ID NO: 205236 - RNA, 31 nt, Human
guacagaugggcauaggugcagugagugcag

SEQ ID NO: 205237 - RNA, 17 nt, Human
guacagauugaugugaa

SEQ ID NO: 205238 - RNA, 32 nt, Human
guacagauuuccaguggauauuucaagcacag

SEQ ID NO: 205239 - RNA, 32 nt, Human
guacagcaauacaccauccagaagaacuugau

SEQ ID NO: 205240 - RNA, 32 nt, Human
guacagcaaugccaucauagcucacugaagcc

SEQ ID NO: 205241 - RNA, 20 nt, Human
guacagcaauuuaucuguuu

SEQ ID NO: 205242 - RNA, 32 nt, Human
guacagcacaguggcuuauaaggaaccagcag

SEQ ID NO: 205243 - RNA, 19 nt, Human
guacagcacccugccaguu

SEQ ID NO: 205244 - RNA, 32 nt, Human
guacagccaacagaggcccacaaggaccaggg

SEQ ID NO: 205245 - RNA, 32 nt, Human
guacagcccucggccuacaagcucuuuagucu

SEQ ID NO: 205246 - RNA, 32 nt, Human
guacagccugaacuuccacaacugcaacaauu

SEQ ID NO: 205247 - RNA, 32 nt, Human
guacagcuauccagagagacugggcuucaagg

SEQ ID NO: 205248 - RNA, 32 nt, Human
guacagcucccaggaacagcuaggugggaaag

SEQ ID NO: 205249 - RNA, 32 nt, Human
guacagcucccaggcucccgaagcuucccaca

SEQ ID NO: 205250 - RNA, 32 nt, Human
guacagcugcaaccgcgaccaugggcgggaag

SEQ ID NO: 205251 - RNA, 32 nt, Human
guacagcugcuccucccuuucauaaagcagcg

SEQ ID NO: 205252 - RNA, 32 nt, Human
guacagcugcugucccugcccuguccuguccu

SEQ ID NO: 205253 - RNA, 32 nt, Human
guacagcuuccuccucugacccuuuggcucuu

SEQ ID NO: 205254 - RNA, 32 nt, Human
guacagcuucuucuccucacccaguuuggcca

SEQ ID NO: 205255 - RNA, 32 nt, Human
guacaggacaaggugucaggugacuccuuccc

SEQ ID NO: 205256 - RNA, 19 nt, Human
guacaggacacagcucucu

SEQ ID NO: 205257 - RNA, 32 nt, Human
guacaggagagggcaggggcuccaggcccagc

SEQ ID NO: 205258 - RNA, 32 nt, Human
guacaggaggcaaauguuaucacuacacaugg

SEQ ID NO: 205259 - RNA, 32 nt, Human
guacaggaggcugaggugggaggaucacuuca

SEQ ID NO: 205260 - RNA, 32 nt, Human
guacaggauaaugccucaucccaaucagaugu

SEQ ID NO: 205261 - RNA, 32 nt, Human
guacaggcaacaggagaaaggaaucaaaccac

SEQ ID NO: 205262 - RNA, 32 nt, Human
guacaggcaauggcagaaggagaugcucaggg

SEQ ID NO: 205263 - RNA, 32 nt, Human
guacaggcacacaccaccacacccagcuaauu

SEQ ID NO: 205264 - RNA, 32 nt, Human
guacaggcaccugccaccacacccagcuaauu

SEQ ID NO: 205265 - RNA, 32 nt, Human
guacaggcacugucuucagcccgaguuccagg

SEQ ID NO: 205266 - RNA, 32 nt, Human
guacaggccugugugccacaccccagccuaac

SEQ ID NO: 205267 - RNA, 32 nt, Human
guacaggcugagacacagcccagagacugaac

SEQ ID NO: 205268 - RNA, 32 nt, Human
guacagggaagagacugagugucauggacuca

SEQ ID NO: 205269 - RNA, 32 nt, Human
guacagggaccuuggcagguggagaggaggau

SEQ ID NO: 205270 - RNA, 32 nt, Human
guacagggcucucaagccugagguuuucuucu

SEQ ID NO: 205271 - RNA, 32 nt, Human
guacaggggaagaguccucuugugcuugcuaa

SEQ ID NO: 205272 - RNA, 32 nt, Human
guacaggggcuggggucagggaaggaagaucu

SEQ ID NO: 205273 - RNA, 32 nt, Human
guacaggguguuuuguggcacaggauuaugua

SEQ ID NO: 205274 - RNA, 32 nt, Human
guacaggucaacaaaugaugacacagugaaca

SEQ ID NO: 205275 - RNA, 32 nt, Human
guacaggugggcauaggugcagugagugcagg

SEQ ID NO: 205276 - RNA, 32 nt, Human
guacagguuaacaucagcauuuucauuuugua

SEQ ID NO: 205277 - RNA, 32 nt, Human
guacagucacauagcaaggaugguuaaagccc

SEQ ID NO: 205278 - RNA, 32 nt, Human
guacagucagaaugguuucccuuguccuagaa

SEQ ID NO: 205279 - RNA, 31 nt, Human
guacagugaaugagagaaaucugccuggaaa

SEQ ID NO: 205280 - RNA, 32 nt, Human
guacagugaguugggagccguuaggcugaaug

SEQ ID NO: 205281 - RNA, 18 nt, Human
guacagugcugacaucug

SEQ ID NO: 205282 - RNA, 32 nt, Human
guacagugcuuuucuguauuaacugguucuua

SEQ ID NO: 205283 - RNA, 32 nt, Human
guacaguggcaacugaaaugcauuucagaaau

SEQ ID NO: 205284 - RNA, 32 nt, Human
guacaguggcacaaucacagcucauugcagcc

SEQ ID NO: 205285 - RNA, 24 nt, Human
guacaguggcgcacaccuguaauc

SEQ ID NO: 205286 - RNA, 24 nt, Human
guacaguggcucacaccuguaauc

SEQ ID NO: 205287 - RNA, 24 nt, Human
guacaguggcucacgccuguaauc

SEQ ID NO: 205288 - RNA, 24 nt, Human
guacaguggcucaugccuguaauc

SEQ ID NO: 205289 - RNA, 31 nt, Human
guacaguggguggaaagggcauuuggagcuc

SEQ ID NO: 205290 - RNA, 32 nt, Human
guacagugguauacccucagugccccaacagg

SEQ ID NO: 205291 - RNA, 32 nt, Human
guacagugguauagucugcauaugauuccuuc

SEQ ID NO: 205292 - RNA, 24 nt, Human
guacagugguucaugccuguaauc

SEQ ID NO: 205293 - RNA, 32 nt, Human
guacaguguguauguguguauguguguaugug

SEQ ID NO: 205294 - RNA, 32 nt, Human
guacaguuaaguuccuccuauuugccacuggg

SEQ ID NO: 205295 - RNA, 22 nt, Human
guacaguuauacauaccucucu

SEQ ID NO: 205296 - RNA, 32 nt, Human
guacaguucuguauuuguaaauucugucuuuc

SEQ ID NO: 205297 - RNA, 32 nt, Human
guacaguuguguagacgucuuccaaauaaauu

SEQ ID NO: 205298 - RNA, 32 nt, Human
guacauaaaaaccacacacaugcaugcacaca

SEQ ID NO: 205299 - RNA, 32 nt, Human
guacauaaaaugacgucugcuuuauaagcauu

SEQ ID NO: 205300 - RNA, 32 nt, Human
guacauaacuaccacaccaaccaccuccacuu

SEQ ID NO: 205301 - RNA, 32 nt, Human
guacauaacuauacaguaguguccagaauguu

SEQ ID NO: 205302 - RNA, 32 nt, Human
guacauaaucuagauuuuguuuucauaguuuu

SEQ ID NO: 205303 - RNA, 32 nt, Human
guacauaauguucccauuucuaugaacagcuc

SEQ ID NO: 205304 - RNA, 32 nt, Human
guacauacacauaugcagacacaugccagggc

SEQ ID NO: 205305 - RNA, 32 nt, Human
guacauacaguacucuuuuauuuuucuuuuaa

SEQ ID NO: 205306 - RNA, 32 nt, Human
guacauacaugcacauacucaaacaugcguac

SEQ ID NO: 205307 - RNA, 22 nt, Human
guacauacucaugcacaugacu

SEQ ID NO: 205308 - RNA, 32 nt, Human
guacauacuugccuuaacccaccuacauugug

SEQ ID NO: 205309 - RNA, 32 nt, Human
guacauauaguuaauaaugacacuguucauca

SEQ ID NO: 205310 - RNA, 32 nt, Human
guacauaugugcuggaauucuaacaagucaua

SEQ ID NO: 205311 - RNA, 32 nt, Human
guacaucacaucacggccugacagaguggccu

SEQ ID NO: 205312 - RNA, 32 nt, Human
guacaucacggcuucucucccacguuaagacu

SEQ ID NO: 205313 - RNA, 32 nt, Human
guacaucagccugucuuagccugagcugcuuu

SEQ ID NO: 205314 - RNA, 32 nt, Human
guacauccugcucuggcccagcuccccauagc

SEQ ID NO: 205315 - RNA, 32 nt, Human
guacaucucaguggcuggaggccaugccuuuu

SEQ ID NO: 205316 - RNA, 32 nt, Human
guacaucugccguggguucaagcgauucuccu

SEQ ID NO: 205317 - RNA, 32 nt, Human
guacaucuggggaccuagcaguuaggcuugac

SEQ ID NO: 205318 - RNA, 23 nt, Human
guacaucuuuuguaucuaugaua

SEQ ID NO: 205319 - RNA, 32 nt, Human
guacaugacccuuucuccuucaugccaggcuc

SEQ ID NO: 205320 - RNA, 32 nt, Human
guacaugacucagcaacauugacagggagcua

SEQ ID NO: 205321 - RNA, 32 nt, Human
guacaugagauggggagguugagggacaggau

SEQ ID NO: 205322 - RNA, 32 nt, Human
guacaugaggggcgcagagaugagcacacagc

SEQ ID NO: 205323 - RNA, 25 nt, Human
guacaugaguuagguucacuuucau

SEQ ID NO: 205324 - RNA, 32 nt, Human
guacaugauccacagcccugcggagccagguc

SEQ ID NO: 205325 - RNA, 32 nt, Human
guacaugccaucaucuccucacaacugcacca

SEQ ID NO: 205326 - RNA, 22 nt, Human
guacaugccuauagucccagcu

SEQ ID NO: 205327 - RNA, 22 nt, Human
guacaugccuguaaucccagcu

SEQ ID NO: 205328 - RNA, 32 nt, Human
guacaugccuguaaucccagcuacuugggagg

SEQ ID NO: 205329 - RNA, 32 nt, Human
guacaugccuguagcccuagcuacucuggagg

SEQ ID NO: 205330 - RNA, 32 nt, Human
guacaugccuguagucccagauacucgggagg

SEQ ID NO: 205331 - RNA, 32 nt, Human
guacaugcgccccacccccaugagccaguuca

SEQ ID NO: 205332 - RNA, 30 nt, Human
guacaugcuacaauaaaugcagcuggcagc

SEQ ID NO: 205333 - RNA, 32 nt, Human
guacaugcucugccuguggagacauggcuuuu

SEQ ID NO: 205334 - RNA, 20 nt, Human
guacauggaaacugugggac

SEQ ID NO: 205335 - RNA, 32 nt, Human
guacauggagaaaacgaggcuccuuccaguug

SEQ ID NO: 205336 - RNA, 32 nt, Human
guacauggagccucugcuguagcuguguguuc

SEQ ID NO: 205337 - RNA, 32 nt, Human
guacauggcaguguuuuaguuggcaauauaau

SEQ ID NO: 205338 - RNA, 32 nt, Human
guacaugggaggcaugugugugauguguacac

SEQ ID NO: 205339 - RNA, 32 nt, Human
guacaugggcaccaugcccuccuccucgugcu

SEQ ID NO: 205340 - RNA, 32 nt, Human
guacaugggcagcaggagugguaggaagagca

SEQ ID NO: 205341 - RNA, 21 nt, Human
guacauggggaccccagaaga

SEQ ID NO: 205342 - RNA, 32 nt, Human
guacauggugugaacucacucucagcugccaa

SEQ ID NO: 205343 - RNA, 32 nt, Human
guacauguaccaccucccuuuccucuuacugu

SEQ ID NO: 205344 - RNA, 19 nt, Human
guacaugugcacaaagcag

SEQ ID NO: 205345 - RNA, 24 nt, Human
guacaugugcacaacgugcagguu

SEQ ID NO: 205346 - RNA, 21 nt, Human
guacaugugcacaaugugcag

SEQ ID NO: 205347 - RNA, 24 nt, Human
guacaugugcacaaugugcagguu

SEQ ID NO: 205348 - RNA, 24 nt, Human
guacaugugcacauugugcagguu

SEQ ID NO: 205349 - RNA, 32 nt, Human
guacauuaaaaauucaauuaagagaagaguca

SEQ ID NO: 205350 - RNA, 32 nt, Human
guacauuaacauccccuuuucauuaccccauu

SEQ ID NO: 205351 - RNA, 32 nt, Human
guacauucaaugcauggaucaaucagugugau

SEQ ID NO: 205352 - RNA, 32 nt, Human
guacauucauuucuaaaauucacucaugcacc

SEQ ID NO: 205353 - RNA, 32 nt, Human
guacauuccaaaaacucuaaacuuuuuaaaga

SEQ ID NO: 205354 - RNA, 32 nt, Human
guacauucuagcuaccugcucucuccacuucu

SEQ ID NO: 205355 - RNA, 32 nt, Human
guacauucugcagugagaaacagugccccagc

SEQ ID NO: 205356 - RNA, 32 nt, Human
guacauucuucccauucuguauucuuguacaa

SEQ ID NO: 205357 - RNA, 32 nt, Human
guacauugaauggauuucagggacaguauguu

SEQ ID NO: 205358 - RNA, 32 nt, Human
guacauugcugggcuuccuaggcagaaauuca

SEQ ID NO: 205359 - RNA, 32 nt, Human
guacauuggccugccauaaagcauuuucaauu

SEQ ID NO: 205360 - RNA, 32 nt, Human
guacauuguguaaugaaugaaaagcacauaaa

SEQ ID NO: 205361 - RNA, 32 nt, Human
guacauuguugggcaggagugugugcaaacac

SEQ ID NO: 205362 - RNA, 32 nt, Human
guacauuuacaaaaauuaaccugacuuauuuu

SEQ ID NO: 205363 - RNA, 32 nt, Human
guacauuuuauagguaucaaagcaauggcuuu

SEQ ID NO: 205364 - RNA, 32 nt, Human
guacauuuugacugagcacuuagggcaucagg

SEQ ID NO: 205365 - RNA, 32 nt, Human
guacauuuuggucuucucugugguuuuauacu

SEQ ID NO: 205366 - RNA, 32 nt, Human
guaccaaaaauacaaaaaguuagcugggcaug

SEQ ID NO: 205367 - RNA, 32 nt, Human
guaccaaaacuugccaaauuccuccauggcca

SEQ ID NO: 205368 - RNA, 32 nt, Human
guaccaaaaugauuucuuugguaauuguguga

SEQ ID NO: 205369 - RNA, 32 nt, Human
guaccaaacugauuucaaaaguacuacauuga

SEQ ID NO: 205370 - RNA, 32 nt, Human
guaccaaagaggaguauggugggagagggagu

SEQ ID NO: 205371 - RNA, 32 nt, Human
guaccaaaggcaugguaccucagucugguauc

SEQ ID NO: 205372 - RNA, 32 nt, Human
guaccaacucaccucuauuuugucaguucaua

SEQ ID NO: 205373 - RNA, 32 nt, Human
guaccaagaccagcucagucagggagacccua

SEQ ID NO: 205374 - RNA, 32 nt, Human
guaccaaggagcugagggcugaggaagucuuu

SEQ ID NO: 205375 - RNA, 32 nt, Human
guaccaaguauuuccugcauuguugcuaaaau

SEQ ID NO: 205376 - RNA, 32 nt, Human
guaccaagugcuggugccagccuguuaccugu

SEQ ID NO: 205377 - RNA, 32 nt, Human
guaccacauauacuuucucuccuucuaucucc

SEQ ID NO: 205378 - RNA, 32 nt, Human
guaccacauucauuguuaaggaauggcugaug

SEQ ID NO: 205379 - RNA, 32 nt, Human
guaccaccagccaucugugguccuccauuugu

SEQ ID NO: 205380 - RNA, 32 nt, Human
guaccacccugccugccuccccaacaccgugg

SEQ ID NO: 205381 - RNA, 32 nt, Human
guaccaccucguaggguuguagaaagaccaag

SEQ ID NO: 205382 - RNA, 32 nt, Human
guaccacgucugcuggucuccagccuuguaug

SEQ ID NO: 205383 - RNA, 32 nt, Human
guaccacuacacuccagccugggcaacggagc

SEQ ID NO: 205384 - RNA, 32 nt, Human
guaccacucccagcacucacacauuccccaga

SEQ ID NO: 205385 - RNA, 32 nt, Human
guaccacugauggcccugcuuccucugaguga

SEQ ID NO: 205386 - RNA, 32 nt, Human
guaccacugcacuccaaccuggguuacagcau

SEQ ID NO: 205387 - RNA, 32 nt, Human
guaccacugcacuccagccuaggugacagggc

SEQ ID NO: 205388 - RNA, 32 nt, Human
guaccacugcacuccagccuggaugacagagu

SEQ ID NO: 205389 - RNA, 32 nt, Human
guaccacugcacuccagccuggcugacaguga

SEQ ID NO: 205390 - RNA, 32 nt, Human
guaccacugcacuccagccugggcaacagagc

SEQ ID NO: 205391 - RNA, 32 nt, Human
guaccacugcacuccagccugggcaacagagu

SEQ ID NO: 205392 - RNA, 32 nt, Human
guaccacugcacuccagccugggcgacagagc

SEQ ID NO: 205393 - RNA, 32 nt, Human
guaccacugcacuccagccugggcuacagauc

SEQ ID NO: 205394 - RNA, 32 nt, Human
guaccacugcacuccagccugggugacagagc

SEQ ID NO: 205395 - RNA, 32 nt, Human
guaccacugcacuccagccugggugacagagu

SEQ ID NO: 205396 - RNA, 32 nt, Human
guaccacugcacuccagccuggucaauggagu

SEQ ID NO: 205397 - RNA, 32 nt, Human
guaccacugcacuccagcucggggaacagagc

SEQ ID NO: 205398 - RNA, 32 nt, Human
guaccacugcacuccagucugggcaacagacg

SEQ ID NO: 205399 - RNA, 32 nt, Human
guaccacugcacuccagucugggcgacagagu

SEQ ID NO: 205400 - RNA, 32 nt, Human
guaccacugcacuccaguuuggcaacagagug

SEQ ID NO: 205401 - RNA, 32 nt, Human
guaccacugcacucuggccugggcaacaagag

SEQ ID NO: 205402 - RNA, 32 nt, Human
guaccacugccuucccuucuagcccaggagaa

SEQ ID NO: 205403 - RNA, 32 nt, Human
guaccacuguacuccagccugggcuggacagu

SEQ ID NO: 205404 - RNA, 32 nt, Human
guaccacuguauuccagccuggacgacugagu

SEQ ID NO: 205405 - RNA, 32 nt, Human
guaccagcaacagcucagcagagcuaugcgga

SEQ ID NO: 205406 - RNA, 32 nt, Human
guaccagcacuagcuggucaagggcaugacag

SEQ ID NO: 205407 - RNA, 32 nt, Human
guaccagcaggggaaaugccagaugcuuauaa

SEQ ID NO: 205408 - RNA, 32 nt, Human
guaccagcaguuuguauuugagcuucacaguu

SEQ ID NO: 205409 - RNA, 32 nt, Human
guaccagcccaccaccaccacagcaacccaga

SEQ ID NO: 205410 - RNA, 32 nt, Human
guaccagcggaaagcuggucucgucuccaacu

SEQ ID NO: 205411 - RNA, 32 nt, Human
guaccaggacagcagaaagacaucccggguag

SEQ ID NO: 205412 - RNA, 32 nt, Human
guaccaggaugccaccgcagaagaggaggagg

SEQ ID NO: 205413 - RNA, 32 nt, Human
guaccaggcugcagcguuucaggaaugaaaag

SEQ ID NO: 205414 - RNA, 32 nt, Human
guaccagggaaacugggugggugucugggugu

SEQ ID NO: 205415 - RNA, 32 nt, Human
guaccagggaaagggcuuaagguuagcagggc

SEQ ID NO: 205416 - RNA, 32 nt, Human
guaccagggacaccucaggacagauucucugg

SEQ ID NO: 205417 - RNA, 32 nt, Human
guaccagggccaugcaggcuuggaguccagag

SEQ ID NO: 205418 - RNA, 32 nt, Human
guaccagucaggacugguagacuuuaaugugg

SEQ ID NO: 205419 - RNA, 32 nt, Human
guaccagucuaccaccaccacagcaccccaga

SEQ ID NO: 205420 - RNA, 32 nt, Human
guaccagugggcaggaagaaagagugaggcaa

SEQ ID NO: 205421 - RNA, 32 nt, Human
guaccaguuuccauuccugggcugagauuguu

SEQ ID NO: 205422 - RNA, 32 nt, Human
guaccaguuuuguaggaaaagugguccagcaa

SEQ ID NO: 205423 - RNA, 32 nt, Human
guaccauaagcuaagaccagagccuuccuguc

SEQ ID NO: 205424 - RNA, 32 nt, Human
guaccauaauguauuuaaccagucuucuuuug

SEQ ID NO: 205425 - RNA, 32 nt, Human
guaccaucaggauauuuaacccuuuaagugcu

SEQ ID NO: 205426 - RNA, 32 nt, Human
guaccauccuugugcccugccucuuauucuca

SEQ ID NO: 205427 - RNA, 32 nt, Human
guaccaugagaugucaaaaccugggggcccgg

SEQ ID NO: 205428 - RNA, 32 nt, Human
guaccauggcacuccagccuggacaacaagag

SEQ ID NO: 205429 - RNA, 32 nt, Human
guaccaugugccacaacugcuguggcccccug

SEQ ID NO: 205430 - RNA, 32 nt, Human
guaccauguggcuguggcauugccgaggcugg

SEQ ID NO: 205431 - RNA, 32 nt, Human
guaccauuaucuucuuuugccuaaaauuacua

SEQ ID NO: 205432 - RNA, 25 nt, Human
guaccauugacaaugguggcuguca

SEQ ID NO: 205433 - RNA, 32 nt, Human
guaccauugcacuccagccugggcaacaagaa

SEQ ID NO: 205434 - RNA, 32 nt, Human
guaccauugcacuccagccugggcaacaagag

SEQ ID NO: 205435 - RNA, 32 nt, Human
guaccauugcacuccagccugggcaacagagc

SEQ ID NO: 205436 - RNA, 32 nt, Human
guaccauuugcucugugcugacugugguccua

SEQ ID NO: 205437 - RNA, 26 nt, Human
guaccauuuucuuguuuaacuuuagc

SEQ ID NO: 205438 - RNA, 23 nt, Human
guaccauuuuguaacucaacaaa

SEQ ID NO: 205439 - RNA, 22 nt, Human
guacccaaacauaacggaugua

SEQ ID NO: 205440 - RNA, 25 nt, Human
guacccaaauguacauauaccuggu

SEQ ID NO: 205441 - RNA, 32 nt, Human
guacccaaccaaagaugcuuaaaaaccuucua

SEQ ID NO: 205442 - RNA, 32 nt, Human
guacccacaagaagaugacuuccaucauacag

SEQ ID NO: 205443 - RNA, 32 nt, Human
guacccacccccgaauggugacgguagagcug

SEQ ID NO: 205444 - RNA, 32 nt, Human
guacccaccuacccggccugggcugaccaugg

SEQ ID NO: 205445 - RNA, 32 nt, Human
guacccagacagggaucugggccuucagagac

SEQ ID NO: 205446 - RNA, 23 nt, Human
guacccagacuugcauguaccug

SEQ ID NO: 205447 - RNA, 25 nt, Human
guacccagagugcauggcaccuggu

SEQ ID NO: 205448 - RNA, 32 nt, Human
guacccagaucaucaugaaaacaaauauugcg

SEQ ID NO: 205449 - RNA, 32 nt, Human
guacccagccuaucuuuuugauacuuuugaau

SEQ ID NO: 205450 - RNA, 32 nt, Human
guacccagccugggcaacagugcgagguuccg

SEQ ID NO: 205451 - RNA, 32 nt, Human
guacccagccugggccacagugcaagacucca

SEQ ID NO: 205452 - RNA, 32 nt, Human
guacccaggaggcagagauugcagugagcuga

SEQ ID NO: 205453 - RNA, 32 nt, Human
guacccaggaggcggagguuguagugagcuga

SEQ ID NO: 205454 - RNA, 32 nt, Human
guacccaggagguggagguugcagugagccga

SEQ ID NO: 205455 - RNA, 32 nt, Human
guacccaggagguggagguugcggugaacuga

SEQ ID NO: 205456 - RNA, 32 nt, Human
guacccaggcagaguggacggcauucagggcu

SEQ ID NO: 205457 - RNA, 32 nt, Human
guacccagugcugauggggugugcccacgugg

SEQ ID NO: 205458 - RNA, 32 nt, Human
guacccaguuagggguuggagcccccauauaa

SEQ ID NO: 205459 - RNA, 32 nt, Human
guacccaguucuucaggcugauuucccugacc

SEQ ID NO: 205460 - RNA, 32 nt, Human
guacccauguacauaugugaacuuuuucauau

SEQ ID NO: 205461 - RNA, 32 nt, Human
guaccccaagcugcuuucucuggaccaaugcu

SEQ ID NO: 205462 - RNA, 32 nt, Human
guaccccacagcugcauucaaacucaaaucug

SEQ ID NO: 205463 - RNA, 32 nt, Human
guaccccaccaccacucuggcuggcuuccaag

SEQ ID NO: 205464 - RNA, 32 nt, Human
guaccccagauggggaaauuugaaucacaugu

SEQ ID NO: 205465 - RNA, 32 nt, Human
guaccccagcuguuccggaggcugaggccagg

SEQ ID NO: 205466 - RNA, 24 nt, Human
guaccccaggcuggagugcaaugg

SEQ ID NO: 205467 - RNA, 32 nt, Human
guaccccauaaauauacaaaauuauuugucaa

SEQ ID NO: 205468 - RNA, 32 nt, Human
guaccccauaaauauguagaaauauuauaugu

SEQ ID NO: 205469 - RNA, 32 nt, Human
guacccccaaccccaaacuuucaccaaaagca

SEQ ID NO: 205470 - RNA, 32 nt, Human
guacccccacacaucucccacccaccugagcg

SEQ ID NO: 205471 - RNA, 32 nt, Human
guacccccagcugcugguuccugcacucuuau

SEQ ID NO: 205472 - RNA, 32 nt, Human
guacccccaggcuggcuagcccuucccuccau

SEQ ID NO: 205473 - RNA, 32 nt, Human
guacccccuccccagucuucgccuuccucuuu

SEQ ID NO: 205474 - RNA, 32 nt, Human
guaccccugagagcugccccagccugggguga

SEQ ID NO: 205475 - RNA, 32 nt, Human
guaccccugaggaaacaaaaaggaaaugagga

SEQ ID NO: 205476 - RNA, 32 nt, Human
guaccccugcacuccagcccagguuacagagc

SEQ ID NO: 205477 - RNA, 18 nt, Human
guaccccugcccccagcc

SEQ ID NO: 205478 - RNA, 32 nt, Human
guaccccugggcagugcuaccugggcacacac

SEQ ID NO: 205479 - RNA, 32 nt, Human
guaccccuguaaucccagcuacucgggaggcu

SEQ ID NO: 205480 - RNA, 32 nt, Human
guacccgagacugggaagaaaaagagguuuac

SEQ ID NO: 205481 - RNA, 32 nt, Human
guacccgccaccgccggugagccugggaagca

SEQ ID NO: 205482 - RNA, 32 nt, Human
guacccgcugcucucagcugggcccgugggug

SEQ ID NO: 205483 - RNA, 32 nt, Human
guacccgcuucugccaccuccuggaccuuccu

SEQ ID NO: 205484 - RNA, 32 nt, Human
guacccggcuguaaggcaagcugggaugcgcg

SEQ ID NO: 205485 - RNA, 25 nt, Human
guacccgggucacauaguaccuggu

SEQ ID NO: 205486 - RNA, 32 nt, Human
guacccguaccccugagguggggagggggagc

SEQ ID NO: 205487 - RNA, 32 nt, Human
guacccguggugagacaagacccagagcuacu

SEQ ID NO: 205488 - RNA, 32 nt, Human
guacccguugcagagccagggacaugaugcag

SEQ ID NO: 205489 - RNA, 32 nt, Human
guacccuagacuguugguaacugggauaacug

SEQ ID NO: 205490 - RNA, 21 nt, Human
guacccucaagaccccagaga

SEQ ID NO: 205491 - RNA, 32 nt, Human
guacccucaggggcaagguucccacuguuagc

SEQ ID NO: 205492 - RNA, 32 nt, Human
guacccuccaacccucaaugucccaagacuuu

SEQ ID NO: 205493 - RNA, 32 nt, Human
guacccuccccauacuuccaccagugaaagac

SEQ ID NO: 205494 - RNA, 32 nt, Human
guacccuccuccccucuccuacugucauucuu

SEQ ID NO: 205495 - RNA, 32 nt, Human
guacccucuaagauucauuagguugaaauccu

SEQ ID NO: 205496 - RNA, 32 nt, Human
guacccucugcccugcuggccuggugaugucc

SEQ ID NO: 205497 - RNA, 23 nt, Human
guacccucuucaagccccgguca

SEQ ID NO: 205498 - RNA, 32 nt, Human
guacccucuuucuugccacccuuuccaaugca

SEQ ID NO: 205499 - RNA, 32 nt, Human
guacccugcagaucugccccagaggagcaggu

SEQ ID NO: 205500 - RNA, 32 nt, Human
guacccugccccucucguccuccuggguagcc

SEQ ID NO: 205501 - RNA, 29 nt, Human
guacccugggcccacugcuguuucucuau

SEQ ID NO: 205502 - RNA, 32 nt, Human
guacccuguaaauaccugucauguccuucagg

SEQ ID NO: 205503 - RNA, 32 nt, Human
guacccuuggccaggacucuggugcccacccu

SEQ ID NO: 205504 - RNA, 32 nt, Human
guacccuuuaaaggagcuacagucauuuuauu

SEQ ID NO: 205505 - RNA, 22 nt, Human
guaccgaaguccucucuucuca

SEQ ID NO: 205506 - RNA, 32 nt, Human
guaccgagcucugucuguuccagccuacaucc

SEQ ID NO: 205507 - RNA, 32 nt, Human
guaccgaugauacuguuucuugcacugaauau

SEQ ID NO: 205508 - RNA, 32 nt, Human
guaccgcauuuuauagaugagauagcugaggc

SEQ ID NO: 205509 - RNA, 32 nt, Human
guaccgccagaagaagaggguggagcaggagg

SEQ ID NO: 205510 - RNA, 32 nt, Human
guaccgccgcccaggguggguggccagugagg

SEQ ID NO: 205511 - RNA, 32 nt, Human
guaccgccuuccuccccucuguccgcgccaug

SEQ ID NO: 205512 - RNA, 31 nt, Human
guaccgcgcuuagcgugccuguugaagucaa

SEQ ID NO: 205513 - RNA, 32 nt, Human
guaccgcgucuggaagaagaugcuugcaucug

SEQ ID NO: 205514 - RNA, 32 nt, Human
guaccgcuacugggcgcccucagucugcgcgg

SEQ ID NO: 205515 - RNA, 32 nt, Human
guaccgcugcacuccagccugggugauagagc

SEQ ID NO: 205516 - RNA, 32 nt, Human
guaccggaaauggcaggcacugucagauuucc

SEQ ID NO: 205517 - RNA, 32 nt, Human
guaccggaugcuagggggcuugcccacugccu

SEQ ID NO: 205518 - RNA, 23 nt, Human
guaccggggcuggagcggaguga

SEQ ID NO: 205519 - RNA, 32 nt, Human
guaccgggggcugaggcccagggaggucucgc

SEQ ID NO: 205520 - RNA, 32 nt, Human
guaccgguuugucaguucuuggugcucugugu

SEQ ID NO: 205521 - RNA, 32 nt, Human
guaccgucuucucccuauucccucucucuccc

SEQ ID NO: 205522 - RNA, 32 nt, Human
guaccuaacuauacacuuugauucagccugcu

SEQ ID NO: 205523 - RNA, 32 nt, Human
guaccuaaugucuccuacagaaacaccaucug

SEQ ID NO: 205524 - RNA, 32 nt, Human
guaccuaauuggagagguaggggugaccgggg

SEQ ID NO: 205525 - RNA, 32 nt, Human
guaccuacuagggcaccauaauacugcagcaa

SEQ ID NO: 205526 - RNA, 32 nt, Human
guaccuacuagguuccuccugaggguucaggu

SEQ ID NO: 205527 - RNA, 32 nt, Human
guaccuauccuuguguuucugaugcaguggua

SEQ ID NO: 205528 - RNA, 32 nt, Human
guaccuauugcacuccauccuggaugaaagag

SEQ ID NO: 205529 - RNA, 32 nt, Human
guaccucaagccccauuuccucacacuaagag

SEQ ID NO: 205530 - RNA, 32 nt, Human
guaccucacagcccccugugggcacagacacc

SEQ ID NO: 205531 - RNA, 32 nt, Human
guaccucacugcacagcuucuagguagccuuc

SEQ ID NO: 205532 - RNA, 32 nt, Human
guaccucagucugguauccagacugugaaauc

SEQ ID NO: 205533 - RNA, 32 nt, Human
guaccucauuaaaaauauaaaacuagcugggc

SEQ ID NO: 205534 - RNA, 32 nt, Human
guaccuccagccuguuuccucugaaguauacc

SEQ ID NO: 205535 - RNA, 32 nt, Human
guaccucgaggcaccauuccagccagggacgc

SEQ ID NO: 205536 - RNA, 32 nt, Human
guaccucuccaccauccuccagucguugcccu

SEQ ID NO: 205537 - RNA, 32 nt, Human
guaccucuccaccuugucucacagucuguuuc

SEQ ID NO: 205538 - RNA, 32 nt, Human
guaccucuuacacucccuguggcuccaacuuc

SEQ ID NO: 205539 - RNA, 32 nt, Human
guaccucuucuuuccuuggcuuccaugguagu

SEQ ID NO: 205540 - RNA, 32 nt, Human
guaccugagagguuuguggaaaagauggcaaa

SEQ ID NO: 205541 - RNA, 32 nt, Human
guaccugagcacugcugcuacuucuuccccca

SEQ ID NO: 205542 - RNA, 32 nt, Human
guaccugagcuuccucuucuccaucccugaga

SEQ ID NO: 205543 - RNA, 32 nt, Human
guaccugcagccaugagguucuggguguuuuu

SEQ ID NO: 205544 - RNA, 19 nt, Human
guaccugcaggcauggggg

SEQ ID NO: 205545 - RNA, 32 nt, Human
guaccugcagugcugcuuuucuugccuagacu

SEQ ID NO: 205546 - RNA, 23 nt, Human
guaccugcccccagcccuggcca

SEQ ID NO: 205547 - RNA, 22 nt, Human
guaccugcgaccgggaccauga

SEQ ID NO: 205548 - RNA, 32 nt, Human
guaccugcuacuguucuccccacauugcccag

SEQ ID NO: 205549 - RNA, 24 nt, Human
guaccugcucaccauuggucauga

SEQ ID NO: 205550 - RNA, 21 nt, Human
guaccugcucacuguuccgug

SEQ ID NO: 205551 - RNA, 21 nt, Human
guaccugcucagggccagcga

SEQ ID NO: 205552 - RNA, 32 nt, Human
guaccugcuccgugcccaacacaugcccucuc

SEQ ID NO: 205553 - RNA, 32 nt, Human
guaccuggaacuucagcucaaacauuuacgau

SEQ ID NO: 205554 - RNA, 32 nt, Human
guaccuggaggaacuccuacauuuuaggcuuu

SEQ ID NO: 205555 - RNA, 32 nt, Human
guaccuggaucuuccacacgagugggauucug

SEQ ID NO: 205556 - RNA, 32 nt, Human
guaccuggcacaggguucuguccucuucauuu

SEQ ID NO: 205557 - RNA, 32 nt, Human
guaccuggccuuuccuggacagacugaagagc

SEQ ID NO: 205558 - RNA, 32 nt, Human
guaccugggaagcgcagguugcagugagcuga

SEQ ID NO: 205559 - RNA, 32 nt, Human
guaccugggaauucuuccuaaauuacucugga

SEQ ID NO: 205560 - RNA, 32 nt, Human
guaccugggacugucuaccauugaagauuagc

SEQ ID NO: 205561 - RNA, 32 nt, Human
guaccugggaggaggagguugcagugagcuga

SEQ ID NO: 205562 - RNA, 32 nt, Human
guaccugggauuacaggcaugugccaccacac

SEQ ID NO: 205563 - RNA, 32 nt, Human
guaccugggauuacaggcaugugccaccacgc

SEQ ID NO: 205564 - RNA, 32 nt, Human
guaccugggauuauaggcacaagucaccaugc

SEQ ID NO: 205565 - RNA, 22 nt, Human
guaccugggccaggccaguggc

SEQ ID NO: 205566 - RNA, 32 nt, Human
guaccuguaagagguauuguauucuuggacuc

SEQ ID NO: 205567 - RNA, 32 nt, Human
guaccuuaacuucaaacauuucucuucagaaa

SEQ ID NO: 205568 - RNA, 32 nt, Human
guaccuuagcaaguugcucccucuccagggag

SEQ ID NO: 205569 - RNA, 32 nt, Human
guaccuuaggguuuugccauuguaaauggguc

SEQ ID NO: 205570 - RNA, 32 nt, Human
guaccuucacguggcacucucccuuuaugugu

SEQ ID NO: 205571 - RNA, 32 nt, Human
guaccuuccacauucucagguaucucauagca

SEQ ID NO: 205572 - RNA, 32 nt, Human
guaccuucuggccccaacccuugacucaacgg

SEQ ID NO: 205573 - RNA, 32 nt, Human
guaccuugccagggaagcaaaaauuggaauua

SEQ ID NO: 205574 - RNA, 32 nt, Human
guaccuugcccaggucuggcacauaguagagu

SEQ ID NO: 205575 - RNA, 32 nt, Human
guaccuugcugguacagacagggguggugggc

SEQ ID NO: 205576 - RNA, 32 nt, Human
guaccuuggaugagggguagccucccacugca

SEQ ID NO: 205577 - RNA, 32 nt, Human
guaccuuggcuucauuuaaaucauccugggag

SEQ ID NO: 205578 - RNA, 32 nt, Human
guaccuugugggcagugaugucauucggugcg

SEQ ID NO: 205579 - RNA, 32 nt, Human
guaccuugugucucuuucaagugccuuaaucc

SEQ ID NO: 205580 - RNA, 32 nt, Human
guaccuuucagaauguaagguacagcagcucc

SEQ ID NO: 205581 - RNA, 32 nt, Human
guaccuuuccaaggugaacagaacagcaagag

SEQ ID NO: 205582 - RNA, 32 nt, Human
guaccuuuggaguagguuuaccagagagagca

SEQ ID NO: 205583 - RNA, 32 nt, Human
guacgaaguugcucucaaagauggggaagucc

SEQ ID NO: 205584 - RNA, 32 nt, Human
guacgaaucuuagaaggaaggagggggagccc

SEQ ID NO: 205585 - RNA, 23 nt, Human
guacgacucacugagccaugcuc

SEQ ID NO: 205586 - RNA, 32 nt, Human
guacgacugucuggcccugaauuugcauggcu

SEQ ID NO: 205587 - RNA, 32 nt, Human
guacgaguguagacacugggcccauuggacgu

SEQ ID NO: 205588 - RNA, 32 nt, Human
guacgauacagaauguuacacagauacaguau

SEQ ID NO: 205589 - RNA, 32 nt, Human
guacgauaguuccggcaccggaaaagagggcu

SEQ ID NO: 205590 - RNA, 32 nt, Human
guacgauccaaaacauuguacccagcuuuuua

SEQ ID NO: 205591 - RNA, 32 nt, Human
guacgcaaaguagcuaaugagcuaaacucaca

SEQ ID NO: 205592 - RNA, 32 nt, Human
guacgcacuguggaggcucuacaaacagccau

SEQ ID NO: 205593 - RNA, 32 nt, Human
guacgccgaggugggagccgguggaccggucc

SEQ ID NO: 205594 - RNA, 32 nt, Human
guacgccgcagcugcccagucucgccuaaucu

SEQ ID NO: 205595 - RNA, 32 nt, Human
guacgccuauagucccagcuacucgggaggcu

SEQ ID NO: 205596 - RNA, 32 nt, Human
guacgccuguaaucccagugacuugggaggcu

SEQ ID NO: 205597 - RNA, 32 nt, Human
guacgccuguagucccagcuacucaggaggcu

SEQ ID NO: 205598 - RNA, 21 nt, Human
guacgcgcucugcuccgagcc

SEQ ID NO: 205599 - RNA, 32 nt, Human
guacgcugaaacccucccuggugguggagcug

SEQ ID NO: 205600 - RNA, 32 nt, Human
guacgcugcugccuggacaucagucuggaagc

SEQ ID NO: 205601 - RNA, 29 nt, Human
guacgcuggcugcuaccucccucacucuu

SEQ ID NO: 205602 - RNA, 32 nt, Human
guacgcugggaggcuggucugggguggucacu

SEQ ID NO: 205603 - RNA, 32 nt, Human
guacggaagcccggaaggaggggcagggggcg

SEQ ID NO: 205604 - RNA, 32 nt, Human
guacggagcagguggaccaugaggucaggacu

SEQ ID NO: 205605 - RNA, 32 nt, Human
guacggaugcgccaccauggaugaaaacaucc

SEQ ID NO: 205606 - RNA, 32 nt, Human
guacggcggcacggcugcagccuggaugggaa

SEQ ID NO: 205607 - RNA, 32 nt, Human
guacggggccuucgucccuccugagcucuucg

SEQ ID NO: 205608 - RNA, 32 nt, Human
guacgggguggggaggggaauggggagggggu

SEQ ID NO: 205609 - RNA, 32 nt, Human
guacggugcucacaccuguaaucccagcacuu

SEQ ID NO: 205610 - RNA, 24 nt, Human
guacgguggcucacacuuauaauc

SEQ ID NO: 205611 - RNA, 24 nt, Human
guacgguggcucacgccuauaauc

SEQ ID NO: 205612 - RNA, 24 nt, Human
guacgguggcucacgccuguaauc

SEQ ID NO: 205613 - RNA, 24 nt, Human
guacgguggcucaugccuauaauc

SEQ ID NO: 205614 - RNA, 24 nt, Human
guacgguggcucaugccuguaauc

SEQ ID NO: 205615 - RNA, 32 nt, Human
guacgguguggggaaguggaagggaagcuggc

SEQ ID NO: 205616 - RNA, 32 nt, Human
guacguagugugaucaaacaugaucauccaga

SEQ ID NO: 205617 - RNA, 32 nt, Human
guacgucggcagccccagccccagaaaaggaa

SEQ ID NO: 205618 - RNA, 32 nt, Human
guacgugcagcacuacggccugggcagugccu

SEQ ID NO: 205619 - RNA, 32 nt, Human
guacgugccaucaucucuccagcccaggcccc

SEQ ID NO: 205620 - RNA, 22 nt, Human
guacgugccuguagucccagcu

SEQ ID NO: 205621 - RNA, 32 nt, Human
guacgugccuguagucccagcuacuucgggga

SEQ ID NO: 205622 - RNA, 32 nt, Human
guacgugccuguagucucagcuacuugggagg

SEQ ID NO: 205623 - RNA, 32 nt, Human
guacguggaggaacuccuacauuuuaggcuuu

SEQ ID NO: 205624 - RNA, 32 nt, Human
guacguggcugcaguucauagcagugaggaag

SEQ ID NO: 205625 - RNA, 32 nt, Human
guacgugguaggugcucacuccccuauuguuu

SEQ ID NO: 205626 - RNA, 32 nt, Human
guacguguaagccuuuucuuuucaagaugccu

SEQ ID NO: 205627 - RNA, 32 nt, Human
guacguucucaccucuuaugcuuaguuggaac

SEQ ID NO: 205628 - RNA, 22 nt, Human
guacguuggaccuaaaacugcu

SEQ ID NO: 205629 - RNA, 32 nt, Human
guacuaaaaauacaaaaauuagccagacgugg

SEQ ID NO: 205630 - RNA, 32 nt, Human
guacuaaaaauacaaaaauuagccagauauga

SEQ ID NO: 205631 - RNA, 32 nt, Human
guacuaaaaauacaaaaauuagccaggcaugg

SEQ ID NO: 205632 - RNA, 32 nt, Human
guacuaaaaauacaaaaauuagccaggcgugg

SEQ ID NO: 205633 - RNA, 32 nt, Human
guacuaaaaauacaaaaauuagcccagugugg

SEQ ID NO: 205634 - RNA, 32 nt, Human
guacuaaaaauacaaaaauuagccggacgugg

SEQ ID NO: 205635 - RNA, 32 nt, Human
guacuaaaaauacaaaaauuagccgggcauag

SEQ ID NO: 205636 - RNA, 32 nt, Human
guacuaaaaauacaaaaauuagccgggcgugg

SEQ ID NO: 205637 - RNA, 32 nt, Human
guacuaaaaauacaaaaauuagccgggugugg

SEQ ID NO: 205638 - RNA, 32 nt, Human
guacuaaaaauacaaaaauuugccuggugugg

SEQ ID NO: 205639 - RNA, 32 nt, Human
guacuaaaaauacaaaacagccagguguggug

SEQ ID NO: 205640 - RNA, 32 nt, Human
guacuaaaaauacaaaauuagccgggcguggu

SEQ ID NO: 205641 - RNA, 32 nt, Human
guacuaaaaauacaaaauuagcuggguuuggu

SEQ ID NO: 205642 - RNA, 32 nt, Human
guacuaaaaauacaaaauuuagccaggcaugg

SEQ ID NO: 205643 - RNA, 32 nt, Human
guacuaaaaauacaaaauuuagcuuggccugg

SEQ ID NO: 205644 - RNA, 32 nt, Human
guacuaaaaauacaagaaaaacuuagccgggc

SEQ ID NO: 205645 - RNA, 32 nt, Human
guacuaaaaaugcaaaaauuagcugggcgugg

SEQ ID NO: 205646 - RNA, 19 nt, Human
guacuaaauuuuguuucuu

SEQ ID NO: 205647 - RNA, 32 nt, Human
guacuaacaaaggagaccuggugaucugccga

SEQ ID NO: 205648 - RNA, 32 nt, Human
guacuaacagaagucuguacuauuuggucagu

SEQ ID NO: 205649 - RNA, 32 nt, Human
guacuaaggagggucuggccagaggaacagac

SEQ ID NO: 205650 - RNA, 32 nt, Human
guacuaauaauacaaaaauuagcugggcaugu

SEQ ID NO: 205651 - RNA, 32 nt, Human
guacuaauuaacuuaaacacagagcuauaaaa

SEQ ID NO: 205652 - RNA, 32 nt, Human
guacuaauuacugcccagccuggggagaucag

SEQ ID NO: 205653 - RNA, 32 nt, Human
guacuacaauguaaucuguuucccagggaaau

SEQ ID NO: 205654 - RNA, 32 nt, Human
guacuacagauuuucaaaacugaaugagagaa

SEQ ID NO: 205655 - RNA, 32 nt, Human
guacuacaggaaugcaccaccaugcccggcaa

SEQ ID NO: 205656 - RNA, 32 nt, Human
guacuacaggcgcgugccaccacaccuggcua

SEQ ID NO: 205657 - RNA, 32 nt, Human
guacuacaggugcgugccaccaugcuuggcua

SEQ ID NO: 205658 - RNA, 32 nt, Human
guacuaccauuuugaggaucuggacuccguuu

SEQ ID NO: 205659 - RNA, 32 nt, Human
guacuacgcagcaacacucacaacuguccagg

SEQ ID NO: 205660 - RNA, 32 nt, Human
guacuacuaauugagcaaccuacgcacucagu

SEQ ID NO: 205661 - RNA, 32 nt, Human
guacuacugcacuccagcauggaagacagcga

SEQ ID NO: 205662 - RNA, 32 nt, Human
guacuacuguacuccagccugggggaaagagu

SEQ ID NO: 205663 - RNA, 32 nt, Human
guacuagaaagccacaggagaggucggcuugu

SEQ ID NO: 205664 - RNA, 31 nt, Human
guacuagaguaccuguuuacauuccucuaua

SEQ ID NO: 205665 - RNA, 32 nt, Human
guacuaggagcauugguugcaguggaggaguu

SEQ ID NO: 205666 - RNA, 32 nt, Human
guacuaggcugucuccagcccagcgaagcuca

SEQ ID NO: 205667 - RNA, 32 nt, Human
guacuaguccaggaguaggcugugggagccgg

SEQ ID NO: 205668 - RNA, 32 nt, Human
guacuauacaucucccaaagaaacccauggug

SEQ ID NO: 205669 - RNA, 32 nt, Human
guacuauaggugugcaccaccacgcccagcaa

SEQ ID NO: 205670 - RNA, 32 nt, Human
guacuaucagaguagggcaggcucuggauuaa

SEQ ID NO: 205671 - RNA, 32 nt, Human
guacuaugauacuguucuuggagcucaauucc

SEQ ID NO: 205672 - RNA, 32 nt, Human
guacuaugccaguccuagcagaaaaauguguu

SEQ ID NO: 205673 - RNA, 32 nt, Human
guacuauggaacuuuucuuaggggacacgucc

SEQ ID NO: 205674 - RNA, 32 nt, Human
guacuauuauuccauacuacuauauucuucca

SEQ ID NO: 205675 - RNA, 32 nt, Human
guacuauucagaaugauauacacacauaugug

SEQ ID NO: 205676 - RNA, 32 nt, Human
guacuauuuggaauugguuuuccagucuuuca

SEQ ID NO: 205677 - RNA, 32 nt, Human
guacucaaaaugcaaaaauuagccaggcgugg

SEQ ID NO: 205678 - RNA, 32 nt, Human
guacucaaagcuauccuuccagaguuacaaaa

SEQ ID NO: 205679 - RNA, 32 nt, Human
guacucaacuguguuuaauacucugaauuuua

SEQ ID NO: 205680 - RNA, 32 nt, Human
guacucaccaggcuggagugugguagcacgau

SEQ ID NO: 205681 - RNA, 32 nt, Human
guacucacgcagcugccgcgccauguccugcu

SEQ ID NO: 205682 - RNA, 32 nt, Human
guacucacucucuccacccucccuucaccucc

SEQ ID NO: 205683 - RNA, 32 nt, Human
guacucacuuccucuuagaucauaauuccauc

SEQ ID NO: 205684 - RNA, 32 nt, Human
guacucaggaggcugaggcaggagaaucacuu

SEQ ID NO: 205685 - RNA, 32 nt, Human
guacucaggaggcugaggcaggagaauugcuu

SEQ ID NO: 205686 - RNA, 32 nt, Human
guacucaggaggcugaggggaggaucacugga

SEQ ID NO: 205687 - RNA, 32 nt, Human
guacucaggcuggagugcgguggugugaucuu

SEQ ID NO: 205688 - RNA, 31 nt, Human
guacucaguggacagugcuguugaagauuug

SEQ ID NO: 205689 - RNA, 32 nt, Human
guacucaguuuagcucucaaagaaggggugaa

SEQ ID NO: 205690 - RNA, 18 nt, Human
guacucauaccauccaca

SEQ ID NO: 205691 - RNA, 32 nt, Human
guacucaucacccauauacugaacacuguacu

SEQ ID NO: 205692 - RNA, 32 nt, Human
guacucaucacucaugcuugugagaaucuaca

SEQ ID NO: 205693 - RNA, 32 nt, Human
guacucaugccuguaaucccagcacuuugaga

SEQ ID NO: 205694 - RNA, 32 nt, Human
guacuccagaugacaguaacugacuugaagau

SEQ ID NO: 205695 - RNA, 32 nt, Human
guacuccagcccggcacuccagccuggcgaca

SEQ ID NO: 205696 - RNA, 32 nt, Human
guacuccagccuaggugacagagcaagacucu

SEQ ID NO: 205697 - RNA, 32 nt, Human
guacuccagccugagcaacagagcaagacagg

SEQ ID NO: 205698 - RNA, 32 nt, Human
guacuccagccuggcaacagagcgagacuccg

SEQ ID NO: 205699 - RNA, 32 nt, Human
guacuccagccugggagauagagcaagacucc

SEQ ID NO: 205700 - RNA, 32 nt, Human
guacuccagccugggcaacagagcaagaccca

SEQ ID NO: 205701 - RNA, 32 nt, Human
guacuccagccugggcaacagagcaagacccu

SEQ ID NO: 205702 - RNA, 32 nt, Human
guacuccagccugggcaacagagcgaggcucc

SEQ ID NO: 205703 - RNA, 32 nt, Human
guacuccagccuggugacagagccagacuguu

SEQ ID NO: 205704 - RNA, 32 nt, Human
guacuccagccuggugacagagcgagacuccc

SEQ ID NO: 205705 - RNA, 32 nt, Human
guacuccagcuuggcgacagagcaagaccccc

SEQ ID NO: 205706 - RNA, 32 nt, Human
guacuccaggauuccaggaguaagccuguaga

SEQ ID NO: 205707 - RNA, 32 nt, Human
guacuccaugaucugcuuagccauugaugaug

SEQ ID NO: 205708 - RNA, 32 nt, Human
guacuccauuguuuuugcuauuuaaauauaau

SEQ ID NO: 205709 - RNA, 32 nt, Human
guacucccagcacuuugggaggcugagguggg

SEQ ID NO: 205710 - RNA, 19 nt, Human
guacucccagcuacuuggg

SEQ ID NO: 205711 - RNA, 32 nt, Human
guacuccccucagggauacgacacaugcccau

SEQ ID NO: 205712 - RNA, 32 nt, Human
guacuccccucggggauacgacacaugcccau

SEQ ID NO: 205713 - RNA, 32 nt, Human
guacuccccucggggauacgacauaugcccau

SEQ ID NO: 205714 - RNA, 32 nt, Human
guacuccccucggggauaugacacaugcccau

SEQ ID NO: 205715 - RNA, 32 nt, Human
guacuccccugagaggccuucugccuagaaag

SEQ ID NO: 205716 - RNA, 32 nt, Human
guacucccuccagccucagcuggcugaaccuc

SEQ ID NO: 205717 - RNA, 32 nt, Human
guacuccgagugaagaauucagcagcuaagug

SEQ ID NO: 205718 - RNA, 32 nt, Human
guacuccgggcugugggggucggugcggauau

SEQ ID NO: 205719 - RNA, 32 nt, Human
guacuccggucugagcgacagagcaagaaucu

SEQ ID NO: 205720 - RNA, 32 nt, Human
guacuccugccggccucccacccggccugcag

SEQ ID NO: 205721 - RNA, 32 nt, Human
guacuccugccuaggugacagagcaagacucc

SEQ ID NO: 205722 - RNA, 32 nt, Human
guacuccuucucccagcccuguccucauccua

SEQ ID NO: 205723 - RNA, 32 nt, Human
guacucgcuugugcagaaaacauuguuccaga

SEQ ID NO: 205724 - RNA, 32 nt, Human
guacucggcuuccugugggguguagguucucg

SEQ ID NO: 205725 - RNA, 32 nt, Human
guacucgggaacaggaaucaggaaaccugagu

SEQ ID NO: 205726 - RNA, 32 nt, Human
guacucgggaggcugaagcaggagaaucgcuu

SEQ ID NO: 205727 - RNA, 32 nt, Human
guacucgggaggcugaggcagagaauugcuug

SEQ ID NO: 205728 - RNA, 32 nt, Human
guacucgggaggcugaggcaggagaauggcgu

SEQ ID NO: 205729 - RNA, 32 nt, Human
guacucguucucucacggcccugagugagccc

SEQ ID NO: 205730 - RNA, 32 nt, Human
guacucuauuuaaggaucugugguaguauaac

SEQ ID NO: 205731 - RNA, 32 nt, Human
guacucucaaagaagguggggagcugcccagg

SEQ ID NO: 205732 - RNA, 32 nt, Human
guacucuccccagacagccagaaggcccuuug

SEQ ID NO: 205733 - RNA, 31 nt, Human
guacucuccuccucaaugccugugucucucc

SEQ ID NO: 205734 - RNA, 32 nt, Human
guacucugacaucacggaaaguguugaaccug

SEQ ID NO: 205735 - RNA, 32 nt, Human
guacucugagucucaccuuaucugauuuagau

SEQ ID NO: 205736 - RNA, 32 nt, Human
guacucugcaccacugccauacgagcuuccca

SEQ ID NO: 205737 - RNA, 32 nt, Human
guacucugcuuuucuccuccucagcauugaug

SEQ ID NO: 205738 - RNA, 22 nt, Human
guacucuggaucccuuccccug

SEQ ID NO: 205739 - RNA, 28 nt, Human
guacucuggggugcugccugaauccauu

SEQ ID NO: 205740 - RNA, 32 nt, Human
guacucugguggccacuggaucuuugggauua

SEQ ID NO: 205741 - RNA, 32 nt, Human
guacucuucaaguaucuuuguaaugaagguuu

SEQ ID NO: 205742 - RNA, 32 nt, Human
guacucuucuuaugcuaauaugcucugggcug

SEQ ID NO: 205743 - RNA, 32 nt, Human
guacucuugagagugucacaacacaaaauacg

SEQ ID NO: 205744 - RNA, 32 nt, Human
guacugaaaauacaaaaauuaggcaugguggu

SEQ ID NO: 205745 - RNA, 32 nt, Human
guacugaaaucaacaauuagacuugcacauca

SEQ ID NO: 205746 - RNA, 32 nt, Human
guacugaaauuagggauucaucagggcaggaa

SEQ ID NO: 205747 - RNA, 22 nt, Human
guacugaaccugcauucuucuc

SEQ ID NO: 205748 - RNA, 32 nt, Human
guacugaagcuggccucagaugggaaggcccg

SEQ ID NO: 205749 - RNA, 26 nt, Human
guacugaaguuagcauggcugugcuu

SEQ ID NO: 205750 - RNA, 23 nt, Human
guacugaaucaggaccucacuca

SEQ ID NO: 205751 - RNA, 22 nt, Human
guacugacagaccccauccugc

SEQ ID NO: 205752 - RNA, 19 nt, Human
guacugacccuggaucccu

SEQ ID NO: 205753 - RNA, 32 nt, Human
guacugagacaaugguuaggguuguuuucuua

SEQ ID NO: 205754 - RNA, 32 nt, Human
guacugaguccccagauguuguauacuguaaa

SEQ ID NO: 205755 - RNA, 23 nt, Human
guacugaguccuaucucucucug

SEQ ID NO: 205756 - RNA, 22 nt, Human
guacugagugcuuauucuuuug

SEQ ID NO: 205757 - RNA, 23 nt, Human
guacugaguggauuccgucuucu

SEQ ID NO: 205758 - RNA, 32 nt, Human
guacugauugcucacugaaagacucagcaccc

SEQ ID NO: 205759 - RNA, 32 nt, Human
guacugcaaggcaggugauaauaucaucuccu

SEQ ID NO: 205760 - RNA, 32 nt, Human
guacugcagaacagagccugcagugagacacc

SEQ ID NO: 205761 - RNA, 32 nt, Human
guacugcaggcucugggucagguucugcuccu

SEQ ID NO: 205762 - RNA, 32 nt, Human
guacugcagggcagugcuaugccaccaccuga

SEQ ID NO: 205763 - RNA, 32 nt, Human
guacugccauggccaacucaucacuccugauu

SEQ ID NO: 205764 - RNA, 32 nt, Human
guacugcccagaacaguggcccauagcaggga

SEQ ID NO: 205765 - RNA, 32 nt, Human
guacugcccuggaugugguggagcugggcugg

SEQ ID NO: 205766 - RNA, 32 nt, Human
guacugccugaacaagaagucccccauuucgc

SEQ ID NO: 205767 - RNA, 32 nt, Human
guacugcgcugccacagucucaucccauuucc

SEQ ID NO: 205768 - RNA, 32 nt, Human
guacugcuacuugaauaacucaguuaacgcug

SEQ ID NO: 205769 - RNA, 32 nt, Human
guacugcuaguaccuguaagcauuuuaggucc

SEQ ID NO: 205770 - RNA, 32 nt, Human
guacugcugccuggggccgggggugggggugg

SEQ ID NO: 205771 - RNA, 32 nt, Human
guacugcugcugcugcugcucagggcuucgug

SEQ ID NO: 205772 - RNA, 32 nt, Human
guacuggaccaggucuacgucagcauucaggu

SEQ ID NO: 205773 - RNA, 32 nt, Human
guacuggagacaacaccucagaccaucugaac

SEQ ID NO: 205774 - RNA, 32 nt, Human
guacuggaggaagagagaagaggcaugacagc

SEQ ID NO: 205775 - RNA, 32 nt, Human
guacuggaggggaauuggagcuuuggaacagg

SEQ ID NO: 205776 - RNA, 32 nt, Human
guacuggaucuucccagagaaaagguucccag

SEQ ID NO: 205777 - RNA, 32 nt, Human
guacuggcauagaaaaaccaaauaaaaggccu

SEQ ID NO: 205778 - RNA, 32 nt, Human
guacuggcccuaggaggauuuccucaaccacu

SEQ ID NO: 205779 - RNA, 26 nt, Human
guacuggccugggugacagagcagga

SEQ ID NO: 205780 - RNA, 21 nt, Human
guacuggcuaccuggagccuu

SEQ ID NO: 205781 - RNA, 32 nt, Human
guacuggcuccaccccuuggugcuggcagugu

SEQ ID NO: 205782 - RNA, 32 nt, Human
guacuggcuccucuguggugucugccuguugc

SEQ ID NO: 205783 - RNA, 32 nt, Human
guacugggaggcaggagguggcccggggaggc

SEQ ID NO: 205784 - RNA, 32 nt, Human
guacugggaggcaugguucauugaggaccauc

SEQ ID NO: 205785 - RNA, 32 nt, Human
guacugggaggguggcagggagggacggggaa

SEQ ID NO: 205786 - RNA, 32 nt, Human
guacugggcccagggugcugagcuuuccagaa

SEQ ID NO: 205787 - RNA, 32 nt, Human
guacuggggccacccuuccuaagacagagagu

SEQ ID NO: 205788 - RNA, 32 nt, Human
guacuggggccugcuggacagcgaggacagca

SEQ ID NO: 205789 - RNA, 32 nt, Human
guacugggguacaggcauguucaccacagucc

SEQ ID NO: 205790 - RNA, 32 nt, Human
guacugggucccccucagcacccuccacagca

SEQ ID NO: 205791 - RNA, 32 nt, Human
guacugggugugaggccuggccugggcccaga

SEQ ID NO: 205792 - RNA, 32 nt, Human
guacugguuacaucaagauauguuuugguugu

SEQ ID NO: 205793 - RNA, 32 nt, Human
guacugguuuacaucacagcugccccaggcug

SEQ ID NO: 205794 - RNA, 32 nt, Human
guacuguauuaauuguccuuguuuacuucaga

SEQ ID NO: 205795 - RNA, 32 nt, Human
guacuguauuugcucagugcaucaggaauggg

SEQ ID NO: 205796 - RNA, 31 nt, Human
guacugugacuuccaaagccagagccacaug

SEQ ID NO: 205797 - RNA, 32 nt, Human
guacugugagccaggagcaagucugggguucc

SEQ ID NO: 205798 - RNA, 32 nt, Human
guacugugagcugucuucuguauaauguauuu

SEQ ID NO: 205799 - RNA, 32 nt, Human
guacugugcagugcuggagaguagaauggcaa

SEQ ID NO: 205800 - RNA, 32 nt, Human
guacugugcccaggaaggcugggugaaguccc

SEQ ID NO: 205801 - RNA, 32 nt, Human
guacugugcuuccucagcagcugggcugucag

SEQ ID NO: 205802 - RNA, 32 nt, Human
guacuguggcauacaaguuauuuucuacagua

SEQ ID NO: 205803 - RNA, 32 nt, Human
guacugugguuucugugcucucuccuuccuga

SEQ ID NO: 205804 - RNA, 32 nt, Human
guacuguuaacuuaaaaacacaauuuauaaau

SEQ ID NO: 205805 - RNA, 32 nt, Human
guacuguuccagcaucuucccuggauggcugg

SEQ ID NO: 205806 - RNA, 32 nt, Human
guacuguuguccaggcuggagcgcaguugauu

SEQ ID NO: 205807 - RNA, 32 nt, Human
guacuguuugcugccacacugucucaucuagu

SEQ ID NO: 205808 - RNA, 32 nt, Human
guacuuaaaagcuucauucagaagcuccagga

SEQ ID NO: 205809 - RNA, 32 nt, Human
guacuuaaaccagacagcaggguucagaggug

SEQ ID NO: 205810 - RNA, 32 nt, Human
guacuuaaagcaccuguggagugcggucgcuc

SEQ ID NO: 205811 - RNA, 32 nt, Human
guacuuaagacauguuguugccgggcauggua

SEQ ID NO: 205812 - RNA, 32 nt, Human
guacuuacagccccaauggcccccaaaaagcc

SEQ ID NO: 205813 - RNA, 32 nt, Human
guacuuacagccuucucuugggaacagccggg

SEQ ID NO: 205814 - RNA, 18 nt, Human
guacuuagccaccugugu

SEQ ID NO: 205815 - RNA, 30 nt, Human
guacuuagccucuucugacuucucaaagga

SEQ ID NO: 205816 - RNA, 32 nt, Human
guacuuagccuucuguuauuccuuauucuuua

SEQ ID NO: 205817 - RNA, 32 nt, Human
guacuuauaaaaccagcuugaaaacaucgucu

SEQ ID NO: 205818 - RNA, 32 nt, Human
guacuuaugaucaguuggcaucaaugaagcau

SEQ ID NO: 205819 - RNA, 32 nt, Human
guacuucaacagcaauccccugucaaaccuca

SEQ ID NO: 205820 - RNA, 32 nt, Human
guacuucaacagcaauccccuguuaaaccuca

SEQ ID NO: 205821 - RNA, 32 nt, Human
guacuucaaguuugccuucuaggaagcugugu

SEQ ID NO: 205822 - RNA, 32 nt, Human
guacuucacccaggcggaaugggauggccugu

SEQ ID NO: 205823 - RNA, 32 nt, Human
guacuuccaggucaggggaaauuucagucccc

SEQ ID NO: 205824 - RNA, 31 nt, Human
guacuuccagugcuggagcaugguaugacca

SEQ ID NO: 205825 - RNA, 32 nt, Human
guacuucccaggcuggaugugaagcuacauua

SEQ ID NO: 205826 - RNA, 21 nt, Human
guacuuccuacaucuccuucu

SEQ ID NO: 205827 - RNA, 32 nt, Human
guacuuccuagagaugccagacuugccucaca

SEQ ID NO: 205828 - RNA, 32 nt, Human
guacuuccuuucucccugcgggccaggcacug

SEQ ID NO: 205829 - RNA, 32 nt, Human
guacuucuacagccauguccuauuccuugauc

SEQ ID NO: 205830 - RNA, 32 nt, Human
guacuucucauagcuuuggagucuggcugucc

SEQ ID NO: 205831 - RNA, 32 nt, Human
guacuucugaugcuauuaauugguuccucaac

SEQ ID NO: 205832 - RNA, 32 nt, Human
guacuucuggcuuaaguauaaccauguaagaa

SEQ ID NO: 205833 - RNA, 32 nt, Human
guacuugacaguguuaucugucacuuauuuaa

SEQ ID NO: 205834 - RNA, 32 nt, Human
guacuugaugccuucucugugagcaguggcuc

SEQ ID NO: 205835 - RNA, 27 nt, Human
guacuugaugcuggaagcucuuggaga

SEQ ID NO: 205836 - RNA, 32 nt, Human
guacuugaugggccucuggucuugccgugucu

SEQ ID NO: 205837 - RNA, 18 nt, Human
guacuugauguauugggg

SEQ ID NO: 205838 - RNA, 28 nt, Human
guacuugcacacagguccccacagaugc

SEQ ID NO: 205839 - RNA, 32 nt, Human
guacuugcacacauccagcaacaccgcacuca

SEQ ID NO: 205840 - RNA, 32 nt, Human
guacuuggagaaacugaggccucuuaugugua

SEQ ID NO: 205841 - RNA, 32 nt, Human
guacuuggcuacagauuucugccuuguuuugc

SEQ ID NO: 205842 - RNA, 32 nt, Human
guacuuggcucucagccuggaguggcagcucu

SEQ ID NO: 205843 - RNA, 32 nt, Human
guacuugggaggcugaggcaggagaaucacuu

SEQ ID NO: 205844 - RNA, 32 nt, Human
guacuugggaggcugaggcaggaggaucgcuu

SEQ ID NO: 205845 - RNA, 32 nt, Human
guacuugggaggcugaggugggaggauuaaug

SEQ ID NO: 205846 - RNA, 32 nt, Human
guacuugggccggugaguccagccucaggaac

SEQ ID NO: 205847 - RNA, 32 nt, Human
guacuugggggacugaggcgggaggaucacuu

SEQ ID NO: 205848 - RNA, 32 nt, Human
guacuugggugagggauguuggacagagccug

SEQ ID NO: 205849 - RNA, 32 nt, Human
guacuugguaggcuguggcaggagaauggcgu

SEQ ID NO: 205850 - RNA, 32 nt, Human
guacuuggugaggaagaguccuggaauggggc

SEQ ID NO: 205851 - RNA, 22 nt, Human
guacuugguuuuacuugggaga

SEQ ID NO: 205852 - RNA, 23 nt, Human
guacuuguauugucauuuggaga

SEQ ID NO: 205853 - RNA, 32 nt, Human
guacuuguccacccugccuccucuguucugaa

SEQ ID NO: 205854 - RNA, 32 nt, Human
guacuugucccuuuguugucguuguuguaguu

SEQ ID NO: 205855 - RNA, 32 nt, Human
guacuuguuucuaugcagaugccugggccgua

SEQ ID NO: 205856 - RNA, 23 nt, Human
guacuuuaacacauccuugaaag

SEQ ID NO: 205857 - RNA, 32 nt, Human
guacuuuacgugcucaccaaaguggugccacc

SEQ ID NO: 205858 - RNA, 32 nt, Human
guacuuugaugaucccuugugaucucacaaug

SEQ ID NO: 205859 - RNA, 32 nt, Human
guacuuugccaagggagagacaugaagacaga

SEQ ID NO: 205860 - RNA, 32 nt, Human
guacuuugccaaguaagcaucuuuacaccuaa

SEQ ID NO: 205861 - RNA, 32 nt, Human
guacuuugcucuggcaacccuagcaaagaaua

SEQ ID NO: 205862 - RNA, 32 nt, Human
guacuuuggaaccacuaacaccucugcacagg

SEQ ID NO: 205863 - RNA, 32 nt, Human
guacuuuggagacagaagguacuggcagcgag

SEQ ID NO: 205864 - RNA, 32 nt, Human
guacuuugggaggccgaaguggguggaucgcu

SEQ ID NO: 205865 - RNA, 32 nt, Human
guacuuuguggauauuuugcccagcaggaagu

SEQ ID NO: 205866 - RNA, 32 nt, Human
guacuuuuuagagugcacugagugcacuuuac

SEQ ID NO: 205867 - RNA, 18 nt, Human
guagaaaaaagacuggaa

SEQ ID NO: 205868 - RNA, 32 nt, Human
guagaaaaacucauucauacuacuuuucuaaa

SEQ ID NO: 205869 - RNA, 32 nt, Human
guagaaaaauggauugggcuggcagcucgaag

SEQ ID NO: 205870 - RNA, 32 nt, Human
guagaaaaccacccuucaaccugggugaugcu

SEQ ID NO: 205871 - RNA, 32 nt, Human
guagaaaagaugucacuucuuccuuuaaggcu

SEQ ID NO: 205872 - RNA, 32 nt, Human
guagaaacgguuuugccauguugcccaggcug

SEQ ID NO: 205873 - RNA, 32 nt, Human
guagaaacguaggaacaauuucgugaacgcaa

SEQ ID NO: 205874 - RNA, 32 nt, Human
guagaaagaaaaugucuguuuuccaaagauaa

SEQ ID NO: 205875 - RNA, 32 nt, Human
guagaaagagaagacccagagugaagaaguaa

SEQ ID NO: 205876 - RNA, 32 nt, Human
guagaaaggaagcacuucugagccagugacca

SEQ ID NO: 205877 - RNA, 32 nt, Human
guagaaaggaggaaggagggagagggaaguag

SEQ ID NO: 205878 - RNA, 32 nt, Human
guagaaaggggagggguggggcuaccagguag

SEQ ID NO: 205879 - RNA, 32 nt, Human
guagaaaucucucuuucacaugagcagggguu

SEQ ID NO: 205880 - RNA, 23 nt, Human
guagaaaugacaguugcuuaaug

SEQ ID NO: 205881 - RNA, 17 nt, Human
guagaaauggagaguga

SEQ ID NO: 205882 - RNA, 32 nt, Human
guagaaaugggcaaaaccccaucucuacuaaa

SEQ ID NO: 205883 - RNA, 32 nt, Human
guagaaauuacuugcaaaaugaaaugugaauu

SEQ ID NO: 205884 - RNA, 32 nt, Human
guagaaauuuuuauuuucauguaagcaaauuu

SEQ ID NO: 205885 - RNA, 32 nt, Human
guagaacauauauuaaucuacuggcgaauggg

SEQ ID NO: 205886 - RNA, 32 nt, Human
guagaacaucugcugucaaaggccagccuguc

SEQ ID NO: 205887 - RNA, 32 nt, Human
guagaacauucacuaacccauucauccaucca

SEQ ID NO: 205888 - RNA, 32 nt, Human
guagaaccaggaguuggauuuagcagucuggc

SEQ ID NO: 205889 - RNA, 32 nt, Human
guagaacuaaggcuucugcuuccuugcugcug

SEQ ID NO: 205890 - RNA, 32 nt, Human
guagaacugcaauuuccauucuuuuaaauggg

SEQ ID NO: 205891 - RNA, 32 nt, Human
guagaacuggaagcaaggcagcuaccuuuuug

SEQ ID NO: 205892 - RNA, 32 nt, Human
guagaacuguucauuuccaccaaggguaucug

SEQ ID NO: 205893 - RNA, 32 nt, Human
guagaacuugaaucuagaggaaccugacagcg

SEQ ID NO: 205894 - RNA, 23 nt, Human
guagaagaaaaagaaucauaaca

SEQ ID NO: 205895 - RNA, 32 nt, Human
guagaagaaagccaugguaaacugauacauaa

SEQ ID NO: 205896 - RNA, 32 nt, Human
guagaagaaggcaguuagagaaaacaaaguau

SEQ ID NO: 205897 - RNA, 32 nt, Human
guagaagaauuagaguagaaguugucgggguc

SEQ ID NO: 205898 - RNA, 32 nt, Human
guagaagacagaauucgaucugccugucccuu

SEQ ID NO: 205899 - RNA, 32 nt, Human
guagaagaggcugagggacacacagaggugac

SEQ ID NO: 205900 - RNA, 32 nt, Human
guagaagauggaccagccugaaaugaucuuga

SEQ ID NO: 205901 - RNA, 32 nt, Human
guagaagauguaugcaaagugaaaugccagcc

SEQ ID NO: 205902 - RNA, 32 nt, Human
guagaagcaagaacaagcuccucugcuuggua

SEQ ID NO: 205903 - RNA, 32 nt, Human
guagaagcaggucgggagagaccucccugggc

SEQ ID NO: 205904 - RNA, 32 nt, Human
guagaagccaucaccuggcccaugucccuaca

SEQ ID NO: 205905 - RNA, 32 nt, Human
guagaagcccaaucaccagcaguuuuuaaaaa

SEQ ID NO: 205906 - RNA, 32 nt, Human
guagaagcugcaagugagaaaccaacguggua

SEQ ID NO: 205907 - RNA, 32 nt, Human
guagaaggagagaaggggaguggaggaagcac

SEQ ID NO: 205908 - RNA, 32 nt, Human
guagaaggcaguggugacuggcauucagaagu

SEQ ID NO: 205909 - RNA, 32 nt, Human
guagaagggaagagaauuggugcugcagaagu

SEQ ID NO: 205910 - RNA, 32 nt, Human
guagaagguuaagaagagaaaaugcuaaauaa

SEQ ID NO: 205911 - RNA, 32 nt, Human
guagaaguccgaccgcggaagccagacugcug

SEQ ID NO: 205912 - RNA, 32 nt, Human
guagaagugaggaccuuccaggaggagcuuua

SEQ ID NO: 205913 - RNA, 22 nt, Human
guagaagugggugacccauuga

SEQ ID NO: 205914 - RNA, 24 nt, Human
guagaaguuauggcuuuucuuuca

SEQ ID NO: 205915 - RNA, 32 nt, Human
guagaauaguguuugucaacugucuuuucucu

SEQ ID NO: 205916 - RNA, 32 nt, Human
guagaauauuuuuauggcaagauauuuguggu

SEQ ID NO: 205917 - RNA, 32 nt, Human
guagaaucacaggauaauauauacaaauauau

SEQ ID NO: 205918 - RNA, 32 nt, Human
guagaaugaaguuuuacuugacagaaggaccu

SEQ ID NO: 205919 - RNA, 32 nt, Human
guagaaugcuccaugcuauuuuauggaaacuu

SEQ ID NO: 205920 - RNA, 32 nt, Human
guagaaugggcucaugggcaaugugauguucc

SEQ ID NO: 205921 - RNA, 29 nt, Human
guagaauguuacuugaguugugagaauuc

SEQ ID NO: 205922 - RNA, 32 nt, Human
guagaauuccagggcugccuugacuucuuccc

SEQ ID NO: 205923 - RNA, 32 nt, Human
guagaauugagcaggcuggcaauggcaguuuu

SEQ ID NO: 205924 - RNA, 32 nt, Human
guagaauuguuuccuaaagaaaaccacucuuu

SEQ ID NO: 205925 - RNA, 32 nt, Human
guagacaaaauggauauaaaugaaaauuacca

SEQ ID NO: 205926 - RNA, 22 nt, Human
guagacaaauaguccauccaca

SEQ ID NO: 205927 - RNA, 32 nt, Human
guagacaagucucucucauaccaacagaacuu

SEQ ID NO: 205928 - RNA, 32 nt, Human
guagacacaggcauguguucaggcuugagcug

SEQ ID NO: 205929 - RNA, 32 nt, Human
guagacacagugcccguccuggaguugcacca

SEQ ID NO: 205930 - RNA, 32 nt, Human
guagacagaagaggaagaaagaacagauguuc

SEQ ID NO: 205931 - RNA, 32 nt, Human
guagacagauccaggcucaccaguccugugcc

SEQ ID NO: 205932 - RNA, 32 nt, Human
guagacagcagcaaacagcagcagggaagcca

SEQ ID NO: 205933 - RNA, 32 nt, Human
guagacagcucugcagggaagucugugacaac

SEQ ID NO: 205934 - RNA, 32 nt, Human
guagacaggcugucucgcugacccuucuggcc

SEQ ID NO: 205935 - RNA, 32 nt, Human
guagacaggggagccaugcacagcaggaaaug

SEQ ID NO: 205936 - RNA, 32 nt, Human
guagacagggucucacuguguugcccaagcuu

SEQ ID NO: 205937 - RNA, 32 nt, Human
guagacagggucucccuauguugcccaggcug

SEQ ID NO: 205938 - RNA, 32 nt, Human
guagacaucaagcucuucuucugugaugaaac

SEQ ID NO: 205939 - RNA, 32 nt, Human
guagacaucuccccaccucuacccuaucagga

SEQ ID NO: 205940 - RNA, 32 nt, Human
guagacaucuuuccucacugccagccugccau

SEQ ID NO: 205941 - RNA, 32 nt, Human
guagacccauuuuacaggugagagaaccaagu

SEQ ID NO: 205942 - RNA, 32 nt, Human
guagaccccagccagggaggaguggaguuucu

SEQ ID NO: 205943 - RNA, 32 nt, Human
guagacccccuuccacagucccccuacagaag

SEQ ID NO: 205944 - RNA, 32 nt, Human
guagaccccugagaugaggccugagauagaug

SEQ ID NO: 205945 - RNA, 32 nt, Human
guagaccucucucaagcugccaccuccuugcu

SEQ ID NO: 205946 - RNA, 32 nt, Human
guagaccucuuuuucuuaccagucuccucccc

SEQ ID NO: 205947 - RNA, 32 nt, Human
guagaccugauuuucaaaaucugcccucagau

SEQ ID NO: 205948 - RNA, 32 nt, Human
guagacgccaugauggaugugucugguguggg

SEQ ID NO: 205949 - RNA, 32 nt, Human
guagacgggguuucaccaugugggccaggcug

SEQ ID NO: 205950 - RNA, 18 nt, Human
guagacgguuuccuccac

SEQ ID NO: 205951 - RNA, 32 nt, Human
guagacguggacuuagucauuacugggcagcu

SEQ ID NO: 205952 - RNA, 18 nt, Human
guagacuauguauuuccu

SEQ ID NO: 205953 - RNA, 32 nt, Human
guagacucaacagggucucccucuguugccca

SEQ ID NO: 205954 - RNA, 32 nt, Human
guagacuccaacaacagaaguggcaucugugu

SEQ ID NO: 205955 - RNA, 32 nt, Human
guagacucuguaaacaccuccuuacucacuau

SEQ ID NO: 205956 - RNA, 32 nt, Human
guagacuguaagcuccuugagggcaaggauug

SEQ ID NO: 205957 - RNA, 32 nt, Human
guagacuuaaggcuucauugugggguuaaaaa

SEQ ID NO: 205958 - RNA, 32 nt, Human
guagacuucaucccaauugucaaacauccuag

SEQ ID NO: 205959 - RNA, 32 nt, Human
guagacuuguaauccccaguguuggaggaggg

SEQ ID NO: 205960 - RNA, 32 nt, Human
guagagaaacuagaucuucccacagaacacug

SEQ ID NO: 205961 - RNA, 32 nt, Human
guagagaaagaaaauuuaggggccaguucuca

SEQ ID NO: 205962 - RNA, 32 nt, Human
guagagaaccuuguuucugcaggaagccuagc

SEQ ID NO: 205963 - RNA, 32 nt, Human
guagagacagggagacagggucucacuguguu

SEQ ID NO: 205964 - RNA, 32 nt, Human
guagagacagggguuucuuccauguugcccag

SEQ ID NO: 205965 - RNA, 32 nt, Human
guagagacaggguuucaccauguuaccaccgc

SEQ ID NO: 205966 - RNA, 32 nt, Human
guagagacccaacuuccaaagacugcaucaga

SEQ ID NO: 205967 - RNA, 32 nt, Human
guagagacgacaggguuucaccauguuggcca

SEQ ID NO: 205968 - RNA, 32 nt, Human
guagagacggggguuuucaccauguuggccag

SEQ ID NO: 205969 - RNA, 32 nt, Human
guagagacgggguuucaccacauugcucaggc

SEQ ID NO: 205970 - RNA, 32 nt, Human
guagagacgggguuucaccauguuaccaggau

SEQ ID NO: 205971 - RNA, 32 nt, Human
guagagacgggguuucaccguguuacggggau

SEQ ID NO: 205972 - RNA, 32 nt, Human
guagagacggguucaccauguugcccaggagg

SEQ ID NO: 205973 - RNA, 32 nt, Human
guagagacugucccuucugccuucgggcgugu

SEQ ID NO: 205974 - RNA, 32 nt, Human
guagagagacacacuaacagccacacccucug

SEQ ID NO: 205975 - RNA, 19 nt, Human
guagagagaggcaauuuaa

SEQ ID NO: 205976 - RNA, 21 nt, Human
guagagagaguauguauuuaa

SEQ ID NO: 205977 - RNA, 22 nt, Human
guagagagauaauaaaaaucaa

SEQ ID NO: 205978 - RNA, 32 nt, Human
guagagagaugggguuucgccauguugcccag

SEQ ID NO: 205979 - RNA, 32 nt, Human
guagagagccgggcuccugcggaugggggcug

SEQ ID NO: 205980 - RNA, 32 nt, Human
guagagaggagagagagugaacagggagcggg

SEQ ID NO: 205981 - RNA, 32 nt, Human
guagagaggaggucugggagaaagauggaaac

SEQ ID NO: 205982 - RNA, 32 nt, Human
guagagagggauggcuccccacccucagcguu

SEQ ID NO: 205983 - RNA, 32 nt, Human
guagagagggggcacuuaagagagggaagugg

SEQ ID NO: 205984 - RNA, 32 nt, Human
guagagagggggucucugaaggcccuuggggc

SEQ ID NO: 205985 - RNA, 21 nt, Human
guagagaguguugaaauucaa

SEQ ID NO: 205986 - RNA, 32 nt, Human
guagagauaaaugugugucacagugaagccag

SEQ ID NO: 205987 - RNA, 32 nt, Human
guagagauagggucucaccauguuggccaggc

SEQ ID NO: 205988 - RNA, 32 nt, Human
guagagauagggucucacuauguugaccaggc

SEQ ID NO: 205989 - RNA, 32 nt, Human
guagagaugaacugugugugaggccaaacugg

SEQ ID NO: 205990 - RNA, 32 nt, Human
guagagauggccucagagucuuuuccauucag

SEQ ID NO: 205991 - RNA, 32 nt, Human
guagagauggcugagugcaauggcucacacuu

SEQ ID NO: 205992 - RNA, 32 nt, Human
guagagauggggucucacccuguuggccaggc

SEQ ID NO: 205993 - RNA, 32 nt, Human
guagagauggggucucacuguguuagccagga

SEQ ID NO: 205994 - RNA, 32 nt, Human
guagagauggggucuugcuuuguugcccaggu

SEQ ID NO: 205995 - RNA, 32 nt, Human
guagagaugggguuucaccauggccaggcugg

SEQ ID NO: 205996 - RNA, 32 nt, Human
guagagaugggguuucaccauguuaccaggau

SEQ ID NO: 205997 - RNA, 32 nt, Human
guagagaugggguuucaccguguuaccaggau

SEQ ID NO: 205998 - RNA, 32 nt, Human
guagagaugguuucaccauguuggccaggcca

SEQ ID NO: 205999 - RNA, 32 nt, Human
guagagcagaaauuguauuuugcacgaacaug

SEQ ID NO: 206000 - RNA, 32 nt, Human
guagagcaguuagcaugauccaugguuauucc

SEQ ID NO: 206001 - RNA, 32 nt, Human
guagagcccugcuucccuucucugaccucaca

SEQ ID NO: 206002 - RNA, 20 nt, Human
guagagcccuggaauggaga

SEQ ID NO: 206003 - RNA, 32 nt, Human
guagagcccuggaauggagauguccuugacgc

SEQ ID NO: 206004 - RNA, 32 nt, Human
guagagccuagcaacagcgcaggcucccagcc

SEQ ID NO: 206005 - RNA, 32 nt, Human
guagagccuuuccuauuucccuuccugcugug

SEQ ID NO: 206006 - RNA, 18 nt, Human
guagagcgauaauuuuug

SEQ ID NO: 206007 - RNA, 32 nt, Human
guagagcuagccgcccugacugccuucagacc

SEQ ID NO: 206008 - RNA, 21 nt, Human
guagagcucagcaccacccua

SEQ ID NO: 206009 - RNA, 32 nt, Human
guagagcucaucugcauguugugugcagauac

SEQ ID NO: 206010 - RNA, 21 nt, Human
guagagcuguacuuuuucuuc

SEQ ID NO: 206011 - RNA, 32 nt, Human
guagagcugugcauuaaacuugcacaugacug

SEQ ID NO: 206012 - RNA, 32 nt, Human
guagagcuguucauuauggauauuucugcugc

SEQ ID NO: 206013 - RNA, 24 nt, Human
guagaggaaaaguauuuucucuca

SEQ ID NO: 206014 - RNA, 22 nt, Human
guagaggaaacugccuucuaca

SEQ ID NO: 206015 - RNA, 24 nt, Human
guagaggaaagagugaucuggugu

SEQ ID NO: 206016 - RNA, 23 nt, Human
guagaggaaucugggugcuucca

SEQ ID NO: 206017 - RNA, 32 nt, Human
guagaggagagaauugggggaguugcaggggg

SEQ ID NO: 206018 - RNA, 32 nt, Human
guagaggaggaaacuccucuccacaaauccac

SEQ ID NO: 206019 - RNA, 32 nt, Human
guagaggaugauggcgccuuuggccgaggggc

SEQ ID NO: 206020 - RNA, 32 nt, Human
guagaggaugcuuuucguuucacugggauccg

SEQ ID NO: 206021 - RNA, 32 nt, Human
guagaggcccugcaaggaccaggaugaaggga

SEQ ID NO: 206022 - RNA, 32 nt, Human
guagaggccuaccuugaauuaaggguuauacu

SEQ ID NO: 206023 - RNA, 21 nt, Human
guagaggcgcggggugcggag

SEQ ID NO: 206024 - RNA, 32 nt, Human
guagaggcugcagugagccaugaucaugccac

SEQ ID NO: 206025 - RNA, 32 nt, Human
guagaggcuucauaugagacccagaaagucua

SEQ ID NO: 206026 - RNA, 20 nt, Human
guagagggaaacagccacug

SEQ ID NO: 206027 - RNA, 32 nt, Human
guagagggacuacagcccugaggggcugcucc

SEQ ID NO: 206028 - RNA, 32 nt, Human
guagagggagagagaagagcaagggacgugga

SEQ ID NO: 206029 - RNA, 32 nt, Human
guagagggcagccucagaggcacugggcauuc

SEQ ID NO: 206030 - RNA, 32 nt, Human
guagaggggaccugcucagcaggugugaccag

SEQ ID NO: 206031 - RNA, 32 nt, Human
guagaggggccguggggguugaggcagggcaa

SEQ ID NO: 206032 - RNA, 32 nt, Human
guagagggggaaaaggagaaugaugaugauag

SEQ ID NO: 206033 - RNA, 32 nt, Human
guagagggggugggugcguaggaugugugagu

SEQ ID NO: 206034 - RNA, 32 nt, Human
guagaggggugaggaaggguaaggggcagggc

SEQ ID NO: 206035 - RNA, 32 nt, Human
guagaggucccucccaacuuccuuugaacugu

SEQ ID NO: 206036 - RNA, 32 nt, Human
guagaggucugccuagugagugagcaggagaa

SEQ ID NO: 206037 - RNA, 32 nt, Human
guagaggugggguuucaucguguuaccaggau

SEQ ID NO: 206038 - RNA, 32 nt, Human
guagaggugguguuuugccauguuucccaggc

SEQ ID NO: 206039 - RNA, 32 nt, Human
guagagguuagagaucaaagaagucagagaga

SEQ ID NO: 206040 - RNA, 32 nt, Human
guagagguucuaaaaagaaagugguauguugu

SEQ ID NO: 206041 - RNA, 32 nt, Human
guagaguaaaacugaacuccaaucccaccacc

SEQ ID NO: 206042 - RNA, 32 nt, Human
guagaguauuuuaauccuauuacuugacuaag

SEQ ID NO: 206043 - RNA, 32 nt, Human
guagagucacuggaacacuaaugaggaaacug

SEQ ID NO: 206044 - RNA, 32 nt, Human
guagagucggaggcggagagccuggacgccca

SEQ ID NO: 206045 - RNA, 24 nt, Human
guagagugacucgcaccuguaauc

SEQ ID NO: 206046 - RNA, 32 nt, Human
guagagugaggugagggucguggcuaaaaccc

SEQ ID NO: 206047 - RNA, 18 nt, Human
guagagugccgguucccu

SEQ ID NO: 206048 - RNA, 22 nt, Human
guagagugggggcagggggcag

SEQ ID NO: 206049 - RNA, 32 nt, Human
guagaguuauuuuucuugaagaggcagcucaa

SEQ ID NO: 206050 - RNA, 32 nt, Human
guagaguugcagcuguauacugcugaaaaugc

SEQ ID NO: 206051 - RNA, 32 nt, Human
guagauaaaauuacacuaguuuaaaauaugug

SEQ ID NO: 206052 - RNA, 32 nt, Human
guagauaccagaaccauuuuacauuugaggau

SEQ ID NO: 206053 - RNA, 32 nt, Human
guagauaccuuggccucagguggauauccagu

SEQ ID NO: 206054 - RNA, 32 nt, Human
guagauagagguggagacaggaaaaagacuaa

SEQ ID NO: 206055 - RNA, 32 nt, Human
guagauaggaaugaaaggaauuuugaaauaga

SEQ ID NO: 206056 - RNA, 32 nt, Human
guagauaguaaaaucacuggcuuuuuccagcu

SEQ ID NO: 206057 - RNA, 32 nt, Human
guagaucaauuugagcuuuaacuacuggagaa

SEQ ID NO: 206058 - RNA, 32 nt, Human
guagaucacaggcugagggacagagcaaagac

SEQ ID NO: 206059 - RNA, 32 nt, Human
guagaucacugcauccgguuccuccucuuucu

SEQ ID NO: 206060 - RNA, 32 nt, Human
guagaucagagacuuggaguggucaagggaga

SEQ ID NO: 206061 - RNA, 32 nt, Human
guagauccuguuuugggguuugcacauggauc

SEQ ID NO: 206062 - RNA, 32 nt, Human
guagaucucaaaggaucuugcuuuaacuuuca

SEQ ID NO: 206063 - RNA, 32 nt, Human
guagaucuucuucacauauucccccuggaagg

SEQ ID NO: 206064 - RNA, 32 nt, Human
guagaugacaucuugcuacagcuuuuauuugu

SEQ ID NO: 206065 - RNA, 32 nt, Human
guagaugagccuuuuaguagagcugauuuauu

SEQ ID NO: 206066 - RNA, 32 nt, Human
guagaugaguacugcguuuuucuuuuauggac

SEQ ID NO: 206067 - RNA, 32 nt, Human
guagaugcagcaaaccaccauggcacacauuu

SEQ ID NO: 206068 - RNA, 22 nt, Human
guagaugccuguaauuccagcu

SEQ ID NO: 206069 - RNA, 32 nt, Human
guagaugcggggagggcuggugaccuccgugg

SEQ ID NO: 206070 - RNA, 32 nt, Human
guagaugcggucucaguauguugcccaggcug

SEQ ID NO: 206071 - RNA, 32 nt, Human
guagaugcugggacagcauuagaagagggucu

SEQ ID NO: 206072 - RNA, 32 nt, Human
guagaugcuguggcuuuguguugcguuuugug

SEQ ID NO: 206073 - RNA, 32 nt, Human
guagaugcuucucagaacaugaaaucaaauug

SEQ ID NO: 206074 - RNA, 32 nt, Human
guagauggcagggggaggauuugaagccuggg

SEQ ID NO: 206075 - RNA, 32 nt, Human
guagaugggaggacauuucuggucagggaacu

SEQ ID NO: 206076 - RNA, 32 nt, Human
guagaugggagguggaaucuguaggaaagaga

SEQ ID NO: 206077 - RNA, 32 nt, Human
guagaugggauuauaggcaugugccacggugc

SEQ ID NO: 206078 - RNA, 32 nt, Human
guagauggggucucacuauguugcccaggcug

SEQ ID NO: 206079 - RNA, 32 nt, Human
guagaugguaaagagaaugaggagaaaaagga

SEQ ID NO: 206080 - RNA, 32 nt, Human
guagauguaccccuaucgauucuuuuaaagua

SEQ ID NO: 206081 - RNA, 23 nt, Human
guagauguaucuuugggcagcug

SEQ ID NO: 206082 - RNA, 32 nt, Human
guagauguguuuucagagcuagguacagagga

SEQ ID NO: 206083 - RNA, 32 nt, Human
guagauguugccuggugcaaagugccccaaac

SEQ ID NO: 206084 - RNA, 32 nt, Human
guagauguuuuccucucucuugcugaccccuc

SEQ ID NO: 206085 - RNA, 32 nt, Human
guagauuagagcuucuguuucuaaucuacaaa

SEQ ID NO: 206086 - RNA, 32 nt, Human
guagauucaaaaggugcuuccuucccggcugu

SEQ ID NO: 206087 - RNA, 32 nt, Human
guagauucugauuuccgaauggugcugcggaa

SEQ ID NO: 206088 - RNA, 32 nt, Human
guagauugcaccacugcacucuagccugggua

SEQ ID NO: 206089 - RNA, 20 nt, Human
guagauugcuugagcccagg

SEQ ID NO: 206090 - RNA, 32 nt, Human
guagauuuauagaccauuucuguuggccagga

SEQ ID NO: 206091 - RNA, 32 nt, Human
guagauuucccaggaaacucaggcuugggaca

SEQ ID NO: 206092 - RNA, 32 nt, Human
guagauuugcugaaauggagaaacaaagacaa

SEQ ID NO: 206093 - RNA, 32 nt, Human
guagauuuggagaggaaggauggagguggacu

SEQ ID NO: 206094 - RNA, 32 nt, Human
guagauuuuaauuugacucacaguuugaagca

SEQ ID NO: 206095 - RNA, 32 nt, Human
guagauuuuacuuucaacuuuuuaaucaguau

SEQ ID NO: 206096 - RNA, 32 nt, Human
guagcaaaaaggaagauuguucauggccuuua

SEQ ID NO: 206097 - RNA, 32 nt, Human
guagcaaaaggugucugcauucugagccucuu

SEQ ID NO: 206098 - RNA, 32 nt, Human
guagcaaagaacuaaaggaggggaagaaaagc

SEQ ID NO: 206099 - RNA, 32 nt, Human
guagcaaagauuugaaccgucugucuuuuuaa

SEQ ID NO: 206100 - RNA, 32 nt, Human
guagcaaagcgauucuuuucaucuucggcgag

SEQ ID NO: 206101 - RNA, 32 nt, Human
guagcaacauccagagaucauucuuccauacu

SEQ ID NO: 206102 - RNA, 32 nt, Human
guagcaaccaaaagguugguugaaggaaacaa

SEQ ID NO: 206103 - RNA, 32 nt, Human
guagcaacuguuugauuucuuucuggauacag

SEQ ID NO: 206104 - RNA, 32 nt, Human
guagcaagaaucuaaguaaaucugccaugggu

SEQ ID NO: 206105 - RNA, 21 nt, Human
guagcaagugcugcccuuuau

SEQ ID NO: 206106 - RNA, 32 nt, Human
guagcaauaaacauguauaucaaaagaauaga

SEQ ID NO: 206107 - RNA, 32 nt, Human
guagcaauagggagagugaaaauauguauucu

SEQ ID NO: 206108 - RNA, 32 nt, Human
guagcacaaauuugagcgaggcccugucaauu

SEQ ID NO: 206109 - RNA, 32 nt, Human
guagcacaacuuccuuuccuuucaguucugcc

SEQ ID NO: 206110 - RNA, 22 nt, Human
guagcacacaccuguaguccca

SEQ ID NO: 206111 - RNA, 22 nt, Human
guagcacacgccuguaauccca

SEQ ID NO: 206112 - RNA, 22 nt, Human
guagcacacgccuguaauucca

SEQ ID NO: 206113 - RNA, 32 nt, Human
guagcacaggcggagugcagcggaggccccug

SEQ ID NO: 206114 - RNA, 32 nt, Human
guagcacaguaaugacuguacaugucauugua

SEQ ID NO: 206115 - RNA, 32 nt, Human
guagcacagugaauguaugccaaaugcaaguc

SEQ ID NO: 206116 - RNA, 22 nt, Human
guagcacauaccuguaauccca

SEQ ID NO: 206117 - RNA, 32 nt, Human
guagcaccacugcacuucagccuggacaacag

SEQ ID NO: 206118 - RNA, 32 nt, Human
guagcaccuggcugagccuggcuggcacagaa

SEQ ID NO: 206119 - RNA, 32 nt, Human
guagcacgccugcuggcagagguaccuggugg

SEQ ID NO: 206120 - RNA, 32 nt, Human
guagcacguaugcauggauauguaugucuuug

SEQ ID NO: 206121 - RNA, 32 nt, Human
guagcacuaagccagcuggccuaaagaugcaa

SEQ ID NO: 206122 - RNA, 32 nt, Human
guagcacuaaugaucaauaucauucauucauu

SEQ ID NO: 206123 - RNA, 32 nt, Human
guagcacucccggaacuggaacuaggugccag

SEQ ID NO: 206124 - RNA, 32 nt, Human
guagcacugaucaguccucccacuuuaccauc

SEQ ID NO: 206125 - RNA, 32 nt, Human
guagcacugcaguccagccugggcgacagagu

SEQ ID NO: 206126 - RNA, 32 nt, Human
guagcacuuaaauauaucugauagcaacacuu

SEQ ID NO: 206127 - RNA, 32 nt, Human
guagcagaaauggaacaggaaaaguuugaucu

SEQ ID NO: 206128 - RNA, 32 nt, Human
guagcagaagcagagggaggccucuugccuga

SEQ ID NO: 206129 - RNA, 32 nt, Human
guagcagacaggcugcccaagguaugaagcag

SEQ ID NO: 206130 - RNA, 32 nt, Human
guagcagaucccugguucaggucuagggcaag

SEQ ID NO: 206131 - RNA, 22 nt, Human
guagcagaugcuuguaauccca

SEQ ID NO: 206132 - RNA, 32 nt, Human
guagcagauuuucacacaugugcauugcagag

SEQ ID NO: 206133 - RNA, 32 nt, Human
guagcagcaaaguguacagucugaaaccguau

SEQ ID NO: 206134 - RNA, 32 nt, Human
guagcagcacacacuucacaaagccaagccua

SEQ ID NO: 206135 - RNA, 20 nt, Human
guagcagcagcugcccccca

SEQ ID NO: 206136 - RNA, 32 nt, Human
guagcagcccugccuuucauagcagggauuac

SEQ ID NO: 206137 - RNA, 32 nt, Human
guagcagccgccgccuccaggugcagguucuc

SEQ ID NO: 206138 - RNA, 32 nt, Human
guagcagccuccugccugcuccaagaaaaggg

SEQ ID NO: 206139 - RNA, 32 nt, Human
guagcagcuccaaagcauuggaugcuggauaa

SEQ ID NO: 206140 - RNA, 32 nt, Human
guagcagcuccaacagggguccagccugcauc

SEQ ID NO: 206141 - RNA, 32 nt, Human
guagcaggaccugccaagaagauuccuucuaa

SEQ ID NO: 206142 - RNA, 22 nt, Human
guagcaggagccuguaauccca

SEQ ID NO: 206143 - RNA, 22 nt, Human
guagcaggcaccuguaacccca

SEQ ID NO: 206144 - RNA, 22 nt, Human
guagcaggcaccuguaauccca

SEQ ID NO: 206145 - RNA, 22 nt, Human
guagcaggcgcuuguaauccca

SEQ ID NO: 206146 - RNA, 32 nt, Human
guagcagggcagggguuggaggagcgaggagc

SEQ ID NO: 206147 - RNA, 22 nt, Human
guagcaggugccuguaauccca

SEQ ID NO: 206148 - RNA, 32 nt, Human
guagcagguggagggccaggauugguggguga

SEQ ID NO: 206149 - RNA, 32 nt, Human
guagcaguaucuguccugccagucccaaggcc

SEQ ID NO: 206150 - RNA, 32 nt, Human
guagcagucacacccuagccacugcugggacc

SEQ ID NO: 206151 - RNA, 18 nt, Human
guagcaguccucccagca

SEQ ID NO: 206152 - RNA, 32 nt, Human
guagcaguugcucccgcacuccaggccugugc

SEQ ID NO: 206153 - RNA, 32 nt, Human
guagcaguuucuuuggcugccugggccccuug

SEQ ID NO: 206154 - RNA, 32 nt, Human
guagcauaauagagucucucagccuuugcuua

SEQ ID NO: 206155 - RNA, 32 nt, Human
guagcaucucugaaaggggguaccaggaagca

SEQ ID NO: 206156 - RNA, 32 nt, Human
guagcaugaaauaucacugacacuccagacua

SEQ ID NO: 206157 - RNA, 22 nt, Human
guagcaugcgccuauaguccca

SEQ ID NO: 206158 - RNA, 22 nt, Human
guagcaugcgccuguaguccca

SEQ ID NO: 206159 - RNA, 32 nt, Human
guagcauggagcaggcuucauuccuuuuuaug

SEQ ID NO: 206160 - RNA, 22 nt, Human
guagcaugugccuguaauccca

SEQ ID NO: 206161 - RNA, 32 nt, Human
guagcaugugcuggauuauuagugcagcagcu

SEQ ID NO: 206162 - RNA, 32 nt, Human
guagcauucccccuucccucuguuaggaacca

SEQ ID NO: 206163 - RNA, 32 nt, Human
guagcauugggccaggccuggcauucaaggga

SEQ ID NO: 206164 - RNA, 32 nt, Human
guagcauuugugaauaaauguguaggugcugu

SEQ ID NO: 206165 - RNA, 32 nt, Human
guagcauuuuucaccuucauagcauacuccuu

SEQ ID NO: 206166 - RNA, 32 nt, Human
guagccaaaggcaguugccugugccuugggca

SEQ ID NO: 206167 - RNA, 22 nt, Human
guagccaacuaccaacgugccu

SEQ ID NO: 206168 - RNA, 21 nt, Human
guagccaauguuaucccagca

SEQ ID NO: 206169 - RNA, 32 nt, Human
guagccacaccaggauagagacuggaacacua

SEQ ID NO: 206170 - RNA, 32 nt, Human
guagccacagcggcagcuccagcccggcccgg

SEQ ID NO: 206171 - RNA, 32 nt, Human
guagccacaucucuccacuucuugccuuuugg

SEQ ID NO: 206172 - RNA, 32 nt, Human
guagccaccauccuguuguauacuaggagaga

SEQ ID NO: 206173 - RNA, 32 nt, Human
guagccacugcacuccagccugggcaacgugg

SEQ ID NO: 206174 - RNA, 32 nt, Human
guagccagaaugcccuguucaugcugagcaaa

SEQ ID NO: 206175 - RNA, 32 nt, Human
guagccagagucagguuggaaaguaagucacc

SEQ ID NO: 206176 - RNA, 18 nt, Human
guagccagcaucugccuc

SEQ ID NO: 206177 - RNA, 32 nt, Human
guagccagcugcagaagaaucuggaucauuag

SEQ ID NO: 206178 - RNA, 32 nt, Human
guagccagcuuggagacuucucagccaaugcu

SEQ ID NO: 206179 - RNA, 21 nt, Human
guagccaggaguugacuugcc

SEQ ID NO: 206180 - RNA, 32 nt, Human
guagccaggcuggagggcaauuguacaaucuc

SEQ ID NO: 206181 - RNA, 22 nt, Human
guagccagggcaggccgggccu

SEQ ID NO: 206182 - RNA, 22 nt, Human
guagccagggcccugccagccu

SEQ ID NO: 206183 - RNA, 21 nt, Human
guagccagggcuccggcugcu

SEQ ID NO: 206184 - RNA, 23 nt, Human
guagccagggguguacagugccu

SEQ ID NO: 206185 - RNA, 32 nt, Human
guagccaggguaagggguaaaaggauaguaag

SEQ ID NO: 206186 - RNA, 19 nt, Human
guagccaggucccccugca

SEQ ID NO: 206187 - RNA, 32 nt, Human
guagccaguuuggggagugggcugcaaggggc

SEQ ID NO: 206188 - RNA, 32 nt, Human
guagccauaguacacacacaacacgcuaucag

SEQ ID NO: 206189 - RNA, 32 nt, Human
guagccaucucucuguucugcauuaucuuaug

SEQ ID NO: 206190 - RNA, 32 nt, Human
guagccauuugcuguuaucugggaaacaagau

SEQ ID NO: 206191 - RNA, 22 nt, Human
guagcccacgccucuaauccca

SEQ ID NO: 206192 - RNA, 32 nt, Human
guagcccagaagccuccggcggcccaggauuc

SEQ ID NO: 206193 - RNA, 24 nt, Human
guagcccaggccagagugcagugg

SEQ ID NO: 206194 - RNA, 24 nt, Human
guagcccaggcuggagugcaaugg

SEQ ID NO: 206195 - RNA, 24 nt, Human
guagcccaggcugggaugcaaugg

SEQ ID NO: 206196 - RNA, 32 nt, Human
guagcccaggguggaggcagaacgaugcugcu

SEQ ID NO: 206197 - RNA, 32 nt, Human
guagcccauucuugauccagagcuguugccug

SEQ ID NO: 206198 - RNA, 32 nt, Human
guagccccaagaggaaggagccucagagagcc

SEQ ID NO: 206199 - RNA, 32 nt, Human
guagccccagcagcagcacccugcaagccagc

SEQ ID NO: 206200 - RNA, 32 nt, Human
guagcccccgaacuauuucucuacguuuucuc

SEQ ID NO: 206201 - RNA, 32 nt, Human
guagcccccgcccagcuggcccucucugaccu

SEQ ID NO: 206202 - RNA, 32 nt, Human
guagcccccuaaaugggcaagcaaggagcccc

SEQ ID NO: 206203 - RNA, 32 nt, Human
guagcccccucggugggcccagggccuagggg

SEQ ID NO: 206204 - RNA, 32 nt, Human
guagcccccugccuuacuguccuggcacaccc

SEQ ID NO: 206205 - RNA, 32 nt, Human
guagcccccuggccugugcaagcccugacucc

SEQ ID NO: 206206 - RNA, 32 nt, Human
guagccccuccccagccuucuuucucucccag

SEQ ID NO: 206207 - RNA, 32 nt, Human
guagccccugcaggaacaagcccuaaucugga

SEQ ID NO: 206208 - RNA, 32 nt, Human
guagcccgaccgccgagaugcccagcccgccg

SEQ ID NO: 206209 - RNA, 32 nt, Human
guagcccgagggaguccaggaggcucuccaag

SEQ ID NO: 206210 - RNA, 32 nt, Human
guagcccuaccuaacugguagcauuugccacu

SEQ ID NO: 206211 - RNA, 32 nt, Human
guagcccucaaugacugacagugcaaguggau

SEQ ID NO: 206212 - RNA, 32 nt, Human
guagcccuccuugcgccuccgauucccagaca

SEQ ID NO: 206213 - RNA, 32 nt, Human
guagcccucucaucgucuuuuaguuccaacaa

SEQ ID NO: 206214 - RNA, 32 nt, Human
guagcccuggcccagccgccuuccugggagag

SEQ ID NO: 206215 - RNA, 32 nt, Human
guagccgaggccaggccacuucugcugaggau

SEQ ID NO: 206216 - RNA, 32 nt, Human
guagccgaggggcaggcgggggaccucuacac

SEQ ID NO: 206217 - RNA, 32 nt, Human
guagccgcccacacaccaugagcccagauugu

SEQ ID NO: 206218 - RNA, 20 nt, Human
guagccgccuccucccagca

SEQ ID NO: 206219 - RNA, 32 nt, Human
guagccggcaguuacuggcaacuugugagcuu

SEQ ID NO: 206220 - RNA, 32 nt, Human
guagccgggcaguggaggucccggaugaggcg

SEQ ID NO: 206221 - RNA, 32 nt, Human
guagccgucauccucacagcugcagggccagg

SEQ ID NO: 206222 - RNA, 32 nt, Human
guagccuaccaaagcuguagaaaucuaggacu

SEQ ID NO: 206223 - RNA, 31 nt, Human
guagccuaggaacugccucagugucuuugcc

SEQ ID NO: 206224 - RNA, 24 nt, Human
guagccucaaacucccaggcucaa

SEQ ID NO: 206225 - RNA, 23 nt, Human
guagccucaucucccaggcucaa

SEQ ID NO: 206226 - RNA, 24 nt, Human
guagccuccaaccccugggcucaa

SEQ ID NO: 206227 - RNA, 32 nt, Human
guagccuccgccucagccucuggaguagcugg

SEQ ID NO: 206228 - RNA, 32 nt, Human
guagccuccgccuccagggcucaagggauccu

SEQ ID NO: 206229 - RNA, 19 nt, Human
guagccuccuccugggcuc

SEQ ID NO: 206230 - RNA, 32 nt, Human
guagccuccuuuccuccccuucugccuucccc

SEQ ID NO: 206231 - RNA, 24 nt, Human
guagccucgaauuccugggcucaa

SEQ ID NO: 206232 - RNA, 26 nt, Human
guagccucgaccuccccugggcucaa

SEQ ID NO: 206233 - RNA, 24 nt, Human
guagccucgaccuuccaggcucaa

SEQ ID NO: 206234 - RNA, 32 nt, Human
guagccucugcaggaacaagcccuaaucugga

SEQ ID NO: 206235 - RNA, 32 nt, Human
guagccugagucuuucaguagacuacacugcc

SEQ ID NO: 206236 - RNA, 32 nt, Human
guagccugcagaaaccaggaagauaaaacaac

SEQ ID NO: 206237 - RNA, 31 nt, Human
guagccuggcuuuucuggcuggggauggccg

SEQ ID NO: 206238 - RNA, 32 nt, Human
guagccugggcaacacagcaagaccccaucua

SEQ ID NO: 206239 - RNA, 19 nt, Human
guagccugggcuuccagca

SEQ ID NO: 206240 - RNA, 32 nt, Human
guagccugggggauguccagagacuaggccuc

SEQ ID NO: 206241 - RNA, 23 nt, Human
guagccugggugacaaagugaga

SEQ ID NO: 206242 - RNA, 32 nt, Human
guagccuguaauggguaaaagccacauuuagg

SEQ ID NO: 206243 - RNA, 32 nt, Human
guagccuucaugggcacgccucugcuggaaac

SEQ ID NO: 206244 - RNA, 24 nt, Human
guagccuugaacucccgggcucaa

SEQ ID NO: 206245 - RNA, 32 nt, Human
guagccuuucaauuuggugcucugucuggcug

SEQ ID NO: 206246 - RNA, 32 nt, Human
guagccuuuggggugaggggacuugggcggcc

SEQ ID NO: 206247 - RNA, 32 nt, Human
guagcgagagaagagagaaaaugaagucggcg

SEQ ID NO: 206248 - RNA, 21 nt, Human
guagcgagcgccccgaaggag

SEQ ID NO: 206249 - RNA, 22 nt, Human
guagcgcacaccuguaauucca

SEQ ID NO: 206250 - RNA, 22 nt, Human
guagcgcacgccuguaauccca

SEQ ID NO: 206251 - RNA, 22 nt, Human
guagcgcaucgcuguaauccca

SEQ ID NO: 206252 - RNA, 32 nt, Human
guagcgcgggagcagggcacugugcugcugcu

SEQ ID NO: 206253 - RNA, 32 nt, Human
guagcgcuggcccuagccucuggcagagccug

SEQ ID NO: 206254 - RNA, 32 nt, Human
guagcgcugggaaggacgggugaggcagggga

SEQ ID NO: 206255 - RNA, 32 nt, Human
guagcggacgccccucgacccacccacccgau

SEQ ID NO: 206256 - RNA, 32 nt, Human
guagcggauuacaggcgcccaccaccaaaaau

SEQ ID NO: 206257 - RNA, 22 nt, Human
guagcgggcgccuguaguccca

SEQ ID NO: 206258 - RNA, 32 nt, Human
guagcggggcugcccagaacccugccaaccaa

SEQ ID NO: 206259 - RNA, 22 nt, Human
guagcgggugccuguaauccca

SEQ ID NO: 206260 - RNA, 32 nt, Human
guagcgguuuuuaaaaaccauauacugacuga

SEQ ID NO: 206261 - RNA, 32 nt, Human
guagcguggccgugugcauguccuuugcgccu

SEQ ID NO: 206262 - RNA, 32 nt, Human
guagcuaaagaaugccauggccgggugcagug

SEQ ID NO: 206263 - RNA, 32 nt, Human
guagcuaagcugcuucagugaucuucacauuu

SEQ ID NO: 206264 - RNA, 32 nt, Human
guagcuaaggaaaugccuucuguugggaaaag

SEQ ID NO: 206265 - RNA, 32 nt, Human
guagcuacuggcaguggggugugaauaaagag

SEQ ID NO: 206266 - RNA, 32 nt, Human
guagcuagagcggcucagagacaggaggcggc

SEQ ID NO: 206267 - RNA, 32 nt, Human
guagcuagcugcagagaaucucacugcccacu

SEQ ID NO: 206268 - RNA, 32 nt, Human
guagcuaggacuacaaggcacaccaccaugcc

SEQ ID NO: 206269 - RNA, 32 nt, Human
guagcuaggacuacagcagcaugccacaaugu

SEQ ID NO: 206270 - RNA, 32 nt, Human
guagcuaggacuacaggcgcccaccaccacac

SEQ ID NO: 206271 - RNA, 32 nt, Human
guagcuaggacuacaggugcccgccaccacac

SEQ ID NO: 206272 - RNA, 32 nt, Human
guagcuaggacuacaggugugcaccaccacgc

SEQ ID NO: 206273 - RNA, 32 nt, Human
guagcuaggacuacaggugugcaccaccaugc

SEQ ID NO: 206274 - RNA, 32 nt, Human
guagcuaggacuauggguacauuccacagugc

SEQ ID NO: 206275 - RNA, 32 nt, Human
guagcuagguacaggcaccugccaccacaccc

SEQ ID NO: 206276 - RNA, 32 nt, Human
guagcuagguucuagguuugaaacagaugcag

SEQ ID NO: 206277 - RNA, 32 nt, Human
guagcuauuccacccucugccugccugccugc

SEQ ID NO: 206278 - RNA, 22 nt, Human
guagcucaaaccuauaauccca

SEQ ID NO: 206279 - RNA, 22 nt, Human
guagcucaagccuguaauccca

SEQ ID NO: 206280 - RNA, 23 nt, Human
guagcucacacccuguaauccca

SEQ ID NO: 206281 - RNA, 22 nt, Human
guagcucacaccuauaauccca

SEQ ID NO: 206282 - RNA, 22 nt, Human
guagcucacaccuauaauccua

SEQ ID NO: 206283 - RNA, 19 nt, Human
guagcucacaccuguaauc

SEQ ID NO: 206284 - RNA, 22 nt, Human
guagcucacaccuguaauccca

SEQ ID NO: 206285 - RNA, 22 nt, Human
guagcucacaccuguaauccua

SEQ ID NO: 206286 - RNA, 21 nt, Human
guagcucacaccuguaguccc

SEQ ID NO: 206287 - RNA, 22 nt, Human
guagcucaccccuguaauccca

SEQ ID NO: 206288 - RNA, 22 nt, Human
guagcucacccuuguaauccca

SEQ ID NO: 206289 - RNA, 22 nt, Human
guagcucacgccuguaauccca

SEQ ID NO: 206290 - RNA, 22 nt, Human
guagcucacgccuguaauucca

SEQ ID NO: 206291 - RNA, 22 nt, Human
guagcucacgccuguauuccca

SEQ ID NO: 206292 - RNA, 32 nt, Human
guagcucacugcagccuccaacuccauggcuc

SEQ ID NO: 206293 - RNA, 32 nt, Human
guagcucacugcagucuucagccuccccagua

SEQ ID NO: 206294 - RNA, 32 nt, Human
guagcucagaaauuaagaaagaaugguauaau

SEQ ID NO: 206295 - RNA, 32 nt, Human
guagcucauacagcuuugaagcagcagcagga

SEQ ID NO: 206296 - RNA, 32 nt, Human
guagcucauacuuguaacccagcacuuuggga

SEQ ID NO: 206297 - RNA, 22 nt, Human
guagcucaugccuauaauccca

SEQ ID NO: 206298 - RNA, 21 nt, Human
guagcucaugccuguaauccc

SEQ ID NO: 206299 - RNA, 22 nt, Human
guagcucaugccuguaauccca

SEQ ID NO: 206300 - RNA, 22 nt, Human
guagcucaugcuuguaauccca

SEQ ID NO: 206301 - RNA, 22 nt, Human
guagcucaugcuuguaaucuca

SEQ ID NO: 206302 - RNA, 22 nt, Human
guagcucaugucuguaauccca

SEQ ID NO: 206303 - RNA, 32 nt, Human
guagcuccagccgccgcgcucccagccccggc

SEQ ID NO: 206304 - RNA, 32 nt, Human
guagcucccacaauuccccugugucaugggag

SEQ ID NO: 206305 - RNA, 32 nt, Human
guagcuccuaacuguugugugauuuggacggc

SEQ ID NO: 206306 - RNA, 32 nt, Human
guagcuccugcaggcaggggcaguuuguugcg

SEQ ID NO: 206307 - RNA, 32 nt, Human
guagcuccuuuuggguucuggcugccauccuu

SEQ ID NO: 206308 - RNA, 32 nt, Human
guagcucgcagagaucacagaaaugcuugcag

SEQ ID NO: 206309 - RNA, 32 nt, Human
guagcucgggcuucuaugaagaucccagcucu

SEQ ID NO: 206310 - RNA, 22 nt, Human
guagcucguggcuguaauccca

SEQ ID NO: 206311 - RNA, 32 nt, Human
guagcucucuggagucaaagagaggccugcuu

SEQ ID NO: 206312 - RNA, 32 nt, Human
guagcucugccucccucuccauaucuccuucc

SEQ ID NO: 206313 - RNA, 32 nt, Human
guagcucuuaguccucccugcucagcuggccg

SEQ ID NO: 206314 - RNA, 32 nt, Human
guagcucuugcauccuccucccaacucuagcc

SEQ ID NO: 206315 - RNA, 32 nt, Human
guagcucuugugucuguggacucugcucagcu

SEQ ID NO: 206316 - RNA, 32 nt, Human
guagcugaaauaaucauaucuuucugaugucu

SEQ ID NO: 206317 - RNA, 32 nt, Human
guagcugaaauacugucuaucucuaauaaaaa

SEQ ID NO: 206318 - RNA, 32 nt, Human
guagcugaaaugcgaaaaaggcagcaguccca

SEQ ID NO: 206319 - RNA, 32 nt, Human
guagcugaacgucuggaugguggagaagagca

SEQ ID NO: 206320 - RNA, 32 nt, Human
guagcugagcaguggcagcagagaggcagacg

SEQ ID NO: 206321 - RNA, 32 nt, Human
guagcugaggaagaagggaggcuucacagcau

SEQ ID NO: 206322 - RNA, 32 nt, Human
guagcugaggccacaggagcuggagggauugc

SEQ ID NO: 206323 - RNA, 32 nt, Human
guagcugaggccacuacugaccugccagggau

SEQ ID NO: 206324 - RNA, 32 nt, Human
guagcugaugaaaaggagcaugaugaacaaca

SEQ ID NO: 206325 - RNA, 32 nt, Human
guagcugcauauauuugucaacauuccucaug

SEQ ID NO: 206326 - RNA, 32 nt, Human
guagcugccaaaaagaacacccaucguauaag

SEQ ID NO: 206327 - RNA, 32 nt, Human
guagcugccauggcuagguagaagugagcaaa

SEQ ID NO: 206328 - RNA, 32 nt, Human
guagcugccccaguguaugucuugccuucucc

SEQ ID NO: 206329 - RNA, 32 nt, Human
guagcugcgggagggggagggggagugggcgg

SEQ ID NO: 206330 - RNA, 32 nt, Human
guagcugcugucacugacucccggcuauacau

SEQ ID NO: 206331 - RNA, 25 nt, Human
guagcugcuguuauuugcuugguua

SEQ ID NO: 206332 - RNA, 21 nt, Human
guagcugcuuccuggacgugc

SEQ ID NO: 206333 - RNA, 32 nt, Human
guagcugcuuugcagguacaucaugugacagu

SEQ ID NO: 206334 - RNA, 32 nt, Human
guagcuggaauacgcaucucuccagcauuccg

SEQ ID NO: 206335 - RNA, 32 nt, Human
guagcuggagugaugcagggaggaaaggcaga

SEQ ID NO: 206336 - RNA, 32 nt, Human
guagcugggaauauaggugugagccaccacgc

SEQ ID NO: 206337 - RNA, 32 nt, Human
guagcugggacuacaagugugagccacugugc

SEQ ID NO: 206338 - RNA, 32 nt, Human
guagcugggacuacaggcaugagccaccaugc

SEQ ID NO: 206339 - RNA, 32 nt, Human
guagcugggacuacaggcaugagccaccgugc

SEQ ID NO: 206340 - RNA, 32 nt, Human
guagcugggacuacaggugcaccaccacaccu

SEQ ID NO: 206341 - RNA, 32 nt, Human
guagcugggacuacaggugugccaccacgccu

SEQ ID NO: 206342 - RNA, 32 nt, Human
guagcugggacuacaguugugccaccacgucc

SEQ ID NO: 206343 - RNA, 32 nt, Human
guagcugggacuauuuugcaugcugaaacuuc

SEQ ID NO: 206344 - RNA, 32 nt, Human
guagcugggacuucaggagacugaagccaagg

SEQ ID NO: 206345 - RNA, 32 nt, Human
guagcugggauuacaagcaccagccaccaugc

SEQ ID NO: 206346 - RNA, 32 nt, Human
guagcugggauuacaagcaugcgccaccaugc

SEQ ID NO: 206347 - RNA, 32 nt, Human
guagcugggauuacaagugcacacuaccacgc

SEQ ID NO: 206348 - RNA, 32 nt, Human
guagcugggauuacaagugcgcacuaccacac

SEQ ID NO: 206349 - RNA, 32 nt, Human
guagcugggauuacagacaugccaccaugcca

SEQ ID NO: 206350 - RNA, 32 nt, Human
guagcugggauuacagacaugugccaccacgc

SEQ ID NO: 206351 - RNA, 32 nt, Human
guagcugggauuacagaugggaccaccuaguu

SEQ ID NO: 206352 - RNA, 32 nt, Human
guagcugggauuacagaugugagccaccguac

SEQ ID NO: 206353 - RNA, 32 nt, Human
guagcugggauuacagaugugugccacaucug

SEQ ID NO: 206354 - RNA, 19 nt, Human
guagcugggauuacagcug

SEQ ID NO: 206355 - RNA, 32 nt, Human
guagcugggauuacaggagcaugccacaagac

SEQ ID NO: 206356 - RNA, 32 nt, Human
guagcugggauuacaggagugugccaccacac

SEQ ID NO: 206357 - RNA, 32 nt, Human
guagcugggauuacaggcaccagccaccaugc

SEQ ID NO: 206358 - RNA, 32 nt, Human
guagcugggauuacaggcagccaccacgccca

SEQ ID NO: 206359 - RNA, 32 nt, Human
guagcugggauuacaggcaucugcuaccacgc

SEQ ID NO: 206360 - RNA, 32 nt, Human
guagcugggauuacaggcaugagccacugagc

SEQ ID NO: 206361 - RNA, 32 nt, Human
guagcugggauuacaggcaugagccacugugc

SEQ ID NO: 206362 - RNA, 32 nt, Human
guagcugggauuacaggcaugcgccaccacac

SEQ ID NO: 206363 - RNA, 32 nt, Human
guagcugggauuacaggcaugcgccaccacgc

SEQ ID NO: 206364 - RNA, 32 nt, Human
guagcugggauuacaggcaugcgccaccaugc

SEQ ID NO: 206365 - RNA, 32 nt, Human
guagcugggauuacaggcaugcgccacuaugc

SEQ ID NO: 206366 - RNA, 32 nt, Human
guagcugggauuacaggcaugcgccaucaugc

SEQ ID NO: 206367 - RNA, 32 nt, Human
guagcugggauuacaggcaugggccaccaugc

SEQ ID NO: 206368 - RNA, 32 nt, Human
guagcugggauuacaggcaugugagaccacgc

SEQ ID NO: 206369 - RNA, 32 nt, Human
guagcugggauuacaggcaugugccacaacgc

SEQ ID NO: 206370 - RNA, 32 nt, Human
guagcugggauuacaggcaugugccacaccug

SEQ ID NO: 206371 - RNA, 32 nt, Human
guagcugggauuacaggcaugugccaccacac

SEQ ID NO: 206372 - RNA, 32 nt, Human
guagcugggauuacaggcaugugccaccacgc

SEQ ID NO: 206373 - RNA, 32 nt, Human
guagcugggauuacaggcaugugccaccaugc

SEQ ID NO: 206374 - RNA, 32 nt, Human
guagcugggauuacaggcaugugccacccacc

SEQ ID NO: 206375 - RNA, 32 nt, Human
guagcugggauuacaggcaugugccaucaccc

SEQ ID NO: 206376 - RNA, 32 nt, Human
guagcugggauuacaggcaugugucaccacgc

SEQ ID NO: 206377 - RNA, 20 nt, Human
guagcugggauuacaggcgu

SEQ ID NO: 206378 - RNA, 32 nt, Human
guagcugggauuacaggcgugcgccaccaaau

SEQ ID NO: 206379 - RNA, 32 nt, Human
guagcugggauuacaggcgugcgccaccacgc

SEQ ID NO: 206380 - RNA, 32 nt, Human
guagcugggauuacaggcgugcgccacuaugc

SEQ ID NO: 206381 - RNA, 32 nt, Human
guagcugggauuacaggcgugcgccaucgugc

SEQ ID NO: 206382 - RNA, 32 nt, Human
guagcugggauuacaggcgugugccaccacac

SEQ ID NO: 206383 - RNA, 32 nt, Human
guagcugggauuacaggcgugugccaccacgc

SEQ ID NO: 206384 - RNA, 32 nt, Human
guagcugggauuacaggcgugugccaccaugc

SEQ ID NO: 206385 - RNA, 32 nt, Human
guagcugggauuacaggcgugugccaccgccu

SEQ ID NO: 206386 - RNA, 32 nt, Human
guagcugggauuacaggcgugugccgccacac

SEQ ID NO: 206387 - RNA, 32 nt, Human
guagcugggauuacaggcgugugucaccacgc

SEQ ID NO: 206388 - RNA, 32 nt, Human
guagcugggauuacaggcucaugccaccaugc

SEQ ID NO: 206389 - RNA, 32 nt, Human
guagcugggauuacaggcucccgccaccacgc

SEQ ID NO: 206390 - RNA, 32 nt, Human
guagcugggauuacaggcuccugccaccacgc

SEQ ID NO: 206391 - RNA, 32 nt, Human
guagcugggauuacagggugaagagggaacag

SEQ ID NO: 206392 - RNA, 32 nt, Human
guagcugggauuacagguaccugccaccaugc

SEQ ID NO: 206393 - RNA, 32 nt, Human
guagcugggauuacagguaugaaccacuaugc

SEQ ID NO: 206394 - RNA, 32 nt, Human
guagcugggauuacagguauguaccaccacac

SEQ ID NO: 206395 - RNA, 32 nt, Human
guagcugggauuacagguaugugccaccacgc

SEQ ID NO: 206396 - RNA, 32 nt, Human
guagcugggauuacagguaugugccaccaugc

SEQ ID NO: 206397 - RNA, 32 nt, Human
guagcugggauuacaggugagcaccacuguac

SEQ ID NO: 206398 - RNA, 32 nt, Human
guagcugggauuacaggugcaggccaccaugc

SEQ ID NO: 206399 - RNA, 32 nt, Human
guagcugggauuacaggugcaugccaccacgc

SEQ ID NO: 206400 - RNA, 32 nt, Human
guagcugggauuacaggugcaugccaccaugc

SEQ ID NO: 206401 - RNA, 32 nt, Human
guagcugggauuacaggugcaugccaccaugg

SEQ ID NO: 206402 - RNA, 32 nt, Human
guagcugggauuacaggugcccgccaccacac

SEQ ID NO: 206403 - RNA, 32 nt, Human
guagcugggauuacaggugcccgccaccacau

SEQ ID NO: 206404 - RNA, 32 nt, Human
guagcugggauuacaggugcccgccaccacgc

SEQ ID NO: 206405 - RNA, 32 nt, Human
guagcugggauuacaggugcccgccaccaugc

SEQ ID NO: 206406 - RNA, 32 nt, Human
guagcugggauuacaggugccugccacaacac

SEQ ID NO: 206407 - RNA, 32 nt, Human
guagcugggauuacaggugccugccaccacac

SEQ ID NO: 206408 - RNA, 32 nt, Human
guagcugggauuacaggugccugccaccacgc

SEQ ID NO: 206409 - RNA, 32 nt, Human
guagcugggauuacaggugccugccaccauac

SEQ ID NO: 206410 - RNA, 32 nt, Human
guagcugggauuacaggugccugccaccaugc

SEQ ID NO: 206411 - RNA, 32 nt, Human
guagcugggauuacaggugccugccaccauuc

SEQ ID NO: 206412 - RNA, 32 nt, Human
guagcugggauuacaggugccugccacugcgu

SEQ ID NO: 206413 - RNA, 32 nt, Human
guagcugggauuacaggugcgcaccauuacau

SEQ ID NO: 206414 - RNA, 32 nt, Human
guagcugggauuacaggugcgcacuaccacgc

SEQ ID NO: 206415 - RNA, 32 nt, Human
guagcugggauuacaggugcgugccaccacgc

SEQ ID NO: 206416 - RNA, 32 nt, Human
guagcugggauuacaggugcucaccaccacgu

SEQ ID NO: 206417 - RNA, 32 nt, Human
guagcugggauuacagguguaugccaccacgc

SEQ ID NO: 206418 - RNA, 32 nt, Human
guagcugggauuacagguguccgccaccacgc

SEQ ID NO: 206419 - RNA, 32 nt, Human
guagcugggauuacaggugucggccaccacac

SEQ ID NO: 206420 - RNA, 32 nt, Human
guagcugggauuacaggugugagccacugcac

SEQ ID NO: 206421 - RNA, 32 nt, Human
guagcugggauuacaggugugcaccaccacac

SEQ ID NO: 206422 - RNA, 32 nt, Human
guagcugggauuacaggugugcaccaccacgc

SEQ ID NO: 206423 - RNA, 32 nt, Human
guagcugggauuacaggugugcaccaccauuc

SEQ ID NO: 206424 - RNA, 32 nt, Human
guagcugggauuacaggugugcaccacccgua

SEQ ID NO: 206425 - RNA, 32 nt, Human
guagcugggauuacaggugugcaccacuacca

SEQ ID NO: 206426 - RNA, 32 nt, Human
guagcugggauuacaggugugccccaccacgc

SEQ ID NO: 206427 - RNA, 32 nt, Human
guagcugggauuacaggugugcgccaccacgc

SEQ ID NO: 206428 - RNA, 32 nt, Human
guagcugggauuacaggugugcgccaccaugu

SEQ ID NO: 206429 - RNA, 32 nt, Human
guagcugggauuacaggugugcgccgccacac

SEQ ID NO: 206430 - RNA, 32 nt, Human
guagcugggauuacaggugugcgccgcuacgc

SEQ ID NO: 206431 - RNA, 32 nt, Human
guagcugggauuacaggugugggccaccacac

SEQ ID NO: 206432 - RNA, 32 nt, Human
guagcugggauuacaggugugugccaccacac

SEQ ID NO: 206433 - RNA, 32 nt, Human
guagcugggauuacaggugugugccaccaugc

SEQ ID NO: 206434 - RNA, 32 nt, Human
guagcugggauuacaggugugugccacuacgg

SEQ ID NO: 206435 - RNA, 32 nt, Human
guagcugggauuacaggugugugccaucaugc

SEQ ID NO: 206436 - RNA, 32 nt, Human
guagcugggauuacaggugugugccgcaaugc

SEQ ID NO: 206437 - RNA, 32 nt, Human
guagcugggauuacagguuccugcuaccacgc

SEQ ID NO: 206438 - RNA, 32 nt, Human
guagcugggauuacagguuugcaccaccaugc

SEQ ID NO: 206439 - RNA, 32 nt, Human
guagcugggauuacaugugugugccaccacag

SEQ ID NO: 206440 - RNA, 32 nt, Human
guagcugggauuaccagugcacgccaccacgc

SEQ ID NO: 206441 - RNA, 32 nt, Human
guagcugggauuacgggcaugcgccaccacac

SEQ ID NO: 206442 - RNA, 32 nt, Human
guagcugggauuacgggcaugugccaccacgc

SEQ ID NO: 206443 - RNA, 32 nt, Human
guagcugggauuacgggugcgugccaccaugc

SEQ ID NO: 206444 - RNA, 32 nt, Human
guagcugggauuagaggcaugugccaucauac

SEQ ID NO: 206445 - RNA, 32 nt, Human
guagcugggauuagaggcgugugccaccaugc

SEQ ID NO: 206446 - RNA, 32 nt, Human
guagcugggauuagaggcgugugccacuacac

SEQ ID NO: 206447 - RNA, 32 nt, Human
guagcugggauuauagacacgugccaccacgc

SEQ ID NO: 206448 - RNA, 32 nt, Human
guagcugggauuauagauuggagccaccaugc

SEQ ID NO: 206449 - RNA, 32 nt, Human
guagcugggauuauaggcacacaccaccacau

SEQ ID NO: 206450 - RNA, 32 nt, Human
guagcugggauuauaggcacacaccaccauac

SEQ ID NO: 206451 - RNA, 32 nt, Human
guagcugggauuauaggcacacaccaccaugu

SEQ ID NO: 206452 - RNA, 32 nt, Human
guagcugggauuauaggcacaugccaccgcgc

SEQ ID NO: 206453 - RNA, 32 nt, Human
guagcugggauuauaggcacccaccaccacac

SEQ ID NO: 206454 - RNA, 32 nt, Human
guagcugggauuauaggcacccgccaccaugu

SEQ ID NO: 206455 - RNA, 32 nt, Human
guagcugggauuauaggcaccugccaccacgg

SEQ ID NO: 206456 - RNA, 32 nt, Human
guagcugggauuauaggcaccugccaucaugc

SEQ ID NO: 206457 - RNA, 32 nt, Human
guagcugggauuauaggcacgugccaccacac

SEQ ID NO: 206458 - RNA, 32 nt, Human
guagcugggauuauaggcauccacuaccaugc

SEQ ID NO: 206459 - RNA, 32 nt, Human
guagcugggauuauaggcaugcaccaccacca

SEQ ID NO: 206460 - RNA, 32 nt, Human
guagcugggauuauaggcaugcaccaccaugc

SEQ ID NO: 206461 - RNA, 32 nt, Human
guagcugggauuauaggcgagagccacugcau

SEQ ID NO: 206462 - RNA, 32 nt, Human
guagcugggauuauaggcgagugccaucaugc

SEQ ID NO: 206463 - RNA, 32 nt, Human
guagcugggauuauaggcgcccgccaccacga

SEQ ID NO: 206464 - RNA, 32 nt, Human
guagcugggauuauaggcguccgccaccaugc

SEQ ID NO: 206465 - RNA, 32 nt, Human
guagcugggauuauaggcgucugccaccacgc

SEQ ID NO: 206466 - RNA, 32 nt, Human
guagcugggauuauaggcgugcaccaccaugc

SEQ ID NO: 206467 - RNA, 32 nt, Human
guagcugggauuauaggcguguaccaccacac

SEQ ID NO: 206468 - RNA, 32 nt, Human
guagcugggauuauaggcgugugccaccaugc

SEQ ID NO: 206469 - RNA, 32 nt, Human
guagcugggauuauagguacaugccaucacac

SEQ ID NO: 206470 - RNA, 32 nt, Human
guagcugggauuauaggugcaugccaccaugc

SEQ ID NO: 206471 - RNA, 32 nt, Human
guagcugggauuauaggugcccaccaccaagc

SEQ ID NO: 206472 - RNA, 32 nt, Human
guagcugggauuauaggugcgagccacugcgc

SEQ ID NO: 206473 - RNA, 32 nt, Human
guagcugggauuauaggugcgcaccaccacac

SEQ ID NO: 206474 - RNA, 32 nt, Human
guagcugggauuauaggugugugccacugugc

SEQ ID NO: 206475 - RNA, 32 nt, Human
guagcugggauuaugggcgcccgccaccacgc

SEQ ID NO: 206476 - RNA, 32 nt, Human
guagcugggauuaugggugccugccaccacac

SEQ ID NO: 206477 - RNA, 24 nt, Human
guagcugggccugugcacugggca

SEQ ID NO: 206478 - RNA, 32 nt, Human
guagcuggggccaggcuucucuccccaccacc

SEQ ID NO: 206479 - RNA, 31 nt, Human
guagcuggucccucugucccugugucugcua

SEQ ID NO: 206480 - RNA, 32 nt, Human
guagcuggugcgcugcucacggccauucacug

SEQ ID NO: 206481 - RNA, 32 nt, Human
guagcuguccugacagccgugaagagcuucuu

SEQ ID NO: 206482 - RNA, 32 nt, Human
guagcugucuaugaggaauuggccgugucugg

SEQ ID NO: 206483 - RNA, 32 nt, Human
guagcuguggcuucuagugcccgcguggcauc

SEQ ID NO: 206484 - RNA, 32 nt, Human
guagcuguucucucccaucuaaccucaggcaa

SEQ ID NO: 206485 - RNA, 20 nt, Human
guagcuuaaucauaaucuca

SEQ ID NO: 206486 - RNA, 32 nt, Human
guagcuuaaucucuauguuucucuccauuuuc

SEQ ID NO: 206487 - RNA, 31 nt, Human
guagcuuaauuaguauuuuguugaaaauacu

SEQ ID NO: 206488 - RNA, 22 nt, Human
guagcuuacaccuauaauccca

SEQ ID NO: 206489 - RNA, 20 nt, Human
guagcuuaccuguaauucca

SEQ ID NO: 206490 - RNA, 22 nt, Human
guagcuuacgccuguuauccca

SEQ ID NO: 206491 - RNA, 32 nt, Human
guagcuuagcccagcuaaguucuaucagagac

SEQ ID NO: 206492 - RNA, 22 nt, Human
guagcuuauaccuguaauccua

SEQ ID NO: 206493 - RNA, 32 nt, Human
guagcuucagguaacuccucuuuguugccaau

SEQ ID NO: 206494 - RNA, 32 nt, Human
guagcuucauccuauccggaggcacagcacau

SEQ ID NO: 206495 - RNA, 32 nt, Human
guagcuucucugggccuggcagagguaagggg

SEQ ID NO: 206496 - RNA, 32 nt, Human
guagcuugaaggaggcaccaugcaggagcugc

SEQ ID NO: 206497 - RNA, 32 nt, Human
guagcuugcgugcuuucuccuguucuuuuaau

SEQ ID NO: 206498 - RNA, 32 nt, Human
guagcuugugugaaaaugagccuuuggaccag

SEQ ID NO: 206499 - RNA, 32 nt, Human
guagcuuguuagaaauguaaacucucaggccc

SEQ ID NO: 206500 - RNA, 32 nt, Human
guagcuuuaaaagaaauuaacaaccuugguca

SEQ ID NO: 206501 - RNA, 24 nt, Human
guagcuuugaccucucaggcucaa

SEQ ID NO: 206502 - RNA, 17 nt, Human
guagcuuugaucgccac

SEQ ID NO: 206503 - RNA, 32 nt, Human
guagcuuugucccuugccaucaugcccaacaa

SEQ ID NO: 206504 - RNA, 22 nt, Human
guagcuuuuaaagaaaauaguc

SEQ ID NO: 206505 - RNA, 32 nt, Human
guagcuuuugacuaaaagacuuuguaguguaa

SEQ ID NO: 206506 - RNA, 32 nt, Human
guaggaaaauuagcugggugugguggcgcaug

SEQ ID NO: 206507 - RNA, 32 nt, Human
guaggaaagagagaggaggagggggaaagagc

SEQ ID NO: 206508 - RNA, 32 nt, Human
guaggaacccagccugaggggaagccacagga

SEQ ID NO: 206509 - RNA, 32 nt, Human
guaggaacccaggagggacccaggaaacuaag

SEQ ID NO: 206510 - RNA, 32 nt, Human
guaggaacuauacuaugccuaacuuucuaucc

SEQ ID NO: 206511 - RNA, 32 nt, Human
guaggaacugccauguugacuccugggcaguu

SEQ ID NO: 206512 - RNA, 24 nt, Human
guaggaagauugcuugaggccagg

SEQ ID NO: 206513 - RNA, 31 nt, Human
guaggaaggaaccaggcccucacuuagguuu

SEQ ID NO: 206514 - RNA, 32 nt, Human
guaggaagugagugcugugucccaggaagcug

SEQ ID NO: 206515 - RNA, 32 nt, Human
guaggaaugcaggauaugcuugcugaauguuu

SEQ ID NO: 206516 - RNA, 32 nt, Human
guaggaaugccagcagaggccugaugauggca

SEQ ID NO: 206517 - RNA, 32 nt, Human
guaggaaugggaagauuugcaguuaaagaugg

SEQ ID NO: 206518 - RNA, 32 nt, Human
guaggaauuauugaaagcuucugccucacuua

SEQ ID NO: 206519 - RNA, 32 nt, Human
guaggacagagagaugacuggggaaggucuug

SEQ ID NO: 206520 - RNA, 32 nt, Human
guaggacagccauauacagugaagaguucuag

SEQ ID NO: 206521 - RNA, 32 nt, Human
guaggaccagcagaccaucgggaugguggagg

SEQ ID NO: 206522 - RNA, 32 nt, Human
guaggacgucgugucagcugugcacugacggc

SEQ ID NO: 206523 - RNA, 32 nt, Human
guaggacucgaauuuacagaaagccacagagg

SEQ ID NO: 206524 - RNA, 32 nt, Human
guaggacugcaguucugaauuuuggguuaaag

SEQ ID NO: 206525 - RNA, 32 nt, Human
guaggacugcuggaggcugugcuuugacauug

SEQ ID NO: 206526 - RNA, 32 nt, Human
guaggacuucggguguucgguccuggucgcag

SEQ ID NO: 206527 - RNA, 32 nt, Human
guaggagaaagaguaucuguggcucucccacc

SEQ ID NO: 206528 - RNA, 31 nt, Human
guaggagaacaauguaauacagcuugguacc

SEQ ID NO: 206529 - RNA, 32 nt, Human
guaggagaagugacaugaaugcaacacguggc

SEQ ID NO: 206530 - RNA, 19 nt, Human
guaggagaaucgcuugaac

SEQ ID NO: 206531 - RNA, 32 nt, Human
guaggagaaucgcuugagcucaggaguuugaa

SEQ ID NO: 206532 - RNA, 19 nt, Human
guaggagaaucguuugaac

SEQ ID NO: 206533 - RNA, 19 nt, Human
guaggagaauugcuugaac

SEQ ID NO: 206534 - RNA, 32 nt, Human
guaggagacagguuugacaaguugcugaggug

SEQ ID NO: 206535 - RNA, 32 nt, Human
guaggagacccaaggcaucuugaaucccaucu

SEQ ID NO: 206536 - RNA, 32 nt, Human
guaggagaccucaguguuuugggucuagguga

SEQ ID NO: 206537 - RNA, 32 nt, Human
guaggagagagaggccuaagaggcucacugcc

SEQ ID NO: 206538 - RNA, 32 nt, Human
guaggagagagccuggaucucuggccccaacc

SEQ ID NO: 206539 - RNA, 32 nt, Human
guaggagagagggacaacaguaggagcaggca

SEQ ID NO: 206540 - RNA, 32 nt, Human
guaggagagagggagcgagagccaggcaggac

SEQ ID NO: 206541 - RNA, 32 nt, Human
guaggagagcacguuggagcugaacuagcccc

SEQ ID NO: 206542 - RNA, 31 nt, Human
guaggagaguugacaucuugccaagggccug

SEQ ID NO: 206543 - RNA, 32 nt, Human
guaggagcaaacaaggcuucauauucuuuuua

SEQ ID NO: 206544 - RNA, 32 nt, Human
guaggagcagagggaagagagagggaugagag

SEQ ID NO: 206545 - RNA, 32 nt, Human
guaggagcagcuuuucuucuaguuugauauca

SEQ ID NO: 206546 - RNA, 32 nt, Human
guaggagcagcuuuucuucuaguuugauguca

SEQ ID NO: 206547 - RNA, 32 nt, Human
guaggagcaggagagaaaggaggguggguggu

SEQ ID NO: 206548 - RNA, 22 nt, Human
guaggagcccaggcuuugggca

SEQ ID NO: 206549 - RNA, 22 nt, Human
guaggagccuagcauuccggca

SEQ ID NO: 206550 - RNA, 32 nt, Human
guaggagccugcaggcccggcgcggggucgcc

SEQ ID NO: 206551 - RNA, 32 nt, Human
guaggagcuggauuugggagcucugcuugccg

SEQ ID NO: 206552 - RNA, 32 nt, Human
guaggagcuggcagugcagggaagaggagaca

SEQ ID NO: 206553 - RNA, 32 nt, Human
guaggagcuguggcgcggggccuuccaggagu

SEQ ID NO: 206554 - RNA, 32 nt, Human
guaggagcuguucucccuccccaaguccuauc

SEQ ID NO: 206555 - RNA, 32 nt, Human
guaggaggaagaauaucaagguuguggaaaaa

SEQ ID NO: 206556 - RNA, 32 nt, Human
guaggaggacugcuugagcucaggagguugag

SEQ ID NO: 206557 - RNA, 32 nt, Human
guaggaggagagaaggcuggggagggcugggc

SEQ ID NO: 206558 - RNA, 24 nt, Human
guaggaggaucacuugagcccagg

SEQ ID NO: 206559 - RNA, 24 nt, Human
guaggaggaucacuugagcucagg

SEQ ID NO: 206560 - RNA, 24 nt, Human
guaggaggaucauuugagcccagg

SEQ ID NO: 206561 - RNA, 24 nt, Human
guaggaggaucgcuuaagcccagg

SEQ ID NO: 206562 - RNA, 19 nt, Human
guaggaggaucgcuugaac

SEQ ID NO: 206563 - RNA, 32 nt, Human
guaggaggaucgcuugaacccaggaaguagag

SEQ ID NO: 206564 - RNA, 24 nt, Human
guaggaggaucgcuugagcccagg

SEQ ID NO: 206565 - RNA, 22 nt, Human
guaggaggauugcuugagccca

SEQ ID NO: 206566 - RNA, 32 nt, Human
guaggaggcagggagaguaagacaugcucugc

SEQ ID NO: 206567 - RNA, 32 nt, Human
guaggaggcuccugacaggccgcggcugucug

SEQ ID NO: 206568 - RNA, 20 nt, Human
guaggagggacagagaguga

SEQ ID NO: 206569 - RNA, 32 nt, Human
guaggagggaggugggugggucaggugagugg

SEQ ID NO: 206570 - RNA, 32 nt, Human
guaggaggggugcugggcucuggccuucucau

SEQ ID NO: 206571 - RNA, 32 nt, Human
guaggagguggggaugggggaggggaggggua

SEQ ID NO: 206572 - RNA, 32 nt, Human
guaggagucgcaaucccagcagcaauagccca

SEQ ID NO: 206573 - RNA, 32 nt, Human
guaggagugccuguugccaguguggggugaga

SEQ ID NO: 206574 - RNA, 32 nt, Human
guaggagugcuaccauggaaauggacagaguu

SEQ ID NO: 206575 - RNA, 32 nt, Human
guaggagugguuggagagacuugcgaaggcgg

SEQ ID NO: 206576 - RNA, 32 nt, Human
guaggauaagccacucugucccuuccugggca

SEQ ID NO: 206577 - RNA, 32 nt, Human
guaggauaggauacuccagacuccagucaucc

SEQ ID NO: 206578 - RNA, 32 nt, Human
guaggauaucccugauuccugggcucccagcc

SEQ ID NO: 206579 - RNA, 32 nt, Human
guaggauaucuuggcuuugccacacacaguua

SEQ ID NO: 206580 - RNA, 18 nt, Human
guaggaucaagaacaagc

SEQ ID NO: 206581 - RNA, 32 nt, Human
guaggaugcaaaacauccaguuguaauguaua

SEQ ID NO: 206582 - RNA, 32 nt, Human
guaggaugcuucuguaguucacaaauguuaca

SEQ ID NO: 206583 - RNA, 32 nt, Human
guaggaugggggcucccagcugcuuguggagg

SEQ ID NO: 206584 - RNA, 32 nt, Human
guaggauugcccacaguuuuucuuuuuaaagg

SEQ ID NO: 206585 - RNA, 32 nt, Human
guaggauuuuucuauuucugcaaaauagaauu

SEQ ID NO: 206586 - RNA, 32 nt, Human
guaggcaacagagcaggcuuuucacuuaggau

SEQ ID NO: 206587 - RNA, 32 nt, Human
guaggcaccuuaccaauauaugacauuaagug

SEQ ID NO: 206588 - RNA, 32 nt, Human
guaggcagaagggacguggcagaagcgggaag

SEQ ID NO: 206589 - RNA, 32 nt, Human
guaggcaggagagaagggcgccagcaggcccg

SEQ ID NO: 206590 - RNA, 32 nt, Human
guaggcaguagggaaaugagugaggcugcccu

SEQ ID NO: 206591 - RNA, 32 nt, Human
guaggcaguuucucuucucacaaaagauguac

SEQ ID NO: 206592 - RNA, 32 nt, Human
guaggcauggaaaauuccacgaggcucauucu

SEQ ID NO: 206593 - RNA, 32 nt, Human
guaggcauuuccuaucaccuguuuccauucaa

SEQ ID NO: 206594 - RNA, 32 nt, Human
guaggccaaaccuacuaacaacacugcuggac

SEQ ID NO: 206595 - RNA, 32 nt, Human
guaggccaagcccgugccucagggcagacuuu

SEQ ID NO: 206596 - RNA, 32 nt, Human
guaggccagccuguucucugccauucccuagu

SEQ ID NO: 206597 - RNA, 32 nt, Human
guaggccauggcuaggcagacaguggggacug

SEQ ID NO: 206598 - RNA, 32 nt, Human
guaggcccaagugucaagaaccacaccagauu

SEQ ID NO: 206599 - RNA, 32 nt, Human
guaggcccgggucugcggagagaggccuuguc

SEQ ID NO: 206600 - RNA, 32 nt, Human
guaggcccuccccucccuaaaucugcuuccgc

SEQ ID NO: 206601 - RNA, 32 nt, Human
guaggcccuggacugcagagacccccgccccc

SEQ ID NO: 206602 - RNA, 32 nt, Human
guaggcccuggcaggcagcugggagccauccu

SEQ ID NO: 206603 - RNA, 32 nt, Human
guaggcccuggucgucacucugggcagggaug

SEQ ID NO: 206604 - RNA, 32 nt, Human
guaggcccuuaagauaucugcaaagaagagua

SEQ ID NO: 206605 - RNA, 32 nt, Human
guaggccgaagugggaggauuccuuggauccc

SEQ ID NO: 206606 - RNA, 32 nt, Human
guaggccgugaagaaagaaugugaguaacugu

SEQ ID NO: 206607 - RNA, 32 nt, Human
guaggccuaaucacagcacuuugggaggccaa

SEQ ID NO: 206608 - RNA, 32 nt, Human
guaggccuagccccugccuuugaaaacaagga

SEQ ID NO: 206609 - RNA, 32 nt, Human
guaggccucuggcugccaguccugcccagccu

SEQ ID NO: 206610 - RNA, 32 nt, Human
guaggccugcaagccuguggccccugggagag

SEQ ID NO: 206611 - RNA, 32 nt, Human
guaggccugcagcucgcucuccucugcgccug

SEQ ID NO: 206612 - RNA, 32 nt, Human
guaggccugcugauucagaggguccucuucau

SEQ ID NO: 206613 - RNA, 32 nt, Human
guaggccuggggacugggagggcagaggguga

SEQ ID NO: 206614 - RNA, 32 nt, Human
guaggccuguucaccgccuccuggugacagcg

SEQ ID NO: 206615 - RNA, 32 nt, Human
guaggccuuccuggucucuggccgccugcugc

SEQ ID NO: 206616 - RNA, 32 nt, Human
guaggccuuuguuuuccaauggugcuauauuc

SEQ ID NO: 206617 - RNA, 32 nt, Human
guaggcgaguaaaaggaggaggaagggcuggg

SEQ ID NO: 206618 - RNA, 32 nt, Human
guaggcgcagcgggacuggaccugggugccga

SEQ ID NO: 206619 - RNA, 32 nt, Human
guaggcgcccaggacaaguggguugcaagaca

SEQ ID NO: 206620 - RNA, 32 nt, Human
guaggcgccuguaaucucagcuacuugaaagg

SEQ ID NO: 206621 - RNA, 32 nt, Human
guaggcgcuggagcuccaguucccaggagcag

SEQ ID NO: 206622 - RNA, 32 nt, Human
guaggcggaggcucaaagacuguucgcgcagc

SEQ ID NO: 206623 - RNA, 32 nt, Human
guaggcggcagcgucugucccucccagccucu

SEQ ID NO: 206624 - RNA, 32 nt, Human
guaggcgguggcagaggguggugagggagggc

SEQ ID NO: 206625 - RNA, 32 nt, Human
guaggcucagcagaugauacugcccagccuuu

SEQ ID NO: 206626 - RNA, 32 nt, Human
guaggcucaggagaaaaugaaagagaaagaau

SEQ ID NO: 206627 - RNA, 32 nt, Human
guaggcucggacacuguaggaggcagauccaa

SEQ ID NO: 206628 - RNA, 32 nt, Human
guaggcucugaccuagucaggcuggaagcguc

SEQ ID NO: 206629 - RNA, 32 nt, Human
guaggcucuguaagcucguguuuucuucccuc

SEQ ID NO: 206630 - RNA, 32 nt, Human
guaggcugaggaagaggagggguuggucuugc

SEQ ID NO: 206631 - RNA, 32 nt, Human
guaggcugaggcagaaggauugcuggggccca

SEQ ID NO: 206632 - RNA, 32 nt, Human
guaggcugaggcaggagaaucgcuugaaccca

SEQ ID NO: 206633 - RNA, 32 nt, Human
guaggcugaggcaggagaauggcgggaaccca

SEQ ID NO: 206634 - RNA, 32 nt, Human
guaggcugaggugggagaauugcuugagccag

SEQ ID NO: 206635 - RNA, 32 nt, Human
guaggcugaggugggaggauugcuugagccug

SEQ ID NO: 206636 - RNA, 32 nt, Human
guaggcugggaauucuugcugaaggaauugga

SEQ ID NO: 206637 - RNA, 32 nt, Human
guaggcuggggcggggcccaggagaccacggg

SEQ ID NO: 206638 - RNA, 32 nt, Human
guaggcuuaaugauguuuuaagugcuggcauu

SEQ ID NO: 206639 - RNA, 32 nt, Human
guaggcuucuuuaacccaucagagagacuccc

SEQ ID NO: 206640 - RNA, 32 nt, Human
guaggcuuggcucccucuccagccucuuaagg

SEQ ID NO: 206641 - RNA, 22 nt, Human
guagggaaaaauaaaaauucaa

SEQ ID NO: 206642 - RNA, 32 nt, Human
guagggaaacguggagauaaucaacacucagg

SEQ ID NO: 206643 - RNA, 32 nt, Human
guagggaaagaaaggagggaaaaaccauaaaa

SEQ ID NO: 206644 - RNA, 32 nt, Human
guagggaagggaggggaagcacuuuaaagucu

SEQ ID NO: 206645 - RNA, 32 nt, Human
guagggacaaaaccacaucagguuuucagaag

SEQ ID NO: 206646 - RNA, 32 nt, Human
guagggacacguguccaugcaccacagacaca

SEQ ID NO: 206647 - RNA, 32 nt, Human
guagggaccagacagaacugccuucaagauga

SEQ ID NO: 206648 - RNA, 32 nt, Human
guagggacggggucucguuuuguugccaaagc

SEQ ID NO: 206649 - RNA, 32 nt, Human
guagggacucugcaguuucuuccugucaaaau

SEQ ID NO: 206650 - RNA, 32 nt, Human
guagggagacaaguuccaggagcacuuugggg

SEQ ID NO: 206651 - RNA, 32 nt, Human
guagggagccaguuccagaccuggguuugugc

SEQ ID NO: 206652 - RNA, 32 nt, Human
guagggagcgcuguggagacagcauccucccc

SEQ ID NO: 206653 - RNA, 32 nt, Human
guagggaggaggagguugcagugagcugagau

SEQ ID NO: 206654 - RNA, 32 nt, Human
guagggagggacggggaggggagccaggaccc

SEQ ID NO: 206655 - RNA, 32 nt, Human
guagggagguggagcugccaccagagauggug

SEQ ID NO: 206656 - RNA, 32 nt, Human
guagggaucuuuaaaaguugaagagggagcca

SEQ ID NO: 206657 - RNA, 32 nt, Human
guagggaugccguuugaaaacaggcacucuuc

SEQ ID NO: 206658 - RNA, 32 nt, Human
guagggauggcuggcccaggagggaggaggac

SEQ ID NO: 206659 - RNA, 32 nt, Human
guagggauggcugugggguggcuuccaggagg

SEQ ID NO: 206660 - RNA, 32 nt, Human
guagggauuggguuuugccuuguugcccaggc

SEQ ID NO: 206661 - RNA, 32 nt, Human
guagggcaacagcaaaacgagcucugccgucc

SEQ ID NO: 206662 - RNA, 32 nt, Human
guagggcaccuuggaccucucucuccugcggg

SEQ ID NO: 206663 - RNA, 32 nt, Human
guagggcaccuuggaccucucucuccuguggg

SEQ ID NO: 206664 - RNA, 32 nt, Human
guagggcagcugguagaggaguaccagcuggu

SEQ ID NO: 206665 - RNA, 32 nt, Human
guagggcagggccacuuccugaggucaggucu

SEQ ID NO: 206666 - RNA, 32 nt, Human
guagggcauggugacccacaccuguaauccca

SEQ ID NO: 206667 - RNA, 32 nt, Human
guagggccuccuuccuccccugccugcagcug

SEQ ID NO: 206668 - RNA, 20 nt, Human
guagggccugcucuccaucc

SEQ ID NO: 206669 - RNA, 24 nt, Human
guagggccuguucccaccacccua

SEQ ID NO: 206670 - RNA, 32 nt, Human
guagggcgcacacgcuuccccgcacucgcuua

SEQ ID NO: 206671 - RNA, 32 nt, Human
guagggcugagcugugugugacuauccuuuug

SEQ ID NO: 206672 - RNA, 32 nt, Human
guagggcugggcagcugggagacaggcucaug

SEQ ID NO: 206673 - RNA, 32 nt, Human
guaggggaagcaaggugaccgcaaggggguau

SEQ ID NO: 206674 - RNA, 32 nt, Human
guaggggaaggaggggagggagaagguggcug

SEQ ID NO: 206675 - RNA, 32 nt, Human
guaggggaagggaggguucagaaagaggaaug

SEQ ID NO: 206676 - RNA, 30 nt, Human
guaggggagacguguaugugagucucagug

SEQ ID NO: 206677 - RNA, 32 nt, Human
guaggggagccccagcauggacucaagggaca

SEQ ID NO: 206678 - RNA, 32 nt, Human
guaggggagggaggggcccuggaggccacauc

SEQ ID NO: 206679 - RNA, 32 nt, Human
guaggggauuauguagacuaaaagccuagaag

SEQ ID NO: 206680 - RNA, 32 nt, Human
guaggggcaaaaaucagugguugcuaggggcu

SEQ ID NO: 206681 - RNA, 32 nt, Human
guaggggcaugguauaaggaaauaucauaaug

SEQ ID NO: 206682 - RNA, 32 nt, Human
guaggggccagcugcugccccagaguccugcc

SEQ ID NO: 206683 - RNA, 32 nt, Human
guaggggcggggaaaugagggggaagaaacaa

SEQ ID NO: 206684 - RNA, 32 nt, Human
guaggggcugggaggccggcgcgcagaucugg

SEQ ID NO: 206685 - RNA, 32 nt, Human
guagggggagaaggaggagcuggaggagggca

SEQ ID NO: 206686 - RNA, 32 nt, Human
guagggggccugggaagaauauuaaaauuuua

SEQ ID NO: 206687 - RNA, 32 nt, Human
guagggggucuccccuggcaauucuugaucgg

SEQ ID NO: 206688 - RNA, 32 nt, Human
guaggggguuccaaggauggcucuucuaacca

SEQ ID NO: 206689 - RNA, 32 nt, Human
guaggggucauugggccugguuccaguucugu

SEQ ID NO: 206690 - RNA, 32 nt, Human
guagggguccucaagugccuuugugauuaaag

SEQ ID NO: 206691 - RNA, 32 nt, Human
guaggggugaaauaugauugauuugcauucug

SEQ ID NO: 206692 - RNA, 32 nt, Human
guaggguaaagaaagagagaucagacugucac

SEQ ID NO: 206693 - RNA, 32 nt, Human
guaggguagggaguguggggaaagauuggggc

SEQ ID NO: 206694 - RNA, 32 nt, Human
guaggguagggcgguggguggggaggaggggc

SEQ ID NO: 206695 - RNA, 32 nt, Human
guagggucaaacugucacaguaucugcuccau

SEQ ID NO: 206696 - RNA, 32 nt, Human
guagggucauuucucccugccugcuuugugcc

SEQ ID NO: 206697 - RNA, 32 nt, Human
guaggguccccaggggcaaccugccccacagc

SEQ ID NO: 206698 - RNA, 32 nt, Human
guaggguccuaacagugcuccuuguccauccc

SEQ ID NO: 206699 - RNA, 32 nt, Human
guaggguccuuggguuacagagccggggagaa

SEQ ID NO: 206700 - RNA, 32 nt, Human
guagggugauggcagugcuccgggaacugggc

SEQ ID NO: 206701 - RNA, 32 nt, Human
guagggugggauggggagggaggcugggcauc

SEQ ID NO: 206702 - RNA, 32 nt, Human
guagguaaagaggaaaaggauccuuuuccuaa

SEQ ID NO: 206703 - RNA, 32 nt, Human
guagguaagguaaguuauacuggagaaaacuu

SEQ ID NO: 206704 - RNA, 32 nt, Human
guagguaagguaauucauucuggagaaaacuu

SEQ ID NO: 206705 - RNA, 32 nt, Human
guagguacacaaaugcugguccgagggucuua

SEQ ID NO: 206706 - RNA, 24 nt, Human
guagguagauugcuugagcccagg

SEQ ID NO: 206707 - RNA, 32 nt, Human
guagguagggccacuucugacugugugucccc

SEQ ID NO: 206708 - RNA, 32 nt, Human
guaggucagaggauuucuuuauggcuaucugu

SEQ ID NO: 206709 - RNA, 32 nt, Human
guaggucccacggccucugccuccccagggag

SEQ ID NO: 206710 - RNA, 32 nt, Human
guagguccucgcaggagcucuucuucccacuc

SEQ ID NO: 206711 - RNA, 32 nt, Human
guagguccugucggcccugcugcuguccucca

SEQ ID NO: 206712 - RNA, 32 nt, Human
guaggucgggcuuccugucccuuccucagguu

SEQ ID NO: 206713 - RNA, 18 nt, Human
guaggucuggaccuggac

SEQ ID NO: 206714 - RNA, 18 nt, Human
guaggucugggauggaca

SEQ ID NO: 206715 - RNA, 32 nt, Human
guaggucuguuugguuucuugucuguccacgg

SEQ ID NO: 206716 - RNA, 32 nt, Human
guaggugaaguggcucacgccuguaauccccg

SEQ ID NO: 206717 - RNA, 32 nt, Human
guaggugaggauucauacaaagagugacucag

SEQ ID NO: 206718 - RNA, 32 nt, Human
guaggugcagagcuggagagccaugggugagg

SEQ ID NO: 206719 - RNA, 32 nt, Human
guaggugcagcaaaccaccauggcacacauuu

SEQ ID NO: 206720 - RNA, 32 nt, Human
guaggugcccuuaucccucccaaggcugcacu

SEQ ID NO: 206721 - RNA, 32 nt, Human
guaggugccucuuccaucuuuugccacugauc

SEQ ID NO: 206722 - RNA, 32 nt, Human
guaggugccuggcccaugguuacccuggauuc

SEQ ID NO: 206723 - RNA, 32 nt, Human
guaggugccuguaaucccagcuacuugggaga

SEQ ID NO: 206724 - RNA, 32 nt, Human
guaggugcucacugcccuauuguuugggugua

SEQ ID NO: 206725 - RNA, 19 nt, Human
guaggugcugcuggccccu

SEQ ID NO: 206726 - RNA, 32 nt, Human
guagguggagagguggaaagaaaagacaaaug

SEQ ID NO: 206727 - RNA, 32 nt, Human
guagguggagcaggcuucaagagcagaaccca

SEQ ID NO: 206728 - RNA, 24 nt, Human
guagguggauugcuucaacccagg

SEQ ID NO: 206729 - RNA, 32 nt, Human
guagguggcaguugggccuggugaggguuagg

SEQ ID NO: 206730 - RNA, 32 nt, Human
guaggugggauuacaagcaugcaccaccaugc

SEQ ID NO: 206731 - RNA, 32 nt, Human
guaggugggauuacaggcaugcgccaccacgc

SEQ ID NO: 206732 - RNA, 32 nt, Human
guaggugggauuauaggagcgugccaucaugc

SEQ ID NO: 206733 - RNA, 32 nt, Human
guaggugggcuccccuugcccuucccucccua

SEQ ID NO: 206734 - RNA, 32 nt, Human
guagguggggcggggguagggguggauaauaa

SEQ ID NO: 206735 - RNA, 32 nt, Human
guagguggugagucugagaaaggggccggaaa

SEQ ID NO: 206736 - RNA, 32 nt, Human
guagguggugcacaccuguagucccagcuacu

SEQ ID NO: 206737 - RNA, 32 nt, Human
guagguuaggagaccccugacacuuuguaauu

SEQ ID NO: 206738 - RNA, 30 nt, Human
guagguuguuucuccauguucuuguuggua

SEQ ID NO: 206739 - RNA, 32 nt, Human
guagguuucggucgcuggaagcugcuaaacca

SEQ ID NO: 206740 - RNA, 32 nt, Human
guagguuucucccacacccacagccccaggcu

SEQ ID NO: 206741 - RNA, 32 nt, Human
guagguuuuaauucuccugcuauuuaggugca

SEQ ID NO: 206742 - RNA, 31 nt, Human
guagguuuucaaaaauaccuggcaagaaauc

SEQ ID NO: 206743 - RNA, 32 nt, Human
guagguuuuucuggcauugucugcccagcugc

SEQ ID NO: 206744 - RNA, 32 nt, Human
guaguaaaaauacaaaaauuagcugggcacgg

SEQ ID NO: 206745 - RNA, 32 nt, Human
guaguaaaacaacauaacucagauuucuacag

SEQ ID NO: 206746 - RNA, 32 nt, Human
guaguaacagucagggccuggucugugcucag

SEQ ID NO: 206747 - RNA, 32 nt, Human
guaguaacccagaagauguagccuugaaggga

SEQ ID NO: 206748 - RNA, 32 nt, Human
guaguaagaagagauucaggaugcuagaggug

SEQ ID NO: 206749 - RNA, 32 nt, Human
guaguaagauaggaagugaggccagguaccuu

SEQ ID NO: 206750 - RNA, 32 nt, Human
guaguaagauccccaccacuccccugccaggg

SEQ ID NO: 206751 - RNA, 32 nt, Human
guaguaagcugccugccucccuucccucagac

SEQ ID NO: 206752 - RNA, 32 nt, Human
guaguaaggaggacagaaaacagaacagaaaa

SEQ ID NO: 206753 - RNA, 32 nt, Human
guaguaauauccacugucccaccagggccuga

SEQ ID NO: 206754 - RNA, 32 nt, Human
guaguaaucccagcuacucaggagguugagac

SEQ ID NO: 206755 - RNA, 32 nt, Human
guaguaaucucacacuucauccuauagaguca

SEQ ID NO: 206756 - RNA, 32 nt, Human
guaguaaugcaaucauagcucacugcagccug

SEQ ID NO: 206757 - RNA, 32 nt, Human
guaguaauuucuauuugcacugugccuuucaa

SEQ ID NO: 206758 - RNA, 32 nt, Human
guaguacaaaggcagagugagggggcuugugg

SEQ ID NO: 206759 - RNA, 32 nt, Human
guaguacagccaccuggcaugccuuguaauag

SEQ ID NO: 206760 - RNA, 32 nt, Human
guaguaccagcaaucagggaacuccuaucugu

SEQ ID NO: 206761 - RNA, 32 nt, Human
guaguacccagccugcuccccgaguccagcga

SEQ ID NO: 206762 - RNA, 32 nt, Human
guaguacuaccugucaaucaucuugcuuuccu

SEQ ID NO: 206763 - RNA, 32 nt, Human
guaguacucccgcuuugcaucuuacaguucag

SEQ ID NO: 206764 - RNA, 32 nt, Human
guaguacuucaaagaagauagcuguauaaaug

SEQ ID NO: 206765 - RNA, 18 nt, Human
guaguacuugggccggug

SEQ ID NO: 206766 - RNA, 32 nt, Human
guaguagaaaaccacaggaagaauggucauau

SEQ ID NO: 206767 - RNA, 32 nt, Human
guaguagaagacacggaaggcacagaaggcag

SEQ ID NO: 206768 - RNA, 32 nt, Human
guaguagaaucagccauugcucugcuccuggc

SEQ ID NO: 206769 - RNA, 32 nt, Human
guaguagauuguuggggguggggagggaggga

SEQ ID NO: 206770 - RNA, 32 nt, Human
guaguagccagucugcugugaccacaggcuca

SEQ ID NO: 206771 - RNA, 32 nt, Human
guaguagccugccucuuaacugguugcuucuc

SEQ ID NO: 206772 - RNA, 32 nt, Human
guaguagcgguggucagacguggaaauggugg

SEQ ID NO: 206773 - RNA, 32 nt, Human
guaguaggaaggugaauaugcauuuuaaugac

SEQ ID NO: 206774 - RNA, 32 nt, Human
guaguagggaggcaucaaaauauuucugauaa

SEQ ID NO: 206775 - RNA, 32 nt, Human
guaguagguuggcuuuaauuuaauauacuuga

SEQ ID NO: 206776 - RNA, 32 nt, Human
guaguaguuuuucuguaacacagaauauagga

SEQ ID NO: 206777 - RNA, 32 nt, Human
guaguauaaucaauuagaaguaaugaauggau

SEQ ID NO: 206778 - RNA, 21 nt, Human
guaguauguuauuccugguua

SEQ ID NO: 206779 - RNA, 32 nt, Human
guaguauucacuacuccagaccuuuuucaagu

SEQ ID NO: 206780 - RNA, 32 nt, Human
guagucacccugcuuguuucugcagcaaugac

SEQ ID NO: 206781 - RNA, 32 nt, Human
guagucaccuaugucugugccucccuucuuua

SEQ ID NO: 206782 - RNA, 32 nt, Human
guagucacuguuuuugacaaccaaugaaauag

SEQ ID NO: 206783 - RNA, 21 nt, Human
guagucagaccugccuuccau

SEQ ID NO: 206784 - RNA, 32 nt, Human
guagucagacuggauaguccgucucugcuuau

SEQ ID NO: 206785 - RNA, 32 nt, Human
guagucagagugagcuacauccugccccgccu

SEQ ID NO: 206786 - RNA, 32 nt, Human
guagucagaugguuacucucuuaacauuaggu

SEQ ID NO: 206787 - RNA, 32 nt, Human
guagucauagaauacagaaauaguuuagggac

SEQ ID NO: 206788 - RNA, 32 nt, Human
guagucaucaacaacaaaagaauaucugaaga

SEQ ID NO: 206789 - RNA, 32 nt, Human
guagucaugagaaaauccauacaauucacauu

SEQ ID NO: 206790 - RNA, 32 nt, Human
guagucauuucgguucugaucuugucaaaccc

SEQ ID NO: 206791 - RNA, 32 nt, Human
guaguccagccuuccaggugggcgugagaggc

SEQ ID NO: 206792 - RNA, 32 nt, Human
guaguccaucaccauuucuuggcauuggaauu

SEQ ID NO: 206793 - RNA, 32 nt, Human
guagucccagcacucgggaaggccgagguggg

SEQ ID NO: 206794 - RNA, 32 nt, Human
guagucccagcacuuugggagacugaggcagg

SEQ ID NO: 206795 - RNA, 32 nt, Human
guagucccagcacuuugggaggcugaggcagg

SEQ ID NO: 206796 - RNA, 32 nt, Human
guagucccagcacuuugggaggcugagguggg

SEQ ID NO: 206797 - RNA, 32 nt, Human
guagucccagcuacucaggaggcugggcagga

SEQ ID NO: 206798 - RNA, 32 nt, Human
guagucccagcuacucggaggcugaggcagua

SEQ ID NO: 206799 - RNA, 32 nt, Human
guagucccagcuacuuggaggcugaggcguga

SEQ ID NO: 206800 - RNA, 19 nt, Human
guagucccagcuacuuggg

SEQ ID NO: 206801 - RNA, 32 nt, Human
guagucccagcugcuugggaggcugaggcagg

SEQ ID NO: 206802 - RNA, 32 nt, Human
guagucccaggccaacacugggaccggaccgg

SEQ ID NO: 206803 - RNA, 32 nt, Human
guagucccaggcccacuggaaaaaugaaucua

SEQ ID NO: 206804 - RNA, 32 nt, Human
guagucccaguacucaggaggcugaggcagga

SEQ ID NO: 206805 - RNA, 32 nt, Human
guagucccaucuccacuauuuagaaauguucu

SEQ ID NO: 206806 - RNA, 32 nt, Human
guagucccccaucccuuccucccuuacccagc

SEQ ID NO: 206807 - RNA, 32 nt, Human
guagucccugcucuuggcuucaccaaaucucc

SEQ ID NO: 206808 - RNA, 32 nt, Human
guaguccuaagucuguuuuccugcugcauuuc

SEQ ID NO: 206809 - RNA, 32 nt, Human
guaguccuagccacucaggaggcugaggcagg

SEQ ID NO: 206810 - RNA, 32 nt, Human
guaguccuagcuaucaagaggcugagacagga

SEQ ID NO: 206811 - RNA, 32 nt, Human
guaguccuccugccucagcuuccugguugcga

SEQ ID NO: 206812 - RNA, 32 nt, Human
guaguccucgccccucuucucucccucccccu

SEQ ID NO: 206813 - RNA, 32 nt, Human
guaguccuguccccucaggcucccagaguuuu

SEQ ID NO: 206814 - RNA, 32 nt, Human
guaguccuucuaaaggaggacauggcagucaa

SEQ ID NO: 206815 - RNA, 32 nt, Human
guaguccuuuugcucaggaagucuuuggggaa

SEQ ID NO: 206816 - RNA, 32 nt, Human
guagucggcucaacacccuccaccuuccccuc

SEQ ID NO: 206817 - RNA, 32 nt, Human
guagucuagucugcaagggcuguccagggccu

SEQ ID NO: 206818 - RNA, 24 nt, Human
guagucucaaccuccugggcucaa

SEQ ID NO: 206819 - RNA, 32 nt, Human
guagucucacccugucgcccaggcuggagugc

SEQ ID NO: 206820 - RNA, 32 nt, Human
guagucucagcuauugggaggcugaggcaaga

SEQ ID NO: 206821 - RNA, 24 nt, Human
guagucucgaccucccaggcucaa

SEQ ID NO: 206822 - RNA, 32 nt, Human
guagucucuacucuuccccugccugcaucaac

SEQ ID NO: 206823 - RNA, 32 nt, Human
guagucucugagguuccuuuucacacacaaaa

SEQ ID NO: 206824 - RNA, 29 nt, Human
guagucuggcugcugaaucccuuucucag

SEQ ID NO: 206825 - RNA, 32 nt, Human
guagucugggcaccccacagugcacuuaagug

SEQ ID NO: 206826 - RNA, 32 nt, Human
guagucuguggaaaccaggaagauaaaacaac

SEQ ID NO: 206827 - RNA, 32 nt, Human
guagucuuuuugaauuggcuucuuucacuuag

SEQ ID NO: 206828 - RNA, 32 nt, Human
guagugaaaauugcacuuucugggcaagacuc

SEQ ID NO: 206829 - RNA, 32 nt, Human
guagugaaggaaaauggcuuggaaaagccaau

SEQ ID NO: 206830 - RNA, 32 nt, Human
guagugaauuacugugugaaguucucaccgac

SEQ ID NO: 206831 - RNA, 32 nt, Human
guagugaccggcccggcgugggcacacagaca

SEQ ID NO: 206832 - RNA, 32 nt, Human
guagugacuaagucucacaagagcugaugauu

SEQ ID NO: 206833 - RNA, 32 nt, Human
guagugagacuccaucucugucuuuuugaaaa

SEQ ID NO: 206834 - RNA, 32 nt, Human
guagugagccgaaaucacaccauugcacucca

SEQ ID NO: 206835 - RNA, 32 nt, Human
guagugagcuggaaagccuacaggaaaagagg

SEQ ID NO: 206836 - RNA, 32 nt, Human
guagugaucuuaggguuuugauuuaaaagaaa

SEQ ID NO: 206837 - RNA, 32 nt, Human
guagugaugaguagucugggcccugggugagg

SEQ ID NO: 206838 - RNA, 32 nt, Human
guagugauuguacaacuuaaagcuccuuucuc

SEQ ID NO: 206839 - RNA, 32 nt, Human
guagugcaaccaucugauaaacuagugugauu

SEQ ID NO: 206840 - RNA, 22 nt, Human
guagugcacaccuguaauccca

SEQ ID NO: 206841 - RNA, 22 nt, Human
guagugcacgccuguaauccca

SEQ ID NO: 206842 - RNA, 32 nt, Human
guagugcaugaaugaaugagucaugggcagug

SEQ ID NO: 206843 - RNA, 32 nt, Human
guagugccagcugcuugggaggcugaggugag

SEQ ID NO: 206844 - RNA, 32 nt, Human
guagugccauuuuggccggacaugguuggggu

SEQ ID NO: 206845 - RNA, 32 nt, Human
guagugcccagcuggcaggccugagguguaca

SEQ ID NO: 206846 - RNA, 32 nt, Human
guagugccugccuuugaaacaggguguagggg

SEQ ID NO: 206847 - RNA, 32 nt, Human
guagugccuggccccagccccaggcagccaca

SEQ ID NO: 206848 - RNA, 32 nt, Human
guagugccuugcgggcucacacauguacuagu

SEQ ID NO: 206849 - RNA, 32 nt, Human
guagugcgagccugagauggucuggaggauuc

SEQ ID NO: 206850 - RNA, 32 nt, Human
guagugcugccccugugacaggcaucagcucc

SEQ ID NO: 206851 - RNA, 32 nt, Human
guagugcuuaaaggaauagacuuaucuccuua

SEQ ID NO: 206852 - RNA, 32 nt, Human
guaguggacaacagguuuucaccauagccuac

SEQ ID NO: 206853 - RNA, 32 nt, Human
guaguggagaugccugaacacaauucuauauu

SEQ ID NO: 206854 - RNA, 32 nt, Human
guaguggcaggcaccuguaaucccagcuacuc

SEQ ID NO: 206855 - RNA, 32 nt, Human
guaguggcaugaucucagcucacugcaacuuc

SEQ ID NO: 206856 - RNA, 32 nt, Human
guaguggccacagccuuacaggcaggcagggg

SEQ ID NO: 206857 - RNA, 32 nt, Human
guaguggccacuuccaguucauccguuuaucc

SEQ ID NO: 206858 - RNA, 32 nt, Human
guaguggccugucaaccacuuucggagaauga

SEQ ID NO: 206859 - RNA, 32 nt, Human
guaguggcgggcgccuguagucucagccacuc

SEQ ID NO: 206860 - RNA, 22 nt, Human
guaguggcucacaccuauaauc

SEQ ID NO: 206861 - RNA, 22 nt, Human
guaguggcucacaccuguaauc

SEQ ID NO: 206862 - RNA, 22 nt, Human
guaguggcucacaccuguaauu

SEQ ID NO: 206863 - RNA, 32 nt, Human
guaguggcucacaccuguaauuccagcacuuu

SEQ ID NO: 206864 - RNA, 22 nt, Human
guaguggcucacgccaguaauc

SEQ ID NO: 206865 - RNA, 22 nt, Human
guaguggcucacgccuguaauc

SEQ ID NO: 206866 - RNA, 22 nt, Human
guaguggcucaugccuauaauu

SEQ ID NO: 206867 - RNA, 22 nt, Human
guaguggcucaugccuguaauc

SEQ ID NO: 206868 - RNA, 32 nt, Human
guaguggcugcugccacugacucucagagcca

SEQ ID NO: 206869 - RNA, 32 nt, Human
guaguggcuuacaccuguagucccaggcacuu

SEQ ID NO: 206870 - RNA, 22 nt, Human
guaguggcuuaugccuguaauc

SEQ ID NO: 206871 - RNA, 32 nt, Human
guagugggagagaggaaaggagggaaggcaag

SEQ ID NO: 206872 - RNA, 32 nt, Human
guagugggcuaugcaggagcuucugggagauu

SEQ ID NO: 206873 - RNA, 32 nt, Human
guagugggggaaagguggcuggaccucuguug

SEQ ID NO: 206874 - RNA, 32 nt, Human
guagugggggaggcggcggcagcguuaaguga

SEQ ID NO: 206875 - RNA, 32 nt, Human
guaguggucagcacuuccuguacgucaacuca

SEQ ID NO: 206876 - RNA, 23 nt, Human
guaguggugaacuguguaaaaua

SEQ ID NO: 206877 - RNA, 32 nt, Human
guaguggugcgaucucagcucacugcaaccuc

SEQ ID NO: 206878 - RNA, 32 nt, Human
guagugguucuaauuuuggugcaacaauuggu

SEQ ID NO: 206879 - RNA, 31 nt, Human
guagugucacucaaggcggugcuugauagaa

SEQ ID NO: 206880 - RNA, 32 nt, Human
guaguguccugggauucucugcccccucugag

SEQ ID NO: 206881 - RNA, 32 nt, Human
guagugucuguaacuaccgucagaucuacuuc

SEQ ID NO: 206882 - RNA, 32 nt, Human
guagugugaaguucacaguugacaaacaacaa

SEQ ID NO: 206883 - RNA, 32 nt, Human
guagugugagccaagcgcagccugccaggcca

SEQ ID NO: 206884 - RNA, 32 nt, Human
guagugugcaagacucugggacggcaugagaa

SEQ ID NO: 206885 - RNA, 32 nt, Human
guagugugcaguucuaguuugcauuccugaua

SEQ ID NO: 206886 - RNA, 32 nt, Human
guaguguggcuguggagggcucugccuauggg

SEQ ID NO: 206887 - RNA, 32 nt, Human
guaguguguucagacugugcacacagaaaaca

SEQ ID NO: 206888 - RNA, 32 nt, Human
guaguguuggguggaggauggacgagugagcu

SEQ ID NO: 206889 - RNA, 32 nt, Human
guaguguuuguccagguaccuuaacuguagcu

SEQ ID NO: 206890 - RNA, 32 nt, Human
guaguuaaaaaugauuaugcuguggagagcua

SEQ ID NO: 206891 - RNA, 32 nt, Human
guaguuaauccuugcauauucuccuuucaucc

SEQ ID NO: 206892 - RNA, 32 nt, Human
guaguuaauuggauaaacuggcagcaucccug

SEQ ID NO: 206893 - RNA, 32 nt, Human
guaguuaccuauaaauaaaaacaaauaugagu

SEQ ID NO: 206894 - RNA, 32 nt, Human
guaguuaccuauaaauaaaaacaaauaugcgu

SEQ ID NO: 206895 - RNA, 32 nt, Human
guaguuaugcugucucucugucaucuacuuga

SEQ ID NO: 206896 - RNA, 32 nt, Human
guaguuauguaggccgggcaugguggcacaug

SEQ ID NO: 206897 - RNA, 32 nt, Human
guaguuauuauuuuuggaggggagaaacccag

SEQ ID NO: 206898 - RNA, 32 nt, Human
guaguuauuuugcaccagcagugccuuucuca

SEQ ID NO: 206899 - RNA, 32 nt, Human
guaguuauuuuucauuaccacauucaaucaug

SEQ ID NO: 206900 - RNA, 22 nt, Human
guaguucacaccuguaguccca

SEQ ID NO: 206901 - RNA, 32 nt, Human
guaguucagaaggaacugggagaacauguuca

SEQ ID NO: 206902 - RNA, 32 nt, Human
guaguucagcuacucagggggcugagguggga

SEQ ID NO: 206903 - RNA, 32 nt, Human
guaguucaugcgggagauggcaggggccuggc

SEQ ID NO: 206904 - RNA, 32 nt, Human
guaguucaugcgggagauggcaggggcuggca

SEQ ID NO: 206905 - RNA, 32 nt, Human
guaguuccagcugcuugggaggcugaggcacg

SEQ ID NO: 206906 - RNA, 32 nt, Human
guaguuccaguuccccuuuccccaccacggag

SEQ ID NO: 206907 - RNA, 31 nt, Human
guaguucgcaguuucugacagugaaggcucg

SEQ ID NO: 206908 - RNA, 32 nt, Human
guaguucuauaauuccaucucaguuccuuuac

SEQ ID NO: 206909 - RNA, 32 nt, Human
guaguucugcauuuaucgagaucugggguucu

SEQ ID NO: 206910 - RNA, 32 nt, Human
guaguucugccugaccuaugaggccucaauga

SEQ ID NO: 206911 - RNA, 32 nt, Human
guaguugaaaguugaauucaagucuuuccuuc

SEQ ID NO: 206912 - RNA, 32 nt, Human
guaguugacuuugcuguauggaaaaauaaagu

SEQ ID NO: 206913 - RNA, 32 nt, Human
guaguugcaucuguacuaaacaugaacagaca

SEQ ID NO: 206914 - RNA, 32 nt, Human
guaguugcugggacagcgaaauggaggggugu

SEQ ID NO: 206915 - RNA, 32 nt, Human
guaguugcugugguuuccguucugagcucgca

SEQ ID NO: 206916 - RNA, 32 nt, Human
guaguugggaggugagaggcaggaauggauac

SEQ ID NO: 206917 - RNA, 32 nt, Human
guaguugggauuacaggugacugccaccgugc

SEQ ID NO: 206918 - RNA, 32 nt, Human
guaguuguagucuuaaggccugugcauuucac

SEQ ID NO: 206919 - RNA, 32 nt, Human
guaguuguucacaguaguugagaaguugaaga

SEQ ID NO: 206920 - RNA, 32 nt, Human
guaguuuagugugguuuucuguuucuaauuug

SEQ ID NO: 206921 - RNA, 32 nt, Human
guaguuuaucauuaguuuguaucuguaaguua

SEQ ID NO: 206922 - RNA, 32 nt, Human
guaguuuccaagagagacgcugagggauguuu

SEQ ID NO: 206923 - RNA, 32 nt, Human
guaguuucuaaccccuguucuauaguaguuac

SEQ ID NO: 206924 - RNA, 32 nt, Human
guaguuugaguaugccuuaccuuuguaaauau

SEQ ID NO: 206925 - RNA, 32 nt, Human
guaguuugcugucaccaacauggcugggccug

SEQ ID NO: 206926 - RNA, 32 nt, Human
guaguuuggaaaugagaauuuuguuaacuaaa

SEQ ID NO: 206927 - RNA, 31 nt, Human
guaguuugggcaaguacagccaacacccuga

SEQ ID NO: 206928 - RNA, 32 nt, Human
guaguuuguuaccuugguggccaucugcagcc

SEQ ID NO: 206929 - RNA, 32 nt, Human
guaguuuuacagccauuucuguucacacuuuu

SEQ ID NO: 206930 - RNA, 32 nt, Human
guauaaaacacuucgaacauuucaccauggag

SEQ ID NO: 206931 - RNA, 32 nt, Human
guauaaaagcuacuuugcuccuggugagagcu

SEQ ID NO: 206932 - RNA, 32 nt, Human
guauaaaauuggaaagucucuaagacacaggc

SEQ ID NO: 206933 - RNA, 32 nt, Human
guauaaacacuaacauuuuccccuucuguagu

SEQ ID NO: 206934 - RNA, 32 nt, Human
guauaaaccuugagaucaaagacugucagcuu

SEQ ID NO: 206935 - RNA, 32 nt, Human
guauaaacugaaaaagacaaaauaaguaaagc

SEQ ID NO: 206936 - RNA, 32 nt, Human
guauaaagaaaauucuugucaaauuucacuca

SEQ ID NO: 206937 - RNA, 32 nt, Human
guauaaagagagagacauaucacgcugcuguc

SEQ ID NO: 206938 - RNA, 32 nt, Human
guauaaagaguuggacucucuccccugguguc

SEQ ID NO: 206939 - RNA, 32 nt, Human
guauaaaggaucuggagguuggggauaugacu

SEQ ID NO: 206940 - RNA, 32 nt, Human
guauaaaggggugggagccccgaggugagcgg

SEQ ID NO: 206941 - RNA, 32 nt, Human
guauaaaguaggagaacuaagagacuuaagag

SEQ ID NO: 206942 - RNA, 32 nt, Human
guauaaauaggagaggaugagagcccagaggu

SEQ ID NO: 206943 - RNA, 32 nt, Human
guauaaaugcagcugucaugcaguucuuuucu

SEQ ID NO: 206944 - RNA, 32 nt, Human
guauaaaugccaccuccuccaugaagccuucc

SEQ ID NO: 206945 - RNA, 32 nt, Human
guauaaaugucagaagacagauuuccuaaaca

SEQ ID NO: 206946 - RNA, 32 nt, Human
guauaaauuuuuaugggacaaagccuagaaaa

SEQ ID NO: 206947 - RNA, 32 nt, Human
guauaacaugcauauguauauguauaugugga

SEQ ID NO: 206948 - RNA, 32 nt, Human
guauaacccuuuccacuuucaucgucuuauau

SEQ ID NO: 206949 - RNA, 32 nt, Human
guauaaccucaccuucccuggcucaucuuggc

SEQ ID NO: 206950 - RNA, 32 nt, Human
guauaacuauagggauaccgaaacaggaaaaa

SEQ ID NO: 206951 - RNA, 32 nt, Human
guauaacuuaaccuugauuuauaaggucuuaa

SEQ ID NO: 206952 - RNA, 32 nt, Human
guauaagaacuaagcuaucaguauagauauag

SEQ ID NO: 206953 - RNA, 32 nt, Human
guauaagaauacuuuucucuccacaacgagug

SEQ ID NO: 206954 - RNA, 32 nt, Human
guauaagccccgaggccuagaguggcagccaa

SEQ ID NO: 206955 - RNA, 32 nt, Human
guauaagccuccauaugucucaucugugcucu

SEQ ID NO: 206956 - RNA, 32 nt, Human
guauaagggaggcuuuguccucaguaucucuu

SEQ ID NO: 206957 - RNA, 31 nt, Human
guauaaggugauguacuacaugcagaucaua

SEQ ID NO: 206958 - RNA, 32 nt, Human
guauaagugaauauauacacacacauacagac

SEQ ID NO: 206959 - RNA, 32 nt, Human
guauaagugaaugggagaguucccuggucccc

SEQ ID NO: 206960 - RNA, 32 nt, Human
guauaauaagcagcagcaacuucaugugaaaa

SEQ ID NO: 206961 - RNA, 32 nt, Human
guauaauacagcaacaacuaucuggcccaaac

SEQ ID NO: 206962 - RNA, 32 nt, Human
guauaauacgguauuauaccugcaugugcucu

SEQ ID NO: 206963 - RNA, 22 nt, Human
guauaaucccagcuacuugaga

SEQ ID NO: 206964 - RNA, 32 nt, Human
guauaaugcaacaacauuggaacacaauaaag

SEQ ID NO: 206965 - RNA, 32 nt, Human
guauaaugugccagguaacucaccugccccuu

SEQ ID NO: 206966 - RNA, 32 nt, Human
guauaauucccaaguguacugucuaccagaaa

SEQ ID NO: 206967 - RNA, 32 nt, Human
guauaauuccucacccccaauccuuaucaauu

SEQ ID NO: 206968 - RNA, 32 nt, Human
guauaauucucaaauaaauauuuuggugaagc

SEQ ID NO: 206969 - RNA, 23 nt, Human
guauaauuguauccagaaaugua

SEQ ID NO: 206970 - RNA, 32 nt, Human
guauacacagaauauuccugugcccacacuua

SEQ ID NO: 206971 - RNA, 32 nt, Human
guauacacauauacacaucucuguccaaaauu

SEQ ID NO: 206972 - RNA, 32 nt, Human
guauacacaugcugccuucuuggggauucaaa

SEQ ID NO: 206973 - RNA, 32 nt, Human
guauacacuugauuugcuuucaaaauaaauaa

SEQ ID NO: 206974 - RNA, 18 nt, Human
guauacacuuuguaguca

SEQ ID NO: 206975 - RNA, 32 nt, Human
guauacagacuggcugggccccacccccugcg

SEQ ID NO: 206976 - RNA, 32 nt, Human
guauacagcacugggaaaugggagcacaguac

SEQ ID NO: 206977 - RNA, 32 nt, Human
guauacagcacugggaaaugggagcacggcac

SEQ ID NO: 206978 - RNA, 32 nt, Human
guauacagcaguaaucuccuauuuugguguca

SEQ ID NO: 206979 - RNA, 32 nt, Human
guauacagccuggagugaauguuaauaaacag

SEQ ID NO: 206980 - RNA, 32 nt, Human
guauacaugauccagucugugacuaccagcca

SEQ ID NO: 206981 - RNA, 32 nt, Human
guauacauucuagugagaaaucuaccuaccua

SEQ ID NO: 206982 - RNA, 32 nt, Human
guauaccaccugaccagccuuugugcauuuau

SEQ ID NO: 206983 - RNA, 32 nt, Human
guauaccaugugccaagcaauuuucauauacu

SEQ ID NO: 206984 - RNA, 32 nt, Human
guauacccugcucugccacccaugaaccagcc

SEQ ID NO: 206985 - RNA, 32 nt, Human
guauaccugagucucuguaugugugcauguau

SEQ ID NO: 206986 - RNA, 32 nt, Human
guauacuaauguucacagcagcgugaacucca

SEQ ID NO: 206987 - RNA, 32 nt, Human
guauacuaauucugaagugaccgucagugcuu

SEQ ID NO: 206988 - RNA, 32 nt, Human
guauacuaguaauuuuugaauaggguaaacuu

SEQ ID NO: 206989 - RNA, 32 nt, Human
guauacucagcuaacaaaccugcccauguguu

SEQ ID NO: 206990 - RNA, 32 nt, Human
guauacucaguuaaaaucggggcuggaggugc

SEQ ID NO: 206991 - RNA, 32 nt, Human
guauacucugaaacacagcccaaccaaaccau

SEQ ID NO: 206992 - RNA, 32 nt, Human
guauacucuguggaguagcaguccacaucaaa

SEQ ID NO: 206993 - RNA, 32 nt, Human
guauacugagggcaauggagcuacagagcauu

SEQ ID NO: 206994 - RNA, 32 nt, Human
guauacugaguauuuacaacuuauacauguaa

SEQ ID NO: 206995 - RNA, 32 nt, Human
guauacuguucuucagcuugucuucucugugu

SEQ ID NO: 206996 - RNA, 32 nt, Human
guauacuuugcuuagguugacuuagcauaucu

SEQ ID NO: 206997 - RNA, 32 nt, Human
guauagaaaguauggaaaagaaaacagacagu

SEQ ID NO: 206998 - RNA, 32 nt, Human
guauagaaaugagagaagacugugacaacuca

SEQ ID NO: 206999 - RNA, 32 nt, Human
guauagaagggagaacaggcaucagauuguuu

SEQ ID NO: 207000 - RNA, 32 nt, Human
guauagaauggcccuggccugggacagcuaag

SEQ ID NO: 207001 - RNA, 32 nt, Human
guauagaauguucuuggaagcuccauugauuu

SEQ ID NO: 207002 - RNA, 32 nt, Human
guauagacaagcuuuguagugaaguauaguag

SEQ ID NO: 207003 - RNA, 32 nt, Human
guauagaccaugcacaguacacauacgugcau

SEQ ID NO: 207004 - RNA, 32 nt, Human
guauagagaccuaggagguggucuuguggugg

SEQ ID NO: 207005 - RNA, 32 nt, Human
guauagagagugagagucagguggcagcugua

SEQ ID NO: 207006 - RNA, 32 nt, Human
guauagagaugaacagaaaacuuuuucuuuau

SEQ ID NO: 207007 - RNA, 32 nt, Human
guauagaggaagaggaagcugggcauuaaauu

SEQ ID NO: 207008 - RNA, 32 nt, Human
guauagagucucaaacacugaucacaaauaaa

SEQ ID NO: 207009 - RNA, 32 nt, Human
guauagaguuugaaaauuugacaagcacacug

SEQ ID NO: 207010 - RNA, 32 nt, Human
guauagauugcauuucuuagguguuuuaauuu

SEQ ID NO: 207011 - RNA, 32 nt, Human
guauagccagagaaggagaagcucccauccaa

SEQ ID NO: 207012 - RNA, 32 nt, Human
guauagcuccuuuugaccuucauuucauguau

SEQ ID NO: 207013 - RNA, 32 nt, Human
guauaggacaccaggaaaacaacucagggcag

SEQ ID NO: 207014 - RNA, 32 nt, Human
guauaggacagaaacugcaaauauaaaaaucc

SEQ ID NO: 207015 - RNA, 32 nt, Human
guauaggauccugggcugcagcagaaagcuuu

SEQ ID NO: 207016 - RNA, 32 nt, Human
guauaggcacuggguccagccuugaucaguga

SEQ ID NO: 207017 - RNA, 31 nt, Human
guauaggggaaaugaaggaaagacuguggcc

SEQ ID NO: 207018 - RNA, 32 nt, Human
  misc_feature (22)..(22): n is a, c, g or u
guauaggggaagaagagguugnaaaggggaag

SEQ ID NO: 207019 - RNA, 32 nt, Human
guauaggggcuucauuuguucacucugaaaaa

SEQ ID NO: 207020 - RNA, 32 nt, Human
guauagguaugugccaccacacucagcuuuau

SEQ ID NO: 207021 - RNA, 32 nt, Human
guauaggugcagcccugucacaacaccaacag

SEQ ID NO: 207022 - RNA, 32 nt, Human
guauaggugggaguggaggagggaacuuacuu

SEQ ID NO: 207023 - RNA, 32 nt, Human
guauaguaaucauugacuaaagccauuugucu

SEQ ID NO: 207024 - RNA, 32 nt, Human
guauaguacccacuuucugcucuuuggagaga

SEQ ID NO: 207025 - RNA, 32 nt, Human
guauaguaggaaauguaagugggguggcuuau

SEQ ID NO: 207026 - RNA, 32 nt, Human
guauaguauuccauugcaugacuguccugugc

SEQ ID NO: 207027 - RNA, 32 nt, Human
guauagugaaaauaugauguaaaagagaaaac

SEQ ID NO: 207028 - RNA, 32 nt, Human
guauagugagagcaccucacuggcagaaaaac

SEQ ID NO: 207029 - RNA, 32 nt, Human
guauaguggaaagagcuuuugacugaguucuu

SEQ ID NO: 207030 - RNA, 24 nt, Human
guauaguggcaggaaccuguaauc

SEQ ID NO: 207031 - RNA, 32 nt, Human
guauaguggccaucuuugguuacuugauauug

SEQ ID NO: 207032 - RNA, 24 nt, Human
guauagugguaugugccuguaguc

SEQ ID NO: 207033 - RNA, 32 nt, Human
guauaguguacacugcuugggugacaggugca

SEQ ID NO: 207034 - RNA, 32 nt, Human
guauagugugccaggcacuucugcuguauuaa

SEQ ID NO: 207035 - RNA, 32 nt, Human
guauaguuaaguuaugccugugcaaagaagag

SEQ ID NO: 207036 - RNA, 32 nt, Human
guauaguucucuuccugcuuuaagcauuaccu

SEQ ID NO: 207037 - RNA, 32 nt, Human
guauaguuuucaaacaucugugguguaaugau

SEQ ID NO: 207038 - RNA, 32 nt, Human
guauauaaaauauaggcauauaccucauauau

SEQ ID NO: 207039 - RNA, 32 nt, Human
guauauaaaccaggauuagucccagggucgug

SEQ ID NO: 207040 - RNA, 32 nt, Human
guauauacacacgaagguugcuagggaaccac

SEQ ID NO: 207041 - RNA, 32 nt, Human
guauauacagcuuuuccuucuuuuguuuagga

SEQ ID NO: 207042 - RNA, 32 nt, Human
guauauacugugaaaacuuugagaagauaaua

SEQ ID NO: 207043 - RNA, 32 nt, Human
guauaucaacuggcccucaaugaagcauuuaa

SEQ ID NO: 207044 - RNA, 32 nt, Human
guauaucacugaggcugauagcaaagaggcau

SEQ ID NO: 207045 - RNA, 32 nt, Human
guauaucacugauuuuguagagcugcugggag

SEQ ID NO: 207046 - RNA, 32 nt, Human
guauaucauuugcagugcuuguauugguuuaa

SEQ ID NO: 207047 - RNA, 32 nt, Human
guauaucccaggcuggagcuggaugccuggga

SEQ ID NO: 207048 - RNA, 32 nt, Human
guauauccuauacacacaucuccuucaucauc

SEQ ID NO: 207049 - RNA, 32 nt, Human
guauauccuucccaucuauugccuuccagcuu

SEQ ID NO: 207050 - RNA, 32 nt, Human
guauaucugaaacaccuuuucaugucaauaaa

SEQ ID NO: 207051 - RNA, 32 nt, Human
guauaucuuuuaaugucagauaugauacacug

SEQ ID NO: 207052 - RNA, 32 nt, Human
guauaugaaaauuaaaguucugugauaaugac

SEQ ID NO: 207053 - RNA, 32 nt, Human
guauaugagccuuugaaaguucccugaaguuu

SEQ ID NO: 207054 - RNA, 32 nt, Human
guauaugcacacacauaaacggcuuugccuag

SEQ ID NO: 207055 - RNA, 32 nt, Human
guauaugcagguaguugucaccauggauugag

SEQ ID NO: 207056 - RNA, 32 nt, Human
guauaugcugggaacagggugcaggggccaag

SEQ ID NO: 207057 - RNA, 31 nt, Human
guauauggcgcgaucucagcucacugcaacc

SEQ ID NO: 207058 - RNA, 32 nt, Human
guauaugggaccuuaagcuaaccuucuuuacu

SEQ ID NO: 207059 - RNA, 32 nt, Human
guauaugggguaggccgggugcaguggcucac

SEQ ID NO: 207060 - RNA, 32 nt, Human
guauauggugugcguguguauguauguguaug

SEQ ID NO: 207061 - RNA, 32 nt, Human
guauauguaccacauuucuccagacauuuacu

SEQ ID NO: 207062 - RNA, 31 nt, Human
guauauguacuuuucuuaaaaugccaagaac

SEQ ID NO: 207063 - RNA, 32 nt, Human
guauaugugccacauuucuuaauccagucuau

SEQ ID NO: 207064 - RNA, 32 nt, Human
guauaugugcgucucucuuucucccucacccc

SEQ ID NO: 207065 - RNA, 32 nt, Human
guauauguggggacagggaguaugugagaaau

SEQ ID NO: 207066 - RNA, 32 nt, Human
guauauuaauugccuuuauccauuugugaagu

SEQ ID NO: 207067 - RNA, 32 nt, Human
guauauuacauacaugcuuugaaguuucugga

SEQ ID NO: 207068 - RNA, 32 nt, Human
guauauuauguaugucuuuaacuucuuucuuu

SEQ ID NO: 207069 - RNA, 32 nt, Human
guauauuauugauuuuuaauuguggugaaaua

SEQ ID NO: 207070 - RNA, 32 nt, Human
guauauucauacagccuacuccuggguagaca

SEQ ID NO: 207071 - RNA, 32 nt, Human
guauauucccauugccucucccccuuuccucg

SEQ ID NO: 207072 - RNA, 32 nt, Human
guauauucccuccugcugaaugacaugcgacu

SEQ ID NO: 207073 - RNA, 32 nt, Human
guauauucgccucauucaaauggcaguagccu

SEQ ID NO: 207074 - RNA, 32 nt, Human
guauauucuagucauuuugauuugaguuaacc

SEQ ID NO: 207075 - RNA, 32 nt, Human
guauauucuaugaaauggaagaaacaagaacu

SEQ ID NO: 207076 - RNA, 32 nt, Human
guauauucuuccagagaucucugucuauacaa

SEQ ID NO: 207077 - RNA, 20 nt, Human
guauauucuuccccagggaa

SEQ ID NO: 207078 - RNA, 32 nt, Human
guauauugggggaggaagagagggaggcacgu

SEQ ID NO: 207079 - RNA, 32 nt, Human
guauauuggguccucugggcaguagaggcaaa

SEQ ID NO: 207080 - RNA, 32 nt, Human
guauauuuagcaguagcacccaaaaccaagcc

SEQ ID NO: 207081 - RNA, 32 nt, Human
guauauuugacagauuaguacuguguccugug

SEQ ID NO: 207082 - RNA, 32 nt, Human
guauauuugaggacagcaucuugcuagagaaa

SEQ ID NO: 207083 - RNA, 32 nt, Human
guauauuugcagauucucugggauuuuaagga

SEQ ID NO: 207084 - RNA, 32 nt, Human
guauauuuguaagaaacauggccaggcaagau

SEQ ID NO: 207085 - RNA, 32 nt, Human
guauauuuuaugccaugacuaaaagugccauu

SEQ ID NO: 207086 - RNA, 32 nt, Human
guauauuuuccugaauuucucaucucaaaccc

SEQ ID NO: 207087 - RNA, 32 nt, Human
guauauuuuccugcucugccuucugggacuag

SEQ ID NO: 207088 - RNA, 32 nt, Human
guaucaagaauuuauauuuugccugcagaaaa

SEQ ID NO: 207089 - RNA, 20 nt, Human
guaucaaggagcaggaagca

SEQ ID NO: 207090 - RNA, 18 nt, Human
guaucaauaaauaugcac

SEQ ID NO: 207091 - RNA, 18 nt, Human
guaucaaucucacagcau

SEQ ID NO: 207092 - RNA, 32 nt, Human
guaucaauggcauuuuauguccagcuaacauc

SEQ ID NO: 207093 - RNA, 20 nt, Human
guaucacaaguucacagcac

SEQ ID NO: 207094 - RNA, 32 nt, Human
guaucacagcucacauuaccugcccagcgcug

SEQ ID NO: 207095 - RNA, 32 nt, Human
guaucacauaggguuuuuggucacucacaacc

SEQ ID NO: 207096 - RNA, 32 nt, Human
guaucaccaaacccuugcaggcucuuaugggc

SEQ ID NO: 207097 - RNA, 32 nt, Human
guaucacccaaagcauguaugugaucuuuccc

SEQ ID NO: 207098 - RNA, 32 nt, Human
guaucacccaggccagaguguaguggcacaau

SEQ ID NO: 207099 - RNA, 26 nt, Human
guaucacccaggcuggaguacagugg

SEQ ID NO: 207100 - RNA, 32 nt, Human
guaucacccuuccucccuccccaggcaccacu

SEQ ID NO: 207101 - RNA, 32 nt, Human
guaucaccucauucaucacuuggacacaucgc

SEQ ID NO: 207102 - RNA, 32 nt, Human
guaucacguaagugugugagugcagugcagau

SEQ ID NO: 207103 - RNA, 32 nt, Human
guaucacuccaaaugaaguguuuuccuugcuu

SEQ ID NO: 207104 - RNA, 32 nt, Human
guaucacugguucgggggaaauaguuccauuc

SEQ ID NO: 207105 - RNA, 32 nt, Human
guaucacuguguaugguaaggaauucuuuuca

SEQ ID NO: 207106 - RNA, 32 nt, Human
guaucagaaacuacaguuuugccuuguauuuu

SEQ ID NO: 207107 - RNA, 32 nt, Human
guaucagaacagcuucccucacuguguacaga

SEQ ID NO: 207108 - RNA, 32 nt, Human
guaucagaauacuugcacucuuuaacacauuc

SEQ ID NO: 207109 - RNA, 32 nt, Human
guaucagaccuacaggcugcuggcaggauuug

SEQ ID NO: 207110 - RNA, 32 nt, Human
guaucagacuccuauagacaaugagcugcgaa

SEQ ID NO: 207111 - RNA, 19 nt, Human
guaucagagcugcuuucca

SEQ ID NO: 207112 - RNA, 32 nt, Human
guaucagauguugauaaaagcaauuuuaacuu

SEQ ID NO: 207113 - RNA, 31 nt, Human
guaucagcaaugucugccuggaggccgagac

SEQ ID NO: 207114 - RNA, 31 nt, Human
guaucagcacuuuucuuucauuagggggaag

SEQ ID NO: 207115 - RNA, 32 nt, Human
guaucagcagcuuaucagggaccaugguuuuc

SEQ ID NO: 207116 - RNA, 32 nt, Human
guaucagcaguuuguuccuuuucauugcugag

SEQ ID NO: 207117 - RNA, 32 nt, Human
guaucagccaacaacgugaucugacaggacag

SEQ ID NO: 207118 - RNA, 32 nt, Human
guaucagccagccuuccccaccaagucuaaaa

SEQ ID NO: 207119 - RNA, 32 nt, Human
guaucaggacccagaggaaggggccagaggcu

SEQ ID NO: 207120 - RNA, 32 nt, Human
guaucaggauuucauuugcauguuaguccaca

SEQ ID NO: 207121 - RNA, 32 nt, Human
guaucaguaaauucccuuuuccauguugcuuc

SEQ ID NO: 207122 - RNA, 32 nt, Human
guaucaguacuguuuugcaaauacucagcaua

SEQ ID NO: 207123 - RNA, 32 nt, Human
guaucaguguaacugccaguucaguuaaucaa

SEQ ID NO: 207124 - RNA, 32 nt, Human
guaucaguucucuaacacuuguuccugagaac

SEQ ID NO: 207125 - RNA, 32 nt, Human
guaucaguuguaaagauacauugagauagaau

SEQ ID NO: 207126 - RNA, 32 nt, Human
guaucaguuucgguagaggugcagcaucguga

SEQ ID NO: 207127 - RNA, 32 nt, Human
guaucauagcaugcucuuaccuguucagugag

SEQ ID NO: 207128 - RNA, 32 nt, Human
guaucauaggaaagccuacaacgguguguuac

SEQ ID NO: 207129 - RNA, 32 nt, Human
guaucaucagaagaaagagaugaacaauuuag

SEQ ID NO: 207130 - RNA, 32 nt, Human
guaucaucauucuugugacuacuauccacacc

SEQ ID NO: 207131 - RNA, 32 nt, Human
guaucauccaaggucgacuucagacugcugug

SEQ ID NO: 207132 - RNA, 32 nt, Human
guaucauccuggcugagucucagugcuccuca

SEQ ID NO: 207133 - RNA, 32 nt, Human
guaucauccuucuccaguguguaagguguugu

SEQ ID NO: 207134 - RNA, 32 nt, Human
guaucaucuguguuaagugaugagaccauauu

SEQ ID NO: 207135 - RNA, 28 nt, Human
guaucaugcagugcugcccucauccucc

SEQ ID NO: 207136 - RNA, 32 nt, Human
guaucauggaccugccuucucaucuuuauagu

SEQ ID NO: 207137 - RNA, 32 nt, Human
guaucauguccauguuuccuucaccucagugg

SEQ ID NO: 207138 - RNA, 32 nt, Human
guaucauuaucaggccagcugcagccucuugc

SEQ ID NO: 207139 - RNA, 32 nt, Human
guaucauugcagcccccuacauggcagagaga

SEQ ID NO: 207140 - RNA, 32 nt, Human
guaucauugccucaauggugcgucugccugca

SEQ ID NO: 207141 - RNA, 32 nt, Human
guauccaagaagugaaguguucaaccacugag

SEQ ID NO: 207142 - RNA, 32 nt, Human
guauccacuccaggcugggcaauuuuguaccu

SEQ ID NO: 207143 - RNA, 32 nt, Human
guauccagaaaccugaguggacauugggugcu

SEQ ID NO: 207144 - RNA, 31 nt, Human
guauccagcaugcuggagaccaaagcugccg

SEQ ID NO: 207145 - RNA, 32 nt, Human
guauccagccaucaguuuccugagaaagagca

SEQ ID NO: 207146 - RNA, 32 nt, Human
guauccaggagguggaagugaauugcaagugg

SEQ ID NO: 207147 - RNA, 32 nt, Human
guaucccacaguuggauucaguuggcugugaa

SEQ ID NO: 207148 - RNA, 32 nt, Human
guaucccaccuaugguucaguguugcaagagu

SEQ ID NO: 207149 - RNA, 32 nt, Human
guaucccagcacuuuggaaggcugaggcgggu

SEQ ID NO: 207150 - RNA, 32 nt, Human
guaucccagcacuuugggaggccgaggcgggc

SEQ ID NO: 207151 - RNA, 32 nt, Human
guaucccagcacuuugggaggcugaggcgggu

SEQ ID NO: 207152 - RNA, 32 nt, Human
guaucccagcuacucgggaggcugaggcagga

SEQ ID NO: 207153 - RNA, 32 nt, Human
guaucccauaaauauaugcaaguauuauuugu

SEQ ID NO: 207154 - RNA, 32 nt, Human
guaucccaugaggcuaggagacaggaguccug

SEQ ID NO: 207155 - RNA, 32 nt, Human
guaucccccaucgcuuaucucugccuccuucc

SEQ ID NO: 207156 - RNA, 32 nt, Human
guaucccccuacuccuacccucaucucauccu

SEQ ID NO: 207157 - RNA, 32 nt, Human
guauccccuucugcuuaacacacccacugaga

SEQ ID NO: 207158 - RNA, 32 nt, Human
guauccccuuggccugccaccagcaccugcac

SEQ ID NO: 207159 - RNA, 24 nt, Human
guaucccggggagccaggaagcag

SEQ ID NO: 207160 - RNA, 32 nt, Human
guaucccgugcuguuucccuggcagacacaca

SEQ ID NO: 207161 - RNA, 32 nt, Human
guaucccuccccucaguuuuaaccugagcugc

SEQ ID NO: 207162 - RNA, 32 nt, Human
guaucccugcucccuuuuuccuccccuucccu

SEQ ID NO: 207163 - RNA, 32 nt, Human
guaucccuuugucaaaccuuguuucccaaauu

SEQ ID NO: 207164 - RNA, 32 nt, Human
guauccuagcuggucucgacuuccugucuggu

SEQ ID NO: 207165 - RNA, 32 nt, Human
guauccuaucucuuucuacaucagaucaaaac

SEQ ID NO: 207166 - RNA, 32 nt, Human
guauccuccagccaaucagggccuggggaauc

SEQ ID NO: 207167 - RNA, 32 nt, Human
guauccugccuaagcuuccugugucacuggga

SEQ ID NO: 207168 - RNA, 32 nt, Human
guauccugggacuuggaagcuggcaggauuug

SEQ ID NO: 207169 - RNA, 32 nt, Human
guauccugggggacccaauguaggagcugccu

SEQ ID NO: 207170 - RNA, 32 nt, Human
guauccugugugugugaagcacccgccgucag

SEQ ID NO: 207171 - RNA, 32 nt, Human
guauccuuccuggugcucacacaccugucacc

SEQ ID NO: 207172 - RNA, 32 nt, Human
guauccuugacuuuggcagucaccuuuuugua

SEQ ID NO: 207173 - RNA, 32 nt, Human
guauccuugagaaacuuuguuuuuguggaagu

SEQ ID NO: 207174 - RNA, 32 nt, Human
guauccuuggcugcuuuacugugguggccgaa

SEQ ID NO: 207175 - RNA, 32 nt, Human
guauccuuucuaggcuuggagauggcuuuggu

SEQ ID NO: 207176 - RNA, 32 nt, Human
guauccuuugagaugaagucguguucucaaaa

SEQ ID NO: 207177 - RNA, 32 nt, Human
guaucgaaaaccagaaaccacuuuuaauaaug

SEQ ID NO: 207178 - RNA, 32 nt, Human
guaucgcagggcccuguuacauaaaccagaga

SEQ ID NO: 207179 - RNA, 32 nt, Human
guaucggccgggcgcacuggcuuacgccugua

SEQ ID NO: 207180 - RNA, 32 nt, Human
guaucgggugaggccagcuggagaacugcaac

SEQ ID NO: 207181 - RNA, 32 nt, Human
guaucuaaaccagaauauuuuggucaaauaua

SEQ ID NO: 207182 - RNA, 32 nt, Human
guaucuaacucuguuccuucucagccaccuug

SEQ ID NO: 207183 - RNA, 32 nt, Human
guaucuaaucuugccaggucuuggccaguuga

SEQ ID NO: 207184 - RNA, 32 nt, Human
guaucuauuuguacaauuuuaaaguucuuauu

SEQ ID NO: 207185 - RNA, 32 nt, Human
guaucucaauuacuguucuucauuucaauuau

SEQ ID NO: 207186 - RNA, 32 nt, Human
guaucucacagaacccuggugggcaguaauca

SEQ ID NO: 207187 - RNA, 32 nt, Human
guaucucauccagaagcaagaaaagggcaugu

SEQ ID NO: 207188 - RNA, 32 nt, Human
guaucucauccuuugcuggagcagguuugcag

SEQ ID NO: 207189 - RNA, 19 nt, Human
guaucuccacagcaugcac

SEQ ID NO: 207190 - RNA, 20 nt, Human
guaucuccuaucacaugcac

SEQ ID NO: 207191 - RNA, 32 nt, Human
guaucuccuccaccucucccauuccaucccca

SEQ ID NO: 207192 - RNA, 32 nt, Human
guaucuccuggccucugcuuuugugucucaca

SEQ ID NO: 207193 - RNA, 32 nt, Human
guaucuccugucuucccuacugcuccaaaccc

SEQ ID NO: 207194 - RNA, 32 nt, Human
guaucucggggaaguucuuacagcauuccugg

SEQ ID NO: 207195 - RNA, 32 nt, Human
guaucucuacuguguaccuguggcauuccuuc

SEQ ID NO: 207196 - RNA, 32 nt, Human
guaucucucugcuacucaaaggcugacucucu

SEQ ID NO: 207197 - RNA, 32 nt, Human
guaucucugagccuggugggauccccggagcg

SEQ ID NO: 207198 - RNA, 32 nt, Human
guaucucugccuucucuccauuguuagccuug

SEQ ID NO: 207199 - RNA, 32 nt, Human
guaucugaacuaaggaccagaggcugccagau

SEQ ID NO: 207200 - RNA, 32 nt, Human
guaucugaaggcauuuucagcucuagcaauuu

SEQ ID NO: 207201 - RNA, 32 nt, Human
guaucugcaagccaaguuuggaaggcauucgg

SEQ ID NO: 207202 - RNA, 32 nt, Human
guaucugcccccaguccaggccaggcggaggg

SEQ ID NO: 207203 - RNA, 32 nt, Human
guaucugccuccauuuuccugagcucaaaaag

SEQ ID NO: 207204 - RNA, 32 nt, Human
guaucugccugagaaccugggcucugagacgc

SEQ ID NO: 207205 - RNA, 32 nt, Human
guaucugccugcccccugucacugcgucugcg

SEQ ID NO: 207206 - RNA, 32 nt, Human
guaucugccuuucucugucucuagacagggaa

SEQ ID NO: 207207 - RNA, 32 nt, Human
guaucuggaaaaucacuuugggguccauuuac

SEQ ID NO: 207208 - RNA, 32 nt, Human
guaucuggcuggguuuucaggggcuuuggaag

SEQ ID NO: 207209 - RNA, 32 nt, Human
guaucugggaggcagaguuugccgugagcuga

SEQ ID NO: 207210 - RNA, 32 nt, Human
guaucugggauuacaggcaugugccaccacac

SEQ ID NO: 207211 - RNA, 32 nt, Human
guaucugggauuacauaugucggcuaccgugu

SEQ ID NO: 207212 - RNA, 32 nt, Human
guaucugggauuauaagcaagagccacugcuc

SEQ ID NO: 207213 - RNA, 32 nt, Human
guaucugggcuuuuuccuccugucugacccag

SEQ ID NO: 207214 - RNA, 23 nt, Human
guaucugguaggggagaaagcag

SEQ ID NO: 207215 - RNA, 32 nt, Human
guaucugguaggggagaaagcagcaggacagu

SEQ ID NO: 207216 - RNA, 32 nt, Human
guaucuguagccugucuaccuccugcaguggg

SEQ ID NO: 207217 - RNA, 32 nt, Human
guaucuguauggcagcaagccagcaaguuccu

SEQ ID NO: 207218 - RNA, 22 nt, Human
guaucuguccggacggaagcag

SEQ ID NO: 207219 - RNA, 32 nt, Human
guaucugugguuucaugccccucucuauaccu

SEQ ID NO: 207220 - RNA, 32 nt, Human
guaucuguguauccacauaggauuucucuuaa

SEQ ID NO: 207221 - RNA, 32 nt, Human
guaucuguuaauaaccacagggguuaauauga

SEQ ID NO: 207222 - RNA, 32 nt, Human
guaucuguugggccuugggaacugagguaggc

SEQ ID NO: 207223 - RNA, 32 nt, Human
guaucuuaaaugcaaucucuucucucuuagcc

SEQ ID NO: 207224 - RNA, 32 nt, Human
guaucuuauaauaaaaaggaaggacaggagga

SEQ ID NO: 207225 - RNA, 32 nt, Human
guaucuuccuucaccuccuccucuuaggagcu

SEQ ID NO: 207226 - RNA, 32 nt, Human
guaucuuccuucagcuccuccucuuaggagcu

SEQ ID NO: 207227 - RNA, 32 nt, Human
guaucuucucacugagcccgggccagaugcuc

SEQ ID NO: 207228 - RNA, 32 nt, Human
guaucuucucccugggcagaccagcaggcaga

SEQ ID NO: 207229 - RNA, 32 nt, Human
guaucuucucuuuucuaauucuuuggauuuaa

SEQ ID NO: 207230 - RNA, 32 nt, Human
guaucuugacccuggucucagaaaugacauuu

SEQ ID NO: 207231 - RNA, 32 nt, Human
guaucuugaguuaaaagaaccugcucuccauu

SEQ ID NO: 207232 - RNA, 32 nt, Human
guaucuuggagacacguuucagaggaagugga

SEQ ID NO: 207233 - RNA, 32 nt, Human
guaucuugggccugaggauugaggccuagaga

SEQ ID NO: 207234 - RNA, 32 nt, Human
guaucuugguugugcucugggguggggguggg

SEQ ID NO: 207235 - RNA, 32 nt, Human
guaucuuuccaaagugcagacucuugugaagu

SEQ ID NO: 207236 - RNA, 32 nt, Human
guaucuuucccagaaaauaauguguuuuaaua

SEQ ID NO: 207237 - RNA, 32 nt, Human
guaucuuucucauuacaauaggcacagagaag

SEQ ID NO: 207238 - RNA, 32 nt, Human
guaucuuugugggacagugagaagacugagaa

SEQ ID NO: 207239 - RNA, 32 nt, Human
guaucuuuucuccuccucccuaguguuccucc

SEQ ID NO: 207240 - RNA, 32 nt, Human
guaucuuuucugagagagggggagucaccccc

SEQ ID NO: 207241 - RNA, 32 nt, Human
guaugaaaagguucucuacacagcugcugcag

SEQ ID NO: 207242 - RNA, 21 nt, Human
guaugaaaaucaaccauguuu

SEQ ID NO: 207243 - RNA, 32 nt, Human
guaugaaaaugauuuuuacaauguaaagagag

SEQ ID NO: 207244 - RNA, 32 nt, Human
guaugaaagauggcugugccucugccugucuc

SEQ ID NO: 207245 - RNA, 32 nt, Human
guaugaaccacugcaccuggcccuggauugca

SEQ ID NO: 207246 - RNA, 32 nt, Human
guaugaaccauaaccugcugugguaccuuugu

SEQ ID NO: 207247 - RNA, 32 nt, Human
guaugaacccauugguuagagugcaguggcuu

SEQ ID NO: 207248 - RNA, 32 nt, Human
guaugaacuucugccuucacgcugccaggaga

SEQ ID NO: 207249 - RNA, 32 nt, Human
guaugaagacaugcuaagcaucaugcuugcua

SEQ ID NO: 207250 - RNA, 32 nt, Human
guaugaagaguguuauuuucauucaaaguguu

SEQ ID NO: 207251 - RNA, 32 nt, Human
guaugaagcugcgcuccuccaucggguuuggg

SEQ ID NO: 207252 - RNA, 27 nt, Human
guaugaaucgugcacacagccaugcuu

SEQ ID NO: 207253 - RNA, 23 nt, Human
guaugaaugagccagccaugcuu

SEQ ID NO: 207254 - RNA, 32 nt, Human
guaugacagugaagcagcacugugagugguuc

SEQ ID NO: 207255 - RNA, 32 nt, Human
guaugacaugauacaguaggaguugucuauac

SEQ ID NO: 207256 - RNA, 28 nt, Human
guaugaccaaauccugccucauuaauuc

SEQ ID NO: 207257 - RNA, 21 nt, Human
guaugacccacauuacuuuuu

SEQ ID NO: 207258 - RNA, 21 nt, Human
guaugacccuguguacuuuuu

SEQ ID NO: 207259 - RNA, 32 nt, Human
guaugaccuggguggggucagggaaagucuua

SEQ ID NO: 207260 - RNA, 24 nt, Human
guaugacggcucacgccuguaauc

SEQ ID NO: 207261 - RNA, 32 nt, Human
guaugacgguccaucagcgcucugccuuccag

SEQ ID NO: 207262 - RNA, 32 nt, Human
guaugacugcacuccagccugggugacagacc

SEQ ID NO: 207263 - RNA, 32 nt, Human
guaugacugcacuccagccugggugacagagc

SEQ ID NO: 207264 - RNA, 32 nt, Human
guaugacugccaugaguuccaccagaaagcca

SEQ ID NO: 207265 - RNA, 32 nt, Human
guaugacugccucuccaacccugugggcugua

SEQ ID NO: 207266 - RNA, 32 nt, Human
guaugacuuauuuuuccuuauccacagauuuc

SEQ ID NO: 207267 - RNA, 32 nt, Human
guaugagaaucuaucuguucugugcuggacuu

SEQ ID NO: 207268 - RNA, 32 nt, Human
guaugagacuagccuggacaacauacuaaaac

SEQ ID NO: 207269 - RNA, 32 nt, Human
guaugagaggagggaggcaggcugcagcuuca

SEQ ID NO: 207270 - RNA, 32 nt, Human
guaugagagggacagaaaaaugaagaugaaag

SEQ ID NO: 207271 - RNA, 32 nt, Human
guaugagagggcccugccugcugcaucuuuuc

SEQ ID NO: 207272 - RNA, 32 nt, Human
guaugagaucuucaugauucuggaccauaagg

SEQ ID NO: 207273 - RNA, 32 nt, Human
guaugagcacagugccuggaccugaaugauca

SEQ ID NO: 207274 - RNA, 32 nt, Human
guaugaggaccagcuuagcugcacacccccag

SEQ ID NO: 207275 - RNA, 32 nt, Human
guaugaggaggaggaggaggaggaugugaaga

SEQ ID NO: 207276 - RNA, 32 nt, Human
guaugaguaauauaggguaugaaugguuuaau

SEQ ID NO: 207277 - RNA, 32 nt, Human
guaugaguaauguggaaucuggggaaggggug

SEQ ID NO: 207278 - RNA, 32 nt, Human
guaugauauaaggaaugugggaaaguguucga

SEQ ID NO: 207279 - RNA, 32 nt, Human
guaugauaugguguccucugugccaguuuugu

SEQ ID NO: 207280 - RNA, 32 nt, Human
guaugauauuauacauuaaccuuuauuuaugu

SEQ ID NO: 207281 - RNA, 32 nt, Human
guaugauccaauaacuuauuuugucacagggc

SEQ ID NO: 207282 - RNA, 25 nt, Human
guaugaucuauggccccuacuuucu

SEQ ID NO: 207283 - RNA, 32 nt, Human
guaugaugacaucucacaggucuugccuuuaa

SEQ ID NO: 207284 - RNA, 32 nt, Human
guaugaugagaaugaucaaggacucuacacac

SEQ ID NO: 207285 - RNA, 32 nt, Human
guaugauggguggaugaggcuguccauuguac

SEQ ID NO: 207286 - RNA, 32 nt, Human
guaugauuaccuaagccuuagcacagaaggua

SEQ ID NO: 207287 - RNA, 32 nt, Human
guaugcaaauauuauuuucuucauacauucau

SEQ ID NO: 207288 - RNA, 32 nt, Human
guaugcacacacacaugcaccgcacacauauc

SEQ ID NO: 207289 - RNA, 32 nt, Human
guaugcacagaauggacgagugcagcccagcc

SEQ ID NO: 207290 - RNA, 32 nt, Human
guaugcacgugugcacacaccacacacauaca

SEQ ID NO: 207291 - RNA, 32 nt, Human
guaugcacuggguggaagaaggguaggagggc

SEQ ID NO: 207292 - RNA, 32 nt, Human
guaugcagaggaguuuucaagaggcuaucugg

SEQ ID NO: 207293 - RNA, 32 nt, Human
guaugccagauggccacacccccagccacaga

SEQ ID NO: 207294 - RNA, 32 nt, Human
guaugccagggagaaagagagagcgcgaaaga

SEQ ID NO: 207295 - RNA, 32 nt, Human
guaugccagucacagcaguggaaaagaccugg

SEQ ID NO: 207296 - RNA, 32 nt, Human
guaugccauauguaaauauguacgagugugua

SEQ ID NO: 207297 - RNA, 32 nt, Human
guaugccccugcccuguucuauaaauagcuau

SEQ ID NO: 207298 - RNA, 32 nt, Human
guaugccccugcccuguucuauaaauaucuau

SEQ ID NO: 207299 - RNA, 32 nt, Human
guaugcccuaggaagaaaucaugcuggguuuu

SEQ ID NO: 207300 - RNA, 32 nt, Human
guaugcccugcucccuuugcugggucccuacc

SEQ ID NO: 207301 - RNA, 32 nt, Human
guaugcccuuucucagcauccuagguccaucc

SEQ ID NO: 207302 - RNA, 32 nt, Human
guaugccgcugcacuccagccugggggacaga

SEQ ID NO: 207303 - RNA, 32 nt, Human
guaugccuacgauccuagcuacucaggaggcu

SEQ ID NO: 207304 - RNA, 32 nt, Human
guaugccuggcuuuguuuacaaacauauaucu

SEQ ID NO: 207305 - RNA, 32 nt, Human
guaugccuggugcuuucucucagaacucauca

SEQ ID NO: 207306 - RNA, 32 nt, Human
guaugccuguaaucccagcuacucgggaggcu

SEQ ID NO: 207307 - RNA, 32 nt, Human
guaugccuguaaucccagcuacuuaggaggcu

SEQ ID NO: 207308 - RNA, 32 nt, Human
guaugcgagaggcuggagguuggcgcuagagg

SEQ ID NO: 207309 - RNA, 32 nt, Human
guaugcgcacaguuccugugggacugggccgu

SEQ ID NO: 207310 - RNA, 32 nt, Human
guaugcgugucuauguggccauggcccuggcc

SEQ ID NO: 207311 - RNA, 32 nt, Human
guaugcuauaaacuaugcuacucucauacagg

SEQ ID NO: 207312 - RNA, 32 nt, Human
guaugcuccaaucacguugcuggcaaggcauu

SEQ ID NO: 207313 - RNA, 32 nt, Human
guaugcucccaccuccaccugccccacucacc

SEQ ID NO: 207314 - RNA, 32 nt, Human
guaugcuccucacuugccccuacaaaauccac

SEQ ID NO: 207315 - RNA, 32 nt, Human
guaugcuccucucuuuucugagagagaaggca

SEQ ID NO: 207316 - RNA, 32 nt, Human
guaugcuggaaacauuaucccaaggcuuuacc

SEQ ID NO: 207317 - RNA, 32 nt, Human
guaugcuggaggcagagggcaagggaggggug

SEQ ID NO: 207318 - RNA, 32 nt, Human
guaugcuggccagcacccucuccugggggugg

SEQ ID NO: 207319 - RNA, 32 nt, Human
guaugcugucaugguccuuucuggaaguuucu

SEQ ID NO: 207320 - RNA, 32 nt, Human
guaugcuuauuucugugccuacuguauaaugg

SEQ ID NO: 207321 - RNA, 32 nt, Human
guaugcuucaucaccuauauuaggcaaauucc

SEQ ID NO: 207322 - RNA, 32 nt, Human
guaugcuuggauguauugggcagcagcuucua

SEQ ID NO: 207323 - RNA, 32 nt, Human
guaugcuuguuauccaugcaucugugucuuua

SEQ ID NO: 207324 - RNA, 31 nt, Human
guauggaaaacauaggguaccaaagugugga

SEQ ID NO: 207325 - RNA, 32 nt, Human
guauggaacacauuugucccagaucugagcau

SEQ ID NO: 207326 - RNA, 32 nt, Human
guauggaauacuugaggggaaguuaaauugua

SEQ ID NO: 207327 - RNA, 32 nt, Human
guauggaccagugcccuccgcagacagcucac

SEQ ID NO: 207328 - RNA, 32 nt, Human
guauggacuggagaugaugggagccaguugga

SEQ ID NO: 207329 - RNA, 32 nt, Human
guauggagcacauugcugccucuggcuaggac

SEQ ID NO: 207330 - RNA, 25 nt, Human
guauggagccuccaucaucaugcuc

SEQ ID NO: 207331 - RNA, 32 nt, Human
guauggagcucuuuuaaaaugugauuauuuau

SEQ ID NO: 207332 - RNA, 32 nt, Human
guauggagcugggcuccagggugcacggggau

SEQ ID NO: 207333 - RNA, 32 nt, Human
guauggaggaagggguuuucauugcauugcau

SEQ ID NO: 207334 - RNA, 32 nt, Human
guauggaucucucaucauagaggugugugcau

SEQ ID NO: 207335 - RNA, 32 nt, Human
guauggcaagcauaaaucaagcucagucuggg

SEQ ID NO: 207336 - RNA, 32 nt, Human
guauggcagcccauguucucuaaugccacugc

SEQ ID NO: 207337 - RNA, 32 nt, Human
guauggcaguacagugcucuguucauugcaag

SEQ ID NO: 207338 - RNA, 32 nt, Human
guauggccuggcccugcccucccgaaggccgc

SEQ ID NO: 207339 - RNA, 21 nt, Human
guauggcgcccaccuguaauc

SEQ ID NO: 207340 - RNA, 32 nt, Human
guauggcugacugcccuggaucccucucccag

SEQ ID NO: 207341 - RNA, 32 nt, Human
guauggcuuuguuuucagucuauuucuaggag

SEQ ID NO: 207342 - RNA, 32 nt, Human
guaugggacaugcacacacacucacaugcucu

SEQ ID NO: 207343 - RNA, 32 nt, Human
guaugggcaaagcuuuugugaucacacaccac

SEQ ID NO: 207344 - RNA, 32 nt, Human
guaugggcagauucagucuccagaggguauuc

SEQ ID NO: 207345 - RNA, 32 nt, Human
guaugggcagcccaagguugcaugggaaaaca

SEQ ID NO: 207346 - RNA, 32 nt, Human
guauggggaagaguuuuggaaggggaggaaaa

SEQ ID NO: 207347 - RNA, 22 nt, Human
guauggggcccuggcuguguuc

SEQ ID NO: 207348 - RNA, 32 nt, Human
guaugggguggggagagaggguggaggguuuu

SEQ ID NO: 207349 - RNA, 24 nt, Human
guauggguggccacagccaugcuu

SEQ ID NO: 207350 - RNA, 32 nt, Human
guauggguguccgguuggguccuguguuuggu

SEQ ID NO: 207351 - RNA, 32 nt, Human
guauggguguguuggggaagucacuguguuuc

SEQ ID NO: 207352 - RNA, 32 nt, Human
guaugguacuagcacaccacugcaugucucua

SEQ ID NO: 207353 - RNA, 32 nt, Human
guaugguaucuuuagauauuugccugucuguu

SEQ ID NO: 207354 - RNA, 24 nt, Human
guauggugacucaugccuguaauc

SEQ ID NO: 207355 - RNA, 23 nt, Human
guauggugcucacgccuguaauc

SEQ ID NO: 207356 - RNA, 24 nt, Human
guaugguggcacaugccuguaauu

SEQ ID NO: 207357 - RNA, 24 nt, Human
guaugguggcacaugccuguaguc

SEQ ID NO: 207358 - RNA, 24 nt, Human
guaugguggcauaugccuauauuc

SEQ ID NO: 207359 - RNA, 24 nt, Human
guaugguggcaugugccuguaguc

SEQ ID NO: 207360 - RNA, 24 nt, Human
guaugguggcgggcgccuguaguc

SEQ ID NO: 207361 - RNA, 24 nt, Human
guaugguggcucaagccuguaauc

SEQ ID NO: 207362 - RNA, 24 nt, Human
guaugguggcucacaacuguaauc

SEQ ID NO: 207363 - RNA, 24 nt, Human
guaugguggcucacgccuauaauc

SEQ ID NO: 207364 - RNA, 24 nt, Human
guaugguggcucacgccuauuauc

SEQ ID NO: 207365 - RNA, 24 nt, Human
guaugguggcucacgccuguaauc

SEQ ID NO: 207366 - RNA, 21 nt, Human
guaugguggcucaugccugua

SEQ ID NO: 207367 - RNA, 24 nt, Human
guaugguggcucaugccuguaauc

SEQ ID NO: 207368 - RNA, 24 nt, Human
guaugguggcucaugucuauaauc

SEQ ID NO: 207369 - RNA, 24 nt, Human
guaugguggcuuacgccuauaauc

SEQ ID NO: 207370 - RNA, 24 nt, Human
guaugguggcuuaugccuguaguc

SEQ ID NO: 207371 - RNA, 31 nt, Human
guauggugggugguggggaaucugggagaga

SEQ ID NO: 207372 - RNA, 24 nt, Human
guauggugguacaugccuguaauc

SEQ ID NO: 207373 - RNA, 24 nt, Human
guaugguggugaacaccuguaauc

SEQ ID NO: 207374 - RNA, 24 nt, Human
guaugguggugcacaccuguaguc

SEQ ID NO: 207375 - RNA, 24 nt, Human
guaugguggugcacgcuuguaauc

SEQ ID NO: 207376 - RNA, 24 nt, Human
guaugguggugcauaccuguaauc

SEQ ID NO: 207377 - RNA, 24 nt, Human
guauggugguucaugccuggaauc

SEQ ID NO: 207378 - RNA, 32 nt, Human
guauggugucaugagauccucuaccucauaac

SEQ ID NO: 207379 - RNA, 24 nt, Human
guauggugucucacaccuguaauc

SEQ ID NO: 207380 - RNA, 32 nt, Human
guaugguguuugcgaaaacuugcggaagcugg

SEQ ID NO: 207381 - RNA, 32 nt, Human
guaugguuaacucucaggccauuauguuuuuc

SEQ ID NO: 207382 - RNA, 32 nt, Human
guaugguuuaaagauuuguguagagguaguga

SEQ ID NO: 207383 - RNA, 32 nt, Human
guaugguuucuaugcuguuucuugucacuggc

SEQ ID NO: 207384 - RNA, 32 nt, Human
guaugguuuuucuucuaagccuaaaauaagcu

SEQ ID NO: 207385 - RNA, 32 nt, Human
guauguaaagcgccuugcacacugccuggcac

SEQ ID NO: 207386 - RNA, 32 nt, Human
guauguaacagcugaccaacaugugaagauac

SEQ ID NO: 207387 - RNA, 32 nt, Human
guauguaauagaagaaagaaguccacguuuuc

SEQ ID NO: 207388 - RNA, 32 nt, Human
guauguacaaguugaguaucccuuauccaaaa

SEQ ID NO: 207389 - RNA, 32 nt, Human
guauguacacagcuaacacagcucuuuagauu

SEQ ID NO: 207390 - RNA, 32 nt, Human
guauguacacucugaaguacagccuggguuag

SEQ ID NO: 207391 - RNA, 32 nt, Human
guauguacagacugaggcucuggggugagguc

SEQ ID NO: 207392 - RNA, 32 nt, Human
guauguaccucccucacuucucuccuaucacu

SEQ ID NO: 207393 - RNA, 32 nt, Human
guauguagagaaaagggaaggagcaggaggag

SEQ ID NO: 207394 - RNA, 32 nt, Human
guauguagucaccauuccagaaccucucuuuu

SEQ ID NO: 207395 - RNA, 32 nt, Human
guauguagucagcucuuguaauacucauauuu

SEQ ID NO: 207396 - RNA, 32 nt, Human
guauguauaguaauaguagcuugagugaauau

SEQ ID NO: 207397 - RNA, 32 nt, Human
guauguaugcaugugauggugccugagacccc

SEQ ID NO: 207398 - RNA, 32 nt, Human
guauguauggaaaggaacucauuuaucaaauu

SEQ ID NO: 207399 - RNA, 32 nt, Human
guauguauggaauguuaugauaugacauagua

SEQ ID NO: 207400 - RNA, 32 nt, Human
guccccacuucgccucccuccugcugccccca

SEQ ID NO: 207401 - RNA, 21 nt, Human
guccccagaagcauccaagaa

SEQ ID NO: 207402 - RNA, 32 nt, Human
guccccagaaugcugcgcuucuccuacaaggu

SEQ ID NO: 207403 - RNA, 32 nt, Human
guccccagacagggaucugggcccucagacuu

SEQ ID NO: 207404 - RNA, 32 nt, Human
guccccagaguuucuugagggcuggguuucac

SEQ ID NO: 207405 - RNA, 32 nt, Human
guccccagaugguagagagcagucauaucuua

SEQ ID NO: 207406 - RNA, 32 nt, Human
guccccagcagauggcaaguuccuugcaggcc

SEQ ID NO: 207407 - RNA, 32 nt, Human
guccccagcagcucaguccugcagugagaguc

SEQ ID NO: 207408 - RNA, 32 nt, Human
guccccagcaggagaaccgaccuggggacaaa

SEQ ID NO: 207409 - RNA, 22 nt, Human
guccccagccaaccccccagaa

SEQ ID NO: 207410 - RNA, 32 nt, Human
guccccagccaaggggccggcucucgucacug

SEQ ID NO: 207411 - RNA, 18 nt, Human
guccccagcccagccugu

SEQ ID NO: 207412 - RNA, 23 nt, Human
guccccagcccccucuccuccca

SEQ ID NO: 207413 - RNA, 32 nt, Human
guccccagccuccccguccucugucuaaccuc

SEQ ID NO: 207414 - RNA, 32 nt, Human
guccccagccuccugggggauucuuuccuaug

SEQ ID NO: 207415 - RNA, 32 nt, Human
guccccagccucuaucugugaggcaguuccaa

SEQ ID NO: 207416 - RNA, 21 nt, Human
guccccagcugcagaccuuca

SEQ ID NO: 207417 - RNA, 32 nt, Human
guccccaggaaggaggaggagucugcagcccu

SEQ ID NO: 207418 - RNA, 32 nt, Human
guccccaggcaugcccacaggccaggcccagu

SEQ ID NO: 207419 - RNA, 20 nt, Human
guccccaggccgugcugcug

SEQ ID NO: 207420 - RNA, 25 nt, Human
guccccaggcgagcccuccuucagg

SEQ ID NO: 207421 - RNA, 32 nt, Human
guccccaggcugcaucggccugccuguguuuc

SEQ ID NO: 207422 - RNA, 32 nt, Human
guccccagggaggacauggcucugaguccaca

SEQ ID NO: 207423 - RNA, 32 nt, Human
guccccagggaguggaaauggggaagggggcc

SEQ ID NO: 207424 - RNA, 32 nt, Human
guccccaguccccagcccugggcuuggcucuu

SEQ ID NO: 207425 - RNA, 32 nt, Human
guccccaguccuccuucucugagcagaccucu

SEQ ID NO: 207426 - RNA, 32 nt, Human
guccccagugcaacaagaaagccaggcacagu

SEQ ID NO: 207427 - RNA, 32 nt, Human
guccccagugcugcacucccacccugggcucc

SEQ ID NO: 207428 - RNA, 20 nt, Human
guccccauaaacauguacug

SEQ ID NO: 207429 - RNA, 32 nt, Human
guccccaucucagugucagaccagccuucucc

SEQ ID NO: 207430 - RNA, 32 nt, Human
guccccaugcccugcuguccuccucacaggac

SEQ ID NO: 207431 - RNA, 32 nt, Human
guccccaugggcuggucuccaaagcucuuucc

SEQ ID NO: 207432 - RNA, 32 nt, Human
guccccauggucagaggagacccagcuguccu

SEQ ID NO: 207433 - RNA, 32 nt, Human
guccccauugcccagcuuuugccugcacucuu

SEQ ID NO: 207434 - RNA, 32 nt, Human
guccccauugguuaggugaggagggugaggcu

SEQ ID NO: 207435 - RNA, 32 nt, Human
gucccccaaauacucugcucccucacugcuga

SEQ ID NO: 207436 - RNA, 32 nt, Human
gucccccaacacugagcaaguaugcuguggag

SEQ ID NO: 207437 - RNA, 22 nt, Human
gucccccaaccucuccugcuca

SEQ ID NO: 207438 - RNA, 23 nt, Human
gucccccaagcuggaguacaaug

SEQ ID NO: 207439 - RNA, 24 nt, Human
gucccccaagcuggaguacaauga

SEQ ID NO: 207440 - RNA, 32 nt, Human
gucccccaaggacaaagcucaggcuggauuca

SEQ ID NO: 207441 - RNA, 32 nt, Human
gucccccacagcaagagagagagccucccagu

SEQ ID NO: 207442 - RNA, 22 nt, Human
gucccccacaggcucugccuca

SEQ ID NO: 207443 - RNA, 18 nt, Human
gucccccacccacugcca

SEQ ID NO: 207444 - RNA, 32 nt, Human
gucccccacccucuccaaaaccaaccccaccc

SEQ ID NO: 207445 - RNA, 32 nt, Human
gucccccaccuguguccucccugggccccugg

SEQ ID NO: 207446 - RNA, 25 nt, Human
gucccccacgugugaaguguagugg

SEQ ID NO: 207447 - RNA, 32 nt, Human
gucccccacugcacaccuuccucaagucauag

SEQ ID NO: 207448 - RNA, 32 nt, Human
gucccccacugccucucugcaaucaaauggca

SEQ ID NO: 207449 - RNA, 32 nt, Human
gucccccagacuccuucccaucucuuuaguuc

SEQ ID NO: 207450 - RNA, 32 nt, Human
gucccccagagcaggccuggcccccagcugug

SEQ ID NO: 207451 - RNA, 32 nt, Human
gucccccagcaagaaagagggacaggagcacc

SEQ ID NO: 207452 - RNA, 32 nt, Human
gucccccagcacugaagagcugggcuuccagc

SEQ ID NO: 207453 - RNA, 21 nt, Human
gucccccaggcuccugcacgg

SEQ ID NO: 207454 - RNA, 24 nt, Human
gucccccaggcugaagugcagcgg

SEQ ID NO: 207455 - RNA, 22 nt, Human
gucccccaggcugaggcugggg

SEQ ID NO: 207456 - RNA, 32 nt, Human
gucccccaggcugaggcuggggaggagggcca

SEQ ID NO: 207457 - RNA, 18 nt, Human
gucccccaggcuggagug

SEQ ID NO: 207458 - RNA, 24 nt, Human
gucccccaggcuggagugcagugg

SEQ ID NO: 207459 - RNA, 22 nt, Human
gucccccaggcuggagugccgu

SEQ ID NO: 207460 - RNA, 23 nt, Human
gucccccaggcuggagugccgug

SEQ ID NO: 207461 - RNA, 24 nt, Human
gucccccaggcuggagugccgugg

SEQ ID NO: 207462 - RNA, 24 nt, Human
gucccccaggcuggagugcgaugg

SEQ ID NO: 207463 - RNA, 27 nt, Human
gucccccaggcuggaguggugcagugg

SEQ ID NO: 207464 - RNA, 21 nt, Human
gucccccaggcugggacgggg

SEQ ID NO: 207465 - RNA, 23 nt, Human
gucccccaggcuugagugcaaug

SEQ ID NO: 207466 - RNA, 32 nt, Human
gucccccagggcugcuuccugccugcaccugc

SEQ ID NO: 207467 - RNA, 32 nt, Human
gucccccauccccauccuccagcuucugguac

SEQ ID NO: 207468 - RNA, 32 nt, Human
gucccccaucuuggugcugaaccaacgcuaag

SEQ ID NO: 207469 - RNA, 32 nt, Human
gucccccaugacaggaguuugugugcaacaga

SEQ ID NO: 207470 - RNA, 24 nt, Human
gucccccaugcuggagugcagugg

SEQ ID NO: 207471 - RNA, 19 nt, Human
guccccccaccacccgccu

SEQ ID NO: 207472 - RNA, 17 nt, Human
guccccccaccugcaca

SEQ ID NO: 207473 - RNA, 17 nt, Human
guccccccuccuccuca

SEQ ID NO: 207474 - RNA, 20 nt, Human
guccccccuccugcccgcuc

SEQ ID NO: 207475 - RNA, 22 nt, Human
gucccccgacccuggccccagg

SEQ ID NO: 207476 - RNA, 21 nt, Human
gucccccgacucgccgcccgg

SEQ ID NO: 207477 - RNA, 32 nt, Human
gucccccgugaugggugcucaggcucaggacc

SEQ ID NO: 207478 - RNA, 32 nt, Human
gucccccuaggcuuuuccuuguggacaacggg

SEQ ID NO: 207479 - RNA, 20 nt, Human
gucccccucccuaccacucu

SEQ ID NO: 207480 - RNA, 32 nt, Human
gucccccugccccagggcucccggcuaugggg

SEQ ID NO: 207481 - RNA, 32 nt, Human
gucccccugccuggagcaguuuguguguauag

SEQ ID NO: 207482 - RNA, 32 nt, Human
gucccccugccuggcguuccugccgcagcucu

SEQ ID NO: 207483 - RNA, 32 nt, Human
gucccccugccugguccucuggggccacugug

SEQ ID NO: 207484 - RNA, 32 nt, Human
gucccccugcugucugaugacaucuugaaauu

SEQ ID NO: 207485 - RNA, 19 nt, Human
gucccccugggaagcuauc

SEQ ID NO: 207486 - RNA, 32 nt, Human
gucccccugucgccacugcucucccucccagc

SEQ ID NO: 207487 - RNA, 32 nt, Human
gucccccugugcaggggguucugugggggucu

SEQ ID NO: 207488 - RNA, 18 nt, Human
gucccccuucaccugcca

SEQ ID NO: 207489 - RNA, 32 nt, Human
gucccccuucugguaaggauucagagggguau

SEQ ID NO: 207490 - RNA, 32 nt, Human
gucccccuucuugcuucucucuccuucuuucc

SEQ ID NO: 207491 - RNA, 32 nt, Human
gucccccuugccugugaaucccuuccuuguac

SEQ ID NO: 207492 - RNA, 18 nt, Human
guccccgaaucucagcca

SEQ ID NO: 207493 - RNA, 32 nt, Human
guccccgacaucuucuggcccucuggccagca

SEQ ID NO: 207494 - RNA, 32 nt, Human
guccccgagcccaggguuacaaaauaaaugcc

SEQ ID NO: 207495 - RNA, 32 nt, Human
guccccgagcgggguucgcggaaaggcagcca

SEQ ID NO: 207496 - RNA, 32 nt, Human
guccccgaggggcauggccugcauucgaugcu

SEQ ID NO: 207497 - RNA, 32 nt, Human
guccccgcacacuucacaggcacuccacugcu

SEQ ID NO: 207498 - RNA, 32 nt, Human
guccccgcaguggaugcagcucacaugcugag

SEQ ID NO: 207499 - RNA, 32 nt, Human
guccccgcccaggaccugcgagugugcaugcu

SEQ ID NO: 207500 - RNA, 19 nt, Human
guccccgccccaccccgcc

SEQ ID NO: 207501 - RNA, 24 nt, Human
guccccgcccccaaacccagccca

SEQ ID NO: 207502 - RNA, 20 nt, Human
guccccgccccgccccgccc

SEQ ID NO: 207503 - RNA, 24 nt, Human
guccccgccccgccccuccgucca

SEQ ID NO: 207504 - RNA, 24 nt, Human
guccccgccccucccgccccgccc

SEQ ID NO: 207505 - RNA, 24 nt, Human
guccccgccccugcguccccgccc

SEQ ID NO: 207506 - RNA, 19 nt, Human
guccccgcccggcuccgcc

SEQ ID NO: 207507 - RNA, 20 nt, Human
guccccgccggcccccgccc

SEQ ID NO: 207508 - RNA, 24 nt, Human
guccccgccucucuccuccgccca

SEQ ID NO: 207509 - RNA, 22 nt, Human
guccccgccugagacgcgccca

SEQ ID NO: 207510 - RNA, 32 nt, Human
guccccgccugagacgcgcccacuccugcccg

SEQ ID NO: 207511 - RNA, 32 nt, Human
guccccgcgcggcgcaucccagccugggcggg

SEQ ID NO: 207512 - RNA, 31 nt, Human
guccccgcggcgucucccagucgggcuccuc

SEQ ID NO: 207513 - RNA, 24 nt, Human
guccccgcugcaucccaccaccca

SEQ ID NO: 207514 - RNA, 32 nt, Human
guccccgcugggcggccccaccccugucugca

SEQ ID NO: 207515 - RNA, 32 nt, Human
guccccggcagugucuggaggcauggcugggg

SEQ ID NO: 207516 - RNA, 32 nt, Human
guccccggcauugagccuugugucuuuccagu

SEQ ID NO: 207517 - RNA, 32 nt, Human
guccccggccacgucugugcucuguccuugug

SEQ ID NO: 207518 - RNA, 32 nt, Human
guccccggccguggcugagcucugccagaaca

SEQ ID NO: 207519 - RNA, 32 nt, Human
guccccgggaaggagcaugacaagaggcugag

SEQ ID NO: 207520 - RNA, 32 nt, Human
guccccgggagaagaagcggaggagggagaga

SEQ ID NO: 207521 - RNA, 32 nt, Human
guccccgggagcacacgaacccugccaggccc

SEQ ID NO: 207522 - RNA, 32 nt, Human
guccccgggaggcagcuggggcagcagcagug

SEQ ID NO: 207523 - RNA, 32 nt, Human
guccccgggccagcagggaugggguuggggag

SEQ ID NO: 207524 - RNA, 32 nt, Human
guccccgggccuggccaacccugcugugcagg

SEQ ID NO: 207525 - RNA, 32 nt, Human
guccccggggaguuaaugcaucuacaccacug

SEQ ID NO: 207526 - RNA, 32 nt, Human
guccccggguggcugcaggcagcuccagcccg

SEQ ID NO: 207527 - RNA, 32 nt, Human
guccccgucggaaaccggaaaaagcaguucca

SEQ ID NO: 207528 - RNA, 32 nt, Human
guccccgucugugucacuugccacacacugcc

SEQ ID NO: 207529 - RNA, 24 nt, Human
guccccgugcccacggggcucccu

SEQ ID NO: 207530 - RNA, 32 nt, Human
guccccgugccuggcucuucuugccucgccac

SEQ ID NO: 207531 - RNA, 32 nt, Human
guccccguggaaguccuggaaguggauaacaa

SEQ ID NO: 207532 - RNA, 32 nt, Human
guccccguguucugcugggcucugauucugcc

SEQ ID NO: 207533 - RNA, 23 nt, Human
guccccuaaacucccccgaccca

SEQ ID NO: 207534 - RNA, 32 nt, Human
guccccuaacccccaguccucacuguccuguu

SEQ ID NO: 207535 - RNA, 32 nt, Human
guccccuaagcucccuccaggcagggaaaaga

SEQ ID NO: 207536 - RNA, 32 nt, Human
guccccuacuacccugccccugcccauuccug

SEQ ID NO: 207537 - RNA, 32 nt, Human
guccccuacucccuggacuagugcaguccuug

SEQ ID NO: 207538 - RNA, 32 nt, Human
guccccuagaagcagaaggacaaggagcaacc

SEQ ID NO: 207539 - RNA, 32 nt, Human
guccccuagcacuagacucagcuguauuguuu

SEQ ID NO: 207540 - RNA, 24 nt, Human
guccccuaggcugcagugcagugg

SEQ ID NO: 207541 - RNA, 32 nt, Human
guccccuaucuuaugggaccaugccgucagga

SEQ ID NO: 207542 - RNA, 32 nt, Human
guccccucaaacgucaugucugcccagaaccu

SEQ ID NO: 207543 - RNA, 32 nt, Human
guccccucacagggaggggagcaggggaggga

SEQ ID NO: 207544 - RNA, 32 nt, Human
guccccucacugcccucugguguccugucacc

SEQ ID NO: 207545 - RNA, 32 nt, Human
guccccucagcaccuggauggacucccacugu

SEQ ID NO: 207546 - RNA, 32 nt, Human
guccccucccagagcugguggacccagggaac

SEQ ID NO: 207547 - RNA, 32 nt, Human
guccccuccccacucuugcccaugggugacuc

SEQ ID NO: 207548 - RNA, 21 nt, Human
guccccucccccaccccugcu

SEQ ID NO: 207549 - RNA, 32 nt, Human
guccccuccccgcugaacagccuggauccugc

SEQ ID NO: 207550 - RNA, 25 nt, Human
guccccuccccucaggcucugccuu

SEQ ID NO: 207551 - RNA, 32 nt, Human
guccccuccccucaggcucugccuuggccugg

SEQ ID NO: 207552 - RNA, 32 nt, Human
guccccuccccuccaucucucuuccccauaga

SEQ ID NO: 207553 - RNA, 25 nt, Human
guccccucccucccagccaccgccu

SEQ ID NO: 207554 - RNA, 32 nt, Human
guccccuccguaggagcucacagucuagauua

SEQ ID NO: 207555 - RNA, 23 nt, Human
guccccuccuccagccgcuggca

SEQ ID NO: 207556 - RNA, 32 nt, Human
guccccuccugccaccacccgcuacccggcca

SEQ ID NO: 207557 - RNA, 32 nt, Human
guccccuccuuuccucccuccuuccuuccacu

SEQ ID NO: 207558 - RNA, 32 nt, Human
guccccuccuuucuaacagaaaugggguuaug

SEQ ID NO: 207559 - RNA, 32 nt, Human
guccccucgcuccuggcuuuggggguugggac

SEQ ID NO: 207560 - RNA, 32 nt, Human
guccccucuagucuggagcuguuaacagaauc

SEQ ID NO: 207561 - RNA, 32 nt, Human
guccccucucccgggcuccccugcugcauggu

SEQ ID NO: 207562 - RNA, 32 nt, Human
guccccucuccuccccugugccagugccaccu

SEQ ID NO: 207563 - RNA, 22 nt, Human
guccccucucuccagggcuccu

SEQ ID NO: 207564 - RNA, 32 nt, Human
guccccucugcaggcucauuccuccuuggucu

SEQ ID NO: 207565 - RNA, 21 nt, Human
guccccucugccccugccuca

SEQ ID NO: 207566 - RNA, 18 nt, Human
guccccugacaccccaag

SEQ ID NO: 207567 - RNA, 32 nt, Human
guccccugacaucagcccucccaacuccuaag

SEQ ID NO: 207568 - RNA, 23 nt, Human
guccccugaccuucacaccugcu

SEQ ID NO: 207569 - RNA, 32 nt, Human
guccccugagcacucucucagcaugaacugca

SEQ ID NO: 207570 - RNA, 32 nt, Human
guccccugcaauggcccugcugugugaugcuc

SEQ ID NO: 207571 - RNA, 32 nt, Human
guccccugcagguuccuucuagcuggagcacu

SEQ ID NO: 207572 - RNA, 32 nt, Human
guccccugcaucaggcccccagccuggccagu

SEQ ID NO: 207573 - RNA, 23 nt, Human
guccccugcccacuaccuucagg

SEQ ID NO: 207574 - RNA, 17 nt, Human
guccccugcccccugcc

SEQ ID NO: 207575 - RNA, 32 nt, Human
guccccugccugcacuggcacuuuguccaguc

SEQ ID NO: 207576 - RNA, 18 nt, Human
guccccugccugcguccu

SEQ ID NO: 207577 - RNA, 32 nt, Human
guccccugccuggaacuggcugugaagaccca

SEQ ID NO: 207578 - RNA, 32 nt, Human
guccccugcuuucauguacagcuuuuucuuua

SEQ ID NO: 207579 - RNA, 32 nt, Human
guccccuggaaaccuguguggcuaaagucugc

SEQ ID NO: 207580 - RNA, 32 nt, Human
guccccuggcagcugggcugagucugcccuga

SEQ ID NO: 207581 - RNA, 29 nt, Human
guccccuggcugcugcccucccauucucc

SEQ ID NO: 207582 - RNA, 32 nt, Human
guccccugggccccaauucagaguuauguuuu

SEQ ID NO: 207583 - RNA, 32 nt, Human
guccccuggucucuuacccugccucacacacc

SEQ ID NO: 207584 - RNA, 32 nt, Human
guccccugugcuccgugacuugcccaccugcc

SEQ ID NO: 207585 - RNA, 23 nt, Human
guccccuuccccacccucuggcc

SEQ ID NO: 207586 - RNA, 32 nt, Human
guccccuucccccaccuuccuccucacucucu

SEQ ID NO: 207587 - RNA, 17 nt, Human
guccccuucccccuguu

SEQ ID NO: 207588 - RNA, 32 nt, Human
guccccuucccuggcccccaacugacuugccu

SEQ ID NO: 207589 - RNA, 32 nt, Human
guccccuuccucacugcucucuaccuggagaa

SEQ ID NO: 207590 - RNA, 32 nt, Human
guccccuucggaggagaugauguagaggaccu

SEQ ID NO: 207591 - RNA, 32 nt, Human
guccccuucuagaccagcagaagcccaggaca

SEQ ID NO: 207592 - RNA, 32 nt, Human
guccccuucuccacugcugccucccagcagag

SEQ ID NO: 207593 - RNA, 18 nt, Human
guccccuucuccaucgcc

SEQ ID NO: 207594 - RNA, 32 nt, Human
guccccuucucuucagccccugcccacccacu

SEQ ID NO: 207595 - RNA, 32 nt, Human
guccccuucugcccuuccccuggcucccaccg

SEQ ID NO: 207596 - RNA, 32 nt, Human
guccccuucugccgccagcccuagccaguaag

SEQ ID NO: 207597 - RNA, 32 nt, Human
guccccuugaaagaaugucucggucacaucag

SEQ ID NO: 207598 - RNA, 32 nt, Human
guccccuugacacacuggaggcucccuggcua

SEQ ID NO: 207599 - RNA, 32 nt, Human
guccccuuggagcgccccaccccacaucuccc

SEQ ID NO: 207600 - RNA, 32 nt, Human
guccccuuuccuucugggcugugaauuccugu

SEQ ID NO: 207601 - RNA, 32 nt, Human
guccccuuuguguuuagaaaugaguuaaccag

SEQ ID NO: 207602 - RNA, 32 nt, Human
guccccuuuuauucccuuuuccucuuaaagag

SEQ ID NO: 207603 - RNA, 32 nt, Human
gucccgaagaugcagucuucucuccaaugaua

SEQ ID NO: 207604 - RNA, 32 nt, Human
gucccgaagugcugggauuacaggugugagcc

SEQ ID NO: 207605 - RNA, 32 nt, Human
gucccgacacagauuccuggaucucagcccca

SEQ ID NO: 207606 - RNA, 32 nt, Human
gucccgaccguugccacguauagggcacuccc

SEQ ID NO: 207607 - RNA, 19 nt, Human
gucccgagaaguuuuguca

SEQ ID NO: 207608 - RNA, 32 nt, Human
gucccgagagcaucauugucgccaguaucacg

SEQ ID NO: 207609 - RNA, 20 nt, Human
gucccgagcccccuccccgc

SEQ ID NO: 207610 - RNA, 23 nt, Human
gucccgagccccgacggccgcgu

SEQ ID NO: 207611 - RNA, 20 nt, Human
gucccgagcccggagccucg

SEQ ID NO: 207612 - RNA, 23 nt, Human
gucccgagcccucacacccugga

SEQ ID NO: 207613 - RNA, 32 nt, Human
gucccgagccuacagagccgggagcagcugag

SEQ ID NO: 207614 - RNA, 23 nt, Human
gucccgagcgcgcucgagccagc

SEQ ID NO: 207615 - RNA, 32 nt, Human
gucccgagggccugagaggccgcagggacacg

SEQ ID NO: 207616 - RNA, 32 nt, Human
gucccgaugcaagcccccucuucgcugggcuc

SEQ ID NO: 207617 - RNA, 32 nt, Human
gucccgccacugcacuccagccugggcaacag

SEQ ID NO: 207618 - RNA, 32 nt, Human
gucccgccacugcacuccagccugggugacag

SEQ ID NO: 207619 - RNA, 32 nt, Human
gucccgcccaggagccuugcaggcuggagggc

SEQ ID NO: 207620 - RNA, 32 nt, Human
gucccgccccucucccgccuuuucgcugggaa

SEQ ID NO: 207621 - RNA, 32 nt, Human
gucccgcccgccgccuccccgcgcagcccggc

SEQ ID NO: 207622 - RNA, 32 nt, Human
gucccgccgccuccggggccuccugggacccu

SEQ ID NO: 207623 - RNA, 32 nt, Human
gucccgcgccgcggcagagccagcacagccag

SEQ ID NO: 207624 - RNA, 32 nt, Human
gucccgcgcgugguuuuugugaagacacgugg

SEQ ID NO: 207625 - RNA, 32 nt, Human
gucccgcgcucccgccccagcaugacagcccc

SEQ ID NO: 207626 - RNA, 32 nt, Human
gucccgcgcugccuccgccgcuccucggaugg

SEQ ID NO: 207627 - RNA, 32 nt, Human
gucccgcggcagcuucuguugcucugggaccu

SEQ ID NO: 207628 - RNA, 32 nt, Human
gucccgcggggccugggcugcgggcccacggg

SEQ ID NO: 207629 - RNA, 32 nt, Human
gucccgcguucccagcuguaucuacugaagca

SEQ ID NO: 207630 - RNA, 21 nt, Human
gucccgcuccugcuccuuccc

SEQ ID NO: 207631 - RNA, 32 nt, Human
gucccgcugccuggagagauggcccagcccug

SEQ ID NO: 207632 - RNA, 32 nt, Human
gucccgcuggccccagcacccagguauaguua

SEQ ID NO: 207633 - RNA, 32 nt, Human
gucccgcuggcuguccccuugucggccugacc

SEQ ID NO: 207634 - RNA, 19 nt, Human
gucccgcuguggagcuguc

SEQ ID NO: 207635 - RNA, 32 nt, Human
gucccggagccggcgucucagcacacgcuccg

SEQ ID NO: 207636 - RNA, 21 nt, Human
gucccggagccggugcccuca

SEQ ID NO: 207637 - RNA, 32 nt, Human
gucccggaggcugcagagcugcuacugcugug

SEQ ID NO: 207638 - RNA, 24 nt, Human
gucccggauuuuuguuaauauuca

SEQ ID NO: 207639 - RNA, 32 nt, Human
gucccggccaccgcugccucagccucugccuc

SEQ ID NO: 207640 - RNA, 19 nt, Human
gucccggcccuggcccagc

SEQ ID NO: 207641 - RNA, 20 nt, Human
gucccggcugaagugcagug

SEQ ID NO: 207642 - RNA, 21 nt, Human
gucccggcugaagugcagugg

SEQ ID NO: 207643 - RNA, 21 nt, Human
gucccggcugacaagccagca

SEQ ID NO: 207644 - RNA, 21 nt, Human
gucccgggaaagagaacuguc

SEQ ID NO: 207645 - RNA, 32 nt, Human
gucccgggagcacccccaggaggaggggaggg

SEQ ID NO: 207646 - RNA, 32 nt, Human
gucccgggagcagcgcggcggcaccucccuca

SEQ ID NO: 207647 - RNA, 32 nt, Human
gucccgggagccaaagggcagaggcaggauca

SEQ ID NO: 207648 - RNA, 32 nt, Human
gucccgggaggacccugagugccagauucccc

SEQ ID NO: 207649 - RNA, 32 nt, Human
gucccgggaggcagccuucaccagggaccugc

SEQ ID NO: 207650 - RNA, 32 nt, Human
gucccgggcugaauucucucuccacucuucga

SEQ ID NO: 207651 - RNA, 32 nt, Human
gucccgggcugugacccuccccgaggccccgc

SEQ ID NO: 207652 - RNA, 23 nt, Human
gucccggggcccccugggccacg

SEQ ID NO: 207653 - RNA, 23 nt, Human
gucccggggcggugccugucuca

SEQ ID NO: 207654 - RNA, 32 nt, Human
gucccggguggggagccucacccuggggacau

SEQ ID NO: 207655 - RNA, 32 nt, Human
gucccggguugguggggguggagcagcacuuc

SEQ ID NO: 207656 - RNA, 32 nt, Human
gucccggucccuggccccugcccugucgcccg

SEQ ID NO: 207657 - RNA, 32 nt, Human
gucccgguccucuuccccugagguccccugau

SEQ ID NO: 207658 - RNA, 32 nt, Human
gucccguaaauguuaacacucaugaagcauac

SEQ ID NO: 207659 - RNA, 32 nt, Human
gucccguacacacaccauccugccaugagagc

SEQ ID NO: 207660 - RNA, 32 nt, Human
gucccguagcacacaguuacaguguccuaaga

SEQ ID NO: 207661 - RNA, 32 nt, Human
gucccgucaggccauagccacgcgggaggagc

SEQ ID NO: 207662 - RNA, 32 nt, Human
gucccguccugcagcagucugccuccucuuuc

SEQ ID NO: 207663 - RNA, 32 nt, Human
gucccgucucaccauccugggcuuccaacgga

SEQ ID NO: 207664 - RNA, 32 nt, Human
gucccgucugcucuccucuuacccacccccau

SEQ ID NO: 207665 - RNA, 21 nt, Human
gucccgugaggcauugccuca

SEQ ID NO: 207666 - RNA, 32 nt, Human
gucccgugcuuuggguuucuugguuuggguuu

SEQ ID NO: 207667 - RNA, 32 nt, Human
gucccguugucccauuuugcucugugaaggug

SEQ ID NO: 207668 - RNA, 32 nt, Human
gucccuaaauuguaugcauuugucuguuguug

SEQ ID NO: 207669 - RNA, 23 nt, Human
gucccuacauccuccuccuuccc

SEQ ID NO: 207670 - RNA, 32 nt, Human
gucccuaccacccaucucaucacuuuccagcc

SEQ ID NO: 207671 - RNA, 32 nt, Human
gucccuacccagcacagcaaaugguuguagua

SEQ ID NO: 207672 - RNA, 32 nt, Human
gucccuaccuccagcuuccuccagccucaaac

SEQ ID NO: 207673 - RNA, 32 nt, Human
gucccuaccuggagccucaccuccaaggaaau

SEQ ID NO: 207674 - RNA, 22 nt, Human
gucccuacuaaaaauacaaaau

SEQ ID NO: 207675 - RNA, 20 nt, Human
gucccuacuaaaauacaaaa

SEQ ID NO: 207676 - RNA, 32 nt, Human
gucccuacugcaccugucacaaagugccuucu

SEQ ID NO: 207677 - RNA, 19 nt, Human
gucccuagcauaaaaagaa

SEQ ID NO: 207678 - RNA, 32 nt, Human
gucccuaggagggaaggagcuguuggggcagg

SEQ ID NO: 207679 - RNA, 32 nt, Human
gucccuaggcuacaaugcuacacuuggcucag

SEQ ID NO: 207680 - RNA, 32 nt, Human
gucccuagguguaggaaauggaagaaaaagau

SEQ ID NO: 207681 - RNA, 32 nt, Human
gucccuauacuaauugagauguuuucagcaga

SEQ ID NO: 207682 - RNA, 18 nt, Human
gucccucacauuugauca

SEQ ID NO: 207683 - RNA, 32 nt, Human
gucccucacccaggccacgcagcuggugcggc

SEQ ID NO: 207684 - RNA, 32 nt, Human
gucccucacuggcugcccucacaagccaccug

SEQ ID NO: 207685 - RNA, 32 nt, Human
gucccucagccaccaacauccauuucagcacu

SEQ ID NO: 207686 - RNA, 32 nt, Human
gucccucagcugcagugugaagugggacacac

SEQ ID NO: 207687 - RNA, 32 nt, Human
gucccucagggagacaaguuguagaggcaaca

SEQ ID NO: 207688 - RNA, 32 nt, Human
gucccuccacccacaucccccugguccuaccc

SEQ ID NO: 207689 - RNA, 32 nt, Human
gucccuccccauucuugucuuacccucugcaa

SEQ ID NO: 207690 - RNA, 32 nt, Human
gucccucccccuuguccuuucccuucaguacc

SEQ ID NO: 207691 - RNA, 21 nt, Human
gucccucccucccuccuuccc

SEQ ID NO: 207692 - RNA, 32 nt, Human
gucccucccugccuccgccuugcccaaggcca

SEQ ID NO: 207693 - RNA, 32 nt, Human
gucccucccuggaaugugacaugaggccgacu

SEQ ID NO: 207694 - RNA, 32 nt, Human
gucccucccuuagcccaagggagaggcaauaa

SEQ ID NO: 207695 - RNA, 19 nt, Human
gucccuccgccgccgccac

SEQ ID NO: 207696 - RNA, 17 nt, Human
gucccuccggggcuccu

SEQ ID NO: 207697 - RNA, 21 nt, Human
gucccuccucaccagcucucc

SEQ ID NO: 207698 - RNA, 32 nt, Human
gucccuccuccacagcccccuccccaaaggaa

SEQ ID NO: 207699 - RNA, 32 nt, Human
gucccuccuccacgaucagcccguucccgcag

SEQ ID NO: 207700 - RNA, 32 nt, Human
gucccuccuccccucucuccgccccuuccccc

SEQ ID NO: 207701 - RNA, 32 nt, Human
gucccuccuccuuugcugccucuuucccuccu

SEQ ID NO: 207702 - RNA, 32 nt, Human
gucccuccugccuuccuucucuucccaagccc

SEQ ID NO: 207703 - RNA, 32 nt, Human
gucccuccugggaggcaagcccggggagcacc

SEQ ID NO: 207704 - RNA, 32 nt, Human
gucccucggccgaacccagcccgcgcugcucc

SEQ ID NO: 207705 - RNA, 32 nt, Human
gucccucggccuggcccgcuaugcccugcaca

SEQ ID NO: 207706 - RNA, 32 nt, Human
gucccucgggugcugugggccagauccgggcg

SEQ ID NO: 207707 - RNA, 32 nt, Human
gucccucgguccauccugcccucuguucuucc

SEQ ID NO: 207708 - RNA, 32 nt, Human
gucccucucacucccucuaccucccucuuuua

SEQ ID NO: 207709 - RNA, 32 nt, Human
gucccucuccacccucuacuaacacucugcac

SEQ ID NO: 207710 - RNA, 32 nt, Human
gucccucucccagcauugcugugcauggcucc

SEQ ID NO: 207711 - RNA, 32 nt, Human
gucccucuccggcucuagcucucuccauauaa

SEQ ID NO: 207712 - RNA, 32 nt, Human
gucccucucuccccaaccucugccagggcaau

SEQ ID NO: 207713 - RNA, 32 nt, Human
gucccucucuccuccucuuccucucucuggac

SEQ ID NO: 207714 - RNA, 32 nt, Human
gucccucugaccgaaaugcucaccucccaaac

SEQ ID NO: 207715 - RNA, 32 nt, Human
gucccucugcccacaacaccagucccaccaga

SEQ ID NO: 207716 - RNA, 32 nt, Human
gucccucugccucugcugcagacauggcgucu

SEQ ID NO: 207717 - RNA, 32 nt, Human
gucccucuggaaggcaacagcuuccagcgacu

SEQ ID NO: 207718 - RNA, 21 nt, Human
gucccucuggaccccacuggc

SEQ ID NO: 207719 - RNA, 32 nt, Human
gucccucugggaauuucuggaaucucguauuu

SEQ ID NO: 207720 - RNA, 32 nt, Human
gucccucugggagagcucugccuagucugguu

SEQ ID NO: 207721 - RNA, 17 nt, Human
gucccucuggggcccuu

SEQ ID NO: 207722 - RNA, 32 nt, Human
gucccucugucccucugacccugcacuguccc

SEQ ID NO: 207723 - RNA, 32 nt, Human
gucccucugugcuucucucuuucuccucccac

SEQ ID NO: 207724 - RNA, 32 nt, Human
gucccucuguuuccuucucuucucuuuccucc

SEQ ID NO: 207725 - RNA, 32 nt, Human
gucccucuuagcacucuagcugcccacuccag

SEQ ID NO: 207726 - RNA, 32 nt, Human
gucccucuucccaccccucucuucuagcuugg

SEQ ID NO: 207727 - RNA, 32 nt, Human
gucccucuuccucugccgggaggguguuuuca

SEQ ID NO: 207728 - RNA, 32 nt, Human
gucccugaacaggagugaugccuccaggcagg

SEQ ID NO: 207729 - RNA, 20 nt, Human
gucccugaacugccacuggc

SEQ ID NO: 207730 - RNA, 32 nt, Human
gucccugaagugacagcggagagaaccaggca

SEQ ID NO: 207731 - RNA, 32 nt, Human
gucccugacucccagucugcagccauccuggg

SEQ ID NO: 207732 - RNA, 21 nt, Human
gucccugacugauuucagcca

SEQ ID NO: 207733 - RNA, 32 nt, Human
gucccugagaagccucaugggagucagggagc

SEQ ID NO: 207734 - RNA, 32 nt, Human
gucccugagacccugagaagagcuguacauag

SEQ ID NO: 207735 - RNA, 32 nt, Human
gucccugagcagagcagagaccagccugagcc

SEQ ID NO: 207736 - RNA, 32 nt, Human
gucccugagcccccuaguccuggcuccugcuu

SEQ ID NO: 207737 - RNA, 32 nt, Human
gucccugagccgcuauauaagcgcggcaggga

SEQ ID NO: 207738 - RNA, 22 nt, Human
gucccugaggguggagggaagc

SEQ ID NO: 207739 - RNA, 32 nt, Human
gucccugcaagugcacagggaggagaggugag

SEQ ID NO: 207740 - RNA, 32 nt, Human
gucccugcacugauacagaaggcuggucuuua

SEQ ID NO: 207741 - RNA, 23 nt, Human
gucccugcacugugacugucuca

SEQ ID NO: 207742 - RNA, 32 nt, Human
gucccugcagcucugggucugguucuucaagu

SEQ ID NO: 207743 - RNA, 32 nt, Human
gucccugcaguggaggcuggccuuucaucuca

SEQ ID NO: 207744 - RNA, 32 nt, Human
gucccugcauuauuugagcaacugacaagcuu

SEQ ID NO: 207745 - RNA, 32 nt, Human
gucccugcccccgagguugucacugcaaauca

SEQ ID NO: 207746 - RNA, 32 nt, Human
gucccugcccuccccugcucccagguugaggu

SEQ ID NO: 207747 - RNA, 32 nt, Human
gucccugccuaugcugacauuccauuguagaa

SEQ ID NO: 207748 - RNA, 32 nt, Human
gucccugccuggcccuccucuggucacuucaa

SEQ ID NO: 207749 - RNA, 32 nt, Human
gucccugcgagcccucaggagcugcguggugg

SEQ ID NO: 207750 - RNA, 22 nt, Human
gucccugcggcgcgucugccuu

SEQ ID NO: 207751 - RNA, 32 nt, Human
gucccugcuagucaagagggugaggcaggaga

SEQ ID NO: 207752 - RNA, 32 nt, Human
gucccugcuccuccucuucccuuuggggcugg

SEQ ID NO: 207753 - RNA, 21 nt, Human
gucccugcucugucugccccg

SEQ ID NO: 207754 - RNA, 32 nt, Human
gucccugcucuuccuucucucuggggugcucu

SEQ ID NO: 207755 - RNA, 19 nt, Human
gucccugcuucuguuuguu

SEQ ID NO: 207756 - RNA, 32 nt, Human
gucccuggaaacucaggaaggcugacaggugg

SEQ ID NO: 207757 - RNA, 32 nt, Human
gucccuggagcgggugacacaccugagauuug

SEQ ID NO: 207758 - RNA, 32 nt, Human
gucccuggagggggcggcuccuggagaucagg

SEQ ID NO: 207759 - RNA, 24 nt, Human
gucccuggcacaccccaccaccca

SEQ ID NO: 207760 - RNA, 32 nt, Human
gucccuggcacccccaugcacaccccugccgc

SEQ ID NO: 207761 - RNA, 32 nt, Human
gucccuggcaugugccuucauguaguaggugc

SEQ ID NO: 207762 - RNA, 32 nt, Human
gucccuggccacugccccugccgcggaggcag

SEQ ID NO: 207763 - RNA, 32 nt, Human
gucccuggccuuuggacccaggcaaaggcuuc

SEQ ID NO: 207764 - RNA, 32 nt, Human
gucccuggcgccugccuuuagccugggggccc

SEQ ID NO: 207765 - RNA, 17 nt, Human
gucccuggcugccucug

SEQ ID NO: 207766 - RNA, 32 nt, Human
gucccuggcugggagcagggcuuucugguagu

SEQ ID NO: 207767 - RNA, 32 nt, Human
gucccuggcuuccugcaugggaggacuuuaug

SEQ ID NO: 207768 - RNA, 32 nt, Human
gucccuggcuuuuagaggcacacacacaaaaa

SEQ ID NO: 207769 - RNA, 32 nt, Human
gucccugggaagcacaggaagcugcuaccagu

SEQ ID NO: 207770 - RNA, 32 nt, Human
gucccugggacacacccuauccaagaagaccc

SEQ ID NO: 207771 - RNA, 32 nt, Human
gucccugggaggugggugcuggagcaggggag

SEQ ID NO: 207772 - RNA, 32 nt, Human
gucccugggcaggagugcuggugaggaggugg

SEQ ID NO: 207773 - RNA, 32 nt, Human
gucccugggcagggccagaggggagaugagac

SEQ ID NO: 207774 - RNA, 32 nt, Human
gucccugggccagcugcaucacugccugugcc

SEQ ID NO: 207775 - RNA, 32 nt, Human
gucccugggcccauggggcccggcaguggcug

SEQ ID NO: 207776 - RNA, 20 nt, Human
gucccuggggauucugcuuu

SEQ ID NO: 207777 - RNA, 24 nt, Human
gucccugggguggggauagggagc

SEQ ID NO: 207778 - RNA, 32 nt, Human
gucccugggguggggauagggagcagaugcaa

SEQ ID NO: 207779 - RNA, 32 nt, Human
gucccugggugaggagacggcuggagccccac

SEQ ID NO: 207780 - RNA, 32 nt, Human
gucccuggguucccgauccugagggauugcau

SEQ ID NO: 207781 - RNA, 27 nt, Human
gucccugguaaggagugacaaggaagc

SEQ ID NO: 207782 - RNA, 32 nt, Human
gucccuggugauuucacaccuucauucacucc

SEQ ID NO: 207783 - RNA, 32 nt, Human
gucccuggugcacauccagggaagaggagugu

SEQ ID NO: 207784 - RNA, 32 nt, Human
gucccuguaagcaucacauugcuggaggaaaa

SEQ ID NO: 207785 - RNA, 21 nt, Human
gucccuguaagugcccccuca

SEQ ID NO: 207786 - RNA, 32 nt, Human
gucccugucaucccuucagauuccagagcugg

SEQ ID NO: 207787 - RNA, 20 nt, Human
gucccuguccaggcugccca

SEQ ID NO: 207788 - RNA, 32 nt, Human
gucccugugcagaggaaaaaugaagaauucuc

SEQ ID NO: 207789 - RNA, 32 nt, Human
gucccugugcagcugggcucagacgugucuca

SEQ ID NO: 207790 - RNA, 22 nt, Human
gucccugugcccgugugcccca

SEQ ID NO: 207791 - RNA, 32 nt, Human
gucccuguggcuuuggugcgccugugugcacu

SEQ ID NO: 207792 - RNA, 32 nt, Human
gucccugugggguggcucagagacaggacccu

SEQ ID NO: 207793 - RNA, 32 nt, Human
gucccugugguggcugccccuuguaggggugg

SEQ ID NO: 207794 - RNA, 32 nt, Human
gucccuguguacaucgcagcagguguggucac

SEQ ID NO: 207795 - RNA, 18 nt, Human
gucccuguuccucacuca

SEQ ID NO: 207796 - RNA, 21 nt, Human
gucccuguuccuuuuuugccu

SEQ ID NO: 207797 - RNA, 23 nt, Human
gucccuguucucgccuuugucuu

SEQ ID NO: 207798 - RNA, 32 nt, Human
gucccuguucucuguguuccuuaccuuucugu

SEQ ID NO: 207799 - RNA, 32 nt, Human
gucccuguugcucuccuugccaaacccagucu

SEQ ID NO: 207800 - RNA, 32 nt, Human
gucccuguuggcugaguacccugguuucaguc

SEQ ID NO: 207801 - RNA, 32 nt, Human
gucccuucaccaccaucuucaguuaggccuga

SEQ ID NO: 207802 - RNA, 32 nt, Human
gucccuucaccuggccccuggcagcuucuguc

SEQ ID NO: 207803 - RNA, 32 nt, Human
gucccuucacugcacuuucuuccugccuuagg

SEQ ID NO: 207804 - RNA, 32 nt, Human
gucccuucacuuccccuacccucugccuaucu

SEQ ID NO: 207805 - RNA, 18 nt, Human
gucccuucagagcuccuu

SEQ ID NO: 207806 - RNA, 32 nt, Human
gucccuucagccugggcugaccagugcccgcc

SEQ ID NO: 207807 - RNA, 23 nt, Human
gucccuuccagacagaagcuguc

SEQ ID NO: 207808 - RNA, 32 nt, Human
gucccuucccgccacaccacagccuaauucuu

SEQ ID NO: 207809 - RNA, 32 nt, Human
gucccuucucacuuauagagcucuccaggacu

SEQ ID NO: 207810 - RNA, 32 nt, Human
gucccuucugaccacucuccugccuccagaga

SEQ ID NO: 207811 - RNA, 32 nt, Human
gucccuucugcccugugccucggugccuguga

SEQ ID NO: 207812 - RNA, 32 nt, Human
gucccuucugugcccauggucaggagcuauuc

SEQ ID NO: 207813 - RNA, 21 nt, Human
gucccuucuuggucucuucca

SEQ ID NO: 207814 - RNA, 32 nt, Human
gucccuugaaugcucccuuuuaguguuacgag

SEQ ID NO: 207815 - RNA, 32 nt, Human
gucccuugagagaugggagcugaugggaagga

SEQ ID NO: 207816 - RNA, 32 nt, Human
gucccuugagccacagcauggggcuacagaaa

SEQ ID NO: 207817 - RNA, 32 nt, Human
gucccuugagggaggaaguccugggacccagg

SEQ ID NO: 207818 - RNA, 32 nt, Human
gucccuugaguucugugucacauuccagaggc

SEQ ID NO: 207819 - RNA, 32 nt, Human
gucccuugccaggcucuuccacuuagcuaagu

SEQ ID NO: 207820 - RNA, 32 nt, Human
gucccuugccuagggggcagagggugcagugg

SEQ ID NO: 207821 - RNA, 32 nt, Human
gucccuugcuuagccugugcuggaccagcugg

SEQ ID NO: 207822 - RNA, 32 nt, Human
gucccuuggcaugaacagccugggcaccauga

SEQ ID NO: 207823 - RNA, 32 nt, Human
gucccuuguagcacaggagacuggggcuaagg

SEQ ID NO: 207824 - RNA, 32 nt, Human
gucccuuguuuccuugcuaaguaguucuacaa

SEQ ID NO: 207825 - RNA, 32 nt, Human
gucccuuuccuuugcucagcccccucuguucu

SEQ ID NO: 207826 - RNA, 32 nt, Human
gucccuuucuccccacuucuucuggcuccuca

SEQ ID NO: 207827 - RNA, 32 nt, Human
gucccuuucucuggcccuguccaugugacuuu

SEQ ID NO: 207828 - RNA, 32 nt, Human
gucccuuugaagaacugacagggacuuggucu

SEQ ID NO: 207829 - RNA, 32 nt, Human
gucccuuugccggccccuacaggcuggggugg

SEQ ID NO: 207830 - RNA, 19 nt, Human
gucccuuuuaguuugauca

SEQ ID NO: 207831 - RNA, 32 nt, Human
gucccuuuuguuacugacaguugccuuggucc

SEQ ID NO: 207832 - RNA, 32 nt, Human
guccgaaacagaggaggaggagggaggggagu

SEQ ID NO: 207833 - RNA, 32 nt, Human
guccgaaagcuucguuccagagcccagcauga

SEQ ID NO: 207834 - RNA, 32 nt, Human
guccgaccagcuguccuggacucgcucccaca

SEQ ID NO: 207835 - RNA, 32 nt, Human
guccgaccugggcuccucagggccccggggca

SEQ ID NO: 207836 - RNA, 32 nt, Human
guccgagaccagccugggcaacauagugagac

SEQ ID NO: 207837 - RNA, 17 nt, Human
guccgagagggaagcug

SEQ ID NO: 207838 - RNA, 32 nt, Human
guccgagauggcuucuggaggaaggcgccccu

SEQ ID NO: 207839 - RNA, 32 nt, Human
guccgagcccugugggcucugcggaugcacgc

SEQ ID NO: 207840 - RNA, 32 nt, Human
guccgagcucuacucaccucccaaacccagcc

SEQ ID NO: 207841 - RNA, 32 nt, Human
guccgaggaggaggagaaggaggccugcagaa

SEQ ID NO: 207842 - RNA, 32 nt, Human
guccgaggcagacacccccaccccugccuccu

SEQ ID NO: 207843 - RNA, 32 nt, Human
guccgaggccuugccagucgucuugccagacg

SEQ ID NO: 207844 - RNA, 32 nt, Human
guccgaguaggggccucugccccaccaggaug

SEQ ID NO: 207845 - RNA, 32 nt, Human
guccgagugaagaucacagugaaggagcugcu

SEQ ID NO: 207846 - RNA, 23 nt, Human
guccgaguggaaugggaagggaa

SEQ ID NO: 207847 - RNA, 32 nt, Human
guccgaguucccagaguuucccucuguggugc

SEQ ID NO: 207848 - RNA, 32 nt, Human
guccgaugauucuucaguaaagauagauuccc

SEQ ID NO: 207849 - RNA, 20 nt, Human
guccgauggacaguuccaag

SEQ ID NO: 207850 - RNA, 32 nt, Human
guccgcacaguguccagcagcaauuuauucuu

SEQ ID NO: 207851 - RNA, 32 nt, Human
guccgcagacugggaugagucuacucgagcau

SEQ ID NO: 207852 - RNA, 32 nt, Human
guccgcagcagccccaugccuccuggacgccc

SEQ ID NO: 207853 - RNA, 32 nt, Human
guccgcaggccuggaugcccucugccucaucu

SEQ ID NO: 207854 - RNA, 32 nt, Human
guccgcaguaucuaaguaucucagccuucauc

SEQ ID NO: 207855 - RNA, 32 nt, Human
guccgccaggaugcaugugcucugccuuccua

SEQ ID NO: 207856 - RNA, 24 nt, Human
guccgccaggcuggagugcagugg

SEQ ID NO: 207857 - RNA, 23 nt, Human
guccgccauccugcccaccacca

SEQ ID NO: 207858 - RNA, 28 nt, Human
guccgcccaagugcccuccucucagcag

SEQ ID NO: 207859 - RNA, 32 nt, Human
guccgcccaagugcccuccucucagcaggcgg

SEQ ID NO: 207860 - RNA, 17 nt, Human
guccgcccaccacugcc

SEQ ID NO: 207861 - RNA, 32 nt, Human
guccgcccaccacugcccugucuguugcgaca

SEQ ID NO: 207862 - RNA, 32 nt, Human
guccgcccaucuguaagcccaucucuguccca

SEQ ID NO: 207863 - RNA, 32 nt, Human
guccgccccaaaacccggccuuggucccuggc

SEQ ID NO: 207864 - RNA, 17 nt, Human
guccgccccgccagcgc

SEQ ID NO: 207865 - RNA, 32 nt, Human
guccgcccgagagcaguguccucggcgaguau

SEQ ID NO: 207866 - RNA, 32 nt, Human
guccgcccucucucccugcucggcggccucgu

SEQ ID NO: 207867 - RNA, 32 nt, Human
guccgccgggccugagcacacccgaggcuccc

SEQ ID NO: 207868 - RNA, 32 nt, Human
guccgccggguuaggaagccacugccuggcag

SEQ ID NO: 207869 - RNA, 32 nt, Human
guccgccucccaguaccaccagugccacagcc

SEQ ID NO: 207870 - RNA, 32 nt, Human
guccgccucccggguugacaccauuuuccugc

SEQ ID NO: 207871 - RNA, 32 nt, Human
guccgccucuccauaucuccccauuucccaca

SEQ ID NO: 207872 - RNA, 32 nt, Human
guccgccugccugccugcgcuuccauccaucc

SEQ ID NO: 207873 - RNA, 32 nt, Human
guccgccugccugugcugugcuugcgacgugc

SEQ ID NO: 207874 - RNA, 24 nt, Human
guccgcgaaggcgcgggcucgggg

SEQ ID NO: 207875 - RNA, 32 nt, Human
guccgcgacuccgcccccaccagaggggcuag

SEQ ID NO: 207876 - RNA, 22 nt, Human
guccgcgagccaucguucgggg

SEQ ID NO: 207877 - RNA, 32 nt, Human
guccgcgaugaggacaucucugggacaccugg

SEQ ID NO: 207878 - RNA, 32 nt, Human
guccgcgccuccauugcgcucuccucuucacu

SEQ ID NO: 207879 - RNA, 32 nt, Human
guccgcgccuugcagcuccuccagagggacgc

SEQ ID NO: 207880 - RNA, 32 nt, Human
guccgcgggcgaggggacgggacugggcccug

SEQ ID NO: 207881 - RNA, 23 nt, Human
guccgcggggccgaccucggaga

SEQ ID NO: 207882 - RNA, 32 nt, Human
guccgcgucucccuggcuuuccaagggcuaau

SEQ ID NO: 207883 - RNA, 23 nt, Human
guccgcgugcccuugcuuuggug

SEQ ID NO: 207884 - RNA, 32 nt, Human
guccgcuaggcucggacgaccugcugagccuc

SEQ ID NO: 207885 - RNA, 21 nt, Human
guccgcuaggcugucugccuc

SEQ ID NO: 207886 - RNA, 32 nt, Human
guccgcucagggugggauggcagacauggcag

SEQ ID NO: 207887 - RNA, 21 nt, Human
guccgcucccgagcucgguga

SEQ ID NO: 207888 - RNA, 18 nt, Human
guccgcucucaguaauca

SEQ ID NO: 207889 - RNA, 32 nt, Human
guccgcucuccucagcaugagcggccgguagg

SEQ ID NO: 207890 - RNA, 32 nt, Human
guccgcucugcugccgccgcuguugcagccac

SEQ ID NO: 207891 - RNA, 32 nt, Human
guccgcugcuucuugguugccgagacagagag

SEQ ID NO: 207892 - RNA, 32 nt, Human
guccgcugguuaugagguguagggaggcaguu

SEQ ID NO: 207893 - RNA, 32 nt, Human
guccgcuguccucugcugccaguccccugccc

SEQ ID NO: 207894 - RNA, 32 nt, Human
guccggaaaugugguggcauucaaccacuugu

SEQ ID NO: 207895 - RNA, 32 nt, Human
guccggaacacugaaaccagucaucacugcau

SEQ ID NO: 207896 - RNA, 32 nt, Human
guccggaagaaaaacaguccgcgacagcuagg

SEQ ID NO: 207897 - RNA, 32 nt, Human
guccggagagcugccuuggacucuccaaugca

SEQ ID NO: 207898 - RNA, 32 nt, Human
guccggagcgagucugggucucagccccgcga

SEQ ID NO: 207899 - RNA, 32 nt, Human
guccggagcugcagcagaggccacacccaggg

SEQ ID NO: 207900 - RNA, 32 nt, Human
guccggaggaagagcgucugcaaaacuggguu

SEQ ID NO: 207901 - RNA, 32 nt, Human
guccggagggcagaaagaggguggggucccgg

SEQ ID NO: 207902 - RNA, 32 nt, Human
guccggauuucuaacagucccugcuuuggggg

SEQ ID NO: 207903 - RNA, 19 nt, Human
guccggcagcuuggcgucc

SEQ ID NO: 207904 - RNA, 32 nt, Human
guccggcauccccuccccagacugccugcugu

SEQ ID NO: 207905 - RNA, 32 nt, Human
guccggccgagcugcccggcgggcuggucccc

SEQ ID NO: 207906 - RNA, 32 nt, Human
guccggccugagcgccucccuccuggagcggc

SEQ ID NO: 207907 - RNA, 32 nt, Human
guccggccugggaaacccucuccaucucccaa

SEQ ID NO: 207908 - RNA, 32 nt, Human
guccggcuaagcuugguggagcauuuucccau

SEQ ID NO: 207909 - RNA, 32 nt, Human
guccggcucacugcaguuuugaccucccaggc

SEQ ID NO: 207910 - RNA, 32 nt, Human
guccggcuccccucugccccuggaggccagca

SEQ ID NO: 207911 - RNA, 32 nt, Human
guccggcucugaggugguggaggcggcggagg

SEQ ID NO: 207912 - RNA, 18 nt, Human
guccggcuucagugcccg

SEQ ID NO: 207913 - RNA, 32 nt, Human
guccgggagcggggcacccacugugggucucc

SEQ ID NO: 207914 - RNA, 32 nt, Human
guccgggaguuugagucugcagugagcuauga

SEQ ID NO: 207915 - RNA, 32 nt, Human
guccgggauccggggugucuguccgcagacug

SEQ ID NO: 207916 - RNA, 32 nt, Human
guccgggcaagaaccgcuuguaguuugguuua

SEQ ID NO: 207917 - RNA, 22 nt, Human
guccgggcccccggcacuuccu

SEQ ID NO: 207918 - RNA, 32 nt, Human
guccgggccccgaggcgcagcagggcaccagg

SEQ ID NO: 207919 - RNA, 32 nt, Human
guccgggccccgcccccgucauggcgcccgag

SEQ ID NO: 207920 - RNA, 32 nt, Human
guccgggccgcuggugaucuccgguagcacuc

SEQ ID NO: 207921 - RNA, 32 nt, Human
guccgggccgguugcugaaugaggggagccgg

SEQ ID NO: 207922 - RNA, 32 nt, Human
guccgggcgaugacacuccgguccccugcgag

SEQ ID NO: 207923 - RNA, 32 nt, Human
guccgggcuugaagauuuccgauucauguaca

SEQ ID NO: 207924 - RNA, 32 nt, Human
guccggggacaggccagccuggcgggguccac

SEQ ID NO: 207925 - RNA, 32 nt, Human
guccggggaguggcguuggcugcuagagcgau

SEQ ID NO: 207926 - RNA, 32 nt, Human
guccgggggccccagccaagggacacaucuca

SEQ ID NO: 207927 - RNA, 32 nt, Human
guccgggggugagugguacccaacgggccggg

SEQ ID NO: 207928 - RNA, 32 nt, Human
guccgguacagucagcagagugcagggugcgg

SEQ ID NO: 207929 - RNA, 22 nt, Human
guccgguaucccuuuuccuccc

SEQ ID NO: 207930 - RNA, 32 nt, Human
guccggucgccaggacugucucugaggcagaa

SEQ ID NO: 207931 - RNA, 32 nt, Human
guccggugccucccccaacccccacacccaug

SEQ ID NO: 207932 - RNA, 32 nt, Human
guccggugcuaccacaccgugcccucagugga

SEQ ID NO: 207933 - RNA, 32 nt, Human
guccggugggacagugucuccagguagugagg

SEQ ID NO: 207934 - RNA, 21 nt, Human
guccguacauccuuccuucuc

SEQ ID NO: 207935 - RNA, 32 nt, Human
guccgucacaggcagugaggaugagagggggu

SEQ ID NO: 207936 - RNA, 32 nt, Human
guccgucagacaucauacaagaacuaugugaa

SEQ ID NO: 207937 - RNA, 32 nt, Human
guccguccccggugcugccugcgcguucaccu

SEQ ID NO: 207938 - RNA, 32 nt, Human
guccgucggcccagacugaagugcaguggcac

SEQ ID NO: 207939 - RNA, 32 nt, Human
guccgucugcagcugcgugacugucugucucu

SEQ ID NO: 207940 - RNA, 32 nt, Human
guccgucugucugucugucuguggugguuucu

SEQ ID NO: 207941 - RNA, 32 nt, Human
guccgucuucacggauuagcugugcuguuaug

SEQ ID NO: 207942 - RNA, 32 nt, Human
guccgugacuccuggcccuucucuguggaucc

SEQ ID NO: 207943 - RNA, 32 nt, Human
guccgugagcuggaacugggcacacgccaucc

SEQ ID NO: 207944 - RNA, 21 nt, Human
guccgugagggcgcgcgggga

SEQ ID NO: 207945 - RNA, 32 nt, Human
guccgugcuugcuaucugucucauguuacaga

SEQ ID NO: 207946 - RNA, 22 nt, Human
guccguggaagccucugccuca

SEQ ID NO: 207947 - RNA, 32 nt, Human
guccguggcauacagaacacacugcagcuucu

SEQ ID NO: 207948 - RNA, 32 nt, Human
guccguggcuuaggcccugccucugcaugggg

SEQ ID NO: 207949 - RNA, 32 nt, Human
guccgugggaacuccacugggguggaugggcu

SEQ ID NO: 207950 - RNA, 32 nt, Human
guccgugggagguggaggccgaggacauuuuc

SEQ ID NO: 207951 - RNA, 32 nt, Human
guccgugucugugucuguccauacgugugagu

SEQ ID NO: 207952 - RNA, 32 nt, Human
guccguguuauuuauugcuacuuccugccugg

SEQ ID NO: 207953 - RNA, 32 nt, Human
guccguucucacccucuccguggcuguacauu

SEQ ID NO: 207954 - RNA, 32 nt, Human
guccguucuccccgcccggucgccgcccgcca

SEQ ID NO: 207955 - RNA, 32 nt, Human
guccguugucuucuccagcauccuugggccca

SEQ ID NO: 207956 - RNA, 32 nt, Human
guccguuuuacugugaauauagcaauauagua

SEQ ID NO: 207957 - RNA, 32 nt, Human
guccuaaaaauacaaaaauuaguugggugcgg

SEQ ID NO: 207958 - RNA, 24 nt, Human
guccuaaaaaucuccuaaaaccag

SEQ ID NO: 207959 - RNA, 32 nt, Human
guccuaaaccagccugggcaacauagugauac

SEQ ID NO: 207960 - RNA, 32 nt, Human
guccuaaagccuuugccauuccuaauacucgu

SEQ ID NO: 207961 - RNA, 32 nt, Human
guccuaaaucacucaucuggccuggauaaucu

SEQ ID NO: 207962 - RNA, 32 nt, Human
guccuaacccccaguaacugugaauguggcuu

SEQ ID NO: 207963 - RNA, 32 nt, Human
guccuaacuggucuuuaagguccuccuaguac

SEQ ID NO: 207964 - RNA, 32 nt, Human
guccuaagagcugggcaccaggaagcgaaggc

SEQ ID NO: 207965 - RNA, 32 nt, Human
guccuaagauacugcuaucauucuucgcuaau

SEQ ID NO: 207966 - RNA, 32 nt, Human
guccuaaggagaaaccuuuaaccacaaaguuu

SEQ ID NO: 207967 - RNA, 32 nt, Human
guccuaaugauggcauuagacuuucauaaugu

SEQ ID NO: 207968 - RNA, 18 nt, Human
guccuaauuaaaacuuua

SEQ ID NO: 207969 - RNA, 32 nt, Human
guccuaauuuuccuccugucuaacuggaggga

SEQ ID NO: 207970 - RNA, 32 nt, Human
guccuacacucacucuccucuggcaccaauau

SEQ ID NO: 207971 - RNA, 32 nt, Human
guccuacagagggagaggccagagaagcugca

SEQ ID NO: 207972 - RNA, 32 nt, Human
guccuacccagccuggaucugagcucugugcc

SEQ ID NO: 207973 - RNA, 32 nt, Human
guccuacccaggagggagagcgcagcugcugc

SEQ ID NO: 207974 - RNA, 32 nt, Human
guccuaccugguguccuccaugagaaucauac

SEQ ID NO: 207975 - RNA, 32 nt, Human
guccuacguccaagguggcagaugucuucccu

SEQ ID NO: 207976 - RNA, 32 nt, Human
guccuacuagaaaggguuagcauuuuaagggg

SEQ ID NO: 207977 - RNA, 32 nt, Human
guccuacugcugagccaagacucagucacucu

SEQ ID NO: 207978 - RNA, 23 nt, Human
guccuacuugaacaaacacaucc

SEQ ID NO: 207979 - RNA, 32 nt, Human
guccuacuuuccucauugccuaggcaaccauu

SEQ ID NO: 207980 - RNA, 21 nt, Human
guccuagaacaggaacucuga

SEQ ID NO: 207981 - RNA, 32 nt, Human
guccuagacacacauuagacucagggaguuuu

SEQ ID NO: 207982 - RNA, 32 nt, Human
guccuagagcagcuccagcaggauggcggcuc

SEQ ID NO: 207983 - RNA, 32 nt, Human
guccuagagcugggacaggucacgccugccuc

SEQ ID NO: 207984 - RNA, 32 nt, Human
guccuagaguccaauaaaaucgcugccuccca

SEQ ID NO: 207985 - RNA, 32 nt, Human
guccuagaguuuuccaggggguucugagggaa

SEQ ID NO: 207986 - RNA, 32 nt, Human
guccuagcagaaggcauugaggugagggauca

SEQ ID NO: 207987 - RNA, 32 nt, Human
guccuagcccauuucagcacccugccacuugg

SEQ ID NO: 207988 - RNA, 17 nt, Human
guccuagcccuagugag

SEQ ID NO: 207989 - RNA, 32 nt, Human
guccuagcuguguuuagaacagaacaucucua

SEQ ID NO: 207990 - RNA, 32 nt, Human
guccuagcuuggugacugggaacugccacaua

SEQ ID NO: 207991 - RNA, 32 nt, Human
guccuaggugggguucucuuuguugccuacca

SEQ ID NO: 207992 - RNA, 32 nt, Human
guccuagucccucccuucccucuccuugagug

SEQ ID NO: 207993 - RNA, 32 nt, Human
guccuagugccggagcccaugcuauuccaggc

SEQ ID NO: 207994 - RNA, 32 nt, Human
guccuaguuauuguccuugaaacccgagccau

SEQ ID NO: 207995 - RNA, 32 nt, Human
guccuaucuaaugcaugagauggcgguaagcc

SEQ ID NO: 207996 - RNA, 32 nt, Human
guccuaucucugagacauuuugaagucucaca

SEQ ID NO: 207997 - RNA, 18 nt, Human
guccucaaacaagccugu

SEQ ID NO: 207998 - RNA, 32 nt, Human
guccucaaacuaaaggccacagaaaugggcac

SEQ ID NO: 207999 - RNA, 32 nt, Human
guccucaaauccggcugaggcagcagcuggca

SEQ ID NO: 208000 - RNA, 32 nt, Human
guccucaacuagacaucugccaaaaauaucau

SEQ ID NO: 208001 - RNA, 32 nt, Human
guccucaagggggaacuggcacugugaccuua

SEQ ID NO: 208002 - RNA, 32 nt, Human
guccucaaucagccucuccaacugccaccaag

SEQ ID NO: 208003 - RNA, 22 nt, Human
guccucacaacuucucugcaca

SEQ ID NO: 208004 - RNA, 32 nt, Human
guccucacagcccucacucgcucgcucacucu

SEQ ID NO: 208005 - RNA, 32 nt, Human
guccucaccagggcccaaccaggcuggcaccc

SEQ ID NO: 208006 - RNA, 32 nt, Human
guccucaccucuccccuaguacacuucugaga

SEQ ID NO: 208007 - RNA, 32 nt, Human
guccucacuacagcaaauaagaugugucccag

SEQ ID NO: 208008 - RNA, 32 nt, Human
guccucacuacucugugucuucugcuuuuagg

SEQ ID NO: 208009 - RNA, 32 nt, Human
guccucacucacuggcuuugugcuucucuucc

SEQ ID NO: 208010 - RNA, 32 nt, Human
guccucacuccucuguggcuuggcuguacuug

SEQ ID NO: 208011 - RNA, 18 nt, Human
guccucacucuguguccu

SEQ ID NO: 208012 - RNA, 32 nt, Human
guccucacugaagcuucucucucuggagccug

SEQ ID NO: 208013 - RNA, 32 nt, Human
guccucagaccccugaggugcaggaugugggg

SEQ ID NO: 208014 - RNA, 32 nt, Human
guccucagagccucgcaggugcccucacuuac

SEQ ID NO: 208015 - RNA, 32 nt, Human
guccucagaggaccagcugggaggacugguug

SEQ ID NO: 208016 - RNA, 32 nt, Human
guccucagaggaggaggaggaggaggcagcuc

SEQ ID NO: 208017 - RNA, 32 nt, Human
guccucagaggauggcgaggcagccgggcagu

SEQ ID NO: 208018 - RNA, 32 nt, Human
guccucagcacacccacgcccuucaucauugg

SEQ ID NO: 208019 - RNA, 22 nt, Human
guccucagccaccagacuguua

SEQ ID NO: 208020 - RNA, 23 nt, Human
guccucagccccaagacccagca

SEQ ID NO: 208021 - RNA, 32 nt, Human
guccucagccuauccccuggagcuuggauacu

SEQ ID NO: 208022 - RNA, 23 nt, Human
guccucagcgggcugagcugcca

SEQ ID NO: 208023 - RNA, 32 nt, Human
guccucagcguuuaucucaggugcggaagguc

SEQ ID NO: 208024 - RNA, 32 nt, Human
guccucagcugcacugcggccugguggcagug

SEQ ID NO: 208025 - RNA, 32 nt, Human
guccucagcuuaccaucuccucacaccccaga

SEQ ID NO: 208026 - RNA, 32 nt, Human
guccucagggagucugugucccacacuggggg

SEQ ID NO: 208027 - RNA, 32 nt, Human
guccucagggaguuucuuuggagagagaagag

SEQ ID NO: 208028 - RNA, 32 nt, Human
guccucaggggcccugcacauucaaucugaag

SEQ ID NO: 208029 - RNA, 31 nt, Human
guccucagucacucugcuguuggagagugcu

SEQ ID NO: 208030 - RNA, 32 nt, Human
guccucagucccugccugcaacuagguugcca

SEQ ID NO: 208031 - RNA, 32 nt, Human
guccucaguguccucaggggccugcccagugc

SEQ ID NO: 208032 - RNA, 32 nt, Human
guccucaguucugcggagacagaguccccaca

SEQ ID NO: 208033 - RNA, 32 nt, Human
guccucaguuuuuccuagucauaaugucauac

SEQ ID NO: 208034 - RNA, 18 nt, Human
guccucauauuucuuucc

SEQ ID NO: 208035 - RNA, 32 nt, Human
guccucaucugcaaagcauggagaguggcauc

SEQ ID NO: 208036 - RNA, 32 nt, Human
guccucaugauaucugcuaucaguggggaaaa

SEQ ID NO: 208037 - RNA, 32 nt, Human
guccucaugccaccccacagcuccaggaaccu

SEQ ID NO: 208038 - RNA, 32 nt, Human
guccucaugccuguaucccagcacuuugggag

SEQ ID NO: 208039 - RNA, 32 nt, Human
guccucaugccuguauucuccaggaaacuugu

SEQ ID NO: 208040 - RNA, 32 nt, Human
guccucauggagaacccaggggacagcuggug

SEQ ID NO: 208041 - RNA, 31 nt, Human
guccucaugguuccuccagucuggacucugc

SEQ ID NO: 208042 - RNA, 32 nt, Human
guccucauguguacagugcaggcccuguggcc

SEQ ID NO: 208043 - RNA, 23 nt, Human
guccucauuagguguuggccuca

SEQ ID NO: 208044 - RNA, 32 nt, Human
guccucauugaauguucugguucaaggcucca

SEQ ID NO: 208045 - RNA, 32 nt, Human
guccuccaacaugaagguguuugcuaagauuc

SEQ ID NO: 208046 - RNA, 32 nt, Human
guccuccaagaagaaagcaccaagacaacauu

SEQ ID NO: 208047 - RNA, 22 nt, Human
guccuccacaccacacccagug

SEQ ID NO: 208048 - RNA, 32 nt, Human
guccuccaccacucaccucuugguuagcggga

SEQ ID NO: 208049 - RNA, 32 nt, Human
guccuccaccucaguacuguggacaucucggg

SEQ ID NO: 208050 - RNA, 32 nt, Human
guccuccacugccggggcugggcccggccgcg

SEQ ID NO: 208051 - RNA, 32 nt, Human
guccuccagaacucuuccuccaaggacagaag

SEQ ID NO: 208052 - RNA, 19 nt, Human
guccuccagaauaccaagu

SEQ ID NO: 208053 - RNA, 32 nt, Human
guccuccagagcucuguggccccgcucggauc

SEQ ID NO: 208054 - RNA, 32 nt, Human
guccuccagaggggucacguguaggagugaga

SEQ ID NO: 208055 - RNA, 32 nt, Human
guccuccagcagaaaggggcgggggaaaaggu

SEQ ID NO: 208056 - RNA, 32 nt, Human
guccuccagcugccaucgccuccugggugaag

SEQ ID NO: 208057 - RNA, 23 nt, Human
guccuccaggcuggagugcaaug

SEQ ID NO: 208058 - RNA, 24 nt, Human
guccuccaggcuggagugcaauga

SEQ ID NO: 208059 - RNA, 32 nt, Human
guccuccagggggagcugggguugcagggcaa

SEQ ID NO: 208060 - RNA, 32 nt, Human
guccuccagguaacugugaugcgggggucagc

SEQ ID NO: 208061 - RNA, 32 nt, Human
guccuccaggugacagaggguggcaaggugac

SEQ ID NO: 208062 - RNA, 32 nt, Human
guccucccaaaguacugggauuacaggcguga

SEQ ID NO: 208063 - RNA, 32 nt, Human
guccucccaaagugcugggauuaauggcguga

SEQ ID NO: 208064 - RNA, 32 nt, Human
guccucccaaagugcugggauuacaggccuga

SEQ ID NO: 208065 - RNA, 32 nt, Human
guccucccaaagugcugggauuacagguguga

SEQ ID NO: 208066 - RNA, 32 nt, Human
guccucccaaagugcugggauugaaggcguga

SEQ ID NO: 208067 - RNA, 32 nt, Human
guccucccaaggugcugggauuacaagcguga

SEQ ID NO: 208068 - RNA, 32 nt, Human
guccucccacagagacagaggggaacaaguag

SEQ ID NO: 208069 - RNA, 32 nt, Human
guccucccaucuucaacaguuaucuccaaagg

SEQ ID NO: 208070 - RNA, 32 nt, Human
guccucccauuucuaaagcugaaugucaaaca

SEQ ID NO: 208071 - RNA, 21 nt, Human
guccuccccacagcaccacgg

SEQ ID NO: 208072 - RNA, 32 nt, Human
guccuccccacccuccuuccucugucucccug

SEQ ID NO: 208073 - RNA, 32 nt, Human
guccuccccagccuccugagacuccggugggc

SEQ ID NO: 208074 - RNA, 32 nt, Human
guccuccccagcucuguuuccucuacuccugg

SEQ ID NO: 208075 - RNA, 32 nt, Human
guccuccccaguaggaggagacaggagucucu

SEQ ID NO: 208076 - RNA, 32 nt, Human
guccuccccaugugcugggauuacaggcguga

SEQ ID NO: 208077 - RNA, 32 nt, Human
guccuccccugccugccugauuccauggcugu

SEQ ID NO: 208078 - RNA, 32 nt, Human
guccuccccugggcaccccucacuuucccuga

SEQ ID NO: 208079 - RNA, 32 nt, Human
guccuccccugucuccuuuccuccuccugggu

SEQ ID NO: 208080 - RNA, 32 nt, Human
guccucccgccaucuuccuuucuuggauggau

SEQ ID NO: 208081 - RNA, 32 nt, Human
guccucccgccugugggagggagggagggcug

SEQ ID NO: 208082 - RNA, 32 nt, Human
guccucccggggcuggcucucuccccaggccc

SEQ ID NO: 208083 - RNA, 32 nt, Human
guccucccuccagcuucccucaugguggcagc

SEQ ID NO: 208084 - RNA, 32 nt, Human
guccucccuccccaaccuccuccauuucccca

SEQ ID NO: 208085 - RNA, 32 nt, Human
guccucccucccccuucuccuucacccccaag

SEQ ID NO: 208086 - RNA, 32 nt, Human
guccucccuccccucccucagccccuucccug

SEQ ID NO: 208087 - RNA, 32 nt, Human
guccucccuccccucccucaguccucccuccc

SEQ ID NO: 208088 - RNA, 32 nt, Human
guccucccuccuugcugccucuucccaccagc

SEQ ID NO: 208089 - RNA, 32 nt, Human
guccucccucugcaagcucuguccucauugca

SEQ ID NO: 208090 - RNA, 32 nt, Human
guccucccugcaggaggcugaguguaaagagu

SEQ ID NO: 208091 - RNA, 32 nt, Human
guccucccugccccucuccccuucacaccugc

SEQ ID NO: 208092 - RNA, 32 nt, Human
guccucccugccucuccgucuuguaaugaguu

SEQ ID NO: 208093 - RNA, 32 nt, Human
guccucccugcgucuggccucugggugggugg

SEQ ID NO: 208094 - RNA, 32 nt, Human
guccucccuucccagccucccuuugggccucc

SEQ ID NO: 208095 - RNA, 32 nt, Human
guccucccuucccugcagcuccagucagugug

SEQ ID NO: 208096 - RNA, 32 nt, Human
guccucccuuggacuagaaaucugcagcaguu

SEQ ID NO: 208097 - RNA, 32 nt, Human
guccucccuuguggcuuccucaguuccugccc

SEQ ID NO: 208098 - RNA, 19 nt, Human
guccuccgcccgguggccc

SEQ ID NO: 208099 - RNA, 32 nt, Human
guccuccggggcccagccucaggcaggaaaca

SEQ ID NO: 208100 - RNA, 32 nt, Human
guccuccgggggcggaggcagcugaggcgcuu

SEQ ID NO: 208101 - RNA, 32 nt, Human
guccuccguagcucuggaguccuggccugccg

SEQ ID NO: 208102 - RNA, 32 nt, Human
guccuccuacaaggaagauccucuuuguuugu

SEQ ID NO: 208103 - RNA, 32 nt, Human
guccuccuagcucugaagcuaaggcugcagag

SEQ ID NO: 208104 - RNA, 32 nt, Human
guccuccuagggugcccuugagccgcaaaacu

SEQ ID NO: 208105 - RNA, 32 nt, Human
guccuccuauccaccugcauccacacauggcc

SEQ ID NO: 208106 - RNA, 32 nt, Human
guccuccucacugcagcccccacagccucagg

SEQ ID NO: 208107 - RNA, 32 nt, Human
guccuccuccccucagcuuugcuaauaccagu

SEQ ID NO: 208108 - RNA, 32 nt, Human
guccuccugcagcuggagccuucaggccguau

SEQ ID NO: 208109 - RNA, 32 nt, Human
guccuccugccucagccuucugagucucugga

SEQ ID NO: 208110 - RNA, 32 nt, Human
guccuccugccuccucuucuccuuggcugguu

SEQ ID NO: 208111 - RNA, 32 nt, Human
guccuccugccugcccugagccacuguuccca

SEQ ID NO: 208112 - RNA, 32 nt, Human
guccuccuggacaggugcugugaccucgugca

SEQ ID NO: 208113 - RNA, 32 nt, Human
guccuccugggggaugggcugagacccucaga

SEQ ID NO: 208114 - RNA, 32 nt, Human
guccuccuguccccucuccucccagccaccau

SEQ ID NO: 208115 - RNA, 20 nt, Human
guccuccugucccugcugca

SEQ ID NO: 208116 - RNA, 32 nt, Human
guccuccugugcucaccucccugaccucugug

SEQ ID NO: 208117 - RNA, 32 nt, Human
guccuccuucugcuuuuacuucuccugcauga

SEQ ID NO: 208118 - RNA, 32 nt, Human
guccuccuucuuucacuaacuucuggacuuuc

SEQ ID NO: 208119 - RNA, 32 nt, Human
guccuccuuuucuccccgccccuucuccuccu

SEQ ID NO: 208120 - RNA, 32 nt, Human
guccuccuuuuguccaugaaucauguuuaccc

SEQ ID NO: 208121 - RNA, 32 nt, Human
guccucgcaggcaccacauacuuauucggagg

SEQ ID NO: 208122 - RNA, 32 nt, Human
guccucgccagccugcgucccagggcaggcgg

SEQ ID NO: 208123 - RNA, 32 nt, Human
guccucgccgugugccuugccucugcccucca

SEQ ID NO: 208124 - RNA, 32 nt, Human
guccucgcuagugccagagaagccccuggguc

SEQ ID NO: 208125 - RNA, 32 nt, Human
guccucggcuaaggguacaggagagggcaggg

SEQ ID NO: 208126 - RNA, 32 nt, Human
guccucgguccccagggcgcagcuguuggggc

SEQ ID NO: 208127 - RNA, 32 nt, Human
guccucgucaucucacuugggggccugcaugu

SEQ ID NO: 208128 - RNA, 31 nt, Human
guccucgucccuccugggccugugcaccggu

SEQ ID NO: 208129 - RNA, 32 nt, Human
guccucguggccagccaagaugguugcccccg

SEQ ID NO: 208130 - RNA, 32 nt, Human
guccucguggugagucgcugaccacggcuucc

SEQ ID NO: 208131 - RNA, 32 nt, Human
guccucuacaggcucaagcuuaucugggccuc

SEQ ID NO: 208132 - RNA, 32 nt, Human
guccucuacuugggaucucaggaggcugcaau

SEQ ID NO: 208133 - RNA, 32 nt, Human
guccucuaggaugcagcugccagauccacuca

SEQ ID NO: 208134 - RNA, 32 nt, Human
guccucuaggcaggcagggugcuccugguguc

SEQ ID NO: 208135 - RNA, 32 nt, Human
guccucuaggccugggcugggcuccaggccag

SEQ ID NO: 208136 - RNA, 32 nt, Human
guccucuagggcccugauccagccccugggcc

SEQ ID NO: 208137 - RNA, 32 nt, Human
guccucucagaaccccagccuugaaaauagug

SEQ ID NO: 208138 - RNA, 32 nt, Human
guccucuccacacaucuuuugggcccccagcu

SEQ ID NO: 208139 - RNA, 32 nt, Human
guccucucccugcuuuggcuucucuacuaugu

SEQ ID NO: 208140 - RNA, 32 nt, Human
guccucuccugagguucugccugcagccccca

SEQ ID NO: 208141 - RNA, 32 nt, Human
guccucuccuuucaaagacugacuucuucugg

SEQ ID NO: 208142 - RNA, 32 nt, Human
guccucucgucagccuuccucuuccagaagcu

SEQ ID NO: 208143 - RNA, 32 nt, Human
guccucucucaccucugacccagcuccaugcc

SEQ ID NO: 208144 - RNA, 32 nt, Human
guccucucugagcaccugcuccccaucacaca

SEQ ID NO: 208145 - RNA, 32 nt, Human
guccucucugcaguuuuauucccuuuagucuu

SEQ ID NO: 208146 - RNA, 32 nt, Human
guccucucugucccauaaccuaccuccacccu

SEQ ID NO: 208147 - RNA, 32 nt, Human
guccucucuuccucacuccucccuucaguguc

SEQ ID NO: 208148 - RNA, 32 nt, Human
guccucucuuuucacccaccuuccucaguuug

SEQ ID NO: 208149 - RNA, 31 nt, Human
guccucugacuucuguccucagaagggagcu

SEQ ID NO: 208150 - RNA, 32 nt, Human
guccucugcagauaucugccacagaauucagc

SEQ ID NO: 208151 - RNA, 32 nt, Human
guccucugcaucccuucugucccuccacccgu

SEQ ID NO: 208152 - RNA, 32 nt, Human
guccucugcccaagcccuuccuccccuccauc

SEQ ID NO: 208153 - RNA, 32 nt, Human
guccucugcccuuuugugcucuucugugauca

SEQ ID NO: 208154 - RNA, 32 nt, Human
guccucugccuuaucuugccccucuaccuggc

SEQ ID NO: 208155 - RNA, 31 nt, Human
guccucugcguuguagugcuaccucaaucuc

SEQ ID NO: 208156 - RNA, 32 nt, Human
guccucugcugccaucugccccggcuguguga

SEQ ID NO: 208157 - RNA, 32 nt, Human
guccucugggagggcugugcugcuagugggua

SEQ ID NO: 208158 - RNA, 32 nt, Human
guccucugguuagucucucaaauugaggcugu

SEQ ID NO: 208159 - RNA, 32 nt, Human
guccucuguccugccagcaccgagggcucauc

SEQ ID NO: 208160 - RNA, 32 nt, Human
guccucuguuccaccaggccuuccucaggggc

SEQ ID NO: 208161 - RNA, 32 nt, Human
guccucuguucccacccuccccugaacagaac

SEQ ID NO: 208162 - RNA, 32 nt, Human
guccucuuaccaacaucuggucuuccaggcac

SEQ ID NO: 208163 - RNA, 32 nt, Human
guccucuucacagauguuucugugccuucagg

SEQ ID NO: 208164 - RNA, 32 nt, Human
guccucuucagcguagcucuccaccucuaccc

SEQ ID NO: 208165 - RNA, 32 nt, Human
guccucuucccaaaacugugccuguccccagc

SEQ ID NO: 208166 - RNA, 32 nt, Human
guccucuucccgcuugcccugaguuuagaaga

SEQ ID NO: 208167 - RNA, 32 nt, Human
guccucuucucccuuuccauccuucagcauag

SEQ ID NO: 208168 - RNA, 32 nt, Human
guccucuucucccuuuccaucuuucagcauag

SEQ ID NO: 208169 - RNA, 32 nt, Human
guccucuucuuucuagcuucugacaagucugu

SEQ ID NO: 208170 - RNA, 32 nt, Human
guccucuuggaagcaagaucgcuccggguuga

SEQ ID NO: 208171 - RNA, 32 nt, Human
guccucuuggacuugagggcauugugaaaagc

SEQ ID NO: 208172 - RNA, 32 nt, Human
guccucuuguguuggcuuaauuucuggauggg

SEQ ID NO: 208173 - RNA, 32 nt, Human
guccucuuuggcgugcagcccaaauucaccaa

SEQ ID NO: 208174 - RNA, 32 nt, Human
guccucuuuuuccgcccauucucccucggguc

SEQ ID NO: 208175 - RNA, 32 nt, Human
guccugaaaccagacaagaccucugccagcca

SEQ ID NO: 208176 - RNA, 32 nt, Human
guccugaacuggggccggguggggaagaguga

SEQ ID NO: 208177 - RNA, 32 nt, Human
guccugaaguuugagccaggcaaguggcagug

SEQ ID NO: 208178 - RNA, 32 nt, Human
guccugaauauuagggaucacaauucacugaa

SEQ ID NO: 208179 - RNA, 18 nt, Human
guccugaaugaagcuguc

SEQ ID NO: 208180 - RNA, 32 nt, Human
guccugaaugucccccagccugacacccgcaa

SEQ ID NO: 208181 - RNA, 32 nt, Human
guccugacagccgugaagagcuucuucauuac

SEQ ID NO: 208182 - RNA, 32 nt, Human
guccugacaucuguguucuuccugucagcucc

SEQ ID NO: 208183 - RNA, 32 nt, Human
guccugaccauggucccugccuggcuguggcu

SEQ ID NO: 208184 - RNA, 32 nt, Human
guccugaccccuucuguccucacuguaccuug

SEQ ID NO: 208185 - RNA, 32 nt, Human
guccugacccucagcagccucuccuggccuug

SEQ ID NO: 208186 - RNA, 32 nt, Human
guccugacucuccugaauuacuagaaugucag

SEQ ID NO: 208187 - RNA, 32 nt, Human
guccugagauaaggaagaacugccugaaacag

SEQ ID NO: 208188 - RNA, 32 nt, Human
guccugagcauuggcccugucucccuuggcaa

SEQ ID NO: 208189 - RNA, 32 nt, Human
guccugagccagugccugguguuuccugggcu

SEQ ID NO: 208190 - RNA, 32 nt, Human
guccugagcucgggagauguucagagucacac

SEQ ID NO: 208191 - RNA, 32 nt, Human
guccugaggcaggaacucgacucuccaacccu

SEQ ID NO: 208192 - RNA, 32 nt, Human
guccugaggguuaggcuggagugacaguuucc

SEQ ID NO: 208193 - RNA, 32 nt, Human
guccugagguauaauacaacagagcacuuuuu

SEQ ID NO: 208194 - RNA, 32 nt, Human
guccugaguagcuggggauuacaggcgcccgc

SEQ ID NO: 208195 - RNA, 32 nt, Human
guccugagucaggagguugaggcugcagugag

SEQ ID NO: 208196 - RNA, 32 nt, Human
guccugagucucauagccacccugccagcugc

SEQ ID NO: 208197 - RNA, 32 nt, Human
guccugagugccccggcuucacaugccaauau

SEQ ID NO: 208198 - RNA, 32 nt, Human
guccugauccucucacagaaacacugggccaa

SEQ ID NO: 208199 - RNA, 32 nt, Human
guccugaugacauguuucguagaugggguuug

SEQ ID NO: 208200 - RNA, 32 nt, Human
guccugaugcccaaccucccaccccuucaaug

SEQ ID NO: 208201 - RNA, 32 nt, Human
guccugauuccuccgcccucccccucuccccc

SEQ ID NO: 208202 - RNA, 32 nt, Human
guccugcaacacagcuggauccucuauguggc

SEQ ID NO: 208203 - RNA, 20 nt, Human
guccugcaaugaagcucuga

SEQ ID NO: 208204 - RNA, 32 nt, Human
guccugcaccugcagccagcuggccucgggcu

SEQ ID NO: 208205 - RNA, 32 nt, Human
guccugcacugguacaugcaucuguaauacag

SEQ ID NO: 208206 - RNA, 32 nt, Human
guccugcacugucccggagcucaggcccuggu

SEQ ID NO: 208207 - RNA, 32 nt, Human
guccugcagacaccucuuucagaaacgcccaa

SEQ ID NO: 208208 - RNA, 32 nt, Human
guccugcagcaaacacuccacccuccaccuuc

SEQ ID NO: 208209 - RNA, 32 nt, Human
guccugcagcagagcugggcaggcuggggacu

SEQ ID NO: 208210 - RNA, 22 nt, Human
guccugcagcuucuucuucgag

SEQ ID NO: 208211 - RNA, 32 nt, Human
guccugcagguggagcuccggcagccgcccug

SEQ ID NO: 208212 - RNA, 32 nt, Human
guccugcagugccaccagaaguggcagccugg

SEQ ID NO: 208213 - RNA, 32 nt, Human
guccugccaauaccuugauuuuaagcccugug

SEQ ID NO: 208214 - RNA, 32 nt, Human
guccugccacauccuucucaaggugguagacu

SEQ ID NO: 208215 - RNA, 32 nt, Human
guccugccaggccgccagcccagagccuccuc

SEQ ID NO: 208216 - RNA, 32 nt, Human
guccugcccagaggguccugaggacucccgcu

SEQ ID NO: 208217 - RNA, 32 nt, Human
guccugccccacuggggaccaggcuggggucg

SEQ ID NO: 208218 - RNA, 32 nt, Human
guccugccccuccagaguaccccacgcacccc

SEQ ID NO: 208219 - RNA, 32 nt, Human
guccugccccugcaccugaccuggggagggac

SEQ ID NO: 208220 - RNA, 32 nt, Human
guccugcccugagacgccgcccucccgggguu

SEQ ID NO: 208221 - RNA, 32 nt, Human
guccugcccuucucccugcaugccuguggguc

SEQ ID NO: 208222 - RNA, 32 nt, Human
guccugcccuuugaaaucagacugggugugug

SEQ ID NO: 208223 - RNA, 20 nt, Human
guccugccggggaagccguc

SEQ ID NO: 208224 - RNA, 32 nt, Human
guccugccugggccuuggcaagcggcccuucg

SEQ ID NO: 208225 - RNA, 32 nt, Human
guccugccugugccagccuggccuucugcgag

SEQ ID NO: 208226 - RNA, 32 nt, Human
guccugccuguggcgccgucuccaggggcugc

SEQ ID NO: 208227 - RNA, 32 nt, Human
guccugccugugucucauccccggcugccuaa

SEQ ID NO: 208228 - RNA, 32 nt, Human
guccugccuuaggcuccugaguagcuggggau

SEQ ID NO: 208229 - RNA, 32 nt, Human
guccugcgauuuuucaggauguguucaauuca

SEQ ID NO: 208230 - RNA, 32 nt, Human
guccugcgcugcagugagaccugggugaaaau

SEQ ID NO: 208231 - RNA, 32 nt, Human
guccugcucaggguuuucauccuuccuccucu

SEQ ID NO: 208232 - RNA, 32 nt, Human
guccugcucaucuguggccacugccuucuagc

SEQ ID NO: 208233 - RNA, 32 nt, Human
guccugcuccaggaguccuacagccugcagcc

SEQ ID NO: 208234 - RNA, 18 nt, Human
guccugcucccccuggug

SEQ ID NO: 208235 - RNA, 32 nt, Human
guccugcuccccucaccuuccuugggcccguc

SEQ ID NO: 208236 - RNA, 32 nt, Human
guccugcuccguccccgcccuccaggggaacc

SEQ ID NO: 208237 - RNA, 32 nt, Human
guccugcuccucugcaaccugccccucuuuuu

SEQ ID NO: 208238 - RNA, 21 nt, Human
guccugcucgcccugugcccu

SEQ ID NO: 208239 - RNA, 32 nt, Human
guccugcucucuggccacaccugugcaggcag

SEQ ID NO: 208240 - RNA, 32 nt, Human
guccugcucugccgcauccagcccuguaccgc

SEQ ID NO: 208241 - RNA, 32 nt, Human
guccugcucuugaccauuccacugacuaacuu

SEQ ID NO: 208242 - RNA, 32 nt, Human
guccugcugaccugcacuguccaggccucacc

SEQ ID NO: 208243 - RNA, 32 nt, Human
guccugcugccucugggcgcccgccucuagcg

SEQ ID NO: 208244 - RNA, 32 nt, Human
guccugcugcugcugccguuccggugucagcg

SEQ ID NO: 208245 - RNA, 32 nt, Human
guccugcuggcuuaauuuaaacaguuauugca

SEQ ID NO: 208246 - RNA, 32 nt, Human
guccugcuguagugccuucugcgccaggcccg

SEQ ID NO: 208247 - RNA, 19 nt, Human
guccugcuguccacaccca

SEQ ID NO: 208248 - RNA, 32 nt, Human
guccugcuucccaguggguucagaccucaccu

SEQ ID NO: 208249 - RNA, 21 nt, Human
guccugcuugaggcucgggga

SEQ ID NO: 208250 - RNA, 23 nt, Human
guccugcuuugcccucuuugaua

SEQ ID NO: 208251 - RNA, 32 nt, Human
guccuggaaaaagaacucugaagaaaaccugg

SEQ ID NO: 208252 - RNA, 32 nt, Human
guccuggaaaucucacauggugggcacugcag

SEQ ID NO: 208253 - RNA, 20 nt, Human
guccuggaauauuagaugcc

SEQ ID NO: 208254 - RNA, 32 nt, Human
guccuggacagagaggguaacaggaggagucg

SEQ ID NO: 208255 - RNA, 32 nt, Human
guccuggaccaugaagaaggaugacuucugac

SEQ ID NO: 208256 - RNA, 32 nt, Human
guccuggaccggagcugcucccggaacuggca

SEQ ID NO: 208257 - RNA, 32 nt, Human
guccuggaccugacugccucauucuggaggcu

SEQ ID NO: 208258 - RNA, 32 nt, Human
guccuggacuccugccaccagcauccacacug

SEQ ID NO: 208259 - RNA, 32 nt, Human
guccuggacugagcuacugaaggagccucacc

SEQ ID NO: 208260 - RNA, 32 nt, Human
guccuggagaagcagaagcagucaguguuggg

SEQ ID NO: 208261 - RNA, 21 nt, Human
guccuggagcccugccuccca

SEQ ID NO: 208262 - RNA, 32 nt, Human
guccuggagcccugccucccacugccugacuu

SEQ ID NO: 208263 - RNA, 32 nt, Human
guccuggaggcagggggugaggggcaggucua

SEQ ID NO: 208264 - RNA, 32 nt, Human
guccuggaggcugaggcagaagaaucacuuga

SEQ ID NO: 208265 - RNA, 32 nt, Human
guccuggaggcuggaugauggaggacaucugg

SEQ ID NO: 208266 - RNA, 32 nt, Human
guccuggaggggccugcagugucuccauuccc

SEQ ID NO: 208267 - RNA, 32 nt, Human
guccuggaggugggguugauggguuuccuuau

SEQ ID NO: 208268 - RNA, 32 nt, Human
guccuggauaccuugauguuuagcacuuuaac

SEQ ID NO: 208269 - RNA, 21 nt, Human
guccuggaugugcaacugguu

SEQ ID NO: 208270 - RNA, 32 nt, Human
guccuggauuccaggaguagaggaccuagcuu

SEQ ID NO: 208271 - RNA, 32 nt, Human
guccuggcacagggaggagcagcucuguaaau

SEQ ID NO: 208272 - RNA, 32 nt, Human
guccuggcacugcccaaggccauaccugccua

SEQ ID NO: 208273 - RNA, 32 nt, Human
guccuggccacugaccagcuguguggcccugg

SEQ ID NO: 208274 - RNA, 32 nt, Human
guccuggccagagacguuauggucauugugag

SEQ ID NO: 208275 - RNA, 32 nt, Human
guccuggccaugccauguuaaagcugucucca

SEQ ID NO: 208276 - RNA, 32 nt, Human
guccuggccccucacgggcccccacacucucc

SEQ ID NO: 208277 - RNA, 32 nt, Human
guccuggcccuuuaaacgccgcgcgugccucg

SEQ ID NO: 208278 - RNA, 32 nt, Human
guccuggccucugcccgccccugcugccccac

SEQ ID NO: 208279 - RNA, 23 nt, Human
guccuggcguugcgggguugggg

SEQ ID NO: 208280 - RNA, 24 nt, Human
guccuggcguugcgggguuggggg

SEQ ID NO: 208281 - RNA, 32 nt, Human
guccuggcuccaccacuccuccagccagaggg

SEQ ID NO: 208282 - RNA, 32 nt, Human
guccuggcugagcucauggccugaggcugccu

SEQ ID NO: 208283 - RNA, 32 nt, Human
guccuggcugcacucuugaacugggcgaaugu

SEQ ID NO: 208284 - RNA, 32 nt, Human
guccuggcugggcugagucaggaccuugccgg

SEQ ID NO: 208285 - RNA, 32 nt, Human
guccuggcuguaacccaggcagugggaggucu

SEQ ID NO: 208286 - RNA, 32 nt, Human
guccugggaagugggcccuucccugggucucu

SEQ ID NO: 208287 - RNA, 32 nt, Human
guccugggagagaagaggaggaucucaucucu

SEQ ID NO: 208288 - RNA, 32 nt, Human
guccugggagagagcuaaagcuuaugcugguc

SEQ ID NO: 208289 - RNA, 32 nt, Human
guccugggagcagagagcagaaagcagcccuc

SEQ ID NO: 208290 - RNA, 18 nt, Human
guccugggaggaaguguc

SEQ ID NO: 208291 - RNA, 32 nt, Human
guccugggaggagagacacugguggggauagg

SEQ ID NO: 208292 - RNA, 32 nt, Human
guccugggcaccccaauuccagccucuaucau

SEQ ID NO: 208293 - RNA, 21 nt, Human
guccugggccaggaccagcag

SEQ ID NO: 208294 - RNA, 32 nt, Human
guccugggccaggccagccagggagaagacaa

SEQ ID NO: 208295 - RNA, 22 nt, Human
guccugggccagguaguggcag

SEQ ID NO: 208296 - RNA, 23 nt, Human
guccugggccccagggugugcag

SEQ ID NO: 208297 - RNA, 32 nt, Human
guccugggcuccugggccaggugcaggaacau

SEQ ID NO: 208298 - RNA, 32 nt, Human
guccuggggaagaacccaggcgccugagcccc

SEQ ID NO: 208299 - RNA, 32 nt, Human
guccuggggagaugcugccagcacacaggggc

SEQ ID NO: 208300 - RNA, 32 nt, Human
guccuggggaggcaggaggcacaugugagggu

SEQ ID NO: 208301 - RNA, 32 nt, Human
guccugggggcaggccagggcaguugacaggu

SEQ ID NO: 208302 - RNA, 32 nt, Human
guccugggucucaggauggguccugggggccu

SEQ ID NO: 208303 - RNA, 22 nt, Human
guccugggucugcaccgggcag

SEQ ID NO: 208304 - RNA, 32 nt, Human
guccuggguguggcugcucuggaagaauuagg

SEQ ID NO: 208305 - RNA, 32 nt, Human
guccuggguguguaccauaccugcugggccag

SEQ ID NO: 208306 - RNA, 32 nt, Human
guccugguacagauuccuuagcauggccaggg

SEQ ID NO: 208307 - RNA, 32 nt, Human
guccuggucagcugucucucuccuuugcaauu

SEQ ID NO: 208308 - RNA, 32 nt, Human
guccuggucgcuuccuggaggagaggcccaug

SEQ ID NO: 208309 - RNA, 32 nt, Human
guccuggugacaccccuccuuuuuccagugcc

SEQ ID NO: 208310 - RNA, 32 nt, Human
guccuggugagggacccgaggagcaggacaga

SEQ ID NO: 208311 - RNA, 23 nt, Human
guccugguggaugcacgcaggag

SEQ ID NO: 208312 - RNA, 32 nt, Human
guccugguggguggugggagucugggggaccc

SEQ ID NO: 208313 - RNA, 32 nt, Human
guccugguuauuccuguuuucucagcuuaaua

SEQ ID NO: 208314 - RNA, 32 nt, Human
guccugguucugaccugcacuugagugucggu

SEQ ID NO: 208315 - RNA, 32 nt, Human
guccugguuugggaccaugaaguggcucggca

SEQ ID NO: 208316 - RNA, 32 nt, Human
guccuguaccugacuccaccuccaggagaagg

SEQ ID NO: 208317 - RNA, 32 nt, Human
guccuguagcugcugcugcuggcuccacuccu

SEQ ID NO: 208318 - RNA, 32 nt, Human
guccuguaggggagacaaaaccagauuggggg

SEQ ID NO: 208319 - RNA, 32 nt, Human
guccuguagguccuagaggagccacagcccag

SEQ ID NO: 208320 - RNA, 32 nt, Human
guccugucacuuccagcgaggcacacaaaacu

SEQ ID NO: 208321 - RNA, 32 nt, Human
guccugucaucccucauggccaccccgccauu

SEQ ID NO: 208322 - RNA, 32 nt, Human
guccuguccacccucuagccucccucucccug

SEQ ID NO: 208323 - RNA, 32 nt, Human
guccuguccugccagcucugcugccaccucug

SEQ ID NO: 208324 - RNA, 32 nt, Human
guccuguccuggcucccaggguccugggggcu

SEQ ID NO: 208325 - RNA, 32 nt, Human
guccuguccuuccuaucuccccaaaguaccau

SEQ ID NO: 208326 - RNA, 32 nt, Human
guccuguccuuuuccuccuguccuuugccagc

SEQ ID NO: 208327 - RNA, 32 nt, Human
guccugucucaaacuccagaccucgggugauc

SEQ ID NO: 208328 - RNA, 32 nt, Human
guccugucucagggcccugcuguucccucugc

SEQ ID NO: 208329 - RNA, 32 nt, Human
guccugucugucuauagcuuggaacagggagc

SEQ ID NO: 208330 - RNA, 32 nt, Human
guccugucugucuauagcuuggaacagggagg

SEQ ID NO: 208331 - RNA, 32 nt, Human
guccugucuguggaguccucagucacucugcu

SEQ ID NO: 208332 - RNA, 32 nt, Human
guccugucuucaccucuucauccuggcaagcc

SEQ ID NO: 208333 - RNA, 31 nt, Human
guccugugacuucgucucuguucucaaggga

SEQ ID NO: 208334 - RNA, 32 nt, Human
guccugugaggccuuccuaucuccaagucuau

SEQ ID NO: 208335 - RNA, 32 nt, Human
guccugugaguccucaugcagagcagggccau

SEQ ID NO: 208336 - RNA, 32 nt, Human
guccugugccagccuucaugcccagcccgcuc

SEQ ID NO: 208337 - RNA, 32 nt, Human
guccugugccagggcccuguccucacuaucag

SEQ ID NO: 208338 - RNA, 32 nt, Human
guccugugcccuuugucuaccucucccaggcc

SEQ ID NO: 208339 - RNA, 32 nt, Human
guccugugcuaucacagggucaccucuuuuac

SEQ ID NO: 208340 - RNA, 32 nt, Human
guccugugcuguaaacacuaugcaaauggaag

SEQ ID NO: 208341 - RNA, 32 nt, Human
guccuguggaugaaguugaagaugcauuucag

SEQ ID NO: 208342 - RNA, 32 nt, Human
guccuguggucugccucaguuuccccuccuaa

SEQ ID NO: 208343 - RNA, 32 nt, Human
guccuguguaugugaaugcacacaugugcacu

SEQ ID NO: 208344 - RNA, 32 nt, Human
guccuguguccccacuuccuccagaagccaca

SEQ ID NO: 208345 - RNA, 32 nt, Human
guccuguguguggugggcuccacccacuagau

SEQ ID NO: 208346 - RNA, 32 nt, Human
guccugugugugugcccgaugccuguguugcg

SEQ ID NO: 208347 - RNA, 32 nt, Human
guccuguucaucucucaggcucugagacacug

SEQ ID NO: 208348 - RNA, 32 nt, Human
guccuguuccuuguaauucucccacuguucuc

SEQ ID NO: 208349 - RNA, 32 nt, Human
guccuguucuuuuuguuucuucaugacauaca

SEQ ID NO: 208350 - RNA, 32 nt, Human
guccuguugggugaaugaggcagaugggaaag

SEQ ID NO: 208351 - RNA, 32 nt, Human
guccuguuuuacaaauaaauuuuguuuuacua

SEQ ID NO: 208352 - RNA, 32 nt, Human
guccuuaaaauuaugugcagaaguuuacugaa

SEQ ID NO: 208353 - RNA, 32 nt, Human
guccuuaacaaauuaaacuuucucuugguuuc

SEQ ID NO: 208354 - RNA, 32 nt, Human
guccuuaaggaaagagucucuccuuugccacu

SEQ ID NO: 208355 - RNA, 32 nt, Human
guccuuacacauuguguccuuugcuaccauca

SEQ ID NO: 208356 - RNA, 32 nt, Human
guccuuacagccgcucgucagacuccagcagc

SEQ ID NO: 208357 - RNA, 32 nt, Human
guccuuacuuccaggcugggugccguaacuca

SEQ ID NO: 208358 - RNA, 18 nt, Human
guccuuagauuuugauca

SEQ ID NO: 208359 - RNA, 32 nt, Human
guccuuagcacugcagcucccaccuccuccuc

SEQ ID NO: 208360 - RNA, 32 nt, Human
guccuuagcgccugucugcucuccucuaacua

SEQ ID NO: 208361 - RNA, 32 nt, Human
guccuuauaguaggaaagugaagaauacacua

SEQ ID NO: 208362 - RNA, 32 nt, Human
guccuuauuccuguggaagcaguauauguuuu

SEQ ID NO: 208363 - RNA, 32 nt, Human
guccuuauuugaacaccugagacccuuuucuu

SEQ ID NO: 208364 - RNA, 32 nt, Human
guccuucaccuccccacuccagccccggcuca

SEQ ID NO: 208365 - RNA, 22 nt, Human
guccuucacucccacccuguaa

SEQ ID NO: 208366 - RNA, 32 nt, Human
guccuucagaacacuucucugugcucaguggg

SEQ ID NO: 208367 - RNA, 32 nt, Human
guccuucagacaccuccagacauccaaucaga

SEQ ID NO: 208368 - RNA, 32 nt, Human
guccuucagaccccuccagacauccaaucaga

SEQ ID NO: 208369 - RNA, 32 nt, Human
guccuucagagggagaaggggaaagcucuccc

SEQ ID NO: 208370 - RNA, 32 nt, Human
guccuucagccuccaucuguucucccaccuac

SEQ ID NO: 208371 - RNA, 32 nt, Human
guccuucaggagaccugggaugaguggugcuu

SEQ ID NO: 208372 - RNA, 32 nt, Human
guccuucagggagcagagcagagcagguggug

SEQ ID NO: 208373 - RNA, 32 nt, Human
guccuucaggugagcuguuguccacagcaccu

SEQ ID NO: 208374 - RNA, 32 nt, Human
guccuuccaaaaauguuguuguguacauacca

SEQ ID NO: 208375 - RNA, 32 nt, Human
guccuuccaccugccacccccuucccugggag

SEQ ID NO: 208376 - RNA, 32 nt, Human
guccuuccacuuugaccccauggaggauugcc

SEQ ID NO: 208377 - RNA, 32 nt, Human
guccuuccagaauaagcauacacuucacuccu

SEQ ID NO: 208378 - RNA, 32 nt, Human
guccuuccauucacccuucucauaaaguagua

SEQ ID NO: 208379 - RNA, 32 nt, Human
guccuucccaccuccagucaucagccccacuc

SEQ ID NO: 208380 - RNA, 32 nt, Human
guccuucccacugcacuccccaguggcuggcg

SEQ ID NO: 208381 - RNA, 32 nt, Human
guccuucccagcugugugagaaaaugaaagcc

SEQ ID NO: 208382 - RNA, 32 nt, Human
guccuucccaucuuguccucuucaguaccacu

SEQ ID NO: 208383 - RNA, 22 nt, Human
guccuucccgggccuccuugug

SEQ ID NO: 208384 - RNA, 32 nt, Human
guccuucccugcuggcagucucuucucguugg

SEQ ID NO: 208385 - RNA, 21 nt, Human
guccuucccuggcccugcugc

SEQ ID NO: 208386 - RNA, 32 nt, Human
guccuucccuggguguucugucucuccuuccc

SEQ ID NO: 208387 - RNA, 32 nt, Human
guccuucccuguggauguagaagcccugucag

SEQ ID NO: 208388 - RNA, 21 nt, Human
guccuuccgcccgcuccucgu

SEQ ID NO: 208389 - RNA, 32 nt, Human
guccuuccuaucuccccaaaguaccauagcca

SEQ ID NO: 208390 - RNA, 25 nt, Human
guccuuccucacaggccuucccgua

SEQ ID NO: 208391 - RNA, 22 nt, Human
guccuuccugggccccuccuug

SEQ ID NO: 208392 - RNA, 32 nt, Human
guccuuccuugcaaaguacuauacagcugaag

SEQ ID NO: 208393 - RNA, 19 nt, Human
guccuucgcccuguggccu

SEQ ID NO: 208394 - RNA, 32 nt, Human
guccuucggccgccaccauguccgccucggcu

SEQ ID NO: 208395 - RNA, 32 nt, Human
guccuucguauaucagagugugagugauacuu

SEQ ID NO: 208396 - RNA, 32 nt, Human
guccuucgucagacaccacaucugccagugcc

SEQ ID NO: 208397 - RNA, 21 nt, Human
guccuucuacaccucaucugc

SEQ ID NO: 208398 - RNA, 23 nt, Human
guccuucuacuuaccugcuggau

SEQ ID NO: 208399 - RNA, 22 nt, Human
guccuucuagguggcugcucau

SEQ ID NO: 208400 - RNA, 32 nt, Human
guccuucuccccucccagcuccuggcgccugc

SEQ ID NO: 208401 - RNA, 20 nt, Human
guccuucucugccuguugca

SEQ ID NO: 208402 - RNA, 21 nt, Human
guccuucucuggcgucugcuu

SEQ ID NO: 208403 - RNA, 32 nt, Human
guccuucucuuuccuuuuucuuccccauuuug

SEQ ID NO: 208404 - RNA, 32 nt, Human
guccuucugaaucccuucccuguuccuuaggu

SEQ ID NO: 208405 - RNA, 32 nt, Human
guccuucugagcggcuuccugggguccucccc

SEQ ID NO: 208406 - RNA, 32 nt, Human
guccuucugauggcuaggcuaaggggaggaag

SEQ ID NO: 208407 - RNA, 21 nt, Human
guccuucugccccuggccgca

SEQ ID NO: 208408 - RNA, 32 nt, Human
guccuucugccucuguccacauuuccccaugu

SEQ ID NO: 208409 - RNA, 22 nt, Human
guccuucugggugccugcuuca

SEQ ID NO: 208410 - RNA, 24 nt, Human
guccuucugugacaccugcugcau

SEQ ID NO: 208411 - RNA, 32 nt, Human
guccuucuuguccuggucguuguucccgucug

SEQ ID NO: 208412 - RNA, 32 nt, Human
guccuugaaaaguucugggugaauggcugccu

SEQ ID NO: 208413 - RNA, 32 nt, Human
guccuugacacugucuaccuguuccauaugcc

SEQ ID NO: 208414 - RNA, 32 nt, Human
guccuugacugaggcggggcggggagcagggg

SEQ ID NO: 208415 - RNA, 32 nt, Human
guccuugagggucaauggaggccucucuucug

SEQ ID NO: 208416 - RNA, 21 nt, Human
guccuugaguccccaccagcu

SEQ ID NO: 208417 - RNA, 32 nt, Human
guccuugauucagccuuggugccugcacucug

SEQ ID NO: 208418 - RNA, 32 nt, Human
guccuugcacauugggcuucaaacuccucuuc

SEQ ID NO: 208419 - RNA, 31 nt, Human
guccuugcacuuuucugagccagggucacug

SEQ ID NO: 208420 - RNA, 32 nt, Human
guccuugcaguugggaaauacccgguaccucg

SEQ ID NO: 208421 - RNA, 32 nt, Human
guccuugcauucaaaggguuggagauugcugc

SEQ ID NO: 208422 - RNA, 32 nt, Human
guccuugcccaggcuggagugcaguggcgcga

SEQ ID NO: 208423 - RNA, 32 nt, Human
guccuugcggcaccuggaaugaucaacucauu

SEQ ID NO: 208424 - RNA, 32 nt, Human
guccuugcugcugguggggaagggaagccaga

SEQ ID NO: 208425 - RNA, 21 nt, Human
guccuugcuucuguuugcuca

SEQ ID NO: 208426 - RNA, 32 nt, Human
guccuuggagaagccuuugccacuccauccag

SEQ ID NO: 208427 - RNA, 32 nt, Human
guccuuggagaaguggaggugugcauggugug

SEQ ID NO: 208428 - RNA, 30 nt, Human
guccuuggccgccuccugcuccugcucugc

SEQ ID NO: 208429 - RNA, 32 nt, Human
guccuuggcuuccuccuggcuuuaaugggaau

SEQ ID NO: 208430 - RNA, 32 nt, Human
guccuugggacugccuuggagacgccucugug

SEQ ID NO: 208431 - RNA, 32 nt, Human
guccuugggcagaccccagcuguugucugccc

SEQ ID NO: 208432 - RNA, 32 nt, Human
guccuugggcugggugguugguagaggagaug

SEQ ID NO: 208433 - RNA, 32 nt, Human
guccuuggucccaucuaccuccucuucaucca

SEQ ID NO: 208434 - RNA, 32 nt, Human
guccuuguauaaggagcuuugcucuuggaauu

SEQ ID NO: 208435 - RNA, 32 nt, Human
guccuugucaaaaggcaggugcuagacagucu

SEQ ID NO: 208436 - RNA, 32 nt, Human
guccuugucaucugggcacccucacacaucuc

SEQ ID NO: 208437 - RNA, 32 nt, Human
guccuugugcagucugcacccugcacucccuc

SEQ ID NO: 208438 - RNA, 32 nt, Human
guccuugugcaucuuaccuuucccuuaccuug

SEQ ID NO: 208439 - RNA, 32 nt, Human
guccuuguguuuugaggucacugagguaggaa

SEQ ID NO: 208440 - RNA, 32 nt, Human
guccuuguucuuagauuccuguagaaccggaa

SEQ ID NO: 208441 - RNA, 23 nt, Human
guccuuguuuacauaccugccuc

SEQ ID NO: 208442 - RNA, 24 nt, Human
guccuuguuucuggaucugcccca

SEQ ID NO: 208443 - RNA, 32 nt, Human
guccuuuauuaaaagcacacuguugguuucaa

SEQ ID NO: 208444 - RNA, 32 nt, Human
guccuuuauuccaccaaaccagcuccagguga

SEQ ID NO: 208445 - RNA, 25 nt, Human
guccuuucagugguagacucgggga

SEQ ID NO: 208446 - RNA, 32 nt, Human
guccuuuccaacaccccugaaauucauaguca

SEQ ID NO: 208447 - RNA, 32 nt, Human
guccuuuccagcugccuuuugucuagccugcu

SEQ ID NO: 208448 - RNA, 32 nt, Human
guccuuucccccaaggugugagcauugcagcg

SEQ ID NO: 208449 - RNA, 32 nt, Human
guccuuuccuaccaauuuccucccccuccuca

SEQ ID NO: 208450 - RNA, 32 nt, Human
guccuuuccuggagggauggagaauccccucc

SEQ ID NO: 208451 - RNA, 32 nt, Human
guccuuucucccacucuacugaaacccggaac

SEQ ID NO: 208452 - RNA, 32 nt, Human
guccuuucuucagcuaaugauuacugagcacc

SEQ ID NO: 208453 - RNA, 32 nt, Human
guccuuucuuccaggcacuguccagugauccu

SEQ ID NO: 208454 - RNA, 24 nt, Human
guccuuucuucugaaauaaaagga

SEQ ID NO: 208455 - RNA, 32 nt, Human
guccuuugaaacugaggaaaacugacggcacg

SEQ ID NO: 208456 - RNA, 32 nt, Human
guccuuugacaucacuggccgcuuucuggccu

SEQ ID NO: 208457 - RNA, 32 nt, Human
guccuuugaccucaccaggccucaugcuuccc

SEQ ID NO: 208458 - RNA, 32 nt, Human
guccuuugaggaagggagaggaggugaaugaa

SEQ ID NO: 208459 - RNA, 32 nt, Human
guccuuugcucucuuugcuucuaccucaaaua

SEQ ID NO: 208460 - RNA, 32 nt, Human
guccuuuggccaaaccuucccucucuucuggc

SEQ ID NO: 208461 - RNA, 32 nt, Human
guccuuuggggcauagaucagaagacuacaaa

SEQ ID NO: 208462 - RNA, 32 nt, Human
guccuuuggggcuugggcagggccgugacaca

SEQ ID NO: 208463 - RNA, 32 nt, Human
guccuuugugccagaccaagcggcccgugggg

SEQ ID NO: 208464 - RNA, 32 nt, Human
guccuuuucagcugcccacgaaggccugcuuc

SEQ ID NO: 208465 - RNA, 32 nt, Human
guccuuuucccaucccuccccaugaaggaggg

SEQ ID NO: 208466 - RNA, 32 nt, Human
guccuuuuccuccuuggagccugggccagcuc

SEQ ID NO: 208467 - RNA, 32 nt, Human
gucgaaaacugaggcuccggccgcagagaacu

SEQ ID NO: 208468 - RNA, 31 nt, Human
gucgaaaugcagaaauuucuuggaucauuuu

SEQ ID NO: 208469 - RNA, 32 nt, Human
gucgaaaugcugugccaguugcucugguauuc

SEQ ID NO: 208470 - RNA, 32 nt, Human
gucgaacaugccucaucauacccuccagcauu

SEQ ID NO: 208471 - RNA, 32 nt, Human
gucgaacaugguggaacugcaauuuaagcuca

SEQ ID NO: 208472 - RNA, 32 nt, Human
gucgaaccacugcugugugucuugucaggaug

SEQ ID NO: 208473 - RNA, 32 nt, Human
gucgaaccagaucuucucauguacuaggaagu

SEQ ID NO: 208474 - RNA, 32 nt, Human
gucgaagcccaggagccuuccuuuuuaacaag

SEQ ID NO: 208475 - RNA, 32 nt, Human
gucgaaggcuguaguggacacaggcuguuuug

SEQ ID NO: 208476 - RNA, 32 nt, Human
gucgaagggggcugcagagaggguagagaagg

SEQ ID NO: 208477 - RNA, 32 nt, Human
gucgaagguccaagggcauguggaaaugguca

SEQ ID NO: 208478 - RNA, 32 nt, Human
gucgaaucagcuuuguaauguuaugggacaaa

SEQ ID NO: 208479 - RNA, 32 nt, Human
gucgaauggaguuuugaucucgcugaguuugg

SEQ ID NO: 208480 - RNA, 32 nt, Human
gucgaauuccagcucgccuuguugacucgccu

SEQ ID NO: 208481 - RNA, 32 nt, Human
gucgacacgucucgucuccugucccaauucag

SEQ ID NO: 208482 - RNA, 32 nt, Human
gucgacagagucuugcucugucgcccaggcug

SEQ ID NO: 208483 - RNA, 32 nt, Human
gucgacaucauguuuggcugggcaucgaugcc

SEQ ID NO: 208484 - RNA, 32 nt, Human
gucgacauccauaguaaccaugugccauaaca

SEQ ID NO: 208485 - RNA, 32 nt, Human
gucgaccccaaagccccuugcucuccccugcc

SEQ ID NO: 208486 - RNA, 32 nt, Human
gucgaccucuacuccuccuugcgcucaccuug

SEQ ID NO: 208487 - RNA, 32 nt, Human
gucgaccugguggggcccggggccaagccugc

SEQ ID NO: 208488 - RNA, 32 nt, Human
gucgaccuguuguguuguggugccauccucuu

SEQ ID NO: 208489 - RNA, 32 nt, Human
gucgacugcacucucuccuuagcugcagacca

SEQ ID NO: 208490 - RNA, 32 nt, Human
gucgagaccauccuggccaacauggugaaacc

SEQ ID NO: 208491 - RNA, 32 nt, Human
gucgagaccggccuggccaacguggugaaaca

SEQ ID NO: 208492 - RNA, 32 nt, Human
gucgagaucagccugggaaacacagggaggcc

SEQ ID NO: 208493 - RNA, 32 nt, Human
gucgagaucauugcacuccagccugggcaaua

SEQ ID NO: 208494 - RNA, 31 nt, Human
gucgagauguccacagaaggaggauuuggug

SEQ ID NO: 208495 - RNA, 19 nt, Human
gucgagcaagcucaggaga

SEQ ID NO: 208496 - RNA, 32 nt, Human
gucgagcagcuuuccuggaggaaaagguuaau

SEQ ID NO: 208497 - RNA, 32 nt, Human
gucgagccccuggacggcggagggacuuugga

SEQ ID NO: 208498 - RNA, 32 nt, Human
gucgagcgggagcagaggaggcgagggaggag

SEQ ID NO: 208499 - RNA, 32 nt, Human
gucgagcucugacucccgugcugucgagaggg

SEQ ID NO: 208500 - RNA, 32 nt, Human
gucgagcugcacuaggccuggccugagccucu

SEQ ID NO: 208501 - RNA, 31 nt, Human
gucgaggaaagaucuuuacucacuuaaugag

SEQ ID NO: 208502 - RNA, 32 nt, Human
gucgaggaagggaagaaagaaacagaagucag

SEQ ID NO: 208503 - RNA, 32 nt, Human
gucgaggaggagguggauguggcagcugagau

SEQ ID NO: 208504 - RNA, 32 nt, Human
gucgaggagggaggacuuaagcccaagaguuc

SEQ ID NO: 208505 - RNA, 32 nt, Human
gucgaggcucaaguuugaauuucagcuucacu

SEQ ID NO: 208506 - RNA, 32 nt, Human
gucgaggcugcagugggcuaugauugcaccac

SEQ ID NO: 208507 - RNA, 20 nt, Human
gucgaggcuggaguguagug

SEQ ID NO: 208508 - RNA, 21 nt, Human
gucgaggcuggaguguagugg

SEQ ID NO: 208509 - RNA, 32 nt, Human
gucgagggaccgagcugcuggggaggaccuca

SEQ ID NO: 208510 - RNA, 32 nt, Human
gucgagggaggaaccagcucucugguuuacug

SEQ ID NO: 208511 - RNA, 32 nt, Human
gucgagggcugcagaacacagcgggguccugu

SEQ ID NO: 208512 - RNA, 32 nt, Human
gucgagguugcgcuacugcacuccagccugga

SEQ ID NO: 208513 - RNA, 32 nt, Human
gucgagugagagcugaccugcaccgaaguuug

SEQ ID NO: 208514 - RNA, 32 nt, Human
gucgagugccugcuuaggugcugaggucacag

SEQ ID NO: 208515 - RNA, 32 nt, Human
gucgauaucucacuuuuuauuuugccauggau

SEQ ID NO: 208516 - RNA, 32 nt, Human
gucgaucaggaaccuguuugcccuuugcuggg

SEQ ID NO: 208517 - RNA, 32 nt, Human
gucgauccugggagagcaaggagccagcaagu

SEQ ID NO: 208518 - RNA, 32 nt, Human
gucgaucucccaggggcuucaugugucuuuuu

SEQ ID NO: 208519 - RNA, 18 nt, Human
gucgaugcauccauuuca

SEQ ID NO: 208520 - RNA, 32 nt, Human
gucgaugcucacugcuucugcuuuuucuuucu

SEQ ID NO: 208521 - RNA, 32 nt, Human
gucgaugggaacugaagacuaguccauaggag

SEQ ID NO: 208522 - RNA, 32 nt, Human
gucgauucucauaaggagcggacaaccuugca

SEQ ID NO: 208523 - RNA, 32 nt, Human
gucgauuucucauugucuucaccaaucuucug

SEQ ID NO: 208524 - RNA, 32 nt, Human
gucgcaaagcagaaacugaaaacuguccagaa

SEQ ID NO: 208525 - RNA, 32 nt, Human
gucgcaaauagccaugcuuugccuuaugccaa

SEQ ID NO: 208526 - RNA, 32 nt, Human
gucgcaccacugcacuccagccugggugacag

SEQ ID NO: 208527 - RNA, 32 nt, Human
gucgcaccacugcacuccagucuggguaacag

SEQ ID NO: 208528 - RNA, 32 nt, Human
gucgcaccacugcacugcagccugggugacag

SEQ ID NO: 208529 - RNA, 32 nt, Human
gucgcaccgcuacacuccagccugggugacag

SEQ ID NO: 208530 - RNA, 32 nt, Human
gucgcaccguuguacuccagccuggugauaga

SEQ ID NO: 208531 - RNA, 32 nt, Human
gucgcacugccucccacccugugucugcuucc

SEQ ID NO: 208532 - RNA, 32 nt, Human
gucgcagacgcuagugugagcccccauggcag

SEQ ID NO: 208533 - RNA, 32 nt, Human
gucgcagacucccugaccccucccucaccccu

SEQ ID NO: 208534 - RNA, 32 nt, Human
gucgcagagagggaccccgggcgccugcugag

SEQ ID NO: 208535 - RNA, 32 nt, Human
gucgcagcaggaaagggaguucccuggucucc

SEQ ID NO: 208536 - RNA, 32 nt, Human
gucgcagcaguuuuacaucacaugcagccaag

SEQ ID NO: 208537 - RNA, 32 nt, Human
gucgcagcauucucugcaggcaucacagaccu

SEQ ID NO: 208538 - RNA, 32 nt, Human
gucgcagccagccugcucuuacuuauacaucu

SEQ ID NO: 208539 - RNA, 32 nt, Human
gucgcagccuucccccuccagacacggaagca

SEQ ID NO: 208540 - RNA, 32 nt, Human
gucgcagcugccgguguucgcgccucuagccg

SEQ ID NO: 208541 - RNA, 32 nt, Human
gucgcagcuucacuuacaccagcugcucugug

SEQ ID NO: 208542 - RNA, 32 nt, Human
gucgcagcuuugacaucuugguguacucaugu

SEQ ID NO: 208543 - RNA, 32 nt, Human
gucgcaggaaccucuugugagccacgagcaga

SEQ ID NO: 208544 - RNA, 32 nt, Human
gucgcaggacucugcccuuccccaagagagga

SEQ ID NO: 208545 - RNA, 32 nt, Human
gucgcaggagaguucugggguacacgggcaaa

SEQ ID NO: 208546 - RNA, 32 nt, Human
gucgcaggaucgagacccugaggcagacagcc

SEQ ID NO: 208547 - RNA, 32 nt, Human
gucgcaggcaggucucuuacccucucugggcc

SEQ ID NO: 208548 - RNA, 21 nt, Human
gucgcaggggugggaugugag

SEQ ID NO: 208549 - RNA, 32 nt, Human
gucgcagggucagcgggccugaagggggcugg

SEQ ID NO: 208550 - RNA, 32 nt, Human
gucgcaucaugccagucagucuggccgacucc

SEQ ID NO: 208551 - RNA, 23 nt, Human
gucgcaugcagugccuguacugg

SEQ ID NO: 208552 - RNA, 32 nt, Human
gucgcauuagagcgagucacauggagcauccu

SEQ ID NO: 208553 - RNA, 32 nt, Human
gucgcauuucaaaacaaaccaugauggagugg

SEQ ID NO: 208554 - RNA, 32 nt, Human
gucgccaaaucaccaguauuugcuuauauagc

SEQ ID NO: 208555 - RNA, 23 nt, Human
gucgccaagccagagugcagugg

SEQ ID NO: 208556 - RNA, 24 nt, Human
gucgccaaggcuggagugcagugg

SEQ ID NO: 208557 - RNA, 32 nt, Human
gucgccaaguuggagcuugcagugagccgaga

SEQ ID NO: 208558 - RNA, 23 nt, Human
gucgccaaguuggagugcaaugg

SEQ ID NO: 208559 - RNA, 32 nt, Human
gucgccaaguuggagugcaauggugcgaucuc

SEQ ID NO: 208560 - RNA, 32 nt, Human
gucgccacccagacuacauuucccgacaggcc

SEQ ID NO: 208561 - RNA, 32 nt, Human
gucgccacccuccuccuugccuguaucuugac

SEQ ID NO: 208562 - RNA, 32 nt, Human
gucgccacucucucccccuguuccgcgucugc

SEQ ID NO: 208563 - RNA, 32 nt, Human
gucgccacugcacccagccugugucuuccagc

SEQ ID NO: 208564 - RNA, 32 nt, Human
gucgccacuggcugccugaggugcucuuacag

SEQ ID NO: 208565 - RNA, 23 nt, Human
gucgccagacuggagugcagugg

SEQ ID NO: 208566 - RNA, 32 nt, Human
gucgccagacuggagugcaguggcgcaaucuc

SEQ ID NO: 208567 - RNA, 32 nt, Human
gucgccagaucguauuucagucugucaggggu

SEQ ID NO: 208568 - RNA, 32 nt, Human
gucgccagccccggcccgggcucgagaaucaa

SEQ ID NO: 208569 - RNA, 32 nt, Human
gucgccaggaaggaaaagcacuguugaagauu

SEQ ID NO: 208570 - RNA, 23 nt, Human
gucgccaggcuagagugcggugg

SEQ ID NO: 208571 - RNA, 23 nt, Human
gucgccaggcugaagugcagugg

SEQ ID NO: 208572 - RNA, 32 nt, Human
gucgccaggcugaagugcaguggcgcaaucuu

SEQ ID NO: 208573 - RNA, 21 nt, Human
gucgccaggcuggaaugcagu

SEQ ID NO: 208574 - RNA, 32 nt, Human
gucgccaggcuggaaugcaguagggcaaucuc

SEQ ID NO: 208575 - RNA, 22 nt, Human
gucgccaggcuggaaugcagug

SEQ ID NO: 208576 - RNA, 32 nt, Human
gucgccaggcuggaaugcagugcagugagcca

SEQ ID NO: 208577 - RNA, 32 nt, Human
gucgccaggcuggaguacaguggugugcaauc

SEQ ID NO: 208578 - RNA, 23 nt, Human
gucgccaggcuggagugcaaugg

SEQ ID NO: 208579 - RNA, 32 nt, Human
gucgccaggcuggagugcaauggcgcgaucuc

SEQ ID NO: 208580 - RNA, 32 nt, Human
gucgccaggcuggagugcaauggcgugaucuc

SEQ ID NO: 208581 - RNA, 23 nt, Human
gucgccaggcuggagugcagugg

SEQ ID NO: 208582 - RNA, 32 nt, Human
gucgccaggcuggagugcaguggcgcagucuc

SEQ ID NO: 208583 - RNA, 32 nt, Human
gucgccaggcuggagugcaguggcgcgaucua

SEQ ID NO: 208584 - RNA, 32 nt, Human
gucgccaggcuggagugcaguggcgcgaucuc

SEQ ID NO: 208585 - RNA, 32 nt, Human
gucgccaggcuggagugcaguggcgugaucuc

SEQ ID NO: 208586 - RNA, 32 nt, Human
gucgccaggcuggagugcaguggugccaucuc

SEQ ID NO: 208587 - RNA, 32 nt, Human
gucgccaggcuggagugcaguggugcgaccuc

SEQ ID NO: 208588 - RNA, 32 nt, Human
gucgccaggcuggagugcaguggugcgaucuc

SEQ ID NO: 208589 - RNA, 32 nt, Human
gucgccaggcuggagugcaguggugugaucuu

SEQ ID NO: 208590 - RNA, 23 nt, Human
gucgccaggcuggaguguagugg

SEQ ID NO: 208591 - RNA, 23 nt, Human
gucgccagguuggagugcagugg

SEQ ID NO: 208592 - RNA, 32 nt, Human
gucgccagguuggagugcaguggcgugaucuc

SEQ ID NO: 208593 - RNA, 32 nt, Human
gucgccaucuuggggccuucaccagaguccaa

SEQ ID NO: 208594 - RNA, 31 nt, Human
gucgccaugggcauguggccucaggccguca

SEQ ID NO: 208595 - RNA, 32 nt, Human
gucgccauugcuuuuucagccauucacaagca

SEQ ID NO: 208596 - RNA, 23 nt, Human
gucgcccaacuagaguguagugg

SEQ ID NO: 208597 - RNA, 23 nt, Human
gucgcccaagcuagagugcagug

SEQ ID NO: 208598 - RNA, 24 nt, Human
gucgcccaagcuagagugcagugg

SEQ ID NO: 208599 - RNA, 24 nt, Human
gucgcccaagcuggagcgcaaugg

SEQ ID NO: 208600 - RNA, 24 nt, Human
gucgcccaagcuggaguacagugg

SEQ ID NO: 208601 - RNA, 23 nt, Human
gucgcccaagcuggagugcagug

SEQ ID NO: 208602 - RNA, 24 nt, Human
gucgcccaagcuggagugcagugg

SEQ ID NO: 208603 - RNA, 32 nt, Human
gucgcccaauagcccaggcuggagugcagugg

SEQ ID NO: 208604 - RNA, 28 nt, Human
gucgcccacccaggcuggaguacagugg

SEQ ID NO: 208605 - RNA, 32 nt, Human
gucgcccacccaggcuggaguacaguggcacg

SEQ ID NO: 208606 - RNA, 20 nt, Human
gucgcccacgugccugcuca

SEQ ID NO: 208607 - RNA, 24 nt, Human
gucgcccagacuagaaugcagugg

SEQ ID NO: 208608 - RNA, 23 nt, Human
gucgcccagacuagagugcaaug

SEQ ID NO: 208609 - RNA, 24 nt, Human
gucgcccagacuagagugcaaugg

SEQ ID NO: 208610 - RNA, 24 nt, Human
gucgcccagacuggaguccagugg

SEQ ID NO: 208611 - RNA, 22 nt, Human
gucgcccagacuggagugcagu

SEQ ID NO: 208612 - RNA, 24 nt, Human
gucgcccagacuggagugcaguag

SEQ ID NO: 208613 - RNA, 23 nt, Human
gucgcccagacuggagugcagug

SEQ ID NO: 208614 - RNA, 24 nt, Human
gucgcccagacuggagugcagugg

SEQ ID NO: 208615 - RNA, 24 nt, Human
gucgcccagacuggagugcugugg

SEQ ID NO: 208616 - RNA, 24 nt, Human
gucgcccagacuguaguacagugg

SEQ ID NO: 208617 - RNA, 24 nt, Human
gucgcccagccuggagugcagugg

SEQ ID NO: 208618 - RNA, 32 nt, Human
gucgcccagcuccggcgcugacggguguggac

SEQ ID NO: 208619 - RNA, 24 nt, Human
gucgcccaggauggagugcagugg

SEQ ID NO: 208620 - RNA, 24 nt, Human
gucgcccaggcuagaguauagugg

SEQ ID NO: 208621 - RNA, 23 nt, Human
gucgcccaggcuagagugcagug

SEQ ID NO: 208622 - RNA, 24 nt, Human
gucgcccaggcuagagugcagugg

SEQ ID NO: 208623 - RNA, 24 nt, Human
gucgcccaggcuagaguggauugg

SEQ ID NO: 208624 - RNA, 32 nt, Human
gucgcccaggcugcaaccucgaccucccgggc

SEQ ID NO: 208625 - RNA, 24 nt, Human
gucgcccaggcugcagugcagugg

SEQ ID NO: 208626 - RNA, 22 nt, Human
gucgcccaggcuggaaugcagu

SEQ ID NO: 208627 - RNA, 24 nt, Human
gucgcccaggcuggaaugcaguag

SEQ ID NO: 208628 - RNA, 23 nt, Human
gucgcccaggcuggaaugcagug

SEQ ID NO: 208629 - RNA, 24 nt, Human
gucgcccaggcuggaaugcagugg

SEQ ID NO: 208630 - RNA, 22 nt, Human
gucgcccaggcuggaaugcugu

SEQ ID NO: 208631 - RNA, 20 nt, Human
gucgcccaggcuggacugca

SEQ ID NO: 208632 - RNA, 24 nt, Human
gucgcccaggcuggacugcagugg

SEQ ID NO: 208633 - RNA, 24 nt, Human
gucgcccaggcuggagagcagugg

SEQ ID NO: 208634 - RNA, 23 nt, Human
gucgcccaggcuggagcgcaaug

SEQ ID NO: 208635 - RNA, 24 nt, Human
gucgcccaggcuggagcgcaaugg

SEQ ID NO: 208636 - RNA, 22 nt, Human
gucgcccaggcuggagcgcagu

SEQ ID NO: 208637 - RNA, 24 nt, Human
gucgcccaggcuggagcgcagucc

SEQ ID NO: 208638 - RNA, 24 nt, Human
gucgcccaggcuggagcgcagugg

SEQ ID NO: 208639 - RNA, 24 nt, Human
gucgcccaggcuggagggcagugg

SEQ ID NO: 208640 - RNA, 22 nt, Human
gucgcccaggcuggagguuaau

SEQ ID NO: 208641 - RNA, 24 nt, Human
gucgcccaggcuggagguuaaugg

SEQ ID NO: 208642 - RNA, 23 nt, Human
gucgcccaggcuggaguacaaug

SEQ ID NO: 208643 - RNA, 24 nt, Human
gucgcccaggcuggaguacaaugg

SEQ ID NO: 208644 - RNA, 24 nt, Human
gucgcccaggcuggaguacagugg

SEQ ID NO: 208645 - RNA, 22 nt, Human
gucgcccaggcuggagugagug

SEQ ID NO: 208646 - RNA, 28 nt, Human
gucgcccaggcuggagugagugcagugg

SEQ ID NO: 208647 - RNA, 32 nt, Human
gucgcccaggcuggagugagugcaguggcgca

SEQ ID NO: 208648 - RNA, 20 nt, Human
gucgcccaggcuggagugca

SEQ ID NO: 208649 - RNA, 23 nt, Human
gucgcccaggcuggagugcaaug

SEQ ID NO: 208650 - RNA, 24 nt, Human
gucgcccaggcuggagugcaaugg

SEQ ID NO: 208651 - RNA, 24 nt, Human
gucgcccaggcuggagugcacugg

SEQ ID NO: 208652 - RNA, 21 nt, Human
gucgcccaggcuggagugcag

SEQ ID NO: 208653 - RNA, 24 nt, Human
gucgcccaggcuggagugcagagg

SEQ ID NO: 208654 - RNA, 23 nt, Human
gucgcccaggcuggagugcaggg

SEQ ID NO: 208655 - RNA, 22 nt, Human
gucgcccaggcuggagugcagu

SEQ ID NO: 208656 - RNA, 24 nt, Human
gucgcccaggcuggagugcaguag

SEQ ID NO: 208657 - RNA, 23 nt, Human
gucgcccaggcuggagugcagug

SEQ ID NO: 208658 - RNA, 24 nt, Human
gucgcccaggcuggagugcaguga

SEQ ID NO: 208659 - RNA, 32 nt, Human
gucgcccaggcuggagugcagugagcugagau

SEQ ID NO: 208660 - RNA, 24 nt, Human
gucgcccaggcuggagugcagugg

SEQ ID NO: 208661 - RNA, 23 nt, Human
gucgcccaggcuggagugcauug

SEQ ID NO: 208662 - RNA, 24 nt, Human
gucgcccaggcuggagugcauugg

SEQ ID NO: 208663 - RNA, 23 nt, Human
gucgcccaggcuggagugcgaug

SEQ ID NO: 208664 - RNA, 24 nt, Human
gucgcccaggcuggagugcgaugg

SEQ ID NO: 208665 - RNA, 23 nt, Human
gucgcccaggcuggagugcggug

SEQ ID NO: 208666 - RNA, 24 nt, Human
gucgcccaggcuggagugcggugg

SEQ ID NO: 208667 - RNA, 22 nt, Human
gucgcccaggcuggaguguagu

SEQ ID NO: 208668 - RNA, 24 nt, Human
gucgcccaggcuggaguguagugg

SEQ ID NO: 208669 - RNA, 23 nt, Human
gucgcccaggcuggaguguggug

SEQ ID NO: 208670 - RNA, 24 nt, Human
gucgcccaggcuggaguguggugg

SEQ ID NO: 208671 - RNA, 24 nt, Human
gucgcccaggcuggcgugaagugg

SEQ ID NO: 208672 - RNA, 24 nt, Human
gucgcccaggcuggcgugcagugg

SEQ ID NO: 208673 - RNA, 24 nt, Human
gucgcccaggcuggggugcagugg

SEQ ID NO: 208674 - RNA, 24 nt, Human
gucgcccaggcuggguugcagugg

SEQ ID NO: 208675 - RNA, 24 nt, Human
gucgcccaggcuguagugcaaugg

SEQ ID NO: 208676 - RNA, 24 nt, Human
gucgcccaggcuguagugcagugg

SEQ ID NO: 208677 - RNA, 25 nt, Human
gucgcccagggcuggagugcagugg

SEQ ID NO: 208678 - RNA, 24 nt, Human
gucgcccaggguggagugcagugg

SEQ ID NO: 208679 - RNA, 24 nt, Human
gucgcccaggguggagugcggugg

SEQ ID NO: 208680 - RNA, 24 nt, Human
gucgcccagguuggagugcagugg

SEQ ID NO: 208681 - RNA, 24 nt, Human
gucgcccagguuggagugccaugg

SEQ ID NO: 208682 - RNA, 24 nt, Human
gucgcccagguuguaaugcagugg

SEQ ID NO: 208683 - RNA, 23 nt, Human
gucgcccagucuguaaugcagug

SEQ ID NO: 208684 - RNA, 24 nt, Human
gucgcccaugcuggagugcagugg

SEQ ID NO: 208685 - RNA, 32 nt, Human
gucgccccagagugcccaggaggcaggcagug

SEQ ID NO: 208686 - RNA, 32 nt, Human
gucgcccccacucaccaccauuaaugcccaca

SEQ ID NO: 208687 - RNA, 32 nt, Human
gucgcccccaggaaagacgggccugggggagg

SEQ ID NO: 208688 - RNA, 32 nt, Human
gucgccccgccugugcagcccaggaccuaggc

SEQ ID NO: 208689 - RNA, 32 nt, Human
gucgccccgugcaggagacguagguaggacgu

SEQ ID NO: 208690 - RNA, 18 nt, Human
gucgccccuuucgcgcug

SEQ ID NO: 208691 - RNA, 24 nt, Human
gucgcccgacagcuuuuucuccgu

SEQ ID NO: 208692 - RNA, 17 nt, Human
gucgcccggagugcggu

SEQ ID NO: 208693 - RNA, 32 nt, Human
gucgcccugagcgagcggggccugggcggccg

SEQ ID NO: 208694 - RNA, 32 nt, Human
gucgcccugcagccucacacagauccugcaca

SEQ ID NO: 208695 - RNA, 24 nt, Human
gucgcccuggcuggagugcaaugg

SEQ ID NO: 208696 - RNA, 32 nt, Human
gucgcccugggagccucuggaaggccuugcua

SEQ ID NO: 208697 - RNA, 32 nt, Human
gucgcccugugcauggggugcccucgcaggcc

SEQ ID NO: 208698 - RNA, 32 nt, Human
gucgcccuuugcugcauggcagggggcugcug

SEQ ID NO: 208699 - RNA, 32 nt, Human
gucgccgcagaacugccacguggggaugagau

SEQ ID NO: 208700 - RNA, 32 nt, Human
gucgccgccugcucccugcacccaugacaauc

SEQ ID NO: 208701 - RNA, 25 nt, Human
gucgccgcucgcacgcccuugggcc

SEQ ID NO: 208702 - RNA, 32 nt, Human
gucgccgcugccgccuccgcccgcggccggga

SEQ ID NO: 208703 - RNA, 18 nt, Human
gucgccggagcugcaaug

SEQ ID NO: 208704 - RNA, 32 nt, Human
gucgccggauugcagagcugaagggagcccug

SEQ ID NO: 208705 - RNA, 21 nt, Human
gucgccggcgcgggauugggg

SEQ ID NO: 208706 - RNA, 17 nt, Human
gucgccggcuccgcgcu

SEQ ID NO: 208707 - RNA, 32 nt, Human
gucgccgucgaccucagaggcggggccggaag

SEQ ID NO: 208708 - RNA, 32 nt, Human
gucgccgugugcuggggaucugaaaugaggcc

SEQ ID NO: 208709 - RNA, 24 nt, Human
gucgccuacgcuggagugcagugg

SEQ ID NO: 208710 - RNA, 20 nt, Human
gucgccuaggcuggagugca

SEQ ID NO: 208711 - RNA, 21 nt, Human
gucgccuaggcuggagugcaa

SEQ ID NO: 208712 - RNA, 24 nt, Human
gucgccuaggcuggagugcagugg

SEQ ID NO: 208713 - RNA, 20 nt, Human
gucgccuagggucagcggug

SEQ ID NO: 208714 - RNA, 32 nt, Human
gucgccuccccuucauccaccucucucucacc

SEQ ID NO: 208715 - RNA, 32 nt, Human
gucgccuccugccaucugaucucccuccccac

SEQ ID NO: 208716 - RNA, 32 nt, Human
gucgccuccugccuggagugacccugggcggg

SEQ ID NO: 208717 - RNA, 32 nt, Human
gucgccugcaacuuaggcggauugggucucuc

SEQ ID NO: 208718 - RNA, 32 nt, Human
gucgccugcacccacucccuucauacaaucua

SEQ ID NO: 208719 - RNA, 20 nt, Human
gucgccugcccgcccuggcc

SEQ ID NO: 208720 - RNA, 23 nt, Human
gucgccuggcuggagugcagugg

SEQ ID NO: 208721 - RNA, 32 nt, Human
gucgccuggcuggagugcaguggugugaucuc

SEQ ID NO: 208722 - RNA, 23 nt, Human
gucgccuggcuggaguggagugg

SEQ ID NO: 208723 - RNA, 32 nt, Human
gucgccuggcuggaguggaguggcacaaucuu

SEQ ID NO: 208724 - RNA, 32 nt, Human
gucgccugggccgcccccggcccagcccugcc

SEQ ID NO: 208725 - RNA, 24 nt, Human
gucgccugggcuggaguacagugg

SEQ ID NO: 208726 - RNA, 32 nt, Human
gucgccuggggaccccagaagggacaggcugg

SEQ ID NO: 208727 - RNA, 32 nt, Human
gucgccuguagucccagcuacucgggaggcug

SEQ ID NO: 208728 - RNA, 32 nt, Human
gucgccugucaacggcuagagugcaguagcgu

SEQ ID NO: 208729 - RNA, 25 nt, Human
gucgccuguucgcggaggugcggag

SEQ ID NO: 208730 - RNA, 32 nt, Human
gucgccuuaccucacccacagcagugcccuug

SEQ ID NO: 208731 - RNA, 32 nt, Human
gucgcgaggccggagauaagcuuggaagguug

SEQ ID NO: 208732 - RNA, 32 nt, Human
gucgcgcaaggacgucgguccucccagguuug

SEQ ID NO: 208733 - RNA, 32 nt, Human
gucgcgcagcugguucgggccgagccccgacu

SEQ ID NO: 208734 - RNA, 32 nt, Human
gucgcgcaggguggagugcgguggcacgaucu

SEQ ID NO: 208735 - RNA, 32 nt, Human
gucgcgccacugcacuccagccugggagaaag

SEQ ID NO: 208736 - RNA, 32 nt, Human
gucgcgccacugcacuccagccugggcagcaa

SEQ ID NO: 208737 - RNA, 32 nt, Human
gucgcgccacugcacuccagccugggcgacag

SEQ ID NO: 208738 - RNA, 32 nt, Human
gucgcgccacugcacuucagccugggugacag

SEQ ID NO: 208739 - RNA, 32 nt, Human
gucgcgccacugcgcuccagccuggacaacac

SEQ ID NO: 208740 - RNA, 32 nt, Human
gucgcgccauugcacuccagccugggcaacaa

SEQ ID NO: 208741 - RNA, 32 nt, Human
gucgcgccauugcacuccagccugggcgacag

SEQ ID NO: 208742 - RNA, 32 nt, Human
gucgcgcccuccugccgcaggccaccgaggcc

SEQ ID NO: 208743 - RNA, 32 nt, Human
gucgcgccuguaaucccagcacuuugggaggc

SEQ ID NO: 208744 - RNA, 32 nt, Human
gucgcgccuguuaggagggaaaggacucagga

SEQ ID NO: 208745 - RNA, 32 nt, Human
gucgcgcggaggcggaggcuugggugcguuca

SEQ ID NO: 208746 - RNA, 32 nt, Human
gucgcgcggucucccugguagaguuuguaggc

SEQ ID NO: 208747 - RNA, 32 nt, Human
gucgcgcucgagggucagggaggagagugacc

SEQ ID NO: 208748 - RNA, 32 nt, Human
gucgcgcugcaacccccggcucgggauccugg

SEQ ID NO: 208749 - RNA, 32 nt, Human
gucgcgcugcugcugcggcgcuccaaguucau

SEQ ID NO: 208750 - RNA, 32 nt, Human
gucgcgcuuuccaaauuucuuaggcauuuauu

SEQ ID NO: 208751 - RNA, 32 nt, Human
gucgcggacgcaauggcuucaagguuacuucg

SEQ ID NO: 208752 - RNA, 32 nt, Human
gucgcggacggacccugccuccccagcuuauc

SEQ ID NO: 208753 - RNA, 32 nt, Human
gucgcggacucguccuugcugcagucgccgcc

SEQ ID NO: 208754 - RNA, 23 nt, Human
gucgcggccggcgcggggcgggg

SEQ ID NO: 208755 - RNA, 21 nt, Human
gucgcggcgccggggcuggag

SEQ ID NO: 208756 - RNA, 23 nt, Human
gucgcgggacaccggguguagag

SEQ ID NO: 208757 - RNA, 32 nt, Human
gucgcgggagcggaagaagcuggaccgccucu

SEQ ID NO: 208758 - RNA, 32 nt, Human
gucgcggggaccaugcugccuucucugggcuc

SEQ ID NO: 208759 - RNA, 24 nt, Human
gucgcgguacucgguggugcagag

SEQ ID NO: 208760 - RNA, 21 nt, Human
gucgcggugaggggaugagag

SEQ ID NO: 208761 - RNA, 22 nt, Human
gucgcggugcaggugaugggag

SEQ ID NO: 208762 - RNA, 32 nt, Human
gucgcgguggcagcccggaugggccggcaggg

SEQ ID NO: 208763 - RNA, 22 nt, Human
gucgcggugucucaugcagcag

SEQ ID NO: 208764 - RNA, 32 nt, Human
gucgcguaucgagucuccgcccccuucccgcc

SEQ ID NO: 208765 - RNA, 32 nt, Human
gucgcgucgcgagggcccggcgcggagcuaga

SEQ ID NO: 208766 - RNA, 32 nt, Human
gucgcguggaucuacccucuaguuuacuugcu

SEQ ID NO: 208767 - RNA, 32 nt, Human
gucgcuacagcccagaccaaggcagaauaauc

SEQ ID NO: 208768 - RNA, 32 nt, Human
gucgcuaggaaggaugcagaggcugugugguu

SEQ ID NO: 208769 - RNA, 32 nt, Human
gucgcucagcaacaccaaaaagagaaagucug

SEQ ID NO: 208770 - RNA, 23 nt, Human
gucgcucagccuggagugcagug

SEQ ID NO: 208771 - RNA, 24 nt, Human
gucgcucaggcuggagugcaaugg

SEQ ID NO: 208772 - RNA, 23 nt, Human
gucgcucaggcuggagugcagug

SEQ ID NO: 208773 - RNA, 24 nt, Human
gucgcucaggcuggagugcagugg

SEQ ID NO: 208774 - RNA, 31 nt, Human
gucgcucagggcgggacaugggugaacggaa

SEQ ID NO: 208775 - RNA, 32 nt, Human
gucgcucauggaggagauggccagggcggacc

SEQ ID NO: 208776 - RNA, 32 nt, Human
gucgcuccauugcacuccagccugggcaacaa

SEQ ID NO: 208777 - RNA, 32 nt, Human
gucgcucccagugcagcugccaccccagccca

SEQ ID NO: 208778 - RNA, 32 nt, Human
gucgcucccauccuagaccaaucuaauugcaa

SEQ ID NO: 208779 - RNA, 32 nt, Human
gucgcuccugcucuccgaaugcugcgcaccgc

SEQ ID NO: 208780 - RNA, 32 nt, Human
gucgcucuccaaucuuaaccagguuugcuccc

SEQ ID NO: 208781 - RNA, 32 nt, Human
gucgcucucuggcugcuccucugucccuugag

SEQ ID NO: 208782 - RNA, 32 nt, Human
gucgcucugucacccaggcuggaguuauagug

SEQ ID NO: 208783 - RNA, 32 nt, Human
gucgcugaaggagagagaaaagaugugugucu

SEQ ID NO: 208784 - RNA, 32 nt, Human
gucgcugcagccucaaccuccugggcucaagu

SEQ ID NO: 208785 - RNA, 32 nt, Human
gucgcugcagcugccgggaaagaaggaaacga

SEQ ID NO: 208786 - RNA, 32 nt, Human
gucgcugcgcggcccaccccggaugucagccc

SEQ ID NO: 208787 - RNA, 32 nt, Human
gucgcugcugccgccuccacccagccuccgcc

SEQ ID NO: 208788 - RNA, 19 nt, Human
gucgcugcugcucucaucc

SEQ ID NO: 208789 - RNA, 20 nt, Human
gucgcugcuugcccugcguc

SEQ ID NO: 208790 - RNA, 32 nt, Human
gucgcuggagugcaccagucuuggggaagagg

SEQ ID NO: 208791 - RNA, 18 nt, Human
gucgcuggagugcagugg

SEQ ID NO: 208792 - RNA, 30 nt, Human
gucgcuggccucucccugcccugacacuug

SEQ ID NO: 208793 - RNA, 32 nt, Human
gucgcuggccucucccugcccugacacuugau

SEQ ID NO: 208794 - RNA, 27 nt, Human
gucgcuggcgggguucggcccgagcua

SEQ ID NO: 208795 - RNA, 32 nt, Human
gucgcugggauuacugagauugugccacugca

SEQ ID NO: 208796 - RNA, 32 nt, Human
gucgcugggcagggcgaguugggaaagcggca

SEQ ID NO: 208797 - RNA, 32 nt, Human
gucgcugucauucugucauugcugcuacucua

SEQ ID NO: 208798 - RNA, 23 nt, Human
gucgcuuagcuggagugcggugg

SEQ ID NO: 208799 - RNA, 32 nt, Human
gucgcuugaccuucaguugugcacugaggccg

SEQ ID NO: 208800 - RNA, 32 nt, Human
gucgcuugcguggcuaggaagggguuggggcc

SEQ ID NO: 208801 - RNA, 32 nt, Human
gucgcuuuugaacagccccugcaccuggcagc

SEQ ID NO: 208802 - RNA, 20 nt, Human
gucgcuuuugccuuuucaaa

SEQ ID NO: 208803 - RNA, 32 nt, Human
gucggaaaugcacauuccuggauaggaaucac

SEQ ID NO: 208804 - RNA, 32 nt, Human
gucggaaccauggaaggccuccggggagacag

SEQ ID NO: 208805 - RNA, 32 nt, Human
gucggaagaaggagggugagcaccugggagag

SEQ ID NO: 208806 - RNA, 32 nt, Human
gucggaagucauauuuuauaugccaucauaga

SEQ ID NO: 208807 - RNA, 32 nt, Human
gucggacacacagcaguaauuucccagucaua

SEQ ID NO: 208808 - RNA, 17 nt, Human
gucggacagcagguagg

SEQ ID NO: 208809 - RNA, 32 nt, Human
gucggacauacaccuacacugcauuccucaaa

SEQ ID NO: 208810 - RNA, 32 nt, Human
gucggacgggaccugggcucucuccacgauuc

SEQ ID NO: 208811 - RNA, 32 nt, Human
gucggacucuacaggccagccucugccucaca

SEQ ID NO: 208812 - RNA, 32 nt, Human
gucggacugcgcucccagccugggcucuggga

SEQ ID NO: 208813 - RNA, 32 nt, Human
gucggagaagcgccccuacccacccacacccc

SEQ ID NO: 208814 - RNA, 32 nt, Human
gucggagacacaccuugauguauguuaauaaa

SEQ ID NO: 208815 - RNA, 32 nt, Human
gucggagacccugucuccaccucuagguuugg

SEQ ID NO: 208816 - RNA, 32 nt, Human
gucggagaugaaaucagagggagucgaagcug

SEQ ID NO: 208817 - RNA, 32 nt, Human
gucggagcacagcgugagcggaaugaaugcug

SEQ ID NO: 208818 - RNA, 32 nt, Human
gucggagccacugguccugcugcuggcugccu

SEQ ID NO: 208819 - RNA, 32 nt, Human
gucggagcucuuccuuccccucuguggaguca

SEQ ID NO: 208820 - RNA, 32 nt, Human
gucggaggaagaggagggaggagggaggccga

SEQ ID NO: 208821 - RNA, 32 nt, Human
gucggagggagguuuaaccacagaucgguucc

SEQ ID NO: 208822 - RNA, 32 nt, Human
gucggagggggccggcgcgcagagccagacgc

SEQ ID NO: 208823 - RNA, 32 nt, Human
gucggaggguggcauuaacaccagugugccau

SEQ ID NO: 208824 - RNA, 32 nt, Human
gucggaggucugggagaaaggagcagcugucu

SEQ ID NO: 208825 - RNA, 32 nt, Human
gucggagguguaaucauauuggugcuauuccu

SEQ ID NO: 208826 - RNA, 32 nt, Human
gucggaguuccccagcaaacagugaccaagcc

SEQ ID NO: 208827 - RNA, 32 nt, Human
gucggauacuguggcguaugaggaccugucug

SEQ ID NO: 208828 - RNA, 32 nt, Human
gucggauuacaagaucaaccaccaccaacaac

SEQ ID NO: 208829 - RNA, 32 nt, Human
gucggauuggccgcacgccucaguucuagacg

SEQ ID NO: 208830 - RNA, 32 nt, Human
gucggcaccugggacaucccugagggaagggc

SEQ ID NO: 208831 - RNA, 32 nt, Human
gucggcagacuggggcuuccuccugggccacc

SEQ ID NO: 208832 - RNA, 32 nt, Human
gucggcagagcaaccccaccuccaggcauuau

SEQ ID NO: 208833 - RNA, 18 nt, Human
gucggcagagucuggggu

SEQ ID NO: 208834 - RNA, 32 nt, Human
gucggcagagucugggguagggagacagcgac

SEQ ID NO: 208835 - RNA, 32 nt, Human
gucggcaggcagcauggggaagggagggaacc

SEQ ID NO: 208836 - RNA, 32 nt, Human
gucggcaggcucggcaagcgaagaggagcggc

SEQ ID NO: 208837 - RNA, 32 nt, Human
gucggccaagugcgugggcauugaucuacacg

SEQ ID NO: 208838 - RNA, 24 nt, Human
gucggccaggcuagagugcagugg

SEQ ID NO: 208839 - RNA, 24 nt, Human
gucggccaggcuggaaugcaaugg

SEQ ID NO: 208840 - RNA, 24 nt, Human
gucggccaggcuggagugcagugg

SEQ ID NO: 208841 - RNA, 32 nt, Human
gucggccagguguggugggaucacgccuguaa

SEQ ID NO: 208842 - RNA, 23 nt, Human
gucggcccagacugaagugcagu

SEQ ID NO: 208843 - RNA, 24 nt, Human
gucggcccagacugaagugcagug

SEQ ID NO: 208844 - RNA, 25 nt, Human
gucggcccagacugaagugcagugg

SEQ ID NO: 208845 - RNA, 32 nt, Human
gucggccccagcccugaggagccggaccgaug

SEQ ID NO: 208846 - RNA, 22 nt, Human
gucggccccuuccagggccagg

SEQ ID NO: 208847 - RNA, 26 nt, Human
gucggcccugcgucggcccuggggua

SEQ ID NO: 208848 - RNA, 32 nt, Human
gucggccggccugcuggcauggcugggcaucc

SEQ ID NO: 208849 - RNA, 31 nt, Human
gucggccgugcacaauuacaugcagaccugc

SEQ ID NO: 208850 - RNA, 32 nt, Human
gucggccucgucggcccugcugagguaucagg

SEQ ID NO: 208851 - RNA, 31 nt, Human
gucggccugcccaccgggccugugcggggcg

SEQ ID NO: 208852 - RNA, 32 nt, Human
gucggccugcgcuccucagccuggcgguucua

SEQ ID NO: 208853 - RNA, 32 nt, Human
gucggccuggagucugugccugguccuuugcc

SEQ ID NO: 208854 - RNA, 32 nt, Human
gucggccuggaguugggguugcagggacgcca

SEQ ID NO: 208855 - RNA, 32 nt, Human
gucggcgcccacugcccggcggcagcggcgga

SEQ ID NO: 208856 - RNA, 32 nt, Human
gucggcgcugccccaucuccccucagcucggc

SEQ ID NO: 208857 - RNA, 32 nt, Human
gucggcgcugcgggcgaggugggcagguaggu

SEQ ID NO: 208858 - RNA, 18 nt, Human
gucggcgggcuccaggga

SEQ ID NO: 208859 - RNA, 32 nt, Human
gucggcgggcugggggcggcacgacuggaggc

SEQ ID NO: 208860 - RNA, 32 nt, Human
gucggcggugcuggcggccgggucccuggugc

SEQ ID NO: 208861 - RNA, 17 nt, Human
gucggcgugaggugggg

SEQ ID NO: 208862 - RNA, 32 nt, Human
gucggcguuuucucccagccuccgccaugccg

SEQ ID NO: 208863 - RNA, 32 nt, Human
gucggcucacugcaacguccgccuccuggguu

SEQ ID NO: 208864 - RNA, 32 nt, Human
gucggcucacugcaagcuccgccuccuggguu

SEQ ID NO: 208865 - RNA, 32 nt, Human
gucggcucacugccaacaucugccacccaggu

SEQ ID NO: 208866 - RNA, 32 nt, Human
gucggcuccaugcucaccagcagccgcccagg

SEQ ID NO: 208867 - RNA, 32 nt, Human
gucggcuccccaggcuguggccucaggaauca

SEQ ID NO: 208868 - RNA, 32 nt, Human
gucggcucgcggauccagcugcagagcgacgu

SEQ ID NO: 208869 - RNA, 32 nt, Human
gucggcucuccugguuucccccuguuuccccu

SEQ ID NO: 208870 - RNA, 32 nt, Human
gucggcugcugccccgggucuggcagaacucg

SEQ ID NO: 208871 - RNA, 18 nt, Human
gucggcugggugcagugg

SEQ ID NO: 208872 - RNA, 32 nt, Human
gucggcuguggucagcagcccagaccccauca

SEQ ID NO: 208873 - RNA, 31 nt, Human
gucgggaccguacugaggacauguauuccuc

SEQ ID NO: 208874 - RNA, 32 nt, Human
gucgggaguaugaacuggaaagaccgaaauca

SEQ ID NO: 208875 - RNA, 32 nt, Human
gucgggaucucagaggaaauugcagugauucc

SEQ ID NO: 208876 - RNA, 32 nt, Human
gucgggaugucauguccuccaggcuggggcca

SEQ ID NO: 208877 - RNA, 19 nt, Human
gucgggcaagaaagucugg

SEQ ID NO: 208878 - RNA, 32 nt, Human
gucgggcaccaugugccugcaggaugggccgc

SEQ ID NO: 208879 - RNA, 32 nt, Human
gucgggcaggggcuggagggaggcgggggcug

SEQ ID NO: 208880 - RNA, 19 nt, Human
gucgggcaguaaagguaga

SEQ ID NO: 208881 - RNA, 32 nt, Human
gucgggcauucuuuguuguuugcacaucuuuu

SEQ ID NO: 208882 - RNA, 32 nt, Human
gucgggccagcucuccccgaaaggucuugacc

SEQ ID NO: 208883 - RNA, 32 nt, Human
gucgggccccugccugccuucuccccuccacg

SEQ ID NO: 208884 - RNA, 32 nt, Human
gucgggcccugccucccucccagcagggaaac

SEQ ID NO: 208885 - RNA, 32 nt, Human
gucgggccggcgcucccuucucugccaggugg

SEQ ID NO: 208886 - RNA, 32 nt, Human
gucgggccucugcaccuggguccauggggucu

SEQ ID NO: 208887 - RNA, 32 nt, Human
gucgggcggcggccucacagcugggggcccug

SEQ ID NO: 208888 - RNA, 32 nt, Human
gucgggcuuccaggcuggauggagugcccugg

SEQ ID NO: 208889 - RNA, 32 nt, Human
gucggggaaaggagggagugccuccaacaaau

SEQ ID NO: 208890 - RNA, 32 nt, Human
gucggggaagggggccgggugggagccgcucc

SEQ ID NO: 208891 - RNA, 32 nt, Human
gucggggacugaggcaguagagggaggcgaga

SEQ ID NO: 208892 - RNA, 32 nt, Human
gucggggagagggaccgggggucccccaguca

SEQ ID NO: 208893 - RNA, 32 nt, Human
gucggggagaggggcggacggcggcacccccu

SEQ ID NO: 208894 - RNA, 32 nt, Human
gucggggccauggacggccugaggcagcgcgu

SEQ ID NO: 208895 - RNA, 32 nt, Human
gucggggccauggcugcugccugcaccugccc

SEQ ID NO: 208896 - RNA, 32 nt, Human
gucggggccgcuggccacgcuggugguuugga

SEQ ID NO: 208897 - RNA, 32 nt, Human
gucgggggagcacaggccacagagcgcagcuc

SEQ ID NO: 208898 - RNA, 32 nt, Human
gucgggggcgggggcggcaggagcagaagcgg

SEQ ID NO: 208899 - RNA, 23 nt, Human
gucgggggguggggcggggaagu

SEQ ID NO: 208900 - RNA, 32 nt, Human
gucggggguggggugggaggagggccaccuuc

SEQ ID NO: 208901 - RNA, 32 nt, Human
gucggggucuaaggugaucagaugcagaagca

SEQ ID NO: 208902 - RNA, 32 nt, Human
gucgggguggcggccaggaggaaaggcagaaa

SEQ ID NO: 208903 - RNA, 32 nt, Human
gucggggugggggaguucucagcucuuugggu

SEQ ID NO: 208904 - RNA, 32 nt, Human
gucggguccugagaccagguccucagccagca

SEQ ID NO: 208905 - RNA, 32 nt, Human
gucgguauuuacucugaacugagggaagaaaa

SEQ ID NO: 208906 - RNA, 32 nt, Human
gucggucacccagacagcucuguggaggcagg

SEQ ID NO: 208907 - RNA, 32 nt, Human
gucggucuugagaaggcagagaucaggccacc

SEQ ID NO: 208908 - RNA, 32 nt, Human
gucggugcccgcgccccuccccgggccccgcc

SEQ ID NO: 208909 - RNA, 32 nt, Human
gucgguggaggaggggaggcggcgaggaggcg

SEQ ID NO: 208910 - RNA, 32 nt, Human
gucgguggcagguuugggggagaccggaagug

SEQ ID NO: 208911 - RNA, 32 nt, Human
gucgguggggagcagccggcugugcugucagc

SEQ ID NO: 208912 - RNA, 32 nt, Human
gucgguggggcuggccuugagaaggaacugga

SEQ ID NO: 208913 - RNA, 32 nt, Human
gucgguguaccuuacuugucaccagcuccaag

SEQ ID NO: 208914 - RNA, 32 nt, Human
gucggugucugaggguugagguugcaguccug

SEQ ID NO: 208915 - RNA, 32 nt, Human
gucgguuccgggcgguugggagcgcgcgagcu

SEQ ID NO: 208916 - RNA, 32 nt, Human
gucguacgcugcgagggcaucaacauuucugg

SEQ ID NO: 208917 - RNA, 32 nt, Human
gucguacuacccuguccagucuugagggccua

SEQ ID NO: 208918 - RNA, 32 nt, Human
gucguacuggggaggcagcuggagcagcaaga

SEQ ID NO: 208919 - RNA, 32 nt, Human
gucguaguaguggauggggaguagccguccca

SEQ ID NO: 208920 - RNA, 32 nt, Human
gucguaguuacucucaggcauggaugaauaaa

SEQ ID NO: 208921 - RNA, 32 nt, Human
gucguaugaacugugcauagucuccagagcuu

SEQ ID NO: 208922 - RNA, 32 nt, Human
gucguauucaaccacugucugccaucacugug

SEQ ID NO: 208923 - RNA, 23 nt, Human
gucgucaagaagagagugggguc

SEQ ID NO: 208924 - RNA, 32 nt, Human
gucgucaagccuguaaucccaacacuuuggga

SEQ ID NO: 208925 - RNA, 32 nt, Human
gucgucacgccuguaaucccagcacuuuagau

SEQ ID NO: 208926 - RNA, 32 nt, Human
gucgucacgccuguaaucccagcacuuuggca

SEQ ID NO: 208927 - RNA, 32 nt, Human
gucgucacgccuguaaucccagcacuuuggga

SEQ ID NO: 208928 - RNA, 32 nt, Human
gucgucacugcacagccagucaccgcggucuc

SEQ ID NO: 208929 - RNA, 32 nt, Human
gucgucacuuccugucacuaggacuacaguuu

SEQ ID NO: 208930 - RNA, 32 nt, Human
gucgucaggagguggagguugcagugagccaa

SEQ ID NO: 208931 - RNA, 32 nt, Human
gucgucaggccugugcugagagccgcagcccc

SEQ ID NO: 208932 - RNA, 32 nt, Human
gucgucauccucugcuggugugaauggcuucu

SEQ ID NO: 208933 - RNA, 25 nt, Human
gucgucaucuaugcauuagaguuga

SEQ ID NO: 208934 - RNA, 32 nt, Human
gucguccacaugcuugucagccccacgcugug

SEQ ID NO: 208935 - RNA, 22 nt, Human
gucguccaggcuggagugcagu

SEQ ID NO: 208936 - RNA, 32 nt, Human
gucguccaggcuggagugcaguacgcaaucuu

SEQ ID NO: 208937 - RNA, 23 nt, Human
gucguccaggcuggagugcagug

SEQ ID NO: 208938 - RNA, 24 nt, Human
gucguccaggcuggagugcagugg

SEQ ID NO: 208939 - RNA, 24 nt, Human
gucguccagguuagagugcaaugg

SEQ ID NO: 208940 - RNA, 32 nt, Human
gucguccccugcugagaggccaugugagacca

SEQ ID NO: 208941 - RNA, 32 nt, Human
gucguccuggacaccacaggggcaccugcagg

SEQ ID NO: 208942 - RNA, 32 nt, Human
gucguccuugcccaaggcagagcuguuccagc

SEQ ID NO: 208943 - RNA, 32 nt, Human
gucgucucucaguucuugagguauauuauuuu

SEQ ID NO: 208944 - RNA, 32 nt, Human
gucgucuucugcugcugacccccaucaaaucc

SEQ ID NO: 208945 - RNA, 32 nt, Human
gucgucuuggcuccaccucuguccucucucua

SEQ ID NO: 208946 - RNA, 32 nt, Human
gucgugaacaugaaaguacuucucaugugucc

SEQ ID NO: 208947 - RNA, 32 nt, Human
gucgugaacuccuggcuucaagcaguccuccu

SEQ ID NO: 208948 - RNA, 32 nt, Human
gucgugaccugcuaggccagagcccacuccau

SEQ ID NO: 208949 - RNA, 32 nt, Human
gucgugacugcugaugggcaugagggaucauc

SEQ ID NO: 208950 - RNA, 32 nt, Human
gucgugcaccuugcgugugucccauucagcac

SEQ ID NO: 208951 - RNA, 32 nt, Human
gucgugccacugcacuccagccugggcaacag

SEQ ID NO: 208952 - RNA, 32 nt, Human
gucgugccacugcacuccagccugggcagcag

SEQ ID NO: 208953 - RNA, 32 nt, Human
gucgugccacugcacuccagccugggcgacag

SEQ ID NO: 208954 - RNA, 32 nt, Human
gucgugccacugcacuucagccugggugacag

SEQ ID NO: 208955 - RNA, 32 nt, Human
gucgugccacugcaugccagccugggcaacaa

SEQ ID NO: 208956 - RNA, 32 nt, Human
gucgugccacugcgcuccagccugggugacag

SEQ ID NO: 208957 - RNA, 32 nt, Human
gucgugccauugcacuccagccugggugacag

SEQ ID NO: 208958 - RNA, 32 nt, Human
gucgugcccuagccaaggagaaguuucaguca

SEQ ID NO: 208959 - RNA, 32 nt, Human
gucgugcccuggaaggugagcgcggccgagcu

SEQ ID NO: 208960 - RNA, 32 nt, Human
gucgugcgcuggcugcugcuuuucugcuccug

SEQ ID NO: 208961 - RNA, 32 nt, Human
gucgugcgugaagcaucucucuucuaaaggau

SEQ ID NO: 208962 - RNA, 32 nt, Human
gucgugcuacugcacucccgccugggugacag

SEQ ID NO: 208963 - RNA, 32 nt, Human
gucgugcugcugcuggaagccaacagccuccg

SEQ ID NO: 208964 - RNA, 32 nt, Human
gucgugcuugcuugaagugcagccuuggauac

SEQ ID NO: 208965 - RNA, 32 nt, Human
gucguggauggggaggggugggcagaguaguu

SEQ ID NO: 208966 - RNA, 21 nt, Human
gucguggcgagaggggcgggg

SEQ ID NO: 208967 - RNA, 32 nt, Human
gucguggcgcccaucccuccccuguucugcug

SEQ ID NO: 208968 - RNA, 23 nt, Human
gucguggcgucgggcuuccggag

SEQ ID NO: 208969 - RNA, 32 nt, Human
gucguggcucacugcagccuccaccuccuggg

SEQ ID NO: 208970 - RNA, 32 nt, Human
gucguggcuccccucaucagcuccccacacca

SEQ ID NO: 208971 - RNA, 32 nt, Human
gucguggcuguguuggguggggccacaucagg

SEQ ID NO: 208972 - RNA, 24 nt, Human
gucguggugcugcuguccgcggag

SEQ ID NO: 208973 - RNA, 32 nt, Human
gucgugguugcagaaggagcaauuaggcugcc

SEQ ID NO: 208974 - RNA, 32 nt, Human
gucguguaccuucuccaccugcccccaggaaa

SEQ ID NO: 208975 - RNA, 32 nt, Human
gucguguaguccuuucugccuccaggagcggc

SEQ ID NO: 208976 - RNA, 32 nt, Human
gucguguccagccugacgccuacuggggcagg

SEQ ID NO: 208977 - RNA, 32 nt, Human
gucgugucuggaaugucagggaaggggagggc

SEQ ID NO: 208978 - RNA, 32 nt, Human
gucgugucugggaguuucucccagagaaacca

SEQ ID NO: 208979 - RNA, 32 nt, Human
gucgugucuuuuaaaaacuccuguuuucacac

SEQ ID NO: 208980 - RNA, 32 nt, Human
gucgugugcacucccaccccagccuuuuggua

SEQ ID NO: 208981 - RNA, 32 nt, Human
gucguguuccugcagugggcacccuaggcgua

SEQ ID NO: 208982 - RNA, 32 nt, Human
gucguguugaacugugucugugucagugcacu

SEQ ID NO: 208983 - RNA, 32 nt, Human
gucguguugacuccauaugaaaggacacagcu

SEQ ID NO: 208984 - RNA, 32 nt, Human
gucguguuguuacugucucaaguggaagcgcc

SEQ ID NO: 208985 - RNA, 32 nt, Human
gucguguuuucaggagcucaaggcuggagugu

SEQ ID NO: 208986 - RNA, 32 nt, Human
gucguuaaaaacaaccaaaaucccgaaacuau

SEQ ID NO: 208987 - RNA, 32 nt, Human
gucguucacgcuccugagcagagccuuccggu

SEQ ID NO: 208988 - RNA, 32 nt, Human
gucguucucugagccccaccucagcaggucuc

SEQ ID NO: 208989 - RNA, 32 nt, Human
gucguucuggggaggccuggccuagcagccac

SEQ ID NO: 208990 - RNA, 32 nt, Human
gucguugccaucucguccucaguggcuucccg

SEQ ID NO: 208991 - RNA, 32 nt, Human
gucguuggacugcacuugccucuccaugugau

SEQ ID NO: 208992 - RNA, 32 nt, Human
gucguuggguagugaagaagagaguggaaagg

SEQ ID NO: 208993 - RNA, 32 nt, Human
gucguuguugagauggaaucuagcucugucac

SEQ ID NO: 208994 - RNA, 32 nt, Human
gucguuguuguuguuuuucuggaaacugcuug

SEQ ID NO: 208995 - RNA, 32 nt, Human
gucguuuaugucaucccuucuucuccagacag

SEQ ID NO: 208996 - RNA, 32 nt, Human
gucguuucuacucaucccuuaacuucucccuu

SEQ ID NO: 208997 - RNA, 32 nt, Human
gucguuuugaaaccaaaaagauaaaaacugca

SEQ ID NO: 208998 - RNA, 32 nt, Human
gucguuuuuguuccaagaaugauaugaaaggu

SEQ ID NO: 208999 - RNA, 32 nt, Human
gucuaaaaauaacauacgcacucaacuuccuu

SEQ ID NO: 209000 - RNA, 32 nt, Human
gucuaaaacacugaaaacuguguccaauaucg

SEQ ID NO: 209001 - RNA, 32 nt, Human
gucuaaaacguacagucugaggcuggggcggg

SEQ ID NO: 209002 - RNA, 32 nt, Human
gucuaaaaguucuguguggcacacagagaugc

SEQ ID NO: 209003 - RNA, 32 nt, Human
gucuaaaccaagauuaugugacuugcaauaaa

SEQ ID NO: 209004 - RNA, 32 nt, Human
gucuaaacuguaucugccucugugccugugca

SEQ ID NO: 209005 - RNA, 32 nt, Human
gucuaaagaaaauuauuugcugaguccucaua

SEQ ID NO: 209006 - RNA, 32 nt, Human
gucuaaagaagaggugagagcaaaaggaauaa

SEQ ID NO: 209007 - RNA, 32 nt, Human
gucuaaagagcugaggaaucuaaacgagaaaa

SEQ ID NO: 209008 - RNA, 32 nt, Human
gucuaaagaguauuugaagcagugaugcaggc

SEQ ID NO: 209009 - RNA, 22 nt, Human
gucuaaagcuguguccugaaua

SEQ ID NO: 209010 - RNA, 32 nt, Human
gucuaaagucaguauaaagaccugugucucuc

SEQ ID NO: 209011 - RNA, 24 nt, Human
gucuaaagucuagggaaaagggaa

SEQ ID NO: 209012 - RNA, 32 nt, Human
gucuaaaguggaacugaauaguagcugugaga

SEQ ID NO: 209013 - RNA, 32 nt, Human
gucuaaagugugagccacugagaagagagacg

SEQ ID NO: 209014 - RNA, 32 nt, Human
gucuaaaugaggagcuugauuucuugaucaca

SEQ ID NO: 209015 - RNA, 32 nt, Human
gucuaacacggugaaaccccaucucuacuaaa

SEQ ID NO: 209016 - RNA, 32 nt, Human
gucuaacacuccugggagcucaggaggcuucu

SEQ ID NO: 209017 - RNA, 32 nt, Human
gucuaaccccuucacugauucccaacacucac

SEQ ID NO: 209018 - RNA, 32 nt, Human
gucuaaccuccuggagggacagucuauacgug

SEQ ID NO: 209019 - RNA, 32 nt, Human
gucuaaccugcucuuucucuuuggugccccuu

SEQ ID NO: 209020 - RNA, 32 nt, Human
gucuaaccuggcauuaugcacacacuuugagu

SEQ ID NO: 209021 - RNA, 32 nt, Human
gucuaacgcugacagaaaugaaugcagaagga

SEQ ID NO: 209022 - RNA, 32 nt, Human
gucuaacuccaguuuuucacaaggucaucuuc

SEQ ID NO: 209023 - RNA, 32 nt, Human
gucuaacuccugggcgugcuuuaagcucagcu

SEQ ID NO: 209024 - RNA, 32 nt, Human
gucuaagaaggugggggugagcaggggguuua

SEQ ID NO: 209025 - RNA, 32 nt, Human
gucuaagccuucccuccugggcuagggaguaa

SEQ ID NO: 209026 - RNA, 32 nt, Human
gucuaaggcuggggugaauggaagggcccacc

SEQ ID NO: 209027 - RNA, 32 nt, Human
gucuaagguggcugcuucuuccccagccauga

SEQ ID NO: 209028 - RNA, 32 nt, Human
gucuaagugugcugcauggagugagcaguaga

SEQ ID NO: 209029 - RNA, 32 nt, Human
gucuaauaaaaauacaaaaauuagccgggcgu

SEQ ID NO: 209030 - RNA, 32 nt, Human
gucuaauauuagacauacaaguugcugccugu

SEQ ID NO: 209031 - RNA, 18 nt, Human
gucuaaucccagcacuuu

SEQ ID NO: 209032 - RNA, 20 nt, Human
gucuaauccuauuccuuccc

SEQ ID NO: 209033 - RNA, 32 nt, Human
gucuaaugcaugugauuuaauguauguuuaau

SEQ ID NO: 209034 - RNA, 32 nt, Human
gucuaauggguauuuaaacaauaaaugugcag

SEQ ID NO: 209035 - RNA, 32 nt, Human
gucuaaugugagaugaccuugauuugaagugu

SEQ ID NO: 209036 - RNA, 32 nt, Human
gucuaauuaaacugagcaauacuuuugugaau

SEQ ID NO: 209037 - RNA, 32 nt, Human
gucuaauuuauucaaagggggcaagaaguagc

SEQ ID NO: 209038 - RNA, 32 nt, Human
gucuacaaggaaaugggagguggaggguugua

SEQ ID NO: 209039 - RNA, 19 nt, Human
gucuacaauaaaacuuuaa

SEQ ID NO: 209040 - RNA, 32 nt, Human
gucuacacucacaaucaucuucucccaagacu

SEQ ID NO: 209041 - RNA, 32 nt, Human
gucuacacugaacucauguucugaugagaaua

SEQ ID NO: 209042 - RNA, 19 nt, Human
gucuacagacugguuucua

SEQ ID NO: 209043 - RNA, 32 nt, Human
gucuacagagucagggacagaagggaagggac

SEQ ID NO: 209044 - RNA, 18 nt, Human
gucuacagcacggguucu

SEQ ID NO: 209045 - RNA, 20 nt, Human
gucuacagcaucagcuucug

SEQ ID NO: 209046 - RNA, 20 nt, Human
gucuacagccaacuauucua

SEQ ID NO: 209047 - RNA, 32 nt, Human
gucuacaggcuggaagaaggcccucaccagaa

SEQ ID NO: 209048 - RNA, 32 nt, Human
gucuacaguaaguggcugauugcaguggugga

SEQ ID NO: 209049 - RNA, 22 nt, Human
gucuacaguuaucauuauuuua

SEQ ID NO: 209050 - RNA, 32 nt, Human
gucuacaucagccugggcugcagcgcgcugcc

SEQ ID NO: 209051 - RNA, 32 nt, Human
gucuaccacagaggccagacgcaguguggggg

SEQ ID NO: 209052 - RNA, 32 nt, Human
gucuaccagaugaggaaauggcaguucugaga

SEQ ID NO: 209053 - RNA, 32 nt, Human
gucuaccagugaccucagggcacuuugggcuu

SEQ ID NO: 209054 - RNA, 32 nt, Human
gucuacccaagacccacccgccucagcccagc

SEQ ID NO: 209055 - RNA, 32 nt, Human
gucuaccccaacacaaaggugcuucuccauaa

SEQ ID NO: 209056 - RNA, 32 nt, Human
gucuaccccucuccuuucacuccuuuccuccc

SEQ ID NO: 209057 - RNA, 32 nt, Human
gucuacccuaauggaucccuguuuauuggauc

SEQ ID NO: 209058 - RNA, 32 nt, Human
gucuaccuagaaccuaugggaaagcugcaaga

SEQ ID NO: 209059 - RNA, 32 nt, Human
gucuaccucccaaagugcugggauuacagucg

SEQ ID NO: 209060 - RNA, 28 nt, Human
gucuaccucccuuccuccucugcucacc

SEQ ID NO: 209061 - RNA, 32 nt, Human
gucuaccugagaucuauauggagcuuaaagga

SEQ ID NO: 209062 - RNA, 32 nt, Human
gucuaccugcauucauaauuccaggaucugug

SEQ ID NO: 209063 - RNA, 32 nt, Human
gucuaccuuuagccaggcacaggacagcccua

SEQ ID NO: 209064 - RNA, 17 nt, Human
gucuacggcagcuauuc

SEQ ID NO: 209065 - RNA, 32 nt, Human
gucuacgugcuaaggcaagacaggaaguaguu

SEQ ID NO: 209066 - RNA, 32 nt, Human
gucuacuaaaaauacaaaaauuaacugggcuu

SEQ ID NO: 209067 - RNA, 32 nt, Human
gucuacuaaaaauacaaaaauuagccaggcau

SEQ ID NO: 209068 - RNA, 32 nt, Human
gucuacuaaaaauacaaaaauuagccgggcau

SEQ ID NO: 209069 - RNA, 32 nt, Human
gucuacuaaaaauacaaaaauuagcugggcau

SEQ ID NO: 209070 - RNA, 32 nt, Human
gucuacuaaaaauacaaaauuagcugggcgug

SEQ ID NO: 209071 - RNA, 32 nt, Human
gucuacuaugugaauacuugaccauggagguc

SEQ ID NO: 209072 - RNA, 32 nt, Human
gucuacucagugccuggugaagccacccucag

SEQ ID NO: 209073 - RNA, 32 nt, Human
gucuacucugauugauugucaugggcacccac

SEQ ID NO: 209074 - RNA, 32 nt, Human
gucuacugcucaggcucucccacuucguggca

SEQ ID NO: 209075 - RNA, 32 nt, Human
gucuacugugggaacaguuaucccuaaccaca

SEQ ID NO: 209076 - RNA, 19 nt, Human
gucuacuuagauuguucua

SEQ ID NO: 209077 - RNA, 32 nt, Human
gucuacuucaguuccuuaagacugucugguca

SEQ ID NO: 209078 - RNA, 32 nt, Human
gucuacuucauuucugucacggguaggacagu

SEQ ID NO: 209079 - RNA, 32 nt, Human
gucuacuuggggagacagaaaagggaagagau

SEQ ID NO: 209080 - RNA, 32 nt, Human
gucuagaaaguaaaauaaagaggaauguuacc

SEQ ID NO: 209081 - RNA, 32 nt, Human
gucuagaacuccuggguucaaguaauccuccc

SEQ ID NO: 209082 - RNA, 32 nt, Human
gucuagaacuucuggucucaagcaaucugccc

SEQ ID NO: 209083 - RNA, 32 nt, Human
gucuagaauagggagguggagaaugaugacuu

SEQ ID NO: 209084 - RNA, 32 nt, Human
gucuagagccauaucugaaauauugcuaagca

SEQ ID NO: 209085 - RNA, 32 nt, Human
gucuagaguagggauuggcuguccuuaaguca

SEQ ID NO: 209086 - RNA, 32 nt, Human
gucuagauguuuuucuucaccugggccaugga

SEQ ID NO: 209087 - RNA, 32 nt, Human
gucuagcaaaugucccuucuguauguaaaaag

SEQ ID NO: 209088 - RNA, 32 nt, Human
gucuagcacacagcacuugagccagcaaaucc

SEQ ID NO: 209089 - RNA, 32 nt, Human
gucuagcacacagcacuugggccagcaaaucc

SEQ ID NO: 209090 - RNA, 32 nt, Human
gucuagcacccccauccccuuggcccuuccuc

SEQ ID NO: 209091 - RNA, 32 nt, Human
gucuagccaagguccaagaaguagcaagcugg

SEQ ID NO: 209092 - RNA, 32 nt, Human
gucuagccauugcccccugccugcugcuccug

SEQ ID NO: 209093 - RNA, 32 nt, Human
gucuagcccuuggguguggaaguccugaacac

SEQ ID NO: 209094 - RNA, 32 nt, Human
gucuagccucuuccucccucccucaugaugaa

SEQ ID NO: 209095 - RNA, 32 nt, Human
gucuagccuuuuccuccacgacauuccuugac

SEQ ID NO: 209096 - RNA, 32 nt, Human
gucuagcgaggaugcugaaggaagggagguau

SEQ ID NO: 209097 - RNA, 32 nt, Human
gucuagcuagaccugcacuguccaguacagua

SEQ ID NO: 209098 - RNA, 20 nt, Human
gucuaggaaaagaaguuuca

SEQ ID NO: 209099 - RNA, 32 nt, Human
gucuaggaagagggucugcagagcagaaagca

SEQ ID NO: 209100 - RNA, 32 nt, Human
gucuaggaccagccuggacaacauggugagac

SEQ ID NO: 209101 - RNA, 32 nt, Human
gucuaggagagggacagagugggaaggagagg

SEQ ID NO: 209102 - RNA, 32 nt, Human
gucuaggagccagccccacccuuagaaaagau

SEQ ID NO: 209103 - RNA, 32 nt, Human
gucuaggaggagagaagggagcaggaauccuc

SEQ ID NO: 209104 - RNA, 32 nt, Human
gucuaggaggucgaggcuucagugagcgguga

SEQ ID NO: 209105 - RNA, 21 nt, Human
gucuaggccucaggggcuccc

SEQ ID NO: 209106 - RNA, 32 nt, Human
gucuaggcugagcaacaugaaggggcccccaa

SEQ ID NO: 209107 - RNA, 21 nt, Human
gucuaggcuggagugccgugg

SEQ ID NO: 209108 - RNA, 32 nt, Human
gucuaggcuggguucaugacaugauucaugag

SEQ ID NO: 209109 - RNA, 32 nt, Human
gucuagggcagaagaucgagagagggcaggcc

SEQ ID NO: 209110 - RNA, 32 nt, Human
gucuaggggagagagucccugagugugagacc

SEQ ID NO: 209111 - RNA, 32 nt, Human
gucuaggggccagcuggucuccuggcaacuga

SEQ ID NO: 209112 - RNA, 32 nt, Human
gucuaggguucuguauaugaagcugccagucu

SEQ ID NO: 209113 - RNA, 32 nt, Human
gucuaggucuucucccugccaugucccuugcc

SEQ ID NO: 209114 - RNA, 32 nt, Human
gucuagucacugagagacagaggcagcaucug

SEQ ID NO: 209115 - RNA, 32 nt, Human
gucuaguccuccccuccaagagcauuaacuau

SEQ ID NO: 209116 - RNA, 32 nt, Human
gucuagucucgaacuccugaccuugugauccg

SEQ ID NO: 209117 - RNA, 32 nt, Human
gucuagucuugaacuccugggcuacaguuacc

SEQ ID NO: 209118 - RNA, 31 nt, Human
gucuagugaaggagagaaaacuguaauaaca

SEQ ID NO: 209119 - RNA, 32 nt, Human
gucuaguuuucauuaaaagaacaaagaucuuu

SEQ ID NO: 209120 - RNA, 32 nt, Human
gucuauaagcagacucaaucuucuugcagagg

SEQ ID NO: 209121 - RNA, 32 nt, Human
gucuauaauaaacucaccauugugcaccaucc

SEQ ID NO: 209122 - RNA, 32 nt, Human
gucuauaauaaauauguaagauacaaagaaca

SEQ ID NO: 209123 - RNA, 32 nt, Human
gucuauacgcaaaccacacaccugccaaggag

SEQ ID NO: 209124 - RNA, 21 nt, Human
gucuauacuaaaaauacaaaa

SEQ ID NO: 209125 - RNA, 20 nt, Human
gucuauaguauauuauacua

SEQ ID NO: 209126 - RNA, 32 nt, Human
gucuauauaagggaaugucuuccuuccuaucu

SEQ ID NO: 209127 - RNA, 32 nt, Human
gucuauaugcugggugcugagacacugauccc

SEQ ID NO: 209128 - RNA, 32 nt, Human
gucuauauuuucaaaugucuuuucauuuucua

SEQ ID NO: 209129 - RNA, 32 nt, Human
gucuaucaaauaaaaagaauaguaccugccca

SEQ ID NO: 209130 - RNA, 32 nt, Human
gucuaucaaauuugcccccuggcuuuauuacu

SEQ ID NO: 209131 - RNA, 32 nt, Human
gucuaucaacugaacaugaaauggagcaggcc

SEQ ID NO: 209132 - RNA, 32 nt, Human
gucuaucccggucucuggucucuuguccagcg

SEQ ID NO: 209133 - RNA, 32 nt, Human
gucuauccgguugcauccucccucccuguucc

SEQ ID NO: 209134 - RNA, 32 nt, Human
gucuauccucaaguugcuacgguucagugaga

SEQ ID NO: 209135 - RNA, 32 nt, Human
gucuauccucauccuacgccucccugggggcu

SEQ ID NO: 209136 - RNA, 32 nt, Human
gucuaucuccucugucacuucucccccuucau

SEQ ID NO: 209137 - RNA, 32 nt, Human
gucuaucuggcuggcagggaaggaaagaacuu

SEQ ID NO: 209138 - RNA, 32 nt, Human
gucuaugagugagggaugcagagccagggaag

SEQ ID NO: 209139 - RNA, 32 nt, Human
gucuaugauucugcucuccacguccaggugua

SEQ ID NO: 209140 - RNA, 32 nt, Human
gucuaugccuagggaaacucaggcuucuaguu

SEQ ID NO: 209141 - RNA, 20 nt, Human
gucuauggcaccucccuccc

SEQ ID NO: 209142 - RNA, 32 nt, Human
gucuauggcccccagccccagccucuggaaaa

SEQ ID NO: 209143 - RNA, 32 nt, Human
gucuauguacaguguuugcugcggguguguuc

SEQ ID NO: 209144 - RNA, 32 nt, Human
gucuaugucaacagaguuguuaucucauagag

SEQ ID NO: 209145 - RNA, 32 nt, Human
gucuauguccagagaagcugagauauggcaua

SEQ ID NO: 209146 - RNA, 32 nt, Human
gucuaugucccagcugacauucagucaaaugu

SEQ ID NO: 209147 - RNA, 32 nt, Human
gucuaugugauccucagagauuggaggccagg

SEQ ID NO: 209148 - RNA, 32 nt, Human
gucuaugugggagaaaagccauauaaugugag

SEQ ID NO: 209149 - RNA, 32 nt, Human
gucuaugugugcugggggaugucaggugccac

SEQ ID NO: 209150 - RNA, 32 nt, Human
gucuauuaaaaauacaaaaauuagcuggcugu

SEQ ID NO: 209151 - RNA, 32 nt, Human
gucuauuauuauauacauaucucuacgcugca

SEQ ID NO: 209152 - RNA, 32 nt, Human
gucuauucccucuuuuccccagccucuggcaa

SEQ ID NO: 209153 - RNA, 32 nt, Human
gucuauugcccaggcuggagugcaguggugcg

SEQ ID NO: 209154 - RNA, 24 nt, Human
gucuauuggggugggaaggggagu

SEQ ID NO: 209155 - RNA, 20 nt, Human
gucuauuguuuguuguucua

SEQ ID NO: 209156 - RNA, 32 nt, Human
gucuauuuaaaauguacugaggcacaacaagu

SEQ ID NO: 209157 - RNA, 32 nt, Human
gucuauuucaauauagaacuguucagcaaaaa

SEQ ID NO: 209158 - RNA, 32 nt, Human
gucuauuugaaauaugcaaaagguaugaggaa

SEQ ID NO: 209159 - RNA, 32 nt, Human
gucuauuugagacuccucaguucuugccacuu

SEQ ID NO: 209160 - RNA, 32 nt, Human
gucuauuugucccuaacaacugucuuugacag

SEQ ID NO: 209161 - RNA, 32 nt, Human
gucuauuuucaaaucagguauccugaagagua

SEQ ID NO: 209162 - RNA, 25 nt, Human
gucucaaaaaaggcuggaguacagu

SEQ ID NO: 209163 - RNA, 32 nt, Human
gucucaaaaagaaagaaagaaagaaagaaaga

SEQ ID NO: 209164 - RNA, 19 nt, Human
gucucaaaaauacaaaaua

SEQ ID NO: 209165 - RNA, 32 nt, Human
gucucaaaaugacccacccagcuagagcacug

SEQ ID NO: 209166 - RNA, 25 nt, Human
gucucaaaccuguggggaaggaggu

SEQ ID NO: 209167 - RNA, 32 nt, Human
gucucaaacuccucgguucaagcaauucgccc

SEQ ID NO: 209168 - RNA, 23 nt, Human
gucucaaacuccugaccuaguga

SEQ ID NO: 209169 - RNA, 32 nt, Human
gucucaaacuccugaccucaagcaauuugccc

SEQ ID NO: 209170 - RNA, 23 nt, Human
gucucaaacuccugaccucguga

SEQ ID NO: 209171 - RNA, 32 nt, Human
gucucaaacuccuggacucaagcaauccuccc

SEQ ID NO: 209172 - RNA, 32 nt, Human
gucucaaacuccuggacucaagcaaucugccc

SEQ ID NO: 209173 - RNA, 32 nt, Human
gucucaaacuccuggccucaagcaauccucac

SEQ ID NO: 209174 - RNA, 32 nt, Human
gucucaaacuccuggccucaagcaauccuccc

SEQ ID NO: 209175 - RNA, 32 nt, Human
gucucaaacuccuggccucaagcaauucuccc

SEQ ID NO: 209176 - RNA, 32 nt, Human
gucucaaacuccuggcuucaagcaauccuucc

SEQ ID NO: 209177 - RNA, 32 nt, Human
gucucaaacuccugggcacaagcaauccaccu

SEQ ID NO: 209178 - RNA, 32 nt, Human
gucucaaacuccugggcucaagcaauccaccc

SEQ ID NO: 209179 - RNA, 32 nt, Human
gucucaaacuccugggcucaagcaauccuccc

SEQ ID NO: 209180 - RNA, 32 nt, Human
gucucaaacuccugggcucaagcaauccuccu

SEQ ID NO: 209181 - RNA, 32 nt, Human
gucucaaacuccugggcucaagcaauguauug

SEQ ID NO: 209182 - RNA, 32 nt, Human
gucucaaacuccuggguucaagcaauccuccc

SEQ ID NO: 209183 - RNA, 32 nt, Human
gucucaaacuccuggguucaagcaguccuccc

SEQ ID NO: 209184 - RNA, 32 nt, Human
gucucaaacuccuggguucaagugaucauucc

SEQ ID NO: 209185 - RNA, 20 nt, Human
gucucaaacuccugugcuca

SEQ ID NO: 209186 - RNA, 21 nt, Human
gucucaaacuucugggcucaa

SEQ ID NO: 209187 - RNA, 32 nt, Human
gucucaaacuucugggcucaagcaauucaucu

SEQ ID NO: 209188 - RNA, 23 nt, Human
gucucaaaggagaaagugaggug

SEQ ID NO: 209189 - RNA, 32 nt, Human
gucucaaaggagaaagugagguggccugacac

SEQ ID NO: 209190 - RNA, 32 nt, Human
gucucaaagugcugggauuacagguaugagcc

SEQ ID NO: 209191 - RNA, 21 nt, Human
gucucaaccuccugggcucaa

SEQ ID NO: 209192 - RNA, 32 nt, Human
gucucaaccuccugggcucaagcaauccuccu

SEQ ID NO: 209193 - RNA, 32 nt, Human
gucucaacuacucagcucuccugcugcagcau

SEQ ID NO: 209194 - RNA, 32 nt, Human
gucucaacuauugccauuuccucauguauuau

SEQ ID NO: 209195 - RNA, 32 nt, Human
gucucaacucacugcaaccccugcucucaggu

SEQ ID NO: 209196 - RNA, 20 nt, Human
gucucaacuccugggcucaa

SEQ ID NO: 209197 - RNA, 32 nt, Human
gucucaagaggaauccuggaggcuuggucccc

SEQ ID NO: 209198 - RNA, 32 nt, Human
gucucaagauuuucuuaauuuaguucgcuguu

SEQ ID NO: 209199 - RNA, 24 nt, Human
gucucaagcaguccucccaccuca

SEQ ID NO: 209200 - RNA, 32 nt, Human
gucucaagccuauaaucccagcacuuugggag

SEQ ID NO: 209201 - RNA, 32 nt, Human
gucucaagccuguaauccuagcacuuugggag

SEQ ID NO: 209202 - RNA, 32 nt, Human
gucucaagcuccugggcucaagcaaucugcuu

SEQ ID NO: 209203 - RNA, 32 nt, Human
gucucaaggagagcaggguaggugaaagucua

SEQ ID NO: 209204 - RNA, 32 nt, Human
gucucaaggaggcagguggcagaugaaaacca

SEQ ID NO: 209205 - RNA, 32 nt, Human
gucucaaggugccuccuccucuccuuagcugg

SEQ ID NO: 209206 - RNA, 32 nt, Human
gucucaaguacaacagugguggcuugcccagu

SEQ ID NO: 209207 - RNA, 32 nt, Human
gucucaagugcuucaagagucuggcuccugcu

SEQ ID NO: 209208 - RNA, 24 nt, Human
gucucaaucccaggcuccucuuga

SEQ ID NO: 209209 - RNA, 21 nt, Human
gucucaaucucaacgcuguga

SEQ ID NO: 209210 - RNA, 32 nt, Human
gucucaaucucaccuaaaugaaucaggucugc

SEQ ID NO: 209211 - RNA, 32 nt, Human
gucucaauggcuucgggaaacacacauauaca

SEQ ID NO: 209212 - RNA, 32 nt, Human
gucucaauucuuuguauaugcauucuuuucag

SEQ ID NO: 209213 - RNA, 32 nt, Human
gucucacaccuguaaucccagcacuuugagag

SEQ ID NO: 209214 - RNA, 32 nt, Human
gucucacaccuguaaucccagcacuuugggag

SEQ ID NO: 209215 - RNA, 32 nt, Human
gucucacaccuguaaucccagcacuuugggug

SEQ ID NO: 209216 - RNA, 32 nt, Human
gucucacacguuuaaucccagcacuuugggag

SEQ ID NO: 209217 - RNA, 32 nt, Human
gucucacagcagaggaaaggacagggaaaaag

SEQ ID NO: 209218 - RNA, 32 nt, Human
gucucacagcccaugcugaauuuucugcauuu

SEQ ID NO: 209219 - RNA, 31 nt, Human
gucucacauaacccuuuacauugugaaauaa

SEQ ID NO: 209220 - RNA, 32 nt, Human
gucucacaucucuaaaccucagugcugagacc

SEQ ID NO: 209221 - RNA, 32 nt, Human
gucucaccagcuugccuucugcucuggacuaa

SEQ ID NO: 209222 - RNA, 32 nt, Human
gucucaccaggacccauaccuuucaccuuguu

SEQ ID NO: 209223 - RNA, 32 nt, Human
gucucaccaugaggcaggagaaucacuugaac

SEQ ID NO: 209224 - RNA, 32 nt, Human
gucucacccacagaugucuguagucggucggu

SEQ ID NO: 209225 - RNA, 32 nt, Human
gucucacccaggcuggagugcaguggcacgau

SEQ ID NO: 209226 - RNA, 32 nt, Human
gucucacccauuaucuggaauauugugauucu

SEQ ID NO: 209227 - RNA, 32 nt, Human
gucucaccccgagcugaccccucugccugggc

SEQ ID NO: 209228 - RNA, 32 nt, Human
gucucacccucuucaaccuccucccuucuucu

SEQ ID NO: 209229 - RNA, 32 nt, Human
gucucaccuaucuccugguucgaucuaggaaa

SEQ ID NO: 209230 - RNA, 32 nt, Human
gucucaccucacugcaaccuccaccuccuagg

SEQ ID NO: 209231 - RNA, 32 nt, Human
gucucaccucauugcaaccuccgccucccggg

SEQ ID NO: 209232 - RNA, 32 nt, Human
gucucaccuccaccggcauccacacaaaacca

SEQ ID NO: 209233 - RNA, 32 nt, Human
gucucaccugucgcuggagugcagugguguga

SEQ ID NO: 209234 - RNA, 32 nt, Human
gucucacgccugugaucccagcacuuugggag

SEQ ID NO: 209235 - RNA, 32 nt, Human
gucucacuaagauugccuagggcugcuuuauu

SEQ ID NO: 209236 - RNA, 32 nt, Human
gucucacuauguugucuggagugcuguggugg

SEQ ID NO: 209237 - RNA, 32 nt, Human
gucucacucccagggaccuuuuuggucaugga

SEQ ID NO: 209238 - RNA, 32 nt, Human
gucucacuccuguaauaccagcacuuugggag

SEQ ID NO: 209239 - RNA, 32 nt, Human
gucucacucucucucuuucucucccucuccua

SEQ ID NO: 209240 - RNA, 32 nt, Human
gucucacucugucacccagacuggagugcagu

SEQ ID NO: 209241 - RNA, 32 nt, Human
gucucacucugucacccaggauggagagcacu

SEQ ID NO: 209242 - RNA, 32 nt, Human
gucucacucugucacccaggcugcagugcaau

SEQ ID NO: 209243 - RNA, 32 nt, Human
gucucacucugucacccaggcugcaguguagu

SEQ ID NO: 209244 - RNA, 32 nt, Human
gucucacucugucacccaggcugcaguucacu

SEQ ID NO: 209245 - RNA, 32 nt, Human
gucucacucugucacccaggcuggagagcaau

SEQ ID NO: 209246 - RNA, 32 nt, Human
gucucacucugucacucuguugcccaggcugg

SEQ ID NO: 209247 - RNA, 32 nt, Human
gucucacucuguugcccagucuggagugcagu

SEQ ID NO: 209248 - RNA, 32 nt, Human
gucucacugcaaccuccgccucccagauucaa

SEQ ID NO: 209249 - RNA, 32 nt, Human
gucucacugcaaccucuaccucccagguucaa

SEQ ID NO: 209250 - RNA, 32 nt, Human
gucucacugcaaccucugccucccggguucaa

SEQ ID NO: 209251 - RNA, 32 nt, Human
gucucacugcaaccucugccuccuggguucag

SEQ ID NO: 209252 - RNA, 32 nt, Human
gucucacugcagccucaaccuccuggguucaa

SEQ ID NO: 209253 - RNA, 32 nt, Human
gucucacugcgcccucuccuccaaccuccccu

SEQ ID NO: 209254 - RNA, 32 nt, Human
gucucacuggaaggcagugaggagagcugagg

SEQ ID NO: 209255 - RNA, 32 nt, Human
gucucacugggcgacagagccagauucugucu

SEQ ID NO: 209256 - RNA, 32 nt, Human
gucucacugggcugaaaucaagguguuaacag

SEQ ID NO: 209257 - RNA, 32 nt, Human
gucucacugucacccaggccggagugcagugg

SEQ ID NO: 209258 - RNA, 32 nt, Human
gucucacugucacccaggcugaacugcagugg

SEQ ID NO: 209259 - RNA, 32 nt, Human
gucucacugucacccaggcuggagugcagugg

SEQ ID NO: 209260 - RNA, 32 nt, Human
gucucacugucgcccaggcuggagugcagugg

SEQ ID NO: 209261 - RNA, 32 nt, Human
gucucacugucgcccaggcuggagugcggugg

SEQ ID NO: 209262 - RNA, 32 nt, Human
gucucacuguguugcccagccugggugucaau

SEQ ID NO: 209263 - RNA, 32 nt, Human
gucucacuguugcccaggcuggagugcagugg

SEQ ID NO: 209264 - RNA, 32 nt, Human
gucucacuguugcccaggcuggagugcauuga

SEQ ID NO: 209265 - RNA, 32 nt, Human
gucucacuguugcccaggcuggcgugcagugg

SEQ ID NO: 209266 - RNA, 21 nt, Human
gucucagaaccgagugaggug

SEQ ID NO: 209267 - RNA, 32 nt, Human
gucucagacagugucuucccagaaaaccacca

SEQ ID NO: 209268 - RNA, 32 nt, Human
gucucagagaaccgcaucacuucauuugcuca

SEQ ID NO: 209269 - RNA, 32 nt, Human
gucucagagcacagagguaggagaacuggggu

SEQ ID NO: 209270 - RNA, 32 nt, Human
gucucagagcagccuuugccccagggaaaugg

SEQ ID NO: 209271 - RNA, 32 nt, Human
gucucagagcauccucaucucuuucucaaaag

SEQ ID NO: 209272 - RNA, 32 nt, Human
gucucagagcggagcccacagagcagggcacc

SEQ ID NO: 209273 - RNA, 32 nt, Human
gucucagaggagcugggggagcgguggccagc

SEQ ID NO: 209274 - RNA, 32 nt, Human
gucucagagucccaggaccuugagugucauua

SEQ ID NO: 209275 - RNA, 32 nt, Human
gucucagaucacugcaaccuccgccuccuggg

SEQ ID NO: 209276 - RNA, 32 nt, Human
gucucagaugcaggagccagagggcagcccag

SEQ ID NO: 209277 - RNA, 32 nt, Human
gucucagauuccuuucuugucuguuagaaacg

SEQ ID NO: 209278 - RNA, 32 nt, Human
gucucagcaacaguggaauucaccuugguguu

SEQ ID NO: 209279 - RNA, 32 nt, Human
gucucagcaagcucugaggucuccccugagag

SEQ ID NO: 209280 - RNA, 32 nt, Human
gucucagcagccaggauucuggcugaaggaaa

SEQ ID NO: 209281 - RNA, 32 nt, Human
gucucagcagccgcccacacgcuccuaacucu

SEQ ID NO: 209282 - RNA, 32 nt, Human
gucucagcagugggauacuauuuaaggcuaag

SEQ ID NO: 209283 - RNA, 32 nt, Human
gucucagccaauggggacagagcggucacggg

SEQ ID NO: 209284 - RNA, 32 nt, Human
gucucagccaggcugguguccucuguccaggc

SEQ ID NO: 209285 - RNA, 32 nt, Human
gucucagcccuagaggaauagacucagggauu

SEQ ID NO: 209286 - RNA, 23 nt, Human
gucucagcccugaccuucuggga

SEQ ID NO: 209287 - RNA, 32 nt, Human
gucucagccgacagaaccagcaagccagaaag

SEQ ID NO: 209288 - RNA, 32 nt, Human
gucucagcucacugcaaccuccaccucccggg

SEQ ID NO: 209289 - RNA, 32 nt, Human
gucucagcucacugcaaccuccgccucccagg

SEQ ID NO: 209290 - RNA, 32 nt, Human
gucucagcucacugcaaccuccgccuucuggg

SEQ ID NO: 209291 - RNA, 32 nt, Human
gucucagcucacugcaaccucugccucccagu

SEQ ID NO: 209292 - RNA, 32 nt, Human
gucucagcucacugcaaccucugccucccggg

SEQ ID NO: 209293 - RNA, 32 nt, Human
gucucagcucacugcaaccuuggccucccgug

SEQ ID NO: 209294 - RNA, 32 nt, Human
gucucagcucacugcagcuuugaccuugccgg

SEQ ID NO: 209295 - RNA, 32 nt, Human
gucucagcucacuggagccucugccuuccagg

SEQ ID NO: 209296 - RNA, 32 nt, Human
gucucagcucacuguaaccuccaccucccgga

SEQ ID NO: 209297 - RNA, 32 nt, Human
gucucagcucuaggcuguggggaucaaugcca

SEQ ID NO: 209298 - RNA, 32 nt, Human
gucucagcucucugcaaccuccaccuccuggg

SEQ ID NO: 209299 - RNA, 32 nt, Human
gucucagcugagggcccagcugaccugguggg

SEQ ID NO: 209300 - RNA, 32 nt, Human
gucucagcugcuuacauccagguccaggauua

SEQ ID NO: 209301 - RNA, 32 nt, Human
gucucagcuguuccgccugaggcgagugacgc

SEQ ID NO: 209302 - RNA, 32 nt, Human
gucucagcuuauuauuugcugugugcaugggg

SEQ ID NO: 209303 - RNA, 25 nt, Human
gucucagcuuccaugcaacugucca

SEQ ID NO: 209304 - RNA, 32 nt, Human
gucucaggaagcccauaguacauaucagcugg

SEQ ID NO: 209305 - RNA, 32 nt, Human
gucucaggaaggaaaucuaguguuagaaaagu

SEQ ID NO: 209306 - RNA, 32 nt, Human
gucucaggaaguggggcccacccauucccaga

SEQ ID NO: 209307 - RNA, 32 nt, Human
gucucaggacagcagagugggcgugggucugg

SEQ ID NO: 209308 - RNA, 32 nt, Human
gucucaggacuuacagcucaagacauucccag

SEQ ID NO: 209309 - RNA, 32 nt, Human
gucucaggagcugaagccgggagaccugaggg

SEQ ID NO: 209310 - RNA, 32 nt, Human
gucucaggccucaccugaagcugcuguuccuc

SEQ ID NO: 209311 - RNA, 32 nt, Human
gucucaggcuccaggacagugaggagcaggcc

SEQ ID NO: 209312 - RNA, 22 nt, Human
gucucaggcuggaguacagugg

SEQ ID NO: 209313 - RNA, 32 nt, Human
gucucaggcugguaguuagcaguugugaccag

SEQ ID NO: 209314 - RNA, 31 nt, Human
gucucaggcuuagaaguuaccaaagugggcu

SEQ ID NO: 209315 - RNA, 32 nt, Human
gucucagggguuggggacagggccagguagcc

SEQ ID NO: 209316 - RNA, 32 nt, Human
gucucagggugggcaguggggguggggcuggg

SEQ ID NO: 209317 - RNA, 32 nt, Human
gucucaguaguuaaggaagcuaacagucuuag

SEQ ID NO: 209318 - RNA, 32 nt, Human
gucucaguauuuuuauaauaugauaagccugg

SEQ ID NO: 209319 - RNA, 26 nt, Human
gucucaguccugugcaaagugagaug

SEQ ID NO: 209320 - RNA, 32 nt, Human
gucucagucgcccaggcuggagugcagcagca

SEQ ID NO: 209321 - RNA, 32 nt, Human
gucucagugaagacuaugaaaaugcuggcuau

SEQ ID NO: 209322 - RNA, 32 nt, Human
gucucaguucacugcagccuccgcccuccagg

SEQ ID NO: 209323 - RNA, 24 nt, Human
gucucaguuuccccauccaugaaa

SEQ ID NO: 209324 - RNA, 32 nt, Human
gucucauaaccaggaaggaguuacuaacuuga

SEQ ID NO: 209325 - RNA, 22 nt, Human
gucucauccccacuuccuuccc

SEQ ID NO: 209326 - RNA, 32 nt, Human
gucucauccuccuuucaguucguugguagagc

SEQ ID NO: 209327 - RNA, 32 nt, Human
gucucauccuguccucacccucagcucugcua

SEQ ID NO: 209328 - RNA, 22 nt, Human
gucucaucggcggugaggaagc

SEQ ID NO: 209329 - RNA, 32 nt, Human
gucucaucuccucugcccaaaaaugaugcucu

SEQ ID NO: 209330 - RNA, 32 nt, Human
gucucaucuguaaaaaggagauaaaaauuauu

SEQ ID NO: 209331 - RNA, 18 nt, Human
gucucaucuguuuuuccu

SEQ ID NO: 209332 - RNA, 32 nt, Human
gucucaugaagugggagcccucugauuugggc

SEQ ID NO: 209333 - RNA, 32 nt, Human
gucucaugauuauuauucacugggugacauug

SEQ ID NO: 209334 - RNA, 32 nt, Human
gucucaugcaagacuucacugcagccuuucac

SEQ ID NO: 209335 - RNA, 32 nt, Human
gucucaugcccaggugggugcucugggcugga

SEQ ID NO: 209336 - RNA, 20 nt, Human
gucucaugccucuaauccca

SEQ ID NO: 209337 - RNA, 32 nt, Human
gucucaugccucuaaucccagcacuuuggaag

SEQ ID NO: 209338 - RNA, 20 nt, Human
gucucaugccuguaauccca

SEQ ID NO: 209339 - RNA, 32 nt, Human
gucucaugccuguaaucccagcacuuugggag

SEQ ID NO: 209340 - RNA, 32 nt, Human
gucucaugccuuuuuguccuguccucagcucu

SEQ ID NO: 209341 - RNA, 32 nt, Human
gucucauggguagauaguggugcagugcuuua

SEQ ID NO: 209342 - RNA, 32 nt, Human
gucucauguccucauucuccccuauaugacau

SEQ ID NO: 209343 - RNA, 32 nt, Human
gucucaugucucugugguucccaagcugcaug

SEQ ID NO: 209344 - RNA, 32 nt, Human
gucucauuagccugaaugugccauaagacuga

SEQ ID NO: 209345 - RNA, 32 nt, Human
gucucauucaacacuggacaguuuacaaugug

SEQ ID NO: 209346 - RNA, 32 nt, Human
gucucauuccagccugacucuuguccccuggg

SEQ ID NO: 209347 - RNA, 32 nt, Human
gucucauucgauacagcaaaguuuacgacacu

SEQ ID NO: 209348 - RNA, 32 nt, Human
gucucauucuaucacccaggcuggaguggagu

SEQ ID NO: 209349 - RNA, 32 nt, Human
gucucauucugucacccagacuggagugcagg

SEQ ID NO: 209350 - RNA, 32 nt, Human
gucucauucugucacccagacuggagugcagu

SEQ ID NO: 209351 - RNA, 32 nt, Human
gucucauucugucacccaggccggagugcagu

SEQ ID NO: 209352 - RNA, 32 nt, Human
gucucauucugucacccaggcuggaguccaau

SEQ ID NO: 209353 - RNA, 32 nt, Human
gucucauucugucacccaggcuggagugcagu

SEQ ID NO: 209354 - RNA, 32 nt, Human
gucucauucuuaccugcaguuuguuacuaugu

SEQ ID NO: 209355 - RNA, 32 nt, Human
gucucauuggcaguugugauucagagaccuag

SEQ ID NO: 209356 - RNA, 32 nt, Human
gucucauugugccaugagguaaauguaauguu

SEQ ID NO: 209357 - RNA, 32 nt, Human
gucucauuuucaucuucuuccaugguuccaca

SEQ ID NO: 209358 - RNA, 32 nt, Human
gucuccaaaugaaagagccacagugaaacccc

SEQ ID NO: 209359 - RNA, 32 nt, Human
gucuccaacuccucgccucaagcaauucgccc

SEQ ID NO: 209360 - RNA, 32 nt, Human
gucuccaacuccuggacucaagcaaucugccc

SEQ ID NO: 209361 - RNA, 21 nt, Human
gucuccaacuccugggcucaa

SEQ ID NO: 209362 - RNA, 32 nt, Human
gucuccaacuccugggcucaagcaauccuccu

SEQ ID NO: 209363 - RNA, 32 nt, Human
gucuccaagaaucagacuacagauauugcaga

SEQ ID NO: 209364 - RNA, 32 nt, Human
gucuccaagcccaacaccaguaaagggucugu

SEQ ID NO: 209365 - RNA, 32 nt, Human
gucuccaauagcucuggcugguaucugcagac

SEQ ID NO: 209366 - RNA, 18 nt, Human
gucuccaauauagccugu

SEQ ID NO: 209367 - RNA, 18 nt, Human
gucuccacacucuuugca

SEQ ID NO: 209368 - RNA, 32 nt, Human
gucuccacagucuucagaagacaaaugcucag

SEQ ID NO: 209369 - RNA, 32 nt, Human
gucuccaccacgacaucucaguaccaagaggg

SEQ ID NO: 209370 - RNA, 32 nt, Human
gucuccacccaccuugacguuucuucuuucua

SEQ ID NO: 209371 - RNA, 32 nt, Human
gucuccaccucaguuccucagggcuguuggcc

SEQ ID NO: 209372 - RNA, 32 nt, Human
gucuccaccucccggguucaagcgauucuccu

SEQ ID NO: 209373 - RNA, 32 nt, Human
gucuccaccuccugagcucaagcaauucucau

SEQ ID NO: 209374 - RNA, 32 nt, Human
gucuccaccugucacuguguuuuuaagagcuc

SEQ ID NO: 209375 - RNA, 32 nt, Human
gucuccacgaggacagaggcugcuuuggacuc

SEQ ID NO: 209376 - RNA, 32 nt, Human
gucuccacggaaggagcucacuuugucagcug

SEQ ID NO: 209377 - RNA, 32 nt, Human
gucuccacguuucagaccagcuucugggggaa

SEQ ID NO: 209378 - RNA, 22 nt, Human
gucuccacuaaaaaauacaaaa

SEQ ID NO: 209379 - RNA, 21 nt, Human
gucuccacuaaaaauacaaaa

SEQ ID NO: 209380 - RNA, 22 nt, Human
gucuccacuaaaaauacaaaau

SEQ ID NO: 209381 - RNA, 21 nt, Human
gucuccacuaaaauacaaaau

SEQ ID NO: 209382 - RNA, 32 nt, Human
gucuccacuaaaauacaaaauuagcugggugu

SEQ ID NO: 209383 - RNA, 32 nt, Human
gucuccacucacagccugaaauucuccugugu

SEQ ID NO: 209384 - RNA, 32 nt, Human
gucuccacucuccgucuggccuaaaggugaug

SEQ ID NO: 209385 - RNA, 32 nt, Human
gucuccacugggacucaagagaggaaccuggg

SEQ ID NO: 209386 - RNA, 32 nt, Human
gucuccacuucacuccagcaucaacaaguggg

SEQ ID NO: 209387 - RNA, 20 nt, Human
gucuccagaaaauaacugug

SEQ ID NO: 209388 - RNA, 24 nt, Human
gucuccagaacagaagcaucugua

SEQ ID NO: 209389 - RNA, 22 nt, Human
gucuccagaacuuguaacugug

SEQ ID NO: 209390 - RNA, 32 nt, Human
gucuccagacgcccaucugggccagguccaga

SEQ ID NO: 209391 - RNA, 19 nt, Human
gucuccagagacagcugug

SEQ ID NO: 209392 - RNA, 32 nt, Human
gucuccagcacccuagcccuccugggcuccca

SEQ ID NO: 209393 - RNA, 32 nt, Human
gucuccagcccaaaccugccuuccuagcccca

SEQ ID NO: 209394 - RNA, 32 nt, Human
gucuccagcccaaaccugccuuccuagcucca

SEQ ID NO: 209395 - RNA, 21 nt, Human
gucuccagcccacccuccgca

SEQ ID NO: 209396 - RNA, 32 nt, Human
gucuccagccccugguccccagcucuugccaa

SEQ ID NO: 209397 - RNA, 32 nt, Human
gucuccagccuggcucuaucuuccuccuugug

SEQ ID NO: 209398 - RNA, 18 nt, Human
gucuccagcuucaccauc

SEQ ID NO: 209399 - RNA, 30 nt, Human
gucuccagcuugcaaauggcaggcuaugga

SEQ ID NO: 209400 - RNA, 32 nt, Human
gucuccagcuuucugccaacauguaaaccuuu

SEQ ID NO: 209401 - RNA, 19 nt, Human
gucuccaggccccagcugu

SEQ ID NO: 209402 - RNA, 32 nt, Human
gucuccaggcuggaguacaguggugcgaucau

SEQ ID NO: 209403 - RNA, 23 nt, Human
gucuccaggcuggagugcagugg

SEQ ID NO: 209404 - RNA, 32 nt, Human
gucuccaggcuggagugcaguggcgucaucuc

SEQ ID NO: 209405 - RNA, 19 nt, Human
gucuccagggaccugagcu

SEQ ID NO: 209406 - RNA, 22 nt, Human
gucuccagguaacccgacugua

SEQ ID NO: 209407 - RNA, 32 nt, Human
gucuccaguaaacauacaaagccauuacaggg

SEQ ID NO: 209408 - RNA, 32 nt, Human
gucuccaguccugguuacugauuuccccuggc

SEQ ID NO: 209409 - RNA, 32 nt, Human
gucuccaguucugcucuggccuacuaacuguu

SEQ ID NO: 209410 - RNA, 32 nt, Human
gucuccaguuuuucuccaucuccugggacgua

SEQ ID NO: 209411 - RNA, 32 nt, Human
gucuccauacgcguucuaggcauacaaggggg

SEQ ID NO: 209412 - RNA, 32 nt, Human
gucuccauccccagaauuuccagcuuuugaaa

SEQ ID NO: 209413 - RNA, 32 nt, Human
gucuccauccuccaccucugagauggacacuu

SEQ ID NO: 209414 - RNA, 32 nt, Human
gucuccauccuggccagggaauggaagggaga

SEQ ID NO: 209415 - RNA, 23 nt, Human
gucuccaucucuugaccucguga

SEQ ID NO: 209416 - RNA, 32 nt, Human
gucuccaucugagccguguccuuccgcugccc

SEQ ID NO: 209417 - RNA, 32 nt, Human
gucuccaugaauggaaggaaugugggagaggc

SEQ ID NO: 209418 - RNA, 32 nt, Human
gucuccaugagcacagaggcugcucuggaguc

SEQ ID NO: 209419 - RNA, 32 nt, Human
gucuccauggugggggucucucaccuucuuga

SEQ ID NO: 209420 - RNA, 21 nt, Human
gucuccauugaguacauauca

SEQ ID NO: 209421 - RNA, 24 nt, Human
gucucccaaaccuucagagagugg

SEQ ID NO: 209422 - RNA, 32 nt, Human
gucucccaaggagcagagcagagcagagcucc

SEQ ID NO: 209423 - RNA, 24 nt, Human
gucucccacacggacaccuucugg

SEQ ID NO: 209424 - RNA, 32 nt, Human
gucucccacacgugagcucccacacguacaca

SEQ ID NO: 209425 - RNA, 32 nt, Human
gucucccacccagggagcagcucuguccaacc

SEQ ID NO: 209426 - RNA, 24 nt, Human
gucucccagacuggacugcagugg

SEQ ID NO: 209427 - RNA, 32 nt, Human
gucucccagaggaaaagaaagaaugguauuug

SEQ ID NO: 209428 - RNA, 21 nt, Human
gucucccagcaccccuucagg

SEQ ID NO: 209429 - RNA, 32 nt, Human
gucucccagcaugggcggaugccgggcaugag

SEQ ID NO: 209430 - RNA, 32 nt, Human
gucucccaggacagagaguuacagaaauggga

SEQ ID NO: 209431 - RNA, 32 nt, Human
gucucccaggaggcugaggcugcuguaucacu

SEQ ID NO: 209432 - RNA, 24 nt, Human
gucucccaggccggagugcagugg

SEQ ID NO: 209433 - RNA, 22 nt, Human
gucucccaggccuucccaguca

SEQ ID NO: 209434 - RNA, 24 nt, Human
gucucccaggcuagaguaccgugg

SEQ ID NO: 209435 - RNA, 23 nt, Human
gucucccaggcuagagugcaaug

SEQ ID NO: 209436 - RNA, 24 nt, Human
gucucccaggcuagagugcaaugg

SEQ ID NO: 209437 - RNA, 23 nt, Human
gucucccaggcugaagugcagug

SEQ ID NO: 209438 - RNA, 24 nt, Human
gucucccaggcugaagugcagugg

SEQ ID NO: 209439 - RNA, 32 nt, Human
gucucccaggcugcaacauccaccucccaggu

SEQ ID NO: 209440 - RNA, 27 nt, Human
gucucccaggcugcuggagugcagugg

SEQ ID NO: 209441 - RNA, 32 nt, Human
gucucccaggcugcuggagugcaguggcacaa

SEQ ID NO: 209442 - RNA, 21 nt, Human
gucucccaggcuggacugcag

SEQ ID NO: 209443 - RNA, 24 nt, Human
gucucccaggcuggacugcagcag

SEQ ID NO: 209444 - RNA, 24 nt, Human
gucucccaggcuggacugcagugg

SEQ ID NO: 209445 - RNA, 22 nt, Human
gucucccaggcuggagcguagu

SEQ ID NO: 209446 - RNA, 24 nt, Human
gucucccaggcuggaggucagugg

SEQ ID NO: 209447 - RNA, 24 nt, Human
gucucccaggcuggaguacagugg

SEQ ID NO: 209448 - RNA, 20 nt, Human
gucucccaggcuggagugca

SEQ ID NO: 209449 - RNA, 22 nt, Human
gucucccaggcuggagugcaau

SEQ ID NO: 209450 - RNA, 24 nt, Human
gucucccaggcuggagugcaauag

SEQ ID NO: 209451 - RNA, 23 nt, Human
gucucccaggcuggagugcaaug

SEQ ID NO: 209452 - RNA, 24 nt, Human
gucucccaggcuggagugcaaugg

SEQ ID NO: 209453 - RNA, 23 nt, Human
gucucccaggcuggagugcagug

SEQ ID NO: 209454 - RNA, 24 nt, Human
gucucccaggcuggagugcagugg

SEQ ID NO: 209455 - RNA, 24 nt, Human
gucucccaggcuggagugcggugg

SEQ ID NO: 209456 - RNA, 24 nt, Human
gucucccaggcuggagugcuaugg

SEQ ID NO: 209457 - RNA, 32 nt, Human
gucucccaggcuggaguugcaguggugcaaug

SEQ ID NO: 209458 - RNA, 24 nt, Human
gucucccagguuggagugcagugg

SEQ ID NO: 209459 - RNA, 32 nt, Human
gucucccagucaggacacaagccagaccugga

SEQ ID NO: 209460 - RNA, 23 nt, Human
gucucccaguuaugaaucagugg

SEQ ID NO: 209461 - RNA, 32 nt, Human
gucucccaugaucugauucugaguuccuacug

SEQ ID NO: 209462 - RNA, 32 nt, Human
gucuccccaaagugcugggauuacaggcguga

SEQ ID NO: 209463 - RNA, 32 nt, Human
gucuccccaccccaccugugcuggugugugug

SEQ ID NO: 209464 - RNA, 32 nt, Human
gucuccccaccucuaccagcaucugcugagcu

SEQ ID NO: 209465 - RNA, 32 nt, Human
gucuccccacuccagcauccccaaacugguac

SEQ ID NO: 209466 - RNA, 32 nt, Human
gucuccccagagaaagcagaguccuccaagac

SEQ ID NO: 209467 - RNA, 32 nt, Human
gucuccccagcccucuugaccuggccacagag

SEQ ID NO: 209468 - RNA, 32 nt, Human
gucucccccaaaacuggcuggcaccagcuuca

SEQ ID NO: 209469 - RNA, 32 nt, Human
gucucccccgagagccacagggagugcuggac

SEQ ID NO: 209470 - RNA, 32 nt, Human
gucucccccuuccugcaucaccaccuugguuu

SEQ ID NO: 209471 - RNA, 24 nt, Human
gucuccccggcuggagugcagugg

SEQ ID NO: 209472 - RNA, 32 nt, Human
gucuccccuccagcucuacucacaggcuccga

SEQ ID NO: 209473 - RNA, 32 nt, Human
gucuccccucucucccuguccugcauuccauc

SEQ ID NO: 209474 - RNA, 32 nt, Human
gucuccccuucugcuguucuccuguucuucau

SEQ ID NO: 209475 - RNA, 32 nt, Human
gucucccgccgccaaucucuggccccuagcag

SEQ ID NO: 209476 - RNA, 22 nt, Human
gucucccgcgcccgccgccagg

SEQ ID NO: 209477 - RNA, 24 nt, Human
gucucccgcggcugcucccccagg

SEQ ID NO: 209478 - RNA, 24 nt, Human
gucucccggccuggagugcagugg

SEQ ID NO: 209479 - RNA, 32 nt, Human
gucucccgggagcagagguucuaugaaucccu

SEQ ID NO: 209480 - RNA, 21 nt, Human
gucucccggggacugcagcgg

SEQ ID NO: 209481 - RNA, 24 nt, Human
gucucccguggccuacgcugccag

SEQ ID NO: 209482 - RNA, 20 nt, Human
gucucccguggggcucuuca

SEQ ID NO: 209483 - RNA, 22 nt, Human
gucucccuaagcaacaugauaa

SEQ ID NO: 209484 - RNA, 32 nt, Human
gucucccucaucaccgacuacaggguccgguu

SEQ ID NO: 209485 - RNA, 32 nt, Human
gucucccuccacccacgucccucacccgccgg

SEQ ID NO: 209486 - RNA, 32 nt, Human
gucucccuccacugcucagaccucuggaccug

SEQ ID NO: 209487 - RNA, 32 nt, Human
gucucccuccccucgccgacugccgccccagg

SEQ ID NO: 209488 - RNA, 16 nt, Human
gucucccucccuccca

SEQ ID NO: 209489 - RNA, 24 nt, Human
gucucccuccugugcacccucagg

SEQ ID NO: 209490 - RNA, 32 nt, Human
gucucccucugccucuccagccccugaaagag

SEQ ID NO: 209491 - RNA, 32 nt, Human
gucucccugcagcugcuaguuccugcccagga

SEQ ID NO: 209492 - RNA, 32 nt, Human
gucucccugcccacccuccauggucuucugug

SEQ ID NO: 209493 - RNA, 32 nt, Human
gucucccugcucccucugcccuuccucccucu

SEQ ID NO: 209494 - RNA, 32 nt, Human
gucucccugggaagagagucaagacuuggaga

SEQ ID NO: 209495 - RNA, 32 nt, Human
gucucccuguauugcccagucuggccuagaac

SEQ ID NO: 209496 - RNA, 19 nt, Human
gucucccugugccuggaga

SEQ ID NO: 209497 - RNA, 32 nt, Human
gucucccuucccucccucccucccucccuccc

SEQ ID NO: 209498 - RNA, 20 nt, Human
gucucccuuccugccuucag

SEQ ID NO: 209499 - RNA, 24 nt, Human
gucuccgaggcuggaauacggugg

SEQ ID NO: 209500 - RNA, 23 nt, Human
gucuccgccuucuguucuucuug

SEQ ID NO: 209501 - RNA, 21 nt, Human
gucuccgcuaaaaauacaaaa

SEQ ID NO: 209502 - RNA, 32 nt, Human
gucuccgcuccccuucugugaugcucacuucu

SEQ ID NO: 209503 - RNA, 24 nt, Human
gucuccggccccuucccccuuccc

SEQ ID NO: 209504 - RNA, 32 nt, Human
gucuccggccuguauucucuccccuucacuca

SEQ ID NO: 209505 - RNA, 32 nt, Human
gucuccggggaggcagggguccugcagguccu

SEQ ID NO: 209506 - RNA, 32 nt, Human
gucuccggguuggauuugcacccuggggucua

SEQ ID NO: 209507 - RNA, 32 nt, Human
gucuccgugauccccgagggcagccccacugc

SEQ ID NO: 209508 - RNA, 24 nt, Human
gucuccuaagcuggagugcagugg

SEQ ID NO: 209509 - RNA, 32 nt, Human
gucuccuacaugccagggaucccaccaggagg

SEQ ID NO: 209510 - RNA, 23 nt, Human
gucuccuacccuucucuuccucu

SEQ ID NO: 209511 - RNA, 32 nt, Human
gucuccuacuugcgacaagguggacuugggag

SEQ ID NO: 209512 - RNA, 32 nt, Human
gucuccuagccaaucagaacuggcuguggacc

SEQ ID NO: 209513 - RNA, 32 nt, Human
gucuccuaggccgacguccaggaagcugcagc

SEQ ID NO: 209514 - RNA, 24 nt, Human
gucuccuaggcuggagugcagugg

SEQ ID NO: 209515 - RNA, 32 nt, Human
gucuccuagggguuuucauuucccugaagaca

SEQ ID NO: 209516 - RNA, 32 nt, Human
gucuccucaccccagccacauguuuucuuuaa

SEQ ID NO: 209517 - RNA, 32 nt, Human
gucuccucaccucugcuccugucuucaucacc

SEQ ID NO: 209518 - RNA, 32 nt, Human
gucuccucaggcacuucccccuuggcuccuga

SEQ ID NO: 209519 - RNA, 32 nt, Human
gucuccucauccguccuucccaccucacaccc

SEQ ID NO: 209520 - RNA, 32 nt, Human
gucuccucauuugucagagaaaggacagagaa

SEQ ID NO: 209521 - RNA, 32 nt, Human
gucuccuccagccucacuucgcugccacuucg

SEQ ID NO: 209522 - RNA, 32 nt, Human
gucuccuccaucuugaacaaacaaaacauuag

SEQ ID NO: 209523 - RNA, 32 nt, Human
gucuccucccaaaaugcugggauuacaggugu

SEQ ID NO: 209524 - RNA, 20 nt, Human
gucuccucccucuccuuccc

SEQ ID NO: 209525 - RNA, 32 nt, Human
gucuccuccucucugcugcccaguccuggccc

SEQ ID NO: 209526 - RNA, 32 nt, Human
gucuccuccugaacuugggccugguggaaggg

SEQ ID NO: 209527 - RNA, 32 nt, Human
gucuccuccuggacuugggccugguggaaggg

SEQ ID NO: 209528 - RNA, 32 nt, Human
gucuccuccuggaugcugcuccuugaaucuuu

SEQ ID NO: 209529 - RNA, 32 nt, Human
gucuccucuccagggacaaggcugcugggcac

SEQ ID NO: 209530 - RNA, 32 nt, Human
gucuccucucccagccuuccuccucacucacc

SEQ ID NO: 209531 - RNA, 18 nt, Human
gucuccucuccuccucca

SEQ ID NO: 209532 - RNA, 32 nt, Human
gucuccucuccucugagcagccacauagaaca

SEQ ID NO: 209533 - RNA, 32 nt, Human
gucuccucuccugcuggucccugccggcgugc

SEQ ID NO: 209534 - RNA, 32 nt, Human
gucuccucucucuccuccuuugaccuucuccu

SEQ ID NO: 209535 - RNA, 32 nt, Human
gucuccucucuuccucacucccuucccccagu

SEQ ID NO: 209536 - RNA, 32 nt, Human
gucuccucuucuuccuccucuguguccuuguc

SEQ ID NO: 209537 - RNA, 32 nt, Human
gucuccucuuucucccuggccugugguugucc

SEQ ID NO: 209538 - RNA, 32 nt, Human
gucuccugagacaagaccuccuacuguacucu

SEQ ID NO: 209539 - RNA, 32 nt, Human
gucuccugagaguggggcugacccugccuugg

SEQ ID NO: 209540 - RNA, 32 nt, Human
gucuccugaguaucuaggacuacaggcccgca

SEQ ID NO: 209541 - RNA, 32 nt, Human
gucuccugauucuacaccaucucuccagaacu

SEQ ID NO: 209542 - RNA, 32 nt, Human
gucuccugcacccacucccuucauacaaucua

SEQ ID NO: 209543 - RNA, 32 nt, Human
gucuccugcaggaaccaugacuagaaaugugg

SEQ ID NO: 209544 - RNA, 32 nt, Human
gucuccugccacuuuaaaugucacucucaauu

SEQ ID NO: 209545 - RNA, 31 nt, Human
gucuccugccucuccuggugucgccgguggc

SEQ ID NO: 209546 - RNA, 32 nt, Human
gucuccugccuguaaucccaucacuuugggag

SEQ ID NO: 209547 - RNA, 22 nt, Human
gucuccugccuuguucccuccc

SEQ ID NO: 209548 - RNA, 17 nt, Human
gucuccuggcccccagg

SEQ ID NO: 209549 - RNA, 32 nt, Human
gucuccuggcccccaggcagggucugucacca

SEQ ID NO: 209550 - RNA, 32 nt, Human
gucuccuggcuggcuccugaagggcuggcugc

SEQ ID NO: 209551 - RNA, 32 nt, Human
gucuccugggagagaggggugagggauguccc

SEQ ID NO: 209552 - RNA, 32 nt, Human
gucuccugggagugcuuugaggguggggccug

SEQ ID NO: 209553 - RNA, 32 nt, Human
gucuccugggaucagaggguaguacagaagcc

SEQ ID NO: 209554 - RNA, 32 nt, Human
gucuccugguagcugggauuacaggcaugcac

SEQ ID NO: 209555 - RNA, 32 nt, Human
gucuccugguccuucugccaucaugccgaugu

SEQ ID NO: 209556 - RNA, 32 nt, Human
gucuccuguagggcuuaugacugugaauccuu

SEQ ID NO: 209557 - RNA, 32 nt, Human
gucuccugucacacuaugaaugcagugaccuc

SEQ ID NO: 209558 - RNA, 32 nt, Human
gucuccuguccaauuucuugcugguggucagc

SEQ ID NO: 209559 - RNA, 31 nt, Human
gucuccugucucucuggcugaugucaccuga

SEQ ID NO: 209560 - RNA, 32 nt, Human
gucuccugucuuaggcgucccacgccgcgugc

SEQ ID NO: 209561 - RNA, 32 nt, Human
gucuccuucagucucccuacccugcacaagca

SEQ ID NO: 209562 - RNA, 21 nt, Human
gucuccuuccaccuccuuccc

SEQ ID NO: 209563 - RNA, 32 nt, Human
gucuccuucccacacacacuccugggcggggu

SEQ ID NO: 209564 - RNA, 32 nt, Human
gucuccuucccacauccucagccccacaccag

SEQ ID NO: 209565 - RNA, 32 nt, Human
gucuccuucccaggaucccacaccaugccuca

SEQ ID NO: 209566 - RNA, 32 nt, Human
gucuccuucccaggaucccacaccaugucuca

SEQ ID NO: 209567 - RNA, 23 nt, Human
gucuccuuccuccgcugcuucca

SEQ ID NO: 209568 - RNA, 32 nt, Human
gucuccuuggccuccuagaggguggggauccg

SEQ ID NO: 209569 - RNA, 21 nt, Human
gucuccuugugaauacuuaga

SEQ ID NO: 209570 - RNA, 32 nt, Human
gucuccuuucuuucucacuucugucuugaggg

SEQ ID NO: 209571 - RNA, 32 nt, Human
gucuccuuuucaugugaauuuauuacucccgu

SEQ ID NO: 209572 - RNA, 32 nt, Human
gucuccuuuuugacucccucccccuuuaugcu

SEQ ID NO: 209573 - RNA, 32 nt, Human
gucucgaacauaacaacacagcuaccuuugaa

SEQ ID NO: 209574 - RNA, 23 nt, Human
gucucgaacuccugaccuuguga

SEQ ID NO: 209575 - RNA, 32 nt, Human
gucucgaacuccuggacucaagcaauccgccc

SEQ ID NO: 209576 - RNA, 32 nt, Human
gucucgaacuccuggccuuaagccacucaccu

SEQ ID NO: 209577 - RNA, 32 nt, Human
gucucgaacucuggaccucagaucuuguagaa

SEQ ID NO: 209578 - RNA, 32 nt, Human
gucucgaacuucugggcucaagcaauuguccc

SEQ ID NO: 209579 - RNA, 32 nt, Human
gucucgaccccgagccccacuggaugauagag

SEQ ID NO: 209580 - RNA, 21 nt, Human
gucucgacuaaaaauacaaaa

SEQ ID NO: 209581 - RNA, 32 nt, Human
gucucgacucacugcaaccuccgccucccgag

SEQ ID NO: 209582 - RNA, 32 nt, Human
gucucgacucacugcagccuugaccucccggg

SEQ ID NO: 209583 - RNA, 31 nt, Human
gucucgacucggcuuucuugccaaaggaggg

SEQ ID NO: 209584 - RNA, 32 nt, Human
gucucgagcucuggcagaggaggacccgggcg

SEQ ID NO: 209585 - RNA, 32 nt, Human
gucucgaggcgggagagccagccgcccugcag

SEQ ID NO: 209586 - RNA, 23 nt, Human
gucucgaucuccggaccucauga

SEQ ID NO: 209587 - RNA, 23 nt, Human
gucucgaucuccugaccucguga

SEQ ID NO: 209588 - RNA, 21 nt, Human
gucucgaucucuguccugugg

SEQ ID NO: 209589 - RNA, 23 nt, Human
gucucgauuuccugaccuuguga

SEQ ID NO: 209590 - RNA, 32 nt, Human
gucucgcacugaggcgcccagagcuggugguc

SEQ ID NO: 209591 - RNA, 32 nt, Human
gucucgcacuugucauuggucacugcagccgc

SEQ ID NO: 209592 - RNA, 24 nt, Human
gucucgcaggccagagugcagugg

SEQ ID NO: 209593 - RNA, 32 nt, Human
gucucgcaucccuaggcuggucccgaacgcuu

SEQ ID NO: 209594 - RNA, 32 nt, Human
gucucgccguugcccaggcuggagugcggugg

SEQ ID NO: 209595 - RNA, 32 nt, Human
gucucgccucuggccuucucuggccacuccug

SEQ ID NO: 209596 - RNA, 32 nt, Human
gucucgcgaaggcaggcguucaaggauauuug

SEQ ID NO: 209597 - RNA, 32 nt, Human
gucucgcucagagcugugucccugaacaucca

SEQ ID NO: 209598 - RNA, 32 nt, Human
gucucgcuccgucacccaggcuggagugcagu

SEQ ID NO: 209599 - RNA, 32 nt, Human
gucucgcucuauugcccagucuggagugcagu

SEQ ID NO: 209600 - RNA, 32 nt, Human
gucucgcucugcacuccagccuggcgacugag

SEQ ID NO: 209601 - RNA, 32 nt, Human
gucucgcucugucacccagacuggagugcagu

SEQ ID NO: 209602 - RNA, 32 nt, Human
gucucgcucugucacccaggcuggggugcagu

SEQ ID NO: 209603 - RNA, 32 nt, Human
gucucgcucugucacccagucuggagugcagu

SEQ ID NO: 209604 - RNA, 32 nt, Human
gucucgcucugucucccagguuggagugcagu

SEQ ID NO: 209605 - RNA, 32 nt, Human
gucucgcugggacccgcacugacagcgggagg

SEQ ID NO: 209606 - RNA, 32 nt, Human
gucucgcugggucuggcgagccaagccccucg

SEQ ID NO: 209607 - RNA, 32 nt, Human
gucucgcuguuacccaggcuggagugcaaugg

SEQ ID NO: 209608 - RNA, 32 nt, Human
gucucgcuguugcccaggcuagagcgcagggg

SEQ ID NO: 209609 - RNA, 32 nt, Human
gucucgcuguugcccaggcuguagugcagugg

SEQ ID NO: 209610 - RNA, 32 nt, Human
gucucggaacuccugacugcaggugauccguc

SEQ ID NO: 209611 - RNA, 32 nt, Human
gucucggaaugcucagggggacucauuaaagc

SEQ ID NO: 209612 - RNA, 32 nt, Human
gucucggacuccucucugcuugcauguguaaa

SEQ ID NO: 209613 - RNA, 32 nt, Human
gucucggacuccuggccucaagcaauccucuu

SEQ ID NO: 209614 - RNA, 32 nt, Human
gucucggacuccugggcucaagcaaucugccc

SEQ ID NO: 209615 - RNA, 24 nt, Human
gucucggagcuacaaccgcagcag

SEQ ID NO: 209616 - RNA, 32 nt, Human
gucucggcaguggcucaugccuauaaucccag

SEQ ID NO: 209617 - RNA, 22 nt, Human
gucucggccucacccgccggga

SEQ ID NO: 209618 - RNA, 32 nt, Human
gucucggccugccuccuuggccagcuccggcu

SEQ ID NO: 209619 - RNA, 32 nt, Human
gucucggcucaccacaaccucugccuacuggg

SEQ ID NO: 209620 - RNA, 32 nt, Human
gucucggcucacugcaaccuccaacucccagg

SEQ ID NO: 209621 - RNA, 32 nt, Human
gucucggcucacugcaaccuccaccucccagg

SEQ ID NO: 209622 - RNA, 32 nt, Human
gucucggcucacugcaaccuccaccucccggg

SEQ ID NO: 209623 - RNA, 32 nt, Human
gucucggcucacugcaaccuccaccuccuggg

SEQ ID NO: 209624 - RNA, 32 nt, Human
gucucggcucacugcaaccuccgccuccuggg

SEQ ID NO: 209625 - RNA, 32 nt, Human
gucucggcucacugcaaccucugccucccggg

SEQ ID NO: 209626 - RNA, 32 nt, Human
gucucggcucacugcaacuuccaccucccggg

SEQ ID NO: 209627 - RNA, 18 nt, Human
gucucggcucacugcaag

SEQ ID NO: 209628 - RNA, 32 nt, Human
gucucggcucacugcaagcuccgccucccagg

SEQ ID NO: 209629 - RNA, 32 nt, Human
gucucggcucacugcaagcuccgccucccgga

SEQ ID NO: 209630 - RNA, 32 nt, Human
gucucggcucacugcaagcuccgccuccuggg

SEQ ID NO: 209631 - RNA, 32 nt, Human
gucucggcucacugcaagcucugccucccagg

SEQ ID NO: 209632 - RNA, 32 nt, Human
gucucggcucacugcaagcucugccucccggg

SEQ ID NO: 209633 - RNA, 32 nt, Human
gucucggcucacugcagccuccgccucccgua

SEQ ID NO: 209634 - RNA, 32 nt, Human
gucucggcucacugcgaccucggccuccugga

SEQ ID NO: 209635 - RNA, 32 nt, Human
gucucggcucacuguagccuccaccuccccca

SEQ ID NO: 209636 - RNA, 32 nt, Human
gucucggcucccugcaaccuccaccuccuggg

SEQ ID NO: 209637 - RNA, 32 nt, Human
gucucggcucgcugcaaccucugacucccugg

SEQ ID NO: 209638 - RNA, 21 nt, Human
gucucggcuggagugcagugg

SEQ ID NO: 209639 - RNA, 32 nt, Human
gucucggggguggucacaaccccacaucccac

SEQ ID NO: 209640 - RNA, 32 nt, Human
gucucgggucacugcagccucugucccugggu

SEQ ID NO: 209641 - RNA, 32 nt, Human
gucucggugaacaugggcucagucucucccgg

SEQ ID NO: 209642 - RNA, 32 nt, Human
gucucggugaugagcacacgcgugcuggggug

SEQ ID NO: 209643 - RNA, 32 nt, Human
gucucggugcugcugcugcugcuccuggggcu

SEQ ID NO: 209644 - RNA, 32 nt, Human
gucucgguucacugcaaccucugccucucagg

SEQ ID NO: 209645 - RNA, 32 nt, Human
gucucguccggagacuggcagcggcggcggcg

SEQ ID NO: 209646 - RNA, 16 nt, Human
gucucgugcugugucg

SEQ ID NO: 209647 - RNA, 32 nt, Human
gucucguggucuuguaaugcacugguaaaaac

SEQ ID NO: 209648 - RNA, 32 nt, Human
gucucgugguugagcucgcaaaccugaaaacu

SEQ ID NO: 209649 - RNA, 32 nt, Human
gucucguguauugaauucgugccaaaggugag

SEQ ID NO: 209650 - RNA, 29 nt, Human
gucucguuucuguguguaucugugaguau

SEQ ID NO: 209651 - RNA, 22 nt, Human
gucucuaacagcuucugccuca

SEQ ID NO: 209652 - RNA, 21 nt, Human
gucucuaauaaaaauacaaaa

SEQ ID NO: 209653 - RNA, 32 nt, Human
gucucuaauaaaaauacgaaaaauuagccagg

SEQ ID NO: 209654 - RNA, 32 nt, Human
gucucuaauaaaaauacgaaaaauuagcuggg

SEQ ID NO: 209655 - RNA, 21 nt, Human
gucucuacaaaaaauacaaaa

SEQ ID NO: 209656 - RNA, 20 nt, Human
gucucuacaaaaauacaaaa

SEQ ID NO: 209657 - RNA, 21 nt, Human
gucucuaccaaaaauacaaaa

SEQ ID NO: 209658 - RNA, 22 nt, Human
gucucuaccgaaaaauacaaaa

SEQ ID NO: 209659 - RNA, 32 nt, Human
gucucuaccugcggcccggccuggugagccca

SEQ ID NO: 209660 - RNA, 21 nt, Human
gucucuacgaaaaauacaaaa

SEQ ID NO: 209661 - RNA, 22 nt, Human
gucucuacuaaaaaauaaaaua

SEQ ID NO: 209662 - RNA, 22 nt, Human
gucucuacuaaaaaauacaaaa

SEQ ID NO: 209663 - RNA, 22 nt, Human
gucucuacuaaaaaauacagaa

SEQ ID NO: 209664 - RNA, 21 nt, Human
gucucuacuaaaaacacaaaa

SEQ ID NO: 209665 - RNA, 32 nt, Human
gucucuacuaaaaacacaaaaguuagcugagc

SEQ ID NO: 209666 - RNA, 23 nt, Human
gucucuacuaaaaacacacaaaa

SEQ ID NO: 209667 - RNA, 23 nt, Human
gucucuacuaaaaacagacaaaa

SEQ ID NO: 209668 - RNA, 21 nt, Human
gucucuacuaaaaagacaaaa

SEQ ID NO: 209669 - RNA, 21 nt, Human
gucucuacuaaaaauaaaaaa

SEQ ID NO: 209670 - RNA, 22 nt, Human
gucucuacuaaaaauaacaaaa

SEQ ID NO: 209671 - RNA, 32 nt, Human
gucucuacuaaaaauaacaaaaauuagccagg

SEQ ID NO: 209672 - RNA, 32 nt, Human
gucucuacuaaaaauaacaaaaauuagcuggg

SEQ ID NO: 209673 - RNA, 21 nt, Human
gucucuacuaaaaauaagaaa

SEQ ID NO: 209674 - RNA, 32 nt, Human
gucucuacuaaaaauaagaaaaauuagcuggg

SEQ ID NO: 209675 - RNA, 19 nt, Human
gucucuacuaaaaauacaa

SEQ ID NO: 209676 - RNA, 20 nt, Human
gucucuacuaaaaauacaaa

SEQ ID NO: 209677 - RNA, 21 nt, Human
gucucuacuaaaaauacaaaa

SEQ ID NO: 209678 - RNA, 22 nt, Human
gucucuacuaaaaauacaaaau

SEQ ID NO: 209679 - RNA, 23 nt, Human
gucucuacuaaaaauacaaaaug

SEQ ID NO: 209680 - RNA, 20 nt, Human
gucucuacuaaaaauacaag

SEQ ID NO: 209681 - RNA, 21 nt, Human
gucucuacuaaaaauacagaa

SEQ ID NO: 209682 - RNA, 32 nt, Human
gucucuacuaaaaauacagaaaauuagcuggg

SEQ ID NO: 209683 - RNA, 22 nt, Human
gucucuacuaaaaauacagaau

SEQ ID NO: 209684 - RNA, 22 nt, Human
gucucuacuaaaaauaccaaaa

SEQ ID NO: 209685 - RNA, 32 nt, Human
gucucuacuaaaaauaccaaaaauuagccggg

SEQ ID NO: 209686 - RNA, 23 nt, Human
gucucuacuaaaaauaccaaaau

SEQ ID NO: 209687 - RNA, 21 nt, Human
gucucuacuaaaaauagaaaa

SEQ ID NO: 209688 - RNA, 32 nt, Human
gucucuacuaaaaauagagaaaauuagccagg

SEQ ID NO: 209689 - RNA, 21 nt, Human
gucucuacuaaaaauauaaaa

SEQ ID NO: 209690 - RNA, 21 nt, Human
gucucuacuaaaaauccaaaa

SEQ ID NO: 209691 - RNA, 21 nt, Human
gucucuacuaaaaaugcaaaa

SEQ ID NO: 209692 - RNA, 32 nt, Human
gucucuacuaaaacaaauacaaaacuucgcug

SEQ ID NO: 209693 - RNA, 21 nt, Human
gucucuacuaaaacuacaaaa

SEQ ID NO: 209694 - RNA, 20 nt, Human
gucucuacuaaaaguacaaa

SEQ ID NO: 209695 - RNA, 21 nt, Human
gucucuacuaaaaguacaaaa

SEQ ID NO: 209696 - RNA, 21 nt, Human
gucucuacuaaaagugcaaaa

SEQ ID NO: 209697 - RNA, 21 nt, Human
gucucuacuaaaagugcagaa

SEQ ID NO: 209698 - RNA, 20 nt, Human
gucucuacuaaaauacaaaa

SEQ ID NO: 209699 - RNA, 23 nt, Human
gucucuacuaaaauaguacaaaa

SEQ ID NO: 209700 - RNA, 22 nt, Human
gucucuacuaaaauauacaaaa

SEQ ID NO: 209701 - RNA, 32 nt, Human
gucucuacuaaaauauacaaaaauuagccugg

SEQ ID NO: 209702 - RNA, 21 nt, Human
gucucuacuaaaauuauaaaa

SEQ ID NO: 209703 - RNA, 21 nt, Human
gucucuacuaaacauacaaaa

SEQ ID NO: 209704 - RNA, 21 nt, Human
gucucuacuaaacaugcaaaa

SEQ ID NO: 209705 - RNA, 21 nt, Human
gucucuacuaaagauacaaaa

SEQ ID NO: 209706 - RNA, 21 nt, Human
gucucuacuaaagauauaaaa

SEQ ID NO: 209707 - RNA, 21 nt, Human
gucucuacuaaagguacaaaa

SEQ ID NO: 209708 - RNA, 21 nt, Human
gucucuacuaaauauacaaaa

SEQ ID NO: 209709 - RNA, 32 nt, Human
gucucuacuaacauacaaaauuagcugggcac

SEQ ID NO: 209710 - RNA, 18 nt, Human
gucucuacuaauacaaaa

SEQ ID NO: 209711 - RNA, 20 nt, Human
gucucuacuaauuuacaaaa

SEQ ID NO: 209712 - RNA, 21 nt, Human
gucucuacuacaaauacaaaa

SEQ ID NO: 209713 - RNA, 32 nt, Human
gucucuacuacaaauacgaaaauuagcugggc

SEQ ID NO: 209714 - RNA, 21 nt, Human
gucucuacuagaaauacaaaa

SEQ ID NO: 209715 - RNA, 22 nt, Human
gucucuacuauaaaauacaaaa

SEQ ID NO: 209716 - RNA, 32 nt, Human
gucucuacucaaaaauacaaaaauuagccugg

SEQ ID NO: 209717 - RNA, 32 nt, Human
gucucuacugaaaaauacaacaaaaauuagac

SEQ ID NO: 209718 - RNA, 21 nt, Human
gucucuacugaaaauacaaaa

SEQ ID NO: 209719 - RNA, 22 nt, Human
gucucuacugaaaauacaaaau

SEQ ID NO: 209720 - RNA, 21 nt, Human
gucucuacugaaaauacaaag

SEQ ID NO: 209721 - RNA, 32 nt, Human
gucucuacugaaaaugcaaagauuggcuggac

SEQ ID NO: 209722 - RNA, 32 nt, Human
gucucuacugggacauguuaggcccuuguuuu

SEQ ID NO: 209723 - RNA, 21 nt, Human
gucucuacuuaaaauacaaaa

SEQ ID NO: 209724 - RNA, 21 nt, Human
gucucuagcaaaaauacaaaa

SEQ ID NO: 209725 - RNA, 32 nt, Human
gucucuagccugcagagugcagugagugagag

SEQ ID NO: 209726 - RNA, 20 nt, Human
gucucuagggugggagcagc

SEQ ID NO: 209727 - RNA, 21 nt, Human
gucucuaguaaaaauacaaaa

SEQ ID NO: 209728 - RNA, 32 nt, Human
gucucuagucagagaaaaaugauaaaggcuua

SEQ ID NO: 209729 - RNA, 22 nt, Human
gucucuaucagaaauacaaaau

SEQ ID NO: 209730 - RNA, 32 nt, Human
gucucuaugugcuccagcacacugaaggaauu

SEQ ID NO: 209731 - RNA, 22 nt, Human
gucucuauuaaaaaauacaaaa

SEQ ID NO: 209732 - RNA, 21 nt, Human
gucucuauuaaaaauacaaaa

SEQ ID NO: 209733 - RNA, 32 nt, Human
gucucuauugaccaauguauuucaaacuuuuu

SEQ ID NO: 209734 - RNA, 32 nt, Human
gucucuauuguacaaccuccuuucucuuggcu

SEQ ID NO: 209735 - RNA, 32 nt, Human
gucucuauuugagaacaacuggggccacccgg

SEQ ID NO: 209736 - RNA, 19 nt, Human
gucucucacacucagggga

SEQ ID NO: 209737 - RNA, 22 nt, Human
gucucucaccacaccuucuggg

SEQ ID NO: 209738 - RNA, 31 nt, Human
gucucucacuucuuugagguuggggaaagcc

SEQ ID NO: 209739 - RNA, 31 nt, Human
gucucucagaacuuuguaaacaggcaaacuu

SEQ ID NO: 209740 - RNA, 18 nt, Human
gucucucagccugaggga

SEQ ID NO: 209741 - RNA, 32 nt, Human
gucucucagccuugccccuccugcuccucuac

SEQ ID NO: 209742 - RNA, 32 nt, Human
gucucucagggauggagggaagaccugaaaga

SEQ ID NO: 209743 - RNA, 32 nt, Human
gucucucagggugggacccauauagcuuguuu

SEQ ID NO: 209744 - RNA, 32 nt, Human
gucucucagugaaaggcugcuuaaacagaaag

SEQ ID NO: 209745 - RNA, 32 nt, Human
gucucucaugaaguuucagucacucagcaacu

SEQ ID NO: 209746 - RNA, 32 nt, Human
gucucucauggauuguuuagagucuaaagagu

SEQ ID NO: 209747 - RNA, 32 nt, Human
gucucucccaacauauuucucuuccuugugcc

SEQ ID NO: 209748 - RNA, 32 nt, Human
gucucucccacugcaacuccacuuucuuugca

SEQ ID NO: 209749 - RNA, 32 nt, Human
gucucucccaggagaccuggggcaugagcugg

SEQ ID NO: 209750 - RNA, 32 nt, Human
gucucuccccucccccaccuuggcccccucuu

SEQ ID NO: 209751 - RNA, 32 nt, Human
gucucucccuaccucuugcucauucuacgagu

SEQ ID NO: 209752 - RNA, 32 nt, Human
gucucucccucagaagccacagaaggaugcag

SEQ ID NO: 209753 - RNA, 32 nt, Human
gucucucccugcggcgcuuucucuuccggcug

SEQ ID NO: 209754 - RNA, 32 nt, Human
gucucucccuggaaagggagggaggcuucaac

SEQ ID NO: 209755 - RNA, 32 nt, Human
gucucucccuggaaagggagggaggcuucgac

SEQ ID NO: 209756 - RNA, 32 nt, Human
gucucuccggcuuucugugcuuuaacuaucuu

SEQ ID NO: 209757 - RNA, 32 nt, Human
gucucuccuaaaaauacagaaaauuagccugg

SEQ ID NO: 209758 - RNA, 32 nt, Human
gucucuccuaaaauauacaaaaauuagccggg

SEQ ID NO: 209759 - RNA, 32 nt, Human
gucucuccucaagucggcuagucgggcgcgcg

SEQ ID NO: 209760 - RNA, 32 nt, Human
gucucuccucccaaggacaguggcuggaagag

SEQ ID NO: 209761 - RNA, 32 nt, Human
gucucuccuccccuccucucucucuuccucuc

SEQ ID NO: 209762 - RNA, 32 nt, Human
gucucuccuccccuccucucucuuccucuccu

SEQ ID NO: 209763 - RNA, 32 nt, Human
gucucuccuccccucucucucuucucugucuc

SEQ ID NO: 209764 - RNA, 32 nt, Human
gucucuccuccccuuucccuccaggcccagug

SEQ ID NO: 209765 - RNA, 32 nt, Human
gucucuccuuccucccuuccuuuacaguuuaa

SEQ ID NO: 209766 - RNA, 32 nt, Human
gucucuccuucucuagcugucaaacagcccca

SEQ ID NO: 209767 - RNA, 32 nt, Human
gucucucggacccacucucugccuucacaguu

SEQ ID NO: 209768 - RNA, 32 nt, Human
gucucucggcggagcugcugugcaguggaacg

SEQ ID NO: 209769 - RNA, 28 nt, Human
gucucucgggugauggccucauccaggg

SEQ ID NO: 209770 - RNA, 32 nt, Human
gucucucgguuuccucaucugcugccucucca

SEQ ID NO: 209771 - RNA, 32 nt, Human
gucucucuagauuccuccucucugagcagggc

SEQ ID NO: 209772 - RNA, 32 nt, Human
gucucucuccaggacugccaggcugcuggagg

SEQ ID NO: 209773 - RNA, 17 nt, Human
gucucucuccugcugcc

SEQ ID NO: 209774 - RNA, 32 nt, Human
gucucucuccuggucauuuuuguuccagccuc

SEQ ID NO: 209775 - RNA, 32 nt, Human
gucucucucugccugccucucuacuguucccc

SEQ ID NO: 209776 - RNA, 32 nt, Human
gucucucucugucacccaggcuggagugcaau

SEQ ID NO: 209777 - RNA, 32 nt, Human
gucucucugagccucaguuuccuuacugguca

SEQ ID NO: 209778 - RNA, 32 nt, Human
gucucucugauugggcuucuaaaucaaaagcc

SEQ ID NO: 209779 - RNA, 32 nt, Human
gucucucugcacuccagccugggugacagagc

SEQ ID NO: 209780 - RNA, 32 nt, Human
gucucucugccucugccugccuccuggucccc

SEQ ID NO: 209781 - RNA, 32 nt, Human
gucucucuggaaagauucucgcuaauggauuu

SEQ ID NO: 209782 - RNA, 32 nt, Human
gucucucuggaaggcgaacgccacagcugccc

SEQ ID NO: 209783 - RNA, 32 nt, Human
gucucucuggagaacccugacuaauaaaauga

SEQ ID NO: 209784 - RNA, 31 nt, Human
gucucucugggcucugugucuaaggagcccu

SEQ ID NO: 209785 - RNA, 22 nt, Human
gucucucugucccccuccccuc

SEQ ID NO: 209786 - RNA, 32 nt, Human
gucucucugucucucuuucucuccuuuuaauu

SEQ ID NO: 209787 - RNA, 32 nt, Human
gucucucugugugugucuguguccucaucucu

SEQ ID NO: 209788 - RNA, 32 nt, Human
gucucucuuacaccagcuccugccucacaaug

SEQ ID NO: 209789 - RNA, 32 nt, Human
gucucucuuaugugaaugcacacaugcagaaa

SEQ ID NO: 209790 - RNA, 23 nt, Human
gucucucuuccgccuuccuuccc

SEQ ID NO: 209791 - RNA, 19 nt, Human
gucucucuucucugacccu

SEQ ID NO: 209792 - RNA, 32 nt, Human
gucucucuugacaucaccgcagcuccaccccc

SEQ ID NO: 209793 - RNA, 23 nt, Human
gucucugaaacuccucuuuguca

SEQ ID NO: 209794 - RNA, 32 nt, Human
gucucugaacauccuaaauauugguuuguuau

SEQ ID NO: 209795 - RNA, 32 nt, Human
gucucugacaucucucacuuccuuuuagauga

SEQ ID NO: 209796 - RNA, 32 nt, Human
gucucugaccucaucugcucccccagucuuuu

SEQ ID NO: 209797 - RNA, 32 nt, Human
gucucugacucugucgcuuuucucuaaguaaa

SEQ ID NO: 209798 - RNA, 32 nt, Human
gucucugacucuugccuuuccaccugcuuucu

SEQ ID NO: 209799 - RNA, 32 nt, Human
gucucugagaaccauucucccaccccaaguuc

SEQ ID NO: 209800 - RNA, 32 nt, Human
gucucugagccuugauuuccucagcugccaaa

SEQ ID NO: 209801 - RNA, 22 nt, Human
gucucugaggcagggugggagc

SEQ ID NO: 209802 - RNA, 32 nt, Human
gucucugaucauacucacugggucagcaacac

SEQ ID NO: 209803 - RNA, 32 nt, Human
gucucugaugauaaaagucauucuucccuggu

SEQ ID NO: 209804 - RNA, 32 nt, Human
gucucugauuccauggagagucaggaguagaa

SEQ ID NO: 209805 - RNA, 32 nt, Human
gucucugcaagacuaaugacuaugucagagug

SEQ ID NO: 209806 - RNA, 32 nt, Human
gucucugcacccagggucccagccuggccacc

SEQ ID NO: 209807 - RNA, 21 nt, Human
gucucugcaccugucugucca

SEQ ID NO: 209808 - RNA, 32 nt, Human
gucucugcaggccugcucaccugccuccagca

SEQ ID NO: 209809 - RNA, 32 nt, Human
gucucugcauauggcaaagcacaaagcugaau

SEQ ID NO: 209810 - RNA, 32 nt, Human
gucucugcauccaugccacccaccccagucgg

SEQ ID NO: 209811 - RNA, 21 nt, Human
gucucugccauucuuuucuca

SEQ ID NO: 209812 - RNA, 32 nt, Human
gucucugcccaggucacagcacaagugcacau

SEQ ID NO: 209813 - RNA, 20 nt, Human
gucucugcccccucuugcca

SEQ ID NO: 209814 - RNA, 23 nt, Human
gucucugccccucucugugccug

SEQ ID NO: 209815 - RNA, 32 nt, Human
gucucugcccuucacuucuucucuucuguccc

SEQ ID NO: 209816 - RNA, 23 nt, Human
gucucugccuggcagaggcugca

SEQ ID NO: 209817 - RNA, 22 nt, Human
gucucugccuggcuauuugcuc

SEQ ID NO: 209818 - RNA, 32 nt, Human
gucucugccuucuccccuuacccucccgccuc

SEQ ID NO: 209819 - RNA, 32 nt, Human
gucucugcuaaaaauaagaaaaauuagccagg

SEQ ID NO: 209820 - RNA, 21 nt, Human
gucucugcuaaaaauacaaaa

SEQ ID NO: 209821 - RNA, 22 nt, Human
gucucugcuaaaaauacaaaau

SEQ ID NO: 209822 - RNA, 32 nt, Human
gucucugcuauggucccuccccagucaggccc

SEQ ID NO: 209823 - RNA, 32 nt, Human
gucucugcucuccugaaucuugggcaugccuu

SEQ ID NO: 209824 - RNA, 32 nt, Human
gucucugcucugcuucuaguucuccaccucca

SEQ ID NO: 209825 - RNA, 32 nt, Human
gucucugcugucuccccuccccaccccauccu

SEQ ID NO: 209826 - RNA, 24 nt, Human
gucucugcuuaccugucuggcuca

SEQ ID NO: 209827 - RNA, 21 nt, Human
gucucugcuucuuccugggcu

SEQ ID NO: 209828 - RNA, 32 nt, Human
gucucugcuugcauccccaacuuagcuguccc

SEQ ID NO: 209829 - RNA, 20 nt, Human
gucucugcuugcugagcuca

SEQ ID NO: 209830 - RNA, 23 nt, Human
gucucugcuuuaagccuuagcca

SEQ ID NO: 209831 - RNA, 22 nt, Human
gucucugcuuuugccuugcuug

SEQ ID NO: 209832 - RNA, 32 nt, Human
gucucuggaggcagacagggugggcugggggc

SEQ ID NO: 209833 - RNA, 24 nt, Human
gucucuggaggcuuugauggaagc

SEQ ID NO: 209834 - RNA, 20 nt, Human
gucucuggaggggcccaagg

SEQ ID NO: 209835 - RNA, 32 nt, Human
gucucuggcaauguacagaaauauuguauaua

SEQ ID NO: 209836 - RNA, 32 nt, Human
gucucuggcagugggauccuggagaggagaaa

SEQ ID NO: 209837 - RNA, 32 nt, Human
gucucuggccagugccuggugcucuggccccu

SEQ ID NO: 209838 - RNA, 32 nt, Human
gucucuggcugucuucauguggggaagccggg

SEQ ID NO: 209839 - RNA, 32 nt, Human
gucucugggaaagacuagauuggaagaauaaa

SEQ ID NO: 209840 - RNA, 23 nt, Human
gucucugggaaagcaagggaggc

SEQ ID NO: 209841 - RNA, 24 nt, Human
gucucugggcggcccaaagggggu

SEQ ID NO: 209842 - RNA, 32 nt, Human
gucucugggcuggggacugaauuccugauguc

SEQ ID NO: 209843 - RNA, 22 nt, Human
gucucuggggcccuggagaggc

SEQ ID NO: 209844 - RNA, 23 nt, Human
gucucuggggcgagucuuggagc

SEQ ID NO: 209845 - RNA, 21 nt, Human
gucucuggggcuucuguuuca

SEQ ID NO: 209846 - RNA, 19 nt, Human
gucucugggggcgaggagg

SEQ ID NO: 209847 - RNA, 22 nt, Human
gucucuggggggcuggagaagc

SEQ ID NO: 209848 - RNA, 21 nt, Human
gucucuggggguggggugagg

SEQ ID NO: 209849 - RNA, 22 nt, Human
gucucuggggugagaagacagc

SEQ ID NO: 209850 - RNA, 24 nt, Human
gucucugggguggggaccauuggc

SEQ ID NO: 209851 - RNA, 24 nt, Human
gucucugggucacguuuugccuca

SEQ ID NO: 209852 - RNA, 32 nt, Human
gucucuggguuauacagacagaauaccagccu

SEQ ID NO: 209853 - RNA, 32 nt, Human
gucucuggguuggcuguuccagcuccaaagag

SEQ ID NO: 209854 - RNA, 32 nt, Human
gucucugguacucaggcuggagugcgguggug

SEQ ID NO: 209855 - RNA, 29 nt, Human
gucucuggucugugucugugugugccugu

SEQ ID NO: 209856 - RNA, 32 nt, Human
gucucuggugggucucacagaugcuggagcag

SEQ ID NO: 209857 - RNA, 32 nt, Human
gucucuguaaccaccauccaggccaguacgca

SEQ ID NO: 209858 - RNA, 23 nt, Human
gucucuguagucucugcacuugu

SEQ ID NO: 209859 - RNA, 32 nt, Human
gucucugucaacucucucauugcccaguggug

SEQ ID NO: 209860 - RNA, 32 nt, Human
gucucugucacacccccacuaccgcugccacg

SEQ ID NO: 209861 - RNA, 32 nt, Human
gucucugucacccaggcuggagugcaauggca

SEQ ID NO: 209862 - RNA, 32 nt, Human
gucucugucacccaggcuggagugcagugcac

SEQ ID NO: 209863 - RNA, 32 nt, Human
gucucugucacccaggcuggagugcaguggug

SEQ ID NO: 209864 - RNA, 32 nt, Human
gucucugucacccuuguccuugagugcucuug

SEQ ID NO: 209865 - RNA, 32 nt, Human
gucucugucagaggaagaucccuuggacaaga

SEQ ID NO: 209866 - RNA, 25 nt, Human
gucucugucagagggguggggaggu

SEQ ID NO: 209867 - RNA, 32 nt, Human
gucucugucgcccaggcuggagcccaguggcg

SEQ ID NO: 209868 - RNA, 32 nt, Human
gucucugucgcccaggcuggggugcaguggcg

SEQ ID NO: 209869 - RNA, 32 nt, Human
gucucugucgccuaggcuggagugcaguggug

SEQ ID NO: 209870 - RNA, 32 nt, Human
gucucugucuccugggcccugcucugggaccu

SEQ ID NO: 209871 - RNA, 32 nt, Human
gucucugucucuccuagccccucucucacaca

SEQ ID NO: 209872 - RNA, 32 nt, Human
gucucugucuguaguuacugggauuauccaga

SEQ ID NO: 209873 - RNA, 32 nt, Human
gucucuguguccgggccggccugcugcagcca

SEQ ID NO: 209874 - RNA, 21 nt, Human
gucucuguuccaugucuccuu

SEQ ID NO: 209875 - RNA, 22 nt, Human
gucucuguucucaggcugccuc

SEQ ID NO: 209876 - RNA, 32 nt, Human
gucucuguucucaggcugccuccugggucagg

SEQ ID NO: 209877 - RNA, 32 nt, Human
gucucuguugcccaggcugcagugcaguggug

SEQ ID NO: 209878 - RNA, 32 nt, Human
gucucuguugcccaggcuggagugcaguggcg

SEQ ID NO: 209879 - RNA, 32 nt, Human
gucucuguugccugggcuggagugcaguggcc

SEQ ID NO: 209880 - RNA, 32 nt, Human
gucucuguugcugcugcugaacucagcuguug

SEQ ID NO: 209881 - RNA, 32 nt, Human
gucucuguuggggaauguggaugguggugaca

SEQ ID NO: 209882 - RNA, 23 nt, Human
gucucuguugucucauuguguug

SEQ ID NO: 209883 - RNA, 22 nt, Human
gucucuuaacugcaccuuguga

SEQ ID NO: 209884 - RNA, 32 nt, Human
gucucuuaauccguuaaugcuuuuggaaacaa

SEQ ID NO: 209885 - RNA, 32 nt, Human
gucucuuacccaggcuagggugcaguggugug

SEQ ID NO: 209886 - RNA, 22 nt, Human
gucucuuacuaaaaauacaaaa

SEQ ID NO: 209887 - RNA, 32 nt, Human
gucucuuacucccauuucugcugccuuuggcc

SEQ ID NO: 209888 - RNA, 32 nt, Human
gucucuucacgcccaucuucugccucauagug

SEQ ID NO: 209889 - RNA, 32 nt, Human
gucucuucagcccuuuucgcuaguggucaccc

SEQ ID NO: 209890 - RNA, 32 nt, Human
gucucuucauuuccucucaaaucuucaacucu

SEQ ID NO: 209891 - RNA, 32 nt, Human
gucucuuccauggaguaagaaggaagggagca

SEQ ID NO: 209892 - RNA, 32 nt, Human
gucucuucccagccuuccucacaggcuucugc

SEQ ID NO: 209893 - RNA, 32 nt, Human
gucucuuccucgcucccucucuuucucuccuc

SEQ ID NO: 209894 - RNA, 32 nt, Human
gucucuucgguggucagggauggcgcggaagu

SEQ ID NO: 209895 - RNA, 21 nt, Human
gucucuucuaaaaauacaaaa

SEQ ID NO: 209896 - RNA, 32 nt, Human
gucucuucucucucccaccaucacccucggcc

SEQ ID NO: 209897 - RNA, 32 nt, Human
gucucuucucugcacuccagggcuuugauaau

SEQ ID NO: 209898 - RNA, 32 nt, Human
gucucuucugagcuauuucaucuauuuuuggc

SEQ ID NO: 209899 - RNA, 32 nt, Human
gucucuucuggaccaggaauuaguugcugugg

SEQ ID NO: 209900 - RNA, 32 nt, Human
gucucuucuucagaggaagccuucccagucac

SEQ ID NO: 209901 - RNA, 32 nt, Human
gucucuugaguuugucgcucaugugugcaaca

SEQ ID NO: 209902 - RNA, 32 nt, Human
gucucuugcuggcaccaagcugugcugugccu

SEQ ID NO: 209903 - RNA, 32 nt, Human
gucucuuggagugcucaggguggcgggcccuu

SEQ ID NO: 209904 - RNA, 32 nt, Human
gucucuuggauaggaagccuuaagccugggaa

SEQ ID NO: 209905 - RNA, 32 nt, Human
gucucuuggcgugcuggagggcauccuggaug

SEQ ID NO: 209906 - RNA, 32 nt, Human
gucucuuggcugccacccaugccuccuccuac

SEQ ID NO: 209907 - RNA, 32 nt, Human
gucucuugggcagaggagcaagccccucgaac

SEQ ID NO: 209908 - RNA, 32 nt, Human
gucucuuguuucuacugcuaagaaggucugaa

SEQ ID NO: 209909 - RNA, 32 nt, Human
gucucuuuaaagggaagagaagcauuggugaa

SEQ ID NO: 209910 - RNA, 32 nt, Human
gucucuuucauucugcuacuucacugucaucu

SEQ ID NO: 209911 - RNA, 32 nt, Human
gucucuuuccacccuuaucuccacaccugccc

SEQ ID NO: 209912 - RNA, 32 nt, Human
gucucuuuccagucaauuucuaaugcucuucu

SEQ ID NO: 209913 - RNA, 32 nt, Human
gucucuuuccccaccauuugaaucugggcugg

SEQ ID NO: 209914 - RNA, 32 nt, Human
gucucuuucugccuccccuccccugggggccg

SEQ ID NO: 209915 - RNA, 32 nt, Human
gucugaaaaugagagagaagacuucggaagca

SEQ ID NO: 209916 - RNA, 32 nt, Human
gucugaaacaaacagucacaagcacaggaaga

SEQ ID NO: 209917 - RNA, 32 nt, Human
gucugaaacccacccacccgcaagccuaccag

SEQ ID NO: 209918 - RNA, 32 nt, Human
gucugaaaguaggaggugggggaagaggcaag

SEQ ID NO: 209919 - RNA, 32 nt, Human
gucugaacaagaaaacuccuucuggaggaaag

SEQ ID NO: 209920 - RNA, 32 nt, Human
gucugaacacuggccugugauugguccauucc

SEQ ID NO: 209921 - RNA, 32 nt, Human
gucugaacaugccucucucuugcuuacaaaug

SEQ ID NO: 209922 - RNA, 32 nt, Human
gucugaacauuuagugaagaugagacuuaaaa

SEQ ID NO: 209923 - RNA, 32 nt, Human
gucugaaccagcugggacagaugguuuaaaga

SEQ ID NO: 209924 - RNA, 32 nt, Human
gucugaaccucugccaguccuggagacuggug

SEQ ID NO: 209925 - RNA, 19 nt, Human
gucugaacucucccuucca

SEQ ID NO: 209926 - RNA, 31 nt, Human
gucugaacuguggguggauggguggauugcc

SEQ ID NO: 209927 - RNA, 25 nt, Human
gucugaagaacagugagguggagug

SEQ ID NO: 209928 - RNA, 32 nt, Human
gucugaagcagccaucucuuucuuggaucuca

SEQ ID NO: 209929 - RNA, 32 nt, Human
gucugaagcugcagagguuagaaggggaagga

SEQ ID NO: 209930 - RNA, 32 nt, Human
gucugaaguuccagaaaggauccuguucccag

SEQ ID NO: 209931 - RNA, 32 nt, Human
gucugaaucuuaucuggguaucaggaaaaaga

SEQ ID NO: 209932 - RNA, 32 nt, Human
gucugaauuccagacuccuccccaccacccac

SEQ ID NO: 209933 - RNA, 32 nt, Human
gucugacacccugcuucuucucucacacugug

SEQ ID NO: 209934 - RNA, 32 nt, Human
gucugacaccugggcuggagugcaguggugca

SEQ ID NO: 209935 - RNA, 32 nt, Human
gucugacagccacuccagaggccaugcuucgu

SEQ ID NO: 209936 - RNA, 32 nt, Human
gucugacagcccaucacgaaagccugcauacu

SEQ ID NO: 209937 - RNA, 32 nt, Human
gucugacagcuuugaagagagcagugguucuc

SEQ ID NO: 209938 - RNA, 32 nt, Human
gucugaccacugcagaccagucucggaggugu

SEQ ID NO: 209939 - RNA, 32 nt, Human
gucugaccaucucaagcaacaccagaagacuc

SEQ ID NO: 209940 - RNA, 32 nt, Human
gugauagcaaucuucaugaugccuagagguuc

SEQ ID NO: 209941 - RNA, 32 nt, Human
gugauagcaccacugcgcuccagccuggguga

SEQ ID NO: 209942 - RNA, 32 nt, Human
gugauagcagcccagcucuggugaguguccuu

SEQ ID NO: 209943 - RNA, 32 nt, Human
gugauagccgccgaccgagccugcugcuuucu

SEQ ID NO: 209944 - RNA, 32 nt, Human
gugauaggagcaaagucucuccauucuccagg

SEQ ID NO: 209945 - RNA, 32 nt, Human
gugauaggccccauaagacacacacaugagca

SEQ ID NO: 209946 - RNA, 31 nt, Human
gugauaggggaacacauuucacuggacaaca

SEQ ID NO: 209947 - RNA, 32 nt, Human
gugauagggucugaacccaguuggggagacag

SEQ ID NO: 209948 - RNA, 32 nt, Human
gugauagucugaaaaguggccucaugggauga

SEQ ID NO: 209949 - RNA, 32 nt, Human
gugauagucugaaaaguggccucgugggagga

SEQ ID NO: 209950 - RNA, 32 nt, Human
gugauagucugcuucucucugguaacuugucu

SEQ ID NO: 209951 - RNA, 32 nt, Human
gugauagugagagaagaggcagaggaaucgag

SEQ ID NO: 209952 - RNA, 32 nt, Human
gugauagugccacugcaauucagccuggguga

SEQ ID NO: 209953 - RNA, 20 nt, Human
gugauagugguucugucauc

SEQ ID NO: 209954 - RNA, 32 nt, Human
gugauaguuaccuucacaauggugcuaccccu

SEQ ID NO: 209955 - RNA, 32 nt, Human
gugauauaaagaaugaaaguagcuguaugagc

SEQ ID NO: 209956 - RNA, 32 nt, Human
gugauauaacuuuguuuuguuuacagaguacc

SEQ ID NO: 209957 - RNA, 32 nt, Human
gugauauauuauuucuuuaaggugcuguguga

SEQ ID NO: 209958 - RNA, 32 nt, Human
gugauauccaaccugguuaaaugaaugaaaga

SEQ ID NO: 209959 - RNA, 32 nt, Human
gugauauccccugcccuccacaaauucuucuu

SEQ ID NO: 209960 - RNA, 32 nt, Human
gugauaugaagagcgagagaaaagagaggaca

SEQ ID NO: 209961 - RNA, 31 nt, Human
gugauauggcuaaucucaguacacauuucaa

SEQ ID NO: 209962 - RNA, 32 nt, Human
gugauauggugaagggaaguggggaguauuug

SEQ ID NO: 209963 - RNA, 31 nt, Human
gugauaugugagagagaaaucuggaaccuuc

SEQ ID NO: 209964 - RNA, 18 nt, Human
gugauauuagcugucauc

SEQ ID NO: 209965 - RNA, 32 nt, Human
gugaucaaggcugaggccaccugggaugagaa

SEQ ID NO: 209966 - RNA, 23 nt, Human
gugaucaagugaaaaagcugcau

SEQ ID NO: 209967 - RNA, 32 nt, Human
gugaucacacaacugcacuccagccugggcaa

SEQ ID NO: 209968 - RNA, 32 nt, Human
gugaucacaccacugcacuccagccuggacga

SEQ ID NO: 209969 - RNA, 32 nt, Human
gugaucacaccacugcacuccagccugggcaa

SEQ ID NO: 209970 - RNA, 32 nt, Human
gugaucacaccacugcacuccagccuggguga

SEQ ID NO: 209971 - RNA, 32 nt, Human
gugaucacaccacugcacuccagccuuggcga

SEQ ID NO: 209972 - RNA, 32 nt, Human
gugaucacaccacugcauucuggccuggguga

SEQ ID NO: 209973 - RNA, 32 nt, Human
gugaucacacugcugcacuccagccugugcaa

SEQ ID NO: 209974 - RNA, 32 nt, Human
gugaucacagcaguuugugguccugacacuac

SEQ ID NO: 209975 - RNA, 32 nt, Human
gugaucaccaacagagagaggcacccuggauc

SEQ ID NO: 209976 - RNA, 32 nt, Human
gugaucaccaugcuguucucaugguaagaacu

SEQ ID NO: 209977 - RNA, 32 nt, Human
gugaucaccgccucagcuuccugaagugcugg

SEQ ID NO: 209978 - RNA, 32 nt, Human
gugaucaccucacugcacgcuagccugggcaa

SEQ ID NO: 209979 - RNA, 32 nt, Human
gugaucacgccacugcaccccagccuggguga

SEQ ID NO: 209980 - RNA, 32 nt, Human
gugaucacgccauugcacuccagccuggguga

SEQ ID NO: 209981 - RNA, 32 nt, Human
gugaucagucugcagcacagcgcagaagucag

SEQ ID NO: 209982 - RNA, 32 nt, Human
gugaucagugauaucaaacaucaggaaucagc

SEQ ID NO: 209983 - RNA, 32 nt, Human
gugaucauaccacugcacuccagccugggcga

SEQ ID NO: 209984 - RNA, 32 nt, Human
gugaucaucgacgaggcgcacaaccugaucga

SEQ ID NO: 209985 - RNA, 32 nt, Human
gugaucaugccacugcacuccagccuggauga

SEQ ID NO: 209986 - RNA, 32 nt, Human
gugaucaugccacugcacuccagccuggguga

SEQ ID NO: 209987 - RNA, 32 nt, Human
gugaucaugccacugcacuuccagccugggug

SEQ ID NO: 209988 - RNA, 32 nt, Human
gugaucaugccacugcacuuuagccugggcaa

SEQ ID NO: 209989 - RNA, 32 nt, Human
gugaucaugccacugcauuccagccugggcga

SEQ ID NO: 209990 - RNA, 32 nt, Human
gugaucaugccacugcauuccagccuguguga

SEQ ID NO: 209991 - RNA, 32 nt, Human
gugaucaugccacuguacuccagccugggcga

SEQ ID NO: 209992 - RNA, 32 nt, Human
gugaucaugccucucuacuccagccugggcaa

SEQ ID NO: 209993 - RNA, 32 nt, Human
gugaucauggcacugcacuccagccugggcaa

SEQ ID NO: 209994 - RNA, 32 nt, Human
gugaucauucaggccagcaaggaagggacucu

SEQ ID NO: 209995 - RNA, 32 nt, Human
gugaucauucugccucuccucaggagaaagua

SEQ ID NO: 209996 - RNA, 17 nt, Human
gugauccaccccacuca

SEQ ID NO: 209997 - RNA, 32 nt, Human
gugauccacugcacuauaccacagugcucagu

SEQ ID NO: 209998 - RNA, 32 nt, Human
gugauccauccuccuagaggcagugagcaggu

SEQ ID NO: 209999 - RNA, 32 nt, Human
gugaucccaaaccaaacuaacagugcugguuu

SEQ ID NO: 210000 - RNA, 32 nt, Human
gugaucccaacauuuuggaggcugaggcagga

SEQ ID NO: 210001 - RNA, 32 nt, Human
gugaucccagcacuugggaaggucgaggaggg

SEQ ID NO: 210002 - RNA, 32 nt, Human
gugaucccagcacuuugggagacugaggcgga

SEQ ID NO: 210003 - RNA, 32 nt, Human
gugaucccagcacuuugggaggcugaggcagg

SEQ ID NO: 210004 - RNA, 32 nt, Human
gugaucccagcacuuugggaggcugagguagg

SEQ ID NO: 210005 - RNA, 32 nt, Human
gugaucccagcacuuugggaggcugagguggg

SEQ ID NO: 210006 - RNA, 32 nt, Human
gugaucccagcacuuugggaugcugagguggg

SEQ ID NO: 210007 - RNA, 32 nt, Human
gugaucccagcuacuuggaggcugaggcagaa

SEQ ID NO: 210008 - RNA, 19 nt, Human
gugaucccagcuacuuggg

SEQ ID NO: 210009 - RNA, 32 nt, Human
gugauccccaggagaagccacaggggaccaug

SEQ ID NO: 210010 - RNA, 32 nt, Human
gugaucccugcacuugccugucugggacaagg

SEQ ID NO: 210011 - RNA, 23 nt, Human
gugaucccugcgcgcgucuccug

SEQ ID NO: 210012 - RNA, 19 nt, Human
gugaucccuuugaccccug

SEQ ID NO: 210013 - RNA, 32 nt, Human
gugauccgccauuacacuccagccugggugac

SEQ ID NO: 210014 - RNA, 32 nt, Human
gugauccgcccgccuccaccucccagggugcu

SEQ ID NO: 210015 - RNA, 32 nt, Human
gugauccgcccgccucggccucccagaaugcu

SEQ ID NO: 210016 - RNA, 32 nt, Human
gugauccgcccgccucggccucccagagugcu

SEQ ID NO: 210017 - RNA, 32 nt, Human
gugauccgccugccucggccucccagagugcu

SEQ ID NO: 210018 - RNA, 32 nt, Human
gugauccgcuggccucggccucccagagugcu

SEQ ID NO: 210019 - RNA, 32 nt, Human
gugauccucacugaggccggggccugcugcgg

SEQ ID NO: 210020 - RNA, 32 nt, Human
gugauccuccaaccucggccuccugguacaua

SEQ ID NO: 210021 - RNA, 32 nt, Human
gugauccuccagccacaguccagcccaaccac

SEQ ID NO: 210022 - RNA, 32 nt, Human
gugauccucccaccccagccuccugaguagcu

SEQ ID NO: 210023 - RNA, 32 nt, Human
gugauccuccuaacguaucaccagcaaccugu

SEQ ID NO: 210024 - RNA, 32 nt, Human
gugauccucuauuuugugaugaugcugugaca

SEQ ID NO: 210025 - RNA, 32 nt, Human
gugauccugagccaaggaggugaggagcagag

SEQ ID NO: 210026 - RNA, 32 nt, Human
gugauccugcaagcccugccuuccuuccuggg

SEQ ID NO: 210027 - RNA, 32 nt, Human
gugauccugcaagcccugcguuccuuccuggg

SEQ ID NO: 210028 - RNA, 32 nt, Human
gugauccugccugcguccgugucucugauucc

SEQ ID NO: 210029 - RNA, 32 nt, Human
gugauccuggacaaguaacugaaucucuccgu

SEQ ID NO: 210030 - RNA, 32 nt, Human
gugauccuugagcugggcugggcacagcccug

SEQ ID NO: 210031 - RNA, 32 nt, Human
gugaucgcaccacugcacuccagcucggguga

SEQ ID NO: 210032 - RNA, 32 nt, Human
gugaucgcaccacugcacuccagcuugguuca

SEQ ID NO: 210033 - RNA, 32 nt, Human
gugaucgcaccacugcauucagccugagcaac

SEQ ID NO: 210034 - RNA, 32 nt, Human
gugaucgcaccacuguacuccagccuggguga

SEQ ID NO: 210035 - RNA, 32 nt, Human
gugaucgcaccacuguauuccagccuggauga

SEQ ID NO: 210036 - RNA, 21 nt, Human
gugaucgccagcgcugucguc

SEQ ID NO: 210037 - RNA, 21 nt, Human
gugaucgggucugcugucauu

SEQ ID NO: 210038 - RNA, 32 nt, Human
gugaucgugacauggccuccagccugggugac

SEQ ID NO: 210039 - RNA, 32 nt, Human
gugaucgugcagcugugagcgcguggccgccc

SEQ ID NO: 210040 - RNA, 32 nt, Human
gugaucgugccacugaccuccagccuggggga

SEQ ID NO: 210041 - RNA, 32 nt, Human
gugaucgugccacugcacuacaaccuggguga

SEQ ID NO: 210042 - RNA, 32 nt, Human
gugaucgugccacugcacuccaaccugaguga

SEQ ID NO: 210043 - RNA, 32 nt, Human
gugaucgugccacugcauuccagccugggaga

SEQ ID NO: 210044 - RNA, 32 nt, Human
gugaucgugcuacugcacuccagccugggcaa

SEQ ID NO: 210045 - RNA, 32 nt, Human
gugaucuaaggguaguccagccuccuuccaag

SEQ ID NO: 210046 - RNA, 32 nt, Human
gugaucuaggcacuuccuccagccucaggcag

SEQ ID NO: 210047 - RNA, 32 nt, Human
gugaucuauaaaugcacagaaaauacuuugua

SEQ ID NO: 210048 - RNA, 32 nt, Human
gugaucuaugucugcugccuggcuccuagaug

SEQ ID NO: 210049 - RNA, 32 nt, Human
gugaucucaccccugcacuccagccugggcaa

SEQ ID NO: 210050 - RNA, 32 nt, Human
gugaucuccaguuuggagcaggggaaggagcc

SEQ ID NO: 210051 - RNA, 32 nt, Human
gugaucucccaccacacuuacugucuuccuuu

SEQ ID NO: 210052 - RNA, 32 nt, Human
gugaucuccggucccuucccccaucauccuuc

SEQ ID NO: 210053 - RNA, 32 nt, Human
gugaucucuccaugcgguucucucacacaagg

SEQ ID NO: 210054 - RNA, 32 nt, Human
gugaucucugcuacacagauaaggaaaccagc

SEQ ID NO: 210055 - RNA, 23 nt, Human
gugaucucuuaauagugccuccu

SEQ ID NO: 210056 - RNA, 32 nt, Human
gugaucugcaaguccugggagacgcacagcua

SEQ ID NO: 210057 - RNA, 32 nt, Human
gugaucugcccaccucugccucccaaagugcu

SEQ ID NO: 210058 - RNA, 32 nt, Human
gugaucugcccuccucagccucccaggugcug

SEQ ID NO: 210059 - RNA, 32 nt, Human
gugaucugcccuccuuggccucccagagugcu

SEQ ID NO: 210060 - RNA, 32 nt, Human
gugaucugccucuucuauugggagaaauucua

SEQ ID NO: 210061 - RNA, 32 nt, Human
gugaucugccugccuuggccucccagauugcu

SEQ ID NO: 210062 - RNA, 32 nt, Human
gugaucuggaauggcccagaucccuuaaaugu

SEQ ID NO: 210063 - RNA, 32 nt, Human
gugaucuguccgccccggccucccagagugcu

SEQ ID NO: 210064 - RNA, 32 nt, Human
gugaucuguggcuggaauggagggagcgccug

SEQ ID NO: 210065 - RNA, 32 nt, Human
gugaucuguguuguagaacaugaggguguaag

SEQ ID NO: 210066 - RNA, 32 nt, Human
gugaucuucccacucagacuccugcguagcug

SEQ ID NO: 210067 - RNA, 32 nt, Human
gugaucuucuaugcuuuaucuuaggaugcugu

SEQ ID NO: 210068 - RNA, 32 nt, Human
gugaucuugccucacuacaaccccugccuccu

SEQ ID NO: 210069 - RNA, 32 nt, Human
gugaucuugugggguggagggaagagaauagc

SEQ ID NO: 210070 - RNA, 32 nt, Human
gugaucuuuccucuccuccuucccaagucauu

SEQ ID NO: 210071 - RNA, 32 nt, Human
gugaucuuuccuguccugacccucucugaauu

SEQ ID NO: 210072 - RNA, 32 nt, Human
gugaugaaaagaaaggaaugagagggaaaguu

SEQ ID NO: 210073 - RNA, 32 nt, Human
gugaugaaagccucuggccucgccacacugau

SEQ ID NO: 210074 - RNA, 32 nt, Human
gugaugaagaaagggcggaagcucccgcuuga

SEQ ID NO: 210075 - RNA, 32 nt, Human
gugaugaagacccagcaacuugcucaaagcau

SEQ ID NO: 210076 - RNA, 32 nt, Human
gugaugaagaugaccucccuccagaccuggcc

SEQ ID NO: 210077 - RNA, 32 nt, Human
gugaugaagcaggcaggagcuggagcgacacu

SEQ ID NO: 210078 - RNA, 28 nt, Human
gugaugaauucugccauguggcaccaga

SEQ ID NO: 210079 - RNA, 32 nt, Human
gugaugacaccacugcacuccaaccuagguaa

SEQ ID NO: 210080 - RNA, 32 nt, Human
gugaugaccagcugcaugaugccuuaauuuga

SEQ ID NO: 210081 - RNA, 32 nt, Human
gugaugacccacccucaccaucgccugggaag

SEQ ID NO: 210082 - RNA, 22 nt, Human
gugaugacucaugccugugauc

SEQ ID NO: 210083 - RNA, 32 nt, Human
gugaugacuggcagcuaaggaggaccucggag

SEQ ID NO: 210084 - RNA, 32 nt, Human
gugaugacuguauaaggaggccuguguguaug

SEQ ID NO: 210085 - RNA, 32 nt, Human
gugaugagaggcuuccucaguccagucgcucc

SEQ ID NO: 210086 - RNA, 32 nt, Human
gugaugagauuauugauagagaguauuagaug

SEQ ID NO: 210087 - RNA, 32 nt, Human
gugaugaggagaggaagagauacaacagaugu

SEQ ID NO: 210088 - RNA, 32 nt, Human
gugaugaggaggcugggugagguggcucaugc

SEQ ID NO: 210089 - RNA, 32 nt, Human
gugaugaggcuucaguugaguacuugcugaag

SEQ ID NO: 210090 - RNA, 32 nt, Human
gugaugagggcaauucuguccuacuguuuuua

SEQ ID NO: 210091 - RNA, 32 nt, Human
gugaugaguagcacugcacugucaccugauga

SEQ ID NO: 210092 - RNA, 23 nt, Human
gugaugagugggccuaguuggga

SEQ ID NO: 210093 - RNA, 32 nt, Human
gugaugaguguggacgggggcaccagucaguu

SEQ ID NO: 210094 - RNA, 32 nt, Human
gugaugauaccuuuugcuuugccuuguggaca

SEQ ID NO: 210095 - RNA, 32 nt, Human
gugaugauggcauuauugauaagccauacaug

SEQ ID NO: 210096 - RNA, 22 nt, Human
gugaugcacaccuguaauccca

SEQ ID NO: 210097 - RNA, 32 nt, Human
gugaugcaccugccuuggcuucccaaggugcu

SEQ ID NO: 210098 - RNA, 28 nt, Human
gugaugcaggacuucuggaggaggagcu

SEQ ID NO: 210099 - RNA, 32 nt, Human
gugaugcagggaggaaaggcagagugggccgg

SEQ ID NO: 210100 - RNA, 32 nt, Human
gugaugccacacagaguggucuuucuggagag

SEQ ID NO: 210101 - RNA, 32 nt, Human
gugaugccaccacugcucccaggagcccacag

SEQ ID NO: 210102 - RNA, 32 nt, Human
gugaugccagcugcuugggaggcugagguggg

SEQ ID NO: 210103 - RNA, 32 nt, Human
gugaugcccacuucuucgccucccucucuugg

SEQ ID NO: 210104 - RNA, 32 nt, Human
gugaugcccauauucauauucucuccucaugu

SEQ ID NO: 210105 - RNA, 32 nt, Human
gugaugcccgggccuucuuccaucuuuuggag

SEQ ID NO: 210106 - RNA, 32 nt, Human
gugaugccgaggguggagugcaguggcacaau

SEQ ID NO: 210107 - RNA, 32 nt, Human
gugaugccgcaccucagucucucccucugcuc

SEQ ID NO: 210108 - RNA, 32 nt, Human
gugaugccugcugaagccacgcagccagugcc

SEQ ID NO: 210109 - RNA, 32 nt, Human
gugaugccuuaugggcuccaucauguuagcca

SEQ ID NO: 210110 - RNA, 32 nt, Human
gugaugcggaacaccaggcucagauucaucag

SEQ ID NO: 210111 - RNA, 32 nt, Human
gugaugcuacugauggccccuuugccaauaag

SEQ ID NO: 210112 - RNA, 32 nt, Human
gugaugcuccugcuucggccuccugaguagcu

SEQ ID NO: 210113 - RNA, 32 nt, Human
gugaugcugagucuggagagaacaguuccgcu

SEQ ID NO: 210114 - RNA, 32 nt, Human
gugaugcuggaaggugggcgucgucacgguua

SEQ ID NO: 210115 - RNA, 32 nt, Human
gugaugcugggcaaggaguacgugggcaagac

SEQ ID NO: 210116 - RNA, 32 nt, Human
gugaugcuggggugaugcugaugcccuuccaa

SEQ ID NO: 210117 - RNA, 32 nt, Human
gugaugcugucugucugucugagucucguggc

SEQ ID NO: 210118 - RNA, 19 nt, Human
gugaugcuuagaaccugga

SEQ ID NO: 210119 - RNA, 32 nt, Human
gugauggaaaccucgccaccuccagaggcagc

SEQ ID NO: 210120 - RNA, 32 nt, Human
gugauggaaauccugcagcuuuaggcuccauu

SEQ ID NO: 210121 - RNA, 32 nt, Human
gugauggaaauuuccacccaaugaaaggaaga

SEQ ID NO: 210122 - RNA, 31 nt, Human
gugauggacagcuagaauguaaaagcuuaaa

SEQ ID NO: 210123 - RNA, 32 nt, Human
gugauggagagcagagggagagggccaggcuc

SEQ ID NO: 210124 - RNA, 32 nt, Human
gugauggagccacccaggcugaucugggccuc

SEQ ID NO: 210125 - RNA, 32 nt, Human
gugauggaggcuguggacagaaacaggucagu

SEQ ID NO: 210126 - RNA, 32 nt, Human
gugauggaggcuguggucagaaacaggucaau

SEQ ID NO: 210127 - RNA, 32 nt, Human
gugauggaggcuguggucagaaacaggucagu

SEQ ID NO: 210128 - RNA, 32 nt, Human
gugauggagggauccuacagaagcccugcuaa

SEQ ID NO: 210129 - RNA, 32 nt, Human
gugauggaguuucuccagaagcuccagugaua

SEQ ID NO: 210130 - RNA, 32 nt, Human
gugauggcaccgcugcacuccaaccugggcaa

SEQ ID NO: 210131 - RNA, 32 nt, Human
gugauggcaggcaucuguagucccagcuacuu

SEQ ID NO: 210132 - RNA, 32 nt, Human
gugauggccacuguaucauuccaggcuaccua

SEQ ID NO: 210133 - RNA, 32 nt, Human
gugauggccacuucuaauaauucagguaguua

SEQ ID NO: 210134 - RNA, 32 nt, Human
gugauggccucuuccuccucagggaccucuga

SEQ ID NO: 210135 - RNA, 32 nt, Human
gugauggcgccacugcacuccagucugggcaa

SEQ ID NO: 210136 - RNA, 32 nt, Human
gugauggcgccacugcacuucagccuuggaga

SEQ ID NO: 210137 - RNA, 32 nt, Human
gugauggcgucaguguucuccagccugggcaa

SEQ ID NO: 210138 - RNA, 23 nt, Human
gugauggcucacaccuguaaucc

SEQ ID NO: 210139 - RNA, 32 nt, Human
gugauggcucacaccuguaauuccagcacuuu

SEQ ID NO: 210140 - RNA, 22 nt, Human
gugauggcucacgccuguaauc

SEQ ID NO: 210141 - RNA, 23 nt, Human
gugauggcucacgccuguaaucc

SEQ ID NO: 210142 - RNA, 22 nt, Human
gugauggcucaugccuguaauc

SEQ ID NO: 210143 - RNA, 23 nt, Human
gugauggcucaugccuguaaucc

SEQ ID NO: 210144 - RNA, 32 nt, Human
gugauggcucaugccuguaauccaguacuuua

SEQ ID NO: 210145 - RNA, 32 nt, Human
gugauggcuccagagaacacaccagcuauuua

SEQ ID NO: 210146 - RNA, 32 nt, Human
gugauggcugugagggaggaaugaggauagac

SEQ ID NO: 210147 - RNA, 28 nt, Human
gugaugggaaaagauuauuacaagauuc

SEQ ID NO: 210148 - RNA, 32 nt, Human
gugaugggaagagauuaccuagccuuacuaac

SEQ ID NO: 210149 - RNA, 32 nt, Human
gugaugggaaugcagagacaggaggcagccca

SEQ ID NO: 210150 - RNA, 32 nt, Human
gugaugggagaggcacaugagguugggggccu

SEQ ID NO: 210151 - RNA, 32 nt, Human
gugaugggcauugagccacaccucuucuuaga

SEQ ID NO: 210152 - RNA, 19 nt, Human
gugaugggcccugucccug

SEQ ID NO: 210153 - RNA, 32 nt, Human
gugaugggccugaaguggaggcugcucagcac

SEQ ID NO: 210154 - RNA, 32 nt, Human
gugauggggaaccuggguuccucuauaagaua

SEQ ID NO: 210155 - RNA, 32 nt, Human
gugauggggacccccucgcugucuccacagga

SEQ ID NO: 210156 - RNA, 32 nt, Human
gugauggggacgauucugcccaguguccucag

SEQ ID NO: 210157 - RNA, 32 nt, Human
gugauggggcccugccuccuuugugaggaagc

SEQ ID NO: 210158 - RNA, 32 nt, Human
gugauggggcuauauugaaucucuguaugcac

SEQ ID NO: 210159 - RNA, 32 nt, Human
gugauggggucugaggcuuggugggagcuguc

SEQ ID NO: 210160 - RNA, 32 nt, Human
gugaugggguuucgcacuuguugcccaggcug

SEQ ID NO: 210161 - RNA, 32 nt, Human
gugaugggguuuugcucuuguugcccaggcug

SEQ ID NO: 210162 - RNA, 32 nt, Human
gugauggguuauaucauaaaugcagcuugggg

SEQ ID NO: 210163 - RNA, 32 nt, Human
gugaugguagaagucucgcauggccauuaucu

SEQ ID NO: 210164 - RNA, 32 nt, Human
gugaugguccagaauuaugagaaccuggucuc

SEQ ID NO: 210165 - RNA, 32 nt, Human
gugauggugaguggguacagacuaggaggacg

SEQ ID NO: 210166 - RNA, 32 nt, Human
gugauggugccacugcacuccagccugggugg

SEQ ID NO: 210167 - RNA, 32 nt, Human
gugauggugccgggaggaaggaagcgcaguga

SEQ ID NO: 210168 - RNA, 32 nt, Human
gugaugguggggugagggaauaugagugcgug

SEQ ID NO: 210169 - RNA, 32 nt, Human
gugauguagugugguucucauuuuaaaccuug

SEQ ID NO: 210170 - RNA, 32 nt, Human
gugauguauacaggaaaacuuagugggaucau

SEQ ID NO: 210171 - RNA, 28 nt, Human
gugaugucaaagaagccagcagaggaaa

SEQ ID NO: 210172 - RNA, 32 nt, Human
gugaugucacugaugacaucacggccacugug

SEQ ID NO: 210173 - RNA, 18 nt, Human
gugaugucagaagaaaug

SEQ ID NO: 210174 - RNA, 32 nt, Human
gugauguccccuuucccugccaccuccagccu

SEQ ID NO: 210175 - RNA, 32 nt, Human
gugauguccucuucauucuucucagcugaggc

SEQ ID NO: 210176 - RNA, 32 nt, Human
gugaugucggcugggugcaguggcucaugccu

SEQ ID NO: 210177 - RNA, 32 nt, Human
gugaugucucucucccagcccuuauaugugga

SEQ ID NO: 210178 - RNA, 32 nt, Human
gugaugucuuuuagcagaaucaugaagaccuu

SEQ ID NO: 210179 - RNA, 32 nt, Human
gugaugugacagccaccaaguccauggucuga

SEQ ID NO: 210180 - RNA, 31 nt, Human
gugaugugacuuuucuucuuacaugcugaau

SEQ ID NO: 210181 - RNA, 32 nt, Human
gugaugugagucugggcugggccacagguccg

SEQ ID NO: 210182 - RNA, 32 nt, Human
gugauguggaugagugaagggagccagguaca

SEQ ID NO: 210183 - RNA, 32 nt, Human
gugauguggauggggccccagauggaagguuu

SEQ ID NO: 210184 - RNA, 31 nt, Human
gugaugugggugggggaggaagaguaaacac

SEQ ID NO: 210185 - RNA, 32 nt, Human
gugauguguagcccccuccaccuuuccacuca

SEQ ID NO: 210186 - RNA, 23 nt, Human
gugauguuaccuagcuucccucu

SEQ ID NO: 210187 - RNA, 32 nt, Human
gugauguuacuguaguggucucagggaaagga

SEQ ID NO: 210188 - RNA, 32 nt, Human
gugauguuagguaauggugagguggaucuucc

SEQ ID NO: 210189 - RNA, 32 nt, Human
gugauguucacagagaaggaaauacuuaggca

SEQ ID NO: 210190 - RNA, 32 nt, Human
gugauguucugaacugcucccuucccuccguu

SEQ ID NO: 210191 - RNA, 32 nt, Human
gugauguucuucucccuguguccauguguucu

SEQ ID NO: 210192 - RNA, 32 nt, Human
gugauguugcaaccuuuccuucugcuagggug

SEQ ID NO: 210193 - RNA, 32 nt, Human
gugauguugcccaggcuagagugcaguggcac

SEQ ID NO: 210194 - RNA, 32 nt, Human
gugauguuuccaaugcugaaugccuguuagca

SEQ ID NO: 210195 - RNA, 32 nt, Human
gugauguuuucucuucucccugccuuuccucu

SEQ ID NO: 210196 - RNA, 32 nt, Human
gugauuaagaagaugguuuuguuauuaaauag

SEQ ID NO: 210197 - RNA, 32 nt, Human
gugauuaagccuucaguuauccuaauucccuu

SEQ ID NO: 210198 - RNA, 32 nt, Human
gugauuaaguugagcaugcuccgcucuacuga

SEQ ID NO: 210199 - RNA, 32 nt, Human
gugauuaauggcagagugugguggcucaggcc

SEQ ID NO: 210200 - RNA, 32 nt, Human
gugauuaauucuuucauggauuuccuauguaa

SEQ ID NO: 210201 - RNA, 32 nt, Human
gugauuacaagaaaaaugcuaagucccagcua

SEQ ID NO: 210202 - RNA, 32 nt, Human
gugauuaccucacugcauuccagccugggcaa

SEQ ID NO: 210203 - RNA, 32 nt, Human
gugauuagacaggcccagugagccgcggggca

SEQ ID NO: 210204 - RNA, 32 nt, Human
gugauuagugauguuggaagcauuuuagcaca

SEQ ID NO: 210205 - RNA, 32 nt, Human
gugauuaucaccugugaggggaaagggggugc

SEQ ID NO: 210206 - RNA, 32 nt, Human
gugauuaucguugccacugaagguucaucaag

SEQ ID NO: 210207 - RNA, 32 nt, Human
gugauuaugccauugcacuccagccuggguga

SEQ ID NO: 210208 - RNA, 32 nt, Human
gugauucaaugccucuggcucuacacauauaa

SEQ ID NO: 210209 - RNA, 32 nt, Human
gugauucaauguuauaaaacaagcagaauuuu

SEQ ID NO: 210210 - RNA, 32 nt, Human
gugauucacagugugaaucuuggugucuacgu

SEQ ID NO: 210211 - RNA, 22 nt, Human
gugauucacgccuguaauccca

SEQ ID NO: 210212 - RNA, 32 nt, Human
gugauucauaccaacagaggacuuucugugau

SEQ ID NO: 210213 - RNA, 32 nt, Human
gugauuccacuacaccuggcugagguuccucu

SEQ ID NO: 210214 - RNA, 32 nt, Human
gugauuccaguucugaagaggauuaugauuga

SEQ ID NO: 210215 - RNA, 32 nt, Human
gugauucccacacauccuuccugcaucccccg

SEQ ID NO: 210216 - RNA, 32 nt, Human
gugauucccccagaggaagcagaaggaaguua

SEQ ID NO: 210217 - RNA, 19 nt, Human
gugauucccccugcccuug

SEQ ID NO: 210218 - RNA, 32 nt, Human
gugauucccccuugcccaucagagaggagcau

SEQ ID NO: 210219 - RNA, 32 nt, Human
gugauucccgcgcuccggcuccggaccggcgc

SEQ ID NO: 210220 - RNA, 32 nt, Human
gugauuccucaaggaucuagaaccagaaauau

SEQ ID NO: 210221 - RNA, 32 nt, Human
gugauuccuuaauggccaacugaagauugaau

SEQ ID NO: 210222 - RNA, 32 nt, Human
gugauucgggcagccagggacaggagccaccc

SEQ ID NO: 210223 - RNA, 32 nt, Human
gugauucuagcacaaacuguaagaaugcuguu

SEQ ID NO: 210224 - RNA, 31 nt, Human
gugauucuaguugggagaguuggagagaagg

SEQ ID NO: 210225 - RNA, 32 nt, Human
gugauucuccagccucagccuccugaguagcu

SEQ ID NO: 210226 - RNA, 32 nt, Human
gugauucuccugccucagccucccagguagcu

SEQ ID NO: 210227 - RNA, 32 nt, Human
gugauucuccugccucagccuccugaggagcu

SEQ ID NO: 210228 - RNA, 32 nt, Human
gugauucuccugccucugccuccugaguagcu

SEQ ID NO: 210229 - RNA, 32 nt, Human
gugauucucgccugcuuucucaucucagggga

SEQ ID NO: 210230 - RNA, 32 nt, Human
gugauucucgugccucagccuccugaguagcc

SEQ ID NO: 210231 - RNA, 32 nt, Human
gugauucucgugccucagccuccugaguagcu

SEQ ID NO: 210232 - RNA, 32 nt, Human
gugauucucuagccuuagccuccuggcaucug

SEQ ID NO: 210233 - RNA, 32 nt, Human
gugauucugaagagguggcuugggaguuggga

SEQ ID NO: 210234 - RNA, 32 nt, Human
gugauucugacuagugggaaauuucagauuac

SEQ ID NO: 210235 - RNA, 32 nt, Human
gugauucugagagcugccugacucgcgaauca

SEQ ID NO: 210236 - RNA, 21 nt, Human
gugauucugccuguaauccca

SEQ ID NO: 210237 - RNA, 32 nt, Human
gugauucugccuguaaucccagaauuuuggga

SEQ ID NO: 210238 - RNA, 32 nt, Human
gugauucuggaaaaccuuggaugggccuucgu

SEQ ID NO: 210239 - RNA, 32 nt, Human
gugauucuucuccaaaauugagaaagacagca

SEQ ID NO: 210240 - RNA, 32 nt, Human
gugauucuugugccucagccuccugaguagcu

SEQ ID NO: 210241 - RNA, 22 nt, Human
gugauugaaugucgggcaaggc

SEQ ID NO: 210242 - RNA, 32 nt, Human
gugauugagccacugcacuccaaucuggguga

SEQ ID NO: 210243 - RNA, 32 nt, Human
gugauugaggcauacuaucaaucacaaaagua

SEQ ID NO: 210244 - RNA, 32 nt, Human
gugauugcaccaccacacuccagccuggguga

SEQ ID NO: 210245 - RNA, 32 nt, Human
gugauugcaccacugcacucaagccugggcaa

SEQ ID NO: 210246 - RNA, 32 nt, Human
gugauugcaccacugcacuccagccugaguga

SEQ ID NO: 210247 - RNA, 32 nt, Human
gugauugcaccacugcacuccagccugggcga

SEQ ID NO: 210248 - RNA, 32 nt, Human
gugauugcaccacugcacuccagccuggguga

SEQ ID NO: 210249 - RNA, 32 nt, Human
gugauugcaccacugcacuucagcuugggcaa

SEQ ID NO: 210250 - RNA, 32 nt, Human
gugauugcaccacugcacuuuagucuggguga

SEQ ID NO: 210251 - RNA, 32 nt, Human
gugauugcaccacuguacuccagacuggauaa

SEQ ID NO: 210252 - RNA, 32 nt, Human
gugauugcaccacuuguaacuccagccugggc

SEQ ID NO: 210253 - RNA, 32 nt, Human
gugauugcaccgugacacuccagccugggcaa

SEQ ID NO: 210254 - RNA, 32 nt, Human
gugauugcacgacugcacuccagccugggcaa

SEQ ID NO: 210255 - RNA, 32 nt, Human
gugauugcagugagcugagauagcaccacugc

SEQ ID NO: 210256 - RNA, 32 nt, Human
gugauugccaguuuauuugcagucucuuaaug

SEQ ID NO: 210257 - RNA, 32 nt, Human
gugauugccccauuuccucuggcaacaaaagc

SEQ ID NO: 210258 - RNA, 32 nt, Human
gugauugcccugaagccacacagcuaaccaga

SEQ ID NO: 210259 - RNA, 32 nt, Human
gugauugcgccacagcauuccagccugggcga

SEQ ID NO: 210260 - RNA, 32 nt, Human
gugauugcgccacugcauuccagcuugggcga

SEQ ID NO: 210261 - RNA, 32 nt, Human
gugauuggaauggauuuaaagcgucaauucca

SEQ ID NO: 210262 - RNA, 32 nt, Human
gugauuggcuagugauucuuguuuucagaagg

SEQ ID NO: 210263 - RNA, 32 nt, Human
gugauuggcuuccucucgccguguugugaggg

SEQ ID NO: 210264 - RNA, 19 nt, Human
gugauuggguccaggcugg

SEQ ID NO: 210265 - RNA, 32 nt, Human
gugauugggugaggcccagacagacagcugcg

SEQ ID NO: 210266 - RNA, 32 nt, Human
gugauugguccagggaugggcacaugacugag

SEQ ID NO: 210267 - RNA, 32 nt, Human
gugauugguuacugaucaugacaugcauuugu

SEQ ID NO: 210268 - RNA, 32 nt, Human
gugauuguaccacugcacuccagcucggggaa

SEQ ID NO: 210269 - RNA, 32 nt, Human
gugauuguccugccucagccuccugaguagcu

SEQ ID NO: 210270 - RNA, 32 nt, Human
gugauuguccuggaaaucgaggugaaaggcuc

SEQ ID NO: 210271 - RNA, 32 nt, Human
gugauugugacacugcccuccagccuggguga

SEQ ID NO: 210272 - RNA, 32 nt, Human
gugauugugccacugcacucauccuggaagac

SEQ ID NO: 210273 - RNA, 32 nt, Human
gugauugugccacugcacuccagccugggcaa

SEQ ID NO: 210274 - RNA, 32 nt, Human
gugauugugccacugcacuccagccugggcac

SEQ ID NO: 210275 - RNA, 32 nt, Human
gugauugugccacugcacuccagccugggcca

SEQ ID NO: 210276 - RNA, 32 nt, Human
gugauugugccacugcacuccagccugggcga

SEQ ID NO: 210277 - RNA, 32 nt, Human
gugauugugccacugcacuccagccuggguua

SEQ ID NO: 210278 - RNA, 32 nt, Human
gugauugugccacuguacuccagccuggguga

SEQ ID NO: 210279 - RNA, 32 nt, Human
gugauugugccacuguuuuccagccugggcaa

SEQ ID NO: 210280 - RNA, 32 nt, Human
gugauugugccauugcacuccagccuggacaa

SEQ ID NO: 210281 - RNA, 32 nt, Human
gugauugugccauugcacuccagccuggguga

SEQ ID NO: 210282 - RNA, 32 nt, Human
gugauugugccauuguacuccagccugggcga

SEQ ID NO: 210283 - RNA, 20 nt, Human
gugauuguggggccaggcug

SEQ ID NO: 210284 - RNA, 32 nt, Human
gugauuguuagagguaguuuucuugaauuaau

SEQ ID NO: 210285 - RNA, 32 nt, Human
gugauuguuuauggaaaguaucuuuaauaaag

SEQ ID NO: 210286 - RNA, 32 nt, Human
gugauuuacagugggaaugaaagaacagauua

SEQ ID NO: 210287 - RNA, 32 nt, Human
gugauuuaguacaucuuacaugauaucucauu

SEQ ID NO: 210288 - RNA, 32 nt, Human
gugauuuauguguuaaccucagucacgagguu

SEQ ID NO: 210289 - RNA, 32 nt, Human
gugauuucacacccgccuuucuugaauggcuu

SEQ ID NO: 210290 - RNA, 32 nt, Human
gugauuucaccaccacuccagccugggugaga

SEQ ID NO: 210291 - RNA, 32 nt, Human
gugauuucacccuugcauuccagccugugaaa

SEQ ID NO: 210292 - RNA, 32 nt, Human
gugauuucagagagggcagagggguaggcaga

SEQ ID NO: 210293 - RNA, 32 nt, Human
gugauuucauacaaucagcagcaaguaacugu

SEQ ID NO: 210294 - RNA, 32 nt, Human
gugauuucauucucuuuuauuaauuuaaaaau

SEQ ID NO: 210295 - RNA, 21 nt, Human
gugauuucccuuagcuuccuc

SEQ ID NO: 210296 - RNA, 32 nt, Human
gugauuuccuuaaaaugaccuacugagucagu

SEQ ID NO: 210297 - RNA, 32 nt, Human
gugauuucucaagcuccuugggggacuguugu

SEQ ID NO: 210298 - RNA, 32 nt, Human
gugauuugagucugaggaagagcugagaguuu

SEQ ID NO: 210299 - RNA, 32 nt, Human
gugauuuguuuuucagccuggccugcagacua

SEQ ID NO: 210300 - RNA, 18 nt, Human
gugauuuucagccucauc

SEQ ID NO: 210301 - RNA, 19 nt, Human
gugauuuucaguuguuauc

SEQ ID NO: 210302 - RNA, 18 nt, Human
gugauuuuccuugccauc

SEQ ID NO: 210303 - RNA, 18 nt, Human
gugauuuucuggcuguca

SEQ ID NO: 210304 - RNA, 20 nt, Human
gugauuuugacgugcgcauc

SEQ ID NO: 210305 - RNA, 20 nt, Human
gugauuuugauagcgucauu

SEQ ID NO: 210306 - RNA, 32 nt, Human
gugauuuugccacugcacuccugccuggguga

SEQ ID NO: 210307 - RNA, 20 nt, Human
gugauuuuggggaggucauu

SEQ ID NO: 210308 - RNA, 16 nt, Human
gugauuuugguucauc

SEQ ID NO: 210309 - RNA, 32 nt, Human
gugauuuuucugcuuuaccuuuuuccugucag

SEQ ID NO: 210310 - RNA, 32 nt, Human
gugcaaaaggaaaucuucaggaggggacuucu

SEQ ID NO: 210311 - RNA, 32 nt, Human
gugcaaaauacugaguaaccacugggaaaaua

SEQ ID NO: 210312 - RNA, 19 nt, Human
gugcaaaauuaaaccauua

SEQ ID NO: 210313 - RNA, 32 nt, Human
gugcaaacaaaaggugugccuggcagccauuu

SEQ ID NO: 210314 - RNA, 32 nt, Human
gugcaaacaauccacuucuucaagcuccaaca

SEQ ID NO: 210315 - RNA, 32 nt, Human
gugcaaaccaucugccccagcugccuccacag

SEQ ID NO: 210316 - RNA, 32 nt, Human
gugcaaacgcuaugccauugcccaucagggac

SEQ ID NO: 210317 - RNA, 32 nt, Human
gugcaaacugggacugccuuucccucuccuca

SEQ ID NO: 210318 - RNA, 32 nt, Human
gugcaaacuuuaagcaccuuaaaacauuuaaa

SEQ ID NO: 210319 - RNA, 32 nt, Human
gugcaaagaaaaucauuggcucagauugcaac

SEQ ID NO: 210320 - RNA, 32 nt, Human
gugcaaaggguuucugaaaaacagcaggauua

SEQ ID NO: 210321 - RNA, 32 nt, Human
gugcaaagugcuggguucuggguuucuggauu

SEQ ID NO: 210322 - RNA, 32 nt, Human
gugcaaauaaugaaggagcacgggggcaccuu

SEQ ID NO: 210323 - RNA, 32 nt, Human
gugcaaaucaugacacagaagggcaguaugaa

SEQ ID NO: 210324 - RNA, 32 nt, Human
gugcaacacccagcaaaaaugaagaggaaaac

SEQ ID NO: 210325 - RNA, 32 nt, Human
gugcaacacuacucaaacugugguucacaaag

SEQ ID NO: 210326 - RNA, 32 nt, Human
gugcaacagcuguucugaauugucuuccgcua

SEQ ID NO: 210327 - RNA, 32 nt, Human
gugcaacaucaugaaacaucaucucuacauaa

SEQ ID NO: 210328 - RNA, 32 nt, Human
gugcaacauugucuuguggccuagagacuaga

SEQ ID NO: 210329 - RNA, 32 nt, Human
gugcaacccccagcccaggaggagacuugacu

SEQ ID NO: 210330 - RNA, 32 nt, Human
gugcaaccucauugaaaaacagcuuggcaguu

SEQ ID NO: 210331 - RNA, 32 nt, Human
gugcaaccucugcuucccagguucaagcgauu

SEQ ID NO: 210332 - RNA, 32 nt, Human
gugcaaccuguaaaaggucucuccacaccagg

SEQ ID NO: 210333 - RNA, 32 nt, Human
gugcaacuagaaaauucaaagccauauuuagg

SEQ ID NO: 210334 - RNA, 32 nt, Human
gugcaacucaucgccucugccacuuaggacca

SEQ ID NO: 210335 - RNA, 32 nt, Human
gugcaacugcacuccaaccugggcaacagagu

SEQ ID NO: 210336 - RNA, 32 nt, Human
gugcaacugcacuccagccugggcaaaagagc

SEQ ID NO: 210337 - RNA, 32 nt, Human
gugcaacugugcuggcugccuccugaaggaag

SEQ ID NO: 210338 - RNA, 32 nt, Human
gugcaacuuaugaagacacugcagcuugagag

SEQ ID NO: 210339 - RNA, 32 nt, Human
gugcaagaaagugagcagucugccugugagug

SEQ ID NO: 210340 - RNA, 32 nt, Human
gugcaagaagacugaaggguccagaguccaug

SEQ ID NO: 210341 - RNA, 32 nt, Human
gugcaagagagggaugcauggagauagcccca

SEQ ID NO: 210342 - RNA, 32 nt, Human
gugcaagauccuguggauuagaaacaaguugc

SEQ ID NO: 210343 - RNA, 32 nt, Human
gugcaagaugaagaagccaacacagaugaccu

SEQ ID NO: 210344 - RNA, 32 nt, Human
gugcaagauugcaaaaagacugugcaaccuga

SEQ ID NO: 210345 - RNA, 32 nt, Human
gugcaagcaauuauccugccucagccucccga

SEQ ID NO: 210346 - RNA, 32 nt, Human
gugcaagcgauuccccugccucagcuucccga

SEQ ID NO: 210347 - RNA, 32 nt, Human
gugcaagcuuugaaccuccuuccacagccgca

SEQ ID NO: 210348 - RNA, 17 nt, Human
gugcaaggcccgggcgg

SEQ ID NO: 210349 - RNA, 32 nt, Human
gugcaagggcugggggucuccugccucuccug

SEQ ID NO: 210350 - RNA, 32 nt, Human
gugcaagucaccauucugccuuccuaaggcag

SEQ ID NO: 210351 - RNA, 32 nt, Human
gugcaagucuccccaacagccucgaguggccu

SEQ ID NO: 210352 - RNA, 32 nt, Human
gugcaagugaugccccugccucagccucccga

SEQ ID NO: 210353 - RNA, 32 nt, Human
gugcaaguggucacucucuugcugagcagaaa

SEQ ID NO: 210354 - RNA, 32 nt, Human
gugcaaguucucuccuguugcccugagugccc

SEQ ID NO: 210355 - RNA, 32 nt, Human
gugcaaguugaccuuaugcccaugccuccaua

SEQ ID NO: 210356 - RNA, 20 nt, Human
gugcaauacaguuucauuaa

SEQ ID NO: 210357 - RNA, 32 nt, Human
gugcaauacucccauugccaugggguccuuca

SEQ ID NO: 210358 - RNA, 32 nt, Human
gugcaauaggcagaggacaagggacacaucac

SEQ ID NO: 210359 - RNA, 32 nt, Human
gugcaauaggugagagaauguauuuucauaga

SEQ ID NO: 210360 - RNA, 32 nt, Human
gugcaaucucacugcaaccuccgccuuccagu

SEQ ID NO: 210361 - RNA, 32 nt, Human
gugcaaucucacugcaagcucugccucccagg

SEQ ID NO: 210362 - RNA, 32 nt, Human
gugcaaucucagcucacugcaaccuccgccuc

SEQ ID NO: 210363 - RNA, 32 nt, Human
gugcaaucucaguucacugcagucucugccuc

SEQ ID NO: 210364 - RNA, 32 nt, Human
gugcaaugacugcagcaccuccugggcuuaca

SEQ ID NO: 210365 - RNA, 32 nt, Human
gugcaaugcacacccagacacacgcacgcaca

SEQ ID NO: 210366 - RNA, 24 nt, Human
gugcaauggcaugcaucuguaauc

SEQ ID NO: 210367 - RNA, 24 nt, Human
gugcaauggcucacaccuguaauu

SEQ ID NO: 210368 - RNA, 24 nt, Human
gugcaauggcucacacuuguaauc

SEQ ID NO: 210369 - RNA, 24 nt, Human
gugcaauggcucaugccuauaauc

SEQ ID NO: 210370 - RNA, 24 nt, Human
gugcaauggcucaugccuguaauc

SEQ ID NO: 210371 - RNA, 24 nt, Human
gugcaauggcucaugucucuaauc

SEQ ID NO: 210372 - RNA, 24 nt, Human
gugcaauggcucgcaccuguaauc

SEQ ID NO: 210373 - RNA, 31 nt, Human
gugcaaugggugaucucagcucacugcaggc

SEQ ID NO: 210374 - RNA, 32 nt, Human
gugcaaugucugccugcaucccucuaucaggg

SEQ ID NO: 210375 - RNA, 32 nt, Human
gugcaaugugccagccacuuggaacugcuaac

SEQ ID NO: 210376 - RNA, 32 nt, Human
gugcaaugugguuaugauagaggcaugccagg

SEQ ID NO: 210377 - RNA, 32 nt, Human
gugcaauucuugcccaaaggcaaggagaugaa

SEQ ID NO: 210378 - RNA, 32 nt, Human
gugcaauugcuuuugcaccaaccuaauauuug

SEQ ID NO: 210379 - RNA, 32 nt, Human
gugcacaacagcuguguggcccggagugagau

SEQ ID NO: 210380 - RNA, 32 nt, Human
gugcacaagggcccagaacaacucugaugcca

SEQ ID NO: 210381 - RNA, 16 nt, Human
gugcacacaugggcgg

SEQ ID NO: 210382 - RNA, 19 nt, Human
gugcacaccuguaauccca

SEQ ID NO: 210383 - RNA, 32 nt, Human
gugcacaccuguaaucccagcuacucuggagg

SEQ ID NO: 210384 - RNA, 32 nt, Human
gugcacacuaaaauaucaaaucaaggugcuug

SEQ ID NO: 210385 - RNA, 32 nt, Human
gugcacacuaccuggaggacaagaggaaguaa

SEQ ID NO: 210386 - RNA, 32 nt, Human
gugcacacuucccaugcuucugagucuaggcg

SEQ ID NO: 210387 - RNA, 32 nt, Human
gugcacagacagguacugagcugacagacugg

SEQ ID NO: 210388 - RNA, 32 nt, Human
gugcacagaccaggucauugugcagcggucuc

SEQ ID NO: 210389 - RNA, 32 nt, Human
gugcacagaccagugccaaucugaacauuguu

SEQ ID NO: 210390 - RNA, 32 nt, Human
gugcacagagaguccucagagcacaagcgugg

SEQ ID NO: 210391 - RNA, 32 nt, Human
gugcacagaggacaaguacugccaggcacaga

SEQ ID NO: 210392 - RNA, 32 nt, Human
gugcacagcucaaaagacauucagagauggaa

SEQ ID NO: 210393 - RNA, 32 nt, Human
gugcacagcucccucuuuaauaaacgcuuagg

SEQ ID NO: 210394 - RNA, 32 nt, Human
gugcacaggaaggaugaggaagaccaggcucu

SEQ ID NO: 210395 - RNA, 32 nt, Human
gugcacaggagagaggcucagagagcugggaa

SEQ ID NO: 210396 - RNA, 32 nt, Human
gugcacagggagaagagaagcagacgggagca

SEQ ID NO: 210397 - RNA, 32 nt, Human
gugcacagggcuagaacgagagugccuccccu

SEQ ID NO: 210398 - RNA, 32 nt, Human
gugcacaggugagcaguugugugcccagcaua

SEQ ID NO: 210399 - RNA, 32 nt, Human
gugcacagugcuaggacgggaggcagagccgg

SEQ ID NO: 210400 - RNA, 21 nt, Human
gugcacauacagcauuuccua

SEQ ID NO: 210401 - RNA, 32 nt, Human
gugcacaucacugaaauaaugagauuuucuuc

SEQ ID NO: 210402 - RNA, 32 nt, Human
gugcacaucagcucacaugacuggcaacucua

SEQ ID NO: 210403 - RNA, 32 nt, Human
gugcacauccccaaggguaagagcuucgaucu

SEQ ID NO: 210404 - RNA, 32 nt, Human
gugcacaucuucccucuccccauucggugugg

SEQ ID NO: 210405 - RNA, 32 nt, Human
gugcacaugaggaagauacuguagaggcauuu

SEQ ID NO: 210406 - RNA, 32 nt, Human
gugcacauggccugaggcguccauggugaugg

SEQ ID NO: 210407 - RNA, 32 nt, Human
gugcacauguggguauguucucagccaugugu

SEQ ID NO: 210408 - RNA, 32 nt, Human
gugcacaugugugcacagacacaaaacagaga

SEQ ID NO: 210409 - RNA, 20 nt, Human
gugcaccaccuggcccggca

SEQ ID NO: 210410 - RNA, 32 nt, Human
gugcaccacugcacuccagccugggcaacaag

SEQ ID NO: 210411 - RNA, 32 nt, Human
gugcaccacugcacuccagccugggcaacaga

SEQ ID NO: 210412 - RNA, 31 nt, Human
gugcaccagagagugcacuugggcgagcgcu

SEQ ID NO: 210413 - RNA, 32 nt, Human
gugcaccagcucaaacaugcaggcuggaacgu

SEQ ID NO: 210414 - RNA, 32 nt, Human
gugcaccaugaagagacaguguccagaagaag

SEQ ID NO: 210415 - RNA, 32 nt, Human
gugcaccauguacagguguugugugcaacaac

SEQ ID NO: 210416 - RNA, 32 nt, Human
gugcaccauugcacuccagccugggcaaaaag

SEQ ID NO: 210417 - RNA, 32 nt, Human
gugcacccagcuugauguccacuggacacugg

SEQ ID NO: 210418 - RNA, 32 nt, Human
gugcacccauagucccagcuacucaggaggcu

SEQ ID NO: 210419 - RNA, 32 nt, Human
gugcacccccuucacagacacugaccucagag

SEQ ID NO: 210420 - RNA, 32 nt, Human
gugcaccccucgggccaggcaacagaacuugu

SEQ ID NO: 210421 - RNA, 32 nt, Human
gugcacccugaccccauucagcagaaauugca

SEQ ID NO: 210422 - RNA, 32 nt, Human
gugcacccugcucucucgugggucgccuuugc

SEQ ID NO: 210423 - RNA, 32 nt, Human
gugcacccugggaggggaagcugggagaaagg

SEQ ID NO: 210424 - RNA, 32 nt, Human
gugcacccuucccacacccuuuacauucccca

SEQ ID NO: 210425 - RNA, 32 nt, Human
gugcacccuuugaagggacccagcacaggguc

SEQ ID NO: 210426 - RNA, 32 nt, Human
gugcaccguagugccuugggccuguguguuaa

SEQ ID NO: 210427 - RNA, 32 nt, Human
gugcaccuaagcugcagaccaagccuuugccc

SEQ ID NO: 210428 - RNA, 32 nt, Human
gugcaccuauaauuccagcuacucaggaggcu

SEQ ID NO: 210429 - RNA, 32 nt, Human
gugcaccuauagucccagcuacucaggaagcu

SEQ ID NO: 210430 - RNA, 32 nt, Human
gugcaccuauagucccagcuacucaggaggcu

SEQ ID NO: 210431 - RNA, 32 nt, Human
gugcaccuauagucccagcuacuugggaggcu

SEQ ID NO: 210432 - RNA, 32 nt, Human
gugcaccuauagucccagcuauucaggaggcu

SEQ ID NO: 210433 - RNA, 32 nt, Human
gugcaccugauuuggccaauaggaucaacagu

SEQ ID NO: 210434 - RNA, 32 nt, Human
gugcaccugcaauccucgccgauaagaggcag

SEQ ID NO: 210435 - RNA, 17 nt, Human
gugcaccugcccagggg

SEQ ID NO: 210436 - RNA, 32 nt, Human
gugcaccuguaaucccagcuacuagggaggau

SEQ ID NO: 210437 - RNA, 32 nt, Human
gugcaccuguaaucccagcuacucaggaggcu

SEQ ID NO: 210438 - RNA, 32 nt, Human
gugcaccuguaaucccagcuacucgagaggcc

SEQ ID NO: 210439 - RNA, 32 nt, Human
gugcaccuguaaucccagcuacucgggaggcu

SEQ ID NO: 210440 - RNA, 32 nt, Human
gugcaccuguaaucccagcuacucuggaggcu

SEQ ID NO: 210441 - RNA, 32 nt, Human
gugcaccuguaaucccagcuacucuggagggu

SEQ ID NO: 210442 - RNA, 32 nt, Human
gugcaccuguaaucccagcuacuugggaggcu

SEQ ID NO: 210443 - RNA, 32 nt, Human
gugcaccuguaauccccgcuacucuggagucu

SEQ ID NO: 210444 - RNA, 32 nt, Human
gugcaccuguaauccuagcuaccgagaaggcu

SEQ ID NO: 210445 - RNA, 32 nt, Human
gugcaccuguaaucucagcuacucgggaggcu

SEQ ID NO: 210446 - RNA, 32 nt, Human
gugcaccuguaauuccagcuacucgggaggcu

SEQ ID NO: 210447 - RNA, 32 nt, Human
gugcaccuguagucacagcuacucgggaggcg

SEQ ID NO: 210448 - RNA, 32 nt, Human
gugcaccuguagucccagcuacuagggaggcu

SEQ ID NO: 210449 - RNA, 32 nt, Human
gugcaccuguagucccagcuacucaggaggcc

SEQ ID NO: 210450 - RNA, 32 nt, Human
gugcaccuguagucccagcuacucaggaggcu

SEQ ID NO: 210451 - RNA, 32 nt, Human
gugcaccuguagucccagcuacucgggaagcu

SEQ ID NO: 210452 - RNA, 32 nt, Human
gugcaccuguagucccagcuacucgggggcug

SEQ ID NO: 210453 - RNA, 32 nt, Human
gugcaccuguagucccagcuacuugggaggcu

SEQ ID NO: 210454 - RNA, 32 nt, Human
gugcaccuguagucccagcuauaugggaugcu

SEQ ID NO: 210455 - RNA, 32 nt, Human
gugcaccuguagucccagcuauucaggaagcu

SEQ ID NO: 210456 - RNA, 32 nt, Human
gugcaccuguagucccagcuauuugggaggcu

SEQ ID NO: 210457 - RNA, 32 nt, Human
gugcaccuguagucccagcucuucaggaggcu

SEQ ID NO: 210458 - RNA, 32 nt, Human
gugcaccuguagucccagcuguuugggaagcu

SEQ ID NO: 210459 - RNA, 32 nt, Human
gugcaccuguagucccagcuucuugggaggcu

SEQ ID NO: 210460 - RNA, 32 nt, Human
gugcaccugugacuuauucuuuacaggaacug

SEQ ID NO: 210461 - RNA, 32 nt, Human
gugcaccuguggucccagcuacuccagaggcu

SEQ ID NO: 210462 - RNA, 32 nt, Human
gugcaccuguggucccagcuacucuggaggcu

SEQ ID NO: 210463 - RNA, 32 nt, Human
gugcaccuguggucccagcuacuggggaggcu

SEQ ID NO: 210464 - RNA, 32 nt, Human
gugcacgaagggggcacaggagaggagagggg

SEQ ID NO: 210465 - RNA, 32 nt, Human
gugcacgagcugguccuggcugccuggaaggc

SEQ ID NO: 210466 - RNA, 32 nt, Human
gugcacgcaacucccucugccccagccggccc

SEQ ID NO: 210467 - RNA, 32 nt, Human
gugcacgcagccgccccgcgggucguccagga

SEQ ID NO: 210468 - RNA, 32 nt, Human
gugcacgccagccugggcgacagacucugugu

SEQ ID NO: 210469 - RNA, 32 nt, Human
gugcacgccuguaaucccagcuacucgggagg

SEQ ID NO: 210470 - RNA, 32 nt, Human
gugcacgccuguaaucccagcuccuugggagg

SEQ ID NO: 210471 - RNA, 32 nt, Human
gugcacgccuguaaucccagcuucuugggagg

SEQ ID NO: 210472 - RNA, 32 nt, Human
gugcacgccuguaauccccagauacucgggag

SEQ ID NO: 210473 - RNA, 32 nt, Human
gugcacgccuguaaucucagcuacuugggagg

SEQ ID NO: 210474 - RNA, 32 nt, Human
gugcacgccuuuaaucccagcuacucgggagg

SEQ ID NO: 210475 - RNA, 32 nt, Human
gugcacgcuuggacacccaccuccauggacac

SEQ ID NO: 210476 - RNA, 32 nt, Human
gugcacgcuuguaaucccagcuacucaggagu

SEQ ID NO: 210477 - RNA, 18 nt, Human
gugcacggcaaggaccca

SEQ ID NO: 210478 - RNA, 32 nt, Human
gugcacggccugugcugccuucugccugggcc

SEQ ID NO: 210479 - RNA, 17 nt, Human
gugcacggcuccgggcg

SEQ ID NO: 210480 - RNA, 32 nt, Human
gugcacggugugauuccaggaggagagccagg

SEQ ID NO: 210481 - RNA, 32 nt, Human
gugcacgucuguaaucccagcugcucgggagg

SEQ ID NO: 210482 - RNA, 19 nt, Human
gugcacuacagaucuccug

SEQ ID NO: 210483 - RNA, 16 nt, Human
gugcacuacugccuca

SEQ ID NO: 210484 - RNA, 32 nt, Human
gugcacuacuguacuccagccagggcaagaga

SEQ ID NO: 210485 - RNA, 32 nt, Human
gugcacuagggccaaaugaaccugaauacugg

SEQ ID NO: 210486 - RNA, 32 nt, Human
gugcacuccagccugggcaagaagagcgaaac

SEQ ID NO: 210487 - RNA, 32 nt, Human
gugcacuccagccuggguaacagagcgagacu

SEQ ID NO: 210488 - RNA, 32 nt, Human
gugcacuccagccugggugacagcgagacccu

SEQ ID NO: 210489 - RNA, 32 nt, Human
gugcacuccccguguucauaugucagggcaca

SEQ ID NO: 210490 - RNA, 32 nt, Human
gugcacuccucccagcccagcuccagaauggc

SEQ ID NO: 210491 - RNA, 32 nt, Human
gugcacucucugcuuagguuuugcuugggaaa

SEQ ID NO: 210492 - RNA, 17 nt, Human
gugcacugagccgucca

SEQ ID NO: 210493 - RNA, 32 nt, Human
gugcacugaugugcccuggcauccauuggugu

SEQ ID NO: 210494 - RNA, 32 nt, Human
gugcacugcacucuagccugggggaagaguga

SEQ ID NO: 210495 - RNA, 32 nt, Human
gugcacuggagaggcuggggaggcaggggccc

SEQ ID NO: 210496 - RNA, 32 nt, Human
gugcacuggauagcauucagccucaucacagg

SEQ ID NO: 210497 - RNA, 24 nt, Human
gugcacuggcucaagccuguaauc

SEQ ID NO: 210498 - RNA, 32 nt, Human
gugcacugggcaagggcagggcggcagguguc

SEQ ID NO: 210499 - RNA, 32 nt, Human
gugcacugguguggggcccaggagaggaccac

SEQ ID NO: 210500 - RNA, 32 nt, Human
gugcacuguggaacagagcugagaccccggcc

SEQ ID NO: 210501 - RNA, 32 nt, Human
gugcacuuacccccaucuuucucccucgggga

SEQ ID NO: 210502 - RNA, 32 nt, Human
gugcacuuacucuucuacaauguggccggauc

SEQ ID NO: 210503 - RNA, 32 nt, Human
gugcacuucccgcagcugcuuccacgguauag

SEQ ID NO: 210504 - RNA, 32 nt, Human
gugcacuucucccuuccaacugcaucaacuaa

SEQ ID NO: 210505 - RNA, 32 nt, Human
gugcacuucuccucucugggccuuggcuuggg

SEQ ID NO: 210506 - RNA, 32 nt, Human
gugcacuugcuguuuucccuguccacauccau

SEQ ID NO: 210507 - RNA, 32 nt, Human
gugcacuuguaaucccagcuacaugggaagcg

SEQ ID NO: 210508 - RNA, 32 nt, Human
gugcacuuugggaggcugaggcuggaggacug

SEQ ID NO: 210509 - RNA, 32 nt, Human
gugcagaaagcccagacuaaggaacaggcuga

SEQ ID NO: 210510 - RNA, 18 nt, Human
gugcagaaauccaucccu

SEQ ID NO: 210511 - RNA, 32 nt, Human
gugcagaaaugagaggagacagugcuagaguc

SEQ ID NO: 210512 - RNA, 32 nt, Human
gugcagaaauuggcugggcaugguggugcgcg

SEQ ID NO: 210513 - RNA, 18 nt, Human
gugcagaagcuuccaggc

SEQ ID NO: 210514 - RNA, 32 nt, Human
gugcagaaguggggagugaugggcagguucgg

SEQ ID NO: 210515 - RNA, 32 nt, Human
gugcagaaguuggaacagugguaaggcuguuu

SEQ ID NO: 210516 - RNA, 22 nt, Human
gugcagaaguuucuccaggugg

SEQ ID NO: 210517 - RNA, 32 nt, Human
gugcagacaacaucauggcucuuggcaguuua

SEQ ID NO: 210518 - RNA, 32 nt, Human
gugcagacacagggcaacacucaccagaauac

SEQ ID NO: 210519 - RNA, 32 nt, Human
gugcagacagcaucagcucugagguucaucau

SEQ ID NO: 210520 - RNA, 32 nt, Human
gugcagaccagcugccgcccugcccgaugcuu

SEQ ID NO: 210521 - RNA, 32 nt, Human
gugcagaccauccucugcccagaagaguugca

SEQ ID NO: 210522 - RNA, 19 nt, Human
gugcagaccccgggcccgg

SEQ ID NO: 210523 - RNA, 32 nt, Human
gugcagacccuggggucccuguuguacgcugc

SEQ ID NO: 210524 - RNA, 32 nt, Human
gugcagacucaggagugaaccugccugaagag

SEQ ID NO: 210525 - RNA, 24 nt, Human
gugcagacucaggauuggggcuug

SEQ ID NO: 210526 - RNA, 21 nt, Human
gugcagacucugggacugcgu

SEQ ID NO: 210527 - RNA, 24 nt, Human
gugcagacugcagcucagccucgu

SEQ ID NO: 210528 - RNA, 32 nt, Human
gugcagagaagaacauaagaagaaaaacccag

SEQ ID NO: 210529 - RNA, 32 nt, Human
gugcagagacccugcauguaggucacagguug

SEQ ID NO: 210530 - RNA, 18 nt, Human
gugcagagaccuagccug

SEQ ID NO: 210531 - RNA, 32 nt, Human
gugcagagagggagacaggcaggcaggcaggu

SEQ ID NO: 210532 - RNA, 32 nt, Human
gugcagagaugggcuuucucugccaguccccu

SEQ ID NO: 210533 - RNA, 32 nt, Human
gugcagagccgcacaggagcugccccggagcu

SEQ ID NO: 210534 - RNA, 32 nt, Human
gugcagagccggccccucaccuaacagcuggu

SEQ ID NO: 210535 - RNA, 32 nt, Human
gugcagagccugggacccagugagacggaguc

SEQ ID NO: 210536 - RNA, 32 nt, Human
gugcagagcuggagagccaugggugaggcagc

SEQ ID NO: 210537 - RNA, 21 nt, Human
gugcagaggacucuccaggug

SEQ ID NO: 210538 - RNA, 32 nt, Human
gugcagaggccugcggggucugaagggccucc

SEQ ID NO: 210539 - RNA, 32 nt, Human
gugcagaggccuggccucugucuguuugccau

SEQ ID NO: 210540 - RNA, 24 nt, Human
gugcagaggcucaugccuguaauc

SEQ ID NO: 210541 - RNA, 32 nt, Human
gugcagagggccuuagcaugggauguguccag

SEQ ID NO: 210542 - RNA, 32 nt, Human
gugcagagguccugagcccacccuaguugggc

SEQ ID NO: 210543 - RNA, 32 nt, Human
gugcagagucuaaaggauaacauaucaaggcu

SEQ ID NO: 210544 - RNA, 32 nt, Human
gugcagagugguucugcaaaugguuagaggaa

SEQ ID NO: 210545 - RNA, 32 nt, Human
gugcagaguguggaguguuugugcccccucuu

SEQ ID NO: 210546 - RNA, 32 nt, Human
gugcagauaacuuaagcuuucucagcugggaa

SEQ ID NO: 210547 - RNA, 32 nt, Human
gugcagauauugccuggacacacacaugugca

SEQ ID NO: 210548 - RNA, 32 nt, Human
gugcagaugaggaagugagcucagggaggcug

SEQ ID NO: 210549 - RNA, 17 nt, Human
gugcagaugcuaggugg

SEQ ID NO: 210550 - RNA, 31 nt, Human
gugcagaugcuggacgacagagccaggaugg

SEQ ID NO: 210551 - RNA, 31 nt, Human
gugcagauggaaaacugugccaacacuuccu

SEQ ID NO: 210552 - RNA, 20 nt, Human
gugcagauggccccgggcgg

SEQ ID NO: 210553 - RNA, 32 nt, Human
gugcagauucaccaauugccaccaccaggagc

SEQ ID NO: 210554 - RNA, 32 nt, Human
gugcagcaagucacugagaaugagcacuuucu

SEQ ID NO: 210555 - RNA, 32 nt, Human
gugcagcaccccaagccccagccugagggcug

SEQ ID NO: 210556 - RNA, 32 nt, Human
gugcagcagagccuagaggagcuguuccuucc

SEQ ID NO: 210557 - RNA, 32 nt, Human
gugcagcagcacagcagggaguguguccaacg

SEQ ID NO: 210558 - RNA, 19 nt, Human
gugcagcagccccaggcgg

SEQ ID NO: 210559 - RNA, 32 nt, Human
gugcagcaggagaaggaggauggucagccuug

SEQ ID NO: 210560 - RNA, 23 nt, Human
gugcagcagggagccccaugccc

SEQ ID NO: 210561 - RNA, 32 nt, Human
gugcagcauuuaggaaagcagugcaguacuca

SEQ ID NO: 210562 - RNA, 32 nt, Human
gugcagccaagcucugcagacuuuugcaggau

SEQ ID NO: 210563 - RNA, 32 nt, Human
gugcagccacagacuuguauuuugauccccaa

SEQ ID NO: 210564 - RNA, 32 nt, Human
gugcagccaccugccugacacccagggaugag

SEQ ID NO: 210565 - RNA, 32 nt, Human
gugcagccaccugccugucccauacgccccgc

SEQ ID NO: 210566 - RNA, 32 nt, Human
gugcagccacucccugcccugugucccaagug

SEQ ID NO: 210567 - RNA, 17 nt, Human
gugcagccaucaggugg

SEQ ID NO: 210568 - RNA, 32 nt, Human
gugcagcccaggcuucugagggaggcagaaga

SEQ ID NO: 210569 - RNA, 32 nt, Human
gugcagcccauguuccugcgugcagcucacgg

SEQ ID NO: 210570 - RNA, 32 nt, Human
gugcagccccagcagccggaccagccuugggc

SEQ ID NO: 210571 - RNA, 32 nt, Human
gugcagccccauugccuuuucccuucaggcuc

SEQ ID NO: 210572 - RNA, 32 nt, Human
gugcagcccucguccugggucugcaccgggca

SEQ ID NO: 210573 - RNA, 32 nt, Human
gugcagcccugagccugcccacuccucauuac

SEQ ID NO: 210574 - RNA, 32 nt, Human
gugcagccgucccgcuggaguggccauguccc

SEQ ID NO: 210575 - RNA, 32 nt, Human
gugcagccguuuuggaaaauagccuggcauuu

SEQ ID NO: 210576 - RNA, 32 nt, Human
gugcagccucaaacuccugggcucaagccauc

SEQ ID NO: 210577 - RNA, 32 nt, Human
gugcagccucaaacucuugggcucaagcagug

SEQ ID NO: 210578 - RNA, 32 nt, Human
gugcagccuccaacuccugggcucaauacucu

SEQ ID NO: 210579 - RNA, 32 nt, Human
gugcagccuccccucgaugucggcccucgaaa

SEQ ID NO: 210580 - RNA, 32 nt, Human
gugcagccuccuucagccagagcccagagcau

SEQ ID NO: 210581 - RNA, 32 nt, Human
gugcagccucgugcagcucuucuggucuccgg

SEQ ID NO: 210582 - RNA, 32 nt, Human
gugcagccucuaacuccugggcucaagcaauc

SEQ ID NO: 210583 - RNA, 22 nt, Human
gugcagccuggcagugcaguga

SEQ ID NO: 210584 - RNA, 32 nt, Human
gugcagccuucagguuugcggaaagggagugg

SEQ ID NO: 210585 - RNA, 32 nt, Human
gugcagcgacugcccggcccucccuccccugc

SEQ ID NO: 210586 - RNA, 17 nt, Human
gugcagcgcucaggugg

SEQ ID NO: 210587 - RNA, 32 nt, Human
gugcagcggacuugcuccagccugggugagga

SEQ ID NO: 210588 - RNA, 32 nt, Human
gugcagcggcgguucccucaucaguccagcca

SEQ ID NO: 210589 - RNA, 32 nt, Human
gugcagcggcgugaggcccgucccggagcgag

SEQ ID NO: 210590 - RNA, 22 nt, Human
gugcagcggcucaugccuguaa

SEQ ID NO: 210591 - RNA, 32 nt, Human
gugcagcgggcagcgagcagcccagggagcca

SEQ ID NO: 210592 - RNA, 32 nt, Human
gugcagcgguccagcacuuaacucuaauacau

SEQ ID NO: 210593 - RNA, 32 nt, Human
gugcagcggugugaucucagcucauugcaacc

SEQ ID NO: 210594 - RNA, 32 nt, Human
gugcagcuccgcagcccugccggcucgguucg

SEQ ID NO: 210595 - RNA, 32 nt, Human
gugcagcucgagagacauucagagauggaaca

SEQ ID NO: 210596 - RNA, 32 nt, Human
gugcagcucgagagacauucagagauggagca

SEQ ID NO: 210597 - RNA, 32 nt, Human
gugcagcucgcucuuuccuuccuuccuaagcu

SEQ ID NO: 210598 - RNA, 17 nt, Human
gugcagcucuccgggcg

SEQ ID NO: 210599 - RNA, 32 nt, Human
gugcagcucuuaaacacauugccuuaugacua

SEQ ID NO: 210600 - RNA, 32 nt, Human
gugcagcugaccaggguuugugcagugaucuu

SEQ ID NO: 210601 - RNA, 32 nt, Human
gugcagcugaccuguaucgacacccacagcuu

SEQ ID NO: 210602 - RNA, 32 nt, Human
gugcagcugagagcaaggagaauuauugucga

SEQ ID NO: 210603 - RNA, 32 nt, Human
gugcagcugcaaccaccauauccagggcccaa

SEQ ID NO: 210604 - RNA, 32 nt, Human
gugcagcugcagaagagaaaugggauuggcuc

SEQ ID NO: 210605 - RNA, 32 nt, Human
gugcagcugccaaggccagcuccgucaggcag

SEQ ID NO: 210606 - RNA, 32 nt, Human
gugcagcugccaccccagcccaaauggauucc

SEQ ID NO: 210607 - RNA, 32 nt, Human
gugcagcugcccacccugccgccaugucucug

SEQ ID NO: 210608 - RNA, 32 nt, Human
gugcagcugccggcaaccacagguuccaagau

SEQ ID NO: 210609 - RNA, 32 nt, Human
gugcagcugguguccccgauucuggcuguccu

SEQ ID NO: 210610 - RNA, 32 nt, Human
gugcagcuguaacugcucacgccaaaauggcu

SEQ ID NO: 210611 - RNA, 32 nt, Human
gugcagcugugagcgcguggccgccccgcggg

SEQ ID NO: 210612 - RNA, 32 nt, Human
gugcagcuguggguggaggcuggggugucugc

SEQ ID NO: 210613 - RNA, 32 nt, Human
gugcagcuguggucccagcuacucaggaggcu

SEQ ID NO: 210614 - RNA, 32 nt, Human
gugcaggaacccuuggucacaugugacauguc

SEQ ID NO: 210615 - RNA, 32 nt, Human
gugcaggacaaaacuccucucuauagucaacu

SEQ ID NO: 210616 - RNA, 32 nt, Human
gugcaggagacccucucacaccagguuaccca

SEQ ID NO: 210617 - RNA, 32 nt, Human
gugcaggaggagaaggaggaggagcaggaggu

SEQ ID NO: 210618 - RNA, 32 nt, Human
gugcaggaggcagagggugccccgcagggagc

SEQ ID NO: 210619 - RNA, 16 nt, Human
gugcaggaggcuguug

SEQ ID NO: 210620 - RNA, 32 nt, Human
gugcaggauagccacacagcaaacauguuugc

SEQ ID NO: 210621 - RNA, 32 nt, Human
gugcaggaucugcuucccuucucuccaggacc

SEQ ID NO: 210622 - RNA, 32 nt, Human
gugcaggcaauagauuuugccuucaaggguuc

SEQ ID NO: 210623 - RNA, 32 nt, Human
gugcaggcacagagaagagcaguugggaagac

SEQ ID NO: 210624 - RNA, 19 nt, Human
gugcaggcacauaggcugg

SEQ ID NO: 210625 - RNA, 19 nt, Human
gugcaggcacugaggcugg

SEQ ID NO: 210626 - RNA, 32 nt, Human
gugcaggcacuucccgugugacacaucacuua

SEQ ID NO: 210627 - RNA, 32 nt, Human
gugcaggcagagccaucugccaggcccaggag

SEQ ID NO: 210628 - RNA, 32 nt, Human
gugcaggcaggcagauggcuugagcccaggaa

SEQ ID NO: 210629 - RNA, 19 nt, Human
gugcaggcauugcacacgg

SEQ ID NO: 210630 - RNA, 17 nt, Human
gugcaggccaccgggug

SEQ ID NO: 210631 - RNA, 16 nt, Human
gugcaggccaggcagg

SEQ ID NO: 210632 - RNA, 22 nt, Human
gugcaggccaggguucgcgcgg

SEQ ID NO: 210633 - RNA, 32 nt, Human
gugcaggcccacucuucuggauccucuuggcc

SEQ ID NO: 210634 - RNA, 17 nt, Human
gugcaggcccagguugg

SEQ ID NO: 210635 - RNA, 17 nt, Human
gugcaggccguggggcg

SEQ ID NO: 210636 - RNA, 19 nt, Human
gugcaggccguuggggcgg

SEQ ID NO: 210637 - RNA, 18 nt, Human
gugcaggccuccagcagg

SEQ ID NO: 210638 - RNA, 32 nt, Human
gugcaggccuguaaucccagcuacucgggagg

SEQ ID NO: 210639 - RNA, 32 nt, Human
gugcaggccugucaacuuuacaggagagcacu

SEQ ID NO: 210640 - RNA, 19 nt, Human
gugcaggccuguucugagg

SEQ ID NO: 210641 - RNA, 17 nt, Human
gugcaggcgcucaggcg

SEQ ID NO: 210642 - RNA, 18 nt, Human
gugcaggcggacaggcgg

SEQ ID NO: 210643 - RNA, 19 nt, Human
gugcaggcucaagagcugg

SEQ ID NO: 210644 - RNA, 18 nt, Human
gugcaggcugaggucugg

SEQ ID NO: 210645 - RNA, 18 nt, Human
gugcaggcugccccaugg

SEQ ID NO: 210646 - RNA, 19 nt, Human
gugcaggcugccuguaugg

SEQ ID NO: 210647 - RNA, 17 nt, Human
gugcaggcugccuguga

SEQ ID NO: 210648 - RNA, 20 nt, Human
gugcaggcugccugugaggc

SEQ ID NO: 210649 - RNA, 32 nt, Human
gugcaggcugccugugaggcuccaggcggugg

SEQ ID NO: 210650 - RNA, 19 nt, Human
gugcaggcugcucccgggg

SEQ ID NO: 210651 - RNA, 18 nt, Human
gugcaggcuggacucagg

SEQ ID NO: 210652 - RNA, 17 nt, Human
gugcaggcuggcagggg

SEQ ID NO: 210653 - RNA, 18 nt, Human
gugcaggcuggccagccg

SEQ ID NO: 210654 - RNA, 19 nt, Human
gugcaggcugggaccagcg

SEQ ID NO: 210655 - RNA, 18 nt, Human
gugcaggcuggggucagg

SEQ ID NO: 210656 - RNA, 16 nt, Human
gugcaggcuguggugg

SEQ ID NO: 210657 - RNA, 19 nt, Human
gugcaggcuguugacugcg

SEQ ID NO: 210658 - RNA, 18 nt, Human
gugcaggcuucaggcagg

SEQ ID NO: 210659 - RNA, 19 nt, Human
gugcaggcuuccccggcgg

SEQ ID NO: 210660 - RNA, 17 nt, Human
gugcaggcuuuucugcg

SEQ ID NO: 210661 - RNA, 32 nt, Human
gugcagggaaagagaaccucaccagaaaguau

SEQ ID NO: 210662 - RNA, 32 nt, Human
gugcagggaaccuggccugagaacugcccagu

SEQ ID NO: 210663 - RNA, 24 nt, Human
gugcagggacucaugacuguaauc

SEQ ID NO: 210664 - RNA, 32 nt, Human
gugcagggaggcggaggcccugggagagccgu

SEQ ID NO: 210665 - RNA, 32 nt, Human
gugcagggaggcgggagaugauggcgaggcgg

SEQ ID NO: 210666 - RNA, 19 nt, Human
gugcagggauuacaggcgu

SEQ ID NO: 210667 - RNA, 20 nt, Human
gugcagggcaagccaguggc

SEQ ID NO: 210668 - RNA, 32 nt, Human
gugcagggcaggaaagcuccacacacacagcc

SEQ ID NO: 210669 - RNA, 32 nt, Human
gugcagggcccgcgggcucuggccggagccgc

SEQ ID NO: 210670 - RNA, 32 nt, Human
gugcagggccuccauuccuggagcccgaggca

SEQ ID NO: 210671 - RNA, 32 nt, Human
gugcagggccuguaaucccagcauuuugggag

SEQ ID NO: 210672 - RNA, 32 nt, Human
gugcagggcgucccccucaacccugcccugaa

SEQ ID NO: 210673 - RNA, 23 nt, Human
gugcagggcucacaccuguaauc

SEQ ID NO: 210674 - RNA, 32 nt, Human
gugcagggcuggucuuggggaggcagggcagc

SEQ ID NO: 210675 - RNA, 17 nt, Human
gugcaggggccaggugg

SEQ ID NO: 210676 - RNA, 32 nt, Human
gugcagggggugggggugcugggagccagcca

SEQ ID NO: 210677 - RNA, 32 nt, Human
gugcagggugcccagugcacacacuagagaga

SEQ ID NO: 210678 - RNA, 32 nt, Human
gugcaggguggcagaggugccucugcagagag

SEQ ID NO: 210679 - RNA, 32 nt, Human
gugcagggugggggucccugcccacccauacu

SEQ ID NO: 210680 - RNA, 32 nt, Human
gugcaggguugugggagccgagacgagauuag

SEQ ID NO: 210681 - RNA, 31 nt, Human
gugcagguacuuuucugccugcagaaggcac

SEQ ID NO: 210682 - RNA, 32 nt, Human
gugcagguagagaagagauggugccaugauau

SEQ ID NO: 210683 - RNA, 19 nt, Human
gugcagguauuucagaagg

SEQ ID NO: 210684 - RNA, 19 nt, Human
gugcaggucacaccagggg

SEQ ID NO: 210685 - RNA, 32 nt, Human
gugcaggucacaugcccacugcagcccuccag

SEQ ID NO: 210686 - RNA, 32 nt, Human
gugcagguccucuauuuuuaauugcuguuuuc

SEQ ID NO: 210687 - RNA, 16 nt, Human
gugcaggucucagggg

SEQ ID NO: 210688 - RNA, 16 nt, Human
gugcaggugcaggugg

SEQ ID NO: 210689 - RNA, 32 nt, Human
gugcaggugggagucaucugucagccuucuau

SEQ ID NO: 210690 - RNA, 32 nt, Human
gugcaggugggcauaggugcagugagugcagg

SEQ ID NO: 210691 - RNA, 32 nt, Human
gugcagguggggugauggccagaggaaugaug

SEQ ID NO: 210692 - RNA, 19 nt, Human
gugcagguguguacaggcg

SEQ ID NO: 210693 - RNA, 19 nt, Human
gugcaggugugugcagggg

SEQ ID NO: 210694 - RNA, 16 nt, Human
gugcagguugcagagg

SEQ ID NO: 210695 - RNA, 24 nt, Human
gugcaguaacucacgccuguaauc

SEQ ID NO: 210696 - RNA, 32 nt, Human
gugcaguaccugcugguuaagaaccggaagac

SEQ ID NO: 210697 - RNA, 32 nt, Human
gugcaguacucaguaaggcagugcaguacuca

SEQ ID NO: 210698 - RNA, 25 nt, Human
gugcaguagcucacacccuguaauc

SEQ ID NO: 210699 - RNA, 24 nt, Human
gugcaguagcucacaccuguaauc

SEQ ID NO: 210700 - RNA, 24 nt, Human
gugcaguagcucacaccuguaguc

SEQ ID NO: 210701 - RNA, 24 nt, Human
gugcaguagcucacgccuguaauc

SEQ ID NO: 210702 - RNA, 23 nt, Human
gugcaguagcucaugccuauaau

SEQ ID NO: 210703 - RNA, 24 nt, Human
gugcaguagcucaugccuguaauc

SEQ ID NO: 210704 - RNA, 32 nt, Human
gugcaguagcuguguguccgaggucagugugc

SEQ ID NO: 210705 - RNA, 32 nt, Human
gugcaguagugccaguccugcaguaguugaua

SEQ ID NO: 210706 - RNA, 25 nt, Human
gugcaguaguucaugcccuguaauc

SEQ ID NO: 210707 - RNA, 24 nt, Human
gugcaguaguuuacgccuguaauc

SEQ ID NO: 210708 - RNA, 32 nt, Human
gugcaguauucuaaacauuucagcuaggaaua

SEQ ID NO: 210709 - RNA, 32 nt, Human
gugcaguauugaaaagacaggagaaaagcaaa

SEQ ID NO: 210710 - RNA, 32 nt, Human
gugcagucacauuauuggggauuccacagcug

SEQ ID NO: 210711 - RNA, 32 nt, Human
gugcaguccagcggggaggaggcugcccguuc

SEQ ID NO: 210712 - RNA, 21 nt, Human
gugcagucgcggcccgggcgg

SEQ ID NO: 210713 - RNA, 32 nt, Human
gugcagucucagaaaacacgagggaugccacc

SEQ ID NO: 210714 - RNA, 32 nt, Human
gugcagucucaggggaacacaaagcagcccug

SEQ ID NO: 210715 - RNA, 32 nt, Human
gugcagugaacaaacuacacaagucaucuaca

SEQ ID NO: 210716 - RNA, 20 nt, Human
gugcagugaacuugcuguca

SEQ ID NO: 210717 - RNA, 32 nt, Human
gugcagugaagaucauaccucacuacauccgu

SEQ ID NO: 210718 - RNA, 32 nt, Human
gugcagugacaugcagaggcuggacugcugcc

SEQ ID NO: 210719 - RNA, 24 nt, Human
gugcagugacucacaucuguaauc

SEQ ID NO: 210720 - RNA, 24 nt, Human
gugcagugacucaugccuacaauc

SEQ ID NO: 210721 - RNA, 17 nt, Human
gugcagugacucauguc

SEQ ID NO: 210722 - RNA, 32 nt, Human
gugcagugagccaagaccaugccauuacacuc

SEQ ID NO: 210723 - RNA, 32 nt, Human
gugcagugagcuaugauugcaccauugcaccu

SEQ ID NO: 210724 - RNA, 32 nt, Human
gugcagugaugucgauuucauuucccuucccc

SEQ ID NO: 210725 - RNA, 32 nt, Human
gugcagugcaagcccccggccucuucccuggg

SEQ ID NO: 210726 - RNA, 31 nt, Human
gugcagugcacaaucucggcucacugcaauc

SEQ ID NO: 210727 - RNA, 17 nt, Human
gugcagugccaugauca

SEQ ID NO: 210728 - RNA, 32 nt, Human
gugcagugcggugcacaccggucuccagguug

SEQ ID NO: 210729 - RNA, 32 nt, Human
gugcagugcucaauaaggcagugcagugcuca

SEQ ID NO: 210730 - RNA, 24 nt, Human
gugcaguggaucacgccuguaauc

SEQ ID NO: 210731 - RNA, 24 nt, Human
gugcaguggaucaugucuguaauc

SEQ ID NO: 210732 - RNA, 24 nt, Human
gugcaguggcacacaccuguaguc

SEQ ID NO: 210733 - RNA, 24 nt, Human
gugcaguggcacacggcuguaauc

SEQ ID NO: 210734 - RNA, 32 nt, Human
gugcaguggcaccaucuccgcucacugcaagc

SEQ ID NO: 210735 - RNA, 32 nt, Human
gugcaguggcaccaucuuggcucacuguaacc

SEQ ID NO: 210736 - RNA, 32 nt, Human
gugcaguggcaccaucuuggcucacuucaacc

SEQ ID NO: 210737 - RNA, 24 nt, Human
gugcaguggcaugugcuuguaauc

SEQ ID NO: 210738 - RNA, 24 nt, Human
gugcaguggcccacgccuguaauc

SEQ ID NO: 210739 - RNA, 24 nt, Human
gugcaguggcccaugccuguaauc

SEQ ID NO: 210740 - RNA, 24 nt, Human
gugcaguggcuaaagccuguaauc

SEQ ID NO: 210741 - RNA, 24 nt, Human
gugcaguggcucacacauguaauc

SEQ ID NO: 210742 - RNA, 24 nt, Human
gugcaguggcucacaccgguaauc

SEQ ID NO: 210743 - RNA, 24 nt, Human
gugcaguggcucacaccuauaauc

SEQ ID NO: 210744 - RNA, 24 nt, Human
gugcaguggcucacaccuggaauc

SEQ ID NO: 210745 - RNA, 23 nt, Human
gugcaguggcucacaccuguaau

SEQ ID NO: 210746 - RNA, 24 nt, Human
gugcaguggcucacaccuguaauc

SEQ ID NO: 210747 - RNA, 24 nt, Human
gugcaguggcucacaccuguauuc

SEQ ID NO: 210748 - RNA, 32 nt, Human
gugcaguggcucacaccugucauuccagcacu

SEQ ID NO: 210749 - RNA, 24 nt, Human
gugcaguggcucacaccugugauc

SEQ ID NO: 210750 - RNA, 22 nt, Human
gugcaguggcucacaccugugg

SEQ ID NO: 210751 - RNA, 24 nt, Human
gugcaguggcucacaccuuuaauc

SEQ ID NO: 210752 - RNA, 22 nt, Human
gugcaguggcucacacuguaau

SEQ ID NO: 210753 - RNA, 22 nt, Human
gugcaguggcucacacuuguaa

SEQ ID NO: 210754 - RNA, 24 nt, Human
gugcaguggcucacacuuguaauc

SEQ ID NO: 210755 - RNA, 22 nt, Human
gugcaguggcucacaucuguaa

SEQ ID NO: 210756 - RNA, 24 nt, Human
gugcaguggcucacaucuguaauc

SEQ ID NO: 210757 - RNA, 24 nt, Human
gugcaguggcucacauucguaauc

SEQ ID NO: 210758 - RNA, 24 nt, Human
gugcaguggcucacgccuauaauc

SEQ ID NO: 210759 - RNA, 24 nt, Human
gugcaguggcucacgccuaugauc

SEQ ID NO: 210760 - RNA, 22 nt, Human
gugcaguggcucacgccuguaa

SEQ ID NO: 210761 - RNA, 24 nt, Human
gugcaguggcucacgccuguaauc

SEQ ID NO: 210762 - RNA, 24 nt, Human
gugcaguggcucacgccuguaguc

SEQ ID NO: 210763 - RNA, 24 nt, Human
gugcaguggcucacgcuuauaauc

SEQ ID NO: 210764 - RNA, 24 nt, Human
gugcaguggcucacgcuuguaauc

SEQ ID NO: 210765 - RNA, 24 nt, Human
gugcaguggcucacguauguaauc

SEQ ID NO: 210766 - RNA, 24 nt, Human
gugcaguggcucacgucuguaauc

SEQ ID NO: 210767 - RNA, 24 nt, Human
gugcaguggcucacuacucuaauu

SEQ ID NO: 210768 - RNA, 24 nt, Human
gugcaguggcucacuccuguaauc

SEQ ID NO: 210769 - RNA, 24 nt, Human
gugcaguggcucacuccuguaguc

SEQ ID NO: 210770 - RNA, 32 nt, Human
gugcaguggcucacugcaaccugggugacaga

SEQ ID NO: 210771 - RNA, 24 nt, Human
gugcaguggcucaggccuguaauc

SEQ ID NO: 210772 - RNA, 24 nt, Human
gugcaguggcucauaccuuuaauc

SEQ ID NO: 210773 - RNA, 24 nt, Human
gugcaguggcucaugccaguuauc

SEQ ID NO: 210774 - RNA, 24 nt, Human
gugcaguggcucaugccuauaauc

SEQ ID NO: 210775 - RNA, 24 nt, Human
gugcaguggcucaugccuauauuc

SEQ ID NO: 210776 - RNA, 21 nt, Human
gugcaguggcucaugccugua

SEQ ID NO: 210777 - RNA, 22 nt, Human
gugcaguggcucaugccuguaa

SEQ ID NO: 210778 - RNA, 24 nt, Human
gugcaguggcucaugccuguaauc

SEQ ID NO: 210779 - RNA, 24 nt, Human
gugcaguggcucaugccuguaauu

SEQ ID NO: 210780 - RNA, 24 nt, Human
gugcaguggcucaugccugugguc

SEQ ID NO: 210781 - RNA, 20 nt, Human
gugcaguggcuccuauaauc

SEQ ID NO: 210782 - RNA, 22 nt, Human
gugcaguggcucgccuguaauc

SEQ ID NO: 210783 - RNA, 24 nt, Human
gugcaguggcucgcgccuguaauc

SEQ ID NO: 210784 - RNA, 24 nt, Human
gugcaguggcucuugccuguaauc

SEQ ID NO: 210785 - RNA, 32 nt, Human
gugcaguggcugcgccgccaggccccaacaau

SEQ ID NO: 210786 - RNA, 24 nt, Human
gugcaguggcuuacaccuguaauc

SEQ ID NO: 210787 - RNA, 24 nt, Human
gugcaguggcuuaugcuuguaauc

SEQ ID NO: 210788 - RNA, 24 nt, Human
gugcaguggcuuguuccuguaguc

SEQ ID NO: 210789 - RNA, 24 nt, Human
gugcagugguauauaccuguaguc

SEQ ID NO: 210790 - RNA, 32 nt, Human
gugcaguggucagccaccugaagagagagcca

SEQ ID NO: 210791 - RNA, 19 nt, Human
gugcaguggugcaugauca

SEQ ID NO: 210792 - RNA, 24 nt, Human
gugcaguggugcaugccuguaguc

SEQ ID NO: 210793 - RNA, 26 nt, Human
gugcaguggugcgcaugccuguaguc

SEQ ID NO: 210794 - RNA, 24 nt, Human
gugcagugguucacaccuguaauu

SEQ ID NO: 210795 - RNA, 24 nt, Human
gugcagugguucaugccuguaauc

SEQ ID NO: 210796 - RNA, 19 nt, Human
gugcaguguauccuggaga

SEQ ID NO: 210797 - RNA, 20 nt, Human
gugcaguguccagaggccaa

SEQ ID NO: 210798 - RNA, 24 nt, Human
gugcagugucuuucaccuguaauc

SEQ ID NO: 210799 - RNA, 32 nt, Human
gugcaguguguggaagcugcaaacaaguaggc

SEQ ID NO: 210800 - RNA, 32 nt, Human
gugcaguguuggagagugacacugucggggca

SEQ ID NO: 210801 - RNA, 32 nt, Human
gugcaguuagaugcuguucuuccuuuagauuu

SEQ ID NO: 210802 - RNA, 24 nt, Human
gugcaguugccaacaccuguaauc

SEQ ID NO: 210803 - RNA, 32 nt, Human
gugcaguuuaggcugguuaagaauggucccug

SEQ ID NO: 210804 - RNA, 32 nt, Human
gugcauaaagaauguuuuaaauguaacuguuu

SEQ ID NO: 210805 - RNA, 32 nt, Human
gugcauagauacagguaaccaccaccacaauc

SEQ ID NO: 210806 - RNA, 32 nt, Human
gugcauagauuccugaaggccauccagugacc

SEQ ID NO: 210807 - RNA, 32 nt, Human
gugcauagcagaugguuuccacauuuagaucc

SEQ ID NO: 210808 - RNA, 32 nt, Human
gugcauagguacaguggcaccugagguaggag

SEQ ID NO: 210809 - RNA, 32 nt, Human
gugcauaugagacuugggggucccuccccaau

SEQ ID NO: 210810 - RNA, 32 nt, Human
gugcauaugcauauacauuguaaguuaguaag

SEQ ID NO: 210811 - RNA, 32 nt, Human
gugcauauguccagcaggacggcagugucagg

SEQ ID NO: 210812 - RNA, 32 nt, Human
gugcaucacagccccucacugggaccaggggg

SEQ ID NO: 210813 - RNA, 32 nt, Human
gugcaucacucaccacagcugccuccugagcu

SEQ ID NO: 210814 - RNA, 32 nt, Human
gugcaucacucucccuucugccuccuucaacu

SEQ ID NO: 210815 - RNA, 32 nt, Human
gugcaucagccuguagguucuuccucuacccu

SEQ ID NO: 210816 - RNA, 32 nt, Human
gugcaucaucccucaugagaggcaagcccaga

SEQ ID NO: 210817 - RNA, 32 nt, Human
gugcauccccucucugcugagagcuguuccgu

SEQ ID NO: 210818 - RNA, 32 nt, Human
gugcauccucaagcucugcuccuucagggcca

SEQ ID NO: 210819 - RNA, 32 nt, Human
gugcauccuguaaucauagcuacuugggaggu

SEQ ID NO: 210820 - RNA, 32 nt, Human
gugcaucgugagggccagagacaggaauguaa

SEQ ID NO: 210821 - RNA, 32 nt, Human
gugcaucuccaaggagcuugcuggcucugcag

SEQ ID NO: 210822 - RNA, 31 nt, Human
gugcaucucugggcauggccugugugugggu

SEQ ID NO: 210823 - RNA, 32 nt, Human
gugcaucugggaggugguaggccacaguccug

SEQ ID NO: 210824 - RNA, 32 nt, Human
gugcaucuguaaucccagcuacuugggaggcu

SEQ ID NO: 210825 - RNA, 32 nt, Human
gugcaucuguaaucccggcuacuugggagguu

SEQ ID NO: 210826 - RNA, 32 nt, Human
gugcaucuguagccucagcuacucaggggguu

SEQ ID NO: 210827 - RNA, 32 nt, Human
gugcaucuguagucccagcuacuugggaggcu

SEQ ID NO: 210828 - RNA, 32 nt, Human
gugcaucuguuaauucaguucacguacagcag

SEQ ID NO: 210829 - RNA, 32 nt, Human
gugcaucuguugggaaucagagacagcuagag

SEQ ID NO: 210830 - RNA, 32 nt, Human
gugcaucuuuuuccuuccccuggacuguccuc

SEQ ID NO: 210831 - RNA, 32 nt, Human
gugcaugaacacggugcugggcauggcccucu

SEQ ID NO: 210832 - RNA, 32 nt, Human
gugcaugacggcaagcccuccgagggcuccua

SEQ ID NO: 210833 - RNA, 32 nt, Human
gugcaugagaggagguagagugugaacaucau

SEQ ID NO: 210834 - RNA, 32 nt, Human
gugcaugcaaaucucugaugguggcuuccagg

SEQ ID NO: 210835 - RNA, 32 nt, Human
gugcaugcacacacacuuacgaugcugcuggc

SEQ ID NO: 210836 - RNA, 32 nt, Human
gugcaugccauggagacugguuuagacaccgc

SEQ ID NO: 210837 - RNA, 32 nt, Human
gugcaugccuauaaucccagcuacucaggagg

SEQ ID NO: 210838 - RNA, 32 nt, Human
gugcaugccuguaaccccagcuacucgggaag

SEQ ID NO: 210839 - RNA, 32 nt, Human
gugcaugccuguaauccagcuacuugggaggc

SEQ ID NO: 210840 - RNA, 32 nt, Human
gugcaugccuguaaucccagcuacccugaagg

SEQ ID NO: 210841 - RNA, 32 nt, Human
gugcaugccuguaaucccagcuacucggaagu

SEQ ID NO: 210842 - RNA, 32 nt, Human
gugcaugccuguaaucccagcuacucgggaga

SEQ ID NO: 210843 - RNA, 32 nt, Human
gugcaugccuguaaucccagcuacucgggagg

SEQ ID NO: 210844 - RNA, 32 nt, Human
gugcaugccuguaaucccagcuacucuggagg

SEQ ID NO: 210845 - RNA, 32 nt, Human
gugcaugccuguaaucccagcuacuuggaagg

SEQ ID NO: 210846 - RNA, 32 nt, Human
gugcaugccuguaaucccagcuacuugggagg

SEQ ID NO: 210847 - RNA, 32 nt, Human
gugcaugccuguaaucccagcugcuggggagg

SEQ ID NO: 210848 - RNA, 32 nt, Human
gugcaugccuguaaucccagcugcuugggagg

SEQ ID NO: 210849 - RNA, 32 nt, Human
gugcaugccuguaaucccagcuucuugggagg

SEQ ID NO: 210850 - RNA, 32 nt, Human
gugcaugccuguaauccuagcuacucgggagg

SEQ ID NO: 210851 - RNA, 32 nt, Human
gugcaugccuguaaucucagcuacucgggagg

SEQ ID NO: 210852 - RNA, 32 nt, Human
gugcaugccuguaaucucagcuacuugggagg

SEQ ID NO: 210853 - RNA, 32 nt, Human
gugcaugccuguaaucucagcugcuccggagg

SEQ ID NO: 210854 - RNA, 32 nt, Human
gugcaugccuguaauuccagcggcuuggaagg

SEQ ID NO: 210855 - RNA, 32 nt, Human
gugcaugccuguagucacagcuacuugggaga

SEQ ID NO: 210856 - RNA, 32 nt, Human
gugcaugccuguagucccagcuacucgggagg

SEQ ID NO: 210857 - RNA, 32 nt, Human
gugcaugccuguagucccagcuacucuggagg

SEQ ID NO: 210858 - RNA, 32 nt, Human
gugcaugccuguagucccagcuacuugagugg

SEQ ID NO: 210859 - RNA, 32 nt, Human
gugcaugccuguagucccagcuacuugggagg

SEQ ID NO: 210860 - RNA, 32 nt, Human
gugcaugccuguagucccagcuacuugggaug

SEQ ID NO: 210861 - RNA, 32 nt, Human
gugcaugccuguagucccgguuacucgggagg

SEQ ID NO: 210862 - RNA, 32 nt, Human
gugcaugccuguaguccuagcuauuugggagg

SEQ ID NO: 210863 - RNA, 32 nt, Human
gugcaugccuguagucucagcuacucaggagg

SEQ ID NO: 210864 - RNA, 32 nt, Human
gugcaugccuguagucucagcuaguuggggag

SEQ ID NO: 210865 - RNA, 32 nt, Human
gugcaugccuguagugcacagugucucuacag

SEQ ID NO: 210866 - RNA, 32 nt, Human
gugcaugccuguauucccagcuacucaggagg

SEQ ID NO: 210867 - RNA, 32 nt, Human
gugcaugccuguauucucagcuacucgggagg

SEQ ID NO: 210868 - RNA, 32 nt, Human
gugcaugccugucauccaagcuacucaagaga

SEQ ID NO: 210869 - RNA, 32 nt, Human
gugcaugcugggggugacagagugcugaucac

SEQ ID NO: 210870 - RNA, 32 nt, Human
gugcaugcuuguaaucccagcuacucagaagg

SEQ ID NO: 210871 - RNA, 32 nt, Human
gugcaugcuuguaauccuagcuacucaagagg

SEQ ID NO: 210872 - RNA, 32 nt, Human
gugcauggaaaauguugacuucuagcuuccau

SEQ ID NO: 210873 - RNA, 32 nt, Human
gugcauggagccagagugcagagccccagauc

SEQ ID NO: 210874 - RNA, 32 nt, Human
gugcauggcagaggaagguggggagagcccag

SEQ ID NO: 210875 - RNA, 32 nt, Human
gugcauggccugugcugccuucugccuggcuc

SEQ ID NO: 210876 - RNA, 32 nt, Human
gugcauggcucccaaaaugagaaggcugagug

SEQ ID NO: 210877 - RNA, 32 nt, Human
gugcaugggcaggcagugcuggaggaacuggg

SEQ ID NO: 210878 - RNA, 32 nt, Human
gugcauggggacuggcugaggagccagcaugg

SEQ ID NO: 210879 - RNA, 32 nt, Human
gugcauggggagcccgcccacuacccugcuua

SEQ ID NO: 210880 - RNA, 32 nt, Human
gugcauggggcuguggagugggugucaguaug

SEQ ID NO: 210881 - RNA, 22 nt, Human
gugcaugguccuggggcagcaa

SEQ ID NO: 210882 - RNA, 32 nt, Human
gugcauggucugugcugccuucugccuggguc

SEQ ID NO: 210883 - RNA, 32 nt, Human
gugcaugguuuugggagaguccuccuugacuc

SEQ ID NO: 210884 - RNA, 32 nt, Human
gugcauguaggauguugagcagcauguguggc

SEQ ID NO: 210885 - RNA, 32 nt, Human
gugcaugucccauguccuuuagggaaccuuuu

SEQ ID NO: 210886 - RNA, 32 nt, Human
gugcauguccccagccacaugggaagugaaag

SEQ ID NO: 210887 - RNA, 32 nt, Human
gugcaugucugcuucaauuagcagaugccgca

SEQ ID NO: 210888 - RNA, 32 nt, Human
gugcaugucugggucuguggguuucuguuggg

SEQ ID NO: 210889 - RNA, 32 nt, Human
gugcaugugaauagccacugcacuccagccug

SEQ ID NO: 210890 - RNA, 31 nt, Human
gugcaugugacuuacucagccaacccaaugc

SEQ ID NO: 210891 - RNA, 32 nt, Human
gugcaugugcaucaaugccccucuuuucuccc

SEQ ID NO: 210892 - RNA, 32 nt, Human
gugcaugugccuguaaucccagcuacucagga

SEQ ID NO: 210893 - RNA, 32 nt, Human
gugcauguguagccugugcauguaugucuugg

SEQ ID NO: 210894 - RNA, 32 nt, Human
gugcauguguguauaagugcacacagaaauau

SEQ ID NO: 210895 - RNA, 32 nt, Human
gugcauguguguuuccuguugccuggaucuau

SEQ ID NO: 210896 - RNA, 32 nt, Human
gugcauguucuagcuccacacacuaguccuug

SEQ ID NO: 210897 - RNA, 32 nt, Human
gugcauuaaaucaaauacaaaaauugguuuuu

SEQ ID NO: 210898 - RNA, 32 nt, Human
gugcauuaguugugauuucugccuccuuuucu

SEQ ID NO: 210899 - RNA, 32 nt, Human
gugcauucagucucucugccucugccugccuc

SEQ ID NO: 210900 - RNA, 32 nt, Human
gugcauucauuucaucuugcuguuuauuagca

SEQ ID NO: 210901 - RNA, 32 nt, Human
gugcauuccagccuggguacacagcgagaccc

SEQ ID NO: 210902 - RNA, 32 nt, Human
gugcauucccugcccaugaggaaggaagcagc

SEQ ID NO: 210903 - RNA, 32 nt, Human
gugcauucccuucacuccuuuuccuacccaag

SEQ ID NO: 210904 - RNA, 32 nt, Human
gugcauucuuugucaucucuucugaguuuucg

SEQ ID NO: 210905 - RNA, 32 nt, Human
gugcauugacaucacaggcugugccaacaugu

SEQ ID NO: 210906 - RNA, 19 nt, Human
gugcauugaugaagaugau

SEQ ID NO: 210907 - RNA, 32 nt, Human
gugcauugccaagggcaagaagcugagaacau

SEQ ID NO: 210908 - RNA, 32 nt, Human
gugcauugccuguagucccagcuacuugggag

SEQ ID NO: 210909 - RNA, 32 nt, Human
gugcauugcuucuguaaaugcaggcgcaguuu

SEQ ID NO: 210910 - RNA, 32 nt, Human
gugcauuggaaucaagccuggcuaccugcaug

SEQ ID NO: 210911 - RNA, 24 nt, Human
gugcauugguucacgccuguaauc

SEQ ID NO: 210912 - RNA, 24 nt, Human
gugcauugguucaugccuauaauc

SEQ ID NO: 210913 - RNA, 32 nt, Human
gugcauugugccuguuguacaccccuggagga

SEQ ID NO: 210914 - RNA, 32 nt, Human
gugcauuuaaaaugugugacacagaaacggca

SEQ ID NO: 210915 - RNA, 32 nt, Human
gugcauuuaacuguuucaugcgcuuguuggcg

SEQ ID NO: 210916 - RNA, 32 nt, Human
gugcauuuauguuuguuuuaagacacugcauu

SEQ ID NO: 210917 - RNA, 32 nt, Human
gugcauuuauguuuguuuuaaggcacugcauu

SEQ ID NO: 210918 - RNA, 32 nt, Human
gugcauuucuucaugcguccccugcacacagg

SEQ ID NO: 210919 - RNA, 32 nt, Human
gugcauuucuugcucaucagaaccucagcuaa

SEQ ID NO: 210920 - RNA, 32 nt, Human
gugcauuuguaaucccagcuacacaggaggcu

SEQ ID NO: 210921 - RNA, 32 nt, Human
gugcauuuguguugagggaagauaaauccuuu

SEQ ID NO: 210922 - RNA, 32 nt, Human
gugcauuuucucuccuuucccuucccaaccug

SEQ ID NO: 210923 - RNA, 32 nt, Human
gugcauuuuucuaguccuaagcuuuucuuugu

SEQ ID NO: 210924 - RNA, 32 nt, Human
gugcauuuuugucuuaguucagacucauauau

SEQ ID NO: 210925 - RNA, 32 nt, Human
gugccaaaccuacuaggccauuagcccuucac

SEQ ID NO: 210926 - RNA, 32 nt, Human
gugccaaagcuuccagaagccaaaaagcuucu

SEQ ID NO: 210927 - RNA, 32 nt, Human
gugccaaauuccaggaggacaagagccuuagc

SEQ ID NO: 210928 - RNA, 32 nt, Human
gugccaacaacguggaacugaccuaaggggcc

SEQ ID NO: 210929 - RNA, 32 nt, Human
gugccaacaucaccagccugggcuaagcuccu

SEQ ID NO: 210930 - RNA, 32 nt, Human
gugccaacccauacuugcacacacaagugagu

SEQ ID NO: 210931 - RNA, 32 nt, Human
gugccaaccugaugaccacagcagaaaccccc

SEQ ID NO: 210932 - RNA, 32 nt, Human
gugccaacuguggcugguccucauucaaaggg

SEQ ID NO: 210933 - RNA, 32 nt, Human
gugccaacuuccuguggguccugggccaggcc

SEQ ID NO: 210934 - RNA, 32 nt, Human
gugccaagagccaccaggaggcccagccaaua

SEQ ID NO: 210935 - RNA, 32 nt, Human
gugccaagaugugccauuuaggucucugcaga

SEQ ID NO: 210936 - RNA, 32 nt, Human
gugccaagcacagugccugcauguauuuaucc

SEQ ID NO: 210937 - RNA, 32 nt, Human
gugccaagcucacuccugcuucucucugcacg

SEQ ID NO: 210938 - RNA, 32 nt, Human
gugccaaggaguuuucugaguuuuagggugug

SEQ ID NO: 210939 - RNA, 32 nt, Human
gugccaaggcagcacaguguugcaugggggcc

SEQ ID NO: 210940 - RNA, 32 nt, Human
gugccaaggccccaccauggaggcugaauucu

SEQ ID NO: 210941 - RNA, 32 nt, Human
gugccaaggcuggccccacucuuguagcaugg

SEQ ID NO: 210942 - RNA, 32 nt, Human
gugccaaggucuucagucugaguucacuccuu

SEQ ID NO: 210943 - RNA, 32 nt, Human
gugccaaguuguuuguaaauauaauguaaucu

SEQ ID NO: 210944 - RNA, 32 nt, Human
gugccaaucccaugccaugcaguauuaugucc

SEQ ID NO: 210945 - RNA, 32 nt, Human
gugccaaucuucuucuggcaaggaaagagauu

SEQ ID NO: 210946 - RNA, 32 nt, Human
gugccaaugcacacaaagcacucaauaaauau

SEQ ID NO: 210947 - RNA, 32 nt, Human
gugccaaugcauuccagccuggaugauggagc

SEQ ID NO: 210948 - RNA, 32 nt, Human
gugccaauggugaaaccaggaggcagagaguu

SEQ ID NO: 210949 - RNA, 32 nt, Human
gugccaauguacuccagccuaggugacagagu

SEQ ID NO: 210950 - RNA, 32 nt, Human
gugccaauuuuuacuuucuucagccaauuugu

SEQ ID NO: 210951 - RNA, 32 nt, Human
gugccacacacuccagccuggguggcaaagug

SEQ ID NO: 210952 - RNA, 20 nt, Human
gugccacacccaggcagcug

SEQ ID NO: 210953 - RNA, 32 nt, Human
gugccacacgcaugggcauugcagccuugcgc

SEQ ID NO: 210954 - RNA, 32 nt, Human
gugccacagagcaggcccugccucacugucug

SEQ ID NO: 210955 - RNA, 32 nt, Human
gugccacagaucuuuuguucucuguaaugagg

SEQ ID NO: 210956 - RNA, 32 nt, Human
gugccacagcacacaaacuuguccuacagugc

SEQ ID NO: 210957 - RNA, 32 nt, Human
gugccacagccccuccaagacaccguagagaa

SEQ ID NO: 210958 - RNA, 32 nt, Human
gugccacagcucuccagccugggcgacagagu

SEQ ID NO: 210959 - RNA, 32 nt, Human
gugccacaggguggggcaaggagauccucucu

SEQ ID NO: 210960 - RNA, 32 nt, Human
gugccacagucaccaaaugacaaggauuugcc

SEQ ID NO: 210961 - RNA, 32 nt, Human
gugccacaucuucccuccacuccccugcuuaa

SEQ ID NO: 210962 - RNA, 32 nt, Human
gugccacaucuucucccccuuuaucccuacaa

SEQ ID NO: 210963 - RNA, 23 nt, Human
gugccacauggauaaugucaacu

SEQ ID NO: 210964 - RNA, 32 nt, Human
gugccacauggcuggacuccagccaggaggac

SEQ ID NO: 210965 - RNA, 32 nt, Human
gugccaccaagaaaccuaaagugaguaaaagg

SEQ ID NO: 210966 - RNA, 32 nt, Human
gugccaccaagcucacaccuguccuucucagg

SEQ ID NO: 210967 - RNA, 27 nt, Human
gugccaccacaccuggguaauuuuuug

SEQ ID NO: 210968 - RNA, 32 nt, Human
gugccaccacacuccagccugggcgacagaau

SEQ ID NO: 210969 - RNA, 32 nt, Human
gugccaccaccaaggucucagccugggcccag

SEQ ID NO: 210970 - RNA, 32 nt, Human
gugccaccacgccugggcaacauggugaaacc

SEQ ID NO: 210971 - RNA, 32 nt, Human
gugccaccacuugccauuccuagcgcgagacc

SEQ ID NO: 210972 - RNA, 22 nt, Human
gugccaccagggcugucggcca

SEQ ID NO: 210973 - RNA, 32 nt, Human
gugccacccacugcacuggggccagcugggaa

SEQ ID NO: 210974 - RNA, 24 nt, Human
gugccacccauuuagguaucacua

SEQ ID NO: 210975 - RNA, 32 nt, Human
gugccacccccuggcccggccgcggcgcgacg

SEQ ID NO: 210976 - RNA, 21 nt, Human
gugccacccuagcagagggcc

SEQ ID NO: 210977 - RNA, 32 nt, Human
gugccacccugggcucugugggcugcacuugu

SEQ ID NO: 210978 - RNA, 32 nt, Human
gugccaccgcacuccagcaugggugacagagu

SEQ ID NO: 210979 - RNA, 21 nt, Human
gugccaccggaagugcaagga

SEQ ID NO: 210980 - RNA, 22 nt, Human
gugccaccgucaauauuuauca

SEQ ID NO: 210981 - RNA, 18 nt, Human
gugccaccgugggagugu

SEQ ID NO: 210982 - RNA, 32 nt, Human
gugccaccuacacuccagccugggugacagag

SEQ ID NO: 210983 - RNA, 32 nt, Human
gugccaccuccucucuccucugugcucaguga

SEQ ID NO: 210984 - RNA, 22 nt, Human
gugccaccugcugcuaucacca

SEQ ID NO: 210985 - RNA, 32 nt, Human
gugccacgauugcaggagucccugccaucaug

SEQ ID NO: 210986 - RNA, 16 nt, Human
gugccacgccaucuca

SEQ ID NO: 210987 - RNA, 32 nt, Human
gugccacggcacuccagccugggcagcagagu

SEQ ID NO: 210988 - RNA, 32 nt, Human
gugccacguguaugugcugugguguguccccc

SEQ ID NO: 210989 - RNA, 32 nt, Human
gugccacuacacuccagccuggccacagagcg

SEQ ID NO: 210990 - RNA, 32 nt, Human
gugccacuacacuccagccuggccgacagagc

SEQ ID NO: 210991 - RNA, 32 nt, Human
gugccacuacacuccagccugggagacagagc

SEQ ID NO: 210992 - RNA, 32 nt, Human
gugccacuacacuccagccugggcaaaagagu

SEQ ID NO: 210993 - RNA, 32 nt, Human
gugccacuacacuccagccugggcaacacagc

SEQ ID NO: 210994 - RNA, 32 nt, Human
gugccacuacacuccagccugggcaacagagu

SEQ ID NO: 210995 - RNA, 32 nt, Human
gugccacuacacuccagccugggggacagaga

SEQ ID NO: 210996 - RNA, 32 nt, Human
gugccacuacacuccagccuggguaaaagagu

SEQ ID NO: 210997 - RNA, 32 nt, Human
gugccacuacacuccagccugggugacaaagc

SEQ ID NO: 210998 - RNA, 32 nt, Human
gugccacuacacuccagccugggugacagagu

SEQ ID NO: 210999 - RNA, 32 nt, Human
gugccacuaguacuccagccugggugacagag

SEQ ID NO: 211000 - RNA, 32 nt, Human
gugccacuccacuccagccugggcaacagugu

SEQ ID NO: 211001 - RNA, 32 nt, Human
gugccacuccccuccagccugggcgacagagu

SEQ ID NO: 211002 - RNA, 32 nt, Human
gugccacucuacuccagccugggcaacacagc

SEQ ID NO: 211003 - RNA, 32 nt, Human
gugccacugaccuccagccugggggacagagc

SEQ ID NO: 211004 - RNA, 32 nt, Human
gugccacugacuaggaggcuucccugcugcgg

SEQ ID NO: 211005 - RNA, 32 nt, Human
gugccacugcaauccagccugggcaacagagc

SEQ ID NO: 211006 - RNA, 32 nt, Human
gugccacugcacacuccaaucugggugaaaga

SEQ ID NO: 211007 - RNA, 32 nt, Human
gugccacugcaccacuccagccugggcaacaa

SEQ ID NO: 211008 - RNA, 32 nt, Human
gugccacugcaccucuagucugggugacagag

SEQ ID NO: 211009 - RNA, 32 nt, Human
gugccacugcacgcacuccagccugggcgaca

SEQ ID NO: 211010 - RNA, 32 nt, Human
gugccacugcacuacaaccugggugauagagc

SEQ ID NO: 211011 - RNA, 32 nt, Human
gugccacugcacuacagcccgggcgacagagu

SEQ ID NO: 211012 - RNA, 32 nt, Human
gugccacugcacucaagccugggugacagagc

SEQ ID NO: 211013 - RNA, 32 nt, Human
gugccacugcacucaagccugggugacgagug

SEQ ID NO: 211014 - RNA, 32 nt, Human
gugccacugcacucaagccuggugacagagcg

SEQ ID NO: 211015 - RNA, 32 nt, Human
gugccacugcacucauccuggaagacagagug

SEQ ID NO: 211016 - RNA, 32 nt, Human
gugccacugcacuccaaccugagugacagcaa

SEQ ID NO: 211017 - RNA, 32 nt, Human
gugccacugcacuccaaccugggggacagagg

SEQ ID NO: 211018 - RNA, 32 nt, Human
gugccacugcacuccaaccugggugacagagu

SEQ ID NO: 211019 - RNA, 32 nt, Human
gugccacugcacuccacccugggcaacagagc

SEQ ID NO: 211020 - RNA, 32 nt, Human
gugccacugcacuccagacugggggagagagc

SEQ ID NO: 211021 - RNA, 32 nt, Human
gugccacugcacuccagacugggugacacagc

SEQ ID NO: 211022 - RNA, 32 nt, Human
gugccacugcacuccagacuuggugacagagc

SEQ ID NO: 211023 - RNA, 32 nt, Human
gugccacugcacuccagagccugggcgacaga

SEQ ID NO: 211024 - RNA, 32 nt, Human
gugccacugcacuccagccagagugacagagc

SEQ ID NO: 211025 - RNA, 32 nt, Human
gugccacugcacuccagcccaggcaacagagu

SEQ ID NO: 211026 - RNA, 32 nt, Human
gugccacugcacuccagccggggugacagaag

SEQ ID NO: 211027 - RNA, 32 nt, Human
gugccacugcacuccagccuaggcaacagagu

SEQ ID NO: 211028 - RNA, 32 nt, Human
gugccacugcacuccagccuaggcgacagagu

SEQ ID NO: 211029 - RNA, 32 nt, Human
gugccacugcacuccagccuaggugacagagc

SEQ ID NO: 211030 - RNA, 32 nt, Human
gugccacugcacuccagccugaagacagagca

SEQ ID NO: 211031 - RNA, 32 nt, Human
gugccacugcacuccagccugagcaacaaaag

SEQ ID NO: 211032 - RNA, 32 nt, Human
gugccacugcacuccagccugagcaacagagc

SEQ ID NO: 211033 - RNA, 32 nt, Human
gugccacugcacuccagccugcgggacagagu

SEQ ID NO: 211034 - RNA, 32 nt, Human
gugccacugcacuccagccuggacaacggagu

SEQ ID NO: 211035 - RNA, 32 nt, Human
gugccacugcacuccagccuggacgacagagc

SEQ ID NO: 211036 - RNA, 32 nt, Human
gugccacugcacuccagccuggaggacagagc

SEQ ID NO: 211037 - RNA, 32 nt, Human
gugccacugcacuccagccuggauuacagagu

SEQ ID NO: 211038 - RNA, 32 nt, Human
gugccacugcacuccagccuggcaacagagca

SEQ ID NO: 211039 - RNA, 32 nt, Human
gugccacugcacuccagccuggcaacagagug

SEQ ID NO: 211040 - RNA, 32 nt, Human
gugccacugcacuccagccuggcgacacagug

SEQ ID NO: 211041 - RNA, 32 nt, Human
gugccacugcacuccagccuggcgacagagca

SEQ ID NO: 211042 - RNA, 32 nt, Human
gugccacugcacuccagccugggagacagagc

SEQ ID NO: 211043 - RNA, 32 nt, Human
gugccacugcacuccagccugggagacagagu

SEQ ID NO: 211044 - RNA, 32 nt, Human
gugccacugcacuccagccugggcaacaagag

SEQ ID NO: 211045 - RNA, 32 nt, Human
gugccacugcacuccagccugggcaacaagcg

SEQ ID NO: 211046 - RNA, 32 nt, Human
gugccacugcacuccagccugggcaacaaggg

SEQ ID NO: 211047 - RNA, 32 nt, Human
gugccacugcacuccagccugggcaacacagc

SEQ ID NO: 211048 - RNA, 32 nt, Human
gugccacugcacuccagccugggcaacacagu

SEQ ID NO: 211049 - RNA, 32 nt, Human
gugccacugcacuccagccugggcaacagagc

SEQ ID NO: 211050 - RNA, 32 nt, Human
gugccacugcacuccagccugggcaacagagu

SEQ ID NO: 211051 - RNA, 32 nt, Human
gugccacugcacuccagccugggcaacugagc

SEQ ID NO: 211052 - RNA, 32 nt, Human
gugccacugcacuccagccugggcaauagagc

SEQ ID NO: 211053 - RNA, 32 nt, Human
gugccacugcacuccagccugggcaauagagu

SEQ ID NO: 211054 - RNA, 32 nt, Human
gugccacugcacuccagccugggcaccaaugu

SEQ ID NO: 211055 - RNA, 32 nt, Human
gugccacugcacuccagccugggcaccacagc

SEQ ID NO: 211056 - RNA, 32 nt, Human
gugccacugcacuccagccugggcaccagagc

SEQ ID NO: 211057 - RNA, 32 nt, Human
gugccacugcacuccagccugggcagcagagc

SEQ ID NO: 211058 - RNA, 32 nt, Human
gugccacugcacuccagccugggccacagaac

SEQ ID NO: 211059 - RNA, 32 nt, Human
gugccacugcacuccagccugggccacagagc

SEQ ID NO: 211060 - RNA, 32 nt, Human
gugccacugcacuccagccugggccacagagu

SEQ ID NO: 211061 - RNA, 32 nt, Human
gugccacugcacuccagccugggcgaaagagc

SEQ ID NO: 211062 - RNA, 32 nt, Human
gugccacugcacuccagccugggcgacaagag

SEQ ID NO: 211063 - RNA, 32 nt, Human
gugccacugcacuccagccugggcgacagagc

SEQ ID NO: 211064 - RNA, 32 nt, Human
gugccacugcacuccagccugggcgacagagu

SEQ ID NO: 211065 - RNA, 32 nt, Human
gugccacugcacuccagccugggcgacaguga

SEQ ID NO: 211066 - RNA, 32 nt, Human
gugccacugcacuccagccugggcgacgagug

SEQ ID NO: 211067 - RNA, 32 nt, Human
gugccacugcacuccagccugggcgauagagc

SEQ ID NO: 211068 - RNA, 32 nt, Human
gugccacugcacuccagccugggcuacaagau

SEQ ID NO: 211069 - RNA, 32 nt, Human
gugccacugcacuccagccuggggaacagagc

SEQ ID NO: 211070 - RNA, 32 nt, Human
gugccacugcacuccagccugggggacagagc

SEQ ID NO: 211071 - RNA, 32 nt, Human
gugccacugcacuccagccugggggacagagu

SEQ ID NO: 211072 - RNA, 32 nt, Human
gugccacugcacuccagccuggguaacagagc

SEQ ID NO: 211073 - RNA, 32 nt, Human
gugccacugcacuccagccuggguaacaguga

SEQ ID NO: 211074 - RNA, 32 nt, Human
gugccacugcacuccagccuggguaagagagc

SEQ ID NO: 211075 - RNA, 32 nt, Human
gugccacugcacuccagccugggugaaagagc

SEQ ID NO: 211076 - RNA, 32 nt, Human
gugccacugcacuccagccugggugacaaaag

SEQ ID NO: 211077 - RNA, 32 nt, Human
gugccacugcacuccagccugggugacacagc

SEQ ID NO: 211078 - RNA, 32 nt, Human
gugccacugcacuccagccugggugacagaga

SEQ ID NO: 211079 - RNA, 32 nt, Human
gugccacugcacuccagccugggugacagagc

SEQ ID NO: 211080 - RNA, 32 nt, Human
gugccacugcacuccagccugggugacagagu

SEQ ID NO: 211081 - RNA, 32 nt, Human
gugccacugcacuccagccugggugacagcga

SEQ ID NO: 211082 - RNA, 32 nt, Human
gugccacugcacuccagccugggugacagggc

SEQ ID NO: 211083 - RNA, 32 nt, Human
gugccacugcacuccagccugggugacugagu

SEQ ID NO: 211084 - RNA, 32 nt, Human
gugccacugcacuccagccugggugauagagc

SEQ ID NO: 211085 - RNA, 32 nt, Human
gugccacugcacuccagccuggguggacagag

SEQ ID NO: 211086 - RNA, 32 nt, Human
gugccacugcacuccagccuggguggcagagc

SEQ ID NO: 211087 - RNA, 32 nt, Human
gugccacugcacuccagccuggguggcagagu

SEQ ID NO: 211088 - RNA, 32 nt, Human
gugccacugcacuccagccuggguuacagagu

SEQ ID NO: 211089 - RNA, 32 nt, Human
gugccacugcacuccagccuggucaacaaagc

SEQ ID NO: 211090 - RNA, 32 nt, Human
gugccacugcacuccagccuggucaacagagc

SEQ ID NO: 211091 - RNA, 32 nt, Human
gugccacugcacuccagccuggugacagagug

SEQ ID NO: 211092 - RNA, 32 nt, Human
gugccacugcacuccagccuggugagagcaag

SEQ ID NO: 211093 - RNA, 32 nt, Human
gugccacugcacuccagccugguugacagagc

SEQ ID NO: 211094 - RNA, 32 nt, Human
gugccacugcacuccagccuugagacagagcg

SEQ ID NO: 211095 - RNA, 32 nt, Human
gugccacugcacuccagccuuggcaacaagag

SEQ ID NO: 211096 - RNA, 32 nt, Human
gugccacugcacuccagccuuggcaacacagu

SEQ ID NO: 211097 - RNA, 32 nt, Human
gugccacugcacuccagccuuggugacagagc

SEQ ID NO: 211098 - RNA, 32 nt, Human
gugccacugcacuccagcgugggcaacggaga

SEQ ID NO: 211099 - RNA, 32 nt, Human
gugccacugcacuccagcuggguggcagagac

SEQ ID NO: 211100 - RNA, 32 nt, Human
gugccacugcacuccagcuuaggugacagagu

SEQ ID NO: 211101 - RNA, 32 nt, Human
gugccacugcacuccagcuugggcaacaaagu

SEQ ID NO: 211102 - RNA, 32 nt, Human
gugccacugcacuccagcuugggugacagagu

SEQ ID NO: 211103 - RNA, 32 nt, Human
gugccacugcacuccagcuuggugacagagug

SEQ ID NO: 211104 - RNA, 32 nt, Human
gugccacugcacuccaggcugggcgacagagu

SEQ ID NO: 211105 - RNA, 32 nt, Human
gugccacugcacuccaggcugggugacagagc

SEQ ID NO: 211106 - RNA, 32 nt, Human
gugccacugcacuccaguauggaugacauagu

SEQ ID NO: 211107 - RNA, 32 nt, Human
gugccacugcacuccagucuggacaacagagc

SEQ ID NO: 211108 - RNA, 32 nt, Human
gugccacugcacuccagucugggcaacagagc

SEQ ID NO: 211109 - RNA, 32 nt, Human
gugccacugcacuccagucugggugacagagu

SEQ ID NO: 211110 - RNA, 32 nt, Human
gugccacugcacuccauccuggacgacagagu

SEQ ID NO: 211111 - RNA, 32 nt, Human
gugccacugcacucccagccugggcaacggag

SEQ ID NO: 211112 - RNA, 32 nt, Human
gugccacugcacucccgccugggcgacagagc

SEQ ID NO: 211113 - RNA, 32 nt, Human
gugccacugcacuccggccugggugauggagc

SEQ ID NO: 211114 - RNA, 32 nt, Human
gugccacugcacucgagccugggugacagagu

SEQ ID NO: 211115 - RNA, 32 nt, Human
gugccacugcacucuaaccugggcgacagagu

SEQ ID NO: 211116 - RNA, 32 nt, Human
gugccacugcacucuagccggggcgacagagc

SEQ ID NO: 211117 - RNA, 32 nt, Human
gugccacugcacucuagccuagguggcugagc

SEQ ID NO: 211118 - RNA, 32 nt, Human
gugccacugcacucuagccucggugacagagu

SEQ ID NO: 211119 - RNA, 32 nt, Human
gugccacugcacucuagccuggacagcagagc

SEQ ID NO: 211120 - RNA, 32 nt, Human
gugccacugcacucuagccugggcaauaagca

SEQ ID NO: 211121 - RNA, 32 nt, Human
gugccacugcacucuagccugggcgacagagc

SEQ ID NO: 211122 - RNA, 32 nt, Human
gugccacugcacucuagccugggugacaaagc

SEQ ID NO: 211123 - RNA, 32 nt, Human
gugccacugcacucuagccugggugacagaga

SEQ ID NO: 211124 - RNA, 32 nt, Human
gugccacugcacucuagccugggugacagagc

SEQ ID NO: 211125 - RNA, 32 nt, Human
gugccacugcacucuauccuggguaacagcga

SEQ ID NO: 211126 - RNA, 32 nt, Human
gugccacugcacugcagccugggcgacaauuu

SEQ ID NO: 211127 - RNA, 32 nt, Human
gugccacugcacugcagccugggcuacagaga

SEQ ID NO: 211128 - RNA, 32 nt, Human
gugccacugcacugcaggcugggugacagagu

SEQ ID NO: 211129 - RNA, 32 nt, Human
gugccacugcacuucagccugggcaacagagu

SEQ ID NO: 211130 - RNA, 32 nt, Human
gugccacugcacuucagccugggcgacagagu

SEQ ID NO: 211131 - RNA, 32 nt, Human
gugccacugcacuucagccugggugacagaaa

SEQ ID NO: 211132 - RNA, 32 nt, Human
gugccacugcacuucagccugggugacagagu

SEQ ID NO: 211133 - RNA, 32 nt, Human
gugccacugcacuucagcuugggcaacagagu

SEQ ID NO: 211134 - RNA, 32 nt, Human
gugccacugcacuucagcuugggugacagagc

SEQ ID NO: 211135 - RNA, 32 nt, Human
gugccacugcacuuuucagccugggugccaca

SEQ ID NO: 211136 - RNA, 32 nt, Human
gugccacugcaguccagccuaggcaacagagu

SEQ ID NO: 211137 - RNA, 32 nt, Human
gugccacugcaguccagccugggugacagagc

SEQ ID NO: 211138 - RNA, 32 nt, Human
gugccacugcauaccagccuaggugacagaau

SEQ ID NO: 211139 - RNA, 21 nt, Human
gugccacugcaugcucaacca

SEQ ID NO: 211140 - RNA, 32 nt, Human
gugccacugcauuccagccugagcgacagagu

SEQ ID NO: 211141 - RNA, 32 nt, Human
gugccacugcauuccagccugggcaacagagc

SEQ ID NO: 211142 - RNA, 32 nt, Human
gugccacugcauuccagccugggcgacagagc

SEQ ID NO: 211143 - RNA, 32 nt, Human
gugccacugcauuccagccugggugacagaau

SEQ ID NO: 211144 - RNA, 32 nt, Human
gugccacugcauuccagccugguugacagagu

SEQ ID NO: 211145 - RNA, 32 nt, Human
gugccacugcccuccagccugggugacagagu

SEQ ID NO: 211146 - RNA, 32 nt, Human
gugccacugcgcccaaacauaacugaagguuu

SEQ ID NO: 211147 - RNA, 32 nt, Human
gugccacugcgcuccagccugggcgacagagu

SEQ ID NO: 211148 - RNA, 32 nt, Human
gugccacugcgcuccagccugggggaggggga

SEQ ID NO: 211149 - RNA, 32 nt, Human
gugccacugcgcuccagccugggugacagagu

SEQ ID NO: 211150 - RNA, 32 nt, Human
gugccacugcgcuccagccuggguggcagaga

SEQ ID NO: 211151 - RNA, 32 nt, Human
gugccacugcucuccagccugggaggcacagc

SEQ ID NO: 211152 - RNA, 32 nt, Human
gugccacugcucuccagccugggugacagagg

SEQ ID NO: 211153 - RNA, 32 nt, Human
gugccacuggacuccagccugggagacagaau

SEQ ID NO: 211154 - RNA, 32 nt, Human
gugccacuggacucccagccugggugacagag

SEQ ID NO: 211155 - RNA, 23 nt, Human
gugccacuggagaauaacaauca

SEQ ID NO: 211156 - RNA, 21 nt, Human
gugccacuguacauaucauca

SEQ ID NO: 211157 - RNA, 32 nt, Human
gugccacuguacaucaccagccugggcgacag

SEQ ID NO: 211158 - RNA, 32 nt, Human
gugccacuguacuccagccaggccacagagug

SEQ ID NO: 211159 - RNA, 32 nt, Human
gugccacuguacuccagccuggaagacaagag

SEQ ID NO: 211160 - RNA, 32 nt, Human
gugccacuguacuccagccuggcccacagagu

SEQ ID NO: 211161 - RNA, 32 nt, Human
gugccacuguacuccagccugggagauagagc

SEQ ID NO: 211162 - RNA, 32 nt, Human
gugccacuguacuccagccugggcagcagagc

SEQ ID NO: 211163 - RNA, 32 nt, Human
gugccacuguacuccagccugggcgacagagg

SEQ ID NO: 211164 - RNA, 32 nt, Human
gugccacuguacuccagccugggugacagagc

SEQ ID NO: 211165 - RNA, 32 nt, Human
gugccacuguacuccagccugggugacagagu

SEQ ID NO: 211166 - RNA, 32 nt, Human
gugccacuguacuccagccugggugauaggau

SEQ ID NO: 211167 - RNA, 32 nt, Human
gugccacuguacuccagccuggugacagagcg

SEQ ID NO: 211168 - RNA, 32 nt, Human
gugccacugucacccagggcucccgggccuca

SEQ ID NO: 211169 - RNA, 32 nt, Human
gugccacugucaggacagcuuaugaaaaacaa

SEQ ID NO: 211170 - RNA, 19 nt, Human
gugccacuguccccccagc

SEQ ID NO: 211171 - RNA, 32 nt, Human
gugccacugugcuccagccuggaugacggagc

SEQ ID NO: 211172 - RNA, 32 nt, Human
gugccacuguuuuccagccugggcaauacagu

SEQ ID NO: 211173 - RNA, 32 nt, Human
gugccacuucacuccagccugggcaaaagagc

SEQ ID NO: 211174 - RNA, 32 nt, Human
gugccacuucacuccagccugggugacaaagu

SEQ ID NO: 211175 - RNA, 32 nt, Human
gugccacuucauuccagccugggcgacagagc

SEQ ID NO: 211176 - RNA, 32 nt, Human
gugccacuucccuccagccugggcaauagagc

SEQ ID NO: 211177 - RNA, 32 nt, Human
gugccacuucuuucuucuccuuucuucugggc

SEQ ID NO: 211178 - RNA, 21 nt, Human
gugccacuugcccccagggca

SEQ ID NO: 211179 - RNA, 24 nt, Human
gugccacuugcccccagggcacuc

SEQ ID NO: 211180 - RNA, 24 nt, Human
gugccacuuguccccagggcacuc

SEQ ID NO: 211181 - RNA, 32 nt, Human
gugccagaacuguccagagcugugaguuuugu

SEQ ID NO: 211182 - RNA, 32 nt, Human
gugccagaagaaaacacacacagggaaaccgc

SEQ ID NO: 211183 - RNA, 32 nt, Human
gugccagaaggaagguuggcgggggcacgugu

SEQ ID NO: 211184 - RNA, 32 nt, Human
gugccagaaugauucucaucugugccauauuu

SEQ ID NO: 211185 - RNA, 32 nt, Human
gugccagagaagaguccuuucuucucuacauc

SEQ ID NO: 211186 - RNA, 22 nt, Human
gugccagagaauguacagauca

SEQ ID NO: 211187 - RNA, 32 nt, Human
gugccagagagggacgaaccaggguggaagcg

SEQ ID NO: 211188 - RNA, 32 nt, Human
gugccagagcccagccggcgcggagcgggagc

SEQ ID NO: 211189 - RNA, 32 nt, Human
gugccagagcuccaugcauggaaaaguggccu

SEQ ID NO: 211190 - RNA, 32 nt, Human
gugccagaguuucaaugaaaaucauuaaagua

SEQ ID NO: 211191 - RNA, 32 nt, Human
gugccagauauaacugucuuguuucagugaga

SEQ ID NO: 211192 - RNA, 21 nt, Human
gugccagaugugccccagccc

SEQ ID NO: 211193 - RNA, 32 nt, Human
gugccagcagggacucaguaccugagccucaa

SEQ ID NO: 211194 - RNA, 32 nt, Human
gugccagccaccgugugaacucuuuggagguu

SEQ ID NO: 211195 - RNA, 32 nt, Human
gugccagccagccucugccagaccucucuuuc

SEQ ID NO: 211196 - RNA, 32 nt, Human
gugccagccagcugcuguucuaggcucuuaga

SEQ ID NO: 211197 - RNA, 32 nt, Human
gugccagccccaggaagcuccagggcugagug

SEQ ID NO: 211198 - RNA, 26 nt, Human
gugccagcccucccagccccaggccc

SEQ ID NO: 211199 - RNA, 32 nt, Human
gugccagcccugcugcccuggcuuugagcugg

SEQ ID NO: 211200 - RNA, 32 nt, Human
gugccagccugagacgguuccugccugucuug

SEQ ID NO: 211201 - RNA, 32 nt, Human
gugccagccugagacucaacuaucaggaaaaa

SEQ ID NO: 211202 - RNA, 32 nt, Human
gugccagccugggaaguaguuucguuuccuuc

SEQ ID NO: 211203 - RNA, 22 nt, Human
gugccagcgaggcuguccucug

SEQ ID NO: 211204 - RNA, 32 nt, Human
gugccagcuagaaaauacugcuuucugccauc

SEQ ID NO: 211205 - RNA, 32 nt, Human
gugccagcugaucguggcuuuccuagaaguga

SEQ ID NO: 211206 - RNA, 32 nt, Human
gugccagcuguucaccaccgagcuaggccggg

SEQ ID NO: 211207 - RNA, 32 nt, Human
gugccaggaccacccuugccugcagccuuugc

SEQ ID NO: 211208 - RNA, 32 nt, Human
gugccaggagcugugggagcugcuagguggug

SEQ ID NO: 211209 - RNA, 32 nt, Human
gugccaggaggaagaaggaaggagucccuuag

SEQ ID NO: 211210 - RNA, 32 nt, Human
gugccaggagguugccuguccuuggggaagag

SEQ ID NO: 211211 - RNA, 32 nt, Human
gugccaggaguacaugugagacuaugggagga

SEQ ID NO: 211212 - RNA, 32 nt, Human
gugccaggaucugggagagggaagggaggugu

SEQ ID NO: 211213 - RNA, 32 nt, Human
gugccaggcaaggacuguggauuucaagaacu

SEQ ID NO: 211214 - RNA, 32 nt, Human
gugccaggcacuguacagggugauggagauca

SEQ ID NO: 211215 - RNA, 32 nt, Human
gugccaggcccagugcagcaguguccugcuca

SEQ ID NO: 211216 - RNA, 32 nt, Human
gugccaggcuagacuaggagguuccggugucu

SEQ ID NO: 211217 - RNA, 32 nt, Human
gugccaggcucuguucuaagcacuuugugaga

SEQ ID NO: 211218 - RNA, 32 nt, Human
gugccaggcugacugugcagagggugauuagu

SEQ ID NO: 211219 - RNA, 32 nt, Human
gugccaggcugcagggcaggcaguaaaaggcc

SEQ ID NO: 211220 - RNA, 32 nt, Human
gugccagggaagggaaggaaaagcucuucccu

SEQ ID NO: 211221 - RNA, 32 nt, Human
gugccagggaccaacgggccacccucaggaaa

SEQ ID NO: 211222 - RNA, 32 nt, Human
gugccagggagaggagggcggguggggaccac

SEQ ID NO: 211223 - RNA, 32 nt, Human
gugccagguccuggugccacgcuagcugagca

SEQ ID NO: 211224 - RNA, 32 nt, Human
gugccaggugaaggaggcuccaggcagcaccc

SEQ ID NO: 211225 - RNA, 32 nt, Human
gugccaggugacaccaaggaggggccuguuua

SEQ ID NO: 211226 - RNA, 32 nt, Human
gugccaggugucuuucauggggccuuccagac

SEQ ID NO: 211227 - RNA, 32 nt, Human
gugccaggugugguggcucaggccuguaaucc

SEQ ID NO: 211228 - RNA, 32 nt, Human
gugccagguugaagagagugugccagugacag

SEQ ID NO: 211229 - RNA, 32 nt, Human
gugccaguauauggcccuggcucugcauugga

SEQ ID NO: 211230 - RNA, 32 nt, Human
gugccagucagauguucuucuccuucagcuuc

SEQ ID NO: 211231 - RNA, 32 nt, Human
gugccagucaucugaccugauucuuuaaaccc

SEQ ID NO: 211232 - RNA, 32 nt, Human
gugccaguccccucacucucugggagcuguga

SEQ ID NO: 211233 - RNA, 32 nt, Human
gugccaguccccucagccugugguggccuugc

SEQ ID NO: 211234 - RNA, 32 nt, Human
gugccagucucgggggcgagguacaggccugg

SEQ ID NO: 211235 - RNA, 32 nt, Human
gugccagucuguguccguugugaucacaggcc

SEQ ID NO: 211236 - RNA, 24 nt, Human
gugccagugaaccgcauccugccc

SEQ ID NO: 211237 - RNA, 32 nt, Human
gugccagugacuacuucucccuggugagugua

SEQ ID NO: 211238 - RNA, 32 nt, Human
gugccagugcacuccagccugggugacagcga

SEQ ID NO: 211239 - RNA, 32 nt, Human
gugccagugcacuccaggcuggacgacagagc

SEQ ID NO: 211240 - RNA, 32 nt, Human
gugccagugcacuccggccugggugacagagu

SEQ ID NO: 211241 - RNA, 32 nt, Human
gugccagugcaggccaggcagggggcugaggc

SEQ ID NO: 211242 - RNA, 32 nt, Human
gugccaguugccagggcaagucacugcgcugg

SEQ ID NO: 211243 - RNA, 32 nt, Human
gugccaguuuaaaaagaugaaaaagaauaaaa

SEQ ID NO: 211244 - RNA, 32 nt, Human
gugccaguuuccugagcuguguguacuacuug

SEQ ID NO: 211245 - RNA, 32 nt, Human
gugccauacauacauuucauuuaauuauccaa

SEQ ID NO: 211246 - RNA, 32 nt, Human
gugccauccccacccauagggcuggcucacau

SEQ ID NO: 211247 - RNA, 32 nt, Human
gugccaucccucgaauccaccagcacgagcgu

SEQ ID NO: 211248 - RNA, 32 nt, Human
gugccauccgggauuguuuccccaaguuguua

SEQ ID NO: 211249 - RNA, 32 nt, Human
gugccauccuacagguggcuggagcagcugcu

SEQ ID NO: 211250 - RNA, 32 nt, Human
gugccauccugaagccuuccuccuggauguca

SEQ ID NO: 211251 - RNA, 32 nt, Human
gugccauccuuggcaaugugacccuggagcag

SEQ ID NO: 211252 - RNA, 32 nt, Human
gugccaucgcacuccagccuggacaacagagc

SEQ ID NO: 211253 - RNA, 19 nt, Human
gugccaucucacaaaagaa

SEQ ID NO: 211254 - RNA, 32 nt, Human
gugccaucucccaccauacucuggcauuuuua

SEQ ID NO: 211255 - RNA, 23 nt, Human
gugccaucucugcaaaucaauca

SEQ ID NO: 211256 - RNA, 32 nt, Human
gugccaucuguccuccugucugugccaggagg

SEQ ID NO: 211257 - RNA, 32 nt, Human
gugccaucuuccuccagcaccaggaagaaggg

SEQ ID NO: 211258 - RNA, 24 nt, Human
gugccaucuuggccaccucggcca

SEQ ID NO: 211259 - RNA, 32 nt, Human
gugccaugaaaccagguccuggaacagaaucc

SEQ ID NO: 211260 - RNA, 21 nt, Human
gugccaugaagggacccuuug

SEQ ID NO: 211261 - RNA, 32 nt, Human
gugccaugagccuggacacccaggagacgcag

SEQ ID NO: 211262 - RNA, 32 nt, Human
gugccauggcaaagaaacagcguccagagcag

SEQ ID NO: 211263 - RNA, 24 nt, Human
gugccauggcucacaccuguaauc

SEQ ID NO: 211264 - RNA, 24 nt, Human
gugccauggcucacaucuguaauc

SEQ ID NO: 211265 - RNA, 32 nt, Human
gugccaugggcugagugccacgacaggcccgu

SEQ ID NO: 211266 - RNA, 32 nt, Human
gugccaugggguccccacugugggcagccccg

SEQ ID NO: 211267 - RNA, 32 nt, Human
gugccaugggguccccacugugggcagcccug

SEQ ID NO: 211268 - RNA, 32 nt, Human
gugccaugguggguguccuggggccugugcgg

SEQ ID NO: 211269 - RNA, 32 nt, Human
gugccauguaaaaguaagucuggacuuaagag

SEQ ID NO: 211270 - RNA, 32 nt, Human
gugccauguccaccuguuguuccuggacucug

SEQ ID NO: 211271 - RNA, 17 nt, Human
gugccauguccaggugg

SEQ ID NO: 211272 - RNA, 32 nt, Human
gugccaugugccacagauggagaggaccagga

SEQ ID NO: 211273 - RNA, 22 nt, Human
gugccauuaagcaauuuagcua

SEQ ID NO: 211274 - RNA, 23 nt, Human
gugccauucagcucacagccgca

SEQ ID NO: 211275 - RNA, 32 nt, Human
gugccauucauuuagaauuagcagagcuaaua

SEQ ID NO: 211276 - RNA, 32 nt, Human
gugccauuccacuccagccugagcaacacagu

SEQ ID NO: 211277 - RNA, 32 nt, Human
gugccauuccacuccagccugggcaacgagag

SEQ ID NO: 211278 - RNA, 32 nt, Human
gugccauuccuucauguuuucucaguuuggag

SEQ ID NO: 211279 - RNA, 24 nt, Human
gugccauucugggcagucgcacca

SEQ ID NO: 211280 - RNA, 32 nt, Human
gugccauugcacuccaaccugggcaacaagag

SEQ ID NO: 211281 - RNA, 32 nt, Human
gugccauugcacuccaagccugggcaacagag

SEQ ID NO: 211282 - RNA, 32 nt, Human
gugccauugcacuccagcccaggcgacagaac

SEQ ID NO: 211283 - RNA, 32 nt, Human
gugccauugcacuccagcccggaugacagagc

SEQ ID NO: 211284 - RNA, 32 nt, Human
gugccauugcacuccagccuaggcaacaagag

SEQ ID NO: 211285 - RNA, 32 nt, Human
gugccauugcacuccagccuaggcaagaagag

SEQ ID NO: 211286 - RNA, 32 nt, Human
gugccauugcacuccagccuaggcaauaagag

SEQ ID NO: 211287 - RNA, 32 nt, Human
gugccauugcacuccagccugcacaacaagag

SEQ ID NO: 211288 - RNA, 32 nt, Human
gugccauugcacuccagccuggacaacaagag

SEQ ID NO: 211289 - RNA, 32 nt, Human
gugccauugcacuccagccuggaugacaagag

SEQ ID NO: 211290 - RNA, 32 nt, Human
gugccauugcacuccagccuggccacagagcg

SEQ ID NO: 211291 - RNA, 32 nt, Human
gugccauugcacuccagccuggcgacaagagc

SEQ ID NO: 211292 - RNA, 32 nt, Human
gugccauugcacuccagccuggcgacagagug

SEQ ID NO: 211293 - RNA, 32 nt, Human
gugccauugcacuccagccugggcaacaagaa

SEQ ID NO: 211294 - RNA, 32 nt, Human
gugccauugcacuccagccugggcaacaagag

SEQ ID NO: 211295 - RNA, 32 nt, Human
gugccauugcacuccagccugggcaacagagc

SEQ ID NO: 211296 - RNA, 32 nt, Human
gugccauugcacuccagccugggcaacagggc

SEQ ID NO: 211297 - RNA, 32 nt, Human
gugccauugcacuccagccugggcaacgagcg

SEQ ID NO: 211298 - RNA, 32 nt, Human
gugccauugcacuccagccugggcaauagagu

SEQ ID NO: 211299 - RNA, 32 nt, Human
gugccauugcacuccagccugggcgacaagag

SEQ ID NO: 211300 - RNA, 32 nt, Human
gugccauugcacuccagccugggcgacaagcg

SEQ ID NO: 211301 - RNA, 32 nt, Human
gugccauugcacuccagccugggcgacagagc

SEQ ID NO: 211302 - RNA, 32 nt, Human
gugccauugcacuccagccugggcgacagagg

SEQ ID NO: 211303 - RNA, 32 nt, Human
gugccauugcacuccagccugggcgacagugc

SEQ ID NO: 211304 - RNA, 32 nt, Human
gugccauugcacuccagccugggcuacaagag

SEQ ID NO: 211305 - RNA, 32 nt, Human
gugccauugcacuccagccugggugacagagc

SEQ ID NO: 211306 - RNA, 32 nt, Human
gugccauugcacuccagccugggugacaguga

SEQ ID NO: 211307 - RNA, 32 nt, Human
gugccauugcacuccagccugggugauaagag

SEQ ID NO: 211308 - RNA, 32 nt, Human
gugccauugcacuccagucggguuaacagagc

SEQ ID NO: 211309 - RNA, 32 nt, Human
gugccauugcacuccagucugggagacaagag

SEQ ID NO: 211310 - RNA, 32 nt, Human
gugccauugcacuccagucuggguaagaagag

SEQ ID NO: 211311 - RNA, 32 nt, Human
gugccauugcacuccggccugggcaacaacag

SEQ ID NO: 211312 - RNA, 32 nt, Human
gugccauugcacuccggccugggcaacagagg

SEQ ID NO: 211313 - RNA, 32 nt, Human
gugccauugcauuccagccugggagacggagc

SEQ ID NO: 211314 - RNA, 32 nt, Human
gugccauugcccuccagccugggcaagaacug

SEQ ID NO: 211315 - RNA, 32 nt, Human
gugccauugccguggugcuuggcauugagggg

SEQ ID NO: 211316 - RNA, 32 nt, Human
gugccauugcgcuccagccuaggugacagagc

SEQ ID NO: 211317 - RNA, 32 nt, Human
gugccauugcgcuccagccugggcaacaagag

SEQ ID NO: 211318 - RNA, 32 nt, Human
gugccauugcucuccagccugggcgacaagag

SEQ ID NO: 211319 - RNA, 32 nt, Human
gugccauuguacuccagccugggcgacaaaag

SEQ ID NO: 211320 - RNA, 32 nt, Human
gugccauuguacuccagcuugggcaacagagu

SEQ ID NO: 211321 - RNA, 32 nt, Human
gugccauuguauuccagccucggcaacacagc

SEQ ID NO: 211322 - RNA, 32 nt, Human
gugccauugugcuccagccugggcaacaagag

SEQ ID NO: 211323 - RNA, 32 nt, Human
gugccauugugcuccagccugggcaacagagu

SEQ ID NO: 211324 - RNA, 32 nt, Human
gugccauuucacuccagccuggacaacaagag

SEQ ID NO: 211325 - RNA, 32 nt, Human
gugccauuuugcauuuucaucuacucauuuaa

SEQ ID NO: 211326 - RNA, 22 nt, Human
gugcccaaaggaugaggaucuc

SEQ ID NO: 211327 - RNA, 28 nt, Human
gugcccaacuucuaagccucaucagcaa

SEQ ID NO: 211328 - RNA, 32 nt, Human
gugcccaaugggacaggaccuuagaagggagg

SEQ ID NO: 211329 - RNA, 32 nt, Human
gugcccacagccgucuggcucagggacuccac

SEQ ID NO: 211330 - RNA, 26 nt, Human
gugcccacaucuauuccaucugguca

SEQ ID NO: 211331 - RNA, 32 nt, Human
gugcccacauggaauguccucccgggcugacc

SEQ ID NO: 211332 - RNA, 32 nt, Human
gugcccacauguguccaucccagcggcuggug

SEQ ID NO: 211333 - RNA, 23 nt, Human
gugcccaccagucagauccugug

SEQ ID NO: 211334 - RNA, 23 nt, Human
gugcccaccaugccccuuccucu

SEQ ID NO: 211335 - RNA, 32 nt, Human
gugcccaccaugccccuuccucuuucuccucc

SEQ ID NO: 211336 - RNA, 21 nt, Human
gugcccacccccggaauucca

SEQ ID NO: 211337 - RNA, 32 nt, Human
gugcccaccccuccaccacauggggccccaaa

SEQ ID NO: 211338 - RNA, 24 nt, Human
gugcccacccgucuucaaucucug

SEQ ID NO: 211339 - RNA, 32 nt, Human
gugcccacccucucccugguguggccccguca

SEQ ID NO: 211340 - RNA, 32 nt, Human
gugcccaccugccucacuccucccuaucaugu

SEQ ID NO: 211341 - RNA, 24 nt, Human
gugcccaccuguccugcuucucug

SEQ ID NO: 211342 - RNA, 32 nt, Human
gugcccacgugcaagaggagagacaggagagg

SEQ ID NO: 211343 - RNA, 20 nt, Human
gugcccacguuucugaccug

SEQ ID NO: 211344 - RNA, 22 nt, Human
gugcccacucccaggcccucug

SEQ ID NO: 211345 - RNA, 23 nt, Human
gugcccacucccgccagccccug

SEQ ID NO: 211346 - RNA, 28 nt, Human
gugcccacucgugcugccucuucuuaac

SEQ ID NO: 211347 - RNA, 18 nt, Human
gugcccacugcccucccu

SEQ ID NO: 211348 - RNA, 24 nt, Human
gugcccacuggcugggacccuuug

SEQ ID NO: 211349 - RNA, 32 nt, Human
gugcccagaaguuugaggcugcagugagccgu

SEQ ID NO: 211350 - RNA, 32 nt, Human
gugcccagaauggaugaccaggaaccuuaaag

SEQ ID NO: 211351 - RNA, 32 nt, Human
gugcccagaauggaugaccaggaaccuucaag

SEQ ID NO: 211352 - RNA, 32 nt, Human
gugcccagagcacccugcucagugggagaggg

SEQ ID NO: 211353 - RNA, 32 nt, Human
gugcccagaucugagcgaggcuugggaagacg

SEQ ID NO: 211354 - RNA, 32 nt, Human
gugcccagcaucagcgccagcacacaguaggu

SEQ ID NO: 211355 - RNA, 32 nt, Human
gugcccagccacaugcucucucccucucuuca

SEQ ID NO: 211356 - RNA, 32 nt, Human
gugcccagcccaggcagggucagucagaacag

SEQ ID NO: 211357 - RNA, 32 nt, Human
gugcccagcccggcccuggcucagggaggacc

SEQ ID NO: 211358 - RNA, 32 nt, Human
gugcccagccuauaucuacuugagccugugug

SEQ ID NO: 211359 - RNA, 32 nt, Human
gugcccagcucuccagggagcuucuggcccaa

SEQ ID NO: 211360 - RNA, 32 nt, Human
gugcccagcuuugcuuagcuuucuuuauuucu

SEQ ID NO: 211361 - RNA, 32 nt, Human
gugcccaggaagaggaaguaguguacgauaca

SEQ ID NO: 211362 - RNA, 32 nt, Human
gugcccaggaagaggagaaccggcagcugcug

SEQ ID NO: 211363 - RNA, 32 nt, Human
gugcccaggaagggacuucauuucugccugug

SEQ ID NO: 211364 - RNA, 32 nt, Human
gugcccaggaaggggaguaacugugcaaaguu

SEQ ID NO: 211365 - RNA, 32 nt, Human
gugcccaggacugugcuggaugcuaaccagac

SEQ ID NO: 211366 - RNA, 32 nt, Human
gugcccaggagcugaaggugggggugacacug

SEQ ID NO: 211367 - RNA, 32 nt, Human
gugcccaggaguucaagaccagccugggcaac

SEQ ID NO: 211368 - RNA, 25 nt, Human
gugcccaggcccuggcccugcgcag

SEQ ID NO: 211369 - RNA, 32 nt, Human
gugcccaggccuguggguaguggggagggcug

SEQ ID NO: 211370 - RNA, 32 nt, Human
gugcccaggcuagagugcaauggcgcgaucuc

SEQ ID NO: 211371 - RNA, 22 nt, Human
gugcccaggcugcaacccucug

SEQ ID NO: 211372 - RNA, 32 nt, Human
gugcccaggcuggagugcaauagcucgaucuc

SEQ ID NO: 211373 - RNA, 32 nt, Human
gugcccaggcuggagugcaguggcgugaucuc

SEQ ID NO: 211374 - RNA, 32 nt, Human
gugcccagggguugcaggcugcagugagcugu

SEQ ID NO: 211375 - RNA, 32 nt, Human
gugcccaggucauuuuugccacugaguaaagg

SEQ ID NO: 211376 - RNA, 32 nt, Human
gugcccagguccgagucgccuuccgccugccc

SEQ ID NO: 211377 - RNA, 32 nt, Human
gugcccaggugcuggaagcucagucuucaugu

SEQ ID NO: 211378 - RNA, 32 nt, Human
gugcccagguggaggugcaguggggguaaggu

SEQ ID NO: 211379 - RNA, 19 nt, Human
gugcccagugcuucucuca

SEQ ID NO: 211380 - RNA, 32 nt, Human
gugcccaguggcugcuccuuccuucaccucug

SEQ ID NO: 211381 - RNA, 32 nt, Human
gugcccaguugucugcgacuacagcuggauca

SEQ ID NO: 211382 - RNA, 23 nt, Human
gugcccaucaucauucuccucug

SEQ ID NO: 211383 - RNA, 32 nt, Human
gugcccaucccccuccccgcccuggcauccac

SEQ ID NO: 211384 - RNA, 21 nt, Human
gugcccaucccucagccucug

SEQ ID NO: 211385 - RNA, 32 nt, Human
gugcccauccucccgaccccuacccacuucca

SEQ ID NO: 211386 - RNA, 32 nt, Human
gugcccauccuuagccaacuugcuggcgugac

SEQ ID NO: 211387 - RNA, 18 nt, Human
gugcccaucucugggcug

SEQ ID NO: 211388 - RNA, 32 nt, Human
gugcccaugccuggcaggacugugccuuuugc

SEQ ID NO: 211389 - RNA, 32 nt, Human
gugcccaugggagagaccccaucucuacaaaa

SEQ ID NO: 211390 - RNA, 21 nt, Human
gugcccauuaaccaacuucug

SEQ ID NO: 211391 - RNA, 24 nt, Human
gugcccauucuucaggcaacuuuc

SEQ ID NO: 211392 - RNA, 22 nt, Human
gugcccauuguuuuaacuugug

SEQ ID NO: 211393 - RNA, 24 nt, Human
gugcccauuuccaggcagccuucu

SEQ ID NO: 211394 - RNA, 32 nt, Human
gugcccauuugaaaggagugggaggaauacag

SEQ ID NO: 211395 - RNA, 32 nt, Human
gugccccaaaggacaaucucuaaagggguaag

SEQ ID NO: 211396 - RNA, 32 nt, Human
gugccccacagggaccccagccugggugguca

SEQ ID NO: 211397 - RNA, 32 nt, Human
gugccccacaguggucaguccccagcccugug

SEQ ID NO: 211398 - RNA, 32 nt, Human
gugccccacauccucuuauuccuacaucccuu

SEQ ID NO: 211399 - RNA, 32 nt, Human
gugccccacugcacuccagccugggugacaga

SEQ ID NO: 211400 - RNA, 32 nt, Human
gugccccacuucaugcaggacuuggcacgcua

SEQ ID NO: 211401 - RNA, 32 nt, Human
gugccccagcacucccagccacuagcaaggac

SEQ ID NO: 211402 - RNA, 18 nt, Human
gugccccagccccagcca

SEQ ID NO: 211403 - RNA, 32 nt, Human
gugccccaggaaaccuggagguuccacuccca

SEQ ID NO: 211404 - RNA, 32 nt, Human
gugccccaggagaucccucucugccuugccuu

SEQ ID NO: 211405 - RNA, 32 nt, Human
gugccccaggccuccccgaaaccaaaggggaa

SEQ ID NO: 211406 - RNA, 32 nt, Human
gugccccaggcuagcucuucuaccucuggggc

SEQ ID NO: 211407 - RNA, 32 nt, Human
gugccccaguccuucuggaggccugggcugcu

SEQ ID NO: 211408 - RNA, 32 nt, Human
gugccccaugccuguccagccugggcagccag

SEQ ID NO: 211409 - RNA, 32 nt, Human
gugccccauuuuuaaagagcagagggccuggg

SEQ ID NO: 211410 - RNA, 26 nt, Human
gugcccccaaccccagcugcagccuc

SEQ ID NO: 211411 - RNA, 20 nt, Human
gugcccccaacccugggcau

SEQ ID NO: 211412 - RNA, 18 nt, Human
gugcccccacccaucuca

SEQ ID NO: 211413 - RNA, 21 nt, Human
gugcccccagcaaggcugcac

SEQ ID NO: 211414 - RNA, 32 nt, Human
gugcccccagugcuacauacgcagguaugcgu

SEQ ID NO: 211415 - RNA, 32 nt, Human
gugcccccaguguccucugauccuguccggug

SEQ ID NO: 211416 - RNA, 32 nt, Human
gugcccccaucuuuccuccaaacuccugccug

SEQ ID NO: 211417 - RNA, 20 nt, Human
gugccccccaaccagggcac

SEQ ID NO: 211418 - RNA, 24 nt, Human
gugccccccgcuggugacccucug

SEQ ID NO: 211419 - RNA, 23 nt, Human
gugcccccgggagggcugccgca

SEQ ID NO: 211420 - RNA, 32 nt, Human
gugcccccucacagagagaugaaggggcagca

SEQ ID NO: 211421 - RNA, 32 nt, Human
gugcccccuccagggcucuggaggauggaugc

SEQ ID NO: 211422 - RNA, 32 nt, Human
gugcccccuccccacccucccuccccaccucc

SEQ ID NO: 211423 - RNA, 32 nt, Human
gugcccccucugccuccaccccggcuccuggc

SEQ ID NO: 211424 - RNA, 32 nt, Human
gugccccgaagcgcucgcuucccgcggugcga

SEQ ID NO: 211425 - RNA, 32 nt, Human
gugccccgcccacugcagcccgaguucucugg

SEQ ID NO: 211426 - RNA, 32 nt, Human
gugccccgcgggccaccauguccuucccccag

SEQ ID NO: 211427 - RNA, 32 nt, Human
gugccccuccacucuucucuuccucucuuuuu

SEQ ID NO: 211428 - RNA, 32 nt, Human
gugccccucuaagagugcacacacacgcacac

SEQ ID NO: 211429 - RNA, 32 nt, Human
gugccccucugccugccugccccacugugcug

SEQ ID NO: 211430 - RNA, 32 nt, Human
gugccccugcacuccagccugagcgacaguga

SEQ ID NO: 211431 - RNA, 32 nt, Human
gugccccugcaggccuguuccacccacugagg

SEQ ID NO: 211432 - RNA, 32 nt, Human
gugccccugcauucuagccugggugacaguga

SEQ ID NO: 211433 - RNA, 32 nt, Human
gugccccugccugccgugccaggcccugcagg

SEQ ID NO: 211434 - RNA, 32 nt, Human
gugccccugccuggugcucuggucaccugccu

SEQ ID NO: 211435 - RNA, 32 nt, Human
gugccccuggaucuugccucugcuccgacgcc

SEQ ID NO: 211436 - RNA, 21 nt, Human
gugccccuggcccgggccuca

SEQ ID NO: 211437 - RNA, 32 nt, Human
gugccccuggccuggccagcagugaauguagg

SEQ ID NO: 211438 - RNA, 32 nt, Human
gugccccuguaaucccagcuacucaggaggcu

SEQ ID NO: 211439 - RNA, 32 nt, Human
gugccccuuagagcuccugugcugcugggagg

SEQ ID NO: 211440 - RNA, 32 nt, Human
gugccccuuccgccacuggggcucagagccgg

SEQ ID NO: 211441 - RNA, 32 nt, Human
gugccccuucuuucugcccuuccucaccgaag

SEQ ID NO: 211442 - RNA, 32 nt, Human
gugccccuugcaguagugccucugucuccuca

SEQ ID NO: 211443 - RNA, 23 nt, Human
gugcccgacggggccaccuucug

SEQ ID NO: 211444 - RNA, 32 nt, Human
gugcccgaggcagcccuuccagagguucgacu

SEQ ID NO: 211445 - RNA, 21 nt, Human
gugcccgcaccccgacuccug

SEQ ID NO: 211446 - RNA, 32 nt, Human
gugcccgccacacgcacgcacacacucuuaca

SEQ ID NO: 211447 - RNA, 27 nt, Human
gugcccgccccacccgcaugcucuuug

SEQ ID NO: 211448 - RNA, 21 nt, Human
gugcccgccccaggcccgcug

SEQ ID NO: 211449 - RNA, 32 nt, Human
gugcccgccucuccacgcacucagcuauaccu

SEQ ID NO: 211450 - RNA, 32 nt, Human
gugcccgccuggugccuucuggccuguggccu

SEQ ID NO: 211451 - RNA, 18 nt, Human
gugcccgcgauggcccuc

SEQ ID NO: 211452 - RNA, 22 nt, Human
gugcccgcuagccugcccugug

SEQ ID NO: 211453 - RNA, 32 nt, Human
gugcccgcuggggcuggcaggaagggagccga

SEQ ID NO: 211454 - RNA, 22 nt, Human
gugcccggaccugcgccuucug

SEQ ID NO: 211455 - RNA, 32 nt, Human
gugcccggccaagaauggauuuuauaugaccc

SEQ ID NO: 211456 - RNA, 32 nt, Human
gugcccggccaggcacgugcuauagacccacu

SEQ ID NO: 211457 - RNA, 32 nt, Human
gugcccggcccaaacuacuuuuuaaaacagcu

SEQ ID NO: 211458 - RNA, 32 nt, Human
gugcccggcccagggugcccagcggggccaug

SEQ ID NO: 211459 - RNA, 32 nt, Human
gugcccggcgcagaagcacacagugguggccu

SEQ ID NO: 211460 - RNA, 25 nt, Human
gugcccggcguuugggagcccuuug

SEQ ID NO: 211461 - RNA, 32 nt, Human
gugcccgggaaagaugccauauauucacuggg

SEQ ID NO: 211462 - RNA, 32 nt, Human
gugcccgggugaggggcggagcugggggcaug

SEQ ID NO: 211463 - RNA, 32 nt, Human
gugcccgugccucugugcuguguaugugaacc

SEQ ID NO: 211464 - RNA, 32 nt, Human
gugcccguggaagacucuggccucccagcaca

SEQ ID NO: 211465 - RNA, 32 nt, Human
gugcccguggcugaggauaagcugcugagguu

SEQ ID NO: 211466 - RNA, 32 nt, Human
gugcccguggugaugccaugccccgccaccac

SEQ ID NO: 211467 - RNA, 22 nt, Human
gugcccuacgauggccuaacag

SEQ ID NO: 211468 - RNA, 32 nt, Human
gugcccucaaagauucaaauucaguuagucga

SEQ ID NO: 211469 - RNA, 32 nt, Human
gugcccucaaggacaucuccaggcccugaugg

SEQ ID NO: 211470 - RNA, 32 nt, Human
gugcccucaccccucacugguccacuggcuug

SEQ ID NO: 211471 - RNA, 32 nt, Human
gugcccucagagcuacuguguucaggguucuu

SEQ ID NO: 211472 - RNA, 25 nt, Human
gugcccucagauguguugacagcug

SEQ ID NO: 211473 - RNA, 32 nt, Human
gugcccucagcagugacagcagcuuagguguc

SEQ ID NO: 211474 - RNA, 22 nt, Human
gugcccucaggggccgacacua

SEQ ID NO: 211475 - RNA, 32 nt, Human
gugcccuccaccucucccuccugcugguuggc

SEQ ID NO: 211476 - RNA, 32 nt, Human
gugcccuccaucugaaacaggccaggugagca

SEQ ID NO: 211477 - RNA, 32 nt, Human
gugcccucccugccacccuccgucuagagcaa

SEQ ID NO: 211478 - RNA, 32 nt, Human
gugcccucccuugcuuccuccugggcucuguc

SEQ ID NO: 211479 - RNA, 24 nt, Human
gugcccuccgcaggccgggccucc

SEQ ID NO: 211480 - RNA, 32 nt, Human
gugcccuccguguucagcuuagccuuugaccc

SEQ ID NO: 211481 - RNA, 32 nt, Human
gugcccuccucuuccuuccucuuuauagggag

SEQ ID NO: 211482 - RNA, 32 nt, Human
gugcccuccuucugcuggcaucugagccaggu

SEQ ID NO: 211483 - RNA, 32 nt, Human
gugcccucgcaucucaucccagaagagucgcc

SEQ ID NO: 211484 - RNA, 32 nt, Human
gugcccucgccgccgccggcacugccucgaug

SEQ ID NO: 211485 - RNA, 32 nt, Human
gugcccucgccuggccccgccccgucgguugu

SEQ ID NO: 211486 - RNA, 32 nt, Human
gugcccucggcagcuucgguccagccugcauc

SEQ ID NO: 211487 - RNA, 32 nt, Human
gugcccucguuccacucucaucagcccaccgc

SEQ ID NO: 211488 - RNA, 32 nt, Human
gugcccucuccucgaauccugccaguugcauu

SEQ ID NO: 211489 - RNA, 22 nt, Human
gugcccucuccuggacgaucgc

SEQ ID NO: 211490 - RNA, 23 nt, Human
gugcccucuccuggcauccccgc

SEQ ID NO: 211491 - RNA, 19 nt, Human
gugcccucugcccaggugg

SEQ ID NO: 211492 - RNA, 32 nt, Human
gugcccucugcucucagucuuguugcccuagu

SEQ ID NO: 211493 - RNA, 32 nt, Human
gugcccucuggaacugcuuccaugcaggugag

SEQ ID NO: 211494 - RNA, 32 nt, Human
gugcccucuguaaucacuaggacuuggauggg

SEQ ID NO: 211495 - RNA, 32 nt, Human
gugcccugagccugagucgcagccagccuggg

SEQ ID NO: 211496 - RNA, 32 nt, Human
gugcccugaggaugggcuuccuuguccugugg

SEQ ID NO: 211497 - RNA, 21 nt, Human
gugcccugaggccccaggcag

SEQ ID NO: 211498 - RNA, 32 nt, Human
gugcccugcaccagacaggccguggucaggcc

SEQ ID NO: 211499 - RNA, 32 nt, Human
gugcccugcagcgcguggacaggcuagggguc

SEQ ID NO: 211500 - RNA, 32 nt, Human
gugcccugcugguacggguggaauggggguga

SEQ ID NO: 211501 - RNA, 32 nt, Human
gugcccugcuuugcaaacaucaaccuggcaaa

SEQ ID NO: 211502 - RNA, 32 nt, Human
gugcccuggaacacugguaguucuggggcugg

SEQ ID NO: 211503 - RNA, 32 nt, Human
gugcccuggcugccuuccugugcccagaaagg

SEQ ID NO: 211504 - RNA, 32 nt, Human
gugcccuggcugcugggcucuccaccucaggc

SEQ ID NO: 211505 - RNA, 32 nt, Human
gugcccugggacuccuaucaggaagcuugaca

SEQ ID NO: 211506 - RNA, 31 nt, Human
gugcccuggguggaaggaaggcacugagagc

SEQ ID NO: 211507 - RNA, 32 nt, Human
gugcccuguccucagauggggagggacagggu

SEQ ID NO: 211508 - RNA, 32 nt, Human
gugcccuguggcugccugcaccccaggaaagg

SEQ ID NO: 211509 - RNA, 32 nt, Human
gugcccuguggugaccaggagaacaaggagcu

SEQ ID NO: 211510 - RNA, 20 nt, Human
gugcccuguguuccuggaga

SEQ ID NO: 211511 - RNA, 32 nt, Human
gugcccuguuccauacauaaaaggagaggggu

SEQ ID NO: 211512 - RNA, 32 nt, Human
gugcccuuaaaugccagaucugguggagggaa

SEQ ID NO: 211513 - RNA, 32 nt, Human
gugcccuuccagccugaagaucugggggcaca

SEQ ID NO: 211514 - RNA, 32 nt, Human
gugcccuucccuggaggucucucccuccccca

SEQ ID NO: 211515 - RNA, 32 nt, Human
gugcccuucccuucccuccaccacaccacuca

SEQ ID NO: 211516 - RNA, 32 nt, Human
gugcccuugaggacgagggggagcagccggcc

SEQ ID NO: 211517 - RNA, 21 nt, Human
gugcccuugaggugaccucug

SEQ ID NO: 211518 - RNA, 32 nt, Human
gugcccuugccugccuuacccccaccaccacu

SEQ ID NO: 211519 - RNA, 32 nt, Human
gugcccuuggccugccacccagagccaagagg

SEQ ID NO: 211520 - RNA, 32 nt, Human
gugcccuugguuguuuuguggugguccugucg

SEQ ID NO: 211521 - RNA, 32 nt, Human
gugcccuuguagggacacaagguuguacauuu

SEQ ID NO: 211522 - RNA, 31 nt, Human
gugcccuuugggaauaaagcuguagcacugc

SEQ ID NO: 211523 - RNA, 32 nt, Human
gugccgacagcaccuccaccuugggccuccau

SEQ ID NO: 211524 - RNA, 32 nt, Human
gugccgaccucacccgcuccccucaguggcgc

SEQ ID NO: 211525 - RNA, 32 nt, Human
gugccgagaggcaggaggaccaugaaaugauc

SEQ ID NO: 211526 - RNA, 32 nt, Human
gugccgagcuguccauagcugcagugaaaggu

SEQ ID NO: 211527 - RNA, 32 nt, Human
gugccgaggaggaggaagaaaaacaggccgag

SEQ ID NO: 211528 - RNA, 32 nt, Human
gugccgaggccuugguaacuguucagagggcc

SEQ ID NO: 211529 - RNA, 32 nt, Human
gugccgagugccugcugcagaccgaggcuggg

SEQ ID NO: 211530 - RNA, 32 nt, Human
gugccgaugucaggagggcugugucggguaau

SEQ ID NO: 211531 - RNA, 32 nt, Human
gugccgcaaccaccucagccuggaugacggag

SEQ ID NO: 211532 - RNA, 32 nt, Human
gugccgcagggagggugcguggggaagaugcu

SEQ ID NO: 211533 - RNA, 21 nt, Human
gugccgccagugguccaagga

SEQ ID NO: 211534 - RNA, 32 nt, Human
gugccgcccaaggucacaggcacagaaccuuu

SEQ ID NO: 211535 - RNA, 32 nt, Human
gugccgccccucugcugcccugcccagguguc

SEQ ID NO: 211536 - RNA, 19 nt, Human
gugccgcccuagcccagcc

SEQ ID NO: 211537 - RNA, 22 nt, Human
gugccgcccucacagugaacca

SEQ ID NO: 211538 - RNA, 32 nt, Human
gugccgcccucuccugggcucuuccaggagca

SEQ ID NO: 211539 - RNA, 32 nt, Human
gugccgccuccuugugcacaaaucagaccugg

SEQ ID NO: 211540 - RNA, 32 nt, Human
gugccgccugcacuccucagggcagccucccc

SEQ ID NO: 211541 - RNA, 32 nt, Human
gugccgcgggacucugcaccuaccucacaggg

SEQ ID NO: 211542 - RNA, 32 nt, Human
gugccgcuacacuccagccugaugacagaccg

SEQ ID NO: 211543 - RNA, 32 nt, Human
gugccgcuccucccuugcccucaggccagguc

SEQ ID NO: 211544 - RNA, 32 nt, Human
gugccgcucugccuagaaaagccaggggcucu

SEQ ID NO: 211545 - RNA, 32 nt, Human
gugccgcugcacuccagccuggcgacaaagca

SEQ ID NO: 211546 - RNA, 32 nt, Human
gugccgcugcacuccauucugggcaagagcua

SEQ ID NO: 211547 - RNA, 32 nt, Human
gugccgcugcccagacacagacuggcaauaaa

SEQ ID NO: 211548 - RNA, 28 nt, Human
gugccggagccugcugccucgccgacgc

SEQ ID NO: 211549 - RNA, 32 nt, Human
gugccggaggcaggguucgggugcguagucgu

SEQ ID NO: 211550 - RNA, 32 nt, Human
gugccggagguggggccugguguguuuggguu

SEQ ID NO: 211551 - RNA, 32 nt, Human
gugccggccugcugccccggccgcacacucga

SEQ ID NO: 211552 - RNA, 32 nt, Human
gugccggcuuauccgaggucucaauccauugc

SEQ ID NO: 211553 - RNA, 32 nt, Human
gugccgggacggggagccaggcuuccgagugc

SEQ ID NO: 211554 - RNA, 32 nt, Human
gugccgggcagccuacaacauugugcacggcu

SEQ ID NO: 211555 - RNA, 18 nt, Human
gugccgggcgcccagggg

SEQ ID NO: 211556 - RNA, 32 nt, Human
gugccggggaggggcagagaggaaguggucug

SEQ ID NO: 211557 - RNA, 32 nt, Human
gugccggggauucuggacuggcucccuccccu

SEQ ID NO: 211558 - RNA, 32 nt, Human
gugccggggccuggggcucugagggaaauuga

SEQ ID NO: 211559 - RNA, 32 nt, Human
gugccggggcugggaggaagugacaagagggg

SEQ ID NO: 211560 - RNA, 32 nt, Human
gugccggggugaggaagauguggcugcaaggu

SEQ ID NO: 211561 - RNA, 32 nt, Human
gugccgguagaauaaggaaggaagggaggcag

SEQ ID NO: 211562 - RNA, 32 nt, Human
gugccgguagccccagcuacucgggaggcuga

SEQ ID NO: 211563 - RNA, 24 nt, Human
gugccguaacucacgccuguaauc

SEQ ID NO: 211564 - RNA, 32 nt, Human
gugccguagggaacaugcacuuuuccauuccc

SEQ ID NO: 211565 - RNA, 17 nt, Human
gugccgucccgcugcug

SEQ ID NO: 211566 - RNA, 32 nt, Human
gugccguccucgaacuuucugacucuaagcuc

SEQ ID NO: 211567 - RNA, 32 nt, Human
gugccgucucagcucacugcaaccuccgccuu

SEQ ID NO: 211568 - RNA, 32 nt, Human
gugccgucuggacuuccaccuccagugccaga

SEQ ID NO: 211569 - RNA, 24 nt, Human
gugccguggcucacaccuguaauc

SEQ ID NO: 211570 - RNA, 24 nt, Human
gugccguggcucacgccuguaauc

SEQ ID NO: 211571 - RNA, 24 nt, Human
gugccguggcucaugccuguaauc

SEQ ID NO: 211572 - RNA, 24 nt, Human
gugccgugggucacgccuguaauc

SEQ ID NO: 211573 - RNA, 32 nt, Human
gugccguuagauucucacagaagcaugaaccc

SEQ ID NO: 211574 - RNA, 32 nt, Human
gugccguuauucugcuggaacauggugccaau

SEQ ID NO: 211575 - RNA, 32 nt, Human
gugccguugcacuccagccgggcaacaagggc

SEQ ID NO: 211576 - RNA, 32 nt, Human
gugccguugcacuccagccugggcaacaagag

SEQ ID NO: 211577 - RNA, 32 nt, Human
gugccguugcacuccagccugggcgacaagag

SEQ ID NO: 211578 - RNA, 32 nt, Human
gugccuaaaaagagcguugagcucagagaaga

SEQ ID NO: 211579 - RNA, 22 nt, Human
gugccuaaaauaguguccuuug

SEQ ID NO: 211580 - RNA, 32 nt, Human
gugccuaaagaauuuuguggaauacacuuugu

SEQ ID NO: 211581 - RNA, 23 nt, Human
gugccuaacagagguguccucug

SEQ ID NO: 211582 - RNA, 23 nt, Human
gugccuacauauuuuaucuucug

SEQ ID NO: 211583 - RNA, 22 nt, Human
gugccuaccucuggucuagaga

SEQ ID NO: 211584 - RNA, 22 nt, Human
gugccuaccugugaccuuucug

SEQ ID NO: 211585 - RNA, 32 nt, Human
gugccuaccugugaccuuucugcuccacugcu

SEQ ID NO: 211586 - RNA, 26 nt, Human
gugccuacucagcugugaauccucug

SEQ ID NO: 211587 - RNA, 24 nt, Human
gugccuacuucgccagccuugcug

SEQ ID NO: 211588 - RNA, 32 nt, Human
gugccuagaccagcaacugggacaugaaucuu

SEQ ID NO: 211589 - RNA, 32 nt, Human
gugccuagacuguuacuuuggcaauuuccugg

SEQ ID NO: 211590 - RNA, 32 nt, Human
gugccuagaugccuuuguaucucuccauguca

SEQ ID NO: 211591 - RNA, 32 nt, Human
gugccuagcacagugccuggcacacaguagag

SEQ ID NO: 211592 - RNA, 32 nt, Human
gugccuagcccaauacauagcucacaggacug

SEQ ID NO: 211593 - RNA, 32 nt, Human
gugccuaggaguucgaggcugcagugggcugu

SEQ ID NO: 211594 - RNA, 32 nt, Human
gugccuaguuaagugggaauguguuuggagau

SEQ ID NO: 211595 - RNA, 32 nt, Human
gugccuauagaaaccucagcuagugugccgag

SEQ ID NO: 211596 - RNA, 32 nt, Human
gugccuauaggggacucacagacugcagaugc

SEQ ID NO: 211597 - RNA, 32 nt, Human
gugccuauaucugugauuugaaugagggagcc

SEQ ID NO: 211598 - RNA, 32 nt, Human
gugccuaucacugaguaacagaagagcugagu

SEQ ID NO: 211599 - RNA, 26 nt, Human
gugccuaucauaacaauuguuuucug

SEQ ID NO: 211600 - RNA, 19 nt, Human
gugccuaucugccuggagg

SEQ ID NO: 211601 - RNA, 32 nt, Human
gugccuaugaugcugguucuguugccaccugg

SEQ ID NO: 211602 - RNA, 32 nt, Human
gugccuaugcuuccacuuuccuuuucccucca

SEQ ID NO: 211603 - RNA, 32 nt, Human
gugccuauugcuagagcuccucccucucaaca

SEQ ID NO: 211604 - RNA, 32 nt, Human
gugccuauugcuucuuacccucccucccuucc

SEQ ID NO: 211605 - RNA, 32 nt, Human
gugccuauuuuuauaccagcaccaugcaguuu

SEQ ID NO: 211606 - RNA, 32 nt, Human
gugccucaagaggaagauagacaggaggagga

SEQ ID NO: 211607 - RNA, 21 nt, Human
gugccucaaguuacaccugug

SEQ ID NO: 211608 - RNA, 32 nt, Human
gugccucaaugccaccgcgugugaagcuuucc

SEQ ID NO: 211609 - RNA, 19 nt, Human
gugccucacaccuguaauc

SEQ ID NO: 211610 - RNA, 22 nt, Human
gugccucacaccuguaauccca

SEQ ID NO: 211611 - RNA, 32 nt, Human
gugccucacacuccagccuggguaacagagug

SEQ ID NO: 211612 - RNA, 32 nt, Human
gugccucaccauugcccacccugcugcccaac

SEQ ID NO: 211613 - RNA, 32 nt, Human
gugccucaccuguaauccaaguacuuugggag

SEQ ID NO: 211614 - RNA, 22 nt, Human
gugccucacgccuguaauccca

SEQ ID NO: 211615 - RNA, 32 nt, Human
gugccucagaaggcagaggaagccuugaggug

SEQ ID NO: 211616 - RNA, 32 nt, Human
gugccucagagcaggcucagacucuggguccc

SEQ ID NO: 211617 - RNA, 23 nt, Human
gugccucagaucauccaccugug

SEQ ID NO: 211618 - RNA, 23 nt, Human
gugccucagcugccugaacugua

SEQ ID NO: 211619 - RNA, 32 nt, Human
gugccucaggagcagugggaccaccugaugcu

SEQ ID NO: 211620 - RNA, 23 nt, Human
gugccucagguuccucaccugua

SEQ ID NO: 211621 - RNA, 32 nt, Human
gugccucagguuucuuuuaugaaaauuauaac

SEQ ID NO: 211622 - RNA, 32 nt, Human
gugccucagugccaccaacugcacaggcuuag

SEQ ID NO: 211623 - RNA, 32 nt, Human
gugccucaguguccuucucauuucaguaggga

SEQ ID NO: 211624 - RNA, 23 nt, Human
gugccucaguuucucugucugua

SEQ ID NO: 211625 - RNA, 19 nt, Human
gugccucaugccuguaauc

SEQ ID NO: 211626 - RNA, 32 nt, Human
gugccucauggagcugucguaaggaaucaguu

SEQ ID NO: 211627 - RNA, 32 nt, Human
gugccucauggcacugccaccugggccuuugg

SEQ ID NO: 211628 - RNA, 32 nt, Human
gugccucauuauagccacacuguggcuagauu

SEQ ID NO: 211629 - RNA, 23 nt, Human
gugccucauuuugcugacuugua

SEQ ID NO: 211630 - RNA, 32 nt, Human
gugccuccaaccucaucuccucccucuucucu

SEQ ID NO: 211631 - RNA, 32 nt, Human
gugccuccaggccaccauggugagaggagagg

SEQ ID NO: 211632 - RNA, 32 nt, Human
gugccuccaguauuugguauacagaaggugaa

SEQ ID NO: 211633 - RNA, 32 nt, Human
gugccuccccgccuuuucugcagagcuccgcc

SEQ ID NO: 211634 - RNA, 32 nt, Human
gugccucccguagccgccuccucccagcaguc

SEQ ID NO: 211635 - RNA, 32 nt, Human
gugccucccucccuccuuccucuacucccacc

SEQ ID NO: 211636 - RNA, 32 nt, Human
gugccucccuucccaggucaccagcuugggac

SEQ ID NO: 211637 - RNA, 31 nt, Human
gugccucccuucucugggcagaguuucccca

SEQ ID NO: 211638 - RNA, 32 nt, Human
gugccucccuuuccuuucccucccacaaagcc

SEQ ID NO: 211639 - RNA, 32 nt, Human
gugccuccggagugggagagaccuuccagcag

SEQ ID NO: 211640 - RNA, 32 nt, Human
gugccuccuccuccucgccccggcgccggcgg

SEQ ID NO: 211641 - RNA, 32 nt, Human
gugccuccuccuucucccgcucccucucccgu

SEQ ID NO: 211642 - RNA, 32 nt, Human
gugccuccugaggagagcaggaaaggcagugg

SEQ ID NO: 211643 - RNA, 32 nt, Human
gugccuccugugagccuccucucugcucugug

SEQ ID NO: 211644 - RNA, 32 nt, Human
gugccuccuugucugcacugcugguauggggu

SEQ ID NO: 211645 - RNA, 32 nt, Human
gugccuccuuucucccugccaggccugacucu

SEQ ID NO: 211646 - RNA, 23 nt, Human
gugccucgcuggucuaaucugua

SEQ ID NO: 211647 - RNA, 32 nt, Human
gugccucucagaaacgcggccagaagacaagc

SEQ ID NO: 211648 - RNA, 32 nt, Human
gugccucucccucugccuucucucacagugcc

SEQ ID NO: 211649 - RNA, 32 nt, Human
gugccucuccuggucguggaaggugcuacucc

SEQ ID NO: 211650 - RNA, 32 nt, Human
gugccucucuccugggucccaggaucggcccc

SEQ ID NO: 211651 - RNA, 32 nt, Human
gugccucugcacuccaaccugggugauggagc

SEQ ID NO: 211652 - RNA, 32 nt, Human
gugccucugcacuccagccugcgugacaaagu

SEQ ID NO: 211653 - RNA, 32 nt, Human
gugccucugcggccccagcccagcucccaggg

SEQ ID NO: 211654 - RNA, 32 nt, Human
gugccucugcucccaucucucucuuugccuca

SEQ ID NO: 211655 - RNA, 32 nt, Human
gugccucugcucccucuuccucuagcugagag

SEQ ID NO: 211656 - RNA, 32 nt, Human
gugccucuggucccacuacaccugcgcagacu

SEQ ID NO: 211657 - RNA, 32 nt, Human
gugccucuguuccugaauuacauaagaaugua

SEQ ID NO: 211658 - RNA, 32 nt, Human
gugccucuuccacucuggagugaaguuaauga

SEQ ID NO: 211659 - RNA, 32 nt, Human
gugccucuuugaguggcaguugcuugaucauu

SEQ ID NO: 211660 - RNA, 32 nt, Human
gugccugaaagugcccuugggcaccuccucag

SEQ ID NO: 211661 - RNA, 32 nt, Human
gugccugaagaagucucucuucucucugcuuc

SEQ ID NO: 211662 - RNA, 32 nt, Human
gugccugacacauauuaggcacuggauaagua

SEQ ID NO: 211663 - RNA, 32 nt, Human
gugccugacacuccugcccuguguuguuaccu

SEQ ID NO: 211664 - RNA, 32 nt, Human
gugccugacccaagccacguuuucacaugccu

SEQ ID NO: 211665 - RNA, 32 nt, Human
gugccugacccuacuucuuuugcucaucuagc

SEQ ID NO: 211666 - RNA, 32 nt, Human
gugccugaccucaagaagcucagagucuagua

SEQ ID NO: 211667 - RNA, 32 nt, Human
gugccugaccugagggcagagacaucugagug

SEQ ID NO: 211668 - RNA, 23 nt, Human
gugccugagcuggggccuggaga

SEQ ID NO: 211669 - RNA, 32 nt, Human
gugccugaggaccuuugcuguguccuugguac

SEQ ID NO: 211670 - RNA, 32 nt, Human
gugccugaggucugauggccucuaauaaacug

SEQ ID NO: 211671 - RNA, 32 nt, Human
gugccugagugguggcuggugauccugggcug

SEQ ID NO: 211672 - RNA, 32 nt, Human
gugccugaguucucccuguugucucaaagcgg

SEQ ID NO: 211673 - RNA, 32 nt, Human
gugccugauaccugcacuccggcuuccuagac

SEQ ID NO: 211674 - RNA, 32 nt, Human
gugccugaucacugggcccccuaccucagccc

SEQ ID NO: 211675 - RNA, 32 nt, Human
gugccugauggaccgggcugcugcucgaggag

SEQ ID NO: 211676 - RNA, 32 nt, Human
gugccugcacccuggggagcccagagccggca

SEQ ID NO: 211677 - RNA, 31 nt, Human
gugccugcacuuugcuguggcaggcagauug

SEQ ID NO: 211678 - RNA, 32 nt, Human
gugccugcaggagagacacccaggaggaguuu

SEQ ID NO: 211679 - RNA, 21 nt, Human
gugccugcaggccccaugccc

SEQ ID NO: 211680 - RNA, 32 nt, Human
gugccugcagguguccaucaccuucaaggacu

SEQ ID NO: 211681 - RNA, 32 nt, Human
gugccugcagguucccuggaccuuccuucuca

SEQ ID NO: 211682 - RNA, 32 nt, Human
gugccugcccaaggaugcagacauacccacca

SEQ ID NO: 211683 - RNA, 23 nt, Human
gugccugcccccggauacugcag

SEQ ID NO: 211684 - RNA, 23 nt, Human
gugccugccggcuaaacauucug

SEQ ID NO: 211685 - RNA, 27 nt, Human
gugccugccuacugggcagcucaucug

SEQ ID NO: 211686 - RNA, 32 nt, Human
gugccugccuagugcuggaguaggggacaaug

SEQ ID NO: 211687 - RNA, 32 nt, Human
gugccugccuugcagccuccccucggcgaucg

SEQ ID NO: 211688 - RNA, 32 nt, Human
gugccugcgggaccugcuauccagcugagccg

SEQ ID NO: 211689 - RNA, 32 nt, Human
gugccugcugagacugcugggccacccccgug

SEQ ID NO: 211690 - RNA, 32 nt, Human
gugccugcugccugccuaccuggguaaucuga

SEQ ID NO: 211691 - RNA, 32 nt, Human
gugccugcuuugcuccagcacagcagagacca

SEQ ID NO: 211692 - RNA, 32 nt, Human
gugccuggaagugggcccugcuccacccccuc

SEQ ID NO: 211693 - RNA, 32 nt, Human
gugccuggacccagaggcuuugcaggacagug

SEQ ID NO: 211694 - RNA, 32 nt, Human
gugccuggagccagaggucggggaguaagcac

SEQ ID NO: 211695 - RNA, 32 nt, Human
gugccuggagugagauggagcuggaaagaucc

SEQ ID NO: 211696 - RNA, 32 nt, Human
gugccuggcaaggccucugccccuggccuuug

SEQ ID NO: 211697 - RNA, 20 nt, Human
gugccuggcacuaugaucca

SEQ ID NO: 211698 - RNA, 19 nt, Human
gugccuggcacucuguggg

SEQ ID NO: 211699 - RNA, 22 nt, Human
gugccuggcagggggagaccac

SEQ ID NO: 211700 - RNA, 32 nt, Human
gugccuggcccccucuugccuuuuauggcuga

SEQ ID NO: 211701 - RNA, 32 nt, Human
gugccuggccucugccuccacccuccuccucu

SEQ ID NO: 211702 - RNA, 32 nt, Human
gugccuggcggacagaacuucagagaccacgc

SEQ ID NO: 211703 - RNA, 32 nt, Human
gugccuggcucagagccagucuuuuuggugag

SEQ ID NO: 211704 - RNA, 25 nt, Human
gugccuggcugcugggcggccucug

SEQ ID NO: 211705 - RNA, 32 nt, Human
gugccugggacccccagcacccagagccuagg

SEQ ID NO: 211706 - RNA, 32 nt, Human
gugccugggaggcugaggcaggagaauugcuu

SEQ ID NO: 211707 - RNA, 32 nt, Human
gugccugggagguggguguggggguggugggu

SEQ ID NO: 211708 - RNA, 31 nt, Human
gugccugggcacuucugggaaguccugcacu

SEQ ID NO: 211709 - RNA, 32 nt, Human
gugccugggcggggcugggagugggaccugag

SEQ ID NO: 211710 - RNA, 32 nt, Human
gugccugggcuggcuggcaucccugggcugau

SEQ ID NO: 211711 - RNA, 32 nt, Human
gugccuggggaguguguguggguccuuggcuc

SEQ ID NO: 211712 - RNA, 32 nt, Human
gugccuggggccuugccacccuucccugucca

SEQ ID NO: 211713 - RNA, 32 nt, Human
gugccuggggugccuuucccccagccaggguc

SEQ ID NO: 211714 - RNA, 32 nt, Human
gugccugguggaggggccuggaaaagacaccc

SEQ ID NO: 211715 - RNA, 32 nt, Human
gugccuggugggagauccccgggguuugggaa

SEQ ID NO: 211716 - RNA, 32 nt, Human
gugccugguuauauuacuggauccuuguguug

SEQ ID NO: 211717 - RNA, 26 nt, Human
gugccugguucaggguagacucucug

SEQ ID NO: 211718 - RNA, 32 nt, Human
gugccugguuccucccccuuggcucaggggua

SEQ ID NO: 211719 - RNA, 32 nt, Human
gugccuguaaauagcuauugcacuccagccuu

SEQ ID NO: 211720 - RNA, 32 nt, Human
gugccuguaacaccccucuucccccacccccu

SEQ ID NO: 211721 - RNA, 32 nt, Human
gugccuguagccccagcuacuugggaggcuga

SEQ ID NO: 211722 - RNA, 19 nt, Human
gugccuguagccuugggga

SEQ ID NO: 211723 - RNA, 32 nt, Human
gugccuguaucauuggcacaggccagugcuga

SEQ ID NO: 211724 - RNA, 32 nt, Human
gugccugucacggaggugaggagugagugagu

SEQ ID NO: 211725 - RNA, 32 nt, Human
gugccuguccccgugugauccgaaaagugcug

SEQ ID NO: 211726 - RNA, 32 nt, Human
gugccugucucauucgccucuggaucugcugc

SEQ ID NO: 211727 - RNA, 22 nt, Human
gugccugucugugccugggaga

SEQ ID NO: 211728 - RNA, 32 nt, Human
gugccugucuugucuguguggcuucucagaug

SEQ ID NO: 211729 - RNA, 32 nt, Human
gugccugugagcauggggccaggaaagucugg

SEQ ID NO: 211730 - RNA, 21 nt, Human
gugccuguggcugugccuggg

SEQ ID NO: 211731 - RNA, 21 nt, Human
gugccugugguggccccucug

SEQ ID NO: 211732 - RNA, 32 nt, Human
gugccugugugggaacagcucuucucccagau

SEQ ID NO: 211733 - RNA, 20 nt, Human
gugccugugugugaaccugg

SEQ ID NO: 211734 - RNA, 20 nt, Human
gugccugugugugccuggga

SEQ ID NO: 211735 - RNA, 32 nt, Human
gugccuguucacucaccucucccuuccccaac

SEQ ID NO: 211736 - RNA, 32 nt, Human
gugccuguuccagauggcagggcuccuuacug

SEQ ID NO: 211737 - RNA, 32 nt, Human
gugccuguucugauucucauuugugucucugg

SEQ ID NO: 211738 - RNA, 19 nt, Human
gugccuguuguccaagugg

SEQ ID NO: 211739 - RNA, 32 nt, Human
gugccuuaaaaauguuguggccaagccacaug

SEQ ID NO: 211740 - RNA, 23 nt, Human
gugccuuaacaagcaauccucug

SEQ ID NO: 211741 - RNA, 32 nt, Human
gugccuuaagcagagucaggagaccccaaggc

SEQ ID NO: 211742 - RNA, 32 nt, Human
gugccuuaaggagagagauuguguucuuccuc

SEQ ID NO: 211743 - RNA, 32 nt, Human
gugccuuacacacugcccccacccucagccgu

SEQ ID NO: 211744 - RNA, 32 nt, Human
gugccuuacacguguuaacacacuugaucagc

SEQ ID NO: 211745 - RNA, 32 nt, Human
gugccuucauuaguuuuaguucugucuguuuu

SEQ ID NO: 211746 - RNA, 32 nt, Human
gugccuucauucugcuuuguacuaggacacca

SEQ ID NO: 211747 - RNA, 32 nt, Human
gugccuuccauggagggaaaugggacaggggc

SEQ ID NO: 211748 - RNA, 32 nt, Human
gugccuuccucccauccucugccaucuuggua

SEQ ID NO: 211749 - RNA, 32 nt, Human
gugccuucgucugaguuuuccugcuuuccugc

SEQ ID NO: 211750 - RNA, 32 nt, Human
gugccuucguuuccucauuuagcaccuaccuc

SEQ ID NO: 211751 - RNA, 32 nt, Human
gugccuucucccacuauuuuucacauggugac

SEQ ID NO: 211752 - RNA, 32 nt, Human
gugccuucucuucaacaccaccccacccucca

SEQ ID NO: 211753 - RNA, 32 nt, Human
gugccuucugcccucugcccagauguguccag

SEQ ID NO: 211754 - RNA, 32 nt, Human
gugccuucugcgcgccugggaucccggagccu

SEQ ID NO: 211755 - RNA, 32 nt, Human
gugccuucuggcccaucgucauuugcucuggg

SEQ ID NO: 211756 - RNA, 21 nt, Human
gugccuucuuuagugcuccac

SEQ ID NO: 211757 - RNA, 32 nt, Human
gugccuugacaccuacauauggcugcauucca

SEQ ID NO: 211758 - RNA, 32 nt, Human
gugccuugcacuccaugcauucugauaacggc

SEQ ID NO: 211759 - RNA, 32 nt, Human
gugccuugcucuucugucggaggcugcugggg

SEQ ID NO: 211760 - RNA, 32 nt, Human
gugccuuggaaccugcugccuuggggacccug

SEQ ID NO: 211761 - RNA, 32 nt, Human
gugccuuggagaacucacagcagcacgccuua

SEQ ID NO: 211762 - RNA, 32 nt, Human
gugccuuguaugaagcccaccccacauggccc

SEQ ID NO: 211763 - RNA, 23 nt, Human
gugccuuguauuuuaaaucugug

SEQ ID NO: 211764 - RNA, 32 nt, Human
gugccuuguugccuccgcucaggaugaaagag

SEQ ID NO: 211765 - RNA, 32 nt, Human
gugccuuuaaucccaccucaggaggcugaggc

SEQ ID NO: 211766 - RNA, 32 nt, Human
gugccuuucccagggggauccccacacugguc

SEQ ID NO: 211767 - RNA, 32 nt, Human
gugccuuucccccagccaggguccaaagaagc

SEQ ID NO: 211768 - RNA, 32 nt, Human
gugccuuugaguuuccucaggcugcuggagga

SEQ ID NO: 211769 - RNA, 32 nt, Human
gugccuuugcacuccagcguggaagacaguga

SEQ ID NO: 211770 - RNA, 32 nt, Human
gugccuuugcggaugaccucauuuugacguug

SEQ ID NO: 211771 - RNA, 32 nt, Human
gugccuuuggagccucgggcuccuggggugca

SEQ ID NO: 211772 - RNA, 32 nt, Human
gugccuuuggggcagacuccagacaaggaugu

SEQ ID NO: 211773 - RNA, 32 nt, Human
gugccuuuuagggagagaacaauaccuaagau

SEQ ID NO: 211774 - RNA, 32 nt, Human
gugccuuuugcugcgcaccaaugcccagcagg

SEQ ID NO: 211775 - RNA, 32 nt, Human
gugcgaacuuucccuucuccuucgaaugcugu

SEQ ID NO: 211776 - RNA, 32 nt, Human
gugcgaagaaaaucauuggcucagauugcaac

SEQ ID NO: 211777 - RNA, 22 nt, Human
gugcgaagaagcugcagccgca

SEQ ID NO: 211778 - RNA, 32 nt, Human
gugcgacacggccgggaggaggagaacaacgc

SEQ ID NO: 211779 - RNA, 32 nt, Human
gugcgacccuggggcugcugccaggcugcggu

SEQ ID NO: 211780 - RNA, 32 nt, Human
gugcgaccucagacuaaugacauccuggcuga

SEQ ID NO: 211781 - RNA, 32 nt, Human
gugcgagagggugugagagugaguggcgugcu

SEQ ID NO: 211782 - RNA, 32 nt, Human
gugcgagauccugacccaagagcaccauaaca

SEQ ID NO: 211783 - RNA, 32 nt, Human
gugcgagcagaggcgcggccaccgcauccgug

SEQ ID NO: 211784 - RNA, 32 nt, Human
gugcgagccagccccgacugcuccuccucuuc

SEQ ID NO: 211785 - RNA, 32 nt, Human
gugcgagggcccugcuuguagcuggacccugg

SEQ ID NO: 211786 - RNA, 32 nt, Human
gugcgagguggcaaaugcaacaugcucuccag

SEQ ID NO: 211787 - RNA, 32 nt, Human
gugcgagugaggcagccccgaggcucugcucg

SEQ ID NO: 211788 - RNA, 32 nt, Human
gugcgaguggcuggugggccugggcagugggc

SEQ ID NO: 211789 - RNA, 32 nt, Human
gugcgagugggugguggaguaggggugggagu

SEQ ID NO: 211790 - RNA, 32 nt, Human
gugcgaucucagcucacagcaaccuccgccuc

SEQ ID NO: 211791 - RNA, 32 nt, Human
gugcgaucucagcucacugcaaccuccgccuc

SEQ ID NO: 211792 - RNA, 32 nt, Human
gugcgaucucagcucacugcaaccuccgccug

SEQ ID NO: 211793 - RNA, 32 nt, Human
gugcgauggaaauguguuccugccggagucug

SEQ ID NO: 211794 - RNA, 24 nt, Human
gugcgauggcucacgccuguaauc

SEQ ID NO: 211795 - RNA, 17 nt, Human
gugcgcaacaacaagga

SEQ ID NO: 211796 - RNA, 32 nt, Human
gugcgcacacacacaagaagccuuagcguuuu

SEQ ID NO: 211797 - RNA, 32 nt, Human
gugcgcacagcagcaggcuuucuguacccaga

SEQ ID NO: 211798 - RNA, 32 nt, Human
gugcgcaccagcugccugcuguuuacacccag

SEQ ID NO: 211799 - RNA, 32 nt, Human
gugcgcacccccuucgagaucucccucuggau

SEQ ID NO: 211800 - RNA, 32 nt, Human
gugcgcacgugucggcgcucacacacacaugc

SEQ ID NO: 211801 - RNA, 32 nt, Human
gugcgcacuuccccauccccugccuggagccu

SEQ ID NO: 211802 - RNA, 23 nt, Human
gugcgcagccagcagguggcgca

SEQ ID NO: 211803 - RNA, 32 nt, Human
gugcgcagggacuggcggcagcgcggucagag

SEQ ID NO: 211804 - RNA, 32 nt, Human
gugcgcaugccuguagucccagcuacuuggga

SEQ ID NO: 211805 - RNA, 32 nt, Human
gugcgcauuaaaaucaguuuguaagggagaca

SEQ ID NO: 211806 - RNA, 32 nt, Human
gugcgccaacgccagcaccaaugucgcgccug

SEQ ID NO: 211807 - RNA, 32 nt, Human
gugcgccaccuugcccggcuaauuuuucuauu

SEQ ID NO: 211808 - RNA, 32 nt, Human
gugcgccacuaugccugacuaauuuuguaguu

SEQ ID NO: 211809 - RNA, 32 nt, Human
gugcgccacugcacccggcccgugaaggucuu

SEQ ID NO: 211810 - RNA, 32 nt, Human
gugcgccacuucacuccagccugggcaacaga

SEQ ID NO: 211811 - RNA, 32 nt, Human
gugcgccccugccacugcugcugauuaggguu

SEQ ID NO: 211812 - RNA, 32 nt, Human
gugcgccgagccccggcccagcgcggcccccg

SEQ ID NO: 211813 - RNA, 32 nt, Human
gugcgccgcugugcugggagcugcagugguaa

SEQ ID NO: 211814 - RNA, 32 nt, Human
gugcgccuaaacugcugauuggccucaacuug

SEQ ID NO: 211815 - RNA, 32 nt, Human
gugcgccuauaaucccagcuacucaggaggca

SEQ ID NO: 211816 - RNA, 32 nt, Human
gugcgccugcagcccuugguucuuggaaacgc

SEQ ID NO: 211817 - RNA, 32 nt, Human
gugcgccugccugccggccuccgcaccguccg

SEQ ID NO: 211818 - RNA, 32 nt, Human
gugcgccuguaaccccagcuauucgggaggcu

SEQ ID NO: 211819 - RNA, 32 nt, Human
gugcgccuguaaucccagcuacccgggaggcu

SEQ ID NO: 211820 - RNA, 32 nt, Human
gugcgccuguaaucccagcuaccggagaggcu

SEQ ID NO: 211821 - RNA, 32 nt, Human
gugcgccuguaaucccagcuacucaagaggcu

SEQ ID NO: 211822 - RNA, 32 nt, Human
gugcgccuguaaucccagcuacucaggaggcu

SEQ ID NO: 211823 - RNA, 32 nt, Human
gugcgccuguaaucccagcuacuccgggaggc

SEQ ID NO: 211824 - RNA, 32 nt, Human
gugcgccuguaaucccagcuacucgggaggcu

SEQ ID NO: 211825 - RNA, 32 nt, Human
gugcgccuguaaucccagcuacucuggaggcu

SEQ ID NO: 211826 - RNA, 32 nt, Human
gugcgccuguaaucccagcuacuugggaggcu

SEQ ID NO: 211827 - RNA, 32 nt, Human
gugcgccuguaaucccagcuauauaggaggcu

SEQ ID NO: 211828 - RNA, 32 nt, Human
gugcgccuguaaucucagcuacucaagaggcu

SEQ ID NO: 211829 - RNA, 32 nt, Human
gugcgccuguaaucucagcuacuugggagccu

SEQ ID NO: 211830 - RNA, 32 nt, Human
gugcgccuguaauuccagcuacucgggaggcu

SEQ ID NO: 211831 - RNA, 32 nt, Human
gugcgccuguagucccagcuacucaggaggcu

SEQ ID NO: 211832 - RNA, 32 nt, Human
gugcgccuguagucccagcuacucgggagacu

SEQ ID NO: 211833 - RNA, 32 nt, Human
gugcgccuguagucccagcuacucgggaggcu

SEQ ID NO: 211834 - RNA, 32 nt, Human
gugcgccuguagucccagcuacuugggaggcu

SEQ ID NO: 211835 - RNA, 32 nt, Human
gugcgccuguagucccagcuacuugugaggcu

SEQ ID NO: 211836 - RNA, 32 nt, Human
gugcgccuguagucccagcugcucggggaggc

SEQ ID NO: 211837 - RNA, 32 nt, Human
gugcgccuguagucucagcuacuuaggagaau

SEQ ID NO: 211838 - RNA, 32 nt, Human
gugcgcgaugccuugaaccugggaaacuaugu

SEQ ID NO: 211839 - RNA, 32 nt, Human
gugcgcgcacacaccacacaugcacacacgua

SEQ ID NO: 211840 - RNA, 32 nt, Human
gugcgcggcuuggaaggauggcugguccuugc

SEQ ID NO: 211841 - RNA, 32 nt, Human
gugcgcggguggagcucaguaggaccacggcg

SEQ ID NO: 211842 - RNA, 32 nt, Human
gugcgcgugaccaccugagcucugccuucugu

SEQ ID NO: 211843 - RNA, 32 nt, Human
gugcgcuaggcuuggugggaaggccuguucuc

SEQ ID NO: 211844 - RNA, 31 nt, Human
gugcgcucaauaaaaaugcuggaauucaaaa

SEQ ID NO: 211845 - RNA, 32 nt, Human
gugcgcucaccuagacggccgggcaguuagga

SEQ ID NO: 211846 - RNA, 32 nt, Human
gugcgcuccaauucacggugguuuccaagcgc

SEQ ID NO: 211847 - RNA, 32 nt, Human
gugcgcuccagccugggcaacagagcgagacu

SEQ ID NO: 211848 - RNA, 32 nt, Human
gugcgcuccucaccccucuacagacaggggcg

SEQ ID NO: 211849 - RNA, 32 nt, Human
gugcgcucgcugccugccucucuggcugucug

SEQ ID NO: 211850 - RNA, 31 nt, Human
gugcgcucucccugagugccuguguagcugg

SEQ ID NO: 211851 - RNA, 32 nt, Human
gugcgcucugcagcaugucgcuacaugccugg

SEQ ID NO: 211852 - RNA, 32 nt, Human
gugcgcugaccuuucuagaaugcaaggcggug

SEQ ID NO: 211853 - RNA, 32 nt, Human
gugcgcugcuccugcccucuccuugcccugcc

SEQ ID NO: 211854 - RNA, 29 nt, Human
gugcgcuggcugcugcuuuucugcuccug

SEQ ID NO: 211855 - RNA, 32 nt, Human
gugcgcuguggacacagcaguccgcggaauuc

SEQ ID NO: 211856 - RNA, 32 nt, Human
gugcgcuuguaaucccagcuacucaggaggcu

SEQ ID NO: 211857 - RNA, 32 nt, Human
gugcgcuuguaaucccagcuacucgggaggcu

SEQ ID NO: 211858 - RNA, 32 nt, Human
gugcgcuuguaguaccagcuacuuggauggcu

SEQ ID NO: 211859 - RNA, 32 nt, Human
gugcgcuuguagucccagcuacucaggaggcu

SEQ ID NO: 211860 - RNA, 32 nt, Human
gugcgcuuuccguccuuucaaaggacaacugu

SEQ ID NO: 211861 - RNA, 32 nt, Human
gugcggaaagagaaaaaggaaaacggggcaca

SEQ ID NO: 211862 - RNA, 32 nt, Human
gugcggaacgccgcggugucucggcgccucug

SEQ ID NO: 211863 - RNA, 32 nt, Human
gugcggagaaagcugacugggccccgcgucuc

SEQ ID NO: 211864 - RNA, 32 nt, Human
gugcggagcgagugggagcgagacggcccuga

SEQ ID NO: 211865 - RNA, 32 nt, Human
gugcggagcuccccugcugguuggggcucagc

SEQ ID NO: 211866 - RNA, 32 nt, Human
gugcggaggagguacccccaccccuggcacag

SEQ ID NO: 211867 - RNA, 32 nt, Human
gugcggagggucaaggcccacacccggaaacc

SEQ ID NO: 211868 - RNA, 32 nt, Human
gugcggaguguggagcuggaccagcugccuga

SEQ ID NO: 211869 - RNA, 24 nt, Human
gugcggcacggcacggugggagug

SEQ ID NO: 211870 - RNA, 32 nt, Human
gugcggcagcggagagcccaggagaacgagcc

SEQ ID NO: 211871 - RNA, 24 nt, Human
gugcggcagcucacaccuguaauc

SEQ ID NO: 211872 - RNA, 24 nt, Human
gugcggcagcucaugccuguaauc

SEQ ID NO: 211873 - RNA, 23 nt, Human
gugcggcagcugcugcucaggug

SEQ ID NO: 211874 - RNA, 32 nt, Human
gugcggcagcugcugcucaggugccaugcccu

SEQ ID NO: 211875 - RNA, 32 nt, Human
gugcggcaggguggggaacgcgggagcggggc

SEQ ID NO: 211876 - RNA, 22 nt, Human
gugcggcaugggcuaagucacu

SEQ ID NO: 211877 - RNA, 32 nt, Human
gugcggccccugcaccugccggcgacacuccu

SEQ ID NO: 211878 - RNA, 32 nt, Human
gugcggccuccagggcgccuccugccggcccc

SEQ ID NO: 211879 - RNA, 32 nt, Human
gugcggccucugccugcagccucguccggcau

SEQ ID NO: 211880 - RNA, 32 nt, Human
gugcggccugaugacccacacaccucucaggg

SEQ ID NO: 211881 - RNA, 32 nt, Human
gugcggcgcggucucagggaagguggggcuau

SEQ ID NO: 211882 - RNA, 32 nt, Human
gugcggcgggugccguggaguggauguaccca

SEQ ID NO: 211883 - RNA, 32 nt, Human
gugcggcggugcuggagguugcggcggcggcu

SEQ ID NO: 211884 - RNA, 32 nt, Human
gugcggcucacugcgcggucccucucagcucc

SEQ ID NO: 211885 - RNA, 32 nt, Human
gugcggcucccagguggggcuguugcacuacc

SEQ ID NO: 211886 - RNA, 32 nt, Human
gugcggcugcaaugcugagcucccgggccgag

SEQ ID NO: 211887 - RNA, 32 nt, Human
gugcggcugccgagagguggucuuguaagcgc

SEQ ID NO: 211888 - RNA, 32 nt, Human
gugcggcuggccuccgccugggucaugggccu

SEQ ID NO: 211889 - RNA, 32 nt, Human
gugcggcuuccagagguacagcugcugaaagu

SEQ ID NO: 211890 - RNA, 32 nt, Human
gugcgggacgguuccacacagccccggccuuu

SEQ ID NO: 211891 - RNA, 22 nt, Human
gugcgggagagcaaggccagug

SEQ ID NO: 211892 - RNA, 32 nt, Human
gugcgggaguccugaggagauguggccugcag

SEQ ID NO: 211893 - RNA, 32 nt, Human
gugcgggcaggcgggggcgcugacgagaagca

SEQ ID NO: 211894 - RNA, 32 nt, Human
gugcgggcaucgugguaauggugcuguucucg

SEQ ID NO: 211895 - RNA, 32 nt, Human
gugcgggccaggcggaggcucaagcggggauc

SEQ ID NO: 211896 - RNA, 32 nt, Human
gugcgggccggcagaggcuggcggggagcagc

SEQ ID NO: 211897 - RNA, 32 nt, Human
gugcgggccugggcccugcuccaccuccagaa

SEQ ID NO: 211898 - RNA, 32 nt, Human
gugcgggcucacugcaagcuccggcucccggg

SEQ ID NO: 211899 - RNA, 32 nt, Human
gugcgggcucaggauggggcggccguggugag

SEQ ID NO: 211900 - RNA, 32 nt, Human
gugcgggcucaggauggggcggccguguugag

SEQ ID NO: 211901 - RNA, 32 nt, Human
gugcggggacuggccgaggccccugcacccug

SEQ ID NO: 211902 - RNA, 32 nt, Human
gugcggggaggggaaggacgccuccaagcccg

SEQ ID NO: 211903 - RNA, 32 nt, Human
gugcggggcagcccugggucucugccucaggg

SEQ ID NO: 211904 - RNA, 32 nt, Human
gugcggggcccaccaagcccacgcccacccug

SEQ ID NO: 211905 - RNA, 32 nt, Human
gugcggggcggccggcggaggagcagcaggau

SEQ ID NO: 211906 - RNA, 32 nt, Human
gugcgggggaagcacacucgcggugaaccugg

SEQ ID NO: 211907 - RNA, 30 nt, Human
gugcggggguggggcagggcacagugggug

SEQ ID NO: 211908 - RNA, 32 nt, Human
gugcggggucucugugcacuuggagcuggggg

SEQ ID NO: 211909 - RNA, 32 nt, Human
gugcgggguuccucgcugccuucuccucccua

SEQ ID NO: 211910 - RNA, 32 nt, Human
gugcgggucgcggggaccgagcgcggcugagg

SEQ ID NO: 211911 - RNA, 16 nt, Human
gugcgggugcaggcgg

SEQ ID NO: 211912 - RNA, 32 nt, Human
gugcggucacagcucacugccuccugggcuca

SEQ ID NO: 211913 - RNA, 32 nt, Human
gugcggucccucccccucacguucucucuucc

SEQ ID NO: 211914 - RNA, 32 nt, Human
gugcggucuccuagggaaggggcagugaugcc

SEQ ID NO: 211915 - RNA, 24 nt, Human
gugcggugacucacgccuauaauc

SEQ ID NO: 211916 - RNA, 24 nt, Human
gugcggugacucaugccuguaauc

SEQ ID NO: 211917 - RNA, 32 nt, Human
gugcggugacuugcccggggcuccagguagcc

SEQ ID NO: 211918 - RNA, 32 nt, Human
gugcggugacuugcccgggguuccagguagcc

SEQ ID NO: 211919 - RNA, 32 nt, Human
gugcggugcccgaggcuucggagcaggcugga

SEQ ID NO: 211920 - RNA, 32 nt, Human
gugcgguggaggcggccuugcgguggugcuuu

SEQ ID NO: 211921 - RNA, 32 nt, Human
gugcgguggcagcugaggauugccugcgugua

SEQ ID NO: 211922 - RNA, 32 nt, Human
gugcgguggcuauaauccuagcacuuugggag

SEQ ID NO: 211923 - RNA, 24 nt, Human
gugcgguggcucacaccuauaauc

SEQ ID NO: 211924 - RNA, 21 nt, Human
gugcgguggcucacaccugua

SEQ ID NO: 211925 - RNA, 24 nt, Human
gugcgguggcucacaccuguaauc

SEQ ID NO: 211926 - RNA, 32 nt, Human
gugcgguggcucacacuguaaucccagcacuu

SEQ ID NO: 211927 - RNA, 24 nt, Human
gugcgguggcucacgccuauaauc

SEQ ID NO: 211928 - RNA, 21 nt, Human
gugcgguggcucacgccugua

SEQ ID NO: 211929 - RNA, 24 nt, Human
gugcgguggcucacgccuguaauc

SEQ ID NO: 211930 - RNA, 24 nt, Human
gugcgguggcucacgucuguaauc

SEQ ID NO: 211931 - RNA, 24 nt, Human
gugcgguggcucaggccuguaauc

SEQ ID NO: 211932 - RNA, 24 nt, Human
gugcgguggcucauaccuauaauc

SEQ ID NO: 211933 - RNA, 24 nt, Human
gugcgguggcucauaccuguaauc

SEQ ID NO: 211934 - RNA, 24 nt, Human
gugcgguggcucaugccuauaauc

SEQ ID NO: 211935 - RNA, 24 nt, Human
gugcgguggcucaugccugcaauu

SEQ ID NO: 211936 - RNA, 24 nt, Human
gugcgguggcucaugccuggaauc

SEQ ID NO: 211937 - RNA, 21 nt, Human
gugcgguggcucaugccugua

SEQ ID NO: 211938 - RNA, 24 nt, Human
gugcgguggcucaugccuguaauc

SEQ ID NO: 211939 - RNA, 24 nt, Human
gugcgguggcucaugucuguaauc

SEQ ID NO: 211940 - RNA, 24 nt, Human
gugcgguggcuuacaccuguaauc

SEQ ID NO: 211941 - RNA, 24 nt, Human
gugcggugguucacaccuguaauc

SEQ ID NO: 211942 - RNA, 24 nt, Human
gugcggugguucaugccuauaauc

SEQ ID NO: 211943 - RNA, 32 nt, Human
gugcggugugcugugcuggagagcacagcccc

SEQ ID NO: 211944 - RNA, 32 nt, Human
gugcgguguggaccccaaagccccugcuccag

SEQ ID NO: 211945 - RNA, 32 nt, Human
gugcgguuguacauccuccccaccucauaacg

SEQ ID NO: 211946 - RNA, 32 nt, Human
gugcguagcagugucugugccucuccugccca

SEQ ID NO: 211947 - RNA, 32 nt, Human
gugcguaucugugaaccugggagacgguuacu

SEQ ID NO: 211948 - RNA, 32 nt, Human
gugcguauuuucucuuucuuccugucacccug

SEQ ID NO: 211949 - RNA, 32 nt, Human
gugcguccagccucacugacccucuuccuugg

SEQ ID NO: 211950 - RNA, 32 nt, Human
gugcguccagcuuacacaaucauaauucaaag

SEQ ID NO: 211951 - RNA, 32 nt, Human
gugcguccaguggagcucugaguuucgaaucg

SEQ ID NO: 211952 - RNA, 32 nt, Human
gugcgucccccaggcugguggccgagcugcag

SEQ ID NO: 211953 - RNA, 32 nt, Human
gugcguccggccgccugagcagguguggugcc

SEQ ID NO: 211954 - RNA, 32 nt, Human
gugcguccugguccaccauggccaaaccaaca

SEQ ID NO: 211955 - RNA, 32 nt, Human
gugcgucucuccuucucaugccguucuggaaa

SEQ ID NO: 211956 - RNA, 32 nt, Human
gugcgucugcgagcgcacacacaugcacaagu

SEQ ID NO: 211957 - RNA, 32 nt, Human
gugcgucuucuaguuuauuccuccuggggaca

SEQ ID NO: 211958 - RNA, 32 nt, Human
gugcgucuuuccaaucccauguuccuccauuc

SEQ ID NO: 211959 - RNA, 32 nt, Human
gugcgugacccgaccggcugugguguuccagu

SEQ ID NO: 211960 - RNA, 32 nt, Human
gugcgugcagagcagcaggaagugagacacgu

SEQ ID NO: 211961 - RNA, 32 nt, Human
gugcgugcagcgcaugaugaaugagugcgucc

SEQ ID NO: 211962 - RNA, 32 nt, Human
gugcgugcccuugagcuccuuaccaccccuuu

SEQ ID NO: 211963 - RNA, 32 nt, Human
gugcgugccuauaauccuagcuacucaggugg

SEQ ID NO: 211964 - RNA, 32 nt, Human
gugcgugccuguaaucccagcuacucgggagg

SEQ ID NO: 211965 - RNA, 32 nt, Human
gugcgugccuguagccucagcuacucgggugg

SEQ ID NO: 211966 - RNA, 32 nt, Human
gugcgugccuguagucccagcuacucgggagg

SEQ ID NO: 211967 - RNA, 32 nt, Human
gugcgugccuguagucccagcuacuuaggagg

SEQ ID NO: 211968 - RNA, 32 nt, Human
gugcgugccuguagucccagcuacuugggagg

SEQ ID NO: 211969 - RNA, 32 nt, Human
gugcgugccuguagucucagcuacucaggagg

SEQ ID NO: 211970 - RNA, 32 nt, Human
gugcgugccuguauucccggccacucgggagg

SEQ ID NO: 211971 - RNA, 32 nt, Human
gugcgugcgucugucugucucuggcccccagc

SEQ ID NO: 211972 - RNA, 32 nt, Human
gugcgugcugggugggguggggcacggaggcu

SEQ ID NO: 211973 - RNA, 32 nt, Human
gugcgugcugugugugcaugugugcgagaggg

SEQ ID NO: 211974 - RNA, 32 nt, Human
gugcguggagguggagccugcggcuggaguaa

SEQ ID NO: 211975 - RNA, 32 nt, Human
gugcguggccauacccugccucccucucuggc

SEQ ID NO: 211976 - RNA, 32 nt, Human
gugcgugggaggacggagccugggagcggggc

SEQ ID NO: 211977 - RNA, 32 nt, Human
gugcgugggcagguaggagguaggauguuucc

SEQ ID NO: 211978 - RNA, 32 nt, Human
gugcgugugaagccacggaaggcuugguccca

SEQ ID NO: 211979 - RNA, 32 nt, Human
gugcgugugguuuguuccuucuccuugccggg

SEQ ID NO: 211980 - RNA, 32 nt, Human
gugcguguguggggcaggcaggauguggugca

SEQ ID NO: 211981 - RNA, 32 nt, Human
gugcguucaagaggcagaugaggcucaguugg

SEQ ID NO: 211982 - RNA, 32 nt, Human
gugcuaacagcccagccuccagccuggccuuu

SEQ ID NO: 211983 - RNA, 32 nt, Human
gugcuaacucagagacuggagauuauaguuua

SEQ ID NO: 211984 - RNA, 32 nt, Human
gugcuaacuccucgcuagcucucccucucaca

SEQ ID NO: 211985 - RNA, 32 nt, Human
gugcuaagaccacccagcugucccuggguucu

SEQ ID NO: 211986 - RNA, 32 nt, Human
gugcuaagggcugggcugcauguggguagccc

SEQ ID NO: 211987 - RNA, 32 nt, Human
gugcuaaguuuaaaauaaucacuguuggaauu

SEQ ID NO: 211988 - RNA, 32 nt, Human
gugcuaaucaauggcugcagaaaccuaacacc

SEQ ID NO: 211989 - RNA, 24 nt, Human
gugcuaaugccgaaccccuguggg

SEQ ID NO: 211990 - RNA, 32 nt, Human
gugcuaauguggcagugacuguaaaacuggca

SEQ ID NO: 211991 - RNA, 26 nt, Human
gugcuaauuccugaggaccugaaggg

SEQ ID NO: 211992 - RNA, 20 nt, Human
gugcuacacccagauccugu

SEQ ID NO: 211993 - RNA, 32 nt, Human
gugcuacacgggcucgggaacagaacaccgug

SEQ ID NO: 211994 - RNA, 32 nt, Human
gugcuacagcaugcaagugagcagugaggugu

SEQ ID NO: 211995 - RNA, 32 nt, Human
gugcuacagcauggggagccucgaccaggcuc

SEQ ID NO: 211996 - RNA, 32 nt, Human
gugcuacaggagguaauagaccagcuucucag

SEQ ID NO: 211997 - RNA, 32 nt, Human
gugcuaccauuauuuugccacagacuuugaag

SEQ ID NO: 211998 - RNA, 32 nt, Human
gugcuacgauaugccaggcauugagcuuagcg

SEQ ID NO: 211999 - RNA, 32 nt, Human
gugcuacucuacuccagccugggcaacacagc

SEQ ID NO: 212000 - RNA, 32 nt, Human
gugcuacucuuggucucccacaggaaaaggcc

SEQ ID NO: 212001 - RNA, 32 nt, Human
gugcuacugcacuccaaucuggcaacagagcg

SEQ ID NO: 212002 - RNA, 32 nt, Human
gugcuacugcacuccagccccagcugggugac

SEQ ID NO: 212003 - RNA, 32 nt, Human
gugcuacugcacuccagccugggcaacacaga

SEQ ID NO: 212004 - RNA, 32 nt, Human
gugcuacugcacuccagccugggcaacagagc

SEQ ID NO: 212005 - RNA, 32 nt, Human
gugcuacugcacuccagccugggggacagaaa

SEQ ID NO: 212006 - RNA, 32 nt, Human
gugcuacugcacuccagucugggugacagagu

SEQ ID NO: 212007 - RNA, 32 nt, Human
gugcuacugcacucccgccugggugacagagu

SEQ ID NO: 212008 - RNA, 32 nt, Human
gugcuacugcacucuagauugggugacagagc

SEQ ID NO: 212009 - RNA, 32 nt, Human
gugcuacugcaguccagccugggcuacagagu

SEQ ID NO: 212010 - RNA, 32 nt, Human
gugcuacuuccucucaagaggcgguugagcgc

SEQ ID NO: 212011 - RNA, 21 nt, Human
gugcuacuuuagcaauaggcc

SEQ ID NO: 212012 - RNA, 32 nt, Human
gugcuagaaucuuccuuuucccucucucccuu

SEQ ID NO: 212013 - RNA, 32 nt, Human
gugcuagauguguguuuagagcuaaaccagcc

SEQ ID NO: 212014 - RNA, 32 nt, Human
gugcuagauucaccucaccccgggcaggagug

SEQ ID NO: 212015 - RNA, 32 nt, Human
gugcuagcacagacaccuuucuaacuggccaa

SEQ ID NO: 212016 - RNA, 32 nt, Human
gugcuagcgggagcgcgagccagcaagaggcg

SEQ ID NO: 212017 - RNA, 32 nt, Human
gugcuaggagccaaggagcaggacuggauuau

SEQ ID NO: 212018 - RNA, 32 nt, Human
gugcuaggcacugagucaggugcuuuacauac

SEQ ID NO: 212019 - RNA, 32 nt, Human
gugcuaggcugcagacugccuuguacucccug

SEQ ID NO: 212020 - RNA, 32 nt, Human
gugcuagggggacagggguggggugagcucug

SEQ ID NO: 212021 - RNA, 32 nt, Human
gugcuagguggagggaaggaaggagggagccg

SEQ ID NO: 212022 - RNA, 32 nt, Human
gugcuaguuuucauguucacacugacccuauu

SEQ ID NO: 212023 - RNA, 32 nt, Human
gugcuauaaaggaugccagcugugcuuuaggc

SEQ ID NO: 212024 - RNA, 32 nt, Human
gugcuauaacauguagucaucuguuuucugau

SEQ ID NO: 212025 - RNA, 32 nt, Human
gugcuauaaccaggguccugggugacagggcg

SEQ ID NO: 212026 - RNA, 32 nt, Human
gugcuauacugauucuguuugcauugcuguaa

SEQ ID NO: 212027 - RNA, 32 nt, Human
gugcuauacuuuucccccaacccuccaauaaa

SEQ ID NO: 212028 - RNA, 32 nt, Human
gugcuauagacacguggcagagcuguaaguaa

SEQ ID NO: 212029 - RNA, 32 nt, Human
gugcuauagagagggagguaacagaaagacuc

SEQ ID NO: 212030 - RNA, 32 nt, Human
gugcuauaggcaugcaccaccacguccaucua

SEQ ID NO: 212031 - RNA, 32 nt, Human
gugcuauauaaauaugucagauguacauagag

SEQ ID NO: 212032 - RNA, 32 nt, Human
gugcuaucauuguauucuuuaagaacuuuauu

SEQ ID NO: 212033 - RNA, 32 nt, Human
gugcuaugagguuucuuugacuucaauguauu

SEQ ID NO: 212034 - RNA, 32 nt, Human
gugcuauggaaaugccuuuuguggcaacucag

SEQ ID NO: 212035 - RNA, 30 nt, Human
gugcuauggaggcggcggcggcgguggugg

SEQ ID NO: 212036 - RNA, 32 nt, Human
gugcuauugaguuuguucuuuauucuuuuauc

SEQ ID NO: 212037 - RNA, 32 nt, Human
gugcuauugcacuccagccugggcgacagagc

SEQ ID NO: 212038 - RNA, 32 nt, Human
gugcuauugcacuccagccugggugacagacu

SEQ ID NO: 212039 - RNA, 32 nt, Human
gugcuauuguagucuuggcaagugagccaaga

SEQ ID NO: 212040 - RNA, 32 nt, Human
gugcuauuugcacucuagccugggugacagag

SEQ ID NO: 212041 - RNA, 32 nt, Human
gugcuauuuguguuaacauggaagaggauuca

SEQ ID NO: 212042 - RNA, 32 nt, Human
gugcucaaaugcaccucucugccuuugugcca

SEQ ID NO: 212043 - RNA, 32 nt, Human
gugcucaaccuacaguggagggagacugaccc

SEQ ID NO: 212044 - RNA, 32 nt, Human
gugcucaagaucuuugccuguaagcuugaaua

SEQ ID NO: 212045 - RNA, 22 nt, Human
gugcucaagcucugcaggacag

SEQ ID NO: 212046 - RNA, 32 nt, Human
gugcucaaguacaggcauaaccauuaacccag

SEQ ID NO: 212047 - RNA, 32 nt, Human
gugcucaaguagccuggcuggcacagggcugc

SEQ ID NO: 212048 - RNA, 32 nt, Human
gugcucacacaaaauacuggguggcuugguuu

SEQ ID NO: 212049 - RNA, 32 nt, Human
gugcucacaccuguaaucccagcacuuuggga

SEQ ID NO: 212050 - RNA, 32 nt, Human
gugcucacacuuccaagcaccccacaccaagg

SEQ ID NO: 212051 - RNA, 32 nt, Human
gugcucacagcuguaaucccagcacuuugagg

SEQ ID NO: 212052 - RNA, 21 nt, Human
gugcucaccacauaaccucug

SEQ ID NO: 212053 - RNA, 32 nt, Human
gugcucacccaggcugagggugccuuuguggc

SEQ ID NO: 212054 - RNA, 20 nt, Human
gugcucaccgaugcccucug

SEQ ID NO: 212055 - RNA, 21 nt, Human
gugcucaccguaugucuuuug

SEQ ID NO: 212056 - RNA, 21 nt, Human
gugcucaccuaaauccaucug

SEQ ID NO: 212057 - RNA, 22 nt, Human
gugcucaccugggacccuucug

SEQ ID NO: 212058 - RNA, 32 nt, Human
gugcucacgccuguaauaccagcacuuuggga

SEQ ID NO: 212059 - RNA, 32 nt, Human
gugcucacgccuguaaucccagcacuuuggga

SEQ ID NO: 212060 - RNA, 32 nt, Human
gugcucacgccuguaaucccagcacuuugggg

SEQ ID NO: 212061 - RNA, 32 nt, Human
gugcucacgccuguaauccuagcacuuuuggg

SEQ ID NO: 212062 - RNA, 32 nt, Human
gugcucacgccuguaauuccagcacuuuggga

SEQ ID NO: 212063 - RNA, 32 nt, Human
gugcucacgccugucaucccagcacuuuggga

SEQ ID NO: 212064 - RNA, 32 nt, Human
gugcucacucagcagaggaggcacuggccacu

SEQ ID NO: 212065 - RNA, 26 nt, Human
gugcucacugauguggcugcuuucug

SEQ ID NO: 212066 - RNA, 32 nt, Human
gugcucacuggguggagcuguggcagggggca

SEQ ID NO: 212067 - RNA, 32 nt, Human
gugcucagauacacaagugagggcuuuuuaac

SEQ ID NO: 212068 - RNA, 32 nt, Human
gugcucagcauccuccucuuccucgguggugg

SEQ ID NO: 212069 - RNA, 32 nt, Human
gugcucagccgcccaguccugccugcaagccc

SEQ ID NO: 212070 - RNA, 32 nt, Human
gugcucaggaaaccucacccaccucagcccuu

SEQ ID NO: 212071 - RNA, 32 nt, Human
gugcucaggaggcagcaucuggaguuggggca

SEQ ID NO: 212072 - RNA, 32 nt, Human
gugcucaggauuacaggcgugagccacugugc

SEQ ID NO: 212073 - RNA, 32 nt, Human
gugcucaggccgggcuuuccagaaggcacagg

SEQ ID NO: 212074 - RNA, 32 nt, Human
gugcucaggccuguguugguucuggggcccua

SEQ ID NO: 212075 - RNA, 32 nt, Human
gugcucaggcuggccaaggaccuucauugccu

SEQ ID NO: 212076 - RNA, 24 nt, Human
gugcucaggguggcgggcccuuug

SEQ ID NO: 212077 - RNA, 32 nt, Human
gugcucagguauaaagccaauuaagguacaau

SEQ ID NO: 212078 - RNA, 32 nt, Human
gugcucaguggggaugauggagggaaggcgcc

SEQ ID NO: 212079 - RNA, 32 nt, Human
gugcucaguuucccucccuucucccuccaucc

SEQ ID NO: 212080 - RNA, 24 nt, Human
gugcucauaccaggcacuucucug

SEQ ID NO: 212081 - RNA, 26 nt, Human
gugcucaucaucaugcccauuuucug

SEQ ID NO: 212082 - RNA, 32 nt, Human
gugcucauccucacccucauugacucaggccu

SEQ ID NO: 212083 - RNA, 21 nt, Human
gugcucaucucgugaccucug

SEQ ID NO: 212084 - RNA, 32 nt, Human
gugcucaucugucuguccuccuuuccucuccc

SEQ ID NO: 212085 - RNA, 32 nt, Human
gugcucaugccaggcugacggguccagugcgg

SEQ ID NO: 212086 - RNA, 32 nt, Human
gugcucaugccuguagucccagcuacuuggga

SEQ ID NO: 212087 - RNA, 21 nt, Human
gugcucauuaggcauuucuua

SEQ ID NO: 212088 - RNA, 32 nt, Human
gugcuccaacucccucagggccuguguugccg

SEQ ID NO: 212089 - RNA, 32 nt, Human
gugcuccaauuugccagccauucccaaccccc

SEQ ID NO: 212090 - RNA, 32 nt, Human
gugcuccacagcuguucuaggaacugacccug

SEQ ID NO: 212091 - RNA, 32 nt, Human
gugcuccaccucucuguaucuuucccuuguca

SEQ ID NO: 212092 - RNA, 32 nt, Human
gugcuccaccucuucaucucuccccuaaccac

SEQ ID NO: 212093 - RNA, 22 nt, Human
gugcuccagccacagaaaagaa

SEQ ID NO: 212094 - RNA, 32 nt, Human
gugcuccagcuuuccagugacaugugacggcg

SEQ ID NO: 212095 - RNA, 32 nt, Human
gugcucccaaagugcugagauuacaggcguga

SEQ ID NO: 212096 - RNA, 32 nt, Human
gugcucccaccacugcacuccagccugggaag

SEQ ID NO: 212097 - RNA, 32 nt, Human
gugcucccagcacuuugggaggcugagguagg

SEQ ID NO: 212098 - RNA, 32 nt, Human
gugcucccagccugcagucuuuggagcaaggc

SEQ ID NO: 212099 - RNA, 32 nt, Human
gugcucccaucuguaacucuccaucugugauu

SEQ ID NO: 212100 - RNA, 32 nt, Human
gugcuccccacauucuuccaguuaacauaaau

SEQ ID NO: 212101 - RNA, 23 nt, Human
gugcuccccaugggugaccucug

SEQ ID NO: 212102 - RNA, 32 nt, Human
gugcuccccuccugcuaaagaaccaguuaccc

SEQ ID NO: 212103 - RNA, 32 nt, Human
gugcucccgaguaagcagggauguacuagggg

SEQ ID NO: 212104 - RNA, 32 nt, Human
gugcucccgccuggaaucccagcacuuuggga

SEQ ID NO: 212105 - RNA, 32 nt, Human
gugcucccguaaugccagcuacuugggaggcu

SEQ ID NO: 212106 - RNA, 32 nt, Human
gugcucccuaccaccuccccagccuuugauca

SEQ ID NO: 212107 - RNA, 32 nt, Human
gugcucccuccagacucccuggcugcgggugg

SEQ ID NO: 212108 - RNA, 17 nt, Human
gugcucccucugcugcc

SEQ ID NO: 212109 - RNA, 32 nt, Human
gugcucccucuggaagcuugggugaccggggc

SEQ ID NO: 212110 - RNA, 32 nt, Human
gugcucccugcuccuucccgcguagccaggug

SEQ ID NO: 212111 - RNA, 32 nt, Human
gugcucccuggaagauggaucuugccuugugg

SEQ ID NO: 212112 - RNA, 32 nt, Human
gugcucccuuucucuccucucuccuuuucuag

SEQ ID NO: 212113 - RNA, 18 nt, Human
gugcuccggcccaggcgg

SEQ ID NO: 212114 - RNA, 32 nt, Human
gugcuccggcccaggcgggggagucagugccc

SEQ ID NO: 212115 - RNA, 18 nt, Human
gugcuccgggaccuggaa

SEQ ID NO: 212116 - RNA, 32 nt, Human
gugcuccuacagccacggcuccgggcggggaa

SEQ ID NO: 212117 - RNA, 32 nt, Human
gugcuccuacagccgcaucugcgguuaacaua

SEQ ID NO: 212118 - RNA, 32 nt, Human
gugcuccuauagcuccagcuacucaggaggcu

SEQ ID NO: 212119 - RNA, 32 nt, Human
gugcuccucacuucccagagggugcaggagcc

SEQ ID NO: 212120 - RNA, 32 nt, Human
gugcuccucacuucccaguaggggcggccggg

SEQ ID NO: 212121 - RNA, 32 nt, Human
gugcuccucccuccuccauccucucuccuccc

SEQ ID NO: 212122 - RNA, 32 nt, Human
gugcuccugaggaggcggcggcagcagcgccu

SEQ ID NO: 212123 - RNA, 32 nt, Human
gugcuccugcagcuaucauucauccaguuaag

SEQ ID NO: 212124 - RNA, 32 nt, Human
gugcuccugccagcugugcacacaucucugua

SEQ ID NO: 212125 - RNA, 32 nt, Human
gugcuccugcccaguugaucagucccauccug

SEQ ID NO: 212126 - RNA, 32 nt, Human
gugcuccugcucccagcagcccucucuuagaa

SEQ ID NO: 212127 - RNA, 32 nt, Human
gugcuccugcugucaagauuucugucauggaa

SEQ ID NO: 212128 - RNA, 32 nt, Human
gugcuccugcugucuuuuccuguuucuguuug

SEQ ID NO: 212129 - RNA, 32 nt, Human
gugcuccuggaggcaggugaugcugugggcac

SEQ ID NO: 212130 - RNA, 32 nt, Human
gugcuccugggagcugugcugacucuucccgg

SEQ ID NO: 212131 - RNA, 32 nt, Human
gugcuccuggugucuccaccugccuggguugu

SEQ ID NO: 212132 - RNA, 32 nt, Human
gugcuccuuccuggcccggucacauugccucc

SEQ ID NO: 212133 - RNA, 32 nt, Human
gugcuccuucucccugagacugaggccacaca

SEQ ID NO: 212134 - RNA, 32 nt, Human
gugcuccuugacugucucuccccaccgggguc

SEQ ID NO: 212135 - RNA, 32 nt, Human
gugcuccuuggagcuggugugcaguguccuga

SEQ ID NO: 212136 - RNA, 22 nt, Human
gugcucgagcucugcaggccag

SEQ ID NO: 212137 - RNA, 22 nt, Human
gugcucgcccugcccaacgcag

SEQ ID NO: 212138 - RNA, 32 nt, Human
gugcucgccuguaaucccagcuacuugggagg

SEQ ID NO: 212139 - RNA, 32 nt, Human
gugcucgucugcacuccacuccauccugcugc

SEQ ID NO: 212140 - RNA, 32 nt, Human
gugcucgugaacuaaggagaaaaagaacagac

SEQ ID NO: 212141 - RNA, 32 nt, Human
gugcucuaaaaaugcagguacucaaaggaaau

SEQ ID NO: 212142 - RNA, 19 nt, Human
gugcucuaacuuuucuuaa

SEQ ID NO: 212143 - RNA, 32 nt, Human
gugcucucacccucccuucucucccucaauaa

SEQ ID NO: 212144 - RNA, 32 nt, Human
gugcucucauuggccucucuagcuaggccguc

SEQ ID NO: 212145 - RNA, 32 nt, Human
gugcucuccagaacccaacugccucaucccgc

SEQ ID NO: 212146 - RNA, 32 nt, Human
gugcucuccagccuggcugccagggagggugg

SEQ ID NO: 212147 - RNA, 32 nt, Human
gugcucuccagcucuucaccuuccucaccuca

SEQ ID NO: 212148 - RNA, 32 nt, Human
gugcucuccaggaguccggagcaugguccugg

SEQ ID NO: 212149 - RNA, 32 nt, Human
gugcucucccugcugucaacacuugcguacaa

SEQ ID NO: 212150 - RNA, 32 nt, Human
gugcucuccucaaguauggcuuuaguuccuuc

SEQ ID NO: 212151 - RNA, 32 nt, Human
gugcucuccugccucuucgucuuucugauuag

SEQ ID NO: 212152 - RNA, 32 nt, Human
gugcucuccugcuguguggcuuggggcuuguu

SEQ ID NO: 212153 - RNA, 32 nt, Human
gugcucuccugguuucugugcaggcggguuga

SEQ ID NO: 212154 - RNA, 32 nt, Human
gugcucuccuucagcccucuccuucggaggga

SEQ ID NO: 212155 - RNA, 32 nt, Human
gugcucucgagaucaccgucccuucccgagaa

SEQ ID NO: 212156 - RNA, 32 nt, Human
gugcucucuccucaaauggaggcagccauggc

SEQ ID NO: 212157 - RNA, 32 nt, Human
gugcucucuccuuccugaagcgcaggcagggg

SEQ ID NO: 212158 - RNA, 32 nt, Human
gugcucugaaguggagugaagccucaagccca

SEQ ID NO: 212159 - RNA, 32 nt, Human
gugcucugacugcaauuuuucuucuuuugcaa

SEQ ID NO: 212160 - RNA, 32 nt, Human
gugcucugauucucccugauggucuuuauagc

SEQ ID NO: 212161 - RNA, 32 nt, Human
gugcucugcacaaaaacagaccuguuguccau

SEQ ID NO: 212162 - RNA, 32 nt, Human
gugcucugcacccccugcucccuugggcuggc

SEQ ID NO: 212163 - RNA, 32 nt, Human
gugcucugcgugggaccaugccugaacucccc

SEQ ID NO: 212164 - RNA, 32 nt, Human
gugcucugcuaccuguucaucagcucuaagcc

SEQ ID NO: 212165 - RNA, 32 nt, Human
gugcucugcucuugccauaauaccaaaccuuu

SEQ ID NO: 212166 - RNA, 32 nt, Human
gugcucuggaagcguaugauagaggcccgggg

SEQ ID NO: 212167 - RNA, 32 nt, Human
gugcucugggccggcgccuucaccauggccuc

SEQ ID NO: 212168 - RNA, 32 nt, Human
gugcucuggggcacuguugaggauguguccag

SEQ ID NO: 212169 - RNA, 32 nt, Human
gugcucugggugggaggagcagcguacacccg

SEQ ID NO: 212170 - RNA, 32 nt, Human
gugcucugucugucugucuuugucugucuguu

SEQ ID NO: 212171 - RNA, 32 nt, Human
gugcucuguguagucaugacaucagcucuucg

SEQ ID NO: 212172 - RNA, 32 nt, Human
gugcucugugugaccaaguccaagucgaugca

SEQ ID NO: 212173 - RNA, 32 nt, Human
gugcucuguuagcugcucccagugcugucccc

SEQ ID NO: 212174 - RNA, 32 nt, Human
gugcucuguugagccuuccuuucuguuugggu

SEQ ID NO: 212175 - RNA, 32 nt, Human
gugcucuuaaccuucugagugcugcuagccca

SEQ ID NO: 212176 - RNA, 32 nt, Human
gugcucuuauuaucuguguuugcucacagcaa

SEQ ID NO: 212177 - RNA, 32 nt, Human
gugcucuucugucugcagugugcacggccuug

SEQ ID NO: 212178 - RNA, 22 nt, Human
gugcucuugcccaccgacagcu

SEQ ID NO: 212179 - RNA, 32 nt, Human
gugcucuuggagcugugacuggacuccccugc

SEQ ID NO: 212180 - RNA, 32 nt, Human
gugcucuuuccagaugaaaacuacucuuuugg

SEQ ID NO: 212181 - RNA, 22 nt, Human
gugcucuuugaggccgacgcua

SEQ ID NO: 212182 - RNA, 32 nt, Human
gugcugaaaaugccaaacagggcccaaaggac

SEQ ID NO: 212183 - RNA, 32 nt, Human
gugcugaaaggagacgccggugcucugucucu

SEQ ID NO: 212184 - RNA, 32 nt, Human
gugcugaaaguguguaaguuccuggccauccu

SEQ ID NO: 212185 - RNA, 32 nt, Human
gugcugaacagagguuugaaucauuccagcug

SEQ ID NO: 212186 - RNA, 32 nt, Human
gugcugaacauuaacuuuuuggaguugugaaa

SEQ ID NO: 212187 - RNA, 32 nt, Human
gugcugaacgauggcgaacacagcagaauggg

SEQ ID NO: 212188 - RNA, 32 nt, Human
gugcugaagaaauauuuucaugugaguaaaau

SEQ ID NO: 212189 - RNA, 32 nt, Human
gugcugaagauaaggaaacccgggaccucguu

SEQ ID NO: 212190 - RNA, 32 nt, Human
gugcugacaagcaggauggccaguaaaccuuc

SEQ ID NO: 212191 - RNA, 32 nt, Human
gugcugacacuggguccagagugagcauucuc

SEQ ID NO: 212192 - RNA, 32 nt, Human
gugcugaccccagcaguuagggacuggcugca

SEQ ID NO: 212193 - RNA, 32 nt, Human
gugcugacucccaagagcaaccgcaagaugga

SEQ ID NO: 212194 - RNA, 22 nt, Human
gugcugagagugacucgccgug

SEQ ID NO: 212195 - RNA, 32 nt, Human
gugcugagauuucaaggcucagcacugaguag

SEQ ID NO: 212196 - RNA, 32 nt, Human
gugcugagcccugcccugggccccacggacag

SEQ ID NO: 212197 - RNA, 32 nt, Human
gugcugagccuucugcugagguccuugcgugg

SEQ ID NO: 212198 - RNA, 20 nt, Human
gugcugagcuagccaggacu

SEQ ID NO: 212199 - RNA, 32 nt, Human
gugcugagcucaugggauuacauaacuguguc

SEQ ID NO: 212200 - RNA, 32 nt, Human
gugcugaggaagagcagcagcagcaggauggu

SEQ ID NO: 212201 - RNA, 32 nt, Human
gugcugaggagaaaggaggggcaguggcuucc

SEQ ID NO: 212202 - RNA, 32 nt, Human
gugcugaggagacucagauguuggccucagcu

SEQ ID NO: 212203 - RNA, 32 nt, Human
gugcugaggcagcagggggcugguguauuagc

SEQ ID NO: 212204 - RNA, 32 nt, Human
gugcugaggccgggauggcaucaggaauuaag

SEQ ID NO: 212205 - RNA, 32 nt, Human
gugcugaguuccaugaaggagaacaaaguggc

SEQ ID NO: 212206 - RNA, 32 nt, Human
gugcugaguucuauaauauaagcugccauaua

SEQ ID NO: 212207 - RNA, 32 nt, Human
gugcugaguuuaaaaguugaccuguguuugua

SEQ ID NO: 212208 - RNA, 32 nt, Human
gugcugauccuaccaccuacugcuaccuuccu

SEQ ID NO: 212209 - RNA, 32 nt, Human
gugcugaucgugucucagcaucaggaaaggag

SEQ ID NO: 212210 - RNA, 21 nt, Human
gugcugaugccauccagggca

SEQ ID NO: 212211 - RNA, 32 nt, Human
gugcugcaaagauaugaagaaauaugauaacg

SEQ ID NO: 212212 - RNA, 32 nt, Human
gugcugcaacaaacauaugcaugcaugugucu

SEQ ID NO: 212213 - RNA, 32 nt, Human
gugcugcaccuugcuguuguacuucugaaauc

SEQ ID NO: 212214 - RNA, 32 nt, Human
gugcugcagaucuucccgcccugugaguucuc

SEQ ID NO: 212215 - RNA, 32 nt, Human
gugcugcaggggucugggguuggcaacuccug

SEQ ID NO: 212216 - RNA, 32 nt, Human
gugcugcagggugugaugaggugggagcccuc

SEQ ID NO: 212217 - RNA, 32 nt, Human
gugcugcagguguaagagagugggagcaggga

SEQ ID NO: 212218 - RNA, 32 nt, Human
gugcugcauaugccccugugcccagugguuga

SEQ ID NO: 212219 - RNA, 32 nt, Human
gugcugcaucccaccagccugagcaagacgcc

SEQ ID NO: 212220 - RNA, 32 nt, Human
gugcugccaagcggcgccgcacguaacccuca

SEQ ID NO: 212221 - RNA, 32 nt, Human
gugcugccacaugugcauggguccccaccaag

SEQ ID NO: 212222 - RNA, 32 nt, Human
gugcugccagauaaucuaagucuuccaaugcc

SEQ ID NO: 212223 - RNA, 32 nt, Human
gugcugccagcacagggcugggugauacguac

SEQ ID NO: 212224 - RNA, 32 nt, Human
gugcugccagccugcccaugugcacacguuag

SEQ ID NO: 212225 - RNA, 32 nt, Human
gugcugccagguccuggugaagcccaagguug

SEQ ID NO: 212226 - RNA, 32 nt, Human
gugcugccaucaguuucacuucugccuuggaa

SEQ ID NO: 212227 - RNA, 20 nt, Human
gugcugcccacgccuggagg

SEQ ID NO: 212228 - RNA, 32 nt, Human
gugcugcccgucugcaaccucaaggccucggc

SEQ ID NO: 212229 - RNA, 32 nt, Human
gugcugcccgucuucagccuagccgaccucag

SEQ ID NO: 212230 - RNA, 32 nt, Human
gugcugcccucuuaccaugcacacgggugcuc

SEQ ID NO: 212231 - RNA, 32 nt, Human
gugcugcccugccucucgugccggguguugcu

SEQ ID NO: 212232 - RNA, 20 nt, Human
gugcugcccuggcaucagcc

SEQ ID NO: 212233 - RNA, 32 nt, Human
gugcugcccuucccucccacagccuggcagcc

SEQ ID NO: 212234 - RNA, 32 nt, Human
gugcugcccuuuccaggcuucuuuccugcuca

SEQ ID NO: 212235 - RNA, 32 nt, Human
gugcugccgcggcuggcgcugccuguggggca

SEQ ID NO: 212236 - RNA, 32 nt, Human
gugcugccguggcuggcgcugccuguggggca

SEQ ID NO: 212237 - RNA, 32 nt, Human
gugcugccucuccugaguagggugggugcaag

SEQ ID NO: 212238 - RNA, 32 nt, Human
gugcugccucugguccugagggguuagggaca

SEQ ID NO: 212239 - RNA, 32 nt, Human
gugcugccuggcgcuggcuaggaggcaaacgc

SEQ ID NO: 212240 - RNA, 32 nt, Human
gugcugccuucuguuguggauuuccugccagc

SEQ ID NO: 212241 - RNA, 32 nt, Human
gugcugccuugccucuucaagaugcuauucac

SEQ ID NO: 212242 - RNA, 32 nt, Human
gugcugccuugcuucuguauuuccuuggauuu

SEQ ID NO: 212243 - RNA, 32 nt, Human
gugcugcgggccaagcuuucccuuccuuugag

SEQ ID NO: 212244 - RNA, 32 nt, Human
gugcugcgugcuuucuacaugacauuaauuuu

SEQ ID NO: 212245 - RNA, 32 nt, Human
gugcugcuagcccagaccuguggacgaggcag

SEQ ID NO: 212246 - RNA, 32 nt, Human
gugcugcuccacuggugccugcuguggcuccu

SEQ ID NO: 212247 - RNA, 32 nt, Human
gugcugcuccauccugccuguccacaccucuu

SEQ ID NO: 212248 - RNA, 32 nt, Human
gugcugcugaguggccaagaugaugccaggcu

SEQ ID NO: 212249 - RNA, 32 nt, Human
gugcugcugcaccccagccuagcgacagagca

SEQ ID NO: 212250 - RNA, 32 nt, Human
gugcugcugcacuccagccugggagacagagc

SEQ ID NO: 212251 - RNA, 32 nt, Human
gugcugcugcacuccagccugggcaauagagu

SEQ ID NO: 212252 - RNA, 32 nt, Human
gugcugcugcacuccagccugggugaaaaaga

SEQ ID NO: 212253 - RNA, 32 nt, Human
gugcugcugcagcugcugauaagccucaaacc

SEQ ID NO: 212254 - RNA, 32 nt, Human
gugcugcugcccaggcuggagugcaguggcac

SEQ ID NO: 212255 - RNA, 32 nt, Human
gugcugcugccuucucugccucccacccaggg

SEQ ID NO: 212256 - RNA, 32 nt, Human
gugcugcuggcguaguguaggccagacauuga

SEQ ID NO: 212257 - RNA, 32 nt, Human
gugcugcugggaaucaggagaauagaagcaaa

SEQ ID NO: 212258 - RNA, 32 nt, Human
gugcugcugggcccgcaccccaugucccuugu

SEQ ID NO: 212259 - RNA, 32 nt, Human
gugcugcuggggccucccagggccgguaaagg

SEQ ID NO: 212260 - RNA, 32 nt, Human
gugcugcugguuuugaagaugccuaaaggagu

SEQ ID NO: 212261 - RNA, 32 nt, Human
gugcugcuguaaccacccaccccucgggacuu

SEQ ID NO: 212262 - RNA, 32 nt, Human
gugcugcuuacacuccagguguggaccggccg

SEQ ID NO: 212263 - RNA, 32 nt, Human
gugcugcuucuuacccugccccugcaccucau

SEQ ID NO: 212264 - RNA, 32 nt, Human
gugcugcuucuuucucccccagacgcccuugc

SEQ ID NO: 212265 - RNA, 32 nt, Human
gugcuggaaaaacgugccugcugagagagugc

SEQ ID NO: 212266 - RNA, 32 nt, Human
gugcuggaagagcguccucagcagggcagggc

SEQ ID NO: 212267 - RNA, 32 nt, Human
gugcuggaaguguggggagaacccggacagcu

SEQ ID NO: 212268 - RNA, 32 nt, Human
gugcuggaauuuuccaaaacagccuguucucu

SEQ ID NO: 212269 - RNA, 32 nt, Human
gugcuggacacugaagcaaauaccauacugcu

SEQ ID NO: 212270 - RNA, 32 nt, Human
gugcuggaccuaaaauacugacuuuaguuagu

SEQ ID NO: 212271 - RNA, 32 nt, Human
gugcuggagaggaaagcagggagccacugcau

SEQ ID NO: 212272 - RNA, 32 nt, Human
gugcuggagauuacaggcaugagccaccacgc

SEQ ID NO: 212273 - RNA, 21 nt, Human
gugcuggagccugugccccug

SEQ ID NO: 212274 - RNA, 32 nt, Human
gugcuggaggacagaggagccaccucuucuca

SEQ ID NO: 212275 - RNA, 32 nt, Human
gugcuggaggauggggaaguggaggcugacau

SEQ ID NO: 212276 - RNA, 32 nt, Human
gugcuggaggcuguauaugugucugugugcgu

SEQ ID NO: 212277 - RNA, 32 nt, Human
gugcuggagguggcggccucugggggagugug

SEQ ID NO: 212278 - RNA, 17 nt, Human
gugcuggaguccaggug

SEQ ID NO: 212279 - RNA, 32 nt, Human
gugcuggaguuagcaccucccucugcccuuaa

SEQ ID NO: 212280 - RNA, 32 nt, Human
gugcuggaugcugugucgggccgcaucauccg

SEQ ID NO: 212281 - RNA, 32 nt, Human
gugcuggauuacaggcaugagccaccucgccu

SEQ ID NO: 212282 - RNA, 32 nt, Human
gugcuggcaccaagggcugagcgcggggaccc

SEQ ID NO: 212283 - RNA, 32 nt, Human
gugcuggcauuuucagcagauccucauguguu

SEQ ID NO: 212284 - RNA, 17 nt, Human
gugcuggccccaggugg

SEQ ID NO: 212285 - RNA, 32 nt, Human
gugcuggccccuggcuggaggggagggcagug

SEQ ID NO: 212286 - RNA, 32 nt, Human
gugcuggcccugccccagccuagcugagugug

SEQ ID NO: 212287 - RNA, 32 nt, Human
gugcuggcccugggugggagcggggaguccug

SEQ ID NO: 212288 - RNA, 32 nt, Human
gugcuggccugaggcagggcaggaaaucagaa

SEQ ID NO: 212289 - RNA, 32 nt, Human
gugcuggcgggauugggcaugggaaggagcag

SEQ ID NO: 212290 - RNA, 16 nt, Human
gugcuggcuccaggug

SEQ ID NO: 212291 - RNA, 32 nt, Human
gugcuggcucuuuccuggcuacuccauguugg

SEQ ID NO: 212292 - RNA, 32 nt, Human
gugcuggcugagucuccgccuugcuggggcuu

SEQ ID NO: 212293 - RNA, 32 nt, Human
gugcuggcugcaggcaggugugaccaucucuc

SEQ ID NO: 212294 - RNA, 32 nt, Human
gugcuggcuguagcccccacagaggcaaucau

SEQ ID NO: 212295 - RNA, 32 nt, Human
gugcugggaaaggcaggacugggagccggagg

SEQ ID NO: 212296 - RNA, 32 nt, Human
gugcugggaaccugcuagcugagcacuuccac

SEQ ID NO: 212297 - RNA, 32 nt, Human
gugcugggaacugaaagaguggggaaggugga

SEQ ID NO: 212298 - RNA, 32 nt, Human
gugcugggaaggcaguuguucauugggagggu

SEQ ID NO: 212299 - RNA, 32 nt, Human
gugcugggacgcgagccuggaggcagagcccc

SEQ ID NO: 212300 - RNA, 32 nt, Human
gugcugggagaaaggggugcaccugggaggac

SEQ ID NO: 212301 - RNA, 32 nt, Human
gugcugggagaaaggguggcagccgggagccu

SEQ ID NO: 212302 - RNA, 32 nt, Human
gugcugggagagaggggagaugugggcaggac

SEQ ID NO: 212303 - RNA, 24 nt, Human
gugcugggagagcaaucaaaggca

SEQ ID NO: 212304 - RNA, 32 nt, Human
gugcugggagccagggggccugggaggagccg

SEQ ID NO: 212305 - RNA, 32 nt, Human
gugcugggaggguggaggugaaggauggggcc

SEQ ID NO: 212306 - RNA, 22 nt, Human
gugcugggagugagcccaggca

SEQ ID NO: 212307 - RNA, 32 nt, Human
gugcugggauaucaggcacugagccacugcgc

SEQ ID NO: 212308 - RNA, 19 nt, Human
gugcugggaucacaggcgu

SEQ ID NO: 212309 - RNA, 32 nt, Human
gugcugggaucuggcgugugugcuccaggggc

SEQ ID NO: 212310 - RNA, 19 nt, Human
gugcugggauuaaaggcgu

SEQ ID NO: 212311 - RNA, 32 nt, Human
gugcugggauuaacgggugugagccacggcgc

SEQ ID NO: 212312 - RNA, 19 nt, Human
gugcugggauuacagacgu

SEQ ID NO: 212313 - RNA, 32 nt, Human
gugcugggauuacagagugugagccaccacac

SEQ ID NO: 212314 - RNA, 32 nt, Human
gugcugggauuacaggcauaagccacagcacc

SEQ ID NO: 212315 - RNA, 22 nt, Human
gugcugggauuacaggcaugag

SEQ ID NO: 212316 - RNA, 18 nt, Human
gugcugggauuacaggcg

SEQ ID NO: 212317 - RNA, 19 nt, Human
gugcugggauuacaggcgu

SEQ ID NO: 212318 - RNA, 22 nt, Human
gugcugggauuacaggcgugag

SEQ ID NO: 212319 - RNA, 19 nt, Human
gugcugggauuacaggggu

SEQ ID NO: 212320 - RNA, 18 nt, Human
gugcugggauuacaggug

SEQ ID NO: 212321 - RNA, 19 nt, Human
gugcugggauuacaggugu

SEQ ID NO: 212322 - RNA, 22 nt, Human
gugcugggauuacaggugugag

SEQ ID NO: 212323 - RNA, 19 nt, Human
gugcugggauuauaggcgu

SEQ ID NO: 212324 - RNA, 22 nt, Human
gugcugggauuauaggcgugag

SEQ ID NO: 212325 - RNA, 32 nt, Human
gugcugggauuuacaggcaugagccaccgcgc

SEQ ID NO: 212326 - RNA, 32 nt, Human
gugcugggcacugggggcacucccugcaggag

SEQ ID NO: 212327 - RNA, 22 nt, Human
gugcugggcauacaacccucug

SEQ ID NO: 212328 - RNA, 32 nt, Human
gugcugggcauacaacccucugcuuucacauc

SEQ ID NO: 212329 - RNA, 32 nt, Human
gugcugggcccgccaaugccgucaucaucagg

SEQ ID NO: 212330 - RNA, 21 nt, Human
gugcugggccgggcaccaggg

SEQ ID NO: 212331 - RNA, 32 nt, Human
gugcugggcuguucccagccucccacagcaga

SEQ ID NO: 212332 - RNA, 32 nt, Human
gugcugggcuguucccuuggcugcauacacag

SEQ ID NO: 212333 - RNA, 32 nt, Human
gugcugggcuuuagagaacaugggaaggcggc

SEQ ID NO: 212334 - RNA, 21 nt, Human
gugcuggggaacaaccagagg

SEQ ID NO: 212335 - RNA, 32 nt, Human
gugcuggggaaugaccacgguuggcugcuacg

SEQ ID NO: 212336 - RNA, 21 nt, Human
gugcuggggaccuccuggaca

SEQ ID NO: 212337 - RNA, 20 nt, Human
gugcuggggacucagagggc

SEQ ID NO: 212338 - RNA, 23 nt, Human
gugcuggggacugugccaggcca

SEQ ID NO: 212339 - RNA, 32 nt, Human
gugcuggggacuuauugggcacauuuauuugu

SEQ ID NO: 212340 - RNA, 32 nt, Human
gugcuggggccagacuggcacaaggcacucgu

SEQ ID NO: 212341 - RNA, 25 nt, Human
gugcugggggcccggucgccaggca

SEQ ID NO: 212342 - RNA, 20 nt, Human
gugcugggggcuacaggugu

SEQ ID NO: 212343 - RNA, 21 nt, Human
gugcuggguaacuggcugggg

SEQ ID NO: 212344 - RNA, 24 nt, Human
gugcuggguacuccagaggugcca

SEQ ID NO: 212345 - RNA, 32 nt, Human
gugcuggguaguguucucauuugggggcugaa

SEQ ID NO: 212346 - RNA, 32 nt, Human
gugcugggucuggggcaggugggcaggcgugu

SEQ ID NO: 212347 - RNA, 23 nt, Human
gugcuggguggggccgggccucc

SEQ ID NO: 212348 - RNA, 32 nt, Human
gugcugggugugagccaccaccagucaacaaa

SEQ ID NO: 212349 - RNA, 32 nt, Human
gugcugguaggguuucaaggugcuauuagugg

SEQ ID NO: 212350 - RNA, 32 nt, Human
gugcuggucccacuaaggaaaccaccucaccc

SEQ ID NO: 212351 - RNA, 32 nt, Human
gugcuggucucuaggccugaacuaggugcugg

SEQ ID NO: 212352 - RNA, 32 nt, Human
gugcuggugaugcugaggacuacuaaaugaag

SEQ ID NO: 212353 - RNA, 32 nt, Human
gugcuggugaugugagccuacaucaggguggg

SEQ ID NO: 212354 - RNA, 32 nt, Human
gugcuggugauuuuauguggcagcccucugcu

SEQ ID NO: 212355 - RNA, 32 nt, Human
gugcugguggaguuugggggccagggggacaa

SEQ ID NO: 212356 - RNA, 20 nt, Human
gugcugguggggccuggaga

SEQ ID NO: 212357 - RNA, 31 nt, Human
gugcuguaccuuuucugauucagaauuauag

SEQ ID NO: 212358 - RNA, 32 nt, Human
gugcuguacuggguacacaguaggcgcccagg

SEQ ID NO: 212359 - RNA, 20 nt, Human
gugcuguaggcaucuggaga

SEQ ID NO: 212360 - RNA, 21 nt, Human
gugcuguaucccggaaaucua

SEQ ID NO: 212361 - RNA, 32 nt, Human
gugcugucaacuuuggaaaaaguaucccgguu

SEQ ID NO: 212362 - RNA, 32 nt, Human
gugcugucaccugcaauucucccuuaucaggg

SEQ ID NO: 212363 - RNA, 32 nt, Human
gugcugucaguggaggggucucugcagccaac

SEQ ID NO: 212364 - RNA, 32 nt, Human
gugcugucauuugcaauuucuuccugugacug

SEQ ID NO: 212365 - RNA, 32 nt, Human
gugcuguccuagcagugcacuggcgggucucu

SEQ ID NO: 212366 - RNA, 32 nt, Human
gugcuguccugccucagaugcagagagagcac

SEQ ID NO: 212367 - RNA, 32 nt, Human
gugcugucuccucccugccuccugccuccugc

SEQ ID NO: 212368 - RNA, 32 nt, Human
gugcugucugcccucaugaaauuggcuccaaa

SEQ ID NO: 212369 - RNA, 20 nt, Human
gugcugucuugcuccagcca

SEQ ID NO: 212370 - RNA, 32 nt, Human
gugcugugaaacugucuaugcacuacauucug

SEQ ID NO: 212371 - RNA, 32 nt, Human
gugcugugaaggagguugugcagcugggcccg

SEQ ID NO: 212372 - RNA, 32 nt, Human
gugcugugacauauugcugggcccagcaccaa

SEQ ID NO: 212373 - RNA, 32 nt, Human
gugcugugaccuccgagcccuccuggugggaa

SEQ ID NO: 212374 - RNA, 32 nt, Human
gugcugugauuacagggugugagccacugcac

SEQ ID NO: 212375 - RNA, 32 nt, Human
gugcugugauuauccacauuuucacuugcucu

SEQ ID NO: 212376 - RNA, 32 nt, Human
gugcugugauucuuccugguucccaagucuug

SEQ ID NO: 212377 - RNA, 32 nt, Human
gugcugugcagccucuggcagagcauccgacc

SEQ ID NO: 212378 - RNA, 32 nt, Human
gugcugugccuccucuugcugcuaaucucugc

SEQ ID NO: 212379 - RNA, 32 nt, Human
gugcugugccuccucuugcugcuaugucuccu

SEQ ID NO: 212380 - RNA, 32 nt, Human
gugcugugcgggaaaggcugcugguaacauuc

SEQ ID NO: 212381 - RNA, 32 nt, Human
gugcugugcuucccgugaggacccaggacccc

SEQ ID NO: 212382 - RNA, 24 nt, Human
gugcuguggcucacaccuguaauc

SEQ ID NO: 212383 - RNA, 24 nt, Human
gugcuguggcucacgccugcaauc

SEQ ID NO: 212384 - RNA, 24 nt, Human
gugcuguggcucacgccuguaauc

SEQ ID NO: 212385 - RNA, 24 nt, Human
gugcuguggcucacgucuguaauc

SEQ ID NO: 212386 - RNA, 24 nt, Human
gugcuguggcucaugccuguaauc

SEQ ID NO: 212387 - RNA, 32 nt, Human
gugcugugggccuggaagaugggaggaggggc

SEQ ID NO: 212388 - RNA, 32 nt, Human
gugcugugggcuguguguagggcguggcugcu

SEQ ID NO: 212389 - RNA, 19 nt, Human
gugcugugggucccggugg

SEQ ID NO: 212390 - RNA, 32 nt, Human
gugcugugggugauauggacagcagaaggggg

SEQ ID NO: 212391 - RNA, 32 nt, Human
gugcugugguucugggugauuuaucugguccc

SEQ ID NO: 212392 - RNA, 32 nt, Human
gugcuguguagucuggaauuguuaacauuuua

SEQ ID NO: 212393 - RNA, 20 nt, Human
gugcugugugggcagaggag

SEQ ID NO: 212394 - RNA, 32 nt, Human
gugcuguguguaucuaguuccagcuacuugag

SEQ ID NO: 212395 - RNA, 32 nt, Human
gugcuguguguccuugcccugccugccugugg

SEQ ID NO: 212396 - RNA, 32 nt, Human
gugcugugugugugcaugugugcaugacggug

SEQ ID NO: 212397 - RNA, 32 nt, Human
gugcuguuacucgguagagucaagacuguuac

SEQ ID NO: 212398 - RNA, 32 nt, Human
gugcuguucccuguuccaucuuuacacuuucu

SEQ ID NO: 212399 - RNA, 32 nt, Human
gugcuguugcccaagggcgugguccacgguac

SEQ ID NO: 212400 - RNA, 32 nt, Human
gugcuguuucaaccuccguccccacaggaggg

SEQ ID NO: 212401 - RNA, 32 nt, Human
gugcuguuuccuggcuggagugcaguggcaug

SEQ ID NO: 212402 - RNA, 32 nt, Human
gugcuuaagaaugggauucccaccucaguuua

SEQ ID NO: 212403 - RNA, 32 nt, Human
gugcuuaauuaggggacuuuguuuucccaaaa

SEQ ID NO: 212404 - RNA, 22 nt, Human
gugcuuaccaguggaccuucug

SEQ ID NO: 212405 - RNA, 32 nt, Human
gugcuuacccuugauugucuugauuuuauaua

SEQ ID NO: 212406 - RNA, 32 nt, Human
gugcuuaccugagaccuggguaauacuggaag

SEQ ID NO: 212407 - RNA, 32 nt, Human
gugcuuacugcacagccugaacagacaguucu

SEQ ID NO: 212408 - RNA, 32 nt, Human
gugcuuagcaaaugcuuguaaaggaaugccug

SEQ ID NO: 212409 - RNA, 21 nt, Human
gugcuuagccccagggcacuc

SEQ ID NO: 212410 - RNA, 32 nt, Human
gugcuuaggaaagccagccucaguccucagca

SEQ ID NO: 212411 - RNA, 32 nt, Human
gugcuuagggccugaggugugaaagcccaggg

SEQ ID NO: 212412 - RNA, 32 nt, Human
gugcuuaugcuccuggugucuuuugcuccacu

SEQ ID NO: 212413 - RNA, 32 nt, Human
gugcuuauguguagcuuuuuacuuuuuauggu

SEQ ID NO: 212414 - RNA, 23 nt, Human
gugcuucaaagucauugaugcaa

SEQ ID NO: 212415 - RNA, 32 nt, Human
gugcuucaacuuacacauuuaugaugaugugg

SEQ ID NO: 212416 - RNA, 32 nt, Human
gugcuucacagaagacaccacauuucaauaau

SEQ ID NO: 212417 - RNA, 16 nt, Human
gugcuucacugguuca

SEQ ID NO: 212418 - RNA, 32 nt, Human
gugcuucauucaccucuccaucgucucuaaau

SEQ ID NO: 212419 - RNA, 25 nt, Human
gugcuuccaaauucuuuuggugcaa

SEQ ID NO: 212420 - RNA, 32 nt, Human
gugcuuccacacccgggcucugagcaaaugga

SEQ ID NO: 212421 - RNA, 32 nt, Human
gugcuuccagcccuggaaggcauaacauuuac

SEQ ID NO: 212422 - RNA, 32 nt, Human
gugcuucccaagccuccugaaaaacugaagac

SEQ ID NO: 212423 - RNA, 32 nt, Human
gugcuuccccauaggucucucccuucauuugu

SEQ ID NO: 212424 - RNA, 32 nt, Human
gugcuucccccaccccuccacguguccgucca

SEQ ID NO: 212425 - RNA, 19 nt, Human
gugcuucccggaccugcgg

SEQ ID NO: 212426 - RNA, 32 nt, Human
gugcuucccucuuuucuugguuguaguucuca

SEQ ID NO: 212427 - RNA, 32 nt, Human
gugcuuccuauauuguugcauuuccuugauaa

SEQ ID NO: 212428 - RNA, 32 nt, Human
gugcuuccucuccugucaauuccaggcucuuu

SEQ ID NO: 212429 - RNA, 32 nt, Human
gugcuuccugaagaggcuguuuugaguguuga

SEQ ID NO: 212430 - RNA, 32 nt, Human
gugcuuccugguguggguauuacaaucccuuc

SEQ ID NO: 212431 - RNA, 32 nt, Human
gugcuuccugguguguguauuagaaucccuuc

SEQ ID NO: 212432 - RNA, 32 nt, Human
gugcuuccuucucccuccucugucucaaacug

SEQ ID NO: 212433 - RNA, 32 nt, Human
gugcuucggaugaaccaagggaagagaaauaa

SEQ ID NO: 212434 - RNA, 32 nt, Human
gugcuucgggagggggagagacugacccugcc

SEQ ID NO: 212435 - RNA, 32 nt, Human
gugcuucucugugguuguucagcacuuuaggu

SEQ ID NO: 212436 - RNA, 32 nt, Human
gugcuucugagcugagguugcuucacgggacc

SEQ ID NO: 212437 - RNA, 32 nt, Human
gugcuucugcaccgggcgucccugcaucugac

SEQ ID NO: 212438 - RNA, 32 nt, Human
gugcuucugccuggcuggccagaaugcacguu

SEQ ID NO: 212439 - RNA, 32 nt, Human
gugcuucugggcagugcaggcggcugccaggc

SEQ ID NO: 212440 - RNA, 32 nt, Human
gugcuucugggguguucuguuucuugaucugg

SEQ ID NO: 212441 - RNA, 20 nt, Human
gugcuucuguggcccccagc

SEQ ID NO: 212442 - RNA, 32 nt, Human
gugcuucuguucagguugcacacugggccaca

SEQ ID NO: 212443 - RNA, 21 nt, Human
gugcuucuuauaccugaugca

SEQ ID NO: 212444 - RNA, 32 nt, Human
gugcuucuuuacuauaucacugccuucuuuua

SEQ ID NO: 212445 - RNA, 32 nt, Human
gugcuucuuuucuaacccaaaacaguucuacu

SEQ ID NO: 212446 - RNA, 32 nt, Human
gugcuugaacccaggaggcggagguuguggug

SEQ ID NO: 212447 - RNA, 32 nt, Human
gugcuugaagccccaggacccccgagagagcc

SEQ ID NO: 212448 - RNA, 32 nt, Human
gugcuugacagauuuucagccaugaccauguu

SEQ ID NO: 212449 - RNA, 32 nt, Human
gugcuugacuccuggaaccugccugcucccuc

SEQ ID NO: 212450 - RNA, 32 nt, Human
gugcuugagauguaggaaucugugcauucuau

SEQ ID NO: 212451 - RNA, 32 nt, Human
gugcuugagcuuuuaaccagguacugucuaac

SEQ ID NO: 212452 - RNA, 32 nt, Human
gugcuugagggaggaggaagagauagaggagg

SEQ ID NO: 212453 - RNA, 32 nt, Human
gugcuugaggguggcugggaaugugauauaca

SEQ ID NO: 212454 - RNA, 19 nt, Human
gugcuugagugccugguga

SEQ ID NO: 212455 - RNA, 19 nt, Human
guggguauaucuucuguga

SEQ ID NO: 212456 - RNA, 32 nt, Human
guggguaugcauauaacaggugucuggccagu

SEQ ID NO: 212457 - RNA, 32 nt, Human
guggguaugguggcucacaccuguaaucccaa

SEQ ID NO: 212458 - RNA, 32 nt, Human
guggguauguauguguguauguauguauccgc

SEQ ID NO: 212459 - RNA, 32 nt, Human
guggguaugucugaggucagccauggggauau

SEQ ID NO: 212460 - RNA, 32 nt, Human
gugggucaaaggacaauaugggugggcauucu

SEQ ID NO: 212461 - RNA, 22 nt, Human
gugggucacgccuguaauccca

SEQ ID NO: 212462 - RNA, 32 nt, Human
gugggucacuugaacccaggaguuugacauca

SEQ ID NO: 212463 - RNA, 31 nt, Human
gugggucagagaguuuuuaugggggucuguu

SEQ ID NO: 212464 - RNA, 32 nt, Human
gugggucagagcaguggaggggagacaucgcc

SEQ ID NO: 212465 - RNA, 32 nt, Human
gugggucagaggcagagauggaaguuggaaug

SEQ ID NO: 212466 - RNA, 21 nt, Human
gugggucaggccuggcccagg

SEQ ID NO: 212467 - RNA, 32 nt, Human
gugggucaggcuccugagggccccaggcucca

SEQ ID NO: 212468 - RNA, 32 nt, Human
gugggucagggaggggucuagaggcuauuccu

SEQ ID NO: 212469 - RNA, 32 nt, Human
gugggucaggguggagguccugggugggcuaa

SEQ ID NO: 212470 - RNA, 32 nt, Human
gugggucauaccguguaccucaguucccucuu

SEQ ID NO: 212471 - RNA, 32 nt, Human
gugggucauuccuggugcaauugugauuuuuc

SEQ ID NO: 212472 - RNA, 32 nt, Human
guggguccagagcaucugucagaucuguggcu

SEQ ID NO: 212473 - RNA, 32 nt, Human
guggguccaggccaggagaugggggcgggggc

SEQ ID NO: 212474 - RNA, 32 nt, Human
gugggucccaacaccgagcagcccacagucuc

SEQ ID NO: 212475 - RNA, 32 nt, Human
gugggucccagagaccucaucagccuugggau

SEQ ID NO: 212476 - RNA, 32 nt, Human
gugggucccagccugggagccugcugucagga

SEQ ID NO: 212477 - RNA, 32 nt, Human
gugggucccaggauggaggagccccaggccgg

SEQ ID NO: 212478 - RNA, 32 nt, Human
gugggucccuggaaagggggagaguugcccuu

SEQ ID NO: 212479 - RNA, 32 nt, Human
gugggucccugggcucuggacaagcacugggg

SEQ ID NO: 212480 - RNA, 32 nt, Human
guggguccugcaguggucucguggguauuacu

SEQ ID NO: 212481 - RNA, 32 nt, Human
gugggucgggcagagucggaagaacuggcuuu

SEQ ID NO: 212482 - RNA, 32 nt, Human
gugggucuaaagagagacggagucuagcucuc

SEQ ID NO: 212483 - RNA, 32 nt, Human
gugggucuauaauaauuguauuuucaagaggu

SEQ ID NO: 212484 - RNA, 32 nt, Human
gugggucucacagaugcuggagcagguguagg

SEQ ID NO: 212485 - RNA, 32 nt, Human
gugggucuccaccacagccacuuugagucugu

SEQ ID NO: 212486 - RNA, 32 nt, Human
gugggucuccaggggcuugggaaauguguucu

SEQ ID NO: 212487 - RNA, 32 nt, Human
gugggucuccauccuccaugggggcucagcca

SEQ ID NO: 212488 - RNA, 32 nt, Human
gugggucuccggccuuagcacacacaccuuga

SEQ ID NO: 212489 - RNA, 32 nt, Human
gugggucucugcggcacucuucugccugguga

SEQ ID NO: 212490 - RNA, 32 nt, Human
gugggucugcaccagguacuccaggccagccc

SEQ ID NO: 212491 - RNA, 32 nt, Human
gugggucuuggaccagggcaagugcaucuuug

SEQ ID NO: 212492 - RNA, 32 nt, Human
gugggucuuuucuuugcuucugaccacacguc

SEQ ID NO: 212493 - RNA, 32 nt, Human
gugggugaaagcuggcuggagacuccuggccu

SEQ ID NO: 212494 - RNA, 32 nt, Human
gugggugaaccugagcucucccaggagacaac

SEQ ID NO: 212495 - RNA, 32 nt, Human
gugggugaagccagggagggagacaggagggc

SEQ ID NO: 212496 - RNA, 24 nt, Human
gugggugaaucaccugaggucagg

SEQ ID NO: 212497 - RNA, 24 nt, Human
gugggugaauugcuugaggucagg

SEQ ID NO: 212498 - RNA, 32 nt, Human
gugggugagagggaagaaggggagguuggggg

SEQ ID NO: 212499 - RNA, 32 nt, Human
gugggugaggacaggcuucaggcugucucuuc

SEQ ID NO: 212500 - RNA, 32 nt, Human
gugggugaggaugugguuuaggaggauggggg

SEQ ID NO: 212501 - RNA, 32 nt, Human
gugggugaggcugccccucccuccaggucccg

SEQ ID NO: 212502 - RNA, 32 nt, Human
gugggugaucagaaggcuggggccaguguaag

SEQ ID NO: 212503 - RNA, 32 nt, Human
gugggugauggacacagacauggggcuguuag

SEQ ID NO: 212504 - RNA, 32 nt, Human
gugggugauuccucccaggaggugcuugaggc

SEQ ID NO: 212505 - RNA, 32 nt, Human
gugggugauucucugcccugagccaccacccu

SEQ ID NO: 212506 - RNA, 32 nt, Human
gugggugcaauggcgucuuaugacucucagaa

SEQ ID NO: 212507 - RNA, 32 nt, Human
gugggugcacacaaagcaagcaccaucuggga

SEQ ID NO: 212508 - RNA, 32 nt, Human
gugggugcaguggcucacgccuguaaucccag

SEQ ID NO: 212509 - RNA, 21 nt, Human
gugggugccaccaggcccagg

SEQ ID NO: 212510 - RNA, 32 nt, Human
gugggugccaucauggucuccgggaccugggc

SEQ ID NO: 212511 - RNA, 32 nt, Human
gugggugcccgaagguugcaugauggaauuug

SEQ ID NO: 212512 - RNA, 32 nt, Human
gugggugcccuugagcauguugcaacgccugc

SEQ ID NO: 212513 - RNA, 32 nt, Human
gugggugccuagugaggcuggagcuagaaagc

SEQ ID NO: 212514 - RNA, 32 nt, Human
gugggugccuguaaccucagcuacuugggagg

SEQ ID NO: 212515 - RNA, 19 nt, Human
gugggugccuguaauccca

SEQ ID NO: 212516 - RNA, 32 nt, Human
gugggugccuguaaucccagcuacucgggaga

SEQ ID NO: 212517 - RNA, 32 nt, Human
gugggugccuguaaucccagcuacucgggagg

SEQ ID NO: 212518 - RNA, 32 nt, Human
gugggugccuguaaucccagcuacuugggaag

SEQ ID NO: 212519 - RNA, 32 nt, Human
gugggugccuguaaucccagcuacuugggagg

SEQ ID NO: 212520 - RNA, 19 nt, Human
gugggugccuguaauccua

SEQ ID NO: 212521 - RNA, 19 nt, Human
gugggugccuguaaucuca

SEQ ID NO: 212522 - RNA, 32 nt, Human
gugggugccuguaaucucagcuacucgggagg

SEQ ID NO: 212523 - RNA, 19 nt, Human
gugggugccuguaauucca

SEQ ID NO: 212524 - RNA, 19 nt, Human
gugggugccuguaguccca

SEQ ID NO: 212525 - RNA, 32 nt, Human
gugggugccuguagucccagcuacucgggagg

SEQ ID NO: 212526 - RNA, 32 nt, Human
gugggugccuguagucccagcuacucuggagg

SEQ ID NO: 212527 - RNA, 32 nt, Human
gugggugccuguagucccagcuacuugggagg

SEQ ID NO: 212528 - RNA, 32 nt, Human
gugggugccuuugccucucccugcugcccccg

SEQ ID NO: 212529 - RNA, 32 nt, Human
gugggugcggccuuaaaagugacuaucuagac

SEQ ID NO: 212530 - RNA, 32 nt, Human
gugggugcggucuccccucuccaaaugccacc

SEQ ID NO: 212531 - RNA, 32 nt, Human
gugggugcgguggcuuacaccuguaaucccaa

SEQ ID NO: 212532 - RNA, 32 nt, Human
gugggugcuacuugcaaggccauagaaucuag

SEQ ID NO: 212533 - RNA, 32 nt, Human
gugggugcucacugaauauaguggacuaguga

SEQ ID NO: 212534 - RNA, 32 nt, Human
gugggugcucgggaguggaggugacgucagca

SEQ ID NO: 212535 - RNA, 18 nt, Human
gugggugcucuggccaca

SEQ ID NO: 212536 - RNA, 32 nt, Human
gugggugcuggcugagccccuggggcagaagg

SEQ ID NO: 212537 - RNA, 32 nt, Human
gugggugcuuguaguuccagcuacucaggagg

SEQ ID NO: 212538 - RNA, 24 nt, Human
guggguggaccaccugagaucagg

SEQ ID NO: 212539 - RNA, 24 nt, Human
guggguggaccaccugagguuagg

SEQ ID NO: 212540 - RNA, 24 nt, Human
guggguggaccacuugaggccagg

SEQ ID NO: 212541 - RNA, 32 nt, Human
guggguggacccucaggucugcagaggacuuc

SEQ ID NO: 212542 - RNA, 22 nt, Human
guggguggaccgcuugagucca

SEQ ID NO: 212543 - RNA, 23 nt, Human
guggguggaccuaacugcccagg

SEQ ID NO: 212544 - RNA, 32 nt, Human
guggguggacuagaagcauuugggaguagugg

SEQ ID NO: 212545 - RNA, 23 nt, Human
guggguggagaggugagcccagg

SEQ ID NO: 212546 - RNA, 32 nt, Human
guggguggagcaucagcguuugcucaguuaag

SEQ ID NO: 212547 - RNA, 32 nt, Human
guggguggagccugacccuggagggcacugag

SEQ ID NO: 212548 - RNA, 32 nt, Human
guggguggagggagggagaucaugagggacuu

SEQ ID NO: 212549 - RNA, 19 nt, Human
guggguggauaacuugaga

SEQ ID NO: 212550 - RNA, 22 nt, Human
guggguggaucacaaggucagg

SEQ ID NO: 212551 - RNA, 21 nt, Human
guggguggaucacaagucagg

SEQ ID NO: 212552 - RNA, 21 nt, Human
guggguggaucacaggucagg

SEQ ID NO: 212553 - RNA, 24 nt, Human
guggguggaucaccagaggucagg

SEQ ID NO: 212554 - RNA, 22 nt, Human
guggguggaucaccaggucagg

SEQ ID NO: 212555 - RNA, 24 nt, Human
guggguggaucaccugaagucagg

SEQ ID NO: 212556 - RNA, 24 nt, Human
guggguggaucaccugagaucagg

SEQ ID NO: 212557 - RNA, 24 nt, Human
guggguggaucaccugagggcagg

SEQ ID NO: 212558 - RNA, 23 nt, Human
guggguggaucaccugaggucag

SEQ ID NO: 212559 - RNA, 24 nt, Human
guggguggaucaccugaggucagg

SEQ ID NO: 212560 - RNA, 24 nt, Human
guggguggaucaccugagguccgg

SEQ ID NO: 212561 - RNA, 24 nt, Human
guggguggaucaccugaggucggg

SEQ ID NO: 212562 - RNA, 24 nt, Human
guggguggaucaccugagguuagg

SEQ ID NO: 212563 - RNA, 22 nt, Human
guggguggaucacgugagguca

SEQ ID NO: 212564 - RNA, 24 nt, Human
guggguggaucacucaaguccagg

SEQ ID NO: 212565 - RNA, 22 nt, Human
guggguggaucacugggucagg

SEQ ID NO: 212566 - RNA, 24 nt, Human
guggguggaucacuugaagccagg

SEQ ID NO: 212567 - RNA, 24 nt, Human
guggguggaucacuugacgucagg

SEQ ID NO: 212568 - RNA, 18 nt, Human
guggguggaucacuugag

SEQ ID NO: 212569 - RNA, 24 nt, Human
guggguggaucacuugagcccagg

SEQ ID NO: 212570 - RNA, 19 nt, Human
guggguggaucacuugagg

SEQ ID NO: 212571 - RNA, 24 nt, Human
guggguggaucacuugaggccagg

SEQ ID NO: 212572 - RNA, 24 nt, Human
guggguggaucacuugaggccggg

SEQ ID NO: 212573 - RNA, 24 nt, Human
guggguggaucacuugaggucagg

SEQ ID NO: 212574 - RNA, 24 nt, Human
guggguggaucacuugaggucggg

SEQ ID NO: 212575 - RNA, 24 nt, Human
guggguggaucacuugaguucagg

SEQ ID NO: 212576 - RNA, 24 nt, Human
guggguggaucacuuggggucagg

SEQ ID NO: 212577 - RNA, 24 nt, Human
guggguggaucauuugaggccagg

SEQ ID NO: 212578 - RNA, 24 nt, Human
guggguggaucgccugagaucagg

SEQ ID NO: 212579 - RNA, 24 nt, Human
guggguggaucgccugagaucggg

SEQ ID NO: 212580 - RNA, 24 nt, Human
guggguggaucgccugaggucggg

SEQ ID NO: 212581 - RNA, 32 nt, Human
guggguggaucgcuugagcucaggaguucaag

SEQ ID NO: 212582 - RNA, 24 nt, Human
guggguggaucgcuugagggcagg

SEQ ID NO: 212583 - RNA, 24 nt, Human
guggguggauuaccugacgucagg

SEQ ID NO: 212584 - RNA, 24 nt, Human
guggguggauuacuugaggucagg

SEQ ID NO: 212585 - RNA, 24 nt, Human
guggguggauugcccgcgcucagg

SEQ ID NO: 212586 - RNA, 24 nt, Human
guggguggauugcuugaaaccagg

SEQ ID NO: 212587 - RNA, 24 nt, Human
guggguggauugcuugagcccagg

SEQ ID NO: 212588 - RNA, 22 nt, Human
guggguggauugcuugagucua

SEQ ID NO: 212589 - RNA, 32 nt, Human
guggguggcagcuguacaccuccaggguggag

SEQ ID NO: 212590 - RNA, 32 nt, Human
guggguggcucauacguguaaucccaguacuu

SEQ ID NO: 212591 - RNA, 32 nt, Human
gugggugggaggauucgugagcugcacacaga

SEQ ID NO: 212592 - RNA, 32 nt, Human
gugggugggccuggcccugcuuucuacgccaa

SEQ ID NO: 212593 - RNA, 32 nt, Human
gugggugggcgguucuagcucuucccacccuc

SEQ ID NO: 212594 - RNA, 32 nt, Human
gugggugggcuucucaggcaggaggacaucuu

SEQ ID NO: 212595 - RNA, 32 nt, Human
guggguggggaccugugucagguguggauagc

SEQ ID NO: 212596 - RNA, 23 nt, Human
guggguggggaggugugcuuuag

SEQ ID NO: 212597 - RNA, 26 nt, Human
guggguggggcagugcuuggcccagg

SEQ ID NO: 212598 - RNA, 32 nt, Human
gugggugggggaagcagacaggagaacacucg

SEQ ID NO: 212599 - RNA, 24 nt, Human
gugggugggucacuugaacccagg

SEQ ID NO: 212600 - RNA, 21 nt, Human
gugggugggucggagcccagg

SEQ ID NO: 212601 - RNA, 32 nt, Human
gugggugggugugacagcaggagcauugccau

SEQ ID NO: 212602 - RNA, 32 nt, Human
guggguggguugcuugagcucaggaguuugag

SEQ ID NO: 212603 - RNA, 32 nt, Human
guggguggguuugggcaucugugccccuggug

SEQ ID NO: 212604 - RNA, 32 nt, Human
guggguggucaggagagaaggccugauaggag

SEQ ID NO: 212605 - RNA, 32 nt, Human
guggguggugcugaagucuggggagugaguuu

SEQ ID NO: 212606 - RNA, 32 nt, Human
gugggugguggaggcugcgagggugcacggcc

SEQ ID NO: 212607 - RNA, 32 nt, Human
gugggugguggaguaggggugggaguggagag

SEQ ID NO: 212608 - RNA, 32 nt, Human
gugggugguggaguggcagggagugcugagug

SEQ ID NO: 212609 - RNA, 32 nt, Human
guggguguaauugguaguguucugucccucca

SEQ ID NO: 212610 - RNA, 19 nt, Human
gugggugucuguaauccca

SEQ ID NO: 212611 - RNA, 32 nt, Human
gugggugugauacugauguguaggcacuuuua

SEQ ID NO: 212612 - RNA, 32 nt, Human
guggguguggccugggguggcucagggcugga

SEQ ID NO: 212613 - RNA, 32 nt, Human
guggguguggcggagcgcgcggugcauggaau

SEQ ID NO: 212614 - RNA, 32 nt, Human
gugggugugggauggggaggggagaguggaaa

SEQ ID NO: 212615 - RNA, 32 nt, Human
guggguguggguggaagggcugggugucgaaa

SEQ ID NO: 212616 - RNA, 32 nt, Human
guggguguguuucggacuggccugggcaggcg

SEQ ID NO: 212617 - RNA, 32 nt, Human
guggguguuccuucgagccccuuccacucaga

SEQ ID NO: 212618 - RNA, 31 nt, Human
guggguguugccuuccauccugugucucuuu

SEQ ID NO: 212619 - RNA, 32 nt, Human
guggguguuguugccuuccucugucugacagg

SEQ ID NO: 212620 - RNA, 32 nt, Human
guggguguuugagagacaugaagaggggagga

SEQ ID NO: 212621 - RNA, 32 nt, Human
guggguuaagagaacuugcagacuggauaugc

SEQ ID NO: 212622 - RNA, 32 nt, Human
guggguucagggugagggcaauuuguaagcuc

SEQ ID NO: 212623 - RNA, 32 nt, Human
guggguucauuucuggacucccuauucuauuc

SEQ ID NO: 212624 - RNA, 32 nt, Human
guggguucccugggccaagaccagccuuuuua

SEQ ID NO: 212625 - RNA, 32 nt, Human
guggguuccugcuggccagggugcagccuuga

SEQ ID NO: 212626 - RNA, 32 nt, Human
guggguuccuucagguuccuugccaacccucc

SEQ ID NO: 212627 - RNA, 32 nt, Human
guggguucgagguggaggcugcagcugaaggu

SEQ ID NO: 212628 - RNA, 32 nt, Human
guggguucuaacuuaaguuccagaccagcuag

SEQ ID NO: 212629 - RNA, 32 nt, Human
guggguugagggugucuuguccgggcugccuu

SEQ ID NO: 212630 - RNA, 32 nt, Human
guggguugggguccccuggagcaggcaggauu

SEQ ID NO: 212631 - RNA, 32 nt, Human
guggguuggggugcauucaguaguccaucuuu

SEQ ID NO: 212632 - RNA, 32 nt, Human
guggguugugacugcuuuugggggagccuggg

SEQ ID NO: 212633 - RNA, 32 nt, Human
guggguugugagugcugguaaugaggagccgu

SEQ ID NO: 212634 - RNA, 22 nt, Human
guggguugugccuguaauccca

SEQ ID NO: 212635 - RNA, 32 nt, Human
guggguuuagucagggcuucuggauccucggu

SEQ ID NO: 212636 - RNA, 22 nt, Human
guggguuucacuauguuggcca

SEQ ID NO: 212637 - RNA, 32 nt, Human
guggguuuccuggauggaugugaaguugggcc

SEQ ID NO: 212638 - RNA, 32 nt, Human
guggguuuccugggcauggggacuggcugccu

SEQ ID NO: 212639 - RNA, 32 nt, Human
guggguuuggcaagaaagaagcaacacagaug

SEQ ID NO: 212640 - RNA, 32 nt, Human
guggguuuguaccuuccuuaagccaggaaagg

SEQ ID NO: 212641 - RNA, 32 nt, Human
guggguuugucacauacgccacuguggaggag

SEQ ID NO: 212642 - RNA, 32 nt, Human
guggguuuucuguuugaaaaggagucauggca

SEQ ID NO: 212643 - RNA, 32 nt, Human
guggguuuucuuuccuuuuuguuuuugguggu

SEQ ID NO: 212644 - RNA, 32 nt, Human
guggguuuuggaauguguguucccggcugugu

SEQ ID NO: 212645 - RNA, 32 nt, Human
guggguuuugugaaagagagcuagcuggcggu

SEQ ID NO: 212646 - RNA, 32 nt, Human
gugguaaaaauuaggcuucuaagaaaggaugg

SEQ ID NO: 212647 - RNA, 32 nt, Human
gugguaaaacccagaaagcauccaucaugaau

SEQ ID NO: 212648 - RNA, 32 nt, Human
gugguaaacaaagacaugggauuuucuuacau

SEQ ID NO: 212649 - RNA, 32 nt, Human
gugguaaaguaguuuggccuguucacaacuua

SEQ ID NO: 212650 - RNA, 32 nt, Human
gugguaacugggaacaauuuuccccaauacag

SEQ ID NO: 212651 - RNA, 32 nt, Human
gugguaacuucuuugaaguuauuuagaaauau

SEQ ID NO: 212652 - RNA, 32 nt, Human
gugguaagaaagcagacuggccagggacuuug

SEQ ID NO: 212653 - RNA, 32 nt, Human
gugguaagccuggguaaagagaaggaacugcg

SEQ ID NO: 212654 - RNA, 32 nt, Human
gugguaaggaauagaaucaaagaggggaguga

SEQ ID NO: 212655 - RNA, 32 nt, Human
gugguaaggauucuugaaaaguggguaagauc

SEQ ID NO: 212656 - RNA, 32 nt, Human
gugguaagggcgaugagugugggccgggcggg

SEQ ID NO: 212657 - RNA, 32 nt, Human
gugguaagucuccaggaggagcccagggcccu

SEQ ID NO: 212658 - RNA, 32 nt, Human
gugguaauauggcaagccuuguuccuuucugc

SEQ ID NO: 212659 - RNA, 32 nt, Human
gugguaauuuuccuccucggccccuauucugg

SEQ ID NO: 212660 - RNA, 22 nt, Human
gugguacacaccuguaauccca

SEQ ID NO: 212661 - RNA, 32 nt, Human
gugguacaccuacaggcuggaguguaaaaugg

SEQ ID NO: 212662 - RNA, 22 nt, Human
gugguacacgccuauaauccca

SEQ ID NO: 212663 - RNA, 22 nt, Human
gugguacacgccuguaauccca

SEQ ID NO: 212664 - RNA, 32 nt, Human
gugguacaggggauuggaaacaugcuccgcgc

SEQ ID NO: 212665 - RNA, 32 nt, Human
gugguaccaauuauaucaucucagucuugaau

SEQ ID NO: 212666 - RNA, 32 nt, Human
gugguaccgauuauaccaucucagucuugaau

SEQ ID NO: 212667 - RNA, 32 nt, Human
gugguaccgauuauaucaucucagucuugaau

SEQ ID NO: 212668 - RNA, 32 nt, Human
gugguaccggggacaggauugcgagggggacc

SEQ ID NO: 212669 - RNA, 32 nt, Human
gugguaccugcucccgguggcccugaggacgu

SEQ ID NO: 212670 - RNA, 32 nt, Human
gugguacuucacccucuucugcccucauuuca

SEQ ID NO: 212671 - RNA, 32 nt, Human
gugguagaaacaaacuccauuacucugauuuu

SEQ ID NO: 212672 - RNA, 32 nt, Human
gugguagaaaggaugcugcugaggcagcugga

SEQ ID NO: 212673 - RNA, 32 nt, Human
gugguagaaaugcaggcuuuaugggcauaaag

SEQ ID NO: 212674 - RNA, 32 nt, Human
gugguagaagcaguagucacuuuuguaagcca

SEQ ID NO: 212675 - RNA, 32 nt, Human
gugguagagggaugaggagaggagaacagagg

SEQ ID NO: 212676 - RNA, 32 nt, Human
gugguagcccuuugccuuucaugcccaugcuu

SEQ ID NO: 212677 - RNA, 22 nt, Human
gugguagcucaugccuguaauc

SEQ ID NO: 212678 - RNA, 32 nt, Human
gugguaggaagugguacugaucaaugauggcc

SEQ ID NO: 212679 - RNA, 32 nt, Human
gugguaggaccggaugcugggccaugucaaga

SEQ ID NO: 212680 - RNA, 32 nt, Human
gugguaggacucuggaagaggccacacacccg

SEQ ID NO: 212681 - RNA, 32 nt, Human
gugguaggacuuugguguggguggugagaaau

SEQ ID NO: 212682 - RNA, 32 nt, Human
gugguaggccaguuccagauaguuucauuuca

SEQ ID NO: 212683 - RNA, 32 nt, Human
gugguaggccauuauuuucauuuucauuuuug

SEQ ID NO: 212684 - RNA, 32 nt, Human
gugguaggcgccugacagaugcuugucugaug

SEQ ID NO: 212685 - RNA, 32 nt, Human
gugguaggcuggugaaaacuugacagcuagac

SEQ ID NO: 212686 - RNA, 32 nt, Human
gugguagggacaagcagugaggugguggccau

SEQ ID NO: 212687 - RNA, 32 nt, Human
gugguagggcuggcacuuauuucuuccaucug

SEQ ID NO: 212688 - RNA, 32 nt, Human
gugguagggggagaaggaggagcuggaggagg

SEQ ID NO: 212689 - RNA, 32 nt, Human
gugguagucccagcuacucaggaggcugaggu

SEQ ID NO: 212690 - RNA, 32 nt, Human
gugguaguccuugccuguagauauuuuuaaug

SEQ ID NO: 212691 - RNA, 32 nt, Human
gugguagugaagccagaaucucagggccaggc

SEQ ID NO: 212692 - RNA, 32 nt, Human
gugguagugagcugaucauccacuuucuucua

SEQ ID NO: 212693 - RNA, 22 nt, Human
gugguauagacugaacagugug

SEQ ID NO: 212694 - RNA, 22 nt, Human
gugguauaggcuggcugguaug

SEQ ID NO: 212695 - RNA, 32 nt, Human
gugguauauguguacacacauacacagggugg

SEQ ID NO: 212696 - RNA, 32 nt, Human
gugguaucccagggucccugcucaaguuuucu

SEQ ID NO: 212697 - RNA, 32 nt, Human
gugguaucuaaccaggcucugccaaucagugc

SEQ ID NO: 212698 - RNA, 32 nt, Human
gugguaucucugcagccuuccccagcgugaau

SEQ ID NO: 212699 - RNA, 31 nt, Human
gugguaucuuuuuuccacagcaguguuccau

SEQ ID NO: 212700 - RNA, 22 nt, Human
gugguaugcuuagcauuuucua

SEQ ID NO: 212701 - RNA, 22 nt, Human
gugguauggaaaagccugcaug

SEQ ID NO: 212702 - RNA, 23 nt, Human
gugguaugggagagcaaaaggca

SEQ ID NO: 212703 - RNA, 32 nt, Human
gugguaugggcugugguccuggagucaucacu

SEQ ID NO: 212704 - RNA, 32 nt, Human
gugguauguacucacaaagauuaagaaagaaa

SEQ ID NO: 212705 - RNA, 22 nt, Human
gugguaugugccuguaauccca

SEQ ID NO: 212706 - RNA, 32 nt, Human
gugguauugauaauagcuacuuacucaaaacu

SEQ ID NO: 212707 - RNA, 32 nt, Human
guggucaacaugguguaaccccaucucuacua

SEQ ID NO: 212708 - RNA, 32 nt, Human
guggucaagcacucgggaaaccuggggcuaau

SEQ ID NO: 212709 - RNA, 32 nt, Human
guggucacaccacuguauuccagccuggguga

SEQ ID NO: 212710 - RNA, 32 nt, Human
guggucacagauggcaucuaggaaaagaccaa

SEQ ID NO: 212711 - RNA, 32 nt, Human
guggucacaggggacccucacucuccauugug

SEQ ID NO: 212712 - RNA, 32 nt, Human
guggucacaguguggcauuccgaguuggggcg

SEQ ID NO: 212713 - RNA, 17 nt, Human
guggucacccaucuucu

SEQ ID NO: 212714 - RNA, 22 nt, Human
guggucacgugggcagcuucug

SEQ ID NO: 212715 - RNA, 21 nt, Human
guggucacuaacaggucacuu

SEQ ID NO: 212716 - RNA, 32 nt, Human
guggucacuagugcccuucccaaggcaaguca

SEQ ID NO: 212717 - RNA, 19 nt, Human
guggucacucccauuuccu

SEQ ID NO: 212718 - RNA, 20 nt, Human
guggucacucccugcuccug

SEQ ID NO: 212719 - RNA, 22 nt, Human
guggucacugaccucauuuccu

SEQ ID NO: 212720 - RNA, 32 nt, Human
guggucacugcaaccuccaucucccuggcuca

SEQ ID NO: 212721 - RNA, 32 nt, Human
guggucacugcacuccagccuggcuacagagu

SEQ ID NO: 212722 - RNA, 21 nt, Human
guggucacugcguacgcucuu

SEQ ID NO: 212723 - RNA, 32 nt, Human
guggucacugugcugcucugcagaguuacuuc

SEQ ID NO: 212724 - RNA, 20 nt, Human
guggucacuguucucuucua

SEQ ID NO: 212725 - RNA, 21 nt, Human
guggucacuguugagaucucc

SEQ ID NO: 212726 - RNA, 32 nt, Human
guggucacuugcuucaccuccaccaccauccc

SEQ ID NO: 212727 - RNA, 22 nt, Human
guggucacuuggcgauuuugua

SEQ ID NO: 212728 - RNA, 19 nt, Human
guggucacuuuucuuccua

SEQ ID NO: 212729 - RNA, 22 nt, Human
guggucagcaggcaaucuccug

SEQ ID NO: 212730 - RNA, 32 nt, Human
guggucagccaagaauagaggucauauaguug

SEQ ID NO: 212731 - RNA, 32 nt, Human
guggucagcccaagccauccaccaccagcucc

SEQ ID NO: 212732 - RNA, 32 nt, Human
guggucagcccgccucggccucccagagugcu

SEQ ID NO: 212733 - RNA, 21 nt, Human
guggucagcugggaucuucug

SEQ ID NO: 212734 - RNA, 32 nt, Human
guggucaggaguuugagaccagccuggccaac

SEQ ID NO: 212735 - RNA, 32 nt, Human
guggucaggcagcuggagcagaaguggaaaug

SEQ ID NO: 212736 - RNA, 32 nt, Human
guggucaggccugggugugccaccugggucac

SEQ ID NO: 212737 - RNA, 32 nt, Human
guggucaggccuggguuggccaccugggucac

SEQ ID NO: 212738 - RNA, 32 nt, Human
guggucagguucagcaggcuccuggguaaaga

SEQ ID NO: 212739 - RNA, 32 nt, Human
guggucagguuucccccgaccuucccucaccc

SEQ ID NO: 212740 - RNA, 20 nt, Human
guggucauagaaucucucug

SEQ ID NO: 212741 - RNA, 32 nt, Human
guggucauagagcauuaaaccaaauaugaggc

SEQ ID NO: 212742 - RNA, 20 nt, Human
guggucaucauccucuccug

SEQ ID NO: 212743 - RNA, 21 nt, Human
guggucaucuacugccuucug

SEQ ID NO: 212744 - RNA, 32 nt, Human
guggucaugccuguaaucccagcauuuuggaa

SEQ ID NO: 212745 - RNA, 32 nt, Human
guggucauggcagaggaggaagaugagggcac

SEQ ID NO: 212746 - RNA, 32 nt, Human
guggucauuuuggaggaaguggaagccuaaga

SEQ ID NO: 212747 - RNA, 21 nt, Human
guggucauuuuuaucuuccua

SEQ ID NO: 212748 - RNA, 32 nt, Human
gugguccaaagccuucagccuagauggugcaa

SEQ ID NO: 212749 - RNA, 32 nt, Human
gugguccagacaguuuagcagaacagccuccg

SEQ ID NO: 212750 - RNA, 32 nt, Human
gugguccagcagaggcgcugggugggagggca

SEQ ID NO: 212751 - RNA, 32 nt, Human
gugguccagggaaguuaguccucuggccucaa

SEQ ID NO: 212752 - RNA, 32 nt, Human
gugguccagguuggccacagacagcuuagaag

SEQ ID NO: 212753 - RNA, 32 nt, Human
guggucccagcacuuugggaggcugagguggg

SEQ ID NO: 212754 - RNA, 32 nt, Human
guggucccagccuggagcugugccagccugac

SEQ ID NO: 212755 - RNA, 32 nt, Human
gugguccccaggaguccugaacaucuggggac

SEQ ID NO: 212756 - RNA, 32 nt, Human
guggucccccaucccuguggcuggugauccug

SEQ ID NO: 212757 - RNA, 32 nt, Human
gugguccccucaagcauccucaguuccucuug

SEQ ID NO: 212758 - RNA, 32 nt, Human
guggucccggcugcuuggaaggcugaggcggg

SEQ ID NO: 212759 - RNA, 32 nt, Human
guggucccggugagcugggcugugcuuacacc

SEQ ID NO: 212760 - RNA, 32 nt, Human
guggucccuccagcggaccagggaagggguca

SEQ ID NO: 212761 - RNA, 32 nt, Human
guggucccucccugggcuccaggggccucugg

SEQ ID NO: 212762 - RNA, 32 nt, Human
guggucccugaggagcauuacacugagaaguu

SEQ ID NO: 212763 - RNA, 32 nt, Human
guggucccugcagaggggcuccaggcugguga

SEQ ID NO: 212764 - RNA, 32 nt, Human
guggucccugcugaaacccccacgccuccgcu

SEQ ID NO: 212765 - RNA, 32 nt, Human
guggucccugcuuuucugaguaccauguuucc

SEQ ID NO: 212766 - RNA, 32 nt, Human
guggucccuggggauggggcggcgguagcagc

SEQ ID NO: 212767 - RNA, 32 nt, Human
guggucccugucucccuucuuguacaauccag

SEQ ID NO: 212768 - RNA, 32 nt, Human
gugguccgcccgccccggccucccagagugcu

SEQ ID NO: 212769 - RNA, 26 nt, Human
gugguccgggaguucaggauugcaug

SEQ ID NO: 212770 - RNA, 32 nt, Human
gugguccgggaguucaggauugcaugaaaaag

SEQ ID NO: 212771 - RNA, 32 nt, Human
gugguccuaaucaugguguugaugccagauuu

SEQ ID NO: 212772 - RNA, 32 nt, Human
gugguccucacaccuuacuauacacugagagu

SEQ ID NO: 212773 - RNA, 32 nt, Human
gugguccuccaaccuccaauacccaggccugg

SEQ ID NO: 212774 - RNA, 32 nt, Human
gugguccuccuccuccucacucuucuugcccc

SEQ ID NO: 212775 - RNA, 32 nt, Human
gugguccugagucaggagguugaggcugcagu

SEQ ID NO: 212776 - RNA, 32 nt, Human
gugguccugugcacguuggccucagauggacu

SEQ ID NO: 212777 - RNA, 27 nt, Human
gugguccuuccaacuuagugcaucccu

SEQ ID NO: 212778 - RNA, 32 nt, Human
gugguccuuccugccugagcccugcacugucc

SEQ ID NO: 212779 - RNA, 32 nt, Human
guggucgcccugcagugcaagcugcugcucca

SEQ ID NO: 212780 - RNA, 32 nt, Human
guggucgcccugcugguucuggcccugggacu

SEQ ID NO: 212781 - RNA, 32 nt, Human
guggucgccuaucuccuuccucugcucccugg

SEQ ID NO: 212782 - RNA, 20 nt, Human
guggucggauucgaccugga

SEQ ID NO: 212783 - RNA, 32 nt, Human
guggucgguuccaugaaaggcaaaggagugug

SEQ ID NO: 212784 - RNA, 32 nt, Human
guggucgucaucugggccauuugccuuacuuc

SEQ ID NO: 212785 - RNA, 32 nt, Human
guggucgugcugaggcaggagugggguugccc

SEQ ID NO: 212786 - RNA, 32 nt, Human
guggucuaaaaauaaucccagcacuuugggag

SEQ ID NO: 212787 - RNA, 32 nt, Human
guggucuaagcuccucccagggcuguguggau

SEQ ID NO: 212788 - RNA, 32 nt, Human
guggucuaaggcuugcaucaaucuagaugaac

SEQ ID NO: 212789 - RNA, 22 nt, Human
guggucuacacaguguucucua

SEQ ID NO: 212790 - RNA, 32 nt, Human
guggucuccgcaccucuccagcuccugcaccc

SEQ ID NO: 212791 - RNA, 32 nt, Human
guggucucgaauuccugaccucaguugagccg

SEQ ID NO: 212792 - RNA, 32 nt, Human
guggucucgccuucccuucuuccugcagguuc

SEQ ID NO: 212793 - RNA, 22 nt, Human
guggucucugaaugugccuucc

SEQ ID NO: 212794 - RNA, 32 nt, Human
guggucucuucaugcucuccccaucccaguuu

SEQ ID NO: 212795 - RNA, 32 nt, Human
guggucucuuugagaagaagcuguggggccua

SEQ ID NO: 212796 - RNA, 32 nt, Human
guggucugacccuucccucggugugggggaug

SEQ ID NO: 212797 - RNA, 32 nt, Human
guggucugccaggcccucgcuccugggguguc

SEQ ID NO: 212798 - RNA, 32 nt, Human
guggucugccccaggcauaaagaaggaaaauu

SEQ ID NO: 212799 - RNA, 32 nt, Human
guggucugcgucuucugccauuggcuugaacu

SEQ ID NO: 212800 - RNA, 32 nt, Human
guggucuguggaccagcagcggcagugacacc

SEQ ID NO: 212801 - RNA, 32 nt, Human
guggucuucaacuugaggacgagggugauuuu

SEQ ID NO: 212802 - RNA, 23 nt, Human
guggucuuccagagcgaccuccu

SEQ ID NO: 212803 - RNA, 32 nt, Human
guggucuucccccugcacuuuucugucuaauu

SEQ ID NO: 212804 - RNA, 21 nt, Human
guggucuuccuguggucuucc

SEQ ID NO: 212805 - RNA, 32 nt, Human
guggucuuccuugcuugacccucucuacucug

SEQ ID NO: 212806 - RNA, 32 nt, Human
guggucuugcagccuccaaaccccgagugcua

SEQ ID NO: 212807 - RNA, 32 nt, Human
guggucuugcccacuguccuuuugccuccaug

SEQ ID NO: 212808 - RNA, 32 nt, Human
guggucuuguguucugccugguggucuuucuu

SEQ ID NO: 212809 - RNA, 32 nt, Human
guggucuuuccuaucauggagugacgguccca

SEQ ID NO: 212810 - RNA, 32 nt, Human
guggugaacagcuccauuucugugcacauguu

SEQ ID NO: 212811 - RNA, 32 nt, Human
guggugaacucugaagauguuuccuggugaau

SEQ ID NO: 212812 - RNA, 32 nt, Human
guggugaagauggaacuguuaggugguuugau

SEQ ID NO: 212813 - RNA, 32 nt, Human
guggugaccucggccauuuuccaccucgccuu

SEQ ID NO: 212814 - RNA, 22 nt, Human
guggugacucaagccuauaauc

SEQ ID NO: 212815 - RNA, 22 nt, Human
guggugacucacaccuauaauc

SEQ ID NO: 212816 - RNA, 22 nt, Human
guggugacucacaccuguaauc

SEQ ID NO: 212817 - RNA, 22 nt, Human
guggugacucaugccuguaauc

SEQ ID NO: 212818 - RNA, 32 nt, Human
guggugacugggcugaggagaugcugggacug

SEQ ID NO: 212819 - RNA, 32 nt, Human
guggugagaacagaggaugaguugggucuguu

SEQ ID NO: 212820 - RNA, 32 nt, Human
guggugagaccaggggaaaggccagcucagag

SEQ ID NO: 212821 - RNA, 32 nt, Human
guggugagagcacacguccucgucucauuccu

SEQ ID NO: 212822 - RNA, 32 nt, Human
guggugagagcagccaccccugcuuuguuccc

SEQ ID NO: 212823 - RNA, 32 nt, Human
guggugagaguauaagcgaguuuauucuuuac

SEQ ID NO: 212824 - RNA, 32 nt, Human
guggugagaucaugccacuacacuccagccug

SEQ ID NO: 212825 - RNA, 32 nt, Human
guggugagcacaccauuugugcugcugcuguu

SEQ ID NO: 212826 - RNA, 19 nt, Human
guggugagcaccuguaauc

SEQ ID NO: 212827 - RNA, 32 nt, Human
guggugagccccggagaggagacgguggaggc

SEQ ID NO: 212828 - RNA, 32 nt, Human
guggugagcucuucccugccugggccuccccg

SEQ ID NO: 212829 - RNA, 32 nt, Human
guggugagcugguggcucucuggugagcuagu

SEQ ID NO: 212830 - RNA, 32 nt, Human
guggugaggccaguuucaugucuugugauuua

SEQ ID NO: 212831 - RNA, 32 nt, Human
guggugaggccgcggccccgggccggccagcc

SEQ ID NO: 212832 - RNA, 32 nt, Human
guggugaggccgugaagguggggacggugccu

SEQ ID NO: 212833 - RNA, 19 nt, Human
guggugaguggaagggagg

SEQ ID NO: 212834 - RNA, 32 nt, Human
guggugauacccagaccagcagucaccccagg

SEQ ID NO: 212835 - RNA, 32 nt, Human
guggugaucagucugcagcacagcgcagaagu

SEQ ID NO: 212836 - RNA, 32 nt, Human
guggugaucagucugcagcacagugcagaagu

SEQ ID NO: 212837 - RNA, 22 nt, Human
guggugaucguacugaugaagu

SEQ ID NO: 212838 - RNA, 32 nt, Human
guggugauuccaccccugcccaucacuggggg

SEQ ID NO: 212839 - RNA, 22 nt, Human
guggugcacaccuguaauccca

SEQ ID NO: 212840 - RNA, 22 nt, Human
guggugcacaccugugauccca

SEQ ID NO: 212841 - RNA, 22 nt, Human
guggugcacacguauaauccca

SEQ ID NO: 212842 - RNA, 32 nt, Human
guggugcacaggaguguuccaggccuuucacc

SEQ ID NO: 212843 - RNA, 22 nt, Human
guggugcaccccuguaauccca

SEQ ID NO: 212844 - RNA, 22 nt, Human
guggugcacgccuguaauccca

SEQ ID NO: 212845 - RNA, 32 nt, Human
guggugcacgugucuccaccuccaaggagagg

SEQ ID NO: 212846 - RNA, 22 nt, Human
guggugcacuccuguaauccca

SEQ ID NO: 212847 - RNA, 23 nt, Human
guggugcagacaggagcugugug

SEQ ID NO: 212848 - RNA, 32 nt, Human
guggugcagccccuggcaucucagacaugguu

SEQ ID NO: 212849 - RNA, 32 nt, Human
guggugcaggccuggcaccaggaggcuugcac

SEQ ID NO: 212850 - RNA, 32 nt, Human
guggugcaggcggggagccagagaaacuugcc

SEQ ID NO: 212851 - RNA, 32 nt, Human
guggugcaggggcacuucuaagugggcucuuu

SEQ ID NO: 212852 - RNA, 32 nt, Human
guggugcaguaagccaagaucacgccacugca

SEQ ID NO: 212853 - RNA, 32 nt, Human
guggugcagucuguuucuccccuagacucugg

SEQ ID NO: 212854 - RNA, 32 nt, Human
guggugcauccuguaaucauagcuacuuggga

SEQ ID NO: 212855 - RNA, 19 nt, Human
guggugcaugccuguaauc

SEQ ID NO: 212856 - RNA, 19 nt, Human
guggugcaugccuguaguc

SEQ ID NO: 212857 - RNA, 32 nt, Human
guggugccaacauacucauugcagccuugaac

SEQ ID NO: 212858 - RNA, 32 nt, Human
guggugccacacaccguugagguuggaguggg

SEQ ID NO: 212859 - RNA, 32 nt, Human
guggugccacagagccucaccgugccugagug

SEQ ID NO: 212860 - RNA, 32 nt, Human
guggugccacugcacuccaaccugggggacag

SEQ ID NO: 212861 - RNA, 32 nt, Human
guggugccacugcgcuccagccugggggaggg

SEQ ID NO: 212862 - RNA, 32 nt, Human
guggugccauaguuugucaucccugggucuag

SEQ ID NO: 212863 - RNA, 32 nt, Human
guggugccauuuccuuccccaucuucauguua

SEQ ID NO: 212864 - RNA, 32 nt, Human
guggugccauuuucucucucuuaagccccauu

SEQ ID NO: 212865 - RNA, 31 nt, Human
guggugcccguggaaagagggagaaagagaa

SEQ ID NO: 212866 - RNA, 32 nt, Human
guggugccuccaggaccgcugcgggugguaac

SEQ ID NO: 212867 - RNA, 32 nt, Human
guggugccuccccucugucucccuccugcucu

SEQ ID NO: 212868 - RNA, 32 nt, Human
guggugccucuccuggaaggaagcucuugcuu

SEQ ID NO: 212869 - RNA, 30 nt, Human
guggugccucuuguaucccuagugcuccau

SEQ ID NO: 212870 - RNA, 32 nt, Human
guggugccugauguuauaacaacaccucauuc

SEQ ID NO: 212871 - RNA, 32 nt, Human
guggugccuguaaucccagcaguuugggaggc

SEQ ID NO: 212872 - RNA, 32 nt, Human
guggugcgauccuugucuuccuccagugcugg

SEQ ID NO: 212873 - RNA, 22 nt, Human
guggugcgcaugccuguagucc

SEQ ID NO: 212874 - RNA, 32 nt, Human
guggugcgcucaauaaaaaugcuggaauucaa

SEQ ID NO: 212875 - RNA, 32 nt, Human
guggugcguccccaggccccugaggcccagcu

SEQ ID NO: 212876 - RNA, 32 nt, Human
guggugcgugccuguagccucagcuacucggg

SEQ ID NO: 212877 - RNA, 32 nt, Human
guggugcuagaagacagacaucuguggaauga

SEQ ID NO: 212878 - RNA, 21 nt, Human
guggugcucacgccuguaauc

SEQ ID NO: 212879 - RNA, 32 nt, Human
guggugcuccuguaacaguaagaacuaauucu

SEQ ID NO: 212880 - RNA, 32 nt, Human
guggugcugcaugucuguggcucaccuuuauu

SEQ ID NO: 212881 - RNA, 17 nt, Human
guggugcugccaggacu

SEQ ID NO: 212882 - RNA, 18 nt, Human
guggugcugccccgagug

SEQ ID NO: 212883 - RNA, 32 nt, Human
guggugcuugccaagggcugugcggagcuggu

SEQ ID NO: 212884 - RNA, 32 nt, Human
gugguggaaauggcaggagggugcagguacuc

SEQ ID NO: 212885 - RNA, 32 nt, Human
gugguggaacagcaaccggugccaccaggaga

SEQ ID NO: 212886 - RNA, 32 nt, Human
gugguggaaccagccccuccagccuggggucc

SEQ ID NO: 212887 - RNA, 32 nt, Human
gugguggaaggaugcugacauccaggcuggga

SEQ ID NO: 212888 - RNA, 32 nt, Human
gugguggacaaggagagcaccaugagcgccga

SEQ ID NO: 212889 - RNA, 32 nt, Human
gugguggacagagaguuccaaacaccucagcc

SEQ ID NO: 212890 - RNA, 32 nt, Human
gugguggaccugaccugcuccuggccccuugg

SEQ ID NO: 212891 - RNA, 32 nt, Human
gugguggacuauuuaacaaaacugaacaaugg

SEQ ID NO: 212892 - RNA, 32 nt, Human
gugguggagccagcaucucaccugccaggcuu

SEQ ID NO: 212893 - RNA, 32 nt, Human
gugguggagccccugagggcuuggugggguug

SEQ ID NO: 212894 - RNA, 32 nt, Human
gugguggaggaacuucaucccacugaauuccu

SEQ ID NO: 212895 - RNA, 32 nt, Human
gugguggaggaggaggaggaggaggaaggcaa

SEQ ID NO: 212896 - RNA, 32 nt, Human
gugguggaggcagccuucagugagcauggagg

SEQ ID NO: 212897 - RNA, 32 nt, Human
gugguggagguggauacagcagucggagacau

SEQ ID NO: 212898 - RNA, 32 nt, Human
gugguggaggugggguuggagcaggaagggaa

SEQ ID NO: 212899 - RNA, 32 nt, Human
gugguggagugaggacaggggagggccggccc

SEQ ID NO: 212900 - RNA, 32 nt, Human
gugguggauacucagcccugugagugcaauaa

SEQ ID NO: 212901 - RNA, 32 nt, Human
gugguggaucucagugccuaggggugccgagg

SEQ ID NO: 212902 - RNA, 22 nt, Human
gugguggauggaccugggcaga

SEQ ID NO: 212903 - RNA, 32 nt, Human
gugguggcacacaccaguaauccuggcuacuc

SEQ ID NO: 212904 - RNA, 32 nt, Human
gugguggcacacaccuguagucccagguacuu

SEQ ID NO: 212905 - RNA, 32 nt, Human
gugguggcagcaggaaggacacugccacaaau

SEQ ID NO: 212906 - RNA, 32 nt, Human
gugguggcagcagugauccucugaaccugcag

SEQ ID NO: 212907 - RNA, 32 nt, Human
gugguggcagcagugauccucuggccuggucc

SEQ ID NO: 212908 - RNA, 32 nt, Human
gugguggcagcgguaccgcuccccagcucacu

SEQ ID NO: 212909 - RNA, 32 nt, Human
gugguggcaggagcaaggagagagggaagaag

SEQ ID NO: 212910 - RNA, 32 nt, Human
gugguggcaggcaccuguaaucccagcuacuc

SEQ ID NO: 212911 - RNA, 32 nt, Human
gugguggcaggcaccuguaaucccagcuacuu

SEQ ID NO: 212912 - RNA, 32 nt, Human
gugguggcaggcaccuguagucccagcuaccc

SEQ ID NO: 212913 - RNA, 32 nt, Human
gugguggcaggcaccuguagucccagcuacuc

SEQ ID NO: 212914 - RNA, 32 nt, Human
gugguggcaggcaccuguagucccagcuacuu

SEQ ID NO: 212915 - RNA, 32 nt, Human
gugguggcaggcaccuguaguccuagcuacuu

SEQ ID NO: 212916 - RNA, 32 nt, Human
gugguggcaggcaucugcaaucucagcuacuc

SEQ ID NO: 212917 - RNA, 32 nt, Human
gugguggcaggugccuguagucucagcuacuc

SEQ ID NO: 212918 - RNA, 32 nt, Human
gugguggcaguggaggugggguguuugggagg

SEQ ID NO: 212919 - RNA, 32 nt, Human
gugguggcaguggcucccagcacuuugggagg

SEQ ID NO: 212920 - RNA, 32 nt, Human
gugguggcauaugccuguaaaucccagcuauu

SEQ ID NO: 212921 - RNA, 32 nt, Human
gugguggcaugcaccugucaucccagcuacuc

SEQ ID NO: 212922 - RNA, 22 nt, Human
gugguggcccacgccuguaauc

SEQ ID NO: 212923 - RNA, 32 nt, Human
gugguggccgucuggcugaccugggccaaugg

SEQ ID NO: 212924 - RNA, 21 nt, Human
gugguggccugcggcaucccu

SEQ ID NO: 212925 - RNA, 32 nt, Human
gugguggccuguaaucccagcuacuugggagg

SEQ ID NO: 212926 - RNA, 32 nt, Human
gugguggcgcauugccuguaaucccagcuacu

SEQ ID NO: 212927 - RNA, 32 nt, Human
gugguggcggcagaggaggagggcagcagcug

SEQ ID NO: 212928 - RNA, 32 nt, Human
gugguggcgggagucuguagucucagcuauuc

SEQ ID NO: 212929 - RNA, 22 nt, Human
gugguggcucaagccuguaauc

SEQ ID NO: 212930 - RNA, 22 nt, Human
gugguggcucacaacuguaauc

SEQ ID NO: 212931 - RNA, 22 nt, Human
gugguggcucacaccugcaauc

SEQ ID NO: 212932 - RNA, 32 nt, Human
gugguggcucacaccuguaaccccagcacuuu

SEQ ID NO: 212933 - RNA, 22 nt, Human
gugguggcucacaccuguaauc

SEQ ID NO: 212934 - RNA, 32 nt, Human
gugguggcucacaccuguaaucucggcacuuu

SEQ ID NO: 212935 - RNA, 32 nt, Human
gugguggcucacaccuguaauuucagcacucu

SEQ ID NO: 212936 - RNA, 32 nt, Human
gugguggcucacaccuguauucccagcacuuu

SEQ ID NO: 212937 - RNA, 32 nt, Human
gugguggcucacaccugucauuccggccucag

SEQ ID NO: 212938 - RNA, 22 nt, Human
gugguggcucacaucuguaauc

SEQ ID NO: 212939 - RNA, 22 nt, Human
gugguggcucacgccuauaauc

SEQ ID NO: 212940 - RNA, 20 nt, Human
gugguggcucacgccuguaa

SEQ ID NO: 212941 - RNA, 22 nt, Human
gugguggcucacgccuguaauc

SEQ ID NO: 212942 - RNA, 32 nt, Human
gugguggcucacgccuguaaucccugcauuuu

SEQ ID NO: 212943 - RNA, 22 nt, Human
gugguggcucacgccuguaauu

SEQ ID NO: 212944 - RNA, 22 nt, Human
gugguggcucacgccuguaguc

SEQ ID NO: 212945 - RNA, 22 nt, Human
gugguggcucacgucuguaauc

SEQ ID NO: 212946 - RNA, 22 nt, Human
gugguggcucaggccuguaauc

SEQ ID NO: 212947 - RNA, 18 nt, Human
gugguggcucauaccugu

SEQ ID NO: 212948 - RNA, 32 nt, Human
gugguggcucauaccuguaaaucccagcacuu

SEQ ID NO: 212949 - RNA, 22 nt, Human
gugguggcucauaccuguaauc

SEQ ID NO: 212950 - RNA, 22 nt, Human
gugguggcucaugccuauaauc

SEQ ID NO: 212951 - RNA, 19 nt, Human
gugguggcucaugccugua

SEQ ID NO: 212952 - RNA, 21 nt, Human
gugguggcucaugccuguaau

SEQ ID NO: 212953 - RNA, 22 nt, Human
gugguggcucaugccuguaauc

SEQ ID NO: 212954 - RNA, 23 nt, Human
gugguggcucaugccuguaaucc

SEQ ID NO: 212955 - RNA, 22 nt, Human
gugguggcucaugccuguaauu

SEQ ID NO: 212956 - RNA, 22 nt, Human
gugguggcucaugccuguaguc

SEQ ID NO: 212957 - RNA, 32 nt, Human
gugguggcucaugccuguauccagcacuuugg

SEQ ID NO: 212958 - RNA, 32 nt, Human
gugguggcuccugcuccgcauguggggaagau

SEQ ID NO: 212959 - RNA, 32 nt, Human
gugguggcucucacagggcucuccagacacuc

SEQ ID NO: 212960 - RNA, 32 nt, Human
gugguggcugaacucuaguggggccgagacua

SEQ ID NO: 212961 - RNA, 32 nt, Human
gugguggcugagccagcuccuugaggaugugg

SEQ ID NO: 212962 - RNA, 32 nt, Human
gugguggcuggcucucuucagcauguaauugg

SEQ ID NO: 212963 - RNA, 32 nt, Human
gugguggcuggcuguagccuagugcacgcugu

SEQ ID NO: 212964 - RNA, 32 nt, Human
gugguggcuuaaguuuugaagggagguagcau

SEQ ID NO: 212965 - RNA, 22 nt, Human
gugguggcuuacaccuguaauc

SEQ ID NO: 212966 - RNA, 22 nt, Human
gugguggcuuacgccuguaauc

SEQ ID NO: 212967 - RNA, 22 nt, Human
gugguggcuuaugccuguaauc

SEQ ID NO: 212968 - RNA, 32 nt, Human
gugguggcuucacgccuguaauucuagcacuu

SEQ ID NO: 212969 - RNA, 32 nt, Human
gugguggcuucaguccugccccugcaccugac

SEQ ID NO: 212970 - RNA, 32 nt, Human
gugguggcuuuaaucccagcacuuugggaacc

SEQ ID NO: 212971 - RNA, 32 nt, Human
gugguggcuuugucccuugaaggcuccuccug

SEQ ID NO: 212972 - RNA, 32 nt, Human
guggugggaaccugggcggcucuggaggccca

SEQ ID NO: 212973 - RNA, 32 nt, Human
guggugggaagagaugccagcgccacgagagg

SEQ ID NO: 212974 - RNA, 32 nt, Human
guggugggaagcuucccaggagaguccucagc

SEQ ID NO: 212975 - RNA, 32 nt, Human
guggugggaaggaaacagagagggguugauca

SEQ ID NO: 212976 - RNA, 32 nt, Human
guggugggagagcagagguggacgcggccgag

SEQ ID NO: 212977 - RNA, 32 nt, Human
guggugggagccuggagcaagguggagggugc

SEQ ID NO: 212978 - RNA, 32 nt, Human
guggugggaggcagcuguggugcaggagcuga

SEQ ID NO: 212979 - RNA, 32 nt, Human
guggugggaucacgccuguaaucccagcacuu

SEQ ID NO: 212980 - RNA, 32 nt, Human
guggugggcaggaaggagcuaucagaauaaag

SEQ ID NO: 212981 - RNA, 32 nt, Human
guggugggcagguggagggccugcccuggaca

SEQ ID NO: 212982 - RNA, 32 nt, Human
guggugggcugguggcccaggagaagucagga

SEQ ID NO: 212983 - RNA, 32 nt, Human
gugguggggaagagccuugucuucuuagcugu

SEQ ID NO: 212984 - RNA, 32 nt, Human
gugguggggagagugaagaaagagauagaaua

SEQ ID NO: 212985 - RNA, 32 nt, Human
gugguggggguuucucauuguucuccggcccu

SEQ ID NO: 212986 - RNA, 32 nt, Human
gugguggguagcagcaugacagcugcuugcca

SEQ ID NO: 212987 - RNA, 22 nt, Human
guggugggucacgccuguaauc

SEQ ID NO: 212988 - RNA, 32 nt, Human
gugguggguccagaacucggagaccagaaagu

SEQ ID NO: 212989 - RNA, 32 nt, Human
gugguggguccugcuccuaucucuccaaaccc

SEQ ID NO: 212990 - RNA, 32 nt, Human
gugguggguggacccucaggucugcagaggac

SEQ ID NO: 212991 - RNA, 19 nt, Human
gugguggucaccuguaguc

SEQ ID NO: 212992 - RNA, 32 nt, Human
gugguggucaucucuucugaucuucacagcca

SEQ ID NO: 212993 - RNA, 32 nt, Human
gugguggucuccgacuuuauagcaggaacuuu

SEQ ID NO: 212994 - RNA, 32 nt, Human
gugguggugagguuggaaccaguuggauuaug

SEQ ID NO: 212995 - RNA, 32 nt, Human
gugguggugagguuguggggcggggguauuuu

SEQ ID NO: 212996 - RNA, 32 nt, Human
gugguggugcacaccuguagucccagguacuc

SEQ ID NO: 212997 - RNA, 32 nt, Human
gugguggugcacuggugacuucauggccacgc

SEQ ID NO: 212998 - RNA, 32 nt, Human
gugguggugcugggggaggcaccccacagacu

SEQ ID NO: 212999 - RNA, 32 nt, Human
guggugguggaagguagucugagccacugccu

SEQ ID NO: 213000 - RNA, 32 nt, Human
guggugguggagggugggggugcacugcagca

SEQ ID NO: 213001 - RNA, 32 nt, Human
guggugguggcaggaguggcugugggagcagc

SEQ ID NO: 213002 - RNA, 32 nt, Human
guggugguggcugcgcacacagcuccacaggu

SEQ ID NO: 213003 - RNA, 32 nt, Human
gugguggugggaagccuguaaucccagcuacu

SEQ ID NO: 213004 - RNA, 32 nt, Human
gugguggugggcaccuguagucucagcuacuu

SEQ ID NO: 213005 - RNA, 32 nt, Human
guggugguggucuccuggcagagcggugggac

SEQ ID NO: 213006 - RNA, 22 nt, Human
guggugguucacaccuguaauc

SEQ ID NO: 213007 - RNA, 22 nt, Human
guggugguucacgccuguaauc

SEQ ID NO: 213008 - RNA, 22 nt, Human
guggugguucaugccuguaauc

SEQ ID NO: 213009 - RNA, 32 nt, Human
guggugguuuucuguucuuucuggcuaugcau

SEQ ID NO: 213010 - RNA, 22 nt, Human
gugguguaccccuguaauccca

SEQ ID NO: 213011 - RNA, 22 nt, Human
gugguguacgccuguaauccca

SEQ ID NO: 213012 - RNA, 32 nt, Human
gugguguagugcuguguguauggaguuagugu

SEQ ID NO: 213013 - RNA, 21 nt, Human
gugguguaugguggucugccg

SEQ ID NO: 213014 - RNA, 32 nt, Human
gugguguaugugccacgggauuugagugguug

SEQ ID NO: 213015 - RNA, 32 nt, Human
guggugucaucuggggagaacaggagggcaug

SEQ ID NO: 213016 - RNA, 31 nt, Human
guggugugacuucugccccgaaguuccuacu

SEQ ID NO: 213017 - RNA, 22 nt, Human
guggugugcaccuguaauccca

SEQ ID NO: 213018 - RNA, 23 nt, Human
guggugugcagagaugcugcaua

SEQ ID NO: 213019 - RNA, 18 nt, Human
guggugugcagcaucccu

SEQ ID NO: 213020 - RNA, 22 nt, Human
guggugugccccuguaauccca

SEQ ID NO: 213021 - RNA, 32 nt, Human
guggugugccuguagucccagcuacuugggag

SEQ ID NO: 213022 - RNA, 32 nt, Human
guggugugccuguaguccuaguuacuugggag

SEQ ID NO: 213023 - RNA, 22 nt, Human
guggugugcgccuguaauccca

SEQ ID NO: 213024 - RNA, 32 nt, Human
gugguguggaggcagcugcugggcaggacccg

SEQ ID NO: 213025 - RNA, 31 nt, Human
gugguguggcucucuggacuuaacgucacuc

SEQ ID NO: 213026 - RNA, 32 nt, Human
gugguguggcuuuguggggagggcguaguucc

SEQ ID NO: 213027 - RNA, 32 nt, Human
guggugugggaaaugagacuugcucucuggcc

SEQ ID NO: 213028 - RNA, 32 nt, Human
gugguguguaagcagguggaauacucacccac

SEQ ID NO: 213029 - RNA, 22 nt, Human
guggugugugccuguaauccca

SEQ ID NO: 213030 - RNA, 31 nt, Human
guggugugugggucuuggccuguguuucucu

SEQ ID NO: 213031 - RNA, 32 nt, Human
gugguguuaccuccccauuuucacaugcacgu

SEQ ID NO: 213032 - RNA, 23 nt, Human
gugguguucacauacauuuucua

SEQ ID NO: 213033 - RNA, 32 nt, Human
gugguguucucuucucaaggcuuugaaaucuc

SEQ ID NO: 213034 - RNA, 32 nt, Human
gugguguugggguuuggguaggggaggggagc

SEQ ID NO: 213035 - RNA, 23 nt, Human
gugguguuguguguguuugugcg

SEQ ID NO: 213036 - RNA, 32 nt, Human
gugguuaaagauuuacccucccucuuggugaa

SEQ ID NO: 213037 - RNA, 32 nt, Human
gugguuacaugaggcaggugugagggacccga

SEQ ID NO: 213038 - RNA, 19 nt, Human
gugguuacaugcauuuccu

SEQ ID NO: 213039 - RNA, 19 nt, Human
gugguuacuuguaucuccu

SEQ ID NO: 213040 - RNA, 32 nt, Human
gugguuagaggcugcccucuccccagcaaugc

SEQ ID NO: 213041 - RNA, 19 nt, Human
gugguuaugcauuuuucua

SEQ ID NO: 213042 - RNA, 18 nt, Human
gugguuauguucccagca

SEQ ID NO: 213043 - RNA, 22 nt, Human
gugguuauuagggcuuuuccug

SEQ ID NO: 213044 - RNA, 19 nt, Human
gugguucacaccuguaauc

SEQ ID NO: 213045 - RNA, 20 nt, Human
gugguucacaccuguaaucc

SEQ ID NO: 213046 - RNA, 22 nt, Human
gugguucacaccuguaauccca

SEQ ID NO: 213047 - RNA, 32 nt, Human
gugguucacagcuguaguauggagauuaauag

SEQ ID NO: 213048 - RNA, 31 nt, Human
gugguucacagcuuucauccaagcuugguga

SEQ ID NO: 213049 - RNA, 32 nt, Human
gugguucaccuguagacagagagcagaucaau

SEQ ID NO: 213050 - RNA, 22 nt, Human
gugguucacgccuguaauccca

SEQ ID NO: 213051 - RNA, 32 nt, Human
gugguucaggccggcucccccuuccuggucuc

SEQ ID NO: 213052 - RNA, 22 nt, Human
gugguucaugccuauaauccca

SEQ ID NO: 213053 - RNA, 32 nt, Human
gugguucaugccuguaauccagcacuuuggga

SEQ ID NO: 213054 - RNA, 32 nt, Human
gugguucaugccuuaaucccagcacuuuggga

SEQ ID NO: 213055 - RNA, 32 nt, Human
gugguuccagcuuuucuuucuccccuacucca

SEQ ID NO: 213056 - RNA, 32 nt, Human
gugguucccagccucugcugacagcaccucag

SEQ ID NO: 213057 - RNA, 32 nt, Human
gugguucccaugaugcggaaaaagccagagag

SEQ ID NO: 213058 - RNA, 32 nt, Human
gugguuccgucagaccaugaggagccaagacc

SEQ ID NO: 213059 - RNA, 32 nt, Human
gugguuccuucccuuuccucccccucccaugc

SEQ ID NO: 213060 - RNA, 32 nt, Human
gugguuccuuucucagccgcuucugacugcug

SEQ ID NO: 213061 - RNA, 31 nt, Human
gugguucgacuucucccucugucugggggca

SEQ ID NO: 213062 - RNA, 32 nt, Human
gugguucuaauucgcuaggcaggccugagcga

SEQ ID NO: 213063 - RNA, 32 nt, Human
gugguucucaaaguguaaucccugggccagca

SEQ ID NO: 213064 - RNA, 32 nt, Human
gugguucucaaagugugggcccuggaccagug

SEQ ID NO: 213065 - RNA, 32 nt, Human
gugguucuccaccccguuguggcuuacagcug

SEQ ID NO: 213066 - RNA, 32 nt, Human
gugguucucccagcacgcagauggagaucuga

SEQ ID NO: 213067 - RNA, 32 nt, Human
gugguucucugccucuggugccucccuaaagc

SEQ ID NO: 213068 - RNA, 32 nt, Human
gugguucugcaugucugugcucuuccucaacc

SEQ ID NO: 213069 - RNA, 32 nt, Human
gugguucuggugggaugcacagucacuccaca

SEQ ID NO: 213070 - RNA, 32 nt, Human
gugguucuuccuguucugugcuguguauagug

SEQ ID NO: 213071 - RNA, 18 nt, Human
gugguugaccucucagca

SEQ ID NO: 213072 - RNA, 32 nt, Human
gugguugaggagaugaaagggaaguauuauag

SEQ ID NO: 213073 - RNA, 19 nt, Human
gugguugaguugucuccua

SEQ ID NO: 213074 - RNA, 32 nt, Human
gugguugauagccagucacugccuuaagaaca

SEQ ID NO: 213075 - RNA, 32 nt, Human
gugguugcaacacuguacuccagccugggcaa

SEQ ID NO: 213076 - RNA, 32 nt, Human
gugguugcagugagccaagauugugccacugc

SEQ ID NO: 213077 - RNA, 32 nt, Human
gugguugcagugagccuagaucgugccacugc

SEQ ID NO: 213078 - RNA, 32 nt, Human
gugguugcagugagcgaagaucgagccacugc

SEQ ID NO: 213079 - RNA, 32 nt, Human
gugguugcagugagcuaugauuguaccacugc

SEQ ID NO: 213080 - RNA, 32 nt, Human
gugguugcagugagcugagauugugucauugc

SEQ ID NO: 213081 - RNA, 32 nt, Human
gugguugccaugauaaggggcagugacuucca

SEQ ID NO: 213082 - RNA, 32 nt, Human
gugguugccgggaggaccagcaccuccaguua

SEQ ID NO: 213083 - RNA, 32 nt, Human
gugguugccuccaugcuguucucaucauagug

SEQ ID NO: 213084 - RNA, 32 nt, Human
gugguugccugccccacucccugccgagacgc

SEQ ID NO: 213085 - RNA, 32 nt, Human
gugguugcuauggaaacagaaaaggcugccag

SEQ ID NO: 213086 - RNA, 32 nt, Human
gugguugcugaaggcuggaguggguguggcaa

SEQ ID NO: 213087 - RNA, 32 nt, Human
gugguugcugcacuugaccacugugaagacug

SEQ ID NO: 213088 - RNA, 32 nt, Human
gugguugcuucgggaugggaggaaugggaaga

SEQ ID NO: 213089 - RNA, 32 nt, Human
gugguuggacuucaccucucagcacugaaaac

SEQ ID NO: 213090 - RNA, 32 nt, Human
gugguuggaggcgguggcggcggcggcgagga

SEQ ID NO: 213091 - RNA, 22 nt, Human
gugguuggcaccuauaguccca

SEQ ID NO: 213092 - RNA, 22 nt, Human
gugguuggcaccuguaguccca

SEQ ID NO: 213093 - RNA, 22 nt, Human
gugguuggcgccuguaauccca

SEQ ID NO: 213094 - RNA, 32 nt, Human
gugguuggcucaugccuguaaucccaccacuu

SEQ ID NO: 213095 - RNA, 32 nt, Human
gugguuggcugagccaagaacucuccuaaauc

SEQ ID NO: 213096 - RNA, 24 nt, Human
gugguugucucacuucaucucuua

SEQ ID NO: 213097 - RNA, 23 nt, Human
gugguugugaaacagcaucuccu

SEQ ID NO: 213098 - RNA, 32 nt, Human
gugguugugcagccccacccccgggaggggcu

SEQ ID NO: 213099 - RNA, 22 nt, Human
gugguuguggccuguaauccca

SEQ ID NO: 213100 - RNA, 32 nt, Human
gugguuguguguguucuguccccaucuagguc

SEQ ID NO: 213101 - RNA, 32 nt, Human
gugguuguugcccaggcuggagugcaguggcg

SEQ ID NO: 213102 - RNA, 22 nt, Human
gugguuuacaccuauaauccca

SEQ ID NO: 213103 - RNA, 32 nt, Human
gugguuuagggugaaggcuuugggugauaccu

SEQ ID NO: 213104 - RNA, 32 nt, Human
gugguuuccaaggagcugagaauagaaggaaa

SEQ ID NO: 213105 - RNA, 32 nt, Human
gugguuuccaucucacagagaaucagacaggg

SEQ ID NO: 213106 - RNA, 32 nt, Human
gugguuucccccaguuguucucauaguaauga

SEQ ID NO: 213107 - RNA, 32 nt, Human
gugguuucuaagauuuggacaugucagaauuu

SEQ ID NO: 213108 - RNA, 32 nt, Human
gugguuucuccauguuggccaggcuggucuca

SEQ ID NO: 213109 - RNA, 32 nt, Human
gugguuucucucuccugacucaaccccgaaug

SEQ ID NO: 213110 - RNA, 32 nt, Human
gugguuucugcucaccagaccucucuuuagaa

SEQ ID NO: 213111 - RNA, 32 nt, Human
gugguuugacaaauccuucacucucauuuccu

SEQ ID NO: 213112 - RNA, 32 nt, Human
gugguuugacucugcuuuucuuccggauuggc

SEQ ID NO: 213113 - RNA, 22 nt, Human
gugguuugcgccuguaauccca

SEQ ID NO: 213114 - RNA, 32 nt, Human
gugguuugcguguuacccaucuguguccccau

SEQ ID NO: 213115 - RNA, 32 nt, Human
gugguuugggcugggccuuuugugcccuggua

SEQ ID NO: 213116 - RNA, 32 nt, Human
gugguuuguagaaucccagccccagcaucucc

SEQ ID NO: 213117 - RNA, 32 nt, Human
gugguuugucagaggcuaauucugcagaguuu

SEQ ID NO: 213118 - RNA, 32 nt, Human
gugguuuguccaggcuccaguacagauggcug

SEQ ID NO: 213119 - RNA, 32 nt, Human
gugguuuguggcagcuacucuucaccugcagc

SEQ ID NO: 213120 - RNA, 32 nt, Human
gugguuuguggggcuggaugccagaagguucu

SEQ ID NO: 213121 - RNA, 32 nt, Human
gugguuuucaggaguccgagguagccuucaau

SEQ ID NO: 213122 - RNA, 32 nt, Human
gugguuuuccccaauaccuggagcucagaaag

SEQ ID NO: 213123 - RNA, 32 nt, Human
gugguuuugcagacaacccuguccucaggccu

SEQ ID NO: 213124 - RNA, 32 nt, Human
gugguuuuguguccugagacaggggagcugac

SEQ ID NO: 213125 - RNA, 32 nt, Human
gugguuuuuacacauggucagaauguguucaa

SEQ ID NO: 213126 - RNA, 32 nt, Human
gugguuuuuauuugaccuguuggaaguucugg

SEQ ID NO: 213127 - RNA, 32 nt, Human
gugguuuuugcaguuacuuuugcaguggccua

SEQ ID NO: 213128 - RNA, 32 nt, Human
guguaaaaaccaagacugggaagccauucacu

SEQ ID NO: 213129 - RNA, 32 nt, Human
guguaaaaagcaaacaucugaagacccuugug

SEQ ID NO: 213130 - RNA, 32 nt, Human
guguaaaaagccuccuugugcaauugucuuuu

SEQ ID NO: 213131 - RNA, 32 nt, Human
guguaaaaauuugaauuugaggccagugggcu

SEQ ID NO: 213132 - RNA, 32 nt, Human
guguaaaagaugaugugauuguagcucugaag

SEQ ID NO: 213133 - RNA, 32 nt, Human
guguaaaagcagccauagacaguagauaaaug

SEQ ID NO: 213134 - RNA, 32 nt, Human
guguaaaauagggaagaaaguuaguauuggau

SEQ ID NO: 213135 - RNA, 32 nt, Human
guguaaaaucuuggguaccuuuagauucuugu

SEQ ID NO: 213136 - RNA, 32 nt, Human
guguaaaccuuuacacuaaggucuccauauac

SEQ ID NO: 213137 - RNA, 32 nt, Human
guguaaacuuggggauggcugagggaacauag

SEQ ID NO: 213138 - RNA, 32 nt, Human
guguaaagaaaaucugucuuuuuauuguuucu

SEQ ID NO: 213139 - RNA, 32 nt, Human
guguaaagaagacuuugccucucacaacuaca

SEQ ID NO: 213140 - RNA, 32 nt, Human
guguaaagaaugucucagucugccuuaaagga

SEQ ID NO: 213141 - RNA, 32 nt, Human
guguaaagacucacaggugaccugcuaucgag

SEQ ID NO: 213142 - RNA, 32 nt, Human
guguaaaguauguugguggugaaagcaagguu

SEQ ID NO: 213143 - RNA, 32 nt, Human
guguaaauauauuaguaaauguuaauauucau

SEQ ID NO: 213144 - RNA, 32 nt, Human
guguaaauguacacacgcacacacaguugugg

SEQ ID NO: 213145 - RNA, 32 nt, Human
guguaaaugugggggagguucaaugagaggug

SEQ ID NO: 213146 - RNA, 32 nt, Human
guguaacaaaccugcacauucagcacauguau

SEQ ID NO: 213147 - RNA, 32 nt, Human
guguaacaaaccugcauguucugcacauggau

SEQ ID NO: 213148 - RNA, 32 nt, Human
guguaacacugagccagccacuacccagagag

SEQ ID NO: 213149 - RNA, 32 nt, Human
guguaaccauugccucugucuaguuccaaaac

SEQ ID NO: 213150 - RNA, 24 nt, Human
guguaaccuugaauaagucacuua

SEQ ID NO: 213151 - RNA, 32 nt, Human
guguaacucccauccaccagggaaguugcuug

SEQ ID NO: 213152 - RNA, 32 nt, Human
guguaagaaggugaaucacgugggaaaaagug

SEQ ID NO: 213153 - RNA, 32 nt, Human
guguaagagaaaaguaccaacagggaaaucag

SEQ ID NO: 213154 - RNA, 32 nt, Human
guguaagaggucacugcugagcuucagugagc

SEQ ID NO: 213155 - RNA, 32 nt, Human
guguaagcaguggagguucuaagacaggcugg

SEQ ID NO: 213156 - RNA, 32 nt, Human
guguaagccaccgcaccccgcccagccuggca

SEQ ID NO: 213157 - RNA, 32 nt, Human
guguaaggcacuuuggaaaaauaccuggcaua

SEQ ID NO: 213158 - RNA, 32 nt, Human
guguaaguaagccaagacacaucgacaaugag

SEQ ID NO: 213159 - RNA, 32 nt, Human
guguaauagccuuuuguuaacuaauuuucuuu

SEQ ID NO: 213160 - RNA, 32 nt, Human
guguaauaggagagcaaaggaaggcaaucugg

SEQ ID NO: 213161 - RNA, 32 nt, Human
guguaaucauuucuugggcccuccugaaacuu

SEQ ID NO: 213162 - RNA, 32 nt, Human
guguaaucucagaauacacaggugacauagau

SEQ ID NO: 213163 - RNA, 32 nt, Human
guguaaucugcaugcaguaacaugcacaaguc

SEQ ID NO: 213164 - RNA, 32 nt, Human
guguaaucuugaacaugggcggugcugugagu

SEQ ID NO: 213165 - RNA, 32 nt, Human
guguaauggaccuuaugcaaauccagaaccca

SEQ ID NO: 213166 - RNA, 32 nt, Human
guguaauugagugaaggaauccuggguagaga

SEQ ID NO: 213167 - RNA, 32 nt, Human
guguaauugcuacauucucugauguaguuaag

SEQ ID NO: 213168 - RNA, 32 nt, Human
guguaauugguaguguucugucccuccaagga

SEQ ID NO: 213169 - RNA, 22 nt, Human
guguaauuuuuauaugcuuaaa

SEQ ID NO: 213170 - RNA, 32 nt, Human
guguacaaacuggccaagugcuucuguagaua

SEQ ID NO: 213171 - RNA, 19 nt, Human
guguacaauacaacaggga

SEQ ID NO: 213172 - RNA, 32 nt, Human
guguacacaaaggauuugaugcuuuucucuca

SEQ ID NO: 213173 - RNA, 32 nt, Human
guguacagacacacagcagaggcacacacaca

SEQ ID NO: 213174 - RNA, 32 nt, Human
guguacagccacagcaaggagcccgacacuga

SEQ ID NO: 213175 - RNA, 18 nt, Human
guguacagcugagaugaa

SEQ ID NO: 213176 - RNA, 32 nt, Human
guguacagggccgggugcaguggcucacacug

SEQ ID NO: 213177 - RNA, 32 nt, Human
guguacaguagcuuaaaauugcagugauugag

SEQ ID NO: 213178 - RNA, 24 nt, Human
guguacauauacggcuauuuccua

SEQ ID NO: 213179 - RNA, 32 nt, Human
guguacauccuauuccuuccucuuuaucucac

SEQ ID NO: 213180 - RNA, 32 nt, Human
guguacaucugaacuuugguccauccuuugau

SEQ ID NO: 213181 - RNA, 32 nt, Human
guguacaugaucaacaaaagcucacagcagca

SEQ ID NO: 213182 - RNA, 32 nt, Human
guguaccaaugccccucaucucccacuuucac

SEQ ID NO: 213183 - RNA, 32 nt, Human
guguaccaccaggcacaccucagucuucuuga

SEQ ID NO: 213184 - RNA, 32 nt, Human
guguaccaguuuccugagccacgcccagugug

SEQ ID NO: 213185 - RNA, 32 nt, Human
guguacccagagccauggcagccacgcuggga

SEQ ID NO: 213186 - RNA, 32 nt, Human
guguacccagguccucccaggugcggugugca

SEQ ID NO: 213187 - RNA, 32 nt, Human
guguacccccuucacucccucccaccagcucu

SEQ ID NO: 213188 - RNA, 32 nt, Human
guguacccgggucuggcccucacugcaggaca

SEQ ID NO: 213189 - RNA, 32 nt, Human
guguacccugcacuugcagacucuacagaggc

SEQ ID NO: 213190 - RNA, 32 nt, Human
guguacccugcucuuucuccuucauuccgcag

SEQ ID NO: 213191 - RNA, 32 nt, Human
guguaccuagguguccucccuaguuuccucuc

SEQ ID NO: 213192 - RNA, 32 nt, Human
guguaccugcagcauaacacagaccccugaau

SEQ ID NO: 213193 - RNA, 32 nt, Human
guguaccuguagucccagcuacuugggaggcu

SEQ ID NO: 213194 - RNA, 32 nt, Human
guguacgaggcagacggcggcagugcggcuug

SEQ ID NO: 213195 - RNA, 32 nt, Human
guguacgaggcagagggccgggacagcuuucc

SEQ ID NO: 213196 - RNA, 32 nt, Human
guguacgauccacgccuaagguugagggcggc

SEQ ID NO: 213197 - RNA, 32 nt, Human
guguacggaagagccagcaggagcagcguggu

SEQ ID NO: 213198 - RNA, 32 nt, Human
guguacgugccuguagucucagcuacuuggga

SEQ ID NO: 213199 - RNA, 32 nt, Human
guguacguggcugugcccucucuccuuaagcc

SEQ ID NO: 213200 - RNA, 32 nt, Human
guguacucagagcagaggggccaggacuucug

SEQ ID NO: 213201 - RNA, 32 nt, Human
guguacucauaauauucuauggcuccagagug

SEQ ID NO: 213202 - RNA, 32 nt, Human
guguacucaucacccauauacugaacacugua

SEQ ID NO: 213203 - RNA, 32 nt, Human
guguacuccuuuagggagugggggacuagaac

SEQ ID NO: 213204 - RNA, 32 nt, Human
guguacucuggccucuugguucauuauuuuca

SEQ ID NO: 213205 - RNA, 32 nt, Human
guguacucugugguucuaggcaguccgcuuuc

SEQ ID NO: 213206 - RNA, 32 nt, Human
guguacucuuugucacagcucaguugguaacc

SEQ ID NO: 213207 - RNA, 32 nt, Human
guguacugaaugccagucuggccggcacacuc

SEQ ID NO: 213208 - RNA, 32 nt, Human
guguacuggcacagcaagcccaccaauuauua

SEQ ID NO: 213209 - RNA, 32 nt, Human
guguacuucgauggguaacugcagucugaauu

SEQ ID NO: 213210 - RNA, 32 nt, Human
guguacuugagugugugucugugugcagccua

SEQ ID NO: 213211 - RNA, 32 nt, Human
guguacuugccugaaaacaaaggaaggugcug

SEQ ID NO: 213212 - RNA, 32 nt, Human
guguacuuguacuuugcuggugaguggaaagc

SEQ ID NO: 213213 - RNA, 32 nt, Human
guguacuuuccuaauagggaagggaagcacaa

SEQ ID NO: 213214 - RNA, 25 nt, Human
guguacuuugauuuuauaacuugua

SEQ ID NO: 213215 - RNA, 32 nt, Human
guguagaaaucugaauuuuuaaaagagcugua

SEQ ID NO: 213216 - RNA, 32 nt, Human
guguagaacagaauguacacauuauagcagcu

SEQ ID NO: 213217 - RNA, 32 nt, Human
guguagaauggugguuaccagauacugggggu

SEQ ID NO: 213218 - RNA, 23 nt, Human
guguagacaacucacauuugcuc

SEQ ID NO: 213219 - RNA, 32 nt, Human
guguagacacuggaauaacagcacagaaaaau

SEQ ID NO: 213220 - RNA, 32 nt, Human
guguagaccuucuuccugcuagggcugcacug

SEQ ID NO: 213221 - RNA, 32 nt, Human
guguagacugcagacauccauaccucaccaca

SEQ ID NO: 213222 - RNA, 25 nt, Human
guguagacuguuggguaggcugcgu

SEQ ID NO: 213223 - RNA, 32 nt, Human
guguagagaacaggaguccgcagcugcuggca

SEQ ID NO: 213224 - RNA, 32 nt, Human
guguagagacgcccuucucuccacuuuauugg

SEQ ID NO: 213225 - RNA, 32 nt, Human
guguagagauaggguuucaccauguugcuuag

SEQ ID NO: 213226 - RNA, 32 nt, Human
guguagagauauagcagcugaagcaggacuuc

SEQ ID NO: 213227 - RNA, 32 nt, Human
guguagagauggggucucacuguuguucaaac

SEQ ID NO: 213228 - RNA, 32 nt, Human
guguagaggagggauggccaaggguggguggu

SEQ ID NO: 213229 - RNA, 32 nt, Human
guguagaggcuccugcuccaccugccagucuc

SEQ ID NO: 213230 - RNA, 32 nt, Human
guguagauaaggcuucagccaugagucacccc

SEQ ID NO: 213231 - RNA, 32 nt, Human
guguagauauaccacauuuucuuuauccauuc

SEQ ID NO: 213232 - RNA, 32 nt, Human
guguagauuuuauucaucacaggacagaauaa

SEQ ID NO: 213233 - RNA, 32 nt, Human
guguagcaacuguuugauuucuuucuggauac

SEQ ID NO: 213234 - RNA, 32 nt, Human
guguagcagccucuccccaucuaccuagcaac

SEQ ID NO: 213235 - RNA, 32 nt, Human
guguagcaugugcugaggaagcacgugcuggg

SEQ ID NO: 213236 - RNA, 32 nt, Human
guguagccacagaacccaccugcacccugaca

SEQ ID NO: 213237 - RNA, 32 nt, Human
guguagccagccaggugcaugccgggaccaug

SEQ ID NO: 213238 - RNA, 32 nt, Human
guguagccccggagagguaacugaggacauga

SEQ ID NO: 213239 - RNA, 32 nt, Human
guguagcccugaggccuggaucuguuaagccc

SEQ ID NO: 213240 - RNA, 32 nt, Human
guguagccucuccuggucauagaccagucucu

SEQ ID NO: 213241 - RNA, 32 nt, Human
guguagccuuucugauuccucgguuguuucuu

SEQ ID NO: 213242 - RNA, 32 nt, Human
guguagcucuggcugccugucagcucccuugg

SEQ ID NO: 213243 - RNA, 32 nt, Human
guguagcugagguccugcuggaaaaauaccac

SEQ ID NO: 213244 - RNA, 32 nt, Human
guguagcugcaaagagcccacacccacgcuga

SEQ ID NO: 213245 - RNA, 32 nt, Human
guguagcugugaccugcugagcucugagaggc

SEQ ID NO: 213246 - RNA, 32 nt, Human
guguaggaaaacagccuguugcauuguaagag

SEQ ID NO: 213247 - RNA, 32 nt, Human
guguaggaccauugaaucuacaauccaugucg

SEQ ID NO: 213248 - RNA, 32 nt, Human
guguaggaggcugugugugugcccaugugaaa

SEQ ID NO: 213249 - RNA, 32 nt, Human
guguaggagggugggagggagagcugguccag

SEQ ID NO: 213250 - RNA, 32 nt, Human
guguaggagugagaagaaggaagaucuugaga

SEQ ID NO: 213251 - RNA, 19 nt, Human
guguaggauauuuugucac

SEQ ID NO: 213252 - RNA, 32 nt, Human
guguaggccccagcugcccacuggaacugccg

SEQ ID NO: 213253 - RNA, 20 nt, Human
guguaggcugggugcagugg

SEQ ID NO: 213254 - RNA, 32 nt, Human
guguagggaagcuucccggaggaucucagucu

SEQ ID NO: 213255 - RNA, 32 nt, Human
guguaggggcagcaggcugcacugaggaccgu

SEQ ID NO: 213256 - RNA, 32 nt, Human
guguagguaugacuguucuacuuuucaguuuu

SEQ ID NO: 213257 - RNA, 32 nt, Human
guguaggugagagaaagagggaggagugagag

SEQ ID NO: 213258 - RNA, 32 nt, Human
guguaguaaagguuuagacgaaaccccauaau

SEQ ID NO: 213259 - RNA, 32 nt, Human
guguaguacaucauauguauacaaucagauaa

SEQ ID NO: 213260 - RNA, 32 nt, Human
guguaguccugcaaaacauuuugagguacauu

SEQ ID NO: 213261 - RNA, 32 nt, Human
guguagucuccuccauuuuuccuccagcacuc

SEQ ID NO: 213262 - RNA, 32 nt, Human
guguagugagccuuugaaaaugguuaguaccg

SEQ ID NO: 213263 - RNA, 32 nt, Human
guguagugugcaaauguuagcaugugcauuau

SEQ ID NO: 213264 - RNA, 32 nt, Human
guguaguuaccugagaaacgcgggaaguuggg

SEQ ID NO: 213265 - RNA, 32 nt, Human
guguaguuggugacugccucuccagaugcuga

SEQ ID NO: 213266 - RNA, 32 nt, Human
guguauaauguuuucuuuagcaaguguggcaa

SEQ ID NO: 213267 - RNA, 23 nt, Human
guguauaauuuucuuaacuugua

SEQ ID NO: 213268 - RNA, 32 nt, Human
guguauacauguguagacacaaacauauacac

SEQ ID NO: 213269 - RNA, 32 nt, Human
guguauaccugugugugucugucuggggugau

SEQ ID NO: 213270 - RNA, 32 nt, Human
guguauacugaagaaaaagaagaagaaaagaa

SEQ ID NO: 213271 - RNA, 32 nt, Human
guguauagaaauagaucagagcacaguugaaa

SEQ ID NO: 213272 - RNA, 32 nt, Human
guguauagguguucccuuuucucugcauccuu

SEQ ID NO: 213273 - RNA, 32 nt, Human
guguauagugucuuugccauuuuagaagguuc

SEQ ID NO: 213274 - RNA, 32 nt, Human
guguauauaaaacuugcuuuauugcauggggc

SEQ ID NO: 213275 - RNA, 19 nt, Human
guguauauauauacacgua

SEQ ID NO: 213276 - RNA, 23 nt, Human
guguauauauauacacguauaua

SEQ ID NO: 213277 - RNA, 21 nt, Human
guguauauauauacauacaca

SEQ ID NO: 213278 - RNA, 21 nt, Human
guguauauauauguauacaua

SEQ ID NO: 213279 - RNA, 32 nt, Human
guguauaucugccuccccugucuguaaggagc

SEQ ID NO: 213280 - RNA, 23 nt, Human
guguauaugaauauguacacaua

SEQ ID NO: 213281 - RNA, 32 nt, Human
guguauaugcagauauuccaaaccugaaaucc

SEQ ID NO: 213282 - RNA, 32 nt, Human
guguauauguuauguauacacaugcacauaug

SEQ ID NO: 213283 - RNA, 32 nt, Human
guguaucaagugucgcucacagccccauucac

SEQ ID NO: 213284 - RNA, 31 nt, Human
guguaucacgguaaaaagugaucuguuuuaa

SEQ ID NO: 213285 - RNA, 32 nt, Human
guguaucagacuuacguuacugucaucaccau

SEQ ID NO: 213286 - RNA, 32 nt, Human
guguaucauuugaauucagauugccuagcuau

SEQ ID NO: 213287 - RNA, 23 nt, Human
guguauccaguuacagaaugcua

SEQ ID NO: 213288 - RNA, 32 nt, Human
guguauccuccugccacaaaagccugaacuuc

SEQ ID NO: 213289 - RNA, 32 nt, Human
guguaucguggcuaugcuacuacuuccugggu

SEQ ID NO: 213290 - RNA, 32 nt, Human
guguaucuauuucauagggcccugcuuugcuu

SEQ ID NO: 213291 - RNA, 32 nt, Human
guguaucuccuuugagcuucugggccuuagca

SEQ ID NO: 213292 - RNA, 32 nt, Human
guguaucugcaccuucucaacugagagaagaa

SEQ ID NO: 213293 - RNA, 32 nt, Human
guguaucugucugucuauuagggguggcucuc

SEQ ID NO: 213294 - RNA, 32 nt, Human
guguaucugugggcaccaugcagauggcggga

SEQ ID NO: 213295 - RNA, 32 nt, Human
guguaucuucaucuggcuguuuacuuauuugu

SEQ ID NO: 213296 - RNA, 32 nt, Human
guguaucuugcuugggcuaucuucccugcucu

SEQ ID NO: 213297 - RNA, 32 nt, Human
guguaucuuguauuuucccugcccucagguug

SEQ ID NO: 213298 - RNA, 32 nt, Human
guguaugacaaccacacacagugaagcucuuu

SEQ ID NO: 213299 - RNA, 32 nt, Human
guguaugacuugauaucacauaacguucuggu

SEQ ID NO: 213300 - RNA, 32 nt, Human
guguaugcaaggggcugcagccccucuucucu

SEQ ID NO: 213301 - RNA, 32 nt, Human
guguaugcauguguuugaauucacaaggaaga

SEQ ID NO: 213302 - RNA, 31 nt, Human
guguaugcauuucucccuuuuaagggagauu

SEQ ID NO: 213303 - RNA, 32 nt, Human
guguaugcccaugucuaucauaccucaccucu

SEQ ID NO: 213304 - RNA, 32 nt, Human
guguaugccuguaaucccagcuacucgggagg

SEQ ID NO: 213305 - RNA, 32 nt, Human
guguaugcgaauguuucagugccucagacaaa

SEQ ID NO: 213306 - RNA, 32 nt, Human
guguaugcugcuuuucuuuucuaaccaagagg

SEQ ID NO: 213307 - RNA, 32 nt, Human
guguauggagcaaaggaggagugaacgucuag

SEQ ID NO: 213308 - RNA, 32 nt, Human
guguauggaugaggcuggagugaucugggacc

SEQ ID NO: 213309 - RNA, 32 nt, Human
guguauggcgcccaccuguaauccuagcugcu

SEQ ID NO: 213310 - RNA, 32 nt, Human
guguauggguagcacuacuaaaaguuuagaac

SEQ ID NO: 213311 - RNA, 32 nt, Human
guguauggucucaacuuuggcagcaaagagga

SEQ ID NO: 213312 - RNA, 32 nt, Human
guguauguaagcaguaguaguugcuauguacu

SEQ ID NO: 213313 - RNA, 32 nt, Human
guguaugugucugaccucaggccuuuuagcca

SEQ ID NO: 213314 - RNA, 32 nt, Human
guguaugugugugcgugucucugucccagacc

SEQ ID NO: 213315 - RNA, 32 nt, Human
guguauguguguguuugugugucuauuuggca

SEQ ID NO: 213316 - RNA, 32 nt, Human
guguauguugggggaguagggacagcacgggg

SEQ ID NO: 213317 - RNA, 32 nt, Human
guguauuaaccugaaauccaccucaccuugau

SEQ ID NO: 213318 - RNA, 32 nt, Human
guguauuagaaucccuuccugccuuguuucau

SEQ ID NO: 213319 - RNA, 32 nt, Human
guguauucacaaauucuguuacuucaagucuu

SEQ ID NO: 213320 - RNA, 32 nt, Human
guguauucccucugcccccauggcugcuggug

SEQ ID NO: 213321 - RNA, 32 nt, Human
guguauucuaggccacagcccagcacuccucu

SEQ ID NO: 213322 - RNA, 32 nt, Human
guguauucuaugucugguuaaauguucauuga

SEQ ID NO: 213323 - RNA, 32 nt, Human
guguauuggggcgcguggaggcugcagucacg

SEQ ID NO: 213324 - RNA, 32 nt, Human
guguauugguguugcagccgcagagaaaugcc

SEQ ID NO: 213325 - RNA, 32 nt, Human
guguauuucagaacuccucccaucuuauccac

SEQ ID NO: 213326 - RNA, 21 nt, Human
guguauuucuguagaaugcug

SEQ ID NO: 213327 - RNA, 32 nt, Human
guguauuucuugugcuucuacuuuguaccaaa

SEQ ID NO: 213328 - RNA, 32 nt, Human
guguauuuguuagagauaauuucugaagucua

SEQ ID NO: 213329 - RNA, 32 nt, Human
guguauuuguucucaguccuaacccuggggcc

SEQ ID NO: 213330 - RNA, 32 nt, Human
guguauuuucuuucuuugcuuccugucacccc

SEQ ID NO: 213331 - RNA, 32 nt, Human
guguauuuugcagcuggucaugagauuguguu

SEQ ID NO: 213332 - RNA, 32 nt, Human
guguauuuuucuuccuccucaacugagaucuu

SEQ ID NO: 213333 - RNA, 32 nt, Human
gugucaaaacagagcuuuugcugagaguuuga

SEQ ID NO: 213334 - RNA, 32 nt, Human
gugucaaaauauugcauuuucuggggccaaaa

SEQ ID NO: 213335 - RNA, 32 nt, Human
gugucaaagaaagagaggaaugcaggaugauu

SEQ ID NO: 213336 - RNA, 32 nt, Human
gugucaagcuccugaaacaagcucauuucagu

SEQ ID NO: 213337 - RNA, 24 nt, Human
gugucaaggagucaaaacagauua

SEQ ID NO: 213338 - RNA, 32 nt, Human
gugucaagggagcaaugcuugguuuggggagu

SEQ ID NO: 213339 - RNA, 32 nt, Human
gugucaaguccugccuuuccuuucaucauccc

SEQ ID NO: 213340 - RNA, 32 nt, Human
gugucaaugucaggaggacaggcugagcuccu

SEQ ID NO: 213341 - RNA, 32 nt, Human
gugucaauuuccaaccuccccuguacuuaccu

SEQ ID NO: 213342 - RNA, 32 nt, Human
gugucacacaggcuggagugcaguggcgugag

SEQ ID NO: 213343 - RNA, 32 nt, Human
gugucacacccugccugcucaguccugggguc

SEQ ID NO: 213344 - RNA, 32 nt, Human
gugucacacggcaccuguacaaaaagacuggc

SEQ ID NO: 213345 - RNA, 32 nt, Human
gugucacacuccuggcuaucucagggggaaug

SEQ ID NO: 213346 - RNA, 32 nt, Human
gugucacaguucacugcagccugggugacacu

SEQ ID NO: 213347 - RNA, 32 nt, Human
gugucacaucugaaacucaucuguaccucacu

SEQ ID NO: 213348 - RNA, 32 nt, Human
gugucaccaaggcuggagggcaauagcaugau

SEQ ID NO: 213349 - RNA, 32 nt, Human
gugucaccaauuccaccaagacagugcugaga

SEQ ID NO: 213350 - RNA, 32 nt, Human
gugucaccaggagaauagugcucacagcccag

SEQ ID NO: 213351 - RNA, 32 nt, Human
gugucaccaugcugggcaguauaaaguuuuaa

SEQ ID NO: 213352 - RNA, 32 nt, Human
gugucacccacuguuccacggauccaaaacaa

SEQ ID NO: 213353 - RNA, 32 nt, Human
gugucacccaggcuggagugcaauggcgcaau

SEQ ID NO: 213354 - RNA, 32 nt, Human
gugucacccaggcuggagugcagugauccacu

SEQ ID NO: 213355 - RNA, 32 nt, Human
gugucacccaggcuggagugcaguggcacaau

SEQ ID NO: 213356 - RNA, 32 nt, Human
gugucacccaggcuggagugcaguggcgcaau

SEQ ID NO: 213357 - RNA, 32 nt, Human
gugucacccaggcuggagugcaguggugcaau

SEQ ID NO: 213358 - RNA, 32 nt, Human
gugucacccaggcuggagugcaguggugugau

SEQ ID NO: 213359 - RNA, 32 nt, Human
gugucacccaggcuggcgugcagggcccugau

SEQ ID NO: 213360 - RNA, 21 nt, Human
gugucacccuguuugucaauc

SEQ ID NO: 213361 - RNA, 32 nt, Human
gugucaccuaggcuggagugcaguggcacaau

SEQ ID NO: 213362 - RNA, 32 nt, Human
gugucaccucaaccucaaaugauauggcucau

SEQ ID NO: 213363 - RNA, 32 nt, Human
gugucaccuccagcccagaggugguuccuuag

SEQ ID NO: 213364 - RNA, 32 nt, Human
gugucacgcaggcugagugcacuggcaggauc

SEQ ID NO: 213365 - RNA, 32 nt, Human
gugucacuacacuccaggcugggugacagauu

SEQ ID NO: 213366 - RNA, 32 nt, Human
gugucacuaccucuaaccuuuuuaaucgcaau

SEQ ID NO: 213367 - RNA, 32 nt, Human
gugucacuauuucaagucagugcucaaaaagu

SEQ ID NO: 213368 - RNA, 20 nt, Human
gugucacuccauaaaaagaa

SEQ ID NO: 213369 - RNA, 32 nt, Human
gugucacugcacuccagccggggcaacagagc

SEQ ID NO: 213370 - RNA, 32 nt, Human
gugucacugcacuccagccuggcgacagagug

SEQ ID NO: 213371 - RNA, 32 nt, Human
gugucacugcacuccagccugggcaacaggua

SEQ ID NO: 213372 - RNA, 32 nt, Human
gugucacugcacuccagccugggcgacagagg

SEQ ID NO: 213373 - RNA, 32 nt, Human
gugucacugcacuccagccugggcgacagagu

SEQ ID NO: 213374 - RNA, 32 nt, Human
gugucacugcacuccagccugggugacaagag

SEQ ID NO: 213375 - RNA, 32 nt, Human
gugucacugcacuccagccugggugacaguga

SEQ ID NO: 213376 - RNA, 32 nt, Human
gugucacugcacuccagccuggugacagagug

SEQ ID NO: 213377 - RNA, 32 nt, Human
gugucacugcacuccagcuugggugacagaga

SEQ ID NO: 213378 - RNA, 32 nt, Human
gugucacugcuuguuaugcaucauuucaggag

SEQ ID NO: 213379 - RNA, 24 nt, Human
gugucacuguuggauguuacacca

SEQ ID NO: 213380 - RNA, 32 nt, Human
gugucacuugaauuccacccaaggagcgggcg

SEQ ID NO: 213381 - RNA, 32 nt, Human
gugucacuugcuggguuaggaacagacggauc

SEQ ID NO: 213382 - RNA, 32 nt, Human
gugucagaaacaaguguuucugccuggacauc

SEQ ID NO: 213383 - RNA, 32 nt, Human
gugucagaaaugcagaaccucaggcuccaccu

SEQ ID NO: 213384 - RNA, 32 nt, Human
gugucagaaggugcugcugaggauagacugac

SEQ ID NO: 213385 - RNA, 32 nt, Human
gugucagaagugcugguuaaugacgagaagag

SEQ ID NO: 213386 - RNA, 32 nt, Human
gugucagaauacuccuuucauccaucacucag

SEQ ID NO: 213387 - RNA, 22 nt, Human
gugucagaauccuuuacauuca

SEQ ID NO: 213388 - RNA, 24 nt, Human
gugucagaaugagaccccaucuca

SEQ ID NO: 213389 - RNA, 32 nt, Human
gugucagacacuggccuggccuguggacacgc

SEQ ID NO: 213390 - RNA, 22 nt, Human
gugucagacgagcagaagauca

SEQ ID NO: 213391 - RNA, 32 nt, Human
gugucagagauccugcagccgcccagucccgg

SEQ ID NO: 213392 - RNA, 32 nt, Human
gugucagagcaagagggcuacagggaaagggc

SEQ ID NO: 213393 - RNA, 32 nt, Human
gugucagagcccaggggagaaugcagcccacc

SEQ ID NO: 213394 - RNA, 23 nt, Human
gugucagagcgagaacccguguc

SEQ ID NO: 213395 - RNA, 32 nt, Human
gugucagaucugucugaggagccccagucaug

SEQ ID NO: 213396 - RNA, 32 nt, Human
gugucagcagccaugucuacaacacagauaag

SEQ ID NO: 213397 - RNA, 32 nt, Human
gugucagcauuuucuuucguucucaggcuaaa

SEQ ID NO: 213398 - RNA, 32 nt, Human
gugucagccaccgcacccagccuggaguggcc

SEQ ID NO: 213399 - RNA, 32 nt, Human
gugucagcggcaagggcuccugcucagcacag

SEQ ID NO: 213400 - RNA, 32 nt, Human
gugucagcucacugcaaccuccaccuccugga

SEQ ID NO: 213401 - RNA, 32 nt, Human
gugucagcucuccaucugucucugccuggcag

SEQ ID NO: 213402 - RNA, 32 nt, Human
gugucagcuuuugagcugcuucccucaucaca

SEQ ID NO: 213403 - RNA, 32 nt, Human
gugucaggaagguaggcgugccaagccgcggc

SEQ ID NO: 213404 - RNA, 32 nt, Human
gugucaggagaucauaaauaggcaucuuacau

SEQ ID NO: 213405 - RNA, 32 nt, Human
gugucaggcaguguucugagaagcagcagccu

SEQ ID NO: 213406 - RNA, 32 nt, Human
gugucaggccauccuauugaugggaaagauug

SEQ ID NO: 213407 - RNA, 32 nt, Human
gugucaggccccaacccagcagaccugggugg

SEQ ID NO: 213408 - RNA, 24 nt, Human
gugucaggccuacggagucagcca

SEQ ID NO: 213409 - RNA, 32 nt, Human
gugucaggccuccugggcgcucuggaaaagac

SEQ ID NO: 213410 - RNA, 32 nt, Human
gugucaggccugcugcccuugccuuguccucg

SEQ ID NO: 213411 - RNA, 32 nt, Human
gugucaggcucauucaugucucaggcacacaa

SEQ ID NO: 213412 - RNA, 31 nt, Human
gugucagggaaguugccucagugcucccaga

SEQ ID NO: 213413 - RNA, 32 nt, Human
gugucagggcugggagacuaggaugucggaca

SEQ ID NO: 213414 - RNA, 32 nt, Human
gugucagugauggcuugguugcccaugcccuc

SEQ ID NO: 213415 - RNA, 32 nt, Human
gugucagugcacggcuagccugggcaacagag

SEQ ID NO: 213416 - RNA, 32 nt, Human
gugucagugugguuuauaauccuugaauauug

SEQ ID NO: 213417 - RNA, 32 nt, Human
gugucaguucccagagguccugggacagggga

SEQ ID NO: 213418 - RNA, 32 nt, Human
gugucauagucaccaaaagcaucaacagagca

SEQ ID NO: 213419 - RNA, 32 nt, Human
gugucauaguuauuagaaucagcagccucuua

SEQ ID NO: 213420 - RNA, 32 nt, Human
gugucauccaggcuggagugcggugguggaau

SEQ ID NO: 213421 - RNA, 32 nt, Human
gugucauccaugauccugcaaaggacaugaac

SEQ ID NO: 213422 - RNA, 32 nt, Human
gugucauccucauguucugccuuccaggaauu

SEQ ID NO: 213423 - RNA, 32 nt, Human
gugucaucugccuggucaucucagacccauga

SEQ ID NO: 213424 - RNA, 32 nt, Human
gugucaucuguccucuugagguucaggagauu

SEQ ID NO: 213425 - RNA, 23 nt, Human
gugucaucuuaguaacagaacca

SEQ ID NO: 213426 - RNA, 32 nt, Human
gugucaucuucucccaggauccauggguccag

SEQ ID NO: 213427 - RNA, 30 nt, Human
gugucaugcaggcuggagugaagucgugug

SEQ ID NO: 213428 - RNA, 32 nt, Human
gugucaugcaggcuggagugcaguggcaugau

SEQ ID NO: 213429 - RNA, 32 nt, Human
gugucaugccugcaaucccagcacuuugggag

SEQ ID NO: 213430 - RNA, 32 nt, Human
gugucaugcugacaugucccuccuggauggcu

SEQ ID NO: 213431 - RNA, 32 nt, Human
gugucauggaagcugcuccaaagucugacccc

SEQ ID NO: 213432 - RNA, 19 nt, Human
gugucauucacacucacua

SEQ ID NO: 213433 - RNA, 32 nt, Human
gugucauuccauggguccugaggucccuuacu

SEQ ID NO: 213434 - RNA, 32 nt, Human
gugucauucucugcagcagcugccugggccca

SEQ ID NO: 213435 - RNA, 32 nt, Human
gugucauugcacuccagccugggcaacaagag

SEQ ID NO: 213436 - RNA, 32 nt, Human
gugucauugcacuccagccugggcgacaagag

SEQ ID NO: 213437 - RNA, 32 nt, Human
gugucauugcacuccagccuggggaacagagc

SEQ ID NO: 213438 - RNA, 32 nt, Human
gugucauuuaaccuuaaaugcaaucaggaaag

SEQ ID NO: 213439 - RNA, 32 nt, Human
gugucauuucuauguguaauuucugagccauu

SEQ ID NO: 213440 - RNA, 32 nt, Human
guguccaagccccagagucccucuggaccaac

SEQ ID NO: 213441 - RNA, 32 nt, Human
guguccaaggagaccagggggugauguggacc

SEQ ID NO: 213442 - RNA, 32 nt, Human
guguccaaggagcugaagguggugaaauuugu

SEQ ID NO: 213443 - RNA, 18 nt, Human
guguccaaucagauccug

SEQ ID NO: 213444 - RNA, 17 nt, Human
guguccacaagaagggg

SEQ ID NO: 213445 - RNA, 32 nt, Human
guguccacaagaagggguguuuauucuuccaa

SEQ ID NO: 213446 - RNA, 32 nt, Human
guguccacaagcuuccagguugggguuggagc

SEQ ID NO: 213447 - RNA, 22 nt, Human
guguccacaccaugacccugug

SEQ ID NO: 213448 - RNA, 23 nt, Human
guguccacaccgcagugccucug

SEQ ID NO: 213449 - RNA, 32 nt, Human
guguccacagcaccuucucaaacuacauacuu

SEQ ID NO: 213450 - RNA, 22 nt, Human
guguccacagcugacuccucug

SEQ ID NO: 213451 - RNA, 32 nt, Human
guguccacagugugggacgcugaccccgggca

SEQ ID NO: 213452 - RNA, 22 nt, Human
guguccacccuguggcccuuug

SEQ ID NO: 213453 - RNA, 32 nt, Human
guguccaccugugcccccaccugggugcccua

SEQ ID NO: 213454 - RNA, 32 nt, Human
guguccacucacugaagucccuucccucuccc

SEQ ID NO: 213455 - RNA, 32 nt, Human
guguccagaaacaggggcaggagugugggaac

SEQ ID NO: 213456 - RNA, 32 nt, Human
guguccagacaggagaggaagagauggugccu

SEQ ID NO: 213457 - RNA, 32 nt, Human
guguccagagccccaaaccaggauggaguugu

SEQ ID NO: 213458 - RNA, 32 nt, Human
guguccagcagcuaccucagugacacccagag

SEQ ID NO: 213459 - RNA, 32 nt, Human
guguccagcaugacgguguccaugccuuccau

SEQ ID NO: 213460 - RNA, 21 nt, Human
guguccagcugggccuggagg

SEQ ID NO: 213461 - RNA, 32 nt, Human
guguccagcuguuaccagcuucugagcuagag

SEQ ID NO: 213462 - RNA, 21 nt, Human
guguccaggagacagaaggag

SEQ ID NO: 213463 - RNA, 32 nt, Human
guguccaggcucuggggaggcccuggggaauu

SEQ ID NO: 213464 - RNA, 32 nt, Human
guguccaggcuggagugcaguggcgugaucuc

SEQ ID NO: 213465 - RNA, 32 nt, Human
guguccaggcuggucugaaacccuugagcuca

SEQ ID NO: 213466 - RNA, 32 nt, Human
guguccagggcagcacaggaggcaggugccca

SEQ ID NO: 213467 - RNA, 32 nt, Human
guguccagggccugauggggcguggccaggca

SEQ ID NO: 213468 - RNA, 32 nt, Human
guguccaggggcuuggagagaccugcgcccac

SEQ ID NO: 213469 - RNA, 24 nt, Human
guguccagucuuuuuaaacuugua

SEQ ID NO: 213470 - RNA, 32 nt, Human
guguccauaggaguccaucaaggcagagcggc

SEQ ID NO: 213471 - RNA, 24 nt, Human
guguccauaugugucuguaagaga

SEQ ID NO: 213472 - RNA, 32 nt, Human
guguccaucagccuggugcuaaucccccagug

SEQ ID NO: 213473 - RNA, 32 nt, Human
guguccauccacaaaggggcagaaggagggag

SEQ ID NO: 213474 - RNA, 32 nt, Human
guguccaucuguuauauguaaaggacaaggca

SEQ ID NO: 213475 - RNA, 32 nt, Human
guguccaugcauauacauacaugauacacaug

SEQ ID NO: 213476 - RNA, 32 nt, Human
guguccaugccucugcuuccucaggccccagg

SEQ ID NO: 213477 - RNA, 32 nt, Human
guguccauggaacuuccucucuguaucucagg

SEQ ID NO: 213478 - RNA, 27 nt, Human
guguccauggcuggagccgacccuuug

SEQ ID NO: 213479 - RNA, 22 nt, Human
guguccaugggacaaaaaagaa

SEQ ID NO: 213480 - RNA, 31 nt, Human
guguccaugucugcuuacucugugccuucaa

SEQ ID NO: 213481 - RNA, 21 nt, Human
guguccauuaaccaacuucug

SEQ ID NO: 213482 - RNA, 32 nt, Human
guguccauucuuugccuuccuggagcucccag

SEQ ID NO: 213483 - RNA, 32 nt, Human
gugucccaacccaagaagcugaaaguccugug

SEQ ID NO: 213484 - RNA, 32 nt, Human
gugucccacagaacuucccacuguggaucugu

SEQ ID NO: 213485 - RNA, 28 nt, Human
gugucccacagugcugcgcuagucccuu

SEQ ID NO: 213486 - RNA, 32 nt, Human
gugucccacccuccccuccugacccuccuacg

SEQ ID NO: 213487 - RNA, 32 nt, Human
gugucccacuagcgggcucuucgcaagaaucc

SEQ ID NO: 213488 - RNA, 32 nt, Human
gugucccagacccuaaggcagaggcugggaaa

SEQ ID NO: 213489 - RNA, 32 nt, Human
gugucccagcagaucaguggcauggaaccauc

SEQ ID NO: 213490 - RNA, 32 nt, Human
gugucccagccaaagaaaacccccaccacggu

SEQ ID NO: 213491 - RNA, 32 nt, Human
gugucccaggcagaaaggugcagagacccauc

SEQ ID NO: 213492 - RNA, 32 nt, Human
gugucccaggcagggagacgguuuccagggag

SEQ ID NO: 213493 - RNA, 32 nt, Human
gugucccagggggagccccgcucugcagcccu

SEQ ID NO: 213494 - RNA, 32 nt, Human
gugucccaggguggaagguggggagggggccg

SEQ ID NO: 213495 - RNA, 24 nt, Human
gugucccaucaugcuuuccacuga

SEQ ID NO: 213496 - RNA, 21 nt, Human
gugucccaugacuuugccauc

SEQ ID NO: 213497 - RNA, 32 nt, Human
guguccccaagugccaugacccaggagccauu

SEQ ID NO: 213498 - RNA, 32 nt, Human
guguccccacuguaccagccucugauaagcug

SEQ ID NO: 213499 - RNA, 32 nt, Human
guguccccagagccauggagagagccagucug

SEQ ID NO: 213500 - RNA, 32 nt, Human
guguccccaggaggccuuuggggcuggggugg

SEQ ID NO: 213501 - RNA, 32 nt, Human
guguccccagggcugagcaccaccccacgccc

SEQ ID NO: 213502 - RNA, 32 nt, Human
guguccccaguuccgucucagcuaccuggacu

SEQ ID NO: 213503 - RNA, 32 nt, Human
guguccccauggcucccacugcagccucgagu

SEQ ID NO: 213504 - RNA, 32 nt, Human
gugucccccaggcuggagugcaguggcacaau

SEQ ID NO: 213505 - RNA, 32 nt, Human
gugucccccugccgaacaaagcugggaguaaa

SEQ ID NO: 213506 - RNA, 32 nt, Human
gugucccccuggcugcccuguguccccuccgc

SEQ ID NO: 213507 - RNA, 32 nt, Human
gugucccccuucuccccugccccuacugccag

SEQ ID NO: 213508 - RNA, 32 nt, Human
guguccccgcagugccugguguccagguggaa

SEQ ID NO: 213509 - RNA, 32 nt, Human
guguccccggcagccacacacagccaugcacu

SEQ ID NO: 213510 - RNA, 32 nt, Human
guguccccgugcaguaggggcuacugugacca

SEQ ID NO: 213511 - RNA, 32 nt, Human
guguccccuauuaggcaggaguuacaaaguuu

SEQ ID NO: 213512 - RNA, 32 nt, Human
guguccccucacugcccucugguguccuguca

SEQ ID NO: 213513 - RNA, 32 nt, Human
guguccccuccccucaggcucugccuuggccu

SEQ ID NO: 213514 - RNA, 32 nt, Human
guguccccuccccuccaucucucuuccccaua

SEQ ID NO: 213515 - RNA, 32 nt, Human
guguccccugcagcuccagccccgggcugcac

SEQ ID NO: 213516 - RNA, 32 nt, Human
guguccccugcagggggcucagcuggacccuc

SEQ ID NO: 213517 - RNA, 32 nt, Human
guguccccugcauucuggaggggaggggagau

SEQ ID NO: 213518 - RNA, 32 nt, Human
guguccccugccugcacuggcacuuuguccag

SEQ ID NO: 213519 - RNA, 32 nt, Human
guguccccugcuccucaccccugggagcccac

SEQ ID NO: 213520 - RNA, 32 nt, Human
guguccccugcucucuggugucccaauacucu

SEQ ID NO: 213521 - RNA, 32 nt, Human
guguccccugucugcucauccucucucccucu

SEQ ID NO: 213522 - RNA, 32 nt, Human
guguccccuuggcccuggcacacacccaugug

SEQ ID NO: 213523 - RNA, 32 nt, Human
guguccccuuucucccaucuuaaggggcucuc

SEQ ID NO: 213524 - RNA, 32 nt, Human
gugucccgagacuaggacguggcuccaggagu

SEQ ID NO: 213525 - RNA, 32 nt, Human
gugucccgcuccaccagcuuccugggcggcau

SEQ ID NO: 213526 - RNA, 32 nt, Human
gugucccgucacacacugcagcagggaagggu

SEQ ID NO: 213527 - RNA, 32 nt, Human
gugucccuaaggccugguacagugccaagcac

SEQ ID NO: 213528 - RNA, 32 nt, Human
gugucccuacccucacugcucuccugugccca

SEQ ID NO: 213529 - RNA, 25 nt, Human
gugucccucacagucacuugcuaua

SEQ ID NO: 213530 - RNA, 32 nt, Human
gugucccuccacccauuuuccugcauucuguc

SEQ ID NO: 213531 - RNA, 32 nt, Human
gugucccuccacucaggucacguuacuccauc

SEQ ID NO: 213532 - RNA, 32 nt, Human
gugucccuccacugccugcaccacccaccucc

SEQ ID NO: 213533 - RNA, 32 nt, Human
gugucccucucagauucacuuguuaaguccug

SEQ ID NO: 213534 - RNA, 32 nt, Human
gugucccucuuacccaaagggugucaguggcu

SEQ ID NO: 213535 - RNA, 32 nt, Human
gugucccucuuccaccccaaccccugcuggcu

SEQ ID NO: 213536 - RNA, 22 nt, Human
gugucccugcaccaggggcaaa

SEQ ID NO: 213537 - RNA, 32 nt, Human
gugucccugcagaugggggcaguccugugcac

SEQ ID NO: 213538 - RNA, 32 nt, Human
gugucccugcaucugcaggccaugucaaagga

SEQ ID NO: 213539 - RNA, 32 nt, Human
gugucccugccuggcccuccucuggucacuuc

SEQ ID NO: 213540 - RNA, 32 nt, Human
gugucccuggaaccccagcucggagggucuca

SEQ ID NO: 213541 - RNA, 23 nt, Human
gugucccuggcagggccuggaga

SEQ ID NO: 213542 - RNA, 32 nt, Human
gugucccuggcuucugagcuugcccaaaguaa

SEQ ID NO: 213543 - RNA, 32 nt, Human
gugucccugggcagagccaggggugcaaacag

SEQ ID NO: 213544 - RNA, 32 nt, Human
gugucccuggguaguugagauuagggaguggu

SEQ ID NO: 213545 - RNA, 32 nt, Human
gugucccugguccucugggaauagaagaucca

SEQ ID NO: 213546 - RNA, 32 nt, Human
gugucccuguucugaagugccaguggcagcuc

SEQ ID NO: 213547 - RNA, 32 nt, Human
gugucccuucaucugcuccauguccucuacuc

SEQ ID NO: 213548 - RNA, 32 nt, Human
gugucccuuuaaugcuacugugcucucuggug

SEQ ID NO: 213549 - RNA, 32 nt, Human
gugucccuuuucuccacaaccuugccagcauc

SEQ ID NO: 213550 - RNA, 32 nt, Human
guguccgaaaaauguuucuucagcuugagaaa

SEQ ID NO: 213551 - RNA, 26 nt, Human
guguccgccaucagggacauccucug

SEQ ID NO: 213552 - RNA, 23 nt, Human
guguccgccaugguccuccccug

SEQ ID NO: 213553 - RNA, 32 nt, Human
guguccgcgcguggcuugugcgcugacuccug

SEQ ID NO: 213554 - RNA, 23 nt, Human
guguccgcuuuguaggacaccac

SEQ ID NO: 213555 - RNA, 32 nt, Human
guguccggaagaggucuucguggaggccucgc

SEQ ID NO: 213556 - RNA, 32 nt, Human
guguccggacuugcccacagccucaaggagga

SEQ ID NO: 213557 - RNA, 20 nt, Human
guguccgugggcagggggag

SEQ ID NO: 213558 - RNA, 32 nt, Human
guguccguggugaguucuggggugcgccuagg

SEQ ID NO: 213559 - RNA, 32 nt, Human
guguccguggugugcaguuccucuccaauugc

SEQ ID NO: 213560 - RNA, 32 nt, Human
guguccuacuaaaaagaauaaauguuggcagu

SEQ ID NO: 213561 - RNA, 19 nt, Human
guguccuagaauuuugcca

SEQ ID NO: 213562 - RNA, 32 nt, Human
guguccuaggagagugaacagguagauuuaga

SEQ ID NO: 213563 - RNA, 32 nt, Human
guguccuaugaagggguguggggugagguagu

SEQ ID NO: 213564 - RNA, 32 nt, Human
guguccuauugagggaggcuugcugaggcuuc

SEQ ID NO: 213565 - RNA, 32 nt, Human
guguccucaaauauauugcauuuuacccagca

SEQ ID NO: 213566 - RNA, 32 nt, Human
guguccucaccuuuaugcaugacugcaaagcc

SEQ ID NO: 213567 - RNA, 32 nt, Human
guguccucauacauacugccgccugaggugcc

SEQ ID NO: 213568 - RNA, 32 nt, Human
guguccucaugacuucucuuguggaccauguc

SEQ ID NO: 213569 - RNA, 32 nt, Human
guguccucaugugauaaacagagcacagucca

SEQ ID NO: 213570 - RNA, 21 nt, Human
guguccuccacauucuugcca

SEQ ID NO: 213571 - RNA, 32 nt, Human
guguccuccagcccagcccacccgggccuaug

SEQ ID NO: 213572 - RNA, 32 nt, Human
guguccucccagagaggacguggaaccuuccc

SEQ ID NO: 213573 - RNA, 32 nt, Human
guguccucccagaucuaugugucuuucccuuu

SEQ ID NO: 213574 - RNA, 32 nt, Human
guguccucccagggagcuucucuucucaacag

SEQ ID NO: 213575 - RNA, 19 nt, Human
guguccuccccugccccac

SEQ ID NO: 213576 - RNA, 32 nt, Human
guguccucccugugugggugcugguguccaaa

SEQ ID NO: 213577 - RNA, 32 nt, Human
guguccuccuccacuucccaugccucuauguu

SEQ ID NO: 213578 - RNA, 32 nt, Human
guguccuccuggggguuggagaugaucccuca

SEQ ID NO: 213579 - RNA, 32 nt, Human
guguccucuacuuuucugaucucccacaagua

SEQ ID NO: 213580 - RNA, 32 nt, Human
guguccucucaccaacaccacaccccaacaag

SEQ ID NO: 213581 - RNA, 32 nt, Human
guguccucuccucuccgcauccagggccacuu

SEQ ID NO: 213582 - RNA, 27 nt, Human
guguccucugaacuuuaaacucucauc

SEQ ID NO: 213583 - RNA, 32 nt, Human
guguccucugaggacauccucaucaggaaagc

SEQ ID NO: 213584 - RNA, 32 nt, Human
guguccucugcagcuuuugauauguuauucuc

SEQ ID NO: 213585 - RNA, 32 nt, Human
guguccugacacugcaauuggcaccgaagccc

SEQ ID NO: 213586 - RNA, 32 nt, Human
guguccugaccaggcccugcuuaccucuguuu

SEQ ID NO: 213587 - RNA, 31 nt, Human
guguccugacuucugucugccacaugaggag

SEQ ID NO: 213588 - RNA, 32 nt, Human
guguccugagucucauagccacccugccagcu

SEQ ID NO: 213589 - RNA, 32 nt, Human
guguccugccugucugccccagcccagauucc

SEQ ID NO: 213590 - RNA, 19 nt, Human
guguccugcuacaaaaaga

SEQ ID NO: 213591 - RNA, 32 nt, Human
guguccugcuguuccuguuggccccagcugca

SEQ ID NO: 213592 - RNA, 32 nt, Human
guguccuggagugggguagggugguggguggu

SEQ ID NO: 213593 - RNA, 32 nt, Human
guguccuggcagggggacaggagacuguaaca

SEQ ID NO: 213594 - RNA, 32 nt, Human
guguccuggcauuuccccucccucucccugau

SEQ ID NO: 213595 - RNA, 22 nt, Human
guguccuggccagcccuggaga

SEQ ID NO: 213596 - RNA, 32 nt, Human
guguccuggccuggcccugcaguaagaagcgu

SEQ ID NO: 213597 - RNA, 18 nt, Human
guguccugucucccagca

SEQ ID NO: 213598 - RNA, 32 nt, Human
guguccugugugucugguauguuuacaccuug

SEQ ID NO: 213599 - RNA, 32 nt, Human
guguccuuaccaccuaagggcauuucagagcc

SEQ ID NO: 213600 - RNA, 32 nt, Human
guguccuuccaagagacagaagaggagacaca

SEQ ID NO: 213601 - RNA, 19 nt, Human
guguccuucguccuggaga

SEQ ID NO: 213602 - RNA, 32 nt, Human
guguccuucugggaugaggaugacagagcaac

SEQ ID NO: 213603 - RNA, 32 nt, Human
guguccuugaacugaggcccugugauauggcg

SEQ ID NO: 213604 - RNA, 32 nt, Human
guguccuugcggugcugggcagcagaccgucc

SEQ ID NO: 213605 - RNA, 29 nt, Human
guguccuugcugccuucauccccuggggc

SEQ ID NO: 213606 - RNA, 32 nt, Human
guguccuuggcagugcugcuacuccucaggug

SEQ ID NO: 213607 - RNA, 17 nt, Human
guguccuuguccagggg

SEQ ID NO: 213608 - RNA, 32 nt, Human
guguccuugucccugcucaccucucuggucuc

SEQ ID NO: 213609 - RNA, 32 nt, Human
guguccuuguguccugcagguaucugcagauu

SEQ ID NO: 213610 - RNA, 32 nt, Human
guguccuuuaaaucugaacuugcucuugcuca

SEQ ID NO: 213611 - RNA, 32 nt, Human
guguccuuucagaauuuuuaccaggaacauaa

SEQ ID NO: 213612 - RNA, 32 nt, Human
gugucgacuucuacgacgucgccuucaagguc

SEQ ID NO: 213613 - RNA, 23 nt, Human
gugucgagggaccaugccagcaa

SEQ ID NO: 213614 - RNA, 32 nt, Human
gugucgagugggcucugggcuggggucggccc

SEQ ID NO: 213615 - RNA, 23 nt, Human
gugucgaucuccugaccucauga

SEQ ID NO: 213616 - RNA, 32 nt, Human
gugucgcacaagugccugguggugggccugga

SEQ ID NO: 213617 - RNA, 32 nt, Human
gugucgcacugccucccacccugugucugcuu

SEQ ID NO: 213618 - RNA, 32 nt, Human
gugucgcaucuucuccagcgcugggcccuccc

SEQ ID NO: 213619 - RNA, 32 nt, Human
gugucgccaaggcuggagugcaguggugcgau

SEQ ID NO: 213620 - RNA, 32 nt, Human
gugucgcccagacuggagugcaguggugggau

SEQ ID NO: 213621 - RNA, 32 nt, Human
gugucgcccaggcuggagugcaaguggcauga

SEQ ID NO: 213622 - RNA, 32 nt, Human
gugucgcccaggcuggagugcagugagcugag

SEQ ID NO: 213623 - RNA, 32 nt, Human
gugucgcccaggcuggagugcaguggcgugau

SEQ ID NO: 213624 - RNA, 32 nt, Human
gugucgccgccaccccagcguaguccaaguca

SEQ ID NO: 213625 - RNA, 32 nt, Human
gugucgccuacccacccucccccagacccccg

SEQ ID NO: 213626 - RNA, 32 nt, Human
gugucgccuaggcuggagugcaguggcgugau

SEQ ID NO: 213627 - RNA, 32 nt, Human
gugucgcgccuguaaucccagcacuuugggag

SEQ ID NO: 213628 - RNA, 32 nt, Human
gugucgcgcugggcugggccuggguggccucu

SEQ ID NO: 213629 - RNA, 32 nt, Human
gugucgcgucugcagugugugggguucgcggg

SEQ ID NO: 213630 - RNA, 32 nt, Human
gugucgcucccugguccacuguuucuccuaua

SEQ ID NO: 213631 - RNA, 32 nt, Human
gugucggagauggcggggcuucagcaccucgg

SEQ ID NO: 213632 - RNA, 32 nt, Human
gugucggagaugucacauagccucauuuauga

SEQ ID NO: 213633 - RNA, 32 nt, Human
gugucggcaguccugcacuccuucuggaggcu

SEQ ID NO: 213634 - RNA, 32 nt, Human
gugucgggagcagggagccaccuucaccugcg

SEQ ID NO: 213635 - RNA, 32 nt, Human
gugucgggcacgaagaaaugagugucacuuuc

SEQ ID NO: 213636 - RNA, 32 nt, Human
gugucgggcuguagcugcuggucccagagagu

SEQ ID NO: 213637 - RNA, 32 nt, Human
gugucggguagagggaagagggcagggggcua

SEQ ID NO: 213638 - RNA, 32 nt, Human
gugucggucauugugccacguccuuggaaccg

SEQ ID NO: 213639 - RNA, 21 nt, Human
gugucggugccgcggugggag

SEQ ID NO: 213640 - RNA, 20 nt, Human
gugucgguggggggugggag

SEQ ID NO: 213641 - RNA, 32 nt, Human
gugucguagagagcagauaugaaggaagaaau

SEQ ID NO: 213642 - RNA, 32 nt, Human
gugucguggcugcuccaaaugccccuucauga

SEQ ID NO: 213643 - RNA, 32 nt, Human
gugucgugugggccucacagcuggccuugagu

SEQ ID NO: 213644 - RNA, 32 nt, Human
gugucguucauucaaggagaguugagauacag

SEQ ID NO: 213645 - RNA, 32 nt, Human
gugucuaaaucuguaggcauuguguuguuguu

SEQ ID NO: 213646 - RNA, 32 nt, Human
gugucuaacauacaguaacaucuaacucagcu

SEQ ID NO: 213647 - RNA, 32 nt, Human
gugucuaagauucuagaucagaugcuccaaga

SEQ ID NO: 213648 - RNA, 32 nt, Human
gugucuaauguuuuucuuucuucuauuucuag

SEQ ID NO: 213649 - RNA, 32 nt, Human
gugucuacaggcccaacuccugccucacaaca

SEQ ID NO: 213650 - RNA, 32 nt, Human
gugucuacaggcccaacugcugccucacaaca

SEQ ID NO: 213651 - RNA, 21 nt, Human
gugucuaccuuccgcccucug

SEQ ID NO: 213652 - RNA, 32 nt, Human
gugucuacuccaggccaagccugggcugcagu

SEQ ID NO: 213653 - RNA, 32 nt, Human
gugucuagcacagaauggggcacacaguaggu

SEQ ID NO: 213654 - RNA, 32 nt, Human
gugucuagcaguucuugguaagcuacucugga

SEQ ID NO: 213655 - RNA, 24 nt, Human
gugucuagcccaguggaccuucug

SEQ ID NO: 213656 - RNA, 32 nt, Human
gugucuaugaagcugucuugugccagugagaa

SEQ ID NO: 213657 - RNA, 22 nt, Human
gugucuauggucgggcccucug

SEQ ID NO: 213658 - RNA, 32 nt, Human
gugucuauggucgggcccucugcguccagcug

SEQ ID NO: 213659 - RNA, 32 nt, Human
gugucuauggugcugcaccuugcuguuguacu

SEQ ID NO: 213660 - RNA, 32 nt, Human
gugucuauggugcugcaucuugcuguuguacu

SEQ ID NO: 213661 - RNA, 32 nt, Human
gugucuauguguguguuucagcacuuuguaaa

SEQ ID NO: 213662 - RNA, 32 nt, Human
gugucuauucaggccuugcggaggcgcccaga

SEQ ID NO: 213663 - RNA, 32 nt, Human
gugucuauuccugcuuccuccaccucaccuug

SEQ ID NO: 213664 - RNA, 32 nt, Human
gugucuauuuuuagguggaugaguugcuaugu

SEQ ID NO: 213665 - RNA, 21 nt, Human
gugucucacacacaaaaagaa

SEQ ID NO: 213666 - RNA, 19 nt, Human
gugucucacaccuguaauc

SEQ ID NO: 213667 - RNA, 22 nt, Human
gugucucacaccuguaauccca

SEQ ID NO: 213668 - RNA, 20 nt, Human
gugucucaccagccuggaga

SEQ ID NO: 213669 - RNA, 32 nt, Human
gugucucaccagccuggagaugucugcugugu

SEQ ID NO: 213670 - RNA, 32 nt, Human
gugucucacccuacuaagaauuggcagaaaug

SEQ ID NO: 213671 - RNA, 32 nt, Human
gugucucacugagaacaccaacccacacccug

SEQ ID NO: 213672 - RNA, 32 nt, Human
gugucucagaaaaucuguguguguacaugugc

SEQ ID NO: 213673 - RNA, 32 nt, Human
gugucucagcccggugcugggccuggccgagg

SEQ ID NO: 213674 - RNA, 32 nt, Human
gugucucagcucuuguucugugccugagaaug

SEQ ID NO: 213675 - RNA, 32 nt, Human
gugucucaggagagaggggugcacguuucaug

SEQ ID NO: 213676 - RNA, 32 nt, Human
gugucucagggugggcaguggggguggggcug

SEQ ID NO: 213677 - RNA, 19 nt, Human
gugucucaugccuguaauc

SEQ ID NO: 213678 - RNA, 32 nt, Human
gugucuccaagauggccgcuuggggaaggagg

SEQ ID NO: 213679 - RNA, 23 nt, Human
gugucuccaagcagccagccauc

SEQ ID NO: 213680 - RNA, 22 nt, Human
gugucuccaagcccccaccauc

SEQ ID NO: 213681 - RNA, 32 nt, Human
gugucuccacacgccagccacaggggagcccu

SEQ ID NO: 213682 - RNA, 32 nt, Human
gugucuccccugggaggcucccccucugugua

SEQ ID NO: 213683 - RNA, 32 nt, Human
gugucucccucuucuaucaccucucuccagga

SEQ ID NO: 213684 - RNA, 32 nt, Human
gugucucccugagucccgacugcacugacugg

SEQ ID NO: 213685 - RNA, 32 nt, Human
gugucucccugcagauuggggcucccugagga

SEQ ID NO: 213686 - RNA, 32 nt, Human
gugucucccugccucauuccccacaucccacu

SEQ ID NO: 213687 - RNA, 22 nt, Human
gugucucccuuuucuagcugug

SEQ ID NO: 213688 - RNA, 32 nt, Human
gugucuccucaagccuuaccuuucucaggugu

SEQ ID NO: 213689 - RNA, 32 nt, Human
gugucuccucaccucugcuccugucuucauca

SEQ ID NO: 213690 - RNA, 32 nt, Human
gugucuccuccuccucaucuuagcuuccaggu

SEQ ID NO: 213691 - RNA, 32 nt, Human
gugucuccucuccaucucugccuuuguuacca

SEQ ID NO: 213692 - RNA, 32 nt, Human
gugucuccugccgcugguggcacuuuguagau

SEQ ID NO: 213693 - RNA, 32 nt, Human
gugucuccugggaggcaugaagggggcaaggu

SEQ ID NO: 213694 - RNA, 32 nt, Human
gugucuccuguacuucccaaaauuucuccucc

SEQ ID NO: 213695 - RNA, 32 nt, Human
gugucuccuucggccccuccucccucuuuucc

SEQ ID NO: 213696 - RNA, 32 nt, Human
gugucuccuugcaucccagccucgucuaugca

SEQ ID NO: 213697 - RNA, 32 nt, Human
gugucuccuuucucucccacugcaacuccacu

SEQ ID NO: 213698 - RNA, 21 nt, Human
gugucucgaguggcuaccugu

SEQ ID NO: 213699 - RNA, 32 nt, Human
gugucucuaagaggaauuuuuagaugucaguu

SEQ ID NO: 213700 - RNA, 32 nt, Human
gugucucuacagcuaggcccagccuagcccag

SEQ ID NO: 213701 - RNA, 32 nt, Human
gugucucuacagucccuucuuccauggagcug

SEQ ID NO: 213702 - RNA, 32 nt, Human
gugucucuacuuccccuguuugccuugugggu

SEQ ID NO: 213703 - RNA, 32 nt, Human
gugucucuagccugcagagugcagugagugag

SEQ ID NO: 213704 - RNA, 32 nt, Human
gugucucucacggcugcuccauccuagccccc

SEQ ID NO: 213705 - RNA, 32 nt, Human
gugucucucauggauuguuuagagucuaaaga

SEQ ID NO: 213706 - RNA, 32 nt, Human
gugucucucccacggcugcaggucagaggauu

SEQ ID NO: 213707 - RNA, 32 nt, Human
gugucucuccccugcugcgggcgcccccaccc

SEQ ID NO: 213708 - RNA, 32 nt, Human
gugucucugcagcuggccuccggagccuuccu

SEQ ID NO: 213709 - RNA, 32 nt, Human
gugucucugccccucucugugccugcaaaccu

SEQ ID NO: 213710 - RNA, 32 nt, Human
gugucucugccuggguccccuggccgguuguc

SEQ ID NO: 213711 - RNA, 32 nt, Human
gugucucugugcauguguaugugcguaugcau

SEQ ID NO: 213712 - RNA, 32 nt, Human
gugucucuucucuccacaucuguaacuucuuu

SEQ ID NO: 213713 - RNA, 32 nt, Human
gugucucuugcccagggaguccucuccacucc

SEQ ID NO: 213714 - RNA, 32 nt, Human
gugucugaaagcugggacacacaauauuuccc

SEQ ID NO: 213715 - RNA, 32 nt, Human
gugucugaacaaggcagggcaggugcugagug

SEQ ID NO: 213716 - RNA, 32 nt, Human
gugucugaacagaaccgcuccgugacugguag

SEQ ID NO: 213717 - RNA, 32 nt, Human
gugucugaacuccaaggaauaugaacaagaug

SEQ ID NO: 213718 - RNA, 32 nt, Human
gugucugagaauuccuccuccugggacucuca

SEQ ID NO: 213719 - RNA, 32 nt, Human
gugucugagagggaguuggagagcugguuggu

SEQ ID NO: 213720 - RNA, 32 nt, Human
gugucugagaugggccccucuuuucagaggcc

SEQ ID NO: 213721 - RNA, 32 nt, Human
gugucugagcaccuccagcagaugucacucug

SEQ ID NO: 213722 - RNA, 32 nt, Human
gugucugaguaccauucacuggaguugcugcu

SEQ ID NO: 213723 - RNA, 22 nt, Human
gugucugcaccaccagccccug

SEQ ID NO: 213724 - RNA, 32 nt, Human
gugucugcaccugaggcccucugugguaccuc

SEQ ID NO: 213725 - RNA, 32 nt, Human
gugucugcaccugaggugcucugugauaccuu

SEQ ID NO: 213726 - RNA, 32 nt, Human
gugucugcagacaagucuugcugugcuuuauu

SEQ ID NO: 213727 - RNA, 32 nt, Human
gugucugcagcugcugcccuucucccaggccc

SEQ ID NO: 213728 - RNA, 32 nt, Human
gugucugcauaaacccuccuguccuggacgug

SEQ ID NO: 213729 - RNA, 32 nt, Human
gugucugcauuuucaaccuguugcaauaacuu

SEQ ID NO: 213730 - RNA, 32 nt, Human
gugucugcccuucacaaacaccucucucuccc

SEQ ID NO: 213731 - RNA, 32 nt, Human
gugucugccuccauaugcaucugggcauuuca

SEQ ID NO: 213732 - RNA, 23 nt, Human
gugucugccucgcuuccuggaga

SEQ ID NO: 213733 - RNA, 32 nt, Human
gugucugccucguucccuccccuggugccugu

SEQ ID NO: 213734 - RNA, 32 nt, Human
gugucugccugccucaugcucucuauagagga

SEQ ID NO: 213735 - RNA, 32 nt, Human
gugucugccugggauaaaauauuuuccccauc

SEQ ID NO: 213736 - RNA, 32 nt, Human
gugucugccuguccccaaacaggacagcacug

SEQ ID NO: 213737 - RNA, 18 nt, Human
gugucugccuucuggaga

SEQ ID NO: 213738 - RNA, 31 nt, Human
gugucugcggcgcugccucagcgugcuaauc

SEQ ID NO: 213739 - RNA, 32 nt, Human
gugucugcggucacaguggccccugggcaggg

SEQ ID NO: 213740 - RNA, 32 nt, Human
gugucugcgugugguuauauguauauuuucca

SEQ ID NO: 213741 - RNA, 32 nt, Human
gugucugcuaauguaaacuuugucaugguuuc

SEQ ID NO: 213742 - RNA, 32 nt, Human
gugucugcuacugcugggacucaggcccucgc

SEQ ID NO: 213743 - RNA, 32 nt, Human
gugucugcuagccucaaccuccuggggcaggg

SEQ ID NO: 213744 - RNA, 32 nt, Human
gugucugcucacugcugccaucuucgcugcua

SEQ ID NO: 213745 - RNA, 32 nt, Human
gugucugcugccgagaagcccgugcccccggg

SEQ ID NO: 213746 - RNA, 32 nt, Human
gugucugcugcucaccuggcucuggagggcug

SEQ ID NO: 213747 - RNA, 32 nt, Human
gugucugcuuucaagcaccacacccacccaga

SEQ ID NO: 213748 - RNA, 32 nt, Human
gugucuggaacacgcugcuccccugggcagcu

SEQ ID NO: 213749 - RNA, 32 nt, Human
gugucuggaagacccaaggaaggggcuucugg

SEQ ID NO: 213750 - RNA, 32 nt, Human
gugucuggaauagaacagugguuugaaaagua

SEQ ID NO: 213751 - RNA, 32 nt, Human
gugucuggaguguggagugaaaugccacgaaa

SEQ ID NO: 213752 - RNA, 32 nt, Human
gugucuggcggugccccagcagcccuggauuc

SEQ ID NO: 213753 - RNA, 32 nt, Human
gugucuggcucucaucugcacaaucgugcaua

SEQ ID NO: 213754 - RNA, 32 nt, Human
gugucugggagcacagugagaccaugggagca

SEQ ID NO: 213755 - RNA, 32 nt, Human
gugucugggaggaaagcauggcccagcauuca

SEQ ID NO: 213756 - RNA, 32 nt, Human
gugucuggguguuacagucugugcccacugca

SEQ ID NO: 213757 - RNA, 32 nt, Human
gugucugguaacagcagcaaugcuuagaaaau

SEQ ID NO: 213758 - RNA, 32 nt, Human
gugucuggucagugcaaaccugggcugugggg

SEQ ID NO: 213759 - RNA, 32 nt, Human
gugucuggucuguccucccuguugauuggucu

SEQ ID NO: 213760 - RNA, 22 nt, Human
gugucuguacauaaucuggaga

SEQ ID NO: 213761 - RNA, 18 nt, Human
gugucuguacguaggaga

SEQ ID NO: 213762 - RNA, 16 nt, Human
gugucuguaucggaga

SEQ ID NO: 213763 - RNA, 25 nt, Human
gugucugucaaggaucuuugucgug

SEQ ID NO: 213764 - RNA, 32 nt, Human
gugucugucccagggcuggagaugcuucccaa

SEQ ID NO: 213765 - RNA, 32 nt, Human
gugucuguccgcagacugggaugagucuacuc

SEQ ID NO: 213766 - RNA, 23 nt, Human
gugucugucuggugugugcugug

SEQ ID NO: 213767 - RNA, 32 nt, Human
gugucugucuuugguaacugagugaaccauaa

SEQ ID NO: 213768 - RNA, 18 nt, Human
gugucugugagcugugga

SEQ ID NO: 213769 - RNA, 20 nt, Human
gugucugugaugguccggag

SEQ ID NO: 213770 - RNA, 18 nt, Human
gugucugugauggugaga

SEQ ID NO: 213771 - RNA, 18 nt, Human
gugucugugauguuugga

SEQ ID NO: 213772 - RNA, 20 nt, Human
gugucugugcaaacuggagg

SEQ ID NO: 213773 - RNA, 21 nt, Human
gugucugugcagccagcggga

SEQ ID NO: 213774 - RNA, 22 nt, Human
gugucugugcagccagcgggag

SEQ ID NO: 213775 - RNA, 20 nt, Human
gugucugugcaugggccugg

SEQ ID NO: 213776 - RNA, 18 nt, Human
gugucugugccuugguga

SEQ ID NO: 213777 - RNA, 32 nt, Human
gugucugugcgugugggcgugugugcaagcga

SEQ ID NO: 213778 - RNA, 19 nt, Human
gugucugugcucgugggga

SEQ ID NO: 213779 - RNA, 20 nt, Human
gugucugugcugcaaggagg

SEQ ID NO: 213780 - RNA, 32 nt, Human
gugucugugcugcguuugugagcugcaacgcu

SEQ ID NO: 213781 - RNA, 32 nt, Human
gugucuguggacacucccacacccaacucugc

SEQ ID NO: 213782 - RNA, 18 nt, Human
gugucuguggacuagaga

SEQ ID NO: 213783 - RNA, 32 nt, Human
gugucuguggggucuccuccucccagaucccc

SEQ ID NO: 213784 - RNA, 32 nt, Human
gugucugugggucccccugagggcaacggcag

SEQ ID NO: 213785 - RNA, 19 nt, Human
gugucuguggugccagagg

SEQ ID NO: 213786 - RNA, 21 nt, Human
gugucugugguuaggauagca

SEQ ID NO: 213787 - RNA, 21 nt, Human
gugucuguguauguugucaug

SEQ ID NO: 213788 - RNA, 18 nt, Human
gugucugugucccucaga

SEQ ID NO: 213789 - RNA, 32 nt, Human
gugucugugucccugauuacuugagauuaggg

SEQ ID NO: 213790 - RNA, 17 nt, Human
gugucugugucuaggga

SEQ ID NO: 213791 - RNA, 15 nt, Human
gugucugugucugga

SEQ ID NO: 213792 - RNA, 32 nt, Human
gugucugugugaaucuuugugccuguaugagc

SEQ ID NO: 213793 - RNA, 17 nt, Human
gugucugugugagugag

SEQ ID NO: 213794 - RNA, 18 nt, Human
gugucugugugaugggga

SEQ ID NO: 213795 - RNA, 32 nt, Human
gugucugugugccagcccugcucucagcacuu

SEQ ID NO: 213796 - RNA, 19 nt, Human
gugucugugugcgagugga

SEQ ID NO: 213797 - RNA, 20 nt, Human
gugucuguguggcacagaga

SEQ ID NO: 213798 - RNA, 19 nt, Human
gugucugugugucuuugga

SEQ ID NO: 213799 - RNA, 21 nt, Human
gugucugugugugccugugag

SEQ ID NO: 213800 - RNA, 32 nt, Human
gugucuguguguggaaguuuuauccgguccuu

SEQ ID NO: 213801 - RNA, 32 nt, Human
gugucugugugugggaauugguaucuugcacc

SEQ ID NO: 213802 - RNA, 22 nt, Human
gugucugugugugugccuggag

SEQ ID NO: 213803 - RNA, 19 nt, Human
gugucugugugugugcuug

SEQ ID NO: 213804 - RNA, 19 nt, Human
gugucuguguguuugggag

SEQ ID NO: 213805 - RNA, 23 nt, Human
gugucuguuaaaugaaugucaua

SEQ ID NO: 213806 - RNA, 24 nt, Human
gugucuguuaaguggucuuuucau

SEQ ID NO: 213807 - RNA, 32 nt, Human
gugucuguuaccaagcaaagccaguuaaagaa

SEQ ID NO: 213808 - RNA, 32 nt, Human
gugucuguuccuggccaggccugaggucggcg

SEQ ID NO: 213809 - RNA, 18 nt, Human
gugucuguucucugggga

SEQ ID NO: 213810 - RNA, 32 nt, Human
gugucuguuuaugggggugguuuauuauuuuu

SEQ ID NO: 213811 - RNA, 32 nt, Human
gugucuuaaggagacugguaggaggaggcaug

SEQ ID NO: 213812 - RNA, 32 nt, Human
gugucuuaauuucucaauuccuuuuuggcaag

SEQ ID NO: 213813 - RNA, 32 nt, Human
gugucuuacacaagcuggacucuuucacccag

SEQ ID NO: 213814 - RNA, 32 nt, Human
gugucuuacaccauuugccuugcuuuuuaaau

SEQ ID NO: 213815 - RNA, 32 nt, Human
gugucuuacugugcuucaacuucccaaggaau

SEQ ID NO: 213816 - RNA, 32 nt, Human
gugucuuagagaaaggacacaugggcuuggga

SEQ ID NO: 213817 - RNA, 32 nt, Human
gugucuuaguccauuucaagcugcuauaacag

SEQ ID NO: 213818 - RNA, 32 nt, Human
gugucuucaaauccucaccaacauccaggauu

SEQ ID NO: 213819 - RNA, 32 nt, Human
gugucuucaacuuauuagaauggaagauaaug

SEQ ID NO: 213820 - RNA, 32 nt, Human
gugucuucacuagaacaccauugucaucucau

SEQ ID NO: 213821 - RNA, 32 nt, Human
gugucuucagacccacuuuuucauacacuugc

SEQ ID NO: 213822 - RNA, 32 nt, Human
gugucuucagcuuugcaaacuggaugaacuag

SEQ ID NO: 213823 - RNA, 22 nt, Human
gugucuucaguucauucuguca

SEQ ID NO: 213824 - RNA, 32 nt, Human
gugucuucaugaacccagaggauguccgggaa

SEQ ID NO: 213825 - RNA, 32 nt, Human
gugucuucauucucucgcacauuuccacagca

SEQ ID NO: 213826 - RNA, 32 nt, Human
gugucuucauucugugaguuaccaccucaagu

SEQ ID NO: 213827 - RNA, 32 nt, Human
gugucuuccaacaaagcuggaacugccaguau

SEQ ID NO: 213828 - RNA, 32 nt, Human
gugucuuccauggaagggggacaaugguuauc

SEQ ID NO: 213829 - RNA, 32 nt, Human
gugucuucccauuaacccccugccuuaguuaa

SEQ ID NO: 213830 - RNA, 22 nt, Human
gugucuuccuaggcagccccug

SEQ ID NO: 213831 - RNA, 32 nt, Human
gugucuuccugacuccagccucugagacagaa

SEQ ID NO: 213832 - RNA, 32 nt, Human
gugucuuccuggcaacugcugccuuuguugcu

SEQ ID NO: 213833 - RNA, 32 nt, Human
gugucuucguggagcccaccaggcuggugucg

SEQ ID NO: 213834 - RNA, 18 nt, Human
gugucuucugaauucacu

SEQ ID NO: 213835 - RNA, 32 nt, Human
gugucuucugagcgucuucuaagacaauugca

SEQ ID NO: 213836 - RNA, 32 nt, Human
gugucuucuguggagcucugagaacaggacuc

SEQ ID NO: 213837 - RNA, 32 nt, Human
gugucuugagacuuuaucaugugucuucugcc

SEQ ID NO: 213838 - RNA, 18 nt, Human
gugucuugagccuggagg

SEQ ID NO: 213839 - RNA, 32 nt, Human
gugucuuggcaucccuuccugccguccuugac

SEQ ID NO: 213840 - RNA, 32 nt, Human
gugucuugggcagagcuggcucugagcgccuc

SEQ ID NO: 213841 - RNA, 32 nt, Human
gugucuuuacaccauuuauuucuuuuaucucu

SEQ ID NO: 213842 - RNA, 32 nt, Human
gugucuuuacauauuuguuuaugauggccaca

SEQ ID NO: 213843 - RNA, 32 nt, Human
gugucuuucuuuccuuccuccuucuucucucu

SEQ ID NO: 213844 - RNA, 32 nt, Human
gugucuuugagcauuucucuucauuccuggaa

SEQ ID NO: 213845 - RNA, 32 nt, Human
gugucuuugccugucuguacucaugccugacc

SEQ ID NO: 213846 - RNA, 32 nt, Human
gugucuuuucaauaucuuuucauuuucuccca

SEQ ID NO: 213847 - RNA, 32 nt, Human
gugucuuuucuccugguuuuggagucuugcac

SEQ ID NO: 213848 - RNA, 32 nt, Human
gugucuuuugcagcccagacaaaugugguuac

SEQ ID NO: 213849 - RNA, 32 nt, Human
gugucuuuuugcugcauuuuacucacacacga

SEQ ID NO: 213850 - RNA, 32 nt, Human
gugugaaacaucuucagggcgggaaaggggcc

SEQ ID NO: 213851 - RNA, 32 nt, Human
gugugaaacaucuucagggugggaaaggggcc

SEQ ID NO: 213852 - RNA, 32 nt, Human
gugugaaaguuccagaccaggccacagcgagc

SEQ ID NO: 213853 - RNA, 32 nt, Human
gugugaacccaggaggcggagcuugcagugag

SEQ ID NO: 213854 - RNA, 32 nt, Human
gugugaacccaggaggcggugcuugcagggag

SEQ ID NO: 213855 - RNA, 32 nt, Human
gugugaacccgggagcggagguugcagugagc

SEQ ID NO: 213856 - RNA, 32 nt, Human
gugugaaccucaccuccuggggcuuccgagcu

SEQ ID NO: 213857 - RNA, 32 nt, Human
gugugaacucaggcuuuucauugggcccggcu

SEQ ID NO: 213858 - RNA, 32 nt, Human
gugugaagacaggcagaugcugcacagugaau

SEQ ID NO: 213859 - RNA, 32 nt, Human
gugugaagacgcugccucccacaucaccuuuc

SEQ ID NO: 213860 - RNA, 32 nt, Human
gugugaagcaguauaaugaagccagaccaaga

SEQ ID NO: 213861 - RNA, 32 nt, Human
gugugaagccaaaaucacccugcagcagagcc

SEQ ID NO: 213862 - RNA, 32 nt, Human
gugugaagcugcauuguuggguaaaagccccg

SEQ ID NO: 213863 - RNA, 32 nt, Human
gugugaagcuggacgugaugcaaaauaaccga

SEQ ID NO: 213864 - RNA, 32 nt, Human
gugugaagcuuagguguaagcccagggcucuu

SEQ ID NO: 213865 - RNA, 32 nt, Human
gugugaagcuuccuuggcuuuuacugaagccu

SEQ ID NO: 213866 - RNA, 32 nt, Human
gugugaaggagagaggacacaggggaugacug

SEQ ID NO: 213867 - RNA, 32 nt, Human
gugugaaggugaacaggauggccuggcagcag

SEQ ID NO: 213868 - RNA, 32 nt, Human
gugugaaguguaguggcauccauuucuaaugu

SEQ ID NO: 213869 - RNA, 32 nt, Human
gugugaauaccugaaaccugccuaccucauag

SEQ ID NO: 213870 - RNA, 32 nt, Human
gugugaauaguguucacaaacugugaaaauag

SEQ ID NO: 213871 - RNA, 32 nt, Human
gugugaauccagugguggagguugcagugagc

SEQ ID NO: 213872 - RNA, 32 nt, Human
gugugaaucgaggggcgggcuuuuggcaggca

SEQ ID NO: 213873 - RNA, 32 nt, Human
gugugacaccugcuugacagaggcagggcugu

SEQ ID NO: 213874 - RNA, 32 nt, Human
gugugacaggaaaaucuguagagaagaggcac

SEQ ID NO: 213875 - RNA, 32 nt, Human
gugugacagggcuggagggaagggcacagggg

SEQ ID NO: 213876 - RNA, 32 nt, Human
gugugacaucagaguauuugaccugcaguauu

SEQ ID NO: 213877 - RNA, 32 nt, Human
gugugacauucagcuaacauugaucuaggcac

SEQ ID NO: 213878 - RNA, 32 nt, Human
gugugaccacugaagcaccacagggagggguu

SEQ ID NO: 213879 - RNA, 32 nt, Human
gugugaccagcccuggccaugcuugcugggug

SEQ ID NO: 213880 - RNA, 24 nt, Human
gugugaccauaggcaaguuacuua

SEQ ID NO: 213881 - RNA, 32 nt, Human
gugugacccacugcgcacagccccagcuaauu

SEQ ID NO: 213882 - RNA, 32 nt, Human
gugugacccagcugccacccaccuccuccauc

SEQ ID NO: 213883 - RNA, 32 nt, Human
gugugacccugacucauccagacccuguagag

SEQ ID NO: 213884 - RNA, 24 nt, Human
gugugacccugggcaagucacuua

SEQ ID NO: 213885 - RNA, 32 nt, Human
gugugaccuagaucuccccucucuccacccuc

SEQ ID NO: 213886 - RNA, 32 nt, Human
gugugaccugacagugcuggagccuccuaguu

SEQ ID NO: 213887 - RNA, 32 nt, Human
gugugaccugcucucuucccuccaggcugacu

SEQ ID NO: 213888 - RNA, 32 nt, Human
gugugaccugcucuguucccucccugcugacc

SEQ ID NO: 213889 - RNA, 32 nt, Human
gugugaccugggaggacagcggagccaggagc

SEQ ID NO: 213890 - RNA, 24 nt, Human
gugugaccuuggcuaagucacuua

SEQ ID NO: 213891 - RNA, 24 nt, Human
gugugaccuugggcaagucacuua

SEQ ID NO: 213892 - RNA, 32 nt, Human
gugugacggggcuguccugagcuguuaggaga

SEQ ID NO: 213893 - RNA, 32 nt, Human
gugugacguuuuaguaucuggagcucagugau

SEQ ID NO: 213894 - RNA, 32 nt, Human
gugugacuaauuccuuaccucucccaaggagg

SEQ ID NO: 213895 - RNA, 32 nt, Human
gugugacuaggccacaccaacucuuaaucauc

SEQ ID NO: 213896 - RNA, 32 nt, Human
gugugacuauaaucccagcuacucgggaggcu

SEQ ID NO: 213897 - RNA, 22 nt, Human
gugugacucaguucuuuccauc

SEQ ID NO: 213898 - RNA, 32 nt, Human
gugugacuccauacuccucccaccacaacacu

SEQ ID NO: 213899 - RNA, 32 nt, Human
gugugacucugaggaagccuuuuuaauucuga

SEQ ID NO: 213900 - RNA, 32 nt, Human
gugugacucugugccagagcaauugacuaaaa

SEQ ID NO: 213901 - RNA, 32 nt, Human
gugugacugagcugaagagcagugcauccaga

SEQ ID NO: 213902 - RNA, 32 nt, Human
gugugacugaguaaagaauuuuuggaucaagc

SEQ ID NO: 213903 - RNA, 32 nt, Human
gugugacugcaaccucauaucaggauuccuga

SEQ ID NO: 213904 - RNA, 32 nt, Human
gugugacuggguguguuucuuuaggguucuga

SEQ ID NO: 213905 - RNA, 31 nt, Human
gugugacugguguccaucuaagaagaaauua

SEQ ID NO: 213906 - RNA, 32 nt, Human
gugugacuguaaucccagcuacucaggaggcu

SEQ ID NO: 213907 - RNA, 32 nt, Human
gugugacugucagcacugggccucuuguccau

SEQ ID NO: 213908 - RNA, 32 nt, Human
gugugacuugauaaugauuuccucugaauuau

SEQ ID NO: 213909 - RNA, 32 nt, Human
gugugacuuuggggcucccucugccagugacc

SEQ ID NO: 213910 - RNA, 32 nt, Human
gugugagaagcaagcuugugggccaguguccu

SEQ ID NO: 213911 - RNA, 32 nt, Human
gugugagagaagaagagaaagcagcagaauug

SEQ ID NO: 213912 - RNA, 32 nt, Human
gugugagagacacacacaaacacauuucaaac

SEQ ID NO: 213913 - RNA, 32 nt, Human
gugugagagacacaugcccacuucaugcaacu

SEQ ID NO: 213914 - RNA, 32 nt, Human
gugugagagagagcccucccacugccagcuca

SEQ ID NO: 213915 - RNA, 32 nt, Human
gugugagagcccagggggaggacagcuugucu

SEQ ID NO: 213916 - RNA, 32 nt, Human
gugugagaggcagagugccaaggaugaagcug

SEQ ID NO: 213917 - RNA, 32 nt, Human
gugugagagguuccuuucuguccacugaaaca

SEQ ID NO: 213918 - RNA, 32 nt, Human
gugugagccaaaggauccuuccuuauuccuaa

SEQ ID NO: 213919 - RNA, 32 nt, Human
gugugagccaccacacccagccugggucucuc

SEQ ID NO: 213920 - RNA, 32 nt, Human
gugugagccaccacagccagccaguaugaccu

SEQ ID NO: 213921 - RNA, 32 nt, Human
gugugagccaccaccagucaacaaaauacuuu

SEQ ID NO: 213922 - RNA, 32 nt, Human
gugugagccaccacgccagccugacgauguuu

SEQ ID NO: 213923 - RNA, 32 nt, Human
gugugagccaccacgcccugccuacucuuugu

SEQ ID NO: 213924 - RNA, 32 nt, Human
gugugagccaccaugcccaacacccacugauc

SEQ ID NO: 213925 - RNA, 32 nt, Human
gugugagccacugcacccagccugugauguuu

SEQ ID NO: 213926 - RNA, 32 nt, Human
gugugagccacugcacccggccugaaauuuuu

SEQ ID NO: 213927 - RNA, 32 nt, Human
gugugagccacugcaccuggccaugguuaguu

SEQ ID NO: 213928 - RNA, 32 nt, Human
gugugagccacugcaccuggccuggagcucag

SEQ ID NO: 213929 - RNA, 32 nt, Human
gugugagcccucaggggcagggcuuguggcuc

SEQ ID NO: 213930 - RNA, 32 nt, Human
gugugagcuacagaagaccccauaccaaauaa

SEQ ID NO: 213931 - RNA, 32 nt, Human
gugugagcuacugcgcccagccccagaaaucu

SEQ ID NO: 213932 - RNA, 32 nt, Human
gugugagcugcugccucuauccugggugccug

SEQ ID NO: 213933 - RNA, 32 nt, Human
gugugagcuucucuugccguaaguccacgggu

SEQ ID NO: 213934 - RNA, 32 nt, Human
gugugaggacucugugcacaccuuagaguucc

SEQ ID NO: 213935 - RNA, 32 nt, Human
gugugaggccagggcagagugagacccagccc

SEQ ID NO: 213936 - RNA, 32 nt, Human
gugugaggccaucaccaugugagaagacaucu

SEQ ID NO: 213937 - RNA, 32 nt, Human
gugugaggcuucacccaugcuaggcaagccca

SEQ ID NO: 213938 - RNA, 32 nt, Human
gugugagggaaagggggaugcagcaaggggau

SEQ ID NO: 213939 - RNA, 32 nt, Human
gugugagggaggacaggcgggaggagguguga

SEQ ID NO: 213940 - RNA, 32 nt, Human
gugugaggucuuucuuuugcuucuggcuucug

SEQ ID NO: 213941 - RNA, 32 nt, Human
gugugaggugcaguuguccaggagacgauuuu

SEQ ID NO: 213942 - RNA, 32 nt, Human
gugugagguggcggccuggugcccgguggagg

SEQ ID NO: 213943 - RNA, 32 nt, Human
gugugagguguucugagcucacugaccggaag

SEQ ID NO: 213944 - RNA, 32 nt, Human
gugugaguaauugaggaaaaacugacagaugc

SEQ ID NO: 213945 - RNA, 32 nt, Human
gugugagugagggagacaggaacggcucuggg

SEQ ID NO: 213946 - RNA, 32 nt, Human
gugugagugcugcucuuuccaccugccuugca

SEQ ID NO: 213947 - RNA, 32 nt, Human
gugugaguguguccugacauggcuccagggcg

SEQ ID NO: 213948 - RNA, 23 nt, Human
gugugaguucaaggcugcaguga

SEQ ID NO: 213949 - RNA, 32 nt, Human
gugugaguucacccagaggccugcucuccuca

SEQ ID NO: 213950 - RNA, 32 nt, Human
gugugaguuugaggcagggucauuugugugau

SEQ ID NO: 213951 - RNA, 32 nt, Human
gugugauaaccagccccagucggcgccauggc

SEQ ID NO: 213952 - RNA, 32 nt, Human
gugugauacagccaucuguaccuacuggagcc

SEQ ID NO: 213953 - RNA, 32 nt, Human
gugugauacaucucucauacaguuugggguga

SEQ ID NO: 213954 - RNA, 32 nt, Human
gugugaucauagcacacugcagccuggaacuc

SEQ ID NO: 213955 - RNA, 32 nt, Human
gugugaucauagcucacugcagccuggaauuc

SEQ ID NO: 213956 - RNA, 32 nt, Human
gugugaucucagcucacugcagccucugucuc

SEQ ID NO: 213957 - RNA, 32 nt, Human
gugugaucucuucagggugggguggucucuga

SEQ ID NO: 213958 - RNA, 32 nt, Human
gugugaucugugggacugucugggccuguuac

SEQ ID NO: 213959 - RNA, 24 nt, Human
gugugaucuugggcaagucacuua

SEQ ID NO: 213960 - RNA, 32 nt, Human
gugugaugaccagacggcggagaagcucauga

SEQ ID NO: 213961 - RNA, 32 nt, Human
gugugaugcaccugcagggugugugcuagccu

SEQ ID NO: 213962 - RNA, 32 nt, Human
gugugauggaacaggccaguuggccuaagaau

SEQ ID NO: 213963 - RNA, 32 nt, Human
gugugauggaggagggagaugccuggggaggg

SEQ ID NO: 213964 - RNA, 21 nt, Human
gugugauggcacauaccugua

SEQ ID NO: 213965 - RNA, 30 nt, Human
gugugauggccaggugcuucagccuggugu

SEQ ID NO: 213966 - RNA, 32 nt, Human
gugugaugggggaguggguauuacaugcauug

SEQ ID NO: 213967 - RNA, 32 nt, Human
gugugaugggguuucgcacuuguugcccaggc

SEQ ID NO: 213968 - RNA, 32 nt, Human
gugugaugggguuuugcucuuguugcccaggc

SEQ ID NO: 213969 - RNA, 32 nt, Human
gugugaugucaggccauugucccuugccuagc

SEQ ID NO: 213970 - RNA, 32 nt, Human
gugugaugucuacaucuuuuaacuucugguuc

SEQ ID NO: 213971 - RNA, 32 nt, Human
gugugaugugugugaugcaccagagcaccccc

SEQ ID NO: 213972 - RNA, 32 nt, Human
gugugauugcacuccagcccaggggacaaugu

SEQ ID NO: 213973 - RNA, 32 nt, Human
gugugauugggagggguggcagacaggaagaa

SEQ ID NO: 213974 - RNA, 32 nt, Human
gugugauuuggccugugaacuuggcugugcca

SEQ ID NO: 213975 - RNA, 32 nt, Human
gugugcaacgugagccaugcucaccccagggu

SEQ ID NO: 213976 - RNA, 32 nt, Human
gugugcaacugcuucauugcuauuaauaguua

SEQ ID NO: 213977 - RNA, 32 nt, Human
gugugcaaguacgacuucguggaggugcgcag

SEQ ID NO: 213978 - RNA, 32 nt, Human
gugugcaauagacucaauguuuauguuccccc

SEQ ID NO: 213979 - RNA, 32 nt, Human
gugugcaauggcugcacacagcagcuuccuug

SEQ ID NO: 213980 - RNA, 32 nt, Human
gugugcacacacacagaaaccacgagguaguu

SEQ ID NO: 213981 - RNA, 32 nt, Human
gugugcacacgcaugcacacacacauucagua

SEQ ID NO: 213982 - RNA, 32 nt, Human
gugugcacagggacugugucgggcuuggaccu

SEQ ID NO: 213983 - RNA, 32 nt, Human
gugugcacagugccaugugguaaaagaggcuu

SEQ ID NO: 213984 - RNA, 31 nt, Human
gugugcacauuccacccuugccagagccacu

SEQ ID NO: 213985 - RNA, 32 nt, Human
gugugcaccggcgcgguauuccugggcgccga

SEQ ID NO: 213986 - RNA, 32 nt, Human
gugugcaccuguaaucccagcuacucuggagg

SEQ ID NO: 213987 - RNA, 32 nt, Human
gugugcaccuguaaucucagcuacucgggagg

SEQ ID NO: 213988 - RNA, 32 nt, Human
gugugcacgucugucuguccgucugugcuugu

SEQ ID NO: 213989 - RNA, 32 nt, Human
gugugcacuuucucccuccaccuggagcaugg

SEQ ID NO: 213990 - RNA, 32 nt, Human
gugugcagacccucagcuaggcccagauggug

SEQ ID NO: 213991 - RNA, 32 nt, Human
gugugcagacgugccugcucccuggaugccag

SEQ ID NO: 213992 - RNA, 32 nt, Human
gugugcagagaaugugcucuucggaggaagaa

SEQ ID NO: 213993 - RNA, 32 nt, Human
gugugcagagcugaagagcuggggagaauggg

SEQ ID NO: 213994 - RNA, 32 nt, Human
gugugcagagcuugggacaggggaagucagau

SEQ ID NO: 213995 - RNA, 32 nt, Human
gugugcagaggugggggugcugagcgaggagg

SEQ ID NO: 213996 - RNA, 32 nt, Human
gugugcagccaucucauucugugaaugugcca

SEQ ID NO: 213997 - RNA, 32 nt, Human
gugugcagcccaggcccugccccuuuacaguc

SEQ ID NO: 213998 - RNA, 32 nt, Human
gugugcagccuuugugcugcucugcccaguau

SEQ ID NO: 213999 - RNA, 32 nt, Human
gugugcagcuguggucccagcuacucaggagg

SEQ ID NO: 214000 - RNA, 32 nt, Human
gugugcaggcagcagggcggcguggaagcuuc

SEQ ID NO: 214001 - RNA, 32 nt, Human
gugugcaggcugggaagagacaucucuuucag

SEQ ID NO: 214002 - RNA, 32 nt, Human
gugugcagggcugcauccgcagauggcuggaa

SEQ ID NO: 214003 - RNA, 32 nt, Human
gugugcaggguggcagaggugccucugcagag

SEQ ID NO: 214004 - RNA, 32 nt, Human
gugugcaguagccaauuucauuuacugcauua

SEQ ID NO: 214005 - RNA, 32 nt, Human
gugugcaguaggaccugcuccccugaaggacg

SEQ ID NO: 214006 - RNA, 32 nt, Human
gugugcagucccagagccuccuaaaauucuag

SEQ ID NO: 214007 - RNA, 32 nt, Human
gugugcagucucuggguugucauucacuuuga

SEQ ID NO: 214008 - RNA, 32 nt, Human
gugugcagugccugagucacgugauagauuaa

SEQ ID NO: 214009 - RNA, 32 nt, Human
gugugcaguuauuuuaaaaacuacagaucauu

SEQ ID NO: 214010 - RNA, 32 nt, Human
gugugcaugcagauguccucagacgggaaggu

SEQ ID NO: 214011 - RNA, 31 nt, Human
gugugcaugccaccccauccccucccgcugg

SEQ ID NO: 214012 - RNA, 32 nt, Human
gugugcauggcuggggacuucucacuuccccu

SEQ ID NO: 214013 - RNA, 32 nt, Human
gugugcauucacugcaaguaacuuauaucuuu

SEQ ID NO: 214014 - RNA, 32 nt, Human
gugugcauucucuccagcugcaaacuuucuuc

SEQ ID NO: 214015 - RNA, 16 nt, Human
gugugccaccauggcc

SEQ ID NO: 214016 - RNA, 32 nt, Human
gugugccaccugcugucugagaggcaggcagu

SEQ ID NO: 214017 - RNA, 32 nt, Human
gugugccaggagcugggcuguugagcagccaa

SEQ ID NO: 214018 - RNA, 25 nt, Human
gugugccaggcagauccucuggaca

SEQ ID NO: 214019 - RNA, 32 nt, Human
gugugccaggucccaggcagcccugcugaccc

SEQ ID NO: 214020 - RNA, 32 nt, Human
gugugccaucguagaugucacacuggggagaa

SEQ ID NO: 214021 - RNA, 32 nt, Human
gugugccauggacucagccgcccggugauauu

SEQ ID NO: 214022 - RNA, 32 nt, Human
gugugccauguaggccgagagcagggggaaca

SEQ ID NO: 214023 - RNA, 32 nt, Human
gugugccauugcagagagacuccaucccaaaa

SEQ ID NO: 214024 - RNA, 32 nt, Human
gugugccauuguucucuuugaccauuuuccua

SEQ ID NO: 214025 - RNA, 32 nt, Human
gugugcccaagaggggaagccuagugggccug

SEQ ID NO: 214026 - RNA, 32 nt, Human
gugugcccagaggcaagaggguugggugguuc

SEQ ID NO: 214027 - RNA, 32 nt, Human
gugugccccaggagggcucugcaggagcuaca

SEQ ID NO: 214028 - RNA, 32 nt, Human
gugugccccauguuguguuaacaccugcgugu

SEQ ID NO: 214029 - RNA, 32 nt, Human
gugugccccguugcagacagggccagggagaa

SEQ ID NO: 214030 - RNA, 32 nt, Human
gugugccccucggggcaggagggaagggcauc

SEQ ID NO: 214031 - RNA, 32 nt, Human
gugugccccucggucgcccaccugcacagcuc

SEQ ID NO: 214032 - RNA, 32 nt, Human
gugugccccuggcuuucugggucugugccucu

SEQ ID NO: 214033 - RNA, 32 nt, Human
gugugcccguggugagguugugcugccugugg

SEQ ID NO: 214034 - RNA, 32 nt, Human
gugugcccuaagcauguuggcagcaguacuuu

SEQ ID NO: 214035 - RNA, 32 nt, Human
gugugcccuaggguauguacccuuccccaucu

SEQ ID NO: 214036 - RNA, 32 nt, Human
gugugcccucccccuccuuuguguauuccuuc

SEQ ID NO: 214037 - RNA, 32 nt, Human
gugugcccucucugccuuccucugacuacaga

SEQ ID NO: 214038 - RNA, 32 nt, Human
gugugcccugaagaggagggugcggcccuccu

SEQ ID NO: 214039 - RNA, 32 nt, Human
gugugcccugcucaccccauuagugucauccu

SEQ ID NO: 214040 - RNA, 32 nt, Human
gugugccgccacacccagccugagcaacuuuu

SEQ ID NO: 214041 - RNA, 32 nt, Human
gugugccggaggccuucccacuccuacugcga

SEQ ID NO: 214042 - RNA, 32 nt, Human
gugugccuauaaucccagcuacucaggaggcu

SEQ ID NO: 214043 - RNA, 32 nt, Human
gugugccuauaaucccagcuacuugggaggcu

SEQ ID NO: 214044 - RNA, 32 nt, Human
gugugccuauagucgcagcuacuagggaaguu

SEQ ID NO: 214045 - RNA, 32 nt, Human
gugugccucuacuguggccucaacccuggcaa

SEQ ID NO: 214046 - RNA, 32 nt, Human
gugugccucuagucccagcuacuugggaggcu

SEQ ID NO: 214047 - RNA, 32 nt, Human
gugugccugagauucggauggggagcucucaa

SEQ ID NO: 214048 - RNA, 32 nt, Human
gugugccugcagcagccuccacagccacgaug

SEQ ID NO: 214049 - RNA, 32 nt, Human
gugugccugcagcagugccgacaccccugaga

SEQ ID NO: 214050 - RNA, 32 nt, Human
gugugccugcagcuguguagugcuggacagug

SEQ ID NO: 214051 - RNA, 32 nt, Human
gugugccuggcagaacacugcacuccaauuuc

SEQ ID NO: 214052 - RNA, 32 nt, Human
gugugccuguaaguguccaggcucagagcugg

SEQ ID NO: 214053 - RNA, 32 nt, Human
gugugccuguaaucccaccuacuugggaggcu

SEQ ID NO: 214054 - RNA, 32 nt, Human
gugugccuguaaucccagcuaaccaggaggcu

SEQ ID NO: 214055 - RNA, 32 nt, Human
gugugccuguaaucccagcuacucaggaggau

SEQ ID NO: 214056 - RNA, 32 nt, Human
gugugccuguaaucccagcuacucgggagguu

SEQ ID NO: 214057 - RNA, 32 nt, Human
gugugccuguaaucccagcuacuugggaggcu

SEQ ID NO: 214058 - RNA, 32 nt, Human
gugugccuguaaucccagcuauuugggaggcu

SEQ ID NO: 214059 - RNA, 32 nt, Human
gugugccuguaaucccggcuacuugggaggcu

SEQ ID NO: 214060 - RNA, 32 nt, Human
gugugccuguaauccuagcuacucgggaggcu

SEQ ID NO: 214061 - RNA, 32 nt, Human
gugugccuguaaucucagcacuuugagggguu

SEQ ID NO: 214062 - RNA, 32 nt, Human
gugugccuguaaucucagcuacucaggaggcu

SEQ ID NO: 214063 - RNA, 32 nt, Human
gugugccuguaaucucagcuacucaggagguu

SEQ ID NO: 214064 - RNA, 32 nt, Human
gugugccuguaaugccagcuacucaggaggcu

SEQ ID NO: 214065 - RNA, 32 nt, Human
gugugccuguaaugccagcuacucgggaggcu

SEQ ID NO: 214066 - RNA, 32 nt, Human
gugugccuguaauuccagcuacucgggaggcu

SEQ ID NO: 214067 - RNA, 32 nt, Human
gugugccuguagucccagcuacuauggagguu

SEQ ID NO: 214068 - RNA, 32 nt, Human
gugugccuguagucccagcuacucaggaggcu

SEQ ID NO: 214069 - RNA, 32 nt, Human
gugugccuguagucccagcuacucgggaggcu

SEQ ID NO: 214070 - RNA, 32 nt, Human
gugugccuguagucccagcuacuggcgaggcu

SEQ ID NO: 214071 - RNA, 32 nt, Human
gugugccuguagucccagcuacuuaggaggcu

SEQ ID NO: 214072 - RNA, 32 nt, Human
gugugccuguagucccagcuacuugagaggcu

SEQ ID NO: 214073 - RNA, 32 nt, Human
gugugccuguagucccagcuacuugggaggcu

SEQ ID NO: 214074 - RNA, 32 nt, Human
gugugccuguagucccagcuacuugggagggc

SEQ ID NO: 214075 - RNA, 32 nt, Human
gugugccuguagucccagcuacuugugaggcu

SEQ ID NO: 214076 - RNA, 32 nt, Human
gugugccuguagucccagcuauucuagaggcu

SEQ ID NO: 214077 - RNA, 32 nt, Human
gugugccuguagucccagcugcuugggaggcu

SEQ ID NO: 214078 - RNA, 32 nt, Human
gugugccuguagucucagcuacuugggaggcc

SEQ ID NO: 214079 - RNA, 32 nt, Human
gugugccuguagugccagcuacucaggaggcu

SEQ ID NO: 214080 - RNA, 32 nt, Human
gugugccuguaguuccagcuacucaggaggcu

SEQ ID NO: 214081 - RNA, 32 nt, Human
gugugccugucgucccagcuacucaggaggcc

SEQ ID NO: 214082 - RNA, 32 nt, Human
gugugccugugaucccagcuacacgggaggca

SEQ ID NO: 214083 - RNA, 32 nt, Human
gugugccugugcaaguguguuugugugugguu

SEQ ID NO: 214084 - RNA, 32 nt, Human
gugugccugugcgcuacugcugugccauuuuc

SEQ ID NO: 214085 - RNA, 32 nt, Human
gugugccuguggucccagcuacucaagagacg

SEQ ID NO: 214086 - RNA, 32 nt, Human
gugugccuguggucccagcuccucaggaggcu

SEQ ID NO: 214087 - RNA, 32 nt, Human
gugugccuguuuguugagugauugugaaagag

SEQ ID NO: 214088 - RNA, 32 nt, Human
gugugccuugggucucagcugcugacacgcag

SEQ ID NO: 214089 - RNA, 32 nt, Human
gugugccuugguguggagaccaaccugaggau

SEQ ID NO: 214090 - RNA, 32 nt, Human
gugugccuuuaaugcacuuagaacagcaggug

SEQ ID NO: 214091 - RNA, 32 nt, Human
gugugccuuucuaucuuagguaaagaagagaa

SEQ ID NO: 214092 - RNA, 32 nt, Human
gugugcgagccgcggcagagugaggcaggcaa

SEQ ID NO: 214093 - RNA, 32 nt, Human
gugugcgaucucagcucacugcagccuccacc

SEQ ID NO: 214094 - RNA, 32 nt, Human
gugugcgcacacacaauggugccugaagaaga

SEQ ID NO: 214095 - RNA, 32 nt, Human
gugugcgcacacacacaagaagccuuagcguu

SEQ ID NO: 214096 - RNA, 32 nt, Human
gugugcgcaugggaguggagggcaggauuggg

SEQ ID NO: 214097 - RNA, 32 nt, Human
gugugcgccuauaaucccagcuacucaggagg

SEQ ID NO: 214098 - RNA, 32 nt, Human
gugugcgccuguaaucccagcuacucgggagg

SEQ ID NO: 214099 - RNA, 32 nt, Human
gugugcgccuguaaucccagcuacucuggagg

SEQ ID NO: 214100 - RNA, 32 nt, Human
gugugcgccuguaaucccagcuacuugggagg

SEQ ID NO: 214101 - RNA, 32 nt, Human
gugugcgccuguaaucucagcuacucaagagg

SEQ ID NO: 214102 - RNA, 32 nt, Human
gugugcgccuguaauuccagcuacucgggagg

SEQ ID NO: 214103 - RNA, 32 nt, Human
gugugcgcgagcuaccgcuucacuuucucccu

SEQ ID NO: 214104 - RNA, 32 nt, Human
gugugcgcugcuucuugaucuaggcaaaccuu

SEQ ID NO: 214105 - RNA, 32 nt, Human
gugugcggugcccuccugccucaggccgcgaa

SEQ ID NO: 214106 - RNA, 32 nt, Human
gugugcgucccucagcccaugcaccccggaag

SEQ ID NO: 214107 - RNA, 32 nt, Human
gugugcgugcauaucagcccguguggcugacu

SEQ ID NO: 214108 - RNA, 32 nt, Human
gugugcuaaaagcaaggaaagcgaguuagucu

SEQ ID NO: 214109 - RNA, 32 nt, Human
gugugcuacacaguguaugucacuguguagug

SEQ ID NO: 214110 - RNA, 32 nt, Human
gugugcuaccuuacaccuccccauucccuaaa

SEQ ID NO: 214111 - RNA, 32 nt, Human
gugugcuagccucugugccccguccuugugcc

SEQ ID NO: 214112 - RNA, 32 nt, Human
gugugcuaugagagcuguaugugcccaggggu

SEQ ID NO: 214113 - RNA, 32 nt, Human
gugugcucaaauaaguguuauguaucagcuag

SEQ ID NO: 214114 - RNA, 32 nt, Human
gugugcucagccucagagccguaggcgagagc

SEQ ID NO: 214115 - RNA, 32 nt, Human
gugugcucagggcacaugcacacagacauuua

SEQ ID NO: 214116 - RNA, 23 nt, Human
gugugcuccagauguguuugggc

SEQ ID NO: 214117 - RNA, 22 nt, Human
gugugcuccggcuccugggaca

SEQ ID NO: 214118 - RNA, 32 nt, Human
gugugcuccuauagcuccagcuacucaggagg

SEQ ID NO: 214119 - RNA, 32 nt, Human
gugugcuccuuaugauaaucuaaugccugaug

SEQ ID NO: 214120 - RNA, 32 nt, Human
gugugcuccuugggcccugcuccugugccaca

SEQ ID NO: 214121 - RNA, 32 nt, Human
gugugcucuguagucaugcagaucccagcuuu

SEQ ID NO: 214122 - RNA, 32 nt, Human
gugugcucuucuucuuucuacaguauuaugua

SEQ ID NO: 214123 - RNA, 32 nt, Human
gugugcucuuucacagaacuugguuuucaaau

SEQ ID NO: 214124 - RNA, 22 nt, Human
gugugcucuuugugaaauucca

SEQ ID NO: 214125 - RNA, 32 nt, Human
gugugcugaagcucugacccuuccugacuccg

SEQ ID NO: 214126 - RNA, 32 nt, Human
gugugcugaagugccaucuuuagggugcucau

SEQ ID NO: 214127 - RNA, 31 nt, Human
gugugcugcacucaugggccuggucucacuc

SEQ ID NO: 214128 - RNA, 32 nt, Human
gugugcugcacugugggcuggugggacgggca

SEQ ID NO: 214129 - RNA, 32 nt, Human
gugugcugcgcgggaagccccaugcuccaauc

SEQ ID NO: 214130 - RNA, 32 nt, Human
gugugcugcuaccugugugcugcuaggauagu

SEQ ID NO: 214131 - RNA, 32 nt, Human
gugugcugcuucucaucacugcacacaagugc

SEQ ID NO: 214132 - RNA, 32 nt, Human
gugugcuggcuguccuagcucccugguaacag

SEQ ID NO: 214133 - RNA, 32 nt, Human
gugugcugggaguccagccgugcacugugcca

SEQ ID NO: 214134 - RNA, 32 nt, Human
gugugcugggauuacaggcaugagcuacuaug

SEQ ID NO: 214135 - RNA, 32 nt, Human
gugugcugggguccccagcaggcaaacacugg

SEQ ID NO: 214136 - RNA, 32 nt, Human
gugugcuguguguguccugccuguauaugugg

SEQ ID NO: 214137 - RNA, 32 nt, Human
gugugcuucaaacaaaugcuagacccuuucac

SEQ ID NO: 214138 - RNA, 32 nt, Human
gugugcuucaggaaguggguugcaccuccaac

SEQ ID NO: 214139 - RNA, 32 nt, Human
gugugcuucccaagagccugcccccuuggccc

SEQ ID NO: 214140 - RNA, 32 nt, Human
gugugcuugguuuaggggaaguaugugugggu

SEQ ID NO: 214141 - RNA, 32 nt, Human
gugugcuuguaaucccagcuacuugggaggcu

SEQ ID NO: 214142 - RNA, 32 nt, Human
gugugcuuguagucccagcuacuuaggaggcu

SEQ ID NO: 214143 - RNA, 32 nt, Human
gugugcuuguagucccagcuacuuuggaggcu

SEQ ID NO: 214144 - RNA, 32 nt, Human
gugugcuugugucugugcgggcgcgugcagcc

SEQ ID NO: 214145 - RNA, 24 nt, Human
gugugcuuuaggauuuauugcaua

SEQ ID NO: 214146 - RNA, 32 nt, Human
gugugcuuuugaguggaagauucaaagccagu

SEQ ID NO: 214147 - RNA, 32 nt, Human
guguggaaaaucaccauagaucauggcugaaa

SEQ ID NO: 214148 - RNA, 32 nt, Human
guguggaaacucagcgcaaacaacccuguuug

SEQ ID NO: 214149 - RNA, 32 nt, Human
guguggaaaguggccagcauucugccugcaga

SEQ ID NO: 214150 - RNA, 32 nt, Human
guguggaacaccuucccaaucuuaguucagaa

SEQ ID NO: 214151 - RNA, 32 nt, Human
guguggaacaugagugcugggcaccuggagga

SEQ ID NO: 214152 - RNA, 32 nt, Human
guguggaagaggagcucaagaggcuggaauaa

SEQ ID NO: 214153 - RNA, 32 nt, Human
guguggaagagugcugugguugauuagcaaug

SEQ ID NO: 214154 - RNA, 32 nt, Human
guguggacaacagugaguauauggggaaugga

SEQ ID NO: 214155 - RNA, 32 nt, Human
guguggacaaguguucuaugagcagagacugg

SEQ ID NO: 214156 - RNA, 22 nt, Human
guguggacacccugccaggacu

SEQ ID NO: 214157 - RNA, 32 nt, Human
guguggacagaaggaagagaggagagggugag

SEQ ID NO: 214158 - RNA, 32 nt, Human
guguggacccaggaggcagagcuugcagugag

SEQ ID NO: 214159 - RNA, 32 nt, Human
guguggaccccaggggagaaucagaggucaaa

SEQ ID NO: 214160 - RNA, 32 nt, Human
guguggacggccaggugcagggcaucgccacg

SEQ ID NO: 214161 - RNA, 32 nt, Human
guguggacuccgggagggugacucagguccuc

SEQ ID NO: 214162 - RNA, 22 nt, Human
guguggacuggagaccaggauu

SEQ ID NO: 214163 - RNA, 32 nt, Human
guguggacugggugugaugaggggaaugacca

SEQ ID NO: 214164 - RNA, 22 nt, Human
guguggacuuuuauauauagau

SEQ ID NO: 214165 - RNA, 32 nt, Human
guguggagacaggguuuugccauguugcccag

SEQ ID NO: 214166 - RNA, 32 nt, Human
guguggagagaagagagguagaauggugcuag

SEQ ID NO: 214167 - RNA, 32 nt, Human
guguggagaucaaggaggaaagaggcaaguga

SEQ ID NO: 214168 - RNA, 32 nt, Human
guguggagaugcagagguaaaagugugagcag

SEQ ID NO: 214169 - RNA, 32 nt, Human
guguggagcaucacaaacacaucagaagcccc

SEQ ID NO: 214170 - RNA, 32 nt, Human
guguggaggaaaaguacugagugaagggcaga

SEQ ID NO: 214171 - RNA, 32 nt, Human
guguggaggcagcagagggacauugggaaggg

SEQ ID NO: 214172 - RNA, 32 nt, Human
guguggaggcagcagccuggggcagggacugu

SEQ ID NO: 214173 - RNA, 32 nt, Human
guguggaggcagugggaugaacugggggacag

SEQ ID NO: 214174 - RNA, 32 nt, Human
guguggagggagaagcgagugugguccggaga

SEQ ID NO: 214175 - RNA, 32 nt, Human
guguggagggcagaggagaggggacaagacag

SEQ ID NO: 214176 - RNA, 32 nt, Human
guguggaguuagaucuggguuauggaagaguu

SEQ ID NO: 214177 - RNA, 32 nt, Human
guguggauaccucugucucacgcccagggauc

SEQ ID NO: 214178 - RNA, 21 nt, Human
guguggauauaacauuugggg

SEQ ID NO: 214179 - RNA, 32 nt, Human
guguggaucggcauuccuugagcucagugcua

SEQ ID NO: 214180 - RNA, 32 nt, Human
guguggaugcuuuuccuggagcacuuuccaag

SEQ ID NO: 214181 - RNA, 21 nt, Human
guguggauggagaacccuccc

SEQ ID NO: 214182 - RNA, 22 nt, Human
guguggaugggauagcccuggg

SEQ ID NO: 214183 - RNA, 32 nt, Human
guguggauguggggaagccagugagcauuacu

SEQ ID NO: 214184 - RNA, 32 nt, Human
guguggauguugugaccacagagcaggauugu

SEQ ID NO: 214185 - RNA, 32 nt, Human
guguggauuauccaccaugccaggaagaccca

SEQ ID NO: 214186 - RNA, 32 nt, Human
guguggauugucugucuguaaggagaugccau

SEQ ID NO: 214187 - RNA, 32 nt, Human
guguggcaaagcugauguugagugcagaacua

SEQ ID NO: 214188 - RNA, 21 nt, Human
guguggcaagcagaccacuua

SEQ ID NO: 214189 - RNA, 32 nt, Human
guguggcacacagauaacaggguaagaaauug

SEQ ID NO: 214190 - RNA, 32 nt, Human
guguggcacugaggcuggaugggcuggcagag

SEQ ID NO: 214191 - RNA, 21 nt, Human
guguggcagaacgugcaguga

SEQ ID NO: 214192 - RNA, 32 nt, Human
guguggcagacaccuguccccugcccugcaug

SEQ ID NO: 214193 - RNA, 32 nt, Human
guguggcagacagcccaggacaacgagaggga

SEQ ID NO: 214194 - RNA, 32 nt, Human
guguggcagagauggggcaugggcauuggggu

SEQ ID NO: 214195 - RNA, 32 nt, Human
guguggcagccugugcaguguugggggcuuac

SEQ ID NO: 214196 - RNA, 32 nt, Human
guguggcagcuccgauagcaggcacagggaau

SEQ ID NO: 214197 - RNA, 31 nt, Human
guguggcagcuuuucugguaagugguagauu

SEQ ID NO: 214198 - RNA, 32 nt, Human
guguggcagggaggaggaagaggaaggugaga

SEQ ID NO: 214199 - RNA, 32 nt, Human
guguggcaucucucccuucucucucuugcucu

SEQ ID NO: 214200 - RNA, 22 nt, Human
guguggcauuacuggucacuug

SEQ ID NO: 214201 - RNA, 19 nt, Human
guguggccaccuggggcuc

SEQ ID NO: 214202 - RNA, 32 nt, Human
guguggccagguucaggcagcccagggccaca

SEQ ID NO: 214203 - RNA, 32 nt, Human
guguggcccacaucccuccacuucuccaacuu

SEQ ID NO: 214204 - RNA, 32 nt, Human
guguggcccaggcuggagugcaguggcgcaau

SEQ ID NO: 214205 - RNA, 32 nt, Human
guguggcccuuuacagaaaaaguuuucuaacc

SEQ ID NO: 214206 - RNA, 32 nt, Human
guguggccuagaaguccucuguggucuccccu

SEQ ID NO: 214207 - RNA, 32 nt, Human
guguggccuagguuggagugcaauggcgcaau

SEQ ID NO: 214208 - RNA, 32 nt, Human
guguggccucacugccccaggcuuccuuucag

SEQ ID NO: 214209 - RNA, 24 nt, Human
guguggccucgaugauggcaguga

SEQ ID NO: 214210 - RNA, 22 nt, Human
guguggccucguagaggcagug

SEQ ID NO: 214211 - RNA, 32 nt, Human
guguggccugacagucucuaccaguccugcug

SEQ ID NO: 214212 - RNA, 32 nt, Human
guguggccugcacuggguuguccagggagacc

SEQ ID NO: 214213 - RNA, 32 nt, Human
guguggccugcaggacaggccugggccuggug

SEQ ID NO: 214214 - RNA, 32 nt, Human
guguggccugcgagauucugaccucagaugug

SEQ ID NO: 214215 - RNA, 32 nt, Human
guguggccuucaucccccucuggccguguucc

SEQ ID NO: 214216 - RNA, 32 nt, Human
guguggccuuggucauaucaucagccucuggg

SEQ ID NO: 214217 - RNA, 32 nt, Human
guguggccuuggugcuaggauucaaagaggaa

SEQ ID NO: 214218 - RNA, 32 nt, Human
guguggcgcuacauuaauuucaagaugucucc

SEQ ID NO: 214219 - RNA, 32 nt, Human
guguggcggagggagaggcgaugcugcaaagu

SEQ ID NO: 214220 - RNA, 30 nt, Human
guguggcgggacuggagggcacaguugagg

SEQ ID NO: 214221 - RNA, 32 nt, Human
guguggcuaagcugagucccaggcacagggug

SEQ ID NO: 214222 - RNA, 32 nt, Human
guguggcuauagucugagcuacucaggaggcu

SEQ ID NO: 214223 - RNA, 32 nt, Human
guguggcucccaccccuuccaguuaagaccug

SEQ ID NO: 214224 - RNA, 32 nt, Human
guguggcugagcuccgggguguguggacgccg

SEQ ID NO: 214225 - RNA, 32 nt, Human
guguggcugcaagagaaaaggggcuggaggaa

SEQ ID NO: 214226 - RNA, 32 nt, Human
guguggcugcuggcaggccagcuugaagauau

SEQ ID NO: 214227 - RNA, 32 nt, Human
guguggcuggaccaggugucuccccacgcuua

SEQ ID NO: 214228 - RNA, 32 nt, Human
guguggcuguucucuggagcagcauucguuua

SEQ ID NO: 214229 - RNA, 32 nt, Human
guguggcuuguauucaugggauacaggacagg

SEQ ID NO: 214230 - RNA, 32 nt, Human
guguggcuuuaaccuccacauccaggucuuuc

SEQ ID NO: 214231 - RNA, 32 nt, Human
guguggcuuuuugcacacuugcccugucuucc

SEQ ID NO: 214232 - RNA, 32 nt, Human
gugugggaaaagaggcagggaggaaugaagag

SEQ ID NO: 214233 - RNA, 32 nt, Human
gugugggaaaugagacuugcucucuggccuuu

SEQ ID NO: 214234 - RNA, 32 nt, Human
gugugggacaagcugcuccugacagaaggaug

SEQ ID NO: 214235 - RNA, 32 nt, Human
gugugggacaaggugcuccugacagaaggaug

SEQ ID NO: 214236 - RNA, 32 nt, Human
gugugggacauggguguguucucuggguugua

SEQ ID NO: 214237 - RNA, 32 nt, Human
gugugggagagggaggagaggggaucacaggg

SEQ ID NO: 214238 - RNA, 32 nt, Human
gugugggagccacuacccucucuuuugaucug

SEQ ID NO: 214239 - RNA, 32 nt, Human
gugugggaggaggaguguugaccuuggacgca

SEQ ID NO: 214240 - RNA, 32 nt, Human
gugugggaggaggccaccagauucagaauuca

SEQ ID NO: 214241 - RNA, 32 nt, Human
gugugggaggcacggccugggccugcucucug

SEQ ID NO: 214242 - RNA, 32 nt, Human
gugugggaggcagagagaggagcaggggccau

SEQ ID NO: 214243 - RNA, 32 nt, Human
gugugggaggcgauggggguugggugguggag

SEQ ID NO: 214244 - RNA, 32 nt, Human
gugugggaggcugcagccaggauugccucagc

SEQ ID NO: 214245 - RNA, 32 nt, Human
gugugggaggggcggggagguuuucuauaaac

SEQ ID NO: 214246 - RNA, 32 nt, Human
gugugggauacuuagugguaugucucuuuaag

SEQ ID NO: 214247 - RNA, 32 nt, Human
gugugggcacauaggugcauguaaccuguuug

SEQ ID NO: 214248 - RNA, 32 nt, Human
gugugggcaggcacuaguggacgucagcuucu

SEQ ID NO: 214249 - RNA, 32 nt, Human
gugugggccagaggcagggaugguuggcuaug

SEQ ID NO: 214250 - RNA, 32 nt, Human
gugugggccaggcugagugcauaggugacagg

SEQ ID NO: 214251 - RNA, 32 nt, Human
gugugggcggcugggccuugcagcuaacccuu

SEQ ID NO: 214252 - RNA, 32 nt, Human
gugugggcgugccuuuuucuucaggccaugcg

SEQ ID NO: 214253 - RNA, 21 nt, Human
gugugggcuacauauauagau

SEQ ID NO: 214254 - RNA, 31 nt, Human
gugugggcuauggaaagaggugaauugcggu

SEQ ID NO: 214255 - RNA, 32 nt, Human
gugugggcucuccagccccgagcaccccuccu

SEQ ID NO: 214256 - RNA, 32 nt, Human
guguggggaggagagagaugcagagagccuuu

SEQ ID NO: 214257 - RNA, 32 nt, Human
guguggggaguggggcuggcuggagaacaggc

SEQ ID NO: 214258 - RNA, 32 nt, Human
guguggggcagagagguuuccaggcagugaga

SEQ ID NO: 214259 - RNA, 32 nt, Human
guguggggcaggcagagagggaugguguccag

SEQ ID NO: 214260 - RNA, 32 nt, Human
guguggggccugauuggaacaggaucugccau

SEQ ID NO: 214261 - RNA, 32 nt, Human
guguggggcgagggggacaggguugcuuccug

SEQ ID NO: 214262 - RNA, 32 nt, Human
guguggggcggguggaggcggcuggcggaggu

SEQ ID NO: 214263 - RNA, 32 nt, Human
guguggggcuacuucucccaagaagaaggggu

SEQ ID NO: 214264 - RNA, 32 nt, Human
guguggggcucugggggugggguggaaaaugc

SEQ ID NO: 214265 - RNA, 32 nt, Human
guguggggcugggcuuugggcuugccugccag

SEQ ID NO: 214266 - RNA, 32 nt, Human
guguggggcugugcucuggugccugagaaugg

SEQ ID NO: 214267 - RNA, 32 nt, Human
gugugggggaaaugaacuugagcuuuaaacuu

SEQ ID NO: 214268 - RNA, 32 nt, Human
gugugggggagagguuuacacccacauauuuc

SEQ ID NO: 214269 - RNA, 31 nt, Human
gugugggggcagauggguggauuuggucuca

SEQ ID NO: 214270 - RNA, 32 nt, Human
gugugggggcagauggguggauuuggucucau

SEQ ID NO: 214271 - RNA, 32 nt, Human
gugugggggcccgggcccugcccagcuacgca

SEQ ID NO: 214272 - RNA, 32 nt, Human
gugugggggcugcuucucaggaggccaggccc

SEQ ID NO: 214273 - RNA, 32 nt, Human
gugugggggucugcuuggcggugagggggcuc

SEQ ID NO: 214274 - RNA, 32 nt, Human
guguggggucaguuccagcagaugaauguguc

SEQ ID NO: 214275 - RNA, 32 nt, Human
guguggggugcaugccuggaaucccagcuacu

SEQ ID NO: 214276 - RNA, 32 nt, Human
guguggggugcugcagucauaacugaaaaauu

SEQ ID NO: 214277 - RNA, 32 nt, Human
gugugggucccaaggcgugcugcagauggaga

SEQ ID NO: 214278 - RNA, 32 nt, Human
gugugggucccucugccccacccuccuuccca

SEQ ID NO: 214279 - RNA, 32 nt, Human
gugugggucucauuuccaugcuagccaugguc

SEQ ID NO: 214280 - RNA, 32 nt, Human
gugugggugacacggugauggccacagucaag

SEQ ID NO: 214281 - RNA, 32 nt, Human
gugugggugagcugauggaggcuucaucuuag

SEQ ID NO: 214282 - RNA, 32 nt, Human
gugugggugagugcgucuucugaguggguucu

SEQ ID NO: 214283 - RNA, 32 nt, Human
gugugggugggaggggcccacaggaagcucag

SEQ ID NO: 214284 - RNA, 32 nt, Human
gugugggugugugagagagcggcugguucauu

SEQ ID NO: 214285 - RNA, 32 nt, Human
gugugggugugugugggcacaggugugagugu

SEQ ID NO: 214286 - RNA, 32 nt, Human
guguggguucuccuguucucucugugcucuug

SEQ ID NO: 214287 - RNA, 32 nt, Human
gugugguaagcauaggcuugaagaggugggua

SEQ ID NO: 214288 - RNA, 32 nt, Human
gugugguagcaaaaggagggagaggaguccuu

SEQ ID NO: 214289 - RNA, 32 nt, Human
gugugguagcuugaagcacaccacuguccauu

SEQ ID NO: 214290 - RNA, 32 nt, Human
gugugguaggugguauuaucucugauuuacac

SEQ ID NO: 214291 - RNA, 32 nt, Human
guguggucacucuuucuuuugugccauuuugg

SEQ ID NO: 214292 - RNA, 32 nt, Human
guguggucaggagggaccucaccggaaggcau

SEQ ID NO: 214293 - RNA, 32 nt, Human
gugugguccauggcugggaggcagcuggcccc

SEQ ID NO: 214294 - RNA, 32 nt, Human
gugugguccucagaccaguagcaucagcguca

SEQ ID NO: 214295 - RNA, 32 nt, Human
gugugguccucagaccagugccugccaaccag

SEQ ID NO: 214296 - RNA, 32 nt, Human
guguggucgcugcguuuccucugccugcgccg

SEQ ID NO: 214297 - RNA, 22 nt, Human
guguggucuacuuacucugggg

SEQ ID NO: 214298 - RNA, 32 nt, Human
guguggucucaaacuccugaccucaugauuug

SEQ ID NO: 214299 - RNA, 32 nt, Human
guguggucucugcaugucuccauucuucucug

SEQ ID NO: 214300 - RNA, 32 nt, Human
guguggucuuccaugauuuauuuguguuuugu

SEQ ID NO: 214301 - RNA, 32 nt, Human
guguggugaugcaucuaacaccuuuugcugcu

SEQ ID NO: 214302 - RNA, 32 nt, Human
guguggugcaggcgccuauaaucccagcuacu

SEQ ID NO: 214303 - RNA, 32 nt, Human
guguggugccuccccucugucucccuccugcu

SEQ ID NO: 214304 - RNA, 32 nt, Human
guguggugcucacgccuguaaucccagcacuu

SEQ ID NO: 214305 - RNA, 32 nt, Human
gugugguggaggacaagguggggacagacuug

SEQ ID NO: 214306 - RNA, 32 nt, Human
gugugguggaggcagaggagugaggcccacgg

SEQ ID NO: 214307 - RNA, 32 nt, Human
gugugguggcacaaucacagcucauugcaucc

SEQ ID NO: 214308 - RNA, 21 nt, Human
gugugguggcacaugccugug

SEQ ID NO: 214309 - RNA, 21 nt, Human
gugugguggcacaugcuugua

SEQ ID NO: 214310 - RNA, 21 nt, Human
gugugguggcacgcaccugua

SEQ ID NO: 214311 - RNA, 32 nt, Human
gugugguggccccuggcacugcagagacuggu

SEQ ID NO: 214312 - RNA, 32 nt, Human
gugugguggcggaaccuguaaucccagcuacu

SEQ ID NO: 214313 - RNA, 32 nt, Human
gugugguggcggcgccuguaaucccagcuacu

SEQ ID NO: 214314 - RNA, 32 nt, Human
gugugguggcggguccagcuacucgggaggcu

SEQ ID NO: 214315 - RNA, 32 nt, Human
gugugguggcuaacagucagaaacccaacaau

SEQ ID NO: 214316 - RNA, 21 nt, Human
gugugguggcucacaccugua

SEQ ID NO: 214317 - RNA, 21 nt, Human
gugugguggcucacaccugug

SEQ ID NO: 214318 - RNA, 32 nt, Human
gugugguggcucaggccuguaaccucagcacu

SEQ ID NO: 214319 - RNA, 21 nt, Human
gugugguggcucaugccugua

SEQ ID NO: 214320 - RNA, 32 nt, Human
gugugguggcucaugccuuaaucccagcacuu

SEQ ID NO: 214321 - RNA, 32 nt, Human
gugugguggcugccuucucucucugcagcugu

SEQ ID NO: 214322 - RNA, 21 nt, Human
gugugguggcuuacaccugua

SEQ ID NO: 214323 - RNA, 21 nt, Human
gugugguggcuuaugccugua

SEQ ID NO: 214324 - RNA, 32 nt, Human
gugugguggcuuuaaucccagcacuuugggaa

SEQ ID NO: 214325 - RNA, 32 nt, Human
gugugguggggaggggaggcagguguggguag

SEQ ID NO: 214326 - RNA, 32 nt, Human
gugugguggucugcauugccgggcccccuggc

SEQ ID NO: 214327 - RNA, 21 nt, Human
gugugguggugcacaccugua

SEQ ID NO: 214328 - RNA, 21 nt, Human
gugugguggugcaugccugua

SEQ ID NO: 214329 - RNA, 32 nt, Human
guguggugguuaacuccaagaggcagaacucg

SEQ ID NO: 214330 - RNA, 32 nt, Human
gugugguuaaucauuagcuacacugcuuccca

SEQ ID NO: 214331 - RNA, 32 nt, Human
gugugguucauaggagaugauuuuugagguuu

SEQ ID NO: 214332 - RNA, 31 nt, Human
gugugguuggucaaggagggaugugagggaa

SEQ ID NO: 214333 - RNA, 32 nt, Human
gugugguuguggugcuguaugugaacucaugu

SEQ ID NO: 214334 - RNA, 32 nt, Human
gugugguuucaggagaaaauuuaaacucuuca

SEQ ID NO: 214335 - RNA, 32 nt, Human
gugugguuucaucauagauuuguaaaacaaaa

SEQ ID NO: 214336 - RNA, 32 nt, Human
guguguaagaaaaacuaggacuguguggggua

SEQ ID NO: 214337 - RNA, 31 nt, Human
guguguaagcucaagaaccuguugagaggag

SEQ ID NO: 214338 - RNA, 32 nt, Human
guguguaauuggggaacagaagggucucuaga

SEQ ID NO: 214339 - RNA, 32 nt, Human
guguguacaaacugauaucuuugccuaccagc

SEQ ID NO: 214340 - RNA, 32 nt, Human
guguguacacacacagaaacauguaagguggu

SEQ ID NO: 214341 - RNA, 32 nt, Human
guguguacacguguauagguguacaugugcau

SEQ ID NO: 214342 - RNA, 32 nt, Human
guguguacauacacaaacauacgauagugugu

SEQ ID NO: 214343 - RNA, 32 nt, Human
guguguaccaugcugcuauugucaucuuccuu

SEQ ID NO: 214344 - RNA, 32 nt, Human
guguguacccgugagagguugugugaauguga

SEQ ID NO: 214345 - RNA, 32 nt, Human
guguguacccuuuagcacuguuuggggugggg

SEQ ID NO: 214346 - RNA, 32 nt, Human
guguguagacccuccucuguucaucaaucaaa

SEQ ID NO: 214347 - RNA, 32 nt, Human
guguguagccuugcgugucugugagcacgccc

SEQ ID NO: 214348 - RNA, 32 nt, Human
guguguagcggguggagguucuaagacaggcu

SEQ ID NO: 214349 - RNA, 32 nt, Human
guguguaggacaaggagccagggaauuggcac

SEQ ID NO: 214350 - RNA, 32 nt, Human
guguguaggcugggaauucuugcugaaggaau

SEQ ID NO: 214351 - RNA, 32 nt, Human
guguguaggucccacggccucugccuccccag

SEQ ID NO: 214352 - RNA, 32 nt, Human
guguguagugagugcuucauguguggaauauu

SEQ ID NO: 214353 - RNA, 24 nt, Human
guguguauacauaaauauauaaua

SEQ ID NO: 214354 - RNA, 21 nt, Human
guguguauacauacauacaca

SEQ ID NO: 214355 - RNA, 24 nt, Human
guguguauauacaguauauacaua

SEQ ID NO: 214356 - RNA, 21 nt, Human
guguguauauauaaauacaua

SEQ ID NO: 214357 - RNA, 21 nt, Human
guguguauauauaaauauaua

SEQ ID NO: 214358 - RNA, 24 nt, Human
guguguauauauaaauauauaaua

SEQ ID NO: 214359 - RNA, 21 nt, Human
guguguauauauauaaauaua

SEQ ID NO: 214360 - RNA, 21 nt, Human
guguguauauauauacacaua

SEQ ID NO: 214361 - RNA, 19 nt, Human
guguguauauauaugcaca

SEQ ID NO: 214362 - RNA, 21 nt, Human
guguguauauauauuuauaua

SEQ ID NO: 214363 - RNA, 22 nt, Human
guguguauauauguaauauaua

SEQ ID NO: 214364 - RNA, 20 nt, Human
guguguauauauguagcaua

SEQ ID NO: 214365 - RNA, 21 nt, Human
guguguauauauguauacaua

SEQ ID NO: 214366 - RNA, 21 nt, Human
guguguauauauguauauaua

SEQ ID NO: 214367 - RNA, 21 nt, Human
guguguauauauguguauaua

SEQ ID NO: 214368 - RNA, 32 nt, Human
guguguauauuucauugcgauuuccuguuaag

SEQ ID NO: 214369 - RNA, 32 nt, Human
guguguaucuaguuccagcuacuugagaggcu

SEQ ID NO: 214370 - RNA, 32 nt, Human
guguguaucugugaguauauuuacacacagaa

SEQ ID NO: 214371 - RNA, 32 nt, Human
guguguaugcgacaugcccugccugaacaggu

SEQ ID NO: 214372 - RNA, 32 nt, Human
guguguaugugugcauuuuccacacuuuuuaa

SEQ ID NO: 214373 - RNA, 32 nt, Human
guguguaugugugugugaucugugucaugguu

SEQ ID NO: 214374 - RNA, 32 nt, Human
gugugucaaccugugagcaugcaccuguguau

SEQ ID NO: 214375 - RNA, 20 nt, Human
gugugucaagcccucacuca

SEQ ID NO: 214376 - RNA, 32 nt, Human
gugugucacaugcugccugagucacauguaca

SEQ ID NO: 214377 - RNA, 32 nt, Human
gugugucaccagccuccugaucugccaggguc

SEQ ID NO: 214378 - RNA, 32 nt, Human
gugugucagcuuugagaugguguguccuggau

SEQ ID NO: 214379 - RNA, 32 nt, Human
guguguccaccacuccacugugcucagggaag

SEQ ID NO: 214380 - RNA, 32 nt, Human
guguguccaucuguuauauguaaaggacaagg

SEQ ID NO: 214381 - RNA, 32 nt, Human
guguguccauggucguggucugugcuuuugua

SEQ ID NO: 214382 - RNA, 32 nt, Human
gugugucccaggaaauuccuccccuuauucuu

SEQ ID NO: 214383 - RNA, 32 nt, Human
gugugucccugggaagcacaggaagcugcuac

SEQ ID NO: 214384 - RNA, 32 nt, Human
gugugucccuuucuccuuccugaccuuccuca

SEQ ID NO: 214385 - RNA, 32 nt, Human
guguguccuaaauccaaugacauauccuuaua

SEQ ID NO: 214386 - RNA, 32 nt, Human
guguguccugugagagggcagggccagccagg

SEQ ID NO: 214387 - RNA, 32 nt, Human
gugugucgggggcagagggaaggagggaagga

SEQ ID NO: 214388 - RNA, 32 nt, Human
gugugucuauacauugcuuuccgcauuucaag

SEQ ID NO: 214389 - RNA, 32 nt, Human
gugugucucucccucaucaucuuccuaaggaa

SEQ ID NO: 214390 - RNA, 32 nt, Human
gugugucugcagcugugcucacaccuggagga

SEQ ID NO: 214391 - RNA, 32 nt, Human
gugugucugcuccuccucucucuccucaucac

SEQ ID NO: 214392 - RNA, 32 nt, Human
gugugucugcugucucgugcuguuuauucuug

SEQ ID NO: 214393 - RNA, 32 nt, Human
gugugucugggagcuugaccaccuggcuguca

SEQ ID NO: 214394 - RNA, 32 nt, Human
gugugucugguguugaggggacgaagggaccc

SEQ ID NO: 214395 - RNA, 32 nt, Human
gugugucuguaaucccagcuacucggccuccc

SEQ ID NO: 214396 - RNA, 32 nt, Human
gugugucuguaaucccagcuacucgggaggcu

SEQ ID NO: 214397 - RNA, 32 nt, Human
gugugucugugagagcuagcugccuuaccccu

SEQ ID NO: 214398 - RNA, 32 nt, Human
gugugucuucuaccugcauuuuggcaucagag

SEQ ID NO: 214399 - RNA, 32 nt, Human
gugugucuuucaugggacuguccccuuuagag

SEQ ID NO: 214400 - RNA, 32 nt, Human
gugugucuuugcacacacagugcagugggaac

SEQ ID NO: 214401 - RNA, 32 nt, Human
gugugugaaaacagacauuccagugccaccca

SEQ ID NO: 214402 - RNA, 32 nt, Human
gugugugaaccaagaauaaucuagucacguga

SEQ ID NO: 214403 - RNA, 32 nt, Human
gugugugacagagagagagcgagagagccugu

SEQ ID NO: 214404 - RNA, 31 nt, Human
gugugugacugccucccuuggccucagcucc

SEQ ID NO: 214405 - RNA, 32 nt, Human
gugugugagagcagugcuucugauccugcugu

SEQ ID NO: 214406 - RNA, 32 nt, Human
gugugugagagggagagacgacgugaggcgag

SEQ ID NO: 214407 - RNA, 32 nt, Human
gugugugagccaagcaauuucauuuaucaaag

SEQ ID NO: 214408 - RNA, 20 nt, Human
gugugugaggaggaccugau

SEQ ID NO: 214409 - RNA, 32 nt, Human
gugugugaggucuuggugggcucaggccagcu

SEQ ID NO: 214410 - RNA, 32 nt, Human
gugugugagugggaggagagggcagagguccc

SEQ ID NO: 214411 - RNA, 32 nt, Human
gugugugauguuccccuccauguccauguguu

SEQ ID NO: 214412 - RNA, 32 nt, Human
gugugugauugaguugaagaucugcagugaga

SEQ ID NO: 214413 - RNA, 32 nt, Human
gugugugauuucccucccucugagaaauauac

SEQ ID NO: 214414 - RNA, 32 nt, Human
gugugugcaaagcaggcucuagcaacaugauc

SEQ ID NO: 214415 - RNA, 32 nt, Human
gugugugcacacacacagaaaccacgagguag

SEQ ID NO: 214416 - RNA, 32 nt, Human
gugugugcacugacugugagucgaauaaacaa

SEQ ID NO: 214417 - RNA, 32 nt, Human
gugugugcaggugucggcacaggcuagcuccu

SEQ ID NO: 214418 - RNA, 32 nt, Human
gugugugcaugcuugggcggagucuacccgga

SEQ ID NO: 214419 - RNA, 32 nt, Human
gugugugcaugugugcgugugugcacacucac

SEQ ID NO: 214420 - RNA, 32 nt, Human
gugugugcccauggaagagacagugacagaaa

SEQ ID NO: 214421 - RNA, 32 nt, Human
gugugugccccaggcacguguaauaaagaacc

SEQ ID NO: 214422 - RNA, 32 nt, Human
gugugugccuauaaucccagcuacucaggagg

SEQ ID NO: 214423 - RNA, 32 nt, Human
gugugugccuggcagaacacugcacuccaauu

SEQ ID NO: 214424 - RNA, 32 nt, Human
gugugugccuguaaucccagcuacucgggagg

SEQ ID NO: 214425 - RNA, 32 nt, Human
gugugugccuguaaucccggcuacuugggagg

SEQ ID NO: 214426 - RNA, 32 nt, Human
gugugugccuguaauccuagcuacucgggagg

SEQ ID NO: 214427 - RNA, 32 nt, Human
gugugugccuguaauuccagcuacucgggagg

SEQ ID NO: 214428 - RNA, 32 nt, Human
gugugugccuguagucccagcuacuauggagg

SEQ ID NO: 214429 - RNA, 32 nt, Human
gugugugccuguagucccagcuacucgggagg

SEQ ID NO: 214430 - RNA, 32 nt, Human
gugugugccuguagucccagcuacuugugagg

SEQ ID NO: 214431 - RNA, 32 nt, Human
gugugugccuguagucucagcuacuugggagg

SEQ ID NO: 214432 - RNA, 32 nt, Human
gugugugccuguauuccuagcuacuuugaugg

SEQ ID NO: 214433 - RNA, 32 nt, Human
gugugugcggaggcacguguucccacuucucc

SEQ ID NO: 214434 - RNA, 32 nt, Human
gugugugcggccgcuccuccaggccuggccgu

SEQ ID NO: 214435 - RNA, 32 nt, Human
gugugugcggcgguucaugccuguaaucccag

SEQ ID NO: 214436 - RNA, 32 nt, Human
gugugugcgucugcgagcgcacacacaugcac

SEQ ID NO: 214437 - RNA, 32 nt, Human
gugugugcucugggcccugccucggccuccug

SEQ ID NO: 214438 - RNA, 32 nt, Human
gugugugcucugucugucugucuuugucuguc

SEQ ID NO: 214439 - RNA, 32 nt, Human
gugugugcugggcuccaaggaggaggagcuug

SEQ ID NO: 214440 - RNA, 32 nt, Human
gugugugcuggugcccguguacacgcugcucu

SEQ ID NO: 214441 - RNA, 30 nt, Human
guguguggaagccacgggcucaagcagcca

SEQ ID NO: 214442 - RNA, 32 nt, Human
guguguggagacuggagagaucaagagagagu

SEQ ID NO: 214443 - RNA, 32 nt, Human
guguguggagacuguggagcugggcagcuaug

SEQ ID NO: 214444 - RNA, 32 nt, Human
guguguggagcaucacaaacacaucagaagcc

SEQ ID NO: 214445 - RNA, 32 nt, Human
guguguggagggagggagggaggggagcaugg

SEQ ID NO: 214446 - RNA, 32 nt, Human
guguguggccagaccaguaccuccaaguguuc

SEQ ID NO: 214447 - RNA, 32 nt, Human
gugugugggccuagaggagagagcagagccca

SEQ ID NO: 214448 - RNA, 32 nt, Human
guguguggggagaaauagaauggugcucuuau

SEQ ID NO: 214449 - RNA, 32 nt, Human
guguguggggcacagaggacgugcaccucccu

SEQ ID NO: 214450 - RNA, 32 nt, Human
guguguggggcaggcaggauguggugcaggca

SEQ ID NO: 214451 - RNA, 32 nt, Human
guguguggggcucaugaaugcccacagcaugg

SEQ ID NO: 214452 - RNA, 32 nt, Human
guguguggucucagagccucugcuuccuuagg

SEQ ID NO: 214453 - RNA, 32 nt, Human
guguguggucucagaggcucugcuuccuuagg

SEQ ID NO: 214454 - RNA, 32 nt, Human
guguguggugaacacguucaguucaucagggc

SEQ ID NO: 214455 - RNA, 19 nt, Human
guguguguaugccuggaga

SEQ ID NO: 214456 - RNA, 32 nt, Human
guguguguauugagauuuacccagacugguuu

SEQ ID NO: 214457 - RNA, 32 nt, Human
guguguguauuuugauaaugauugaucuuaaa

SEQ ID NO: 214458 - RNA, 32 nt, Human
gugugugucccggugugaaaucgaggagggga

SEQ ID NO: 214459 - RNA, 32 nt, Human
gugugugucuguaaucccagcuacucgggagg

SEQ ID NO: 214460 - RNA, 32 nt, Human
gugugugucugucagugucucugugucagugu

SEQ ID NO: 214461 - RNA, 32 nt, Human
gugugugucuguguauacacacaaacacauau

SEQ ID NO: 214462 - RNA, 32 nt, Human
gugugugugaaagagagacagaagggaugguu

SEQ ID NO: 214463 - RNA, 32 nt, Human
gugugugugagugagagagcgagugagugagu

SEQ ID NO: 214464 - RNA, 32 nt, Human
gugugugugauaccagacaaauucccuuuuau

SEQ ID NO: 214465 - RNA, 32 nt, Human
gugugugugauggagggaaggggacagauuug

SEQ ID NO: 214466 - RNA, 32 nt, Human
gugugugugcgcacacacacaagaagccuuag

SEQ ID NO: 214467 - RNA, 32 nt, Human
guguguguggagggcagaggagaggggacaag

SEQ ID NO: 214468 - RNA, 20 nt, Human
guguguguggcagcaggcag

SEQ ID NO: 214469 - RNA, 32 nt, Human
guguguguggcgggagagugaaaccuuggggg

SEQ ID NO: 214470 - RNA, 32 nt, Human
guguguguggguggucacaggagagugugagu

SEQ ID NO: 214471 - RNA, 32 nt, Human
guguguguggugucugugugugugaugucagu

SEQ ID NO: 214472 - RNA, 32 nt, Human
guguguguggugugugcaucuggugucugugg

SEQ ID NO: 214473 - RNA, 32 nt, Human
guguguguucucucaaucucuguggauuuucu

SEQ ID NO: 214474 - RNA, 32 nt, Human
guguguguugcgggaggggaggacuggggcug

SEQ ID NO: 214475 - RNA, 32 nt, Human
guguguguuguuuuauaaugacugcuguacag

SEQ ID NO: 214476 - RNA, 32 nt, Human
guguguguuuuaugacuuaaauaucuuuacgu

SEQ ID NO: 214477 - RNA, 32 nt, Human
guguguguuuuguuuugauuugggggauauuu

SEQ ID NO: 214478 - RNA, 32 nt, Human
guguguguuuuuccucugcuguguucugugug

SEQ ID NO: 214479 - RNA, 32 nt, Human
guguguuacuauauuaaaauacacacacaacu

SEQ ID NO: 214480 - RNA, 32 nt, Human
guguguuagaagcaaguuagaggaagaagguc

SEQ ID NO: 214481 - RNA, 32 nt, Human
guguguuagagcaguugcaugcucuccugcug

SEQ ID NO: 214482 - RNA, 24 nt, Human
guguguuauacugauaaaauuuca

SEQ ID NO: 214483 - RNA, 32 nt, Human
guguguuaucuccacccacccacacacauaca

SEQ ID NO: 214484 - RNA, 32 nt, Human
guguguucaagaccagccuggucaacauagug

SEQ ID NO: 214485 - RNA, 32 nt, Human
guguguucagagcuugucuccaccucacggcu

SEQ ID NO: 214486 - RNA, 32 nt, Human
guguguucagccagacugggcaggugcagucu

SEQ ID NO: 214487 - RNA, 32 nt, Human
guguguucaguggcacccccagccuggguccc

SEQ ID NO: 214488 - RNA, 32 nt, Human
guguguucccuccuccgccauccucuguuccc

SEQ ID NO: 214489 - RNA, 32 nt, Human
guguguuccuuucuugauacuuagucauggga

SEQ ID NO: 214490 - RNA, 32 nt, Human
guguguucggaggggugaaagcauuaagaagc

SEQ ID NO: 214491 - RNA, 32 nt, Human
guguguucugugaaugcuagcucucuugaauu

SEQ ID NO: 214492 - RNA, 32 nt, Human
guguguucugugggagggugucuguggggaug

SEQ ID NO: 214493 - RNA, 32 nt, Human
guguguucugugugugcguuugcaaguauaua

SEQ ID NO: 214494 - RNA, 32 nt, Human
guguguucuucauaagcuucagugcaggauuu

SEQ ID NO: 214495 - RNA, 32 nt, Human
guguguugaauccauaguaugucccauucaga

SEQ ID NO: 214496 - RNA, 32 nt, Human
guguguugagggggauacucuguuuaugaaaa

SEQ ID NO: 214497 - RNA, 32 nt, Human
guguguugauuuucugacaugcuuguguaauu

SEQ ID NO: 214498 - RNA, 19 nt, Human
guguguugccaggggcaga

SEQ ID NO: 214499 - RNA, 32 nt, Human
guguguugcgggaggggaggacuggggcugga

SEQ ID NO: 214500 - RNA, 32 nt, Human
guguguugggaaaaccaaaaaccacaacuaca

SEQ ID NO: 214501 - RNA, 32 nt, Human
guguguuguguaacacaaauguuuuuaaaugg

SEQ ID NO: 214502 - RNA, 32 nt, Human
guguguuguguauggguuuauguguguguggu

SEQ ID NO: 214503 - RNA, 32 nt, Human
guguguuuagauuggaauaaaugugaugcauu

SEQ ID NO: 214504 - RNA, 24 nt, Human
guguguuuauaugccagaaauucu

SEQ ID NO: 214505 - RNA, 32 nt, Human
guguguuuauucuucucuacuugauuuccaaa

SEQ ID NO: 214506 - RNA, 32 nt, Human
guguguuugcuaggaauaauacaugaugacuu

SEQ ID NO: 214507 - RNA, 32 nt, Human
guguguuuucauuuuugucugcuuuaguucuc

SEQ ID NO: 214508 - RNA, 32 nt, Human
guguguuuucccuacgcaccucccauagcuau

SEQ ID NO: 214509 - RNA, 32 nt, Human
guguguuuuuccucugcuguguucuguguguc

SEQ ID NO: 214510 - RNA, 32 nt, Human
guguuaaaaaccugcauugccaacauugcagc

SEQ ID NO: 214511 - RNA, 32 nt, Human
guguuaaagcaggcagcgccucagcuugguua

SEQ ID NO: 214512 - RNA, 32 nt, Human
guguuaaauguugucuacagugcaaaauccau

SEQ ID NO: 214513 - RNA, 32 nt, Human
guguuaacacucccucccgaggagacuucccu

SEQ ID NO: 214514 - RNA, 32 nt, Human
guguuaacucaggaugccaaguggcccucaga

SEQ ID NO: 214515 - RNA, 32 nt, Human
guguuaagcccaaaguguguguuucugguugg

SEQ ID NO: 214516 - RNA, 32 nt, Human
guguuaagcuagaugaugacagugaugaugau

SEQ ID NO: 214517 - RNA, 32 nt, Human
guguuaagcuuuguggaccagguguuuuucuu

SEQ ID NO: 214518 - RNA, 32 nt, Human
guguuaagugcuccaaggagguuacuacugcc

SEQ ID NO: 214519 - RNA, 32 nt, Human
guguuaaucuacagagaacugcagcccuuauu

SEQ ID NO: 214520 - RNA, 32 nt, Human
guguuaaugugaauacuacaugcugaauuuca

SEQ ID NO: 214521 - RNA, 32 nt, Human
guguuacaaaggggugaaagagagggaauagu

SEQ ID NO: 214522 - RNA, 32 nt, Human
guguuacaaagucaguguuaauucuaaagaug

SEQ ID NO: 214523 - RNA, 32 nt, Human
guguuacaggagcugaaggauaaaguagcugg

SEQ ID NO: 214524 - RNA, 32 nt, Human
guguuacaggaggcuugugagcacagguagcc

SEQ ID NO: 214525 - RNA, 32 nt, Human
guguuacaggcagagucauuggacaauaaauu

SEQ ID NO: 214526 - RNA, 32 nt, Human
guguuacaguguccuacaguauucacuacaau

SEQ ID NO: 214527 - RNA, 32 nt, Human
guguuaccaucccagcucccgggagcccuuaa

SEQ ID NO: 214528 - RNA, 32 nt, Human
guguuacccaggcuggucuucaacucuuggcc

SEQ ID NO: 214529 - RNA, 32 nt, Human
guguuaccuccccuccuaacccuuccccuucu

SEQ ID NO: 214530 - RNA, 32 nt, Human
guguuacuaaguuuuuauggcuuuugugcauu

SEQ ID NO: 214531 - RNA, 32 nt, Human
guguuacuaguccugaaugcuuacagagaacu

SEQ ID NO: 214532 - RNA, 32 nt, Human
guguuacucaaauuauguggcuuucauuuugu

SEQ ID NO: 214533 - RNA, 24 nt, Human
guguuacuuaagcaaaaucaacua

SEQ ID NO: 214534 - RNA, 32 nt, Human
guguuacuuucuaauaacccuaggaggcguag

SEQ ID NO: 214535 - RNA, 32 nt, Human
guguuagaaaacaaacccuuagaacuuuccuu

SEQ ID NO: 214536 - RNA, 32 nt, Human
guguuagaaaugcaguugccauaggaguaacc

SEQ ID NO: 214537 - RNA, 32 nt, Human
guguuagaagcugauucuaggcugaggaaagc

SEQ ID NO: 214538 - RNA, 32 nt, Human
guguuagaaguggaugugcaagaccagccacu

SEQ ID NO: 214539 - RNA, 21 nt, Human
guguuagaauaggacaccccg

SEQ ID NO: 214540 - RNA, 32 nt, Human
guguuagauuugagucucucauguggaugcau

SEQ ID NO: 214541 - RNA, 32 nt, Human
guguuagccacuacaccuggccuggauugugu

SEQ ID NO: 214542 - RNA, 32 nt, Human
guguuagcgaaaccugucuaccugcuauagca

SEQ ID NO: 214543 - RNA, 32 nt, Human
guguuagcucuaacaucucccacaagcuaaag

SEQ ID NO: 214544 - RNA, 32 nt, Human
guguuagcucuuacacauguauaaacaacacu

SEQ ID NO: 214545 - RNA, 32 nt, Human
guguuagcuugccucugggcugggugagcuug

SEQ ID NO: 214546 - RNA, 32 nt, Human
guguuaggacuugagacauagcaaugggugag

SEQ ID NO: 214547 - RNA, 32 nt, Human
guguuaggaugcggcuuucucugccucugggc

SEQ ID NO: 214548 - RNA, 32 nt, Human
guguuaggcauggcacugagcagcuucuuuua

SEQ ID NO: 214549 - RNA, 32 nt, Human
guguuaggccgugaggcaucuuccugccagcc

SEQ ID NO: 214550 - RNA, 32 nt, Human
guguuaguauuuugaauaaacauguuauuacu

SEQ ID NO: 214551 - RNA, 32 nt, Human
guguuagucucaggcccuccuggaccacguug

SEQ ID NO: 214552 - RNA, 32 nt, Human
guguuaguuccauggguguggcuggucauggu

SEQ ID NO: 214553 - RNA, 32 nt, Human
guguuauacaaacuguaauggugugcuucaaa

SEQ ID NO: 214554 - RNA, 22 nt, Human
guguuauaggugaauugccaua

SEQ ID NO: 214555 - RNA, 32 nt, Human
guguuaucaaagcaaaaagaaaaugcugcaua

SEQ ID NO: 214556 - RNA, 32 nt, Human
guguuaucuguaaaucccagacauuguaugag

SEQ ID NO: 214557 - RNA, 32 nt, Human
guguuaucuguaaauuccagacauuguaugag

SEQ ID NO: 214558 - RNA, 32 nt, Human
guguuaugaugcaguuccacaacacacagcca

SEQ ID NO: 214559 - RNA, 20 nt, Human
guguuaugccacaaacagaa

SEQ ID NO: 214560 - RNA, 32 nt, Human
guguuauggagaugcuuccucucuccaaccuc

SEQ ID NO: 214561 - RNA, 32 nt, Human
guguuauguuuucauguaauagugucuuggag

SEQ ID NO: 214562 - RNA, 32 nt, Human
guguuauuaguggggaacagaaguauaugugc

SEQ ID NO: 214563 - RNA, 32 nt, Human
guguuauuccucaccccuucacucaacuccau

SEQ ID NO: 214564 - RNA, 32 nt, Human
guguuauuugggcuacuuggaaaaagaacaaa

SEQ ID NO: 214565 - RNA, 27 nt, Human
guguucaaaaccuguaggcacucucug

SEQ ID NO: 214566 - RNA, 23 nt, Human
guguucaaauucugauuauuaca

SEQ ID NO: 214567 - RNA, 32 nt, Human
guguucaagacuguuauggccaauauuguguu

SEQ ID NO: 214568 - RNA, 23 nt, Human
guguucaagcagcucccaugaca

SEQ ID NO: 214569 - RNA, 32 nt, Human
guguucaagcauggcuuccuggcggcccaggc

SEQ ID NO: 214570 - RNA, 21 nt, Human
guguucaagcuccugugggca

SEQ ID NO: 214571 - RNA, 32 nt, Human
guguucaaggcagacuuccugcccccugcacc

SEQ ID NO: 214572 - RNA, 32 nt, Human
guguucaauuggguugagauaaugauauugga

SEQ ID NO: 214573 - RNA, 32 nt, Human
guguucacaccacugcacuccagucugggcaa

SEQ ID NO: 214574 - RNA, 32 nt, Human
guguucaccaacccaaaagcacucugagccuu

SEQ ID NO: 214575 - RNA, 32 nt, Human
guguucaccaucacugaggcacugugaugugu

SEQ ID NO: 214576 - RNA, 22 nt, Human
guguucaccauggaacauuuug

SEQ ID NO: 214577 - RNA, 32 nt, Human
guguucacccaucccacccaaggcuuggcaca

SEQ ID NO: 214578 - RNA, 32 nt, Human
guguucacccuuauagagacauagucaaguuc

SEQ ID NO: 214579 - RNA, 24 nt, Human
guguucaccuguuucaucugagga

SEQ ID NO: 214580 - RNA, 32 nt, Human
guguucacuaauauuuuaacaguuuuucuuau

SEQ ID NO: 214581 - RNA, 32 nt, Human
guguucagacagccacaugaggggacagugca

SEQ ID NO: 214582 - RNA, 32 nt, Human
guguucagccugagcuaggagaguaucuagag

SEQ ID NO: 214583 - RNA, 32 nt, Human
guguucagccuucuggcacugcaggccuaggu

SEQ ID NO: 214584 - RNA, 32 nt, Human
guguucaggacacaucuauugcagagacucau

SEQ ID NO: 214585 - RNA, 32 nt, Human
guguucagggaaaguaccugaccaacagaacu

SEQ ID NO: 214586 - RNA, 32 nt, Human
guguucaggggucuccuucagggaaggagacc

SEQ ID NO: 214587 - RNA, 32 nt, Human
guguucaguaguuccaggacucagggacucag

SEQ ID NO: 214588 - RNA, 32 nt, Human
guguucaguucugggagacaagaguugggcca

SEQ ID NO: 214589 - RNA, 30 nt, Human
guguucauaaauaaaguuuguugaaacaca

SEQ ID NO: 214590 - RNA, 23 nt, Human
guguucaucaagacaccccucug

SEQ ID NO: 214591 - RNA, 24 nt, Human
guguucaucuuugggugcucucug

SEQ ID NO: 214592 - RNA, 32 nt, Human
guguucaugaaccugggcuggagcuuggggac

SEQ ID NO: 214593 - RNA, 32 nt, Human
guguucaugccacugcacuuccagccugggug

SEQ ID NO: 214594 - RNA, 32 nt, Human
guguuccaagcacaauauuacaacuucuuuug

SEQ ID NO: 214595 - RNA, 32 nt, Human
guguuccaaguugguugcugugacaaccucca

SEQ ID NO: 214596 - RNA, 32 nt, Human
guguuccacauccuuucacacgcuacacagaa

SEQ ID NO: 214597 - RNA, 32 nt, Human
guguuccagcaucuaaccuuuuacuuuugcau

SEQ ID NO: 214598 - RNA, 32 nt, Human
guguuccaggguaaugccagguggguuuugag

SEQ ID NO: 214599 - RNA, 32 nt, Human
guguucccaccaggaagucacgcgcagagagg

SEQ ID NO: 214600 - RNA, 32 nt, Human
guguucccacccaccugcuccagcacaggaac

SEQ ID NO: 214601 - RNA, 32 nt, Human
guguucccagaggcaggcggagguugaagaaa

SEQ ID NO: 214602 - RNA, 32 nt, Human
guguucccaggagcacugacugcaguugagag

SEQ ID NO: 214603 - RNA, 32 nt, Human
guguuccccaagaauucagagaacagcacugg

SEQ ID NO: 214604 - RNA, 32 nt, Human
guguuccccaggcugaagugcaguggcaugau

SEQ ID NO: 214605 - RNA, 32 nt, Human
guguucccuaacauucaaacugugcauuggcc

SEQ ID NO: 214606 - RNA, 32 nt, Human
guguucccucaucaucccccuaccugaacccc

SEQ ID NO: 214607 - RNA, 32 nt, Human
guguucccuggcccacucuccucucuccuucu

SEQ ID NO: 214608 - RNA, 32 nt, Human
guguuccgagccggagccugaccuguggaccg

SEQ ID NO: 214609 - RNA, 32 nt, Human
guguuccgccugggccggccccggcuggcugc

SEQ ID NO: 214610 - RNA, 32 nt, Human
guguuccggaucucccccuccauggcucccuu

SEQ ID NO: 214611 - RNA, 32 nt, Human
guguuccggcagggcaggaugggaaggcgugc

SEQ ID NO: 214612 - RNA, 32 nt, Human
guguuccggggcuucugggcagcugggccugc

SEQ ID NO: 214613 - RNA, 32 nt, Human
guguuccuaagggaggagacagaaggaggcug

SEQ ID NO: 214614 - RNA, 32 nt, Human
guguuccucagagaucccccaaacuggggucu

SEQ ID NO: 214615 - RNA, 32 nt, Human
guguuccucuauuugccugccaccucucuugu

SEQ ID NO: 214616 - RNA, 32 nt, Human
guguuccucucccccaucccuuaucucaacau

SEQ ID NO: 214617 - RNA, 32 nt, Human
guguuccugcagcuagagacaugaccuaacac

SEQ ID NO: 214618 - RNA, 32 nt, Human
guguuccugcagggacccuccgucuccuguaa

SEQ ID NO: 214619 - RNA, 32 nt, Human
guguuccuggagccugugccuaugucacugca

SEQ ID NO: 214620 - RNA, 31 nt, Human
guguuccuggcagcugggccugucuccuggg

SEQ ID NO: 214621 - RNA, 32 nt, Human
guguuccuguagucccagcuccccaggaggcu

SEQ ID NO: 214622 - RNA, 32 nt, Human
guguuccugugcaagggggagcuuugcuccag

SEQ ID NO: 214623 - RNA, 32 nt, Human
guguuccuucuggccagucccauacuuucugc

SEQ ID NO: 214624 - RNA, 32 nt, Human
guguuccuuucugcuuuauuucccugcugugu

SEQ ID NO: 214625 - RNA, 32 nt, Human
guguucgagguggagguuaggcgggugaaguu

SEQ ID NO: 214626 - RNA, 32 nt, Human
guguucgauucugcccuauuuauguuucuacu

SEQ ID NO: 214627 - RNA, 32 nt, Human
guguucgcaccacugcacuccagccuggguga

SEQ ID NO: 214628 - RNA, 32 nt, Human
guguucgcaucaacuuggaagugcaguaauug

SEQ ID NO: 214629 - RNA, 32 nt, Human
guguucuaagaacggaagcaucugggcuggau

SEQ ID NO: 214630 - RNA, 32 nt, Human
guguucuacauguauauuucucauuuuuaauu

SEQ ID NO: 214631 - RNA, 32 nt, Human
guguucuauuuauuuauugucuuccuguaaga

SEQ ID NO: 214632 - RNA, 22 nt, Human
guguucucaaagcaacuuucug

SEQ ID NO: 214633 - RNA, 32 nt, Human
guguucucagccaguacaccagagccaggcca

SEQ ID NO: 214634 - RNA, 32 nt, Human
guguucucagggacugggacacgggccaaaua

SEQ ID NO: 214635 - RNA, 32 nt, Human
guguucucauuuccuucacuguuuauuuuugu

SEQ ID NO: 214636 - RNA, 32 nt, Human
guguucuccagaaguacagggugcauuauuug

SEQ ID NO: 214637 - RNA, 32 nt, Human
guguucuccagccugggcaacagagugagucc

SEQ ID NO: 214638 - RNA, 32 nt, Human
guguucuccaucucuagugaagacagaaccag

SEQ ID NO: 214639 - RNA, 32 nt, Human
guguucucuuccuauuccuuuuugauaguuug

SEQ ID NO: 214640 - RNA, 32 nt, Human
guguucugaccacagcucuggugccguuucuc

SEQ ID NO: 214641 - RNA, 18 nt, Human
guguucugcaccugggga

SEQ ID NO: 214642 - RNA, 32 nt, Human
guguucugcuguguuucaggaucagggggacc

SEQ ID NO: 214643 - RNA, 32 nt, Human
guguucuggcagcuucucaggugcccgcacag

SEQ ID NO: 214644 - RNA, 32 nt, Human
guguucuggggagggaaggaaaagguguugga

SEQ ID NO: 214645 - RNA, 32 nt, Human
guguucugguggagugggaagggaggcuuggg

SEQ ID NO: 214646 - RNA, 32 nt, Human
guguucuguagucugugaggggagagcagaga

SEQ ID NO: 214647 - RNA, 32 nt, Human
guguucuguuguaugaauaauaccucaaguga

SEQ ID NO: 214648 - RNA, 32 nt, Human
guguucuuccauccuucaacugagcucaaagu

SEQ ID NO: 214649 - RNA, 32 nt, Human
guguucuuguaaccuuuauuucaugaaggacu

SEQ ID NO: 214650 - RNA, 32 nt, Human
guguucuuguccuuccucucugcuggcuggaa

SEQ ID NO: 214651 - RNA, 32 nt, Human
guguucuuucccaagagaaucaaaggaaagaa

SEQ ID NO: 214652 - RNA, 32 nt, Human
guguucuuugagccuagcaguuugguuuagac

SEQ ID NO: 214653 - RNA, 32 nt, Human
guguucuuuugaaauuauauaaaauagcugaa

SEQ ID NO: 214654 - RNA, 32 nt, Human
guguugaagcacuguugguuguuugguuagug

SEQ ID NO: 214655 - RNA, 21 nt, Human
guguugaagggaaucaaacua

SEQ ID NO: 214656 - RNA, 32 nt, Human
guguugaauuacgccagaagaccugaaaugcc

SEQ ID NO: 214657 - RNA, 32 nt, Human
guguugacagugugugcacacugcagacagca

SEQ ID NO: 214658 - RNA, 32 nt, Human
guguugacuggacugcuuggggugggggacga

SEQ ID NO: 214659 - RNA, 32 nt, Human
guguugagagaacguccuucuguccaucgugg

SEQ ID NO: 214660 - RNA, 32 nt, Human
guguugagauuuacaggugugagccaccacac

SEQ ID NO: 214661 - RNA, 32 nt, Human
guguugaggaaggcauuccaaccuuauuaaug

SEQ ID NO: 214662 - RNA, 32 nt, Human
guguugagugaggggugacccaggaagaacgu

SEQ ID NO: 214663 - RNA, 32 nt, Human
guguugaugccagaauguucagcuucaguaaa

SEQ ID NO: 214664 - RNA, 32 nt, Human
guguugauggggcagugaccagacaguccuga

SEQ ID NO: 214665 - RNA, 32 nt, Human
guguugauucauuuuaaugcuguuuaugauuu

SEQ ID NO: 214666 - RNA, 32 nt, Human
guguugcaagcuggaaacccagggaagccuga

SEQ ID NO: 214667 - RNA, 32 nt, Human
guguugcaauccaugagugaugucugccaugc

SEQ ID NO: 214668 - RNA, 32 nt, Human
guguugcaggcacuccagccuggcgacagagc

SEQ ID NO: 214669 - RNA, 32 nt, Human
guguugcaggguggagaaguggggagaagugu

SEQ ID NO: 214670 - RNA, 32 nt, Human
guguugcaguccggcucacugcaguuuugacc

SEQ ID NO: 214671 - RNA, 32 nt, Human
guguugcauuucuccccacucccugcccugcu

SEQ ID NO: 214672 - RNA, 32 nt, Human
guguugccaaggcuggagugcaggccgcgauc

SEQ ID NO: 214673 - RNA, 28 nt, Human
guguugccaagugcugcguccuccuggu

SEQ ID NO: 214674 - RNA, 32 nt, Human
guguugccacaaacacugcagagaccagguga

SEQ ID NO: 214675 - RNA, 32 nt, Human
guguugccaucuuugaaagcaucuucuacaag

SEQ ID NO: 214676 - RNA, 32 nt, Human
guguugcccagccuggucuugaauugggcuca

SEQ ID NO: 214677 - RNA, 32 nt, Human
guguugcccaggcuagagugcagcagugacau

SEQ ID NO: 214678 - RNA, 32 nt, Human
guguugcccaggcuagagugcaguggugccac

SEQ ID NO: 214679 - RNA, 32 nt, Human
guguugcccaggcuggagugcaaauggcuuga

SEQ ID NO: 214680 - RNA, 32 nt, Human
guguugcccaggcuggagugcaauggcgcaau

SEQ ID NO: 214681 - RNA, 32 nt, Human
guguugcccaggcuggagugcaguagcuauuc

SEQ ID NO: 214682 - RNA, 32 nt, Human
guguugcccaggcuggagugcaguagugcagu

SEQ ID NO: 214683 - RNA, 27 nt, Human
guguugcccaggcuggagugcaguggc

SEQ ID NO: 214684 - RNA, 32 nt, Human
guguugcccaggcuggagugcaguggccuggu

SEQ ID NO: 214685 - RNA, 32 nt, Human
guguugcccaggcuggagugcaguggugugau

SEQ ID NO: 214686 - RNA, 32 nt, Human
guguugcccaggcuggagugcgguggcuauuc

SEQ ID NO: 214687 - RNA, 32 nt, Human
guguugcccaggcugguauucaaacuccuggc

SEQ ID NO: 214688 - RNA, 21 nt, Human
guguugcccaggcuggucuca

SEQ ID NO: 214689 - RNA, 32 nt, Human
guguugccccggcuggagugcaguggcgcuau

SEQ ID NO: 214690 - RNA, 32 nt, Human
guguugcccucugucaaguuacugaauguugu

SEQ ID NO: 214691 - RNA, 32 nt, Human
guguugcccuggggcuaacagcuuaugacuug

SEQ ID NO: 214692 - RNA, 32 nt, Human
guguugccuaggcuggucucaaacuccugcuc

SEQ ID NO: 214693 - RNA, 32 nt, Human
guguugccuaggcuggucuggagcucuugauc

SEQ ID NO: 214694 - RNA, 32 nt, Human
guguugccucauucagcucaaacagauuucau

SEQ ID NO: 214695 - RNA, 32 nt, Human
guguugccugagacuaaagugcuuagcacaga

SEQ ID NO: 214696 - RNA, 32 nt, Human
guguugcgcagucuucauggguucccgacgag

SEQ ID NO: 214697 - RNA, 32 nt, Human
guguugcuaagcuguaaccgauaugcacuuga

SEQ ID NO: 214698 - RNA, 32 nt, Human
guguugcucaagggagucaggaagagacggca

SEQ ID NO: 214699 - RNA, 32 nt, Human
guguugcucacauguuaaaaucuugcucaccu

SEQ ID NO: 214700 - RNA, 32 nt, Human
guguugcucaggcuggagugcaguggugugau

SEQ ID NO: 214701 - RNA, 32 nt, Human
guguugcucuccauucuuuuaaaucucgcacu

SEQ ID NO: 214702 - RNA, 32 nt, Human
guguugcugaagauggagucucgcucugucac

SEQ ID NO: 214703 - RNA, 32 nt, Human
guguugcuucccucccccuauagggcuggaau

SEQ ID NO: 214704 - RNA, 32 nt, Human
guguuggagcuguuacuugcuccuucauuucc

SEQ ID NO: 214705 - RNA, 32 nt, Human
guguuggaggaggcaggggcugaaggugucaa

SEQ ID NO: 214706 - RNA, 32 nt, Human
guguuggaggccacuggguaacaacagaagaa

SEQ ID NO: 214707 - RNA, 22 nt, Human
guguuggcacacaccuguaauc

SEQ ID NO: 214708 - RNA, 32 nt, Human
guguuggcagucagcucccugccugcagggcc

SEQ ID NO: 214709 - RNA, 32 nt, Human
guguuggcccaggccuucuacaggaggucuug

SEQ ID NO: 214710 - RNA, 32 nt, Human
guguuggcuucccaacuccugaacacgacaca

SEQ ID NO: 214711 - RNA, 32 nt, Human
guguugggaagugggagcgggagggccgggca

SEQ ID NO: 214712 - RNA, 32 nt, Human
guguugggauuacaggcaaugagccaccacgc

SEQ ID NO: 214713 - RNA, 32 nt, Human
guguugggauuacguguguaagccacagugcc

SEQ ID NO: 214714 - RNA, 32 nt, Human
guguugggcacugucugaccauguugcauuug

SEQ ID NO: 214715 - RNA, 32 nt, Human
guguugggcagggugguuucaaacuucuggcc

SEQ ID NO: 214716 - RNA, 32 nt, Human
guguugggcaggucucugucccucucugggcc

SEQ ID NO: 214717 - RNA, 21 nt, Human
guguugggcagugacaccaug

SEQ ID NO: 214718 - RNA, 23 nt, Human
guguugggccacauucaaagcca

SEQ ID NO: 214719 - RNA, 32 nt, Human
guguuggggccuccaggauuugccugcagcuu

SEQ ID NO: 214720 - RNA, 32 nt, Human
guguugggggaagcugggcaucaguggccaca

SEQ ID NO: 214721 - RNA, 32 nt, Human
guguugggggaugcagugccgugccacauuuc

SEQ ID NO: 214722 - RNA, 32 nt, Human
guguugggucaugcugggaagggagcggcagc

SEQ ID NO: 214723 - RNA, 32 nt, Human
guguuggguccugggaaucuaagcuuuguucc

SEQ ID NO: 214724 - RNA, 32 nt, Human
guguugguaaugugcaucaugacaauuuccag

SEQ ID NO: 214725 - RNA, 32 nt, Human
guguugguaccacugccccuggccugagagcc

SEQ ID NO: 214726 - RNA, 32 nt, Human
guguugguauuagcuugauugguugguccgcu

SEQ ID NO: 214727 - RNA, 32 nt, Human
guguuggucaaagacaucacuggcuuugaagg

SEQ ID NO: 214728 - RNA, 32 nt, Human
guguuggucuugaacuccuggccucaagcaau

SEQ ID NO: 214729 - RNA, 32 nt, Human
guguuggugccauccuguggcuauagugauaa

SEQ ID NO: 214730 - RNA, 32 nt, Human
guguugguggaaugcagagcagcuggagauca

SEQ ID NO: 214731 - RNA, 19 nt, Human
guguugguggugcuguggg

SEQ ID NO: 214732 - RNA, 32 nt, Human
guguugguggugcugugggcuuggguguuaaa

SEQ ID NO: 214733 - RNA, 32 nt, Human
guguuggugucauguugagaaaaagguagaau

SEQ ID NO: 214734 - RNA, 32 nt, Human
guguugguuuccacucucgccaaagagagaag

SEQ ID NO: 214735 - RNA, 32 nt, Human
guguuguacagagggaaaaagacugguggaaa

SEQ ID NO: 214736 - RNA, 31 nt, Human
guguuguacagcuagaaaaggccuucuuccc

SEQ ID NO: 214737 - RNA, 32 nt, Human
guguuguaccacugcacuccagccugggugac

SEQ ID NO: 214738 - RNA, 32 nt, Human
guguuguagaagggccuuaaaaagaauuauuu

SEQ ID NO: 214739 - RNA, 21 nt, Human
guguuguaggaaguguccugu

SEQ ID NO: 214740 - RNA, 32 nt, Human
guguuguauuagaucucauaauuugacaaguu

SEQ ID NO: 214741 - RNA, 32 nt, Human
guguugucacuggguugaaguauauuugugug

SEQ ID NO: 214742 - RNA, 32 nt, Human
guguugucagcuucugaccucuugaucuguug

SEQ ID NO: 214743 - RNA, 32 nt, Human
guguugucaugaaaguaugacauccuagagug

SEQ ID NO: 214744 - RNA, 32 nt, Human
guguugucauuugcaaguucuuccugugacug

SEQ ID NO: 214745 - RNA, 32 nt, Human
guguuguccaggcuggagugcaauggugugau

SEQ ID NO: 214746 - RNA, 32 nt, Human
guguuguccaggcuggagugcaguggugugau

SEQ ID NO: 214747 - RNA, 32 nt, Human
guguuguccaguuuuccagaccaggacugaaa

SEQ ID NO: 214748 - RNA, 32 nt, Human
guguuguccucauuaggacaucaugucuuugu

SEQ ID NO: 214749 - RNA, 32 nt, Human
guguugucucacugcauccaaugcuuuuccuu

SEQ ID NO: 214750 - RNA, 32 nt, Human
guguugucucauagaacugccuggauuccauu

SEQ ID NO: 214751 - RNA, 32 nt, Human
guguugucuguggagaccgguggccugcagac

SEQ ID NO: 214752 - RNA, 32 nt, Human
guguugucuucgucugugccguuugucuucgu

SEQ ID NO: 214753 - RNA, 32 nt, Human
guguugugagagcugggauggggccagagauu

SEQ ID NO: 214754 - RNA, 32 nt, Human
guguugugagccaucaggacuccaucacucgu

SEQ ID NO: 214755 - RNA, 32 nt, Human
guguugugcucaggacucacucugcugcuggu

SEQ ID NO: 214756 - RNA, 32 nt, Human
guguugugggguccagaggggcugauacaugu

SEQ ID NO: 214757 - RNA, 32 nt, Human
guguugugucugccaggcucaggcagaggcgc

SEQ ID NO: 214758 - RNA, 32 nt, Human
guguuguuccuggcuggacuugauguccaggg

SEQ ID NO: 214759 - RNA, 32 nt, Human
guguuguuguguguaguauauaguugacucgc

SEQ ID NO: 214760 - RNA, 32 nt, Human
guguuuaaagcuuacuaugucuucauuuuggc

SEQ ID NO: 214761 - RNA, 32 nt, Human
guguuuaaaggacaaauagcugcuagaauuca

SEQ ID NO: 214762 - RNA, 32 nt, Human
guguuuaaccaccucccagcuuucuucuucuu

SEQ ID NO: 214763 - RNA, 32 nt, Human
guguuuaaccauuuuuaaguucgcuuucugca

SEQ ID NO: 214764 - RNA, 32 nt, Human
guguuuaagaauugguuuugggagggcgagga

SEQ ID NO: 214765 - RNA, 31 nt, Human
guguuuaagagaccacauucuuggguuccaa

SEQ ID NO: 214766 - RNA, 24 nt, Human
guguuuacaaaaggcagcccuuug

SEQ ID NO: 214767 - RNA, 32 nt, Human
guguuuacaggcucugguggcagagcaguugg

SEQ ID NO: 214768 - RNA, 32 nt, Human
guguuuacuggcacuccaugcaugcuugcuga

SEQ ID NO: 214769 - RNA, 32 nt, Human
guguuuacuucuagguccuuuggccaaaugcg

SEQ ID NO: 214770 - RNA, 32 nt, Human
guguuuacuuggugaggaggaggcagaaccag

SEQ ID NO: 214771 - RNA, 21 nt, Human
guguuuacuuguaacuuucug

SEQ ID NO: 214772 - RNA, 32 nt, Human
guguuuagaaguaggaagucacugugagcaau

SEQ ID NO: 214773 - RNA, 19 nt, Human
guguuuagggcagugggag

SEQ ID NO: 214774 - RNA, 32 nt, Human
guguuuauaugccagaaauucuguaccauuuu

SEQ ID NO: 214775 - RNA, 32 nt, Human
guguuuauggacuuuucacacacuaauuuuga

SEQ ID NO: 214776 - RNA, 32 nt, Human
guguuucacagcaaagaggguacagaaccauc

SEQ ID NO: 214777 - RNA, 32 nt, Human
guguuucaccaugccagcacagcgccaugagu

SEQ ID NO: 214778 - RNA, 32 nt, Human
guguuucagcucccauuguguugcucauaguc

SEQ ID NO: 214779 - RNA, 32 nt, Human
guguuucaggaagaagagagcagguagaaagg

SEQ ID NO: 214780 - RNA, 32 nt, Human
guguuucaggcagagcucuggccaggcugugc

SEQ ID NO: 214781 - RNA, 32 nt, Human
guguuucauacuuuagcaucaacgcugaguug

SEQ ID NO: 214782 - RNA, 32 nt, Human
guguuuccaacacagauuauguggcuguuggu

SEQ ID NO: 214783 - RNA, 32 nt, Human
guguuuccaaccccuuucaugggggagaggaa

SEQ ID NO: 214784 - RNA, 32 nt, Human
guguuuccaccugguccuaccugcuuagccau

SEQ ID NO: 214785 - RNA, 32 nt, Human
guguuuccagagugucaaguacauuuaaacac

SEQ ID NO: 214786 - RNA, 32 nt, Human
guguuuccauuuuaaagugaguugaguucuca

SEQ ID NO: 214787 - RNA, 32 nt, Human
guguuucccgggcuggguauuugccucgcacc

SEQ ID NO: 214788 - RNA, 32 nt, Human
guguuucccugccucucaauucgcugaaaaag

SEQ ID NO: 214789 - RNA, 32 nt, Human
guguuuccucugacucuagugcacugaugauc

SEQ ID NO: 214790 - RNA, 32 nt, Human
guguuuccuuggaaguuguagguggguuuuua

SEQ ID NO: 214791 - RNA, 32 nt, Human
guguuucgccacugcacaccagccugggugac

SEQ ID NO: 214792 - RNA, 21 nt, Human
guguuucgugaacugcaguga

SEQ ID NO: 214793 - RNA, 32 nt, Human
guguuucgugugggggcggggagcagcugcgc

SEQ ID NO: 214794 - RNA, 32 nt, Human
guguuucuccaccgcucagcacgccuucuaau

SEQ ID NO: 214795 - RNA, 21 nt, Human
guguuucugcaguggcugcag

SEQ ID NO: 214796 - RNA, 32 nt, Human
guguuucugccugucccugccugaugucccug

SEQ ID NO: 214797 - RNA, 32 nt, Human
guguuucuggacugcacuguuguccuugcccu

SEQ ID NO: 214798 - RNA, 32 nt, Human
guguuucuguagucccagcuacucgggaggcu

SEQ ID NO: 214799 - RNA, 32 nt, Human
guguuucuuaaugaacuugcaaaggaauauug

SEQ ID NO: 214800 - RNA, 23 nt, Human
guguuucuuagcucugaccugua

SEQ ID NO: 214801 - RNA, 32 nt, Human
guguuucuugacuguuuauucagaaucacagu

SEQ ID NO: 214802 - RNA, 32 nt, Human
guguuucuuucucccagcuggguggaaggaga

SEQ ID NO: 214803 - RNA, 32 nt, Human
guguuugaagcacagugaucaaguuauuuuua

SEQ ID NO: 214804 - RNA, 32 nt, Human
guguuugaaggagacuucgugguucugaggug

SEQ ID NO: 214805 - RNA, 32 nt, Human
guguuugagucuagauuuuauggcacaaggaa

SEQ ID NO: 214806 - RNA, 32 nt, Human
guguuugauaaauguuguccagguuccauugc

SEQ ID NO: 214807 - RNA, 32 nt, Human
guguuugauaaauguuguccagguuccauugu

SEQ ID NO: 214808 - RNA, 32 nt, Human
guguuugauaaauguuguccagguucuauugc

SEQ ID NO: 214809 - RNA, 32 nt, Human
guguuugauaaauguugucuagguuccauugc

SEQ ID NO: 214810 - RNA, 32 nt, Human
guguuugauuccauuccauggaaauaaaaagu

SEQ ID NO: 214811 - RNA, 32 nt, Human
guguuugcacacacaagugcacagcggcauga

SEQ ID NO: 214812 - RNA, 32 nt, Human
guguuugcagacuggcugggcccgugacccag

SEQ ID NO: 214813 - RNA, 32 nt, Human
guguuugcagugagagugacuugcugucaguc

SEQ ID NO: 214814 - RNA, 32 nt, Human
guguuugcaucacugcacuccagccugggcag

SEQ ID NO: 214815 - RNA, 32 nt, Human
guguuugccaagugccuggcccagagcaagug

SEQ ID NO: 214816 - RNA, 32 nt, Human
guguuugccagagcucccaucugccccacucg

SEQ ID NO: 214817 - RNA, 32 nt, Human
guguuugccagucccugcaugggugaauguug

SEQ ID NO: 214818 - RNA, 32 nt, Human
guguuugcuaacuguggucuuuguggcuacuu

SEQ ID NO: 214819 - RNA, 32 nt, Human
guguuugcuacaaauugaaugcucacguuacc

SEQ ID NO: 214820 - RNA, 32 nt, Human
guguuugcucaggccucuuucuuaguguugcu

SEQ ID NO: 214821 - RNA, 32 nt, Human
guguuugcugaauccaggucugagaucacaau

SEQ ID NO: 214822 - RNA, 32 nt, Human
guguuugcugggcacuaugcuaagcacuuugg

SEQ ID NO: 214823 - RNA, 32 nt, Human
guguuugcuguugcacacugauugcugagggu

SEQ ID NO: 214824 - RNA, 32 nt, Human
guguuugcuguugcuuuacugcugucuguaug

SEQ ID NO: 214825 - RNA, 21 nt, Human
guguuugcuucucugccauca

SEQ ID NO: 214826 - RNA, 32 nt, Human
guguuugcuuggaaauuccuugccccacaguu

SEQ ID NO: 214827 - RNA, 32 nt, Human
guguuuggagaaaaggacuccggugaggacug

SEQ ID NO: 214828 - RNA, 32 nt, Human
guguuuggagaggccccagggagccagggagc

SEQ ID NO: 214829 - RNA, 32 nt, Human
guguuuggaggaaccuccucccggcucucaga

SEQ ID NO: 214830 - RNA, 32 nt, Human
guguuuggcccuuagagagagauucuguguga

SEQ ID NO: 214831 - RNA, 32 nt, Human
guguuuggccuccauaaacugcagagaaauug

SEQ ID NO: 214832 - RNA, 32 nt, Human
guguuuggcucagagccacuauugucuguaaa

SEQ ID NO: 214833 - RNA, 32 nt, Human
guguuugggaaagggcagaagucaggcaagac

SEQ ID NO: 214834 - RNA, 32 nt, Human
guguuugggaccugggcucgggcuucuugcgu

SEQ ID NO: 214835 - RNA, 32 nt, Human
guguuugggcaggccgacuugauuuacagcca

SEQ ID NO: 214836 - RNA, 32 nt, Human
guguuuggggagugaauaaggggaagagugcu

SEQ ID NO: 214837 - RNA, 32 nt, Human
guguuuggggcugaggccugcuggacagaugg

SEQ ID NO: 214838 - RNA, 32 nt, Human
guguuugggggaaaauacgagggauugauuuu

SEQ ID NO: 214839 - RNA, 19 nt, Human
guguuugggucccuggaga

SEQ ID NO: 214840 - RNA, 32 nt, Human
guguuugggugcagacacaggcagcugcugcc

SEQ ID NO: 214841 - RNA, 32 nt, Human
guguuuggugguaaaggauuuucuccauggcc

SEQ ID NO: 214842 - RNA, 20 nt, Human
guguuugguuugccuggaga

SEQ ID NO: 214843 - RNA, 23 nt, Human
guguuugucuguauuugcacaug

SEQ ID NO: 214844 - RNA, 32 nt, Human
guguuugucuucauuccucuagcaccacuggg

SEQ ID NO: 214845 - RNA, 32 nt, Human
guguuugugcaaccuucaucugcacugggccc

SEQ ID NO: 214846 - RNA, 32 nt, Human
guguuugugggaaagccaggaggaaaagcucc

SEQ ID NO: 214847 - RNA, 32 nt, Human
guguuugugugugagagagagugagaaaugua

SEQ ID NO: 214848 - RNA, 32 nt, Human
guguuuguuagggagagaagagggagaggcag

SEQ ID NO: 214849 - RNA, 32 nt, Human
guguuuguuugaagacuucacuguggaagaaa

SEQ ID NO: 214850 - RNA, 32 nt, Human
guguuuguuugcuugaauacaaauguuugaua

SEQ ID NO: 214851 - RNA, 32 nt, Human
guguuuguuuguuugcagucucucucugccau

SEQ ID NO: 214852 - RNA, 32 nt, Human
guguuuguuuuuaaucaaauauuaccuaaaaa

SEQ ID NO: 214853 - RNA, 32 nt, Human
guguuuuaaagaaagaaugagggagacgggaa

SEQ ID NO: 214854 - RNA, 32 nt, Human
guguuuuacacaaaaccauuuuugaauuaagg

SEQ ID NO: 214855 - RNA, 32 nt, Human
guguuuuacacaaaugcauaucuugaacguca

SEQ ID NO: 214856 - RNA, 32 nt, Human
guguuuuacuuauucaucccucccucuccuuu

SEQ ID NO: 214857 - RNA, 24 nt, Human
guguuuuagcgaaggaacccucug

SEQ ID NO: 214858 - RNA, 32 nt, Human
guguuuuaugauacauuacagccaaauuauuu

SEQ ID NO: 214859 - RNA, 32 nt, Human
guguuuuaugguugcuucuguccuucuuuuua

SEQ ID NO: 214860 - RNA, 32 nt, Human
guguuuucaacuccaaaccccagagagggguu

SEQ ID NO: 214861 - RNA, 32 nt, Human
guguuuucaagcacaacccaccacaacaagca

SEQ ID NO: 214862 - RNA, 32 nt, Human
guguuuucacagcccccugagggaagggacgc

SEQ ID NO: 214863 - RNA, 32 nt, Human
guguuuucacugcaguuuagacugacuucuug

SEQ ID NO: 214864 - RNA, 32 nt, Human
guguuuucauuccccgcccucugacagaacaa

SEQ ID NO: 214865 - RNA, 32 nt, Human
guguuuucauucucuucccauuuuuguacauu

SEQ ID NO: 214866 - RNA, 32 nt, Human
guguuuucauuggaguccagggacccugguac

SEQ ID NO: 214867 - RNA, 32 nt, Human
guguuuuccaacaauggacuuggaucggcuuc

SEQ ID NO: 214868 - RNA, 32 nt, Human
guguuuuccuaccuggugaucagaagugucug

SEQ ID NO: 214869 - RNA, 32 nt, Human
guguuuuccuccguaccaucugacguuucugg

SEQ ID NO: 214870 - RNA, 32 nt, Human
guguuuucuaacccccuccugggagcucucua

SEQ ID NO: 214871 - RNA, 32 nt, Human
guguuuucucagagagaaagcagcacgcuucu

SEQ ID NO: 214872 - RNA, 32 nt, Human
guguuuucuccauugccucuugccagggaggg

SEQ ID NO: 214873 - RNA, 32 nt, Human
guguuuucugcgugagaggaaaagaugcuaga

SEQ ID NO: 214874 - RNA, 32 nt, Human
guguuuucuguaccuuagauucacaaacuuug

SEQ ID NO: 214875 - RNA, 32 nt, Human
guguuuucuucacuaaccucagaauacugggc

SEQ ID NO: 214876 - RNA, 32 nt, Human
guguuuucuuuuccucaacucccacagccagg

SEQ ID NO: 214877 - RNA, 32 nt, Human
guguuuucuuuucuaaaacaucaaaaugccaa

SEQ ID NO: 214878 - RNA, 32 nt, Human
guguuuugagcagcaauguguaaccagguguu

SEQ ID NO: 214879 - RNA, 32 nt, Human
guguuuugauuugugcugacugggugguggcu

SEQ ID NO: 214880 - RNA, 32 nt, Human
guguuuugccuuaaccucuuuucucuucccac

SEQ ID NO: 214881 - RNA, 32 nt, Human
guguuuugcuucaugcuagaagcauaugcaac

SEQ ID NO: 214882 - RNA, 32 nt, Human
guguuuugggagaacgaagacagccaggcuga

SEQ ID NO: 214883 - RNA, 32 nt, Human
guguuuuggggcacagaagcugugggaggagc

SEQ ID NO: 214884 - RNA, 32 nt, Human
guguuuuggggccccagaauuuggcauucacc

SEQ ID NO: 214885 - RNA, 32 nt, Human
guguuuugugaccucagcagggugggggucuu

SEQ ID NO: 214886 - RNA, 32 nt, Human
guguuuugugggcugccagggugggagaggag

SEQ ID NO: 214887 - RNA, 32 nt, Human
guguuuuguggggcuugggguuugguaacuua

SEQ ID NO: 214888 - RNA, 32 nt, Human
guguuuugugugugugcccacacguagacaaa

SEQ ID NO: 214889 - RNA, 32 nt, Human
guguuuuuaaaaauuaaagaagaagaaaagua

SEQ ID NO: 214890 - RNA, 32 nt, Human
guguuuuuaucacaccugcuccccagauuccc

SEQ ID NO: 214891 - RNA, 23 nt, Human
guguuuuuauugcugacuuuaaa

SEQ ID NO: 214892 - RNA, 32 nt, Human
guguuuuucauucacuuuaauagaagggcaaa

SEQ ID NO: 214893 - RNA, 32 nt, Human
guguuuuuccagcuaccugccacuugcccacc

SEQ ID NO: 214894 - RNA, 32 nt, Human
guguuuuucucauauuugaggaguguuaagau

SEQ ID NO: 214895 - RNA, 32 nt, Human
guguuuuucucuuccccaggagggacuuugau

SEQ ID NO: 214896 - RNA, 32 nt, Human
guguuuuucuucuuguguccuggauucugaua

SEQ ID NO: 214897 - RNA, 32 nt, Human
guguuuuucuuugguuucuucuguuuuccaac

SEQ ID NO: 214898 - RNA, 32 nt, Human
guguuuuugaaauguugggcauggccucguau

SEQ ID NO: 214899 - RNA, 32 nt, Human
guguuuuuggccagguugcacacucugagccu

SEQ ID NO: 214900 - RNA, 32 nt, Human
guguuuuuggcuaacaagcaguagacgccucc

SEQ ID NO: 214901 - RNA, 32 nt, Human
guuaaaaacaugugaaagauagguauggaaaa

SEQ ID NO: 214902 - RNA, 32 nt, Human
guuaaaaagacuguuauuucaccauuuaauug

SEQ ID NO: 214903 - RNA, 32 nt, Human
guuaaaaaugcaggccaggugcgguggcucac

SEQ ID NO: 214904 - RNA, 32 nt, Human
guuaaaacaacaacaacacuauccuauaaacu

SEQ ID NO: 214905 - RNA, 32 nt, Human
guuaaaacucagggauucugugacuacaagau

SEQ ID NO: 214906 - RNA, 32 nt, Human
guuaaaacugcaacagcucuuccaggaaagaa

SEQ ID NO: 214907 - RNA, 32 nt, Human
guuaaaagacuccaaguugcuuucugccuuuu

SEQ ID NO: 214908 - RNA, 32 nt, Human
guuaaaagauuuggcuaaaaucacacagucgg

SEQ ID NO: 214909 - RNA, 32 nt, Human
guuaaaagcuguucuuguguguuacauguaac

SEQ ID NO: 214910 - RNA, 32 nt, Human
guuaaaaggaacacugguugccugaacaguca

SEQ ID NO: 214911 - RNA, 32 nt, Human
guuaaacaaaagcauccagacacacaacaaug

SEQ ID NO: 214912 - RNA, 32 nt, Human
guuaaacaagugcuugaaggcaguaugcuugg

SEQ ID NO: 214913 - RNA, 32 nt, Human
guuaaacaaugcccaacaaccaaccagcuggc

SEQ ID NO: 214914 - RNA, 32 nt, Human
guuaaacagaaaacaagaaauucccuauaccu

SEQ ID NO: 214915 - RNA, 32 nt, Human
guuaaacagugcuccauucucucuccacaggc

SEQ ID NO: 214916 - RNA, 32 nt, Human
guuaaacaugguaagacugagguucugcagga

SEQ ID NO: 214917 - RNA, 32 nt, Human
guuaaacccagaccaacuccccaaaucuaauu

SEQ ID NO: 214918 - RNA, 32 nt, Human
guuaaacgaacugaacuagccugguggaagga

SEQ ID NO: 214919 - RNA, 32 nt, Human
guuaaacuucaauuccuguaaccugguuagua

SEQ ID NO: 214920 - RNA, 32 nt, Human
guuaaacuucacucuugaauucuuuacaaucu

SEQ ID NO: 214921 - RNA, 21 nt, Human
guuaaagaacaaagcuuccac

SEQ ID NO: 214922 - RNA, 32 nt, Human
guuaaagccauucucucgccucagccucccga

SEQ ID NO: 214923 - RNA, 24 nt, Human
guuaaagccccgcgguugccucuu

SEQ ID NO: 214924 - RNA, 32 nt, Human
guuaaagcugccuccagccucaggagcagugu

SEQ ID NO: 214925 - RNA, 32 nt, Human
guuaaagcugcucgauucccaggaucucggcu

SEQ ID NO: 214926 - RNA, 32 nt, Human
guuaaagcugcucucaccaguggaaccuaaga

SEQ ID NO: 214927 - RNA, 32 nt, Human
guuaaagcuuuguuuucauggccugugugaag

SEQ ID NO: 214928 - RNA, 32 nt, Human
guuaaaggaaagacuuaugucagucccagccc

SEQ ID NO: 214929 - RNA, 32 nt, Human
guuaaaggagaagcaagagcaagaaccuuuaa

SEQ ID NO: 214930 - RNA, 32 nt, Human
guuaaagggcugaggguugaggugagaggcac

SEQ ID NO: 214931 - RNA, 32 nt, Human
guuaaagucaugcaucagacccugccagacgu

SEQ ID NO: 214932 - RNA, 32 nt, Human
guuaaaguuaguuucagaacaauuacucaugc

SEQ ID NO: 214933 - RNA, 32 nt, Human
guuaaauaaccagcccaaaauugcagagcuaa

SEQ ID NO: 214934 - RNA, 32 nt, Human
guuaaauaaucugccuaaaauauuuuagaaau

SEQ ID NO: 214935 - RNA, 32 nt, Human
guuaaauacagauggcaguugagcacuucugu

SEQ ID NO: 214936 - RNA, 32 nt, Human
guuaaauacagcugcaaguagguuaccguaag

SEQ ID NO: 214937 - RNA, 32 nt, Human
guuaaauaucuuaccagccuauguaaggccga

SEQ ID NO: 214938 - RNA, 32 nt, Human
guuaaaucaaccuaauguucuuacacuguguu

SEQ ID NO: 214939 - RNA, 22 nt, Human
guuaaaucagugguccugagca

SEQ ID NO: 214940 - RNA, 32 nt, Human
guuaaaucccauaugcuagguaguguaggcau

SEQ ID NO: 214941 - RNA, 32 nt, Human
guuaaaucuuuguucucccugaggcuccuuag

SEQ ID NO: 214942 - RNA, 32 nt, Human
guuaaaugaaaguacagacagcuucauuguug

SEQ ID NO: 214943 - RNA, 32 nt, Human
guuaaaugacaucacuggaugaacuugaagau

SEQ ID NO: 214944 - RNA, 31 nt, Human
guuaaaugacuucuugcuagagaagacccca

SEQ ID NO: 214945 - RNA, 32 nt, Human
guuaaaugccucugauccacagaguuucauau

SEQ ID NO: 214946 - RNA, 24 nt, Human
guuaaauguguuauuugcuuuuaa

SEQ ID NO: 214947 - RNA, 30 nt, Human
guuaaauguuuaccuauauaaaaauuauua

SEQ ID NO: 214948 - RNA, 32 nt, Human
guuaaauuuuaugaguagugcugugucuggag

SEQ ID NO: 214949 - RNA, 20 nt, Human
guuaacaaaagaaaacuuua

SEQ ID NO: 214950 - RNA, 32 nt, Human
guuaacaaggugaguccaggaguguugcccug

SEQ ID NO: 214951 - RNA, 32 nt, Human
guuaacaauguucucagccucagcuuccuuac

SEQ ID NO: 214952 - RNA, 20 nt, Human
guuaacaauuaugacaucug

SEQ ID NO: 214953 - RNA, 32 nt, Human
guuaacacugcaacuaccaccguguacaggug

SEQ ID NO: 214954 - RNA, 32 nt, Human
guuaacagcuuuucaccuuacuucuccuguga

SEQ ID NO: 214955 - RNA, 20 nt, Human
guuaacaguauuaauucuaa

SEQ ID NO: 214956 - RNA, 32 nt, Human
guuaacaguugaguguucagcuccugacuuac

SEQ ID NO: 214957 - RNA, 21 nt, Human
guuaacauuccaagacucuag

SEQ ID NO: 214958 - RNA, 32 nt, Human
guugcacugcagcuuguguauagcaugcuaaa

SEQ ID NO: 214959 - RNA, 32 nt, Human
guugcacuggccagcaugggccugucccaagc

SEQ ID NO: 214960 - RNA, 32 nt, Human
guugcacuuggcuggcuuaugccucugagauc

SEQ ID NO: 214961 - RNA, 32 nt, Human
guugcagaaagcccuagauguaaugauagugu

SEQ ID NO: 214962 - RNA, 32 nt, Human
guugcagaacacuuccugucucuggcuucauc

SEQ ID NO: 214963 - RNA, 32 nt, Human
guugcagaccagccuggguaacauagugagac

SEQ ID NO: 214964 - RNA, 32 nt, Human
guugcagaggaagaguagaugagccggguccg

SEQ ID NO: 214965 - RNA, 32 nt, Human
guugcagaguuggaaguauuggccaagaagag

SEQ ID NO: 214966 - RNA, 32 nt, Human
guugcagaucgguccuuccucagcuccuugau

SEQ ID NO: 214967 - RNA, 32 nt, Human
guugcagccucacucucuacaggaugagggag

SEQ ID NO: 214968 - RNA, 32 nt, Human
guugcagcucuguucaaacacaauucuaucag

SEQ ID NO: 214969 - RNA, 32 nt, Human
guugcagcuguggccacugccucccggcacug

SEQ ID NO: 214970 - RNA, 32 nt, Human
guugcaggaacagcacccaggacucugaggag

SEQ ID NO: 214971 - RNA, 30 nt, Human
guugcaggaagccagaggaggcaauacagu

SEQ ID NO: 214972 - RNA, 32 nt, Human
guugcaggacaaaugcuucaguccgccgagag

SEQ ID NO: 214973 - RNA, 32 nt, Human
guugcaggccuccagugagcagggccccacca

SEQ ID NO: 214974 - RNA, 32 nt, Human
guugcaggcugaagugggggaugucauucuua

SEQ ID NO: 214975 - RNA, 32 nt, Human
guugcagggacuguggucucuccuggggcccg

SEQ ID NO: 214976 - RNA, 32 nt, Human
guugcagggaggcggagguugcagugagccga

SEQ ID NO: 214977 - RNA, 24 nt, Human
guugcaggggcuggugugcagugg

SEQ ID NO: 214978 - RNA, 32 nt, Human
guugcagguauucucaauuuccuuuuaagaaa

SEQ ID NO: 214979 - RNA, 32 nt, Human
guugcagguugggcacuagaaaaggccccacu

SEQ ID NO: 214980 - RNA, 32 nt, Human
guugcaguccacagcauucacauucucaggau

SEQ ID NO: 214981 - RNA, 32 nt, Human
guugcagugagcaggguggggucugggagggg

SEQ ID NO: 214982 - RNA, 32 nt, Human
guugcagugagccaagauugcagugagccaag

SEQ ID NO: 214983 - RNA, 32 nt, Human
guugcagugagccgggauugcagugagccacg

SEQ ID NO: 214984 - RNA, 32 nt, Human
guugcagugagcugagaucacaccaaaauggg

SEQ ID NO: 214985 - RNA, 32 nt, Human
guugcagugagcugagaucguggccacugcaa

SEQ ID NO: 214986 - RNA, 32 nt, Human
guugcagugagcugagaucgugucacuacacu

SEQ ID NO: 214987 - RNA, 32 nt, Human
guugcagugagcugagauggcaccacugcacu

SEQ ID NO: 214988 - RNA, 32 nt, Human
guugcagugagcugagauggcaccacuuauug

SEQ ID NO: 214989 - RNA, 32 nt, Human
guugcagugagcugagauugcaccacggcacu

SEQ ID NO: 214990 - RNA, 32 nt, Human
guugcagugagcugagauugcaccacuacacu

SEQ ID NO: 214991 - RNA, 32 nt, Human
guugcagugagcugagauugcaccacugcacu

SEQ ID NO: 214992 - RNA, 32 nt, Human
guugcagugagcugagauugcaccacugcauu

SEQ ID NO: 214993 - RNA, 32 nt, Human
guugcagugagcugagauugcaccacuguacu

SEQ ID NO: 214994 - RNA, 32 nt, Human
guugcagugagcugagauugcaccauugcacu

SEQ ID NO: 214995 - RNA, 32 nt, Human
guugcagugagcugagauugcaccauugcauu

SEQ ID NO: 214996 - RNA, 32 nt, Human
guugcagugagcugagauugcaucauugcacu

SEQ ID NO: 214997 - RNA, 32 nt, Human
guugcagugagcugagauugcgccacugcacu

SEQ ID NO: 214998 - RNA, 32 nt, Human
guugcagugagcugagauugcgccacuguacu

SEQ ID NO: 214999 - RNA, 32 nt, Human
guugcagugagcugagauugcgccauugcacu

SEQ ID NO: 215000 - RNA, 32 nt, Human
guugcagugagcugagauugcgccauugcagc

SEQ ID NO: 215001 - RNA, 32 nt, Human
guugcagugagcugagauugcgccauuguacu

SEQ ID NO: 215002 - RNA, 32 nt, Human
guugcagugagcugagauugcgcugcugcacu

SEQ ID NO: 215003 - RNA, 32 nt, Human
guugcagugagcugagauugggccacugcacu

SEQ ID NO: 215004 - RNA, 32 nt, Human
guugcagugagcugagauuguaccacugcgcu

SEQ ID NO: 215005 - RNA, 32 nt, Human
guugcagugagcugagauuguaccaugcacuc

SEQ ID NO: 215006 - RNA, 32 nt, Human
guugcagugagcugagauuguaccauugcacu

SEQ ID NO: 215007 - RNA, 32 nt, Human
guugcagugagcugagauugugccacuacacu

SEQ ID NO: 215008 - RNA, 32 nt, Human
guugcagugagcugagauugugccacuucauu

SEQ ID NO: 215009 - RNA, 32 nt, Human
guugcagugagcugagauugugcugcugcacu

SEQ ID NO: 215010 - RNA, 32 nt, Human
guugcagugagcugaggucgugcuacugcacu

SEQ ID NO: 215011 - RNA, 32 nt, Human
guugcagugagcugagguugcggugagcugag

SEQ ID NO: 215012 - RNA, 32 nt, Human
guugcagugagcugaguuugcaucacugcacu

SEQ ID NO: 215013 - RNA, 32 nt, Human
guugcagugagcuggaaucgugccacuccacu

SEQ ID NO: 215014 - RNA, 32 nt, Human
guugcagugucaggaugaccugccuuggaggc

SEQ ID NO: 215015 - RNA, 32 nt, Human
guugcaguuuacaaccugcccuccagggacac

SEQ ID NO: 215016 - RNA, 32 nt, Human
guugcauacagaugaguuggcagccggucuga

SEQ ID NO: 215017 - RNA, 32 nt, Human
guugcaucacuuaucuacguaaacaauugaag

SEQ ID NO: 215018 - RNA, 32 nt, Human
guugcauccccaggaagcaggcccgcagcgcc

SEQ ID NO: 215019 - RNA, 32 nt, Human
guugcaugauuuggcauguuggggcacauuug

SEQ ID NO: 215020 - RNA, 32 nt, Human
guugcaugccuguaaucccagcauuuugggag

SEQ ID NO: 215021 - RNA, 32 nt, Human
guugcauggagagguccaggagggaccggagg

SEQ ID NO: 215022 - RNA, 32 nt, Human
guugcauggcaucaccuccaccauacuccauc

SEQ ID NO: 215023 - RNA, 32 nt, Human
guugcauggcggcagugcucgcagggacaaca

SEQ ID NO: 215024 - RNA, 32 nt, Human
guugcauuacuggguaaucggggcccuggcuu

SEQ ID NO: 215025 - RNA, 32 nt, Human
guugcauugcacgcaggccugccugugguggg

SEQ ID NO: 215026 - RNA, 32 nt, Human
guugcauugggcuucuuggccucccaacucuu

SEQ ID NO: 215027 - RNA, 32 nt, Human
guugcauuuaugaagggagaagguuccuaucu

SEQ ID NO: 215028 - RNA, 32 nt, Human
guugcauuuccccauuucuuguuuuuaaaaga

SEQ ID NO: 215029 - RNA, 32 nt, Human
guugccaaacccauugagcuuggggcugcccu

SEQ ID NO: 215030 - RNA, 24 nt, Human
guugccaaggcuggaaugcagugg

SEQ ID NO: 215031 - RNA, 23 nt, Human
guugccaaggcuggagugcagug

SEQ ID NO: 215032 - RNA, 24 nt, Human
guugccaaggcuggagugcagugg

SEQ ID NO: 215033 - RNA, 32 nt, Human
guugccacaucuccugccuaguggagaagccu

SEQ ID NO: 215034 - RNA, 32 nt, Human
guugccacccacugcccaggccucacccagcg

SEQ ID NO: 215035 - RNA, 32 nt, Human
guugccacgugggaacaggaagauggugaaag

SEQ ID NO: 215036 - RNA, 21 nt, Human
guugccacuagaauguaguag

SEQ ID NO: 215037 - RNA, 32 nt, Human
guugccacucucagcaccccacauuugcaucu

SEQ ID NO: 215038 - RNA, 32 nt, Human
guugccacugcacucuggccugggcaacagag

SEQ ID NO: 215039 - RNA, 32 nt, Human
guugccacugugguuugccacacugacaccua

SEQ ID NO: 215040 - RNA, 32 nt, Human
guugccacuuucaaagugguccccuggggagc

SEQ ID NO: 215041 - RNA, 22 nt, Human
guugccagacuggagugcagug

SEQ ID NO: 215042 - RNA, 23 nt, Human
guugccagacuggagugcagugg

SEQ ID NO: 215043 - RNA, 32 nt, Human
guugccagacuuaacccagcagacacucugac

SEQ ID NO: 215044 - RNA, 32 nt, Human
guugccagagugaggaguuagcaggcaggacu

SEQ ID NO: 215045 - RNA, 32 nt, Human
guugccagcacacuggcucuuuccucgaaauu

SEQ ID NO: 215046 - RNA, 32 nt, Human
guugccaggaguuuucucugaaugguuguaau

SEQ ID NO: 215047 - RNA, 23 nt, Human
guugccaggccagagugcagugg

SEQ ID NO: 215048 - RNA, 23 nt, Human
guugccaggcuagagugcagugg

SEQ ID NO: 215049 - RNA, 23 nt, Human
guugccaggcuggaaugcagugg

SEQ ID NO: 215050 - RNA, 32 nt, Human
guugccaggcuggaaugcaguggcgcgaucuu

SEQ ID NO: 215051 - RNA, 32 nt, Human
guugccaggcuggaaugcaguggcgucaucuc

SEQ ID NO: 215052 - RNA, 32 nt, Human
guugccaggcuggaaugcaguggcgugaucuu

SEQ ID NO: 215053 - RNA, 23 nt, Human
guugccaggcuggaaugccgugg

SEQ ID NO: 215054 - RNA, 32 nt, Human
guugccaggcuggaaugccguggcgcaaucuc

SEQ ID NO: 215055 - RNA, 23 nt, Human
guugccaggcuggagggcagugg

SEQ ID NO: 215056 - RNA, 32 nt, Human
guugccaggcuggagugcacuggggcuuggcu

SEQ ID NO: 215057 - RNA, 23 nt, Human
guugccaggcuggagugcagugg

SEQ ID NO: 215058 - RNA, 32 nt, Human
guugccaggcuggagugcaguggcacaaucuu

SEQ ID NO: 215059 - RNA, 32 nt, Human
guugccaggcuggagugcaguggcgcaaucuu

SEQ ID NO: 215060 - RNA, 32 nt, Human
guugccaggcuggagugcaguggcgcgaucuc

SEQ ID NO: 215061 - RNA, 32 nt, Human
guugccaggcuggagugcaguggugcgaugua

SEQ ID NO: 215062 - RNA, 21 nt, Human
guugccaggcuggagugcugu

SEQ ID NO: 215063 - RNA, 22 nt, Human
guugccaggcuggagugcugug

SEQ ID NO: 215064 - RNA, 23 nt, Human
guugccaggcuggagugcugugg

SEQ ID NO: 215065 - RNA, 32 nt, Human
guugccaggcuggagugcuguggcgcuaucuc

SEQ ID NO: 215066 - RNA, 23 nt, Human
guugccaggcuggggugcagugg

SEQ ID NO: 215067 - RNA, 32 nt, Human
guugccaggcuggucucaaacuucuggacuca

SEQ ID NO: 215068 - RNA, 32 nt, Human
guugccagguuaucaucggagccuucuugugu

SEQ ID NO: 215069 - RNA, 31 nt, Human
guugccaucagggugcacacagcaggugcag

SEQ ID NO: 215070 - RNA, 32 nt, Human
guugccaucagugcuaacugacugccucucca

SEQ ID NO: 215071 - RNA, 32 nt, Human
guugccaucuccagggugacacggugugccug

SEQ ID NO: 215072 - RNA, 32 nt, Human
guugccaucucucaagaugguaaauuguuucc

SEQ ID NO: 215073 - RNA, 32 nt, Human
guugccauguacaaugagauuuauaaucauga

SEQ ID NO: 215074 - RNA, 32 nt, Human
guugccauguuugcucugccccugggguggag

SEQ ID NO: 215075 - RNA, 23 nt, Human
guugcccaaauucagugucagug

SEQ ID NO: 215076 - RNA, 20 nt, Human
guugcccaaccuggagugca

SEQ ID NO: 215077 - RNA, 23 nt, Human
guugcccaaccuggagugcaaug

SEQ ID NO: 215078 - RNA, 24 nt, Human
guugcccaaccuggagugcaaugg

SEQ ID NO: 215079 - RNA, 23 nt, Human
guugcccaaccuggagugcagug

SEQ ID NO: 215080 - RNA, 24 nt, Human
guugcccaaccuggagugcagugg

SEQ ID NO: 215081 - RNA, 32 nt, Human
guugcccaagcuaguuucaaacuccugggcuc

SEQ ID NO: 215082 - RNA, 23 nt, Human
guugcccaagcuggaaugcagug

SEQ ID NO: 215083 - RNA, 24 nt, Human
guugcccaagcuggaaugcagugg

SEQ ID NO: 215084 - RNA, 22 nt, Human
guugcccaagcuggaguacagu

SEQ ID NO: 215085 - RNA, 24 nt, Human
guugcccaagcuggaguacaguag

SEQ ID NO: 215086 - RNA, 24 nt, Human
guugcccaagcuggagugaagugg

SEQ ID NO: 215087 - RNA, 23 nt, Human
guugcccaagcuggagugcaaug

SEQ ID NO: 215088 - RNA, 24 nt, Human
guugcccaagcuggagugcaaugg

SEQ ID NO: 215089 - RNA, 23 nt, Human
guugcccaagcuggagugcagug

SEQ ID NO: 215090 - RNA, 24 nt, Human
guugcccaagcuggagugcagugg

SEQ ID NO: 215091 - RNA, 24 nt, Human
guugcccaagcuugagggcagugg

SEQ ID NO: 215092 - RNA, 21 nt, Human
guugcccaaggcuguaaguag

SEQ ID NO: 215093 - RNA, 23 nt, Human
guugcccaagguagagugcagug

SEQ ID NO: 215094 - RNA, 24 nt, Human
guugcccaagguagagugcagugg

SEQ ID NO: 215095 - RNA, 32 nt, Human
guugcccaagugaagcuggaaguggaucuuuc

SEQ ID NO: 215096 - RNA, 22 nt, Human
guugcccaaguuggagugcaau

SEQ ID NO: 215097 - RNA, 23 nt, Human
guugcccaaguuggagugcagug

SEQ ID NO: 215098 - RNA, 24 nt, Human
guugcccaaguuggagugcagugg

SEQ ID NO: 215099 - RNA, 23 nt, Human
guugcccacacuagagugcaaug

SEQ ID NO: 215100 - RNA, 24 nt, Human
guugcccacacuagagugcaaugg

SEQ ID NO: 215101 - RNA, 23 nt, Human
guugcccacauuggagugcagug

SEQ ID NO: 215102 - RNA, 24 nt, Human
guugcccacauuggagugcagugg

SEQ ID NO: 215103 - RNA, 23 nt, Human
guugcccacgcaggagugcagug

SEQ ID NO: 215104 - RNA, 24 nt, Human
guugcccacgcaggagugcagugg

SEQ ID NO: 215105 - RNA, 23 nt, Human
guugcccacgcuggagugcaaug

SEQ ID NO: 215106 - RNA, 24 nt, Human
guugcccacgcuggagugcaaugg

SEQ ID NO: 215107 - RNA, 32 nt, Human
guugcccacugcacugccccagcccagcccca

SEQ ID NO: 215108 - RNA, 32 nt, Human
guugcccagaccaaaugugucaauaaaccaga

SEQ ID NO: 215109 - RNA, 22 nt, Human
guugcccagacuagaguacaau

SEQ ID NO: 215110 - RNA, 23 nt, Human
guugcccagacuagagugcagug

SEQ ID NO: 215111 - RNA, 24 nt, Human
guugcccagacuagagugcagugg

SEQ ID NO: 215112 - RNA, 24 nt, Human
guugcccagacuggagagcagugg

SEQ ID NO: 215113 - RNA, 24 nt, Human
guugcccagacuggagggcagugg

SEQ ID NO: 215114 - RNA, 23 nt, Human
guugcccagacuggagugcaaug

SEQ ID NO: 215115 - RNA, 24 nt, Human
guugcccagacuggagugcaaugg

SEQ ID NO: 215116 - RNA, 23 nt, Human
guugcccagacuggagugcagug

SEQ ID NO: 215117 - RNA, 24 nt, Human
guugcccagacuggagugcagugg

SEQ ID NO: 215118 - RNA, 18 nt, Human
guugcccagacuggucuc

SEQ ID NO: 215119 - RNA, 19 nt, Human
guugcccagacuggucuca

SEQ ID NO: 215120 - RNA, 32 nt, Human
guugcccagacuguucggaaacuccugggcuc

SEQ ID NO: 215121 - RNA, 21 nt, Human
guugcccagaggaugugcagu

SEQ ID NO: 215122 - RNA, 19 nt, Human
guugcccagauuggucuca

SEQ ID NO: 215123 - RNA, 20 nt, Human
guugcccagccuggagugca

SEQ ID NO: 215124 - RNA, 22 nt, Human
guugcccagccuggagugcaau

SEQ ID NO: 215125 - RNA, 24 nt, Human
guugcccagccuggagugcaauag

SEQ ID NO: 215126 - RNA, 23 nt, Human
guugcccagcuggagugcagugg

SEQ ID NO: 215127 - RNA, 21 nt, Human
guugcccaggaggagcugcag

SEQ ID NO: 215128 - RNA, 23 nt, Human
guugcccaggagggagugcagug

SEQ ID NO: 215129 - RNA, 24 nt, Human
guugcccaggagggagugcagugg

SEQ ID NO: 215130 - RNA, 32 nt, Human
guugcccaggagggagugcaguggugcaaccu

SEQ ID NO: 215131 - RNA, 23 nt, Human
guugcccaggauggagugcagug

SEQ ID NO: 215132 - RNA, 24 nt, Human
guugcccaggauggagugcagugg

SEQ ID NO: 215133 - RNA, 23 nt, Human
guugcccaggcaagagugcagug

SEQ ID NO: 215134 - RNA, 24 nt, Human
guugcccaggcaagagugcagugg

SEQ ID NO: 215135 - RNA, 23 nt, Human
guugcccaggcaggaguacagug

SEQ ID NO: 215136 - RNA, 24 nt, Human
guugcccaggcaggaguacagugg

SEQ ID NO: 215137 - RNA, 32 nt, Human
guugcccaggcaggaguacaguggcauuaucu

SEQ ID NO: 215138 - RNA, 23 nt, Human
guugcccaggcaguagugcagug

SEQ ID NO: 215139 - RNA, 24 nt, Human
guugcccaggcaguagugcagugg

SEQ ID NO: 215140 - RNA, 32 nt, Human
guugcccaggccagucucaaacuccuggacuc

SEQ ID NO: 215141 - RNA, 23 nt, Human
guugcccaggccuaguuucagug

SEQ ID NO: 215142 - RNA, 24 nt, Human
guugcccaggccuaguuucagugg

SEQ ID NO: 215143 - RNA, 22 nt, Human
guugcccaggcggaguacaaug

SEQ ID NO: 215144 - RNA, 23 nt, Human
guugcccaggcggaguacaaugg

SEQ ID NO: 215145 - RNA, 32 nt, Human
guugcccaggcggaguacaauggugggaucuc

SEQ ID NO: 215146 - RNA, 21 nt, Human
guugcccaggcuagagcgcag

SEQ ID NO: 215147 - RNA, 23 nt, Human
guugcccaggcuagagcgcaggg

SEQ ID NO: 215148 - RNA, 20 nt, Human
guugcccaggcuagagugca

SEQ ID NO: 215149 - RNA, 23 nt, Human
guugcccaggcuagagugcaaug

SEQ ID NO: 215150 - RNA, 24 nt, Human
guugcccaggcuagagugcaaugg

SEQ ID NO: 215151 - RNA, 23 nt, Human
guugcccaggcuagagugcacug

SEQ ID NO: 215152 - RNA, 24 nt, Human
guugcccaggcuagagugcacugg

SEQ ID NO: 215153 - RNA, 21 nt, Human
guugcccaggcuagagugcag

SEQ ID NO: 215154 - RNA, 24 nt, Human
guugcccaggcuagagugcagcag

SEQ ID NO: 215155 - RNA, 23 nt, Human
guugcccaggcuagagugcagug

SEQ ID NO: 215156 - RNA, 24 nt, Human
guugcccaggcuagagugcagugg

SEQ ID NO: 215157 - RNA, 23 nt, Human
guugcccaggcuagcaugcaaug

SEQ ID NO: 215158 - RNA, 24 nt, Human
guugcccaggcuagcaugcaaugg

SEQ ID NO: 215159 - RNA, 32 nt, Human
guugcccaggcuagccucaaacuccugggcuc

SEQ ID NO: 215160 - RNA, 32 nt, Human
guugcccaggcuagucucaaacuccugggcuc

SEQ ID NO: 215161 - RNA, 20 nt, Human
guugcccaggcugaagugca

SEQ ID NO: 215162 - RNA, 23 nt, Human
guugcccaggcugaagugcaaug

SEQ ID NO: 215163 - RNA, 23 nt, Human
guugcccaggcugaagugcagug

SEQ ID NO: 215164 - RNA, 24 nt, Human
guugcccaggcugaagugcagugg

SEQ ID NO: 215165 - RNA, 23 nt, Human
guugcccaggcugaagugccaug

SEQ ID NO: 215166 - RNA, 24 nt, Human
guugcccaggcugaagugccaugg

SEQ ID NO: 215167 - RNA, 24 nt, Human
guugcccaggcugaaguguagugg

SEQ ID NO: 215168 - RNA, 20 nt, Human
guugcccaggcugaauucag

SEQ ID NO: 215169 - RNA, 23 nt, Human
guugcccaggcugcagugcagug

SEQ ID NO: 215170 - RNA, 24 nt, Human
guugcccaggcugcagugcagugg

SEQ ID NO: 215171 - RNA, 21 nt, Human
guugcccaggcugcuggagug

SEQ ID NO: 215172 - RNA, 27 nt, Human
guugcccaggcugcuggagugccgugg

SEQ ID NO: 215173 - RNA, 23 nt, Human
guugcccaggcuggaaauggcgc

SEQ ID NO: 215174 - RNA, 20 nt, Human
guugcccaggcuggaagugu

SEQ ID NO: 215175 - RNA, 23 nt, Human
guugcccaggcuggaauacagug

SEQ ID NO: 215176 - RNA, 24 nt, Human
guugcccaggcuggaauacagugg

SEQ ID NO: 215177 - RNA, 23 nt, Human
guugcccaggcuggaaugcaaug

SEQ ID NO: 215178 - RNA, 24 nt, Human
guugcccaggcuggaaugcaaugg

SEQ ID NO: 215179 - RNA, 23 nt, Human
guugcccaggcuggaaugcagug

SEQ ID NO: 215180 - RNA, 24 nt, Human
guugcccaggcuggaaugcagugg

SEQ ID NO: 215181 - RNA, 24 nt, Human
guugcccaggcuggacugcagugg

SEQ ID NO: 215182 - RNA, 24 nt, Human
guugcccaggcuggagagcagugg

SEQ ID NO: 215183 - RNA, 23 nt, Human
guugcccaggcuggagcgcagug

SEQ ID NO: 215184 - RNA, 24 nt, Human
guugcccaggcuggagcgcagugg

SEQ ID NO: 215185 - RNA, 23 nt, Human
guugcccaggcuggagggcaaug

SEQ ID NO: 215186 - RNA, 24 nt, Human
guugcccaggcuggagggcaaugg

SEQ ID NO: 215187 - RNA, 22 nt, Human
guugcccaggcuggagggcagu

SEQ ID NO: 215188 - RNA, 23 nt, Human
guugcccaggcuggagggcagug

SEQ ID NO: 215189 - RNA, 24 nt, Human
guugcccaggcuggagggcagugg

SEQ ID NO: 215190 - RNA, 20 nt, Human
guugcccaggcuggaguaca

SEQ ID NO: 215191 - RNA, 23 nt, Human
guugcccaggcuggaguacaaug

SEQ ID NO: 215192 - RNA, 24 nt, Human
guugcccaggcuggaguacaaugg

SEQ ID NO: 215193 - RNA, 23 nt, Human
guugcccaggcuggaguacagug

SEQ ID NO: 215194 - RNA, 24 nt, Human
guugcccaggcuggaguacagugg

SEQ ID NO: 215195 - RNA, 23 nt, Human
guugcccaggcuggaguacauug

SEQ ID NO: 215196 - RNA, 24 nt, Human
guugcccaggcuggaguacauugg

SEQ ID NO: 215197 - RNA, 22 nt, Human
guugcccaggcuggaguauagu

SEQ ID NO: 215198 - RNA, 24 nt, Human
guugcccaggcuggaguauaguag

SEQ ID NO: 215199 - RNA, 26 nt, Human
guugcccaggcuggaguauaguagug

SEQ ID NO: 215200 - RNA, 24 nt, Human
guugcccaggcuggagugaagugg

SEQ ID NO: 215201 - RNA, 19 nt, Human
guugcccaggcuggagugc

SEQ ID NO: 215202 - RNA, 20 nt, Human
guugcccaggcuggagugca

SEQ ID NO: 215203 - RNA, 21 nt, Human
guugcccaggcuggagugcaa

SEQ ID NO: 215204 - RNA, 24 nt, Human
guugcccaggcuggagugcaacgg

SEQ ID NO: 215205 - RNA, 22 nt, Human
guugcccaggcuggagugcaau

SEQ ID NO: 215206 - RNA, 24 nt, Human
guugcccaggcuggagugcaauag

SEQ ID NO: 215207 - RNA, 23 nt, Human
guugcccaggcuggagugcaaug

SEQ ID NO: 215208 - RNA, 24 nt, Human
guugcccaggcuggagugcaauga

SEQ ID NO: 215209 - RNA, 24 nt, Human
guugcccaggcuggagugcaaugg

SEQ ID NO: 215210 - RNA, 21 nt, Human
guugcccaggcuggagugcag

SEQ ID NO: 215211 - RNA, 24 nt, Human
guugcccaggcuggagugcagagg

SEQ ID NO: 215212 - RNA, 23 nt, Human
guugcccaggcuggagugcaggg

SEQ ID NO: 215213 - RNA, 22 nt, Human
guugcccaggcuggagugcagu

SEQ ID NO: 215214 - RNA, 24 nt, Human
guugcccaggcuggagugcaguag

SEQ ID NO: 215215 - RNA, 23 nt, Human
guugcccaggcuggagugcagug

SEQ ID NO: 215216 - RNA, 24 nt, Human
guugcccaggcuggagugcagugg

SEQ ID NO: 215217 - RNA, 23 nt, Human
guugcccaggcuggagugcauug

SEQ ID NO: 215218 - RNA, 24 nt, Human
guugcccaggcuggagugcauugg

SEQ ID NO: 215219 - RNA, 24 nt, Human
guugcccaggcuggagugccuugg

SEQ ID NO: 215220 - RNA, 23 nt, Human
guugcccaggcuggagugcgaug

SEQ ID NO: 215221 - RNA, 24 nt, Human
guugcccaggcuggagugcgaugg

SEQ ID NO: 215222 - RNA, 22 nt, Human
guugcccaggcuggagugcggu

SEQ ID NO: 215223 - RNA, 23 nt, Human
guugcccaggcuggagugcggug

SEQ ID NO: 215224 - RNA, 24 nt, Human
guugcccaggcuggagugcggugg

SEQ ID NO: 215225 - RNA, 24 nt, Human
guugcccaggcuggaguggagugg

SEQ ID NO: 215226 - RNA, 21 nt, Human
guugcccaggcuggaguguag

SEQ ID NO: 215227 - RNA, 24 nt, Human
guugcccaggcuggaguguagugg

SEQ ID NO: 215228 - RNA, 24 nt, Human
guugcccaggcuggagugugaugg

SEQ ID NO: 215229 - RNA, 24 nt, Human
guugcccaggcuggaguguggugg

SEQ ID NO: 215230 - RNA, 24 nt, Human
guugcccaggcuggauugcggugg

SEQ ID NO: 215231 - RNA, 23 nt, Human
guugcccaggcuggcgugcagug

SEQ ID NO: 215232 - RNA, 24 nt, Human
guugcccaggcuggcgugcagugg

SEQ ID NO: 215233 - RNA, 21 nt, Human
guugcccaggcugggagggca

SEQ ID NO: 215234 - RNA, 24 nt, Human
guugcccaggcugggagggcaaug

SEQ ID NO: 215235 - RNA, 23 nt, Human
guugcccaggcuggggugcagug

SEQ ID NO: 215236 - RNA, 24 nt, Human
guugcccaggcuggggugcagugg

SEQ ID NO: 215237 - RNA, 19 nt, Human
guugcccaggcuggucuca

SEQ ID NO: 215238 - RNA, 20 nt, Human
guugcccaggcuggucucag

SEQ ID NO: 215239 - RNA, 22 nt, Human
guugcccaggcuggucucggag

SEQ ID NO: 215240 - RNA, 21 nt, Human
guugcccaggcuggucugaag

SEQ ID NO: 215241 - RNA, 17 nt, Human
guugcccaggcuggugu

SEQ ID NO: 215242 - RNA, 19 nt, Human
guugcccaggcugguguca

SEQ ID NO: 215243 - RNA, 23 nt, Human
guugcccaggcuggugugcaaug

SEQ ID NO: 215244 - RNA, 24 nt, Human
guugcccaggcuggugugcaaugg

SEQ ID NO: 215245 - RNA, 23 nt, Human
guugcccaggcuguaguacaaug

SEQ ID NO: 215246 - RNA, 24 nt, Human
guugcccaggcuguaguacaaugg

SEQ ID NO: 215247 - RNA, 23 nt, Human
guugcccaggcuguagugcagug

SEQ ID NO: 215248 - RNA, 24 nt, Human
guugcccaggcuguagugcagugg

SEQ ID NO: 215249 - RNA, 23 nt, Human
guugcccaggcuugagugcagug

SEQ ID NO: 215250 - RNA, 32 nt, Human
guugcccaggcuugccuggaacuccuagccuc

SEQ ID NO: 215251 - RNA, 24 nt, Human
guugcccagggcuggagugcagug

SEQ ID NO: 215252 - RNA, 25 nt, Human
guugcccagggcuggagugcagugg

SEQ ID NO: 215253 - RNA, 32 nt, Human
guugcccaggguggagugcagcggugcgaucu

SEQ ID NO: 215254 - RNA, 23 nt, Human
guugcccaggguggagugcagug

SEQ ID NO: 215255 - RNA, 24 nt, Human
guugcccaggguggagugcagugg

SEQ ID NO: 215256 - RNA, 32 nt, Human
guugcccaggguggagugcaguggcaggauca

SEQ ID NO: 215257 - RNA, 20 nt, Human
guugcccaggguggucugua

SEQ ID NO: 215258 - RNA, 21 nt, Human
guugcccagguccugcaaagg

SEQ ID NO: 215259 - RNA, 23 nt, Human
guugcccagguuagagugcagug

SEQ ID NO: 215260 - RNA, 24 nt, Human
guugcccagguuagagugcagugg

SEQ ID NO: 215261 - RNA, 25 nt, Human
guugcccagguucuagagugcagug

SEQ ID NO: 215262 - RNA, 26 nt, Human
guugcccagguucuagagugcagugg

SEQ ID NO: 215263 - RNA, 22 nt, Human
guugcccagguuggagugcagu

SEQ ID NO: 215264 - RNA, 23 nt, Human
guugcccagguuggagugcagug

SEQ ID NO: 215265 - RNA, 24 nt, Human
guugcccagguuggagugcagugg

SEQ ID NO: 215266 - RNA, 20 nt, Human
guugcccagguuggagugua

SEQ ID NO: 215267 - RNA, 22 nt, Human
guugcccagguuggaguguaau

SEQ ID NO: 215268 - RNA, 24 nt, Human
guugcccagucuggaguucagugg

SEQ ID NO: 215269 - RNA, 24 nt, Human
guugcccaugcuggagggcagugg

SEQ ID NO: 215270 - RNA, 23 nt, Human
guugcccaugcuggagugcaaug

SEQ ID NO: 215271 - RNA, 24 nt, Human
guugcccaugcuggagugcaaugg

SEQ ID NO: 215272 - RNA, 23 nt, Human
guugcccaugcuggagugcauug

SEQ ID NO: 215273 - RNA, 24 nt, Human
guugcccaugcuggagugcauugg

SEQ ID NO: 215274 - RNA, 32 nt, Human
guugcccauguaugcagaugggagaagugauu

SEQ ID NO: 215275 - RNA, 23 nt, Human
guugcccauucuggagugcagug

SEQ ID NO: 215276 - RNA, 24 nt, Human
guugcccauucuggagugcagugg

SEQ ID NO: 215277 - RNA, 32 nt, Human
guugccccaccugagcccccacccgggagcag

SEQ ID NO: 215278 - RNA, 24 nt, Human
guugccccagcuugagugcagugg

SEQ ID NO: 215279 - RNA, 24 nt, Human
guugccccaggcuggagugcagug

SEQ ID NO: 215280 - RNA, 25 nt, Human
guugccccaggcuggagugcagugg

SEQ ID NO: 215281 - RNA, 32 nt, Human
guugcccccacccuggcugccugcuaagggcc

SEQ ID NO: 215282 - RNA, 19 nt, Human
guugccccccaggguccua

SEQ ID NO: 215283 - RNA, 32 nt, Human
guugccccgccuggcccggcgacgcccgcuca

SEQ ID NO: 215284 - RNA, 32 nt, Human
guugccccuuucucuuuuccccuuuccugucc

SEQ ID NO: 215285 - RNA, 32 nt, Human
guugcccgcgccagagccucaggccggcuccu

SEQ ID NO: 215286 - RNA, 23 nt, Human
guugcccgggcuggaaugcaaug

SEQ ID NO: 215287 - RNA, 24 nt, Human
guugcccgggcuggaaugcaaugg

SEQ ID NO: 215288 - RNA, 23 nt, Human
guugcccgggcuggagugcaaug

SEQ ID NO: 215289 - RNA, 24 nt, Human
guugcccgggcuggagugcaaugg

SEQ ID NO: 215290 - RNA, 21 nt, Human
guugcccgggcuggagugcag

SEQ ID NO: 215291 - RNA, 24 nt, Human
guugcccgggcuggagugcagcgg

SEQ ID NO: 215292 - RNA, 32 nt, Human
guugcccgggcuggcgccgcugggcagagccg

SEQ ID NO: 215293 - RNA, 32 nt, Human
guugcccguggaucugggcacaaucauuggaa

SEQ ID NO: 215294 - RNA, 21 nt, Human
guugcccuauuugucuucucc

SEQ ID NO: 215295 - RNA, 22 nt, Human
guugcccucacuagagugcagu

SEQ ID NO: 215296 - RNA, 24 nt, Human
guugcccucacuagagugcaguag

SEQ ID NO: 215297 - RNA, 32 nt, Human
guugcccugccugguuucugccaagggcugcu

SEQ ID NO: 215298 - RNA, 32 nt, Human
guugcccuggccucuuugcccugggccagccu

SEQ ID NO: 215299 - RNA, 23 nt, Human
guugcccuggcuggaguucagug

SEQ ID NO: 215300 - RNA, 32 nt, Human
guugcccuguucuuggugaacugcuuguuagg

SEQ ID NO: 215301 - RNA, 23 nt, Human
guugccgaggcuggagugcaaug

SEQ ID NO: 215302 - RNA, 24 nt, Human
guugccgaggcuggagugcaaugg

SEQ ID NO: 215303 - RNA, 32 nt, Human
guugccgcaaccucgccuucagccuggcccug

SEQ ID NO: 215304 - RNA, 32 nt, Human
guugccgcacagauuccugaccauccucagaa

SEQ ID NO: 215305 - RNA, 32 nt, Human
guugccgcagcggugggaaggaaaggcagaug

SEQ ID NO: 215306 - RNA, 32 nt, Human
guugccgcauuuauuccaccuccagcuggacc

SEQ ID NO: 215307 - RNA, 32 nt, Human
guugccgccucucccgguaccugcugcugcuc

SEQ ID NO: 215308 - RNA, 32 nt, Human
guugccgcggggucggggaccagcacgagugc

SEQ ID NO: 215309 - RNA, 32 nt, Human
guugccgcugcgcaccuggcucaggugagcug

SEQ ID NO: 215310 - RNA, 23 nt, Human
guugccgcugcggagcgcggcgg

SEQ ID NO: 215311 - RNA, 32 nt, Human
guugccgcugggagccggaggcgcggggaccu

SEQ ID NO: 215312 - RNA, 32 nt, Human
guugccggaagucggcgugagguggggcuuau

SEQ ID NO: 215313 - RNA, 32 nt, Human
guugccggcugaagaaggaugaugauuauucc

SEQ ID NO: 215314 - RNA, 32 nt, Human
guugccuagcuggagugcaauggcgcaaucuc

SEQ ID NO: 215315 - RNA, 23 nt, Human
guugccuaggccagagugcagug

SEQ ID NO: 215316 - RNA, 24 nt, Human
guugccuaggccagagugcagugg

SEQ ID NO: 215317 - RNA, 23 nt, Human
guugccuaggcggaguacagugg

SEQ ID NO: 215318 - RNA, 23 nt, Human
guugccuaggcuggaguacagug

SEQ ID NO: 215319 - RNA, 24 nt, Human
guugccuaggcuggaguacagugg

SEQ ID NO: 215320 - RNA, 24 nt, Human
guugccuaggcuggagugaagugg

SEQ ID NO: 215321 - RNA, 23 nt, Human
guugccuaggcuggagugcaaug

SEQ ID NO: 215322 - RNA, 24 nt, Human
guugccuaggcuggagugcaaugg

SEQ ID NO: 215323 - RNA, 23 nt, Human
guugccuaggcuggagugcagug

SEQ ID NO: 215324 - RNA, 24 nt, Human
guugccuaggcuggagugcagugg

SEQ ID NO: 215325 - RNA, 32 nt, Human
guugccucuaucuaguccuacaaguaggguuu

SEQ ID NO: 215326 - RNA, 32 nt, Human
guugccucuucccuggcgggggugauacucuc

SEQ ID NO: 215327 - RNA, 32 nt, Human
guugccugaagaaaaaguuuguaaguacugug

SEQ ID NO: 215328 - RNA, 32 nt, Human
guugccugaggucacagagcagggacuuggac

SEQ ID NO: 215329 - RNA, 32 nt, Human
guugccugagucugggcaucugugaagaaggg

SEQ ID NO: 215330 - RNA, 32 nt, Human
guugccugcaggagggaaggcggugaacacag

SEQ ID NO: 215331 - RNA, 32 nt, Human
guugccugcauuucucccaggacuugggggug

SEQ ID NO: 215332 - RNA, 23 nt, Human
guugccugccccacucccugccg

SEQ ID NO: 215333 - RNA, 21 nt, Human
guugccugcuaaaaggcaaug

SEQ ID NO: 215334 - RNA, 23 nt, Human
guugccugggcuggaaugcagug

SEQ ID NO: 215335 - RNA, 24 nt, Human
guugccugggcuggaaugcagugg

SEQ ID NO: 215336 - RNA, 23 nt, Human
guugccugggcuggagugcagug

SEQ ID NO: 215337 - RNA, 24 nt, Human
guugccugggcuggagugcagugg

SEQ ID NO: 215338 - RNA, 32 nt, Human
guugccuggugaggaagagccaggacuucuga

SEQ ID NO: 215339 - RNA, 32 nt, Human
guugccuggugcaaagugccccaaacagcaau

SEQ ID NO: 215340 - RNA, 32 nt, Human
guugccugucaaaggcuggagggcaggaggag

SEQ ID NO: 215341 - RNA, 32 nt, Human
guugccuuagcacuucuuuccucuccaauugu

SEQ ID NO: 215342 - RNA, 32 nt, Human
guugccuucacaggccucuccgcagcagccau

SEQ ID NO: 215343 - RNA, 32 nt, Human
guugccuugaaccacuucccucaucucuccuc

SEQ ID NO: 215344 - RNA, 32 nt, Human
guugccuugcagcuggccuuuucucccagaau

SEQ ID NO: 215345 - RNA, 32 nt, Human
guugccuuggaggcagaagcugugaguuucag

SEQ ID NO: 215346 - RNA, 32 nt, Human
guugccuugggaccucggaucuccucuggggg

SEQ ID NO: 215347 - RNA, 32 nt, Human
guugccuuuguaugucuucccaccucauggau

SEQ ID NO: 215348 - RNA, 32 nt, Human
guugcgacgguccggcgagagagagcuggggu

SEQ ID NO: 215349 - RNA, 32 nt, Human
guugcgagacgggguuucaccauguuggucgg

SEQ ID NO: 215350 - RNA, 32 nt, Human
guugcgccacuacacuccagccugggugacag

SEQ ID NO: 215351 - RNA, 32 nt, Human
guugcgccacugcacuccagccugggcaacaa

SEQ ID NO: 215352 - RNA, 32 nt, Human
guugcgccacugcacucuagccugggcuacag

SEQ ID NO: 215353 - RNA, 32 nt, Human
guugcgccacuguacuccagccugggugagga

SEQ ID NO: 215354 - RNA, 21 nt, Human
guugcgcccaugcucuuguca

SEQ ID NO: 215355 - RNA, 32 nt, Human
guugcgccgcaguuuggagucacuguaguuaa

SEQ ID NO: 215356 - RNA, 32 nt, Human
guugcgcuacugcacuccagccuggacaacag

SEQ ID NO: 215357 - RNA, 32 nt, Human
guugcgcugccucuugagcagccucgugccug

SEQ ID NO: 215358 - RNA, 32 nt, Human
guugcgcugucacccaggcuggagugcagugc

SEQ ID NO: 215359 - RNA, 32 nt, Human
guugcggaauauggaagcaccucccaauggua

SEQ ID NO: 215360 - RNA, 32 nt, Human
guugcggagacacauuccucuguccaccuaag

SEQ ID NO: 215361 - RNA, 32 nt, Human
guugcggcagaacaucgcgaugggaaccgaug

SEQ ID NO: 215362 - RNA, 32 nt, Human
guugcggcagagccauggacuuccggucccug

SEQ ID NO: 215363 - RNA, 25 nt, Human
guugcggcgcuggcgacagucgggg

SEQ ID NO: 215364 - RNA, 32 nt, Human
guugcgggggcaacaugagagccccucacccc

SEQ ID NO: 215365 - RNA, 32 nt, Human
guugcggugagcugagauugcaccauuucauu

SEQ ID NO: 215366 - RNA, 32 nt, Human
guugcggugagcugagauugcacuauugcacu

SEQ ID NO: 215367 - RNA, 32 nt, Human
guugcggugagcugaggucgcgccauugcacu

SEQ ID NO: 215368 - RNA, 32 nt, Human
guugcgguuccccuguaaagcaaauguacuua

SEQ ID NO: 215369 - RNA, 32 nt, Human
guugcgucagccagagcagugcccaggggcag

SEQ ID NO: 215370 - RNA, 32 nt, Human
guugcgugccuguagucccagcuacuugggag

SEQ ID NO: 215371 - RNA, 32 nt, Human
guugcguggagacagcuuuccucccaguacuc

SEQ ID NO: 215372 - RNA, 21 nt, Human
guugcuaagucaggugcagag

SEQ ID NO: 215373 - RNA, 32 nt, Human
guugcuaaugccuuucaucuugaaguuacaca

SEQ ID NO: 215374 - RNA, 32 nt, Human
guugcuacaggcuguaccuauaagauguacag

SEQ ID NO: 215375 - RNA, 32 nt, Human
guugcuaccaauauuuagcaacuacaaugaau

SEQ ID NO: 215376 - RNA, 32 nt, Human
guugcuaccuaagcccuccacucccgacacca

SEQ ID NO: 215377 - RNA, 32 nt, Human
guugcuaccuauccugaaucaagccuugagcc

SEQ ID NO: 215378 - RNA, 32 nt, Human
guugcuaccuucacuucuccccagcucugccc

SEQ ID NO: 215379 - RNA, 32 nt, Human
guugcuacgugcggggaugacauggauccaga

SEQ ID NO: 215380 - RNA, 32 nt, Human
guugcuagaggggcacauggagugggacagga

SEQ ID NO: 215381 - RNA, 23 nt, Human
guugcuaggcuggagugcagugg

SEQ ID NO: 215382 - RNA, 32 nt, Human
guugcuaggcuggagugcaguggcacaaucau

SEQ ID NO: 215383 - RNA, 32 nt, Human
guugcuaggcuggagugcaguggugcgaucuc

SEQ ID NO: 215384 - RNA, 24 nt, Human
guugcucaagcuggaguggagugg

SEQ ID NO: 215385 - RNA, 31 nt, Human
guugcucaagugccagagguugggagaagga

SEQ ID NO: 215386 - RNA, 22 nt, Human
guugcucacaccgguaauccca

SEQ ID NO: 215387 - RNA, 32 nt, Human
guugcucacaccuguaucccagcacuuuggga

SEQ ID NO: 215388 - RNA, 32 nt, Human
guugcucacugcaaauauaaaucucagcaaug

SEQ ID NO: 215389 - RNA, 24 nt, Human
guugcucaggcuggaguacagugg

SEQ ID NO: 215390 - RNA, 24 nt, Human
guugcucaggcuggauugcagugg

SEQ ID NO: 215391 - RNA, 32 nt, Human
guugcucaugccugccagccagccugucccac

SEQ ID NO: 215392 - RNA, 32 nt, Human
guugcucaugcuguuuaagugcaggcugagac

SEQ ID NO: 215393 - RNA, 32 nt, Human
guugcucccagagucacucagugucccucguu

SEQ ID NO: 215394 - RNA, 32 nt, Human
guugcucccugggaacauuguccuuuccccac

SEQ ID NO: 215395 - RNA, 32 nt, Human
guugcuccgccuggccuggccauacugugucc

SEQ ID NO: 215396 - RNA, 32 nt, Human
guugcuccugcucuccuaggaggccccgugug

SEQ ID NO: 215397 - RNA, 32 nt, Human
guugcuccuggccucaucagccuccaaacuca

SEQ ID NO: 215398 - RNA, 32 nt, Human
guugcucuauagucaaacagcucuuuugaaga

SEQ ID NO: 215399 - RNA, 32 nt, Human
guugcucucacaccugugccauaacaucaucu

SEQ ID NO: 215400 - RNA, 21 nt, Human
guugcucugauucugcagguu

SEQ ID NO: 215401 - RNA, 32 nt, Human
guugcucugucacccaggcuggagugcaauga

SEQ ID NO: 215402 - RNA, 32 nt, Human
guugcucuugcuuuggucuucuuccaaugaug

SEQ ID NO: 215403 - RNA, 32 nt, Human
guugcugaaaacaaaaccuaacaaaccuugau

SEQ ID NO: 215404 - RNA, 32 nt, Human
guugcugaaauugaaaaagaaaaagaagaaaa

SEQ ID NO: 215405 - RNA, 32 nt, Human
guugcugaagccagaucguuuccccagggcac

SEQ ID NO: 215406 - RNA, 32 nt, Human
guugcugaagcuucauccuuugcucucauucu

SEQ ID NO: 215407 - RNA, 18 nt, Human
guugcugaaggagaaagg

SEQ ID NO: 215408 - RNA, 21 nt, Human
guugcugaaggagcccaaggc

SEQ ID NO: 215409 - RNA, 22 nt, Human
guugcugaagggacuccgagca

SEQ ID NO: 215410 - RNA, 26 nt, Human
guugcugacagguggaaccugaggca

SEQ ID NO: 215411 - RNA, 32 nt, Human
guugcugacuccaugcugugguugcuggagaa

SEQ ID NO: 215412 - RNA, 32 nt, Human
guugcugacugacccuccaccucagagguagu

SEQ ID NO: 215413 - RNA, 32 nt, Human
guugcugagauaagacauccauuuuucucaaa

SEQ ID NO: 215414 - RNA, 22 nt, Human
guugcugagcugggcuuggcuc

SEQ ID NO: 215415 - RNA, 23 nt, Human
guugcugaggcuggagugcagug

SEQ ID NO: 215416 - RNA, 24 nt, Human
guugcugaggcuggagugcagugg

SEQ ID NO: 215417 - RNA, 32 nt, Human
guugcugaucugcuccuugagcaggcagauga

SEQ ID NO: 215418 - RNA, 22 nt, Human
guugcugauggugggccagggc

SEQ ID NO: 215419 - RNA, 32 nt, Human
guugcugauuaaaauacacucccccuauaaag

SEQ ID NO: 215420 - RNA, 32 nt, Human
guugcugauuuguccauuucuuucccugcacu

SEQ ID NO: 215421 - RNA, 32 nt, Human
guugcugcaaacaaccacccaaaacuuagugg

SEQ ID NO: 215422 - RNA, 32 nt, Human
guugcugcaaaugacaugauuucauucuuuuu

SEQ ID NO: 215423 - RNA, 32 nt, Human
guugcugcagaacaguccauacuguggggcug

SEQ ID NO: 215424 - RNA, 19 nt, Human
guugcugcaggccaaggua

SEQ ID NO: 215425 - RNA, 32 nt, Human
guugcugcauuuucuucacuugcaggcaaacu

SEQ ID NO: 215426 - RNA, 32 nt, Human
guugcugcccagccgcuccaucauguccuuca

SEQ ID NO: 215427 - RNA, 32 nt, Human
guugcugcccgacuugaaggugggggugcugc

SEQ ID NO: 215428 - RNA, 32 nt, Human
guugcugccgcugaggagcccgcccagccagc

SEQ ID NO: 215429 - RNA, 32 nt, Human
guugcugccgucaccgccuccugggucguccg

SEQ ID NO: 215430 - RNA, 20 nt, Human
guugcugcgcgccccgagcc

SEQ ID NO: 215431 - RNA, 32 nt, Human
guugcugcuauugaugcauaacauacugcuau

SEQ ID NO: 215432 - RNA, 32 nt, Human
guugcugcucccuguuccauaugcucgcaauc

SEQ ID NO: 215433 - RNA, 20 nt, Human
guugcugcucgcccugcucc

SEQ ID NO: 215434 - RNA, 32 nt, Human
guugcugcugaaggaggaggcagcagcgaggu

SEQ ID NO: 215435 - RNA, 32 nt, Human
guugcugcugcucggccuggcccgcggcgccg

SEQ ID NO: 215436 - RNA, 32 nt, Human
guugcugcuuucuccucuaaaucuuggucucu

SEQ ID NO: 215437 - RNA, 32 nt, Human
guugcuggaaugcgacagagacagggagucag

SEQ ID NO: 215438 - RNA, 32 nt, Human
guugcuggagccaagcgcgcaucugucaagaa

SEQ ID NO: 215439 - RNA, 32 nt, Human
guugcuggagcugcuggcagggccaggcaagg

SEQ ID NO: 215440 - RNA, 19 nt, Human
guugcuggaggugacaagg

SEQ ID NO: 215441 - RNA, 32 nt, Human
guugcuggcagugggagcagcggcagcagcuu

SEQ ID NO: 215442 - RNA, 32 nt, Human
guugcuggccauggggcagaugcugaauguga

SEQ ID NO: 215443 - RNA, 19 nt, Human
guugcuggccuccaaggca

SEQ ID NO: 215444 - RNA, 32 nt, Human
guugcugggaaguucuggaaggaagcaugugc

SEQ ID NO: 215445 - RNA, 32 nt, Human
guugcugggauuacaggugugagccacagugc

SEQ ID NO: 215446 - RNA, 32 nt, Human
guugcugggcccagcugaaccugccucuucac

SEQ ID NO: 215447 - RNA, 32 nt, Human
guugcugggcgagccuguacucugccugacga

SEQ ID NO: 215448 - RNA, 32 nt, Human
guugcugguggagcggcggcgggggcggguau

SEQ ID NO: 215449 - RNA, 32 nt, Human
guugcuguaagggugcaacaucagggcgcuug

SEQ ID NO: 215450 - RNA, 32 nt, Human
guugcuguacgaacaccacagaauguacuuug

SEQ ID NO: 215451 - RNA, 32 nt, Human
guugcugucaucauguucacuguggcuuuuac

SEQ ID NO: 215452 - RNA, 32 nt, Human
guugcugucccaaagauaacaggggaggaagu

SEQ ID NO: 215453 - RNA, 32 nt, Human
guugcugucuucugcucucauccugcaggugg

SEQ ID NO: 215454 - RNA, 32 nt, Human
guugcugugagcugagauuguggcacugcacu

SEQ ID NO: 215455 - RNA, 32 nt, Human
guugcugugguuuucagaauuuucucuuuuaa

SEQ ID NO: 215456 - RNA, 22 nt, Human
guugcugugucgugaggugcag

SEQ ID NO: 215457 - RNA, 32 nt, Human
guugcuguugcagacccaggagucucugaagg

SEQ ID NO: 215458 - RNA, 32 nt, Human
guugcuguuuauaguuuguggaaaguggggga

SEQ ID NO: 215459 - RNA, 32 nt, Human
guugcuuagacugucuccugccacuuuaaaug

SEQ ID NO: 215460 - RNA, 32 nt, Human
guugcuuaggaugcccggccacccugggaggc

SEQ ID NO: 215461 - RNA, 32 nt, Human
guugcuucagccagugcagugagaacagcagc

SEQ ID NO: 215462 - RNA, 32 nt, Human
guugcuucaggcguuuucuccccaccaagccc

SEQ ID NO: 215463 - RNA, 31 nt, Human
guugcuucauacaaggagggugguugaacuu

SEQ ID NO: 215464 - RNA, 32 nt, Human
guugcuucauucucucaagcaugcaugaaauu

SEQ ID NO: 215465 - RNA, 32 nt, Human
guugcuuccucuuccucccaaaucccuuaguu

SEQ ID NO: 215466 - RNA, 23 nt, Human
guugcuucucacagaagcugcga

SEQ ID NO: 215467 - RNA, 32 nt, Human
guugcuucuccccucgccacgcccuucuccug

SEQ ID NO: 215468 - RNA, 32 nt, Human
guugcuucuccucccucccauucucucugcaa

SEQ ID NO: 215469 - RNA, 32 nt, Human
guugcuucuccucucugcuggcugagucugug

SEQ ID NO: 215470 - RNA, 32 nt, Human
guugcuucucuugccauuccucccacagaucu

SEQ ID NO: 215471 - RNA, 32 nt, Human
guugcuugaacccaggaggcggagauugcagu

SEQ ID NO: 215472 - RNA, 32 nt, Human
guugcuugcacuccagccugggugacagagug

SEQ ID NO: 215473 - RNA, 32 nt, Human
guugcuugcucaccuuugcugucuccccuuca

SEQ ID NO: 215474 - RNA, 32 nt, Human
guugcuuggaauuguggaaagcguuggcgagg

SEQ ID NO: 215475 - RNA, 32 nt, Human
guugcuuggcgggaacaacuugcugaagucaa

SEQ ID NO: 215476 - RNA, 23 nt, Human
guugcuugggcugcaaugcagug

SEQ ID NO: 215477 - RNA, 32 nt, Human
guugcuuguguucaacuacugugaagaguugg

SEQ ID NO: 215478 - RNA, 32 nt, Human
guugcuuguguuugagaauuggaggaaugagu

SEQ ID NO: 215479 - RNA, 32 nt, Human
guugcuuguugacuguacuauucagauggcuu

SEQ ID NO: 215480 - RNA, 32 nt, Human
guugcuuuaaagaagaaagaaaaagaaguuuc

SEQ ID NO: 215481 - RNA, 32 nt, Human
guugcuuucauuuuaaaccagagcaaguaaca

SEQ ID NO: 215482 - RNA, 32 nt, Human
guugcuuuccucacucccugucaugagacuuc

SEQ ID NO: 215483 - RNA, 32 nt, Human
guugcuuuccugagucagcuacuucacacuug

SEQ ID NO: 215484 - RNA, 32 nt, Human
guugcuuucuccaacuuuugggcugacucugu

SEQ ID NO: 215485 - RNA, 32 nt, Human
guugcuuucugauuuuuaucagagugagaaaa

SEQ ID NO: 215486 - RNA, 32 nt, Human
guugcuuuggccugcugcccucuuucaggggu

SEQ ID NO: 215487 - RNA, 32 nt, Human
guugcuuuucagaaaaaggaacgugguaggga

SEQ ID NO: 215488 - RNA, 32 nt, Human
guugcuuuuccagacugggcagaggggcugac

SEQ ID NO: 215489 - RNA, 32 nt, Human
guugcuuuucuuccucucucauuuggguuuga

SEQ ID NO: 215490 - RNA, 32 nt, Human
guugcuuuucuuguuuuccuuuuuagaaguuu

SEQ ID NO: 215491 - RNA, 32 nt, Human
guugcuuuuucuggugggggcaaggggagcug

SEQ ID NO: 215492 - RNA, 32 nt, Human
guugcuuuuucuuccuccugggcaacuauuug

SEQ ID NO: 215493 - RNA, 32 nt, Human
guuggaaaaguggaacagauagacuugcugga

SEQ ID NO: 215494 - RNA, 22 nt, Human
guuggaaaccuugcagagcaag

SEQ ID NO: 215495 - RNA, 32 nt, Human
guuggaaaccuugguuaaaaauguaggugccu

SEQ ID NO: 215496 - RNA, 19 nt, Human
guuggaaagaaagguucug

SEQ ID NO: 215497 - RNA, 32 nt, Human
guuggaaaucaguugugaauacauucuuugcu

SEQ ID NO: 215498 - RNA, 32 nt, Human
guuggaacaagaaauccggacuuuugcucucc

SEQ ID NO: 215499 - RNA, 32 nt, Human
guuggaacaguuuggagggcucagaaggagac

SEQ ID NO: 215500 - RNA, 32 nt, Human
guuggaaccaagaauugcaggcauaugggaug

SEQ ID NO: 215501 - RNA, 32 nt, Human
guuggaaccugcuuagaaccaggugugaacug

SEQ ID NO: 215502 - RNA, 32 nt, Human
guuggaagacaaagagccagcccaggauggca

SEQ ID NO: 215503 - RNA, 32 nt, Human
guuggaagaccacagacauggaaggggcccau

SEQ ID NO: 215504 - RNA, 32 nt, Human
guuggaagagaucuuccucuuccagggggcga

SEQ ID NO: 215505 - RNA, 32 nt, Human
guuggaagaucaccauauccaccagaagaccc

SEQ ID NO: 215506 - RNA, 32 nt, Human
guuggaagcagcugcccugggagccugggaca

SEQ ID NO: 215507 - RNA, 32 nt, Human
guuggaagcauacugagugucuuggugaaccu

SEQ ID NO: 215508 - RNA, 32 nt, Human
guuggaagcauacugagugucuuggugggccu

SEQ ID NO: 215509 - RNA, 32 nt, Human
guuggaagccaaagccagcuuagugggacuuc

SEQ ID NO: 215510 - RNA, 32 nt, Human
guuggaagccauggauaugguggaggucauuu

SEQ ID NO: 215511 - RNA, 32 nt, Human
guuggaaggagaagggagggaagagagcagaa

SEQ ID NO: 215512 - RNA, 32 nt, Human
guuggaagggaaauggcucugggcuggaacug

SEQ ID NO: 215513 - RNA, 32 nt, Human
guuggaaggggagggugaccagagaagaggga

SEQ ID NO: 215514 - RNA, 32 nt, Human
guuggaagucauggguccucagagugggggcu

SEQ ID NO: 215515 - RNA, 32 nt, Human
guuggaaguggucugagaaagcuguauggaca

SEQ ID NO: 215516 - RNA, 32 nt, Human
guuggaagugucauguacaacaugcggcgauu

SEQ ID NO: 215517 - RNA, 32 nt, Human
guuggaauauaugcaacaguguuuuuccacug

SEQ ID NO: 215518 - RNA, 32 nt, Human
guuggaauauccaguuauuucaugucacacau

SEQ ID NO: 215519 - RNA, 32 nt, Human
guuggaaucccugggcaaagauuuccucacug

SEQ ID NO: 215520 - RNA, 23 nt, Human
guuggaaugaugacaacaugcug

SEQ ID NO: 215521 - RNA, 32 nt, Human
guuggaaugugguucccaggagggaagagguu

SEQ ID NO: 215522 - RNA, 32 nt, Human
guuggaauucagggcauugcuauucaguccuc

SEQ ID NO: 215523 - RNA, 32 nt, Human
guuggaauuuccuggacgaggguggguacugg

SEQ ID NO: 215524 - RNA, 32 nt, Human
guuggacacacugcucuaccaguccuucguga

SEQ ID NO: 215525 - RNA, 32 nt, Human
guuggacaccugcgcguuaggagauucuggag

SEQ ID NO: 215526 - RNA, 32 nt, Human
guuggacagaaggagguguuggggugaggugg

SEQ ID NO: 215527 - RNA, 32 nt, Human
guuggacaggcaggauugaugauagcaugacc

SEQ ID NO: 215528 - RNA, 32 nt, Human
guuggacaucaaacggaucgugcagugcacua

SEQ ID NO: 215529 - RNA, 32 nt, Human
guuggaccacacccgucacaguucacaguucc

SEQ ID NO: 215530 - RNA, 32 nt, Human
guuggaccagcugauucacaaagugcugagcc

SEQ ID NO: 215531 - RNA, 32 nt, Human
guuggaccaggcugaagaccugggaucuuggu

SEQ ID NO: 215532 - RNA, 32 nt, Human
guuggaccuccagacccaucacugaccauuug

SEQ ID NO: 215533 - RNA, 32 nt, Human
guuggacucuacaggccagccucugccucaca

SEQ ID NO: 215534 - RNA, 32 nt, Human
guuggacucuucuguucaccagacacccugcc

SEQ ID NO: 215535 - RNA, 32 nt, Human
guuggacugaaaacccuccuccccaauuuggg

SEQ ID NO: 215536 - RNA, 31 nt, Human
guuggacugagaccuaacucacuggacucag

SEQ ID NO: 215537 - RNA, 32 nt, Human
guuggacugcucauggauuuuguagcuguuua

SEQ ID NO: 215538 - RNA, 32 nt, Human
guuggacuucagucuugccuaggcgauuuugu

SEQ ID NO: 215539 - RNA, 32 nt, Human
guuggacuuugccccucacacuggcccagccc

SEQ ID NO: 215540 - RNA, 32 nt, Human
guuggagaagaaccauuagaaagggaaauuag

SEQ ID NO: 215541 - RNA, 32 nt, Human
guuggagaccagccugagcaacauagugagac

SEQ ID NO: 215542 - RNA, 32 nt, Human
guuggagaccagccuggccaacauagugaaac

SEQ ID NO: 215543 - RNA, 32 nt, Human
guuggagaccagccuggccaacauggugaaac

SEQ ID NO: 215544 - RNA, 32 nt, Human
guuggagaccagccugggcaacauagugagac

SEQ ID NO: 215545 - RNA, 32 nt, Human
guuggagaccagccugggcaacauggugagac

SEQ ID NO: 215546 - RNA, 32 nt, Human
guuggagacucaagauauuuuuguugcaucag

SEQ ID NO: 215547 - RNA, 32 nt, Human
guuggagacucgauuguugaugacagcggaag

SEQ ID NO: 215548 - RNA, 31 nt, Human
guuggagagagaccugugcuuauuggaugga

SEQ ID NO: 215549 - RNA, 32 nt, Human
guuggagagcuucucauguucuuccuuuguau

SEQ ID NO: 215550 - RNA, 32 nt, Human
guuggagaggggaaaaguugugcauaaagaac

SEQ ID NO: 215551 - RNA, 32 nt, Human
guuggagaggugcucccuagaagaaccugcca

SEQ ID NO: 215552 - RNA, 32 nt, Human
guuggagcacacugcaaaagcaaaagcacagu

SEQ ID NO: 215553 - RNA, 32 nt, Human
guuggagcagaacuacugagaaaaaccaggca

SEQ ID NO: 215554 - RNA, 21 nt, Human
guuggagccacaccagccugg

SEQ ID NO: 215555 - RNA, 32 nt, Human
guuggagcccagguauuaucaugcaggagacc

SEQ ID NO: 215556 - RNA, 32 nt, Human
guuggagccuacucggggcgacugcgauggac

SEQ ID NO: 215557 - RNA, 32 nt, Human
guuggagcuacugcauguugauuguuuuguuu

SEQ ID NO: 215558 - RNA, 32 nt, Human
guuggagcugccggcccugcagucggugaccg

SEQ ID NO: 215559 - RNA, 32 nt, Human
guuggagcuggcauuccuggggaccaaauaac

SEQ ID NO: 215560 - RNA, 23 nt, Human
guuggagcuuuuaaagaaccugg

SEQ ID NO: 215561 - RNA, 32 nt, Human
guuggaggaagcuuccuccaaaguucuacaau

SEQ ID NO: 215562 - RNA, 32 nt, Human
guuggaggacuggcccacugcaccugcagcca

SEQ ID NO: 215563 - RNA, 32 nt, Human
guuggaggaugagagcuccugaggggcagagg

SEQ ID NO: 215564 - RNA, 32 nt, Human
guuggaggcugaagagagcuaugacugcauca

SEQ ID NO: 215565 - RNA, 20 nt, Human
guuggagggaagagagacca

SEQ ID NO: 215566 - RNA, 32 nt, Human
guuggagggaggcagggaaucuggcuugauug

SEQ ID NO: 215567 - RNA, 32 nt, Human
guuggagggcugggaucuuguagggccugugc

SEQ ID NO: 215568 - RNA, 32 nt, Human
guuggaggggcuaaggaggagugcagagggga

SEQ ID NO: 215569 - RNA, 32 nt, Human
guuggaggguagaccaaggcugugcaugauuc

SEQ ID NO: 215570 - RNA, 32 nt, Human
guuggaggugcuggacggccacgaccccgagc

SEQ ID NO: 215571 - RNA, 32 nt, Human
guuggagguuagagaaggccucagggaccaac

SEQ ID NO: 215572 - RNA, 32 nt, Human
guuggaguacuacaauugcagcauuaauauaa

SEQ ID NO: 215573 - RNA, 32 nt, Human
guuggaguagaugaggaaugggcucgugauua

SEQ ID NO: 215574 - RNA, 32 nt, Human
guuggagucguuacccucagaaccucagguaa

SEQ ID NO: 215575 - RNA, 32 nt, Human
guuggaguugcuggugccuccuccuucaccca

SEQ ID NO: 215576 - RNA, 32 nt, Human
guuggauaacuaccuucccaaaagagaacauc

SEQ ID NO: 215577 - RNA, 32 nt, Human
guuggauaagcuccaaucaggcaugaguuaca

SEQ ID NO: 215578 - RNA, 32 nt, Human
guuggauacauauuacagaaauaugugccacu

SEQ ID NO: 215579 - RNA, 32 nt, Human
guuggauagagcuaguuucaggaacagugagg

SEQ ID NO: 215580 - RNA, 32 nt, Human
guuggauauagagaggagagugcugaaggcaa

SEQ ID NO: 215581 - RNA, 17 nt, Human
guuggauauuuaggaua

SEQ ID NO: 215582 - RNA, 32 nt, Human
guuggaucacuugaggccaggaguucaagacu

SEQ ID NO: 215583 - RNA, 27 nt, Human
guuggaucauguauauuuuacuucuaa

SEQ ID NO: 215584 - RNA, 32 nt, Human
guuggaucuuucucccuuucuccucuccuuuu

SEQ ID NO: 215585 - RNA, 30 nt, Human
guuggaugaauaggcaccucuggaagagcc

SEQ ID NO: 215586 - RNA, 32 nt, Human
guuggaugaugaggaauauuaccgcauggagu

SEQ ID NO: 215587 - RNA, 32 nt, Human
guuggauggggucgugugugauucagauggac

SEQ ID NO: 215588 - RNA, 32 nt, Human
guuggauggugcacucacugugcucagcaccu

SEQ ID NO: 215589 - RNA, 32 nt, Human
guuggaugguuugaugaaggggagugacagga

SEQ ID NO: 215590 - RNA, 32 nt, Human
guuggauguaugcaucuuuaauuucuaaacua

SEQ ID NO: 215591 - RNA, 29 nt, Human
guuggaugucugugaguaccuggucauac

SEQ ID NO: 215592 - RNA, 32 nt, Human
guuggauuacuugaggccaggaguucaugacc

SEQ ID NO: 215593 - RNA, 21 nt, Human
guuggauuugaagacuuuuaa

SEQ ID NO: 215594 - RNA, 32 nt, Human
guuggauuugcucuucccaaaaaucuaaaaug

SEQ ID NO: 215595 - RNA, 32 nt, Human
guuggcaaacuacagcccacaggccaaaucag

SEQ ID NO: 215596 - RNA, 32 nt, Human
guuggcaaacuaugaaccacaggccaauucca

SEQ ID NO: 215597 - RNA, 32 nt, Human
guuggcaacuccauaaaaacauuucagauuuu

SEQ ID NO: 215598 - RNA, 32 nt, Human
guuggcaagagggagggaaggaaggagagcaa

SEQ ID NO: 215599 - RNA, 32 nt, Human
guuggcaaggagucaguacucagucccugagu

SEQ ID NO: 215600 - RNA, 32 nt, Human
guuggcaauaaauacaacaaauuauuuguugg

SEQ ID NO: 215601 - RNA, 32 nt, Human
guuggcaauugauuuaguugggcucuagcaaa

SEQ ID NO: 215602 - RNA, 32 nt, Human
guuggcacagaaguccugucugagguccuauc

SEQ ID NO: 215603 - RNA, 32 nt, Human
guuggcacaggcauuaucucugcaauuuuaga

SEQ ID NO: 215604 - RNA, 32 nt, Human
guuggcaccaugguaucauauauuaaaacaau

SEQ ID NO: 215605 - RNA, 32 nt, Human
guuggcaccccguuuuuccugcucugagaggg

SEQ ID NO: 215606 - RNA, 32 nt, Human
guuggcaccuguguuuacauggguugaaaacu

SEQ ID NO: 215607 - RNA, 32 nt, Human
guuggcacuggcagagcuggaggaggaggagg

SEQ ID NO: 215608 - RNA, 32 nt, Human
guuggcagagggcaggcaagcuggcccuuggu

SEQ ID NO: 215609 - RNA, 32 nt, Human
guuggcagagugcucagauggccgccuuugag

SEQ ID NO: 215610 - RNA, 24 nt, Human
guuggcagaucaccugaggucagg

SEQ ID NO: 215611 - RNA, 32 nt, Human
guuggcagccaaggagaacucgccaaccucgc

SEQ ID NO: 215612 - RNA, 32 nt, Human
guuggcagccgcuugagccacugcgaggaaag

SEQ ID NO: 215613 - RNA, 32 nt, Human
guuggcagccuggcgggcggcgcggaggagag

SEQ ID NO: 215614 - RNA, 32 nt, Human
guuggcagcugguuauauuuaauucagccccu

SEQ ID NO: 215615 - RNA, 30 nt, Human
guuggcagcuugccaagaaggacugucuuu

SEQ ID NO: 215616 - RNA, 32 nt, Human
guuggcagcuuuggggcuguuuuugagcuucu

SEQ ID NO: 215617 - RNA, 32 nt, Human
guuggcaggaaagagacauauaguagaaagug

SEQ ID NO: 215618 - RNA, 32 nt, Human
guuggcaggcagcacucugugguggucagccc

SEQ ID NO: 215619 - RNA, 32 nt, Human
guuggcagggaaguugcugguaagaguuuuua

SEQ ID NO: 215620 - RNA, 32 nt, Human
guuggcauuugguucccaaaaaguaggaugua

SEQ ID NO: 215621 - RNA, 32 nt, Human
guuggccaaauaccauccacagugaggguuau

SEQ ID NO: 215622 - RNA, 23 nt, Human
guuggccaacccuguuuagagca

SEQ ID NO: 215623 - RNA, 22 nt, Human
guuggccaaccucccgcagcca

SEQ ID NO: 215624 - RNA, 20 nt, Human
guuggccaacuuuggucacc

SEQ ID NO: 215625 - RNA, 32 nt, Human
guuggccacacccagcuccauggaugcuggga

SEQ ID NO: 215626 - RNA, 22 nt, Human
guuggccacagucaccacucca

SEQ ID NO: 215627 - RNA, 32 nt, Human
guuggccacaguuacagggagagaacaauauc

SEQ ID NO: 215628 - RNA, 32 nt, Human
guuggccaccuuccuggcaggcuguagaccug

SEQ ID NO: 215629 - RNA, 19 nt, Human
guuggccagacuggucuca

SEQ ID NO: 215630 - RNA, 32 nt, Human
guuggccaggaguucaaaaccagccugaccaa

SEQ ID NO: 215631 - RNA, 32 nt, Human
guuggccaggcagaucucaaacuccugaccuc

SEQ ID NO: 215632 - RNA, 32 nt, Human
guuggccaggccagucucaaacuccugaccuc

SEQ ID NO: 215633 - RNA, 32 nt, Human
guuggccaggcccagucacaggggcaguguca

SEQ ID NO: 215634 - RNA, 32 nt, Human
guuggccaggccggucucaaacuccugaccuc

SEQ ID NO: 215635 - RNA, 24 nt, Human
guuggccaggcuggaaugcagugg

SEQ ID NO: 215636 - RNA, 22 nt, Human
guuggccaggcuggagugcagu

SEQ ID NO: 215637 - RNA, 32 nt, Human
guuggccaggcuggucuggaacuccuaaccuc

SEQ ID NO: 215638 - RNA, 32 nt, Human
guuggccaggcuguucugcccaccucacccuc

SEQ ID NO: 215639 - RNA, 32 nt, Human
guuggccagguaauugcugcagagggagaaau

SEQ ID NO: 215640 - RNA, 32 nt, Human
guuggccauacucacccccauccugggaauuu

SEQ ID NO: 215641 - RNA, 32 nt, Human
guuggccauucucaugcccaccagcuucuggc

SEQ ID NO: 215642 - RNA, 32 nt, Human
guuggcccaagaaacauaaacauauaaccacc

SEQ ID NO: 215643 - RNA, 32 nt, Human
guuggccccuggcagaggaacaaggacacaga

SEQ ID NO: 215644 - RNA, 32 nt, Human
guuggcccucacugcagggcacugugccugag

SEQ ID NO: 215645 - RNA, 32 nt, Human
guuggcccugcucuuguggccucccgcagaau

SEQ ID NO: 215646 - RNA, 19 nt, Human
guuggcccuggcuggccgg

SEQ ID NO: 215647 - RNA, 32 nt, Human
guuggccgggccagucucaaacuccugacguc

SEQ ID NO: 215648 - RNA, 32 nt, Human
guuggccuccacuguggguaauuggcuucuca

SEQ ID NO: 215649 - RNA, 32 nt, Human
guuggccuccugggaguguaguuuucuguuuu

SEQ ID NO: 215650 - RNA, 32 nt, Human
guuggccucuugucuuucuucccugcuuugcu

SEQ ID NO: 215651 - RNA, 32 nt, Human
guuggccugcugucagugcuucucucacuccu

SEQ ID NO: 215652 - RNA, 32 nt, Human
guuggccuggacaacauggcgagaccccaccu

SEQ ID NO: 215653 - RNA, 32 nt, Human
guuggccuucuucccacaucugccucagacug

SEQ ID NO: 215654 - RNA, 21 nt, Human
guuggccuuggaauauggcca

SEQ ID NO: 215655 - RNA, 32 nt, Human
guuggccuuggcuaggacccagagccacacug

SEQ ID NO: 215656 - RNA, 32 nt, Human
guuggcgagcucuggcaccugcaaaccacccc

SEQ ID NO: 215657 - RNA, 32 nt, Human
guuggcgccuguaaucccagcuacucgggagg

SEQ ID NO: 215658 - RNA, 32 nt, Human
guuggcgcuagaggcaagaggaagggggucug

SEQ ID NO: 215659 - RNA, 32 nt, Human
guuggcgcugaaucccacaacugugugauuug

SEQ ID NO: 215660 - RNA, 32 nt, Human
guuggcgggaauggcugcucgcggaggggcag

SEQ ID NO: 215661 - RNA, 32 nt, Human
guuggcgggcaggcggguggggcaggcugggg

SEQ ID NO: 215662 - RNA, 32 nt, Human
guuggcgucccuggugggcaggaaaggaaggc

SEQ ID NO: 215663 - RNA, 32 nt, Human
guuggcuacuaucacuuuccuuccaaaugaga

SEQ ID NO: 215664 - RNA, 32 nt, Human
guuggcuagaaaacaaguguuaacuugcuucu

SEQ ID NO: 215665 - RNA, 24 nt, Human
guuggcucuaacuuaaacaugcug

SEQ ID NO: 215666 - RNA, 32 nt, Human
guuggcucucccucuccucucucccucucccu

SEQ ID NO: 215667 - RNA, 23 nt, Human
guuggcucuggccuuuugcugua

SEQ ID NO: 215668 - RNA, 32 nt, Human
guuggcucugugggcuguauggucucugccau

SEQ ID NO: 215669 - RNA, 32 nt, Human
guuggcugaaguuccuagucucaggccguagg

SEQ ID NO: 215670 - RNA, 32 nt, Human
guuggcugagcucuccugggcuacucauuuca

SEQ ID NO: 215671 - RNA, 32 nt, Human
guuggcugaggcugggggaucgauacacagcc

SEQ ID NO: 215672 - RNA, 32 nt, Human
guuggcugcacuucagugccucuuaaagcuuu

SEQ ID NO: 215673 - RNA, 32 nt, Human
guuggcugcacuugauguuuguuugcaugaug

SEQ ID NO: 215674 - RNA, 32 nt, Human
guuggcugcaguuccggcuaccuguguagucc

SEQ ID NO: 215675 - RNA, 31 nt, Human
guuggcugggaagaaagaugagugaaauaac

SEQ ID NO: 215676 - RNA, 32 nt, Human
guuggcugggaguucaagaccagccuggccaa

SEQ ID NO: 215677 - RNA, 32 nt, Human
guuggcuguggcaggccagcugugguuuucuu

SEQ ID NO: 215678 - RNA, 32 nt, Human
guuggcuuacagucuuauauucuacaagcaag

SEQ ID NO: 215679 - RNA, 32 nt, Human
guuggcuucacaaaggagaguugauguggcca

SEQ ID NO: 215680 - RNA, 32 nt, Human
guuggcuuccaucagggguggucauuuccaau

SEQ ID NO: 215681 - RNA, 32 nt, Human
guuggcuucuuuggaccugcacuggaggauuu

SEQ ID NO: 215682 - RNA, 32 nt, Human
guuggcuugaaucucaucagcaggcagccuca

SEQ ID NO: 215683 - RNA, 32 nt, Human
guuggcuugcuuuggggaugacugucuggugu

SEQ ID NO: 215684 - RNA, 32 nt, Human
guuggcuuggggcaacagauugaaaagaccua

SEQ ID NO: 215685 - RNA, 32 nt, Human
guuggcuuugagauggcugucuccuccuugug

SEQ ID NO: 215686 - RNA, 32 nt, Human
guuggcuuugcgcggucucugccugcugagca

SEQ ID NO: 215687 - RNA, 32 nt, Human
guuggcuuuguauugaucucuccagucauuuu

SEQ ID NO: 215688 - RNA, 21 nt, Human
guugggaaaaagggagcaggg

SEQ ID NO: 215689 - RNA, 25 nt, Human
guugggaaaaaucaguaagcauagg

SEQ ID NO: 215690 - RNA, 24 nt, Human
guugggaaaauagagaagagcaag

SEQ ID NO: 215691 - RNA, 32 nt, Human
guugggaaacgcuggccacugggaaaucauua

SEQ ID NO: 215692 - RNA, 32 nt, Human
guugggaaacguuuuaacaucuggagccuuug

SEQ ID NO: 215693 - RNA, 32 nt, Human
guugggaacaggcccccaaaucuggccauaaa

SEQ ID NO: 215694 - RNA, 32 nt, Human
guugggaacuccugcccuaucuguucugcccu

SEQ ID NO: 215695 - RNA, 32 nt, Human
guugggaacugcugcccccagagaaccuagca

SEQ ID NO: 215696 - RNA, 15 nt, Human
guugggaacugugau

SEQ ID NO: 215697 - RNA, 32 nt, Human
guugggaagagggagugggaggggucugucuc

SEQ ID NO: 215698 - RNA, 32 nt, Human
guugggaagccgguguuggcagaugcuguggc

SEQ ID NO: 215699 - RNA, 32 nt, Human
guugggaaggacuggggaaacagcuguaacau

SEQ ID NO: 215700 - RNA, 32 nt, Human
guugggaaggcaugauugguuuugaaauguga

SEQ ID NO: 215701 - RNA, 32 nt, Human
guugggaaggcaugguugguuuugaaauguga

SEQ ID NO: 215702 - RNA, 32 nt, Human
guugggaccaaaaccuggguguccucacugcu

SEQ ID NO: 215703 - RNA, 20 nt, Human
guugggacuacaggcgugag

SEQ ID NO: 215704 - RNA, 32 nt, Human
guugggagacacacccuuguucauucuccuug

SEQ ID NO: 215705 - RNA, 32 nt, Human
guugggagagcauuccuggcagaggagaugga

SEQ ID NO: 215706 - RNA, 32 nt, Human
guugggagaggaagcuagaaggguuaugguug

SEQ ID NO: 215707 - RNA, 32 nt, Human
guugggagaggugggaaauagcagugaauuuu

SEQ ID NO: 215708 - RNA, 32 nt, Human
guugggagagugcguuccuggagcucaguccu

SEQ ID NO: 215709 - RNA, 32 nt, Human
guugggagcaaggagaaaaaugggaagaacca

SEQ ID NO: 215710 - RNA, 32 nt, Human
guugggagcauuugggugggggccaguggggu

SEQ ID NO: 215711 - RNA, 32 nt, Human
guugggagcggguucuggagcucacgccuggc

SEQ ID NO: 215712 - RNA, 20 nt, Human
guugggagcugcccuuucua

SEQ ID NO: 215713 - RNA, 32 nt, Human
guugggagcuugggcaggccagcuucacccuu

SEQ ID NO: 215714 - RNA, 32 nt, Human
guugggaggaagcagaggcagaugggaaagca

SEQ ID NO: 215715 - RNA, 32 nt, Human
guugggaggaagcauguaagagagggaacauu

SEQ ID NO: 215716 - RNA, 32 nt, Human
guugggaggaggaggaaagggaaggcuggcag

SEQ ID NO: 215717 - RNA, 32 nt, Human
guugggaggcagcagagcaugggugacagugg

SEQ ID NO: 215718 - RNA, 32 nt, Human
guugggaggccuggguccuuuuccccacgacu

SEQ ID NO: 215719 - RNA, 32 nt, Human
guugggagggagggaaaguguuuucugaaugg

SEQ ID NO: 215720 - RNA, 32 nt, Human
guugggagugagagagcaaguccucuguggag

SEQ ID NO: 215721 - RNA, 32 nt, Human
guugggaguguaguguagcaucuggggagaca

SEQ ID NO: 215722 - RNA, 32 nt, Human
guugggagugucaagggcuggggaagaggccc

SEQ ID NO: 215723 - RNA, 32 nt, Human
guugggaucaaaugugagccuauggaucaaga

SEQ ID NO: 215724 - RNA, 32 nt, Human
guugggaucaaaugugagccuauggaucaagc

SEQ ID NO: 215725 - RNA, 32 nt, Human
guugggaucagaggaacuuugaggugucugcc

SEQ ID NO: 215726 - RNA, 32 nt, Human
guugggaucccuccuccagccaagaugauccu

SEQ ID NO: 215727 - RNA, 32 nt, Human
guugggcaauggagaaggcaggaaggcagggg

SEQ ID NO: 215728 - RNA, 32 nt, Human
guugggcaguuuuucugcccaguggcucugau

SEQ ID NO: 215729 - RNA, 32 nt, Human
guugggcauauaauccuuccacacagccccug

SEQ ID NO: 215730 - RNA, 32 nt, Human
guugggcaugcugugguugcugagggaugagg

SEQ ID NO: 215731 - RNA, 32 nt, Human
guugggccaccugaaacacacacaaacacaca

SEQ ID NO: 215732 - RNA, 32 nt, Human
guugggccccacauucccccacugccucacag

SEQ ID NO: 215733 - RNA, 28 nt, Human
guugggccuaauccugccucaucauucu

SEQ ID NO: 215734 - RNA, 32 nt, Human
guugggccugggaggcauagguugcagugagc

SEQ ID NO: 215735 - RNA, 32 nt, Human
guugggccuggggcagaugaggcuggcuggcg

SEQ ID NO: 215736 - RNA, 32 nt, Human
guugggcgccuguaaucccagcuacuggggag

SEQ ID NO: 215737 - RNA, 32 nt, Human
guugggcgcugaggcgcgagaggaggggaugg

SEQ ID NO: 215738 - RNA, 32 nt, Human
guugggcggcuuugagacuggggugucugucc

SEQ ID NO: 215739 - RNA, 32 nt, Human
guugggcucaggcugggugcucugccaugggc

SEQ ID NO: 215740 - RNA, 32 nt, Human
guugggcugcauuccuccgaggaccagucuga

SEQ ID NO: 215741 - RNA, 32 nt, Human
guugggcugucagccaaggugccugaaacgau

SEQ ID NO: 215742 - RNA, 32 nt, Human
guuggggaaaccccucccuacuguuggaugua

SEQ ID NO: 215743 - RNA, 32 nt, Human
guuggggaaagauggcccauucccagaacucc

SEQ ID NO: 215744 - RNA, 32 nt, Human
guuggggaaauacuuuauuucuuuccauuuau

SEQ ID NO: 215745 - RNA, 32 nt, Human
guuggggaacacacccccaacccgucacagcg

SEQ ID NO: 215746 - RNA, 32 nt, Human
guuggggaagaugggagguugugggugaggcc

SEQ ID NO: 215747 - RNA, 32 nt, Human
guuggggaaguugcaggaggagagguggaugg

SEQ ID NO: 215748 - RNA, 32 nt, Human
guuggggagacaucaaaaccacccuaaccucg

SEQ ID NO: 215749 - RNA, 32 nt, Human
guuggggagagagaacccucacuguggggaau

SEQ ID NO: 215750 - RNA, 32 nt, Human
guuggggaggcaugauugguuuugaaauguga

SEQ ID NO: 215751 - RNA, 32 nt, Human
guuggggaggcugagacggaaggaucgcuuca

SEQ ID NO: 215752 - RNA, 32 nt, Human
guuggggagggugggcccagcucagcagggac

SEQ ID NO: 215753 - RNA, 32 nt, Human
guuggggaucagccgcuaguguaaacgagcau

SEQ ID NO: 215754 - RNA, 32 nt, Human
guuggggauccagcaggagacccucugcacau

SEQ ID NO: 215755 - RNA, 32 nt, Human
guuggggcagaaauauguucgaugcugauuau

SEQ ID NO: 215756 - RNA, 32 nt, Human
guuggggcagaaccauggaggaaaagccuucg

SEQ ID NO: 215757 - RNA, 32 nt, Human
guuggggcagaggcaugcuccuggcaucgagu

SEQ ID NO: 215758 - RNA, 32 nt, Human
guuggggccaggacacccagugagcccauacu

SEQ ID NO: 215759 - RNA, 32 nt, Human
guuggggccugggacucagcucucucugcggu

SEQ ID NO: 215760 - RNA, 32 nt, Human
guuggggcucugaccccaggagugggguggag

SEQ ID NO: 215761 - RNA, 32 nt, Human
guuggggcugcauggccaggguggcaggaaga

SEQ ID NO: 215762 - RNA, 32 nt, Human
guugggggacuuuggaggcgggcaggggacag

SEQ ID NO: 215763 - RNA, 32 nt, Human
guugggggagagaagggcagcagcuuauuggu

SEQ ID NO: 215764 - RNA, 32 nt, Human
guugggggagagauggagggguguugacaguc

SEQ ID NO: 215765 - RNA, 32 nt, Human
guugggggagcagcaaggacccacaugaaauc

SEQ ID NO: 215766 - RNA, 32 nt, Human
guugggggaggcagagccagcagguggacagg

SEQ ID NO: 215767 - RNA, 32 nt, Human
guugggggaggcagagguggcacuggaggccu

SEQ ID NO: 215768 - RNA, 32 nt, Human
guugggggaggcgggugcaggaccgaggccug

SEQ ID NO: 215769 - RNA, 32 nt, Human
guugggggcugccugagagggccagguguggg

SEQ ID NO: 215770 - RNA, 32 nt, Human
guuggggguauuggggaaggcaggaaagggaa

SEQ ID NO: 215771 - RNA, 32 nt, Human
guugggggugacaagaggagacagggacaggu

SEQ ID NO: 215772 - RNA, 32 nt, Human
guuggggguuaagucaggaugggguagguccc

SEQ ID NO: 215773 - RNA, 19 nt, Human
guugggguaagcacuuccu

SEQ ID NO: 215774 - RNA, 32 nt, Human
guugggguaugugcugcacuucccagggagaa

SEQ ID NO: 215775 - RNA, 20 nt, Human
guuggggucuuuggugcuuc

SEQ ID NO: 215776 - RNA, 32 nt, Human
guuggggugcugcuuguucaggcuccccugac

SEQ ID NO: 215777 - RNA, 32 nt, Human
guugggguggaagggaauuggugcccagaaaa

SEQ ID NO: 215778 - RNA, 32 nt, Human
guuggggugggugggaggauucgugagcugca

SEQ ID NO: 215779 - RNA, 22 nt, Human
guugggguguauggggucccca

SEQ ID NO: 215780 - RNA, 32 nt, Human
guugggguucacccuucaucccucacauuuaa

SEQ ID NO: 215781 - RNA, 32 nt, Human
guugggguuuguggcaucaucauccccuggaa

SEQ ID NO: 215782 - RNA, 32 nt, Human
guuggguaagggaauggucaagacugagaaag

SEQ ID NO: 215783 - RNA, 32 nt, Human
guuggguacuguguuacugccugggugguagg

SEQ ID NO: 215784 - RNA, 32 nt, Human
guuggguagcggaagagagaucaaagggaaga

SEQ ID NO: 215785 - RNA, 32 nt, Human
guuggguagcucagagggaaauaaguaaaaug

SEQ ID NO: 215786 - RNA, 32 nt, Human
guugggucaaggacagggcugagcguggaagg

SEQ ID NO: 215787 - RNA, 32 nt, Human
guugggucaggaugaggggcagaggaaacacu

SEQ ID NO: 215788 - RNA, 32 nt, Human
guugggucaugcugggaagggagcggcagccc

SEQ ID NO: 215789 - RNA, 32 nt, Human
guugggucucauaaucuugcauauaccucugu

SEQ ID NO: 215790 - RNA, 32 nt, Human
guugggucucccgugacugcugccucaucgau

SEQ ID NO: 215791 - RNA, 32 nt, Human
guugggugcccaggcugcccuagcucagcacc

SEQ ID NO: 215792 - RNA, 32 nt, Human
guugggugggaggaggaagaaagggaagaauu

SEQ ID NO: 215793 - RNA, 32 nt, Human
guugggugggguggcacaugggugggguccau

SEQ ID NO: 215794 - RNA, 32 nt, Human
guugggugucuccuuaagcugcagagauuucu

SEQ ID NO: 215795 - RNA, 32 nt, Human
guuggguguggguggucuccaaggccacgcug

SEQ ID NO: 215796 - RNA, 32 nt, Human
guuggguuagagagcugggagaacaggguagg

SEQ ID NO: 215797 - RNA, 32 nt, Human
guuggguuccagaggcuggagucaugcugccc

SEQ ID NO: 215798 - RNA, 32 nt, Human
guuggguuccuccugguuuucuuuuguuacaa

SEQ ID NO: 215799 - RNA, 21 nt, Human
guuggguucuguuacuucuga

SEQ ID NO: 215800 - RNA, 32 nt, Human
guuggguuuauuuccaggucacagaauugcug

SEQ ID NO: 215801 - RNA, 32 nt, Human
guuggguuugccauucauccccuaggcauggu

SEQ ID NO: 215802 - RNA, 32 nt, Human
guuggguuuucuggugggaguggggugguggg

SEQ ID NO: 215803 - RNA, 32 nt, Human
guugguaacaacuuuuucuauagucauugaug

SEQ ID NO: 215804 - RNA, 32 nt, Human
guugguaccucccucccuggaucucugagcca

SEQ ID NO: 215805 - RNA, 32 nt, Human
guugguagaaacaagaauuccacccacgcacc

SEQ ID NO: 215806 - RNA, 32 nt, Human
guugguaggaggugugauuuguuuacaugcac

SEQ ID NO: 215807 - RNA, 32 nt, Human
guuggucagaugcaccugugugcacuggggga

SEQ ID NO: 215808 - RNA, 32 nt, Human
guugguccacagcacuccauucuggguggcag

SEQ ID NO: 215809 - RNA, 32 nt, Human
guugguccacugcaccuggcagaaaagaaguu

SEQ ID NO: 215810 - RNA, 32 nt, Human
guugguccagcagggccauacagccaugggac

SEQ ID NO: 215811 - RNA, 32 nt, Human
guugguccuugucccagccucugccccagccc

SEQ ID NO: 215812 - RNA, 32 nt, Human
guuggucggcaacguggugcacucaaggauca

SEQ ID NO: 215813 - RNA, 32 nt, Human
guuggucgggagaagggugagaggcagugcug

SEQ ID NO: 215814 - RNA, 32 nt, Human
guuggucucuccccuucuacugccuccaacac

SEQ ID NO: 215815 - RNA, 32 nt, Human
guuggucugggcacugcagcaggcucggcucu

SEQ ID NO: 215816 - RNA, 32 nt, Human
guuggucugucugucuguccuuguccuugugg

SEQ ID NO: 215817 - RNA, 32 nt, Human
guuggucuucauuucauuugugcugcgcugcc

SEQ ID NO: 215818 - RNA, 32 nt, Human
guuggucuucuugcaucgaugauccaacagca

SEQ ID NO: 215819 - RNA, 32 nt, Human
guuggugacagcaacagaaagagcaccacgcc

SEQ ID NO: 215820 - RNA, 32 nt, Human
guuggugacuugucugccuccugcuuugggaa

SEQ ID NO: 215821 - RNA, 32 nt, Human
guuggugaggcugaggaaacaggcucaaacuc

SEQ ID NO: 215822 - RNA, 32 nt, Human
guuggugccugagacaccaaauggaagaagca

SEQ ID NO: 215823 - RNA, 32 nt, Human
guuggugccuugggaaacagucugacuugaac

SEQ ID NO: 215824 - RNA, 32 nt, Human
guuggugcggugccaugaucauaguucacuau

SEQ ID NO: 215825 - RNA, 32 nt, Human
guugguggaacagugcuccuuauguaaacuga

SEQ ID NO: 215826 - RNA, 32 nt, Human
guugguggcaaaauugccaacauaaguuaaua

SEQ ID NO: 215827 - RNA, 32 nt, Human
guugguggcaggcaccuguagucccagcuaca

SEQ ID NO: 215828 - RNA, 32 nt, Human
guugguggcgcaugccuguaaucccagcuacu

SEQ ID NO: 215829 - RNA, 32 nt, Human
guugguggcgggcgccuguaaucccagcuacu

SEQ ID NO: 215830 - RNA, 32 nt, Human
guuggugggaccccuguccacacccacccuau

SEQ ID NO: 215831 - RNA, 32 nt, Human
guuggugggaggacagagcaagugggaagggg

SEQ ID NO: 215832 - RNA, 32 nt, Human
guuggugggggugcgggggugcguguccccau

SEQ ID NO: 215833 - RNA, 32 nt, Human
guugguggugugcaccuguaaucccggcuacu

SEQ ID NO: 215834 - RNA, 32 nt, Human
guugguguauagcacugcuacugauuugugua

SEQ ID NO: 215835 - RNA, 32 nt, Human
guugguguauuuuucuggugucacuucugugc

SEQ ID NO: 215836 - RNA, 32 nt, Human
guuggugucagaggcaggagugggggaucagg

SEQ ID NO: 215837 - RNA, 32 nt, Human
guuggugucaucccaggagcaauauuaacagc

SEQ ID NO: 215838 - RNA, 32 nt, Human
guugguguccuuucaugcuucugcccugucaa

SEQ ID NO: 215839 - RNA, 32 nt, Human
guuggugucuguggucgggggcgagggccguc

SEQ ID NO: 215840 - RNA, 32 nt, Human
guuggugucuuauaaaacaaacagugauaauc

SEQ ID NO: 215841 - RNA, 32 nt, Human
guuggugugaaauaagaggugcgugaugaguu

SEQ ID NO: 215842 - RNA, 32 nt, Human
guuggugugcagaucucugcucagcuucccuu

SEQ ID NO: 215843 - RNA, 32 nt, Human
guuggugugcaggaaccaggaaaugggucagg

SEQ ID NO: 215844 - RNA, 32 nt, Human
guugguguggguugggagagagcugugugcag

SEQ ID NO: 215845 - RNA, 32 nt, Human
guugguguugggggcuuagccgagggacguua

SEQ ID NO: 215846 - RNA, 32 nt, Human
guugguguuuuuaaauuugcuuucuauucccc

SEQ ID NO: 215847 - RNA, 32 nt, Human
guugguuaccuugcuucugucaauuccaguaa

SEQ ID NO: 215848 - RNA, 32 nt, Human
guugguuauugcuuaagaagugcagugugucu

SEQ ID NO: 215849 - RNA, 32 nt, Human
guugguuauuuucagggcaaaagccuauauuc

SEQ ID NO: 215850 - RNA, 32 nt, Human
guugguucagcuggcgauagcggcgggagcgg

SEQ ID NO: 215851 - RNA, 32 nt, Human
guugguucuuucuccugacuccugugguuuug

SEQ ID NO: 215852 - RNA, 32 nt, Human
guugguugccucuccccugcucacuccaguca

SEQ ID NO: 215853 - RNA, 32 nt, Human
guugguugggcagaguggcaggagcaugggca

SEQ ID NO: 215854 - RNA, 32 nt, Human
guugguugggggaggaaguggggaggaguguu

SEQ ID NO: 215855 - RNA, 32 nt, Human
guugguugugaucugugggcaccagcucauuc

SEQ ID NO: 215856 - RNA, 32 nt, Human
guugguuuaccugaguuuucucuggggucugc

SEQ ID NO: 215857 - RNA, 32 nt, Human
guugguuuagccuuccuguauacaugugauaa

SEQ ID NO: 215858 - RNA, 32 nt, Human
guugguuuccuuccuuccuuccuuccuuccuu

SEQ ID NO: 215859 - RNA, 32 nt, Human
guugguuucucauuguuuuuaagccuacugga

SEQ ID NO: 215860 - RNA, 32 nt, Human
guugguuuggauuuguaacuccagaaacauuc

SEQ ID NO: 215861 - RNA, 32 nt, Human
guugguuugggaauauuaggugauccuguuga

SEQ ID NO: 215862 - RNA, 32 nt, Human
guugguuuugagaccgggucuggcucuguagc

SEQ ID NO: 215863 - RNA, 32 nt, Human
guugguuuuguuguuguuguuuuucaaacuaa

SEQ ID NO: 215864 - RNA, 19 nt, Human
guugguuuuuugggucuuu

SEQ ID NO: 215865 - RNA, 32 nt, Human
guuguaaaagagaccucuggggccgagugugg

SEQ ID NO: 215866 - RNA, 32 nt, Human
guuguaaaccaagcuaguaaaugaguaauuug

SEQ ID NO: 215867 - RNA, 32 nt, Human
guuguaaagaugucuuggccucccagacaguc

SEQ ID NO: 215868 - RNA, 32 nt, Human
guuguaaauacugagaaacauuuugaauguuc

SEQ ID NO: 215869 - RNA, 32 nt, Human
guuguaacaauguuguaaauguucaauuuguu

SEQ ID NO: 215870 - RNA, 32 nt, Human
guuguaacacuaaccaaaggcucuuuuuagaa

SEQ ID NO: 215871 - RNA, 32 nt, Human
guuguaacagccaggggccaggauggaggagg

SEQ ID NO: 215872 - RNA, 32 nt, Human
guuguaaccuucagaaguuacagcagcgccca

SEQ ID NO: 215873 - RNA, 32 nt, Human
guuguaacuguaaacucaccucccuaguagau

SEQ ID NO: 215874 - RNA, 32 nt, Human
guuguaagaguuuuuguuuuuaaucacgcauu

SEQ ID NO: 215875 - RNA, 32 nt, Human
guuguaagcuucccuguguccucucucccucu

SEQ ID NO: 215876 - RNA, 32 nt, Human
guuguaaggcuggauugaaauaugcaugugac

SEQ ID NO: 215877 - RNA, 32 nt, Human
guuguaaguuugaauaguuagacauggaaauu

SEQ ID NO: 215878 - RNA, 32 nt, Human
guuguaauacaguuuauaccaguguaugcucu

SEQ ID NO: 215879 - RNA, 32 nt, Human
guuguaaucauagagaaaagcaaagaagaaau

SEQ ID NO: 215880 - RNA, 32 nt, Human
guuguaauggaguaaagaagagggccagcuua

SEQ ID NO: 215881 - RNA, 32 nt, Human
guuguaauuguucccuuucuguuuucauauag

SEQ ID NO: 215882 - RNA, 32 nt, Human
guuguaauuuccucuuggaaaaagcgccaaau

SEQ ID NO: 215883 - RNA, 32 nt, Human
guuguacaacucauaaauacuaacugcugauu

SEQ ID NO: 215884 - RNA, 32 nt, Human
guuguaccacugcacuccagccuggcugacag

SEQ ID NO: 215885 - RNA, 32 nt, Human
guuguaccacugcacuccagccugggugacag

SEQ ID NO: 215886 - RNA, 32 nt, Human
guuguaccaucuuuggguaggcagacuucccu

SEQ ID NO: 215887 - RNA, 32 nt, Human
guuguacccacugccuaaccagucccaguugg

SEQ ID NO: 215888 - RNA, 32 nt, Human
guuguacguacuacggagaaacucaucauuuu

SEQ ID NO: 215889 - RNA, 32 nt, Human
guuguacguggaggacuaaugagacuuguaca

SEQ ID NO: 215890 - RNA, 32 nt, Human
guuguacucuuuaauuuuugcaaagaaaaguu

SEQ ID NO: 215891 - RNA, 32 nt, Human
guuguacugccuggauggucaccucuggugcg

SEQ ID NO: 215892 - RNA, 32 nt, Human
guuguacuucugaaaacagaccugugugaaug

SEQ ID NO: 215893 - RNA, 32 nt, Human
guuguacuucugaaaucagaccugugugaacg

SEQ ID NO: 215894 - RNA, 32 nt, Human
guuguacuucugaaaucagaccugugugaaug

SEQ ID NO: 215895 - RNA, 32 nt, Human
guuguacuuucucagagacuauggcagaauau

SEQ ID NO: 215896 - RNA, 32 nt, Human
guuguagaagggccuuaaaaagaauuauuuua

SEQ ID NO: 215897 - RNA, 32 nt, Human
guuguagaugaaacuguauaagauuuuuacau

SEQ ID NO: 215898 - RNA, 32 nt, Human
guuguagccacuuugaggucuguguuuccuuu

SEQ ID NO: 215899 - RNA, 32 nt, Human
guuguagccccagcuacucaagaggcugaggc

SEQ ID NO: 215900 - RNA, 32 nt, Human
guuguagcuagagagccgcuguggaaaauaug

SEQ ID NO: 215901 - RNA, 32 nt, Human
guuguagcugugcucaggcuucagcuugguuu

SEQ ID NO: 215902 - RNA, 32 nt, Human
guuguaggaagagagcgaggcaucccugaauu

SEQ ID NO: 215903 - RNA, 32 nt, Human
guuguaggaagcugugauugcaccaccacacu

SEQ ID NO: 215904 - RNA, 32 nt, Human
guuguaggcauggaagagagccaggcagcccc

SEQ ID NO: 215905 - RNA, 32 nt, Human
guuguaggggauguuuuacuacugaucaaaau

SEQ ID NO: 215906 - RNA, 32 nt, Human
guuguaggugugagccauggugcccggccgcc

SEQ ID NO: 215907 - RNA, 32 nt, Human
guuguaguagucuggugcuggccacauuuaag

SEQ ID NO: 215908 - RNA, 32 nt, Human
guuguagucauauuguaaauauuuuuguaccu

SEQ ID NO: 215909 - RNA, 32 nt, Human
guuguagucccagcucuuaucugccaucuugg

SEQ ID NO: 215910 - RNA, 32 nt, Human
guuguagugagcugagauugcaccacugcacu

SEQ ID NO: 215911 - RNA, 32 nt, Human
guuguaguggugagcugacacguccaggugug

SEQ ID NO: 215912 - RNA, 32 nt, Human
guuguaguggugagcugacacguccagguuug

SEQ ID NO: 215913 - RNA, 32 nt, Human
guuguauagcaguuccaccucuugaagguuuu

SEQ ID NO: 215914 - RNA, 32 nt, Human
guuguaucaguaccauuugaucugccauggac

SEQ ID NO: 215915 - RNA, 19 nt, Human
guuguaucuauauuucaca

SEQ ID NO: 215916 - RNA, 32 nt, Human
guuguaucugagucccuccagaacuaagauaa

SEQ ID NO: 215917 - RNA, 32 nt, Human
guuguaucuuuaguauucagguugugaaaaau

SEQ ID NO: 215918 - RNA, 32 nt, Human
guuguaugcucuucuguuuuaaagguuugaau

SEQ ID NO: 215919 - RNA, 32 nt, Human
guuguauggaaaggauggcagggaacaugcug

SEQ ID NO: 215920 - RNA, 32 nt, Human
guuguaugugcuguuccaugguguugacugca

SEQ ID NO: 215921 - RNA, 32 nt, Human
guuguauguucgugcuggaguuuuguuggugu

SEQ ID NO: 215922 - RNA, 32 nt, Human
guuguauucucauucucacucucccucccuuc

SEQ ID NO: 215923 - RNA, 32 nt, Human
guuguauuggcaagagggaggggugagagcug

SEQ ID NO: 215924 - RNA, 32 nt, Human
guuguauuguucuucccuugguggccaaacaa

SEQ ID NO: 215925 - RNA, 32 nt, Human
guugucaaggaaugagggaaaguaaauccuca

SEQ ID NO: 215926 - RNA, 31 nt, Human
guugucaaggaugaugaaaaagaggcugagg

SEQ ID NO: 215927 - RNA, 32 nt, Human
guugucaaggggaauauauucaggucuagucu

SEQ ID NO: 215928 - RNA, 32 nt, Human
guugucaauuuguuggagaugcagccuucacc

SEQ ID NO: 215929 - RNA, 32 nt, Human
guugucacagaggcaagugcuaccgcacaggc

SEQ ID NO: 215930 - RNA, 32 nt, Human
guugucacagggcagcuagaaaagccaucuuc

SEQ ID NO: 215931 - RNA, 32 nt, Human
guugucacauggacgauacaaaagccagcaau

SEQ ID NO: 215932 - RNA, 32 nt, Human
guugucacccacccuccugcccuucucagccc

SEQ ID NO: 215933 - RNA, 32 nt, Human
guugucacccaggcuggagugcagugguguga

SEQ ID NO: 215934 - RNA, 32 nt, Human
guugucacccugcccagaaaggccagcagcuu

SEQ ID NO: 215935 - RNA, 20 nt, Human
guugucacuggaaguacugu

SEQ ID NO: 215936 - RNA, 32 nt, Human
guugucacuuaaguuuggagugcaguggcaug

SEQ ID NO: 215937 - RNA, 32 nt, Human
guugucagaugauucugcccagcugcaggcua

SEQ ID NO: 215938 - RNA, 32 nt, Human
guugucagcacugggaaggcuuggggguagca

SEQ ID NO: 215939 - RNA, 32 nt, Human
guugucagcaggcaggcuggggaggccagugu

SEQ ID NO: 215940 - RNA, 32 nt, Human
guugucagcaucuucucacucccuucuccuug

SEQ ID NO: 215941 - RNA, 32 nt, Human
guugucagcugaugccgucaccuggccugcaa

SEQ ID NO: 215942 - RNA, 32 nt, Human
guugucagcuucaugagcuaugcagcugagua

SEQ ID NO: 215943 - RNA, 32 nt, Human
guugucaggcggagcugguaggggagcugccc

SEQ ID NO: 215944 - RNA, 23 nt, Human
guugucauaaccucagaguggag

SEQ ID NO: 215945 - RNA, 32 nt, Human
guugucauccagaagucagagcagagugcgca

SEQ ID NO: 215946 - RNA, 32 nt, Human
guugucaugaacaacaagaccucggcuggugg

SEQ ID NO: 215947 - RNA, 32 nt, Human
guugucaugcaccaugagacaaagcccaagcu

SEQ ID NO: 215948 - RNA, 32 nt, Human
guugucauugcuaccgugguagucaccuucau

SEQ ID NO: 215949 - RNA, 21 nt, Human
guuguccaaauaaacuuaccc

SEQ ID NO: 215950 - RNA, 32 nt, Human
guuguccagaccguagucgucugugaucugug

SEQ ID NO: 215951 - RNA, 19 nt, Human
guuguccagacuggucuca

SEQ ID NO: 215952 - RNA, 32 nt, Human
guuguccaggagacgauuuuguauaguauuuu

SEQ ID NO: 215953 - RNA, 24 nt, Human
guuguccaggauggagugcagugg

SEQ ID NO: 215954 - RNA, 24 nt, Human
guuguccaggcuagagugcagugg

SEQ ID NO: 215955 - RNA, 32 nt, Human
guuguccaggcuagauucaaacuccugggcuc

SEQ ID NO: 215956 - RNA, 23 nt, Human
guuguccaggcuggagggcagug

SEQ ID NO: 215957 - RNA, 24 nt, Human
guuguccaggcuggagugcaaugg

SEQ ID NO: 215958 - RNA, 21 nt, Human
guuguccaggcuggagugcag

SEQ ID NO: 215959 - RNA, 22 nt, Human
guuguccaggcuggagugcagu

SEQ ID NO: 215960 - RNA, 23 nt, Human
guuguccaggcuggagugcagug

SEQ ID NO: 215961 - RNA, 24 nt, Human
guuguccaggcuggagugcagugg

SEQ ID NO: 215962 - RNA, 31 nt, Human
guuguccaucuguccaucccaacagcaagac

SEQ ID NO: 215963 - RNA, 32 nt, Human
guugucccaaacuguugauuuggaaaagaaau

SEQ ID NO: 215964 - RNA, 19 nt, Human
guugucccaagagccugcc

SEQ ID NO: 215965 - RNA, 32 nt, Human
guugucccaaguggacauaauuauaaauagcu

SEQ ID NO: 215966 - RNA, 20 nt, Human
guugucccagcgugcccugc

SEQ ID NO: 215967 - RNA, 32 nt, Human
guugucccagcugcuugggaggcugaggcagg

SEQ ID NO: 215968 - RNA, 32 nt, Human
guugucccgaacuguugauuuggaaaagaaau

SEQ ID NO: 215969 - RNA, 32 nt, Human
guugucccuccaguucccuccugagggcugug

SEQ ID NO: 215970 - RNA, 22 nt, Human
guugucccuggaaggagggcgg

SEQ ID NO: 215971 - RNA, 32 nt, Human
guuguccggagugcaccugcugccuguucugu

SEQ ID NO: 215972 - RNA, 32 nt, Human
guuguccgggccacuccucccuuccuuuccac

SEQ ID NO: 215973 - RNA, 32 nt, Human
guuguccgguuucuauggccuugcuguguacu

SEQ ID NO: 215974 - RNA, 32 nt, Human
guuguccuaccaccccuugcucuuugagggcu

SEQ ID NO: 215975 - RNA, 32 nt, Human
guuguccucacccuuguuaaucucaagaaacu

SEQ ID NO: 215976 - RNA, 16 nt, Human
guuguccuccagaaau

SEQ ID NO: 215977 - RNA, 32 nt, Human
guuguccucccauccauccauuaagcugcuau

SEQ ID NO: 215978 - RNA, 32 nt, Human
guuguccugagcccuucugcguuguuaugcca

SEQ ID NO: 215979 - RNA, 32 nt, Human
guuguccuggacaccacaggggcaccugcagg

SEQ ID NO: 215980 - RNA, 22 nt, Human
guuguccuguuucaucuucucc

SEQ ID NO: 215981 - RNA, 32 nt, Human
guuguccuuagguggcugagaacugggggauu

SEQ ID NO: 215982 - RNA, 32 nt, Human
guuguccuucccaguuucuccccaaccucccc

SEQ ID NO: 215983 - RNA, 32 nt, Human
guuguccuucucaguuucuccccaaccucccc

SEQ ID NO: 215984 - RNA, 32 nt, Human
guuguccuucuuccuccaccaccugcggggug

SEQ ID NO: 215985 - RNA, 32 nt, Human
guugucgacucugccagcagggauuggcuaac

SEQ ID NO: 215986 - RNA, 32 nt, Human
guugucgcgcacgccucugcccgccagcccgc

SEQ ID NO: 215987 - RNA, 32 nt, Human
guugucggcugaugccuugucuugugucugaa

SEQ ID NO: 215988 - RNA, 32 nt, Human
guugucuaaggguuugucugagccgccucgga

SEQ ID NO: 215989 - RNA, 32 nt, Human
guugucuaggagacagagccaagcacugcuca

SEQ ID NO: 215990 - RNA, 32 nt, Human
guugucucacugcauccaaugcuuuuccuucu

SEQ ID NO: 215991 - RNA, 32 nt, Human
guugucucccaggcuggagugcaguggcguga

SEQ ID NO: 215992 - RNA, 32 nt, Human
guugucucccucucccuccacagucuccuugg

SEQ ID NO: 215993 - RNA, 32 nt, Human
guugucuccguguccccuccucccucugcccc

SEQ ID NO: 215994 - RNA, 32 nt, Human
guugucucucaccucuacauuggaucacaugg

SEQ ID NO: 215995 - RNA, 32 nt, Human
guugucucugcucuucccucuccuggcugugg

SEQ ID NO: 215996 - RNA, 32 nt, Human
guugucucuuuguuucuugcugccacugccag

SEQ ID NO: 215997 - RNA, 32 nt, Human
guugucugaacccaggcagcuggcaggagugg

SEQ ID NO: 215998 - RNA, 21 nt, Human
guugucugagacagaguugga

SEQ ID NO: 215999 - RNA, 32 nt, Human
guugucugagauugcugcagccauucuuguua

SEQ ID NO: 216000 - RNA, 32 nt, Human
guugucugauucaacuccaaaaggacagaguc

SEQ ID NO: 216001 - RNA, 32 nt, Human
guugucuggagugcugugguggaguggagugg

SEQ ID NO: 216002 - RNA, 32 nt, Human
guugucugggacccucccucuccugagagggg

SEQ ID NO: 216003 - RNA, 32 nt, Human
guugucugggaccuuuuuccagggucaaagca

SEQ ID NO: 216004 - RNA, 32 nt, Human
guugucugggaggacgggacggugucucuggc

SEQ ID NO: 216005 - RNA, 32 nt, Human
guugucugggcccuuguuuacaagcacgcguu

SEQ ID NO: 216006 - RNA, 32 nt, Human
guugucugggguggguggaguggcgacaggau

SEQ ID NO: 216007 - RNA, 32 nt, Human
guugucugucuuacuaucuacuucuugaguag

SEQ ID NO: 216008 - RNA, 32 nt, Human
guugucuguuagcuuuggguugcagugcuaga

SEQ ID NO: 216009 - RNA, 32 nt, Human
guugucuuagaucugaugaugcugcuauuuac

SEQ ID NO: 216010 - RNA, 32 nt, Human
guugucuucaucucagaacuuuccuauccugg

SEQ ID NO: 216011 - RNA, 32 nt, Human
guugucuucuucuucuucuucuucuucuucuu

SEQ ID NO: 216012 - RNA, 32 nt, Human
guugucuuugauuaaaggaaacucaccgccau

SEQ ID NO: 216013 - RNA, 32 nt, Human
guugucuuuguggacucugccugcauggcuua

SEQ ID NO: 216014 - RNA, 31 nt, Human
guugugaacagacccuguucacuggagaggc

SEQ ID NO: 216015 - RNA, 32 nt, Human
guugugaagcuuugugugacuugcucaggauc

SEQ ID NO: 216016 - RNA, 32 nt, Human
guugugaagucagcagcauuuuuaagcccauu

SEQ ID NO: 216017 - RNA, 32 nt, Human
guugugaauacccagagguugggcagaucagu

SEQ ID NO: 216018 - RNA, 32 nt, Human
guugugacagucuuccugaaagcaagggccgu

SEQ ID NO: 216019 - RNA, 32 nt, Human
guugugacuaucuccagguacauggcuugcga

SEQ ID NO: 216020 - RNA, 32 nt, Human
guugugacucacuccaccucugugcccugcag

SEQ ID NO: 216021 - RNA, 32 nt, Human
guugugacuguacuauuucuaguauagugaac

SEQ ID NO: 216022 - RNA, 32 nt, Human
guugugagaacugauuucugcaucagaauauc

SEQ ID NO: 216023 - RNA, 32 nt, Human
guugugagacugaguucuguauucuggugagu

SEQ ID NO: 216024 - RNA, 32 nt, Human
guugugagagcauuagaagcagcagucgauag

SEQ ID NO: 216025 - RNA, 32 nt, Human
guugugagauaacauucugguagcucaguuaa

SEQ ID NO: 216026 - RNA, 32 nt, Human
guugugagccaagauuguaaccagagagcagc

SEQ ID NO: 216027 - RNA, 32 nt, Human
guugugaggagaaagaagaaaauggcugccca

SEQ ID NO: 216028 - RNA, 32 nt, Human
guugugaggauugaguuagaaaaugcuagcaa

SEQ ID NO: 216029 - RNA, 32 nt, Human
guugugaguuuuguuucucuuccagcuuuuca

SEQ ID NO: 216030 - RNA, 32 nt, Human
guugugaucucaggacucugacaggcacgugg

SEQ ID NO: 216031 - RNA, 32 nt, Human
guugugauggagggcuggaggagcagcgagac

SEQ ID NO: 216032 - RNA, 32 nt, Human
guugugauuaccugcugcaugaaaaguggcau

SEQ ID NO: 216033 - RNA, 32 nt, Human
guugugcaaccauugcuucauuucuuugcaaa

SEQ ID NO: 216034 - RNA, 32 nt, Human
guugugcacugaggccggcugguccuugagaa

SEQ ID NO: 216035 - RNA, 32 nt, Human
guugugcagccugagcugggcgcugccuuccu

SEQ ID NO: 216036 - RNA, 32 nt, Human
guugugcagcugguugggcagagcuggcauua

SEQ ID NO: 216037 - RNA, 32 nt, Human
guugugcagcuucuccaccuccugguagagga

SEQ ID NO: 216038 - RNA, 23 nt, Human
guugugcaggcuggagugcagug

SEQ ID NO: 216039 - RNA, 24 nt, Human
guugugcaggcuggagugcagugg

SEQ ID NO: 216040 - RNA, 24 nt, Human
guugugcaggcuguagugcagugg

SEQ ID NO: 216041 - RNA, 32 nt, Human
guugugcagggagggagcacgagaugggcaga

SEQ ID NO: 216042 - RNA, 32 nt, Human
guugugccaacugccuagucagucccaaugag

SEQ ID NO: 216043 - RNA, 32 nt, Human
guugugccaagugcaauaaaccagucacaaaa

SEQ ID NO: 216044 - RNA, 32 nt, Human
guugugccacagaauuggaacagggaaaccca

SEQ ID NO: 216045 - RNA, 32 nt, Human
guugugccacugcacuccagccugggcaaaaa

SEQ ID NO: 216046 - RNA, 32 nt, Human
guugugccacugcacuccagccuggguaagag

SEQ ID NO: 216047 - RNA, 32 nt, Human
guugugccacugcacuccagccugggugacag

SEQ ID NO: 216048 - RNA, 32 nt, Human
guugugccacugcacugcagccugggcuacag

SEQ ID NO: 216049 - RNA, 29 nt, Human
guugugccacuguuaucauccuccuagca

SEQ ID NO: 216050 - RNA, 32 nt, Human
guugugccagcagaaaugucucuccucuaggu

SEQ ID NO: 216051 - RNA, 32 nt, Human
guugugccauuccccagccacugccuucaugc

SEQ ID NO: 216052 - RNA, 32 nt, Human
guugugcccuggaaucagccugguugagcuca

SEQ ID NO: 216053 - RNA, 32 nt, Human
guugugccuguaaucccagcuacuugggaggc

SEQ ID NO: 216054 - RNA, 32 nt, Human
guugugccuuuaucaugagaaaggucuuuauu

SEQ ID NO: 216055 - RNA, 32 nt, Human
guugugcgcagaaggcuggggcaagcgaguag

SEQ ID NO: 216056 - RNA, 32 nt, Human
guugugcucacuucagggcccagcacaaaaau

SEQ ID NO: 216057 - RNA, 32 nt, Human
guugugcucgaguuggucugagugcaggcaca

SEQ ID NO: 216058 - RNA, 32 nt, Human
guugugcucuuucaaagacccuuguuucugcc

SEQ ID NO: 216059 - RNA, 32 nt, Human
guugugcuggaaagcuggggacagguugaugg

SEQ ID NO: 216060 - RNA, 32 nt, Human
guugugcugguuuuuaaaugugcaucaagaaa

SEQ ID NO: 216061 - RNA, 32 nt, Human
guugugcuuuucuguguuguguguuuugauuu

SEQ ID NO: 216062 - RNA, 32 nt, Human
guuguggagguuuccuuggaucgccccggugu

SEQ ID NO: 216063 - RNA, 32 nt, Human
guuguggaugagcugcaggugcagugacucca

SEQ ID NO: 216064 - RNA, 32 nt, Human
guuguggcaaacauaagagaaaccugaaaaac

SEQ ID NO: 216065 - RNA, 32 nt, Human
guuguggcaugguucuccuccgagcugggacu

SEQ ID NO: 216066 - RNA, 32 nt, Human
guuguggccagggggagugucccauggguaag

SEQ ID NO: 216067 - RNA, 32 nt, Human
guuguggccucuaccauugccuuggcuucugg

SEQ ID NO: 216068 - RNA, 32 nt, Human
guuguggccuguaaucccagcuacucgggagg

SEQ ID NO: 216069 - RNA, 32 nt, Human
guuguggcggguguucugaggcugagaggaca

SEQ ID NO: 216070 - RNA, 32 nt, Human
guuguggcucuuuuugucugugccaguuggca

SEQ ID NO: 216071 - RNA, 22 nt, Human
guuguggcugagaagaugagag

SEQ ID NO: 216072 - RNA, 32 nt, Human
guugugggagagaggcagcugggagacaggcc

SEQ ID NO: 216073 - RNA, 32 nt, Human
guugugggagguagggaggaaauauguaaaga

SEQ ID NO: 216074 - RNA, 32 nt, Human
guugugggauucaggccagggcuaggacgaag

SEQ ID NO: 216075 - RNA, 32 nt, Human
guuguggggcuggggccucacuuccccuccuc

SEQ ID NO: 216076 - RNA, 32 nt, Human
guuguggggucugaggcacaugggagugggac

SEQ ID NO: 216077 - RNA, 32 nt, Human
guuguggguggggagcaagggaagagagaaac

SEQ ID NO: 216078 - RNA, 32 nt, Human
guuguggguuccuggagucuggcuccaucucc

SEQ ID NO: 216079 - RNA, 32 nt, Human
guuguggguugcagguugggugcugcuguugu

SEQ ID NO: 216080 - RNA, 32 nt, Human
guuguggucucagccaaaaugagugauacccc

SEQ ID NO: 216081 - RNA, 32 nt, Human
guuguggugagcugagauugcaccauugcacu

SEQ ID NO: 216082 - RNA, 32 nt, Human
guuguggugagcugagauugcgccauugcacu

SEQ ID NO: 216083 - RNA, 24 nt, Human
guugugguguccagugugcagcag

SEQ ID NO: 216084 - RNA, 32 nt, Human
guuguggugugugguaggguuuuuguuuucuu

SEQ ID NO: 216085 - RNA, 32 nt, Human
guugugguucucugucucuagcagcaugaucu

SEQ ID NO: 216086 - RNA, 32 nt, Human
guuguguaacaaaccaccccaaaacuuacugg

SEQ ID NO: 216087 - RNA, 32 nt, Human
guuguguagggagauggagaaaaugcuuaauc

SEQ ID NO: 216088 - RNA, 32 nt, Human
guugugucacaguucacugcagccugggugac

SEQ ID NO: 216089 - RNA, 32 nt, Human
guugugucacccagguuagaguguaguggcgc

SEQ ID NO: 216090 - RNA, 32 nt, Human
guugugucauugcacuccagccuggggaacag

SEQ ID NO: 216091 - RNA, 32 nt, Human
guugugugagccucuucagggguucauccagc

SEQ ID NO: 216092 - RNA, 32 nt, Human
guugugugagucaggaagaggggccagauauc

SEQ ID NO: 216093 - RNA, 32 nt, Human
guugugugaucaagcaugucucuguguaguuc

SEQ ID NO: 216094 - RNA, 32 nt, Human
guugugugcacgcacgcacacacucaugcaca

SEQ ID NO: 216095 - RNA, 32 nt, Human
guugugugcauucgucuuuuccagagcaaacc

SEQ ID NO: 216096 - RNA, 32 nt, Human
guugugugccuguagucccagcuacuuaggag

SEQ ID NO: 216097 - RNA, 32 nt, Human
guugugugcuccuuaugauaaucuaaugccug

SEQ ID NO: 216098 - RNA, 32 nt, Human
guuguguggcugcaaaacaucacaaagugacc

SEQ ID NO: 216099 - RNA, 32 nt, Human
guugugugggcagguucacgucuuccaccagg

SEQ ID NO: 216100 - RNA, 31 nt, Human
guugugugggugggagugagacuggguagaa

SEQ ID NO: 216101 - RNA, 31 nt, Human
guugugugggugggcuguugggagugaggau

SEQ ID NO: 216102 - RNA, 32 nt, Human
guuguguuacgaaggcugacccugccaauggc

SEQ ID NO: 216103 - RNA, 32 nt, Human
guuguguuauaaaaaguggcucccagcuugga

SEQ ID NO: 216104 - RNA, 32 nt, Human
guuguguugaguggagggaguuuaagagaaag

SEQ ID NO: 216105 - RNA, 32 nt, Human
guuguguuuugugcugagccuccugggaaacu

SEQ ID NO: 216106 - RNA, 32 nt, Human
guuguuaaaauggaaauaaaagugaaguggua

SEQ ID NO: 216107 - RNA, 32 nt, Human
guuguuaaauaaaugcaguucuuuuugucauu

SEQ ID NO: 216108 - RNA, 32 nt, Human
guuguuaacuucuacauucaagggcuuaucuc

SEQ ID NO: 216109 - RNA, 32 nt, Human
guuguuacucuuccucucucaaggagaaagua

SEQ ID NO: 216110 - RNA, 32 nt, Human
guuguuacugccccauccgccauguccuucag

SEQ ID NO: 216111 - RNA, 32 nt, Human
guuguuacuuggaacagccacuugagaggcuc

SEQ ID NO: 216112 - RNA, 32 nt, Human
guuguuagaacucagaggaagaggcaggggca

SEQ ID NO: 216113 - RNA, 32 nt, Human
guuguuagggcugaggaaccaaucaagguaga

SEQ ID NO: 216114 - RNA, 32 nt, Human
guuguucaccaacagaccagaccuccuuuaac

SEQ ID NO: 216115 - RNA, 32 nt, Human
guuguucacuuaaggggaaccagcacaacagg

SEQ ID NO: 216116 - RNA, 32 nt, Human
guuguucaggcagccaggguccugugcccacc

SEQ ID NO: 216117 - RNA, 31 nt, Human
guuguucauuuucagcacuuacuucaaaaga

SEQ ID NO: 216118 - RNA, 32 nt, Human
guuguucccuuucccuggggcuuuuccauuua

SEQ ID NO: 216119 - RNA, 32 nt, Human
guuguuccuaacuuggggacuggaccuacccu

SEQ ID NO: 216120 - RNA, 32 nt, Human
guuguucucuaaaagaagcuggagggaggaag

SEQ ID NO: 216121 - RNA, 32 nt, Human
guuguucucugcagagaaccagccuggcuccu

SEQ ID NO: 216122 - RNA, 32 nt, Human
guuguucugugggacucaacaggggacagcgu

SEQ ID NO: 216123 - RNA, 32 nt, Human
guuguucuguuugggaccuggaaaagaaccca

SEQ ID NO: 216124 - RNA, 32 nt, Human
guuguucuugcaggaauuagccuccccgucuc

SEQ ID NO: 216125 - RNA, 32 nt, Human
guuguucuuggguuaggauuuggggcucugau

SEQ ID NO: 216126 - RNA, 21 nt, Human
guuguugaauagaccuaggca

SEQ ID NO: 216127 - RNA, 32 nt, Human
guuguugagauggagucucaccuugucgccca

SEQ ID NO: 216128 - RNA, 32 nt, Human
guuguugagauggagucugccacccaggcugg

SEQ ID NO: 216129 - RNA, 32 nt, Human
guuguugauaccuugcaaaaguauugcuucug

SEQ ID NO: 216130 - RNA, 32 nt, Human
guuguugcaaaugacaggaucccauucuuuuu

SEQ ID NO: 216131 - RNA, 32 nt, Human
guuguugcagugagcugugaucaugccaucac

SEQ ID NO: 216132 - RNA, 32 nt, Human
guuguugcagugauugguugucuuuuucuaga

SEQ ID NO: 216133 - RNA, 32 nt, Human
guuguugccacaucugaccaccgaagcuuaaa

SEQ ID NO: 216134 - RNA, 32 nt, Human
guuguugccacuccgccaccauguucgaggcg

SEQ ID NO: 216135 - RNA, 32 nt, Human
guuguugcccaggcuggagugcaguggcgcca

SEQ ID NO: 216136 - RNA, 32 nt, Human
guuguugcccaggcuggagugcaguggcguga

SEQ ID NO: 216137 - RNA, 32 nt, Human
guuguugccuggauuuccagaucaugugacag

SEQ ID NO: 216138 - RNA, 32 nt, Human
guuguugccuguaaucacacaugguuugacau

SEQ ID NO: 216139 - RNA, 32 nt, Human
guuguugccuuccucugucugacaggaaucuc

SEQ ID NO: 216140 - RNA, 32 nt, Human
guuguugcucuaggaagacauuuuuccguuug

SEQ ID NO: 216141 - RNA, 32 nt, Human
guuguugcuguuggacuaaauagcuauuccug

SEQ ID NO: 216142 - RNA, 32 nt, Human
guuguuggaggcugcaaaauguuaguagauau

SEQ ID NO: 216143 - RNA, 32 nt, Human
guuguugggaggaucuggugguuugaggugug

SEQ ID NO: 216144 - RNA, 32 nt, Human
guuguuggggagagaggcagaggcagcuggag

SEQ ID NO: 216145 - RNA, 32 nt, Human
guuguuggggcuuuagcaucugacugauuuug

SEQ ID NO: 216146 - RNA, 32 nt, Human
guuguugggggcuggaggcgggaggucccaug

SEQ ID NO: 216147 - RNA, 32 nt, Human
guuguuguccaaaggaagucugaucuguguuu

SEQ ID NO: 216148 - RNA, 22 nt, Human
guuguugugagcaucaaaugag

SEQ ID NO: 216149 - RNA, 32 nt, Human
guuguuguguaguugcauuggaagagagaaag

SEQ ID NO: 216150 - RNA, 32 nt, Human
guuguuguugagacagagucucgcucugucac

SEQ ID NO: 216151 - RNA, 32 nt, Human
guuguuguugagacagagucucgcucugucgc

SEQ ID NO: 216152 - RNA, 32 nt, Human
guuguuguugagacggagucucgcucugucgc

SEQ ID NO: 216153 - RNA, 32 nt, Human
guuguuguugagauggagucuugcgcuguugc

SEQ ID NO: 216154 - RNA, 32 nt, Human
guuguuguuguuguucuggguaacuccaaccc

SEQ ID NO: 216155 - RNA, 32 nt, Human
guuguuguuguuguuguuuuuggugaggaacu

SEQ ID NO: 216156 - RNA, 32 nt, Human
guuguuguuguuguuuucugagauggagucuu

SEQ ID NO: 216157 - RNA, 32 nt, Human
guuguuguuguuguuuugagauggagucucgc

SEQ ID NO: 216158 - RNA, 32 nt, Human
guuguuguuguuguuuuuggugaggaacucuu

SEQ ID NO: 216159 - RNA, 32 nt, Human
guuguuguuguuuaaauacuuaucucauugcu

SEQ ID NO: 216160 - RNA, 32 nt, Human
guuguuguuuuuccucuccuuuugagaauuuu

SEQ ID NO: 216161 - RNA, 32 nt, Human
guuguuuacaugccaguacaauuuauaauaaa

SEQ ID NO: 216162 - RNA, 32 nt, Human
guuguuuaccagcaggacagagcccgggcgca

SEQ ID NO: 216163 - RNA, 32 nt, Human
guuguuuagccaucuagucugugguuuucugu

SEQ ID NO: 216164 - RNA, 32 nt, Human
guuguuuagggcacccuguccauggcaccuug

SEQ ID NO: 216165 - RNA, 32 nt, Human
guuguuuauccagcaaugccucaaggauguug

SEQ ID NO: 216166 - RNA, 32 nt, Human
guuguuucaaagaugauauuucugugaacaga

SEQ ID NO: 216167 - RNA, 32 nt, Human
guuguuucaccguaaccucugccuccugacuu

SEQ ID NO: 216168 - RNA, 32 nt, Human
guuguuuccaagguacgcuuguuuuccaagga

SEQ ID NO: 216169 - RNA, 32 nt, Human
guuguuuccagccucaggccacgggcuggacg

SEQ ID NO: 216170 - RNA, 32 nt, Human
guuguuuccauggugauggggccagauguaua

SEQ ID NO: 216171 - RNA, 22 nt, Human
guuguuuccucuguaauccuca

SEQ ID NO: 216172 - RNA, 32 nt, Human
guuguuuccuuuuucuccucccgaaggaacag

SEQ ID NO: 216173 - RNA, 20 nt, Human
guuguuucuacaaaucucuc

SEQ ID NO: 216174 - RNA, 21 nt, Human
guuguuucucccugugccuca

SEQ ID NO: 216175 - RNA, 32 nt, Human
guuguuucuccuccuccuugcauauuuccuac

SEQ ID NO: 216176 - RNA, 31 nt, Human
guuguuucucucccugggccucaguuucccc

SEQ ID NO: 216177 - RNA, 32 nt, Human
guuguuucugaugcagcugagaaaaaugcaga

SEQ ID NO: 216178 - RNA, 32 nt, Human
guuguuugaaaccuuuguaacuuguuuguaug

SEQ ID NO: 216179 - RNA, 32 nt, Human
guuguuugccuuucaaccuuguuuuacaguuc

SEQ ID NO: 216180 - RNA, 32 nt, Human
guuguuugggauucccuuuugggucacgcacu

SEQ ID NO: 216181 - RNA, 32 nt, Human
guuguuugucucauuuuugcucugugcauuuu

SEQ ID NO: 216182 - RNA, 32 nt, Human
guuguuuuaaggcuuaauuaaugaaaugccuu

SEQ ID NO: 216183 - RNA, 32 nt, Human
guuguuuucaugccgccugugaucucagauuc

SEQ ID NO: 216184 - RNA, 32 nt, Human
guuguuuucucauauuaagaaauuuaaaucua

SEQ ID NO: 216185 - RNA, 32 nt, Human
guuguuuucugcuuccagaaccacccaggagc

SEQ ID NO: 216186 - RNA, 32 nt, Human
guuguuuucuguucccuugccaucacacuguu

SEQ ID NO: 216187 - RNA, 21 nt, Human
guuguuuuggugccugccucu

SEQ ID NO: 216188 - RNA, 32 nt, Human
guuguuuuguuuuguggaccugcccugggggc

SEQ ID NO: 216189 - RNA, 32 nt, Human
guuguuuuucuuuuccaccugccccaugccuu

SEQ ID NO: 216190 - RNA, 32 nt, Human
guuguuuuugagacagggucuugcucugucac

SEQ ID NO: 216191 - RNA, 32 nt, Human
guuguuuuugagacugaguuucacucuuguug

SEQ ID NO: 216192 - RNA, 32 nt, Human
guuguuuuugagauggagucuugcgcuguugc

SEQ ID NO: 216193 - RNA, 32 nt, Human
guuguuuuugagauggaguuucacucuugucu

SEQ ID NO: 216194 - RNA, 19 nt, Human
guuguuuuuucuuaaugua

SEQ ID NO: 216195 - RNA, 32 nt, Human
guuuaaaaagucagguuguccaucccauuggg

SEQ ID NO: 216196 - RNA, 32 nt, Human
guuuaaaacuucugaagugcugucuuuuuaca

SEQ ID NO: 216197 - RNA, 32 nt, Human
guuuaaaagacuauccuuuugcuccaaugaau

SEQ ID NO: 216198 - RNA, 32 nt, Human
guuuaaaagauccaaggaguacaaaaggagaa

SEQ ID NO: 216199 - RNA, 32 nt, Human
guuuaaacaagaagagagagugugacagagag

SEQ ID NO: 216200 - RNA, 31 nt, Human
guuuaaacaagaucuuccacagcagacuuca

SEQ ID NO: 216201 - RNA, 32 nt, Human
guuuaaacacagauagcacgggccuuucucuu

SEQ ID NO: 216202 - RNA, 32 nt, Human
guuuaaaccagccugggcaccauggugagacc

SEQ ID NO: 216203 - RNA, 32 nt, Human
guuuaaacuaagcugugaaaaauauguaggcu

SEQ ID NO: 216204 - RNA, 32 nt, Human
guuuaaacugcuuccuuugagaacaaguuuga

SEQ ID NO: 216205 - RNA, 22 nt, Human
guuuaaacuguauuuuauacca

SEQ ID NO: 216206 - RNA, 24 nt, Human
guuuaaacuguguuuuauaccagu

SEQ ID NO: 216207 - RNA, 32 nt, Human
guuuaaagaagcuggccauaagaaaaauauau

SEQ ID NO: 216208 - RNA, 32 nt, Human
guuuaaagcugcuguuccucuaccucaguggu

SEQ ID NO: 216209 - RNA, 32 nt, Human
guuuaaaggaagcauccacaccccaacucccg

SEQ ID NO: 216210 - RNA, 32 nt, Human
guuuaaaggaaguauuccucuaaagguucaaa

SEQ ID NO: 216211 - RNA, 32 nt, Human
guuuaaauaugcggagaauguauauugccucu

SEQ ID NO: 216212 - RNA, 32 nt, Human
guuuaaauaugggaguaaauucagccuuucuu

SEQ ID NO: 216213 - RNA, 20 nt, Human
guuuaaauauuugagcuuua

SEQ ID NO: 216214 - RNA, 32 nt, Human
guuuaaaucaccauuaaaaaucaacgcuuucu

SEQ ID NO: 216215 - RNA, 32 nt, Human
guuuaaaugauggugaauacuuucuuaacacu

SEQ ID NO: 216216 - RNA, 32 nt, Human
guuuaaaugggaaucagauccccugguugaga

SEQ ID NO: 216217 - RNA, 32 nt, Human
guuuaaaugggcuuauucuguacauugcuaaa

SEQ ID NO: 216218 - RNA, 32 nt, Human
guuuaaauuuagauguucaaaaguaguuguga

SEQ ID NO: 216219 - RNA, 32 nt, Human
guuuaacacggggaaaccccgucucuacuaaa

SEQ ID NO: 216220 - RNA, 32 nt, Human
guuuaacagccgaagacacacgccuagggaug

SEQ ID NO: 216221 - RNA, 32 nt, Human
guuuaacccacugugcuauaguugcgggugga

SEQ ID NO: 216222 - RNA, 32 nt, Human
guuuaaccugcucuuggucauuggaaauuuac

SEQ ID NO: 216223 - RNA, 32 nt, Human
guuuaaccuuugguucugcccaugaagcaugu

SEQ ID NO: 216224 - RNA, 32 nt, Human
guuuaagaaagccagugacaaguaggaugcaa

SEQ ID NO: 216225 - RNA, 32 nt, Human
guuuaagaaggccaugacucuuuaggugugua

SEQ ID NO: 216226 - RNA, 32 nt, Human
guuuaagaccagccugggcaacauacagaaag

SEQ ID NO: 216227 - RNA, 32 nt, Human
guuuaagaccagccugggcaacauggugaagc

SEQ ID NO: 216228 - RNA, 32 nt, Human
guuuaagaccuccagacucuaacuuuauagau

SEQ ID NO: 216229 - RNA, 32 nt, Human
guuuaagacucugacauuccuggcugucaugc

SEQ ID NO: 216230 - RNA, 32 nt, Human
guuuaagagaauccaguugagaaaacaaacuu

SEQ ID NO: 216231 - RNA, 32 nt, Human
guuuaagagcguagacuugagcuagacuaccc

SEQ ID NO: 216232 - RNA, 32 nt, Human
guuuaagaggauugaggaaggcugggaaguuu

SEQ ID NO: 216233 - RNA, 32 nt, Human
guuuaagcaaugcuucugccucagcuucccaa

SEQ ID NO: 216234 - RNA, 32 nt, Human
guuuaagcaauucuccugcuucaaccucuaga

SEQ ID NO: 216235 - RNA, 32 nt, Human
guuuaagcagagggcuacagaaaacagggaag

SEQ ID NO: 216236 - RNA, 32 nt, Human
guuuaagcgauucuccugccucagcuucccga

SEQ ID NO: 216237 - RNA, 32 nt, Human
guuuaagcuccaccaacuucaagccaugugac

SEQ ID NO: 216238 - RNA, 32 nt, Human
guuuaaggccagagcuuuucucaguauuugau

SEQ ID NO: 216239 - RNA, 32 nt, Human
guuuaagggaaauaagcucugugauaagcaga

SEQ ID NO: 216240 - RNA, 32 nt, Human
guuuaaggucaccugcacucccagccaagugg

SEQ ID NO: 216241 - RNA, 32 nt, Human
guuuaagucaguucuaacugugcaucagaaaa

SEQ ID NO: 216242 - RNA, 32 nt, Human
guuuaagucugucaguuucuuaauuguggaca

SEQ ID NO: 216243 - RNA, 32 nt, Human
guuuaaguuaaguuucucuggugcaaucugug

SEQ ID NO: 216244 - RNA, 32 nt, Human
guuuaaguuauuaagagguaagacuuaguacu

SEQ ID NO: 216245 - RNA, 32 nt, Human
guuuaauaaccccugggccaugccuagaugau

SEQ ID NO: 216246 - RNA, 32 nt, Human
guuuaauagagaaugauugucuuccgaguuuu

SEQ ID NO: 216247 - RNA, 32 nt, Human
guuuaauauugucuuccuaauugggauaauuu

SEQ ID NO: 216248 - RNA, 32 nt, Human
guuuaaugaacuguuuucuacauuucacaggc

SEQ ID NO: 216249 - RNA, 32 nt, Human
guuuaaugagaaauaggagauuagcugcaaua

SEQ ID NO: 216250 - RNA, 32 nt, Human
guuuaauggacucaguuccgcauugcugguga

SEQ ID NO: 216251 - RNA, 32 nt, Human
guuuaauggaggugugggauguuugcauuacg

SEQ ID NO: 216252 - RNA, 32 nt, Human
guuuaauuacaguguuuuacugccugguagaa

SEQ ID NO: 216253 - RNA, 32 nt, Human
guuuaauuccauccaaguuguggauggcaggc

SEQ ID NO: 216254 - RNA, 32 nt, Human
guuuaauuccgcaugauguuucccucuccuuc

SEQ ID NO: 216255 - RNA, 32 nt, Human
guuuaauuguugugcaguuucauagauggguc

SEQ ID NO: 216256 - RNA, 32 nt, Human
guuuaauuucccuucauuucccccuccuuugc

SEQ ID NO: 216257 - RNA, 32 nt, Human
guuuacaaaggacugugcuuuuuauucugucu

SEQ ID NO: 216258 - RNA, 32 nt, Human
guuuacaacaucaccagugccacgucaugagc

SEQ ID NO: 216259 - RNA, 32 nt, Human
guuuacaacauggggaaaggcguauuucuuac

SEQ ID NO: 216260 - RNA, 32 nt, Human
guuuacaagcagagacucacuccaacccaaac

SEQ ID NO: 216261 - RNA, 22 nt, Human
guuuacacacgugcaauuuguu

SEQ ID NO: 216262 - RNA, 32 nt, Human
guuuacacaggcaaacugucagaaaagaguag

SEQ ID NO: 216263 - RNA, 32 nt, Human
guuuacacaguucucaggaggcugugguuuau

SEQ ID NO: 216264 - RNA, 32 nt, Human
guuuacaccacugcacuccagucuggaugaca

SEQ ID NO: 216265 - RNA, 32 nt, Human
guuuacaccuguaaucccagcacuuugggagg

SEQ ID NO: 216266 - RNA, 32 nt, Human
guuuacagaagcugguggcuguggagacaaau

SEQ ID NO: 216267 - RNA, 32 nt, Human
guuuacagacaagauuugcauuugaacugggg

SEQ ID NO: 216268 - RNA, 32 nt, Human
guuuacagaccucagugaugucagcacuguug

SEQ ID NO: 216269 - RNA, 32 nt, Human
guuuacagagaaggaugcugaggaccuagaug

SEQ ID NO: 216270 - RNA, 32 nt, Human
guuuacagccacugggccugggcacacacauu

SEQ ID NO: 216271 - RNA, 32 nt, Human
guuuacaguggaauugugaauaaguuuucagu

SEQ ID NO: 216272 - RNA, 32 nt, Human
guuuacauauaucucugugucucuccaucauu

SEQ ID NO: 216273 - RNA, 32 nt, Human
guuuacaucacagcugccccaggcugaggcgu

SEQ ID NO: 216274 - RNA, 32 nt, Human
guuuacauccugcugcugauagguucaaggaa

SEQ ID NO: 216275 - RNA, 32 nt, Human
guuuacaucgguugccccaggggaagugccug

SEQ ID NO: 216276 - RNA, 32 nt, Human
guuuacaugguuuuaucuagcuuucuuauuua

SEQ ID NO: 216277 - RNA, 32 nt, Human
guuuacauuuucugguacucugugaaagaaga

SEQ ID NO: 216278 - RNA, 32 nt, Human
guuuacauuuuucuguguuacacucaaggaua

SEQ ID NO: 216279 - RNA, 32 nt, Human
guuuaccaaaauaaaggaaaccaccuuuguag

SEQ ID NO: 216280 - RNA, 32 nt, Human
guuuaccaaucugggggcuuguuuuucuuuuc

SEQ ID NO: 216281 - RNA, 32 nt, Human
guuuacccagcagaaauucaagcauauguccu

SEQ ID NO: 216282 - RNA, 32 nt, Human
guuuacccaggagaggaugggacgaaguugga

SEQ ID NO: 216283 - RNA, 32 nt, Human
guuuacccaguauucaucugcaaagccagauu

SEQ ID NO: 216284 - RNA, 32 nt, Human
guuuacccauuuucccuuuuauggcucaugcc

SEQ ID NO: 216285 - RNA, 32 nt, Human
guuuaccccaggcagaaaccacccucauaagg

SEQ ID NO: 216286 - RNA, 32 nt, Human
guuuacccugcucccucucucugucccuaggc

SEQ ID NO: 216287 - RNA, 32 nt, Human
guuuaccuaaaauggugauuuccagccuuuac

SEQ ID NO: 216288 - RNA, 32 nt, Human
guuuaccuaauggugccagccuccuuuugcuu

SEQ ID NO: 216289 - RNA, 32 nt, Human
guuuaccucccaagcuggaguccaguggugag

SEQ ID NO: 216290 - RNA, 32 nt, Human
guuuaccuggaagugguaggggugggagagau

SEQ ID NO: 216291 - RNA, 32 nt, Human
guuuaccuggcuuaccaggggaaguugacaac

SEQ ID NO: 216292 - RNA, 32 nt, Human
guuuaccuuccagaggcuggcaaugcuguuuc

SEQ ID NO: 216293 - RNA, 32 nt, Human
guuuaccuuucacagaaggcaggguaacuugc

SEQ ID NO: 216294 - RNA, 32 nt, Human
guuuacgccagaaaacagagauuucuguuuuc

SEQ ID NO: 216295 - RNA, 19 nt, Human
guuuacgccuguaauccca

SEQ ID NO: 216296 - RNA, 32 nt, Human
guuuacgccuguaaucccagcacugugggagg

SEQ ID NO: 216297 - RNA, 32 nt, Human
guuuacgggaggcgcuugguuacgggauccag

SEQ ID NO: 216298 - RNA, 32 nt, Human
guuuacgucccucccacugcuaaccuuauaua

SEQ ID NO: 216299 - RNA, 32 nt, Human
guuuacuaacaggcaccccugugucaucugaa

SEQ ID NO: 216300 - RNA, 32 nt, Human
guuuacucaccuuuugcacugaacagaauacu

SEQ ID NO: 216301 - RNA, 32 nt, Human
guuuacucagcuuuaauuagauaguugaguca

SEQ ID NO: 216302 - RNA, 32 nt, Human
guuuacucaucccggcgaggugaucccaugcg

SEQ ID NO: 216303 - RNA, 32 nt, Human
guuuacucugcagccuguguuuucuguuuccc

SEQ ID NO: 216304 - RNA, 32 nt, Human
guuuacucuuuuaauuuucauccuuugcaggu

SEQ ID NO: 216305 - RNA, 17 nt, Human
guuuacugaaauuuguu

SEQ ID NO: 216306 - RNA, 32 nt, Human
guuuacugagccuuaauccaccaaguuuauau

SEQ ID NO: 216307 - RNA, 32 nt, Human
guuuacugagggugauaucuucagguaaucag

SEQ ID NO: 216308 - RNA, 32 nt, Human
guuuacugcaaccuccaccuccuaggcucaag

SEQ ID NO: 216309 - RNA, 32 nt, Human
guuuacugcccaccuccgccugccagcccacc

SEQ ID NO: 216310 - RNA, 23 nt, Human
guuuacuguaaugugaaauuuuc

SEQ ID NO: 216311 - RNA, 32 nt, Human
guuuacugugugaacucugacaaguggcugga

SEQ ID NO: 216312 - RNA, 32 nt, Human
guuuacuuaaauaggccaggcgcaguggcuca

SEQ ID NO: 216313 - RNA, 32 nt, Human
guuuacuuaaccucucugugcuuugugugccu

SEQ ID NO: 216314 - RNA, 32 nt, Human
guuuacuucuagaccuggucaggcuccauccc

SEQ ID NO: 216315 - RNA, 32 nt, Human
guuuacuucucccuugccuuugacucauugga

SEQ ID NO: 216316 - RNA, 32 nt, Human
guuuacuucucuucugggcuuccccugguuuc

SEQ ID NO: 216317 - RNA, 32 nt, Human
guuuacuuuauccaauccucaggauuucauug

SEQ ID NO: 216318 - RNA, 32 nt, Human
guuuacuuuucagaucaaauuguuuaugguuu

SEQ ID NO: 216319 - RNA, 32 nt, Human
guuuagaaaccagcuuauugccaaagggaaaa

SEQ ID NO: 216320 - RNA, 32 nt, Human
guuuagaacaguguccagcacaaacaggcacu

SEQ ID NO: 216321 - RNA, 32 nt, Human
guuuagaagcaugcagcaccuccugcuucacu

SEQ ID NO: 216322 - RNA, 32 nt, Human
guuuagaaguagcaaagagcacccacauucaa

SEQ ID NO: 216323 - RNA, 32 nt, Human
guuuagaccuuuaauucuagcacuuugaauuc

SEQ ID NO: 216324 - RNA, 32 nt, Human
guuuagacuaaagagcugggaacagcuucaga

SEQ ID NO: 216325 - RNA, 32 nt, Human
guuuagacugcuaugguaauacauauuuuaaa

SEQ ID NO: 216326 - RNA, 32 nt, Human
guuuagagaaaaauugaagggaaaguacagag

SEQ ID NO: 216327 - RNA, 32 nt, Human
guuuagagcaguuucaaagaugagagcaguag

SEQ ID NO: 216328 - RNA, 32 nt, Human
guuuagaggaaggcccccuaccucuuccacac

SEQ ID NO: 216329 - RNA, 32 nt, Human
guuuagaggcuagagggagcugaggggaggau

SEQ ID NO: 216330 - RNA, 32 nt, Human
guuuagagugaggcuuccacuucacucuccgg

SEQ ID NO: 216331 - RNA, 32 nt, Human
guuuagaucuuaggcaugugcugguauccaca

SEQ ID NO: 216332 - RNA, 32 nt, Human
guuuagaugcacuuuuucuuuugagaguaagg

SEQ ID NO: 216333 - RNA, 32 nt, Human
guuuagauguguuugcuggauaccaaacaaac

SEQ ID NO: 216334 - RNA, 32 nt, Human
guuuagcauccuugcagaauuacuugagaagg

SEQ ID NO: 216335 - RNA, 32 nt, Human
guuuagcaucuuuacagauggagaggacagag

SEQ ID NO: 216336 - RNA, 32 nt, Human
guuuagcauuccucaggcuacugugaaaacac

SEQ ID NO: 216337 - RNA, 32 nt, Human
guuuagcccaggagacaucugccucaagccug

SEQ ID NO: 216338 - RNA, 32 nt, Human
guuuagccugggagcaguggcucacgccuaua

SEQ ID NO: 216339 - RNA, 32 nt, Human
guuuagcuccacuuugcacagaacaguuacuu

SEQ ID NO: 216340 - RNA, 32 nt, Human
guuuagcucuuacacucuauccuuccuagaaa

SEQ ID NO: 216341 - RNA, 32 nt, Human
guuuagcugccucugcugcccuuuacugugac

SEQ ID NO: 216342 - RNA, 32 nt, Human
guuuagcuuccuaucagugggcuuuaaauugu

SEQ ID NO: 216343 - RNA, 32 nt, Human
guuuagcuuccucuugcuucccaaagauuuua

SEQ ID NO: 216344 - RNA, 32 nt, Human
guuuaggaauuggaggcggcagugagucauga

SEQ ID NO: 216345 - RNA, 32 nt, Human
guuuaggaggaaaaggaaauaaggagaaaaga

SEQ ID NO: 216346 - RNA, 32 nt, Human
guuuaggcaccccuuuccccagccucuccucc

SEQ ID NO: 216347 - RNA, 32 nt, Human
guuuaggccaugucacuagaagcgcaguuuaa

SEQ ID NO: 216348 - RNA, 20 nt, Human
guuuaggcugggcgcagugg

SEQ ID NO: 216349 - RNA, 32 nt, Human
guuuagggccaccacauuuucucacugcuuuc

SEQ ID NO: 216350 - RNA, 32 nt, Human
guuuaggggcugggacacucacagccccaguc

SEQ ID NO: 216351 - RNA, 32 nt, Human
guuuaggguggagaaagagguacuggaaaaca

SEQ ID NO: 216352 - RNA, 32 nt, Human
guuuaguagcacaaauccaugcaacccaacag

SEQ ID NO: 216353 - RNA, 32 nt, Human
guuuaguauaaauauaucuagacauucagacu

SEQ ID NO: 216354 - RNA, 32 nt, Human
guuuagucacauauuuguuuaguucugggaaa

SEQ ID NO: 216355 - RNA, 32 nt, Human
guuuagucuuucuaagaaauagaucauggagc

SEQ ID NO: 216356 - RNA, 32 nt, Human
guuuagugaacaaacaauauguggucaauuaa

SEQ ID NO: 216357 - RNA, 32 nt, Human
guuuagugacaugcucaacgggugcgggaagg

SEQ ID NO: 216358 - RNA, 32 nt, Human
guuuagugagacaagcaauuucucccuucuga

SEQ ID NO: 216359 - RNA, 32 nt, Human
guuuagugggcaacauacaguugggccuuccu

SEQ ID NO: 216360 - RNA, 32 nt, Human
guuuagugucaauacuaaugcucuaauaaugu

SEQ ID NO: 216361 - RNA, 32 nt, Human
guuuagugugcaaauaaauguaaaugcuuuua

SEQ ID NO: 216362 - RNA, 21 nt, Human
guuuaguuaggcaggaagcag

SEQ ID NO: 216363 - RNA, 32 nt, Human
guuuaguuucacccagugugcuuuuggauaag

SEQ ID NO: 216364 - RNA, 32 nt, Human
guuuaguuuuauacuauauuugugcuauuuaa

SEQ ID NO: 216365 - RNA, 32 nt, Human
guuuauaacuugaaaaauccucuccgucuccc

SEQ ID NO: 216366 - RNA, 32 nt, Human
guuuauaagacaggagaaaagggagaaagcaa

SEQ ID NO: 216367 - RNA, 32 nt, Human
guuuauaagaccucuuucagcagaucacauca

SEQ ID NO: 216368 - RNA, 32 nt, Human
guuuauaauaaaaaucaucuauacaaaagaag

SEQ ID NO: 216369 - RNA, 32 nt, Human
guuuauacaguuuguguuguucagagauguuu

SEQ ID NO: 216370 - RNA, 32 nt, Human
guuuauaccaagagauucuucuagaucucauu

SEQ ID NO: 216371 - RNA, 32 nt, Human
guuuauagucacaaccucuccucagcccuaac

SEQ ID NO: 216372 - RNA, 23 nt, Human
guuuauauauaaaagaaaagcuc

SEQ ID NO: 216373 - RNA, 32 nt, Human
guuuauauuucaauaaaccucuaccucuucac

SEQ ID NO: 216374 - RNA, 32 nt, Human
guuuaucagaaagggcagaaguaggggaagaa

SEQ ID NO: 216375 - RNA, 22 nt, Human
guuuaucauauaauaauuuguu

SEQ ID NO: 216376 - RNA, 32 nt, Human
guuuaucauccauuuaaacaugagugggaggg

SEQ ID NO: 216377 - RNA, 32 nt, Human
guuuaucaugccacuuccuucuuaccugugcc

SEQ ID NO: 216378 - RNA, 32 nt, Human
guuuauccaaucucaaaacaucuacauaaagg

SEQ ID NO: 216379 - RNA, 32 nt, Human
guuuauccacagacguuaagugcucuuugcuu

SEQ ID NO: 216380 - RNA, 32 nt, Human
guuuauccauuuccucaacugugugcacuccu

SEQ ID NO: 216381 - RNA, 32 nt, Human
guuuauccggguacuaaaugcauuucaacuug

SEQ ID NO: 216382 - RNA, 32 nt, Human
guuuauccucauuccuuuugaccaacuuagca

SEQ ID NO: 216383 - RNA, 32 nt, Human
guuuauccugacaguaaccucuccccaggucg

SEQ ID NO: 216384 - RNA, 32 nt, Human
guuuaucggccguggaauucacucagaaagga

SEQ ID NO: 216385 - RNA, 32 nt, Human
guuuaucugcccccagcauuccggggcagaaa

SEQ ID NO: 216386 - RNA, 32 nt, Human
guuuaucugggcagaaccagauuguuaugucc

SEQ ID NO: 216387 - RNA, 32 nt, Human
guuuaucugugccccagcuuccucacuuaguc

SEQ ID NO: 216388 - RNA, 20 nt, Human
guuuaucuuccacccugcug

SEQ ID NO: 216389 - RNA, 32 nt, Human
guuuaucuugcuggauauuuuauaugaacagu

SEQ ID NO: 216390 - RNA, 32 nt, Human
guuuaugaaauguuacauguagaaaaauacug

SEQ ID NO: 216391 - RNA, 32 nt, Human
guuuaugaauccauuccccuguuuucagggac

SEQ ID NO: 216392 - RNA, 31 nt, Human
guuuaugagcauauauugcauuuaaagaaag

SEQ ID NO: 216393 - RNA, 32 nt, Human
guuuaugauaaacgcuuaaauauuucuaaaau

SEQ ID NO: 216394 - RNA, 32 nt, Human
guuuaugcaaauacaaucagcccagugcaaac

SEQ ID NO: 216395 - RNA, 32 nt, Human
guuuaugcagagccugaggccagaaaaccuag

SEQ ID NO: 216396 - RNA, 32 nt, Human
guuuaugcauuuucauggcucuuaauaaacau

SEQ ID NO: 216397 - RNA, 32 nt, Human
guuuaugccaacgugacuucauucauacagau

SEQ ID NO: 216398 - RNA, 32 nt, Human
guuuaugccacaucggucauuuugaaguaggu

SEQ ID NO: 216399 - RNA, 32 nt, Human
guuuaugccauucuccugucucagccucccga

SEQ ID NO: 216400 - RNA, 32 nt, Human
guuuaugccccagaggauguguacagguuccu

SEQ ID NO: 216401 - RNA, 32 nt, Human
guuuaugccuccauugccccaguucuuaucug

SEQ ID NO: 216402 - RNA, 32 nt, Human
guuuaugccuguaaucccagcacugugggagg

SEQ ID NO: 216403 - RNA, 32 nt, Human
guuuaugcucaauccauguucuauuucagugc

SEQ ID NO: 216404 - RNA, 32 nt, Human
guuuauggaaacagcaguauuugaaaauaaau

SEQ ID NO: 216405 - RNA, 32 nt, Human
guuuauggaagauuugugugcuuuuguguuuu

SEQ ID NO: 216406 - RNA, 32 nt, Human
guuuauggacagugcucuagaugugaaaacag

SEQ ID NO: 216407 - RNA, 32 nt, Human
guuuauggcuguaaucugcaaacucugggagg

SEQ ID NO: 216408 - RNA, 32 nt, Human
guuuaugggaagccgcucugcaacuguccuga

SEQ ID NO: 216409 - RNA, 32 nt, Human
guuuaugggaauggagagaggucugggcagga

SEQ ID NO: 216410 - RNA, 32 nt, Human
guuuaugguaauggguacaugggucaggccau

SEQ ID NO: 216411 - RNA, 29 nt, Human
guuuauggucugauuaugccuggaguauu

SEQ ID NO: 216412 - RNA, 32 nt, Human
guuuaugucaucucuucauuauuuagggcugg

SEQ ID NO: 216413 - RNA, 32 nt, Human
guuuaugucauugucuuaacuucagauacaaa

SEQ ID NO: 216414 - RNA, 32 nt, Human
guuuaugucuguucuuugggcugauuugcugu

SEQ ID NO: 216415 - RNA, 32 nt, Human
guuuaugugaacauuccuaucaauccaaauuc

SEQ ID NO: 216416 - RNA, 32 nt, Human
guuuauguuacagugaaggcucuccuuauuaa

SEQ ID NO: 216417 - RNA, 32 nt, Human
guuuauuaucuucuccacgaccucaccuauac

SEQ ID NO: 216418 - RNA, 32 nt, Human
guuuauuauuuugucaaaauguaaacaaagac

SEQ ID NO: 216419 - RNA, 32 nt, Human
guuuauucccaccccucauccccacccccaua

SEQ ID NO: 216420 - RNA, 32 nt, Human
guuuauucuaacucuuuugcccuucucuucug

SEQ ID NO: 216421 - RNA, 32 nt, Human
guuuauucucacuggagcuuaguuccaaugca

SEQ ID NO: 216422 - RNA, 32 nt, Human
guuuauucucagaagaaaaagauauguaaggu

SEQ ID NO: 216423 - RNA, 32 nt, Human
guuuauuguacagaugucggugcagaucucuu

SEQ ID NO: 216424 - RNA, 32 nt, Human
guuuauuuaaacgcuuaacaucuuccaccgca

SEQ ID NO: 216425 - RNA, 32 nt, Human
guuuauuucaguucacauguaagguauugcaa

SEQ ID NO: 216426 - RNA, 32 nt, Human
guuuauuuccauaccugacucuggguguggug

SEQ ID NO: 216427 - RNA, 32 nt, Human
guuuauuucuaagguauaacgucuuugaugcu

SEQ ID NO: 216428 - RNA, 32 nt, Human
guuuauuucuaaguucacgauacuuguucccc

SEQ ID NO: 216429 - RNA, 32 nt, Human
guuuauuucucuauucccuccuucucauaacu

SEQ ID NO: 216430 - RNA, 20 nt, Human
guuuauuucuguuuauggug

SEQ ID NO: 216431 - RNA, 32 nt, Human
guuuauuuggagaaggaauuguggagaguuug

SEQ ID NO: 216432 - RNA, 32 nt, Human
guuuauuuguccauaggucugccuguagaucu

SEQ ID NO: 216433 - RNA, 32 nt, Human
guuuauuuuccucugccauccuugcuaaguag

SEQ ID NO: 216434 - RNA, 32 nt, Human
guuuauuuucugggaggucucuccuuugugug

SEQ ID NO: 216435 - RNA, 32 nt, Human
guuuauuuuucaaagaagacagcaggucccug

SEQ ID NO: 216436 - RNA, 32 nt, Human
guuuauuuuucccauucccuuccuuuaucugc

SEQ ID NO: 216437 - RNA, 32 nt, Human
guuuauuuuuguuccuuugucuucuggcuuuu

SEQ ID NO: 216438 - RNA, 32 nt, Human
guuucaaacuccuggccucaagcaauccuccu

SEQ ID NO: 216439 - RNA, 32 nt, Human
guuucaaagaagcagcgaucggagauggaugu

SEQ ID NO: 216440 - RNA, 32 nt, Human
guuucaacacacacagacaaacacagccacac

SEQ ID NO: 216441 - RNA, 32 nt, Human
guuucaaccucccagauuccagucauccuccu

SEQ ID NO: 216442 - RNA, 32 nt, Human
guuucaacucuugcuugaaucaagaacagaag

SEQ ID NO: 216443 - RNA, 32 nt, Human
guuucaacuuaagggaucuccaugcggucccu

SEQ ID NO: 216444 - RNA, 32 nt, Human
guuucaagaauggcucucccuaucauuguaaa

SEQ ID NO: 216445 - RNA, 32 nt, Human
guuucaagagguggaguuggguuaacaggaag

SEQ ID NO: 216446 - RNA, 32 nt, Human
guuucaagcaagaaggaugagaauuuuagauc

SEQ ID NO: 216447 - RNA, 32 nt, Human
guuucaagcccagcccccagccuuucuuacca

SEQ ID NO: 216448 - RNA, 22 nt, Human
guuucaagcgauucuccugccu

SEQ ID NO: 216449 - RNA, 32 nt, Human
guuucaaggccuaaaaggaaagagugagaucu

SEQ ID NO: 216450 - RNA, 32 nt, Human
guuucaaggccugggaguaaucuucagcucac

SEQ ID NO: 216451 - RNA, 32 nt, Human
guuucaagucagccuggaauucuuacuuucac

SEQ ID NO: 216452 - RNA, 28 nt, Human
guuucaaguguaccaucuucuuuggcaa

SEQ ID NO: 216453 - RNA, 32 nt, Human
guuucaaguucacaccugcagauucuaggacc

SEQ ID NO: 216454 - RNA, 32 nt, Human
guuucaaguugaguuuuugaugugaucccacc

SEQ ID NO: 216455 - RNA, 32 nt, Human
guuucaaucugcaaaauggggauggggaaggu

SEQ ID NO: 216456 - RNA, 32 nt, Human
guuucaaucugccaggaacuccugggccucau

SEQ ID NO: 216457 - RNA, 32 nt, Human
guuucacacauacauaguaccaugauuuucuu

SEQ ID NO: 216458 - RNA, 32 nt, Human
guuucacacuauuccuauaccuccagguccgg

SEQ ID NO: 216459 - RNA, 31 nt, Human
guuucacaggccuuccuacauuuagaaaucg

SEQ ID NO: 216460 - RNA, 32 nt, Human
guuucaccaguguuggccaggcuggucucgaa

SEQ ID NO: 216461 - RNA, 32 nt, Human
guuucaccauauuggccagucuggucucgaac

SEQ ID NO: 216462 - RNA, 32 nt, Human
guuucaccauguaacacacaauacaugcaugc

SEQ ID NO: 216463 - RNA, 32 nt, Human
guuucaccauguuggccagggcuggucucgaa

SEQ ID NO: 216464 - RNA, 32 nt, Human
guuucaccauuuucucugguuugacuugcuga

SEQ ID NO: 216465 - RNA, 32 nt, Human
guuucacccacacugccagccuggguuggggc

SEQ ID NO: 216466 - RNA, 32 nt, Human
guuucacccuguuucccagguuggaguauagu

SEQ ID NO: 216467 - RNA, 32 nt, Human
guuucacccuuuuuaaucucucagccacaaac

SEQ ID NO: 216468 - RNA, 32 nt, Human
guuucaccguaaccucugccuccugacuucaa

SEQ ID NO: 216469 - RNA, 32 nt, Human
guuucaccuccaccaugguccccaagaugauu

SEQ ID NO: 216470 - RNA, 32 nt, Human
guuucaccuccaccauuguccccaagaugauu

SEQ ID NO: 216471 - RNA, 32 nt, Human
guuucaccugcagcuuucagucugcuuugucu

SEQ ID NO: 216472 - RNA, 32 nt, Human
guuucaccuugauuuuggcccgguucuuucag

SEQ ID NO: 216473 - RNA, 32 nt, Human
guuucacuagaugagcuggaauuuguauuuug

SEQ ID NO: 216474 - RNA, 31 nt, Human
guuucacuaguaggaaauaccaaaagcuucg

SEQ ID NO: 216475 - RNA, 32 nt, Human
guuucacucugucacccaggcugggaauugca

SEQ ID NO: 216476 - RNA, 32 nt, Human
guuucacucuugucucccagacuggagugcaa

SEQ ID NO: 216477 - RNA, 32 nt, Human
guuucacuuauuuaucccaaaauauuuauuau

SEQ ID NO: 216478 - RNA, 32 nt, Human
guuucacuucagucuuccccaucccagguuuu

SEQ ID NO: 216479 - RNA, 24 nt, Human
guuucacuugcucuuugacuguca

SEQ ID NO: 216480 - RNA, 32 nt, Human
guuucacuuuccucuuugguaagaugaauaug

SEQ ID NO: 216481 - RNA, 32 nt, Human
guuucagaacagcugucugcagggaacgccac

SEQ ID NO: 216482 - RNA, 25 nt, Human
guuucagaagugucaggguggagug

SEQ ID NO: 216483 - RNA, 32 nt, Human
guuucagaccaauauggugaaaccccaucucu

SEQ ID NO: 216484 - RNA, 32 nt, Human
guuucagaccagccugggcaacaugacaaaac

SEQ ID NO: 216485 - RNA, 32 nt, Human
guuucagagaggaggaagggaaagagauguga

SEQ ID NO: 216486 - RNA, 32 nt, Human
guuucagagauggacagagaacuuuauuuugg

SEQ ID NO: 216487 - RNA, 32 nt, Human
guuucagaucaucuugcucacagggaaccaaa

SEQ ID NO: 216488 - RNA, 32 nt, Human
guuucagaugggcaguguuauggcuacgugau

SEQ ID NO: 216489 - RNA, 32 nt, Human
guuucagauucagguggacaaaggacaaguga

SEQ ID NO: 216490 - RNA, 32 nt, Human
guuucagcaggaagcuaugccucccagucugu

SEQ ID NO: 216491 - RNA, 32 nt, Human
guuucagcaugaacaugggcuucuugcugucu

SEQ ID NO: 216492 - RNA, 32 nt, Human
guuucagccugggaggucaaggcugcagugag

SEQ ID NO: 216493 - RNA, 32 nt, Human
guuucagcgagcggggauuuccugcgaggccg

SEQ ID NO: 216494 - RNA, 32 nt, Human
guuucagcucacugcaaccuccgccucccagg

SEQ ID NO: 216495 - RNA, 32 nt, Human
guuucagcuccagggaaauggagguauugaug

SEQ ID NO: 216496 - RNA, 32 nt, Human
guuucagcuggacuucguuuuuacuuaaucuu

SEQ ID NO: 216497 - RNA, 32 nt, Human
guuucaggaggacagugggggugguguagaac

SEQ ID NO: 216498 - RNA, 32 nt, Human
guuucaggauguuccccacugagcuggaggaa

SEQ ID NO: 216499 - RNA, 32 nt, Human
guuucaggauuguaggaguggaagaggggaaa

SEQ ID NO: 216500 - RNA, 31 nt, Human
guuucaggcuuaaacaucacagcagauaaug

SEQ ID NO: 216501 - RNA, 32 nt, Human
guuucagguggagcagaucggagagaauaaau

SEQ ID NO: 216502 - RNA, 21 nt, Human
guuucagguugaagggaaaug

SEQ ID NO: 216503 - RNA, 32 nt, Human
guuucagguuucaauccucccaauaccacaag

SEQ ID NO: 216504 - RNA, 32 nt, Human
guuucaguccuccccagacagcagcccuucuu

SEQ ID NO: 216505 - RNA, 32 nt, Human
guuucagucugaguucucugcacuuugaggau

SEQ ID NO: 216506 - RNA, 32 nt, Human
guuucagugcuuugggacagauuuuauauuau

SEQ ID NO: 216507 - RNA, 32 nt, Human
guuucaguguacuggaaacuuuccauuuuauu

SEQ ID NO: 216508 - RNA, 32 nt, Human
guuucaguugucuugaauuucuuucaguggcc

SEQ ID NO: 216509 - RNA, 32 nt, Human
guuucauacagcuagcauuagaugggugaugu

SEQ ID NO: 216510 - RNA, 32 nt, Human
guuucaucagcucuuguuagcaaccagaacuc

SEQ ID NO: 216511 - RNA, 32 nt, Human
guuucaucccaccuuucucaguauaauccaug

SEQ ID NO: 216512 - RNA, 32 nt, Human
guuucaucgcucuugcauuuuaauggucuuga

SEQ ID NO: 216513 - RNA, 32 nt, Human
guuucaucuccaggaaauuccuagacuuauuu

SEQ ID NO: 216514 - RNA, 32 nt, Human
guuucaucuuuuuccccucugagagcaagaag

SEQ ID NO: 216515 - RNA, 32 nt, Human
guuucaugcucagugaggaugauggucaccgu

SEQ ID NO: 216516 - RNA, 32 nt, Human
guuucaugcugugucauucacacucacuacuu

SEQ ID NO: 216517 - RNA, 32 nt, Human
guuucaugucaccugcuacagcucucccccag

SEQ ID NO: 216518 - RNA, 32 nt, Human
guuucauugucacccaggcuggaguacagugg

SEQ ID NO: 216519 - RNA, 32 nt, Human
guuucauuucaucagaugaucugcacagaacu

SEQ ID NO: 216520 - RNA, 24 nt, Human
guuucauuugcagucgacuguaca

SEQ ID NO: 216521 - RNA, 25 nt, Human
guuucauuuuccuuccugguuugug

SEQ ID NO: 216522 - RNA, 32 nt, Human
guuucauuuuguuuaauuuucugggguguuuu

SEQ ID NO: 216523 - RNA, 32 nt, Human
guuucauuuuguuuuugagauagggucuuugu

SEQ ID NO: 216524 - RNA, 32 nt, Human
guuuccaaaaccagaagacaucguaugcuugg

SEQ ID NO: 216525 - RNA, 32 nt, Human
guuuccaaauuuggcugcacauucauaccaau

SEQ ID NO: 216526 - RNA, 32 nt, Human
guuuccaacaccccugugcuccaggcuggguu

SEQ ID NO: 216527 - RNA, 32 nt, Human
guuuccaaguccucuucuaggaccaggcuccu

SEQ ID NO: 216528 - RNA, 32 nt, Human
guuuccaagugaaagguagggaaagugggaga

SEQ ID NO: 216529 - RNA, 32 nt, Human
guuuccacagaagacauguggagcaguugugg

SEQ ID NO: 216530 - RNA, 32 nt, Human
guuuccacagcccggccccaggcccaggucau

SEQ ID NO: 216531 - RNA, 32 nt, Human
guuuccaccccagcugccucucuuguccugag

SEQ ID NO: 216532 - RNA, 32 nt, Human
guuuccaccuccucccccuccuucagccagcc

SEQ ID NO: 216533 - RNA, 32 nt, Human
guuuccaccuuauuuuccugcccccguuuuaa

SEQ ID NO: 216534 - RNA, 32 nt, Human
guuuccacugaggacauucagccugggaagga

SEQ ID NO: 216535 - RNA, 32 nt, Human
guuuccacuuaucuuggauguuuuagauugaa

SEQ ID NO: 216536 - RNA, 32 nt, Human
guuuccagaaaggguuugacuggaggaaccuc

SEQ ID NO: 216537 - RNA, 32 nt, Human
guuuccagaaaucccuguuguaacaucaagug

SEQ ID NO: 216538 - RNA, 32 nt, Human
guuuccagagacaaccucacagucuugaaacg

SEQ ID NO: 216539 - RNA, 32 nt, Human
guuuccagagagagucaugcuggaggagaagg

SEQ ID NO: 216540 - RNA, 32 nt, Human
guuuccagagaguggagagagcagggcuaaau

SEQ ID NO: 216541 - RNA, 32 nt, Human
guuuccagaugcuaucacagacucugcuagug

SEQ ID NO: 216542 - RNA, 32 nt, Human
guuuccagaugguaacaugggagagggcauau

SEQ ID NO: 216543 - RNA, 32 nt, Human
guuuccagccaagaauugccacugcaccugag

SEQ ID NO: 216544 - RNA, 32 nt, Human
guuuccagcccggcugccccaggaugggugag

SEQ ID NO: 216545 - RNA, 32 nt, Human
guuuccagccuacagacuuucggggguuccug

SEQ ID NO: 216546 - RNA, 32 nt, Human
guuuccagccuccagugggcucucccuggggc

SEQ ID NO: 216547 - RNA, 32 nt, Human
guuuccagcgugaggaggaggcugagggcgga

SEQ ID NO: 216548 - RNA, 32 nt, Human
guuuccagcuacuugggaggcggaagcaggag

SEQ ID NO: 216549 - RNA, 32 nt, Human
guuuccagcuuugagcaauacucugcuuucac

SEQ ID NO: 216550 - RNA, 32 nt, Human
guuuccaggaggggcuaccuguugacugucuu

SEQ ID NO: 216551 - RNA, 32 nt, Human
guuuccaggcagagagaagcagcucugggcug

SEQ ID NO: 216552 - RNA, 32 nt, Human
guuuccaggcuccccuccugcaccacagcgga

SEQ ID NO: 216553 - RNA, 32 nt, Human
guuuccagucgggggaacugaggcagagcaag

SEQ ID NO: 216554 - RNA, 32 nt, Human
guuuccagucuguggugaugcugucugucugu

SEQ ID NO: 216555 - RNA, 32 nt, Human
guuuccagugcccaaagguacaugcuuuccga

SEQ ID NO: 216556 - RNA, 32 nt, Human
guuuccauaagaagcuugcaaugacaauaaag

SEQ ID NO: 216557 - RNA, 32 nt, Human
guuuccauacccuuucuuugucuuucuugcuu

SEQ ID NO: 216558 - RNA, 32 nt, Human
guuuccauacccuuucuuuuucuugcuuuuug

SEQ ID NO: 216559 - RNA, 32 nt, Human
guuuccauauuaaaauccucacucuuuaauug

SEQ ID NO: 216560 - RNA, 32 nt, Human
guuuccaucaguaucacuaauggaccaguauu

SEQ ID NO: 216561 - RNA, 32 nt, Human
guuuccauccuuugcauuucucugcgaguagu

SEQ ID NO: 216562 - RNA, 32 nt, Human
guuuccaucuuuugggcuguucuuguguauuu

SEQ ID NO: 216563 - RNA, 32 nt, Human
guuuccaugcacaggccagcaccucaguuaug

SEQ ID NO: 216564 - RNA, 31 nt, Human
guuuccaugccuuuaguagaagagaggcauc

SEQ ID NO: 216565 - RNA, 32 nt, Human
guuuccauggaaaugauccuuguuaaauucag

SEQ ID NO: 216566 - RNA, 32 nt, Human
guuuccauguccaucucaacagucuggccuuc

SEQ ID NO: 216567 - RNA, 32 nt, Human
guuuccauuaugcaacuugucuauguaaauaa

SEQ ID NO: 216568 - RNA, 32 nt, Human
guuuccauucucugcccagcagucucuuaccu

SEQ ID NO: 216569 - RNA, 32 nt, Human
guuucccaaaggacaagcuaauuggaauuauc

SEQ ID NO: 216570 - RNA, 32 nt, Human
guuucccacaauauaaaacuguacuucacugu

SEQ ID NO: 216571 - RNA, 32 nt, Human
guuucccacagcaacacagagacugauucaaa

SEQ ID NO: 216572 - RNA, 32 nt, Human
guuucccaccugcugcuacacucaugucugag

SEQ ID NO: 216573 - RNA, 32 nt, Human
guuucccagaagugccugguucuggguacuug

SEQ ID NO: 216574 - RNA, 32 nt, Human
guuucccagacuccggagcugcccgggacagg

SEQ ID NO: 216575 - RNA, 24 nt, Human
guuucccaggcugaagugcagugg

SEQ ID NO: 216576 - RNA, 23 nt, Human
guuucccaggcuggagugcaaug

SEQ ID NO: 216577 - RNA, 24 nt, Human
guuucccaggcuggagugcaaugg

SEQ ID NO: 216578 - RNA, 24 nt, Human
guuucccaggcuggagugcagugg

SEQ ID NO: 216579 - RNA, 23 nt, Human
guuucccaggcuggaguguagug

SEQ ID NO: 216580 - RNA, 32 nt, Human
guuucccagguggguggggguggccuucagug

SEQ ID NO: 216581 - RNA, 32 nt, Human
guuucccauucuauguugaucccauucuugaa

SEQ ID NO: 216582 - RNA, 32 nt, Human
guuucccauuuuaaaaucuaaacuagacaucu

SEQ ID NO: 216583 - RNA, 22 nt, Human
guuuccccaaagccccagggca

SEQ ID NO: 216584 - RNA, 32 nt, Human
guuuccccaagaaaccuggaagugaagugacc

SEQ ID NO: 216585 - RNA, 32 nt, Human
guuuccccacagaacauugucuuucugguguc

SEQ ID NO: 216586 - RNA, 32 nt, Human
guuuccccaccaggaaaugagauaggaggacu

SEQ ID NO: 216587 - RNA, 32 nt, Human
guuuccccauuucugucagagccaagggcuug

SEQ ID NO: 216588 - RNA, 32 nt, Human
guuucccccauaccacugugguaguggguaag

SEQ ID NO: 216589 - RNA, 32 nt, Human
guuucccccuugugugguuuccgccugcgaca

SEQ ID NO: 216590 - RNA, 32 nt, Human
guuuccccucaugaucuggccucugcccccuu

SEQ ID NO: 216591 - RNA, 32 nt, Human
guuuccccucauugcucccugggcuaagacag

SEQ ID NO: 216592 - RNA, 32 nt, Human
guuuccccuccucuccccugugacuucacaag

SEQ ID NO: 216593 - RNA, 32 nt, Human
guuuccccucucagcaucgcuuuugcugggcc

SEQ ID NO: 216594 - RNA, 32 nt, Human
guuuccccugccacuccagcccccuugagcug

SEQ ID NO: 216595 - RNA, 32 nt, Human
guuuccccugcucuucucucuugccugccacc

SEQ ID NO: 216596 - RNA, 32 nt, Human
guuucccgccuccuagggaagggaagggagac

SEQ ID NO: 216597 - RNA, 32 nt, Human
guuucccuacagaaaagaaauuggacagaaca

SEQ ID NO: 216598 - RNA, 32 nt, Human
guuucccucugguucuuccuggcuuugcaccu

SEQ ID NO: 216599 - RNA, 32 nt, Human
guuucccugagcgacucuguucuguguggggc

SEQ ID NO: 216600 - RNA, 32 nt, Human
guuucccugcagucucccacacggacaccuuc

SEQ ID NO: 216601 - RNA, 32 nt, Human
guuucccugccugucacugcucgggcagaggc

SEQ ID NO: 216602 - RNA, 32 nt, Human
guuucccugcuguuggcuuucuguuuugguua

SEQ ID NO: 216603 - RNA, 32 nt, Human
guuucccuguaacccagagcugaugggugaua

SEQ ID NO: 216604 - RNA, 32 nt, Human
guuucccuuccccuugaaccagucccaguguc

SEQ ID NO: 216605 - RNA, 32 nt, Human
guuuccgagugagacaaagcaauuacuggaag

SEQ ID NO: 216606 - RNA, 28 nt, Human
guuuccgccauggaugccucaucaccaa

SEQ ID NO: 216607 - RNA, 32 nt, Human
guuuccgcccagagcuggagucucccagcugc

SEQ ID NO: 216608 - RNA, 32 nt, Human
guuuccgggcggcucccuucccuugcaugcug

SEQ ID NO: 216609 - RNA, 32 nt, Human
guuuccgggcguuuggugagucucuagauuuu

SEQ ID NO: 216610 - RNA, 32 nt, Human
guuuccgggugaggaagcagcuaggggcgggu

SEQ ID NO: 216611 - RNA, 23 nt, Human
guuuccgguggggugggcggggc

SEQ ID NO: 216612 - RNA, 32 nt, Human
guuuccgugggcaagucguguguacuccucgc

SEQ ID NO: 216613 - RNA, 32 nt, Human
guuuccguuccucugcccgccaugccguuccu

SEQ ID NO: 216614 - RNA, 32 nt, Human
guuuccuaagugagagagagccuggcugaagc

SEQ ID NO: 216615 - RNA, 32 nt, Human
guuuccuacagcuguaagauagcugcuacuca

SEQ ID NO: 216616 - RNA, 32 nt, Human
guuuccuaggagacagacuuugauagugauuu

SEQ ID NO: 216617 - RNA, 32 nt, Human
guuuccuaucuaguuuguaaauaaucauggug

SEQ ID NO: 216618 - RNA, 32 nt, Human
guuuccuauuaaaauacagacauuucuacccu

SEQ ID NO: 216619 - RNA, 32 nt, Human
guuuccucaccacuuuucccuuaauucuaagu

SEQ ID NO: 216620 - RNA, 19 nt, Human
guuuccucacuucagggug

SEQ ID NO: 216621 - RNA, 32 nt, Human
guuuccucagcuugaaaugggcuuggcauaca

SEQ ID NO: 216622 - RNA, 32 nt, Human
guuuccucaggagcugucugggguguugaugg

SEQ ID NO: 216623 - RNA, 28 nt, Human
guuuccucaucugcugccucuccagacu

SEQ ID NO: 216624 - RNA, 32 nt, Human
guuuccucauuucaucagaccuaguguucuca

SEQ ID NO: 216625 - RNA, 32 nt, Human
guuuccuccaaggcccucugaagugcagccca

SEQ ID NO: 216626 - RNA, 32 nt, Human
guuuccuccacuucucagguuugguauuuagu

SEQ ID NO: 216627 - RNA, 32 nt, Human
guuuccucuagggugauauucgucauuacucu

SEQ ID NO: 216628 - RNA, 32 nt, Human
guuuccucucaacuaucgggggagaaacuccc

SEQ ID NO: 216629 - RNA, 32 nt, Human
guuuccucucacucugaauuauucuuccucuc

SEQ ID NO: 216630 - RNA, 32 nt, Human
guuuccucuccggugcaauccccuguccuuuc

SEQ ID NO: 216631 - RNA, 32 nt, Human
guuuccucuccuccaccaugguugacagcacu

SEQ ID NO: 216632 - RNA, 32 nt, Human
guuuccucugcccccuccuuuucccacugguu

SEQ ID NO: 216633 - RNA, 32 nt, Human
guuuccucugggcuccaaucuccagucccugg

SEQ ID NO: 216634 - RNA, 32 nt, Human
guuuccucuuuccuuucccucuugucagguca

SEQ ID NO: 216635 - RNA, 32 nt, Human
guuuccugacaguggggagauggcauguuacu

SEQ ID NO: 216636 - RNA, 32 nt, Human
guuuccugagcagguacuuagcuuauagagcu

SEQ ID NO: 216637 - RNA, 32 nt, Human
guuuccugagccacgcccagugugugaacuug

SEQ ID NO: 216638 - RNA, 32 nt, Human
guuuccugcccuggcccuggcccugcgaucuc

SEQ ID NO: 216639 - RNA, 32 nt, Human
guuuccugcgagccagccugagcgcaacacuu

SEQ ID NO: 216640 - RNA, 32 nt, Human
guuuccugcgcuuucuccuuuuccugugaaau

SEQ ID NO: 216641 - RNA, 32 nt, Human
guuuccuggcaaggcaggcucucacaugccug

SEQ ID NO: 216642 - RNA, 32 nt, Human
guuuccuggccacuuuuguugauagcagaugg

SEQ ID NO: 216643 - RNA, 32 nt, Human
guuuccugggcugucacguacacuccugcugc

SEQ ID NO: 216644 - RNA, 32 nt, Human
guuuccuggggacccaggcuugcaaagugacg

SEQ ID NO: 216645 - RNA, 32 nt, Human
guuuccugggucaggaacagagccaacaggau

SEQ ID NO: 216646 - RNA, 32 nt, Human
guuuccuggugucucuuuagcaagugaaguuu

SEQ ID NO: 216647 - RNA, 32 nt, Human
guuuccugguuuguaaggcagccccagcguuc

SEQ ID NO: 216648 - RNA, 32 nt, Human
guuuccuguaguucucccucuucccacaaagc

SEQ ID NO: 216649 - RNA, 32 nt, Human
guuuccuguggaaccuggaggcuccugaugcc

SEQ ID NO: 216650 - RNA, 32 nt, Human
guuuccuguggccaggcacagagccaggugcu

SEQ ID NO: 216651 - RNA, 32 nt, Human
guuuccuguggcuggugaugcugugguuaagu

SEQ ID NO: 216652 - RNA, 32 nt, Human
guuuccuguucauccgugucccugcaaaggac

SEQ ID NO: 216653 - RNA, 32 nt, Human
guuuccuuauaccagauccucagucucacuaa

SEQ ID NO: 216654 - RNA, 32 nt, Human
guuuccuucacaggaauccuuuguccagguag

SEQ ID NO: 216655 - RNA, 32 nt, Human
guuuccuucccgcagugucugcguccgcacag

SEQ ID NO: 216656 - RNA, 32 nt, Human
guuuccuucccucuuuccuuccuuccuccugg

SEQ ID NO: 216657 - RNA, 32 nt, Human
guuuccuuccuuccuuccuuccuuccuuccuu

SEQ ID NO: 216658 - RNA, 32 nt, Human
guuuccuucucccuuucuuggcccuccucugc

SEQ ID NO: 216659 - RNA, 32 nt, Human
guuuccuucuuugcuuucaucccuguugcacu

SEQ ID NO: 216660 - RNA, 32 nt, Human
guuuccuugaaggaaacuacagaaaaggaaag

SEQ ID NO: 216661 - RNA, 32 nt, Human
guuuccuugcugaaaaugaaacccuaucuuuc

SEQ ID NO: 216662 - RNA, 32 nt, Human
guuuccuuggggaccccugaacaaggagguug

SEQ ID NO: 216663 - RNA, 32 nt, Human
guuuccuuguccugaagguuugaauggaguug

SEQ ID NO: 216664 - RNA, 32 nt, Human
guuuccuuuacuucccugcuuccugggaauca

SEQ ID NO: 216665 - RNA, 32 nt, Human
guuuccuuucagggauguggacaggguaaggg

SEQ ID NO: 216666 - RNA, 32 nt, Human
guuuccuuugcuguggugggagauaguuugac

SEQ ID NO: 216667 - RNA, 32 nt, Human
guuuccuuuuccucucccaacccucugguugg

SEQ ID NO: 216668 - RNA, 32 nt, Human
guuucgaacucugggguucaagcaaucugccc

SEQ ID NO: 216669 - RNA, 32 nt, Human
guuucgagagagaagggagcaagacaagagca

SEQ ID NO: 216670 - RNA, 32 nt, Human
guuucgccacugcacaccagccugggugacag

SEQ ID NO: 216671 - RNA, 18 nt, Human
guuucgccauguugguca

SEQ ID NO: 216672 - RNA, 32 nt, Human
guuucgccccagccacccccacugccugggcc

SEQ ID NO: 216673 - RNA, 32 nt, Human
guuucgcgcuggccggggcucugggugcugcc

SEQ ID NO: 216674 - RNA, 32 nt, Human
guuucggaaagagggaaaagaguccccgagcc

SEQ ID NO: 216675 - RNA, 32 nt, Human
guuucggaccagccuggccaacguggugaaac

SEQ ID NO: 216676 - RNA, 32 nt, Human
guuucggcaggcgggugaggucgcugagggcc

SEQ ID NO: 216677 - RNA, 32 nt, Human
guuucggguggcgggauggggagcagcuuggu

SEQ ID NO: 216678 - RNA, 32 nt, Human
guuucgucucccacauacagaagcagggugga

SEQ ID NO: 216679 - RNA, 32 nt, Human
guuucgugcugucauuuauuaggcugggccac

SEQ ID NO: 216680 - RNA, 32 nt, Human
guuucguugucuagagccccuucuccaauugu

SEQ ID NO: 216681 - RNA, 32 nt, Human
guuucguuuccucugcugucuucuccagagcu

SEQ ID NO: 216682 - RNA, 32 nt, Human
guuucguuugguaguucaucugccuuuuaacc

SEQ ID NO: 216683 - RNA, 22 nt, Human
guuucuacuaaaaauacaaaau

SEQ ID NO: 216684 - RNA, 32 nt, Human
guuucuacuaaaauauacaaaaauuagccagg

SEQ ID NO: 216685 - RNA, 32 nt, Human
guuucuacuuuugcauucuuccucguuuucuc

SEQ ID NO: 216686 - RNA, 32 nt, Human
guuucuagaagccacuccagccacuccuuccu

SEQ ID NO: 216687 - RNA, 32 nt, Human
guuucuagccccagguuccugguuguguccgg

SEQ ID NO: 216688 - RNA, 32 nt, Human
guuucuaggguaagggaccugcagguguaagc

SEQ ID NO: 216689 - RNA, 32 nt, Human
guuucuaugagcagcugcuguaacauacucau

SEQ ID NO: 216690 - RNA, 32 nt, Human
guuucucaacagaugguuucaguggcucagga

SEQ ID NO: 216691 - RNA, 22 nt, Human
guuucucaaccucauuugcuca

SEQ ID NO: 216692 - RNA, 32 nt, Human
guuucucaagaaccuguaaucuugccuuaauc

SEQ ID NO: 216693 - RNA, 32 nt, Human
guuucucacaggagaauagcuaugagucaaau

SEQ ID NO: 216694 - RNA, 32 nt, Human
guuucucagccccuuaggacgcgggucuccuu

SEQ ID NO: 216695 - RNA, 32 nt, Human
guuucucagcggccuagaugccucuuggucug

SEQ ID NO: 216696 - RNA, 32 nt, Human
guuucucagggcccugggcgcccgcccaagac

SEQ ID NO: 216697 - RNA, 32 nt, Human
guuucucagggugggaaaugugggggcuuugc

SEQ ID NO: 216698 - RNA, 32 nt, Human
guuucucagggugguccuaugggaaugaguau

SEQ ID NO: 216699 - RNA, 32 nt, Human
guuucucagucuuugcacuaugacauuuuuag

SEQ ID NO: 216700 - RNA, 32 nt, Human
guuucucaguuuccucauccauccaacaauca

SEQ ID NO: 216701 - RNA, 32 nt, Human
guuucucauccaggaagguaaccuugggcauu

SEQ ID NO: 216702 - RNA, 32 nt, Human
guuucucaucuucucucuacggccucugaguu

SEQ ID NO: 216703 - RNA, 32 nt, Human
guuucucaucuucucucuacugccucugaguu

SEQ ID NO: 216704 - RNA, 32 nt, Human
guuucucauuuuucuuuucuuuuuacauaugu

SEQ ID NO: 216705 - RNA, 32 nt, Human
guuucuccacagccuucuccagccugugugau

SEQ ID NO: 216706 - RNA, 32 nt, Human
guuucuccacaguccucuucugggcaaauucu

SEQ ID NO: 216707 - RNA, 32 nt, Human
guuucuccagaacacaggaggaaaagugaacc

SEQ ID NO: 216708 - RNA, 32 nt, Human
guuucuccaguucugccugcccuggcagaauc

SEQ ID NO: 216709 - RNA, 32 nt, Human
guuucucccacauauucacauacgugucugug

SEQ ID NO: 216710 - RNA, 32 nt, Human
guuucucccauagaaagagccgggacacgcag

SEQ ID NO: 216711 - RNA, 32 nt, Human
guuucuccccuccgacuggggcucccugagga

SEQ ID NO: 216712 - RNA, 21 nt, Human
guuucucccucccaggcuagg

SEQ ID NO: 216713 - RNA, 19 nt, Human
guuucucccugauggcuag

SEQ ID NO: 216714 - RNA, 32 nt, Human
guuucucccuugccagguccuugggaugguug

SEQ ID NO: 216715 - RNA, 32 nt, Human
guuucuccgggaacuggugggagacacaggau

SEQ ID NO: 216716 - RNA, 32 nt, Human
guuucuccuccaccucucaaugcaaacacuau

SEQ ID NO: 216717 - RNA, 32 nt, Human
guuucuccucuuggcccuccccuacagaccau

SEQ ID NO: 216718 - RNA, 32 nt, Human
guuucuccuggcugaggaagggaagggaacau

SEQ ID NO: 216719 - RNA, 32 nt, Human
guuucuccuguugcacaaaaaugaugucuaac

SEQ ID NO: 216720 - RNA, 22 nt, Human
guuucuccuuuauaaaggcagg

SEQ ID NO: 216721 - RNA, 32 nt, Human
guuucucgagggcgggagcugcgcagcgcucc

SEQ ID NO: 216722 - RNA, 32 nt, Human
guuucucgcacagcagaguucuuggaagagcc

SEQ ID NO: 216723 - RNA, 32 nt, Human
guuucucggcaccagugccucagugcugcaau

SEQ ID NO: 216724 - RNA, 32 nt, Human
guuucucuacauccucuccagcaccuguuguu

SEQ ID NO: 216725 - RNA, 32 nt, Human
guuucucuccacccaaaauaucacagcugcuu

SEQ ID NO: 216726 - RNA, 28 nt, Human
guuucucuccacucugccucaucucugu

SEQ ID NO: 216727 - RNA, 32 nt, Human
guuucucuccauauuugcccagaagaggcagu

SEQ ID NO: 216728 - RNA, 32 nt, Human
guuucucucccggccccacugccuucagguau

SEQ ID NO: 216729 - RNA, 32 nt, Human
guuucucuccuccacuucauauuucauaccca

SEQ ID NO: 216730 - RNA, 32 nt, Human
guuucucuccuuggaccuuggguuuccaacuc

SEQ ID NO: 216731 - RNA, 32 nt, Human
guuucucucucccccuuucucucuucucuugg

SEQ ID NO: 216732 - RNA, 20 nt, Human
guuucucucugcuguaggug

SEQ ID NO: 216733 - RNA, 32 nt, Human
guuucucucuuucagcaccagcucuugccccu

SEQ ID NO: 216734 - RNA, 32 nt, Human
guuucucugaaaaauuuuagagcuagguauag

SEQ ID NO: 216735 - RNA, 32 nt, Human
guuucucugcccaaggaagacagaacauggag

SEQ ID NO: 216736 - RNA, 32 nt, Human
guuucucugcugucaagcacucugugucaccc

SEQ ID NO: 216737 - RNA, 32 nt, Human
guuucucugggcuucaaauggcuggcaaggcu

SEQ ID NO: 216738 - RNA, 32 nt, Human
guuucucuuccggggucucugcucuuaugcau

SEQ ID NO: 216739 - RNA, 32 nt, Human
guuucucuucuggugagauaggguuccugguu

SEQ ID NO: 216740 - RNA, 32 nt, Human
guuucucuugaugaagaagaagaugguggugg

SEQ ID NO: 216741 - RNA, 32 nt, Human
guuucucuuucuuccuccuugauuuuccaucu

SEQ ID NO: 216742 - RNA, 32 nt, Human
guuucugaaauguaagcauuacaugacuauug

SEQ ID NO: 216743 - RNA, 32 nt, Human
guuucugaacauucuccuucauagcacagugg

SEQ ID NO: 216744 - RNA, 32 nt, Human
guuucugaaccauguacauacauguucugaaa

SEQ ID NO: 216745 - RNA, 24 nt, Human
guuucugaacugugggugagaggc

SEQ ID NO: 216746 - RNA, 32 nt, Human
guuucugaacugugggugagaggcagaaaggg

SEQ ID NO: 216747 - RNA, 32 nt, Human
guuucugacuccaaauucugcuaggaaccaga

SEQ ID NO: 216748 - RNA, 32 nt, Human
guuucugaucauauaacugugcuagaagucaa

SEQ ID NO: 216749 - RNA, 32 nt, Human
guuucugaucaucugaaucuuaaucaugucca

SEQ ID NO: 216750 - RNA, 32 nt, Human
guuucugauuauuuucuauguaaaggaacccu

SEQ ID NO: 216751 - RNA, 32 nt, Human
guuucugcaagcuguaucccaagugcacuguc

SEQ ID NO: 216752 - RNA, 32 nt, Human
guuucugcaaugcucacuugcggucacauagu

SEQ ID NO: 216753 - RNA, 32 nt, Human
guuucugcacaguuguaacugcucuuggggau

SEQ ID NO: 216754 - RNA, 32 nt, Human
guuucugccacccuguaacaggccauuaaagc

SEQ ID NO: 216755 - RNA, 32 nt, Human
guuucugccauucugggugacccuguauuucu

SEQ ID NO: 216756 - RNA, 23 nt, Human
guuucugcccacuuggcuauagg

SEQ ID NO: 216757 - RNA, 32 nt, Human
guuucugccgcauuugauguggaggcagugaa

SEQ ID NO: 216758 - RNA, 32 nt, Human
guuucugccggaucagaugagcagauugguua

SEQ ID NO: 216759 - RNA, 32 nt, Human
guuucugccucaggcccugcccugcucuacuc

SEQ ID NO: 216760 - RNA, 32 nt, Human
guuucugcgcuccuagccugggugacagagca

SEQ ID NO: 216761 - RNA, 32 nt, Human
guuucugcgcuuccuucucccucucuccagac

SEQ ID NO: 216762 - RNA, 32 nt, Human
guuucugcuauucccuagcucuucuccagaac

SEQ ID NO: 216763 - RNA, 32 nt, Human
guuucugcucagucugucccccuucccccucg

SEQ ID NO: 216764 - RNA, 32 nt, Human
guuucugcuuaggagguggggacuugggcugg

SEQ ID NO: 216765 - RNA, 32 nt, Human
guuucuggaagagucugugcgcccauggaugg

SEQ ID NO: 216766 - RNA, 32 nt, Human
guuucuggagagaaugggaggauuccagaggg

SEQ ID NO: 216767 - RNA, 32 nt, Human
guuucuggagcaguggacugccacaagccacc

SEQ ID NO: 216768 - RNA, 20 nt, Human
guuucuggagcuacuugcca

SEQ ID NO: 216769 - RNA, 32 nt, Human
guuucuggagugauucuagagggagacuuguu

SEQ ID NO: 216770 - RNA, 32 nt, Human
guuucuggaucugccccacaaaguagguccug

SEQ ID NO: 216771 - RNA, 32 nt, Human
guuucuggccagaggaauuggggucuugccau

SEQ ID NO: 216772 - RNA, 22 nt, Human
guuucugggaggagugaggggc

SEQ ID NO: 216773 - RNA, 22 nt, Human
guuucugggcagugcaggaagu

SEQ ID NO: 216774 - RNA, 21 nt, Human
guuucuggggcugguggaagc

SEQ ID NO: 216775 - RNA, 26 nt, Human
guuucugggguggaaggcagggaggu

SEQ ID NO: 216776 - RNA, 23 nt, Human
guuucuggguccuggagggaggc

SEQ ID NO: 216777 - RNA, 32 nt, Human
guuucugggucuuccucuuccccucuuuacca

SEQ ID NO: 216778 - RNA, 22 nt, Human
guuucugggugccucugccuua

SEQ ID NO: 216779 - RNA, 23 nt, Human
guuucugggugucucuggggagc

SEQ ID NO: 216780 - RNA, 32 nt, Human
guuucugguccccuguuuacauggcccaugag

SEQ ID NO: 216781 - RNA, 32 nt, Human
guuucuggugaaaacauggagaggaggcugga

SEQ ID NO: 216782 - RNA, 32 nt, Human
guuucugucauaaagcaaaggaaauguuacca

SEQ ID NO: 216783 - RNA, 32 nt, Human
guuucuguccccgggagccucagggcucugag

SEQ ID NO: 216784 - RNA, 32 nt, Human
guuucugucccugcaucuccccuagccccguu

SEQ ID NO: 216785 - RNA, 32 nt, Human
guuucugucuuucuccccugggcuccugucuc

SEQ ID NO: 216786 - RNA, 32 nt, Human
guuucugugacccagcagcaucaagccccucg

SEQ ID NO: 216787 - RNA, 32 nt, Human
guuucugugagagugacagagcugugcccguu

SEQ ID NO: 216788 - RNA, 32 nt, Human
guuucugugagcagagcagacagaaaggagau

SEQ ID NO: 216789 - RNA, 32 nt, Human
guuucugugggguuuggcauggguguuuuggu

SEQ ID NO: 216790 - RNA, 32 nt, Human
guuucuguggguacuccucuuaccccagcaaa

SEQ ID NO: 216791 - RNA, 32 nt, Human
guuucuguguggguccccacucccagggaggg

SEQ ID NO: 216792 - RNA, 32 nt, Human
guuucuguuacucugugcaaaauaacuuugag

SEQ ID NO: 216793 - RNA, 21 nt, Human
guuucuguucagcucuuuuca

SEQ ID NO: 216794 - RNA, 21 nt, Human
guuucuguucaguuucccuca

SEQ ID NO: 216795 - RNA, 32 nt, Human
guuucuguuccuugugggaugcugcucuaggg

SEQ ID NO: 216796 - RNA, 32 nt, Human
guuucuguuucaaagcacaauaacuaguaaua

SEQ ID NO: 216797 - RNA, 32 nt, Human
guuucuguuuuauuuaaaguaacugacauuuu

SEQ ID NO: 216798 - RNA, 32 nt, Human
guuucuuaaugaagaugaaaaauauguaauuc

SEQ ID NO: 216799 - RNA, 32 nt, Human
guuucuuagaacaacaacaaauacauggucug

SEQ ID NO: 216800 - RNA, 32 nt, Human
guuucuuauccagggcuucucccagaaagcag

SEQ ID NO: 216801 - RNA, 32 nt, Human
guuucuucaccaucacuccaucaaagucccug

SEQ ID NO: 216802 - RNA, 32 nt, Human
guuucuucaguggcaaauguagcccugcaucc

SEQ ID NO: 216803 - RNA, 32 nt, Human
guuucuucaugucuagauucagaguauggauu

SEQ ID NO: 216804 - RNA, 32 nt, Human
guuucuucauucuuuacugcacucagauuuaa

SEQ ID NO: 216805 - RNA, 32 nt, Human
guuucuucauuuuaaaaaggaaaagguaauuu

SEQ ID NO: 216806 - RNA, 21 nt, Human
guuucuuccacaacagaagua

SEQ ID NO: 216807 - RNA, 32 nt, Human
guuucuuccauguugcccaggcuggucucgaa

SEQ ID NO: 216808 - RNA, 32 nt, Human
guuucuucccacccugucuucuccccuaggug

SEQ ID NO: 216809 - RNA, 32 nt, Human
guuucuucccccauaggguccugucuuuuggg

SEQ ID NO: 216810 - RNA, 32 nt, Human
guuucuuccccuccuccaguucuuuggaaauu

SEQ ID NO: 216811 - RNA, 32 nt, Human
guuucuucccuccuguucucugguuauagcug

SEQ ID NO: 216812 - RNA, 32 nt, Human
guuucuucgcccucccuuuccuucccuucguc

SEQ ID NO: 216813 - RNA, 32 nt, Human
guuucuucuccuccuuucucucccucuuuccc

SEQ ID NO: 216814 - RNA, 32 nt, Human
guuucuucuccucuacagguccucccggcccg

SEQ ID NO: 216815 - RNA, 32 nt, Human
guuucuucuccucuaucucauaaugcauuaug

SEQ ID NO: 216816 - RNA, 32 nt, Human
guuucuucucuccccuccuucccacccuuuuu

SEQ ID NO: 216817 - RNA, 32 nt, Human
guuucuucucucuuugaaaccaaauagcacgc

SEQ ID NO: 216818 - RNA, 32 nt, Human
guuucuucugaaauucucaggcagucagacug

SEQ ID NO: 216819 - RNA, 32 nt, Human
guuucuucugucuucuugucagucccaagugc

SEQ ID NO: 216820 - RNA, 32 nt, Human
guuucuucuuauuuugcauuuaccccaauuuc

SEQ ID NO: 216821 - RNA, 32 nt, Human
guuucuucuuuacacacauauacacacagaca

SEQ ID NO: 216822 - RNA, 32 nt, Human
guuucuugagccaggucuucuguccaugcaug

SEQ ID NO: 216823 - RNA, 24 nt, Human
guuucuugaugugggaggggaggu

SEQ ID NO: 216824 - RNA, 32 nt, Human
guuucuugcauuggacaggcccagucuucucc

SEQ ID NO: 216825 - RNA, 32 nt, Human
guuucuuggauaggggccagugcagugccauc

SEQ ID NO: 216826 - RNA, 32 nt, Human
guuucuuggccucuucagcuaacuuuuaagug

SEQ ID NO: 216827 - RNA, 32 nt, Human
guuucuuggcucugcucagccaugccaggcag

SEQ ID NO: 216828 - RNA, 32 nt, Human
guuucuuguccaccgcuucacuggcaagaguc

SEQ ID NO: 216829 - RNA, 32 nt, Human
guuucuugugcauuccuccucucccuccuucg

SEQ ID NO: 216830 - RNA, 32 nt, Human
guuucuugugguucccugcaggccaguccugu

SEQ ID NO: 216831 - RNA, 32 nt, Human
guuucuuguguggcauuguugcucuuggguau

SEQ ID NO: 216832 - RNA, 32 nt, Human
guuucuuguucagccaaugaggaaagggcauu

SEQ ID NO: 216833 - RNA, 32 nt, Human
guuucuuuaggaugagaggugcaccuggcuag

SEQ ID NO: 216834 - RNA, 32 nt, Human
guuucuuucccuuugaauuucuuuuuacuguc

SEQ ID NO: 216835 - RNA, 32 nt, Human
guuucuuuccuuccuuccuuccuuccuuccuu

SEQ ID NO: 216836 - RNA, 32 nt, Human
guuucuuucuacuuucuccaucaucuucuuuc

SEQ ID NO: 216837 - RNA, 32 nt, Human
guuucuuugcagugagcagugcaguggaaguc

SEQ ID NO: 216838 - RNA, 31 nt, Human
guuucuuuggagagagaagagaaugaggcug

SEQ ID NO: 216839 - RNA, 32 nt, Human
guuucuuuuaucugacugacucugucaaacaa

SEQ ID NO: 216840 - RNA, 32 nt, Human
guuucuuuuucagguugugauguggccauucc

SEQ ID NO: 216841 - RNA, 32 nt, Human
guuugaaaauaacuuuaccugacucaaggagu

SEQ ID NO: 216842 - RNA, 32 nt, Human
guuugaaaauaugccagacuucagcccccaag

SEQ ID NO: 216843 - RNA, 32 nt, Human
guuugaaacagcuguuuuucccacauuugcug

SEQ ID NO: 216844 - RNA, 32 nt, Human
guuugaaacauucagugaaacuuuuuaaaacu

SEQ ID NO: 216845 - RNA, 32 nt, Human
guuugaaaccagccuagguaacauagugagac

SEQ ID NO: 216846 - RNA, 32 nt, Human
guuugaaaccagccuggacuacauggugaaac

SEQ ID NO: 216847 - RNA, 32 nt, Human
guuugaaaccagccuggccaacauggugaaaa

SEQ ID NO: 216848 - RNA, 32 nt, Human
guuugaaaccagccuggccaacauggugaaac

SEQ ID NO: 216849 - RNA, 32 nt, Human
guuugaaaccagccuggccaacauggugaaau

SEQ ID NO: 216850 - RNA, 32 nt, Human
guuugaaaccagccugggcaacauggugaaac

SEQ ID NO: 216851 - RNA, 32 nt, Human
guuugaaaccagccuggguaacauggcaaaau

SEQ ID NO: 216852 - RNA, 32 nt, Human
guuugaaacuagucuggucaacauggugaaac

SEQ ID NO: 216853 - RNA, 32 nt, Human
guuugaaaguggaggauggaaaaagacauugu

SEQ ID NO: 216854 - RNA, 32 nt, Human
guuugaaauaagcuauuugauguaauacuucu

SEQ ID NO: 216855 - RNA, 32 nt, Human
guuugaaauggaugaagacagcugcuaccauu

SEQ ID NO: 216856 - RNA, 32 nt, Human
guuugaaauguucaagcucacaauaagcuuaa

SEQ ID NO: 216857 - RNA, 32 nt, Human
guuugaaauucauauaucuuauuucaaaggau

SEQ ID NO: 216858 - RNA, 32 nt, Human
guuugaacagagcaggcuucugaggucuccaa

SEQ ID NO: 216859 - RNA, 32 nt, Human
guuugaaccacaucugcaccugugagaggcca

SEQ ID NO: 216860 - RNA, 32 nt, Human
guuugaacccaggaggcacagguugcagugag

SEQ ID NO: 216861 - RNA, 32 nt, Human
guuugaacccaggaggcggagguugcagugac

SEQ ID NO: 216862 - RNA, 32 nt, Human
guuugaacccaggaggcugagguugcagugag

SEQ ID NO: 216863 - RNA, 32 nt, Human
guuugaacccaggagguggaggcugcagugag

SEQ ID NO: 216864 - RNA, 32 nt, Human
guuugaacccgggaggcggaggcugcagugag

SEQ ID NO: 216865 - RNA, 32 nt, Human
guuugaaccugggaggcggaggcugcagugag

SEQ ID NO: 216866 - RNA, 32 nt, Human
guuugaagaagcugggauacagcauuuaaugg

SEQ ID NO: 216867 - RNA, 32 nt, Human
guuugaagcugcagugagcuaugaucacacca

SEQ ID NO: 216868 - RNA, 32 nt, Human
guuugaagggcuuguucuuccauucuggcagg

SEQ ID NO: 216869 - RNA, 21 nt, Human
guuugaaggugcucucugcca

SEQ ID NO: 216870 - RNA, 32 nt, Human
guuugaaguuugcagaugagaagguuugacaa

SEQ ID NO: 216871 - RNA, 32 nt, Human
guuugaaguuuucagggauaacauaccugaug

SEQ ID NO: 216872 - RNA, 32 nt, Human
guuugaauaaaacuaaguaggccaggcgcagu

SEQ ID NO: 216873 - RNA, 32 nt, Human
guuugaauacucugcuugaaaggcaaaagaca

SEQ ID NO: 216874 - RNA, 32 nt, Human
guuugaauuagaagcauguauuuggaguagua

SEQ ID NO: 216875 - RNA, 32 nt, Human
guuugaauuccuccucuauuuaagauauauac

SEQ ID NO: 216876 - RNA, 32 nt, Human
guuugacaagggcagugguccguacuucggcu

SEQ ID NO: 216877 - RNA, 32 nt, Human
guuugacaccagccugggcaacauagugagac

SEQ ID NO: 216878 - RNA, 32 nt, Human
guuugacagugauauucugaagcaaaaacugu

SEQ ID NO: 216879 - RNA, 32 nt, Human
guuugacaguggucaguuacauguccccacag

SEQ ID NO: 216880 - RNA, 32 nt, Human
guuugacauuggagauacgcuaguaacuguga

SEQ ID NO: 216881 - RNA, 32 nt, Human
guuugacauugugucugggaaggaagggccag

SEQ ID NO: 216882 - RNA, 32 nt, Human
guuugacauuucccuuucuucuuuccuuuuug

SEQ ID NO: 216883 - RNA, 32 nt, Human
guuugaccuggcaggcggagguugcagugagc

SEQ ID NO: 216884 - RNA, 32 nt, Human
guuugagaaacuccgcguucaaaguuaaaaac

SEQ ID NO: 216885 - RNA, 32 nt, Human
guuugagaacagcuggccaagauggugaaacc

SEQ ID NO: 216886 - RNA, 32 nt, Human
guuugagaaccauuuacuuagcagaaccacau

SEQ ID NO: 216887 - RNA, 24 nt, Human
guuugagaacugcuggcuugaggu

SEQ ID NO: 216888 - RNA, 23 nt, Human
guuugagacaccugguagaugua

SEQ ID NO: 216889 - RNA, 32 nt, Human
guuugagaccaccuggccaacauggugaaacc

SEQ ID NO: 216890 - RNA, 32 nt, Human
guuugagaccagccuagacaacauggugaaac

SEQ ID NO: 216891 - RNA, 32 nt, Human
guuugagaccagccuagccaacaugcugaaac

SEQ ID NO: 216892 - RNA, 32 nt, Human
guuugagaccagccugaccaacauggugaaac

SEQ ID NO: 216893 - RNA, 32 nt, Human
guuugagaccagccugaccaacauggugaaau

SEQ ID NO: 216894 - RNA, 32 nt, Human
guuugagaccagccugagugacauagugagac

SEQ ID NO: 216895 - RNA, 32 nt, Human
guuugagaccagccugaucaacauggugaaac

SEQ ID NO: 216896 - RNA, 32 nt, Human
guuugagaccagccugcccaacauggugaaac

SEQ ID NO: 216897 - RNA, 32 nt, Human
guuugagaccagccuggacaacaaacaugcug

SEQ ID NO: 216898 - RNA, 32 nt, Human
guuugagaccagccuggacaacauggugaaac

SEQ ID NO: 216899 - RNA, 32 nt, Human
guuugagaccagccuggcaaacauggugaaac

SEQ ID NO: 216900 - RNA, 32 nt, Human
guuugagaccagccuggccaaaaucuauacua

SEQ ID NO: 216901 - RNA, 32 nt, Human
guuugagaccagccuggccaacauagugaaac

SEQ ID NO: 216902 - RNA, 32 nt, Human
guuugagaccagccuggccaacaugcugaaac

SEQ ID NO: 216903 - RNA, 32 nt, Human
guuugagaccagccuggccaacaugguaaaac

SEQ ID NO: 216904 - RNA, 32 nt, Human
guuugagaccagccuggccaacauggugaaac

SEQ ID NO: 216905 - RNA, 32 nt, Human
guuugagaccagccuggccaacauggugaaau

SEQ ID NO: 216906 - RNA, 32 nt, Human
guuugagaccagccuggccaacauggugaagc

SEQ ID NO: 216907 - RNA, 32 nt, Human
guuugagaccagccuggccaacauggugagac

SEQ ID NO: 216908 - RNA, 32 nt, Human
guuugagaccagccuggccaacauggugauau

SEQ ID NO: 216909 - RNA, 32 nt, Human
guuugagaccagccuggccaacaugguggaac

SEQ ID NO: 216910 - RNA, 32 nt, Human
guuugagaccagccuggccaacguagugaaac

SEQ ID NO: 216911 - RNA, 32 nt, Human
guuugagaccagccuggccaacguggugaaac

SEQ ID NO: 216912 - RNA, 32 nt, Human
guuugagaccagccuggccagcauggugaaac

SEQ ID NO: 216913 - RNA, 32 nt, Human
guuugagaccagccuggcccacauggugaaac

SEQ ID NO: 216914 - RNA, 32 nt, Human
guuugagaccagccuggccgacauggugaaac

SEQ ID NO: 216915 - RNA, 32 nt, Human
guuugagaccagccuggcuaacauggugaaau

SEQ ID NO: 216916 - RNA, 32 nt, Human
guuugagaccagccugggcaacauaguaagac

SEQ ID NO: 216917 - RNA, 32 nt, Human
guuugagaccagccugggcaacauagugagac

SEQ ID NO: 216918 - RNA, 32 nt, Human
guuugagaccagccugggcaacauagugagau

SEQ ID NO: 216919 - RNA, 32 nt, Human
guuugagaccagccugggcaacauagugaggc

SEQ ID NO: 216920 - RNA, 32 nt, Human
guuugagaccagccugggcaacauagugauac

SEQ ID NO: 216921 - RNA, 32 nt, Human
guuugagaccagccugggcaacauggcuaaac

SEQ ID NO: 216922 - RNA, 32 nt, Human
guuugagaccagccugggcaacauggugaaac

SEQ ID NO: 216923 - RNA, 32 nt, Human
guuugagaccagccugggcaauauagugagac

SEQ ID NO: 216924 - RNA, 32 nt, Human
guuugagaccagccugggcaauauggugagac

SEQ ID NO: 216925 - RNA, 32 nt, Human
guuugagaccagccugggcgauauagugaggc

SEQ ID NO: 216926 - RNA, 32 nt, Human
guuugagaccagccuggucaacaugguaaaac

SEQ ID NO: 216927 - RNA, 32 nt, Human
guuugagaccagccuugacaacauggugaaac

SEQ ID NO: 216928 - RNA, 32 nt, Human
guuugagaccagcugggcaacauggugaaacc

SEQ ID NO: 216929 - RNA, 32 nt, Human
guuugagaccuccugggcaacauagugagauc

SEQ ID NO: 216930 - RNA, 32 nt, Human
guuugagagaaggaauuggcucaacuucaguu

SEQ ID NO: 216931 - RNA, 32 nt, Human
guuugagagagggagagugggcccuggcuuuc

SEQ ID NO: 216932 - RNA, 24 nt, Human
guuugagagccacuacccuagaug

SEQ ID NO: 216933 - RNA, 22 nt, Human
guuugagaguaccguacaggug

SEQ ID NO: 216934 - RNA, 32 nt, Human
guuugagauauaauuaaugcuugucugcauaa

SEQ ID NO: 216935 - RNA, 32 nt, Human
guuugagauaugucuucuucgugaugcuugug

SEQ ID NO: 216936 - RNA, 32 nt, Human
guuugagaucagccuggccaacauagugaaac

SEQ ID NO: 216937 - RNA, 32 nt, Human
guuugagaucagccuggccaacauggugaaac

SEQ ID NO: 216938 - RNA, 32 nt, Human
guuugagaucagccugggcaacaugguggaac

SEQ ID NO: 216939 - RNA, 32 nt, Human
guuugagcaaggagacucaaagaggcaaggug

SEQ ID NO: 216940 - RNA, 32 nt, Human
guuugagccagccuggccaacauggugaaacc

SEQ ID NO: 216941 - RNA, 32 nt, Human
guuugagcccaggaggcagaauuugcagugag

SEQ ID NO: 216942 - RNA, 32 nt, Human
guuugagcccaggaggucaaggcugcagugag

SEQ ID NO: 216943 - RNA, 32 nt, Human
guuugagcccaggagguugaggcugcagugag

SEQ ID NO: 216944 - RNA, 32 nt, Human
guuugagcccaggaguucaaggcagcaaugag

SEQ ID NO: 216945 - RNA, 32 nt, Human
guuugagcccaggaguucaaggccagccuggg

SEQ ID NO: 216946 - RNA, 32 nt, Human
guuugagcccaggaguucagggcugcagugag

SEQ ID NO: 216947 - RNA, 32 nt, Human
guuugagcccuggagguugaggcugcagugag

SEQ ID NO: 216948 - RNA, 32 nt, Human
guuugagccugaccaacaugcuaaaauccccu

SEQ ID NO: 216949 - RNA, 32 nt, Human
guuugagccugagacacucuuugagguaaaaa

SEQ ID NO: 216950 - RNA, 32 nt, Human
guuugagcgagggaaguugaggcugcagugaa

SEQ ID NO: 216951 - RNA, 32 nt, Human
guuugagcuggucagcaaggagaggggguggg

SEQ ID NO: 216952 - RNA, 32 nt, Human
guuugagcuguggcugaaagcuuucccacacu

SEQ ID NO: 216953 - RNA, 32 nt, Human
guuugaggaaggcacaugaaucagggccauug

SEQ ID NO: 216954 - RNA, 32 nt, Human
guuugaggaggaagaggaagaggaggaaggcg

SEQ ID NO: 216955 - RNA, 32 nt, Human
guuugaggcaaaacuggauucccacucuggua

SEQ ID NO: 216956 - RNA, 32 nt, Human
guuugaggccagaguugguaccugcuuuaaga

SEQ ID NO: 216957 - RNA, 32 nt, Human
guuugaggccagccugggaaauauagugagac

SEQ ID NO: 216958 - RNA, 32 nt, Human
guuugaggcggcacgcagccuagacgacagac

SEQ ID NO: 216959 - RNA, 32 nt, Human
guuugaggcugcagagagccaagauugcacca

SEQ ID NO: 216960 - RNA, 32 nt, Human
guuugaggcuuagaagcuggaucuccugccgg

SEQ ID NO: 216961 - RNA, 32 nt, Human
guuugagggaggaggaaggaggaucagaguuu

SEQ ID NO: 216962 - RNA, 32 nt, Human
guuugagggcagccugggaaacauggcuaaau

SEQ ID NO: 216963 - RNA, 32 nt, Human
guuugaggggaguagauaugagagggagccgc

SEQ ID NO: 216964 - RNA, 27 nt, Human
guuugaguaaagccucucccaggagca

SEQ ID NO: 216965 - RNA, 32 nt, Human
guuugaguccaggaguuggaggcuacagugag

SEQ ID NO: 216966 - RNA, 32 nt, Human
guuugagugcagaaugacggcgguucacaucg

SEQ ID NO: 216967 - RNA, 32 nt, Human
guuugagugugaaguuaauaucacacaaagca

SEQ ID NO: 216968 - RNA, 32 nt, Human
guuugaguucauacccuguuaccauuuugggg

SEQ ID NO: 216969 - RNA, 32 nt, Human
guuugauaagcuucgcgaguucuugagagugg

SEQ ID NO: 216970 - RNA, 32 nt, Human
guuugauauaaauaucuuuguauucuaguuug

SEQ ID NO: 216971 - RNA, 32 nt, Human
guuugauauuuagcuugagaauggguauggaa

SEQ ID NO: 216972 - RNA, 32 nt, Human
guuugauccuaccucucggacuauuagguccu

SEQ ID NO: 216973 - RNA, 32 nt, Human
guuugaucucagacugccgugcuagcaaucag

SEQ ID NO: 216974 - RNA, 32 nt, Human
guuugaucucagacugcugugcuagcaaucag

SEQ ID NO: 216975 - RNA, 32 nt, Human
guuugaugagagcacuaccuuccuucaggagg

SEQ ID NO: 216976 - RNA, 32 nt, Human
guuugaugccugugaagaacccugcagggccc

SEQ ID NO: 216977 - RNA, 32 nt, Human
guuugauggagagagaggcagagacagauccc

SEQ ID NO: 216978 - RNA, 32 nt, Human
guuugauuagguuggugcaaaaguaauugugg

SEQ ID NO: 216979 - RNA, 32 nt, Human
guuugauuaucaaugcuggagaaaaauaucug

SEQ ID NO: 216980 - RNA, 32 nt, Human
guuugauuccagggauauuucuugucuuacau

SEQ ID NO: 216981 - RNA, 32 nt, Human
guuugauucuaugccauuuggacccaauucug

SEQ ID NO: 216982 - RNA, 32 nt, Human
guuugauugcuaugcagguuugggagaggagg

SEQ ID NO: 216983 - RNA, 32 nt, Human
guuugauuuucuuucucugacucucaucccua

SEQ ID NO: 216984 - RNA, 32 nt, Human
guuugcaaacaaaaugaugggaaaguggaaca

SEQ ID NO: 216985 - RNA, 32 nt, Human
guuugcaaccagccugagcaaaauauugagac

SEQ ID NO: 216986 - RNA, 32 nt, Human
guuugcaagacagagcgcgcagcccggcaagg

SEQ ID NO: 216987 - RNA, 32 nt, Human
guuugcaauacucccuucgcacuugaggaaga

SEQ ID NO: 216988 - RNA, 32 nt, Human
guuugcaauauuuguuuuaagcacuuugaaac

SEQ ID NO: 216989 - RNA, 32 nt, Human
guuugcacacaucaaaaguauugugauauuuu

SEQ ID NO: 216990 - RNA, 32 nt, Human
guuugcacagagcggguagggcuguagggaaa

SEQ ID NO: 216991 - RNA, 19 nt, Human
guuugcaccaugucuucca

SEQ ID NO: 216992 - RNA, 32 nt, Human
guuugcaccucgcugcuccagccucuggggcg

SEQ ID NO: 216993 - RNA, 32 nt, Human
guuugcagagaggagccagccacuccaggguc

SEQ ID NO: 216994 - RNA, 32 nt, Human
guuugcagagcugggcaguugaggaaaggaca

SEQ ID NO: 216995 - RNA, 32 nt, Human
guuugcagcaaaaaucauaaguagaaggaaac

SEQ ID NO: 216996 - RNA, 32 nt, Human
guuugcagcauugcacuccagccugggugaca

SEQ ID NO: 216997 - RNA, 15 nt, Human
guuugcagccuucga

SEQ ID NO: 216998 - RNA, 18 nt, Human
guuugcagcuccuugcca

SEQ ID NO: 216999 - RNA, 32 nt, Human
guuugcagcucucacauuuuguuaaauucaug

SEQ ID NO: 217000 - RNA, 32 nt, Human
guuugcaguugagaggggagggcaggaggggu

SEQ ID NO: 217001 - RNA, 32 nt, Human
guuugcauacacuagaaaaugccuucaauuug

SEQ ID NO: 217002 - RNA, 28 nt, Human
guuugcaucaaugcugccuuguuauucu

SEQ ID NO: 217003 - RNA, 32 nt, Human
guuugcaucacugcacuccagccugggcaaca

SEQ ID NO: 217004 - RNA, 32 nt, Human
guuugcaucacugcacuccagccugggcagca

SEQ ID NO: 217005 - RNA, 32 nt, Human
guuugcaucguggauccagcugugcuccaguc

SEQ ID NO: 217006 - RNA, 32 nt, Human
guuugcaucuuccuugggcuuaucucagaguu

SEQ ID NO: 217007 - RNA, 32 nt, Human
guuugcauucucacauugccaggaugauaagu

SEQ ID NO: 217008 - RNA, 32 nt, Human
guuugccaaaucucugauccucccuuuccauu

SEQ ID NO: 217009 - RNA, 32 nt, Human
guuugccaaggauauggggcaggaggcucccu

SEQ ID NO: 217010 - RNA, 32 nt, Human
guuugccaaguaugccaguguaaugaaacugc

SEQ ID NO: 217011 - RNA, 32 nt, Human
guuugccaaguaugccagugugaugaaacugc

SEQ ID NO: 217012 - RNA, 32 nt, Human
guuugccagcacagaccuuugaugggugcagg

SEQ ID NO: 217013 - RNA, 32 nt, Human
guuugccagucccaggaaagcacuucucaacu

SEQ ID NO: 217014 - RNA, 32 nt, Human
guuugcccacagaccugucgggugcuccugug

SEQ ID NO: 217015 - RNA, 32 nt, Human
guuugcccacagaucagcucugcucauucccc

SEQ ID NO: 217016 - RNA, 32 nt, Human
guuugcccaucaguugucuuuguuaaaugaga

SEQ ID NO: 217017 - RNA, 32 nt, Human
guuugccccuaaaaauggaaggaacuuauaua

SEQ ID NO: 217018 - RNA, 32 nt, Human
guuugcccucauucuccuguuucagguuugcu

SEQ ID NO: 217019 - RNA, 32 nt, Human
guuugcccuccugauuccugcuuucuuuaccu

SEQ ID NO: 217020 - RNA, 32 nt, Human
guuugcccucucuugacuccagccuagggaau

SEQ ID NO: 217021 - RNA, 32 nt, Human
guuugcccugcagagagcugggucugcccuug

SEQ ID NO: 217022 - RNA, 32 nt, Human
guuugcccugcucugccugggacugagcgagu

SEQ ID NO: 217023 - RNA, 32 nt, Human
guuugcccuuugguacagaaggugaguuaaag

SEQ ID NO: 217024 - RNA, 32 nt, Human
guuugccguccccuggccaggaugguggaguc

SEQ ID NO: 217025 - RNA, 32 nt, Human
guuugccuauagguggagguauccuguguguc

SEQ ID NO: 217026 - RNA, 32 nt, Human
guuugccucaccauguaguauuacaaauuuuu

SEQ ID NO: 217027 - RNA, 32 nt, Human
guuugccucauugugcuauuugcccacuuucc

SEQ ID NO: 217028 - RNA, 32 nt, Human
guuugccucccaauguugucccuuuccuucgu

SEQ ID NO: 217029 - RNA, 32 nt, Human
guuugccucugccucugacacacagcucuguc

SEQ ID NO: 217030 - RNA, 32 nt, Human
guuugccucuuucagaauacuaccuccuuuug

SEQ ID NO: 217031 - RNA, 32 nt, Human
guuugccucuuuuucucccuggaggaaaaugc

SEQ ID NO: 217032 - RNA, 32 nt, Human
guuugccugcggucccagcuacuugggaagcu

SEQ ID NO: 217033 - RNA, 32 nt, Human
guuugccugcucagaguggccccucagaacaa

SEQ ID NO: 217034 - RNA, 32 nt, Human
guuugccuggaauuguucuguaccucuuugua

SEQ ID NO: 217035 - RNA, 32 nt, Human
guuugccugucuggcugccuugggucuuuggu

SEQ ID NO: 217036 - RNA, 32 nt, Human
guuugccuuacucauuucuaagugcaauaagg

SEQ ID NO: 217037 - RNA, 32 nt, Human
guuugcgaccagccuggucaacauaguggacc

SEQ ID NO: 217038 - RNA, 32 nt, Human
guuugcgacuccgccucccugggaccuggauu

SEQ ID NO: 217039 - RNA, 32 nt, Human
guuugcgccgacuccgucucccagaaaucaac

SEQ ID NO: 217040 - RNA, 19 nt, Human
guuugcgccuguaauccca

SEQ ID NO: 217041 - RNA, 22 nt, Human
guuugcggcccggucucggaga

SEQ ID NO: 217042 - RNA, 32 nt, Human
guuugcgggagguggugaccgcgcuggggacg

SEQ ID NO: 217043 - RNA, 32 nt, Human
guuugcggggagagaggucagagccagaugaa

SEQ ID NO: 217044 - RNA, 32 nt, Human
guuugcgugcaggagccagagugggacccacg

SEQ ID NO: 217045 - RNA, 32 nt, Human
guuugcgugggugguuucaauuugccagggaa

SEQ ID NO: 217046 - RNA, 32 nt, Human
guuugcucacggcagaaaaccugaacagcccc

SEQ ID NO: 217047 - RNA, 32 nt, Human
guuugcucacuacccuccuucucccuguccac

SEQ ID NO: 217048 - RNA, 32 nt, Human
guuugcucccugauuaaagugccuucagccaa

SEQ ID NO: 217049 - RNA, 32 nt, Human
guuugcucugcauuuuugaugaugguuuggaa

SEQ ID NO: 217050 - RNA, 32 nt, Human
guuugcugagucuuguuuuaaguggccuugau

SEQ ID NO: 217051 - RNA, 32 nt, Human
guuugcugccaccacaccauacaacugccuga

SEQ ID NO: 217052 - RNA, 32 nt, Human
guuugcugcgauaccauggaaggaggcggggg

SEQ ID NO: 217053 - RNA, 32 nt, Human
guuugcugcggccucgaccuccugggcuuaag

SEQ ID NO: 217054 - RNA, 32 nt, Human
guuugcugggaggcgggagaugcagccaggag

SEQ ID NO: 217055 - RNA, 20 nt, Human
guuugcuggggugggggagc

SEQ ID NO: 217056 - RNA, 32 nt, Human
guuugcuguccuagaacaaggcagcaggaggg

SEQ ID NO: 217057 - RNA, 32 nt, Human
guuugcuguugcuguuuccuaccuucugaggc

SEQ ID NO: 217058 - RNA, 32 nt, Human
guuugcuuaaaggagcuuggcugguuugggcc

SEQ ID NO: 217059 - RNA, 32 nt, Human
guuugcuucaaaauauguagaauugugguuga

SEQ ID NO: 217060 - RNA, 32 nt, Human
guuugcuucccccuuucagcagcauucuuuuu

SEQ ID NO: 217061 - RNA, 32 nt, Human
guuugcuucuaggauauacacuuuaaaagaac

SEQ ID NO: 217062 - RNA, 32 nt, Human
guuugcuuucuccguuucuuccuuccuuugca

SEQ ID NO: 217063 - RNA, 32 nt, Human
guuugcuuugggcccuacugggccuggggagg

SEQ ID NO: 217064 - RNA, 32 nt, Human
guuugcuuuuucccuuuuccuacagacguaua

SEQ ID NO: 217065 - RNA, 32 nt, Human
guuuggaaaaggaaucuuccacugaaacauuu

SEQ ID NO: 217066 - RNA, 32 nt, Human
guuuggaaauggggagcuggccuaggugggag

SEQ ID NO: 217067 - RNA, 20 nt, Human
guuuggaacaggcugccaug

SEQ ID NO: 217068 - RNA, 32 nt, Human
guuuggaaccuaugaacacuuugaggcugcca

SEQ ID NO: 217069 - RNA, 32 nt, Human
guuuggaagacugauucuuuguuugcaauaau

SEQ ID NO: 217070 - RNA, 20 nt, Human
guuuggaauaggcugccaug

SEQ ID NO: 217071 - RNA, 32 nt, Human
guuuggaauccacguuucagcacuuuggacag

SEQ ID NO: 217072 - RNA, 32 nt, Human
guuuggacaaccuaacucagcuuuauuugaca

SEQ ID NO: 217073 - RNA, 32 nt, Human
guuuggacaguauuuaaauauugcaaauaugu

SEQ ID NO: 217074 - RNA, 32 nt, Human
guuuggaccaaagcaucggggugggggagggg

SEQ ID NO: 217075 - RNA, 32 nt, Human
guuuggaccagccugggcaacauaagaaggcc

SEQ ID NO: 217076 - RNA, 32 nt, Human
guuuggaccagccugggcaacauggugaaacc

SEQ ID NO: 217077 - RNA, 32 nt, Human
guuuggacccaagcuuaacuuuuccaaugugg

SEQ ID NO: 217078 - RNA, 32 nt, Human
guuuggacugcuuuuaaaaccugagcaauguc

SEQ ID NO: 217079 - RNA, 32 nt, Human
guuuggacuuagugccugucuggcagccugug

SEQ ID NO: 217080 - RNA, 32 nt, Human
guuuggacuuuauuacaucugcuuuagcaaac

SEQ ID NO: 217081 - RNA, 32 nt, Human
guuuggagaacugguuucugucuaauccuucu

SEQ ID NO: 217082 - RNA, 32 nt, Human
guuuggagaauagaaaugaaaagccacgucau

SEQ ID NO: 217083 - RNA, 32 nt, Human
guuuggagaccaugugcguugugugcaugcga

SEQ ID NO: 217084 - RNA, 20 nt, Human
guuuggagagagaaacaauc

SEQ ID NO: 217085 - RNA, 32 nt, Human
guuuggagagagccuucuagaaugacagacug

SEQ ID NO: 217086 - RNA, 32 nt, Human
guuuggagaggaggcaggggcugggcuggggg

SEQ ID NO: 217087 - RNA, 32 nt, Human
guuuggagcuucccccaagcacccaacccacu

SEQ ID NO: 217088 - RNA, 32 nt, Human
guuuggaggaaucacuggcauuugauggggaa

SEQ ID NO: 217089 - RNA, 20 nt, Human
guuuggaggagccccgagug

SEQ ID NO: 217090 - RNA, 32 nt, Human
guuuggaggaggaggagugggccaagcaggga

SEQ ID NO: 217091 - RNA, 32 nt, Human
guuuggaggagguggcagcccagcucccaguu

SEQ ID NO: 217092 - RNA, 32 nt, Human
guuuggaggauuucagaguuaaccucauggaa

SEQ ID NO: 217093 - RNA, 32 nt, Human
guuuggaggggcucacugccacuggguacuca

SEQ ID NO: 217094 - RNA, 32 nt, Human
guuuggagucacuguaguuaaguguggaugca

SEQ ID NO: 217095 - RNA, 32 nt, Human
guuuggauaugacugaggcucuccaaugggcc

SEQ ID NO: 217096 - RNA, 32 nt, Human
guuuggauauuugacaaggcacucugauguga

SEQ ID NO: 217097 - RNA, 32 nt, Human
guuuggaugggagccccacagaggcagguccu

SEQ ID NO: 217098 - RNA, 32 nt, Human
guuuggaugucacacagagcugaagggguugg

SEQ ID NO: 217099 - RNA, 32 nt, Human
guuuggaugugaggagaaugaaacuacaaaaa

SEQ ID NO: 217100 - RNA, 32 nt, Human
guuuggauugacugaugaagacauaaagcucu

SEQ ID NO: 217101 - RNA, 32 nt, Human
guuuggauuuccugcaucuuguggauuacucc

SEQ ID NO: 217102 - RNA, 32 nt, Human
guuuggcauuggugcucucugccuggcaggua

SEQ ID NO: 217103 - RNA, 32 nt, Human
guuuggccagggcuacuuacaggggcuguugg

SEQ ID NO: 217104 - RNA, 32 nt, Human
guuuggccaugaagagagagaaucaugauaac

SEQ ID NO: 217105 - RNA, 32 nt, Human
guuuggcccagccucaguccuugcucuucucu

SEQ ID NO: 217106 - RNA, 32 nt, Human
guuuggccccaagaagugaauuuggguuugag

SEQ ID NO: 217107 - RNA, 32 nt, Human
guuuggccggcagaggaaguggcacaagaggc

SEQ ID NO: 217108 - RNA, 32 nt, Human
guuuggccucaagugauccuccugccucagcc

SEQ ID NO: 217109 - RNA, 32 nt, Human
guuuggccucugcuuccucccaguucacagcc

SEQ ID NO: 217110 - RNA, 32 nt, Human
guuuggccugcaggcuguagcuugccaaucag

SEQ ID NO: 217111 - RNA, 32 nt, Human
guuuggccugggcuucucagcuuguccaguau

SEQ ID NO: 217112 - RNA, 32 nt, Human
guuuggccuugagaguccccaggguccucccc

SEQ ID NO: 217113 - RNA, 32 nt, Human
guuuggcuauaucccccguccccagccccucu

SEQ ID NO: 217114 - RNA, 32 nt, Human
guuuggcugcagcugcccgggcggcgucgaug

SEQ ID NO: 217115 - RNA, 32 nt, Human
guuuggcuguguuguuugcucacugcucugag

SEQ ID NO: 217116 - RNA, 32 nt, Human
guuugggaacugcugccuagauuucagaaggu

SEQ ID NO: 217117 - RNA, 32 nt, Human
guuugggaaugagaggaugagugagugaggcu

SEQ ID NO: 217118 - RNA, 32 nt, Human
guuugggaauucaagcaucauauggcugaggu

SEQ ID NO: 217119 - RNA, 32 nt, Human
guuugggacagaggggacaguugaggucauuc

SEQ ID NO: 217120 - RNA, 32 nt, Human
guuugggaccagccugaccaacauggugaaau

SEQ ID NO: 217121 - RNA, 32 nt, Human
guuugggaccagccuggccaacauggugaaac

SEQ ID NO: 217122 - RNA, 32 nt, Human
guuugggacugaauauuacaguagguggcaaa

SEQ ID NO: 217123 - RNA, 32 nt, Human
guuugggacugccccggcaacuccaggguguc

SEQ ID NO: 217124 - RNA, 24 nt, Human
guuugggagcuacugauggacaug

SEQ ID NO: 217125 - RNA, 32 nt, Human
guuugggagcugccagucuccugggaggaucg

SEQ ID NO: 217126 - RNA, 32 nt, Human
guuugggaggccaaggcaggcagaucaccuga

SEQ ID NO: 217127 - RNA, 32 nt, Human
guuugggaggccaaggcgggcagaucaccuga

SEQ ID NO: 217128 - RNA, 32 nt, Human
guuugggaggccgaggcaggcagaucacuuga

SEQ ID NO: 217129 - RNA, 32 nt, Human
guuugggaggccgaggcgagcagaucaggagu

SEQ ID NO: 217130 - RNA, 21 nt, Human
guuugggaggcgcgggagaug

SEQ ID NO: 217131 - RNA, 32 nt, Human
guuugggaggcugagccggguggaucgccuga

SEQ ID NO: 217132 - RNA, 32 nt, Human
guuugggaggcugaggcaggaggaucgcuuga

SEQ ID NO: 217133 - RNA, 32 nt, Human
guuugggaggcugaggcagguggaucaccuga

SEQ ID NO: 217134 - RNA, 32 nt, Human
guuugggaggcugaggcggauggaucacuuga

SEQ ID NO: 217135 - RNA, 32 nt, Human
guuugggaggcugaggcgggcggaucaccagg

SEQ ID NO: 217136 - RNA, 32 nt, Human
guuugggaggcugaggcuaguggaucaugugg

SEQ ID NO: 217137 - RNA, 32 nt, Human
guuugggaggcugaguugggcagaucaccuga

SEQ ID NO: 217138 - RNA, 32 nt, Human
guuugggaggcuggggcagguagaucacuuga

SEQ ID NO: 217139 - RNA, 32 nt, Human
guuugggauccucugaaaaggcccagaaaaau

SEQ ID NO: 217140 - RNA, 32 nt, Human
guuugggauuaugaacaaaccucacagacuuu

SEQ ID NO: 217141 - RNA, 32 nt, Human
guuugggauuugaaaaguggaauuauugcagu

SEQ ID NO: 217142 - RNA, 32 nt, Human
guuugggcaaaccugcugaugucuauuuaauu

SEQ ID NO: 217143 - RNA, 31 nt, Human
guuugggcaaugucucagcagagacuggcau

SEQ ID NO: 217144 - RNA, 32 nt, Human
guuugggcagucugcauucucccagcuacggu

SEQ ID NO: 217145 - RNA, 32 nt, Human
guuugggccacugcacucuagccuggcaacag

SEQ ID NO: 217146 - RNA, 32 nt, Human
guuugggcugccuccccuccucccguccaccc

SEQ ID NO: 217147 - RNA, 32 nt, Human
guuugggcuggccuggccacguguggucacau

SEQ ID NO: 217148 - RNA, 32 nt, Human
guuugggcuguaaucuaaacaauuggacagau

SEQ ID NO: 217149 - RNA, 32 nt, Human
guuuggggaagccucucagaggaggaggagcu

SEQ ID NO: 217150 - RNA, 32 nt, Human
guuuggggacuuaccucugcagcacugugaaa

SEQ ID NO: 217151 - RNA, 32 nt, Human
guuuggggagcacacucuuggcacauagaucu

SEQ ID NO: 217152 - RNA, 32 nt, Human
guuuggggagugaauaaggggaagagugcuca

SEQ ID NO: 217153 - RNA, 32 nt, Human
guuuggggcauucugcuccgaggucccucuag

SEQ ID NO: 217154 - RNA, 32 nt, Human
guuuggggcuggggguuggagaauaaaagcag

SEQ ID NO: 217155 - RNA, 32 nt, Human
guuuggggcugguucccccaucuugaauuguu

SEQ ID NO: 217156 - RNA, 32 nt, Human
guuugggggaagagaaacuugcagugaaaagg

SEQ ID NO: 217157 - RNA, 32 nt, Human
guuugggggauggugagccgacacuuuccuuu

SEQ ID NO: 217158 - RNA, 32 nt, Human
guuugggggcuacuuuguuacacagaaauaga

SEQ ID NO: 217159 - RNA, 32 nt, Human
guuuggggucaugaucacaaaggggccauucc

SEQ ID NO: 217160 - RNA, 32 nt, Human
guuuggggucugccaccauccugcugcugugu

SEQ ID NO: 217161 - RNA, 32 nt, Human
guuuggggugagaucuggaaaucaagaaaugg

SEQ ID NO: 217162 - RNA, 31 nt, Human
guuugggguuacuucuuuguuucuaaguaua

SEQ ID NO: 217163 - RNA, 32 nt, Human
guuuggguagcgcugcccucuggcagucaugc

SEQ ID NO: 217164 - RNA, 32 nt, Human
guuugggucaucucuguuuccagaguuguucu

SEQ ID NO: 217165 - RNA, 32 nt, Human
guuugggucuccuaggcccacccuuucuagga

SEQ ID NO: 217166 - RNA, 32 nt, Human
guuugggugauaccccucacagccccugucau

SEQ ID NO: 217167 - RNA, 32 nt, Human
guuugggugauggcugaugcuggcugugcuag

SEQ ID NO: 217168 - RNA, 32 nt, Human
guuugggugcagacacaggcagcugcugcccu

SEQ ID NO: 217169 - RNA, 32 nt, Human
guuuggguggggacucagcccagaucuacgug

SEQ ID NO: 217170 - RNA, 32 nt, Human
guuuggguucugguccuggcugugccacugac

SEQ ID NO: 217171 - RNA, 32 nt, Human
guuuggguugcaugccuguaaucccagcauuu

SEQ ID NO: 217172 - RNA, 32 nt, Human
guuuggguuguguuugguauuguuuuuagugg

SEQ ID NO: 217173 - RNA, 32 nt, Human
guuugguaaagauggcauuucaccauguugua

SEQ ID NO: 217174 - RNA, 32 nt, Human
guuugguaacaaguguuuaauguauguuaaaa

SEQ ID NO: 217175 - RNA, 32 nt, Human
guuugguaacacagcuuuaacuaugucaugca

SEQ ID NO: 217176 - RNA, 32 nt, Human
guuugguagauggggcauggaaggaacgaaca

SEQ ID NO: 217177 - RNA, 32 nt, Human
guuugguagcagggaugaaagcuagggccucu

SEQ ID NO: 217178 - RNA, 32 nt, Human
guuuggucauuuugaagcuugacauuuuaguu

SEQ ID NO: 217179 - RNA, 32 nt, Human
guuugguccagaggagggaggaggaagggaag

SEQ ID NO: 217180 - RNA, 32 nt, Human
guuugguccuguaggaguucuauuuugggguc

SEQ ID NO: 217181 - RNA, 32 nt, Human
guuuggucgcuuugguugucaugagaaagaga

SEQ ID NO: 217182 - RNA, 32 nt, Human
guuuggucuggcccaguuccccaucauuaaac

SEQ ID NO: 217183 - RNA, 32 nt, Human
guuuggugaugaagacuuccaacucaaauuug

SEQ ID NO: 217184 - RNA, 32 nt, Human
guuuggugcggccacuccaaggccaaagccgc

SEQ ID NO: 217185 - RNA, 32 nt, Human
guuuggugcggccacuccaaggccaaagcgag

SEQ ID NO: 217186 - RNA, 32 nt, Human
guuugguggggaucuggguucaucucacccac

SEQ ID NO: 217187 - RNA, 32 nt, Human
guuuggugggguggcaccuguuucccgggcaa

SEQ ID NO: 217188 - RNA, 32 nt, Human
guuuggugguugccacuggggcagugagccuu

SEQ ID NO: 217189 - RNA, 32 nt, Human
guuugguuccaagcacuucccaccucaaacuc

SEQ ID NO: 217190 - RNA, 32 nt, Human
guuugguuccggugcugaccccuaggccccag

SEQ ID NO: 217191 - RNA, 21 nt, Human
guuugguuucugcuuauggug

SEQ ID NO: 217192 - RNA, 32 nt, Human
guuugguuugcagagaacacagccugauacuu

SEQ ID NO: 217193 - RNA, 32 nt, Human
guuugguuugguuuguuauggcuuccuuuuua

SEQ ID NO: 217194 - RNA, 32 nt, Human
guuugguuuugagaaaagauggugaaguuucu

SEQ ID NO: 217195 - RNA, 32 nt, Human
guuugguuuuugagaaggaaugaagugggaac

SEQ ID NO: 217196 - RNA, 32 nt, Human
guuuguaaacugugguugccugccuucccagc

SEQ ID NO: 217197 - RNA, 17 nt, Human
guuuguacacuuucaaa

SEQ ID NO: 217198 - RNA, 32 nt, Human
guuuguaccuguguuaguuugcugagaauuau

SEQ ID NO: 217199 - RNA, 32 nt, Human
guuuguacugacaaccuccuuggcuuauuugg

SEQ ID NO: 217200 - RNA, 32 nt, Human
guuuguagcaagacucugaugauaauucuguu

SEQ ID NO: 217201 - RNA, 32 nt, Human
guuuguagcuuucugucacucauuccaucuuc

SEQ ID NO: 217202 - RNA, 32 nt, Human
guuuguaggauguaugggcaaagcuuuuguga

SEQ ID NO: 217203 - RNA, 32 nt, Human
guuuguagggcugccaggcugcagccugcugc

SEQ ID NO: 217204 - RNA, 32 nt, Human
guuuguaguaaauuuuacuauaacuccaaguu

SEQ ID NO: 217205 - RNA, 32 nt, Human
guuuguagucauguagaaaaggccaguauaaa

SEQ ID NO: 217206 - RNA, 30 nt, Human
guuuguagucuugaugugcuccugugguau

SEQ ID NO: 217207 - RNA, 32 nt, Human
guuuguaugaacuucuggaucuccagucagau

SEQ ID NO: 217208 - RNA, 32 nt, Human
guuuguaugcuuugguuuagugcaaugugugg

SEQ ID NO: 217209 - RNA, 32 nt, Human
guuuguauuggcagagguagugaggugauuca

SEQ ID NO: 217210 - RNA, 32 nt, Human
guuuguauuuggaauauuugaauaaugacaga

SEQ ID NO: 217211 - RNA, 32 nt, Human
guuugucaagugagucaagacuugcuuuuguc

SEQ ID NO: 217212 - RNA, 32 nt, Human
guuugucacccaggcuggagugcaguggcaug

SEQ ID NO: 217213 - RNA, 32 nt, Human
guuugucacccaggcuggagugcuguggugug

SEQ ID NO: 217214 - RNA, 32 nt, Human
guuugucacccugcauccuucucccauucccc

SEQ ID NO: 217215 - RNA, 23 nt, Human
guuugucagaagacccugaagua

SEQ ID NO: 217216 - RNA, 32 nt, Human
guuugucagcagccaagguguuuccaggaagu

SEQ ID NO: 217217 - RNA, 32 nt, Human
guuugucaguucucaauuuccuguguuugcaa

SEQ ID NO: 217218 - RNA, 32 nt, Human
guuugucaucccugggucuaggaaauagucaa

SEQ ID NO: 217219 - RNA, 32 nt, Human
guuugucaugcugacacugaugacagagguga

SEQ ID NO: 217220 - RNA, 32 nt, Human
guuugucauucuuaucuccagccugggaaaag

SEQ ID NO: 217221 - RNA, 32 nt, Human
guuuguccaagcaauuggaugugugcaguagc

SEQ ID NO: 217222 - RNA, 32 nt, Human
guuuguccacgacccaggcuggacgaaugccu

SEQ ID NO: 217223 - RNA, 32 nt, Human
guuuguccagccucuaacauuguccagcacuu

SEQ ID NO: 217224 - RNA, 32 nt, Human
guuuguccaguucuuuguucaacacgccaaga

SEQ ID NO: 217225 - RNA, 32 nt, Human
guuugucccaggaggacauagucaggagccca

SEQ ID NO: 217226 - RNA, 32 nt, Human
guuugucccaggcucgggggcucagugggagu

SEQ ID NO: 217227 - RNA, 32 nt, Human
guuuguccuugcaggacagggugcaggcagau

SEQ ID NO: 217228 - RNA, 32 nt, Human
guuugucgccaggcuggagugcaguggugcca

SEQ ID NO: 217229 - RNA, 32 nt, Human
guuugucgugggcucccaagugccuaggccau

SEQ ID NO: 217230 - RNA, 32 nt, Human
guuugucuaaagaccugugucuaaagaccugg

SEQ ID NO: 217231 - RNA, 32 nt, Human
guuugucuacuuccuccugcuuccccgccgcc

SEQ ID NO: 217232 - RNA, 32 nt, Human
guuugucuagaagaguagauugcuugauuaaa

SEQ ID NO: 217233 - RNA, 32 nt, Human
guuugucucaaucugacccagcggcuggaccc

SEQ ID NO: 217234 - RNA, 32 nt, Human
guuugucucauggauauauugccugugccgag

SEQ ID NO: 217235 - RNA, 18 nt, Human
guuugucugaugugcaca

SEQ ID NO: 217236 - RNA, 32 nt, Human
guuugucuggaaagccucuugagaugggguua

SEQ ID NO: 217237 - RNA, 32 nt, Human
guuugucuuuaaauaguuacagaagggauacg

SEQ ID NO: 217238 - RNA, 31 nt, Human
guuugugaacagagagaagaaguugcaagug

SEQ ID NO: 217239 - RNA, 32 nt, Human
guuugugaagauagagugaaauucaguaccac

SEQ ID NO: 217240 - RNA, 32 nt, Human
guuugugaccagaccagauuacagagggguau

SEQ ID NO: 217241 - RNA, 32 nt, Human
guuugugaccagccuggccaacauagugaaau

SEQ ID NO: 217242 - RNA, 32 nt, Human
guuugugacugauggagaauuucaggaaugaa

SEQ ID NO: 217243 - RNA, 32 nt, Human
guuugugagagcccagucauuguacuguuuuu

SEQ ID NO: 217244 - RNA, 32 nt, Human
guuugugagugugagagggucauauaggugca

SEQ ID NO: 217245 - RNA, 24 nt, Human
guuugugaguguguauuugagaga

SEQ ID NO: 217246 - RNA, 32 nt, Human
guuugugauauggcagaaucugucuccauugg

SEQ ID NO: 217247 - RNA, 32 nt, Human
guuugugaucacugugagucucagaugauuau

SEQ ID NO: 217248 - RNA, 31 nt, Human
guuugugaugaaggaacugcucaucuaagca

SEQ ID NO: 217249 - RNA, 32 nt, Human
guuugugauguuuucugacaguagccuccaag

SEQ ID NO: 217250 - RNA, 32 nt, Human
guuugugcacagaacuguggauguuugucaca

SEQ ID NO: 217251 - RNA, 32 nt, Human
guuugugccaagcgggcuuuccauugaccuuc

SEQ ID NO: 217252 - RNA, 32 nt, Human
guuugugccucacacuccagccuggguaacag

SEQ ID NO: 217253 - RNA, 32 nt, Human
guuugugcuaggaguuggcaaugaacacuguu

SEQ ID NO: 217254 - RNA, 32 nt, Human
guuugugcuguaagccuccaucuuguuuuaca

SEQ ID NO: 217255 - RNA, 32 nt, Human
guuugugcuucaaagucauugaugcaacuuga

SEQ ID NO: 217256 - RNA, 32 nt, Human
guuugugcuucauuaaggugaacucaucucuc

SEQ ID NO: 217257 - RNA, 32 nt, Human
guuugugcuuuuucccccuccuuaccugaccc

SEQ ID NO: 217258 - RNA, 32 nt, Human
guuuguggauuucauugugauuuauaauaagg

SEQ ID NO: 217259 - RNA, 32 nt, Human
guuuguggauuugagagaagauugggaugguc

SEQ ID NO: 217260 - RNA, 32 nt, Human
guuuguggcauacaaccugagccuuuucuuau

SEQ ID NO: 217261 - RNA, 32 nt, Human
guuuguggcggaagacggggcccagcggcucc

SEQ ID NO: 217262 - RNA, 32 nt, Human
guuuguggcucucagcucucaaggcuguuuuc

SEQ ID NO: 217263 - RNA, 32 nt, Human
guuugugggagccuggcuggaaacuuuuaagu

SEQ ID NO: 217264 - RNA, 32 nt, Human
guuugugggcaguuuucauaugcucugugaaa

SEQ ID NO: 217265 - RNA, 32 nt, Human
guuuguggggaaaaggaaagaugggggacacu

SEQ ID NO: 217266 - RNA, 32 nt, Human
guuuguggggcugaaaccccaucccuaaaaua

SEQ ID NO: 217267 - RNA, 32 nt, Human
guuuguggucagcacaacaaggaacaaaacaa

SEQ ID NO: 217268 - RNA, 32 nt, Human
guuuguggucuagcucccagggccaggccagg

SEQ ID NO: 217269 - RNA, 32 nt, Human
guuugugguuuuucccccucuuuggcuggugg

SEQ ID NO: 217270 - RNA, 32 nt, Human
guuuguguagccaagaggacagaauuacauga

SEQ ID NO: 217271 - RNA, 32 nt, Human
guuugugucaaauuauaguuacagugaguugu

SEQ ID NO: 217272 - RNA, 32 nt, Human
guuugugucucucugcugucauguuuucuacc

SEQ ID NO: 217273 - RNA, 32 nt, Human
guuuguguguuuuguacacuuagggauauaua

SEQ ID NO: 217274 - RNA, 32 nt, Human
guuuguguuagacaauuugcccaacuguagga

SEQ ID NO: 217275 - RNA, 32 nt, Human
guuuguuaccagccugggcaacauagugagac

SEQ ID NO: 217276 - RNA, 32 nt, Human
guuuguucacaguuuugucuuccaauacuuug

SEQ ID NO: 217277 - RNA, 32 nt, Human
guuuguucaguguggaguauauucagcaguau

SEQ ID NO: 217278 - RNA, 32 nt, Human
guuuguucauucucugcuuuauucucuccaug

SEQ ID NO: 217279 - RNA, 32 nt, Human
guuuguuccccuucaccgcucucccucucauu

SEQ ID NO: 217280 - RNA, 32 nt, Human
guuuguucuaauuccccaaccuugccacgacu

SEQ ID NO: 217281 - RNA, 32 nt, Human
guuuguucuagaugagugucucaggccaccgg

SEQ ID NO: 217282 - RNA, 32 nt, Human
guuuguucugcuucucuucauauaacugagcu

SEQ ID NO: 217283 - RNA, 20 nt, Human
guuuguucuuguauacagug

SEQ ID NO: 217284 - RNA, 32 nt, Human
guuuguugaggguguggggugugccccaccug

SEQ ID NO: 217285 - RNA, 32 nt, Human
guuuguugagguggaggaacagaagugaaaug

SEQ ID NO: 217286 - RNA, 32 nt, Human
guuuguugcccaggcuggagugaguggcacag

SEQ ID NO: 217287 - RNA, 32 nt, Human
guuuguuggaaaugccucguugccagagaaac

SEQ ID NO: 217288 - RNA, 32 nt, Human
guuuguuugaagcacuucgucuuacccauuua

SEQ ID NO: 217289 - RNA, 32 nt, Human
guuuguuuuagacaagagucucgcuuuguugc

SEQ ID NO: 217290 - RNA, 32 nt, Human
guuuguuuuccuuuuauuucuucaccagauuu

SEQ ID NO: 217291 - RNA, 32 nt, Human
guuuguuuucuaaagggcaugccaaguccugc

SEQ ID NO: 217292 - RNA, 32 nt, Human
guuuguuuucuuauuuucuuuuuaauuaaaaa

SEQ ID NO: 217293 - RNA, 32 nt, Human
guuuguuuugagaaggcguuucgcucuuguug

SEQ ID NO: 217294 - RNA, 32 nt, Human
guuuguuuugagacagaaucuugaucuguuac

SEQ ID NO: 217295 - RNA, 32 nt, Human
guuuguuuugagacagagucuugcucugucac

SEQ ID NO: 217296 - RNA, 32 nt, Human
guuuguuuugagacagagucuugcucugucgc

SEQ ID NO: 217297 - RNA, 32 nt, Human
guuuguuuugagacagucuggcccugucgccc

SEQ ID NO: 217298 - RNA, 32 nt, Human
guuuguuuugagacggagucuugcucagucgc

SEQ ID NO: 217299 - RNA, 32 nt, Human
guuuguuuugagacgggaguuucucucuuguc

SEQ ID NO: 217300 - RNA, 32 nt, Human
guuuguuuugagacggggucucgcucugucac

SEQ ID NO: 217301 - RNA, 32 nt, Human
guuuguuuugagacuccagucugggugucaga

SEQ ID NO: 217302 - RNA, 32 nt, Human
guuuguuuugagagagagucuugcucugucuc

SEQ ID NO: 217303 - RNA, 32 nt, Human
guuuguuuugagauggagucucacucugucac

SEQ ID NO: 217304 - RNA, 32 nt, Human
guuuguuuugagauggagucuugcccugucac

SEQ ID NO: 217305 - RNA, 32 nt, Human
guuuguuuugaggcacaaugaaacuuuagcca

SEQ ID NO: 217306 - RNA, 32 nt, Human
guuuguuuuguuuuaggcuuuuugccaaauac

SEQ ID NO: 217307 - RNA, 32 nt, Human
guuuguuuuuauuuuuggcuuuaugucuauac

SEQ ID NO: 217308 - RNA, 32 nt, Human
  misc_feature (5)..(5): n is a, c, g or u
guuunuguaacuuccuguggagugcaaauaga

SEQ ID NO: 217309 - RNA, 32 nt, Human
guuuuaaaccaccaaaccaauauuuuuccuuu

SEQ ID NO: 217310 - RNA, 32 nt, Human
guuuuaaacucauuuuugccauacaucaguua

SEQ ID NO: 217311 - RNA, 32 nt, Human
guuuuaaacuuuacaggcugggcaaaggauuu

SEQ ID NO: 217312 - RNA, 32 nt, Human
guuuuaaagauaagcacauggguaaaaaugag

SEQ ID NO: 217313 - RNA, 32 nt, Human
guuuuaaagaugaauccgaauuuggaagacuu

SEQ ID NO: 217314 - RNA, 32 nt, Human
guuuuaaaucuucugucucccugcuuuucuaa

SEQ ID NO: 217315 - RNA, 19 nt, Human
guuuuaaaugcuaugcagu

SEQ ID NO: 217316 - RNA, 18 nt, Human
guuuuaaauuuuuucccc

SEQ ID NO: 217317 - RNA, 32 nt, Human
guuuuaacauaguaaauccucuuuuugaugag

SEQ ID NO: 217318 - RNA, 32 nt, Human
guuuuaacccagaagacaggcugcagugagcc

SEQ ID NO: 217319 - RNA, 32 nt, Human
guuuuaaccugggaaguguucuuccugccuuu

SEQ ID NO: 217320 - RNA, 32 nt, Human
guuuuaaccuuaauaaaaaugggucuaucaga

SEQ ID NO: 217321 - RNA, 32 nt, Human
guuuuaacugaagugugagaaggagguuuaag

SEQ ID NO: 217322 - RNA, 32 nt, Human
guuuuaacugcaacugcuuuggcuaccaguuu

SEQ ID NO: 217323 - RNA, 21 nt, Human
guuuuaacugggaggcccaga

SEQ ID NO: 217324 - RNA, 32 nt, Human
guuuuaagagaucccuuccuuccucuucggug

SEQ ID NO: 217325 - RNA, 32 nt, Human
guuuuaagauagagccucgcucuguugcccag

SEQ ID NO: 217326 - RNA, 32 nt, Human
guuuuaagcuggaccauaaagcagaggggaau

SEQ ID NO: 217327 - RNA, 32 nt, Human
guuuuaaggagaagacuugaaugaaguuggag

SEQ ID NO: 217328 - RNA, 32 nt, Human
guuuuaagggagcggugugggagugggaaagu

SEQ ID NO: 217329 - RNA, 32 nt, Human
guuuuaagguggagagggaggagaagccugaa

SEQ ID NO: 217330 - RNA, 32 nt, Human
guuuuaaguuguuucuggguaagggagauguu

SEQ ID NO: 217331 - RNA, 32 nt, Human
guuuuaaguuuaccuagugacugacuacucuc

SEQ ID NO: 217332 - RNA, 32 nt, Human
guuuuaauaaggauuuuugagaaacaaauaac

SEQ ID NO: 217333 - RNA, 32 nt, Human
guuuuaaucaguccgccauaaaaagcuccucc

SEQ ID NO: 217334 - RNA, 32 nt, Human
guuuuaauguauacugaauuauaggaauccaa

SEQ ID NO: 217335 - RNA, 32 nt, Human
guuuuaauucuaggauucuggaaacagagaca

SEQ ID NO: 217336 - RNA, 32 nt, Human
guuuuacaaagucauuuuaagaaagcaagaua

SEQ ID NO: 217337 - RNA, 32 nt, Human
guuuuacacaacacugugaauguaaugaaugc

SEQ ID NO: 217338 - RNA, 32 nt, Human
guuuuacacagcaaaggaaaccaugacaaaau

SEQ ID NO: 217339 - RNA, 32 nt, Human
guuuuacacaugcucuucauauaaaugcuaca

SEQ ID NO: 217340 - RNA, 32 nt, Human
guuuuacagauggggcaaaaggaggcccagag

SEQ ID NO: 217341 - RNA, 32 nt, Human
guuuuacaguguuucucaucaucuguuuccca

SEQ ID NO: 217342 - RNA, 32 nt, Human
guuuuacauacucauuaguaagugggaggucc

SEQ ID NO: 217343 - RNA, 32 nt, Human
guuuuacaugaucugauacaaccauuaaugaa

SEQ ID NO: 217344 - RNA, 32 nt, Human
guuuuaccaagugcugucuugaugacugcuga

SEQ ID NO: 217345 - RNA, 32 nt, Human
guuuuaccagggauccagagacauagaggaag

SEQ ID NO: 217346 - RNA, 32 nt, Human
guuuuaccucuaaauaaaugaauucagagaaa

SEQ ID NO: 217347 - RNA, 32 nt, Human
guuuuacuauuuuaaagugggcguuaggagca

SEQ ID NO: 217348 - RNA, 32 nt, Human
guuuuacucaucucccccuccauugauuagcc

SEQ ID NO: 217349 - RNA, 32 nt, Human
guuuuagaaacaugaguccggacuguguaagu

SEQ ID NO: 217350 - RNA, 32 nt, Human
guuuuagaacacaucagagguauuucugcugu

SEQ ID NO: 217351 - RNA, 32 nt, Human
guuuuagaagguucucuccuccccaaggagac

SEQ ID NO: 217352 - RNA, 32 nt, Human
guuuuagacuuagguggguagcaaugccagua

SEQ ID NO: 217353 - RNA, 32 nt, Human
guuuuagagacagggucuugcucugucgcccg

SEQ ID NO: 217354 - RNA, 32 nt, Human
guuuuagagagugacaguuacaguuguaacaa

SEQ ID NO: 217355 - RNA, 32 nt, Human
guuuuagaguccaguucuagagacuccucagc

SEQ ID NO: 217356 - RNA, 32 nt, Human
guuuuagaguguguuuauucuucucuacuuga

SEQ ID NO: 217357 - RNA, 32 nt, Human
guuuuagauuucuaugaaggcuuucauuugua

SEQ ID NO: 217358 - RNA, 32 nt, Human
guuuuagccaaagaaaaagaagagaggcuuuu

SEQ ID NO: 217359 - RNA, 32 nt, Human
guuuuagcuaccaacggccaggaaaagcccuc

SEQ ID NO: 217360 - RNA, 32 nt, Human
guuuuagcugcagccuuggaaggaggcaccga

SEQ ID NO: 217361 - RNA, 32 nt, Human
guuuuaggacaucaacccuccgagaaaaggca

SEQ ID NO: 217362 - RNA, 32 nt, Human
guuuuaggagggaaugagccucagggaggagu

SEQ ID NO: 217363 - RNA, 32 nt, Human
guuuuagggaaagaggccuauggaaucccuua

SEQ ID NO: 217364 - RNA, 32 nt, Human
guuuuagggaacagaagaggagcacauauuua

SEQ ID NO: 217365 - RNA, 32 nt, Human
guuuuaggggcagauaguuaggucaggaaaaa

SEQ ID NO: 217366 - RNA, 32 nt, Human
guuuuaggucucaaaauauaacucggcuguuu

SEQ ID NO: 217367 - RNA, 32 nt, Human
guuuuagguuccaacuguguuagacaugaguu

SEQ ID NO: 217368 - RNA, 32 nt, Human
guuuuaguagcuugaggcaagguggaggggca

SEQ ID NO: 217369 - RNA, 32 nt, Human
guuuuaguugagaauauaauguuccagcuuag

SEQ ID NO: 217370 - RNA, 30 nt, Human
guuuuaguuuaaaaaucagaaagacauucu

SEQ ID NO: 217371 - RNA, 32 nt, Human
guuuuaguuuagauacgagguguugguagcau

SEQ ID NO: 217372 - RNA, 32 nt, Human
guuuuaguuucagggcacacaggacagcagaa

SEQ ID NO: 217373 - RNA, 32 nt, Human
guuuuaguuuuuaaaauaucuuuugaccugug

SEQ ID NO: 217374 - RNA, 32 nt, Human
guuuuauaaaguguggucagaggccccuauag

SEQ ID NO: 217375 - RNA, 32 nt, Human
guuuuauacucagaaaaggaaaaagaagcaaa

SEQ ID NO: 217376 - RNA, 32 nt, Human
guuuuauauuugcuuauuuaagguacauuucu

SEQ ID NO: 217377 - RNA, 32 nt, Human
guuuuaucaagucacuguuaaguagaagaaag

SEQ ID NO: 217378 - RNA, 32 nt, Human
guuuuaucagcagcaggaaggaugugggacuc

SEQ ID NO: 217379 - RNA, 32 nt, Human
guuuuauccacuuuucuuggauaaucaggagg

SEQ ID NO: 217380 - RNA, 22 nt, Human
guuuuauccauguuauauauug

SEQ ID NO: 217381 - RNA, 32 nt, Human
guuuuaucccuccggccggcaggcugggcgca

SEQ ID NO: 217382 - RNA, 32 nt, Human
guuuuauccuuaucaauagugccaucauccac

SEQ ID NO: 217383 - RNA, 32 nt, Human
guuuuaucuaucuccuuaucuccugcccuguc

SEQ ID NO: 217384 - RNA, 32 nt, Human
guuuuaucuaucugucuuugcaagcagucuuc

SEQ ID NO: 217385 - RNA, 32 nt, Human
guuuuaucucccuugcuccccuuuaaacaccu

SEQ ID NO: 217386 - RNA, 32 nt, Human
guuuuaucuccuccccuugaauauggguggcu

SEQ ID NO: 217387 - RNA, 32 nt, Human
guuuuaucugauguaaguuuagcuacuccuga

SEQ ID NO: 217388 - RNA, 32 nt, Human
guuuuaucuucugcucuuucuucuuccacaca

SEQ ID NO: 217389 - RNA, 32 nt, Human
guuuuaugaauuuucaggcaaagcuuuaauuu

SEQ ID NO: 217390 - RNA, 32 nt, Human
guuuuaugacucugcugcaguuuguggaaaug

SEQ ID NO: 217391 - RNA, 32 nt, Human
guuuuaugauugcagcccucagccugggcugc

SEQ ID NO: 217392 - RNA, 32 nt, Human
guuuuaugcagggcauucuguauuccaaaugg

SEQ ID NO: 217393 - RNA, 32 nt, Human
guuuuauguacuuugauuuacagugccuguau

SEQ ID NO: 217394 - RNA, 32 nt, Human
guuuuauguauuacuuucaagaucccaacuag

SEQ ID NO: 217395 - RNA, 32 nt, Human
guuuuaugucaucuuugcugagcuccaccggg

SEQ ID NO: 217396 - RNA, 32 nt, Human
guuuuaugucugcuugcuuggagcucagugau

SEQ ID NO: 217397 - RNA, 32 nt, Human
guuuuauuauugcuugugccucaacuguuuaa

SEQ ID NO: 217398 - RNA, 32 nt, Human
guuuuauuauuuuugaauucauggagccauca

SEQ ID NO: 217399 - RNA, 32 nt, Human
guuuuauuguccauuuucugugaggauaugca

SEQ ID NO: 217400 - RNA, 32 nt, Human
guuuuauuuaauucuccuuuacauugccaccu

SEQ ID NO: 217401 - RNA, 32 nt, Human
guuuuauuucuuucucuugccugauugcucug

SEQ ID NO: 217402 - RNA, 32 nt, Human
guuuuauuuguagacauggacugugaaauaaa

SEQ ID NO: 217403 - RNA, 32 nt, Human
guuuuauuuugcagaagaauuggguauuuggu

SEQ ID NO: 217404 - RNA, 32 nt, Human
guuuucaaaacaaaagcaucuucccuagaaau

SEQ ID NO: 217405 - RNA, 32 nt, Human
guuuucaaaauuacuguaaugguuugugucug

SEQ ID NO: 217406 - RNA, 32 nt, Human
guuuucaaacacaaaguggauggugguaugag

SEQ ID NO: 217407 - RNA, 32 nt, Human
guuuucaaagaguucaaacuaaauaucuguca

SEQ ID NO: 217408 - RNA, 32 nt, Human
guuuucaaccaaagaagucacguaccacuggu

SEQ ID NO: 217409 - RNA, 24 nt, Human
guuuucaagagacugcuguaggug

SEQ ID NO: 217410 - RNA, 32 nt, Human
guuuucaaggaggugcuuaggauuguggguuu

SEQ ID NO: 217411 - RNA, 32 nt, Human
guuuucaaggggaaggucauuuguaaagcacg

SEQ ID NO: 217412 - RNA, 32 nt, Human
guuuucaaguacaagucuuuugcuuccuuaag

SEQ ID NO: 217413 - RNA, 20 nt, Human
guuuucaaugugaauuuguu

SEQ ID NO: 217414 - RNA, 32 nt, Human
guuuucacagcccccugagggaagggacgcag

SEQ ID NO: 217415 - RNA, 32 nt, Human
guuuucacaguuucagcacucaaccucaucau

SEQ ID NO: 217416 - RNA, 32 nt, Human
guuuucaccauguuagccaggcuggucucaaa

SEQ ID NO: 217417 - RNA, 32 nt, Human
guuuucaccauguugaccaggcuggucucgaa

SEQ ID NO: 217418 - RNA, 32 nt, Human
guuuucaccauguuggccaggcuggucucgaa

SEQ ID NO: 217419 - RNA, 32 nt, Human
guuuucaccauguuggccaggcuggucuugaa

SEQ ID NO: 217420 - RNA, 32 nt, Human
guuuucaccauguuggcuaggcuggucuugaa

SEQ ID NO: 217421 - RNA, 32 nt, Human
guuuucacugaauucugagggugccucugcau

SEQ ID NO: 217422 - RNA, 32 nt, Human
guuuucacuuuaguuucuaaacuuuuuauccc

SEQ ID NO: 217423 - RNA, 32 nt, Human
guuuucacuuuuggucuccucuuccagaguca

SEQ ID NO: 217424 - RNA, 32 nt, Human
guuuucagaaaugccacuuuuguaagcaucag

SEQ ID NO: 217425 - RNA, 32 nt, Human
guuuucagagacaccauuuucuuucuaaacuu

SEQ ID NO: 217426 - RNA, 32 nt, Human
guuuucagagugugaggaagggagggaccauu

SEQ ID NO: 217427 - RNA, 32 nt, Human
guuuucagaguuuacagcgucaauuguacuga

SEQ ID NO: 217428 - RNA, 32 nt, Human
guuuucagaugaagccauaaggcuuuggaguu

SEQ ID NO: 217429 - RNA, 32 nt, Human
guuuucagcagucugugcugugccuggaugua

SEQ ID NO: 217430 - RNA, 32 nt, Human
guuuucagcccuccucaggguggcucucagca

SEQ ID NO: 217431 - RNA, 32 nt, Human
guuuucagccuauggaaugauuuccuuuuguc

SEQ ID NO: 217432 - RNA, 32 nt, Human
guuuucagccuccucaugccuccgucuccuuu

SEQ ID NO: 217433 - RNA, 18 nt, Human
guuuucagccuggcagug

SEQ ID NO: 217434 - RNA, 32 nt, Human
guuuucaggacugggcccugauugauaacacc

SEQ ID NO: 217435 - RNA, 32 nt, Human
guuuucaguaguacaggcuucuugccgauaug

SEQ ID NO: 217436 - RNA, 32 nt, Human
guuuucaguauuaugacaguaucugcagauac

SEQ ID NO: 217437 - RNA, 32 nt, Human
guuuucagucagggagcaugugcauuguuugu

SEQ ID NO: 217438 - RNA, 32 nt, Human
guuuucagucauugauuccugggugucuugcu

SEQ ID NO: 217439 - RNA, 32 nt, Human
guuuucagugagugaguuaacaauaaaagcuu

SEQ ID NO: 217440 - RNA, 32 nt, Human
guuuucaguguuugguaaacagccaggguccg

SEQ ID NO: 217441 - RNA, 32 nt, Human
guuuucaguuaaagcccuaucugcacuuuuua

SEQ ID NO: 217442 - RNA, 20 nt, Human
guuuucaguuguaugcagug

SEQ ID NO: 217443 - RNA, 32 nt, Human
guuuucauaagaaauugucccuggagguguug

SEQ ID NO: 217444 - RNA, 32 nt, Human
guuuucauaauggguguuuauaugaaacuacu

SEQ ID NO: 217445 - RNA, 32 nt, Human
guuuucaucagugccuguaucuguggucagca

SEQ ID NO: 217446 - RNA, 32 nt, Human
guuuucaucucuagggaccagaaccaaaccca

SEQ ID NO: 217447 - RNA, 25 nt, Human
guuuucaucuggugucuuuuauuua

SEQ ID NO: 217448 - RNA, 32 nt, Human
guuuucaugaaacugaguguuucuguggacca

SEQ ID NO: 217449 - RNA, 31 nt, Human
guuuucaugaagaggagugaaaagccagaag

SEQ ID NO: 217450 - RNA, 32 nt, Human
guuuucaugaguuuuccccacucugaagcugu

SEQ ID NO: 217451 - RNA, 32 nt, Human
guuuucauucuuccucugccacaugaggccac

SEQ ID NO: 217452 - RNA, 32 nt, Human
guuuucauuugaaaaagaauaucuuucuuccu

SEQ ID NO: 217453 - RNA, 32 nt, Human
guuuucauuuggaacgucuuuuaaaaggaaaa

SEQ ID NO: 217454 - RNA, 32 nt, Human
guuuucauuuuauucuggucucagggccauac

SEQ ID NO: 217455 - RNA, 32 nt, Human
guuuucauuuuccuccaaaguugaauuuugcu

SEQ ID NO: 217456 - RNA, 32 nt, Human
guuuucauuuuuaaaaauuuaggaugaaggaa

SEQ ID NO: 217457 - RNA, 32 nt, Human
uaacuagaccuagacuuucuacuccaaucagg

SEQ ID NO: 217458 - RNA, 32 nt, Human
uaacuagacugcagcuaaccaccaccaacagc

SEQ ID NO: 217459 - RNA, 24 nt, Human
uaacuagccagacccaucccuuua

SEQ ID NO: 217460 - RNA, 31 nt, Human
uaacuagcuaguaggcuuucacuggaaaguu

SEQ ID NO: 217461 - RNA, 21 nt, Human
uaacuagguuuuacauggaag

SEQ ID NO: 217462 - RNA, 32 nt, Human
uaacuaguccgccccaccacacuccccgccug

SEQ ID NO: 217463 - RNA, 32 nt, Human
uaacuagucuaccagugaccucagggcacuuu

SEQ ID NO: 217464 - RNA, 32 nt, Human
uaacuaguguuucugcagaggcagcaggagcc

SEQ ID NO: 217465 - RNA, 32 nt, Human
uaacuaguuaccuggguaaaagcgcuaacgac

SEQ ID NO: 217466 - RNA, 32 nt, Human
uaacuaguuuuguaauuucuguauuuaauugu

SEQ ID NO: 217467 - RNA, 32 nt, Human
uaacuauacaucuuugcucuuaacuccaaguc

SEQ ID NO: 217468 - RNA, 32 nt, Human
uaacuauagccuagagaaaagaggguugaaga

SEQ ID NO: 217469 - RNA, 32 nt, Human
uaacuauauaaauauuaaagauaaucaauacg

SEQ ID NO: 217470 - RNA, 32 nt, Human
uaacuauauuguuaauaucuucccucugacag

SEQ ID NO: 217471 - RNA, 32 nt, Human
uaacuaucccaggguuauguagcaaacaggug

SEQ ID NO: 217472 - RNA, 32 nt, Human
uaacuaucuuauguuucuagucuuucaagcuu

SEQ ID NO: 217473 - RNA, 32 nt, Human
uaacuaugaaaaucauuaugucauuccauaau

SEQ ID NO: 217474 - RNA, 32 nt, Human
uaacuaugacaucaaugguaggaaccugaagc

SEQ ID NO: 217475 - RNA, 21 nt, Human
uaacuaugacuagacauguua

SEQ ID NO: 217476 - RNA, 32 nt, Human
uaacuaugacuuuggucuuaagcaauuuucuu

SEQ ID NO: 217477 - RNA, 32 nt, Human
uaacuaugagacacaucuuguuuuacugaauu

SEQ ID NO: 217478 - RNA, 32 nt, Human
uaacuauuagguuagugcaaaaguaauugcgg

SEQ ID NO: 217479 - RNA, 32 nt, Human
uaacuauuuccuuuucuuguugaauaccuuag

SEQ ID NO: 217480 - RNA, 32 nt, Human
uaacucaacauggcaugccuuucucuccguaa

SEQ ID NO: 217481 - RNA, 32 nt, Human
uaacucaacccgcuucccagcacagcggcuuu

SEQ ID NO: 217482 - RNA, 32 nt, Human
uaacucaagaggacagaggcuggugaggaggu

SEQ ID NO: 217483 - RNA, 32 nt, Human
uaacucaagaggacagaggcuggugggaggua

SEQ ID NO: 217484 - RNA, 32 nt, Human
uaacucaauccucauucucugccuccuggacc

SEQ ID NO: 217485 - RNA, 32 nt, Human
uaacucaaugaaaaaguugaugcccaagggag

SEQ ID NO: 217486 - RNA, 32 nt, Human
uaacucaauuaugucagccacaggugaauuac

SEQ ID NO: 217487 - RNA, 32 nt, Human
uaacucacgccuguaaucccagcacuuaggaa

SEQ ID NO: 217488 - RNA, 32 nt, Human
uaacucacugagccucuuaauauugccaugau

SEQ ID NO: 217489 - RNA, 32 nt, Human
uaacucacugcaaccuccgcuucccagguaau

SEQ ID NO: 217490 - RNA, 32 nt, Human
uaacucacuguuucuaagccuccuggaccaug

SEQ ID NO: 217491 - RNA, 32 nt, Human
uaacucagaucucacagguugaagacucaguc

SEQ ID NO: 217492 - RNA, 32 nt, Human
uaacucagcuucuaguauuucaagaugacauc

SEQ ID NO: 217493 - RNA, 32 nt, Human
uaacucagcuuugguacuggaggggaauugga

SEQ ID NO: 217494 - RNA, 32 nt, Human
uaacucaggcuggagugcaguggcgcgaucug

SEQ ID NO: 217495 - RNA, 32 nt, Human
uaacucaguaauuucaaaauacagauuugaau

SEQ ID NO: 217496 - RNA, 32 nt, Human
uaacucaugccugacaucucagcacuucagga

SEQ ID NO: 217497 - RNA, 32 nt, Human
uaacucaugcucccuccacuuccccagaggag

SEQ ID NO: 217498 - RNA, 32 nt, Human
uaacucauuuaaggagcuaccccagccaucau

SEQ ID NO: 217499 - RNA, 32 nt, Human
uaacucauuuccaggauucuggcauuguagac

SEQ ID NO: 217500 - RNA, 32 nt, Human
uaacuccaacucuaaagcuaacuccuaacccu

SEQ ID NO: 217501 - RNA, 32 nt, Human
uaacuccaagaguccaaaggccaaagaaccug

SEQ ID NO: 217502 - RNA, 32 nt, Human
uaacuccaagccuuaaaauucccaaauggagu

SEQ ID NO: 217503 - RNA, 32 nt, Human
uaacuccacuggcuccaugauucucugagugg

SEQ ID NO: 217504 - RNA, 32 nt, Human
uaacuccagaaaaggguggcugcagauggagc

SEQ ID NO: 217505 - RNA, 32 nt, Human
uaacuccagcaaggaaauggccaguuaaguag

SEQ ID NO: 217506 - RNA, 32 nt, Human
uaacuccagcacuuugggaggccgaggugggu

SEQ ID NO: 217507 - RNA, 32 nt, Human
uaacuccagcuacuugggaggcugaggcagga

SEQ ID NO: 217508 - RNA, 32 nt, Human
uaacuccauagagaggaaugacaggcugggcc

SEQ ID NO: 217509 - RNA, 32 nt, Human
uaacuccauuacacucucucuccuggagccuc

SEQ ID NO: 217510 - RNA, 32 nt, Human
uaacucccaguucugagaagagccauaggagu

SEQ ID NO: 217511 - RNA, 32 nt, Human
uaacucccauuuugauuccaggaaaaguguaa

SEQ ID NO: 217512 - RNA, 32 nt, Human
uaacuccccacuuccuccugcaccaccacggg

SEQ ID NO: 217513 - RNA, 32 nt, Human
uaacuccccuaaaaacucccuaggaaguaaca

SEQ ID NO: 217514 - RNA, 32 nt, Human
uaacuccccucagggauacgacacaugcccau

SEQ ID NO: 217515 - RNA, 32 nt, Human
uaacuccccucggggauacgacacaugcccau

SEQ ID NO: 217516 - RNA, 32 nt, Human
uaacucccugcucucagcccugaugacuacac

SEQ ID NO: 217517 - RNA, 32 nt, Human
uaacucccuuucucccuucccuucucccgguc

SEQ ID NO: 217518 - RNA, 32 nt, Human
uaacuccgcccugacccacccuucccgaugca

SEQ ID NO: 217519 - RNA, 32 nt, Human
uaacuccucaauuccaacacugauuuccccuu

SEQ ID NO: 217520 - RNA, 32 nt, Human
uaacuccuccuccuccucucuucuccucuggu

SEQ ID NO: 217521 - RNA, 32 nt, Human
uaacuccuccuccuuacuccccaacacccucc

SEQ ID NO: 217522 - RNA, 32 nt, Human
uaacuccugauggugauccacccaccucggcc

SEQ ID NO: 217523 - RNA, 32 nt, Human
uaacuccugccuccacacauguucuugacuga

SEQ ID NO: 217524 - RNA, 32 nt, Human
uaacuccuguaaccccagcucuuugggaggcc

SEQ ID NO: 217525 - RNA, 32 nt, Human
uaacuccuuuaaucccaggcaucuguugggac

SEQ ID NO: 217526 - RNA, 32 nt, Human
uaacucgaaaaguugugauuuagaagacagga

SEQ ID NO: 217527 - RNA, 32 nt, Human
uaacucuaaagcuccauguccugggccuaaaa

SEQ ID NO: 217528 - RNA, 32 nt, Human
uaacucucagauuaaucucugucauccaucgc

SEQ ID NO: 217529 - RNA, 32 nt, Human
uaacucuccauauucucuauucauacauauau

SEQ ID NO: 217530 - RNA, 32 nt, Human
uaacucucccucauuugcuuugcccacagccu

SEQ ID NO: 217531 - RNA, 32 nt, Human
uaacucucucccgcucugccuucccuccuucc

SEQ ID NO: 217532 - RNA, 32 nt, Human
uaacucuguaauggaauaguuugcugccaacu

SEQ ID NO: 217533 - RNA, 32 nt, Human
uaacucugugaccuugaaugcaucauuucccc

SEQ ID NO: 217534 - RNA, 32 nt, Human
uaacucugugagguuacugagauuugagcugu

SEQ ID NO: 217535 - RNA, 32 nt, Human
uaacucugugaguaugcucuucugcccaaaaa

SEQ ID NO: 217536 - RNA, 32 nt, Human
uaacucuuccuuguagggcccuuuccuuauuc

SEQ ID NO: 217537 - RNA, 32 nt, Human
uaacucuucuuccucguccucuuccauaaggc

SEQ ID NO: 217538 - RNA, 32 nt, Human
uaacucuugcugcugcucacuguuugggucca

SEQ ID NO: 217539 - RNA, 32 nt, Human
uaacucuuguccaggcuggaggagugcagucg

SEQ ID NO: 217540 - RNA, 32 nt, Human
uaacucuuuacaugaucugugagcaccugcuu

SEQ ID NO: 217541 - RNA, 32 nt, Human
uaacucuuugugaauggaaccaaugugcaaga

SEQ ID NO: 217542 - RNA, 32 nt, Human
uaacucuuuugcccuucucuucugccagugaa

SEQ ID NO: 217543 - RNA, 32 nt, Human
uaacugaaagagaaucggugcuaagagcuuuu

SEQ ID NO: 217544 - RNA, 21 nt, Human
uaacugaaggaccccagggga

SEQ ID NO: 217545 - RNA, 32 nt, Human
uaacugaauggcaccaaaaggcauauuggggu

SEQ ID NO: 217546 - RNA, 19 nt, Human
uaacugacaaaccauugaa

SEQ ID NO: 217547 - RNA, 32 nt, Human
uaacugacccuugacaaucuugucagcaauau

SEQ ID NO: 217548 - RNA, 32 nt, Human
uaacugagacaagauuucgccauguugcccag

SEQ ID NO: 217549 - RNA, 32 nt, Human
uaacugagcauuuucucaacucgacucucauu

SEQ ID NO: 217550 - RNA, 32 nt, Human
uaacugagcuaacauaaaauaacucuagguuu

SEQ ID NO: 217551 - RNA, 32 nt, Human
uaacugaguuuuaaagccaaacugacugagga

SEQ ID NO: 217552 - RNA, 32 nt, Human
uaacugaugcagauguacuucuucagugugau

SEQ ID NO: 217553 - RNA, 32 nt, Human
uaacugaugcuacugagccgauggagcguggu

SEQ ID NO: 217554 - RNA, 19 nt, Human
uaacugauguaaccauuga

SEQ ID NO: 217555 - RNA, 32 nt, Human
uaacugauuccaaugacauucauuuuguuuuc

SEQ ID NO: 217556 - RNA, 32 nt, Human
uaacugauuccucuccugacccuuuacuaaua

SEQ ID NO: 217557 - RNA, 32 nt, Human
uaacugcaacgagucaucucccugccacccau

SEQ ID NO: 217558 - RNA, 32 nt, Human
uaacugcaccccuucuugguccuuccuccaca

SEQ ID NO: 217559 - RNA, 32 nt, Human
uaacugcacgaugcugacaagacaaugccucc

SEQ ID NO: 217560 - RNA, 32 nt, Human
uaacugcagaauguacgcugucuucaguuaag

SEQ ID NO: 217561 - RNA, 19 nt, Human
uaacugcagacauucugaa

SEQ ID NO: 217562 - RNA, 17 nt, Human
uaacugcagaccaugaa

SEQ ID NO: 217563 - RNA, 19 nt, Human
uaacugcagauaaauuuga

SEQ ID NO: 217564 - RNA, 32 nt, Human
uaacugcagaugucucuacuuuguucuaaaau

SEQ ID NO: 217565 - RNA, 17 nt, Human
uaacugcagauugugaa

SEQ ID NO: 217566 - RNA, 32 nt, Human
uaacugcaggggaaugaagauuucuaguccuc

SEQ ID NO: 217567 - RNA, 19 nt, Human
uaacugcagugaagucuga

SEQ ID NO: 217568 - RNA, 17 nt, Human
uaacugcagugacuuga

SEQ ID NO: 217569 - RNA, 19 nt, Human
uaacugcaguuucaaugag

SEQ ID NO: 217570 - RNA, 32 nt, Human
uaacugcaucuuccacucagucacuacaaaaa

SEQ ID NO: 217571 - RNA, 32 nt, Human
uaacugcaucuucuccccuugccaccccaugg

SEQ ID NO: 217572 - RNA, 32 nt, Human
uaacugcaucuucucugaccccugguaccaga

SEQ ID NO: 217573 - RNA, 17 nt, Human
uaacugcaucuuuugga

SEQ ID NO: 217574 - RNA, 32 nt, Human
uaacugccagucccagcaccuccugaaagccc

SEQ ID NO: 217575 - RNA, 18 nt, Human
uaacugcgagccauugga

SEQ ID NO: 217576 - RNA, 31 nt, Human
uaacugcgguuucagccaacacucuucaugg

SEQ ID NO: 217577 - RNA, 32 nt, Human
uaacugcuacaaauacucuuaggaagagaaac

SEQ ID NO: 217578 - RNA, 32 nt, Human
uaacugcucugagcagagaugaguggugguug

SEQ ID NO: 217579 - RNA, 32 nt, Human
uaacuggaaucagcucaggacugccauuggac

SEQ ID NO: 217580 - RNA, 32 nt, Human
uaacuggaaugaacuccugaucccaaagccua

SEQ ID NO: 217581 - RNA, 32 nt, Human
uaacuggacaaggagaaaaacauagggaaaaa

SEQ ID NO: 217582 - RNA, 32 nt, Human
uaacuggacauggcagacacugcuuugaacaa

SEQ ID NO: 217583 - RNA, 32 nt, Human
uaacuggaguagcugggauuuacuaguagugu

SEQ ID NO: 217584 - RNA, 32 nt, Human
uaacuggaucugccacuuguuuggaaaauauc

SEQ ID NO: 217585 - RNA, 32 nt, Human
uaacuggcaaauagagcuguacucaguggccu

SEQ ID NO: 217586 - RNA, 32 nt, Human
uaacuggccauccugguuuugcagagaucagg

SEQ ID NO: 217587 - RNA, 32 nt, Human
uaacuggcccaggcacuggaguggaauagaau

SEQ ID NO: 217588 - RNA, 32 nt, Human
uaacuggccuccaucuugggucaucucaucuu

SEQ ID NO: 217589 - RNA, 32 nt, Human
uaacuggcugagaggaaguagagaugggguuu

SEQ ID NO: 217590 - RNA, 32 nt, Human
uaacuggcugcgcacagggagcugucaccaug

SEQ ID NO: 217591 - RNA, 32 nt, Human
uaacuggcugcucccugcucccagggacugac

SEQ ID NO: 217592 - RNA, 32 nt, Human
uaacugggaagagcugaagugggggccuggcu

SEQ ID NO: 217593 - RNA, 32 nt, Human
uaacugggagagggcaguaaggaggacuuccu

SEQ ID NO: 217594 - RNA, 32 nt, Human
uaacugggaggcacuucccaguaggggccaac

SEQ ID NO: 217595 - RNA, 32 nt, Human
uaacugggccagacuaccuuuuuauacuaggu

SEQ ID NO: 217596 - RNA, 32 nt, Human
uaacuggguaacuuauuggggcugggcaagca

SEQ ID NO: 217597 - RNA, 32 nt, Human
uaacuggguaacuuauuggggcugggcaugca

SEQ ID NO: 217598 - RNA, 32 nt, Human
uaacugguauguugaaguagugucuaaaagua

SEQ ID NO: 217599 - RNA, 32 nt, Human
uaacuggucauuaauuaugaacauuuacuucu

SEQ ID NO: 217600 - RNA, 32 nt, Human
uaacuggugccuucccuguacccgcagcagcc

SEQ ID NO: 217601 - RNA, 32 nt, Human
uaacugguucauccuuaccaguggccaagcac

SEQ ID NO: 217602 - RNA, 32 nt, Human
uaacugguuccugcaacccacuuuuaggucuc

SEQ ID NO: 217603 - RNA, 32 nt, Human
uaacugguugugacaaagcuuguuguugauca

SEQ ID NO: 217604 - RNA, 18 nt, Human
uaacuguauacacaugaa

SEQ ID NO: 217605 - RNA, 32 nt, Human
uaacuguccgcagcugucugcuagugguuguc

SEQ ID NO: 217606 - RNA, 32 nt, Human
uaacugugccagugcccauguuuacagaaguc

SEQ ID NO: 217607 - RNA, 32 nt, Human
uaacugugcuuccacugagcaagccagacaca

SEQ ID NO: 217608 - RNA, 32 nt, Human
uaacuguggauuuccaaaguucuggcuacaau

SEQ ID NO: 217609 - RNA, 32 nt, Human
uaacugugggcaaccugacugaugccgucuug

SEQ ID NO: 217610 - RNA, 32 nt, Human
uaacuguggugaggaccaacugcaacacugug

SEQ ID NO: 217611 - RNA, 32 nt, Human
uaacugugucaugauucacccccaaacaguga

SEQ ID NO: 217612 - RNA, 32 nt, Human
uaacugugugaccagcggaaacaggugugugu

SEQ ID NO: 217613 - RNA, 19 nt, Human
uaacugugugccuacugaa

SEQ ID NO: 217614 - RNA, 32 nt, Human
uaacuguugauugccaaacauuucacucugcu

SEQ ID NO: 217615 - RNA, 32 nt, Human
uaacuguuuaaccuuucuaaaucuuuucaaga

SEQ ID NO: 217616 - RNA, 32 nt, Human
uaacuuaaaagcuucuccucugagaaacauuu

SEQ ID NO: 217617 - RNA, 32 nt, Human
uaacuuaaagccauucaacaaggagucaagua

SEQ ID NO: 217618 - RNA, 32 nt, Human
uaacuuaaaggaugagaaaaugugguguagcu

SEQ ID NO: 217619 - RNA, 32 nt, Human
uaacuuaaguuccagaccagcuaguccaaauu

SEQ ID NO: 217620 - RNA, 23 nt, Human
uaacuuaauaaaaagaguugaga

SEQ ID NO: 217621 - RNA, 32 nt, Human
uaacuuaaugucuugucaaauacuuuuauuga

SEQ ID NO: 217622 - RNA, 32 nt, Human
uaacuuagaugauucccaaggacucuaauaaa

SEQ ID NO: 217623 - RNA, 32 nt, Human
uaacuuaucuuuuggagaacagcuuuaagugc

SEQ ID NO: 217624 - RNA, 32 nt, Human
uaacuuauugcuucccuuccuguuucugcaug

SEQ ID NO: 217625 - RNA, 23 nt, Human
uaacuucaacuccaucgccaaga

SEQ ID NO: 217626 - RNA, 32 nt, Human
uaacuucacaauuaccuuuucuagugcaguua

SEQ ID NO: 217627 - RNA, 32 nt, Human
uaacuucacugcaauucuguuucccucauuug

SEQ ID NO: 217628 - RNA, 32 nt, Human
uaacuucagagaagucaguuggagaaaaauga

SEQ ID NO: 217629 - RNA, 32 nt, Human
uaacuucagagaagucaguuggagaaaaugaa

SEQ ID NO: 217630 - RNA, 32 nt, Human
uaacuucaucuaaguccccagauggguacaau

SEQ ID NO: 217631 - RNA, 32 nt, Human
uaacuucaugcugucugugugaggcucccucc

SEQ ID NO: 217632 - RNA, 32 nt, Human
uaacuuccaagaggagaagggcucgggguugc

SEQ ID NO: 217633 - RNA, 32 nt, Human
uaacuuccagggucucagcaaacugcuguuuu

SEQ ID NO: 217634 - RNA, 32 nt, Human
uaacuucccaacaagauaguucugucuugcaa

SEQ ID NO: 217635 - RNA, 32 nt, Human
uaacuucccaacauuuaagaaaccccaauaga

SEQ ID NO: 217636 - RNA, 32 nt, Human
uaacuucgggaugcggaagugagggaaagucc

SEQ ID NO: 217637 - RNA, 32 nt, Human
uaacuucuaagaugauuucaucuucucauagu

SEQ ID NO: 217638 - RNA, 32 nt, Human
uaacuucucagagcuguucuccacuccugacu

SEQ ID NO: 217639 - RNA, 32 nt, Human
uaacuucucaguuauuuguaugucaggagaca

SEQ ID NO: 217640 - RNA, 32 nt, Human
uaacuucuuccuuaacaagaacauggagguga

SEQ ID NO: 217641 - RNA, 32 nt, Human
uaacuucuuuuaaauuagcuaacucuaaauga

SEQ ID NO: 217642 - RNA, 32 nt, Human
uaacuugagaugucugugguuguggggguguu

SEQ ID NO: 217643 - RNA, 32 nt, Human
uaacuugagccccagucucagaaauuaacaug

SEQ ID NO: 217644 - RNA, 32 nt, Human
uaacuugaucagauauaggacaugacacugaa

SEQ ID NO: 217645 - RNA, 32 nt, Human
uaacuugcacggcuuuaucacagcauuuuuaa

SEQ ID NO: 217646 - RNA, 32 nt, Human
uaacuugcaucuaggcugggcguggcggcuca

SEQ ID NO: 217647 - RNA, 32 nt, Human
uaacuugcgguggcaugacugucaggaggugc

SEQ ID NO: 217648 - RNA, 32 nt, Human
uaacuugcucugcuuguuuuggaaaaggcacu

SEQ ID NO: 217649 - RNA, 32 nt, Human
uaacuugcuuugacaaccuacugauguaacuu

SEQ ID NO: 217650 - RNA, 32 nt, Human
uaacuugggaaacugaaaguguucccauauag

SEQ ID NO: 217651 - RNA, 32 nt, Human
uaacuugggccauccuaucaucuggagcccua

SEQ ID NO: 217652 - RNA, 32 nt, Human
uaacuuguaaugaagacagaaauauguaugag

SEQ ID NO: 217653 - RNA, 32 nt, Human
uaacuugucaugcacugacacagcauucauga

SEQ ID NO: 217654 - RNA, 32 nt, Human
uaacuugucuuuuuacugcauaacucuccaga

SEQ ID NO: 217655 - RNA, 32 nt, Human
uaacuugugauccuuggccagaauuucuuucu

SEQ ID NO: 217656 - RNA, 32 nt, Human
uaacuugugcaagaucaaaugacaaauaacug

SEQ ID NO: 217657 - RNA, 32 nt, Human
uaacuugugccuguaauuccagcugcucugga

SEQ ID NO: 217658 - RNA, 32 nt, Human
uaacuuguguauugcauuccagcagaccacug

SEQ ID NO: 217659 - RNA, 32 nt, Human
uaacuuguucagaggcagagggugcaaaggag

SEQ ID NO: 217660 - RNA, 32 nt, Human
uaacuuuacaaaugucagcuaguuuugacuac

SEQ ID NO: 217661 - RNA, 32 nt, Human
uaacuuuaccaacauuggaaaacagccaacua

SEQ ID NO: 217662 - RNA, 32 nt, Human
uaacuuuacuauaugaaagcagcauaagagua

SEQ ID NO: 217663 - RNA, 32 nt, Human
uaacuuuaucuuaguaauguaaagauucagua

SEQ ID NO: 217664 - RNA, 32 nt, Human
uaacuuuaugacuacaaagaaaacauguuuuc

SEQ ID NO: 217665 - RNA, 32 nt, Human
uaacuuucaaugcuuguuaugggaaccaguuc

SEQ ID NO: 217666 - RNA, 32 nt, Human
uaacuuucaguuuuuggcuauuacaaauaaac

SEQ ID NO: 217667 - RNA, 32 nt, Human
uaacuuuccugaaggacuucccccucugccau

SEQ ID NO: 217668 - RNA, 32 nt, Human
uaacuuucucaccucugugccuuugugcaagc

SEQ ID NO: 217669 - RNA, 32 nt, Human
uaacuuucucacuaagugagaaugagaacugc

SEQ ID NO: 217670 - RNA, 32 nt, Human
uaacuuucugcagcuuuuccauagaagcccug

SEQ ID NO: 217671 - RNA, 32 nt, Human
uaacuuucuuuggucacauaauauuaaauuuu

SEQ ID NO: 217672 - RNA, 32 nt, Human
uaacuuuguccuguccuccaccuuucuauccc

SEQ ID NO: 217673 - RNA, 32 nt, Human
uaacuuuguucagguugcccuucaccauggau

SEQ ID NO: 217674 - RNA, 32 nt, Human
uaacuuuucacacauccagaugguuccacacu

SEQ ID NO: 217675 - RNA, 32 nt, Human
uaacuuuuccagaucuaacacuagcuuauucu

SEQ ID NO: 217676 - RNA, 32 nt, Human
uaacuuuugagugucaggauguuuggaaggac

SEQ ID NO: 217677 - RNA, 32 nt, Human
uaacuuuuuauuagcucuuccuaagggaaaug

SEQ ID NO: 217678 - RNA, 32 nt, Human
uaacuuuuuccagaucucaugucuggcuuaau

SEQ ID NO: 217679 - RNA, 32 nt, Human
uaacuuuuuccauccagcaacauccagacgau

SEQ ID NO: 217680 - RNA, 32 nt, Human
uaacuuuuuggacacccgugauuugcauacug

SEQ ID NO: 217681 - RNA, 32 nt, Human
uaagaaaaaccugaaauuaacuugugccacaa

SEQ ID NO: 217682 - RNA, 32 nt, Human
uaagaaaaagagaaggcucucuuuucucccuu

SEQ ID NO: 217683 - RNA, 32 nt, Human
uaagaaaaaggauugaaagggaccaaguagcu

SEQ ID NO: 217684 - RNA, 32 nt, Human
uaagaaaaagugagcauuuuuggaaggauagu

SEQ ID NO: 217685 - RNA, 24 nt, Human
uaagaaaaauaaaguugaaguuca

SEQ ID NO: 217686 - RNA, 24 nt, Human
uaagaaaaauaaaguugucauuca

SEQ ID NO: 217687 - RNA, 23 nt, Human
uaagaaaaauacaguuuauuuca

SEQ ID NO: 217688 - RNA, 32 nt, Human
uaagaaaaauuagcugggcgugguggcgggca

SEQ ID NO: 217689 - RNA, 23 nt, Human
uaagaaaaauuuaaguuuauuca

SEQ ID NO: 217690 - RNA, 32 nt, Human
uaagaaaacccgacaacauuucugccagguuu

SEQ ID NO: 217691 - RNA, 32 nt, Human
uaagaaaacuauuucauuacuuuuguaaucca

SEQ ID NO: 217692 - RNA, 32 nt, Human
uaagaaaagguuuucuucauucauggcuagag

SEQ ID NO: 217693 - RNA, 30 nt, Human
uaagaaaauaaauauuuccauuuaaauguc

SEQ ID NO: 217694 - RNA, 31 nt, Human
uaagaaaauaaauauuuccauuuaaauguca

SEQ ID NO: 217695 - RNA, 32 nt, Human
uaagaaaaucagauaacuuguacuggagagaa

SEQ ID NO: 217696 - RNA, 32 nt, Human
uaagaaaauccugaauagcacagggaagcaga

SEQ ID NO: 217697 - RNA, 32 nt, Human
uaagaaacacacugaggcagggaaguccccag

SEQ ID NO: 217698 - RNA, 32 nt, Human
uaagaaacauggcaaaccaggcugucucauuc

SEQ ID NO: 217699 - RNA, 32 nt, Human
uaagaaacccauccagcugucaugguauguua

SEQ ID NO: 217700 - RNA, 32 nt, Human
uaagaaacccgggguguuuccucugccuacgu

SEQ ID NO: 217701 - RNA, 32 nt, Human
uaagaaacccguaaggagcugcagugaaaagu

SEQ ID NO: 217702 - RNA, 32 nt, Human
uaagaaacucuaaauccaaggugacaucgugg

SEQ ID NO: 217703 - RNA, 32 nt, Human
uaagaaagacaacuacuuuugaaggaaguuaa

SEQ ID NO: 217704 - RNA, 32 nt, Human
uaagaaagacacuuccaaaacuacccauuguu

SEQ ID NO: 217705 - RNA, 23 nt, Human
uaagaaagcacaguugucaguca

SEQ ID NO: 217706 - RNA, 32 nt, Human
uaagaaagccacagcacguacacccacuccag

SEQ ID NO: 217707 - RNA, 32 nt, Human
uaagaaagcucugagaaugggcauuuuuguau

SEQ ID NO: 217708 - RNA, 32 nt, Human
uaagaaaggaagcacagaagucgcaggcagcc

SEQ ID NO: 217709 - RNA, 32 nt, Human
uaagaaaggaagcuaacgcaguaucugcaaag

SEQ ID NO: 217710 - RNA, 32 nt, Human
uaagaaaggggaggggacagugcaauccgggu

SEQ ID NO: 217711 - RNA, 32 nt, Human
uaagaaagucaccaagugucuuaagcuguuuu

SEQ ID NO: 217712 - RNA, 32 nt, Human
uaagaaaucucaaugaacuauuuguagagaau

SEQ ID NO: 217713 - RNA, 32 nt, Human
uaagaaauguguuugcccuguuuuguuugguu

SEQ ID NO: 217714 - RNA, 32 nt, Human
uaagaacaacagcaacaaaaggcuccaaaaca

SEQ ID NO: 217715 - RNA, 32 nt, Human
uaagaacagcauagagcuucaaaaugcaaagu

SEQ ID NO: 217716 - RNA, 32 nt, Human
uaagaaccugcuucuuucugcaguagaagcgu

SEQ ID NO: 217717 - RNA, 32 nt, Human
uaagaaccugggagcuggaggcugguccaccu

SEQ ID NO: 217718 - RNA, 32 nt, Human
uaagaaccuguggcccuggaacacuuuucaag

SEQ ID NO: 217719 - RNA, 32 nt, Human
uaagaaccuugccugaacauccuuccuuccca

SEQ ID NO: 217720 - RNA, 32 nt, Human
uaagaacuaggccacacgcagaggagaaaugg

SEQ ID NO: 217721 - RNA, 32 nt, Human
uaagaacucgacaacagagugggaacuuucug

SEQ ID NO: 217722 - RNA, 32 nt, Human
uaagaacugcggauucugccugggcacacacc

SEQ ID NO: 217723 - RNA, 32 nt, Human
uaagaacuggcagcaaggcuugaggccuuaug

SEQ ID NO: 217724 - RNA, 32 nt, Human
uaagaacuguaacccucacugcaaggggccgu

SEQ ID NO: 217725 - RNA, 32 nt, Human
uaagaagaaauacccacuaacaaagaacaagc

SEQ ID NO: 217726 - RNA, 32 nt, Human
uaagaagaaauauauguggugaaauguuggaa

SEQ ID NO: 217727 - RNA, 32 nt, Human
uaagaagaaaugcaaaagaaguggcauaggag

SEQ ID NO: 217728 - RNA, 32 nt, Human
uaagaagaacugcuuucuuauagcacaaaacu

SEQ ID NO: 217729 - RNA, 32 nt, Human
uaagaagacagagagaacugaguauccuccca

SEQ ID NO: 217730 - RNA, 32 nt, Human
uaagaagacccaguagcccuccugccucccug

SEQ ID NO: 217731 - RNA, 32 nt, Human
uaagaagacucauguuuaugucuggaauaagu

SEQ ID NO: 217732 - RNA, 32 nt, Human
uaagaagagaagacagccagaggcucacacug

SEQ ID NO: 217733 - RNA, 32 nt, Human
uaagaagagauccuggaaguuccaguagggag

SEQ ID NO: 217734 - RNA, 32 nt, Human
uaagaagagaucuggcugggaucaagaaaccu

SEQ ID NO: 217735 - RNA, 32 nt, Human
uaagaagaggcugggugcaguggcucacaccu

SEQ ID NO: 217736 - RNA, 32 nt, Human
uaagaagauagaaucauaugucugcuaaauaa

SEQ ID NO: 217737 - RNA, 32 nt, Human
uaagaagaugccauugcacuccagccugggca

SEQ ID NO: 217738 - RNA, 32 nt, Human
uaagaagcaacaaccucuccucuucgucuccg

SEQ ID NO: 217739 - RNA, 32 nt, Human
uaagaagcaauggagaaaaugauaauacagca

SEQ ID NO: 217740 - RNA, 32 nt, Human
uaagaagcagcaacuggcccaaaucagagagg

SEQ ID NO: 217741 - RNA, 32 nt, Human
uaagaagcucuggguugcuccuugggcuucuc

SEQ ID NO: 217742 - RNA, 32 nt, Human
uaagaagcucuguugucgauguggaaaaauau

SEQ ID NO: 217743 - RNA, 32 nt, Human
uaagaagcuuugcucugccuuuguagagcucu

SEQ ID NO: 217744 - RNA, 32 nt, Human
uaagaaggagaaagggauugaauggacuuaca

SEQ ID NO: 217745 - RNA, 32 nt, Human
uaagaaggagguggacgaugccuuaguggaga

SEQ ID NO: 217746 - RNA, 32 nt, Human
uaagaaggccucuugcuccuugccaggugcuu

SEQ ID NO: 217747 - RNA, 32 nt, Human
uaagaagggaacauuucuguugauacauguuu

SEQ ID NO: 217748 - RNA, 32 nt, Human
uaagaagggaagagaaagccgggaggcaagua

SEQ ID NO: 217749 - RNA, 32 nt, Human
uaagaagucguggugguuauagcaggaggaga

SEQ ID NO: 217750 - RNA, 32 nt, Human
uaagaagugaaauagaauuuugcugcagacca

SEQ ID NO: 217751 - RNA, 32 nt, Human
uaagaagugguguuuuguguuucaucuccagc

SEQ ID NO: 217752 - RNA, 32 nt, Human
uaagaaguguaucugccuuuccaucuuuuggu

SEQ ID NO: 217753 - RNA, 32 nt, Human
uaagaaguugguguucagcuuaguugauucag

SEQ ID NO: 217754 - RNA, 32 nt, Human
uaagaauagaacaacauauacaacaccaaaaa

SEQ ID NO: 217755 - RNA, 32 nt, Human
uaagaauagcacugaucucacaggguugugau

SEQ ID NO: 217756 - RNA, 32 nt, Human
uaagaauaguaugccagcaaucccugauucuc

SEQ ID NO: 217757 - RNA, 32 nt, Human
uaagaauauaccaaaaguugucugauuuaaag

SEQ ID NO: 217758 - RNA, 32 nt, Human
uaagaauauguagauauagcaaaaagaaugag

SEQ ID NO: 217759 - RNA, 32 nt, Human
uaagaaucaccaccauggcccuugugccaggg

SEQ ID NO: 217760 - RNA, 32 nt, Human
uaagaaucauuuacaaaagcaagcagagaaaa

SEQ ID NO: 217761 - RNA, 32 nt, Human
uaagaauccuuuccuaccaguuuuuccuauau

SEQ ID NO: 217762 - RNA, 32 nt, Human
uaagaaucucucuugcaggaguaacacaggca

SEQ ID NO: 217763 - RNA, 32 nt, Human
uaagaaucugcuugaagucucguauuuguacu

SEQ ID NO: 217764 - RNA, 32 nt, Human
uaagaaucuguacugacuuuucacuuggccau

SEQ ID NO: 217765 - RNA, 32 nt, Human
uaagaaugaggaaaaagagguaauaucagggc

SEQ ID NO: 217766 - RNA, 32 nt, Human
uaagaaugcugggggcugggcgcaguggcuca

SEQ ID NO: 217767 - RNA, 32 nt, Human
uaagaaugcuucuguuccuggaagacccagag

SEQ ID NO: 217768 - RNA, 32 nt, Human
uaagaauggggauggcaaagggcagaguaaga

SEQ ID NO: 217769 - RNA, 30 nt, Human
uaagaaugguuaugauaauuagcaccaugg

SEQ ID NO: 217770 - RNA, 32 nt, Human
uaagaauuaccuuucauuuucucuuuauguua

SEQ ID NO: 217771 - RNA, 32 nt, Human
uaagaauugcuuguugggaagagugcuuuagg

SEQ ID NO: 217772 - RNA, 32 nt, Human
uaagaauuuauuaagcaaaauagccuuagaaa

SEQ ID NO: 217773 - RNA, 32 nt, Human
uaagacaaagccaagaugcaaaauuaggcuuu

SEQ ID NO: 217774 - RNA, 32 nt, Human
uaagacaaaguuuugcucugucaccaaggcug

SEQ ID NO: 217775 - RNA, 32 nt, Human
uaagacaagccuugcucugccgaagcuuacaa

SEQ ID NO: 217776 - RNA, 32 nt, Human
uaagacaauggugaaaucuggcuugaacuugc

SEQ ID NO: 217777 - RNA, 32 nt, Human
uaagacacucccucaaugccacccugacccca

SEQ ID NO: 217778 - RNA, 32 nt, Human
uaagacagaaguucuuuucuuccucacuuugu

SEQ ID NO: 217779 - RNA, 32 nt, Human
uaagacagagacauuugaacagggccuugaag

SEQ ID NO: 217780 - RNA, 32 nt, Human
uaagacagagucuugcucugucacccaggcug

SEQ ID NO: 217781 - RNA, 32 nt, Human
uaagacagaguuucucucugucacccaagcug

SEQ ID NO: 217782 - RNA, 32 nt, Human
uaagacagaguuucucucuguugcccaggcug

SEQ ID NO: 217783 - RNA, 32 nt, Human
uaagacagcaaagaagugugcaaggagggccc

SEQ ID NO: 217784 - RNA, 32 nt, Human
uaagacaggagaaucacuugagccugggagga

SEQ ID NO: 217785 - RNA, 32 nt, Human
uaagacaggaggaucacaagagcccaggaggu

SEQ ID NO: 217786 - RNA, 32 nt, Human
uaagacaggauuuugcuguguugcccagacug

SEQ ID NO: 217787 - RNA, 32 nt, Human
uaagacaggcagaucaccugagcucaggaguc

SEQ ID NO: 217788 - RNA, 32 nt, Human
uaagacaggcuggaggaacagugcagacacac

SEQ ID NO: 217789 - RNA, 32 nt, Human
uaagacagggucucgcucugucacccaggcug

SEQ ID NO: 217790 - RNA, 32 nt, Human
uaagacagggucuugcucuguugcccaggcuc

SEQ ID NO: 217791 - RNA, 32 nt, Human
uaagacagggucuugcucuguugcccaggcug

SEQ ID NO: 217792 - RNA, 32 nt, Human
uaagacaggucuagagacaggagaagcagaaa

SEQ ID NO: 217793 - RNA, 32 nt, Human
uaagacaguuuauacuuugagagaaacccugc

SEQ ID NO: 217794 - RNA, 32 nt, Human
uaagacaugggaauaccuucaguuauuuacau

SEQ ID NO: 217795 - RNA, 32 nt, Human
uaagacauguguuugcuccuccuucaccuucu

SEQ ID NO: 217796 - RNA, 32 nt, Human
uaagaccacaaacuguauugcuaaggacauuu

SEQ ID NO: 217797 - RNA, 32 nt, Human
uaagaccacaagucugcaggaaacucuggaau

SEQ ID NO: 217798 - RNA, 32 nt, Human
uaagaccaccuucccuuccucagcaggccaaa

SEQ ID NO: 217799 - RNA, 32 nt, Human
uaagaccacucuaaggacugggguuggaggcc

SEQ ID NO: 217800 - RNA, 32 nt, Human
uaagacccaaaauccuggcauauugccagguc

SEQ ID NO: 217801 - RNA, 28 nt, Human
uaagacccaagugccuccugcuguuucc

SEQ ID NO: 217802 - RNA, 32 nt, Human
uaagaccccuggcagaacccagccucugcuca

SEQ ID NO: 217803 - RNA, 32 nt, Human
uaagaccccuuuggccacaccuuccaggcacu

SEQ ID NO: 217804 - RNA, 32 nt, Human
uaagacccucauagagcuugauucuuguauau

SEQ ID NO: 217805 - RNA, 32 nt, Human
uaagacccucccccaacagucugaccuuggca

SEQ ID NO: 217806 - RNA, 32 nt, Human
uaagaccgccaccacacucacccucccucaag

SEQ ID NO: 217807 - RNA, 32 nt, Human
uaagaccggaagcaggaaggagggcgcaggaa

SEQ ID NO: 217808 - RNA, 23 nt, Human
uaagaccgguaggcguggggcca

SEQ ID NO: 217809 - RNA, 32 nt, Human
uaagaccuccaccucuagacuagcucuucagu

SEQ ID NO: 217810 - RNA, 32 nt, Human
uaagaccuugggcugccucuucugucuuaacu

SEQ ID NO: 217811 - RNA, 32 nt, Human
uaagacgccagggcaucccggaagcugggaaa

SEQ ID NO: 217812 - RNA, 32 nt, Human
uaagacgggaggauugcuugaauccaggaguu

SEQ ID NO: 217813 - RNA, 32 nt, Human
uaagacgucgagugccaagaccagccuuccag

SEQ ID NO: 217814 - RNA, 32 nt, Human
uaagacguuuuaauuucuuugcagacaagguc

SEQ ID NO: 217815 - RNA, 32 nt, Human
uaagacuacaggguagagaaucagaggcuugu

SEQ ID NO: 217816 - RNA, 32 nt, Human
uaagacuauaaucccuuaaauauuuuagaaga

SEQ ID NO: 217817 - RNA, 32 nt, Human
uaagacuauuagaaucccccaaagugggauac

SEQ ID NO: 217818 - RNA, 32 nt, Human
uaagacuauuccaacugggcauuucaauccau

SEQ ID NO: 217819 - RNA, 32 nt, Human
uaagacucaccaggagaggucugagggccauu

SEQ ID NO: 217820 - RNA, 32 nt, Human
uaagacucacccagggcaaacacugggaccac

SEQ ID NO: 217821 - RNA, 32 nt, Human
uaagacuccagccaccccucuugggcucucua

SEQ ID NO: 217822 - RNA, 32 nt, Human
uaagacuccaucucuucucugccucuggcccu

SEQ ID NO: 217823 - RNA, 32 nt, Human
uaagacucugaaaucuggugacuuugacacug

SEQ ID NO: 217824 - RNA, 32 nt, Human
uaagacugacccacugcauuccagccuggcga

SEQ ID NO: 217825 - RNA, 32 nt, Human
uaagacugagcaccugcuucaugcucagcccu

SEQ ID NO: 217826 - RNA, 32 nt, Human
uaagacugcgcuucuaacaagucucccaguug

SEQ ID NO: 217827 - RNA, 32 nt, Human
uaagacuggucuucggaacuugcccacuccau

SEQ ID NO: 217828 - RNA, 32 nt, Human
uaagacugucauguaagaggugcucuccuggc

SEQ ID NO: 217829 - RNA, 32 nt, Human
uaagacugugccacugcacuccagccugggca

SEQ ID NO: 217830 - RNA, 32 nt, Human
uaagacuuccaagccagaagacagaggguucg

SEQ ID NO: 217831 - RNA, 32 nt, Human
uaagacuuggauuuacuauucuaccucagccc

SEQ ID NO: 217832 - RNA, 32 nt, Human
uaagacuugguaugguuggaguguaggaauga

SEQ ID NO: 217833 - RNA, 32 nt, Human
uaagacuuuaugggagagauuagacacuggag

SEQ ID NO: 217834 - RNA, 32 nt, Human
uaagacuuuuaaaaucagaguaaguauguucu

SEQ ID NO: 217835 - RNA, 32 nt, Human
uaagacuuuuacacugccaguauuccacauuu

SEQ ID NO: 217836 - RNA, 24 nt, Human
uaagagaaaugagcuugacauuua

SEQ ID NO: 217837 - RNA, 32 nt, Human
uaagagaaauggcauuugcauguuccagaguc

SEQ ID NO: 217838 - RNA, 32 nt, Human
uaagagaacaauuuggggcugaagggaguguc

SEQ ID NO: 217839 - RNA, 32 nt, Human
uaagagaacagagcuacguucuuugugagagc

SEQ ID NO: 217840 - RNA, 32 nt, Human
uaagagaacaucuuccagcugccuuuuucaca

SEQ ID NO: 217841 - RNA, 32 nt, Human
uaagagaacuccaggacacaauucagcccggg

SEQ ID NO: 217842 - RNA, 32 nt, Human
uaagagaagagagggagugaaggguggcacca

SEQ ID NO: 217843 - RNA, 32 nt, Human
uaagagaaguuucuagguuugcacugaauugu

SEQ ID NO: 217844 - RNA, 32 nt, Human
uaagagaauuuuggcccuucugugucugagaa

SEQ ID NO: 217845 - RNA, 32 nt, Human
uaagagacaacugaaaucuugccuccuccagc

SEQ ID NO: 217846 - RNA, 32 nt, Human
uaagagacuggggcgcagccucuccccaacac

SEQ ID NO: 217847 - RNA, 32 nt, Human
uaagagacuggguuucggggaaggaggggcua

SEQ ID NO: 217848 - RNA, 32 nt, Human
uaagagagaacaguaaaagugagcaauacuuc

SEQ ID NO: 217849 - RNA, 32 nt, Human
uaagagagaaguucucauugugggaaucugac

SEQ ID NO: 217850 - RNA, 32 nt, Human
uaagagagagaagaggagaaacuucaacgccu

SEQ ID NO: 217851 - RNA, 32 nt, Human
uaagagagaguccucagcagagucuucuugug

SEQ ID NO: 217852 - RNA, 32 nt, Human
uaagagagggaagugggcuggggagaguagaa

SEQ ID NO: 217853 - RNA, 32 nt, Human
uaagagagggccuggggcagacuuaggaucag

SEQ ID NO: 217854 - RNA, 32 nt, Human
uaagagaguggaccagggccccugaggaagac

SEQ ID NO: 217855 - RNA, 32 nt, Human
uaagagaguuuauacugaaaggaaaucauaua

SEQ ID NO: 217856 - RNA, 32 nt, Human
uaagagaugagggagagagagccagagacagu

SEQ ID NO: 217857 - RNA, 32 nt, Human
uaagagcaaaagaaaaauaaagugauugauga

SEQ ID NO: 217858 - RNA, 32 nt, Human
uaagagcaaggagacaccacugggacaaagcc

SEQ ID NO: 217859 - RNA, 32 nt, Human
uaagagcacugcacugacgguuuggagaccug

SEQ ID NO: 217860 - RNA, 32 nt, Human
uaagagcagccagagggagcuggugaggcccu

SEQ ID NO: 217861 - RNA, 32 nt, Human
uaagagcaguguccucccaucuucaacaguua

SEQ ID NO: 217862 - RNA, 32 nt, Human
uaagagcauagagcaaauuaauuuggaagaaa

SEQ ID NO: 217863 - RNA, 32 nt, Human
uaagagcaucugauugcucuuuuaauuugcau

SEQ ID NO: 217864 - RNA, 32 nt, Human
uaagagcaucuggaagugaggguaggagcugg

SEQ ID NO: 217865 - RNA, 32 nt, Human
uaagagccauuuccugucucuccucugcaguc

SEQ ID NO: 217866 - RNA, 32 nt, Human
uaagagccucuuccuucccucagaggaugugg

SEQ ID NO: 217867 - RNA, 32 nt, Human
uaagagcuccuggauggguccgggaacucgcc

SEQ ID NO: 217868 - RNA, 32 nt, Human
uaagagcugaaagggcugugcugagagcacug

SEQ ID NO: 217869 - RNA, 32 nt, Human
uaagagcugcaacugaacgugugagacauggu

SEQ ID NO: 217870 - RNA, 32 nt, Human
uaagagcugcagcauugacugugcuuccguuc

SEQ ID NO: 217871 - RNA, 32 nt, Human
uaagagcugccucugcuguagguauuuguagu

SEQ ID NO: 217872 - RNA, 32 nt, Human
uaagagcuggcuuuucugccauaguguccucu

SEQ ID NO: 217873 - RNA, 19 nt, Human
uaagagcuuccacugcacc

SEQ ID NO: 217874 - RNA, 32 nt, Human
uaagagcuuccuacuguuuguuaaauuaacuc

SEQ ID NO: 217875 - RNA, 32 nt, Human
uaagagcuuuaaauaugaggguuguguuucug

SEQ ID NO: 217876 - RNA, 32 nt, Human
uaagaggaaaaugaaaguguuccuggggugcu

SEQ ID NO: 217877 - RNA, 32 nt, Human
uaagaggagacugaggcauagagcagauaaga

SEQ ID NO: 217878 - RNA, 32 nt, Human
uaagaggaggcaggaggagcaacucaaauccc

SEQ ID NO: 217879 - RNA, 32 nt, Human
uaagaggaggugggcguaggaagucucacuga

SEQ ID NO: 217880 - RNA, 32 nt, Human
uaagaggaguugcccauuccagccagguggaa

SEQ ID NO: 217881 - RNA, 32 nt, Human
uaagaggaugaaucucacaggguucuugcagg

SEQ ID NO: 217882 - RNA, 32 nt, Human
uaagaggcaaaagagaaaagacucaagaaacu

SEQ ID NO: 217883 - RNA, 32 nt, Human
uaagaggcagugagauguagccuggcccugga

SEQ ID NO: 217884 - RNA, 32 nt, Human
uaagaggccaggagagugggaacuggacacag

SEQ ID NO: 217885 - RNA, 32 nt, Human
uaagaggcccugggccgaggugcagugacccu

SEQ ID NO: 217886 - RNA, 32 nt, Human
uaagaggccucagauugauaccugccauggcu

SEQ ID NO: 217887 - RNA, 32 nt, Human
uaagaggcucacugcccuaucuccuucuuucc

SEQ ID NO: 217888 - RNA, 32 nt, Human
uaagagggaaggcaaggaggcgggacgccgca

SEQ ID NO: 217889 - RNA, 32 nt, Human
uaagagggagagagaagaagaggaagaagagg

SEQ ID NO: 217890 - RNA, 32 nt, Human
uaagagggaggcaggaggguuagagugaguag

SEQ ID NO: 217891 - RNA, 32 nt, Human
uaagagggaugaaagagagcuaugauguccua

SEQ ID NO: 217892 - RNA, 32 nt, Human
uaagaggguaagauuucuacuugagugagcuc

SEQ ID NO: 217893 - RNA, 32 nt, Human
uaagaggucugggggcugggacauaggagggg

SEQ ID NO: 217894 - RNA, 32 nt, Human
uaagaggugaucucugggaguuauaggucaug

SEQ ID NO: 217895 - RNA, 32 nt, Human
uaagagguuuauuuggguacauggcccgcagu

SEQ ID NO: 217896 - RNA, 32 nt, Human
uaagaguagaauaccuucaggccaggcgcggu

SEQ ID NO: 217897 - RNA, 32 nt, Human
uaagaguagcaauacugcaccuggugaucaca

SEQ ID NO: 217898 - RNA, 32 nt, Human
uaagagucacaucuuagcacuuccgcucucag

SEQ ID NO: 217899 - RNA, 32 nt, Human
uaagagucagaacaccccacaggccugacucc

SEQ ID NO: 217900 - RNA, 32 nt, Human
uaagagucauaucacaaaaagccauuaagcau

SEQ ID NO: 217901 - RNA, 32 nt, Human
uaagagugauaagggcccuacuacacuggcuu

SEQ ID NO: 217902 - RNA, 32 nt, Human
uaagagugauuuccgauuucucuccuuucagu

SEQ ID NO: 217903 - RNA, 31 nt, Human
uaagagugccucucugagucucaguuucccc

SEQ ID NO: 217904 - RNA, 32 nt, Human
uaagagugccugagaggccuggaggagacuug

SEQ ID NO: 217905 - RNA, 22 nt, Human
uaagaguggaaaugaaagcaga

SEQ ID NO: 217906 - RNA, 32 nt, Human
uaagaguggauuacaggcaugagccacuguac

SEQ ID NO: 217907 - RNA, 32 nt, Human
uaagaguggggaacagggccagcaagacagac

SEQ ID NO: 217908 - RNA, 32 nt, Human
uaagagugguggccuauuucagcugcuuugac

SEQ ID NO: 217909 - RNA, 31 nt, Human
uaagagugugagagagacugauggggucgcu

SEQ ID NO: 217910 - RNA, 32 nt, Human
uaagaguguuuguuuaaggugaucucauugau

SEQ ID NO: 217911 - RNA, 32 nt, Human
uaagaguuacucugcaaucuaagcaaagcacc

SEQ ID NO: 217912 - RNA, 32 nt, Human
uaagaguugggaugagggauggagagggacug

SEQ ID NO: 217913 - RNA, 32 nt, Human
uaagaguuuguguguaaacaggcucaucucug

SEQ ID NO: 217914 - RNA, 32 nt, Human
uaagauaagagccuggaaagaggacucuguug

SEQ ID NO: 217915 - RNA, 32 nt, Human
uaagauacacacacaaccacacacgcgcacac

SEQ ID NO: 217916 - RNA, 32 nt, Human
uaagauaccgcgcuucaucuucaucuaaucuu

SEQ ID NO: 217917 - RNA, 32 nt, Human
uaagauacucucaucuaagaaauaacaucacc

SEQ ID NO: 217918 - RNA, 32 nt, Human
uaagauacugacaccaaaugccuuuaaauggc

SEQ ID NO: 217919 - RNA, 32 nt, Human
uaagauagagugcacagcaaaggggaucugcc

SEQ ID NO: 217920 - RNA, 32 nt, Human
uaagauaggaaguacuagccugggcaacgugg

SEQ ID NO: 217921 - RNA, 32 nt, Human
uaagauaggaggaucacuugagcccaggaggc

SEQ ID NO: 217922 - RNA, 32 nt, Human
uaagauaggguuucacuauguuggcuaggcug

SEQ ID NO: 217923 - RNA, 32 nt, Human
uaagauaguuccuaaagccuuacccuggcuag

SEQ ID NO: 217924 - RNA, 32 nt, Human
uaagauauauuugucauuuucucuugaauaug

SEQ ID NO: 217925 - RNA, 32 nt, Human
uaagauaugccuccuucuccuucaccuuccac

SEQ ID NO: 217926 - RNA, 32 nt, Human
uaagaucaaccugaagguccuaccuaaaccaa

SEQ ID NO: 217927 - RNA, 32 nt, Human
uaagaucacacacaucaucucuauccaugagu

SEQ ID NO: 217928 - RNA, 32 nt, Human
uaagaucacaccacuacacuccagccugggcg

SEQ ID NO: 217929 - RNA, 32 nt, Human
uaagaucacaccacugcacuccagccagggca

SEQ ID NO: 217930 - RNA, 32 nt, Human
uaagaucacaccauugcgcuagagcccgggcg

SEQ ID NO: 217931 - RNA, 32 nt, Human
uaagaucacaggcuuagugugaggacgagcuu

SEQ ID NO: 217932 - RNA, 32 nt, Human
uaagaucacaucacugcacuccagccugggua

SEQ ID NO: 217933 - RNA, 32 nt, Human
uaagaucacgccacugcacuccagccugcgga

SEQ ID NO: 217934 - RNA, 32 nt, Human
uaagaucacgccauugcacuccagccugggca

SEQ ID NO: 217935 - RNA, 32 nt, Human
uaagaucacuauagguccauuucuugaaccca

SEQ ID NO: 217936 - RNA, 32 nt, Human
uaagaucaggaguucaagaccagccuggccaa

SEQ ID NO: 217937 - RNA, 32 nt, Human
uaagaucaugccacugcacuccagccugggca

SEQ ID NO: 217938 - RNA, 32 nt, Human
uaagaucgagcaauggcuucaggacauggguu

SEQ ID NO: 217939 - RNA, 32 nt, Human
uaagaucgcaccacugcacuccagccugggug

SEQ ID NO: 217940 - RNA, 32 nt, Human
uaagaucgcgccauugcacuccagccugggcg

SEQ ID NO: 217941 - RNA, 32 nt, Human
uaagaucgugccacugcacuccagccuggaca

SEQ ID NO: 217942 - RNA, 32 nt, Human
uaagaucgugccacugcacuccggccugggug

SEQ ID NO: 217943 - RNA, 32 nt, Human
uaagaucgugccacugcauuccagccugguug

SEQ ID NO: 217944 - RNA, 32 nt, Human
uaagaucgugccguugcacuccagccugggca

SEQ ID NO: 217945 - RNA, 32 nt, Human
uaagaucuagccccauugacucuucuagaaau

SEQ ID NO: 217946 - RNA, 32 nt, Human
uaagaucuccuugagucaggaaccugcaaggg

SEQ ID NO: 217947 - RNA, 32 nt, Human
uaagaugaacauccucuuacauaucuccugau

SEQ ID NO: 217948 - RNA, 32 nt, Human
uaagaugagcaguugaggggacugagagagug

SEQ ID NO: 217949 - RNA, 32 nt, Human
uaagaugagcaucuggauccccuuccuuuaca

SEQ ID NO: 217950 - RNA, 32 nt, Human
uaagaugaggucacgcuggaguaggaugggcc

SEQ ID NO: 217951 - RNA, 32 nt, Human
uaagaugcacaaugucuccuucaggugaucac

SEQ ID NO: 217952 - RNA, 32 nt, Human
uaagaugcagauuacaggugugagccaccaca

SEQ ID NO: 217953 - RNA, 32 nt, Human
uaagaugcaggcauucucauggaacacagacg

SEQ ID NO: 217954 - RNA, 32 nt, Human
uaagaugcccaccgugacagugccccagcuug

SEQ ID NO: 217955 - RNA, 32 nt, Human
uaagaugccuuaaaaaucuuaaagucacaaaa

SEQ ID NO: 217956 - RNA, 32 nt, Human
uaagaugcuccugguggcugggaggcaucagu

SEQ ID NO: 217957 - RNA, 32 nt, Human
uaagaugcugcacuuggcugggcacaguggca

SEQ ID NO: 217958 - RNA, 32 nt, Human
uaagauggagucuugcucugucacccagguug

SEQ ID NO: 217959 - RNA, 32 nt, Human
uaagauggagucuugcucuguugcccgggcug

SEQ ID NO: 217960 - RNA, 32 nt, Human
uaagauggauaaucacuuucucauuuggguuc

SEQ ID NO: 217961 - RNA, 32 nt, Human
uaagauggauuucacccccaggccaaugcagc

SEQ ID NO: 217962 - RNA, 32 nt, Human
uaagauggcaccacugcacuccagccugggug

SEQ ID NO: 217963 - RNA, 32 nt, Human
uaagauggccucagucuccacugugggcuuga

SEQ ID NO: 217964 - RNA, 32 nt, Human
uaagauggcucaauguauugggaggcuucuuu

SEQ ID NO: 217965 - RNA, 32 nt, Human
uaagaugggaucucauuuuguugcccaggcug

SEQ ID NO: 217966 - RNA, 32 nt, Human
uaagaugggggaaaauuaagguuugagguuuu

SEQ ID NO: 217967 - RNA, 32 nt, Human
uaagauggguggaucacuugaggucaggaguu

SEQ ID NO: 217968 - RNA, 32 nt, Human
uaagauguguggcauuuacuuaaaccaucaca

SEQ ID NO: 217969 - RNA, 32 nt, Human
uaagauuauagaaucccagaggccuccucauu

SEQ ID NO: 217970 - RNA, 32 nt, Human
uaagauuauauguuucuguuucugguaaauac

SEQ ID NO: 217971 - RNA, 32 nt, Human
uaagauucacagucugcuccccaacccagugc

SEQ ID NO: 217972 - RNA, 32 nt, Human
uaagauucauucuaguucacuaaugaccagaa

SEQ ID NO: 217973 - RNA, 32 nt, Human
uaagauucuuaccucuaugcuaaguuuguguu

SEQ ID NO: 217974 - RNA, 32 nt, Human
uaagauucuugaucugccucccccuagagcag

SEQ ID NO: 217975 - RNA, 32 nt, Human
uaagauugaacucuguggugcagcuuuaagcu

SEQ ID NO: 217976 - RNA, 32 nt, Human
uaagauugagcccucuccuacucucccccaac

SEQ ID NO: 217977 - RNA, 32 nt, Human
uaagauugcaccacugcacuccaaccugggug

SEQ ID NO: 217978 - RNA, 32 nt, Human
uaagauugccaaaaucagagaaucuugcaaag

SEQ ID NO: 217979 - RNA, 32 nt, Human
uaagauuggagcugcagaagacuugccagccc

SEQ ID NO: 217980 - RNA, 32 nt, Human
uaagauugugccacugcacuccagccugggua

SEQ ID NO: 217981 - RNA, 32 nt, Human
uaagauuuauugguaucucacauuaaauugua

SEQ ID NO: 217982 - RNA, 32 nt, Human
uaagauuucaugaagaaagcauguauugugug

SEQ ID NO: 217983 - RNA, 32 nt, Human
uaagauuugggugggaacacagagccaaacca

SEQ ID NO: 217984 - RNA, 32 nt, Human
uaagauuuugcaccuguaaagugccuuacagg

SEQ ID NO: 217985 - RNA, 21 nt, Human
uaagcaaaaaauaccugguaa

SEQ ID NO: 217986 - RNA, 32 nt, Human
uaagcaaaagaauguauuggaaguugauggaa

SEQ ID NO: 217987 - RNA, 32 nt, Human
uaagcaaaaguuugauuuccagacacuacaga

SEQ ID NO: 217988 - RNA, 32 nt, Human
uaagcaaagacaaagaagcaagaaauaguaug

SEQ ID NO: 217989 - RNA, 22 nt, Human
uaagcaaagucuccucuugcuu

SEQ ID NO: 217990 - RNA, 32 nt, Human
uaagcaaauagaagaugaccgucaaagaaaaa

SEQ ID NO: 217991 - RNA, 32 nt, Human
uaagcaaauguuucagcccaaugucaacccag

SEQ ID NO: 217992 - RNA, 32 nt, Human
uaagcaacauagugaaaccccaucuccaaaaa

SEQ ID NO: 217993 - RNA, 32 nt, Human
uaagcaaccccagaucaggguacuugcugugg

SEQ ID NO: 217994 - RNA, 32 nt, Human
uaagcaacgggaacaccugcugagggggcucu

SEQ ID NO: 217995 - RNA, 32 nt, Human
uaagcaagagaaagacaacuguucugcggguu

SEQ ID NO: 217996 - RNA, 32 nt, Human
uaagcaagaguuguuucuguuauuuuguccac

SEQ ID NO: 217997 - RNA, 23 nt, Human
uaagcaaggcaugcugcagggaa

SEQ ID NO: 217998 - RNA, 32 nt, Human
uaagcaagguaauuucuagcacucuggaaagg

SEQ ID NO: 217999 - RNA, 32 nt, Human
uaagcacaauaucuucacacugugcuguauug

SEQ ID NO: 218000 - RNA, 32 nt, Human
uaagcacacaccuaaagauaucuuuuuagaug

SEQ ID NO: 218001 - RNA, 32 nt, Human
uaagcacacaugcgcacacacacuugcauuca

SEQ ID NO: 218002 - RNA, 32 nt, Human
uaagcacagacaacucccucccugccuugcac

SEQ ID NO: 218003 - RNA, 32 nt, Human
uaagcacaguugacaguugugcauugggaugg

SEQ ID NO: 218004 - RNA, 32 nt, Human
uaagcacaucaguacuuuucucuggcuggaau

SEQ ID NO: 218005 - RNA, 32 nt, Human
uaagcacaugaaucuuuaccugugcugaaguu

SEQ ID NO: 218006 - RNA, 25 nt, Human
uaagcacaugucugugacaaggucu

SEQ ID NO: 218007 - RNA, 19 nt, Human
uaagcacauucacuucuau

SEQ ID NO: 218008 - RNA, 32 nt, Human
uaagcaccaaaaagaagauggggaagaaaaga

SEQ ID NO: 218009 - RNA, 32 nt, Human
uaagcaccagcggaaggagcugugccccggga

SEQ ID NO: 218010 - RNA, 32 nt, Human
uaagcaccaggaguccaugaagaagauggcuc

SEQ ID NO: 218011 - RNA, 32 nt, Human
uaagcaccccuucauuuggcauuccccacuug

SEQ ID NO: 218012 - RNA, 32 nt, Human
uaagcaccuugaucuuggacuucccagccucc

SEQ ID NO: 218013 - RNA, 32 nt, Human
uaagcacuaugcugcaggaauccugagaaaaa

SEQ ID NO: 218014 - RNA, 31 nt, Human
uaagcacucaauaaaucuuugaugaaugaaa

SEQ ID NO: 218015 - RNA, 32 nt, Human
uaagcacuccuagucucuggccuguggaucca

SEQ ID NO: 218016 - RNA, 32 nt, Human
uaagcacugcaacagacucuaccagagaugca

SEQ ID NO: 218017 - RNA, 32 nt, Human
uaagcacuggggauauggcaggaaucaaaaua

SEQ ID NO: 218018 - RNA, 32 nt, Human
uaagcacuuggaauuguacuggguuuucugua

SEQ ID NO: 218019 - RNA, 32 nt, Human
uaagcacuuuaucuauaucucauuucauucuc

SEQ ID NO: 218020 - RNA, 29 nt, Human
uaagcagaaaaaucucauuuugcgcuccc

SEQ ID NO: 218021 - RNA, 32 nt, Human
uaagcagagcaucugcucugggcccuggccuc

SEQ ID NO: 218022 - RNA, 32 nt, Human
uaagcagagcccagggccucuagggcaguggg

SEQ ID NO: 218023 - RNA, 32 nt, Human
uaagcagagcugagucucugucucuguccaca

SEQ ID NO: 218024 - RNA, 32 nt, Human
uaagcagaucacaccucuuucugccucuacau

SEQ ID NO: 218025 - RNA, 19 nt, Human
uaagcagaugggcuuccgu

SEQ ID NO: 218026 - RNA, 32 nt, Human
uaagcagccagacccacaaggccagguccugu

SEQ ID NO: 218027 - RNA, 32 nt, Human
uaagcagccauguuggaaaagucuucauggca

SEQ ID NO: 218028 - RNA, 32 nt, Human
uaagcagcuaccauuccauggacuugccuccc

SEQ ID NO: 218029 - RNA, 32 nt, Human
uaagcagcugccugugcagagugcaggcugca

SEQ ID NO: 218030 - RNA, 32 nt, Human
uaagcagcuucccaaggucaaacacagcaaau

SEQ ID NO: 218031 - RNA, 32 nt, Human
uaagcaggaggcggaggcggaggcggagggcg

SEQ ID NO: 218032 - RNA, 32 nt, Human
uaagcaggcaagaaauccuacuaauccaguuu

SEQ ID NO: 218033 - RNA, 32 nt, Human
uaagcagggggaacaggggugggcaggaugua

SEQ ID NO: 218034 - RNA, 32 nt, Human
uaagcaggguccaagccuggggcugccucugc

SEQ ID NO: 218035 - RNA, 28 nt, Human
uaagcagucaaugcugccucauuuauug

SEQ ID NO: 218036 - RNA, 32 nt, Human
uaagcagucauccucagaucauuaucagccug

SEQ ID NO: 218037 - RNA, 26 nt, Human
uaagcagucuauaaaguugucauuua

SEQ ID NO: 218038 - RNA, 32 nt, Human
uaagcagucuuuaugggcuuucucugaggccc

SEQ ID NO: 218039 - RNA, 32 nt, Human
uaagcagugagucaguucaucauacaaaggca

SEQ ID NO: 218040 - RNA, 32 nt, Human
uaagcagugugacaugcaucccagggacaacu

SEQ ID NO: 218041 - RNA, 32 nt, Human
uaagcagugugggaaaguguuaucucauagcu

SEQ ID NO: 218042 - RNA, 32 nt, Human
uaagcaguuaccugaugccugcugcugaagag

SEQ ID NO: 218043 - RNA, 32 nt, Human
uaagcaguuagaaacucugcauaugagcagga

SEQ ID NO: 218044 - RNA, 32 nt, Human
uaagcaguucccaacuugacuuuucccuuuag

SEQ ID NO: 218045 - RNA, 32 nt, Human
uaagcauauaggauuuguuuaucaucccacua

SEQ ID NO: 218046 - RNA, 32 nt, Human
uaagcaucagcccuguagagugaggagccauc

SEQ ID NO: 218047 - RNA, 32 nt, Human
uaagcaucccccaaauuauucugaagguuuuu

SEQ ID NO: 218048 - RNA, 32 nt, Human
uaagcauccugaaaaaucagcuggggcauauu

SEQ ID NO: 218049 - RNA, 32 nt, Human
uaagcaucucuagcagagcaauuugaucagua

SEQ ID NO: 218050 - RNA, 32 nt, Human
uaagcaugccacuauacuccagccugggcaac

SEQ ID NO: 218051 - RNA, 32 nt, Human
uaagcauggggcccaagaguaugcauucuuac

SEQ ID NO: 218052 - RNA, 32 nt, Human
uaagcauucauccuucguaucacugcagaagc

SEQ ID NO: 218053 - RNA, 32 nt, Human
uaagcauuccuggagccacccuaccucagggc

SEQ ID NO: 218054 - RNA, 32 nt, Human
uaagcauuccuucuuucacaggcaucaggaau

SEQ ID NO: 218055 - RNA, 20 nt, Human
uaagcauugccugguuacug

SEQ ID NO: 218056 - RNA, 32 nt, Human
uaagcauugugggaaagcauucauaucugcca

SEQ ID NO: 218057 - RNA, 32 nt, Human
uaagcauuuaaugucaguccaggaaggggcaa

SEQ ID NO: 218058 - RNA, 32 nt, Human
uaagcauuucaucugcugaaaguccuuauaua

SEQ ID NO: 218059 - RNA, 32 nt, Human
uaagcauuuugaaacaaaguacucuuuaacau

SEQ ID NO: 218060 - RNA, 32 nt, Human
uaagccaaacaaggagcuuucugcagaaugaa

SEQ ID NO: 218061 - RNA, 32 nt, Human
uaagccaaagccauguggaauuuuuguuuaga

SEQ ID NO: 218062 - RNA, 31 nt, Human
uaagccaacaacaacagaacaggguggagug

SEQ ID NO: 218063 - RNA, 32 nt, Human
uaagccaagauccuggaucuucuaucauuaau

SEQ ID NO: 218064 - RNA, 32 nt, Human
uaagccaagcuccugagaaugauuggucacau

SEQ ID NO: 218065 - RNA, 32 nt, Human
uaagccaagcuuucccugucaggauaccuucc

SEQ ID NO: 218066 - RNA, 32 nt, Human
uaagccaauccucacuccccagccuccucugg

SEQ ID NO: 218067 - RNA, 32 nt, Human
uaagccaaugguagcuugccacaugccccauc

SEQ ID NO: 218068 - RNA, 32 nt, Human
uaagccacaagaccccaacccagauccccaca

SEQ ID NO: 218069 - RNA, 32 nt, Human
uaagccacaaggaucacaugcuucgaagggca

SEQ ID NO: 218070 - RNA, 32 nt, Human
uaagccacacuauaucuucaugaguugcaaau

SEQ ID NO: 218071 - RNA, 32 nt, Human
uaagccaccgcaccccgcccagccuggcagau

SEQ ID NO: 218072 - RNA, 32 nt, Human
uaagccaccgcacuccagccugggcgacagag

SEQ ID NO: 218073 - RNA, 32 nt, Human
uaagccaccucucuaccuuaauauugacagga

SEQ ID NO: 218074 - RNA, 22 nt, Human
uaagccaccuuggaauaggaag

SEQ ID NO: 218075 - RNA, 32 nt, Human
uaagccacugcaccuggcggggucuugcuuau

SEQ ID NO: 218076 - RNA, 32 nt, Human
uaagccacuggguggaugaaaggccgagggau

SEQ ID NO: 218077 - RNA, 32 nt, Human
uaagccagaagagccaaagagggaccucgcca

SEQ ID NO: 218078 - RNA, 32 nt, Human
uaagccagagcugagggggaaagagcucugaa

SEQ ID NO: 218079 - RNA, 32 nt, Human
uaagccaggagggugccucuccccucagugga

SEQ ID NO: 218080 - RNA, 32 nt, Human
uaagccaggcauaaccacagccaagcagauua

SEQ ID NO: 218081 - RNA, 32 nt, Human
uaagccaggccugggugucuggaguuugugaa

SEQ ID NO: 218082 - RNA, 32 nt, Human
uaagccagugaccagauuucccccagaugucu

SEQ ID NO: 218083 - RNA, 32 nt, Human
uaagccauaaacugucucaccuaaacaagaua

SEQ ID NO: 218084 - RNA, 32 nt, Human
uaagccauauuggaguagcgaggaaucugauu

SEQ ID NO: 218085 - RNA, 32 nt, Human
uaagccaugccuacagauacuaugagauaaua

SEQ ID NO: 218086 - RNA, 32 nt, Human
uaagccauugcaacuucuuuuucuucagagau

SEQ ID NO: 218087 - RNA, 32 nt, Human
uaagccauuuagaacauaaaugcauucauuua

SEQ ID NO: 218088 - RNA, 32 nt, Human
uaagccauuugaaaaacagaaaagcaaaacaa

SEQ ID NO: 218089 - RNA, 32 nt, Human
uaagcccaacacuuugggaggcugaggcaggu

SEQ ID NO: 218090 - RNA, 32 nt, Human
uaagcccaagaguucaggacuagccugggcaa

SEQ ID NO: 218091 - RNA, 32 nt, Human
uaagcccaauaugccaguuggcaccagaugcu

SEQ ID NO: 218092 - RNA, 32 nt, Human
uaagcccacggugcucccuccugggaccccac

SEQ ID NO: 218093 - RNA, 32 nt, Human
uaagcccagaaggcagagguuguagugagcug

SEQ ID NO: 218094 - RNA, 32 nt, Human
uaagcccagcuauucgggaggcugagguagga

SEQ ID NO: 218095 - RNA, 32 nt, Human
uaagcccaggagacagagguugcagugagcca

SEQ ID NO: 218096 - RNA, 32 nt, Human
uaagcccaggaggccaagucugcagugagcua

SEQ ID NO: 218097 - RNA, 32 nt, Human
uaagcccaggagguucaggcugcaguaagguc

SEQ ID NO: 218098 - RNA, 32 nt, Human
uaagcccaggaguucaagaccaaccuggacaa

SEQ ID NO: 218099 - RNA, 32 nt, Human
uaagcccaggaguucaagaccagccugggcaa

SEQ ID NO: 218100 - RNA, 32 nt, Human
uaagcccaguuuuaggauuagugagaaucccu

SEQ ID NO: 218101 - RNA, 32 nt, Human
uaagcccauggauccauaauguuaaacuaaau

SEQ ID NO: 218102 - RNA, 20 nt, Human
uaagccccaacauguucaga

SEQ ID NO: 218103 - RNA, 32 nt, Human
uaagccccaggaggucgaggcugcagugagcc

SEQ ID NO: 218104 - RNA, 32 nt, Human
uaagcccccacuguucaaguuggguggccauc

SEQ ID NO: 218105 - RNA, 32 nt, Human
uaagccccuccccacacuccucuaauuuaaac

SEQ ID NO: 218106 - RNA, 31 nt, Human
uaagcccgcagcuuugggccuggucucugcu

SEQ ID NO: 218107 - RNA, 32 nt, Human
uaagcccggcuucacuaggccugggugucugg

SEQ ID NO: 218108 - RNA, 32 nt, Human
uaagcccgggaggcagaaccugcagugagcca

SEQ ID NO: 218109 - RNA, 32 nt, Human
uaagcccgggagguggagguugcagugagccc

SEQ ID NO: 218110 - RNA, 32 nt, Human
uaagcccgggaguucaagaccagccuagccca

SEQ ID NO: 218111 - RNA, 32 nt, Human
uaagcccgguaggaaagagagaggaggagggg

SEQ ID NO: 218112 - RNA, 32 nt, Human
uaagcccuacgaugggaucauuauuucaugac

SEQ ID NO: 218113 - RNA, 32 nt, Human
uaagcccugcauaauguuaagcuuuauuguga

SEQ ID NO: 218114 - RNA, 32 nt, Human
uaagcccugcauucauuagauauuuguccuaa

SEQ ID NO: 218115 - RNA, 32 nt, Human
uaagcccuuaauaaauauaaaauaucauuauu

SEQ ID NO: 218116 - RNA, 32 nt, Human
uaagcccuucuuuaggaagccuucccacacag

SEQ ID NO: 218117 - RNA, 32 nt, Human
uaagcccuuucccauucucuuucucaggaaug

SEQ ID NO: 218118 - RNA, 32 nt, Human
uaagccuacuccucuaggaacuauguugaaaa

SEQ ID NO: 218119 - RNA, 32 nt, Human
uaagccuacuccugacuaacuuggcauuugca

SEQ ID NO: 218120 - RNA, 32 nt, Human
uaagccuauggugaacaaauauuuuuaaugaa

SEQ ID NO: 218121 - RNA, 32 nt, Human
uaagccucauuucuauuucuucuucauuaauu

SEQ ID NO: 218122 - RNA, 32 nt, Human
uaagccucauuucucauguucagaccucacau

SEQ ID NO: 218123 - RNA, 32 nt, Human
uaagccuccauuucugacaauuccuguggccc

SEQ ID NO: 218124 - RNA, 32 nt, Human
uaagccucccaaagugcugggauuacaggcgu

SEQ ID NO: 218125 - RNA, 32 nt, Human
uaagccucccaaguaacugggauuacaggcau

SEQ ID NO: 218126 - RNA, 32 nt, Human
uaagccucccgaagugcugggauuacaggcgu

SEQ ID NO: 218127 - RNA, 32 nt, Human
uaagccucgggugggagcucagggccaccugu

SEQ ID NO: 218128 - RNA, 32 nt, Human
uaagccucucauaaugcauaaucaugaguagu

SEQ ID NO: 218129 - RNA, 32 nt, Human
uaagccugacauuggaacagauuucucccgug

SEQ ID NO: 218130 - RNA, 32 nt, Human
uaagccugaguguggggagugaguuaugcaag

SEQ ID NO: 218131 - RNA, 32 nt, Human
uaagccugcagauacguaaugugaccacuguu

SEQ ID NO: 218132 - RNA, 32 nt, Human
uaagccugcagucccagcuacuugggaggccg

SEQ ID NO: 218133 - RNA, 32 nt, Human
uaagccugcauucuauaaauggcguaugacca

SEQ ID NO: 218134 - RNA, 32 nt, Human
uaagccugcccaguaggcaguguuuugcagac

SEQ ID NO: 218135 - RNA, 32 nt, Human
uaagccuggaagguggaaguugcagugagucg

SEQ ID NO: 218136 - RNA, 32 nt, Human
uaagccugggaggcaauggcugcaguaaacca

SEQ ID NO: 218137 - RNA, 32 nt, Human
uaagccugggaggcagagguugcagugagccg

SEQ ID NO: 218138 - RNA, 32 nt, Human
uaagccuguguucaccaccaccaucagacuca

SEQ ID NO: 218139 - RNA, 18 nt, Human
uaagccuguuacuuucau

SEQ ID NO: 218140 - RNA, 26 nt, Human
uaagccuuaacauguaucuucauuca

SEQ ID NO: 218141 - RNA, 32 nt, Human
uaagccuuagggaaggugaguguggguccuuc

SEQ ID NO: 218142 - RNA, 32 nt, Human
uaagccuuccaaagugcugggauuacuggcag

SEQ ID NO: 218143 - RNA, 32 nt, Human
uaagccuucggucaaauuuucucccccucauc

SEQ ID NO: 218144 - RNA, 32 nt, Human
uaagccuuuauuucauacaguccuaggauuaa

SEQ ID NO: 218145 - RNA, 32 nt, Human
uaagcgacauaaggaugaaauacugaugaauc

SEQ ID NO: 218146 - RNA, 32 nt, Human
uaagcgacuguacgugcuacuaaaaaugucug

SEQ ID NO: 218147 - RNA, 32 nt, Human
uaagcgagguauaaaaguacgcaguuuucaug

SEQ ID NO: 218148 - RNA, 32 nt, Human
uaagcgcagaagaucaagaccagccugggaaa

SEQ ID NO: 218149 - RNA, 32 nt, Human
uaagcgcugacgcaugcgcauagcuaaccgca

SEQ ID NO: 218150 - RNA, 32 nt, Human
uaagcggauucccagacccaugaacagacauc

SEQ ID NO: 218151 - RNA, 32 nt, Human
uaagcggcagaggcagggccagccauccuguc

SEQ ID NO: 218152 - RNA, 32 nt, Human
uaagcggcaggcaggauugggcuuuucuggcu

SEQ ID NO: 218153 - RNA, 32 nt, Human
uaagcgggggugaaagaggacguguuacccac

SEQ ID NO: 218154 - RNA, 32 nt, Human
uaagcgucaguaccuggugucaggugcucuca

SEQ ID NO: 218155 - RNA, 32 nt, Human
uaagcgucucuuacagcagagagaccagacca

SEQ ID NO: 218156 - RNA, 32 nt, Human
uaagcgugagccaccaugccuggccccaauuu

SEQ ID NO: 218157 - RNA, 31 nt, Human
uaagcgugcccacuggggccuguggucagga

SEQ ID NO: 218158 - RNA, 32 nt, Human
uaagcuaacaacacagaucccauguaguugga

SEQ ID NO: 218159 - RNA, 32 nt, Human
uaagcuaaguugaggguucagagggagacaaa

SEQ ID NO: 218160 - RNA, 32 nt, Human
uaagcuacaguuccuucucuccauccuucgac

SEQ ID NO: 218161 - RNA, 32 nt, Human
uaagcuagcaucugccccaguugguguucaaa

SEQ ID NO: 218162 - RNA, 32 nt, Human
uaagcucacaugccuuuucccugccacagcca

SEQ ID NO: 218163 - RNA, 32 nt, Human
uaagcucaggaguucaaggccagccugggcaa

SEQ ID NO: 218164 - RNA, 32 nt, Human
uaagcucaucccucccguccgaggcuaguuuc

SEQ ID NO: 218165 - RNA, 32 nt, Human
uaagcuccaauacuucagaaugugacgcugau

SEQ ID NO: 218166 - RNA, 32 nt, Human
uaagcuccacaaagccuaggugagugggacac

SEQ ID NO: 218167 - RNA, 32 nt, Human
uaagcuccaccaacuucaagccaugugacuuu

SEQ ID NO: 218168 - RNA, 32 nt, Human
uaagcuccaguaaauaaacagaacagcuuuca

SEQ ID NO: 218169 - RNA, 32 nt, Human
uaagcuccaguuccauggcaaggcucagacuu

SEQ ID NO: 218170 - RNA, 32 nt, Human
uaagcucccacuacaugcccagccuggggccc

SEQ ID NO: 218171 - RNA, 21 nt, Human
uaagcucgggaucauuuccau

SEQ ID NO: 218172 - RNA, 32 nt, Human
uaagcucuacuaugggcaacugaagauggaua

SEQ ID NO: 218173 - RNA, 32 nt, Human
uaagcucucccucucuuugccugcugccaucc

SEQ ID NO: 218174 - RNA, 32 nt, Human
uaagcucucucaguuccuucccuuccacaaaa

SEQ ID NO: 218175 - RNA, 32 nt, Human
uaagcucucugccuccuccucccuuucucccu

SEQ ID NO: 218176 - RNA, 32 nt, Human
uaagcucugaaaacacuuccaaugccaguuug

SEQ ID NO: 218177 - RNA, 32 nt, Human
uaagcucuguaacgcgggccgaggcagaccga

SEQ ID NO: 218178 - RNA, 32 nt, Human
uaagcucuucauuugguauuuaggcaauauau

SEQ ID NO: 218179 - RNA, 32 nt, Human
uaagcucuugaggccauucaccugccaaccug

SEQ ID NO: 218180 - RNA, 32 nt, Human
uaagcucuugcagagugagaugacuugaaaua

SEQ ID NO: 218181 - RNA, 32 nt, Human
uaagcucuuggcuuggagucccgugucgucuc

SEQ ID NO: 218182 - RNA, 32 nt, Human
uaagcugaagauucccuugagaacaaguacug

SEQ ID NO: 218183 - RNA, 32 nt, Human
uaagcugaaguaacuggcuccuuacuuuaaau

SEQ ID NO: 218184 - RNA, 32 nt, Human
uaagcugacuguucucucuugagaaccugugg

SEQ ID NO: 218185 - RNA, 32 nt, Human
uaagcugagaucgcugcacuccagccugggcg

SEQ ID NO: 218186 - RNA, 32 nt, Human
uaagcugcagccgccggagccgcagaaacaag

SEQ ID NO: 218187 - RNA, 32 nt, Human
uaagcugccaucaauucccaccuggacaacug

SEQ ID NO: 218188 - RNA, 32 nt, Human
uaagcugccaucucagaccagaggaacaggga

SEQ ID NO: 218189 - RNA, 32 nt, Human
uaagcugccugggagcccucauugccuuccug

SEQ ID NO: 218190 - RNA, 32 nt, Human
uaagcugcgauacagcccuggagcucagucag

SEQ ID NO: 218191 - RNA, 32 nt, Human
uaagcugcuaaguuuugaggaaauuuguuaca

SEQ ID NO: 218192 - RNA, 32 nt, Human
uaagcugcuaucucagccugucccuucugccc

SEQ ID NO: 218193 - RNA, 32 nt, Human
uaagcugcugacaucauccacugccuucugcu

SEQ ID NO: 218194 - RNA, 32 nt, Human
uaagcugcugcucuggccaagugccuaauuuu

SEQ ID NO: 218195 - RNA, 32 nt, Human
uaagcugcugggaacccaucugugcugaaaug

SEQ ID NO: 218196 - RNA, 32 nt, Human
uaagcugggggaggagggaggggugggaauug

SEQ ID NO: 218197 - RNA, 32 nt, Human
uaagcugggucucaggcugggcucagcaaagg

SEQ ID NO: 218198 - RNA, 32 nt, Human
uaagcugggugagcuacugaagccaaggcggg

SEQ ID NO: 218199 - RNA, 32 nt, Human
uaagcugggugagcuacugaagccaagguggg

SEQ ID NO: 218200 - RNA, 32 nt, Human
uaagcuggucucaaacuccugggcucaagcga

SEQ ID NO: 218201 - RNA, 32 nt, Human
uaagcugguggaagcuaucaggaccaauuaca

SEQ ID NO: 218202 - RNA, 32 nt, Human
uaagcuguauuuuuagugagcuaccccuuuua

SEQ ID NO: 218203 - RNA, 32 nt, Human
uaagcugucauggagauaaauccaaaauaguu

SEQ ID NO: 218204 - RNA, 32 nt, Human
uaagcuguccucagauccuccuucuacccagg

SEQ ID NO: 218205 - RNA, 32 nt, Human
uaagcugugccccaccacccuaggcaaugagg

SEQ ID NO: 218206 - RNA, 32 nt, Human
uaagcugugugagcucuuccacccaggagggc

SEQ ID NO: 218207 - RNA, 32 nt, Human
uaagcuguucucucccaccccaccuuucugug

SEQ ID NO: 218208 - RNA, 32 nt, Human
uaagcuguuggcuucucugagcuccaguggaa

SEQ ID NO: 218209 - RNA, 32 nt, Human
uaagcuguuuuaagaggaacagaagggaaauc

SEQ ID NO: 218210 - RNA, 32 nt, Human
uaagcuuauuauccucccaggucauaggaaga

SEQ ID NO: 218211 - RNA, 32 nt, Human
uaagcuucaaaccagacucugugcugcuucug

SEQ ID NO: 218212 - RNA, 32 nt, Human
uaagcuuccaggcugcauagaaggaggagagg

SEQ ID NO: 218213 - RNA, 32 nt, Human
uaagcuucccuguguccucucucccucucucc

SEQ ID NO: 218214 - RNA, 32 nt, Human
uaagcuuccugaggcccucaccagaagcugag

SEQ ID NO: 218215 - RNA, 32 nt, Human
uaagcuucuaagggaggaaggcagcauugggg

SEQ ID NO: 218216 - RNA, 32 nt, Human
uaagcuugguggagcauuuucccauugagagc

SEQ ID NO: 218217 - RNA, 32 nt, Human
uaagcuuugaaaagcugagaauauccaucugg

SEQ ID NO: 218218 - RNA, 32 nt, Human
uaagcuuuugccacaggcucugucuuuugggg

SEQ ID NO: 218219 - RNA, 32 nt, Human
uaagcuuuugccugaugacuaaccuggugcug

SEQ ID NO: 218220 - RNA, 32 nt, Human
uaaggaaaaagaauauagacaagcauggaaag

SEQ ID NO: 218221 - RNA, 24 nt, Human
uaaggaaaauaaaguggugcauuu

SEQ ID NO: 218222 - RNA, 32 nt, Human
uaaggaaaccagcccagaucagucccaaggcc

SEQ ID NO: 218223 - RNA, 21 nt, Human
uaaggaaacugaacacucgaa

SEQ ID NO: 218224 - RNA, 32 nt, Human
uaaggaaagcacaucgacuccuuucccagaca

SEQ ID NO: 218225 - RNA, 32 nt, Human
uaaggaaaggaaauggaagucaggaggaaggg

SEQ ID NO: 218226 - RNA, 32 nt, Human
uaaggaaauacacagugaaguuuuuaggaaau

SEQ ID NO: 218227 - RNA, 32 nt, Human
uaaggaaaucuaacacaaacagcaacuguuuu

SEQ ID NO: 218228 - RNA, 32 nt, Human
uaaggaaaugggcuugagcagagcagggggua

SEQ ID NO: 218229 - RNA, 32 nt, Human
uaaggaacuaaaacuugaggcagagucuucuu

SEQ ID NO: 218230 - RNA, 32 nt, Human
uaaggaagaaaacagacuuuugcucaaaugga

SEQ ID NO: 218231 - RNA, 32 nt, Human
uaaggaagacuugucgggaacacaggcagggc

SEQ ID NO: 218232 - RNA, 32 nt, Human
uaaggaagagcaucucauacauaucauuaucg

SEQ ID NO: 218233 - RNA, 22 nt, Human
uaaggaagaugaagggucuuca

SEQ ID NO: 218234 - RNA, 32 nt, Human
uaaggaagccuucuuauuuaucuuccugcaaa

SEQ ID NO: 218235 - RNA, 32 nt, Human
uaaggaaggaaggaggaaugaggcuggauacg

SEQ ID NO: 218236 - RNA, 32 nt, Human
uaaggaaggaagucaaggcugcagugagcuau

SEQ ID NO: 218237 - RNA, 32 nt, Human
uaaggaaggaggugcuggagcaguugaugaag

SEQ ID NO: 218238 - RNA, 32 nt, Human
uaaggaagggcagauaaugugacucuuugcgg

SEQ ID NO: 218239 - RNA, 32 nt, Human
uaaggaaguugccgugcacugcagccugccgg

SEQ ID NO: 218240 - RNA, 22 nt, Human
uaaggaauagagguuaauuuua

SEQ ID NO: 218241 - RNA, 32 nt, Human
uaaggaaugagggagagaagggggcuguacag

SEQ ID NO: 218242 - RNA, 32 nt, Human
uaaggaauuuuucuucccuccucauucuuugu

SEQ ID NO: 218243 - RNA, 32 nt, Human
uaaggacaagacuacuguggauucaagugcuu

SEQ ID NO: 218244 - RNA, 32 nt, Human
uaaggacacugccuuuucagauuaaagauugu

SEQ ID NO: 218245 - RNA, 32 nt, Human
uaaggacaguggaaagcuauggaugauucaug

SEQ ID NO: 218246 - RNA, 20 nt, Human
uaaggacauagaaaauugac

SEQ ID NO: 218247 - RNA, 32 nt, Human
uaaggacccaggagguggggcagaagagagga

SEQ ID NO: 218248 - RNA, 32 nt, Human
uaaggacgacaccgucagcuguccgacucgca

SEQ ID NO: 218249 - RNA, 32 nt, Human
uaaggacgauggugaaaagaucacguuuucaa

SEQ ID NO: 218250 - RNA, 19 nt, Human
uaaggacuauggaauggau

SEQ ID NO: 218251 - RNA, 32 nt, Human
uaaggacucagccuuggucaaggugguaaagg

SEQ ID NO: 218252 - RNA, 32 nt, Human
uaaggacucaggcuuggucaaggugguaaagg

SEQ ID NO: 218253 - RNA, 32 nt, Human
uaaggacuccaaugucgaacucuucuuugcug

SEQ ID NO: 218254 - RNA, 32 nt, Human
uaaggacucuguccacccgggguccucccagg

SEQ ID NO: 218255 - RNA, 32 nt, Human
uaaggacuugacuuccuuucucccaugauucc

SEQ ID NO: 218256 - RNA, 24 nt, Human
uaaggacuuguuagaucuaguuca

SEQ ID NO: 218257 - RNA, 32 nt, Human
uaaggagaacuccgaggagagcagggggagug

SEQ ID NO: 218258 - RNA, 32 nt, Human
uaaggagaaggucaaggcugcagugagccauc

SEQ ID NO: 218259 - RNA, 23 nt, Human
uaaggagaaucaucuucaugccu

SEQ ID NO: 218260 - RNA, 31 nt, Human
uaaggagaggaaagagaaaacucugggguca

SEQ ID NO: 218261 - RNA, 32 nt, Human
uaaggagaggagaaacugagaaaugaaugcug

SEQ ID NO: 218262 - RNA, 32 nt, Human
uaaggagaggccccagaaccccaaagcagaca

SEQ ID NO: 218263 - RNA, 32 nt, Human
uaaggagaguccgguuuaaccgucaccgggaa

SEQ ID NO: 218264 - RNA, 32 nt, Human
uaaggagagucuuccaggugugacaaucagga

SEQ ID NO: 218265 - RNA, 32 nt, Human
uaaggagaguggaaccaggagcucagaguccu

SEQ ID NO: 218266 - RNA, 32 nt, Human
uaaggagaugguaucuccccagucaagggcaa

SEQ ID NO: 218267 - RNA, 32 nt, Human
uaaggagcagccagggcugagacucccggugc

SEQ ID NO: 218268 - RNA, 32 nt, Human
uaaggagcaggagcugcugggccaggucugcg

SEQ ID NO: 218269 - RNA, 32 nt, Human
uaaggagcagugcucucuucucucaaagcuca

SEQ ID NO: 218270 - RNA, 32 nt, Human
uaaggagccagaggaguuaccuguguccugca

SEQ ID NO: 218271 - RNA, 32 nt, Human
uaaggagccgcccagaccuagggcuggacuca

SEQ ID NO: 218272 - RNA, 32 nt, Human
uaaggagcgcuagugccuugcccacaggugcg

SEQ ID NO: 218273 - RNA, 32 nt, Human
uaaggagcugcugcccucugguggauacagag

SEQ ID NO: 218274 - RNA, 32 nt, Human
uaaggagcuuggggaggccucccaggcugguc

SEQ ID NO: 218275 - RNA, 32 nt, Human
uaaggaggaaaggggagggcagaggggaggca

SEQ ID NO: 218276 - RNA, 32 nt, Human
uaaggaggcaccacacaguggugcaggcacau

SEQ ID NO: 218277 - RNA, 32 nt, Human
uaaggaggcugaggcaggagaaucacuugaac

SEQ ID NO: 218278 - RNA, 32 nt, Human
uaaggagggagugggccagaccagagugccag

SEQ ID NO: 218279 - RNA, 32 nt, Human
uaaggagggugagauaagagacccuuuuccua

SEQ ID NO: 218280 - RNA, 32 nt, Human
uaaggagguggugagagcggcugaggaggcug

SEQ ID NO: 218281 - RNA, 32 nt, Human
uaaggaguauuggaagaagcagugagucagcu

SEQ ID NO: 218282 - RNA, 32 nt, Human
uaaggagucccacaccuccaccaccagcccag

SEQ ID NO: 218283 - RNA, 32 nt, Human
uaaggagugauggaagccaagugaacaagccu

SEQ ID NO: 218284 - RNA, 32 nt, Human
uaaggauaaaaaggagggagcgggaagggaga

SEQ ID NO: 218285 - RNA, 32 nt, Human
uaaggauaacauccauguacacauucuuuguu

SEQ ID NO: 218286 - RNA, 32 nt, Human
uaaggauaauggaguuccucuccucugcuuuc

SEQ ID NO: 218287 - RNA, 32 nt, Human
uaaggauagaucuucugcaacagucuugcuga

SEQ ID NO: 218288 - RNA, 23 nt, Human
uaaggauauaaauuugucauuua

SEQ ID NO: 218289 - RNA, 32 nt, Human
uaaggaucaauaaaggaguagugcaguuuaag

SEQ ID NO: 218290 - RNA, 32 nt, Human
uaaggaucagugcuuuguucugcagcagaguu

SEQ ID NO: 218291 - RNA, 32 nt, Human
uaaggaucucauuuggguaucuggaaggugau

SEQ ID NO: 218292 - RNA, 18 nt, Human
uaaggaugacacuaucca

SEQ ID NO: 218293 - RNA, 32 nt, Human
uaaggaugacagagaugugcauguggguauug

SEQ ID NO: 218294 - RNA, 32 nt, Human
uaaggaugauugugugggcugcacaggcugaa

SEQ ID NO: 218295 - RNA, 31 nt, Human
uaaggaugccacauuuuucaugcagaaaaga

SEQ ID NO: 218296 - RNA, 32 nt, Human
uaaggauggacauuuuaucgucucauagucau

SEQ ID NO: 218297 - RNA, 32 nt, Human
uaaggauuaaaauguauaggccagcacgugua

SEQ ID NO: 218298 - RNA, 32 nt, Human
uaaggauuaguuggugggauugaggagagaau

SEQ ID NO: 218299 - RNA, 32 nt, Human
uaaggauucaaaccauuugccaaaaaugaguc

SEQ ID NO: 218300 - RNA, 32 nt, Human
uaaggauugagugagcgcgagcuggggacucu

SEQ ID NO: 218301 - RNA, 32 nt, Human
uaaggauuuuucucuuauuucucccccuaguu

SEQ ID NO: 218302 - RNA, 32 nt, Human
uaaggcaaagaaugugcaguaugaguaugaga

SEQ ID NO: 218303 - RNA, 32 nt, Human
uaaggcaaaggccaagcuuucaaaagaguaaa

SEQ ID NO: 218304 - RNA, 32 nt, Human
uaaggcaaauaaucacuucaccucuggugccu

SEQ ID NO: 218305 - RNA, 32 nt, Human
uaaggcaagguuuaucagugcagaucaucaga

SEQ ID NO: 218306 - RNA, 32 nt, Human
uaaggcacaaguguccuuggcuuucagaauuu

SEQ ID NO: 218307 - RNA, 32 nt, Human
uaaggcagaucuuucuucauaaaaaggaaagu

SEQ ID NO: 218308 - RNA, 32 nt, Human
uaaggcagccgugucuguguuuuugucucgca

SEQ ID NO: 218309 - RNA, 20 nt, Human
uaaggcaggaaaggaaagac

SEQ ID NO: 218310 - RNA, 32 nt, Human
uaaggcaggaggaucacuugagcccaggaggu

SEQ ID NO: 218311 - RNA, 32 nt, Human
uaaggcaggaggaucacuugagccccggaggu

SEQ ID NO: 218312 - RNA, 32 nt, Human
uaaggcaggcggaucacuugaggucaggaguu

SEQ ID NO: 218313 - RNA, 32 nt, Human
uaaggcaggcugaucacuugaggucaggaauu

SEQ ID NO: 218314 - RNA, 24 nt, Human
uaaggcagguggaucacuugaggc

SEQ ID NO: 218315 - RNA, 32 nt, Human
uaaggcagguggaucacuugaggccaggaguu

SEQ ID NO: 218316 - RNA, 32 nt, Human
uaaggcaguagagaaaaacuguuggguuagaa

SEQ ID NO: 218317 - RNA, 32 nt, Human
uaaggcagucucccccuucacccugcuugcug

SEQ ID NO: 218318 - RNA, 32 nt, Human
uaaggcagucucucaaaagucauacugccaga

SEQ ID NO: 218319 - RNA, 20 nt, Human
uaaggcaugacccuuggaua

SEQ ID NO: 218320 - RNA, 32 nt, Human
uaaggcaugcucccagcauuuguccacccacu

SEQ ID NO: 218321 - RNA, 32 nt, Human
uaaggccaaaaacaaccagugaaagaagagag

SEQ ID NO: 218322 - RNA, 32 nt, Human
uaaggccaaucuggcccucccugugugacccg

SEQ ID NO: 218323 - RNA, 32 nt, Human
uaaggccaccuugcagccgcuuuccagggcca

SEQ ID NO: 218324 - RNA, 32 nt, Human
uaaggccacugaugcucaacucugccuggaau

SEQ ID NO: 218325 - RNA, 32 nt, Human
uaaggccagaacuuggucguagagguucaggg

SEQ ID NO: 218326 - RNA, 32 nt, Human
uaaggccagccgcggcaggaccaaggcggcgg

SEQ ID NO: 218327 - RNA, 32 nt, Human
uaaggccaggaggucaaggcugcggugagccg

SEQ ID NO: 218328 - RNA, 32 nt, Human
uaaggccaggaguucaaccagccuggacaaca

SEQ ID NO: 218329 - RNA, 32 nt, Human
uaaggccaggaguucaagaccaccuggccaac

SEQ ID NO: 218330 - RNA, 32 nt, Human
uaaggcccaaguuauugagcagcagcuuccua

SEQ ID NO: 218331 - RNA, 31 nt, Human
uaaggcccacacuucuuugaauuacucuuca

SEQ ID NO: 218332 - RNA, 32 nt, Human
uaaggccccacugucaggcuuagccucagcag

SEQ ID NO: 218333 - RNA, 32 nt, Human
uaaggccccugaccacacuucagaagccccau

SEQ ID NO: 218334 - RNA, 32 nt, Human
uaaggcccucuucucaagaggauuuccuaauu

SEQ ID NO: 218335 - RNA, 32 nt, Human
uaaggcccuggaguccaccuccaggcuggguc

SEQ ID NO: 218336 - RNA, 32 nt, Human
uaaggccgggaguucaagaccagccugaccaa

SEQ ID NO: 218337 - RNA, 26 nt, Human
uaaggccuaagauaggguuucauuua

SEQ ID NO: 218338 - RNA, 32 nt, Human
uaaggccucuacucuggcucaggacccagucc

SEQ ID NO: 218339 - RNA, 32 nt, Human
uaaggccucuuucuaaggaaguuuggcugaag

SEQ ID NO: 218340 - RNA, 32 nt, Human
uaaggccugaaaaggaacaaggcccaccggaa

SEQ ID NO: 218341 - RNA, 32 nt, Human
uaaggccugaacuucaugucauggcuuaugag

SEQ ID NO: 218342 - RNA, 32 nt, Human
uaaggccugaaggaugaugagguaucaggugg

SEQ ID NO: 218343 - RNA, 32 nt, Human
uaaggccugaucuccaggagggguaggggaga

SEQ ID NO: 218344 - RNA, 32 nt, Human
uaaggccugggagaucccaggguccuccaccc

SEQ ID NO: 218345 - RNA, 32 nt, Human
uaaggccugggguggagaagcgcggaggaaug

SEQ ID NO: 218346 - RNA, 32 nt, Human
uaaggccuuaucaccuccccugcccauaggcc

SEQ ID NO: 218347 - RNA, 32 nt, Human
uaaggcgccugccaccaugcccggcuaauuuu

SEQ ID NO: 218348 - RNA, 32 nt, Human
uaaggcgggagaaucacuugaaccugggaggc

SEQ ID NO: 218349 - RNA, 32 nt, Human
uaaggcgggaggaucccuugaggccaggaguu

SEQ ID NO: 218350 - RNA, 32 nt, Human
uaaggcgggaggaugacuugaggccaggaguu

SEQ ID NO: 218351 - RNA, 24 nt, Human
uaaggcggguggaucaccugaggc

SEQ ID NO: 218352 - RNA, 32 nt, Human
uaaggcgugggcuuccacagugucugccagag

SEQ ID NO: 218353 - RNA, 32 nt, Human
uaaggcuaaaucuugaauacauuguugaauuc

SEQ ID NO: 218354 - RNA, 32 nt, Human
uaaggcuaacaugcuuuuccuccaucaaucuu

SEQ ID NO: 218355 - RNA, 32 nt, Human
uaaggcuaaggagagcauggaauuugucaguu

SEQ ID NO: 218356 - RNA, 32 nt, Human
uaaggcuaugcaccccuccccacgucuuccag

SEQ ID NO: 218357 - RNA, 32 nt, Human
uaaggcucaacuauuggaauacaucuaccaug

SEQ ID NO: 218358 - RNA, 32 nt, Human
uaaggcuccaacggccaaacugccucacccuc

SEQ ID NO: 218359 - RNA, 32 nt, Human
uaaggcucccacugcuacuacuuuaaugaaga

SEQ ID NO: 218360 - RNA, 32 nt, Human
uaaggcugaaaccucggaggaacaaccacuuu

SEQ ID NO: 218361 - RNA, 32 nt, Human
uaaggcugaaagagcaggagaguuccaugcag

SEQ ID NO: 218362 - RNA, 32 nt, Human
uaaggcugaaguauuuuuagcaucucaggaca

SEQ ID NO: 218363 - RNA, 32 nt, Human
uaaggcugaccuuaccugaguuucuguaugug

SEQ ID NO: 218364 - RNA, 32 nt, Human
uaaggcugagagagaaaaauaugugcaguauc

SEQ ID NO: 218365 - RNA, 32 nt, Human
uaaggcugaggcacaagaauugcuugaacccg

SEQ ID NO: 218366 - RNA, 32 nt, Human
uaaggcuggaagcuguggcucacaccuguaau

SEQ ID NO: 218367 - RNA, 32 nt, Human
uaaggcuggaggaucacuucagcccaggaguu

SEQ ID NO: 218368 - RNA, 32 nt, Human
uaaggcugguggcccuuugggcucccugucca

SEQ ID NO: 218369 - RNA, 32 nt, Human
uaaggcugugccagaacccaucccaauaaaga

SEQ ID NO: 218370 - RNA, 32 nt, Human
uaaggcuguuuccuuuugcaucuggaacugac

SEQ ID NO: 218371 - RNA, 32 nt, Human
uaaggcuuacgcguguuccauccaccacauca

SEQ ID NO: 218372 - RNA, 32 nt, Human
uaaggcuucuccccaucuuuucuucuacauuu

SEQ ID NO: 218373 - RNA, 32 nt, Human
uaaggcuucugauaagacaggaaagggauauu

SEQ ID NO: 218374 - RNA, 32 nt, Human
uaaggcuuggccgaugucugauugggaccagg

SEQ ID NO: 218375 - RNA, 32 nt, Human
uaagggaacuugccucucccucuuguuuugcu

SEQ ID NO: 218376 - RNA, 32 nt, Human
uaagggaagaggagaggaaggggagccggacc

SEQ ID NO: 218377 - RNA, 32 nt, Human
uaagggaagagucagucuauguucuuuaggua

SEQ ID NO: 218378 - RNA, 32 nt, Human
uaagggaagcaagaguaggguuguggaaagac

SEQ ID NO: 218379 - RNA, 32 nt, Human
uaagggaaucacacagacucauggacauagau

SEQ ID NO: 218380 - RNA, 32 nt, Human
uaagggacccucucuuuuuggauggcagagau

SEQ ID NO: 218381 - RNA, 32 nt, Human
uaagggaccucagacugggcugauggaagguc

SEQ ID NO: 218382 - RNA, 32 nt, Human
uaagggagcauagcugcuccacacagcggaau

SEQ ID NO: 218383 - RNA, 32 nt, Human
uaagggaggagaggggacuggagagugugggg

SEQ ID NO: 218384 - RNA, 32 nt, Human
uaagggaggaggaggccaggagggaggcacag

SEQ ID NO: 218385 - RNA, 32 nt, Human
uaagggaggcuuucauuuccucccgacugauu

SEQ ID NO: 218386 - RNA, 32 nt, Human
uaagggagggaaggggaauggaagagaaaaga

SEQ ID NO: 218387 - RNA, 32 nt, Human
uaagggaggguacuguugacaccagcuauggc

SEQ ID NO: 218388 - RNA, 32 nt, Human
uaagggagguguccaagcugaccucagccuuc

SEQ ID NO: 218389 - RNA, 32 nt, Human
uaagggaguguaacagucucuggaggaccacu

SEQ ID NO: 218390 - RNA, 32 nt, Human
uaagggauauuucugguuucaaagucaugggu

SEQ ID NO: 218391 - RNA, 32 nt, Human
uaagggauucacugcaucauagcuaugccugu

SEQ ID NO: 218392 - RNA, 26 nt, Human
uaagggauuuuuguuauucuagcuca

SEQ ID NO: 218393 - RNA, 32 nt, Human
uaagggcacugagcccuucccaggcuggauac

SEQ ID NO: 218394 - RNA, 32 nt, Human
uaagggcagcagagguggaguagggaggaggc

SEQ ID NO: 218395 - RNA, 32 nt, Human
uaagggcagcuuuuauagguuccacauguaag

SEQ ID NO: 218396 - RNA, 32 nt, Human
uaagggccaaagugcagggugggugaacuuua

SEQ ID NO: 218397 - RNA, 28 nt, Human
uaagggccaagugcaguccugucuugau

SEQ ID NO: 218398 - RNA, 32 nt, Human
uaagggcccaaguauccugaauggcucagcag

SEQ ID NO: 218399 - RNA, 32 nt, Human
uaagggcuacaggccagcguggaugaccugaa

SEQ ID NO: 218400 - RNA, 31 nt, Human
uaagggcucaauaaauguuagcugaaugaaa

SEQ ID NO: 218401 - RNA, 32 nt, Human
uaagggcugccuccccgccacuccuuguccgg

SEQ ID NO: 218402 - RNA, 32 nt, Human
uaagggcuggagugcuguggugccaucauggu

SEQ ID NO: 218403 - RNA, 24 nt, Human
uaagggcuguguuauauuaaguuc

SEQ ID NO: 218404 - RNA, 32 nt, Human
uaagggcuuucucaucagauggcagaaauuau

SEQ ID NO: 218405 - RNA, 32 nt, Human
uaaggggaaccagcacaacaggccauauuccc

SEQ ID NO: 218406 - RNA, 23 nt, Human
uaaggggacagagcaagugcaga

SEQ ID NO: 218407 - RNA, 32 nt, Human
uaaggggacaggaguuccagaagaaccuuuca

SEQ ID NO: 218408 - RNA, 32 nt, Human
uaaggggaccguggcccccaccagggacgucc

SEQ ID NO: 218409 - RNA, 32 nt, Human
uaaggggagagggauugagaaagagacgcuga

SEQ ID NO: 218410 - RNA, 20 nt, Human
uaaggggaggaagaauuccu

SEQ ID NO: 218411 - RNA, 32 nt, Human
uaaggggcaaaugaaacgguauauuauuucuu

SEQ ID NO: 218412 - RNA, 32 nt, Human
uaaggggcagggcugguuucagcugggggcuc

SEQ ID NO: 218413 - RNA, 32 nt, Human
uaaggggcaguggugugaagggaccaaaaggg

SEQ ID NO: 218414 - RNA, 32 nt, Human
uaaggggccacuggggaagccugggucaguau

SEQ ID NO: 218415 - RNA, 32 nt, Human
uaaggggccaggcuccaaagaagauuaaagga

SEQ ID NO: 218416 - RNA, 32 nt, Human
uaaggggccuccaucccuuuuacucauuugua

SEQ ID NO: 218417 - RNA, 32 nt, Human
uaaggggccugccuaagauugcagugauaaag

SEQ ID NO: 218418 - RNA, 32 nt, Human
uaagggggaagaggagaggguauggggcggca

SEQ ID NO: 218419 - RNA, 32 nt, Human
uaaggggucagaacuucugaaaccagagaucu

SEQ ID NO: 218420 - RNA, 32 nt, Human
uaaggggugggaagaacaggaaaagaagcugg

SEQ ID NO: 218421 - RNA, 32 nt, Human
uaagggguuaugggguuuugggggagguaaua

SEQ ID NO: 218422 - RNA, 32 nt, Human
uaagggguucacugcuuugguggaaauuggug

SEQ ID NO: 218423 - RNA, 18 nt, Human
uaaggguaugcuugugua

SEQ ID NO: 218424 - RNA, 32 nt, Human
uaagggucggucgguuuaccacuggacgggug

SEQ ID NO: 218425 - RNA, 32 nt, Human
uaaggguggcagggacuggagucaguuggaga

SEQ ID NO: 218426 - RNA, 32 nt, Human
uaagggugggcuagguuggauggaaggugaaa

SEQ ID NO: 218427 - RNA, 32 nt, Human
uaaggguuauuugagcaaguaacauuaacuca

SEQ ID NO: 218428 - RNA, 32 nt, Human
uaaggguucuuggggaucuggaaaggaucagu

SEQ ID NO: 218429 - RNA, 32 nt, Human
uaaggguugccuaagugucugccuuacuuucu

SEQ ID NO: 218430 - RNA, 32 nt, Human
uaagguaacuaucagaggugggauuaucuugc

SEQ ID NO: 218431 - RNA, 32 nt, Human
uaagguaagagaugauuuccaucuacucucau

SEQ ID NO: 218432 - RNA, 22 nt, Human
uaagguacaugguaccaugaca

SEQ ID NO: 218433 - RNA, 32 nt, Human
uaagguacccuuuaauauguacuccuuaaucu

SEQ ID NO: 218434 - RNA, 32 nt, Human
uaagguaccucucaacauuaccaaaaucauuu

SEQ ID NO: 218435 - RNA, 32 nt, Human
uaagguacugacacuucagacauugcugagua

SEQ ID NO: 218436 - RNA, 32 nt, Human
uaagguacuguagccuugguccuggggaccac

SEQ ID NO: 218437 - RNA, 32 nt, Human
uaagguacuugguuauccagugcagugcaccg

SEQ ID NO: 218438 - RNA, 32 nt, Human
uaagguagagacaaaacuuuauugcacugaca

SEQ ID NO: 218439 - RNA, 32 nt, Human
uaagguaguacacauuugguucagaaauuaau

SEQ ID NO: 218440 - RNA, 32 nt, Human
uaagguauugaaucucucugagccucaguuuu

SEQ ID NO: 218441 - RNA, 32 nt, Human
uaagguauuuuuagcccuugauccccuuugcu

SEQ ID NO: 218442 - RNA, 32 nt, Human
uaaggucagauggucagagucagcaccaacac

SEQ ID NO: 218443 - RNA, 32 nt, Human
uaaggucagccaggcuggacaccacgcugugg

SEQ ID NO: 218444 - RNA, 32 nt, Human
uaaggucaggagaucaagaccauccuggcuaa

SEQ ID NO: 218445 - RNA, 32 nt, Human
uaaggucaggaguucaacaacaccagccugac

SEQ ID NO: 218446 - RNA, 32 nt, Human
uaaggucaggaguucaagaccagccuggccaa

SEQ ID NO: 218447 - RNA, 32 nt, Human
uaaggucaggaguucaagaccagccuggccac

SEQ ID NO: 218448 - RNA, 32 nt, Human
uaaggucaggaguucaagaccagccuggucaa

SEQ ID NO: 218449 - RNA, 32 nt, Human
uaaggucaggaguucaagaccagcguggccaa

SEQ ID NO: 218450 - RNA, 32 nt, Human
uaaggucaggaguucaagaccagcuuggccaa

SEQ ID NO: 218451 - RNA, 32 nt, Human
uaaggucaggaguucaagaccaggcuggucaa

SEQ ID NO: 218452 - RNA, 32 nt, Human
uaaggucaggaguucaagaucagccuggccua

SEQ ID NO: 218453 - RNA, 32 nt, Human
uaaggucauaacugcauuuaucaugaacacua

SEQ ID NO: 218454 - RNA, 32 nt, Human
uaaggucauccuuccccacagggguggcuuug

SEQ ID NO: 218455 - RNA, 32 nt, Human
uaaggucauuacucucaaccaccuaggcaaug

SEQ ID NO: 218456 - RNA, 32 nt, Human
uaaggucauuggcugcucuacucuguccccua

SEQ ID NO: 218457 - RNA, 32 nt, Human
uaagguccaguauaugguuaguuuuuauaaau

SEQ ID NO: 218458 - RNA, 32 nt, Human
uaagguccauccuuccgucucugacauuuuga

SEQ ID NO: 218459 - RNA, 32 nt, Human
uaagguccccacugccugcugcagagaaaaca

SEQ ID NO: 218460 - RNA, 32 nt, Human
uaagguccccuuuucacaacaucaucacaggg

SEQ ID NO: 218461 - RNA, 32 nt, Human
uaaggucccuacagcaagugggacagcagacc

SEQ ID NO: 218462 - RNA, 32 nt, Human
uaaggucccuuccagcccagccguucugggag

SEQ ID NO: 218463 - RNA, 32 nt, Human
uaagguccucaccuaauuccuccaucacaacc

SEQ ID NO: 218464 - RNA, 32 nt, Human
uaaggucgagaguccaagaccagccuggccaa

SEQ ID NO: 218465 - RNA, 32 nt, Human
uaaggucgccacugccugcugcagagaaaaca

SEQ ID NO: 218466 - RNA, 32 nt, Human
uaaggucguugugccagcagaaaugucucucc

SEQ ID NO: 218467 - RNA, 32 nt, Human
uaaggucuaauauccagcaucuguaaggaauu

SEQ ID NO: 218468 - RNA, 32 nt, Human
uaaggucuauguaaaacccuucccucucugac

SEQ ID NO: 218469 - RNA, 32 nt, Human
uaaggugaagcagcaacugcugauggagaagc

SEQ ID NO: 218470 - RNA, 23 nt, Human
uaaggugauccacccaccuucca

SEQ ID NO: 218471 - RNA, 32 nt, Human
uaaggugcugggagcaaagagagggugacuga

SEQ ID NO: 218472 - RNA, 32 nt, Human
uaagguggacgagcaugcccuuuuugucauau

SEQ ID NO: 218473 - RNA, 32 nt, Human
uaagguggcaggaucaccaaaggccaggaguu

SEQ ID NO: 218474 - RNA, 32 nt, Human
uaagguggcucacaccuauaauccuaggacuu

SEQ ID NO: 218475 - RNA, 32 nt, Human
uaagguggcucauaccuauaaucccagcccuu

SEQ ID NO: 218476 - RNA, 32 nt, Human
uaaggugggagaauugcuugagcuugggaagu

SEQ ID NO: 218477 - RNA, 32 nt, Human
uaaggugggaggaucaccugagcucaagaggc

SEQ ID NO: 218478 - RNA, 32 nt, Human
uaaggugggaggaucacuugagcccaggaggu

SEQ ID NO: 218479 - RNA, 32 nt, Human
uaaggugggaggaucacuugauccugggaggu

SEQ ID NO: 218480 - RNA, 32 nt, Human
uaaggugggaggaucguuucagccugggaggu

SEQ ID NO: 218481 - RNA, 32 nt, Human
uaaggugggaggauggcuugagcucaggaugu

SEQ ID NO: 218482 - RNA, 32 nt, Human
uaaggugggcagaucacuugagcccagggguu

SEQ ID NO: 218483 - RNA, 24 nt, Human
uaaggugggcggaucaccugaggu

SEQ ID NO: 218484 - RNA, 24 nt, Human
uaagguggguggaucaccugaggu

SEQ ID NO: 218485 - RNA, 32 nt, Human
uaaggugucagagagcucaguguuccaggauu

SEQ ID NO: 218486 - RNA, 32 nt, Human
uaagguguuaacauugggggaggcuggggcaa

SEQ ID NO: 218487 - RNA, 32 nt, Human
uaagguguucuaauuuucugugagcacacuaa

SEQ ID NO: 218488 - RNA, 32 nt, Human
uaagguuagaagggaaggaaggaaagaucaag

SEQ ID NO: 218489 - RNA, 32 nt, Human
uaagguugagcgcauugagaagagaugucugg

SEQ ID NO: 218490 - RNA, 32 nt, Human
uaagguuggcccuuggaggccauguuuggguc

SEQ ID NO: 218491 - RNA, 32 nt, Human
uaaguaaaacuaaaagcacagaauggugggaa

SEQ ID NO: 218492 - RNA, 32 nt, Human
uaaguaaaguguuaugguaggguucuucagau

SEQ ID NO: 218493 - RNA, 32 nt, Human
uaaguaaauaagaguaguugaacugagcaaua

SEQ ID NO: 218494 - RNA, 32 nt, Human
uaaguaaaugccagucccuaggaagagagaac

SEQ ID NO: 218495 - RNA, 32 nt, Human
uaaguaaccugaccauggcccaacagcaaaca

SEQ ID NO: 218496 - RNA, 32 nt, Human
uaaguaagauaggguuucacuauguuggcuag

SEQ ID NO: 218497 - RNA, 32 nt, Human
uaaguaagcauggagugugucacuggauaaau

SEQ ID NO: 218498 - RNA, 32 nt, Human
uaaguaagcuaaaucaauuuaagccauuaaua

SEQ ID NO: 218499 - RNA, 32 nt, Human
uaaguaaggagaggaggggcagaggagcugcc

SEQ ID NO: 218500 - RNA, 31 nt, Human
uaaguaaguuagagagaaaacauuguaugau

SEQ ID NO: 218501 - RNA, 32 nt, Human
uaaguaaguuugguuucaucaugagggaugaa

SEQ ID NO: 218502 - RNA, 32 nt, Human
uaaguaauauagcauuaagcaaauggucaguu

SEQ ID NO: 218503 - RNA, 23 nt, Human
uaaguaaucagacucagguucca

SEQ ID NO: 218504 - RNA, 32 nt, Human
uaaguaaucccacugaauuccagaaucaugaa

SEQ ID NO: 218505 - RNA, 32 nt, Human
uaaguaauucagugggaauugcagcauaucgu

SEQ ID NO: 218506 - RNA, 32 nt, Human
uaaguaauuucuuuuaucacuaccucaacuga

SEQ ID NO: 218507 - RNA, 32 nt, Human
uaaguacauauguagauauuguuuucuguaaa

SEQ ID NO: 218508 - RNA, 32 nt, Human
uaaguacauuuugcuuuuuaaaguugauuuuu

SEQ ID NO: 218509 - RNA, 32 nt, Human
uaaguacccaugucuuuuucaugucuaaccau

SEQ ID NO: 218510 - RNA, 32 nt, Human
uaaguaccuacaaaugcaaagaaaaauacuac

SEQ ID NO: 218511 - RNA, 32 nt, Human
uaaguaccugcucucccauuaccaccuauuuc

SEQ ID NO: 218512 - RNA, 32 nt, Human
uaaguacuacauaccucaucucuuggguuauu

SEQ ID NO: 218513 - RNA, 32 nt, Human
uaaguagacuugugugacagcuaauucuuaaa

SEQ ID NO: 218514 - RNA, 32 nt, Human
uaaguagagacauuggucucacuguguugccc

SEQ ID NO: 218515 - RNA, 32 nt, Human
uaaguagcagggccaggguagaccuggucagc

SEQ ID NO: 218516 - RNA, 32 nt, Human
uaaguagcucagaaauuaagaaagaaugguau

SEQ ID NO: 218517 - RNA, 32 nt, Human
uaaguagcuugacuaggcagggaccaagcuua

SEQ ID NO: 218518 - RNA, 32 nt, Human
uaaguaggaauuuauuacuugcagaauguuag

SEQ ID NO: 218519 - RNA, 32 nt, Human
uaaguagggcuaagccaguuggaucucugguu

SEQ ID NO: 218520 - RNA, 32 nt, Human
uaaguagggucgaacacagaagugggaaggag

SEQ ID NO: 218521 - RNA, 32 nt, Human
uaaguaggugccagaaccauugcuguuuuccc

SEQ ID NO: 218522 - RNA, 32 nt, Human
uaaguaguuuucugaacggccagaagaccauu

SEQ ID NO: 218523 - RNA, 32 nt, Human
uaaguauaugauugcgaguggaaaaauagggg

SEQ ID NO: 218524 - RNA, 31 nt, Human
uaaguauauuauuucugacaucguaagaaau

SEQ ID NO: 218525 - RNA, 32 nt, Human
uaaguaucaaguuuucuuugugauguuuucug

SEQ ID NO: 218526 - RNA, 22 nt, Human
uaaguaucaguaauucgucuua

SEQ ID NO: 218527 - RNA, 32 nt, Human
uaaguauccaguacuuuauaaccaaagcaauu

SEQ ID NO: 218528 - RNA, 32 nt, Human
uaaguaucccuaauccugaaaucugaaacacu

SEQ ID NO: 218529 - RNA, 32 nt, Human
uaaguauguauaugugcaugggaaaacaacau

SEQ ID NO: 218530 - RNA, 32 nt, Human
uaaguauuaaagauuauuuguaagucauugua

SEQ ID NO: 218531 - RNA, 32 nt, Human
uaaguauucaauuaaaaggaaacaugauuucu

SEQ ID NO: 218532 - RNA, 32 nt, Human
uaaguauucguauucucuucaucccagucuga

SEQ ID NO: 218533 - RNA, 21 nt, Human
uaaguauugagggugacuuua

SEQ ID NO: 218534 - RNA, 32 nt, Human
uaaguauugcuuuuugcugcuauguucugcau

SEQ ID NO: 218535 - RNA, 32 nt, Human
uaaguauuguuuccugagcauaacuccauaag

SEQ ID NO: 218536 - RNA, 32 nt, Human
uaagucaaagauuagagucaacagaaauaaag

SEQ ID NO: 218537 - RNA, 32 nt, Human
uaagucaaauuuuaguggcucuuuaauuccug

SEQ ID NO: 218538 - RNA, 32 nt, Human
uaagucaagcccuuuguguuaagcaagaacua

SEQ ID NO: 218539 - RNA, 32 nt, Human
uaagucaagucacgaagauagagcuuugcgaa

SEQ ID NO: 218540 - RNA, 32 nt, Human
uaagucaauagccauagaaaccuacugacaaa

SEQ ID NO: 218541 - RNA, 23 nt, Human
uaagucaaucuagauuuauuuug

SEQ ID NO: 218542 - RNA, 32 nt, Human
uaagucaccacucaaccaguggcuguuucaca

SEQ ID NO: 218543 - RNA, 32 nt, Human
uaagucacuagccugugaucccagcacuuugg

SEQ ID NO: 218544 - RNA, 32 nt, Human
uaagucacucccagacuagggaagugacucag

SEQ ID NO: 218545 - RNA, 32 nt, Human
uaagucacugaggcuggaguacaguggcauga

SEQ ID NO: 218546 - RNA, 32 nt, Human
uaagucagaacagcagacucagcucugacauu

SEQ ID NO: 218547 - RNA, 32 nt, Human
uaagucagagacaaaauuccacugucuguucc

SEQ ID NO: 218548 - RNA, 32 nt, Human
uaagucagcacacagcaccugcagccuccucu

SEQ ID NO: 218549 - RNA, 32 nt, Human
uaagucagucuagaagaaggagucuccuauuu

SEQ ID NO: 218550 - RNA, 20 nt, Human
uaagucauacauucauuuug

SEQ ID NO: 218551 - RNA, 32 nt, Human
uaagucaucaguacuugcuggaaaagaauaug

SEQ ID NO: 218552 - RNA, 32 nt, Human
uaagucaugauggcuggagcacuggcaaucuu

SEQ ID NO: 218553 - RNA, 24 nt, Human
uaagucauuaugagcuucaucuua

SEQ ID NO: 218554 - RNA, 32 nt, Human
uaagucauuccacuccucaagagaccauucca

SEQ ID NO: 218555 - RNA, 32 nt, Human
uaaguccaaaaacuauagagcagaagaauuga

SEQ ID NO: 218556 - RNA, 32 nt, Human
uaaguccaaaggacaggaccagacuguuggug

SEQ ID NO: 218557 - RNA, 32 nt, Human
uaaguccaccuucuaucccauucauguuagau

SEQ ID NO: 218558 - RNA, 21 nt, Human
uaaguccacugacuuauuuua

SEQ ID NO: 218559 - RNA, 32 nt, Human
uaaguccagcacuuugggaggcugaggcagga

SEQ ID NO: 218560 - RNA, 32 nt, Human
uaaguccaggaguucaagaccagccuggguaa

SEQ ID NO: 218561 - RNA, 32 nt, Human
uaagucccaaagaaagaggcagaggagcgaca

SEQ ID NO: 218562 - RNA, 32 nt, Human
uaagucccaacuugggguugcaaaaucauuuu

SEQ ID NO: 218563 - RNA, 32 nt, Human
uaagucccaugcugggguuugggcauuuagug

SEQ ID NO: 218564 - RNA, 32 nt, Human
uaaguccccagcccccucuccucccagccucu

SEQ ID NO: 218565 - RNA, 32 nt, Human
uaaguccccuuacucaugauucaucaauauuc

SEQ ID NO: 218566 - RNA, 32 nt, Human
uaaguccccuuccucagccucagaccuggagg

SEQ ID NO: 218567 - RNA, 32 nt, Human
uaagucccugcuccuccucuucccuuuggggc

SEQ ID NO: 218568 - RNA, 32 nt, Human
uaaguccucuuucuaaggaaguuuggcugaag

SEQ ID NO: 218569 - RNA, 32 nt, Human
uaaguccuguaagaauagggaagggcggaggg

SEQ ID NO: 218570 - RNA, 32 nt, Human
uaagucggucccugccuugucugucuaggccc

SEQ ID NO: 218571 - RNA, 32 nt, Human
uaagucuagcacacagcacuugagccagcaaa

SEQ ID NO: 218572 - RNA, 32 nt, Human
uaagucuaugugagcaagugagagaagguuag

SEQ ID NO: 218573 - RNA, 32 nt, Human
uaagucucauuucccuaucccucccuucaaga

SEQ ID NO: 218574 - RNA, 32 nt, Human
uaagucucauuucuuuucaugacacauuucuc

SEQ ID NO: 218575 - RNA, 32 nt, Human
uaagucuccugucuuaugguccagaaacuccu

SEQ ID NO: 218576 - RNA, 32 nt, Human
uaagucucgaagggaaaggcaguguggaagca

SEQ ID NO: 218577 - RNA, 21 nt, Human
uaagucucuagcucuccaucu

SEQ ID NO: 218578 - RNA, 18 nt, Human
uaagucucugacaucuug

SEQ ID NO: 218579 - RNA, 32 nt, Human
uaagucugcuggccuccgccaucuuaguaaag

SEQ ID NO: 218580 - RNA, 32 nt, Human
uaagucugggagguugaggcugcagugagcug

SEQ ID NO: 218581 - RNA, 32 nt, Human
uaagucugggcuuauuggacauaauacauauu

SEQ ID NO: 218582 - RNA, 32 nt, Human
uaagucuguggcccaauccccuuccucuccuu

SEQ ID NO: 218583 - RNA, 22 nt, Human
uaagucuuaagucacuuuuuua

SEQ ID NO: 218584 - RNA, 32 nt, Human
uaagucuuacugagaucagccaccccagggga

SEQ ID NO: 218585 - RNA, 32 nt, Human
uaagucuucaaaaugcacaugggaugggaugu

SEQ ID NO: 218586 - RNA, 32 nt, Human
uaagucuuccaaugccaaucugggaccuucag

SEQ ID NO: 218587 - RNA, 32 nt, Human
uaagucuucuaaaaauauaaagauuaguuaaa

SEQ ID NO: 218588 - RNA, 32 nt, Human
uaagucuugcugcugcucacucuuugggucca

SEQ ID NO: 218589 - RNA, 32 nt, Human
uaagucuuuaucagucacccugccucaguuau

SEQ ID NO: 218590 - RNA, 21 nt, Human
uaagucuuucaccuuaacuua

SEQ ID NO: 218591 - RNA, 32 nt, Human
uaagucuuuuggaagcuacaacaacaacgucg

SEQ ID NO: 218592 - RNA, 32 nt, Human
uaagugaaaggagccaaucacaaaagaccaca

SEQ ID NO: 218593 - RNA, 32 nt, Human
uaagugaaauaaacugguucacuaguagagaa

SEQ ID NO: 218594 - RNA, 32 nt, Human
uaagugaagaugcucuuccagagaccaccuuc

SEQ ID NO: 218595 - RNA, 27 nt, Human
uaagugaagugaccccucuucuugccu

SEQ ID NO: 218596 - RNA, 23 nt, Human
uaagugaauccugauuauuucca

SEQ ID NO: 218597 - RNA, 24 nt, Human
uaagugaauggcagucccuugucu

SEQ ID NO: 218598 - RNA, 32 nt, Human
uaagugacaccuaggacccaggaaauaaaugc

SEQ ID NO: 218599 - RNA, 32 nt, Human
uaagugacccccgucaacccacugccucccac

SEQ ID NO: 218600 - RNA, 32 nt, Human
uaagugacuuugguguguucaugggaaacuga

SEQ ID NO: 218601 - RNA, 32 nt, Human
uaagugagaaugagaacugcugugauagggag

SEQ ID NO: 218602 - RNA, 32 nt, Human
uaagugagccgggccuucugagccuucccccg

SEQ ID NO: 218603 - RNA, 32 nt, Human
uaagugagcugggcugggaggcuuccuacagg

SEQ ID NO: 218604 - RNA, 32 nt, Human
uaagugaggaagaagaggccuucaaaugcuua

SEQ ID NO: 218605 - RNA, 32 nt, Human
uaagugaggaagagccuggcauagacucauaa

SEQ ID NO: 218606 - RNA, 32 nt, Human
uaagugaugcagaagccagagagaagguugcu

SEQ ID NO: 218607 - RNA, 31 nt, Human
uaagugauucuucucccuggcaaggcucuuc

SEQ ID NO: 218608 - RNA, 32 nt, Human
uaagugauuuccaaaagcagagguguguggaa

SEQ ID NO: 218609 - RNA, 32 nt, Human
uaagugcacagcccgugacuuggcucagugug

SEQ ID NO: 218610 - RNA, 32 nt, Human
uaagugcaggagacauugguauucugggcagc

SEQ ID NO: 218611 - RNA, 32 nt, Human
uaagugcagguguggggagggauuucacaagu

SEQ ID NO: 218612 - RNA, 32 nt, Human
uaagugcagucuaguuucuguguuccaauucu

SEQ ID NO: 218613 - RNA, 32 nt, Human
uaagugcaugggggaaaauaccuagggcucaa

SEQ ID NO: 218614 - RNA, 32 nt, Human
uaagugcccacuaaaugguggcuguugaggua

SEQ ID NO: 218615 - RNA, 32 nt, Human
uaagugcccucagacagcagugacgggacacu

SEQ ID NO: 218616 - RNA, 32 nt, Human
uaagugccgccuggccugcaugcauuggcuaa

SEQ ID NO: 218617 - RNA, 32 nt, Human
uaagugccuagacuuuaaauagaucuagcaau

SEQ ID NO: 218618 - RNA, 32 nt, Human
uaagugcuagggcuggucacacacaaccaacc

SEQ ID NO: 218619 - RNA, 31 nt, Human
uaagugcucaauaaauacugagugaaauccu

SEQ ID NO: 218620 - RNA, 32 nt, Human
uaagugcugccuggaggccucuacagagacau

SEQ ID NO: 218621 - RNA, 32 nt, Human
uaagugcuggacugcaggcugcagugaucccu

SEQ ID NO: 218622 - RNA, 30 nt, Human
uaagugcugggauuacuuuacaggcgugag

SEQ ID NO: 218623 - RNA, 31 nt, Human
uaagugcuuaauaaauauuugcugaauguua

SEQ ID NO: 218624 - RNA, 32 nt, Human
uaagugcuucuuuggaucucaggcucuaggug

SEQ ID NO: 218625 - RNA, 32 nt, Human
uaagugcuuugagaucuuugaccaacaggugc

SEQ ID NO: 218626 - RNA, 32 nt, Human
uaagugcuuuucuccucugagucuuagcaaug

SEQ ID NO: 218627 - RNA, 32 nt, Human
uaaguggaaauggauugauaauggcacaucuc

SEQ ID NO: 218628 - RNA, 32 nt, Human
uaaguggaacaugcugccacuuuucaauucug

SEQ ID NO: 218629 - RNA, 32 nt, Human
uaaguggaagaggccugcaucacaauugaggu

SEQ ID NO: 218630 - RNA, 32 nt, Human
uaaguggaaugagccgaggauuugaauaucag

SEQ ID NO: 218631 - RNA, 32 nt, Human
uaaguggacacaugcccuuaagaggcuugcuu

SEQ ID NO: 218632 - RNA, 32 nt, Human
uaaguggcacuuccaggacacccauccugagc

SEQ ID NO: 218633 - RNA, 32 nt, Human
uaaguggcaggcacugucucaggugcuagcau

SEQ ID NO: 218634 - RNA, 32 nt, Human
uaaguggccuaggcagucaucccaggcuccaa

SEQ ID NO: 218635 - RNA, 32 nt, Human
uaaguggcugcuccagggaugacagggguuca

SEQ ID NO: 218636 - RNA, 21 nt, Human
uaaguggcuggacuuaucuug

SEQ ID NO: 218637 - RNA, 32 nt, Human
uaaguggcuugucugcagucacccagggcguc

SEQ ID NO: 218638 - RNA, 32 nt, Human
uaagugggaagaggaagggagaggcaagcaac

SEQ ID NO: 218639 - RNA, 32 nt, Human
uaagugggauggcucuccuucucccaagcugc

SEQ ID NO: 218640 - RNA, 32 nt, Human
uaagugggugcucagccuuuuucauaaucaga

SEQ ID NO: 218641 - RNA, 21 nt, Human
uaagugguaagauaauuguaa

SEQ ID NO: 218642 - RNA, 32 nt, Human
uaagugguagggcucacagacugugugaaguc

SEQ ID NO: 218643 - RNA, 32 nt, Human
uaaguggugagggagauggaagcugcacccca

SEQ ID NO: 218644 - RNA, 32 nt, Human
uaagugguuacuaggcagcuugcagugauuuc

SEQ ID NO: 218645 - RNA, 32 nt, Human
uaagugguuauaacaguggauucugacgggga

SEQ ID NO: 218646 - RNA, 32 nt, Human
uaaguguaugaugucacacaagcuccuuaacc

SEQ ID NO: 218647 - RNA, 32 nt, Human
uaagugucagagagcuacguguacccguuucu

SEQ ID NO: 218648 - RNA, 32 nt, Human
uaagugucaguguagcuacuguaggagcacuu

SEQ ID NO: 218649 - RNA, 32 nt, Human
uaagugucauggacaguaaaugaauuugaacu

SEQ ID NO: 218650 - RNA, 32 nt, Human
uaaguguccagcucuguuucugguucuuuccc

SEQ ID NO: 218651 - RNA, 32 nt, Human
uaagugucugagacugacaucggaaccagagg

SEQ ID NO: 218652 - RNA, 32 nt, Human
uaagugugaguacuauacaagcauuaaacugg

SEQ ID NO: 218653 - RNA, 32 nt, Human
uaaguguggugcugcuaacauugcccaggcaa

SEQ ID NO: 218654 - RNA, 32 nt, Human
uaagugugguugaagagcaaaaugcuaauuga

SEQ ID NO: 218655 - RNA, 20 nt, Human
uaagugugugccgccaccca

SEQ ID NO: 218656 - RNA, 21 nt, Human
uaaguguuugcacuuauuuua

SEQ ID NO: 218657 - RNA, 32 nt, Human
uaaguguuuuccaagcaaaaugccucucccau

SEQ ID NO: 218658 - RNA, 32 nt, Human
uaaguguuuuuguucucuaugugucuucuauu

SEQ ID NO: 218659 - RNA, 32 nt, Human
uaaguuaaaagcuuccaugggagccuuccuuc

SEQ ID NO: 218660 - RNA, 32 nt, Human
uaaguuaaaggcaguccagagcuuuucagcca

SEQ ID NO: 218661 - RNA, 32 nt, Human
uaaguuaacaccuuuaaaguguguaguaaagu

SEQ ID NO: 218662 - RNA, 32 nt, Human
uaaguuacaauguuuuauggccuaaauuuauu

SEQ ID NO: 218663 - RNA, 32 nt, Human
uaaguuaguuacccauguccccaaucaaggga

SEQ ID NO: 218664 - RNA, 32 nt, Human
uaaguuauagugaauacugcuacagcaauuuc

SEQ ID NO: 218665 - RNA, 32 nt, Human
uaaguuaucauucuagacaaguuucuuuacaa

SEQ ID NO: 218666 - RNA, 32 nt, Human
uaaguucaaauuuugacuuauuuuacaagugu

SEQ ID NO: 218667 - RNA, 32 nt, Human
uaaguucagcaacuguuuaaccuguuuucagu

SEQ ID NO: 218668 - RNA, 32 nt, Human
uaaguucauccagaaagccaugaaagagggac

SEQ ID NO: 218669 - RNA, 32 nt, Human
uaaguucauccagcagcuccaugagccacaca

SEQ ID NO: 218670 - RNA, 32 nt, Human
uaaguuccacaaaauccaaauuuaccauauua

SEQ ID NO: 218671 - RNA, 32 nt, Human
uaaguuccuccuauuugccacugggcuguugg

SEQ ID NO: 218672 - RNA, 32 nt, Human
uaaguucuaggguacaugugcacaacgugcag

SEQ ID NO: 218673 - RNA, 32 nt, Human
uaaguucucccaguagagauugaguuugagcc

SEQ ID NO: 218674 - RNA, 32 nt, Human
uaaguucugccugaccuaugaggccucaauga

SEQ ID NO: 218675 - RNA, 32 nt, Human
uaaguucugcuuucagcauuuuccuuaaaguu

SEQ ID NO: 218676 - RNA, 32 nt, Human
uaaguucuuaaugucaaccaucuuuaagguau

SEQ ID NO: 218677 - RNA, 32 nt, Human
uaaguucuuccagauuuuaacuguguuaauag

SEQ ID NO: 218678 - RNA, 32 nt, Human
uaaguugccccgucauacucagucccaugcca

SEQ ID NO: 218679 - RNA, 32 nt, Human
uaaguugccugguauuguucagucucuccugc

SEQ ID NO: 218680 - RNA, 32 nt, Human
uaaguugcuaugaucuccaccucaggaucuug

SEQ ID NO: 218681 - RNA, 23 nt, Human
uaaguugcuuuggugccaagaaa

SEQ ID NO: 218682 - RNA, 32 nt, Human
uaaguuggaauucucccacugcccuaaaacuu

SEQ ID NO: 218683 - RNA, 31 nt, Human
uaaguuggauauuucucuacauuccugaaac

SEQ ID NO: 218684 - RNA, 32 nt, Human
uaaguuggauucaaauggccauuuuucuccaa

SEQ ID NO: 218685 - RNA, 32 nt, Human
uaaguuggggaguucaagaccagccugaccaa

SEQ ID NO: 218686 - RNA, 32 nt, Human
uaaguugguguuuggagguggggaggaugcua

SEQ ID NO: 218687 - RNA, 31 nt, Human
uaaguuguacuuuucuguggaggaaauugug

SEQ ID NO: 218688 - RNA, 32 nt, Human
uaaguugucccccaucccaaaguauuccaucu

SEQ ID NO: 218689 - RNA, 32 nt, Human
uaaguugugauugugucugaugaagaggaaug

SEQ ID NO: 218690 - RNA, 32 nt, Human
uaaguuguguauguuuggcaggucacauugaa

SEQ ID NO: 218691 - RNA, 32 nt, Human
uaaguuguuccuuuccccauccuuccuuccuu

SEQ ID NO: 218692 - RNA, 32 nt, Human
uaaguuuagauggaguccaaacgcaguacagc

SEQ ID NO: 218693 - RNA, 32 nt, Human
uaaguuucccagagaaaaugagaugcugaugu

SEQ ID NO: 218694 - RNA, 32 nt, Human
uaaguuuccucaagccuccccugccaugugga

SEQ ID NO: 218695 - RNA, 22 nt, Human
uaaguuucuuaacugcauuuug

SEQ ID NO: 218696 - RNA, 32 nt, Human
uaaguuugagccugaaauuuuaaugaagugca

SEQ ID NO: 218697 - RNA, 32 nt, Human
uaaguuuggacuaaugacuaaaacacuuuaug

SEQ ID NO: 218698 - RNA, 32 nt, Human
uaaguuuggagugcaguggcaugaucaucagu

SEQ ID NO: 218699 - RNA, 32 nt, Human
uaaguuuggcauuauugucagacuggauggag

SEQ ID NO: 218700 - RNA, 31 nt, Human
uaaguuugugagguguggugggugaaacuaa

SEQ ID NO: 218701 - RNA, 32 nt, Human
uaaguuuguuugcuuuuucagguuuaucuuug

SEQ ID NO: 218702 - RNA, 32 nt, Human
uaaguuuuaucuucugucagaaugugaaaagu

SEQ ID NO: 218703 - RNA, 32 nt, Human
uaaguuuucccuucgagacauucuuucagguc

SEQ ID NO: 218704 - RNA, 32 nt, Human
uaaguuuuccugucaagaaagcagaaaccauc

SEQ ID NO: 218705 - RNA, 32 nt, Human
uaauaaaaagaaaagugaagaguaagagaaaa

SEQ ID NO: 218706 - RNA, 32 nt, Human
uaauaaaaauacgaaaaauuagccaggcgugg

SEQ ID NO: 218707 - RNA, 32 nt, Human
uaauaaaaauacgaaaaauuagcugggcaugg

SEQ ID NO: 218708 - RNA, 32 nt, Human
uaauaaaacauuugucuuuuccuugcuaaugu

SEQ ID NO: 218709 - RNA, 32 nt, Human
uaauaaaacccaacagauacuggaaguuuugc

SEQ ID NO: 218710 - RNA, 31 nt, Human
uaauaaaaggauaaagaaaaagcugaagaca

SEQ ID NO: 218711 - RNA, 32 nt, Human
uaauaaaaucccuacauuucugaggccugaau

SEQ ID NO: 218712 - RNA, 32 nt, Human
uaauaaaaugcugcucauugagccaaagagaa

SEQ ID NO: 218713 - RNA, 32 nt, Human
uaauaaacaaguacuaucguagccagggggug

SEQ ID NO: 218714 - RNA, 23 nt, Human
uaauaaacacagauuauuggggg

SEQ ID NO: 218715 - RNA, 32 nt, Human
uaauaaaccuauugauuucucugcuuauaaau

SEQ ID NO: 218716 - RNA, 32 nt, Human
uaauaaaccuuugaccagugucuuccaaguag

SEQ ID NO: 218717 - RNA, 32 nt, Human
uaauaaagacaggguuucaccauguuggccag

SEQ ID NO: 218718 - RNA, 32 nt, Human
uaauaaagacgggguuucaucauguuggccag

SEQ ID NO: 218719 - RNA, 32 nt, Human
uaauaaagagcaauuuguaacugaguggcacu

SEQ ID NO: 218720 - RNA, 32 nt, Human
uaauaaagaugggguuucaccauguuggucag

SEQ ID NO: 218721 - RNA, 32 nt, Human
uaauaaagcucucaaaagauguugauucucaa

SEQ ID NO: 218722 - RNA, 28 nt, Human
uaauaaagcugcauacaguuuggcuugg

SEQ ID NO: 218723 - RNA, 32 nt, Human
uaauaaagcuguugccaagcuggacggcacga

SEQ ID NO: 218724 - RNA, 32 nt, Human
uaauaaaggcauuucaaagucucacuuuuauu

SEQ ID NO: 218725 - RNA, 26 nt, Human
uaauaaaguaguuauuuuauagggga

SEQ ID NO: 218726 - RNA, 22 nt, Human
uaauaaauacaauaugcuacuc

SEQ ID NO: 218727 - RNA, 21 nt, Human
uaauaaauaccauaguagcuc

SEQ ID NO: 218728 - RNA, 32 nt, Human
uaauaaauacccuuggucuuucuucuagucac

SEQ ID NO: 218729 - RNA, 32 nt, Human
uaauaaauacuaguuauuuacaacuuuugcuc

SEQ ID NO: 218730 - RNA, 32 nt, Human
uaauaaaugauggcugggugcggugucucaug

SEQ ID NO: 218731 - RNA, 32 nt, Human
uaauaaaugccaccacauucuaccagcacaag

SEQ ID NO: 218732 - RNA, 32 nt, Human
uaauaaauggcagagugagcauucaaguccag

SEQ ID NO: 218733 - RNA, 32 nt, Human
uaauaaauggcagggccuaaacaagcccuuag

SEQ ID NO: 218734 - RNA, 32 nt, Human
uaauaaauggugcuagauauugcuacuauuuu

SEQ ID NO: 218735 - RNA, 32 nt, Human
uaauaaauggugcugggaaaacuggcuagcca

SEQ ID NO: 218736 - RNA, 32 nt, Human
uaauaaauggugcugggagaacuggcuagcca

SEQ ID NO: 218737 - RNA, 32 nt, Human
uaauaacacuucaccuucuguaauacuaaguc

SEQ ID NO: 218738 - RNA, 32 nt, Human
uaauaacaggcugggugcaauggcucacaccu

SEQ ID NO: 218739 - RNA, 32 nt, Human
uaauaacagugcagugucuacacaggagguaa

SEQ ID NO: 218740 - RNA, 32 nt, Human
uaauaacauucuaguagacucucgaugguggu

SEQ ID NO: 218741 - RNA, 32 nt, Human
uaauaaccaaccaaccaaccaaccaaacuucc

SEQ ID NO: 218742 - RNA, 31 nt, Human
uaauaacugaaacugccucagagaguuguga

SEQ ID NO: 218743 - RNA, 32 nt, Human
uaauaagacuccaacccuaauggcccaacagg

SEQ ID NO: 218744 - RNA, 31 nt, Human
uaauaagagcacuucuguauuccuugggacu

SEQ ID NO: 218745 - RNA, 32 nt, Human
uaauaagauauuguauuuuacuucagcuaugg

SEQ ID NO: 218746 - RNA, 32 nt, Human
uaauaagcaugcauacuuuaacuucuauaguu

SEQ ID NO: 218747 - RNA, 32 nt, Human
uaauaagcauuuucauugcagcagcaaauccu

SEQ ID NO: 218748 - RNA, 32 nt, Human
uaauaagcccucacuguacagaacagcccguu

SEQ ID NO: 218749 - RNA, 32 nt, Human
uaauaagccugucacucaacagguacgacaag

SEQ ID NO: 218750 - RNA, 32 nt, Human
uaauaaggagcuaugacuggagucaggagaag

SEQ ID NO: 218751 - RNA, 32 nt, Human
uaauaaggagucagaccuaaaagggggugggg

SEQ ID NO: 218752 - RNA, 32 nt, Human
uaauaaggauucauggcucagagggauuuucu

SEQ ID NO: 218753 - RNA, 32 nt, Human
uaauaagucaugucccagccugggcaacauag

SEQ ID NO: 218754 - RNA, 32 nt, Human
uaauaagugggaaagagagggacgggucugau

SEQ ID NO: 218755 - RNA, 29 nt, Human
uaauaauaaagcaguuuuaaccugccaaa

SEQ ID NO: 218756 - RNA, 32 nt, Human
uaauaauacauacaugauuuuucuucugaaug

SEQ ID NO: 218757 - RNA, 32 nt, Human
uaauaauagcaacccuugucucccucuucucu

SEQ ID NO: 218758 - RNA, 32 nt, Human
uaauaauagcucaguuuuuaaaggaggggaac

SEQ ID NO: 218759 - RNA, 32 nt, Human
uaauaauaggacaggacacagagcuggaauau

SEQ ID NO: 218760 - RNA, 32 nt, Human
uaauaauaggagaauagaagaacugguagcca

SEQ ID NO: 218761 - RNA, 32 nt, Human
uaauaauauaaggaaaaagggaaaguaaacua

SEQ ID NO: 218762 - RNA, 32 nt, Human
uaauaauauuagccugaugcagauaccaaaga

SEQ ID NO: 218763 - RNA, 32 nt, Human
uaauaauauuuucuucugccucaggcuccaaa

SEQ ID NO: 218764 - RNA, 32 nt, Human
uaauaaucauaugucagcauucugacuacuua

SEQ ID NO: 218765 - RNA, 32 nt, Human
uaauaaucauuuccuacuauuugcauuaagaa

SEQ ID NO: 218766 - RNA, 32 nt, Human
uaauaauccauucaguaauguuauaguuaucc

SEQ ID NO: 218767 - RNA, 32 nt, Human
uaauaaucccuuuaaauuuuaucuguugcugu

SEQ ID NO: 218768 - RNA, 32 nt, Human
uaauaauccuuaaaaaucagcacacaaaucca

SEQ ID NO: 218769 - RNA, 32 nt, Human
uaauaaugauggucaacaauaagccacgucaa

SEQ ID NO: 218770 - RNA, 32 nt, Human
uaauaaugaugucaauuucaugaaaagccuga

SEQ ID NO: 218771 - RNA, 32 nt, Human
uaauaauggaguuuaccagugcuugucaacua

SEQ ID NO: 218772 - RNA, 32 nt, Human
uaauaauucauuucugucaaacuguaagagua

SEQ ID NO: 218773 - RNA, 32 nt, Human
uaauaauuuuaugugagaauguuuucaaaaag

SEQ ID NO: 218774 - RNA, 32 nt, Human
uaauacaaguaauauuauuacuuuaugaacaa

SEQ ID NO: 218775 - RNA, 32 nt, Human
uaauacacacagaaaaacuggcauuuauuuug

SEQ ID NO: 218776 - RNA, 32 nt, Human
uaauacacagccccuggauggggaggggguag

SEQ ID NO: 218777 - RNA, 32 nt, Human
uaauacaccuagugaggaguggagcugaauuu

SEQ ID NO: 218778 - RNA, 32 nt, Human
uaauacaguaaauuuguagccaguuguagaaa

SEQ ID NO: 218779 - RNA, 32 nt, Human
uaauacauagcccuauguaccaaaaaguaagg

SEQ ID NO: 218780 - RNA, 32 nt, Human
uaauacauagguguguuccaggauuuguucag

SEQ ID NO: 218781 - RNA, 32 nt, Human
uaauacaucaugaacugcagguuguggaagaa

SEQ ID NO: 218782 - RNA, 32 nt, Human
uaauacaugccuguggucucagcuacucggga

SEQ ID NO: 218783 - RNA, 27 nt, Human
uaauaccaaacuugaaaaagcggccgc

SEQ ID NO: 218784 - RNA, 32 nt, Human
uaauaccaacagcuaucguuucugaccauuua

SEQ ID NO: 218785 - RNA, 32 nt, Human
uaauaccacaguucuaaaugugcacuguuggc

SEQ ID NO: 218786 - RNA, 32 nt, Human
uaauaccacugcagagaauccaucuaaaagua

SEQ ID NO: 218787 - RNA, 32 nt, Human
uaauaccagcacuuugggaggcugaggcaggc

SEQ ID NO: 218788 - RNA, 32 nt, Human
uaauaccagcgcuuugggaggcugaggcagga

SEQ ID NO: 218789 - RNA, 32 nt, Human
uaauaccagcguuuugggaggcugagauggga

SEQ ID NO: 218790 - RNA, 32 nt, Human
uaauaccagcuacucaggaggcugaggcagga

SEQ ID NO: 218791 - RNA, 32 nt, Human
uaauaccagcuacucagguggcugaggcauaa

SEQ ID NO: 218792 - RNA, 32 nt, Human
uaauaccagcuacuccggaggcugaggcagga

SEQ ID NO: 218793 - RNA, 32 nt, Human
uaauaccagcucucugggaggcugaggcgggu

SEQ ID NO: 218794 - RNA, 32 nt, Human
uaauaccgugcuauuucagauaugggugagga

SEQ ID NO: 218795 - RNA, 32 nt, Human
uaauaccuauucuucaaccaccucgguuacuc

SEQ ID NO: 218796 - RNA, 32 nt, Human
uaauaccuguuuaauauugucuuccuaauugg

SEQ ID NO: 218797 - RNA, 32 nt, Human
uaauaccuuacuaaauacuucgucucauuagu

SEQ ID NO: 218798 - RNA, 32 nt, Human
uaauacgagaaauuugaugagagaggcgggcc

SEQ ID NO: 218799 - RNA, 32 nt, Human
uaauacuaacuacuacauacucgguacaaagu

SEQ ID NO: 218800 - RNA, 18 nt, Human
uaauacuacuagcuucca

SEQ ID NO: 218801 - RNA, 32 nt, Human
uaauacuauaaauacuugauuguaaacuaaau

SEQ ID NO: 218802 - RNA, 32 nt, Human
uaauacucaaaccauuguaaaguugcugacua

SEQ ID NO: 218803 - RNA, 32 nt, Human
uaauacucuccucgacaagucaugcuguuuua

SEQ ID NO: 218804 - RNA, 32 nt, Human
uaauacugagcaugaaaaaucauagcaaggca

SEQ ID NO: 218805 - RNA, 32 nt, Human
uaauacugaugugauggaugcauuuguuuugc

SEQ ID NO: 218806 - RNA, 25 nt, Human
uaauacugccuucugccuuugggac

SEQ ID NO: 218807 - RNA, 32 nt, Human
uaauacuguggcuuauaccugagccacacauc

SEQ ID NO: 218808 - RNA, 32 nt, Human
uaauacuuaaggcacuauggcacuuagcuuug

SEQ ID NO: 218809 - RNA, 32 nt, Human
uaauacuucaaacuggaaagucaccuggucga

SEQ ID NO: 218810 - RNA, 25 nt, Human
uaauagaaaugcuuuuuauugagga

SEQ ID NO: 218811 - RNA, 32 nt, Human
uaauagaaccucuuuccaccacugccuucauc

SEQ ID NO: 218812 - RNA, 32 nt, Human
uaauagaauggcacuguaaguguuuauuauuu

SEQ ID NO: 218813 - RNA, 32 nt, Human
uaauagaccugguacaugguacacacaccccc

SEQ ID NO: 218814 - RNA, 32 nt, Human
uaauagagaagaaaggacagcuuccuaugggg

SEQ ID NO: 218815 - RNA, 32 nt, Human
uaauagagacaggguuucacaauguugaccag

SEQ ID NO: 218816 - RNA, 32 nt, Human
uaauagagacaggguuucaccauguuagccac

SEQ ID NO: 218817 - RNA, 32 nt, Human
uaauagagacaggguuucaccauguuagccag

SEQ ID NO: 218818 - RNA, 32 nt, Human
uaauagagacggaguuucaccauguugaccag

SEQ ID NO: 218819 - RNA, 32 nt, Human
uaauagagacgggguuucaccauguuagccag

SEQ ID NO: 218820 - RNA, 32 nt, Human
uaauagagacgggguuucaccauguuggccag

SEQ ID NO: 218821 - RNA, 32 nt, Human
uaauagagacgggguuucacuguguuagccag

SEQ ID NO: 218822 - RNA, 32 nt, Human
uaauagagacgggguuucacuuuguuagccag

SEQ ID NO: 218823 - RNA, 32 nt, Human
uaauagagacgggguuucaucauguuggccag

SEQ ID NO: 218824 - RNA, 32 nt, Human
uaauagagacgggguuucgccauuuggccagg

SEQ ID NO: 218825 - RNA, 32 nt, Human
uaauagagacgggguuuuaccauguuggccag

SEQ ID NO: 218826 - RNA, 32 nt, Human
uaauagagacuggguuucaccauguugaccgg

SEQ ID NO: 218827 - RNA, 32 nt, Human
uaauagagaggggguuuuuccauguuggccag

SEQ ID NO: 218828 - RNA, 32 nt, Human
uaauagagaugagguuucaccaugauggccag

SEQ ID NO: 218829 - RNA, 32 nt, Human
uaauagagaugggauuucaucauguuggcuag

SEQ ID NO: 218830 - RNA, 32 nt, Human
uaauagagaugggguuucaccauguuggccag

SEQ ID NO: 218831 - RNA, 32 nt, Human
uaauagagaugggguuucaccauguugguuag

SEQ ID NO: 218832 - RNA, 32 nt, Human
uaauagagaugggguuucgccauguuggccag

SEQ ID NO: 218833 - RNA, 32 nt, Human
uaauagagaugggguuuugccauguuggccag

SEQ ID NO: 218834 - RNA, 32 nt, Human
uaauagagccaggguuuugccauguuggccag

SEQ ID NO: 218835 - RNA, 32 nt, Human
uaauagaggcgggguuucaucauguugaacuc

SEQ ID NO: 218836 - RNA, 32 nt, Human
uaauagaggcugaggagauugcaggggaaaca

SEQ ID NO: 218837 - RNA, 32 nt, Human
uaauagagguaggaauccagagccagagaggu

SEQ ID NO: 218838 - RNA, 32 nt, Human
uaauagagugguacauuuguuacaacugauga

SEQ ID NO: 218839 - RNA, 32 nt, Human
uaauagauacaggguuucaccacguugcucag

SEQ ID NO: 218840 - RNA, 32 nt, Human
uaauagauaugggguuucgccauguuggccag

SEQ ID NO: 218841 - RNA, 32 nt, Human
uaauagauuuggaauuuuugaaaugaaaugaa

SEQ ID NO: 218842 - RNA, 32 nt, Human
uaauagcaagagacagagggggcugggagugu

SEQ ID NO: 218843 - RNA, 21 nt, Human
uaauagcaagugcaacuaacu

SEQ ID NO: 218844 - RNA, 32 nt, Human
uaauagcacugggauuuugccucccagccaaa

SEQ ID NO: 218845 - RNA, 32 nt, Human
uaauagcagacugcacaugagcagagugacau

SEQ ID NO: 218846 - RNA, 32 nt, Human
uaauagcagcuacucgggaggcugaggcagga

SEQ ID NO: 218847 - RNA, 32 nt, Human
uaauagcagcuacugagguggcugaggcacaa

SEQ ID NO: 218848 - RNA, 18 nt, Human
uaauagcagggucagacu

SEQ ID NO: 218849 - RNA, 18 nt, Human
uaauagcauagacuggac

SEQ ID NO: 218850 - RNA, 18 nt, Human
uaauagcaugauugagac

SEQ ID NO: 218851 - RNA, 21 nt, Human
uaauagcaugucaacuggacu

SEQ ID NO: 218852 - RNA, 31 nt, Human
uaauagcauucucucugacauuuaaaaauaa

SEQ ID NO: 218853 - RNA, 32 nt, Human
uaauagccacaaguucuuguuuagagaccaga

SEQ ID NO: 218854 - RNA, 32 nt, Human
uaauagccauggauugcugugccucucgaggc

SEQ ID NO: 218855 - RNA, 32 nt, Human
uaauagccauuugaagaaggaggaauuuuaga

SEQ ID NO: 218856 - RNA, 32 nt, Human
uaauagccucaccuucccuaguucuuugcauu

SEQ ID NO: 218857 - RNA, 32 nt, Human
uaauagccuuuccaaagaaaugagggcaugau

SEQ ID NO: 218858 - RNA, 32 nt, Human
uaauagccuuuccuuacuguuguuugguucug

SEQ ID NO: 218859 - RNA, 32 nt, Human
uaauagcuauagucucuucagcauuuuguuua

SEQ ID NO: 218860 - RNA, 32 nt, Human
uaauagcuguuuaacaaauuagucuuugcuga

SEQ ID NO: 218861 - RNA, 32 nt, Human
uaauaggaaaacaaaacccaaagcuuuucaaa

SEQ ID NO: 218862 - RNA, 32 nt, Human
uaauaggagcuuccagcucuaauaaaacagcu

SEQ ID NO: 218863 - RNA, 32 nt, Human
uaauaggagggguuaagguucaugagaaccau

SEQ ID NO: 218864 - RNA, 32 nt, Human
uaauaggcacuuaaguggcuuccaauuuuugg

SEQ ID NO: 218865 - RNA, 32 nt, Human
uaauaggcuagggagagaggggugcugucugc

SEQ ID NO: 218866 - RNA, 32 nt, Human
uaauaggcugggagacugaagacucagcccgg

SEQ ID NO: 218867 - RNA, 32 nt, Human
uaauagggaagccacacucaaugagcaucucu

SEQ ID NO: 218868 - RNA, 32 nt, Human
uaauaggggcagacacaacagcguggcuuaga

SEQ ID NO: 218869 - RNA, 32 nt, Human
uaauagguuucugacuuuuguggaucauuuug

SEQ ID NO: 218870 - RNA, 32 nt, Human
uaauaguauacaaaagcuauuuaauucuuuaa

SEQ ID NO: 218871 - RNA, 32 nt, Human
uaauaguauuagaacucauucccugaacugau

SEQ ID NO: 218872 - RNA, 32 nt, Human
uaauagugaucucaauaccacacccucaugga

SEQ ID NO: 218873 - RNA, 32 nt, Human
uaauagugaugaucguauguugcugucuccau

SEQ ID NO: 218874 - RNA, 32 nt, Human
uaauagugcaggaagggaugagcuuuugauuu

SEQ ID NO: 218875 - RNA, 32 nt, Human
uaauagugguuuugcaguguacuggcuugaau

SEQ ID NO: 218876 - RNA, 32 nt, Human
uaauagugucuucuccccggguuugguggccu

SEQ ID NO: 218877 - RNA, 32 nt, Human
uaauagugugaugaaccauucuucugaagguu

SEQ ID NO: 218878 - RNA, 32 nt, Human
uaauaguuucauauuuucuccaucucuuuuug

SEQ ID NO: 218879 - RNA, 32 nt, Human
uaauauaaacuguguucauuacacugcugaua

SEQ ID NO: 218880 - RNA, 32 nt, Human
uaauauaacugauaccuugagagauggcugga

SEQ ID NO: 218881 - RNA, 32 nt, Human
uaauauaccuucagaauaucaaagcgaaaacu

SEQ ID NO: 218882 - RNA, 32 nt, Human
uaauauaguagagaucuuccaugaagauaaca

SEQ ID NO: 218883 - RNA, 32 nt, Human
uaauauaguagggguugaagaaaacaaaauag

SEQ ID NO: 218884 - RNA, 32 nt, Human
uaauauaucagcagcauguaucugccaaucau

SEQ ID NO: 218885 - RNA, 32 nt, Human
uaauauauguagcacacacacauagauguaua

SEQ ID NO: 218886 - RNA, 32 nt, Human
uaauauauucggcccauauuuuguguguuugg

SEQ ID NO: 218887 - RNA, 32 nt, Human
uaauaucaaacaaucccuuuaagaacuuauua

SEQ ID NO: 218888 - RNA, 32 nt, Human
uaauaucagcuacucaggaggcugaggcagga

SEQ ID NO: 218889 - RNA, 32 nt, Human
uaauaucccauggcuaaaaggaagauccuaag

SEQ ID NO: 218890 - RNA, 32 nt, Human
uaauaucccuauccagugcuugcccuuggaau

SEQ ID NO: 218891 - RNA, 32 nt, Human
uaauaucccuccccauucuucucuuccccucu

SEQ ID NO: 218892 - RNA, 32 nt, Human
uaauauccucaccuuuccuucucaccuguccu

SEQ ID NO: 218893 - RNA, 32 nt, Human
uaauaucucuguccccuugauccuggcauucu

SEQ ID NO: 218894 - RNA, 32 nt, Human
uaauaucugaccuugccuccugacugaugguc

SEQ ID NO: 218895 - RNA, 32 nt, Human
uaauaugaaauguuaacggcucagagcuaacg

SEQ ID NO: 218896 - RNA, 32 nt, Human
uaauaugaagaccaaaugauagaacuguacug

SEQ ID NO: 218897 - RNA, 32 nt, Human
uaauaugagcacaucaagguugacuucucauc

SEQ ID NO: 218898 - RNA, 31 nt, Human
uaauaugagcucuucugacaacuguagacac

SEQ ID NO: 218899 - RNA, 32 nt, Human
uaauaugccaacacccuucucggaggcucagg

SEQ ID NO: 218900 - RNA, 32 nt, Human
uaauaugcuacuucuguguauguuguguaugg

SEQ ID NO: 218901 - RNA, 32 nt, Human
uaauaugcucugggcuggagaaaugaaauccu

SEQ ID NO: 218902 - RNA, 32 nt, Human
uaauaugcugccaaauuuuggccaaaguguua

SEQ ID NO: 218903 - RNA, 32 nt, Human
uaauaugcuugcaaacauuacugcugcguuau

SEQ ID NO: 218904 - RNA, 32 nt, Human
uaauauggagaauccuuugucuuccacucacu

SEQ ID NO: 218905 - RNA, 32 nt, Human
uaauauggagcuuucauaaaaaugggaugcau

SEQ ID NO: 218906 - RNA, 32 nt, Human
uaauauggauuucugcuccuuguugcuugcua

SEQ ID NO: 218907 - RNA, 32 nt, Human
uaauauggcauuugaauuccauuuuucugaag

SEQ ID NO: 218908 - RNA, 32 nt, Human
uaauauggguuagauaggucaugacgguaggg

SEQ ID NO: 218909 - RNA, 29 nt, Human
uaauauguggugcugggaaaacuggcuag

SEQ ID NO: 218910 - RNA, 32 nt, Human
uaauauguugacuguuguauguuuggacuaau

SEQ ID NO: 218911 - RNA, 32 nt, Human
uaauauguugucuuuuauauuuuuauuuaaau

SEQ ID NO: 218912 - RNA, 32 nt, Human
uaauauuacagaaccaguucugggaccaccuu

SEQ ID NO: 218913 - RNA, 32 nt, Human
uaauauuacaggaaauucuuaggauauaccau

SEQ ID NO: 218914 - RNA, 32 nt, Human
uaauauuagccugaugcagauaccaaagauaa

SEQ ID NO: 218915 - RNA, 32 nt, Human
uaauauucaaugcccagccaaagacccuaaau

SEQ ID NO: 218916 - RNA, 32 nt, Human
uaauauucagauacauuaucuuggcugcuaac

SEQ ID NO: 218917 - RNA, 32 nt, Human
uaauauucccuaauguguucaugccagaauuc

SEQ ID NO: 218918 - RNA, 32 nt, Human
uaauauucuauagccuauuuucuuuuauaaau

SEQ ID NO: 218919 - RNA, 32 nt, Human
uaauauucucagaacuuauggcauuuuacuau

SEQ ID NO: 218920 - RNA, 32 nt, Human
uaauauucuuuccccucuggccuucuuacagu

SEQ ID NO: 218921 - RNA, 32 nt, Human
uaauauugagugauccaugaaguagguuuuca

SEQ ID NO: 218922 - RNA, 32 nt, Human
uaauauugauuucugcccucagcuucaaauaa

SEQ ID NO: 218923 - RNA, 32 nt, Human
uaauauuggccuuggggcucuccagcccuuug

SEQ ID NO: 218924 - RNA, 32 nt, Human
uaauauuuaguaggaguauaugaaaggauugc

SEQ ID NO: 218925 - RNA, 32 nt, Human
uaauauuuagugggagaccauaaugugucagc

SEQ ID NO: 218926 - RNA, 17 nt, Human
uaauauuugauggcagu

SEQ ID NO: 218927 - RNA, 32 nt, Human
uaauauuuggcauggaauaaugccuagccuua

SEQ ID NO: 218928 - RNA, 32 nt, Human
uaauauuugugcugaaaauauguuucaguauu

SEQ ID NO: 218929 - RNA, 32 nt, Human
uaauauuuugaaaauuuucucaguuaaauuuc

SEQ ID NO: 218930 - RNA, 32 nt, Human
uaauauuuuugaaagaguucuuuuagguuaau

SEQ ID NO: 218931 - RNA, 32 nt, Human
uaaucaaaggcugaaaucucugccugaccugg

SEQ ID NO: 218932 - RNA, 32 nt, Human
uaaucaaaguacugcugaacugugagugcagu

SEQ ID NO: 218933 - RNA, 32 nt, Human
uaaucaaaucuauugacaguaucugcaguucu

SEQ ID NO: 218934 - RNA, 32 nt, Human
uaaucaaauugcuucugacuggaugguauuug

SEQ ID NO: 218935 - RNA, 32 nt, Human
uaaucaaccacccucccuucccaaaccaccca

SEQ ID NO: 218936 - RNA, 32 nt, Human
uaaucaaccuuuaugugacucucaccuucuga

SEQ ID NO: 218937 - RNA, 32 nt, Human
uaaucaagaagagcaaagcauggauucaaacu

SEQ ID NO: 218938 - RNA, 32 nt, Human
uaaucaagaccagacuguuucuugucacugga

SEQ ID NO: 218939 - RNA, 32 nt, Human
uaaucaagcaugaagaggaacagaggugaugu

SEQ ID NO: 218940 - RNA, 31 nt, Human
uaaucaaggaucucuuccacauuccuccuuc

SEQ ID NO: 218941 - RNA, 32 nt, Human
uaaucaaggccccagaguguguaugcuuccag

SEQ ID NO: 218942 - RNA, 32 nt, Human
uaaucaagggggcagauagcagaggaaaauaa

SEQ ID NO: 218943 - RNA, 31 nt, Human
uaaucaauaaaguaugucuguugaagcaagc

SEQ ID NO: 218944 - RNA, 32 nt, Human
uaaucaauuacccaaaggcugcaccugccgug

SEQ ID NO: 218945 - RNA, 32 nt, Human
uaaucacaacacuuugggaggcugaggcgggc

SEQ ID NO: 218946 - RNA, 32 nt, Human
uaaucacaacacuuugggaggcugagguggga

SEQ ID NO: 218947 - RNA, 32 nt, Human
uaaucacaagaaggaggcaggaagggagaguc

SEQ ID NO: 218948 - RNA, 32 nt, Human
uaaucacaccacugcacuccagccugggcaac

SEQ ID NO: 218949 - RNA, 32 nt, Human
uaaucacaccacugcacuccagcuugggggau

SEQ ID NO: 218950 - RNA, 32 nt, Human
uaaucacagcacuucgggaggcugaaguggga

SEQ ID NO: 218951 - RNA, 32 nt, Human
uaaucacagcacuuugggaggcugaggcgcgu

SEQ ID NO: 218952 - RNA, 32 nt, Human
uaaucacagcacuuugggaggcugaggugggc

SEQ ID NO: 218953 - RNA, 32 nt, Human
uaaucacagcauguaccgggacccggggugca

SEQ ID NO: 218954 - RNA, 32 nt, Human
uaaucacagcuacucgggaggcugaggcagag

SEQ ID NO: 218955 - RNA, 32 nt, Human
uaaucacagcuacuugggaggcugagauggga

SEQ ID NO: 218956 - RNA, 32 nt, Human
uaaucacagcuacuugggaggcugaggcagga

SEQ ID NO: 218957 - RNA, 32 nt, Human
uaaucacagcuacuugggaggcugaggcauga

SEQ ID NO: 218958 - RNA, 32 nt, Human
uaaucacagguccagagagcuuuauggaagcg

SEQ ID NO: 218959 - RNA, 32 nt, Human
uaaucacagugacucaggaggcugaggugaga

SEQ ID NO: 218960 - RNA, 32 nt, Human
uaaucacauaucuggggcaggccuagugccaa

SEQ ID NO: 218961 - RNA, 32 nt, Human
uaaucacaucaguuuggcaaucuaagaugucu

SEQ ID NO: 218962 - RNA, 32 nt, Human
uaaucaccaacccaucaacaucaagccucccc

SEQ ID NO: 218963 - RNA, 32 nt, Human
uaaucacccacugauuaguggcagagcguagg

SEQ ID NO: 218964 - RNA, 32 nt, Human
uaaucacccagagggagcuggucuccagccag

SEQ ID NO: 218965 - RNA, 32 nt, Human
uaaucacgccacugcacuccagccugggcugc

SEQ ID NO: 218966 - RNA, 32 nt, Human
uaaucacuaggggaagaaaaaguaggccuacc

SEQ ID NO: 218967 - RNA, 24 nt, Human
uaaucacuauaaaaagcaaaagua

SEQ ID NO: 218968 - RNA, 32 nt, Human
uaaucacucagugcccuuagcuagccugacua

SEQ ID NO: 218969 - RNA, 32 nt, Human
uaaucacugcacuccaaccuggcaacagagug

SEQ ID NO: 218970 - RNA, 32 nt, Human
uaaucagaaaugcagaagccaccugccccaca

SEQ ID NO: 218971 - RNA, 32 nt, Human
uaaucagaacuaccuggcaucuuccugaacaa

SEQ ID NO: 218972 - RNA, 32 nt, Human
uaaucagaagcuaagcugggugcaguggcuca

SEQ ID NO: 218973 - RNA, 32 nt, Human
uaaucagaaguuucacuuguuucucaguuauu

SEQ ID NO: 218974 - RNA, 32 nt, Human
uaaucagagacacaaucauagcacaccacagc

SEQ ID NO: 218975 - RNA, 23 nt, Human
uaaucagcaauauugccugugcu

SEQ ID NO: 218976 - RNA, 32 nt, Human
uaaucagcauggacuguguucaggacacaggg

SEQ ID NO: 218977 - RNA, 32 nt, Human
uaaucagcccaggauggagggucuguguugug

SEQ ID NO: 218978 - RNA, 32 nt, Human
uaaucagcucaauggacccucugccuuaucac

SEQ ID NO: 218979 - RNA, 32 nt, Human
uaaucaggaggaagaggaaggaaggacuuacc

SEQ ID NO: 218980 - RNA, 32 nt, Human
uaaucaggcaggugguguuugcucuuagguga

SEQ ID NO: 218981 - RNA, 32 nt, Human
uaaucagggccugagugcuuuaccuuuaaaau

SEQ ID NO: 218982 - RNA, 32 nt, Human
uaaucaguaaacagcagcuacugugugcacaa

SEQ ID NO: 218983 - RNA, 32 nt, Human
uaaucagucccuuuuugcuuucuuuuacgacc

SEQ ID NO: 218984 - RNA, 32 nt, Human
uaaucaguggugcuuuuguaccuagguuuuau

SEQ ID NO: 218985 - RNA, 32 nt, Human
uaaucauacaaacuagaauacugcuagucucc

SEQ ID NO: 218986 - RNA, 32 nt, Human
uaaucauagcauuaugggaggcugaggcgggc

SEQ ID NO: 218987 - RNA, 32 nt, Human
uaaucauauccaggaguuugcaagaaacaggu

SEQ ID NO: 218988 - RNA, 32 nt, Human
uaaucauaucuuuuaauuguguauuuaagaaa

SEQ ID NO: 218989 - RNA, 32 nt, Human
uaaucaucacagacuugaguuugcuuccuaaa

SEQ ID NO: 218990 - RNA, 32 nt, Human
uaaucaucacauaaauucaaaugcaaaaacca

SEQ ID NO: 218991 - RNA, 32 nt, Human
uaaucaucagguuuacucagugaaaucauauu

SEQ ID NO: 218992 - RNA, 32 nt, Human
uaaucaucuucucuuuuuccagaauuuggaag

SEQ ID NO: 218993 - RNA, 32 nt, Human
uaaucaugccacugcauucuagcuuugauggc

SEQ ID NO: 218994 - RNA, 32 nt, Human
uaaucaugccacuguacuccagccugggugac

SEQ ID NO: 218995 - RNA, 32 nt, Human
uaaucaugcccuucacugacagucuccuuaac

SEQ ID NO: 218996 - RNA, 31 nt, Human
uaaucauggcagccaggaugggugaaugaug

SEQ ID NO: 218997 - RNA, 30 nt, Human
uaaucaugucccugguggaggccaucagcc

SEQ ID NO: 218998 - RNA, 22 nt, Human
uaaucaugucggugucauguca

SEQ ID NO: 218999 - RNA, 32 nt, Human
uaaucaugugcuccucuccuucccaaggaacc

SEQ ID NO: 219000 - RNA, 20 nt, Human
uaaucauguucugguauguc

SEQ ID NO: 219001 - RNA, 32 nt, Human
uaaucauuaguuuuagaggcauuguuaguuua

SEQ ID NO: 219002 - RNA, 32 nt, Human
uaaucauucauccucacaguggcaauaaucac

SEQ ID NO: 219003 - RNA, 32 nt, Human
uaaucauugccaccucuucgcuacaugaacua

SEQ ID NO: 219004 - RNA, 19 nt, Human
uaaucauuggauuuaggga

SEQ ID NO: 219005 - RNA, 32 nt, Human
uaaucauuucaguccugugcugugagugauau

SEQ ID NO: 219006 - RNA, 32 nt, Human
uaaucauuugggaggcauggcuguaauucuuu

SEQ ID NO: 219007 - RNA, 32 nt, Human
uaauccaaaacaccuuccgccucccagagcuu

SEQ ID NO: 219008 - RNA, 32 nt, Human
uaauccaaaguagagauguuauuacucaauuc

SEQ ID NO: 219009 - RNA, 32 nt, Human
uaauccaaaucucuguggcuucaugcuuguau

SEQ ID NO: 219010 - RNA, 32 nt, Human
uaauccaacacacaccugcaaugauuacugug

SEQ ID NO: 219011 - RNA, 32 nt, Human
uaauccaagauacucaggaggcugaggcagga

SEQ ID NO: 219012 - RNA, 32 nt, Human
uaauccaagcacuuugagaggcugaggcgggu

SEQ ID NO: 219013 - RNA, 32 nt, Human
uaauccaagcuacuggggaggcugaggcagga

SEQ ID NO: 219014 - RNA, 28 nt, Human
uaauccacaagugcuucucauauugccc

SEQ ID NO: 219015 - RNA, 32 nt, Human
uaauccacccugggggcaauagccauauugcc

SEQ ID NO: 219016 - RNA, 32 nt, Human
uaauccaccucuucugcuucaguugggugaca

SEQ ID NO: 219017 - RNA, 32 nt, Human
uaauccacugcaugguuugauggccaccaucu

SEQ ID NO: 219018 - RNA, 32 nt, Human
uaauccacuugacuaagugucuggaagagcua

SEQ ID NO: 219019 - RNA, 32 nt, Human
uaauccagaggcauaagaguccugguccaaag

SEQ ID NO: 219020 - RNA, 32 nt, Human
uaauccagcuacucaggaggcugaggcaggau

SEQ ID NO: 219021 - RNA, 32 nt, Human
uaauccagcuacuccagcgccugaggcaggag

SEQ ID NO: 219022 - RNA, 32 nt, Human
uaauccagcuacucgggaggcugaggcaggag

SEQ ID NO: 219023 - RNA, 32 nt, Human
uaauccagcuacuugggaggcugaagcaggag

SEQ ID NO: 219024 - RNA, 32 nt, Human
uaauccagcuacuugggaggcugaggcaggaa

SEQ ID NO: 219025 - RNA, 25 nt, Human
uaauccagcucaucagucuacuagu

SEQ ID NO: 219026 - RNA, 32 nt, Human
uaauccaggcgugagaguguucucuugggaaa

SEQ ID NO: 219027 - RNA, 32 nt, Human
uaauccaguaacccuguuguucaucaauagca

SEQ ID NO: 219028 - RNA, 32 nt, Human
uaauccaguucugcaaaaaugaccuauaaauu

SEQ ID NO: 219029 - RNA, 32 nt, Human
uaauccauacagaaaaugaauguaauguggau

SEQ ID NO: 219030 - RNA, 32 nt, Human
uaauccauguacauaguaaaucauuuuaaaag

SEQ ID NO: 219031 - RNA, 32 nt, Human
uaauccauuuucacuaaaagugugugaaaccu

SEQ ID NO: 219032 - RNA, 32 nt, Human
uaaucccaaauacucgggaggcugaggcagga

SEQ ID NO: 219033 - RNA, 32 nt, Human
uaaucccaacaauuugggaggcugaggcaggc

SEQ ID NO: 219034 - RNA, 32 nt, Human
uaaucccaacacuuuaggaggcugaggcuggu

SEQ ID NO: 219035 - RNA, 32 nt, Human
uaaucccaacacuuugagaggcugaggcagga

SEQ ID NO: 219036 - RNA, 32 nt, Human
uaaucccaacacuuugagaggcugagguggga

SEQ ID NO: 219037 - RNA, 32 nt, Human
uaaucccaacacuuuggaaggcugaggcggga

SEQ ID NO: 219038 - RNA, 32 nt, Human
uaaucccaacacuuuggaaggcugaggcgggc

SEQ ID NO: 219039 - RNA, 32 nt, Human
uaaucccaacacuuugggaggcugaggaggaa

SEQ ID NO: 219040 - RNA, 32 nt, Human
uaaucccaacacuuugggaggcugaggcagga

SEQ ID NO: 219041 - RNA, 32 nt, Human
uaaucccaacacuuugggaggcugaggcaggc

SEQ ID NO: 219042 - RNA, 32 nt, Human
uaaucccaacacuuugggaggcugaggccgga

SEQ ID NO: 219043 - RNA, 32 nt, Human
uaaucccaacacuuugggaggcugaggugggc

SEQ ID NO: 219044 - RNA, 32 nt, Human
uaaucccaacuaccuggaaggcugaggcagaa

SEQ ID NO: 219045 - RNA, 32 nt, Human
uaaucccaacuacucaggaggcugaggcagga

SEQ ID NO: 219046 - RNA, 32 nt, Human
uaaucccaacuacucaggaggcugaggcuaga

SEQ ID NO: 219047 - RNA, 32 nt, Human
uaaucccaacuacucaggaggcugcgacagga

SEQ ID NO: 219048 - RNA, 32 nt, Human
uaaucccaacuacucuggaggcugaggcagga

SEQ ID NO: 219049 - RNA, 32 nt, Human
uaaucccaacuacuugggaggcugaggcagga

SEQ ID NO: 219050 - RNA, 32 nt, Human
uaaucccaagacaaacauucccgcugcucgaa

SEQ ID NO: 219051 - RNA, 32 nt, Human
uaaucccaauacuuugggaggcugaggcaagu

SEQ ID NO: 219052 - RNA, 32 nt, Human
uaaucccaauacuuuggguggcugaggugaga

SEQ ID NO: 219053 - RNA, 32 nt, Human
uaaucccaccauuuugggaggcugaggcggag

SEQ ID NO: 219054 - RNA, 32 nt, Human
uaaucccaccuacucaggaggcugaggcaaga

SEQ ID NO: 219055 - RNA, 32 nt, Human
uaaucccaccuacucaggaggcugaggcagga

SEQ ID NO: 219056 - RNA, 32 nt, Human
uaaucccaccuacucgagaggcugaggcagca

SEQ ID NO: 219057 - RNA, 32 nt, Human
uaaucccaccuacucgggaggcugaggcagga

SEQ ID NO: 219058 - RNA, 32 nt, Human
uaaucccaccuacuugguaggcugaggcagga

SEQ ID NO: 219059 - RNA, 21 nt, Human
uaaucccaccuuuuggcccua

SEQ ID NO: 219060 - RNA, 32 nt, Human
uaaucccacuacugcauuccagccugggugga

SEQ ID NO: 219061 - RNA, 32 nt, Human
uaaucccacugcauccagccaauaggagccca

SEQ ID NO: 219062 - RNA, 32 nt, Human
uaaucccacugcauuccagccugggcaacagc

SEQ ID NO: 219063 - RNA, 32 nt, Human
uaaucccagaacuaugugaggcugaggcaggu

SEQ ID NO: 219064 - RNA, 32 nt, Human
uaaucccagaacuuuaggaggcugagguggga

SEQ ID NO: 219065 - RNA, 32 nt, Human
uaaucccagaacuuuggaaggccgaggugggu

SEQ ID NO: 219066 - RNA, 32 nt, Human
uaaucccagaacuuugggaggcugaggugggu

SEQ ID NO: 219067 - RNA, 32 nt, Human
uaaucccagaauuuuaggaggcugagguggga

SEQ ID NO: 219068 - RNA, 32 nt, Human
uaaucccagauacucaggaggcugaggcagga

SEQ ID NO: 219069 - RNA, 32 nt, Human
uaaucccagauacucaggaggcugagguagga

SEQ ID NO: 219070 - RNA, 32 nt, Human
uaaucccagauacucgggaggcugaggcauga

SEQ ID NO: 219071 - RNA, 32 nt, Human
uaaucccagauacuugggaggcugaggcagga

SEQ ID NO: 219072 - RNA, 32 nt, Human
uaaucccagauagucaggaggcugaggcagga

SEQ ID NO: 219073 - RNA, 32 nt, Human
uaaucccagcaaguugggaggcugaggcgggc

SEQ ID NO: 219074 - RNA, 32 nt, Human
uaaucccagcaauuugggaggcugagaagggc

SEQ ID NO: 219075 - RNA, 32 nt, Human
uaaucccagcaauuugggaggcugagacagga

SEQ ID NO: 219076 - RNA, 32 nt, Human
uaaucccagcaauuugggaggcugaggcggau

SEQ ID NO: 219077 - RNA, 32 nt, Human
uaaucccagcaauuugggaggcugaggcggga

SEQ ID NO: 219078 - RNA, 32 nt, Human
uaaucccagcaauuugggaggcugaggcuggc

SEQ ID NO: 219079 - RNA, 32 nt, Human
uaaucccagcaauuugggaggcugaggugggc

SEQ ID NO: 219080 - RNA, 32 nt, Human
uaaucccagcaccuugggaggcugaggcgggc

SEQ ID NO: 219081 - RNA, 32 nt, Human
uaaucccagcaccuugggaggcugagguggga

SEQ ID NO: 219082 - RNA, 32 nt, Human
uaaucccagcacguugggaggcugaggcgggc

SEQ ID NO: 219083 - RNA, 32 nt, Human
uaaucccagcacguugggaggcugaggcggua

SEQ ID NO: 219084 - RNA, 32 nt, Human
uaaucccagcacuaugggaggcugaggcaagc

SEQ ID NO: 219085 - RNA, 32 nt, Human
uaaucccagcacuaugggaggcugaggugaga

SEQ ID NO: 219086 - RNA, 32 nt, Human
uaaucccagcacuaugggaggcugaggugggc

SEQ ID NO: 219087 - RNA, 32 nt, Human
uaaucccagcacucuggaaggcugaggugggu

SEQ ID NO: 219088 - RNA, 32 nt, Human
uaaucccagcacucugggaggccgaggcaggc

SEQ ID NO: 219089 - RNA, 32 nt, Human
uaaucccagcacucugggaggccgagguggau

SEQ ID NO: 219090 - RNA, 32 nt, Human
uaaucccagcacucugggaggccgaggugggc

SEQ ID NO: 219091 - RNA, 32 nt, Human
uaaucccagcacucugggaggccgaggugggu

SEQ ID NO: 219092 - RNA, 32 nt, Human
uaaucccagcacucugggaggcugagacaggu

SEQ ID NO: 219093 - RNA, 32 nt, Human
uaaucccagcacucugggaggcugaggcgggc

SEQ ID NO: 219094 - RNA, 32 nt, Human
uaaucccagcacucugggaggcugaggcgggu

SEQ ID NO: 219095 - RNA, 32 nt, Human
uaaucccagcacucugggaggcugaggugggc

SEQ ID NO: 219096 - RNA, 32 nt, Human
uaaucccagcacugugagaggcugaggcggga

SEQ ID NO: 219097 - RNA, 32 nt, Human
uaaucccagcacugugggaggccgaggcagac

SEQ ID NO: 219098 - RNA, 32 nt, Human
uaaucccagcacugugggaggccgaggcggau

SEQ ID NO: 219099 - RNA, 32 nt, Human
uaaucccagcacugugggaggccgaggcgggc

SEQ ID NO: 219100 - RNA, 32 nt, Human
uaaucccagcacugugggaggcugaggcgggu

SEQ ID NO: 219101 - RNA, 32 nt, Human
uaaucccagcacugugggaggcugaggugguu

SEQ ID NO: 219102 - RNA, 32 nt, Human
uaaucccagcacuuagggaggcuggggcgggc

SEQ ID NO: 219103 - RNA, 32 nt, Human
uaaucccagcacuucaggaggccgagguggac

SEQ ID NO: 219104 - RNA, 32 nt, Human
uaaucccagcacuucgggaggccgagaugggc

SEQ ID NO: 219105 - RNA, 32 nt, Human
uaaucccagcacuucgggaggccgaggcaggu

SEQ ID NO: 219106 - RNA, 32 nt, Human
uaaucccagcacuucgggaggccgaggcgggu

SEQ ID NO: 219107 - RNA, 32 nt, Human
uaaucccagcacuucgggaggccgagguaggc

SEQ ID NO: 219108 - RNA, 32 nt, Human
uaaucccagcacuuggagaggcugagguugcg

SEQ ID NO: 219109 - RNA, 32 nt, Human
uaaucccagcacuuggggaagccgagucaggu

SEQ ID NO: 219110 - RNA, 32 nt, Human
uaaucccagcacuuggggaggccgaagugggc

SEQ ID NO: 219111 - RNA, 32 nt, Human
uaaucccagcacuuggggaggccgaggcgggu

SEQ ID NO: 219112 - RNA, 32 nt, Human
uaaucccagcacuuggggaggccguggugaga

SEQ ID NO: 219113 - RNA, 32 nt, Human
uaaucccagcacuuggggaggcugagaugggc

SEQ ID NO: 219114 - RNA, 32 nt, Human
uaaucccagcacuuggggaggcugaggcagga

SEQ ID NO: 219115 - RNA, 32 nt, Human
uaaucccagcacuuuagaucacuugaggucag

SEQ ID NO: 219116 - RNA, 32 nt, Human
uaaucccagcacuuucaaaggcugaggcaggc

SEQ ID NO: 219117 - RNA, 32 nt, Human
uaaucccagcacuuugagaggcugaagagggu

SEQ ID NO: 219118 - RNA, 32 nt, Human
uaaucccagcacuuugagaggcugaggcaggg

SEQ ID NO: 219119 - RNA, 32 nt, Human
uaaucccagcacuuugagaggcugaggccggu

SEQ ID NO: 219120 - RNA, 32 nt, Human
uaaucccagcacuuugagaggcugaggcggga

SEQ ID NO: 219121 - RNA, 32 nt, Human
uaaucccagcacuuugagaggcugaggcgggc

SEQ ID NO: 219122 - RNA, 32 nt, Human
uaaucccagcacuuugagaggcugaggcgggu

SEQ ID NO: 219123 - RNA, 32 nt, Human
uaaucccagcacuuugagaggcugagguggua

SEQ ID NO: 219124 - RNA, 32 nt, Human
uaaucccagcacuuugauaggcugaggcaggu

SEQ ID NO: 219125 - RNA, 32 nt, Human
uaaucccagcacuuugcggggcugaggugguu

SEQ ID NO: 219126 - RNA, 32 nt, Human
uaaucccagcacuuuggaacgcuggguggauu

SEQ ID NO: 219127 - RNA, 32 nt, Human
uaaucccagcacuuuggaaggccgaggcaggc

SEQ ID NO: 219128 - RNA, 32 nt, Human
uaaucccagcacuuuggaaggccgaggcgggc

SEQ ID NO: 219129 - RNA, 32 nt, Human
uaaucccagcacuuuggaaggccgaggcgggu

SEQ ID NO: 219130 - RNA, 32 nt, Human
uaaucccagcacuuuggaaggccgaggcuacg

SEQ ID NO: 219131 - RNA, 32 nt, Human
uaaucccagcacuuuggaaggcugaggagggu

SEQ ID NO: 219132 - RNA, 32 nt, Human
uaaucccagcacuuuggaaggcugaggcaggc

SEQ ID NO: 219133 - RNA, 32 nt, Human
uaaucccagcacuuuggaaggcugaggcaggg

SEQ ID NO: 219134 - RNA, 32 nt, Human
uaaucccagcacuuuggaaggcugaggcgggc

SEQ ID NO: 219135 - RNA, 32 nt, Human
uaaucccagcacuuuggaaggcugaggugggu

SEQ ID NO: 219136 - RNA, 32 nt, Human
uaaucccagcacuuuggaggccgaggcgggua

SEQ ID NO: 219137 - RNA, 32 nt, Human
uaaucccagcacuuuggagggcugaagcagga

SEQ ID NO: 219138 - RNA, 32 nt, Human
uaaucccagcacuuuggcaggccgaggcaggu

SEQ ID NO: 219139 - RNA, 32 nt, Human
uaaucccagcacuuuggcaggccgaggcgggu

SEQ ID NO: 219140 - RNA, 32 nt, Human
uaaucccagcacuuuggcaggcugaggugggc

SEQ ID NO: 219141 - RNA, 32 nt, Human
uaaucccagcacuuugggaacccgaggcaggu

SEQ ID NO: 219142 - RNA, 32 nt, Human
uaaucccagcacuuugggaagccgagggggau

SEQ ID NO: 219143 - RNA, 32 nt, Human
uaaucccagcacuuugggaagccgaggugggc

SEQ ID NO: 219144 - RNA, 32 nt, Human
uaaucccagcacuuugggaagccgagucgggu

SEQ ID NO: 219145 - RNA, 32 nt, Human
uaaucccagcacuuugggaagccgggguagga

SEQ ID NO: 219146 - RNA, 32 nt, Human
uaaucccagcacuuugggaagcugaagcagga

SEQ ID NO: 219147 - RNA, 32 nt, Human
uaaucccagcacuuugggaagcugagaugggu

SEQ ID NO: 219148 - RNA, 32 nt, Human
uaaucccagcacuuugggaagcugaggcagga

SEQ ID NO: 219149 - RNA, 32 nt, Human
uaaucccagcacuuugggaagcugaggugggc

SEQ ID NO: 219150 - RNA, 32 nt, Human
uaaucccagcacuuugggaagcugaggugggu

SEQ ID NO: 219151 - RNA, 32 nt, Human
uaaucccagcacuuugggaagcuguggcaggc

SEQ ID NO: 219152 - RNA, 32 nt, Human
uaaucccagcacuuugggacgccgaagcaggu

SEQ ID NO: 219153 - RNA, 32 nt, Human
uaaucccagcacuuugggaggaggccgagcug

SEQ ID NO: 219154 - RNA, 32 nt, Human
uaaucccagcacuuugggaggccgaaacaggc

SEQ ID NO: 219155 - RNA, 32 nt, Human
uaaucccagcacuuugggaggccgaagcaggc

SEQ ID NO: 219156 - RNA, 32 nt, Human
uaaucccagcacuuugggaggccgaagcaggu

SEQ ID NO: 219157 - RNA, 32 nt, Human
uaaucccagcacuuugggaggccgaagcgggc

SEQ ID NO: 219158 - RNA, 32 nt, Human
uaaucccagcacuuugggaggccgaagggggc

SEQ ID NO: 219159 - RNA, 32 nt, Human
uaaucccagcacuuugggaggccgaaguaagc

SEQ ID NO: 219160 - RNA, 32 nt, Human
uaaucccagcacuuugggaggccgaagugggu

SEQ ID NO: 219161 - RNA, 32 nt, Human
uaaucccagcacuuugggaggccgagaaccac

SEQ ID NO: 219162 - RNA, 32 nt, Human
uaaucccagcacuuugggaggccgagacaggc

SEQ ID NO: 219163 - RNA, 32 nt, Human
uaaucccagcacuuugggaggccgagacaggu

SEQ ID NO: 219164 - RNA, 32 nt, Human
uaaucccagcacuuugggaggccgagacgggc

SEQ ID NO: 219165 - RNA, 32 nt, Human
uaaucccagcacuuugggaggccgagacgggu

SEQ ID NO: 219166 - RNA, 32 nt, Human
uaaucccagcacuuugggaggccgagaugggc

SEQ ID NO: 219167 - RNA, 32 nt, Human
uaaucccagcacuuugggaggccgagaugggu

SEQ ID NO: 219168 - RNA, 32 nt, Human
uaaucccagcacuuugggaggccgagccaagu

SEQ ID NO: 219169 - RNA, 32 nt, Human
uaaucccagcacuuugggaggccgagccgggc

SEQ ID NO: 219170 - RNA, 32 nt, Human
uaaucccagcacuuugggaggccgaggaagga

SEQ ID NO: 219171 - RNA, 32 nt, Human
uaaucccagcacuuugggaggccgaggagggc

SEQ ID NO: 219172 - RNA, 32 nt, Human
uaaucccagcacuuugggaggccgaggagggu

SEQ ID NO: 219173 - RNA, 32 nt, Human
uaaucccagcacuuugggaggccgaggcagga

SEQ ID NO: 219174 - RNA, 32 nt, Human
uaaucccagcacuuugggaggccgaggcaggc

SEQ ID NO: 219175 - RNA, 32 nt, Human
uaaucccagcacuuugggaggccgaggcaggg

SEQ ID NO: 219176 - RNA, 32 nt, Human
uaaucccagcacuuugggaggccgaggcaggu

SEQ ID NO: 219177 - RNA, 32 nt, Human
uaaucccagcacuuugggaggccgaggcaguu

SEQ ID NO: 219178 - RNA, 32 nt, Human
uaaucccagcacuuugggaggccgaggcaugu

SEQ ID NO: 219179 - RNA, 32 nt, Human
uaaucccagcacuuugggaggccgaggccagu

SEQ ID NO: 219180 - RNA, 32 nt, Human
uaaucccagcacuuugggaggccgaggccggc

SEQ ID NO: 219181 - RNA, 32 nt, Human
uaaucccagcacuuugggaggccgaggccggu

SEQ ID NO: 219182 - RNA, 32 nt, Human
uaaucccagcacuuugggaggccgaggcgagc

SEQ ID NO: 219183 - RNA, 32 nt, Human
uaaucccagcacuuugggaggccgaggcgagu

SEQ ID NO: 219184 - RNA, 32 nt, Human
uaaucccagcacuuugggaggccgaggcggac

SEQ ID NO: 219185 - RNA, 32 nt, Human
uaaucccagcacuuugggaggccgaggcggau

SEQ ID NO: 219186 - RNA, 32 nt, Human
uaaucccagcacuuugggaggccgaggcggga

SEQ ID NO: 219187 - RNA, 32 nt, Human
uaaucccagcacuuugggaggccgaggcgggc

SEQ ID NO: 219188 - RNA, 32 nt, Human
uaaucccagcacuuugggaggccgaggcgggg

SEQ ID NO: 219189 - RNA, 32 nt, Human
uaaucccagcacuuugggaggccgaggcgggu

SEQ ID NO: 219190 - RNA, 32 nt, Human
uaaucccagcacuuugggaggccgaggcgguc

SEQ ID NO: 219191 - RNA, 32 nt, Human
uaaucccagcacuuugggaggccgaggcgugu

SEQ ID NO: 219192 - RNA, 32 nt, Human
uaaucccagcacuuugggaggccgaggcuggc

SEQ ID NO: 219193 - RNA, 32 nt, Human
uaaucccagcacuuugggaggccgaggcuggg

SEQ ID NO: 219194 - RNA, 32 nt, Human
uaaucccagcacuuugggaggccgaggcuggu

SEQ ID NO: 219195 - RNA, 32 nt, Human
uaaucccagcacuuugggaggccgaggggagu

SEQ ID NO: 219196 - RNA, 32 nt, Human
uaaucccagcacuuugggaggccgagguaggc

SEQ ID NO: 219197 - RNA, 32 nt, Human
uaaucccagcacuuugggaggccgagguaggu

SEQ ID NO: 219198 - RNA, 32 nt, Human
uaaucccagcacuuugggaggccgaggugaaa

SEQ ID NO: 219199 - RNA, 32 nt, Human
uaaucccagcacuuugggaggccgaggugagc

SEQ ID NO: 219200 - RNA, 32 nt, Human
uaaucccagcacuuugggaggccgaggugagu

SEQ ID NO: 219201 - RNA, 32 nt, Human
uaaucccagcacuuugggaggccgaggugcau

SEQ ID NO: 219202 - RNA, 32 nt, Human
uaaucccagcacuuugggaggccgagguggau

SEQ ID NO: 219203 - RNA, 32 nt, Human
uaaucccagcacuuugggaggccgagguggcc

SEQ ID NO: 219204 - RNA, 32 nt, Human
uaaucccagcacuuugggaggccgagguggga

SEQ ID NO: 219205 - RNA, 32 nt, Human
uaaucccagcacuuugggaggccgaggugggc

SEQ ID NO: 219206 - RNA, 32 nt, Human
uaaucccagcacuuugggaggccgaggugggu

SEQ ID NO: 219207 - RNA, 32 nt, Human
uaaucccagcacuuugggaggccgaggugguu

SEQ ID NO: 219208 - RNA, 32 nt, Human
uaaucccagcacuuugggaggccgagguugga

SEQ ID NO: 219209 - RNA, 32 nt, Human
uaaucccagcacuuugggaggccgaugcgggc

SEQ ID NO: 219210 - RNA, 32 nt, Human
uaaucccagcacuuugggaggccgaugugggc

SEQ ID NO: 219211 - RNA, 32 nt, Human
uaaucccagcacuuugggaggccgaugugggu

SEQ ID NO: 219212 - RNA, 32 nt, Human
uaaucccagcacuuugggaggccgugaugggc

SEQ ID NO: 219213 - RNA, 32 nt, Human
uaaucccagcacuuugggaggccguggcgggc

SEQ ID NO: 219214 - RNA, 32 nt, Human
uaaucccagcacuuugggaggccguggugggc

SEQ ID NO: 219215 - RNA, 32 nt, Human
uaaucccagcacuuugggaggcugaagcagga

SEQ ID NO: 219216 - RNA, 32 nt, Human
uaaucccagcacuuugggaggcugaaguggga

SEQ ID NO: 219217 - RNA, 32 nt, Human
uaaucccagcacuuugggaggcugaagugggc

SEQ ID NO: 219218 - RNA, 32 nt, Human
uaaucccagcacuuugggaggcugaagugggu

SEQ ID NO: 219219 - RNA, 32 nt, Human
uaaucccagcacuuugggaggcugagaagggc

SEQ ID NO: 219220 - RNA, 32 nt, Human
uaaucccagcacuuugggaggcugagacaggc

SEQ ID NO: 219221 - RNA, 32 nt, Human
uaaucccagcacuuugggaggcugagacaggu

SEQ ID NO: 219222 - RNA, 32 nt, Human
uaaucccagcacuuugggaggcugagacccgu

SEQ ID NO: 219223 - RNA, 32 nt, Human
uaaucccagcacuuugggaggcugagacgggc

SEQ ID NO: 219224 - RNA, 32 nt, Human
uaaucccagcacuuugggaggcugagacgggu

SEQ ID NO: 219225 - RNA, 32 nt, Human
uaaucccagcacuuugggaggcugagauggga

SEQ ID NO: 219226 - RNA, 32 nt, Human
uaaucccagcacuuugggaggcugagauguga

SEQ ID NO: 219227 - RNA, 32 nt, Human
uaaucccagcacuuugggaggcugagcaaggu

SEQ ID NO: 219228 - RNA, 32 nt, Human
uaaucccagcacuuugggaggcugagcuggau

SEQ ID NO: 219229 - RNA, 32 nt, Human
uaaucccagcacuuugggaggcugaggaaggc

SEQ ID NO: 219230 - RNA, 32 nt, Human
uaaucccagcacuuugggaggcugaggacaga

SEQ ID NO: 219231 - RNA, 32 nt, Human
uaaucccagcacuuugggaggcugaggagagc

SEQ ID NO: 219232 - RNA, 32 nt, Human
uaaucccagcacuuugggaggcugaggagggu

SEQ ID NO: 219233 - RNA, 28 nt, Human
uaaucccagcacuuugggaggcugaggc

SEQ ID NO: 219234 - RNA, 32 nt, Human
uaaucccagcacuuugggaggcugaggcaagc

SEQ ID NO: 219235 - RNA, 32 nt, Human
uaaucccagcacuuugggaggcugaggcaagu

SEQ ID NO: 219236 - RNA, 32 nt, Human
uaaucccagcacuuugggaggcugaggcagga

SEQ ID NO: 219237 - RNA, 32 nt, Human
uaaucccagcacuuugggaggcugaggcaggc

SEQ ID NO: 219238 - RNA, 32 nt, Human
uaaucccagcacuuugggaggcugaggcaggu

SEQ ID NO: 219239 - RNA, 32 nt, Human
uaaucccagcacuuugggaggcugaggcaguu

SEQ ID NO: 219240 - RNA, 32 nt, Human
uaaucccagcacuuugggaggcugaggccggc

SEQ ID NO: 219241 - RNA, 32 nt, Human
uaaucccagcacuuugggaggcugaggccggu

SEQ ID NO: 219242 - RNA, 32 nt, Human
uaaucccagcacuuugggaggcugaggcgagu

SEQ ID NO: 219243 - RNA, 32 nt, Human
uaaucccagcacuuugggaggcugaggcggau

SEQ ID NO: 219244 - RNA, 32 nt, Human
uaaucccagcacuuugggaggcugaggcggcc

SEQ ID NO: 219245 - RNA, 32 nt, Human
uaaucccagcacuuugggaggcugaggcggga

SEQ ID NO: 219246 - RNA, 32 nt, Human
uaaucccagcacuuugggaggcugaggcgggc

SEQ ID NO: 219247 - RNA, 32 nt, Human
uaaucccagcacuuugggaggcugaggcgggg

SEQ ID NO: 219248 - RNA, 32 nt, Human
uaaucccagcacuuugggaggcugaggcgggu

SEQ ID NO: 219249 - RNA, 32 nt, Human
uaaucccagcacuuugggaggcugaggcgguc

SEQ ID NO: 219250 - RNA, 32 nt, Human
uaaucccagcacuuugggaggcugaggcuggc

SEQ ID NO: 219251 - RNA, 32 nt, Human
uaaucccagcacuuugggaggcugaggcuggg

SEQ ID NO: 219252 - RNA, 32 nt, Human
uaaucccagcacuuugggaggcugagggaggc

SEQ ID NO: 219253 - RNA, 32 nt, Human
uaaucccagcacuuugggaggcugagggggug

SEQ ID NO: 219254 - RNA, 32 nt, Human
uaaucccagcacuuugggaggcugagguaggc

SEQ ID NO: 219255 - RNA, 32 nt, Human
uaaucccagcacuuugggaggcugagguaggu

SEQ ID NO: 219256 - RNA, 32 nt, Human
uaaucccagcacuuugggaggcugaggugaga

SEQ ID NO: 219257 - RNA, 32 nt, Human
uaaucccagcacuuugggaggcugaggugagu

SEQ ID NO: 219258 - RNA, 32 nt, Human
uaaucccagcacuuugggaggcugagguggaa

SEQ ID NO: 219259 - RNA, 32 nt, Human
uaaucccagcacuuugggaggcugagguggac

SEQ ID NO: 219260 - RNA, 32 nt, Human
uaaucccagcacuuugggaggcugagguggga

SEQ ID NO: 219261 - RNA, 32 nt, Human
uaaucccagcacuuugggaggcugaggugggc

SEQ ID NO: 219262 - RNA, 32 nt, Human
uaaucccagcacuuugggaggcugaggugggu

SEQ ID NO: 219263 - RNA, 32 nt, Human
uaaucccagcacuuugggaggcugaggugguc

SEQ ID NO: 219264 - RNA, 32 nt, Human
uaaucccagcacuuugggaggcugaguugcuu

SEQ ID NO: 219265 - RNA, 32 nt, Human
uaaucccagcacuuugggaggcugaugcgggc

SEQ ID NO: 219266 - RNA, 32 nt, Human
uaaucccagcacuuugggaggcugcagcgggu

SEQ ID NO: 219267 - RNA, 32 nt, Human
uaaucccagcacuuugggaggcugcggcaggc

SEQ ID NO: 219268 - RNA, 32 nt, Human
uaaucccagcacuuugggaggcuggggcgagc

SEQ ID NO: 219269 - RNA, 32 nt, Human
uaaucccagcacuuugggaggcuggggcgggu

SEQ ID NO: 219270 - RNA, 32 nt, Human
uaaucccagcacuuugggaggcuguggcaggc

SEQ ID NO: 219271 - RNA, 32 nt, Human
uaaucccagcacuuugggaggcuguggcaggu

SEQ ID NO: 219272 - RNA, 32 nt, Human
uaaucccagcacuuugggaggucgagguaggu

SEQ ID NO: 219273 - RNA, 32 nt, Human
uaaucccagcacuuugggagguugaggcaggc

SEQ ID NO: 219274 - RNA, 32 nt, Human
uaaucccagcacuuugggagguugaggcgggc

SEQ ID NO: 219275 - RNA, 32 nt, Human
uaaucccagcacuuugggagguugagguaggu

SEQ ID NO: 219276 - RNA, 32 nt, Human
uaaucccagcacuuugggagguugagguggga

SEQ ID NO: 219277 - RNA, 32 nt, Human
uaaucccagcacuuugggagguugaggugggc

SEQ ID NO: 219278 - RNA, 32 nt, Human
uaaucccagcacuuugggagguugaggugggu

SEQ ID NO: 219279 - RNA, 32 nt, Human
uaaucccagcacuuugggaugcugaagugaga

SEQ ID NO: 219280 - RNA, 32 nt, Human
uaaucccagcacuuugggaugcugaggcgggc

SEQ ID NO: 219281 - RNA, 32 nt, Human
uaaucccagcacuuugggauuacucccgggcu

SEQ ID NO: 219282 - RNA, 32 nt, Human
uaaucccagcacuuugggauuccgaggcgggu

SEQ ID NO: 219283 - RNA, 20 nt, Human
uaaucccagcacuuugggga

SEQ ID NO: 219284 - RNA, 32 nt, Human
uaaucccagcacuuuggggagcugaggcgggc

SEQ ID NO: 219285 - RNA, 32 nt, Human
uaaucccagcacuuuggggaggccgaggcagg

SEQ ID NO: 219286 - RNA, 32 nt, Human
uaaucccagcacuuuggguggccgagacgggu

SEQ ID NO: 219287 - RNA, 32 nt, Human
uaaucccagcacuuugguaggcugagguaggu

SEQ ID NO: 219288 - RNA, 32 nt, Human
uaaucccagcacuuugguaggcugaggugggu

SEQ ID NO: 219289 - RNA, 32 nt, Human
uaaucccagcacuuugugaggcugaggugggc

SEQ ID NO: 219290 - RNA, 32 nt, Human
uaaucccagcacuuuguggggcugagggagaa

SEQ ID NO: 219291 - RNA, 32 nt, Human
uaaucccagcacuuuuggaggcugaggcgggc

SEQ ID NO: 219292 - RNA, 32 nt, Human
uaaucccagcacuuuuggaggcugaggcgggu

SEQ ID NO: 219293 - RNA, 32 nt, Human
uaaucccagcagugggagaccgaggugggcag

SEQ ID NO: 219294 - RNA, 32 nt, Human
uaaucccagcaguuugggaggcugaggcggau

SEQ ID NO: 219295 - RNA, 32 nt, Human
uaaucccagcaguuugggaggcugaggcgggc

SEQ ID NO: 219296 - RNA, 32 nt, Human
uaaucccagcaguuugggaggcugaggcuagu

SEQ ID NO: 219297 - RNA, 32 nt, Human
uaaucccagcaguuugggaggcugaguugggc

SEQ ID NO: 219298 - RNA, 32 nt, Human
uaaucccagcauguugagaggcugaggugggc

SEQ ID NO: 219299 - RNA, 32 nt, Human
uaaucccagcauuucgggaggcugaggcagga

SEQ ID NO: 219300 - RNA, 19 nt, Human
uaaucccagcauuugggga

SEQ ID NO: 219301 - RNA, 32 nt, Human
uaaucccagcauuuucagaggcugagacaggu

SEQ ID NO: 219302 - RNA, 32 nt, Human
uaaucccagcauuuugagaggcugaggcgggu

SEQ ID NO: 219303 - RNA, 32 nt, Human
uaaucccagcauuuugagaggcugaggugggu

SEQ ID NO: 219304 - RNA, 32 nt, Human
uaaucccagcauuuugggaggcugaagugaga

SEQ ID NO: 219305 - RNA, 32 nt, Human
uaaucccagcauuuugggaggcugaggcaagu

SEQ ID NO: 219306 - RNA, 32 nt, Human
uaaucccagcauuuugggaggcugaggcaggc

SEQ ID NO: 219307 - RNA, 32 nt, Human
uaaucccagcauuuugggaggcugaggcaggu

SEQ ID NO: 219308 - RNA, 32 nt, Human
uaaucccagcauuuugggaggcugaggugggc

SEQ ID NO: 219309 - RNA, 32 nt, Human
uaaucccagccaccugggaggcugaggcagga

SEQ ID NO: 219310 - RNA, 32 nt, Human
uaaucccagccacucagaaggcugaggcagga

SEQ ID NO: 219311 - RNA, 32 nt, Human
uaaucccagccacucaggaggcugaggcaggg

SEQ ID NO: 219312 - RNA, 32 nt, Human
uaaucccagccacucaggaggcugaggcgggg

SEQ ID NO: 219313 - RNA, 32 nt, Human
uaaucccagccacuccagaggcugaggcagga

SEQ ID NO: 219314 - RNA, 32 nt, Human
uaaucccagccacucgggaggcugaggcaaga

SEQ ID NO: 219315 - RNA, 32 nt, Human
uaaucccagccacuugggaggcugaggcagga

SEQ ID NO: 219316 - RNA, 32 nt, Human
uaaucccagccccacaaugucaccagcucgca

SEQ ID NO: 219317 - RNA, 32 nt, Human
uaaucccagcccuuugggaggcugaggcggga

SEQ ID NO: 219318 - RNA, 32 nt, Human
uaaucccagcccuuugggaggcugaggcgggc

SEQ ID NO: 219319 - RNA, 32 nt, Human
uaaucccagcccuuugggaggcugaggugggu

SEQ ID NO: 219320 - RNA, 32 nt, Human
uaaucccagcgcucugggaggcugaggcagga

SEQ ID NO: 219321 - RNA, 32 nt, Human
uaaucccagcgcuuugggaggcugaggcaggu

SEQ ID NO: 219322 - RNA, 32 nt, Human
uaaucccagcgcuuugggaggcugagguggac

SEQ ID NO: 219323 - RNA, 32 nt, Human
  misc_feature (11)..(11): n is a, c, g or u
  misc_feature (19)..(19): n is a, c, g or u
uaaucccagcnacucgccnggcugaggcagga

SEQ ID NO: 219324 - RNA, 32 nt, Human
uaaucccagcuaaccaggaggcugaggcagga

SEQ ID NO: 219325 - RNA, 32 nt, Human
uaaucccagcuaaucaggaggcugaggcagga

SEQ ID NO: 219326 - RNA, 32 nt, Human
uaaucccagcuacacaggaggcugaggcacga

SEQ ID NO: 219327 - RNA, 32 nt, Human
uaaucccagcuacacaggaggcugaggcagga

SEQ ID NO: 219328 - RNA, 32 nt, Human
uaaucccagcuacaccugaggcugaggcagga

SEQ ID NO: 219329 - RNA, 32 nt, Human
uaaucccagcuacacuggaggcugagucagga

SEQ ID NO: 219330 - RNA, 32 nt, Human
uaaucccagcuacaggggaggcugaggcagga

SEQ ID NO: 219331 - RNA, 32 nt, Human
uaaucccagcuacaugggaggcugaggcacga

SEQ ID NO: 219332 - RNA, 32 nt, Human
uaaucccagcuacaugggaggcugagguggga

SEQ ID NO: 219333 - RNA, 32 nt, Human
uaaucccagcuacccaggaggcugagacagga

SEQ ID NO: 219334 - RNA, 32 nt, Human
uaaucccagcuacccaggaggcugaggcaaga

SEQ ID NO: 219335 - RNA, 32 nt, Human
uaaucccagcuacccaggaggcugaggcagga

SEQ ID NO: 219336 - RNA, 32 nt, Human
uaaucccagcuacccgggaggcugaggcagga

SEQ ID NO: 219337 - RNA, 32 nt, Human
uaaucccagcuacccgggaggcugaggccuga

SEQ ID NO: 219338 - RNA, 32 nt, Human
uaaucccagcuacccugaaggcugaggcagga

SEQ ID NO: 219339 - RNA, 32 nt, Human
uaaucccagcuaccggagaggcugaggcagga

SEQ ID NO: 219340 - RNA, 32 nt, Human
uaaucccagcuaccggggaggcugaggcagga

SEQ ID NO: 219341 - RNA, 32 nt, Human
uaaucccagcuaccugagaggcugaggcagga

SEQ ID NO: 219342 - RNA, 32 nt, Human
uaaucccagcuaccugggaggcugaggcagga

SEQ ID NO: 219343 - RNA, 32 nt, Human
uaaucccagcuaccugggaggcugagguauga

SEQ ID NO: 219344 - RNA, 32 nt, Human
uaaucccagcuacgugggaggcugaggcagga

SEQ ID NO: 219345 - RNA, 32 nt, Human
uaaucccagcuacgugggaggcugagguggga

SEQ ID NO: 219346 - RNA, 32 nt, Human
uaaucccagcuacuaaggaggcugaggcagga

SEQ ID NO: 219347 - RNA, 32 nt, Human
uaaucccagcuacuagagaggcugaggcagga

SEQ ID NO: 219348 - RNA, 32 nt, Human
uaaucccagcuacuagggaggcugagacacac

SEQ ID NO: 219349 - RNA, 32 nt, Human
uaaucccagcuacuagggaggcugaggcaaga

SEQ ID NO: 219350 - RNA, 32 nt, Human
uaaucccagcuacuagggaggcugaggcagga

SEQ ID NO: 219351 - RNA, 32 nt, Human
uaaucccagcuacuagggaggcugcggcagga

SEQ ID NO: 219352 - RNA, 32 nt, Human
uaaucccagcuacucaagaggcugaggcaaga

SEQ ID NO: 219353 - RNA, 32 nt, Human
uaaucccagcuacucaagaggcugaggcacga

SEQ ID NO: 219354 - RNA, 32 nt, Human
uaaucccagcuacucaagaggcugaggcagga

SEQ ID NO: 219355 - RNA, 32 nt, Human
uaaucccagcuacucaagaggcugagguagga

SEQ ID NO: 219356 - RNA, 32 nt, Human
uaaucccagcuacucagaaggcugaggcagga

SEQ ID NO: 219357 - RNA, 32 nt, Human
uaaucccagcuacucagaaggcugaggcauga

SEQ ID NO: 219358 - RNA, 32 nt, Human
uaaucccagcuacucagaaggcugagguacaa

SEQ ID NO: 219359 - RNA, 32 nt, Human
uaaucccagcuacucagaaggcugagguggga

SEQ ID NO: 219360 - RNA, 32 nt, Human
uaaucccagcuacucagauggcugaggcagga

SEQ ID NO: 219361 - RNA, 32 nt, Human
uaaucccagcuacucagcagggugaggugaga

SEQ ID NO: 219362 - RNA, 32 nt, Human
uaaucccagcuacucaggaggcugagacagaa

SEQ ID NO: 219363 - RNA, 32 nt, Human
uaaucccagcuacucaggaggcugagacagga

SEQ ID NO: 219364 - RNA, 32 nt, Human
uaaucccagcuacucaggaggcugaggaagga

SEQ ID NO: 219365 - RNA, 32 nt, Human
uaaucccagcuacucaggaggcugaggcaaga

SEQ ID NO: 219366 - RNA, 32 nt, Human
uaaucccagcuacucaggaggcugaggcacaa

SEQ ID NO: 219367 - RNA, 32 nt, Human
uaaucccagcuacucaggaggcugaggcacga

SEQ ID NO: 219368 - RNA, 32 nt, Human
uaaucccagcuacucaggaggcugaggcagaa

SEQ ID NO: 219369 - RNA, 32 nt, Human
uaaucccagcuacucaggaggcugaggcagga

SEQ ID NO: 219370 - RNA, 32 nt, Human
uaaucccagcuacucaggaggcugaggcaggg

SEQ ID NO: 219371 - RNA, 32 nt, Human
uaaucccagcuacucaggaggcugaggcaggu

SEQ ID NO: 219372 - RNA, 32 nt, Human
uaaucccagcuacucaggaggcugaggcagua

SEQ ID NO: 219373 - RNA, 32 nt, Human
uaaucccagcuacucaggaggcugaggcauga

SEQ ID NO: 219374 - RNA, 32 nt, Human
uaaucccagcuacucaggaggcugaggccgga

SEQ ID NO: 219375 - RNA, 32 nt, Human
uaaucccagcuacucaggaggcugaggcggag

SEQ ID NO: 219376 - RNA, 32 nt, Human
uaaucccagcuacucaggaggcugaggcggau

SEQ ID NO: 219377 - RNA, 32 nt, Human
uaaucccagcuacucaggaggcugaggcggga

SEQ ID NO: 219378 - RNA, 32 nt, Human
uaaucccagcuacucaggaggcugaggcugga

SEQ ID NO: 219379 - RNA, 32 nt, Human
uaaucccagcuacucaggaggcugaggcuuga

SEQ ID NO: 219380 - RNA, 32 nt, Human
uaaucccagcuacucaggaggcugagggagga

SEQ ID NO: 219381 - RNA, 32 nt, Human
uaaucccagcuacucaggaggcugagguagga

SEQ ID NO: 219382 - RNA, 32 nt, Human
uaaucccagcuacucaggaggcugagguggga

SEQ ID NO: 219383 - RNA, 32 nt, Human
uaaucccagcuacucaggaggcugagucagga

SEQ ID NO: 219384 - RNA, 32 nt, Human
uaaucccagcuacucaggaggcugagugaggc

SEQ ID NO: 219385 - RNA, 32 nt, Human
uaaucccagcuacucaggaggcugggacagga

SEQ ID NO: 219386 - RNA, 32 nt, Human
uaaucccagcuacucaggaggcuggggcagca

SEQ ID NO: 219387 - RNA, 32 nt, Human
uaaucccagcuacucaggaggcuggggcagga

SEQ ID NO: 219388 - RNA, 32 nt, Human
uaaucccagcuacucaggaggcuguggcgaga

SEQ ID NO: 219389 - RNA, 32 nt, Human
uaaucccagcuacucaggagguugagacagga

SEQ ID NO: 219390 - RNA, 32 nt, Human
uaaucccagcuacucaggagguugaggcagca

SEQ ID NO: 219391 - RNA, 32 nt, Human
uaaucccagcuacucagggggcugaggcagga

SEQ ID NO: 219392 - RNA, 32 nt, Human
uaaucccagcuacucagggggcugaggcaggg

SEQ ID NO: 219393 - RNA, 32 nt, Human
uaaucccagcuacucagguggcugaggcagga

SEQ ID NO: 219394 - RNA, 32 nt, Human
uaaucccagcuacucaugaggcugaggcagaa

SEQ ID NO: 219395 - RNA, 32 nt, Human
uaaucccagcuacucaugaggcugaggcagua

SEQ ID NO: 219396 - RNA, 32 nt, Human
uaaucccagcuacuccagaggcugaggcagga

SEQ ID NO: 219397 - RNA, 32 nt, Human
uaaucccagcuacucccaaggcugaggcagga

SEQ ID NO: 219398 - RNA, 32 nt, Human
uaaucccagcuacucgagaggcugaggcagga

SEQ ID NO: 219399 - RNA, 32 nt, Human
uaaucccagcuacucgcaaggcugaggcagga

SEQ ID NO: 219400 - RNA, 32 nt, Human
uaaucccagcuacucgggaggcugacgcagga

SEQ ID NO: 219401 - RNA, 32 nt, Human
uaaucccagcuacucgggaggcugagacagga

SEQ ID NO: 219402 - RNA, 32 nt, Human
uaaucccagcuacucgggaggcugagaugaag

SEQ ID NO: 219403 - RNA, 32 nt, Human
uaaucccagcuacucgggaggcugaggaagga

SEQ ID NO: 219404 - RNA, 32 nt, Human
uaaucccagcuacucgggaggcugaggaggga

SEQ ID NO: 219405 - RNA, 32 nt, Human
uaaucccagcuacucgggaggcugaggcacga

SEQ ID NO: 219406 - RNA, 32 nt, Human
uaaucccagcuacucgggaggcugaggcagaa

SEQ ID NO: 219407 - RNA, 32 nt, Human
uaaucccagcuacucgggaggcugaggcagga

SEQ ID NO: 219408 - RNA, 32 nt, Human
uaaucccagcuacucgggaggcugaggcaggg

SEQ ID NO: 219409 - RNA, 32 nt, Human
uaaucccagcuacucgggaggcugaggcauaa

SEQ ID NO: 219410 - RNA, 32 nt, Human
uaaucccagcuacucgggaggcugaggcauga

SEQ ID NO: 219411 - RNA, 32 nt, Human
uaaucccagcuacucgggaggcugaggcggaa

SEQ ID NO: 219412 - RNA, 32 nt, Human
uaaucccagcuacucgggaggcugagggagga

SEQ ID NO: 219413 - RNA, 32 nt, Human
uaaucccagcuacucgggaggcugagguggga

SEQ ID NO: 219414 - RNA, 32 nt, Human
uaaucccagcuacucgggaggcugagucagga

SEQ ID NO: 219415 - RNA, 32 nt, Human
uaaucccagcuacucgggaggcugcggcggga

SEQ ID NO: 219416 - RNA, 32 nt, Human
uaaucccagcuacucgggaggcuguggcagga

SEQ ID NO: 219417 - RNA, 32 nt, Human
uaaucccagcuacucgguaggcugaggcagga

SEQ ID NO: 219418 - RNA, 32 nt, Human
uaaucccagcuacucuggaggcuaaggcagga

SEQ ID NO: 219419 - RNA, 32 nt, Human
uaaucccagcuacucuggaggcugagacagaa

SEQ ID NO: 219420 - RNA, 32 nt, Human
uaaucccagcuacucuggaggcugagauagga

SEQ ID NO: 219421 - RNA, 32 nt, Human
uaaucccagcuacucuggaggcugaggcacag

SEQ ID NO: 219422 - RNA, 32 nt, Human
uaaucccagcuacucuggaggcugaggcagga

SEQ ID NO: 219423 - RNA, 32 nt, Human
uaaucccagcuacucuggaggcugggcuggag

SEQ ID NO: 219424 - RNA, 32 nt, Human
uaaucccagcuacucuggaggcuggggcagga

SEQ ID NO: 219425 - RNA, 32 nt, Human
uaaucccagcuacucuggagggugaggcagga

SEQ ID NO: 219426 - RNA, 32 nt, Human
uaaucccagcuacugagggggcugaggcauga

SEQ ID NO: 219427 - RNA, 32 nt, Human
uaaucccagcuacugggaaggcugagguagga

SEQ ID NO: 219428 - RNA, 32 nt, Human
uaaucccagcuacuggggaggcugaggcacga

SEQ ID NO: 219429 - RNA, 32 nt, Human
uaaucccagcuacuggggaggcugaggcagga

SEQ ID NO: 219430 - RNA, 32 nt, Human
uaaucccagcuacuggggaggcugaggcggga

SEQ ID NO: 219431 - RNA, 32 nt, Human
uaaucccagcuacuuaggaggcugaggcagga

SEQ ID NO: 219432 - RNA, 32 nt, Human
uaaucccagcuacuuaggaggcugagguggga

SEQ ID NO: 219433 - RNA, 32 nt, Human
uaaucccagcuacuuaggaggcugaugcagga

SEQ ID NO: 219434 - RNA, 32 nt, Human
uaaucccagcuacuuggaaggcugaggcagga

SEQ ID NO: 219435 - RNA, 32 nt, Human
uaaucccagcuacuuggaaggcugaggcauag

SEQ ID NO: 219436 - RNA, 32 nt, Human
uaaucccagcuacuuggaaggcugagguauga

SEQ ID NO: 219437 - RNA, 32 nt, Human
uaaucccagcuacuuggcaggcugagguggga

SEQ ID NO: 219438 - RNA, 18 nt, Human
uaaucccagcuacuuggg

SEQ ID NO: 219439 - RNA, 32 nt, Human
uaaucccagcuacuugggaggcugacgcaggg

SEQ ID NO: 219440 - RNA, 32 nt, Human
uaaucccagcuacuugggaggcugagacagga

SEQ ID NO: 219441 - RNA, 32 nt, Human
uaaucccagcuacuugggaggcugagagagga

SEQ ID NO: 219442 - RNA, 32 nt, Human
uaaucccagcuacuugggaggcugagauguga

SEQ ID NO: 219443 - RNA, 32 nt, Human
uaaucccagcuacuugggaggcugagccagga

SEQ ID NO: 219444 - RNA, 32 nt, Human
uaaucccagcuacuugggaggcugaggcaaga

SEQ ID NO: 219445 - RNA, 32 nt, Human
uaaucccagcuacuugggaggcugaggcaagu

SEQ ID NO: 219446 - RNA, 32 nt, Human
uaaucccagcuacuugggaggcugaggcacga

SEQ ID NO: 219447 - RNA, 32 nt, Human
uaaucccagcuacuugggaggcugaggcagaa

SEQ ID NO: 219448 - RNA, 32 nt, Human
uaaucccagcuacuugggaggcugaggcagag

SEQ ID NO: 219449 - RNA, 32 nt, Human
uaaucccagcuacuugggaggcugaggcagca

SEQ ID NO: 219450 - RNA, 32 nt, Human
uaaucccagcuacuugggaggcugaggcagga

SEQ ID NO: 219451 - RNA, 32 nt, Human
uaaucccagcuacuugggaggcugaggcaggg

SEQ ID NO: 219452 - RNA, 32 nt, Human
uaaucccagcuacuugggaggcugaggcauaa

SEQ ID NO: 219453 - RNA, 32 nt, Human
uaaucccagcuacuugggaggcugaggcauga

SEQ ID NO: 219454 - RNA, 32 nt, Human
uaaucccagcuacuugggaggcugaggcgaga

SEQ ID NO: 219455 - RNA, 32 nt, Human
uaaucccagcuacuugggaggcugaggcggca

SEQ ID NO: 219456 - RNA, 32 nt, Human
uaaucccagcuacuugggaggcugaggcugga

SEQ ID NO: 219457 - RNA, 32 nt, Human
uaaucccagcuacuugggaggcugagggcagg

SEQ ID NO: 219458 - RNA, 32 nt, Human
uaaucccagcuacuugggaggcugagguagga

SEQ ID NO: 219459 - RNA, 32 nt, Human
uaaucccagcuacuugggaggcugagguaggg

SEQ ID NO: 219460 - RNA, 32 nt, Human
uaaucccagcuacuugggaggcugagguggga

SEQ ID NO: 219461 - RNA, 32 nt, Human
uaaucccagcuacuugggaggcugaguuggga

SEQ ID NO: 219462 - RNA, 32 nt, Human
uaaucccagcuacuugggaggcuguggcagga

SEQ ID NO: 219463 - RNA, 32 nt, Human
uaaucccagcuacuuggguggcugaggcaaga

SEQ ID NO: 219464 - RNA, 32 nt, Human
uaaucccagcuacuuggguggcugaggcaggc

SEQ ID NO: 219465 - RNA, 32 nt, Human
uaaucccagcuacuuugguggcugaggcauga

SEQ ID NO: 219466 - RNA, 32 nt, Human
uaaucccagcuagucaggaggcugaggcagga

SEQ ID NO: 219467 - RNA, 32 nt, Human
uaaucccagcuauauaggaggcugaggcagga

SEQ ID NO: 219468 - RNA, 32 nt, Human
uaaucccagcuauuagggaggcugaggcagga

SEQ ID NO: 219469 - RNA, 32 nt, Human
uaaucccagcuauucacgaggcugaggcagga

SEQ ID NO: 219470 - RNA, 32 nt, Human
uaaucccagcuauucaggaggcugaggcacca

SEQ ID NO: 219471 - RNA, 32 nt, Human
uaaucccagcuauucaggaggcugaggcacga

SEQ ID NO: 219472 - RNA, 32 nt, Human
uaaucccagcuauucaggaggcugaggcagga

SEQ ID NO: 219473 - RNA, 32 nt, Human
uaaucccagcuauucaggagguugaggcagaa

SEQ ID NO: 219474 - RNA, 32 nt, Human
uaaucccagcuauucggaaggcugaggcagga

SEQ ID NO: 219475 - RNA, 32 nt, Human
uaaucccagcuauucggcugaggcacgagaau

SEQ ID NO: 219476 - RNA, 32 nt, Human
uaaucccagcuauucgggagccugaggcaggg

SEQ ID NO: 219477 - RNA, 32 nt, Human
uaaucccagcuauucgggaggcugaggcagga

SEQ ID NO: 219478 - RNA, 32 nt, Human
uaaucccagcuauucgggaggcugaggcccga

SEQ ID NO: 219479 - RNA, 32 nt, Human
uaaucccagcuauucuggaggcugaggcagga

SEQ ID NO: 219480 - RNA, 32 nt, Human
uaaucccagcuauuuggcaggcugaggcauga

SEQ ID NO: 219481 - RNA, 18 nt, Human
uaaucccagcuauuuggg

SEQ ID NO: 219482 - RNA, 32 nt, Human
uaaucccagcuauuugggaggccaaggcagga

SEQ ID NO: 219483 - RNA, 32 nt, Human
uaaucccagcuauuugggaggcugaggcaaga

SEQ ID NO: 219484 - RNA, 32 nt, Human
uaaucccagcuauuugggaggcugaggcagaa

SEQ ID NO: 219485 - RNA, 32 nt, Human
uaaucccagcuauuugggaggcugaggcagga

SEQ ID NO: 219486 - RNA, 32 nt, Human
uaaucccagcuccuugggaggcugaggcagga

SEQ ID NO: 219487 - RNA, 32 nt, Human
uaaucccagcucuuugggaggcugaagcgggu

SEQ ID NO: 219488 - RNA, 32 nt, Human
uaaucccagcucuuugggaggcugaagugggu

SEQ ID NO: 219489 - RNA, 32 nt, Human
uaaucccagcucuuugggaggcugaggcaggu

SEQ ID NO: 219490 - RNA, 32 nt, Human
uaaucccagcugcccaggaggcugaggcauga

SEQ ID NO: 219491 - RNA, 32 nt, Human
uaaucccagcugcucaggaggcugaggcagga

SEQ ID NO: 219492 - RNA, 32 nt, Human
uaaucccagcugcucgggaggcugaggcagga

SEQ ID NO: 219493 - RNA, 32 nt, Human
uaaucccagcugcucuggaggcugaggcaugc

SEQ ID NO: 219494 - RNA, 32 nt, Human
uaaucccagcugcuggagaggcugaggcagga

SEQ ID NO: 219495 - RNA, 32 nt, Human
uaaucccagcugcuggggaggcugaggcagga

SEQ ID NO: 219496 - RNA, 32 nt, Human
uaaucccagcugcuugggaggcugaggcagga

SEQ ID NO: 219497 - RNA, 32 nt, Human
uaaucccagcugcuugggaggcugaggcagua

SEQ ID NO: 219498 - RNA, 32 nt, Human
uaaucccagcugcuugggaggcugagggcagg

SEQ ID NO: 219499 - RNA, 32 nt, Human
uaaucccagcugcuugggaggcugagguagga

SEQ ID NO: 219500 - RNA, 32 nt, Human
uaaucccagcuguucgggaggcugaggcagga

SEQ ID NO: 219501 - RNA, 32 nt, Human
uaaucccagcuguuugggaggcugaggcaggu

SEQ ID NO: 219502 - RNA, 32 nt, Human
uaaucccagcuucucgggaggcugaggcagga

SEQ ID NO: 219503 - RNA, 32 nt, Human
uaaucccagcuucuuaggaggcugagguagga

SEQ ID NO: 219504 - RNA, 32 nt, Human
uaaucccaggacuuugggaggcugaggaaagc

SEQ ID NO: 219505 - RNA, 32 nt, Human
uaaucccaggacuuugggaggcugaggcaggu

SEQ ID NO: 219506 - RNA, 32 nt, Human
uaaucccagguacucaagaggcugaggcagga

SEQ ID NO: 219507 - RNA, 32 nt, Human
uaaucccagguacucaggaggcugaggcagaa

SEQ ID NO: 219508 - RNA, 32 nt, Human
uaaucccagguacucaggaggcugaggcagga

SEQ ID NO: 219509 - RNA, 32 nt, Human
uaaucccagguacucgggaggcugaggcagag

SEQ ID NO: 219510 - RNA, 32 nt, Human
uaaucccagguacuuggaaggcugaggcagga

SEQ ID NO: 219511 - RNA, 32 nt, Human
uaaucccagguacuugggaggcugaggcagga

SEQ ID NO: 219512 - RNA, 32 nt, Human
uaaucccaguaaucccagcuacuugggaggcu

SEQ ID NO: 219513 - RNA, 32 nt, Human
uaaucccaguacuuuaggaggcugugguaggu

SEQ ID NO: 219514 - RNA, 32 nt, Human
uaaucccaguacuuugggaggcugaggugggc

SEQ ID NO: 219515 - RNA, 32 nt, Human
uaaucccaguacuuugggaggcugaggugggu

SEQ ID NO: 219516 - RNA, 32 nt, Human
uaaucccagugacuugggaggcugaggcagga

SEQ ID NO: 219517 - RNA, 32 nt, Human
uaaucccagugcuuugggaggcugagguggga

SEQ ID NO: 219518 - RNA, 32 nt, Human
uaaucccaguuacucaggaggcugaggcaaga

SEQ ID NO: 219519 - RNA, 32 nt, Human
uaaucccaguuacucaggaggcugaggcagga

SEQ ID NO: 219520 - RNA, 32 nt, Human
uaaucccaguuacucgagaggcugaggcagga

SEQ ID NO: 219521 - RNA, 32 nt, Human
uaaucccaguuacucgggaggcugaggcaaga

SEQ ID NO: 219522 - RNA, 32 nt, Human
uaaucccaguuacucgggaggcugaggcagga

SEQ ID NO: 219523 - RNA, 32 nt, Human
uaaucccaguuacuggggaggcugaggcagga

SEQ ID NO: 219524 - RNA, 32 nt, Human
uaaucccaguuacuuaggaggcugaggcagga

SEQ ID NO: 219525 - RNA, 32 nt, Human
uaaucccaguuacuugggaggcugaggcaaga

SEQ ID NO: 219526 - RNA, 32 nt, Human
uaaucccaguuacuugggaggcugaggcacaa

SEQ ID NO: 219527 - RNA, 32 nt, Human
uaaucccaguuacuugggaggcugaggcagga

SEQ ID NO: 219528 - RNA, 32 nt, Human
uaaucccaguuacuuuggaggcugaggcagga

SEQ ID NO: 219529 - RNA, 32 nt, Human
uaaucccaguuagucgggaggcugaggcagga

SEQ ID NO: 219530 - RNA, 32 nt, Human
uaaucccaguuccuugggaggcugaggcggga

SEQ ID NO: 219531 - RNA, 32 nt, Human
uaaucccaucacuuugggaggcugaggcagau

SEQ ID NO: 219532 - RNA, 32 nt, Human
uaaucccaucacuuugggaggcugagguggga

SEQ ID NO: 219533 - RNA, 32 nt, Human
uaaucccauguacucuggaggcugagguagga

SEQ ID NO: 219534 - RNA, 32 nt, Human
uaauccccaaugugauuguauuuagagugggg

SEQ ID NO: 219535 - RNA, 32 nt, Human
uaauccccacccugggcucugggagcagcccg

SEQ ID NO: 219536 - RNA, 32 nt, Human
uaauccccaggccccggacaaagagcccagag

SEQ ID NO: 219537 - RNA, 32 nt, Human
uaauccccaugugugccucucuccuuccuuag

SEQ ID NO: 219538 - RNA, 32 nt, Human
uaaucccccaaaggaccuauuugagcuguucc

SEQ ID NO: 219539 - RNA, 32 nt, Human
uaaucccgccacugcacucuagccugggugac

SEQ ID NO: 219540 - RNA, 32 nt, Human
uaaucccgcuacucgggaggcugaggcaggag

SEQ ID NO: 219541 - RNA, 32 nt, Human
uaaucccggcacugugggaggcugagguggga

SEQ ID NO: 219542 - RNA, 32 nt, Human
uaaucccggcacuuugggaggcugaggcgggc

SEQ ID NO: 219543 - RNA, 32 nt, Human
uaaucccggcacuuugggaggcugaggucagg

SEQ ID NO: 219544 - RNA, 32 nt, Human
uaaucccggcacuuugggaggcugaggugggc

SEQ ID NO: 219545 - RNA, 32 nt, Human
uaaucccggcaguuugggaggcuggggcaggu

SEQ ID NO: 219546 - RNA, 32 nt, Human
uaaucccggcuacucaggaggcugaggcagga

SEQ ID NO: 219547 - RNA, 32 nt, Human
uaaucccggcuacucgggaggcugaggcagca

SEQ ID NO: 219548 - RNA, 32 nt, Human
uaaucccggcuacucgggaggcugaggcagga

SEQ ID NO: 219549 - RNA, 32 nt, Human
uaaucccggcuacuugggaggcugagguagga

SEQ ID NO: 219550 - RNA, 32 nt, Human
uaaucccgggauuacaggugugugccaccaca

SEQ ID NO: 219551 - RNA, 32 nt, Human
uaaucccgguacuuugggaggcugagguggga

SEQ ID NO: 219552 - RNA, 32 nt, Human
uaaucccuauaauccccacaucaagggagaga

SEQ ID NO: 219553 - RNA, 32 nt, Human
uaaucccucuccccauccuguuucaauuuugg

SEQ ID NO: 219554 - RNA, 32 nt, Human
uaaucccugcacuuugggaugccugaggucag

SEQ ID NO: 219555 - RNA, 32 nt, Human
uaaucccugccuggcuucaagccucuggcuuc

SEQ ID NO: 219556 - RNA, 32 nt, Human
uaaucccugcuacucaggaggcugaggaagga

SEQ ID NO: 219557 - RNA, 32 nt, Human
uaaucccugcuacucgggaggcugaggcaaga

SEQ ID NO: 219558 - RNA, 32 nt, Human
uaaucccuguauaaaguagugccaaacugauu

SEQ ID NO: 219559 - RNA, 32 nt, Human
uaaucccuucaaggaagugauaacacuggagu

SEQ ID NO: 219560 - RNA, 32 nt, Human
uaaucccuuucuaagugaagggagaggcuggc

SEQ ID NO: 219561 - RNA, 32 nt, Human
uaauccgagcuacuagggaggcugaggcagaa

SEQ ID NO: 219562 - RNA, 32 nt, Human
uaauccgagcuacuggggaggcugaggcagga

SEQ ID NO: 219563 - RNA, 32 nt, Human
uaauccgaggcugaggugggaggaucacuuga

SEQ ID NO: 219564 - RNA, 32 nt, Human
uaauccgagugcuuugggaggcugaggcagga

SEQ ID NO: 219565 - RNA, 32 nt, Human
uaauccuaacacuuugggaggcugaggugggc

SEQ ID NO: 219566 - RNA, 32 nt, Human
uaauccuaaugcuuugagaggcugagguagga

SEQ ID NO: 219567 - RNA, 32 nt, Human
uaauccuacuaaaagguggaggugaccgcugu

SEQ ID NO: 219568 - RNA, 32 nt, Human
uaauccuacuccucaaaauagaaaguugaaga

SEQ ID NO: 219569 - RNA, 32 nt, Human
uaauccuagcaccuugggaggcugaggcaggu

SEQ ID NO: 219570 - RNA, 32 nt, Human
uaauccuagcacguggggaggcugaggcaggc

SEQ ID NO: 219571 - RNA, 32 nt, Human
uaauccuagcacuuuggaaggcugaggagggc

SEQ ID NO: 219572 - RNA, 32 nt, Human
uaauccuagcacuuugggaggcugaggcaaga

SEQ ID NO: 219573 - RNA, 32 nt, Human
uaauccuagcacuuugggaggcugaggcaggu

SEQ ID NO: 219574 - RNA, 32 nt, Human
uaauccuagcacuuugggaggcugaggcaguc

SEQ ID NO: 219575 - RNA, 32 nt, Human
uaauccuagcacuuugggaggcugaggcgggc

SEQ ID NO: 219576 - RNA, 32 nt, Human
uaauccuagcacuuugggaggcugaggcgggu

SEQ ID NO: 219577 - RNA, 32 nt, Human
uaauccuagcacuuugggaggcugagguaggc

SEQ ID NO: 219578 - RNA, 32 nt, Human
uaauccuagcacuuugggaggcugaggugggc

SEQ ID NO: 219579 - RNA, 32 nt, Human
uaauccuagcacuuugggaggcugaggugggu

SEQ ID NO: 219580 - RNA, 32 nt, Human
uaauccuagcacuuuggguggcugagguggga

SEQ ID NO: 219581 - RNA, 32 nt, Human
uaauccuagcacuuuguaaggcugaggcgagu

SEQ ID NO: 219582 - RNA, 32 nt, Human
uaauccuagcaguuuggaaggcugaggcacau

SEQ ID NO: 219583 - RNA, 32 nt, Human
uaauccuagcuacccggaaggcugaggcagga

SEQ ID NO: 219584 - RNA, 32 nt, Human
uaauccuagcuaccgagaaggcugaggcagga

SEQ ID NO: 219585 - RNA, 32 nt, Human
uaauccuagcuacucaagaggcugaggcagga

SEQ ID NO: 219586 - RNA, 32 nt, Human
uaauccuagcuacucaggaggcugaggcaaga

SEQ ID NO: 219587 - RNA, 32 nt, Human
uaauccuagcuacucaggaggcugaggcagga

SEQ ID NO: 219588 - RNA, 32 nt, Human
uaauccuagcuacucgggaggcugaggcagaa

SEQ ID NO: 219589 - RNA, 32 nt, Human
uaauccuagcuacucgggaggcugaggcagga

SEQ ID NO: 219590 - RNA, 32 nt, Human
uaauccuagcuacucgggaggcuguggcagga

SEQ ID NO: 219591 - RNA, 32 nt, Human
uaauccuagcuacuuggcaggcugaggugaga

SEQ ID NO: 219592 - RNA, 32 nt, Human
uaauccuagcuacuugggaggcugaggcacga

SEQ ID NO: 219593 - RNA, 32 nt, Human
uaauccuagcuacuugggaggcugaggcagga

SEQ ID NO: 219594 - RNA, 32 nt, Human
uaauccuagcuacuugggaggcugaggcaggu

SEQ ID NO: 219595 - RNA, 32 nt, Human
uaauccuagcuacuugggaggcugaggcauga

SEQ ID NO: 219596 - RNA, 32 nt, Human
uaauccuagcuaguugggaggcuggcacagga

SEQ ID NO: 219597 - RNA, 32 nt, Human
uaauccuagcuauucaaggggcugagguggga

SEQ ID NO: 219598 - RNA, 32 nt, Human
uaauccuagcuauucgggaggcugagacagga

SEQ ID NO: 219599 - RNA, 32 nt, Human
uaauccuagcuauucuggaggcugaggcagga

SEQ ID NO: 219600 - RNA, 32 nt, Human
uaauccuagcugcuugggaggcugaaguggga

SEQ ID NO: 219601 - RNA, 32 nt, Human
uaauccuagcugcuugggaggcugaggcagag

SEQ ID NO: 219602 - RNA, 32 nt, Human
uaauccuaggacuuugggaggcugaggcaggc

SEQ ID NO: 219603 - RNA, 32 nt, Human
uaauccuaguacuuugggaggcugaggcggga

SEQ ID NO: 219604 - RNA, 32 nt, Human
uaauccucaacuccaguggcagcuccaugugc

SEQ ID NO: 219605 - RNA, 32 nt, Human
uaauccucagaacaucccagggagcuccacag

SEQ ID NO: 219606 - RNA, 32 nt, Human
uaauccucccaacggcccccaaagguagaacu

SEQ ID NO: 219607 - RNA, 32 nt, Human
uaauccuccucuaucaccuuuuuagacuuugu

SEQ ID NO: 219608 - RNA, 32 nt, Human
uaauccuccugccucagacuccugaguaucug

SEQ ID NO: 219609 - RNA, 32 nt, Human
uaauccucuauuuugcucuuccuuguccauug

SEQ ID NO: 219610 - RNA, 32 nt, Human
uaauccucuuucucagggcuccacccuuuggg

SEQ ID NO: 219611 - RNA, 32 nt, Human
uaauccugaccccagaggggcauguggccacu

SEQ ID NO: 219612 - RNA, 32 nt, Human
uaauccugagucuuauuugaaaaaugguuucc

SEQ ID NO: 219613 - RNA, 32 nt, Human
uaauccugcauucagcaaaguggcauaaaaau

SEQ ID NO: 219614 - RNA, 32 nt, Human
uaauccugccugauuguguuuacagaagcuuc

SEQ ID NO: 219615 - RNA, 32 nt, Human
uaauccuggcacuuuaggaggcugagguggga

SEQ ID NO: 219616 - RNA, 32 nt, Human
uaauccuggcacuuugggaggcugaggcgggc

SEQ ID NO: 219617 - RNA, 32 nt, Human
uaauccuggcauuuuaggaggcugagguugga

SEQ ID NO: 219618 - RNA, 32 nt, Human
uaauccuggcuacucgggaggcugaggcagga

SEQ ID NO: 219619 - RNA, 32 nt, Human
uaauccuggcuacuugggaggcugaggcauga

SEQ ID NO: 219620 - RNA, 32 nt, Human
uaauccugugcaaaggaaaagaggugcuuugu

SEQ ID NO: 219621 - RNA, 32 nt, Human
uaauccuguggccaacaccaaugccccaaccu

SEQ ID NO: 219622 - RNA, 32 nt, Human
uaauccuuagcaggcucuuauucuuuaauuaa

SEQ ID NO: 219623 - RNA, 32 nt, Human
uaauccuugcauuuuggaaggcugaggcagga

SEQ ID NO: 219624 - RNA, 32 nt, Human
uaauccuugcccgccauguccgggggcuucga

SEQ ID NO: 219625 - RNA, 32 nt, Human
uaauccuugccugcugaacccagccugggccu

SEQ ID NO: 219626 - RNA, 32 nt, Human
uaauccuuuacauugucuaugaugcaaagacc

SEQ ID NO: 219627 - RNA, 32 nt, Human
uaauccuuuguauucauguuuacagugcuauu

SEQ ID NO: 219628 - RNA, 32 nt, Human
uaauccuuuguuuucugacuaauuaggcaagg

SEQ ID NO: 219629 - RNA, 32 nt, Human
uaaucgagaauguaagucuuucccaggaauuu

SEQ ID NO: 219630 - RNA, 32 nt, Human
uaaucgaggaagcaugaccaccaacuuggauc

SEQ ID NO: 219631 - RNA, 32 nt, Human
uaaucgaugggggagucugaagcagaugcaaa

SEQ ID NO: 219632 - RNA, 32 nt, Human
uaaucgcagcacuuugggaggcugaagggggc

SEQ ID NO: 219633 - RNA, 32 nt, Human
uaaucgcagcacuuugggaggcugaggcagga

SEQ ID NO: 219634 - RNA, 32 nt, Human
uaaucgcagcacuuugggaggcugagguaggg

SEQ ID NO: 219635 - RNA, 32 nt, Human
uaaucgcagcuacucaggaggcugaggcagga

SEQ ID NO: 219636 - RNA, 32 nt, Human
uaaucgcaguacuuugggaggcugaggcaaga

SEQ ID NO: 219637 - RNA, 32 nt, Human
uaaucgcugcugccccuccacucccaagaugc

SEQ ID NO: 219638 - RNA, 32 nt, Human
uaaucggauugagagcgcgccggcccgggccg

SEQ ID NO: 219639 - RNA, 32 nt, Human
uaaucggcaccccagugagcagacuggacauc

SEQ ID NO: 219640 - RNA, 32 nt, Human
uaaucguagcgcuuugagaggcugaggcagga

SEQ ID NO: 219641 - RNA, 32 nt, Human
uaaucgugccacugcaguccagccuaggcaac

SEQ ID NO: 219642 - RNA, 32 nt, Human
uaaucuaaccacugcaacugugucccugcuuc

SEQ ID NO: 219643 - RNA, 17 nt, Human
uaaucuacauuuuaggg

SEQ ID NO: 219644 - RNA, 32 nt, Human
uaaucuaccuugcaguguaggaauucuauuga

SEQ ID NO: 219645 - RNA, 20 nt, Human
uaaucuacugcauuuaggga

SEQ ID NO: 219646 - RNA, 20 nt, Human
uaaucuacuggcgaauggga

SEQ ID NO: 219647 - RNA, 32 nt, Human
uaaucuauaaugaagaucaacagugaagagga

SEQ ID NO: 219648 - RNA, 32 nt, Human
uaaucuauauucuacccuuauaauaaaagauc

SEQ ID NO: 219649 - RNA, 32 nt, Human
uaaucuaucccuucccuuucccagggccuucu

SEQ ID NO: 219650 - RNA, 32 nt, Human
uaaucuauuuugcuccauacaugcaacugcgu

SEQ ID NO: 219651 - RNA, 32 nt, Human
uaaucucaacuacuugggaggcugaggcagga

SEQ ID NO: 219652 - RNA, 32 nt, Human
uaaucucaagagugucauuacagugagaaucu

SEQ ID NO: 219653 - RNA, 32 nt, Human
uaaucucaaugcaagccccaacuuucuuaucc

SEQ ID NO: 219654 - RNA, 32 nt, Human
uaaucucaauuuaagauacaaauaaggacaca

SEQ ID NO: 219655 - RNA, 32 nt, Human
uaaucucacuugacuccagcuaggagcugaug

SEQ ID NO: 219656 - RNA, 32 nt, Human
uaaucucagaacuuugggaggcugaggcaggu

SEQ ID NO: 219657 - RNA, 32 nt, Human
uaaucucagcaacucaggaggcugaggcagga

SEQ ID NO: 219658 - RNA, 32 nt, Human
uaaucucagcacauugggaggcugaggugggc

SEQ ID NO: 219659 - RNA, 32 nt, Human
uaaucucagcacucugggaggccgaggcgggu

SEQ ID NO: 219660 - RNA, 32 nt, Human
uaaucucagcacuuugggagacugagaugaga

SEQ ID NO: 219661 - RNA, 32 nt, Human
uaaucucagcacuuugggaggcugaggcagaa

SEQ ID NO: 219662 - RNA, 32 nt, Human
uaaucucagcacuuugggaggcugaggcaggc

SEQ ID NO: 219663 - RNA, 32 nt, Human
uaaucucagcacuuugggaggcugaggcaggu

SEQ ID NO: 219664 - RNA, 32 nt, Human
uaaucucagcacuuugggaggcugaggcgggc

SEQ ID NO: 219665 - RNA, 32 nt, Human
uaaucucagcacuuugggaggcugagguggga

SEQ ID NO: 219666 - RNA, 32 nt, Human
uaaucucagcacuuugggaggcugaggugggc

SEQ ID NO: 219667 - RNA, 32 nt, Human
uaaucucagcacuuugggaggcugaggugggu

SEQ ID NO: 219668 - RNA, 32 nt, Human
uaaucucagcauuuugggaggcugaggcaggc

SEQ ID NO: 219669 - RNA, 32 nt, Human
uaaucucagcccuucccgaggcugagguggaa

SEQ ID NO: 219670 - RNA, 32 nt, Human
uaaucucagcgacuugggaggcugagguggag

SEQ ID NO: 219671 - RNA, 32 nt, Human
uaaucucagcuacuagagaggcugaggcagga

SEQ ID NO: 219672 - RNA, 32 nt, Human
uaaucucagcuacucaagaggcugagguagaa

SEQ ID NO: 219673 - RNA, 32 nt, Human
uaaucucagcuacucaggaggcugaggcaaga

SEQ ID NO: 219674 - RNA, 32 nt, Human
uaaucucagcuacucaggaggcugaggcacaa

SEQ ID NO: 219675 - RNA, 32 nt, Human
uaaucucagcuacucaggaggcugaggcacga

SEQ ID NO: 219676 - RNA, 32 nt, Human
uaaucucagcuacucaggaggcugaggcagga

SEQ ID NO: 219677 - RNA, 32 nt, Human
uaaucucagcuacucaggaggcugagguagua

SEQ ID NO: 219678 - RNA, 32 nt, Human
uaaucucagcuacucgggaggcugaggcaaga

SEQ ID NO: 219679 - RNA, 32 nt, Human
uaaucucagcuacucgggaggcugaggcagga

SEQ ID NO: 219680 - RNA, 32 nt, Human
uaaucucagcuacuggagaggcugaggcagga

SEQ ID NO: 219681 - RNA, 32 nt, Human
uaaucucagcuacuugaaaggcugaggcagga

SEQ ID NO: 219682 - RNA, 32 nt, Human
uaaucucagcuacuugagaggcugaggcagga

SEQ ID NO: 219683 - RNA, 32 nt, Human
uaaucucagcuacuugggaggcugacgcagga

SEQ ID NO: 219684 - RNA, 32 nt, Human
uaaucucagcuacuugggaggcugagacagga

SEQ ID NO: 219685 - RNA, 32 nt, Human
uaaucucagcuacuugggaggcugaggcacga

SEQ ID NO: 219686 - RNA, 32 nt, Human
uaaucucagcuacuugggaggcugaggcagga

SEQ ID NO: 219687 - RNA, 32 nt, Human
uaaucucagcuauucuggaggcuuaggcggga

SEQ ID NO: 219688 - RNA, 32 nt, Human
uaaucucagcuauugaggaggcugaggcagga

SEQ ID NO: 219689 - RNA, 32 nt, Human
uaaucucagcugcuccggaggcugaggcagga

SEQ ID NO: 219690 - RNA, 32 nt, Human
uaaucucagguaaaugccaaucaggagacaaa

SEQ ID NO: 219691 - RNA, 32 nt, Human
uaaucucagguacucaggaggcugaggcagga

SEQ ID NO: 219692 - RNA, 32 nt, Human
uaaucucauccaaaaccaugcucacagacaca

SEQ ID NO: 219693 - RNA, 32 nt, Human
uaaucucauccuguuuugaugcaaggguucuc

SEQ ID NO: 219694 - RNA, 32 nt, Human
uaaucucauuggaggagggaacuguuuccugc

SEQ ID NO: 219695 - RNA, 32 nt, Human
uaaucucauuuucaaagcuguuucucauuuua

SEQ ID NO: 219696 - RNA, 32 nt, Human
uaaucuccaacuuuauuuugaauguaccucua

SEQ ID NO: 219697 - RNA, 32 nt, Human
uaaucuccucaccucaugagucuuaacuuaau

SEQ ID NO: 219698 - RNA, 32 nt, Human
uaaucucggaagaugauaccaagagcagaggc

SEQ ID NO: 219699 - RNA, 32 nt, Human
uaaucucuagagccuuauuuuccacaccaccu

SEQ ID NO: 219700 - RNA, 32 nt, Human
uaaucucucagccacaaaccucaguuuccaaa

SEQ ID NO: 219701 - RNA, 32 nt, Human
uaaucucucauggugaaaucugcucuguacau

SEQ ID NO: 219702 - RNA, 32 nt, Human
uaaucucuccaccuuccaaagagugcuaagca

SEQ ID NO: 219703 - RNA, 32 nt, Human
uaaucucuccccuaguuuagaguccuuugcau

SEQ ID NO: 219704 - RNA, 32 nt, Human
uaaucucugaguuucuggaauauuuucuuaga

SEQ ID NO: 219705 - RNA, 32 nt, Human
uaaucucuuuccaucuuacuugcccuucuaua

SEQ ID NO: 219706 - RNA, 32 nt, Human
uaaucugaggcagagacacagcagaaccugag

SEQ ID NO: 219707 - RNA, 32 nt, Human
uaaucugaucagcaugguccagggacaguuga

SEQ ID NO: 219708 - RNA, 18 nt, Human
uaaucugcccaucuggga

SEQ ID NO: 219709 - RNA, 32 nt, Human
uaaucugccuuuuggugcauuacuuggucaau

SEQ ID NO: 219710 - RNA, 32 nt, Human
uaaucugcuaucuucauuccagucccuacccc

SEQ ID NO: 219711 - RNA, 19 nt, Human
uaaucugcucacuugagga

SEQ ID NO: 219712 - RNA, 32 nt, Human
uaaucuggaccaggcuguggguagaugugcaa

SEQ ID NO: 219713 - RNA, 32 nt, Human
uaaucuggagaaacugaacuaccuucuguuca

SEQ ID NO: 219714 - RNA, 32 nt, Human
uaaucuggaggcaagguucgacugcagccgcc

SEQ ID NO: 219715 - RNA, 32 nt, Human
uaaucugggaagggaagggcuacugcagcuuu

SEQ ID NO: 219716 - RNA, 32 nt, Human
uaaucugggaagugccugguuuugaaaauccg

SEQ ID NO: 219717 - RNA, 32 nt, Human
uaaucuguaagauucaugaaauucggggccag

SEQ ID NO: 219718 - RNA, 32 nt, Human
uaaucuguaggagcagaaccucugauugacca

SEQ ID NO: 219719 - RNA, 32 nt, Human
uaaucugucccauuuucgaggcuccuuauaag

SEQ ID NO: 219720 - RNA, 32 nt, Human
uaaucugugacugcuccuguggaaacuccaca

SEQ ID NO: 219721 - RNA, 32 nt, Human
uaaucugugguuuugaccagagcccagauggg

SEQ ID NO: 219722 - RNA, 32 nt, Human
uaaucuguugucugacaggcauuucccagacc

SEQ ID NO: 219723 - RNA, 32 nt, Human
uaaucuuaaguggacagcaauuuggaacagug

SEQ ID NO: 219724 - RNA, 32 nt, Human
uaaucuuacugaugcacugggccuaucuuuuu

SEQ ID NO: 219725 - RNA, 32 nt, Human
uaaucuuagcuacuugggaggcugaggcacaa

SEQ ID NO: 219726 - RNA, 32 nt, Human
uaaucuuauacagaagaaacuaacuuagaaac

SEQ ID NO: 219727 - RNA, 32 nt, Human
uaaucuuccuuuccucaaugcuuccuaauccu

SEQ ID NO: 219728 - RNA, 32 nt, Human
uaaucuucucaauuucccuuuuuaagccguug

SEQ ID NO: 219729 - RNA, 32 nt, Human
uaaucuucuuccuauguuuuggaauucugggg

SEQ ID NO: 219730 - RNA, 32 nt, Human
uaaucuugagauccugaacaugugcugauuuu

SEQ ID NO: 219731 - RNA, 32 nt, Human
uaaucuuguauaaagcaucacauuuuacuaug

SEQ ID NO: 219732 - RNA, 32 nt, Human
uaaucuuuaacacuaaacuacugugaaauucu

SEQ ID NO: 219733 - RNA, 32 nt, Human
uaaucuuuagagauguccacaucauaacagaa

SEQ ID NO: 219734 - RNA, 20 nt, Human
uaaucuuuagcauuuaggga

SEQ ID NO: 219735 - RNA, 32 nt, Human
uaaucuuucacugcagccucaaacuccuggag

SEQ ID NO: 219736 - RNA, 32 nt, Human
uaaucuuugcuuugcugaccucucaggccucu

SEQ ID NO: 219737 - RNA, 32 nt, Human
uaaucuuuuagcaaccccaguauuccuucacu

SEQ ID NO: 219738 - RNA, 32 nt, Human
uaaugaaaaacagcucaaauuuuaggguaacu

SEQ ID NO: 219739 - RNA, 32 nt, Human
uaaugaaaaggacuguucaagugggucuggcc

SEQ ID NO: 219740 - RNA, 32 nt, Human
uaaugaaacauacacuuuuagaucaagauaac

SEQ ID NO: 219741 - RNA, 32 nt, Human
uaaugaaacucaucauuuuagucaaguagagg

SEQ ID NO: 219742 - RNA, 32 nt, Human
uaaugaaagagccaugucugugucuaaucacu

SEQ ID NO: 219743 - RNA, 32 nt, Human
uaaugaaauccaccccugccugcuagauacuu

SEQ ID NO: 219744 - RNA, 32 nt, Human
uaaugaaauguucaaguauuacagcaauauuc

SEQ ID NO: 219745 - RNA, 32 nt, Human
uaaugaacaaauuuccuugguuacaugguuuu

SEQ ID NO: 219746 - RNA, 21 nt, Human
uaaugaacaacaaaaugggga

SEQ ID NO: 219747 - RNA, 32 nt, Human
uaaugaaccgaccucaugguccugggcaaagc

SEQ ID NO: 219748 - RNA, 32 nt, Human
uaaugaacuuaucuguggaguacauugaagaa

SEQ ID NO: 219749 - RNA, 32 nt, Human
uaaugaagaaaagaaugacagaugcaaggaag

SEQ ID NO: 219750 - RNA, 32 nt, Human
uaaugaagacuauuuuucagcagaagugaaga

SEQ ID NO: 219751 - RNA, 32 nt, Human
uaaugaagaggaugauacugugucuagcuuaa

SEQ ID NO: 219752 - RNA, 32 nt, Human
uaaugaagaguagaugacuuucccuucugucc

SEQ ID NO: 219753 - RNA, 32 nt, Human
uaaugaagcuguacaguucuccagaaauuaaa

SEQ ID NO: 219754 - RNA, 32 nt, Human
uaaugaagcuugccucacccaguagcugggaa

SEQ ID NO: 219755 - RNA, 32 nt, Human
uaaugaaggugccauuuggcugcuccuuaaua

SEQ ID NO: 219756 - RNA, 32 nt, Human
uaaugaaucugagcagucauuuaucagugcuu

SEQ ID NO: 219757 - RNA, 32 nt, Human
uaaugaaugaacacaguucaucagauuggaau

SEQ ID NO: 219758 - RNA, 32 nt, Human
uaaugaaugccuguagucccagcuacuccgga

SEQ ID NO: 219759 - RNA, 32 nt, Human
uaaugaauggcagaauuaacaaaauuacaaac

SEQ ID NO: 219760 - RNA, 21 nt, Human
uaaugacaaaaagcauaagua

SEQ ID NO: 219761 - RNA, 32 nt, Human
uaaugacaaagaacauucuucugauaaaggaa

SEQ ID NO: 219762 - RNA, 32 nt, Human
uaaugacaaucagaagagcuaccugcccucug

SEQ ID NO: 219763 - RNA, 32 nt, Human
uaaugacaguagagaaguacagcaaccuguuu

SEQ ID NO: 219764 - RNA, 27 nt, Human
uaaugaccaucaccgaccagagccugg

SEQ ID NO: 219765 - RNA, 32 nt, Human
uaaugacccauaucucuauauguauguguucc

SEQ ID NO: 219766 - RNA, 32 nt, Human
uaaugacggagugcuccuucuccaguuccggg

SEQ ID NO: 219767 - RNA, 32 nt, Human
uaaugacggugacuugugucgugggggaaaac

SEQ ID NO: 219768 - RNA, 22 nt, Human
uaaugacuguccccaucuccug

SEQ ID NO: 219769 - RNA, 32 nt, Human
uaaugacuuuuguaugugugcucucuuuauaa

SEQ ID NO: 219770 - RNA, 32 nt, Human
uaaugagaaaccaggacaggccaucugcagug

SEQ ID NO: 219771 - RNA, 32 nt, Human
uaaugagaagcuuugguucugccaucucuccc

SEQ ID NO: 219772 - RNA, 32 nt, Human
uaaugagaccaugccauauaagcacaaaauuu

SEQ ID NO: 219773 - RNA, 32 nt, Human
uaaugagacugauucuggugucuuuaguuauu

SEQ ID NO: 219774 - RNA, 32 nt, Human
uaaugagacuucagaaagaaucaaaagcaaua

SEQ ID NO: 219775 - RNA, 32 nt, Human
uaaugagaugcuucagcucacaguuugaagug

SEQ ID NO: 219776 - RNA, 32 nt, Human
uaaugagccguugugcuccagccugggcgaca

SEQ ID NO: 219777 - RNA, 32 nt, Human
uaaugagccuccucaauaagagagaaguucuc

SEQ ID NO: 219778 - RNA, 32 nt, Human
uaaugagcuauuaaaacucagccugggacagu

SEQ ID NO: 219779 - RNA, 32 nt, Human
uaaugagcucaagugauccucccaccucagcc

SEQ ID NO: 219780 - RNA, 32 nt, Human
uaaugagcugguuccugcugagcucccaccau

SEQ ID NO: 219781 - RNA, 32 nt, Human
uaaugagggagggaagaaagaagaacaaauaa

SEQ ID NO: 219782 - RNA, 32 nt, Human
uaaugaggugcagagguguggggaagaccugg

SEQ ID NO: 219783 - RNA, 32 nt, Human
uaaugagguuuucaaagauucugcaagucaga

SEQ ID NO: 219784 - RNA, 32 nt, Human
uaaugagucuguucuggcucccagaagaugcc

SEQ ID NO: 219785 - RNA, 32 nt, Human
uaaugaguggucggaccguggggaagggcccc

SEQ ID NO: 219786 - RNA, 32 nt, Human
uaaugagugguucagccaucaccaccaguggc

SEQ ID NO: 219787 - RNA, 32 nt, Human
uaaugaguuccgaagguucauggagaagaauc

SEQ ID NO: 219788 - RNA, 32 nt, Human
uaaugaguuuuuaaaggcuuucuauguagugc

SEQ ID NO: 219789 - RNA, 32 nt, Human
uaaugauacaauaugguugaguaugcauuuca

SEQ ID NO: 219790 - RNA, 32 nt, Human
uaaugauacagcacuucugccaucucagcauc

SEQ ID NO: 219791 - RNA, 32 nt, Human
uaaugauacuguuuuaaagaacaggugugaaa

SEQ ID NO: 219792 - RNA, 32 nt, Human
uaaugauauguaacuuuuuaacuuuuuaaaua

SEQ ID NO: 219793 - RNA, 32 nt, Human
uaaugaucagacauaggagaaacccugaauag

SEQ ID NO: 219794 - RNA, 32 nt, Human
uaaugaugaaggggaggaaggagaggaggaug

SEQ ID NO: 219795 - RNA, 32 nt, Human
uaaugaugacauuuagcaagugcucaaaauaa

SEQ ID NO: 219796 - RNA, 32 nt, Human
uaaugaugccucuuucuuuucucagauguugc

SEQ ID NO: 219797 - RNA, 32 nt, Human
uaaugauggaguuuugcucuuacgcccaggcu

SEQ ID NO: 219798 - RNA, 32 nt, Human
uaaugaugggagaaaggggguagggugcugac

SEQ ID NO: 219799 - RNA, 32 nt, Human
uaaugauguaguaaaaagauuucuccagaaaa

SEQ ID NO: 219800 - RNA, 32 nt, Human
uaaugauguauugugccguggaaguacugugu

SEQ ID NO: 219801 - RNA, 32 nt, Human
uaaugauuccagccucucacugugccuuaugc

SEQ ID NO: 219802 - RNA, 32 nt, Human
uaaugauuccuugccuccuuuuauccagauca

SEQ ID NO: 219803 - RNA, 31 nt, Human
uaaugauucuuggaggagguuguagggagag

SEQ ID NO: 219804 - RNA, 32 nt, Human
uaaugauucuugucuaaaauugccuuaacuau

SEQ ID NO: 219805 - RNA, 32 nt, Human
uaaugauuucucccaagcaaaucaggcauacg

SEQ ID NO: 219806 - RNA, 32 nt, Human
uaaugcaacguuguucaaauauaucaaaggau

SEQ ID NO: 219807 - RNA, 32 nt, Human
uaaugcaagagaaaggagaauccccagagaaa

SEQ ID NO: 219808 - RNA, 32 nt, Human
uaaugcaagcauacccucccuugagucucaau

SEQ ID NO: 219809 - RNA, 32 nt, Human
uaaugcaauaguggaugugcacugccuguaca

SEQ ID NO: 219810 - RNA, 32 nt, Human
uaaugcaaucauagcucacugcagccuggaac

SEQ ID NO: 219811 - RNA, 32 nt, Human
uaaugcacucauuuaccuuuacauggugaaag

SEQ ID NO: 219812 - RNA, 32 nt, Human
uaaugcacugguuguuguucuuguucuuuccu

SEQ ID NO: 219813 - RNA, 32 nt, Human
uaaugcagaaugcgugccuucaucucagauuu

SEQ ID NO: 219814 - RNA, 32 nt, Human
uaaugcagagcagcuuaacauccaccacagag

SEQ ID NO: 219815 - RNA, 32 nt, Human
uaaugcagauauagugaacacuggaaagauuu

SEQ ID NO: 219816 - RNA, 32 nt, Human
uaaugcaggcuauuaucagacacagcagcagg

SEQ ID NO: 219817 - RNA, 25 nt, Human
uaaugcauauuaaguuauaugcaga

SEQ ID NO: 219818 - RNA, 32 nt, Human
uaaugcaucacugugacaaaagccacacgcau

SEQ ID NO: 219819 - RNA, 32 nt, Human
uaaugcaucuaugggccaggugcaguggcuca

SEQ ID NO: 219820 - RNA, 32 nt, Human
uaaugcaugugcaaaguuaggucuucccaguu

SEQ ID NO: 219821 - RNA, 32 nt, Human
uaaugcauguuaggaaaauuucacauuaauau

SEQ ID NO: 219822 - RNA, 32 nt, Human
uaaugcauguucugaaaggauucacuuuugac

SEQ ID NO: 219823 - RNA, 32 nt, Human
uaaugccaaagcaacagaagcagcaccagaaa

SEQ ID NO: 219824 - RNA, 32 nt, Human
uaaugccaaguggagacaauaaauugcccuuu

SEQ ID NO: 219825 - RNA, 32 nt, Human
uaaugccacugaacuguacacuuuaaaaugga

SEQ ID NO: 219826 - RNA, 32 nt, Human
uaaugccacugcacuccagccugccuggauga

SEQ ID NO: 219827 - RNA, 32 nt, Human
uaaugccagcacuuugccaaggugggcagauc

SEQ ID NO: 219828 - RNA, 32 nt, Human
uaaugccagcacuuugggaggccgaggcgggu

SEQ ID NO: 219829 - RNA, 32 nt, Human
uaaugccagcacuuugggcagcugaggcgagu

SEQ ID NO: 219830 - RNA, 32 nt, Human
uaaugccagcuacucaggaggcugaggcauga

SEQ ID NO: 219831 - RNA, 32 nt, Human
uaaugccagcuacucgggaggcugaggcacga

SEQ ID NO: 219832 - RNA, 32 nt, Human
uaaugccagcuacucgggaggcugaggcagga

SEQ ID NO: 219833 - RNA, 32 nt, Human
uaaugccagcuacuugggaggcugaggcagga

SEQ ID NO: 219834 - RNA, 32 nt, Human
uaaugccccaaagccaaaguggacccagcucu

SEQ ID NO: 219835 - RNA, 32 nt, Human
uaaugccgggcaggccgggcacaguggcucac

SEQ ID NO: 219836 - RNA, 32 nt, Human
uaaugccgguucugcuccacuuguccacucug

SEQ ID NO: 219837 - RNA, 32 nt, Human
uaaugccuaucucuuggucuauuaaggaaaga

SEQ ID NO: 219838 - RNA, 32 nt, Human
uaaugccucacagcacacuuuugaggcugagc

SEQ ID NO: 219839 - RNA, 32 nt, Human
uaaugccucuacuuggccuauuugccagagaa

SEQ ID NO: 219840 - RNA, 32 nt, Human
uaaugccugggcagggaccaggccagcgcugc

SEQ ID NO: 219841 - RNA, 32 nt, Human
uaaugcgugcaguuccugcugccugcaggcag

SEQ ID NO: 219842 - RNA, 32 nt, Human
uaaugcguucaggaguccacaccaggcacaga

SEQ ID NO: 219843 - RNA, 32 nt, Human
uaaugcuaacauaagagcuaaaugcuugauua

SEQ ID NO: 219844 - RNA, 32 nt, Human
uaaugcuagggaauaugugaagauguuuuuau

SEQ ID NO: 219845 - RNA, 32 nt, Human
uaaugcuaggguagugacugagauguaaaaau

SEQ ID NO: 219846 - RNA, 32 nt, Human
uaaugcuaucccuccccucuccacccacccca

SEQ ID NO: 219847 - RNA, 32 nt, Human
uaaugcuaucucauggugacaaguuucauguu

SEQ ID NO: 219848 - RNA, 32 nt, Human
uaaugcugauaauaccuaaagaugcauugaau

SEQ ID NO: 219849 - RNA, 32 nt, Human
uaaugcugcaggaaguaguuaggagaaaacga

SEQ ID NO: 219850 - RNA, 32 nt, Human
uaaugcuggcuacacccccacaggugacuugg

SEQ ID NO: 219851 - RNA, 32 nt, Human
uaaugcuguucuaacuacagugcucaauaaaa

SEQ ID NO: 219852 - RNA, 32 nt, Human
uaaugcuuccagaugugcacugcuucugucua

SEQ ID NO: 219853 - RNA, 32 nt, Human
uaaugcuugaaguuuuaucuacauacacaggu

SEQ ID NO: 219854 - RNA, 32 nt, Human
uaaugcuugcugaccuuagagaaugaguugag

SEQ ID NO: 219855 - RNA, 32 nt, Human
uaaugcuuggagccaagggccccagcccaccc

SEQ ID NO: 219856 - RNA, 32 nt, Human
uaaugcuugguaucucuggucuuccuaauaug

SEQ ID NO: 219857 - RNA, 32 nt, Human
uaaugcuuuuagcugcucgcaugcuugucuuu

SEQ ID NO: 219858 - RNA, 32 nt, Human
uaauggaaaauuacauugcuaauauuuaaggu

SEQ ID NO: 219859 - RNA, 32 nt, Human
uaauggaacagaaaggagguguggagauccuu

SEQ ID NO: 219860 - RNA, 32 nt, Human
uaauggaaccacagauaacaccuucuaguacu

SEQ ID NO: 219861 - RNA, 32 nt, Human
uaauggaagaggaaagugaacaguaucuucau

SEQ ID NO: 219862 - RNA, 32 nt, Human
uaauggaagguaaagaaaaauuacagaaugga

SEQ ID NO: 219863 - RNA, 32 nt, Human
uaauggaaugauugguuaaaaugugauuuuuc

SEQ ID NO: 219864 - RNA, 32 nt, Human
uaauggaauuaccuugcuccuacuucuuuuga

SEQ ID NO: 219865 - RNA, 32 nt, Human
uaauggaauucacagagguguugcagcguauc

SEQ ID NO: 219866 - RNA, 20 nt, Human
uaauggacaaauuaccaugu

SEQ ID NO: 219867 - RNA, 32 nt, Human
uaauggaccgggcuugguggcucaugcuugua

SEQ ID NO: 219868 - RNA, 32 nt, Human
uaauggacuucacugcauccaggaaugguagg

SEQ ID NO: 219869 - RNA, 32 nt, Human
uaauggagaucauuccauuacacuccagccug

SEQ ID NO: 219870 - RNA, 32 nt, Human
uaauggagccaggguuuugccauguuggccag

SEQ ID NO: 219871 - RNA, 32 nt, Human
uaauggaggggaggcugagggaaaggcucgua

SEQ ID NO: 219872 - RNA, 32 nt, Human
uaauggaguuauuguuaaaacagaguauucuu

SEQ ID NO: 219873 - RNA, 32 nt, Human
uaauggaucuacugacauuagcacuuuguaca

SEQ ID NO: 219874 - RNA, 32 nt, Human
uaauggcaacacugcgcuccagccuggcagac

SEQ ID NO: 219875 - RNA, 32 nt, Human
uaauggcacaguaccuaaugaauauuguuggc

SEQ ID NO: 219876 - RNA, 32 nt, Human
uaauggcaccacuguacuccacuugggcgaca

SEQ ID NO: 219877 - RNA, 32 nt, Human
uaauggcagaagugccugugcuagaguuccaa

SEQ ID NO: 219878 - RNA, 32 nt, Human
uaauggcagcauaaaucaaagaauuucacagg

SEQ ID NO: 219879 - RNA, 32 nt, Human
uaauggcaggugcccuucccccaaugaagucg

SEQ ID NO: 219880 - RNA, 32 nt, Human
uaauggcauucaauaaacauauguugaaagaa

SEQ ID NO: 219881 - RNA, 32 nt, Human
uaauggcauuuaaagcaaacaaacaaacaaaa

SEQ ID NO: 219882 - RNA, 32 nt, Human
uaauggccacagucuguaauccauucacauuc

SEQ ID NO: 219883 - RNA, 32 nt, Human
uaauggccccagcaucugccucuggaaaacua

SEQ ID NO: 219884 - RNA, 32 nt, Human
uaauggcgugagccaccguaccuggccauauu

SEQ ID NO: 219885 - RNA, 32 nt, Human
uaauggcgugagccacuguaccuggccauauu

SEQ ID NO: 219886 - RNA, 32 nt, Human
uaauggcugaugcuaauaauaauagcaauuac

SEQ ID NO: 219887 - RNA, 32 nt, Human
uaauggcugccucccucuccugaucucuucaa

SEQ ID NO: 219888 - RNA, 32 nt, Human
uaauggcuggagauggcuucacaugcccagua

SEQ ID NO: 219889 - RNA, 32 nt, Human
uaauggcuuccauuuaauacaggcaaagcccu

SEQ ID NO: 219890 - RNA, 32 nt, Human
uaauggcuucucuuuucucucuuguggaauug

SEQ ID NO: 219891 - RNA, 32 nt, Human
uaaugggaagccagaacauaauucuuuuucga

SEQ ID NO: 219892 - RNA, 32 nt, Human
uaaugggaaggucauuuaauuuacagaugguu

SEQ ID NO: 219893 - RNA, 32 nt, Human
uaaugggaccauugaaucccuaagguggaccu

SEQ ID NO: 219894 - RNA, 32 nt, Human
uaaugggacucuugcuauguugcucacacuag

SEQ ID NO: 219895 - RNA, 32 nt, Human
uaaugggagccaauucacaauucacuaaguga

SEQ ID NO: 219896 - RNA, 32 nt, Human
uaaugggaggagcacucggaaggguugguuug

SEQ ID NO: 219897 - RNA, 32 nt, Human
uaaugggauagagagggaaacugaggccagca

SEQ ID NO: 219898 - RNA, 32 nt, Human
uaaugggaugaggaggaauugggggugggggu

SEQ ID NO: 219899 - RNA, 32 nt, Human
uaaugggcuacugggagaaucagaugagacaa

SEQ ID NO: 219900 - RNA, 32 nt, Human
uaaugggcucugcccucauccccagucucggg

SEQ ID NO: 219901 - RNA, 32 nt, Human
uaauggggagacaaaaaugggggccaggggag

SEQ ID NO: 219902 - RNA, 32 nt, Human
uaauggggagggcugagggcucccugucccca

SEQ ID NO: 219903 - RNA, 32 nt, Human
uaauggggcagagagaugggaccuggggcaaa

SEQ ID NO: 219904 - RNA, 32 nt, Human
uaauggggcggugagaggggaacagacuggaa

SEQ ID NO: 219905 - RNA, 32 nt, Human
uacaggugugagccaccgugcccggccucuuu

SEQ ID NO: 219906 - RNA, 32 nt, Human
uacaggugugagccaccgugccuggccaauuc

SEQ ID NO: 219907 - RNA, 32 nt, Human
uacaggugugagccaccgugccuggccagugu

SEQ ID NO: 219908 - RNA, 32 nt, Human
uacaggugugagccaccgugccuggccgaggc

SEQ ID NO: 219909 - RNA, 32 nt, Human
uacaggugugagccaccucgccugggcccccu

SEQ ID NO: 219910 - RNA, 32 nt, Human
uacaggugugagccacggcacccagccuagcu

SEQ ID NO: 219911 - RNA, 32 nt, Human
uacaggugugagccacggcacccugccgaauc

SEQ ID NO: 219912 - RNA, 32 nt, Human
uacaggugugagccacggcaccuggccagaac

SEQ ID NO: 219913 - RNA, 32 nt, Human
uacaggugugagccacggugcccggcccacaa

SEQ ID NO: 219914 - RNA, 32 nt, Human
uacaggugugagccacuacacccagcccugca

SEQ ID NO: 219915 - RNA, 32 nt, Human
uacaggugugagccacuacgccccggcccaac

SEQ ID NO: 219916 - RNA, 32 nt, Human
uacaggugugagccacuauacccgaccagauc

SEQ ID NO: 219917 - RNA, 32 nt, Human
uacaggugugagccacuaugccuggccuuccc

SEQ ID NO: 219918 - RNA, 32 nt, Human
uacaggugugagccacucugccuggccuacca

SEQ ID NO: 219919 - RNA, 32 nt, Human
uacaggugugagccacugagcccagccauuua

SEQ ID NO: 219920 - RNA, 32 nt, Human
uacaggugugagccacugagcccggccacagu

SEQ ID NO: 219921 - RNA, 32 nt, Human
uacaggugugagccacugcacccaacccaacg

SEQ ID NO: 219922 - RNA, 32 nt, Human
uacaggugugagccacugcacccacccaagac

SEQ ID NO: 219923 - RNA, 32 nt, Human
uacaggugugagccacugcacccagcccacuu

SEQ ID NO: 219924 - RNA, 32 nt, Human
uacaggugugagccacugcacccagccuaccu

SEQ ID NO: 219925 - RNA, 32 nt, Human
uacaggugugagccacugcacccagccuguga

SEQ ID NO: 219926 - RNA, 32 nt, Human
uacaggugugagccacugcacccagcugagag

SEQ ID NO: 219927 - RNA, 32 nt, Human
uacaggugugagccacugcaccccuccuaaau

SEQ ID NO: 219928 - RNA, 32 nt, Human
uacaggugugagccacugcacccgaccgauac

SEQ ID NO: 219929 - RNA, 26 nt, Human
uacaggugugagccacugcacccggc

SEQ ID NO: 219930 - RNA, 32 nt, Human
uacaggugugagccacugcacccggccaacua

SEQ ID NO: 219931 - RNA, 32 nt, Human
uacaggugugagccacugcacccggccacaag

SEQ ID NO: 219932 - RNA, 32 nt, Human
uacaggugugagccacugcacccggccugaaa

SEQ ID NO: 219933 - RNA, 32 nt, Human
uacaggugugagccacugcaccucgccagaug

SEQ ID NO: 219934 - RNA, 32 nt, Human
uacaggugugagccacugcaccuggccauggu

SEQ ID NO: 219935 - RNA, 32 nt, Human
uacaggugugagccacugcaccuggccuccuu

SEQ ID NO: 219936 - RNA, 32 nt, Human
uacaggugugagccacugcaccuggcucuaau

SEQ ID NO: 219937 - RNA, 32 nt, Human
uacaggugugagccacugcacguggccuaaaa

SEQ ID NO: 219938 - RNA, 32 nt, Human
uacaggugugagccacugccuggccuggccgu

SEQ ID NO: 219939 - RNA, 32 nt, Human
uacaggugugagccacugcgcccagcacacuc

SEQ ID NO: 219940 - RNA, 32 nt, Human
uacaggugugagccacugcgcccagccagcac

SEQ ID NO: 219941 - RNA, 32 nt, Human
uacaggugugagccacugcgcccagccuauac

SEQ ID NO: 219942 - RNA, 32 nt, Human
uacaggugugagccacugcgcccagucaugcc

SEQ ID NO: 219943 - RNA, 32 nt, Human
uacaggugugagccacugcgcccggccaugcc

SEQ ID NO: 219944 - RNA, 32 nt, Human
uacaggugugagccacugcgccgggccuaaua

SEQ ID NO: 219945 - RNA, 32 nt, Human
uacaggugugagccacugcgccuggacugagu

SEQ ID NO: 219946 - RNA, 32 nt, Human
uacaggugugagccacugcgccuggccuguug

SEQ ID NO: 219947 - RNA, 32 nt, Human
uacaggugugagccacugggcccggucuuuuu

SEQ ID NO: 219948 - RNA, 32 nt, Human
uacaggugugagccacugugcccagcaguuuc

SEQ ID NO: 219949 - RNA, 32 nt, Human
uacaggugugagccacugugcccagccuaauu

SEQ ID NO: 219950 - RNA, 32 nt, Human
uacaggugugagccacugugcccagccucuuc

SEQ ID NO: 219951 - RNA, 32 nt, Human
uacaggugugagccacugugcccagccucuuu

SEQ ID NO: 219952 - RNA, 32 nt, Human
uacaggugugagccacugugcccagcgugauu

SEQ ID NO: 219953 - RNA, 32 nt, Human
uacaggugugagccacugugcccagcucucau

SEQ ID NO: 219954 - RNA, 32 nt, Human
uacaggugugagccacugugcccggccaaaag

SEQ ID NO: 219955 - RNA, 32 nt, Human
uacaggugugagccacugugccuaccagcuuu

SEQ ID NO: 219956 - RNA, 32 nt, Human
uacaggugugagccacugugccuagccuauaa

SEQ ID NO: 219957 - RNA, 32 nt, Human
uacaggugugagccacugugccuggccuccgg

SEQ ID NO: 219958 - RNA, 32 nt, Human
uacaggugugagccacugugccuggccugauu

SEQ ID NO: 219959 - RNA, 32 nt, Human
uacaggugugagccacugugccuggccuucua

SEQ ID NO: 219960 - RNA, 32 nt, Human
uacaggugugagccacugugcguggccuccca

SEQ ID NO: 219961 - RNA, 32 nt, Human
uacaggugugagccacugugcucggccuaccu

SEQ ID NO: 219962 - RNA, 32 nt, Human
uacaggugugagccacuguggccgaccuacua

SEQ ID NO: 219963 - RNA, 32 nt, Human
uacaggugugagccacuguguccagccuguaa

SEQ ID NO: 219964 - RNA, 32 nt, Human
uacaggugugagccacugugucuagccaaguu

SEQ ID NO: 219965 - RNA, 32 nt, Human
uacaggugugagccacuucaccaggcccauuu

SEQ ID NO: 219966 - RNA, 32 nt, Human
uacaggugugagccaucacacucggccaaagc

SEQ ID NO: 219967 - RNA, 32 nt, Human
uacaggugugagccaucacgcucggccaagag

SEQ ID NO: 219968 - RNA, 32 nt, Human
uacaggugugagccaucgcgccuggccaggac

SEQ ID NO: 219969 - RNA, 32 nt, Human
uacaggugugagccauggcacccagcccuaga

SEQ ID NO: 219970 - RNA, 32 nt, Human
uacaggugugagccauugugccuggccaaguu

SEQ ID NO: 219971 - RNA, 32 nt, Human
uacaggugugagccgccaugcccggccgggcu

SEQ ID NO: 219972 - RNA, 32 nt, Human
uacaggugugagccgcugggcccagccugguu

SEQ ID NO: 219973 - RNA, 32 nt, Human
uacaggugugagccuccaugcccagccuaaau

SEQ ID NO: 219974 - RNA, 28 nt, Human
uacaggugugagcuaccaugcccagcca

SEQ ID NO: 219975 - RNA, 32 nt, Human
uacaggugugagcuacugcgcccagccccaga

SEQ ID NO: 219976 - RNA, 32 nt, Human
uacaggugugagcuacugugcccagccugcaa

SEQ ID NO: 219977 - RNA, 32 nt, Human
uacaggugugagcugccacgcccagccccagu

SEQ ID NO: 219978 - RNA, 32 nt, Human
uacaggugugaggcacggugcccagccaauau

SEQ ID NO: 219979 - RNA, 32 nt, Human
uacaggugugagucaccgugcccagccuggac

SEQ ID NO: 219980 - RNA, 19 nt, Human
uacaggugugcaccaccac

SEQ ID NO: 219981 - RNA, 20 nt, Human
uacaggugugcaccaccacg

SEQ ID NO: 219982 - RNA, 20 nt, Human
uacaggugugcaccaccaug

SEQ ID NO: 219983 - RNA, 23 nt, Human
uacaggugugcaccaccaugccc

SEQ ID NO: 219984 - RNA, 32 nt, Human
uacaggugugcaccaccaugcccagcuaguuu

SEQ ID NO: 219985 - RNA, 32 nt, Human
uacaggugugcaccaccaugccugguucauuu

SEQ ID NO: 219986 - RNA, 19 nt, Human
uacaggugugcaccacccg

SEQ ID NO: 219987 - RNA, 19 nt, Human
uacaggugugcacuaccac

SEQ ID NO: 219988 - RNA, 20 nt, Human
uacaggugugcacuaccacg

SEQ ID NO: 219989 - RNA, 32 nt, Human
uacaggugugcacuaccaugcccagcuaauuu

SEQ ID NO: 219990 - RNA, 32 nt, Human
uacaggugugcacuccucgccuggcuaauuuu

SEQ ID NO: 219991 - RNA, 18 nt, Human
uacaggugugccaccacg

SEQ ID NO: 219992 - RNA, 20 nt, Human
uacaggugugccccaccacg

SEQ ID NO: 219993 - RNA, 32 nt, Human
uacaggugugcgccaccaagcccagccaauug

SEQ ID NO: 219994 - RNA, 32 nt, Human
uacaggugugcgccaccaagcccagccaauuu

SEQ ID NO: 219995 - RNA, 20 nt, Human
uacaggugugcgccaccacg

SEQ ID NO: 219996 - RNA, 23 nt, Human
uacaggugugcgccaccaugccc

SEQ ID NO: 219997 - RNA, 32 nt, Human
uacaggugugcgccaccaugcccgacuaauuu

SEQ ID NO: 219998 - RNA, 32 nt, Human
uacaggugugcgccaccaugcccggccucagc

SEQ ID NO: 219999 - RNA, 32 nt, Human
uacaggugugcgccaccaugcccggcuaauuu

SEQ ID NO: 220000 - RNA, 32 nt, Human
uacaggugugcgccaccauguccggcuaauuu

SEQ ID NO: 220001 - RNA, 32 nt, Human
uacagguguggcugacucugagcccaggccug

SEQ ID NO: 220002 - RNA, 19 nt, Human
uacagguguguaccgccac

SEQ ID NO: 220003 - RNA, 23 nt, Human
uacaggugugugccaccacgccc

SEQ ID NO: 220004 - RNA, 31 nt, Human
uacaggugugugccaccauacuuggcuaauu

SEQ ID NO: 220005 - RNA, 32 nt, Human
uacaggugugugccaccaugcccagacgccca

SEQ ID NO: 220006 - RNA, 32 nt, Human
uacaggugugugccaccaugcccgucucauuu

SEQ ID NO: 220007 - RNA, 32 nt, Human
uacaggugugugccaccaugccuggcuaauuu

SEQ ID NO: 220008 - RNA, 32 nt, Human
uacaggugugugccaccaugcuuggcuaauuu

SEQ ID NO: 220009 - RNA, 32 nt, Human
uacaggugugugccacuacggcuggcuaauuu

SEQ ID NO: 220010 - RNA, 32 nt, Human
uacaggugugugccgcaaugcccagcuaauuu

SEQ ID NO: 220011 - RNA, 32 nt, Human
uacaggugugugccgccaugcccagucucuuu

SEQ ID NO: 220012 - RNA, 32 nt, Human
uacagguguguggcaccaugcccagcuaauuu

SEQ ID NO: 220013 - RNA, 23 nt, Human
uacaggugugugucaccacgccc

SEQ ID NO: 220014 - RNA, 32 nt, Human
uacagguuaccguugagaacaaucaucuaaau

SEQ ID NO: 220015 - RNA, 32 nt, Human
uacagguuagaaaauuccagagaguucauauu

SEQ ID NO: 220016 - RNA, 32 nt, Human
uacagguuagaaaauuccagaguucauauuaa

SEQ ID NO: 220017 - RNA, 22 nt, Human
uacagguucuuuucugguguca

SEQ ID NO: 220018 - RNA, 32 nt, Human
uacagguuuagaagagaaaagagcaacagauu

SEQ ID NO: 220019 - RNA, 32 nt, Human
uacagguuugagccaccgugccuggccuaagu

SEQ ID NO: 220020 - RNA, 32 nt, Human
uacagguuugagccacugcaccuagucuuuuu

SEQ ID NO: 220021 - RNA, 32 nt, Human
uacagguuugcaccaccaugcccggcuaauuu

SEQ ID NO: 220022 - RNA, 32 nt, Human
uacagguuugccaaaggaaaagccuggcucug

SEQ ID NO: 220023 - RNA, 32 nt, Human
uacaguaaagcaauuguugcaagaugaauggc

SEQ ID NO: 220024 - RNA, 32 nt, Human
uacaguaaucuacauaaauauaccucagaaau

SEQ ID NO: 220025 - RNA, 32 nt, Human
uacaguacaucauuccuccucacuaggagcac

SEQ ID NO: 220026 - RNA, 32 nt, Human
uacaguacuccuagggcuugacccugguaccc

SEQ ID NO: 220027 - RNA, 20 nt, Human
uacaguacugacaccaccac

SEQ ID NO: 220028 - RNA, 30 nt, Human
uacaguagccucuucaggcuuuguaauuuu

SEQ ID NO: 220029 - RNA, 32 nt, Human
uacaguagcucaugccuguaaucccagcacuu

SEQ ID NO: 220030 - RNA, 32 nt, Human
uacaguaggcccugagccgacugugaauucgg

SEQ ID NO: 220031 - RNA, 32 nt, Human
uacaguaguguagcgcccccucccucuuucgg

SEQ ID NO: 220032 - RNA, 21 nt, Human
uacaguauguucaguacacug

SEQ ID NO: 220033 - RNA, 32 nt, Human
uacaguauuguucugggaucugggcaaguugu

SEQ ID NO: 220034 - RNA, 32 nt, Human
uacagucaagaagaggaaagugugugaagacc

SEQ ID NO: 220035 - RNA, 32 nt, Human
uacagucaagauagaaagggugcugccacgga

SEQ ID NO: 220036 - RNA, 32 nt, Human
uacagucaauauguuggaggcaugcuaaggua

SEQ ID NO: 220037 - RNA, 32 nt, Human
uacagucaccucaguguucagaccauguuuau

SEQ ID NO: 220038 - RNA, 32 nt, Human
uacagucaccucauguugcagaccauguuuau

SEQ ID NO: 220039 - RNA, 32 nt, Human
uacagucaccuguggcagaggugugcagaggc

SEQ ID NO: 220040 - RNA, 32 nt, Human
uacagucagcccaggagguuacagugagcucu

SEQ ID NO: 220041 - RNA, 19 nt, Human
uacagucaggcaccaccac

SEQ ID NO: 220042 - RNA, 32 nt, Human
uacagucaggcaccaccacacccggcuaauuu

SEQ ID NO: 220043 - RNA, 32 nt, Human
uacagucaugagccaccacucccggccuuauu

SEQ ID NO: 220044 - RNA, 32 nt, Human
uacagucaugagccaccaugcccagccuacca

SEQ ID NO: 220045 - RNA, 32 nt, Human
uacagucaugagccaccaugcccagccuauuu

SEQ ID NO: 220046 - RNA, 32 nt, Human
uacagucaugagccaccgugcccagccuaauu

SEQ ID NO: 220047 - RNA, 32 nt, Human
uacagucaugagucaccaugccuggcccaagu

SEQ ID NO: 220048 - RNA, 32 nt, Human
uacaguccaucugcaagaggcaaguuuguguc

SEQ ID NO: 220049 - RNA, 20 nt, Human
uacagucgcccgccaccacg

SEQ ID NO: 220050 - RNA, 32 nt, Human
uacagucgcuagucaagugguuuuuaaaguaa

SEQ ID NO: 220051 - RNA, 32 nt, Human
uacagucgugagccacuguaccccgccuaaaa

SEQ ID NO: 220052 - RNA, 32 nt, Human
uacagucuccaccuccccgucuuccucugggu

SEQ ID NO: 220053 - RNA, 32 nt, Human
uacagucuggaaaauaaaguugagggaaucuc

SEQ ID NO: 220054 - RNA, 32 nt, Human
uacagucuguaugucugugucucccuagaauu

SEQ ID NO: 220055 - RNA, 32 nt, Human
uacagucuucauuuuagugcuuuacacauucg

SEQ ID NO: 220056 - RNA, 32 nt, Human
uacagucuuucuuucugaauuuugaguaucuu

SEQ ID NO: 220057 - RNA, 32 nt, Human
uacagugaaugagagaaaucugccuggaaauu

SEQ ID NO: 220058 - RNA, 32 nt, Human
uacagugacaucucucaguguuuccaacacag

SEQ ID NO: 220059 - RNA, 32 nt, Human
uacagugagaccaagaggaaaaauguguuucg

SEQ ID NO: 220060 - RNA, 21 nt, Human
uacagugagccaagaucacac

SEQ ID NO: 220061 - RNA, 21 nt, Human
uacagugagccaugaucacac

SEQ ID NO: 220062 - RNA, 21 nt, Human
uacagugagcuaugauuacac

SEQ ID NO: 220063 - RNA, 25 nt, Human
uacagugagcugagaucacacgcca

SEQ ID NO: 220064 - RNA, 21 nt, Human
uacagugagcuguggucacac

SEQ ID NO: 220065 - RNA, 32 nt, Human
uacagugaggacucggccacugugucucuguu

SEQ ID NO: 220066 - RNA, 32 nt, Human
uacagugaugacugcucacugcagccuccacc

SEQ ID NO: 220067 - RNA, 32 nt, Human
uacagugcaauggcaugaucacggcucacugc

SEQ ID NO: 220068 - RNA, 32 nt, Human
uacagugcaguggugugaucacagcucacugc

SEQ ID NO: 220069 - RNA, 32 nt, Human
uacagugcaguuucaguauguuucauguuagu

SEQ ID NO: 220070 - RNA, 32 nt, Human
uacagugccacugcaauccagccugggcaaca

SEQ ID NO: 220071 - RNA, 32 nt, Human
uacagugccccagggcagagacauguuccucu

SEQ ID NO: 220072 - RNA, 32 nt, Human
uacagugccugccaccaugcccagcuaauuuu

SEQ ID NO: 220073 - RNA, 32 nt, Human
uacagugcuuggauagcagcaucaaggagcau

SEQ ID NO: 220074 - RNA, 32 nt, Human
uacagugcuugguggguggugccugugccuga

SEQ ID NO: 220075 - RNA, 32 nt, Human
uacagugcuuuggauucuuccucccaggccua

SEQ ID NO: 220076 - RNA, 31 nt, Human
uacaguggcacaaucucagcucacugcggcc

SEQ ID NO: 220077 - RNA, 31 nt, Human
uacaguggcacaaucucggcucacugcaacc

SEQ ID NO: 220078 - RNA, 31 nt, Human
uacaguggcacgaucucagcucacugcaacc

SEQ ID NO: 220079 - RNA, 31 nt, Human
uacaguggcgcaaucucagcucgcugcaacc

SEQ ID NO: 220080 - RNA, 32 nt, Human
uacaguggcgcacaccuguaaucccagcuacu

SEQ ID NO: 220081 - RNA, 32 nt, Human
uacaguggcucacaccuguaaucccagcacuu

SEQ ID NO: 220082 - RNA, 32 nt, Human
uacaguggcucaccccuguaaucccagcacuu

SEQ ID NO: 220083 - RNA, 32 nt, Human
uacaguggcucaugccuguaaucccagcacuu

SEQ ID NO: 220084 - RNA, 32 nt, Human
uacaguggcugcaccaaauuggaggugugggu

SEQ ID NO: 220085 - RNA, 32 nt, Human
uacaguggggcugagcacccccaggccuucca

SEQ ID NO: 220086 - RNA, 32 nt, Human
uacaguggucacugcaaccuccaucucccugg

SEQ ID NO: 220087 - RNA, 31 nt, Human
uacaguggugcgaucucagcucacugcaacu

SEQ ID NO: 220088 - RNA, 32 nt, Human
uacagugguucaugccuguaaucccagaacuu

SEQ ID NO: 220089 - RNA, 32 nt, Human
uacagugguucaugccuguaaucccagcacuu

SEQ ID NO: 220090 - RNA, 32 nt, Human
uacaguguaaauuuuuccuccuuuaccuuugu

SEQ ID NO: 220091 - RNA, 32 nt, Human
uacaguguaugccuuuuccuucaugcagaauu

SEQ ID NO: 220092 - RNA, 32 nt, Human
uacagugucacaggugguggggaccaggggau

SEQ ID NO: 220093 - RNA, 32 nt, Human
uacagugucucacaccuguaaucccagcacuu

SEQ ID NO: 220094 - RNA, 32 nt, Human
uacaguguggaguguugagaccagacaccuuu

SEQ ID NO: 220095 - RNA, 32 nt, Human
uacagugugggugguggugcugggcuggacua

SEQ ID NO: 220096 - RNA, 32 nt, Human
uacaguguuaucugugaaugcacauauuaaau

SEQ ID NO: 220097 - RNA, 31 nt, Human
uacaguguuuuauuugguccugugucuuucg

SEQ ID NO: 220098 - RNA, 32 nt, Human
uacaguuaaagaaauugacuugguacuuaaaa

SEQ ID NO: 220099 - RNA, 31 nt, Human
uacaguuacagguagaauacuguaggaaguc

SEQ ID NO: 220100 - RNA, 21 nt, Human
uacaguuacaucuuaauucca

SEQ ID NO: 220101 - RNA, 32 nt, Human
uacaguuagcugucacucagcugacaccauga

SEQ ID NO: 220102 - RNA, 20 nt, Human
uacaguuaugcaccaccaug

SEQ ID NO: 220103 - RNA, 32 nt, Human
uacaguuauuucccccucccugccuuaaaacu

SEQ ID NO: 220104 - RNA, 32 nt, Human
uacaguucaaccugccuuaacacaacaguauc

SEQ ID NO: 220105 - RNA, 32 nt, Human
uacaguucagacuugaggggaggugacaagag

SEQ ID NO: 220106 - RNA, 32 nt, Human
uacaguucauccagauggagaagagaagccau

SEQ ID NO: 220107 - RNA, 32 nt, Human
uacaguucaugguauaaggucauuuagggugc

SEQ ID NO: 220108 - RNA, 32 nt, Human
uacaguuccucgcucagaacagcuucagcugu

SEQ ID NO: 220109 - RNA, 32 nt, Human
uacaguucucuucuaaaaagcauuucaccuuu

SEQ ID NO: 220110 - RNA, 32 nt, Human
uacaguucuggcagugggcggcugcaagccaa

SEQ ID NO: 220111 - RNA, 32 nt, Human
uacaguucuuagccucaggccuaggauuaagu

SEQ ID NO: 220112 - RNA, 32 nt, Human
uacaguugaauuccuagucuuccuucauccuu

SEQ ID NO: 220113 - RNA, 32 nt, Human
uacaguugccaaggaggaaaauacugaaugac

SEQ ID NO: 220114 - RNA, 20 nt, Human
uacaguugcccaccaccaug

SEQ ID NO: 220115 - RNA, 32 nt, Human
uacaguugcgagccaccgcgcccgaccuauuu

SEQ ID NO: 220116 - RNA, 32 nt, Human
uacaguugcucacgccuguaaucccagaacuu

SEQ ID NO: 220117 - RNA, 32 nt, Human
uacaguugcucacgccuguaaucccagaauuu

SEQ ID NO: 220118 - RNA, 32 nt, Human
uacaguugcuguugugugaucaagcaugucuc

SEQ ID NO: 220119 - RNA, 32 nt, Human
uacaguugcuuacaccuguaaucccagcacuu

SEQ ID NO: 220120 - RNA, 22 nt, Human
uacaguuguacuguuucuuuua

SEQ ID NO: 220121 - RNA, 25 nt, Human
uacaguugucuacagaucacaucca

SEQ ID NO: 220122 - RNA, 32 nt, Human
uacaguugugagccacugugccuggccuuuuu

SEQ ID NO: 220123 - RNA, 19 nt, Human
uacaguugugcaccaccac

SEQ ID NO: 220124 - RNA, 32 nt, Human
uacaguugugccaucuuccuccagcaccagga

SEQ ID NO: 220125 - RNA, 32 nt, Human
uacaguuucuagcauuaaacaaauaaacaagg

SEQ ID NO: 220126 - RNA, 32 nt, Human
uacaguuugcucugauguuggcauuuuaugaa

SEQ ID NO: 220127 - RNA, 32 nt, Human
uacaguuuucuccuucuucugauccagccaca

SEQ ID NO: 220128 - RNA, 32 nt, Human
uacauaaaaaggaaaagaaaguagacauuuua

SEQ ID NO: 220129 - RNA, 32 nt, Human
uacauaaaaugcaagaaaacagcauggccagu

SEQ ID NO: 220130 - RNA, 32 nt, Human
uacauaaaccucagacucucccccucucaaca

SEQ ID NO: 220131 - RNA, 31 nt, Human
uacauaaacuuuaaacuacauuuaaaacuag

SEQ ID NO: 220132 - RNA, 32 nt, Human
uacauaaaguaauuucacuaugauguuaccau

SEQ ID NO: 220133 - RNA, 32 nt, Human
uacauaacaaaccugcacauugugcacaugua

SEQ ID NO: 220134 - RNA, 32 nt, Human
uacauaacauuguguggaugaaaugcugcauc

SEQ ID NO: 220135 - RNA, 32 nt, Human
uacauaaccuggaagacugagaaggguauauu

SEQ ID NO: 220136 - RNA, 32 nt, Human
uacauaagcuaguuucuguucuguaaagugau

SEQ ID NO: 220137 - RNA, 32 nt, Human
uacauaaggaagagaagaaauugaguggcaua

SEQ ID NO: 220138 - RNA, 32 nt, Human
uacauaaggagagaagguacagugaugaagga

SEQ ID NO: 220139 - RNA, 24 nt, Human
uacauaagguacugaaguuagcca

SEQ ID NO: 220140 - RNA, 32 nt, Human
uacauaauugcagaagcacaagccauacaucg

SEQ ID NO: 220141 - RNA, 21 nt, Human
uacauacaaacaaugcaacca

SEQ ID NO: 220142 - RNA, 32 nt, Human
uacauacaaaccugugugccaagugacagcua

SEQ ID NO: 220143 - RNA, 32 nt, Human
uacauacaaauguacacagucauauaugacua

SEQ ID NO: 220144 - RNA, 32 nt, Human
uacauacaauuuaaaaaguacagguaguacug

SEQ ID NO: 220145 - RNA, 22 nt, Human
uacauacacagcaagggugaga

SEQ ID NO: 220146 - RNA, 32 nt, Human
uacauacacauacauacauacauacauauaua

SEQ ID NO: 220147 - RNA, 32 nt, Human
uacauacacaugcgugcacacuguuaugacac

SEQ ID NO: 220148 - RNA, 32 nt, Human
uacauacacguauuaacaaaacaaaugcaaag

SEQ ID NO: 220149 - RNA, 32 nt, Human
uacauacagcacaauguuauuaccuauaaucc

SEQ ID NO: 220150 - RNA, 32 nt, Human
uacauacauacacacauacauacauaugcaca

SEQ ID NO: 220151 - RNA, 32 nt, Human
uacauacauaugcacacacacguacacgcaga

SEQ ID NO: 220152 - RNA, 32 nt, Human
uacauaccuggggcaggggcuuggggaggugg

SEQ ID NO: 220153 - RNA, 32 nt, Human
uacauacgugcacacacacauacauauucaua

SEQ ID NO: 220154 - RNA, 32 nt, Human
uacauacugcugucuauguggcuguaucuugu

SEQ ID NO: 220155 - RNA, 32 nt, Human
uacauacuucauuucuuuccuccucucuugcu

SEQ ID NO: 220156 - RNA, 32 nt, Human
uacauagcacauccagggcugagcaagaaaua

SEQ ID NO: 220157 - RNA, 32 nt, Human
uacauagcaucagugaauaguaaugaguggua

SEQ ID NO: 220158 - RNA, 32 nt, Human
uacauagcauugaagaauauauuucacugugc

SEQ ID NO: 220159 - RNA, 32 nt, Human
uacauagcugcaagcaaaccauuuuuccccuu

SEQ ID NO: 220160 - RNA, 32 nt, Human
uacauaggcaaacuguugggagcugcucuagu

SEQ ID NO: 220161 - RNA, 32 nt, Human
uacauagggaagggaggaagggaaaacagaaa

SEQ ID NO: 220162 - RNA, 32 nt, Human
uacauagguauuucauugcggaucaggaaaga

SEQ ID NO: 220163 - RNA, 32 nt, Human
uacauagguuacgucagccuacuguggcuguu

SEQ ID NO: 220164 - RNA, 32 nt, Human
uacauaguagcauguaucaacacuucauuuuu

SEQ ID NO: 220165 - RNA, 32 nt, Human
uacauaguauguuacugauaaaggaaugacua

SEQ ID NO: 220166 - RNA, 32 nt, Human
uacauagucaucugagcuaaacguucuguauu

SEQ ID NO: 220167 - RNA, 23 nt, Human
uacauagugacauuccaguucca

SEQ ID NO: 220168 - RNA, 32 nt, Human
uacauaguuuguauaacaaaggauuuauuuau

SEQ ID NO: 220169 - RNA, 32 nt, Human
uacauauaauuguuuuugugguuguuuuguuu

SEQ ID NO: 220170 - RNA, 32 nt, Human
uacauauacauguacacauacacauaaauauu

SEQ ID NO: 220171 - RNA, 32 nt, Human
uacauauagcuuugcaaccuuguacuuuacaa

SEQ ID NO: 220172 - RNA, 32 nt, Human
uacauauauaaauauauaaauacaaacacaca

SEQ ID NO: 220173 - RNA, 32 nt, Human
uacauauaugaagcuuuuaaaaagcacaaguu

SEQ ID NO: 220174 - RNA, 21 nt, Human
uacauaugauaggcagcacug

SEQ ID NO: 220175 - RNA, 32 nt, Human
uacauaugcacgcacacacacaugcacacaua

SEQ ID NO: 220176 - RNA, 32 nt, Human
uacauaugcugcuuucuuuccuggugaaaauu

SEQ ID NO: 220177 - RNA, 32 nt, Human
uacauauguauacacacacauaauuugaaaac

SEQ ID NO: 220178 - RNA, 19 nt, Human
uacauauguaucuagacug

SEQ ID NO: 220179 - RNA, 32 nt, Human
uacauauguauguauauacguauguauacaua

SEQ ID NO: 220180 - RNA, 19 nt, Human
uacauauguauuauacacu

SEQ ID NO: 220181 - RNA, 32 nt, Human
uacauauguggacauaaacagggaucaaauaa

SEQ ID NO: 220182 - RNA, 22 nt, Human
uacauauguguaacuuacacug

SEQ ID NO: 220183 - RNA, 32 nt, Human
uacauauguguguguggguauguguuuauuuc

SEQ ID NO: 220184 - RNA, 32 nt, Human
uacauauguuuguguguauauguaaauauauu

SEQ ID NO: 220185 - RNA, 32 nt, Human
uacauauuagguuggugcaaaauaauuguggu

SEQ ID NO: 220186 - RNA, 32 nt, Human
uacauauucguuuucaauacuugcuguucaug

SEQ ID NO: 220187 - RNA, 32 nt, Human
uacauauuuuguuucaaaauguuugaaacaaa

SEQ ID NO: 220188 - RNA, 32 nt, Human
uacaucaacuauuuucagcccaaaaaggugcc

SEQ ID NO: 220189 - RNA, 32 nt, Human
uacaucaagacaccggugaggggcgaggaacc

SEQ ID NO: 220190 - RNA, 32 nt, Human
uacaucaaucuagagaaagagaaggacgaccc

SEQ ID NO: 220191 - RNA, 32 nt, Human
uacaucaccagccugggcgacagagugagacu

SEQ ID NO: 220192 - RNA, 32 nt, Human
uacaucacucaaccugaacacaggggaggcag

SEQ ID NO: 220193 - RNA, 32 nt, Human
uacaucacucuaaccugaacagcucacaaugu

SEQ ID NO: 220194 - RNA, 32 nt, Human
uacaucagagagagcgugaucccccuacagcu

SEQ ID NO: 220195 - RNA, 32 nt, Human
uacaucagcuguccuaagaagcaguugucaca

SEQ ID NO: 220196 - RNA, 32 nt, Human
uacaucauacagggaagagagaagggaggagg

SEQ ID NO: 220197 - RNA, 32 nt, Human
uacaucauauuccuuaccucuuuugggaaaua

SEQ ID NO: 220198 - RNA, 32 nt, Human
uacaucaugccgcgcuguuguaauacuguaua

SEQ ID NO: 220199 - RNA, 32 nt, Human
uacaucauggugcuggccuggggcuucuauua

SEQ ID NO: 220200 - RNA, 32 nt, Human
uacaucauucacagacuuugguguuuuaagug

SEQ ID NO: 220201 - RNA, 32 nt, Human
uacauccagccuguggcuuugcccaccaggac

SEQ ID NO: 220202 - RNA, 32 nt, Human
uacauccagcugacucagcugaagaugaaucg

SEQ ID NO: 220203 - RNA, 32 nt, Human
uacauccagcuucuggggucagccagggcaau

SEQ ID NO: 220204 - RNA, 32 nt, Human
uacauccauaucuguauuuauaucuuauuugu

SEQ ID NO: 220205 - RNA, 32 nt, Human
uacaucccacaccccacccucccuucccuuca

SEQ ID NO: 220206 - RNA, 32 nt, Human
uacaucccacagaacuggugacuaugaaacac

SEQ ID NO: 220207 - RNA, 32 nt, Human
uacaucccagccugugguuacagugcagacag

SEQ ID NO: 220208 - RNA, 32 nt, Human
uacaucccugaaacugagcacauuucugacca

SEQ ID NO: 220209 - RNA, 32 nt, Human
uacaucccugugcaaaugccauaaucccagcu

SEQ ID NO: 220210 - RNA, 32 nt, Human
uacaucccuuucucccuucccuccucuugcuc

SEQ ID NO: 220211 - RNA, 32 nt, Human
uacauccuacugcuuuggccucccucuccucu

SEQ ID NO: 220212 - RNA, 20 nt, Human
uacauccuauuguuucuuuc

SEQ ID NO: 220213 - RNA, 32 nt, Human
uacauccucugccaucagcacaggugcccaga

SEQ ID NO: 220214 - RNA, 32 nt, Human
uacauccugccucccauccacaugguccaauc

SEQ ID NO: 220215 - RNA, 32 nt, Human
uacauccuggguaaugagagguggcuuuugcg

SEQ ID NO: 220216 - RNA, 32 nt, Human
uacaucgucuucgucuuccuccugggcgccau

SEQ ID NO: 220217 - RNA, 32 nt, Human
uacaucuagcauucugccuacaguucagacag

SEQ ID NO: 220218 - RNA, 32 nt, Human
uacaucuaggguacccucccaugucaugaagu

SEQ ID NO: 220219 - RNA, 32 nt, Human
uacaucuccaggaagaugggcugccagcaacu

SEQ ID NO: 220220 - RNA, 32 nt, Human
uacaucuccauuagggcugaaaagaaugaccu

SEQ ID NO: 220221 - RNA, 32 nt, Human
uacaucuccuggaagggaugcuuuuuagcuga

SEQ ID NO: 220222 - RNA, 32 nt, Human
uacaucucggcacucuagcugcagccgggaga

SEQ ID NO: 220223 - RNA, 32 nt, Human
uacaucucuccaccucuugcacuguugucuug

SEQ ID NO: 220224 - RNA, 32 nt, Human
uacaucugaacuccuccugggcucagaagugg

SEQ ID NO: 220225 - RNA, 25 nt, Human
uacaucugaagucucuucucuuuua

SEQ ID NO: 220226 - RNA, 26 nt, Human
uacaucugacaauacugccucuuuua

SEQ ID NO: 220227 - RNA, 32 nt, Human
uacaucugaugaacuaugguaacugaagaaca

SEQ ID NO: 220228 - RNA, 32 nt, Human
uacaucuggcaaaagccaaagguuuggaagau

SEQ ID NO: 220229 - RNA, 32 nt, Human
uacaucugguuuccaccuuauuuuccugcccc

SEQ ID NO: 220230 - RNA, 32 nt, Human
uacaucugucagugagucagaggcagaaccua

SEQ ID NO: 220231 - RNA, 22 nt, Human
uacaucugucauuuucauuuca

SEQ ID NO: 220232 - RNA, 22 nt, Human
uacaucugugaaguuucuguca

SEQ ID NO: 220233 - RNA, 32 nt, Human
uacaucugugcuuuguaaguaccacuucaaaa

SEQ ID NO: 220234 - RNA, 32 nt, Human
uacaucuuacucaccugccaaggcuugguggc

SEQ ID NO: 220235 - RNA, 32 nt, Human
uacaucuucucccagauucucuggccuuuuua

SEQ ID NO: 220236 - RNA, 32 nt, Human
uacaucuuucagcaguagugcagaaccgacgu

SEQ ID NO: 220237 - RNA, 32 nt, Human
uacaugaaacacuuugggggucaugggagugc

SEQ ID NO: 220238 - RNA, 32 nt, Human
uacaugaaagaaaagaaggcagcagugaaaga

SEQ ID NO: 220239 - RNA, 32 nt, Human
uacaugaauacacacacauauucacuaaacug

SEQ ID NO: 220240 - RNA, 32 nt, Human
uacaugaauguugcaugugugcaugggagcaa

SEQ ID NO: 220241 - RNA, 28 nt, Human
uacaugaccaaagaguuugagagugaag

SEQ ID NO: 220242 - RNA, 32 nt, Human
uacaugacuuauaaauucauagauuauuaguu

SEQ ID NO: 220243 - RNA, 32 nt, Human
uacaugagaacagacuggccugaggagcagca

SEQ ID NO: 220244 - RNA, 32 nt, Human
uacaugagcagagagaaacauuauaauguagu

SEQ ID NO: 220245 - RNA, 32 nt, Human
uacaugaucuggagcaacagcuaggaaauauc

SEQ ID NO: 220246 - RNA, 32 nt, Human
uacaugauuucucacuuucauguaagguuauc

SEQ ID NO: 220247 - RNA, 32 nt, Human
uacaugcaaaaauagaaaauuauuuguuaaau

SEQ ID NO: 220248 - RNA, 32 nt, Human
uacaugcaaggcauggagcuguuugaggaagc

SEQ ID NO: 220249 - RNA, 32 nt, Human
uacaugcacacugauacauacauguacugaua

SEQ ID NO: 220250 - RNA, 32 nt, Human
uacaugcacgaagucccucugcccuacucccu

SEQ ID NO: 220251 - RNA, 32 nt, Human
uacaugcacgugcacacacauacacacacauc

SEQ ID NO: 220252 - RNA, 32 nt, Human
uacaugcagaacuugaugcguggcauuagagc

SEQ ID NO: 220253 - RNA, 32 nt, Human
uacaugcagacucaccucacacccuuacaacu

SEQ ID NO: 220254 - RNA, 32 nt, Human
uacaugcagcuacucgggaggcugaggcagga

SEQ ID NO: 220255 - RNA, 32 nt, Human
uacaugcagguugugagcuggaaaagaaaguu

SEQ ID NO: 220256 - RNA, 31 nt, Human
uacaugcaucuuuucugcagcaggcccagau

SEQ ID NO: 220257 - RNA, 32 nt, Human
uacaugcaugagccacgcgcccagccuagacu

SEQ ID NO: 220258 - RNA, 32 nt, Human
uacaugcaugagccacugugcugggcuucauu

SEQ ID NO: 220259 - RNA, 32 nt, Human
uacaugcaugcacaugaaaacaugcacaacca

SEQ ID NO: 220260 - RNA, 32 nt, Human
uacaugcaugcauuguauuaguguuagaaaac

SEQ ID NO: 220261 - RNA, 32 nt, Human
uacaugccagaggcugaugcugcacuguugau

SEQ ID NO: 220262 - RNA, 32 nt, Human
uacaugcccagccugcagugcuuccuuauggc

SEQ ID NO: 220263 - RNA, 32 nt, Human
uacaugcccagccuggggcccugagaucugac

SEQ ID NO: 220264 - RNA, 28 nt, Human
uacaugcccccagagccgagacagggau

SEQ ID NO: 220265 - RNA, 32 nt, Human
uacaugccuguaaucccagcuacuugggaggc

SEQ ID NO: 220266 - RNA, 32 nt, Human
uacaugccuguaauccuggcuacuugggaggc

SEQ ID NO: 220267 - RNA, 32 nt, Human
uacaugccuucuauauggaacauggcagaaag

SEQ ID NO: 220268 - RNA, 20 nt, Human
uacaugcgcacaccaccacg

SEQ ID NO: 220269 - RNA, 32 nt, Human
uacaugcgggugagcaagucugccuuuucccu

SEQ ID NO: 220270 - RNA, 32 nt, Human
uacaugcgugagccacugcgcccugccuguuu

SEQ ID NO: 220271 - RNA, 32 nt, Human
uacaugcugcaucuuucagccuggagacugug

SEQ ID NO: 220272 - RNA, 32 nt, Human
uacaugcugcauucugaaaguuuuaugucauc

SEQ ID NO: 220273 - RNA, 32 nt, Human
uacaugcugguaauuaugccagacaguaauaa

SEQ ID NO: 220274 - RNA, 32 nt, Human
uacauggaagcaagaaagacacugccuccucu

SEQ ID NO: 220275 - RNA, 32 nt, Human
uacauggacucagagaaaagagauugagaugu

SEQ ID NO: 220276 - RNA, 32 nt, Human
uacauggaguguguucauggucgcccauuuuu

SEQ ID NO: 220277 - RNA, 32 nt, Human
uacauggccuguaauucuuuggaccauuguaa

SEQ ID NO: 220278 - RNA, 32 nt, Human
uacaugggaagcggaggugggagaauuucuug

SEQ ID NO: 220279 - RNA, 32 nt, Human
uacaugggaggcugaggcaggagaagggcgug

SEQ ID NO: 220280 - RNA, 32 nt, Human
uacaugggaggcugaggcaggagaaucgcuug

SEQ ID NO: 220281 - RNA, 32 nt, Human
uacaugggcuuauacagggagagagucuucaa

SEQ ID NO: 220282 - RNA, 32 nt, Human
uacauggggaaagagcauguggggugggaagg

SEQ ID NO: 220283 - RNA, 32 nt, Human
uacauggggagcaucagucacacccuggguca

SEQ ID NO: 220284 - RNA, 31 nt, Human
uacaugggugagagagguuaagcugauggga

SEQ ID NO: 220285 - RNA, 32 nt, Human
uacaugguagaucaacaauucuuuuugggggu

SEQ ID NO: 220286 - RNA, 32 nt, Human
uacauggucacaguauauuuugcugcaagaaa

SEQ ID NO: 220287 - RNA, 32 nt, Human
uacauggugacuccaguacggggacauuuauc

SEQ ID NO: 220288 - RNA, 28 nt, Human
uacauggugcagccccaggggugcagcg

SEQ ID NO: 220289 - RNA, 32 nt, Human
uacauggugcagcugcuacaaggccuggacua

SEQ ID NO: 220290 - RNA, 32 nt, Human
uacauggugcuacugcucuuggaguggacaug

SEQ ID NO: 220291 - RNA, 32 nt, Human
uacauggugcuggaguacugcagccgccaguc

SEQ ID NO: 220292 - RNA, 32 nt, Human
uacaugguuuucuuuuucuuaguaugggagug

SEQ ID NO: 220293 - RNA, 32 nt, Human
uacauguaacccacagugguaccaugagaugu

SEQ ID NO: 220294 - RNA, 32 nt, Human
uacauguaccagaaucucacauggaccccaua

SEQ ID NO: 220295 - RNA, 32 nt, Human
uacauguagcaaaugugggaaagacuacagac

SEQ ID NO: 220296 - RNA, 32 nt, Human
uacauguagcaaaugugggaaagacuauaggc

SEQ ID NO: 220297 - RNA, 32 nt, Human
uacauguagcuggcuugaguuuguaccaaaac

SEQ ID NO: 220298 - RNA, 32 nt, Human
uacauguagcuucagacugcagagacaggacg

SEQ ID NO: 220299 - RNA, 32 nt, Human
uacauguauaugcacaugaaugcauauauaaa

SEQ ID NO: 220300 - RNA, 32 nt, Human
uacauguaucaaaacaucacacuguaccacau

SEQ ID NO: 220301 - RNA, 32 nt, Human
uacauguauuguguuuuccauggugcuacagu

SEQ ID NO: 220302 - RNA, 32 nt, Human
uacaugucauggagugcauugaguaggccggc

SEQ ID NO: 220303 - RNA, 32 nt, Human
uacaugucuagaaacaauaggaaauguucacu

SEQ ID NO: 220304 - RNA, 32 nt, Human
uacaugucuagggucuagacauguucagcuuu

SEQ ID NO: 220305 - RNA, 32 nt, Human
uacaugugaacaaacagaaggaaguucacucu

SEQ ID NO: 220306 - RNA, 32 nt, Human
uacaugugagccaccgugccuggccuugaguu

SEQ ID NO: 220307 - RNA, 32 nt, Human
uacaugugagccccugccagggccaaguccuu

SEQ ID NO: 220308 - RNA, 23 nt, Human
uacaugugcagaacaugcagguu

SEQ ID NO: 220309 - RNA, 23 nt, Human
uacaugugcaggaccugcagguu

SEQ ID NO: 220310 - RNA, 23 nt, Human
uacaugugcaggaugugcagguu

SEQ ID NO: 220311 - RNA, 32 nt, Human
uacaugugcucggggcugggcgcgguggcuca

SEQ ID NO: 220312 - RNA, 32 nt, Human
uacaugugggccagccugccucacuuuaccca

SEQ ID NO: 220313 - RNA, 32 nt, Human
uacauguggucacaguuuuggaagagaagauc

SEQ ID NO: 220314 - RNA, 32 nt, Human
uacauguguacagaugagaaacugcaacaaaa

SEQ ID NO: 220315 - RNA, 32 nt, Human
uacauguguagccuauguugugguccaucagc

SEQ ID NO: 220316 - RNA, 32 nt, Human
uacaugugugagccaccgccccuggccucugu

SEQ ID NO: 220317 - RNA, 32 nt, Human
uacaugugugcuuucagagcaguagugugagg

SEQ ID NO: 220318 - RNA, 32 nt, Human
uacaugugugugcacacaugguacguguccau

SEQ ID NO: 220319 - RNA, 32 nt, Human
uacaugugugugugagcacaugugugcaugug

SEQ ID NO: 220320 - RNA, 32 nt, Human
uacauguguuuauuuacauguccuaguuugau

SEQ ID NO: 220321 - RNA, 31 nt, Human
uacauguucaauaaaaguuguugaaagauua

SEQ ID NO: 220322 - RNA, 21 nt, Human
uacauguugaaaaaugugcuu

SEQ ID NO: 220323 - RNA, 32 nt, Human
uacauguugccucaccagcccugaggcuccgc

SEQ ID NO: 220324 - RNA, 32 nt, Human
uacauguugccucaccagcccugggcuccgcc

SEQ ID NO: 220325 - RNA, 32 nt, Human
uacauguuugucucccugccagcugcccuaug

SEQ ID NO: 220326 - RNA, 32 nt, Human
uacauguuuuccuaacuuuuuguauuuuucuu

SEQ ID NO: 220327 - RNA, 18 nt, Human
uacauuaaaaagauucaa

SEQ ID NO: 220328 - RNA, 32 nt, Human
uacauuaacuaaaucaauacaaguuuggggug

SEQ ID NO: 220329 - RNA, 32 nt, Human
uacauuaacucauguaaugucuuaaaucuuac

SEQ ID NO: 220330 - RNA, 32 nt, Human
uacauuaacucauguaaugucuucaaucuuac

SEQ ID NO: 220331 - RNA, 32 nt, Human
uacauuaauuaauuaaccacuagacaagcaga

SEQ ID NO: 220332 - RNA, 32 nt, Human
uacauuaauugcugucaaagaugaagaagaag

SEQ ID NO: 220333 - RNA, 32 nt, Human
uacauuacaaaucucugaggccauuaggggaa

SEQ ID NO: 220334 - RNA, 32 nt, Human
uacauuaccaugcugugccucaguuuacccau

SEQ ID NO: 220335 - RNA, 32 nt, Human
uacauuaccuuaacuggaguucaucaaguucc

SEQ ID NO: 220336 - RNA, 32 nt, Human
uacauuaggaggugaggccuugggaggugaua

SEQ ID NO: 220337 - RNA, 32 nt, Human
uacauuaguaucccacuagcccaggggagcag

SEQ ID NO: 220338 - RNA, 32 nt, Human
uacauuaguguugaugggccagaugguuuuga

SEQ ID NO: 220339 - RNA, 32 nt, Human
uacauuauaggguggguauagaugcauagaua

SEQ ID NO: 220340 - RNA, 24 nt, Human
uacauuaucagccagcccagccuu

SEQ ID NO: 220341 - RNA, 32 nt, Human
uacauuauuccacauccacagaacacuggccu

SEQ ID NO: 220342 - RNA, 32 nt, Human
uacauuauuuuagaaucauuuacuauuuaaau

SEQ ID NO: 220343 - RNA, 32 nt, Human
uacauuauuuuugucacuuugccaucauuguu

SEQ ID NO: 220344 - RNA, 32 nt, Human
uacauucacaaaccacagcuagaauuccucca

SEQ ID NO: 220345 - RNA, 32 nt, Human
uacauucacaugcuucucaccuaaguccccag

SEQ ID NO: 220346 - RNA, 32 nt, Human
uacauucaccuggucuggucucuguaagcuua

SEQ ID NO: 220347 - RNA, 32 nt, Human
uacauucagaacuuuuauuuuaaaacaaccac

SEQ ID NO: 220348 - RNA, 32 nt, Human
uacauucagcacagcugugguguccccaagug

SEQ ID NO: 220349 - RNA, 32 nt, Human
uacauucaguuucucacauuuuaugcuuucau

SEQ ID NO: 220350 - RNA, 18 nt, Human
uacauucauagugaacuc

SEQ ID NO: 220351 - RNA, 32 nt, Human
uacauucaucucucaggaggugggcugaccac

SEQ ID NO: 220352 - RNA, 32 nt, Human
uacauucaucucuguauucucucagcuguugu

SEQ ID NO: 220353 - RNA, 32 nt, Human
uacauucaugccauugugcaaccuucaccacc

SEQ ID NO: 220354 - RNA, 32 nt, Human
uacauuccacagucuuuaccguuuuauguuca

SEQ ID NO: 220355 - RNA, 32 nt, Human
uacauucccaagggaaaggagcuuuggccgca

SEQ ID NO: 220356 - RNA, 32 nt, Human
uacauucgugauuuuguuuucucccaagucag

SEQ ID NO: 220357 - RNA, 24 nt, Human
uacauucgugugugucugcuuuua

SEQ ID NO: 220358 - RNA, 32 nt, Human
uacauucguuauuuuaaaugaacaaguuuaca

SEQ ID NO: 220359 - RNA, 32 nt, Human
uacauucuagagaauugugagacuuugcccua

SEQ ID NO: 220360 - RNA, 32 nt, Human
uacauucuauguguaguuugcuuucuucauuu

SEQ ID NO: 220361 - RNA, 32 nt, Human
uacauucucaggcuggggaggaagcacauggc

SEQ ID NO: 220362 - RNA, 22 nt, Human
uacauucucuccugucuuuuca

SEQ ID NO: 220363 - RNA, 32 nt, Human
uacauucucuucuguggucucuccccuggcuu

SEQ ID NO: 220364 - RNA, 32 nt, Human
uacauucugaaaugcuggcaccaggagacggc

SEQ ID NO: 220365 - RNA, 32 nt, Human
uacauucuuacgauucuuuaacuuuucacugu

SEQ ID NO: 220366 - RNA, 32 nt, Human
uacauucuucauguggauguggccagugucag

SEQ ID NO: 220367 - RNA, 32 nt, Human
uacauucuuccagauggaaucaauaacuuuuu

SEQ ID NO: 220368 - RNA, 32 nt, Human
uacauucuuccagauucauauuacuuuucaaa

SEQ ID NO: 220369 - RNA, 32 nt, Human
uacauucuucuuaaaguccacaacagcagauu

SEQ ID NO: 220370 - RNA, 31 nt, Human
uacauucuugucauuuugccuguguuuagac

SEQ ID NO: 220371 - RNA, 32 nt, Human
uacauugauggccaucacaaugcagcuuuggu

SEQ ID NO: 220372 - RNA, 32 nt, Human
uacauugcauuuccucccuagcugcacggggc

SEQ ID NO: 220373 - RNA, 32 nt, Human
uacauugcccuuccucucccauaagauggaca

SEQ ID NO: 220374 - RNA, 32 nt, Human
uacauugcuagcgagauagggggaagacagau

SEQ ID NO: 220375 - RNA, 32 nt, Human
uacauuggaauugugccuuuucuaccacacug

SEQ ID NO: 220376 - RNA, 24 nt, Human
uacauuggagcaaggugugagaga

SEQ ID NO: 220377 - RNA, 32 nt, Human
uacauuggaugggggaacuggcucaccuucuu

SEQ ID NO: 220378 - RNA, 32 nt, Human
uacauuggggcacacaggaaaucccagugucu

SEQ ID NO: 220379 - RNA, 32 nt, Human
uacauuggguacaguguacacugcuccaguga

SEQ ID NO: 220380 - RNA, 32 nt, Human
uacauuggugucagaggaccuugacuggguuc

SEQ ID NO: 220381 - RNA, 32 nt, Human
uacauugguuugggggaagaaaaguaguucug

SEQ ID NO: 220382 - RNA, 32 nt, Human
uacauuguccauacccggacaugugaggcucu

SEQ ID NO: 220383 - RNA, 32 nt, Human
uacauugugggauguucagcacugucccuugc

SEQ ID NO: 220384 - RNA, 32 nt, Human
uacauuuaaagcuuggucggugaccuuugcau

SEQ ID NO: 220385 - RNA, 32 nt, Human
uacauuuaaauacuacuuuauuuuauaaggua

SEQ ID NO: 220386 - RNA, 32 nt, Human
uacauuuagcuucagguugucuuguuucugua

SEQ ID NO: 220387 - RNA, 32 nt, Human
uacauuuaguuaacacacauauaucugauggc

SEQ ID NO: 220388 - RNA, 32 nt, Human
uacauuuaucuaaaugugaauuggugugccac

SEQ ID NO: 220389 - RNA, 32 nt, Human
uacauuucacacauucuuuugcaaguuuuagg

SEQ ID NO: 220390 - RNA, 32 nt, Human
uacauuucagucauucgguauguggccuugua

SEQ ID NO: 220391 - RNA, 32 nt, Human
uacauuucagugcuuuuucccuaagcuguuug

SEQ ID NO: 220392 - RNA, 32 nt, Human
uacauuucauuucaucagcuuuaaucucuagu

SEQ ID NO: 220393 - RNA, 32 nt, Human
uacauuuccucuuuuugccuuuaucuccccaa

SEQ ID NO: 220394 - RNA, 32 nt, Human
uacauuuccugccuuuuucuuucaguguuuuu

SEQ ID NO: 220395 - RNA, 32 nt, Human
uacauuucucuagcucagccucacaggccaaa

SEQ ID NO: 220396 - RNA, 32 nt, Human
uacauuucuuuauagccucuucugaucucuaa

SEQ ID NO: 220397 - RNA, 32 nt, Human
uacauuugaaaccuuaaggcuaaacaaaaaua

SEQ ID NO: 220398 - RNA, 32 nt, Human
uacauuugagauuaaguugcagacauguugac

SEQ ID NO: 220399 - RNA, 32 nt, Human
uacauuugccuuggguggagcugggggugguc

SEQ ID NO: 220400 - RNA, 32 nt, Human
uacauuuggaaauguggucaucaaagaugacu

SEQ ID NO: 220401 - RNA, 32 nt, Human
uacauuuguaagaaauaacacugugaauguaa

SEQ ID NO: 220402 - RNA, 32 nt, Human
uacauuuguagugcaaaucacuuugucaaaca

SEQ ID NO: 220403 - RNA, 21 nt, Human
uacauuugucaccucucuuuc

SEQ ID NO: 220404 - RNA, 32 nt, Human
uacauuuucuacaguagcaaccacagugcaca

SEQ ID NO: 220405 - RNA, 19 nt, Human
uacauuuucugguacucug

SEQ ID NO: 220406 - RNA, 32 nt, Human
uacauuuuuaaugggagcaccuuuuaucccaa

SEQ ID NO: 220407 - RNA, 18 nt, Human
uacauuuuuaucaacaua

SEQ ID NO: 220408 - RNA, 32 nt, Human
uaccaaaaacuagacauuauuuuguauggaau

SEQ ID NO: 220409 - RNA, 32 nt, Human
uaccaaaacagcaauuugaaacuagaacuagu

SEQ ID NO: 220410 - RNA, 32 nt, Human
uaccaaaauaggagaaagugacagacagccaa

SEQ ID NO: 220411 - RNA, 32 nt, Human
uaccaaagaagcaggggaaucauuggccagug

SEQ ID NO: 220412 - RNA, 32 nt, Human
uaccaaagaaugcagaugugcuguuuuccuca

SEQ ID NO: 220413 - RNA, 32 nt, Human
uaccaaagcagcguucagggauccucucaguc

SEQ ID NO: 220414 - RNA, 32 nt, Human
uaccaaaggaaaaggcaaugggaguaaauaga

SEQ ID NO: 220415 - RNA, 32 nt, Human
uaccaaauagcugugggcuuucuggaacugcu

SEQ ID NO: 220416 - RNA, 32 nt, Human
uaccaaauguagcuuuacguugccaaaggaag

SEQ ID NO: 220417 - RNA, 32 nt, Human
uaccaacacauuuaugcugaagguuuccagag

SEQ ID NO: 220418 - RNA, 32 nt, Human
uaccaacacugaacauucaucagggaacuuuc

SEQ ID NO: 220419 - RNA, 32 nt, Human
uaccaacacuucagcagcuaggucagcaggug

SEQ ID NO: 220420 - RNA, 32 nt, Human
uaccaacauggagaaaccccaucucuacuaaa

SEQ ID NO: 220421 - RNA, 32 nt, Human
uaccaaccaaccagugcugaagagauuuuaga

SEQ ID NO: 220422 - RNA, 19 nt, Human
uaccaaccacagccuggca

SEQ ID NO: 220423 - RNA, 32 nt, Human
uaccaaccaucuuuauccuugucugcagggau

SEQ ID NO: 220424 - RNA, 19 nt, Human
uaccaaccccccacugcca

SEQ ID NO: 220425 - RNA, 32 nt, Human
uaccaacugucugaccccgaggagcucuguaa

SEQ ID NO: 220426 - RNA, 32 nt, Human
uaccaagaaagccaaggaagagcagccugacu

SEQ ID NO: 220427 - RNA, 32 nt, Human
uaccaagaacuagcaguggcccuggauucaag

SEQ ID NO: 220428 - RNA, 32 nt, Human
uaccaagacaauaccugcuacaguauuuuggg

SEQ ID NO: 220429 - RNA, 32 nt, Human
uaccaagacaccauggcucagacaugggauca

SEQ ID NO: 220430 - RNA, 32 nt, Human
uaccaagagacuguuuaccucccagaauguuu

SEQ ID NO: 220431 - RNA, 32 nt, Human
uaccaagagcauucaccuugccaucugucuug

SEQ ID NO: 220432 - RNA, 32 nt, Human
uaccaagagccuggccagugcugcugucucag

SEQ ID NO: 220433 - RNA, 32 nt, Human
uaccaagaucacaggugcacucuacacauaac

SEQ ID NO: 220434 - RNA, 32 nt, Human
uaccaagcacagaccccaguucaguugucucu

SEQ ID NO: 220435 - RNA, 32 nt, Human
uaccaagccacuuuucuugugaaaugucccau

SEQ ID NO: 220436 - RNA, 32 nt, Human
uaccaagccauggcagaggcccgcacaucccu

SEQ ID NO: 220437 - RNA, 32 nt, Human
uaccaagcucucugugcuuuggaaacugccag

SEQ ID NO: 220438 - RNA, 32 nt, Human
uaccaaggguccaaggagaggccuugcuuggc

SEQ ID NO: 220439 - RNA, 25 nt, Human
uaccaaggucugaccuaggguuccc

SEQ ID NO: 220440 - RNA, 32 nt, Human
uaccaagugcagcacuuucacaugcuugaugc

SEQ ID NO: 220441 - RNA, 32 nt, Human
uaccaagugggucagcacagggcugaggaugg

SEQ ID NO: 220442 - RNA, 32 nt, Human
uaccaaguggguuugcaccuccucauaaagaa

SEQ ID NO: 220443 - RNA, 32 nt, Human
uaccaauaacaugcaugcauuguaccaaguaa

SEQ ID NO: 220444 - RNA, 32 nt, Human
uaccaaucaugaaucuuuguuucagguucagu

SEQ ID NO: 220445 - RNA, 32 nt, Human
uaccaaugacucaccugaagugcaauacgaaa

SEQ ID NO: 220446 - RNA, 32 nt, Human
uaccaauggggaugauuuucaaagggaagugu

SEQ ID NO: 220447 - RNA, 32 nt, Human
uaccaaugucuaggaagcuguggugugaaaau

SEQ ID NO: 220448 - RNA, 32 nt, Human
uaccaauuauuugcuagguccugugcaaggaa

SEQ ID NO: 220449 - RNA, 32 nt, Human
uaccaauugugaacacaaaauaucugauaugg

SEQ ID NO: 220450 - RNA, 32 nt, Human
uaccaauuuccugagguaauuucugaacucga

SEQ ID NO: 220451 - RNA, 32 nt, Human
uaccaauuugccuccuccuuccucacuucguu

SEQ ID NO: 220452 - RNA, 32 nt, Human
uaccaauuuuagaauauuauuucuugguuucu

SEQ ID NO: 220453 - RNA, 32 nt, Human
uaccacaauccuccuccuccucuccaggggcc

SEQ ID NO: 220454 - RNA, 32 nt, Human
uaccacacccagcuaauuuuguauuucuagua

SEQ ID NO: 220455 - RNA, 32 nt, Human
uaccacacccagcugauuuuuguauuuuuagu

SEQ ID NO: 220456 - RNA, 32 nt, Human
uaccacacuaggucucugggcccuugugcuuc

SEQ ID NO: 220457 - RNA, 32 nt, Human
uaccacacucuccccagcaucuacucaaggua

SEQ ID NO: 220458 - RNA, 32 nt, Human
uaccacacucugcuuaguuaguaugcugauaa

SEQ ID NO: 220459 - RNA, 32 nt, Human
uaccacagaccacccuucaugcuggggcucug

SEQ ID NO: 220460 - RNA, 32 nt, Human
uaccacagauguagacaaaaaugaucucugaa

SEQ ID NO: 220461 - RNA, 32 nt, Human
uaccacaggaccugggcuucgucuccagggga

SEQ ID NO: 220462 - RNA, 32 nt, Human
uaccacaggugagagacagauugaaagacaac

SEQ ID NO: 220463 - RNA, 32 nt, Human
uaccacagguuccugaauaauuccugcagggc

SEQ ID NO: 220464 - RNA, 32 nt, Human
uaccacaguaaccagcagaccuccaggauccu

SEQ ID NO: 220465 - RNA, 32 nt, Human
uaccacaguguaugugucuuuugcaagcuucc

SEQ ID NO: 220466 - RNA, 32 nt, Human
uaccacauugaaugaacaaagacugaacuuug

SEQ ID NO: 220467 - RNA, 32 nt, Human
uaccacauuuagcaguuaaauggcuauaggug

SEQ ID NO: 220468 - RNA, 20 nt, Human
uaccacauuuugcacauuca

SEQ ID NO: 220469 - RNA, 32 nt, Human
uaccaccaacugccuuucuuuguuccuaguua

SEQ ID NO: 220470 - RNA, 32 nt, Human
uaccaccaccaccaccaccauuacagcgccuc

SEQ ID NO: 220471 - RNA, 26 nt, Human
uaccaccaccagugagcuccagccug

SEQ ID NO: 220472 - RNA, 32 nt, Human
uaccaccaccgauuuaaaugggcugaguuggg

SEQ ID NO: 220473 - RNA, 32 nt, Human
uaccaccagcaccacacuguuuuaauuauugu

SEQ ID NO: 220474 - RNA, 32 nt, Human
uaccaccaggaggugagcuugcucugggaggc

SEQ ID NO: 220475 - RNA, 32 nt, Human
uaccaccaguacucagaggccgccaucaaccg

SEQ ID NO: 220476 - RNA, 32 nt, Human
uaccaccaucauucuucacagaauuacaaaaa

SEQ ID NO: 220477 - RNA, 32 nt, Human
uaccacccucccccaccucucccccgaaacuc

SEQ ID NO: 220478 - RNA, 32 nt, Human
uaccacccuucacaugguuuuggggaacccaa

SEQ ID NO: 220479 - RNA, 32 nt, Human
uaccaccgaaugucuguguuucauugucuagu

SEQ ID NO: 220480 - RNA, 32 nt, Human
uaccaccgcacuccagccugagcaacagagug

SEQ ID NO: 220481 - RNA, 32 nt, Human
uaccaccgcaucguagaggcuuuccgguuugc

SEQ ID NO: 220482 - RNA, 32 nt, Human
uaccaccgccugcuggaagacagugaggacuu

SEQ ID NO: 220483 - RNA, 30 nt, Human
uaccaccgcggucacucaccgccgccgccg

SEQ ID NO: 220484 - RNA, 25 nt, Human
uaccaccgcugccaccaccaccgcc

SEQ ID NO: 220485 - RNA, 32 nt, Human
uaccaccucuuugcccuuccuaccccuuccuc

SEQ ID NO: 220486 - RNA, 32 nt, Human
uaccaccuggacaucauaguuuugacucccca

SEQ ID NO: 220487 - RNA, 32 nt, Human
uaccaccuggggacccaaaagagaaggccuag

SEQ ID NO: 220488 - RNA, 32 nt, Human
uaccaccuguccagcaggugcaucugugagga

SEQ ID NO: 220489 - RNA, 32 nt, Human
uaccacgcagaccuuggguggggagagcuucc

SEQ ID NO: 220490 - RNA, 32 nt, Human
uaccacgcccaacuaauuuuuguauuuuuagu

SEQ ID NO: 220491 - RNA, 32 nt, Human
uaccacgcccagcuaauuuuugcauuuuuacu

SEQ ID NO: 220492 - RNA, 32 nt, Human
uaccacgcccagcuaauuuuuguauuuuuagu

SEQ ID NO: 220493 - RNA, 32 nt, Human
uaccacgcccagguaguuuuuguauuuuuagu

SEQ ID NO: 220494 - RNA, 32 nt, Human
uaccacgcccggcuaauuuuucuauuuuuagu

SEQ ID NO: 220495 - RNA, 32 nt, Human
uaccacgcccggcuaauuuuuguauuuuuaau

SEQ ID NO: 220496 - RNA, 32 nt, Human
uaccacgccuggcuaauucuuuguauuuuuag

SEQ ID NO: 220497 - RNA, 32 nt, Human
uaccacgccuggcuaauuuuucuauuuuuagu

SEQ ID NO: 220498 - RNA, 32 nt, Human
uaccacgccuggcuaauuuuuguauuuuuauu

SEQ ID NO: 220499 - RNA, 32 nt, Human
uaccacgcugggaaggaagaggacagcaagac

SEQ ID NO: 220500 - RNA, 32 nt, Human
uaccacgcuuggcuaauuuuuguauuuuuagu

SEQ ID NO: 220501 - RNA, 32 nt, Human
uaccacggcacuccagccugggugacagugag

SEQ ID NO: 220502 - RNA, 32 nt, Human
uaccacgggaaagggaaggggaagcaguagca

SEQ ID NO: 220503 - RNA, 32 nt, Human
uaccacguaucuagcuaauauguaugugucag

SEQ ID NO: 220504 - RNA, 32 nt, Human
uaccacgucugcuggucuccagccuuguaugg

SEQ ID NO: 220505 - RNA, 32 nt, Human
uaccacgugagcugugugaggcugguggugaa

SEQ ID NO: 220506 - RNA, 32 nt, Human
uaccacuacacuccagccugggcaacggagca

SEQ ID NO: 220507 - RNA, 32 nt, Human
uaccacuacacuucagcuugggugaugaagug

SEQ ID NO: 220508 - RNA, 32 nt, Human
uaccacuagagggagcucugaugcagcuggag

SEQ ID NO: 220509 - RNA, 32 nt, Human
uaccacuauaaauacaaaagcaucugguaaac

SEQ ID NO: 220510 - RNA, 32 nt, Human
uaccacucaccuggggauucagcaacagguau

SEQ ID NO: 220511 - RNA, 32 nt, Human
uaccacucagcccuguguugggguccucaaag

SEQ ID NO: 220512 - RNA, 32 nt, Human
uaccacuccaaauucccugccuucugcaaguu

SEQ ID NO: 220513 - RNA, 32 nt, Human
uaccacucucaucugcucaguacaucugcggc

SEQ ID NO: 220514 - RNA, 32 nt, Human
uaccacucuguauuggacaaaggcuagcacag

SEQ ID NO: 220515 - RNA, 32 nt, Human
uaccacugagccugagauggggaugagggcag

SEQ ID NO: 220516 - RNA, 32 nt, Human
uaccacugauggugaaggacaagacuuccugg

SEQ ID NO: 220517 - RNA, 32 nt, Human
uaccacugcacuccaaccuggguuacagcauc

SEQ ID NO: 220518 - RNA, 32 nt, Human
uaccacugcacuccagccuaggugacagggca

SEQ ID NO: 220519 - RNA, 32 nt, Human
uaccacugcacuccagccuggaugacagagug

SEQ ID NO: 220520 - RNA, 32 nt, Human
uaccacugcacuccagccuggcugacagugag

SEQ ID NO: 220521 - RNA, 32 nt, Human
uaccacugcacuccagccugggcaacagagug

SEQ ID NO: 220522 - RNA, 32 nt, Human
uaccacugcacuccagccugggcgacagagaa

SEQ ID NO: 220523 - RNA, 32 nt, Human
uaccacugcacuccagccugggcgacagagca

SEQ ID NO: 220524 - RNA, 32 nt, Human
uaccacugcacuccagccugggugacagagcg

SEQ ID NO: 220525 - RNA, 32 nt, Human
uaccacugcacuccagccugggugacagagug

SEQ ID NO: 220526 - RNA, 32 nt, Human
uaccacugcacuccagccuggucaauggagug

SEQ ID NO: 220527 - RNA, 32 nt, Human
uaccacugcacuccagcuugggcgacggagug

SEQ ID NO: 220528 - RNA, 32 nt, Human
uaccacugcacuccagucugggcaacagacgg

SEQ ID NO: 220529 - RNA, 32 nt, Human
uaccacugcacuccagucugggcgacagagug

SEQ ID NO: 220530 - RNA, 32 nt, Human
uaccacugcacuccaguuuggcaacagaguga

SEQ ID NO: 220531 - RNA, 32 nt, Human
uaccacugcacucuggccugggcaacaagagc

SEQ ID NO: 220532 - RNA, 32 nt, Human
uaccacugcacugcagccugagugacacagua

SEQ ID NO: 220533 - RNA, 32 nt, Human
uaccacugcauuccagccugggugacagagcg

SEQ ID NO: 220534 - RNA, 32 nt, Human
uaccacugcgcuccaaacugggugacauggug

SEQ ID NO: 220535 - RNA, 32 nt, Human
uaccacugcuggugguucacacaucaucccau

SEQ ID NO: 220536 - RNA, 32 nt, Human
uaccacuguacuccagccugggcuggacagug

SEQ ID NO: 220537 - RNA, 32 nt, Human
uaccacuguugaguuuuccugcuuggaaaagg

SEQ ID NO: 220538 - RNA, 32 nt, Human
uaccacuuaccugagacauucugauuuggaug

SEQ ID NO: 220539 - RNA, 32 nt, Human
uaccacuuaucucauagcauugcagugagaau

SEQ ID NO: 220540 - RNA, 32 nt, Human
uaccacuucauuccagccugggugacagagca

SEQ ID NO: 220541 - RNA, 32 nt, Human
uaccacuucucagcuuucaucauucuuuauug

SEQ ID NO: 220542 - RNA, 32 nt, Human
uaccacuugaaggugaacauucccugucuggu

SEQ ID NO: 220543 - RNA, 32 nt, Human
uaccacuuuccacucccugcuuaggauucugu

SEQ ID NO: 220544 - RNA, 32 nt, Human
uaccacuuucuuccacuguuaccagguacuua

SEQ ID NO: 220545 - RNA, 32 nt, Human
uaccagaaaccagacuuguaucgaccaauggc

SEQ ID NO: 220546 - RNA, 32 nt, Human
uaccagaagaacuaguagaagaagcuuugccg

SEQ ID NO: 220547 - RNA, 32 nt, Human
uaccagaagccagaaucacagaacagucucug

SEQ ID NO: 220548 - RNA, 32 nt, Human
uaccagaaucauuucuuuuaccaaaaugauuu

SEQ ID NO: 220549 - RNA, 17 nt, Human
uaccagacacuacagca

SEQ ID NO: 220550 - RNA, 32 nt, Human
uaccagacccuguccuggaugcugggauacaa

SEQ ID NO: 220551 - RNA, 32 nt, Human
uaccagacuaaaucaaccacuccagcagagca

SEQ ID NO: 220552 - RNA, 32 nt, Human
uaccagagaggaaaauuccacaucccaccaga

SEQ ID NO: 220553 - RNA, 32 nt, Human
uaccagaggaagagaggaaaaucagcggauuc

SEQ ID NO: 220554 - RNA, 32 nt, Human
uaccagaggcuguguugcuggggagaaaaaug

SEQ ID NO: 220555 - RNA, 31 nt, Human
uaccagagugagagaguagaagagaagggag

SEQ ID NO: 220556 - RNA, 32 nt, Human
uaccagauaacaaacacugaacuccuauuuga

SEQ ID NO: 220557 - RNA, 32 nt, Human
uaccagauaagcuuuugauuuuuguauuguuu

SEQ ID NO: 220558 - RNA, 32 nt, Human
uaccagauacugggggugagggguggggaaug

SEQ ID NO: 220559 - RNA, 32 nt, Human
uaccagauucaugcuucuaugaaaauuccauc

SEQ ID NO: 220560 - RNA, 32 nt, Human
uaccagauuuuuacacauguaucuaugcauuu

SEQ ID NO: 220561 - RNA, 32 nt, Human
uaccagcaacagcucagcagagcuaugcggau

SEQ ID NO: 220562 - RNA, 32 nt, Human
uaccagcaagaucacucugagauacauaaacu

SEQ ID NO: 220563 - RNA, 32 nt, Human
uaccagcaaucagggaacuccuaucuguuuug

SEQ ID NO: 220564 - RNA, 32 nt, Human
uaccagcaccccacuccagccucgaggaagcu

SEQ ID NO: 220565 - RNA, 32 nt, Human
uaccagcaccuguaaucccagcuacucgggag

SEQ ID NO: 220566 - RNA, 31 nt, Human
uaccagcaggggaaaugccagaugcuuauaa

SEQ ID NO: 220567 - RNA, 32 nt, Human
uaccagcagugagggaguuaacacagcagcug

SEQ ID NO: 220568 - RNA, 32 nt, Human
uaccagcauacgcucaccuuacagggaaaugg

SEQ ID NO: 220569 - RNA, 32 nt, Human
uaccagcauccugcuccacugccuuccucuag

SEQ ID NO: 220570 - RNA, 32 nt, Human
uaccagcaucugcaaucuggguguuuucucug

SEQ ID NO: 220571 - RNA, 32 nt, Human
uaccagcaugguaaaggguuagaaagagggca

SEQ ID NO: 220572 - RNA, 32 nt, Human
uaccagccacagucucugcacguuuccaagag

SEQ ID NO: 220573 - RNA, 32 nt, Human
uaccagccaguucugcuugcugugucugagcc

SEQ ID NO: 220574 - RNA, 32 nt, Human
uaccagccccacggccgcugggcagagcgggc

SEQ ID NO: 220575 - RNA, 32 nt, Human
uaccagcccccaggaccacuaccccacggcca

SEQ ID NO: 220576 - RNA, 32 nt, Human
uaccagcccugagacagaccccaggauaaggg

SEQ ID NO: 220577 - RNA, 32 nt, Human
uaccagccucaaauucccacaggcucauacuc

SEQ ID NO: 220578 - RNA, 32 nt, Human
uaccagccugggaggcccagguguagcggucc

SEQ ID NO: 220579 - RNA, 32 nt, Human
uaccagccuuucugguccugcugcucccuaug

SEQ ID NO: 220580 - RNA, 32 nt, Human
uaccagcgugagccaccacgcugggcuuccug

SEQ ID NO: 220581 - RNA, 32 nt, Human
uaccagcuccucugucucccucugccucucca

SEQ ID NO: 220582 - RNA, 32 nt, Human
uaccagcuggcagggccagggggugggugggc

SEQ ID NO: 220583 - RNA, 32 nt, Human
uaccagcugggauguuggcagcagccgcuccc

SEQ ID NO: 220584 - RNA, 32 nt, Human
uaccagcuguaaucccagcuacuugggaggcu

SEQ ID NO: 220585 - RNA, 32 nt, Human
uaccagcuuccaagcugggccccaccaauucc

SEQ ID NO: 220586 - RNA, 32 nt, Human
uaccagcuucuucacauaugcugcuuccuccc

SEQ ID NO: 220587 - RNA, 32 nt, Human
uaccaggaccacugcauuuaccagccugauac

SEQ ID NO: 220588 - RNA, 32 nt, Human
uaccaggacgccugggcugcucugcgggggac

SEQ ID NO: 220589 - RNA, 32 nt, Human
uaccaggagacaccuggacccuguaaggcugu

SEQ ID NO: 220590 - RNA, 32 nt, Human
uaccaggagacaggguuugagagcagacaacc

SEQ ID NO: 220591 - RNA, 32 nt, Human
uaccaggagcaggggcauggagcacagugagg

SEQ ID NO: 220592 - RNA, 32 nt, Human
uaccaggaggagaccagguugcaguggcguaa

SEQ ID NO: 220593 - RNA, 32 nt, Human
uaccaggaggcagggaugcugggggucguggu

SEQ ID NO: 220594 - RNA, 32 nt, Human
uaccaggaugaggaagagaagaaaugaggagc

SEQ ID NO: 220595 - RNA, 32 nt, Human
uaccaggauugcugccgcauuccacuggguau

SEQ ID NO: 220596 - RNA, 32 nt, Human
uaccaggcaggugccuucuccacccacaggca

SEQ ID NO: 220597 - RNA, 32 nt, Human
uaccaggccaucuccccaguuucccaguucuu

SEQ ID NO: 220598 - RNA, 32 nt, Human
uaccaggcccaggagaucaguaauuacaaauu

SEQ ID NO: 220599 - RNA, 32 nt, Human
uaccaggccucauuuacuuauuaauuuauggu

SEQ ID NO: 220600 - RNA, 32 nt, Human
uaccaggccuccugccccagccuacuccaccu

SEQ ID NO: 220601 - RNA, 32 nt, Human
uaccagggacuaucuuugcugcagagaucaag

SEQ ID NO: 220602 - RNA, 32 nt, Human
uaccagggaugcagugguguuuaggcaggaua

SEQ ID NO: 220603 - RNA, 32 nt, Human
uaccagggccagagacagggaauggggcacgg

SEQ ID NO: 220604 - RNA, 32 nt, Human
uaccaggggaggcagugucuggaugaugcugu

SEQ ID NO: 220605 - RNA, 32 nt, Human
uaccaggggcucagcaaugaccagccugcaac

SEQ ID NO: 220606 - RNA, 32 nt, Human
uaccagguagccccaaggaggagcugccgacc

SEQ ID NO: 220607 - RNA, 32 nt, Human
uaccaggucaaagauuuuuguauucuugugaa

SEQ ID NO: 220608 - RNA, 32 nt, Human
uaccagguccccauccugcugccagcucucaa

SEQ ID NO: 220609 - RNA, 31 nt, Human
uaccaguacagagagaagaggaaugcugcau

SEQ ID NO: 220610 - RNA, 32 nt, Human
uaccaguaggagaccacugggauggugugugg

SEQ ID NO: 220611 - RNA, 32 nt, Human
uaccagucuggcuucuagucuauuuacuguuu

SEQ ID NO: 220612 - RNA, 32 nt, Human
uaccagugcacuccaggcgggugacagagcaa

SEQ ID NO: 220613 - RNA, 32 nt, Human
uaccagugcugugccagacacugaggcauucu

SEQ ID NO: 220614 - RNA, 32 nt, Human
uaccaguggguucucauuuuccuccuaaucua

SEQ ID NO: 220615 - RNA, 32 nt, Human
uaccaguuacacugggacuguaacagcauuuu

SEQ ID NO: 220616 - RNA, 32 nt, Human
uaccaguugcccuagcccagacucugagcugc

SEQ ID NO: 220617 - RNA, 32 nt, Human
uaccaguuuccuuaccaggaaggaaagaaaac

SEQ ID NO: 220618 - RNA, 32 nt, Human
uaccaguuuuggagacugccugagaugaaagg

SEQ ID NO: 220619 - RNA, 32 nt, Human
uaccauaacagcuugggggaaagaccaugaaa

SEQ ID NO: 220620 - RNA, 32 nt, Human
uaccauaaccgaugugcuggagcuacacgacu

SEQ ID NO: 220621 - RNA, 32 nt, Human
uaccauaagagguuggaaugagaggaugacug

SEQ ID NO: 220622 - RNA, 32 nt, Human
uaccauaagcagcagcacgauccagagaucca

SEQ ID NO: 220623 - RNA, 32 nt, Human
uaccauaaguagaauuuuaaguaaacugguga

SEQ ID NO: 220624 - RNA, 32 nt, Human
uaccauaaucccccucaauucagaccuucuga

SEQ ID NO: 220625 - RNA, 32 nt, Human
uaccauacaaggguauuacaacuguaaaacaa

SEQ ID NO: 220626 - RNA, 32 nt, Human
uaccauacugauuuucaaggcagggucuaacc

SEQ ID NO: 220627 - RNA, 32 nt, Human
uaccauagaagggaacacagguuaccauauug

SEQ ID NO: 220628 - RNA, 32 nt, Human
uaccauaggucaaaaggacuggaauuuuccuu

SEQ ID NO: 220629 - RNA, 32 nt, Human
uaccauaugagaaaguugccuucagaaggugg

SEQ ID NO: 220630 - RNA, 32 nt, Human
uaccauauugcccaggcuggucucaaacucuu

SEQ ID NO: 220631 - RNA, 32 nt, Human
uaccaucaagagccuguauuuugaguuauucc

SEQ ID NO: 220632 - RNA, 31 nt, Human
uaccaucacagcugaaugcaaugaaaggcua

SEQ ID NO: 220633 - RNA, 32 nt, Human
uaccaucacccaggccagggaugggggugggg

SEQ ID NO: 220634 - RNA, 32 nt, Human
uaccaucagagcagugcagugcucuuccgagg

SEQ ID NO: 220635 - RNA, 32 nt, Human
uaccaucagcagcucaucccugugcaugguga

SEQ ID NO: 220636 - RNA, 32 nt, Human
uaccaucaguguccaagaauuucuguucuauc

SEQ ID NO: 220637 - RNA, 32 nt, Human
uaccaucaucagugagagucuugaguucacua

SEQ ID NO: 220638 - RNA, 32 nt, Human
uaccauccuaggcugacaccuaacucuucuuu

SEQ ID NO: 220639 - RNA, 32 nt, Human
uaccauccucuccuacaauaaacucuagcucu

SEQ ID NO: 220640 - RNA, 32 nt, Human
uaccauccugcaggugggcugccacucugcuc

SEQ ID NO: 220641 - RNA, 32 nt, Human
uaccauccugggagcaaggcccugcagcucca

SEQ ID NO: 220642 - RNA, 32 nt, Human
uaccauccuuucuccuuuggguuuuaaaauaa

SEQ ID NO: 220643 - RNA, 32 nt, Human
uaccaucgucuauuuccacuacgggcugaaca

SEQ ID NO: 220644 - RNA, 32 nt, Human
uaccaucguggaagaauggaagggagggggag

SEQ ID NO: 220645 - RNA, 32 nt, Human
uaccaucucauuaauuuacaaaggauaaucuu

SEQ ID NO: 220646 - RNA, 32 nt, Human
uaccaucuuacaugcuuaaauaacuccacauu

SEQ ID NO: 220647 - RNA, 32 nt, Human
uaccaucuuggaugcagagaccagacccucac

SEQ ID NO: 220648 - RNA, 32 nt, Human
uaccaugaaaacuuccucugaaacaccuuaca

SEQ ID NO: 220649 - RNA, 32 nt, Human
uaccaugaaacccauggcuucucacgggacag

SEQ ID NO: 220650 - RNA, 29 nt, Human
uaccaugaagaaggucaagaagaaaaggu

SEQ ID NO: 220651 - RNA, 32 nt, Human
uaccaugaagugaaaaugccacauuuugcuuu

SEQ ID NO: 220652 - RNA, 32 nt, Human
uaccaugagacaacacuauuuuuauuuauaua

SEQ ID NO: 220653 - RNA, 32 nt, Human
uaccaugaucaaaggcgaaggaagggaucucu

SEQ ID NO: 220654 - RNA, 31 nt, Human
uaccaugcacuuuccuuugaugcugaggaga

SEQ ID NO: 220655 - RNA, 32 nt, Human
uaccaugcagucucgcauuugaugacaugcag

SEQ ID NO: 220656 - RNA, 32 nt, Human
uaccaugccauuuaacaagagaucccacucuc

SEQ ID NO: 220657 - RNA, 32 nt, Human
uaccaugcccagcuaauuuuuguauuuuuagu

SEQ ID NO: 220658 - RNA, 32 nt, Human
uaccaugcccagcuaauuuuuguguuuuuagu

SEQ ID NO: 220659 - RNA, 32 nt, Human
uaccaugcccagcucauuuuuguauuuuuagu

SEQ ID NO: 220660 - RNA, 32 nt, Human
uaccaugcccggcuaauuuuuguauuuuuagu

SEQ ID NO: 220661 - RNA, 32 nt, Human
uaccaugccuggcuaauuuucuuguaguuuua

SEQ ID NO: 220662 - RNA, 32 nt, Human
uaccaugccuggcuaauuuuuguauuuuuagu

SEQ ID NO: 220663 - RNA, 29 nt, Human
uaccauggcaggccaacgaacaugucaaa

SEQ ID NO: 220664 - RNA, 32 nt, Human
uaccauggccuccagccuucacuggcuaugga

SEQ ID NO: 220665 - RNA, 32 nt, Human
uaccauggcucaugcuuuccaucaagcaccag

SEQ ID NO: 220666 - RNA, 32 nt, Human
uaccauggugucagugcuggaggaucugauug

SEQ ID NO: 220667 - RNA, 32 nt, Human
uaccauguaauagaacaaacccugccaagugc

SEQ ID NO: 220668 - RNA, 32 nt, Human
uaccauguagaaaccauuuucuuucuagaaac

SEQ ID NO: 220669 - RNA, 32 nt, Human
uaccauguaugacauaccuugaccucaaagau

SEQ ID NO: 220670 - RNA, 32 nt, Human
uaccauguccuaagcugaggcaggcggcaggc

SEQ ID NO: 220671 - RNA, 32 nt, Human
uaccauguucauuccucuggcucaguuuggug

SEQ ID NO: 220672 - RNA, 32 nt, Human
uaccauguugcccaggcuggucucaaacucgu

SEQ ID NO: 220673 - RNA, 32 nt, Human
uaccauguugcccaggcuggucucgaacuucu

SEQ ID NO: 220674 - RNA, 32 nt, Human
uaccauguuggccaggcuggucacaaacuccu

SEQ ID NO: 220675 - RNA, 32 nt, Human
uaccauguuggccaggcuggucucaaacuccu

SEQ ID NO: 220676 - RNA, 32 nt, Human
uaccauguuggccaggcuggucucgaacuccu

SEQ ID NO: 220677 - RNA, 32 nt, Human
uaccauguuggccaggcugguuucaaacuccu

SEQ ID NO: 220678 - RNA, 32 nt, Human
uaccauuacauccugauaucuggggcuucuga

SEQ ID NO: 220679 - RNA, 32 nt, Human
uaccauucagccucugucucacaugcuuuaua

SEQ ID NO: 220680 - RNA, 32 nt, Human
uaccauucucaagcucucugggcacagagacc

SEQ ID NO: 220681 - RNA, 32 nt, Human
uaccauucuggggucuaccauucuggggucua

SEQ ID NO: 220682 - RNA, 32 nt, Human
uaccauucuuaacacugguagcuccuguccca

SEQ ID NO: 220683 - RNA, 32 nt, Human
uaccauugcacuccagccugggcaacaagaau

SEQ ID NO: 220684 - RNA, 32 nt, Human
uaccauugcacuccagccugggcaacaagagc

SEQ ID NO: 220685 - RNA, 32 nt, Human
uaccauugcacuccagccugggcaacaagagu

SEQ ID NO: 220686 - RNA, 32 nt, Human
uaccauuggaagcaagggaaagaggaggagau

SEQ ID NO: 220687 - RNA, 32 nt, Human
uaccauuggaauaacauaaugagaggccuggg

SEQ ID NO: 220688 - RNA, 32 nt, Human
uaccauuuaccccagcaugcuugugacgggca

SEQ ID NO: 220689 - RNA, 32 nt, Human
uaccauuugcauucucaucaacaguaugugaa

SEQ ID NO: 220690 - RNA, 32 nt, Human
uaccauuuuaaguucugaccucaggccuccau

SEQ ID NO: 220691 - RNA, 32 nt, Human
uaccauuuuguggagcuuucacuuacauuauu

SEQ ID NO: 220692 - RNA, 32 nt, Human
uaccauuuuugugguuguuuggagcagggaug

SEQ ID NO: 220693 - RNA, 32 nt, Human
uacccaaaggcuaagaaauucuaaagaacuga

SEQ ID NO: 220694 - RNA, 32 nt, Human
uacccaaauuuccaagacacaaacaugaccua

SEQ ID NO: 220695 - RNA, 32 nt, Human
uacccaacauggugaaaccccaucucuucuaa

SEQ ID NO: 220696 - RNA, 32 nt, Human
uacccaacccugcccucaccuccagggccugg

SEQ ID NO: 220697 - RNA, 32 nt, Human
uacccaaccuucccuucucccuugagugcuug

SEQ ID NO: 220698 - RNA, 32 nt, Human
uacccaagacacaccuccccaaccucagucuu

SEQ ID NO: 220699 - RNA, 18 nt, Human
uacccaagccacagggaa

SEQ ID NO: 220700 - RNA, 32 nt, Human
uacccaagcugcaucauuuagaaaaccuguac

SEQ ID NO: 220701 - RNA, 21 nt, Human
uacccaagcuggagugcagug

SEQ ID NO: 220702 - RNA, 32 nt, Human
uacccaaggaaauaggaggagucuagaguaga

SEQ ID NO: 220703 - RNA, 32 nt, Human
uacccaaggaauucccuuaaagaauuagaagu

SEQ ID NO: 220704 - RNA, 31 nt, Human
uacccaaggacauugccucaggguugcaaac

SEQ ID NO: 220705 - RNA, 32 nt, Human
uacccaaggacuuguuugcaaugcagaaucac

SEQ ID NO: 220706 - RNA, 32 nt, Human
uacccaaggcauuggucuagcuuuuccuacaa

SEQ ID NO: 220707 - RNA, 32 nt, Human
uacccaaguaagguucucaaauguagaaaauu

SEQ ID NO: 220708 - RNA, 32 nt, Human
uacccaaugccccaaagagcccuucaggccug

SEQ ID NO: 220709 - RNA, 32 nt, Human
uacccacaaaaacaccagcaagcaggagacca

SEQ ID NO: 220710 - RNA, 32 nt, Human
uacccacaacaacuguaguuacuuucuuggcc

SEQ ID NO: 220711 - RNA, 32 nt, Human
uacccacaacaacuguaguuucuuacuuggcc

SEQ ID NO: 220712 - RNA, 32 nt, Human
uacccacacagucacagucacacacacauaug

SEQ ID NO: 220713 - RNA, 32 nt, Human
uacccacacccaggccggaagccggcuguuug

SEQ ID NO: 220714 - RNA, 32 nt, Human
uacccacacuggcuuccugccucccaccccuc

SEQ ID NO: 220715 - RNA, 32 nt, Human
uacccacaggcagagggcaucggggccauuug

SEQ ID NO: 220716 - RNA, 32 nt, Human
uacccacaggugaggggcaggaccugaaggua

SEQ ID NO: 220717 - RNA, 32 nt, Human
uacccacagguguggaggggcuggcccccuuc

SEQ ID NO: 220718 - RNA, 32 nt, Human
uacccacauguacagacauacauuuaugcaca

SEQ ID NO: 220719 - RNA, 32 nt, Human
uacccacauugcuggcacuaccagccuugggc

SEQ ID NO: 220720 - RNA, 32 nt, Human
uacccaccaggaugugugcccagccaggccuc

SEQ ID NO: 220721 - RNA, 32 nt, Human
uacccaccccaaaggccugccucaagguuuaa

SEQ ID NO: 220722 - RNA, 32 nt, Human
uacccaccccuguguugaucacuugcaggccc

SEQ ID NO: 220723 - RNA, 32 nt, Human
uacccacccugagccuuccggucuccauggcg

SEQ ID NO: 220724 - RNA, 32 nt, Human
uacccaccgauggagcccccagauagagcugg

SEQ ID NO: 220725 - RNA, 32 nt, Human
uacccaccuccacccccuucuuccagaaucug

SEQ ID NO: 220726 - RNA, 32 nt, Human
uacccaccugcuuguucacaugcacaggugcu

SEQ ID NO: 220727 - RNA, 32 nt, Human
uacccacgcuggguauuaccauguaaauaauc

SEQ ID NO: 220728 - RNA, 32 nt, Human
uacccacuccagcacacagaagcaugagguuc

SEQ ID NO: 220729 - RNA, 32 nt, Human
uacccacucuggcugccguuguccuguccugc

SEQ ID NO: 220730 - RNA, 32 nt, Human
uacccacugcccacccuggcugccgcugggcg

SEQ ID NO: 220731 - RNA, 32 nt, Human
uacccacuguacaguccacuucacaggaucag

SEQ ID NO: 220732 - RNA, 32 nt, Human
uacccagacaacaggaucgucucguccaagua

SEQ ID NO: 220733 - RNA, 32 nt, Human
uacccagacugccagagcccaggcuggccuca

SEQ ID NO: 220734 - RNA, 32 nt, Human
uacccagagaccagagagagucagccuagucc

SEQ ID NO: 220735 - RNA, 32 nt, Human
uacccagagaccugcauguucucuccaacgac

SEQ ID NO: 220736 - RNA, 32 nt, Human
uacccagaggagccugagcacacuccacccua

SEQ ID NO: 220737 - RNA, 32 nt, Human
uacccagaugguggaggaugugaagggauugc

SEQ ID NO: 220738 - RNA, 31 nt, Human
uacccagcaauguccucaaugagggucuuuu

SEQ ID NO: 220739 - RNA, 32 nt, Human
uacccagcagugggccccagacuucucgcagg

SEQ ID NO: 220740 - RNA, 32 nt, Human
uacccagccagccuuugccucuacuguaucgc

SEQ ID NO: 220741 - RNA, 32 nt, Human
uacccagccaucggcugcgguaugacagcagg

SEQ ID NO: 220742 - RNA, 21 nt, Human
uacccagccuggagugcagug

SEQ ID NO: 220743 - RNA, 32 nt, Human
uacccagcuucucaacauccagggcccaauuu

SEQ ID NO: 220744 - RNA, 32 nt, Human
uacccaggaaauucucuugugucucuuuccag

SEQ ID NO: 220745 - RNA, 32 nt, Human
uacccaggacagcuggaaauagcgugccgcag

SEQ ID NO: 220746 - RNA, 32 nt, Human
uacccaggacgucagcaugacuaccuaguccc

SEQ ID NO: 220747 - RNA, 32 nt, Human
uacccaggagcagcaggcuuuacgucuucagc

SEQ ID NO: 220748 - RNA, 32 nt, Human
uacccaggaggcagagauugcagugagcugag

SEQ ID NO: 220749 - RNA, 32 nt, Human
uacccaggaggcggagguuguagugagcugag

SEQ ID NO: 220750 - RNA, 26 nt, Human
uacccaggagguggagguugcaguga

SEQ ID NO: 220751 - RNA, 32 nt, Human
uacccaggagguggagguugcagugagccgaa

SEQ ID NO: 220752 - RNA, 32 nt, Human
uacccaggagguggagguugcggugaacugag

SEQ ID NO: 220753 - RNA, 31 nt, Human
uacccaggcagaguggacggcauucagggcu

SEQ ID NO: 220754 - RNA, 32 nt, Human
uacccaggccuccucaaccuucaccuccuuuc

SEQ ID NO: 220755 - RNA, 32 nt, Human
uacccaggcucagaaagggcaagagccaugcu

SEQ ID NO: 220756 - RNA, 20 nt, Human
uacccaggcugagugcagug

SEQ ID NO: 220757 - RNA, 21 nt, Human
uacccaggcuggagugcaaug

SEQ ID NO: 220758 - RNA, 32 nt, Human
uacccaggcuggucucaacuccugggcucaag

SEQ ID NO: 220759 - RNA, 21 nt, Human
uacccaggguggagugcagug

SEQ ID NO: 220760 - RNA, 32 nt, Human
uacccaggugccgaggcaagagacugaaggca

SEQ ID NO: 220761 - RNA, 32 nt, Human
uacccagucccugcuacuaucuccaucccuaa

SEQ ID NO: 220762 - RNA, 32 nt, Human
uacccaguuagcacaguagguggggagucugc

SEQ ID NO: 220763 - RNA, 32 nt, Human
uacccauaaugucuuucugcauuaguuccuug

SEQ ID NO: 220764 - RNA, 32 nt, Human
uacccauaucaccucugcucugaggcugggcc

SEQ ID NO: 220765 - RNA, 32 nt, Human
uacccaucacacaccagcguuuugaccagaug

SEQ ID NO: 220766 - RNA, 32 nt, Human
uacccaucacuaucaaaaaguuuaauguguau

SEQ ID NO: 220767 - RNA, 32 nt, Human
uacccaucuccaugccacaccuuauccaguua

SEQ ID NO: 220768 - RNA, 32 nt, Human
uacccaucucccaguugcauaguacagugucu

SEQ ID NO: 220769 - RNA, 32 nt, Human
uacccaucucugauuuggcucuccuuaaguga

SEQ ID NO: 220770 - RNA, 32 nt, Human
uacccaucuggcagcugcugugccugaggugg

SEQ ID NO: 220771 - RNA, 32 nt, Human
uacccaucuguguccccaugcccaguucaggg

SEQ ID NO: 220772 - RNA, 32 nt, Human
uacccaugaucauccuaaccccaaagccaccc

SEQ ID NO: 220773 - RNA, 32 nt, Human
uacccaugcucacuuggugaauaaauucuggc

SEQ ID NO: 220774 - RNA, 32 nt, Human
uacccaugggcaacaugguucuacaucaggac

SEQ ID NO: 220775 - RNA, 32 nt, Human
uacccauggguggaagcuaaagaguccggggg

SEQ ID NO: 220776 - RNA, 32 nt, Human
uacccauuacacaaugagaaaccagaggagcc

SEQ ID NO: 220777 - RNA, 32 nt, Human
uacccauuagaugcaggcucuaccucaaguac

SEQ ID NO: 220778 - RNA, 19 nt, Human
uacccauuccccuuuucca

SEQ ID NO: 220779 - RNA, 32 nt, Human
uacccauuccugccagcucugccuccuuuuca

SEQ ID NO: 220780 - RNA, 32 nt, Human
uacccauuuauccuauuuuuagcaauaauucg

SEQ ID NO: 220781 - RNA, 32 nt, Human
uacccauuuccucauucuccauguuauugucu

SEQ ID NO: 220782 - RNA, 32 nt, Human
uacccauuuucagcuucucugccucucuucug

SEQ ID NO: 220783 - RNA, 32 nt, Human
uaccccaaaacaaugucaccaugguuaccacc

SEQ ID NO: 220784 - RNA, 32 nt, Human
uaccccaaacuuccucuccugucuucaugugg

SEQ ID NO: 220785 - RNA, 21 nt, Human
uaccccaacaaucucuccccu

SEQ ID NO: 220786 - RNA, 32 nt, Human
uaccccacagugcaccugcccaggggcuguuc

SEQ ID NO: 220787 - RNA, 32 nt, Human
uaccccacauaaggaaaguacuacacuaaauu

SEQ ID NO: 220788 - RNA, 32 nt, Human
uaccccaccaggugggcaaagcagaaaccugc

SEQ ID NO: 220789 - RNA, 32 nt, Human
uaccccaccauggacaguggugaaugggacgu

SEQ ID NO: 220790 - RNA, 32 nt, Human
uaccccacgcccaccuccaccccaggagccga

SEQ ID NO: 220791 - RNA, 32 nt, Human
uaccccagaaagcagaggaggcguguaaauaa

SEQ ID NO: 220792 - RNA, 32 nt, Human
uaccccagacacacccucucuccucggaugac

SEQ ID NO: 220793 - RNA, 32 nt, Human
uaccccagagaccuuaaacagaaacaguagcu

SEQ ID NO: 220794 - RNA, 32 nt, Human
uaccccagccaucauuuucucagauggugaaa

SEQ ID NO: 220795 - RNA, 27 nt, Human
uaccccagccccacagacuccaguggc

SEQ ID NO: 220796 - RNA, 32 nt, Human
uaccccagccuggagucagggccagggaggca

SEQ ID NO: 220797 - RNA, 32 nt, Human
uaccccaggcuggagugcaauggcgugaucuc

SEQ ID NO: 220798 - RNA, 32 nt, Human
uaccccagugagguugaaggcaccaauuccaa

SEQ ID NO: 220799 - RNA, 32 nt, Human
uaccccauagcaggcagggacaaggaccacuc

SEQ ID NO: 220800 - RNA, 32 nt, Human
uaccccaucccccauacucaccucuuuccauu

SEQ ID NO: 220801 - RNA, 32 nt, Human
uacccccacaaacuucaguucccaaaucugua

SEQ ID NO: 220802 - RNA, 32 nt, Human
uacccccaccccucuagagacccuccagcuaa

SEQ ID NO: 220803 - RNA, 32 nt, Human
uacccccagaucugaccuugcuguagauccau

SEQ ID NO: 220804 - RNA, 32 nt, Human
uacccccagcacugggucauuucuugccaaua

SEQ ID NO: 220805 - RNA, 32 nt, Human
uacccccagcacuuuagcccuguguggccagc

SEQ ID NO: 220806 - RNA, 32 nt, Human
uacccccagcugugaagccuuccucuugaggg

SEQ ID NO: 220807 - RNA, 32 nt, Human
uacccccaggagagggggucaguguuuccugg

SEQ ID NO: 220808 - RNA, 32 nt, Human
uacccccaggguggcugugagaacaaaaugag

SEQ ID NO: 220809 - RNA, 30 nt, Human
uaccccccaaacuacccucuuccugggaaa

SEQ ID NO: 220810 - RNA, 32 nt, Human
uacccccucaccgacuacuaaggcccgccagg

SEQ ID NO: 220811 - RNA, 32 nt, Human
uacccccuccagccccacaccugggccucccc

SEQ ID NO: 220812 - RNA, 32 nt, Human
uacccccuccccucccaucuguggcuuggcuc

SEQ ID NO: 220813 - RNA, 32 nt, Human
uacccccugugccauuugagcugcuugcgcuc

SEQ ID NO: 220814 - RNA, 32 nt, Human
uaccccgagaucaggccccaccugccagcucu

SEQ ID NO: 220815 - RNA, 32 nt, Human
uaccccgcagagccgccagccccgggcauguu

SEQ ID NO: 220816 - RNA, 32 nt, Human
uaccccgccacuggccuguacacccacccaag

SEQ ID NO: 220817 - RNA, 32 nt, Human
uaccccgccuccauuccguugcucucucaguc

SEQ ID NO: 220818 - RNA, 32 nt, Human
uaccccggaggcaccuggguccaucagagaag

SEQ ID NO: 220819 - RNA, 32 nt, Human
uaccccggcugcuuggcaguugcagugcugcu

SEQ ID NO: 220820 - RNA, 32 nt, Human
uaccccuacaaacccaugccucacugacagac

SEQ ID NO: 220821 - RNA, 32 nt, Human
uaccccucagcccuaccuggggcugguccugg

SEQ ID NO: 220822 - RNA, 32 nt, Human
uaccccucauacccucccagcauauacaaaag

SEQ ID NO: 220823 - RNA, 32 nt, Human
uaccccuccaccccgcaagcucucauuggcuc

SEQ ID NO: 220824 - RNA, 32 nt, Human
uaccccucccccauucccagcugcagcccccu

SEQ ID NO: 220825 - RNA, 32 nt, Human
uaccccuccuccuuacccuacuucuuucuagu

SEQ ID NO: 220826 - RNA, 32 nt, Human
uaccccucgcugcugucaucauccccuugccu

SEQ ID NO: 220827 - RNA, 32 nt, Human
uaccccucucauuccuuccgugccaugguuuu

SEQ ID NO: 220828 - RNA, 32 nt, Human
uaccccugacuuagagccugguggaggugugg

SEQ ID NO: 220829 - RNA, 32 nt, Human
uaccccugagugagcaagcugcuuccucugug

SEQ ID NO: 220830 - RNA, 32 nt, Human
uaccccugcacuccagcccagguuacagagca

SEQ ID NO: 220831 - RNA, 32 nt, Human
uaccccugggccacugcuaacaagcaccuaac

SEQ ID NO: 220832 - RNA, 32 nt, Human
uaccccuggggcaaaaauauaacucuagcugu

SEQ ID NO: 220833 - RNA, 32 nt, Human
uaccccuguaaucccagcuacucgggaggcug

SEQ ID NO: 220834 - RNA, 32 nt, Human
uaccccuuacccagaguggcccacaggaaaca

SEQ ID NO: 220835 - RNA, 32 nt, Human
uaccccuuaccuaaggaguguaguuauaauac

SEQ ID NO: 220836 - RNA, 32 nt, Human
uaccccuuccuguguccaugugaucucauugu

SEQ ID NO: 220837 - RNA, 32 nt, Human
uaccccuugucgccccucccucccagagcacc

SEQ ID NO: 220838 - RNA, 32 nt, Human
uaccccuuuccccaaaagucugaaaguguagg

SEQ ID NO: 220839 - RNA, 32 nt, Human
uaccccuuugaaaggcugaagaugucugcuga

SEQ ID NO: 220840 - RNA, 32 nt, Human
uacccgaaggcccucuguccacacaacaugaa

SEQ ID NO: 220841 - RNA, 32 nt, Human
uacccgaccuucccuucucccuugagugcuug

SEQ ID NO: 220842 - RNA, 23 nt, Human
uacccgcagauccugucccaugg

SEQ ID NO: 220843 - RNA, 21 nt, Human
uacccgcagcuccuggcgcuc

SEQ ID NO: 220844 - RNA, 32 nt, Human
uacccgcauccagcgacugcagcaccagaaaa

SEQ ID NO: 220845 - RNA, 32 nt, Human
uacccgcccugccuucucuucucauaugcaau

SEQ ID NO: 220846 - RNA, 32 nt, Human
uacccgccuccaccucccaaaguguugugauu

SEQ ID NO: 220847 - RNA, 32 nt, Human
uacccgcgcggugcgggccucagucugcggcc

SEQ ID NO: 220848 - RNA, 32 nt, Human
uacccgcggccccgggcagggagggagcagcu

SEQ ID NO: 220849 - RNA, 32 nt, Human
uacccgcgugagccaccgcgcccggcugcaaa

SEQ ID NO: 220850 - RNA, 32 nt, Human
uacccgcucccucugcucauccauccuugauu

SEQ ID NO: 220851 - RNA, 32 nt, Human
uacccgcucugccaggcccugccccuccuccc

SEQ ID NO: 220852 - RNA, 32 nt, Human
uacccggaugaagagguuggaggugggcagcc

SEQ ID NO: 220853 - RNA, 32 nt, Human
uacccgggaccccagcccggccgcucgcccgc

SEQ ID NO: 220854 - RNA, 32 nt, Human
uacccgggaggcaguggcugcagugagcugag

SEQ ID NO: 220855 - RNA, 32 nt, Human
uacccgggaggcugaggcaggagaaucgcuug

SEQ ID NO: 220856 - RNA, 32 nt, Human
uacccgggaggcugaggcaggagaauugcuug

SEQ ID NO: 220857 - RNA, 32 nt, Human
uacccggggaggacgcggggagccggaacccc

SEQ ID NO: 220858 - RNA, 32 nt, Human
uacccggggaggacguggggagccggaacccc

SEQ ID NO: 220859 - RNA, 32 nt, Human
uacccggggaggcugaggcaggagaauugcuu

SEQ ID NO: 220860 - RNA, 32 nt, Human
uacccggugggacuugugguuggggcuggugu

SEQ ID NO: 220861 - RNA, 32 nt, Human
uacccgucacccaagugguaguagucucuuau

SEQ ID NO: 220862 - RNA, 32 nt, Human
uacccgucuuucucccagcucacccuggcuuu

SEQ ID NO: 220863 - RNA, 32 nt, Human
uacccgugguuucaaacaucaacuuggaauuc

SEQ ID NO: 220864 - RNA, 28 nt, Human
uacccuaaaagugcugucucuucaaguc

SEQ ID NO: 220865 - RNA, 32 nt, Human
uacccuaaaucuuaacuuuauggaagggccuc

SEQ ID NO: 220866 - RNA, 23 nt, Human
uacccuaacuuagcuguguggga

SEQ ID NO: 220867 - RNA, 32 nt, Human
uacccuaagagagguuuucuucuuauuuuuag

SEQ ID NO: 220868 - RNA, 32 nt, Human
uacccuaccacacaccuggccuaggagacaca

SEQ ID NO: 220869 - RNA, 32 nt, Human
uacccuacuuucauuccucccaccccaagcaa

SEQ ID NO: 220870 - RNA, 32 nt, Human
uacccuagcugggugcaugugugugcacacac

SEQ ID NO: 220871 - RNA, 32 nt, Human
uacccuagcuuuuuaccagugacuuggucucu

SEQ ID NO: 220872 - RNA, 32 nt, Human
uacccuauacugaugcuccgacugccuacuca

SEQ ID NO: 220873 - RNA, 32 nt, Human
uacccucaccaccugggaacaucccccagaca

SEQ ID NO: 220874 - RNA, 32 nt, Human
uacccucaccuuggucaucuauccugaaauaa

SEQ ID NO: 220875 - RNA, 32 nt, Human
uacccucagagagcaguuaugaaggaaaacca

SEQ ID NO: 220876 - RNA, 32 nt, Human
uacccucaggcagggcccugcuuuucuaggaa

SEQ ID NO: 220877 - RNA, 32 nt, Human
uacccucaugcuguucuugugauggugaguuc

SEQ ID NO: 220878 - RNA, 32 nt, Human
uacccucauguucuuaauucuuagcucauucu

SEQ ID NO: 220879 - RNA, 32 nt, Human
uacccuccaccccacugcccauucauauguug

SEQ ID NO: 220880 - RNA, 31 nt, Human
uacccuccacucaaggagguagaacucaguc

SEQ ID NO: 220881 - RNA, 32 nt, Human
uacccucccucgcugccugccugcggccugcc

SEQ ID NO: 220882 - RNA, 32 nt, Human
uacccucccuuucucuuuccucauugccuucu

SEQ ID NO: 220883 - RNA, 32 nt, Human
uacccuccucacaacacccucuucacccucca

SEQ ID NO: 220884 - RNA, 32 nt, Human
uacccuccuccccucuccuacugucauucuua

SEQ ID NO: 220885 - RNA, 32 nt, Human
uacccucucacacccgcacccgcgccucacga

SEQ ID NO: 220886 - RNA, 32 nt, Human
uacccucucaccauccccuugucuacucugau

SEQ ID NO: 220887 - RNA, 32 nt, Human
uacccucucccacuuucuuuguucuggguccu

SEQ ID NO: 220888 - RNA, 32 nt, Human
uacccucugggcaccagaaggcuccuggacca

SEQ ID NO: 220889 - RNA, 32 nt, Human
uacccucugguugggagaugcagccaccacau

SEQ ID NO: 220890 - RNA, 32 nt, Human
uacccugagcugcaucaccuccuaaacugagc

SEQ ID NO: 220891 - RNA, 32 nt, Human
uacccugagggcccugcaggcaaccugggacu

SEQ ID NO: 220892 - RNA, 19 nt, Human
uacccugauuauuuuauua

SEQ ID NO: 220893 - RNA, 32 nt, Human
uacccugcacuuccuccacauucuuuugcccu

SEQ ID NO: 220894 - RNA, 32 nt, Human
uacccugcagaggcuguuucagcucacacaga

SEQ ID NO: 220895 - RNA, 32 nt, Human
uacccugcaggaagaaugggauggcaguggag

SEQ ID NO: 220896 - RNA, 32 nt, Human
uacccugccccucucguccuccuggguagccu

SEQ ID NO: 220897 - RNA, 32 nt, Human
uacccugccugagauuccucaggagaaaaggc

SEQ ID NO: 220898 - RNA, 32 nt, Human
uacccugccugugcacaguggguggguuggug

SEQ ID NO: 220899 - RNA, 32 nt, Human
uacccugcuccucuuuuccuuuucccagacuc

SEQ ID NO: 220900 - RNA, 32 nt, Human
uacccugcuggguucauggaugucaucagcau

SEQ ID NO: 220901 - RNA, 32 nt, Human
uacccuggaccaaaacauuuuugaggugcaua

SEQ ID NO: 220902 - RNA, 32 nt, Human
uacccuggagccaggagcaucaggguuggcuu

SEQ ID NO: 220903 - RNA, 32 nt, Human
uacccuggagccauagcugggaggagaggaag

SEQ ID NO: 220904 - RNA, 32 nt, Human
uacccuggagccuuuggaauuugguuuccaaa

SEQ ID NO: 220905 - RNA, 32 nt, Human
uacccuggcaugcacaggugugcacugaugug

SEQ ID NO: 220906 - RNA, 32 nt, Human
uacccuggccaacauggugaaaccccaucucu

SEQ ID NO: 220907 - RNA, 32 nt, Human
uacccuggccagaacaucucacugauacucga

SEQ ID NO: 220908 - RNA, 32 nt, Human
uacccugggcauccagccccuggaccaugacu

SEQ ID NO: 220909 - RNA, 32 nt, Human
uacccugggccucagccccaccuuccaaaggg

SEQ ID NO: 220910 - RNA, 32 nt, Human
uacccugggcugaucuuugccccugguaugca

SEQ ID NO: 220911 - RNA, 32 nt, Human
uacccugggugcgaggaacugggugaagggaa

SEQ ID NO: 220912 - RNA, 32 nt, Human
uacccuggucccgggggauuggaggaggaggu

SEQ ID NO: 220913 - RNA, 32 nt, Human
uacccugucauccaguucccugccucggagau

SEQ ID NO: 220914 - RNA, 32 nt, Human
uacccuguccccagaugcacuaacagaugggg

SEQ ID NO: 220915 - RNA, 21 nt, Human
uacccugucuucuagccccac

SEQ ID NO: 220916 - RNA, 32 nt, Human
uacccuguggaggaaugcuggaagaacauaaa

SEQ ID NO: 220917 - RNA, 32 nt, Human
uacccugugucacacccagcaagaaguuuuuc

SEQ ID NO: 220918 - RNA, 32 nt, Human
uacccuguguggucugcaggacuggacuguuu

SEQ ID NO: 220919 - RNA, 32 nt, Human
uacccuguuauccucagcaacaaaacccacau

SEQ ID NO: 220920 - RNA, 32 nt, Human
uacccuguuuuaugauuguuccuugaaaguca

SEQ ID NO: 220921 - RNA, 32 nt, Human
uacccuuaaacacauccuuucuccccugggcu

SEQ ID NO: 220922 - RNA, 25 nt, Human
uacccuuacacucugaaguuguguu

SEQ ID NO: 220923 - RNA, 20 nt, Human
uacccuuauuuugaauugcu

SEQ ID NO: 220924 - RNA, 32 nt, Human
uacccuucagcaauggcuacuagaaggacgaa

SEQ ID NO: 220925 - RNA, 32 nt, Human
uacccuucagcuuugaccccaacaccgcagcu

SEQ ID NO: 220926 - RNA, 32 nt, Human
uacccuucaggacccuccccaccagcucagcc

SEQ ID NO: 220927 - RNA, 32 nt, Human
uacccuucauccacuuuuaucucuuuccaauc

SEQ ID NO: 220928 - RNA, 32 nt, Human
uacccuucccugcgggcucucuccccgacaca

SEQ ID NO: 220929 - RNA, 32 nt, Human
uacccuuccucaccacuucccucagucccaac

SEQ ID NO: 220930 - RNA, 32 nt, Human
uacccuucuucugagauguccucugccuucca

SEQ ID NO: 220931 - RNA, 32 nt, Human
uacccuucuugcuauuggaaacucagcacauu

SEQ ID NO: 220932 - RNA, 32 nt, Human
uacccuucuugcuucagacuccagcaaauucc

SEQ ID NO: 220933 - RNA, 32 nt, Human
uacccuugcagggggccagggagucaagaaua

SEQ ID NO: 220934 - RNA, 32 nt, Human
uacccuugcugcucugcauuugccaguuuauu

SEQ ID NO: 220935 - RNA, 32 nt, Human
uacccuuucugauguguguggccauuggacua

SEQ ID NO: 220936 - RNA, 32 nt, Human
uacccuuucugcacuccgugggcccugggugc

SEQ ID NO: 220937 - RNA, 32 nt, Human
uacccuuugucucgcaugagugcaauauuuca

SEQ ID NO: 220938 - RNA, 32 nt, Human
uacccuuuugcaauguacgugccugaaggggu

SEQ ID NO: 220939 - RNA, 32 nt, Human
uaccgaaggccuucugauuuagcauuuuugca

SEQ ID NO: 220940 - RNA, 32 nt, Human
uaccgacaagcacagucagguugaagaccuaa

SEQ ID NO: 220941 - RNA, 32 nt, Human
uaccgaccaagaaagcuccucccccguccucc

SEQ ID NO: 220942 - RNA, 32 nt, Human
uaccgagaagguuggagguggggaaggcuuug

SEQ ID NO: 220943 - RNA, 32 nt, Human
uaccgagagacacggucuggacagcccaaggc

SEQ ID NO: 220944 - RNA, 32 nt, Human
uaccgagagccaaacagagcccagggagacuc

SEQ ID NO: 220945 - RNA, 22 nt, Human
uaccgagcagauaaaacucaga

SEQ ID NO: 220946 - RNA, 32 nt, Human
uaccgaggguuccuggcugugaggaaacagcc

SEQ ID NO: 220947 - RNA, 32 nt, Human
uaccgaguucaagugauuuuccugccuuggcc

SEQ ID NO: 220948 - RNA, 32 nt, Human
uaccgaugauacuguuucuugcacugaauaua

SEQ ID NO: 220949 - RNA, 32 nt, Human
uaccgaugccuaggacacugcaguguuuagaa

SEQ ID NO: 220950 - RNA, 32 nt, Human
uaccgcagagggcagaaaggugcccuguagcg

SEQ ID NO: 220951 - RNA, 32 nt, Human
uaccgcagaguuguauaaucgccacccuccac

SEQ ID NO: 220952 - RNA, 32 nt, Human
uaccgcauuuggaaccaugcgagugauaccua

SEQ ID NO: 220953 - RNA, 32 nt, Human
uaccgccaccuauucaagcucucagcuacucc

SEQ ID NO: 220954 - RNA, 32 nt, Human
uaccgccagacaccuccccagaggccuuggac

SEQ ID NO: 220955 - RNA, 32 nt, Human
uaccgccccugccaucuucauuucuggcugca

SEQ ID NO: 220956 - RNA, 32 nt, Human
uaccgccggcugcuguggagugccucgcuguc

SEQ ID NO: 220957 - RNA, 32 nt, Human
uaccgcugcacuccagccugggugauagagca

SEQ ID NO: 220958 - RNA, 32 nt, Human
uaccgcugugcuuggaauucagcagcugucaa

SEQ ID NO: 220959 - RNA, 32 nt, Human
uaccggaagaagugaaacguguggaaaaugcc

SEQ ID NO: 220960 - RNA, 32 nt, Human
uaccggauucccgaguuugggaggcucugcuu

SEQ ID NO: 220961 - RNA, 20 nt, Human
uaccggcaggcugugcagga

SEQ ID NO: 220962 - RNA, 32 nt, Human
uaccggcaugagccacugcaccagccccaggg

SEQ ID NO: 220963 - RNA, 32 nt, Human
uaccggcaugagccacugcgccuggccgacaa

SEQ ID NO: 220964 - RNA, 21 nt, Human
uaccggcccagccccucuucc

SEQ ID NO: 220965 - RNA, 32 nt, Human
uaccggcccauguuucuauuugcauuuccccc

SEQ ID NO: 220966 - RNA, 32 nt, Human
uaccggccuggugccaaacuggcuacugcugc

SEQ ID NO: 220967 - RNA, 20 nt, Human
uaccggcgcacgccaccacg

SEQ ID NO: 220968 - RNA, 20 nt, Human
uaccggcgcccaccaccacg

SEQ ID NO: 220969 - RNA, 32 nt, Human
uaccggcguaagccacuaugcccagcccaaga

SEQ ID NO: 220970 - RNA, 32 nt, Human
uaccggcgugagccaccaugcccagccuaucu

SEQ ID NO: 220971 - RNA, 32 nt, Human
uaccggcgugagccaccaugccuggcccggau

SEQ ID NO: 220972 - RNA, 32 nt, Human
uaccggcgugcaccaccaugccaggcuaauuu

SEQ ID NO: 220973 - RNA, 32 nt, Human
uaccggcuugagccaccacacccggcacaucu

SEQ ID NO: 220974 - RNA, 32 nt, Human
uaccgggacgaaggccagagaccccaccgcuc

SEQ ID NO: 220975 - RNA, 24 nt, Human
uaccgggccagagcuuagaaugag

SEQ ID NO: 220976 - RNA, 32 nt, Human
uaccggggaggcugaggcaggagaaucgcuag

SEQ ID NO: 220977 - RNA, 32 nt, Human
uaccggggcuggcuagucaugggggagcccag

SEQ ID NO: 220978 - RNA, 32 nt, Human
uaccgggguggaagggagggucagggaagaaa

SEQ ID NO: 220979 - RNA, 32 nt, Human
uaccggguucaagugauucuugugccucagcc

SEQ ID NO: 220980 - RNA, 32 nt, Human
uaccgguccuccauuuuggugccugcaaagcu

SEQ ID NO: 220981 - RNA, 32 nt, Human
uaccggugcuucuggaaacuaccaggugugcc

SEQ ID NO: 220982 - RNA, 32 nt, Human
uaccggugugagccaccgcgccggcccagcug

SEQ ID NO: 220983 - RNA, 32 nt, Human
uaccggugugagccacugcgcccggccuuuuu

SEQ ID NO: 220984 - RNA, 32 nt, Human
uaccgucagaucuacuucuucacuuucauuuu

SEQ ID NO: 220985 - RNA, 32 nt, Human
uaccguccacauuccucacuacuaaccaagcu

SEQ ID NO: 220986 - RNA, 23 nt, Human
uaccgucccgugaagacagcaua

SEQ ID NO: 220987 - RNA, 32 nt, Human
uaccguccucccggugaaggcuugugaagcaa

SEQ ID NO: 220988 - RNA, 32 nt, Human
uaccguccucuagacuauuuuucuugaauacc

SEQ ID NO: 220989 - RNA, 32 nt, Human
uaccguccugacccuugucauccacuacuugg

SEQ ID NO: 220990 - RNA, 32 nt, Human
uaccgucgcucagcaacaccaaaaagagaaag

SEQ ID NO: 220991 - RNA, 32 nt, Human
uaccgucugggaggauugcuggcugguuuccu

SEQ ID NO: 220992 - RNA, 32 nt, Human
uaccgucuucucccuauucccucucucuccca

SEQ ID NO: 220993 - RNA, 31 nt, Human
uaccguggcacaaucucggcucauugcaacc

SEQ ID NO: 220994 - RNA, 32 nt, Human
uaccguggguagagcaaggaggcccaggugug

SEQ ID NO: 220995 - RNA, 32 nt, Human
uaccguguccugcuuaggggaaggugauugga

SEQ ID NO: 220996 - RNA, 32 nt, Human
uaccgugucuucacucuccagccugagguggu

SEQ ID NO: 220997 - RNA, 32 nt, Human
uaccguguucugucugugucuucaggagucuc

SEQ ID NO: 220998 - RNA, 32 nt, Human
uaccguguuggccaggcuggucucgaacuccu

SEQ ID NO: 220999 - RNA, 32 nt, Human
uaccguguuuucuuuguauuguguucuaccuu

SEQ ID NO: 221000 - RNA, 32 nt, Human
uaccguucacggggauuccggaacccucagag

SEQ ID NO: 221001 - RNA, 32 nt, Human
uaccguucccugcugguugagaguugggggcu

SEQ ID NO: 221002 - RNA, 32 nt, Human
uaccguuuucauuuuccaacagucuacuagag

SEQ ID NO: 221003 - RNA, 32 nt, Human
uaccuaaaaggauauguuaucacuggaauuua

SEQ ID NO: 221004 - RNA, 32 nt, Human
uaccuaaccucucugugccucaguuuaccaag

SEQ ID NO: 221005 - RNA, 30 nt, Human
uaccuaagcuagcaaucagaagcuacaugg

SEQ ID NO: 221006 - RNA, 32 nt, Human
uaccuaaucucaccaucucuucacuucuagcu

SEQ ID NO: 221007 - RNA, 32 nt, Human
uaccuaaucugccucugccucuguuuaauaag

SEQ ID NO: 221008 - RNA, 32 nt, Human
uaccuacaaagaacacugaaaggugaugugug

SEQ ID NO: 221009 - RNA, 32 nt, Human
uaccuacaaauacuguaaaaugccuaggaauu

SEQ ID NO: 221010 - RNA, 32 nt, Human
uaccuacaaugccaaagccucacugucacccu

SEQ ID NO: 221011 - RNA, 21 nt, Human
uaccuaccagcuguaugagaa

SEQ ID NO: 221012 - RNA, 24 nt, Human
uaccuaccugcaagugguucagug

SEQ ID NO: 221013 - RNA, 32 nt, Human
uaccuacuagcccucgcccuccuagggccugg

SEQ ID NO: 221014 - RNA, 32 nt, Human
uaccuacuaugugcaagcauuguguuagguac

SEQ ID NO: 221015 - RNA, 32 nt, Human
uaccuacugaguaggcggcgauuuuuguaugu

SEQ ID NO: 221016 - RNA, 32 nt, Human
uaccuacuuauucuaaagaagaaaaggacuuu

SEQ ID NO: 221017 - RNA, 32 nt, Human
uaccuagaccacaggugcgcaccaccauaccc

SEQ ID NO: 221018 - RNA, 32 nt, Human
uaccuagagcaggggucgccaaauguuuucuu

SEQ ID NO: 221019 - RNA, 32 nt, Human
uaccuagauaaugccaaagucagcauuugucc

SEQ ID NO: 221020 - RNA, 32 nt, Human
uaccuagauuccauacagugacaauacaaaua

SEQ ID NO: 221021 - RNA, 32 nt, Human
uaccuagcgcugcaggcuccugggcgauugua

SEQ ID NO: 221022 - RNA, 32 nt, Human
uaccuaggaaugcagaacaagggcaagaaacu

SEQ ID NO: 221023 - RNA, 32 nt, Human
uaccuagggugccucccagccugguggaccca

SEQ ID NO: 221024 - RNA, 32 nt, Human
uaccuaggucucagggcacggaggcagaacug

SEQ ID NO: 221025 - RNA, 32 nt, Human
uaccuagguguggagucuuguacauugccauc

SEQ ID NO: 221026 - RNA, 32 nt, Human
uaccuauaaagugaguguucugccugugugug

SEQ ID NO: 221027 - RNA, 32 nt, Human
uaccuauacauacgugcacacacacauacaua

SEQ ID NO: 221028 - RNA, 32 nt, Human
uaccuauacccaaauguucccucccccgacau

SEQ ID NO: 221029 - RNA, 32 nt, Human
uaccuaucaaagcugaaccagagccagacucc

SEQ ID NO: 221030 - RNA, 32 nt, Human
uaccuaucuaacacagucuuugucuuacuauc

SEQ ID NO: 221031 - RNA, 32 nt, Human
uaccuaugacucggcucugccucccaguccgc

SEQ ID NO: 221032 - RNA, 32 nt, Human
uaccuaugugcccgguuuuacucucauuuggg

SEQ ID NO: 221033 - RNA, 32 nt, Human
uaccuauuccaagugaagaauuccaaggguag

SEQ ID NO: 221034 - RNA, 32 nt, Human
uaccucaacacaguugcuuuucugccuugucu

SEQ ID NO: 221035 - RNA, 32 nt, Human
uaccucaacacuucacuccauggcaguucccg

SEQ ID NO: 221036 - RNA, 30 nt, Human
uaccucaaccccucaucaucuccaggaaag

SEQ ID NO: 221037 - RNA, 32 nt, Human
uaccucaacugccucucacuucccaagacaaa

SEQ ID NO: 221038 - RNA, 24 nt, Human
uaccucaagugauccacccaccuc

SEQ ID NO: 221039 - RNA, 32 nt, Human
uaccucacaccuguaaucccagcacuuaggua

SEQ ID NO: 221040 - RNA, 32 nt, Human
uaccucacagcagcccugggggugggugcaau

SEQ ID NO: 221041 - RNA, 32 nt, Human
uaccucacagggcuguugugaggacccaggga

SEQ ID NO: 221042 - RNA, 32 nt, Human
uaccucacagggcuguugugaggaucaaauga

SEQ ID NO: 221043 - RNA, 32 nt, Human
uaccucacagggcuguugugaggaucagagag

SEQ ID NO: 221044 - RNA, 32 nt, Human
uaccucacagggcuguugugaggauuaaauga

SEQ ID NO: 221045 - RNA, 32 nt, Human
uaccucacagggguguugugaggacugagaag

SEQ ID NO: 221046 - RNA, 32 nt, Human
uaccucacaggguuguugugaggaucaaguaa

SEQ ID NO: 221047 - RNA, 32 nt, Human
uaccucacaggguuguugugaggauuacauau

SEQ ID NO: 221048 - RNA, 32 nt, Human
uaccucacaggguuguugugaggauuuaaauu

SEQ ID NO: 221049 - RNA, 32 nt, Human
uaccucaccaugguuuuucacauugcaaaggg

SEQ ID NO: 221050 - RNA, 18 nt, Human
uaccucaccccugccugg

SEQ ID NO: 221051 - RNA, 32 nt, Human
uaccucaccccuguaaucccagcacuuugggu

SEQ ID NO: 221052 - RNA, 32 nt, Human
uaccucacugcacagcuucuagguagccuucc

SEQ ID NO: 221053 - RNA, 32 nt, Human
uaccucacugcagcuucaacuuccugggcuca

SEQ ID NO: 221054 - RNA, 32 nt, Human
uaccucacugcauuccagccugggcaacagag

SEQ ID NO: 221055 - RNA, 32 nt, Human
uaccucacugcauuccggccugggcaacagag

SEQ ID NO: 221056 - RNA, 32 nt, Human
uaccucagacuguuuguuuucuuucugggaag

SEQ ID NO: 221057 - RNA, 32 nt, Human
uaccucagcaaacaaaaggaauggaggaggag

SEQ ID NO: 221058 - RNA, 32 nt, Human
uaccucagccuccugaguagcuggaacugcag

SEQ ID NO: 221059 - RNA, 32 nt, Human
uaccucagccuccugaguagcugggauuacag

SEQ ID NO: 221060 - RNA, 32 nt, Human
uaccucaggaacaccaccagacaaauauagac

SEQ ID NO: 221061 - RNA, 32 nt, Human
uaccucaggccugggggcucccccgacuuguu

SEQ ID NO: 221062 - RNA, 24 nt, Human
uaccucaggugauccacccaccuc

SEQ ID NO: 221063 - RNA, 32 nt, Human
uaccucaguauuucagcaccuuaagcacugau

SEQ ID NO: 221064 - RNA, 32 nt, Human
uaccucagucuccugaguagcugggaugacag

SEQ ID NO: 221065 - RNA, 21 nt, Human
uaccucauaagcugcagugag

SEQ ID NO: 221066 - RNA, 32 nt, Human
uaccucauagggcuguugugaggauuaggaug

SEQ ID NO: 221067 - RNA, 32 nt, Human
uaccucauccaccucuuccauaccuuuacagg

SEQ ID NO: 221068 - RNA, 32 nt, Human
uaccucauuagcaaaugauggugagacugaag

SEQ ID NO: 221069 - RNA, 32 nt, Human
uaccucauugggccugugauguuaacauuucg

SEQ ID NO: 221070 - RNA, 32 nt, Human
uaccucauuuucuauuucacaaggaguggcuc

SEQ ID NO: 221071 - RNA, 32 nt, Human
uaccuccaacacagccaagcucugauaccuca

SEQ ID NO: 221072 - RNA, 32 nt, Human
uaccuccaaguugcacuguuuacuuauucauc

SEQ ID NO: 221073 - RNA, 32 nt, Human
uaccuccacggccaccacgugcuccaccuaga

SEQ ID NO: 221074 - RNA, 32 nt, Human
uaccuccacuuccuuucccuugcucacucugg

SEQ ID NO: 221075 - RNA, 32 nt, Human
uaccuccacuucguacuucuguauaaacuaac

SEQ ID NO: 221076 - RNA, 32 nt, Human
uaccuccagauccagggaggccaacgugccau

SEQ ID NO: 221077 - RNA, 32 nt, Human
uaccuccagcagcuggacauggggaggcgaca

SEQ ID NO: 221078 - RNA, 32 nt, Human
uaccuccaggaccuggaguguacuggaagaaa

SEQ ID NO: 221079 - RNA, 32 nt, Human
uaccuccaguaaaacacugcauuuuucuguga

SEQ ID NO: 221080 - RNA, 32 nt, Human
uaccuccauacccagcccuauacgcagaccca

SEQ ID NO: 221081 - RNA, 32 nt, Human
uaccuccaugucuggucacauggcuggacuuu

SEQ ID NO: 221082 - RNA, 32 nt, Human
uaccuccaugugcccuuuuuagggaagcuguu

SEQ ID NO: 221083 - RNA, 32 nt, Human
uaccucccaaagugcugggauuacagacauga

SEQ ID NO: 221084 - RNA, 32 nt, Human
uaccucccaaagugcugggauuacaggcauga

SEQ ID NO: 221085 - RNA, 32 nt, Human
uaccucccaaagugcugggauuacagucguga

SEQ ID NO: 221086 - RNA, 32 nt, Human
uaccucccaaggcagccuccugccuuuggacu

SEQ ID NO: 221087 - RNA, 32 nt, Human
uaccucccaagugccugguacauagugggugc

SEQ ID NO: 221088 - RNA, 32 nt, Human
uaccucccacuuccugagcccugaguggaagc

SEQ ID NO: 221089 - RNA, 32 nt, Human
uaccucccagggcuauugguuuuuaucuuaga

SEQ ID NO: 221090 - RNA, 32 nt, Human
uaccuccccacuguggcugguaacaccccagg

SEQ ID NO: 221091 - RNA, 32 nt, Human
uaccuccccaugacaccuaggcugucagucuc

SEQ ID NO: 221092 - RNA, 32 nt, Human
uaccucccgaagugcugagauuaugggcguga

SEQ ID NO: 221093 - RNA, 32 nt, Human
uaccucccugcccuucuccuccuuccuggcug

SEQ ID NO: 221094 - RNA, 32 nt, Human
uaccucccugcucccuggcuggcccacugcac

SEQ ID NO: 221095 - RNA, 32 nt, Human
uaccuccuaacuggucacccugccucaaaucu

SEQ ID NO: 221096 - RNA, 32 nt, Human
uaccuccugagaccuccguccucugcuuuccg

SEQ ID NO: 221097 - RNA, 32 nt, Human
uaccuccugaguaacugggauuacagucgugu

SEQ ID NO: 221098 - RNA, 32 nt, Human
uaccuccuguaagaggacuggaggggaagcgg

SEQ ID NO: 221099 - RNA, 32 nt, Human
uaccuccuucacccuucacuccugcccuccuc

SEQ ID NO: 221100 - RNA, 32 nt, Human
uaccuccuuccccucacuccuccccuccuucg

SEQ ID NO: 221101 - RNA, 32 nt, Human
uaccuccuuccccucauuccuccccuccuucg

SEQ ID NO: 221102 - RNA, 32 nt, Human
uaccuccuuggagaugagauagggaaggagca

SEQ ID NO: 221103 - RNA, 32 nt, Human
uaccucgaagaauguaaaaagacuuuaagugc

SEQ ID NO: 221104 - RNA, 32 nt, Human
uaccucgagggaggggcguggggaaggcggcg

SEQ ID NO: 221105 - RNA, 32 nt, Human
uaccucgcaggguuguugugaggauuuaaugc

SEQ ID NO: 221106 - RNA, 32 nt, Human
uaccucgcugaauugugcauugcaguuauugu

SEQ ID NO: 221107 - RNA, 32 nt, Human
uaccucgcugggaacgcacuuccugggacgcu

SEQ ID NO: 221108 - RNA, 32 nt, Human
uaccucggcgggaccgccaugguucugcugca

SEQ ID NO: 221109 - RNA, 32 nt, Human
uaccucggguuggggugggagccccagccaaa

SEQ ID NO: 221110 - RNA, 22 nt, Human
uaccucuaaaugaggugaaauu

SEQ ID NO: 221111 - RNA, 32 nt, Human
uaccucuaaugaagcacagagagaggaagaga

SEQ ID NO: 221112 - RNA, 32 nt, Human
uaccucuagcagccccucugcuccugggagcu

SEQ ID NO: 221113 - RNA, 23 nt, Human
uaccucuauaaacuuggacgaua

SEQ ID NO: 221114 - RNA, 32 nt, Human
uaccucuaugguuuuccucgcuuucuugagcu

SEQ ID NO: 221115 - RNA, 32 nt, Human
uaccucucagcuuacucuucaggggauaugaa

SEQ ID NO: 221116 - RNA, 32 nt, Human
uaccucuccagccucagcucucaguugcagcc

SEQ ID NO: 221117 - RNA, 32 nt, Human
uaccucuccuacguauuauuuucuugacccaa

SEQ ID NO: 221118 - RNA, 32 nt, Human
uaccucucgaugguucucuccugggcucaggc

SEQ ID NO: 221119 - RNA, 32 nt, Human
uaccucucgccuggaggaucugugccaucuug

SEQ ID NO: 221120 - RNA, 32 nt, Human
uaccucucuaucuuucuauucucaccaauaau

SEQ ID NO: 221121 - RNA, 32 nt, Human
uaccucucuguucugcaagagcuggaagcucc

SEQ ID NO: 221122 - RNA, 21 nt, Human
uaccucucuguuugguuuaga

SEQ ID NO: 221123 - RNA, 32 nt, Human
uaccucugcacugcagccugggcaacagaaug

SEQ ID NO: 221124 - RNA, 32 nt, Human
uaccucugcauucaacaaggagagaacacgac

SEQ ID NO: 221125 - RNA, 32 nt, Human
uaccucugcccugcccuccagccugggacaau

SEQ ID NO: 221126 - RNA, 32 nt, Human
uaccucuggcagcuggcccaggaagagccagc

SEQ ID NO: 221127 - RNA, 32 nt, Human
uaccucuguaccaacagaggagggaucaugag

SEQ ID NO: 221128 - RNA, 32 nt, Human
uaccucuguagauaggucacugguuuuuguuu

SEQ ID NO: 221129 - RNA, 32 nt, Human
uaccucugugugcuccuccuuggugccuggcc

SEQ ID NO: 221130 - RNA, 32 nt, Human
uaccucuguuuaaaaugcucuguuaauuauua

SEQ ID NO: 221131 - RNA, 32 nt, Human
uaccucuuaccuguaaccuaccuuaucaugug

SEQ ID NO: 221132 - RNA, 32 nt, Human
uaccucuuacuucaaauucuucugccucccuc

SEQ ID NO: 221133 - RNA, 32 nt, Human
uaccucuuagcccucuacuguugaccaaucac

SEQ ID NO: 221134 - RNA, 32 nt, Human
uaccucuuauacucaucuccccaaauuauuug

SEQ ID NO: 221135 - RNA, 32 nt, Human
uaccucuuauuucucauugagccucaggcuau

SEQ ID NO: 221136 - RNA, 32 nt, Human
uaccucuucaggucuugagaacauggaaaaga

SEQ ID NO: 221137 - RNA, 32 nt, Human
uaccucuugcccagcugccucuucugaaaucc

SEQ ID NO: 221138 - RNA, 32 nt, Human
uaccucuugcuccucauuccuccccugcccuu

SEQ ID NO: 221139 - RNA, 32 nt, Human
uaccucuuucaggguuuucuaacccugacacg

SEQ ID NO: 221140 - RNA, 32 nt, Human
uaccugaaagcuccuggcaaugcuggaaaauu

SEQ ID NO: 221141 - RNA, 32 nt, Human
uaccugaaccccucuugccacugccuucuacc

SEQ ID NO: 221142 - RNA, 32 nt, Human
uaccugaagagaggugagaccaaggccacagg

SEQ ID NO: 221143 - RNA, 32 nt, Human
uaccugaagauccuccccauguucuucaucgu

SEQ ID NO: 221144 - RNA, 32 nt, Human
uaccugaagcgccggccccuggaauugccccg

SEQ ID NO: 221145 - RNA, 32 nt, Human
uaccugaaguugauguagucacucugguuuug

SEQ ID NO: 221146 - RNA, 32 nt, Human
uaccugacacugagcucaugcagagagaugau

SEQ ID NO: 221147 - RNA, 32 nt, Human
uaccugaccugucugcaccugugugacagccc

SEQ ID NO: 221148 - RNA, 32 nt, Human
uaccugacucaaggagugucuggagcaccucc

SEQ ID NO: 221149 - RNA, 32 nt, Human
uaccugacucacaaccuucuaaucccaugauc

SEQ ID NO: 221150 - RNA, 32 nt, Human
uaccugagagugagagauguguaggaagaaua

SEQ ID NO: 221151 - RNA, 32 nt, Human
uaccugagcccaggaagcagagauuccaguga

SEQ ID NO: 221152 - RNA, 32 nt, Human
uaccugagguuaggaguuugagaccagccuga

SEQ ID NO: 221153 - RNA, 32 nt, Human
uaccugaguccaagaauguggaaauguaucug

SEQ ID NO: 221154 - RNA, 32 nt, Human
uaccugaucagagagaaaagaaaaucugcaga

SEQ ID NO: 221155 - RNA, 18 nt, Human
uaccugcaaccucuucca

SEQ ID NO: 221156 - RNA, 32 nt, Human
uaccugcacacagaagcccauugucgccggcg

SEQ ID NO: 221157 - RNA, 22 nt, Human
uaccugcaccgccccuucucca

SEQ ID NO: 221158 - RNA, 32 nt, Human
uaccugcacgaugggagcaagacacugacggu

SEQ ID NO: 221159 - RNA, 22 nt, Human
uaccugcacuuccccucucaca

SEQ ID NO: 221160 - RNA, 32 nt, Human
uaccugcagcgacucaacccuaugcauggagg

SEQ ID NO: 221161 - RNA, 32 nt, Human
uaccugcagcuuuuccugcuugauauagcaca

SEQ ID NO: 221162 - RNA, 32 nt, Human
uaccugccaaaugcuauacugugucaugguga

SEQ ID NO: 221163 - RNA, 32 nt, Human
uaccugccaguggagcugagcacugccuagcc

SEQ ID NO: 221164 - RNA, 32 nt, Human
uaccugcccaacuuuauccagagcgugcuguc

SEQ ID NO: 221165 - RNA, 22 nt, Human
uaccugcccagccccuccccca

SEQ ID NO: 221166 - RNA, 32 nt, Human
uaccugcccucagaccugccacagcccuucaa

SEQ ID NO: 221167 - RNA, 32 nt, Human
uaccugcccugcugccugcacacugcaugccu

SEQ ID NO: 221168 - RNA, 32 nt, Human
uaccugccugcggggagaauggagccagggga

SEQ ID NO: 221169 - RNA, 32 nt, Human
uaccugccuuucucucugcaccuaagucccug

SEQ ID NO: 221170 - RNA, 32 nt, Human
uaccugcguucuguggccugcuccccgccugc

SEQ ID NO: 221171 - RNA, 19 nt, Human
uaccugcucaaggucagug

SEQ ID NO: 221172 - RNA, 32 nt, Human
uaccugcuccacccucaauccaccagaaccau

SEQ ID NO: 221173 - RNA, 32 nt, Human
uaccugcuccacccugacucauuccgauuacc

SEQ ID NO: 221174 - RNA, 32 nt, Human
uaccugcucuccccuggacuucuuuuucaaua

SEQ ID NO: 221175 - RNA, 32 nt, Human
uaccugcuucccaauuacucauuuccucagau

SEQ ID NO: 221176 - RNA, 32 nt, Human
uaccugcuuccucuuuuucuugcaaguuuuaa

SEQ ID NO: 221177 - RNA, 32 nt, Human
uaccugcuugcucaagcaaccugcugccucca

SEQ ID NO: 221178 - RNA, 32 nt, Human
uaccugcuuugcauauucacacauggucaacu

SEQ ID NO: 221179 - RNA, 32 nt, Human
uaccuggaagaaaaccagacgaaugaaggauu

SEQ ID NO: 221180 - RNA, 32 nt, Human
uaccuggaagaagccauugagcucuccggcug

SEQ ID NO: 221181 - RNA, 32 nt, Human
uaccuggaagguaguaggagcagaugguggga

SEQ ID NO: 221182 - RNA, 32 nt, Human
uaccuggacgggcccaggcuuggggacucuga

SEQ ID NO: 221183 - RNA, 32 nt, Human
uaccuggaggaagggaagaaaccacaagcauu

SEQ ID NO: 221184 - RNA, 32 nt, Human
uaccuggaggaugagggcaggagcaaggcgcg

SEQ ID NO: 221185 - RNA, 32 nt, Human
uaccuggauaccugagcugccaccuguguauc

SEQ ID NO: 221186 - RNA, 32 nt, Human
uaccuggauccaguuauggugccucaggggcu

SEQ ID NO: 221187 - RNA, 32 nt, Human
uaccuggaugcauguaugcacacacaugcgcg

SEQ ID NO: 221188 - RNA, 32 nt, Human
uaccuggauuguagggaggggugcacaguguu

SEQ ID NO: 221189 - RNA, 32 nt, Human
uaccuggccccucgccuguggagcucagcccu

SEQ ID NO: 221190 - RNA, 32 nt, Human
uaccuggcccuuccagccccagccuuuggagc

SEQ ID NO: 221191 - RNA, 32 nt, Human
uaccuggccugaucacugugugccacacccca

SEQ ID NO: 221192 - RNA, 32 nt, Human
uaccuggcucuaucucacuggcugcauucccu

SEQ ID NO: 221193 - RNA, 32 nt, Human
uaccugggaacugucuaaagucuacacacaua

SEQ ID NO: 221194 - RNA, 32 nt, Human
uaccugggaagcgcagguugcagugagcugag

SEQ ID NO: 221195 - RNA, 32 nt, Human
uaccugggaggaaggcuuuuccuucacaauug

SEQ ID NO: 221196 - RNA, 32 nt, Human
uaccugggaggaggagguugcagugagcugag

SEQ ID NO: 221197 - RNA, 32 nt, Human
uaccugggaggcagaggguguuaugggaggaa

SEQ ID NO: 221198 - RNA, 32 nt, Human
uaccugggaggcggagauugcagugagccgag

SEQ ID NO: 221199 - RNA, 32 nt, Human
uaccugggaggcugaggaaggagaaucgcuug

SEQ ID NO: 221200 - RNA, 32 nt, Human
uaccugggaggcugaggcaggagaaucgcuug

SEQ ID NO: 221201 - RNA, 32 nt, Human
uaccugggaggcugaggcaggagaauugcugg

SEQ ID NO: 221202 - RNA, 32 nt, Human
uaccugggagguggagggagacaggagagaaa

SEQ ID NO: 221203 - RNA, 32 nt, Human
uaccugggauacugugcccagagccucgagga

SEQ ID NO: 221204 - RNA, 32 nt, Human
uaccugggauucggggcguggcccagaaagac

SEQ ID NO: 221205 - RNA, 32 nt, Human
uaccugggccaggccaggaaagagacuauuua

SEQ ID NO: 221206 - RNA, 32 nt, Human
uaccugggcucuggggaggcugugggccugga

SEQ ID NO: 221207 - RNA, 32 nt, Human
uaccuggggaccccugucugcacaccagggau

SEQ ID NO: 221208 - RNA, 32 nt, Human
uaccuggggagaggugucauuuggaugugagg

SEQ ID NO: 221209 - RNA, 32 nt, Human
uaccugguaggugacuggagguguugaucagu

SEQ ID NO: 221210 - RNA, 32 nt, Human
uaccuggucccuucuagguguggucccauagg

SEQ ID NO: 221211 - RNA, 32 nt, Human
uaccuggugagucuggaauggucucugggcuc

SEQ ID NO: 221212 - RNA, 32 nt, Human
uaccugguggccccuccagauggucuccacca

SEQ ID NO: 221213 - RNA, 22 nt, Human
uaccugguuguacaacuuuagc

SEQ ID NO: 221214 - RNA, 32 nt, Human
uaccuguacaacgacucugccucuuagaugau

SEQ ID NO: 221215 - RNA, 32 nt, Human
uaccuguacacauuccugcauucauguauuuu

SEQ ID NO: 221216 - RNA, 32 nt, Human
uaccuguaggacucaaagggagccaggacccc

SEQ ID NO: 221217 - RNA, 23 nt, Human
uaccuguauccaauuuguauuau

SEQ ID NO: 221218 - RNA, 32 nt, Human
uaccugucacugcaaaugcuuugucucugggc

SEQ ID NO: 221219 - RNA, 16 nt, Human
uaccugucaggaugac

SEQ ID NO: 221220 - RNA, 32 nt, Human
uaccugucaucugggccaccagcuccacuggc

SEQ ID NO: 221221 - RNA, 32 nt, Human
uaccugucauuuccuacccuuagugccuugua

SEQ ID NO: 221222 - RNA, 32 nt, Human
uaccuguccaugucuuauacuuugaccgcgau

SEQ ID NO: 221223 - RNA, 31 nt, Human
uaccugucccucucuggcuugguccccuucc

SEQ ID NO: 221224 - RNA, 32 nt, Human
uaccugucccuuggcuaugagcaggcuuuggg

SEQ ID NO: 221225 - RNA, 32 nt, Human
uaccugucucuauccaugcugucaacuccugc

SEQ ID NO: 221226 - RNA, 32 nt, Human
uaccugugcuaggguuuucacacugggagugc

SEQ ID NO: 221227 - RNA, 32 nt, Human
uaccuguggagcugucuguagguugggaagug

SEQ ID NO: 221228 - RNA, 32 nt, Human
uaccuguggcuggcugugcugguugagcccga

SEQ ID NO: 221229 - RNA, 32 nt, Human
uaccugugguaugugggcauguuuacugccac

SEQ ID NO: 221230 - RNA, 32 nt, Human
uaccugugugugugcaugugcacguguuugag

SEQ ID NO: 221231 - RNA, 32 nt, Human
uaccuguguuuaaauuauggauaacucgaaag

SEQ ID NO: 221232 - RNA, 32 nt, Human
uaccuguuacaccaauggauuguaauacuggu

SEQ ID NO: 221233 - RNA, 32 nt, Human
uaccuguucugcaggcggguccuggccucccc

SEQ ID NO: 221234 - RNA, 32 nt, Human
uaccuguucuggaagggagaggggcuggaggc

SEQ ID NO: 221235 - RNA, 27 nt, Human
uaccuguucuggauauuucacauaaau

SEQ ID NO: 221236 - RNA, 32 nt, Human
uaccuguugccucacauuggcaaaagaggggg

SEQ ID NO: 221237 - RNA, 32 nt, Human
uaccuguuguggacugaauugcgucaaauuca

SEQ ID NO: 221238 - RNA, 32 nt, Human
uaccuguuucaaggaccugccagucugagaag

SEQ ID NO: 221239 - RNA, 32 nt, Human
uaccuguuucugcugcuagaagauccaggaaa

SEQ ID NO: 221240 - RNA, 23 nt, Human
uaccuuaaagagagaugugaaga

SEQ ID NO: 221241 - RNA, 24 nt, Human
uaccuuaaagagauaaaaugcaga

SEQ ID NO: 221242 - RNA, 32 nt, Human
uaccuuaaccucugaacucugaccucaggagg

SEQ ID NO: 221243 - RNA, 32 nt, Human
uaccuuacaaagccacaggagcagagcugccc

SEQ ID NO: 221244 - RNA, 32 nt, Human
uaccuuacagugagggcuauacaugguagcca

SEQ ID NO: 221245 - RNA, 32 nt, Human
uaccuuacauauaagucucaguaguaucccua

SEQ ID NO: 221246 - RNA, 32 nt, Human
uaccuuaccuccuaagaagaaaagccacuuuc

SEQ ID NO: 221247 - RNA, 32 nt, Human
uaccuuagaacauguugaucugugagugccca

SEQ ID NO: 221248 - RNA, 32 nt, Human
uaccuuagccacccuccucaugcccacccagc

SEQ ID NO: 221249 - RNA, 32 nt, Human
uaccuuagcuggaccucgucucccagggauua

SEQ ID NO: 221250 - RNA, 32 nt, Human
uaccuuagggaaaagaaagggaaguaaauuga

SEQ ID NO: 221251 - RNA, 32 nt, Human
uaccuuaguucuuucucucugacuccuggaag

SEQ ID NO: 221252 - RNA, 32 nt, Human
uaccuuauggucaccacuccugcaacaacaac

SEQ ID NO: 221253 - RNA, 32 nt, Human
uaccuuauuuuccuccuccuccuuggccuacu

SEQ ID NO: 221254 - RNA, 32 nt, Human
uaccuucaaccuggcccaguccccugcgucau

SEQ ID NO: 221255 - RNA, 32 nt, Human
uaccuucaaggcucuucuuccucaccgagcau

SEQ ID NO: 221256 - RNA, 32 nt, Human
uaccuucacacuccugagcuccgccuuccuuu

SEQ ID NO: 221257 - RNA, 32 nt, Human
uaccuucaggcagccagugugacacugcuuua

SEQ ID NO: 221258 - RNA, 32 nt, Human
uaccuuccaaagugcugggauuacaggcguca

SEQ ID NO: 221259 - RNA, 32 nt, Human
uaccuucccaugcaggcuaaagugauuccuuc

SEQ ID NO: 221260 - RNA, 32 nt, Human
uaccuucccgagagcagugucgggcagugggg

SEQ ID NO: 221261 - RNA, 32 nt, Human
uaccuuccucgccuccccucuuccucauucca

SEQ ID NO: 221262 - RNA, 32 nt, Human
uaccuuccuguuucucugaaucagcccauagg

SEQ ID NO: 221263 - RNA, 32 nt, Human
uaccuuccuucccaucgcccugccucgcagcc

SEQ ID NO: 221264 - RNA, 23 nt, Human
uaccuucgugggccuuugauuua

SEQ ID NO: 221265 - RNA, 32 nt, Human
uaccuucucuacccaucucccccaucccccac

SEQ ID NO: 221266 - RNA, 32 nt, Human
uaccuucugaauccauauguagagauuucagc

SEQ ID NO: 221267 - RNA, 32 nt, Human
uaccuucugccuccuccauucuuccugggugc

SEQ ID NO: 221268 - RNA, 32 nt, Human
uaccuucugcuguuuguuccaggcucaccuuu

SEQ ID NO: 221269 - RNA, 32 nt, Human
uaccuucuugaggaugugccagacaguggaaa

SEQ ID NO: 221270 - RNA, 32 nt, Human
uaccuucuuugucccaggcugcuucucuauaa

SEQ ID NO: 221271 - RNA, 32 nt, Human
uaccuugaaaagaagguuggagugcagcuuga

SEQ ID NO: 221272 - RNA, 32 nt, Human
uaccuugaccucaagcccuucaucccacuuug

SEQ ID NO: 221273 - RNA, 32 nt, Human
uaccuugcagaggaaaggugggagagaggaaa

SEQ ID NO: 221274 - RNA, 32 nt, Human
uaccuugccuguaguccagucucuccagcauc

SEQ ID NO: 221275 - RNA, 32 nt, Human
uaccuugggaggccaaggugggcagaucgcuu

SEQ ID NO: 221276 - RNA, 32 nt, Human
uaccuuggucagugaaaagaugcuacuauauu

SEQ ID NO: 221277 - RNA, 32 nt, Human
uaccuuggucucaccuauccugcccucacauc

SEQ ID NO: 221278 - RNA, 32 nt, Human
uaccuugucucucagaucacuaguucagggga

SEQ ID NO: 221279 - RNA, 21 nt, Human
uaccuugugcuuugaagauuu

SEQ ID NO: 221280 - RNA, 32 nt, Human
uaccuuguuauugucucuacuaggaaauuaca

SEQ ID NO: 221281 - RNA, 32 nt, Human
uaccuuguuauuuccauguaccaaaauaaacc

SEQ ID NO: 221282 - RNA, 32 nt, Human
uaccuuguucuaugugaccagaagugcugaug

SEQ ID NO: 221283 - RNA, 19 nt, Human
uaccuuguucuggucacug

SEQ ID NO: 221284 - RNA, 32 nt, Human
uaccuuguuuucacuugugcacugugaaugaa

SEQ ID NO: 221285 - RNA, 32 nt, Human
uaccuuuaaagucagaacaggccaggcccggu

SEQ ID NO: 221286 - RNA, 32 nt, Human
uaccuuuaaguuuguguagacuucugaauaag

SEQ ID NO: 221287 - RNA, 32 nt, Human
uaccuuuacagcuuuuuauuguggacuaaugc

SEQ ID NO: 221288 - RNA, 32 nt, Human
uaccuuuacauggugaaaguucucucuugauc

SEQ ID NO: 221289 - RNA, 32 nt, Human
uaccuuuaucugucuuuaauccaucuuuuuaa

SEQ ID NO: 221290 - RNA, 32 nt, Human
uaccuuuauugcuucuuaaggguccuugcugu

SEQ ID NO: 221291 - RNA, 32 nt, Human
uaccuuucauuucgcacuuucuccucugcugc

SEQ ID NO: 221292 - RNA, 32 nt, Human
uaccuuucauuuucucuuuauguuauucuuuc

SEQ ID NO: 221293 - RNA, 32 nt, Human
uaccuuucuccaccauccagagccacaaaagc

SEQ ID NO: 221294 - RNA, 32 nt, Human
uaccuuucuccccuagugcucaugccccagaa

SEQ ID NO: 221295 - RNA, 32 nt, Human
uaccuuucugacucugucguccaggcuggagu

SEQ ID NO: 221296 - RNA, 32 nt, Human
uaccuuugaacagcaaccaugugggcuacuca

SEQ ID NO: 221297 - RNA, 27 nt, Human
uaccuuugcucucuucauaguguguug

SEQ ID NO: 221298 - RNA, 22 nt, Human
uaccuuuguguaugugcuugaa

SEQ ID NO: 221299 - RNA, 32 nt, Human
uaccuuuuaaggacagugucuuugaauguagg

SEQ ID NO: 221300 - RNA, 32 nt, Human
uaccuuuuccauccuccuccucugccuucaaa

SEQ ID NO: 221301 - RNA, 32 nt, Human
uaccuuuuguccuaagaaaaaggcuugaauuu

SEQ ID NO: 221302 - RNA, 32 nt, Human
uacgaaaaacacagaaagauuagccaggcaua

SEQ ID NO: 221303 - RNA, 32 nt, Human
uacgaaaaauuagcugggcaugguggcgcaca

SEQ ID NO: 221304 - RNA, 24 nt, Human
uacgaaaagcagcugucccaccag

SEQ ID NO: 221305 - RNA, 32 nt, Human
uacgaaacacagaaagggaaaauaaacugacu

SEQ ID NO: 221306 - RNA, 32 nt, Human
uacgaaagucauguuacccaacaccgggaggc

SEQ ID NO: 221307 - RNA, 32 nt, Human
uacgaaggccauaccugccacauuuauaaaau

SEQ ID NO: 221308 - RNA, 32 nt, Human
uacgaagggaccaggccaggccacagggcucu

SEQ ID NO: 221309 - RNA, 32 nt, Human
uacgaaguauucccaaucacuggucaucugac

SEQ ID NO: 221310 - RNA, 32 nt, Human
uacgaagucauccucaagcuucaauuuauuua

SEQ ID NO: 221311 - RNA, 32 nt, Human
uacgaaguucaagaucaaaaaggcuuauaaaa

SEQ ID NO: 221312 - RNA, 32 nt, Human
uacgaaucguacuucuuuaauugaucuaauuu

SEQ ID NO: 221313 - RNA, 32 nt, Human
uacgacagacccaggcuggagucuuggcugug

SEQ ID NO: 221314 - RNA, 32 nt, Human
uacgaccccuucucccuguuacugcccuucuc

SEQ ID NO: 221315 - RNA, 32 nt, Human
uacgacccuggugcccugggcugccgcccugc

SEQ ID NO: 221316 - RNA, 32 nt, Human
uacgaccugggcaccuugcaagcacaagaaag

SEQ ID NO: 221317 - RNA, 32 nt, Human
uacgacgacugcuucagcacgugaguggcugu

SEQ ID NO: 221318 - RNA, 32 nt, Human
uacgacuccuguaaucccagcacuuugggagg

SEQ ID NO: 221319 - RNA, 32 nt, Human
uacgagaccacccugggcaacauggugaaauc

SEQ ID NO: 221320 - RNA, 32 nt, Human
uacgagaucagccuggccagcacggugaaacc

SEQ ID NO: 221321 - RNA, 32 nt, Human
uacgagaucuggagcaacagcuaggaaauauc

SEQ ID NO: 221322 - RNA, 32 nt, Human
uacgagaugugcacaugggggaggcugggcau

SEQ ID NO: 221323 - RNA, 32 nt, Human
uacgagccaagaugcucagcuuuauaggugug

SEQ ID NO: 221324 - RNA, 32 nt, Human
uacgagcugcucauccagaaguuccucagccu

SEQ ID NO: 221325 - RNA, 32 nt, Human
uacgagcuucccacccuuccuaacgcuuucac

SEQ ID NO: 221326 - RNA, 32 nt, Human
uacgaggggagaaagugggacuccuccacucc

SEQ ID NO: 221327 - RNA, 32 nt, Human
uacgagguguguguccuaacacacucccggca

SEQ ID NO: 221328 - RNA, 32 nt, Human
uacgaguccacauuccuguuuguaauccuugg

SEQ ID NO: 221329 - RNA, 32 nt, Human
uacgagugaaguuuauauccaaguucagacuc

SEQ ID NO: 221330 - RNA, 32 nt, Human
uacgaguguggggucuccaucccuggaaagug

SEQ ID NO: 221331 - RNA, 23 nt, Human
uacgaguuaccgauucuauguca

SEQ ID NO: 221332 - RNA, 32 nt, Human
uacgaguuggggaccagaaaucugggcucaga

SEQ ID NO: 221333 - RNA, 32 nt, Human
uacgauauacaaaaaucagugguauuuucaua

SEQ ID NO: 221334 - RNA, 32 nt, Human
uacgaucaagccacugcacuccagccugggcg

SEQ ID NO: 221335 - RNA, 32 nt, Human
uacgaucacaccacugcacucuggccugcaug

SEQ ID NO: 221336 - RNA, 32 nt, Human
uacgaucaugccacugcacuccacucugggca

SEQ ID NO: 221337 - RNA, 32 nt, Human
uacgaucgcaccacugcauucuagccuuagug

SEQ ID NO: 221338 - RNA, 32 nt, Human
uacgaugacucacaccuguacucccagcacuu

SEQ ID NO: 221339 - RNA, 29 nt, Human
uacgaugagcacaccggccgugccccagg

SEQ ID NO: 221340 - RNA, 31 nt, Human
uacgaugagguguccaucauggagguuaaga

SEQ ID NO: 221341 - RNA, 32 nt, Human
uacgauuccggagaaucgcgaggcagagcggg

SEQ ID NO: 221342 - RNA, 32 nt, Human
uacgauuccucauauccaaggcuacuuuugaa

SEQ ID NO: 221343 - RNA, 32 nt, Human
uacgcaaacugcgccugcuccugaaaagcucu

SEQ ID NO: 221344 - RNA, 32 nt, Human
uacgcacacacgugcacacauguacacacgga

SEQ ID NO: 221345 - RNA, 32 nt, Human
uacgcacagcacaccacugucccuucacugca

SEQ ID NO: 221346 - RNA, 32 nt, Human
uacgcacauacacacaugcacgcacgcacacg

SEQ ID NO: 221347 - RNA, 32 nt, Human
uacgcacauaugcacacaggcagacauaccuc

SEQ ID NO: 221348 - RNA, 32 nt, Human
uacgcaccugggaccugcaggcggcggcgcag

SEQ ID NO: 221349 - RNA, 32 nt, Human
uacgcacggcaucuggcugcucugucuacugu

SEQ ID NO: 221350 - RNA, 32 nt, Human
uacgcacggucugauuuucucuuuggauucuu

SEQ ID NO: 221351 - RNA, 32 nt, Human
uacgcacuuuugcaggaugaccucagggcuau

SEQ ID NO: 221352 - RNA, 32 nt, Human
uacgcagaccgaguggcagucuggcuaaaggc

SEQ ID NO: 221353 - RNA, 32 nt, Human
uacgcagccagccagcaucugggagcccggcg

SEQ ID NO: 221354 - RNA, 32 nt, Human
uacgcaggccggccuccaccuccagaggguuc

SEQ ID NO: 221355 - RNA, 32 nt, Human
uacgcagggcugggguuuugcuacuuguuccu

SEQ ID NO: 221356 - RNA, 20 nt, Human
uacgcaguuuucauguccuu

SEQ ID NO: 221357 - RNA, 32 nt, Human
uacgcaucucuccagcauuccguccugggauc

SEQ ID NO: 221358 - RNA, 32 nt, Human
uacgcauuauggaaauauaggaagagauauag

SEQ ID NO: 221359 - RNA, 32 nt, Human
uacgccacggacuaugcuguugggcccaggcc

SEQ ID NO: 221360 - RNA, 32 nt, Human
uacgccacugcaccccaaccugggcgacagag

SEQ ID NO: 221361 - RNA, 32 nt, Human
uacgccacugcacuaaugucuggugacagagu

SEQ ID NO: 221362 - RNA, 32 nt, Human
uacgccacugcacuccagccuggaggccagag

SEQ ID NO: 221363 - RNA, 32 nt, Human
uacgccacugcacuccagccugggcaacacag

SEQ ID NO: 221364 - RNA, 32 nt, Human
uacgccacugcacuccagccugggcaacagag

SEQ ID NO: 221365 - RNA, 32 nt, Human
uacgccacugcacuccagccugggugacggag

SEQ ID NO: 221366 - RNA, 32 nt, Human
uacgccacugcauuguagccugggcaacagag

SEQ ID NO: 221367 - RNA, 32 nt, Human
uacgccagaagaccugaaaugccuuguaccua

SEQ ID NO: 221368 - RNA, 32 nt, Human
uacgccaggagaaguugaggggagcaugcuuc

SEQ ID NO: 221369 - RNA, 32 nt, Human
uacgccaggccaugaaauacaaaagccucucu

SEQ ID NO: 221370 - RNA, 32 nt, Human
uacgccauccaggcugggaggggaagagugcu

SEQ ID NO: 221371 - RNA, 32 nt, Human
uacgccaugguuaugagcagguugaugagggu

SEQ ID NO: 221372 - RNA, 32 nt, Human
uacgcccaagagaaggagguggaggcagccaa

SEQ ID NO: 221373 - RNA, 32 nt, Human
uacgcccacugcaaggccucccucccaccgcg

SEQ ID NO: 221374 - RNA, 32 nt, Human
uacgccccaguucuuucaucuuggaauucuuu

SEQ ID NO: 221375 - RNA, 32 nt, Human
uacgccccgcugucugugcugugagagucgcc

SEQ ID NO: 221376 - RNA, 32 nt, Human
uacgccccuccuccuucucucuuggcgaggcc

SEQ ID NO: 221377 - RNA, 32 nt, Human
uacgcccgagcggaagaagcgggcucugagcc

SEQ ID NO: 221378 - RNA, 32 nt, Human
uacgcccuccucagcgccuccugggcugugcu

SEQ ID NO: 221379 - RNA, 32 nt, Human
uacgcccuuacauucugcacuucauaguugga

SEQ ID NO: 221380 - RNA, 32 nt, Human
uacgccggcagcccggugcaccacgcggccga

SEQ ID NO: 221381 - RNA, 32 nt, Human
uacgccucagauggugguauuugcuaacauca

SEQ ID NO: 221382 - RNA, 32 nt, Human
uacgccuguaaucccagcuacucgggaggcug

SEQ ID NO: 221383 - RNA, 32 nt, Human
uacgccuguagucccagcuacucaggaggcug

SEQ ID NO: 221384 - RNA, 32 nt, Human
uacgccugugcugcugucaugaguggcgagcu

SEQ ID NO: 221385 - RNA, 32 nt, Human
uacgccuugucauuggaaacacugccuuuguc

SEQ ID NO: 221386 - RNA, 32 nt, Human
uacgcgaggguagagcacaagauggaaaugga

SEQ ID NO: 221387 - RNA, 22 nt, Human
uacgcgccguggugcgcacgga

SEQ ID NO: 221388 - RNA, 32 nt, Human
uacgcgcuggugguccaccacccucaggauga

SEQ ID NO: 221389 - RNA, 32 nt, Human
uacgcggacaaccaccaccaccacccccacac

SEQ ID NO: 221390 - RNA, 32 nt, Human
uacgcggagcgggagagcggccacaccaugcg

SEQ ID NO: 221391 - RNA, 32 nt, Human
uacgcggagcugggcaccaccaucuccaaauc

SEQ ID NO: 221392 - RNA, 32 nt, Human
uacgcggccucucugugccgcuucauuuguag

SEQ ID NO: 221393 - RNA, 32 nt, Human
uacgcgggccguacagaggagcucuagagggc

SEQ ID NO: 221394 - RNA, 32 nt, Human
uacgcucacagcaacugcuuaccugcuccaag

SEQ ID NO: 221395 - RNA, 32 nt, Human
uacgcuccaacuugcauggccuagagaccgcu

SEQ ID NO: 221396 - RNA, 32 nt, Human
uacgcugagccugagacgggaggcaggaaagg

SEQ ID NO: 221397 - RNA, 32 nt, Human
uacgcugcccucgcagccuggcggccuccgcu

SEQ ID NO: 221398 - RNA, 32 nt, Human
uacgcugcucaguugguggagacuggggcugg

SEQ ID NO: 221399 - RNA, 32 nt, Human
uacgcuggaaauugacuccccuuucccuuccc

SEQ ID NO: 221400 - RNA, 32 nt, Human
uacgcugggaaagacauagaagaacuauuaag

SEQ ID NO: 221401 - RNA, 32 nt, Human
uacgcuguguguggauuucuccugaaaccaca

SEQ ID NO: 221402 - RNA, 32 nt, Human
uacgcuuguagucccagcacuuugggaggcug

SEQ ID NO: 221403 - RNA, 32 nt, Human
uacgcuuuauagguggaaaaguagcaaauaaa

SEQ ID NO: 221404 - RNA, 32 nt, Human
uacgcuuuguuggcugggcacggcgacucacg

SEQ ID NO: 221405 - RNA, 32 nt, Human
uacggaauccacccuuauuugcucucaggcuu

SEQ ID NO: 221406 - RNA, 32 nt, Human
uacggacgugagccaccacgccuggcccaggc

SEQ ID NO: 221407 - RNA, 32 nt, Human
uacggacucacacccguucccacucucugcaa

SEQ ID NO: 221408 - RNA, 32 nt, Human
uacggacugcaaccuucaaauucagcuguggu

SEQ ID NO: 221409 - RNA, 32 nt, Human
uacggacuuccuuuaggaucucaggcuucugc

SEQ ID NO: 221410 - RNA, 32 nt, Human
uacggacuugcagcccacgggaccccagccca

SEQ ID NO: 221411 - RNA, 32 nt, Human
uacggacuuggggucuaucuugccaaauauuu

SEQ ID NO: 221412 - RNA, 32 nt, Human
uacggagaaaguaucagcaacuuuaugcucaa

SEQ ID NO: 221413 - RNA, 32 nt, Human
uacggagaggagaaaguugugcagugauucca

SEQ ID NO: 221414 - RNA, 32 nt, Human
uacggagggggccuggcucucagucucuacuc

SEQ ID NO: 221415 - RNA, 18 nt, Human
uacggagugauuuggugu

SEQ ID NO: 221416 - RNA, 32 nt, Human
uacggauauaagccucaguuaaauggaauuau

SEQ ID NO: 221417 - RNA, 32 nt, Human
uacggaugagacugaaagaaaaccucaaagga

SEQ ID NO: 221418 - RNA, 31 nt, Human
uacggcacaguguccagggcagcugggugug

SEQ ID NO: 221419 - RNA, 32 nt, Human
uacggcaccaccacccucaaguacuuccagga

SEQ ID NO: 221420 - RNA, 32 nt, Human
uacggcagccaucuugguacccugagaagagu

SEQ ID NO: 221421 - RNA, 32 nt, Human
uacggcagcuacuacggaggccugggcuacag

SEQ ID NO: 221422 - RNA, 32 nt, Human
uacggcauuacauuccauccagccugggcgac

SEQ ID NO: 221423 - RNA, 21 nt, Human
uacggccgcggccugagugga

SEQ ID NO: 221424 - RNA, 32 nt, Human
uacggcggcuguaugggcucucuuccuccuuc

SEQ ID NO: 221425 - RNA, 32 nt, Human
uacggcucacuaggcagccccagaucugggga

SEQ ID NO: 221426 - RNA, 27 nt, Human
uacggcugcagcagcagcugccagggg

SEQ ID NO: 221427 - RNA, 32 nt, Human
uacggcugcauucuguaagugggcauggucuc

SEQ ID NO: 221428 - RNA, 32 nt, Human
uacggcugucccagacacugagccuggugccc

SEQ ID NO: 221429 - RNA, 32 nt, Human
uacggcuugagguuucagcauccaggcugcag

SEQ ID NO: 221430 - RNA, 32 nt, Human
uacgggaaguucugcaaguguucuccaggggc

SEQ ID NO: 221431 - RNA, 32 nt, Human
uacgggagccgccuugccaucccugcagccca

SEQ ID NO: 221432 - RNA, 32 nt, Human
uacgggaggcugagagacugagggucuuucuu

SEQ ID NO: 221433 - RNA, 20 nt, Human
uacgggcacacaccaccaug

SEQ ID NO: 221434 - RNA, 20 nt, Human
uacgggcacgcaccaccacg

SEQ ID NO: 221435 - RNA, 32 nt, Human
uacgggcaguggcugcucguguccucugccac

SEQ ID NO: 221436 - RNA, 32 nt, Human
uacgggcaugagccaccgcacccggcuuacug

SEQ ID NO: 221437 - RNA, 32 nt, Human
uacgggcaugagccacugcacccggcccugag

SEQ ID NO: 221438 - RNA, 32 nt, Human
uacgggcaugagccacugugcgcaaucugauu

SEQ ID NO: 221439 - RNA, 32 nt, Human
uacgggcaugagcugcugugcccagccucaau

SEQ ID NO: 221440 - RNA, 20 nt, Human
uacgggcaugcaccaccaug

SEQ ID NO: 221441 - RNA, 32 nt, Human
uacgggcgagcacccuucccaccccaucccag

SEQ ID NO: 221442 - RNA, 32 nt, Human
uacgggcgcccaccaccaugcccagcuaauuu

SEQ ID NO: 221443 - RNA, 32 nt, Human
uacgggcgcccgccaccaugcccagcuacuuu

SEQ ID NO: 221444 - RNA, 32 nt, Human
uacgggcgugagccaccgcgccuggccaggau

SEQ ID NO: 221445 - RNA, 32 nt, Human
uacgggcgugagccaccgugcucggcccaagg

SEQ ID NO: 221446 - RNA, 32 nt, Human
uacgggcgugagccacuucacccggcccggag

SEQ ID NO: 221447 - RNA, 32 nt, Human
uacgggcugcugcagaggcggcuggagaacuu

SEQ ID NO: 221448 - RNA, 32 nt, Human
uacgggggugagccacugcgcccggccccugc

SEQ ID NO: 221449 - RNA, 32 nt, Human
uacggggucgccacugcacccagccugugucu

SEQ ID NO: 221450 - RNA, 32 nt, Human
uacggggucuugcucugucucccaggcuggag

SEQ ID NO: 221451 - RNA, 32 nt, Human
uacggguccuuguggcuucugcucugagggcu

SEQ ID NO: 221452 - RNA, 32 nt, Human
uacgggugacagaucuuguuucugaagauggu

SEQ ID NO: 221453 - RNA, 32 nt, Human
uacgggugcgugccaccaugccuggcuaauuu

SEQ ID NO: 221454 - RNA, 32 nt, Human
uacgggugugagccaccacacccggcccaagg

SEQ ID NO: 221455 - RNA, 32 nt, Human
uacgggugugagccaccacgccuggcuaauuu

SEQ ID NO: 221456 - RNA, 32 nt, Human
uacgggugugagccaccgugcccagccuuuuu

SEQ ID NO: 221457 - RNA, 32 nt, Human
uacgguaggagcuuugcaggaaguuugcaaaa

SEQ ID NO: 221458 - RNA, 32 nt, Human
uacgguaugccauuaaauaaauauaccacaau

SEQ ID NO: 221459 - RNA, 32 nt, Human
uacggucccaucucuucacaggcauggauucu

SEQ ID NO: 221460 - RNA, 32 nt, Human
uacggucccucuucaccuucugaggcccacga

SEQ ID NO: 221461 - RNA, 32 nt, Human
uacgguccuccccugaccccuccuuccacccg

SEQ ID NO: 221462 - RNA, 32 nt, Human
uacgguccugcucucuuggagcugacauucug

SEQ ID NO: 221463 - RNA, 32 nt, Human
uacggucuccucugaccugagagggacaguga

SEQ ID NO: 221464 - RNA, 32 nt, Human
uacggucugagagaucugaaauaaccuuuccc

SEQ ID NO: 221465 - RNA, 32 nt, Human
uacggucugcagcuguucccauggagcccgga

SEQ ID NO: 221466 - RNA, 32 nt, Human
uacgguggcaaaaaugacaagccauagacccu

SEQ ID NO: 221467 - RNA, 32 nt, Human
uacgguggcucacaccuauaaucucagcacuu

SEQ ID NO: 221468 - RNA, 32 nt, Human
uacgguggcucacaccuguaaucccagcacuu

SEQ ID NO: 221469 - RNA, 32 nt, Human
uacgguggcucacaccugucaucccagcacuu

SEQ ID NO: 221470 - RNA, 32 nt, Human
uacgguggcucacgccuauaaucccagcacag

SEQ ID NO: 221471 - RNA, 32 nt, Human
uacgguggcucacgccuauaaucccagcacuu

SEQ ID NO: 221472 - RNA, 32 nt, Human
uacgguggcucacgccuguaaucccagcacuu

SEQ ID NO: 221473 - RNA, 32 nt, Human
uacgguggcucaugccuauaaucccagcacuu

SEQ ID NO: 221474 - RNA, 32 nt, Human
uacgguggcucaugccuguaaucccagcacuu

SEQ ID NO: 221475 - RNA, 32 nt, Human
uacgguggcucuguuauaugcuugccuaacac

SEQ ID NO: 221476 - RNA, 32 nt, Human
uacgguuuccucaguaauuuccaccaggauga

SEQ ID NO: 221477 - RNA, 32 nt, Human
uacguaacaaaccugcacauugugcacaugua

SEQ ID NO: 221478 - RNA, 32 nt, Human
uacguaacaguuaucgugucuccuuguaacuc

SEQ ID NO: 221479 - RNA, 32 nt, Human
uacguaacaguuaucgugucuccuuguaacuu

SEQ ID NO: 221480 - RNA, 32 nt, Human
uacguaaccugaccauggcccaacagcaaaca

SEQ ID NO: 221481 - RNA, 32 nt, Human
uacguaagucagaaagaggaaaagaaaauuau

SEQ ID NO: 221482 - RNA, 32 nt, Human
uacguaaugcagauucccugggugccgugaaa

SEQ ID NO: 221483 - RNA, 32 nt, Human
uacguacauaaccuaaaccuacuccaaugcua

SEQ ID NO: 221484 - RNA, 32 nt, Human
uacguacgugucaacacauacaugcauaggua

SEQ ID NO: 221485 - RNA, 32 nt, Human
uacguacuaagagcccaauuuaauuauauucc

SEQ ID NO: 221486 - RNA, 32 nt, Human
uacguacucuagacugaaagguucuacuauac

SEQ ID NO: 221487 - RNA, 32 nt, Human
uacguauauuucuguaucuauguauguauaua

SEQ ID NO: 221488 - RNA, 32 nt, Human
uacguaucuuuucuccuccucccuaguguucc

SEQ ID NO: 221489 - RNA, 32 nt, Human
uacguauuagguugcugcaaaaguaauugugg

SEQ ID NO: 221490 - RNA, 32 nt, Human
uacgucacugcauuccagccugggugacagag

SEQ ID NO: 221491 - RNA, 32 nt, Human
uacgucccccaccucuagcucccuagccucac

SEQ ID NO: 221492 - RNA, 32 nt, Human
uacguccccuucuugguccacagucugcccuc

SEQ ID NO: 221493 - RNA, 32 nt, Human
uacguccuuggcuacagacuccuggaacagca

SEQ ID NO: 221494 - RNA, 32 nt, Human
uacgucgccagcaaaagaagagauacacugca

SEQ ID NO: 221495 - RNA, 32 nt, Human
uacgucgggcuggggccuggcccccuccuguc

SEQ ID NO: 221496 - RNA, 32 nt, Human
uacgucuuccagccucuccaggucaagcuccu

SEQ ID NO: 221497 - RNA, 32 nt, Human
uacgucuugaaccuggauucgccuagggguug

SEQ ID NO: 221498 - RNA, 32 nt, Human
uacgucuugagucugggauuauccgcauugua

SEQ ID NO: 221499 - RNA, 32 nt, Human
uacgugacccaggcuggaguguaguagcuauu

SEQ ID NO: 221500 - RNA, 32 nt, Human
uacgugaccugugcugucacugggcauaggac

SEQ ID NO: 221501 - RNA, 32 nt, Human
uacgugaggaagaaaaaugucugaaaagcaga

SEQ ID NO: 221502 - RNA, 32 nt, Human
uacgugaggccugucucucggggccuggaagu

SEQ ID NO: 221503 - RNA, 21 nt, Human
uacgugaggcgccagcucugu

SEQ ID NO: 221504 - RNA, 32 nt, Human
uacgugauugacacuucucuccucagacuuca

SEQ ID NO: 221505 - RNA, 32 nt, Human
uacgugcacuucaggcaggagcugaacaagag

SEQ ID NO: 221506 - RNA, 32 nt, Human
uacgugcgccuccgccggcagcuccugacuca

SEQ ID NO: 221507 - RNA, 32 nt, Human
uacgugcggagggaggacacagcagaccuguu

SEQ ID NO: 221508 - RNA, 32 nt, Human
uacguggaguuuccuagugggcuucucaacuu

SEQ ID NO: 221509 - RNA, 32 nt, Human
uacgugggaggcagaggcaggagaaucauuug

SEQ ID NO: 221510 - RNA, 32 nt, Human
uacgugggauaggauuuauucucuccacacuu

SEQ ID NO: 221511 - RNA, 32 nt, Human
uacgugggggagagaauaaaacuccagcgaga

SEQ ID NO: 221512 - RNA, 20 nt, Human
uacgugguggccgucugcca

SEQ ID NO: 221513 - RNA, 32 nt, Human
uacgugguuggcacagacacaagacucccaga

SEQ ID NO: 221514 - RNA, 32 nt, Human
uacgugugccucuuucucacacaugccacauc

SEQ ID NO: 221515 - RNA, 32 nt, Human
uacguguguaagccacagugcccagcccgaau

SEQ ID NO: 221516 - RNA, 32 nt, Human
uacguuagccugcauuaaaauaaaaauaucug

SEQ ID NO: 221517 - RNA, 32 nt, Human
uacguuaucuuccugggccucauuuuauuauc

SEQ ID NO: 221518 - RNA, 32 nt, Human
uacguucaagaguucacacaccccugcaguca

SEQ ID NO: 221519 - RNA, 32 nt, Human
uacguugcagugauguggguacugcuuucaua

SEQ ID NO: 221520 - RNA, 32 nt, Human
uacguugguauauucauugaaauuagauuuau

SEQ ID NO: 221521 - RNA, 32 nt, Human
uacguugguguauugcaaggggagaggcuuuu

SEQ ID NO: 221522 - RNA, 32 nt, Human
uacguuuucaguaguacaggcuucuugccgau

SEQ ID NO: 221523 - RNA, 32 nt, Human
uacguuuuucucuguggcuguauguggguugc

SEQ ID NO: 221524 - RNA, 32 nt, Human
uacuaaaaacucaacugaagucaggcauggua

SEQ ID NO: 221525 - RNA, 32 nt, Human
uacuaaaaagaguuguuagugcuuuaugugag

SEQ ID NO: 221526 - RNA, 32 nt, Human
uacuaaaaaguacaaaaauuagcugggugugg

SEQ ID NO: 221527 - RNA, 32 nt, Human
uacuaaaaauaacaaaaauuagccaggcaugg

SEQ ID NO: 221528 - RNA, 32 nt, Human
uacuaaaaauaacaaaaauuagcugggcgugg

SEQ ID NO: 221529 - RNA, 32 nt, Human
uacuaaaaauacaaaaacaaaaauuagccagg

SEQ ID NO: 221530 - RNA, 32 nt, Human
uacuaaaaauacaaaaagauuagccaggcaug

SEQ ID NO: 221531 - RNA, 32 nt, Human
uacuaaaaauacaaaaauuuagccaggcaugg

SEQ ID NO: 221532 - RNA, 32 nt, Human
uacuaaaaauacaaaacaauuagccgggcgug

SEQ ID NO: 221533 - RNA, 32 nt, Human
uacuaaaaauacaaacaaaauuagcugggcau

SEQ ID NO: 221534 - RNA, 32 nt, Human
uacuaaaaauacaaacaaauuagccgggcgug

SEQ ID NO: 221535 - RNA, 32 nt, Human
uacuaaaaauacaagaaaaacuuagccgggca

SEQ ID NO: 221536 - RNA, 32 nt, Human
uacuaaaaauacaauaaauuagcugggcaugg

SEQ ID NO: 221537 - RNA, 32 nt, Human
uacuaaaaauacacaaaauuagcugggcgugg

SEQ ID NO: 221538 - RNA, 32 nt, Human
uacuaaaaauacagaaaaauuagccaggguug

SEQ ID NO: 221539 - RNA, 32 nt, Human
uacuaaaaauacagaaaauuagcugggcgcag

SEQ ID NO: 221540 - RNA, 32 nt, Human
uacuaaaaauacagcaaauuagcugggcgugg

SEQ ID NO: 221541 - RNA, 32 nt, Human
uacuaaaaauaccaaaaauuagccgggcgugg

SEQ ID NO: 221542 - RNA, 32 nt, Human
uacuaaaaauacgaaacauuagccaggugugg

SEQ ID NO: 221543 - RNA, 32 nt, Human
uacuaaaaauagagaaaauuagccaggcauag

SEQ ID NO: 221544 - RNA, 32 nt, Human
uacuaaaaaugcaaaaaguuagccaggcaugg

SEQ ID NO: 221545 - RNA, 32 nt, Human
uacuaaaaaugcggaagaguuagccaggcgug

SEQ ID NO: 221546 - RNA, 32 nt, Human
uacuaaaacauacaaaaauuagccgggcaugg

SEQ ID NO: 221547 - RNA, 25 nt, Human
uacuaaaaccucgguggaaaagcuu

SEQ ID NO: 221548 - RNA, 32 nt, Human
uacuaaaauauacaaaaauuagccaggugugg

SEQ ID NO: 221549 - RNA, 32 nt, Human
uacuaaaaugcucauuuacaugugccauuuuu

SEQ ID NO: 221550 - RNA, 32 nt, Human
uacuaaaauuuaaauucaauacaugguuuuua

SEQ ID NO: 221551 - RNA, 32 nt, Human
uacuaaacauaaaagaauucauacuggagaga

SEQ ID NO: 221552 - RNA, 32 nt, Human
uacuaaaccagcuucaucuagcacuaaaccac

SEQ ID NO: 221553 - RNA, 32 nt, Human
uacuaaacccacggguuuucagccucuuaagc

SEQ ID NO: 221554 - RNA, 32 nt, Human
uacuaaagauacaaacaauuagccgggcgugg

SEQ ID NO: 221555 - RNA, 32 nt, Human
uacuaaagcaguacuggacuggccauuggacc

SEQ ID NO: 221556 - RNA, 31 nt, Human
uacuaaaggcacuuccuuccuguuaaacccc

SEQ ID NO: 221557 - RNA, 32 nt, Human
uacuaaagggggaggaagggagggcaaaggga

SEQ ID NO: 221558 - RNA, 32 nt, Human
uacuaaaguuauuauuguuuuucccaaguucu

SEQ ID NO: 221559 - RNA, 32 nt, Human
uacuaaauacaaaaauuagcugggcguggugg

SEQ ID NO: 221560 - RNA, 32 nt, Human
uacuaaaucauuuauguccauuucucaauuuu

SEQ ID NO: 221561 - RNA, 32 nt, Human
uacuaaauuuacuuagaaauauuugaaaugca

SEQ ID NO: 221562 - RNA, 32 nt, Human
uacuaacacaccugcuacauuuuacacaugug

SEQ ID NO: 221563 - RNA, 32 nt, Human
uacuaacacaguggcaguguuagaugaagaug

SEQ ID NO: 221564 - RNA, 32 nt, Human
uacuaacacauacauuuuuacguucauaugua

SEQ ID NO: 221565 - RNA, 32 nt, Human
uacuaacagcacaagacgcacucacagggugg

SEQ ID NO: 221566 - RNA, 32 nt, Human
uacuaacauacaaaauuagcugggcacagugg

SEQ ID NO: 221567 - RNA, 32 nt, Human
uacuaacauggugaugggcucccuccccuaac

SEQ ID NO: 221568 - RNA, 32 nt, Human
uacuaacauuagauucacauaggaccagguuu

SEQ ID NO: 221569 - RNA, 32 nt, Human
uacuaaccuccaccagcaaccuggacugccuc

SEQ ID NO: 221570 - RNA, 32 nt, Human
uacuaaccuccaggaacagacauggaccuucu

SEQ ID NO: 221571 - RNA, 32 nt, Human
uacuaacgaauacccaccacaaguauagugac

SEQ ID NO: 221572 - RNA, 32 nt, Human
uacuaacucccucugaguuugcacaugggacc

SEQ ID NO: 221573 - RNA, 32 nt, Human
uacuaacuggacugccaggccagcccugggcu

SEQ ID NO: 221574 - RNA, 32 nt, Human
uacuaagagaagcaccagaagagaugccaaga

SEQ ID NO: 221575 - RNA, 32 nt, Human
uacuaagauagaaagaaaaaggugaaagagaa

SEQ ID NO: 221576 - RNA, 32 nt, Human
uacuaagauuccaaggcagaaauaaauguaua

SEQ ID NO: 221577 - RNA, 32 nt, Human
uacuaagccagccacacuuggagucugccccc

SEQ ID NO: 221578 - RNA, 32 nt, Human
uacuaagcuccucuuuuuaauuuuccaucagc

SEQ ID NO: 221579 - RNA, 32 nt, Human
uacuaagcuguacugcucuucauuuugcugau

SEQ ID NO: 221580 - RNA, 18 nt, Human
uacuaaggacccaaggca

SEQ ID NO: 221581 - RNA, 32 nt, Human
uacuaaggcacuaacaguuucagauguuacuu

SEQ ID NO: 221582 - RNA, 32 nt, Human
uacuaaggccgcagacuccuguccgcagccuc

SEQ ID NO: 221583 - RNA, 32 nt, Human
uacuaagggaaagaauugaggaauuaacugca

SEQ ID NO: 221584 - RNA, 32 nt, Human
uacuaagggcacaugucuuaaucaaaguuagu

SEQ ID NO: 221585 - RNA, 32 nt, Human
uacuaagugacaaaggggcaggugaaguauac

SEQ ID NO: 221586 - RNA, 32 nt, Human
uacuaagugacuaaggggcaggugaaguauac

SEQ ID NO: 221587 - RNA, 32 nt, Human
uacuaaguugaugaagcacgcagcucaaauga

SEQ ID NO: 221588 - RNA, 32 nt, Human
uacuaauacaucacuuuuuaacuucuguaaaa

SEQ ID NO: 221589 - RNA, 32 nt, Human
uacuaauccaucaucccucacagagauguaga

SEQ ID NO: 221590 - RNA, 32 nt, Human
uacuaauggaugucugagucaccagaaauucc

SEQ ID NO: 221591 - RNA, 32 nt, Human
uacuaauguuuuuauaugaagaacauaggugu

SEQ ID NO: 221592 - RNA, 32 nt, Human
uacuaauuacaugauguaacuacuucuugaua

SEQ ID NO: 221593 - RNA, 32 nt, Human
uacuaauuagaaaauauaguuugaggccgggc

SEQ ID NO: 221594 - RNA, 16 nt, Human
uacuaauuugcuucuu

SEQ ID NO: 221595 - RNA, 32 nt, Human
uacuaauuuucccuuguagcauguuauauuuu

SEQ ID NO: 221596 - RNA, 32 nt, Human
uacuacaauugcacuuccagcacuuugagaac

SEQ ID NO: 221597 - RNA, 32 nt, Human
uacuacacacuuagugcuuucucuguaaagua

SEQ ID NO: 221598 - RNA, 32 nt, Human
uacuacacagccugagugcggcauaguugacc

SEQ ID NO: 221599 - RNA, 32 nt, Human
uacuacacugucuuuaaaacaauguuucuuua

SEQ ID NO: 221600 - RNA, 32 nt, Human
uacuacagacggaguuuccccauguuggccgg

SEQ ID NO: 221601 - RNA, 32 nt, Human
uacuacagcauuacacauuuugcaagcacauc

SEQ ID NO: 221602 - RNA, 32 nt, Human
uacuacagcuccauuuacagaacuguugcuuu

SEQ ID NO: 221603 - RNA, 32 nt, Human
uacuacagggaagggaagagggugcugggucc

SEQ ID NO: 221604 - RNA, 32 nt, Human
uacuacaguacauggcuaaucuucccaaaaac

SEQ ID NO: 221605 - RNA, 32 nt, Human
uacuacaguacuuccugacuucucccauucaa

SEQ ID NO: 221606 - RNA, 32 nt, Human
uacuacauucgugugugucugcuuuuaaacuu

SEQ ID NO: 221607 - RNA, 32 nt, Human
uacuaccacuuccgccaggccugggugccgcu

SEQ ID NO: 221608 - RNA, 32 nt, Human
uacuaccagaaguggucaggagagggagcaag

SEQ ID NO: 221609 - RNA, 32 nt, Human
uacuaccauucaaauaaucauucccuauuuua

SEQ ID NO: 221610 - RNA, 32 nt, Human
uacuaccgcuccccucuccuccgccacccccg

SEQ ID NO: 221611 - RNA, 32 nt, Human
uacuaccuauuucuaaacuuugccauauugag

SEQ ID NO: 221612 - RNA, 23 nt, Human
uacuaccugaaggaguccagggg

SEQ ID NO: 221613 - RNA, 32 nt, Human
uacuaccugccagccuucuuccuugcucugcg

SEQ ID NO: 221614 - RNA, 32 nt, Human
uacuaccuguaaugacaggccuguccaacaca

SEQ ID NO: 221615 - RNA, 32 nt, Human
uacuacgaaaggccaaaacagcagacuugauu

SEQ ID NO: 221616 - RNA, 32 nt, Human
uacuacgcccuccccuccccagccuuuuccag

SEQ ID NO: 221617 - RNA, 21 nt, Human
uacuacguccagacgcaggga

SEQ ID NO: 221618 - RNA, 32 nt, Human
uacuacuagaugucuuuaggcagcagcuuuua

SEQ ID NO: 221619 - RNA, 32 nt, Human
uacuacucagcccucuccugcggccacaucaa

SEQ ID NO: 221620 - RNA, 32 nt, Human
uacuacucaguuauaaaaagaaaugaaauaau

SEQ ID NO: 221621 - RNA, 32 nt, Human
uacuacucuaauuuaacccuuacccucuccca

SEQ ID NO: 221622 - RNA, 32 nt, Human
uacuacugcacuccagcauggaagacagcgag

SEQ ID NO: 221623 - RNA, 32 nt, Human
uacuacugcacuccagccugggcgacaagagu

SEQ ID NO: 221624 - RNA, 32 nt, Human
uacuacugccuggguggcaagggugagacucc

SEQ ID NO: 221625 - RNA, 31 nt, Human
uacuacuggccucucccuuuccagagccagg

SEQ ID NO: 221626 - RNA, 32 nt, Human
uacuacuguacuccagccugggggaaagagug

SEQ ID NO: 221627 - RNA, 32 nt, Human
uacuacuguagaaauguuggcagcuuuuagua

SEQ ID NO: 221628 - RNA, 32 nt, Human
uacuacuguauuuuuaaaaaugaagguuguua

SEQ ID NO: 221629 - RNA, 32 nt, Human
uacuacuugccacacacuguucuaagugguau

SEQ ID NO: 221630 - RNA, 32 nt, Human
uacuacuugccugaaaugaaugaauauuuuuc

SEQ ID NO: 221631 - RNA, 32 nt, Human
uacuacuuucucaggugcuacauaucauauau

SEQ ID NO: 221632 - RNA, 32 nt, Human
uacuacuuugaccuuccgagugcagugaggca

SEQ ID NO: 221633 - RNA, 32 nt, Human
uacuagaaaggcagugccucagcccuucccug

SEQ ID NO: 221634 - RNA, 32 nt, Human
uacuagaaaguagaauagcaugaaaaacuuaa

SEQ ID NO: 221635 - RNA, 32 nt, Human
uacuagaccagaaaagaacuuauuccagauaa

SEQ ID NO: 221636 - RNA, 32 nt, Human
uacuagacucagcuugaucuuugccuguuacu

SEQ ID NO: 221637 - RNA, 32 nt, Human
uacuagagacaggguuucaccauguuggccac

SEQ ID NO: 221638 - RNA, 32 nt, Human
uacuagagacaggguuucaccauguuggccag

SEQ ID NO: 221639 - RNA, 32 nt, Human
uacuagagacgggguuucaccauguugaccag

SEQ ID NO: 221640 - RNA, 32 nt, Human
uacuagagacgggguuucagcauauugaccag

SEQ ID NO: 221641 - RNA, 32 nt, Human
uacuagagagacuucgaggcaauaauaaaaga

SEQ ID NO: 221642 - RNA, 32 nt, Human
uacuagagaggcugaggcaggagaaucacuug

SEQ ID NO: 221643 - RNA, 32 nt, Human
uacuagagaggcugaggcaggagaaucgcuug

SEQ ID NO: 221644 - RNA, 32 nt, Human
uacuagaggagagaguugaaggagcugagaca

SEQ ID NO: 221645 - RNA, 32 nt, Human
uacuagaggugggguuuugccauguuggccag

SEQ ID NO: 221646 - RNA, 32 nt, Human
uacuagaguuacaacucugauaccucaacaca

SEQ ID NO: 221647 - RNA, 32 nt, Human
uacuagcagaggaggaagucagagucggccac

SEQ ID NO: 221648 - RNA, 32 nt, Human
uacuagcaugagccaccaugccuggccuauaa

SEQ ID NO: 221649 - RNA, 32 nt, Human
uacuagccauuaacuuaaagguggugggaaaa

SEQ ID NO: 221650 - RNA, 32 nt, Human
uacuagcgaccggaggaaagugaacaggggga

SEQ ID NO: 221651 - RNA, 32 nt, Human
uacuagcgugugccuuuugccugcuucucuuu

SEQ ID NO: 221652 - RNA, 32 nt, Human
uacuagcuauauaaucuugagcuggacauuua

SEQ ID NO: 221653 - RNA, 32 nt, Human
uacuagcuauguuucuauaagauauggugccc

SEQ ID NO: 221654 - RNA, 32 nt, Human
uacuaggaacuugcacaguccgccucgggcag

SEQ ID NO: 221655 - RNA, 32 nt, Human
uacuaggaaggcugaggcaggagaaucgcuug

SEQ ID NO: 221656 - RNA, 32 nt, Human
uacuaggacucauaaugauuguccucaaccga

SEQ ID NO: 221657 - RNA, 32 nt, Human
uacuaggagagggagcugagguccuggugcca

SEQ ID NO: 221658 - RNA, 32 nt, Human
uacuaggaggggcuggcagggccuccauagca

SEQ ID NO: 221659 - RNA, 32 nt, Human
uacuaggcagagccguggaaccgccgccaggu

SEQ ID NO: 221660 - RNA, 32 nt, Human
uacuaggccaacuagggugggaagguggggag

SEQ ID NO: 221661 - RNA, 32 nt, Human
uacuaggccggcgcugcacccaacugaaauga

SEQ ID NO: 221662 - RNA, 32 nt, Human
uacuaggcucaagcaauucucgugccucagcc

SEQ ID NO: 221663 - RNA, 32 nt, Human
uacuaggcucagagcaaccuccagccuucucc

SEQ ID NO: 221664 - RNA, 32 nt, Human
uacuagggacgcugaggcaggagaaucgcuug

SEQ ID NO: 221665 - RNA, 32 nt, Human
uacuagggagacugaggcaggagaauugcuug

SEQ ID NO: 221666 - RNA, 32 nt, Human
uacuagggaggaugaggcaggagaauugcuug

SEQ ID NO: 221667 - RNA, 32 nt, Human
uacuagggaggcaggaggaucacuugagccca

SEQ ID NO: 221668 - RNA, 32 nt, Human
uacuagggaggcugaggcaggagaaucacuug

SEQ ID NO: 221669 - RNA, 32 nt, Human
uacuagggaggcugaggcaggagaaucgcuug

SEQ ID NO: 221670 - RNA, 32 nt, Human
uacuagggaggcugaggcaggagaauggccag

SEQ ID NO: 221671 - RNA, 32 nt, Human
uacuagggaggcugaggcaggagaauggcgug

SEQ ID NO: 221672 - RNA, 32 nt, Human
uacuagggaggcugaggcaggagaauugcuug

SEQ ID NO: 221673 - RNA, 32 nt, Human
uacuagggaggcugcggcaggagaauugcuug

SEQ ID NO: 221674 - RNA, 32 nt, Human
uacuaggggagggcaaggugggggagaucgcu

SEQ ID NO: 221675 - RNA, 32 nt, Human
uacuagggggaucccagcacugaagauuugcc

SEQ ID NO: 221676 - RNA, 32 nt, Human
uacuagguucaagugauuguccugccucagcc

SEQ ID NO: 221677 - RNA, 32 nt, Human
uacuagguuuaucucauuuaagccccacaaca

SEQ ID NO: 221678 - RNA, 25 nt, Human
uacuagguuuuuauggaauaggaug

SEQ ID NO: 221679 - RNA, 32 nt, Human
uacuaguaguaucuucuccuacccauaaguua

SEQ ID NO: 221680 - RNA, 32 nt, Human
uacuagucagccacaguccagguuccagcaac

SEQ ID NO: 221681 - RNA, 32 nt, Human
uacuagugagccacacgccacagucagcgucu

SEQ ID NO: 221682 - RNA, 32 nt, Human
uacuagugugggcuggaccccagcucauuuug

SEQ ID NO: 221683 - RNA, 32 nt, Human
uacuaguuaccucccucuuuucguaguuuuug

SEQ ID NO: 221684 - RNA, 32 nt, Human
uacuaguuaggagauccccacaggcuuuacac

SEQ ID NO: 221685 - RNA, 32 nt, Human
uacuaguucauaaccagcuauaugacaaagca

SEQ ID NO: 221686 - RNA, 16 nt, Human
uacuaguuugcuucuu

SEQ ID NO: 221687 - RNA, 32 nt, Human
uacuauaaagcauuuaauaaacuguuauuaau

SEQ ID NO: 221688 - RNA, 32 nt, Human
uacuauaaaggaaaaagaguguugcaauuuau

SEQ ID NO: 221689 - RNA, 32 nt, Human
uacuauaacagucauagccacaguggggaaga

SEQ ID NO: 221690 - RNA, 32 nt, Human
uacuauacaguggaugucaucuguagaagcaa

SEQ ID NO: 221691 - RNA, 32 nt, Human
uacuauacuaugaaaagcauuaccuugccuau

SEQ ID NO: 221692 - RNA, 32 nt, Human
uacuauagcgcuguuuuccugcacugauaaac

SEQ ID NO: 221693 - RNA, 32 nt, Human
uacuauauacauauauucaaauaucucauugu

SEQ ID NO: 221694 - RNA, 32 nt, Human
uacuauauguaaagcuaagauguggauuuaca

SEQ ID NO: 221695 - RNA, 32 nt, Human
uacuaucacccaggcucauagcagcugaugug

SEQ ID NO: 221696 - RNA, 32 nt, Human
uacuaucgccaguaguuauauuacaaacauua

SEQ ID NO: 221697 - RNA, 32 nt, Human
uacuaucuaacaacagucuugcaccuaaagac

SEQ ID NO: 221698 - RNA, 32 nt, Human
uacuaucuugggcuucuuagaaguaaaauaag

SEQ ID NO: 221699 - RNA, 32 nt, Human
uacuaugaacagcacccugcugagaucauaaa

SEQ ID NO: 221700 - RNA, 32 nt, Human
uacuaugacaguuauaauaaagauuauauggg

SEQ ID NO: 221701 - RNA, 32 nt, Human
uacuaugaggauuuuucucacugacauaauuu

SEQ ID NO: 221702 - RNA, 32 nt, Human
uacuaugauauucuggacauuuuaggaaaugg

SEQ ID NO: 221703 - RNA, 32 nt, Human
uacuaugaucagaagaacaugauuuuacaagu

SEQ ID NO: 221704 - RNA, 32 nt, Human
uacuaugaucauaccaaucaccucugagaagc

SEQ ID NO: 221705 - RNA, 32 nt, Human
uacuaugcccggcuaauuuuucuuuugguauu

SEQ ID NO: 221706 - RNA, 32 nt, Human
uacuauggaagccacaucacuauugggccccc

SEQ ID NO: 221707 - RNA, 32 nt, Human
uacuauggcuggaacauuggaaaaaggagagc

SEQ ID NO: 221708 - RNA, 32 nt, Human
uacuauguaaauucacagcaguaagauaauau

SEQ ID NO: 221709 - RNA, 32 nt, Human
uacuauguauuguaacauuuucucagauacag

SEQ ID NO: 221710 - RNA, 32 nt, Human
uacuaugucagugauguauauuacaaaauguc

SEQ ID NO: 221711 - RNA, 32 nt, Human
uacuaugugggcugguacgaguguggggucuc

SEQ ID NO: 221712 - RNA, 32 nt, Human
uacuauguuacccaggcuggacuccaacuccu

SEQ ID NO: 221713 - RNA, 32 nt, Human
uacuauguugcccaggcuggugucgaacuccu

SEQ ID NO: 221714 - RNA, 32 nt, Human
uacuauuacauccuggagcugucguuuuauug

SEQ ID NO: 221715 - RNA, 32 nt, Human
uacuauucaaauuccuacaguuucuggcuggc

SEQ ID NO: 221716 - RNA, 32 nt, Human
uacuauucaagaccaagguagcagaaaaguua

SEQ ID NO: 221717 - RNA, 32 nt, Human
uacuauuccaaguggcaccugggccagcagca

SEQ ID NO: 221718 - RNA, 32 nt, Human
uacuauucccucaauacugcauguuaucgaaa

SEQ ID NO: 221719 - RNA, 32 nt, Human
uacuauuccugacaagacuuggaaaagcagga

SEQ ID NO: 221720 - RNA, 32 nt, Human
uacuauuccuuugggaucucugaggccucaga

SEQ ID NO: 221721 - RNA, 32 nt, Human
uacuauucuugcuacauuaguccagcuucuac

SEQ ID NO: 221722 - RNA, 32 nt, Human
uacuauugaguauagaacuguugauuucaaca

SEQ ID NO: 221723 - RNA, 32 nt, Human
uacuauugcugaggccaaguacauuuaguaug

SEQ ID NO: 221724 - RNA, 32 nt, Human
uacuauuggcccuaaauagcagaaagaagaga

SEQ ID NO: 221725 - RNA, 32 nt, Human
uacuauuguaaaggaagagucaacuggaaaau

SEQ ID NO: 221726 - RNA, 32 nt, Human
uacuauugugcauucagugaaguguuauuaug

SEQ ID NO: 221727 - RNA, 32 nt, Human
uacuauuguggaauauauugcuguuguacucu

SEQ ID NO: 221728 - RNA, 32 nt, Human
uacuauuucacaacagccugacaacauuucua

SEQ ID NO: 221729 - RNA, 32 nt, Human
uacuauuucuuccucuugcccucuuaggccua

SEQ ID NO: 221730 - RNA, 32 nt, Human
uacuauuugaagcuuggccgaugccaacacag

SEQ ID NO: 221731 - RNA, 32 nt, Human
uacucaaaaauacaaaaauuagccuggugugg

SEQ ID NO: 221732 - RNA, 32 nt, Human
uacucaaaaauuacaugaggagaaauccuuuu

SEQ ID NO: 221733 - RNA, 32 nt, Human
uacucaaacacuguucuggcaugugaauaaag

SEQ ID NO: 221734 - RNA, 32 nt, Human
uacucaaacucucacuuuccccaaaucacauc

SEQ ID NO: 221735 - RNA, 32 nt, Human
uacucaaaucugugaagacuguauuugcuaua

SEQ ID NO: 221736 - RNA, 32 nt, Human
uacucaagagguggaggcaggaagaucacuug

SEQ ID NO: 221737 - RNA, 32 nt, Human
uacucaagauuuccuccuacuuccccagcauu

SEQ ID NO: 221738 - RNA, 32 nt, Human
uacucaagccagccuguaaacggugcuauuuc

SEQ ID NO: 221739 - RNA, 32 nt, Human
uacucaaggaggugggggcagggaggaucacu

SEQ ID NO: 221740 - RNA, 32 nt, Human
uacucaaugagcacuaaaggaaucauaggaau

SEQ ID NO: 221741 - RNA, 32 nt, Human
uacucaauguacuguaauaaucgcaaaggaaa

SEQ ID NO: 221742 - RNA, 32 nt, Human
uacucaauuaaaagcagaccaaaacuugagaa

SEQ ID NO: 221743 - RNA, 32 nt, Human
uacucacaaccaucacagcagaggugacgcac

SEQ ID NO: 221744 - RNA, 32 nt, Human
uacucacacaugccacaacauggaugagccuu

SEQ ID NO: 221745 - RNA, 32 nt, Human
uacucacaccuguaaucccagcacuuugggaa

SEQ ID NO: 221746 - RNA, 32 nt, Human
uacucacaccuguaaucccagcacuuugggag

SEQ ID NO: 221747 - RNA, 32 nt, Human
uacucacagagggagagaaagauguguacaaa

SEQ ID NO: 221748 - RNA, 32 nt, Human
uacucacaucuucauucucuaaccacucuauu

SEQ ID NO: 221749 - RNA, 32 nt, Human
uacucaccccaaaaggcagaaaagcaacacag

SEQ ID NO: 221750 - RNA, 32 nt, Human
uacucaccccuucaccugaggcuucuccccuc

SEQ ID NO: 221751 - RNA, 32 nt, Human
uacucacccucucugcugcuggcauguuggua

SEQ ID NO: 221752 - RNA, 32 nt, Human
uacucaccuccccuuucccaguccccucugga

SEQ ID NO: 221753 - RNA, 32 nt, Human
uacucacgcagcugccgcgccauguccugcuu

SEQ ID NO: 221754 - RNA, 32 nt, Human
uacucacguauaccccauuuccuuccagucag

SEQ ID NO: 221755 - RNA, 32 nt, Human
uacucacucacucuccaccagccugggaaaug

SEQ ID NO: 221756 - RNA, 21 nt, Human
uacucacucacuucauugucc

SEQ ID NO: 221757 - RNA, 32 nt, Human
uacucacucagccuggucagccugguggguac

SEQ ID NO: 221758 - RNA, 32 nt, Human
uacucacuccuucucccucuuucuggauuuua

SEQ ID NO: 221759 - RNA, 32 nt, Human
uacucacugagucgcauaauguggugcuugaa

SEQ ID NO: 221760 - RNA, 32 nt, Human
uacucacugcaaccuccaccucccggguucaa

SEQ ID NO: 221761 - RNA, 32 nt, Human
uacucacugcaagccugccaaguaggaccucc

SEQ ID NO: 221762 - RNA, 32 nt, Human
uacucacugcagccucaaucuccuggucucaa

SEQ ID NO: 221763 - RNA, 32 nt, Human
uacucacugugaacccagccuauugcaaaaau

SEQ ID NO: 221764 - RNA, 32 nt, Human
uacucagaaagaggagccgcagaguucuuggu

SEQ ID NO: 221765 - RNA, 32 nt, Human
uacucagaacgugucagcuucucagguugaug

SEQ ID NO: 221766 - RNA, 32 nt, Human
uacucagacuccaauguccaggggcuuuauga

SEQ ID NO: 221767 - RNA, 32 nt, Human
uacucagacuguuacucuggugacacaaccug

SEQ ID NO: 221768 - RNA, 32 nt, Human
uacucagagaacgaaaaggaaugcugacguaa

SEQ ID NO: 221769 - RNA, 32 nt, Human
uacucagaggcugaggcaggaaaaucgcuuga

SEQ ID NO: 221770 - RNA, 32 nt, Human
uacucagaggcugaggcaggaggaucgcuuga

SEQ ID NO: 221771 - RNA, 32 nt, Human
uacucagaugaccugaggaaaggagggaaagu

SEQ ID NO: 221772 - RNA, 32 nt, Human
uacucagaugagaauuagcaucaggaaagccu

SEQ ID NO: 221773 - RNA, 32 nt, Human
uacucagaugagcauuagcaucaggaaagccu

SEQ ID NO: 221774 - RNA, 20 nt, Human
uacucagcagggcucuggga

SEQ ID NO: 221775 - RNA, 32 nt, Human
uacucagcgaucuauucuucugaugcuaaaua

SEQ ID NO: 221776 - RNA, 32 nt, Human
uacucagcuugggcccccuccgggccagccgc

SEQ ID NO: 221777 - RNA, 32 nt, Human
uacucagcuuucccagcaccuacccaggcaga

SEQ ID NO: 221778 - RNA, 32 nt, Human
uacucagcuuuuccaaugaggcuugaauccau

SEQ ID NO: 221779 - RNA, 32 nt, Human
uacucaggaaggcugaggcaggagaaucgcuu

SEQ ID NO: 221780 - RNA, 32 nt, Human
uacucaggaaggugggagagagccaagcccug

SEQ ID NO: 221781 - RNA, 21 nt, Human
uacucaggaaugggaaaagga

SEQ ID NO: 221782 - RNA, 32 nt, Human
uacucaggaccccaagauacagaaggaaauca

SEQ ID NO: 221783 - RNA, 32 nt, Human
uacucaggagacugaagcaggagaaucgcucg

SEQ ID NO: 221784 - RNA, 24 nt, Human
uacucaggaggcugaagcaggaug

SEQ ID NO: 221785 - RNA, 32 nt, Human
uacucaggaggcugaggaaggagaaucacuug

SEQ ID NO: 221786 - RNA, 32 nt, Human
uacucaggaggcugaggaaggagagccuguga

SEQ ID NO: 221787 - RNA, 32 nt, Human
uacucaggaggcugaggcaggaagaucgcuua

SEQ ID NO: 221788 - RNA, 32 nt, Human
uacucaggaggcugaggcaggagaagggcgug

SEQ ID NO: 221789 - RNA, 32 nt, Human
uacucaggaggcugaggcaggagaaggguggg

SEQ ID NO: 221790 - RNA, 32 nt, Human
uacucaggaggcugaggcaggagcauugcuug

SEQ ID NO: 221791 - RNA, 32 nt, Human
uacucaggaggcugaggcaggggaaucgcuug

SEQ ID NO: 221792 - RNA, 32 nt, Human
uacucaggaggcugaggcaggggaaucucuug

SEQ ID NO: 221793 - RNA, 32 nt, Human
uacucaggaggcugaggcaggggaauugcuug

SEQ ID NO: 221794 - RNA, 32 nt, Human
uacucaggaggcugggacaggagaaucgcuug

SEQ ID NO: 221795 - RNA, 32 nt, Human
uacucaggaggcuugaggcgggaggaucacuu

SEQ ID NO: 221796 - RNA, 32 nt, Human
uacucaggcugaggcaggagaaucgcuugaac

SEQ ID NO: 221797 - RNA, 21 nt, Human
uacucaggcuggagugcggug

SEQ ID NO: 221798 - RNA, 32 nt, Human
uacucagggggcugaggcaggagaauugcuug

SEQ ID NO: 221799 - RNA, 32 nt, Human
uacucaggggguugaggcaggagaaucgcuuc

SEQ ID NO: 221800 - RNA, 32 nt, Human
uacucagggguccaggaagaauuuguaccauu

SEQ ID NO: 221801 - RNA, 32 nt, Human
uacucaguaaaggaagguaggaagagacaaac

SEQ ID NO: 221802 - RNA, 32 nt, Human
uacucagugguguuucaucauguuucccaggc

SEQ ID NO: 221803 - RNA, 32 nt, Human
uacucagugucagacaucuacaggaaagaaac

SEQ ID NO: 221804 - RNA, 32 nt, Human
uacucauacuagcucugugaccauaggcaagu

SEQ ID NO: 221805 - RNA, 32 nt, Human
uacucauaucuucucuaauuugguccugauac

SEQ ID NO: 221806 - RNA, 22 nt, Human
uacucaucaccuugcaguggcc

SEQ ID NO: 221807 - RNA, 32 nt, Human
uacucauccuuuccuuucuugucuuguauccu

SEQ ID NO: 221808 - RNA, 32 nt, Human
uacucaugaaaggccucucccaaaaagccaug

SEQ ID NO: 221809 - RNA, 32 nt, Human
uacucaugaggcuuaaauggaggaucacuuga

SEQ ID NO: 221810 - RNA, 32 nt, Human
uacucaugccuguaaucccagcacuuugagag

SEQ ID NO: 221811 - RNA, 32 nt, Human
uacucauucaaggauauccucaggaaacuggc

SEQ ID NO: 221812 - RNA, 32 nt, Human
uacucauuugcaauggcuaagaagugagaugg

SEQ ID NO: 221813 - RNA, 32 nt, Human
uacucauuuuucucccccaagugagcugcaag

SEQ ID NO: 221814 - RNA, 32 nt, Human
uacuccaaaccucccuuuuuauuucuugagcc

SEQ ID NO: 221815 - RNA, 32 nt, Human
uacuccaaccuggaugacagagugagacucca

SEQ ID NO: 221816 - RNA, 32 nt, Human
uacuccaaccugggcgacagagcaagacugug

SEQ ID NO: 221817 - RNA, 32 nt, Human
uacuccaccaucaccucucuccccuaucaccc

SEQ ID NO: 221818 - RNA, 32 nt, Human
uacuccaccauggggcgcuuccuuucuucucu

SEQ ID NO: 221819 - RNA, 32 nt, Human
uacuccaccuucggugccaucuggacucccac

SEQ ID NO: 221820 - RNA, 32 nt, Human
uacuccaccuuggauuuuucucuccaucacau

SEQ ID NO: 221821 - RNA, 32 nt, Human
uacuccacugcacuccagccugggcaacagag

SEQ ID NO: 221822 - RNA, 32 nt, Human
uacuccagaggucgaggcaggagcaucgcuua

SEQ ID NO: 221823 - RNA, 32 nt, Human
uacuccagaguccagacccagccaagaaaggg

SEQ ID NO: 221824 - RNA, 32 nt, Human
uacuccagcacucuagccugggcgacagagug

SEQ ID NO: 221825 - RNA, 32 nt, Human
uacuccagcagguaggggcacagugaaugugu

SEQ ID NO: 221826 - RNA, 32 nt, Human
uacuccagccagggcaagagagcgagacccug

SEQ ID NO: 221827 - RNA, 32 nt, Human
uacuccagcccggcacuccagccuggcgacaa

SEQ ID NO: 221828 - RNA, 32 nt, Human
uacuccagcccuucucccucccucccuuccuc

SEQ ID NO: 221829 - RNA, 32 nt, Human
uacuccagccuaggugacagagcaagacucug

SEQ ID NO: 221830 - RNA, 32 nt, Human
uacuccagccuaggugacagagcgagacuccg

SEQ ID NO: 221831 - RNA, 32 nt, Human
uacuccagccuaggugacagagugagacccug

SEQ ID NO: 221832 - RNA, 32 nt, Human
uacuccagccuggacaacagcgagagcuccau

SEQ ID NO: 221833 - RNA, 32 nt, Human
uacuccagccuggaugacacagcgagacuccg

SEQ ID NO: 221834 - RNA, 32 nt, Human
uacuccagccuggaugacagaguggagacucu

SEQ ID NO: 221835 - RNA, 32 nt, Human
uacuccagccuggcaacagagcaagacccugu

SEQ ID NO: 221836 - RNA, 32 nt, Human
uacuccagccuggcaacagagcgagacuccgu

SEQ ID NO: 221837 - RNA, 32 nt, Human
uacuccagccuggcaacagagugagacugugu

SEQ ID NO: 221838 - RNA, 32 nt, Human
uacuccagccuggcccacagagugagauccug

SEQ ID NO: 221839 - RNA, 32 nt, Human
uacuccagccugggaaacaaugcgagucccua

SEQ ID NO: 221840 - RNA, 32 nt, Human
uacuccagccugggagacacagugagacccug

SEQ ID NO: 221841 - RNA, 32 nt, Human
uacuccagccugggagauagagcaagacucca

SEQ ID NO: 221842 - RNA, 32 nt, Human
uacuccagccugggcaacaaagcgagacccug

SEQ ID NO: 221843 - RNA, 32 nt, Human
uacuccagccugggcaacacagcaagacccug

SEQ ID NO: 221844 - RNA, 32 nt, Human
uacuccagccugggcaacagaagaagaauccg

SEQ ID NO: 221845 - RNA, 32 nt, Human
uacuccagccugggcaacagagcaagacccau

SEQ ID NO: 221846 - RNA, 32 nt, Human
uacuccagccugggcaacagagcaagacccug

SEQ ID NO: 221847 - RNA, 32 nt, Human
uacuccagccugggcaacagagcgaggcuccg

SEQ ID NO: 221848 - RNA, 32 nt, Human
uacuccagccugggcaacagagggagacucca

SEQ ID NO: 221849 - RNA, 32 nt, Human
uacuccagccugggcaacagagggagacucug

SEQ ID NO: 221850 - RNA, 32 nt, Human
uacuccagccugggcaacagagggagacuuca

SEQ ID NO: 221851 - RNA, 32 nt, Human
uacuccagccugggcaacagagugagacccug

SEQ ID NO: 221852 - RNA, 32 nt, Human
uacuccagccugggcaacagagugagacuguc

SEQ ID NO: 221853 - RNA, 32 nt, Human
uacuccagccugggcaauaggguaagauccug

SEQ ID NO: 221854 - RNA, 32 nt, Human
uacuccagccugggcagcagagcaagacucug

SEQ ID NO: 221855 - RNA, 32 nt, Human
uacuccagccugggccacaaggcaagacucug

SEQ ID NO: 221856 - RNA, 32 nt, Human
uacuccagccugggcgacagagcaagacucca

SEQ ID NO: 221857 - RNA, 32 nt, Human
uacuccagccugggcgacagagggggacucug

SEQ ID NO: 221858 - RNA, 32 nt, Human
uacuccagccugggcgacggagugagacuccc

SEQ ID NO: 221859 - RNA, 32 nt, Human
uacuccagccugggcgauggagcaagacucag

SEQ ID NO: 221860 - RNA, 32 nt, Human
uacuccagccugggcuggacagugagacuuuu

SEQ ID NO: 221861 - RNA, 32 nt, Human
uacuccagccugggggacaggagcgagacucc

SEQ ID NO: 221862 - RNA, 32 nt, Human
uacuccagccugggugacaaaguaagacccug

SEQ ID NO: 221863 - RNA, 32 nt, Human
uacuccagccugggugacaaagucagacucca

SEQ ID NO: 221864 - RNA, 32 nt, Human
uacuccagccugggugacaaagugagacucua

SEQ ID NO: 221865 - RNA, 32 nt, Human
uacuccagccugggugacagaaugagacccug

SEQ ID NO: 221866 - RNA, 32 nt, Human
uacuccagccugggugacagagcaagacccug

SEQ ID NO: 221867 - RNA, 32 nt, Human
uacuccagccugggugacagagcaagacucca

SEQ ID NO: 221868 - RNA, 32 nt, Human
uacuccagccugggugacagagcaagacucug

SEQ ID NO: 221869 - RNA, 32 nt, Human
uacuccagccugggugacagagcgagacccag

SEQ ID NO: 221870 - RNA, 32 nt, Human
uacuccagccugggugacagagcgagacccua

SEQ ID NO: 221871 - RNA, 32 nt, Human
uacuccagccugggugacagagcgagacucag

SEQ ID NO: 221872 - RNA, 32 nt, Human
uacuccagccugggugacagagcgagacuccg

SEQ ID NO: 221873 - RNA, 32 nt, Human
uacuccagccugggugacagagcgagacucug

SEQ ID NO: 221874 - RNA, 32 nt, Human
uacuccagccugggugacagagcgagacuuau

SEQ ID NO: 221875 - RNA, 32 nt, Human
uacuccagccugggugacagagugagacccug

SEQ ID NO: 221876 - RNA, 32 nt, Human
uacuccagccugggugacagagugagacucca

SEQ ID NO: 221877 - RNA, 32 nt, Human
uacuccagccugggugacagagugaggcccug

SEQ ID NO: 221878 - RNA, 32 nt, Human
uacuccagccugggugacagagugauacucca

SEQ ID NO: 221879 - RNA, 32 nt, Human
uacuccagccugggugacagggcaagacccug

SEQ ID NO: 221880 - RNA, 32 nt, Human
uacuccagccugggugacauagggagacccug

SEQ ID NO: 221881 - RNA, 32 nt, Human
uacuccagccugggugacgagcgaaacuccau

SEQ ID NO: 221882 - RNA, 32 nt, Human
uacuccagccugggugacugagcgagacucca

SEQ ID NO: 221883 - RNA, 32 nt, Human
uacuccagccugggugaggagagcgagacucu

SEQ ID NO: 221884 - RNA, 32 nt, Human
uacuccagccugggugauaggaugagacucca

SEQ ID NO: 221885 - RNA, 32 nt, Human
uacuccagccuggugacagagccagacuguuu

SEQ ID NO: 221886 - RNA, 32 nt, Human
uacuccagccuggugacagagcgagacucccu

SEQ ID NO: 221887 - RNA, 32 nt, Human
uacuccagccuggugacagagugagacucugu

SEQ ID NO: 221888 - RNA, 32 nt, Human
uacuccagccuggugauagaacgagacuccac

SEQ ID NO: 221889 - RNA, 32 nt, Human
uacuccagcgugggugacagagugagacucug

SEQ ID NO: 221890 - RNA, 32 nt, Human
uacuccagcucccaacuuuuguggacugagcg

SEQ ID NO: 221891 - RNA, 32 nt, Human
uacuccauccugggugauggagcgaagaaccu

SEQ ID NO: 221892 - RNA, 32 nt, Human
uacucccaacuaguugaaaggcugaggcaaca

SEQ ID NO: 221893 - RNA, 32 nt, Human
uacucccaaggcugaggcaggagaauugcuug

SEQ ID NO: 221894 - RNA, 32 nt, Human
uacucccacccacaccugccucccucuuaccc

SEQ ID NO: 221895 - RNA, 32 nt, Human
uacucccagcacuuugggaggccgaggcaggu

SEQ ID NO: 221896 - RNA, 32 nt, Human
uacucccagcacuuugggaggcugagguggga

SEQ ID NO: 221897 - RNA, 32 nt, Human
uacucccagcuacucaggaggcugaggcagga

SEQ ID NO: 221898 - RNA, 32 nt, Human
uacucccagcuacuugggaggcugagacagga

SEQ ID NO: 221899 - RNA, 32 nt, Human
uacucccagcuauucaggaggcugaggcggca

SEQ ID NO: 221900 - RNA, 32 nt, Human
uacucccagcuguuggggaggcugagacggaa

SEQ ID NO: 221901 - RNA, 32 nt, Human
uacucccaggaggcugcgggucgaugcucgug

SEQ ID NO: 221902 - RNA, 32 nt, Human
uacucccagguccagccucaucaugcccucca

SEQ ID NO: 221903 - RNA, 32 nt, Human
uacucccauaccuccuccucuucugggcuccc

SEQ ID NO: 221904 - RNA, 32 nt, Human
uacuccccaacuuggaguguggcagggcugca

SEQ ID NO: 221905 - RNA, 32 nt, Human
uacuccccugccucccccuaccccagcccaug

SEQ ID NO: 221906 - RNA, 32 nt, Human
uacucccgccucccugccuccagcccuggcug

SEQ ID NO: 221907 - RNA, 32 nt, Human
uacucccgcugcuuguucuguccccucccucg

SEQ ID NO: 221908 - RNA, 32 nt, Human
uacucccucagccucaggcaguggugcuccca

SEQ ID NO: 221909 - RNA, 32 nt, Human
uacucccuccacccucccucccugaucccgug

SEQ ID NO: 221910 - RNA, 32 nt, Human
uacucccucccaagacuaaaccaggaagaagu

SEQ ID NO: 221911 - RNA, 32 nt, Human
uacucccugcagccccucgcacuacccagcug

SEQ ID NO: 221912 - RNA, 32 nt, Human
uacucccugcuauaauccuagcacuuugggag

SEQ ID NO: 221913 - RNA, 32 nt, Human
uacucccuguuugccuuuccuuugccacccuc

SEQ ID NO: 221914 - RNA, 32 nt, Human
uacucccuugcccuagauaguuuauuauuauu

SEQ ID NO: 221915 - RNA, 32 nt, Human
uacuccgagccaaggcacugauguuugaacug

SEQ ID NO: 221916 - RNA, 32 nt, Human
uacuccgagucuuggucuccgucccucuaucu

SEQ ID NO: 221917 - RNA, 32 nt, Human
uacuccgcaagagaggccagaaugacagcuga

SEQ ID NO: 221918 - RNA, 32 nt, Human
uacuccgcaucucagccaccuuccucaggcuc

SEQ ID NO: 221919 - RNA, 32 nt, Human
uacuccgcuccccucuuuucccucccucuccu

SEQ ID NO: 221920 - RNA, 32 nt, Human
uacuccggcugguccgggacauggaaauucgg

SEQ ID NO: 221921 - RNA, 32 nt, Human
uacuccgggaggcugaggcaggagagucacuu

SEQ ID NO: 221922 - RNA, 32 nt, Human
uacuccggucugagcgacagagcaagaaucug

SEQ ID NO: 221923 - RNA, 32 nt, Human
uacuccguaaagaacauacaaggacauucacu

SEQ ID NO: 221924 - RNA, 32 nt, Human
uacuccguagcccaggcuggagugcaguggca

SEQ ID NO: 221925 - RNA, 32 nt, Human
uacuccguucucuaucaguuaaagcuauugaa

SEQ ID NO: 221926 - RNA, 32 nt, Human
uacuccguugcccaggcuggaguacaauggug

SEQ ID NO: 221927 - RNA, 32 nt, Human
uacuccuacccuuaguugaauuuccuuauuaa

SEQ ID NO: 221928 - RNA, 32 nt, Human
uacuccuauaacuccuaaagaggggaggcagc

SEQ ID NO: 221929 - RNA, 32 nt, Human
uacuccuauauacugaccugccuguccacgaa

SEQ ID NO: 221930 - RNA, 32 nt, Human
uacuccucagcaccuuccgugcaguuaccagu

SEQ ID NO: 221931 - RNA, 32 nt, Human
uacuccucaguuccucaccaucaucaucuugu

SEQ ID NO: 221932 - RNA, 32 nt, Human
uacuccuccaggcccccagccugggacagccc

SEQ ID NO: 221933 - RNA, 32 nt, Human
uacuccuccucuuucucuccccaacccccauu

SEQ ID NO: 221934 - RNA, 21 nt, Human
uacuccucguugcuugugucc

SEQ ID NO: 221935 - RNA, 32 nt, Human
uacuccucuaacucauguuuuuccugggcaua

SEQ ID NO: 221936 - RNA, 32 nt, Human
uacuccucucagggguguguaacacucaacag

SEQ ID NO: 221937 - RNA, 31 nt, Human
uacuccugacuucuccuaggcuugagaauug

SEQ ID NO: 221938 - RNA, 32 nt, Human
uacuccugagucuacacccgugcuucaccaga

SEQ ID NO: 221939 - RNA, 19 nt, Human
uacuccugcaggccaggaa

SEQ ID NO: 221940 - RNA, 32 nt, Human
uacuccugccuaggugacagagcaagacuccg

SEQ ID NO: 221941 - RNA, 32 nt, Human
uacuccugcggggcaucugcugggcuugcccg

SEQ ID NO: 221942 - RNA, 32 nt, Human
uacuccugcugccuggccucuccucacuccug

SEQ ID NO: 221943 - RNA, 32 nt, Human
uacuccuggccucagagccccugcugacccug

SEQ ID NO: 221944 - RNA, 32 nt, Human
uacuccuggcucaagcccugaauuucuucuuu

SEQ ID NO: 221945 - RNA, 32 nt, Human
uacuccugggcaacagcgagacuccgucucaa

SEQ ID NO: 221946 - RNA, 32 nt, Human
uacuccugggggcugaacaccaucccucccac

SEQ ID NO: 221947 - RNA, 32 nt, Human
uacuccugucccagcccugccuccagggcucc

SEQ ID NO: 221948 - RNA, 32 nt, Human
uacuccuguggugcagaugagaagcuauaaca

SEQ ID NO: 221949 - RNA, 32 nt, Human
uacuccuguuuggaaguauuuagauccagauu

SEQ ID NO: 221950 - RNA, 32 nt, Human
uacuccuucucccagcccuguccucauccuag

SEQ ID NO: 221951 - RNA, 32 nt, Human
uacuccuucuuugguaguugaaaguugaauuc

SEQ ID NO: 221952 - RNA, 32 nt, Human
uacuccuugccuaggcuggaguuuacagagac

SEQ ID NO: 221953 - RNA, 32 nt, Human
uacucgagcuuggaaaaaucccaacacaaaac

SEQ ID NO: 221954 - RNA, 32 nt, Human
uacucgcaaggcugaggcaggagaaucgcuug

SEQ ID NO: 221955 - RNA, 32 nt, Human
uacucgcaauaggaauaagcuaaugcccauuu

SEQ ID NO: 221956 - RNA, 32 nt, Human
uacucgcaccucuuggcuuuguugaugcuccg

SEQ ID NO: 221957 - RNA, 32 nt, Human
uacucgcaggugguggggagccugggcuuuug

SEQ ID NO: 221958 - RNA, 32 nt, Human
uacucggcauccuccauuccccaaacucccuc

SEQ ID NO: 221959 - RNA, 32 nt, Human
uacucgggacgcugaggcgggaggaucacaug

SEQ ID NO: 221960 - RNA, 32 nt, Human
uacucgggaggaugaggcaggagaauugcuug

SEQ ID NO: 221961 - RNA, 32 nt, Human
uacucgggaggccaaggcaggagaauugcucg

SEQ ID NO: 221962 - RNA, 32 nt, Human
uacucgggaggccgaggcaggagaauugcgug

SEQ ID NO: 221963 - RNA, 32 nt, Human
uacucgggaggccgaggcaggagaauugcuug

SEQ ID NO: 221964 - RNA, 32 nt, Human
uacucgggaggccgaggcaggagcauugcuug

SEQ ID NO: 221965 - RNA, 32 nt, Human
uacucgggaggcggaggcaggagaaucacuug

SEQ ID NO: 221966 - RNA, 32 nt, Human
uacucgggaggcuaaggcaggagaaucgcuug

SEQ ID NO: 221967 - RNA, 32 nt, Human
uacucgggaggcugaagcaggagaaucgcuug

SEQ ID NO: 221968 - RNA, 32 nt, Human
uacucgggaggcugaagcaggagaauggcgug

SEQ ID NO: 221969 - RNA, 32 nt, Human
uacucgggaggcugaagcaggagaauugcuug

SEQ ID NO: 221970 - RNA, 32 nt, Human
uacucgggaggcugaagcaggaggacugcuug

SEQ ID NO: 221971 - RNA, 32 nt, Human
uacucgggaggcugagacaggagaaucacuug

SEQ ID NO: 221972 - RNA, 32 nt, Human
uacucgggaggcugagacaggagaaucgcuug

SEQ ID NO: 221973 - RNA, 32 nt, Human
uacucgggaggcugagacaggagaauugcuug

SEQ ID NO: 221974 - RNA, 32 nt, Human
uacucgggaggcugaggaaggagaaucgcuug

SEQ ID NO: 221975 - RNA, 32 nt, Human
uacucgggaggcugaggaaggagaauggugug

SEQ ID NO: 221976 - RNA, 32 nt, Human
uacucgggaggcugaggcaggaagaaucgcuu

SEQ ID NO: 221977 - RNA, 32 nt, Human
uacucgggaggcugaggcaggagaaccgcuug

SEQ ID NO: 221978 - RNA, 32 nt, Human
uacucgggaggcugaggcaggagaauagccug

SEQ ID NO: 221979 - RNA, 32 nt, Human
uacucgggaggcugaggcaggagaauagcgug

SEQ ID NO: 221980 - RNA, 32 nt, Human
uacucgggaggcugaggcaggagaaucgccug

SEQ ID NO: 221981 - RNA, 32 nt, Human
uacucgggaggcugaggcaggagaaucgcugg

SEQ ID NO: 221982 - RNA, 32 nt, Human
uacucgggaggcugaggcaggagaaucgcuua

SEQ ID NO: 221983 - RNA, 32 nt, Human
uacucgggaggcugaggcaggagaaucgcuug

SEQ ID NO: 221984 - RNA, 32 nt, Human
uacucgggaggcugaggcaggagaauugcuug

SEQ ID NO: 221985 - RNA, 32 nt, Human
uacucgggaggcugaggcaggagcaucgcuug

SEQ ID NO: 221986 - RNA, 32 nt, Human
uacucgggaggcugaggcagggggagcacuug

SEQ ID NO: 221987 - RNA, 32 nt, Human
uacucgggaggcugcagcaggagaauggcaug

SEQ ID NO: 221988 - RNA, 32 nt, Human
uacucgggaggcuggggcaggagaaucacuug

SEQ ID NO: 221989 - RNA, 32 nt, Human
uacucgggaggcuguggcaggagaaucgcuug

SEQ ID NO: 221990 - RNA, 32 nt, Human
uacucgggaggcuguggcaggagaauugcuug

SEQ ID NO: 221991 - RNA, 32 nt, Human
uacucgggagggugaggcaggagaaucacuuc

SEQ ID NO: 221992 - RNA, 32 nt, Human
uacucgggagguggagguugcagugagccaag

SEQ ID NO: 221993 - RNA, 32 nt, Human
uacucgggagguugaggcaggagaaucgcuua

SEQ ID NO: 221994 - RNA, 32 nt, Human
uacucgggagguugaggcaggagaaucgcuug

SEQ ID NO: 221995 - RNA, 32 nt, Human
uacucgggagguugaggcaggagaauugcaug

SEQ ID NO: 221996 - RNA, 32 nt, Human
uacucgggagguugaggcaggagaauugcuua

SEQ ID NO: 221997 - RNA, 32 nt, Human
uacucgggagguugaggcaggagaauugcuug

SEQ ID NO: 221998 - RNA, 32 nt, Human
uacucgggagguuuaggcaggagaaucgcuug

SEQ ID NO: 221999 - RNA, 32 nt, Human
uacucggggaggcaggguagcagugcuuccag

SEQ ID NO: 222000 - RNA, 32 nt, Human
uacucgguaggcugaggcaggagaaucacuug

SEQ ID NO: 222001 - RNA, 32 nt, Human
uacucgucucccccgacgcagaccauggagag

SEQ ID NO: 222002 - RNA, 32 nt, Human
uacucgugacacuucccaguucuggcuuuuug

SEQ ID NO: 222003 - RNA, 32 nt, Human
uacucguuggaugucugugaguaccuggucau

SEQ ID NO: 222004 - RNA, 32 nt, Human
uacucguuuucccugauccgugguguugcagu

SEQ ID NO: 222005 - RNA, 32 nt, Human
uacucuaagagugaggaaauuagaagaaaaca

SEQ ID NO: 222006 - RNA, 32 nt, Human
uacucuaagaucuuagauucucugugucuaag

SEQ ID NO: 222007 - RNA, 32 nt, Human
uacucuacagcagcuucacugccugaaaauga

SEQ ID NO: 222008 - RNA, 32 nt, Human
uacucuacauuucaucaauguuggaguggcaa

SEQ ID NO: 222009 - RNA, 32 nt, Human
uacucuaccauggggcaucccaaguggggucc

SEQ ID NO: 222010 - RNA, 32 nt, Human
uacucuacugacuggcagagacaggagaggua

SEQ ID NO: 222011 - RNA, 32 nt, Human
uacucuagaagaguagggaaaauaaugcuugu

SEQ ID NO: 222012 - RNA, 32 nt, Human
uacucuagccugggcagcagagugagacccug

SEQ ID NO: 222013 - RNA, 32 nt, Human
uacucuagccugggcgacagagcaagacucca

SEQ ID NO: 222014 - RNA, 32 nt, Human
uacucuaggaagaggaagguauggcgagccca

SEQ ID NO: 222015 - RNA, 32 nt, Human
uacucuaggaugaucacuugugcuuagcuuag

SEQ ID NO: 222016 - RNA, 32 nt, Human
uacucuagggaguaugcuggaggcagagggca

SEQ ID NO: 222017 - RNA, 32 nt, Human
uacucuagucacccucuucaagcuuuugggcu

SEQ ID NO: 222018 - RNA, 32 nt, Human
uacucuaguccccagcccccagcccugccauc

SEQ ID NO: 222019 - RNA, 32 nt, Human
uacucucaacuugcuguucucuuuacauuccu

SEQ ID NO: 222020 - RNA, 32 nt, Human
uacucucaucagucguucauggucacaaccug

SEQ ID NO: 222021 - RNA, 32 nt, Human
uacucucaucuucucccccgcucccuuccacu

SEQ ID NO: 222022 - RNA, 32 nt, Human
uacucucauucauuuugcuuacaaaagguaca

SEQ ID NO: 222023 - RNA, 32 nt, Human
uacucuccaagcuccugucuuucuuuccucuc

SEQ ID NO: 222024 - RNA, 17 nt, Human
uacucuccagcuggaaa

SEQ ID NO: 222025 - RNA, 32 nt, Human
uacucuccuuuugacuccuuuuggaaccccca

SEQ ID NO: 222026 - RNA, 32 nt, Human
uacucucgcccaggcuagagugcaguggcaug

SEQ ID NO: 222027 - RNA, 32 nt, Human
uacucucuagcaacugacuuggggaaguuuuu

SEQ ID NO: 222028 - RNA, 32 nt, Human
uacucucuccacuuuauagcucuaauaaguuu

SEQ ID NO: 222029 - RNA, 32 nt, Human
uacucucuccuccugaccuccugggacuuugg

SEQ ID NO: 222030 - RNA, 32 nt, Human
uacucucucgcccaggcuggagugcaguggug

SEQ ID NO: 222031 - RNA, 32 nt, Human
uacucucucuccuaaagacaccaccuuccugc

SEQ ID NO: 222032 - RNA, 32 nt, Human
uacucucugguaagacuugaaugugauuauuu

SEQ ID NO: 222033 - RNA, 32 nt, Human
uacucucugugaacauccuccuuugccucuga

SEQ ID NO: 222034 - RNA, 32 nt, Human
uacucucuuacucacacuucugggaugcaagc

SEQ ID NO: 222035 - RNA, 32 nt, Human
uacucucuugcacucuugcucucccccucccu

SEQ ID NO: 222036 - RNA, 32 nt, Human
uacucucuuugugggugcaggaagagggcgcu

SEQ ID NO: 222037 - RNA, 32 nt, Human
uacucugaauggaccacaguguuugcacauau

SEQ ID NO: 222038 - RNA, 32 nt, Human
uacucugacuccucaccgucuucaccaacaug

SEQ ID NO: 222039 - RNA, 32 nt, Human
uacucugagaaacaucucucucuucugaauua

SEQ ID NO: 222040 - RNA, 32 nt, Human
uacucugaguuacugguuaccuagccagucca

SEQ ID NO: 222041 - RNA, 32 nt, Human
uacucugaucaaauaaauaaugcuggaauacu

SEQ ID NO: 222042 - RNA, 32 nt, Human
uacucugcagccugccuuccuagaguuggguu

SEQ ID NO: 222043 - RNA, 32 nt, Human
uacucugcuaaguucuggggaugaggaaauua

SEQ ID NO: 222044 - RNA, 32 nt, Human
uacucugcuacucuuaggcugcauaguuuaug

SEQ ID NO: 222045 - RNA, 32 nt, Human
uacucugcuguaggaaagccuuugccaaugcu

SEQ ID NO: 222046 - RNA, 32 nt, Human
uacucugcuguaugaaucuccaggcaggaaau

SEQ ID NO: 222047 - RNA, 32 nt, Human
uacucuggaagguggcuugagguggaggagug

SEQ ID NO: 222048 - RNA, 32 nt, Human
uacucuggagcaguucauuuuacaguaucuac

SEQ ID NO: 222049 - RNA, 32 nt, Human
uacucuggagcaugcugagauuaaggugguug

SEQ ID NO: 222050 - RNA, 32 nt, Human
uacucuggaggcugaggcggaggcaggauugc

SEQ ID NO: 222051 - RNA, 32 nt, Human
uacucuggagguuuagcaggaggaucacuuga

SEQ ID NO: 222052 - RNA, 32 nt, Human
uacucuggcaccacucuccaggcugccauggg

SEQ ID NO: 222053 - RNA, 32 nt, Human
uacucuggcaucugcacauuuccguguuacag

SEQ ID NO: 222054 - RNA, 32 nt, Human
uacucuggccccuucagucggggaguggaagg

SEQ ID NO: 222055 - RNA, 32 nt, Human
uacucugggagguggaggaaauguuauuugaa

SEQ ID NO: 222056 - RNA, 32 nt, Human
uacucugucacccaggcuagagugcaauggca

SEQ ID NO: 222057 - RNA, 32 nt, Human
uacucugucacccaggcuagagugcaguggcg

SEQ ID NO: 222058 - RNA, 32 nt, Human
uacucugucacccaggcuggagugcaauggcg

SEQ ID NO: 222059 - RNA, 32 nt, Human
uacucugucacccaggcuggagugcaguggca

SEQ ID NO: 222060 - RNA, 32 nt, Human
uacucugucacccaggcuggagugcaguggcg

SEQ ID NO: 222061 - RNA, 32 nt, Human
uacucugucacccaggcuggagugcaguggcu

SEQ ID NO: 222062 - RNA, 32 nt, Human
uacucugucacccaggcuggagugcaguggug

SEQ ID NO: 222063 - RNA, 32 nt, Human
uacucugucacccaggcuguagugcaguggca

SEQ ID NO: 222064 - RNA, 32 nt, Human
uacucugucaccccggcuggagugcaguggug

SEQ ID NO: 222065 - RNA, 32 nt, Human
uacucugucaccuaggcuggagugcaguggca

SEQ ID NO: 222066 - RNA, 32 nt, Human
uacucugucgcccaggcuggacugcaguggug

SEQ ID NO: 222067 - RNA, 32 nt, Human
uacucugucgcccaggcuggaguacaauggug

SEQ ID NO: 222068 - RNA, 32 nt, Human
uacucugucgcccaggcuggagugcagugaug

SEQ ID NO: 222069 - RNA, 32 nt, Human
uacucugucgcccaggcuggagugcaguggua

SEQ ID NO: 222070 - RNA, 32 nt, Human
uacucugucgcccaggcuggagugcaguggug

SEQ ID NO: 222071 - RNA, 32 nt, Human
uacucugucgcccaggcuggaguguaguggca

SEQ ID NO: 222072 - RNA, 32 nt, Human
uacucugucucccaggcugcuggagugcagug

SEQ ID NO: 222073 - RNA, 32 nt, Human
uacucugucucccuuguuucugaggggccuag

SEQ ID NO: 222074 - RNA, 32 nt, Human
uacucugucucucaagccauuuugccacucgc

SEQ ID NO: 222075 - RNA, 32 nt, Human
uacucugugucagcccauccccuagacacccu

SEQ ID NO: 222076 - RNA, 32 nt, Human
uacucuguuccuggcccugccggcagccacug

SEQ ID NO: 222077 - RNA, 32 nt, Human
uacucuguugccaggcuggagugcaguggcgc

SEQ ID NO: 222078 - RNA, 32 nt, Human
uacucuguugcccaggcuggagugcaggggca

SEQ ID NO: 222079 - RNA, 32 nt, Human
uacucuguugcccaggcuggagugcaggggcg

SEQ ID NO: 222080 - RNA, 32 nt, Human
uacucuguugcccaggcuggagugcaguggca

SEQ ID NO: 222081 - RNA, 32 nt, Human
uacucuguugcccaggcuggagugcaguggug

SEQ ID NO: 222082 - RNA, 32 nt, Human
uacucuguugcccaggcuggaguguaguggug

SEQ ID NO: 222083 - RNA, 32 nt, Human
uacucuguugccuaggcuggagugaaaguggc

SEQ ID NO: 222084 - RNA, 32 nt, Human
uacucuguugcuaggcuggagugcaguggugc

SEQ ID NO: 222085 - RNA, 32 nt, Human
uacucuguugcucaagcuggaguggaguggca

SEQ ID NO: 222086 - RNA, 32 nt, Human
uacucuguuucccaggcuggagugcacaaaca

SEQ ID NO: 222087 - RNA, 32 nt, Human
uacucuuaaaagagaagaugaaguucucaugu

SEQ ID NO: 222088 - RNA, 19 nt, Human
uacucuuauuuugguaaua

SEQ ID NO: 222089 - RNA, 32 nt, Human
uacucuucaguauuuuucuaucagacuuguac

SEQ ID NO: 222090 - RNA, 32 nt, Human
uacucuucaugccucauccugcagccucgggu

SEQ ID NO: 222091 - RNA, 32 nt, Human
uacucuuccaccaaacagcugugugauaggag

SEQ ID NO: 222092 - RNA, 32 nt, Human
uacucuucuccaaggacugacaaaaacaaccc

SEQ ID NO: 222093 - RNA, 32 nt, Human
uacucuucucucuaucagauaccauuuaugag

SEQ ID NO: 222094 - RNA, 32 nt, Human
uacucuucuucugugggaggccaguccacauc

SEQ ID NO: 222095 - RNA, 32 nt, Human
uacucuucuuucucccugcccccuggagggca

SEQ ID NO: 222096 - RNA, 32 nt, Human
uacucuugccuagaacuggaggguuuuuaugg

SEQ ID NO: 222097 - RNA, 32 nt, Human
uacucuuguaccuccuguucagccaggugcau

SEQ ID NO: 222098 - RNA, 23 nt, Human
uacucuugucaccugggcugcag

SEQ ID NO: 222099 - RNA, 32 nt, Human
uacucuuuccucaacccuugucucuaucugua

SEQ ID NO: 222100 - RNA, 32 nt, Human
uacucuuuccucaucucuucccaaacucucug

SEQ ID NO: 222101 - RNA, 32 nt, Human
uacugaaaaggagucaggaaaacuacaggugu

SEQ ID NO: 222102 - RNA, 32 nt, Human
uacugaaaauacaaaauaauuagccggguguu

SEQ ID NO: 222103 - RNA, 32 nt, Human
uacugaaaauacaagaaauuagcugggacuac

SEQ ID NO: 222104 - RNA, 32 nt, Human
uacugaaaauacagaaaaguuagccaggcgug

SEQ ID NO: 222105 - RNA, 32 nt, Human
uacugaaaauagauucaacuaggcuguagaag

SEQ ID NO: 222106 - RNA, 32 nt, Human
uacugaaaggagguggggucacagugaauuuc

SEQ ID NO: 222107 - RNA, 32 nt, Human
uacugaaagggagggguggagauggguguggc

SEQ ID NO: 222108 - RNA, 32 nt, Human
uacugaaauacaaaagaaauuagccaggugug

SEQ ID NO: 222109 - RNA, 32 nt, Human
uacugaacuaugaauaguugcuccaccuacuu

SEQ ID NO: 222110 - RNA, 32 nt, Human
uacugaacugacugguuacgaaaugcucacag

SEQ ID NO: 222111 - RNA, 32 nt, Human
uacugaagagucacuggacacagaaauggaaa

SEQ ID NO: 222112 - RNA, 32 nt, Human
uacugaagaugauguuccagcagcagcgacuu

SEQ ID NO: 222113 - RNA, 32 nt, Human
uacugaaggagaagaaauuuuaaaugaggaaa

SEQ ID NO: 222114 - RNA, 32 nt, Human
uacugaaggccugccccagcugaucucgcucg

SEQ ID NO: 222115 - RNA, 32 nt, Human
uacugaaggcuucugcagcuuuggcugcacgu

SEQ ID NO: 222116 - RNA, 32 nt, Human
uacugaaucucuugcaaugaagaaagcuauuu

SEQ ID NO: 222117 - RNA, 32 nt, Human
uacugaaugcauuuaccagcaaacauguagca

SEQ ID NO: 222118 - RNA, 32 nt, Human
uacugaauguauuuaccagcaaacauguagca

SEQ ID NO: 222119 - RNA, 32 nt, Human
uacugaauuuaguucugugcucuuccuuauuu

SEQ ID NO: 222120 - RNA, 24 nt, Human
uacugaauuuucaucucacuccca

SEQ ID NO: 222121 - RNA, 32 nt, Human
uacugacacuucagauauacuaaaucagagug

SEQ ID NO: 222122 - RNA, 32 nt, Human
uacugacagcacaagacccagaauuagacaau

SEQ ID NO: 222123 - RNA, 32 nt, Human
uacugacaugacuuggcuuucucauccagaaa

SEQ ID NO: 222124 - RNA, 32 nt, Human
uacugacaugagccaccacacucagcccuuua

SEQ ID NO: 222125 - RNA, 32 nt, Human
uacugaccaaaccuaaauaaagauuuuuauug

SEQ ID NO: 222126 - RNA, 32 nt, Human
uacugacccuauauuauccagacugugccggg

SEQ ID NO: 222127 - RNA, 32 nt, Human
uacugacccucccaagccuccccacucugugc

SEQ ID NO: 222128 - RNA, 32 nt, Human
uacugacccucccagggcauuccagcucaagc

SEQ ID NO: 222129 - RNA, 32 nt, Human
uacugacccuggggauccgugcgacuugaucu

SEQ ID NO: 222130 - RNA, 32 nt, Human
uacugacccuggggcuggcuuuucuguuuccu

SEQ ID NO: 222131 - RNA, 32 nt, Human
uacugaccuggagugacuggaauagcaccugg

SEQ ID NO: 222132 - RNA, 32 nt, Human
uacugacuuguugccauuaagugaacuugacu

SEQ ID NO: 222133 - RNA, 32 nt, Human
uacugacuuuucucccugcucacccucuucca

SEQ ID NO: 222134 - RNA, 32 nt, Human
uacugagaacuccuuccagugagccggacgaa

SEQ ID NO: 222135 - RNA, 32 nt, Human
uacugagacacggcggacacacacaaacacag

SEQ ID NO: 222136 - RNA, 32 nt, Human
uacugagagacagcuacaauaaaaggagagca

SEQ ID NO: 222137 - RNA, 32 nt, Human
uacugagaggcagggcccuuaagaggugauug

SEQ ID NO: 222138 - RNA, 32 nt, Human
uacugagcaguagguaggcucacuucucuuuc

SEQ ID NO: 222139 - RNA, 32 nt, Human
uacugagcauuuuuauuccuguuuacacuugu

SEQ ID NO: 222140 - RNA, 32 nt, Human
uacugagcuggcugagccuauggccaaugagu

SEQ ID NO: 222141 - RNA, 32 nt, Human
uacugaggacaguacagauuaugugcacagag

SEQ ID NO: 222142 - RNA, 32 nt, Human
uacugaggacaucagggccaccucuggacccc

SEQ ID NO: 222143 - RNA, 32 nt, Human
uacugaggacuccauaaacagaacgggauaca

SEQ ID NO: 222144 - RNA, 32 nt, Human
uacugaggagaaagauggagccugggucucaa

SEQ ID NO: 222145 - RNA, 32 nt, Human
uacugaggcccaggcauggagcugccggaucc

SEQ ID NO: 222146 - RNA, 32 nt, Human
uacugagggagggagaggaggggagccaagac

SEQ ID NO: 222147 - RNA, 32 nt, Human
uacugaggguugggacuucaacacagcuuuuu

SEQ ID NO: 222148 - RNA, 32 nt, Human
uacugaggugaugggugcaggaaagguucaca

SEQ ID NO: 222149 - RNA, 32 nt, Human
uacugagguguuagaucaaauaucucuaauug

SEQ ID NO: 222150 - RNA, 32 nt, Human
uacugaguacuuucugcaggggccuguuaagg

SEQ ID NO: 222151 - RNA, 32 nt, Human
uacugaguaguagaaagaagcuaauuugaaau

SEQ ID NO: 222152 - RNA, 32 nt, Human
uacugaguuuggugauugagcuugcuuucccc

SEQ ID NO: 222153 - RNA, 32 nt, Human
uacugauaaaaucaauauuuugcugaaaugag

SEQ ID NO: 222154 - RNA, 32 nt, Human
uacugauaugaccaccagagcuacauggcuuu

SEQ ID NO: 222155 - RNA, 25 nt, Human
uacugaucagaggcacacaaagcgu

SEQ ID NO: 222156 - RNA, 32 nt, Human
uacugauccaagauacauggcacacaauuaaa

SEQ ID NO: 222157 - RNA, 32 nt, Human
uacugaucuauuucugugccaauaccaccuac

SEQ ID NO: 222158 - RNA, 32 nt, Human
uacugaugaguagcaugugacuuuccaagagu

SEQ ID NO: 222159 - RNA, 32 nt, Human
uacugaugcagaccuggcuguggagagcagcu

SEQ ID NO: 222160 - RNA, 32 nt, Human
uacugauggccucucauacaauggagcuauca

SEQ ID NO: 222161 - RNA, 32 nt, Human
uacugaugucggcugcgagagccugugcuuaa

SEQ ID NO: 222162 - RNA, 32 nt, Human
uacugauuccuccaacucuccaccccacaaaa

SEQ ID NO: 222163 - RNA, 32 nt, Human
uacugauucuacucugcuuuuauccuuuggag

SEQ ID NO: 222164 - RNA, 32 nt, Human
uacugauuuggggcaaagugaaaccucugcuu

SEQ ID NO: 222165 - RNA, 32 nt, Human
uacugauuugugggaugguggcaggggugugg

SEQ ID NO: 222166 - RNA, 32 nt, Human
uacugauuuugaaaaagagaauuauucuuauu

SEQ ID NO: 222167 - RNA, 32 nt, Human
uacugcaaaaacucaaaaauuagccaggcgug

SEQ ID NO: 222168 - RNA, 32 nt, Human
uacugcaaaauacaaaaauuagccgggcuugg

SEQ ID NO: 222169 - RNA, 32 nt, Human
uacugcaauaaagagagcaggagaggagcugc

SEQ ID NO: 222170 - RNA, 32 nt, Human
uacugcaauugcuucccuucuuaaacaguaua

SEQ ID NO: 222171 - RNA, 32 nt, Human
uacugcacacucagcacccaggacuggaauca

SEQ ID NO: 222172 - RNA, 32 nt, Human
uacugcacccucaaccuccugggcucaagcaa

SEQ ID NO: 222173 - RNA, 32 nt, Human
uacugcacuccagccccagcugggugacagag

SEQ ID NO: 222174 - RNA, 32 nt, Human
uacugcacuguaguuucaaauggauccuccag

SEQ ID NO: 222175 - RNA, 32 nt, Human
uacugcagauguguguucucugggcuuuaugu

SEQ ID NO: 222176 - RNA, 26 nt, Human
uacugcagcacaaguuugagcaggug

SEQ ID NO: 222177 - RNA, 20 nt, Human
uacugcagccucaaccuccu

SEQ ID NO: 222178 - RNA, 32 nt, Human
uacugcagccucaaccuccugggcucaaguga

SEQ ID NO: 222179 - RNA, 32 nt, Human
uacugcagccucaaccuccugggcucagguga

SEQ ID NO: 222180 - RNA, 32 nt, Human
uacugcagccuccagagaguaucugaggcaca

SEQ ID NO: 222181 - RNA, 32 nt, Human
uacugcagccugggugacagaaugagacugca

SEQ ID NO: 222182 - RNA, 32 nt, Human
uacugcagcuauuuggaaauguuuuccaaacc

SEQ ID NO: 222183 - RNA, 32 nt, Human
uacugcaggaacuucuggaggaaagcacucau

SEQ ID NO: 222184 - RNA, 32 nt, Human
uacugcaggaauaaaccaggagagcugagaga

SEQ ID NO: 222185 - RNA, 32 nt, Human
uacugcaguaagcauuaggaagugaauaugau

SEQ ID NO: 222186 - RNA, 32 nt, Human
uacugcagucuauuuaaagaugacauuuggug

SEQ ID NO: 222187 - RNA, 32 nt, Human
uacugcagugucuggagguugcgggaaggaga

SEQ ID NO: 222188 - RNA, 32 nt, Human
uacugcauccuuuggcugggccuuguugaccc

SEQ ID NO: 222189 - RNA, 32 nt, Human
uacugcaucuaucaacccgucaucuagguuuu

SEQ ID NO: 222190 - RNA, 32 nt, Human
uacugcaucucagcccacaucucagcccuucc

SEQ ID NO: 222191 - RNA, 32 nt, Human
uacugcaucugucagcaggcugcagggagugc

SEQ ID NO: 222192 - RNA, 32 nt, Human
uacugcauucucuuuaucacauagugguuguu

SEQ ID NO: 222193 - RNA, 32 nt, Human
uacugcauugugccuucccaaugaugucaaac

SEQ ID NO: 222194 - RNA, 32 nt, Human
uacugccaagccccugcccuggggagaaagua

SEQ ID NO: 222195 - RNA, 32 nt, Human
uacugccacagcugcucaccuugucuggcaaa

SEQ ID NO: 222196 - RNA, 32 nt, Human
uacugccaccucuuuguucaucuggcccagcu

SEQ ID NO: 222197 - RNA, 32 nt, Human
uacugccacugaggcaguagguuuuagguggu

SEQ ID NO: 222198 - RNA, 32 nt, Human
uacugccacugugugccuucugccaacgccuc

SEQ ID NO: 222199 - RNA, 32 nt, Human
uacugccaggagguggaggaaggagcaggugc

SEQ ID NO: 222200 - RNA, 32 nt, Human
uacugccaucaaccccacccccauaaagcugu

SEQ ID NO: 222201 - RNA, 32 nt, Human
uacugccauccauacuaacacaaauuuggaaa

SEQ ID NO: 222202 - RNA, 32 nt, Human
uacugcccagaacaguggcccauagcagggac

SEQ ID NO: 222203 - RNA, 32 nt, Human
uacugcccagcacccacccggccaugaggacc

SEQ ID NO: 222204 - RNA, 32 nt, Human
uacugccccucagcagggaugacucagcaggg

SEQ ID NO: 222205 - RNA, 32 nt, Human
uacugccccugccuaugcccacggggcuggug

SEQ ID NO: 222206 - RNA, 32 nt, Human
uacugcccucgaggcagcccucccaagucaga

SEQ ID NO: 222207 - RNA, 32 nt, Human
uacugcccugugagacugggaaugacaacugg

SEQ ID NO: 222208 - RNA, 32 nt, Human
uacugcccuucacccaaccucucccaccucca

SEQ ID NO: 222209 - RNA, 32 nt, Human
uacugcccuucucuugcugccuccugggcagg

SEQ ID NO: 222210 - RNA, 32 nt, Human
uacugccucaaccucucaggcccgagcaaucc

SEQ ID NO: 222211 - RNA, 32 nt, Human
uacugccucucgcuccucaaccccuccccucc

SEQ ID NO: 222212 - RNA, 32 nt, Human
uacugccugccugccugccugcuacggcucag

SEQ ID NO: 222213 - RNA, 32 nt, Human
uacugccugccugccugccugcuacggugagu

SEQ ID NO: 222214 - RNA, 32 nt, Human
uacugccuggguggcaagggugagacuccauc

SEQ ID NO: 222215 - RNA, 32 nt, Human
uacugccugucccggcaucucucccuccgccg

SEQ ID NO: 222216 - RNA, 32 nt, Human
uacugccugugggccaaauuugcccaccaccu

SEQ ID NO: 222217 - RNA, 32 nt, Human
uacugccuuuaauagaaaaccuaaaugcuggg

SEQ ID NO: 222218 - RNA, 32 nt, Human
uacugcgcaaauucugggagguuugggccugg

SEQ ID NO: 222219 - RNA, 29 nt, Human
uacugcgguuugccugugccuggacaaug

SEQ ID NO: 222220 - RNA, 32 nt, Human
uacugcguagaggccguagcuggcggaaggag

SEQ ID NO: 222221 - RNA, 32 nt, Human
uacugcgugcuuguauucgaugagguuuccau

SEQ ID NO: 222222 - RNA, 32 nt, Human
uacugcuaaaucugcauguccucugugugacu

SEQ ID NO: 222223 - RNA, 32 nt, Human
uacugcuaaugccaccacuaccccugccauca

SEQ ID NO: 222224 - RNA, 32 nt, Human
uacugcuaggugugugggguguuucgccugca

SEQ ID NO: 222225 - RNA, 32 nt, Human
uacugcuauauuaucccagucaaaaccaauac

SEQ ID NO: 222226 - RNA, 32 nt, Human
uacugcucauuucucaaccuuuuccaagccac

SEQ ID NO: 222227 - RNA, 32 nt, Human
uacugcuccagccggggcuccggggcggcagc

SEQ ID NO: 222228 - RNA, 32 nt, Human
uacugcuccuacuccaggacucucacaaagcu

SEQ ID NO: 222229 - RNA, 32 nt, Human
uacugcucgccaggaaccucgccugguccuga

SEQ ID NO: 222230 - RNA, 32 nt, Human
uacugcucuaauuugagugaaaguuauuagcg

SEQ ID NO: 222231 - RNA, 32 nt, Human
uacugcucuccuccaccucaacuccgugcuua

SEQ ID NO: 222232 - RNA, 32 nt, Human
uacugcucuuguaggagcuccucucacaagua

SEQ ID NO: 222233 - RNA, 32 nt, Human
uacugcucuuucagacaaacaguccauuuuua

SEQ ID NO: 222234 - RNA, 32 nt, Human
uacugcucuuuuccccucucccuccacaccag

SEQ ID NO: 222235 - RNA, 32 nt, Human
uacugcugacagcaaccauguucucacccaaa

SEQ ID NO: 222236 - RNA, 32 nt, Human
uacugcugaccuuucagugcuguuugcucaga

SEQ ID NO: 222237 - RNA, 32 nt, Human
uacugcugccaagaaguugcucugaagucagu

SEQ ID NO: 222238 - RNA, 32 nt, Human
uacugcugcccugaaaggaugcacugagaaca

SEQ ID NO: 222239 - RNA, 32 nt, Human
uacugcugguauagcugaacuacugaccugga

SEQ ID NO: 222240 - RNA, 32 nt, Human
uacugcuguggcuagagaguuugaggauugcu

SEQ ID NO: 222241 - RNA, 32 nt, Human
uacugcuuccugcagcuggccuagaugauguc

SEQ ID NO: 222242 - RNA, 32 nt, Human
uacugcuucuuucugucuguguguuuuaauuu

SEQ ID NO: 222243 - RNA, 32 nt, Human
uacugcuuugauggcuggggccagucucuugu

SEQ ID NO: 222244 - RNA, 32 nt, Human
uacuggaaaaccaggcguagucuggagucuca

SEQ ID NO: 222245 - RNA, 32 nt, Human
uacuggaacuaguacuuucuucucucauuccg

SEQ ID NO: 222246 - RNA, 32 nt, Human
uacuggacaaaaagacuggacugcaacugacc

SEQ ID NO: 222247 - RNA, 32 nt, Human
uacuggacuguacauaaacauuccacauugug

SEQ ID NO: 222248 - RNA, 32 nt, Human
uacuggagacaggguuucaccauguuggccag

SEQ ID NO: 222249 - RNA, 32 nt, Human
uacuggagccuggucagaggaggacuuugggg

SEQ ID NO: 222250 - RNA, 32 nt, Human
uacuggagcgugcccuugcuggggacguggcu

SEQ ID NO: 222251 - RNA, 19 nt, Human
uacuggaguucccuucuuc

SEQ ID NO: 222252 - RNA, 32 nt, Human
uacuggauguggugaugcuccuccuuuaucuu

SEQ ID NO: 222253 - RNA, 32 nt, Human
uacuggauguuacuuauuuuugaacugaauac

SEQ ID NO: 222254 - RNA, 32 nt, Human
uacuggauguuuagcuucuuacugcaaaaaca

SEQ ID NO: 222255 - RNA, 32 nt, Human
uacuggauuccagcauucagcaggugcagauc

SEQ ID NO: 222256 - RNA, 32 nt, Human
uacuggauucuugaucuuucugcaucaucaag

SEQ ID NO: 222257 - RNA, 32 nt, Human
uacuggcaagguuuuuaaaaaugagguaaaug

SEQ ID NO: 222258 - RNA, 32 nt, Human
uacuggcaauacuccagccuggugacagagug

SEQ ID NO: 222259 - RNA, 32 nt, Human
uacuggcacagcaagcccaccaauuauuagca

SEQ ID NO: 222260 - RNA, 32 nt, Human
uacuggcaccuugaucuuggacuucccagccu

SEQ ID NO: 222261 - RNA, 32 nt, Human
uacuggcagagcugcugcgaggacccuguggc

SEQ ID NO: 222262 - RNA, 32 nt, Human
uacuggcagccccugaauuggcucaacguuug

SEQ ID NO: 222263 - RNA, 32 nt, Human
uacuggcaggaaccaccaggcccagccaacca

SEQ ID NO: 222264 - RNA, 32 nt, Human
uacuggcagguccucacccccugggccggaac

SEQ ID NO: 222265 - RNA, 32 nt, Human
uacuggcauagucaugacaaccucugguaauc

SEQ ID NO: 222266 - RNA, 32 nt, Human
uacuggcaugagccacugugcccagcccggau

SEQ ID NO: 222267 - RNA, 32 nt, Human
uacuggcauuucuauuucuagaaauaauauuu

SEQ ID NO: 222268 - RNA, 32 nt, Human
uacuggccagucugcauccuugccuagaccau

SEQ ID NO: 222269 - RNA, 32 nt, Human
uacuggccaucugaccuacaaaugugguggca

SEQ ID NO: 222270 - RNA, 32 nt, Human
uacuggcccuuuagugcuuugccugaaagaga

SEQ ID NO: 222271 - RNA, 32 nt, Human
uacuggcgaaaauguuggaccacuugcuuuac

SEQ ID NO: 222272 - RNA, 32 nt, Human
uacuggcgaucaucaagcaaaagcugccaauu

SEQ ID NO: 222273 - RNA, 32 nt, Human
uacuggcgugagccaccgugccuggccagcau

SEQ ID NO: 222274 - RNA, 32 nt, Human
uacuggcuaagaaaggagagacagcuucauga

SEQ ID NO: 222275 - RNA, 32 nt, Human
uacuggcuauuuucucuucucgccguagugcc

SEQ ID NO: 222276 - RNA, 32 nt, Human
uacuggcucccaggauggcggugguggcagca

SEQ ID NO: 222277 - RNA, 32 nt, Human
uacuggcuccugcaaaccugggcugcucaucu

SEQ ID NO: 222278 - RNA, 32 nt, Human
uacuggcuccuggaugagggggccagagagga

SEQ ID NO: 222279 - RNA, 32 nt, Human
uacuggcuccuggcagcggcuuuuguggaaga

SEQ ID NO: 222280 - RNA, 32 nt, Human
uacuggcucugaggugcaugcagagaggagga

SEQ ID NO: 222281 - RNA, 32 nt, Human
uacuggcugaggacaggggagggagugaaguu

SEQ ID NO: 222282 - RNA, 32 nt, Human
uacuggcuggacccucugcccugggcaggagg

SEQ ID NO: 222283 - RNA, 18 nt, Human
uacuggcuggagugcagu

SEQ ID NO: 222284 - RNA, 19 nt, Human
uacuggcuggagugcagug

SEQ ID NO: 222285 - RNA, 32 nt, Human
uacuggcugggauggcucugauauacagccuu

SEQ ID NO: 222286 - RNA, 32 nt, Human
uacuggcugggguaggccucagugagucggcc

SEQ ID NO: 222287 - RNA, 32 nt, Human
uacuggcuuacugagagauuacuccaauuuaa

SEQ ID NO: 222288 - RNA, 32 nt, Human
uacuggcuucgcacacagcuggcuccaggaaa

SEQ ID NO: 222289 - RNA, 32 nt, Human
uacuggcuugagccacugcacccaccccucca

SEQ ID NO: 222290 - RNA, 32 nt, Human
uacuggcuuugugccuguagcucauuuuauua

SEQ ID NO: 222291 - RNA, 32 nt, Human
uacugggaaaaggucaagaaagaggcagaaag

SEQ ID NO: 222292 - RNA, 32 nt, Human
uacugggaaaggcagaggguggagggaagauu

SEQ ID NO: 222293 - RNA, 32 nt, Human
uacugggaaguuaaaaggaaggggcuuagaaa

SEQ ID NO: 222294 - RNA, 32 nt, Human
uacugggacaaugaccacgcugccuguuuguc

SEQ ID NO: 222295 - RNA, 32 nt, Human
uacugggacuacaggcaugagaaaccaagccc

SEQ ID NO: 222296 - RNA, 32 nt, Human
uacugggagagaagaagauaagcuggaagagg

SEQ ID NO: 222297 - RNA, 32 nt, Human
uacugggagagggagacaaaaccucauggcaa

SEQ ID NO: 222298 - RNA, 32 nt, Human
uacugggauuacaagagcccaccaccaugccu

SEQ ID NO: 222299 - RNA, 32 nt, Human
uacugggauuacaggcaugaaccaccguggcc

SEQ ID NO: 222300 - RNA, 32 nt, Human
uacugggauuacaggcaugagcaccuggcccc

SEQ ID NO: 222301 - RNA, 32 nt, Human
uacugggauuacaggcaugagccaccacaccu

SEQ ID NO: 222302 - RNA, 32 nt, Human
uacugggauuacaggcaugagccacugcaccc

SEQ ID NO: 222303 - RNA, 32 nt, Human
uacugggauuacaggcaugaggcaucacagcc

SEQ ID NO: 222304 - RNA, 32 nt, Human
uacugggauuacaggcgcccaccaccacgccc

SEQ ID NO: 222305 - RNA, 32 nt, Human
uacugggauuacaggcgugagccaccucgccc

SEQ ID NO: 222306 - RNA, 32 nt, Human
uacugggauuacaggugcccaccaccaccccu

SEQ ID NO: 222307 - RNA, 32 nt, Human
uacugggauuauauaggcaugagccacugagc

SEQ ID NO: 222308 - RNA, 32 nt, Human
uacugggcaggacuugaggugugcaaaggugu

SEQ ID NO: 222309 - RNA, 24 nt, Human
uacugggcaggcugcaaaugucug

SEQ ID NO: 222310 - RNA, 32 nt, Human
uacugggcaucuccugagccuaggcaauagcu

SEQ ID NO: 222311 - RNA, 32 nt, Human
uacugggcauuggccagcuacuggggauaugg

SEQ ID NO: 222312 - RNA, 32 nt, Human
uacugggcccaggaguucgaggugcaguuugg

SEQ ID NO: 222313 - RNA, 32 nt, Human
uacugggcccagggugcugagcuuuccagaac

SEQ ID NO: 222314 - RNA, 32 nt, Human
uacugggcucaagacauccuccugcuucagcc

SEQ ID NO: 222315 - RNA, 32 nt, Human
uacugggcucaagccuuccucccgccucagcc

SEQ ID NO: 222316 - RNA, 32 nt, Human
uacugggcuggucggaugagcugaggccauug

SEQ ID NO: 222317 - RNA, 22 nt, Human
uacugggcuuugguggaaacug

SEQ ID NO: 222318 - RNA, 32 nt, Human
uacuggggaaauuccuacacugucuuagaacc

SEQ ID NO: 222319 - RNA, 32 nt, Human
uacuggggaaauuccuucacugucuuagaacc

SEQ ID NO: 222320 - RNA, 32 nt, Human
uacuggggaaauugcuucacugucuuagaacc

SEQ ID NO: 222321 - RNA, 32 nt, Human
uacuggggaacagaaagauaugacagaguuuu

SEQ ID NO: 222322 - RNA, 32 nt, Human
uacuggggaagcugaggcaggagaauugcuug

SEQ ID NO: 222323 - RNA, 32 nt, Human
uacuggggagaaaccccacaaauguggagaau

SEQ ID NO: 222324 - RNA, 32 nt, Human
uacuggggaggcagcuggagcagcaagaugcu

SEQ ID NO: 222325 - RNA, 32 nt, Human
uacuggggaggcugaggcaggagaauagcuug

SEQ ID NO: 222326 - RNA, 27 nt, Human
uacuggggaggcugaggcaggagaauc

SEQ ID NO: 222327 - RNA, 32 nt, Human
uacuggggaggcugaggcaggagaaucacuug

SEQ ID NO: 222328 - RNA, 32 nt, Human
uacuggggaggcugaggcaggagaaucgcuug

SEQ ID NO: 222329 - RNA, 32 nt, Human
uacuggggaggcugaggcaggagaaucguuuu

SEQ ID NO: 222330 - RNA, 32 nt, Human
uacuggggaggcugaggcaggagaauggcaug

SEQ ID NO: 222331 - RNA, 32 nt, Human
uacuggggaggcugaggcaggagaauggcgug

SEQ ID NO: 222332 - RNA, 32 nt, Human
uacuggggaggcugaggcaggagaauggcuug

SEQ ID NO: 222333 - RNA, 32 nt, Human
uacuggggaggcugaggcaggagaauugcuua

SEQ ID NO: 222334 - RNA, 32 nt, Human
uacuggggaggcugaggcaggagaauugcuuu

SEQ ID NO: 222335 - RNA, 32 nt, Human
uacuggggaggcugagucaggagaaucgcuug

SEQ ID NO: 222336 - RNA, 32 nt, Human
uacuggggcuguagucugaucuacuggggcug

SEQ ID NO: 222337 - RNA, 32 nt, Human
uacugggggaugagagaaaggcauuuuauagc

SEQ ID NO: 222338 - RNA, 32 nt, Human
uacugggggugaggggacaagaaagccaugaa

SEQ ID NO: 222339 - RNA, 32 nt, Human
uacuggggucuggucuuccugcucugugguuu

SEQ ID NO: 222340 - RNA, 32 nt, Human
uacugggugcaguggggugcuuaaacaucaac

SEQ ID NO: 222341 - RNA, 32 nt, Human
uacuggguucaagugauucucuugccucaauc

SEQ ID NO: 222342 - RNA, 32 nt, Human
uacugguauacagcuacauccaggagagaaug

SEQ ID NO: 222343 - RNA, 32 nt, Human
uacuggucagagacuguguucaacaccucuga

SEQ ID NO: 222344 - RNA, 32 nt, Human
uacuggucagcaucaggguccccagccucugg

SEQ ID NO: 222345 - RNA, 31 nt, Human
uacuggucaucuuucugacaucacaguagaa

SEQ ID NO: 222346 - RNA, 32 nt, Human
uacuggucaugccaggcacacacugcugccca

SEQ ID NO: 222347 - RNA, 32 nt, Human
uacugguccagcugcccugggcuccuuuucua

SEQ ID NO: 222348 - RNA, 32 nt, Human
uacuggucuaacuucauucaguaugcuucauu

SEQ ID NO: 222349 - RNA, 22 nt, Human
uacuggucugggaaacaggaug

SEQ ID NO: 222350 - RNA, 32 nt, Human
uacuggugaggaagcugaagcagagaaguuaa

SEQ ID NO: 222351 - RNA, 32 nt, Human
uacuggugcaaucacugaucacugcagccucc

SEQ ID NO: 222352 - RNA, 32 nt, Human
uacuggugcagaugguugacauuuuucccuau

SEQ ID NO: 222353 - RNA, 32 nt, Human
uacuggugcauguuguaacauaucuaugauaa

SEQ ID NO: 222354 - RNA, 32 nt, Human
uacuggugcccaccaccaugcccagcuaauuu

SEQ ID NO: 222355 - RNA, 32 nt, Human
uacuggugugagccaccacggccagcugcuag

SEQ ID NO: 222356 - RNA, 32 nt, Human
uacuggugugagccacugugucuggccagaaa

SEQ ID NO: 222357 - RNA, 32 nt, Human
uacugguuuaggaguucaaaauucagugaaac

SEQ ID NO: 222358 - RNA, 26 nt, Human
uagcuguaggugugugcacaguuuac

SEQ ID NO: 222359 - RNA, 32 nt, Human
uagcuguauuaaaaauagcaaagcaucggacu

SEQ ID NO: 222360 - RNA, 32 nt, Human
uagcugucagaugucacauaauuacuuucgua

SEQ ID NO: 222361 - RNA, 32 nt, Human
uagcugucaggguuccacuuaauuuaaagcug

SEQ ID NO: 222362 - RNA, 32 nt, Human
uagcugucuccucaucucauccuagucuaggu

SEQ ID NO: 222363 - RNA, 32 nt, Human
uagcugucuccucugcagcaugagcagcugua

SEQ ID NO: 222364 - RNA, 23 nt, Human
uagcugucucuucucacccaaau

SEQ ID NO: 222365 - RNA, 18 nt, Human
uagcugucuuuuucauua

SEQ ID NO: 222366 - RNA, 31 nt, Human
uagcugugacuucugcccugccaggccgcac

SEQ ID NO: 222367 - RNA, 32 nt, Human
uagcugugagacauagauuacagccuaugcua

SEQ ID NO: 222368 - RNA, 32 nt, Human
uagcugugagccagcacucagcugugucagau

SEQ ID NO: 222369 - RNA, 32 nt, Human
uagcugugaggguggacacacauauguguauu

SEQ ID NO: 222370 - RNA, 32 nt, Human
uagcugugcaagauaaaagcagccugggucac

SEQ ID NO: 222371 - RNA, 32 nt, Human
uagcugugcagaaagugagagcaggggcaccu

SEQ ID NO: 222372 - RNA, 32 nt, Human
uagcugugcagauguggaucaacauuuguuua

SEQ ID NO: 222373 - RNA, 31 nt, Human
uagcugugccacucugggcaaaugcucuucc

SEQ ID NO: 222374 - RNA, 32 nt, Human
uagcuguggacuucugcugauugccuauagcu

SEQ ID NO: 222375 - RNA, 32 nt, Human
uagcuguggcugagccaagauugcacuuguga

SEQ ID NO: 222376 - RNA, 32 nt, Human
uagcugugguaggaaguggcccucagagucaa

SEQ ID NO: 222377 - RNA, 32 nt, Human
uagcuguguggcugcccuuccugggcccugcc

SEQ ID NO: 222378 - RNA, 32 nt, Human
uagcugugugggcugggaggucugguagggcu

SEQ ID NO: 222379 - RNA, 32 nt, Human
uagcuguuaagguggcguguugcagugcagag

SEQ ID NO: 222380 - RNA, 32 nt, Human
uagcuguuuccagccagggggcugaggcaccu

SEQ ID NO: 222381 - RNA, 32 nt, Human
uagcuguuuccaggguugcaacuugaauuaag

SEQ ID NO: 222382 - RNA, 32 nt, Human
uagcuguuuccucugccuaaacauccuuacac

SEQ ID NO: 222383 - RNA, 23 nt, Human
uagcuuaacagugaccuucagaa

SEQ ID NO: 222384 - RNA, 24 nt, Human
uagcuuaauaacugaccuucugaa

SEQ ID NO: 222385 - RNA, 32 nt, Human
uagcuuacgccuguaaucccagcacuuugaga

SEQ ID NO: 222386 - RNA, 32 nt, Human
uagcuuacgccuguuaucccagcacuuuggga

SEQ ID NO: 222387 - RNA, 32 nt, Human
uagcuuacugcacccucaaccuccugggcuca

SEQ ID NO: 222388 - RNA, 32 nt, Human
uagcuuacuucacaaugugcccaggucagcug

SEQ ID NO: 222389 - RNA, 32 nt, Human
uagcuuaugaaaauaaucgacucugaauauuu

SEQ ID NO: 222390 - RNA, 32 nt, Human
uagcuuauguacaaaacuuuuuaaauuuuaua

SEQ ID NO: 222391 - RNA, 32 nt, Human
uagcuucacagcaacagggagcuaggccauug

SEQ ID NO: 222392 - RNA, 32 nt, Human
uagcuucacaugcuucugcagcugagcuugca

SEQ ID NO: 222393 - RNA, 32 nt, Human
uagcuucacucagcuggacugcauugaaggcg

SEQ ID NO: 222394 - RNA, 32 nt, Human
uagcuucagcuugggcuggagcagucaauaua

SEQ ID NO: 222395 - RNA, 32 nt, Human
uagcuucaggaucagcuggggguauggaauug

SEQ ID NO: 222396 - RNA, 32 nt, Human
uagcuucaucuugagccugagccuuagaaucu

SEQ ID NO: 222397 - RNA, 32 nt, Human
uagcuuccacuggcagccuagcuuugagggua

SEQ ID NO: 222398 - RNA, 32 nt, Human
uagcuuccacuugguggguaaggccugaucau

SEQ ID NO: 222399 - RNA, 32 nt, Human
uagcuuccagcaguccacuaucugccagagga

SEQ ID NO: 222400 - RNA, 19 nt, Human
uagcuuccagggcagggag

SEQ ID NO: 222401 - RNA, 32 nt, Human
uagcuuccucaaauuccugggcucgaaugguc

SEQ ID NO: 222402 - RNA, 32 nt, Human
uagcuuccuccaggagcugcuccuguggguug

SEQ ID NO: 222403 - RNA, 32 nt, Human
uagcuuccugcccucugcuugaggaacacgga

SEQ ID NO: 222404 - RNA, 32 nt, Human
uagcuuccugggccccucacccccagcuggaa

SEQ ID NO: 222405 - RNA, 32 nt, Human
uagcuuccuguggcugucacuccugggcccag

SEQ ID NO: 222406 - RNA, 32 nt, Human
uagcuucggccaaacguucuccucccgcuaag

SEQ ID NO: 222407 - RNA, 32 nt, Human
uagcuucuaguuuuccucaucuguaaacuggg

SEQ ID NO: 222408 - RNA, 32 nt, Human
uagcuucucaaaggccuaaccaagccuuggca

SEQ ID NO: 222409 - RNA, 32 nt, Human
uagcuucucacugacacacccuucccaauugc

SEQ ID NO: 222410 - RNA, 32 nt, Human
uagcuucugaguagaaacaaggaagcuacccu

SEQ ID NO: 222411 - RNA, 20 nt, Human
uagcuucugcucacugggca

SEQ ID NO: 222412 - RNA, 32 nt, Human
uagcuucugcuggccugggguggacccaggac

SEQ ID NO: 222413 - RNA, 32 nt, Human
uagcuucuugggaggcugaggcaggauugcuu

SEQ ID NO: 222414 - RNA, 19 nt, Human
uagcuucuuguaguuuuaa

SEQ ID NO: 222415 - RNA, 32 nt, Human
uagcuugaacccaggagguggagguugcagug

SEQ ID NO: 222416 - RNA, 32 nt, Human
uagcuugaagcacaccacuguccauuuauuug

SEQ ID NO: 222417 - RNA, 32 nt, Human
uagcuugagcccaggaguuugaagcugcagug

SEQ ID NO: 222418 - RNA, 32 nt, Human
uagcuugagcucagagaguucgagacaaaccu

SEQ ID NO: 222419 - RNA, 22 nt, Human
uagcuugagggggcacaugaag

SEQ ID NO: 222420 - RNA, 32 nt, Human
uagcuugauucugccuaccauccaggaaaacu

SEQ ID NO: 222421 - RNA, 32 nt, Human
uagcuugauuucugucauuugagcccagggau

SEQ ID NO: 222422 - RNA, 32 nt, Human
uagcuugcagugagccgagauugcgccacugc

SEQ ID NO: 222423 - RNA, 32 nt, Human
uagcuugcagugagcugagaucacaccacugc

SEQ ID NO: 222424 - RNA, 32 nt, Human
uagcuugcauucuuguugucucugaugcaugc

SEQ ID NO: 222425 - RNA, 32 nt, Human
uagcuugcccugcugugaacuugcacuuggag

SEQ ID NO: 222426 - RNA, 32 nt, Human
uagcuugccugacaguguucuuaaaacugguu

SEQ ID NO: 222427 - RNA, 32 nt, Human
uagcuugcuugaaguugucucacagcucacuu

SEQ ID NO: 222428 - RNA, 32 nt, Human
uagcuuggaagggggagggacgucuaccauua

SEQ ID NO: 222429 - RNA, 32 nt, Human
uagcuuggaagguuuacugcugccucaagucc

SEQ ID NO: 222430 - RNA, 32 nt, Human
uagcuuggacuacaggcccugccaccacgccc

SEQ ID NO: 222431 - RNA, 32 nt, Human
uagcuuggauuacagagguuguuggcuuccau

SEQ ID NO: 222432 - RNA, 32 nt, Human
uagcuuggccaacauagugaaaccccaucucu

SEQ ID NO: 222433 - RNA, 32 nt, Human
uagcuuggccaacauggugaaaccucaucucu

SEQ ID NO: 222434 - RNA, 32 nt, Human
uagcuuguauccagcagaguggcacgugcugg

SEQ ID NO: 222435 - RNA, 32 nt, Human
uagcuugucccaagcuucccugccagccugaa

SEQ ID NO: 222436 - RNA, 31 nt, Human
uagcuuguccccucugggccugccugucuug

SEQ ID NO: 222437 - RNA, 32 nt, Human
uagcuugugagcaggcucaucaguaucuuguu

SEQ ID NO: 222438 - RNA, 32 nt, Human
uagcuuguguguggccugccuccaccauagca

SEQ ID NO: 222439 - RNA, 32 nt, Human
uagcuuuaaaccaucaaccugaugaguuuaaa

SEQ ID NO: 222440 - RNA, 32 nt, Human
uagcuuuaaggagccaagcugaaaaucaugug

SEQ ID NO: 222441 - RNA, 32 nt, Human
uagcuuuauugagauauucacauaucauauaa

SEQ ID NO: 222442 - RNA, 32 nt, Human
uagcuuucauuuggggaaugaaguucugaaau

SEQ ID NO: 222443 - RNA, 32 nt, Human
uagcuuucgguugguuugguguucuguuuauu

SEQ ID NO: 222444 - RNA, 32 nt, Human
uagcuuucucauaaauaugggcaccacuuuac

SEQ ID NO: 222445 - RNA, 32 nt, Human
uagcuuucuccuccuggugucauugcugcagc

SEQ ID NO: 222446 - RNA, 32 nt, Human
uagcuuucuguagagaaggaauuccuaccucu

SEQ ID NO: 222447 - RNA, 18 nt, Human
uagcuuugaauauucaca

SEQ ID NO: 222448 - RNA, 32 nt, Human
uagcuuugacaggaaaaggaaaaagaaugagg

SEQ ID NO: 222449 - RNA, 20 nt, Human
uagcuuugaguuucucugca

SEQ ID NO: 222450 - RNA, 32 nt, Human
uagcuuugaugucugggcaucgauuucccucg

SEQ ID NO: 222451 - RNA, 32 nt, Human
uagcuuugggugcagagccaggagggcguuug

SEQ ID NO: 222452 - RNA, 32 nt, Human
uagcuuuguaugaacugagugugccagaaaua

SEQ ID NO: 222453 - RNA, 32 nt, Human
uagcuuuuccuucuuucucuccagaagaaaca

SEQ ID NO: 222454 - RNA, 32 nt, Human
uagcuuuucuuucuuugagucuuuaaagggca

SEQ ID NO: 222455 - RNA, 32 nt, Human
uagcuuuuuaaaacccccuccuguuucagagc

SEQ ID NO: 222456 - RNA, 32 nt, Human
uaggaaaaauuagcuggccaugguggcgugca

SEQ ID NO: 222457 - RNA, 32 nt, Human
uaggaaaacaaaacccaaagcuuuucaaacuu

SEQ ID NO: 222458 - RNA, 32 nt, Human
uaggaaaacagaagcuuucuucuuccuucuac

SEQ ID NO: 222459 - RNA, 32 nt, Human
uaggaaaagagaggagagaaaagcaacugagu

SEQ ID NO: 222460 - RNA, 32 nt, Human
uaggaaaagcugcucagagaggucauaugggc

SEQ ID NO: 222461 - RNA, 32 nt, Human
uaggaaaagucucuuucuuucucuucuuuccu

SEQ ID NO: 222462 - RNA, 32 nt, Human
uaggaaacagcauaggauuguaugugggaggu

SEQ ID NO: 222463 - RNA, 22 nt, Human
uaggaaacagugaccauuuuca

SEQ ID NO: 222464 - RNA, 32 nt, Human
uaggaaaccauaguauuucauuguuuuaauuu

SEQ ID NO: 222465 - RNA, 32 nt, Human
uaggaaacgaaaggcaccaaagagcacaauga

SEQ ID NO: 222466 - RNA, 32 nt, Human
uaggaaacuggaaagauaaugaguggcccccu

SEQ ID NO: 222467 - RNA, 32 nt, Human
uaggaaacuggaaagauaaugaguggccccgu

SEQ ID NO: 222468 - RNA, 32 nt, Human
uaggaaacuuaaaagaaauauccuuuugacac

SEQ ID NO: 222469 - RNA, 32 nt, Human
uaggaaagaacaguagccuuuuguauuagaaa

SEQ ID NO: 222470 - RNA, 32 nt, Human
uaggaaagacuugcuauugccuaaggcuaugu

SEQ ID NO: 222471 - RNA, 32 nt, Human
uaggaaagagagauguuuuucccaccugucag

SEQ ID NO: 222472 - RNA, 32 nt, Human
uaggaaagaggugaaaaggaaaaagguugucc

SEQ ID NO: 222473 - RNA, 32 nt, Human
uaggaaagauccaaaacacagagcaggagucc

SEQ ID NO: 222474 - RNA, 32 nt, Human
uaggaaagccaggucccugggcccuuguccca

SEQ ID NO: 222475 - RNA, 32 nt, Human
uaggaaagccuggguuggguggagcagaacca

SEQ ID NO: 222476 - RNA, 32 nt, Human
uaggaaagccuguauucuuucaaugaauguca

SEQ ID NO: 222477 - RNA, 32 nt, Human
uaggaaaggaaaggcaccaaagagcacaauga

SEQ ID NO: 222478 - RNA, 32 nt, Human
uaggaaaggaagcagauaccuugcaaagcaac

SEQ ID NO: 222479 - RNA, 32 nt, Human
uaggaaaggguaaguggggcccaggggcaggg

SEQ ID NO: 222480 - RNA, 32 nt, Human
uaggaaauaucauuaauucagcucuucagaga

SEQ ID NO: 222481 - RNA, 32 nt, Human
uaggaaaucccuugagcuuagaccugagggag

SEQ ID NO: 222482 - RNA, 32 nt, Human
uaggaaauggggccgccuggcccagccacuca

SEQ ID NO: 222483 - RNA, 31 nt, Human
uaggaaauuauuuuagggguuggagguggga

SEQ ID NO: 222484 - RNA, 24 nt, Human
uaggaaauugauugcccauucuca

SEQ ID NO: 222485 - RNA, 32 nt, Human
uaggaacaacgcucaaaauccuaaggaaacug

SEQ ID NO: 222486 - RNA, 32 nt, Human
uaggaacaaugccaccauucccacaggagugg

SEQ ID NO: 222487 - RNA, 32 nt, Human
uaggaacacucgggaugacaccccuuaucaca

SEQ ID NO: 222488 - RNA, 32 nt, Human
uaggaacagcuccagucuacagcucccagcau

SEQ ID NO: 222489 - RNA, 32 nt, Human
uaggaacagcuccagucugcagcucccagcga

SEQ ID NO: 222490 - RNA, 32 nt, Human
uaggaacaggggagagugcaccugcuaccagu

SEQ ID NO: 222491 - RNA, 32 nt, Human
uaggaacauacaggaaacugccagcaggaucc

SEQ ID NO: 222492 - RNA, 20 nt, Human
uaggaacccagcucucaggg

SEQ ID NO: 222493 - RNA, 32 nt, Human
uaggaaccggggcagagucagcucugugcuga

SEQ ID NO: 222494 - RNA, 32 nt, Human
uaggaaccuccccucacuccccguuuuucuuc

SEQ ID NO: 222495 - RNA, 32 nt, Human
uaggaacgcagcgccgcggucucuccagccuc

SEQ ID NO: 222496 - RNA, 32 nt, Human
uaggaacucaaggagucagccuagaccccaca

SEQ ID NO: 222497 - RNA, 32 nt, Human
uaggaacucuaaugcuaagagugcuaaaaacu

SEQ ID NO: 222498 - RNA, 22 nt, Human
uaggaacugaacgugucaggga

SEQ ID NO: 222499 - RNA, 22 nt, Human
uaggaacuggugucuucagggg

SEQ ID NO: 222500 - RNA, 32 nt, Human
uaggaacuugacuugcguuagaguguacucug

SEQ ID NO: 222501 - RNA, 32 nt, Human
uaggaagaaagaggagacaaggacagacaaau

SEQ ID NO: 222502 - RNA, 32 nt, Human
uaggaagaaauggaaaucaguguucugaagaa

SEQ ID NO: 222503 - RNA, 32 nt, Human
uaggaagaacaaggaguugagcccuugaaaga

SEQ ID NO: 222504 - RNA, 32 nt, Human
uaggaagaacuggugcccccuccaguccuaau

SEQ ID NO: 222505 - RNA, 32 nt, Human
uaggaagaaguuagagucagggaacuuguaua

SEQ ID NO: 222506 - RNA, 32 nt, Human
uaggaagacuccgucucuacauagaaauuuua

SEQ ID NO: 222507 - RNA, 32 nt, Human
uaggaagaguacuccagagagcagggauaugu

SEQ ID NO: 222508 - RNA, 32 nt, Human
uaggaagauuguuauuauucuucacuugugau

SEQ ID NO: 222509 - RNA, 32 nt, Human
uaggaagcccagccagaggcuguaccaugagc

SEQ ID NO: 222510 - RNA, 32 nt, Human
uaggaagccugggaaccuggucuguuccuucc

SEQ ID NO: 222511 - RNA, 32 nt, Human
uaggaaggaccuuggagaucagcuggaccagc

SEQ ID NO: 222512 - RNA, 32 nt, Human
uaggaaggagaaauguggaaguuugggcagca

SEQ ID NO: 222513 - RNA, 32 nt, Human
uaggaaggccugugaaacaugacacugcaguu

SEQ ID NO: 222514 - RNA, 32 nt, Human
uaggaaggcugaggcaggagaaucgcuugaac

SEQ ID NO: 222515 - RNA, 32 nt, Human
uaggaaggggcagacguagacuuggaaggauu

SEQ ID NO: 222516 - RNA, 32 nt, Human
uaggaaggggcgacaccuuccucccaggaagc

SEQ ID NO: 222517 - RNA, 32 nt, Human
uaggaagggugggaagggagaagcagacauag

SEQ ID NO: 222518 - RNA, 32 nt, Human
uaggaagguggcggccagggaugaggaggccc

SEQ ID NO: 222519 - RNA, 32 nt, Human
uaggaaguacgagccccacagagcaggaagcc

SEQ ID NO: 222520 - RNA, 24 nt, Human
uaggaagugcauucuccauccuca

SEQ ID NO: 222521 - RNA, 22 nt, Human
uaggaagugcucucagccucuc

SEQ ID NO: 222522 - RNA, 32 nt, Human
uaggaaguuagauuugaauauagacaaggugg

SEQ ID NO: 222523 - RNA, 32 nt, Human
uaggaaguugugucagaggagugcagucaucu

SEQ ID NO: 222524 - RNA, 32 nt, Human
uaggaauacaucuugacccuuuuccacucaau

SEQ ID NO: 222525 - RNA, 32 nt, Human
uaggaaucauagugucagugaggucccgugag

SEQ ID NO: 222526 - RNA, 21 nt, Human
uaggaauccguacccuaggga

SEQ ID NO: 222527 - RNA, 21 nt, Human
uaggaauccguaccuuaggga

SEQ ID NO: 222528 - RNA, 32 nt, Human
uaggaaugaacugucugugaauguuuucaagc

SEQ ID NO: 222529 - RNA, 32 nt, Human
uaggaaugacacucagguucacuguggaaaac

SEQ ID NO: 222530 - RNA, 32 nt, Human
uaggaaugacauaccugggcucaggggaagca

SEQ ID NO: 222531 - RNA, 32 nt, Human
uaggaauggaggaggggagacuuucaaugguu

SEQ ID NO: 222532 - RNA, 32 nt, Human
uaggaauggucuggacuaggguucuccuuccc

SEQ ID NO: 222533 - RNA, 22 nt, Human
uaggaauguacguuuccagggg

SEQ ID NO: 222534 - RNA, 32 nt, Human
uaggaaugugaccgaaaacaaguugugcuaau

SEQ ID NO: 222535 - RNA, 32 nt, Human
uaggaaugugauacaugccuguuugcaaaguc

SEQ ID NO: 222536 - RNA, 32 nt, Human
uaggaauuacuugguuuugcacauuaagaggc

SEQ ID NO: 222537 - RNA, 32 nt, Human
uaggaauucauacugcgaaaagcaaugaauaa

SEQ ID NO: 222538 - RNA, 32 nt, Human
uaggaauucucuugauccugggauuaugcuuu

SEQ ID NO: 222539 - RNA, 32 nt, Human
uaggaauugcucacucagggagcucaguuuuu

SEQ ID NO: 222540 - RNA, 32 nt, Human
uaggaauuguuacuuguuacugcagcagcagc

SEQ ID NO: 222541 - RNA, 32 nt, Human
uaggacaaagcucaaaaguaccucugggacua

SEQ ID NO: 222542 - RNA, 32 nt, Human
uaggacaaguuguaccuugcccucucuccagc

SEQ ID NO: 222543 - RNA, 32 nt, Human
uaggacaccagcugccacuucuuuugccucau

SEQ ID NO: 222544 - RNA, 32 nt, Human
uaggacagacuucugaaaacuaaagacagaaa

SEQ ID NO: 222545 - RNA, 18 nt, Human
uaggacagauugcuucca

SEQ ID NO: 222546 - RNA, 22 nt, Human
uaggacagauuuuacguggaga

SEQ ID NO: 222547 - RNA, 32 nt, Human
uaggacagcaggcccaagucugcacaucccag

SEQ ID NO: 222548 - RNA, 32 nt, Human
uaggacagucucugucagacugagaugauggu

SEQ ID NO: 222549 - RNA, 32 nt, Human
uaggacagugccuggcacauaguagguguuca

SEQ ID NO: 222550 - RNA, 32 nt, Human
uaggacauaaaaaucacauauaucauguuuca

SEQ ID NO: 222551 - RNA, 32 nt, Human
uaggacauccuggguggguggagcuggggagg

SEQ ID NO: 222552 - RNA, 32 nt, Human
uaggacaucuguggggacugggagaagcagaa

SEQ ID NO: 222553 - RNA, 32 nt, Human
uaggacauugaguuuccaaguauugagauaag

SEQ ID NO: 222554 - RNA, 32 nt, Human
uaggaccaauuaccuugaaauauuuuaaaauc

SEQ ID NO: 222555 - RNA, 32 nt, Human
uaggaccacagcuugcuggauuuguguuagcu

SEQ ID NO: 222556 - RNA, 32 nt, Human
uaggaccagccaccccuccccauggccuccaa

SEQ ID NO: 222557 - RNA, 22 nt, Human
uaggaccagccuggacaacaug

SEQ ID NO: 222558 - RNA, 32 nt, Human
uaggaccagguccccuugagaggucagagggg

SEQ ID NO: 222559 - RNA, 32 nt, Human
uaggaccgggggaccccagagggaggccuagg

SEQ ID NO: 222560 - RNA, 30 nt, Human
uaggaccgucccacaccuuuuacuugcuca

SEQ ID NO: 222561 - RNA, 32 nt, Human
uaggaccucugauaugaaugugaucugagacu

SEQ ID NO: 222562 - RNA, 32 nt, Human
uaggaccugcaacuucagugcuucugggauaa

SEQ ID NO: 222563 - RNA, 32 nt, Human
uaggaccuucuugauagcucccugcacuuugg

SEQ ID NO: 222564 - RNA, 32 nt, Human
uaggaccuugccggauggggcaacuccgcccu

SEQ ID NO: 222565 - RNA, 32 nt, Human
uaggaccuugcuggacggugguggcugagacc

SEQ ID NO: 222566 - RNA, 32 nt, Human
uaggacgaaaguugccucugugucugagaaag

SEQ ID NO: 222567 - RNA, 32 nt, Human
uaggacgagguuucacccuguuggccaggcug

SEQ ID NO: 222568 - RNA, 32 nt, Human
uaggacgcagccgccucauggggguccagggg

SEQ ID NO: 222569 - RNA, 32 nt, Human
uaggacggucacuguccucucuccuggacugg

SEQ ID NO: 222570 - RNA, 32 nt, Human
uaggacgucugcacggccuccaccuucuguac

SEQ ID NO: 222571 - RNA, 32 nt, Human
uaggacuaaccagccacugcccucucuuaggc

SEQ ID NO: 222572 - RNA, 32 nt, Human
uaggacuacaggcacaugccaccaccaagccc

SEQ ID NO: 222573 - RNA, 32 nt, Human
uaggacuacuccugaagcacauucauugacuc

SEQ ID NO: 222574 - RNA, 32 nt, Human
uaggacuagaagcaggaguaggacaaggagua

SEQ ID NO: 222575 - RNA, 32 nt, Human
uaggacuauaaaccacagcugucccccaggau

SEQ ID NO: 222576 - RNA, 32 nt, Human
uaggacuccaaccucagggacucggguggccu

SEQ ID NO: 222577 - RNA, 32 nt, Human
uaggacucugcacuuccccagaaggaagaauu

SEQ ID NO: 222578 - RNA, 32 nt, Human
uaggacugagcuagaagcugaagaggauaaga

SEQ ID NO: 222579 - RNA, 32 nt, Human
uaggacugauaccauggaauauuucaucucac

SEQ ID NO: 222580 - RNA, 32 nt, Human
uaggacuggagagagauuggaugucagaguga

SEQ ID NO: 222581 - RNA, 32 nt, Human
uaggacugggcuggaugagagagcacagcugu

SEQ ID NO: 222582 - RNA, 32 nt, Human
uaggacuguccggcaguugccugcuuuuggcu

SEQ ID NO: 222583 - RNA, 32 nt, Human
uaggacugugggaggcuuaaguugcagaugcu

SEQ ID NO: 222584 - RNA, 32 nt, Human
uaggacugugggcuuuuagcagcccacaggug

SEQ ID NO: 222585 - RNA, 32 nt, Human
uaggacuuugggaggcugaggcaggcagauug

SEQ ID NO: 222586 - RNA, 32 nt, Human
uaggagaaaagucagcccugccccuggagcuu

SEQ ID NO: 222587 - RNA, 32 nt, Human
uaggagaaacaggguuucaccauguuggccag

SEQ ID NO: 222588 - RNA, 32 nt, Human
uaggagaacuguaggccagggcugagugcacc

SEQ ID NO: 222589 - RNA, 18 nt, Human
uaggagaagagagaguuu

SEQ ID NO: 222590 - RNA, 32 nt, Human
uaggagaagaggaggaggaggagcgggguccc

SEQ ID NO: 222591 - RNA, 19 nt, Human
uaggagaagccaggaauuu

SEQ ID NO: 222592 - RNA, 32 nt, Human
uaggagaaggaggaggaggaggucggaaagug

SEQ ID NO: 222593 - RNA, 32 nt, Human
uaggagaauaagagucuggagacugggagccu

SEQ ID NO: 222594 - RNA, 32 nt, Human
uaggagaauagaagaacugguagccacagugg

SEQ ID NO: 222595 - RNA, 32 nt, Human
uaggagaaugcauuccucugcagacugcuaga

SEQ ID NO: 222596 - RNA, 32 nt, Human
uaggagacaaaggagagugauugauuuucuuc

SEQ ID NO: 222597 - RNA, 32 nt, Human
uaggagacaaaggaggaauuuacuuucuucac

SEQ ID NO: 222598 - RNA, 32 nt, Human
uaggagacaaugaggaaggaggauggauucug

SEQ ID NO: 222599 - RNA, 32 nt, Human
uaggagacaguuacuaugauucccucuauugu

SEQ ID NO: 222600 - RNA, 32 nt, Human
uaggagacaucuuccgagaaacaggcgauaau

SEQ ID NO: 222601 - RNA, 19 nt, Human
uaggagacauuagugaauu

SEQ ID NO: 222602 - RNA, 20 nt, Human
uaggagaccaaguuagaauu

SEQ ID NO: 222603 - RNA, 19 nt, Human
uaggagaccauuugauuuu

SEQ ID NO: 222604 - RNA, 18 nt, Human
uaggagacgucugaauuu

SEQ ID NO: 222605 - RNA, 21 nt, Human
uaggagacugugaaggaauuu

SEQ ID NO: 222606 - RNA, 32 nt, Human
uaggagacuucuaagauuggagcugcagaaga

SEQ ID NO: 222607 - RNA, 32 nt, Human
uaggagacuucuacaaguuuguuuccuguuuc

SEQ ID NO: 222608 - RNA, 32 nt, Human
uaggagagaccgguuuucaccacguuggccag

SEQ ID NO: 222609 - RNA, 32 nt, Human
uaggagagacgggguuucaccguguuagccag

SEQ ID NO: 222610 - RNA, 32 nt, Human
uaggagagacgggguuucaccguguuagucag

SEQ ID NO: 222611 - RNA, 19 nt, Human
uaggagagacugagaauuu

SEQ ID NO: 222612 - RNA, 32 nt, Human
uaggagagaugggguuucgccauguuggccag

SEQ ID NO: 222613 - RNA, 32 nt, Human
uaggagagcaagcacaagacaccagggagcca

SEQ ID NO: 222614 - RNA, 17 nt, Human
uaggagaggaaggauuu

SEQ ID NO: 222615 - RNA, 32 nt, Human
uaggagaggguucugagaggaggcagcaaucc

SEQ ID NO: 222616 - RNA, 32 nt, Human
uaggagagugccauuuacagcuuccgccaggg

SEQ ID NO: 222617 - RNA, 32 nt, Human
uaggagagugugugugggcagcuguguguaag

SEQ ID NO: 222618 - RNA, 32 nt, Human
uaggagauauuugcuuugcaauuacauguuac

SEQ ID NO: 222619 - RNA, 23 nt, Human
uaggagaucauggugucacagug

SEQ ID NO: 222620 - RNA, 32 nt, Human
uaggagaucugucccuuuuagagacaccuuac

SEQ ID NO: 222621 - RNA, 32 nt, Human
uaggagauggucuugcucugucacucaggcug

SEQ ID NO: 222622 - RNA, 32 nt, Human
uaggagauguacuggaauugcucauucuguga

SEQ ID NO: 222623 - RNA, 32 nt, Human
uaggagauucacuaagcaagguuggugagacg

SEQ ID NO: 222624 - RNA, 32 nt, Human
uaggagcaaagcaaugcuccaagcgaggccuc

SEQ ID NO: 222625 - RNA, 32 nt, Human
uaggagcaaaggaaaggggaaaaagaaaaacg

SEQ ID NO: 222626 - RNA, 19 nt, Human
uaggagcagacaggaaucc

SEQ ID NO: 222627 - RNA, 32 nt, Human
uaggagcaguugaaccugggaacaaaccucac

SEQ ID NO: 222628 - RNA, 32 nt, Human
uaggagcaucaucauggggucuagugccacag

SEQ ID NO: 222629 - RNA, 32 nt, Human
uaggagcccagccuugcgccgcauucgcacug

SEQ ID NO: 222630 - RNA, 27 nt, Human
uaggagcccgccccacccucccagggg

SEQ ID NO: 222631 - RNA, 32 nt, Human
uaggagccuaaagaacccuccuggccuccagc

SEQ ID NO: 222632 - RNA, 32 nt, Human
uaggagccuccagggaguucucuuugaggcug

SEQ ID NO: 222633 - RNA, 32 nt, Human
uaggagccuccgcuucccaauacagccguguc

SEQ ID NO: 222634 - RNA, 32 nt, Human
uaggagccugggaaggaagagggaacgggucc

SEQ ID NO: 222635 - RNA, 32 nt, Human
uaggagcgaggugcacauugcaccuuacaucc

SEQ ID NO: 222636 - RNA, 32 nt, Human
uaggagcgcuuggccagcugggaaggcagcgc

SEQ ID NO: 222637 - RNA, 32 nt, Human
uaggagcuagggccuggaaugggagccucaag

SEQ ID NO: 222638 - RNA, 32 nt, Human
uaggagcuccaccauuccuguuacuuucauuu

SEQ ID NO: 222639 - RNA, 32 nt, Human
uaggagcucucauuaucucggucucugguucc

SEQ ID NO: 222640 - RNA, 32 nt, Human
uaggagcugaaauccaugcugagcuguaccag

SEQ ID NO: 222641 - RNA, 20 nt, Human
uaggagcugcguguguggca

SEQ ID NO: 222642 - RNA, 32 nt, Human
uaggagcuguauaaagaagcccaggggcucuu

SEQ ID NO: 222643 - RNA, 32 nt, Human
uaggagcuuagcucaaaguucagcuaaccuuu

SEQ ID NO: 222644 - RNA, 32 nt, Human
uaggagcuuuagaagucuuuauguucuuccug

SEQ ID NO: 222645 - RNA, 24 nt, Human
uaggaggaauacuguuggcguuca

SEQ ID NO: 222646 - RNA, 21 nt, Human
uaggaggaauagcucacaaua

SEQ ID NO: 222647 - RNA, 32 nt, Human
uaggaggacaggguccccucucucacgaagca

SEQ ID NO: 222648 - RNA, 32 nt, Human
uaggaggagagggaggaggguaggaagacagu

SEQ ID NO: 222649 - RNA, 32 nt, Human
uaggaggagauggaguuucacugugucagcca

SEQ ID NO: 222650 - RNA, 32 nt, Human
uaggaggaggcagaggggugccuggaguuucu

SEQ ID NO: 222651 - RNA, 32 nt, Human
uaggaggaguuagagggaaguugaaagccaac

SEQ ID NO: 222652 - RNA, 32 nt, Human
uaggaggaucgucuugagcccaggaguucaag

SEQ ID NO: 222653 - RNA, 32 nt, Human
uaggaggcagcgacugagaaggucagucccau

SEQ ID NO: 222654 - RNA, 32 nt, Human
uaggaggccaucuuuggacaaugguguauggu

SEQ ID NO: 222655 - RNA, 32 nt, Human
uaggaggccccugcuugugcucagggaaggcc

SEQ ID NO: 222656 - RNA, 32 nt, Human
uaggaggcgacagaagaaaaagacacaagacc

SEQ ID NO: 222657 - RNA, 32 nt, Human
uaggaggcggagguggggguggggguaguuua

SEQ ID NO: 222658 - RNA, 32 nt, Human
uaggaggcucacugccuccuguuccagcuccu

SEQ ID NO: 222659 - RNA, 32 nt, Human
uaggaggcucugggcggaggugcagugacccc

SEQ ID NO: 222660 - RNA, 32 nt, Human
uaggaggcugggccggagggaggcggaggaac

SEQ ID NO: 222661 - RNA, 32 nt, Human
uaggagggagagagggaaggggcugaggaaau

SEQ ID NO: 222662 - RNA, 32 nt, Human
uaggagggaggcaggagcuuucuggauagagg

SEQ ID NO: 222663 - RNA, 32 nt, Human
uaggagggcagagauggcacucagguagcuug

SEQ ID NO: 222664 - RNA, 32 nt, Human
uaggaggggagcacuggcagggagagacauuc

SEQ ID NO: 222665 - RNA, 32 nt, Human
uaggagggggaugaagauuacacaugcaguua

SEQ ID NO: 222666 - RNA, 32 nt, Human
uaggaggguauucugggccuucugcccaggca

SEQ ID NO: 222667 - RNA, 32 nt, Human
uaggagggucucaaacuccugaccucaggcga

SEQ ID NO: 222668 - RNA, 30 nt, Human
uaggaggguguguacagggcaaaaugccaa

SEQ ID NO: 222669 - RNA, 31 nt, Human
uaggagguacucaaggguuugggggcaaaac

SEQ ID NO: 222670 - RNA, 32 nt, Human
uaggaggugggacugagcucugaugaaugaga

SEQ ID NO: 222671 - RNA, 32 nt, Human
uaggagguucccggaagggacacuaggaggac

SEQ ID NO: 222672 - RNA, 32 nt, Human
uaggaguaaggucguguugucuuccucaacua

SEQ ID NO: 222673 - RNA, 32 nt, Human
uaggaguacaagugccugggguguaaugagcu

SEQ ID NO: 222674 - RNA, 32 nt, Human
uaggaguagagcugugaaugaggccaaccaga

SEQ ID NO: 222675 - RNA, 32 nt, Human
uaggaguauggagugggcugggccucccuuug

SEQ ID NO: 222676 - RNA, 32 nt, Human
uaggagucagaugaccugaacucagaucuccc

SEQ ID NO: 222677 - RNA, 32 nt, Human
uaggagucagggagucagggaggaggcaagga

SEQ ID NO: 222678 - RNA, 32 nt, Human
uaggagucagguguccguuugcugcuaucagu

SEQ ID NO: 222679 - RNA, 32 nt, Human
uaggaguccacucaacccuggaggucuuugcu

SEQ ID NO: 222680 - RNA, 32 nt, Human
uaggagucucagcugcuuacauccagguccag

SEQ ID NO: 222681 - RNA, 32 nt, Human
uaggagucuuggucccugcacacagcgagcuu

SEQ ID NO: 222682 - RNA, 32 nt, Human
uaggagugagccaccgcgccgggccagacucu

SEQ ID NO: 222683 - RNA, 32 nt, Human
uaggaguuagaggaagagagugacucaaauca

SEQ ID NO: 222684 - RNA, 32 nt, Human
uaggaguuguggguugguaagcucccagguac

SEQ ID NO: 222685 - RNA, 32 nt, Human
uaggaguuguuugagcuauucuggagauuauu

SEQ ID NO: 222686 - RNA, 32 nt, Human
uaggauaaaaauaucugcaggguccuuuccau

SEQ ID NO: 222687 - RNA, 32 nt, Human
uaggauaaauguugucuuacuccucugcuaug

SEQ ID NO: 222688 - RNA, 32 nt, Human
uaggauacgggggugguauggaagggagcguu

SEQ ID NO: 222689 - RNA, 32 nt, Human
uaggauacucaucaaacugggauuauucuuau

SEQ ID NO: 222690 - RNA, 32 nt, Human
uaggauaugaggguuaggccuuugccacauua

SEQ ID NO: 222691 - RNA, 32 nt, Human
uaggauauguagaugaguuuuugcuacagagc

SEQ ID NO: 222692 - RNA, 32 nt, Human
uaggaucaauaugaccacacuccagccaagga

SEQ ID NO: 222693 - RNA, 32 nt, Human
uaggaucacaccacugcacuccagccuggaca

SEQ ID NO: 222694 - RNA, 32 nt, Human
uaggaucacuugaucccaggaggcggagguug

SEQ ID NO: 222695 - RNA, 32 nt, Human
uaggaucaggaguuagcuuaagaaaaaggaaa

SEQ ID NO: 222696 - RNA, 32 nt, Human
uaggaucaggccacugcacuccagccugggua

SEQ ID NO: 222697 - RNA, 32 nt, Human
uaggauccagcugugucaaccuuuauuuagca

SEQ ID NO: 222698 - RNA, 32 nt, Human
uaggaucccaaaauucaucucuaaugugguuu

SEQ ID NO: 222699 - RNA, 32 nt, Human
uaggauccucaagcaucucuaccguaagucca

SEQ ID NO: 222700 - RNA, 32 nt, Human
uaggauccuccuuauggagaacuauuuauuau

SEQ ID NO: 222701 - RNA, 32 nt, Human
uaggaucgugccacugcacuccaaccugggug

SEQ ID NO: 222702 - RNA, 32 nt, Human
uaggaucugcauuuucagguuccgagccugac

SEQ ID NO: 222703 - RNA, 32 nt, Human
uaggaucuguaacucugugggcugggucaaug

SEQ ID NO: 222704 - RNA, 32 nt, Human
uaggaucugucugcuaauggugcuuaaauucu

SEQ ID NO: 222705 - RNA, 32 nt, Human
uaggaugacaacacuuugacuguggaggugcu

SEQ ID NO: 222706 - RNA, 32 nt, Human
uaggaugacugauuccagcccaguggccuggc

SEQ ID NO: 222707 - RNA, 32 nt, Human
uaggaugagcuacuaaaugacaaauggguggg

SEQ ID NO: 222708 - RNA, 32 nt, Human
uaggaugauggggcuugaugcaguagggaaga

SEQ ID NO: 222709 - RNA, 32 nt, Human
uaggaugauuuacaagacuggcuuuuuguucu

SEQ ID NO: 222710 - RNA, 32 nt, Human
uaggaugcacuuauaggaucugaaaagcucac

SEQ ID NO: 222711 - RNA, 32 nt, Human
uaggaugcauuauaaacugaagaggcuuuuaa

SEQ ID NO: 222712 - RNA, 32 nt, Human
uaggaugcggcuuucucugccucugggcagcc

SEQ ID NO: 222713 - RNA, 32 nt, Human
uaggauggaacucggugucucuuaauucauuu

SEQ ID NO: 222714 - RNA, 32 nt, Human
uaggauggaaggcacgcaguggcauggccugg

SEQ ID NO: 222715 - RNA, 32 nt, Human
uaggauggagugaaacccaagaggaagugcca

SEQ ID NO: 222716 - RNA, 32 nt, Human
uaggauggcaguguccuucauccugcccccag

SEQ ID NO: 222717 - RNA, 29 nt, Human
uaggauggcuguaguaccucugcuguugu

SEQ ID NO: 222718 - RNA, 32 nt, Human
uaggaugggcaggaacccggcuagcgagaaac

SEQ ID NO: 222719 - RNA, 29 nt, Human
uaggauggucaccagcccaagccaccacc

SEQ ID NO: 222720 - RNA, 32 nt, Human
uaggaugguggaauauugguguuaccagggaa

SEQ ID NO: 222721 - RNA, 32 nt, Human
uaggaugguucagaacccagagaggacccugg

SEQ ID NO: 222722 - RNA, 32 nt, Human
uaggaugucauuguccccaaaaugaaaauauu

SEQ ID NO: 222723 - RNA, 32 nt, Human
uaggaugugaggugagcaugagcuugagcuga

SEQ ID NO: 222724 - RNA, 32 nt, Human
uaggaugugcccaccugcauuggugaagguca

SEQ ID NO: 222725 - RNA, 24 nt, Human
uaggauguguauuuaaugcauuua

SEQ ID NO: 222726 - RNA, 32 nt, Human
uaggauuacaccauugacuuagggcuuccuca

SEQ ID NO: 222727 - RNA, 32 nt, Human
uaggauuacaugcuccuugauuacaguggggu

SEQ ID NO: 222728 - RNA, 32 nt, Human
uaggauuacgcugaggcccagccugggggaga

SEQ ID NO: 222729 - RNA, 32 nt, Human
uaggauuaucacacccuccaucuuuauucuuu

SEQ ID NO: 222730 - RNA, 32 nt, Human
uaggauucaaacuugagggcaaauuguggagc

SEQ ID NO: 222731 - RNA, 32 nt, Human
uaggauucaagaaauggaaggaugauucuugu

SEQ ID NO: 222732 - RNA, 32 nt, Human
uaggauucauauagcacccacagagcuccaag

SEQ ID NO: 222733 - RNA, 32 nt, Human
uaggauucuccucucucuaggugcugagcccu

SEQ ID NO: 222734 - RNA, 32 nt, Human
uaggauucugguuccagccaggguugaggaaa

SEQ ID NO: 222735 - RNA, 32 nt, Human
uaggauugaguguguugggcuuuggguauaaa

SEQ ID NO: 222736 - RNA, 32 nt, Human
uaggauugaucaggaaauaguguuuguaaucu

SEQ ID NO: 222737 - RNA, 32 nt, Human
uaggauugcagagaagaugcaagagcacuuug

SEQ ID NO: 222738 - RNA, 32 nt, Human
uaggauugcagcaacacguucggcugcccaaa

SEQ ID NO: 222739 - RNA, 32 nt, Human
uaggauugcuguggccuagacuucugaguaau

SEQ ID NO: 222740 - RNA, 32 nt, Human
uaggauuuaugcuaccaguugcagagaaaaug

SEQ ID NO: 222741 - RNA, 32 nt, Human
uaggauuugcuuguaacaguuauuucaggaua

SEQ ID NO: 222742 - RNA, 32 nt, Human
uaggauuugcuuguuuuucuuccacuucagaa

SEQ ID NO: 222743 - RNA, 32 nt, Human
uaggauuugguuucagcauuaguaccuacaua

SEQ ID NO: 222744 - RNA, 23 nt, Human
uaggauuuuuaguauuuauuuua

SEQ ID NO: 222745 - RNA, 32 nt, Human
uaggcaaaaacaggagguaaagaaauagccaa

SEQ ID NO: 222746 - RNA, 32 nt, Human
uaggcaaaaagaaccaggccagauuggugugc

SEQ ID NO: 222747 - RNA, 32 nt, Human
uaggcaaauccauagacacagaaugcagaucc

SEQ ID NO: 222748 - RNA, 32 nt, Human
uaggcaaauguauucaugaaugguagcucaaa

SEQ ID NO: 222749 - RNA, 32 nt, Human
uaggcaacacggugaaaccccaucucuacaaa

SEQ ID NO: 222750 - RNA, 32 nt, Human
uaggcaacauagcaaggucccaucucuaaaaa

SEQ ID NO: 222751 - RNA, 32 nt, Human
uaggcaacauggagaaaccccgucucuaucag

SEQ ID NO: 222752 - RNA, 32 nt, Human
uaggcaacauggcaaaaccccaucucgacaaa

SEQ ID NO: 222753 - RNA, 32 nt, Human
uaggcaacauggcaaaaccccgucucuacaaa

SEQ ID NO: 222754 - RNA, 25 nt, Human
uaggcaacauggcagaugugacuca

SEQ ID NO: 222755 - RNA, 29 nt, Human
uaggcaacauggcgaaacccugucucuac

SEQ ID NO: 222756 - RNA, 32 nt, Human
uaggcaacauugcaagacuccaucucuacaaa

SEQ ID NO: 222757 - RNA, 32 nt, Human
uaggcaacuccaaacaugccuccaggguuaau

SEQ ID NO: 222758 - RNA, 32 nt, Human
uaggcaacuccaaacaugccuccaggguuggu

SEQ ID NO: 222759 - RNA, 31 nt, Human
uaggcaagaugaccuguucaucaggaauguu

SEQ ID NO: 222760 - RNA, 32 nt, Human
uaggcaagauggcaacaucccgucucuacaaa

SEQ ID NO: 222761 - RNA, 32 nt, Human
uaggcaagccccagguugcagacauggugaag

SEQ ID NO: 222762 - RNA, 32 nt, Human
uaggcaaggacucaugauaccaagagugugau

SEQ ID NO: 222763 - RNA, 32 nt, Human
uaggcaaguuuucccugaaguuauguguaugu

SEQ ID NO: 222764 - RNA, 32 nt, Human
uaggcaaugggaaaacaguaagaggcagacca

SEQ ID NO: 222765 - RNA, 32 nt, Human
uaggcacacagauccccuggaaacccaccucu

SEQ ID NO: 222766 - RNA, 32 nt, Human
uaggcacaccuuuacugcauuagcagccuuug

SEQ ID NO: 222767 - RNA, 20 nt, Human
uaggcacaucauaagaaucc

SEQ ID NO: 222768 - RNA, 32 nt, Human
uaggcaccagagagacaagauacgagugacau

SEQ ID NO: 222769 - RNA, 32 nt, Human
uaggcaccaugucggacagugaucuaggugag

SEQ ID NO: 222770 - RNA, 31 nt, Human
uaggcacccaauaaauauuuguugaauuuag

SEQ ID NO: 222771 - RNA, 32 nt, Human
uaggcaccuguaaucccagcuacucgggaggc

SEQ ID NO: 222772 - RNA, 32 nt, Human
uaggcacgaggcagucugggcacuuuucugca

SEQ ID NO: 222773 - RNA, 18 nt, Human
uaggcacgaucucagcuc

SEQ ID NO: 222774 - RNA, 32 nt, Human
uaggcacguuuguccuggugcaguggggcagc

SEQ ID NO: 222775 - RNA, 31 nt, Human
uaggcacucaauaaauacuuguuuguugaaa

SEQ ID NO: 222776 - RNA, 31 nt, Human
uaggcacucaauaaauauugaaugaguaaau

SEQ ID NO: 222777 - RNA, 31 nt, Human
uaggcacuccauaaauaucuguugaaccuuc

SEQ ID NO: 222778 - RNA, 32 nt, Human
uaggcacucucucuaccccaccucucaguacu

SEQ ID NO: 222779 - RNA, 32 nt, Human
uaggcacuggggacccugcacagucuggccau

SEQ ID NO: 222780 - RNA, 32 nt, Human
uaggcacuguuuuaggcaauaggaaucauaau

SEQ ID NO: 222781 - RNA, 32 nt, Human
uaggcagaaagaggaggacaaagaggaggaaa

SEQ ID NO: 222782 - RNA, 32 nt, Human
uaggcagaaauggccagucaaacacauagcag

SEQ ID NO: 222783 - RNA, 31 nt, Human
uaggcagaacaaugacucauuugcaagccgg

SEQ ID NO: 222784 - RNA, 32 nt, Human
uaggcagaacacaggaaggaagagaggugcag

SEQ ID NO: 222785 - RNA, 32 nt, Human
uaggcagaagagacuugccuugucucagauga

SEQ ID NO: 222786 - RNA, 32 nt, Human
uaggcagagagcgcacccuacucuuuccguga

SEQ ID NO: 222787 - RNA, 32 nt, Human
uaggcagcagagagagaggacagagggguaag

SEQ ID NO: 222788 - RNA, 32 nt, Human
uaggcagcaguguaucugcuuccugucugggg

SEQ ID NO: 222789 - RNA, 32 nt, Human
uaggcagccagccugccgccauuggaccuccc

SEQ ID NO: 222790 - RNA, 32 nt, Human
uaggcagccugcagggaauaacauacuggccg

SEQ ID NO: 222791 - RNA, 32 nt, Human
uaggcagcugccgagagaaguacgccucucug

SEQ ID NO: 222792 - RNA, 32 nt, Human
uaggcagcuuggcaagaccccaucucuacaaa

SEQ ID NO: 222793 - RNA, 32 nt, Human
uaggcagcuuugacaggugcuguuuucaauuc

SEQ ID NO: 222794 - RNA, 32 nt, Human
uaggcaggaccccagagagggcaggcagccac

SEQ ID NO: 222795 - RNA, 32 nt, Human
uaggcaggacgugagagaagggagaugggaga

SEQ ID NO: 222796 - RNA, 32 nt, Human
uaggcaggacugugauaacagugcaagcucug

SEQ ID NO: 222797 - RNA, 32 nt, Human
uaggcaggaggaagaugcggaggaggguggca

SEQ ID NO: 222798 - RNA, 32 nt, Human
uaggcaggauaaaucauaucuuaccucaaaaa

SEQ ID NO: 222799 - RNA, 32 nt, Human
uaggcaggcuacugugcuggagcaucccccag

SEQ ID NO: 222800 - RNA, 32 nt, Human
uaggcagggcuggcacuauuuccuuggccagg

SEQ ID NO: 222801 - RNA, 32 nt, Human
uaggcaggguaaacaggaaagcauuaaaaguu

SEQ ID NO: 222802 - RNA, 32 nt, Human
uaggcaggugugagggacaguggcuaagaauu

SEQ ID NO: 222803 - RNA, 32 nt, Human
uaggcaguaaugaagacaguuggggaaaggag

SEQ ID NO: 222804 - RNA, 32 nt, Human
uaggcagucaucuuuguaaaccuccacuggug

SEQ ID NO: 222805 - RNA, 32 nt, Human
uaggcagucugcaucuucagauuucagagauu

SEQ ID NO: 222806 - RNA, 32 nt, Human
uaggcagucuugacagucaaccaguguaauca

SEQ ID NO: 222807 - RNA, 32 nt, Human
uaggcagugccauuugaccacaccgaucaugu

SEQ ID NO: 222808 - RNA, 32 nt, Human
uaggcagugcuugaaugagaaaaggcuccugg

SEQ ID NO: 222809 - RNA, 32 nt, Human
uaggcagugguggcugccaucccucggggccc

SEQ ID NO: 222810 - RNA, 32 nt, Human
uaggcaguguagagaaauggcguuaauggcuc

SEQ ID NO: 222811 - RNA, 32 nt, Human
uaggcaguucuuacagucaucuugcugguggu

SEQ ID NO: 222812 - RNA, 32 nt, Human
uaggcauaaaguuauccugaaaaggacaagag

SEQ ID NO: 222813 - RNA, 32 nt, Human
uaggcauagcuguuuuucucccaugaguaugc

SEQ ID NO: 222814 - RNA, 32 nt, Human
uaggcauagguuugcaauccagaucugauuuu

SEQ ID NO: 222815 - RNA, 32 nt, Human
uaggcauccccaggauagggcagucggggaag

SEQ ID NO: 222816 - RNA, 32 nt, Human
uaggcaucccuaaaugaucaccagcccucgcc

SEQ ID NO: 222817 - RNA, 32 nt, Human
uaggcaucccuggccacugccucccagucuug

SEQ ID NO: 222818 - RNA, 32 nt, Human
uaggcauccuguaaauaauuccaaggggaaaa

SEQ ID NO: 222819 - RNA, 32 nt, Human
uaggcaucuccucuccccaacccuuccacacg

SEQ ID NO: 222820 - RNA, 32 nt, Human
uaggcaucuggaagacuucuuccuagccugga

SEQ ID NO: 222821 - RNA, 32 nt, Human
uaggcaugaccugcuggagaaacugcccuagc

SEQ ID NO: 222822 - RNA, 32 nt, Human
uaggcaugagccaccacacccagccuccucuu

SEQ ID NO: 222823 - RNA, 32 nt, Human
uaggcaugagccaccacaccuggcuacuuuau

SEQ ID NO: 222824 - RNA, 32 nt, Human
uaggcaugagccaccacaucuggccaauaguu

SEQ ID NO: 222825 - RNA, 32 nt, Human
uaggcaugagccaccacgacuggccagaggac

SEQ ID NO: 222826 - RNA, 32 nt, Human
uaggcaugagccaccacgcccagccuguuauu

SEQ ID NO: 222827 - RNA, 32 nt, Human
uaggcaugagccaccacgccuggccagaugca

SEQ ID NO: 222828 - RNA, 32 nt, Human
uaggcaugagccaccaugcccagccaggaaaa

SEQ ID NO: 222829 - RNA, 32 nt, Human
uaggcaugagccaccgugcccagccuacuuuc

SEQ ID NO: 222830 - RNA, 32 nt, Human
uaggcaugagccaccgugcccggcuauuuuca

SEQ ID NO: 222831 - RNA, 32 nt, Human
uaggcaugagccaccgugccuggcugaugcug

SEQ ID NO: 222832 - RNA, 32 nt, Human
uaggcaugagccacugcacccggccgguggaa

SEQ ID NO: 222833 - RNA, 32 nt, Human
uaggcaugagccacugcaccuggccuguguau

SEQ ID NO: 222834 - RNA, 32 nt, Human
uaggcaugagccacugcgccuggccaacaauc

SEQ ID NO: 222835 - RNA, 32 nt, Human
uaggcaugagccacugggccccgccaggcuuu

SEQ ID NO: 222836 - RNA, 32 nt, Human
uaggcaugagccacugugccuggcccucucau

SEQ ID NO: 222837 - RNA, 32 nt, Human
uaggcaugaguguguaugugcuaacauguagg

SEQ ID NO: 222838 - RNA, 18 nt, Human
uaggcaugcaccaccacg

SEQ ID NO: 222839 - RNA, 18 nt, Human
uaggcaugcaccaccaug

SEQ ID NO: 222840 - RNA, 21 nt, Human
uaggcaugcauauaugccaga

SEQ ID NO: 222841 - RNA, 32 nt, Human
uaggcauggaagagagccaggcagccccgaaa

SEQ ID NO: 222842 - RNA, 31 nt, Human
uaggcauggguggaaagugcucagugaagua

SEQ ID NO: 222843 - RNA, 32 nt, Human
uaggcaugugagaaaaucagccuagcaguuua

SEQ ID NO: 222844 - RNA, 32 nt, Human
uaggcauuagcacaucccagcacucuaauuca

SEQ ID NO: 222845 - RNA, 31 nt, Human
uaggcauucaauaaauguugaaauaaugaca

SEQ ID NO: 222846 - RNA, 32 nt, Human
uaggcauucaauacuuguugaauaaauaaacu

SEQ ID NO: 222847 - RNA, 32 nt, Human
uaggcauuucuucccuuccuuccuuccuucau

SEQ ID NO: 222848 - RNA, 32 nt, Human
uaggccaacguggugaaaccccgucacuacua

SEQ ID NO: 222849 - RNA, 32 nt, Human
uaggccaagauggcuggaucaccugaggucag

SEQ ID NO: 222850 - RNA, 32 nt, Human
uaggccaagguguccuacagaaaaaccuuggg

SEQ ID NO: 222851 - RNA, 31 nt, Human
uaggccaaguaguccaucauaguaaucuuuc

SEQ ID NO: 222852 - RNA, 32 nt, Human
uaggccacagcaccacacacacugcaaaccag

SEQ ID NO: 222853 - RNA, 32 nt, Human
uaggccacgaauuugagaccagccugguaaaa

SEQ ID NO: 222854 - RNA, 32 nt, Human
uaggccacucuccccucuaaaucucuagugcu

SEQ ID NO: 222855 - RNA, 32 nt, Human
uaggccacugcacaccucuaugccuugcagug

SEQ ID NO: 222856 - RNA, 32 nt, Human
uaggccagaaggacuccuaccugggugaugag

SEQ ID NO: 222857 - RNA, 32 nt, Human
uaggccagacaggcccaaggauggaugaaugg

SEQ ID NO: 222858 - RNA, 32 nt, Human
uaggccagagcagcacagcaucacacuccacg

SEQ ID NO: 222859 - RNA, 32 nt, Human
uaggccagaggaagaagagcgcaggccugggc

SEQ ID NO: 222860 - RNA, 32 nt, Human
uaggccagauggugaaaccccaucucuacaaa

SEQ ID NO: 222861 - RNA, 32 nt, Human
uaggccagcuggaaagaggacauggacaggcc

SEQ ID NO: 222862 - RNA, 32 nt, Human
uaggccaggccuggggcuuggugucugacugu

SEQ ID NO: 222863 - RNA, 17 nt, Human
uaggccaggcgcagugg

SEQ ID NO: 222864 - RNA, 32 nt, Human
uaggccagggacugggcuuucuccccacuaag

SEQ ID NO: 222865 - RNA, 32 nt, Human
uaggccaucaucauccuuaucccacacccauu

SEQ ID NO: 222866 - RNA, 32 nt, Human
uaggccaucugcaagcugaggaagaaagaagc

SEQ ID NO: 222867 - RNA, 32 nt, Human
uaggccauugcacuccagccucagcaacaaga

SEQ ID NO: 222868 - RNA, 32 nt, Human
uaggccauuucuguaguuagugaacagagcag

SEQ ID NO: 222869 - RNA, 32 nt, Human
uaggccauuuucagaucagcagucacccaucg

SEQ ID NO: 222870 - RNA, 32 nt, Human
uaggcccacgcugccccuggccuguguuaggc

SEQ ID NO: 222871 - RNA, 32 nt, Human
uaggcccaugggcaccuggccuccaggagucg

SEQ ID NO: 222872 - RNA, 32 nt, Human
uaggcccaugguguuccugaaugugauugaca

SEQ ID NO: 222873 - RNA, 31 nt, Human
uaggccccaccucuggggguuggagggaccc

SEQ ID NO: 222874 - RNA, 32 nt, Human
uaggccccucaggagcuuugcagagaggagga

SEQ ID NO: 222875 - RNA, 32 nt, Human
uaggcccgacucagcauccugucccagcuuca

SEQ ID NO: 222876 - RNA, 32 nt, Human
uaggcccggggugggaccagaggucauaggug

SEQ ID NO: 222877 - RNA, 32 nt, Human
uaggcccugcacuccaccuggggacggccccu

SEQ ID NO: 222878 - RNA, 32 nt, Human
uaggcccugccugugccuguccgcuggccugg

SEQ ID NO: 222879 - RNA, 32 nt, Human
uaggcccuggcuggcgggcaugugggcaacuu

SEQ ID NO: 222880 - RNA, 23 nt, Human
uaggcccugggagaacuccggcu

SEQ ID NO: 222881 - RNA, 32 nt, Human
uaggcccuggggauucagacacaaagcaggua

SEQ ID NO: 222882 - RNA, 31 nt, Human
uaggcccuuaauaaacaccuguuggauaagc

SEQ ID NO: 222883 - RNA, 22 nt, Human
uaggcccuuguuaggaguggcu

SEQ ID NO: 222884 - RNA, 23 nt, Human
uaggcccuuuaaggggucuaguu

SEQ ID NO: 222885 - RNA, 32 nt, Human
uaggccgccugcccgccuccagcucucggggu

SEQ ID NO: 222886 - RNA, 32 nt, Human
uaggccgcuggaggaaagggaacucacccaac

SEQ ID NO: 222887 - RNA, 32 nt, Human
uaggccggccuucuggaacguucucucccggc

SEQ ID NO: 222888 - RNA, 31 nt, Human
uaggccggcugaggaacuguguguugaauaa

SEQ ID NO: 222889 - RNA, 30 nt, Human
uaggccgggcgcggcugggucccccggggg

SEQ ID NO: 222890 - RNA, 32 nt, Human
uaggccgugaccccgggugccaugaagcagga

SEQ ID NO: 222891 - RNA, 32 nt, Human
uaggccgugaggcaucuuccugccagccugca

SEQ ID NO: 222892 - RNA, 32 nt, Human
uaggccuaaugccacaaccacauccccauccu

SEQ ID NO: 222893 - RNA, 32 nt, Human
uaggccuagccucuuuuaacagccucugaaau

SEQ ID NO: 222894 - RNA, 32 nt, Human
uaggccuagcuacuuaggaggcugagguggga

SEQ ID NO: 222895 - RNA, 23 nt, Human
uaggccucagaaagaagucaguu

SEQ ID NO: 222896 - RNA, 32 nt, Human
uaggccucagcagggacagcacagacccucug

SEQ ID NO: 222897 - RNA, 32 nt, Human
uaggccuccaggagcccucagugagagggacc

SEQ ID NO: 222898 - RNA, 32 nt, Human
uaggccuccagggaaagagcugggaggcagga

SEQ ID NO: 222899 - RNA, 32 nt, Human
uaggccucccaaaaugcugggacuauaggugu

SEQ ID NO: 222900 - RNA, 32 nt, Human
uaggccucccaaaguacugggauuacaggcgu

SEQ ID NO: 222901 - RNA, 32 nt, Human
uaggccucccaaaguccugggauuacaggcgu

SEQ ID NO: 222902 - RNA, 32 nt, Human
uaggccucccaaagugcugggauuacaggcau

SEQ ID NO: 222903 - RNA, 32 nt, Human
uaggccucccaaagugcuggguuuaccagcgu

SEQ ID NO: 222904 - RNA, 32 nt, Human
uaggccucccaaaguguugggauuacaggcgu

SEQ ID NO: 222905 - RNA, 32 nt, Human
uaggccucccaaaguguugggauuauagguau

SEQ ID NO: 222906 - RNA, 32 nt, Human
uaggccucccuaauauccccucccagggucuc

SEQ ID NO: 222907 - RNA, 22 nt, Human
uaggccuccugagauuccagcu

SEQ ID NO: 222908 - RNA, 32 nt, Human
uaggccucucaaaguguugggauuacgugugu

SEQ ID NO: 222909 - RNA, 32 nt, Human
uaggccucucaccucugugccucugucuccuu

SEQ ID NO: 222910 - RNA, 32 nt, Human
uaggccucucccaccaugugcagucucauggg

SEQ ID NO: 222911 - RNA, 18 nt, Human
uaggccucuccucagcuc

SEQ ID NO: 222912 - RNA, 32 nt, Human
uaggccucuccuccaaccucccacuccuucuc

SEQ ID NO: 222913 - RNA, 23 nt, Human
uaggccucugccaggaucuaagc

SEQ ID NO: 222914 - RNA, 32 nt, Human
uaggccugaccuuuuaaauuccugggauaaau

SEQ ID NO: 222915 - RNA, 32 nt, Human
uaggccuggaguuguauccugccccucuggag

SEQ ID NO: 222916 - RNA, 32 nt, Human
uaggccugggcccuggaggaggacauggugau

SEQ ID NO: 222917 - RNA, 32 nt, Human
uaggccugguguguucaagaccagccugguca

SEQ ID NO: 222918 - RNA, 32 nt, Human
uaggccugugccaaaguggccagagauugggc

SEQ ID NO: 222919 - RNA, 32 nt, Human
uaggccuuccagagugcugggauuauaggcgu

SEQ ID NO: 222920 - RNA, 32 nt, Human
uaggccuucuacuagccagcaguucucucugg

SEQ ID NO: 222921 - RNA, 32 nt, Human
uaggccuucuuggcugagaugaccagggcgua

SEQ ID NO: 222922 - RNA, 32 nt, Human
uaggccuuucccucagguuuuccucuucccca

SEQ ID NO: 222923 - RNA, 32 nt, Human
uaggccuuuccucugcacgcucaaugcccagu

SEQ ID NO: 222924 - RNA, 32 nt, Human
uaggcgaguaaaaggaggaggaagggcugggg

SEQ ID NO: 222925 - RNA, 18 nt, Human
uaggcgcacaccaucacg

SEQ ID NO: 222926 - RNA, 32 nt, Human
uaggcgcagccugucccgcagggccuggcugg

SEQ ID NO: 222927 - RNA, 15 nt, Human
uaggcgcccaccacg

SEQ ID NO: 222928 - RNA, 32 nt, Human
uaggcgccccuccuaccccggcugcuuggcag

SEQ ID NO: 222929 - RNA, 32 nt, Human
uaggcgccuguaaucccagcuacucaggaggc

SEQ ID NO: 222930 - RNA, 18 nt, Human
uaggcgcgcgccaccacg

SEQ ID NO: 222931 - RNA, 32 nt, Human
uaggcgcggacgugcccggugccuggcgcgug

SEQ ID NO: 222932 - RNA, 32 nt, Human
uaggcgcggccagggccccacaacagcagguc

SEQ ID NO: 222933 - RNA, 28 nt, Human
uaggcgcucaauaaauacuuguuuguug

SEQ ID NO: 222934 - RNA, 31 nt, Human
uaggcgcucaauaaauacuuguuuguugaau

SEQ ID NO: 222935 - RNA, 31 nt, Human
uaggcgcucaauaaauguugaaugaaugaau

SEQ ID NO: 222936 - RNA, 32 nt, Human
uaggcgcuccuagucuggucagugccaagagg

SEQ ID NO: 222937 - RNA, 32 nt, Human
uaggcggaccccagacugcccucugccccuca

SEQ ID NO: 222938 - RNA, 32 nt, Human
uaggcgggcucuggcaccaccaggugcccaag

SEQ ID NO: 222939 - RNA, 32 nt, Human
uaggcggggcugggcaugcugggaccuccccu

SEQ ID NO: 222940 - RNA, 32 nt, Human
uaggcggguauccccuuccucccucaccacuc

SEQ ID NO: 222941 - RNA, 31 nt, Human
uaggcgggugaaucacuugauugaggucagg

SEQ ID NO: 222942 - RNA, 32 nt, Human
uaggcgguuagauuugaauacuucacugaggc

SEQ ID NO: 222943 - RNA, 32 nt, Human
uaggcguaagccaccacacccagccagaaagu

SEQ ID NO: 222944 - RNA, 32 nt, Human
uaggcguaagccaccacaccuggccaaaaaua

SEQ ID NO: 222945 - RNA, 32 nt, Human
uaggcguaagccaccaugccuggccaaaaauu

SEQ ID NO: 222946 - RNA, 32 nt, Human
uaggcguaagccacugugucuggccuagugua

SEQ ID NO: 222947 - RNA, 18 nt, Human
uaggcgugaaccaccacg

SEQ ID NO: 222948 - RNA, 32 nt, Human
uaggcgugagccaccacacccggccaagcaca

SEQ ID NO: 222949 - RNA, 32 nt, Human
uaggcgugagccaccaugcccagccuaauuuu

SEQ ID NO: 222950 - RNA, 32 nt, Human
uaggcgugagccaccaugcucagccauuaagg

SEQ ID NO: 222951 - RNA, 32 nt, Human
uaggcgugagccaccgcaccgugagccacugc

SEQ ID NO: 222952 - RNA, 32 nt, Human
uaggcgugagccaccgcaccuggccuaugagu

SEQ ID NO: 222953 - RNA, 32 nt, Human
uaggcgugagccaccgcgccuggccccgggcc

SEQ ID NO: 222954 - RNA, 32 nt, Human
uaggcgugagccaccgcuccuggccaggcauc

SEQ ID NO: 222955 - RNA, 32 nt, Human
uaggcgugagccaccgcuccuggccagggucu

SEQ ID NO: 222956 - RNA, 32 nt, Human
uaggcgugagccaccguacccggccuacccuu

SEQ ID NO: 222957 - RNA, 32 nt, Human
uaggcgugagccaccgugccuggccuaaagga

SEQ ID NO: 222958 - RNA, 32 nt, Human
uaggcgugagccacugcgccuggccaaaugcu

SEQ ID NO: 222959 - RNA, 32 nt, Human
uaggcgugagccacugugcccagccucacagc

SEQ ID NO: 222960 - RNA, 32 nt, Human
uaggcgugagccacuguguccagccuuuuccu

SEQ ID NO: 222961 - RNA, 32 nt, Human
uaggcgugcaccaccacaccuggcuaauuuuu

SEQ ID NO: 222962 - RNA, 18 nt, Human
uaggcgugcaccaccacg

SEQ ID NO: 222963 - RNA, 32 nt, Human
uaggcgugguggcucaggccaguaauuucagu

SEQ ID NO: 222964 - RNA, 32 nt, Human
uaggcuacaauuuucucccaggaagcuuugau

SEQ ID NO: 222965 - RNA, 32 nt, Human
uaggcuacaccacccugcccugacccugggau

SEQ ID NO: 222966 - RNA, 32 nt, Human
uaggcuaccaaaacauagaugacagaaggagg

SEQ ID NO: 222967 - RNA, 32 nt, Human
uaggcuacccuugccaaggccgcccaccugca

SEQ ID NO: 222968 - RNA, 32 nt, Human
uaggcuacugaguuuaguucucaguuuggcac

SEQ ID NO: 222969 - RNA, 32 nt, Human
uaggcuaggggugggagcaggaagagcuuaga

SEQ ID NO: 222970 - RNA, 32 nt, Human
uaggcuaucucccaucuucccacucaaguuaa

SEQ ID NO: 222971 - RNA, 32 nt, Human
uaggcuauggguuugagaccagccuggcaaca

SEQ ID NO: 222972 - RNA, 32 nt, Human
uaggcucaagccauccucccaccucagccucc

SEQ ID NO: 222973 - RNA, 32 nt, Human
uaggcucaagcgauccucccaccucaaccucu

SEQ ID NO: 222974 - RNA, 32 nt, Human
uaggcucaagugauccucccaccucagccucc

SEQ ID NO: 222975 - RNA, 32 nt, Human
uaggcucacaugcccaaacucuggguggggaa

SEQ ID NO: 222976 - RNA, 32 nt, Human
uaggcucacugcaaccuccaccucccagguuc

SEQ ID NO: 222977 - RNA, 32 nt, Human
uaggcucacugcaaccuccuucucccagguuc

SEQ ID NO: 222978 - RNA, 32 nt, Human
uaggcucacugcaaccucugucuccaggguug

SEQ ID NO: 222979 - RNA, 32 nt, Human
uaggcucacugcaacuuccgccucccggguuc

SEQ ID NO: 222980 - RNA, 32 nt, Human
uaggcucacugcaacuucugccucccaugcuu

SEQ ID NO: 222981 - RNA, 32 nt, Human
uaggcucagagcaaccuccagccuucuccagc

SEQ ID NO: 222982 - RNA, 32 nt, Human
uaggcucagcagauguuuuucugccauuagga

SEQ ID NO: 222983 - RNA, 32 nt, Human
uaggcucagucugacagguucuguacggggcu

SEQ ID NO: 222984 - RNA, 32 nt, Human
uaggcucaucaugcagucuucccucagccucc

SEQ ID NO: 222985 - RNA, 32 nt, Human
uaggcucauccagaaucucaucaggacuggac

SEQ ID NO: 222986 - RNA, 32 nt, Human
uaggcucaugaagagcauggccauuguggcag

SEQ ID NO: 222987 - RNA, 32 nt, Human
uaggcuccacugcccucacaccucuaggccuc

SEQ ID NO: 222988 - RNA, 32 nt, Human
uaggcucccagaggcgccuggccuccgcagag

SEQ ID NO: 222989 - RNA, 32 nt, Human
uaggcucccagucuuugacugccuucccaugg

SEQ ID NO: 222990 - RNA, 32 nt, Human
uaggcuccccagcuuucuccaggcuggggugg

SEQ ID NO: 222991 - RNA, 32 nt, Human
uaggcucggacacuguaggaggcagauccaag

SEQ ID NO: 222992 - RNA, 32 nt, Human
uaggcucuccaugaaacugcaaaggaacugau

SEQ ID NO: 222993 - RNA, 32 nt, Human
uaggcucucccaggugcaaugugggugcaggg

SEQ ID NO: 222994 - RNA, 32 nt, Human
uaggcucucugcaaccugggccucccggguuc

SEQ ID NO: 222995 - RNA, 32 nt, Human
uaggcugaagcacaguggugcgaucacagcuc

SEQ ID NO: 222996 - RNA, 32 nt, Human
uaggcugacagagcagggcuguuucucauaug

SEQ ID NO: 222997 - RNA, 32 nt, Human
uaggcugaccccugauccagacugucuucuga

SEQ ID NO: 222998 - RNA, 32 nt, Human
uaggcugagaggcggcgggagagaugcccaug

SEQ ID NO: 222999 - RNA, 32 nt, Human
uaggcugagguagguggaucaccugaggucag

SEQ ID NO: 223000 - RNA, 32 nt, Human
uaggcugaucucaaacuccugaucucaaguga

SEQ ID NO: 223001 - RNA, 32 nt, Human
uaggcugcaaaccaauuugggcucagagggaa

SEQ ID NO: 223002 - RNA, 32 nt, Human
uaggcugcacacacaccucgcucugggaguag

SEQ ID NO: 223003 - RNA, 32 nt, Human
uaggcugcacacagcacagagacccugggccc

SEQ ID NO: 223004 - RNA, 32 nt, Human
uaggcugcacacagcaggggguucugggccca

SEQ ID NO: 223005 - RNA, 32 nt, Human
uaggcugcagcuugccacuccugggcugggua

SEQ ID NO: 223006 - RNA, 32 nt, Human
uaggcugccacaggcccugcuucuggaaggug

SEQ ID NO: 223007 - RNA, 32 nt, Human
uaggcugccgucucccuccacucugucggcuc

SEQ ID NO: 223008 - RNA, 32 nt, Human
uaggcugccucugcuuucuuuccguccccuug

SEQ ID NO: 223009 - RNA, 32 nt, Human
uaggcugcgccugcugccuccagcccugagga

SEQ ID NO: 223010 - RNA, 32 nt, Human
uaggcugcugggauggugggcuucagggcagg

SEQ ID NO: 223011 - RNA, 32 nt, Human
uaggcugcuucugagcuucagccugggagcaa

SEQ ID NO: 223012 - RNA, 32 nt, Human
uaggcuggagcuggaagggugggugaauccgg

SEQ ID NO: 223013 - RNA, 32 nt, Human
uaggcuggagugcaguggcacaaucauggcuc

SEQ ID NO: 223014 - RNA, 32 nt, Human
uaggcuggccucaaacucccgaccucagguga

SEQ ID NO: 223015 - RNA, 32 nt, Human
uaggcugggacuagcacagcaucacuucuacc

SEQ ID NO: 223016 - RNA, 32 nt, Human
uaggcugggcuggggaaauucuccuccggaac

SEQ ID NO: 223017 - RNA, 31 nt, Human
uaggcuggggcauucuuuacaccuacaaaaa

SEQ ID NO: 223018 - RNA, 32 nt, Human
uaggcuggggcauucuuuacaccuacaaaaag

SEQ ID NO: 223019 - RNA, 32 nt, Human
uaggcugggggccguggccagcacuuugggaa

SEQ ID NO: 223020 - RNA, 32 nt, Human
uaggcugggguagagggcacuuuuggaaggca

SEQ ID NO: 223021 - RNA, 32 nt, Human
uaggcugggucauaugacaagcauuagccaau

SEQ ID NO: 223022 - RNA, 32 nt, Human
uaggcuggucucaaacuccagaccucaugauu

SEQ ID NO: 223023 - RNA, 32 nt, Human
uaggcuggucucaaacuccugaccucaaguga

SEQ ID NO: 223024 - RNA, 32 nt, Human
uaggcuggucucaaacuccugaccucagguga

SEQ ID NO: 223025 - RNA, 32 nt, Human
uaggcuggucucaaacuccugcucucaaguga

SEQ ID NO: 223026 - RNA, 32 nt, Human
uaggcuggucucaaacuccuggacucaaggga

SEQ ID NO: 223027 - RNA, 32 nt, Human
uaggcuggucucaaacuccuggccucaaguga

SEQ ID NO: 223028 - RNA, 32 nt, Human
uaggcuggucucaaacucuugaccucagguga

SEQ ID NO: 223029 - RNA, 32 nt, Human
uaggcuggucucaaacucuugaccucgugauu

SEQ ID NO: 223030 - RNA, 32 nt, Human
uaggcuggucucauacucggccucgagccauc

SEQ ID NO: 223031 - RNA, 32 nt, Human
uaggcuggugaggaaguccaggcuccagggga

SEQ ID NO: 223032 - RNA, 32 nt, Human
uaggcugucccagcugucugaguguuuguccg

SEQ ID NO: 223033 - RNA, 32 nt, Human
uaggcugugggcagagggucugaaaggugggc

SEQ ID NO: 223034 - RNA, 32 nt, Human
uaggcuuauacagcgggggauuugagcuuaca

SEQ ID NO: 223035 - RNA, 32 nt, Human
uaggcuuccuuaaccuccuuuacccuuaaccc

SEQ ID NO: 223036 - RNA, 32 nt, Human
uaggcuucucauguggcucauucuuuaaucua

SEQ ID NO: 223037 - RNA, 32 nt, Human
uaggcuucuccccucaggggcucuuucugaau

SEQ ID NO: 223038 - RNA, 32 nt, Human
uaggcuucuccucuguggcuuauagccaguug

SEQ ID NO: 223039 - RNA, 32 nt, Human
uaggcuugagccaccaugcaugugcacggcca

SEQ ID NO: 223040 - RNA, 32 nt, Human
uaggcuugaggguggagagccaggccuccuca

SEQ ID NO: 223041 - RNA, 32 nt, Human
uaggcuugaugguggccaggcuugccugcucc

SEQ ID NO: 223042 - RNA, 32 nt, Human
uaggcuugcagugcuuucugacccauccaccu

SEQ ID NO: 223043 - RNA, 32 nt, Human
uaggcuuugcucucuuaccuugcccuuucuac

SEQ ID NO: 223044 - RNA, 32 nt, Human
uaggcuuuucaucuuaggaacaauuaggaaga

SEQ ID NO: 223045 - RNA, 32 nt, Human
uaggcuuuuccuuguggacaacggggcccugu

SEQ ID NO: 223046 - RNA, 19 nt, Human
uagggaaaaacaagaauuu

SEQ ID NO: 223047 - RNA, 32 nt, Human
uagggaaaaaccaucaagcucauuauuauuuu

SEQ ID NO: 223048 - RNA, 32 nt, Human
uagggaaaaagauacacauggugccuucagcg

SEQ ID NO: 223049 - RNA, 32 nt, Human
uagggaaaacaacugugauccugggagcuaau

SEQ ID NO: 223050 - RNA, 32 nt, Human
uagggaaaauaauguuggacaagucuaggauu

SEQ ID NO: 223051 - RNA, 32 nt, Human
uagggaaagagaaagaaagaauaaaagcugga

SEQ ID NO: 223052 - RNA, 32 nt, Human
uagggaaaggaaagggggaggcggcuggggaa

SEQ ID NO: 223053 - RNA, 32 nt, Human
uagggaaaguuugucaauuuguuuucacuaua

SEQ ID NO: 223054 - RNA, 32 nt, Human
uagggaaauacacguaauggccaauguucugg

SEQ ID NO: 223055 - RNA, 32 nt, Human
uagggaaauuccaggaaggcgauuuacaaagg

SEQ ID NO: 223056 - RNA, 32 nt, Human
uagggaacaaauuacuaguggcaggguggugg

SEQ ID NO: 223057 - RNA, 32 nt, Human
uagggaacacagagugcuucucccgcagcccu

SEQ ID NO: 223058 - RNA, 32 nt, Human
uagggaacauggcaaaaccccagcucuacaaa

SEQ ID NO: 223059 - RNA, 32 nt, Human
uagggaaccaguuuccagaagaggucagcaca

SEQ ID NO: 223060 - RNA, 32 nt, Human
uagggaaccccuggaggacacuaaacauguca

SEQ ID NO: 223061 - RNA, 32 nt, Human
uagggaagaacuuuugcucucagucaccucuc

SEQ ID NO: 223062 - RNA, 22 nt, Human
uagggaagaagcaagaaacuuc

SEQ ID NO: 223063 - RNA, 32 nt, Human
uagggaagacaagaccacuuuagaugaagaaa

SEQ ID NO: 223064 - RNA, 32 nt, Human
uagggaagagaaaggaaaagagcccacacaau

SEQ ID NO: 223065 - RNA, 32 nt, Human
uagggaagagcagagaugcuggagguuuugaa

SEQ ID NO: 223066 - RNA, 32 nt, Human
uagggaagcagugaugcucucaaugggaagau

SEQ ID NO: 223067 - RNA, 32 nt, Human
uagggaaucugccggaaggagcuguuugaggc

SEQ ID NO: 223068 - RNA, 32 nt, Human
uagggaaugcuggucacaugcguggaagggua

SEQ ID NO: 223069 - RNA, 32 nt, Human
uagggaaugggguggagaaaggaugggaaugu

SEQ ID NO: 223070 - RNA, 32 nt, Human
uagggacaaagacauuuuggaaauugucaguu

SEQ ID NO: 223071 - RNA, 32 nt, Human
uagggacacagcaggucaggagagauucaaca

SEQ ID NO: 223072 - RNA, 32 nt, Human
uagggacaccacugcccugucuuuaggaaauc

SEQ ID NO: 223073 - RNA, 31 nt, Human
uagggacacguguccaugcaccacagacaca

SEQ ID NO: 223074 - RNA, 32 nt, Human
uagggacagaagccucacaggucaagacuggc

SEQ ID NO: 223075 - RNA, 32 nt, Human
uagggacagacugcaagaggcuccuguccccu

SEQ ID NO: 223076 - RNA, 32 nt, Human
uagggacagauguccggauacugucugucgug

SEQ ID NO: 223077 - RNA, 32 nt, Human
uagggacagcagcaccacuccagccucagaga

SEQ ID NO: 223078 - RNA, 32 nt, Human
uagggacagcuaccggaaggaggggaacaagg

SEQ ID NO: 223079 - RNA, 32 nt, Human
uagggacagcugcuggugcaggauggaagacu

SEQ ID NO: 223080 - RNA, 32 nt, Human
uagggacagcuggucacacaaggaacucuuga

SEQ ID NO: 223081 - RNA, 32 nt, Human
uagggacaggcagggcagggacagccaccuug

SEQ ID NO: 223082 - RNA, 32 nt, Human
uagggacagggcagggacagggacagcccagg

SEQ ID NO: 223083 - RNA, 32 nt, Human
uagggacaucacacccugucucacgucgcagu

SEQ ID NO: 223084 - RNA, 32 nt, Human
uagggacauguuggccaggcugguggugagcu

SEQ ID NO: 223085 - RNA, 32 nt, Human
uagggaccccugcucccagccugcugagagcc

SEQ ID NO: 223086 - RNA, 32 nt, Human
uagggacgaaguuucacucuuguugcccaggc

SEQ ID NO: 223087 - RNA, 32 nt, Human
uagggacgcugaggcaggagaaucgcuugaac

SEQ ID NO: 223088 - RNA, 32 nt, Human
uagggacucuaccccucucuccccuuccuugu

SEQ ID NO: 223089 - RNA, 20 nt, Human
uagggacucugcccagcgga

SEQ ID NO: 223090 - RNA, 32 nt, Human
uagggacucugccuuuuuguugguagggagaa

SEQ ID NO: 223091 - RNA, 32 nt, Human
uagggacugauguuauguucgacucagcacuu

SEQ ID NO: 223092 - RNA, 32 nt, Human
uagggacugguggaguucugucuucucaaauc

SEQ ID NO: 223093 - RNA, 32 nt, Human
uagggacuguaucuuaaaaucuuggcauuucu

SEQ ID NO: 223094 - RNA, 32 nt, Human
uagggacuuggggcuuggaaccuaagguuguu

SEQ ID NO: 223095 - RNA, 32 nt, Human
uagggagaauucaggguuuccaugacuugauu

SEQ ID NO: 223096 - RNA, 32 nt, Human
uagggagacugaggcaggagaauugcuugaac

SEQ ID NO: 223097 - RNA, 32 nt, Human
uagggagagaacgccagagggaggcggcuggc

SEQ ID NO: 223098 - RNA, 32 nt, Human
uagggagagacagauguguugccauguuacuu

SEQ ID NO: 223099 - RNA, 32 nt, Human
uagggagaguguccugggugucagccagaaca

SEQ ID NO: 223100 - RNA, 32 nt, Human
uagggagcagagaaucauugaauccugacaug

SEQ ID NO: 223101 - RNA, 32 nt, Human
uagggagcaguuucugccccuccugccccguc

SEQ ID NO: 223102 - RNA, 32 nt, Human
uagggagcccugccuuuuucuacugguucccc

SEQ ID NO: 223103 - RNA, 32 nt, Human
uagggagccuccauucugugggagagugugga

SEQ ID NO: 223104 - RNA, 32 nt, Human
uagggagcucugccagaggggcagcagcugca

SEQ ID NO: 223105 - RNA, 32 nt, Human
uagggagcugaaguucuucugcgcugagguuc

SEQ ID NO: 223106 - RNA, 32 nt, Human
uagggaggagaaagagaaagauccucagaagu

SEQ ID NO: 223107 - RNA, 32 nt, Human
uagggaggaugaggcagaagaaucacuugaac

SEQ ID NO: 223108 - RNA, 32 nt, Human
uagggaggaugaggcaggagaauugcuugaac

SEQ ID NO: 223109 - RNA, 32 nt, Human
uagggaggcagccuccagccugcccaagccca

SEQ ID NO: 223110 - RNA, 32 nt, Human
uagggaggccgaggcagguacaucaccugagg

SEQ ID NO: 223111 - RNA, 32 nt, Human
uagggaggccgaggcagguggaucacuugagg

SEQ ID NO: 223112 - RNA, 32 nt, Human
uagggaggccgaggcgggcggaucaccugaga

SEQ ID NO: 223113 - RNA, 32 nt, Human
uagggaggcucaacggaaacucaggccauugu

SEQ ID NO: 223114 - RNA, 32 nt, Human
uagggaggcugaggcaggagaaucacuugaac

SEQ ID NO: 223115 - RNA, 32 nt, Human
uagggaggcugaggcaggagaaucgcuugaac

SEQ ID NO: 223116 - RNA, 32 nt, Human
uagggaggcugaggcaggagaaucucuugaac

SEQ ID NO: 223117 - RNA, 32 nt, Human
uagggaggcugaggcaggagaauggccagaac

SEQ ID NO: 223118 - RNA, 32 nt, Human
uagggaggcugaggcaggagaauggcgugaac

SEQ ID NO: 223119 - RNA, 32 nt, Human
uagggaggcugaggcaggagaauugcuugaac

SEQ ID NO: 223120 - RNA, 32 nt, Human
uagggaggcugcggcaggagaauugcuugaac

SEQ ID NO: 223121 - RNA, 32 nt, Human
uagggaggcuugcggagcaggagcgcccucuu

SEQ ID NO: 223122 - RNA, 32 nt, Human
uagggaggcuuuagagaggaagacagaugcuu

SEQ ID NO: 223123 - RNA, 32 nt, Human
uagggagggcuguccugaaaccuggagccugg

SEQ ID NO: 223124 - RNA, 22 nt, Human
uagggaggggcauuccagcaaa

SEQ ID NO: 223125 - RNA, 32 nt, Human
uagggaggggugcacaguguucccuccuggca

SEQ ID NO: 223126 - RNA, 32 nt, Human
uagggaggguugaugggggaggcguggggaag

SEQ ID NO: 223127 - RNA, 32 nt, Human
uagggaguaauuuuguguuuucuugaguguca

SEQ ID NO: 223128 - RNA, 32 nt, Human
uagggagucucaauggcccugggugaagaaaa

SEQ ID NO: 223129 - RNA, 32 nt, Human
uagggaguggagcuggggaggggcccagaguc

SEQ ID NO: 223130 - RNA, 32 nt, Human
uagggaguuccccacacaaggguuugcaaagc

SEQ ID NO: 223131 - RNA, 32 nt, Human
uagggauacucagggggcuccugcucuccuuc

SEQ ID NO: 223132 - RNA, 32 nt, Human
uagggauagagggaggaguaagucagcugcuc

SEQ ID NO: 223133 - RNA, 32 nt, Human
uagggaucaagccuuuugccaccuugggcugg

SEQ ID NO: 223134 - RNA, 32 nt, Human
uagggaucagcaccugcccuguguuuuguacc

SEQ ID NO: 223135 - RNA, 32 nt, Human
uagggaucauugcagacucugccucucaggcu

SEQ ID NO: 223136 - RNA, 32 nt, Human
uagggaucccagagcguuguaagccuucuugu

SEQ ID NO: 223137 - RNA, 32 nt, Human
uagggaugagggagggaggggcauugugaugu

SEQ ID NO: 223138 - RNA, 32 nt, Human
uagggaugcaugggcuggaguaaaggaugcuu

SEQ ID NO: 223139 - RNA, 32 nt, Human
uagggaugggguuucccauguuggccaggcug

SEQ ID NO: 223140 - RNA, 32 nt, Human
uagggauggugaggaggggagaggagggagac

SEQ ID NO: 223141 - RNA, 32 nt, Human
uagggaugguggcucaacaaaucaaacaaacu

SEQ ID NO: 223142 - RNA, 32 nt, Human
uagggaugguggcucaacaaaucaagcaaacu

SEQ ID NO: 223143 - RNA, 19 nt, Human
uagggauucaaaagaauuu

SEQ ID NO: 223144 - RNA, 32 nt, Human
uagggauucaucagggcaggaagcaggcaggc

SEQ ID NO: 223145 - RNA, 32 nt, Human
uagggauugagaccagccuggccaacauggug

SEQ ID NO: 223146 - RNA, 32 nt, Human
uagggcaaccaccaccaccugucuuccaggac

SEQ ID NO: 223147 - RNA, 32 nt, Human
uagggcaagacaauguugacagugaugcauga

SEQ ID NO: 223148 - RNA, 32 nt, Human
uagggcaaggccagacugcaaaaagaauagac

SEQ ID NO: 223149 - RNA, 32 nt, Human
uagggcaauagggagugucaguaggguaguuu

SEQ ID NO: 223150 - RNA, 32 nt, Human
uagggcacagcccuguaacugcacgugccuuc

SEQ ID NO: 223151 - RNA, 32 nt, Human
uagggcacauugguuccagccuagccaguuuc

SEQ ID NO: 223152 - RNA, 32 nt, Human
uagggcagaaggaggugcuugcagggccucuc

SEQ ID NO: 223153 - RNA, 32 nt, Human
uagggcagaaggcagcggaggccaggucuguc

SEQ ID NO: 223154 - RNA, 32 nt, Human
uagggcagacacacaaccuccuccuccucuuc

SEQ ID NO: 223155 - RNA, 32 nt, Human
uagggcagagcugagucggcagaaaagggaag

SEQ ID NO: 223156 - RNA, 32 nt, Human
uagggcagaguuugcacguccucuggucacug

SEQ ID NO: 223157 - RNA, 31 nt, Human
uagggcagccucucugauguugucaaugaug

SEQ ID NO: 223158 - RNA, 32 nt, Human
uagggcaggagaaucacuugaaccugggaggu

SEQ ID NO: 223159 - RNA, 32 nt, Human
uagggcagggccaagagcaggaaccagccuca

SEQ ID NO: 223160 - RNA, 32 nt, Human
uagggcagguuaucucuguuccagucaccccc

SEQ ID NO: 223161 - RNA, 32 nt, Human
uagggcaguuaccacagaaacagaaauugacc

SEQ ID NO: 223162 - RNA, 32 nt, Human
uagggcaucauuuugauauuucauucugauuu

SEQ ID NO: 223163 - RNA, 32 nt, Human
uagggccaaucgggagaggcagcuguggcggg

SEQ ID NO: 223164 - RNA, 21 nt, Human
uagggccagaggccaacugcc

SEQ ID NO: 223165 - RNA, 32 nt, Human
uagggccagcucacaagcccaggcuggagauc

SEQ ID NO: 223166 - RNA, 22 nt, Human
uagggccagugcaacagggcca

SEQ ID NO: 223167 - RNA, 32 nt, Human
uagggccccaggaggcgagucugaguggaacc

SEQ ID NO: 223168 - RNA, 32 nt, Human
uagggccccaucccagugccaggcugguuucc

SEQ ID NO: 223169 - RNA, 32 nt, Human
uagggccugagugccaccugcuuccugauguu

SEQ ID NO: 223170 - RNA, 32 nt, Human
uagggccugcacagaucucugguucaaaugca

SEQ ID NO: 223171 - RNA, 32 nt, Human
uagggccugcucugacagggcccaugucccac

SEQ ID NO: 223172 - RNA, 32 nt, Human
uagggccuggaccugggcuggacaguguaucc

SEQ ID NO: 223173 - RNA, 32 nt, Human
uagggccuucaagggcuggcagucuuacagag

SEQ ID NO: 223174 - RNA, 32 nt, Human
uagggcgaggccucccccuuccuccucgccau

SEQ ID NO: 223175 - RNA, 32 nt, Human
uagggcggcucaacuccucccacagcaccaac

SEQ ID NO: 223176 - RNA, 32 nt, Human
uagggcggcugagacgcaagacuugcuugaac

SEQ ID NO: 223177 - RNA, 32 nt, Human
uagggcggggccugugcaugcucucccaugac

SEQ ID NO: 223178 - RNA, 32 nt, Human
uagggcgggguuucaccaugauggccagguug

SEQ ID NO: 223179 - RNA, 32 nt, Human
uagggcgugauggcucaugccuguaaucucag

SEQ ID NO: 223180 - RNA, 32 nt, Human
uagggcgugugcagggcuggggccaguggacc

SEQ ID NO: 223181 - RNA, 32 nt, Human
uagggcuaaugcugcauuuuucuacaacauca

SEQ ID NO: 223182 - RNA, 32 nt, Human
uagggcuacaucuuguuaauugcaauugucca

SEQ ID NO: 223183 - RNA, 32 nt, Human
uagggcucauacaccucuuccaggcgucaccu

SEQ ID NO: 223184 - RNA, 32 nt, Human
uagggcuccacgggucucucuccuggggccgg

SEQ ID NO: 223185 - RNA, 32 nt, Human
uagggcucccccaggugcuggaauuauggcac

SEQ ID NO: 223186 - RNA, 32 nt, Human
uagggcuccuuucuaacaaccuagacuggaau

SEQ ID NO: 223187 - RNA, 32 nt, Human
uagggcucggugccagcacuucccggguaauc

SEQ ID NO: 223188 - RNA, 32 nt, Human
uagggcucuugggagcucugcgguugcuaggg

SEQ ID NO: 223189 - RNA, 32 nt, Human
uagggcugaaccaggcgccaggcuccagagga

SEQ ID NO: 223190 - RNA, 32 nt, Human
uagggcugaguggggucgggugaggcagaggu

SEQ ID NO: 223191 - RNA, 32 nt, Human
uagggcugcacuguccuggguguugggcccuu

SEQ ID NO: 223192 - RNA, 32 nt, Human
uagggcugccaggcugcagccugcugcuccag

SEQ ID NO: 223193 - RNA, 32 nt, Human
uagggcuggggacuugcccuccauggagguca

SEQ ID NO: 223194 - RNA, 32 nt, Human
uagggcuggggugggaggcacauggugacagg

SEQ ID NO: 223195 - RNA, 32 nt, Human
uagggcuggucugcacuuagccucucccuucc

SEQ ID NO: 223196 - RNA, 32 nt, Human
uagggcuggugcuggcccugcccacgccuagg

SEQ ID NO: 223197 - RNA, 32 nt, Human
uagggcuucagccugugaauaugagacucaca

SEQ ID NO: 223198 - RNA, 32 nt, Human
uagggcuucugugguuguggaugggaggcucc

SEQ ID NO: 223199 - RNA, 32 nt, Human
uaggggaaaauguaaaauauuuaacaaucaac

SEQ ID NO: 223200 - RNA, 32 nt, Human
uaggggaaaugagccagcacuugcuggguuug

SEQ ID NO: 223201 - RNA, 32 nt, Human
uaggggaaccugaggcuuguucuugaaguggg

SEQ ID NO: 223202 - RNA, 32 nt, Human
uaggggaagaggagaagaggguaagggggcuu

SEQ ID NO: 223203 - RNA, 32 nt, Human
uaggggaagaggaggggcaggagggagaguuc

SEQ ID NO: 223204 - RNA, 32 nt, Human
uaggggaauauggagaaauuuaaacuauugua

SEQ ID NO: 223205 - RNA, 32 nt, Human
uaggggacaauguauauguaaugaguauauga

SEQ ID NO: 223206 - RNA, 32 nt, Human
uaggggaccagugaguugggaaaguugauuag

SEQ ID NO: 223207 - RNA, 32 nt, Human
uaggggacugugcgggaagcuggggguggaug

SEQ ID NO: 223208 - RNA, 32 nt, Human
uaggggagaacacacauacagcagagaccaug

SEQ ID NO: 223209 - RNA, 32 nt, Human
uaggggagucagcugggaccacagcuugggca

SEQ ID NO: 223210 - RNA, 32 nt, Human
uaggggagugcugugcugauucuccagccaug

SEQ ID NO: 223211 - RNA, 32 nt, Human
uaggggauaaucagcccugcacggccauccuc

SEQ ID NO: 223212 - RNA, 32 nt, Human
uaggggauauggggagggaacaaguagaaggg

SEQ ID NO: 223213 - RNA, 32 nt, Human
uaggggaugguacauuuauuucaucugcaaau

SEQ ID NO: 223214 - RNA, 32 nt, Human
uaggggauucuacugucuugacauguaaaugu

SEQ ID NO: 223215 - RNA, 32 nt, Human
uaggggcaaacaucacaaaauguaauuuaaug

SEQ ID NO: 223216 - RNA, 32 nt, Human
uaggggcaacacagucugcugcuauauagugg

SEQ ID NO: 223217 - RNA, 32 nt, Human
uaggggcaagggaagagagcugaggagaggga

SEQ ID NO: 223218 - RNA, 32 nt, Human
uaggggcagaagcaauggcuugugagugagca

SEQ ID NO: 223219 - RNA, 32 nt, Human
uaggggcaggggcaaugggauguaguuuuuac

SEQ ID NO: 223220 - RNA, 21 nt, Human
uaggggcauaugauuagcuca

SEQ ID NO: 223221 - RNA, 32 nt, Human
uaggggcaugagccaccgcacccagcuugcau

SEQ ID NO: 223222 - RNA, 32 nt, Human
uaggggccagaaucuccaugcacuuuguagac

SEQ ID NO: 223223 - RNA, 32 nt, Human
uaggggcccagccucuguggcccugugaccug

SEQ ID NO: 223224 - RNA, 32 nt, Human
uaggggcccgggaagguggaagcgccgggccu

SEQ ID NO: 223225 - RNA, 32 nt, Human
uaggggcccugccugcacugcgguuguccacg

SEQ ID NO: 223226 - RNA, 32 nt, Human
uaggggccgccucugucaucucacuagacauu

SEQ ID NO: 223227 - RNA, 32 nt, Human
uaggggccgucaauaaaugugaugaugaggau

SEQ ID NO: 223228 - RNA, 32 nt, Human
uaggggccuccuggcacugcuguuuccucuca

SEQ ID NO: 223229 - RNA, 32 nt, Human
uaggggccuguaacccagcuacucgugaggcc

SEQ ID NO: 223230 - RNA, 32 nt, Human
uaggggcgcgcagaugugugaggccuuuuauu

SEQ ID NO: 223231 - RNA, 32 nt, Human
uaggggcuagagcagauuguaagaacucugga

SEQ ID NO: 223232 - RNA, 32 nt, Human
uaggggcucugagcuucugcccccagaaucau

SEQ ID NO: 223233 - RNA, 32 nt, Human
uaggggcugcagcuggggaauaagccucaaau

SEQ ID NO: 223234 - RNA, 32 nt, Human
uaggggcugggaaaggggagagauuggagucc

SEQ ID NO: 223235 - RNA, 32 nt, Human
uagggggaagucucccucccaucccucagauc

SEQ ID NO: 223236 - RNA, 32 nt, Human
uagggggaccuugauagagaacuuuauaaacu

SEQ ID NO: 223237 - RNA, 32 nt, Human
uagggggagagggaccugccgcgaaaccauca

SEQ ID NO: 223238 - RNA, 32 nt, Human
uagggggagagugcgugucuucaugguugccg

SEQ ID NO: 223239 - RNA, 32 nt, Human
uagggggagggagggggaaguuaaggggguca

SEQ ID NO: 223240 - RNA, 32 nt, Human
uagggggauauaauacauauuacuccacaccu

SEQ ID NO: 223241 - RNA, 32 nt, Human
uagggggcagcuaaaugugauccugccuugcu

SEQ ID NO: 223242 - RNA, 32 nt, Human
uagggggcagugauugccaucuggggaccugu

SEQ ID NO: 223243 - RNA, 32 nt, Human
uagggggcauggugccuggagcugaggggcau

SEQ ID NO: 223244 - RNA, 32 nt, Human
uagggggcgcggggcucggcggggcucugacg

SEQ ID NO: 223245 - RNA, 32 nt, Human
uagggggcugcuggugggaaaugggagccagg

SEQ ID NO: 223246 - RNA, 32 nt, Human
uagggggugauggagacugugggcaagccugu

SEQ ID NO: 223247 - RNA, 32 nt, Human
uaggggguuccaaggauggcucuucuaaccag

SEQ ID NO: 223248 - RNA, 32 nt, Human
uaggggguuucuguaguaugagacaucaagag

SEQ ID NO: 223249 - RNA, 32 nt, Human
uagggguacaaggacaguuguguuacauggau

SEQ ID NO: 223250 - RNA, 32 nt, Human
uaggggucaggaucaagccucccccuaacugu

SEQ ID NO: 223251 - RNA, 32 nt, Human
uaggggucggauggguggguaagcccaggauu

SEQ ID NO: 223252 - RNA, 32 nt, Human
uaggggugcaggaaguggacagggcggagggu

SEQ ID NO: 223253 - RNA, 32 nt, Human
uagggguggggagaugcuucucuccuugcccc

SEQ ID NO: 223254 - RNA, 32 nt, Human
uaggggugggggugggauggcaggaggagccg

SEQ ID NO: 223255 - RNA, 29 nt, Human
uaggggugucugugugugaaucucuguuu

SEQ ID NO: 223256 - RNA, 32 nt, Human
uaggggugugccaggccacuuugguaucagaa

SEQ ID NO: 223257 - RNA, 32 nt, Human
uagggguguguauucacauaguccucagggcu

SEQ ID NO: 223258 - RNA, 23 nt, Human
uagggguuauguugucugugcuu

SEQ ID NO: 223259 - RNA, 32 nt, Human
uagggguucccgcuuccauguacggagacccu

SEQ ID NO: 223260 - RNA, 32 nt, Human
uagggguucucacucuagcuuggggagccagg

SEQ ID NO: 223261 - RNA, 32 nt, Human
uaggguaaccagccucaagcccaugcucuccu

SEQ ID NO: 223262 - RNA, 32 nt, Human
uaggguaagggacuguucugaagaaccuuucc

SEQ ID NO: 223263 - RNA, 32 nt, Human
uaggguaagucccagcccuguucacgugaaag

SEQ ID NO: 223264 - RNA, 18 nt, Human
uaggguacagaagaauuu

SEQ ID NO: 223265 - RNA, 32 nt, Human
uaggguacugaaguccccuacuauucuugugu

SEQ ID NO: 223266 - RNA, 32 nt, Human
uaggguagugcuaaaugagaaagcccauguag

SEQ ID NO: 223267 - RNA, 32 nt, Human
uaggguaugggcagugcuuaggcacuccauau

SEQ ID NO: 223268 - RNA, 32 nt, Human
uagggucacuucagaagcaagaggcacaagaa

SEQ ID NO: 223269 - RNA, 32 nt, Human
uagggucagcagagacucagaguccagggcaa

SEQ ID NO: 223270 - RNA, 32 nt, Human
uagggucauuucucccugccugcuuugugcca

SEQ ID NO: 223271 - RNA, 32 nt, Human
uaggguccaggcaggaaugaagccaauaauuu

SEQ ID NO: 223272 - RNA, 32 nt, Human
uaggguccucaggcaguggcccagggaaucag

SEQ ID NO: 223273 - RNA, 32 nt, Human
uaggguccuggguccccgaaccaggaaggguu

SEQ ID NO: 223274 - RNA, 18 nt, Human
uagggucucgcucuguca

SEQ ID NO: 223275 - RNA, 32 nt, Human
uagggucuggggacacagaaggagccggcauu

SEQ ID NO: 223276 - RNA, 32 nt, Human
uagggucugggggcuuagaggcugggauggcu

SEQ ID NO: 223277 - RNA, 18 nt, Human
uagggucuuacucuguca

SEQ ID NO: 223278 - RNA, 32 nt, Human
uagggucuugcacuccagcccaggcgagagag

SEQ ID NO: 223279 - RNA, 32 nt, Human
uagggugagagggaguggggagggagagggca

SEQ ID NO: 223280 - RNA, 32 nt, Human
uagggugagggugggaggacuguguguccgug

SEQ ID NO: 223281 - RNA, 32 nt, Human
uagggugauuggcugcugcagcccacccccua

SEQ ID NO: 223282 - RNA, 32 nt, Human
uagggugcagugacgugaucauggcucacugc

SEQ ID NO: 223283 - RNA, 32 nt, Human
uagggugcaguggugugaucauaguucacugu

SEQ ID NO: 223284 - RNA, 32 nt, Human
uagggugccuuggcaggagccaggacaaggcc

SEQ ID NO: 223285 - RNA, 32 nt, Human
uagggugcgccuucucaagggugaggugucug

SEQ ID NO: 223286 - RNA, 32 nt, Human
uagggugcugagugccugauacugccugacaa

SEQ ID NO: 223287 - RNA, 32 nt, Human
uaggguggaaacacucugaucugaagcccagc

SEQ ID NO: 223288 - RNA, 32 nt, Human
uaggguggaacagaaggacagacggacccagg

SEQ ID NO: 223289 - RNA, 32 nt, Human
uaggguggaggggagagaagaagaugcugaug

SEQ ID NO: 223290 - RNA, 32 nt, Human
uaggguggcacaucuguccugacagacgagga

SEQ ID NO: 223291 - RNA, 32 nt, Human
uaggguggcauggcuccccaucucggguccau

SEQ ID NO: 223292 - RNA, 32 nt, Human
uagggugggaagggggacagagagggcccucc

SEQ ID NO: 223293 - RNA, 32 nt, Human
uagggugggaggcagggcaaugcaggauccaa

SEQ ID NO: 223294 - RNA, 32 nt, Human
uagggugggaucuuugaaaagcugacauuugc

SEQ ID NO: 223295 - RNA, 32 nt, Human
uaggguggggucuggucacacacagguguuga

SEQ ID NO: 223296 - RNA, 32 nt, Human
uagggugugcaaggguggacagcaggcguugc

SEQ ID NO: 223297 - RNA, 32 nt, Human
uaggguucaauguugaagauggcagagccaau

SEQ ID NO: 223298 - RNA, 32 nt, Human
uaggguuccaacugggccuacaagcucaagcc

SEQ ID NO: 223299 - RNA, 32 nt, Human
uaggguugugacuggcuuuggugcaaaugugu

SEQ ID NO: 223300 - RNA, 32 nt, Human
uaggguuguuagugacccacaggacaguauag

SEQ ID NO: 223301 - RNA, 32 nt, Human
uaggguuucuaaaacgcucugacagaugcaag

SEQ ID NO: 223302 - RNA, 32 nt, Human
uaggguuugagacuuagcugugauacugacag

SEQ ID NO: 223303 - RNA, 32 nt, Human
uaggguuugaggauuccugagugugggcuucu

SEQ ID NO: 223304 - RNA, 32 nt, Human
uaggguuugggagcuuggcccuacgguuugua

SEQ ID NO: 223305 - RNA, 32 nt, Human
uaggguuuguaacccagggccugugcuggcgu

SEQ ID NO: 223306 - RNA, 32 nt, Human
uagguaaaagaauuccagaaggaggccagggc

SEQ ID NO: 223307 - RNA, 32 nt, Human
uagguaagcuuauuucagaacaagucuaauau

SEQ ID NO: 223308 - RNA, 32 nt, Human
uagguaaggcuacaugagaaauugagcuuuuc

SEQ ID NO: 223309 - RNA, 32 nt, Human
uagguaagguaagaggaaucaaguucugagug

SEQ ID NO: 223310 - RNA, 32 nt, Human
uagguaaugggggaauggacagaggaauccug

SEQ ID NO: 223311 - RNA, 32 nt, Human
uagguaauucaagcccucaucagguuuacaag

SEQ ID NO: 223312 - RNA, 31 nt, Human
uagguaauucauauuauacauuuaaguucuu

SEQ ID NO: 223313 - RNA, 32 nt, Human
uagguacacagcaaaauuaaacaaauccaaca

SEQ ID NO: 223314 - RNA, 32 nt, Human
uagguacacuggcugcugccuauccugucccu

SEQ ID NO: 223315 - RNA, 32 nt, Human
uagguaccuuguagcagugugcuuugcauuuu

SEQ ID NO: 223316 - RNA, 32 nt, Human
uagguacucaaacuccauucuccagggguuua

SEQ ID NO: 223317 - RNA, 32 nt, Human
uagguacuccaaugguguacaaugucuuuugc

SEQ ID NO: 223318 - RNA, 32 nt, Human
uagguacugaccccucccucuugggcagcacc

SEQ ID NO: 223319 - RNA, 31 nt, Human
uagguacuuaauaaauauuugcuguugauga

SEQ ID NO: 223320 - RNA, 32 nt, Human
uagguacuucaggccuucuuggacuguuguua

SEQ ID NO: 223321 - RNA, 32 nt, Human
uagguagauccagauccagacuguaagauguu

SEQ ID NO: 223322 - RNA, 32 nt, Human
uagguagcuacacguacauaauuaucucuuua

SEQ ID NO: 223323 - RNA, 32 nt, Human
uagguagggcugggcacuggucauuccacucu

SEQ ID NO: 223324 - RNA, 28 nt, Human
uagguagucaaggcagccucaucucccc

SEQ ID NO: 223325 - RNA, 32 nt, Human
uagguagucccagcuacucgagguugcuccag

SEQ ID NO: 223326 - RNA, 32 nt, Human
uagguaguguccucauuuuauauugugaccac

SEQ ID NO: 223327 - RNA, 32 nt, Human
uagguauaaaggcuuuuaugugucuaacuaga

SEQ ID NO: 223328 - RNA, 32 nt, Human
uagguaucacuuaccuuaccugcccagacccc

SEQ ID NO: 223329 - RNA, 32 nt, Human
uagguaucugacauuuccccugcuugcacucc

SEQ ID NO: 223330 - RNA, 32 nt, Human
uagguaugaauagggacuugcaguaugagggc

SEQ ID NO: 223331 - RNA, 32 nt, Human
uagguaugauucacauacaaaaagcugcacau

SEQ ID NO: 223332 - RNA, 32 nt, Human
uagguauggccaccuggugaauucaguuguua

SEQ ID NO: 223333 - RNA, 32 nt, Human
uagguaugggauuuaugagaccaguaccugaa

SEQ ID NO: 223334 - RNA, 32 nt, Human
uagguauuucuccuaaugcucucccuccccca

SEQ ID NO: 223335 - RNA, 32 nt, Human
uagguauuuucuccagcucugacauuguuuuc

SEQ ID NO: 223336 - RNA, 32 nt, Human
uaggucaaaugaugugcccaaccaaggucaca

SEQ ID NO: 223337 - RNA, 32 nt, Human
uaggucacagaaaccucugccugccagguagg

SEQ ID NO: 223338 - RNA, 32 nt, Human
uaggucacagaagcagugggucagaagccaga

SEQ ID NO: 223339 - RNA, 32 nt, Human
uaggucacuguagccuccgccuccagggcuca

SEQ ID NO: 223340 - RNA, 32 nt, Human
uaggucagagggcucuuuguccugguugaagu

SEQ ID NO: 223341 - RNA, 32 nt, Human
uaggucagagguggggacagagaacuccccua

SEQ ID NO: 223342 - RNA, 32 nt, Human
uaggucagcucuuuugaaaauguuuuauuuga

SEQ ID NO: 223343 - RNA, 32 nt, Human
uaggucaggagaucaagaccagcugggccaac

SEQ ID NO: 223344 - RNA, 32 nt, Human
uaggucaggaguuugagaccagccuggccaac

SEQ ID NO: 223345 - RNA, 32 nt, Human
uaggucaggaguuugagaccagccuggccaau

SEQ ID NO: 223346 - RNA, 32 nt, Human
uaggucaggaguuugagaucagccuggccaau

SEQ ID NO: 223347 - RNA, 32 nt, Human
uaggucagggccacccuccauucucagcggac

SEQ ID NO: 223348 - RNA, 32 nt, Human
uaggucaguguaagaauuaaagaaagaggaaa

SEQ ID NO: 223349 - RNA, 32 nt, Human
uaggucauaagaauucugagaaugaaauacaa

SEQ ID NO: 223350 - RNA, 32 nt, Human
uaggucauccuggguacucaggccucuagacu

SEQ ID NO: 223351 - RNA, 32 nt, Human
uaggucauuaacaccacuucuuuucaucugua

SEQ ID NO: 223352 - RNA, 32 nt, Human
uagguccagaagagugaaagagagggaggggu

SEQ ID NO: 223353 - RNA, 32 nt, Human
uagguccagcugguaugaugcuguucaaguuc

SEQ ID NO: 223354 - RNA, 25 nt, Human
uagguccaggaccagggguccugcu

SEQ ID NO: 223355 - RNA, 32 nt, Human
uagguccaucucaugccuuucucagacucucc

SEQ ID NO: 223356 - RNA, 32 nt, Human
uagguccccacuguccccgccgucccgccccu

SEQ ID NO: 223357 - RNA, 32 nt, Human
uagguccccagauggggagacugaggccgugg

SEQ ID NO: 223358 - RNA, 32 nt, Human
uaggucccuccaggcuggggcuugggacugcu

SEQ ID NO: 223359 - RNA, 32 nt, Human
uagguccgcuggucacagcacacacacgcucc

SEQ ID NO: 223360 - RNA, 32 nt, Human
uagguccgcuugguccagagcugaguucaagu

SEQ ID NO: 223361 - RNA, 32 nt, Human
uagguccuaugucaccaccacaccaugccagc

SEQ ID NO: 223362 - RNA, 32 nt, Human
uagguccuggguggaggaagaagugguggagc

SEQ ID NO: 223363 - RNA, 32 nt, Human
uaggucgggaggcaccucuagcaugagacagu

SEQ ID NO: 223364 - RNA, 32 nt, Human
uaggucgugccacugcacuccagccugggcaa

SEQ ID NO: 223365 - RNA, 32 nt, Human
uaggucguggaggagacaggcaccuucucucg

SEQ ID NO: 223366 - RNA, 31 nt, Human
uaggucucacucaaggggugaugacgggagg

SEQ ID NO: 223367 - RNA, 32 nt, Human
uaggucucagagaguuaauaggaguauuuuug

SEQ ID NO: 223368 - RNA, 32 nt, Human
uaggucucauuaaacagaguggagauuucauu

SEQ ID NO: 223369 - RNA, 32 nt, Human
uaggucuccaagcucauuugaccagcgcagcu

SEQ ID NO: 223370 - RNA, 32 nt, Human
uaggucuccagcaucacaucucuuuacagggu

SEQ ID NO: 223371 - RNA, 32 nt, Human
uaggucuccagcgcccugcagcuugacagaaa

SEQ ID NO: 223372 - RNA, 32 nt, Human
uaggucucuccuucuccuccuccuccuccucu

SEQ ID NO: 223373 - RNA, 25 nt, Human
uaggucugacagccccucccuccca

SEQ ID NO: 223374 - RNA, 32 nt, Human
uaggucugcacacauaacacacaucaguccac

SEQ ID NO: 223375 - RNA, 32 nt, Human
uaggucugcaggaaggaaggcugaaaaagcgg

SEQ ID NO: 223376 - RNA, 32 nt, Human
uaggucugcugauuccuguccuggugagcuca

SEQ ID NO: 223377 - RNA, 32 nt, Human
uaggucugugcgcaccucucugggcuugcugg

SEQ ID NO: 223378 - RNA, 32 nt, Human
uaggucuguguguaugaacauaauauacacga

SEQ ID NO: 223379 - RNA, 32 nt, Human
uaggucuguuuucaaagaacuuuuuccaagug

SEQ ID NO: 223380 - RNA, 32 nt, Human
uaggucuuaugugguucaacucccacccccgc

SEQ ID NO: 223381 - RNA, 31 nt, Human
uaggucuucaauaaauauuuaauggaagguu

SEQ ID NO: 223382 - RNA, 32 nt, Human
uaggucuugcagguuuccuuuugaauuuuaag

SEQ ID NO: 223383 - RNA, 22 nt, Human
uaggucuugcauaucaguuuua

SEQ ID NO: 223384 - RNA, 32 nt, Human
uaggucuuuacuggcccugacugcuguuaaua

SEQ ID NO: 223385 - RNA, 24 nt, Human
uaggucuuuggggaaguccuggcu

SEQ ID NO: 223386 - RNA, 22 nt, Human
uaggugaacacugagaaggcag

SEQ ID NO: 223387 - RNA, 32 nt, Human
uaggugacaaagugagaccccaucucuacaaa

SEQ ID NO: 223388 - RNA, 32 nt, Human
uaggugacacacuuccaacacugugaauugcu

SEQ ID NO: 223389 - RNA, 32 nt, Human
uaggugacagggugguccagucaaggugacag

SEQ ID NO: 223390 - RNA, 32 nt, Human
uaggugacauagugagaccccaucucuacaaa

SEQ ID NO: 223391 - RNA, 32 nt, Human
uaggugaccaaagcacuauggaagugaauauc

SEQ ID NO: 223392 - RNA, 32 nt, Human
uaggugacccagguucucagcauuguacaugg

SEQ ID NO: 223393 - RNA, 32 nt, Human
uaggugaccuuagagaccuaaggugagagacu

SEQ ID NO: 223394 - RNA, 32 nt, Human
uaggugacugcacugcagcccacauggagagc

SEQ ID NO: 223395 - RNA, 32 nt, Human
uaggugacugucuccuggaaauguuaugcagc

SEQ ID NO: 223396 - RNA, 32 nt, Human
uaggugagaacuggcuuccucauugucccagg

SEQ ID NO: 223397 - RNA, 32 nt, Human
uaggugaggaggcaggagagacacccucccuu

SEQ ID NO: 223398 - RNA, 32 nt, Human
uaggugagggcagaggaggagaucagaaaauc

SEQ ID NO: 223399 - RNA, 32 nt, Human
uaggugaguagggguggugcaagugaauucgu

SEQ ID NO: 223400 - RNA, 32 nt, Human
uaggugaucagcuugaaauucagcuaaccgag

SEQ ID NO: 223401 - RNA, 32 nt, Human
uaggugauggccagucaugugcugguaaaugu

SEQ ID NO: 223402 - RNA, 32 nt, Human
uaggugauggccuggugggguggcucaugccu

SEQ ID NO: 223403 - RNA, 32 nt, Human
uaggugcaacccaauggaccacuuaugcaaaa

SEQ ID NO: 223404 - RNA, 32 nt, Human
uaggugcacgaguuuucauuucaagagucucc

SEQ ID NO: 223405 - RNA, 32 nt, Human
uaggugcacuguccggcuccagccagguccgc

SEQ ID NO: 223406 - RNA, 32 nt, Human
uaggugcaggugagcacaggugcaguggguac

SEQ ID NO: 223407 - RNA, 32 nt, Human
uaggugcauauguauacauacacacacauaua

SEQ ID NO: 223408 - RNA, 32 nt, Human
uaggugcccaggcugaggugaagaggccuggg

SEQ ID NO: 223409 - RNA, 32 nt, Human
uaggugcccgccaccagacccggcuaauuuuu

SEQ ID NO: 223410 - RNA, 32 nt, Human
uaggugcccugagcuguuucugccaauagauu

SEQ ID NO: 223411 - RNA, 32 nt, Human
uaggugccuguaaucccagcuacuugggagac

SEQ ID NO: 223412 - RNA, 32 nt, Human
uaggugccuuucucuuccugcugaccacaagc

SEQ ID NO: 223413 - RNA, 32 nt, Human
uaggugcgagccacugcgcccagccucaguua

SEQ ID NO: 223414 - RNA, 32 nt, Human
uaggugcuaaccaccugcccagaagaguggau

SEQ ID NO: 223415 - RNA, 29 nt, Human
uaggugcucaauaaagacuuguugaauga

SEQ ID NO: 223416 - RNA, 31 nt, Human
uaggugcucaauaaauauuuauaugagugaa

SEQ ID NO: 223417 - RNA, 31 nt, Human
uaggugcucaauaaaugcauauugaauaacu

SEQ ID NO: 223418 - RNA, 31 nt, Human
uaggugcucaauaaauguugaaaccaacuga

SEQ ID NO: 223419 - RNA, 31 nt, Human
uaggugcucaauaaguauccaaugaguggac

SEQ ID NO: 223420 - RNA, 32 nt, Human
uaggugcucagguuugugcucuuggaugaaac

SEQ ID NO: 223421 - RNA, 32 nt, Human
uaggugcuggaagguauuggcucccuguuuug

SEQ ID NO: 223422 - RNA, 32 nt, Human
uaggugcuggaagguauuggcuccuuguuuug

SEQ ID NO: 223423 - RNA, 32 nt, Human
uaggugcugggaaaagggcuuguggggugccu

SEQ ID NO: 223424 - RNA, 32 nt, Human
uaggugcugggaauaccacugaugagacagac

SEQ ID NO: 223425 - RNA, 32 nt, Human
uagguggacccggucucccacaggugacauca

SEQ ID NO: 223426 - RNA, 32 nt, Human
uagguggagggaaggaaggagggagccgggga

SEQ ID NO: 223427 - RNA, 32 nt, Human
uaggugggcagcccucacaggggaggccgagg

SEQ ID NO: 223428 - RNA, 25 nt, Human
uaggugggcggaucacaaggucagg

SEQ ID NO: 223429 - RNA, 32 nt, Human
uagguggggucacugccccuccuggguuagca

SEQ ID NO: 223430 - RNA, 32 nt, Human
uaggugggucugaacccucuggcuucagagag

SEQ ID NO: 223431 - RNA, 32 nt, Human
uaggugggugauauucuggucugcaccguacc

SEQ ID NO: 223432 - RNA, 32 nt, Human
uagguggguucgugcgccuucuaccucgcugu

SEQ ID NO: 223433 - RNA, 32 nt, Human
uaggugguacaugcacaguugcucugggaguc

SEQ ID NO: 223434 - RNA, 32 nt, Human
uagguggucuugaacuccugaugucaggugau

SEQ ID NO: 223435 - RNA, 32 nt, Human
uagguggugccacugcacuccaaccuggggga

SEQ ID NO: 223436 - RNA, 32 nt, Human
uagguggugcugcugcuccauucccaaguaac

SEQ ID NO: 223437 - RNA, 32 nt, Human
uagguguaagaaacugcuuuuaucucauuuau

SEQ ID NO: 223438 - RNA, 32 nt, Human
uaggugucacuaccucuaaccuuuuuaaucgc

SEQ ID NO: 223439 - RNA, 32 nt, Human
uaggugucagccaccgcacccagccuggagug

SEQ ID NO: 223440 - RNA, 32 nt, Human
uaggugucuggccaggcccaccugcugcggau

SEQ ID NO: 223441 - RNA, 31 nt, Human
uaggugugacuucucuuccuuagaggggcau

SEQ ID NO: 223442 - RNA, 32 nt, Human
uaggugugagccaccacacccagccucuauau

SEQ ID NO: 223443 - RNA, 32 nt, Human
uaggugugagccaccacgccuggcuaauuuuu

SEQ ID NO: 223444 - RNA, 32 nt, Human
uaggugugagccaccaugcccagccccuucug

SEQ ID NO: 223445 - RNA, 32 nt, Human
uaggugugagccacccugcucaaccagguuuu

SEQ ID NO: 223446 - RNA, 32 nt, Human
uaggugugagccaccgcacccagccaaaccuu

SEQ ID NO: 223447 - RNA, 32 nt, Human
uaggugugagccaccgcaccuggccgauauuu

SEQ ID NO: 223448 - RNA, 32 nt, Human
uaggugugagccaccgcgccgggccgguugcu

SEQ ID NO: 223449 - RNA, 32 nt, Human
uaggugugagccaccgugccgggccuggacuu

SEQ ID NO: 223450 - RNA, 32 nt, Human
uaggugugagccacugcacccggccuccaagc

SEQ ID NO: 223451 - RNA, 32 nt, Human
uaggugugagccacugcaccuggccuggagcu

SEQ ID NO: 223452 - RNA, 32 nt, Human
uaggugugagccacugcgccuggcuaaguuau

SEQ ID NO: 223453 - RNA, 32 nt, Human
uaggugugagccacugucccuggccuauacgg

SEQ ID NO: 223454 - RNA, 32 nt, Human
uaggugugagccagcacgucugguuaauuuau

SEQ ID NO: 223455 - RNA, 32 nt, Human
uaggugugagccagcaugccuggccccuggaa

SEQ ID NO: 223456 - RNA, 32 nt, Human
uaggugugagccaucacgccaggucaagagcc

SEQ ID NO: 223457 - RNA, 18 nt, Human
uaggugugcaccaccacg

SEQ ID NO: 223458 - RNA, 18 nt, Human
uaggugugcaccaccaug

SEQ ID NO: 223459 - RNA, 32 nt, Human
uaggugugcaccaccaugccuggcuaauuuuu

SEQ ID NO: 223460 - RNA, 29 nt, Human
uaggugugguggcgugugccugugauccc

SEQ ID NO: 223461 - RNA, 31 nt, Human
uagguguucaauaaauauuuguugaaugaau

SEQ ID NO: 223462 - RNA, 32 nt, Human
uagguguugcccaaauucagugucagugaagu

SEQ ID NO: 223463 - RNA, 32 nt, Human
uagguguuuuauucuuuuuguggcaguuguga

SEQ ID NO: 223464 - RNA, 32 nt, Human
uagguguuuucaaaacacaguccggaguguaa

SEQ ID NO: 223465 - RNA, 32 nt, Human
uagguuaaaauggcugaaaaugugaucuuugg

SEQ ID NO: 223466 - RNA, 32 nt, Human
uagguuaccacucugggcauugccuuuccacc

SEQ ID NO: 223467 - RNA, 32 nt, Human
uagguuacuuuuucucuuuaagcaauuauucc

SEQ ID NO: 223468 - RNA, 32 nt, Human
uagguuaggcccugcacuccaccuggggacgg

SEQ ID NO: 223469 - RNA, 32 nt, Human
uagguuaugacaggagcagcacugcagccaca

SEQ ID NO: 223470 - RNA, 32 nt, Human
uagguuauggugccucacaccuguaaucccag

SEQ ID NO: 223471 - RNA, 32 nt, Human
uagguuauucaaaguuuucagcucuuuuaaaa

SEQ ID NO: 223472 - RNA, 32 nt, Human
uagguucacagaaaaauugagcagaguacaua

SEQ ID NO: 223473 - RNA, 32 nt, Human
uagguucacauguauuaccucuuggcuucacc

SEQ ID NO: 223474 - RNA, 32 nt, Human
uagguucagccaagguuuuauaaggcugaugu

SEQ ID NO: 223475 - RNA, 32 nt, Human
uagguucaguagguagagaccaagcaucuauc

SEQ ID NO: 223476 - RNA, 32 nt, Human
uagguucaugaucuacauuggggccugggauu

SEQ ID NO: 223477 - RNA, 32 nt, Human
uagguuccaguuacagcuuggaucuggcauaa

SEQ ID NO: 223478 - RNA, 32 nt, Human
uagguucccaucucuccuucugccucacucug

SEQ ID NO: 223479 - RNA, 32 nt, Human
uagguucuagguuugaaacagaugcagaaucc

SEQ ID NO: 223480 - RNA, 32 nt, Human
uagguucucaggguuagaaacagucuugcgag

SEQ ID NO: 223481 - RNA, 32 nt, Human
uagguucuuggaaauggcaacuuuaaacaaaa

SEQ ID NO: 223482 - RNA, 32 nt, Human
uagguugaauaagguguggaaaaugcuuuucu

SEQ ID NO: 223483 - RNA, 32 nt, Human
uagguugcaacaguggagugauuuugaagaag

SEQ ID NO: 223484 - RNA, 32 nt, Human
uagguugcagaacuucaugaaagcuuuacuaa

SEQ ID NO: 223485 - RNA, 32 nt, Human
uagguugcagugagcugagaucacaccaaaau

SEQ ID NO: 223486 - RNA, 32 nt, Human
uagguugccaugagccauggugucaacaugcu

SEQ ID NO: 223487 - RNA, 31 nt, Human
uagguuggagugggcaucacagccagggugg

SEQ ID NO: 223488 - RNA, 32 nt, Human
uagguuggggcggaggaagcuggaggauaggg

SEQ ID NO: 223489 - RNA, 32 nt, Human
uagguuguccagcauaaggagccccagaguuc

SEQ ID NO: 223490 - RNA, 32 nt, Human
uagguuguccuagaaaggguguggagggagga

SEQ ID NO: 223491 - RNA, 32 nt, Human
uagguuguggugagcugagaucgcgccauugc

SEQ ID NO: 223492 - RNA, 32 nt, Human
uagguuuaaagaaaagggaauguuuucugcug

SEQ ID NO: 223493 - RNA, 32 nt, Human
uagguuucauagaguccucuccucugcaaugu

SEQ ID NO: 223494 - RNA, 32 nt, Human
uagguuuccaggccucacagccaagcugaagc

SEQ ID NO: 223495 - RNA, 32 nt, Human
uagguuugacuuuuugaaacaaaagucauuca

SEQ ID NO: 223496 - RNA, 32 nt, Human
uagguuugaugaagccagcaauggcaacaagu

SEQ ID NO: 223497 - RNA, 32 nt, Human
uagguuugcaaacaaaguuaagaaauaggaaa

SEQ ID NO: 223498 - RNA, 32 nt, Human
uagguuuggaccagucugaauccagaggauca

SEQ ID NO: 223499 - RNA, 32 nt, Human
uagguuuggauucuuuaauaauaucuaaaaag

SEQ ID NO: 223500 - RNA, 32 nt, Human
uagguuuuauuuccucauugcaauuuccuggc

SEQ ID NO: 223501 - RNA, 31 nt, Human
uagguuuucaaaaauaccuggcaagaaaucu

SEQ ID NO: 223502 - RNA, 32 nt, Human
uagguuuugcuacaugacggguugugagacuu

SEQ ID NO: 223503 - RNA, 32 nt, Human
uagguuuuuggagcuucucugcuucaugucuu

SEQ ID NO: 223504 - RNA, 32 nt, Human
uaguaaaaaccugugaccagagcugaaggaag

SEQ ID NO: 223505 - RNA, 32 nt, Human
uaguaaaaauagauuacuugugaaauuauuuu

SEQ ID NO: 223506 - RNA, 32 nt, Human
uaguaaaagagaguguuugagagcagaagcua

SEQ ID NO: 223507 - RNA, 32 nt, Human
uaguaaacaagaaaauacucuugagugaaaug

SEQ ID NO: 223508 - RNA, 32 nt, Human
uaguaaacauaaggaaaauaacauuuauuuaa

SEQ ID NO: 223509 - RNA, 32 nt, Human
uaguaaaccugacauuccaggcccaugagggg

SEQ ID NO: 223510 - RNA, 32 nt, Human
uaguaaacucaaugacaccacacuucaggugc

SEQ ID NO: 223511 - RNA, 32 nt, Human
uaguaaagacaggguuucaccauauuggccag

SEQ ID NO: 223512 - RNA, 32 nt, Human
uaguaaagacaggguuucaccauguuggccag

SEQ ID NO: 223513 - RNA, 32 nt, Human
uaguaaagacaggguuucaccguguuagccag

SEQ ID NO: 223514 - RNA, 32 nt, Human
uaguaaagacaggguuucaucauguuggccug

SEQ ID NO: 223515 - RNA, 32 nt, Human
uaguaaagacaggguuucuccauguuggucag

SEQ ID NO: 223516 - RNA, 32 nt, Human
uaguaaagacgggguuucaccauguuggucag

SEQ ID NO: 223517 - RNA, 32 nt, Human
uaguaaagaugggguuucaccauguuggccag

SEQ ID NO: 223518 - RNA, 32 nt, Human
uaguaaaggagcagcuggaggaggagcaggga

SEQ ID NO: 223519 - RNA, 32 nt, Human
uaguaaaggucaggaguucaagacaagaccag

SEQ ID NO: 223520 - RNA, 32 nt, Human
uaguaaauaagagagaggaaggaggugacguu

SEQ ID NO: 223521 - RNA, 32 nt, Human
uaguaaaucaucaaaaugagauaauaagugcu

SEQ ID NO: 223522 - RNA, 32 nt, Human
uaguaaaucuaugagcaacuccuuacuucggu

SEQ ID NO: 223523 - RNA, 32 nt, Human
uaguaacagaagcaucugguucugugaauaaa

SEQ ID NO: 223524 - RNA, 32 nt, Human
uaguaacaggcgugaagucaggagaauuugag

SEQ ID NO: 223525 - RNA, 32 nt, Human
uaguaacauauguauacaugugccaugcuggu

SEQ ID NO: 223526 - RNA, 32 nt, Human
uaguaaccaaagagaaaauccaggaagccaaa

SEQ ID NO: 223527 - RNA, 32 nt, Human
uaguaacccaaagaagugaaggagaaagcagc

SEQ ID NO: 223528 - RNA, 32 nt, Human
uaguaaccugcucuguccuuagucauccuuag

SEQ ID NO: 223529 - RNA, 32 nt, Human
uaguaacuuuccaauaugauuucuccguggua

SEQ ID NO: 223530 - RNA, 32 nt, Human
uaguaagaaaacaucacugaaaugcuagcugc

SEQ ID NO: 223531 - RNA, 24 nt, Human
uaguaagacccccaucgcuacaaa

SEQ ID NO: 223532 - RNA, 32 nt, Human
uaguaagagagggagcagggagaccaguuacg

SEQ ID NO: 223533 - RNA, 32 nt, Human
uaguaagauaggaagugaggccagguaccuug

SEQ ID NO: 223534 - RNA, 32 nt, Human
uaguaagccccugugacccucucacuuacccc

SEQ ID NO: 223535 - RNA, 32 nt, Human
uaguaagcuagcaucuuacugccgucaauauu

SEQ ID NO: 223536 - RNA, 32 nt, Human
uaguaaggacaaaaggaagcacuguggcuaua

SEQ ID NO: 223537 - RNA, 32 nt, Human
uaguaaggaccacaagucucagaagaguagga

SEQ ID NO: 223538 - RNA, 32 nt, Human
uaguaaggagaaauuaagaccagcuggcuguu

SEQ ID NO: 223539 - RNA, 32 nt, Human
uaguaaggaggccaguuuggaggcaggcguug

SEQ ID NO: 223540 - RNA, 32 nt, Human
uaguaaguauuucaacucuggaaacaagaugg

SEQ ID NO: 223541 - RNA, 23 nt, Human
uaguaagucgugaguucaagauu

SEQ ID NO: 223542 - RNA, 32 nt, Human
uaguaaguggcagaacagggacuugaaccaag

SEQ ID NO: 223543 - RNA, 32 nt, Human
uaguaauaauucacaccuugcacagcaugaga

SEQ ID NO: 223544 - RNA, 32 nt, Human
uaguaauagaucugagcaacacauggaguauc

SEQ ID NO: 223545 - RNA, 32 nt, Human
uaguaaucaagauaguguggcuuugguguaag

SEQ ID NO: 223546 - RNA, 32 nt, Human
uaguaauccaggauuucucugagaacugggau

SEQ ID NO: 223547 - RNA, 32 nt, Human
uaguaauccauuaguuauggccagcaguguuc

SEQ ID NO: 223548 - RNA, 32 nt, Human
uaguaaugacaggguuucaccguguuggccag

SEQ ID NO: 223549 - RNA, 32 nt, Human
uaguaaugaugucccagcauuugauguucccu

SEQ ID NO: 223550 - RNA, 32 nt, Human
uaguaaugcugggaaggagcagcagagucugg

SEQ ID NO: 223551 - RNA, 32 nt, Human
uaguaauggaggugcugugccaugaccagcag

SEQ ID NO: 223552 - RNA, 32 nt, Human
uaguaauucacaguccucagaagccuauuuuu

SEQ ID NO: 223553 - RNA, 32 nt, Human
uaguaauucuugcccauggagggauuagugac

SEQ ID NO: 223554 - RNA, 32 nt, Human
uaguaauugcuccccuguuccuucaccucccc

SEQ ID NO: 223555 - RNA, 21 nt, Human
uaguacaagaaagagcaauga

SEQ ID NO: 223556 - RNA, 32 nt, Human
uaguacaccauggagcacgguuuaagcaccac

SEQ ID NO: 223557 - RNA, 32 nt, Human
uaguacagacgggguuucaccauguuggccag

SEQ ID NO: 223558 - RNA, 32 nt, Human
uaguacagacgggguuucaccauguuggucag

SEQ ID NO: 223559 - RNA, 32 nt, Human
uaguacagacgggguuucacuguguugcccag

SEQ ID NO: 223560 - RNA, 32 nt, Human
uaguacagacgggguuucuccguguuggucag

SEQ ID NO: 223561 - RNA, 32 nt, Human
uaguacagacgguguuucaccauguuagucag

SEQ ID NO: 223562 - RNA, 32 nt, Human
uaguacagagacaaagugagauuuucacuuag

SEQ ID NO: 223563 - RNA, 32 nt, Human
uaguacagaggggguuucaccauguuugucag

SEQ ID NO: 223564 - RNA, 32 nt, Human
uaguacagaugggguuucaccauguuggccag

SEQ ID NO: 223565 - RNA, 32 nt, Human
uaguacagaugggguuucaccauguuggucag

SEQ ID NO: 223566 - RNA, 32 nt, Human
uaguacagugccugguauauaguaggugcuca

SEQ ID NO: 223567 - RNA, 32 nt, Human
uaguacaguggugccaucucagcucacugcaa

SEQ ID NO: 223568 - RNA, 32 nt, Human
uaguacauuaacauccccuuuucauuacccca

SEQ ID NO: 223569 - RNA, 32 nt, Human
uaguaccacugcacuccagccugggcaacaga

SEQ ID NO: 223570 - RNA, 32 nt, Human
uaguaccacugcacuccagccugggcgacaga

SEQ ID NO: 223571 - RNA, 32 nt, Human
uaguaccagcuacucgagaggcugagucagga

SEQ ID NO: 223572 - RNA, 32 nt, Human
uaguaccagcuacucuggaggcugaggcagga

SEQ ID NO: 223573 - RNA, 32 nt, Human
uaguaccagcuauuuuaaaggcuaaggcagga

SEQ ID NO: 223574 - RNA, 32 nt, Human
uaguacccuguacucuaguccccagcccccag

SEQ ID NO: 223575 - RNA, 32 nt, Human
uaguaccucaggugguacaggagaaggugaga

SEQ ID NO: 223576 - RNA, 32 nt, Human
uaguaccugcagcugcuucuccacaccccugc

SEQ ID NO: 223577 - RNA, 32 nt, Human
uaguaccugcugcacagguuauuaaugaguaa

SEQ ID NO: 223578 - RNA, 32 nt, Human
uaguaccuggcagcuucucccuuagccuggaa

SEQ ID NO: 223579 - RNA, 32 nt, Human
uaguaccuuccagaugggcaaaaguguacacu

SEQ ID NO: 223580 - RNA, 32 nt, Human
uaguacuacuggguaaccagagccaagcguga

SEQ ID NO: 223581 - RNA, 32 nt, Human
uaguacuaggugaauaggaaaauaaaucaugc

SEQ ID NO: 223582 - RNA, 32 nt, Human
uaguacuauuauggaauuacucuacuguucuu

SEQ ID NO: 223583 - RNA, 32 nt, Human
uaguacuccacuuccggacuccuggacugcau

SEQ ID NO: 223584 - RNA, 32 nt, Human
uaguacugaagccaaaugaaacucaaaaccau

SEQ ID NO: 223585 - RNA, 31 nt, Human
uaguacugccucuguggacuuagguuccagu

SEQ ID NO: 223586 - RNA, 32 nt, Human
uaguacugcucauugacaaugcaccuggccau

SEQ ID NO: 223587 - RNA, 32 nt, Human
uaguacuguggugaggagcacuggggaaagcc

SEQ ID NO: 223588 - RNA, 32 nt, Human
uaguacuguguugucaggcucuucccaggccu

SEQ ID NO: 223589 - RNA, 32 nt, Human
uaguacuugggccggugaguccagccucagga

SEQ ID NO: 223590 - RNA, 32 nt, Human
uaguacuuugggaggccgagacaggcagauug

SEQ ID NO: 223591 - RNA, 32 nt, Human
uaguacuuuuaugacuguaaauacucuggcuu

SEQ ID NO: 223592 - RNA, 32 nt, Human
uaguagaaacaggcuuucaccauguuggccag

SEQ ID NO: 223593 - RNA, 32 nt, Human
uaguagaaacaggguuucaccaugcuggccau

SEQ ID NO: 223594 - RNA, 32 nt, Human
uaguagaaacaggguuucaccauguuagccag

SEQ ID NO: 223595 - RNA, 32 nt, Human
uaguagaaacaggguuucacuguguuggccca

SEQ ID NO: 223596 - RNA, 32 nt, Human
uaguagaaacccgugggacauacacaugggcc

SEQ ID NO: 223597 - RNA, 32 nt, Human
uaguagaaacgggacuucaccauguugcccag

SEQ ID NO: 223598 - RNA, 32 nt, Human
uaguagaaacgggguuucaccauauuggucag

SEQ ID NO: 223599 - RNA, 32 nt, Human
uaguagaaacgggguuucaccauguugcucag

SEQ ID NO: 223600 - RNA, 32 nt, Human
uaguagaaacgggguuucaccauguuggccag

SEQ ID NO: 223601 - RNA, 32 nt, Human
uaguagaaacgggguuucaccauguuggccgg

SEQ ID NO: 223602 - RNA, 32 nt, Human
uaguagaaacgggguuuugccauguuggccag

SEQ ID NO: 223603 - RNA, 32 nt, Human
uaguagaaaugaggucucgccauguugcucag

SEQ ID NO: 223604 - RNA, 32 nt, Human
uaguagaaauggggauucaccauguuggucag

SEQ ID NO: 223605 - RNA, 32 nt, Human
uaguagaaaugggguuucaccauguuagccag

SEQ ID NO: 223606 - RNA, 32 nt, Human
uaguagaaaugggguuucaccauguuggccag

SEQ ID NO: 223607 - RNA, 32 nt, Human
uaguagaaaugggguuucacuguguuagccag

SEQ ID NO: 223608 - RNA, 32 nt, Human
uaguagaaaugggguuucgccacguuggccag

SEQ ID NO: 223609 - RNA, 32 nt, Human
uaguagaaaugggguuucgucauguuggccag

SEQ ID NO: 223610 - RNA, 32 nt, Human
uaguagaaaugggguuuuaccauguuguccag

SEQ ID NO: 223611 - RNA, 32 nt, Human
uaguagaaaugggguuuuaccguguuggccag

SEQ ID NO: 223612 - RNA, 32 nt, Human
uaguagaaaugggguuuugccauguuggccag

SEQ ID NO: 223613 - RNA, 32 nt, Human
uaguagaaguuaaggaugagaaaacaagcagu

SEQ ID NO: 223614 - RNA, 32 nt, Human
uaguagacaaagauguuauuucccagugcaaa

SEQ ID NO: 223615 - RNA, 32 nt, Human
uaguagacacaggguuucaccauauuggccag

SEQ ID NO: 223616 - RNA, 32 nt, Human
uaguagacacaggguuucuccauguuggucag

SEQ ID NO: 223617 - RNA, 32 nt, Human
uaguagacacggguuuucaccauguuggucag

SEQ ID NO: 223618 - RNA, 32 nt, Human
uaguagacaugagguuuugccauguuguccgg

SEQ ID NO: 223619 - RNA, 32 nt, Human
uaguagacaugggguuucaccacauuggccag

SEQ ID NO: 223620 - RNA, 32 nt, Human
uaguagacaugggguuucaccauguugcccag

SEQ ID NO: 223621 - RNA, 32 nt, Human
uaguagacgugggguuucaccauguuggccag

SEQ ID NO: 223622 - RNA, 32 nt, Human
uaguagacuaauccuucucugcuuguucuuca

SEQ ID NO: 223623 - RNA, 32 nt, Human
uaguagagaaaggguuucaccauguugguuag

SEQ ID NO: 223624 - RNA, 32 nt, Human
uaguagagaagagguuucaccauguuggccag

SEQ ID NO: 223625 - RNA, 32 nt, Human
uaguagagaagggauuucaccauguuggccgg

SEQ ID NO: 223626 - RNA, 32 nt, Human
uaguagagaagggguuucaccacauuggccgg

SEQ ID NO: 223627 - RNA, 32 nt, Human
uaguagagacaagauuucaccauguuggccag

SEQ ID NO: 223628 - RNA, 32 nt, Human
uaguagagacaagguuucaccauauuggccag

SEQ ID NO: 223629 - RNA, 32 nt, Human
uaguagagacaagguuucaccauguugaccag

SEQ ID NO: 223630 - RNA, 32 nt, Human
uaguagagacaagguuucaccauguuggucag

SEQ ID NO: 223631 - RNA, 32 nt, Human
uaguagagacaagguuucaccauguuguccag

SEQ ID NO: 223632 - RNA, 32 nt, Human
uaguagagacaagguuucacccuguuggcaag

SEQ ID NO: 223633 - RNA, 32 nt, Human
uaguagagacaagguuucaccggguuggccag

SEQ ID NO: 223634 - RNA, 32 nt, Human
uaguagagacaagguuucgccauguuggccag

SEQ ID NO: 223635 - RNA, 32 nt, Human
uaguagagacaagguuuugccauguugaccag

SEQ ID NO: 223636 - RNA, 32 nt, Human
uaguagagacacaguuuugccauguuggccag

SEQ ID NO: 223637 - RNA, 32 nt, Human
uaguagagacacuguuucgccauguuggcuag

SEQ ID NO: 223638 - RNA, 32 nt, Human
uaguagagacagaguuucaccauguuggccag

SEQ ID NO: 223639 - RNA, 32 nt, Human
uaguagagacagaguuucgccauguuggccag

SEQ ID NO: 223640 - RNA, 32 nt, Human
uaguagagacagaguuuuaccauguuggccag

SEQ ID NO: 223641 - RNA, 32 nt, Human
uaguagagacagaguuuugccauguuggccag

SEQ ID NO: 223642 - RNA, 32 nt, Human
uaguagagacaggaucucccuauguuguccag

SEQ ID NO: 223643 - RNA, 32 nt, Human
uaguagagacaggauuucaccauguuggccag

SEQ ID NO: 223644 - RNA, 32 nt, Human
uaguagagacaggauuucuccauguuggucag

SEQ ID NO: 223645 - RNA, 32 nt, Human
uaguagagacaggauuuuaccauguuggccau

SEQ ID NO: 223646 - RNA, 32 nt, Human
uaguagagacagggcuucaccauguuggcaag

SEQ ID NO: 223647 - RNA, 32 nt, Human
uaguagagacagggcuucaccauguuggcuag

SEQ ID NO: 223648 - RNA, 32 nt, Human
uaguagagacagggucucaccauguuggccag

SEQ ID NO: 223649 - RNA, 32 nt, Human
uaguagagacaggguuucaccacauuggccag

SEQ ID NO: 223650 - RNA, 32 nt, Human
uaguagagacaggguuucaccacguuggccag

SEQ ID NO: 223651 - RNA, 32 nt, Human
uaguagagacaggguuucaccauauuggccag

SEQ ID NO: 223652 - RNA, 32 nt, Human
uaguagagacaggguuucaccauauuggucag

SEQ ID NO: 223653 - RNA, 32 nt, Human
uaguagagacaggguuucaccaugucaagcug

SEQ ID NO: 223654 - RNA, 32 nt, Human
uaguagagacaggguuucaccaugucagccag

SEQ ID NO: 223655 - RNA, 32 nt, Human
uaguagagacaggguuucaccaugugagccag

SEQ ID NO: 223656 - RNA, 32 nt, Human
uaguagagacaggguuucaccauguuagccag

SEQ ID NO: 223657 - RNA, 32 nt, Human
uaguagagacaggguuucaccauguuagccgg

SEQ ID NO: 223658 - RNA, 32 nt, Human
uaguagagacaggguuucaccauguuagucag

SEQ ID NO: 223659 - RNA, 32 nt, Human
uaguagagacaggguuucaccauguugaccug

SEQ ID NO: 223660 - RNA, 32 nt, Human
uaguagagacaggguuucaccauguugcccag

SEQ ID NO: 223661 - RNA, 32 nt, Human
uaguagagacaggguuucaccauguugccuag

SEQ ID NO: 223662 - RNA, 32 nt, Human
uaguagagacaggguuucaccauguuggacag

SEQ ID NO: 223663 - RNA, 32 nt, Human
uaguagagacaggguuucaccauguuggccag

SEQ ID NO: 223664 - RNA, 32 nt, Human
uaguagagacaggguuucaccauguuggccgg

SEQ ID NO: 223665 - RNA, 32 nt, Human
uaguagagacaggguuucaccauguuggucag

SEQ ID NO: 223666 - RNA, 32 nt, Human
uaguagagacaggguuucaccauguuggucau

SEQ ID NO: 223667 - RNA, 32 nt, Human
uaguagagacaggguuucaccauguuggucgg

SEQ ID NO: 223668 - RNA, 32 nt, Human
uaguagagacaggguuucaccauguugguuag

SEQ ID NO: 223669 - RNA, 32 nt, Human
uaguagagacaggguuucaccauguuguccag

SEQ ID NO: 223670 - RNA, 32 nt, Human
uaguagagacaggguuucaccauguuugccag

SEQ ID NO: 223671 - RNA, 32 nt, Human
uaguagagacaggguuucaccauuuuggccag

SEQ ID NO: 223672 - RNA, 32 nt, Human
uaguagagacaggguuucaccguguuaaccag

SEQ ID NO: 223673 - RNA, 32 nt, Human
uaguagagacaggguuucaccguguuagccag

SEQ ID NO: 223674 - RNA, 32 nt, Human
uaguagagacaggguuucaccguguuggcgag

SEQ ID NO: 223675 - RNA, 32 nt, Human
uaguagagacaggguuucaccguguuggucag

SEQ ID NO: 223676 - RNA, 32 nt, Human
uaguagagacaggguuucacuaugcuggucag

SEQ ID NO: 223677 - RNA, 32 nt, Human
uaguagagacaggguuucacuauguuggccag

SEQ ID NO: 223678 - RNA, 32 nt, Human
uaguagagacaggguuucacuguguuagccag

SEQ ID NO: 223679 - RNA, 32 nt, Human
uaguagagacaggguuucacuguguugcccag

SEQ ID NO: 223680 - RNA, 32 nt, Human
uaguagagacaggguuucaucauguuggccag

SEQ ID NO: 223681 - RNA, 32 nt, Human
uaguagagacaggguuucaucauuguuggcca

SEQ ID NO: 223682 - RNA, 32 nt, Human
uaguagagacaggguuucauuauguuggccag

SEQ ID NO: 223683 - RNA, 32 nt, Human
uaguagagacaggguuucgccauguuggccag

SEQ ID NO: 223684 - RNA, 32 nt, Human
uaguagagacaggguuucgccauguuggcuau

SEQ ID NO: 223685 - RNA, 32 nt, Human
uaguagagacaggguuucuccauguuggucag

SEQ ID NO: 223686 - RNA, 32 nt, Human
uaguagagacaggguuucuccauguuggucgg

SEQ ID NO: 223687 - RNA, 32 nt, Human
uaguagagacaggguuucuccauguugguuag

SEQ ID NO: 223688 - RNA, 32 nt, Human
uaguagagacaggguuuuaccauguuggccag

SEQ ID NO: 223689 - RNA, 32 nt, Human
uaguagagacaggguuuuaccauguuggucag

SEQ ID NO: 223690 - RNA, 32 nt, Human
uaguagagacaggguuuugccauguugcccag

SEQ ID NO: 223691 - RNA, 32 nt, Human
uaguagagacaggguuuugccauguuggccag

SEQ ID NO: 223692 - RNA, 32 nt, Human
uaguagagacagguuuucaccauguuggccag

SEQ ID NO: 223693 - RNA, 32 nt, Human
uaguagagacagguuuucaccauguuggcgag

SEQ ID NO: 223694 - RNA, 32 nt, Human
uaguagagacaguguuucaccauguugaccag

SEQ ID NO: 223695 - RNA, 32 nt, Human
uaguagagacaguguuucaccauguuggccag

SEQ ID NO: 223696 - RNA, 32 nt, Human
uaguagagacaguguuucgccauguuggccag

SEQ ID NO: 223697 - RNA, 32 nt, Human
uaguagagacaguguuuugccauguuggccag

SEQ ID NO: 223698 - RNA, 32 nt, Human
uaguagagacaugguuuugccauguuggccag

SEQ ID NO: 223699 - RNA, 32 nt, Human
uaguagagaccacguuucgccauguuguccag

SEQ ID NO: 223700 - RNA, 32 nt, Human
uaguagagaccaggcuucgccauguuggccag

SEQ ID NO: 223701 - RNA, 32 nt, Human
uaguagagaccagguuuauccauguuggucag

SEQ ID NO: 223702 - RNA, 32 nt, Human
uaguagagaccagguuucaccauguuggccag

SEQ ID NO: 223703 - RNA, 32 nt, Human
uaguagagaccgaguuucgccauguuggccag

SEQ ID NO: 223704 - RNA, 32 nt, Human
uaguagagaccgggcuucaccauguuggccag

SEQ ID NO: 223705 - RNA, 32 nt, Human
uaguagagaccggguuucaccauguuggccag

SEQ ID NO: 223706 - RNA, 32 nt, Human
uaguagagacgaggcuucaccauguuggccag

SEQ ID NO: 223707 - RNA, 32 nt, Human
uaguagagacgagguuucaccaucuuggccag

SEQ ID NO: 223708 - RNA, 32 nt, Human
uaguagagacgagguuucaccaugcuggccaa

SEQ ID NO: 223709 - RNA, 32 nt, Human
uaguagagacgagguuucaccauguugaccag

SEQ ID NO: 223710 - RNA, 32 nt, Human
uaguagagacgagguuucaccauguuggccag

SEQ ID NO: 223711 - RNA, 32 nt, Human
uaguagagacgagguuucacuguguuggccag

SEQ ID NO: 223712 - RNA, 32 nt, Human
uaguagagacgaguuuucaccauguugaccag

SEQ ID NO: 223713 - RNA, 32 nt, Human
uaguagagacgcaguuucaccguguugaccag

SEQ ID NO: 223714 - RNA, 32 nt, Human
uaguagagacggaguugcaccauguuggccag

SEQ ID NO: 223715 - RNA, 32 nt, Human
uaguagagacggaguuucaccauauuggcugg

SEQ ID NO: 223716 - RNA, 32 nt, Human
uaguagagacggaguuucaccauguuagccag

SEQ ID NO: 223717 - RNA, 32 nt, Human
uaguagagacggaguuucaccauguuggccac

SEQ ID NO: 223718 - RNA, 32 nt, Human
uaguagagacggaguuucaccauguuggccag

SEQ ID NO: 223719 - RNA, 32 nt, Human
uaguagagacggaguuucaccauguugguuag

SEQ ID NO: 223720 - RNA, 32 nt, Human
uaguagagacggaguuucaccguguuagccag

SEQ ID NO: 223721 - RNA, 32 nt, Human
uaguagagacggaguuucuccauguuggccag

SEQ ID NO: 223722 - RNA, 32 nt, Human
uaguagagacggaguuuugccauguuggccaa

SEQ ID NO: 223723 - RNA, 32 nt, Human
uaguagagacggcauuucaccaugucagccag

SEQ ID NO: 223724 - RNA, 32 nt, Human
uaguagagacggcauuucaccauguuggccag

SEQ ID NO: 223725 - RNA, 32 nt, Human
uaguagagacggcguuucaccauguuggccag

SEQ ID NO: 223726 - RNA, 32 nt, Human
uaguagagacggcguuucaccauuuuggccgg

SEQ ID NO: 223727 - RNA, 32 nt, Human
uaguagagacggcguuucaccguguuggccag

SEQ ID NO: 223728 - RNA, 32 nt, Human
uaguagagacgggauuucaccauguuggccag

SEQ ID NO: 223729 - RNA, 32 nt, Human
uaguagagacgggauuucaccauguuggucag

SEQ ID NO: 223730 - RNA, 32 nt, Human
uaguagagacgggauuucuccauguugaucag

SEQ ID NO: 223731 - RNA, 32 nt, Human
uaguagagacgggcuuucaccauguuagccag

SEQ ID NO: 223732 - RNA, 32 nt, Human
uaguagagacggggauucaccauguuggccag

SEQ ID NO: 223733 - RNA, 32 nt, Human
uaguagagacggggcuucaccaucuuggccag

SEQ ID NO: 223734 - RNA, 32 nt, Human
uaguagagacggggcuucuccauguuggucag

SEQ ID NO: 223735 - RNA, 32 nt, Human
uaguagagacggggcuuugccauguuggccag

SEQ ID NO: 223736 - RNA, 32 nt, Human
uaguagagacggggguuugccauguugcccag

SEQ ID NO: 223737 - RNA, 32 nt, Human
uaguagagacgggguuuaaccauguuggccag

SEQ ID NO: 223738 - RNA, 32 nt, Human
uaguagagacgggguuucaacauauuggccag

SEQ ID NO: 223739 - RNA, 32 nt, Human
uaguagagacgggguuucaccacauugcucag

SEQ ID NO: 223740 - RNA, 32 nt, Human
uaguagagacgggguuucaccacauuggccag

SEQ ID NO: 223741 - RNA, 32 nt, Human
uaguagagacgggguuucaccacauuggucag

SEQ ID NO: 223742 - RNA, 32 nt, Human
uaguagagacgggguuucaccacguuggccag

SEQ ID NO: 223743 - RNA, 32 nt, Human
uaguagagacgggguuucaccacguuggccgg

SEQ ID NO: 223744 - RNA, 32 nt, Human
uaguagagacgggguuucaccagguuagccag

SEQ ID NO: 223745 - RNA, 32 nt, Human
uaguagagacgggguuucaccauacuggccag

SEQ ID NO: 223746 - RNA, 32 nt, Human
uaguagagacgggguuucaccauauuggccaa

SEQ ID NO: 223747 - RNA, 32 nt, Human
uaguagagacgggguuucaccauauuggccag

SEQ ID NO: 223748 - RNA, 32 nt, Human
uaguagagacgggguuucaccaucuuggccag

SEQ ID NO: 223749 - RNA, 32 nt, Human
uaguagagacgggguuucaccaugcuggccag

SEQ ID NO: 223750 - RNA, 32 nt, Human
uaguagagacgggguuucaccaugucggccag

SEQ ID NO: 223751 - RNA, 32 nt, Human
uaguagagacgggguuucaccauguuaccuag

SEQ ID NO: 223752 - RNA, 32 nt, Human
uaguagagacgggguuucaccauguuagacag

SEQ ID NO: 223753 - RNA, 32 nt, Human
uaguagagacgggguuucaccauguuagccag

SEQ ID NO: 223754 - RNA, 32 nt, Human
uaguagagacgggguuucaccauguuagcuag

SEQ ID NO: 223755 - RNA, 32 nt, Human
uaguagagacgggguuucaccauguugaccag

SEQ ID NO: 223756 - RNA, 32 nt, Human
uaguagagacgggguuucaccauguugcccag

SEQ ID NO: 223757 - RNA, 32 nt, Human
uaguagagacgggguuucaccauguugcucag

SEQ ID NO: 223758 - RNA, 32 nt, Human
uaguagagacgggguuucaccauguuggccaa

SEQ ID NO: 223759 - RNA, 32 nt, Human
uaguagagacgggguuucaccauguuggccag

SEQ ID NO: 223760 - RNA, 32 nt, Human
uaguagagacgggguuucaccauguuggccgg

SEQ ID NO: 223761 - RNA, 32 nt, Human
uaguagagacgggguuucaccauguuggcuag

SEQ ID NO: 223762 - RNA, 32 nt, Human
uaguagagacgggguuucaccauguugggcag

SEQ ID NO: 223763 - RNA, 32 nt, Human
uaguagagacgggguuucaccauguuggucag

SEQ ID NO: 223764 - RNA, 32 nt, Human
uaguagagacgggguuucaccauguugucagg

SEQ ID NO: 223765 - RNA, 32 nt, Human
uaguagagacgggguuucaccauuuugaccag

SEQ ID NO: 223766 - RNA, 32 nt, Human
uaguagagacgggguuucaccauuuuggccag

SEQ ID NO: 223767 - RNA, 32 nt, Human
uaguagagacgggguuucaccguguuaaccag

SEQ ID NO: 223768 - RNA, 32 nt, Human
uaguagagacgggguuucaccguguuagccag

SEQ ID NO: 223769 - RNA, 32 nt, Human
uaguagagacgggguuucaccguguuagccgg

SEQ ID NO: 223770 - RNA, 32 nt, Human
uaguagagacgggguuucaccguguuagucag

SEQ ID NO: 223771 - RNA, 32 nt, Human
uaguagagacgggguuucaccguguugaccag

SEQ ID NO: 223772 - RNA, 32 nt, Human
uaguagagacgggguuucaccguguugcccag

SEQ ID NO: 223773 - RNA, 32 nt, Human
uaguagagacgggguuucaccguguuggccag

SEQ ID NO: 223774 - RNA, 32 nt, Human
uaguagagacgggguuucaccguguuggccgg

SEQ ID NO: 223775 - RNA, 32 nt, Human
uaguagagacgggguuucaccguguuggcuag

SEQ ID NO: 223776 - RNA, 32 nt, Human
uaguagagacgggguuucaccguguuguccag

SEQ ID NO: 223777 - RNA, 32 nt, Human
uaguagagacgggguuucaccuuguuagccag

SEQ ID NO: 223778 - RNA, 32 nt, Human
uaguagagacgggguuucaccuuguuggccag

SEQ ID NO: 223779 - RNA, 32 nt, Human
uaguagagacgggguuucacuauauuggccag

SEQ ID NO: 223780 - RNA, 32 nt, Human
uaguagagacgggguuucacuaugcuggccag

SEQ ID NO: 223781 - RNA, 32 nt, Human
uaguagagacgggguuucacuauguuggccag

SEQ ID NO: 223782 - RNA, 32 nt, Human
uaguagagacgggguuucacuguguuagccag

SEQ ID NO: 223783 - RNA, 32 nt, Human
uaguagagacgggguuucacuguguuggccag

SEQ ID NO: 223784 - RNA, 32 nt, Human
uaguagagacgggguuucagcauguuggcuag

SEQ ID NO: 223785 - RNA, 32 nt, Human
uaguagagacgggguuucaucauauuggucag

SEQ ID NO: 223786 - RNA, 32 nt, Human
uaguagagacgggguuucaucauguuggccag

SEQ ID NO: 223787 - RNA, 32 nt, Human
uaguagagacgggguuucaucguguuaaccag

SEQ ID NO: 223788 - RNA, 32 nt, Human
uaguagagacgggguuucaucguguuagccag

SEQ ID NO: 223789 - RNA, 32 nt, Human
uaguagagacgggguuuccccauguuggucag

SEQ ID NO: 223790 - RNA, 32 nt, Human
uaguagagacgggguuuccccguguuagccag

SEQ ID NO: 223791 - RNA, 32 nt, Human
uaguagagacgggguuucgccauguugcccag

SEQ ID NO: 223792 - RNA, 32 nt, Human
uaguagagacgggguuucgccauguuggucag

SEQ ID NO: 223793 - RNA, 32 nt, Human
uaguagagacgggguuucgccauguuguccgg

SEQ ID NO: 223794 - RNA, 32 nt, Human
uaguagagacgggguuucgccauuuuggccag

SEQ ID NO: 223795 - RNA, 32 nt, Human
uaguagagacgggguuucgccguguuggccag

SEQ ID NO: 223796 - RNA, 32 nt, Human
uaguagagacgggguuucgcuauuuuggccgg

SEQ ID NO: 223797 - RNA, 32 nt, Human
uaguagagacgggguuucggcauguuggccag

SEQ ID NO: 223798 - RNA, 32 nt, Human
uaguagagacgggguuucuccacauuggucag

SEQ ID NO: 223799 - RNA, 32 nt, Human
uaguagagacgggguuucuccauguuagucag

SEQ ID NO: 223800 - RNA, 32 nt, Human
uaguagagacgggguuucuccauguuggucag

SEQ ID NO: 223801 - RNA, 32 nt, Human
uaguagagacgggguuucuccauguuggucug

SEQ ID NO: 223802 - RNA, 32 nt, Human
uaguagagacgggguuucuccauguugguuag

SEQ ID NO: 223803 - RNA, 32 nt, Human
uaguagagacgggguuucuccguguuggucag

SEQ ID NO: 223804 - RNA, 32 nt, Human
uaguagagacgggguuucuccuuguuggucag

SEQ ID NO: 223805 - RNA, 32 nt, Human
uaguagagacgggguuugaccauguuggucag

SEQ ID NO: 223806 - RNA, 32 nt, Human
uaguagagacgggguuuugccauguugcccgg

SEQ ID NO: 223807 - RNA, 32 nt, Human
uaguagagacgggguuuugccauguuggccag

SEQ ID NO: 223808 - RNA, 32 nt, Human
uaguagagacgggguuuugccauguuggccau

SEQ ID NO: 223809 - RNA, 32 nt, Human
uaguagagacggguuuucaccauguugccccg

SEQ ID NO: 223810 - RNA, 32 nt, Human
uaguagagacgguguuucaccauauuggccag

SEQ ID NO: 223811 - RNA, 32 nt, Human
uaguagagacgguguuucaccauguuggucag

SEQ ID NO: 223812 - RNA, 32 nt, Human
uaguagagacgugguuucaccauguuggccag

SEQ ID NO: 223813 - RNA, 32 nt, Human
uaguagagacucgguuucaccauguuggucag

SEQ ID NO: 223814 - RNA, 32 nt, Human
uaguagagacuggguuucaccacguuggccag

SEQ ID NO: 223815 - RNA, 32 nt, Human
uaguagagacuggguuucaccauguuggccag

SEQ ID NO: 223816 - RNA, 32 nt, Human
uaguagagacuggguuucaccguguuagcuag

SEQ ID NO: 223817 - RNA, 32 nt, Human
uaguagagagaauggcuucaguuauaccugcc

SEQ ID NO: 223818 - RNA, 32 nt, Human
uaguagagagggaguuucaccauguuggccag

SEQ ID NO: 223819 - RNA, 32 nt, Human
uaguagagagggaguuucaccauguuggucag

SEQ ID NO: 223820 - RNA, 32 nt, Human
uaguagagagggaguuucgccauguuggccag

SEQ ID NO: 223821 - RNA, 32 nt, Human
uaguagagagggcguuuugccauguuggcuag

SEQ ID NO: 223822 - RNA, 32 nt, Human
uaguagagaggggguuucaccacguuggccag

SEQ ID NO: 223823 - RNA, 32 nt, Human
uaguagagaggggguuucaccguguuagccag

SEQ ID NO: 223824 - RNA, 32 nt, Human
uaguagagaggggguuucaucauguuaccuag

SEQ ID NO: 223825 - RNA, 32 nt, Human
uaguagagaguggguuucacuauguuggccag

SEQ ID NO: 223826 - RNA, 32 nt, Human
uaguagagauagggauucaccauguuggccag

SEQ ID NO: 223827 - RNA, 32 nt, Human
uaguagagauagggucucaccauguuggccag

SEQ ID NO: 223828 - RNA, 32 nt, Human
uaguagagauaggguuucaccaugucucccag

SEQ ID NO: 223829 - RNA, 32 nt, Human
uaguagagauaggguuucaccauguugcccag

SEQ ID NO: 223830 - RNA, 32 nt, Human
uaguagagauaggguuucaccauguuggccag

SEQ ID NO: 223831 - RNA, 32 nt, Human
uaguagagaugaaguuucaccguguuggccag

SEQ ID NO: 223832 - RNA, 32 nt, Human
uaguagagaugagguuucaccauguuggccag

SEQ ID NO: 223833 - RNA, 32 nt, Human
uaguagagaugagguuucaccauuuuggccag

SEQ ID NO: 223834 - RNA, 32 nt, Human
uaguagagaugagguuucaccguguuggccag

SEQ ID NO: 223835 - RNA, 32 nt, Human
uaguagagaugagguuucaccuuguuggucag

SEQ ID NO: 223836 - RNA, 32 nt, Human
uaguagagaugagguuucacuguguuggccag

SEQ ID NO: 223837 - RNA, 32 nt, Human
uaguagagaugagguuucgccauguuggccag

SEQ ID NO: 223838 - RNA, 32 nt, Human
uaguagagauggaauuucaccauguuagccag

SEQ ID NO: 223839 - RNA, 32 nt, Human
uaguagagauggaguuucaccauguuacccag

SEQ ID NO: 223840 - RNA, 32 nt, Human
uaguagagauggaguuucaccauguugcccag

SEQ ID NO: 223841 - RNA, 32 nt, Human
uaguagagauggaguuucaccauguuggccag

SEQ ID NO: 223842 - RNA, 32 nt, Human
uaguagagauggcguuucaccauguuggccag

SEQ ID NO: 223843 - RNA, 32 nt, Human
uaguagagaugggaucuuucuauguugccuag

SEQ ID NO: 223844 - RNA, 32 nt, Human
uaguagagaugggauuucaccauguugcccag

SEQ ID NO: 223845 - RNA, 32 nt, Human
uaguagagaugggauuucaccauguuggccag

SEQ ID NO: 223846 - RNA, 32 nt, Human
uaguagagaugggauuucaccauguuggcuag

SEQ ID NO: 223847 - RNA, 32 nt, Human
uaguagagaugggauuucgccauguuggccag

SEQ ID NO: 223848 - RNA, 32 nt, Human
uaguagagaugggauuuucccuuguuggucag

SEQ ID NO: 223849 - RNA, 32 nt, Human
uaguagagaugggcuuucacuacguuagccag

SEQ ID NO: 223850 - RNA, 32 nt, Human
uaguagagauggggacuucaccguguuggcca

SEQ ID NO: 223851 - RNA, 32 nt, Human
uaguagagauggggcuucaccaucuugaccag

SEQ ID NO: 223852 - RNA, 32 nt, Human
uaguagagauggggcuucaccauguuggccag

SEQ ID NO: 223853 - RNA, 32 nt, Human
uaguagagauggggguuucaccauauuggcca

SEQ ID NO: 223854 - RNA, 32 nt, Human
uaguagagauggggguuucaccauauugguca

SEQ ID NO: 223855 - RNA, 32 nt, Human
uaguagagauggggguuucuccuuguugguca

SEQ ID NO: 223856 - RNA, 32 nt, Human
uaguagagauggggguuuuccauauugcccag

SEQ ID NO: 223857 - RNA, 32 nt, Human
uaguagagauggggucucaccauguuggccag

SEQ ID NO: 223858 - RNA, 32 nt, Human
uaguagagauggggucucacuauguugcccag

SEQ ID NO: 223859 - RNA, 32 nt, Human
uaguagagauggggucucacuguguuagccag

SEQ ID NO: 223860 - RNA, 32 nt, Human
uaguagagauggggucucuccauguuggucag

SEQ ID NO: 223861 - RNA, 32 nt, Human
uaguagagaugggguuccaccauguuggccag

SEQ ID NO: 223862 - RNA, 32 nt, Human
uaguagagaugggguuuauccauguuggucag

SEQ ID NO: 223863 - RNA, 32 nt, Human
uaguagagaugggguuucaacauauuggccag

SEQ ID NO: 223864 - RNA, 32 nt, Human
uaguagagaugggguuucaccaaguuagccag

SEQ ID NO: 223865 - RNA, 32 nt, Human
uaguagagaugggguuucaccacauuggccag

SEQ ID NO: 223866 - RNA, 32 nt, Human
uaguagagaugggguuucaccacguuagccag

SEQ ID NO: 223867 - RNA, 32 nt, Human
uaguagagaugggguuucaccacguugcccag

SEQ ID NO: 223868 - RNA, 32 nt, Human
uaguagagaugggguuucaccacguuggccac

SEQ ID NO: 223869 - RNA, 32 nt, Human
uaguagagaugggguuucaccacguuggccag

SEQ ID NO: 223870 - RNA, 32 nt, Human
uaguagagaugggguuucaccauacuggcuag

SEQ ID NO: 223871 - RNA, 32 nt, Human
uaguagagaugggguuucaccauauuggccaa

SEQ ID NO: 223872 - RNA, 32 nt, Human
uaguagagaugggguuucaccauauuggccag

SEQ ID NO: 223873 - RNA, 32 nt, Human
uaguagagaugggguuucaccauauuggucac

SEQ ID NO: 223874 - RNA, 32 nt, Human
uaguagagaugggguuucaccauauuggucag

SEQ ID NO: 223875 - RNA, 32 nt, Human
uaguagagaugggguuucaccauauuggugag

SEQ ID NO: 223876 - RNA, 32 nt, Human
uaguagagaugggguuucaccaucuuggccag

SEQ ID NO: 223877 - RNA, 32 nt, Human
uaguagagaugggguuucaccaugcuggccaa

SEQ ID NO: 223878 - RNA, 32 nt, Human
uaguagagaugggguuucaccaugcuggccag

SEQ ID NO: 223879 - RNA, 32 nt, Human
uaguagagaugggguuucaccauggccaggcu

SEQ ID NO: 223880 - RNA, 32 nt, Human
uaguagagaugggguuucaccauggcuaggcu

SEQ ID NO: 223881 - RNA, 32 nt, Human
uaguagagaugggguuucaccauguaggccag

SEQ ID NO: 223882 - RNA, 32 nt, Human
uaguagagaugggguuucaccaugucucaaac

SEQ ID NO: 223883 - RNA, 32 nt, Human
uaguagagaugggguuucaccaugugggccgg

SEQ ID NO: 223884 - RNA, 32 nt, Human
uaguagagaugggguuucaccauguuaaccag

SEQ ID NO: 223885 - RNA, 32 nt, Human
uaguagagaugggguuucaccauguuagccag

SEQ ID NO: 223886 - RNA, 32 nt, Human
uaguagagaugggguuucaccauguuagucag

SEQ ID NO: 223887 - RNA, 32 nt, Human
uaguagagaugggguuucaccauguugaccag

SEQ ID NO: 223888 - RNA, 32 nt, Human
uaguagagaugggguuucaccauguugaucag

SEQ ID NO: 223889 - RNA, 32 nt, Human
uaguagagaugggguuucaccauguugccugg

SEQ ID NO: 223890 - RNA, 32 nt, Human
uaguagagaugggguuucaccauguuggcaag

SEQ ID NO: 223891 - RNA, 32 nt, Human
uaguagagaugggguuucaccauguuggccag

SEQ ID NO: 223892 - RNA, 32 nt, Human
uaguagagaugggguuucaccauguuggcuag

SEQ ID NO: 223893 - RNA, 32 nt, Human
uaguagagaugggguuucaccauguuggcugg

SEQ ID NO: 223894 - RNA, 32 nt, Human
uaguagagaugggguuucaccauguuggucag

SEQ ID NO: 223895 - RNA, 32 nt, Human
uaguagagaugggguuucaccauguuguccag

SEQ ID NO: 223896 - RNA, 32 nt, Human
uaguagagaugggguuucaccauguugucuag

SEQ ID NO: 223897 - RNA, 32 nt, Human
uaguagagaugggguuucaccauguuugccag

SEQ ID NO: 223898 - RNA, 32 nt, Human
uaguagagaugggguuucaccauuuuggccau

SEQ ID NO: 223899 - RNA, 32 nt, Human
uaguagagaugggguuucacccuauuggucag

SEQ ID NO: 223900 - RNA, 32 nt, Human
uaguagagaugggguuucacccuguuagccag

SEQ ID NO: 223901 - RNA, 32 nt, Human
uaguagagaugggguuucaccggguuagccag

SEQ ID NO: 223902 - RNA, 32 nt, Human
uaguagagaugggguuucaccgugcuggccag

SEQ ID NO: 223903 - RNA, 32 nt, Human
uaguagagaugggguuucaccguguuagccag

SEQ ID NO: 223904 - RNA, 32 nt, Human
uaguagagaugggguuucaccguguuaggcag

SEQ ID NO: 223905 - RNA, 32 nt, Human
uaguagagaugggguuucaccguguuagucag

SEQ ID NO: 223906 - RNA, 32 nt, Human
uaguagagaugggguuucaccguguuggccag

SEQ ID NO: 223907 - RNA, 32 nt, Human
uaguagagaugggguuucaccuuguuggccag

SEQ ID NO: 223908 - RNA, 32 nt, Human
uaguagagaugggguuucaccuuguugggugg

SEQ ID NO: 223909 - RNA, 32 nt, Human
uaguagagaugggguuucaccuuguuggucaa

SEQ ID NO: 223910 - RNA, 32 nt, Human
uaguagagaugggguuucacgauguuggccag

SEQ ID NO: 223911 - RNA, 32 nt, Human
uaguagagaugggguuucacguuguuagccag

SEQ ID NO: 223912 - RNA, 32 nt, Human
uaguagagaugggguuucacuauguuggccag

SEQ ID NO: 223913 - RNA, 32 nt, Human
uaguagagaugggguuucacuauguuggucag

SEQ ID NO: 223914 - RNA, 32 nt, Human
uaguagagaugggguuucacuguguaggccag

SEQ ID NO: 223915 - RNA, 32 nt, Human
uaguagagaugggguuucacuguguuagccgg

SEQ ID NO: 223916 - RNA, 32 nt, Human
uaguagagaugggguuucacuguguuggccag

SEQ ID NO: 223917 - RNA, 32 nt, Human
uaguagagaugggguuucaucacguugaccag

SEQ ID NO: 223918 - RNA, 32 nt, Human
uaguagagaugggguuucaucauauuggucag

SEQ ID NO: 223919 - RNA, 32 nt, Human
uaguagagaugggguuucaucauguugcccag

SEQ ID NO: 223920 - RNA, 32 nt, Human
uaguagagaugggguuucaucauguuggccag

SEQ ID NO: 223921 - RNA, 32 nt, Human
uaguagagaugggguuucaucauguuugccag

SEQ ID NO: 223922 - RNA, 32 nt, Human
uaguagagaugggguuucaucguguuagccag

SEQ ID NO: 223923 - RNA, 32 nt, Human
uaguagagaugggguuucauuauguuggccag

SEQ ID NO: 223924 - RNA, 32 nt, Human
uaguagagaugggguuuccccauguuggccag

SEQ ID NO: 223925 - RNA, 32 nt, Human
uaguagagaugggguuucgccagguuggccag

SEQ ID NO: 223926 - RNA, 32 nt, Human
uaguagagaugggguuucgccauguuggccaa

SEQ ID NO: 223927 - RNA, 32 nt, Human
uaguagagaugggguuucgccauguuggccac

SEQ ID NO: 223928 - RNA, 32 nt, Human
uaguagagaugggguuucgccauguuggccag

SEQ ID NO: 223929 - RNA, 32 nt, Human
uaguagagaugggguuucgccauguuugucag

SEQ ID NO: 223930 - RNA, 32 nt, Human
uaguagagaugggguuucgcuauguuggccaa

SEQ ID NO: 223931 - RNA, 32 nt, Human
uaguagagaugggguuucgcuauguuggccag

SEQ ID NO: 223932 - RNA, 32 nt, Human
uaguagagaugggguuucucauauuggucagg

SEQ ID NO: 223933 - RNA, 32 nt, Human
uaguagagaugggguuucuccaugguggucag

SEQ ID NO: 223934 - RNA, 32 nt, Human
uaguagagaugggguuucuccaugucggucag

SEQ ID NO: 223935 - RNA, 32 nt, Human
uaguagagaugggguuucuccauguugaucag

SEQ ID NO: 223936 - RNA, 32 nt, Human
uaguagagaugggguuucuccauguuggccag

SEQ ID NO: 223937 - RNA, 32 nt, Human
uaguagagaugggguuucuccauguuggucag

SEQ ID NO: 223938 - RNA, 32 nt, Human
uaguagagaugggguuugaccauguuggccag

SEQ ID NO: 223939 - RNA, 32 nt, Human
uaguagagaugggguuugaccguguuagccag

SEQ ID NO: 223940 - RNA, 32 nt, Human
uaguagagaugggguuugccauguaggccagg

SEQ ID NO: 223941 - RNA, 32 nt, Human
uaguagagaugggguuuggccaugauggccag

SEQ ID NO: 223942 - RNA, 32 nt, Human
uaguagagaugggguuuuaccauauugcccag

SEQ ID NO: 223943 - RNA, 32 nt, Human
uaguagagaugggguuuuaccauguggccagg

SEQ ID NO: 223944 - RNA, 32 nt, Human
uaguagagaugggguuuuaccauguuaggaug

SEQ ID NO: 223945 - RNA, 32 nt, Human
uaguagagaugggguuuuaccauguuggccag

SEQ ID NO: 223946 - RNA, 32 nt, Human
uaguagagaugggguuuugccauauuggccag

SEQ ID NO: 223947 - RNA, 32 nt, Human
uaguagagaugggguuuugccauguugcccag

SEQ ID NO: 223948 - RNA, 32 nt, Human
uaguagagaugggguuuugccauguuggccag

SEQ ID NO: 223949 - RNA, 32 nt, Human
uaguagagaugggguuuugccauguuggucag

SEQ ID NO: 223950 - RNA, 32 nt, Human
uaguagagaugggguuuugccauguuugccgg

SEQ ID NO: 223951 - RNA, 32 nt, Human
uaguagagaugggguuuugccuuguuggccag

SEQ ID NO: 223952 - RNA, 32 nt, Human
uaguagagauggguuucaccauguuggccaug

SEQ ID NO: 223953 - RNA, 32 nt, Human
uaguagagauggguuucuccauguuggucggg

SEQ ID NO: 223954 - RNA, 32 nt, Human
uaguagagauggguuuucaccauauuggucag

SEQ ID NO: 223955 - RNA, 32 nt, Human
uaguagagauggguuuucaccaugguggccag

SEQ ID NO: 223956 - RNA, 32 nt, Human
uaguagagaugguguuucaccauguuggccag

SEQ ID NO: 223957 - RNA, 32 nt, Human
uaguagagaugugguuucuccauguuggccag

SEQ ID NO: 223958 - RNA, 32 nt, Human
uaguagagaugugguuuuaccauguuugccag

SEQ ID NO: 223959 - RNA, 32 nt, Human
uaguagagauuggguuucaccauguuggccag

SEQ ID NO: 223960 - RNA, 32 nt, Human
uaguagagccgggguuucaccaucuuggccag

SEQ ID NO: 223961 - RNA, 32 nt, Human
uaguagaggaugggguuucacuauguuggcca

SEQ ID NO: 223962 - RNA, 32 nt, Human
uaguagaggcaagguuucaccaucuuggucaa

SEQ ID NO: 223963 - RNA, 32 nt, Human
uaguagaggcagaguuucaccauguuggccag

SEQ ID NO: 223964 - RNA, 32 nt, Human
uaguagaggcaggguuuagccauguugaucag

SEQ ID NO: 223965 - RNA, 32 nt, Human
uaguagaggcaggguuucaccauguuagccag

SEQ ID NO: 223966 - RNA, 32 nt, Human
uaguagaggcaggguuucaccauguugaccag

SEQ ID NO: 223967 - RNA, 32 nt, Human
uaguagaggcaggguuucaccauguuggccag

SEQ ID NO: 223968 - RNA, 32 nt, Human
uaguagaggcaggguuucuccauguuggucag

SEQ ID NO: 223969 - RNA, 32 nt, Human
uaguagaggcgaaguuuccccauguuggccag

SEQ ID NO: 223970 - RNA, 32 nt, Human
uaguagaggcggaguuucaccauguuggccag

SEQ ID NO: 223971 - RNA, 32 nt, Human
uaguagaggcggaguuucgccauguuggucag

SEQ ID NO: 223972 - RNA, 32 nt, Human
uaguagaggcgggguuucaccaugcuggucag

SEQ ID NO: 223973 - RNA, 32 nt, Human
uaguagaggcgggguuucaccauguuagccag

SEQ ID NO: 223974 - RNA, 32 nt, Human
uaguagaggcgggguuucaccauguuggccag

SEQ ID NO: 223975 - RNA, 32 nt, Human
uaguagaggcgggguuucaccauguuggcuag

SEQ ID NO: 223976 - RNA, 32 nt, Human
uaguagaggcgggguuucaucauguuggccag

SEQ ID NO: 223977 - RNA, 32 nt, Human
uaguagaggugggguuucaccagguuggccag

SEQ ID NO: 223978 - RNA, 32 nt, Human
uaguagaggugggguuucaccaucuuggccag

SEQ ID NO: 223979 - RNA, 32 nt, Human
uaguagaggugggguuucaccaugcuggucag

SEQ ID NO: 223980 - RNA, 32 nt, Human
uaguagaggugggguuucaccguguuggucag

SEQ ID NO: 223981 - RNA, 32 nt, Human
uaguagaggugggguuucauguuucaccgugu

SEQ ID NO: 223982 - RNA, 32 nt, Human
uaguagagucgggguuucaccauguugcccag

SEQ ID NO: 223983 - RNA, 32 nt, Human
uaguagagugaggguuucaccauguuggccag

SEQ ID NO: 223984 - RNA, 32 nt, Human
uaguagaguuuuguuucuauuuuuauuuuuau

SEQ ID NO: 223985 - RNA, 32 nt, Human
uaguagauacaaguugaccuuucucuggcccc

SEQ ID NO: 223986 - RNA, 32 nt, Human
uaguagauacgggguuucaccaugcuggccag

SEQ ID NO: 223987 - RNA, 32 nt, Human
uaguagauauggaguuucaccacguuggccaa

SEQ ID NO: 223988 - RNA, 32 nt, Human
uaguagauaugggguuucaccguguuagccag

SEQ ID NO: 223989 - RNA, 32 nt, Human
uaguagaucuguggcgauaugagagggaugca

SEQ ID NO: 223990 - RNA, 32 nt, Human
uaguagaugagccacagccaggugcccaugua

SEQ ID NO: 223991 - RNA, 32 nt, Human
uaguagauucucucuuucucagccucuccccu

SEQ ID NO: 223992 - RNA, 32 nt, Human
uaguagauugcagccauguuguggaagcugcu

SEQ ID NO: 223993 - RNA, 32 nt, Human
uaguagcaaacaguaugcaguacuccuguguu

SEQ ID NO: 223994 - RNA, 32 nt, Human
uaguagcagcuacuccagaggcugaaauggga

SEQ ID NO: 223995 - RNA, 32 nt, Human
uaguagcauuucuuucucuccccauuauuuau

SEQ ID NO: 223996 - RNA, 32 nt, Human
uaguagccaugguguuucaccauguuggccag

SEQ ID NO: 223997 - RNA, 32 nt, Human
uaguagcgacaggguuguaccauguuggccau

SEQ ID NO: 223998 - RNA, 32 nt, Human
uaguagcuagagcucauggccuagcagaguga

SEQ ID NO: 223999 - RNA, 32 nt, Human
uaguagcucaacagagagggugccguggcuca

SEQ ID NO: 224000 - RNA, 21 nt, Human
uaguagcucaugccuguaauc

SEQ ID NO: 224001 - RNA, 32 nt, Human
uaguagcuuaagcaguuaugcauaucaggaua

SEQ ID NO: 224002 - RNA, 32 nt, Human
uaguaggaagugagcuguucagaggcaggagg

SEQ ID NO: 224003 - RNA, 32 nt, Human
uaguaggacccaagggaaaggaagggaagagu

SEQ ID NO: 224004 - RNA, 32 nt, Human
uaguaggagggcuucacaccagcacugcucac

SEQ ID NO: 224005 - RNA, 32 nt, Human
uaguaggauauauuucuccuagaacaucccuu

SEQ ID NO: 224006 - RNA, 32 nt, Human
uaguaggaucacugggacuccaagccucagca

SEQ ID NO: 224007 - RNA, 32 nt, Human
uaguaggcaagccugggcauuucugcauuugu

SEQ ID NO: 224008 - RNA, 32 nt, Human
uaguaggcagcaaaagaccaaaucucaguugu

SEQ ID NO: 224009 - RNA, 32 nt, Human
uaguagggacgggguuucaucauguuggccag

SEQ ID NO: 224010 - RNA, 32 nt, Human
uaguagggacuaaaccacacugaaaagaaucc

SEQ ID NO: 224011 - RNA, 32 nt, Human
uaguagggaugggguuucaccauguuagcuag

SEQ ID NO: 224012 - RNA, 32 nt, Human
uaguagggaugggguuucccauguuggccagg

SEQ ID NO: 224013 - RNA, 32 nt, Human
uaguagggaugggguuucuccauguuggucag

SEQ ID NO: 224014 - RNA, 32 nt, Human
uaguagggcuguagauggggucuuucgagguc

SEQ ID NO: 224015 - RNA, 32 nt, Human
uaguaggguacuucugcucaaguguccaacag

SEQ ID NO: 224016 - RNA, 31 nt, Human
uaguaggugcucaauaaauguugaaaccaac

SEQ ID NO: 224017 - RNA, 32 nt, Human
uaguagguuuuaauaaauauuucucugaguaa

SEQ ID NO: 224018 - RNA, 32 nt, Human
uaguaguaacgggguuucaccauguuggccag

SEQ ID NO: 224019 - RNA, 32 nt, Human
uaguaguagugggauuucaccauguuggccag

SEQ ID NO: 224020 - RNA, 32 nt, Human
uaguagugacgggguuucaccauguuggccag

SEQ ID NO: 224021 - RNA, 32 nt, Human
uaguagugacuggguuucaccauguuggccag

SEQ ID NO: 224022 - RNA, 32 nt, Human
uaguagugagacgugaagccagcuggacuucc

SEQ ID NO: 224023 - RNA, 32 nt, Human
uaguagugggauuacaggugcccgcuacuaug

SEQ ID NO: 224024 - RNA, 32 nt, Human
uaguagugguaggaauaggaaugugauuguaa

SEQ ID NO: 224025 - RNA, 32 nt, Human
uaguaguuaccucccuuuuacuuuucaaauuc

SEQ ID NO: 224026 - RNA, 32 nt, Human
uaguaguucaucuucuuuuugagcaaagacua

SEQ ID NO: 224027 - RNA, 32 nt, Human
uaguaguuguauccuagguaaauauggugauu

SEQ ID NO: 224028 - RNA, 32 nt, Human
uaguauaaaacacaggcuuucacaaauuuugu

SEQ ID NO: 224029 - RNA, 32 nt, Human
uaguauaagaaugaggaaaaagagguaauauc

SEQ ID NO: 224030 - RNA, 32 nt, Human
uaguauaaggguugcagcugaauggcucuaaa

SEQ ID NO: 224031 - RNA, 32 nt, Human
uaguauacaaaccauuaugauuuaugcuacuu

SEQ ID NO: 224032 - RNA, 32 nt, Human
uaguauagacacgguuucaccauguuggccag

SEQ ID NO: 224033 - RNA, 32 nt, Human
uaguauagauagcccugagccaaaaaguaaua

SEQ ID NO: 224034 - RNA, 32 nt, Human
uaguauagaugggguuucaccauguuggccag

SEQ ID NO: 224035 - RNA, 32 nt, Human
uaguauagggaaaggauaaaaauaagucaccu

SEQ ID NO: 224036 - RNA, 32 nt, Human
uaguauaguagaaagacaucugccuguaauua

SEQ ID NO: 224037 - RNA, 32 nt, Human
uaguauagucucaaagaccucaugcuucuagu

SEQ ID NO: 224038 - RNA, 32 nt, Human
uaguauaucacacuuagaggaaguacaugauu

SEQ ID NO: 224039 - RNA, 32 nt, Human
uaguauauucaugauucaguguagaauguaua

SEQ ID NO: 224040 - RNA, 32 nt, Human
uaguaucaauaucaauuucagaaaaauggacu

SEQ ID NO: 224041 - RNA, 32 nt, Human
uaguaucagauauuaauuuucuucaguguuca

SEQ ID NO: 224042 - RNA, 32 nt, Human
uaguaucaggagcaauugagaccccucaggag

SEQ ID NO: 224043 - RNA, 32 nt, Human
uaguaucccuggcugcuaagcccuuggcaggg

SEQ ID NO: 224044 - RNA, 32 nt, Human
uaguauccuagaguguuauagcagcaguccuc

SEQ ID NO: 224045 - RNA, 32 nt, Human
uaguauccuucccacuguaccacauuaucucu

SEQ ID NO: 224046 - RNA, 32 nt, Human
uaguauccuuuccucauucauccuggagagga

SEQ ID NO: 224047 - RNA, 32 nt, Human
uaguaucuagcaaucacaacacuggcugagcg

SEQ ID NO: 224048 - RNA, 32 nt, Human
uaguaucucauucugucaucagauccagaaga

SEQ ID NO: 224049 - RNA, 32 nt, Human
uaguaucuggagauggggccuuuggagguaau

SEQ ID NO: 224050 - RNA, 32 nt, Human
uaguaugaaagcuggggguggggaggggccuu

SEQ ID NO: 224051 - RNA, 32 nt, Human
uaguaugacugcgcucagccucggaugggagc

SEQ ID NO: 224052 - RNA, 32 nt, Human
uaguaugcuaaauauauuagauuucauauucu

SEQ ID NO: 224053 - RNA, 32 nt, Human
uaguauggaaugggagaagugaaaguucaguu

SEQ ID NO: 224054 - RNA, 32 nt, Human
uaguauggccugugucacucagcagugggaca

SEQ ID NO: 224055 - RNA, 32 nt, Human
uaguaugucaauguuauuuuaacuuucuuuga

SEQ ID NO: 224056 - RNA, 32 nt, Human
uaguaugucucauauucuuugacugacugacc

SEQ ID NO: 224057 - RNA, 32 nt, Human
uaguaugucuguaaucucuguauaaacuuugu

SEQ ID NO: 224058 - RNA, 32 nt, Human
uaguaugugacgagggagaacuguccacucau

SEQ ID NO: 224059 - RNA, 32 nt, Human
uaguauguucauguuggaaguggcuggcucug

SEQ ID NO: 224060 - RNA, 32 nt, Human
uaguauuaacaaacaugcuguaucggguuuuu

SEQ ID NO: 224061 - RNA, 32 nt, Human
uaguauuaaugguuuuggagcuggguccaguu

SEQ ID NO: 224062 - RNA, 32 nt, Human
uaguauuccugcuucuaccaagaagguauuua

SEQ ID NO: 224063 - RNA, 32 nt, Human
uaguauugugaacaagaacacuccucgaguaa

SEQ ID NO: 224064 - RNA, 32 nt, Human
uaguauuguuuuuccccucucccuccugcuuu

SEQ ID NO: 224065 - RNA, 32 nt, Human
uaguauuuaagucauaaugucauuucagaauu

SEQ ID NO: 224066 - RNA, 32 nt, Human
uaguauuuaauuaguugauuuauuuaauguaa

SEQ ID NO: 224067 - RNA, 32 nt, Human
uaguauuuauucacuuuuauuuagcaccaggg

SEQ ID NO: 224068 - RNA, 32 nt, Human
uaguauuuccuuugcccuagagcuagagucau

SEQ ID NO: 224069 - RNA, 32 nt, Human
uaguauuucucgccaugcuuugcucaugcgca

SEQ ID NO: 224070 - RNA, 32 nt, Human
uaguauuugguuuggaauauauuuuguggcuc

SEQ ID NO: 224071 - RNA, 32 nt, Human
uaguauuuugaccuucuacuagcagucagccu

SEQ ID NO: 224072 - RNA, 32 nt, Human
uaguauuuugcuucaagccuucugaaaauaua

SEQ ID NO: 224073 - RNA, 32 nt, Human
uaguauuuugucuuuguaauuuacagaaguua

SEQ ID NO: 224074 - RNA, 32 nt, Human
uaguauuuuugugaggaugaaaugcuaauaaa

SEQ ID NO: 224075 - RNA, 32 nt, Human
uagucaaagcacaaagucacgauuccacaaug

SEQ ID NO: 224076 - RNA, 32 nt, Human
uagucaaaucuuuuggaaagaauuucuggaag

SEQ ID NO: 224077 - RNA, 32 nt, Human
uagucaacagcagaccagccuggccaaugccu

SEQ ID NO: 224078 - RNA, 32 nt, Human
uagucaacauggugaaaccccgucuccauuaa

SEQ ID NO: 224079 - RNA, 32 nt, Human
uagucaaccugugccagcaacauucugaaauu

SEQ ID NO: 224080 - RNA, 32 nt, Human
uagucaagaauucacccaguguucuuuggaug

SEQ ID NO: 224081 - RNA, 32 nt, Human
uagucaaggagcuggucacaaaggcagaaaug

SEQ ID NO: 224082 - RNA, 32 nt, Human
uagucaauagggucuucagcuauuaauuguag

SEQ ID NO: 224083 - RNA, 32 nt, Human
uagucaaucccaguugcuuuuccccagauuug

SEQ ID NO: 224084 - RNA, 32 nt, Human
uagucaauccuaauugugguccugccucuuuu

SEQ ID NO: 224085 - RNA, 32 nt, Human
uagucaauccugguguuucucuguaucuucuc

SEQ ID NO: 224086 - RNA, 32 nt, Human
uagucacaaauuugaaaccgugcuucagaauc

SEQ ID NO: 224087 - RNA, 32 nt, Human
uagucacacaaacuguucaguguugcaggaac

SEQ ID NO: 224088 - RNA, 32 nt, Human
uagucacagcuacuccagaggcugaggcagga

SEQ ID NO: 224089 - RNA, 32 nt, Human
uagucacaguccggaagagaugauagaugcau

SEQ ID NO: 224090 - RNA, 32 nt, Human
uagucacaguuacacggcaggcugagguggga

SEQ ID NO: 224091 - RNA, 32 nt, Human
uagucacccgggcugggcucuacuaccuguac

SEQ ID NO: 224092 - RNA, 32 nt, Human
uagucaccuaugucugugccucccuucuuuau

SEQ ID NO: 224093 - RNA, 32 nt, Human
uagucaccuuuagugcugcagaacagcagaac

SEQ ID NO: 224094 - RNA, 31 nt, Human
uagucaccuuuuaaauccuguugaaaagcca

SEQ ID NO: 224095 - RNA, 32 nt, Human
uagucacgguuacugcagaggcugaggcagga

SEQ ID NO: 224096 - RNA, 32 nt, Human
uagucacucauccauccccuggcuccagagau

SEQ ID NO: 224097 - RNA, 32 nt, Human
uagucacugagcauacccuccuccuaccacuc

SEQ ID NO: 224098 - RNA, 32 nt, Human
uagucacugccagcacccagaaacccagcauu

SEQ ID NO: 224099 - RNA, 32 nt, Human
uagucacuuccuccgucuccgggacggcgugc

SEQ ID NO: 224100 - RNA, 32 nt, Human
uagucagagaaaaguagccagaagaauuugca

SEQ ID NO: 224101 - RNA, 32 nt, Human
uagucagaguaaguaggcagcacuuuuaaaaa

SEQ ID NO: 224102 - RNA, 32 nt, Human
uagucagauuccaugguagaggcaagcauucu

SEQ ID NO: 224103 - RNA, 18 nt, Human
uagucagcaaccauuuua

SEQ ID NO: 224104 - RNA, 32 nt, Human
uagucagcaagaagacugaguugcuucuacau

SEQ ID NO: 224105 - RNA, 32 nt, Human
uagucagcaugugcguuuuccugagaagugaa

SEQ ID NO: 224106 - RNA, 32 nt, Human
uagucagcuuucuuccccguagcuuguacacu

SEQ ID NO: 224107 - RNA, 32 nt, Human
uagucagggaaugggggagguggggaguuggg

SEQ ID NO: 224108 - RNA, 32 nt, Human
uagucaggguucccugaaggaaugaggagaaa

SEQ ID NO: 224109 - RNA, 32 nt, Human
uagucaggugaacaggaugacuucucaauuua

SEQ ID NO: 224110 - RNA, 32 nt, Human
uagucauacuccugugcucugucaccauggac

SEQ ID NO: 224111 - RNA, 32 nt, Human
uagucauaugugaagacagagcagaucagucu

SEQ ID NO: 224112 - RNA, 32 nt, Human
uagucaucacccagcugggcuucugcaguguu

SEQ ID NO: 224113 - RNA, 32 nt, Human
uagucauccuuuuuaagcugcaaagaagcauu

SEQ ID NO: 224114 - RNA, 32 nt, Human
uagucaucgucagagacacugccuacccaagc

SEQ ID NO: 224115 - RNA, 32 nt, Human
uagucaucuuccuacagcaccaucuagacauc

SEQ ID NO: 224116 - RNA, 32 nt, Human
uagucaugagccuccuacuucugggauugcag

SEQ ID NO: 224117 - RNA, 22 nt, Human
uagucaugagugauccuucaua

SEQ ID NO: 224118 - RNA, 32 nt, Human
uagucauguccagcagcacacgccuagucccg

SEQ ID NO: 224119 - RNA, 32 nt, Human
uagucauguuuccuauccaagagaccaguuaa

SEQ ID NO: 224120 - RNA, 32 nt, Human
uagucauuauuaacgugucuucccucuucccc

SEQ ID NO: 224121 - RNA, 32 nt, Human
uagucauucucaauucauauggaaucuagaug

SEQ ID NO: 224122 - RNA, 32 nt, Human
uaguccaagcuacucaagaggcugagguggga

SEQ ID NO: 224123 - RNA, 32 nt, Human
uaguccaagcuacucaggaggcugaggcagaa

SEQ ID NO: 224124 - RNA, 32 nt, Human
uaguccaagcuacuugggaggcugaaguggga

SEQ ID NO: 224125 - RNA, 32 nt, Human
uaguccaaucagcugaaauuaaaucacuuggg

SEQ ID NO: 224126 - RNA, 32 nt, Human
uaguccacaaguggagguggucguaagugaaa

SEQ ID NO: 224127 - RNA, 32 nt, Human
uaguccagcaggacaguggccauuuggacaga

SEQ ID NO: 224128 - RNA, 32 nt, Human
uaguccagccugagugacagagugagacccug

SEQ ID NO: 224129 - RNA, 32 nt, Human
uaguccagggacaggacuuugaagggaguaag

SEQ ID NO: 224130 - RNA, 25 nt, Human
uaguccagguauauuccugaucaaa

SEQ ID NO: 224131 - RNA, 32 nt, Human
uaguccagugggaagccagggguuggagaagg

SEQ ID NO: 224132 - RNA, 32 nt, Human
uaguccauccuuuccuccuuuugaaaaucagg

SEQ ID NO: 224133 - RNA, 32 nt, Human
uaguccaugugaagucacuuccuggguauaug

SEQ ID NO: 224134 - RNA, 32 nt, Human
uagucccaacuaccugggaggcugaggcggga

SEQ ID NO: 224135 - RNA, 32 nt, Human
uagucccaacuacuagggaggcugaggcagga

SEQ ID NO: 224136 - RNA, 32 nt, Human
uagucccaacuacuagggaggcugagguggga

SEQ ID NO: 224137 - RNA, 32 nt, Human
uagucccaacuacucaggaggcugaggcagga

SEQ ID NO: 224138 - RNA, 32 nt, Human
uagucccaacuacucaggaggcugaggcauga

SEQ ID NO: 224139 - RNA, 32 nt, Human
uagucccaacuacucaggaggcuggggcagga

SEQ ID NO: 224140 - RNA, 32 nt, Human
uagucccaacuacucggaaggcugaggcagga

SEQ ID NO: 224141 - RNA, 32 nt, Human
uagucccaacuacucgggaggcugaggcggga

SEQ ID NO: 224142 - RNA, 32 nt, Human
uagucccaacuacuuggaaggcugagguguga

SEQ ID NO: 224143 - RNA, 32 nt, Human
uagucccaacuacuugggaggcugaggcagga

SEQ ID NO: 224144 - RNA, 32 nt, Human
uagucccaacuacuugggaggcugagguggga

SEQ ID NO: 224145 - RNA, 32 nt, Human
uagucccaacuauucggcaggcugaggcagua

SEQ ID NO: 224146 - RNA, 32 nt, Human
uagucccaacuauuugggaggcugaggcagga

SEQ ID NO: 224147 - RNA, 32 nt, Human
uagucccaauuacucaggaggcugaggcgaga

SEQ ID NO: 224148 - RNA, 32 nt, Human
uagucccaauuacucgggaggcugcagcagga

SEQ ID NO: 224149 - RNA, 32 nt, Human
uagucccacaggccaaggauaagguugaaaug

SEQ ID NO: 224150 - RNA, 32 nt, Human
uagucccaccuacucaggaggcugaggaagga

SEQ ID NO: 224151 - RNA, 32 nt, Human
uagucccaccuacucaggaggcugaggcagga

SEQ ID NO: 224152 - RNA, 32 nt, Human
uagucccaccuacuguggaggcugaggugaga

SEQ ID NO: 224153 - RNA, 32 nt, Human
uagucccaccuacuugggaggcugaggcagga

SEQ ID NO: 224154 - RNA, 32 nt, Human
uagucccaccuauucgggaggcugaggcacaa

SEQ ID NO: 224155 - RNA, 32 nt, Human
uagucccaccucuugcuauuaaagcuucucug

SEQ ID NO: 224156 - RNA, 32 nt, Human
uagucccacuuagcaccccacacccaaagguc

SEQ ID NO: 224157 - RNA, 32 nt, Human
uagucccagagcucggcugccaccuccaccgg

SEQ ID NO: 224158 - RNA, 32 nt, Human
uagucccagagcuuugggaggcugaggugggu

SEQ ID NO: 224159 - RNA, 32 nt, Human
uagucccagauacucaggaggcugaggugaaa

SEQ ID NO: 224160 - RNA, 32 nt, Human
uagucccagauacucgggaggcugaggcagga

SEQ ID NO: 224161 - RNA, 32 nt, Human
uagucccagcaacucaggaggcugaggcagga

SEQ ID NO: 224162 - RNA, 32 nt, Human
uagucccagcaacucgggaggcugaggcagga

SEQ ID NO: 224163 - RNA, 32 nt, Human
uagucccagcaacuugggaggcugaggcagaa

SEQ ID NO: 224164 - RNA, 32 nt, Human
uagucccagcacucgggaaggccgagguggga

SEQ ID NO: 224165 - RNA, 32 nt, Human
uagucccagcacucugggaaccuggguuggga

SEQ ID NO: 224166 - RNA, 32 nt, Human
uagucccagcacuuugggaggccgagacaggc

SEQ ID NO: 224167 - RNA, 32 nt, Human
uagucccagcacuuugggaggccgaggcaggu

SEQ ID NO: 224168 - RNA, 32 nt, Human
uagucccagcacuuugggaggccgaggcgggu

SEQ ID NO: 224169 - RNA, 32 nt, Human
uagucccagcacuuugggaggccgaggcuggu

SEQ ID NO: 224170 - RNA, 32 nt, Human
uagucccagcacuuugggaggccgaggucagg

SEQ ID NO: 224171 - RNA, 32 nt, Human
uagucccagcacuuugggaggccgaggugggc

SEQ ID NO: 224172 - RNA, 32 nt, Human
uagucccagcacuuugggaggccggugggcag

SEQ ID NO: 224173 - RNA, 32 nt, Human
uagucccagcacuuugggaggcugaggcaggc

SEQ ID NO: 224174 - RNA, 32 nt, Human
uagucccagcacuuugggaggcugaggugggu

SEQ ID NO: 224175 - RNA, 32 nt, Human
uagucccagcagcuugggaggcugaggcugga

SEQ ID NO: 224176 - RNA, 32 nt, Human
uagucccagcauuuugggaggcugagugggau

SEQ ID NO: 224177 - RNA, 32 nt, Human
uagucccagccaagcuggaggcugaggcggga

SEQ ID NO: 224178 - RNA, 32 nt, Human
uagucccagccaccugggaggcugaggcagga

SEQ ID NO: 224179 - RNA, 32 nt, Human
uagucccagccacucagaaggcugaggcagga

SEQ ID NO: 224180 - RNA, 32 nt, Human
uagucccagccacuugagaggcugagguggaa

SEQ ID NO: 224181 - RNA, 32 nt, Human
uagucccagccacuugggaggcugaggcagga

SEQ ID NO: 224182 - RNA, 32 nt, Human
uagucccagccagucgggaggcugaggcggaa

SEQ ID NO: 224183 - RNA, 32 nt, Human
uagucccagcuaacugggaggcugaggcagga

SEQ ID NO: 224184 - RNA, 32 nt, Human
uagucccagcuaaucaggaggcugaggcaaga

SEQ ID NO: 224185 - RNA, 32 nt, Human
uagucccagcuacacaggaggcugaggcagga

SEQ ID NO: 224186 - RNA, 32 nt, Human
uagucccagcuacacgggaggcugaggcagga

SEQ ID NO: 224187 - RNA, 32 nt, Human
uagucccagcuacaugggaggcugaggcagga

SEQ ID NO: 224188 - RNA, 32 nt, Human
uagucccagcuacaugggaggcugaggcggga

SEQ ID NO: 224189 - RNA, 32 nt, Human
uagucccagcuacaugggaggcugagguggga

SEQ ID NO: 224190 - RNA, 32 nt, Human
uagucccagcuacccgggaggcugaggcagga

SEQ ID NO: 224191 - RNA, 32 nt, Human
uagucccagcuaccuaggaggcugaggcagga

SEQ ID NO: 224192 - RNA, 32 nt, Human
uagucccagcuaccugggaggcugagguggga

SEQ ID NO: 224193 - RNA, 32 nt, Human
uagucccagcuacgugagaggcugagguggga

SEQ ID NO: 224194 - RNA, 32 nt, Human
uagucccagcuacgugggaggcugaggcacga

SEQ ID NO: 224195 - RNA, 32 nt, Human
uagucccagcuacgugggaggcugaggcagca

SEQ ID NO: 224196 - RNA, 32 nt, Human
uagucccagcuacuaggaaggcugaggcagga

SEQ ID NO: 224197 - RNA, 32 nt, Human
uagucccagcuacuagggaggcugagccagga

SEQ ID NO: 224198 - RNA, 32 nt, Human
uagucccagcuacuagggaggcugaggcagga

SEQ ID NO: 224199 - RNA, 32 nt, Human
uagucccagcuacuauggagguugagguggga

SEQ ID NO: 224200 - RNA, 32 nt, Human
uagucccagcuacucaagaggcugaggcagaa

SEQ ID NO: 224201 - RNA, 32 nt, Human
uagucccagcuacucaagaggcugaggcagga

SEQ ID NO: 224202 - RNA, 32 nt, Human
uagucccagcuacucaggaggcugagacagga

SEQ ID NO: 224203 - RNA, 32 nt, Human
uagucccagcuacucaggaggcugaggaagau

SEQ ID NO: 224204 - RNA, 32 nt, Human
uagucccagcuacucaggaggcugaggcaagc

SEQ ID NO: 224205 - RNA, 32 nt, Human
uagucccagcuacucaggaggcugaggcagaa

SEQ ID NO: 224206 - RNA, 32 nt, Human
uagucccagcuacucaggaggcugaggcagga

SEQ ID NO: 224207 - RNA, 32 nt, Human
uagucccagcuacucaggaggcugaggcggga

SEQ ID NO: 224208 - RNA, 32 nt, Human
uagucccagcuacucaggaggcugaggcuaga

SEQ ID NO: 224209 - RNA, 32 nt, Human
uagucccagcuacucaggaggcugagguagga

SEQ ID NO: 224210 - RNA, 32 nt, Human
uagucccagcuacucaggaggcugagguggaa

SEQ ID NO: 224211 - RNA, 32 nt, Human
uagucccagcuacucaggaggcugagguggga

SEQ ID NO: 224212 - RNA, 32 nt, Human
uagucccagcuacucaggaggcugggcaggag

SEQ ID NO: 224213 - RNA, 32 nt, Human
uagucccagcuacucaggaggcuggggaagga

SEQ ID NO: 224214 - RNA, 32 nt, Human
uagucccagcuacucaggaggcuggggcagga

SEQ ID NO: 224215 - RNA, 32 nt, Human
uagucccagcuacucaggaggcugugguggga

SEQ ID NO: 224216 - RNA, 32 nt, Human
uagucccagcuacucagggggcugaggcggga

SEQ ID NO: 224217 - RNA, 32 nt, Human
uagucccagcuacuccagaggcugagauggau

SEQ ID NO: 224218 - RNA, 32 nt, Human
uagucccagcuacuccggaggcugaggcagga

SEQ ID NO: 224219 - RNA, 32 nt, Human
uagucccagcuacuccugaggcugagguggga

SEQ ID NO: 224220 - RNA, 32 nt, Human
uagucccagcuacucgaaaggcugaggcggga

SEQ ID NO: 224221 - RNA, 32 nt, Human
uagucccagcuacucgagaggcugaggcagga

SEQ ID NO: 224222 - RNA, 32 nt, Human
uagucccagcuacucgagaggcugaggcugga

SEQ ID NO: 224223 - RNA, 32 nt, Human
uagucccagcuacucggcaggcugagguggga

SEQ ID NO: 224224 - RNA, 32 nt, Human
uagucccagcuacucgggaggcugaagcggga

SEQ ID NO: 224225 - RNA, 32 nt, Human
uagucccagcuacucgggaggcugagacagaa

SEQ ID NO: 224226 - RNA, 32 nt, Human
uagucccagcuacucgggaggcugagacagga

SEQ ID NO: 224227 - RNA, 32 nt, Human
uagucccagcuacucgggaggcugagcuucga

SEQ ID NO: 224228 - RNA, 32 nt, Human
uagucccagcuacucgggaggcugaggaagga

SEQ ID NO: 224229 - RNA, 32 nt, Human
uagucccagcuacucgggaggcugaggcaaga

SEQ ID NO: 224230 - RNA, 32 nt, Human
uagucccagcuacucgggaggcugaggcacaa

SEQ ID NO: 224231 - RNA, 32 nt, Human
uagucccagcuacucgggaggcugaggcacga

SEQ ID NO: 224232 - RNA, 32 nt, Human
uagucccagcuacucgggaggcugaggcagaa

SEQ ID NO: 224233 - RNA, 32 nt, Human
uagucccagcuacucgggaggcugaggcagga

SEQ ID NO: 224234 - RNA, 32 nt, Human
uagucccagcuacucgggaggcugaggcaggg

SEQ ID NO: 224235 - RNA, 32 nt, Human
uagucccagcuacucgggaggcugaggcauga

SEQ ID NO: 224236 - RNA, 32 nt, Human
uagucccagcuacucgggaggcugaggccgua

SEQ ID NO: 224237 - RNA, 32 nt, Human
uagucccagcuacucgggaggcugaggcggga

SEQ ID NO: 224238 - RNA, 32 nt, Human
uagucccagcuacucgggaggcugaggcugga

SEQ ID NO: 224239 - RNA, 32 nt, Human
uagucccagcuacucgggaggcugagguagga

SEQ ID NO: 224240 - RNA, 32 nt, Human
uagucccagcuacucgggaggcugagguggga

SEQ ID NO: 224241 - RNA, 32 nt, Human
uagucccagcuacucgggaggcuggggcagga

SEQ ID NO: 224242 - RNA, 32 nt, Human
uagucccagcuacucuagaggcugagguggga

SEQ ID NO: 224243 - RNA, 32 nt, Human
uagucccagcuacucuggaggcugaaauggga

SEQ ID NO: 224244 - RNA, 32 nt, Human
uagucccagcuacucuggaggcugaagcagga

SEQ ID NO: 224245 - RNA, 32 nt, Human
uagucccagcuacucuggaggcugaaguugga

SEQ ID NO: 224246 - RNA, 32 nt, Human
uagucccagcuacucuggaggcugagacagga

SEQ ID NO: 224247 - RNA, 32 nt, Human
uagucccagcuacucuggaggcugaggcagga

SEQ ID NO: 224248 - RNA, 32 nt, Human
uagucccagcuacucuggaggcugaggcggga

SEQ ID NO: 224249 - RNA, 32 nt, Human
uagucccagcuacucuggaggcugaggugagg

SEQ ID NO: 224250 - RNA, 32 nt, Human
uagucccagcuacuggcgaggcugaggcugga

SEQ ID NO: 224251 - RNA, 32 nt, Human
uagucccagcuacuggggaggcugaggcagca

SEQ ID NO: 224252 - RNA, 32 nt, Human
uagucccagcuacuggggaggcugaggcagga

SEQ ID NO: 224253 - RNA, 32 nt, Human
uagucccagcuacuggggaggcugaggcaggg

SEQ ID NO: 224254 - RNA, 32 nt, Human
uagucccagcuacuuaggaggcugagauggga

SEQ ID NO: 224255 - RNA, 32 nt, Human
uagucccagcuacuuaggaggcugaggcauga

SEQ ID NO: 224256 - RNA, 32 nt, Human
uagucccagcuacuuaggaggcugaggggcaa

SEQ ID NO: 224257 - RNA, 32 nt, Human
uagucccagcuacuuaggaggcugagguagga

SEQ ID NO: 224258 - RNA, 32 nt, Human
uagucccagcuacuuaggaggcugagguggga

SEQ ID NO: 224259 - RNA, 32 nt, Human
uagucccagcuacuugagaggcugaggcaaga

SEQ ID NO: 224260 - RNA, 32 nt, Human
uagucccagcuacuugagaggcugaggcugga

SEQ ID NO: 224261 - RNA, 32 nt, Human
uagucccagcuacuuggaaggcugagacagga

SEQ ID NO: 224262 - RNA, 32 nt, Human
uagucccagcuacuuggcaggcugaggcagaa

SEQ ID NO: 224263 - RNA, 32 nt, Human
uagucccagcuacuuggcaggcugaggcagga

SEQ ID NO: 224264 - RNA, 18 nt, Human
uagucccagcuacuuggg

SEQ ID NO: 224265 - RNA, 32 nt, Human
uagucccagcuacuugggaggcugaaguggga

SEQ ID NO: 224266 - RNA, 32 nt, Human
uagucccagcuacuugggaggcugagacagga

SEQ ID NO: 224267 - RNA, 32 nt, Human
uagucccagcuacuugggaggcugagagagga

SEQ ID NO: 224268 - RNA, 32 nt, Human
uagucccagcuacuugggaggcugagauggga

SEQ ID NO: 224269 - RNA, 32 nt, Human
uagucccagcuacuugggaggcugagcccugg

SEQ ID NO: 224270 - RNA, 32 nt, Human
uagucccagcuacuugggaggcugaggcaaga

SEQ ID NO: 224271 - RNA, 32 nt, Human
uagucccagcuacuugggaggcugaggcacaa

SEQ ID NO: 224272 - RNA, 32 nt, Human
uagucccagcuacuugggaggcugaggcagaa

SEQ ID NO: 224273 - RNA, 32 nt, Human
uagucccagcuacuugggaggcugaggcagga

SEQ ID NO: 224274 - RNA, 32 nt, Human
uagucccagcuacuugggaggcugaggcaggg

SEQ ID NO: 224275 - RNA, 32 nt, Human
uagucccagcuacuugggaggcugagggcagg

SEQ ID NO: 224276 - RNA, 32 nt, Human
uagucccagcuacuugggaggcugagguagga

SEQ ID NO: 224277 - RNA, 32 nt, Human
uagucccagcuacuugggaggcugaggucaga

SEQ ID NO: 224278 - RNA, 32 nt, Human
uagucccagcuacuugggaggcugagguggaa

SEQ ID NO: 224279 - RNA, 32 nt, Human
uagucccagcuacuugggaggcugagguggag

SEQ ID NO: 224280 - RNA, 32 nt, Human
uagucccagcuacuugggaggcugagguggga

SEQ ID NO: 224281 - RNA, 32 nt, Human
uagucccagcuacuugggaggcugaggugggg

SEQ ID NO: 224282 - RNA, 32 nt, Human
uagucccagcuacuugggaggcugaguccgga

SEQ ID NO: 224283 - RNA, 32 nt, Human
uagucccagcuacuugggaggcugcagcugug

SEQ ID NO: 224284 - RNA, 32 nt, Human
uagucccagcuacuugggaggcuggggaagga

SEQ ID NO: 224285 - RNA, 32 nt, Human
uagucccagcuacuugggaggcuggggcauga

SEQ ID NO: 224286 - RNA, 32 nt, Human
uagucccagcuacuugguaggcugaggcagga

SEQ ID NO: 224287 - RNA, 32 nt, Human
uagucccagcuacuugugaggcugagggagga

SEQ ID NO: 224288 - RNA, 32 nt, Human
uagucccagcuacuugugaggcugagguggga

SEQ ID NO: 224289 - RNA, 32 nt, Human
uagucccagcuacuuuggaggcugaagcggaa

SEQ ID NO: 224290 - RNA, 32 nt, Human
uagucccagcuacuuuggaggcugaggcagga

SEQ ID NO: 224291 - RNA, 32 nt, Human
uagucccagcuagucaagaggcugaggccaga

SEQ ID NO: 224292 - RNA, 32 nt, Human
uagucccagcuagucgggaggcugaggcagga

SEQ ID NO: 224293 - RNA, 32 nt, Human
uagucccagcuauaugggaugcugaggcagaa

SEQ ID NO: 224294 - RNA, 32 nt, Human
uagucccagcuaucccagaggucgaggcugca

SEQ ID NO: 224295 - RNA, 32 nt, Human
uagucccagcuaucugggaggcugaggcagga

SEQ ID NO: 224296 - RNA, 32 nt, Human
uagucccagcuaugcgagaggcugaggcagga

SEQ ID NO: 224297 - RNA, 32 nt, Human
uagucccagcuaugugggaggcuaagguggga

SEQ ID NO: 224298 - RNA, 32 nt, Human
uagucccagcuauucagaaggcugaggcagga

SEQ ID NO: 224299 - RNA, 32 nt, Human
uagucccagcuauucaggaagcugagguggga

SEQ ID NO: 224300 - RNA, 32 nt, Human
uagucccagcuauucaggagcuguuguaggag

SEQ ID NO: 224301 - RNA, 32 nt, Human
uagucccagcuauucaggaggcuaagguaaga

SEQ ID NO: 224302 - RNA, 32 nt, Human
uagucccagcuauucaggaggcugaggcagga

SEQ ID NO: 224303 - RNA, 32 nt, Human
uagucccagcuauucaggaggcugagguggga

SEQ ID NO: 224304 - RNA, 32 nt, Human
uagucccagcuauuccagggggcugaggcagg

SEQ ID NO: 224305 - RNA, 32 nt, Human
uagucccagcuauucgggaggcugaggcagga

SEQ ID NO: 224306 - RNA, 32 nt, Human
uagucccagcuauucgggaggcugagguaaga

SEQ ID NO: 224307 - RNA, 32 nt, Human
uagucccagcuauucuagaggcugaggcggga

SEQ ID NO: 224308 - RNA, 32 nt, Human
uagucccagcuauucuggaggcugagauggga

SEQ ID NO: 224309 - RNA, 32 nt, Human
uagucccagcuauuugggaggcuaaggcagga

SEQ ID NO: 224310 - RNA, 32 nt, Human
uagucccagcuauuugggaggcugaggcagga

SEQ ID NO: 224311 - RNA, 32 nt, Human
uagucccagcuauuugggaggcugagguggga

SEQ ID NO: 224312 - RNA, 32 nt, Human
uagucccagcuauuugggaggcugaugcagga

SEQ ID NO: 224313 - RNA, 32 nt, Human
uagucccagcuccccaggaggcugagguggga

SEQ ID NO: 224314 - RNA, 32 nt, Human
uagucccagcuccucaggaggcugaggcagga

SEQ ID NO: 224315 - RNA, 32 nt, Human
uagucccagcucuucaggaggcugagaaaaga

SEQ ID NO: 224316 - RNA, 32 nt, Human
uagucccagcugcccaggaggcugaggcagga

SEQ ID NO: 224317 - RNA, 32 nt, Human
uagucccagcugcucaggaggcugaggcagga

SEQ ID NO: 224318 - RNA, 32 nt, Human
uagucccagcugcucaggaggcugaggcauga

SEQ ID NO: 224319 - RNA, 32 nt, Human
uagucccagcugcucaggaggcugagguggga

SEQ ID NO: 224320 - RNA, 32 nt, Human
uagucccagcugcuccugaggcugaggcagga

SEQ ID NO: 224321 - RNA, 32 nt, Human
uagucccagcugcucgggaggcugaggcagga

SEQ ID NO: 224322 - RNA, 32 nt, Human
uagucccagcugcucgggaggcugaggcaggg

SEQ ID NO: 224323 - RNA, 32 nt, Human
uagucccagcugcuugggaggcugaggcagga

SEQ ID NO: 224324 - RNA, 32 nt, Human
uagucccagcuguccuggaggcugaggcagaa

SEQ ID NO: 224325 - RNA, 32 nt, Human
uagucccagcuguucgagaggcugaggcaaga

SEQ ID NO: 224326 - RNA, 32 nt, Human
uagucccagcuucucaggaggcugggguggga

SEQ ID NO: 224327 - RNA, 32 nt, Human
uagucccagcuucucgggaggcugaggcagga

SEQ ID NO: 224328 - RNA, 32 nt, Human
uagucccagcuucuugggaggcugagguggga

SEQ ID NO: 224329 - RNA, 32 nt, Human
uagucccaggcugaggugggaggaucacuuga

SEQ ID NO: 224330 - RNA, 32 nt, Human
uagucccagguaaccauugggccaaaggauca

SEQ ID NO: 224331 - RNA, 32 nt, Human
uagucccagguacucaggaggcugaggcagga

SEQ ID NO: 224332 - RNA, 32 nt, Human
uagucccagguacucaggaggcugagguagga

SEQ ID NO: 224333 - RNA, 32 nt, Human
uagucccagguacucaggaggcugagguagua

SEQ ID NO: 224334 - RNA, 32 nt, Human
uagucccagguacucgggaggcugaggcagga

SEQ ID NO: 224335 - RNA, 32 nt, Human
uagucccagguacuugggaggcugaggcagga

SEQ ID NO: 224336 - RNA, 32 nt, Human
uagucccaguuacucgggaggcugaggcacga

SEQ ID NO: 224337 - RNA, 32 nt, Human
uagucccaguuacucgggaggcugaggcagga

SEQ ID NO: 224338 - RNA, 32 nt, Human
uagucccaguuacucggguggcugaggcagga

SEQ ID NO: 224339 - RNA, 32 nt, Human
uagucccaguuacucuggaggcugaggcagaa

SEQ ID NO: 224340 - RNA, 32 nt, Human
uagucccaguuacuugggaggcugagacagga

SEQ ID NO: 224341 - RNA, 32 nt, Human
uagucccaguuacuugggaggcugaggcagga

SEQ ID NO: 224342 - RNA, 32 nt, Human
uagucccaucuacuugggaggcugagguggau

SEQ ID NO: 224343 - RNA, 32 nt, Human
uagucccauguacuugggaggcugaggcagga

SEQ ID NO: 224344 - RNA, 32 nt, Human
uaguccccaagcggcaguccuggaccuaacgg

SEQ ID NO: 224345 - RNA, 32 nt, Human
uaguccccuggacugagucccccaggccuucc

SEQ ID NO: 224346 - RNA, 32 nt, Human
uaguccccugggggaggggaagggugggucua

SEQ ID NO: 224347 - RNA, 32 nt, Human
uagucccggcuacucgggaggcugaggcagga

SEQ ID NO: 224348 - RNA, 32 nt, Human
uagucccgguuacucgggaggcugagacagga

SEQ ID NO: 224349 - RNA, 32 nt, Human
uagucccucucaccugcuuccucagacgacuc

SEQ ID NO: 224350 - RNA, 32 nt, Human
uagucccucuccugccaccucuccaagacuuc

SEQ ID NO: 224351 - RNA, 32 nt, Human
uagucccugcaacucuggaggcugagguggga

SEQ ID NO: 224352 - RNA, 32 nt, Human
uagucccugcuacucaggaggcugaggcagga

SEQ ID NO: 224353 - RNA, 32 nt, Human
uagucccugcuacuugggaggcugaggcagga

SEQ ID NO: 224354 - RNA, 32 nt, Human
uagucccugcuacuugggaggcugagguagga

SEQ ID NO: 224355 - RNA, 32 nt, Human
uagucccugcuauuugagaggcugagguggga

SEQ ID NO: 224356 - RNA, 32 nt, Human
uagucccuggccaucccuccuguccuggaucc

SEQ ID NO: 224357 - RNA, 32 nt, Human
uaguccgagccacuugggaggcugagguggga

SEQ ID NO: 224358 - RNA, 32 nt, Human
uaguccgagcuacucgggaggcugaggcagaa

SEQ ID NO: 224359 - RNA, 32 nt, Human
uaguccgcgccaggaagagagcaacgaggaaa

SEQ ID NO: 224360 - RNA, 32 nt, Human
uaguccguccuggcacagaagaggagucaagu

SEQ ID NO: 224361 - RNA, 32 nt, Human
uaguccuaacugcucaggaggcugagguggga

SEQ ID NO: 224362 - RNA, 32 nt, Human
uaguccuaaggagaugaucagagauguguaaa

SEQ ID NO: 224363 - RNA, 32 nt, Human
uaguccuacaccuugcccugccugggcuuugg

SEQ ID NO: 224364 - RNA, 32 nt, Human
uaguccuacugagaaaaugagcacuuugauca

SEQ ID NO: 224365 - RNA, 32 nt, Human
uaguccuagcacuuugggaggcugaggcgggu

SEQ ID NO: 224366 - RNA, 32 nt, Human
uaguccuagccacucaggaggcugaggcagga

SEQ ID NO: 224367 - RNA, 32 nt, Human
uaguccuagcuacucaggaggcugagauggga

SEQ ID NO: 224368 - RNA, 32 nt, Human
uaguccuagcuacucaggaggcugaggcagga

SEQ ID NO: 224369 - RNA, 32 nt, Human
uaguccuagcuacucaggaggcugagguggga

SEQ ID NO: 224370 - RNA, 32 nt, Human
uaguccuagcuacuccggaggcugagccagga

SEQ ID NO: 224371 - RNA, 32 nt, Human
uaguccuagcuacucgagaggcugaggcagga

SEQ ID NO: 224372 - RNA, 32 nt, Human
uaguccuagcuacucggaaggcugaggcagga

SEQ ID NO: 224373 - RNA, 32 nt, Human
uaguccuagcuacucgggaggcugaggcacga

SEQ ID NO: 224374 - RNA, 32 nt, Human
uaguccuagcuacucgggaggcugaggcagga

SEQ ID NO: 224375 - RNA, 32 nt, Human
uaguccuagcuacugaggaggcugacggagga

SEQ ID NO: 224376 - RNA, 32 nt, Human
uaguccuagcuacuugggaggcugagauggga

SEQ ID NO: 224377 - RNA, 32 nt, Human
uaguccuagcuacuugggaggcugaggcagga

SEQ ID NO: 224378 - RNA, 32 nt, Human
uaguccuagcuacuugggaggcugagguggaa

SEQ ID NO: 224379 - RNA, 32 nt, Human
uaguccuagcuauuugggaggcugaggcugga

SEQ ID NO: 224380 - RNA, 32 nt, Human
uaguccuagcugcucaggaggcugaggcagga

SEQ ID NO: 224381 - RNA, 32 nt, Human
uaguccuagcugcucgggaggcugaggcagga

SEQ ID NO: 224382 - RNA, 32 nt, Human
uaguccuagcugcuugggaggcugaggcaggc

SEQ ID NO: 224383 - RNA, 32 nt, Human
uaguccuagcuucuugggaggcugaggcagga

SEQ ID NO: 224384 - RNA, 32 nt, Human
uaguccuaguuacuugggaggcugaagcggga

SEQ ID NO: 224385 - RNA, 32 nt, Human
uaguccuaguuacuugggaggcugagguggga

SEQ ID NO: 224386 - RNA, 32 nt, Human
uaguccuccaagaagaaagcaccaagacaaca

SEQ ID NO: 224387 - RNA, 32 nt, Human
uaguccuccugccucagcuuccugguugcgac

SEQ ID NO: 224388 - RNA, 32 nt, Human
uaguccuccugcuacaccacugaccaacagga

SEQ ID NO: 224389 - RNA, 32 nt, Human
uaguccucuguggguuggucuucagccagcau

SEQ ID NO: 224390 - RNA, 32 nt, Human
uaguccugcagaggauuuaacugugaaccugg

SEQ ID NO: 224391 - RNA, 32 nt, Human
uaguccuggaaacaacccuaugugguugggac

SEQ ID NO: 224392 - RNA, 32 nt, Human
uaguccuguaggucagccuuucucacaaacuc

SEQ ID NO: 224393 - RNA, 32 nt, Human
uaguccuuccuugguguuaacucugaaauuaa

SEQ ID NO: 224394 - RNA, 32 nt, Human
uagucgaaccccaaacauuguaaaaugugucc

SEQ ID NO: 224395 - RNA, 32 nt, Human
uagucgaagcuacucaggaggcugaggcagaa

SEQ ID NO: 224396 - RNA, 32 nt, Human
uagucgcaaugucauugucagaaaaauggaag

SEQ ID NO: 224397 - RNA, 32 nt, Human
uagucgcaccgcuggcaccuguaagaacgcgc

SEQ ID NO: 224398 - RNA, 32 nt, Human
uagucgcagccuuucgggaggcugagacagga

SEQ ID NO: 224399 - RNA, 32 nt, Human
uagucgcagcuacucagaaggcugagguggga

SEQ ID NO: 224400 - RNA, 32 nt, Human
uagucgcagcuacucaggaggcugaggcggga

SEQ ID NO: 224401 - RNA, 32 nt, Human
uagucgcagcuacuggggaggcugaggcagga

SEQ ID NO: 224402 - RNA, 32 nt, Human
uagucgcagcuacuugggaggcuggggcagga

SEQ ID NO: 224403 - RNA, 32 nt, Human
uagucgccgcaaugacgaccgcguccaccucg

SEQ ID NO: 224404 - RNA, 32 nt, Human
uagucgccuccaccucccugccugaaccucca

SEQ ID NO: 224405 - RNA, 32 nt, Human
uagucgcgggaaaggacccacacuccuuagcc

SEQ ID NO: 224406 - RNA, 32 nt, Human
uagucgcuggaguccgcgccucccugggacug

SEQ ID NO: 224407 - RNA, 21 nt, Human
uagucggcaccagaggcaagg

SEQ ID NO: 224408 - RNA, 32 nt, Human
uagucgggaagaggagcuucagcagcgcuguu

SEQ ID NO: 224409 - RNA, 32 nt, Human
uagucgggucggagaugaaaucagagggaguc

SEQ ID NO: 224410 - RNA, 32 nt, Human
uagucuaccacuguacaucugguaaccucaau

SEQ ID NO: 224411 - RNA, 32 nt, Human
uagucuacgagccaggaugacagggacagcga

SEQ ID NO: 224412 - RNA, 32 nt, Human
uagucuacuguauuuauuuauaugggaucaac

SEQ ID NO: 224413 - RNA, 20 nt, Human
uagucuauaaauucuucaca

SEQ ID NO: 224414 - RNA, 32 nt, Human
uagucucaaaacugugaagugacaugucagaa

SEQ ID NO: 224415 - RNA, 22 nt, Human
uagucucaaccuccugggcuca

SEQ ID NO: 224416 - RNA, 32 nt, Human
uagucucaacuauuugggaggcugaggcagga

SEQ ID NO: 224417 - RNA, 32 nt, Human
uagucucaagaauggaaaccugaaugucugag

SEQ ID NO: 224418 - RNA, 32 nt, Human
uagucucaccuacuccggaggcugagguggga

SEQ ID NO: 224419 - RNA, 32 nt, Human
uagucucagauacuugggaggcugagggugga

SEQ ID NO: 224420 - RNA, 32 nt, Human
uagucucagcacuuugggaggcugagguggga

SEQ ID NO: 224421 - RNA, 32 nt, Human
uagucucagccacucgggaggcugaggcagga

SEQ ID NO: 224422 - RNA, 32 nt, Human
uagucucagcuaccugggaggcugaggcagga

SEQ ID NO: 224423 - RNA, 32 nt, Human
uagucucagcuacuagggaggcugaggcaaga

SEQ ID NO: 224424 - RNA, 32 nt, Human
uagucucagcuacucaggaggcugagacagga

SEQ ID NO: 224425 - RNA, 32 nt, Human
uagucucagcuacucaggaggcugagaugaga

SEQ ID NO: 224426 - RNA, 32 nt, Human
uagucucagcuacucaggaggcugaggcagga

SEQ ID NO: 224427 - RNA, 32 nt, Human
uagucucagcuacucaggaggcuguggcagga

SEQ ID NO: 224428 - RNA, 32 nt, Human
uagucucagcuacucggaaggcugaggcagga

SEQ ID NO: 224429 - RNA, 32 nt, Human
uagucucagcuacucgggaggcugaggcagga

SEQ ID NO: 224430 - RNA, 32 nt, Human
uagucucagcuacucuggagguuuagcaggag

SEQ ID NO: 224431 - RNA, 32 nt, Human
uagucucagcuacuuaggaggcugagguggca

SEQ ID NO: 224432 - RNA, 32 nt, Human
uagucucagcuacuuaggaggcugagguggga

SEQ ID NO: 224433 - RNA, 32 nt, Human
uagucucagcuacuugggaggcugaggcacaa

SEQ ID NO: 224434 - RNA, 32 nt, Human
uagucucagcuacuugggaggcugaggcagga

SEQ ID NO: 224435 - RNA, 32 nt, Human
uagucucagcuauucgggaggaugaggcaaga

SEQ ID NO: 224436 - RNA, 32 nt, Human
uagucucagcuauugggaggcugaggcaagaa

SEQ ID NO: 224437 - RNA, 32 nt, Human
uagucucaucuucuuaacucccucaggcauca

SEQ ID NO: 224438 - RNA, 32 nt, Human
uagucucaugaagaauucuggcgugcagccag

SEQ ID NO: 224439 - RNA, 22 nt, Human
uagucucauuaugaccuucaca

SEQ ID NO: 224440 - RNA, 32 nt, Human
uagucuccagaacugugagacagugcauuuug

SEQ ID NO: 224441 - RNA, 32 nt, Human
uagucucccuuucacuguuuucuuauucugua

SEQ ID NO: 224442 - RNA, 32 nt, Human
uagucuccuacuuagagauauucuagaaaaug

SEQ ID NO: 224443 - RNA, 32 nt, Human
uagucuccuccccguggauucccccaaaccca

SEQ ID NO: 224444 - RNA, 22 nt, Human
uagucucgaccucccaggcuca

SEQ ID NO: 224445 - RNA, 32 nt, Human
uagucucuacagcuguuucccucuuuucccau

SEQ ID NO: 224446 - RNA, 32 nt, Human
uagucucuccaccuuggccauuuccagccagc

SEQ ID NO: 224447 - RNA, 32 nt, Human
uagucucuccagcacaugcacacagcaugcac

SEQ ID NO: 224448 - RNA, 32 nt, Human
uagucucuccccuucuuucccuuccacuucua

SEQ ID NO: 224449 - RNA, 32 nt, Human
uagucucugaaguucccccauuuccuucagua

SEQ ID NO: 224450 - RNA, 32 nt, Human
uagucucugagguuccuuuucacacacaaaaa

SEQ ID NO: 224451 - RNA, 32 nt, Human
uagucucugcuuucuuuccccagggcugggcc

SEQ ID NO: 224452 - RNA, 32 nt, Human
uagucucugucucuauagguuugcuuuuucag

SEQ ID NO: 224453 - RNA, 32 nt, Human
uagucucuucuucauugcccuuccucaccagc

SEQ ID NO: 224454 - RNA, 32 nt, Human
uagucugaacuuaaguguccuaaaaccuuguu

SEQ ID NO: 224455 - RNA, 22 nt, Human
uagucugaagcugucccaggcu

SEQ ID NO: 224456 - RNA, 32 nt, Human
uagucugaagugaaguacagagcuggcaucua

SEQ ID NO: 224457 - RNA, 23 nt, Human
uagucugaccccucacuuaggcu

SEQ ID NO: 224458 - RNA, 32 nt, Human
uagucugcauaggaagggaacaccuggacgug

SEQ ID NO: 224459 - RNA, 32 nt, Human
uagucugcaucuguaucuuuguggacuugaug

SEQ ID NO: 224460 - RNA, 32 nt, Human
uagucugcccuugaacacauacccucacuggg

SEQ ID NO: 224461 - RNA, 32 nt, Human
uagucugccucuacaccagcagagaccucccu

SEQ ID NO: 224462 - RNA, 32 nt, Human
uagucugccugggugaggcucccuuccuguuu

SEQ ID NO: 224463 - RNA, 32 nt, Human
uagucugcuggggcuuggccucuggguccugc

SEQ ID NO: 224464 - RNA, 32 nt, Human
uagucuggacugcuuccccaucagccuuccca

SEQ ID NO: 224465 - RNA, 32 nt, Human
uagucuggacuggccaauccaggucccugcac

SEQ ID NO: 224466 - RNA, 32 nt, Human
uagucuggccaacauggugaaacacuaucucu

SEQ ID NO: 224467 - RNA, 32 nt, Human
uagucuggccaacauggugaaaccccaucucu

SEQ ID NO: 224468 - RNA, 32 nt, Human
uagucuggucaacauggugaaaccccgucucc

SEQ ID NO: 224469 - RNA, 28 nt, Human
uagucugguuuuuguugcuuaucggguu

SEQ ID NO: 224470 - RNA, 32 nt, Human
uagucugucagggccuuggcccaggggucagc

SEQ ID NO: 224471 - RNA, 23 nt, Human
uagucugucucuuggcuuuguca

SEQ ID NO: 224472 - RNA, 24 nt, Human
uagucuguucucaugcugcuguua

SEQ ID NO: 224473 - RNA, 19 nt, Human
uagucuguuucauauuauu

SEQ ID NO: 224474 - RNA, 32 nt, Human
uagucuguuuucucugagcauguuggccaacu

SEQ ID NO: 224475 - RNA, 32 nt, Human
uagucuuagcuacucaggaggcugaggaggga

SEQ ID NO: 224476 - RNA, 32 nt, Human
uagucuuagcuacucaggaggcugaggcagga

SEQ ID NO: 224477 - RNA, 32 nt, Human
uagucuucauuucugucugauucuaccuuuac

SEQ ID NO: 224478 - RNA, 32 nt, Human
uagucuuccacucugggauauugagcagugcu

SEQ ID NO: 224479 - RNA, 32 nt, Human
uagucuucccauuuucuuccuauuacuuuauu

SEQ ID NO: 224480 - RNA, 32 nt, Human
uagucuuccgucuuuucuucuucaccaagcau

SEQ ID NO: 224481 - RNA, 32 nt, Human
uagucuuccuucauccuugcccucuguuggca

SEQ ID NO: 224482 - RNA, 32 nt, Human
uagucuucucagaugaccuugacuaauauacu

SEQ ID NO: 224483 - RNA, 32 nt, Human
uagucuugcugguacaauuugggcuaaggagu

SEQ ID NO: 224484 - RNA, 21 nt, Human
uagucuuggugaccuuuuaua

SEQ ID NO: 224485 - RNA, 32 nt, Human
uagucuuucccucuccccuccuguuuuaguuu

SEQ ID NO: 224486 - RNA, 20 nt, Human
uagucuuucucuccuucaua

SEQ ID NO: 224487 - RNA, 32 nt, Human
uagucuuuucaguuaucuucuaccuccuguau

SEQ ID NO: 224488 - RNA, 32 nt, Human
uagugaaaaacucaguucuauaagcuagcugu

SEQ ID NO: 224489 - RNA, 32 nt, Human
uagugaaaaggugaguuaugagcuuagauuac

SEQ ID NO: 224490 - RNA, 32 nt, Human
uagugaaagaaagauggaaaguguugagaaag

SEQ ID NO: 224491 - RNA, 32 nt, Human
uagugaaauaacugaagggccugcucuuucca

SEQ ID NO: 224492 - RNA, 32 nt, Human
uagugaaaucauaguagccauugagaacacaa

SEQ ID NO: 224493 - RNA, 32 nt, Human
uagugaacacagaguaugggcacggcuaugcu

SEQ ID NO: 224494 - RNA, 32 nt, Human
uagugaagacgguguuuugccauguugggcag

SEQ ID NO: 224495 - RNA, 32 nt, Human
uagugaagagcaacauguggcacacagggccu

SEQ ID NO: 224496 - RNA, 32 nt, Human
uagugaagccagaaucucagggccaggcaucc

SEQ ID NO: 224497 - RNA, 32 nt, Human
uagugaaucaggcaccggagugcagguucggg

SEQ ID NO: 224498 - RNA, 32 nt, Human
uagugaaugacuugaccugugaccucaauaca

SEQ ID NO: 224499 - RNA, 32 nt, Human
uagugaauuuguggaggcauugccaaaaauca

SEQ ID NO: 224500 - RNA, 32 nt, Human
uagugacaaccaggaaaacuuacuugggauua

SEQ ID NO: 224501 - RNA, 32 nt, Human
uagugacaccaguuuugggagaugucuuucau

SEQ ID NO: 224502 - RNA, 32 nt, Human
uagugacagaacuuccucggccauauggaggg

SEQ ID NO: 224503 - RNA, 32 nt, Human
uagugacagccauuucuugguugauggguugg

SEQ ID NO: 224504 - RNA, 31 nt, Human
uagugacagguggaaaagaaggaugaggaag

SEQ ID NO: 224505 - RNA, 32 nt, Human
uagugacaugcaggcaccucucuuucauccuu

SEQ ID NO: 224506 - RNA, 32 nt, Human
uagugacccagugcccucacugcccagccccg

SEQ ID NO: 224507 - RNA, 32 nt, Human
uagugacccucugaauaaccugagugacuggc

SEQ ID NO: 224508 - RNA, 32 nt, Human
uagugacccugcauuguggugccugagcccug

SEQ ID NO: 224509 - RNA, 32 nt, Human
uagugacggguuucaccauguuagccaggaug

SEQ ID NO: 224510 - RNA, 32 nt, Human
uagugacucugugcuugucuguuuaguucugu

SEQ ID NO: 224511 - RNA, 32 nt, Human
uagugacucuucugaagaagcuuucuggucug

SEQ ID NO: 224512 - RNA, 32 nt, Human
uagugacugagaaggauugauaucauggcuag

SEQ ID NO: 224513 - RNA, 21 nt, Human
uagugacugaugccuguaauc

SEQ ID NO: 224514 - RNA, 32 nt, Human
uagugacuucuccaccaagcuggagaaggauu

SEQ ID NO: 224515 - RNA, 32 nt, Human
uagugacuugacugagaaguuaggguagaaaa

SEQ ID NO: 224516 - RNA, 32 nt, Human
uagugagaaagagggaaggaauagaacgagga

SEQ ID NO: 224517 - RNA, 32 nt, Human
uagugagaauauagccucccaccccauuaacu

SEQ ID NO: 224518 - RNA, 23 nt, Human
uagugagacccaauuucuacaaa

SEQ ID NO: 224519 - RNA, 23 nt, Human
uagugagaccccaucccuauaaa

SEQ ID NO: 224520 - RNA, 21 nt, Human
uagugagaccccaucucuaca

SEQ ID NO: 224521 - RNA, 22 nt, Human
uagugagaccccaucucuacaa

SEQ ID NO: 224522 - RNA, 23 nt, Human
uagugagaccccaucucuacaaa

SEQ ID NO: 224523 - RNA, 23 nt, Human
uagugagaccccauuucuacaaa

SEQ ID NO: 224524 - RNA, 23 nt, Human
uagugagacccccaucucuacaa

SEQ ID NO: 224525 - RNA, 24 nt, Human
uagugagacccccaucucuacaaa

SEQ ID NO: 224526 - RNA, 24 nt, Human
uagugagacccccuaucucuacaa

SEQ ID NO: 224527 - RNA, 23 nt, Human
uagugagaccccgucuaugcaaa

SEQ ID NO: 224528 - RNA, 23 nt, Human
uagugagacccuaucucuacaaa

SEQ ID NO: 224529 - RNA, 23 nt, Human
uagugagacccuauuucuacaaa

SEQ ID NO: 224530 - RNA, 23 nt, Human
uagugagacccuguaucuacaaa

SEQ ID NO: 224531 - RNA, 23 nt, Human
uagugagacccugucucuacaaa

SEQ ID NO: 224532 - RNA, 24 nt, Human
uagugagacccugucucuagcaaa

SEQ ID NO: 224533 - RNA, 23 nt, Human
uagugagacccuuucucuacaaa

SEQ ID NO: 224534 - RNA, 23 nt, Human
uagugagaccuuggcgcuacaaa

SEQ ID NO: 224535 - RNA, 32 nt, Human
uagugagacuuucccagcauguuucuaccaaa

SEQ ID NO: 224536 - RNA, 32 nt, Human
uagugagaucccgucuccgaagaaaagauaug

SEQ ID NO: 224537 - RNA, 32 nt, Human
uagugagauguaugcaguauguggccauguuu

SEQ ID NO: 224538 - RNA, 32 nt, Human
uagugagccaagauccagccugggcgacagag

SEQ ID NO: 224539 - RNA, 32 nt, Human
uagugagcggagggacaggaaggguagggcaa

SEQ ID NO: 224540 - RNA, 32 nt, Human
uagugagcguaugacacacacagccauacggu

SEQ ID NO: 224541 - RNA, 32 nt, Human
uagugaggaaaugacugucgggugugcgggua

SEQ ID NO: 224542 - RNA, 32 nt, Human
uagugagggagagugucucuguucuuuugcuc

SEQ ID NO: 224543 - RNA, 32 nt, Human
uagugagggcaagugggcugcacuccuuucuc

SEQ ID NO: 224544 - RNA, 32 nt, Human
uagugaggguauaaaguguaagcaucaguuaa

SEQ ID NO: 224545 - RNA, 32 nt, Human
uagugaggugaggcugagaaagaaaaagcccg

SEQ ID NO: 224546 - RNA, 32 nt, Human
uagugagguuuacauuuucaggaauuuaaguu

SEQ ID NO: 224547 - RNA, 32 nt, Human
uagugaguuucuuggugugaugccauuuuuau

SEQ ID NO: 224548 - RNA, 32 nt, Human
uagugauaaucccaccacccuuugcugacucu

SEQ ID NO: 224549 - RNA, 32 nt, Human
uagugauagcuggacacacaaggaauucacaa

SEQ ID NO: 224550 - RNA, 32 nt, Human
uagugauccccuccucuucacccccagggcag

SEQ ID NO: 224551 - RNA, 32 nt, Human
uagugaugaaauuuuucuuugagaacuggcaa

SEQ ID NO: 224552 - RNA, 32 nt, Human
uagugaugagcuucacccuggagcuccucccg

SEQ ID NO: 224553 - RNA, 30 nt, Human
uagugaugcugaugcugcugguccggggaa

SEQ ID NO: 224554 - RNA, 32 nt, Human
uagugauggagagcagagggagagggccaggc

SEQ ID NO: 224555 - RNA, 32 nt, Human
uagugauggaugaacucucuuaucucuggcuu

SEQ ID NO: 224556 - RNA, 32 nt, Human
uagugaugggaguauguguagcuuugauuugg

SEQ ID NO: 224557 - RNA, 32 nt, Human
uagugauguggagcaccuuuucauauacuuaa

SEQ ID NO: 224558 - RNA, 32 nt, Human
uagugauguuguuugggagagugcaguaguaa

SEQ ID NO: 224559 - RNA, 32 nt, Human
uagugauucauaccucuaaugcuagcacuuuu

SEQ ID NO: 224560 - RNA, 32 nt, Human
uagugcaacaguaacccaaaaaugucaaugaa

SEQ ID NO: 224561 - RNA, 32 nt, Human
uagugcaacuacuaccuuggugccucaguuua

SEQ ID NO: 224562 - RNA, 32 nt, Human
uagugcaaucacagcugacugcagccuugacc

SEQ ID NO: 224563 - RNA, 32 nt, Human
uagugcacagugacuuuucuguuucuuaucac

SEQ ID NO: 224564 - RNA, 23 nt, Human
uagugcaccugaagggguccaca

SEQ ID NO: 224565 - RNA, 32 nt, Human
uagugcagaagcuuccaggcuguagagcccug

SEQ ID NO: 224566 - RNA, 32 nt, Human
uagugcagacacaccucagaguccugagcagg

SEQ ID NO: 224567 - RNA, 32 nt, Human
uagugcagagaagccagucaccauagaaggca

SEQ ID NO: 224568 - RNA, 32 nt, Human
uagugcagaguguuuagagaucacucaguuuu

SEQ ID NO: 224569 - RNA, 32 nt, Human
uagugcagccacuccugggggcuguggggaag

SEQ ID NO: 224570 - RNA, 32 nt, Human
uagugcagccucccucuccuccugaugacuuu

SEQ ID NO: 224571 - RNA, 32 nt, Human
uagugcagcuguggguggaggcuggggugucu

SEQ ID NO: 224572 - RNA, 32 nt, Human
uagugcaggguuugccuugaaaccauuacauu

SEQ ID NO: 224573 - RNA, 21 nt, Human
uagugcauauuuuuuauagua

SEQ ID NO: 224574 - RNA, 32 nt, Human
uagugcaugaaugaaugagucaugggcagugg

SEQ ID NO: 224575 - RNA, 32 nt, Human
uagugcaugccuguaaucccagcuacucagga

SEQ ID NO: 224576 - RNA, 32 nt, Human
uagugcaugccuguaaucccagcuacuuggga

SEQ ID NO: 224577 - RNA, 32 nt, Human
uagugcaugccuguagucccagcuaccuggga

SEQ ID NO: 224578 - RNA, 32 nt, Human
uagugcaugccuguagucccagcuacuuggga

SEQ ID NO: 224579 - RNA, 32 nt, Human
uagugcaugguguguggugcccccagggcucc

SEQ ID NO: 224580 - RNA, 32 nt, Human
uagugccaaggugggugcaagagugaacaaag

SEQ ID NO: 224581 - RNA, 32 nt, Human
uagugccacagcucuccagccugggcgacaga

SEQ ID NO: 224582 - RNA, 32 nt, Human
uagugccaccacaagcuuauggcaucucauug

SEQ ID NO: 224583 - RNA, 32 nt, Human
uagugccacugcaauucagccugggugacaua

SEQ ID NO: 224584 - RNA, 32 nt, Human
uagugccacugcacuacagcccgggcgacaga

SEQ ID NO: 224585 - RNA, 32 nt, Human
uagugccacugcacuccagccugggcaacaca

SEQ ID NO: 224586 - RNA, 32 nt, Human
uagugccacugcacuccagccugggugacaga

SEQ ID NO: 224587 - RNA, 32 nt, Human
uagugccacugcacuucagccugggugacaga

SEQ ID NO: 224588 - RNA, 32 nt, Human
uagugccacugcacuucagcuugggcaacaga

SEQ ID NO: 224589 - RNA, 32 nt, Human
uagugccacugcauuccggccugggcgacaga

SEQ ID NO: 224590 - RNA, 32 nt, Human
uagugccacugugcuccagccuggaugacgga

SEQ ID NO: 224591 - RNA, 32 nt, Human
uagugccagcauuuugggaggcugaagcaggc

SEQ ID NO: 224592 - RNA, 32 nt, Human
uagugccagcuacucaggaggcugaggcagga

SEQ ID NO: 224593 - RNA, 32 nt, Human
uagugccagcucuccccuaaaaguuccagcuc

SEQ ID NO: 224594 - RNA, 32 nt, Human
uagugccagcugcuugggaggcugaggugagg

SEQ ID NO: 224595 - RNA, 32 nt, Human
uagugccaggauucaggaaaauggcucccuua

SEQ ID NO: 224596 - RNA, 32 nt, Human
uagugccagucaccaaagaaggccuggaacuu

SEQ ID NO: 224597 - RNA, 32 nt, Human
uagugccaucgcacuccagccuggacaacaga

SEQ ID NO: 224598 - RNA, 32 nt, Human
uagugccauugcacuccggccugggcaacaga

SEQ ID NO: 224599 - RNA, 32 nt, Human
uagugccauuguacuccagcuugggcaacaga

SEQ ID NO: 224600 - RNA, 32 nt, Human
uagugcccagcccucuguugaaaaagagaacu

SEQ ID NO: 224601 - RNA, 32 nt, Human
uagugccccaggaaaccuggagguuccacucc

SEQ ID NO: 224602 - RNA, 32 nt, Human
uagugcccccucuaacccccagugccacagag

SEQ ID NO: 224603 - RNA, 32 nt, Human
uagugcccuagguuggugacagaagggacaga

SEQ ID NO: 224604 - RNA, 31 nt, Human
uagugcccucucucugggcccagggcugugg

SEQ ID NO: 224605 - RNA, 32 nt, Human
uagugcccugucucccugucucuagaagccuu

SEQ ID NO: 224606 - RNA, 32 nt, Human
uagugcccuugcaagagccuuuaacuuggcgg

SEQ ID NO: 224607 - RNA, 32 nt, Human
uagugccgcugcacuccauucugggcaagagc

SEQ ID NO: 224608 - RNA, 32 nt, Human
uagugccggcuacucaggaggcugaggcacaa

SEQ ID NO: 224609 - RNA, 32 nt, Human
uagugccuacggcaugggucagcucuuucugc

SEQ ID NO: 224610 - RNA, 32 nt, Human
uagugccuccuggaccuaaggggccucccuca

SEQ ID NO: 224611 - RNA, 32 nt, Human
uagugccucuacugaauuauuccucuuuuaaa

SEQ ID NO: 224612 - RNA, 32 nt, Human
uagugccucugcacuccagccugcgugacaaa

SEQ ID NO: 224613 - RNA, 32 nt, Human
uagugccuucuggaccuaaggggccucccuca

SEQ ID NO: 224614 - RNA, 32 nt, Human
uagugcgggccugggcccugcuccaccuccag

SEQ ID NO: 224615 - RNA, 32 nt, Human
uagugcuaagaggaucuccuguccaucagcca

SEQ ID NO: 224616 - RNA, 32 nt, Human
uagugcuagcuacucagaaggcugagguggga

SEQ ID NO: 224617 - RNA, 32 nt, Human
uagugcuauuauagugaaaaacucaguucuau

SEQ ID NO: 224618 - RNA, 32 nt, Human
uagugcuccaagucuaggaacucccucagauc

SEQ ID NO: 224619 - RNA, 32 nt, Human
uagugcucccuucacuauccugugccuuccuc

SEQ ID NO: 224620 - RNA, 32 nt, Human
uagugcucucagucuucauaccccagaaauua

SEQ ID NO: 224621 - RNA, 32 nt, Human
uagugcugaauguuuauuguaaaagagagucu

SEQ ID NO: 224622 - RNA, 32 nt, Human
uagugcugacauauauucagaguguuguaguu

SEQ ID NO: 224623 - RNA, 32 nt, Human
uagugcugcagugaacauacacaugcuuguau

SEQ ID NO: 224624 - RNA, 32 nt, Human
uagugcugcuggcccagcugagcuccaccuag

SEQ ID NO: 224625 - RNA, 32 nt, Human
uagugcugggauuacaggcaugagccaccuca

SEQ ID NO: 224626 - RNA, 32 nt, Human
uagugcugggauuacaggugugagccaccgca

SEQ ID NO: 224627 - RNA, 32 nt, Human
uagugcuggguguggagugaggcaccacccuu

SEQ ID NO: 224628 - RNA, 32 nt, Human
uagugcuucaaagcuccugggacaccuccagu

SEQ ID NO: 224629 - RNA, 32 nt, Human
uagugcuugcucccccugccuugucccaccag

SEQ ID NO: 224630 - RNA, 32 nt, Human
uagugcuugugagguucauccagguugcugua

SEQ ID NO: 224631 - RNA, 32 nt, Human
uagugcuuugugaucaaugaucuuugauguua

SEQ ID NO: 224632 - RNA, 32 nt, Human
uaguggaaagaguuaagagcaagauggaauga

SEQ ID NO: 224633 - RNA, 32 nt, Human
uaguggaaagucaggcuagcugugcugguauu

SEQ ID NO: 224634 - RNA, 32 nt, Human
uaguggaacccucuuuucccccuagaagaacc

SEQ ID NO: 224635 - RNA, 32 nt, Human
uaguggaaccgggguuucaccauguuggccag

SEQ ID NO: 224636 - RNA, 32 nt, Human
uaguggaacuccaggaaguauaaccuuuucag

SEQ ID NO: 224637 - RNA, 32 nt, Human
uaguggaagagcucagggaagagccaguggag

SEQ ID NO: 224638 - RNA, 32 nt, Human
uaguggaagagguaguaagcaccagcugccuc

SEQ ID NO: 224639 - RNA, 32 nt, Human
uaguggacacacuggaauaaugcugagaaauu

SEQ ID NO: 224640 - RNA, 32 nt, Human
uaguggacagagaagacucuuggccaggcaga

SEQ ID NO: 224641 - RNA, 32 nt, Human
uaguggacauggucacaguccuauguacagag

SEQ ID NO: 224642 - RNA, 32 nt, Human
uaguggacauuuacagaacagaugcacccgau

SEQ ID NO: 224643 - RNA, 31 nt, Human
uaguggagaagaugaaaaggcauucauugcc

SEQ ID NO: 224644 - RNA, 32 nt, Human
uaguggagaaggagcaaugcugaggggugagg

SEQ ID NO: 224645 - RNA, 32 nt, Human
uaguggagacaagcaguuaaccuagcaccauc

SEQ ID NO: 224646 - RNA, 32 nt, Human
uaguggagacaggauuuuaccauguuggccag

SEQ ID NO: 224647 - RNA, 32 nt, Human
uaguggagacgggauuucaccauguuggccau

SEQ ID NO: 224648 - RNA, 32 nt, Human
uaguggagacgggguuucaccaugcuggccag

SEQ ID NO: 224649 - RNA, 32 nt, Human
uaguggagacgggguuucaccauguuggccag

SEQ ID NO: 224650 - RNA, 32 nt, Human
uaguggagacgggguuucaccauguuggcuaa

SEQ ID NO: 224651 - RNA, 32 nt, Human
uaguggagacgggguuucaccauguuggucag

SEQ ID NO: 224652 - RNA, 32 nt, Human
uaguggagacgggguuucaccauguuguccag

SEQ ID NO: 224653 - RNA, 32 nt, Human
uaguggagacgggguuucaccguguuagccag

SEQ ID NO: 224654 - RNA, 32 nt, Human
uaguggagacgggguuucuccaugucggucag

SEQ ID NO: 224655 - RNA, 32 nt, Human
uaguggagacgggguuucuccauguuggucag

SEQ ID NO: 224656 - RNA, 32 nt, Human
uaguggagagggagcaagggaggccgcagagg

SEQ ID NO: 224657 - RNA, 32 nt, Human
uaguggagaggggguuucaccauguuggccag

SEQ ID NO: 224658 - RNA, 32 nt, Human
uaguggagauaggguuucacaauguuggccau

SEQ ID NO: 224659 - RNA, 32 nt, Human
uaguggagaugcgguuucaccauguuggccgg

SEQ ID NO: 224660 - RNA, 32 nt, Human
uaguggagaugcgguuucaccauguuggcugg

SEQ ID NO: 224661 - RNA, 32 nt, Human
uaguggagaugcuuacacauugucaaacauau

SEQ ID NO: 224662 - RNA, 32 nt, Human
uaguggagauggcguuuuaccauguuggucag

SEQ ID NO: 224663 - RNA, 32 nt, Human
uaguggagauggggugucaccauguuggccag

SEQ ID NO: 224664 - RNA, 32 nt, Human
uaguggagaugggguuucacaauguuggccag

SEQ ID NO: 224665 - RNA, 32 nt, Human
uaguggagaugggguuucaccauguuagccag

SEQ ID NO: 224666 - RNA, 32 nt, Human
uaguggagaugggguuucaccauguuggccag

SEQ ID NO: 224667 - RNA, 32 nt, Human
uaguggagaugggguuucacuguguuggccag

SEQ ID NO: 224668 - RNA, 32 nt, Human
uaguggagaugggguuucuccauauuggucag

SEQ ID NO: 224669 - RNA, 32 nt, Human
uaguggagaugggguuuuaccauguuggccag

SEQ ID NO: 224670 - RNA, 32 nt, Human
uaguggagaugggguuuugucauguuggccag

SEQ ID NO: 224671 - RNA, 32 nt, Human
uaguggagaugguguuucaccauguuggccag

SEQ ID NO: 224672 - RNA, 32 nt, Human
uaguggagcccaaaacaggccucauucccuac

SEQ ID NO: 224673 - RNA, 32 nt, Human
uaguggagcugcucaaccaccugcccagagcu

SEQ ID NO: 224674 - RNA, 32 nt, Human
uaguggagggagagaggacuuaagucagaugg

SEQ ID NO: 224675 - RNA, 32 nt, Human
uaguggaggugggauuuugccauguuggccag

SEQ ID NO: 224676 - RNA, 32 nt, Human
uaguggagugggaagaguugagacugaaaguu

SEQ ID NO: 224677 - RNA, 32 nt, Human
uaguggaucacuguuaggguaagggaauguau

SEQ ID NO: 224678 - RNA, 32 nt, Human
uaguggaucagugucuuucaaugaugugacug

SEQ ID NO: 224679 - RNA, 32 nt, Human
uaguggaugggguuucuguuguaucuuguggg

SEQ ID NO: 224680 - RNA, 32 nt, Human
uaguggaugguuggcaggauuaguagguucua

SEQ ID NO: 224681 - RNA, 31 nt, Human
uaguggauguaugguagauggguugaagcuu

SEQ ID NO: 224682 - RNA, 32 nt, Human
uaguggauuacugccauucacuucauaaucca

SEQ ID NO: 224683 - RNA, 32 nt, Human
uaguggauuugggaaagguucuuaaguagauc

SEQ ID NO: 224684 - RNA, 32 nt, Human
uaguggcaaaguccucugucaguaaacucuuu

SEQ ID NO: 224685 - RNA, 32 nt, Human
uaguggcaaccuugccuuccugaccucagcgg

SEQ ID NO: 224686 - RNA, 32 nt, Human
uaguggcaccgccuccccaccuccaggcuuuc

SEQ ID NO: 224687 - RNA, 32 nt, Human
uaguggcagccaugguucaucuguggguguuc

SEQ ID NO: 224688 - RNA, 32 nt, Human
uaguggcaggcaggagagagcaugugcagggg

SEQ ID NO: 224689 - RNA, 32 nt, Human
uaguggcaugaucauagaucacugcagccuca

SEQ ID NO: 224690 - RNA, 32 nt, Human
uaguggccaagcaugggcucuaccccucugcg

SEQ ID NO: 224691 - RNA, 32 nt, Human
uaguggccaucucauaccuacucugaaaugca

SEQ ID NO: 224692 - RNA, 32 nt, Human
uaguggcccugacuuccggucggcuggccagc

SEQ ID NO: 224693 - RNA, 32 nt, Human
uaguggccuaaagaagucugaaguggcugaug

SEQ ID NO: 224694 - RNA, 32 nt, Human
uaguggcgccugccuuuaguccuaguuacuug

SEQ ID NO: 224695 - RNA, 21 nt, Human
uaguggcucacgccuguaauc

SEQ ID NO: 224696 - RNA, 32 nt, Human
uaguggcugccaguguggcacauuuaugucaa

SEQ ID NO: 224697 - RNA, 32 nt, Human
uaguggcugggaaaaggggugugcgaggggaa

SEQ ID NO: 224698 - RNA, 32 nt, Human
uaguggcugggagcuugccaggaacccagugg

SEQ ID NO: 224699 - RNA, 32 nt, Human
uaguggcugucaucccagcacuuuaggaggcc

SEQ ID NO: 224700 - RNA, 21 nt, Human
uaguggcuuaugccuguaauc

SEQ ID NO: 224701 - RNA, 32 nt, Human
uaguggcuucaaaggcccagcugacacccucc

SEQ ID NO: 224702 - RNA, 32 nt, Human
uaguggcuucagauuggagaccagccugggac

SEQ ID NO: 224703 - RNA, 32 nt, Human
uaguggcuuucauuaaauacuugcuguaaagu

SEQ ID NO: 224704 - RNA, 32 nt, Human
uagugggaggggcagcaggcccaaaccccaac

SEQ ID NO: 224705 - RNA, 32 nt, Human
uagugggauagcacuugugaauagccacugca

SEQ ID NO: 224706 - RNA, 32 nt, Human
uagugggauuacaggugcccgcuacuaugccc

SEQ ID NO: 224707 - RNA, 32 nt, Human
uagugggauuucaggcaugaccaccuggccua

SEQ ID NO: 224708 - RNA, 32 nt, Human
uagugggcagucaccuuccaaccggggacagu

SEQ ID NO: 224709 - RNA, 32 nt, Human
uagugggccagaaaaaucagucucugguccca

SEQ ID NO: 224710 - RNA, 32 nt, Human
uagugggccauucucauuugauguucccuaga

SEQ ID NO: 224711 - RNA, 32 nt, Human
uagugggccuucgggggcucuacugacguccc

SEQ ID NO: 224712 - RNA, 32 nt, Human
uagugggcugagaagaggggacuaggaagggc

SEQ ID NO: 224713 - RNA, 32 nt, Human
uaguggggagggcugaacaggacaaccucuca

SEQ ID NO: 224714 - RNA, 32 nt, Human
uaguggggaugggguuucaccauguuggccag

SEQ ID NO: 224715 - RNA, 32 nt, Human
uaguggggaugggguuucaucauguuggccag

SEQ ID NO: 224716 - RNA, 32 nt, Human
uaguggggaugggguuuuaccauguuggccag

SEQ ID NO: 224717 - RNA, 32 nt, Human
uaguggggcagcucucuuccucauguuauaac

SEQ ID NO: 224718 - RNA, 32 nt, Human
uagugggggaccuggccccugaggcaguggcg

SEQ ID NO: 224719 - RNA, 32 nt, Human
uagugggggaggcggcggcagcguuaagugag

SEQ ID NO: 224720 - RNA, 32 nt, Human
uagugggucauuggccaucuccgccugccuaa

SEQ ID NO: 224721 - RNA, 32 nt, Human
uagugggugccuguaaucccagcuacuuggga

SEQ ID NO: 224722 - RNA, 32 nt, Human
uagugggugccuguagucccagcuacuuggga

SEQ ID NO: 224723 - RNA, 32 nt, Human
uaguggguggcuaaguccagcccacacuggag

SEQ ID NO: 224724 - RNA, 32 nt, Human
uaguggguuaucuuuuccaaggaacagguuug

SEQ ID NO: 224725 - RNA, 32 nt, Human
uaguggguucccaucacuccaugaggucacug

SEQ ID NO: 224726 - RNA, 32 nt, Human
uagugguagauucaaagcuccacccaccucau

SEQ ID NO: 224727 - RNA, 32 nt, Human
uaguggucauggacagcuaagacugagcauag

SEQ ID NO: 224728 - RNA, 24 nt, Human
uaguggucuaagcuccucccaggg

SEQ ID NO: 224729 - RNA, 32 nt, Human
uaguggucugacauauacuggaaauguaugua

SEQ ID NO: 224730 - RNA, 32 nt, Human
uaguggugaacaagacagacuugguccaagcu

SEQ ID NO: 224731 - RNA, 32 nt, Human
uaguggugaacucagauaacaaacuucccuuc

SEQ ID NO: 224732 - RNA, 32 nt, Human
uagugguggaaagaagaggcagagaggucguc

SEQ ID NO: 224733 - RNA, 32 nt, Human
uagugguggagcuguggggcugugggauacug

SEQ ID NO: 224734 - RNA, 32 nt, Human
uaguggugguaguuuguuuuguuucauaucau

SEQ ID NO: 224735 - RNA, 32 nt, Human
uaguggugugaucacagcucacugcagccuug

SEQ ID NO: 224736 - RNA, 32 nt, Human
uagugguuaacauuuagcaccuugguugucuu

SEQ ID NO: 224737 - RNA, 32 nt, Human
uagugguuaagcauuccuuucucuucagugcc

SEQ ID NO: 224738 - RNA, 32 nt, Human
uagugguuaugcccuguacuaccauuuugagg

SEQ ID NO: 224739 - RNA, 21 nt, Human
uagugguucaugccuguaauc

SEQ ID NO: 224740 - RNA, 32 nt, Human
uagugguuucccuggaaguggcagcagcagug

SEQ ID NO: 224741 - RNA, 32 nt, Human
uagugguuuuucucuagcuuuuugccagaaca

SEQ ID NO: 224742 - RNA, 32 nt, Human
uaguguaacauacuccccacagucuacuuuua

SEQ ID NO: 224743 - RNA, 32 nt, Human
uaguguacauucuucuuaaaguccacaacagc

SEQ ID NO: 224744 - RNA, 32 nt, Human
uaguguagacauacccuucaucuauuauauca

SEQ ID NO: 224745 - RNA, 32 nt, Human
uaguguagcaucuggggagacagcaggaucac

SEQ ID NO: 224746 - RNA, 31 nt, Human
uaguguaugagcggcaccagcaccccggcca

SEQ ID NO: 224747 - RNA, 32 nt, Human
uagugucacaguuuggcauuggugcucucugc

SEQ ID NO: 224748 - RNA, 32 nt, Human
uagugucacauucugaggggcagcccugugcc

SEQ ID NO: 224749 - RNA, 32 nt, Human
uagugucacccaggcuggagugcagugaucca

SEQ ID NO: 224750 - RNA, 32 nt, Human
uaguguccagucagcugagcuccacccugaug

SEQ ID NO: 224751 - RNA, 32 nt, Human
uaguguccuacaugggguugugaagcgaugga

SEQ ID NO: 224752 - RNA, 32 nt, Human
uagugucuagucugcagagagcugugugauua

SEQ ID NO: 224753 - RNA, 32 nt, Human
uagugucuccuuccuaaagagcacuuuuguau

SEQ ID NO: 224754 - RNA, 32 nt, Human
uagugucugcugcccuccuccuggccucccag

SEQ ID NO: 224755 - RNA, 32 nt, Human
uagugucuugugcucaccaagaggcucacggg

SEQ ID NO: 224756 - RNA, 32 nt, Human
uagugugaacccaggaggcggagcuugcagug

SEQ ID NO: 224757 - RNA, 32 nt, Human
uagugugaagaaaugggagggagcaggaugga

SEQ ID NO: 224758 - RNA, 32 nt, Human
uagugugacugcacacaucugggcucuaaaug

SEQ ID NO: 224759 - RNA, 32 nt, Human
uagugugagccacauaugugacuuuaaauuuu

SEQ ID NO: 224760 - RNA, 32 nt, Human
uagugugaucauagcucacugcagccucaaac

SEQ ID NO: 224761 - RNA, 32 nt, Human
uagugugauguaucacaaauugugcugagguu

SEQ ID NO: 224762 - RNA, 32 nt, Human
uagugugauuaggacuccacuuuccuuuguca

SEQ ID NO: 224763 - RNA, 32 nt, Human
uagugugcaagacucugggacggcaugagaaa

SEQ ID NO: 224764 - RNA, 32 nt, Human
uagugugcagagcggugguuugagacuaaaua

SEQ ID NO: 224765 - RNA, 32 nt, Human
uagugugcuaagcugagcagugcagugugaac

SEQ ID NO: 224766 - RNA, 32 nt, Human
uagugugcucccugccccagacuuuugccuuc

SEQ ID NO: 224767 - RNA, 32 nt, Human
uagugugcuuuccuuucuuuacuauguuucuc

SEQ ID NO: 224768 - RNA, 32 nt, Human
uaguguggagugaggcggggagcaugaagaua

SEQ ID NO: 224769 - RNA, 32 nt, Human
uaguguggccaagagcaggguuuucuuuuugu

SEQ ID NO: 224770 - RNA, 32 nt, Human
uaguguggccagggccugguggccugguggcc

SEQ ID NO: 224771 - RNA, 32 nt, Human
uaguguggccccugccccuuguugggcaggag

SEQ ID NO: 224772 - RNA, 32 nt, Human
uagugugucagaguaacaugccagcuuccugu

SEQ ID NO: 224773 - RNA, 32 nt, Human
uagugugugauguauaugugugugauguauac

SEQ ID NO: 224774 - RNA, 21 nt, Human
uagugugugcagugucuucgg

SEQ ID NO: 224775 - RNA, 32 nt, Human
uagugugugucacaauucugagguuuucgcag

SEQ ID NO: 224776 - RNA, 32 nt, Human
uaguguuaacucugcauuuuuacagcguagca

SEQ ID NO: 224777 - RNA, 32 nt, Human
uaguguuaggggcggugguggaggugggauca

SEQ ID NO: 224778 - RNA, 32 nt, Human
uaguguuaucaaagcaaaaagaaaaugcugca

SEQ ID NO: 224779 - RNA, 32 nt, Human
uaguguucauaagagaccuggccacaugugca

SEQ ID NO: 224780 - RNA, 32 nt, Human
uaguguucccucucauccccaggguucguccc

SEQ ID NO: 224781 - RNA, 32 nt, Human
uaguguucccuggccucccugccaucagguug

SEQ ID NO: 224782 - RNA, 32 nt, Human
uaguguucguuugucgagaggauuuccugaga

SEQ ID NO: 224783 - RNA, 32 nt, Human
uaguguugacuacugguuaccuuaaaguauuc

SEQ ID NO: 224784 - RNA, 29 nt, Human
uaguguugcccaggcuggagugcaguggc

SEQ ID NO: 224785 - RNA, 32 nt, Human
uaguguugcuuuccuugugcuuuccuuguggu

SEQ ID NO: 224786 - RNA, 32 nt, Human
uaguguuggcccagagugugguuacugcccug

SEQ ID NO: 224787 - RNA, 31 nt, Human
uaguguuggguggaggauggacgagugagcu

SEQ ID NO: 224788 - RNA, 32 nt, Human
uaguguugguguagcacagaagaaagaccugu

SEQ ID NO: 224789 - RNA, 32 nt, Human
uaguguuuagaacuuaggcuggaaaaccauau

SEQ ID NO: 224790 - RNA, 32 nt, Human
uaguguuucgcuucucagccuuugccaucucc

SEQ ID NO: 224791 - RNA, 32 nt, Human
uaguguuucugugggcuaaggguuguagcucu

SEQ ID NO: 224792 - RNA, 32 nt, Human
uaguguuuucucagaaucagcaacucaaggua

SEQ ID NO: 224793 - RNA, 32 nt, Human
uaguguuuuggcuucuguacugcuuaugguug

SEQ ID NO: 224794 - RNA, 32 nt, Human
uaguuaaaagagagugggucucuguggcuuuc

SEQ ID NO: 224795 - RNA, 32 nt, Human
uaguuaaaagcccauugccauuuggucuggau

SEQ ID NO: 224796 - RNA, 32 nt, Human
uaguuaaaagcccauugccauuugguguggau

SEQ ID NO: 224797 - RNA, 32 nt, Human
uaguuaacaucaugaauggacuucuuaagcug

SEQ ID NO: 224798 - RNA, 32 nt, Human
uaguuaaccagaggggcuuccuuuguauguua

SEQ ID NO: 224799 - RNA, 32 nt, Human
uaguuaagagcuaagagcaguacucugaagga

SEQ ID NO: 224800 - RNA, 32 nt, Human
uaguuaagauucacaaucuuuagaaagaauga

SEQ ID NO: 224801 - RNA, 32 nt, Human
uaguuaagcacaaaggaaaauauuucaauaaa

SEQ ID NO: 224802 - RNA, 31 nt, Human
uaguuaagugagagugugaacuguguggcaa

SEQ ID NO: 224803 - RNA, 32 nt, Human
uaguuaaucuuagauguaagguuccagaaugu

SEQ ID NO: 224804 - RNA, 32 nt, Human
uaguuaauuggguuuguccucugcugacuguu

SEQ ID NO: 224805 - RNA, 32 nt, Human
uaguuacaacaacacugagcaucuugaccaag

SEQ ID NO: 224806 - RNA, 32 nt, Human
uaguuacaacccaguaugcugagugccaaggc

SEQ ID NO: 224807 - RNA, 31 nt, Human
uaguuacaacucaaggauuuugguagaaagg

SEQ ID NO: 224808 - RNA, 32 nt, Human
uaguuacagcgccuccgucucucuccauugug

SEQ ID NO: 224809 - RNA, 32 nt, Human
uauggauuacuuugaaacuuagcaaugagagu

SEQ ID NO: 224810 - RNA, 32 nt, Human
uauggauuaugugaaagagcccagggacauua

SEQ ID NO: 224811 - RNA, 32 nt, Human
uauggauucaaagagauucugucuuaccggug

SEQ ID NO: 224812 - RNA, 32 nt, Human
uauggauucugucaguucaucaugucagauuc

SEQ ID NO: 224813 - RNA, 32 nt, Human
uauggauuuaaacauuagagcuggaguggggc

SEQ ID NO: 224814 - RNA, 32 nt, Human
uauggcaaauauagcgaaaucucuccacugcc

SEQ ID NO: 224815 - RNA, 32 nt, Human
uauggcaaaucaggaagcagcaauacaagcuu

SEQ ID NO: 224816 - RNA, 32 nt, Human
uauggcaaaugagauuuuguacauggaguuga

SEQ ID NO: 224817 - RNA, 32 nt, Human
uauggcaacuggaaaguauuuacuaugggauu

SEQ ID NO: 224818 - RNA, 32 nt, Human
uauggcaacuuuaauugaacauguggaagacc

SEQ ID NO: 224819 - RNA, 32 nt, Human
uauggcaagaaagaguggaagcacuucuuguc

SEQ ID NO: 224820 - RNA, 32 nt, Human
uauggcaagcugccccacaaagggcuaugccu

SEQ ID NO: 224821 - RNA, 32 nt, Human
uauggcacaaauguucaggaguguauauaaaa

SEQ ID NO: 224822 - RNA, 32 nt, Human
uauggcagaggccacagccacuguggggcacc

SEQ ID NO: 224823 - RNA, 32 nt, Human
uauggcaggaagccacugacaugugggagccg

SEQ ID NO: 224824 - RNA, 32 nt, Human
uauggcaggagcagcugggaugcagggcacca

SEQ ID NO: 224825 - RNA, 32 nt, Human
uauggcagguaaucacuugucauccaaagaau

SEQ ID NO: 224826 - RNA, 32 nt, Human
uauggcagguucuaugcagauugugccagagc

SEQ ID NO: 224827 - RNA, 18 nt, Human
uauggcaucugcugucuu

SEQ ID NO: 224828 - RNA, 32 nt, Human
uauggccaaacagaaagcucagcaggccaugu

SEQ ID NO: 224829 - RNA, 32 nt, Human
uauggccaacaugguaagacccugucucuacu

SEQ ID NO: 224830 - RNA, 32 nt, Human
uauggccaaucagcugagggugucaugugaug

SEQ ID NO: 224831 - RNA, 32 nt, Human
uauggccaggaucagggguacagauggcucgu

SEQ ID NO: 224832 - RNA, 32 nt, Human
uauggccaggaucgugucugggaaccagaaac

SEQ ID NO: 224833 - RNA, 32 nt, Human
uauggcccaaguggcagagcaacuugcacaac

SEQ ID NO: 224834 - RNA, 32 nt, Human
uauggcccaggagaaaauguagacccugagaa

SEQ ID NO: 224835 - RNA, 32 nt, Human
uauggccccaaacugaaaacacccuggaagcc

SEQ ID NO: 224836 - RNA, 32 nt, Human
uauggccucagcugccucacuuccuacaagag

SEQ ID NO: 224837 - RNA, 32 nt, Human
uauggccuccaccacacuagccuccuaaagcg

SEQ ID NO: 224838 - RNA, 32 nt, Human
uauggccuccaccacacuagccuccugaagcg

SEQ ID NO: 224839 - RNA, 32 nt, Human
uauggccucugcacuccagccugggugacaga

SEQ ID NO: 224840 - RNA, 32 nt, Human
uauggccugcuggcccaccucccuggaccccg

SEQ ID NO: 224841 - RNA, 32 nt, Human
uauggccugggugucauggcacagcuuagugg

SEQ ID NO: 224842 - RNA, 32 nt, Human
uauggccuguaugacccagcugcccauuucua

SEQ ID NO: 224843 - RNA, 32 nt, Human
uauggcggcuagugauacagagcgagauggac

SEQ ID NO: 224844 - RNA, 32 nt, Human
uauggcguauaucuugguucaucuucaaaauc

SEQ ID NO: 224845 - RNA, 32 nt, Human
uauggcuaguguuaauggcaaaaaguccuuuc

SEQ ID NO: 224846 - RNA, 32 nt, Human
uauggcuauuaaaauaauuauuagccuccugu

SEQ ID NO: 224847 - RNA, 32 nt, Human
uauggcucacugcaguuucaaccucccagauu

SEQ ID NO: 224848 - RNA, 32 nt, Human
uauggcucauuucuauguauuuuucuuacuuu

SEQ ID NO: 224849 - RNA, 32 nt, Human
uauggcuccuggcugcgucagccucccccacc

SEQ ID NO: 224850 - RNA, 32 nt, Human
uauggcucuguggcuggagugcagccauccag

SEQ ID NO: 224851 - RNA, 22 nt, Human
uauggcugcagugaauguggga

SEQ ID NO: 224852 - RNA, 32 nt, Human
uauggcugccacccucccuccugccugugucc

SEQ ID NO: 224853 - RNA, 32 nt, Human
uauggcugggcaggcacaggcagugaggccga

SEQ ID NO: 224854 - RNA, 32 nt, Human
uauggcuggucuuccauuugcuuuuucuuuaa

SEQ ID NO: 224855 - RNA, 32 nt, Human
uauggcuucaugaagucuuuuauguguuuuga

SEQ ID NO: 224856 - RNA, 32 nt, Human
uauggcuuccuauuucugugcgugucauccuu

SEQ ID NO: 224857 - RNA, 32 nt, Human
uauggcuuccuugauaugcucuugacagcucu

SEQ ID NO: 224858 - RNA, 32 nt, Human
uauggcuucuugagaaggcucacagcuguggu

SEQ ID NO: 224859 - RNA, 25 nt, Human
uaugggaaagcagagguugcaguga

SEQ ID NO: 224860 - RNA, 32 nt, Human
uaugggaagaauuccaguuguuaggaagagau

SEQ ID NO: 224861 - RNA, 32 nt, Human
uaugggaagcuucuugaacugcauuuacuauu

SEQ ID NO: 224862 - RNA, 32 nt, Human
uaugggaaugauaucuccuacuucacugaggu

SEQ ID NO: 224863 - RNA, 32 nt, Human
uaugggacaggugccaggugugugguggggac

SEQ ID NO: 224864 - RNA, 32 nt, Human
uaugggaccuugagucaugcaggaugggaucu

SEQ ID NO: 224865 - RNA, 32 nt, Human
uaugggagaaaccuuaugaauguaauaaaugu

SEQ ID NO: 224866 - RNA, 32 nt, Human
uaugggagaagcaggcuggggcuugaagccca

SEQ ID NO: 224867 - RNA, 32 nt, Human
uaugggagacacaccaacuacucuucaaauca

SEQ ID NO: 224868 - RNA, 32 nt, Human
uaugggagaugcuugcccauguguuucaucaa

SEQ ID NO: 224869 - RNA, 32 nt, Human
uaugggagcacaagcugaagcuuuagugccuu

SEQ ID NO: 224870 - RNA, 32 nt, Human
uaugggaggaaagcuccggaagaaggagaaac

SEQ ID NO: 224871 - RNA, 32 nt, Human
uaugggaggaauaggauauaagcaguugagga

SEQ ID NO: 224872 - RNA, 32 nt, Human
uaugggaggcugagagacugagggucuuucuu

SEQ ID NO: 224873 - RNA, 32 nt, Human
uaugggaggcuggagugcaauggugccaucuu

SEQ ID NO: 224874 - RNA, 32 nt, Human
uaugggagggagcaagaagggaaaggaugucu

SEQ ID NO: 224875 - RNA, 32 nt, Human
uaugggagugggcucuaugggguggucugcac

SEQ ID NO: 224876 - RNA, 32 nt, Human
uaugggaucucucaccuagucauuguauguug

SEQ ID NO: 224877 - RNA, 32 nt, Human
uaugggaugagaucaauaagccuacagagaug

SEQ ID NO: 224878 - RNA, 32 nt, Human
uaugggauggggaaugcauuucuucaguguuu

SEQ ID NO: 224879 - RNA, 32 nt, Human
uaugggauuagaaaauguccuuaccuuaaauc

SEQ ID NO: 224880 - RNA, 25 nt, Human
uaugggcaagcggagguugcaguga

SEQ ID NO: 224881 - RNA, 32 nt, Human
uaugggcacagagcaaauagcuucuuagacug

SEQ ID NO: 224882 - RNA, 32 nt, Human
uaugggcaucaguuggugggggugcgggggug

SEQ ID NO: 224883 - RNA, 32 nt, Human
uaugggccaggcuuugauaucugugaugugca

SEQ ID NO: 224884 - RNA, 32 nt, Human
uaugggccuaaauugggcucuaggucucuguc

SEQ ID NO: 224885 - RNA, 20 nt, Human
uaugggcgcccaccaccacg

SEQ ID NO: 224886 - RNA, 32 nt, Human
uaugggcgugaaccaccaugcccagccgaaaa

SEQ ID NO: 224887 - RNA, 32 nt, Human
uaugggcgugagccaccgugacuggccuguuu

SEQ ID NO: 224888 - RNA, 32 nt, Human
uaugggcuccugcgugaggccugugguacaca

SEQ ID NO: 224889 - RNA, 32 nt, Human
uaugggcucuacugccagugugaccucacccu

SEQ ID NO: 224890 - RNA, 32 nt, Human
uaugggcucuggggccauagagucuagguuug

SEQ ID NO: 224891 - RNA, 32 nt, Human
uaugggcugcugcagaggcggcuggagaacau

SEQ ID NO: 224892 - RNA, 32 nt, Human
uauggggaaaaccaggcaccagccucugcagc

SEQ ID NO: 224893 - RNA, 25 nt, Human
uauggggacacacaaccccuggaua

SEQ ID NO: 224894 - RNA, 32 nt, Human
uauggggacuuuauguugaaauauuguauaaa

SEQ ID NO: 224895 - RNA, 32 nt, Human
uauggggagaguauucauuauggcaggugucu

SEQ ID NO: 224896 - RNA, 32 nt, Human
uauggggagcaguuugggggcggccggcagca

SEQ ID NO: 224897 - RNA, 32 nt, Human
uauggggaggucuuguaacauuuuauucaggu

SEQ ID NO: 224898 - RNA, 24 nt, Human
uauggggcaggcaaugugugcgga

SEQ ID NO: 224899 - RNA, 32 nt, Human
uauggggcaggcagggucucaccugagccuca

SEQ ID NO: 224900 - RNA, 32 nt, Human
uauggggcucccagagugcaaaggacagugau

SEQ ID NO: 224901 - RNA, 32 nt, Human
uauggggcuuucuaaaacaauggucucuguuc

SEQ ID NO: 224902 - RNA, 32 nt, Human
uaugggggacuucuagcuuugugucuuguuuc

SEQ ID NO: 224903 - RNA, 32 nt, Human
uaugggggucauuccugccucuuggcaccagg

SEQ ID NO: 224904 - RNA, 32 nt, Human
uaugggguaaaagccccaggagcauacagaac

SEQ ID NO: 224905 - RNA, 32 nt, Human
uaugggguaccacgugagcugugugaggcugg

SEQ ID NO: 224906 - RNA, 32 nt, Human
uaugggguggucugcacccaucugggacucuu

SEQ ID NO: 224907 - RNA, 32 nt, Human
uaugggguuggagaggacaggagccagaagcu

SEQ ID NO: 224908 - RNA, 32 nt, Human
uauggguauauaagagggaauuuguuauggaa

SEQ ID NO: 224909 - RNA, 32 nt, Human
uauggguccugcccugcccucccaggagucca

SEQ ID NO: 224910 - RNA, 32 nt, Human
uaugggucucagucaauuuagaaaguuuauuu

SEQ ID NO: 224911 - RNA, 32 nt, Human
uaugggucuuuggaauagcaguaguuuuggaa

SEQ ID NO: 224912 - RNA, 32 nt, Human
uaugggugcaaacuagacauggggagugaagu

SEQ ID NO: 224913 - RNA, 32 nt, Human
uauggguggaagcagcacuuucugguuugacc

SEQ ID NO: 224914 - RNA, 32 nt, Human
uauggguggauguccucaggggccaagaagag

SEQ ID NO: 224915 - RNA, 31 nt, Human
uaugggugggugguggggaagcuuucaaaua

SEQ ID NO: 224916 - RNA, 32 nt, Human
uaugggugugagccaccgcgccuggccuauac

SEQ ID NO: 224917 - RNA, 32 nt, Human
uauggguguuaacgugcaugaggaucaguuug

SEQ ID NO: 224918 - RNA, 32 nt, Human
uauggguucuccccagagcaucuuucaggggu

SEQ ID NO: 224919 - RNA, 32 nt, Human
uauggguucugguaguccugggagaggcaggg

SEQ ID NO: 224920 - RNA, 32 nt, Human
uauggguuggggcaggggccugugggaggaug

SEQ ID NO: 224921 - RNA, 32 nt, Human
uaugguaacaccacugcacuccaaccugggca

SEQ ID NO: 224922 - RNA, 32 nt, Human
uaugguagcacacaccuguaaucccagcuacu

SEQ ID NO: 224923 - RNA, 32 nt, Human
uaugguagcacaggcuggccugugcaucggca

SEQ ID NO: 224924 - RNA, 32 nt, Human
uaugguagcaccacugcacuucagccuggaca

SEQ ID NO: 224925 - RNA, 32 nt, Human
uaugguagcucaugugggaggcugaggcagga

SEQ ID NO: 224926 - RNA, 32 nt, Human
uaugguaucuguguacguauccaaacuucuuu

SEQ ID NO: 224927 - RNA, 32 nt, Human
uaugguauuauuuuacauacugacacaaccua

SEQ ID NO: 224928 - RNA, 32 nt, Human
uaugguauuuggaacacaugaaaauggacugu

SEQ ID NO: 224929 - RNA, 32 nt, Human
uauggucacaccacugcacuccagccugggca

SEQ ID NO: 224930 - RNA, 32 nt, Human
uauggucacaccucucagugucucauagccca

SEQ ID NO: 224931 - RNA, 32 nt, Human
uauggucacagacuucuggccuaggaccccuc

SEQ ID NO: 224932 - RNA, 32 nt, Human
uauggucauaccaccgcacuccagccugagca

SEQ ID NO: 224933 - RNA, 32 nt, Human
uauggucauagaaaaugcaucuuugguuuugu

SEQ ID NO: 224934 - RNA, 32 nt, Human
uauggucaugccacugcacuccagccugggca

SEQ ID NO: 224935 - RNA, 32 nt, Human
uauggucauugguugcauaauuugauuugagg

SEQ ID NO: 224936 - RNA, 32 nt, Human
uauggucccagcuacucaacaggcugagguug

SEQ ID NO: 224937 - RNA, 32 nt, Human
uauggucgagugaccccaggagugauagggag

SEQ ID NO: 224938 - RNA, 28 nt, Human
uauggucgccagagggcagcauccccua

SEQ ID NO: 224939 - RNA, 32 nt, Human
uauggucuaucuuuccugauuggaccagauuu

SEQ ID NO: 224940 - RNA, 32 nt, Human
uauggucuccacugcuacuauccugcaugcau

SEQ ID NO: 224941 - RNA, 32 nt, Human
uauggucucuucacucaggucucagcuauaau

SEQ ID NO: 224942 - RNA, 32 nt, Human
uauggucuguauugcaacuauaguacacaacu

SEQ ID NO: 224943 - RNA, 32 nt, Human
uauggugaaacuccuaagaaacaggugguuuu

SEQ ID NO: 224944 - RNA, 32 nt, Human
uauggugacucaugccuguaauccuagcacuu

SEQ ID NO: 224945 - RNA, 32 nt, Human
uauggugagaucagauguggccaagggaagga

SEQ ID NO: 224946 - RNA, 32 nt, Human
uauggugcaguggcacaaucacagcucacugc

SEQ ID NO: 224947 - RNA, 32 nt, Human
uauggugcauuacgugggcauugucuuuuuag

SEQ ID NO: 224948 - RNA, 32 nt, Human
uauggugccaauggaaccuccuuucucuucuc

SEQ ID NO: 224949 - RNA, 23 nt, Human
uauggugccucacaccuguaauc

SEQ ID NO: 224950 - RNA, 32 nt, Human
uauggugccucacaccuguaaucccagcacuu

SEQ ID NO: 224951 - RNA, 32 nt, Human
uauggugcucaacacuuguuacugcaagcuac

SEQ ID NO: 224952 - RNA, 32 nt, Human
uaugguggaugaugauuucaucucacgugcug

SEQ ID NO: 224953 - RNA, 32 nt, Human
uaugguggcacacgccuguaaucccagcuacu

SEQ ID NO: 224954 - RNA, 32 nt, Human
uaugguggcacaugccuguaauuccagcugcu

SEQ ID NO: 224955 - RNA, 32 nt, Human
uaugguggcaccacugcacuccagccugggug

SEQ ID NO: 224956 - RNA, 32 nt, Human
uaugguggcacgugccuguaaucccagcuacc

SEQ ID NO: 224957 - RNA, 32 nt, Human
uaugguggcauacgccuguaauccuagcuacu

SEQ ID NO: 224958 - RNA, 32 nt, Human
uaugguggccggcgccuguaaucccagcuacu

SEQ ID NO: 224959 - RNA, 32 nt, Human
uaugguggcgggugccuguaaucucagcuacu

SEQ ID NO: 224960 - RNA, 32 nt, Human
uaugguggcucacaccuguaaucccaacacuu

SEQ ID NO: 224961 - RNA, 23 nt, Human
uaugguggcucacgccuauaauc

SEQ ID NO: 224962 - RNA, 32 nt, Human
uaugguggcucacgccuauaaucccagcacuu

SEQ ID NO: 224963 - RNA, 23 nt, Human
uaugguggcucacgccuguaauc

SEQ ID NO: 224964 - RNA, 32 nt, Human
uaugguggcucacgccuguaaucccagcacuu

SEQ ID NO: 224965 - RNA, 32 nt, Human
uaugguggcucacgccuguaaucccaguacug

SEQ ID NO: 224966 - RNA, 32 nt, Human
uaugguggcucaugccuguaaucccagcacuu

SEQ ID NO: 224967 - RNA, 32 nt, Human
uaugguggcucaugccuguaaucccagcauuu

SEQ ID NO: 224968 - RNA, 32 nt, Human
uaugguggcucaugccuguaaucucagcacuu

SEQ ID NO: 224969 - RNA, 32 nt, Human
uaugguggcucaugucuauaaucccagcacuu

SEQ ID NO: 224970 - RNA, 32 nt, Human
uaugguggcuuacgccuauaaucccagcuacu

SEQ ID NO: 224971 - RNA, 32 nt, Human
uauggugggagacgaacggaaggguugguggg

SEQ ID NO: 224972 - RNA, 32 nt, Human
uauggugggaggaucgcuugagcccagaaguc

SEQ ID NO: 224973 - RNA, 32 nt, Human
uauggugggccuuggcuggagaccucugucca

SEQ ID NO: 224974 - RNA, 32 nt, Human
uaugguggggauuuccugagggccaggauguc

SEQ ID NO: 224975 - RNA, 28 nt, Human
uauggugguacaugccuguaaucccagc

SEQ ID NO: 224976 - RNA, 23 nt, Human
uauggugguaugugccuguaauc

SEQ ID NO: 224977 - RNA, 32 nt, Human
uauggugguaugugccuguaaucccagcuacu

SEQ ID NO: 224978 - RNA, 32 nt, Human
uaugguggugaacaccuguaaucccagcuacu

SEQ ID NO: 224979 - RNA, 32 nt, Human
uaugguggugcacaccuguagucccagcuacu

SEQ ID NO: 224980 - RNA, 32 nt, Human
uaugguggugcacgcuuguaaucccagcuacu

SEQ ID NO: 224981 - RNA, 32 nt, Human
uaugguggugcauaccuguaaucccagcuacu

SEQ ID NO: 224982 - RNA, 32 nt, Human
uaugguggugcaugccuguaaucccagcuacu

SEQ ID NO: 224983 - RNA, 32 nt, Human
uaugguggugggcaccuguaaucccagcuacu

SEQ ID NO: 224984 - RNA, 32 nt, Human
uaugguggugggcaccuguaaucucagcuacu

SEQ ID NO: 224985 - RNA, 32 nt, Human
uaugguggugugaaccugcaaucccagugcuu

SEQ ID NO: 224986 - RNA, 32 nt, Human
uauggugucaugagauccucuaccucauaaca

SEQ ID NO: 224987 - RNA, 23 nt, Human
uauggugucucacaccuguaauc

SEQ ID NO: 224988 - RNA, 32 nt, Human
uauggugucucacaccuguaaucccagcacuu

SEQ ID NO: 224989 - RNA, 32 nt, Human
uaugguguguauagguaacauggggaaaaugc

SEQ ID NO: 224990 - RNA, 32 nt, Human
uaugguuacaaggacgagucagcgguggccua

SEQ ID NO: 224991 - RNA, 32 nt, Human
uaugguuacugaccccaggggcugccaucagc

SEQ ID NO: 224992 - RNA, 32 nt, Human
uaugguuagaccucugauucaggaagucucaa

SEQ ID NO: 224993 - RNA, 32 nt, Human
uaugguucuggaggaauccugcagccagccuu

SEQ ID NO: 224994 - RNA, 32 nt, Human
uaugguugcaccacuguacuccagccugggcg

SEQ ID NO: 224995 - RNA, 32 nt, Human
uaugguugugccacugcacuccagccugggua

SEQ ID NO: 224996 - RNA, 20 nt, Human
uaugguuguggccgcacgga

SEQ ID NO: 224997 - RNA, 32 nt, Human
uaugguuguuuuuguuuuccucccucuccucu

SEQ ID NO: 224998 - RNA, 32 nt, Human
uaugguuucagugaguuuccucauuucaucca

SEQ ID NO: 224999 - RNA, 32 nt, Human
uaugguuucugucauaaugugcuuuaucugau

SEQ ID NO: 225000 - RNA, 32 nt, Human
uaugguuugcugggucaaacaauguuuccaac

SEQ ID NO: 225001 - RNA, 32 nt, Human
uaugguuuuucaccaucaaagauuuuauugag

SEQ ID NO: 225002 - RNA, 32 nt, Human
uauguaaaaggagucguggucacaagacccug

SEQ ID NO: 225003 - RNA, 18 nt, Human
uauguaaacaucugagua

SEQ ID NO: 225004 - RNA, 32 nt, Human
uauguaaacucauaaagauguucauuuaauca

SEQ ID NO: 225005 - RNA, 32 nt, Human
uauguaaacuucaaggaggaaugguaaaaugu

SEQ ID NO: 225006 - RNA, 32 nt, Human
uauguaaagaacaaggaauaacaguuguagga

SEQ ID NO: 225007 - RNA, 32 nt, Human
uauguaaauagaaggaauggccaguucaaaag

SEQ ID NO: 225008 - RNA, 32 nt, Human
uauguaaauauuguaauuuaaauaugauugga

SEQ ID NO: 225009 - RNA, 32 nt, Human
uauguaaauucauauauguauuuuuggaauca

SEQ ID NO: 225010 - RNA, 32 nt, Human
uauguaacaaacccgcauguucugcacaugua

SEQ ID NO: 225011 - RNA, 32 nt, Human
uauguaacaaaccugcacauccugcacaugua

SEQ ID NO: 225012 - RNA, 32 nt, Human
uauguaacaaaccugcacauucugcacauaua

SEQ ID NO: 225013 - RNA, 32 nt, Human
uauguaacaaaccugcacauugugcacaugua

SEQ ID NO: 225014 - RNA, 32 nt, Human
uauguaacaaaccugcacguucagcacaugua

SEQ ID NO: 225015 - RNA, 32 nt, Human
uauguaacaaaccugcacguucugcacaugua

SEQ ID NO: 225016 - RNA, 32 nt, Human
uauguaacaaaccugcacguugugcacacgua

SEQ ID NO: 225017 - RNA, 32 nt, Human
uauguaacaaaccugcacguugugcacauggu

SEQ ID NO: 225018 - RNA, 32 nt, Human
uauguaacaaaccugcacguugugcacaugua

SEQ ID NO: 225019 - RNA, 32 nt, Human
uauguaacaaaccugcacuuguaccccugaac

SEQ ID NO: 225020 - RNA, 32 nt, Human
uauguaacaaaccugcauauccugcacaugua

SEQ ID NO: 225021 - RNA, 32 nt, Human
uauguaacaaaccugcauguugugcacaugua

SEQ ID NO: 225022 - RNA, 32 nt, Human
uauguaacaaaccugcauuuguaccccuaaac

SEQ ID NO: 225023 - RNA, 32 nt, Human
uauguaacaaaucugcacguugugcacaugua

SEQ ID NO: 225024 - RNA, 32 nt, Human
uauguaacaaauuugcaaauugugcacaugua

SEQ ID NO: 225025 - RNA, 32 nt, Human
uauguaacagauacacuacaguagaagaacuu

SEQ ID NO: 225026 - RNA, 32 nt, Human
uauguaacuaaccugcacauugugcacacgua

SEQ ID NO: 225027 - RNA, 32 nt, Human
uauguaacuaaccugcacauugugcacaugua

SEQ ID NO: 225028 - RNA, 32 nt, Human
uauguaagaaaaugacuguaaaucucaagaaa

SEQ ID NO: 225029 - RNA, 32 nt, Human
uauguaagacacacacugcccuaaccucacuu

SEQ ID NO: 225030 - RNA, 23 nt, Human
uauguaagcauguauacacugug

SEQ ID NO: 225031 - RNA, 32 nt, Human
uauguaaggagguuuauauaaguaauucagug

SEQ ID NO: 225032 - RNA, 24 nt, Human
uauguaaggcagugauauacuaua

SEQ ID NO: 225033 - RNA, 23 nt, Human
uauguaauauacauauauacaca

SEQ ID NO: 225034 - RNA, 32 nt, Human
uauguaaucccaaauacucgggaggcugaggc

SEQ ID NO: 225035 - RNA, 32 nt, Human
uauguaaucuguacauaaucucuuucacugaa

SEQ ID NO: 225036 - RNA, 32 nt, Human
uauguaauugucuccacuucuucaccucucac

SEQ ID NO: 225037 - RNA, 32 nt, Human
uauguacaacuugcagguuuguuacauaugua

SEQ ID NO: 225038 - RNA, 32 nt, Human
uauguacacaugcuucagaaauauuguugcuu

SEQ ID NO: 225039 - RNA, 32 nt, Human
uauguacacucugaaguacagccuggguuagu

SEQ ID NO: 225040 - RNA, 32 nt, Human
uauguacagcucuccccucccuuguccuugaa

SEQ ID NO: 225041 - RNA, 24 nt, Human
uauguacauacacauacauacaua

SEQ ID NO: 225042 - RNA, 24 nt, Human
uauguacauauacauguauauaca

SEQ ID NO: 225043 - RNA, 28 nt, Human
uauguacauauauauguguguauauaau

SEQ ID NO: 225044 - RNA, 32 nt, Human
uauguacauaugcauccacguguguguaugug

SEQ ID NO: 225045 - RNA, 22 nt, Human
uauguacauauguguguguaua

SEQ ID NO: 225046 - RNA, 32 nt, Human
uauguacauauguuuguguguauauguaaaua

SEQ ID NO: 225047 - RNA, 32 nt, Human
uauguacaugccacauucugggcuuucccacu

SEQ ID NO: 225048 - RNA, 32 nt, Human
uauguaccacauucuaucccagguauuggguu

SEQ ID NO: 225049 - RNA, 32 nt, Human
uauguaccauauauacacuguagcaaauauuu

SEQ ID NO: 225050 - RNA, 32 nt, Human
uauguacccacuguggggccaggcugggccgg

SEQ ID NO: 225051 - RNA, 32 nt, Human
uauguaccgccuggccaugaccggggcaggga

SEQ ID NO: 225052 - RNA, 32 nt, Human
uauguaccugcagugggguugcagagaugggg

SEQ ID NO: 225053 - RNA, 32 nt, Human
uauguacguccuccuaggugauggagaugugu

SEQ ID NO: 225054 - RNA, 29 nt, Human
uauguacucaauaaauauuuguuggcuuu

SEQ ID NO: 225055 - RNA, 32 nt, Human
uauguacugaacaccaacuguguggcauacac

SEQ ID NO: 225056 - RNA, 32 nt, Human
uauguacugcagccacauugugcagcccacca

SEQ ID NO: 225057 - RNA, 32 nt, Human
uauguacuugcuguugugaaguuugggcauga

SEQ ID NO: 225058 - RNA, 32 nt, Human
uauguagagaaaaggaggggacgggacagacg

SEQ ID NO: 225059 - RNA, 32 nt, Human
uauguagagaagaggucucccuguguugccca

SEQ ID NO: 225060 - RNA, 32 nt, Human
uauguagagacaggggucuugccaugucgccc

SEQ ID NO: 225061 - RNA, 32 nt, Human
uauguagagacagggucucacuuuguugccca

SEQ ID NO: 225062 - RNA, 22 nt, Human
uauguagagacguauacauaua

SEQ ID NO: 225063 - RNA, 32 nt, Human
uauguagagagagcaacaugacuggggcugca

SEQ ID NO: 225064 - RNA, 32 nt, Human
uauguagagaggaggucugggagaaagaugga

SEQ ID NO: 225065 - RNA, 32 nt, Human
uauguagagauagggucucacuauguugacca

SEQ ID NO: 225066 - RNA, 32 nt, Human
uauguagagcuaguucucaaagcugcccugcc

SEQ ID NO: 225067 - RNA, 32 nt, Human
uauguagagggagagaucgaagacugagugac

SEQ ID NO: 225068 - RNA, 32 nt, Human
uauguagauagucacauauacaccagacugag

SEQ ID NO: 225069 - RNA, 32 nt, Human
uauguagcaaaaaucagggcugggggagagcc

SEQ ID NO: 225070 - RNA, 32 nt, Human
uauguagcaaaaggcuuccauuucuggaaggg

SEQ ID NO: 225071 - RNA, 32 nt, Human
uauguagcaaacaggugucagagucagaauug

SEQ ID NO: 225072 - RNA, 32 nt, Human
uauguagccaggagugguggggaccagaagcc

SEQ ID NO: 225073 - RNA, 32 nt, Human
uauguagcuaacccuucguugugcacauguac

SEQ ID NO: 225074 - RNA, 32 nt, Human
uauguagcuucuaacaagugugugcuaguggu

SEQ ID NO: 225075 - RNA, 32 nt, Human
uauguagggagaaaaugcuugccaaccaccgg

SEQ ID NO: 225076 - RNA, 32 nt, Human
uauguaggugugcucccugggguggggaguuu

SEQ ID NO: 225077 - RNA, 32 nt, Human
uauguaguaaaaaguauaaggccacacauggu

SEQ ID NO: 225078 - RNA, 32 nt, Human
uauguaguaccuuagaaggcugugcugggagu

SEQ ID NO: 225079 - RNA, 32 nt, Human
uauguagugaagaaaauuuaguuguuaguugc

SEQ ID NO: 225080 - RNA, 25 nt, Human
uauguauaauauacauacauacaua

SEQ ID NO: 225081 - RNA, 31 nt, Human
uauguauacaguuagaauacccaaggagacc

SEQ ID NO: 225082 - RNA, 32 nt, Human
uauguauacauacauuuuccaaaaagaaaaau

SEQ ID NO: 225083 - RNA, 20 nt, Human
uauguauacauauauacaca

SEQ ID NO: 225084 - RNA, 32 nt, Human
uauguauacauauauacacauauauguauaca

SEQ ID NO: 225085 - RNA, 32 nt, Human
uauguauacauauauacacauauauucuacag

SEQ ID NO: 225086 - RNA, 24 nt, Human
uauguauacauguauauacauaua

SEQ ID NO: 225087 - RNA, 32 nt, Human
uauguauacuaauaaauauacacuaauauaua

SEQ ID NO: 225088 - RNA, 24 nt, Human
uauguauauacguguauauauaua

SEQ ID NO: 225089 - RNA, 32 nt, Human
uauguauauacucagugccucaguucagcuuc

SEQ ID NO: 225090 - RNA, 19 nt, Human
uauguauauacuguauaua

SEQ ID NO: 225091 - RNA, 24 nt, Human
uauguauauauacacacauauaua

SEQ ID NO: 225092 - RNA, 24 nt, Human
uauguauauauauguauauauaua

SEQ ID NO: 225093 - RNA, 24 nt, Human
uauguauauauauuuaaauacaca

SEQ ID NO: 225094 - RNA, 28 nt, Human
uauguauauaucucuguguguguauaua

SEQ ID NO: 225095 - RNA, 22 nt, Human
uauguauauaugcauauacaua

SEQ ID NO: 225096 - RNA, 22 nt, Human
uauguauauauguauauauaua

SEQ ID NO: 225097 - RNA, 32 nt, Human
uauguauauguauguaagauguguauauguau

SEQ ID NO: 225098 - RNA, 32 nt, Human
uauguauccuuuccucaaccuccuccuuuccc

SEQ ID NO: 225099 - RNA, 32 nt, Human
uauguaucuugaguucuucauaggggaagugu

SEQ ID NO: 225100 - RNA, 32 nt, Human
uauguaucuuucuuuuguuacacaugaguaac

SEQ ID NO: 225101 - RNA, 22 nt, Human
uauguaucuuuguaugcauaua

SEQ ID NO: 225102 - RNA, 32 nt, Human
uauguaugagaaagggauuuucugguauuuug

SEQ ID NO: 225103 - RNA, 32 nt, Human
uauguaugcauauguauguagauauguuuaua

SEQ ID NO: 225104 - RNA, 32 nt, Human
uauguaugcguauguauguauguauguaugcc

SEQ ID NO: 225105 - RNA, 19 nt, Human
uauguaugcucugguacac

SEQ ID NO: 225106 - RNA, 32 nt, Human
uauguaugcugggaaacggcuugaguggaugg

SEQ ID NO: 225107 - RNA, 31 nt, Human
uauguauggaaaggaacucauuuaucaaauu

SEQ ID NO: 225108 - RNA, 32 nt, Human
uauguauggagcaucuacuaugugccaggcgc

SEQ ID NO: 225109 - RNA, 24 nt, Human
uauguauguauauacacacguaca

SEQ ID NO: 225110 - RNA, 24 nt, Human
uauguauguauauacguauguaua

SEQ ID NO: 225111 - RNA, 22 nt, Human
uauguauguauauacguguaua

SEQ ID NO: 225112 - RNA, 24 nt, Human
uauguauguauguguauguacaua

SEQ ID NO: 225113 - RNA, 32 nt, Human
uauguaugucugguuugcuggaagagugauua

SEQ ID NO: 225114 - RNA, 32 nt, Human
uauguauguggacacaggcuggagucagguuc

SEQ ID NO: 225115 - RNA, 22 nt, Human
uauguauguguacauacacaua

SEQ ID NO: 225116 - RNA, 24 nt, Human
uauguauguguauauguguauaca

SEQ ID NO: 225117 - RNA, 32 nt, Human
uauguauguguauguauaugcaugcaugugua

SEQ ID NO: 225118 - RNA, 32 nt, Human
uauguauguguguggguauguguguauacagu

SEQ ID NO: 225119 - RNA, 32 nt, Human
uauguaugugugugugcgugcauaaauuauuu

SEQ ID NO: 225120 - RNA, 22 nt, Human
uauguauguuuauauacacaca

SEQ ID NO: 225121 - RNA, 32 nt, Human
uauguauucaguccuaggauuuugaaugguuu

SEQ ID NO: 225122 - RNA, 32 nt, Human
uauguauuuauugucauuacugccuuuggaag

SEQ ID NO: 225123 - RNA, 32 nt, Human
uauguauuuauuuaucuaucugucuacuccau

SEQ ID NO: 225124 - RNA, 32 nt, Human
uauguauuuccaccugaggagaaggccugggg

SEQ ID NO: 225125 - RNA, 32 nt, Human
uauguauuugcauauuaccuacucacaucuuc

SEQ ID NO: 225126 - RNA, 32 nt, Human
uauguauuuuuaguagagauggaguuucacca

SEQ ID NO: 225127 - RNA, 32 nt, Human
uaugucaaguuuaggucauuuagaagauuuga

SEQ ID NO: 225128 - RNA, 32 nt, Human
uaugucaaugaaaugcuagggggccagggaaa

SEQ ID NO: 225129 - RNA, 32 nt, Human
uaugucacucaggcuggagugcaguggcacaa

SEQ ID NO: 225130 - RNA, 32 nt, Human
uaugucacuccucugcugggcuguucauuguc

SEQ ID NO: 225131 - RNA, 32 nt, Human
uaugucacugcacuccauccugggugacaaga

SEQ ID NO: 225132 - RNA, 32 nt, Human
uaugucagaaugcaagcccugccucagcuucu

SEQ ID NO: 225133 - RNA, 32 nt, Human
uaugucagacacacccaagucaaucccaaccc

SEQ ID NO: 225134 - RNA, 32 nt, Human
uaugucagaugguggaaaaagcccacgugacc

SEQ ID NO: 225135 - RNA, 32 nt, Human
uaugucagcaacaggcugagguuccagaccug

SEQ ID NO: 225136 - RNA, 32 nt, Human
uaugucagcuuuucucacccucuucugugcug

SEQ ID NO: 225137 - RNA, 32 nt, Human
uaugucaggccuuccugacuucucccccucuu

SEQ ID NO: 225138 - RNA, 32 nt, Human
uaugucauacugucuccucccaauucauccuu

SEQ ID NO: 225139 - RNA, 32 nt, Human
uaugucaucucucauaaaaguuucuggcagga

SEQ ID NO: 225140 - RNA, 32 nt, Human
uaugucaugguuuucagauccauuccaaccug

SEQ ID NO: 225141 - RNA, 32 nt, Human
uaugucauuuucagauccuuccaaacucucua

SEQ ID NO: 225142 - RNA, 32 nt, Human
uauguccaacuuccacuuuuccacuucucacu

SEQ ID NO: 225143 - RNA, 32 nt, Human
uauguccaagagucaggaagacacugaauguc

SEQ ID NO: 225144 - RNA, 32 nt, Human
uauguccacaggccagggccugugcugcaguc

SEQ ID NO: 225145 - RNA, 32 nt, Human
uauguccacuuguggucgugaucaauauauuu

SEQ ID NO: 225146 - RNA, 22 nt, Human
uauguccaggagagggcaauag

SEQ ID NO: 225147 - RNA, 20 nt, Human
uauguccaggagugaauaca

SEQ ID NO: 225148 - RNA, 32 nt, Human
uauguccaggagugaauacaacagaaagaguu

SEQ ID NO: 225149 - RNA, 32 nt, Human
uaugucccaagagccauaagggggugggaauu

SEQ ID NO: 225150 - RNA, 32 nt, Human
uaugucccagccccaacaacuaucaaagucua

SEQ ID NO: 225151 - RNA, 32 nt, Human
uaugucccaggccguauucuaacaagggcaca

SEQ ID NO: 225152 - RNA, 32 nt, Human
uaugucccagggguauauuuagacccuguuuc

SEQ ID NO: 225153 - RNA, 32 nt, Human
uaugucccaguaaacccauuggaagucaaaug

SEQ ID NO: 225154 - RNA, 32 nt, Human
uauguccccauuccucccuccugccacaaauu

SEQ ID NO: 225155 - RNA, 32 nt, Human
uauguccuacuagauacacugcaaacuacagu

SEQ ID NO: 225156 - RNA, 32 nt, Human
uauguccuccaggcuuugcucagcugagcucc

SEQ ID NO: 225157 - RNA, 32 nt, Human
uauguccucuucucccuuuccaucuuucagca

SEQ ID NO: 225158 - RNA, 23 nt, Human
uauguccucuuuaauugcuuuca

SEQ ID NO: 225159 - RNA, 32 nt, Human
uauguccugacaaccaacacccagcaggccac

SEQ ID NO: 225160 - RNA, 32 nt, Human
uauguccuggugcaagucauuggaagacccug

SEQ ID NO: 225161 - RNA, 32 nt, Human
uauguccugugguguauuaacuccuuuuuauu

SEQ ID NO: 225162 - RNA, 32 nt, Human
uaugucuaaagguauuuggaacuuuuuacagg

SEQ ID NO: 225163 - RNA, 32 nt, Human
uaugucuauuaaaaaguacaaaauuuagccag

SEQ ID NO: 225164 - RNA, 32 nt, Human
uaugucuauuccaggauucagucuagaaacuu

SEQ ID NO: 225165 - RNA, 24 nt, Human
uaugucucacaauauauauacaca

SEQ ID NO: 225166 - RNA, 32 nt, Human
uaugucucacuugauaccagaauauacaucuu

SEQ ID NO: 225167 - RNA, 32 nt, Human
uaugucucauuucauaucuaacucauguuuuu

SEQ ID NO: 225168 - RNA, 32 nt, Human
uaugucucauuucucagccuuauuuuauaacg

SEQ ID NO: 225169 - RNA, 32 nt, Human
uaugucucccaggcuggagugcaguggcacag

SEQ ID NO: 225170 - RNA, 32 nt, Human
uaugucucucugucuuuuccugucuucugauu

SEQ ID NO: 225171 - RNA, 32 nt, Human
uaugucucuguaacauuggccuuuucauggcu

SEQ ID NO: 225172 - RNA, 32 nt, Human
uaugucugagacugaaugcgggagguucaaug

SEQ ID NO: 225173 - RNA, 32 nt, Human
uaugucuguccaucuuucuccuuucuuccagc

SEQ ID NO: 225174 - RNA, 32 nt, Human
uaugucugugccaugggcugagugccacgaca

SEQ ID NO: 225175 - RNA, 32 nt, Human
uaugucuguguauguauguauauaguguaaua

SEQ ID NO: 225176 - RNA, 32 nt, Human
uaugucuucaagcagcagaaccuggagcagcg

SEQ ID NO: 225177 - RNA, 32 nt, Human
uaugucuucuuaagccucuggcccucagaggc

SEQ ID NO: 225178 - RNA, 32 nt, Human
uaugucuugguuguuguauuguaccagugaaa

SEQ ID NO: 225179 - RNA, 32 nt, Human
uaugucuuugggguaauuuuugauuuagaauu

SEQ ID NO: 225180 - RNA, 32 nt, Human
uaugucuuuuaaagcgggccacacaacuguag

SEQ ID NO: 225181 - RNA, 32 nt, Human
uaugugaaaaguuuugagaacugugaaauguu

SEQ ID NO: 225182 - RNA, 32 nt, Human
uaugugaaaugagaaccauuguaucagauguu

SEQ ID NO: 225183 - RNA, 32 nt, Human
uaugugaaauggccaaagcacaugcaggcucc

SEQ ID NO: 225184 - RNA, 32 nt, Human
uaugugaacuccagucaucacaguuuaggugc

SEQ ID NO: 225185 - RNA, 31 nt, Human
uaugugaaggaugaaaggugggugaaaggac

SEQ ID NO: 225186 - RNA, 32 nt, Human
uaugugacacauaguacaaauaguuugcuagg

SEQ ID NO: 225187 - RNA, 32 nt, Human
uaugugacacuggagaaaaguggaccaggcau

SEQ ID NO: 225188 - RNA, 32 nt, Human
uaugugacagcuauauuguauuacaaaguaaa

SEQ ID NO: 225189 - RNA, 32 nt, Human
uaugugacugccucugugcugggcaccuggcc

SEQ ID NO: 225190 - RNA, 32 nt, Human
uaugugagaccauuuagcacacugcuugugaa

SEQ ID NO: 225191 - RNA, 32 nt, Human
uaugugagauauagauucuaaaaaccucaggu

SEQ ID NO: 225192 - RNA, 32 nt, Human
uaugugagauuugcauuuuacuuugcugacuu

SEQ ID NO: 225193 - RNA, 32 nt, Human
uaugugagcaccagagguaaagcaacacaaag

SEQ ID NO: 225194 - RNA, 32 nt, Human
uaugugagcgaagauggcaguaacuguuaaau

SEQ ID NO: 225195 - RNA, 32 nt, Human
uaugugaggccuuccccggugagccucaguuc

SEQ ID NO: 225196 - RNA, 24 nt, Human
uaugugaguauauauacacacaca

SEQ ID NO: 225197 - RNA, 32 nt, Human
uaugugaguguguguggcuguaaccugcacgu

SEQ ID NO: 225198 - RNA, 32 nt, Human
uaugugauguggauugcugguguccagcauga

SEQ ID NO: 225199 - RNA, 32 nt, Human
uaugugauuauccaugucccagccucucucca

SEQ ID NO: 225200 - RNA, 32 nt, Human
uaugugcaacagcaaugaaauuaacuccagaa

SEQ ID NO: 225201 - RNA, 32 nt, Human
uaugugcacacccggagguggggugaggacgg

SEQ ID NO: 225202 - RNA, 31 nt, Human
uaugugcagugucagcaccaccuggaagguu

SEQ ID NO: 225203 - RNA, 32 nt, Human
uaugugcaugugcacacacacucaaacaugua

SEQ ID NO: 225204 - RNA, 22 nt, Human
uaugugcauguguacacauaug

SEQ ID NO: 225205 - RNA, 32 nt, Human
uaugugccaguuccuguaacagguguggggac

SEQ ID NO: 225206 - RNA, 32 nt, Human
uaugugcccaagagcugcccagcuucagcuug

SEQ ID NO: 225207 - RNA, 32 nt, Human
uaugugcccaccccucucccauuauccuuuag

SEQ ID NO: 225208 - RNA, 32 nt, Human
uaugugccccucuguaucuuuugagaagugcg

SEQ ID NO: 225209 - RNA, 32 nt, Human
uaugugcccgccaccagacccggcuaauauuu

SEQ ID NO: 225210 - RNA, 32 nt, Human
uaugugcccugguggacacuugcccaccaucc

SEQ ID NO: 225211 - RNA, 32 nt, Human
uaugugccuggcuaugugcacacacaugugaa

SEQ ID NO: 225212 - RNA, 32 nt, Human
uaugugccuguaaucccagcuacuugggaggc

SEQ ID NO: 225213 - RNA, 32 nt, Human
uaugugccuuccacccagagggagacccagua

SEQ ID NO: 225214 - RNA, 24 nt, Human
uaugugcguguguguauacacaug

SEQ ID NO: 225215 - RNA, 32 nt, Human
uaugugcguguguguauacacaugcauauauu

SEQ ID NO: 225216 - RNA, 32 nt, Human
uaugugcuagauuuuaauauccuugagccugg

SEQ ID NO: 225217 - RNA, 32 nt, Human
uaugugcuaggugcuggggaaaacuugaccaa

SEQ ID NO: 225218 - RNA, 32 nt, Human
uaugugcucacugcuggcucaggccccaaccu

SEQ ID NO: 225219 - RNA, 32 nt, Human
uaugugcuccgcuuuuguugcaucacuaugug

SEQ ID NO: 225220 - RNA, 32 nt, Human
uaugugcugcugcugcucaagagcuggaucca

SEQ ID NO: 225221 - RNA, 32 nt, Human
uauguggagcucagcaacaaggcugcacagcu

SEQ ID NO: 225222 - RNA, 32 nt, Human
uauguggcaauauuaaccugguacaugaauau

SEQ ID NO: 225223 - RNA, 32 nt, Human
uauguggcaggccuacucaugggugggaaggg

SEQ ID NO: 225224 - RNA, 32 nt, Human
uauguggcauuuucuguuucucauugguaaua

SEQ ID NO: 225225 - RNA, 32 nt, Human
uauguggcuggucucaaacuccugggcucaag

SEQ ID NO: 225226 - RNA, 32 nt, Human
uauguggcuuuucuuugucuuccccaaggcug

SEQ ID NO: 225227 - RNA, 32 nt, Human
uaugugggacccauuccucaccaaaaugagga

SEQ ID NO: 225228 - RNA, 32 nt, Human
uaugugggagaaccuuacaaggcucuaaaaug

SEQ ID NO: 225229 - RNA, 32 nt, Human
uauguggggagguggaggggguccauguggac

SEQ ID NO: 225230 - RNA, 32 nt, Human
uauguggggcugagagucaaaagggaaagccu

SEQ ID NO: 225231 - RNA, 32 nt, Human
uauguggucaccagcaggagaaagcuuugaug

SEQ ID NO: 225232 - RNA, 32 nt, Human
uaugugguccacccucccucccaggcaacaaa

SEQ ID NO: 225233 - RNA, 22 nt, Human
uauguguaaauauauguacaaa

SEQ ID NO: 225234 - RNA, 24 nt, Human
uauguguacauauggacauacaca

SEQ ID NO: 225235 - RNA, 32 nt, Human
uauguguagaucuuugauccauugugaauuaa

SEQ ID NO: 225236 - RNA, 32 nt, Human
uauguguagcuguggggaaaagaaagagagau

SEQ ID NO: 225237 - RNA, 24 nt, Human
uauguguauagauucacauacaca

SEQ ID NO: 225238 - RNA, 25 nt, Human
uauguguauauaugauacauacaca

SEQ ID NO: 225239 - RNA, 24 nt, Human
uauguguauauauguauauauaua

SEQ ID NO: 225240 - RNA, 22 nt, Human
uauguguauauguauacacaua

SEQ ID NO: 225241 - RNA, 24 nt, Human
uauguguauauguauuuacauaua

SEQ ID NO: 225242 - RNA, 22 nt, Human
uauguguauauguguauacaca

SEQ ID NO: 225243 - RNA, 24 nt, Human
uauguguauauguguauacacaua

SEQ ID NO: 225244 - RNA, 23 nt, Human
uauguguauauguuauguauaca

SEQ ID NO: 225245 - RNA, 22 nt, Human
uauguguauguacacauacaua

SEQ ID NO: 225246 - RNA, 32 nt, Human
uauguguauguauguauguauauguauaugau

SEQ ID NO: 225247 - RNA, 32 nt, Human
uauguguauuucuccacagugcuugcuuugcc

SEQ ID NO: 225248 - RNA, 32 nt, Human
uaugugucaaggaucaucagcaaucagcaaau

SEQ ID NO: 225249 - RNA, 28 nt, Human
uauguguccaaugcugccuucccaugaa

SEQ ID NO: 225250 - RNA, 32 nt, Human
uaugugucucagaaaaucuguguguguacaug

SEQ ID NO: 225251 - RNA, 21 nt, Human
uaugugucucugaguguagua

SEQ ID NO: 225252 - RNA, 32 nt, Human
uaugugugcagguaucacagggugagagagga

SEQ ID NO: 225253 - RNA, 32 nt, Human
uauguguggacuuuugucauggguugaauagu

SEQ ID NO: 225254 - RNA, 24 nt, Human
uauguguguauacacauauacaca

SEQ ID NO: 225255 - RNA, 32 nt, Human
uauguguguauaggcugggugcgguggcucau

SEQ ID NO: 225256 - RNA, 22 nt, Human
uauguguguauauauauacaca

SEQ ID NO: 225257 - RNA, 25 nt, Human
uauguguguauuucauacacacaca

SEQ ID NO: 225258 - RNA, 32 nt, Human
uaugugugucagcuuugagaugguguguccug

SEQ ID NO: 225259 - RNA, 22 nt, Human
uaugugugucuauacacacaca

SEQ ID NO: 225260 - RNA, 29 nt, Human
uaugugugucugugugucucucuguggag

SEQ ID NO: 225261 - RNA, 24 nt, Human
uaugugugugauguauacuauaua

SEQ ID NO: 225262 - RNA, 32 nt, Human
uauguguguguaugugcaucugaagaugugua

SEQ ID NO: 225263 - RNA, 20 nt, Human
uauguguuccucuuguucua

SEQ ID NO: 225264 - RNA, 32 nt, Human
uauguguuggggcucugucaguucucagcccc

SEQ ID NO: 225265 - RNA, 32 nt, Human
uauguguuggguagggaggugacgauugccac

SEQ ID NO: 225266 - RNA, 24 nt, Human
uauguguuuauauguaugcauaua

SEQ ID NO: 225267 - RNA, 32 nt, Human
uauguguuuccagaucugcuuauuguuugggu

SEQ ID NO: 225268 - RNA, 32 nt, Human
uauguuaaccacuguauguaaccaacccuuau

SEQ ID NO: 225269 - RNA, 32 nt, Human
uauguuaagucacaaacccacuugacuucugg

SEQ ID NO: 225270 - RNA, 32 nt, Human
uauguuaauacacacauacauacgcacacaug

SEQ ID NO: 225271 - RNA, 32 nt, Human
uauguuacacauguucauguucaccucucauu

SEQ ID NO: 225272 - RNA, 32 nt, Human
uauguuaccgaaucaaauagccuuccagaggc

SEQ ID NO: 225273 - RNA, 32 nt, Human
uauguuauaguccagucuacuucuuuaaaaac

SEQ ID NO: 225274 - RNA, 32 nt, Human
uauguucacaccaauaauugccugcuucagag

SEQ ID NO: 225275 - RNA, 32 nt, Human
uauguucacaccaccacauucccauucacuuu

SEQ ID NO: 225276 - RNA, 32 nt, Human
uauguucacugcacucugauuuucuguaggua

SEQ ID NO: 225277 - RNA, 32 nt, Human
uauguucagggugggaugauggaaccgagggc

SEQ ID NO: 225278 - RNA, 32 nt, Human
uauguucaugacacugcacuccagccuuggca

SEQ ID NO: 225279 - RNA, 32 nt, Human
uauguucaugacucuguauuccaggcuggaug

SEQ ID NO: 225280 - RNA, 28 nt, Human
uauguuccaagugcuacucucacucagc

SEQ ID NO: 225281 - RNA, 32 nt, Human
uauguuccaggauaaaaucccaagaagaugga

SEQ ID NO: 225282 - RNA, 32 nt, Human
uauguucccucagacugaagcuacagucucau

SEQ ID NO: 225283 - RNA, 32 nt, Human
uauguucggacccaagcaaguuagcuaaacca

SEQ ID NO: 225284 - RNA, 32 nt, Human
uauguucgugcugcaagugaucuguaaucccu

SEQ ID NO: 225285 - RNA, 32 nt, Human
uauguucuauguugggccuccugcugcaaaac

SEQ ID NO: 225286 - RNA, 32 nt, Human
uauguucucuuuaccccuucccccucuucucu

SEQ ID NO: 225287 - RNA, 32 nt, Human
uauguucugaguaaacaaauauugcuauggga

SEQ ID NO: 225288 - RNA, 32 nt, Human
uauguucuuagcaauaaaugcuuuucuaaugc

SEQ ID NO: 225289 - RNA, 32 nt, Human
uauguugaaaacaaguauuucuugugugaaca

SEQ ID NO: 225290 - RNA, 32 nt, Human
  misc_feature (30)..(30): n is a, c, g or u
uauguugaauuccauugccuccuuuucucnau

SEQ ID NO: 225291 - RNA, 32 nt, Human
uauguugaccugucugaauuauaaaccagccu

SEQ ID NO: 225292 - RNA, 32 nt, Human
uauguugaucagugaugaguugggcuuaaugc

SEQ ID NO: 225293 - RNA, 32 nt, Human
uauguugcacuaagaagguggggucgaggagu

SEQ ID NO: 225294 - RNA, 32 nt, Human
uauguugcauuuucauuaucauuuguuucaag

SEQ ID NO: 225295 - RNA, 22 nt, Human
uauguugcccaggcugaucuca

SEQ ID NO: 225296 - RNA, 32 nt, Human
uauguugcccaggcuggagugcaguggugcga

SEQ ID NO: 225297 - RNA, 32 nt, Human
uauguugcuuuucuaaauaaauguauugugaa

SEQ ID NO: 225298 - RNA, 32 nt, Human
uauguuggaaaucgcuuuugcuggugcaaagu

SEQ ID NO: 225299 - RNA, 32 nt, Human
uauguugggagugugauuuguucuccaaugug

SEQ ID NO: 225300 - RNA, 32 nt, Human
uauguugggccuuccuuuuuggaauguacgcu

SEQ ID NO: 225301 - RNA, 32 nt, Human
uauguuggucaacuuuucguuuucccuaacuc

SEQ ID NO: 225302 - RNA, 32 nt, Human
uauguuggugcaggcuugcaaucccagcuacu

SEQ ID NO: 225303 - RNA, 32 nt, Human
uauguugguguguuuguccuuacuugaaaugg

SEQ ID NO: 225304 - RNA, 32 nt, Human
uauguuguaaagcuggaaccaaguuugcauuu

SEQ ID NO: 225305 - RNA, 32 nt, Human
uauguuguaucgugaauaaauugcacauagua

SEQ ID NO: 225306 - RNA, 32 nt, Human
uauguugucaucucugguccacaggugucaca

SEQ ID NO: 225307 - RNA, 32 nt, Human
uauguugucuguuguaaaauguuaacgaauac

SEQ ID NO: 225308 - RNA, 32 nt, Human
uauguugugaaguuucccaguucacugaaaug

SEQ ID NO: 225309 - RNA, 32 nt, Human
uauguugugcugcuguccagcugcuaagaucc

SEQ ID NO: 225310 - RNA, 32 nt, Human
uauguugugggaaucuuugcaaguuaguguug

SEQ ID NO: 225311 - RNA, 32 nt, Human
uauguuguucugaagucuuguaauguuuaacu

SEQ ID NO: 225312 - RNA, 32 nt, Human
uauguuguugaauacuucauucacaagggaaa

SEQ ID NO: 225313 - RNA, 32 nt, Human
uauguuuacacaauuaauucaucccuuaauuu

SEQ ID NO: 225314 - RNA, 32 nt, Human
uauguuuacagaugugcccugcauuuagucug

SEQ ID NO: 225315 - RNA, 20 nt, Human
uauguuuacaucucuuugca

SEQ ID NO: 225316 - RNA, 32 nt, Human
uauguuuagcagcauuuugccccugggcauuu

SEQ ID NO: 225317 - RNA, 32 nt, Human
uauguuuauaagaacucagaagcaauggugag

SEQ ID NO: 225318 - RNA, 32 nt, Human
uauguuuauaugcacaaaugcacuaauuaguc

SEQ ID NO: 225319 - RNA, 22 nt, Human
uauguuuauauguguacauaua

SEQ ID NO: 225320 - RNA, 32 nt, Human
uauguuuauuuuuaugggauuuggguaaauuu

SEQ ID NO: 225321 - RNA, 32 nt, Human
uauguuucaauucaaaacaaagacaguuuucc

SEQ ID NO: 225322 - RNA, 32 nt, Human
uauguuucaguagcagauuuucacacaugugc

SEQ ID NO: 225323 - RNA, 32 nt, Human
uauguuucaguuacuuagauggucucauaagg

SEQ ID NO: 225324 - RNA, 32 nt, Human
uauguuucauuuucuuucuucuucaccucuau

SEQ ID NO: 225325 - RNA, 32 nt, Human
uauguuuccaugguuaccauggguguggaugg

SEQ ID NO: 225326 - RNA, 32 nt, Human
uauguuuccuuggccaggugcaauggcucaug

SEQ ID NO: 225327 - RNA, 32 nt, Human
uauguuuccuuucaaagggaucuugacguggu

SEQ ID NO: 225328 - RNA, 32 nt, Human
uauguuucugaauucacugucuucuaugcagc

SEQ ID NO: 225329 - RNA, 32 nt, Human
uauguuugcaauauuuguuuuaagcacuuuga

SEQ ID NO: 225330 - RNA, 32 nt, Human
uauguuuggacacaauagugcacuuuaaaacc

SEQ ID NO: 225331 - RNA, 32 nt, Human
uauguuuggaggcagugacaaaaggacuuuuu

SEQ ID NO: 225332 - RNA, 32 nt, Human
uauguuuggccugccccagugcagugggacgg

SEQ ID NO: 225333 - RNA, 32 nt, Human
uauguuugguuauggcaagauguuacagcauu

SEQ ID NO: 225334 - RNA, 32 nt, Human
uauguuuguuucugcugcugugaaaccccaaa

SEQ ID NO: 225335 - RNA, 32 nt, Human
uauguuuguuuggucaauguuuccgcaguauu

SEQ ID NO: 225336 - RNA, 32 nt, Human
uauguuuuaaaucucuuagugguuacauugcc

SEQ ID NO: 225337 - RNA, 32 nt, Human
uauguuuuacaguucuggaggcugggaagucc

SEQ ID NO: 225338 - RNA, 23 nt, Human
uauguuuucacuggcuuauguuu

SEQ ID NO: 225339 - RNA, 32 nt, Human
uauguuuucauaauuuagcucccacuuaugag

SEQ ID NO: 225340 - RNA, 22 nt, Human
uauguuuucauucuuggcuucu

SEQ ID NO: 225341 - RNA, 24 nt, Human
uauguuuucauuuccccucugucu

SEQ ID NO: 225342 - RNA, 32 nt, Human
uauguuuucgccucuucugugaucaccaauag

SEQ ID NO: 225343 - RNA, 32 nt, Human
uauguuuuggaaggcaaagucuuggcuuuuga

SEQ ID NO: 225344 - RNA, 23 nt, Human
uauguuuuguacauagauacaca

SEQ ID NO: 225345 - RNA, 32 nt, Human
uauguuuuguguugguguuuccuauuuucugc

SEQ ID NO: 225346 - RNA, 32 nt, Human
uauguuuuucucucaaaaaggcaacguuauuu

SEQ ID NO: 225347 - RNA, 32 nt, Human
uauuaaaaaccagcacauucugaaaagaagaa

SEQ ID NO: 225348 - RNA, 32 nt, Human
uauuaaaaaguacaaaauuuagccaggugugg

SEQ ID NO: 225349 - RNA, 32 nt, Human
uauuaaaaauaacaaaaauuagccaggcaugg

SEQ ID NO: 225350 - RNA, 32 nt, Human
uauuaaaaauacaaaaacuuagccagucaugg

SEQ ID NO: 225351 - RNA, 32 nt, Human
uauuaaaacuauuccacauauccuaaaauuuc

SEQ ID NO: 225352 - RNA, 32 nt, Human
uauuaaaacucauguggcaguauccuggucuu

SEQ ID NO: 225353 - RNA, 32 nt, Human
uauuaaaagacaguaguuuauuugaacugguu

SEQ ID NO: 225354 - RNA, 32 nt, Human
uauuaaaaguaguucugguuuauuaaucaacg

SEQ ID NO: 225355 - RNA, 32 nt, Human
uauuaaaaguuaagcaaauagauuaaugacgu

SEQ ID NO: 225356 - RNA, 24 nt, Human
uauuaaaaguucauacauuagaca

SEQ ID NO: 225357 - RNA, 32 nt, Human
uauuaaaaucuuccucauuuggauuugcuuuc

SEQ ID NO: 225358 - RNA, 32 nt, Human
uauuaaaauggcauauggaaaagcuuuguauu

SEQ ID NO: 225359 - RNA, 32 nt, Human
uauuaaaauuccagagugaccguggcacuugg

SEQ ID NO: 225360 - RNA, 30 nt, Human
uauuaaaauucuuguccuauuuugccauga

SEQ ID NO: 225361 - RNA, 32 nt, Human
uauuaaaccuggacagggagagggaggguguu

SEQ ID NO: 225362 - RNA, 32 nt, Human
uauuaaagaccaggcuguuggcaccagaacuu

SEQ ID NO: 225363 - RNA, 32 nt, Human
uauuaaagaccauuucuggcugggcagggcac

SEQ ID NO: 225364 - RNA, 32 nt, Human
uauuaaagaggcugcaaaguccagccacccug

SEQ ID NO: 225365 - RNA, 32 nt, Human
uauuaaaggagagaacuugguaacgugaagua

SEQ ID NO: 225366 - RNA, 32 nt, Human
uauuaaagggaccggagcggggcaguucccga

SEQ ID NO: 225367 - RNA, 32 nt, Human
uauuaaauauuuugauauguaaagcucuacac

SEQ ID NO: 225368 - RNA, 32 nt, Human
uauuaaaucaaccugagccacauguuaucuaa

SEQ ID NO: 225369 - RNA, 32 nt, Human
uauuaaauggccuucgggucugaaaagcuuuu

SEQ ID NO: 225370 - RNA, 32 nt, Human
uauuaaauguacuggugacuaguacauguauu

SEQ ID NO: 225371 - RNA, 32 nt, Human
uauuaaauuaugcaacugaaacuccugaauua

SEQ ID NO: 225372 - RNA, 32 nt, Human
uauuaacaacuaauugcauccauuaucuccuu

SEQ ID NO: 225373 - RNA, 32 nt, Human
uauuaacacagcuguuugggucugauccuaga

SEQ ID NO: 225374 - RNA, 32 nt, Human
uauuaaccagucauuacacugcggaacagcca

SEQ ID NO: 225375 - RNA, 24 nt, Human
uauuaaccccugaccaaaacgacu

SEQ ID NO: 225376 - RNA, 23 nt, Human
uauuaaccccugaccaaaacuac

SEQ ID NO: 225377 - RNA, 24 nt, Human
uauuaaccccugaccaaaacuacu

SEQ ID NO: 225378 - RNA, 24 nt, Human
uauuaaccccugaccaaaacuauu

SEQ ID NO: 225379 - RNA, 20 nt, Human
uauuaaccccuggcaaaacu

SEQ ID NO: 225380 - RNA, 32 nt, Human
uauuaacgacggucccagcagaaugcuguaug

SEQ ID NO: 225381 - RNA, 32 nt, Human
uauuaacgcaucuggccaacuuggguuauaaa

SEQ ID NO: 225382 - RNA, 32 nt, Human
uauuaacgcuaaagguguaagacuucagauuu

SEQ ID NO: 225383 - RNA, 32 nt, Human
uauuaacuguggcaauggcauggggguuauaa

SEQ ID NO: 225384 - RNA, 32 nt, Human
uauuaacugugguugugcuggaauggaggagg

SEQ ID NO: 225385 - RNA, 32 nt, Human
uauuaagagcacauuuauuuacauuuguauau

SEQ ID NO: 225386 - RNA, 32 nt, Human
uauuaagaguuaugccuggugggguguggugg

SEQ ID NO: 225387 - RNA, 32 nt, Human
uauuaagaugauucauuucauuuccacucgug

SEQ ID NO: 225388 - RNA, 32 nt, Human
uauuaagauggaaguaguuaaauauggguuau

SEQ ID NO: 225389 - RNA, 32 nt, Human
uauuaagcccaggaguugcuuuggggauggcu

SEQ ID NO: 225390 - RNA, 32 nt, Human
uauuaagcuccuacucugugcaaaucacucua

SEQ ID NO: 225391 - RNA, 32 nt, Human
uauuaaggaagcugagcaacuggagccucgag

SEQ ID NO: 225392 - RNA, 32 nt, Human
uauuaaggacucucugcuccagccucucacuc

SEQ ID NO: 225393 - RNA, 32 nt, Human
uauuaaggauguuaggagagauuugauuuaau

SEQ ID NO: 225394 - RNA, 32 nt, Human
uauuaagggaaaggaaaagaacacuagcuaag

SEQ ID NO: 225395 - RNA, 32 nt, Human
uauuaagguauuuuaagacagaaagagagaga

SEQ ID NO: 225396 - RNA, 32 nt, Human
uauuaaguaaccuguuuugaauccagacauuc

SEQ ID NO: 225397 - RNA, 32 nt, Human
uauuaaguauauguguucaucuuagcaauggu

SEQ ID NO: 225398 - RNA, 31 nt, Human
uauuaagugcacuucuuguauuucuaauaag

SEQ ID NO: 225399 - RNA, 32 nt, Human
uauuaagugcagcuugacauuauguuuuauuu

SEQ ID NO: 225400 - RNA, 32 nt, Human
uauuaauacaagggguuugaacuggacauccu

SEQ ID NO: 225401 - RNA, 32 nt, Human
uauuaauacaccgauaaccacaggggaagggc

SEQ ID NO: 225402 - RNA, 32 nt, Human
uauuaauacuaggaauaccaacauuauuaggg

SEQ ID NO: 225403 - RNA, 32 nt, Human
uauuaauacugaugugauggaugcauuuguuu

SEQ ID NO: 225404 - RNA, 23 nt, Human
uauuaauacuguaguuauacacc

SEQ ID NO: 225405 - RNA, 32 nt, Human
uauuaauagcacagcagaugugugcugcccau

SEQ ID NO: 225406 - RNA, 32 nt, Human
uauuaauaggcgcauucaguuuggaaaagaca

SEQ ID NO: 225407 - RNA, 32 nt, Human
uauuaauaggggcauaaauaaaggucgaagag

SEQ ID NO: 225408 - RNA, 32 nt, Human
uauuaauaugugcacacaaauauguguaaaag

SEQ ID NO: 225409 - RNA, 32 nt, Human
uauuaaucauaggagcuugcagucucacuagg

SEQ ID NO: 225410 - RNA, 32 nt, Human
uauuaauccauguuauccucccaauaacucug

SEQ ID NO: 225411 - RNA, 32 nt, Human
uauuaaucuuuuuaguguaaacaucaguaacu

SEQ ID NO: 225412 - RNA, 32 nt, Human
uauuaaugaaaaugcaucuauuucagagcuga

SEQ ID NO: 225413 - RNA, 32 nt, Human
uauuaaugacucaucaucagugccccagagga

SEQ ID NO: 225414 - RNA, 32 nt, Human
uauuaaugaguauuuggaagaaaauugaccua

SEQ ID NO: 225415 - RNA, 32 nt, Human
uauuaaugagucuacaacugcugcuuuguuca

SEQ ID NO: 225416 - RNA, 32 nt, Human
uauuaaugaugcagagguuggaggagagaggu

SEQ ID NO: 225417 - RNA, 32 nt, Human
uauuaauggaguuauugcuauuuuugcuguga

SEQ ID NO: 225418 - RNA, 32 nt, Human
uauuaaugggccugcuucuuagcaauauuaga

SEQ ID NO: 225419 - RNA, 32 nt, Human
uauuaaugucaguacuaccagcacuuugccaa

SEQ ID NO: 225420 - RNA, 32 nt, Human
uauuaauucauaaugaacuucccucuucugga

SEQ ID NO: 225421 - RNA, 32 nt, Human
uauuaauuccaucugagugauugucaguguaa

SEQ ID NO: 225422 - RNA, 32 nt, Human
uauuaauucccucccuuucuuuuucuuacuag

SEQ ID NO: 225423 - RNA, 32 nt, Human
uauuaauugacugucuuguaagccacuuguuu

SEQ ID NO: 225424 - RNA, 32 nt, Human
uauuaauugcuuacagauuauaccucauauua

SEQ ID NO: 225425 - RNA, 32 nt, Human
uauuaauuuagaaaauaccccauuuuugccac

SEQ ID NO: 225426 - RNA, 32 nt, Human
uauuaauuucccucaucucuuuuauaggccug

SEQ ID NO: 225427 - RNA, 32 nt, Human
uauuacaaaaccagacacuuuuacauucaugg

SEQ ID NO: 225428 - RNA, 32 nt, Human
uauuacaaagcaaauauuaccccaaauugucc

SEQ ID NO: 225429 - RNA, 32 nt, Human
uauuacaaaucugcauaaaauaccucauuuca

SEQ ID NO: 225430 - RNA, 32 nt, Human
uauuacaagcaccuggcagugacauugcacga

SEQ ID NO: 225431 - RNA, 32 nt, Human
uauuacacaagaaacuuggucugcagucugga

SEQ ID NO: 225432 - RNA, 25 nt, Human
uauuacacauaauuuauacuggaca

SEQ ID NO: 225433 - RNA, 32 nt, Human
uauuacagauggaaagaaugaggcucagggaa

SEQ ID NO: 225434 - RNA, 32 nt, Human
uauuacagcucucuggugucucuucucauuug

SEQ ID NO: 225435 - RNA, 32 nt, Human
uauuacaggagaaggauugggaacagaaugga

SEQ ID NO: 225436 - RNA, 32 nt, Human
uauuacaggauuucaucauguugcccaggcuc

SEQ ID NO: 225437 - RNA, 32 nt, Human
uauuacauauccaccaucacuucauuuagcug

SEQ ID NO: 225438 - RNA, 32 nt, Human
uauuacaugcugcaucuuucagccuggagacu

SEQ ID NO: 225439 - RNA, 32 nt, Human
uauuacauguaauacaaaacaaacauguaguu

SEQ ID NO: 225440 - RNA, 32 nt, Human
uauuaccacuccucucccauuuguggcaguuu

SEQ ID NO: 225441 - RNA, 32 nt, Human
uauuaccagcaacgucgcuucucaggccuugg

SEQ ID NO: 225442 - RNA, 32 nt, Human
uauuaccagcacuuacaagcacugugaaaacu

SEQ ID NO: 225443 - RNA, 32 nt, Human
uauuaccaggaggaagagaaagaggacaaaau

SEQ ID NO: 225444 - RNA, 32 nt, Human
uauuaccaggaucggagagagcgggccccuuu

SEQ ID NO: 225445 - RNA, 32 nt, Human
uauuaccaggcccaacucagucuucagugauu

SEQ ID NO: 225446 - RNA, 32 nt, Human
uauuacccacacaaacccacauugaguuagaa

SEQ ID NO: 225447 - RNA, 32 nt, Human
uauuaccccauacuugaagauagcuuagugua

SEQ ID NO: 225448 - RNA, 32 nt, Human
uauuacccucuacaauauacuuuuuauugagc

SEQ ID NO: 225449 - RNA, 32 nt, Human
uauuacccuucucuuuauaucaagggucuaau

SEQ ID NO: 225450 - RNA, 32 nt, Human
uauuacccuuuccuauguguuuuaucuaauua

SEQ ID NO: 225451 - RNA, 32 nt, Human
uauuaccucgcugcuacuuuucugcagggaua

SEQ ID NO: 225452 - RNA, 31 nt, Human
uauuaccugccuuagcuuugccaaagcaacg

SEQ ID NO: 225453 - RNA, 32 nt, Human
uauuaccuucaccuccuuuucucccccuucuc

SEQ ID NO: 225454 - RNA, 32 nt, Human
uauuaccuuugucucuucauaccgguuuuaug

SEQ ID NO: 225455 - RNA, 32 nt, Human
uauuacggcagggagaggaagaucgggagagc

SEQ ID NO: 225456 - RNA, 32 nt, Human
uauuacggggucuggcucugucacccaggcug

SEQ ID NO: 225457 - RNA, 32 nt, Human
uauuacguagacuuuccucucucccaaaagau

SEQ ID NO: 225458 - RNA, 32 nt, Human
uauuacgucauaaaccauugaaaacacaucua

SEQ ID NO: 225459 - RNA, 32 nt, Human
uauuacuaacagguccaacccuaagugagaca

SEQ ID NO: 225460 - RNA, 32 nt, Human
uauuacuacuucuguuccauggugugcagguc

SEQ ID NO: 225461 - RNA, 32 nt, Human
uauuacuauccuaaauggaaacucagaaucac

SEQ ID NO: 225462 - RNA, 32 nt, Human
uauuacucaaucuggaaagugcaaauacacac

SEQ ID NO: 225463 - RNA, 32 nt, Human
uauuacucagcagcaguaacaugguaacacuu

SEQ ID NO: 225464 - RNA, 32 nt, Human
uauuacucuuuggcaucucucuucuccaaagu

SEQ ID NO: 225465 - RNA, 32 nt, Human
uauuacugcagcugcccaaagaugcuuuauuu

SEQ ID NO: 225466 - RNA, 32 nt, Human
uauuacugcuuugugaaaguccagacugaacg

SEQ ID NO: 225467 - RNA, 32 nt, Human
uauuacugguggaugcaccguguccacagcag

SEQ ID NO: 225468 - RNA, 32 nt, Human
uauuacuguauuaguccaauguuaaacauuuu

SEQ ID NO: 225469 - RNA, 32 nt, Human
uauuacuguggugaaacaaaauaucuuuaaaa

SEQ ID NO: 225470 - RNA, 32 nt, Human
uauuacuuacuucaaacuguuucccaaaauaa

SEQ ID NO: 225471 - RNA, 32 nt, Human
uauuacuuuagcauuugacccuccaguggagu

SEQ ID NO: 225472 - RNA, 32 nt, Human
uauuacuuucauaugaauaaaaguaauccaug

SEQ ID NO: 225473 - RNA, 32 nt, Human
uauuacuuuguucuugguccuucacagggccu

SEQ ID NO: 225474 - RNA, 32 nt, Human
uauuacuuuuaccauggugagcuggaauggcc

SEQ ID NO: 225475 - RNA, 32 nt, Human
uauuagaaaagcuuuguuuuccuugaagaaug

SEQ ID NO: 225476 - RNA, 32 nt, Human
uauuagaaaaggacagggcuggcugaccuguc

SEQ ID NO: 225477 - RNA, 32 nt, Human
uauuagaacuucagaagacauaggagcaguua

SEQ ID NO: 225478 - RNA, 32 nt, Human
uauuagagaagagauugugguuucauucugua

SEQ ID NO: 225479 - RNA, 27 nt, Human
uauuagagacaggguuucuccguguug

SEQ ID NO: 225480 - RNA, 32 nt, Human
uauuagagacgggguuucaccauguuaggaua

SEQ ID NO: 225481 - RNA, 32 nt, Human
uauuagagaugggguuucaccauguuggccag

SEQ ID NO: 225482 - RNA, 32 nt, Human
uauuagaggaagagauugagagaccuagcaau

SEQ ID NO: 225483 - RNA, 32 nt, Human
uauuagaguuuauacuguagagaaaucauaug

SEQ ID NO: 225484 - RNA, 32 nt, Human
uauuagauguuuguguaaccacuugcuuauuu

SEQ ID NO: 225485 - RNA, 32 nt, Human
uauuagcaaugggguuucaccaugcuggccag

SEQ ID NO: 225486 - RNA, 21 nt, Human
uauuagcagauuaaacuagca

SEQ ID NO: 225487 - RNA, 32 nt, Human
uauuagcaggcauacuuuuccacacaucuuug

SEQ ID NO: 225488 - RNA, 30 nt, Human
uauuagcccuucuccauggcccugccaugc

SEQ ID NO: 225489 - RNA, 32 nt, Human
uauuagccucaagccuucuaaugaguccuugc

SEQ ID NO: 225490 - RNA, 32 nt, Human
uauuagccugaugcagauaccaaagauaauuu

SEQ ID NO: 225491 - RNA, 32 nt, Human
uauuagcguuuuaacaguuacaagcuuuaaau

SEQ ID NO: 225492 - RNA, 32 nt, Human
uauuagcuauugugugcuaagcauucaacuag

SEQ ID NO: 225493 - RNA, 32 nt, Human
uauuagcucuacuggaauuuucauacacguaa

SEQ ID NO: 225494 - RNA, 31 nt, Human
uauuagcuuaaaacuguacuguugaauucug

SEQ ID NO: 225495 - RNA, 32 nt, Human
uauuagcuuaucagcuaaaauauugcauagug

SEQ ID NO: 225496 - RNA, 32 nt, Human
uauuagcuuuuuaaguuccuuccaaauauguu

SEQ ID NO: 225497 - RNA, 32 nt, Human
uauuaggaaaggaauggaaaguagucauuaug

SEQ ID NO: 225498 - RNA, 32 nt, Human
uauuaggaaugugaagccagaaugggucaguu

SEQ ID NO: 225499 - RNA, 32 nt, Human
uauuaggagguggggucuuugggaggugaugu

SEQ ID NO: 225500 - RNA, 32 nt, Human
uauuagggaggcugaggcaggagaaucgcuug

SEQ ID NO: 225501 - RNA, 32 nt, Human
uauuagggauaaaacauauaggugcacaagag

SEQ ID NO: 225502 - RNA, 32 nt, Human
uauuagggucucaauacuuucucaaggggcua

SEQ ID NO: 225503 - RNA, 32 nt, Human
uauuaggguggaagaggaaucaagaguaaaga

SEQ ID NO: 225504 - RNA, 32 nt, Human
uauuagggugguuccugaugggaaaaggacau

SEQ ID NO: 225505 - RNA, 32 nt, Human
uauuagguauuuuuccuaaugcuaucccuccc

SEQ ID NO: 225506 - RNA, 32 nt, Human
uauuaggucauccuggguacucaggccucuag

SEQ ID NO: 225507 - RNA, 32 nt, Human
uauuaggugguugggccucuuccaaucaguug

SEQ ID NO: 225508 - RNA, 20 nt, Human
uauuaguaaacaucuggaua

SEQ ID NO: 225509 - RNA, 32 nt, Human
uauuagucucuucucaggcugcuaauaaacac

SEQ ID NO: 225510 - RNA, 21 nt, Human
uauuagucuguucucaugcug

SEQ ID NO: 225511 - RNA, 32 nt, Human
uauuagugagaggugaagccagcuggacuucc

SEQ ID NO: 225512 - RNA, 32 nt, Human
uauuagugauacaaaguuaaaauuucaauauu

SEQ ID NO: 225513 - RNA, 32 nt, Human
uauuagugguguggcacugggagcugcuccua

SEQ ID NO: 225514 - RNA, 32 nt, Human
uauuaguguuucuuauuuuggccaguucuuuu

SEQ ID NO: 225515 - RNA, 32 nt, Human
uauuaguuaugaguuugguugcaguguucuua

SEQ ID NO: 225516 - RNA, 32 nt, Human
uauuaguuauuguuauaaauaucuuauugugc

SEQ ID NO: 225517 - RNA, 32 nt, Human
uauuauaaacagaaaaucuuuccucuucucau

SEQ ID NO: 225518 - RNA, 32 nt, Human
uauuauaaacucaucaaauauauuucuucuug

SEQ ID NO: 225519 - RNA, 32 nt, Human
uauuauaaaguacauuuaaaguucaaggacua

SEQ ID NO: 225520 - RNA, 32 nt, Human
uauuauaauaauccucacccuacaaucauaac

SEQ ID NO: 225521 - RNA, 32 nt, Human
uauuauaauucaagugccauuagaugauauau

SEQ ID NO: 225522 - RNA, 29 nt, Human
uauuauacacuugaacauguguuuguaua

SEQ ID NO: 225523 - RNA, 32 nt, Human
uauuauaccaacaauugguuuuuacaagcuag

SEQ ID NO: 225524 - RNA, 32 nt, Human
uauuauacuguggcugguggacuauuuucauc

SEQ ID NO: 225525 - RNA, 32 nt, Human
uauuauagguauuuuugccugcccucuagggu

SEQ ID NO: 225526 - RNA, 32 nt, Human
uauuauauuuucacagacuuuugaagcacaaa

SEQ ID NO: 225527 - RNA, 32 nt, Human
uauuaucaacacccuccaugugcagaaaccug

SEQ ID NO: 225528 - RNA, 21 nt, Human
uauuaucaauaggcauggagg

SEQ ID NO: 225529 - RNA, 32 nt, Human
uauuaucaauucuccuucauagacauuuuaua

SEQ ID NO: 225530 - RNA, 32 nt, Human
uauuaucacaccauugcacucuugucugggug

SEQ ID NO: 225531 - RNA, 32 nt, Human
uauuaucacgccgcugcacuccagcuugaaug

SEQ ID NO: 225532 - RNA, 32 nt, Human
uauuaucccauaugcuaccuaguuugcugguc

SEQ ID NO: 225533 - RNA, 32 nt, Human
uauuaucccccagugcuccagaacagcgggag

SEQ ID NO: 225534 - RNA, 32 nt, Human
uauuaucccggcuuggagauuuugccagccug

SEQ ID NO: 225535 - RNA, 32 nt, Human
uauuaucugcucucacacugcucauaaagaca

SEQ ID NO: 225536 - RNA, 32 nt, Human
uauuaugacaacaucaccaauguugugguaaa

SEQ ID NO: 225537 - RNA, 32 nt, Human
uauuaugaccucacugacaguucuuuuucucu

SEQ ID NO: 225538 - RNA, 32 nt, Human
uauuaugaggagaagguaggaguguagcuagc

SEQ ID NO: 225539 - RNA, 32 nt, Human
uauuaugauggagggaagugaggugaauccag

SEQ ID NO: 225540 - RNA, 25 nt, Human
uauuaugcacuaaccuuuuuuggug

SEQ ID NO: 225541 - RNA, 32 nt, Human
uauuaugcaggggcaaacaccugcugaugugg

SEQ ID NO: 225542 - RNA, 32 nt, Human
uauuaugccugggccagucuugagccagcuuu

SEQ ID NO: 225543 - RNA, 22 nt, Human
uauuaugcuaucuuuuuugaua

SEQ ID NO: 225544 - RNA, 32 nt, Human
uauuaugggaggcuggagugcaauggugccau

SEQ ID NO: 225545 - RNA, 32 nt, Human
uauuaugguucacaucugagguaacccaucgg

SEQ ID NO: 225546 - RNA, 32 nt, Human
uauuauguauuuaauaaucacauaacucuuua

SEQ ID NO: 225547 - RNA, 32 nt, Human
uauuauuaagcagacuuaagggccaguggggg

SEQ ID NO: 225548 - RNA, 32 nt, Human
uauuauuaauagcaaccagggccgggugucgu

SEQ ID NO: 225549 - RNA, 32 nt, Human
uauuauuagcuucuaacuuugcacugaguguc

SEQ ID NO: 225550 - RNA, 32 nt, Human
uauuauuauauguauguguuuauauguaugca

SEQ ID NO: 225551 - RNA, 32 nt, Human
uauuauuauuguuuguaaaacaugguucacau

SEQ ID NO: 225552 - RNA, 32 nt, Human
uauuauuauuuguagaaaggcuuuuuaacuuc

SEQ ID NO: 225553 - RNA, 32 nt, Human
uauuauuauuuuuaguagagaugggguuucac

SEQ ID NO: 225554 - RNA, 32 nt, Human
uauuauuauuuuugauuuacuaagccaaugga

SEQ ID NO: 225555 - RNA, 32 nt, Human
uauuauucccuugcucauauaacuuuaaaaau

SEQ ID NO: 225556 - RNA, 32 nt, Human
uauuauugaguuguaagaguccuuuuauagcc

SEQ ID NO: 225557 - RNA, 32 nt, Human
uauuauugccuucuucagcacaauaaggcuuu

SEQ ID NO: 225558 - RNA, 32 nt, Human
uauuauugucugaaaaugaauguaguacugau

SEQ ID NO: 225559 - RNA, 23 nt, Human
uauuauuuacucuuuacuagaca

SEQ ID NO: 225560 - RNA, 32 nt, Human
uauuauuuacuucauuuauuuuuaugagguau

SEQ ID NO: 225561 - RNA, 32 nt, Human
uauuauuuauccacucaggauugaccaccccu

SEQ ID NO: 225562 - RNA, 32 nt, Human
uauuauuucuauaauuggauacucauucuucc

SEQ ID NO: 225563 - RNA, 32 nt, Human
uauuauuugcacagaagaguucuagggagaug

SEQ ID NO: 225564 - RNA, 32 nt, Human
uauuauuugggggaacagaaaaggacaaggaa

SEQ ID NO: 225565 - RNA, 32 nt, Human
uauuauuuguuagaggagugacuugauuugaa

SEQ ID NO: 225566 - RNA, 32 nt, Human
uauuauuuuaaaccugcaugauuguaccaugc

SEQ ID NO: 225567 - RNA, 32 nt, Human
uauuauuuucaucaguaugaucauaauuauga

SEQ ID NO: 225568 - RNA, 32 nt, Human
uauuauuuucaucaugggcuucugccuggcuc

SEQ ID NO: 225569 - RNA, 32 nt, Human
uauuauuuucuaaauuggguuaagucuaagaa

SEQ ID NO: 225570 - RNA, 32 nt, Human
uauuauuuugagacggagucuuacucuguugc

SEQ ID NO: 225571 - RNA, 30 nt, Human
uauuauuuugagacggaguuucgcucuugu

SEQ ID NO: 225572 - RNA, 32 nt, Human
uauuauuuugagacugagucuugcucuaucac

SEQ ID NO: 225573 - RNA, 32 nt, Human
uauuauuuugagauggagucucgcucugucac

SEQ ID NO: 225574 - RNA, 32 nt, Human
uauucaaaaggccaucccuguaaaggcagaaa

SEQ ID NO: 225575 - RNA, 31 nt, Human
uauucaaagacagagaagaccaaagcauugc

SEQ ID NO: 225576 - RNA, 32 nt, Human
uauucaaagcacuuucuuaagcauuuuagaaa

SEQ ID NO: 225577 - RNA, 32 nt, Human
uauucaaauaucuauuuaaagacauuuauauu

SEQ ID NO: 225578 - RNA, 32 nt, Human
uauucaaauccuggguccugagcugcuguuuc

SEQ ID NO: 225579 - RNA, 32 nt, Human
uauucaagaauaaugcauacaauucaguggua

SEQ ID NO: 225580 - RNA, 24 nt, Human
uauucaagcgauucuccugucuca

SEQ ID NO: 225581 - RNA, 32 nt, Human
uauucaagcuaaauguuacugcucucucccaa

SEQ ID NO: 225582 - RNA, 31 nt, Human
uauucaaggaaacuggguagaggcuacauga

SEQ ID NO: 225583 - RNA, 32 nt, Human
uauucaaggaugacucccucccuuccugucua

SEQ ID NO: 225584 - RNA, 32 nt, Human
uauucaaggucugagugccacguggacuucuu

SEQ ID NO: 225585 - RNA, 32 nt, Human
uauucaagugaugcucaugauccuguuacugu

SEQ ID NO: 225586 - RNA, 32 nt, Human
uauucaauaaaacaaaaauuucuagguauuug

SEQ ID NO: 225587 - RNA, 30 nt, Human
uauucaauaaaauaugcacagaacagaaag

SEQ ID NO: 225588 - RNA, 32 nt, Human
uauucaauaagccuggucaauucuauaguuau

SEQ ID NO: 225589 - RNA, 32 nt, Human
uauucaauagguaauaaaaauuaguugucccu

SEQ ID NO: 225590 - RNA, 32 nt, Human
uauucaauuacaaaugggcauuuaguauaguu

SEQ ID NO: 225591 - RNA, 32 nt, Human
uauucaauuagcaaaggagaaacuuucucaau

SEQ ID NO: 225592 - RNA, 32 nt, Human
uauucaauuucaucaagccuuguauacuucug

SEQ ID NO: 225593 - RNA, 32 nt, Human
uauucacacccaugcacgcacacacauacaca

SEQ ID NO: 225594 - RNA, 32 nt, Human
uauucacacuccucugcccucgauuugcauga

SEQ ID NO: 225595 - RNA, 32 nt, Human
uauucacagcaaccuggcagaagagaauguga

SEQ ID NO: 225596 - RNA, 32 nt, Human
uauucacagcacagcacagcagugcugacagc

SEQ ID NO: 225597 - RNA, 32 nt, Human
uauucacagcugcuuggauggcugaggcagga

SEQ ID NO: 225598 - RNA, 32 nt, Human
uauucacauaagauuccuagaagccaccgaau

SEQ ID NO: 225599 - RNA, 32 nt, Human
uauucacauauauaaugagaggaguaguaccu

SEQ ID NO: 225600 - RNA, 32 nt, Human
uauucaccaccaauaaaucagaccaugaaacc

SEQ ID NO: 225601 - RNA, 32 nt, Human
uauucacuccaagaaaaguaacaggcaaggca

SEQ ID NO: 225602 - RNA, 32 nt, Human
uauucacugagucucauggagagaugucuguu

SEQ ID NO: 225603 - RNA, 32 nt, Human
uauucacuuuuuauuaaaacaggaugaggcgu

SEQ ID NO: 225604 - RNA, 32 nt, Human
uauucagaccuaagacagggaggggucagagu

SEQ ID NO: 225605 - RNA, 32 nt, Human
uauucagagagaagaacaaauggcuggcuugg

SEQ ID NO: 225606 - RNA, 32 nt, Human
uauucagaggcagugaugacuugcuguccagg

SEQ ID NO: 225607 - RNA, 32 nt, Human
uauucagauacccucacgccacugcagaagcg

SEQ ID NO: 225608 - RNA, 32 nt, Human
uauucagaucaggagacugagauucagagcag

SEQ ID NO: 225609 - RNA, 32 nt, Human
uauucagcaauaaaaagacaugaagcauugac

SEQ ID NO: 225610 - RNA, 32 nt, Human
uauucagcaaucauaagugcugugcauaacua

SEQ ID NO: 225611 - RNA, 32 nt, Human
uauucagcacaugaaauaaacaaggggcaucc

SEQ ID NO: 225612 - RNA, 32 nt, Human
uauucagcagcagaguuggugacuuugacaac

SEQ ID NO: 225613 - RNA, 31 nt, Human
uauucagcagcuuucugacguggacaucaga

SEQ ID NO: 225614 - RNA, 32 nt, Human
uauucagccugaaagcauuucugccauaguug

SEQ ID NO: 225615 - RNA, 32 nt, Human
uauucaggaaacugaggugggaggaucacuug

SEQ ID NO: 225616 - RNA, 32 nt, Human
uauucaggccaggucuugcuguuguaucaagg

SEQ ID NO: 225617 - RNA, 32 nt, Human
uauucagggaacaccagugaguguucaucugc

SEQ ID NO: 225618 - RNA, 31 nt, Human
uauucagguuggcugugucagaugcuaaugu

SEQ ID NO: 225619 - RNA, 32 nt, Human
uauucagucuuuuauucuuuauaauugugugu

SEQ ID NO: 225620 - RNA, 32 nt, Human
uauucagugagcuaugggguaguguuucacuc

SEQ ID NO: 225621 - RNA, 32 nt, Human
uauucaguguccgaauugaggccauuugggaa

SEQ ID NO: 225622 - RNA, 32 nt, Human
uauucaguugcugcuuacaauaguugauaccc

SEQ ID NO: 225623 - RNA, 32 nt, Human
uauucauaagcuauuuuugguaagaauuuuaa

SEQ ID NO: 225624 - RNA, 32 nt, Human
uauucauaaugucgugugcuuaaaagugggcu

SEQ ID NO: 225625 - RNA, 32 nt, Human
uauucauagucuuuugugaaucauugccuuuu

SEQ ID NO: 225626 - RNA, 32 nt, Human
uauucauauagucagauauauguugucugcuu

SEQ ID NO: 225627 - RNA, 32 nt, Human
uauucauauuaguggccugagagguguuuguu

SEQ ID NO: 225628 - RNA, 32 nt, Human
uauucauauuccucucuguuguguuucggggg

SEQ ID NO: 225629 - RNA, 32 nt, Human
uauucaucaagugcccucuagcuguuaaguca

SEQ ID NO: 225630 - RNA, 32 nt, Human
uauucaucaccuuuguagcauuugacaaauuu

SEQ ID NO: 225631 - RNA, 32 nt, Human
uauucaucagcuugggcugccacagcaccaug

SEQ ID NO: 225632 - RNA, 32 nt, Human
uauucauccaacaagccauaaagccauaaugu

SEQ ID NO: 225633 - RNA, 32 nt, Human
uauucaucccuuaauauccccauuagaauaua

SEQ ID NO: 225634 - RNA, 32 nt, Human
uauucauccuuguuucccuugugggaucaggu

SEQ ID NO: 225635 - RNA, 32 nt, Human
uauucaucugggaggcagaacaggcuucggac

SEQ ID NO: 225636 - RNA, 32 nt, Human
uauucaucuuuaugaacacaucagccuuucaa

SEQ ID NO: 225637 - RNA, 32 nt, Human
uauucaucuuugucuucccucggaucagcuuu

SEQ ID NO: 225638 - RNA, 32 nt, Human
uauucaucuuugugucuccagcaucuaguaca

SEQ ID NO: 225639 - RNA, 32 nt, Human
uauucaugagggugguccugacacaugcguau

SEQ ID NO: 225640 - RNA, 32 nt, Human
uauucauggcagucacagcagggguagaggga

SEQ ID NO: 225641 - RNA, 32 nt, Human
uauucauucaagauuuuuguguccucauuaug

SEQ ID NO: 225642 - RNA, 32 nt, Human
uauucauucccaggaacucuugggguaggugu

SEQ ID NO: 225643 - RNA, 32 nt, Human
uauucauucucucuucuccaucacccauaccc

SEQ ID NO: 225644 - RNA, 32 nt, Human
uauucauugagcauauacuaugugccaagcau

SEQ ID NO: 225645 - RNA, 32 nt, Human
uauucauuguuuggcuucccacccauaagcuc

SEQ ID NO: 225646 - RNA, 32 nt, Human
uauucauuucuauuuucagcauguuucuacca

SEQ ID NO: 225647 - RNA, 32 nt, Human
uauucauuuuacuuuuucauuuuggggugaag

SEQ ID NO: 225648 - RNA, 32 nt, Human
uauuccaaaugagaguaugauggacagauauu

SEQ ID NO: 225649 - RNA, 32 nt, Human
uauuccaaggaacaacaucaguucacuguugu

SEQ ID NO: 225650 - RNA, 23 nt, Human
uauuccacaauuuggaguaaaca

SEQ ID NO: 225651 - RNA, 32 nt, Human
uauuccacccuugugacaugguauuagucaag

SEQ ID NO: 225652 - RNA, 32 nt, Human
uauuccaccugauaauagcccagauucuacug

SEQ ID NO: 225653 - RNA, 32 nt, Human
uauuccaccuguaauagcacuuuggaacugug

SEQ ID NO: 225654 - RNA, 32 nt, Human
uauuccagaacagcaaacuuccugggugaggg

SEQ ID NO: 225655 - RNA, 32 nt, Human
uauuccagacugggugacagagugagacucca

SEQ ID NO: 225656 - RNA, 32 nt, Human
uauuccagaggugggaggugggaggggaaggg

SEQ ID NO: 225657 - RNA, 32 nt, Human
uauuccagcaagaaagaaaagauuguuaugca

SEQ ID NO: 225658 - RNA, 32 nt, Human
uauuccagcaagaaagauugugaugcaagauu

SEQ ID NO: 225659 - RNA, 32 nt, Human
uauuccagcccgggugacagagcaagacugug

SEQ ID NO: 225660 - RNA, 32 nt, Human
uauuccagccuccuccuaagguccuccucagc

SEQ ID NO: 225661 - RNA, 32 nt, Human
uauuccagccuggacgacugagugagacccug

SEQ ID NO: 225662 - RNA, 32 nt, Human
uauuccagccuggaugacaaagcaagacccug

SEQ ID NO: 225663 - RNA, 32 nt, Human
uauuccagccugggugacagagugagauccug

SEQ ID NO: 225664 - RNA, 32 nt, Human
uauuccaggacgagauccaguucuccagcggg

SEQ ID NO: 225665 - RNA, 32 nt, Human
uauuccaggauuguuaaggauccucgcuucca

SEQ ID NO: 225666 - RNA, 32 nt, Human
uauuccagggggcugaggcaggagaauuguuu

SEQ ID NO: 225667 - RNA, 32 nt, Human
uauuccaguagucaguacacuuuucuagauaa

SEQ ID NO: 225668 - RNA, 32 nt, Human
uauuccagucugggugacagagugagacucug

SEQ ID NO: 225669 - RNA, 32 nt, Human
uauuccaucagggaggagucagaggaauuugc

SEQ ID NO: 225670 - RNA, 32 nt, Human
uauuccauccuguaauccuagcacuuuaaaag

SEQ ID NO: 225671 - RNA, 32 nt, Human
uauuccaucucucaagauauauuauaaaauuu

SEQ ID NO: 225672 - RNA, 32 nt, Human
uauuccaucugcuguagcaauggcuaaagggu

SEQ ID NO: 225673 - RNA, 27 nt, Human
uauuccauuaaaucuacugaagcagug

SEQ ID NO: 225674 - RNA, 24 nt, Human
uauuccauuuuuacuaaagcacug

SEQ ID NO: 225675 - RNA, 32 nt, Human
uauucccaacacuuuuggaggcugagguugga

SEQ ID NO: 225676 - RNA, 32 nt, Human
uauucccaauugcacuggcccugggcauggcc

SEQ ID NO: 225677 - RNA, 32 nt, Human
uauucccaccacauacuaggcacuccauaaau

SEQ ID NO: 225678 - RNA, 32 nt, Human
uauucccaccccugggccugaguggggaagga

SEQ ID NO: 225679 - RNA, 32 nt, Human
uauucccagagcuuugggaggcugaggcgaga

SEQ ID NO: 225680 - RNA, 32 nt, Human
uauucccagcacuuugggaggccgaggcaggu

SEQ ID NO: 225681 - RNA, 32 nt, Human
uauucccagcagacacauuuagaaacuaagcu

SEQ ID NO: 225682 - RNA, 32 nt, Human
uauucccagcauuuugggaggcugaggcagga

SEQ ID NO: 225683 - RNA, 32 nt, Human
uauucccagcuacucaugaggcugaggcagga

SEQ ID NO: 225684 - RNA, 32 nt, Human
uauucccagcuacucgggaggcugaggcagga

SEQ ID NO: 225685 - RNA, 32 nt, Human
uauucccagcuacucuggaggcugaggcggag

SEQ ID NO: 225686 - RNA, 32 nt, Human
uauucccagcuacuggggaggcugaggcagga

SEQ ID NO: 225687 - RNA, 32 nt, Human
uauucccagcuacuuggaaggcugagacagga

SEQ ID NO: 225688 - RNA, 32 nt, Human
uauucccagcuacuugggaggcugaggcagga

SEQ ID NO: 225689 - RNA, 32 nt, Human
uauucccagcugcuugggaggcugaggcagga

SEQ ID NO: 225690 - RNA, 32 nt, Human
uauucccagcuucucgggaggcugaggcagga

SEQ ID NO: 225691 - RNA, 32 nt, Human
uauucccaggccaaggagaguccuuccucucc

SEQ ID NO: 225692 - RNA, 32 nt, Human
uauucccaucuacuugggaggcugaggcagga

SEQ ID NO: 225693 - RNA, 18 nt, Human
uauuccccacaguuccca

SEQ ID NO: 225694 - RNA, 32 nt, Human
uauuccccaucugguccaguuccuucacuuac

SEQ ID NO: 225695 - RNA, 32 nt, Human
uauucccccucugccucuccccaccuucuuug

SEQ ID NO: 225696 - RNA, 32 nt, Human
uauuccccuaggcugagccugcucauguaccu

SEQ ID NO: 225697 - RNA, 32 nt, Human
uauuccccugcuccuccaccuuucaaucccuc

SEQ ID NO: 225698 - RNA, 32 nt, Human
uauuccccugggugugcacacagggcgggugu

SEQ ID NO: 225699 - RNA, 32 nt, Human
uauuccccuuucucuuccccacacagccagua

SEQ ID NO: 225700 - RNA, 32 nt, Human
uauucccggccacucgggaggcugaggcagga

SEQ ID NO: 225701 - RNA, 32 nt, Human
uauucccugacccuucacccccaaucaccuca

SEQ ID NO: 225702 - RNA, 32 nt, Human
uauucccuugauaccacucugucuuuaugacu

SEQ ID NO: 225703 - RNA, 32 nt, Human
uauucccuugggcugugguggaaaaaugaggg

SEQ ID NO: 225704 - RNA, 32 nt, Human
uauuccgugccugcugucugcuguaaggcugc

SEQ ID NO: 225705 - RNA, 32 nt, Human
uauuccuacauacuugcugaguucaucuucua

SEQ ID NO: 225706 - RNA, 32 nt, Human
uauuccuagcuacuuugauggcugaggcacaa

SEQ ID NO: 225707 - RNA, 32 nt, Human
uauuccuaucucaaggaugugggguuuaaaug

SEQ ID NO: 225708 - RNA, 27 nt, Human
uauuccuauguguuucuuuggccugug

SEQ ID NO: 225709 - RNA, 32 nt, Human
uauuccuauuggaaacagagagguuuuucuga

SEQ ID NO: 225710 - RNA, 32 nt, Human
uauuccucaaggagucaaccaaccuaugaucu

SEQ ID NO: 225711 - RNA, 32 nt, Human
uauuccucacuccauccagccucuugacaagc

SEQ ID NO: 225712 - RNA, 32 nt, Human
uauuccuccaccucuugcuccaaucagugguc

SEQ ID NO: 225713 - RNA, 32 nt, Human
uauuccuccccacccacccauguuuuuaaacu

SEQ ID NO: 225714 - RNA, 32 nt, Human
uauuccuccccuagcccugacccccugacagg

SEQ ID NO: 225715 - RNA, 32 nt, Human
uauuccuccuccauuccaucgacucccagcac

SEQ ID NO: 225716 - RNA, 32 nt, Human
uauuccucuccuccuccuccuccugggucccc

SEQ ID NO: 225717 - RNA, 32 nt, Human
uauuccucugaaggugaacucuaaagaggaaa

SEQ ID NO: 225718 - RNA, 32 nt, Human
uauuccucuuccaaaucucagcacuuuaaaaa

SEQ ID NO: 225719 - RNA, 32 nt, Human
uauuccucuuccagguaccaucuuuuguugga

SEQ ID NO: 225720 - RNA, 32 nt, Human
uauuccugacaggagcccugaugucuuaaauu

SEQ ID NO: 225721 - RNA, 32 nt, Human
uauuccugaggguuugcuccaccuucucuggu

SEQ ID NO: 225722 - RNA, 32 nt, Human
uauuccugagugggaacugagaagucaagauc

SEQ ID NO: 225723 - RNA, 32 nt, Human
uauuccugaguuuuacucugugacacauuuaa

SEQ ID NO: 225724 - RNA, 32 nt, Human
uauuccugcagaguaacaacacagccuaucua

SEQ ID NO: 225725 - RNA, 32 nt, Human
uauuccugcccccaucaugccccacacccauc

SEQ ID NO: 225726 - RNA, 32 nt, Human
uauuccuggcagugucaggaauauugguuuga

SEQ ID NO: 225727 - RNA, 32 nt, Human
uauuccugucauuccugacugaggcuguugua

SEQ ID NO: 225728 - RNA, 32 nt, Human
uauuccuguuucacauuugccccaaaucuuug

SEQ ID NO: 225729 - RNA, 32 nt, Human
uauuccuguuucauagauuacugugaaacaug

SEQ ID NO: 225730 - RNA, 32 nt, Human
uauuccuguuugguaaccucagucuccuguaa

SEQ ID NO: 225731 - RNA, 32 nt, Human
uauuccuuaaaaggugaaggacccugguccuu

SEQ ID NO: 225732 - RNA, 28 nt, Human
uauuccuuagucucaagggcuagcaucc

SEQ ID NO: 225733 - RNA, 32 nt, Human
uauuccuucccugguccaagcuccuaucuucg

SEQ ID NO: 225734 - RNA, 32 nt, Human
uauuccuucuuguuccucuguauucuaagaau

SEQ ID NO: 225735 - RNA, 32 nt, Human
uauuccuugcuuauuauaauauuauuauucau

SEQ ID NO: 225736 - RNA, 32 nt, Human
uauuccuugggucaaaacuuuugaggugggcu

SEQ ID NO: 225737 - RNA, 32 nt, Human
uauuccuuguucugcucugccacuacuugaau

SEQ ID NO: 225738 - RNA, 32 nt, Human
uauuccuuuguauccucaaggguccuugagaa

SEQ ID NO: 225739 - RNA, 32 nt, Human
uauucgauauuauguacgauggagauugggaa

SEQ ID NO: 225740 - RNA, 32 nt, Human
uauucgaugccauuaaaucaucccgugaccuu

SEQ ID NO: 225741 - RNA, 32 nt, Human
uauucgaugggcucuacguaucaggaagguac

SEQ ID NO: 225742 - RNA, 32 nt, Human
uauucgccguagccuucaaccuggucaagucu

SEQ ID NO: 225743 - RNA, 32 nt, Human
uauucgcggaauggcuuuagaggcagaugaag

SEQ ID NO: 225744 - RNA, 32 nt, Human
uauucgcucuuccuccagccucuggcaaccac

SEQ ID NO: 225745 - RNA, 32 nt, Human
uauucgggagagacuagggcaggcccagcaaa

SEQ ID NO: 225746 - RNA, 32 nt, Human
uauucgggaggcugagacaggagaaucacuug

SEQ ID NO: 225747 - RNA, 32 nt, Human
uauucgggaggcugaggcaggagaaucgcgug

SEQ ID NO: 225748 - RNA, 32 nt, Human
uauucgggaggcugaggcaggagaauugcuug

SEQ ID NO: 225749 - RNA, 32 nt, Human
uauucggggugaguaaguaguuggguauaaga

SEQ ID NO: 225750 - RNA, 32 nt, Human
uauucguaaggaugggaaggagggagguauuc

SEQ ID NO: 225751 - RNA, 32 nt, Human
uauucguccuguaggugcugugguggauggac

SEQ ID NO: 225752 - RNA, 32 nt, Human
uauucguugguaucugaaggggauugguucca

SEQ ID NO: 225753 - RNA, 32 nt, Human
uauucuaaaccagcugaugcugucaguguuca

SEQ ID NO: 225754 - RNA, 32 nt, Human
uauucuaauccaaaaguuaccccacacaaaag

SEQ ID NO: 225755 - RNA, 32 nt, Human
uauucuacaaauuccagccuucuguggucgcu

SEQ ID NO: 225756 - RNA, 32 nt, Human
uauucuacauauagugccuauaugacaaaauc

SEQ ID NO: 225757 - RNA, 32 nt, Human
uauucuacaugcuguaacuaucaggacauggu

SEQ ID NO: 225758 - RNA, 32 nt, Human
uauucuacauuuccucauuucucuacaccguc

SEQ ID NO: 225759 - RNA, 32 nt, Human
uauucuacucaaacuuaugucucagaguuccc

SEQ ID NO: 225760 - RNA, 32 nt, Human
uauucuacugccucuaggccaggguaguccua

SEQ ID NO: 225761 - RNA, 32 nt, Human
uauucuagcacagugccuugccuagaguagua

SEQ ID NO: 225762 - RNA, 32 nt, Human
uauucuagcuacucaggaggcugagaugggag

SEQ ID NO: 225763 - RNA, 32 nt, Human
uauucuaugccuauucccuccuaauuuaaggg

SEQ ID NO: 225764 - RNA, 32 nt, Human
uauucuauuuccucaucucccuaaccacuaau

SEQ ID NO: 225765 - RNA, 32 nt, Human
uauucucaacaucuguuuuugguguuaagcua

SEQ ID NO: 225766 - RNA, 32 nt, Human
uauucucagacacugcucuaguaccauuccuu

SEQ ID NO: 225767 - RNA, 32 nt, Human
uauucucagcuacucgggaggcugaggcagga

SEQ ID NO: 225768 - RNA, 32 nt, Human
uauucucaucuucccccacccuugccacuacc

SEQ ID NO: 225769 - RNA, 32 nt, Human
uauucucaugagcucauccaagccaagguugg

SEQ ID NO: 225770 - RNA, 32 nt, Human
uauucucauucuucccaacuugccuuugaaga

SEQ ID NO: 225771 - RNA, 32 nt, Human
uauucucauuuauuuugcuauacaggauguaa

SEQ ID NO: 225772 - RNA, 32 nt, Human
uauucucauuuuccuuuuaccuuucuccacca

SEQ ID NO: 225773 - RNA, 32 nt, Human
uauucuccaagaggaggagggcgacgccaagg

SEQ ID NO: 225774 - RNA, 32 nt, Human
uauucuccaccugagaauucacccaugagaga

SEQ ID NO: 225775 - RNA, 32 nt, Human
uauucuccucaucuccccaucauugguaccca

SEQ ID NO: 225776 - RNA, 32 nt, Human
uauucucuaaacuggcaucugcucuagauuca

SEQ ID NO: 225777 - RNA, 32 nt, Human
uauucucucagugccuuacagcagguuacucc

SEQ ID NO: 225778 - RNA, 32 nt, Human
uauucucucuccuuugcuuuccuugaagucag

SEQ ID NO: 225779 - RNA, 32 nt, Human
uauucucugcuccacugcccucucaccccggu

SEQ ID NO: 225780 - RNA, 32 nt, Human
uauucucugcugcaucuuacagaagaguaaac

SEQ ID NO: 225781 - RNA, 32 nt, Human
uauucucugcuguccucuguugucuuugucuu

SEQ ID NO: 225782 - RNA, 32 nt, Human
uauucucuggcuguauuuccagcaguuaugaa

SEQ ID NO: 225783 - RNA, 32 nt, Human
uauucucugggcaggcauuucaaguuuccuuu

SEQ ID NO: 225784 - RNA, 32 nt, Human
uauucucuuaaaaaucaaagaugaucucuauc

SEQ ID NO: 225785 - RNA, 32 nt, Human
uauucucuucuuucucccccacaccuaucugg

SEQ ID NO: 225786 - RNA, 32 nt, Human
uauucucuugguacuucagccuauuuaccaua

SEQ ID NO: 225787 - RNA, 32 nt, Human
uauucucuuugaagcaauugugaaugggaguu

SEQ ID NO: 225788 - RNA, 32 nt, Human
uauucugaaggugaaagauaccagagauucuc

SEQ ID NO: 225789 - RNA, 32 nt, Human
uauucugaaugugguuucugucuuagaccagg

SEQ ID NO: 225790 - RNA, 32 nt, Human
uauucugaauuuccaccugcccgccccuucgc

SEQ ID NO: 225791 - RNA, 32 nt, Human
uauucugacuuuaaauccuuugcucagacaca

SEQ ID NO: 225792 - RNA, 32 nt, Human
uauucugacuuuccacauacugucuuuaaaaa

SEQ ID NO: 225793 - RNA, 32 nt, Human
uauucugagaucuguagaugcuuagaauauca

SEQ ID NO: 225794 - RNA, 32 nt, Human
uauucugaggcugccuuggauggccucaggcc

SEQ ID NO: 225795 - RNA, 32 nt, Human
uauucugaguauggugauauuaaacauuuuuc

SEQ ID NO: 225796 - RNA, 32 nt, Human
uauucugaucuuuggcuuacuacuccauugca

SEQ ID NO: 225797 - RNA, 32 nt, Human
uauucugaugaugccacuacugcccagaacuc

SEQ ID NO: 225798 - RNA, 32 nt, Human
uauucugcacccaggguauagauaguagcccu

SEQ ID NO: 225799 - RNA, 32 nt, Human
uauucugcacuguucaguuuuauggaggaaaa

SEQ ID NO: 225800 - RNA, 32 nt, Human
uauucugcagugacuaugggaaagccuugaau

SEQ ID NO: 225801 - RNA, 32 nt, Human
uauucugccacauuugccacccucugagccca

SEQ ID NO: 225802 - RNA, 32 nt, Human
uauucugcucacauaucugucauuugagcagg

SEQ ID NO: 225803 - RNA, 32 nt, Human
uauucugcuccuagcagagugaccucaggcaa

SEQ ID NO: 225804 - RNA, 32 nt, Human
uauucugcucuaauacuguacuguguagugug

SEQ ID NO: 225805 - RNA, 32 nt, Human
uauucugcugucuggcuucaugccauugcaug

SEQ ID NO: 225806 - RNA, 32 nt, Human
uauucugcuuuucuagcuguuuuuaccuaguu

SEQ ID NO: 225807 - RNA, 32 nt, Human
uauucuggagcuuuguuaugaguugcagguua

SEQ ID NO: 225808 - RNA, 32 nt, Human
uauucuggauucacagcugcugaggaggagga

SEQ ID NO: 225809 - RNA, 32 nt, Human
uauucuguauagcacccuaaucugcuguagac

SEQ ID NO: 225810 - RNA, 32 nt, Human
uauucugucagcugaauauggaagagaucuuu

SEQ ID NO: 225811 - RNA, 32 nt, Human
uauucuguccuccaggcuggagugcaaugaca

SEQ ID NO: 225812 - RNA, 32 nt, Human
uauucuguccuguuugacauuuuuauugacuu

SEQ ID NO: 225813 - RNA, 32 nt, Human
uauucugugcaaccccucccaacccuucuucc

SEQ ID NO: 225814 - RNA, 32 nt, Human
uauucuguguuuucucuuggcucuuugggucu

SEQ ID NO: 225815 - RNA, 32 nt, Human
uauucuguucacugcuguauaucugcagcccu

SEQ ID NO: 225816 - RNA, 32 nt, Human
uauucuguucucaaauaaagcagugucacuag

SEQ ID NO: 225817 - RNA, 32 nt, Human
uauucuguugacagccagcucacaguuucuug

SEQ ID NO: 225818 - RNA, 32 nt, Human
uauucuguugacuaugagaaaguuaaaguuua

SEQ ID NO: 225819 - RNA, 25 nt, Human
uauucuuacuuuguauguuguguug

SEQ ID NO: 225820 - RNA, 32 nt, Human
uauucuuagcagugacuuauuaucuguugaag

SEQ ID NO: 225821 - RNA, 32 nt, Human
uauucuucaaccugcugacuucccucuggauu

SEQ ID NO: 225822 - RNA, 32 nt, Human
uauucuucacugaggauuucugaucugauuuu

SEQ ID NO: 225823 - RNA, 32 nt, Human
uauucuucaguggaugccagcuucccugcccc

SEQ ID NO: 225824 - RNA, 32 nt, Human
uauucuucauuuucuucuugauucagggcuuc

SEQ ID NO: 225825 - RNA, 32 nt, Human
uauucuuccaucuucauugucuuaccucugaa

SEQ ID NO: 225826 - RNA, 32 nt, Human
uauucuucuagucuucugaguuucuggucuuu

SEQ ID NO: 225827 - RNA, 32 nt, Human
uauucuucucagacccucagaaagacauccaa

SEQ ID NO: 225828 - RNA, 32 nt, Human
uauucuucugcugcugcuuauuaaauaaagaa

SEQ ID NO: 225829 - RNA, 32 nt, Human
uauucuucuuccagacacucucuguuucugcu

SEQ ID NO: 225830 - RNA, 22 nt, Human
uauucuugaagcacuccaccca

SEQ ID NO: 225831 - RNA, 32 nt, Human
uauucuugcauuuuucuagcugcagcaugcca

SEQ ID NO: 225832 - RNA, 15 nt, Human
uauucuuggacaguu

SEQ ID NO: 225833 - RNA, 32 nt, Human
uauucuugguauaaaggcuucuccggaucagu

SEQ ID NO: 225834 - RNA, 32 nt, Human
uauucuuuauuccaguguggcauaugugcccc

SEQ ID NO: 225835 - RNA, 30 nt, Human
uauucuuucaauaaauagccuucugaguug

SEQ ID NO: 225836 - RNA, 32 nt, Human
uauucuuuccagaggcuuccuucugccugccu

SEQ ID NO: 225837 - RNA, 32 nt, Human
uauucuuugacugacugaccucauuccacugg

SEQ ID NO: 225838 - RNA, 32 nt, Human
uauucuuugagacuauccugaacuugaaaucc

SEQ ID NO: 225839 - RNA, 32 nt, Human
uauucuuugccucuuuccugagccucuugcuu

SEQ ID NO: 225840 - RNA, 32 nt, Human
uauucuuuggcauugguguccauggcccuaua

SEQ ID NO: 225841 - RNA, 32 nt, Human
uauucuuuguuuccuuucccuccucuguuuuu

SEQ ID NO: 225842 - RNA, 32 nt, Human
uauucuuuuccacugcuugcagucuccaaugu

SEQ ID NO: 225843 - RNA, 32 nt, Human
uauucuuuugagacagucuggcucugcugccc

SEQ ID NO: 225844 - RNA, 32 nt, Human
uauucuuuugagauggaguuucacucuuguca

SEQ ID NO: 225845 - RNA, 32 nt, Human
uauucuuuuguucuaaaaaucucuuaugggau

SEQ ID NO: 225846 - RNA, 32 nt, Human
uauucuuuuugcuuaggauugcacuggcuuug

SEQ ID NO: 225847 - RNA, 32 nt, Human
uauucuuuuuguggcaguugugaaugggauua

SEQ ID NO: 225848 - RNA, 32 nt, Human
uauugaaaacuagauaaacugcuccaaaccaa

SEQ ID NO: 225849 - RNA, 32 nt, Human
uauugaaacaauuggagaaauucuaaagaaaa

SEQ ID NO: 225850 - RNA, 32 nt, Human
uauugaaaggcaguuuuaccaggccucaagcu

SEQ ID NO: 225851 - RNA, 32 nt, Human
uauugaaauucuaacccucaaugugaugguau

SEQ ID NO: 225852 - RNA, 32 nt, Human
uauugaacacaagugaguuuuauuaucaggaa

SEQ ID NO: 225853 - RNA, 32 nt, Human
uauugaacugucucccugugccuuuauaauau

SEQ ID NO: 225854 - RNA, 32 nt, Human
uauugaagacagcagacaggcccggacugaga

SEQ ID NO: 225855 - RNA, 32 nt, Human
uauugaagcuguucuuuuaaacuacaaggaag

SEQ ID NO: 225856 - RNA, 32 nt, Human
uauugaaggagagaaucagagcaagugauaau

SEQ ID NO: 225857 - RNA, 30 nt, Human
uauugaaguauccauagggcacaauuuuca

SEQ ID NO: 225858 - RNA, 32 nt, Human
uauugaauauggaggaucugauagugguaggu

SEQ ID NO: 225859 - RNA, 32 nt, Human
uauugaaucucuacccucucccaccacacagu

SEQ ID NO: 225860 - RNA, 32 nt, Human
uauugaaugccuuuugauuuagccagagucuc

SEQ ID NO: 225861 - RNA, 32 nt, Human
uauugaauuggacacuuugaaauggugaauuu

SEQ ID NO: 225862 - RNA, 32 nt, Human
uauugacaaacucucccuucacuccgaaaguu

SEQ ID NO: 225863 - RNA, 32 nt, Human
uauugacagccuugcuguuagaggcucuuucc

SEQ ID NO: 225864 - RNA, 32 nt, Human
uauugacaggagaagguuuaaauguucuugaa

SEQ ID NO: 225865 - RNA, 32 nt, Human
uauugaccgagcacauaccaugugccacacac

SEQ ID NO: 225866 - RNA, 32 nt, Human
uauugaccuggugcaagaaacaugcucuggug

SEQ ID NO: 225867 - RNA, 32 nt, Human
uauugacuacuauucagcacugccuucaauau

SEQ ID NO: 225868 - RNA, 32 nt, Human
uauugacuccuaucuggccuucaucaacugac

SEQ ID NO: 225869 - RNA, 31 nt, Human
uauugagaaagaccuguugcuagaaguuggg

SEQ ID NO: 225870 - RNA, 32 nt, Human
uauugagaaagggagagugggaaugugaagug

SEQ ID NO: 225871 - RNA, 32 nt, Human
uauugagaacagcaaaaauaucugaccaaaaa

SEQ ID NO: 225872 - RNA, 32 nt, Human
uauugagacuccugucucuccaaaacaauaaa

SEQ ID NO: 225873 - RNA, 32 nt, Human
uauugagagauagauuuuacucugauuagaaa

SEQ ID NO: 225874 - RNA, 32 nt, Human
uauugagaggccauaguaccuccuguuugaag

SEQ ID NO: 225875 - RNA, 32 nt, Human
uauugagcagagggacugugcuucuaugcacu

SEQ ID NO: 225876 - RNA, 32 nt, Human
uauugagccugauggcccagguauugagggcc

SEQ ID NO: 225877 - RNA, 32 nt, Human
uauugagcugaguuuucauuuugauuuuguua

SEQ ID NO: 225878 - RNA, 32 nt, Human
uauugagcuguugccucucugaguacucaggc

SEQ ID NO: 225879 - RNA, 32 nt, Human
uauugaggaggucacuaauuaguuggugcagu

SEQ ID NO: 225880 - RNA, 32 nt, Human
uauugaggcugcagcaggugcugggcuggacu

SEQ ID NO: 225881 - RNA, 32 nt, Human
uauugagggaguauauguauccaucucaguga

SEQ ID NO: 225882 - RNA, 32 nt, Human
uauugaggggcgaguagcagcucugcagacag

SEQ ID NO: 225883 - RNA, 32 nt, Human
uauugaguuuggauuaaaauguugacaugauu

SEQ ID NO: 225884 - RNA, 32 nt, Human
uauugaguuuguggaacccugccucuuccugc

SEQ ID NO: 225885 - RNA, 32 nt, Human
uauugauaaagcaaagcuaacuguguguuuag

SEQ ID NO: 225886 - RNA, 32 nt, Human
uauugauaagccauauauuaagaggaguauuu

SEQ ID NO: 225887 - RNA, 32 nt, Human
uauugauaagccauuuauuaaaaggaguauuu

SEQ ID NO: 225888 - RNA, 32 nt, Human
uauugauacaaacugugaccucagcuucagag

SEQ ID NO: 225889 - RNA, 32 nt, Human
uauugauacaauauugugcaugcuaguguugu

SEQ ID NO: 225890 - RNA, 32 nt, Human
uauugauacuuugcuauugauaccuuuacuug

SEQ ID NO: 225891 - RNA, 32 nt, Human
uauugaucacuauagaagcaaaagccaaauca

SEQ ID NO: 225892 - RNA, 32 nt, Human
uauugauccuccugucuccaccucccgaguug

SEQ ID NO: 225893 - RNA, 32 nt, Human
uauugaucuacuucuguaauuguguggauucu

SEQ ID NO: 225894 - RNA, 32 nt, Human
uauugaucuccacggaagccccaaacccucgc

SEQ ID NO: 225895 - RNA, 32 nt, Human
uauugaugaauaacuauccagcacucaccaug

SEQ ID NO: 225896 - RNA, 32 nt, Human
uauugaugagaagaaaaggcucaggggugagg

SEQ ID NO: 225897 - RNA, 32 nt, Human
uauugauggagucugcauuccaccacauaucc

SEQ ID NO: 225898 - RNA, 32 nt, Human
uauugauguaaggguuuccuggacacucauga

SEQ ID NO: 225899 - RNA, 32 nt, Human
uauugauguggcccuggcugccggcacggccc

SEQ ID NO: 225900 - RNA, 32 nt, Human
uauugauguguucggguuuccuuucccaagcc

SEQ ID NO: 225901 - RNA, 32 nt, Human
uauugauucaaaugucagcagcuuuaagccua

SEQ ID NO: 225902 - RNA, 32 nt, Human
uauugauugagcaucuacaaugugccaguugu

SEQ ID NO: 225903 - RNA, 32 nt, Human
uauugauuguguccaaagccucccgaggaccu

SEQ ID NO: 225904 - RNA, 32 nt, Human
uauugauuuuacuggcacuguauuuggaccug

SEQ ID NO: 225905 - RNA, 32 nt, Human
uauugauuuuaucuuuuccuuucaggguuuug

SEQ ID NO: 225906 - RNA, 32 nt, Human
uauugcaaaagauacagugccagaacagaaaa

SEQ ID NO: 225907 - RNA, 32 nt, Human
uauugcaaagucuguauuccagcucuuaagaa

SEQ ID NO: 225908 - RNA, 32 nt, Human
uauugcaauagagaguagaaauugagcuccac

SEQ ID NO: 225909 - RNA, 32 nt, Human
uauugcacauuugaaaacacacuaagagaagc

SEQ ID NO: 225910 - RNA, 32 nt, Human
uauugcaccacugaacuccagccugggccaca

SEQ ID NO: 225911 - RNA, 32 nt, Human
uauugcaccacugcucuccaagcugggcaaug

SEQ ID NO: 225912 - RNA, 32 nt, Human
uauugcaccauugcacuccugccugggcaaca

SEQ ID NO: 225913 - RNA, 32 nt, Human
uauugcacuacugcauuccagccugggugaca

SEQ ID NO: 225914 - RNA, 32 nt, Human
uauugcaggccagcaggcccucaguagguccu

SEQ ID NO: 225915 - RNA, 32 nt, Human
uauugcaggcuccacuccagaucaccacaaua

SEQ ID NO: 225916 - RNA, 32 nt, Human
uauugcagguuucccuguauaacguaaacaca

SEQ ID NO: 225917 - RNA, 32 nt, Human
uauugcagugugaaugcugggccccugcucaa

SEQ ID NO: 225918 - RNA, 32 nt, Human
uauugcaucaaugaauuaaaacaaaaaucuug

SEQ ID NO: 225919 - RNA, 32 nt, Human
uauugccaaaaaucaaaaaucauucccugaaa

SEQ ID NO: 225920 - RNA, 32 nt, Human
uauugccaaaacugggaaguugaaggaagccc

SEQ ID NO: 225921 - RNA, 32 nt, Human
uauugccaagggagcaaagcaugaugacaaug

SEQ ID NO: 225922 - RNA, 32 nt, Human
uauugccaccaaauuauuuauaguucugcggg

SEQ ID NO: 225923 - RNA, 32 nt, Human
uauugccaccuuccagcucuaacauuaauguc

SEQ ID NO: 225924 - RNA, 32 nt, Human
uauugccagcuacucggaaggcugaggcagga

SEQ ID NO: 225925 - RNA, 32 nt, Human
uauugccaggaaaauauaaggaaauacuguua

SEQ ID NO: 225926 - RNA, 32 nt, Human
uauugccaggagauacugaaaaucauccagaa

SEQ ID NO: 225927 - RNA, 32 nt, Human
uauugcccagccacaggcucucaaccaccaac

SEQ ID NO: 225928 - RNA, 21 nt, Human
uauugcccaggcuggagugca

SEQ ID NO: 225929 - RNA, 23 nt, Human
uauugcccaggcuggagugcagu

SEQ ID NO: 225930 - RNA, 32 nt, Human
uauugccccaggagccaggcccagccugcacc

SEQ ID NO: 225931 - RNA, 32 nt, Human
uauugccccucucuccccugacaaccacuaau

SEQ ID NO: 225932 - RNA, 32 nt, Human
uauugcccuaaucaugcuaagagacuauuauu

SEQ ID NO: 225933 - RNA, 32 nt, Human
uauugcccugccaccacuaucucuagucuccc

SEQ ID NO: 225934 - RNA, 32 nt, Human
uauugccgaucugccauguauuccagaaaggc

SEQ ID NO: 225935 - RNA, 19 nt, Human
uauugccgucaucuguuua

SEQ ID NO: 225936 - RNA, 32 nt, Human
uauugccuaguugacaacauugcuugaaugcu

SEQ ID NO: 225937 - RNA, 28 nt, Human
uauugccugcaugcugccugaucuugcg

SEQ ID NO: 225938 - RNA, 32 nt, Human
uauugcgcguuucucuuccuugcugacucucc

SEQ ID NO: 225939 - RNA, 32 nt, Human
uauugcuacucauuaacaaugcaccugguuac

SEQ ID NO: 225940 - RNA, 32 nt, Human
uauugcuagguagaauuuguacuuguuuucuu

SEQ ID NO: 225941 - RNA, 32 nt, Human
uauugcucacccagacaccaugugcaaugaca

SEQ ID NO: 225942 - RNA, 32 nt, Human
uauugcucacugcagccccucugccccuaucc

SEQ ID NO: 225943 - RNA, 32 nt, Human
uauugcucauuuccuucucuacccaaccugag

SEQ ID NO: 225944 - RNA, 32 nt, Human
uauugcugcuggggcuccccauuugcuuacuu

SEQ ID NO: 225945 - RNA, 32 nt, Human
uauugcugggcugggacaugaggcaggcagag

SEQ ID NO: 225946 - RNA, 32 nt, Human
uauugcugggguuagccaggagcaguguggau

SEQ ID NO: 225947 - RNA, 32 nt, Human
uauugcuuccuugcgcaacuucucaaaacgau

SEQ ID NO: 225948 - RNA, 32 nt, Human
uauugcuucucccuuuaguucugcugucuccc

SEQ ID NO: 225949 - RNA, 32 nt, Human
uauugcuucuguuuggacaaaauccacaucuu

SEQ ID NO: 225950 - RNA, 32 nt, Human
uauugcuuugauuucucccaaagaauaacuug

SEQ ID NO: 225951 - RNA, 32 nt, Human
uauuggaaauacaggcaugagccacugcuccu

SEQ ID NO: 225952 - RNA, 32 nt, Human
uauuggaagaggcagagccugaggugguagga

SEQ ID NO: 225953 - RNA, 32 nt, Human
uauuggaaugauuauauagaaaaugcucuuaa

SEQ ID NO: 225954 - RNA, 32 nt, Human
uauuggaauucuaugggagugaucucacugag

SEQ ID NO: 225955 - RNA, 32 nt, Human
uauuggacaacaaaacacucuuucaguuguga

SEQ ID NO: 225956 - RNA, 32 nt, Human
uauuggaccaaauuugguguuuguuuucaccu

SEQ ID NO: 225957 - RNA, 32 nt, Human
uauuggaccagaaacacucacaugucacuucc

SEQ ID NO: 225958 - RNA, 32 nt, Human
uauuggaccucuuccaucauggaaaggaaaga

SEQ ID NO: 225959 - RNA, 32 nt, Human
uauuggacuucucugcugucagucuuuguuuc

SEQ ID NO: 225960 - RNA, 32 nt, Human
uauuggagacaggguuucaccauguuggccag

SEQ ID NO: 225961 - RNA, 32 nt, Human
uauuggagacgggguuucacuguguuagccag

SEQ ID NO: 225962 - RNA, 32 nt, Human
uauuggaguaacucaaauugccugaggaaaaa

SEQ ID NO: 225963 - RNA, 32 nt, Human
uauuggaugcagagaagaucugcucggaauug

SEQ ID NO: 225964 - RNA, 32 nt, Human
uauuggcaacacagacagccgauucuuuacaa

SEQ ID NO: 225965 - RNA, 32 nt, Human
uauuggcaauguagccuggugcuucaugagac

SEQ ID NO: 225966 - RNA, 21 nt, Human
uauuggcacccuuuacuaaca

SEQ ID NO: 225967 - RNA, 32 nt, Human
uauuggcagcacagcuacucagaucugcacuc

SEQ ID NO: 225968 - RNA, 32 nt, Human
uauuggcauguagcuacaaauauuaaaggagg

SEQ ID NO: 225969 - RNA, 22 nt, Human
uauuggcauuuaauauuggaca

SEQ ID NO: 225970 - RNA, 32 nt, Human
uauuggccauuuucuuuuucuuuuucuuuauu

SEQ ID NO: 225971 - RNA, 32 nt, Human
uauuggcccuccugccuuccuuggggcucccc

SEQ ID NO: 225972 - RNA, 32 nt, Human
uauuggccuaaggggcugacuggggaggguca

SEQ ID NO: 225973 - RNA, 32 nt, Human
uauuggcggaaaggaaaauacagcggaaaaau

SEQ ID NO: 225974 - RNA, 32 nt, Human
uauuggcuacauaaucacuccaugcggugggc

SEQ ID NO: 225975 - RNA, 32 nt, Human
uauuggcucacugcaaccucugccuucugggu

SEQ ID NO: 225976 - RNA, 32 nt, Human
uauuggcucacugcagccucugcuccccagua

SEQ ID NO: 225977 - RNA, 32 nt, Human
uauuggcuguucuguugaaugucauaucuuac

SEQ ID NO: 225978 - RNA, 32 nt, Human
uauuggcuuuaugaugugaucaaacauaccug

SEQ ID NO: 225979 - RNA, 32 nt, Human
uauugggaaaucaaguggcuuaucauguauau

SEQ ID NO: 225980 - RNA, 32 nt, Human
uauugggacaaaaggcaagauggcaccauucu

SEQ ID NO: 225981 - RNA, 32 nt, Human
uauugggagcuaggagucugaaccugaaguau

SEQ ID NO: 225982 - RNA, 32 nt, Human
uauugggaggccgaggcgggaggaucacaaag

SEQ ID NO: 225983 - RNA, 32 nt, Human
uauugggaugucugauauuugagagcccgaag

SEQ ID NO: 225984 - RNA, 32 nt, Human
uauugggcaaaugaacuugaucuuccacaucu

SEQ ID NO: 225985 - RNA, 32 nt, Human
uauuggggcacacccaugcucacccuuuuaaa

SEQ ID NO: 225986 - RNA, 32 nt, Human
uauugggggaaucagagcccauuccacaccga

SEQ ID NO: 225987 - RNA, 32 nt, Human
uauugggggaggaagagagggaggcacguagg

SEQ ID NO: 225988 - RNA, 32 nt, Human
uauugggguuaggagaaaagacuagacaauua

SEQ ID NO: 225989 - RNA, 32 nt, Human
uauugggucuauugggcucugugggaagguau

SEQ ID NO: 225990 - RNA, 32 nt, Human
uauugggucugaguuucagggguggggcccca

SEQ ID NO: 225991 - RNA, 25 nt, Human
uauuggguuccuccuauucuugcca

SEQ ID NO: 225992 - RNA, 25 nt, Human
uauugguauauucacagacuguaga

SEQ ID NO: 225993 - RNA, 32 nt, Human
uauugguaucaaaagggauaaaagccaauuug

SEQ ID NO: 225994 - RNA, 32 nt, Human
uauuggucaccuaccucggcaguagggcagac

SEQ ID NO: 225995 - RNA, 32 nt, Human
uauugguccucauggaagaagagcaagauuua

SEQ ID NO: 225996 - RNA, 32 nt, Human
uauugguccuucucucauucuccgaacuuacu

SEQ ID NO: 225997 - RNA, 32 nt, Human
uauuggucucugcuuaaaauggcuugaagucc

SEQ ID NO: 225998 - RNA, 23 nt, Human
uauuggugagaauuaaacagcug

SEQ ID NO: 225999 - RNA, 32 nt, Human
uauuggugcgcuccagccgggcagguuuugag

SEQ ID NO: 226000 - RNA, 32 nt, Human
uauugguggcaccuggaggacaugcaccaagg

SEQ ID NO: 226001 - RNA, 32 nt, Human
uauugguggugaagcgccgcucuccuugacag

SEQ ID NO: 226002 - RNA, 32 nt, Human
uauugguucuuucuguaccauuuaaguauagu

SEQ ID NO: 226003 - RNA, 32 nt, Human
uauugguugugcuuuauauuugccaaaguccu

SEQ ID NO: 226004 - RNA, 32 nt, Human
uauuguaaauagugagcuaaaccucaaauuuc

SEQ ID NO: 226005 - RNA, 32 nt, Human
uauuguaacuuaggaggugaacgaccuaagau

SEQ ID NO: 226006 - RNA, 32 nt, Human
uauuguaauauauuucuguuauuuauagaugu

SEQ ID NO: 226007 - RNA, 32 nt, Human
uauuguaccuuuuaacaccugauguguacauc

SEQ ID NO: 226008 - RNA, 32 nt, Human
uauuguacgccgcccggcaggccugccgccua

SEQ ID NO: 226009 - RNA, 32 nt, Human
uauuguagaaggauuuuucucaugcucuuaua

SEQ ID NO: 226010 - RNA, 32 nt, Human
uauuguagauaagaggaaaagacugagcaugc

SEQ ID NO: 226011 - RNA, 32 nt, Human
uauuguauagucaauguuaaauaaaagccaaa

SEQ ID NO: 226012 - RNA, 32 nt, Human
uauuguaucucuucacuucugugaaaguaaua

SEQ ID NO: 226013 - RNA, 32 nt, Human
uauuguauuaccuguaaauugauuuacaagua

SEQ ID NO: 226014 - RNA, 32 nt, Human
uauuguauuggccaucccuuguuucauauucg

SEQ ID NO: 226015 - RNA, 32 nt, Human
uauuguauuugugguuguugagaggcauuuuc

SEQ ID NO: 226016 - RNA, 32 nt, Human
uauugucacaacacugaaccucuggcuagagg

SEQ ID NO: 226017 - RNA, 32 nt, Human
uauugucauuauuuccuucuucuacaucaggu

SEQ ID NO: 226018 - RNA, 32 nt, Human
uauuguccauucagaaaugugugacccuucau

SEQ ID NO: 226019 - RNA, 32 nt, Human
uauugucccaucuucacccccauuccagagca

SEQ ID NO: 226020 - RNA, 32 nt, Human
uauuguccuaaagaggguacauuggauuuuaa

SEQ ID NO: 226021 - RNA, 32 nt, Human
uauuguccuccuccuccuggcucggccucccu

SEQ ID NO: 226022 - RNA, 32 nt, Human
uauuguccucuuggcauaugcuucuggaauaa

SEQ ID NO: 226023 - RNA, 32 nt, Human
uauuguccuguugccaaacaaaagccagucau

SEQ ID NO: 226024 - RNA, 32 nt, Human
uauugucucucagaguugcaaacuagauugua

SEQ ID NO: 226025 - RNA, 32 nt, Human
uauugucucuuguagaggaaacuaauaaagug

SEQ ID NO: 226026 - RNA, 32 nt, Human
uauugucucuuuauaaaugucauuuuacaaau

SEQ ID NO: 226027 - RNA, 32 nt, Human
uauugucugaaaucccagaggacccauaagug

SEQ ID NO: 226028 - RNA, 32 nt, Human
uauugugaacugccuucucuucaucccaacau

SEQ ID NO: 226029 - RNA, 32 nt, Human
uauugugaccacaggcugguguguagguggua

SEQ ID NO: 226030 - RNA, 32 nt, Human
uauugugagaacacauuuagucaguuuggguu

SEQ ID NO: 226031 - RNA, 32 nt, Human
uauugugaggauaaaauaaaaggugugacauu

SEQ ID NO: 226032 - RNA, 32 nt, Human
uauugugaguaugaaaaagguuuuaaucagug

SEQ ID NO: 226033 - RNA, 32 nt, Human
uauugugauaaauauauuugaucauuaaugug

SEQ ID NO: 226034 - RNA, 32 nt, Human
uauugugauccccaagacuccagaccucagag

SEQ ID NO: 226035 - RNA, 32 nt, Human
uauugugauggaaaggcuguguggaaauucau

SEQ ID NO: 226036 - RNA, 32 nt, Human
uauugugauucuguuuauucuuccagaaugcu

SEQ ID NO: 226037 - RNA, 32 nt, Human
uauugugcaguaaaccuaaaagguaguggaga

SEQ ID NO: 226038 - RNA, 32 nt, Human
uauugugcauaacagauuguuccucuuauauu

SEQ ID NO: 226039 - RNA, 32 nt, Human
uauugugccacugcacuccagccugggcgaca

SEQ ID NO: 226040 - RNA, 32 nt, Human
uauugugcugggucccagccugguuugcaaag

SEQ ID NO: 226041 - RNA, 32 nt, Human
uauuguggcccaugcccuccuccugaguucuu

SEQ ID NO: 226042 - RNA, 32 nt, Human
uauuguggcccuggguccucuaccucucacga

SEQ ID NO: 226043 - RNA, 32 nt, Human
uauuguggcuuuuguauuucugcuucagugga

SEQ ID NO: 226044 - RNA, 32 nt, Human
uauugugggacagugggaauagcagcuuguag

SEQ ID NO: 226045 - RNA, 32 nt, Human
uauugugguguggcuucauuucucagagaaga

SEQ ID NO: 226046 - RNA, 32 nt, Human
uauugugucuaggggagaagauaaaaauauca

SEQ ID NO: 226047 - RNA, 32 nt, Human
uauugugugauuuuccggcugaucagaagugu

SEQ ID NO: 226048 - RNA, 32 nt, Human
uauugugugguuuucucuuuuugucuuuuuga

SEQ ID NO: 226049 - RNA, 32 nt, Human
uauuguguuacuugaccuuauuuuggaaguuu

SEQ ID NO: 226050 - RNA, 32 nt, Human
uauuguguuuuccauggugcuacaguuacaca

SEQ ID NO: 226051 - RNA, 32 nt, Human
uauuguuaaaaccuuacuuaaagcuuguuugu

SEQ ID NO: 226052 - RNA, 32 nt, Human
uauuguuaaaagucucucaaauuaggccagau

SEQ ID NO: 226053 - RNA, 32 nt, Human
uauuguuaauaucuucccucugacaguuauga

SEQ ID NO: 226054 - RNA, 32 nt, Human
uauuguuagaguagcugaaagauucaggaguu

SEQ ID NO: 226055 - RNA, 32 nt, Human
uauuguucaagagugagaucuuguagaguggc

SEQ ID NO: 226056 - RNA, 32 nt, Human
uauuguucagaaauggguaauguggccauuuc

SEQ ID NO: 226057 - RNA, 32 nt, Human
uauuguucauuucuuguaaaggucuuccuaca

SEQ ID NO: 226058 - RNA, 28 nt, Human
uauuguuccaagggagccucaucaaaac

SEQ ID NO: 226059 - RNA, 32 nt, Human
uauuguucuaauauuucuacuuuuguaugugu

SEQ ID NO: 226060 - RNA, 32 nt, Human
uauuguucucaauggucccaagaauuacucua

SEQ ID NO: 226061 - RNA, 32 nt, Human
uauuguucuuuaauggcugucuugcccuucca

SEQ ID NO: 226062 - RNA, 31 nt, Human
uauuguugcaauaaauauccuugaacacaaa

SEQ ID NO: 226063 - RNA, 32 nt, Human
uauuguugggggagcuaugaaccugacauguc

SEQ ID NO: 226064 - RNA, 32 nt, Human
uauuguuucuuugcuaaguccagaccugcuuu

SEQ ID NO: 226065 - RNA, 32 nt, Human
uauuguuucuuuucuuuuccgcgacagucuca

SEQ ID NO: 226066 - RNA, 32 nt, Human
uauuguuugccucacuccuggaugcugcguuu

SEQ ID NO: 226067 - RNA, 32 nt, Human
uauuguuugcuugcuucuagguguuuucgcca

SEQ ID NO: 226068 - RNA, 32 nt, Human
uauuguuuggacuguguuugucucacaaucac

SEQ ID NO: 226069 - RNA, 32 nt, Human
uauuguuuuuccccucucccuccugcuuucuu

SEQ ID NO: 226070 - RNA, 32 nt, Human
uauuuaaaaaccauggguccacuguuaaaacc

SEQ ID NO: 226071 - RNA, 32 nt, Human
uauuuaaaaauauacacacauguauguacaca

SEQ ID NO: 226072 - RNA, 32 nt, Human
uauuuaaaaauguaaguacaagaaauguguca

SEQ ID NO: 226073 - RNA, 32 nt, Human
uauuuaaaauugcuuaggaugaucucagacag

SEQ ID NO: 226074 - RNA, 32 nt, Human
uauuuaaacuaaauucauccuguuguguuccu

SEQ ID NO: 226075 - RNA, 32 nt, Human
uauuuaaacucaugggcuucaguuucaacauc

SEQ ID NO: 226076 - RNA, 32 nt, Human
uauuuaaagcucaagaagaacacagaagcaca

SEQ ID NO: 226077 - RNA, 32 nt, Human
uauuuaaauuccaauuccuggugacagaaaag

SEQ ID NO: 226078 - RNA, 32 nt, Human
uauuuaaauucugccucuuccuacucucuaac

SEQ ID NO: 226079 - RNA, 32 nt, Human
uauuuaaccuuccucccuucaucuuccucacc

SEQ ID NO: 226080 - RNA, 32 nt, Human
uauuuaacguuaaugcaccucugccuccacga

SEQ ID NO: 226081 - RNA, 32 nt, Human
uauuuaacuucuccaccuucauugcuagaucc

SEQ ID NO: 226082 - RNA, 32 nt, Human
uauuuaacuucugcuuugugcuagcuaguggg

SEQ ID NO: 226083 - RNA, 32 nt, Human
uauuuaagacugaaagaaggagaauuucuaac

SEQ ID NO: 226084 - RNA, 32 nt, Human
uauuuaagagguggggucccaggugggaaccc

SEQ ID NO: 226085 - RNA, 32 nt, Human
uauuuaagcauugugcaaucacuugggaaaaa

SEQ ID NO: 226086 - RNA, 32 nt, Human
uauuuaagcuuggacaguuuucagagacaaac

SEQ ID NO: 226087 - RNA, 32 nt, Human
uauuuaaggaagagaugaagcucugcaguuuu

SEQ ID NO: 226088 - RNA, 32 nt, Human
uauuuaagugugcugcucccucuugucuugaa

SEQ ID NO: 226089 - RNA, 32 nt, Human
uauuuaaguuucagcaguuuaacccugaaauu

SEQ ID NO: 226090 - RNA, 32 nt, Human
uauuuaauccaccuuaaaaccuaaauguauuu

SEQ ID NO: 226091 - RNA, 31 nt, Human
uauuuaaugaacucuuacuaugagccaguug

SEQ ID NO: 226092 - RNA, 32 nt, Human
uauuuaauugcucccuucuuccuuuccuuguu

SEQ ID NO: 226093 - RNA, 32 nt, Human
uauuuacaacuaauugaucacaaccaguuugu

SEQ ID NO: 226094 - RNA, 32 nt, Human
uauuuacaaggcaaagcaaagagaaccaaagu

SEQ ID NO: 226095 - RNA, 32 nt, Human
uauuuacacaguuaaggaacaggugauacauu

SEQ ID NO: 226096 - RNA, 32 nt, Human
uauuuacagcacaacaugaaaaggcaauuugu

SEQ ID NO: 226097 - RNA, 32 nt, Human
uauuuacaggagaaagaggugauuauggaggg

SEQ ID NO: 226098 - RNA, 32 nt, Human
uauuuacaggugaggaaauggaggcucagaga

SEQ ID NO: 226099 - RNA, 32 nt, Human
uauuuacagucuguaacuuuccacucuuccug

SEQ ID NO: 226100 - RNA, 32 nt, Human
uauuuacauacagcuuauauuaaaagagcugu

SEQ ID NO: 226101 - RNA, 32 nt, Human
uauuuacauauauuaauuugguuagggauuau

SEQ ID NO: 226102 - RNA, 32 nt, Human
uauuuacauaugcuuauauacaacuauguaca

SEQ ID NO: 226103 - RNA, 32 nt, Human
uauuuacauguuaaaggauuuggggaaauugg

SEQ ID NO: 226104 - RNA, 32 nt, Human
uauuuacauuccccucuccacgugaugucggu

SEQ ID NO: 226105 - RNA, 32 nt, Human
uauuuacauuuaugacaauauaccucaaagua

SEQ ID NO: 226106 - RNA, 32 nt, Human
uauuuaccagcuauuuuaaaugagcuguaacu

SEQ ID NO: 226107 - RNA, 32 nt, Human
uauuuaccgacauuccuuauacaugacagaca

SEQ ID NO: 226108 - RNA, 32 nt, Human
uauuuaccugggauauacacugcaagaaaauc

SEQ ID NO: 226109 - RNA, 32 nt, Human
uauuuacuaugcguguuuccagcaguuggcau

SEQ ID NO: 226110 - RNA, 32 nt, Human
uauuuacucugccaggugccuauauuccaaua

SEQ ID NO: 226111 - RNA, 32 nt, Human
uauuuacuuacugcuaucuacuaaguuuccuu

SEQ ID NO: 226112 - RNA, 32 nt, Human
uauuuagaagagccacgugaaacccaugacaa

SEQ ID NO: 226113 - RNA, 32 nt, Human
uauuuagaagcagggucucacuauguugcugg

SEQ ID NO: 226114 - RNA, 32 nt, Human
uauuuagagaaugauuuuaaaagggaaugaua

SEQ ID NO: 226115 - RNA, 32 nt, Human
uauuuagagacagggucucacucuguugccca

SEQ ID NO: 226116 - RNA, 32 nt, Human
uauuuagagacagggucucgcucuguugccaa

SEQ ID NO: 226117 - RNA, 32 nt, Human
uauuuagagauggcagagagugagguaguggc

SEQ ID NO: 226118 - RNA, 32 nt, Human
uauuuagagauuauaaggcucucugagccauc

SEQ ID NO: 226119 - RNA, 32 nt, Human
uauuuagauggaaagugauggcauucacaggc

SEQ ID NO: 226120 - RNA, 32 nt, Human
uauuuagauggccaugaagaggaugcugugaa

SEQ ID NO: 226121 - RNA, 32 nt, Human
uauuuagcaagacacacuacuacaauggagaa

SEQ ID NO: 226122 - RNA, 32 nt, Human
uauuuagcaagaucaaagacacucuggcugga

SEQ ID NO: 226123 - RNA, 32 nt, Human
uauuuagcuaaaacuaaaauggauuagagaua

SEQ ID NO: 226124 - RNA, 32 nt, Human
uauuuaggaaaggggcugggugcaguggcuca

SEQ ID NO: 226125 - RNA, 32 nt, Human
uauuuaggaggaugaaguugaagcuuagaaua

SEQ ID NO: 226126 - RNA, 32 nt, Human
uauuuagggcuagaugagcccagauuucuucc

SEQ ID NO: 226127 - RNA, 32 nt, Human
uauuuaguaauggcccagcuuagagacuucag

SEQ ID NO: 226128 - RNA, 32 nt, Human
uauuuaguauaccugaaucuugguuucuuuuu

SEQ ID NO: 226129 - RNA, 32 nt, Human
uauuuaguaugccaucaugucacugcagaggu

SEQ ID NO: 226130 - RNA, 32 nt, Human
uauuuaguaugccauuaugucacugcagaggu

SEQ ID NO: 226131 - RNA, 32 nt, Human
uauuuaguaugccuucaugucacugcagaggu

SEQ ID NO: 226132 - RNA, 32 nt, Human
uauuuauaccaaaggcugggucuucccaucua

SEQ ID NO: 226133 - RNA, 32 nt, Human
uauuuauacuauauucugcauacaguacuuua

SEQ ID NO: 226134 - RNA, 32 nt, Human
uauuuauaggaccacaggccagccugggagau

SEQ ID NO: 226135 - RNA, 32 nt, Human
uauuuauauggcaugaaaucucugguuuauuu

SEQ ID NO: 226136 - RNA, 32 nt, Human
uauuuauauucugccuuguuccagaaaagugu

SEQ ID NO: 226137 - RNA, 32 nt, Human
uauuuauauuuuuaagaaguaccacuugaaac

SEQ ID NO: 226138 - RNA, 32 nt, Human
uauuuauauuuuugggggugggagaaauccaa

SEQ ID NO: 226139 - RNA, 32 nt, Human
uauuuaucaaaauguaauggauuuuuaaaggc

SEQ ID NO: 226140 - RNA, 32 nt, Human
uauuuaucacccaauugccucugacacugacu

SEQ ID NO: 226141 - RNA, 32 nt, Human
uauuuauccugcuuagaauuuacagaacuucu

SEQ ID NO: 226142 - RNA, 32 nt, Human
uauuuaucuaguuucagggaaggucuaauaaa

SEQ ID NO: 226143 - RNA, 32 nt, Human
uauuuaugaagaaaccuugagaacgaaguuac

SEQ ID NO: 226144 - RNA, 32 nt, Human
uauuuaugacuaaucuuaccuacuucuacuuu

SEQ ID NO: 226145 - RNA, 32 nt, Human
uauuuaugaucagugaauaaaaaugucagaac

SEQ ID NO: 226146 - RNA, 32 nt, Human
uauuuauggagagaaguaaaaauaaguuccac

SEQ ID NO: 226147 - RNA, 32 nt, Human
uauuuauggccugggaaacaauuugcauuugu

SEQ ID NO: 226148 - RNA, 32 nt, Human
uauuuaugggucucacucuauugcccaggcug

SEQ ID NO: 226149 - RNA, 32 nt, Human
uauuuauuacugacaguauuguuuugauacag

SEQ ID NO: 226150 - RNA, 32 nt, Human
uauuuauuagagaccuugugggugggugggcu

SEQ ID NO: 226151 - RNA, 32 nt, Human
uauuuauuauaucuauuuggcaggugcacaau

SEQ ID NO: 226152 - RNA, 32 nt, Human
uauuuauuauucaaaagugucauuuuaauauu

SEQ ID NO: 226153 - RNA, 32 nt, Human
uauuuauucagcaccgcacuacccaggaaaua

SEQ ID NO: 226154 - RNA, 32 nt, Human
uauuuauucucauacuuuacauucaugcuuag

SEQ ID NO: 226155 - RNA, 32 nt, Human
uauuuauucugccaaaugaaacccauuucaag

SEQ ID NO: 226156 - RNA, 32 nt, Human
uauuuauucuguauugauaaaaagucagucuu

SEQ ID NO: 226157 - RNA, 32 nt, Human
uauuuauucuuauuuucucuccuuucagaguu

SEQ ID NO: 226158 - RNA, 32 nt, Human
uauuuauucuuccgcugucugccugcagcagu

SEQ ID NO: 226159 - RNA, 32 nt, Human
uauuuauucuuucuaugcagacauagguauac

SEQ ID NO: 226160 - RNA, 32 nt, Human
uauuuauugagcaccuacuaugugccagccac

SEQ ID NO: 226161 - RNA, 32 nt, Human
uauuuauugagcaccuacuaugugcccagccc

SEQ ID NO: 226162 - RNA, 32 nt, Human
uauuuauugagugcuuacuauguaccagguac

SEQ ID NO: 226163 - RNA, 32 nt, Human
uauuuauugcaaggucagauuuacagauuguu

SEQ ID NO: 226164 - RNA, 32 nt, Human
uauuuauugggcaccuacuaugugccaggcac

SEQ ID NO: 226165 - RNA, 32 nt, Human
uauuuauugggcagggggagggggagggcaca

SEQ ID NO: 226166 - RNA, 32 nt, Human
uauuuauuggggauaggagaagaggcauccug

SEQ ID NO: 226167 - RNA, 32 nt, Human
uauuuauuucucauuuguaccaaggcaucucc

SEQ ID NO: 226168 - RNA, 32 nt, Human
uauuuauuugugaauaaacuguacugguguca

SEQ ID NO: 226169 - RNA, 32 nt, Human
uauuuauuuucaaauaucaaauugaagaaaaa

SEQ ID NO: 226170 - RNA, 32 nt, Human
uauuuauuuucuccagaggcaggaugauccag

SEQ ID NO: 226171 - RNA, 32 nt, Human
uauuuauuuuugagacagucucgcccugucac

SEQ ID NO: 226172 - RNA, 32 nt, Human
uauuucaaaacagaagugucuccuugcacuua

SEQ ID NO: 226173 - RNA, 32 nt, Human
uauuucaaaccugugaacuaaccuugcaguuc

SEQ ID NO: 226174 - RNA, 32 nt, Human
uauuucaaaguuaauaaagacaaaguggcaac

SEQ ID NO: 226175 - RNA, 32 nt, Human
uauuucaaauuuguuugacuaauucuggaauu

SEQ ID NO: 226176 - RNA, 32 nt, Human
uauuucaacaaagaaguauuagaagaugacag

SEQ ID NO: 226177 - RNA, 32 nt, Human
uauuucaagccuuuccucuaagcucuaugcca

SEQ ID NO: 226178 - RNA, 32 nt, Human
uauuucacaucuuuauuauugcaguuuucucu

SEQ ID NO: 226179 - RNA, 32 nt, Human
uauuucaccaauucugguacacgcuaguuuuu

SEQ ID NO: 226180 - RNA, 32 nt, Human
uauuucagaaaggagagccaggagaacugggg

SEQ ID NO: 226181 - RNA, 32 nt, Human
uauuucagaaauguguauuuccauaauccaga

SEQ ID NO: 226182 - RNA, 32 nt, Human
uauuucagaauaacuaaaguacuucagaauga

SEQ ID NO: 226183 - RNA, 18 nt, Human
uauuucagaauugacaua

SEQ ID NO: 226184 - RNA, 32 nt, Human
uauuucagacaaaauagagaauucuuuuaaaa

SEQ ID NO: 226185 - RNA, 32 nt, Human
uauuucagccucccaaagggcuagaauuacag

SEQ ID NO: 226186 - RNA, 32 nt, Human
uauuucagccuucugcugccuuugccuggucc

SEQ ID NO: 226187 - RNA, 32 nt, Human
uauuucagcuccaggaaagagagcuaauucac

SEQ ID NO: 226188 - RNA, 32 nt, Human
uauuucagcugcuuugacaaaaugacuggcuc

SEQ ID NO: 226189 - RNA, 32 nt, Human
uauuucaggcaguuauggauagauacauuaca

SEQ ID NO: 226190 - RNA, 32 nt, Human
uauuucaggcugggcgugguggcucacgccug

SEQ ID NO: 226191 - RNA, 32 nt, Human
uauuucaggugggaucaaagaggucauaagaa

SEQ ID NO: 226192 - RNA, 32 nt, Human
uauuucaguaaagcuuucuaucuuuucaaaaa

SEQ ID NO: 226193 - RNA, 32 nt, Human
uauuucaguagaaauuacuugcaaaaugaaau

SEQ ID NO: 226194 - RNA, 31 nt, Human
uauuucagugagagaaggaaaguuguaaacu

SEQ ID NO: 226195 - RNA, 32 nt, Human
uauuucaguucaaaugucucacggaagaggca

SEQ ID NO: 226196 - RNA, 32 nt, Human
uauuucauagauacuucauuuguauuuacagu

SEQ ID NO: 226197 - RNA, 32 nt, Human
uauuucaucaccaagauauuaagccuaguacc

SEQ ID NO: 226198 - RNA, 32 nt, Human
uauuucaucacucuaaaagcacugaccucaaa

SEQ ID NO: 226199 - RNA, 25 nt, Human
uauuucaucuaaaucugauuucuca

SEQ ID NO: 226200 - RNA, 32 nt, Human
uauuucaucugaagaguucacaggcuauuaaa

SEQ ID NO: 226201 - RNA, 32 nt, Human
uauuucaugacacugaaacagagcaauaauug

SEQ ID NO: 226202 - RNA, 32 nt, Human
uauuucauuuaaagaauaugcugugcuaauaa

SEQ ID NO: 226203 - RNA, 32 nt, Human
uauuucauuugggauuucaaguuuacagaugg

SEQ ID NO: 226204 - RNA, 32 nt, Human
uauuucauuuguuuugcacauaugcauaugug

SEQ ID NO: 226205 - RNA, 32 nt, Human
uauuuccaaaaaccugagggggagaaaauacu

SEQ ID NO: 226206 - RNA, 32 nt, Human
uauuuccaaauaccaccaccuuaaggguuagg

SEQ ID NO: 226207 - RNA, 32 nt, Human
uauuuccaaaugguauccaaaaguacuuguaa

SEQ ID NO: 226208 - RNA, 32 nt, Human
uauuuccaauggagaccuagcccaggccaagg

SEQ ID NO: 226209 - RNA, 32 nt, Human
uauuuccacauucucucucacucacauuuucu

SEQ ID NO: 226210 - RNA, 32 nt, Human
uauuuccacugcacgcuggugcugggagcgcc

SEQ ID NO: 226211 - RNA, 32 nt, Human
uauuuccagccaccccagcagcuagggaggca

SEQ ID NO: 226212 - RNA, 32 nt, Human
uauuuccagcuucccucagccauucacaagca

SEQ ID NO: 226213 - RNA, 32 nt, Human
uauuuccagggccuuauaaagccagaugguag

SEQ ID NO: 226214 - RNA, 32 nt, Human
uauuuccauuucaauuuugcugugccuucacu

SEQ ID NO: 226215 - RNA, 25 nt, Human
uauuucccaagaggcucugcuccag

SEQ ID NO: 226216 - RNA, 32 nt, Human
uauuucccagaggaggaagcagcagcuagacu

SEQ ID NO: 226217 - RNA, 32 nt, Human
uauuucccauggcugcuucauuuguuguucau

SEQ ID NO: 226218 - RNA, 32 nt, Human
uauuucccaugugcacaagucuuuuuguauuc

SEQ ID NO: 226219 - RNA, 32 nt, Human
uauuuccccaaaacaacccagcuucaccccau

SEQ ID NO: 226220 - RNA, 32 nt, Human
uauuucccccuggaugguuguugggagggagg

SEQ ID NO: 226221 - RNA, 32 nt, Human
uauuucccccuucauccauccugagccaaauu

SEQ ID NO: 226222 - RNA, 32 nt, Human
uauuuccccuucauccuauuuuuaacuuaaac

SEQ ID NO: 226223 - RNA, 32 nt, Human
uauuuccccuuguggcuuucaaccaccugcuc

SEQ ID NO: 226224 - RNA, 32 nt, Human
uauuucccuggaauuuaauucaaaguuugugg

SEQ ID NO: 226225 - RNA, 32 nt, Human
uauuucccuugccucauaggcuucugggaugu

SEQ ID NO: 226226 - RNA, 32 nt, Human
uauuuccguucccgccgccguucucgcugacc

SEQ ID NO: 226227 - RNA, 32 nt, Human
uauuuccuaacaacagagagauucucuuaugu

SEQ ID NO: 226228 - RNA, 32 nt, Human
uauuuccucuguacugugagacugugggagau

SEQ ID NO: 226229 - RNA, 32 nt, Human
uauuuccugaagauccacccugggugaggcuu

SEQ ID NO: 226230 - RNA, 32 nt, Human
uauuuccugaagguaauauuguuaacuguuaa

SEQ ID NO: 226231 - RNA, 32 nt, Human
uauuuccugagaccaggcaggcucugccugca

SEQ ID NO: 226232 - RNA, 32 nt, Human
uauuuccugauaacauuauguggcccucugga

SEQ ID NO: 226233 - RNA, 23 nt, Human
uauuuccugggccuguuuucuca

SEQ ID NO: 226234 - RNA, 32 nt, Human
uauuuccuugaccucuuuacccugaagcuuuu

SEQ ID NO: 226235 - RNA, 32 nt, Human
uauuuccuuuauguguuucuccagaauggugc

SEQ ID NO: 226236 - RNA, 32 nt, Human
uauuucgaauauuuucucaaucuuaggaggaa

SEQ ID NO: 226237 - RNA, 32 nt, Human
uauuucuaccauuguaaccaccauugugcuau

SEQ ID NO: 226238 - RNA, 32 nt, Human
uauuucuacccaggcugcugucgucgugggag

SEQ ID NO: 226239 - RNA, 32 nt, Human
uauuucuagugaauuguuuguaucaguuucau

SEQ ID NO: 226240 - RNA, 32 nt, Human
uauuucuauccaauuugugaagaaggaggacu

SEQ ID NO: 226241 - RNA, 32 nt, Human
uauuucuauccuauauuucaugggcuuaccuc

SEQ ID NO: 226242 - RNA, 32 nt, Human
uauuucuaucuagugaaaugguacagagacac

SEQ ID NO: 226243 - RNA, 32 nt, Human
uauuucuaugugugccacacacaaugcaguau

SEQ ID NO: 226244 - RNA, 32 nt, Human
uauuucuauuugugccacaucuucccuccacu

SEQ ID NO: 226245 - RNA, 32 nt, Human
uauuucucacccaggaguggauuugugguuug

SEQ ID NO: 226246 - RNA, 32 nt, Human
uauuucucaguaggaacuuggaagggaagagc

SEQ ID NO: 226247 - RNA, 32 nt, Human
uauuucucaucacucccucaauccaaguaaca

SEQ ID NO: 226248 - RNA, 32 nt, Human
uauuucucauugaaaugcuuucccuuuuguau

SEQ ID NO: 226249 - RNA, 32 nt, Human
uauuucucauugugcuuucccuucccuucuuu

SEQ ID NO: 226250 - RNA, 32 nt, Human
uauuucuccaaacaacucaauauuucucuuua

SEQ ID NO: 226251 - RNA, 32 nt, Human
uauuucuccaucuccaguucuggacagugcag

SEQ ID NO: 226252 - RNA, 32 nt, Human
uauuucuccuuaaccccuaauaccuuucuuac

SEQ ID NO: 226253 - RNA, 32 nt, Human
uauuucucucaggugcgugccacaucaauaac

SEQ ID NO: 226254 - RNA, 32 nt, Human
uauuucucuccacccuaacucagaccucaccu

SEQ ID NO: 226255 - RNA, 32 nt, Human
uauuucucucucccauaacagugcagugauag

SEQ ID NO: 226256 - RNA, 32 nt, Human
uauuucucugcagcguuccuucccuggcccgg

SEQ ID NO: 226257 - RNA, 32 nt, Human
uauuucucugggaaaaauaggcugcaggucuc

SEQ ID NO: 226258 - RNA, 32 nt, Human
uauuucucuuaauaaucuuuuguaguuuucag

SEQ ID NO: 226259 - RNA, 32 nt, Human
uauuucucuuucccucucccugucccucucuu

SEQ ID NO: 226260 - RNA, 20 nt, Human
uauuucucuuugcuuucuca

SEQ ID NO: 226261 - RNA, 32 nt, Human
uauuucugaaguauucacuugaccuuccauca

SEQ ID NO: 226262 - RNA, 32 nt, Human
uauuucugaaucuuaaaauucaucccaugugu

SEQ ID NO: 226263 - RNA, 32 nt, Human
uauuucugcaaguagaacucacugccuuuaga

SEQ ID NO: 226264 - RNA, 32 nt, Human
uauuucugcugagugauaaagccagcggggag

SEQ ID NO: 226265 - RNA, 32 nt, Human
uauuucuggcugaauagcacagaaaaguauuu

SEQ ID NO: 226266 - RNA, 32 nt, Human
uauuucuggugaggaaugaaagggccaagugu

SEQ ID NO: 226267 - RNA, 32 nt, Human
uauuucuguagacagaaguucagucuagauuu

SEQ ID NO: 226268 - RNA, 32 nt, Human
uauuucuguaugaagaugcaaauaucaugaau

SEQ ID NO: 226269 - RNA, 32 nt, Human
uauuucuguauuuccuggauaaggaagagcaa

SEQ ID NO: 226270 - RNA, 32 nt, Human
uauuucugucagcugguguugcugacacuuuc

SEQ ID NO: 226271 - RNA, 32 nt, Human
uauuucugugaggucacugaggccuuauggac

SEQ ID NO: 226272 - RNA, 32 nt, Human
uauuucugugccagacacauuccaccucucca

SEQ ID NO: 226273 - RNA, 32 nt, Human
uauuucuguucauuuauucaagcuuuuucuuc

SEQ ID NO: 226274 - RNA, 31 nt, Human
uauuucuuaauaaauaaauuuggaacuauua

SEQ ID NO: 226275 - RNA, 32 nt, Human
uauuucuuauggugcuggauuacuccuacaga

SEQ ID NO: 226276 - RNA, 32 nt, Human
uauuucuuccuugagcuaaggaggccaguugu

SEQ ID NO: 226277 - RNA, 32 nt, Human
uauuucuuccuugauguccuccaccuaagauu

SEQ ID NO: 226278 - RNA, 32 nt, Human
uauuucuucuacugcuaucuacuacaaacuuc

SEQ ID NO: 226279 - RNA, 32 nt, Human
uauuucuucuuaagagaugccuaaaauguuuu

SEQ ID NO: 226280 - RNA, 32 nt, Human
uauuucuugaaugcguauuaugugccaagcac

SEQ ID NO: 226281 - RNA, 24 nt, Human
uauuucuugcugaccaaaucuacu

SEQ ID NO: 226282 - RNA, 23 nt, Human
uauuucuugucucuauuuuuuca

SEQ ID NO: 226283 - RNA, 32 nt, Human
uauuucuuguggcaggggguggucaaagagcc

SEQ ID NO: 226284 - RNA, 32 nt, Human
uauuucuuuaagauggagucuugcucuguugc

SEQ ID NO: 226285 - RNA, 32 nt, Human
uauuucuuucagccauuucauuucuuaucuau

SEQ ID NO: 226286 - RNA, 32 nt, Human
uauuucuuucagggguaucuuguaauucucau

SEQ ID NO: 226287 - RNA, 32 nt, Human
uauuucuuucaucagagcaaauuauaguggaa

SEQ ID NO: 226288 - RNA, 32 nt, Human
uauuucuuucuauuuugcuauuugcaaaugcu

SEQ ID NO: 226289 - RNA, 32 nt, Human
uauuucuuuucuuugcccuccugauucuuggc

SEQ ID NO: 226290 - RNA, 32 nt, Human
uauuugaaagaugccugugcucugcuucaggc

SEQ ID NO: 226291 - RNA, 32 nt, Human
uauuugaaagcaacugaacaauggagccagac

SEQ ID NO: 226292 - RNA, 32 nt, Human
uauuugaaguguccagcaguugcuugaaaugc

SEQ ID NO: 226293 - RNA, 32 nt, Human
uauuugaauauuagaugggaaaauuagugucu

SEQ ID NO: 226294 - RNA, 32 nt, Human
uauuugaaucucaaaaagggagcaugggaauc

SEQ ID NO: 226295 - RNA, 32 nt, Human
uauuugaccagaacuuuuuccucucgagauag

SEQ ID NO: 226296 - RNA, 32 nt, Human
uauuugacucccacuuguaauaacuccuuuaa

SEQ ID NO: 226297 - RNA, 32 nt, Human
uauuugacuguauuuggagacagggucuuuac

SEQ ID NO: 226298 - RNA, 32 nt, Human
uauuugacuguggccuucuuauugagaacucu

SEQ ID NO: 226299 - RNA, 32 nt, Human
uauuugagacagagucucacucuguugcccag

SEQ ID NO: 226300 - RNA, 32 nt, Human
uauuugagagcugaaccaaugguuuuugaugg

SEQ ID NO: 226301 - RNA, 32 nt, Human
uauuugagcuccgggucucuucuaccugcauu

SEQ ID NO: 226302 - RNA, 32 nt, Human
uauuugagcucuggaguuugagaccagccugg

SEQ ID NO: 226303 - RNA, 32 nt, Human
uauuugagcugcauaaucuaaacaugucaaac

SEQ ID NO: 226304 - RNA, 32 nt, Human
uauuugagguuagguguggccuugaccuuacc

SEQ ID NO: 226305 - RNA, 32 nt, Human
uauuugaguguacaaacccauggcugggcuca

SEQ ID NO: 226306 - RNA, 32 nt, Human
uauuugaguugcuuccuuucugggguaauaac

SEQ ID NO: 226307 - RNA, 32 nt, Human
uauuugauaaaugaucacaauguguaaaacac

SEQ ID NO: 226308 - RNA, 32 nt, Human
uauuugauagcacauacugauggcucuaaaga

SEQ ID NO: 226309 - RNA, 32 nt, Human
uauuugaucagaauauuuuguaaugaaaggau

SEQ ID NO: 226310 - RNA, 32 nt, Human
uauuugaugauauuuauuuucucugccaagcu

SEQ ID NO: 226311 - RNA, 32 nt, Human
uauuugaugcuucuucaagucagcucugacgu

SEQ ID NO: 226312 - RNA, 32 nt, Human
uauuugauuccuugugcacaugugggagaaaa

SEQ ID NO: 226313 - RNA, 32 nt, Human
uauuugauuucuuaccgccuuaggcaaguauu

SEQ ID NO: 226314 - RNA, 31 nt, Human
uauuugcaaaugucucuuauugacaaggaaa

SEQ ID NO: 226315 - RNA, 32 nt, Human
uauuugcagacuacagaaugggagaaaauguu

SEQ ID NO: 226316 - RNA, 32 nt, Human
uauuugcagauaauucuggaccagagacuugg

SEQ ID NO: 226317 - RNA, 32 nt, Human
uauuugcauauguaugauagugugcauguggu

SEQ ID NO: 226318 - RNA, 32 nt, Human
uauuugcauauguauuuuguauuugcauaugu

SEQ ID NO: 226319 - RNA, 32 nt, Human
uauuugcaucucagugcugcuuuggggucucg

SEQ ID NO: 226320 - RNA, 32 nt, Human
uauuugcauuaauuuucccuacucauacuuug

SEQ ID NO: 226321 - RNA, 32 nt, Human
uauuugccugcaggcagucaccaagucuguau

SEQ ID NO: 226322 - RNA, 32 nt, Human
uauuugcggucugauaaaaggguccuuguggg

SEQ ID NO: 226323 - RNA, 32 nt, Human
uauuugcgguuagaaucccauggauguuucuu

SEQ ID NO: 226324 - RNA, 32 nt, Human
uauuugcuaaaaaucugagguagaugggcggc

SEQ ID NO: 226325 - RNA, 32 nt, Human
uauuugcuccaaugcguaacagacugauguca

SEQ ID NO: 226326 - RNA, 32 nt, Human
uauuugcucuccugaacucucacucaauccuc

SEQ ID NO: 226327 - RNA, 31 nt, Human
uauuugcuucagguuauccuguugagggugg

SEQ ID NO: 226328 - RNA, 21 nt, Human
uauuuggaaaacaaacgucaa

SEQ ID NO: 226329 - RNA, 20 nt, Human
uauuuggaaaacaaucggcu

SEQ ID NO: 226330 - RNA, 32 nt, Human
uauuuggaaacagacaaguagaagaugcuaca

SEQ ID NO: 226331 - RNA, 32 nt, Human
uauuuggaaaccccuucuuuacuucccaggcc

SEQ ID NO: 226332 - RNA, 32 nt, Human
uauuuggaacuuaguaaccaguuguucucuag

SEQ ID NO: 226333 - RNA, 32 nt, Human
uauuuggaagcauguuugguaaugucaagugg

SEQ ID NO: 226334 - RNA, 32 nt, Human
uauuuggaagcuaccuacagaggaucgacgag

SEQ ID NO: 226335 - RNA, 32 nt, Human
uauuuggaauauuugaauaaugacagauggug

SEQ ID NO: 226336 - RNA, 32 nt, Human
uauuuggacaacaccccaacagagcaggcuga

SEQ ID NO: 226337 - RNA, 32 nt, Human
uauuuggagaacuauauugagguggagacuag

SEQ ID NO: 226338 - RNA, 32 nt, Human
uauuuggagagauuguguggauuuaagagacc

SEQ ID NO: 226339 - RNA, 32 nt, Human
uauuuggagaugaagcauuuggaggugauuaa

SEQ ID NO: 226340 - RNA, 22 nt, Human
uauuuggaguuuugugcuucaa

SEQ ID NO: 226341 - RNA, 32 nt, Human
uauuuggauuagugaauuuauuucucaaucca

SEQ ID NO: 226342 - RNA, 32 nt, Human
uauuuggcacuccuggaacaaguauaucuaac

SEQ ID NO: 226343 - RNA, 31 nt, Human
uauuuggcaguguucaucacaggcuagagag

SEQ ID NO: 226344 - RNA, 32 nt, Human
uauuuggcauugaaauaacacccagagcauga

SEQ ID NO: 226345 - RNA, 32 nt, Human
uauuuggccucucaaaugaacugagauuccug

SEQ ID NO: 226346 - RNA, 32 nt, Human
uauuuggccuucaucuuggcauggaagguggc

SEQ ID NO: 226347 - RNA, 32 nt, Human
uauuuggcucacauuucugccuggcaguggcu

SEQ ID NO: 226348 - RNA, 32 nt, Human
uauuuggcucaccucguuccacagcuccaccu

SEQ ID NO: 226349 - RNA, 32 nt, Human
uauuugggaggccaaggcaggagaauugccug

SEQ ID NO: 226350 - RNA, 32 nt, Human
uauuugggaggcugaggcaggagaaucgcuug

SEQ ID NO: 226351 - RNA, 32 nt, Human
uauuuggggcuguagcuccuuccaagcccaug

SEQ ID NO: 226352 - RNA, 32 nt, Human
uauuugggggaagggaaauguuucaagguaaa

SEQ ID NO: 226353 - RNA, 23 nt, Human
uauuugggggaaucuguuuucca

SEQ ID NO: 226354 - RNA, 32 nt, Human
uauuuggggucuucccccaguggaugucucau

SEQ ID NO: 226355 - RNA, 32 nt, Human
uauuugggucacugcagaucucugaguccccc

SEQ ID NO: 226356 - RNA, 32 nt, Human
uauuuggguccugggagggugggugaaauaaa

SEQ ID NO: 226357 - RNA, 32 nt, Human
uauuugguacuuucacuuacuacacaucauuu

SEQ ID NO: 226358 - RNA, 32 nt, Human
uauuuggugauggagaaucuucagcuguguua

SEQ ID NO: 226359 - RNA, 32 nt, Human
uauuuggugugcugaaaauuugaguugacaaa

SEQ ID NO: 226360 - RNA, 32 nt, Human
uauuugguuggaguuucucauauuugaaaaca

SEQ ID NO: 226361 - RNA, 32 nt, Human
uauuugguuggggaggcacagagcagagguuc

SEQ ID NO: 226362 - RNA, 32 nt, Human
uauuugguuucuagaucacugugcuuauuuug

SEQ ID NO: 226363 - RNA, 32 nt, Human
uauuuguaagaaaagaggagaauggagaaucu

SEQ ID NO: 226364 - RNA, 32 nt, Human
uauuuguaagagcuuugaaagccagccugaga

SEQ ID NO: 226365 - RNA, 32 nt, Human
uauuuguacacauacacacaugcacacccucu

SEQ ID NO: 226366 - RNA, 32 nt, Human
uauuuguauuuauuuccagaccaauaaauuug

SEQ ID NO: 226367 - RNA, 32 nt, Human
uauuugucaccugaaccuaauguauauucucc

SEQ ID NO: 226368 - RNA, 32 nt, Human
uauuugucagugccaugauggaagaagcugag

SEQ ID NO: 226369 - RNA, 32 nt, Human
uauuugucauaaggcggcgugggcgaggccug

SEQ ID NO: 226370 - RNA, 32 nt, Human
uauuugucgcuuauuugcccugcagcaauuca

SEQ ID NO: 226371 - RNA, 32 nt, Human
uauuugucuuuugaaaauuaaggcugggcgcg

SEQ ID NO: 226372 - RNA, 32 nt, Human
uauuugugauguucugucuuccuugucacuuc

SEQ ID NO: 226373 - RNA, 32 nt, Human
uauuugugccuagggcuugggcuguuugugug

SEQ ID NO: 226374 - RNA, 32 nt, Human
uauuugugcuggagugaggggaagaagcuguu

SEQ ID NO: 226375 - RNA, 32 nt, Human
uauuuguggagagagaguugaagauuagggaa

SEQ ID NO: 226376 - RNA, 32 nt, Human
uauuuguggcuuugcugagugaaggaagggga

SEQ ID NO: 226377 - RNA, 32 nt, Human
uauuuguguggacaagaugaggagcauaaaca

SEQ ID NO: 226378 - RNA, 32 nt, Human
uauuuguuaaauaacacaaaagucugaaauuc

SEQ ID NO: 226379 - RNA, 31 nt, Human
uauuuguucaauaaauaagugaauuaauuag

SEQ ID NO: 226380 - RNA, 32 nt, Human
uauuuguucccaaguagcuacugaacugcuca

SEQ ID NO: 226381 - RNA, 32 nt, Human
uauuuguucuaucacccagaauuuugagaagg

SEQ ID NO: 226382 - RNA, 32 nt, Human
uauuuguugaacacuuacauguaccagacauu

SEQ ID NO: 226383 - RNA, 32 nt, Human
uauuuguuguuuguuugcuuguuuuuguuuuu

SEQ ID NO: 226384 - RNA, 32 nt, Human
uauuuguuucaguagaugagcacacaaaugug

SEQ ID NO: 226385 - RNA, 32 nt, Human
uauuuguuugagacggggucucgcucugucgc

SEQ ID NO: 226386 - RNA, 32 nt, Human
uauuuguuuucuuguuuccaugaauuauauca

SEQ ID NO: 226387 - RNA, 32 nt, Human
uauuuguuuuugcaccugcuucugccuggaga

SEQ ID NO: 226388 - RNA, 32 nt, Human
uauuuuaaacuagaaauuauauuagaacucaa

SEQ ID NO: 226389 - RNA, 32 nt, Human
uauuuuaaaggcugcuuuaacuuguuuguuug

SEQ ID NO: 226390 - RNA, 32 nt, Human
uauuuuaaauauuugggagaguuaauuuguua

SEQ ID NO: 226391 - RNA, 32 nt, Human
uauuuuaaccaaagguuaucagagccaguugg

SEQ ID NO: 226392 - RNA, 32 nt, Human
uauuuuaacucauaccuuuaaaggaauucccc

SEQ ID NO: 226393 - RNA, 32 nt, Human
uauuuuaacucucagugugcugucuuuauauu

SEQ ID NO: 226394 - RNA, 32 nt, Human
uauuuuaagggccagaggguuaaucacaaaga

SEQ ID NO: 226395 - RNA, 32 nt, Human
uauuuuaauagugaucuugauccuguuguggg

SEQ ID NO: 226396 - RNA, 32 nt, Human
uauuuuaauuuuaugaccaacaugucauuugg

SEQ ID NO: 226397 - RNA, 32 nt, Human
uauuuuacaagugguuuucuuacauaggacuc

SEQ ID NO: 226398 - RNA, 32 nt, Human
uauuuuacaguacauguuuauuauguucaaua

SEQ ID NO: 226399 - RNA, 32 nt, Human
uauuuuacagugcagcauaaugccaugggcuu

SEQ ID NO: 226400 - RNA, 32 nt, Human
uauuuuacccuugagcuuagccgcgggucccu

SEQ ID NO: 226401 - RNA, 32 nt, Human
uauuuuaccuaaaagacucuagacaugggaug

SEQ ID NO: 226402 - RNA, 32 nt, Human
uauuuuacuaccugaaguacaauuuaacuuuu

SEQ ID NO: 226403 - RNA, 32 nt, Human
uauuuuacugacuuguuuaaaugauucgcuuu

SEQ ID NO: 226404 - RNA, 32 nt, Human
uauuuuagaagagaaggagcaagagaagaaga

SEQ ID NO: 226405 - RNA, 32 nt, Human
uauuuuaguagagacgggguuucuccacauug

SEQ ID NO: 226406 - RNA, 32 nt, Human
uauuuuaguagagacgggguuucuccauguug

SEQ ID NO: 226407 - RNA, 32 nt, Human
uauuuuauagauaggcaccugggaaccaaaca

SEQ ID NO: 226408 - RNA, 32 nt, Human
uauuuuauagggcuguugugaggauuaaauga

SEQ ID NO: 226409 - RNA, 32 nt, Human
uauuuuaucaacuuuuucucuuaguuacugug

SEQ ID NO: 226410 - RNA, 31 nt, Human
uauuuuaucacagaggagguuccagaaagga

SEQ ID NO: 226411 - RNA, 32 nt, Human
uauuuuaucaucccaaaagcaacauggagagu

SEQ ID NO: 226412 - RNA, 32 nt, Human
uauuuuaucucuucucuggggcugagagguga

SEQ ID NO: 226413 - RNA, 32 nt, Human
uauuuuaucugugugugcucaggaggugagcc

SEQ ID NO: 226414 - RNA, 32 nt, Human
uauuuuaugaauaauaugcagagaugcauauu

SEQ ID NO: 226415 - RNA, 32 nt, Human
uauuuuaugccucugugucucagcucuguguu

SEQ ID NO: 226416 - RNA, 32 nt, Human
uauuuuaugggucuugagugcauuugaaggug

SEQ ID NO: 226417 - RNA, 32 nt, Human
uauuuuauucucucucccuuuuuauuuugccu

SEQ ID NO: 226418 - RNA, 32 nt, Human
uauuuuauugaauuaccccuuuagaaaucaug

SEQ ID NO: 226419 - RNA, 32 nt, Human
uauuuuauuuuguauagagaacacguagcgac

SEQ ID NO: 226420 - RNA, 32 nt, Human
uauuuuauuuuuaauucucucuucuccuccag

SEQ ID NO: 226421 - RNA, 32 nt, Human
uauuuucaaacuugacaugagccuauguugac

SEQ ID NO: 226422 - RNA, 32 nt, Human
uauuuucaauuuccucccucacucccucuuac

SEQ ID NO: 226423 - RNA, 32 nt, Human
uauuuucacacguaagcacauucgggccauuu

SEQ ID NO: 226424 - RNA, 32 nt, Human
uauuuucacacuucaaagaccuaaggaaaaau

SEQ ID NO: 226425 - RNA, 32 nt, Human
uauuuucacaugcugcuuauacaagauuauua

SEQ ID NO: 226426 - RNA, 32 nt, Human
uauuuucacuggcuuuuccuucuccaaacuuu

SEQ ID NO: 226427 - RNA, 32 nt, Human
uauuuucagagaauucaggugcugcugguuuu

SEQ ID NO: 226428 - RNA, 32 nt, Human
uauuuucagauagcggggucuuuuccauuuau

SEQ ID NO: 226429 - RNA, 32 nt, Human
uauuuucagcacugcagcucugaugguccagc

SEQ ID NO: 226430 - RNA, 32 nt, Human
uauuuucagguuggaaugugaagguuccuggc

SEQ ID NO: 226431 - RNA, 32 nt, Human
uauuuucaguccuuucuuucugucuacucaaa

SEQ ID NO: 226432 - RNA, 32 nt, Human
uauuuucaguuuuccaaaauucuaucaucuuu

SEQ ID NO: 226433 - RNA, 32 nt, Human
uauuuucauaacacuaauaauacacugggauu

SEQ ID NO: 226434 - RNA, 32 nt, Human
uauuuucaucuaugagagaagaggagcccaaa

SEQ ID NO: 226435 - RNA, 32 nt, Human
uauuuucauuacacaaacuuaauuugucuugu

SEQ ID NO: 226436 - RNA, 32 nt, Human
uauuuucauuucucucaagcucuuucaauaaa

SEQ ID NO: 226437 - RNA, 32 nt, Human
uauuuuccaagugccuucaccaaaaggccaag

SEQ ID NO: 226438 - RNA, 32 nt, Human
uauuuuccagaacauagcccaacaaagaacuu

SEQ ID NO: 226439 - RNA, 32 nt, Human
uauuuuccauaagauggcgguggagaagagaa

SEQ ID NO: 226440 - RNA, 32 nt, Human
uauuuuccaucuuuguuuucuguucuacaaag

SEQ ID NO: 226441 - RNA, 32 nt, Human
uauuuuccauggaagacacagggucagagauc

SEQ ID NO: 226442 - RNA, 31 nt, Human
uauuuucccagcuagaaaaguauacucauuc

SEQ ID NO: 226443 - RNA, 32 nt, Human
uauuuucccauucaaguacaaaaauguuuuca

SEQ ID NO: 226444 - RNA, 32 nt, Human
uauuuuccccucuuaaggauuaauauucuuca

SEQ ID NO: 226445 - RNA, 32 nt, Human
uauuuucccugcaacaucuccaccucccaaua

SEQ ID NO: 226446 - RNA, 32 nt, Human
uauuuucccugcccucagguugccuauguauu

SEQ ID NO: 226447 - RNA, 32 nt, Human
uauuuuccuaaccuuucuucuggguccuuccu

SEQ ID NO: 226448 - RNA, 32 nt, Human
uauuuuccucauuucuuuacugcugccauuuu

SEQ ID NO: 226449 - RNA, 32 nt, Human
uauuuuccuccuccuccuuggccuacucaaca

SEQ ID NO: 226450 - RNA, 32 nt, Human
uauuuuccugcucugccuucugggacuagccu

SEQ ID NO: 226451 - RNA, 32 nt, Human
uauuuuccuugucugcugcuauuugaaguaau

SEQ ID NO: 226452 - RNA, 32 nt, Human
uauuuuccuuucuccaauuaauguggucauaa

SEQ ID NO: 226453 - RNA, 32 nt, Human
uauuuucggaaaguuaaauaacagggacuacg

SEQ ID NO: 226454 - RNA, 32 nt, Human
uauuuucguauguacacaaugcaagugugauu

SEQ ID NO: 226455 - RNA, 32 nt, Human
uauuuucuaagaagcugagcagcuccaagggc

SEQ ID NO: 226456 - RNA, 32 nt, Human
uauuuucuaagaagguugaagaaggaugagug

SEQ ID NO: 226457 - RNA, 32 nt, Human
uauuuucuagacaauucucuauuuuacugaag

SEQ ID NO: 226458 - RNA, 32 nt, Human
uauuuucucaacugccauauccuagggggcuu

SEQ ID NO: 226459 - RNA, 32 nt, Human
uauuuucucaagguguuucuagauuccacaua

SEQ ID NO: 226460 - RNA, 32 nt, Human
uauuuucucaggcucaucauccaucagaugca

SEQ ID NO: 226461 - RNA, 32 nt, Human
uauuuucucucaucuuuuucaagucuuuucca

SEQ ID NO: 226462 - RNA, 32 nt, Human
uauuuucugcagcugcucccagauuacuccuu

SEQ ID NO: 226463 - RNA, 32 nt, Human
uauuuucugcagggaccagccccacaugguca

SEQ ID NO: 226464 - RNA, 32 nt, Human
uauuuucugcuaaaggagugacugugcauaua

SEQ ID NO: 226465 - RNA, 32 nt, Human
uauuuucuggcaccuucucugcaugucugcag

SEQ ID NO: 226466 - RNA, 32 nt, Human
uauuuucuguuagcuugugggcauuuugaauu

SEQ ID NO: 226467 - RNA, 32 nt, Human
uauuuucuuagcaguuauuucuacaguuaauu

SEQ ID NO: 226468 - RNA, 32 nt, Human
uauuuucuuccuucuacuucucuauacauuuc

SEQ ID NO: 226469 - RNA, 32 nt, Human
uauuuucuuuccgcccccuccggggcugagcc

SEQ ID NO: 226470 - RNA, 32 nt, Human
uauuuucuuucuguugaaauaacugaaaaugu

SEQ ID NO: 226471 - RNA, 32 nt, Human
uauuuucuuuuaucuuuggaacaucagcacca

SEQ ID NO: 226472 - RNA, 32 nt, Human
uauuuucuuuucucccccagcugccccagggu

SEQ ID NO: 226473 - RNA, 32 nt, Human
uauuuucuuuuuccuuuauaauucuuucuuuu

SEQ ID NO: 226474 - RNA, 31 nt, Human
uauuuugaacaaugcagacaguacuugccag

SEQ ID NO: 226475 - RNA, 32 nt, Human
uauuuugagaguuucuucuucauaaaucuaca

SEQ ID NO: 226476 - RNA, 32 nt, Human
uauuuugagauggagucucgcucugucaccca

SEQ ID NO: 226477 - RNA, 32 nt, Human
uauuuugagauggagucuugcucugucgccca

SEQ ID NO: 226478 - RNA, 32 nt, Human
uauuuugagcaucuauuuugaggugauguuua

SEQ ID NO: 226479 - RNA, 32 nt, Human
uauuuugagggagggaggggcaagcccagugu

SEQ ID NO: 226480 - RNA, 32 nt, Human
uauuuugauauaacaaagacuucugucauaaa

SEQ ID NO: 226481 - RNA, 32 nt, Human
uauuuugaugaccaaguuuucuggaaguuucc

SEQ ID NO: 226482 - RNA, 32 nt, Human
uauuuugauuccugccuuuccccagccucagc

SEQ ID NO: 226483 - RNA, 32 nt, Human
uauuuugcaagacaggcccaagcauguaauac

SEQ ID NO: 226484 - RNA, 32 nt, Human
uauuuugcaagccagaugaguaaccagagggc

SEQ ID NO: 226485 - RNA, 32 nt, Human
uauuuugcacacagcaaaacaaacaauguuua

SEQ ID NO: 226486 - RNA, 32 nt, Human
uauuuugcagaucaccccacagagcuaggguu

SEQ ID NO: 226487 - RNA, 32 nt, Human
uauuuugcagugguagagguuguuuugcuaaa

SEQ ID NO: 226488 - RNA, 32 nt, Human
uauuuugcauugaagauacauugccagguugu

SEQ ID NO: 226489 - RNA, 31 nt, Human
uauuuugcauuuuuaugccaugcagaacaau

SEQ ID NO: 226490 - RNA, 32 nt, Human
uauuuugccacuggcuucaugcuggaguaaug

SEQ ID NO: 226491 - RNA, 32 nt, Human
uauuuugccauggagaaaucugacagcauugc

SEQ ID NO: 226492 - RNA, 32 nt, Human
uauuuugccugauaccuguuacucaaggcauu

SEQ ID NO: 226493 - RNA, 32 nt, Human
uauuuugcuaccaaaugcuuuuggcuaccaca

SEQ ID NO: 226494 - RNA, 32 nt, Human
uauuuugcuggagcguuauacauagcaguaaa

SEQ ID NO: 226495 - RNA, 32 nt, Human
uauuuugcuuuaaaucucugguaguuuuucca

SEQ ID NO: 226496 - RNA, 32 nt, Human
uauuuugcuuugucuuucucucccuucuuuua

SEQ ID NO: 226497 - RNA, 32 nt, Human
uauuuuggaaggccagacuaggaggagguggg

SEQ ID NO: 226498 - RNA, 32 nt, Human
uauuuuggacaaggaguucuggugacaagcua

SEQ ID NO: 226499 - RNA, 32 nt, Human
uauuuuggauaacauuuguauucagcaugcua

SEQ ID NO: 226500 - RNA, 32 nt, Human
uauuuuggggucucguuugcccagggagggcu

SEQ ID NO: 226501 - RNA, 32 nt, Human
uauuuugguagccuguaacacacggcaacacu

SEQ ID NO: 226502 - RNA, 32 nt, Human
uauuuugguaggaauuaggagaacaaaaagca

SEQ ID NO: 226503 - RNA, 32 nt, Human
uauuuuggucaggaagagaaaguggccauuua

SEQ ID NO: 226504 - RNA, 32 nt, Human
uauuuugguugagucuuugugauuuucuacac

SEQ ID NO: 226505 - RNA, 31 nt, Human
uauuuuguauuuauuuuacauuuaaauuccc

SEQ ID NO: 226506 - RNA, 32 nt, Human
uauuuugucaccgaggcuggagugcaauggcc

SEQ ID NO: 226507 - RNA, 32 nt, Human
uauuuugucuccaaacuacagcccaaguauga

SEQ ID NO: 226508 - RNA, 32 nt, Human
uauuuugucugcgccaccagaaugacaauaaa

SEQ ID NO: 226509 - RNA, 32 nt, Human
uauuuugucuuucuuuccuuuuugacuuuagu

SEQ ID NO: 226510 - RNA, 32 nt, Human
uauuuuguguacacagaagccauuccgagucu

SEQ ID NO: 226511 - RNA, 32 nt, Human
uauuuugugugaaaaucucuuuucuacagauu

SEQ ID NO: 226512 - RNA, 32 nt, Human
uauuuuguuaucugaacuguggaaucaucacu

SEQ ID NO: 226513 - RNA, 32 nt, Human
uauuuuguuguaaagcaucuuaacuacacaua

SEQ ID NO: 226514 - RNA, 32 nt, Human
uauuuuguuuaauaaagaacauucucaaaacg

SEQ ID NO: 226515 - RNA, 32 nt, Human
uauuuuguuuccuuugguuuccuuccucccca

SEQ ID NO: 226516 - RNA, 32 nt, Human
uauuuuguuuuaucuccaugcugacauuugaa

SEQ ID NO: 226517 - RNA, 32 nt, Human
uauuuuguuuugcucugcuggcucuuuaaaga

SEQ ID NO: 226518 - RNA, 32 nt, Human
uauuuuguuuuuaauaaauacaaccugauuua

SEQ ID NO: 226519 - RNA, 32 nt, Human
uauuuuuaaaaaggaaggaaggagcaagugaa

SEQ ID NO: 226520 - RNA, 32 nt, Human
uauuuuuaaaaauuuacaucaagagaggcagu

SEQ ID NO: 226521 - RNA, 32 nt, Human
uauuuuuaaaacacacgaaugaccaaggcuug

SEQ ID NO: 226522 - RNA, 32 nt, Human
uauuuuuaaaggcuuuuuaaaaaucugacaaa

SEQ ID NO: 226523 - RNA, 32 nt, Human
uauuuuuaaagugccaaacaaauccccuuccu

SEQ ID NO: 226524 - RNA, 32 nt, Human
uauuuuuaaauacauuguuucauuuaauucuu

SEQ ID NO: 226525 - RNA, 32 nt, Human
uauuuuuaacauccugugacuucaugcuagaa

SEQ ID NO: 226526 - RNA, 31 nt, Human
uauuuuuaaguguccucagcauugcagaaaa

SEQ ID NO: 226527 - RNA, 32 nt, Human
uauuuuuacaucauuuguuuuuccugaccagu

SEQ ID NO: 226528 - RNA, 32 nt, Human
uauuuuuaguagagacugguuucuccauguug

SEQ ID NO: 226529 - RNA, 32 nt, Human
uauuuuuaguagagauggguuucuccauguug

SEQ ID NO: 226530 - RNA, 32 nt, Human
uauuuuuaguagugucauaagaacggacuagu

SEQ ID NO: 226531 - RNA, 23 nt, Human
uauuuuuauaaauuauuuucuca

SEQ ID NO: 226532 - RNA, 32 nt, Human
uauuuuuauauguauauuuauuaacauguuua

SEQ ID NO: 226533 - RNA, 32 nt, Human
uauuuuuauuggcuuuagcugugucuuuugaa

SEQ ID NO: 226534 - RNA, 32 nt, Human
uauuuuuauuucuuuaagauggagucuugcuc

SEQ ID NO: 226535 - RNA, 32 nt, Human
uauuuuuauuuuauaaacuauuuuggaggccu

SEQ ID NO: 226536 - RNA, 32 nt, Human
uauuuuuauuuucuuccuugucucauaacguu

SEQ ID NO: 226537 - RNA, 32 nt, Human
uauuuuuauuuuuacuuagagacagggucuug

SEQ ID NO: 226538 - RNA, 32 nt, Human
uauuuuuauuuuuguagagacaggagucuugc

SEQ ID NO: 226539 - RNA, 32 nt, Human
uauuuuucaagguuuuaaaacagucuacauug

SEQ ID NO: 226540 - RNA, 32 nt, Human
uauuuuucagaagaauaugaggaacaguacuc

SEQ ID NO: 226541 - RNA, 32 nt, Human
uauuuuucauuaucacauguauggaaauggca

SEQ ID NO: 226542 - RNA, 32 nt, Human
uauuuuucauucuuauuaacacugauaaacuu

SEQ ID NO: 226543 - RNA, 32 nt, Human
uauuuuucauuuccagcucuggcucuaaauaa

SEQ ID NO: 226544 - RNA, 32 nt, Human
uauuuuucccuuucucuuacauuucucaugag

SEQ ID NO: 226545 - RNA, 32 nt, Human
uauuuuuccugcucucuuuuccacuuuuccac

SEQ ID NO: 226546 - RNA, 32 nt, Human
uauuuuuccuuugaguggugacccagcucuuu

SEQ ID NO: 226547 - RNA, 32 nt, Human
uauuuuucuaaauccaacagcccauauuugau

SEQ ID NO: 226548 - RNA, 32 nt, Human
uauuuuucuaauguuuugcauuucaaguggua

SEQ ID NO: 226549 - RNA, 32 nt, Human
uauuuuucuaggagaagaaccucuuugcccag

SEQ ID NO: 226550 - RNA, 32 nt, Human
uauuuuucuaggagccucuugccuugucacuu

SEQ ID NO: 226551 - RNA, 32 nt, Human
uauuuuucucagccaugucauucuuuaaauua

SEQ ID NO: 226552 - RNA, 32 nt, Human
uauuuuucuguagugugaaacagcugcccugu

SEQ ID NO: 226553 - RNA, 32 nt, Human
uauuuuucuguuagcuggguuuacaugugaug

SEQ ID NO: 226554 - RNA, 32 nt, Human
uauuuuucuguuugcggcccaggaagcagugg

SEQ ID NO: 226555 - RNA, 32 nt, Human
uauuuuugaaauaaauuuuucccagugggaga

SEQ ID NO: 226556 - RNA, 32 nt, Human
uauuuuugaagauggcuuauucuuuuguucuu

SEQ ID NO: 226557 - RNA, 32 nt, Human
uauuuuugaaggcauaaaagcaguugaguuuc

SEQ ID NO: 226558 - RNA, 32 nt, Human
uauuuuugacauaucugucaacccacuugacu

SEQ ID NO: 226559 - RNA, 32 nt, Human
uauuuuugaccagcuucauuugucagcuuugc

SEQ ID NO: 226560 - RNA, 32 nt, Human
uauuuuugagcccucuaugugguccaggcaga

SEQ ID NO: 226561 - RNA, 32 nt, Human
uauuuuugauacagcaagugucaaacuugcua

SEQ ID NO: 226562 - RNA, 32 nt, Human
uauuuuugcaaacuaaauacacaaagcaugcc

SEQ ID NO: 226563 - RNA, 32 nt, Human
uauuuuugccuuuauaagauuuucuuggaaaa

SEQ ID NO: 226564 - RNA, 32 nt, Human
uauuuuugcuaccagaugauagcuauuuucau

SEQ ID NO: 226565 - RNA, 32 nt, Human
uauuuuugcugaggcauguaagaggaaauugc

SEQ ID NO: 226566 - RNA, 32 nt, Human
uauuuuuggccauucucauaccacagacaaaa

SEQ ID NO: 226567 - RNA, 32 nt, Human
uauuuuugggaggcagagaggggcaggcuugg

SEQ ID NO: 226568 - RNA, 32 nt, Human
uauuuuugggcaaaugaaaccauaaacuccga

SEQ ID NO: 226569 - RNA, 32 nt, Human
uauuuuuguauuugugcuuuccauccaucuuc

SEQ ID NO: 226570 - RNA, 31 nt, Human
uauuuuugucuaaaagagugauuucuguuua

SEQ ID NO: 226571 - RNA, 32 nt, Human
uauuuuugugcaaaugaacuucuccuuuugac

SEQ ID NO: 226572 - RNA, 32 nt, Human
uauuuuugugguagggaagugggaugcuccuc

SEQ ID NO: 226573 - RNA, 32 nt, Human
uauuuuuguguauguguguauguucacuugaa

SEQ ID NO: 226574 - RNA, 25 nt, Human
uauuuuuguguuuugggguugguug

SEQ ID NO: 226575 - RNA, 32 nt, Human
uauuuuuguuuucagaguagcugugcuaugug

SEQ ID NO: 226576 - RNA, 20 nt, Human
ucaaaaaagugguuuugacc

SEQ ID NO: 226577 - RNA, 32 nt, Human
ucaaaaacaacaacaacaacaaaaacccuauu

SEQ ID NO: 226578 - RNA, 25 nt, Human
ucaaaaacaagacaacuuccucuca

SEQ ID NO: 226579 - RNA, 32 nt, Human
ucaaaaacacuguugguggaaucuuuuauuuc

SEQ ID NO: 226580 - RNA, 32 nt, Human
ucaaaaacucugauuucugcacuugagcauac

SEQ ID NO: 226581 - RNA, 32 nt, Human
ucaaaaacugaggugggguguguguuacgaau

SEQ ID NO: 226582 - RNA, 32 nt, Human
ucaaaaagacuguaugccugugucugaggaac

SEQ ID NO: 226583 - RNA, 32 nt, Human
ucaaaaaggauguaagacuuggagccagagca

SEQ ID NO: 226584 - RNA, 32 nt, Human
ucaaaaaggcagcuaggucagaaggaaacaua

SEQ ID NO: 226585 - RNA, 32 nt, Human
ucaaaaaggccauucaucugaagaagcucaau

SEQ ID NO: 226586 - RNA, 32 nt, Human
ucaaaaaguaagaaagaaaauuuggaaaauga

SEQ ID NO: 226587 - RNA, 32 nt, Human
ucaaaaaguuuaaaaagggaauucuuuagaga

SEQ ID NO: 226588 - RNA, 32 nt, Human
ucaaaaauacaaaaauuagcuggcaugguggu

SEQ ID NO: 226589 - RNA, 32 nt, Human
ucaaaaaucaggcuggagugcaguggcaugau

SEQ ID NO: 226590 - RNA, 25 nt, Human
ucaaaaaucccaggauuacaggcau

SEQ ID NO: 226591 - RNA, 32 nt, Human
ucaaaaaugcuaaaauaauuugggagaaaaua

SEQ ID NO: 226592 - RNA, 32 nt, Human
ucaaaaaugcugggaaagguugggagaaauuu

SEQ ID NO: 226593 - RNA, 32 nt, Human
ucaaaaauggcagaacacggaagcagggcgag

SEQ ID NO: 226594 - RNA, 32 nt, Human
ucaaaaauggcugcaaccacaugagccaugug

SEQ ID NO: 226595 - RNA, 32 nt, Human
ucaaaaaugggucacaggauggccuuuuaaaa

SEQ ID NO: 226596 - RNA, 32 nt, Human
ucaaaaauucaggcugauugucuuuuaucaga

SEQ ID NO: 226597 - RNA, 32 nt, Human
ucaaaaauuucaaagugaaagccacauccucc

SEQ ID NO: 226598 - RNA, 32 nt, Human
ucaaaacaagacccagcuuauuuucugcuugc

SEQ ID NO: 226599 - RNA, 32 nt, Human
ucaaaacaggcagagggaauaggagcaaaaag

SEQ ID NO: 226600 - RNA, 32 nt, Human
ucaaaacauaacacaucacagcacucaguaga

SEQ ID NO: 226601 - RNA, 32 nt, Human
ucaaaacaucauguccuacaucacugccaaga

SEQ ID NO: 226602 - RNA, 32 nt, Human
ucaaaacaugcuuacacuaacacuucuuucca

SEQ ID NO: 226603 - RNA, 24 nt, Human
ucaaaacauguuacagccugcauc

SEQ ID NO: 226604 - RNA, 32 nt, Human
ucaaaaccaauauagaccagaagacaguggaa

SEQ ID NO: 226605 - RNA, 32 nt, Human
ucaaaaccacagugagauauugccucauagga

SEQ ID NO: 226606 - RNA, 32 nt, Human
ucaaaaccagccugaccaacauggugaaaccc

SEQ ID NO: 226607 - RNA, 32 nt, Human
ucaaaaccagccugaccaauauggugaaaccc

SEQ ID NO: 226608 - RNA, 32 nt, Human
ucaaaaccagccuggacaaucuggcgaaaccc

SEQ ID NO: 226609 - RNA, 32 nt, Human
ucaaaaccagccuggccaacauagugaaaccc

SEQ ID NO: 226610 - RNA, 23 nt, Human
ucaaaaccagccuggccaacaug

SEQ ID NO: 226611 - RNA, 32 nt, Human
ucaaaaccagccuggccaacaugcugaaaccu

SEQ ID NO: 226612 - RNA, 32 nt, Human
ucaaaaccagccuggccaacauggugaaaccc

SEQ ID NO: 226613 - RNA, 32 nt, Human
ucaaaaccagccuggccaacauggugaaaccg

SEQ ID NO: 226614 - RNA, 32 nt, Human
ucaaaaccagccugggcaauauagugagaccg

SEQ ID NO: 226615 - RNA, 26 nt, Human
ucaaaaccagccuguccaauauagug

SEQ ID NO: 226616 - RNA, 21 nt, Human
ucaaaaccaguucaguguauc

SEQ ID NO: 226617 - RNA, 32 nt, Human
ucaaaaccauccuggcuaacauggugaaaccc

SEQ ID NO: 226618 - RNA, 32 nt, Human
ucaaaacccagccucuugcaagaagcuaaaaa

SEQ ID NO: 226619 - RNA, 21 nt, Human
ucaaaacggaaugguuuuccu

SEQ ID NO: 226620 - RNA, 21 nt, Human
ucaaaacuacauccucugcca

SEQ ID NO: 226621 - RNA, 32 nt, Human
ucaaaacuccucuuugauaucagaccugaugu

SEQ ID NO: 226622 - RNA, 32 nt, Human
ucaaaacuccuggcaguuccucagggacaggc

SEQ ID NO: 226623 - RNA, 32 nt, Human
ucaaaacugauaacaaugaaacugcggcucuu

SEQ ID NO: 226624 - RNA, 22 nt, Human
ucaaaacugccaugccccccug

SEQ ID NO: 226625 - RNA, 32 nt, Human
ucaaaacugccucugcauugggugaagacuaa

SEQ ID NO: 226626 - RNA, 32 nt, Human
ucaaaacugugugaccacuacagcagaguaaa

SEQ ID NO: 226627 - RNA, 20 nt, Human
ucaaaacuuaauccccaaug

SEQ ID NO: 226628 - RNA, 32 nt, Human
ucaaaacuuacuuuaaaccucuaguuucgugc

SEQ ID NO: 226629 - RNA, 32 nt, Human
ucaaaacuucauuuucugaauguuuuacauaa

SEQ ID NO: 226630 - RNA, 32 nt, Human
ucaaaacuuccagagaucuuaauggcuauaua

SEQ ID NO: 226631 - RNA, 32 nt, Human
ucaaaagaaagaggagaaaggaagggaagcau

SEQ ID NO: 226632 - RNA, 32 nt, Human
ucaaaagaacaaaauccacagaugcaauguga

SEQ ID NO: 226633 - RNA, 32 nt, Human
ucaaaagaacaggcaggcugugccaguuuagu

SEQ ID NO: 226634 - RNA, 32 nt, Human
ucaaaagacucuuugaauucagaaagaugauu

SEQ ID NO: 226635 - RNA, 32 nt, Human
ucaaaagagaagccagacccagcuucagauca

SEQ ID NO: 226636 - RNA, 21 nt, Human
ucaaaagauccaacuuuuucu

SEQ ID NO: 226637 - RNA, 32 nt, Human
ucaaaagauggacugagcuuccacuuggguuu

SEQ ID NO: 226638 - RNA, 32 nt, Human
ucaaaagauguucugauaacauugugauugua

SEQ ID NO: 226639 - RNA, 22 nt, Human
ucaaaagauuccaucagaacuu

SEQ ID NO: 226640 - RNA, 32 nt, Human
ucaaaagcaaaaagauaacgauccuuucuacu

SEQ ID NO: 226641 - RNA, 32 nt, Human
ucaaaagcaaagcauucucuucccagugccua

SEQ ID NO: 226642 - RNA, 32 nt, Human
ucaaaagcaccuucugcacacagucugcacac

SEQ ID NO: 226643 - RNA, 32 nt, Human
ucaaaagcuucuguccagcaaaggacacaguc

SEQ ID NO: 226644 - RNA, 32 nt, Human
ucaaaaggaaggcuuccuuuaaggucaaguuu

SEQ ID NO: 226645 - RNA, 32 nt, Human
ucaaaaggaauccugcaaguagccuuaauaac

SEQ ID NO: 226646 - RNA, 32 nt, Human
ucaaaaggacugcccucucuuguucuuggaaa

SEQ ID NO: 226647 - RNA, 32 nt, Human
ucaaaaggagaaaaguauaggcuguggacaau

SEQ ID NO: 226648 - RNA, 32 nt, Human
ucaaaaggauuucaggcugagugugguggcuc

SEQ ID NO: 226649 - RNA, 32 nt, Human
ucaaaaggcucaacagacugaauggccucuug

SEQ ID NO: 226650 - RNA, 32 nt, Human
ucaaaagggcuggcucggcacuggcuccuugc

SEQ ID NO: 226651 - RNA, 32 nt, Human
ucaaaagguauuagcaaauuuauguauucuuc

SEQ ID NO: 226652 - RNA, 32 nt, Human
ucaaaagguuuuaauaaaucuaauccuauuuc

SEQ ID NO: 226653 - RNA, 32 nt, Human
ucaaaaguaaaagcaguggcccugcuuugggg

SEQ ID NO: 226654 - RNA, 32 nt, Human
ucaaaagucacagaacuggaaaguuaauucau

SEQ ID NO: 226655 - RNA, 32 nt, Human
ucaaaagucuuucauuggcagaucuugguagc

SEQ ID NO: 226656 - RNA, 32 nt, Human
ucaaaaguuaucucccucucccugugaugccu

SEQ ID NO: 226657 - RNA, 32 nt, Human
ucaaaaguuuuuauuuugauauuugaaagaga

SEQ ID NO: 226658 - RNA, 32 nt, Human
ucaaaauaauaagaaccauauguaauaaaccc

SEQ ID NO: 226659 - RNA, 32 nt, Human
ucaaaauaccaaaaauuacagcuuuggaacug

SEQ ID NO: 226660 - RNA, 32 nt, Human
ucaaaauaccugccaaauggcaagaguuucca

SEQ ID NO: 226661 - RNA, 32 nt, Human
ucaaaauaccuguaaucccagcacuuugggag

SEQ ID NO: 226662 - RNA, 32 nt, Human
ucaaaauacuguaaucucagcauuuugggaga

SEQ ID NO: 226663 - RNA, 21 nt, Human
ucaaaauacuuuacucuuuca

SEQ ID NO: 226664 - RNA, 32 nt, Human
ucaaaauagggaggaaauagccagaaagucau

SEQ ID NO: 226665 - RNA, 32 nt, Human
ucaaaauauacaacuacagauucucugacaga

SEQ ID NO: 226666 - RNA, 32 nt, Human
ucaaaauauauacacccccaacacuggaguac

SEQ ID NO: 226667 - RNA, 32 nt, Human
ucaaaauauucucgaaggcagugcagucacua

SEQ ID NO: 226668 - RNA, 32 nt, Human
ucaaaaucagccagguagaccugaagggguac

SEQ ID NO: 226669 - RNA, 32 nt, Human
ucaaaaucagccuggccaaaaugcugaaacuc

SEQ ID NO: 226670 - RNA, 32 nt, Human
ucaaaaucauguccccuccacuuccacugcca

SEQ ID NO: 226671 - RNA, 32 nt, Human
ucaaaaucuggugccucucccuucccuuuccc

SEQ ID NO: 226672 - RNA, 32 nt, Human
ucaaaaugaaggaggaguacucaggaaaacau

SEQ ID NO: 226673 - RNA, 32 nt, Human
ucaaaaugaggccugugaaauacaagguuccc

SEQ ID NO: 226674 - RNA, 32 nt, Human
ucaaaaugaguggcuaauucuccauacguaau

SEQ ID NO: 226675 - RNA, 24 nt, Human
ucaaaaugcugggauuacaggugu

SEQ ID NO: 226676 - RNA, 32 nt, Human
ucaaaaugcuuucugggccagacaugguggcu

SEQ ID NO: 226677 - RNA, 21 nt, Human
ucaaaauggaaagaguauuca

SEQ ID NO: 226678 - RNA, 32 nt, Human
ucaaaaugggcucccaugagacugccuggcuc

SEQ ID NO: 226679 - RNA, 32 nt, Human
ucaaaauggggguaaacagaagaggcugcucc

SEQ ID NO: 226680 - RNA, 32 nt, Human
ucaaaauguagauucauugugucuguguggua

SEQ ID NO: 226681 - RNA, 32 nt, Human
ucaaaauuaacacuauuaaauguaauauaagc

SEQ ID NO: 226682 - RNA, 32 nt, Human
ucaaaauuagguauaguuaacacagaauaccc

SEQ ID NO: 226683 - RNA, 21 nt, Human
ucaaaauuccaaauuuuuucu

SEQ ID NO: 226684 - RNA, 22 nt, Human
ucaaaauucugcgccuuuuucu

SEQ ID NO: 226685 - RNA, 32 nt, Human
ucaaaauuuccagauuugggcuauuucuguau

SEQ ID NO: 226686 - RNA, 23 nt, Human
ucaaacaauacacuguuaccuuu

SEQ ID NO: 226687 - RNA, 32 nt, Human
ucaaacaaugcccuaaugcugaggcuuaucug

SEQ ID NO: 226688 - RNA, 32 nt, Human
ucaaacacacaaaaauacugccuuguacuggu

SEQ ID NO: 226689 - RNA, 32 nt, Human
ucaaacacacaugcucuacaaacaauuugugc

SEQ ID NO: 226690 - RNA, 32 nt, Human
ucaaacacacuuccagcuggcauauagguugc

SEQ ID NO: 226691 - RNA, 32 nt, Human
ucaaacagaacagcuccccuuguagcugucuu

SEQ ID NO: 226692 - RNA, 32 nt, Human
ucaaacagacacuuuccucaaacauauaaaug

SEQ ID NO: 226693 - RNA, 32 nt, Human
ucaaacagagcauucugaguguuuacaggcgg

SEQ ID NO: 226694 - RNA, 32 nt, Human
ucaaacagaguuuaccugagaugugcaucugg

SEQ ID NO: 226695 - RNA, 32 nt, Human
ucaaacaggccaggcuccagcacuucaguacg

SEQ ID NO: 226696 - RNA, 32 nt, Human
ucaaacaggccuggguaucugaggcuugcuug

SEQ ID NO: 226697 - RNA, 32 nt, Human
ucaaacagggagacagacagagguugcaguga

SEQ ID NO: 226698 - RNA, 32 nt, Human
ucaaaccaaacaguggggaccccaacagaaga

SEQ ID NO: 226699 - RNA, 32 nt, Human
ucaaaccacaauauauacauuuggaucagugu

SEQ ID NO: 226700 - RNA, 32 nt, Human
ucaaaccacauauguuauugggagaaacgauu

SEQ ID NO: 226701 - RNA, 32 nt, Human
ucaaaccacugcaauccagccugggcaacgag

SEQ ID NO: 226702 - RNA, 32 nt, Human
ucaaaccacuguaguccagccugagugacaga

SEQ ID NO: 226703 - RNA, 32 nt, Human
ucaaaccagcccugguguagcagacacugcaa

SEQ ID NO: 226704 - RNA, 32 nt, Human
ucaaaccagugaagcuugggaaagucauugac

SEQ ID NO: 226705 - RNA, 24 nt, Human
ucaaaccauuugagccaaacugua

SEQ ID NO: 226706 - RNA, 32 nt, Human
ucaaacccagaagguuuaaucacuucauccca

SEQ ID NO: 226707 - RNA, 23 nt, Human
ucaaaccccggaccucaggugau

SEQ ID NO: 226708 - RNA, 19 nt, Human
ucaaaccccugggcucaag

SEQ ID NO: 226709 - RNA, 32 nt, Human
ucaaacccugcucccacuuugugagagccagc

SEQ ID NO: 226710 - RNA, 32 nt, Human
ucaaacccuucccucacucucugccucauuuu

SEQ ID NO: 226711 - RNA, 32 nt, Human
ucaaaccggauguguacuuugccccucaguag

SEQ ID NO: 226712 - RNA, 19 nt, Human
ucaaaccguguugauuuuu

SEQ ID NO: 226713 - RNA, 32 nt, Human
ucaaaccguguugauuuuugcugguaaguauu

SEQ ID NO: 226714 - RNA, 24 nt, Human
ucaaaccuauaaucccagcacuuu

SEQ ID NO: 226715 - RNA, 32 nt, Human
ucaaaccuauaaucccagcacuuugggaggcc

SEQ ID NO: 226716 - RNA, 32 nt, Human
ucaaaccucacccugaccuccugcugccuaug

SEQ ID NO: 226717 - RNA, 32 nt, Human
ucaaaccuccauuagaccucaggacuccaaga

SEQ ID NO: 226718 - RNA, 32 nt, Human
ucaaaccugaccagacagcagaggggcggcuc

SEQ ID NO: 226719 - RNA, 32 nt, Human
ucaaaccugaguaucaguacaugccuagaccu

SEQ ID NO: 226720 - RNA, 18 nt, Human
ucaaaccugaugauucuu

SEQ ID NO: 226721 - RNA, 32 nt, Human
ucaaaccugcauauugugauuuuaauuugacc

SEQ ID NO: 226722 - RNA, 24 nt, Human
ucaaaccuggcggacagagugaga

SEQ ID NO: 226723 - RNA, 32 nt, Human
ucaaaccuggcggacagagugagacccuaucu

SEQ ID NO: 226724 - RNA, 32 nt, Human
ucaaaccugggaguuugaagcugcagugagcc

SEQ ID NO: 226725 - RNA, 24 nt, Human
ucaaaccuguaaucccagcacuuu

SEQ ID NO: 226726 - RNA, 32 nt, Human
ucaaaccuguaaucccagcacuuugggaggcc

SEQ ID NO: 226727 - RNA, 32 nt, Human
ucaaaccuguaaucccagcacuuugggaggcu

SEQ ID NO: 226728 - RNA, 32 nt, Human
ucaaaccugugguguguggaagugaccacugg

SEQ ID NO: 226729 - RNA, 32 nt, Human
ucaaaccuucagcugagacugcagcccugcca

SEQ ID NO: 226730 - RNA, 32 nt, Human
ucaaacgcggagggcugcgugcagugggagcg

SEQ ID NO: 226731 - RNA, 32 nt, Human
ucaaacgucccaaaaggagaaaugcuuucuua

SEQ ID NO: 226732 - RNA, 32 nt, Human
ucaaacuaagaugacuuauaagaaauaaaaga

SEQ ID NO: 226733 - RNA, 32 nt, Human
ucaaacuacaaauaggcuuuucccucuccccu

SEQ ID NO: 226734 - RNA, 18 nt, Human
ucaaacuacagagugaga

SEQ ID NO: 226735 - RNA, 32 nt, Human
ucaaacuacauacuugcuauccguuucacuag

SEQ ID NO: 226736 - RNA, 32 nt, Human
ucaaacuacugcccaguuucccuggacuagcc

SEQ ID NO: 226737 - RNA, 19 nt, Human
ucaaacuacugggcucaag

SEQ ID NO: 226738 - RNA, 24 nt, Human
ucaaacucauccuucaaggugauu

SEQ ID NO: 226739 - RNA, 23 nt, Human
ucaaacucaugggcucaagugau

SEQ ID NO: 226740 - RNA, 32 nt, Human
ucaaacuccaaccagucacccaaccagagccu

SEQ ID NO: 226741 - RNA, 19 nt, Human
ucaaacuccagggcucaag

SEQ ID NO: 226742 - RNA, 23 nt, Human
ucaaacucccaaagcgcaugauu

SEQ ID NO: 226743 - RNA, 23 nt, Human
ucaaacucccaaccucaagugau

SEQ ID NO: 226744 - RNA, 23 nt, Human
ucaaacucccaaccucaggugau

SEQ ID NO: 226745 - RNA, 23 nt, Human
ucaaacucccaggcucaagggau

SEQ ID NO: 226746 - RNA, 32 nt, Human
ucaaacuccccagcucgggugauucuuccugc

SEQ ID NO: 226747 - RNA, 22 nt, Human
ucaaacucccgaccucaaguga

SEQ ID NO: 226748 - RNA, 23 nt, Human
ucaaacucccgaccucaagugau

SEQ ID NO: 226749 - RNA, 23 nt, Human
ucaaacucccgaccucaggugau

SEQ ID NO: 226750 - RNA, 23 nt, Human
ucaaacucccgacuucaggugau

SEQ ID NO: 226751 - RNA, 19 nt, Human
ucaaacucccgggcucaag

SEQ ID NO: 226752 - RNA, 19 nt, Human
ucaaacuccggagcucaag

SEQ ID NO: 226753 - RNA, 23 nt, Human
ucaaacuccuaaccucaacugau

SEQ ID NO: 226754 - RNA, 21 nt, Human
ucaaacuccuagccucaagug

SEQ ID NO: 226755 - RNA, 23 nt, Human
ucaaacuccuaggcucaagcgau

SEQ ID NO: 226756 - RNA, 23 nt, Human
ucaaacuccuaggcucaggcgau

SEQ ID NO: 226757 - RNA, 23 nt, Human
ucaaacuccuccacucaggugau

SEQ ID NO: 226758 - RNA, 24 nt, Human
ucaaacuccucgguucaagcaauu

SEQ ID NO: 226759 - RNA, 23 nt, Human
ucaaacuccugaacucaggugau

SEQ ID NO: 226760 - RNA, 23 nt, Human
ucaaacuccugaccgcaggugau

SEQ ID NO: 226761 - RNA, 21 nt, Human
ucaaacuccugaccuagugau

SEQ ID NO: 226762 - RNA, 23 nt, Human
ucaaacuccugaccucaaaugau

SEQ ID NO: 226763 - RNA, 23 nt, Human
ucaaacuccugaccucaagcgau

SEQ ID NO: 226764 - RNA, 22 nt, Human
ucaaacuccugaccucaaggau

SEQ ID NO: 226765 - RNA, 20 nt, Human
ucaaacuccugaccucaagu

SEQ ID NO: 226766 - RNA, 22 nt, Human
ucaaacuccugaccucaaguga

SEQ ID NO: 226767 - RNA, 23 nt, Human
ucaaacuccugaccucaagugau

SEQ ID NO: 226768 - RNA, 23 nt, Human
ucaaacuccugaccucagaugau

SEQ ID NO: 226769 - RNA, 24 nt, Human
ucaaacuccugaccucagaugauu

SEQ ID NO: 226770 - RNA, 23 nt, Human
ucaaacuccugaccucaggcgau

SEQ ID NO: 226771 - RNA, 23 nt, Human
ucaaacuccugaccucaggugau

SEQ ID NO: 226772 - RNA, 23 nt, Human
ucaaacuccugaccucaguugau

SEQ ID NO: 226773 - RNA, 21 nt, Human
ucaaacuccugaccucaugau

SEQ ID NO: 226774 - RNA, 22 nt, Human
ucaaacuccugaccucaugauu

SEQ ID NO: 226775 - RNA, 23 nt, Human
ucaaacuccugaccuccagugau

SEQ ID NO: 226776 - RNA, 23 nt, Human
ucaaacuccugaccugaggcgau

SEQ ID NO: 226777 - RNA, 23 nt, Human
ucaaacuccugaccuuaggugau

SEQ ID NO: 226778 - RNA, 23 nt, Human
ucaaacuccugaccuuaguugau

SEQ ID NO: 226779 - RNA, 23 nt, Human
ucaaacuccugacgccaggugau

SEQ ID NO: 226780 - RNA, 21 nt, Human
ucaaacuccugacgucgugau

SEQ ID NO: 226781 - RNA, 23 nt, Human
ucaaacuccugacucgaagugau

SEQ ID NO: 226782 - RNA, 23 nt, Human
ucaaacuccugacuucaaaugau

SEQ ID NO: 226783 - RNA, 23 nt, Human
ucaaacuccugacuucaagugau

SEQ ID NO: 226784 - RNA, 23 nt, Human
ucaaacuccugacuucaggugau

SEQ ID NO: 226785 - RNA, 21 nt, Human
ucaaacuccugacuuugugau

SEQ ID NO: 226786 - RNA, 23 nt, Human
ucaaacuccugagcccaggugau

SEQ ID NO: 226787 - RNA, 19 nt, Human
ucaaacuccugagcucaag

SEQ ID NO: 226788 - RNA, 23 nt, Human
ucaaacuccugagcucaagcgau

SEQ ID NO: 226789 - RNA, 20 nt, Human
ucaaacuccugagcucaagu

SEQ ID NO: 226790 - RNA, 23 nt, Human
ucaaacuccugagcucaagugau

SEQ ID NO: 226791 - RNA, 23 nt, Human
ucaaacuccugaucucaagugau

SEQ ID NO: 226792 - RNA, 23 nt, Human
ucaaacuccugcucucaagugau

SEQ ID NO: 226793 - RNA, 19 nt, Human
ucaaacuccuggacucaag

SEQ ID NO: 226794 - RNA, 23 nt, Human
ucaaacuccuggacucaagcgau

SEQ ID NO: 226795 - RNA, 23 nt, Human
ucaaacuccuggacucaagugau

SEQ ID NO: 226796 - RNA, 23 nt, Human
ucaaacuccuggacucaugggau

SEQ ID NO: 226797 - RNA, 19 nt, Human
ucaaacuccuggccucaag

SEQ ID NO: 226798 - RNA, 23 nt, Human
ucaaacuccuggccucaagugau

SEQ ID NO: 226799 - RNA, 23 nt, Human
ucaaacuccuggccucaaguggu

SEQ ID NO: 226800 - RNA, 23 nt, Human
ucaaacuccuggccucaggcgau

SEQ ID NO: 226801 - RNA, 23 nt, Human
ucaaacuccuggccucaggugau

SEQ ID NO: 226802 - RNA, 23 nt, Human
ucaaacuccuggccucaugugau

SEQ ID NO: 226803 - RNA, 23 nt, Human
ucaaacuccuggcuucaagugau

SEQ ID NO: 226804 - RNA, 19 nt, Human
ucaaacuccugggcacaag

SEQ ID NO: 226805 - RNA, 19 nt, Human
ucaaacuccugggcucaag

SEQ ID NO: 226806 - RNA, 22 nt, Human
ucaaacuccugggcucaagcga

SEQ ID NO: 226807 - RNA, 23 nt, Human
ucaaacuccugggcucaagcgau

SEQ ID NO: 226808 - RNA, 23 nt, Human
ucaaacuccugggcucaagggau

SEQ ID NO: 226809 - RNA, 20 nt, Human
ucaaacuccugggcucaagu

SEQ ID NO: 226810 - RNA, 22 nt, Human
ucaaacuccugggcucaaguga

SEQ ID NO: 226811 - RNA, 23 nt, Human
ucaaacuccugggcucaagugau

SEQ ID NO: 226812 - RNA, 23 nt, Human
ucaaacuccugggcucagaugau

SEQ ID NO: 226813 - RNA, 19 nt, Human
ucaaacuccugggcucagg

SEQ ID NO: 226814 - RNA, 23 nt, Human
ucaaacuccugggcucaggcgau

SEQ ID NO: 226815 - RNA, 23 nt, Human
ucaaacuccugggcuccaacgau

SEQ ID NO: 226816 - RNA, 22 nt, Human
ucaaacuccugggcuccaguga

SEQ ID NO: 226817 - RNA, 23 nt, Human
ucaaacuccugggcuccagugau

SEQ ID NO: 226818 - RNA, 19 nt, Human
ucaaacuccuggggucaag

SEQ ID NO: 226819 - RNA, 23 nt, Human
ucaaacuccuggguucaagagau

SEQ ID NO: 226820 - RNA, 23 nt, Human
ucaaacuccuggucucaagugau

SEQ ID NO: 226821 - RNA, 22 nt, Human
ucaaacuccugugcucaaguga

SEQ ID NO: 226822 - RNA, 23 nt, Human
ucaaacuccuuggcugaagugau

SEQ ID NO: 226823 - RNA, 23 nt, Human
ucaaacucuaacgucaagugauu

SEQ ID NO: 226824 - RNA, 32 nt, Human
ucaaacucucauuuaggugacagccuggugac

SEQ ID NO: 226825 - RNA, 32 nt, Human
ucaaacucuccccaucucuacugccucacccc

SEQ ID NO: 226826 - RNA, 23 nt, Human
ucaaacucugcauccuucucuaa

SEQ ID NO: 226827 - RNA, 24 nt, Human
ucaaacucuggggcucaagcaguu

SEQ ID NO: 226828 - RNA, 23 nt, Human
ucaaacucuuaggcucaggcgau

SEQ ID NO: 226829 - RNA, 23 nt, Human
ucaaacucuugacuucaagugau

SEQ ID NO: 226830 - RNA, 19 nt, Human
ucaaacucuugggcucaag

SEQ ID NO: 226831 - RNA, 32 nt, Human
ucaaacugagaauguaaccguuuccagacuuu

SEQ ID NO: 226832 - RNA, 32 nt, Human
ucaaacugcaaagcuaaugauaugcuaucugc

SEQ ID NO: 226833 - RNA, 32 nt, Human
ucaaacugcagacauacugucaacaucuggga

SEQ ID NO: 226834 - RNA, 32 nt, Human
ucaaacugcauuugcaaaaugugcaaagaccu

SEQ ID NO: 226835 - RNA, 23 nt, Human
ucaaacugcuaacaucaagugau

SEQ ID NO: 226836 - RNA, 32 nt, Human
ucaaacugcugccuuugccuccagugcauccu

SEQ ID NO: 226837 - RNA, 32 nt, Human
ucaaacugggcuuccuggauguacaaauggaa

SEQ ID NO: 226838 - RNA, 32 nt, Human
ucaaacuguaauaagcucaucaauuucauuuc

SEQ ID NO: 226839 - RNA, 32 nt, Human
ucaaacuguaugccugcuccagccuggacugc

SEQ ID NO: 226840 - RNA, 32 nt, Human
ucaaacugucucaagcugagagauguuuuuag

SEQ ID NO: 226841 - RNA, 32 nt, Human
ucaaacuuaaggcugaucagcagaugggaugu

SEQ ID NO: 226842 - RNA, 23 nt, Human
ucaaacuucugaccucaagugau

SEQ ID NO: 226843 - RNA, 23 nt, Human
ucaaacuucuggacucaagugau

SEQ ID NO: 226844 - RNA, 23 nt, Human
ucaaacuucuggccucaagugau

SEQ ID NO: 226845 - RNA, 24 nt, Human
ucaaacuucugggcucaagcaauu

SEQ ID NO: 226846 - RNA, 20 nt, Human
ucaaacuucugggcucaagu

SEQ ID NO: 226847 - RNA, 19 nt, Human
ucaaacuucugggcuuaag

SEQ ID NO: 226848 - RNA, 32 nt, Human
ucaaacuugaaaagaaggacagagccacacaa

SEQ ID NO: 226849 - RNA, 32 nt, Human
ucaaacuugccuggcaguguuuguucaaaacu

SEQ ID NO: 226850 - RNA, 32 nt, Human
ucaaacuugcuugaccuccacuuuucaggaga

SEQ ID NO: 226851 - RNA, 32 nt, Human
ucaaacuuuugaaagaucuuugcaguguaauu

SEQ ID NO: 226852 - RNA, 32 nt, Human
ucaaagaaaaacaaacacugcguaaauuuuua

SEQ ID NO: 226853 - RNA, 32 nt, Human
ucaaagaaaaucaagaaauggcuuuggagaaa

SEQ ID NO: 226854 - RNA, 32 nt, Human
ucaaagaaacggcucugauccucuuuuccccc

SEQ ID NO: 226855 - RNA, 32 nt, Human
ucaaagaaaggaaggaaggaaggacaacuccc

SEQ ID NO: 226856 - RNA, 18 nt, Human
ucaaagaaauccuccaau

SEQ ID NO: 226857 - RNA, 32 nt, Human
ucaaagaacagagaggaggaggagggagaaau

SEQ ID NO: 226858 - RNA, 32 nt, Human
ucaaagaauaccagauauuuuagaguuggaag

SEQ ID NO: 226859 - RNA, 32 nt, Human
ucaaagaauuuauguaaccuucccagagucac

SEQ ID NO: 226860 - RNA, 32 nt, Human
ucaaagacaucacuggcuuugaagggaaaauu

SEQ ID NO: 226861 - RNA, 32 nt, Human
ucaaagacuauguccuaguggagggaguaauc

SEQ ID NO: 226862 - RNA, 32 nt, Human
ucaaagacugagcaguucagugguacauaaau

SEQ ID NO: 226863 - RNA, 32 nt, Human
ucaaagagaacaguaaugacagcuuccaacaa

SEQ ID NO: 226864 - RNA, 32 nt, Human
ucaaagagagugagagaagcaaguugcaugag

SEQ ID NO: 226865 - RNA, 32 nt, Human
ucaaagagagugaggaagagaaggagagagag

SEQ ID NO: 226866 - RNA, 32 nt, Human
ucaaagagauagagagcugcuuuuaugcugag

SEQ ID NO: 226867 - RNA, 32 nt, Human
ucaaagagccggcaagaauagagcagagacca

SEQ ID NO: 226868 - RNA, 32 nt, Human
ucaaagaggaaaggagaaaaacaaacagacca

SEQ ID NO: 226869 - RNA, 32 nt, Human
ucaaagaggaagaagaaaauagcagcaagaaa

SEQ ID NO: 226870 - RNA, 32 nt, Human
ucaaagaggagcugacacaagagaccacaguu

SEQ ID NO: 226871 - RNA, 32 nt, Human
ucaaagaggagggggaguggccucaccaugug

SEQ ID NO: 226872 - RNA, 32 nt, Human
ucaaagaggcauccuggcugggccaguugauu

SEQ ID NO: 226873 - RNA, 21 nt, Human
ucaaagauaaaaaacugggug

SEQ ID NO: 226874 - RNA, 32 nt, Human
ucaaagauagcucuuugcaagugccuugauua

SEQ ID NO: 226875 - RNA, 31 nt, Human
ucaaagaugacagccucagcucuugggggcc

SEQ ID NO: 226876 - RNA, 32 nt, Human
ucaaagaugccuuuugugagagugcccuaacc

SEQ ID NO: 226877 - RNA, 32 nt, Human
ucaaagauggcucaccaaucaccugccuguuu

SEQ ID NO: 226878 - RNA, 21 nt, Human
ucaaagauuuagaaccagaaa

SEQ ID NO: 226879 - RNA, 32 nt, Human
ucaaagcaaagucaugacaaugcagggcuccu

SEQ ID NO: 226880 - RNA, 21 nt, Human
ucaaagcaaauucaaauucuc

SEQ ID NO: 226881 - RNA, 32 nt, Human
ucaaagcaacaccaccaccacugaaguauuuu

SEQ ID NO: 226882 - RNA, 22 nt, Human
ucaaagcaagcaggagaaucuc

SEQ ID NO: 226883 - RNA, 32 nt, Human
ucaaagcaauagaaauagcuuggugguccuau

SEQ ID NO: 226884 - RNA, 32 nt, Human
ucaaagcaauugaaaugcauugcucuggaucu

SEQ ID NO: 226885 - RNA, 32 nt, Human
ucaaagcacaacucuauuucaugcuuucuguu

SEQ ID NO: 226886 - RNA, 32 nt, Human
ucaaagcacauuguagauauucagagagaaga

SEQ ID NO: 226887 - RNA, 32 nt, Human
ucaaagcaccagaauacacaaaguaaagacug

SEQ ID NO: 226888 - RNA, 32 nt, Human
ucaaagcaccugcuaaucaaagauuuccuauu

SEQ ID NO: 226889 - RNA, 32 nt, Human
ucaaagcacuuguauuuuccagccuaggcuuu

SEQ ID NO: 226890 - RNA, 22 nt, Human
ucaaagcaguggaggagcacac

SEQ ID NO: 226891 - RNA, 32 nt, Human
ucaaagcaguuggcuggaauacuuuugucaga

SEQ ID NO: 226892 - RNA, 32 nt, Human
ucaaagcaucucccccaucugcauacccagca

SEQ ID NO: 226893 - RNA, 22 nt, Human
ucaaagccaaacucaugcacac

SEQ ID NO: 226894 - RNA, 32 nt, Human
ucaaagccaaacucaugcacacacacgcagac

SEQ ID NO: 226895 - RNA, 32 nt, Human
ucaaagccaacuguccaccaggccugugcuag

SEQ ID NO: 226896 - RNA, 32 nt, Human
ucaaagccaagaccaagagccagugagguuug

SEQ ID NO: 226897 - RNA, 32 nt, Human
ucaaagccaagcaaaaugcacacccuuuuucu

SEQ ID NO: 226898 - RNA, 32 nt, Human
ucaaagccacaucgcauugaagccacaggugg

SEQ ID NO: 226899 - RNA, 23 nt, Human
ucaaagccagcacaagagcacac

SEQ ID NO: 226900 - RNA, 32 nt, Human
ucaaagccagccugagccacauagugagacug

SEQ ID NO: 226901 - RNA, 32 nt, Human
ucaaagccagcguccuccucugugaccaaugu

SEQ ID NO: 226902 - RNA, 32 nt, Human
ucaaagccaucccccaccagacugcuuagcgu

SEQ ID NO: 226903 - RNA, 32 nt, Human
ucaaagccaucuuuaaauaguucuuuaaaaau

SEQ ID NO: 226904 - RNA, 32 nt, Human
ucaaagcccacuuuagaaccuaaagcauuuug

SEQ ID NO: 226905 - RNA, 32 nt, Human
ucaaagcccagguaucucucagaucugcugcc

SEQ ID NO: 226906 - RNA, 32 nt, Human
ucaaagccccaaauuccugggcuggggauucc

SEQ ID NO: 226907 - RNA, 32 nt, Human
ucaaagcccccucugcacuggggugacuaucu

SEQ ID NO: 226908 - RNA, 32 nt, Human
ucaaagcccugccucugcccgacaggcugaag

SEQ ID NO: 226909 - RNA, 32 nt, Human
ucaaagcccugcuucuaagcagccagggagca

SEQ ID NO: 226910 - RNA, 32 nt, Human
ucaaagccgucgguuacagaggagacugacag

SEQ ID NO: 226911 - RNA, 32 nt, Human
ucaaagccuaucuaccuugauccaaaaacuac

SEQ ID NO: 226912 - RNA, 32 nt, Human
ucaaagccuucccaguccccagcaccugccuu

SEQ ID NO: 226913 - RNA, 32 nt, Human
ucaaagccuuuaccaguaucuuccuguauucc

SEQ ID NO: 226914 - RNA, 32 nt, Human
ucaaagccuuucuuuuccagccgagcgggccc

SEQ ID NO: 226915 - RNA, 32 nt, Human
ucaaagcgggccgugcugccccggcugccucg

SEQ ID NO: 226916 - RNA, 32 nt, Human
ucaaagcucacugcagccuugaacuccuaggc

SEQ ID NO: 226917 - RNA, 32 nt, Human
ucaaagcucacugcagccuugaauuccugggc

SEQ ID NO: 226918 - RNA, 32 nt, Human
ucaaagcucagagacugguuugaaugguuuaa

SEQ ID NO: 226919 - RNA, 32 nt, Human
ucaaagcuccacccaccucaucccagguacau

SEQ ID NO: 226920 - RNA, 32 nt, Human
ucaaagcuccauauucucuuguccucaaucau

SEQ ID NO: 226921 - RNA, 32 nt, Human
ucaaagcucuagacuuccauggcucuacauac

SEQ ID NO: 226922 - RNA, 18 nt, Human
ucaaagcucucucccaau

SEQ ID NO: 226923 - RNA, 32 nt, Human
ucaaagcugcaaucugcccacucucagguacu

SEQ ID NO: 226924 - RNA, 21 nt, Human
ucaaagcugcacugcaaaggg

SEQ ID NO: 226925 - RNA, 32 nt, Human
ucaaagcugcuugcuguaacugugugagauug

SEQ ID NO: 226926 - RNA, 32 nt, Human
ucaaagcuggacugaguugguccuguucuggc

SEQ ID NO: 226927 - RNA, 20 nt, Human
ucaaagcuguauuuccaaga

SEQ ID NO: 226928 - RNA, 30 nt, Human
ucaaagcuucugcagauagaaagaccagca

SEQ ID NO: 226929 - RNA, 32 nt, Human
ucaaagcuuguuuuauuucaccacuguaggaa

SEQ ID NO: 226930 - RNA, 21 nt, Human
ucaaagcuuucuccuccaaga

SEQ ID NO: 226931 - RNA, 32 nt, Human
ucaaaggaaaguuuuuaaaauguuuuuaaaac

SEQ ID NO: 226932 - RNA, 32 nt, Human
ucaaaggaagcaggggauucagugagugugaa

SEQ ID NO: 226933 - RNA, 32 nt, Human
ucaaaggaaugagaaaagacaaguuaagaaug

SEQ ID NO: 226934 - RNA, 32 nt, Human
ucaaaggaaugaguaaagcagaaaaacuuuua

SEQ ID NO: 226935 - RNA, 32 nt, Human
ucaaaggaauguaccagccacugugaaccaaa

SEQ ID NO: 226936 - RNA, 32 nt, Human
ucaaaggacacgagagaaaggaaggggaagaa

SEQ ID NO: 226937 - RNA, 32 nt, Human
ucaaaggacaggcgaggagcugugggcgcagg

SEQ ID NO: 226938 - RNA, 32 nt, Human
ucaaaggaccccacagcaccugggccagacca

SEQ ID NO: 226939 - RNA, 32 nt, Human
ucaaaggaccuucuggcagacacuucaucaaa

SEQ ID NO: 226940 - RNA, 32 nt, Human
ucaaaggagguggguuacauggguaaugcauu

SEQ ID NO: 226941 - RNA, 32 nt, Human
ucaaaggagucaggaauuauuuauguagaaac

SEQ ID NO: 226942 - RNA, 32 nt, Human
ucaaaggauaaaccuuggacagcagggcugcc

SEQ ID NO: 226943 - RNA, 32 nt, Human
ucaaaggcaaagaaagcacauuguuuuccuuc

SEQ ID NO: 226944 - RNA, 32 nt, Human
ucaaaggcaaaggacacuccuuucuaauugca

SEQ ID NO: 226945 - RNA, 32 nt, Human
ucaaaggcaaccugcuccacagagccagcccc

SEQ ID NO: 226946 - RNA, 32 nt, Human
ucaaaggcagaggggcuuccaggcccuggaug

SEQ ID NO: 226947 - RNA, 32 nt, Human
ucaaaggcauccugcaaccaccccauccaucc

SEQ ID NO: 226948 - RNA, 32 nt, Human
ucaaaggcccccuuucuauguucauguuaguu

SEQ ID NO: 226949 - RNA, 32 nt, Human
ucaaaggccguguucaccuccacgcagaagcc

SEQ ID NO: 226950 - RNA, 32 nt, Human
ucaaaggccuucaggaccccagccucuuucca

SEQ ID NO: 226951 - RNA, 32 nt, Human
ucaaaggcugggagauucuaagaggcuguugc

SEQ ID NO: 226952 - RNA, 32 nt, Human
ucaaaggcugguaccaggaagccagacgguca

SEQ ID NO: 226953 - RNA, 32 nt, Human
ucaaagggaccugggaacgacacuccucugca

SEQ ID NO: 226954 - RNA, 32 nt, Human
ucaaagggagccaccaguaccaaacccaauac

SEQ ID NO: 226955 - RNA, 32 nt, Human
ucaaagggaggcugaagagauuucaaagaauu

SEQ ID NO: 226956 - RNA, 32 nt, Human
ucaaagggcugauacugucaccacugggacca

SEQ ID NO: 226957 - RNA, 32 nt, Human
ucaaagggcuggccugcuucucagccuacauu

SEQ ID NO: 226958 - RNA, 31 nt, Human
ucaaaggggaaacugacaucaaaugugcugu

SEQ ID NO: 226959 - RNA, 31 nt, Human
ucaaaggguaaagaaagaugggaggaaaacu

SEQ ID NO: 226960 - RNA, 32 nt, Human
ucaaagguauuuuuauaguucaaaucgcuuca

SEQ ID NO: 226961 - RNA, 24 nt, Human
ucaaaggucaucaagcaguguuca

SEQ ID NO: 226962 - RNA, 32 nt, Human
ucaaaggugacucuccugcucuucuggacucu

SEQ ID NO: 226963 - RNA, 32 nt, Human
ucaaagguuuuuaugcacuggcuauuuguguu

SEQ ID NO: 226964 - RNA, 32 nt, Human
ucaaaguaaacauaagggaaaauaucagcucu

SEQ ID NO: 226965 - RNA, 24 nt, Human
ucaaaguaccaggauuauaggcau

SEQ ID NO: 226966 - RNA, 24 nt, Human
ucaaaguauugagauuacaggcau

SEQ ID NO: 226967 - RNA, 32 nt, Human
ucaaagucacucaacagaaagagaccaagagc

SEQ ID NO: 226968 - RNA, 19 nt, Human
ucaaagucauauuuugccu

SEQ ID NO: 226969 - RNA, 20 nt, Human
ucaaagucuccuacccuucu

SEQ ID NO: 226970 - RNA, 32 nt, Human
ucaaagucucugcucucucuuccuaugaucac

SEQ ID NO: 226971 - RNA, 21 nt, Human
ucaaagugacaagcucauuca

SEQ ID NO: 226972 - RNA, 32 nt, Human
ucaaagugagggcugaggagggugcuagcacc

SEQ ID NO: 226973 - RNA, 24 nt, Human
ucaaagugaguagcaacauauuca

SEQ ID NO: 226974 - RNA, 32 nt, Human
ucaaagugccagagaauuagauccuguccucu

SEQ ID NO: 226975 - RNA, 24 nt, Human
ucaaagugcugggauuacagacau

SEQ ID NO: 226976 - RNA, 24 nt, Human
ucaaagugcugggauuacaggcau

SEQ ID NO: 226977 - RNA, 24 nt, Human
ucaaagugcugggauuacaggcgu

SEQ ID NO: 226978 - RNA, 24 nt, Human
ucaaagugcugggauuacagguau

SEQ ID NO: 226979 - RNA, 21 nt, Human
ucaaagugguauuacagacau

SEQ ID NO: 226980 - RNA, 24 nt, Human
ucaaagugguauuacagacauuca

SEQ ID NO: 226981 - RNA, 24 nt, Human
ucaaaguguugagaucacaggcgu

SEQ ID NO: 226982 - RNA, 24 nt, Human
ucaaaguguugagauuacaggcgu

SEQ ID NO: 226983 - RNA, 24 nt, Human
ucaaaguguuggaguuacaagcau

SEQ ID NO: 226984 - RNA, 24 nt, Human
ucaaaguguuggaguuacaggcau

SEQ ID NO: 226985 - RNA, 24 nt, Human
ucaaaguguugggauaacaggcau

SEQ ID NO: 226986 - RNA, 22 nt, Human
ucaaaguguugggauuacaggc

SEQ ID NO: 226987 - RNA, 23 nt, Human
ucaaaguucaacuuccccuccca

SEQ ID NO: 226988 - RNA, 32 nt, Human
ucaaaguucccgaggagagauggaugccgcgu

SEQ ID NO: 226989 - RNA, 24 nt, Human
ucaaaguucuaaaagcagaacuca

SEQ ID NO: 226990 - RNA, 24 nt, Human
ucaaaguucugggacuacaggcau

SEQ ID NO: 226991 - RNA, 32 nt, Human
ucaaaguugcuucccagaacaggaagcaaaac

SEQ ID NO: 226992 - RNA, 32 nt, Human
ucaaaguugguggaacucuggagagguaaaga

SEQ ID NO: 226993 - RNA, 32 nt, Human
ucaaauaagaggagagaaaagaacucaagggg

SEQ ID NO: 226994 - RNA, 32 nt, Human
ucaaauacaaauucugguaaacuguuagguuu

SEQ ID NO: 226995 - RNA, 32 nt, Human
ucaaauacaacaaaauucccuuuaugaacuuu

SEQ ID NO: 226996 - RNA, 32 nt, Human
ucaaauacacagauauuggggcaaauauucug

SEQ ID NO: 226997 - RNA, 32 nt, Human
ucaaauacauagucuucaggcuguccauuggu

SEQ ID NO: 226998 - RNA, 32 nt, Human
ucaaauacuaccuuuucuagggaaaauuaggc

SEQ ID NO: 226999 - RNA, 32 nt, Human
ucaaauacuuguugaauaaauacaugaaugug

SEQ ID NO: 227000 - RNA, 32 nt, Human
ucaaauacuuuuuauuagacacggccaggcag

SEQ ID NO: 227001 - RNA, 32 nt, Human
ucaaauagacacacggccccagccaccugcaa

SEQ ID NO: 227002 - RNA, 32 nt, Human
ucaaauagaugccgccccugcccgcgcuuugc

SEQ ID NO: 227003 - RNA, 32 nt, Human
ucaaauagcacacaggaaucaaacuuugguaa

SEQ ID NO: 227004 - RNA, 23 nt, Human
ucaaauagcugggacuacaggca

SEQ ID NO: 227005 - RNA, 32 nt, Human
ucaaauagcugguuccucuguaucauucauaa

SEQ ID NO: 227006 - RNA, 32 nt, Human
ucaaauaguugaauagauucaccagaauaauu

SEQ ID NO: 227007 - RNA, 21 nt, Human
ucaaauauaaaugguuucccu

SEQ ID NO: 227008 - RNA, 23 nt, Human
ucaaauauguaagaauacaggca

SEQ ID NO: 227009 - RNA, 32 nt, Human
ucaaauauguaugcucucacuccaaguucaga

SEQ ID NO: 227010 - RNA, 32 nt, Human
ucaaaucaacaucuuucuggauaaaucuauuu

SEQ ID NO: 227011 - RNA, 32 nt, Human
ucaaaucaccacccacuguucucccccuuugg

SEQ ID NO: 227012 - RNA, 32 nt, Human
ucaaaucacugcagucaugaaauacugaacaa

SEQ ID NO: 227013 - RNA, 32 nt, Human
ucaaaucagacuccucucaucccagaugaccc

SEQ ID NO: 227014 - RNA, 32 nt, Human
ucaaaucaguaguuugggcagugccuuuuggg

SEQ ID NO: 227015 - RNA, 18 nt, Human
ucaaaucagucaguucuu

SEQ ID NO: 227016 - RNA, 32 nt, Human
ucaaaucaguucagugaaaauaguacagauuu

SEQ ID NO: 227017 - RNA, 20 nt, Human
ucaaauccaggccaagugau

SEQ ID NO: 227018 - RNA, 32 nt, Human
ucaaaucccaccacggugucuccucccaccuc

SEQ ID NO: 227019 - RNA, 32 nt, Human
ucaaauccuacaguauggaggguggcguugca

SEQ ID NO: 227020 - RNA, 32 nt, Human
ucaaauccugcacucaggccugguggugaaga

SEQ ID NO: 227021 - RNA, 32 nt, Human
ucaaauccuuguuuuugcacuuauugucugga

SEQ ID NO: 227022 - RNA, 32 nt, Human
ucaaaucucaacuugaauucucccagaauucc

SEQ ID NO: 227023 - RNA, 32 nt, Human
ucaaaucucuccuccucccccucucuccuucc

SEQ ID NO: 227024 - RNA, 32 nt, Human
ucaaaucugcuccaaucauccacuucucucuu

SEQ ID NO: 227025 - RNA, 32 nt, Human
ucaaaugacccaccuaccucagccucucaaag

SEQ ID NO: 227026 - RNA, 32 nt, Human
ucaaaugacugcagcauuuugagugaaaccaa

SEQ ID NO: 227027 - RNA, 20 nt, Human
ucaaaugagagcaaacuuua

SEQ ID NO: 227028 - RNA, 32 nt, Human
ucaaaugaucugcccaccucuaccuccaaagu

SEQ ID NO: 227029 - RNA, 32 nt, Human
ucaaaugaugcaugugaggucaggauucauug

SEQ ID NO: 227030 - RNA, 20 nt, Human
ucaaaugaugcucuucuucc

SEQ ID NO: 227031 - RNA, 22 nt, Human
ucaaaugaugcucuucuuccca

SEQ ID NO: 227032 - RNA, 32 nt, Human
ucaaaugcaaccugggccgggccgugcagcuc

SEQ ID NO: 227033 - RNA, 32 nt, Human
ucaaaugcagcacugcaccacccugcaacacc

SEQ ID NO: 227034 - RNA, 32 nt, Human
ucaaaugcaugcugggacucacccugaagaga

SEQ ID NO: 227035 - RNA, 32 nt, Human
ucaaaugccaugacauuggaaaaaggucauca

SEQ ID NO: 227036 - RNA, 32 nt, Human
ucaaaugccaugacauuggaagaaggugguca

SEQ ID NO: 227037 - RNA, 32 nt, Human
ucaaaugccuccaucuccauaccauuucaguu

SEQ ID NO: 227038 - RNA, 32 nt, Human
ucaaaugccuguaaucccaguacuuugggagg

SEQ ID NO: 227039 - RNA, 32 nt, Human
ucaaaugcuaaccaccucuucccgucccugcc

SEQ ID NO: 227040 - RNA, 32 nt, Human
ucaaaugcuacuguucagcaggugccugacac

SEQ ID NO: 227041 - RNA, 32 nt, Human
ucaaauggaagacacauugaaaguguuuuucc

SEQ ID NO: 227042 - RNA, 32 nt, Human
ucaaauggagaaacaggcccagagaggaaggu

SEQ ID NO: 227043 - RNA, 32 nt, Human
ucaaauggauuguucuauuccauucuggucuc

SEQ ID NO: 227044 - RNA, 21 nt, Human
ucaaauggccacauguccacu

SEQ ID NO: 227045 - RNA, 32 nt, Human
ucaaauggcugcagauugguacaugagaccuc

SEQ ID NO: 227046 - RNA, 32 nt, Human
ucaaauggcugcauacuuauaccuggaugggu

SEQ ID NO: 227047 - RNA, 22 nt, Human
ucaaaugggggaccuguccauu

SEQ ID NO: 227048 - RNA, 32 nt, Human
ucaaaugggggaccuguccauugugcucuauu

SEQ ID NO: 227049 - RNA, 32 nt, Human
ucaaaugggguuuucuguguuauuucauaaaa

SEQ ID NO: 227050 - RNA, 29 nt, Human
ucaaauggugccucaaauugagggaaaca

SEQ ID NO: 227051 - RNA, 32 nt, Human
ucaaauguuagaagaauccuguguucaguuau

SEQ ID NO: 227052 - RNA, 32 nt, Human
ucaaauguuugcugaauugaaaaagaauauuc

SEQ ID NO: 227053 - RNA, 32 nt, Human
ucaaauuaaaaaggaaaagauuuguuuggaag

SEQ ID NO: 227054 - RNA, 32 nt, Human
ucaaauuaaggaagcucugaaugugauuugug

SEQ ID NO: 227055 - RNA, 32 nt, Human
ucaaauuacaauaaacauacuaagacaauggg

SEQ ID NO: 227056 - RNA, 32 nt, Human
ucaaauuacaauggugggaacaggcauaggau

SEQ ID NO: 227057 - RNA, 32 nt, Human
ucaaauuagauguuucaacugugcuccuguuu

SEQ ID NO: 227058 - RNA, 32 nt, Human
ucaaauuagauucccuaggagguauaauauau

SEQ ID NO: 227059 - RNA, 32 nt, Human
ucaaauuagguuuggagggaaacuugaucuuc

SEQ ID NO: 227060 - RNA, 32 nt, Human
ucaaauuaucucacauuauguguucaacauuu

SEQ ID NO: 227061 - RNA, 32 nt, Human
ucaaauucaaugcuucuaucagacucaguuuu

SEQ ID NO: 227062 - RNA, 32 nt, Human
ucaaauucagcccuagaggggccugucucugc

SEQ ID NO: 227063 - RNA, 32 nt, Human
ucaaauuccgagugcagaaaagaaaccggacc

SEQ ID NO: 227064 - RNA, 32 nt, Human
ucaaauuccuacaguuucuggcuggcuucauu

SEQ ID NO: 227065 - RNA, 23 nt, Human
ucaaauuccugagcuaaagcgau

SEQ ID NO: 227066 - RNA, 32 nt, Human
ucaaauuccugccuuuccucaagagaagagcc

SEQ ID NO: 227067 - RNA, 23 nt, Human
ucaaauuccuggccucaagcgau

SEQ ID NO: 227068 - RNA, 19 nt, Human
ucaaauuccugggcucaag

SEQ ID NO: 227069 - RNA, 23 nt, Human
ucaaauuccugggcucaagggau

SEQ ID NO: 227070 - RNA, 24 nt, Human
ucaaauuccugggcucaagugauu

SEQ ID NO: 227071 - RNA, 32 nt, Human
ucaaauuccuuucucauuggagccuagugaaa

SEQ ID NO: 227072 - RNA, 32 nt, Human
ucaaauucuaaggagcuugaucaggagggcug

SEQ ID NO: 227073 - RNA, 32 nt, Human
ucaaauucuaguuucaaguaucucacuguacc

SEQ ID NO: 227074 - RNA, 32 nt, Human
ucaaauucucauaggggcucaugacccacaau

SEQ ID NO: 227075 - RNA, 21 nt, Human
ucaaauucucgggcucaagug

SEQ ID NO: 227076 - RNA, 23 nt, Human
ucaaauucucgggcucaaguggu

SEQ ID NO: 227077 - RNA, 32 nt, Human
ucaaauucugccacuccagcuccuggguuagg

SEQ ID NO: 227078 - RNA, 23 nt, Human
ucaaauucuugaucucaagugau

SEQ ID NO: 227079 - RNA, 32 nt, Human
ucaaauugaccugucaaugucaaccuaguagu

SEQ ID NO: 227080 - RNA, 32 nt, Human
ucaaauugagauuguugccacugugguuugcc

SEQ ID NO: 227081 - RNA, 32 nt, Human
ucaaauugcuagaaaauucacagggaagaaaa

SEQ ID NO: 227082 - RNA, 32 nt, Human
ucaaauugcucacacaauuuuaauugcaauag

SEQ ID NO: 227083 - RNA, 32 nt, Human
ucaaauugcucccccuccccaggaugacacac

SEQ ID NO: 227084 - RNA, 32 nt, Human
ucaaauuucucuuccauugagcuuccugccug

SEQ ID NO: 227085 - RNA, 32 nt, Human
ucaaauuuugcagagcucugcuaucacugaau

SEQ ID NO: 227086 - RNA, 32 nt, Human
ucaacaaaaagaaaaauccagagcagccuuuc

SEQ ID NO: 227087 - RNA, 32 nt, Human
ucaacaaaaaggaguuuaucaggccggguggc

SEQ ID NO: 227088 - RNA, 32 nt, Human
ucaacaaaagaauguccaugguggugucuggc

SEQ ID NO: 227089 - RNA, 32 nt, Human
ucaacaaaaucggcaaggucucagggaccuug

SEQ ID NO: 227090 - RNA, 21 nt, Human
ucaacaaacgaggggcugcuu

SEQ ID NO: 227091 - RNA, 32 nt, Human
ucaacaaagcagggugggguaggugacauuug

SEQ ID NO: 227092 - RNA, 32 nt, Human
ucaacaaauguuacgagaucugaugagugaug

SEQ ID NO: 227093 - RNA, 32 nt, Human
ucaacaacaagagauugaaauaagcuaugggu

SEQ ID NO: 227094 - RNA, 32 nt, Human
ucaacaacacagagugcuggaagccuguggca

SEQ ID NO: 227095 - RNA, 32 nt, Human
ucaacaacacuccaccaugucugagaaugugu

SEQ ID NO: 227096 - RNA, 32 nt, Human
ucaacaacccuuuaaugagccuguaaggacca

SEQ ID NO: 227097 - RNA, 32 nt, Human
ucaacaacuucuuccucugcuuuuucaccugu

SEQ ID NO: 227098 - RNA, 32 nt, Human
ucaacaagacucaggaaacucugugaaaagag

SEQ ID NO: 227099 - RNA, 32 nt, Human
ucaacaagaggauuuuaacagcaaagaagaga

SEQ ID NO: 227100 - RNA, 32 nt, Human
ucaacaagaguugucuuguccccucuugaccc

SEQ ID NO: 227101 - RNA, 32 nt, Human
ucaacaagauuucagaaagguauaaucaugua

SEQ ID NO: 227102 - RNA, 17 nt, Human
ucaacaagcaccucuuu

SEQ ID NO: 227103 - RNA, 32 nt, Human
ucaacaagcggcucucaaaguccucugccacg

SEQ ID NO: 227104 - RNA, 32 nt, Human
ucaacaaggaaaagcaguuggaggucucuucc

SEQ ID NO: 227105 - RNA, 32 nt, Human
ucaacaaggagcuggcccugcacauccauaca

SEQ ID NO: 227106 - RNA, 32 nt, Human
ucaacaauacccucugccugaccaacauggug

SEQ ID NO: 227107 - RNA, 32 nt, Human
ucaacaaugccagaugaauggaagagggaaca

SEQ ID NO: 227108 - RNA, 32 nt, Human
ucaacacaacuugcuucucuccagacuugggc

SEQ ID NO: 227109 - RNA, 32 nt, Human
ucaacacacaacagcagauggcaccaacggga

SEQ ID NO: 227110 - RNA, 32 nt, Human
ucaacacacauccccacccuguguacacacaa

SEQ ID NO: 227111 - RNA, 32 nt, Human
ucaacacagcuggcuggaugauugggacuuua

SEQ ID NO: 227112 - RNA, 32 nt, Human
ucaacacauggaacggaccacacccucucucc

SEQ ID NO: 227113 - RNA, 32 nt, Human
ucaacaccaacagcucugaccugggcagccuu

SEQ ID NO: 227114 - RNA, 32 nt, Human
ucaacaccacccugcuguccaguccccagccu

SEQ ID NO: 227115 - RNA, 32 nt, Human
ucaacaccacuuugcagcauucagcugcugag

SEQ ID NO: 227116 - RNA, 32 nt, Human
ucaacaccagccugagcaacaugguaaaaccc

SEQ ID NO: 227117 - RNA, 32 nt, Human
ucaacaccagccuggccaacauagugaaaccc

SEQ ID NO: 227118 - RNA, 32 nt, Human
ucaacaccagccuggccaacauggaaaaaccc

SEQ ID NO: 227119 - RNA, 32 nt, Human
ucaacaccagccuggccaacauggugaaaccc

SEQ ID NO: 227120 - RNA, 32 nt, Human
ucaacaccagccugggccauauugugagaaca

SEQ ID NO: 227121 - RNA, 18 nt, Human
ucaacaccauccaucccu

SEQ ID NO: 227122 - RNA, 32 nt, Human
ucaacaccucccaguaccuggcuggagguggc

SEQ ID NO: 227123 - RNA, 32 nt, Human
ucaacaccuuccuuaagucuuugcugucauaa

SEQ ID NO: 227124 - RNA, 32 nt, Human
ucaacacgaaggcagaaguuggagugaugagu

SEQ ID NO: 227125 - RNA, 32 nt, Human
ucaacacuacacuugcacaaugucuuugaaac

SEQ ID NO: 227126 - RNA, 31 nt, Human
ucaacacuacuuuucugauaugagggcagca

SEQ ID NO: 227127 - RNA, 32 nt, Human
ucaacacucccagcccuugcugggggcuccuu

SEQ ID NO: 227128 - RNA, 32 nt, Human
ucaacacucuucuugagcagaccgugauuugg

SEQ ID NO: 227129 - RNA, 32 nt, Human
ucaacacugagccuccacaggcuccauuccaa

SEQ ID NO: 227130 - RNA, 32 nt, Human
ucaacacugcacuccagccugggcgacagagu

SEQ ID NO: 227131 - RNA, 32 nt, Human
ucaacacugcagcauuuugcugcuuuaucaaa

SEQ ID NO: 227132 - RNA, 32 nt, Human
ucaacacuuuggccaggcagccugcugagcaa

SEQ ID NO: 227133 - RNA, 32 nt, Human
ucaacagaaagccacugacggcuuucuucaag

SEQ ID NO: 227134 - RNA, 32 nt, Human
ucaacagaaauuacauuuauaaugcuuuuguu

SEQ ID NO: 227135 - RNA, 32 nt, Human
ucaacagaaguugacugcauccuuuucugucc

SEQ ID NO: 227136 - RNA, 32 nt, Human
ucaacagaaguuguucuucuuccuucgaagag

SEQ ID NO: 227137 - RNA, 18 nt, Human
ucaacagagaacucuguc

SEQ ID NO: 227138 - RNA, 32 nt, Human
ucaacagagacugaagugggcuuuuguguuau

SEQ ID NO: 227139 - RNA, 32 nt, Human
ucaacagagagggagaaaggaggagacagagg

SEQ ID NO: 227140 - RNA, 32 nt, Human
ucaacagaggccacgagauguguuacaggcag

SEQ ID NO: 227141 - RNA, 21 nt, Human
ucaacagagugagacucuguc

SEQ ID NO: 227142 - RNA, 32 nt, Human
ucaacagcaaaugccagcaauucuuucuccga

SEQ ID NO: 227143 - RNA, 32 nt, Human
ucaacagccacuuugaggagugaccagccugc

SEQ ID NO: 227144 - RNA, 22 nt, Human
ucaacagccauucagaagaaug

SEQ ID NO: 227145 - RNA, 32 nt, Human
ucaacagcccgccagcugauuggaugucuagg

SEQ ID NO: 227146 - RNA, 32 nt, Human
ucaacagcccugcuagauuuuguaugaugcug

SEQ ID NO: 227147 - RNA, 32 nt, Human
ucaacagcccuugucugugaccugcuucagcc

SEQ ID NO: 227148 - RNA, 32 nt, Human
ucaacagccgccagaaguacacgaggaaccgg

SEQ ID NO: 227149 - RNA, 32 nt, Human
ucaacagccugacagaagguucagucuaugga

SEQ ID NO: 227150 - RNA, 32 nt, Human
ucaacagcuagacacagaugcucacagccgac

SEQ ID NO: 227151 - RNA, 21 nt, Human
ucaacaggauggagcucuuca

SEQ ID NO: 227152 - RNA, 32 nt, Human
ucaacaggauguguaacaguuuuccuucacca

SEQ ID NO: 227153 - RNA, 32 nt, Human
ucaacaggcuacaccugaaccccagguuuggg

SEQ ID NO: 227154 - RNA, 19 nt, Human
ucaacagggaaauucuuca

SEQ ID NO: 227155 - RNA, 32 nt, Human
ucaacagggaggaugucuguugcucagagagg

SEQ ID NO: 227156 - RNA, 32 nt, Human
ucaacagggaugacucagcagacucagcaggg

SEQ ID NO: 227157 - RNA, 23 nt, Human
ucaacagggcaguucugcugcuc

SEQ ID NO: 227158 - RNA, 32 nt, Human
ucaacaggggcgugaggucccaggaaguggcc

SEQ ID NO: 227159 - RNA, 16 nt, Human
ucaacagggucuucug

SEQ ID NO: 227160 - RNA, 21 nt, Human
ucaacaggugacaggcugcuu

SEQ ID NO: 227161 - RNA, 32 nt, Human
ucaacagguggaagaagaucaugagagaugaa

SEQ ID NO: 227162 - RNA, 32 nt, Human
ucaacaggugucagcugucacccaggaccuag

SEQ ID NO: 227163 - RNA, 32 nt, Human
ucaacagguucaaauauucaagaagguagaac

SEQ ID NO: 227164 - RNA, 32 nt, Human
ucaacagguuuuagaggcaugccaccauuuuu

SEQ ID NO: 227165 - RNA, 32 nt, Human
ucaacaguaauguuugagaauuacuggguuaa

SEQ ID NO: 227166 - RNA, 32 nt, Human
ucaacaguagcucuagaggagugcugucccau

SEQ ID NO: 227167 - RNA, 32 nt, Human
ucaacagucaaagucccugaagagcucacugc

SEQ ID NO: 227168 - RNA, 32 nt, Human
ucaacagucaggaaagcuaaacuggucaguau

SEQ ID NO: 227169 - RNA, 32 nt, Human
ucaacagugcacugcacguugaggacaaggcc

SEQ ID NO: 227170 - RNA, 32 nt, Human
ucaacagugcuuugggaagcuguguggauucc

SEQ ID NO: 227171 - RNA, 32 nt, Human
ucaacaguggugcuguggaaugcccagcuagu

SEQ ID NO: 227172 - RNA, 32 nt, Human
ucaacagugugaagcuggaucguccacaacag

SEQ ID NO: 227173 - RNA, 18 nt, Human
ucaacaguuaaaaucuaa

SEQ ID NO: 227174 - RNA, 32 nt, Human
ucaacaguucccuccccuccacuaccccauuu

SEQ ID NO: 227175 - RNA, 32 nt, Human
ucaacaguuucucaaguuuaaagucaugucag

SEQ ID NO: 227176 - RNA, 32 nt, Human
ucaacauagggugaaacuauuucugauaaaga

SEQ ID NO: 227177 - RNA, 32 nt, Human
ucaacaucaaagaauucauacuggagaaaaac

SEQ ID NO: 227178 - RNA, 32 nt, Human
ucaacaucaaagaauucauacuggugagaaac

SEQ ID NO: 227179 - RNA, 32 nt, Human
ucaacaucacacucaggagaagaaggagauug

SEQ ID NO: 227180 - RNA, 32 nt, Human
ucaacaucagccuggccaacaugaugaaaccu

SEQ ID NO: 227181 - RNA, 28 nt, Human
ucaacaucguauugaaguuuguuauuua

SEQ ID NO: 227182 - RNA, 32 nt, Human
ucaacaucugcucuuuggccucuugggaguug

SEQ ID NO: 227183 - RNA, 32 nt, Human
ucaacaucuguauacccccuucccagggguaa

SEQ ID NO: 227184 - RNA, 32 nt, Human
ucaacaugacuaauuaacacugaaaagucagu

SEQ ID NO: 227185 - RNA, 32 nt, Human
ucaacaugagauuugggcagggagacagaucc

SEQ ID NO: 227186 - RNA, 32 nt, Human
ucaacaugagggcaacuuacuucaagaucucu

SEQ ID NO: 227187 - RNA, 32 nt, Human
ucaacaugccugguuuaggcagcagcuugggc

SEQ ID NO: 227188 - RNA, 32 nt, Human
ucaacaugcuggggcaggauggacaugguaga

SEQ ID NO: 227189 - RNA, 32 nt, Human
ucaacauggaaaugauccucauugauuaauac

SEQ ID NO: 227190 - RNA, 32 nt, Human
ucaacauggaagaauuccaaaauguaugacua

SEQ ID NO: 227191 - RNA, 20 nt, Human
ucaacauggagaaaccccgu

SEQ ID NO: 227192 - RNA, 32 nt, Human
ucaacauguugaccaggauggucucgaucucu

SEQ ID NO: 227193 - RNA, 32 nt, Human
ucaacauguuggccaggauggucucaaucucu

SEQ ID NO: 227194 - RNA, 22 nt, Human
ucaacauguuuaagaaagauag

SEQ ID NO: 227195 - RNA, 32 nt, Human
ucaacauuaagcugcaacauccuaaccaccau

SEQ ID NO: 227196 - RNA, 18 nt, Human
ucaacauuagaauuuuga

SEQ ID NO: 227197 - RNA, 32 nt, Human
ucaacauuauuauuaguggauuucuuaauagg

SEQ ID NO: 227198 - RNA, 32 nt, Human
ucaacauuauuuucucuucuuccucagcuucu

SEQ ID NO: 227199 - RNA, 32 nt, Human
ucaacauuccuuuuguuggugacauuugugau

SEQ ID NO: 227200 - RNA, 32 nt, Human
ucaacauugaagguggagguggaagaugcagu

SEQ ID NO: 227201 - RNA, 23 nt, Human
ucaacauugugauauaugcuacu

SEQ ID NO: 227202 - RNA, 32 nt, Human
ucaacauuguggcucagcucucuucaacagcu

SEQ ID NO: 227203 - RNA, 32 nt, Human
ucaacauuuugaccaacagcaggaaugcucgg

SEQ ID NO: 227204 - RNA, 32 nt, Human
ucaaccaacccagcaacaacaaaacaggucua

SEQ ID NO: 227205 - RNA, 23 nt, Human
ucaaccaacugaaaccugacuuu

SEQ ID NO: 227206 - RNA, 32 nt, Human
ucaaccaaggagccugagcccaggaaggggcu

SEQ ID NO: 227207 - RNA, 32 nt, Human
ucaaccacaaaauagucuucucagaugaccuu

SEQ ID NO: 227208 - RNA, 32 nt, Human
ucaaccacagaagucugauauuguaguauuag

SEQ ID NO: 227209 - RNA, 32 nt, Human
ucaaccaccuuuccucagcuuucuuaaaaugg

SEQ ID NO: 227210 - RNA, 32 nt, Human
ucaaccacgcaaaacaugaauauaaagcucuu

SEQ ID NO: 227211 - RNA, 32 nt, Human
ucaaccacugaacugccuucuuccauuguccu

SEQ ID NO: 227212 - RNA, 32 nt, Human
ucaaccacugcacuccacuaagcaacuggcac

SEQ ID NO: 227213 - RNA, 32 nt, Human
ucaaccagagucccacaguuugagccucacug

SEQ ID NO: 227214 - RNA, 32 nt, Human
ucaaccagauuggagugcaguggugcaaucuc

SEQ ID NO: 227215 - RNA, 32 nt, Human
ucaaccagccuggacaacaaagcaagacccca

SEQ ID NO: 227216 - RNA, 32 nt, Human
ucaaccagcgguuucccagcaggacaacuguc

SEQ ID NO: 227217 - RNA, 32 nt, Human
ucaaccagcuacucaggaggcugggcaggaga

SEQ ID NO: 227218 - RNA, 32 nt, Human
ucaaccagcuguagaugggcuuguuccgaguu

SEQ ID NO: 227219 - RNA, 32 nt, Human
ucaaccaggaaggcacaccacuguauuaguuu

SEQ ID NO: 227220 - RNA, 32 nt, Human
ucaaccaggagacugugggaggaugugagcuc

SEQ ID NO: 227221 - RNA, 32 nt, Human
ucaaccaggcuggagugcacuggcgcaaucuc

SEQ ID NO: 227222 - RNA, 32 nt, Human
ucaaccagggaggcagagguugcagugagccg

SEQ ID NO: 227223 - RNA, 32 nt, Human
ucaaccaucucucagcaguuauugaucauuuc

SEQ ID NO: 227224 - RNA, 19 nt, Human
ucaaccauggccugggcau

SEQ ID NO: 227225 - RNA, 32 nt, Human
ucaaccauuaguuauuguuaaaggaguaauuu

SEQ ID NO: 227226 - RNA, 32 nt, Human
ucaaccauucacugcaaugccuauuccaaacu

SEQ ID NO: 227227 - RNA, 31 nt, Human
ucaacccaaauguccaucagugacagacugg

SEQ ID NO: 227228 - RNA, 19 nt, Human
ucaacccaaccuccucuca

SEQ ID NO: 227229 - RNA, 32 nt, Human
ucaacccaacuccggugagcgaagagcgguca

SEQ ID NO: 227230 - RNA, 31 nt, Human
ucaacccaagaaccuguuuccuggaccagug

SEQ ID NO: 227231 - RNA, 21 nt, Human
ucaacccaagggaccccuccc

SEQ ID NO: 227232 - RNA, 32 nt, Human
ucaacccacugccucuguucauccaagacuuc

SEQ ID NO: 227233 - RNA, 32 nt, Human
ucaacccacugcuggccagcuucuucagcaag

SEQ ID NO: 227234 - RNA, 32 nt, Human
ucaacccagcagcaauuugaggggaugagggg

SEQ ID NO: 227235 - RNA, 32 nt, Human
ucaacccaggaggcagacguugcagcgagcca

SEQ ID NO: 227236 - RNA, 32 nt, Human
ucaacccaggaggcagaggcuacagugagcug

SEQ ID NO: 227237 - RNA, 32 nt, Human
ucaaccccaccaugacaugaaggaggccaccg

SEQ ID NO: 227238 - RNA, 32 nt, Human
ucaaccccacgccuuuuaggaaaaagaaaagu

SEQ ID NO: 227239 - RNA, 20 nt, Human
ucaaccccaggccaccccca

SEQ ID NO: 227240 - RNA, 32 nt, Human
ucaacccccuccauuuucuccacaaaggcccu

SEQ ID NO: 227241 - RNA, 32 nt, Human
ucaaccccucacugcacucugcucaucacggg

SEQ ID NO: 227242 - RNA, 32 nt, Human
ucaaccccuccccuccaucccuggcccccucc

SEQ ID NO: 227243 - RNA, 20 nt, Human
ucaaccccucuccucuccca

SEQ ID NO: 227244 - RNA, 20 nt, Human
ucaaccccuggcccccuccc

SEQ ID NO: 227245 - RNA, 32 nt, Human
ucaaccccuuucucccacccagccccaacccc

SEQ ID NO: 227246 - RNA, 32 nt, Human
ucaacccggaugggugacaggcuggauggccu

SEQ ID NO: 227247 - RNA, 32 nt, Human
ucaacccgggaggcggagcuugcagugagccg

SEQ ID NO: 227248 - RNA, 32 nt, Human
ucaacccgggaggcugagguugcagugagugg

SEQ ID NO: 227249 - RNA, 32 nt, Human
ucaacccucacacuccugcucacuagccccca

SEQ ID NO: 227250 - RNA, 21 nt, Human
ucaacccucacccuccuccca

SEQ ID NO: 227251 - RNA, 32 nt, Human
ucaacccucugccucccuacucaaccugagac

SEQ ID NO: 227252 - RNA, 20 nt, Human
ucaacccugaaccccuccca

SEQ ID NO: 227253 - RNA, 32 nt, Human
ucaacccugcacccacccuccuccagggauca

SEQ ID NO: 227254 - RNA, 32 nt, Human
ucaacccuguaauuccagcacuuugggagggu

SEQ ID NO: 227255 - RNA, 32 nt, Human
ucaacccuucagacucccuccuggcagcugua

SEQ ID NO: 227256 - RNA, 32 nt, Human
ucaaccgccugccucugucuagcaacgcagug

SEQ ID NO: 227257 - RNA, 32 nt, Human
ucaaccgcgguggccacgccuccugggaaagg

SEQ ID NO: 227258 - RNA, 32 nt, Human
ucaaccggccuccccuaccccugcuggccggg

SEQ ID NO: 227259 - RNA, 32 nt, Human
ucaaccgggccgugccccagaugcccaccggg

SEQ ID NO: 227260 - RNA, 32 nt, Human
ucaaccgggcuggagugcaguggugcaaucuu

SEQ ID NO: 227261 - RNA, 32 nt, Human
ucaaccgguagcagauacuuccaaggaguggc

SEQ ID NO: 227262 - RNA, 31 nt, Human
ucaaccuaaauguccaucaaugacagacuag

SEQ ID NO: 227263 - RNA, 32 nt, Human
ucaaccuaaccagccacagccaagggcccaag

SEQ ID NO: 227264 - RNA, 31 nt, Human
ucaaccuaaguguccaucaauggaugaaugg

SEQ ID NO: 227265 - RNA, 32 nt, Human
ucaaccuaccaccccuuccugucccaccucuu

SEQ ID NO: 227266 - RNA, 32 nt, Human
ucaaccuaggaaaaaggagagcuuucuuacau

SEQ ID NO: 227267 - RNA, 32 nt, Human
ucaaccuauaucucccuugaaaauacuuucag

SEQ ID NO: 227268 - RNA, 32 nt, Human
ucaaccuauguauacuagauccuuccaguuug

SEQ ID NO: 227269 - RNA, 32 nt, Human
ucaaccucagccacagcccuguguccaucccc

SEQ ID NO: 227270 - RNA, 32 nt, Human
ucaaccuccagccagcuucuugagccuauuug

SEQ ID NO: 227271 - RNA, 32 nt, Human
ucaaccucccaaaagugcuggauuacagggau

SEQ ID NO: 227272 - RNA, 32 nt, Human
ucaaccucccaaagcgcugggauuacaggcgu

SEQ ID NO: 227273 - RNA, 32 nt, Human
ucaaccucccaaagugcugagauuacaggcgu

SEQ ID NO: 227274 - RNA, 32 nt, Human
ucaaccucccaaagugcuggaauuacagcuua

SEQ ID NO: 227275 - RNA, 32 nt, Human
ucaaccucccaaagugcuggaauuacaguucc

SEQ ID NO: 227276 - RNA, 32 nt, Human
ucaaccucccaaagugcugggauuacaggcau

SEQ ID NO: 227277 - RNA, 32 nt, Human
ucaaccucccaaagugcugggauuacaggcgu

SEQ ID NO: 227278 - RNA, 32 nt, Human
ucaaccucccaaagugcugggauuacaggugu

SEQ ID NO: 227279 - RNA, 32 nt, Human
ucaaccucccaaagugcugggauugcaggcgu

SEQ ID NO: 227280 - RNA, 32 nt, Human
ucaaccucccaaauaguugggauuacaggcac

SEQ ID NO: 227281 - RNA, 32 nt, Human
ucaaccucccaaguagcuagaccuauaggcgc

SEQ ID NO: 227282 - RNA, 23 nt, Human
ucaaccucccaggcucaagugau

SEQ ID NO: 227283 - RNA, 32 nt, Human
ucaaccucccgaguaacugggauuacaggugu

SEQ ID NO: 227284 - RNA, 32 nt, Human
ucaaccucccggauagcugggauuacaggcgu

SEQ ID NO: 227285 - RNA, 32 nt, Human
ucaaccucccuaguagcugggauuacaggugc

SEQ ID NO: 227286 - RNA, 32 nt, Human
ucaaccuccgauucugaagaagaaggagauga

SEQ ID NO: 227287 - RNA, 23 nt, Human
ucaaccuccugaccucaagugau

SEQ ID NO: 227288 - RNA, 32 nt, Human
ucaaccuccugccucagccuuccgagcagcug

SEQ ID NO: 227289 - RNA, 23 nt, Human
ucaaccuccuggccucaagugau

SEQ ID NO: 227290 - RNA, 19 nt, Human
ucaaccuccugggcucaag

SEQ ID NO: 227291 - RNA, 22 nt, Human
ucaaccuccugggcucaaguga

SEQ ID NO: 227292 - RNA, 23 nt, Human
ucaaccuccugggcucaagugau

SEQ ID NO: 227293 - RNA, 32 nt, Human
ucaaccuccuguacagcacccugccaguucuc

SEQ ID NO: 227294 - RNA, 32 nt, Human
ucaaccucgcugucugcugcgucucaggaguc

SEQ ID NO: 227295 - RNA, 24 nt, Human
ucacccuaggcgggcugggcgggg

SEQ ID NO: 227296 - RNA, 32 nt, Human
ucacccuagucucugcaggccauguccugaag

SEQ ID NO: 227297 - RNA, 32 nt, Human
ucacccuaugucaagugcuuuaucucuuuugg

SEQ ID NO: 227298 - RNA, 32 nt, Human
ucacccuauuccagggacacagucugcuuggc

SEQ ID NO: 227299 - RNA, 32 nt, Human
ucacccucaacccucuggggccacgugggccc

SEQ ID NO: 227300 - RNA, 31 nt, Human
ucacccucaauaaauacuguuaauuggagau

SEQ ID NO: 227301 - RNA, 32 nt, Human
ucacccucacaccacacgccuuaaaucuaauc

SEQ ID NO: 227302 - RNA, 32 nt, Human
ucacccucacccaagugauguggugguggcug

SEQ ID NO: 227303 - RNA, 32 nt, Human
ucacccucaccccauccuuccccaccaauaca

SEQ ID NO: 227304 - RNA, 22 nt, Human
ucacccucagacccccucgccu

SEQ ID NO: 227305 - RNA, 32 nt, Human
ucacccucagcuguccagcccugcugccuguc

SEQ ID NO: 227306 - RNA, 32 nt, Human
ucacccuccacaccugguggccucagccaugg

SEQ ID NO: 227307 - RNA, 32 nt, Human
ucacccuccacaccuuagaauguggcuguauc

SEQ ID NO: 227308 - RNA, 32 nt, Human
ucacccuccacccuccccacccccucggggca

SEQ ID NO: 227309 - RNA, 32 nt, Human
ucacccuccacuuguccgucuaccucauucuu

SEQ ID NO: 227310 - RNA, 32 nt, Human
ucacccuccagcccuggaggcuuuugcuggga

SEQ ID NO: 227311 - RNA, 32 nt, Human
ucacccuccagucugaaagugaagagcagagu

SEQ ID NO: 227312 - RNA, 32 nt, Human
ucacccucccaaaaugcugggauuacaggcgu

SEQ ID NO: 227313 - RNA, 32 nt, Human
ucacccucccaaagugcugggauuacaggcau

SEQ ID NO: 227314 - RNA, 32 nt, Human
ucacccucccaaagugcugggauuauaggcau

SEQ ID NO: 227315 - RNA, 32 nt, Human
ucacccucccaaguagcugggauuacaggugc

SEQ ID NO: 227316 - RNA, 32 nt, Human
ucacccucccauguagcugggauuacagcugc

SEQ ID NO: 227317 - RNA, 32 nt, Human
ucacccucccgaguagcugggauuacaggcac

SEQ ID NO: 227318 - RNA, 32 nt, Human
ucacccucccgagucacugggauuacaggcgc

SEQ ID NO: 227319 - RNA, 32 nt, Human
ucacccuccucucccacaucaggcuggcacuc

SEQ ID NO: 227320 - RNA, 32 nt, Human
ucacccuccugaggcccucagcucauacgggc

SEQ ID NO: 227321 - RNA, 32 nt, Human
ucacccuccugcacuccaacaauuggcugggg

SEQ ID NO: 227322 - RNA, 32 nt, Human
ucacccuccuggccaauuguguugcaccuugg

SEQ ID NO: 227323 - RNA, 32 nt, Human
ucacccucuaccucccugugcucaugcacuag

SEQ ID NO: 227324 - RNA, 32 nt, Human
ucacccucugacugcaggccugggcgacugcg

SEQ ID NO: 227325 - RNA, 32 nt, Human
ucacccucugcaggcccagcuccugccuccaa

SEQ ID NO: 227326 - RNA, 32 nt, Human
ucacccucuggacccgccuccucuggggagug

SEQ ID NO: 227327 - RNA, 27 nt, Human
ucacccucuucagacuggagucagugg

SEQ ID NO: 227328 - RNA, 32 nt, Human
ucacccucuuuccaccaugugaggauauaaug

SEQ ID NO: 227329 - RNA, 32 nt, Human
ucacccugagacugugggauguguucaucuug

SEQ ID NO: 227330 - RNA, 32 nt, Human
ucacccugaggguugcagggaggcagggauau

SEQ ID NO: 227331 - RNA, 32 nt, Human
ucacccugaguacacacacaaucacugccacu

SEQ ID NO: 227332 - RNA, 32 nt, Human
ucacccugcauccuucucccauuccccaaagu

SEQ ID NO: 227333 - RNA, 32 nt, Human
ucacccugccaagggagcuacuguucccaacc

SEQ ID NO: 227334 - RNA, 31 nt, Human
ucacccugccagagcagcuguaggagaugga

SEQ ID NO: 227335 - RNA, 32 nt, Human
ucacccugcccuccuccccagccuggaaucgg

SEQ ID NO: 227336 - RNA, 32 nt, Human
ucacccugcccuuggagcagucuuccaucgcg

SEQ ID NO: 227337 - RNA, 32 nt, Human
ucacccugccuagcaguugucaccauucacaa

SEQ ID NO: 227338 - RNA, 32 nt, Human
ucacccugcucugcccagccucgcgugaccuc

SEQ ID NO: 227339 - RNA, 32 nt, Human
ucacccuggaggugcacugguuuggggaaggc

SEQ ID NO: 227340 - RNA, 21 nt, Human
ucacccuggcuggagugcagu

SEQ ID NO: 227341 - RNA, 32 nt, Human
ucacccuggcuggagugcaguagugcgaucgc

SEQ ID NO: 227342 - RNA, 32 nt, Human
ucacccugggcaacagagugagaccccaucuc

SEQ ID NO: 227343 - RNA, 32 nt, Human
ucacccugguauccaauaucugagcauggcaa

SEQ ID NO: 227344 - RNA, 17 nt, Human
ucacccugucaauacuu

SEQ ID NO: 227345 - RNA, 32 nt, Human
ucacccugucauggucucagggaacagccugc

SEQ ID NO: 227346 - RNA, 32 nt, Human
ucacccuguguaucucuucaucuggcuguuca

SEQ ID NO: 227347 - RNA, 32 nt, Human
ucacccuguugccaggcuggaaugcaguggcg

SEQ ID NO: 227348 - RNA, 32 nt, Human
ucacccuguuucuuccccuccuccaguucuuu

SEQ ID NO: 227349 - RNA, 32 nt, Human
ucacccuuaaugaagagucacagggagaagac

SEQ ID NO: 227350 - RNA, 32 nt, Human
ucacccuuagagacaggguuucacuauguugc

SEQ ID NO: 227351 - RNA, 32 nt, Human
ucacccuuauccuuaucucugcugucaccccc

SEQ ID NO: 227352 - RNA, 32 nt, Human
ucacccuuccaggacacccaccuugugcaucu

SEQ ID NO: 227353 - RNA, 32 nt, Human
ucacccuucccaacuuggucuccuccaacaug

SEQ ID NO: 227354 - RNA, 32 nt, Human
ucacccuuccugagcugagacuucggggcugu

SEQ ID NO: 227355 - RNA, 32 nt, Human
ucacccuuccugcccgacggagcugcuucugc

SEQ ID NO: 227356 - RNA, 32 nt, Human
ucacccuuccuugacuuaccuccccaccugag

SEQ ID NO: 227357 - RNA, 32 nt, Human
ucacccuugcauuccagccugugaaauaaagg

SEQ ID NO: 227358 - RNA, 24 nt, Human
ucacccuuguaaucccagcacuuu

SEQ ID NO: 227359 - RNA, 32 nt, Human
ucacccuuguaaucccagcacuuugggaggcu

SEQ ID NO: 227360 - RNA, 32 nt, Human
ucacccuuguucccucuccuucuaugcccucc

SEQ ID NO: 227361 - RNA, 32 nt, Human
ucacccuuguugcccaggcuggagugcaaugg

SEQ ID NO: 227362 - RNA, 32 nt, Human
ucacccuuuccaggucucggaauggugcugaa

SEQ ID NO: 227363 - RNA, 32 nt, Human
ucacccuuuguugggggccaggcacagggcau

SEQ ID NO: 227364 - RNA, 32 nt, Human
ucaccgaagagaggaaccaccacacccagcag

SEQ ID NO: 227365 - RNA, 32 nt, Human
ucaccgacccuccuuuaugugagagagaaaua

SEQ ID NO: 227366 - RNA, 32 nt, Human
ucaccgaggaacacugggcugagcacaugaca

SEQ ID NO: 227367 - RNA, 32 nt, Human
ucaccgaggcuacagugcagugguucaaucgc

SEQ ID NO: 227368 - RNA, 32 nt, Human
ucaccgaggcuggagugcaaugacaugaucuc

SEQ ID NO: 227369 - RNA, 32 nt, Human
ucaccgaggcuggagugcaguggcgcgaucuc

SEQ ID NO: 227370 - RNA, 32 nt, Human
ucaccgagguuggagugcagugguaugaucau

SEQ ID NO: 227371 - RNA, 32 nt, Human
ucaccgauuucuuccuaugcaggaaaugagca

SEQ ID NO: 227372 - RNA, 21 nt, Human
ucaccgcauggacaagcccag

SEQ ID NO: 227373 - RNA, 32 nt, Human
ucaccgcauuugcugcuaucugugcccuggau

SEQ ID NO: 227374 - RNA, 32 nt, Human
ucaccgccacuacugcagcucagugcccagug

SEQ ID NO: 227375 - RNA, 32 nt, Human
ucaccgcccccaccaaccaccaccuccuaaau

SEQ ID NO: 227376 - RNA, 32 nt, Human
ucaccgcccggaggguaugggaagagaaauga

SEQ ID NO: 227377 - RNA, 32 nt, Human
ucaccgccuccuucauugauucuucaugcguu

SEQ ID NO: 227378 - RNA, 32 nt, Human
ucaccgccugaacacggagauugucuuucugc

SEQ ID NO: 227379 - RNA, 32 nt, Human
ucaccgcgcccagccgggaaugcaugcuuuua

SEQ ID NO: 227380 - RNA, 32 nt, Human
ucaccgcgccuauaauccuagcacuuugggag

SEQ ID NO: 227381 - RNA, 32 nt, Human
ucaccggccagagaagaccacugugagcauuu

SEQ ID NO: 227382 - RNA, 18 nt, Human
ucaccggccugcuuggca

SEQ ID NO: 227383 - RNA, 32 nt, Human
ucaccggcgcggaggcaggaggagcagucuca

SEQ ID NO: 227384 - RNA, 32 nt, Human
ucaccgggacgguggaggagauccucaacgug

SEQ ID NO: 227385 - RNA, 26 nt, Human
ucaccguaauccuacccagcaucuuu

SEQ ID NO: 227386 - RNA, 32 nt, Human
ucaccgucaagccuuucaccuuccucaaaaug

SEQ ID NO: 227387 - RNA, 21 nt, Human
ucaccgucaccgucaucauca

SEQ ID NO: 227388 - RNA, 32 nt, Human
ucaccgucacuggggucacugugcucguguug

SEQ ID NO: 227389 - RNA, 24 nt, Human
ucaccgucaucaucaucaucacca

SEQ ID NO: 227390 - RNA, 32 nt, Human
ucaccgucccccaggcuggagugccguggcgu

SEQ ID NO: 227391 - RNA, 32 nt, Human
ucaccgucuccucuuaagcucacucgggccag

SEQ ID NO: 227392 - RNA, 32 nt, Human
ucaccgugagccaucaaugugcucuggucuga

SEQ ID NO: 227393 - RNA, 22 nt, Human
ucaccgugcccagccuccugca

SEQ ID NO: 227394 - RNA, 32 nt, Human
ucaccgugcccagccuggacuugccuuuuacc

SEQ ID NO: 227395 - RNA, 32 nt, Human
ucaccgugcccagccuggaugagggucuuuag

SEQ ID NO: 227396 - RNA, 32 nt, Human
ucaccgugcgcuguugcgaucuggaccccgag

SEQ ID NO: 227397 - RNA, 32 nt, Human
ucaccgugugagccaggauggucucaaucucc

SEQ ID NO: 227398 - RNA, 32 nt, Human
ucaccguguggaaguuuuacagaaggauccca

SEQ ID NO: 227399 - RNA, 32 nt, Human
ucaccguguuaaccaggauggucucgaucucc

SEQ ID NO: 227400 - RNA, 32 nt, Human
ucaccguguuagccaggauggacuccaucucc

SEQ ID NO: 227401 - RNA, 32 nt, Human
ucaccguguuagccaggaugguccugaucucc

SEQ ID NO: 227402 - RNA, 32 nt, Human
ucaccguguuagccaggauggucucaaucucc

SEQ ID NO: 227403 - RNA, 32 nt, Human
ucaccguguuagccaggauggucucgaucccc

SEQ ID NO: 227404 - RNA, 32 nt, Human
ucaccguguuagccaggauggucucgaucucc

SEQ ID NO: 227405 - RNA, 32 nt, Human
ucaccguguuagccaggauggucucgaucuuc

SEQ ID NO: 227406 - RNA, 32 nt, Human
ucaccguguuagccaggauggucucgauuucc

SEQ ID NO: 227407 - RNA, 32 nt, Human
ucaccguguuagccaggauggucuggaucucc

SEQ ID NO: 227408 - RNA, 32 nt, Human
ucaccguguuagccaggauggucuugaucucc

SEQ ID NO: 227409 - RNA, 32 nt, Human
ucaccguguuagccaggauggucuugaucucu

SEQ ID NO: 227410 - RNA, 32 nt, Human
ucaccguguuagccaggauggugucgaucucc

SEQ ID NO: 227411 - RNA, 32 nt, Human
ucaccguguuggccaggauggucuugaucucc

SEQ ID NO: 227412 - RNA, 32 nt, Human
ucaccguguuggccaggauggucuugaucucu

SEQ ID NO: 227413 - RNA, 32 nt, Human
ucaccuaaaacuuccuuaagugagugacaagc

SEQ ID NO: 227414 - RNA, 32 nt, Human
ucaccuaaaccaaagaucacugaagauaaugu

SEQ ID NO: 227415 - RNA, 32 nt, Human
ucaccuaaaggcaguuggcaagagaccaacau

SEQ ID NO: 227416 - RNA, 32 nt, Human
ucaccuaacauuaccagccuuugcaaggagag

SEQ ID NO: 227417 - RNA, 32 nt, Human
ucaccuaagcauaaggggaaaaacucucaggg

SEQ ID NO: 227418 - RNA, 32 nt, Human
ucaccuaagcuggagugcagugcgcgaucucg

SEQ ID NO: 227419 - RNA, 32 nt, Human
ucaccuaaggaaaugcauuugaugagugcugg

SEQ ID NO: 227420 - RNA, 32 nt, Human
ucaccuacaagaaggugaccccguaaccuaga

SEQ ID NO: 227421 - RNA, 32 nt, Human
ucaccuacaaugcuggcuuucucccacugagu

SEQ ID NO: 227422 - RNA, 32 nt, Human
ucaccuacacgguccucacacccuuccucagc

SEQ ID NO: 227423 - RNA, 23 nt, Human
ucaccuaccgaguucaagugauu

SEQ ID NO: 227424 - RNA, 32 nt, Human
ucaccuaccucauaggggagguugugaggcca

SEQ ID NO: 227425 - RNA, 32 nt, Human
ucaccuagacuagacuggagugcaauggccug

SEQ ID NO: 227426 - RNA, 32 nt, Human
ucaccuagagacaagacuccuuagugguggaa

SEQ ID NO: 227427 - RNA, 32 nt, Human
ucaccuagcauuccucuuccucauguucagau

SEQ ID NO: 227428 - RNA, 32 nt, Human
ucaccuagcugguuaauggcagcauucagaac

SEQ ID NO: 227429 - RNA, 32 nt, Human
ucaccuagcuugccacaaaaauucuuuggcga

SEQ ID NO: 227430 - RNA, 32 nt, Human
ucaccuaggcaagagugcaauggcacaaucuc

SEQ ID NO: 227431 - RNA, 32 nt, Human
ucaccuaggcuacagugcaguggugugaucac

SEQ ID NO: 227432 - RNA, 32 nt, Human
ucaccuaggcuagagugcaguggugcgaucuc

SEQ ID NO: 227433 - RNA, 32 nt, Human
ucaccuaggcuagagugcaguggugugaucuc

SEQ ID NO: 227434 - RNA, 32 nt, Human
ucaccuaggcugcagugcaguggcacaagauu

SEQ ID NO: 227435 - RNA, 32 nt, Human
ucaccuaggcuggaaugcaguggugcaaucau

SEQ ID NO: 227436 - RNA, 20 nt, Human
ucaccuaggcuggagugcag

SEQ ID NO: 227437 - RNA, 23 nt, Human
ucaccuaggcuggagugcagcgg

SEQ ID NO: 227438 - RNA, 21 nt, Human
ucaccuaggcuggagugcagu

SEQ ID NO: 227439 - RNA, 22 nt, Human
ucaccuaggcuggagugcagug

SEQ ID NO: 227440 - RNA, 32 nt, Human
ucaccuaggcuggagugcaguggcacaaucuc

SEQ ID NO: 227441 - RNA, 32 nt, Human
ucaccuaggcuggagugcaguggcacaaucuu

SEQ ID NO: 227442 - RNA, 32 nt, Human
ucaccuaggcuggagugcaguggcacagucuc

SEQ ID NO: 227443 - RNA, 32 nt, Human
ucaccuaggcuggagugcaguggcgcaaucuc

SEQ ID NO: 227444 - RNA, 32 nt, Human
ucaccuaggcuggagugcaguggggcaaucuc

SEQ ID NO: 227445 - RNA, 32 nt, Human
ucaccuaggcuggagugcagugguaaaucucg

SEQ ID NO: 227446 - RNA, 32 nt, Human
ucaccuaggcuggagugcaguggugcaauuau

SEQ ID NO: 227447 - RNA, 32 nt, Human
ucaccuaggcuggaguguaguggcgcaaucgu

SEQ ID NO: 227448 - RNA, 32 nt, Human
ucaccuaggcuggaguugcagugguuugaucu

SEQ ID NO: 227449 - RNA, 32 nt, Human
ucaccuaggcuggauugcaauggugcaaucuu

SEQ ID NO: 227450 - RNA, 32 nt, Human
ucaccuaggguggagugcaguggcacaaucac

SEQ ID NO: 227451 - RNA, 32 nt, Human
ucaccuaggugaggauaggcgcgggagccucg

SEQ ID NO: 227452 - RNA, 32 nt, Human
ucaccuauccacccucugcauccccuuggccc

SEQ ID NO: 227453 - RNA, 32 nt, Human
ucaccuauuguacaaagaaauugcgauguaua

SEQ ID NO: 227454 - RNA, 32 nt, Human
ucaccucaacuccagccagggaggaauagaug

SEQ ID NO: 227455 - RNA, 32 nt, Human
ucaccucaagacgaccauggccaccaucccag

SEQ ID NO: 227456 - RNA, 32 nt, Human
ucaccucacaccugaguuaagacgaggaaaua

SEQ ID NO: 227457 - RNA, 31 nt, Human
ucaccucaccucucugagccuguucccuccu

SEQ ID NO: 227458 - RNA, 32 nt, Human
ucaccucacugcaaccuccaccuccuagguuc

SEQ ID NO: 227459 - RNA, 32 nt, Human
ucaccucacugcaaccuccgccuccuggguuc

SEQ ID NO: 227460 - RNA, 32 nt, Human
ucaccucacugcaaccucugccucccgggucc

SEQ ID NO: 227461 - RNA, 32 nt, Human
ucaccucacugcaagcucugccucccgggcuc

SEQ ID NO: 227462 - RNA, 32 nt, Human
ucaccucacugcacgcuagccugggcaacaga

SEQ ID NO: 227463 - RNA, 22 nt, Human
ucaccucaggccaggugcagug

SEQ ID NO: 227464 - RNA, 23 nt, Human
ucaccucaggccaggugcagugg

SEQ ID NO: 227465 - RNA, 32 nt, Human
ucaccucaggccaggugcaguggcucacgccu

SEQ ID NO: 227466 - RNA, 22 nt, Human
ucaccucaggcccugccagggg

SEQ ID NO: 227467 - RNA, 32 nt, Human
ucaccucagugcaacagcugggagggggccgu

SEQ ID NO: 227468 - RNA, 32 nt, Human
ucaccucauugcaaccuccgccucccggguuc

SEQ ID NO: 227469 - RNA, 32 nt, Human
ucaccucauuuguggguggauuuucuagaauu

SEQ ID NO: 227470 - RNA, 26 nt, Human
ucaccuccaaagcaggcaaagacagu

SEQ ID NO: 227471 - RNA, 22 nt, Human
ucaccuccaaaggagaguacag

SEQ ID NO: 227472 - RNA, 19 nt, Human
ucaccuccaaaugaggaca

SEQ ID NO: 227473 - RNA, 32 nt, Human
ucaccuccaacgugaagaucaggcugggccau

SEQ ID NO: 227474 - RNA, 18 nt, Human
ucaccuccagcucagggg

SEQ ID NO: 227475 - RNA, 21 nt, Human
ucaccuccaggauacagacag

SEQ ID NO: 227476 - RNA, 22 nt, Human
ucaccuccagguucaagugauu

SEQ ID NO: 227477 - RNA, 32 nt, Human
ucaccuccauccucugucucuggggcucaucu

SEQ ID NO: 227478 - RNA, 32 nt, Human
ucaccucccagccugccuuccuggucuaucug

SEQ ID NO: 227479 - RNA, 32 nt, Human
ucaccuccccuccuagggacccagagcuuccc

SEQ ID NO: 227480 - RNA, 32 nt, Human
ucaccuccccuguaucugcagcacuuugagcu

SEQ ID NO: 227481 - RNA, 32 nt, Human
ucaccucccuacuccugucauuacauuuacuu

SEQ ID NO: 227482 - RNA, 32 nt, Human
ucaccucccuacuccuuuuauuuuacaugagu

SEQ ID NO: 227483 - RNA, 19 nt, Human
ucaccuccgcuccuugagc

SEQ ID NO: 227484 - RNA, 32 nt, Human
ucaccuccuauuuuauacccuaccuucugguu

SEQ ID NO: 227485 - RNA, 32 nt, Human
ucaccuccucaccucugcuccuugcccucuca

SEQ ID NO: 227486 - RNA, 32 nt, Human
ucaccuccuccacccuucuugcuuaaauccau

SEQ ID NO: 227487 - RNA, 32 nt, Human
ucaccuccuccacucacuccagcccaacagaa

SEQ ID NO: 227488 - RNA, 32 nt, Human
ucaccuccuccaggaagccuucccagcuaccc

SEQ ID NO: 227489 - RNA, 32 nt, Human
ucaccuccuccaggaagccuuccugcucccca

SEQ ID NO: 227490 - RNA, 32 nt, Human
ucaccuccuccaggaaguccucuggauugacu

SEQ ID NO: 227491 - RNA, 32 nt, Human
ucaccuccuccaggacaacacucucucugugg

SEQ ID NO: 227492 - RNA, 32 nt, Human
ucaccuccucccaggcuccugggaagcaccug

SEQ ID NO: 227493 - RNA, 32 nt, Human
ucaccuccucuggccuuuuugcugauggcaga

SEQ ID NO: 227494 - RNA, 32 nt, Human
ucaccuccucuucaugugauguggaccccugg

SEQ ID NO: 227495 - RNA, 18 nt, Human
ucaccuccugcccucagg

SEQ ID NO: 227496 - RNA, 32 nt, Human
ucaccucuaguuauaagccagcaacaggaacu

SEQ ID NO: 227497 - RNA, 32 nt, Human
ucaccucucccaggcccaaggcugcgggcgcc

SEQ ID NO: 227498 - RNA, 32 nt, Human
ucaccucuccccuucugcugagcuucugcgca

SEQ ID NO: 227499 - RNA, 32 nt, Human
ucaccucucucuucaacugccucucuccagag

SEQ ID NO: 227500 - RNA, 32 nt, Human
ucaccucucuucugagaguagcaugagggucc

SEQ ID NO: 227501 - RNA, 32 nt, Human
ucaccucugagagccaaaugucugacuauaga

SEQ ID NO: 227502 - RNA, 32 nt, Human
ucaccucugccacccaucuacuugcauucguc

SEQ ID NO: 227503 - RNA, 32 nt, Human
ucaccucugcuccugucuucaucaccuucucu

SEQ ID NO: 227504 - RNA, 32 nt, Human
ucaccucugcuccuugcccucucaccugguuc

SEQ ID NO: 227505 - RNA, 32 nt, Human
ucaccucugcugucccucucuucccucauccc

SEQ ID NO: 227506 - RNA, 24 nt, Human
ucaccucuguaaucccagcacuuu

SEQ ID NO: 227507 - RNA, 32 nt, Human
ucaccucuguaaucccagcacuuugggaggcc

SEQ ID NO: 227508 - RNA, 32 nt, Human
ucaccucuguaauuuuucagcucucuguauaa

SEQ ID NO: 227509 - RNA, 32 nt, Human
ucaccucuguagaaaaguuucuccccaguucu

SEQ ID NO: 227510 - RNA, 32 nt, Human
ucaccucuguagugugagggucuguggguggu

SEQ ID NO: 227511 - RNA, 32 nt, Human
ucaccucuuaaggagcucugagacuccacuuc

SEQ ID NO: 227512 - RNA, 32 nt, Human
ucaccucuuccaccaucauuugcuagggccaa

SEQ ID NO: 227513 - RNA, 32 nt, Human
ucaccucuuccuggaagccuuccucuuuucca

SEQ ID NO: 227514 - RNA, 32 nt, Human
ucaccucuucugcaaucaugaccucuugaugu

SEQ ID NO: 227515 - RNA, 32 nt, Human
ucaccucuuuuacaccaaaaggucugcagggu

SEQ ID NO: 227516 - RNA, 18 nt, Human
ucaccucuuuugcuagca

SEQ ID NO: 227517 - RNA, 32 nt, Human
ucaccugaacccaggaggcagagguugcagug

SEQ ID NO: 227518 - RNA, 32 nt, Human
ucaccugaaccccagaggcagagguugcagug

SEQ ID NO: 227519 - RNA, 32 nt, Human
ucaccugaacucucuggaccucagguuuccau

SEQ ID NO: 227520 - RNA, 32 nt, Human
ucaccugaagucagaaguuugagaccagccug

SEQ ID NO: 227521 - RNA, 32 nt, Human
ucaccugaagucaggagagaccagccuggcca

SEQ ID NO: 227522 - RNA, 32 nt, Human
ucaccugaagucaggaguucgagaccagccug

SEQ ID NO: 227523 - RNA, 32 nt, Human
ucaccugaagucaggaguuugagaccagccug

SEQ ID NO: 227524 - RNA, 32 nt, Human
ucaccugaagucagggauuugagaccagccug

SEQ ID NO: 227525 - RNA, 32 nt, Human
ucaccugaaucugacuaugaagaaacaucaga

SEQ ID NO: 227526 - RNA, 32 nt, Human
ucaccugagcagguaaagucugaaaagcucaa

SEQ ID NO: 227527 - RNA, 32 nt, Human
ucaccugagcccaggaggucaagacugcagug

SEQ ID NO: 227528 - RNA, 32 nt, Human
ucaccugagcccaggagguggaggcugcagug

SEQ ID NO: 227529 - RNA, 32 nt, Human
ucaccugagccgggggaaucaccugagcccag

SEQ ID NO: 227530 - RNA, 32 nt, Human
ucaccugaggccaccaggcucaagccacugcu

SEQ ID NO: 227531 - RNA, 32 nt, Human
ucaccugagguauggcaaacauggugaaacgc

SEQ ID NO: 227532 - RNA, 32 nt, Human
ucaccugaggucaggaguucgagcccagccug

SEQ ID NO: 227533 - RNA, 32 nt, Human
ucaccugaguccaggaggucgaggcugcagug

SEQ ID NO: 227534 - RNA, 32 nt, Human
ucaccugaucacucaacugcuucuuaacaccu

SEQ ID NO: 227535 - RNA, 21 nt, Human
ucaccugaugcucugccagug

SEQ ID NO: 227536 - RNA, 32 nt, Human
ucaccugcaaagcucuguggccacauuuucag

SEQ ID NO: 227537 - RNA, 32 nt, Human
ucaccugcaacaagcucugauacuccagggga

SEQ ID NO: 227538 - RNA, 32 nt, Human
ucaccugcaccaggauagaaagcacgugaugg

SEQ ID NO: 227539 - RNA, 19 nt, Human
ucaccugcagcuggccaca

SEQ ID NO: 227540 - RNA, 21 nt, Human
ucaccugcaggcuggccuggg

SEQ ID NO: 227541 - RNA, 32 nt, Human
ucaccugcaguugggagccagcuacaacccaa

SEQ ID NO: 227542 - RNA, 32 nt, Human
ucaccugcauauacauuuuuccauuuuaugcu

SEQ ID NO: 227543 - RNA, 32 nt, Human
ucaccugcccaccauacuauccuugaaaaucu

SEQ ID NO: 227544 - RNA, 31 nt, Human
ucaccugcccucucuggacuuguuucuucaa

SEQ ID NO: 227545 - RNA, 32 nt, Human
ucaccugcccugcugagucccaggcugagccu

SEQ ID NO: 227546 - RNA, 31 nt, Human
ucaccugccggcucugggcuggcugcuccua

SEQ ID NO: 227547 - RNA, 32 nt, Human
ucaccugccuccucaucauggaaggggguggg

SEQ ID NO: 227548 - RNA, 32 nt, Human
ucaccugccugggaccugccccgccuccgcau

SEQ ID NO: 227549 - RNA, 32 nt, Human
ucaccugccuuuccuucucccauccuuuuucu

SEQ ID NO: 227550 - RNA, 32 nt, Human
ucaccugcggcagaggugugcagaggcagaau

SEQ ID NO: 227551 - RNA, 32 nt, Human
ucaccugcuaggagccucaccugcuggggacc

SEQ ID NO: 227552 - RNA, 32 nt, Human
ucaccugcucacgcccucccacccccacccua

SEQ ID NO: 227553 - RNA, 32 nt, Human
ucaccugcuccaccccuucacggcgacccacu

SEQ ID NO: 227554 - RNA, 32 nt, Human
ucaccugcucugccuugaaauggcuauuuggg

SEQ ID NO: 227555 - RNA, 32 nt, Human
ucaccugcucuggggcccuccugcgcccagag

SEQ ID NO: 227556 - RNA, 32 nt, Human
ucaccugcugugguuaugaugcucugaguuca

SEQ ID NO: 227557 - RNA, 32 nt, Human
ucaccugcugugguugaguuucucacucaugc

SEQ ID NO: 227558 - RNA, 32 nt, Human
ucaccugcuucucugcccagcuuuucauugcu

SEQ ID NO: 227559 - RNA, 32 nt, Human
ucaccugcuuuaccaccuccuuuucccucagc

SEQ ID NO: 227560 - RNA, 32 nt, Human
ucaccuggaacagcaugucaggccgcagugua

SEQ ID NO: 227561 - RNA, 32 nt, Human
ucaccuggaacagcaugucaggccgcagugug

SEQ ID NO: 227562 - RNA, 32 nt, Human
ucaccuggaaggcagaucuaacagagaaccug

SEQ ID NO: 227563 - RNA, 32 nt, Human
ucaccuggagccuucaauucaccggaagaaaa

SEQ ID NO: 227564 - RNA, 32 nt, Human
ucaccuggauuuugagaaagaaaauaacuucu

SEQ ID NO: 227565 - RNA, 31 nt, Human
ucaccuggauuuuucugaauguuuuaaagaa

SEQ ID NO: 227566 - RNA, 32 nt, Human
ucaccuggcacauucauuuucucaguugaaga

SEQ ID NO: 227567 - RNA, 32 nt, Human
ucaccuggcaccacccucccgcucucacccac

SEQ ID NO: 227568 - RNA, 21 nt, Human
ucaccuggcaggucucugcca

SEQ ID NO: 227569 - RNA, 32 nt, Human
ucaccuggccuggaguguguugggcagccagu

SEQ ID NO: 227570 - RNA, 32 nt, Human
ucaccuggccugggccgcacagcuggugcaug

SEQ ID NO: 227571 - RNA, 32 nt, Human
ucaccuggcuucuccacugcccucucuguucc

SEQ ID NO: 227572 - RNA, 26 nt, Human
ucaccuggcuuuacuucuggugggaa

SEQ ID NO: 227573 - RNA, 21 nt, Human
ucaccugggacucugccagug

SEQ ID NO: 227574 - RNA, 32 nt, Human
ucaccugggaggaccuccugggccagaaucug

SEQ ID NO: 227575 - RNA, 32 nt, Human
ucaccugggagguggggcagggaugguguuuc

SEQ ID NO: 227576 - RNA, 32 nt, Human
ucaccugggaucaggaguccaagaucagccug

SEQ ID NO: 227577 - RNA, 32 nt, Human
ucaccugggccagaggucagaaggucggggca

SEQ ID NO: 227578 - RNA, 32 nt, Human
ucaccuggggaaaugacuggguugucgaugga

SEQ ID NO: 227579 - RNA, 32 nt, Human
ucaccuggggcugcuggccugaaugcuuauag

SEQ ID NO: 227580 - RNA, 32 nt, Human
ucaccugggucgggauucucaggucaugaacg

SEQ ID NO: 227581 - RNA, 32 nt, Human
ucaccuguaagaguccuguccucugccagacu

SEQ ID NO: 227582 - RNA, 22 nt, Human
ucaccuguaaucccagcacuuu

SEQ ID NO: 227583 - RNA, 32 nt, Human
ucaccuguccuggucuugcugugugaugggaa

SEQ ID NO: 227584 - RNA, 23 nt, Human
ucaccugucgcuggagugcagug

SEQ ID NO: 227585 - RNA, 23 nt, Human
ucaccugucucaggaaccaccug

SEQ ID NO: 227586 - RNA, 32 nt, Human
ucaccugucugaaccucaguuuccuugucugu

SEQ ID NO: 227587 - RNA, 32 nt, Human
ucaccugugaagccaucugcgccaagccuugc

SEQ ID NO: 227588 - RNA, 32 nt, Human
ucaccuguggcagaggugugcagaggcagagu

SEQ ID NO: 227589 - RNA, 27 nt, Human
ucaccuguggcuucuucccccagugua

SEQ ID NO: 227590 - RNA, 32 nt, Human
ucaccugugggugggggagggagagggcaguu

SEQ ID NO: 227591 - RNA, 32 nt, Human
ucaccuguugcagcuucaccugccuggggauu

SEQ ID NO: 227592 - RNA, 32 nt, Human
ucaccuguuuaaugccaagauaacaaagcgcu

SEQ ID NO: 227593 - RNA, 32 nt, Human
ucaccuuaaacuugacaguggcucaugcugau

SEQ ID NO: 227594 - RNA, 32 nt, Human
ucaccuuacagcuggggaaacugaggccugga

SEQ ID NO: 227595 - RNA, 32 nt, Human
ucaccuuaccaucagagcagugcagugcucuu

SEQ ID NO: 227596 - RNA, 19 nt, Human
ucaccuuacuccccucagg

SEQ ID NO: 227597 - RNA, 32 nt, Human
ucaccuuagcuccugugguccuuggggcuuag

SEQ ID NO: 227598 - RNA, 32 nt, Human
ucaccuuauucccaggcuggagugcaaugucg

SEQ ID NO: 227599 - RNA, 32 nt, Human
ucaccuucagguagcgcuccagcuucuugcug

SEQ ID NO: 227600 - RNA, 32 nt, Human
ucaccuucauucuucaauucagucuaggaaac

SEQ ID NO: 227601 - RNA, 32 nt, Human
ucaccuucgccucugcugaagucuccccgcag

SEQ ID NO: 227602 - RNA, 32 nt, Human
ucaccuucuccucucuucacggggcccuuuug

SEQ ID NO: 227603 - RNA, 32 nt, Human
ucaccuucugaugucccaucacucccugaugu

SEQ ID NO: 227604 - RNA, 32 nt, Human
ucaccuucugcuccuaggaggcugcuuguugc

SEQ ID NO: 227605 - RNA, 32 nt, Human
ucaccuucuggguucaaguguccuccugccuu

SEQ ID NO: 227606 - RNA, 32 nt, Human
ucaccuugcucaccuucuacuugcccacauac

SEQ ID NO: 227607 - RNA, 32 nt, Human
ucaccuugcuccgucuaugucuucccagcuca

SEQ ID NO: 227608 - RNA, 32 nt, Human
ucaccuuggcugcaacugcugagugcugguaa

SEQ ID NO: 227609 - RNA, 32 nt, Human
ucaccuuguccuauguccagaucuaucuauuc

SEQ ID NO: 227610 - RNA, 23 nt, Human
ucaccuuguggggcuggccgugg

SEQ ID NO: 227611 - RNA, 32 nt, Human
ucaccuuguuagccaggauggucucacguuuu

SEQ ID NO: 227612 - RNA, 32 nt, Human
ucaccuuguuagccaggauggucucgaucucc

SEQ ID NO: 227613 - RNA, 32 nt, Human
ucaccuuguucccuccugccccgguucgagag

SEQ ID NO: 227614 - RNA, 32 nt, Human
ucaccuuguuggccaggauggucucgaucucc

SEQ ID NO: 227615 - RNA, 32 nt, Human
ucaccuuuaacugacguuuuguccucaauaau

SEQ ID NO: 227616 - RNA, 32 nt, Human
ucaccuuuacaaaggccuuucuuuagaucugu

SEQ ID NO: 227617 - RNA, 32 nt, Human
ucaccuuucaugccagacaaaagccccaguga

SEQ ID NO: 227618 - RNA, 32 nt, Human
ucaccuuucccaccucucuccccaaagugauc

SEQ ID NO: 227619 - RNA, 23 nt, Human
ucaccuuucccaucuuccaaggg

SEQ ID NO: 227620 - RNA, 32 nt, Human
ucaccuuuccgagccucgguuuccuuaucugu

SEQ ID NO: 227621 - RNA, 20 nt, Human
ucaccuuuccggagcagggg

SEQ ID NO: 227622 - RNA, 32 nt, Human
ucaccuuucuccuguccaacuucaccaccacc

SEQ ID NO: 227623 - RNA, 18 nt, Human
ucaccuuucucuccucag

SEQ ID NO: 227624 - RNA, 32 nt, Human
ucaccuuugcacuugcugaaucugucuuuguu

SEQ ID NO: 227625 - RNA, 32 nt, Human
ucaccuuuguguuuccagcugcagagaaagua

SEQ ID NO: 227626 - RNA, 32 nt, Human
ucaccuuuugccacccccuccccaccagaggc

SEQ ID NO: 227627 - RNA, 32 nt, Human
ucaccuuuuucuuccucacacuuuuuagucuu

SEQ ID NO: 227628 - RNA, 32 nt, Human
ucacgaacaggcaaagcugcagacuaugguau

SEQ ID NO: 227629 - RNA, 32 nt, Human
ucacgaaggaaauaguaauaugcugaauaaua

SEQ ID NO: 227630 - RNA, 32 nt, Human
ucacgaaugccagaggcagugaugucccaucc

SEQ ID NO: 227631 - RNA, 32 nt, Human
ucacgacacugcacuccagccugggcaacgga

SEQ ID NO: 227632 - RNA, 32 nt, Human
ucacgacagcacagacugacuuuauaccuuca

SEQ ID NO: 227633 - RNA, 32 nt, Human
ucacgaccaccgaccugagccugguggagaug

SEQ ID NO: 227634 - RNA, 32 nt, Human
ucacgaccagccuggccaacauggugaaaccc

SEQ ID NO: 227635 - RNA, 32 nt, Human
ucacgaccagccuggccaacauugugaaaccc

SEQ ID NO: 227636 - RNA, 32 nt, Human
ucacgaccauccuggcuaacauggugguaccc

SEQ ID NO: 227637 - RNA, 32 nt, Human
ucacgacccucucacguggacccccuuagagu

SEQ ID NO: 227638 - RNA, 32 nt, Human
ucacgaccugcaaggggccagcagggacgugg

SEQ ID NO: 227639 - RNA, 32 nt, Human
ucacgacuaagcucucacgauuaaggcacgcc

SEQ ID NO: 227640 - RNA, 32 nt, Human
ucacgacucauuggcucacugcagccuagacc

SEQ ID NO: 227641 - RNA, 32 nt, Human
ucacgagaauagcacagaaaagacuggccucc

SEQ ID NO: 227642 - RNA, 32 nt, Human
ucacgagacacagaaccuggaggggugugcac

SEQ ID NO: 227643 - RNA, 32 nt, Human
ucacgagagcacacaaaauauacaaaggauga

SEQ ID NO: 227644 - RNA, 32 nt, Human
ucacgagcacugggucugcagcuguggggaca

SEQ ID NO: 227645 - RNA, 32 nt, Human
ucacgagcugcuuucaaaaaguugacacaaua

SEQ ID NO: 227646 - RNA, 32 nt, Human
ucacgaggacccucagcugcuggaggccaccc

SEQ ID NO: 227647 - RNA, 32 nt, Human
ucacgaggcuuggaccugcuguggagggugcc

SEQ ID NO: 227648 - RNA, 32 nt, Human
ucacgaggucaggaguucgagggcagccugac

SEQ ID NO: 227649 - RNA, 32 nt, Human
ucacgaucccagauuuagugacuuuaaaccag

SEQ ID NO: 227650 - RNA, 32 nt, Human
ucacgauccugcacuccagccugggcaacaga

SEQ ID NO: 227651 - RNA, 20 nt, Human
ucacgaugcuggcucaggcu

SEQ ID NO: 227652 - RNA, 32 nt, Human
ucacgauuaauaggcucugugguucugguuuu

SEQ ID NO: 227653 - RNA, 31 nt, Human
ucacgauucaauaaauauuggaugaaauuaa

SEQ ID NO: 227654 - RNA, 32 nt, Human
ucacgcaaguuggaaugcaguggugugauguc

SEQ ID NO: 227655 - RNA, 22 nt, Human
ucacgcaaugcucaccucgccu

SEQ ID NO: 227656 - RNA, 17 nt, Human
ucacgcagcagcuggga

SEQ ID NO: 227657 - RNA, 21 nt, Human
ucacgcagcaggagcagggga

SEQ ID NO: 227658 - RNA, 22 nt, Human
ucacgcaggcuagagugcagug

SEQ ID NO: 227659 - RNA, 32 nt, Human
ucacgcaggcuagagugcaguggcgcaaacau

SEQ ID NO: 227660 - RNA, 32 nt, Human
ucacgcaugagaaggagguucccacuggaaaa

SEQ ID NO: 227661 - RNA, 22 nt, Human
ucacgcauguaaucccagcacu

SEQ ID NO: 227662 - RNA, 32 nt, Human
ucacgcauguaaucccagcacucugggaggcu

SEQ ID NO: 227663 - RNA, 24 nt, Human
ucacgcauguaaucccagcacuuu

SEQ ID NO: 227664 - RNA, 32 nt, Human
ucacgcauguaaucccagcacuuugggaggcc

SEQ ID NO: 227665 - RNA, 32 nt, Human
ucacgcauguaaucccugcacuuugggaggcc

SEQ ID NO: 227666 - RNA, 24 nt, Human
ucacgcauguaauccuaacacuuu

SEQ ID NO: 227667 - RNA, 32 nt, Human
ucacgcauuccucccaccuccaccucccaaac

SEQ ID NO: 227668 - RNA, 32 nt, Human
ucacgccacagcacuccagccugggcgacaga

SEQ ID NO: 227669 - RNA, 24 nt, Human
ucacgccacuaaucccaacauuuu

SEQ ID NO: 227670 - RNA, 32 nt, Human
ucacgccacuacacuccaaccugggugacaga

SEQ ID NO: 227671 - RNA, 32 nt, Human
ucacgccacuacacuccagccugggcaacaga

SEQ ID NO: 227672 - RNA, 32 nt, Human
ucacgccacuacacuccagccugggcgacaga

SEQ ID NO: 227673 - RNA, 32 nt, Human
ucacgccacuacauuccagcugggcaacacag

SEQ ID NO: 227674 - RNA, 32 nt, Human
ucacgccacugaacuccagccugggagacagc

SEQ ID NO: 227675 - RNA, 32 nt, Human
ucacgccacugaacuccagccugggugacaga

SEQ ID NO: 227676 - RNA, 32 nt, Human
ucacgccacugcaacuccagcuugggugacag

SEQ ID NO: 227677 - RNA, 32 nt, Human
ucacgccacugcaccccagccugggugacaga

SEQ ID NO: 227678 - RNA, 32 nt, Human
ucacgccacugcacuacagccuggacgacaga

SEQ ID NO: 227679 - RNA, 32 nt, Human
ucacgccacugcacuauagccuaggugacaga

SEQ ID NO: 227680 - RNA, 32 nt, Human
ucacgccacugcacucaagccugggcgacaga

SEQ ID NO: 227681 - RNA, 32 nt, Human
ucacgccacugcacuccaaccugggugacaga

SEQ ID NO: 227682 - RNA, 32 nt, Human
ucacgccacugcacuccaacuugggcaacaga

SEQ ID NO: 227683 - RNA, 32 nt, Human
ucacgccacugcacuccaccugggcaacaaga

SEQ ID NO: 227684 - RNA, 32 nt, Human
ucacgccacugcacuccacuccaucucaaaaa

SEQ ID NO: 227685 - RNA, 32 nt, Human
ucacgccacugcacuccagcacccugggcgac

SEQ ID NO: 227686 - RNA, 32 nt, Human
ucacgccacugcacuccagcccgggcgacagu

SEQ ID NO: 227687 - RNA, 32 nt, Human
ucacgccacugcacuccagcccgggcggcaga

SEQ ID NO: 227688 - RNA, 32 nt, Human
ucacgccacugcacuccagcccggggacagag

SEQ ID NO: 227689 - RNA, 32 nt, Human
ucacgccacugcacuccagccuaggcgacaga

SEQ ID NO: 227690 - RNA, 32 nt, Human
ucacgccacugcacuccagccucggugacaga

SEQ ID NO: 227691 - RNA, 32 nt, Human
ucacgccacugcacuccagccugagugacaga

SEQ ID NO: 227692 - RNA, 32 nt, Human
ucacgccacugcacuccagccugcggacagac

SEQ ID NO: 227693 - RNA, 32 nt, Human
ucacgccacugcacuccagccuggacaacaga

SEQ ID NO: 227694 - RNA, 32 nt, Human
ucacgccacugcacuccagccuggaugacaga

SEQ ID NO: 227695 - RNA, 32 nt, Human
ucacgccacugcacuccagccuggcgacagag

SEQ ID NO: 227696 - RNA, 32 nt, Human
ucacgccacugcacuccagccugggagacaga

SEQ ID NO: 227697 - RNA, 32 nt, Human
ucacgccacugcacuccagccugggcaacaag

SEQ ID NO: 227698 - RNA, 32 nt, Human
ucacgccacugcacuccagccugggcaacaga

SEQ ID NO: 227699 - RNA, 32 nt, Human
ucacgccacugcacuccagccugggcaacagu

SEQ ID NO: 227700 - RNA, 32 nt, Human
ucacgccacugcacuccagccugggcaacgga

SEQ ID NO: 227701 - RNA, 32 nt, Human
ucacgccacugcacuccagccugggccacaga

SEQ ID NO: 227702 - RNA, 32 nt, Human
ucacgccacugcacuccagccugggcgacaga

SEQ ID NO: 227703 - RNA, 32 nt, Human
ucacgccacugcacuccagccugggcgacagu

SEQ ID NO: 227704 - RNA, 32 nt, Human
ucacgccacugcacuccagccugggcgaugga

SEQ ID NO: 227705 - RNA, 32 nt, Human
ucacgccacugcacuccagccugggcugcagg

SEQ ID NO: 227706 - RNA, 32 nt, Human
ucacgccacugcacuccagccuggguaacaag

SEQ ID NO: 227707 - RNA, 32 nt, Human
ucacgccacugcacuccagccuggguaacaga

SEQ ID NO: 227708 - RNA, 32 nt, Human
ucacgccacugcacuccagccugggugacaga

SEQ ID NO: 227709 - RNA, 32 nt, Human
ucacgccacugcacuccagccuggucaacaga

SEQ ID NO: 227710 - RNA, 32 nt, Human
ucacgccacugcacuccagccuggugacagag

SEQ ID NO: 227711 - RNA, 32 nt, Human
ucacgccacugcacuccagccuggugacagcg

SEQ ID NO: 227712 - RNA, 32 nt, Human
ucacgccacugcacuccagccuguugacaaag

SEQ ID NO: 227713 - RNA, 32 nt, Human
ucacgccacugcacuccagcuggagugacaga

SEQ ID NO: 227714 - RNA, 32 nt, Human
ucacgccacugcacuccagcuugggugacaaa

SEQ ID NO: 227715 - RNA, 32 nt, Human
ucacgccacugcacuccagucugggugacaga

SEQ ID NO: 227716 - RNA, 32 nt, Human
ucacgccacugcacuccauccagccuggguga

SEQ ID NO: 227717 - RNA, 32 nt, Human
ucacgccacugcacucuagccuaggcgacaga

SEQ ID NO: 227718 - RNA, 32 nt, Human
ucacgccacugcacucuagccugggauacaga

SEQ ID NO: 227719 - RNA, 32 nt, Human
ucacgccacugcacucuagccugggcaacaag

SEQ ID NO: 227720 - RNA, 32 nt, Human
ucacgccacugcacucuagccugggcaauaag

SEQ ID NO: 227721 - RNA, 32 nt, Human
ucacgccacugcacuugagccugggcgacaca

SEQ ID NO: 227722 - RNA, 32 nt, Human
ucacgccacugcauuacagccuggugcagagc

SEQ ID NO: 227723 - RNA, 32 nt, Human
ucacgccacugcauuccagacugggcgacaga

SEQ ID NO: 227724 - RNA, 32 nt, Human
ucacgccacugcauuccagccugggcgacaga

SEQ ID NO: 227725 - RNA, 32 nt, Human
ucacgccacugcauuccagccuggugacagag

SEQ ID NO: 227726 - RNA, 32 nt, Human
ucacgccacugcauuccagccugugcgacaga

SEQ ID NO: 227727 - RNA, 32 nt, Human
ucacgccacugcauucuauccugggcaacaga

SEQ ID NO: 227728 - RNA, 32 nt, Human
ucacgccacugcccuccagccuggggagacag

SEQ ID NO: 227729 - RNA, 32 nt, Human
ucacgccacugcgcuacagccugggcgacaca

SEQ ID NO: 227730 - RNA, 32 nt, Human
ucacgccacugcgcuccagccugggcgaaaga

SEQ ID NO: 227731 - RNA, 32 nt, Human
ucacgccacuguacuccagccuggaugacaca

SEQ ID NO: 227732 - RNA, 32 nt, Human
ucacgccacuguacuccagccugggagacaca

SEQ ID NO: 227733 - RNA, 32 nt, Human
ucacgccacugugcuccagccugggcaacaaa

SEQ ID NO: 227734 - RNA, 32 nt, Human
ucacgccagaagcacacuugaggcugcagucg

SEQ ID NO: 227735 - RNA, 32 nt, Human
ucacgccagcugcaguguggaggcacaagugg

SEQ ID NO: 227736 - RNA, 24 nt, Human
ucacgccaggaaucccagcacuuu

SEQ ID NO: 227737 - RNA, 32 nt, Human
ucacgccaggaaucccagcacuuugggaggcc

SEQ ID NO: 227738 - RNA, 32 nt, Human
ucacgccaggaggcuguggcugcugugggccc

SEQ ID NO: 227739 - RNA, 21 nt, Human
ucacgccaguaaucccagcac

SEQ ID NO: 227740 - RNA, 24 nt, Human
ucacgccaguaaucccagcacuuu

SEQ ID NO: 227741 - RNA, 32 nt, Human
ucacgccaguaaucccagcacuuuggagggcu

SEQ ID NO: 227742 - RNA, 32 nt, Human
ucacgccaguaaucccagcacuuugggaggcc

SEQ ID NO: 227743 - RNA, 32 nt, Human
ucacgccagugcacuccagccugagagacaga

SEQ ID NO: 227744 - RNA, 32 nt, Human
ucacgccaucacacugcagccuaggugacaga

SEQ ID NO: 227745 - RNA, 32 nt, Human
ucacgccauuacacuccagccuggcugacagu

SEQ ID NO: 227746 - RNA, 32 nt, Human
ucacgccauuacacuccagccugggcaacaga

SEQ ID NO: 227747 - RNA, 32 nt, Human
ucacgccauugcacuacagccugggugacaga

SEQ ID NO: 227748 - RNA, 32 nt, Human
ucacgccauugcacuccaaccugggugacaag

SEQ ID NO: 227749 - RNA, 32 nt, Human
ucacgccauugcacuccagccuaggcaacgag

SEQ ID NO: 227750 - RNA, 32 nt, Human
ucacgccauugcacuccagccuaggcgacaga

SEQ ID NO: 227751 - RNA, 32 nt, Human
ucacgccauugcacuccagccugggcaacaag

SEQ ID NO: 227752 - RNA, 32 nt, Human
ucacgccauugcacuccagccugggcaacaga

SEQ ID NO: 227753 - RNA, 32 nt, Human
ucacgccauugcacuccagccugggcaacagu

SEQ ID NO: 227754 - RNA, 32 nt, Human
ucacgccauugcacuccagccugggcaacgag

SEQ ID NO: 227755 - RNA, 32 nt, Human
ucacgccauugcacuccagccugggcaauaag

SEQ ID NO: 227756 - RNA, 32 nt, Human
ucacgccauugcacuccagccugggcgacaga

SEQ ID NO: 227757 - RNA, 32 nt, Human
ucacgccauugcacuccagccugggggacaga

SEQ ID NO: 227758 - RNA, 32 nt, Human
ucacgccauugcacuccagccugggugacaca

SEQ ID NO: 227759 - RNA, 32 nt, Human
ucacgccauugcacuccagccugggugacaga

SEQ ID NO: 227760 - RNA, 32 nt, Human
ucacgccauugcacuccagccugugcgacaag

SEQ ID NO: 227761 - RNA, 32 nt, Human
ucacgccauugcacuccagucugagcaacaag

SEQ ID NO: 227762 - RNA, 32 nt, Human
ucacgccauugcacuccagucugguugacaga

SEQ ID NO: 227763 - RNA, 32 nt, Human
ucacgccauuguacuccagccuggcaacagag

SEQ ID NO: 227764 - RNA, 32 nt, Human
ucacgccauuguacuccagccugggcaacaag

SEQ ID NO: 227765 - RNA, 32 nt, Human
ucacgccauuguacuccagccugggcgacaga

SEQ ID NO: 227766 - RNA, 23 nt, Human
ucacgcccauaauccagcacuuu

SEQ ID NO: 227767 - RNA, 32 nt, Human
ucacgcccauaaucccagcacuuugggaggcc

SEQ ID NO: 227768 - RNA, 24 nt, Human
ucacgcccguaaucccagggcuuu

SEQ ID NO: 227769 - RNA, 23 nt, Human
ucacgcccucugaacugcucuuc

SEQ ID NO: 227770 - RNA, 22 nt, Human
ucacgcccuucaaugcugcagg

SEQ ID NO: 227771 - RNA, 32 nt, Human
ucacgcccuuuccaccaugugagguuauggug

SEQ ID NO: 227772 - RNA, 21 nt, Human
ucacgcccuuucuccccgccu

SEQ ID NO: 227773 - RNA, 32 nt, Human
ucacgcccuuucuccccgccuuuuugcugggc

SEQ ID NO: 227774 - RNA, 32 nt, Human
ucacgccgcugcacuccagccugagcacagag

SEQ ID NO: 227775 - RNA, 32 nt, Human
ucacgccgcugcacuccagcuugaaugacaga

SEQ ID NO: 227776 - RNA, 24 nt, Human
ucacgccgguaaucccagcacuuu

SEQ ID NO: 227777 - RNA, 32 nt, Human
ucacgccgguaaucccagcacuuugggaggcc

SEQ ID NO: 227778 - RNA, 32 nt, Human
ucacgccgguaaucccagcauuucgggaggcu

SEQ ID NO: 227779 - RNA, 23 nt, Human
ucacgccguaaugccaacacuuu

SEQ ID NO: 227780 - RNA, 32 nt, Human
ucacgccgucccgcagggcccagcacagcccc

SEQ ID NO: 227781 - RNA, 32 nt, Human
ucacgccguugcacuccagccugggcaacaag

SEQ ID NO: 227782 - RNA, 32 nt, Human
ucacgccuacagccccaacacaagcuccaguc

SEQ ID NO: 227783 - RNA, 24 nt, Human
ucacgccuagaaucccagcacuuu

SEQ ID NO: 227784 - RNA, 24 nt, Human
ucacgccuauaaucccaacaguuu

SEQ ID NO: 227785 - RNA, 32 nt, Human
ucacgccuauaaucccagaggcugaggcaggc

SEQ ID NO: 227786 - RNA, 32 nt, Human
ucacgccuauaaucccagcacagugggaggcc

SEQ ID NO: 227787 - RNA, 23 nt, Human
ucacgccuauaaucccagcacuu

SEQ ID NO: 227788 - RNA, 32 nt, Human
ucacgccuauaaucccagcacuuagggaggcc

SEQ ID NO: 227789 - RNA, 32 nt, Human
ucacgccuauaaucccagcacuuccagagucc

SEQ ID NO: 227790 - RNA, 24 nt, Human
ucacgccuauaaucccagcacuuu

SEQ ID NO: 227791 - RNA, 32 nt, Human
ucacgccuauaaucccagcacuuuaggaggcc

SEQ ID NO: 227792 - RNA, 32 nt, Human
ucacgccuauaaucccagcacuuugcgaggcc

SEQ ID NO: 227793 - RNA, 32 nt, Human
ucacgccuauaaucccagcacuuugggaggcc

SEQ ID NO: 227794 - RNA, 32 nt, Human
ucacgccuauaaucccagcacuuugggaggcu

SEQ ID NO: 227795 - RNA, 32 nt, Human
ucacgccuauaaucccagcaguuugggaggcu

SEQ ID NO: 227796 - RNA, 32 nt, Human
ucacgccuauaaucccagcauuuugggaggcc

SEQ ID NO: 227797 - RNA, 24 nt, Human
ucacgccuauaauccuaucacuuu

SEQ ID NO: 227798 - RNA, 21 nt, Human
ucacgccuauaaucucagcac

SEQ ID NO: 227799 - RNA, 22 nt, Human
ucacgccuauaaucucagcacu

SEQ ID NO: 227800 - RNA, 24 nt, Human
ucacgccuauaaucucagcacuuu

SEQ ID NO: 227801 - RNA, 24 nt, Human
ucacgccuauaauuccagcacuuu

SEQ ID NO: 227802 - RNA, 24 nt, Human
ucacgccuauacacccagcacuuu

SEQ ID NO: 227803 - RNA, 24 nt, Human
ucacgccuaugaucccagcacuuu

SEQ ID NO: 227804 - RNA, 32 nt, Human
ucacgccuaugaucccagcacuuugggaggcu

SEQ ID NO: 227805 - RNA, 24 nt, Human
ucacgccucuaaucccagcacuuu

SEQ ID NO: 227806 - RNA, 32 nt, Human
ucacgccucuaaucccagcacuuugggagguc

SEQ ID NO: 227807 - RNA, 24 nt, Human
ucacgccucuaaucccaggacuuu

SEQ ID NO: 227808 - RNA, 32 nt, Human
ucacgccucuaaucccaggacuuugggaggcc

SEQ ID NO: 227809 - RNA, 24 nt, Human
ucacgccucuaaucgcagcacuuu

SEQ ID NO: 227810 - RNA, 24 nt, Human
ucacgccucuaaucucagcacuuu

SEQ ID NO: 227811 - RNA, 32 nt, Human
ucacgccucugcacuccagccugggcaacaag

SEQ ID NO: 227812 - RNA, 24 nt, Human
ucacgccugaaaucccagcacuuu

SEQ ID NO: 227813 - RNA, 32 nt, Human
ucacgccugaaaucccagcacuuugggagacu

SEQ ID NO: 227814 - RNA, 32 nt, Human
ucacgccugaaaucccagcacuuugggaggcc

SEQ ID NO: 227815 - RNA, 24 nt, Human
ucacgccugaaaucucagcacuuu

SEQ ID NO: 227816 - RNA, 32 nt, Human
ucacgccugcaaucccaacacuuuaggaggcc

SEQ ID NO: 227817 - RNA, 32 nt, Human
ucacgccugcaaucccagagcuuugggaagcc

SEQ ID NO: 227818 - RNA, 32 nt, Human
ucacgccugcaaucccagcaccaugggaggcu

SEQ ID NO: 227819 - RNA, 24 nt, Human
ucacgccugcaaucccagcacuuu

SEQ ID NO: 227820 - RNA, 32 nt, Human
ucacgccugcaaucccagcacuuugggagacu

SEQ ID NO: 227821 - RNA, 32 nt, Human
ucacgccugcaaucccagcacuuugggaggcc

SEQ ID NO: 227822 - RNA, 32 nt, Human
ucacgccugcaaucccagcgcuuugggaggcc

SEQ ID NO: 227823 - RNA, 24 nt, Human
ucacgccugcagucccagcacuuu

SEQ ID NO: 227824 - RNA, 22 nt, Human
ucacgccuggaaucccagcacu

SEQ ID NO: 227825 - RNA, 32 nt, Human
ucacgccuggaaucccagcacugugggaggcc

SEQ ID NO: 227826 - RNA, 23 nt, Human
ucacgccuggaaucccagcacuu

SEQ ID NO: 227827 - RNA, 32 nt, Human
ucacgccuggaaucccagcacuugaggccagg

SEQ ID NO: 227828 - RNA, 24 nt, Human
ucacgccuggaaucccagcacuuu

SEQ ID NO: 227829 - RNA, 32 nt, Human
ucacgccuggaaucccagcacuuugggaagcc

SEQ ID NO: 227830 - RNA, 32 nt, Human
ucacgccuggaaucccagcacuuugggaggcc

SEQ ID NO: 227831 - RNA, 32 nt, Human
ucacgccuggaaucccagcauuuugggaggcc

SEQ ID NO: 227832 - RNA, 24 nt, Human
ucacgccuguaaacccagcacuuu

SEQ ID NO: 227833 - RNA, 32 nt, Human
ucacgccuguaaccccaacacuuugggaggcc

SEQ ID NO: 227834 - RNA, 21 nt, Human
ucacgccuguaaccccagcac

SEQ ID NO: 227835 - RNA, 32 nt, Human
ucacgccuguaaccccagcacauugggaggcc

SEQ ID NO: 227836 - RNA, 24 nt, Human
ucacgccuguaaccccagcacuuu

SEQ ID NO: 227837 - RNA, 32 nt, Human
ucacgccuguaaccccagcacuuugggaggcc

SEQ ID NO: 227838 - RNA, 32 nt, Human
ucacgccuguaaccccagcacuuugggaggcu

SEQ ID NO: 227839 - RNA, 24 nt, Human
ucacgccuguaaccccaucacuuu

SEQ ID NO: 227840 - RNA, 32 nt, Human
ucacgccuguaaccccaucacuuugggaggcc

SEQ ID NO: 227841 - RNA, 32 nt, Human
ucacgccuguaacccuagcacuuugggagucc

SEQ ID NO: 227842 - RNA, 22 nt, Human
ucacgccuguaaccucagcacu

SEQ ID NO: 227843 - RNA, 32 nt, Human
ucacgccuguaaccucagcacugugggaggcc

SEQ ID NO: 227844 - RNA, 24 nt, Human
ucacgccuguaaccucagcacuuu

SEQ ID NO: 227845 - RNA, 32 nt, Human
ucacgccuguaaccucagcacuuugggaggcc

SEQ ID NO: 227846 - RNA, 21 nt, Human
ucacgccuguaauaccagcac

SEQ ID NO: 227847 - RNA, 32 nt, Human
ucacgccuguaauaccagcaccuuagaggucg

SEQ ID NO: 227848 - RNA, 22 nt, Human
ucacgccuguaauaccagcacu

SEQ ID NO: 227849 - RNA, 24 nt, Human
ucacgccuguaauaccagcacuuu

SEQ ID NO: 227850 - RNA, 32 nt, Human
ucacgccuguaauaccagcacuuugggaggcu

SEQ ID NO: 227851 - RNA, 24 nt, Human
ucacgccuguaaucacagcacuuu

SEQ ID NO: 227852 - RNA, 32 nt, Human
ucacgccuguaaucacagcacuuugggaggcc

SEQ ID NO: 227853 - RNA, 32 nt, Human
ucacgccuguaaucacagcacuuugggaggcu

SEQ ID NO: 227854 - RNA, 24 nt, Human
ucacgccuguaaucacaguauuuu

SEQ ID NO: 227855 - RNA, 23 nt, Human
ucacgccuguaauccaacacuuu

SEQ ID NO: 227856 - RNA, 32 nt, Human
ucacgccuguaauccaacacuuugagaggcug

SEQ ID NO: 227857 - RNA, 23 nt, Human
ucacgccuguaauccaagcacuu

SEQ ID NO: 227858 - RNA, 32 nt, Human
ucacgccuguaauccaagcacuuggggaggcc

SEQ ID NO: 227859 - RNA, 32 nt, Human
ucacgccuguaauccagcaauuugggaggcca

SEQ ID NO: 227860 - RNA, 21 nt, Human
ucacgccuguaauccagcacu

SEQ ID NO: 227861 - RNA, 32 nt, Human
ucacgccuguaauccagcacugugggaggccu

SEQ ID NO: 227862 - RNA, 23 nt, Human
ucacgccuguaauccagcacuuu

SEQ ID NO: 227863 - RNA, 32 nt, Human
ucacgccuguaauccagcacuuugggaggccc

SEQ ID NO: 227864 - RNA, 24 nt, Human
ucacgccuguaaucccaaagugcu

SEQ ID NO: 227865 - RNA, 32 nt, Human
ucacgccuguaaucccaaagugcugggauuac

SEQ ID NO: 227866 - RNA, 32 nt, Human
ucacgccuguaaucccaacaacacuuugggag

SEQ ID NO: 227867 - RNA, 21 nt, Human
ucacgccuguaaucccaacac

SEQ ID NO: 227868 - RNA, 32 nt, Human
ucacgccuguaaucccaacaccuugggaggcc

SEQ ID NO: 227869 - RNA, 32 nt, Human
ucacgccuguaaucccaacacucugggaggcc

SEQ ID NO: 227870 - RNA, 23 nt, Human
ucacgccuguaaucccaacacuu

SEQ ID NO: 227871 - RNA, 24 nt, Human
ucacgccuguaaucccaacacuuu

SEQ ID NO: 227872 - RNA, 32 nt, Human
ucacgccuguaaucccaacacuuuaggagacc

SEQ ID NO: 227873 - RNA, 32 nt, Human
ucacgccuguaaucccaacacuuuaggagucc

SEQ ID NO: 227874 - RNA, 32 nt, Human
ucacgccuguaaucccaacacuuugggagccc

SEQ ID NO: 227875 - RNA, 32 nt, Human
ucacgccuguaaucccaacacuuugggaggca

SEQ ID NO: 227876 - RNA, 32 nt, Human
ucacgccuguaaucccaacacuuugggaggcc

SEQ ID NO: 227877 - RNA, 32 nt, Human
ucacgccuguaaucccaacacuuugggaggcu

SEQ ID NO: 227878 - RNA, 32 nt, Human
ucacgccuguaaucccaacacuuugggaggug

SEQ ID NO: 227879 - RNA, 32 nt, Human
ucacgccuguaaucccaacacuuuucgaggcc

SEQ ID NO: 227880 - RNA, 24 nt, Human
ucacgccuguaaucccaacauuuu

SEQ ID NO: 227881 - RNA, 32 nt, Human
ucacgccuguaaucccaacauuuugggaggcc

SEQ ID NO: 227882 - RNA, 32 nt, Human
ucacgccuguaaucccaauacuuugggaggcc

SEQ ID NO: 227883 - RNA, 24 nt, Human
ucacgccuguaaucccaccacuuu

SEQ ID NO: 227884 - RNA, 32 nt, Human
ucacgccuguaaucccaccacuuuggaaagcu

SEQ ID NO: 227885 - RNA, 32 nt, Human
ucacgccuguaaucccaccacuuugggaggac

SEQ ID NO: 227886 - RNA, 22 nt, Human
ucacgccuguaaucccagaacu

SEQ ID NO: 227887 - RNA, 32 nt, Human
ucacgccuguaaucccagaacuaugugaggcu

SEQ ID NO: 227888 - RNA, 32 nt, Human
ucacgccuguaaucccagaacucugggaagcc

SEQ ID NO: 227889 - RNA, 24 nt, Human
ucacgccuguaaucccagaacuuu

SEQ ID NO: 227890 - RNA, 32 nt, Human
ucacgccuguaaucccagaacuuuaggaggcu

SEQ ID NO: 227891 - RNA, 32 nt, Human
ucacgccuguaaucccagaacuuugagaggcc

SEQ ID NO: 227892 - RNA, 32 nt, Human
ucacgccuguaaucccagaacuuugggaagcc

SEQ ID NO: 227893 - RNA, 32 nt, Human
ucacgccuguaaucccagaacuuugggaggcu

SEQ ID NO: 227894 - RNA, 24 nt, Human
ucacgccuguaaucccagaauuuu

SEQ ID NO: 227895 - RNA, 32 nt, Human
ucacgccuguaaucccagaauuuuaggaggcu

SEQ ID NO: 227896 - RNA, 21 nt, Human
ucacgccuguaaucccagacu

SEQ ID NO: 227897 - RNA, 23 nt, Human
ucacgccuguaaucccagacuuu

SEQ ID NO: 227898 - RNA, 32 nt, Human
ucacgccuguaaucccagacuuugggaggccg

SEQ ID NO: 227899 - RNA, 20 nt, Human
ucacgccuguaaucccagca

SEQ ID NO: 227900 - RNA, 24 nt, Human
ucacgccuguaaucccagcaaguu

SEQ ID NO: 227901 - RNA, 32 nt, Human
ucacgccuguaaucccagcaaguugggaggcu

SEQ ID NO: 227902 - RNA, 32 nt, Human
ucacgccuguaaucccagcaauugggaaggcc

SEQ ID NO: 227903 - RNA, 32 nt, Human
ucacgccuguaaucccagcaauuugggaggcu

SEQ ID NO: 227904 - RNA, 32 nt, Human
ucacgccuguaaucccagcaauuugggagguc

SEQ ID NO: 227905 - RNA, 32 nt, Human
ucacgccuguaaucccagcaauuugggagucc

SEQ ID NO: 227906 - RNA, 21 nt, Human
ucacgccuguaaucccagcac

SEQ ID NO: 227907 - RNA, 32 nt, Human
ucacgccuguaaucccagcacacugggaggcc

SEQ ID NO: 227908 - RNA, 32 nt, Human
ucacgccuguaaucccagcacauugggaggcc

SEQ ID NO: 227909 - RNA, 32 nt, Human
ucacgccuguaaucccagcaccuugggaggcc

SEQ ID NO: 227910 - RNA, 32 nt, Human
ucacgccuguaaucccagcaccuugggaggcu

SEQ ID NO: 227911 - RNA, 32 nt, Human
ucacgccuguaaucccagcacgcugggaggcc

SEQ ID NO: 227912 - RNA, 22 nt, Human
ucacgccuguaaucccagcacu

SEQ ID NO: 227913 - RNA, 32 nt, Human
ucacgccuguaaucccagcacuaggaggccga

SEQ ID NO: 227914 - RNA, 32 nt, Human
ucacgccuguaaucccagcacucugggaggca

SEQ ID NO: 227915 - RNA, 32 nt, Human
ucacgccuguaaucccagcacucugggaggcu

SEQ ID NO: 227916 - RNA, 32 nt, Human
ucacgccuguaaucccagcacugagaggccga

SEQ ID NO: 227917 - RNA, 32 nt, Human
ucacgccuguaaucccagcacuggaaggccaa

SEQ ID NO: 227918 - RNA, 32 nt, Human
ucacgccuguaaucccagcacugggaggccga

SEQ ID NO: 227919 - RNA, 32 nt, Human
ucacgccuguaaucccagcacugugagaggcu

SEQ ID NO: 227920 - RNA, 32 nt, Human
ucacgccuguaaucccagcacugugggaggcc

SEQ ID NO: 227921 - RNA, 32 nt, Human
ucacgccuguaaucccagcacugugggaggcg

SEQ ID NO: 227922 - RNA, 23 nt, Human
ucacgccuguaaucccagcacuu

SEQ ID NO: 227923 - RNA, 32 nt, Human
ucacgccuguaaucccagcacuuaggaagacc

SEQ ID NO: 227924 - RNA, 32 nt, Human
ucacgccuguaaucccagcacuuagggaggcu

SEQ ID NO: 227925 - RNA, 32 nt, Human
ucacgccuguaaucccagcacuuagggugggc

SEQ ID NO: 227926 - RNA, 32 nt, Human
ucacgccuguaaucccagcacuucgggaggcc

SEQ ID NO: 227927 - RNA, 32 nt, Human
ucacgccuguaaucccagcacuugggaggcca

SEQ ID NO: 227928 - RNA, 32 nt, Human
ucacgccuguaaucccagcacuuggggaggac

SEQ ID NO: 227929 - RNA, 32 nt, Human
ucacgccuguaaucccagcacuuggggaggcc

SEQ ID NO: 227930 - RNA, 32 nt, Human
ucacgccuguaaucccagcacuuggggaggcu

SEQ ID NO: 227931 - RNA, 24 nt, Human
ucacgccuguaaucccagcacuuu

SEQ ID NO: 227932 - RNA, 32 nt, Human
ucacgccuguaaucccagcacuuuaagaggcc

SEQ ID NO: 227933 - RNA, 32 nt, Human
ucacgccuguaaucccagcacuuuagaucacu

SEQ ID NO: 227934 - RNA, 32 nt, Human
ucacgccuguaaucccagcacuuuaggaggcc

SEQ ID NO: 227935 - RNA, 32 nt, Human
ucacgccuguaaucccagcacuuucggaggca

SEQ ID NO: 227936 - RNA, 32 nt, Human
ucacgccuguaaucccagcacuuugagaagcc

SEQ ID NO: 227937 - RNA, 32 nt, Human
ucacgccuguaaucccagcacuuugagagacc

SEQ ID NO: 227938 - RNA, 32 nt, Human
ucacgccuguaaucccagcacuuugagaggcc

SEQ ID NO: 227939 - RNA, 32 nt, Human
ucacgccuguaaucccagcacuuugagaggcu

SEQ ID NO: 227940 - RNA, 32 nt, Human
ucacgccuguaaucccagcacuuugagaugcu

SEQ ID NO: 227941 - RNA, 32 nt, Human
ucacgccuguaaucccagcacuuugcgauacc

SEQ ID NO: 227942 - RNA, 32 nt, Human
ucacgccuguaaucccagcacuuugcggggcu

SEQ ID NO: 227943 - RNA, 32 nt, Human
ucacgccuguaaucccagcacuuuggaaggcc

SEQ ID NO: 227944 - RNA, 32 nt, Human
ucacgccuguaaucccagcacuuuggaaggcu

SEQ ID NO: 227945 - RNA, 32 nt, Human
ucacgccuguaaucccagcacuuuggaggcca

SEQ ID NO: 227946 - RNA, 32 nt, Human
ucacgccuguaaucccagcacuuuggcaggcc

SEQ ID NO: 227947 - RNA, 32 nt, Human
ucacgccuguaaucccagcacuuugggaagcc

SEQ ID NO: 227948 - RNA, 32 nt, Human
ucacgccuguaaucccagcacuuugggaagcu

SEQ ID NO: 227949 - RNA, 32 nt, Human
ucacgccuguaaucccagcacuuugggacacc

SEQ ID NO: 227950 - RNA, 32 nt, Human
ucacgccuguaaucccagcacuuugggagccc

SEQ ID NO: 227951 - RNA, 32 nt, Human
ucacgccuguaaucccagcacuuugggaggac

SEQ ID NO: 227952 - RNA, 32 nt, Human
ucacgccuguaaucccagcacuuugggaggau

SEQ ID NO: 227953 - RNA, 32 nt, Human
ucacgccuguaaucccagcacuuugggaggca

SEQ ID NO: 227954 - RNA, 32 nt, Human
ucacgccuguaaucccagcacuuugggaggcc

SEQ ID NO: 227955 - RNA, 32 nt, Human
ucacgccuguaaucccagcacuuugggaggcg

SEQ ID NO: 227956 - RNA, 32 nt, Human
ucacgccuguaaucccagcacuuugggaggcu

SEQ ID NO: 227957 - RNA, 32 nt, Human
ucacgccuguaaucccagcacuuugggagggc

SEQ ID NO: 227958 - RNA, 32 nt, Human
ucacgccuguaaucccagcacuuugggagggg

SEQ ID NO: 227959 - RNA, 32 nt, Human
ucacgccuguaaucccagcacuuugggagguc

SEQ ID NO: 227960 - RNA, 32 nt, Human
ucacgccuguaaucccagcacuuugggaggug

SEQ ID NO: 227961 - RNA, 32 nt, Human
ucacgccuguaaucccagcacuuugggagguu

SEQ ID NO: 227962 - RNA, 32 nt, Human
ucacgccuguaaucccagcacuuugggagucc

SEQ ID NO: 227963 - RNA, 32 nt, Human
ucacgccuguaaucccagcacuuugggaugcc

SEQ ID NO: 227964 - RNA, 32 nt, Human
ucacgccuguaaucccagcacuuuggggagcc

SEQ ID NO: 227965 - RNA, 32 nt, Human
ucacgccuguaaucccagcacuuugguaggcc

SEQ ID NO: 227966 - RNA, 32 nt, Human
ucacgccuguaaucccagcacuuugguugggu

SEQ ID NO: 227967 - RNA, 32 nt, Human
ucacgccuguaaucccagcacuuuguggggcu

SEQ ID NO: 227968 - RNA, 32 nt, Human
ucacgccuguaaucccagcacuuuucagaggc

SEQ ID NO: 227969 - RNA, 32 nt, Human
ucacgccuguaaucccagcacuuuuggaggcc

SEQ ID NO: 227970 - RNA, 32 nt, Human
ucacgccuguaaucccagcacuuuugggaggc

SEQ ID NO: 227971 - RNA, 24 nt, Human
ucacgccuguaaucccagcaguuu

SEQ ID NO: 227972 - RNA, 32 nt, Human
ucacgccuguaaucccagcaguuugggaagcc

SEQ ID NO: 227973 - RNA, 32 nt, Human
ucacgccuguaaucccagcaguuugggagguc

SEQ ID NO: 227974 - RNA, 23 nt, Human
ucacgccuguaaucccagcauuu

SEQ ID NO: 227975 - RNA, 32 nt, Human
ucacgccuguaaucccagcauuugggaggcug

SEQ ID NO: 227976 - RNA, 24 nt, Human
ucacgccuguaaucccagcauuuu

SEQ ID NO: 227977 - RNA, 32 nt, Human
ucacgccuguaaucccagcauuuugggagcuu

SEQ ID NO: 227978 - RNA, 32 nt, Human
ucacgccuguaaucccagcauuuugggaggcc

SEQ ID NO: 227979 - RNA, 32 nt, Human
ucacgccuguaaucccagcauuuugggaggcu

SEQ ID NO: 227980 - RNA, 22 nt, Human
ucacgccuguaaucccagcccu

SEQ ID NO: 227981 - RNA, 32 nt, Human
ucacgccuguaaucccagcccuaugggaggcu

SEQ ID NO: 227982 - RNA, 24 nt, Human
ucacgccuguaaucccagcccuuu

SEQ ID NO: 227983 - RNA, 32 nt, Human
ucacgccuguaaucccagcccuuugggaggcc

SEQ ID NO: 227984 - RNA, 32 nt, Human
ucacgccuguaaucccagcccuuugggaggcu

SEQ ID NO: 227985 - RNA, 24 nt, Human
ucacgccuguaaucccagcgcuuu

SEQ ID NO: 227986 - RNA, 32 nt, Human
ucacgccuguaaucccagcgcuuugggagagc

SEQ ID NO: 227987 - RNA, 32 nt, Human
ucacgccuguaaucccagcgcuuugggaggca

SEQ ID NO: 227988 - RNA, 32 nt, Human
ucacgccuguaaucccagcgcuuugggaggcc

SEQ ID NO: 227989 - RNA, 23 nt, Human
ucacgccuguaaucccagcuacu

SEQ ID NO: 227990 - RNA, 32 nt, Human
ucacgccuguaaucccagcuacucaggaggcu

SEQ ID NO: 227991 - RNA, 24 nt, Human
ucacgccuguaaucccagcucuuu

SEQ ID NO: 227992 - RNA, 32 nt, Human
ucacgccuguaaucccagcucuuugggaggcc

SEQ ID NO: 227993 - RNA, 32 nt, Human
ucacgccuguaaucccagcucuuugggaggcu

SEQ ID NO: 227994 - RNA, 32 nt, Human
ucacgccuguaaucccagcucuuuguggggcc

SEQ ID NO: 227995 - RNA, 32 nt, Human
ucacgccuguaaucccaggacuuuaggaggcc

SEQ ID NO: 227996 - RNA, 32 nt, Human
ucacgccuguaaucccaggacuuugggaggcc

SEQ ID NO: 227997 - RNA, 32 nt, Human
ucacgccuguaaucccagggugcugagauuac

SEQ ID NO: 227998 - RNA, 32 nt, Human
ucacgccuguaaucccaguacugugggaggcc

SEQ ID NO: 227999 - RNA, 23 nt, Human
ucacgccuguaaucccaguacuu

SEQ ID NO: 228000 - RNA, 32 nt, Human
ucacgccuguaaucccaguacuugggaggcca

SEQ ID NO: 228001 - RNA, 24 nt, Human
ucacgccuguaaucccaguacuuu

SEQ ID NO: 228002 - RNA, 32 nt, Human
ucacgccuguaaucccaguacuuugggagcca

SEQ ID NO: 228003 - RNA, 32 nt, Human
ucacgccuguaaucccaguacuuugggaggcc

SEQ ID NO: 228004 - RNA, 32 nt, Human
ucacgccuguaaucccaguacuuugggaggcu

SEQ ID NO: 228005 - RNA, 24 nt, Human
ucacgccuguaaucccaguaguuu

SEQ ID NO: 228006 - RNA, 32 nt, Human
ucacgccuguaaucccaguaguuugggaggcc

SEQ ID NO: 228007 - RNA, 32 nt, Human
ucacgccuguaaucccaguauuuugggagucc

SEQ ID NO: 228008 - RNA, 24 nt, Human
ucacgccuguaaucccaucacuuu

SEQ ID NO: 228009 - RNA, 32 nt, Human
ucacgccuguaaucccaucacuuugggaggcu

SEQ ID NO: 228010 - RNA, 23 nt, Human
ucacgccuguaaucccaucauuu

SEQ ID NO: 228011 - RNA, 23 nt, Human
ucacgccuguaauccccacacuu

SEQ ID NO: 228012 - RNA, 32 nt, Human
ucacgccuguaaucccccagcaauuugggagg

SEQ ID NO: 228013 - RNA, 32 nt, Human
ucacgccuguaauccccgcacuuugggaggcc

SEQ ID NO: 228014 - RNA, 22 nt, Human
ucacgccuguaaucccggcacu

SEQ ID NO: 228015 - RNA, 32 nt, Human
ucacgccuguaaucccggcacugugggaggcu

SEQ ID NO: 228016 - RNA, 24 nt, Human
ucacgccuguaaucccggcacuuu

SEQ ID NO: 228017 - RNA, 32 nt, Human
ucacgccuguaaucccggcacuuugggaggcc

SEQ ID NO: 228018 - RNA, 32 nt, Human
ucacgccuguaaucccggcacuuugggaggcu

SEQ ID NO: 228019 - RNA, 32 nt, Human
ucacgccuguaaucccggcaguuugggaggcu

SEQ ID NO: 228020 - RNA, 32 nt, Human
ucacgccuguaaucccgguauuuugggaggcc

SEQ ID NO: 228021 - RNA, 24 nt, Human
ucacgccuguaaucccuacacuuu

SEQ ID NO: 228022 - RNA, 32 nt, Human
ucacgccuguaaucccuacacuuugggaggcc

SEQ ID NO: 228023 - RNA, 24 nt, Human
ucacgccuguaaucccugcacuuu

SEQ ID NO: 228024 - RNA, 24 nt, Human
ucacgccuguaaucccugcauuuu

SEQ ID NO: 228025 - RNA, 32 nt, Human
ucacgccuguaaucccuuagcuacucaggagg

SEQ ID NO: 228026 - RNA, 24 nt, Human
ucacgccuguaauccgagcacuuu

SEQ ID NO: 228027 - RNA, 24 nt, Human
ucacgccuguaauccuaacacuuu

SEQ ID NO: 228028 - RNA, 32 nt, Human
ucacgccuguaauccuaacacuuugggaggcc

SEQ ID NO: 228029 - RNA, 32 nt, Human
ucacgccuguaauccuagcaauuugggaggcc

SEQ ID NO: 228030 - RNA, 21 nt, Human
ucacgccuguaauccuagcac

SEQ ID NO: 228031 - RNA, 32 nt, Human
ucacgccuguaauccuagcaccuugggaggcc

SEQ ID NO: 228032 - RNA, 32 nt, Human
ucacgccuguaauccuagcaccuuggggguca

SEQ ID NO: 228033 - RNA, 23 nt, Human
ucacgccuguaauccuagcacuu

SEQ ID NO: 228034 - RNA, 32 nt, Human
ucacgccuguaauccuagcacuugggaggcag

SEQ ID NO: 228035 - RNA, 24 nt, Human
ucacgccuguaauccuagcacuuu

SEQ ID NO: 228036 - RNA, 32 nt, Human
ucacgccuguaauccuagcacuuuggaaggcc

SEQ ID NO: 228037 - RNA, 32 nt, Human
ucacgccuguaauccuagcacuuugggaggcc

SEQ ID NO: 228038 - RNA, 32 nt, Human
ucacgccuguaauccuagcacuuugggaggcu

SEQ ID NO: 228039 - RNA, 32 nt, Human
ucacgccuguaauccuagcacuuuugggaggc

SEQ ID NO: 228040 - RNA, 24 nt, Human
ucacgccuguaauccuagcaguuu

SEQ ID NO: 228041 - RNA, 32 nt, Human
ucacgccuguaauccuagcaguuugggaggcu

SEQ ID NO: 228042 - RNA, 24 nt, Human
ucacgccuguaauccuagcauuuu

SEQ ID NO: 228043 - RNA, 32 nt, Human
ucacgccuguaauccuagcauuuugggaggcc

SEQ ID NO: 228044 - RNA, 32 nt, Human
ucacgccuguaauccuagcauuuugggugacu

SEQ ID NO: 228045 - RNA, 32 nt, Human
ucacgccuguaauccuagcauuuuuggaggcc

SEQ ID NO: 228046 - RNA, 24 nt, Human
ucacgccuguaauccuagcccuuu

SEQ ID NO: 228047 - RNA, 23 nt, Human
ucacgccuguaauccuauccuuu

SEQ ID NO: 228048 - RNA, 24 nt, Human
ucacgccuguaauccuggcacuuu

SEQ ID NO: 228049 - RNA, 32 nt, Human
ucacgccuguaauccuggcacuuugggaggac

SEQ ID NO: 228050 - RNA, 32 nt, Human
ucacgccuguaauccuggcacuuugggaggcu

SEQ ID NO: 228051 - RNA, 24 nt, Human
ucacgccuguaaucgcagcacuuu

SEQ ID NO: 228052 - RNA, 32 nt, Human
ucacgccuguaaucgcagcacuuugggaggcc

SEQ ID NO: 228053 - RNA, 24 nt, Human
ucacgccuguaaucgcggcacuuu

SEQ ID NO: 228054 - RNA, 32 nt, Human
ucacgccuguaaucgcggcacuuugggaggcc

SEQ ID NO: 228055 - RNA, 24 nt, Human
ucacgccuguaaucucaacacuuu

SEQ ID NO: 228056 - RNA, 32 nt, Human
ucacgccuguaaucucaacacuuugggaggcc

SEQ ID NO: 228057 - RNA, 32 nt, Human
ucacgccuguaaucucagcacauugggaggcu

SEQ ID NO: 228058 - RNA, 24 nt, Human
ucacgccuguaaucucagcacuuu

SEQ ID NO: 228059 - RNA, 32 nt, Human
ucacgccuguaaucucagcacuuuaagaggcc

SEQ ID NO: 228060 - RNA, 32 nt, Human
ucacgccuguaaucucagcacuuugggaggcc

SEQ ID NO: 228061 - RNA, 32 nt, Human
ucacgccuguaaucucagcacuuugggaggcu

SEQ ID NO: 228062 - RNA, 32 nt, Human
ucacgccuguaaucucagcacuuuggguggcc

SEQ ID NO: 228063 - RNA, 32 nt, Human
ucacgccuguaaucucagcauuuugggaggcc

SEQ ID NO: 228064 - RNA, 32 nt, Human
ucacgccuguaaucucggcacuuugggagacu

SEQ ID NO: 228065 - RNA, 24 nt, Human
ucacgccuguaaucuuagcacuuu

SEQ ID NO: 228066 - RNA, 32 nt, Human
ucacgccuguaaugccagcacucugggaggcc

SEQ ID NO: 228067 - RNA, 24 nt, Human
ucacgccuguaaugccagcacuuu

SEQ ID NO: 228068 - RNA, 32 nt, Human
ucacgccuguaaugccagcacuuugggaggcc

SEQ ID NO: 228069 - RNA, 32 nt, Human
ucacgccuguaaugccagcacuuugggagggu

SEQ ID NO: 228070 - RNA, 32 nt, Human
ucacgccuguaauuccagcacuucgagaggcu

SEQ ID NO: 228071 - RNA, 24 nt, Human
ucacgccuguaauuccagcacuuu

SEQ ID NO: 228072 - RNA, 32 nt, Human
ucacgccuguaauuccagcacuuugagaggca

SEQ ID NO: 228073 - RNA, 32 nt, Human
ucacgccuguaauuccagcacuuugggagacu

SEQ ID NO: 228074 - RNA, 32 nt, Human
ucacgccuguaauuccagcacuuugggaggca

SEQ ID NO: 228075 - RNA, 32 nt, Human
ucacgccuguaauuccagcacuuugggaggcc

SEQ ID NO: 228076 - RNA, 32 nt, Human
ucacgccuguaauuccagcacuuugggaggcu

SEQ ID NO: 228077 - RNA, 32 nt, Human
ucacgccuguaauuccagcauguugggaggcc

SEQ ID NO: 228078 - RNA, 32 nt, Human
ucacgccuguaauuccagugcuuugggaggcc

SEQ ID NO: 228079 - RNA, 32 nt, Human
ucacgccuguaauuccaucauuuugggaggcc

SEQ ID NO: 228080 - RNA, 24 nt, Human
ucacgccuguaauucuagcacuuu

SEQ ID NO: 228081 - RNA, 32 nt, Human
ucacgccuguaauucuagcacuuugggagacu

SEQ ID NO: 228082 - RNA, 32 nt, Human
ucacgccuguaauucuagcacuuugggaggcc

SEQ ID NO: 228083 - RNA, 23 nt, Human
ucacgccuguagucccaacacuu

SEQ ID NO: 228084 - RNA, 24 nt, Human
ucacgccuguagucccaacacuuu

SEQ ID NO: 228085 - RNA, 24 nt, Human
ucacgccuguagucccagcacuuu

SEQ ID NO: 228086 - RNA, 24 nt, Human
ucacgccuguagucccagcauuuu

SEQ ID NO: 228087 - RNA, 32 nt, Human
ucacgccuguagucccagcuacuugggaggcu

SEQ ID NO: 228088 - RNA, 24 nt, Human
ucacgccuguauucccagcaguuu

SEQ ID NO: 228089 - RNA, 24 nt, Human
ucacgccugucaucccagcacuuu

SEQ ID NO: 228090 - RNA, 32 nt, Human
ucacgccugucaucccagcacuuugggaggca

SEQ ID NO: 228091 - RNA, 32 nt, Human
ucacgccugucaucccagcacuuugggaggcc

SEQ ID NO: 228092 - RNA, 32 nt, Human
ucacgccugucaucccagcacuuugggaggcu

SEQ ID NO: 228093 - RNA, 24 nt, Human
ucacgccugucauccuagcacuuu

SEQ ID NO: 228094 - RNA, 24 nt, Human
ucacgccugucaucucagcacuuu

SEQ ID NO: 228095 - RNA, 24 nt, Human
ucacgccugugaucccagcacuuu

SEQ ID NO: 228096 - RNA, 32 nt, Human
ucacgccugugaucccagcacuuugggaggcc

SEQ ID NO: 228097 - RNA, 32 nt, Human
ucacgccugugaucccagcauuuugggaggcc

SEQ ID NO: 228098 - RNA, 24 nt, Human
ucacgccugugaucccggcacuuu

SEQ ID NO: 228099 - RNA, 32 nt, Human
ucacgccugugcaguggcccccacagaaagac

SEQ ID NO: 228100 - RNA, 24 nt, Human
ucacgccuguggucccagcacuuu

SEQ ID NO: 228101 - RNA, 32 nt, Human
ucacgccuguggucccagcuacucgggaggcu

SEQ ID NO: 228102 - RNA, 24 nt, Human
ucacgccuguggucucagcacuuu

SEQ ID NO: 228103 - RNA, 32 nt, Human
ucacgccuguuaaguccagcacuuugggaggc

SEQ ID NO: 228104 - RNA, 24 nt, Human
ucacgccuguuaucccagcacuuu

SEQ ID NO: 228105 - RNA, 32 nt, Human
ucacgccuguuaucccagcacuuugggaggcc

SEQ ID NO: 228106 - RNA, 32 nt, Human
ucacgccuguuaucccagcacuuugggaggcu

SEQ ID NO: 228107 - RNA, 32 nt, Human
ucacgccuucgccguagcaucuuucgcagcgg

SEQ ID NO: 228108 - RNA, 32 nt, Human
ucacgccuuguaaucccagcacuuugggaggc

SEQ ID NO: 228109 - RNA, 32 nt, Human
ucacgccuuugucucgggcuuuugguuuucaa

SEQ ID NO: 228110 - RNA, 32 nt, Human
ucacgcgccaaggucugaauucggcguggcuc

SEQ ID NO: 228111 - RNA, 22 nt, Human
ucacgcggggaccgacugcaga

SEQ ID NO: 228112 - RNA, 32 nt, Human
ucacgcuacuccccagaucucuucccccauuc

SEQ ID NO: 228113 - RNA, 32 nt, Human
ucacgcuacugcgcuccagccugagugauaga

SEQ ID NO: 228114 - RNA, 32 nt, Human
ucacgcuacuugggaaacucacucuggccacu

SEQ ID NO: 228115 - RNA, 32 nt, Human
ucacgcucggugcaggaccucagggcugucgg

SEQ ID NO: 228116 - RNA, 32 nt, Human
ucacgcugagagaccccacuccccugcugaga

SEQ ID NO: 228117 - RNA, 22 nt, Human
ucacgcuggacugagcugcucu

SEQ ID NO: 228118 - RNA, 32 nt, Human
ucacgcugguuucuccccaggacccaugagcu

SEQ ID NO: 228119 - RNA, 32 nt, Human
ucacgcugucaccaggcuggagugcaguggcg

SEQ ID NO: 228120 - RNA, 24 nt, Human
ucacgcuuacagucccagcacuuu

SEQ ID NO: 228121 - RNA, 24 nt, Human
ucacgcuuauaaucccagcacuuu

SEQ ID NO: 228122 - RNA, 32 nt, Human
ucacgcuuauaaucccagcacuuugggaggcc

SEQ ID NO: 228123 - RNA, 32 nt, Human
ucacgcuuguaaucccaacacuuugggaggcc

SEQ ID NO: 228124 - RNA, 24 nt, Human
ucacgcuuguaaucccagcacuuu

SEQ ID NO: 228125 - RNA, 32 nt, Human
ucacgcuuguaaucccagcacuuugggaagcc

SEQ ID NO: 228126 - RNA, 32 nt, Human
ucacgcuuguaaucccagcacuuugggaagcu

SEQ ID NO: 228127 - RNA, 32 nt, Human
ucacgcuuguaaucccagcacuuugggaggcc

SEQ ID NO: 228128 - RNA, 32 nt, Human
ucacgcuuguaaucccagcacuuugggaggcu

SEQ ID NO: 228129 - RNA, 32 nt, Human
ucacgcuuguaaucccagcuacucuggaggcu

SEQ ID NO: 228130 - RNA, 32 nt, Human
ucacgcuuguaaucccaguacuuugggaggcc

SEQ ID NO: 228131 - RNA, 32 nt, Human
ucacgcuuguaaucccaucacuuugggaggcc

SEQ ID NO: 228132 - RNA, 32 nt, Human
ucacgcuuguaaucccggcacuuuaggagggc

SEQ ID NO: 228133 - RNA, 24 nt, Human
ucacgcuuguaaucgcagcacuuu

SEQ ID NO: 228134 - RNA, 24 nt, Human
ucacgcuuguaauuccagcacuuu

SEQ ID NO: 228135 - RNA, 32 nt, Human
ucacggaaaaggcagugaaguugggaguacug

SEQ ID NO: 228136 - RNA, 32 nt, Human
ucacggaccacagggaaacggagugggcgggc

SEQ ID NO: 228137 - RNA, 32 nt, Human
ucacggagaggaagggaaggaaggagagggag

SEQ ID NO: 228138 - RNA, 32 nt, Human
ucacggagagugagauagucacagagacugag

SEQ ID NO: 228139 - RNA, 32 nt, Human
ucacggaggagggaagaggaagaggcaagggg

SEQ ID NO: 228140 - RNA, 32 nt, Human
ucacggaggcugggaccaggcagcccuucggu

SEQ ID NO: 228141 - RNA, 32 nt, Human
ucacggagggcacugguugcagaggcuggaag

SEQ ID NO: 228142 - RNA, 32 nt, Human
ucacggagggccgugugacacucucgugguau

SEQ ID NO: 228143 - RNA, 32 nt, Human
ucacggcacacagcagggaaucccaggccccc

SEQ ID NO: 228144 - RNA, 32 nt, Human
ucacggcaccgacugacggccacccaccaugg

SEQ ID NO: 228145 - RNA, 32 nt, Human
ucacggcacugcgcugcagccugggcaacaca

SEQ ID NO: 228146 - RNA, 32 nt, Human
ucacggcagcaaccccagccuucccaaagcag

SEQ ID NO: 228147 - RNA, 32 nt, Human
ucacggcagggagggggcgcgggagccgccgg

SEQ ID NO: 228148 - RNA, 32 nt, Human
ucacggcauucaguuuucuugccugcagagug

SEQ ID NO: 228149 - RNA, 32 nt, Human
ucacggccacugcccaugucuuggacacugga

SEQ ID NO: 228150 - RNA, 32 nt, Human
ucacggcccgggcugggcugggcagggcaacg

SEQ ID NO: 228151 - RNA, 32 nt, Human
ucacggccucacccagcccccugggcccaugg

SEQ ID NO: 228152 - RNA, 32 nt, Human
ucacggccuccucguugguagaucuuaaggcu

SEQ ID NO: 228153 - RNA, 32 nt, Human
ucacggcucacugcaaccuccaccuccugagu

SEQ ID NO: 228154 - RNA, 32 nt, Human
ucacggcucacugcagccucaaacuccuaggc

SEQ ID NO: 228155 - RNA, 32 nt, Human
ucacggcucacugcagccucaaccuccugggc

SEQ ID NO: 228156 - RNA, 32 nt, Human
ucacggcucacugcagccucgaccuccccagc

SEQ ID NO: 228157 - RNA, 32 nt, Human
ucacggcucacugcagccucuaccuccccagg

SEQ ID NO: 228158 - RNA, 32 nt, Human
ucacggcucacugcagccuugacgcccugggc

SEQ ID NO: 228159 - RNA, 32 nt, Human
ucacggcucacugcagcuucaaacuccugggc

SEQ ID NO: 228160 - RNA, 32 nt, Human
ucacggcucacugcagucucugccucccagau

SEQ ID NO: 228161 - RNA, 32 nt, Human
ucacggcucacugcaguuucaaguuccugggc

SEQ ID NO: 228162 - RNA, 32 nt, Human
ucacggcucacugcauccucaaccuccugggu

SEQ ID NO: 228163 - RNA, 32 nt, Human
ucacggcucacuguagucucaaccuccugggc

SEQ ID NO: 228164 - RNA, 32 nt, Human
ucacggcucacuguagucucgaccucccaggc

SEQ ID NO: 228165 - RNA, 32 nt, Human
ucacggcuguaaucccagcacuuugggaggcu

SEQ ID NO: 228166 - RNA, 32 nt, Human
ucacgggaggcagaaggccaaauaaauacucu

SEQ ID NO: 228167 - RNA, 32 nt, Human
ucacgggccaccagagcaccuacuagagcagc

SEQ ID NO: 228168 - RNA, 32 nt, Human
ucacgggccugaugcaguccuccugccguucc

SEQ ID NO: 228169 - RNA, 32 nt, Human
ucacgggccuggggcccacccagcacagaucu

SEQ ID NO: 228170 - RNA, 32 nt, Human
ucacgggcuggcugagcuggacuuuggucagc

SEQ ID NO: 228171 - RNA, 32 nt, Human
ucacggggaggggacguggcagggaaugugag

SEQ ID NO: 228172 - RNA, 32 nt, Human
ucacggggccuggcucaugguggaaaaucgca

SEQ ID NO: 228173 - RNA, 32 nt, Human
ucacggggccuuccauuuccagccaggccuca

SEQ ID NO: 228174 - RNA, 32 nt, Human
ucacgggguuggcuguuccagacucagguucc

SEQ ID NO: 228175 - RNA, 32 nt, Human
ucacggguagguggaguggagaggcugguuac

SEQ ID NO: 228176 - RNA, 32 nt, Human
ucacgggugcccacugcaguuccugcuucucc

SEQ ID NO: 228177 - RNA, 22 nt, Human
ucacgggugcccugugacccca

SEQ ID NO: 228178 - RNA, 32 nt, Human
ucacgggugcgguggaggcggccuugcggugg

SEQ ID NO: 228179 - RNA, 32 nt, Human
ucacggguucaagcaauucuccugccucagcc

SEQ ID NO: 228180 - RNA, 24 nt, Human
ucacgguaaccucugccucccagg

SEQ ID NO: 228181 - RNA, 32 nt, Human
ucacgguagugggagcaaucacaaaacuguaa

SEQ ID NO: 228182 - RNA, 32 nt, Human
ucacggucacaaacuggcaaugucaagaaggu

SEQ ID NO: 228183 - RNA, 32 nt, Human
ucacggucacccgaaagccagguguuggugaa

SEQ ID NO: 228184 - RNA, 32 nt, Human
ucacggucaugcuggagggaugcagaaacuaa

SEQ ID NO: 228185 - RNA, 32 nt, Human
ucacggucauuuccacagccucaaccacuguc

SEQ ID NO: 228186 - RNA, 32 nt, Human
ucacgguccugggccugccugcucuggccaag

SEQ ID NO: 228187 - RNA, 32 nt, Human
ucacggugcccaugcugcccagccuggaggua

SEQ ID NO: 228188 - RNA, 32 nt, Human
ucacgguggcuccgagcaugagguccgccucc

SEQ ID NO: 228189 - RNA, 32 nt, Human
ucacgguuguuuccaagcgccuccugggggag

SEQ ID NO: 228190 - RNA, 31 nt, Human
ucacguaagcagcacacuaggaggcccaggc

SEQ ID NO: 228191 - RNA, 32 nt, Human
ucacguacagaaaauuugccacuguuccaaga

SEQ ID NO: 228192 - RNA, 24 nt, Human
ucacguauguaaucccagcacuuu

SEQ ID NO: 228193 - RNA, 32 nt, Human
ucacguauguaaucccagcacuuugggaagcc

SEQ ID NO: 228194 - RNA, 32 nt, Human
ucacgucacugcacuccagcuugggcaacaga

SEQ ID NO: 228195 - RNA, 32 nt, Human
ucacgucacugcacuccggccugggugacaga

SEQ ID NO: 228196 - RNA, 32 nt, Human
ucacgucacugcacucuagccugggcaacaga

SEQ ID NO: 228197 - RNA, 32 nt, Human
ucacgucacugcauuccagccuggauaauaga

SEQ ID NO: 228198 - RNA, 32 nt, Human
ucacgucacugcauuucagccugagcgacaga

SEQ ID NO: 228199 - RNA, 32 nt, Human
ucacgucacuguacuccagccugggugacaga

SEQ ID NO: 228200 - RNA, 32 nt, Human
ucacgucaggcuguggagcaggagcacagcag

SEQ ID NO: 228201 - RNA, 32 nt, Human
ucacgucauugcacuccagccuggucaacaag

SEQ ID NO: 228202 - RNA, 32 nt, Human
ucacgucauugcacuccauccugagccacaag

SEQ ID NO: 228203 - RNA, 32 nt, Human
ucacgucauugcucuccagccugggcaacaga

SEQ ID NO: 228204 - RNA, 32 nt, Human
ucacguccuauguuugcuuucucccauuuuua

SEQ ID NO: 228205 - RNA, 32 nt, Human
ucacguccucagccucccagcauucaaucgua

SEQ ID NO: 228206 - RNA, 32 nt, Human
ucacguccugaacaugagccuccuccucuccu

SEQ ID NO: 228207 - RNA, 22 nt, Human
ucacgucuauaaucccagcacu

SEQ ID NO: 228208 - RNA, 32 nt, Human
ucacgucuauaaucccagcacugugggaggcc

SEQ ID NO: 228209 - RNA, 32 nt, Human
ucacgucucacugcagccucaaccuccugggu

SEQ ID NO: 228210 - RNA, 32 nt, Human
ucacgucucuccccagugggcuccuaaggggg

SEQ ID NO: 228211 - RNA, 32 nt, Human
ucacgucugcugcaaccugaagcuugcaucuc

SEQ ID NO: 228212 - RNA, 32 nt, Human
ucacgucuggaucuggcuuccucuccaaucca

SEQ ID NO: 228213 - RNA, 32 nt, Human
ucacgucugggagcuagcuuguauggcuucug

SEQ ID NO: 228214 - RNA, 20 nt, Human
ucacgucuguaaucccagca

SEQ ID NO: 228215 - RNA, 32 nt, Human
ucacgucuguaaucccagcaauuugggaggcu

SEQ ID NO: 228216 - RNA, 21 nt, Human
ucacgucuguaaucccagcac

SEQ ID NO: 228217 - RNA, 32 nt, Human
ucacgucuguaaucccagcaccuugggaggcc

SEQ ID NO: 228218 - RNA, 24 nt, Human
ucacgucuguaaucccagcacuuu

SEQ ID NO: 228219 - RNA, 32 nt, Human
ucacgucuguaaucccagcacuuuggaaggcc

SEQ ID NO: 228220 - RNA, 32 nt, Human
ucacgucuguaaucccagcacuuugggagccu

SEQ ID NO: 228221 - RNA, 32 nt, Human
ucacgucuguaaucccagcacuuugggaggcc

SEQ ID NO: 228222 - RNA, 32 nt, Human
ucacgucuguaaucccagcacuuugggaggcu

SEQ ID NO: 228223 - RNA, 32 nt, Human
ucacgucuguaaucccagcacuuugggagggc

SEQ ID NO: 228224 - RNA, 24 nt, Human
ucacgucuguaaucccagcaguuu

SEQ ID NO: 228225 - RNA, 32 nt, Human
ucacgucuguaaucccagcaguuugggaggcc

SEQ ID NO: 228226 - RNA, 22 nt, Human
ucacgucuguaaucccagcgcu

SEQ ID NO: 228227 - RNA, 24 nt, Human
ucacgucuguaaucccagcgcuuu

SEQ ID NO: 228228 - RNA, 32 nt, Human
ucacgucuguaaucccagcgcuuugggaggcc

SEQ ID NO: 228229 - RNA, 32 nt, Human
ucacgucuguaaucccaggacuuugggaggcu

SEQ ID NO: 228230 - RNA, 32 nt, Human
ucacgucuguaaucucagcacuuagggaggcc

SEQ ID NO: 228231 - RNA, 21 nt, Human
ucacgugaaauccugagcuca

SEQ ID NO: 228232 - RNA, 21 nt, Human
ucacgugacacugagggaugg

SEQ ID NO: 228233 - RNA, 32 nt, Human
ucacgugaggcaggcggcgagcgcgggugggg

SEQ ID NO: 228234 - RNA, 32 nt, Human
ucacgugaggucugugaggaccaauuuguggg

SEQ ID NO: 228235 - RNA, 32 nt, Human
ucacgugaugggagaguuuuguaggagcugug

SEQ ID NO: 228236 - RNA, 32 nt, Human
ucacgugccacauuugcuuggggaagguacgu

SEQ ID NO: 228237 - RNA, 32 nt, Human
ucacgugccugcagggccaggaaagggaaaug

SEQ ID NO: 228238 - RNA, 32 nt, Human
ucacguggcuuucaaagggaaggaagggcagu

SEQ ID NO: 228239 - RNA, 32 nt, Human
ucacgugggaaaaaguggcuuuucaguaaacg

SEQ ID NO: 228240 - RNA, 32 nt, Human
ucacgugggacccgcuccaucuuccguggaac

SEQ ID NO: 228241 - RNA, 32 nt, Human
ucacgugggcaggcccuguucuggggccccac

SEQ ID NO: 228242 - RNA, 32 nt, Human
ucacgugucccaggaccuccgugggcuuccgu

SEQ ID NO: 228243 - RNA, 32 nt, Human
ucacgugugcccaggcccugaggugggccgga

SEQ ID NO: 228244 - RNA, 32 nt, Human
ucacguguggguugauguuggcuugucuccag

SEQ ID NO: 228245 - RNA, 32 nt, Human
ucacguuaacguacacacacaaacacacgccc

SEQ ID NO: 228246 - RNA, 32 nt, Human
ucacguucaaaacaauccuuugacuacaacuc

SEQ ID NO: 228247 - RNA, 32 nt, Human
ucacguucccacccagccuggcuggcggugcc

SEQ ID NO: 228248 - RNA, 32 nt, Human
ucacguugagccaagugcacgagcugguccug

SEQ ID NO: 228249 - RNA, 32 nt, Human
ucacguugggagaagagagagagugccaggag

SEQ ID NO: 228250 - RNA, 32 nt, Human
ucacguuucucagcagccugacaggugucuga

SEQ ID NO: 228251 - RNA, 24 nt, Human
ucacguuuguaaucccagcacuuu

SEQ ID NO: 228252 - RNA, 32 nt, Human
ucacguuuguaaucccagcacuuugggaggcc

SEQ ID NO: 228253 - RNA, 32 nt, Human
ucacuaaaaaggaguguuguguguggcggcca

SEQ ID NO: 228254 - RNA, 32 nt, Human
ucacuaaaaaguacauguaaaaguacauuuga

SEQ ID NO: 228255 - RNA, 32 nt, Human
ucacuaaaaauacaaaaauuacccgggcaugg

SEQ ID NO: 228256 - RNA, 32 nt, Human
ucacuaaaagguuaauuuccagucuugucaaa

SEQ ID NO: 228257 - RNA, 32 nt, Human
ucacuaaagauggaaacacuggagucugaauu

SEQ ID NO: 228258 - RNA, 32 nt, Human
ucacuaaaggucaggcaguccugcugagcagg

SEQ ID NO: 228259 - RNA, 32 nt, Human
ucacuaacagaaguaacuuugguuaauuauuu

SEQ ID NO: 228260 - RNA, 32 nt, Human
ucacuaaccaguugacgagcagugcauuuaca

SEQ ID NO: 228261 - RNA, 32 nt, Human
ucacuaacccuugaagaucauuuagucaaaga

SEQ ID NO: 228262 - RNA, 32 nt, Human
ucacuaagaacuagguuucuuugguucauuuu

SEQ ID NO: 228263 - RNA, 32 nt, Human
ucacuaagaucacccauuaguaagaauuacua

SEQ ID NO: 228264 - RNA, 21 nt, Human
ucacuaagcucugccagcgug

SEQ ID NO: 228265 - RNA, 32 nt, Human
ucacuaagcugggcagccuccacccacagagc

SEQ ID NO: 228266 - RNA, 30 nt, Human
ucacuaagcuugcauuuuggcagaaagaaa

SEQ ID NO: 228267 - RNA, 31 nt, Human
ucacuaagugagaaugagaacugcugugaua

SEQ ID NO: 228268 - RNA, 32 nt, Human
ucacuacacaguuuagaauagacguucucauu

SEQ ID NO: 228269 - RNA, 32 nt, Human
ucacuacaugcuccacugccucccagguucau

SEQ ID NO: 228270 - RNA, 32 nt, Human
ucacuacauuauaaaugucucuuuaaugucac

SEQ ID NO: 228271 - RNA, 32 nt, Human
ucacuacccacuggccagccacccagccaaca

SEQ ID NO: 228272 - RNA, 32 nt, Human
ucacuacguguucacaggcugcuaauauuaaa

SEQ ID NO: 228273 - RNA, 24 nt, Human
ucacuacucuaauuccagcacuuu

SEQ ID NO: 228274 - RNA, 32 nt, Human
ucacuacucugagcacugugccuggugucauc

SEQ ID NO: 228275 - RNA, 28 nt, Human
ucacuacuuaaguuagccucaucauuuu

SEQ ID NO: 228276 - RNA, 32 nt, Human
ucacuacuuccucucugaucguucugaagcuu

SEQ ID NO: 228277 - RNA, 32 nt, Human
ucacuacuuggcuuugcuuagcagguucugcu

SEQ ID NO: 228278 - RNA, 32 nt, Human
ucacuagaaagagacagguggcccuggguuuu

SEQ ID NO: 228279 - RNA, 32 nt, Human
ucacuagaaguuaccugaguaucucugggagg

SEQ ID NO: 228280 - RNA, 32 nt, Human
ucacuagacuaucucccuuauucuccauguga

SEQ ID NO: 228281 - RNA, 32 nt, Human
ucacuagagacugguuucaccauguucgccag

SEQ ID NO: 228282 - RNA, 32 nt, Human
ucacuagccccagggauugaggucuuggauac

SEQ ID NO: 228283 - RNA, 32 nt, Human
ucacuagccugucuuuugccucuagggaugga

SEQ ID NO: 228284 - RNA, 32 nt, Human
ucacuagccugugaucccagcacuuugggagg

SEQ ID NO: 228285 - RNA, 32 nt, Human
ucacuaggaggcagagguugcagugagcaguu

SEQ ID NO: 228286 - RNA, 32 nt, Human
ucacuaggccugggugucuggguugugaaaug

SEQ ID NO: 228287 - RNA, 32 nt, Human
ucacuaggcugcugaggaagaucaauaauacc

SEQ ID NO: 228288 - RNA, 32 nt, Human
ucacuaggcuucugguugaugccugugaacug

SEQ ID NO: 228289 - RNA, 32 nt, Human
ucacuaggugaaaugagguuuuuaggauuauu

SEQ ID NO: 228290 - RNA, 32 nt, Human
ucacuauaagcuccaccucccagguucaugcc

SEQ ID NO: 228291 - RNA, 32 nt, Human
ucacuauacaacuccccucucccugcaaaaac

SEQ ID NO: 228292 - RNA, 32 nt, Human
ucacuauagugggagagauuuggaagacaaag

SEQ ID NO: 228293 - RNA, 32 nt, Human
ucacuauauuugaguguucccuuacagguaug

SEQ ID NO: 228294 - RNA, 32 nt, Human
ucacuaucacccaggcuagagggcaguggcac

SEQ ID NO: 228295 - RNA, 32 nt, Human
ucacuaucaguguggagacaagcacagcacac

SEQ ID NO: 228296 - RNA, 32 nt, Human
ucacuaucauucucaguaaacuaucgcaagaa

SEQ ID NO: 228297 - RNA, 32 nt, Human
ucacuaucauuugagagcccuaccuuuuccug

SEQ ID NO: 228298 - RNA, 17 nt, Human
ucacuauccacaugcca

SEQ ID NO: 228299 - RNA, 32 nt, Human
ucacuauccuugacucauugcacuuugaccuc

SEQ ID NO: 228300 - RNA, 30 nt, Human
ucacuaugaagaaaagugguguucuuuucc

SEQ ID NO: 228301 - RNA, 32 nt, Human
ucacuauguuagacaccauuuacauuggaugu

SEQ ID NO: 228302 - RNA, 32 nt, Human
ucacuauguuggccaggauggucucgaucucu

SEQ ID NO: 228303 - RNA, 32 nt, Human
ucacuauugaacacuauucuguucacuaucug

SEQ ID NO: 228304 - RNA, 32 nt, Human
ucacuauuuugcaaaugccgacccuguggccu

SEQ ID NO: 228305 - RNA, 32 nt, Human
ucacucaaaaccugucuauaaccaaagaauuc

SEQ ID NO: 228306 - RNA, 32 nt, Human
ucacucaaaccugaaacuucagcauauuuguu

SEQ ID NO: 228307 - RNA, 32 nt, Human
ucacucaaagggagccagaaguccaaggaggg

SEQ ID NO: 228308 - RNA, 32 nt, Human
ucacucaaaucuggaaacugggugagagacug

SEQ ID NO: 228309 - RNA, 32 nt, Human
ucacucaaccccaggcuagggguacaccugac

SEQ ID NO: 228310 - RNA, 32 nt, Human
ucacucaacuccauugacccucuccuuuccca

SEQ ID NO: 228311 - RNA, 32 nt, Human
ucacucaagcuguagugcaguggugccaucuu

SEQ ID NO: 228312 - RNA, 32 nt, Human
ucacucacaaguccucauggagacucugccgu

SEQ ID NO: 228313 - RNA, 32 nt, Human
ucacucacacuggccucuuuaggaucagggga

SEQ ID NO: 228314 - RNA, 32 nt, Human
ucacucaccagcuccugcugucuuccaugcug

SEQ ID NO: 228315 - RNA, 32 nt, Human
ucacucaccauggccagccaguucugccuccc

SEQ ID NO: 228316 - RNA, 31 nt, Human
ucacucacgucagaagagguuggggcaaaac

SEQ ID NO: 228317 - RNA, 32 nt, Human
ucacucacgucagaagagguuggggcaaaaca

SEQ ID NO: 228318 - RNA, 32 nt, Human
ucacucacuagccauggagccucggcaauuau

SEQ ID NO: 228319 - RNA, 32 nt, Human
ucacucacucacccugacccugggcaaguuac

SEQ ID NO: 228320 - RNA, 32 nt, Human
ucacucacucuccaccagccugggaaaugaau

SEQ ID NO: 228321 - RNA, 32 nt, Human
ucacucacugcaauugcuucuacucugggcac

SEQ ID NO: 228322 - RNA, 32 nt, Human
ucacucagaaaugaucaaugcagggacucuuu

SEQ ID NO: 228323 - RNA, 32 nt, Human
ucacucagaccaccauauccuucugauuaaag

SEQ ID NO: 228324 - RNA, 32 nt, Human
ucacucagagcugauucacaggaggaggggag

SEQ ID NO: 228325 - RNA, 32 nt, Human
ucacucagauguauuuuagauaagcuauuuag

SEQ ID NO: 228326 - RNA, 32 nt, Human
ucacucagccaccucccucucccucuucaggu

SEQ ID NO: 228327 - RNA, 32 nt, Human
ucacucagcccgggaagcaggaagccccuucu

SEQ ID NO: 228328 - RNA, 32 nt, Human
ucacucagccuggcagaggaagaaggaaggca

SEQ ID NO: 228329 - RNA, 32 nt, Human
ucacucaggcugcagugcaguggcgcaaucuc

SEQ ID NO: 228330 - RNA, 32 nt, Human
ucacucaggcuggaaugcaguggcgcgaucuc

SEQ ID NO: 228331 - RNA, 32 nt, Human
ucacucaggcuggagcacaguggugugaucac

SEQ ID NO: 228332 - RNA, 21 nt, Human
ucacucaggcuggaguacagu

SEQ ID NO: 228333 - RNA, 22 nt, Human
ucacucaggcuggaguacagug

SEQ ID NO: 228334 - RNA, 32 nt, Human
ucacucaggcuggaguacaguggcacaaucau

SEQ ID NO: 228335 - RNA, 32 nt, Human
ucacucaggcuggaguacaguggugccaucau

SEQ ID NO: 228336 - RNA, 32 nt, Human
ucacucaggcuggagugcaaugacgugaucuc

SEQ ID NO: 228337 - RNA, 21 nt, Human
ucacucaggcuggagugcagu

SEQ ID NO: 228338 - RNA, 22 nt, Human
ucacucaggcuggagugcagug

SEQ ID NO: 228339 - RNA, 32 nt, Human
ucacucaggcuggagugcaguggcacaaucuu

SEQ ID NO: 228340 - RNA, 32 nt, Human
ucacucaggcuggagugcaguggcgcgaucuu

SEQ ID NO: 228341 - RNA, 32 nt, Human
ucacucaggcuggagugcaguggcgugaucuu

SEQ ID NO: 228342 - RNA, 32 nt, Human
ucacucaggcuggagugcagugguauaaucau

SEQ ID NO: 228343 - RNA, 32 nt, Human
ucacucaggcuggagugcagugguauaaucuc

SEQ ID NO: 228344 - RNA, 32 nt, Human
ucacucaggcuggagugcaguggugugaucuc

SEQ ID NO: 228345 - RNA, 32 nt, Human
ucacucaggcuggagugcggugguauaaucuc

SEQ ID NO: 228346 - RNA, 31 nt, Human
ucacucagguuugcuuccccuguguccacug

SEQ ID NO: 228347 - RNA, 32 nt, Human
ucacucagugucccucguuuugcucggagaca

SEQ ID NO: 228348 - RNA, 19 nt, Human
ucacucaucaugcuuagca

SEQ ID NO: 228349 - RNA, 32 nt, Human
ucacucaucucuaaguaaaccuuucccgggac

SEQ ID NO: 228350 - RNA, 32 nt, Human
ucacucaugcuggagugcaguggcgugaucuc

SEQ ID NO: 228351 - RNA, 19 nt, Human
ucacucauguccccuccca

SEQ ID NO: 228352 - RNA, 32 nt, Human
ucacucauguugaaguucugucuuccaggaaa

SEQ ID NO: 228353 - RNA, 32 nt, Human
ucacuccaacuugguauugauuuucuccacgg

SEQ ID NO: 228354 - RNA, 32 nt, Human
ucacuccaagcccaguuacagcagaaaguuuu

SEQ ID NO: 228355 - RNA, 32 nt, Human
ucacuccaccucucugugccucaguuuccccc

SEQ ID NO: 228356 - RNA, 32 nt, Human
ucacuccacugcacuccagccugggcaacaga

SEQ ID NO: 228357 - RNA, 32 nt, Human
ucacuccacugcacuccagccugggcgacaga

SEQ ID NO: 228358 - RNA, 32 nt, Human
ucacuccacugcacuccagccugggugacaga

SEQ ID NO: 228359 - RNA, 32 nt, Human
ucacuccacuuggacaugggccccagauacca

SEQ ID NO: 228360 - RNA, 32 nt, Human
ucacuccagcccaacagaaggaaggaggaggg

SEQ ID NO: 228361 - RNA, 32 nt, Human
ucacuccagccuggauaaaagagcaagacucc

SEQ ID NO: 228362 - RNA, 32 nt, Human
ucacuccaggcagaguggggcggaaggcugcu

SEQ ID NO: 228363 - RNA, 32 nt, Human
ucacuccagugcacucgagccugggugacagg

SEQ ID NO: 228364 - RNA, 32 nt, Human
ucacuccaugaaugacuggaguguaggggcag

SEQ ID NO: 228365 - RNA, 32 nt, Human
ucacucccaacagcguccagcacacaaauaaa

SEQ ID NO: 228366 - RNA, 31 nt, Human
ucacucccacucaaggaaaggagauuauaca

SEQ ID NO: 228367 - RNA, 17 nt, Human
ucacucccaugccagcc

SEQ ID NO: 228368 - RNA, 21 nt, Human
ucacucccauucuauugcuga

SEQ ID NO: 228369 - RNA, 32 nt, Human
ucacuccccacccccucccccgggucggggga

SEQ ID NO: 228370 - RNA, 32 nt, Human
ucacucccccuuccuuggucuccacgggcccc

SEQ ID NO: 228371 - RNA, 32 nt, Human
ucacucccggaggccucugccugcggcugacc

SEQ ID NO: 228372 - RNA, 32 nt, Human
ucacucccgugccauucccagccuuccuucag

SEQ ID NO: 228373 - RNA, 32 nt, Human
ucacucccugcucccaccuggaaccuugccag

SEQ ID NO: 228374 - RNA, 32 nt, Human
ucacucccugcuccccgcacccggagccucag

SEQ ID NO: 228375 - RNA, 32 nt, Human
ucacucccuucagaagcagacauggcaucugu

SEQ ID NO: 228376 - RNA, 32 nt, Human
ucacuccgccuccucacucucacugcauuucc

SEQ ID NO: 228377 - RNA, 32 nt, Human
ucacuccgcgggcggaggacgcacgucggggc

SEQ ID NO: 228378 - RNA, 32 nt, Human
ucacuccgcuccacuccucgggcuggcucucc

SEQ ID NO: 228379 - RNA, 32 nt, Human
ucacuccguugccaggcuggagugcuguggcg

SEQ ID NO: 228380 - RNA, 32 nt, Human
ucacuccuauaaucccagcacuucgggaggcc

SEQ ID NO: 228381 - RNA, 32 nt, Human
ucacuccuccacuccuacuccuucucuuacug

SEQ ID NO: 228382 - RNA, 32 nt, Human
ucacuccuccagccuggaaugugaagugacuc

SEQ ID NO: 228383 - RNA, 32 nt, Human
ucacuccucgggucucuccauaauucagccca

SEQ ID NO: 228384 - RNA, 32 nt, Human
ucacuccucuccccuuucucuuucucucuguu

SEQ ID NO: 228385 - RNA, 32 nt, Human
ucacuccucuucucccugcccugaucagauuc

SEQ ID NO: 228386 - RNA, 32 nt, Human
ucacuccugacucuuccucuucccagcggacg

SEQ ID NO: 228387 - RNA, 27 nt, Human
ucacuccugauuucucuuuccaaggca

SEQ ID NO: 228388 - RNA, 32 nt, Human
ucacuccugauuucucuuuccaaggcacugua

SEQ ID NO: 228389 - RNA, 32 nt, Human
ucacuccugccaagcugaccucagcuggguaa

SEQ ID NO: 228390 - RNA, 32 nt, Human
ucacuccugccuccucagcuuugcuucauguu

SEQ ID NO: 228391 - RNA, 32 nt, Human
ucacuccugccugacugccaagccaccugcau

SEQ ID NO: 228392 - RNA, 32 nt, Human
ucacuccugcuguaaauuuggcuucuguuguc

SEQ ID NO: 228393 - RNA, 32 nt, Human
ucacuccugggaacugucuggcagguaggcug

SEQ ID NO: 228394 - RNA, 32 nt, Human
ucacuccugggccugcugggccuguggcugcc

SEQ ID NO: 228395 - RNA, 32 nt, Human
ucacuccuggguuccaggucacugcaucuguc

SEQ ID NO: 228396 - RNA, 32 nt, Human
ucacuccuggucccuuugcaagugaacccugc

SEQ ID NO: 228397 - RNA, 24 nt, Human
ucacuccuguaauaccagcacuuu

SEQ ID NO: 228398 - RNA, 32 nt, Human
ucacuccuguaauaccagcacuuugggaggcc

SEQ ID NO: 228399 - RNA, 32 nt, Human
ucacuccuguaaucccaacacuuugagaggcu

SEQ ID NO: 228400 - RNA, 32 nt, Human
ucacuccuguaaucccaccacuuugggaggcc

SEQ ID NO: 228401 - RNA, 32 nt, Human
ucacuccuguaaucccagcacucuagaaggcc

SEQ ID NO: 228402 - RNA, 24 nt, Human
ucacuccuguaaucccagcacuuu

SEQ ID NO: 228403 - RNA, 32 nt, Human
ucacuccuguaaucccagcacuuuggaggccg

SEQ ID NO: 228404 - RNA, 32 nt, Human
ucacuccuguaaucccagcacuuugggaagcc

SEQ ID NO: 228405 - RNA, 32 nt, Human
ucacuccuguaaucccagcacuuugggaagcu

SEQ ID NO: 228406 - RNA, 32 nt, Human
ucacuccuguaaucccagcacuuugggaggcc

SEQ ID NO: 228407 - RNA, 32 nt, Human
ucacuccuguaaucccagcacuuugggaggcu

SEQ ID NO: 228408 - RNA, 32 nt, Human
ucacuccuguaaucccagcacuuugggagguc

SEQ ID NO: 228409 - RNA, 32 nt, Human
ucacuccuguaaucccagcacuuugggagguu

SEQ ID NO: 228410 - RNA, 24 nt, Human
ucacuccuguaaucccagcauuuu

SEQ ID NO: 228411 - RNA, 32 nt, Human
ucacuccuguaaucccagcauuuugagaggcc

SEQ ID NO: 228412 - RNA, 32 nt, Human
ucacuccuguaaucccagcauuuugggaggcc

SEQ ID NO: 228413 - RNA, 24 nt, Human
ucacuccuguaaucccggcacuuu

SEQ ID NO: 228414 - RNA, 32 nt, Human
ucacuccuguaaucccggcacuuuggaaugcc

SEQ ID NO: 228415 - RNA, 32 nt, Human
ucacuccuguaauccgagcaauuugggaggcc

SEQ ID NO: 228416 - RNA, 32 nt, Human
ucacuccuguaaucucaacaauuugagaggcc

SEQ ID NO: 228417 - RNA, 32 nt, Human
ucacuccuguaaucucagaacuuugggaggcu

SEQ ID NO: 228418 - RNA, 32 nt, Human
ucacuccuguaauuccagcacuuugggaggcc

SEQ ID NO: 228419 - RNA, 32 nt, Human
ucacuccuguaguccuagcuacucggggaggc

SEQ ID NO: 228420 - RNA, 32 nt, Human
ucacuccuguccaaacuguuguauaaggacug

SEQ ID NO: 228421 - RNA, 32 nt, Human
ucacuccuguuacccaggcuggaggacaguga

SEQ ID NO: 228422 - RNA, 32 nt, Human
ucacuccuucauuccuccucugucucuuugca

SEQ ID NO: 228423 - RNA, 32 nt, Human
ucacuccuucgggcugccucccccuccccuug

SEQ ID NO: 228424 - RNA, 32 nt, Human
ucacuccuuguccuccaugcuguggcuguauc

SEQ ID NO: 228425 - RNA, 32 nt, Human
ucacuccuuugccucccaaauaugucuguaug

SEQ ID NO: 228426 - RNA, 32 nt, Human
ucacuccuuuguucaagaaccuuccacagcuc

SEQ ID NO: 228427 - RNA, 32 nt, Human
ucacuccuuuuacucacugggcucaugacagu

SEQ ID NO: 228428 - RNA, 32 nt, Human
ucacucgaacccaggaggcagagguugcagug

SEQ ID NO: 228429 - RNA, 32 nt, Human
ucacucgagaccccaaaccuccaggccugagg

SEQ ID NO: 228430 - RNA, 25 nt, Human
ucacucgagcccagcuaacucggug

SEQ ID NO: 228431 - RNA, 25 nt, Human
ucacucgagcccgcacggcucggug

SEQ ID NO: 228432 - RNA, 25 nt, Human
ucacucgagcucagugcacucggug

SEQ ID NO: 228433 - RNA, 32 nt, Human
ucacucgcacacacagacacaagcgcgcacac

SEQ ID NO: 228434 - RNA, 32 nt, Human
ucacucggaaggcagcugugugagcugccaag

SEQ ID NO: 228435 - RNA, 32 nt, Human
ucacucgggcugugugaacccagcaagucaca

SEQ ID NO: 228436 - RNA, 20 nt, Human
ucacucgguuccaucccccu

SEQ ID NO: 228437 - RNA, 32 nt, Human
ucacucgucaccccagcuggagugcaguggug

SEQ ID NO: 228438 - RNA, 32 nt, Human
ucacucguugcccaggcuggagugcaguggcg

SEQ ID NO: 228439 - RNA, 32 nt, Human
ucacucguugcccaggcuggaguguagaggcg

SEQ ID NO: 228440 - RNA, 32 nt, Human
ucacucuacuuuccuuucaauuuucuuuucuc

SEQ ID NO: 228441 - RNA, 21 nt, Human
ucacucuagccuugaauuccu

SEQ ID NO: 228442 - RNA, 32 nt, Human
ucacucuagucacuaaagaaggauuuuacucc

SEQ ID NO: 228443 - RNA, 32 nt, Human
ucacucuauaccuugcaggcucauuucagcag

SEQ ID NO: 228444 - RNA, 32 nt, Human
ucacucuauccuggauaggcacuugggaacuu

SEQ ID NO: 228445 - RNA, 32 nt, Human
ucacucucaaguuucacaggcauacaacggga

SEQ ID NO: 228446 - RNA, 32 nt, Human
ucacucucacccaggcuggagugcaguggcac

SEQ ID NO: 228447 - RNA, 32 nt, Human
ucacucucacugcauuucccaccuuccugugg

SEQ ID NO: 228448 - RNA, 32 nt, Human
ucacucucagcacaggugcugugugacggccu

SEQ ID NO: 228449 - RNA, 32 nt, Human
ucacucucagccauagcacuuuguucacuguc

SEQ ID NO: 228450 - RNA, 32 nt, Human
ucacucucauugcccaggcuggagugcaguga

SEQ ID NO: 228451 - RNA, 32 nt, Human
ucacucuccacauccccgccucccagacauau

SEQ ID NO: 228452 - RNA, 32 nt, Human
ucacucuccauaguaggaccuggaucuuugca

SEQ ID NO: 228453 - RNA, 32 nt, Human
ucacucucccucccuucucucacucucacucu

SEQ ID NO: 228454 - RNA, 31 nt, Human
ucacucucccucucugggcaugucugcuaca

SEQ ID NO: 228455 - RNA, 32 nt, Human
ucacucuccgagagcuaugagcucuccucgga

SEQ ID NO: 228456 - RNA, 32 nt, Human
ucacucucgggccgcagacaaugcugugagca

SEQ ID NO: 228457 - RNA, 32 nt, Human
ucacucucgucgcccaggcuggaaugcagugg

SEQ ID NO: 228458 - RNA, 32 nt, Human
ucacucucguugcccaggcuggagugcaaugg

SEQ ID NO: 228459 - RNA, 32 nt, Human
ucacucucuaacccacucucucucauucccuu

SEQ ID NO: 228460 - RNA, 32 nt, Human
ucacucucugcagguuuuugccuacacuuuga

SEQ ID NO: 228461 - RNA, 32 nt, Human
ucacucucuggccuaaaaccuuccuuggcucc

SEQ ID NO: 228462 - RNA, 27 nt, Human
ucacucucuucuuccuuaguuucugga

SEQ ID NO: 228463 - RNA, 32 nt, Human
ucacucugaggaagaagcaggacuugguacgg

SEQ ID NO: 228464 - RNA, 32 nt, Human
ucacucugaggggccacgucuguuaguuuccu

SEQ ID NO: 228465 - RNA, 32 nt, Human
ucacucugccuguggacgcugcaccugccacu

SEQ ID NO: 228466 - RNA, 32 nt, Human
ucacucugccuuuucauccaggccagugacuu

SEQ ID NO: 228467 - RNA, 21 nt, Human
ucacucugcggaacuguccug

SEQ ID NO: 228468 - RNA, 32 nt, Human
ucacucugcuagcaccuccucccuuuccccaa

SEQ ID NO: 228469 - RNA, 32 nt, Human
ucacucugcuccuccccugccugggccuuaaa

SEQ ID NO: 228470 - RNA, 32 nt, Human
ucacucuggaaagagcaugaccgauaaagaaa

SEQ ID NO: 228471 - RNA, 32 nt, Human
ucacucuggcauccuucagcauuuuucuuuuu

SEQ ID NO: 228472 - RNA, 32 nt, Human
ucacucuggccuugcugcuucucuccagcucc

SEQ ID NO: 228473 - RNA, 32 nt, Human
ucacucuggcgcucuggagugcagugguguga

SEQ ID NO: 228474 - RNA, 32 nt, Human
ucacucugggaggggucggcggugcuggcggc

SEQ ID NO: 228475 - RNA, 32 nt, Human
ucacucugggcuguguuuaugagcaucaccca

SEQ ID NO: 228476 - RNA, 32 nt, Human
ucacucuggucaccuuguuugcucugggucug

SEQ ID NO: 228477 - RNA, 32 nt, Human
ucacucugguugcccaggcuggagugcagugg

SEQ ID NO: 228478 - RNA, 32 nt, Human
ucacucugucaccagacuggagugcaguggcg

SEQ ID NO: 228479 - RNA, 32 nt, Human
ucacucugucaccaggcuggagugcagugccg

SEQ ID NO: 228480 - RNA, 32 nt, Human
ucacucugucaccaggcuggagugcaguggcg

SEQ ID NO: 228481 - RNA, 32 nt, Human
ucacucuguccgcccaggcugggugcagucac

SEQ ID NO: 228482 - RNA, 32 nt, Human
ucacucugucgccaggcuggaaugcaguaggg

SEQ ID NO: 228483 - RNA, 32 nt, Human
ucacucugucgccaggcuggagugcaguggcg

SEQ ID NO: 228484 - RNA, 32 nt, Human
ucacucugucgccaggcuggagugcaguggug

SEQ ID NO: 228485 - RNA, 32 nt, Human
ucacucugucgccugggcuggaguacaguggu

SEQ ID NO: 228486 - RNA, 32 nt, Human
ucacucugucucccagacuggagugaguggug

SEQ ID NO: 228487 - RNA, 32 nt, Human
ucacucuguugccaggcuggaaugcaguggcg

SEQ ID NO: 228488 - RNA, 32 nt, Human
ucacucuguugccaggcuggagugcaguggcg

SEQ ID NO: 228489 - RNA, 32 nt, Human
ucacucuguugccaggcuggucucaaacuucu

SEQ ID NO: 228490 - RNA, 32 nt, Human
ucacucuguugcccagcuggagugcaguggcg

SEQ ID NO: 228491 - RNA, 32 nt, Human
ucacucuguugccccaggcuggagugcagugg

SEQ ID NO: 228492 - RNA, 32 nt, Human
ucacucuguugcuaggcuggagugcaguggca

SEQ ID NO: 228493 - RNA, 32 nt, Human
ucacucuuaccucccugucugcuuacucaccc

SEQ ID NO: 228494 - RNA, 32 nt, Human
ucacucuuauugcccaggcuagagugcaaugg

SEQ ID NO: 228495 - RNA, 32 nt, Human
ucacucuuauugcccaggcuggagugcaaugg

SEQ ID NO: 228496 - RNA, 32 nt, Human
ucacucuucaggcuggggugugcucccugacc

SEQ ID NO: 228497 - RNA, 32 nt, Human
ucacucuuccaccccuuuucucccucuccccu

SEQ ID NO: 228498 - RNA, 23 nt, Human
ucacucuuccauuuaagggauag

SEQ ID NO: 228499 - RNA, 21 nt, Human
ucacucuucugacauccugca

SEQ ID NO: 228500 - RNA, 32 nt, Human
ucacucuugcccaggcuggagugcaguggugc

SEQ ID NO: 228501 - RNA, 32 nt, Human
ucacucuugcccaggcuggggugucguggcgu

SEQ ID NO: 228502 - RNA, 32 nt, Human
ucacucuugcccaggcuguagugcuguggcac

SEQ ID NO: 228503 - RNA, 32 nt, Human
ucacucuugcugcccaggcuggagugcaaugg

SEQ ID NO: 228504 - RNA, 32 nt, Human
ucacucuugcugcccaggcuggagugcagugg

SEQ ID NO: 228505 - RNA, 22 nt, Human
ucacucuugcugucuuaaguuc

SEQ ID NO: 228506 - RNA, 32 nt, Human
ucacucuugggaggguguauguguccaggaau

SEQ ID NO: 228507 - RNA, 24 nt, Human
ucacucuuguaaucccaaaacuuu

SEQ ID NO: 228508 - RNA, 32 nt, Human
ucacucuuguaaucccaaaacuuuaggaggcc

SEQ ID NO: 228509 - RNA, 32 nt, Human
ucacucuuguaccccaggcuggagugcaaugg

SEQ ID NO: 228510 - RNA, 32 nt, Human
ucacucuugucacccaggcuggaguacagugg

SEQ ID NO: 228511 - RNA, 32 nt, Human
ucacucuugucacccaggcuggagugcaaugg

SEQ ID NO: 228512 - RNA, 32 nt, Human
ucacucuugucacccaggcuggagugcaguag

SEQ ID NO: 228513 - RNA, 32 nt, Human
ucacucuugucacccaggcuggagugcagugg

SEQ ID NO: 228514 - RNA, 32 nt, Human
ucacucuugucacccaggcuggaguguagugg

SEQ ID NO: 228515 - RNA, 32 nt, Human
ucacucuuguugcccaggcuagagggcaaugg

SEQ ID NO: 228516 - RNA, 32 nt, Human
ucacucuuguugcccaggcuggaaugcagugg

SEQ ID NO: 228517 - RNA, 32 nt, Human
ucacucuuguugcccaggcuggaguacaaugg

SEQ ID NO: 228518 - RNA, 32 nt, Human
ucacucuuguugcccaggcuggagugcaauag

SEQ ID NO: 228519 - RNA, 32 nt, Human
ucacucuuguugcccaggcuggagugcaaugc

SEQ ID NO: 228520 - RNA, 32 nt, Human
ucacucuuguugcccaggcuggagugcaaugg

SEQ ID NO: 228521 - RNA, 32 nt, Human
ucacucuuguugcccaggcuggagugcaguag

SEQ ID NO: 228522 - RNA, 32 nt, Human
ucacucuuguugcccaggcuggagugcagugg

SEQ ID NO: 228523 - RNA, 32 nt, Human
ucacucuuguugcccaggcuggagugcggugg

SEQ ID NO: 228524 - RNA, 32 nt, Human
ucacucuuguugcccaggcuggagugcguugg

SEQ ID NO: 228525 - RNA, 32 nt, Human
ucacucuuuccagauaagcagaguugcucuuc

SEQ ID NO: 228526 - RNA, 32 nt, Human
ucacucuuucccaggcugcaguacagugacac

SEQ ID NO: 228527 - RNA, 32 nt, Human
ucacucuuuccucucucccucuccuuguccua

SEQ ID NO: 228528 - RNA, 32 nt, Human
ucacucuuuuuacccaggcuggagugcaauga

SEQ ID NO: 228529 - RNA, 32 nt, Human
ucacugaacccaugcugaucuccagggaacca

SEQ ID NO: 228530 - RNA, 32 nt, Human
ucacugaagagcagacccguuuggguucucca

SEQ ID NO: 228531 - RNA, 32 nt, Human
ucacugacaaauucuggcauuaaaaauggcaa

SEQ ID NO: 228532 - RNA, 32 nt, Human
ucacugacaggagagcagagacaggacguguc

SEQ ID NO: 228533 - RNA, 32 nt, Human
ucacugacauccugacaucucaggauccuacc

SEQ ID NO: 228534 - RNA, 32 nt, Human
ucacugaccaaccaaccaaacuccacacuuca

SEQ ID NO: 228535 - RNA, 32 nt, Human
ucacugaccagccaccaaguugcccauugaug

SEQ ID NO: 228536 - RNA, 28 nt, Human
ucacugaccccaggggccucauccuccc

SEQ ID NO: 228537 - RNA, 32 nt, Human
ucacugaccuccugaccccugaccucaucacc

SEQ ID NO: 228538 - RNA, 32 nt, Human
ucacugacuccccgucuuccuggcagacacaa

SEQ ID NO: 228539 - RNA, 32 nt, Human
ucacugagagaagaggauggauaaggacguua

SEQ ID NO: 228540 - RNA, 32 nt, Human
ucacugagcgcucgccgccgcccagccucucc

SEQ ID NO: 228541 - RNA, 32 nt, Human
ucacugagcuaaauuuaucuuuguaaaucuuu

SEQ ID NO: 228542 - RNA, 32 nt, Human
ucacugagcuuccucugagccuugaaggguuu

SEQ ID NO: 228543 - RNA, 32 nt, Human
ucacugaggcucaggacacggccacaccaagu

SEQ ID NO: 228544 - RNA, 32 nt, Human
ucacugaggcuggagugcaguggcgcaauuuc

SEQ ID NO: 228545 - RNA, 32 nt, Human
ucacugagggcagggaaaaggaacacucaggu

SEQ ID NO: 228546 - RNA, 32 nt, Human
ucacugagguggccaccaugcuggccugcggc

SEQ ID NO: 228547 - RNA, 32 nt, Human
ucacugaguuuaccucagcaacuuuuuaaaaa

SEQ ID NO: 228548 - RNA, 32 nt, Human
ucacugauauuccaaguguggcuaucuguuca

SEQ ID NO: 228549 - RNA, 32 nt, Human
ucacugaucacgccugccccagagcagugugu

SEQ ID NO: 228550 - RNA, 29 nt, Human
ucacugaucacugcagccuccacuuccca

SEQ ID NO: 228551 - RNA, 32 nt, Human
ucacugaucccaauuacucugauccuuuugcc

SEQ ID NO: 228552 - RNA, 32 nt, Human
ucacugaucccagccaccccagaaaagcugca

SEQ ID NO: 228553 - RNA, 32 nt, Human
ucacugaugcucaaacaugagaagacugggac

SEQ ID NO: 228554 - RNA, 32 nt, Human
ucacugauggccugagagggccuauggcugcu

SEQ ID NO: 228555 - RNA, 32 nt, Human
ucacugauugcauuccagccugggugacagag

SEQ ID NO: 228556 - RNA, 32 nt, Human
ucacugcaacauccagcuccuggguuucagca

SEQ ID NO: 228557 - RNA, 32 nt, Human
ucacugcaacccugcaaccucugccuaccggg

SEQ ID NO: 228558 - RNA, 20 nt, Human
ucacugcaaccuccaccucc

SEQ ID NO: 228559 - RNA, 32 nt, Human
ucacugcaaccuccaccucuuauguucaagca

SEQ ID NO: 228560 - RNA, 32 nt, Human
ucacugcaaccuccaccucuuggguucaagcg

SEQ ID NO: 228561 - RNA, 21 nt, Human
ucacugcaaccuccgccuccu

SEQ ID NO: 228562 - RNA, 32 nt, Human
ucacugcaaccucgaccucuuggguucaagug

SEQ ID NO: 228563 - RNA, 32 nt, Human
ucacugcaaccucugccccaccaaaauucaag

SEQ ID NO: 228564 - RNA, 20 nt, Human
ucacugcaaccucugccucc

SEQ ID NO: 228565 - RNA, 21 nt, Human
ucacugcaaccucugccuccu

SEQ ID NO: 228566 - RNA, 21 nt, Human
ucacugcaaccucugcuuccu

SEQ ID NO: 228567 - RNA, 32 nt, Human
ucacugcaagagauauucaaguucuacaauca

SEQ ID NO: 228568 - RNA, 32 nt, Human
ucacugcaagcuccgccuccucccggguucac

SEQ ID NO: 228569 - RNA, 32 nt, Human
ucacugcaaucucgacuuccaguuucagguga

SEQ ID NO: 228570 - RNA, 32 nt, Human
ucacugcaaucucugccuccuggguuuaagcc

SEQ ID NO: 228571 - RNA, 32 nt, Human
ucacugcaaugcuggacacuacagguaucugu

SEQ ID NO: 228572 - RNA, 32 nt, Human
ucacugcaaugugcaacccacacccacagcca

SEQ ID NO: 228573 - RNA, 32 nt, Human
ucacugcacaugcaaguauaccacccuuccau

SEQ ID NO: 228574 - RNA, 32 nt, Human
ucacugcacucaggcuggagugcagugguacg

SEQ ID NO: 228575 - RNA, 32 nt, Human
ucacugcacuggcagcgugcacuggcguauuu

SEQ ID NO: 228576 - RNA, 32 nt, Human
ucacugcacuuucuuccugccuuagguaguug

SEQ ID NO: 228577 - RNA, 32 nt, Human
ucacugcagaaugacagagaaggugaagcucc

SEQ ID NO: 228578 - RNA, 20 nt, Human
ucacugcagccccccucgcc

SEQ ID NO: 228579 - RNA, 32 nt, Human
ucacugcagccuccuucuccuggguccaagca

SEQ ID NO: 228580 - RNA, 21 nt, Human
ucacugcagccucugccuccu

SEQ ID NO: 228581 - RNA, 32 nt, Human
ucacugcagccuguccguggaugucucugccu

SEQ ID NO: 228582 - RNA, 32 nt, Human
ucacugcagcuggcaaaaggcauuggccagcu

SEQ ID NO: 228583 - RNA, 32 nt, Human
ucacugcaggcccacucugaaagagaaauccc

SEQ ID NO: 228584 - RNA, 32 nt, Human
ucacugcagugucuaaagguagaugcaaauua

SEQ ID NO: 228585 - RNA, 21 nt, Human
ucacugcaguuucaaguuccu

SEQ ID NO: 228586 - RNA, 32 nt, Human
ucacugcauaugcacaucaacucacugcauau

SEQ ID NO: 228587 - RNA, 32 nt, Human
ucacugcauuggauggaugaacaucagugccc

SEQ ID NO: 228588 - RNA, 32 nt, Human
ucacugccaacaacaacgagguuccuauaauu

SEQ ID NO: 228589 - RNA, 32 nt, Human
ucacugccacacagcaaguuccgagaccaugg

SEQ ID NO: 228590 - RNA, 32 nt, Human
ucacugccacacgcagcucagccugggcggca

SEQ ID NO: 228591 - RNA, 32 nt, Human
ucacugccaccugugcccaugggcaccccaga

SEQ ID NO: 228592 - RNA, 32 nt, Human
ucacugccacugcucuugccucuugugauguc

SEQ ID NO: 228593 - RNA, 32 nt, Human
ucacugccagaggccugggcugcaugaggacc

SEQ ID NO: 228594 - RNA, 32 nt, Human
ucacugccagcgcuugggcugaaggaagcucc

SEQ ID NO: 228595 - RNA, 32 nt, Human
ucacugccagggaggcucaggcugccauggcu

SEQ ID NO: 228596 - RNA, 32 nt, Human
ucacugccagugccuguggcggaagccaucuu

SEQ ID NO: 228597 - RNA, 32 nt, Human
ucacugccauuuugugaggugcugcugucucu

SEQ ID NO: 228598 - RNA, 32 nt, Human
ucacugcccaagucauggcaacaggcuggagc

SEQ ID NO: 228599 - RNA, 32 nt, Human
ucacugccccaccagccaccucuugggcaugc

SEQ ID NO: 228600 - RNA, 31 nt, Human
ucacugccccucucugggcuucaguuuccuc

SEQ ID NO: 228601 - RNA, 32 nt, Human
ucacugccccuuuguuuacagcuccugccucc

SEQ ID NO: 228602 - RNA, 32 nt, Human
ucacugcccuuccuccccagcccagccuggga

SEQ ID NO: 228603 - RNA, 32 nt, Human
ucacugccgccucaaccucuccuggguucagg

SEQ ID NO: 228604 - RNA, 32 nt, Human
ucacugccuccuuccuccugguguugccacuu

SEQ ID NO: 228605 - RNA, 32 nt, Human
ucacugccugggcaguggcacaaccauccccc

SEQ ID NO: 228606 - RNA, 32 nt, Human
ucacugccugguaucuuaguguggaccgaagc

SEQ ID NO: 228607 - RNA, 32 nt, Human
ucacugccugucacaagccucaguguggccug

SEQ ID NO: 228608 - RNA, 32 nt, Human
ucacugccuguuccccacugccuguguucgca

SEQ ID NO: 228609 - RNA, 32 nt, Human
ucacugccuuaaaacagauuucuaugacaguu

SEQ ID NO: 228610 - RNA, 32 nt, Human
ucacugccuucuuccuccucuugccccauuca

SEQ ID NO: 228611 - RNA, 32 nt, Human
ucacugccuugccacuccaucucccuccgugc

SEQ ID NO: 228612 - RNA, 32 nt, Human
ucacugccuuuauuuucccuccucccucuugu

SEQ ID NO: 228613 - RNA, 21 nt, Human
ucacugcgaccucugcuuccu

SEQ ID NO: 228614 - RNA, 32 nt, Human
ucacugcggccuugaacuccugggcuuaagug

SEQ ID NO: 228615 - RNA, 32 nt, Human
ucacugcgggcuccugagccugcuucugccug

SEQ ID NO: 228616 - RNA, 32 nt, Human
ucacugcuacucagccugagguugcagacugg

SEQ ID NO: 228617 - RNA, 23 nt, Human
ucacugcucacccaccugcugcu

SEQ ID NO: 228618 - RNA, 32 nt, Human
ucacugcucacuguagccuugacucuggagcu

SEQ ID NO: 228619 - RNA, 32 nt, Human
ucacugcucagugcaaccucugccucccagga

SEQ ID NO: 228620 - RNA, 32 nt, Human
ucacugcucaguuaaagguuccagggauucca

SEQ ID NO: 228621 - RNA, 32 nt, Human
ucacugcuccucuccacccagcagugggcuag

SEQ ID NO: 228622 - RNA, 25 nt, Human
ucacugcucuauguccucugcuccu

SEQ ID NO: 228623 - RNA, 32 nt, Human
ucacugcucugcauggccuggugcagggcucc

SEQ ID NO: 228624 - RNA, 25 nt, Human
ucacugcucuguguccucugcuccu

SEQ ID NO: 228625 - RNA, 32 nt, Human
ucacugcugagugagagggcuaggcagugucu

SEQ ID NO: 228626 - RNA, 32 nt, Human
ucacugcugcaaccucccccuccuggguucaa

SEQ ID NO: 228627 - RNA, 32 nt, Human
ucacugcugcagggccuuccugccuggacaga

SEQ ID NO: 228628 - RNA, 32 nt, Human
ucacugcugcgcgcacagucucccgggacuug

SEQ ID NO: 228629 - RNA, 32 nt, Human
ucacugcugcugucugugacuccacgucugug

SEQ ID NO: 228630 - RNA, 21 nt, Human
ucacugcugucucugccuccu

SEQ ID NO: 228631 - RNA, 21 nt, Human
ucacugcuguggcaaacccag

SEQ ID NO: 228632 - RNA, 31 nt, Human
ucacugcuguucucugggcuuguugacuguc

SEQ ID NO: 228633 - RNA, 32 nt, Human
ucacugcuuccagaauuuuagaguacugguaa

SEQ ID NO: 228634 - RNA, 32 nt, Human
ucacugcuugagccacugcccuaguuggcacu

SEQ ID NO: 228635 - RNA, 32 nt, Human
ucacugcuuugcaaaguggggccugagguaga

SEQ ID NO: 228636 - RNA, 32 nt, Human
ucacuggaggcuggaaugaaugaucacuagaa

SEQ ID NO: 228637 - RNA, 32 nt, Human
ucacuggagggagauuugauggguacagagca

SEQ ID NO: 228638 - RNA, 32 nt, Human
ucacuggagguugaagccaaguggggugcugg

SEQ ID NO: 228639 - RNA, 32 nt, Human
ucacuggagugcaccugccucuaccucauggg

SEQ ID NO: 228640 - RNA, 32 nt, Human
ucacuggaguucgaggcugcagugagcuauga

SEQ ID NO: 228641 - RNA, 31 nt, Human
ucacuggauaaauaaaauaugugaacaagug

SEQ ID NO: 228642 - RNA, 32 nt, Human
ucacuggauccaccacggccuggguggacggc

SEQ ID NO: 228643 - RNA, 32 nt, Human
ucacuggcaaagggucuagaauaaccuuuagg

SEQ ID NO: 228644 - RNA, 32 nt, Human
ucacuggcacuucucccuccggccacacggcg

SEQ ID NO: 228645 - RNA, 32 nt, Human
ucacuggcagccccagcaccaccaggucuccc

SEQ ID NO: 228646 - RNA, 32 nt, Human
ucacuggcaggaagagcuaaagauccgagaaa

SEQ ID NO: 228647 - RNA, 31 nt, Human
ucacuggcaucagcuaauaccaaagugaguu

SEQ ID NO: 228648 - RNA, 32 nt, Human
ucacuggcauggaugaucaggagcugccuaua

SEQ ID NO: 228649 - RNA, 32 nt, Human
ucacuggccacaucuuuggaaggggauggugg

SEQ ID NO: 228650 - RNA, 32 nt, Human
ucacuggcccagugguguucuaccuccuaccc

SEQ ID NO: 228651 - RNA, 32 nt, Human
ucacuggcccugagcacuugaaggugcagcaa

SEQ ID NO: 228652 - RNA, 32 nt, Human
ucacuggccggaaggaugugucucagcccugc

SEQ ID NO: 228653 - RNA, 32 nt, Human
ucacuggccuuacccuccuccuggccuuacua

SEQ ID NO: 228654 - RNA, 32 nt, Human
ucacuggccuuugcaguccccaaaggaucagg

SEQ ID NO: 228655 - RNA, 32 nt, Human
ucacuggcuccaggaaacccgcugguguugac

SEQ ID NO: 228656 - RNA, 25 nt, Human
ucacuggcuuguuuguucccuacca

SEQ ID NO: 228657 - RNA, 32 nt, Human
ucacuggcuuguuuguucccuaccaauauucu

SEQ ID NO: 228658 - RNA, 32 nt, Human
ucacuggcuuugcccuggaauuugccagaugc

SEQ ID NO: 228659 - RNA, 32 nt, Human
ucacugggaauagcauugugcguguccggaaa

SEQ ID NO: 228660 - RNA, 32 nt, Human
ucacugggagagaagagccguccagggaccca

SEQ ID NO: 228661 - RNA, 32 nt, Human
ucacugggagcaaugggguugcagcugaaguc

SEQ ID NO: 228662 - RNA, 32 nt, Human
ucacugggcauauccuccuucuccuuaaccag

SEQ ID NO: 228663 - RNA, 32 nt, Human
ucacugggccaggcaccucucuccccauggug

SEQ ID NO: 228664 - RNA, 32 nt, Human
ucacugggcugacauggagaaggcuggcaagc

SEQ ID NO: 228665 - RNA, 21 nt, Human
ucacugggcugggugcagugg

SEQ ID NO: 228666 - RNA, 32 nt, Human
ucacuggggaaaggagggaaaagugcauuuau

SEQ ID NO: 228667 - RNA, 32 nt, Human
ucacuggggcccugucugugugcugagccagu

SEQ ID NO: 228668 - RNA, 32 nt, Human
ucacuggggcggaggcagcggcuguagcgggg

SEQ ID NO: 228669 - RNA, 32 nt, Human
ucacugggguuagagguggguccgaaauaauc

SEQ ID NO: 228670 - RNA, 32 nt, Human
ucacugggucaccaucgagaucaauccuccuc

SEQ ID NO: 228671 - RNA, 32 nt, Human
ucacuggguuggucaaagguagucaccuuggc

SEQ ID NO: 228672 - RNA, 32 nt, Human
ucacuggucaaccuuugugcucccagauccca

SEQ ID NO: 228673 - RNA, 32 nt, Human
ucacuggucauugugugaaauaaagauaaucu

SEQ ID NO: 228674 - RNA, 32 nt, Human
ucacugguccacccuuccugucagggcuuuuc

SEQ ID NO: 228675 - RNA, 32 nt, Human
ucacuggucugacuugucaccugccaaugccu

SEQ ID NO: 228676 - RNA, 32 nt, Human
ucacuggucuuguaacuguccucuccuuauua

SEQ ID NO: 228677 - RNA, 32 nt, Human
ucacugguggcuguuccugaaggaggcccugc

SEQ ID NO: 228678 - RNA, 32 nt, Human
ucacuggugggcuuugggagaugaggaggaua

SEQ ID NO: 228679 - RNA, 32 nt, Human
ucacugguucagucuuaaaugccugcauggug

SEQ ID NO: 228680 - RNA, 32 nt, Human
ucacugguucuucaucuuuugucuguugcacg

SEQ ID NO: 228681 - RNA, 24 nt, Human
ucacugguuucagauguucauuua

SEQ ID NO: 228682 - RNA, 32 nt, Human
ucacugguuugcaggcgcuuuccucuuggaag

SEQ ID NO: 228683 - RNA, 32 nt, Human
ucacuguaaagcaguugaaagaauuuauucag

SEQ ID NO: 228684 - RNA, 32 nt, Human
ucacuguauuagccaggauggucucgaucucc

SEQ ID NO: 228685 - RNA, 32 nt, Human
ucacuguauuuuugaaacuucuaacgucauaa

SEQ ID NO: 228686 - RNA, 32 nt, Human
ucacugucaaccaggccagagugcagugaaga

SEQ ID NO: 228687 - RNA, 32 nt, Human
ucacugucaccaaggcuuagugcagugacaca

SEQ ID NO: 228688 - RNA, 32 nt, Human
ucacugucaccaggcuggagugcaguggugca

SEQ ID NO: 228689 - RNA, 32 nt, Human
ucacugucacccaggccggagugcaguggcac

SEQ ID NO: 228690 - RNA, 32 nt, Human
ucacugucacccaggcugaacugcaguggugu

SEQ ID NO: 228691 - RNA, 32 nt, Human
ucacugucacccaggcuggagugcaguggcau

SEQ ID NO: 228692 - RNA, 32 nt, Human
ucacugucacccagucuggaguggaguggcau

SEQ ID NO: 228693 - RNA, 32 nt, Human
ucacugucaccuaggcuggagugcagugguaa

SEQ ID NO: 228694 - RNA, 32 nt, Human
ucacuguccaguuuggugggaggaacugaaug

SEQ ID NO: 228695 - RNA, 31 nt, Human
ucacugucccucucugucugucucucagccu

SEQ ID NO: 228696 - RNA, 32 nt, Human
ucacugucgcccaggcuggagugcaguggcgc

SEQ ID NO: 228697 - RNA, 32 nt, Human
ucacugucgcccaggcuggagugcaguggcgu

SEQ ID NO: 228698 - RNA, 32 nt, Human
ucacugucgcccaggcuggagugcgguggugc

SEQ ID NO: 228699 - RNA, 22 nt, Human
ucacugucuacaccaucccucu

SEQ ID NO: 228700 - RNA, 32 nt, Human
ucacugucucccaggcuggaauguagggugug

SEQ ID NO: 228701 - RNA, 32 nt, Human
ucacugucuccuaggcuggagugcaguggugu

SEQ ID NO: 228702 - RNA, 32 nt, Human
ucacugucugcagcugccugucuggugucugu

SEQ ID NO: 228703 - RNA, 32 nt, Human
ucacugugaaaccuugcagaggaggagagggc

SEQ ID NO: 228704 - RNA, 32 nt, Human
ucacugugaacacauucugguugugcagaacc

SEQ ID NO: 228705 - RNA, 32 nt, Human
ucacugugagccagacacuguguuaaauacug

SEQ ID NO: 228706 - RNA, 32 nt, Human
ucacugugagucugaugugugaagaaggguau

SEQ ID NO: 228707 - RNA, 32 nt, Human
ucacugugagucuugcucugucgcccaggcug

SEQ ID NO: 228708 - RNA, 32 nt, Human
ucacugugccacucuacuccagccugggcaac

SEQ ID NO: 228709 - RNA, 32 nt, Human
ucacugugcuacucuacuccagccugggcaac

SEQ ID NO: 228710 - RNA, 32 nt, Human
ucacugugcuucaagguuguagaaagagcaca

SEQ ID NO: 228711 - RNA, 18 nt, Human
ucacugugcuucgagcca

SEQ ID NO: 228712 - RNA, 32 nt, Human
ucacuguggguagccugggauuaggccucauc

SEQ ID NO: 228713 - RNA, 32 nt, Human
ucacuguggugggaaagaucacacuacaugcc

SEQ ID NO: 228714 - RNA, 32 nt, Human
ucacugugguuacaaggcccuguccuggcugg

SEQ ID NO: 228715 - RNA, 32 nt, Human
ucacugugucagccaggauggucucgaucucc

SEQ ID NO: 228716 - RNA, 32 nt, Human
ucacugugucccacccuuccuagcuuugugcc

SEQ ID NO: 228717 - RNA, 32 nt, Human
ucacuguguuagccaggauggucucaaucucc

SEQ ID NO: 228718 - RNA, 32 nt, Human
ucacuguguuagccaggauggucucgaucucc

SEQ ID NO: 228719 - RNA, 32 nt, Human
ucacuguguuagccaggauggucuggaucucc

SEQ ID NO: 228720 - RNA, 32 nt, Human
ucacuguguuagccaggauggucuugaucucc

SEQ ID NO: 228721 - RNA, 32 nt, Human
ucacuguguuagccaggauggucuuggucucc

SEQ ID NO: 228722 - RNA, 32 nt, Human
ucacuguguugccaggcuggucucaaacuccu

SEQ ID NO: 228723 - RNA, 32 nt, Human
ucacuguuaccuguguuaguaucugcaaaugc

SEQ ID NO: 228724 - RNA, 32 nt, Human
ucacuguuaguguggccaagagcaggguuuuc

SEQ ID NO: 228725 - RNA, 32 nt, Human
ucacuguuauccaggcuggagugcagaggcac

SEQ ID NO: 228726 - RNA, 32 nt, Human
ucacuguuccaggaauucuugcaguguagagg

SEQ ID NO: 228727 - RNA, 32 nt, Human
ucacuguucccuggcaaauucugaccacaccu

SEQ ID NO: 228728 - RNA, 32 nt, Human
ucacuguucucccaucacacccuucagcccau

SEQ ID NO: 228729 - RNA, 21 nt, Human
ucacuguugacucuauucuga

SEQ ID NO: 228730 - RNA, 32 nt, Human
ucacuguugccaggcuggagugcaguggcaca

SEQ ID NO: 228731 - RNA, 32 nt, Human
ucacuguugcccaggcuggagugcaguggugc

SEQ ID NO: 228732 - RNA, 32 nt, Human
ucacuguugcccaggcuggagugcauugaugu

SEQ ID NO: 228733 - RNA, 32 nt, Human
ucacuguugcccaggcuggcgugcaguggugc

SEQ ID NO: 228734 - RNA, 32 nt, Human
ucacuguugccuggcuggagcacuuugguuua

SEQ ID NO: 228735 - RNA, 32 nt, Human
ucacuguuguugcccaggcuggagugcagugg

SEQ ID NO: 228736 - RNA, 32 nt, Human
ucacuuaaacccaggaggcggagguugcagug

SEQ ID NO: 228737 - RNA, 32 nt, Human
ucacuuaaacccaggagguggagguugcagug

SEQ ID NO: 228738 - RNA, 32 nt, Human
ucacuuaaaggccauaugaccuuagacaaguc

SEQ ID NO: 228739 - RNA, 32 nt, Human
ucacuuaaaggccaugaguuacucgggaggcu

SEQ ID NO: 228740 - RNA, 32 nt, Human
ucacuuaaccaccccauaccagucaccuccug

SEQ ID NO: 228741 - RNA, 20 nt, Human
ucacuuaacuguuguuaaga

SEQ ID NO: 228742 - RNA, 32 nt, Human
ucacuuaaggccaugaguuugaggcuacagag

SEQ ID NO: 228743 - RNA, 32 nt, Human
ucacuuacaggggagaaggaaaugcagggcac

SEQ ID NO: 228744 - RNA, 32 nt, Human
ucacuuaccauggcuagagaugggggugagac

SEQ ID NO: 228745 - RNA, 32 nt, Human
ucacuuacuaguuugcagugcugggcagguga

SEQ ID NO: 228746 - RNA, 32 nt, Human
ucacuuaggcuggagugcaguggcguggucac

SEQ ID NO: 228747 - RNA, 22 nt, Human
ucacuuaggcuuuccucugcca

SEQ ID NO: 228748 - RNA, 32 nt, Human
ucacuuagggcaucuccugcugccuucagcug

SEQ ID NO: 228749 - RNA, 32 nt, Human
ucacuuagggccuggggcucaaggagcuguag

SEQ ID NO: 228750 - RNA, 32 nt, Human
ucacuuaggucaucuaaaagcuuuuagagauu

SEQ ID NO: 228751 - RNA, 32 nt, Human
ucacuuauagcuuggaaauugucuucuguugg

SEQ ID NO: 228752 - RNA, 32 nt, Human
ucacuucaauaacagccuccuccaacucauuu

SEQ ID NO: 228753 - RNA, 32 nt, Human
ucacuucacacuuggcaugcacugugaaagcu

SEQ ID NO: 228754 - RNA, 32 nt, Human
ucacuucaccuccauaagaaccuguguuucca

SEQ ID NO: 228755 - RNA, 32 nt, Human
ucacuucaccucucugugccuugguuuccuca

SEQ ID NO: 228756 - RNA, 32 nt, Human
ucacuucacugcacuccagucugggugacaga

SEQ ID NO: 228757 - RNA, 32 nt, Human
ucacuucacugcauuccagauuggacauguuc

SEQ ID NO: 228758 - RNA, 32 nt, Human
ucacuucagcccaggagguggagguugcagug

SEQ ID NO: 228759 - RNA, 32 nt, Human
ucacuucagcccaggaguuuaaggcugcagug

SEQ ID NO: 228760 - RNA, 21 nt, Human
ucacuucagucauauccugga

SEQ ID NO: 228761 - RNA, 32 nt, Human
ucacuucagugcagugugguguagguguuacg

SEQ ID NO: 228762 - RNA, 22 nt, Human
ucacuucaguuucccaguuccu

SEQ ID NO: 228763 - RNA, 32 nt, Human
ucacuucauauuuuucuuguauuaacuguuua

SEQ ID NO: 228764 - RNA, 32 nt, Human
ucacuucauccagcaacuagcacccggugcag

SEQ ID NO: 228765 - RNA, 32 nt, Human
ucacuucaucuucucagcucccauuucuacuc

SEQ ID NO: 228766 - RNA, 32 nt, Human
ucacuucauuguccucaccaucccacccugaa

SEQ ID NO: 228767 - RNA, 31 nt, Human
ucacuuccauuugucugacauggagauugag

SEQ ID NO: 228768 - RNA, 32 nt, Human
ucacuucccagagggugcaggagccagcucug

SEQ ID NO: 228769 - RNA, 32 nt, Human
ucacuucccugagacuugguucuggguccuua

SEQ ID NO: 228770 - RNA, 24 nt, Human
ucacuucccugggaacucauccug

SEQ ID NO: 228771 - RNA, 32 nt, Human
ucacuuccggccucucugcccuggcuuaugug

SEQ ID NO: 228772 - RNA, 32 nt, Human
ucacuuccuaaacugcagcccggcccacccgg

SEQ ID NO: 228773 - RNA, 32 nt, Human
ucacuuccuaaacugcagccuggcccacccgg

SEQ ID NO: 228774 - RNA, 32 nt, Human
ucacuuccugguuccucuaccuuucccguuug

SEQ ID NO: 228775 - RNA, 19 nt, Human
ucacuuccuuacuccucca

SEQ ID NO: 228776 - RNA, 24 nt, Human
ucacuucuacaaaucagcaagaua

SEQ ID NO: 228777 - RNA, 32 nt, Human
ucacuucucccaggaacguguguaugugaaug

SEQ ID NO: 228778 - RNA, 32 nt, Human
ucacuucucuacugccucccagccccacgguu

SEQ ID NO: 228779 - RNA, 32 nt, Human
ucacuucucugcuucuuccccaacacagcugc

SEQ ID NO: 228780 - RNA, 32 nt, Human
ucacuucugacaggggaaguggguccccaggu

SEQ ID NO: 228781 - RNA, 32 nt, Human
ucacuucugcuccaauucucuuccucucuaaa

SEQ ID NO: 228782 - RNA, 32 nt, Human
ucacuucugcucucacacuacugccauacauu

SEQ ID NO: 228783 - RNA, 32 nt, Human
ucacuucugggaugugccccagcacugagaac

SEQ ID NO: 228784 - RNA, 32 nt, Human
ucacuucugucagucuguaagcuuugauaacc

SEQ ID NO: 228785 - RNA, 32 nt, Human
ucacuucugucucuuaggcagacuuguacggc

SEQ ID NO: 228786 - RNA, 32 nt, Human
ucacuugaaccaaggagguggagguugcagug

SEQ ID NO: 228787 - RNA, 32 nt, Human
ucacuugaacccagaagacagguugcagugag

SEQ ID NO: 228788 - RNA, 32 nt, Human
ucacuugaacccagaaggcggaaguugcagug

SEQ ID NO: 228789 - RNA, 32 nt, Human
ucacuugaacccagaaggugcagguugcagug

SEQ ID NO: 228790 - RNA, 32 nt, Human
ucacuugaacccagcaggcggagguugcggug

SEQ ID NO: 228791 - RNA, 32 nt, Human
ucacuugaacccaggaagcggagguugcaauc

SEQ ID NO: 228792 - RNA, 32 nt, Human
ucacuugaacccaggaagcgggguugcaguga

SEQ ID NO: 228793 - RNA, 32 nt, Human
ucacuugaacccaggaaguggagguugcagug

SEQ ID NO: 228794 - RNA, 32 nt, Human
ucacuugaacccaggagacggagguugcggug

SEQ ID NO: 228795 - RNA, 32 nt, Human
ucacuugaacccaggagacggugguugcagug

SEQ ID NO: 228796 - RNA, 32 nt, Human
ucacuugaacccaggaggcagagguugcaguc

SEQ ID NO: 228797 - RNA, 32 nt, Human
ucacuugaacccaggaggcagagguugcagug

SEQ ID NO: 228798 - RNA, 32 nt, Human
ucacuugaacccaggaggcagagguugcggug

SEQ ID NO: 228799 - RNA, 32 nt, Human
ucacuugaacccaggaggcagagguuggggug

SEQ ID NO: 228800 - RNA, 32 nt, Human
ucacuugaacccaggaggcagcuguugcagug

SEQ ID NO: 228801 - RNA, 32 nt, Human
ucacuugaacccaggaggcggaaguugcagug

SEQ ID NO: 228802 - RNA, 32 nt, Human
ucacuugaacccaggaggcggagguugcagug

SEQ ID NO: 228803 - RNA, 32 nt, Human
ucacuugaacccaggaggcggagguugcggug

SEQ ID NO: 228804 - RNA, 32 nt, Human
ucacuugaacccaggagguagaggcugcagug

SEQ ID NO: 228805 - RNA, 32 nt, Human
ucacuugaacccaggagguagagguugcagug

SEQ ID NO: 228806 - RNA, 32 nt, Human
ucacuugaacccaggagguggagauugcagug

SEQ ID NO: 228807 - RNA, 32 nt, Human
ucacuugaacccaggagguggaggcugcggug

SEQ ID NO: 228808 - RNA, 32 nt, Human
ucacuugaacccaggagguggagguuacagug

SEQ ID NO: 228809 - RNA, 32 nt, Human
ucacuugaacccaggagguggagguugcagca

SEQ ID NO: 228810 - RNA, 32 nt, Human
ucacuugaacccaggagguggagguugcagug

SEQ ID NO: 228811 - RNA, 32 nt, Human
ucacuugaacccaggagguggagguuguagug

SEQ ID NO: 228812 - RNA, 32 nt, Human
ucacuugaacccaggagguggagguuguggug

SEQ ID NO: 228813 - RNA, 32 nt, Human
ucacuugaacccaggaggugggcauugcagug

SEQ ID NO: 228814 - RNA, 32 nt, Human
ucacuugaacccaggagguggugguugcagug

SEQ ID NO: 228815 - RNA, 32 nt, Human
ucacuugaacccaggagguguugcagugaacc

SEQ ID NO: 228816 - RNA, 32 nt, Human
ucacuugaacccaggagguugaggcugcagug

SEQ ID NO: 228817 - RNA, 32 nt, Human
ucacuugaacccaguaggcggaaguugcagug

SEQ ID NO: 228818 - RNA, 32 nt, Human
ucacuugaaccccagaggcagaggcugaagug

SEQ ID NO: 228819 - RNA, 32 nt, Human
ucacuugaacucaggagguggagguugcagug

SEQ ID NO: 228820 - RNA, 32 nt, Human
ucacuugaacucgggaggaagagguugcagug

SEQ ID NO: 228821 - RNA, 32 nt, Human
ucacuugaagccaggaggcggagguugcagug

SEQ ID NO: 228822 - RNA, 32 nt, Human
ucacuugaagucaggaguuugagaccagccug

SEQ ID NO: 228823 - RNA, 32 nt, Human
ucacuugaauccaggaggcgaagguugcagug

SEQ ID NO: 228824 - RNA, 32 nt, Human
ucacuugaauccaggaggcggaguuuguggug

SEQ ID NO: 228825 - RNA, 32 nt, Human
ucacuugaauucaggagguggagguugcagug

SEQ ID NO: 228826 - RNA, 32 nt, Human
ucacuugagcccagaaguuugagaccagccug

SEQ ID NO: 228827 - RNA, 32 nt, Human
ucacuugagcccaggaggccaagguugcagug

SEQ ID NO: 228828 - RNA, 32 nt, Human
ucacuugagcccaggaggucaaggcugcagug

SEQ ID NO: 228829 - RNA, 32 nt, Human
ucacuugagcccaggaggucgaggcugcagug

SEQ ID NO: 228830 - RNA, 32 nt, Human
ucacuugagcccaggaggucgagguugcagug

SEQ ID NO: 228831 - RNA, 32 nt, Human
ucacuugagcccaggaggucuaggcugcagug

SEQ ID NO: 228832 - RNA, 32 nt, Human
ucacuugagcccaggagguggagguugcagug

SEQ ID NO: 228833 - RNA, 32 nt, Human
ucacuugagcccaggagguggagguuucagcg

SEQ ID NO: 228834 - RNA, 32 nt, Human
ucacuugagcccaggagguugaggcugcagug

SEQ ID NO: 228835 - RNA, 32 nt, Human
ucacuugagcccaggagugcaaaagcagccug

SEQ ID NO: 228836 - RNA, 32 nt, Human
ucacuugagcccaggaguucaagaccaacaug

SEQ ID NO: 228837 - RNA, 32 nt, Human
ucacuugagcccaggaguucaagaccagccug

SEQ ID NO: 228838 - RNA, 32 nt, Human
ucacuugagcccaggaguucaagaccagcuug

SEQ ID NO: 228839 - RNA, 32 nt, Human
ucacuugagcccaggaguuccagaccagugug

SEQ ID NO: 228840 - RNA, 32 nt, Human
ucacuugagcccaggaguucuagacaagccug

SEQ ID NO: 228841 - RNA, 32 nt, Human
ucacuugagcccaggaguucugggcuguagug

SEQ ID NO: 228842 - RNA, 32 nt, Human
ucacuugagcccaggaguuggaggccgcagug

SEQ ID NO: 228843 - RNA, 32 nt, Human
ucacuugagcccaggaguuuaagaccagccug

SEQ ID NO: 228844 - RNA, 32 nt, Human
ucacuugagcccaggaguuugagguugcagug

SEQ ID NO: 228845 - RNA, 32 nt, Human
ucacuugagcccaggaguuuugaguccagccu

SEQ ID NO: 228846 - RNA, 32 nt, Human
ucacuugagcccagggguucgagaccagcuug

SEQ ID NO: 228847 - RNA, 32 nt, Human
ucacuugagccccagaggucaaggcugcagug

SEQ ID NO: 228848 - RNA, 32 nt, Human
ucacuugagccccagggguggaggcugcaaug

SEQ ID NO: 228849 - RNA, 32 nt, Human
ucacuugagcccgggagguugaggcugcagug

SEQ ID NO: 228850 - RNA, 32 nt, Human
ucacuugagccugggagguugugguugcagug

SEQ ID NO: 228851 - RNA, 32 nt, Human
ucacuugaggaguucaagaccagccuggucaa

SEQ ID NO: 228852 - RNA, 32 nt, Human
ucacuugaguuucuugaaggcuuccuggccuc

SEQ ID NO: 228853 - RNA, 32 nt, Human
ucacuugaucccaggaggcggagguugcagug

SEQ ID NO: 228854 - RNA, 32 nt, Human
ucacuugauuuggaaggacacagggcugucaa

SEQ ID NO: 228855 - RNA, 32 nt, Human
ucacuugcaaaggaccucacacaugccccggc

SEQ ID NO: 228856 - RNA, 32 nt, Human
ucacuugcagcuccauuuccaucacgugguaa

SEQ ID NO: 228857 - RNA, 32 nt, Human
ucacuugcaguuuccuguucuccucauugccu

SEQ ID NO: 228858 - RNA, 32 nt, Human
ucacuugcccuugagucaaucuuuccauguca

SEQ ID NO: 228859 - RNA, 32 nt, Human
ucacuugccggcccuuugcaaugaaugacucu

SEQ ID NO: 228860 - RNA, 32 nt, Human
ucacuugccgggaagguggcucgggccaggcu

SEQ ID NO: 228861 - RNA, 32 nt, Human
ucacuugccuuuggcuuccuguugacuucuuc

SEQ ID NO: 228862 - RNA, 32 nt, Human
ucacuugcucauccuugcucuaccucaacgug

SEQ ID NO: 228863 - RNA, 31 nt, Human
ucacuugcucucucuggccucuuucaggcuc

SEQ ID NO: 228864 - RNA, 32 nt, Human
ucacuugcuggcugugaaaccaggacaagcua

SEQ ID NO: 228865 - RNA, 32 nt, Human
ucacuuggacuccagagguggagguugcagua

SEQ ID NO: 228866 - RNA, 32 nt, Human
ucacuuggagugacaaugggagaggucaggaa

SEQ ID NO: 228867 - RNA, 32 nt, Human
ucacuuggaugcaugaccucuucaugaagaac

SEQ ID NO: 228868 - RNA, 31 nt, Human
ucacuuggcaaagcagcucggcgucucagcc

SEQ ID NO: 228869 - RNA, 19 nt, Human
ucacuuggcaccugccccu

SEQ ID NO: 228870 - RNA, 32 nt, Human
ucacuuggcaccugccccugaggguccugaga

SEQ ID NO: 228871 - RNA, 32 nt, Human
ucacuuggcuccccucuccuccuuagccagaa

SEQ ID NO: 228872 - RNA, 32 nt, Human
ucacuugggagcuuauugaaaugcagauccca

SEQ ID NO: 228873 - RNA, 32 nt, Human
ucacuugggcccaggaggucaagccugcagcg

SEQ ID NO: 228874 - RNA, 32 nt, Human
ucacuuggguccaggagguggaggcugcagug

SEQ ID NO: 228875 - RNA, 32 nt, Human
ucacuuggguuggagugcaguugcaggaucau

SEQ ID NO: 228876 - RNA, 18 nt, Human
ucacuugguacacaccuu

SEQ ID NO: 228877 - RNA, 32 nt, Human
ucacuuggucugucugucucugucuugguagu

SEQ ID NO: 228878 - RNA, 32 nt, Human
ucacuuguaaccauuguacucuuauggauuug

SEQ ID NO: 228879 - RNA, 32 nt, Human
ucacuuguacccaggagguggagguugcggug

SEQ ID NO: 228880 - RNA, 32 nt, Human
ucacuuguacuguugcugauuuuugcaucuuc

SEQ ID NO: 228881 - RNA, 32 nt, Human
ucacuuguaggugauuaaaaagauugacagcc

SEQ ID NO: 228882 - RNA, 32 nt, Human
ucacuuguagguuucucugccuccagguugcc

SEQ ID NO: 228883 - RNA, 32 nt, Human
ucacuugucacccaggcuggagugcaguggcu

SEQ ID NO: 228884 - RNA, 32 nt, Human
ucacuugucuuaaaggaggacaggcagucucu

SEQ ID NO: 228885 - RNA, 21 nt, Human
ucacuugugcuuagcuuagca

SEQ ID NO: 228886 - RNA, 32 nt, Human
ucacuugugcuuugaugccugcuucugaacaa

SEQ ID NO: 228887 - RNA, 32 nt, Human
ucacuugugggagcuggaccagccuggguuuc

SEQ ID NO: 228888 - RNA, 32 nt, Human
ucacuuguguagguagguuggaaucaggauag

SEQ ID NO: 228889 - RNA, 32 nt, Human
ucacuugugucacccccauagucauuggguug

SEQ ID NO: 228890 - RNA, 32 nt, Human
ucacuuguuggacauuuuuccaauaaagguuc

SEQ ID NO: 228891 - RNA, 32 nt, Human
ucacuuuagacaggacccaauggcugcacugc

SEQ ID NO: 228892 - RNA, 32 nt, Human
ucacuuuaucugccaagcugcuguguuuuaag

SEQ ID NO: 228893 - RNA, 32 nt, Human
ucacuuuauuccagcacuucucuguguuuuac

SEQ ID NO: 228894 - RNA, 32 nt, Human
ucacuuucaagaaguuaugaagaaaagagaag

SEQ ID NO: 228895 - RNA, 32 nt, Human
ucacuuucauguccagagcugcuuagacugau

SEQ ID NO: 228896 - RNA, 32 nt, Human
ucacuuucauuuucuuacuuacuagaccauuu

SEQ ID NO: 228897 - RNA, 32 nt, Human
ucacuuuccaccacugucagccuggaaagaga

SEQ ID NO: 228898 - RNA, 32 nt, Human
ucacuuucccucuccaggccuccaggccuccu

SEQ ID NO: 228899 - RNA, 32 nt, Human
ucacuuuccucuuccacuuugauaccauuggg

SEQ ID NO: 228900 - RNA, 32 nt, Human
ucacuuuccuggauccaggauaauuuuuaaac

SEQ ID NO: 228901 - RNA, 32 nt, Human
ucacuuucgcugcguuggaggcugaggagaau

SEQ ID NO: 228902 - RNA, 32 nt, Human
ucacuuucucccuggcugcagaacuagacacc

SEQ ID NO: 228903 - RNA, 32 nt, Human
ucacuuucuccuccuccucaugcccugccuug

SEQ ID NO: 228904 - RNA, 32 nt, Human
ucacuuucucuagcccaucauuaccugugaac

SEQ ID NO: 228905 - RNA, 32 nt, Human
ucacuuucucucucacuccacucaagcagcgg

SEQ ID NO: 228906 - RNA, 32 nt, Human
ucacuuucucugaaugcuucugagccuugccu

SEQ ID NO: 228907 - RNA, 32 nt, Human
ucacuuucugacuccagccuugccagccugac

SEQ ID NO: 228908 - RNA, 32 nt, Human
ucacuuugaacaaaccacuuugcccaaccuga

SEQ ID NO: 228909 - RNA, 32 nt, Human
ucacuuugaaguauuuguauccuuuuacaaaa

SEQ ID NO: 228910 - RNA, 32 nt, Human
ucacuuugaaucuguugguuuuucccccuaca

SEQ ID NO: 228911 - RNA, 32 nt, Human
ucacuuugagaaauucaccaaauaugaauuuu

SEQ ID NO: 228912 - RNA, 32 nt, Human
ucacuuugcugugguuggcuuaagagguuugu

SEQ ID NO: 228913 - RNA, 32 nt, Human
ucacuuugcuugcugaccccuuccucauaguu

SEQ ID NO: 228914 - RNA, 32 nt, Human
ucacuuuggcauucaucgccucuuuuccucuu

SEQ ID NO: 228915 - RNA, 32 nt, Human
ucacuuugggaggccagggcagguggauugcc

SEQ ID NO: 228916 - RNA, 32 nt, Human
ucacuuuggggaggggaaaaagaauaguaugc

SEQ ID NO: 228917 - RNA, 32 nt, Human
ucacuuuguaaaccaggugggggcaucucaca

SEQ ID NO: 228918 - RNA, 32 nt, Human
ucacuuuguagggugggggauuacugagaguc

SEQ ID NO: 228919 - RNA, 32 nt, Human
ucacuuugucucuggcaucuagcauggugccu

SEQ ID NO: 228920 - RNA, 32 nt, Human
ucacuuuguuagccaggauggucucaaucucc

SEQ ID NO: 228921 - RNA, 32 nt, Human
ucacuuuguugcccaggcuagucucaaacucc

SEQ ID NO: 228922 - RNA, 32 nt, Human
ucacuuuucaacagagucaucuagaagggagg

SEQ ID NO: 228923 - RNA, 32 nt, Human
ucacuuuuccagagugaaauguaggagggagc

SEQ ID NO: 228924 - RNA, 32 nt, Human
ucacuuuucccacccuguauuuuguuucuuua

SEQ ID NO: 228925 - RNA, 32 nt, Human
ucacuuuuccuggggccccucuccccaacccu

SEQ ID NO: 228926 - RNA, 32 nt, Human
ucacuuuucggaucuucugucccagauccugc

SEQ ID NO: 228927 - RNA, 32 nt, Human
ucacuuuugaagaaccaaaugaccucacuggu

SEQ ID NO: 228928 - RNA, 32 nt, Human
ucacuuuugauccuuccagcuccagggucucg

SEQ ID NO: 228929 - RNA, 32 nt, Human
ucacuuuugcccaggcuggagugcaguggcgu

SEQ ID NO: 228930 - RNA, 32 nt, Human
ucacuuuugcuccgaagcuacuucuccacugu

SEQ ID NO: 228931 - RNA, 32 nt, Human
ucacuuuuguugcccaggcuggagugcaacgg

SEQ ID NO: 228932 - RNA, 32 nt, Human
ucacuuuuguugcccaggcuggagugcaauga

SEQ ID NO: 228933 - RNA, 32 nt, Human
ucacuuuuguugcccaggcuggagugcaaugg

SEQ ID NO: 228934 - RNA, 32 nt, Human
ucacuuuuguugcccaggcuggaguguagugg

SEQ ID NO: 228935 - RNA, 32 nt, Human
ucacuuuuguugcccaggcuggaguucagugg

SEQ ID NO: 228936 - RNA, 32 nt, Human
ucacuuuuuauuuuuauggggguggguggugc

SEQ ID NO: 228937 - RNA, 32 nt, Human
ucacuuuuucaaggauauacacaucuguguuu

SEQ ID NO: 228938 - RNA, 32 nt, Human
ucacuuuuugagaagauucgcccuguacccca

SEQ ID NO: 228939 - RNA, 22 nt, Human
ucagaaaaaacaaauagaagaa

SEQ ID NO: 228940 - RNA, 22 nt, Human
ucagaaaaaagcaacaaaaaga

SEQ ID NO: 228941 - RNA, 32 nt, Human
ucagaaaaacucagaacauugagcuggcuuua

SEQ ID NO: 228942 - RNA, 32 nt, Human
ucagaaaacacaccuggaauacgaugcagccc

SEQ ID NO: 228943 - RNA, 32 nt, Human
ucagaaaacaugucucgaagauaugacuccag

SEQ ID NO: 228944 - RNA, 32 nt, Human
ucagaaaaccauuuucucugcaaagaaaggaa

SEQ ID NO: 228945 - RNA, 32 nt, Human
ucagaaaagacauauauuuccaugccuuuuua

SEQ ID NO: 228946 - RNA, 32 nt, Human
ucagaaaaggagagaggaaauuagcagagcga

SEQ ID NO: 228947 - RNA, 32 nt, Human
ucagaaaauacugauagacugacagaccccua

SEQ ID NO: 228948 - RNA, 32 nt, Human
ucagaaaaugcugcugacugugguauugcccc

SEQ ID NO: 228949 - RNA, 23 nt, Human
ucagaaaauucauuuuugagaua

SEQ ID NO: 228950 - RNA, 32 nt, Human
ucagaaacaaaaggacauuaaugaggaauaag

SEQ ID NO: 228951 - RNA, 32 nt, Human
ucagaaacacacucugaaaacaugcacagaac

SEQ ID NO: 228952 - RNA, 32 nt, Human
ucagaaacauaaagauugaaggggcaugugac

SEQ ID NO: 228953 - RNA, 32 nt, Human
ucagaaacccgcaaggcucugaaggguucuug

SEQ ID NO: 228954 - RNA, 20 nt, Human
ucagaaaccuucuccaagug

SEQ ID NO: 228955 - RNA, 32 nt, Human
ucagaaacuacugcaaacacuucuaugcauac

SEQ ID NO: 228956 - RNA, 32 nt, Human
ucagaaacucacugugauuccaaaaauguuuc

SEQ ID NO: 228957 - RNA, 32 nt, Human
ucagaaacucugagagagagcaugggcagaca

SEQ ID NO: 228958 - RNA, 32 nt, Human
ucagaaacugacaagaaaaucugaccuucauc

SEQ ID NO: 228959 - RNA, 32 nt, Human
ucagaaacugauuauuuggaucagaaaccauu

SEQ ID NO: 228960 - RNA, 32 nt, Human
ucagaaagaaacuuccaacacaguuucccaaa

SEQ ID NO: 228961 - RNA, 32 nt, Human
ucagaaagcagccacaggcccugucuggggca

SEQ ID NO: 228962 - RNA, 32 nt, Human
ucagaaagcuuuguauauuuugcaguugccag

SEQ ID NO: 228963 - RNA, 32 nt, Human
ucagaaaggagaaagcagaggccucuaacgca

SEQ ID NO: 228964 - RNA, 32 nt, Human
ucagaaaggagaaggauaucagaugagggaag

SEQ ID NO: 228965 - RNA, 32 nt, Human
ucagaaaggcuaacugugaugaugacacuuug

SEQ ID NO: 228966 - RNA, 32 nt, Human
ucagaaagggagaacgccagagcccuggcugg

SEQ ID NO: 228967 - RNA, 16 nt, Human
ucagaaagggcacuga

SEQ ID NO: 228968 - RNA, 21 nt, Human
ucagaaagucaccaggacuug

SEQ ID NO: 228969 - RNA, 21 nt, Human
ucagaaaguggucagaacuua

SEQ ID NO: 228970 - RNA, 25 nt, Human
ucagaaaucuuacaaaugugaagaa

SEQ ID NO: 228971 - RNA, 32 nt, Human
ucagaaaugaauauacaaguauacaaauuucc

SEQ ID NO: 228972 - RNA, 32 nt, Human
ucagaaaugaggcugacuauaaggcugcucug

SEQ ID NO: 228973 - RNA, 19 nt, Human
ucagaaaugcccccuccca

SEQ ID NO: 228974 - RNA, 31 nt, Human
ucagaaauggugaaugaauacaagaaaauuc

SEQ ID NO: 228975 - RNA, 32 nt, Human
ucagaaaugucaaugagacuaaagugguuuug

SEQ ID NO: 228976 - RNA, 18 nt, Human
ucagaaaugucaauucuu

SEQ ID NO: 228977 - RNA, 32 nt, Human
ucagaaaugugucuaugugcucugggaaccug

SEQ ID NO: 228978 - RNA, 32 nt, Human
ucagaaauuaagaauacacauauaaaauguug

SEQ ID NO: 228979 - RNA, 32 nt, Human
ucagaaauucaggcugugagggguuagauuag

SEQ ID NO: 228980 - RNA, 32 nt, Human
ucagaaauugucuuaagcaacagccccaaaug

SEQ ID NO: 228981 - RNA, 32 nt, Human
ucagaacaagaguuaauaucugccuguaucuu

SEQ ID NO: 228982 - RNA, 32 nt, Human
ucagaacagacacgccgcccuccuuguguucu

SEQ ID NO: 228983 - RNA, 32 nt, Human
ucagaacagugggcagugccugggugaacgug

SEQ ID NO: 228984 - RNA, 32 nt, Human
ucagaacauuccuucuuuacuggucacagcca

SEQ ID NO: 228985 - RNA, 21 nt, Human
ucagaaccaacccccagcauc

SEQ ID NO: 228986 - RNA, 22 nt, Human
ucagaaccaagaugccaacauc

SEQ ID NO: 228987 - RNA, 23 nt, Human
ucagaaccaauaacuucugcauc

SEQ ID NO: 228988 - RNA, 32 nt, Human
ucagaaccagccuggacaacauagugagaccc

SEQ ID NO: 228989 - RNA, 18 nt, Human
ucagaaccagcgcaagca

SEQ ID NO: 228990 - RNA, 23 nt, Human
ucagaaccagcuccacccaaauc

SEQ ID NO: 228991 - RNA, 18 nt, Human
ucagaaccaguccccugc

SEQ ID NO: 228992 - RNA, 32 nt, Human
ucagaacccacgucuucagcagcauuugaaac

SEQ ID NO: 228993 - RNA, 32 nt, Human
ucagaacccagaaucuuugaggguaagguuau

SEQ ID NO: 228994 - RNA, 32 nt, Human
ucagaaccuccacccucccccacaccaaagac

SEQ ID NO: 228995 - RNA, 32 nt, Human
ucagaaccucuugagaggcaacagugacagag

SEQ ID NO: 228996 - RNA, 32 nt, Human
ucagaaccuuccugaaaugagcagaaauuguu

SEQ ID NO: 228997 - RNA, 32 nt, Human
ucagaacgauggagagcucccgcgugaggcug

SEQ ID NO: 228998 - RNA, 32 nt, Human
ucagaacuaccuggcaucuuccugaacaagac

SEQ ID NO: 228999 - RNA, 32 nt, Human
ucagaacucacugcagccucuacaucccuggg

SEQ ID NO: 229000 - RNA, 32 nt, Human
ucagaacuccauguuuguuucucucuaucccc

SEQ ID NO: 229001 - RNA, 32 nt, Human
ucagaacugaaaacuccaccuuccguugggcc

SEQ ID NO: 229002 - RNA, 32 nt, Human
ucagaacugaagagaggaaggggaggagccga

SEQ ID NO: 229003 - RNA, 17 nt, Human
ucagaacugcaauucuu

SEQ ID NO: 229004 - RNA, 32 nt, Human
ucagaacugcauguuaccaagaucccagguga

SEQ ID NO: 229005 - RNA, 25 nt, Human
ucagaacugucucuccugggcccag

SEQ ID NO: 229006 - RNA, 32 nt, Human
ucagaacuuucuccccgcccccaaaccuggau

SEQ ID NO: 229007 - RNA, 32 nt, Human
ucagaagaacauccuucucugcuugaccugaa

SEQ ID NO: 229008 - RNA, 32 nt, Human
ucagaagaagugaacguuaauuagaauuuaau

SEQ ID NO: 229009 - RNA, 32 nt, Human
ucagaagaaucauguacuccagccucccuuga

SEQ ID NO: 229010 - RNA, 32 nt, Human
ucagaagacaaacuggugugugccucauugcu

SEQ ID NO: 229011 - RNA, 32 nt, Human
ucagaagacauuucauaccugcccugguccug

SEQ ID NO: 229012 - RNA, 32 nt, Human
ucagaagacuccagaagcagccacuuaguaga

SEQ ID NO: 229013 - RNA, 32 nt, Human
ucagaagagaauuccccggcagcagcguggcg

SEQ ID NO: 229014 - RNA, 32 nt, Human
ucagaagagcuggagaugcaagcucuaggcug

SEQ ID NO: 229015 - RNA, 32 nt, Human
ucagaagagucgaugaucaccaagcaggaaag

SEQ ID NO: 229016 - RNA, 32 nt, Human
ucagaagaucguggccaccugggaagccauca

SEQ ID NO: 229017 - RNA, 32 nt, Human
ucagaagaugccugcauuucuccaugaagaaa

SEQ ID NO: 229018 - RNA, 32 nt, Human
ucagaagaugccugcauuucuccaugaagaag

SEQ ID NO: 229019 - RNA, 32 nt, Human
ucagaagcaaaguacacccauuauuuaugcag

SEQ ID NO: 229020 - RNA, 32 nt, Human
ucagaagcagcaguaauagcaagagacagagg

SEQ ID NO: 229021 - RNA, 32 nt, Human
ucagaagcagcccuuggcugggugaggugugc

SEQ ID NO: 229022 - RNA, 32 nt, Human
ucagaagcauuuuaccagugaagcccucauua

SEQ ID NO: 229023 - RNA, 23 nt, Human
ucagaagcauuuuggauuucaga

SEQ ID NO: 229024 - RNA, 32 nt, Human
ucagaagccacauuuggccaggccucccgccu

SEQ ID NO: 229025 - RNA, 32 nt, Human
ucagaagccagucugcgucaggcacgucuccu

SEQ ID NO: 229026 - RNA, 32 nt, Human
ucagaagcccugcagugccuccagauggaaag

SEQ ID NO: 229027 - RNA, 32 nt, Human
ucagaagcucacaaccugguuugaaucccuca

SEQ ID NO: 229028 - RNA, 32 nt, Human
ucagaagcuccaggaggaagaagaucgggaag

SEQ ID NO: 229029 - RNA, 28 nt, Human
ucagaagcuccccuggcacaauuucaga

SEQ ID NO: 229030 - RNA, 32 nt, Human
ucagaagcuggaagggacaaggaaugguuucu

SEQ ID NO: 229031 - RNA, 32 nt, Human
ucagaagcuguugcuacugcgucucucugucu

SEQ ID NO: 229032 - RNA, 21 nt, Human
ucagaaggaaauuggguccag

SEQ ID NO: 229033 - RNA, 32 nt, Human
ucagaaggagccaauggacacugguguagaca

SEQ ID NO: 229034 - RNA, 20 nt, Human
ucagaaggagcguggcccag

SEQ ID NO: 229035 - RNA, 28 nt, Human
ucagaaggaggagagacaccgggcccag

SEQ ID NO: 229036 - RNA, 24 nt, Human
ucagaaggagggcugggugcccag

SEQ ID NO: 229037 - RNA, 32 nt, Human
ucagaaggcaagcaucuucauuuugcuagcuu

SEQ ID NO: 229038 - RNA, 27 nt, Human
ucagaaggcaccagcaccagggcccag

SEQ ID NO: 229039 - RNA, 32 nt, Human
ucagaaggccgaggugggagaaucacuugaau

SEQ ID NO: 229040 - RNA, 32 nt, Human
ucagaaggcugagaggguuugcaguggagccc

SEQ ID NO: 229041 - RNA, 32 nt, Human
ucagaaggcugaggcaggagaaucacuugaac

SEQ ID NO: 229042 - RNA, 32 nt, Human
ucagaaggcugaggcaggagaauugcuugaac

SEQ ID NO: 229043 - RNA, 32 nt, Human
ucagaaggcugaggcaggaggaucgcuugaga

SEQ ID NO: 229044 - RNA, 32 nt, Human
ucagaaggcugaggcaugagaaucacuugaac

SEQ ID NO: 229045 - RNA, 32 nt, Human
ucagaaggcugaggugggagaaucccuugaac

SEQ ID NO: 229046 - RNA, 31 nt, Human
ucagaaggcuggugacaucuguugaagcaac

SEQ ID NO: 229047 - RNA, 23 nt, Human
ucagaaggcugucuggcacccag

SEQ ID NO: 229048 - RNA, 21 nt, Human
ucagaagggaccuuggcacag

SEQ ID NO: 229049 - RNA, 32 nt, Human
ucagaagggcuggccuggagugcucacuccau

SEQ ID NO: 229050 - RNA, 17 nt, Human
ucagaaggggagcuguc

SEQ ID NO: 229051 - RNA, 21 nt, Human
ucagaaggggccacggccucc

SEQ ID NO: 229052 - RNA, 24 nt, Human
ucagaaggggccaucugggcccag

SEQ ID NO: 229053 - RNA, 22 nt, Human
ucagaagggugccaggccacag

SEQ ID NO: 229054 - RNA, 21 nt, Human
ucagaaggguggugugggccc

SEQ ID NO: 229055 - RNA, 23 nt, Human
ucagaagguuuagcugggcccag

SEQ ID NO: 229056 - RNA, 23 nt, Human
ucagaaguagcauuaggaucuuc

SEQ ID NO: 229057 - RNA, 21 nt, Human
ucagaagucaccgcucaguga

SEQ ID NO: 229058 - RNA, 32 nt, Human
ucagaagucauuuugacugcccucaauaaaau

SEQ ID NO: 229059 - RNA, 32 nt, Human
ucagaagucgcuguccuuacuacuuuugcgga

SEQ ID NO: 229060 - RNA, 32 nt, Human
ucagaagucugcuuuucagguuuauuccuaca

SEQ ID NO: 229061 - RNA, 32 nt, Human
ucagaagucuucuucuucuuuuaauucauaag

SEQ ID NO: 229062 - RNA, 32 nt, Human
ucagaagugauuuaguuguggaaagauaauaa

SEQ ID NO: 229063 - RNA, 32 nt, Human
ucagaaguggcugauuggaaggggacaagcuu

SEQ ID NO: 229064 - RNA, 32 nt, Human
ucagaaguuaaggcugguguccuggccccagu

SEQ ID NO: 229065 - RNA, 32 nt, Human
ucagaaguuaucucccucucccugugaugccu

SEQ ID NO: 229066 - RNA, 32 nt, Human
ucagaaguuccacugcacuccagccuggguua

SEQ ID NO: 229067 - RNA, 21 nt, Human
ucagaaguuccccucccugcc

SEQ ID NO: 229068 - RNA, 32 nt, Human
ucagaaguugcagagcagccugggcaacaugg

SEQ ID NO: 229069 - RNA, 32 nt, Human
ucagaaguuguaguccaagcacacacaaauag

SEQ ID NO: 229070 - RNA, 32 nt, Human
ucagaaguugucuuugacauuuaccaugaaaa

SEQ ID NO: 229071 - RNA, 32 nt, Human
ucagaauaaagugucuguuagacuucguuuug

SEQ ID NO: 229072 - RNA, 22 nt, Human
ucagaauaacugcugucuccca

SEQ ID NO: 229073 - RNA, 32 nt, Human
ucagaauaggaggcuaaagaaaagccagccca

SEQ ID NO: 229074 - RNA, 32 nt, Human
ucagaauauguauguaccugagcauauguaca

SEQ ID NO: 229075 - RNA, 32 nt, Human
ucagaaucaccuccucuccccaaaauuuguag

SEQ ID NO: 229076 - RNA, 32 nt, Human
ucagaaucacuuaggauggagacugggaccug

SEQ ID NO: 229077 - RNA, 32 nt, Human
ucagaaucagaauaugucuucugugucauggu

SEQ ID NO: 229078 - RNA, 32 nt, Human
ucagaauccauggcuggaagagguaguaaggc

SEQ ID NO: 229079 - RNA, 32 nt, Human
ucagaaucccagggacgggcgugagaguuugg

SEQ ID NO: 229080 - RNA, 32 nt, Human
ucagaaucccuuagggauggggcauuagaaac

SEQ ID NO: 229081 - RNA, 32 nt, Human
ucagaauccuccaggaucuagaagaaggaaga

SEQ ID NO: 229082 - RNA, 32 nt, Human
ucagaaucuaccacagcauucccuaucagccc

SEQ ID NO: 229083 - RNA, 23 nt, Human
ucagaaucucgcugucuccuucc

SEQ ID NO: 229084 - RNA, 32 nt, Human
ucagaaucuuuucucccucuugaguuuuugca

SEQ ID NO: 229085 - RNA, 21 nt, Human
ucagaaugaaagagguugcuu

SEQ ID NO: 229086 - RNA, 30 nt, Human
ucagaaugacaccuucucagguugccuuug

SEQ ID NO: 229087 - RNA, 32 nt, Human
ucagaaugaccgcuuuuggccuagcgguuugu

SEQ ID NO: 229088 - RNA, 32 nt, Human
ucagaaugaccguaagauagcuuacauuuccu

SEQ ID NO: 229089 - RNA, 32 nt, Human
ucagaaugagcaguaaaccuuccccaguccua

SEQ ID NO: 229090 - RNA, 32 nt, Human
ucagaauggcaguccuggaggcagggggugag

SEQ ID NO: 229091 - RNA, 32 nt, Human
ucagaaugggcuuuagggaugaagcagcuggg

SEQ ID NO: 229092 - RNA, 32 nt, Human
ucagaauguuaucaccuguuugucaaagcuug

SEQ ID NO: 229093 - RNA, 32 nt, Human
ucagaauuaaucucuuaaaauauuuuacagag

SEQ ID NO: 229094 - RNA, 32 nt, Human
ucagaauuccucccccugccucuccucccuga

SEQ ID NO: 229095 - RNA, 19 nt, Human
ucagaauuggaacuuuuua

SEQ ID NO: 229096 - RNA, 32 nt, Human
ucagaauuucaagcucuggguaauaacugcug

SEQ ID NO: 229097 - RNA, 32 nt, Human
ucagaauuuucucuuuuaaucacaagaagccu

SEQ ID NO: 229098 - RNA, 32 nt, Human
ucagacaacccccacccccacuguuucugggg

SEQ ID NO: 229099 - RNA, 32 nt, Human
ucagacaacuucuuccuucuccguggagcuca

SEQ ID NO: 229100 - RNA, 32 nt, Human
ucagacaaugccuucuccauuacuugaagcuu

SEQ ID NO: 229101 - RNA, 32 nt, Human
ucagacaauucagaaaagacuggugagagagu

SEQ ID NO: 229102 - RNA, 32 nt, Human
ucagacacacucccuucugccuuccggcuuaa

SEQ ID NO: 229103 - RNA, 32 nt, Human
ucagacacagccguguaugcucccagcagcaa

SEQ ID NO: 229104 - RNA, 32 nt, Human
ucagacacgggcccugggcagacagcccccag

SEQ ID NO: 229105 - RNA, 32 nt, Human
ucagacacucagggaacaaaauggucagccag

SEQ ID NO: 229106 - RNA, 32 nt, Human
ucagacacuccguccucacacuggcaggacgg

SEQ ID NO: 229107 - RNA, 32 nt, Human
ucagacacugcucagcuucccuccaggagguu

SEQ ID NO: 229108 - RNA, 32 nt, Human
ucagacagaugugguugcauccuaacuccaug

SEQ ID NO: 229109 - RNA, 32 nt, Human
ucagacagcaggaaggagagaaggaaggaagg

SEQ ID NO: 229110 - RNA, 32 nt, Human
ucagacagccaugaagcuggccagcagcgaca

SEQ ID NO: 229111 - RNA, 32 nt, Human
ucagacaggacuagagaauaacaucauuucac

SEQ ID NO: 229112 - RNA, 32 nt, Human
ucagacagggucucgcuauguugcccaggcug

SEQ ID NO: 229113 - RNA, 32 nt, Human
ucagacagggucuuacucugucacccaggcug

SEQ ID NO: 229114 - RNA, 32 nt, Human
ucagacagugaucaggacugaggauggaguua

SEQ ID NO: 229115 - RNA, 32 nt, Human
ucagacagugcuggugcuucugcuucuuaagu

SEQ ID NO: 229116 - RNA, 32 nt, Human
ucagacaguggaugagacacacaacggcagug

SEQ ID NO: 229117 - RNA, 32 nt, Human
ucagacaguguguggaggggcaggagcgugau

SEQ ID NO: 229118 - RNA, 32 nt, Human
ucagacaguuuauggugaaaggaagcagguua

SEQ ID NO: 229119 - RNA, 32 nt, Human
ucagacaucuaguggggcagcucucuuccuca

SEQ ID NO: 229120 - RNA, 32 nt, Human
ucagaccaagaucacacacagaaucaauugca

SEQ ID NO: 229121 - RNA, 32 nt, Human
ucagaccaaugccuuccacugcuccuuuauga

SEQ ID NO: 229122 - RNA, 32 nt, Human
ucagaccacaaacaacaacaacaauccaaaaa

SEQ ID NO: 229123 - RNA, 32 nt, Human
ucagaccacaccaucaaugauccagagcaaca

SEQ ID NO: 229124 - RNA, 32 nt, Human
ucagaccacugcaaucuaugggcagaccgccu

SEQ ID NO: 229125 - RNA, 32 nt, Human
ucagaccacugcccuccagccugggcaauaga

SEQ ID NO: 229126 - RNA, 32 nt, Human
ucagaccacuugcuucccacauaacaaugucg

SEQ ID NO: 229127 - RNA, 32 nt, Human
ucagaccagccaggaaccucucagagcugaag

SEQ ID NO: 229128 - RNA, 32 nt, Human
ucagaccagcugggaugggauccugccuccag

SEQ ID NO: 229129 - RNA, 32 nt, Human
ucagaccaggaggcauugcugugaaagauaau

SEQ ID NO: 229130 - RNA, 32 nt, Human
ucagaccaggucuugcugguguauccagggac

SEQ ID NO: 229131 - RNA, 32 nt, Human
ucagaccagugaaagaguagugcauuuaauug

SEQ ID NO: 229132 - RNA, 32 nt, Human
ucagaccagugggaguaaaccgaguguuaagu

SEQ ID NO: 229133 - RNA, 32 nt, Human
ucagaccauacaaccgcagcucuggcucuggg

SEQ ID NO: 229134 - RNA, 32 nt, Human
ucagaccaucucaaaaaggaggaaaagaugac

SEQ ID NO: 229135 - RNA, 32 nt, Human
ucagacccacacagaacaggggcugagggcac

SEQ ID NO: 229136 - RNA, 32 nt, Human
ucagacccacuuuuucauacacuugcuauaua

SEQ ID NO: 229137 - RNA, 32 nt, Human
ucagacccaguucugucagcucuagaggcacc

SEQ ID NO: 229138 - RNA, 21 nt, Human
ucagacccaucaccuuugccg

SEQ ID NO: 229139 - RNA, 32 nt, Human
ucagacccaucuccaaccaugagcaaugccau

SEQ ID NO: 229140 - RNA, 19 nt, Human
ucagaccccagggcagcau

SEQ ID NO: 229141 - RNA, 22 nt, Human
ucagacccccacuccucugcug

SEQ ID NO: 229142 - RNA, 32 nt, Human
ucagaccccgcccaugcuguguggucucugca

SEQ ID NO: 229143 - RNA, 32 nt, Human
ucagaccccuggguacaugguggaugauuuua

SEQ ID NO: 229144 - RNA, 32 nt, Human
ucagacccgcucuuccuuuucccuucauuccc

SEQ ID NO: 229145 - RNA, 32 nt, Human
ucagacccuccugugggcaggguucuuagugg

SEQ ID NO: 229146 - RNA, 18 nt, Human
ucagacccucgccuucca

SEQ ID NO: 229147 - RNA, 32 nt, Human
ucagacccucuuccucccagguaaaggccggg

SEQ ID NO: 229148 - RNA, 32 nt, Human
ucagacccugaggaacaugcagaaggaagcua

SEQ ID NO: 229149 - RNA, 32 nt, Human
ucagaccggggaggcccgggccagcagcuccc

SEQ ID NO: 229150 - RNA, 32 nt, Human
ucagaccgguguaaacaaaccagccagccgcc

SEQ ID NO: 229151 - RNA, 24 nt, Human
ucagaccuauaaucccagcacuuu

SEQ ID NO: 229152 - RNA, 32 nt, Human
ucagaccuauaaucccagcacuuugggagucc

SEQ ID NO: 229153 - RNA, 32 nt, Human
ucagaccuccgcacccucaccccaccaucacu

SEQ ID NO: 229154 - RNA, 32 nt, Human
ucagaccuccuccaaacaaaccaacuccacca

SEQ ID NO: 229155 - RNA, 32 nt, Human
ucagaccuccugggugggguuuggcuucaggg

SEQ ID NO: 229156 - RNA, 32 nt, Human
ucagaccucugcuccaccuuggacuagccuuu

SEQ ID NO: 229157 - RNA, 19 nt, Human
ucagaccugcccccuccca

SEQ ID NO: 229158 - RNA, 32 nt, Human
ucagaccuguaaucccagaacuuugggagccg

SEQ ID NO: 229159 - RNA, 32 nt, Human
ucagaccuucugccucuggcucugccuacuca

SEQ ID NO: 229160 - RNA, 32 nt, Human
ucagacgacacacacgaccuacccugaugguu

SEQ ID NO: 229161 - RNA, 21 nt, Human
ucagacgccaacuggccuucu

SEQ ID NO: 229162 - RNA, 32 nt, Human
ucagacggcugcaggcacagggaggaggcgcg

SEQ ID NO: 229163 - RNA, 19 nt, Human
ucagacgugcucccuccca

SEQ ID NO: 229164 - RNA, 32 nt, Human
ucagacguucccaccacugaagaugagguuga

SEQ ID NO: 229165 - RNA, 32 nt, Human
ucagacuaacaucuuaaaacacugaccucuau

SEQ ID NO: 229166 - RNA, 32 nt, Human
ucagacuaauuuccuucuuuccucgcacuucu

SEQ ID NO: 229167 - RNA, 32 nt, Human
ucagacuauacccauggugccucugggcuuga

SEQ ID NO: 229168 - RNA, 32 nt, Human
ucagacucaaugauaagucugaaguggaaaga

SEQ ID NO: 229169 - RNA, 24 nt, Human
ucagacucacaugagaagcuggga

SEQ ID NO: 229170 - RNA, 32 nt, Human
ucagacucagcccuccuggaggcugucaugua

SEQ ID NO: 229171 - RNA, 24 nt, Human
ucagacuccaucccuccucugccg

SEQ ID NO: 229172 - RNA, 32 nt, Human
ucagacucccaaagugcugggauuacaggugu

SEQ ID NO: 229173 - RNA, 32 nt, Human
ucagacucccaaagugcugggauuauagggau

SEQ ID NO: 229174 - RNA, 32 nt, Human
ucagacucccaaauagcuaugauuacaggcac

SEQ ID NO: 229175 - RNA, 32 nt, Human
ucagacucccgaauagcugggauuacagacag

SEQ ID NO: 229176 - RNA, 32 nt, Human
ucagacucccgaguagcugggauuacaggcac

SEQ ID NO: 229177 - RNA, 32 nt, Human
ucagacuccgaggaggugucuagugagagugg

SEQ ID NO: 229178 - RNA, 32 nt, Human
ucagacuccuaaguagcugggauuacaggcac

SEQ ID NO: 229179 - RNA, 22 nt, Human
ucagacuccugaucucagguga

SEQ ID NO: 229180 - RNA, 23 nt, Human
ucagacuccugggcucaagcgau

SEQ ID NO: 229181 - RNA, 32 nt, Human
ucagacucucagaagggucuguggguguugua

SEQ ID NO: 229182 - RNA, 32 nt, Human
ucagacucuccccaauagcggaagucgaucuu

SEQ ID NO: 229183 - RNA, 23 nt, Human
ucagacucuccuccgccucuacc

SEQ ID NO: 229184 - RNA, 32 nt, Human
ucagacucucuccucucucucccuccacuccu

SEQ ID NO: 229185 - RNA, 32 nt, Human
ucagacucugggacuccugagaugggagaggc

SEQ ID NO: 229186 - RNA, 32 nt, Human
ucagacucuggggcagagagggggauucucag

SEQ ID NO: 229187 - RNA, 32 nt, Human
ucagacucugugggcucugcguggccgggccu

SEQ ID NO: 229188 - RNA, 32 nt, Human
ucagacugaauaauuccugcugcagcaaggaa

SEQ ID NO: 229189 - RNA, 21 nt, Human
ucagacugaccugggagcccu

SEQ ID NO: 229190 - RNA, 32 nt, Human
ucagacugagcuuccugccugccuguaccccg

SEQ ID NO: 229191 - RNA, 32 nt, Human
ucagacuggacaacauauugaaaccucauguc

SEQ ID NO: 229192 - RNA, 32 nt, Human
ucagacugggugugugucuucccuggacauca

SEQ ID NO: 229193 - RNA, 31 nt, Human
ucagacuguaaugcuuucaugccaaguaaau

SEQ ID NO: 229194 - RNA, 32 nt, Human
ucagacuguuugagccuguugucuagaauauu

SEQ ID NO: 229195 - RNA, 32 nt, Human
ucagacuucagcacugcggucuugcccacucu

SEQ ID NO: 229196 - RNA, 32 nt, Human
ucagacuucaucuuuugaugggagaagaaaag

SEQ ID NO: 229197 - RNA, 32 nt, Human
ucagacuuccaaguagcugggauuacagacau

SEQ ID NO: 229198 - RNA, 32 nt, Human
ucagacuuccgaguggcugggauuacaggcgc

SEQ ID NO: 229199 - RNA, 32 nt, Human
ucagacuucuucagauuuuguccaacugauga

SEQ ID NO: 229200 - RNA, 32 nt, Human
ucagacuugcaggguaauccaaaaugaaguuu

SEQ ID NO: 229201 - RNA, 32 nt, Human
ucagacuuuaacauaugaauuucugggguggg

SEQ ID NO: 229202 - RNA, 32 nt, Human
ucagacuuugaggagggaagggggaagugaag

SEQ ID NO: 229203 - RNA, 32 nt, Human
ucagagaaaccagcugagucugucacuucuaa

SEQ ID NO: 229204 - RNA, 32 nt, Human
ucagagaacagcuauacaggcuggaggccucc

SEQ ID NO: 229205 - RNA, 32 nt, Human
ucagagaagcccaccuucccccucucuguccc

SEQ ID NO: 229206 - RNA, 32 nt, Human
ucagagaagcuggcaagagcugagggagugag

SEQ ID NO: 229207 - RNA, 32 nt, Human
ucagagaaggugcggcuggagauccugccugu

SEQ ID NO: 229208 - RNA, 32 nt, Human
ucagagaaguaaaggaaaagaaucucaaagug

SEQ ID NO: 229209 - RNA, 32 nt, Human
ucagagaagugcguuucaugcacagaaguuug

SEQ ID NO: 229210 - RNA, 32 nt, Human
ucagagaaguuaacuacuccaaagucauauag

SEQ ID NO: 229211 - RNA, 32 nt, Human
ucagagaauccuagagauacugaagauguucc

SEQ ID NO: 229212 - RNA, 32 nt, Human
ucagagaaugcacacuggacggaaaucuuaca

SEQ ID NO: 229213 - RNA, 32 nt, Human
ucagagaauucacacagacuuuacagcacauc

SEQ ID NO: 229214 - RNA, 32 nt, Human
ucagagacaagccaggcagacacuguccagag

SEQ ID NO: 229215 - RNA, 32 nt, Human
ucagagacacuguucagggccacggagaauuc

SEQ ID NO: 229216 - RNA, 32 nt, Human
ucagagacacuguucccugcucccaggguuag

SEQ ID NO: 229217 - RNA, 32 nt, Human
ucagagacauccuucaggauugugagcuggau

SEQ ID NO: 229218 - RNA, 32 nt, Human
ucagagaccacucauccucuggaaucaaccuc

SEQ ID NO: 229219 - RNA, 32 nt, Human
ucagagaccauguaguucaacuuuccacucaa

SEQ ID NO: 229220 - RNA, 32 nt, Human
ucagagacccaggaguugggagcuuucgcucc

SEQ ID NO: 229221 - RNA, 32 nt, Human
ucagagaccuugccaggcccaggcugggugcc

SEQ ID NO: 229222 - RNA, 32 nt, Human
ucagagacugucucgaucucuccacucaccgu

SEQ ID NO: 229223 - RNA, 22 nt, Human
ucagagacuucaaucuccuccc

SEQ ID NO: 229224 - RNA, 32 nt, Human
ucagagagaaacccaucaauugcucaaauacu

SEQ ID NO: 229225 - RNA, 32 nt, Human
ucagagagagugacccagcagaggugugacgg

SEQ ID NO: 229226 - RNA, 32 nt, Human
ucagagagauagggucucucuauguugcccua

SEQ ID NO: 229227 - RNA, 32 nt, Human
ucagagagcucuuugcaguguagugacacugg

SEQ ID NO: 229228 - RNA, 32 nt, Human
ucagagaggcuaggugacuuugccaaggcugc

SEQ ID NO: 229229 - RNA, 32 nt, Human
ucagagagggagcaggucuagagaagaaccag

SEQ ID NO: 229230 - RNA, 32 nt, Human
ucagagagggcauccaaaaaggccaacaguuc

SEQ ID NO: 229231 - RNA, 32 nt, Human
ucagagaggggcugccuggucuggggccugac

SEQ ID NO: 229232 - RNA, 32 nt, Human
ucagagagggguugacgaaggagaagcauuca

SEQ ID NO: 229233 - RNA, 32 nt, Human
ucagagagucacaggagggccuuaaaccccac

SEQ ID NO: 229234 - RNA, 32 nt, Human
ucagagagucuacagaacacgcacgacgacag

SEQ ID NO: 229235 - RNA, 32 nt, Human
ucagagagugugagcuacuggcccaagauuau

SEQ ID NO: 229236 - RNA, 32 nt, Human
ucagagaucagcaggcacuguacuggguagag

SEQ ID NO: 229237 - RNA, 32 nt, Human
ucagagaucaggagaaaagacauaagagaauu

SEQ ID NO: 229238 - RNA, 32 nt, Human
ucagagaucugauucaggaagccccagauggg

SEQ ID NO: 229239 - RNA, 32 nt, Human
ucagagaugcuguagcuccuuggggcaaaggu

SEQ ID NO: 229240 - RNA, 32 nt, Human
ucagagauggggaccaggcucagaguucuacc

SEQ ID NO: 229241 - RNA, 32 nt, Human
ucagagauguggucucgcuuuguugccuacac

SEQ ID NO: 229242 - RNA, 32 nt, Human
ucagagauugaggcugaaagaggauccaccau

SEQ ID NO: 229243 - RNA, 32 nt, Human
ucagagauuuggguaaaagaauggguaauguu

SEQ ID NO: 229244 - RNA, 32 nt, Human
ucagagauuuugaaggaauacuuccuaacuca

SEQ ID NO: 229245 - RNA, 32 nt, Human
ucagagcaauuaggaaggaaggagaacaggag

SEQ ID NO: 229246 - RNA, 32 nt, Human
ucagagcacaugcacacugucagggcuagccu

SEQ ID NO: 229247 - RNA, 32 nt, Human
ucagagcaccuugcagauucccaagaaacacc

SEQ ID NO: 229248 - RNA, 32 nt, Human
ucagagcacuggcucuccagccccaggaggag

SEQ ID NO: 229249 - RNA, 32 nt, Human
ucagagcagccccaggagguaagggcucuuuu

SEQ ID NO: 229250 - RNA, 32 nt, Human
ucagagcagcccugcagaacggggugggggcu

SEQ ID NO: 229251 - RNA, 32 nt, Human
ucagagcagccucuguccuggcugugcacauu

SEQ ID NO: 229252 - RNA, 32 nt, Human
ucagagcagcuucaacaccacagccauuucca

SEQ ID NO: 229253 - RNA, 32 nt, Human
ucagagcaggagaaguugcagcuuacugaucc

SEQ ID NO: 229254 - RNA, 32 nt, Human
ucagagcaggccagccaagcaggaagcacacu

SEQ ID NO: 229255 - RNA, 32 nt, Human
ucagagcagucagcagacgggagccagucuga

SEQ ID NO: 229256 - RNA, 32 nt, Human
ucagagcagugcagggggaggagaggagaaag

SEQ ID NO: 229257 - RNA, 32 nt, Human
ucagagcaguggagacuggagcccuguuugca

SEQ ID NO: 229258 - RNA, 32 nt, Human
ucagagcagugggucacgugaccugcgcacgg

SEQ ID NO: 229259 - RNA, 32 nt, Human
ucagagcaguuguaaguagaucugccaucuag

SEQ ID NO: 229260 - RNA, 32 nt, Human
ucagagcaucaugcuuugagguuuggggugcu

SEQ ID NO: 229261 - RNA, 27 nt, Human
ucagagcaucuacugggacuacaggug

SEQ ID NO: 229262 - RNA, 32 nt, Human
ucagagcaucugacugcccugccuuggaggag

SEQ ID NO: 229263 - RNA, 20 nt, Human
ucagagcaugcccccuccca

SEQ ID NO: 229264 - RNA, 32 nt, Human
ucagagcauugauccuggaaugugugcuggag

SEQ ID NO: 229265 - RNA, 19 nt, Human
ucagagccaaaagugccuu

SEQ ID NO: 229266 - RNA, 32 nt, Human
ucagagccaaccuggugggcuuggucuaucac

SEQ ID NO: 229267 - RNA, 32 nt, Human
ucagagccacuccgcuccauaucaguaucuca

SEQ ID NO: 229268 - RNA, 32 nt, Human
ucagagccacuuggugacagagccaggaugag

SEQ ID NO: 229269 - RNA, 32 nt, Human
ucagagccauggaggcaaguaccuuaauuagu

SEQ ID NO: 229270 - RNA, 32 nt, Human
ucagagccauuacccuuucaagccccugguca

SEQ ID NO: 229271 - RNA, 32 nt, Human
ucagagcccgggaggugaagcaaaugcggcag

SEQ ID NO: 229272 - RNA, 22 nt, Human
ucagagcccugaaucucuuccu

SEQ ID NO: 229273 - RNA, 32 nt, Human
ucagagcccugacuaaaacccagauccacagc

SEQ ID NO: 229274 - RNA, 32 nt, Human
ucagagccgagccgacagagagcagggaaccg

SEQ ID NO: 229275 - RNA, 32 nt, Human
ucagagccgcacagcaagcccaccacccugaa

SEQ ID NO: 229276 - RNA, 32 nt, Human
ucagagccuagccaccucccaccccacuucag

SEQ ID NO: 229277 - RNA, 32 nt, Human
ucagagccugcucuuccugaacccacucggca

SEQ ID NO: 229278 - RNA, 32 nt, Human
ucagagccuuggaguuuacagagcagaggcca

SEQ ID NO: 229279 - RNA, 23 nt, Human
ucagagccuuggcccucuuuccu

SEQ ID NO: 229280 - RNA, 32 nt, Human
ucagagcuaugggugcuacaggcuugucuuuc

SEQ ID NO: 229281 - RNA, 32 nt, Human
ucagagcucaagucugaacucuaccuccagac

SEQ ID NO: 229282 - RNA, 32 nt, Human
ucagagcucacugcagcuucaacaccccaggg

SEQ ID NO: 229283 - RNA, 32 nt, Human
ucagagcucacugcagcuucaaucuccuggcu

SEQ ID NO: 229284 - RNA, 32 nt, Human
ucagagcucacugcauccuugaccucccagac

SEQ ID NO: 229285 - RNA, 32 nt, Human
ucagagcucacuguaaccucaaaauccugggc

SEQ ID NO: 229286 - RNA, 32 nt, Human
ucagagcuccacaucugaccuucuagucauga

SEQ ID NO: 229287 - RNA, 32 nt, Human
ucagagcucugaguccucuacucaauacccau

SEQ ID NO: 229288 - RNA, 32 nt, Human
ucagagcugaccaacccgccaggccugcucaa

SEQ ID NO: 229289 - RNA, 32 nt, Human
ucagagcugcagcuacacagcugcccaguguc

SEQ ID NO: 229290 - RNA, 24 nt, Human
ucagagcugcuagagaccauccug

SEQ ID NO: 229291 - RNA, 32 nt, Human
ucagagcuggcaccccucagugcccccuuuug

SEQ ID NO: 229292 - RNA, 32 nt, Human
ucagagcuggggcagcugccucccaggggugg

SEQ ID NO: 229293 - RNA, 32 nt, Human
ucagagcugggucugccccaucaaagagcaag

SEQ ID NO: 229294 - RNA, 32 nt, Human
ucagagcuguaacagaucguggcagauucugc

SEQ ID NO: 229295 - RNA, 32 nt, Human
ucagagcuuaccagccccaccccaccauggua

SEQ ID NO: 229296 - RNA, 32 nt, Human
ucagaggaagaaggggaagaagaagaggagga

SEQ ID NO: 229297 - RNA, 32 nt, Human
ucagaggaagauggagaggagcuucggaccaa

SEQ ID NO: 229298 - RNA, 32 nt, Human
ucagaggacaacaaugaguaagccaucacaca

SEQ ID NO: 229299 - RNA, 23 nt, Human
ucagaggacagcagucuccuucc

SEQ ID NO: 229300 - RNA, 32 nt, Human
ucagaggagaacggcuguuccaccugccagca

SEQ ID NO: 229301 - RNA, 32 nt, Human
ucagaggagaagaaggucaguguuuggaggug

SEQ ID NO: 229302 - RNA, 32 nt, Human
ucagaggagagggaggaaggaucucaagagca

SEQ ID NO: 229303 - RNA, 32 nt, Human
ucagaggagaggggcaccagccgggggcccug

SEQ ID NO: 229304 - RNA, 32 nt, Human
ucagaggaggagaaaggccggagccagccgag

SEQ ID NO: 229305 - RNA, 32 nt, Human
ucagaggaggcagagauggggugguggcugag

SEQ ID NO: 229306 - RNA, 32 nt, Human
ucagaggaggccugagaagaagguccugggaa

SEQ ID NO: 229307 - RNA, 32 nt, Human
ucagaggaggccugagauuucgaaugggcagu

SEQ ID NO: 229308 - RNA, 32 nt, Human
ucagaggaggugagaggagaggaaggagaaaa

SEQ ID NO: 229309 - RNA, 32 nt, Human
ucagaggcaagaaaaacucuuuacagguuuuu

SEQ ID NO: 229310 - RNA, 32 nt, Human
ucagaggcaagucccugaugcaaggcaguagc

SEQ ID NO: 229311 - RNA, 32 nt, Human
ucagaggcaccaccccucaccccagcugccug

SEQ ID NO: 229312 - RNA, 32 nt, Human
ucagaggcagaaacacagcaauggaugcacag

SEQ ID NO: 229313 - RNA, 32 nt, Human
ucagaggcauaauuugcagccauuccauccua

SEQ ID NO: 229314 - RNA, 17 nt, Human
ucagaggccaccauggc

SEQ ID NO: 229315 - RNA, 32 nt, Human
ucagaggccagccugcauagccucuguccuca

SEQ ID NO: 229316 - RNA, 22 nt, Human
ucagaggccauagcaaaagcaa

SEQ ID NO: 229317 - RNA, 23 nt, Human
ucagaggccauaugucucagcaa

SEQ ID NO: 229318 - RNA, 23 nt, Human
ucagaggccauggauacugacaa

SEQ ID NO: 229319 - RNA, 32 nt, Human
ucagaggcccaggaaucggagcgaagcagaga

SEQ ID NO: 229320 - RNA, 32 nt, Human
ucagaggcccccaguggggacagggaggggga

SEQ ID NO: 229321 - RNA, 32 nt, Human
ucagaggcccggggaagggaagagcaggucag

SEQ ID NO: 229322 - RNA, 32 nt, Human
ucagaggcccugccaagucuagcauguuccug

SEQ ID NO: 229323 - RNA, 32 nt, Human
ucagaggcccugcugagguggggcaaugagca

SEQ ID NO: 229324 - RNA, 32 nt, Human
ucagaggcccuucucuggacaucuaaagguca

SEQ ID NO: 229325 - RNA, 32 nt, Human
ucagaggccgcuccuaggcuccucggaggagg

SEQ ID NO: 229326 - RNA, 32 nt, Human
ucagaggccucugcuucucucuugcuccuaga

SEQ ID NO: 229327 - RNA, 32 nt, Human
ucagaggccugacaccucaggcugccaaaugu

SEQ ID NO: 229328 - RNA, 32 nt, Human
ucagaggccugcugccagugcagccacuggcu

SEQ ID NO: 229329 - RNA, 21 nt, Human
ucagaggcuggagugcaaugg

SEQ ID NO: 229330 - RNA, 32 nt, Human
ucagaggcuuacauucagauuuggaagaggcg

SEQ ID NO: 229331 - RNA, 32 nt, Human
ucagaggcuucugggaacccaggcugggccug

SEQ ID NO: 229332 - RNA, 32 nt, Human
ucagaggcuugugauuaacuguggcggcagac

SEQ ID NO: 229333 - RNA, 32 nt, Human
ucagaggcuuugcccgaauugcuucguccugu

SEQ ID NO: 229334 - RNA, 32 nt, Human
ucagagggaccagcccagguggggcaggcaga

SEQ ID NO: 229335 - RNA, 32 nt, Human
ucagagggacugucagcugagcuugagcuccc

SEQ ID NO: 229336 - RNA, 32 nt, Human
ucagagggagagaggcuggagaccugggcugg

SEQ ID NO: 229337 - RNA, 32 nt, Human
ucagagggaucacgaccucagcagagccagga

SEQ ID NO: 229338 - RNA, 32 nt, Human
ucagagggauccucccacacacccagcagaga

SEQ ID NO: 229339 - RNA, 32 nt, Human
ucagagggcaacaggaagaugcaggccuucaa

SEQ ID NO: 229340 - RNA, 31 nt, Human
ucagagggcaccaaggaggguggcagagccu

SEQ ID NO: 229341 - RNA, 32 nt, Human
ucagagggcaggcugagccagggagcaaaaag

SEQ ID NO: 229342 - RNA, 32 nt, Human
ucagagggcugcccuccagaggcugcacccag

SEQ ID NO: 229343 - RNA, 32 nt, Human
ucagagggcuuaaauaaauuacucuaggucuu

SEQ ID NO: 229344 - RNA, 32 nt, Human
ucagagggcuucaagcaaaacaaacagccuuu

SEQ ID NO: 229345 - RNA, 32 nt, Human
ucagaggggaaaaugcaauccgggagguguuu

SEQ ID NO: 229346 - RNA, 32 nt, Human
ucagaggggccuggggccugugucugagaccc

SEQ ID NO: 229347 - RNA, 32 nt, Human
ucagagggggaugucaacaacagaucaagccg

SEQ ID NO: 229348 - RNA, 32 nt, Human
ucagagggguuuuucauuuacuuuugaaaaga

SEQ ID NO: 229349 - RNA, 32 nt, Human
ucagaggguacuuggcaucaccggugcacagc

SEQ ID NO: 229350 - RNA, 32 nt, Human
ucagaggguagguggagagugaagccaagccc

SEQ ID NO: 229351 - RNA, 32 nt, Human
ucagagggucuggggcaccagguggagaccau

SEQ ID NO: 229352 - RNA, 32 nt, Human
ucagagggugggaucuggcagcucggggaagu

SEQ ID NO: 229353 - RNA, 32 nt, Human
ucagagggugggggaacaaaccccuaugcacu

SEQ ID NO: 229354 - RNA, 32 nt, Human
ucagagggugguaggaggugaagaggaacaag

SEQ ID NO: 229355 - RNA, 32 nt, Human
ucagagguagagaagacagggauugggaagug

SEQ ID NO: 229356 - RNA, 32 nt, Human
ucagagguaggagaagucucuaggggucagga

SEQ ID NO: 229357 - RNA, 32 nt, Human
ucagagguauugugagguuacugugaugauua

SEQ ID NO: 229358 - RNA, 32 nt, Human
ucagaggucaccaaguucagucgucccaaaac

SEQ ID NO: 229359 - RNA, 32 nt, Human
ucagaggucacucagggucaauacucaggguc

SEQ ID NO: 229360 - RNA, 32 nt, Human
ucagaggucagcagugucugugguguaggaug

SEQ ID NO: 229361 - RNA, 32 nt, Human
ucagaggucgugaacggcugaggcagacgcag

SEQ ID NO: 229362 - RNA, 32 nt, Human
ucagagguucuccugccuggaaucaagugaug

SEQ ID NO: 229363 - RNA, 32 nt, Human
ucagaguaaaccugaggcauuuggggacaagu

SEQ ID NO: 229364 - RNA, 32 nt, Human
ucagaguaaauucuucuauacaguuauaucua

SEQ ID NO: 229365 - RNA, 32 nt, Human
ucagaguaauggaccagcaaugcugaagacgc

SEQ ID NO: 229366 - RNA, 22 nt, Human
ucagaguagcugggacuacagg

SEQ ID NO: 229367 - RNA, 32 nt, Human
ucagaguaggacugcaucaccaggcaaauacc

SEQ ID NO: 229368 - RNA, 32 nt, Human
ucagagucaaggaggcaggaugaauuuaaauu

SEQ ID NO: 229369 - RNA, 32 nt, Human
ucagagucagggacacagcagcguccggcgag

SEQ ID NO: 229370 - RNA, 21 nt, Human
ucagagucaucucgcccuucc

SEQ ID NO: 229371 - RNA, 32 nt, Human
ucagagucauugaaggguguucacccauccca

SEQ ID NO: 229372 - RNA, 21 nt, Human
ucagaguccccaguccugccu

SEQ ID NO: 229373 - RNA, 22 nt, Human
ucagaguccgacucucccaccu

SEQ ID NO: 229374 - RNA, 32 nt, Human
ucagaguccuacagugguagacuggucuucug

SEQ ID NO: 229375 - RNA, 32 nt, Human
ucagagucgcgggcugcgcccugggcagaggc

SEQ ID NO: 229376 - RNA, 32 nt, Human
ucagagucuaucuccucugucacuucuccccc

SEQ ID NO: 229377 - RNA, 19 nt, Human
ucagagucuccagccuacc

SEQ ID NO: 229378 - RNA, 32 nt, Human
ucagagucugaaugccuccagucugcguggaa

SEQ ID NO: 229379 - RNA, 21 nt, Human
ucagagucuguccccgcuccu

SEQ ID NO: 229380 - RNA, 32 nt, Human
ucagagucuucuccucucucugaucucugugc

SEQ ID NO: 229381 - RNA, 32 nt, Human
ucagagugagcagcagcagcugaccagauugg

SEQ ID NO: 229382 - RNA, 25 nt, Human
ucagagugcaagcugggagcacagg

SEQ ID NO: 229383 - RNA, 32 nt, Human
ucagagugcaagcugggagcacaggcacugca

SEQ ID NO: 229384 - RNA, 31 nt, Human
ucagagugcccgucagggccugugcauccgc

SEQ ID NO: 229385 - RNA, 21 nt, Human
ucagagugcugggaucacagg

SEQ ID NO: 229386 - RNA, 24 nt, Human
ucagagugcugggaucacaggcgu

SEQ ID NO: 229387 - RNA, 32 nt, Human
ucagagugggagacagagagacaagugugcuc

SEQ ID NO: 229388 - RNA, 32 nt, Human
ucagagugggaggcagagagagaagugugcuc

SEQ ID NO: 229389 - RNA, 32 nt, Human
ucagaguggggaggggacagccuggggcugcc

SEQ ID NO: 229390 - RNA, 32 nt, Human
ucagagugggggagagaaaugagcaauccugg

SEQ ID NO: 229391 - RNA, 32 nt, Human
ucagagugugguuccuggaccagcaacaucag

SEQ ID NO: 229392 - RNA, 32 nt, Human
ucagaguuaguguucuggaaggaaagcagcag

SEQ ID NO: 229393 - RNA, 24 nt, Human
ucagaguucuagaauuacaggcau

SEQ ID NO: 229394 - RNA, 32 nt, Human
ucagaguucucugcuccuguuggcaaaucgca

SEQ ID NO: 229395 - RNA, 22 nt, Human
ucagaguugaauaucucuuucc

SEQ ID NO: 229396 - RNA, 32 nt, Human
ucagaguugcaaccucagccucgcuauggcuc

SEQ ID NO: 229397 - RNA, 32 nt, Human
ucagaguugggaggggcucugagcaguguugg

SEQ ID NO: 229398 - RNA, 32 nt, Human
ucagaguuuuaauaaaggugugaggaggcugg

SEQ ID NO: 229399 - RNA, 32 nt, Human
ucagaguuuuccauuggcagugccaguuucua

SEQ ID NO: 229400 - RNA, 32 nt, Human
ucagauaaaaccuacaaagauccugugaauua

SEQ ID NO: 229401 - RNA, 32 nt, Human
ucagauaacacuguaauccaccuccagguuuc

SEQ ID NO: 229402 - RNA, 32 nt, Human
ucagauaagguaaaaugccaugaugccucugu

SEQ ID NO: 229403 - RNA, 32 nt, Human
ucagauaauacagcucaucauaccucaggaaa

SEQ ID NO: 229404 - RNA, 32 nt, Human
ucagauacagucagauggagugccuugguuuu

SEQ ID NO: 229405 - RNA, 32 nt, Human
ucagauaccuuaaaucaucucugucaaguuca

SEQ ID NO: 229406 - RNA, 32 nt, Human
ucagauagaucauuguuagauauuucacauuu

SEQ ID NO: 229407 - RNA, 32 nt, Human
ucagauagauuuuucucccagcauguucuacu

SEQ ID NO: 229408 - RNA, 32 nt, Human
ucagauagcuggacccacccccagcauuucug

SEQ ID NO: 229409 - RNA, 32 nt, Human
ucagauagggaaagaaaguugauuggaauggc

SEQ ID NO: 229410 - RNA, 32 nt, Human
ucagauagugccacugcacuccagccugggug

SEQ ID NO: 229411 - RNA, 32 nt, Human
ucagauaguguugccaucaagaaagcaugcaa

SEQ ID NO: 229412 - RNA, 32 nt, Human
ucagauauagaaggcuggagcacaguguaaac

SEQ ID NO: 229413 - RNA, 32 nt, Human
ucagauauauaagcagauaagcacagauuauu

SEQ ID NO: 229414 - RNA, 32 nt, Human
ucagauaucagcucugcuauuuucuaacugaa

SEQ ID NO: 229415 - RNA, 32 nt, Human
ucagauaucugcaacuggggaugauaucugga

SEQ ID NO: 229416 - RNA, 32 nt, Human
ucagauauguuaaguaauaaaaaguuaaugug

SEQ ID NO: 229417 - RNA, 32 nt, Human
ucagauauuucauguaaugucauugcagaagc

SEQ ID NO: 229418 - RNA, 32 nt, Human
ucagaucaccuuugguaaacuggaccucagga

SEQ ID NO: 229419 - RNA, 32 nt, Human
ucagaucacugcaaccuccaccucccagguuc

SEQ ID NO: 229420 - RNA, 32 nt, Human
ucagaucacugcaaccuccgccuccuggguuc

SEQ ID NO: 229421 - RNA, 32 nt, Human
ucagaucacugcaaccucugccucccggguuc

SEQ ID NO: 229422 - RNA, 32 nt, Human
ucagaucacuguggccacacuuugcugaaaga

SEQ ID NO: 229423 - RNA, 32 nt, Human
ucagaucaguggcaaucucaguccccuggcua

SEQ ID NO: 229424 - RNA, 32 nt, Human
ucagauccaagauccaauuggucaccaauucg

SEQ ID NO: 229425 - RNA, 32 nt, Human
ucagauccaugccaccaaacaucucccaccga

SEQ ID NO: 229426 - RNA, 32 nt, Human
ucagauccgaggugccuccugcagugaccccu

SEQ ID NO: 229427 - RNA, 32 nt, Human
ucagauccgauuuuggaccccuccgagugaga

SEQ ID NO: 229428 - RNA, 32 nt, Human
ucagauccuccucuuugggaguccagugucuu

SEQ ID NO: 229429 - RNA, 32 nt, Human
ucagauccugaacaagagagaacaaaaucucu

SEQ ID NO: 229430 - RNA, 32 nt, Human
ucagaucgagucuugcucugucacccgggcug

SEQ ID NO: 229431 - RNA, 32 nt, Human
ucagaucgugccacugcacuccagccugggug

SEQ ID NO: 229432 - RNA, 32 nt, Human
ucagaucucaccauugcacuccagccugggcg

SEQ ID NO: 229433 - RNA, 32 nt, Human
ucagaucucaggcuugucccccugucagcugc

SEQ ID NO: 229434 - RNA, 32 nt, Human
ucagaucucccauccagggcaaggacagacua

SEQ ID NO: 229435 - RNA, 32 nt, Human
ucagaucucuccccgucucccucccaacuuau

SEQ ID NO: 229436 - RNA, 32 nt, Human
ucagaucugcuccccagcaucuucuguuuccu

SEQ ID NO: 229437 - RNA, 32 nt, Human
ucagaucuugaccaagaaaccccagcgauuuc

SEQ ID NO: 229438 - RNA, 32 nt, Human
ucagaucuugggauuggcccaaggucacagag

SEQ ID NO: 229439 - RNA, 32 nt, Human
ucagaucuuuagccuagacagagugucgcugg

SEQ ID NO: 229440 - RNA, 32 nt, Human
ucagaugaacagagacuucuggaguugauuug

SEQ ID NO: 229441 - RNA, 32 nt, Human
ucagaugaagaaauugagucuugaagaacuug

SEQ ID NO: 229442 - RNA, 21 nt, Human
ucagaugaagucagggauaga

SEQ ID NO: 229443 - RNA, 32 nt, Human
ucagaugaagucagggauagaagacccuugga

SEQ ID NO: 229444 - RNA, 32 nt, Human
ucagaugacagcaugcaggcaccaagagagug

SEQ ID NO: 229445 - RNA, 32 nt, Human
ucagaugagaauggagucugaauggccuuccu

SEQ ID NO: 229446 - RNA, 24 nt, Human
ucagaugaggaggcuucuaucuug

SEQ ID NO: 229447 - RNA, 32 nt, Human
ucagaugaucagcucuguaucugguuaagucg

SEQ ID NO: 229448 - RNA, 24 nt, Human
ucagaugaugccagcugucuccca

SEQ ID NO: 229449 - RNA, 31 nt, Human
ucagaugcaaacuucaucacagcagggauuu

SEQ ID NO: 229450 - RNA, 32 nt, Human
ucagaugcagugagaccuggccuuccuguugu

SEQ ID NO: 229451 - RNA, 32 nt, Human
ucagaugcauuugcacaggacuuggauccuga

SEQ ID NO: 229452 - RNA, 32 nt, Human
ucagaugccccugagaccacccagaaaucaag

SEQ ID NO: 229453 - RNA, 29 nt, Human
ucagaugccggccucagagcucaaggcuu

SEQ ID NO: 229454 - RNA, 32 nt, Human
ucagaugccuauuaaaagaggaaugguuuaaa

SEQ ID NO: 229455 - RNA, 32 nt, Human
ucagaugccugaggagcucccagucucaaagg

SEQ ID NO: 229456 - RNA, 32 nt, Human
ucagaugccugggaagcccagccccucaggug

SEQ ID NO: 229457 - RNA, 32 nt, Human
ucagaugccuguagucccagcuacuugugagg

SEQ ID NO: 229458 - RNA, 32 nt, Human
ucagaugcuaucugccgcugcuguuugguggg

SEQ ID NO: 229459 - RNA, 32 nt, Human
ucagaugcucagcucgguccccuccgccugac

SEQ ID NO: 229460 - RNA, 32 nt, Human
ucagauggaagcucuguggccuuuccuaacuc

SEQ ID NO: 229461 - RNA, 32 nt, Human
ucagauggccacggugagggcuuggaaggaga

SEQ ID NO: 229462 - RNA, 22 nt, Human
ucagauggcccagggccacaca

SEQ ID NO: 229463 - RNA, 32 nt, Human
ucagauggcccagggccacacagggaaggagu

SEQ ID NO: 229464 - RNA, 32 nt, Human
ucagauggccugagccucccgaggcuugcugc

SEQ ID NO: 229465 - RNA, 32 nt, Human
ucagauggccugggugcuauguggagcaggug

SEQ ID NO: 229466 - RNA, 32 nt, Human
ucagauggcugaggcaggagaacuacuugaac

SEQ ID NO: 229467 - RNA, 23 nt, Human
ucagauggcugugacuacaggug

SEQ ID NO: 229468 - RNA, 32 nt, Human
ucagauggcuugucaguaucugcucugaggaa

SEQ ID NO: 229469 - RNA, 32 nt, Human
ucagaugggagagagccagagagaggagugag

SEQ ID NO: 229470 - RNA, 32 nt, Human
ucagauggggccugggcuguugugucuggagc

SEQ ID NO: 229471 - RNA, 32 nt, Human
ucagauggugccacugcacuccagccugggug

SEQ ID NO: 229472 - RNA, 32 nt, Human
ucagauggugcuggugacuuucuguuccuuuu

SEQ ID NO: 229473 - RNA, 32 nt, Human
ucagauggugcuguguccugugucacgucacc

SEQ ID NO: 229474 - RNA, 32 nt, Human
ucagauggugugccaguccaggaguugucaga

SEQ ID NO: 229475 - RNA, 22 nt, Human
ucagauguagcauuaggaccuu

SEQ ID NO: 229476 - RNA, 29 nt, Human
ucagaugucauguaauccuuccuuuggug

SEQ ID NO: 229477 - RNA, 32 nt, Human
ucagaugucuucaugucgguaauuauagaacu

SEQ ID NO: 229478 - RNA, 32 nt, Human
ucagaugugugaaggcaaaaagguuuccuggc

SEQ ID NO: 229479 - RNA, 22 nt, Human
ucagauguucuccuauuucugg

SEQ ID NO: 229480 - RNA, 21 nt, Human
ucagauguuuucuguuucugg

SEQ ID NO: 229481 - RNA, 22 nt, Human
ucagauuaaucauuucggcaga

SEQ ID NO: 229482 - RNA, 32 nt, Human
ucagauuauuacagaagaagaggcauugaaga

SEQ ID NO: 229483 - RNA, 32 nt, Human
ucagauucaacagggggaagaaaauggagauu

SEQ ID NO: 229484 - RNA, 32 nt, Human
ucagauucaagcaauucuccugccucagccuc

SEQ ID NO: 229485 - RNA, 32 nt, Human
ucagauucacacaggagcauuugcuuacaaau

SEQ ID NO: 229486 - RNA, 32 nt, Human
ucagauucacugcagcucuccucuuaauaugu

SEQ ID NO: 229487 - RNA, 32 nt, Human
ucagauucaggaccgggccccuuguuccgagu

SEQ ID NO: 229488 - RNA, 20 nt, Human
ucagauucagguuuugaaau

SEQ ID NO: 229489 - RNA, 32 nt, Human
ucagauuccacuacacuuucuuccucauaggu

SEQ ID NO: 229490 - RNA, 32 nt, Human
ucagauuccaggcuggagugugauucuguggg

SEQ ID NO: 229491 - RNA, 32 nt, Human
ucagauucccgaguagcugggauuacagaugu

SEQ ID NO: 229492 - RNA, 32 nt, Human
ucagauucuccuggaauucuucucccucagga

SEQ ID NO: 229493 - RNA, 23 nt, Human
ucagauucucugaaaacauuuuu

SEQ ID NO: 229494 - RNA, 32 nt, Human
ucagauugaggagguaccgaaagggaaggagc

SEQ ID NO: 229495 - RNA, 32 nt, Human
ucagauugcaccacugcacuccagccugggca

SEQ ID NO: 229496 - RNA, 32 nt, Human
ucagauugcaccauugcacuccagccugcgca

SEQ ID NO: 229497 - RNA, 32 nt, Human
ucagauugcgucacugcacuccaaccugggug

SEQ ID NO: 229498 - RNA, 32 nt, Human
ucagauuggcugcuuuagcuccauaguucucu

SEQ ID NO: 229499 - RNA, 32 nt, Human
ucagauugguaaauaaugacaccugguggaua

SEQ ID NO: 229500 - RNA, 32 nt, Human
ucagauugugcaaguuugaacgcuuguuuccc

SEQ ID NO: 229501 - RNA, 32 nt, Human
ucagauuuaauuagcaucagaguugauuuuau

SEQ ID NO: 229502 - RNA, 32 nt, Human
ucagauuuacagaguagcauuugcauucuucu

SEQ ID NO: 229503 - RNA, 22 nt, Human
ucagauuuaguacuuguaaaua

SEQ ID NO: 229504 - RNA, 32 nt, Human
ucagauuuaguucaauaagaacagugaaacuu

SEQ ID NO: 229505 - RNA, 32 nt, Human
ucagauuuaucugaaugcugagaagaugaugu

SEQ ID NO: 229506 - RNA, 32 nt, Human
ucagauuucauagaaaggagcaaccaaaaugu

SEQ ID NO: 229507 - RNA, 32 nt, Human
ucagauuugcugcacucauuguggacuucaug

SEQ ID NO: 229508 - RNA, 32 nt, Human
ucagauuuucaaggccuuaacaaaguuaaagg

SEQ ID NO: 229509 - RNA, 32 nt, Human
ucagauuuugcuggauucugauucaggaggag

SEQ ID NO: 229510 - RNA, 32 nt, Human
ucagauuuuguuugaaguuaacaugccugaca

SEQ ID NO: 229511 - RNA, 32 nt, Human
ucagcaaacagcacaaucucacccucacagga

SEQ ID NO: 229512 - RNA, 32 nt, Human
ucagcaaagagugggccgcuguguuuggagac

SEQ ID NO: 229513 - RNA, 32 nt, Human
ucagcaaagccuugcucucuggagcuuacuau

SEQ ID NO: 229514 - RNA, 32 nt, Human
ucagcaaagcuacaggacugguacucaagcca

SEQ ID NO: 229515 - RNA, 32 nt, Human
ucagcaaaggggacacccaugaggcuucggcc

SEQ ID NO: 229516 - RNA, 32 nt, Human
ucagcaaauuccagauuuguuuccuuuuggcc

SEQ ID NO: 229517 - RNA, 32 nt, Human
ucagcaaauuucauacuaguugcucaggacug

SEQ ID NO: 229518 - RNA, 32 nt, Human
ucagcaacacagugaaaccccgucucuacuaa

SEQ ID NO: 229519 - RNA, 32 nt, Human
ucagcaacaccccgggcuguuucacaagcaag

SEQ ID NO: 229520 - RNA, 32 nt, Human
ucagcaacugauucacugaucagauuacaggc

SEQ ID NO: 229521 - RNA, 32 nt, Human
ucagcaagaccacccaccccuucuaguaccag

SEQ ID NO: 229522 - RNA, 32 nt, Human
ucagcaagagcaccccaucuucagguggcggc

SEQ ID NO: 229523 - RNA, 32 nt, Human
ucagcaagaggaagccgggaaugggagauggc

SEQ ID NO: 229524 - RNA, 32 nt, Human
ucagcaagcuacagcaaagcccauuggccaga

SEQ ID NO: 229525 - RNA, 32 nt, Human
ucagcaaggaauugucucccagugcauuuugc

SEQ ID NO: 229526 - RNA, 32 nt, Human
ucagcaaggauaugaugagauuuugcucacag

SEQ ID NO: 229527 - RNA, 32 nt, Human
ucagcaaggcuuucauauccuugcuguggguc

SEQ ID NO: 229528 - RNA, 32 nt, Human
ucagcaagggaugggccucucugccucgccca

SEQ ID NO: 229529 - RNA, 32 nt, Human
ucagcaaggucacaggcuagaucaauauacag

SEQ ID NO: 229530 - RNA, 32 nt, Human
ucagcaauagcagagacagagggaagguaucu

SEQ ID NO: 229531 - RNA, 32 nt, Human
ucagcaauguugccuggcaacagggaaggggc

SEQ ID NO: 229532 - RNA, 19 nt, Human
ucagcaauuaaaauguuaa

SEQ ID NO: 229533 - RNA, 18 nt, Human
ucagcaauucugauucug

SEQ ID NO: 229534 - RNA, 32 nt, Human
ucagcaauuucaucucuugaacacugacucac

SEQ ID NO: 229535 - RNA, 32 nt, Human
ucagcacaaaccguaaacagcaggugcucggg

SEQ ID NO: 229536 - RNA, 32 nt, Human
ucagcacaaaccuuucaaguauguuguuucuu

SEQ ID NO: 229537 - RNA, 32 nt, Human
ucagcacaaaggaggcuuuuucugugcuuuga

SEQ ID NO: 229538 - RNA, 32 nt, Human
ucagcacaacacagcugggcgccacugggauu

SEQ ID NO: 229539 - RNA, 32 nt, Human
ucagcacacagcuguauccugguagauuauaa

SEQ ID NO: 229540 - RNA, 32 nt, Human
ucagcacacaggcugguaguguugggcacccc

SEQ ID NO: 229541 - RNA, 32 nt, Human
ucagcacagagcagugcccuggcuguguccug

SEQ ID NO: 229542 - RNA, 18 nt, Human
ucagcacagcaguggaga

SEQ ID NO: 229543 - RNA, 32 nt, Human
ucagcacaggaaguacccacauggacagaggg

SEQ ID NO: 229544 - RNA, 32 nt, Human
ucagcacagggagaauguugacuuagaagcaa

SEQ ID NO: 229545 - RNA, 24 nt, Human
ucagcacaguccagggaucuuuug

SEQ ID NO: 229546 - RNA, 32 nt, Human
ucagcaccaaaccaaaccauucuuauuuaaac

SEQ ID NO: 229547 - RNA, 32 nt, Human
ucagcaccaagggcccccgacacuccacuccu

SEQ ID NO: 229548 - RNA, 32 nt, Human
ucagcaccaaguaacaccacacacacgcagca

SEQ ID NO: 229549 - RNA, 19 nt, Human
ucagcaccacccccuccca

SEQ ID NO: 229550 - RNA, 32 nt, Human
ucagcaccagacgucugugcugccugguuugc

SEQ ID NO: 229551 - RNA, 22 nt, Human
ucagcaccaggaagucauccug

SEQ ID NO: 229552 - RNA, 32 nt, Human
ucagcaccauggcugcucauacccugccucga

SEQ ID NO: 229553 - RNA, 32 nt, Human
ucagcaccaugugagagcuccuuugauuggaa

SEQ ID NO: 229554 - RNA, 32 nt, Human
ucagcacccaggacaguggugucuguuaaggc

SEQ ID NO: 229555 - RNA, 32 nt, Human
ucagcacccaggacggagaggagcagagaagc

SEQ ID NO: 229556 - RNA, 32 nt, Human
ucagcacccauggggaccaggagacuuuaaag

SEQ ID NO: 229557 - RNA, 30 nt, Human
ucagcacccgccacagcagccagccauggg

SEQ ID NO: 229558 - RNA, 32 nt, Human
ucagcacccgccacagcagccagccauggggu

SEQ ID NO: 229559 - RNA, 32 nt, Human
ucagcacccucccaggcgcuccuggagccagg

SEQ ID NO: 229560 - RNA, 32 nt, Human
ucagcaccuccagguugguucuggguguccug

SEQ ID NO: 229561 - RNA, 32 nt, Human
ucagcaccugagcgugcugagcuccagguaua

SEQ ID NO: 229562 - RNA, 32 nt, Human
ucagcaccugagucacagcccaggugcccgga

SEQ ID NO: 229563 - RNA, 32 nt, Human
ucagcaccuggaaguggagugcaggcugcagc

SEQ ID NO: 229564 - RNA, 22 nt, Human
ucagcaccuucaauucaacaga

SEQ ID NO: 229565 - RNA, 32 nt, Human
ucagcacgcucacuaacccagcaugccacuuc

SEQ ID NO: 229566 - RNA, 32 nt, Human
ucagcacgugagccuucaccgccugcuucauu

SEQ ID NO: 229567 - RNA, 32 nt, Human
ucagcacuagagggagggagggggagggagga

SEQ ID NO: 229568 - RNA, 15 nt, Human
ucagcacucaccucu

SEQ ID NO: 229569 - RNA, 32 nt, Human
ucagcacucauuucagaaaucugauuauaaca

SEQ ID NO: 229570 - RNA, 32 nt, Human
ucagcacucauuucagaaaucugauuauaaua

SEQ ID NO: 229571 - RNA, 19 nt, Human
ucagcacucuguaagaugg

SEQ ID NO: 229572 - RNA, 32 nt, Human
ucagcacucuucucucuccaucucuccuuccu

SEQ ID NO: 229573 - RNA, 32 nt, Human
ucagcacucuugcccuuugaggguggggccaa

SEQ ID NO: 229574 - RNA, 28 nt, Human
ucagcacugaguacugccucaucugcug

SEQ ID NO: 229575 - RNA, 21 nt, Human
ucagcacugcccccucucuga

SEQ ID NO: 229576 - RNA, 32 nt, Human
ucagcacugggguggaggcggcaggaaggggc

SEQ ID NO: 229577 - RNA, 32 nt, Human
ucagcacuguccugcugcuccccaccagcacg

SEQ ID NO: 229578 - RNA, 32 nt, Human
ucagcacugucgucuucuuggagggcaaacuu

SEQ ID NO: 229579 - RNA, 32 nt, Human
ucagcacugugccaguggaagcagguguauug

SEQ ID NO: 229580 - RNA, 32 nt, Human
ucagcacuuacugcuaucaccuauuacuuuua

SEQ ID NO: 229581 - RNA, 32 nt, Human
ucagcacuuucgggggcagagcuggcccagca

SEQ ID NO: 229582 - RNA, 32 nt, Human
ucagcagaaaccuugcucugaagaccagagac

SEQ ID NO: 229583 - RNA, 32 nt, Human
ucagcagaaagagacccugagaucuucgccug

SEQ ID NO: 229584 - RNA, 25 nt, Human
ucagcagaaucaggcucagguucug

SEQ ID NO: 229585 - RNA, 32 nt, Human
ucagcagaaucaucuuaaaaccugccaaacuu

SEQ ID NO: 229586 - RNA, 18 nt, Human
ucagcagaccaccccggc

SEQ ID NO: 229587 - RNA, 32 nt, Human
ucagcagacgcuucccuucccuuccccuaggg

SEQ ID NO: 229588 - RNA, 32 nt, Human
ucagcagagaugcggugcauccugaucuuggg

SEQ ID NO: 229589 - RNA, 32 nt, Human
ucagcagagauggugccccggccuggauccuc

SEQ ID NO: 229590 - RNA, 32 nt, Human
ucagcagagcagcagcccugcugcugaaggcc

SEQ ID NO: 229591 - RNA, 32 nt, Human
ucagcagaggagagcauuugauaacuaagagg

SEQ ID NO: 229592 - RNA, 22 nt, Human
ucagcagagucauuucauucug

SEQ ID NO: 229593 - RNA, 32 nt, Human
ucagcagagucuucuugugcugccuuugggcu

SEQ ID NO: 229594 - RNA, 32 nt, Human
ucagcagaguggcgccugccugugcuggccca

SEQ ID NO: 229595 - RNA, 32 nt, Human
ucagcagauccggaagcugaucaaagaugggc

SEQ ID NO: 229596 - RNA, 32 nt, Human
ucagcagcaaagagaagagcauuggggcugga

SEQ ID NO: 229597 - RNA, 32 nt, Human
ucagcagcagaggcuccuggccuucuucaagu

SEQ ID NO: 229598 - RNA, 32 nt, Human
ucagcagcagcccaaaagguucuccuucuuca

SEQ ID NO: 229599 - RNA, 32 nt, Human
ucagcagcagcccagauuuaggggacauuuga

SEQ ID NO: 229600 - RNA, 32 nt, Human
ucagcagcaucuccaccugccaucucacccuc

SEQ ID NO: 229601 - RNA, 32 nt, Human
ucagcagccacaggccuuccaggagcuguuau

SEQ ID NO: 229602 - RNA, 32 nt, Human
ucagcagcccaccucugagucucagcuuugcu

SEQ ID NO: 229603 - RNA, 32 nt, Human
ucagcagcccagugaguguccucugcaccggg

SEQ ID NO: 229604 - RNA, 23 nt, Human
ucagcagcccccuccccccggcc

SEQ ID NO: 229605 - RNA, 22 nt, Human
ucagcagcccuggagcaggcca

SEQ ID NO: 229606 - RNA, 32 nt, Human
ucagcagcccuggcagaacugaagagcggcac

SEQ ID NO: 229607 - RNA, 32 nt, Human
ucagcagccgcaucugcuaccugauuuuaucc

SEQ ID NO: 229608 - RNA, 32 nt, Human
ucagcagccucuuccuccuccaggacccagaa

SEQ ID NO: 229609 - RNA, 32 nt, Human
ucagcagcgcuggugggcucuuuguccuggug

SEQ ID NO: 229610 - RNA, 32 nt, Human
ucagcagcugaccugugagaaggaggcgcugu

SEQ ID NO: 229611 - RNA, 32 nt, Human
ucagcagcugagccuaggucugugcuguaaau

SEQ ID NO: 229612 - RNA, 32 nt, Human
ucagcagcugguaaucuugcucugcuugacaa

SEQ ID NO: 229613 - RNA, 32 nt, Human
ucagcagcugugguggggaaacauuucuccug

SEQ ID NO: 229614 - RNA, 32 nt, Human
ucagcagcuuggaagaaaucccagaagcggac

SEQ ID NO: 229615 - RNA, 32 nt, Human
ucagcaggaaaaagaucacaagccugccacga

SEQ ID NO: 229616 - RNA, 32 nt, Human
ucagcaggaagugaacaggcucagggaacugg

SEQ ID NO: 229617 - RNA, 32 nt, Human
ucagcaggagagaggcccagaggcuccagcug

SEQ ID NO: 229618 - RNA, 32 nt, Human
ucagcaggagcagcagcagggauguauagaaa

SEQ ID NO: 229619 - RNA, 32 nt, Human
ucagcaggaguaauaaauuuacucacagcacu

SEQ ID NO: 229620 - RNA, 32 nt, Human
ucagcaggaugugugagccaggaucccucuuu

SEQ ID NO: 229621 - RNA, 32 nt, Human
ucagcaggcuccuggguaaagagggugggagg

SEQ ID NO: 229622 - RNA, 32 nt, Human
ucagcagggcaggccagggaucuggacaaugg

SEQ ID NO: 229623 - RNA, 32 nt, Human
ucagcagggcugugcuuggcucacaggaauag

SEQ ID NO: 229624 - RNA, 32 nt, Human
ucagcagggucccagcccacggccacacaugc

SEQ ID NO: 229625 - RNA, 32 nt, Human
ucagcagggucugcccacucccuacgcuggcc

SEQ ID NO: 229626 - RNA, 20 nt, Human
ucagcaggguggagugcagu

SEQ ID NO: 229627 - RNA, 32 nt, Human
ucagcagguccagcuccugccucccaguggcc

SEQ ID NO: 229628 - RNA, 32 nt, Human
ucagcagguccucccaccccauguggaacuca

SEQ ID NO: 229629 - RNA, 32 nt, Human
ucagcaggugugaucaggggcucagagccagg

SEQ ID NO: 229630 - RNA, 32 nt, Human
ucagcagguuaaagaugguugcagcuggaggg

SEQ ID NO: 229631 - RNA, 32 nt, Human
ucagcagguuccagugccugacuugggauagg

SEQ ID NO: 229632 - RNA, 32 nt, Human
ucagcagguuucucuccugcagccaggugaag

SEQ ID NO: 229633 - RNA, 29 nt, Human
ucagcagucugugcugugccuggauguaa

SEQ ID NO: 229634 - RNA, 19 nt, Human
ucagcagugacagaagaga

SEQ ID NO: 229635 - RNA, 32 nt, Human
ucagcaguggcuagguuaugcuuagugguuua

SEQ ID NO: 229636 - RNA, 18 nt, Human
ucagcaguugaagccuga

SEQ ID NO: 229637 - RNA, 32 nt, Human
ucagcaguuggcccgggagacucuggaggagc

SEQ ID NO: 229638 - RNA, 32 nt, Human
ucagcaguuuguuccuuuucauugcugaguag

SEQ ID NO: 229639 - RNA, 24 nt, Human
ucagcauaaaccugggggcccuca

SEQ ID NO: 229640 - RNA, 22 nt, Human
ucagcauaacucaaccugcuuu

SEQ ID NO: 229641 - RNA, 32 nt, Human
ucagcauacauaacugaagcaugugaaacagu

SEQ ID NO: 229642 - RNA, 32 nt, Human
ucagcauacuccucaaacuccuccuccucagc

SEQ ID NO: 229643 - RNA, 24 nt, Human
ucagcaucaaaauauuucagugaa

SEQ ID NO: 229644 - RNA, 32 nt, Human
ucagcaucacacaguguuccugcuggagagag

SEQ ID NO: 229645 - RNA, 25 nt, Human
ucagcaucacccgggaacuuuuuua

SEQ ID NO: 229646 - RNA, 32 nt, Human
ucagcaucaccugggugugagacauggaguca

SEQ ID NO: 229647 - RNA, 32 nt, Human
ucagcaucagauaauucacaccagagagaaac

SEQ ID NO: 229648 - RNA, 32 nt, Human
ucagcaucauuuccuugagaugcauccaggcu

SEQ ID NO: 229649 - RNA, 32 nt, Human
ucagcauccaauaguuguuaaaugaauaaaua

SEQ ID NO: 229650 - RNA, 32 nt, Human
ucagcaucccaaacuccugggauuuuaggcau

SEQ ID NO: 229651 - RNA, 32 nt, Human
ucagcaucccaaagugcugggauuacaggcau

SEQ ID NO: 229652 - RNA, 32 nt, Human
ucagcaucccaaaguguugggauuacagccgu

SEQ ID NO: 229653 - RNA, 32 nt, Human
ucagcaucccaaguagcugggauaacaggugc

SEQ ID NO: 229654 - RNA, 32 nt, Human
ucagcaucccaaguagcugggauuacaggcac

SEQ ID NO: 229655 - RNA, 32 nt, Human
ucagcauccuacuccuggcaacaucaggccaa

SEQ ID NO: 229656 - RNA, 32 nt, Human
ucagcauccuccucuuccucgguggugggugu

SEQ ID NO: 229657 - RNA, 32 nt, Human
ucagcaucgcuuucaauaggcuuuucaggacc

SEQ ID NO: 229658 - RNA, 32 nt, Human
ucagcaucuccugguccugcaguguugcugua

SEQ ID NO: 229659 - RNA, 32 nt, Human
ucagcaucucgaguagcugggauuacaggcau

SEQ ID NO: 229660 - RNA, 32 nt, Human
ucagcaucugcugcccugaucacagagacggg

SEQ ID NO: 229661 - RNA, 18 nt, Human
ucagcaucugugccucuc

SEQ ID NO: 229662 - RNA, 32 nt, Human
ucagcaucuguggagauguguagagacaggga

SEQ ID NO: 229663 - RNA, 32 nt, Human
ucagcaugaccugcaugugagacauggaguca

SEQ ID NO: 229664 - RNA, 32 nt, Human
ucagcaugacuucaccuccauccugguggaca

SEQ ID NO: 229665 - RNA, 32 nt, Human
ucagcaugagccaagacuggggucagggagca

SEQ ID NO: 229666 - RNA, 32 nt, Human
ucagcaugagccugggaagcugaagguugggg

SEQ ID NO: 229667 - RNA, 30 nt, Human
ucagcaugauuuccagguuccaugucuucu

SEQ ID NO: 229668 - RNA, 32 nt, Human
ucagcaugcaggaaguuuggggagagcucggc

SEQ ID NO: 229669 - RNA, 19 nt, Human
ucagcaugcaguguuucca

SEQ ID NO: 229670 - RNA, 32 nt, Human
ucagcauggagacaucaccacaugcacugugg

SEQ ID NO: 229671 - RNA, 32 nt, Human
ucagcaugggcaacaugguaagaccuccgccu

SEQ ID NO: 229672 - RNA, 32 nt, Human
ucagcaugggcaaccucggagaucuucagcag

SEQ ID NO: 229673 - RNA, 32 nt, Human
ucagcaugggccaguuuugacaaggacuuguc

SEQ ID NO: 229674 - RNA, 32 nt, Human
ucagcaugggguuugggaagccuagcagugga

SEQ ID NO: 229675 - RNA, 32 nt, Human
ucagcauggugaaacgccaucccuacuaagga

SEQ ID NO: 229676 - RNA, 32 nt, Human
ucagcauguacuccccuccucugauuccccgu

SEQ ID NO: 229677 - RNA, 30 nt, Human
ucagcaugugggaccugguucucuccaucg

SEQ ID NO: 229678 - RNA, 32 nt, Human
ucagcauuaagauccaggugucagccuauguc

SEQ ID NO: 229679 - RNA, 32 nt, Human
ucagcauuaucucugaguccaccagaaguugu

SEQ ID NO: 229680 - RNA, 32 nt, Human
ucagcauucagcccagggaaugugguuuucac

SEQ ID NO: 229681 - RNA, 32 nt, Human
ucagcauugucucauguacagcucccuucccu

SEQ ID NO: 229682 - RNA, 32 nt, Human
ucagcauuuccuugucccgucuggaccugggg

SEQ ID NO: 229683 - RNA, 32 nt, Human
ucagcauuugggaugccagggaacagagagug

SEQ ID NO: 229684 - RNA, 32 nt, Human
ucagcauuuuugucaucccugcccuuggccaa

SEQ ID NO: 229685 - RNA, 32 nt, Human
ucagccaaaggagagaggugcauuuuaaguau

SEQ ID NO: 229686 - RNA, 32 nt, Human
ucagccaaaggaugagaacauuaugggauuau

SEQ ID NO: 229687 - RNA, 32 nt, Human
ucagccaacccagaggauguagacccuguccu

SEQ ID NO: 229688 - RNA, 20 nt, Human
ucagccaaccccccucacca

SEQ ID NO: 229689 - RNA, 32 nt, Human
ucagccaagagccugaggcugaagggaaaagu

SEQ ID NO: 229690 - RNA, 23 nt, Human
ucagccaagaguugaggcugcca

SEQ ID NO: 229691 - RNA, 32 nt, Human
ucagccaagaugguuuuucuuccuucagugag

SEQ ID NO: 229692 - RNA, 32 nt, Human
ucagccaagccgcgccaccagcuaagccggga

SEQ ID NO: 229693 - RNA, 32 nt, Human
ucagccaaguccaaggggaaccccuccucguc

SEQ ID NO: 229694 - RNA, 32 nt, Human
ucagccaauucaaccuccagccagcuucuuga

SEQ ID NO: 229695 - RNA, 32 nt, Human
ucagccaauucuguaggacacugaggcucuug

SEQ ID NO: 229696 - RNA, 32 nt, Human
ucagccacaaaugugacccaggauacagagug

SEQ ID NO: 229697 - RNA, 32 nt, Human
ucagccacagcccagccccauuaguggguuag

SEQ ID NO: 229698 - RNA, 32 nt, Human
ucagccacaggccuuccugguuggaguucugg

SEQ ID NO: 229699 - RNA, 32 nt, Human
ucagccaccacugugccauggugacacaggcc

SEQ ID NO: 229700 - RNA, 32 nt, Human
ucagccacccaaaaugcugggauuacaggcau

SEQ ID NO: 229701 - RNA, 32 nt, Human
ucagccaccuggcuccccuccugggaggccuc

SEQ ID NO: 229702 - RNA, 32 nt, Human
ucagccacugcaagcuggagugcugauauggu

SEQ ID NO: 229703 - RNA, 17 nt, Human
ucagccacuggagucug

SEQ ID NO: 229704 - RNA, 32 nt, Human
ucagccacuguaguacagccaccuggcaugcc

SEQ ID NO: 229705 - RNA, 32 nt, Human
ucagccacugugggcccugccucugccuguuc

SEQ ID NO: 229706 - RNA, 32 nt, Human
ucagccacuguucccagccacaauuuuuaucu

SEQ ID NO: 229707 - RNA, 32 nt, Human
ucagccagagaggcagagaacuugcagcgcga

SEQ ID NO: 229708 - RNA, 32 nt, Human
ucagccagaguuguuucucuccacucugccuc

SEQ ID NO: 229709 - RNA, 32 nt, Human
ucagccagcagagaauuuugacuugcaguagg

SEQ ID NO: 229710 - RNA, 20 nt, Human
ucagccagcagcccccuccc

SEQ ID NO: 229711 - RNA, 32 nt, Human
ucagccagcccagccuugcccaccauuuaaga

SEQ ID NO: 229712 - RNA, 32 nt, Human
ucagccagccuccagcaccuucccucucacca

SEQ ID NO: 229713 - RNA, 32 nt, Human
ucagccagccucccagacugcaccucuucuau

SEQ ID NO: 229714 - RNA, 32 nt, Human
ucagccaggaagaguuugccaggcagcuacag

SEQ ID NO: 229715 - RNA, 32 nt, Human
ucagccaggagaagaaugaccucaccauccag

SEQ ID NO: 229716 - RNA, 32 nt, Human
ucagccaggcagcccaccccacccuggggccc

SEQ ID NO: 229717 - RNA, 32 nt, Human
ucagccaggccccggggagggagccagccaca

SEQ ID NO: 229718 - RNA, 32 nt, Human
ucagccaggcccuccuccuccugggcuugccc

SEQ ID NO: 229719 - RNA, 32 nt, Human
ucagccaggcuggagugcaaugugcaauggca

SEQ ID NO: 229720 - RNA, 32 nt, Human
ucagccaggcuggagugcaguggugcaaucuc

SEQ ID NO: 229721 - RNA, 32 nt, Human
ucagccaggcuggagugugguggcacaaucuc

SEQ ID NO: 229722 - RNA, 32 nt, Human
ucagccagggugaagggaaaguaguuggggcu

SEQ ID NO: 229723 - RNA, 32 nt, Human
ucagccagguaaagggacucacugugaucgug

SEQ ID NO: 229724 - RNA, 32 nt, Human
ucagccagucccuguuggcugaguacccuggu

SEQ ID NO: 229725 - RNA, 32 nt, Human
ucagccauccucgucugcucuccucucucuuc

SEQ ID NO: 229726 - RNA, 31 nt, Human
ucagccaugaagacagaaacagugccaccgu

SEQ ID NO: 229727 - RNA, 32 nt, Human
ucagccaugaggccucaggacccacucugcuc

SEQ ID NO: 229728 - RNA, 32 nt, Human
ucagccaugcaagccucaguuuucccaucugu

SEQ ID NO: 229729 - RNA, 31 nt, Human
ucagccauggacaugcuucauccaucaucgg

SEQ ID NO: 229730 - RNA, 31 nt, Human
ucagccauggccccaagaaagagagguggac

SEQ ID NO: 229731 - RNA, 32 nt, Human
ucagccauucggcuuggggcaccaggcucccc

SEQ ID NO: 229732 - RNA, 32 nt, Human
ucagccauuggucacuuaagagcacuaacccc

SEQ ID NO: 229733 - RNA, 24 nt, Human
ucagcccaacacgcuccccuccca

SEQ ID NO: 229734 - RNA, 32 nt, Human
ucagcccaagauucuucagucuggacuauauu

SEQ ID NO: 229735 - RNA, 32 nt, Human
ucagcccaagcacuagaugugcagccccagcc

SEQ ID NO: 229736 - RNA, 32 nt, Human
ucagcccaaggaggaggaagaggaaaacaaga

SEQ ID NO: 229737 - RNA, 32 nt, Human
ucagcccaagguuccuccucuccuaccaagca

SEQ ID NO: 229738 - RNA, 19 nt, Human
ucagcccacacccuuccca

SEQ ID NO: 229739 - RNA, 20 nt, Human
ucagcccaccucccucacca

SEQ ID NO: 229740 - RNA, 32 nt, Human
ucagcccacucuugaagccucugaggagucuc

SEQ ID NO: 229741 - RNA, 32 nt, Human
ucagcccacugcacucuccacucugccagaaa

SEQ ID NO: 229742 - RNA, 19 nt, Human
ucagcccagaagcccuucc

SEQ ID NO: 229743 - RNA, 32 nt, Human
ucagcccagacccuggcucacagggaagcaga

SEQ ID NO: 229744 - RNA, 19 nt, Human
ucagcccagacuccugcca

SEQ ID NO: 229745 - RNA, 21 nt, Human
ucagcccagcaccugcuccca

SEQ ID NO: 229746 - RNA, 23 nt, Human
ucagcccagccaggcccccuccc

SEQ ID NO: 229747 - RNA, 18 nt, Human
ucagcccagcccacccuc

SEQ ID NO: 229748 - RNA, 20 nt, Human
ucagcccagcccuaacccuc

SEQ ID NO: 229749 - RNA, 18 nt, Human
ucagcccagcuacuuccc

SEQ ID NO: 229750 - RNA, 21 nt, Human
ucagcccagcucugccucgca

SEQ ID NO: 229751 - RNA, 20 nt, Human
ucagcccagcugcuuggccu

SEQ ID NO: 229752 - RNA, 18 nt, Human
ucagcccagcuggguucc

SEQ ID NO: 229753 - RNA, 32 nt, Human
ucagcccaggaauucaagaccagccugggcaa

SEQ ID NO: 229754 - RNA, 32 nt, Human
ucagcccaggagagagggguccugaucuuaac

SEQ ID NO: 229755 - RNA, 32 nt, Human
ucagcccaggagagccagggguccagugcagc

SEQ ID NO: 229756 - RNA, 32 nt, Human
ucagcccaggagguggagguugcagugagcgg

SEQ ID NO: 229757 - RNA, 32 nt, Human
ucagcccaggagguuguggauacagugaguua

SEQ ID NO: 229758 - RNA, 32 nt, Human
ucagcccaggcagaagcugcucuaggaccugg

SEQ ID NO: 229759 - RNA, 32 nt, Human
ucagcccagggcuucagucuuccuuuauuuau

SEQ ID NO: 229760 - RNA, 20 nt, Human
ucagcccaugcccccuccca

SEQ ID NO: 229761 - RNA, 32 nt, Human
ucagcccaugucaaucaagaugggugauuaug

SEQ ID NO: 229762 - RNA, 32 nt, Human
ucagcccaugucuucacagcagccacucccaa

SEQ ID NO: 229763 - RNA, 22 nt, Human
ucagcccauucaaagagcaagg

SEQ ID NO: 229764 - RNA, 19 nt, Human
ucagccccaacccccuccc

SEQ ID NO: 229765 - RNA, 32 nt, Human
ucagccccaaguaggugggacuccaggcaugc

SEQ ID NO: 229766 - RNA, 32 nt, Human
ucagccccacagcugcugccacaggggccaac

SEQ ID NO: 229767 - RNA, 18 nt, Human
ucagccccacccccuccc

SEQ ID NO: 229768 - RNA, 32 nt, Human
ucagccccacucccucuccaugcccaucaaac

SEQ ID NO: 229769 - RNA, 32 nt, Human
ucagccccacuuccuuucuuucuaacuccuac

SEQ ID NO: 229770 - RNA, 32 nt, Human
ucagccccagcccaagaugauccaauucuguu

SEQ ID NO: 229771 - RNA, 32 nt, Human
ucagccccaguucagaacacagaacuucacac

SEQ ID NO: 229772 - RNA, 32 nt, Human
ucagccccaugguggugaauucuguuucuuuc

SEQ ID NO: 229773 - RNA, 32 nt, Human
ucagcccccaccaggggaaggaaggagggcac

SEQ ID NO: 229774 - RNA, 19 nt, Human
ucagcccccaccucagguu

SEQ ID NO: 229775 - RNA, 32 nt, Human
ucagcccccaccuccagccacacacacauuac

SEQ ID NO: 229776 - RNA, 22 nt, Human
ucagcccccagccccagucuca

SEQ ID NO: 229777 - RNA, 20 nt, Human
ucagcccccagccccggguu

SEQ ID NO: 229778 - RNA, 20 nt, Human
ucagcccccagccccucccc

SEQ ID NO: 229779 - RNA, 32 nt, Human
ucagcccccagccuccaggccugcuguggagg

SEQ ID NO: 229780 - RNA, 32 nt, Human
ucagcccccaugcuucugccucaggccccacc

SEQ ID NO: 229781 - RNA, 21 nt, Human
ucagccccccucccccagacu

SEQ ID NO: 229782 - RNA, 32 nt, Human
ucagcccccggcccuuccuuguggcccagccc

SEQ ID NO: 229783 - RNA, 32 nt, Human
ucagcccccucagcacagacaaaagccagcag

SEQ ID NO: 229784 - RNA, 32 nt, Human
ucagcccccugaagacucuggucccagucagc

SEQ ID NO: 229785 - RNA, 32 nt, Human
ucagcccccuggaaggaggccauagucgugug

SEQ ID NO: 229786 - RNA, 32 nt, Human
ucagcccccuggcucugccucuccuuguuggc

SEQ ID NO: 229787 - RNA, 32 nt, Human
ucagccccggccccagcuucagcucuucgagu

SEQ ID NO: 229788 - RNA, 20 nt, Human
ucagccccuacccgggcucg

SEQ ID NO: 229789 - RNA, 20 nt, Human
ucagccccucacccugcauc

SEQ ID NO: 229790 - RNA, 32 nt, Human
ucagccccuccccuccaacucucaucccauug

SEQ ID NO: 229791 - RNA, 32 nt, Human
ucagccccuccccugacagcugucccucaccu

SEQ ID NO: 229792 - RNA, 32 nt, Human
ucauacucugccauuuugucucuuaaugcgcu

SEQ ID NO: 229793 - RNA, 32 nt, Human
ucauacuugcuuuacugaucagccaggcaaua

SEQ ID NO: 229794 - RNA, 32 nt, Human
ucauacuuguaacccagcacuuugggaagccg

SEQ ID NO: 229795 - RNA, 24 nt, Human
ucauacuuguaaucccugcacuuu

SEQ ID NO: 229796 - RNA, 32 nt, Human
ucauacuuucucuucucucucuuuuaauuuuc

SEQ ID NO: 229797 - RNA, 32 nt, Human
ucauacuuuguaugugcuuuagggaaggggug

SEQ ID NO: 229798 - RNA, 32 nt, Human
ucauacuuuuguuuugcaacauagaagucaca

SEQ ID NO: 229799 - RNA, 32 nt, Human
ucauagaaaaauggccuuauuucuccagaagu

SEQ ID NO: 229800 - RNA, 32 nt, Human
ucauagaaaauaaggaacaaagagaaacuugu

SEQ ID NO: 229801 - RNA, 32 nt, Human
ucauagaacuauacuaaucuucucacaaaagg

SEQ ID NO: 229802 - RNA, 32 nt, Human
ucauagacaauuccuccagagacacugagcca

SEQ ID NO: 229803 - RNA, 32 nt, Human
ucauagacaugcgccaccuccacgugagaaca

SEQ ID NO: 229804 - RNA, 32 nt, Human
ucauagaccaagucccgggggucuccacucag

SEQ ID NO: 229805 - RNA, 32 nt, Human
ucauagaccccgccugccguccggucaauaaa

SEQ ID NO: 229806 - RNA, 32 nt, Human
ucauagacuccucuguaucacugccuugaggc

SEQ ID NO: 229807 - RNA, 32 nt, Human
ucauagacuuuucuuuuuaaccuucugcaaaa

SEQ ID NO: 229808 - RNA, 32 nt, Human
ucauagagaacaauucgagagacagagagacg

SEQ ID NO: 229809 - RNA, 32 nt, Human
ucauagagacaggguuucaccauguuggccag

SEQ ID NO: 229810 - RNA, 32 nt, Human
ucauagagacuggguuucaccauguagaccag

SEQ ID NO: 229811 - RNA, 32 nt, Human
ucauagagauggggucucacuauguugcccag

SEQ ID NO: 229812 - RNA, 32 nt, Human
ucauagagaugggguuucaccauguuggccag

SEQ ID NO: 229813 - RNA, 32 nt, Human
ucauagagccaguuuucaaagcuccuucugca

SEQ ID NO: 229814 - RNA, 32 nt, Human
ucauagaggaagagcuagaaauccaguagcau

SEQ ID NO: 229815 - RNA, 32 nt, Human
ucauagaucacugcagccucaaacuccugggc

SEQ ID NO: 229816 - RNA, 32 nt, Human
ucauagcaaagcuucuuuuguaaagaacucca

SEQ ID NO: 229817 - RNA, 32 nt, Human
ucauagcacaggaugaggguaaggugaggguu

SEQ ID NO: 229818 - RNA, 32 nt, Human
ucauagcagaagaaauaggauuaucaauguga

SEQ ID NO: 229819 - RNA, 32 nt, Human
ucauagcaucauagcucacugcagccuccaac

SEQ ID NO: 229820 - RNA, 32 nt, Human
ucauagcaucccucagcacucgccaggugcag

SEQ ID NO: 229821 - RNA, 32 nt, Human
ucauagccauggugacacaaaggcccucaaga

SEQ ID NO: 229822 - RNA, 32 nt, Human
ucauagcccagauaggaauccucugcuccucc

SEQ ID NO: 229823 - RNA, 32 nt, Human
ucauagcccagcugcacugacuccuccuccag

SEQ ID NO: 229824 - RNA, 32 nt, Human
ucauagcccugguacaugguacacacaccccc

SEQ ID NO: 229825 - RNA, 32 nt, Human
ucauagccucaaacuccuggucucaagugauc

SEQ ID NO: 229826 - RNA, 32 nt, Human
ucauagccucaguugucccaguuauuuguccu

SEQ ID NO: 229827 - RNA, 32 nt, Human
ucauagccuggacacuucuguggcuguauauc

SEQ ID NO: 229828 - RNA, 32 nt, Human
ucauagccuguuuauucuacugugccauuaaa

SEQ ID NO: 229829 - RNA, 32 nt, Human
ucauagcuacuugggagguugaggcaggagaa

SEQ ID NO: 229830 - RNA, 32 nt, Human
ucauagcucacugaagccucaaccucccuggg

SEQ ID NO: 229831 - RNA, 32 nt, Human
ucauagcucacugcaaccucaaacuccugggc

SEQ ID NO: 229832 - RNA, 32 nt, Human
ucauagcucacugcacccucaaccuccugggu

SEQ ID NO: 229833 - RNA, 32 nt, Human
ucauagcucacugcagacuccaacuccuggcc

SEQ ID NO: 229834 - RNA, 32 nt, Human
ucauagcucacugcagccucaaacuccuggau

SEQ ID NO: 229835 - RNA, 32 nt, Human
ucauagcucacugcagccucaaacuccugggc

SEQ ID NO: 229836 - RNA, 32 nt, Human
ucauagcucacugcagccucaaacucuuuggc

SEQ ID NO: 229837 - RNA, 32 nt, Human
ucauagcucacugcagccucauacuccugggc

SEQ ID NO: 229838 - RNA, 32 nt, Human
ucauagcucacugcagccuccaacuccugggu

SEQ ID NO: 229839 - RNA, 32 nt, Human
ucauagcucacugcagccucgaacuccugggc

SEQ ID NO: 229840 - RNA, 32 nt, Human
ucauagcucacugcagccucgaacucuugggc

SEQ ID NO: 229841 - RNA, 32 nt, Human
ucauagcucacugcagccucgaaucccugggc

SEQ ID NO: 229842 - RNA, 32 nt, Human
ucauagcucacugcagccuggaacuccugggc

SEQ ID NO: 229843 - RNA, 32 nt, Human
ucauagcucacugcagccuggaacuccuuggc

SEQ ID NO: 229844 - RNA, 32 nt, Human
ucauagcucacugcagccuggaauuccugggc

SEQ ID NO: 229845 - RNA, 32 nt, Human
ucauagcucacugcagccuucaacuucugggc

SEQ ID NO: 229846 - RNA, 32 nt, Human
ucauagcucacugcagccuugaacuccuggga

SEQ ID NO: 229847 - RNA, 32 nt, Human
ucauagcucacugcagccuugaauuccuaggc

SEQ ID NO: 229848 - RNA, 32 nt, Human
ucauagcucacugcagccuugacccccucccu

SEQ ID NO: 229849 - RNA, 32 nt, Human
ucauagcucacugcagccuugagcuccuaggc

SEQ ID NO: 229850 - RNA, 32 nt, Human
ucauagcucacugcagccuugagcuccugggc

SEQ ID NO: 229851 - RNA, 32 nt, Human
ucauagcucacugcagccuuuaacuacugggc

SEQ ID NO: 229852 - RNA, 32 nt, Human
ucauagcucacugcagcuucaaacucuugggc

SEQ ID NO: 229853 - RNA, 32 nt, Human
ucauagcucacugcagcuuugaccucccagac

SEQ ID NO: 229854 - RNA, 32 nt, Human
ucauagcucacugcagcuuugacuuccugggc

SEQ ID NO: 229855 - RNA, 32 nt, Human
ucauagcucacugcauccuccaguuccugggu

SEQ ID NO: 229856 - RNA, 32 nt, Human
ucauagcucacugcugccucaaccucccaggc

SEQ ID NO: 229857 - RNA, 32 nt, Human
ucauagcucacugcugcugcuccacccacuuc

SEQ ID NO: 229858 - RNA, 32 nt, Human
ucauagcucacuggagccucuaaugccugggc

SEQ ID NO: 229859 - RNA, 32 nt, Human
ucauagcucacuguaaccucaaacuccuggac

SEQ ID NO: 229860 - RNA, 32 nt, Human
ucauagcucacuguaaccucaaacucuggggc

SEQ ID NO: 229861 - RNA, 32 nt, Human
ucauagcucacuguaacuucgaccaccugggc

SEQ ID NO: 229862 - RNA, 32 nt, Human
ucauagcucacuguacccuugaacuccugggc

SEQ ID NO: 229863 - RNA, 32 nt, Human
ucauagcucacuguagccucgaccuuccggga

SEQ ID NO: 229864 - RNA, 32 nt, Human
ucauagcucacuguagccuuaaacuucuggac

SEQ ID NO: 229865 - RNA, 32 nt, Human
ucauagcugaagcccaaaucgcucaaacgugu

SEQ ID NO: 229866 - RNA, 32 nt, Human
ucauagcugacacagagccaucugccacaaac

SEQ ID NO: 229867 - RNA, 32 nt, Human
ucauagcugccuaucagaauuucccaaauauu

SEQ ID NO: 229868 - RNA, 32 nt, Human
ucauagcugguaaaauuauucccacuguuuua

SEQ ID NO: 229869 - RNA, 32 nt, Human
ucauagcugucugaccucuacggaccucacau

SEQ ID NO: 229870 - RNA, 32 nt, Human
ucauaggaauaugcucucacaggagauaaugu

SEQ ID NO: 229871 - RNA, 32 nt, Human
ucauaggacucaauggagagugaggcagcugg

SEQ ID NO: 229872 - RNA, 32 nt, Human
ucauaggacucacauuucucucaguuauauuu

SEQ ID NO: 229873 - RNA, 32 nt, Human
ucauaggagaauugaauaauuucuaucaauau

SEQ ID NO: 229874 - RNA, 32 nt, Human
ucauaggagguaaucaccagacaacugcagaa

SEQ ID NO: 229875 - RNA, 32 nt, Human
ucauaggaguagcuguggacagaggaaccaac

SEQ ID NO: 229876 - RNA, 32 nt, Human
ucauaggauaacucauacuggagagaaaccau

SEQ ID NO: 229877 - RNA, 32 nt, Human
ucauaggcaaguuaguaggaccaccugauucc

SEQ ID NO: 229878 - RNA, 32 nt, Human
ucauaggccucagacuccaacugguguuaucc

SEQ ID NO: 229879 - RNA, 32 nt, Human
ucauaggccuuccuuuuacuaguagggcauaa

SEQ ID NO: 229880 - RNA, 32 nt, Human
ucauaggcucaaguaaucuuccugccucaacc

SEQ ID NO: 229881 - RNA, 32 nt, Human
ucauaggucacugcagccucaaacucccaaau

SEQ ID NO: 229882 - RNA, 32 nt, Human
ucauaggugacuggcauacacacuccucauaa

SEQ ID NO: 229883 - RNA, 32 nt, Human
ucauagguggggacucaagguacaggaccaag

SEQ ID NO: 229884 - RNA, 32 nt, Human
ucauagguugugugagccuaugaaaaagugua

SEQ ID NO: 229885 - RNA, 32 nt, Human
ucauaguaggugcugcuggccccuggugaucc

SEQ ID NO: 229886 - RNA, 32 nt, Human
ucauagucaccuacuccaacauucauaaguag

SEQ ID NO: 229887 - RNA, 32 nt, Human
ucauagucauuuuucuuaauugcccuuaauau

SEQ ID NO: 229888 - RNA, 32 nt, Human
ucauagucuuucauuugcuagcugugauccaa

SEQ ID NO: 229889 - RNA, 32 nt, Human
ucauagugguauaaaguucacacaguauuaug

SEQ ID NO: 229890 - RNA, 32 nt, Human
ucauaguucacugcagccuugaacucuuuggc

SEQ ID NO: 229891 - RNA, 32 nt, Human
ucauaguucccagcgugaggaaaaugaagaaa

SEQ ID NO: 229892 - RNA, 32 nt, Human
ucauaguucuagaggcuggaaguccacagugc

SEQ ID NO: 229893 - RNA, 32 nt, Human
ucauaguugcccacucccucuccuuacuuagc

SEQ ID NO: 229894 - RNA, 32 nt, Human
ucauauaaaguuccaaaugacaccagaaaaau

SEQ ID NO: 229895 - RNA, 32 nt, Human
ucauauaacuauauguuaucuuccaagcuuuu

SEQ ID NO: 229896 - RNA, 32 nt, Human
ucauauaagacagauggaugaucugugaacau

SEQ ID NO: 229897 - RNA, 32 nt, Human
ucauauacaucguuaugaaaauauugcuauga

SEQ ID NO: 229898 - RNA, 32 nt, Human
ucauauacauucucuugcuaucuacaauaagg

SEQ ID NO: 229899 - RNA, 32 nt, Human
ucauauaccagccuggcagccccgugcacauu

SEQ ID NO: 229900 - RNA, 32 nt, Human
ucauauagcaucucucccuacacacaguuucc

SEQ ID NO: 229901 - RNA, 32 nt, Human
ucauauagcuuguccccucugggccugccugu

SEQ ID NO: 229902 - RNA, 32 nt, Human
ucauauauaccuuguggaugagagcuauauac

SEQ ID NO: 229903 - RNA, 32 nt, Human
ucauauauuuggaguuuuucugaaaaauggag

SEQ ID NO: 229904 - RNA, 32 nt, Human
ucauaucacugcacuccagccuggcugacaga

SEQ ID NO: 229905 - RNA, 32 nt, Human
ucauauccaagaaaucauuacagaauucaaua

SEQ ID NO: 229906 - RNA, 32 nt, Human
ucauauccgugcugccccggaccccugugacu

SEQ ID NO: 229907 - RNA, 32 nt, Human
ucauauccuggcucuucucugggcaagaugag

SEQ ID NO: 229908 - RNA, 19 nt, Human
ucauaucuauugccuacaa

SEQ ID NO: 229909 - RNA, 32 nt, Human
ucauaucucuacacugcaaauuuugggucuca

SEQ ID NO: 229910 - RNA, 32 nt, Human
ucauaucucuacgcugcaaauuuugggucuca

SEQ ID NO: 229911 - RNA, 32 nt, Human
ucauaucucuagaccuggggcuucacggaggc

SEQ ID NO: 229912 - RNA, 32 nt, Human
ucauaucugccucuuccccuuaccaucguaau

SEQ ID NO: 229913 - RNA, 32 nt, Human
ucauaucuucauugucacuuugucuuaccuca

SEQ ID NO: 229914 - RNA, 32 nt, Human
ucauaucuugccuaggaacuccaggcuugucu

SEQ ID NO: 229915 - RNA, 32 nt, Human
ucauaugaagugagagagaguuuggucguggc

SEQ ID NO: 229916 - RNA, 32 nt, Human
ucauaugagcacuuugguguaggcuuggaaaa

SEQ ID NO: 229917 - RNA, 32 nt, Human
ucauaugauaaauaagugauuuauaaacaaga

SEQ ID NO: 229918 - RNA, 32 nt, Human
ucauaugcaauauuucuucuggcuucucaugg

SEQ ID NO: 229919 - RNA, 32 nt, Human
ucauaugccuccagccauuauaugagaacugu

SEQ ID NO: 229920 - RNA, 32 nt, Human
ucauaugcugcuuugagugaaccagagaaaca

SEQ ID NO: 229921 - RNA, 32 nt, Human
ucauaugcuguauuuaaaaagcaacaaugaua

SEQ ID NO: 229922 - RNA, 32 nt, Human
ucauaugcuguugcauaugacucucaucacaa

SEQ ID NO: 229923 - RNA, 32 nt, Human
ucauaugcuuauugaccauuuguacuucuuuc

SEQ ID NO: 229924 - RNA, 32 nt, Human
ucauauggagcgagguguuggggaaggcgggg

SEQ ID NO: 229925 - RNA, 32 nt, Human
ucauauggcuuaauuuuaacaaaaccauacgu

SEQ ID NO: 229926 - RNA, 32 nt, Human
ucauaugggaguuuuagagagcugugucccaa

SEQ ID NO: 229927 - RNA, 32 nt, Human
ucauauguauaugucauaugacuuuauaaaau

SEQ ID NO: 229928 - RNA, 32 nt, Human
ucauauguccccugucuuccuccaucugagaa

SEQ ID NO: 229929 - RNA, 32 nt, Human
ucauaugucccugugcuccuuuuaaccaaaua

SEQ ID NO: 229930 - RNA, 32 nt, Human
ucauaugugaaggcacguucuccagccaucag

SEQ ID NO: 229931 - RNA, 32 nt, Human
ucauauguuucaagcuaaucuuguagcuaagc

SEQ ID NO: 229932 - RNA, 32 nt, Human
ucauauuauaugcacuaaacuauaugcaugaa

SEQ ID NO: 229933 - RNA, 32 nt, Human
ucauauucaagcuucagaagcuagugaccauc

SEQ ID NO: 229934 - RNA, 32 nt, Human
ucauauucacauauguaaaccagaacauucua

SEQ ID NO: 229935 - RNA, 32 nt, Human
ucauauuccuugagccccuucacuaaagcaag

SEQ ID NO: 229936 - RNA, 32 nt, Human
ucauauucuguuggaagcuuguuuuccagucu

SEQ ID NO: 229937 - RNA, 32 nt, Human
ucauauugccacugugcuauccuugaacuacc

SEQ ID NO: 229938 - RNA, 32 nt, Human
ucauauugcucaaacacacaugcuguauaauu

SEQ ID NO: 229939 - RNA, 32 nt, Human
ucauauugucauuuguuuugagcagucugaau

SEQ ID NO: 229940 - RNA, 31 nt, Human
ucauauuuacucaaggagggaccaggaugau

SEQ ID NO: 229941 - RNA, 32 nt, Human
ucauauuuagagcuaaggccacugaggaaaga

SEQ ID NO: 229942 - RNA, 32 nt, Human
ucauauuucacuucuagccuuuuaguauggca

SEQ ID NO: 229943 - RNA, 32 nt, Human
ucauauuucagcaguuugccacugugacuguc

SEQ ID NO: 229944 - RNA, 32 nt, Human
ucauauuuuauucauuuucucccuuuagcaau

SEQ ID NO: 229945 - RNA, 32 nt, Human
ucauauuuugcagccagcaaugaaguucugcc

SEQ ID NO: 229946 - RNA, 32 nt, Human
ucaucaaaaccuuugccucccuaguucaagcg

SEQ ID NO: 229947 - RNA, 32 nt, Human
ucaucaaaagagccauuggaggggacaccaga

SEQ ID NO: 229948 - RNA, 32 nt, Human
ucaucaaaauggcagccuuuuccccagcuacu

SEQ ID NO: 229949 - RNA, 32 nt, Human
ucaucaaagacacccuugcccucuggcgucgc

SEQ ID NO: 229950 - RNA, 32 nt, Human
ucaucaacaagauuuccuugugcaaaauauuu

SEQ ID NO: 229951 - RNA, 32 nt, Human
ucaucaacauagugagaccccaucucuauuaa

SEQ ID NO: 229952 - RNA, 32 nt, Human
ucaucaaccagcugccuuuguuucauuucacc

SEQ ID NO: 229953 - RNA, 32 nt, Human
ucaucaacccacaaggagagagaugugcggga

SEQ ID NO: 229954 - RNA, 32 nt, Human
ucaucaacggaagucccuccacuggauuccuu

SEQ ID NO: 229955 - RNA, 32 nt, Human
ucaucaacuacaaaauaugaaaucagcauucc

SEQ ID NO: 229956 - RNA, 32 nt, Human
ucaucaacucacacuccucucccugucuuccg

SEQ ID NO: 229957 - RNA, 32 nt, Human
ucaucaacucagagacagagccaggggcugcu

SEQ ID NO: 229958 - RNA, 32 nt, Human
ucaucaagaagcagaggcuaguucacccacuc

SEQ ID NO: 229959 - RNA, 24 nt, Human
ucaucaagcuccacaucacugagg

SEQ ID NO: 229960 - RNA, 32 nt, Human
ucaucaagcuccacccuccuggccucauacag

SEQ ID NO: 229961 - RNA, 32 nt, Human
ucaucaaggucuagccuuccaggaaggggcug

SEQ ID NO: 229962 - RNA, 32 nt, Human
ucaucaauaacucaccagcaaauacuuccuga

SEQ ID NO: 229963 - RNA, 23 nt, Human
ucaucaaucauacagucagugaa

SEQ ID NO: 229964 - RNA, 24 nt, Human
ucaucaaucuuucacuuucuuccu

SEQ ID NO: 229965 - RNA, 32 nt, Human
ucaucaaugccccaguucacauccaccugcuu

SEQ ID NO: 229966 - RNA, 32 nt, Human
ucaucaaugcucaauuucuacuucuucauuac

SEQ ID NO: 229967 - RNA, 32 nt, Human
ucaucaauuauuagacaaaucccacuggccua

SEQ ID NO: 229968 - RNA, 32 nt, Human
ucaucaauucaccuuuaugcaugggcaccaaa

SEQ ID NO: 229969 - RNA, 32 nt, Human
ucaucaauuucugcuucuucauggaaugcuga

SEQ ID NO: 229970 - RNA, 32 nt, Human
ucaucacaaaaguucaucagcaaacaggaaaa

SEQ ID NO: 229971 - RNA, 32 nt, Human
ucaucacaaacaucuccaaaggccaugcugcc

SEQ ID NO: 229972 - RNA, 32 nt, Human
ucaucacaccacuccgcugccugggguuuuca

SEQ ID NO: 229973 - RNA, 32 nt, Human
ucaucacaccaguacacuccaggcuaggucac

SEQ ID NO: 229974 - RNA, 24 nt, Human
ucaucacagagaaggucaaaugaa

SEQ ID NO: 229975 - RNA, 32 nt, Human
ucaucacaggggccauuucugccuugugaugg

SEQ ID NO: 229976 - RNA, 32 nt, Human
ucaucacaguuauccugaguugaguuuaagcc

SEQ ID NO: 229977 - RNA, 32 nt, Human
ucaucacaucuucucuggcccucgacugagau

SEQ ID NO: 229978 - RNA, 32 nt, Human
ucaucacaugagcccugcugggcacagcugcg

SEQ ID NO: 229979 - RNA, 32 nt, Human
ucaucacaugccaccacacuguaccauggggg

SEQ ID NO: 229980 - RNA, 32 nt, Human
ucaucacaugucuaacaccacuuccaccccac

SEQ ID NO: 229981 - RNA, 31 nt, Human
ucaucaccaaugucugucaugcugagcaaga

SEQ ID NO: 229982 - RNA, 22 nt, Human
ucaucaccaccuuccaucauca

SEQ ID NO: 229983 - RNA, 23 nt, Human
ucaucaccauggccauccugcaa

SEQ ID NO: 229984 - RNA, 32 nt, Human
ucaucaccauuuccuccuuuaccuuucagugc

SEQ ID NO: 229985 - RNA, 32 nt, Human
ucaucaccauuuuuccugaguagggcuuaguu

SEQ ID NO: 229986 - RNA, 32 nt, Human
ucaucacccacacucccuauuuugggcccuca

SEQ ID NO: 229987 - RNA, 32 nt, Human
ucaucacccacuggauuaugccccaggcuucc

SEQ ID NO: 229988 - RNA, 32 nt, Human
ucaucacccacuggcacugaucagggcaccac

SEQ ID NO: 229989 - RNA, 32 nt, Human
ucaucacccaggcuagagugcaguggcacaaa

SEQ ID NO: 229990 - RNA, 32 nt, Human
ucaucacccaguuuuucccucuggacccagga

SEQ ID NO: 229991 - RNA, 32 nt, Human
ucaucacccccaaaagaauccccacacccauu

SEQ ID NO: 229992 - RNA, 32 nt, Human
ucaucacccgaugaggcaaccagccagaacgc

SEQ ID NO: 229993 - RNA, 32 nt, Human
ucaucaccuccaggaacaccgcucaggccuga

SEQ ID NO: 229994 - RNA, 18 nt, Human
ucaucaccugcuggcccc

SEQ ID NO: 229995 - RNA, 32 nt, Human
ucaucaccuucaccugccuuggucauggcucu

SEQ ID NO: 229996 - RNA, 32 nt, Human
ucaucaccuuccuccccaguguuuccacuuau

SEQ ID NO: 229997 - RNA, 32 nt, Human
ucaucacuaccuaauuccaaaacauuuuuauc

SEQ ID NO: 229998 - RNA, 32 nt, Human
ucaucacucauuccguggaugauucuaccucc

SEQ ID NO: 229999 - RNA, 32 nt, Human
ucaucacuggacugcauggggaggcagcagag

SEQ ID NO: 230000 - RNA, 32 nt, Human
ucaucacuggcuggggacagagccgggcacca

SEQ ID NO: 230001 - RNA, 32 nt, Human
ucaucacugggugggaccacgagggcaaugcu

SEQ ID NO: 230002 - RNA, 32 nt, Human
ucaucacugguagcaaagauuuacagaauguc

SEQ ID NO: 230003 - RNA, 32 nt, Human
ucaucacugguaggaggcaaagcagugggucc

SEQ ID NO: 230004 - RNA, 32 nt, Human
ucaucacuuccucucuccacccccucuccaac

SEQ ID NO: 230005 - RNA, 32 nt, Human
ucaucacuuccugucugguucugcuucugugg

SEQ ID NO: 230006 - RNA, 32 nt, Human
ucaucagaaaaauguuuuacgguggcugcuug

SEQ ID NO: 230007 - RNA, 32 nt, Human
ucaucagaaauaccuccagaagauucaaggag

SEQ ID NO: 230008 - RNA, 32 nt, Human
ucaucagaagcaucauucaucaaucaacuuga

SEQ ID NO: 230009 - RNA, 32 nt, Human
ucaucagagcauagagcugacagaacaugaug

SEQ ID NO: 230010 - RNA, 32 nt, Human
ucaucagaggcagccuuccaggcacagcucug

SEQ ID NO: 230011 - RNA, 32 nt, Human
ucaucagaugcccucuggaaugguuagcaucc

SEQ ID NO: 230012 - RNA, 32 nt, Human
ucaucagauguucaccauggccaccgcagaac

SEQ ID NO: 230013 - RNA, 32 nt, Human
ucaucagcaacaacaaaaccugauauuccaag

SEQ ID NO: 230014 - RNA, 32 nt, Human
ucaucagccagcauuggugaauauucaguuua

SEQ ID NO: 230015 - RNA, 32 nt, Human
ucaucagccagccugcaugagccucuacauuu

SEQ ID NO: 230016 - RNA, 32 nt, Human
ucaucagccccaggcugcaggugaggcuucag

SEQ ID NO: 230017 - RNA, 32 nt, Human
ucaucagcccuagaggguagaaaguuuuccca

SEQ ID NO: 230018 - RNA, 32 nt, Human
ucaucagcccucuuuuccggugccggaacuau

SEQ ID NO: 230019 - RNA, 32 nt, Human
ucaucagcccugccuguuuugcaccugggaag

SEQ ID NO: 230020 - RNA, 32 nt, Human
ucaucagcuaaauaaucaucucugccucaaau

SEQ ID NO: 230021 - RNA, 32 nt, Human
ucaucagcucuaaacucucugccuccacaaaa

SEQ ID NO: 230022 - RNA, 32 nt, Human
ucaucagcugcccgcuagcauguggccagggg

SEQ ID NO: 230023 - RNA, 32 nt, Human
ucaucaggaaauccuugcagcagggguuuaga

SEQ ID NO: 230024 - RNA, 31 nt, Human
ucaucaggagcaucucccaucucaagauuca

SEQ ID NO: 230025 - RNA, 32 nt, Human
ucaucaggauucaggagcugggauggguacac

SEQ ID NO: 230026 - RNA, 20 nt, Human
ucaucaggccgggugcagug

SEQ ID NO: 230027 - RNA, 21 nt, Human
ucaucaggccgggugcagugg

SEQ ID NO: 230028 - RNA, 32 nt, Human
ucaucagggccacccccugcaguauugagcac

SEQ ID NO: 230029 - RNA, 22 nt, Human
ucaucagucccucuccuggagc

SEQ ID NO: 230030 - RNA, 32 nt, Human
ucaucagucuagacugacugcugcuauaagua

SEQ ID NO: 230031 - RNA, 32 nt, Human
ucaucagucucucaauggaauguucaugguca

SEQ ID NO: 230032 - RNA, 32 nt, Human
ucaucagugaaauguugaauaguagcaaugau

SEQ ID NO: 230033 - RNA, 32 nt, Human
ucaucauaagacagaguaagaauuuuuaacag

SEQ ID NO: 230034 - RNA, 24 nt, Human
ucaucauaaguacuugcugaugga

SEQ ID NO: 230035 - RNA, 32 nt, Human
ucaucauacaucccacacagucuguauuacuu

SEQ ID NO: 230036 - RNA, 32 nt, Human
ucaucauacauguacauuuccaccaugugcag

SEQ ID NO: 230037 - RNA, 32 nt, Human
ucaucauauucacggguucuggagauuagcuc

SEQ ID NO: 230038 - RNA, 32 nt, Human
ucaucaucacccagcuaugaacuaucuaucau

SEQ ID NO: 230039 - RNA, 24 nt, Human
ucaucaucacccuuucauucauca

SEQ ID NO: 230040 - RNA, 32 nt, Human
ucaucaucacccuuucauucaucauagggaua

SEQ ID NO: 230041 - RNA, 20 nt, Human
ucaucaucacgaucuucugg

SEQ ID NO: 230042 - RNA, 20 nt, Human
ucaucaucagauucuccugg

SEQ ID NO: 230043 - RNA, 32 nt, Human
ucaucaucagguuuccccuauaagcuuucucc

SEQ ID NO: 230044 - RNA, 32 nt, Human
ucaucaucaguaguccuccagccugggcagcu

SEQ ID NO: 230045 - RNA, 32 nt, Human
ucaucaucagugucagagcccaaaaggagaau

SEQ ID NO: 230046 - RNA, 24 nt, Human
ucaucaucaucauccucauccuca

SEQ ID NO: 230047 - RNA, 23 nt, Human
ucaucaucaucaucuucaucauc

SEQ ID NO: 230048 - RNA, 21 nt, Human
ucaucaucaucgucaucauca

SEQ ID NO: 230049 - RNA, 32 nt, Human
ucaucaucaucucugcuacagucauguuucug

SEQ ID NO: 230050 - RNA, 32 nt, Human
ucaucaucucauucacauuugggaaacgaaca

SEQ ID NO: 230051 - RNA, 32 nt, Human
ucaucaucuuccuaaggaacagacuuaaguau

SEQ ID NO: 230052 - RNA, 32 nt, Human
ucaucaugccacugcacuuccagccuggguga

SEQ ID NO: 230053 - RNA, 21 nt, Human
ucaucaugcugugcuaaugaa

SEQ ID NO: 230054 - RNA, 32 nt, Human
ucaucauggaaaugauucucauugacuaauac

SEQ ID NO: 230055 - RNA, 32 nt, Human
ucaucauggaaaugauucucauugacuaaugc

SEQ ID NO: 230056 - RNA, 32 nt, Human
ucaucauggcaacaagagcugcagccugggac

SEQ ID NO: 230057 - RNA, 32 nt, Human
ucaucauggccagcuuaauccuuccacuuccc

SEQ ID NO: 230058 - RNA, 32 nt, Human
ucaucauguuagccaggauggucuugaucucc

SEQ ID NO: 230059 - RNA, 32 nt, Human
ucaucauguuggccaggauggucucgaucucc

SEQ ID NO: 230060 - RNA, 32 nt, Human
ucaucauguuggccaggauggucuugaucucu

SEQ ID NO: 230061 - RNA, 32 nt, Human
ucaucauguuggccaggaugguuuugaucucc

SEQ ID NO: 230062 - RNA, 22 nt, Human
ucaucauuaccccuacuggguc

SEQ ID NO: 230063 - RNA, 32 nt, Human
ucaucauugcuugcccugggccuaucccauga

SEQ ID NO: 230064 - RNA, 32 nt, Human
ucaucauuuuccuaaggaacagacuuaaguau

SEQ ID NO: 230065 - RNA, 24 nt, Human
ucaucauuuugacagucaucauca

SEQ ID NO: 230066 - RNA, 32 nt, Human
ucauccaaaaugucuuaggaaccuccuuaguu

SEQ ID NO: 230067 - RNA, 22 nt, Human
ucauccaaacuggagugcagug

SEQ ID NO: 230068 - RNA, 32 nt, Human
ucauccaaagagaagaaaggugaccucacauu

SEQ ID NO: 230069 - RNA, 32 nt, Human
ucauccaaccuggaaucuuagcuuugaccccc

SEQ ID NO: 230070 - RNA, 22 nt, Human
ucauccaagcuggagugcagug

SEQ ID NO: 230071 - RNA, 32 nt, Human
ucauccaagcuggagugcaguggugcaauccu

SEQ ID NO: 230072 - RNA, 32 nt, Human
ucauccacaaacacccucauagacgcacccag

SEQ ID NO: 230073 - RNA, 32 nt, Human
ucauccacaggcaagcaucuuggaucuugcaa

SEQ ID NO: 230074 - RNA, 32 nt, Human
ucauccaccagaagcauuuccagcacauccag

SEQ ID NO: 230075 - RNA, 18 nt, Human
ucauccacccaucccucu

SEQ ID NO: 230076 - RNA, 32 nt, Human
ucauccaccccuccccaucuggaccauaauag

SEQ ID NO: 230077 - RNA, 32 nt, Human
ucauccacccucuggcacccagccucugaggg

SEQ ID NO: 230078 - RNA, 32 nt, Human
ucauccacccugagcucccuggcugauuuauu

SEQ ID NO: 230079 - RNA, 32 nt, Human
ucauccaccgcaacccauccagugccagcuuu

SEQ ID NO: 230080 - RNA, 32 nt, Human
ucauccacgaccagaccuccccaaaccccaag

SEQ ID NO: 230081 - RNA, 32 nt, Human
ucauccacucaggucuuccucuggaccugcau

SEQ ID NO: 230082 - RNA, 32 nt, Human
ucauccagaaaaucuugcucaguggcucugag

SEQ ID NO: 230083 - RNA, 32 nt, Human
ucauccagaaagccaugaaagagggacgcuac

SEQ ID NO: 230084 - RNA, 24 nt, Human
ucauccagaagucaacauccugca

SEQ ID NO: 230085 - RNA, 32 nt, Human
ucauccagacccccugcccugucuuggcaacc

SEQ ID NO: 230086 - RNA, 32 nt, Human
ucauccagaggacccaaccacccggaucugag

SEQ ID NO: 230087 - RNA, 32 nt, Human
ucauccagaugcuucuggaggaggggcaggag

SEQ ID NO: 230088 - RNA, 23 nt, Human
ucauccagcagccuccccuccca

SEQ ID NO: 230089 - RNA, 23 nt, Human
ucauccagcagcuccccccacca

SEQ ID NO: 230090 - RNA, 18 nt, Human
ucauccagcaucuccugg

SEQ ID NO: 230091 - RNA, 32 nt, Human
ucauccagccucccagaagaauacucaacaac

SEQ ID NO: 230092 - RNA, 32 nt, Human
ucauccagcucaccaguuaucaacugacgacc

SEQ ID NO: 230093 - RNA, 32 nt, Human
ucauccaggaggccgccuucacccucauuggc

SEQ ID NO: 230094 - RNA, 22 nt, Human
ucauccaggcuagagugcagug

SEQ ID NO: 230095 - RNA, 20 nt, Human
ucauccaggcugcagugcag

SEQ ID NO: 230096 - RNA, 32 nt, Human
ucauccaggcuggacaguucagugauuugccu

SEQ ID NO: 230097 - RNA, 32 nt, Human
ucauccaggcuggaggguaguggcgugaccag

SEQ ID NO: 230098 - RNA, 22 nt, Human
ucauccaggcuggagugcagug

SEQ ID NO: 230099 - RNA, 32 nt, Human
ucauccaggcuggagugcagugaugcgauuga

SEQ ID NO: 230100 - RNA, 32 nt, Human
ucauccaggcuggagugcaguggcgcaaucuc

SEQ ID NO: 230101 - RNA, 32 nt, Human
ucauccaggcuggagugcaguggugcaaucau

SEQ ID NO: 230102 - RNA, 32 nt, Human
ucauccaggcuggagugcaguggugugaucac

SEQ ID NO: 230103 - RNA, 32 nt, Human
ucauccaggcuggagugcggugguggaaucau

SEQ ID NO: 230104 - RNA, 32 nt, Human
ucauccaggcuggauguggcuugggagagacc

SEQ ID NO: 230105 - RNA, 21 nt, Human
ucauccagguucccccuccca

SEQ ID NO: 230106 - RNA, 32 nt, Human
ucauccagucugugcugaucugcaggccaaaa

SEQ ID NO: 230107 - RNA, 32 nt, Human
ucauccauacccuucucuuuugcauggcuucu

SEQ ID NO: 230108 - RNA, 32 nt, Human
ucauccauccauccaucauccauccguccauc

SEQ ID NO: 230109 - RNA, 32 nt, Human
ucauccaucuuccucuacuucucuccuucauu

SEQ ID NO: 230110 - RNA, 32 nt, Human
ucauccaugcguccgccugccugccugcgcuu

SEQ ID NO: 230111 - RNA, 32 nt, Human
ucauccauggugccauguuaaagaaguuggaa

SEQ ID NO: 230112 - RNA, 32 nt, Human
ucauccauguuguuacuuaggcauuuuaucuu

SEQ ID NO: 230113 - RNA, 32 nt, Human
ucaucccaaaagagcuggagugacaugggagg

SEQ ID NO: 230114 - RNA, 32 nt, Human
ucaucccaaaggacagccgccuggagaugacu

SEQ ID NO: 230115 - RNA, 32 nt, Human
ucaucccacaauauagacaggcauugucacuu

SEQ ID NO: 230116 - RNA, 32 nt, Human
ucaucccacaggcugcacugucaggaagagga

SEQ ID NO: 230117 - RNA, 32 nt, Human
ucaucccacuccaacucuucccccucucccag

SEQ ID NO: 230118 - RNA, 19 nt, Human
ucaucccagaccaauggca

SEQ ID NO: 230119 - RNA, 32 nt, Human
ucaucccagauguugguuaucuuucugaagua

SEQ ID NO: 230120 - RNA, 32 nt, Human
ucaucccagcaauuugggaggcugaggugggc

SEQ ID NO: 230121 - RNA, 32 nt, Human
ucaucccagcacugugggaggccgaggcgggu

SEQ ID NO: 230122 - RNA, 32 nt, Human
ucaucccagcacuuugggaagcugaggcgagc

SEQ ID NO: 230123 - RNA, 32 nt, Human
ucaucccagcacuuugggaggccgagacggga

SEQ ID NO: 230124 - RNA, 32 nt, Human
ucaucccagcacuuugggaggccgaggcagga

SEQ ID NO: 230125 - RNA, 32 nt, Human
ucaucccagcacuuugggaggccgaggugggc

SEQ ID NO: 230126 - RNA, 32 nt, Human
ucaucccagcacuuugggaggcugaggcaggc

SEQ ID NO: 230127 - RNA, 32 nt, Human
ucaucccagcagcucuuaaggcugaggcacaa

SEQ ID NO: 230128 - RNA, 32 nt, Human
ucaucccagccuagucuccugaugucugugcu

SEQ ID NO: 230129 - RNA, 32 nt, Human
ucaucccagcuacuccagaggcugagauggga

SEQ ID NO: 230130 - RNA, 32 nt, Human
ucaucccagcuacucgggaggcugaggcagga

SEQ ID NO: 230131 - RNA, 32 nt, Human
ucaucccagcuacucgggaggcugagguggga

SEQ ID NO: 230132 - RNA, 32 nt, Human
ucaucccagcuacucgguaggcugaggcagga

SEQ ID NO: 230133 - RNA, 32 nt, Human
ucaucccagcuacuugggaggcugaggcagga

SEQ ID NO: 230134 - RNA, 32 nt, Human
ucaucccauacagucacaacaacugauaaaau

SEQ ID NO: 230135 - RNA, 32 nt, Human
ucaucccaugauguagugccucuuucauccac

SEQ ID NO: 230136 - RNA, 32 nt, Human
ucaucccauguccaccauguaggggagggacu

SEQ ID NO: 230137 - RNA, 28 nt, Human
ucauccccaagugccccuucugccucag

SEQ ID NO: 230138 - RNA, 32 nt, Human
ucauccccaagugccccuucugccucaguccu

SEQ ID NO: 230139 - RNA, 32 nt, Human
ucaucccccugccucuaccuucauuccaaacc

SEQ ID NO: 230140 - RNA, 32 nt, Human
ucauccccgggccaggaggaugagguuguccu

SEQ ID NO: 230141 - RNA, 32 nt, Human
ucauccccuaugaaccugggucuuauucuguc

SEQ ID NO: 230142 - RNA, 32 nt, Human
ucauccccucaggagucugaacacugggcuua

SEQ ID NO: 230143 - RNA, 32 nt, Human
ucauccccuccccgcgcguuccuucgcacacu

SEQ ID NO: 230144 - RNA, 32 nt, Human
ucauccccuccuggggccaggcuuggguuuca

SEQ ID NO: 230145 - RNA, 32 nt, Human
ucauccccucuuccuuucuuguccuuguccca

SEQ ID NO: 230146 - RNA, 32 nt, Human
ucauccccugcagacgugucaucgagcaggcu

SEQ ID NO: 230147 - RNA, 32 nt, Human
ucauccccuucccaccaaaccccagacucugu

SEQ ID NO: 230148 - RNA, 32 nt, Human
ucauccccuugccuuuucaagcucugcggagg

SEQ ID NO: 230149 - RNA, 32 nt, Human
ucauccccuuuauuuucccuguguauacauuc

SEQ ID NO: 230150 - RNA, 32 nt, Human
ucaucccgagcaccuccacauccuccacguuc

SEQ ID NO: 230151 - RNA, 32 nt, Human
ucaucccgcuacugcugcugggaucagguuga

SEQ ID NO: 230152 - RNA, 25 nt, Human
ucaucccgcuucucuccggccugag

SEQ ID NO: 230153 - RNA, 32 nt, Human
ucaucccggggcaaagcaggcaucaaaaccag

SEQ ID NO: 230154 - RNA, 19 nt, Human
ucaucccggggcccuggua

SEQ ID NO: 230155 - RNA, 20 nt, Human
ucaucccucacccccuccca

SEQ ID NO: 230156 - RNA, 32 nt, Human
ucaucccuccacucugacucugacuauggcag

SEQ ID NO: 230157 - RNA, 32 nt, Human
ucaucccucugccuccaagaaggccuguauua

SEQ ID NO: 230158 - RNA, 32 nt, Human
ucaucccucugccucugagaaaauauaagagg

SEQ ID NO: 230159 - RNA, 32 nt, Human
ucaucccugcuccccgugugucccucgguccu

SEQ ID NO: 230160 - RNA, 32 nt, Human
ucaucccuguaaucccagcacuuaaggaguac

SEQ ID NO: 230161 - RNA, 32 nt, Human
ucaucccuguaaucccagugcuuugggaggcc

SEQ ID NO: 230162 - RNA, 32 nt, Human
ucaucccuguaauuccagcacuuuggaaggcc

SEQ ID NO: 230163 - RNA, 32 nt, Human
ucaucccuucugagaaauguacccuauuauuu

SEQ ID NO: 230164 - RNA, 32 nt, Human
ucauccgaccccaaguggcccacaguuuccuu

SEQ ID NO: 230165 - RNA, 32 nt, Human
ucauccgaggcagggucaggagaggggcagaa

SEQ ID NO: 230166 - RNA, 32 nt, Human
ucauccgccugcacagcugaguccagugggag

SEQ ID NO: 230167 - RNA, 32 nt, Human
ucauccgccuguggcuggaguaaaauauacgg

SEQ ID NO: 230168 - RNA, 32 nt, Human
ucauccgcuacuugcaccaaccagucccgggu

SEQ ID NO: 230169 - RNA, 32 nt, Human
ucauccgugcugaaaaucagggcccugggaaa

SEQ ID NO: 230170 - RNA, 28 nt, Human
ucauccuaaagugcuggccucucauucc

SEQ ID NO: 230171 - RNA, 32 nt, Human
ucauccuaaggugugcagcccaggcccugccc

SEQ ID NO: 230172 - RNA, 32 nt, Human
ucauccuacagccucagcucgggcccagccuu

SEQ ID NO: 230173 - RNA, 32 nt, Human
ucauccuacucuuuaccuugucaccacaaaaa

SEQ ID NO: 230174 - RNA, 32 nt, Human
ucauccuauauuuuacaaagcaugugaauucu

SEQ ID NO: 230175 - RNA, 32 nt, Human
ucauccuaugccacagaaucugugugugaugu

SEQ ID NO: 230176 - RNA, 32 nt, Human
ucauccuauggacugagccggccacucucugg

SEQ ID NO: 230177 - RNA, 32 nt, Human
ucauccucaaauucuauauguaaagagcauuu

SEQ ID NO: 230178 - RNA, 32 nt, Human
ucauccucagcuguccauccaggcccagaagg

SEQ ID NO: 230179 - RNA, 32 nt, Human
ucauccucagcuugcacaaacugguugaacgg

SEQ ID NO: 230180 - RNA, 32 nt, Human
ucauccucauccuccuccuccuccacuugcag

SEQ ID NO: 230181 - RNA, 32 nt, Human
ucauccuccaaaagugcugggauuacaggcau

SEQ ID NO: 230182 - RNA, 32 nt, Human
ucauccuccauacauuugaauucaaguuguuu

SEQ ID NO: 230183 - RNA, 32 nt, Human
ucauccucccaaaaugcugggauuacaggcau

SEQ ID NO: 230184 - RNA, 32 nt, Human
ucauccucccaaagugcugggauuacaggugu

SEQ ID NO: 230185 - RNA, 32 nt, Human
ucauccucccaaagugcugggauuauaggccu

SEQ ID NO: 230186 - RNA, 32 nt, Human
ucauccucccaaaguguugggauuacaggugu

SEQ ID NO: 230187 - RNA, 32 nt, Human
ucauccucccaaguaggugggauuacaggugc

SEQ ID NO: 230188 - RNA, 32 nt, Human
ucauccuccggaguagcugggauuacaggcgc

SEQ ID NO: 230189 - RNA, 32 nt, Human
ucauccuccuacccuguacucccaccaaacca

SEQ ID NO: 230190 - RNA, 18 nt, Human
ucauccuccucuuugcca

SEQ ID NO: 230191 - RNA, 32 nt, Human
ucauccucgccaggagcuugugggccgucccu

SEQ ID NO: 230192 - RNA, 32 nt, Human
ucauccucguuggcuucucugccuucccccac

SEQ ID NO: 230193 - RNA, 32 nt, Human
ucauccucucuucuggcauccauguuuucugc

SEQ ID NO: 230194 - RNA, 32 nt, Human
ucauccucuggaccauggagacuagcucagaa

SEQ ID NO: 230195 - RNA, 31 nt, Human
ucauccucuuuuucugggccccugugucucg

SEQ ID NO: 230196 - RNA, 32 nt, Human
ucauccugaaguagcuggauugauagaaugac

SEQ ID NO: 230197 - RNA, 32 nt, Human
ucauccugagauacuucuaauuucauuguaua

SEQ ID NO: 230198 - RNA, 32 nt, Human
ucauccugaucuaaccauuccccagucauccc

SEQ ID NO: 230199 - RNA, 32 nt, Human
ucauccugccaaacuccaggcucagaugaugu

SEQ ID NO: 230200 - RNA, 32 nt, Human
ucauccugccaaacuccaggcucagaugucac

SEQ ID NO: 230201 - RNA, 32 nt, Human
ucauccugccaaacuccaggcucagauugucu

SEQ ID NO: 230202 - RNA, 32 nt, Human
ucauccugcccagcccugccuccuggccaugc

SEQ ID NO: 230203 - RNA, 21 nt, Human
ucauccugcccaucucuggua

SEQ ID NO: 230204 - RNA, 21 nt, Human
ucauccugcggggcuggcugg

SEQ ID NO: 230205 - RNA, 32 nt, Human
ucauccugcuccacccucccacuccuuggauu

SEQ ID NO: 230206 - RNA, 32 nt, Human
ucauccugcugcccuccuccagugcuggggcu

SEQ ID NO: 230207 - RNA, 32 nt, Human
ucauccugcugucaccaacuagcucuguggcc

SEQ ID NO: 230208 - RNA, 32 nt, Human
ucauccugcuucucuuuuccucgcagaugaua

SEQ ID NO: 230209 - RNA, 32 nt, Human
ucauccuggagcagcaccucacccucacuugc

SEQ ID NO: 230210 - RNA, 32 nt, Human
ucauccuggaguaccuuccuggaccacucucu

SEQ ID NO: 230211 - RNA, 32 nt, Human
ucauccuggcuggagugugauggugcgaucuu

SEQ ID NO: 230212 - RNA, 32 nt, Human
ucauccugggagcaacugggaggcagagcacc

SEQ ID NO: 230213 - RNA, 32 nt, Human
ucauccugggcagagguugccuaguugguaua

SEQ ID NO: 230214 - RNA, 32 nt, Human
ucauccugggcccuggccgaugugcauaucaa

SEQ ID NO: 230215 - RNA, 32 nt, Human
ucauccugggcuuuuccuacugugucuuguua

SEQ ID NO: 230216 - RNA, 32 nt, Human
ucauccuggggcucugcacagagcagcagagc

SEQ ID NO: 230217 - RNA, 21 nt, Human
ucauccugguaaaucccagug

SEQ ID NO: 230218 - RNA, 32 nt, Human
ucauccugugccucauccuccuaaccauugag

SEQ ID NO: 230219 - RNA, 32 nt, Human
ucauccuuaacuuugugcuagagcgagaccca

SEQ ID NO: 230220 - RNA, 32 nt, Human
ucauccuuacuagcuccugccugcuagcagaa

SEQ ID NO: 230221 - RNA, 32 nt, Human
ucauccuucuaaagugcugggauuacaggugu

SEQ ID NO: 230222 - RNA, 32 nt, Human
ucauccuucuucucuguguuuucugguuuaaa

SEQ ID NO: 230223 - RNA, 32 nt, Human
ucauccuugcaaccccauucaccaggagccuu

SEQ ID NO: 230224 - RNA, 32 nt, Human
ucauccuuuccccagcccucuucagcccuccc

SEQ ID NO: 230225 - RNA, 32 nt, Human
ucaucgacuuccucaucgacacuuacuccagu

SEQ ID NO: 230226 - RNA, 32 nt, Human
ucaucgagaucuuguuaaaauguagauccugg

SEQ ID NO: 230227 - RNA, 32 nt, Human
ucaucgagcaccuucgcucccacccgggggag

SEQ ID NO: 230228 - RNA, 32 nt, Human
ucaucgaggagaacuugguagauggggagaaa

SEQ ID NO: 230229 - RNA, 32 nt, Human
ucaucgcaacaaacgcaacaguggcuuucaaa

SEQ ID NO: 230230 - RNA, 32 nt, Human
ucaucgcagcugucugaacucuugaucaucug

SEQ ID NO: 230231 - RNA, 32 nt, Human
ucaucgcuuaacaacaggaauauguucugaac

SEQ ID NO: 230232 - RNA, 32 nt, Human
ucaucggaggcugggccccugggaugggacca

SEQ ID NO: 230233 - RNA, 32 nt, Human
ucaucggugauaagcaaagccacacacaauau

SEQ ID NO: 230234 - RNA, 32 nt, Human
ucaucgguguggcagccaaucuguaccuggac

SEQ ID NO: 230235 - RNA, 32 nt, Human
ucaucguacuagggaggaagaagcgggugaga

SEQ ID NO: 230236 - RNA, 20 nt, Human
ucaucgucaucaucaucauc

SEQ ID NO: 230237 - RNA, 32 nt, Human
ucaucgucuccuccuacgccuuccgguaccac

SEQ ID NO: 230238 - RNA, 32 nt, Human
ucaucgugggagcagcccugccccacccucca

SEQ ID NO: 230239 - RNA, 32 nt, Human
ucaucgugggcguggcuccaggaggacuuccu

SEQ ID NO: 230240 - RNA, 32 nt, Human
ucaucguggguggcucauacguguaaucccag

SEQ ID NO: 230241 - RNA, 32 nt, Human
ucaucguguguauaccacauuugugccccacu

SEQ ID NO: 230242 - RNA, 32 nt, Human
ucaucguguuaaccaggauggucucgaucucc

SEQ ID NO: 230243 - RNA, 32 nt, Human
ucaucguguuagccaggauggucucgaucucc

SEQ ID NO: 230244 - RNA, 32 nt, Human
ucaucuaacgccccaaaccuucauuugggccu

SEQ ID NO: 230245 - RNA, 32 nt, Human
ucaucuaaguagcagugagcauugcacggaac

SEQ ID NO: 230246 - RNA, 32 nt, Human
ucaucuacauaaagccauuagauuguaauacg

SEQ ID NO: 230247 - RNA, 32 nt, Human
ucaucuaccugccaggccucaggcccaggacc

SEQ ID NO: 230248 - RNA, 32 nt, Human
ucaucuacuacaaagagacucuaaauggcaaa

SEQ ID NO: 230249 - RNA, 32 nt, Human
ucaucuacucacuguagugcccuccuugaaau

SEQ ID NO: 230250 - RNA, 32 nt, Human
ucaucuagacacguccaaaggagugcauggcc

SEQ ID NO: 230251 - RNA, 32 nt, Human
ucaucuagacacugcaaccucuugcucguauc

SEQ ID NO: 230252 - RNA, 32 nt, Human
ucaucuagcaccuucucuaccucccagggucu

SEQ ID NO: 230253 - RNA, 32 nt, Human
ucaucuagccaucugauaucuuccucauuuga

SEQ ID NO: 230254 - RNA, 32 nt, Human
ucaucuagccauggaguuuaccuucaccucca

SEQ ID NO: 230255 - RNA, 32 nt, Human
ucaucuagcuaaauuauauuucuuuauagaga

SEQ ID NO: 230256 - RNA, 32 nt, Human
ucaucuagcuaaauuguauuucuuuauagaga

SEQ ID NO: 230257 - RNA, 32 nt, Human
ucaucuaggagagaaacaauauaaaugugaug

SEQ ID NO: 230258 - RNA, 32 nt, Human
ucaucuaggcagggggagagccugggcugaac

SEQ ID NO: 230259 - RNA, 21 nt, Human
ucaucuaggcuggagugcaau

SEQ ID NO: 230260 - RNA, 22 nt, Human
ucaucuaggcuggagugcaaug

SEQ ID NO: 230261 - RNA, 32 nt, Human
ucaucuaggcuggagugcaaugguuugaucuc

SEQ ID NO: 230262 - RNA, 21 nt, Human
ucaucuaggcuggagugcagu

SEQ ID NO: 230263 - RNA, 22 nt, Human
ucaucuaggcuggagugcagug

SEQ ID NO: 230264 - RNA, 32 nt, Human
ucaucuaggcuggagugcaguggugugaucuc

SEQ ID NO: 230265 - RNA, 32 nt, Human
ucaucuaguagucggggagaucaagagaggua

SEQ ID NO: 230266 - RNA, 32 nt, Human
ucaucuauagaagugccuuccccuauguguau

SEQ ID NO: 230267 - RNA, 32 nt, Human
ucaucucaacaucggcuggugguugguagggg

SEQ ID NO: 230268 - RNA, 22 nt, Human
ucaucucaacguucaaccgggg

SEQ ID NO: 230269 - RNA, 32 nt, Human
ucaucucacgcagaggaugccaggcaggaaaa

SEQ ID NO: 230270 - RNA, 32 nt, Human
ucaucucacugcaaccuccaccucccagguuc

SEQ ID NO: 230271 - RNA, 32 nt, Human
ucaucucacuguaucccuccaggaguuccugg

SEQ ID NO: 230272 - RNA, 24 nt, Human
ucaucucacuugggggccugcaug

SEQ ID NO: 230273 - RNA, 32 nt, Human
ucaucucagccugagcccuggaggcugggccu

SEQ ID NO: 230274 - RNA, 32 nt, Human
ucaucucagcuacucaggaggcugaggcagga

SEQ ID NO: 230275 - RNA, 32 nt, Human
ucaucucaggagacaaggacugugccgagugu

SEQ ID NO: 230276 - RNA, 32 nt, Human
ucaucucaggcccuccccuugugccugauacc

SEQ ID NO: 230277 - RNA, 24 nt, Human
ucaucucaggcgggcuggccgggg

SEQ ID NO: 230278 - RNA, 32 nt, Human
ucaucucagggccacugcuccauugcucuggg

SEQ ID NO: 230279 - RNA, 32 nt, Human
ucaucucagugcaaccuccaccucucacguuc

SEQ ID NO: 230280 - RNA, 32 nt, Human
ucaucucaguggggucuugcucugucacccag

SEQ ID NO: 230281 - RNA, 32 nt, Human
ucaucucauuuaauccucccuuccucccuauu

SEQ ID NO: 230282 - RNA, 32 nt, Human
ucaucuccaaccacuugcccugccucaguuuc

SEQ ID NO: 230283 - RNA, 32 nt, Human
ucaucuccagaauuuguucucagucccaaacu

SEQ ID NO: 230284 - RNA, 32 nt, Human
ucaucucccaaagccccuuccucuuuggccuc

SEQ ID NO: 230285 - RNA, 32 nt, Human
ucaucucccaggagagucucguccaaaggagg

SEQ ID NO: 230286 - RNA, 32 nt, Human
ucaucuccccaaaggcggcagaugcuugauuc

SEQ ID NO: 230287 - RNA, 32 nt, Human
ucaucucccucacuuaagucucaggccuguca

SEQ ID NO: 230288 - RNA, 32 nt, Human
ucaucucccuccugcgaggagcugagccaguc

SEQ ID NO: 230289 - RNA, 21 nt, Human
ucaucuccuaaagauccugca

SEQ ID NO: 230290 - RNA, 32 nt, Human
ucaucuccuagacuguuucacccagaugcuag

SEQ ID NO: 230291 - RNA, 32 nt, Human
ucaucuccuccacuguuuccuuuucuaugucc

SEQ ID NO: 230292 - RNA, 32 nt, Human
ucaucuccugacaaaagaaugcaauuucaacu

SEQ ID NO: 230293 - RNA, 32 nt, Human
ucaucucuacccauccccugaugcccagguca

SEQ ID NO: 230294 - RNA, 32 nt, Human
ucaucucuagagaauuuuugcuucuuagcuau

SEQ ID NO: 230295 - RNA, 32 nt, Human
ucaucucucagguguugauuugcuucugauag

SEQ ID NO: 230296 - RNA, 32 nt, Human
ucaucucugagcucccugucacuggccuggac

SEQ ID NO: 230297 - RNA, 32 nt, Human
ucaucucugcaacuccuuccucccugggccuc

SEQ ID NO: 230298 - RNA, 32 nt, Human
ucaucucuggacguguagaccagauccagaag

SEQ ID NO: 230299 - RNA, 32 nt, Human
ucaucucuggacugcaacggucuucuugugcu

SEQ ID NO: 230300 - RNA, 32 nt, Human
ucaucucuggcauugcuuccucuccuuccuuc

SEQ ID NO: 230301 - RNA, 32 nt, Human
ucaucucuggugcagccccuguccucaccacu

SEQ ID NO: 230302 - RNA, 32 nt, Human
ucaucucuguauccucuacacacgaugcuugg

SEQ ID NO: 230303 - RNA, 32 nt, Human
ucaucucugucuuuaccagcaggcucuguauu

SEQ ID NO: 230304 - RNA, 32 nt, Human
ucaucugaaagccaagaaaagagcgacacaga

SEQ ID NO: 230305 - RNA, 32 nt, Human
ucaucugaacccaggagacagguugcagugag

SEQ ID NO: 230306 - RNA, 32 nt, Human
ucaucugacaaagggcuaauauacagaaucua

SEQ ID NO: 230307 - RNA, 32 nt, Human
ucaucugacauaggggaagaagacuuacauag

SEQ ID NO: 230308 - RNA, 32 nt, Human
ucaucugaccucaguuccucuccaugugggcu

SEQ ID NO: 230309 - RNA, 21 nt, Human
ucaucugacuagcucucaaca

SEQ ID NO: 230310 - RNA, 32 nt, Human
ucaucugacugaugaaaaagaggaaagaauaa

SEQ ID NO: 230311 - RNA, 22 nt, Human
ucaucugacuucugaucaagca

SEQ ID NO: 230312 - RNA, 32 nt, Human
ucaucugagccucaggagguugaggcugcagu

SEQ ID NO: 230313 - RNA, 32 nt, Human
ucaucugagcuggaugcaguggcuuguuccua

SEQ ID NO: 230314 - RNA, 32 nt, Human
ucaucugaggucaggaguucgagcccagccca

SEQ ID NO: 230315 - RNA, 32 nt, Human
ucaucugcagagcccuggaggaggcccaccua

SEQ ID NO: 230316 - RNA, 32 nt, Human
ucaucugccaaaaauagagaacuuaugaucua

SEQ ID NO: 230317 - RNA, 32 nt, Human
ucaucugccucucucugagcaggaagccccuc

SEQ ID NO: 230318 - RNA, 32 nt, Human
ucaucugccuggggacauuccucauuggcuuc

SEQ ID NO: 230319 - RNA, 22 nt, Human
ucaucugcucagaggagaacgg

SEQ ID NO: 230320 - RNA, 23 nt, Human
ucaucugcucaguacaucugcgg

SEQ ID NO: 230321 - RNA, 32 nt, Human
ucaucugcuugaaucacuaacuugucuccacu

SEQ ID NO: 230322 - RNA, 32 nt, Human
ucaucuggaaggagggaggcuuggaugagcag

SEQ ID NO: 230323 - RNA, 32 nt, Human
ucaucuggagaccccauggagggacuuggaaa

SEQ ID NO: 230324 - RNA, 32 nt, Human
ucaucuggagagaggcaagaacagggcagcuu

SEQ ID NO: 230325 - RNA, 32 nt, Human
ucaucugggcugcagugcagugguguaaucac

SEQ ID NO: 230326 - RNA, 32 nt, Human
ucaucugggugaguuagugccagauggaauuu

SEQ ID NO: 230327 - RNA, 32 nt, Human
ucaucuggucugggugaccuccgagacuggcc

SEQ ID NO: 230328 - RNA, 32 nt, Human
ucaucuggucuugcccucaagcaacaauugcu

SEQ ID NO: 230329 - RNA, 32 nt, Human
ucaucugguggagcaggaagugcaggcagagu

SEQ ID NO: 230330 - RNA, 20 nt, Human
ucaucuguaaaugucagugu

SEQ ID NO: 230331 - RNA, 32 nt, Human
ucaucuguagccugaaaagccugaauccagcu

SEQ ID NO: 230332 - RNA, 32 nt, Human
ucaucugucacccaggcuggagugcaauggca

SEQ ID NO: 230333 - RNA, 32 nt, Human
ucaucugucacccaggcuggagugcaguagug

SEQ ID NO: 230334 - RNA, 21 nt, Human
ucaucugucagauccagugua

SEQ ID NO: 230335 - RNA, 32 nt, Human
ucaucuguggccacugccuucuagccguccuc

SEQ ID NO: 230336 - RNA, 32 nt, Human
ucaucuguggccaggcacgccuguaaucccag

SEQ ID NO: 230337 - RNA, 32 nt, Human
ucaucugugguucaccuguagacagagagcag

SEQ ID NO: 230338 - RNA, 32 nt, Human
ucaucuguguacacuccagcuguuugaagaga

SEQ ID NO: 230339 - RNA, 32 nt, Human
ucaucuguguacugaaccacuagccuaauaga

SEQ ID NO: 230340 - RNA, 23 nt, Human
ucaucuguguagaugccacugua

SEQ ID NO: 230341 - RNA, 32 nt, Human
ucaucugugugugacagaagagauuuuaaaaa

SEQ ID NO: 230342 - RNA, 32 nt, Human
ucaucuguguguguuuucuggauuuucucucu

SEQ ID NO: 230343 - RNA, 32 nt, Human
ucaucuguguuuugugguuggagagaaacugg

SEQ ID NO: 230344 - RNA, 23 nt, Human
ucaucuguuaggaagccauucua

SEQ ID NO: 230345 - RNA, 25 nt, Human
ucaucuguuuacucugcucagugua

SEQ ID NO: 230346 - RNA, 32 nt, Human
ucaucuguuuguucugaaaaugcagcugcugu

SEQ ID NO: 230347 - RNA, 32 nt, Human
ucaucuuacauuucucacccuacucuggaugg

SEQ ID NO: 230348 - RNA, 32 nt, Human
ucaucuuaccuguaauccuagcacuuugagac

SEQ ID NO: 230349 - RNA, 32 nt, Human
ucaucuuagcauugggcagacaccagggcaac

SEQ ID NO: 230350 - RNA, 32 nt, Human
ucaucuuagcucaggcugcuguaacaggguaa

SEQ ID NO: 230351 - RNA, 32 nt, Human
ucaucuuaggagugcuugcucugagugaggcu

SEQ ID NO: 230352 - RNA, 32 nt, Human
ucaucuuaugcaaaacacaggugaauucauac

SEQ ID NO: 230353 - RNA, 32 nt, Human
ucaucuucaaaaaggaaagauuuggaauuuua

SEQ ID NO: 230354 - RNA, 32 nt, Human
ucaucuucaagcacgccaacuucaggcagugu

SEQ ID NO: 230355 - RNA, 32 nt, Human
ucaucuucacugcacccuggauuugcauacau

SEQ ID NO: 230356 - RNA, 32 nt, Human
ucaucuucacugcauagccucaggcuagugag

SEQ ID NO: 230357 - RNA, 32 nt, Human
ucaucuucaguauuuucugucauuugcaaaag

SEQ ID NO: 230358 - RNA, 32 nt, Human
ucaucuucccaauguugcuguaucuaagaggc

SEQ ID NO: 230359 - RNA, 32 nt, Human
ucaucuucccagguagcugggauuacaggcau

SEQ ID NO: 230360 - RNA, 22 nt, Human
ucaucuuccccacacauaauca

SEQ ID NO: 230361 - RNA, 32 nt, Human
ucaucuuccccgagaaagggugcaguggccuc

SEQ ID NO: 230362 - RNA, 32 nt, Human
ucaucuuccucaagaucuuuguuuccacaaac

SEQ ID NO: 230363 - RNA, 32 nt, Human
ucaucuucugccacagucucucagauagcuca

SEQ ID NO: 230364 - RNA, 32 nt, Human
ucaucuucugccucccuuccuacuccuuuugg

SEQ ID NO: 230365 - RNA, 32 nt, Human
ucaucuucuguaacaauucucuuuuccaccuc

SEQ ID NO: 230366 - RNA, 32 nt, Human
ucaucuucuuccugcuccuccaccuccuccuc

SEQ ID NO: 230367 - RNA, 32 nt, Human
ucaucuucuuggugucucauguccucauucuc

SEQ ID NO: 230368 - RNA, 32 nt, Human
ucaucuucuuuccucuuucuucccacauuucu

SEQ ID NO: 230369 - RNA, 32 nt, Human
ucaucuucuuucucaaaacuaguuuuugaugc

SEQ ID NO: 230370 - RNA, 27 nt, Human
ucaucuugaugaugaucgucaucauca

SEQ ID NO: 230371 - RNA, 32 nt, Human
ucaucuugcagcagcaccgcacccucacuagc

SEQ ID NO: 230372 - RNA, 32 nt, Human
ucaucuugcaggcuggaagcaccagggaauua

SEQ ID NO: 230373 - RNA, 32 nt, Human
ucaucuugcuuaauaaauaucugcuggauucu

SEQ ID NO: 230374 - RNA, 32 nt, Human
ucaucuugcuuuccuuaaucaucgauccugga

SEQ ID NO: 230375 - RNA, 32 nt, Human
ucaucuuggagcugcuccaccuuagagggccg

SEQ ID NO: 230376 - RNA, 32 nt, Human
ucaucuuguauuguuccauggacauuaaauga

SEQ ID NO: 230377 - RNA, 32 nt, Human
ucaucuuguucccagucugucugucuguccau

SEQ ID NO: 230378 - RNA, 32 nt, Human
ucaucuuuaaacugaggccuucagggaagcuu

SEQ ID NO: 230379 - RNA, 22 nt, Human
ucaucuuuacucucagugaauu

SEQ ID NO: 230380 - RNA, 32 nt, Human
ucaucuuucccaagcauugaucugcccguuuc

SEQ ID NO: 230381 - RNA, 20 nt, Human
ucaucuuuccuuucuuggua

SEQ ID NO: 230382 - RNA, 19 nt, Human
ucaucuuuggaaugggaga

SEQ ID NO: 230383 - RNA, 32 nt, Human
ucaucuuugguuuacuaaauuuacuuagaaau

SEQ ID NO: 230384 - RNA, 32 nt, Human
ucaucuuugugucugcagagcucuggcacucg

SEQ ID NO: 230385 - RNA, 32 nt, Human
ucaucuuuuucuuccuccuaccuucuguuuuu

SEQ ID NO: 230386 - RNA, 32 nt, Human
ucaugaaaacagccccuuuaccugccaagaca

SEQ ID NO: 230387 - RNA, 32 nt, Human
ucaugaaaaguauguuguuguuuugauaguaa

SEQ ID NO: 230388 - RNA, 32 nt, Human
ucaugaaaaugucuauucaaaauaucaaaacc

SEQ ID NO: 230389 - RNA, 32 nt, Human
ucaugaaaccaaucuucagaugcucuguaaac

SEQ ID NO: 230390 - RNA, 32 nt, Human
ucaugaacaagaaaauugcuuaaccauuugau

SEQ ID NO: 230391 - RNA, 32 nt, Human
ucaugaacauggucagaaccuuuggacaagag

SEQ ID NO: 230392 - RNA, 32 nt, Human
ucaugaaccagcccuuucucagagccagugau

SEQ ID NO: 230393 - RNA, 32 nt, Human
ucaugaacccaggaggcagagguugcagugag

SEQ ID NO: 230394 - RNA, 32 nt, Human
ucaugaaccccugguagcugaauagcagcuug

SEQ ID NO: 230395 - RNA, 32 nt, Human
ucaugaaccugggcuggagcuuggggaccccu

SEQ ID NO: 230396 - RNA, 32 nt, Human
ucaugaacuggcagccauguggaaagaagacu

SEQ ID NO: 230397 - RNA, 23 nt, Human
ucaugaagaauacugcaagugaa

SEQ ID NO: 230398 - RNA, 31 nt, Human
ucaugaagauauacauuacauuugaaaaacu

SEQ ID NO: 230399 - RNA, 32 nt, Human
ucaugaagcccacuccuguccucugcccuacc

SEQ ID NO: 230400 - RNA, 31 nt, Human
ucaugaagcuauacauuacauuugaaaaacu

SEQ ID NO: 230401 - RNA, 27 nt, Human
ucaugaagcuguuccagcgcuccacgc

SEQ ID NO: 230402 - RNA, 32 nt, Human
ucaugaaggaagaggcaggccacgcaacacuu

SEQ ID NO: 230403 - RNA, 27 nt, Human
ucaugaaggccacuaucauccuccuuc

SEQ ID NO: 230404 - RNA, 32 nt, Human
ucaugaaucugcaaugugggcagagauuggaa

SEQ ID NO: 230405 - RNA, 32 nt, Human
ucaugaauguacaaaguagacuuucuuacaau

SEQ ID NO: 230406 - RNA, 22 nt, Human
ucaugaauguggccauggcccc

SEQ ID NO: 230407 - RNA, 32 nt, Human
ucaugaauuuacccacacaggugugauccucc

SEQ ID NO: 230408 - RNA, 32 nt, Human
ucaugacaauuuaggaacgaaugaccucacug

SEQ ID NO: 230409 - RNA, 32 nt, Human
ucaugacacagcccugauguuguaccggcuag

SEQ ID NO: 230410 - RNA, 32 nt, Human
ucaugacacugcacuccagccugggcaacaga

SEQ ID NO: 230411 - RNA, 32 nt, Human
ucaugacacugcacuccagccugggugauaga

SEQ ID NO: 230412 - RNA, 32 nt, Human
ucaugacacugcacuccagccuuggcaacaaa

SEQ ID NO: 230413 - RNA, 32 nt, Human
ucaugacacugcacuccagccuuggcaacaga

SEQ ID NO: 230414 - RNA, 32 nt, Human
ucaugacacugcccuccagccuggacaacaga

SEQ ID NO: 230415 - RNA, 27 nt, Human
ucaugacagauguuccggcuacauuua

SEQ ID NO: 230416 - RNA, 32 nt, Human
ucaugacagucuaugugagagaauguccauuu

SEQ ID NO: 230417 - RNA, 32 nt, Human
ucaugacauacugaagcuccagccagggggau

SEQ ID NO: 230418 - RNA, 32 nt, Human
ucaugacaucaaaacaccagcuuuucaccuuu

SEQ ID NO: 230419 - RNA, 27 nt, Human
ucaugacaucacaaccuguucccaaug

SEQ ID NO: 230420 - RNA, 32 nt, Human
ucaugacaugucgggcgaugcuuggaaaagcc

SEQ ID NO: 230421 - RNA, 32 nt, Human
ucaugaccauccuggccaacacagugaaaccu

SEQ ID NO: 230422 - RNA, 32 nt, Human
ucaugacccacguccaagucacccugcacauc

SEQ ID NO: 230423 - RNA, 32 nt, Human
ucaugacccgccuggccaacauggugaaaccc

SEQ ID NO: 230424 - RNA, 32 nt, Human
ucaugaccucaagugauccgcccacuucgguc

SEQ ID NO: 230425 - RNA, 24 nt, Human
ucaugaccucaagugaucugcuca

SEQ ID NO: 230426 - RNA, 32 nt, Human
ucaugaccucaagugaucugcucaccuuggcc

SEQ ID NO: 230427 - RNA, 32 nt, Human
ucaugaccuccagggagccuagaagcuggugg

SEQ ID NO: 230428 - RNA, 32 nt, Human
ucaugacgcucauggaaccucuuucuuugauc

SEQ ID NO: 230429 - RNA, 32 nt, Human
ucaugacggaagaagagagugagccgcaauug

SEQ ID NO: 230430 - RNA, 32 nt, Human
ucaugacuauaaucccagcuguuugagaggcc

SEQ ID NO: 230431 - RNA, 32 nt, Human
ucaugacucacugcagccucaaacuccugggu

SEQ ID NO: 230432 - RNA, 32 nt, Human
ucaugacucccagagaggauggcaucuagaag

SEQ ID NO: 230433 - RNA, 32 nt, Human
ucaugacugcacuuuggagacugaagcaucuc

SEQ ID NO: 230434 - RNA, 32 nt, Human
ucaugacuguaaucccaacacuuuggaggagg

SEQ ID NO: 230435 - RNA, 24 nt, Human
ucaugacuguaaucccagcacuuu

SEQ ID NO: 230436 - RNA, 32 nt, Human
ucaugacuguaaucccagcacuuugggaggcc

SEQ ID NO: 230437 - RNA, 32 nt, Human
ucaugacuguaaucccaguacuuugggaagcc

SEQ ID NO: 230438 - RNA, 32 nt, Human
ucaugacuguaauccuaguacuuuggaaggcu

SEQ ID NO: 230439 - RNA, 32 nt, Human
ucaugacuucacccucuacucuuccaaccaau

SEQ ID NO: 230440 - RNA, 32 nt, Human
ucaugacuuuauuuucuugucuucuuguauug

SEQ ID NO: 230441 - RNA, 32 nt, Human
ucaugagaaaugucuaaucccaugggaaaacc

SEQ ID NO: 230442 - RNA, 32 nt, Human
ucaugagaagagcuuggauacagugaguuugc

SEQ ID NO: 230443 - RNA, 32 nt, Human
ucaugagacaauacaggcaucacuggcagagg

SEQ ID NO: 230444 - RNA, 32 nt, Human
ucaugagagguuuccauguaacaagccugccu

SEQ ID NO: 230445 - RNA, 32 nt, Human
ucaugagaguggaggccugccacccagaaagg

SEQ ID NO: 230446 - RNA, 32 nt, Human
ucaugagaucaaucacuuguaugucucacgca

SEQ ID NO: 230447 - RNA, 32 nt, Human
ucaugagcaccguccccacccccagguggauc

SEQ ID NO: 230448 - RNA, 22 nt, Human
ucaugagcaggcacugccguca

SEQ ID NO: 230449 - RNA, 32 nt, Human
ucaugagcauuuguuuaauaagcauaccauug

SEQ ID NO: 230450 - RNA, 32 nt, Human
ucaugagccaucagcuccucuggggccagcua

SEQ ID NO: 230451 - RNA, 32 nt, Human
ucaugagcccaggagcuccugcuacauaaaac

SEQ ID NO: 230452 - RNA, 23 nt, Human
ucaugagccuaaggaccauucua

SEQ ID NO: 230453 - RNA, 32 nt, Human
ucaugagcuccaacacauucuucagugcaauc

SEQ ID NO: 230454 - RNA, 32 nt, Human
ucaugagcuggguggggcaugcagggaaggag

SEQ ID NO: 230455 - RNA, 32 nt, Human
ucaugagcuuugcugaucucuuugccaucucu

SEQ ID NO: 230456 - RNA, 32 nt, Human
ucaugaggaaggaaaguugaugaacuaguacg

SEQ ID NO: 230457 - RNA, 32 nt, Human
ucaugaggacagugauguguguucugaaauug

SEQ ID NO: 230458 - RNA, 32 nt, Human
ucaugaggccaucagucauacuggauuaggga

SEQ ID NO: 230459 - RNA, 32 nt, Human
ucaugaggcccagaugugggcaggcagcccgg

SEQ ID NO: 230460 - RNA, 32 nt, Human
ucaugaggcugaggcaggagaauggcgugaac

SEQ ID NO: 230461 - RNA, 18 nt, Human
ucaugaggcuucuagcca

SEQ ID NO: 230462 - RNA, 32 nt, Human
ucaugagggaaagggaagguuaguagcagaac

SEQ ID NO: 230463 - RNA, 32 nt, Human
ucaugagggcacugacgcugaauggugcagug

SEQ ID NO: 230464 - RNA, 32 nt, Human
ucaugagggcuccaauuucuccaccuccuuag

SEQ ID NO: 230465 - RNA, 24 nt, Human
ucaugagggggcgggccgagcggg

SEQ ID NO: 230466 - RNA, 32 nt, Human
ucaugagggugaaaggaggaugagagacguga

SEQ ID NO: 230467 - RNA, 31 nt, Human
ucaugaggguugugccuucagaugcucagca

SEQ ID NO: 230468 - RNA, 32 nt, Human
ucaugagguacccuuugugucaccagcucaag

SEQ ID NO: 230469 - RNA, 32 nt, Human
ucaugaggucaugguaccauauaugggauuuu

SEQ ID NO: 230470 - RNA, 32 nt, Human
ucaugaggucuggcucaugccuguaaucccag

SEQ ID NO: 230471 - RNA, 21 nt, Human
ucaugaggugggauggcccca

SEQ ID NO: 230472 - RNA, 32 nt, Human
ucaugaguaagaagauucaccaucccauguga

SEQ ID NO: 230473 - RNA, 32 nt, Human
ucaugaguacuugccuuuuaacuuucccccac

SEQ ID NO: 230474 - RNA, 32 nt, Human
ucaugagugugguccguaucuugguuuggaau

SEQ ID NO: 230475 - RNA, 32 nt, Human
ucaugaguuccaaguugaaacaugguugugca

SEQ ID NO: 230476 - RNA, 32 nt, Human
ucaugaguucccccaacuggagugcagacaag

SEQ ID NO: 230477 - RNA, 32 nt, Human
ucaugaguuugcuuuggacaccccaaauucua

SEQ ID NO: 230478 - RNA, 32 nt, Human
ucaugauaaagugaaauugagucagaacaaga

SEQ ID NO: 230479 - RNA, 32 nt, Human
ucaugauaguuuuugcagaugaaaaucacuuc

SEQ ID NO: 230480 - RNA, 32 nt, Human
ucaugaucauuucccuaagccauuuccagaau

SEQ ID NO: 230481 - RNA, 32 nt, Human
ucaugaucuuaagcuuccugagguugcaccag

SEQ ID NO: 230482 - RNA, 32 nt, Human
ucaugaucuuuuucuuuccuucccaagaaacu

SEQ ID NO: 230483 - RNA, 32 nt, Human
ucaugaugaaaccaagugguggccggaucagu

SEQ ID NO: 230484 - RNA, 32 nt, Human
ucaugaugauaaucauagcagcacuuuucaca

SEQ ID NO: 230485 - RNA, 32 nt, Human
ucaugaugcaggaaucugcgacagagacaaua

SEQ ID NO: 230486 - RNA, 32 nt, Human
ucaugaugcuucuagcauuggaaauccuccag

SEQ ID NO: 230487 - RNA, 32 nt, Human
ucaugauggagacaguaaccaagguaauguuc

SEQ ID NO: 230488 - RNA, 32 nt, Human
ucaugauggagacaguaaccaagguaauguuu

SEQ ID NO: 230489 - RNA, 23 nt, Human
ucaugauggguggcagagcaaga

SEQ ID NO: 230490 - RNA, 32 nt, Human
ucaugaugguuuggagauacugucuguggaug

SEQ ID NO: 230491 - RNA, 32 nt, Human
ucaugauguuaagaaaaugcaggcaguauccc

SEQ ID NO: 230492 - RNA, 32 nt, Human
ucaugauuacagucuagaguuacuugaaaugg

SEQ ID NO: 230493 - RNA, 32 nt, Human
ucaugauuacuuuaagcccacauccacugagu

SEQ ID NO: 230494 - RNA, 32 nt, Human
ucaugauuauaaucaaccacacuuauugauuu

SEQ ID NO: 230495 - RNA, 32 nt, Human
ucaugauucuucagaucaucacaccuuuaaaa

SEQ ID NO: 230496 - RNA, 27 nt, Human
ucaugcaaaaacugcaacucuguguuu

SEQ ID NO: 230497 - RNA, 32 nt, Human
ucaugcaaaaugucuccugaaauaagggaaaa

SEQ ID NO: 230498 - RNA, 32 nt, Human
ucaugcaaauucuauauuuuacauucuuggaa

SEQ ID NO: 230499 - RNA, 21 nt, Human
ucaugcaaucuuccugccuca

SEQ ID NO: 230500 - RNA, 32 nt, Human
ucaugcaauugcacuccagccugggcaacaag

SEQ ID NO: 230501 - RNA, 32 nt, Human
ucaugcacacaaaauuagcugggcaugguggc

SEQ ID NO: 230502 - RNA, 32 nt, Human
ucaugcacagcccccagaugccagggaagagg

SEQ ID NO: 230503 - RNA, 32 nt, Human
ucaugcacauggucaguacucaauaaauauuu

SEQ ID NO: 230504 - RNA, 32 nt, Human
ucaugcaccaacccauacagaguaaaucuuuu

SEQ ID NO: 230505 - RNA, 32 nt, Human
ucaugcaccacuugaaguugaguuccagaaag

SEQ ID NO: 230506 - RNA, 21 nt, Human
ucaugcaccgacccaacccag

SEQ ID NO: 230507 - RNA, 32 nt, Human
ucaugcacguucccccugggccauucucugau

SEQ ID NO: 230508 - RNA, 32 nt, Human
ucaugcacuccaggaggggcacuuagcagccu

SEQ ID NO: 230509 - RNA, 22 nt, Human
ucaugcagacuggagugcagug

SEQ ID NO: 230510 - RNA, 32 nt, Human
ucaugcagcugcuuccuguaacgcaggacucc

SEQ ID NO: 230511 - RNA, 21 nt, Human
ucaugcagcuggacuacagca

SEQ ID NO: 230512 - RNA, 32 nt, Human
ucaugcagcuuucaguggacauggugagaugg

SEQ ID NO: 230513 - RNA, 32 nt, Human
ucaugcagcuuugggaccaucaguuuuauacu

SEQ ID NO: 230514 - RNA, 32 nt, Human
ucaugcaggagagaaaugucacaagugugaug

SEQ ID NO: 230515 - RNA, 32 nt, Human
ucaugcaggaggaucacuugagcccaggaguu

SEQ ID NO: 230516 - RNA, 32 nt, Human
ucaugcaggccugucugugugauugucaggga

SEQ ID NO: 230517 - RNA, 27 nt, Human
ucaugcaggcuggagugaagucgugug

SEQ ID NO: 230518 - RNA, 32 nt, Human
ucaugcaggcuggagugcgguggugcgaucau

SEQ ID NO: 230519 - RNA, 32 nt, Human
ucaugcagggagagcugugcuccugggugcug

SEQ ID NO: 230520 - RNA, 32 nt, Human
ucaugcagucacaggaaugacaaucauucaac

SEQ ID NO: 230521 - RNA, 32 nt, Human
ucaugcagugagccagccuggccgcuccaccc

SEQ ID NO: 230522 - RNA, 32 nt, Human
ucaugcagugaguggguggggugcaggagaca

SEQ ID NO: 230523 - RNA, 32 nt, Human
ucaugcaugagacagugaaggaccuggcuccg

SEQ ID NO: 230524 - RNA, 32 nt, Human
ucaugcauguaaucccagcacuuugggaggcc

SEQ ID NO: 230525 - RNA, 32 nt, Human
ucaugcaugucuguuuacuuuagugacguucc

SEQ ID NO: 230526 - RNA, 32 nt, Human
ucaugcauucucugcaggaagaaaguuugaug

SEQ ID NO: 230527 - RNA, 32 nt, Human
ucaugcauuuccacauauccacaaacacagaa

SEQ ID NO: 230528 - RNA, 32 nt, Human
ucaugccaacagcuuggaagcugcaguaauua

SEQ ID NO: 230529 - RNA, 32 nt, Human
ucaugccaacuugaaaacucuccaguuuguag

SEQ ID NO: 230530 - RNA, 32 nt, Human
ucaugccaagagucagugccaucugauuggcu

SEQ ID NO: 230531 - RNA, 32 nt, Human
ucaugccaauuuucacaucuuccacaaacucc

SEQ ID NO: 230532 - RNA, 32 nt, Human
ucaugccacaccguacuccagccugggcgaca

SEQ ID NO: 230533 - RNA, 32 nt, Human
ucaugccacaggaucccagcacuuugggaggc

SEQ ID NO: 230534 - RNA, 32 nt, Human
ucaugccacaucacuccaaccugggcaacaga

SEQ ID NO: 230535 - RNA, 32 nt, Human
ucaugccacaucacuccagccugggcaacaga

SEQ ID NO: 230536 - RNA, 32 nt, Human
ucaugccaccgcacuccagccugggcaacaga

SEQ ID NO: 230537 - RNA, 32 nt, Human
ucaugccaccgcacuucagccugggugacaga

SEQ ID NO: 230538 - RNA, 32 nt, Human
ucaugccaccgcacuuccagccugggugacag

SEQ ID NO: 230539 - RNA, 32 nt, Human
ucaugccacuacacuccagccuggcgacagag

SEQ ID NO: 230540 - RNA, 32 nt, Human
ucaugccacuccacuccagucugggcgacaga

SEQ ID NO: 230541 - RNA, 32 nt, Human
ucaugccacugaacuccagccugggcaacaga

SEQ ID NO: 230542 - RNA, 32 nt, Human
ucaugccacugaacuccagccugggcaacagg

SEQ ID NO: 230543 - RNA, 32 nt, Human
ucaugccacugaacuccagccugggugacaga

SEQ ID NO: 230544 - RNA, 32 nt, Human
ucaugccacugcaaucuagccugggugacaga

SEQ ID NO: 230545 - RNA, 32 nt, Human
ucaugccacugcacccaucuugggcaacagaa

SEQ ID NO: 230546 - RNA, 32 nt, Human
ucaugccacugcaccccagcaccuggcuacag

SEQ ID NO: 230547 - RNA, 32 nt, Human
ucaugccacugcaccccagccugggcaacaga

SEQ ID NO: 230548 - RNA, 32 nt, Human
ucaugccacugcacccuagcuuggguggcaaa

SEQ ID NO: 230549 - RNA, 32 nt, Human
ucaugccacugcacccuagcuuggguggcaga

SEQ ID NO: 230550 - RNA, 32 nt, Human
ucaugccacugcacuagagccugggcaacaga

SEQ ID NO: 230551 - RNA, 32 nt, Human
ucaugccacugcacucaaaccuggcggacaga

SEQ ID NO: 230552 - RNA, 32 nt, Human
ucaugccacugcacuccaaccugggcaacaga

SEQ ID NO: 230553 - RNA, 32 nt, Human
ucaugccacugcacuccaaccugggcagcaga

SEQ ID NO: 230554 - RNA, 32 nt, Human
ucaugccacugcacuccaaccugggcgacaga

SEQ ID NO: 230555 - RNA, 32 nt, Human
ucaugccacugcacuccaaccugggugacaga

SEQ ID NO: 230556 - RNA, 32 nt, Human
ucaugccacugcacuccacucugggcaacaga

SEQ ID NO: 230557 - RNA, 32 nt, Human
ucaugccacugcacuccagcaugcaugacaga

SEQ ID NO: 230558 - RNA, 32 nt, Human
ucaugccacugcacuccagcaugggugaugga

SEQ ID NO: 230559 - RNA, 32 nt, Human
ucaugccacugcacuccagcccaggugacaga

SEQ ID NO: 230560 - RNA, 32 nt, Human
ucaugccacugcacuccagccuaugugacuag

SEQ ID NO: 230561 - RNA, 32 nt, Human
ucaugccacugcacuccagccugagugacaga

SEQ ID NO: 230562 - RNA, 32 nt, Human
ucaugccacugcacuccagccuggacaacaga

SEQ ID NO: 230563 - RNA, 32 nt, Human
ucaugccacugcacuccagccuggaugacaga

SEQ ID NO: 230564 - RNA, 32 nt, Human
ucaugccacugcacuccagccuggaugacagc

SEQ ID NO: 230565 - RNA, 32 nt, Human
ucaugccacugcacuccagccuggccugggca

SEQ ID NO: 230566 - RNA, 32 nt, Human
ucaugccacugcacuccagccugggagacaga

SEQ ID NO: 230567 - RNA, 32 nt, Human
ucaugccacugcacuccagccugggcaacaaa

SEQ ID NO: 230568 - RNA, 32 nt, Human
ucaugccacugcacuccagccugggcaacaag

SEQ ID NO: 230569 - RNA, 32 nt, Human
ucaugccacugcacuccagccugggcaacaca

SEQ ID NO: 230570 - RNA, 32 nt, Human
ucaugccacugcacuccagccugggcaacaga

SEQ ID NO: 230571 - RNA, 32 nt, Human
ucaugccacugcacuccagccugggcaacagc

SEQ ID NO: 230572 - RNA, 32 nt, Human
ucaugccacugcacuccagccugggcaaccag

SEQ ID NO: 230573 - RNA, 32 nt, Human
ucaugccacugcacuccagccugggcaaugga

SEQ ID NO: 230574 - RNA, 32 nt, Human
ucaugccacugcacuccagccugggcagcaga

SEQ ID NO: 230575 - RNA, 32 nt, Human
ucaugccacugcacuccagccugggcaugaga

SEQ ID NO: 230576 - RNA, 32 nt, Human
ucaugccacugcacuccagccugggccagaau

SEQ ID NO: 230577 - RNA, 32 nt, Human
ucaugccacugcacuccagccugggcgacaga

SEQ ID NO: 230578 - RNA, 32 nt, Human
ucaugccacugcacuccagccugggcgacgga

SEQ ID NO: 230579 - RNA, 32 nt, Human
ucaugccacugcacuccagccugggcgaugga

SEQ ID NO: 230580 - RNA, 32 nt, Human
ucaugccacugcacuccagccugggcggcaga

SEQ ID NO: 230581 - RNA, 32 nt, Human
ucaugccacugcacuccagccuggggcugaca

SEQ ID NO: 230582 - RNA, 32 nt, Human
ucaugccacugcacuccagccugggugacaga

SEQ ID NO: 230583 - RNA, 32 nt, Human
ucaugccacugcacuccagcuugggcgacaga

SEQ ID NO: 230584 - RNA, 32 nt, Human
ucaugccacugcacuccagcuugggugagagu

SEQ ID NO: 230585 - RNA, 32 nt, Human
ucaugccacugcacuccagucuggaugacaga

SEQ ID NO: 230586 - RNA, 32 nt, Human
ucaugccacugcacuccagucugggugacagc

SEQ ID NO: 230587 - RNA, 32 nt, Human
ucaugccacugcacuccauccugggcaacaag

SEQ ID NO: 230588 - RNA, 32 nt, Human
ucaugccacugcacuccauccugggugacagc

SEQ ID NO: 230589 - RNA, 32 nt, Human
ucaugccacugcacuccggccuaggugacaga

SEQ ID NO: 230590 - RNA, 32 nt, Human
ucaugccacugcacuccuccgugggugacaga

SEQ ID NO: 230591 - RNA, 32 nt, Human
ucaugccacugcacuccugccugggugacaaa

SEQ ID NO: 230592 - RNA, 32 nt, Human
ucaugccacugcacucuagccuaggcuacaga

SEQ ID NO: 230593 - RNA, 32 nt, Human
ucaugccacugcacucuagccugggugacaga

SEQ ID NO: 230594 - RNA, 32 nt, Human
ucaugccacugcacucugggcuggguaacaga

SEQ ID NO: 230595 - RNA, 32 nt, Human
ucaugccacugcacugcacuccagccugggug

SEQ ID NO: 230596 - RNA, 32 nt, Human
ucaugccacugcacugcagcccgggcgacaga

SEQ ID NO: 230597 - RNA, 32 nt, Human
ucaugccacugcacugcagccugggcgacaga

SEQ ID NO: 230598 - RNA, 32 nt, Human
ucaugccacugcacuuccagccugggugacac

SEQ ID NO: 230599 - RNA, 32 nt, Human
ucaugccacugcacuuccagccugggugacag

SEQ ID NO: 230600 - RNA, 32 nt, Human
ucaugccacugcacuuuagccugggcaacaga

SEQ ID NO: 230601 - RNA, 32 nt, Human
ucaugccacugcacuuuagccugggugacaga

SEQ ID NO: 230602 - RNA, 32 nt, Human
ucaugccacugcaugccagccugggcaacaga

SEQ ID NO: 230603 - RNA, 32 nt, Human
ucaugccacugcauuccagccugggcaacaga

SEQ ID NO: 230604 - RNA, 32 nt, Human
ucaugccacugcauuccagccugggcgacaga

SEQ ID NO: 230605 - RNA, 32 nt, Human
ucaugccacugcauuccagccugugugaugga

SEQ ID NO: 230606 - RNA, 32 nt, Human
ucaugccacugcauucuagccugggcaacaga

SEQ ID NO: 230607 - RNA, 32 nt, Human
ucaugccacugcauucuagcuuugauggcgaa

SEQ ID NO: 230608 - RNA, 32 nt, Human
ucaugccacuggacuccagccugggugaaaga

SEQ ID NO: 230609 - RNA, 32 nt, Human
ucaugccacuguacuccagccuaggugacaga

SEQ ID NO: 230610 - RNA, 32 nt, Human
ucaugccacuguacuccagccugggcgacagc

SEQ ID NO: 230611 - RNA, 32 nt, Human
ucaugccacuguacuccagccugggugacaga

SEQ ID NO: 230612 - RNA, 32 nt, Human
ucaugccagaagcggcuggacaguggcugccu

SEQ ID NO: 230613 - RNA, 32 nt, Human
ucaugccagauggggaaacugaggcucagaga

SEQ ID NO: 230614 - RNA, 24 nt, Human
ucaugccagcaauccuagcacuuu

SEQ ID NO: 230615 - RNA, 32 nt, Human
ucaugccagccuguccuucuggcuuccucugu

SEQ ID NO: 230616 - RNA, 32 nt, Human
ucaugccaggauacaugaggugcucuauagua

SEQ ID NO: 230617 - RNA, 32 nt, Human
ucaugccagggaaagagagauggaauucagaa

SEQ ID NO: 230618 - RNA, 32 nt, Human
ucaugccagggacugacaaaagacuugagaca

SEQ ID NO: 230619 - RNA, 24 nt, Human
ucaugccaguaaucccagcacuuu

SEQ ID NO: 230620 - RNA, 32 nt, Human
ucaugccaguaaucccagcacuuucggaggcc

SEQ ID NO: 230621 - RNA, 24 nt, Human
ucaugccagugauccgaguacuuu

SEQ ID NO: 230622 - RNA, 32 nt, Human
ucaugccagugcacuccagccugggcaacaga

SEQ ID NO: 230623 - RNA, 24 nt, Human
ucaugccaguuaucccagcacuuu

SEQ ID NO: 230624 - RNA, 32 nt, Human
ucaugccaguuaucccagcacuuugggaggcc

SEQ ID NO: 230625 - RNA, 21 nt, Human
ucaugccaucugccugccuua

SEQ ID NO: 230626 - RNA, 32 nt, Human
ucaugccauggcacuccauccugggugacaaa

SEQ ID NO: 230627 - RNA, 32 nt, Human
ucaugccauggcacuccguccugggugacaaa

SEQ ID NO: 230628 - RNA, 32 nt, Human
ucaugccauggcagucuagccugggcaacaga

SEQ ID NO: 230629 - RNA, 32 nt, Human
ucaugccauuacacuccagccugggcgacaga

SEQ ID NO: 230630 - RNA, 32 nt, Human
ucaugccauuacuccagccugggugacauagg

SEQ ID NO: 230631 - RNA, 32 nt, Human
ucaugccauuauacuccagccugggugacaga

SEQ ID NO: 230632 - RNA, 32 nt, Human
ucaugccauugcacagcagccugggugacaga

SEQ ID NO: 230633 - RNA, 32 nt, Human
ucaugccauugcacuccaaccugggugacaga

SEQ ID NO: 230634 - RNA, 32 nt, Human
ucaugccauugcacuccagcccagguaacaga

SEQ ID NO: 230635 - RNA, 32 nt, Human
ucaugccauugcacuccagcccggguuacagu

SEQ ID NO: 230636 - RNA, 32 nt, Human
ucaugccauugcacuccagccuaggcaacaag

SEQ ID NO: 230637 - RNA, 32 nt, Human
ucaugccauugcacuccagccugagugacaag

SEQ ID NO: 230638 - RNA, 32 nt, Human
ucaugccauugcacuccagccuggacaacaga

SEQ ID NO: 230639 - RNA, 32 nt, Human
ucaugccauugcacuccagccugggcaacaag

SEQ ID NO: 230640 - RNA, 32 nt, Human
ucaugccauugcacuccagccugggcaacaga

SEQ ID NO: 230641 - RNA, 32 nt, Human
ucaugccauugcacuccagccugggcaacgag

SEQ ID NO: 230642 - RNA, 32 nt, Human
ucaugccauugcacuccagccugggcgacaag

SEQ ID NO: 230643 - RNA, 32 nt, Human
ucaugccauugcacuccagccugggcgacaga

SEQ ID NO: 230644 - RNA, 32 nt, Human
ucaugccauugcacuccagccugggugacaag

SEQ ID NO: 230645 - RNA, 32 nt, Human
ucaugccauugcacuccagccugggugacaga

SEQ ID NO: 230646 - RNA, 32 nt, Human
ucaugccauugcacuccagccugggugauaag

SEQ ID NO: 230647 - RNA, 32 nt, Human
ucaugccauugcacuccagcuugggugacaga

SEQ ID NO: 230648 - RNA, 32 nt, Human
ucaugccauugcacuccagucugggcgacagg

SEQ ID NO: 230649 - RNA, 32 nt, Human
ucaugccauugcacuccgacucugggcaacag

SEQ ID NO: 230650 - RNA, 32 nt, Human
ucaugccauugcacucgagccugggcaacaag

SEQ ID NO: 230651 - RNA, 27 nt, Human
ucaugccauugcacucuagccugggug

SEQ ID NO: 230652 - RNA, 32 nt, Human
ucaugccauugcacugcaccugggcaacaaga

SEQ ID NO: 230653 - RNA, 32 nt, Human
ucaugccauugcauuccagccuaggcaacacg

SEQ ID NO: 230654 - RNA, 32 nt, Human
ucaugccauugcauuccagccuuggcgacaga

SEQ ID NO: 230655 - RNA, 32 nt, Human
ucaugccauuguacuccagccugggcaacaag

SEQ ID NO: 230656 - RNA, 32 nt, Human
ucaugccauuguacuucaccugggcaacaaga

SEQ ID NO: 230657 - RNA, 32 nt, Human
ucaugccauugucuuccagccugagugucaga

SEQ ID NO: 230658 - RNA, 32 nt, Human
ucaugccauugugcaaccuucaccaccgccca

SEQ ID NO: 230659 - RNA, 24 nt, Human
ucaugcccauaaucccagcacuuu

SEQ ID NO: 230660 - RNA, 32 nt, Human
ucaugcccauaaucccagcacuuugggagaug

SEQ ID NO: 230661 - RNA, 24 nt, Human
ucaugcccauaaucccagcccuuu

SEQ ID NO: 230662 - RNA, 32 nt, Human
ucaugcccauaaucccagcccuuugggaagcu

SEQ ID NO: 230663 - RNA, 32 nt, Human
ucaugccccgggaaacagucuuucuucagaau

SEQ ID NO: 230664 - RNA, 32 nt, Human
ucaugccccugcauuccagccuaggcgacaga

SEQ ID NO: 230665 - RNA, 32 nt, Human
ucaugccccuguacuccagccugggugacaga

SEQ ID NO: 230666 - RNA, 24 nt, Human
ucaugcccguaaucccagcacuuu

SEQ ID NO: 230667 - RNA, 32 nt, Human
ucaugcccguaaucccagcacuuugguaggcc

SEQ ID NO: 230668 - RNA, 24 nt, Human
ucaugcccguaauucucacauuuu

SEQ ID NO: 230669 - RNA, 24 nt, Human
ucaugcccguaauuucugcacuuu

SEQ ID NO: 230670 - RNA, 32 nt, Human
ucaugcccucggucucuugccucggcaccugg

SEQ ID NO: 230671 - RNA, 32 nt, Human
ucaugcccugcuccugucuugugcuuuauccu

SEQ ID NO: 230672 - RNA, 32 nt, Human
ucaugcccuguaauccuagaacuuugggaggc

SEQ ID NO: 230673 - RNA, 32 nt, Human
ucaugcccuguaauccuagcacuuugggaggg

SEQ ID NO: 230674 - RNA, 22 nt, Human
ucaugcccuuagcaaguacuuu

SEQ ID NO: 230675 - RNA, 18 nt, Human
ucaugcccuuucuggcca

SEQ ID NO: 230676 - RNA, 32 nt, Human
ucaugccgagguggagguaguggaggaagcua

SEQ ID NO: 230677 - RNA, 20 nt, Human
ucaugccgauaaucccagca

SEQ ID NO: 230678 - RNA, 32 nt, Human
ucaugccgcaagggcuuucugcucuggccuua

SEQ ID NO: 230679 - RNA, 32 nt, Human
ucaugccgccugaugacccccugggccgccau

SEQ ID NO: 230680 - RNA, 27 nt, Human
ucaugccgcgacuugaggcugugaggu

SEQ ID NO: 230681 - RNA, 27 nt, Human
ucaugccgcugcauuccagccugggug

SEQ ID NO: 230682 - RNA, 32 nt, Human
ucaugccguuguacuccagcuugggcaacaga

SEQ ID NO: 230683 - RNA, 24 nt, Human
ucaugccuacaaucccagcacuuu

SEQ ID NO: 230684 - RNA, 23 nt, Human
ucaugccuacaaucccagcauuu

SEQ ID NO: 230685 - RNA, 32 nt, Human
ucaugccuacaaucccagcauuugggaggcuc

SEQ ID NO: 230686 - RNA, 32 nt, Human
ucaugccuacugcacuccagccugggcaacaa

SEQ ID NO: 230687 - RNA, 26 nt, Human
ucaugccuauaaaauuccagcacuuu

SEQ ID NO: 230688 - RNA, 32 nt, Human
ucaugccuauaaaauuccagcacuuugggagg

SEQ ID NO: 230689 - RNA, 24 nt, Human
ucaugccuauaaccccagcacuuu

SEQ ID NO: 230690 - RNA, 24 nt, Human
ucaugccuauaauacccacacuuu

SEQ ID NO: 230691 - RNA, 20 nt, Human
ucaugccuauaaucagcacu

SEQ ID NO: 230692 - RNA, 21 nt, Human
ucaugccuauaauccaagcac

SEQ ID NO: 230693 - RNA, 21 nt, Human
ucaugccuauaaucccaacac

SEQ ID NO: 230694 - RNA, 24 nt, Human
ucaugccuauaaucccaacacuuu

SEQ ID NO: 230695 - RNA, 32 nt, Human
ucaugccuauaaucccaacacuuuaggaggcu

SEQ ID NO: 230696 - RNA, 21 nt, Human
ucaugccuauaaucccagcac

SEQ ID NO: 230697 - RNA, 32 nt, Human
ucaugccuauaaucccagcaccuugggaggcc

SEQ ID NO: 230698 - RNA, 32 nt, Human
ucaugccuauaaucccagcacguugggaggcu

SEQ ID NO: 230699 - RNA, 24 nt, Human
ucaugccuauaaucccagcacuuu

SEQ ID NO: 230700 - RNA, 32 nt, Human
ucaugccuauaaucccagcacuuuaggagccc

SEQ ID NO: 230701 - RNA, 32 nt, Human
ucaugccuauaaucccagcacuuuaggaggcc

SEQ ID NO: 230702 - RNA, 32 nt, Human
ucaugccuauaaucccagcacuuugagaggcc

SEQ ID NO: 230703 - RNA, 32 nt, Human
ucaugccuauaaucccagcacuuuggaaggcu

SEQ ID NO: 230704 - RNA, 32 nt, Human
ucaugccuauaaucccagcacuuuggcaggcu

SEQ ID NO: 230705 - RNA, 32 nt, Human
ucaugccuauaaucccagcacuuugggaagcc

SEQ ID NO: 230706 - RNA, 32 nt, Human
ucaugccuauaaucccagcacuuugggaaguc

SEQ ID NO: 230707 - RNA, 32 nt, Human
ucaugccuauaaucccagcacuuugggaggcc

SEQ ID NO: 230708 - RNA, 32 nt, Human
ucaugccuauaaucccagcacuuugggaggcu

SEQ ID NO: 230709 - RNA, 32 nt, Human
ucaugccuauaaucccagcacuuuuggaggcu

SEQ ID NO: 230710 - RNA, 24 nt, Human
ucaugccuauaaucccagcgcuuu

SEQ ID NO: 230711 - RNA, 32 nt, Human
ucaugccuauaaucccagcgcuuugggagguc

SEQ ID NO: 230712 - RNA, 32 nt, Human
ucaugccuauaaucccagcucuuagggaggca

SEQ ID NO: 230713 - RNA, 24 nt, Human
ucaugccuauaaucccaggacuuu

SEQ ID NO: 230714 - RNA, 32 nt, Human
ucaugccuauaaucccaggacuuugggaagcu

SEQ ID NO: 230715 - RNA, 24 nt, Human
ucaugccuauaaucccagugcuuu

SEQ ID NO: 230716 - RNA, 32 nt, Human
ucaugccuauaaucccagugcuuugggaagcc

SEQ ID NO: 230717 - RNA, 24 nt, Human
ucaugccuauaaucccggcacuuu

SEQ ID NO: 230718 - RNA, 24 nt, Human
ucaugccuauaauccuaacacuuu

SEQ ID NO: 230719 - RNA, 24 nt, Human
ucaugccuauaauccuagcacuuu

SEQ ID NO: 230720 - RNA, 24 nt, Human
ucaugccuauaaucucagcacuuu

SEQ ID NO: 230721 - RNA, 24 nt, Human
ucaugccuauaaucuuagcacuuu

SEQ ID NO: 230722 - RNA, 28 nt, Human
ucaugccuauaauuaaucccaguacuuu

SEQ ID NO: 230723 - RNA, 24 nt, Human
ucaugccuauaauuccaacccuuu

SEQ ID NO: 230724 - RNA, 24 nt, Human
ucaugccuauaauuccagcacuuu

SEQ ID NO: 230725 - RNA, 32 nt, Human
ucaugccuauaguaguucuagcacuuugagag

SEQ ID NO: 230726 - RNA, 24 nt, Human
ucaugccuauagucccagcacuuu

SEQ ID NO: 230727 - RNA, 24 nt, Human
ucaugccuauauucccagcacuuu

SEQ ID NO: 230728 - RNA, 24 nt, Human
ucaugccuauauucccugcacuuu

SEQ ID NO: 230729 - RNA, 24 nt, Human
ucaugccuaucaucccagcacuuu

SEQ ID NO: 230730 - RNA, 32 nt, Human
ucaugccuaucaucccagcacuuugggaggcc

SEQ ID NO: 230731 - RNA, 24 nt, Human
ucaugccuauuaucccagcacuuu

SEQ ID NO: 230732 - RNA, 32 nt, Human
ucaugccuauuaucccagcacuuugggaggcc

SEQ ID NO: 230733 - RNA, 32 nt, Human
ucaugccucacugcagccucgaccucccuggg

SEQ ID NO: 230734 - RNA, 32 nt, Human
ucaugccucacugcagccucggcuuccugggc

SEQ ID NO: 230735 - RNA, 24 nt, Human
ucaugccuccaaucccagcacuuu

SEQ ID NO: 230736 - RNA, 32 nt, Human
ucaugccucccagaauaugaggucuaauuaag

SEQ ID NO: 230737 - RNA, 22 nt, Human
ucaugccuccuaccaagccuuu

SEQ ID NO: 230738 - RNA, 24 nt, Human
ucaugccucuaaucccagcacuuu

SEQ ID NO: 230739 - RNA, 32 nt, Human
ucaugccucuaaucccagcacuuuggaagacc

SEQ ID NO: 230740 - RNA, 32 nt, Human
ucaugccucuaaucccagcacuuugggaggcu

SEQ ID NO: 230741 - RNA, 32 nt, Human
ucaugccucuccugccaacauccuccaagggc

SEQ ID NO: 230742 - RNA, 32 nt, Human
ucaugccucucuacuccagccugggcaauagg

SEQ ID NO: 230743 - RNA, 32 nt, Human
ucaugccucugcauuccagccuuggugacaga

SEQ ID NO: 230744 - RNA, 24 nt, Human
ucaugccucuugucccagcacuuu

SEQ ID NO: 230745 - RNA, 24 nt, Human
ucaugccugaaaucccaacacuuu

SEQ ID NO: 230746 - RNA, 24 nt, Human
ucaugccugaaaucccugcacuuu

SEQ ID NO: 230747 - RNA, 24 nt, Human
ucaugccugaaauccuagcacuuu

SEQ ID NO: 230748 - RNA, 23 nt, Human
ucaugccugaaucucagcacuuu

SEQ ID NO: 230749 - RNA, 23 nt, Human
ucaugccugacaucucagcacuu

SEQ ID NO: 230750 - RNA, 32 nt, Human
ucaugccugcaaucccagcacuguagaaggca

SEQ ID NO: 230751 - RNA, 24 nt, Human
ucaugccugcaaucccagcacuuu

SEQ ID NO: 230752 - RNA, 32 nt, Human
ucaugccugcaaucccagcacuuugggaggca

SEQ ID NO: 230753 - RNA, 32 nt, Human
ucaugccugcaaucccagcacuuugggaggcc

SEQ ID NO: 230754 - RNA, 24 nt, Human
ucaugccugcaauuccagcacuuu

SEQ ID NO: 230755 - RNA, 32 nt, Human
ucaugccugccuguaaucccagcacuguggga

SEQ ID NO: 230756 - RNA, 32 nt, Human
ucaugccugcggucccagcuacuuagggaggc

SEQ ID NO: 230757 - RNA, 24 nt, Human
ucaugccuggaaucccagcacuuu

SEQ ID NO: 230758 - RNA, 32 nt, Human
ucaugccuggaaucccagcacuuugagaggcc

SEQ ID NO: 230759 - RNA, 32 nt, Human
ucaugccuggaaucccagcacuuugggaggcc

SEQ ID NO: 230760 - RNA, 32 nt, Human
ucaugccuggaaucccagcacuuugggaggug

SEQ ID NO: 230761 - RNA, 24 nt, Human
ucaugccuggaauccuagcacuuu

SEQ ID NO: 230762 - RNA, 32 nt, Human
ucaugccugguggugucacaucccaaggcagc

SEQ ID NO: 230763 - RNA, 24 nt, Human
ucaugccuguaaacccagcacuuu

SEQ ID NO: 230764 - RNA, 25 nt, Human
ucaugccuguaaaucccagcacuuu

SEQ ID NO: 230765 - RNA, 32 nt, Human
ucaugccuguaaaucccagcacuuugguagcc

SEQ ID NO: 230766 - RNA, 24 nt, Human
ucaugccuguaaccccagcacuuu

SEQ ID NO: 230767 - RNA, 32 nt, Human
ucaugccuguaaccccagcacuuugggaggcc

SEQ ID NO: 230768 - RNA, 32 nt, Human
ucaugccuguaaccccagcgcuuugggaagcc

SEQ ID NO: 230769 - RNA, 23 nt, Human
ucaugccuguaacccuggcacuu

SEQ ID NO: 230770 - RNA, 32 nt, Human
ucaugccuguaacccuggcacuuaaggggcca

SEQ ID NO: 230771 - RNA, 24 nt, Human
ucaugccuguaaccucagcacuuu

SEQ ID NO: 230772 - RNA, 32 nt, Human
ucaugccuguaaccucagcacuuugggaggcu

SEQ ID NO: 230773 - RNA, 24 nt, Human
ucaugccuguaagcccaacacuuu

SEQ ID NO: 230774 - RNA, 24 nt, Human
ucaugccuguaagcccagcacuuu

SEQ ID NO: 230775 - RNA, 32 nt, Human
ucaugccuguaauaccagcguuuugggaggcu

SEQ ID NO: 230776 - RNA, 32 nt, Human
ucaugccuguaauagcagcuacucgggaggcu

SEQ ID NO: 230777 - RNA, 32 nt, Human
ucaugccuguaaucaaucccagcacuuuggga

SEQ ID NO: 230778 - RNA, 32 nt, Human
ucaugccuguaaucauagcauuaugggaggcu

SEQ ID NO: 230779 - RNA, 21 nt, Human
ucaugccuguaauccaacauu

SEQ ID NO: 230780 - RNA, 32 nt, Human
ucaugccuguaauccaagcacuuugagaggcu

SEQ ID NO: 230781 - RNA, 24 nt, Human
ucaugccuguaauccaagcauuuu

SEQ ID NO: 230782 - RNA, 32 nt, Human
ucaugccuguaauccaagcauuuugagaggcc

SEQ ID NO: 230783 - RNA, 23 nt, Human
ucaugccuguaauccagcacuuu

SEQ ID NO: 230784 - RNA, 32 nt, Human
ucaugccuguaauccagcacuuugggaggccg

SEQ ID NO: 230785 - RNA, 32 nt, Human
ucaugccuguaauccagcacuuugggaggcua

SEQ ID NO: 230786 - RNA, 23 nt, Human
ucaugccuguaauccaguacuuu

SEQ ID NO: 230787 - RNA, 32 nt, Human
ucaugccuguaauccaguacuuuaggaggcca

SEQ ID NO: 230788 - RNA, 24 nt, Human
ucaugccuguaaucccaaaacuuu

SEQ ID NO: 230789 - RNA, 32 nt, Human
ucaugccuguaaucccaaaacuuugggagucc

SEQ ID NO: 230790 - RNA, 22 nt, Human
ucaugccuguaaucccaacacu

SEQ ID NO: 230791 - RNA, 32 nt, Human
ucaugccuguaaucccaacacucugggaggcc

SEQ ID NO: 230792 - RNA, 23 nt, Human
ucaugccuguaaucccaacacuu

SEQ ID NO: 230793 - RNA, 32 nt, Human
ucaugccuguaaucccaacacuuagggaggcu

SEQ ID NO: 230794 - RNA, 32 nt, Human
ucaugccuguaaucccaacacuuaggguggcu

SEQ ID NO: 230795 - RNA, 24 nt, Human
ucaugccuguaaucccaacacuuu

SEQ ID NO: 230796 - RNA, 32 nt, Human
ucaugccuguaaucccaacacuuugagaagcu

SEQ ID NO: 230797 - RNA, 32 nt, Human
ucaugccuguaaucccaacacuuugagaggcc

SEQ ID NO: 230798 - RNA, 32 nt, Human
ucaugccuguaaucccaacacuuugggagacu

SEQ ID NO: 230799 - RNA, 32 nt, Human
ucaugccuguaaucccaacacuuugggaggaa

SEQ ID NO: 230800 - RNA, 32 nt, Human
ucaugccuguaaucccaacacuuugggaggcc

SEQ ID NO: 230801 - RNA, 32 nt, Human
ucaugccuguaaucccaacacuuugggaggcu

SEQ ID NO: 230802 - RNA, 32 nt, Human
ucaugccuguaaucccaacacuuugggagucc

SEQ ID NO: 230803 - RNA, 32 nt, Human
ucaugccuguaaucccaacacuuuugggaggu

SEQ ID NO: 230804 - RNA, 22 nt, Human
ucaugccuguaaucccaacauu

SEQ ID NO: 230805 - RNA, 32 nt, Human
ucaugccuguaaucccaacauucugggaggcc

SEQ ID NO: 230806 - RNA, 24 nt, Human
ucaugccuguaaucccaacauuuu

SEQ ID NO: 230807 - RNA, 32 nt, Human
ucaugccuguaaucccaacauuuugggaggcc

SEQ ID NO: 230808 - RNA, 23 nt, Human
ucaugccuguaaucccaacucuu

SEQ ID NO: 230809 - RNA, 32 nt, Human
ucaugccuguaaucccaacucuuggggaggca

SEQ ID NO: 230810 - RNA, 24 nt, Human
ucaugccuguaaucccaauacuuu

SEQ ID NO: 230811 - RNA, 32 nt, Human
ucaugccuguaaucccaauacuuugggaggcu

SEQ ID NO: 230812 - RNA, 32 nt, Human
ucaugccuguaaucccaaugcuuugggaggcc

SEQ ID NO: 230813 - RNA, 32 nt, Human
ucaugccuguaaucccaccacugaggucagga

SEQ ID NO: 230814 - RNA, 24 nt, Human
ucaugccuguaaucccaccacuuu

SEQ ID NO: 230815 - RNA, 32 nt, Human
ucaugccuguaaucccaccacuuugggaggcc

SEQ ID NO: 230816 - RNA, 32 nt, Human
ucaugccuguaaucccagaacuucgggaggcc

SEQ ID NO: 230817 - RNA, 24 nt, Human
ucaugccuguaaucccagaacuuu

SEQ ID NO: 230818 - RNA, 32 nt, Human
ucaugccuguaaucccagaacuuugggaggcc

SEQ ID NO: 230819 - RNA, 32 nt, Human
ucaugccuguaaucccagaauuuugggaggcc

SEQ ID NO: 230820 - RNA, 19 nt, Human
ucaugccuguaaucccagc

SEQ ID NO: 230821 - RNA, 20 nt, Human
ucaugccuguaaucccagca

SEQ ID NO: 230822 - RNA, 32 nt, Human
ucaugccuguaaucccagcaauuuaggaggcc

SEQ ID NO: 230823 - RNA, 21 nt, Human
ucaugccuguaaucccagcac

SEQ ID NO: 230824 - RNA, 32 nt, Human
ucaugccuguaaucccagcacauugggaagau

SEQ ID NO: 230825 - RNA, 32 nt, Human
ucaugccuguaaucccagcacccugggaggcc

SEQ ID NO: 230826 - RNA, 32 nt, Human
ucaugccuguaaucccagcaccuugaaggccg

SEQ ID NO: 230827 - RNA, 32 nt, Human
ucaugccuguaaucccagcaccuugggaggcc

SEQ ID NO: 230828 - RNA, 32 nt, Human
ucaugccuguaaucccagcacguugggaggcc

SEQ ID NO: 230829 - RNA, 22 nt, Human
ucaugccuguaaucccagcacu

SEQ ID NO: 230830 - RNA, 32 nt, Human
ucaugccuguaaucccagcacuaugggaggcc

SEQ ID NO: 230831 - RNA, 32 nt, Human
ucaugccuguaaucccagcacuaugggaggcu

SEQ ID NO: 230832 - RNA, 32 nt, Human
ucaugccuguaaucccagcacucuggaaggcu

SEQ ID NO: 230833 - RNA, 32 nt, Human
ucaugccuguaaucccagcacucugggaggcc

SEQ ID NO: 230834 - RNA, 32 nt, Human
ucaugccuguaaucccagcacucugggaggcu

SEQ ID NO: 230835 - RNA, 32 nt, Human
ucaugccuguaaucccagcacuguaggcggcc

SEQ ID NO: 230836 - RNA, 32 nt, Human
ucaugccuguaaucccagcacugugggaagcu

SEQ ID NO: 230837 - RNA, 32 nt, Human
ucaugccuguaaucccagcacugugggaggcu

SEQ ID NO: 230838 - RNA, 23 nt, Human
ucaugccuguaaucccagcacuu

SEQ ID NO: 230839 - RNA, 32 nt, Human
ucaugccuguaaucccagcacuucaggaggcc

SEQ ID NO: 230840 - RNA, 32 nt, Human
ucaugccuguaaucccagcacuucgggaggcc

SEQ ID NO: 230841 - RNA, 32 nt, Human
ucaugccuguaaucccagcacuuggagaggcu

SEQ ID NO: 230842 - RNA, 32 nt, Human
ucaugccuguaaucccagcacuugggaggcca

SEQ ID NO: 230843 - RNA, 32 nt, Human
ucaugccuguaaucccagcacuugggaggccg

SEQ ID NO: 230844 - RNA, 32 nt, Human
ucaugccuguaaucccagcacuuggggaggcc

SEQ ID NO: 230845 - RNA, 24 nt, Human
ucaugccuguaaucccagcacuuu

SEQ ID NO: 230846 - RNA, 32 nt, Human
ucaugccuguaaucccagcacuuucagaggcu

SEQ ID NO: 230847 - RNA, 32 nt, Human
ucaugccuguaaucccagcacuuucggaggcc

SEQ ID NO: 230848 - RNA, 32 nt, Human
ucaugccuguaaucccagcacuuugagagacc

SEQ ID NO: 230849 - RNA, 32 nt, Human
ucaugccuguaaucccagcacuuugagagacu

SEQ ID NO: 230850 - RNA, 32 nt, Human
ucaugccuguaaucccagcacuuugagaggcc

SEQ ID NO: 230851 - RNA, 32 nt, Human
ucaugccuguaaucccagcacuuugagaggcu

SEQ ID NO: 230852 - RNA, 32 nt, Human
ucaugccuguaaucccagcacuuugauaggcu

SEQ ID NO: 230853 - RNA, 32 nt, Human
ucaugccuguaaucccagcacuuugcgaggcc

SEQ ID NO: 230854 - RNA, 32 nt, Human
ucaugccuguaaucccagcacuuuggaaggcc

SEQ ID NO: 230855 - RNA, 32 nt, Human
ucaugccuguaaucccagcacuuuggaaggcu

SEQ ID NO: 230856 - RNA, 32 nt, Human
ucaugccuguaaucccagcacuuuggcaggac

SEQ ID NO: 230857 - RNA, 32 nt, Human
ucaugccuguaaucccagcacuuugggaagca

SEQ ID NO: 230858 - RNA, 32 nt, Human
ucaugccuguaaucccagcacuuugggaagcc

SEQ ID NO: 230859 - RNA, 32 nt, Human
ucaugccuguaaucccagcacuuugggaagcu

SEQ ID NO: 230860 - RNA, 32 nt, Human
ucaugccuguaaucccagcacuuugggaaguc

SEQ ID NO: 230861 - RNA, 32 nt, Human
ucaugccuguaaucccagcacuuugggagacu

SEQ ID NO: 230862 - RNA, 32 nt, Human
ucaugccuguaaucccagcacuuugggaggag

SEQ ID NO: 230863 - RNA, 32 nt, Human
ucaugccuguaaucccagcacuuugggaggca

SEQ ID NO: 230864 - RNA, 32 nt, Human
ucaugccuguaaucccagcacuuugggaggcc

SEQ ID NO: 230865 - RNA, 32 nt, Human
ucaugccuguaaucccagcacuuugggaggcg

SEQ ID NO: 230866 - RNA, 32 nt, Human
ucaugccuguaaucccagcacuuugggaggcu

SEQ ID NO: 230867 - RNA, 32 nt, Human
ucaugccuguaaucccagcacuuugggagguc

SEQ ID NO: 230868 - RNA, 32 nt, Human
ucaugccuguaaucccagcacuuugggagguu

SEQ ID NO: 230869 - RNA, 32 nt, Human
ucaugccuguaaucccagcacuuugggagucu

SEQ ID NO: 230870 - RNA, 32 nt, Human
ucaugccuguaaucccagcacuuugggaugcu

SEQ ID NO: 230871 - RNA, 32 nt, Human
ucaugccuguaaucccagcacuuugggauucu

SEQ ID NO: 230872 - RNA, 32 nt, Human
ucaugccuguaaucccagcacuuuggggagcc

SEQ ID NO: 230873 - RNA, 32 nt, Human
ucaugccuguaaucccagcacuuuggggaggc

SEQ ID NO: 230874 - RNA, 32 nt, Human
ucaugccuguaaucccagcacuuugggggcca

SEQ ID NO: 230875 - RNA, 32 nt, Human
ucaugccuguaaucccagcacuuugguaggcu

SEQ ID NO: 230876 - RNA, 32 nt, Human
ucaugccuguaaucccagcacuuuucggaggc

SEQ ID NO: 230877 - RNA, 32 nt, Human
ucaugccuguaaucccagcacuuuugaggcug

SEQ ID NO: 230878 - RNA, 32 nt, Human
ucaugccuguaaucccagcacuuuuggaggcc

SEQ ID NO: 230879 - RNA, 22 nt, Human
ucaugccuguaaucccagcauu

SEQ ID NO: 230880 - RNA, 24 nt, Human
ucaugccuguaaucccagcauuuu

SEQ ID NO: 230881 - RNA, 32 nt, Human
ucaugccuguaaucccagcauuuugagaggcu

SEQ ID NO: 230882 - RNA, 32 nt, Human
ucaugccuguaaucccagcauuuugggagacc

SEQ ID NO: 230883 - RNA, 32 nt, Human
ucaugccuguaaucccagcauuuugggaggca

SEQ ID NO: 230884 - RNA, 32 nt, Human
ucaugccuguaaucccagcauuuugggaggcc

SEQ ID NO: 230885 - RNA, 32 nt, Human
ucaugccuguaaucccagcauuuugggaggcu

SEQ ID NO: 230886 - RNA, 24 nt, Human
ucaugccuguaaucccagcccuuu

SEQ ID NO: 230887 - RNA, 32 nt, Human
ucaugccuguaaucccagcccuuugggaggcu

SEQ ID NO: 230888 - RNA, 24 nt, Human
ucaugccuguaaucccagcgcuuu

SEQ ID NO: 230889 - RNA, 32 nt, Human
ucaugccuguaaucccagcgcuuugggaggcc

SEQ ID NO: 230890 - RNA, 32 nt, Human
ucaugccuguaaucccagcgcuuugggaggcu

SEQ ID NO: 230891 - RNA, 22 nt, Human
ucaugccuguaaucccagcuac

SEQ ID NO: 230892 - RNA, 32 nt, Human
ucaugccuguaaucccagcuacgcaggaggcc

SEQ ID NO: 230893 - RNA, 32 nt, Human
ucaugccuguaaucccagcuacucaggaggcu

SEQ ID NO: 230894 - RNA, 24 nt, Human
ucaugccuguaaucccaggacuuu

SEQ ID NO: 230895 - RNA, 32 nt, Human
ucaugccuguaaucccaggacuuugggaggcc

SEQ ID NO: 230896 - RNA, 32 nt, Human
ucaugccuguaaucccaggacuuugguaggcc

SEQ ID NO: 230897 - RNA, 22 nt, Human
ucaugccuguaaucccaguacu

SEQ ID NO: 230898 - RNA, 32 nt, Human
ucaugccuguaaucccaguacucugggaagcc

SEQ ID NO: 230899 - RNA, 24 nt, Human
ucaugccuguaaucccaguacuuu

SEQ ID NO: 230900 - RNA, 32 nt, Human
ucaugccuguaaucccaguacuuuggaaagcc

SEQ ID NO: 230901 - RNA, 32 nt, Human
ucaugccuguaaucccaguacuuugggaggcc

SEQ ID NO: 230902 - RNA, 32 nt, Human
ucaugccuguaaucccaguacuuugggaggcu

SEQ ID NO: 230903 - RNA, 24 nt, Human
ucaugccuguaaucccagugcuuu

SEQ ID NO: 230904 - RNA, 32 nt, Human
ucaugccuguaaucccagugcuuugggaggcu

SEQ ID NO: 230905 - RNA, 24 nt, Human
ucaugccuguaauccccgcacuuu

SEQ ID NO: 230906 - RNA, 32 nt, Human
ucaugccuguaaucccgacacuuugggaggcc

SEQ ID NO: 230907 - RNA, 32 nt, Human
ucaugccuguaaucccggcacuuugggaggcc

SEQ ID NO: 230908 - RNA, 20 nt, Human
ucaugccuguaaucccugca

SEQ ID NO: 230909 - RNA, 32 nt, Human
ucaugccuguaaucccugcaauuugggagacc

SEQ ID NO: 230910 - RNA, 23 nt, Human
ucaugccuguaaucccugcacuu

SEQ ID NO: 230911 - RNA, 24 nt, Human
ucaugccuguaaucccugcacuuu

SEQ ID NO: 230912 - RNA, 32 nt, Human
ucaugccuguaaucccugcacuuugggaggcu

SEQ ID NO: 230913 - RNA, 32 nt, Human
ucaugccuguaaucccugcacuuugggaugcc

SEQ ID NO: 230914 - RNA, 23 nt, Human
ucaugccuguaauccgagcacuu

SEQ ID NO: 230915 - RNA, 32 nt, Human
ucaugccuguaauccgagcacuucgggaagcu

SEQ ID NO: 230916 - RNA, 24 nt, Human
ucaugccuguaauccgagcacuuu

SEQ ID NO: 230917 - RNA, 32 nt, Human
ucaugccuguaauccgagcacuuugggaggcc

SEQ ID NO: 230918 - RNA, 32 nt, Human
ucaugccuguaauccgagugcuuuaggaggcc

SEQ ID NO: 230919 - RNA, 23 nt, Human
ucaugccuguaauccuaacacuu

SEQ ID NO: 230920 - RNA, 24 nt, Human
ucaugccuguaauccuaacacuuu

SEQ ID NO: 230921 - RNA, 32 nt, Human
ucaugccuguaauccuaacacuuugggaggcc

SEQ ID NO: 230922 - RNA, 21 nt, Human
ucaugccuguaauccuagcac

SEQ ID NO: 230923 - RNA, 32 nt, Human
ucaugccuguaauccuagcaccuugggaggcu

SEQ ID NO: 230924 - RNA, 24 nt, Human
ucaugccuguaauccuagcacuuu

SEQ ID NO: 230925 - RNA, 32 nt, Human
ucaugccuguaauccuagcacuuugagaggcc

SEQ ID NO: 230926 - RNA, 32 nt, Human
ucaugccuguaauccuagcacuuuggaaggcu

SEQ ID NO: 230927 - RNA, 32 nt, Human
ucaugccuguaauccuagcacuuuggaagguc

SEQ ID NO: 230928 - RNA, 32 nt, Human
ucaugccuguaauccuagcacuuugggaagcc

SEQ ID NO: 230929 - RNA, 32 nt, Human
ucaugccuguaauccuagcacuuugggaggcc

SEQ ID NO: 230930 - RNA, 32 nt, Human
ucaugccuguaauccuagcacuuugggaggcu

SEQ ID NO: 230931 - RNA, 32 nt, Human
ucaugccuguaauccuagcacuuuggguggcu

SEQ ID NO: 230932 - RNA, 24 nt, Human
ucaugccuguaauccuagcagcuu

SEQ ID NO: 230933 - RNA, 32 nt, Human
ucaugccuguaauccuagcagcuugggaggcc

SEQ ID NO: 230934 - RNA, 32 nt, Human
ucaugccuguaauccuagcagguugggaggcc

SEQ ID NO: 230935 - RNA, 24 nt, Human
ucaugccuguaauccuagcauuuu

SEQ ID NO: 230936 - RNA, 32 nt, Human
ucaugccuguaauccuagcauuuugggaggac

SEQ ID NO: 230937 - RNA, 24 nt, Human
ucaugccuguaauccuaguacuuu

SEQ ID NO: 230938 - RNA, 32 nt, Human
ucaugccuguaauccuaguacuuugggaggcc

SEQ ID NO: 230939 - RNA, 24 nt, Human
ucaugccuguaauccuggcacuuu

SEQ ID NO: 230940 - RNA, 32 nt, Human
ucaugccuguaauccuggcacuuugggaggcu

SEQ ID NO: 230941 - RNA, 24 nt, Human
ucaugccuguaaucgcagcacuuu

SEQ ID NO: 230942 - RNA, 32 nt, Human
ucaugccuguaaucgcagcacuuugggaggcc

SEQ ID NO: 230943 - RNA, 24 nt, Human
ucaugccuguaaucguagcacuuu

SEQ ID NO: 230944 - RNA, 32 nt, Human
ucaugccuguaaucguagcacuuugagaggcc

SEQ ID NO: 230945 - RNA, 32 nt, Human
ucaugccuguaaucucaacacuuugggaagcc

SEQ ID NO: 230946 - RNA, 25 nt, Human
ucaugccuguaaucucaagcacuuu

SEQ ID NO: 230947 - RNA, 24 nt, Human
ucaugccuguaaucucagaacuuu

SEQ ID NO: 230948 - RNA, 32 nt, Human
ucaugccuguaaucucagaacuuugggaggcc

SEQ ID NO: 230949 - RNA, 20 nt, Human
ucaugccuguaaucucagca

SEQ ID NO: 230950 - RNA, 32 nt, Human
ucaugccuguaaucucagcaauuugggaggcc

SEQ ID NO: 230951 - RNA, 32 nt, Human
ucaugccuguaaucucagcacuguaggaggcc

SEQ ID NO: 230952 - RNA, 24 nt, Human
ucaugccuguaaucucagcacuuu

SEQ ID NO: 230953 - RNA, 32 nt, Human
ucaugccuguaaucucagcacuuugagaggcu

SEQ ID NO: 230954 - RNA, 32 nt, Human
ucaugccuguaaucucagcacuuugggagacu

SEQ ID NO: 230955 - RNA, 32 nt, Human
ucaugccuguaaucucagcacuuugggaggcc

SEQ ID NO: 230956 - RNA, 32 nt, Human
ucaugccuguaaucucagcacuuugggaggcu

SEQ ID NO: 230957 - RNA, 24 nt, Human
ucaugccuguaaucucagcuacuu

SEQ ID NO: 230958 - RNA, 32 nt, Human
ucaugccuguaaucucagcuacuuggcuggcu

SEQ ID NO: 230959 - RNA, 21 nt, Human
ucaugccuguaaucucaguac

SEQ ID NO: 230960 - RNA, 32 nt, Human
ucaugccuguaaucucaguacauugggaggcc

SEQ ID NO: 230961 - RNA, 24 nt, Human
ucaugccuguaaucucaguacuuu

SEQ ID NO: 230962 - RNA, 32 nt, Human
ucaugccuguaaucucaguacuuugggaggua

SEQ ID NO: 230963 - RNA, 25 nt, Human
ucaugccuguaaucuccagcacuuu

SEQ ID NO: 230964 - RNA, 32 nt, Human
ucaugccuguaaucuccagcacuuugggaggc

SEQ ID NO: 230965 - RNA, 24 nt, Human
ucaugccuguaaucugagcacuuu

SEQ ID NO: 230966 - RNA, 24 nt, Human
ucaugccuguaaucuuaguacuuu

SEQ ID NO: 230967 - RNA, 24 nt, Human
ucaugccuguaaucuuaucacuuu

SEQ ID NO: 230968 - RNA, 24 nt, Human
ucaugccuguaaugccagcacuuu

SEQ ID NO: 230969 - RNA, 24 nt, Human
ucaugccuguaauuccagcacuuu

SEQ ID NO: 230970 - RNA, 32 nt, Human
ucaugccuguaauuccagcacuuuaggaggcc

SEQ ID NO: 230971 - RNA, 32 nt, Human
ucaugccuguaauuccagcacuuugggaggau

SEQ ID NO: 230972 - RNA, 32 nt, Human
ucaugccuguaauuccagcacuuugggaggca

SEQ ID NO: 230973 - RNA, 32 nt, Human
ucaugccuguaauuccagcacuuugggaggcc

SEQ ID NO: 230974 - RNA, 32 nt, Human
ucaugccuguaauuccagcacuuugggaggcg

SEQ ID NO: 230975 - RNA, 32 nt, Human
ucaugccuguaauuccagcacuuugggaggcu

SEQ ID NO: 230976 - RNA, 32 nt, Human
ucaugccuguaauuccggcacuuugggaggcc

SEQ ID NO: 230977 - RNA, 24 nt, Human
ucaugccuguaauucuagcacuuu

SEQ ID NO: 230978 - RNA, 32 nt, Human
ucaugccuguaauuucaguacuuugggaggcc

SEQ ID NO: 230979 - RNA, 32 nt, Human
ucaugccuguaguaaucccagcacuuuuggag

SEQ ID NO: 230980 - RNA, 22 nt, Human
ucaugccuguagucccagcacu

SEQ ID NO: 230981 - RNA, 24 nt, Human
ucaugccuguagucccagcacucg

SEQ ID NO: 230982 - RNA, 24 nt, Human
ucaugccuguagucccagcacuuu

SEQ ID NO: 230983 - RNA, 32 nt, Human
ucaugccuguagucccagcuacuccagagguc

SEQ ID NO: 230984 - RNA, 32 nt, Human
ucaugccuguagucccagcuacucuggaggcu

SEQ ID NO: 230985 - RNA, 32 nt, Human
ucaugccuguagucccagcuacuugggaggcu

SEQ ID NO: 230986 - RNA, 26 nt, Human
ucaugccuguauaaucccagcacuuu

SEQ ID NO: 230987 - RNA, 32 nt, Human
ucaugccuguauaaucccagcacuuugggagg

SEQ ID NO: 230988 - RNA, 24 nt, Human
ucaugccuguauucccaccacuuu

SEQ ID NO: 230989 - RNA, 24 nt, Human
ucaugccuguauucucagcacuuu

SEQ ID NO: 230990 - RNA, 24 nt, Human
ucaugccugucaucccagcacuuu

SEQ ID NO: 230991 - RNA, 32 nt, Human
ucaugccugucaucccagcacuuugggaagcu

SEQ ID NO: 230992 - RNA, 32 nt, Human
ucaugccugucaucccagcacuuugggaggcc

SEQ ID NO: 230993 - RNA, 23 nt, Human
ucaugccugucaucccagcauuu

SEQ ID NO: 230994 - RNA, 32 nt, Human
ucaugccugucaucccagcauuugggaggcug

SEQ ID NO: 230995 - RNA, 22 nt, Human
ucaugccugugaucccagcacu

SEQ ID NO: 230996 - RNA, 24 nt, Human
ucaugccugugaucccagcacuuu

SEQ ID NO: 230997 - RNA, 32 nt, Human
ucaugccugugaucccagcacuuugggaggcg

SEQ ID NO: 230998 - RNA, 32 nt, Human
ucaugccugugaucccagcacuuuggguggcu

SEQ ID NO: 230999 - RNA, 32 nt, Human
ucaugccugugaucccagcuacucgggaggcu

SEQ ID NO: 231000 - RNA, 24 nt, Human
ucaugccugugaucccuacacuuu

SEQ ID NO: 231001 - RNA, 24 nt, Human
ucaugccugugauccuagcacuuu

SEQ ID NO: 231002 - RNA, 24 nt, Human
ucaugccuguggucccagaacuuu

SEQ ID NO: 231003 - RNA, 24 nt, Human
ucaugccuguggucccagcacuuu

SEQ ID NO: 231004 - RNA, 24 nt, Human
ucaugccuguggucccagcgcuuu

SEQ ID NO: 231005 - RNA, 32 nt, Human
ucaugccuguggucccagcuacuugagaggcu

SEQ ID NO: 231006 - RNA, 32 nt, Human
ucaugccuguguucccagcuauucaggaggcu

SEQ ID NO: 231007 - RNA, 19 nt, Human
ucaugccuuguuuuugaua

SEQ ID NO: 231008 - RNA, 32 nt, Human
ucaugccuuguuuuugauaccuccuggcagcu

SEQ ID NO: 231009 - RNA, 24 nt, Human
ucaugccuuuaaucccagcacuuu

SEQ ID NO: 231010 - RNA, 32 nt, Human
ucaugccuuuaaucccagcacuuugggaggcc

SEQ ID NO: 231011 - RNA, 32 nt, Human
ucaugccuuuaaucccagcacuuugggaggcu

SEQ ID NO: 231012 - RNA, 24 nt, Human
ucaugccuuuaaucccagcauuuu

SEQ ID NO: 231013 - RNA, 32 nt, Human
ucaugccuuuaaucccagcauuuugggaggcu

SEQ ID NO: 231014 - RNA, 22 nt, Human
ucaugccuuugacaagcauuuu

SEQ ID NO: 231015 - RNA, 32 nt, Human
ucaugcgacugcacuccagccugggugacuga

SEQ ID NO: 231016 - RNA, 32 nt, Human
ucaugcgagagggagaugugugggcgagagcc

SEQ ID NO: 231017 - RNA, 32 nt, Human
ucaugcgccgguuaaacucugccauuaugccu

SEQ ID NO: 231018 - RNA, 32 nt, Human
ucaugcgcgguggcucacgccuguaauucuag

SEQ ID NO: 231019 - RNA, 32 nt, Human
ucaugcggcacgggggccccuuguucagcgag

SEQ ID NO: 231020 - RNA, 32 nt, Human
ucaugcgggaggcaaugagcugcuggagcaca

SEQ ID NO: 231021 - RNA, 32 nt, Human
ucaugcgggcccagagggcagcagagccgcuu

SEQ ID NO: 231022 - RNA, 32 nt, Human
ucaugcgggucagaggaugaaggggcacaggg

SEQ ID NO: 231023 - RNA, 20 nt, Human
ucaugcggugggugcugcca

SEQ ID NO: 231024 - RNA, 32 nt, Human
ucaugcgucacugcagccuccaccucccgggc

SEQ ID NO: 231025 - RNA, 32 nt, Human
ucaugcguguaaucccagcacuuugggaggcc

SEQ ID NO: 231026 - RNA, 32 nt, Human
ucaugcuacccaccaccucagugcugagguca

SEQ ID NO: 231027 - RNA, 32 nt, Human
ucaugcuacugcacuccagccuaggugacaga

SEQ ID NO: 231028 - RNA, 32 nt, Human
ucaugcuacugcacuccagccugggcgacaga

SEQ ID NO: 231029 - RNA, 32 nt, Human
ucaugcuacugcacuccagccugggugacaga

SEQ ID NO: 231030 - RNA, 32 nt, Human
ucaugcuacugcacuccagcuuagguggcaaa

SEQ ID NO: 231031 - RNA, 32 nt, Human
ucaugcuacugcacucuagccugagcgacaga

SEQ ID NO: 231032 - RNA, 32 nt, Human
ucaugcuacugcaugccagccugggugacaaa

SEQ ID NO: 231033 - RNA, 32 nt, Human
ucaugcuagugcgcuccagccugggcaacaga

SEQ ID NO: 231034 - RNA, 32 nt, Human
ucaugcucaauccagccuuagcugagcaccug

SEQ ID NO: 231035 - RNA, 32 nt, Human
ucaugcucagugccaggggcagaacacugggg

SEQ ID NO: 231036 - RNA, 23 nt, Human
ucaugcuccccgaucuccuuccu

SEQ ID NO: 231037 - RNA, 32 nt, Human
ucaugcucccuccagcccaugacccggggcua

SEQ ID NO: 231038 - RNA, 32 nt, Human
ucaugcuccuuugcacagcccagggccuguuu

SEQ ID NO: 231039 - RNA, 32 nt, Human
ucaugcucucuaaauuuauucugccauagaag

SEQ ID NO: 231040 - RNA, 32 nt, Human
ucaugcucugcucucuucaaccagaccucuac

SEQ ID NO: 231041 - RNA, 32 nt, Human
ucaugcucuguggcuccaggguuucuguuacu

SEQ ID NO: 231042 - RNA, 32 nt, Human
ucaugcugaccuugcaaauucagccgcugcuu

SEQ ID NO: 231043 - RNA, 32 nt, Human
ucaugcugagcgcucucuuaggcacaggcugg

SEQ ID NO: 231044 - RNA, 32 nt, Human
ucaugcugagugucuucauguuucauguaagu

SEQ ID NO: 231045 - RNA, 32 nt, Human
ucaugcugcaccuucagagccaguccucuagu

SEQ ID NO: 231046 - RNA, 22 nt, Human
ucaugcugcagaauauguuaua

SEQ ID NO: 231047 - RNA, 27 nt, Human
ucaugcugcccgcugccuccucccuca

SEQ ID NO: 231048 - RNA, 32 nt, Human
ucaugcugcuccaccagugggccuuggaaaau

SEQ ID NO: 231049 - RNA, 22 nt, Human
ucaugcuggccggcguggcccc

SEQ ID NO: 231050 - RNA, 23 nt, Human
ucaugcuguaaucccaucacuuu

SEQ ID NO: 231051 - RNA, 32 nt, Human
ucaugcugucucuccgcuaaagccugaggccc

SEQ ID NO: 231052 - RNA, 32 nt, Human
ucaugcuguggcuggggccucuugcuuccugc

SEQ ID NO: 231053 - RNA, 32 nt, Human
ucaugcuguuaugauuucaccuggugaaucag

SEQ ID NO: 231054 - RNA, 32 nt, Human
ucaugcuucucccccauucccacccucucugc

SEQ ID NO: 231055 - RNA, 32 nt, Human
ucaugcuugccuugaucuccucuccuuccucu

SEQ ID NO: 231056 - RNA, 23 nt, Human
ucaugcuuguaaucccaacacuu

SEQ ID NO: 231057 - RNA, 24 nt, Human
ucaugcuuguaaucccaacacuuu

SEQ ID NO: 231058 - RNA, 32 nt, Human
ucaugcuuguaaucccaacacuuugggaagcc

SEQ ID NO: 231059 - RNA, 32 nt, Human
ucaugcuuguaaucccagcacuuggggaggcc

SEQ ID NO: 231060 - RNA, 24 nt, Human
ucaugcuuguaaucccagcacuuu

SEQ ID NO: 231061 - RNA, 32 nt, Human
ucaugcuuguaaucccagcacuuugggaagcu

SEQ ID NO: 231062 - RNA, 32 nt, Human
ucaugcuuguaaucccagcacuuugggaggcc

SEQ ID NO: 231063 - RNA, 32 nt, Human
ucaugcuuguaaucccagcacuuugguaggcu

SEQ ID NO: 231064 - RNA, 24 nt, Human
ucaugcuuguaaucccaguacuuu

SEQ ID NO: 231065 - RNA, 32 nt, Human
ucaugcuuguaaucccaguacuuuaggaggcu

SEQ ID NO: 231066 - RNA, 24 nt, Human
ucaugcuuguaaucccggcacuuu

SEQ ID NO: 231067 - RNA, 24 nt, Human
ucaugcuuguaauccuagcacuuu

SEQ ID NO: 231068 - RNA, 32 nt, Human
ucaugcuuguaauccuagcacuuuuugaggcc

SEQ ID NO: 231069 - RNA, 32 nt, Human
ucaugcuuguggucccagcuguucaggaggau

SEQ ID NO: 231070 - RNA, 32 nt, Human
ucaugcuuuucaaagcauccuaacuugcuaag

SEQ ID NO: 231071 - RNA, 32 nt, Human
ucauggaaagacucaacuugcaacugugcccu

SEQ ID NO: 231072 - RNA, 32 nt, Human
ucauggaaaggguggagaauggaggggaacca

SEQ ID NO: 231073 - RNA, 32 nt, Human
ucauggaacuaggggauugucucacuucucca

SEQ ID NO: 231074 - RNA, 32 nt, Human
ucauggaaggagacccaggagucaacuuguuu

SEQ ID NO: 231075 - RNA, 32 nt, Human
ucauggaaggaucagacugggaaccacagagg

SEQ ID NO: 231076 - RNA, 32 nt, Human
ucauggaagggccgcugagcaaauggacuaac

SEQ ID NO: 231077 - RNA, 32 nt, Human
ucauggaauagaaugcugucaccagaaaaugc

SEQ ID NO: 231078 - RNA, 22 nt, Human
ucauggaauguuguuguguuag

SEQ ID NO: 231079 - RNA, 27 nt, Human
ucauggacauacagcuggacccugcca

SEQ ID NO: 231080 - RNA, 23 nt, Human
ucauggacgaaguugccgaugga

SEQ ID NO: 231081 - RNA, 32 nt, Human
ucauggacgggagcgcaguggggaagguaggg

SEQ ID NO: 231082 - RNA, 32 nt, Human
ucauggacgucuuaaucuuccacacacauccc

SEQ ID NO: 231083 - RNA, 32 nt, Human
ucauggacucaagugaucugccugccucagcc

SEQ ID NO: 231084 - RNA, 32 nt, Human
ucauggacugaagccugaggccaucuguccgu

SEQ ID NO: 231085 - RNA, 32 nt, Human
ucauggacuguacaagucucuauacaaugucu

SEQ ID NO: 231086 - RNA, 32 nt, Human
ucauggagaacuguuucccuacaaugacaaaa

SEQ ID NO: 231087 - RNA, 32 nt, Human
ucauggagcacuuccuuuccagaaacugauuu

SEQ ID NO: 231088 - RNA, 32 nt, Human
ucauggagcugcagagagcuccuccagccugg

SEQ ID NO: 231089 - RNA, 32 nt, Human
ucauggaggagaaaggacgugagauccugcug

SEQ ID NO: 231090 - RNA, 32 nt, Human
ucauggaggcuggcagcugagcucagagguuc

SEQ ID NO: 231091 - RNA, 27 nt, Human
ucauggagguggccgagguggaaaguc

SEQ ID NO: 231092 - RNA, 32 nt, Human
ucauggaguagagucaggagaaaccccugaca

SEQ ID NO: 231093 - RNA, 32 nt, Human
ucauggagucagcaggcacguggauaaaaccu

SEQ ID NO: 231094 - RNA, 32 nt, Human
ucauggaguuagcuaacagcccagggaacugg

SEQ ID NO: 231095 - RNA, 32 nt, Human
ucauggaguugauaacaagaagaauaaagggc

SEQ ID NO: 231096 - RNA, 32 nt, Human
ucauggauagcucagagguauccucuuuuugc

SEQ ID NO: 231097 - RNA, 32 nt, Human
ucauggauauuggccuguaauuuuauuuucuu

SEQ ID NO: 231098 - RNA, 32 nt, Human
ucauggaucagacuuaguauuguuaagauggc

SEQ ID NO: 231099 - RNA, 32 nt, Human
ucauggaucccagcuacucucaacaaggcuua

SEQ ID NO: 231100 - RNA, 24 nt, Human
ucauggaugcaggggcuugucuga

SEQ ID NO: 231101 - RNA, 32 nt, Human
ucauggauggggcugcuuuugcagugggugcc

SEQ ID NO: 231102 - RNA, 32 nt, Human
ucauggauguuaggaaaucuagucaucuuccc

SEQ ID NO: 231103 - RNA, 32 nt, Human
ucauggauuguaacuaaagaagaaacgguucc

SEQ ID NO: 231104 - RNA, 32 nt, Human
ucauggcaacaucagcuuucuaauguucuaaa

SEQ ID NO: 231105 - RNA, 21 nt, Human
ucauggcaagggcuggcccca

SEQ ID NO: 231106 - RNA, 32 nt, Human
ucauggcacugcacuccagccugggcaacaga

SEQ ID NO: 231107 - RNA, 27 nt, Human
ucauggcacugccaccugggccuuugg

SEQ ID NO: 231108 - RNA, 27 nt, Human
ucauggcagaggaagcagcuguguucg

SEQ ID NO: 231109 - RNA, 32 nt, Human
ucauggcagaggaggaagaugagggcacggac

SEQ ID NO: 231110 - RNA, 32 nt, Human
ucauggcagcgaugaguaaucugugaugauac

SEQ ID NO: 231111 - RNA, 32 nt, Human
ucauggcaucaaggcucacugcagccuggacc

SEQ ID NO: 231112 - RNA, 32 nt, Human
ucauggcaucauugcauuccagccugggcaac

SEQ ID NO: 231113 - RNA, 32 nt, Human
ucauggccaagcgucuaaccuaaagucccagg

SEQ ID NO: 231114 - RNA, 32 nt, Human
ucauggccaccuggacaacuggcaaaccauuc

SEQ ID NO: 231115 - RNA, 32 nt, Human
ucauggccagccaggccuaccuggaggagacc

SEQ ID NO: 231116 - RNA, 32 nt, Human
ucauggccagccuguguuugcagaucacuggg

SEQ ID NO: 231117 - RNA, 32 nt, Human
ucauggccauaucaugaacccaggacaggcac

SEQ ID NO: 231118 - RNA, 32 nt, Human
ucauggccauuuccugcccuccuccaacuugu

SEQ ID NO: 231119 - RNA, 24 nt, Human
ucauggccauuuggcaugauugca

SEQ ID NO: 231120 - RNA, 32 nt, Human
ucauggcccagagacccaaaagaaugaaaggu

SEQ ID NO: 231121 - RNA, 19 nt, Human
ucauggcccagauugugaa

SEQ ID NO: 231122 - RNA, 32 nt, Human
ucauggcccauagauauucaaaagcaagauau

SEQ ID NO: 231123 - RNA, 32 nt, Human
ucauggcccauuuuauugucugccuuucagua

SEQ ID NO: 231124 - RNA, 32 nt, Human
ucauggcccugaggugggucagcuacucuccu

SEQ ID NO: 231125 - RNA, 32 nt, Human
ucauggccgacuggaauccugaguccugggaa

SEQ ID NO: 231126 - RNA, 32 nt, Human
ucauggccucggacaggcagaggcugugaaau

SEQ ID NO: 231127 - RNA, 27 nt, Human
ucauggcggacccuagagauaaggcgc

SEQ ID NO: 231128 - RNA, 32 nt, Human
ucauggcggaggcggaggcggagguugcagug

SEQ ID NO: 231129 - RNA, 32 nt, Human
ucauggcgugccaggguggugacaguugaaca

SEQ ID NO: 231130 - RNA, 32 nt, Human
ucauggcucacugaagccucgacuuccagggc

SEQ ID NO: 231131 - RNA, 32 nt, Human
ucauggcucacugaagucuugaccccgcugcc

SEQ ID NO: 231132 - RNA, 32 nt, Human
ucauggcucacugcaaccuccaccuccugggu

SEQ ID NO: 231133 - RNA, 32 nt, Human
ucauggcucacugcaaccucugccucccgguu

SEQ ID NO: 231134 - RNA, 32 nt, Human
ucauggcucacugcaaccuugaccucccaggc

SEQ ID NO: 231135 - RNA, 32 nt, Human
ucauggcucacugcaaccuugacgucccaggu

SEQ ID NO: 231136 - RNA, 32 nt, Human
ucauggcucacugcagccccaaccuucagggc

SEQ ID NO: 231137 - RNA, 32 nt, Human
ucauggcucacugcagccccgaacuacugggc

SEQ ID NO: 231138 - RNA, 32 nt, Human
ucauggcucacugcagccucaaccuagccauc

SEQ ID NO: 231139 - RNA, 32 nt, Human
ucauggcucacugcagccucaaccugcugggc

SEQ ID NO: 231140 - RNA, 32 nt, Human
ucauggcucacugcagccucaaccuugaagac

SEQ ID NO: 231141 - RNA, 32 nt, Human
ucauggcucacugcagccuccaccucccaggc

SEQ ID NO: 231142 - RNA, 32 nt, Human
ucauggcucacugcagccuccaccuccuugac

SEQ ID NO: 231143 - RNA, 32 nt, Human
ucauggcucacugcagccucgaacuccugggc

SEQ ID NO: 231144 - RNA, 32 nt, Human
ucauggcucacugcagccucgaccucccaggc

SEQ ID NO: 231145 - RNA, 32 nt, Human
ucauggcucacugcagccucgaccuccugggc

SEQ ID NO: 231146 - RNA, 32 nt, Human
ucauggcucacugcagccucgagcuccugagc

SEQ ID NO: 231147 - RNA, 32 nt, Human
ucauggcucacugcagccuggagcuccugggc

SEQ ID NO: 231148 - RNA, 32 nt, Human
ucauggcucacugcagccuugaacucccagac

SEQ ID NO: 231149 - RNA, 32 nt, Human
ucauggcucacugcagccuugaacuccugagc

SEQ ID NO: 231150 - RNA, 32 nt, Human
ucauggcucacugcagccuugaacuccuggcc

SEQ ID NO: 231151 - RNA, 32 nt, Human
ucauggcucacugcagccuugaccuuccagcc

SEQ ID NO: 231152 - RNA, 32 nt, Human
ucauggcucacugcagccuugacuucucaggc

SEQ ID NO: 231153 - RNA, 32 nt, Human
ucauggcucacugcagcuuaagcucacugccu

SEQ ID NO: 231154 - RNA, 32 nt, Human
ucauggcucacugcagucucaaucucucuggc

SEQ ID NO: 231155 - RNA, 32 nt, Human
ucauggcucacugcagucucugccucccaggc

SEQ ID NO: 231156 - RNA, 32 nt, Human
ucauggcucacugcggccucaaacuccggggc

SEQ ID NO: 231157 - RNA, 32 nt, Human
ucauggcucacuguaaccucugccucccaggc

SEQ ID NO: 231158 - RNA, 32 nt, Human
ucauggcucacuguagccacaaccucucaggc

SEQ ID NO: 231159 - RNA, 32 nt, Human
ucauggcucacuguagccucgaccuccugggc

SEQ ID NO: 231160 - RNA, 32 nt, Human
ucauggcucauugcaaccuugaauuccugggc

SEQ ID NO: 231161 - RNA, 32 nt, Human
ucauggcucccaucuuggccccuggaggugag

SEQ ID NO: 231162 - RNA, 32 nt, Human
ucauggcucucggcagccuucccaggccccgc

SEQ ID NO: 231163 - RNA, 32 nt, Human
ucauggcucucggcggccuucccaggccccgc

SEQ ID NO: 231164 - RNA, 32 nt, Human
ucauggcucucggcggucuucccaggccccgc

SEQ ID NO: 231165 - RNA, 32 nt, Human
ucauggcugagcugcaaucuaacacuuuacug

SEQ ID NO: 231166 - RNA, 18 nt, Human
ucauggcugccaguucuu

SEQ ID NO: 231167 - RNA, 19 nt, Human
ucauggcuguccccuccca

SEQ ID NO: 231168 - RNA, 32 nt, Human
ucauggcuucaucucuaucuuuacuuucucuu

SEQ ID NO: 231169 - RNA, 32 nt, Human
ucauggcuuggaagaauguguuaggaaacucu

SEQ ID NO: 231170 - RNA, 32 nt, Human
ucauggcuugggcuggagugggcucucuggac

SEQ ID NO: 231171 - RNA, 32 nt, Human
ucauggcuuucaauaaguacacaauauaaugu

SEQ ID NO: 231172 - RNA, 32 nt, Human
ucaugggaaaucuaccuagaaagaaguucuug

SEQ ID NO: 231173 - RNA, 32 nt, Human
ucaugggacugcacuccagccugggugacaga

SEQ ID NO: 231174 - RNA, 32 nt, Human
ucaugggaggcagagcugggggagcgaggcug

SEQ ID NO: 231175 - RNA, 32 nt, Human
ucaugggaugcagcaguucuucaacgaaaacc

SEQ ID NO: 231176 - RNA, 24 nt, Human
ucaugggcaagaagccugacccca

SEQ ID NO: 231177 - RNA, 32 nt, Human
ucaugggcacucccacaggccagccugcacag

SEQ ID NO: 231178 - RNA, 32 nt, Human
ucaugggccacuguucucuuugaggggacagg

SEQ ID NO: 231179 - RNA, 32 nt, Human
ucaugggcuaacacucucuggugcacagggau

SEQ ID NO: 231180 - RNA, 32 nt, Human
ucaugggcucaagcaguccucccaccucagcc

SEQ ID NO: 231181 - RNA, 32 nt, Human
ucaugggcucaagcgauucuccugccucagcc

SEQ ID NO: 231182 - RNA, 32 nt, Human
ucaugggcucaagggauccugccaucucagcu

SEQ ID NO: 231183 - RNA, 32 nt, Human
ucauggggaaacucgcuccuucuguuggcaga

SEQ ID NO: 231184 - RNA, 32 nt, Human
ucauggggaaggaaaaugcagcacucuaaaug

SEQ ID NO: 231185 - RNA, 32 nt, Human
ucauggggaggggcccuucagagcagagucca

SEQ ID NO: 231186 - RNA, 32 nt, Human
ucauggggccagcccuagcugcuggagggacu

SEQ ID NO: 231187 - RNA, 21 nt, Human
ucauggggccucacucugcca

SEQ ID NO: 231188 - RNA, 32 nt, Human
ucauggggcuuugugaggguuugaaaaaguga

SEQ ID NO: 231189 - RNA, 32 nt, Human
ucauggggguccucuggcuggcccaggagcac

SEQ ID NO: 231190 - RNA, 22 nt, Human
ucaugggguuugguugugcuga

SEQ ID NO: 231191 - RNA, 23 nt, Human
ucaugggucaggaaccgcuccug

SEQ ID NO: 231192 - RNA, 32 nt, Human
ucauggguccagcaucaggccugaggucagca

SEQ ID NO: 231193 - RNA, 32 nt, Human
ucauggguccugagucaucccacacacagccu

SEQ ID NO: 231194 - RNA, 21 nt, Human
ucaugggugccuccugcccca

SEQ ID NO: 231195 - RNA, 24 nt, Human
ucauggguggcggguaugaucuca

SEQ ID NO: 231196 - RNA, 24 nt, Human
ucauggguguuaccugcuggcccu

SEQ ID NO: 231197 - RNA, 32 nt, Human
ucauggguuagaaggaaguguuugaaagucac

SEQ ID NO: 231198 - RNA, 32 nt, Human
ucaugguagcuggcugcagguguccugggcca

SEQ ID NO: 231199 - RNA, 27 nt, Human
ucaugguauugggaaccauagauuugu

SEQ ID NO: 231200 - RNA, 32 nt, Human
ucaugguccaagcaaauguuccagguauuuaa

SEQ ID NO: 231201 - RNA, 32 nt, Human
ucaugguccacacccaucacaccauggaaucu

SEQ ID NO: 231202 - RNA, 32 nt, Human
ucaugguccgguguccuuuucacuacaccaug

SEQ ID NO: 231203 - RNA, 32 nt, Human
ucauggucgugggcccuuucccauggaggcug

SEQ ID NO: 231204 - RNA, 32 nt, Human
ucauggucuacuccucuuuccguggcuggggg

SEQ ID NO: 231205 - RNA, 27 nt, Human
ucauggucucccaggcccucaggcucc

SEQ ID NO: 231206 - RNA, 32 nt, Human
ucauggucucuuccagcccagacauccuguga

SEQ ID NO: 231207 - RNA, 32 nt, Human
ucauggucugcuuaagaaaacuuaaagaaagg

SEQ ID NO: 231208 - RNA, 32 nt, Human
ucauggucuuccaggguuuuuauccuggcugu

SEQ ID NO: 231209 - RNA, 18 nt, Human
ucauggugaauuaucuca

SEQ ID NO: 231210 - RNA, 32 nt, Human
ucauggugaccaacucucagaaacuccagcug

SEQ ID NO: 231211 - RNA, 32 nt, Human
ucauggugucacaguuugguucuuuuguuuug

SEQ ID NO: 231212 - RNA, 32 nt, Human
ucaugguuaccugagucugggcaucugugaag

SEQ ID NO: 231213 - RNA, 32 nt, Human
ucaugguucacugcaaucucgacuuccaguuu

SEQ ID NO: 231214 - RNA, 27 nt, Human
ucaugguucacugcagccucagccucc

SEQ ID NO: 231215 - RNA, 32 nt, Human
ucaugguucacugcagccucgaccucccaggc

SEQ ID NO: 231216 - RNA, 32 nt, Human
ucaugguucacugcagccuugaccuccagggc

SEQ ID NO: 231217 - RNA, 32 nt, Human
ucaugguucacugcagucuugaccucccaggc

SEQ ID NO: 231218 - RNA, 32 nt, Human
ucaugguucacugcagucuugaccuuuugggc

SEQ ID NO: 231219 - RNA, 32 nt, Human
ucaugguucacuucaaccccuaccuccugggc

SEQ ID NO: 231220 - RNA, 32 nt, Human
ucaugguucuagcucccagucgccaagcguug

SEQ ID NO: 231221 - RNA, 32 nt, Human
ucaugguugagacucauugucuaccugugcag

SEQ ID NO: 231222 - RNA, 32 nt, Human
ucaugguugcaaugagucaugaucacgccacu

SEQ ID NO: 231223 - RNA, 32 nt, Human
ucaugguugcagcauuugaacuuuugguguua

SEQ ID NO: 231224 - RNA, 32 nt, Human
ucaugguugggagcugagggaaggcugagaau

SEQ ID NO: 231225 - RNA, 18 nt, Human
ucaugguuguccauuuga

SEQ ID NO: 231226 - RNA, 32 nt, Human
ucaugguuuugguaucaggaugaugcuggccu

SEQ ID NO: 231227 - RNA, 32 nt, Human
ucauguaaggacucaauuuggggaagagcauu

SEQ ID NO: 231228 - RNA, 32 nt, Human
ucauguaauaguggcuuucauuucuuauuaac

SEQ ID NO: 231229 - RNA, 32 nt, Human
ucauguaauccaggcuggggaagauggcggug

SEQ ID NO: 231230 - RNA, 32 nt, Human
ucauguaccgcuucuagugaaauguagaggaa

SEQ ID NO: 231231 - RNA, 32 nt, Human
ucauguacuaacugugcuuuucccucuugugu

SEQ ID NO: 231232 - RNA, 32 nt, Human
ucauguacuacugcacuugagcaugaaugggu

SEQ ID NO: 231233 - RNA, 19 nt, Human
ucauguaggucuucugguc

SEQ ID NO: 231234 - RNA, 32 nt, Human
ucauguauacagucauuuaugccuaaagccug

SEQ ID NO: 231235 - RNA, 23 nt, Human
ucauguauguaauccuagcacuu

SEQ ID NO: 231236 - RNA, 32 nt, Human
ucauguauguaauccuagcacuucgagaggcc

SEQ ID NO: 231237 - RNA, 32 nt, Human
ucauguauuccaucauaccaucaugccgugga

SEQ ID NO: 231238 - RNA, 19 nt, Human
ucaugucaagcaccucuca

SEQ ID NO: 231239 - RNA, 32 nt, Human
ucaugucaauaugggauuaaugccuaaacuuu

SEQ ID NO: 231240 - RNA, 19 nt, Human
ucaugucaaugaccauuca

SEQ ID NO: 231241 - RNA, 32 nt, Human
ucaugucaccgccauccuccugggcuuccucg

SEQ ID NO: 231242 - RNA, 32 nt, Human
ucaugucacggcaaccuccgccucccagguuc

SEQ ID NO: 231243 - RNA, 21 nt, Human
ucaugucacucgccacacuca

SEQ ID NO: 231244 - RNA, 32 nt, Human
ucaugucacugauugcauuccagccuggguga

SEQ ID NO: 231245 - RNA, 32 nt, Human
ucaugucacugcacuccagccugggugacaga

SEQ ID NO: 231246 - RNA, 32 nt, Human
ucaugucacugcacucuagcuugggagacaga

SEQ ID NO: 231247 - RNA, 32 nt, Human
ucaugucacugcagagguaugaaaaggagagc

SEQ ID NO: 231248 - RNA, 32 nt, Human
ucaugucacuguacuccagccugggcaacaga

SEQ ID NO: 231249 - RNA, 19 nt, Human
ucaugucagcaucagcuca

SEQ ID NO: 231250 - RNA, 19 nt, Human
ucaugucaguccacauuca

SEQ ID NO: 231251 - RNA, 32 nt, Human
ucaugucauugcacucuagucugggugacaag

SEQ ID NO: 231252 - RNA, 32 nt, Human
ucaugucauuuguucaagaaacaagugauaau

SEQ ID NO: 231253 - RNA, 32 nt, Human
ucauguccaaacguccucuuuaguuuuugguu

SEQ ID NO: 231254 - RNA, 32 nt, Human
ucauguccagaggcugaggauggagguggaag

SEQ ID NO: 231255 - RNA, 32 nt, Human
ucaugucccacaggccacagagcccagugugu

SEQ ID NO: 231256 - RNA, 32 nt, Human
ucaugucccagccugggcaacauagcaagacc

SEQ ID NO: 231257 - RNA, 32 nt, Human
ucauguccccucccaugcaaagccccuacugg

SEQ ID NO: 231258 - RNA, 32 nt, Human
ucauguccucgccucugccacaaaccauccuc

SEQ ID NO: 231259 - RNA, 24 nt, Human
ucauguccucggucucuugccuca

SEQ ID NO: 231260 - RNA, 32 nt, Human
ucauguccuucaggaucucugcccucaaaauu

SEQ ID NO: 231261 - RNA, 31 nt, Human
ucauguccuuccaaggaggcugggaccucuc

SEQ ID NO: 231262 - RNA, 19 nt, Human
ucaugucggugucauguca

SEQ ID NO: 231263 - RNA, 32 nt, Human
ucaugucgugcuuuguaaaugucuuauuugug

SEQ ID NO: 231264 - RNA, 24 nt, Human
ucaugucuauaaucccagcacuuu

SEQ ID NO: 231265 - RNA, 32 nt, Human
ucaugucuauaaucccagcacuuugggagguu

SEQ ID NO: 231266 - RNA, 32 nt, Human
ucaugucuaugccuuggucccuuuccccucag

SEQ ID NO: 231267 - RNA, 32 nt, Human
ucaugucucaauaccaaucuuuuaaacuacug

SEQ ID NO: 231268 - RNA, 24 nt, Human
ucaugucucuaaucccagcacuuu

SEQ ID NO: 231269 - RNA, 32 nt, Human
ucaugucucuaaucccagcacuuugggagacu

SEQ ID NO: 231270 - RNA, 32 nt, Human
ucaugucucuuggccucuuccucucucaagau

SEQ ID NO: 231271 - RNA, 32 nt, Human
ucaugucucuuuggggagagcuggcagugugc

SEQ ID NO: 231272 - RNA, 32 nt, Human
ucaugucugagcugauucuguuugcuccacgu

SEQ ID NO: 231273 - RNA, 32 nt, Human
ucaugucugcaaucccagcgauuugggagguu

SEQ ID NO: 231274 - RNA, 32 nt, Human
ucaugucugcagccccagcuacucgggaggcu

SEQ ID NO: 231275 - RNA, 32 nt, Human
ucaugucugcccagggggacugcgaguuccug

SEQ ID NO: 231276 - RNA, 32 nt, Human
ucaugucuguaaucccagcaauuuggaggcug

SEQ ID NO: 231277 - RNA, 22 nt, Human
ucaugucuguaaucccagcacu

SEQ ID NO: 231278 - RNA, 24 nt, Human
ucaugucuguaaucccagcacuuu

SEQ ID NO: 231279 - RNA, 27 nt, Human
ucaugucuguaaucccagcacuuuggg

SEQ ID NO: 231280 - RNA, 32 nt, Human
ucaugucuguaaucccagcacuuugggaggcc

SEQ ID NO: 231281 - RNA, 32 nt, Human
ucaugucuguaaucccagcacuuugggagguc

SEQ ID NO: 231282 - RNA, 32 nt, Human
ucaugucuguaaucccagcacuuugugaggcu

SEQ ID NO: 231283 - RNA, 32 nt, Human
ucaugucuguaauccuagcacugugggaggcc

SEQ ID NO: 231284 - RNA, 32 nt, Human
ucaugugaacauuugaacuaguuauaggauaa

SEQ ID NO: 231285 - RNA, 32 nt, Human
ucaugugacacaaaauaucauucuucuuuuua

SEQ ID NO: 231286 - RNA, 32 nt, Human
ucaugugagaaaaaccuguuucccucugguuc

SEQ ID NO: 231287 - RNA, 32 nt, Human
ucaugugaggaaauaaugcacaugcucuaacu

SEQ ID NO: 231288 - RNA, 32 nt, Human
ucaugugcaaggggucacgugaggucacugac

SEQ ID NO: 231289 - RNA, 27 nt, Human
ucaugugcaggauggggacauccaggc

SEQ ID NO: 231290 - RNA, 32 nt, Human
ucaugugcaugagucugaagcugcagagguua

SEQ ID NO: 231291 - RNA, 32 nt, Human
ucaugugccacagaagcucagccugggcuuca

SEQ ID NO: 231292 - RNA, 32 nt, Human
ucaugugccagccuccacccucacgccauuuc

SEQ ID NO: 231293 - RNA, 32 nt, Human
ucaugugccagggcaucccauuccaggcuucc

SEQ ID NO: 231294 - RNA, 32 nt, Human
ucaugugcuguccacaugaauguguugacugu

SEQ ID NO: 231295 - RNA, 32 nt, Human
ucauguggaaagcuuuuagcacaguaucuggu

SEQ ID NO: 231296 - RNA, 32 nt, Human
ucauguggaagaacgugggccgccacguggca

SEQ ID NO: 231297 - RNA, 32 nt, Human
ucauguggcucucuuuucaucuuugaugucag

SEQ ID NO: 231298 - RNA, 32 nt, Human
ucauguggcugugugugaccucugccugaaaa

SEQ ID NO: 231299 - RNA, 32 nt, Human
ucaugugggaggcugaggcaggaguauuguga

SEQ ID NO: 231300 - RNA, 32 nt, Human
ucaugugggucugaguguugcuuuuggaaaag

SEQ ID NO: 231301 - RNA, 32 nt, Human
ucaugugguucacccuucaccccagauacaaa

SEQ ID NO: 231302 - RNA, 32 nt, Human
ucauguguccccaaccuuuaaaaauguuuauu

SEQ ID NO: 231303 - RNA, 32 nt, Human
ucaugugucccccaacuccaccccucacaguu

SEQ ID NO: 231304 - RNA, 32 nt, Human
ucaugugugaaucauggagaaaucucauaaua

SEQ ID NO: 231305 - RNA, 32 nt, Human
ucaugugugcaucaugucucuuugccaaggga

SEQ ID NO: 231306 - RNA, 32 nt, Human
ucauguguggacugucccucucuuugggucuc

SEQ ID NO: 231307 - RNA, 32 nt, Human
ucaugugugggaaccacaguuccuggcugccu

SEQ ID NO: 231308 - RNA, 22 nt, Human
ucauguguguaaucccagcacu

SEQ ID NO: 231309 - RNA, 32 nt, Human
ucauguguguaaucccagcacucugggaggcu

SEQ ID NO: 231310 - RNA, 32 nt, Human
ucauguguucauuuauuuccaccacagcagau

SEQ ID NO: 231311 - RNA, 32 nt, Human
ucauguuaaagugcuuauagggaaagaagccu

SEQ ID NO: 231312 - RNA, 32 nt, Human
ucauguuacagguauuuaccugagaugaugcc

SEQ ID NO: 231313 - RNA, 32 nt, Human
ucauguuaggccacccuccgguuccuuaauga

SEQ ID NO: 231314 - RNA, 31 nt, Human
ucauguucaauaaauauuggguguauugaaa

SEQ ID NO: 231315 - RNA, 32 nt, Human
ucauguucacuacccuucaugcaugaaagaca

SEQ ID NO: 231316 - RNA, 32 nt, Human
ucauguucauccccaucuauuuauuuaagccu

SEQ ID NO: 231317 - RNA, 32 nt, Human
ucauguuccagaaccagcaagugcuccagagu

SEQ ID NO: 231318 - RNA, 32 nt, Human
ucauguucucugaaguggaauguggcuuuccu

SEQ ID NO: 231319 - RNA, 22 nt, Human
ucauguucuggaacugugcuaa

SEQ ID NO: 231320 - RNA, 32 nt, Human
ucauguucuguugaauacugcagccgcugccc

SEQ ID NO: 231321 - RNA, 32 nt, Human
ucauguugaacaaacuaagagugccaggaagu

SEQ ID NO: 231322 - RNA, 32 nt, Human
ucauguugaacacagcucucuccacucccuug

SEQ ID NO: 231323 - RNA, 32 nt, Human
ucauguugacccuggcccuggauagcagcuuu

SEQ ID NO: 231324 - RNA, 32 nt, Human
ucauguugauucuuguaagcacuggacugucu

SEQ ID NO: 231325 - RNA, 32 nt, Human
ucauguugcacacccacucagcuccgugaacu

SEQ ID NO: 231326 - RNA, 32 nt, Human
ucauguuggaaagaaaugaaagauuagaaacc

SEQ ID NO: 231327 - RNA, 32 nt, Human
ucauguuggaaaugcaacugcaucccaggaac

SEQ ID NO: 231328 - RNA, 32 nt, Human
ucauguuggccaggcuggucuccaacuccuag

SEQ ID NO: 231329 - RNA, 32 nt, Human
ucauguuggcucagaaucaaccucuuuaaaua

SEQ ID NO: 231330 - RNA, 32 nt, Human
ucauguugugugugugcauguacauguaugga

SEQ ID NO: 231331 - RNA, 32 nt, Human
ucauguuguugcccugcggcgccccuuugaag

SEQ ID NO: 231332 - RNA, 32 nt, Human
ucauguuuaugaggagaugauaacugggggcc

SEQ ID NO: 231333 - RNA, 32 nt, Human
ucauguuuccacccuuccucuugccccuccac

SEQ ID NO: 231334 - RNA, 32 nt, Human
ucauguuuccauccucacuguugacuccuggc

SEQ ID NO: 231335 - RNA, 32 nt, Human
ucauguuucccuucuaguuuuggcugacagga

SEQ ID NO: 231336 - RNA, 32 nt, Human
ucauguuucuuauuggcucugccuccugugcu

SEQ ID NO: 231337 - RNA, 32 nt, Human
ucauguuucuuucuguggccauggguauagug

SEQ ID NO: 231338 - RNA, 27 nt, Human
ucauguuugggaagaaaaagaaaaaga

SEQ ID NO: 231339 - RNA, 25 nt, Human
ucauguuuguaaaucccagcacuuu

SEQ ID NO: 231340 - RNA, 32 nt, Human
ucauguuuguaaaucccagcacuuugggaagg

SEQ ID NO: 231341 - RNA, 32 nt, Human
ucauguuuguaaucccagcacuuugggggauu

SEQ ID NO: 231342 - RNA, 24 nt, Human
ucauguuuguaauccuagcacuuu

SEQ ID NO: 231343 - RNA, 32 nt, Human
ucauguuuguaauccuagcacuuugggaggcu

SEQ ID NO: 231344 - RNA, 32 nt, Human
ucauguuuugaagcagcagguccaggucacuu

SEQ ID NO: 231345 - RNA, 32 nt, Human
ucauguuuuguuuaacucuuuauccuuauccu

SEQ ID NO: 231346 - RNA, 32 nt, Human
ucauuaaaaccagcuuaagagcagauaugaca

SEQ ID NO: 231347 - RNA, 32 nt, Human
ucauuaaagaugaguccucauggcucuuacag

SEQ ID NO: 231348 - RNA, 32 nt, Human
ucauuaaagccgccaacgccauccagcagcaa

SEQ ID NO: 231349 - RNA, 32 nt, Human
ucauuaaauguucaaaauuguaguuuuaaaaa

SEQ ID NO: 231350 - RNA, 32 nt, Human
ucauuaaauucagaaacuacagccugagugaa

SEQ ID NO: 231351 - RNA, 32 nt, Human
ucauuaacaugcugcaauucaggagcugguua

SEQ ID NO: 231352 - RNA, 32 nt, Human
ucauuaaccauggccugauauuaguucuuaga

SEQ ID NO: 231353 - RNA, 32 nt, Human
ucauuaacccaagugaaccaaccaaagucacc

SEQ ID NO: 231354 - RNA, 32 nt, Human
ucauuaacuauacugugcuuucccuugacuga

SEQ ID NO: 231355 - RNA, 32 nt, Human
ucauuaagaacugcauucccacauccucacac

SEQ ID NO: 231356 - RNA, 32 nt, Human
ucauuaagacuggaaucaagcuuacauguaaa

SEQ ID NO: 231357 - RNA, 32 nt, Human
ucauuaaguaauuuugguuuguucagaaacuu

SEQ ID NO: 231358 - RNA, 32 nt, Human
ucauuaaucaggaaaccuggacugccugcuug

SEQ ID NO: 231359 - RNA, 32 nt, Human
ucauuaauucagugaaguugagacuucauagu

SEQ ID NO: 231360 - RNA, 24 nt, Human
ucauuacaaaauauuuagugugaa

SEQ ID NO: 231361 - RNA, 32 nt, Human
ucauuacaaaccucagauggacacuaagcacu

SEQ ID NO: 231362 - RNA, 32 nt, Human
ucauuacaaaggaugugagaggaaaaauuuau

SEQ ID NO: 231363 - RNA, 32 nt, Human
ucauuacacuuucacccauagcagaaaacacu

SEQ ID NO: 231364 - RNA, 32 nt, Human
ucauuacaucaaggagcugccccugucagggu

SEQ ID NO: 231365 - RNA, 32 nt, Human
ucauuacaucugccagggccugccucaagaag

SEQ ID NO: 231366 - RNA, 32 nt, Human
ucauuacauuguuuugacuaagcacaauuaga

SEQ ID NO: 231367 - RNA, 18 nt, Human
ucauuaccacaguuuuaa

SEQ ID NO: 231368 - RNA, 32 nt, Human
ucauuacccaggcuggagugcaaggcacgauc

SEQ ID NO: 231369 - RNA, 32 nt, Human
ucauuaccuggcagaggcaaagaaaggugaga

SEQ ID NO: 231370 - RNA, 32 nt, Human
ucauuacugugaccuugggaagcagcaggaca

SEQ ID NO: 231371 - RNA, 32 nt, Human
ucauuacuguugggugaaccugugaagauaac

SEQ ID NO: 231372 - RNA, 32 nt, Human
ucauuacuuacuacugcacuccugcuuuugug

SEQ ID NO: 231373 - RNA, 32 nt, Human
ucauuacuuaggagccagggcuuuucagauau

SEQ ID NO: 231374 - RNA, 32 nt, Human
ucauuacuuuguaccccuauccuuccaagcac

SEQ ID NO: 231375 - RNA, 32 nt, Human
ucauuagaaaauuuguacugaggggaauucua

SEQ ID NO: 231376 - RNA, 32 nt, Human
ucauuagaccgagacaucacuagaaauucugg

SEQ ID NO: 231377 - RNA, 32 nt, Human
ucauuagacuuaaauuuuaauucuucagaaug

SEQ ID NO: 231378 - RNA, 32 nt, Human
ucauuagagagggagacaccagcucuuugguu

SEQ ID NO: 231379 - RNA, 32 nt, Human
ucauuagagcugcauuucaguaccaaagagga

SEQ ID NO: 231380 - RNA, 32 nt, Human
ucauuagcaaauguguugcuucaugccuuggu

SEQ ID NO: 231381 - RNA, 32 nt, Human
ucauuagcagcuuuuccuccucuucccugcac

SEQ ID NO: 231382 - RNA, 32 nt, Human
ucauuagcaguuuuaauacugcugugucaguu

SEQ ID NO: 231383 - RNA, 32 nt, Human
ucauuagcauggcaaugaggaguuucuguaau

SEQ ID NO: 231384 - RNA, 32 nt, Human
ucauuagcuacacugcuucccacuugauuaga

SEQ ID NO: 231385 - RNA, 32 nt, Human
ucauuagcuagauaugggacccuggcaaguga

SEQ ID NO: 231386 - RNA, 32 nt, Human
ucauuaggaagggagagcugcaguacguuagg

SEQ ID NO: 231387 - RNA, 32 nt, Human
ucauuaggagagaccugucguuaaggauuugu

SEQ ID NO: 231388 - RNA, 32 nt, Human
ucauuagggaaagggguuaagugaaaaugcug

SEQ ID NO: 231389 - RNA, 32 nt, Human
ucauuagggcaaagaucucagcagccagcucc

SEQ ID NO: 231390 - RNA, 22 nt, Human
ucauuauaaaauauuguuaaug

SEQ ID NO: 231391 - RNA, 32 nt, Human
ucauuauacuucugaccuuugggcuuucuuuu

SEQ ID NO: 231392 - RNA, 32 nt, Human
ucauuaucaaaagugaucagcaaugaagaacu

SEQ ID NO: 231393 - RNA, 32 nt, Human
ucauuaucaguauuucucaugcuguacacaau

SEQ ID NO: 231394 - RNA, 32 nt, Human
ucauuaucccacaaugcaccccuuagcauuaa

SEQ ID NO: 231395 - RNA, 32 nt, Human
ucauuauccuucucuuucugcacaaggaaaaa

SEQ ID NO: 231396 - RNA, 32 nt, Human
ucauuaucuaucuucuucucccuucccucgcc

SEQ ID NO: 231397 - RNA, 32 nt, Human
ucauuaucucucuuuuucagauaacaaaaugu

SEQ ID NO: 231398 - RNA, 32 nt, Human
ucauuaugaauccauggauggcucaauucuua

SEQ ID NO: 231399 - RNA, 32 nt, Human
ucauuaugagauacagucgguuuaccucagga

SEQ ID NO: 231400 - RNA, 32 nt, Human
ucauuaugagaugucgucucucggugccuccu

SEQ ID NO: 231401 - RNA, 32 nt, Human
ucauuaugcucuucugccuggggcugucaucu

SEQ ID NO: 231402 - RNA, 32 nt, Human
ucauuauguaaauacuuuaauucuacucuuuu

SEQ ID NO: 231403 - RNA, 32 nt, Human
ucauuaugugaaauaggugaaaagccagaucc

SEQ ID NO: 231404 - RNA, 32 nt, Human
ucauuauuuagauacuuucuuccuucacucac

SEQ ID NO: 231405 - RNA, 32 nt, Human
ucauuauuuccacuugcaggccagcuuaaccu

SEQ ID NO: 231406 - RNA, 32 nt, Human
ucauuauuuuucacugccccagacacagugcc

SEQ ID NO: 231407 - RNA, 32 nt, Human
ucauucaaaccagcucaggucagaaacaaaaa

SEQ ID NO: 231408 - RNA, 32 nt, Human
ucauucaaauguguaaaugucauauucauuca

SEQ ID NO: 231409 - RNA, 32 nt, Human
ucauucaacacacaugaccacccgugugaucu

SEQ ID NO: 231410 - RNA, 27 nt, Human
ucauucaacauugaagcuaggcuucaa

SEQ ID NO: 231411 - RNA, 32 nt, Human
ucauucaaccauuguuuacaugucguucagga

SEQ ID NO: 231412 - RNA, 32 nt, Human
ucauucaagaggaagauggaaggggcuguuua

SEQ ID NO: 231413 - RNA, 23 nt, Human
ucauucacaucaacagagcgagg

SEQ ID NO: 231414 - RNA, 32 nt, Human
ucauucacugaaguaaaagcaccugaugcugc

SEQ ID NO: 231415 - RNA, 32 nt, Human
ucauucagagguggguauaagugaaugggaga

SEQ ID NO: 231416 - RNA, 32 nt, Human
ucauucagccuaucuugcgaggcccgggcagc

SEQ ID NO: 231417 - RNA, 32 nt, Human
ucauucagccuccacugugucugucuuuucuu

SEQ ID NO: 231418 - RNA, 32 nt, Human
ucauucaggccacccugcucauggcccuuccu

SEQ ID NO: 231419 - RNA, 32 nt, Human
ucauucaggcuggagugcaguggugcaaucuc

SEQ ID NO: 231420 - RNA, 32 nt, Human
ucauucaggcuggagugcaguggugcgaucuc

SEQ ID NO: 231421 - RNA, 32 nt, Human
ucauucagucuguuauuuuguacagcaacccu

SEQ ID NO: 231422 - RNA, 32 nt, Human
ucauucaguuauauccuuuggcucagcuagcu

SEQ ID NO: 231423 - RNA, 32 nt, Human
ucauucaugucucugcaaaugauaugaucuca

SEQ ID NO: 231424 - RNA, 32 nt, Human
ucauucauuaugcacccagugcugggugcuug

SEQ ID NO: 231425 - RNA, 32 nt, Human
ucauucauucaccccaugauguucuggaagua

SEQ ID NO: 231426 - RNA, 32 nt, Human
ucauucauucacuaggggugcauuauuuagga

SEQ ID NO: 231427 - RNA, 32 nt, Human
ucauuccacaaacccuaugggggcugccacgu

SEQ ID NO: 231428 - RNA, 32 nt, Human
ucauuccacugcauuucagccugggggauaca

SEQ ID NO: 231429 - RNA, 20 nt, Human
ucauuccagaucuccagggc

SEQ ID NO: 231430 - RNA, 32 nt, Human
ucauuccaguccuuauuuuuguaaguauuacu

SEQ ID NO: 231431 - RNA, 32 nt, Human
ucauuccaugccagcaccucugcagccugcug

SEQ ID NO: 231432 - RNA, 32 nt, Human
ucauuccauuacacuccagccugggcaccagg

SEQ ID NO: 231433 - RNA, 19 nt, Human
ucauuccauuuauccuaga

SEQ ID NO: 231434 - RNA, 28 nt, Human
ucauucccaagugcccuugugcccuguu

SEQ ID NO: 231435 - RNA, 32 nt, Human
ucauucccaucccugucaccagucccagcucc

SEQ ID NO: 231436 - RNA, 19 nt, Human
ucauuccccacccccuccc

SEQ ID NO: 231437 - RNA, 32 nt, Human
ucauuccccuccgguucuccucggugacucac

SEQ ID NO: 231438 - RNA, 32 nt, Human
ucauuccccuuuccccuaauauuuccuauuau

SEQ ID NO: 231439 - RNA, 32 nt, Human
ucauucccuagggcuaguccaagucuccuggc

SEQ ID NO: 231440 - RNA, 32 nt, Human
ucauucccucgccuccccuuguggacgggggu

SEQ ID NO: 231441 - RNA, 32 nt, Human
ucauucccucugccuaggcccuggugaaacca

SEQ ID NO: 231442 - RNA, 32 nt, Human
ucauuccggaggaggagccaggcagcagggcc

SEQ ID NO: 231443 - RNA, 32 nt, Human
ucauuccucacaggacagaagcagagugggug

SEQ ID NO: 231444 - RNA, 32 nt, Human
ucauuccuccccuggcucuucucccucuucag

SEQ ID NO: 231445 - RNA, 25 nt, Human
ucauuccucccugggaaucagggua

SEQ ID NO: 231446 - RNA, 24 nt, Human
ucauuccucuccuuccuugcugca

SEQ ID NO: 231447 - RNA, 20 nt, Human
ucauuccucucuuagggggc

SEQ ID NO: 231448 - RNA, 32 nt, Human
ucauuccucucuuuucucauccuuccccuuuu

SEQ ID NO: 231449 - RNA, 22 nt, Human
ucauuccucuuucccaagggca

SEQ ID NO: 231450 - RNA, 32 nt, Human
ucauuccucuuuugaaacuuucugcuuugccu

SEQ ID NO: 231451 - RNA, 32 nt, Human
ucauuccugcacugguugccaccaacauucuc

SEQ ID NO: 231452 - RNA, 32 nt, Human
ucauuccugcaggagcugcagccacccaaagu

SEQ ID NO: 231453 - RNA, 32 nt, Human
ucauuccugccugaagccaugacccgcuucuc

SEQ ID NO: 231454 - RNA, 32 nt, Human
ucauuccuggaaccagccaggccaggcaacca

SEQ ID NO: 231455 - RNA, 32 nt, Human
ucauuccugguaaaacagcagcugguuagcca

SEQ ID NO: 231456 - RNA, 24 nt, Human
ucauuccuguaaucccagcacuuu

SEQ ID NO: 231457 - RNA, 32 nt, Human
ucauuccuguaaucccagcacuuugggaggcc

SEQ ID NO: 231458 - RNA, 32 nt, Human
ucauuccuguaaucccagcucuuugggaggcu

SEQ ID NO: 231459 - RNA, 32 nt, Human
ucauuccuucaaaacagagagccuuaaucuuu

SEQ ID NO: 231460 - RNA, 32 nt, Human
ucauuccuucauuccuuccuuuguuccuuugu

SEQ ID NO: 231461 - RNA, 32 nt, Human
ucauuccuugguuugugacugcaucucccucu

SEQ ID NO: 231462 - RNA, 32 nt, Human
ucauucgagacaacauguguguaugugugugu

SEQ ID NO: 231463 - RNA, 32 nt, Human
ucauucgcugggacuuaagaaaggagauauuu

SEQ ID NO: 231464 - RNA, 32 nt, Human
ucauucggacacugauuugcagugcauuggca

SEQ ID NO: 231465 - RNA, 32 nt, Human
ucauucuaagccucuggagagacuguaaugau

SEQ ID NO: 231466 - RNA, 32 nt, Human
ucauucuaguuaagauucauuucacaaaauuu

SEQ ID NO: 231467 - RNA, 32 nt, Human
ucauucucaaguggcugcaauuacaggcaacc

SEQ ID NO: 231468 - RNA, 32 nt, Human
ucauucucacucugcuuugcaucccccaaacu

SEQ ID NO: 231469 - RNA, 32 nt, Human
ucauucucagaaaauccaaccauaucuuagag

SEQ ID NO: 231470 - RNA, 32 nt, Human
ucauucucaggcacccacuccccacacaaugc

SEQ ID NO: 231471 - RNA, 32 nt, Human
ucauucucaucuguugaggaugugggaacuuu

SEQ ID NO: 231472 - RNA, 32 nt, Human
ucauucuccagaaccagguguggauugugauc

SEQ ID NO: 231473 - RNA, 32 nt, Human
ucauucuccccaguagcugggauuacaggugc

SEQ ID NO: 231474 - RNA, 32 nt, Human
ucauucuccugaguagcugggauugcuggugc

SEQ ID NO: 231475 - RNA, 32 nt, Human
ucauucuccugccucagccucccgaguagcug

SEQ ID NO: 231476 - RNA, 32 nt, Human
ucauucuccugccucagccucuugcgagcuga

SEQ ID NO: 231477 - RNA, 32 nt, Human
ucauucuccuuccuuuuuccucccgcuucccu

SEQ ID NO: 231478 - RNA, 32 nt, Human
ucauucucuccaccaggccuccagguccugag

SEQ ID NO: 231479 - RNA, 16 nt, Human
ucauucucuccccucc

SEQ ID NO: 231480 - RNA, 32 nt, Human
ucauucucucugagcagaggagcaggaauccc

SEQ ID NO: 231481 - RNA, 32 nt, Human
ucauucucucuuccuucccuccuuccuacuuc

SEQ ID NO: 231482 - RNA, 32 nt, Human
ucauucucugcagcagcugccugggcccaagg

SEQ ID NO: 231483 - RNA, 32 nt, Human
ucauucucuggccucaucuugucgcucuccuc

SEQ ID NO: 231484 - RNA, 32 nt, Human
ucauucugaaucucuaccagcugcucccagaa

SEQ ID NO: 231485 - RNA, 32 nt, Human
ucauucugcuaaucauuguuacagaaugguga

SEQ ID NO: 231486 - RNA, 32 nt, Human
ucauucugcucccuauguuauuucaagggccu

SEQ ID NO: 231487 - RNA, 32 nt, Human
ucauucugcuggggguagagaugaggggaggg

SEQ ID NO: 231488 - RNA, 32 nt, Human
ucauucugcuuuguacuaggacaccaaagaca

SEQ ID NO: 231489 - RNA, 32 nt, Human
ucauucuggaaccauacuaucaaauggcgaca

SEQ ID NO: 231490 - RNA, 32 nt, Human
ucauucuggccuggccugguuuugccaucuga

SEQ ID NO: 231491 - RNA, 32 nt, Human
ucauucugucaugcugccccagugagauagug

SEQ ID NO: 231492 - RNA, 32 nt, Human
ucauucugugugcguuguggggugggggaggg

SEQ ID NO: 231493 - RNA, 32 nt, Human
ucauucuguguggaggugaguggaguggggca

SEQ ID NO: 231494 - RNA, 32 nt, Human
ucauucuguuuucuagacugugcuacagccug

SEQ ID NO: 231495 - RNA, 32 nt, Human
ucauucuguuuuugcuuaaaauaaucugcaac

SEQ ID NO: 231496 - RNA, 32 nt, Human
ucauucuuaucuuucuucuguuucuuccuccc

SEQ ID NO: 231497 - RNA, 32 nt, Human
ucauucuuccuugauugugaccaugcccaggc

SEQ ID NO: 231498 - RNA, 32 nt, Human
ucauucuugaguggagagacagaggaagcaaa

SEQ ID NO: 231499 - RNA, 32 nt, Human
ucauucuugauuaaaugcacugaaaaguaaag

SEQ ID NO: 231500 - RNA, 32 nt, Human
ucauucuugcaguugccauacagugccuuucc

SEQ ID NO: 231501 - RNA, 32 nt, Human
ucauucuugcuaaccuagucuaggugaccuac

SEQ ID NO: 231502 - RNA, 32 nt, Human
ucauucuugcuccccgguaccuggauuuuucu

SEQ ID NO: 231503 - RNA, 32 nt, Human
ucauucuugcugcuucagccccuaucacauag

SEQ ID NO: 231504 - RNA, 32 nt, Human
ucauucuuggaagguggcagagccaagaguaa

SEQ ID NO: 231505 - RNA, 32 nt, Human
ucauucuuuucccccuuccuucucaucuuccu

SEQ ID NO: 231506 - RNA, 32 nt, Human
ucauucuuuucugaaguuguguguugcugcua

SEQ ID NO: 231507 - RNA, 32 nt, Human
ucauugaaaaugugagaguugauauaccagcc

SEQ ID NO: 231508 - RNA, 32 nt, Human
ucauugaaaauguuaauuacacacacaugcau

SEQ ID NO: 231509 - RNA, 32 nt, Human
ucauugaaaccagcuucagaaaacaagaugcc

SEQ ID NO: 231510 - RNA, 32 nt, Human
ucauugaacaucagaggacauauccuggagaa

SEQ ID NO: 231511 - RNA, 32 nt, Human
ucauugaagggaaaaugugagcauuaagcacu

SEQ ID NO: 231512 - RNA, 32 nt, Human
ucauugacaauguaguuggccacccaagagcu

SEQ ID NO: 231513 - RNA, 32 nt, Human
ucauugaccagaaggcuuucuuagucccaaca

SEQ ID NO: 231514 - RNA, 32 nt, Human
ucauugaccugaggcccuucucuccagccccu

SEQ ID NO: 231515 - RNA, 32 nt, Human
ucauugagaaacacccucacaggaacacucag

SEQ ID NO: 231516 - RNA, 32 nt, Human
ucauugagcaccuacuaugugccaggccaauu

SEQ ID NO: 231517 - RNA, 32 nt, Human
ucauugagcagcaggaggcugaaggaggggag

SEQ ID NO: 231518 - RNA, 32 nt, Human
ucauugagcuggcagagcuggagcucaaacac

SEQ ID NO: 231519 - RNA, 32 nt, Human
ucauugaggaagcaacuacagauucagcaaca

SEQ ID NO: 231520 - RNA, 32 nt, Human
ucauugagggaaugccuuggaaggcaaagucc

SEQ ID NO: 231521 - RNA, 32 nt, Human
ucauugauaacucccuuucucccuucccuucu

SEQ ID NO: 231522 - RNA, 32 nt, Human
ucauugauauccacuggucacaucauaacugu

SEQ ID NO: 231523 - RNA, 32 nt, Human
ucauugaugccugggauauaacaauugcauau

SEQ ID NO: 231524 - RNA, 32 nt, Human
ucauugauguuggguggaugaaucugugagug

SEQ ID NO: 231525 - RNA, 32 nt, Human
ucauugauugaauaguuauaaagauguuauag

SEQ ID NO: 231526 - RNA, 32 nt, Human
ucauugcacauuacaugaucacuuccagagua

SEQ ID NO: 231527 - RNA, 32 nt, Human
ucauugcaccacuuuacuuagccugggugaca

SEQ ID NO: 231528 - RNA, 32 nt, Human
ucauugcacugagugaccugcuuccugauugc

SEQ ID NO: 231529 - RNA, 32 nt, Human
ucauugcacugcccuggcacaugggcacaacg

SEQ ID NO: 231530 - RNA, 32 nt, Human
ucauugcagccaucacaaggugcgaucgaagc

SEQ ID NO: 231531 - RNA, 32 nt, Human
ucauugcagccucaaacuccugggcucaagca

SEQ ID NO: 231532 - RNA, 32 nt, Human
ucauugcagccucagacuccuggguucaagca

SEQ ID NO: 231533 - RNA, 32 nt, Human
ucauugcagccuccacuuccugggcucaagcg

SEQ ID NO: 231534 - RNA, 32 nt, Human
ucauugcagccucgaacuccugggcucauauu

SEQ ID NO: 231535 - RNA, 32 nt, Human
ucauugcagccucgaacuccugggcuuaaggg

SEQ ID NO: 231536 - RNA, 32 nt, Human
ucauugcagccuucaauuccugggcucaggca

SEQ ID NO: 231537 - RNA, 32 nt, Human
ucauugcagcuuugaccuccugggcuuaggug

SEQ ID NO: 231538 - RNA, 32 nt, Human
ucauugcaggaaugaaugcuguggaagaaaac

SEQ ID NO: 231539 - RNA, 32 nt, Human
ucauugcagugcggcggcccuaccucggcccu

SEQ ID NO: 231540 - RNA, 32 nt, Human
ucauugcauugcacuccagcuugagcaacaga

SEQ ID NO: 231541 - RNA, 24 nt, Human
ucauugccaaauuauuagugaaug

SEQ ID NO: 231542 - RNA, 32 nt, Human
ucauugccaauauggaacagagcccagggcca

SEQ ID NO: 231543 - RNA, 32 nt, Human
ucauugccagaaucuucuucuccuggggucug

SEQ ID NO: 231544 - RNA, 32 nt, Human
ucauugcccaggcuggagugcagugagcuauu

SEQ ID NO: 231545 - RNA, 22 nt, Human
ucauugcccggcaaacacuuuu

SEQ ID NO: 231546 - RNA, 32 nt, Human
ucauugcccuccaguaagggcucaggguuuug

SEQ ID NO: 231547 - RNA, 32 nt, Human
ucauugccgacacugcagcagaaucucuccgg

SEQ ID NO: 231548 - RNA, 32 nt, Human
ucauugccguuacacuucccagccuggugguc

SEQ ID NO: 231549 - RNA, 32 nt, Human
ucauugccucaaacccugggguagguggaacg

SEQ ID NO: 231550 - RNA, 32 nt, Human
ucauugccucacaggcccugagccucccgaag

SEQ ID NO: 231551 - RNA, 32 nt, Human
ucauugccugcacuuacuggucggaagagaga

SEQ ID NO: 231552 - RNA, 32 nt, Human
ucauugccuguaaucccagcacuuugggaggc

SEQ ID NO: 231553 - RNA, 32 nt, Human
ucauugccuuccugggcaacccggccaaaggc

SEQ ID NO: 231554 - RNA, 32 nt, Human
ucauugccuucucccuuccuguucccucaucc

SEQ ID NO: 231555 - RNA, 32 nt, Human
ucauugcgccacugcaaaccagccugggcaau

SEQ ID NO: 231556 - RNA, 32 nt, Human
ucauugcgucccccucugcccacuggacuugg

SEQ ID NO: 231557 - RNA, 32 nt, Human
ucauugcucacuguagccucgaauuccugggc

SEQ ID NO: 231558 - RNA, 32 nt, Human
ucauugcuccuucucagugaucuuugagcucc

SEQ ID NO: 231559 - RNA, 32 nt, Human
ucauugcucugcagaacucaaaaagaaaauug

SEQ ID NO: 231560 - RNA, 32 nt, Human
ucauugcugaggucaaggcacaguagaggaga

SEQ ID NO: 231561 - RNA, 32 nt, Human
ucauugcugcagcuccuugucgacaucauccc

SEQ ID NO: 231562 - RNA, 32 nt, Human
ucauugcuggggaugggaaggagaagcagugg

SEQ ID NO: 231563 - RNA, 32 nt, Human
ucauugcuggucccagcacaccuggaaaguuc

SEQ ID NO: 231564 - RNA, 21 nt, Human
ucauugcuuccacaguuaaug

SEQ ID NO: 231565 - RNA, 32 nt, Human
ucauugcuugucucccuggcaugugccaguua

SEQ ID NO: 231566 - RNA, 32 nt, Human
ucauugcuuugcuaaggagggaaggaaguuac

SEQ ID NO: 231567 - RNA, 32 nt, Human
ucauuggaaacccagaggcugcagagagcaaa

SEQ ID NO: 231568 - RNA, 32 nt, Human
ucauuggaaggaaaaagaagguacuauuuuua

SEQ ID NO: 231569 - RNA, 32 nt, Human
ucauuggaauccacguuuuggccacaguaguu

SEQ ID NO: 231570 - RNA, 32 nt, Human
ucauuggagguugggaaggaagugaggagaaa

SEQ ID NO: 231571 - RNA, 31 nt, Human
ucauuggauauaaaagagugauuuuccucac

SEQ ID NO: 231572 - RNA, 32 nt, Human
ucauuggcaagggacaggcucaugggagcugg

SEQ ID NO: 231573 - RNA, 32 nt, Human
ucauuggcagacauauauguccuugaaccuuu

SEQ ID NO: 231574 - RNA, 27 nt, Human
ucauuggcagagagcauugcuagugag

SEQ ID NO: 231575 - RNA, 32 nt, Human
ucauuggcaguggaugaagccuaagccagcug

SEQ ID NO: 231576 - RNA, 32 nt, Human
ucauuggccaggacccucagacccacgggcca

SEQ ID NO: 231577 - RNA, 32 nt, Human
ucauuggcucacugcagccuagaccucccagc

SEQ ID NO: 231578 - RNA, 32 nt, Human
ucauuggcugcuugcaggcugcugauuggcug

SEQ ID NO: 231579 - RNA, 32 nt, Human
ucauuggcuucugauuggcugccuguaagaua

SEQ ID NO: 231580 - RNA, 32 nt, Human
ucauugggccacugcagucgagccugggcgac

SEQ ID NO: 231581 - RNA, 32 nt, Human
ucauugggccugguuccaguucuguagccauu

SEQ ID NO: 231582 - RNA, 32 nt, Human
ucauuggggaagagagccugaggcuggcaauc

SEQ ID NO: 231583 - RNA, 31 nt, Human
ucauuggggauucugccucagguacuuugau

SEQ ID NO: 231584 - RNA, 32 nt, Human
ucauuggggcauccccuuucugcugcaggaac

SEQ ID NO: 231585 - RNA, 32 nt, Human
ucauuggggguaaggguaugaggugaucagga

SEQ ID NO: 231586 - RNA, 32 nt, Human
ucauuggguugcaggccauggaggagggaccu

SEQ ID NO: 231587 - RNA, 32 nt, Human
ucauuggucugucugggacgugcaguguucau

SEQ ID NO: 231588 - RNA, 32 nt, Human
ucauuguaacaccagagugcagccuggaucuc

SEQ ID NO: 231589 - RNA, 32 nt, Human
ucauuguaaccagcauuuuguaauacucuuaa

SEQ ID NO: 231590 - RNA, 32 nt, Human
ucauuguaaguucuguccuacagagaagugug

SEQ ID NO: 231591 - RNA, 32 nt, Human
ucauuguacacagcagccaguuuucaucggug

SEQ ID NO: 231592 - RNA, 32 nt, Human
ucauuguacagggggaaauggguaugagagac

SEQ ID NO: 231593 - RNA, 32 nt, Human
ucauuguacugcaaccucagcuggcaucaugg

SEQ ID NO: 231594 - RNA, 32 nt, Human
ucauuguagauacuagggaaaagcuuuguuga

SEQ ID NO: 231595 - RNA, 31 nt, Human
ucauuguaguuucaggacuuugucaguacaa

SEQ ID NO: 231596 - RNA, 32 nt, Human
ucauugucacccagacaccacauuacaugcgc

SEQ ID NO: 231597 - RNA, 32 nt, Human
ucauugucacccaggcuggaguacaguggcau

SEQ ID NO: 231598 - RNA, 21 nt, Human
ucauugucauuacuguuuuaa

SEQ ID NO: 231599 - RNA, 32 nt, Human
ucauugucggccucugucucuggcugcccucg

SEQ ID NO: 231600 - RNA, 22 nt, Human
ucauugucgggcacuguccacu

SEQ ID NO: 231601 - RNA, 32 nt, Human
ucauugucucaccuuuugccuggguggcugcc

SEQ ID NO: 231602 - RNA, 32 nt, Human
ucauugucucaucuagacaucaagcagggaaa

SEQ ID NO: 231603 - RNA, 32 nt, Human
ucauugugaagagaaagaaagguauagcaguc

SEQ ID NO: 231604 - RNA, 32 nt, Human
ucauugugacugcugcucucauugcuaucaug

SEQ ID NO: 231605 - RNA, 32 nt, Human
ucauugugagguggaugggggagugaaauugu

SEQ ID NO: 231606 - RNA, 32 nt, Human
ucauugugcacacguggcuugccugaaugaac

SEQ ID NO: 231607 - RNA, 32 nt, Human
ucauugugccaugagguaaauguaauguuuca

SEQ ID NO: 231608 - RNA, 32 nt, Human
ucauugugcugauuuuuggugaucaagccuca

SEQ ID NO: 231609 - RNA, 32 nt, Human
ucauugugcuguccugacaacaugcuccaaac

SEQ ID NO: 231610 - RNA, 32 nt, Human
ucauuguggaagcagaagguugucauggaaau

SEQ ID NO: 231611 - RNA, 32 nt, Human
ucauugugucauuucaaaauguauugauaucu

SEQ ID NO: 231612 - RNA, 32 nt, Human
ucauuguguccccagcccucuucucgguuccc

SEQ ID NO: 231613 - RNA, 32 nt, Human
ucauugugucuuuucugccucugucaggcgaa

SEQ ID NO: 231614 - RNA, 32 nt, Human
ucauuguuccagcauaaugagauggaaucugc

SEQ ID NO: 231615 - RNA, 32 nt, Human
ucauuguucucuccaucucccuagucaucauu

SEQ ID NO: 231616 - RNA, 32 nt, Human
ucauuguugcccaggaagagacggaggaugca

SEQ ID NO: 231617 - RNA, 32 nt, Human
ucauuguuuccuuggccccuguauccagauau

SEQ ID NO: 231618 - RNA, 32 nt, Human
ucauuguuuuccccauccucuuccucaacaca

SEQ ID NO: 231619 - RNA, 32 nt, Human
ucauuguuuuggaagccauggagaccugccuc

SEQ ID NO: 231620 - RNA, 32 nt, Human
ucauuuaacacaugcauuugacauauaaacag

SEQ ID NO: 231621 - RNA, 32 nt, Human
ucauuuaauggaaacugccccucauacaauga

SEQ ID NO: 231622 - RNA, 32 nt, Human
ucauuuacacagugcuuuccagccuuuggugc

SEQ ID NO: 231623 - RNA, 32 nt, Human
ucauuuacuguggcuucuuaaucuuuucacaa

SEQ ID NO: 231624 - RNA, 32 nt, Human
ucauuuacuguugaacacggacaaucauauuc

SEQ ID NO: 231625 - RNA, 32 nt, Human
ucauuuagauugaaaacuuuucucagauggau

SEQ ID NO: 231626 - RNA, 32 nt, Human
ucauuuagguuugaauugggcguauuguguaa

SEQ ID NO: 231627 - RNA, 32 nt, Human
ucauuuaguuuuaauuuauguucagucuccca

SEQ ID NO: 231628 - RNA, 32 nt, Human
ucauuuaucaaaaguaaacacagcauuaguac

SEQ ID NO: 231629 - RNA, 32 nt, Human
ucauuuaugucugucuuucuaucauaaagaau

SEQ ID NO: 231630 - RNA, 32 nt, Human
ucauuuauucugcuucgaggguccccagggcc

SEQ ID NO: 231631 - RNA, 32 nt, Human
ucauuuauuuauggcccaccagucucccccaa

SEQ ID NO: 231632 - RNA, 32 nt, Human
ucauuuauuucuggagccccugguacacucca

SEQ ID NO: 231633 - RNA, 32 nt, Human
ucauuuauuuuccauugucugucuucggucuu

SEQ ID NO: 231634 - RNA, 32 nt, Human
ucauuucaaauauguacucuugaagucaagca

SEQ ID NO: 231635 - RNA, 32 nt, Human
ucauuucacagccuuucguucugcugaccaaa

SEQ ID NO: 231636 - RNA, 32 nt, Human
ucauuucaccaggagcuuucagaaguuucacc

SEQ ID NO: 231637 - RNA, 32 nt, Human
ucauuucaccucacuccagccugggugacagc

SEQ ID NO: 231638 - RNA, 32 nt, Human
ucauuucagaaaccgaaacagaaacgacauag

SEQ ID NO: 231639 - RNA, 22 nt, Human
ucauuucagaagcuuugcuucu

SEQ ID NO: 231640 - RNA, 32 nt, Human
ucauuucaguucuauugcaguccuggugccau

SEQ ID NO: 231641 - RNA, 32 nt, Human
ucauuucauaggcaucuauuccugccuggugu

SEQ ID NO: 231642 - RNA, 32 nt, Human
ucauuucauaugcacuauaucaaguacaaaca

SEQ ID NO: 231643 - RNA, 32 nt, Human
ucauuucauguuauguuuucauuuccccucug

SEQ ID NO: 231644 - RNA, 32 nt, Human
ucauuucauuuuauucccaucuguuuucaaac

SEQ ID NO: 231645 - RNA, 32 nt, Human
ucauuuccaaaacacauuugguccccagaguu

SEQ ID NO: 231646 - RNA, 32 nt, Human
ucauuuccaagaggggagaaaaaguggaguca

SEQ ID NO: 231647 - RNA, 32 nt, Human
ucauuuccacccaaccccaggauuuccacagc

SEQ ID NO: 231648 - RNA, 32 nt, Human
ucauuuccacccacgcucccagccucuuagcu

SEQ ID NO: 231649 - RNA, 32 nt, Human
ucauuuccacccagccccaggauuuccagagc

SEQ ID NO: 231650 - RNA, 32 nt, Human
ucauuucccaccccugcuccagccucgauuug

SEQ ID NO: 231651 - RNA, 20 nt, Human
ucauuucccacccuuugcca

SEQ ID NO: 231652 - RNA, 22 nt, Human
ucauuucccagggacccuccua

SEQ ID NO: 231653 - RNA, 32 nt, Human
ucauuuccccagccuaggcaagggugaccuuu

SEQ ID NO: 231654 - RNA, 19 nt, Human
ucauuuccccccuugacca

SEQ ID NO: 231655 - RNA, 31 nt, Human
ucauuuccccucucugagccucggugucuuc

SEQ ID NO: 231656 - RNA, 32 nt, Human
ucauuucccuauuuaggccucaguuuaaucac

SEQ ID NO: 231657 - RNA, 32 nt, Human
ucauuuccuagacucuacuccaugauuuaacu

SEQ ID NO: 231658 - RNA, 32 nt, Human
ucauuuccugggaggggagagggugcgaccaa

SEQ ID NO: 231659 - RNA, 32 nt, Human
ucauuuccuucuuuuauuccuccccaccccaa

SEQ ID NO: 231660 - RNA, 32 nt, Human
ucauuucguuuaauuaaagcuaccuccuaaac

SEQ ID NO: 231661 - RNA, 32 nt, Human
ucauuucguuuuggggaagaaaucuguacugu

SEQ ID NO: 231662 - RNA, 32 nt, Human
ucauuucuacagugaagucugaugcuuuguua

SEQ ID NO: 231663 - RNA, 32 nt, Human
ucauuucuauuuuuccccuccuuuccuccucc

SEQ ID NO: 231664 - RNA, 32 nt, Human
ucauuucucaggagaacuuauggcuucagaau

SEQ ID NO: 231665 - RNA, 32 nt, Human
ucauuucuccggaagcugagccagucuccugg

SEQ ID NO: 231666 - RNA, 32 nt, Human
ucauuucucuuccuccucaccuccaccacccc

SEQ ID NO: 231667 - RNA, 32 nt, Human
ucauuucugcauuggagagacuucucauacuu

SEQ ID NO: 231668 - RNA, 32 nt, Human
ucauuucugccagcuucuuaugguccugaggc

SEQ ID NO: 231669 - RNA, 32 nt, Human
ucauuucugcuggcuuuucuccaaugaacauu

SEQ ID NO: 231670 - RNA, 32 nt, Human
ucauuucuggagauggggcagcagguggcucu

SEQ ID NO: 231671 - RNA, 32 nt, Human
ucauuucugucugacuugaguacccggggucc

SEQ ID NO: 231672 - RNA, 32 nt, Human
ucauuucuuagcagccucucuacauacaucuc

SEQ ID NO: 231673 - RNA, 32 nt, Human
ucauuucuucuuuucccuguggcaucguggau

SEQ ID NO: 231674 - RNA, 32 nt, Human
ucauuucuugacuuucauguggguaaccaguu

SEQ ID NO: 231675 - RNA, 32 nt, Human
ucauuucuugccaauaggaaggcuggugcuuc

SEQ ID NO: 231676 - RNA, 32 nt, Human
ucauuucuuuacugcugccauuuuccucacca

SEQ ID NO: 231677 - RNA, 32 nt, Human
ucauuugaaccuaggagguggcgguugcugug

SEQ ID NO: 231678 - RNA, 32 nt, Human
ucauuugaacuuaccuaaaagacuuguauuuc

SEQ ID NO: 231679 - RNA, 31 nt, Human
ucauuugacaacacaugugggagaggagguc

SEQ ID NO: 231680 - RNA, 32 nt, Human
ucauuugagagggagagcugugguacuggcua

SEQ ID NO: 231681 - RNA, 32 nt, Human
ucauuugagccaggagguugagguugcaguga

SEQ ID NO: 231682 - RNA, 32 nt, Human
ucauuugagcccagagguagaggcugcaguga

SEQ ID NO: 231683 - RNA, 32 nt, Human
ucauuugagcccaggaggucaaggcugcagug

SEQ ID NO: 231684 - RNA, 32 nt, Human
ucauuugagcccaggaguuccagaccagccua

SEQ ID NO: 231685 - RNA, 32 nt, Human
ucauuugagcugggauucccacauccucugag

SEQ ID NO: 231686 - RNA, 32 nt, Human
ucauuugaguuaacagugguguuagugauaga

SEQ ID NO: 231687 - RNA, 32 nt, Human
ucauuugauagucugugauccauuucaaguug

SEQ ID NO: 231688 - RNA, 32 nt, Human
ucauuugaugauuuucuagaguguaguggcgu

SEQ ID NO: 231689 - RNA, 32 nt, Human
ucauuugauguacauaccacacuccuuggcuu

SEQ ID NO: 231690 - RNA, 32 nt, Human
ucauuugcaagagcaccucuucagauauggca

SEQ ID NO: 231691 - RNA, 32 nt, Human
ucauuugcacacaaaaauaaagacuagagcaa

SEQ ID NO: 231692 - RNA, 31 nt, Human
ucauuugcacuuugacagagcagaggcagag

SEQ ID NO: 231693 - RNA, 21 nt, Human
ucauuugcagcaaacuguaca

SEQ ID NO: 231694 - RNA, 32 nt, Human
ucauuugcagcaguucuaguuccugacuuuua

SEQ ID NO: 231695 - RNA, 32 nt, Human
ucauuugcccuuaaggacaaaaaugaacugaa

SEQ ID NO: 231696 - RNA, 32 nt, Human
ucauuugcgaaaagcaggcucaucgaauacag

SEQ ID NO: 231697 - RNA, 32 nt, Human
ucauuugcuacaccaacuauguuuucagaauu

SEQ ID NO: 231698 - RNA, 32 nt, Human
ucauuugcucuaauucucaacuguaggcaaac

SEQ ID NO: 231699 - RNA, 32 nt, Human
ucauuugcucuaauucucaauuguaggcaaac

SEQ ID NO: 231700 - RNA, 32 nt, Human
ucauuugcugaaugggggaccugcucugagcc

SEQ ID NO: 231701 - RNA, 32 nt, Human
ucauuugcugccucuuggucaucaggagcugc

SEQ ID NO: 231702 - RNA, 32 nt, Human
ucauuugcuggagcucugcccauccugccccu

SEQ ID NO: 231703 - RNA, 32 nt, Human
ucauuugcuguugcuugcugaacugugaagaa

SEQ ID NO: 231704 - RNA, 32 nt, Human
ucauuuggaaaaagugaguacuguggauauuu

SEQ ID NO: 231705 - RNA, 32 nt, Human
ucauuuggaaagggaaaaccagcuucuguugc

SEQ ID NO: 231706 - RNA, 32 nt, Human
ucauuuggccuccuccugacuuguugcuccag

SEQ ID NO: 231707 - RNA, 32 nt, Human
ucauuugggggcugaaguuagcaacugggccu

SEQ ID NO: 231708 - RNA, 32 nt, Human
ucauuugggguuuggcauccugcccagccacu

SEQ ID NO: 231709 - RNA, 32 nt, Human
ucauuuggguaugaggaucaaaucaugacugc

SEQ ID NO: 231710 - RNA, 32 nt, Human
ucauuugguaggcggagagugaauuaccaaca

SEQ ID NO: 231711 - RNA, 32 nt, Human
ucauuuggucucauggcaguaagccucaugua

SEQ ID NO: 231712 - RNA, 32 nt, Human
ucauuugguuccuguuaaaguuguucucacug

SEQ ID NO: 231713 - RNA, 32 nt, Human
ucauuuguccaaauuucugggcucagcgcuug

SEQ ID NO: 231714 - RNA, 32 nt, Human
ucauuuguggaugucauggaauuucgggauca

SEQ ID NO: 231715 - RNA, 32 nt, Human
ucauuuguguguggcuuugcguuccaggcugu

SEQ ID NO: 231716 - RNA, 32 nt, Human
ucauuuguguuuuuggggaauguuuggaccua

SEQ ID NO: 231717 - RNA, 32 nt, Human
ucauuuguuaaaggagaagcaagagcaagaac

SEQ ID NO: 231718 - RNA, 32 nt, Human
ucauuuguuagccaagcaaagccauuuauuga

SEQ ID NO: 231719 - RNA, 32 nt, Human
ucauuuguucucucccugcuccaacccugcag

SEQ ID NO: 231720 - RNA, 32 nt, Human
ucauuuguugcagaaaaacaauggauacauuu

SEQ ID NO: 231721 - RNA, 32 nt, Human
ucauuuguuucugauuguuuucauccugauac

SEQ ID NO: 231722 - RNA, 32 nt, Human
ucauuuuacauacacacacauauuuuacacac

SEQ ID NO: 231723 - RNA, 32 nt, Human
ucauuuuaggaacuaaggaaaauaaauuuaaa

SEQ ID NO: 231724 - RNA, 31 nt, Human
ucauuuuaguucauugagguuggcagggauu

SEQ ID NO: 231725 - RNA, 32 nt, Human
ucauuuuauauguccagaaauggcuuugaauu

SEQ ID NO: 231726 - RNA, 32 nt, Human
ucauuuuaugagaucgcuaucuguaaguccag

SEQ ID NO: 231727 - RNA, 32 nt, Human
ucauuuuauguuuuauauagcuuucuuagaca

SEQ ID NO: 231728 - RNA, 32 nt, Human
ucauuuucaggucugcagaaccauagcuucca

SEQ ID NO: 231729 - RNA, 32 nt, Human
ucauuuucaucuuuucuugcugcuacccaucu

SEQ ID NO: 231730 - RNA, 32 nt, Human
ucauuuucauggcagaccuaagcucagacccu

SEQ ID NO: 231731 - RNA, 32 nt, Human
ucauuuucauuuccauuaaccuggaagcuuuc

SEQ ID NO: 231732 - RNA, 32 nt, Human
ucauuuuccauuucugaaaacucccagguggu

SEQ ID NO: 231733 - RNA, 32 nt, Human
ucauuuucccccagaaagggugcaguggccuc

SEQ ID NO: 231734 - RNA, 32 nt, Human
ucauuuucccuucacagauuccuccgccagaa

SEQ ID NO: 231735 - RNA, 32 nt, Human
ucauuuucguaacagucgucgaacuaggccuc

SEQ ID NO: 231736 - RNA, 32 nt, Human
ucauuuucuaauucucuuuucaaacacacaca

SEQ ID NO: 231737 - RNA, 32 nt, Human
ucauuuucuagcccucucccucaguccuuuau

SEQ ID NO: 231738 - RNA, 32 nt, Human
ucauuuucucacguuggucuucuaaagucacc

SEQ ID NO: 231739 - RNA, 32 nt, Human
ucauuuucugaauggauugauuccaauaaaag

SEQ ID NO: 231740 - RNA, 21 nt, Human
ucauuuucugaauuacuuggu

SEQ ID NO: 231741 - RNA, 32 nt, Human
ucauuuucugccucuuugugugucuauuaauc

SEQ ID NO: 231742 - RNA, 32 nt, Human
ucauuuucuucagggaaucacagucucuccuc

SEQ ID NO: 231743 - RNA, 32 nt, Human
ucauuuugagcaauuuugcccuguguuauaug

SEQ ID NO: 231744 - RNA, 32 nt, Human
ucauuuugauuuucucucucacaaucaguaau

SEQ ID NO: 231745 - RNA, 32 nt, Human
ucauuuugcacuguaaauugcuggcagaugcu

SEQ ID NO: 231746 - RNA, 32 nt, Human
ucauuuugcaggcuggaagcaccagggaauua

SEQ ID NO: 231747 - RNA, 32 nt, Human
ucauuuugccaugagccagucuugagauuuuc

SEQ ID NO: 231748 - RNA, 32 nt, Human
ucauuuuggaaaugcuucuccaccaaauaagg

SEQ ID NO: 231749 - RNA, 32 nt, Human
ucauuuuggcugcuuuugauuauuuuauacag

SEQ ID NO: 231750 - RNA, 32 nt, Human
ucauuuugggcugccuuagccaugaagcuccu

SEQ ID NO: 231751 - RNA, 32 nt, Human
ucauuuugguucuguguuuugacauuuuuccc

SEQ ID NO: 231752 - RNA, 32 nt, Human
ucauuuuguguuaauagucuauaguaacucgg

SEQ ID NO: 231753 - RNA, 32 nt, Human
ucauuuuguuuucauaagacaauguuucagau

SEQ ID NO: 231754 - RNA, 32 nt, Human
ucauuuuuaaaaagaaguuuucauggcaucag

SEQ ID NO: 231755 - RNA, 32 nt, Human
ucauuuuucagaccuuuuaacuccucaauucc

SEQ ID NO: 231756 - RNA, 32 nt, Human
ucauuuuuccaucugcugaaaugccauuucag

SEQ ID NO: 231757 - RNA, 32 nt, Human
ucauuuuuccucaugcagauaacagcaggaag

SEQ ID NO: 231758 - RNA, 32 nt, Human
ucauuuuuccuccucccuccccaaaccccaag

SEQ ID NO: 231759 - RNA, 32 nt, Human
ucauuuuucucaagaugugagcucuuuaucaa

SEQ ID NO: 231760 - RNA, 23 nt, Human
ucauuuuucucuucugaacccca

SEQ ID NO: 231761 - RNA, 32 nt, Human
ucauuuuucuucuuguggccucuggaauguga

SEQ ID NO: 231762 - RNA, 32 nt, Human
ucauuuuucuuuucuuuuuacauauguacaaa

SEQ ID NO: 231763 - RNA, 32 nt, Human
ucauuuuugggaacuccuuuccaaagccauau

SEQ ID NO: 231764 - RNA, 31 nt, Human
ucauuuuuguauuuauuucauuuaaaaucau

SEQ ID NO: 231765 - RNA, 32 nt, Human
ucauuuuuguuuccuuuguuccuuuuuacguu

SEQ ID NO: 231766 - RNA, 23 nt, Human
ucauuuuuugucuucuguuuuaa

SEQ ID NO: 231767 - RNA, 32 nt, Human
uccaaaaacaaaaacaaaacacacaccacaca

SEQ ID NO: 231768 - RNA, 32 nt, Human
uccaaaaaccaaaucagaugaaucaggggagg

SEQ ID NO: 231769 - RNA, 32 nt, Human
uccaaaaagaacaaauacacguauguuauaac

SEQ ID NO: 231770 - RNA, 32 nt, Human
uccaaaaagaagauccguuucuucucaaagau

SEQ ID NO: 231771 - RNA, 32 nt, Human
uccaaaaagagcuuccuuucgugacgagacgc

SEQ ID NO: 231772 - RNA, 32 nt, Human
uccaaaaaggccaacgaucugccccucagccu

SEQ ID NO: 231773 - RNA, 32 nt, Human
uccaaaaaucuacucuuccucuacaucuuacu

SEQ ID NO: 231774 - RNA, 32 nt, Human
uccaaaaauucacauaguauuaccucacagua

SEQ ID NO: 231775 - RNA, 32 nt, Human
uccaaaacaaagagagcacagguugugcaaga

SEQ ID NO: 231776 - RNA, 32 nt, Human
uccaaaacacauauguuggaaaucgcuuuugc

SEQ ID NO: 231777 - RNA, 32 nt, Human
uccaaaaccaaggaaguccuugguguucucca

SEQ ID NO: 231778 - RNA, 20 nt, Human
uccaaaaccugccauucuca

SEQ ID NO: 231779 - RNA, 32 nt, Human
uccaaaagaaaccagcccugcccacgccuuga

SEQ ID NO: 231780 - RNA, 32 nt, Human
uccaaaagaccggcaauaacacuugcugguga

SEQ ID NO: 231781 - RNA, 32 nt, Human
uccaaaagauuaaaaggaguuguucuuuucuc

SEQ ID NO: 231782 - RNA, 32 nt, Human
uccaaaagccgaguccucugauggcucccuua

SEQ ID NO: 231783 - RNA, 32 nt, Human
uccaaaagccucuucccucccuuuccuuuucc

SEQ ID NO: 231784 - RNA, 32 nt, Human
uccaaaagccugagaagagagaaguggagggg

SEQ ID NO: 231785 - RNA, 19 nt, Human
uccaaaagcucccagggcc

SEQ ID NO: 231786 - RNA, 22 nt, Human
uccaaaagucaaaauacuguga

SEQ ID NO: 231787 - RNA, 32 nt, Human
uccaaaagucucaguguaauagcaggaccaaa

SEQ ID NO: 231788 - RNA, 32 nt, Human
uccaaaagugaagauuuugugaggaauaagug

SEQ ID NO: 231789 - RNA, 23 nt, Human
uccaaaauagaaauguuuucaua

SEQ ID NO: 231790 - RNA, 32 nt, Human
uccaaaaucacccaaaugagcucguacuuugu

SEQ ID NO: 231791 - RNA, 32 nt, Human
uccaaaauccagcaagaaaaauccuucucaga

SEQ ID NO: 231792 - RNA, 22 nt, Human
uccaaaaugaugccuuggggug

SEQ ID NO: 231793 - RNA, 31 nt, Human
uccaaaauggcauccuccucuggcacugcaa

SEQ ID NO: 231794 - RNA, 32 nt, Human
uccaaaauguugaucuuccacugcaaauuuca

SEQ ID NO: 231795 - RNA, 32 nt, Human
uccaaaauuuacuaauacagaagcuugacaag

SEQ ID NO: 231796 - RNA, 32 nt, Human
uccaaacaaaacugggcacagagaaucagcua

SEQ ID NO: 231797 - RNA, 32 nt, Human
uccaaacaauguuacugcugggcacagcucug

SEQ ID NO: 231798 - RNA, 32 nt, Human
uccaaacaccucagccaccaggaaaagggagu

SEQ ID NO: 231799 - RNA, 32 nt, Human
uccaaacagaccagcucccugccuugccagga

SEQ ID NO: 231800 - RNA, 32 nt, Human
uccaaacagcccuucagguauggaaucauccc

SEQ ID NO: 231801 - RNA, 32 nt, Human
uccaaacagggaucugucucuuuggcucucag

SEQ ID NO: 231802 - RNA, 32 nt, Human
uccaaacauggccucucucuuuacuuggacuu

SEQ ID NO: 231803 - RNA, 32 nt, Human
uccaaacauguaggaggaaaugaggaaaucgc

SEQ ID NO: 231804 - RNA, 21 nt, Human
uccaaacauguucccaaggcc

SEQ ID NO: 231805 - RNA, 32 nt, Human
uccaaaccacacacaaagcacaaguaaagccu

SEQ ID NO: 231806 - RNA, 32 nt, Human
uccaaaccccugccuggaagacgggcugucgc

SEQ ID NO: 231807 - RNA, 32 nt, Human
uccaaacccuucagaagaagguaguaaacuug

SEQ ID NO: 231808 - RNA, 32 nt, Human
uccaaacccuugcacauauccaaaaggugcau

SEQ ID NO: 231809 - RNA, 32 nt, Human
uccaaaccucaaguccucuuggaggccugugu

SEQ ID NO: 231810 - RNA, 32 nt, Human
uccaaaccuuauacugaauaacuacugaaucc

SEQ ID NO: 231811 - RNA, 32 nt, Human
uccaaacgaauuugucaauuacuccaacgcgg

SEQ ID NO: 231812 - RNA, 32 nt, Human
uccaaacgcaggaauuagaaguagccuugugu

SEQ ID NO: 231813 - RNA, 32 nt, Human
uccaaacucaggaaguuugcagagagcagaca

SEQ ID NO: 231814 - RNA, 32 nt, Human
uccaaacuccacguaguaacagcagcugaaag

SEQ ID NO: 231815 - RNA, 21 nt, Human
uccaaacucgaaccccaggca

SEQ ID NO: 231816 - RNA, 32 nt, Human
uccaaacugaugcccaauaugcagccuauauc

SEQ ID NO: 231817 - RNA, 32 nt, Human
uccaaacugccugggccguggcugccucguga

SEQ ID NO: 231818 - RNA, 21 nt, Human
uccaaacugcuugccaccucu

SEQ ID NO: 231819 - RNA, 20 nt, Human
uccaaacuggagugcagugg

SEQ ID NO: 231820 - RNA, 24 nt, Human
uccaaacugggugacauggugaga

SEQ ID NO: 231821 - RNA, 32 nt, Human
uccaaacuucacacuucccugccugcagagga

SEQ ID NO: 231822 - RNA, 32 nt, Human
uccaaacuugcagacagggcagggagcgguca

SEQ ID NO: 231823 - RNA, 32 nt, Human
uccaaagaacuccaccaggaauuccugugacg

SEQ ID NO: 231824 - RNA, 32 nt, Human
uccaaagacagugacagcugacugagggcaaa

SEQ ID NO: 231825 - RNA, 32 nt, Human
uccaaagacaugcuauguuagcauuugaugca

SEQ ID NO: 231826 - RNA, 32 nt, Human
uccaaagacugugcuucauccauccacuuugc

SEQ ID NO: 231827 - RNA, 32 nt, Human
uccaaagagacacacuaauaaauacuucauua

SEQ ID NO: 231828 - RNA, 32 nt, Human
uccaaagagcuacuucgugacacuggccaucu

SEQ ID NO: 231829 - RNA, 32 nt, Human
uccaaagaggagaugauagaauaauacauuca

SEQ ID NO: 231830 - RNA, 32 nt, Human
uccaaagaguuucuuuuacaggcucucagauc

SEQ ID NO: 231831 - RNA, 32 nt, Human
uccaaagauccagcaggguaucaggaaagaau

SEQ ID NO: 231832 - RNA, 32 nt, Human
uccaaagauccucucaccuccaccucccaaag

SEQ ID NO: 231833 - RNA, 32 nt, Human
uccaaagcaagaaucuuucucagugaaaucuc

SEQ ID NO: 231834 - RNA, 31 nt, Human
uccaaagcacuuuuggauacucaggaggaaa

SEQ ID NO: 231835 - RNA, 32 nt, Human
uccaaagcaggcugguuggcauaauauguaau

SEQ ID NO: 231836 - RNA, 23 nt, Human
uccaaagcauuaauauccaauca

SEQ ID NO: 231837 - RNA, 32 nt, Human
uccaaagccagccugggcaacauggugaaacc

SEQ ID NO: 231838 - RNA, 32 nt, Human
uccaaagccaggcuaggacaucugccaccaag

SEQ ID NO: 231839 - RNA, 32 nt, Human
uccaaagccauggugaaacaucucugugcuaa

SEQ ID NO: 231840 - RNA, 32 nt, Human
uccaaagccccaaaucccuagagugcuuucug

SEQ ID NO: 231841 - RNA, 32 nt, Human
uccaaagccuccugccggcagggaaccaaauc

SEQ ID NO: 231842 - RNA, 32 nt, Human
uccaaagcgugcccuguuucccuuccuuagcg

SEQ ID NO: 231843 - RNA, 32 nt, Human
uccaaagcuugcuuccuuccuccuggcugcac

SEQ ID NO: 231844 - RNA, 32 nt, Human
uccaaagcuuuuucucuguguccacucuccaa

SEQ ID NO: 231845 - RNA, 32 nt, Human
uccaaaggaagucuaggagcugggaggaaaag

SEQ ID NO: 231846 - RNA, 32 nt, Human
uccaaaggacaagucuccuacucccaaaacua

SEQ ID NO: 231847 - RNA, 32 nt, Human
uccaaaggacagugugucacugugaacuggaa

SEQ ID NO: 231848 - RNA, 32 nt, Human
uccaaaggaggaaggagaagaaguaaaagugc

SEQ ID NO: 231849 - RNA, 32 nt, Human
uccaaaggaugccaccaucagcuccaccuggg

SEQ ID NO: 231850 - RNA, 32 nt, Human
uccaaaggauuacaacuccuugccaggaaugg

SEQ ID NO: 231851 - RNA, 32 nt, Human
uccaaaggccacacuuucagcaaacuucacau

SEQ ID NO: 231852 - RNA, 32 nt, Human
uccaaaggccucagccugugccugugucgagc

SEQ ID NO: 231853 - RNA, 27 nt, Human
uccaaaggcucuuuucagagccacuua

SEQ ID NO: 231854 - RNA, 32 nt, Human
uccaaagggaauggggguauggaccugggccu

SEQ ID NO: 231855 - RNA, 32 nt, Human
uccaaagggauaaggcuucagugcuguuggga

SEQ ID NO: 231856 - RNA, 32 nt, Human
uccaaaggucauccuuaauaacaacagaucug

SEQ ID NO: 231857 - RNA, 21 nt, Human
uccaaagguggagguugcagu

SEQ ID NO: 231858 - RNA, 32 nt, Human
uccaaagguuucugaggacuucucccaggaga

SEQ ID NO: 231859 - RNA, 32 nt, Human
uccaaagucacacaaauucuucaagaaauuca

SEQ ID NO: 231860 - RNA, 32 nt, Human
uccaaagucaccaugaggccacccuggaauca

SEQ ID NO: 231861 - RNA, 32 nt, Human
uccaaagucacgugccaaaaucaugucugagc

SEQ ID NO: 231862 - RNA, 32 nt, Human
uccaaaguccuaucucaugccaaaggacagug

SEQ ID NO: 231863 - RNA, 32 nt, Human
uccaaaguccucuaaacugacagggucucauu

SEQ ID NO: 231864 - RNA, 32 nt, Human
uccaaagucugcaucuggauuuggggguguuu

SEQ ID NO: 231865 - RNA, 32 nt, Human
uccaaagucuuucauaggcagaucuugguagc

SEQ ID NO: 231866 - RNA, 32 nt, Human
uccaaagucuuucauuggcagaucuugguagc

SEQ ID NO: 231867 - RNA, 32 nt, Human
uccaaagugagcuccacuuugggucugaggag

SEQ ID NO: 231868 - RNA, 32 nt, Human
uccaaagugauggacaggaaggggcagaguga

SEQ ID NO: 231869 - RNA, 32 nt, Human
uccaaaguguucuuuaguuugagaacuaaaaa

SEQ ID NO: 231870 - RNA, 32 nt, Human
uccaaaguuuuuaaagaauacgggucuguggu

SEQ ID NO: 231871 - RNA, 32 nt, Human
uccaaauaugcugaacuaagguaucuggggga

SEQ ID NO: 231872 - RNA, 32 nt, Human
uccaaaucagauuccucaaaccaccuuugaaa

SEQ ID NO: 231873 - RNA, 32 nt, Human
uccaaaucagauugccaggaagaaauaggacg

SEQ ID NO: 231874 - RNA, 32 nt, Human
uccaaaucagcccuugagauuugaggccuugg

SEQ ID NO: 231875 - RNA, 32 nt, Human
uccaaaucaggaggcaaagaaagagaagaaag

SEQ ID NO: 231876 - RNA, 32 nt, Human
uccaaauccaaucugaauuuaccuggaagagg

SEQ ID NO: 231877 - RNA, 32 nt, Human
uccaaauccagccuguuaccugacuuuuguca

SEQ ID NO: 231878 - RNA, 22 nt, Human
uccaaauccaggagcaacgcca

SEQ ID NO: 231879 - RNA, 32 nt, Human
uccaaauccuuccugggauucccccaaaccca

SEQ ID NO: 231880 - RNA, 18 nt, Human
uccaaaucucugucucuc

SEQ ID NO: 231881 - RNA, 19 nt, Human
uccaaaucuuucccaggcc

SEQ ID NO: 231882 - RNA, 31 nt, Human
uccaaaugacuucugcauuuguaaagauaac

SEQ ID NO: 231883 - RNA, 32 nt, Human
uccaaaugagccacaacacccagccagucaca

SEQ ID NO: 231884 - RNA, 32 nt, Human
uccaaaugauaguguauaugcuaacuggaugc

SEQ ID NO: 231885 - RNA, 32 nt, Human
uccaaaugcaugaugaaggaguucucauccac

SEQ ID NO: 231886 - RNA, 32 nt, Human
uccaaauggaguuucgcucucguugccgaggc

SEQ ID NO: 231887 - RNA, 29 nt, Human
uccaaauggcugcugucuuccucuaguac

SEQ ID NO: 231888 - RNA, 29 nt, Human
uccaaauggcugcuuuugucucccuuacc

SEQ ID NO: 231889 - RNA, 32 nt, Human
uccaaauggucuguuuuggccuccauuccuau

SEQ ID NO: 231890 - RNA, 20 nt, Human
uccaaauggugcccaaggcu

SEQ ID NO: 231891 - RNA, 32 nt, Human
uccaaaugugcaaaauacaugcuucgagcaaa

SEQ ID NO: 231892 - RNA, 20 nt, Human
uccaaauucacccauucuca

SEQ ID NO: 231893 - RNA, 22 nt, Human
uccaaauucagcucuucaguua

SEQ ID NO: 231894 - RNA, 19 nt, Human
uccaaauuccauuaagguc

SEQ ID NO: 231895 - RNA, 32 nt, Human
uccaaauucuggccucucaucccaggcugcag

SEQ ID NO: 231896 - RNA, 23 nt, Human
uccaaauuguaguuuugcugcuc

SEQ ID NO: 231897 - RNA, 21 nt, Human
uccaacaaagacuacauuuug

SEQ ID NO: 231898 - RNA, 22 nt, Human
uccaacaacagcgaccucucca

SEQ ID NO: 231899 - RNA, 32 nt, Human
uccaacaacuccaggaaaacuguuuuucaaaa

SEQ ID NO: 231900 - RNA, 32 nt, Human
uccaacaagacacuccaaagccaacuggauuu

SEQ ID NO: 231901 - RNA, 32 nt, Human
uccaacaagaggcaucagccacugugucuuuc

SEQ ID NO: 231902 - RNA, 32 nt, Human
uccaacaagguguggguggaaagaucaaauua

SEQ ID NO: 231903 - RNA, 32 nt, Human
uccaacaauccucccaucucagccucugaagu

SEQ ID NO: 231904 - RNA, 32 nt, Human
uccaacaaugcgagcauuguucucagaucaca

SEQ ID NO: 231905 - RNA, 20 nt, Human
uccaacaaugggauccaggg

SEQ ID NO: 231906 - RNA, 32 nt, Human
uccaacacaggcaauauuccagcuauggagcu

SEQ ID NO: 231907 - RNA, 32 nt, Human
uccaacacagguuuuggcaucuuuugugcugu

SEQ ID NO: 231908 - RNA, 32 nt, Human
uccaacacauuuucucuuuucauuccccugaa

SEQ ID NO: 231909 - RNA, 32 nt, Human
uccaacacugguuaucucuugucuuuuugaua

SEQ ID NO: 231910 - RNA, 32 nt, Human
uccaacagaaggaggaagugaaaacaaacuau

SEQ ID NO: 231911 - RNA, 32 nt, Human
uccaacagacaggauugugugagcagcugaaa

SEQ ID NO: 231912 - RNA, 32 nt, Human
uccaacagauuucccaacacagucccagaauu

SEQ ID NO: 231913 - RNA, 32 nt, Human
uccaacagccaucaggaguguuucuugaaugc

SEQ ID NO: 231914 - RNA, 32 nt, Human
uccaacagccuggauuaucugcgagauuccug

SEQ ID NO: 231915 - RNA, 32 nt, Human
uccaacagcuuucccugccacuguggguggaa

SEQ ID NO: 231916 - RNA, 32 nt, Human
uccaacaggcacaucuccuccuuugugguucc

SEQ ID NO: 231917 - RNA, 32 nt, Human
uccaacagucaguguuacagcauuucaccuug

SEQ ID NO: 231918 - RNA, 32 nt, Human
uccaacaguggcucccagccugcauggggagg

SEQ ID NO: 231919 - RNA, 32 nt, Human
uccaacaguucuggccuccuggccuucucuca

SEQ ID NO: 231920 - RNA, 32 nt, Human
uccaacauauccacaagcaaguuaucugucuu

SEQ ID NO: 231921 - RNA, 32 nt, Human
uccaacaucucuccccaccucaugauugucau

SEQ ID NO: 231922 - RNA, 32 nt, Human
uccaacaugaccuacaaggaggaagacuucga

SEQ ID NO: 231923 - RNA, 32 nt, Human
uccaacauggugaaacccccaucucuacuaaa

SEQ ID NO: 231924 - RNA, 32 nt, Human
uccaacauuccuccggauggugcucaauuacc

SEQ ID NO: 231925 - RNA, 32 nt, Human
uccaaccaacuugguucugcuucaauaaaucu

SEQ ID NO: 231926 - RNA, 32 nt, Human
uccaaccaaguggaaaggcaaguuggucuuau

SEQ ID NO: 231927 - RNA, 32 nt, Human
uccaaccaaucacaccccucccugcacccaug

SEQ ID NO: 231928 - RNA, 32 nt, Human
uccaaccaccaccaccugacaacccugcaugg

SEQ ID NO: 231929 - RNA, 32 nt, Human
uccaaccaccagcacugacuccugggcucuga

SEQ ID NO: 231930 - RNA, 32 nt, Human
uccaaccagcacaaauuccauagucagguuuu

SEQ ID NO: 231931 - RNA, 24 nt, Human
uccaaccauguggaaucugagggc

SEQ ID NO: 231932 - RNA, 32 nt, Human
uccaaccauuguucuaagcuguguagaagucc

SEQ ID NO: 231933 - RNA, 32 nt, Human
uccaacccaagugccuccagcugaccucuggc

SEQ ID NO: 231934 - RNA, 32 nt, Human
uccaacccaauaagcaggcagcuuugaggaca

SEQ ID NO: 231935 - RNA, 32 nt, Human
uccaacccaccugaaccugccugcacggugga

SEQ ID NO: 231936 - RNA, 32 nt, Human
uccaacccagugcuuccuaagaggguuacgga

SEQ ID NO: 231937 - RNA, 32 nt, Human
uccaaccccaaaacaccacuggccuucuuuca

SEQ ID NO: 231938 - RNA, 32 nt, Human
uccaacccucauucaguauuucuaucaagaaa

SEQ ID NO: 231939 - RNA, 24 nt, Human
uccaacccucgguacagagcagga

SEQ ID NO: 231940 - RNA, 32 nt, Human
uccaaccgggaugggagccgggcaaacuggcc

SEQ ID NO: 231941 - RNA, 32 nt, Human
uccaaccuagcccuacugcccaccccacccca

SEQ ID NO: 231942 - RNA, 24 nt, Human
uccaaccuaggugacagagcaaga

SEQ ID NO: 231943 - RNA, 32 nt, Human
uccaaccuaggugacagagcaagacccugucu

SEQ ID NO: 231944 - RNA, 21 nt, Human
uccaaccucagucuggcccca

SEQ ID NO: 231945 - RNA, 24 nt, Human
uccaaccucugacuggcugguccu

SEQ ID NO: 231946 - RNA, 32 nt, Human
uccaaccugagcgagugggugugugugcaaag

SEQ ID NO: 231947 - RNA, 32 nt, Human
uccaaccugcacuccagccugggcaacagagc

SEQ ID NO: 231948 - RNA, 32 nt, Human
uccaaccuggacaacaagagcgaaacuccguc

SEQ ID NO: 231949 - RNA, 32 nt, Human
uccaaccuggacaacacagcgagauuccgucu

SEQ ID NO: 231950 - RNA, 24 nt, Human
uccaaccuggacaacagagcgaga

SEQ ID NO: 231951 - RNA, 32 nt, Human
uccaaccuggacaacagagcgagacuccaucu

SEQ ID NO: 231952 - RNA, 24 nt, Human
uccaaccuggacgacagagcaaga

SEQ ID NO: 231953 - RNA, 32 nt, Human
uccaaccuggacgacagagcaagacuccaucu

SEQ ID NO: 231954 - RNA, 32 nt, Human
uccaaccuggaugacagagugagacuccagcu

SEQ ID NO: 231955 - RNA, 32 nt, Human
uccaaccugggcaacagaaugagacccugucu

SEQ ID NO: 231956 - RNA, 32 nt, Human
uccaaccugggcaacagagcaagacucggucu

SEQ ID NO: 231957 - RNA, 24 nt, Human
uccaaccugggcaacagaguaaga

SEQ ID NO: 231958 - RNA, 32 nt, Human
uccaaccugggcaacagagugagacccugucu

SEQ ID NO: 231959 - RNA, 24 nt, Human
uccaaccugggcagcagagcaaga

SEQ ID NO: 231960 - RNA, 32 nt, Human
uccaaccugggcagcagagcaagacucugucu

SEQ ID NO: 231961 - RNA, 24 nt, Human
uccaaccugggcgacagagcaaga

SEQ ID NO: 231962 - RNA, 32 nt, Human
uccaaccugggcgacagagcaagacuccaucu

SEQ ID NO: 231963 - RNA, 32 nt, Human
uccaaccugggcgacagagcaagacugugucu

SEQ ID NO: 231964 - RNA, 24 nt, Human
uccaaccugggcgacagggcgaga

SEQ ID NO: 231965 - RNA, 24 nt, Human
uccaaccugggcggcagagugaga

SEQ ID NO: 231966 - RNA, 32 nt, Human
uccaaccuggggaacagagcaagaucuugucu

SEQ ID NO: 231967 - RNA, 24 nt, Human
uccaaccuggguaacagagugaga

SEQ ID NO: 231968 - RNA, 24 nt, Human
uccaaccuggguaacagggcaaga

SEQ ID NO: 231969 - RNA, 32 nt, Human
uccaaccugggugacaagagcaaaacucuguc

SEQ ID NO: 231970 - RNA, 23 nt, Human
uccaaccugggugacaagaguga

SEQ ID NO: 231971 - RNA, 31 nt, Human
uccaaccugggugacaagagugaaacugaau

SEQ ID NO: 231972 - RNA, 24 nt, Human
uccaaccugggugacagaccgaga

SEQ ID NO: 231973 - RNA, 32 nt, Human
uccaaccugggugacagaccgagacccugucu

SEQ ID NO: 231974 - RNA, 24 nt, Human
uccaaccugggugacagagcaaga

SEQ ID NO: 231975 - RNA, 22 nt, Human
uccaaccugggugacagagcga

SEQ ID NO: 231976 - RNA, 32 nt, Human
uccaaccugggugacagagcgaaacuccaucu

SEQ ID NO: 231977 - RNA, 24 nt, Human
uccaaccugggugacagagcgaga

SEQ ID NO: 231978 - RNA, 32 nt, Human
uccaaccugggugacagagcgagacuccaccu

SEQ ID NO: 231979 - RNA, 32 nt, Human
uccaaccugggugacagagcgagacuccgucu

SEQ ID NO: 231980 - RNA, 24 nt, Human
uccaaccugggugacagagugaga

SEQ ID NO: 231981 - RNA, 32 nt, Human
uccaaccugggugacagagugagacccugucu

SEQ ID NO: 231982 - RNA, 32 nt, Human
uccaaccugggugacagagugagacuccaucu

SEQ ID NO: 231983 - RNA, 32 nt, Human
uccaaccugggugacagagugagauuccaucu

SEQ ID NO: 231984 - RNA, 32 nt, Human
uccaaccugggugacagagugagugagacucu

SEQ ID NO: 231985 - RNA, 23 nt, Human
uccaaccugggugacgagugaga

SEQ ID NO: 231986 - RNA, 32 nt, Human
uccaaccugggugacgagugagacuccaucuc

SEQ ID NO: 231987 - RNA, 24 nt, Human
uccaaccugggugagagagcgaga

SEQ ID NO: 231988 - RNA, 32 nt, Human
uccaaccugggugagagagcgagacccugucu

SEQ ID NO: 231989 - RNA, 24 nt, Human
uccaaccugggugauggagcaaga

SEQ ID NO: 231990 - RNA, 32 nt, Human
uccaaccugggugauggagcaagacuccaucu

SEQ ID NO: 231991 - RNA, 32 nt, Human
uccaaccugguggcauaggcuuggcaaaugga

SEQ ID NO: 231992 - RNA, 32 nt, Human
uccaaccuuccagaaagccgauuaucuucauu

SEQ ID NO: 231993 - RNA, 32 nt, Human
uccaacgcauaugccagcagcuucucacucca

SEQ ID NO: 231994 - RNA, 32 nt, Human
uccaacguccgcgcggccaccaugaugcaaau

SEQ ID NO: 231995 - RNA, 20 nt, Human
uccaacguucucacacugga

SEQ ID NO: 231996 - RNA, 32 nt, Human
uccaacucacaguccacuagcuucacuccuuu

SEQ ID NO: 231997 - RNA, 32 nt, Human
uccaacucauuuucagccugauccagcaucuu

SEQ ID NO: 231998 - RNA, 32 nt, Human
uccaacuccaacacuuaacacagggccaauga

SEQ ID NO: 231999 - RNA, 32 nt, Human
uccaacuccagccaccacuuuccugugcauuu

SEQ ID NO: 232000 - RNA, 32 nt, Human
uccaacucccuagcccagacccucaggucagg

SEQ ID NO: 232001 - RNA, 32 nt, Human
uccaacucccuuaaaauaccuagaccuaaacg

SEQ ID NO: 232002 - RNA, 32 nt, Human
uccaacuccuaguaaaagugggggacugaccc

SEQ ID NO: 232003 - RNA, 32 nt, Human
uccaacucgcccagaucucugcacuucucagu

SEQ ID NO: 232004 - RNA, 32 nt, Human
uccaacucucagacaaaaagcuuugucagaua

SEQ ID NO: 232005 - RNA, 20 nt, Human
uccaacucuuagagacucau

SEQ ID NO: 232006 - RNA, 32 nt, Human
uccaacugaagcacccgguucaucucacuggg

SEQ ID NO: 232007 - RNA, 32 nt, Human
uccaacugacaagccuuugugccugcaucucc

SEQ ID NO: 232008 - RNA, 32 nt, Human
uccaacugacucugcucccugcccucaccauc

SEQ ID NO: 232009 - RNA, 32 nt, Human
uccaacugagcucagugaccugggugggcagu

SEQ ID NO: 232010 - RNA, 32 nt, Human
uccaacugagguacccgguucaucugauuggg

SEQ ID NO: 232011 - RNA, 32 nt, Human
uccaacugauggguaaugucugccuuuaagcc

SEQ ID NO: 232012 - RNA, 32 nt, Human
uccaacugccagaaggaaggaggaagcuuauu

SEQ ID NO: 232013 - RNA, 32 nt, Human
uccaacuggagcaugaccacagacccauucag

SEQ ID NO: 232014 - RNA, 25 nt, Human
uccaacuggucagggcagagugauc

SEQ ID NO: 232015 - RNA, 32 nt, Human
uccaacuguauaccugcaucagugucauuccu

SEQ ID NO: 232016 - RNA, 32 nt, Human
uccaacuguggaggcuguaaauccagauuuuc

SEQ ID NO: 232017 - RNA, 32 nt, Human
uccaacuguuggaccugcacugccuuuccagc

SEQ ID NO: 232018 - RNA, 32 nt, Human
uccaacuuaggcuacagaaugagacucugccc

SEQ ID NO: 232019 - RNA, 32 nt, Human
uccaacuuccaauauuuauccauucguugugg

SEQ ID NO: 232020 - RNA, 32 nt, Human
uccaacuuccuuccuuucuuguccuguuuccc

SEQ ID NO: 232021 - RNA, 32 nt, Human
uccaacuucucacuccuccuuacuaggcuugg

SEQ ID NO: 232022 - RNA, 32 nt, Human
uccaacuugggugacagagcacgacucugucu

SEQ ID NO: 232023 - RNA, 32 nt, Human
uccaacuuguuuuuccagccuaguuggaaacu

SEQ ID NO: 232024 - RNA, 32 nt, Human
uccaacuuucuacauaauggcuaguucugacu

SEQ ID NO: 232025 - RNA, 32 nt, Human
uccaagaaaagaaagggugucacuggaaccac

SEQ ID NO: 232026 - RNA, 32 nt, Human
uccaagaaaagaaccaaagagggcagaggaac

SEQ ID NO: 232027 - RNA, 32 nt, Human
uccaagaaagggaggggaaggaaugagcuaaa

SEQ ID NO: 232028 - RNA, 32 nt, Human
uccaagaacucaccaagauguuuuucagagau

SEQ ID NO: 232029 - RNA, 20 nt, Human
uccaagaacuccugcugcuu

SEQ ID NO: 232030 - RNA, 32 nt, Human
uccaagaagaugggaggaaggggagccccguc

SEQ ID NO: 232031 - RNA, 32 nt, Human
uccaagaagugcuguugagaggcgaggaggua

SEQ ID NO: 232032 - RNA, 32 nt, Human
uccaagaccaaagaaggaaggaagguggacgg

SEQ ID NO: 232033 - RNA, 32 nt, Human
uccaagaccacccuggccaacauggugaaguc

SEQ ID NO: 232034 - RNA, 32 nt, Human
uccaagaccagacucgccaacauggugaaacc

SEQ ID NO: 232035 - RNA, 32 nt, Human
uccaagaccagccuggccaacauggugaaacc

SEQ ID NO: 232036 - RNA, 32 nt, Human
uccaagaccagccuggccaacauggugaaauc

SEQ ID NO: 232037 - RNA, 32 nt, Human
uccaagaccagccuggccaauguggugaaacu

SEQ ID NO: 232038 - RNA, 32 nt, Human
uccaagaccagccugggcaacauggcaaaaca

SEQ ID NO: 232039 - RNA, 32 nt, Human
uccaagaccguuggugccuagaggacuagaau

SEQ ID NO: 232040 - RNA, 26 nt, Human
uccaagacggaggucccugguccacu

SEQ ID NO: 232041 - RNA, 32 nt, Human
uccaagacuaaguugagaaaagagauacuauu

SEQ ID NO: 232042 - RNA, 23 nt, Human
uccaagacuaguuuguuaucuca

SEQ ID NO: 232043 - RNA, 32 nt, Human
uccaagagagucaguguagcugaaacuuuguc

SEQ ID NO: 232044 - RNA, 32 nt, Human
uccaagagcaaacucaguggugaacagcucca

SEQ ID NO: 232045 - RNA, 32 nt, Human
uccaagagccagccccuuucugcuccacaaaa

SEQ ID NO: 232046 - RNA, 32 nt, Human
uccaagagggaaaugcuggucugagaggagaa

SEQ ID NO: 232047 - RNA, 32 nt, Human
uccaagagucgggggucucccuauguuuccca

SEQ ID NO: 232048 - RNA, 32 nt, Human
uccaagagugugaaggaaaauggggcaauucc

SEQ ID NO: 232049 - RNA, 32 nt, Human
uccaagaguguguggaggacaugaccagaggc

SEQ ID NO: 232050 - RNA, 21 nt, Human
uccaagaguuuagugauuuca

SEQ ID NO: 232051 - RNA, 32 nt, Human
uccaagaucagccuggccaacaugucgaagug

SEQ ID NO: 232052 - RNA, 32 nt, Human
uccaagaucucagucucucagugcuuggcaga

SEQ ID NO: 232053 - RNA, 31 nt, Human
uccaagauggcggcagaagcagcugguggga

SEQ ID NO: 232054 - RNA, 22 nt, Human
uccaagauuugagaucaauuua

SEQ ID NO: 232055 - RNA, 32 nt, Human
uccaagcaaaaucuccccgccugggccauggg

SEQ ID NO: 232056 - RNA, 32 nt, Human
uccaagcaacccaaccuucagaucaacuccug

SEQ ID NO: 232057 - RNA, 32 nt, Human
uccaagcaagggaaaagaagccuuggcggaga

SEQ ID NO: 232058 - RNA, 32 nt, Human
uccaagcacugccucccuccugcucuguccag

SEQ ID NO: 232059 - RNA, 18 nt, Human
uccaagcagccaaccuaa

SEQ ID NO: 232060 - RNA, 32 nt, Human
uccaagcagccaucuuuccggaagcucaugga

SEQ ID NO: 232061 - RNA, 29 nt, Human
uccaagcagcugcuaucaacccucucucc

SEQ ID NO: 232062 - RNA, 32 nt, Human
uccaagccaagcucugugggcuuucuguuccu

SEQ ID NO: 232063 - RNA, 32 nt, Human
uccaagccacaguguagugaaccucaucacaa

SEQ ID NO: 232064 - RNA, 21 nt, Human
uccaagccaguccccccagcc

SEQ ID NO: 232065 - RNA, 32 nt, Human
uccaagccauagcuugggcugaaggacaaauu

SEQ ID NO: 232066 - RNA, 32 nt, Human
uccaagcccacugcagccuuguggauuuucca

SEQ ID NO: 232067 - RNA, 32 nt, Human
uccaagccccagagucccucuggaccaacccc

SEQ ID NO: 232068 - RNA, 20 nt, Human
uccaagccccaucuggggcu

SEQ ID NO: 232069 - RNA, 32 nt, Human
uccaagccgauguugcucuguccuuccucaca

SEQ ID NO: 232070 - RNA, 32 nt, Human
uccaagccgccugucucugcccuggguccugg

SEQ ID NO: 232071 - RNA, 32 nt, Human
uccaagccggugccgggcgcccagggguugcc

SEQ ID NO: 232072 - RNA, 32 nt, Human
uccaagccucguuccuccuucugccuccccgg

SEQ ID NO: 232073 - RNA, 32 nt, Human
uccaagccugaacaaugggaccugccccuccc

SEQ ID NO: 232074 - RNA, 25 nt, Human
uccaagccugcugcuggaaaccuca

SEQ ID NO: 232075 - RNA, 32 nt, Human
uccaagccuggcccuccaugcccccaugaccu

SEQ ID NO: 232076 - RNA, 32 nt, Human
uccaagccuuccaccaaaacagugccccaccu

SEQ ID NO: 232077 - RNA, 32 nt, Human
uccaagccuuccccaaccucccccucugugag

SEQ ID NO: 232078 - RNA, 32 nt, Human
uccaagcgaacagcaaccuccugcuacccucc

SEQ ID NO: 232079 - RNA, 30 nt, Human
uccaagcggggccacaggguggggucauag

SEQ ID NO: 232080 - RNA, 32 nt, Human
uccaagcuaaagaugucgucacaugccacauc

SEQ ID NO: 232081 - RNA, 20 nt, Human
uccaagcuacucggaaggcu

SEQ ID NO: 232082 - RNA, 32 nt, Human
uccaagcuccacuggcauuucagucugacgug

SEQ ID NO: 232083 - RNA, 32 nt, Human
uccaagcucuauccuccccggguccagaggcc

SEQ ID NO: 232084 - RNA, 32 nt, Human
uccaagcucuuauuacuaaaguauuuaguauc

SEQ ID NO: 232085 - RNA, 32 nt, Human
uccaagcucuuucacacucaggcucuuccugg

SEQ ID NO: 232086 - RNA, 32 nt, Human
uccaagcugcugcucaccuaugcugacaacau

SEQ ID NO: 232087 - RNA, 20 nt, Human
uccaagcuggagugcagugg

SEQ ID NO: 232088 - RNA, 22 nt, Human
uccaagcuggagugcaguggug

SEQ ID NO: 232089 - RNA, 32 nt, Human
uccaagcugguccccucuguguaucacucuac

SEQ ID NO: 232090 - RNA, 32 nt, Human
uccaagcuggucucaaacuccuggguucaagc

SEQ ID NO: 232091 - RNA, 32 nt, Human
uccaagcuguggcccagcuggaagaggagagg

SEQ ID NO: 232092 - RNA, 32 nt, Human
uccaagcuuugcuugagaacuuuuguaacgug

SEQ ID NO: 232093 - RNA, 32 nt, Human
uccaaggaacugcugcccucccuuccuucuac

SEQ ID NO: 232094 - RNA, 32 nt, Human
uccaaggagccagggcccugggucuagccgug

SEQ ID NO: 232095 - RNA, 20 nt, Human
uccaaggagcuucugcugcu

SEQ ID NO: 232096 - RNA, 32 nt, Human
uccaaggaggagaccugaguugcugggaauuu

SEQ ID NO: 232097 - RNA, 32 nt, Human
uccaaggaggcagggauggggguggagugucu

SEQ ID NO: 232098 - RNA, 18 nt, Human
uccaaggaguucagggcc

SEQ ID NO: 232099 - RNA, 32 nt, Human
uccaaggaugaauccuggaaauugcaguuagc

SEQ ID NO: 232100 - RNA, 19 nt, Human
uccaaggaugcccaaggcc

SEQ ID NO: 232101 - RNA, 32 nt, Human
uccaaggaugcugaauguaaugccuggucaau

SEQ ID NO: 232102 - RNA, 32 nt, Human
uccaaggauuaggugaucggagcuugaaaaga

SEQ ID NO: 232103 - RNA, 32 nt, Human
uccaaggcaaaagagguaagcagaucacaccu

SEQ ID NO: 232104 - RNA, 22 nt, Human
uccaaggcaccuccuggcccca

SEQ ID NO: 232105 - RNA, 28 nt, Human
uccaaggccaaugcugccugcucuguuu

SEQ ID NO: 232106 - RNA, 32 nt, Human
uccaaggcccccagcaggcucuccagucccag

SEQ ID NO: 232107 - RNA, 32 nt, Human
uccaaggcucaucucuggcucuugccuggucu

SEQ ID NO: 232108 - RNA, 32 nt, Human
uccaaggcugcuuggaaaaugcuuugcuagac

SEQ ID NO: 232109 - RNA, 32 nt, Human
uccaaggcuggccacuuuucucuccaaggugc

SEQ ID NO: 232110 - RNA, 32 nt, Human
uccaaggcuuuugagacacaagggaaucucaa

SEQ ID NO: 232111 - RNA, 32 nt, Human
uccaagggagaaacuucugggagccuccaaac

SEQ ID NO: 232112 - RNA, 32 nt, Human
uccaagggcaggcagagcucaugaaugccucu

SEQ ID NO: 232113 - RNA, 21 nt, Human
uccaagggcaucccauucuca

SEQ ID NO: 232114 - RNA, 32 nt, Human
uccaagggccagaagcagaacagucuccgcag

SEQ ID NO: 232115 - RNA, 32 nt, Human
uccaagggccuuuuguccuguuagcaauugag

SEQ ID NO: 232116 - RNA, 32 nt, Human
uccaaggggaaagggcagcaucucagcaugca

SEQ ID NO: 232117 - RNA, 32 nt, Human
uccaaggggccuccuggauucaguccccacug

SEQ ID NO: 232118 - RNA, 31 nt, Human
uccaaggggcuucucccuuuccuugagcucu

SEQ ID NO: 232119 - RNA, 20 nt, Human
uccaaggguacuucuuugga

SEQ ID NO: 232120 - RNA, 32 nt, Human
uccaaggguccccggcucuacccuccaguuau

SEQ ID NO: 232121 - RNA, 32 nt, Human
uccaagguacgcuuguuuuccaaggaagugcc

SEQ ID NO: 232122 - RNA, 32 nt, Human
uccaagguccaauugacugcgcccuugacagc

SEQ ID NO: 232123 - RNA, 32 nt, Human
uccaaggucucccccagcacugaggagcucgc

SEQ ID NO: 232124 - RNA, 32 nt, Human
uccaaggugccuggagccagaggucggggagu

SEQ ID NO: 232125 - RNA, 19 nt, Human
uccaaggugcucacucuua

SEQ ID NO: 232126 - RNA, 32 nt, Human
uccaagguugcuagcaggaaauggcagagcca

SEQ ID NO: 232127 - RNA, 23 nt, Human
uccaaguacauaguucacucaca

SEQ ID NO: 232128 - RNA, 32 nt, Human
uccaaguaccagagaguauuguguaugcucuc

SEQ ID NO: 232129 - RNA, 32 nt, Human
uccaaguacccacuccaggggccagcccacgu

SEQ ID NO: 232130 - RNA, 32 nt, Human
uccaaguacucacaggggcucugggugcccau

SEQ ID NO: 232131 - RNA, 22 nt, Human
uccaaguagcugggacuacagg

SEQ ID NO: 232132 - RNA, 22 nt, Human
uccaaguagcugggacuauagg

SEQ ID NO: 232133 - RNA, 22 nt, Human
uccaaguagcugggucuacagg

SEQ ID NO: 232134 - RNA, 19 nt, Human
uccaagucaccaccuagua

SEQ ID NO: 232135 - RNA, 32 nt, Human
uccaagucaccuaggccuugggcagugccucc

SEQ ID NO: 232136 - RNA, 32 nt, Human
uccaagucaccuggccugggaaaguacuugcc

SEQ ID NO: 232137 - RNA, 32 nt, Human
uccaagucucuuucccugucugggccucacuc

SEQ ID NO: 232138 - RNA, 32 nt, Human
uccaagucugcagccucccauucucuaggccu

SEQ ID NO: 232139 - RNA, 32 nt, Human
uccaagucugcuccuuggcuuccucuccugag

SEQ ID NO: 232140 - RNA, 18 nt, Human
uccaagugacccagggcc

SEQ ID NO: 232141 - RNA, 19 nt, Human
uccaagugaggcccuguca

SEQ ID NO: 232142 - RNA, 32 nt, Human
uccaagugccagagaaguggaggcagaucgcu

SEQ ID NO: 232143 - RNA, 32 nt, Human
uccaagugccccaccacuccccaaccccucuc

SEQ ID NO: 232144 - RNA, 29 nt, Human
uccaagugccugucugugccugggagaac

SEQ ID NO: 232145 - RNA, 32 nt, Human
uccaaguguagcuaaaauauuuuugcagguaa

SEQ ID NO: 232146 - RNA, 32 nt, Human
uccaaguguucaggacuuuuauaccuguuaua

SEQ ID NO: 232147 - RNA, 32 nt, Human
uccaaguuacguguugucacuggguugaagua

SEQ ID NO: 232148 - RNA, 32 nt, Human
uccaaguucaaggacugggcuggcaaacccag

SEQ ID NO: 232149 - RNA, 32 nt, Human
uccaaguuccaggguauuuuucauuccuagua

SEQ ID NO: 232150 - RNA, 23 nt, Human
uccaaguuuuauuuguuaucaca

SEQ ID NO: 232151 - RNA, 18 nt, Human
uccaaguuuuuucaggcu

SEQ ID NO: 232152 - RNA, 32 nt, Human
uccaauaaaguuuaauuuuacuuucuguuauu

SEQ ID NO: 232153 - RNA, 32 nt, Human
uccaauacucuuuccaaaacccccuccugggu

SEQ ID NO: 232154 - RNA, 32 nt, Human
uccaauacugcuuaauuauagcacuuuauuuu

SEQ ID NO: 232155 - RNA, 32 nt, Human
uccaauacuugccugaaagcugugaagaagaa

SEQ ID NO: 232156 - RNA, 32 nt, Human
uccaauauaacuaggcaaaaagaagugaggag

SEQ ID NO: 232157 - RNA, 32 nt, Human
uccaauauuguaauccuagcacuuugggaggc

SEQ ID NO: 232158 - RNA, 32 nt, Human
uccaauauuuggacacuuagagugguuuuugu

SEQ ID NO: 232159 - RNA, 32 nt, Human
uccaaucauaugcauugacauacacagcaaag

SEQ ID NO: 232160 - RNA, 32 nt, Human
uccaauccaaacguucaccuguuuccuuuccu

SEQ ID NO: 232161 - RNA, 32 nt, Human
uccaaucccaacucccuuucccaaacaaaaag

SEQ ID NO: 232162 - RNA, 19 nt, Human
uccaaucccagacugggaa

SEQ ID NO: 232163 - RNA, 32 nt, Human
uccaaucccaucuauucucugccuuuacuaua

SEQ ID NO: 232164 - RNA, 32 nt, Human
uccaaucccauugccgaggacaucccaaaccc

SEQ ID NO: 232165 - RNA, 32 nt, Human
uccaaucuauguugguuuaccuguaguguuuu

SEQ ID NO: 232166 - RNA, 32 nt, Human
uccaaucucacagcagucaucuccuaugcggg

SEQ ID NO: 232167 - RNA, 32 nt, Human
uccaaucucccaucccuaugagggaggcagaa

SEQ ID NO: 232168 - RNA, 32 nt, Human
uccaaucucucaccaucucuaaagcagccguu

SEQ ID NO: 232169 - RNA, 32 nt, Human
uccaaucucucaggaccccguggaauugcauc

SEQ ID NO: 232170 - RNA, 23 nt, Human
uccaaucuggcaacagagcgaga

SEQ ID NO: 232171 - RNA, 32 nt, Human
uccaaucugggcaacauggggaaaccccagcu

SEQ ID NO: 232172 - RNA, 24 nt, Human
uccaaucugggugacagaauaaga

SEQ ID NO: 232173 - RNA, 32 nt, Human
uccaaucugggugacagaauaagaccccgucu

SEQ ID NO: 232174 - RNA, 32 nt, Human
uccaaucuguaugguggcugucuucuauggca

SEQ ID NO: 232175 - RNA, 32 nt, Human
uccaaucuuccagccuuugggagcaggggagg

SEQ ID NO: 232176 - RNA, 32 nt, Human
uccaaugaaggggugauauuaucaacugaagg

SEQ ID NO: 232177 - RNA, 31 nt, Human
uccaaugacaaaggaaguggugaucagucug

SEQ ID NO: 232178 - RNA, 25 nt, Human
uccaaugaggcagagguugcaguga

SEQ ID NO: 232179 - RNA, 32 nt, Human
uccaaugaggcagagguugcagugagcugaga

SEQ ID NO: 232180 - RNA, 32 nt, Human
uccaaugaucaugccaaucgagaggcugaaau

SEQ ID NO: 232181 - RNA, 32 nt, Human
uccaaugcaaaugauccuucuguucuuucgaa

SEQ ID NO: 232182 - RNA, 32 nt, Human
uccaaugcagucaaguccacccugcccagacu

SEQ ID NO: 232183 - RNA, 32 nt, Human
uccaaugcaugaagccaccccaaaauacagca

SEQ ID NO: 232184 - RNA, 32 nt, Human
uccaaugcccugguuuuccugcuugaaucugu

SEQ ID NO: 232185 - RNA, 32 nt, Human
uccaaugccugaugguuccccagaucuaugaa

SEQ ID NO: 232186 - RNA, 32 nt, Human
uccaaugcucaagugagucacaucugccuguu

SEQ ID NO: 232187 - RNA, 32 nt, Human
uccaaugcuccuggcauuucuggagcaggagg

SEQ ID NO: 232188 - RNA, 32 nt, Human
uccaaugcuguugucaacuuugauucuggguu

SEQ ID NO: 232189 - RNA, 32 nt, Human
uccaauggaauuuucuucaguguuggaaaugg

SEQ ID NO: 232190 - RNA, 32 nt, Human
uccaauggacugcauaaauaaccggggauucu

SEQ ID NO: 232191 - RNA, 32 nt, Human
uccaauggagggcugacagcuucccgccuccu

SEQ ID NO: 232192 - RNA, 26 nt, Human
uccaauguggcagguagcacagagcu

SEQ ID NO: 232193 - RNA, 32 nt, Human
uccaaugugguacaccccacagagcuaaucua

SEQ ID NO: 232194 - RNA, 32 nt, Human
uccaauguguaggucccuccaggcuggggcuu

SEQ ID NO: 232195 - RNA, 32 nt, Human
uccaauguucgcgcaggcacuggagucagaga

SEQ ID NO: 232196 - RNA, 32 nt, Human
uccaauuaaaacgccuacagcugccuccuaga

SEQ ID NO: 232197 - RNA, 32 nt, Human
uccaauuacuccaccaucaccucucuccccua

SEQ ID NO: 232198 - RNA, 32 nt, Human
uccaauuagcugugugauaaacuucaguuuuc

SEQ ID NO: 232199 - RNA, 32 nt, Human
uccaauucaaaaauaaauuagaaaaauauaug

SEQ ID NO: 232200 - RNA, 32 nt, Human
uccaauuccaaagccuuuuucacauuuuaaga

SEQ ID NO: 232201 - RNA, 32 nt, Human
uccaauucuuuuucucuccuuagaucuaugac

SEQ ID NO: 232202 - RNA, 32 nt, Human
uccaauugcuggcugcuucacuccuggaacug

SEQ ID NO: 232203 - RNA, 32 nt, Human
uccaauugcugucugccccagaguuucauccu

SEQ ID NO: 232204 - RNA, 32 nt, Human
uccaauugggacucccauucuuugccaggaga

SEQ ID NO: 232205 - RNA, 32 nt, Human
uccaauuggguguguaguaaagacuuaaaccu

SEQ ID NO: 232206 - RNA, 32 nt, Human
uccaauuuacaggcuggagcagcagcugcauc

SEQ ID NO: 232207 - RNA, 32 nt, Human
uccaauuucucggccucaaccccagccucauu

SEQ ID NO: 232208 - RNA, 32 nt, Human
uccaauuuugcagagaagaauaccucuguuua

SEQ ID NO: 232209 - RNA, 32 nt, Human
uccacaaaacagugccuucuaagccgggcugg

SEQ ID NO: 232210 - RNA, 32 nt, Human
uccacaaaagaaugacucuaacagcagaaagg

SEQ ID NO: 232211 - RNA, 32 nt, Human
uccacaaagauaccagccaaggggacaccauu

SEQ ID NO: 232212 - RNA, 32 nt, Human
uccacaaagugcugggauuacaggugugagcu

SEQ ID NO: 232213 - RNA, 25 nt, Human
uccacaaauaacauguuggcaguga

SEQ ID NO: 232214 - RNA, 32 nt, Human
uccacaaaucaucuguaacaauuauguuuuca

SEQ ID NO: 232215 - RNA, 32 nt, Human
uccacaacagccaggggagcaguuggcaaagg

SEQ ID NO: 232216 - RNA, 32 nt, Human
uccacaacccaagcaacauuuguauggauuua

SEQ ID NO: 232217 - RNA, 32 nt, Human
uccacaaccccugucacauaccuuucaggagg

SEQ ID NO: 232218 - RNA, 32 nt, Human
uccacaaccgagagagcuuggaagaggguccc

SEQ ID NO: 232219 - RNA, 32 nt, Human
uccacaacugcaacaauucagugccaggaaag

SEQ ID NO: 232220 - RNA, 32 nt, Human
uccacaagaucuguaauguuauuuccacuuau

SEQ ID NO: 232221 - RNA, 25 nt, Human
uccacaagcacucaggccacuggca

SEQ ID NO: 232222 - RNA, 32 nt, Human
uccacaagcagcacaaccacacugguugguga

SEQ ID NO: 232223 - RNA, 32 nt, Human
uccacaagcgaggguagcagaggcucuccuca

SEQ ID NO: 232224 - RNA, 32 nt, Human
uccacaaggagagcacacaggagagaauggcu

SEQ ID NO: 232225 - RNA, 32 nt, Human
uccacaaggagagugacaagaggcgacgggga

SEQ ID NO: 232226 - RNA, 32 nt, Human
uccacaaucagagccauuuuuguuaaaguggc

SEQ ID NO: 232227 - RNA, 32 nt, Human
uccacaaugaccacagcaaaugaccaagcaug

SEQ ID NO: 232228 - RNA, 32 nt, Human
uccacaauucagaggccacauucuaacagggg

SEQ ID NO: 232229 - RNA, 32 nt, Human
uccacaauuugcuggggaggccccagggucca

SEQ ID NO: 232230 - RNA, 32 nt, Human
uccacacaagggcagagaguccgucuagauuu

SEQ ID NO: 232231 - RNA, 32 nt, Human
uccacacacaccuccaugguauuccuucuuuc

SEQ ID NO: 232232 - RNA, 32 nt, Human
uccacacaccugccaacccugggaagcaucca

SEQ ID NO: 232233 - RNA, 32 nt, Human
uccacacacugcacccccacuccuggggcagg

SEQ ID NO: 232234 - RNA, 32 nt, Human
uccacacacuucuuccaaaaggaagcacccgu

SEQ ID NO: 232235 - RNA, 32 nt, Human
uccacacagcagcaaaucgcuucaccuucuug

SEQ ID NO: 232236 - RNA, 32 nt, Human
uccacacagcauggggcuucagcugcuggccc

SEQ ID NO: 232237 - RNA, 32 nt, Human
uccacacagcggcgcucccagccugaucugcc

SEQ ID NO: 232238 - RNA, 32 nt, Human
uccacacaggcagacuugaccuugaccagaua

SEQ ID NO: 232239 - RNA, 32 nt, Human
uccacacaggccaggagggaaggaccaggcca

SEQ ID NO: 232240 - RNA, 32 nt, Human
uccacacaguccuggccucaucaggggugggg

SEQ ID NO: 232241 - RNA, 22 nt, Human
uccacacaguguguaucauuua

SEQ ID NO: 232242 - RNA, 21 nt, Human
uccacacaguuuccacccuca

SEQ ID NO: 232243 - RNA, 32 nt, Human
uccacacaucuucuuggucuugcauaaggcag

SEQ ID NO: 232244 - RNA, 25 nt, Human
uccacacauggccaggacacugcca

SEQ ID NO: 232245 - RNA, 32 nt, Human
uccacaccaacaugaagacacugaccuugucc

SEQ ID NO: 232246 - RNA, 32 nt, Human
uccacacccaggagucuaggccuugguaacua

SEQ ID NO: 232247 - RNA, 32 nt, Human
uccacaccccugcaccugaccaagggaccaau

SEQ ID NO: 232248 - RNA, 32 nt, Human
uccacaccuucccugucaccccaaacugugcg

SEQ ID NO: 232249 - RNA, 32 nt, Human
uccacacgccgcugccccagcaacccuguuca

SEQ ID NO: 232250 - RNA, 32 nt, Human
uccacacggcccacggccacaugugauggcca

SEQ ID NO: 232251 - RNA, 32 nt, Human
uccacacguccugcucccccuggugaagaagc

SEQ ID NO: 232252 - RNA, 32 nt, Human
uccacacgugccuguagcauuccagagcucac

SEQ ID NO: 232253 - RNA, 32 nt, Human
uccacacuaggcugggcccagcaauacaggag

SEQ ID NO: 232254 - RNA, 32 nt, Human
uccacacucacacauccacuucucccuccaga

SEQ ID NO: 232255 - RNA, 32 nt, Human
uccacacucacaccucuauucacagaccagca

SEQ ID NO: 232256 - RNA, 32 nt, Human
uccacacuccagguucccucaggcuugugucc

SEQ ID NO: 232257 - RNA, 32 nt, Human
uccacacuccuggacagggcucuggacaguug

SEQ ID NO: 232258 - RNA, 24 nt, Human
uccacacugaagcucaguuugcaa

SEQ ID NO: 232259 - RNA, 32 nt, Human
uccacacugccacccagcuuccaaggcugagu

SEQ ID NO: 232260 - RNA, 32 nt, Human
uccacacugccucugcuaccugcccguugguc

SEQ ID NO: 232261 - RNA, 16 nt, Human
uccacacugccuggca

SEQ ID NO: 232262 - RNA, 32 nt, Human
uccacacuggaagucgaauuccagcucgccuu

SEQ ID NO: 232263 - RNA, 32 nt, Human
uccacacuguaaccacugggucugggcuccau

SEQ ID NO: 232264 - RNA, 32 nt, Human
uccacacugugccaguagccuaggugucucag

SEQ ID NO: 232265 - RNA, 32 nt, Human
uccacacuucugggcccuaggcugcuuccggu

SEQ ID NO: 232266 - RNA, 32 nt, Human
uccacagaaauagccacagcuuccaguggugg

SEQ ID NO: 232267 - RNA, 32 nt, Human
uccacagaaauccuguucguauccccauuuug

SEQ ID NO: 232268 - RNA, 32 nt, Human
uccacagaaccuuugucaacuucaguugaaaa

SEQ ID NO: 232269 - RNA, 32 nt, Human
uccacagaacuccacucggaacuuucuucuuu

SEQ ID NO: 232270 - RNA, 32 nt, Human
uccacagaagcccucucacaggcauggccacc

SEQ ID NO: 232271 - RNA, 21 nt, Human
uccacagacacgcagcacagg

SEQ ID NO: 232272 - RNA, 32 nt, Human
uccacagagagggacagcaugugcaaaggcug

SEQ ID NO: 232273 - RNA, 32 nt, Human
uccacagagagggagagcagagaaagaagucc

SEQ ID NO: 232274 - RNA, 22 nt, Human
uccacagagcccacccuccagg

SEQ ID NO: 232275 - RNA, 32 nt, Human
uccacagagccugggcugggcccgguggaggc

SEQ ID NO: 232276 - RNA, 22 nt, Human
uccacagagcuggcucugcuca

SEQ ID NO: 232277 - RNA, 19 nt, Human
uccacagaggaccuucagg

SEQ ID NO: 232278 - RNA, 32 nt, Human
uccacagaggaggaaagagcaggcagcagaga

SEQ ID NO: 232279 - RNA, 32 nt, Human
uccacagaggcugagagcaguggcucaugccu

SEQ ID NO: 232280 - RNA, 32 nt, Human
uccacagaguggggcucaggcaucugugacug

SEQ ID NO: 232281 - RNA, 32 nt, Human
uccacagaugacaccaggcugguccagggccg

SEQ ID NO: 232282 - RNA, 32 nt, Human
uccacagcagaggaccgguugcagcuuaccca

SEQ ID NO: 232283 - RNA, 32 nt, Human
uccacagcauagccagcaggccacuuuucacu

SEQ ID NO: 232284 - RNA, 32 nt, Human
uccacagcauucacauucucaggauaaacaug

SEQ ID NO: 232285 - RNA, 32 nt, Human
uccacagcccaugcgagccacacugcuggguu

SEQ ID NO: 232286 - RNA, 32 nt, Human
uccacagccucaccccucccacccccauacug

SEQ ID NO: 232287 - RNA, 32 nt, Human
uccaguggggcagaggacagagggucacaacc

SEQ ID NO: 232288 - RNA, 22 nt, Human
uccaguggucacacacugguca

SEQ ID NO: 232289 - RNA, 32 nt, Human
uccagugguggaggcgcuguggauggcugcuu

SEQ ID NO: 232290 - RNA, 32 nt, Human
uccaguguaaugcauggcauuguggugucugu

SEQ ID NO: 232291 - RNA, 24 nt, Human
uccaguguaggcaacagagugaga

SEQ ID NO: 232292 - RNA, 32 nt, Human
uccagugucaaagauuuggggcacugcccguc

SEQ ID NO: 232293 - RNA, 32 nt, Human
uccaguguccccagcacugagugcaaggcccc

SEQ ID NO: 232294 - RNA, 32 nt, Human
uccagugugcagaagagccagcagggaaccgg

SEQ ID NO: 232295 - RNA, 32 nt, Human
uccagugugcagcagcccugggagccacugcc

SEQ ID NO: 232296 - RNA, 24 nt, Human
uccagugugcaugccagagugggg

SEQ ID NO: 232297 - RNA, 32 nt, Human
uccaguguggauagcacgaagagaugcaacug

SEQ ID NO: 232298 - RNA, 24 nt, Human
uccaguguggaugacagagcgaga

SEQ ID NO: 232299 - RNA, 32 nt, Human
uccaguguggcugcaggcgguggugcagccuu

SEQ ID NO: 232300 - RNA, 32 nt, Human
uccaguguggugaugccaugcccaucauggga

SEQ ID NO: 232301 - RNA, 32 nt, Human
uccaguguguauccugcaucugccuuuccuga

SEQ ID NO: 232302 - RNA, 32 nt, Human
uccaguguucagcccugccaauccagaaagcu

SEQ ID NO: 232303 - RNA, 32 nt, Human
uccaguguuggacugugccacuguggugucca

SEQ ID NO: 232304 - RNA, 22 nt, Human
uccaguguuguccaaggaaaug

SEQ ID NO: 232305 - RNA, 32 nt, Human
uccaguguuuuuaagagaauguuucuuaaaac

SEQ ID NO: 232306 - RNA, 32 nt, Human
uccaguuaaagggccuguuucuuacuggccug

SEQ ID NO: 232307 - RNA, 32 nt, Human
uccaguuaaccaagucagcccaacaggcaggu

SEQ ID NO: 232308 - RNA, 21 nt, Human
uccaguuaccaccuccugccu

SEQ ID NO: 232309 - RNA, 32 nt, Human
uccaguuaccugcugcuggggucggggcugga

SEQ ID NO: 232310 - RNA, 32 nt, Human
uccaguuaggcuucgggcgggucuccauguua

SEQ ID NO: 232311 - RNA, 32 nt, Human
uccaguucacacccuucacugugcgugcagac

SEQ ID NO: 232312 - RNA, 32 nt, Human
uccaguucaccccucaccuccagccuggagga

SEQ ID NO: 232313 - RNA, 32 nt, Human
uccaguucagaaaacccaagcuagcaacuucu

SEQ ID NO: 232314 - RNA, 32 nt, Human
uccaguucagacagcaccaccacuaagcgugu

SEQ ID NO: 232315 - RNA, 19 nt, Human
uccaguuccagauugugaa

SEQ ID NO: 232316 - RNA, 32 nt, Human
uccaguuccauggccugguggaggacccugug

SEQ ID NO: 232317 - RNA, 32 nt, Human
uccaguucccuccuggucaccugcugccugau

SEQ ID NO: 232318 - RNA, 32 nt, Human
uccaguuccuacucuaguuucaucucaugcug

SEQ ID NO: 232319 - RNA, 32 nt, Human
uccaguuccuuccauaaaacaggcuggacaaa

SEQ ID NO: 232320 - RNA, 32 nt, Human
uccaguuccuuuccucucuugccucuucccac

SEQ ID NO: 232321 - RNA, 32 nt, Human
uccaguucggaggaggaggaggaagauuacag

SEQ ID NO: 232322 - RNA, 32 nt, Human
uccaguucucacuuaaauuaugcaaugauauu

SEQ ID NO: 232323 - RNA, 32 nt, Human
uccaguucucaucugcucaggugucccgggcg

SEQ ID NO: 232324 - RNA, 32 nt, Human
uccaguucucccagggcagaggggcgagggag

SEQ ID NO: 232325 - RNA, 32 nt, Human
uccaguucucuguugauccugagacuaacaau

SEQ ID NO: 232326 - RNA, 32 nt, Human
uccaguucugcaccuauacccucugguguugc

SEQ ID NO: 232327 - RNA, 18 nt, Human
uccaguucugcccagguc

SEQ ID NO: 232328 - RNA, 23 nt, Human
uccaguugcggagacaguaacag

SEQ ID NO: 232329 - RNA, 20 nt, Human
uccaguugcugccucagguc

SEQ ID NO: 232330 - RNA, 32 nt, Human
uccaguugcugccuccuugucuugucuugggu

SEQ ID NO: 232331 - RNA, 32 nt, Human
uccaguugcuggggccucuugggaucuuggga

SEQ ID NO: 232332 - RNA, 32 nt, Human
uccaguuggucuugguuugcuucucucuguac

SEQ ID NO: 232333 - RNA, 32 nt, Human
uccaguugguuucuuucuuucucuuaccugaa

SEQ ID NO: 232334 - RNA, 32 nt, Human
uccaguuguauuugucaccuggggugacaaga

SEQ ID NO: 232335 - RNA, 32 nt, Human
uccaguuuaaugaacuaccaucugauguuuca

SEQ ID NO: 232336 - RNA, 32 nt, Human
uccaguuuaguuugcugcuauuagcagaaacu

SEQ ID NO: 232337 - RNA, 32 nt, Human
uccaguuuaucugugccccagcuuccucacuu

SEQ ID NO: 232338 - RNA, 32 nt, Human
uccaguuucaaccagaguuccaaccaaugggc

SEQ ID NO: 232339 - RNA, 32 nt, Human
uccaguuuccaagugagaaggggagcaggugu

SEQ ID NO: 232340 - RNA, 22 nt, Human
uccaguuucccugcgggccccu

SEQ ID NO: 232341 - RNA, 32 nt, Human
uccaguuucccugucaugcagacuuguugcug

SEQ ID NO: 232342 - RNA, 32 nt, Human
uccaguuucuauccaggaauguucacauccaa

SEQ ID NO: 232343 - RNA, 32 nt, Human
uccaguuucuguaugaauaaaauccaugauga

SEQ ID NO: 232344 - RNA, 24 nt, Human
uccaguuugagcaacagaucaaga

SEQ ID NO: 232345 - RNA, 32 nt, Human
uccaguuugcagguguuccugugacccugaca

SEQ ID NO: 232346 - RNA, 32 nt, Human
uccaguuugcccugagagaugcaccugaccag

SEQ ID NO: 232347 - RNA, 24 nt, Human
uccaguuuggaaaaggagcagaga

SEQ ID NO: 232348 - RNA, 24 nt, Human
uccaguuuggacuacagagugaga

SEQ ID NO: 232349 - RNA, 23 nt, Human
uccaguuuggcaacagagugaga

SEQ ID NO: 232350 - RNA, 24 nt, Human
uccaguuugggcaacagaaugagg

SEQ ID NO: 232351 - RNA, 22 nt, Human
uccaguuuggggcggaaugagg

SEQ ID NO: 232352 - RNA, 32 nt, Human
uccaguuuguaucgucagcccagaccuguccc

SEQ ID NO: 232353 - RNA, 32 nt, Human
uccaguuuuaaaagauguuguggaaguuaggu

SEQ ID NO: 232354 - RNA, 32 nt, Human
uccaguuuucucuguaccuguguguauagaaa

SEQ ID NO: 232355 - RNA, 32 nt, Human
uccaguuuucugcacuucaucaucuagggaug

SEQ ID NO: 232356 - RNA, 32 nt, Human
uccaguuuuguauuuuguguauuauaaaagcg

SEQ ID NO: 232357 - RNA, 32 nt, Human
uccaguuuuuaacaagaucacauaacuggcuu

SEQ ID NO: 232358 - RNA, 32 nt, Human
uccauaaaaugaagguagccaggccugccuca

SEQ ID NO: 232359 - RNA, 32 nt, Human
uccauaaaccauggcauguuggguuugcagga

SEQ ID NO: 232360 - RNA, 32 nt, Human
uccauaaagccuuagcccugguucucaauaga

SEQ ID NO: 232361 - RNA, 32 nt, Human
uccauaaaggaugcuagccugccuuguacuaa

SEQ ID NO: 232362 - RNA, 32 nt, Human
uccauaaaucugcaaugucucaguuaagaaag

SEQ ID NO: 232363 - RNA, 32 nt, Human
uccauaaauuuagaggugacuggagaacucuc

SEQ ID NO: 232364 - RNA, 32 nt, Human
uccauaaccuucucuucuaugacccaacaaca

SEQ ID NO: 232365 - RNA, 32 nt, Human
uccauaacugaauucuccugcaggggcgugac

SEQ ID NO: 232366 - RNA, 19 nt, Human
uccauaacuucccucugca

SEQ ID NO: 232367 - RNA, 32 nt, Human
uccauaaugcauaagggauauaaacucugugu

SEQ ID NO: 232368 - RNA, 32 nt, Human
uccauaauggaugggacagagagcugggaucu

SEQ ID NO: 232369 - RNA, 32 nt, Human
uccauacaaaugcacacaugguacaaugauag

SEQ ID NO: 232370 - RNA, 32 nt, Human
uccauacaacccagccagcugucagaagacaa

SEQ ID NO: 232371 - RNA, 22 nt, Human
uccauacaaccuguauuuacuu

SEQ ID NO: 232372 - RNA, 32 nt, Human
uccauacacccaggcuaugcauugaagaguuu

SEQ ID NO: 232373 - RNA, 32 nt, Human
uccauacaggcgcuguuaccaguucagggcuc

SEQ ID NO: 232374 - RNA, 32 nt, Human
uccauacccccugcccuccucugacaggcccc

SEQ ID NO: 232375 - RNA, 32 nt, Human
uccauaccccuucaaacauguugcuuugcuuu

SEQ ID NO: 232376 - RNA, 32 nt, Human
uccauaccgugccauggaggcuguuuuagaag

SEQ ID NO: 232377 - RNA, 32 nt, Human
uccauaccucugccuccccaaaaagcuccuau

SEQ ID NO: 232378 - RNA, 32 nt, Human
uccauaccuggaauccugguugaguggguuuu

SEQ ID NO: 232379 - RNA, 32 nt, Human
uccauacucacugaagacaaaaagccaccuuu

SEQ ID NO: 232380 - RNA, 32 nt, Human
uccauacucaggacuccucuccgcaguuccug

SEQ ID NO: 232381 - RNA, 32 nt, Human
uccauacugaacacuuguuucuccuuggccag

SEQ ID NO: 232382 - RNA, 18 nt, Human
uccauacugcaguucccu

SEQ ID NO: 232383 - RNA, 32 nt, Human
uccauacugggagcugagcuuucucugaguuu

SEQ ID NO: 232384 - RNA, 32 nt, Human
uccauagacaucaguauucugccaucauuuuu

SEQ ID NO: 232385 - RNA, 32 nt, Human
uccauagagaagaaagaugggauagcucaacu

SEQ ID NO: 232386 - RNA, 32 nt, Human
uccauagagcugcauauguugugaauaaauuc

SEQ ID NO: 232387 - RNA, 32 nt, Human
uccauagaggaaaaggaagaugacgaggccau

SEQ ID NO: 232388 - RNA, 32 nt, Human
uccauagccuggccaaggagaccaugaguagc

SEQ ID NO: 232389 - RNA, 32 nt, Human
uccauagcuaccaaguuaaccugcucuaaacu

SEQ ID NO: 232390 - RNA, 32 nt, Human
uccauagcucuucacuuccuccagaagccucc

SEQ ID NO: 232391 - RNA, 32 nt, Human
uccauagcugcucugcagggcggaagacaccu

SEQ ID NO: 232392 - RNA, 31 nt, Human
uccauagcuuugguugggccugugucacauc

SEQ ID NO: 232393 - RNA, 32 nt, Human
uccauaguaugggacuggccucugcugauccu

SEQ ID NO: 232394 - RNA, 32 nt, Human
uccauagucucaacuguauugugucaucuccu

SEQ ID NO: 232395 - RNA, 32 nt, Human
uccauaguggaggcugggaugggugagagaau

SEQ ID NO: 232396 - RNA, 32 nt, Human
uccauaguucccugcggccucugccuugggga

SEQ ID NO: 232397 - RNA, 32 nt, Human
uccauaguuuuacagcauaugaagagcuguca

SEQ ID NO: 232398 - RNA, 32 nt, Human
uccauaguuuugccuuuuccagaauguuguaa

SEQ ID NO: 232399 - RNA, 20 nt, Human
uccauauaaucuucuacuua

SEQ ID NO: 232400 - RNA, 32 nt, Human
uccauauagcugguggggaccaaguuucuaac

SEQ ID NO: 232401 - RNA, 26 nt, Human
uccauauauggcugaaauuuacauca

SEQ ID NO: 232402 - RNA, 32 nt, Human
uccauauccaacuccauuugggauugugcccc

SEQ ID NO: 232403 - RNA, 32 nt, Human
uccauaucuccacacugaacauguauaagaaa

SEQ ID NO: 232404 - RNA, 32 nt, Human
uccauaucuccaccacauccccugcuugagcc

SEQ ID NO: 232405 - RNA, 32 nt, Human
uccauaucucuucuuugccauggaaacuacac

SEQ ID NO: 232406 - RNA, 30 nt, Human
uccauauggagacgccaccagucaauacaa

SEQ ID NO: 232407 - RNA, 32 nt, Human
uccauaugguggccgggaucgcuaugaugacc

SEQ ID NO: 232408 - RNA, 32 nt, Human
uccauauuaauaggcuucuucucuuaagucuu

SEQ ID NO: 232409 - RNA, 32 nt, Human
uccauauucucaucuuucauaccauaucacac

SEQ ID NO: 232410 - RNA, 32 nt, Human
uccauauucuuacaggccuuccagucaauaau

SEQ ID NO: 232411 - RNA, 32 nt, Human
uccauauuggaaggaaaagacuuaguacaauu

SEQ ID NO: 232412 - RNA, 32 nt, Human
uccauauuguagugcaagaggauucuugugga

SEQ ID NO: 232413 - RNA, 32 nt, Human
uccauauuguagugcaagaggauucuuugugg

SEQ ID NO: 232414 - RNA, 32 nt, Human
uccauauuuagugguacucugaaauuggucac

SEQ ID NO: 232415 - RNA, 32 nt, Human
uccauauuuccucugcgcaggcugcuuucucu

SEQ ID NO: 232416 - RNA, 23 nt, Human
uccaucaaccauauggaaugccc

SEQ ID NO: 232417 - RNA, 32 nt, Human
uccaucaagccaagccuccugugguccugagc

SEQ ID NO: 232418 - RNA, 32 nt, Human
uccaucaaguauuacaggagaaggauugggaa

SEQ ID NO: 232419 - RNA, 32 nt, Human
uccaucacagcccaggcucaccccaagaacuc

SEQ ID NO: 232420 - RNA, 32 nt, Human
uccaucaccaggcuggagugcaguggugcgau

SEQ ID NO: 232421 - RNA, 24 nt, Human
uccaucacccaggcuggaguccag

SEQ ID NO: 232422 - RNA, 32 nt, Human
uccaucaccccuucugccaugugaaagggaga

SEQ ID NO: 232423 - RNA, 32 nt, Human
uccaucaccuuccuccucugcucuggguggua

SEQ ID NO: 232424 - RNA, 32 nt, Human
uccaucacuaaucuaaaacaaagguggcacuu

SEQ ID NO: 232425 - RNA, 32 nt, Human
uccaucacuuaccagucaggaacccuggcgau

SEQ ID NO: 232426 - RNA, 21 nt, Human
uccaucagagcuggucugcac

SEQ ID NO: 232427 - RNA, 32 nt, Human
uccaucagccaggcuggagugcaguggugcaa

SEQ ID NO: 232428 - RNA, 32 nt, Human
uccaucagccuccagcuuccuuucuucauucu

SEQ ID NO: 232429 - RNA, 32 nt, Human
uccaucagccuggcuggcagcagccuuggacu

SEQ ID NO: 232430 - RNA, 32 nt, Human
uccaucaggagaaggaaaggauaaacccuggg

SEQ ID NO: 232431 - RNA, 32 nt, Human
uccaucaggagaaugcagggccucuucuauag

SEQ ID NO: 232432 - RNA, 22 nt, Human
uccaucaggccucucuccagca

SEQ ID NO: 232433 - RNA, 32 nt, Human
uccaucagggaaaugagcugaauggcccagca

SEQ ID NO: 232434 - RNA, 32 nt, Human
uccaucagugucuuccagccugcauggggagg

SEQ ID NO: 232435 - RNA, 32 nt, Human
uccaucauaaccaccccagccugggaaggaga

SEQ ID NO: 232436 - RNA, 32 nt, Human
uccaucauacagucuucagcaaccuugaaaga

SEQ ID NO: 232437 - RNA, 20 nt, Human
uccaucauagccaggccacu

SEQ ID NO: 232438 - RNA, 32 nt, Human
uccaucauccugacagcgcugccugcaaaaua

SEQ ID NO: 232439 - RNA, 32 nt, Human
uccaucaucuuccuuccucccuaucucugugu

SEQ ID NO: 232440 - RNA, 32 nt, Human
uccaucaugacugugucacuccugccacuguu

SEQ ID NO: 232441 - RNA, 32 nt, Human
uccaucaugucagagcaggugaagagccagaa

SEQ ID NO: 232442 - RNA, 32 nt, Human
uccaucauuauguagaugaaaaagccauaggu

SEQ ID NO: 232443 - RNA, 32 nt, Human
uccaucauucagcuggucaucugguggcccaa

SEQ ID NO: 232444 - RNA, 32 nt, Human
uccaucauucuggcagauacauucauaggagu

SEQ ID NO: 232445 - RNA, 32 nt, Human
uccauccaacuaaggguagcggugagacccga

SEQ ID NO: 232446 - RNA, 32 nt, Human
uccauccaaucuauuauuucucuaauuaugca

SEQ ID NO: 232447 - RNA, 32 nt, Human
uccauccacaguugaagcuacagugaagucac

SEQ ID NO: 232448 - RNA, 32 nt, Human
uccauccacaugaccucaucucuugcacaaac

SEQ ID NO: 232449 - RNA, 19 nt, Human
uccauccaccucggccucc

SEQ ID NO: 232450 - RNA, 32 nt, Human
uccauccacugcauugaguagugaccccgacg

SEQ ID NO: 232451 - RNA, 32 nt, Human
uccauccacugccucccagcaccugugcugcc

SEQ ID NO: 232452 - RNA, 32 nt, Human
uccauccacuggagaagagcagaggaacuggg

SEQ ID NO: 232453 - RNA, 32 nt, Human
uccauccaggauugggggccucucugcucacc

SEQ ID NO: 232454 - RNA, 32 nt, Human
uccauccagguagacacagacacacacagaga

SEQ ID NO: 232455 - RNA, 32 nt, Human
uccauccaucacugcugacccucuccggaccu

SEQ ID NO: 232456 - RNA, 32 nt, Human
uccauccauccacccauccaucauccauccau

SEQ ID NO: 232457 - RNA, 32 nt, Human
uccauccauccacucuuccacccucuaccccu

SEQ ID NO: 232458 - RNA, 32 nt, Human
uccauccaucugucugucccuccuucucaugc

SEQ ID NO: 232459 - RNA, 32 nt, Human
uccauccaugaauuaugccagcaagaaugaag

SEQ ID NO: 232460 - RNA, 21 nt, Human
uccauccaugcucucuccagc

SEQ ID NO: 232461 - RNA, 32 nt, Human
uccauccauugaaacugucuaccaggauguuc

SEQ ID NO: 232462 - RNA, 32 nt, Human
uccauccauugggccuuugaaaggacuaauca

SEQ ID NO: 232463 - RNA, 32 nt, Human
uccaucccaaaaacaaaacaaaacaaaacaaa

SEQ ID NO: 232464 - RNA, 32 nt, Human
uccaucccaaaccugacgaagcagaagcugca

SEQ ID NO: 232465 - RNA, 32 nt, Human
uccaucccaaaggaaaauguagacaucaccug

SEQ ID NO: 232466 - RNA, 32 nt, Human
uccaucccaagugccugcggagcccgaggaga

SEQ ID NO: 232467 - RNA, 32 nt, Human
uccaucccagaaccagaccuugcagggaccuc

SEQ ID NO: 232468 - RNA, 32 nt, Human
uccaucccagcgcuggaagggccagugggaag

SEQ ID NO: 232469 - RNA, 32 nt, Human
uccauccccacuguguccucagcuccuagaac

SEQ ID NO: 232470 - RNA, 32 nt, Human
uccaucccgacuccaucucccccaccaggcug

SEQ ID NO: 232471 - RNA, 19 nt, Human
uccaucccguccugcgcag

SEQ ID NO: 232472 - RNA, 32 nt, Human
uccaucccuaauuucugcccucuugucugucu

SEQ ID NO: 232473 - RNA, 32 nt, Human
uccaucccucaucccucccaaccacaguggga

SEQ ID NO: 232474 - RNA, 32 nt, Human
uccaucccuccaggcucucauuguggaaagac

SEQ ID NO: 232475 - RNA, 32 nt, Human
uccaucccugagccgccugccaccucccacuc

SEQ ID NO: 232476 - RNA, 32 nt, Human
uccaucccugcaaguucugggcucagaauuug

SEQ ID NO: 232477 - RNA, 22 nt, Human
uccauccgcgccgccgccgccg

SEQ ID NO: 232478 - RNA, 29 nt, Human
uccauccggcuccugucauccccuacacu

SEQ ID NO: 232479 - RNA, 32 nt, Human
uccauccgucuauccauccaucauccauccau

SEQ ID NO: 232480 - RNA, 32 nt, Human
uccauccuaaaaguaccugccuccuucccagc

SEQ ID NO: 232481 - RNA, 32 nt, Human
uccauccuacuggaugaugguuuagaauaaac

SEQ ID NO: 232482 - RNA, 32 nt, Human
uccauccuacuguaaugggagaggaggagaau

SEQ ID NO: 232483 - RNA, 32 nt, Human
uccauccucacaccuucugccuuuguccugcu

SEQ ID NO: 232484 - RNA, 32 nt, Human
uccauccucagcccucugcccacugggcccag

SEQ ID NO: 232485 - RNA, 32 nt, Human
uccauccucauccucugcccucccaggaaguc

SEQ ID NO: 232486 - RNA, 32 nt, Human
uccauccuccauccauccaucuauccauccau

SEQ ID NO: 232487 - RNA, 32 nt, Human
uccauccuccauccauccauucauccucuauc

SEQ ID NO: 232488 - RNA, 32 nt, Human
uccauccuccaucccagcaucccuccaucccu

SEQ ID NO: 232489 - RNA, 32 nt, Human
uccauccuccauccgucauccauccguccauc

SEQ ID NO: 232490 - RNA, 32 nt, Human
uccauccuccuccuccccuuaauggauugugg

SEQ ID NO: 232491 - RNA, 32 nt, Human
uccauccucuaaggagccaacuuggcuuuuac

SEQ ID NO: 232492 - RNA, 32 nt, Human
uccauccucuacuucuggugcaguccugggac

SEQ ID NO: 232493 - RNA, 32 nt, Human
uccauccucucccacuuccaucuggcguccca

SEQ ID NO: 232494 - RNA, 32 nt, Human
uccauccucuugugguacccguagugcccagc

SEQ ID NO: 232495 - RNA, 32 nt, Human
uccauccucuuucaucagcccugagagcagaa

SEQ ID NO: 232496 - RNA, 22 nt, Human
uccauccugaaccccuggaaaa

SEQ ID NO: 232497 - RNA, 32 nt, Human
uccauccugaagguguuuuucauucacuuuaa

SEQ ID NO: 232498 - RNA, 18 nt, Human
uccauccugacucuugaa

SEQ ID NO: 232499 - RNA, 32 nt, Human
uccauccugcaccccagucccccagcccuaaa

SEQ ID NO: 232500 - RNA, 32 nt, Human
uccauccugcucccugagaauggcagugcagg

SEQ ID NO: 232501 - RNA, 32 nt, Human
uccauccugcugucucuguccugucccaaguu

SEQ ID NO: 232502 - RNA, 32 nt, Human
uccauccuggacaacagagugagacuccuucu

SEQ ID NO: 232503 - RNA, 32 nt, Human
uccauccuggacaacaggagugaaacuccguc

SEQ ID NO: 232504 - RNA, 32 nt, Human
uccauccuggacaacucggugagaggcagugg

SEQ ID NO: 232505 - RNA, 32 nt, Human
uccauccuggcaccacggcacacaccuccagc

SEQ ID NO: 232506 - RNA, 32 nt, Human
uccauccugggcagcauacugagacccugccu

SEQ ID NO: 232507 - RNA, 24 nt, Human
uccauccugggucacagagugaga

SEQ ID NO: 232508 - RNA, 24 nt, Human
uccauccugggugacaaagugaga

SEQ ID NO: 232509 - RNA, 32 nt, Human
uccauccugggugacaaagugagacucccucu

SEQ ID NO: 232510 - RNA, 32 nt, Human
uccauccugggugacaagagcgaaacuccauc

SEQ ID NO: 232511 - RNA, 24 nt, Human
uccauccugggugacagagagaga

SEQ ID NO: 232512 - RNA, 32 nt, Human
uccauccugggugacagagagagacccugucu

SEQ ID NO: 232513 - RNA, 24 nt, Human
uccauccugggugacagagcaaga

SEQ ID NO: 232514 - RNA, 32 nt, Human
uccauccugggugacagagcaagacuuccucu

SEQ ID NO: 232515 - RNA, 32 nt, Human
uccauccugggugacagcaagaucuugucuca

SEQ ID NO: 232516 - RNA, 22 nt, Human
uccauccugggugauggagcga

SEQ ID NO: 232517 - RNA, 21 nt, Human
uccauccuguuuucugcaaca

SEQ ID NO: 232518 - RNA, 32 nt, Human
uccauccuuccagagaagucucugggaccuuu

SEQ ID NO: 232519 - RNA, 32 nt, Human
uccauccuucuuuccuucauccuuuuccuuca

SEQ ID NO: 232520 - RNA, 20 nt, Human
uccauccuugcaccccuggg

SEQ ID NO: 232521 - RNA, 32 nt, Human
uccauccuuguaguaugaaacaugcuccaagg

SEQ ID NO: 232522 - RNA, 32 nt, Human
uccaucgagcugguugucuucuugccugcccu

SEQ ID NO: 232523 - RNA, 32 nt, Human
uccaucgaucuauuuauauguacaugagaagg

SEQ ID NO: 232524 - RNA, 24 nt, Human
uccaucgcccaggccugggaugca

SEQ ID NO: 232525 - RNA, 24 nt, Human
uccaucgcccaggcugcagugcag

SEQ ID NO: 232526 - RNA, 32 nt, Human
uccaucgcccaggcugcagugcagugacacga

SEQ ID NO: 232527 - RNA, 32 nt, Human
uccaucgcugccucugaggguggagaaggagg

SEQ ID NO: 232528 - RNA, 32 nt, Human
uccaucguccaggcuggagugcaguggcgcga

SEQ ID NO: 232529 - RNA, 32 nt, Human
uccaucgucccaggaaucccagggggcagcac

SEQ ID NO: 232530 - RNA, 22 nt, Human
uccaucgugccguccgccgcug

SEQ ID NO: 232531 - RNA, 32 nt, Human
uccaucguggacaacauagcaagauuccaucu

SEQ ID NO: 232532 - RNA, 32 nt, Human
uccaucguggcucugccuucaaagggaaauuu

SEQ ID NO: 232533 - RNA, 32 nt, Human
uccaucuaagaucucuuccccuuguccauagc

SEQ ID NO: 232534 - RNA, 32 nt, Human
uccaucuacuucugaaugugagacuuucccuu

SEQ ID NO: 232535 - RNA, 32 nt, Human
uccaucuacuuuuccacuccagagugggaaaa

SEQ ID NO: 232536 - RNA, 32 nt, Human
uccaucuaucuaggauauguugauacaaaguc

SEQ ID NO: 232537 - RNA, 32 nt, Human
uccaucucaaaaacaaaacaaauaaacgaaca

SEQ ID NO: 232538 - RNA, 32 nt, Human
uccaucucaaaacaaaaacaaacaaacaaaca

SEQ ID NO: 232539 - RNA, 32 nt, Human
uccaucucaaauaggcuugguggccuguggaa

SEQ ID NO: 232540 - RNA, 32 nt, Human
uccaucucaccucugcuccagaaauaaaugcc

SEQ ID NO: 232541 - RNA, 28 nt, Human
uccaucucacgcgcugccucugucauuu

SEQ ID NO: 232542 - RNA, 19 nt, Human
uccaucucagcugcaucua

SEQ ID NO: 232543 - RNA, 32 nt, Human
uccaucucauucucuccccuccagaagaagca

SEQ ID NO: 232544 - RNA, 32 nt, Human
uccaucuccaauggcugggauuuguggcaggg

SEQ ID NO: 232545 - RNA, 32 nt, Human
uccaucucccaaagugcugggaugacaggcgu

SEQ ID NO: 232546 - RNA, 32 nt, Human
uccaucuccccagccaccugagaagggagaug

SEQ ID NO: 232547 - RNA, 32 nt, Human
uccaucuccuguguaaucaaggccagugcuaa

SEQ ID NO: 232548 - RNA, 32 nt, Human
uccaucucgagagaaagggagugguugaaagc

SEQ ID NO: 232549 - RNA, 32 nt, Human
uccaucucgcucaucaucaccgacacguccuu

SEQ ID NO: 232550 - RNA, 32 nt, Human
uccaucucuauauaaaaacaaaaaccacgaaa

SEQ ID NO: 232551 - RNA, 32 nt, Human
uccaucucucauccuccaguaccuugcuucuu

SEQ ID NO: 232552 - RNA, 32 nt, Human
uccaucucuccuauucuuucucuuucuucucu

SEQ ID NO: 232553 - RNA, 32 nt, Human
uccaucucuccucauccuuuugccuuuguuau

SEQ ID NO: 232554 - RNA, 32 nt, Human
uccaucucucuccccucucuucucucaugaug

SEQ ID NO: 232555 - RNA, 21 nt, Human
uccaucucucuuccccauaga

SEQ ID NO: 232556 - RNA, 32 nt, Human
uccaucucucuucccuuccugcugucaguaag

SEQ ID NO: 232557 - RNA, 22 nt, Human
uccaucucugaagaucugcuca

SEQ ID NO: 232558 - RNA, 20 nt, Human
uccaucucugcaagcucccu

SEQ ID NO: 232559 - RNA, 32 nt, Human
uccaucucuguacgcuuauugaucucauccuc

SEQ ID NO: 232560 - RNA, 32 nt, Human
uccaucucuguggaccuacagaggcacagagg

SEQ ID NO: 232561 - RNA, 32 nt, Human
uccaucugacagcuaagccaagccacagaggg

SEQ ID NO: 232562 - RNA, 32 nt, Human
uccaucugagaccaccucagccuggauuuuau

SEQ ID NO: 232563 - RNA, 17 nt, Human
uccaucugaggaccaga

SEQ ID NO: 232564 - RNA, 32 nt, Human
uccaucugagguaccggguucaucucacuacg

SEQ ID NO: 232565 - RNA, 32 nt, Human
uccaucugccccuaaucucuguccccuuugcc

SEQ ID NO: 232566 - RNA, 20 nt, Human
uccaucugccugggagaugc

SEQ ID NO: 232567 - RNA, 32 nt, Human
uccaucugggcaaccugguuuuccaaauauca

SEQ ID NO: 232568 - RNA, 32 nt, Human
uccaucugggcucugcagcccagcucuguggc

SEQ ID NO: 232569 - RNA, 32 nt, Human
uccaucugggcugcuaggaaggggcacucauc

SEQ ID NO: 232570 - RNA, 32 nt, Human
uccaucugggggagggacuuguuuacaagcag

SEQ ID NO: 232571 - RNA, 32 nt, Human
uccaucuguccguggucagaaguggggucagu

SEQ ID NO: 232572 - RNA, 32 nt, Human
uccaucugucugucccuccuucucaugccccu

SEQ ID NO: 232573 - RNA, 32 nt, Human
uccaucugugagaaggagccagagcccaaggg

SEQ ID NO: 232574 - RNA, 32 nt, Human
uccaucuguggcugggacagccagggggugug

SEQ ID NO: 232575 - RNA, 23 nt, Human
uccaucugugguccuuucugcca

SEQ ID NO: 232576 - RNA, 32 nt, Human
uccaucugugguuggagcgccucuuugggauu

SEQ ID NO: 232577 - RNA, 32 nt, Human
uccaucuuagccacacuucucccuucaggggc

SEQ ID NO: 232578 - RNA, 32 nt, Human
uccaucuuaguauuugugcacacugcuauaac

SEQ ID NO: 232579 - RNA, 32 nt, Human
uccaucuucaaaacaaaacaaaacaaaacaaa

SEQ ID NO: 232580 - RNA, 17 nt, Human
uccaucuucaccccaga

SEQ ID NO: 232581 - RNA, 23 nt, Human
uccaucuuccaaucccuggaaaa

SEQ ID NO: 232582 - RNA, 32 nt, Human
uccaucuuccaggauggcagcaauggcgcugu

SEQ ID NO: 232583 - RNA, 32 nt, Human
uccaucuuccauccccuacauggcaguuaaua

SEQ ID NO: 232584 - RNA, 32 nt, Human
uccaucuucuccccaccaccgccccggugugc

SEQ ID NO: 232585 - RNA, 32 nt, Human
uccaucuugaccaggacugcaccaagaagcac

SEQ ID NO: 232586 - RNA, 32 nt, Human
uccaucuugggcaacacagugagacccccauc

SEQ ID NO: 232587 - RNA, 32 nt, Human
uccaucuuuaaaaugcucaaacauggauucag

SEQ ID NO: 232588 - RNA, 32 nt, Human
uccaucuuuccagaauccaugccuguguaaug

SEQ ID NO: 232589 - RNA, 32 nt, Human
uccaucuuugguggggacagggcccagcagca

SEQ ID NO: 232590 - RNA, 32 nt, Human
uccaucuuuugucagcucugcaugucauacag

SEQ ID NO: 232591 - RNA, 28 nt, Human
uccaugaaaauugcucucugccaaagag

SEQ ID NO: 232592 - RNA, 32 nt, Human
uccaugaaaccaagcucagaaaagcuuuaacu

SEQ ID NO: 232593 - RNA, 32 nt, Human
uccaugaaagaaugacccuggugagugcucua

SEQ ID NO: 232594 - RNA, 32 nt, Human
uccaugaaaggagucauuuuagugaugagcug

SEQ ID NO: 232595 - RNA, 32 nt, Human
uccaugaaaucaggaacugcuugaugaaaugu

SEQ ID NO: 232596 - RNA, 32 nt, Human
uccaugaaccugggcuaaugggagacuguaga

SEQ ID NO: 232597 - RNA, 32 nt, Human
uccaugaagaguuaagaauuuuaucccagcac

SEQ ID NO: 232598 - RNA, 32 nt, Human
uccaugaagccccagagguagaagggaccuca

SEQ ID NO: 232599 - RNA, 32 nt, Human
uccaugaauuccagaaauaucacugaaauuau

SEQ ID NO: 232600 - RNA, 32 nt, Human
uccaugacaagccacaccgaaauguagcaagc

SEQ ID NO: 232601 - RNA, 32 nt, Human
uccaugacaaucaugugagcucagccacagac

SEQ ID NO: 232602 - RNA, 32 nt, Human
uccaugacccucccugugugguggguugaacg

SEQ ID NO: 232603 - RNA, 32 nt, Human
uccaugagaaaaggauuguuugcucaaaaagc

SEQ ID NO: 232604 - RNA, 32 nt, Human
uccaugagaacagcaggguagucugguuucua

SEQ ID NO: 232605 - RNA, 32 nt, Human
uccaugagaccaaaugguuuuauauggaacca

SEQ ID NO: 232606 - RNA, 32 nt, Human
uccaugaggaugaccugcaccgugugccuuua

SEQ ID NO: 232607 - RNA, 32 nt, Human
uccaugaggccuggacuggaggccuucucuag

SEQ ID NO: 232608 - RNA, 32 nt, Human
uccaugaggccuuauuagcaaaggacacccag

SEQ ID NO: 232609 - RNA, 32 nt, Human
uccaugaggcugccuguguagcuguucuuguc

SEQ ID NO: 232610 - RNA, 32 nt, Human
uccaugaggcuggugcuugcaguuccugcaag

SEQ ID NO: 232611 - RNA, 32 nt, Human
uccaugaguuucaucgagucacugugagugga

SEQ ID NO: 232612 - RNA, 24 nt, Human
uccaugcaaacuaccaucugcuca

SEQ ID NO: 232613 - RNA, 32 nt, Human
uccaugcagaagcacaacugggcagcccuggc

SEQ ID NO: 232614 - RNA, 32 nt, Human
uccaugcaggacagggucuccugcugcaaguc

SEQ ID NO: 232615 - RNA, 32 nt, Human
uccaugcagguguuggaagggagagcugaacc

SEQ ID NO: 232616 - RNA, 21 nt, Human
uccaugcauugcacgcugcca

SEQ ID NO: 232617 - RNA, 32 nt, Human
uccaugccaagcagaaaacucauagucaauac

SEQ ID NO: 232618 - RNA, 32 nt, Human
uccaugccaaggccccauaccugggccggggg

SEQ ID NO: 232619 - RNA, 32 nt, Human
uccaugccaagucccugcacuguugguggccu

SEQ ID NO: 232620 - RNA, 32 nt, Human
uccaugccacugccagagcuggccuagcaaga

SEQ ID NO: 232621 - RNA, 32 nt, Human
uccaugccagggcugugacugcagccugugua

SEQ ID NO: 232622 - RNA, 32 nt, Human
uccaugcccagaaaucagaagucagauugaac

SEQ ID NO: 232623 - RNA, 32 nt, Human
uccaugccccgagggccucucucaguucuggg

SEQ ID NO: 232624 - RNA, 32 nt, Human
uccaugcccguagaggaagugugcagauggga

SEQ ID NO: 232625 - RNA, 32 nt, Human
uccaugcccugggcuggaggccagcuucgggg

SEQ ID NO: 232626 - RNA, 32 nt, Human
uccaugccgacaucaugucacucuaggccugg

SEQ ID NO: 232627 - RNA, 21 nt, Human
uccaugccguccacagcgccu

SEQ ID NO: 232628 - RNA, 32 nt, Human
uccaugccucagccuuugccuaccccaggaau

SEQ ID NO: 232629 - RNA, 32 nt, Human
uccaugccucaggauagaacagccuggcuuau

SEQ ID NO: 232630 - RNA, 32 nt, Human
uccaugccuccaggaguguggcagagcuucuc

SEQ ID NO: 232631 - RNA, 32 nt, Human
uccaugccugccauaccugccagcuucagaca

SEQ ID NO: 232632 - RNA, 32 nt, Human
uccaugccugccuccccucucugccacgcccc

SEQ ID NO: 232633 - RNA, 32 nt, Human
uccaugcgggaggggccacccacccacuggag

SEQ ID NO: 232634 - RNA, 22 nt, Human
uccaugcgggcaccaccacucc

SEQ ID NO: 232635 - RNA, 32 nt, Human
uccaugcucacugcucaugcacuuuuuacacg

SEQ ID NO: 232636 - RNA, 20 nt, Human
uccaugcucaggcucucagc

SEQ ID NO: 232637 - RNA, 23 nt, Human
uccaugcuccuucccugacccca

SEQ ID NO: 232638 - RNA, 32 nt, Human
uccaugcucucuggcucauugugucauuucaa

SEQ ID NO: 232639 - RNA, 32 nt, Human
uccaugcucuuaacucccaguugaagugggcc

SEQ ID NO: 232640 - RNA, 24 nt, Human
uccaugcugccaucaaggcauuua

SEQ ID NO: 232641 - RNA, 32 nt, Human
uccaugcugccuggcuuuccuccugcuaccaa

SEQ ID NO: 232642 - RNA, 28 nt, Human
uccaugcugcugcugacucggagcccca

SEQ ID NO: 232643 - RNA, 32 nt, Human
uccaugcuuucucuacucccugccucaaacca

SEQ ID NO: 232644 - RNA, 32 nt, Human
uccauggaaucagagcaagauuuccuuucugc

SEQ ID NO: 232645 - RNA, 32 nt, Human
uccauggacgagcaagggcaucccagaaacgu

SEQ ID NO: 232646 - RNA, 21 nt, Human
uccauggagaauccagccuca

SEQ ID NO: 232647 - RNA, 32 nt, Human
uccauggagcuucccucagcucuuaccucacc

SEQ ID NO: 232648 - RNA, 32 nt, Human
uccauggaugaacauuguaaagaggcuggaga

SEQ ID NO: 232649 - RNA, 32 nt, Human
uccauggcacacugcccucugccacugacagg

SEQ ID NO: 232650 - RNA, 22 nt, Human
uccauggcaggacagagcggga

SEQ ID NO: 232651 - RNA, 32 nt, Human
uccauggccauggaacaaguaaacgcaacccc

SEQ ID NO: 232652 - RNA, 28 nt, Human
uccauggccauggagauagacagcaggc

SEQ ID NO: 232653 - RNA, 28 nt, Human
uccauggcccagaaggaagaggcugcug

SEQ ID NO: 232654 - RNA, 32 nt, Human
uccauggccgaacccaccccacugccuguuac

SEQ ID NO: 232655 - RNA, 32 nt, Human
uccauggccuccucucugggcaguguugcugc

SEQ ID NO: 232656 - RNA, 32 nt, Human
uccauggccuucugcuguuucucgccaacacu

SEQ ID NO: 232657 - RNA, 32 nt, Human
uccauggccuucuucuggacacugcuaggauc

SEQ ID NO: 232658 - RNA, 32 nt, Human
uccauggcgguggaugccugacuggaagcccg

SEQ ID NO: 232659 - RNA, 32 nt, Human
uccauggcucaagugauccuccugccucagcc

SEQ ID NO: 232660 - RNA, 32 nt, Human
uccauggcugccaucucaccuccugcugggca

SEQ ID NO: 232661 - RNA, 32 nt, Human
uccauggcuggccugcucacagagcucuaccu

SEQ ID NO: 232662 - RNA, 32 nt, Human
uccauggcuggcuggguccccuucgcaguguu

SEQ ID NO: 232663 - RNA, 32 nt, Human
uccaugggaagccaugauggccuagcauggag

SEQ ID NO: 232664 - RNA, 22 nt, Human
uccaugggaaggaagcauggga

SEQ ID NO: 232665 - RNA, 32 nt, Human
uccaugggaggaaaguuuucuucuagcugcaa

SEQ ID NO: 232666 - RNA, 26 nt, Human
uccaugggaggcugcacagaagaccc

SEQ ID NO: 232667 - RNA, 32 nt, Human
uccaugggcacuaacccaccucccaggcugau

SEQ ID NO: 232668 - RNA, 32 nt, Human
uccaugggccccaggggaagcugcaguguggg

SEQ ID NO: 232669 - RNA, 32 nt, Human
uccaugggcccugcaggaggggagacccaccu

SEQ ID NO: 232670 - RNA, 32 nt, Human
uccaugggccuuccagaauggagggaggcucu

SEQ ID NO: 232671 - RNA, 32 nt, Human
uccauggggacagaagcuccagcauuugccca

SEQ ID NO: 232672 - RNA, 32 nt, Human
uccauggggaggugggcucugaaggugaaggu

SEQ ID NO: 232673 - RNA, 28 nt, Human
uccaugggggcggccagcugcgaggaug

SEQ ID NO: 232674 - RNA, 20 nt, Human
uccauggggucccauucuca

SEQ ID NO: 232675 - RNA, 32 nt, Human
uccaugggguuaucacccacugugcugaguca

SEQ ID NO: 232676 - RNA, 32 nt, Human
uccaugggugagucaccaugcuuggccacauu

SEQ ID NO: 232677 - RNA, 32 nt, Human
uccaugguccugguuggcccuggcuuugccua

SEQ ID NO: 232678 - RNA, 32 nt, Human
uccauggucucccggcuggcaauguggugaag

SEQ ID NO: 232679 - RNA, 26 nt, Human
uccauggucucuagaugguuuacuua

SEQ ID NO: 232680 - RNA, 32 nt, Human
uccaugguggccugggccacgcaggcuguacc

SEQ ID NO: 232681 - RNA, 32 nt, Human
uccaugguguuagaagccaggggaacaguuaa

SEQ ID NO: 232682 - RNA, 32 nt, Human
uccaugguuuuccuugguggccggcgcguguu

SEQ ID NO: 232683 - RNA, 32 nt, Human
uccauguaacccaguacuggaggucaagaugg

SEQ ID NO: 232684 - RNA, 32 nt, Human
uccauguaaggaggggagagugcucagagucc

SEQ ID NO: 232685 - RNA, 32 nt, Human
uccauguacuucugcccugccuccuccuuucg

SEQ ID NO: 232686 - RNA, 32 nt, Human
uccauguauagagagaaaauuuggaaaacagg

SEQ ID NO: 232687 - RNA, 32 nt, Human
uccaugucacagaacauaucagccucaagaag

SEQ ID NO: 232688 - RNA, 32 nt, Human
uccaugucaccacguggugaauggcugccuca

SEQ ID NO: 232689 - RNA, 32 nt, Human
uccaugucaccuuucccaccucuuucaaaaac

SEQ ID NO: 232690 - RNA, 31 nt, Human
uccaugucacucagaaggacuuugagguagu

SEQ ID NO: 232691 - RNA, 32 nt, Human
uccaugucccacguugggauggauuacagagg

SEQ ID NO: 232692 - RNA, 32 nt, Human
uccaugucucccaguuuguauaguuaaauugu

SEQ ID NO: 232693 - RNA, 32 nt, Human
uccaugucuccucauuccuacaccuauuuucu

SEQ ID NO: 232694 - RNA, 28 nt, Human
uccaugucucugaggagcggcgggcggc

SEQ ID NO: 232695 - RNA, 32 nt, Human
uccaugucucugcuuagcugugcuggcagcua

SEQ ID NO: 232696 - RNA, 32 nt, Human
uccaugucugugguagaagaagccccacacag

SEQ ID NO: 232697 - RNA, 32 nt, Human
uccaugugaucauucugccucuccucaggaga

SEQ ID NO: 232698 - RNA, 32 nt, Human
uccaugugaucugccauuggcuugcuucagug

SEQ ID NO: 232699 - RNA, 32 nt, Human
uccaugugaugcacaggaagcugagaugaacc

SEQ ID NO: 232700 - RNA, 32 nt, Human
uccaugugcucugcacaaaaacagaccuguug

SEQ ID NO: 232701 - RNA, 32 nt, Human
uccauguggagaaaggagugaaaccuuuaggg

SEQ ID NO: 232702 - RNA, 32 nt, Human
uccaugugggagcagaggugugaagagaauuu

SEQ ID NO: 232703 - RNA, 32 nt, Human
uccauguguagagugcuuagaaaccccaucaa

SEQ ID NO: 232704 - RNA, 29 nt, Human
uccauguguaugugugugucugguguuug

SEQ ID NO: 232705 - RNA, 32 nt, Human
uccaugugucuggcgggggauggguggacugu

SEQ ID NO: 232706 - RNA, 32 nt, Human
uccauguuauucucucacaguguacucuauaa

SEQ ID NO: 232707 - RNA, 32 nt, Human
uccauguucagggaugaggggagcagcagcag

SEQ ID NO: 232708 - RNA, 32 nt, Human
uccauguuccuccuccucucuccccacuugaa

SEQ ID NO: 232709 - RNA, 32 nt, Human
uccauguuggacauggccgcccccagguaguc

SEQ ID NO: 232710 - RNA, 32 nt, Human
uccauguuggccugucaccagacccgagucaa

SEQ ID NO: 232711 - RNA, 32 nt, Human
uccauguuuacucucuucuauuuggagaauaa

SEQ ID NO: 232712 - RNA, 32 nt, Human
uccauguuucaccucaugggugaguggauugc

SEQ ID NO: 232713 - RNA, 30 nt, Human
uccauuaaacuucuacugagcaaaugguua

SEQ ID NO: 232714 - RNA, 32 nt, Human
uccauuaauuugccgucagcucucacaugacc

SEQ ID NO: 232715 - RNA, 32 nt, Human
uccauuaccaaagccuggaaguucucaucacc

SEQ ID NO: 232716 - RNA, 32 nt, Human
uccauuaccccaagacuuucuucuagauauau

SEQ ID NO: 232717 - RNA, 32 nt, Human
uccauuagcuuccuuugcaaaggcuacuuaug

SEQ ID NO: 232718 - RNA, 32 nt, Human
uccauuauggcagauaaggaggcacgucaggc

SEQ ID NO: 232719 - RNA, 31 nt, Human
uccauuaugucugugugccuggaugucugug

SEQ ID NO: 232720 - RNA, 32 nt, Human
uccauuauuaccuggucacaccagauuuuccc

SEQ ID NO: 232721 - RNA, 32 nt, Human
uccauucacaugcucauauguuuauaaacugu

SEQ ID NO: 232722 - RNA, 32 nt, Human
uccauucacccagcgggaggugggaugugaga

SEQ ID NO: 232723 - RNA, 32 nt, Human
uccauucacuauacuacacuuuauugaagaca

SEQ ID NO: 232724 - RNA, 32 nt, Human
uccauucacucccaggugagaauucaggcaaa

SEQ ID NO: 232725 - RNA, 32 nt, Human
uccauucacucuguuucucuucugcuggauua

SEQ ID NO: 232726 - RNA, 32 nt, Human
uccauucacugcaaaccucguuccccauuucu

SEQ ID NO: 232727 - RNA, 32 nt, Human
uccauucacuugcccaacucugacaggauacg

SEQ ID NO: 232728 - RNA, 32 nt, Human
uccauucacuuuggguuccaucuugcuuuaaa

SEQ ID NO: 232729 - RNA, 32 nt, Human
uccauucagacuccuuuccugccuugugaccu

SEQ ID NO: 232730 - RNA, 32 nt, Human
uccauucagaggagggaggacaggaggccaca

SEQ ID NO: 232731 - RNA, 32 nt, Human
uccauucaggaaauaucgacagggcuacacgu

SEQ ID NO: 232732 - RNA, 32 nt, Human
uccauucaggagcaaagagcaccaugauucca

SEQ ID NO: 232733 - RNA, 32 nt, Human
uccauucagguucucaaaccuucuucuugaau

SEQ ID NO: 232734 - RNA, 32 nt, Human
uccauucauucaacacacaugaccacccgugu

SEQ ID NO: 232735 - RNA, 32 nt, Human
uccauuccacagugaaacagguggccucgugg

SEQ ID NO: 232736 - RNA, 32 nt, Human
uccauuccacaugugcccuggccacauuugca

SEQ ID NO: 232737 - RNA, 32 nt, Human
uccauuccagagcugcagaaccagucccucug

SEQ ID NO: 232738 - RNA, 32 nt, Human
uccauuccagccacagcagccccucagcgucc

SEQ ID NO: 232739 - RNA, 32 nt, Human
uccauuccagguagcuuugccaccccaccugc

SEQ ID NO: 232740 - RNA, 32 nt, Human
uccauuccagucaucauaggcaucaaaucuua

SEQ ID NO: 232741 - RNA, 32 nt, Human
uccauuccaguucucugauuauagaauccaga

SEQ ID NO: 232742 - RNA, 32 nt, Human
uccauuccauggauuuaaucagucccaagaag

SEQ ID NO: 232743 - RNA, 20 nt, Human
uccauucccuucuccuuccc

SEQ ID NO: 232744 - RNA, 32 nt, Human
uccauucccuuucuuuucaugcccaucccgau

SEQ ID NO: 232745 - RNA, 32 nt, Human
uccauuccuccuggcccaccuggggcauucac

SEQ ID NO: 232746 - RNA, 32 nt, Human
uccauuccucucucccugcccuuuuccugccu

SEQ ID NO: 232747 - RNA, 32 nt, Human
uccauuccuucuucccccucucugcagccucu

SEQ ID NO: 232748 - RNA, 32 nt, Human
uccauuccuuuuggcccugcagcaugucaugc

SEQ ID NO: 232749 - RNA, 32 nt, Human
uccauuccuuuuggcccugcagcaugucgugc

SEQ ID NO: 232750 - RNA, 32 nt, Human
uccauucgccagguuacccaggagaacaagga

SEQ ID NO: 232751 - RNA, 25 nt, Human
uccauucuaaagaugccucugggau

SEQ ID NO: 232752 - RNA, 32 nt, Human
uccauucuagaauuaugagaccaccuuggaga

SEQ ID NO: 232753 - RNA, 32 nt, Human
uccauucucagagcgguuaggauuacuguuua

SEQ ID NO: 232754 - RNA, 32 nt, Human
uccauucucagggcguuugaaugugaauuagg

SEQ ID NO: 232755 - RNA, 24 nt, Human
uccauucucaguuucuuccccaca

SEQ ID NO: 232756 - RNA, 32 nt, Human
uccauucuccaccgugucucauucaucacugc

SEQ ID NO: 232757 - RNA, 22 nt, Human
uccauucuccaugaucccucac

SEQ ID NO: 232758 - RNA, 32 nt, Human
uccauucucccaggagcuucucugcagacuga

SEQ ID NO: 232759 - RNA, 32 nt, Human
uccauucuccccucagauuagcggccggacac

SEQ ID NO: 232760 - RNA, 32 nt, Human
uccauucucuuuuugcugaaucacgucaagua

SEQ ID NO: 232761 - RNA, 32 nt, Human
uccauucugaggguuucaucgucaggugggag

SEQ ID NO: 232762 - RNA, 32 nt, Human
uccauucugcccucccggcuucccaguaagca

SEQ ID NO: 232763 - RNA, 32 nt, Human
uccauucugccuggcuguccauccucucaaca

SEQ ID NO: 232764 - RNA, 24 nt, Human
uccauucuggcaucccagagugga

SEQ ID NO: 232765 - RNA, 20 nt, Human
uccauucugggucgagugga

SEQ ID NO: 232766 - RNA, 32 nt, Human
uccauucuucaauuccagaugcuauucauaau

SEQ ID NO: 232767 - RNA, 32 nt, Human
uccauucuuccuccagccaaccccugaaaauu

SEQ ID NO: 232768 - RNA, 32 nt, Human
uccauucuucucucagcuuuccugugggcagg

SEQ ID NO: 232769 - RNA, 32 nt, Human
uccauucuucuuucaaucuucucagcuuauaa

SEQ ID NO: 232770 - RNA, 32 nt, Human
uccauucuugcccucuggagaagugguuccug

SEQ ID NO: 232771 - RNA, 32 nt, Human
uccauucuuggcuuuuucauucauagagauag

SEQ ID NO: 232772 - RNA, 32 nt, Human
uccauugaaaacaaauccaugagugagaggga

SEQ ID NO: 232773 - RNA, 32 nt, Human
uccauugauuagcucagagaacuguagguaua

SEQ ID NO: 232774 - RNA, 32 nt, Human
uccauugcaauuacuuaucuuccucuucuauc

SEQ ID NO: 232775 - RNA, 32 nt, Human
uccauugcacuccagccugggugacagugaaa

SEQ ID NO: 232776 - RNA, 32 nt, Human
uccauugccacugucuccagguucaguaccug

SEQ ID NO: 232777 - RNA, 23 nt, Human
uccauugcccaggcuggaguaca

SEQ ID NO: 232778 - RNA, 32 nt, Human
uccauugcccuccuggugcuggguuugcccuc

SEQ ID NO: 232779 - RNA, 32 nt, Human
uccauugcccugcucaguuuggcugcauuugg

SEQ ID NO: 232780 - RNA, 32 nt, Human
uccauugcgcccaggcugguaugcagucaugu

SEQ ID NO: 232781 - RNA, 32 nt, Human
uccauugcucaugucacuugugcagugacuga

SEQ ID NO: 232782 - RNA, 32 nt, Human
uccauugcuuuucccuuccuggagucgaugcc

SEQ ID NO: 232783 - RNA, 32 nt, Human
uccauuggaaacaguugcuugaaguagcacag

SEQ ID NO: 232784 - RNA, 32 nt, Human
uccauuggaauauuaagcccaggaguugcuuu

SEQ ID NO: 232785 - RNA, 21 nt, Human
uccauuggauguccccacucc

SEQ ID NO: 232786 - RNA, 32 nt, Human
uccauuggcaauucaaaacaggcugacauaca

SEQ ID NO: 232787 - RNA, 32 nt, Human
uccauuggcaguaccagcaagccagacacucc

SEQ ID NO: 232788 - RNA, 24 nt, Human
uccauuggcugguuuuaccacucc

SEQ ID NO: 232789 - RNA, 32 nt, Human
uccauuggcuugagacacaugacccaaacaua

SEQ ID NO: 232790 - RNA, 32 nt, Human
uccauugggacaugaaguuaaccacagucggg

SEQ ID NO: 232791 - RNA, 32 nt, Human
uccauugggaggguggccagaggagcaggugg

SEQ ID NO: 232792 - RNA, 32 nt, Human
uccauugggggaaagauauucuuggaaccacu

SEQ ID NO: 232793 - RNA, 32 nt, Human
uccauuggucacagugcugccucugggggcca

SEQ ID NO: 232794 - RNA, 32 nt, Human
uccauuguacauugucuauacacacacauaaa

SEQ ID NO: 232795 - RNA, 32 nt, Human
uccauuguaguaguguaggauguaggccauuu

SEQ ID NO: 232796 - RNA, 24 nt, Human
uccauuguaucagauccuuuugua

SEQ ID NO: 232797 - RNA, 32 nt, Human
uccauugucauagcccuuccccuaggccggga

SEQ ID NO: 232798 - RNA, 32 nt, Human
uccauugucuccuggccccacccuccauuggg

SEQ ID NO: 232799 - RNA, 32 nt, Human
uccauugugcaucugccucuuuugacguugga

SEQ ID NO: 232800 - RNA, 32 nt, Human
uccauugugcugccgcccuccgcgcucuccag

SEQ ID NO: 232801 - RNA, 32 nt, Human
uccauuguggguuccugagaguaggacacauu

SEQ ID NO: 232802 - RNA, 32 nt, Human
uccauuguggguuccuggaguaggacacauug

SEQ ID NO: 232803 - RNA, 32 nt, Human
uccauuguggugaggagaauacuucaaugucc

SEQ ID NO: 232804 - RNA, 15 nt, Human
uccauuuaagcuccc

SEQ ID NO: 232805 - RNA, 32 nt, Human
uccauuuacaccauuaugcugugucuccucuu

SEQ ID NO: 232806 - RNA, 23 nt, Human
uccauuuacuguagcucugcuua

SEQ ID NO: 232807 - RNA, 32 nt, Human
uccauuuagaaaauguuaaacugcuuuuccag

SEQ ID NO: 232808 - RNA, 32 nt, Human
uccauuuagacuacuuuccucuucuauuguuu

SEQ ID NO: 232809 - RNA, 32 nt, Human
uccauuuagcuucagguugucuuguuucugua

SEQ ID NO: 232810 - RNA, 32 nt, Human
uccauuuaggguaaccaugcaugugguuaguc

SEQ ID NO: 232811 - RNA, 32 nt, Human
uccauuuauguacccaccuacccggccugggc

SEQ ID NO: 232812 - RNA, 20 nt, Human
uccauuuauucaucauccua

SEQ ID NO: 232813 - RNA, 32 nt, Human
uccauuuauuuagaucuuuuauuucuuucaaa

SEQ ID NO: 232814 - RNA, 18 nt, Human
uccauuucaauacugccg

SEQ ID NO: 232815 - RNA, 32 nt, Human
uccauuuccaucccaucauccuuguccaaugc

SEQ ID NO: 232816 - RNA, 32 nt, Human
uccauuuccugccucuccuuucaccaagcucu

SEQ ID NO: 232817 - RNA, 32 nt, Human
uccauuucgcagaaauaagaaggagaauaaaa

SEQ ID NO: 232818 - RNA, 32 nt, Human
uccauuucucucucauauaucuauauuuaucu

SEQ ID NO: 232819 - RNA, 32 nt, Human
uccauuucugcagcuuagcuuguguccugccc

SEQ ID NO: 232820 - RNA, 32 nt, Human
uccauuucugcucucaaacccuacugggauca

SEQ ID NO: 232821 - RNA, 32 nt, Human
uccauuucuguucacuuuguggagagggcauu

SEQ ID NO: 232822 - RNA, 32 nt, Human
uccauuucuuccacgauggugcaguguaacga

SEQ ID NO: 232823 - RNA, 32 nt, Human
uccauuugaagcaggaggggcuggauuuggaa

SEQ ID NO: 232824 - RNA, 22 nt, Human
uccauuugacaccgcaguucug

SEQ ID NO: 232825 - RNA, 32 nt, Human
uccauuugcaauauuugguuacaccauuugcu

SEQ ID NO: 232826 - RNA, 32 nt, Human
uccauuugcaauauuugguuacaccauuuguu

SEQ ID NO: 232827 - RNA, 25 nt, Human
uccauuugcaccaugccacacugcu

SEQ ID NO: 232828 - RNA, 32 nt, Human
uccauuugguguguauuucacaggguaacaau

SEQ ID NO: 232829 - RNA, 32 nt, Human
uccauuugguuuuacuauuuuaaagugggcgu

SEQ ID NO: 232830 - RNA, 32 nt, Human
uccauuugucagcacuuuccagccugccaauu

SEQ ID NO: 232831 - RNA, 32 nt, Human
uccauuuguggaccaaaagauggaguugguuu

SEQ ID NO: 232832 - RNA, 32 nt, Human
uccauuugugugugugcaaguguguaugugcg

SEQ ID NO: 232833 - RNA, 32 nt, Human
uccauuuguugugaaugaagacuuguccuaua

SEQ ID NO: 232834 - RNA, 25 nt, Human
uccauuuuagcgccgcccgccgucg

SEQ ID NO: 232835 - RNA, 32 nt, Human
uccauuuucaaaggaucuucggcucuacuuuu

SEQ ID NO: 232836 - RNA, 32 nt, Human
uccauuuucccauccaguucuggaguucguag

SEQ ID NO: 232837 - RNA, 32 nt, Human
uccauuuuccccuucagguccucaguggauua

SEQ ID NO: 232838 - RNA, 32 nt, Human
uccauuuucuacaaugcaaccaacagcaacau

SEQ ID NO: 232839 - RNA, 32 nt, Human
uccauuuugauguuuccaauugccuccucucc

SEQ ID NO: 232840 - RNA, 21 nt, Human
uccauuuuguaaaaauauaaa

SEQ ID NO: 232841 - RNA, 32 nt, Human
uccauuuugugaaaccuuagaggacagcggcu

SEQ ID NO: 232842 - RNA, 32 nt, Human
uccauuuuugauucauuccugagaauggcuua

SEQ ID NO: 232843 - RNA, 32 nt, Human
ucccaaaacagcuuccuccauuuccugaaagu

SEQ ID NO: 232844 - RNA, 32 nt, Human
ucccaaaaccacauuuugaaacuagaauagug

SEQ ID NO: 232845 - RNA, 21 nt, Human
ucccaaaaccucauucccuuu

SEQ ID NO: 232846 - RNA, 32 nt, Human
ucccaaaagcagcagaaggugaagcaggaagc

SEQ ID NO: 232847 - RNA, 24 nt, Human
ucccaaaagcuucuugcagucuaa

SEQ ID NO: 232848 - RNA, 32 nt, Human
ucccaaaaggcagaugacggggaguuaggcau

SEQ ID NO: 232849 - RNA, 32 nt, Human
ucccaaaauugcugggauuacaggugugagcc

SEQ ID NO: 232850 - RNA, 32 nt, Human
ucccaaacaaauucugauuccacagagugggg

SEQ ID NO: 232851 - RNA, 18 nt, Human
ucccaaacaccagaccac

SEQ ID NO: 232852 - RNA, 32 nt, Human
ucccaaacagcccaagggccggaacagcaggu

SEQ ID NO: 232853 - RNA, 32 nt, Human
ucccaaacucaggcuuucagcugugcuuuuug

SEQ ID NO: 232854 - RNA, 22 nt, Human
ucccaaagaagaagaugaggaa

SEQ ID NO: 232855 - RNA, 32 nt, Human
ucccaaagaugcacaaugauaaugaugcugau

SEQ ID NO: 232856 - RNA, 32 nt, Human
ucccaaagccaagguucuggcuucauuggcaa

SEQ ID NO: 232857 - RNA, 19 nt, Human
ucccaaagccagccugccu

SEQ ID NO: 232858 - RNA, 20 nt, Human
ucccaaagccguguguuugu

SEQ ID NO: 232859 - RNA, 25 nt, Human
ucccaaagcugcccaguccaugggg

SEQ ID NO: 232860 - RNA, 24 nt, Human
ucccaaaggaauguuuauuuauua

SEQ ID NO: 232861 - RNA, 23 nt, Human
ucccaaaggaauugaaauuuuca

SEQ ID NO: 232862 - RNA, 18 nt, Human
ucccaaaggagcccuuga

SEQ ID NO: 232863 - RNA, 32 nt, Human
ucccaaaggcagcagggaagugcggcggcugu

SEQ ID NO: 232864 - RNA, 32 nt, Human
ucccaaaggccaggaaagguuggggucauuuu

SEQ ID NO: 232865 - RNA, 32 nt, Human
ucccaaagggcucauuccagccauuccaaucu

SEQ ID NO: 232866 - RNA, 32 nt, Human
ucccaaagggcugggacugcaggugcaugcac

SEQ ID NO: 232867 - RNA, 32 nt, Human
ucccaaaggggcaacgggaggaaggggaggcu

SEQ ID NO: 232868 - RNA, 32 nt, Human
ucccaaagugcuagaauuacaggugugagcca

SEQ ID NO: 232869 - RNA, 32 nt, Human
ucccaaagugcuaggauaacaggugugagcca

SEQ ID NO: 232870 - RNA, 32 nt, Human
ucccaaagugcuaggauuacaggcuggagcua

SEQ ID NO: 232871 - RNA, 32 nt, Human
ucccaaagugcucaggauuacaggcgugagcc

SEQ ID NO: 232872 - RNA, 32 nt, Human
ucccaaagugcugggaauacaggugugaacca

SEQ ID NO: 232873 - RNA, 32 nt, Human
ucccaaagugcugggaugacaggugugagcca

SEQ ID NO: 232874 - RNA, 32 nt, Human
ucccaaagugcugggauuacaggcgugagcca

SEQ ID NO: 232875 - RNA, 32 nt, Human
ucccaaagugcugggauuacaggugggagcca

SEQ ID NO: 232876 - RNA, 21 nt, Human
ucccaaaucggccacggcaca

SEQ ID NO: 232877 - RNA, 32 nt, Human
ucccaaaucugaaggacuucaucucccgcuuu

SEQ ID NO: 232878 - RNA, 32 nt, Human
ucccaaaucugucagcaucuggcugucuagaa

SEQ ID NO: 232879 - RNA, 32 nt, Human
ucccaaaugaaauuaugcaacuuugauaucau

SEQ ID NO: 232880 - RNA, 21 nt, Human
ucccaaaugaugaguuuguca

SEQ ID NO: 232881 - RNA, 32 nt, Human
ucccaaauugcccuugcccuaccagagcuccc

SEQ ID NO: 232882 - RNA, 32 nt, Human
ucccaaauugcugggauuuacaggcaugagcc

SEQ ID NO: 232883 - RNA, 32 nt, Human
ucccaacaaggagagaacaauaugucaaccau

SEQ ID NO: 232884 - RNA, 32 nt, Human
ucccaacacagcacacuagucagcccacugcc

SEQ ID NO: 232885 - RNA, 32 nt, Human
ucccaacacaugucuagcuuucaccuccagga

SEQ ID NO: 232886 - RNA, 25 nt, Human
ucccaacacuuugggaggacaggac

SEQ ID NO: 232887 - RNA, 18 nt, Human
ucccaacacuuuugggag

SEQ ID NO: 232888 - RNA, 20 nt, Human
ucccaacagguggacuuguc

SEQ ID NO: 232889 - RNA, 32 nt, Human
ucccaacagugcagaagcacagccugagucuc

SEQ ID NO: 232890 - RNA, 32 nt, Human
ucccaacaguguaaaagcauucauguuucucc

SEQ ID NO: 232891 - RNA, 32 nt, Human
ucccaacaguuugggagguugaggcaggagga

SEQ ID NO: 232892 - RNA, 32 nt, Human
ucccaacauagcacuugagcucugcugaggga

SEQ ID NO: 232893 - RNA, 21 nt, Human
ucccaacaucucaucuucuuu

SEQ ID NO: 232894 - RNA, 32 nt, Human
ucccaacauggugaaaccccaucucuacuaaa

SEQ ID NO: 232895 - RNA, 32 nt, Human
ucccaaccaaaaccacaccauaggguuuucug

SEQ ID NO: 232896 - RNA, 22 nt, Human
ucccaaccaaccagucuucacu

SEQ ID NO: 232897 - RNA, 32 nt, Human
ucccaaccacagugggagccagacugaauaua

SEQ ID NO: 232898 - RNA, 32 nt, Human
ucccaaccacugccgaguuucugccuggagca

SEQ ID NO: 232899 - RNA, 32 nt, Human
ucccaacccacucugccuucuuuuucagcuug

SEQ ID NO: 232900 - RNA, 32 nt, Human
ucccaaccccagcagccugaauacugugcccu

SEQ ID NO: 232901 - RNA, 20 nt, Human
ucccaacccgccacuggcca

SEQ ID NO: 232902 - RNA, 32 nt, Human
ucccaacccuggcuccaaucagccugccuacg

SEQ ID NO: 232903 - RNA, 32 nt, Human
ucccaaccgaagucacuccaggcugggaucaa

SEQ ID NO: 232904 - RNA, 32 nt, Human
ucccaaccucaagugauccacccaccuuguuc

SEQ ID NO: 232905 - RNA, 32 nt, Human
ucccaaccucaagugauccgccugccucgacc

SEQ ID NO: 232906 - RNA, 32 nt, Human
ucccaaccucaagugaucugcccgccucggcc

SEQ ID NO: 232907 - RNA, 32 nt, Human
ucccaaccucagcucucuuccccagccuuuau

SEQ ID NO: 232908 - RNA, 21 nt, Human
ucccaaccucaggugauccgc

SEQ ID NO: 232909 - RNA, 32 nt, Human
ucccaaccucaggugauccuccugccuccgcc

SEQ ID NO: 232910 - RNA, 32 nt, Human
ucccaaccuuucucuccucagucccugcuccu

SEQ ID NO: 232911 - RNA, 32 nt, Human
ucccaacgccagcccuucauccuuccucccuc

SEQ ID NO: 232912 - RNA, 32 nt, Human
ucccaacgugcugggauuacaggugugagcca

SEQ ID NO: 232913 - RNA, 32 nt, Human
ucccaacucagccacaagcucugugaggaugg

SEQ ID NO: 232914 - RNA, 32 nt, Human
ucccaacucagccugcucucacuacgaguuuu

SEQ ID NO: 232915 - RNA, 32 nt, Human
ucccaacucauucuagcuuauuugguguucga

SEQ ID NO: 232916 - RNA, 32 nt, Human
ucccaacuccacccucuuccugccaagcaauc

SEQ ID NO: 232917 - RNA, 32 nt, Human
ucccaacucccaugaccucuggcuucaguggu

SEQ ID NO: 232918 - RNA, 23 nt, Human
ucccaacuccucaugucuucuca

SEQ ID NO: 232919 - RNA, 32 nt, Human
ucccaacucucagucccuuuguucucaugagc

SEQ ID NO: 232920 - RNA, 19 nt, Human
ucccaacugggugcagugg

SEQ ID NO: 232921 - RNA, 32 nt, Human
ucccaacuuagcccugggugggccgggccggg

SEQ ID NO: 232922 - RNA, 32 nt, Human
ucccaacuuccuccaggucauuucccagugug

SEQ ID NO: 232923 - RNA, 32 nt, Human
ucccaagaaaguucagcccagauggaaggugu

SEQ ID NO: 232924 - RNA, 25 nt, Human
ucccaagaaugcagcugucuucucc

SEQ ID NO: 232925 - RNA, 32 nt, Human
ucccaagacaaaccuccagcaggacuucagua

SEQ ID NO: 232926 - RNA, 32 nt, Human
ucccaagacagagcuagagcaagggucucuuu

SEQ ID NO: 232927 - RNA, 32 nt, Human
ucccaagacuuguugagagaugugacaugguu

SEQ ID NO: 232928 - RNA, 19 nt, Human
ucccaagagccccaugagg

SEQ ID NO: 232929 - RNA, 32 nt, Human
ucccaagaggaggagagggaggcugcagacgc

SEQ ID NO: 232930 - RNA, 32 nt, Human
ucccaagagguuaggguuggagaagaaaucac

SEQ ID NO: 232931 - RNA, 32 nt, Human
ucccaagaugcuggagcuaaggggaccugacc

SEQ ID NO: 232932 - RNA, 23 nt, Human
ucccaagcaauccucccaccuca

SEQ ID NO: 232933 - RNA, 32 nt, Human
ucccaagcagaggccccucccucaggcacucc

SEQ ID NO: 232934 - RNA, 18 nt, Human
ucccaagccaccaaugca

SEQ ID NO: 232935 - RNA, 29 nt, Human
ucccaagccacugcacuucggaggggcug

SEQ ID NO: 232936 - RNA, 32 nt, Human
ucccaagccaggcugcccuuccucauuuccca

SEQ ID NO: 232937 - RNA, 32 nt, Human
ucccaagcucaggggcuucucagcauuuaccu

SEQ ID NO: 232938 - RNA, 19 nt, Human
ucccaagcuccauaugcca

SEQ ID NO: 232939 - RNA, 32 nt, Human
ucccaagcugcuguuucaaggcugagcuggcc

SEQ ID NO: 232940 - RNA, 32 nt, Human
ucccaagcuggagucugguggaagaugaggcu

SEQ ID NO: 232941 - RNA, 32 nt, Human
ucccaagcuggcugggguggccuguguggcca

SEQ ID NO: 232942 - RNA, 32 nt, Human
ucccaagcuguuguugaggcugcauuagguca

SEQ ID NO: 232943 - RNA, 32 nt, Human
ucccaagcuucucaaacuguuagcugcugucu

SEQ ID NO: 232944 - RNA, 32 nt, Human
ucccaaggaacacgugacuguguguuuccaca

SEQ ID NO: 232945 - RNA, 32 nt, Human
ucccaaggauguggaggggcagugaggccugg

SEQ ID NO: 232946 - RNA, 32 nt, Human
ucccaaggcauauuucuccuagacccuacagc

SEQ ID NO: 232947 - RNA, 32 nt, Human
ucccaaggcuaaacuuucuaauucccuucuuu

SEQ ID NO: 232948 - RNA, 32 nt, Human
ucccaaggcugaggcaggagaauugcuugagc

SEQ ID NO: 232949 - RNA, 25 nt, Human
ucccaaggcuggcacuaaccaggua

SEQ ID NO: 232950 - RNA, 32 nt, Human
ucccaagggaaacucaggcgugugcugguccc

SEQ ID NO: 232951 - RNA, 32 nt, Human
ucccaagggaagagaaugggcagcagguaugu

SEQ ID NO: 232952 - RNA, 32 nt, Human
ucccaagggacugaaguauacauuuaguuaac

SEQ ID NO: 232953 - RNA, 32 nt, Human
ucccaaggggcuguuugcuguguuuauugacu

SEQ ID NO: 232954 - RNA, 18 nt, Human
ucccaagggucacaugcc

SEQ ID NO: 232955 - RNA, 32 nt, Human
ucccaagggucugggcucugaguuggaacccg

SEQ ID NO: 232956 - RNA, 32 nt, Human
ucccaagguauucuguccuccaggacucugaa

SEQ ID NO: 232957 - RNA, 32 nt, Human
ucccaaggugcuggaauuacaggugugagcca

SEQ ID NO: 232958 - RNA, 32 nt, Human
ucccaaggugcugggauuacaggugugagcca

SEQ ID NO: 232959 - RNA, 32 nt, Human
ucccaagguggaggagggggaaggacaggcag

SEQ ID NO: 232960 - RNA, 32 nt, Human
ucccaagguuugcugggcucugggauccacga

SEQ ID NO: 232961 - RNA, 32 nt, Human
ucccaaguagcuagcugggacuacaggcacgc

SEQ ID NO: 232962 - RNA, 23 nt, Human
ucccaaguagcugggauuacagg

SEQ ID NO: 232963 - RNA, 32 nt, Human
ucccaaguccugcuccuuucugcccagccugc

SEQ ID NO: 232964 - RNA, 27 nt, Human
ucccaagucuucaaggagaagauucuc

SEQ ID NO: 232965 - RNA, 32 nt, Human
ucccaagugugcccucuucccucucuccagau

SEQ ID NO: 232966 - RNA, 32 nt, Human
ucccaaguucaagcgauuguccugccucagcu

SEQ ID NO: 232967 - RNA, 32 nt, Human
ucccaaguucaagugauucuccugccugagcc

SEQ ID NO: 232968 - RNA, 32 nt, Human
ucccaaguucacaccauucuccugccucagcc

SEQ ID NO: 232969 - RNA, 32 nt, Human
ucccaaguucacgccauucuccugccucagcc

SEQ ID NO: 232970 - RNA, 32 nt, Human
ucccaaguucaugccauucuccugccucagcc

SEQ ID NO: 232971 - RNA, 32 nt, Human
ucccaaguuucccacccuccacccuaaaaauu

SEQ ID NO: 232972 - RNA, 32 nt, Human
ucccaaguuugaagguucagacuuaaaccuga

SEQ ID NO: 232973 - RNA, 22 nt, Human
ucccaaguuuucauccaacugc

SEQ ID NO: 232974 - RNA, 21 nt, Human
ucccaauacaggcaugaacca

SEQ ID NO: 232975 - RNA, 32 nt, Human
ucccaauagggugggggccugugggccagagg

SEQ ID NO: 232976 - RNA, 32 nt, Human
ucccaaucaaagugccaagugagcuugaaguu

SEQ ID NO: 232977 - RNA, 32 nt, Human
ucccaaucaccagaggaaguugcuguaagccc

SEQ ID NO: 232978 - RNA, 32 nt, Human
ucccaauccagucuacccucaaaggagcuggg

SEQ ID NO: 232979 - RNA, 32 nt, Human
ucccaauccccacagacacacacauugauccu

SEQ ID NO: 232980 - RNA, 22 nt, Human
ucccaauccugcugucuucucc

SEQ ID NO: 232981 - RNA, 32 nt, Human
ucccaaucgggagggagagacagagacagagc

SEQ ID NO: 232982 - RNA, 32 nt, Human
ucccaaucuggugagcgcuacacaccuucauc

SEQ ID NO: 232983 - RNA, 32 nt, Human
ucccaauggaggggagguugcaggggagagcu

SEQ ID NO: 232984 - RNA, 31 nt, Human
ucccaauggaugggcucagccaauuucaccc

SEQ ID NO: 232985 - RNA, 30 nt, Human
ucccaauggcccuguccuuuucuuuacuga

SEQ ID NO: 232986 - RNA, 23 nt, Human
ucccaaugucagucugccucuuu

SEQ ID NO: 232987 - RNA, 32 nt, Human
ucccaauguccaccccugccuccccuucacug

SEQ ID NO: 232988 - RNA, 32 nt, Human
ucccaaugugaaugcaucuacagaagaaacug

SEQ ID NO: 232989 - RNA, 32 nt, Human
ucccaauuuucuuuuuacucccccucuuaagg

SEQ ID NO: 232990 - RNA, 32 nt, Human
ucccacaaaaaccugaggcagcucuuuugccc

SEQ ID NO: 232991 - RNA, 21 nt, Human
ucccacaaaagucagcaccuu

SEQ ID NO: 232992 - RNA, 22 nt, Human
ucccacaaaagucagcaccuuc

SEQ ID NO: 232993 - RNA, 32 nt, Human
ucccacaaagugcugggauuacaggugugagc

SEQ ID NO: 232994 - RNA, 32 nt, Human
ucccacaacaccaagccucagugagaaaucaa

SEQ ID NO: 232995 - RNA, 32 nt, Human
ucccacaacagcuucccacagcaugaagaucu

SEQ ID NO: 232996 - RNA, 32 nt, Human
ucccacaacgaugacucugccucuugucagcc

SEQ ID NO: 232997 - RNA, 32 nt, Human
ucccacaagaagcugguggagcagaguguucc

SEQ ID NO: 232998 - RNA, 32 nt, Human
ucccacaagccuuaggcuuuacaggguuguau

SEQ ID NO: 232999 - RNA, 32 nt, Human
ucccacaaggcugcuuggccucagugggugcu

SEQ ID NO: 233000 - RNA, 32 nt, Human
ucccacaaguugagagugugucucucccucau

SEQ ID NO: 233001 - RNA, 32 nt, Human
ucccacaaugcugaugaaaacugucaagcugc

SEQ ID NO: 233002 - RNA, 32 nt, Human
ucccacaauuugcuuucuccuccucaaggguu

SEQ ID NO: 233003 - RNA, 32 nt, Human
ucccacacaaucccuguacucugacccauagc

SEQ ID NO: 233004 - RNA, 32 nt, Human
ucccacacacuguucaaaaauagacugccauu

SEQ ID NO: 233005 - RNA, 20 nt, Human
ucccacacagcccauggagg

SEQ ID NO: 233006 - RNA, 32 nt, Human
ucccacacagccgccucugcuccagcaaggau

SEQ ID NO: 233007 - RNA, 32 nt, Human
ucccacacagcugucuguucugccaguuagug

SEQ ID NO: 233008 - RNA, 32 nt, Human
ucccacacaguuccugagcuggugccaggcag

SEQ ID NO: 233009 - RNA, 32 nt, Human
ucccacacaugauccuucuucccuucaucacc

SEQ ID NO: 233010 - RNA, 21 nt, Human
ucccacaccacuguagucaga

SEQ ID NO: 233011 - RNA, 18 nt, Human
ucccacaccagcugugaa

SEQ ID NO: 233012 - RNA, 32 nt, Human
ucccacacccacccuggcuuccaucaugagug

SEQ ID NO: 233013 - RNA, 24 nt, Human
ucccacaccccacccucccuuccc

SEQ ID NO: 233014 - RNA, 20 nt, Human
ucccacaccccagccaucca

SEQ ID NO: 233015 - RNA, 18 nt, Human
ucccacaccggcugugga

SEQ ID NO: 233016 - RNA, 32 nt, Human
ucccacaccucacuuuucacagccucugaggg

SEQ ID NO: 233017 - RNA, 32 nt, Human
ucccacaccuguaaucucagcacuuuaggagg

SEQ ID NO: 233018 - RNA, 32 nt, Human
ucccacaccuuuguuccucaauagcugggggc

SEQ ID NO: 233019 - RNA, 32 nt, Human
ucccacacgagcccagcucucccuucgaguag

SEQ ID NO: 233020 - RNA, 32 nt, Human
ucccacacgccugggcuguauggcaggaccuc

SEQ ID NO: 233021 - RNA, 32 nt, Human
ucccacacucacucacuuuccuaggagcccac

SEQ ID NO: 233022 - RNA, 32 nt, Human
ucccacacugcagcuuuaucuuuaggcuuaug

SEQ ID NO: 233023 - RNA, 32 nt, Human
ucccacacugcucccaguccugggcacagugg

SEQ ID NO: 233024 - RNA, 25 nt, Human
ucccacacuucuuuucucccauccc

SEQ ID NO: 233025 - RNA, 32 nt, Human
ucccacagacaucuuacacuugcucgacacug

SEQ ID NO: 233026 - RNA, 19 nt, Human
ucccacagacaugccuucc

SEQ ID NO: 233027 - RNA, 18 nt, Human
ucccacagacugccccag

SEQ ID NO: 233028 - RNA, 18 nt, Human
ucccacagcagcugugaa

SEQ ID NO: 233029 - RNA, 21 nt, Human
ucccacagcagggacugugag

SEQ ID NO: 233030 - RNA, 32 nt, Human
ucccacagcauggccacacugcaccuccuucg

SEQ ID NO: 233031 - RNA, 32 nt, Human
ucccacagcccagcagauagcucauuggcuua

SEQ ID NO: 233032 - RNA, 32 nt, Human
ucccacagccuccuucucaccuuuuccauaac

SEQ ID NO: 233033 - RNA, 32 nt, Human
ucccacagccuggucccugauacugggcucug

SEQ ID NO: 233034 - RNA, 32 nt, Human
ucccacagccuguaacucaguguuuuguacuu

SEQ ID NO: 233035 - RNA, 32 nt, Human
ucccacagcuggagcacgcagagcaggcauca

SEQ ID NO: 233036 - RNA, 32 nt, Human
ucccacagcuuccugagggcuaauucugggaa

SEQ ID NO: 233037 - RNA, 30 nt, Human
ucccacagcuugcaaggaccaagggaggcc

SEQ ID NO: 233038 - RNA, 32 nt, Human
ucccacagcuuucugcccauuguuucuuacua

SEQ ID NO: 233039 - RNA, 32 nt, Human
ucccacaggauugugggcucucugcuuccuua

SEQ ID NO: 233040 - RNA, 23 nt, Human
ucccacaggcaauaccccugggc

SEQ ID NO: 233041 - RNA, 32 nt, Human
ucccacaggccugucugguauuuguggagcau

SEQ ID NO: 233042 - RNA, 32 nt, Human
ucccacaggcuggagugcaauggugugaucuc

SEQ ID NO: 233043 - RNA, 32 nt, Human
ucccacagggcaccuggcuggggcucaugccu

SEQ ID NO: 233044 - RNA, 32 nt, Human
ucccacaggggaaaucugggcgugcuguagcu

SEQ ID NO: 233045 - RNA, 32 nt, Human
ucccacaguccccaccgcgggacuguuccauu

SEQ ID NO: 233046 - RNA, 32 nt, Human
ucccacagugggcaggaggccaccaagaggug

SEQ ID NO: 233047 - RNA, 32 nt, Human
ucccacagugugcuggaaugguuaucacaaga

SEQ ID NO: 233048 - RNA, 32 nt, Human
ucccacaguugcccuggugaugacuuagggcu

SEQ ID NO: 233049 - RNA, 32 nt, Human
ucccacaguuguucccgcucugcaccuguguu

SEQ ID NO: 233050 - RNA, 21 nt, Human
ucccacaucccaguccugagg

SEQ ID NO: 233051 - RNA, 25 nt, Human
ucccacauccguccucccccuuccc

SEQ ID NO: 233052 - RNA, 32 nt, Human
ucccacauccucccccucccuuuccucaugaa

SEQ ID NO: 233053 - RNA, 32 nt, Human
ucccacaucugccucagacuggagggggcuca

SEQ ID NO: 233054 - RNA, 32 nt, Human
ucccacaucuuuccucaaguaucuucuauuuu

SEQ ID NO: 233055 - RNA, 22 nt, Human
ucccacaugccacccccuuccc

SEQ ID NO: 233056 - RNA, 32 nt, Human
ucccacaugccacccccuucccuguccuuccc

SEQ ID NO: 233057 - RNA, 32 nt, Human
ucccacaugccccgcaugcgugcaaugccucc

SEQ ID NO: 233058 - RNA, 20 nt, Human
ucccacauggaaauguaucc

SEQ ID NO: 233059 - RNA, 24 nt, Human
ucccacauggaagacgcuauucca

SEQ ID NO: 233060 - RNA, 18 nt, Human
ucccaccacagccaccca

SEQ ID NO: 233061 - RNA, 18 nt, Human
ucccaccacagccuccca

SEQ ID NO: 233062 - RNA, 22 nt, Human
ucccaccacagccucccaggua

SEQ ID NO: 233063 - RNA, 32 nt, Human
ucccaccaccaccaccaccagcaccaccacuc

SEQ ID NO: 233064 - RNA, 32 nt, Human
ucccaccacugcacuccagccugggaagcaga

SEQ ID NO: 233065 - RNA, 32 nt, Human
ucccaccacugcacuccagccugggcgacaca

SEQ ID NO: 233066 - RNA, 32 nt, Human
ucccaccacugcacuccagccugggcgacaga

SEQ ID NO: 233067 - RNA, 32 nt, Human
ucccaccacugcacuccagccugggugacaga

SEQ ID NO: 233068 - RNA, 32 nt, Human
ucccaccagcccaguggcuggggucagcuuag

SEQ ID NO: 233069 - RNA, 19 nt, Human
ucccaccagugaucgagaa

SEQ ID NO: 233070 - RNA, 32 nt, Human
ucccaccauacagacagcgagauccaagaaga

SEQ ID NO: 233071 - RNA, 32 nt, Human
ucccaccaucuuaccuggaauauaaggcugcc

SEQ ID NO: 233072 - RNA, 32 nt, Human
ucccaccauugcacuccagccugggcaacaga

SEQ ID NO: 233073 - RNA, 32 nt, Human
ucccaccauuuucucaguuucucccucucucu

SEQ ID NO: 233074 - RNA, 32 nt, Human
ucccacccaaccacaggccccacuugcuaagg

SEQ ID NO: 233075 - RNA, 32 nt, Human
ucccacccacaugugacacauaugcaccuugu

SEQ ID NO: 233076 - RNA, 32 nt, Human
ucccacccaccacccuucccucugaacaaaug

SEQ ID NO: 233077 - RNA, 19 nt, Human
ucccacccacccucccaca

SEQ ID NO: 233078 - RNA, 32 nt, Human
ucccacccaccucuggcugaaggugcucaaga

SEQ ID NO: 233079 - RNA, 32 nt, Human
ucccacccaccugagcgccauguguucccgga

SEQ ID NO: 233080 - RNA, 32 nt, Human
ucccacccagaacgcuucaguucugcucugca

SEQ ID NO: 233081 - RNA, 32 nt, Human
ucccacccagcagaccaggagauagcuggggg

SEQ ID NO: 233082 - RNA, 32 nt, Human
ucccacccauagacuggcugggccaggaggga

SEQ ID NO: 233083 - RNA, 32 nt, Human
ucccacccauagguaguucuuaaaccagguga

SEQ ID NO: 233084 - RNA, 32 nt, Human
ucccacccaucuccaguaggaaauugauuuug

SEQ ID NO: 233085 - RNA, 32 nt, Human
ucccaccccaacuccagcauccucuccagcuc

SEQ ID NO: 233086 - RNA, 20 nt, Human
ucccaccccacaaacaaagg

SEQ ID NO: 233087 - RNA, 32 nt, Human
ucccaccccacaccccucccagaucugcucac

SEQ ID NO: 233088 - RNA, 16 nt, Human
ucccaccccacuucua

SEQ ID NO: 233089 - RNA, 32 nt, Human
ucccaccccagacgucaccacagggaccagaa

SEQ ID NO: 233090 - RNA, 22 nt, Human
ucccaccccagccucccaagua

SEQ ID NO: 233091 - RNA, 22 nt, Human
ucccaccccagccucccaggua

SEQ ID NO: 233092 - RNA, 26 nt, Human
ucccaccccagggggugcccccaggc

SEQ ID NO: 233093 - RNA, 32 nt, Human
ucccaccccauucuggcgacacuuggagccau

SEQ ID NO: 233094 - RNA, 32 nt, Human
ucccacccccaaaccaccgacucucauugccg

SEQ ID NO: 233095 - RNA, 32 nt, Human
ucccacccccaccuuuguucugaggccuuuag

SEQ ID NO: 233096 - RNA, 32 nt, Human
ucccacccccuucucugcuccaccacauccuc

SEQ ID NO: 233097 - RNA, 32 nt, Human
ucccaccccuaaugcugacaaaaagcuuagcc

SEQ ID NO: 233098 - RNA, 32 nt, Human
ucccaccccuaccucuaguaaauuuaagucca

SEQ ID NO: 233099 - RNA, 16 nt, Human
ucccaccccucccucu

SEQ ID NO: 233100 - RNA, 32 nt, Human
ucccaccccucggaguagagcugcacaugcgg

SEQ ID NO: 233101 - RNA, 32 nt, Human
ucccaccccugccccacuuuaccauagagacc

SEQ ID NO: 233102 - RNA, 32 nt, Human
ucccaccccugccuccuccagaccgcugacca

SEQ ID NO: 233103 - RNA, 32 nt, Human
ucccaccccugccuguuccccuucucccggcc

SEQ ID NO: 233104 - RNA, 32 nt, Human
ucccaccccugccuuugcggccccgcacauuu

SEQ ID NO: 233105 - RNA, 26 nt, Human
ucccaccccugcucccuucaucccuc

SEQ ID NO: 233106 - RNA, 22 nt, Human
ucccaccccuggacugggcugg

SEQ ID NO: 233107 - RNA, 32 nt, Human
ucccaccccuucucuaacacuagcuucaaggc

SEQ ID NO: 233108 - RNA, 32 nt, Human
ucccaccccuugcccuuuccccaaaggaccuu

SEQ ID NO: 233109 - RNA, 24 nt, Human
ucccacccgaccuuccucucuguc

SEQ ID NO: 233110 - RNA, 32 nt, Human
ucccacccgcgucucccuaucccuggaggccu

SEQ ID NO: 233111 - RNA, 25 nt, Human
ucccacccgggaucuccaucucucu

SEQ ID NO: 233112 - RNA, 32 nt, Human
ucccacccgggggccuugggccccagacaugc

SEQ ID NO: 233113 - RNA, 32 nt, Human
ucccacccucacugcgggccucugcugucaca

SEQ ID NO: 233114 - RNA, 32 nt, Human
ucccacccuccccuccugacccuccuacgagg

SEQ ID NO: 233115 - RNA, 23 nt, Human
ucccacccucuagacaacucucu

SEQ ID NO: 233116 - RNA, 26 nt, Human
ucccacccucuauguucuuaccccuc

SEQ ID NO: 233117 - RNA, 32 nt, Human
ucccacccugaacaacgagccuuuucacccuu

SEQ ID NO: 233118 - RNA, 32 nt, Human
ucccacccugaaggagcucaugccaggcaggg

SEQ ID NO: 233119 - RNA, 19 nt, Human
ucccacccugcccccuaca

SEQ ID NO: 233120 - RNA, 19 nt, Human
ucccacccuuucuccucaa

SEQ ID NO: 233121 - RNA, 22 nt, Human
ucccacccuuuucucuccuccc

SEQ ID NO: 233122 - RNA, 32 nt, Human
ucccaccgaaugcucccucuaacacacucuua

SEQ ID NO: 233123 - RNA, 32 nt, Human
ucccaccgcacuccagccugggcaacagagug

SEQ ID NO: 233124 - RNA, 32 nt, Human
ucccaccgccuaccuuagcacagggucucugc

SEQ ID NO: 233125 - RNA, 24 nt, Human
ucccaccgcugccucguagaguga

SEQ ID NO: 233126 - RNA, 21 nt, Human
ucccaccguccacaucccucu

SEQ ID NO: 233127 - RNA, 32 nt, Human
ucccaccuauaaucccagcaguuugggaggcu

SEQ ID NO: 233128 - RNA, 32 nt, Human
ucccaccuauucucccugccggugcccaaguu

SEQ ID NO: 233129 - RNA, 32 nt, Human
ucccaccucacacccuucacucuccuuuuucu

SEQ ID NO: 233130 - RNA, 32 nt, Human
ucccaccucacagaggagacggaggccaggag

SEQ ID NO: 233131 - RNA, 18 nt, Human
ucccaccucagccaccca

SEQ ID NO: 233132 - RNA, 18 nt, Human
ucccaccucagccaucca

SEQ ID NO: 233133 - RNA, 22 nt, Human
ucccaccucagccucccaagca

SEQ ID NO: 233134 - RNA, 22 nt, Human
ucccaccucagccucccaagua

SEQ ID NO: 233135 - RNA, 32 nt, Human
ucccaccucagccucuggaguagcugggacca

SEQ ID NO: 233136 - RNA, 19 nt, Human
ucccaccucagcuucucaa

SEQ ID NO: 233137 - RNA, 21 nt, Human
ucccaccucauuccccaccuc

SEQ ID NO: 233138 - RNA, 32 nt, Human
ucccaccucauuccccaccucuaccuuucuaa

SEQ ID NO: 233139 - RNA, 32 nt, Human
ucccaccuccacugucugcugccucugugugu

SEQ ID NO: 233140 - RNA, 32 nt, Human
ucccaccucccagggcuccuugccuuaggugg

SEQ ID NO: 233141 - RNA, 24 nt, Human
ucccaccucccccucccccuucuc

SEQ ID NO: 233142 - RNA, 22 nt, Human
ucccaccuccgcggcccugggc

SEQ ID NO: 233143 - RNA, 23 nt, Human
ucccaccuccugcccaucccucu

SEQ ID NO: 233144 - RNA, 32 nt, Human
ucccaccuccuugagcuccgccacccuucccg

SEQ ID NO: 233145 - RNA, 32 nt, Human
ucccaccucgcugaacaccaucccgccauuag

SEQ ID NO: 233146 - RNA, 19 nt, Human
ucccaccucucccccucca

SEQ ID NO: 233147 - RNA, 32 nt, Human
ucccaccucucuccaccacauacuuacagggc

SEQ ID NO: 233148 - RNA, 21 nt, Human
ucccaccucugccucccgagu

SEQ ID NO: 233149 - RNA, 22 nt, Human
ucccaccucugugaccucaggc

SEQ ID NO: 233150 - RNA, 32 nt, Human
ucccaccucuuccuccuccuagcuccccaagc

SEQ ID NO: 233151 - RNA, 32 nt, Human
ucccaccucuuucccaggcaccugggcccugc

SEQ ID NO: 233152 - RNA, 32 nt, Human
ucccaccugaguccuguucccugaaacuggga

SEQ ID NO: 233153 - RNA, 32 nt, Human
ucccaccugcagcaugcccagcccaagugccc

SEQ ID NO: 233154 - RNA, 32 nt, Human
ucccaccugcagcugcccuggaauucccuucg

SEQ ID NO: 233155 - RNA, 32 nt, Human
ucccaccugccuguccacugcccaugacugag

SEQ ID NO: 233156 - RNA, 32 nt, Human
ucccaccugcuacccugaucagagucaucaug

SEQ ID NO: 233157 - RNA, 32 nt, Human
ucccaccugcugcuacacucaugucugaggca

SEQ ID NO: 233158 - RNA, 23 nt, Human
ucccaccuggacuggcucaguga

SEQ ID NO: 233159 - RNA, 32 nt, Human
ucccaccuggauacccagaagcuaagaaggug

SEQ ID NO: 233160 - RNA, 32 nt, Human
ucccaccuggggaggaaaggaagggcugggaa

SEQ ID NO: 233161 - RNA, 32 nt, Human
ucccaccuguaaucucagcccuucccgaggcu

SEQ ID NO: 233162 - RNA, 32 nt, Human
ucccaccugugcaguguggccccggccagacg

SEQ ID NO: 233163 - RNA, 32 nt, Human
ucccaccuguggcaaaugcuggagccucaguu

SEQ ID NO: 233164 - RNA, 32 nt, Human
ucccaccuucacccucuuccuuccccagccag

SEQ ID NO: 233165 - RNA, 32 nt, Human
ucccaccuucaggcaggauuggguauacaugu

SEQ ID NO: 233166 - RNA, 32 nt, Human
ucccaccuugcauuucagaccugggcuggcag

SEQ ID NO: 233167 - RNA, 32 nt, Human
ucccacgaauaacauuuucauuucuuaaaauu

SEQ ID NO: 233168 - RNA, 32 nt, Human
ucccacgagaucuggagguuuuuguugaaaug

SEQ ID NO: 233169 - RNA, 25 nt, Human
ucccacgaggcucagcucucaggca

SEQ ID NO: 233170 - RNA, 21 nt, Human
ucccacgcccccaccccccac

SEQ ID NO: 233171 - RNA, 32 nt, Human
ucccacgcgccgcgcagccucggugggcgccc

SEQ ID NO: 233172 - RNA, 17 nt, Human
ucccacgcucuccggug

SEQ ID NO: 233173 - RNA, 32 nt, Human
ucccacgcugccccuaguccugggcauggagc

SEQ ID NO: 233174 - RNA, 32 nt, Human
ucccacgcuuccucucucucgaggccacugaa

SEQ ID NO: 233175 - RNA, 32 nt, Human
ucccacgggaacaggcuuccaccccagcacuu

SEQ ID NO: 233176 - RNA, 25 nt, Human
ucccacgggguuccggccucccagg

SEQ ID NO: 233177 - RNA, 32 nt, Human
ucccacgguucccaggggccaggcugggagcc

SEQ ID NO: 233178 - RNA, 32 nt, Human
ucccacguccaggagacaaggaagguagggca

SEQ ID NO: 233179 - RNA, 18 nt, Human
ucccacgucuaacuggaa

SEQ ID NO: 233180 - RNA, 22 nt, Human
ucccacguggacaccagcucca

SEQ ID NO: 233181 - RNA, 20 nt, Human
ucccacguguuccuguugaa

SEQ ID NO: 233182 - RNA, 32 nt, Human
ucccacguguucuuucccaucuggcggccgcg

SEQ ID NO: 233183 - RNA, 32 nt, Human
ucccacuacauacaggucucuuccuguuucau

SEQ ID NO: 233184 - RNA, 32 nt, Human
ucccacuacaucugggacugacuuuccgagcc

SEQ ID NO: 233185 - RNA, 32 nt, Human
ucccacuacugcauuccagccuggguggacag

SEQ ID NO: 233186 - RNA, 32 nt, Human
ucccacuacuuuccuuucccucugcccugcca

SEQ ID NO: 233187 - RNA, 32 nt, Human
ucccacuagccugaagcaaugaccucauucca

SEQ ID NO: 233188 - RNA, 32 nt, Human
ucccacuaucuugcacacaggugcucuaacca

SEQ ID NO: 233189 - RNA, 32 nt, Human
ucccacucacuggaaucuccagccuuccagau

SEQ ID NO: 233190 - RNA, 32 nt, Human
ucccacucagauugcuucaagagaccaacaga

SEQ ID NO: 233191 - RNA, 32 nt, Human
ucccacuccacuccaggcugccggcaccugcc

SEQ ID NO: 233192 - RNA, 16 nt, Human
ucccacuccagcccca

SEQ ID NO: 233193 - RNA, 32 nt, Human
ucccacuccaggccuggaucccuuccuucuau

SEQ ID NO: 233194 - RNA, 32 nt, Human
ucccacucccacaugucugggcaccugcccug

SEQ ID NO: 233195 - RNA, 32 nt, Human
ucccacucccuaauccuggagaccccuucaaa

SEQ ID NO: 233196 - RNA, 24 nt, Human
ucccacucccuuuccccucuuccc

SEQ ID NO: 233197 - RNA, 32 nt, Human
ucccacuccgcccucugaggaugguaccaaga

SEQ ID NO: 233198 - RNA, 32 nt, Human
ucccacuccuaaucaagagucucuccagccuc

SEQ ID NO: 233199 - RNA, 32 nt, Human
ucccacuccucuucagucuuuacacccugcca

SEQ ID NO: 233200 - RNA, 32 nt, Human
ucccacuccuucuccccauuucugucccacag

SEQ ID NO: 233201 - RNA, 32 nt, Human
ucccacuccuuuccugucugugugguguaagu

SEQ ID NO: 233202 - RNA, 32 nt, Human
ucccacucuccacuucccaguuugcaaaugug

SEQ ID NO: 233203 - RNA, 32 nt, Human
ucccacucuccugccccaaucuaucuaguacu

SEQ ID NO: 233204 - RNA, 32 nt, Human
ucccacucucucuccaaauuuccucuucggag

SEQ ID NO: 233205 - RNA, 32 nt, Human
ucccacucuuaucaccucuccccagcaagugc

SEQ ID NO: 233206 - RNA, 32 nt, Human
ucccacucuugccucuuugugcugcuguuucg

SEQ ID NO: 233207 - RNA, 18 nt, Human
ucccacucuuucuucaua

SEQ ID NO: 233208 - RNA, 25 nt, Human
ucccacugaaggaaacucuuucuca

SEQ ID NO: 233209 - RNA, 32 nt, Human
ucccacugagcacaucguggcuaccugacuug

SEQ ID NO: 233210 - RNA, 32 nt, Human
ucccacugaggcggcuccagccccagacaaca

SEQ ID NO: 233211 - RNA, 32 nt, Human
ucccacugagucucauuccucuguccccgagc

SEQ ID NO: 233212 - RNA, 32 nt, Human
ucccacugauaggagguguugggugguguuau

SEQ ID NO: 233213 - RNA, 32 nt, Human
ucccacugcaacuuuucagcucagggguuguu

SEQ ID NO: 233214 - RNA, 32 nt, Human
ucccacugcacacucccacuuccucagcgacc

SEQ ID NO: 233215 - RNA, 32 nt, Human
ucccacugcacuccagccugagugacagagcg

SEQ ID NO: 233216 - RNA, 32 nt, Human
ucccacugcacuccagccuggccaauaagacc

SEQ ID NO: 233217 - RNA, 32 nt, Human
ucccacugcacuccagccugggcaacagagug

SEQ ID NO: 233218 - RNA, 32 nt, Human
ucccacugcacuccagccugggcgacagagcc

SEQ ID NO: 233219 - RNA, 32 nt, Human
ucccacugcacuccccaguggcuggcguggcu

SEQ ID NO: 233220 - RNA, 32 nt, Human
ucccacugcagaagggccucuugagugcgaug

SEQ ID NO: 233221 - RNA, 32 nt, Human
ucccacugcagagaugacauccccucuucucc

SEQ ID NO: 233222 - RNA, 32 nt, Human
ucccacugcagccucugccugcucugccgccg

SEQ ID NO: 233223 - RNA, 32 nt, Human
ucccacugcauauuuccaucuugaauuggugg

SEQ ID NO: 233224 - RNA, 32 nt, Human
ucccacugcauuccagccugggcaacagcgug

SEQ ID NO: 233225 - RNA, 21 nt, Human
ucccacugccagucugucuuc

SEQ ID NO: 233226 - RNA, 22 nt, Human
ucccacugcccaccccaucaca

SEQ ID NO: 233227 - RNA, 32 nt, Human
ucccacugcccucagccccacuucucagccug

SEQ ID NO: 233228 - RNA, 32 nt, Human
ucccacugcucaccuuggucucucuuccuucu

SEQ ID NO: 233229 - RNA, 32 nt, Human
ucccacugcugcacuuuagccugggugaaaaa

SEQ ID NO: 233230 - RNA, 32 nt, Human
ucccacugcuucuuccuccuuucucaaccauc

SEQ ID NO: 233231 - RNA, 19 nt, Human
ucccacuggaaggaccaga

SEQ ID NO: 233232 - RNA, 32 nt, Human
ucccacuggcacugcacgaggggccaggagag

SEQ ID NO: 233233 - RNA, 32 nt, Human
ucccacuggccucuguacauuucccugugguu

SEQ ID NO: 233234 - RNA, 32 nt, Human
ucccacuggcgaagauggucuccauaucagcu

SEQ ID NO: 233235 - RNA, 32 nt, Human
ucccacuggcucugcugaccuugugccuugga

SEQ ID NO: 233236 - RNA, 32 nt, Human
ucccacugggaagcuucaacauagcuguggaa

SEQ ID NO: 233237 - RNA, 32 nt, Human
ucccacugggagggcggcgggccugcagcccg

SEQ ID NO: 233238 - RNA, 18 nt, Human
ucccacuggggacuguga

SEQ ID NO: 233239 - RNA, 32 nt, Human
ucccacugggguccagggagcaggcggugggc

SEQ ID NO: 233240 - RNA, 32 nt, Human
ucccacugucucucuccuucucuccaguuuug

SEQ ID NO: 233241 - RNA, 31 nt, Human
ucccacuuacucaaggaggugggggcaggga

SEQ ID NO: 233242 - RNA, 32 nt, Human
ucccacuucagaggaggcagaaauggaagcau

SEQ ID NO: 233243 - RNA, 22 nt, Human
ucccacuucagccucccaagca

SEQ ID NO: 233244 - RNA, 32 nt, Human
ucccacuucagugcuguccuccugggcgugug

SEQ ID NO: 233245 - RNA, 32 nt, Human
ucccacuucauaaagcuuuuacccaaucuuau

SEQ ID NO: 233246 - RNA, 32 nt, Human
ucccacuucauuuuaaagccagucccagcagg

SEQ ID NO: 233247 - RNA, 32 nt, Human
ucccacuuccccucucugauuggggguguaua

SEQ ID NO: 233248 - RNA, 16 nt, Human
ucccacuucccugaca

SEQ ID NO: 233249 - RNA, 32 nt, Human
ucccacuuccucagccccaucugucccuccau

SEQ ID NO: 233250 - RNA, 32 nt, Human
ucccacuuccuguuuccaucugcuugggauau

SEQ ID NO: 233251 - RNA, 32 nt, Human
ucccacuuccuucagggauucucccuaaauuu

SEQ ID NO: 233252 - RNA, 32 nt, Human
ucccacuucucaucuuaaaaauauugucaugu

SEQ ID NO: 233253 - RNA, 32 nt, Human
ucccacuugagguugaggcguacuggagacaa

SEQ ID NO: 233254 - RNA, 32 nt, Human
ucccacuugcaaucccagcuauuugggaggcu

SEQ ID NO: 233255 - RNA, 32 nt, Human
ucccacuugcccacucuccuuccuggaguguu

SEQ ID NO: 233256 - RNA, 16 nt, Human
ucccacuuguccucca

SEQ ID NO: 233257 - RNA, 22 nt, Human
ucccacuuuagccucccaagua

SEQ ID NO: 233258 - RNA, 32 nt, Human
ucccacuuuguccaggaggagccugaggccca

SEQ ID NO: 233259 - RNA, 19 nt, Human
ucccagaaaaagccagagg

SEQ ID NO: 233260 - RNA, 30 nt, Human
ucccagaaaauguaaagaauggauaccagc

SEQ ID NO: 233261 - RNA, 32 nt, Human
ucccagaaaccaaaggcucuuuucagagccac

SEQ ID NO: 233262 - RNA, 32 nt, Human
ucccagaaaccaguccuauaucuggccagagg

SEQ ID NO: 233263 - RNA, 32 nt, Human
ucccagaaagggucugccauggaguuggcagu

SEQ ID NO: 233264 - RNA, 18 nt, Human
ucccagaaaugucaugag

SEQ ID NO: 233265 - RNA, 32 nt, Human
ucccagaaauuggcuuagcaugugaguguugc

SEQ ID NO: 233266 - RNA, 24 nt, Human
ucccagaacaugacaaauuaugaa

SEQ ID NO: 233267 - RNA, 22 nt, Human
ucccagaacccagccaugcugg

SEQ ID NO: 233268 - RNA, 24 nt, Human
ucccagaacccagccaugcuggca

SEQ ID NO: 233269 - RNA, 32 nt, Human
ucccagaacccagcgcgcucugugcuggcggg

SEQ ID NO: 233270 - RNA, 32 nt, Human
ucccagaacccccuuccucugcuccuccauga

SEQ ID NO: 233271 - RNA, 19 nt, Human
ucccagaaccccguugggg

SEQ ID NO: 233272 - RNA, 22 nt, Human
ucccagaacccucucuccaagg

SEQ ID NO: 233273 - RNA, 21 nt, Human
ucccagaaccuccucacuagg

SEQ ID NO: 233274 - RNA, 19 nt, Human
ucccagaaccugccacagg

SEQ ID NO: 233275 - RNA, 19 nt, Human
ucccagaaccuugaugggg

SEQ ID NO: 233276 - RNA, 21 nt, Human
ucccagaacugacuccuaagg

SEQ ID NO: 233277 - RNA, 32 nt, Human
ucccagaacugacuccuaaggucuccagccag

SEQ ID NO: 233278 - RNA, 19 nt, Human
ucccagaagaagccagagg

SEQ ID NO: 233279 - RNA, 22 nt, Human
ucccagaagagaaccuaugagg

SEQ ID NO: 233280 - RNA, 32 nt, Human
ucccagaagagagaaauaaaaguccuaaauaa

SEQ ID NO: 233281 - RNA, 32 nt, Human
ucccagaagauaaccucuccuccugggccacc

SEQ ID NO: 233282 - RNA, 32 nt, Human
ucccagaagauggaaugggggugugggggucc

SEQ ID NO: 233283 - RNA, 32 nt, Human
ucccagaagcagcucuggugcugaagagagca

SEQ ID NO: 233284 - RNA, 32 nt, Human
ucccagaagcuccgugagccucagccaccccu

SEQ ID NO: 233285 - RNA, 32 nt, Human
ucccagaagcuccugccccucugacagcuguc

SEQ ID NO: 233286 - RNA, 21 nt, Human
ucccagaagcuguaucaugag

SEQ ID NO: 233287 - RNA, 32 nt, Human
ucccagaagguaacguuaauguuuucagucau

SEQ ID NO: 233288 - RNA, 21 nt, Human
ucccagaagguaccccugagg

SEQ ID NO: 233289 - RNA, 18 nt, Human
ucccagaagucucccgag

SEQ ID NO: 233290 - RNA, 32 nt, Human
ucccagaagugcuaggauuacaaacgugagcc

SEQ ID NO: 233291 - RNA, 32 nt, Human
ucccagaaugguagaaaccaggcugugcauaa

SEQ ID NO: 233292 - RNA, 32 nt, Human
ucccagaaugguuugggguaucacacaaaaca

SEQ ID NO: 233293 - RNA, 32 nt, Human
ucccagacaaaaacaaaagcugagggauuuca

SEQ ID NO: 233294 - RNA, 32 nt, Human
ucccagacagccaggcccaucugcugcccagg

SEQ ID NO: 233295 - RNA, 32 nt, Human
ucccagacaggucccugaguacugacggucac

SEQ ID NO: 233296 - RNA, 32 nt, Human
ucccagacccaagugauccucccaccucagcc

SEQ ID NO: 233297 - RNA, 32 nt, Human
ucccagaccugggcaggagcugugcugggaga

SEQ ID NO: 233298 - RNA, 19 nt, Human
ucccagaccugucaugagg

SEQ ID NO: 233299 - RNA, 32 nt, Human
ucccagacgggccuggugaauuggcuggccag

SEQ ID NO: 233300 - RNA, 32 nt, Human
ucccagacuacuuauggagaauugcaguuuaa

SEQ ID NO: 233301 - RNA, 32 nt, Human
ucccagacuagaccaaauagccagaaaaauga

SEQ ID NO: 233302 - RNA, 32 nt, Human
ucccagacucaagugauccucuugccucagcc

SEQ ID NO: 233303 - RNA, 32 nt, Human
ucccagacucaagugauccuuccaccucagcc

SEQ ID NO: 233304 - RNA, 32 nt, Human
ucccagacuccaaagcccugguccuuuccuga

SEQ ID NO: 233305 - RNA, 32 nt, Human
ucccagacucucuguccccaccccagaccagg

SEQ ID NO: 233306 - RNA, 32 nt, Human
ucccagacugaguccucuccccaaaucagggc

SEQ ID NO: 233307 - RNA, 32 nt, Human
ucccagacugccuccuugcccaugccucucuc

SEQ ID NO: 233308 - RNA, 19 nt, Human
ucccagagaaaaugaugaa

SEQ ID NO: 233309 - RNA, 19 nt, Human
ucccagagaaccuuaugga

SEQ ID NO: 233310 - RNA, 20 nt, Human
ucccagagaagccaggugaa

SEQ ID NO: 233311 - RNA, 32 nt, Human
ucccagagacaagaagcccaaccuucuggccu

SEQ ID NO: 233312 - RNA, 19 nt, Human
ucccagagacggccaccca

SEQ ID NO: 233313 - RNA, 32 nt, Human
ucccagagagacauagcuggaaaauuccuauu

SEQ ID NO: 233314 - RNA, 32 nt, Human
ucccagagagccccagagcucucaagcuccuu

SEQ ID NO: 233315 - RNA, 32 nt, Human
ucccagagagugaagaacaggagcaugaagag

SEQ ID NO: 233316 - RNA, 32 nt, Human
ucccagagagugcucuuucuucauacuuccuu

SEQ ID NO: 233317 - RNA, 32 nt, Human
ucccagagaugccaccacuugugucuccacaa

SEQ ID NO: 233318 - RNA, 32 nt, Human
ucccagagcagcuucagggagaguguggggcc

SEQ ID NO: 233319 - RNA, 32 nt, Human
ucccagagcaucucacccccacccucauguuc

SEQ ID NO: 233320 - RNA, 32 nt, Human
ucccagagcgcccagcccugggaaccugcuga

SEQ ID NO: 233321 - RNA, 32 nt, Human
ucccagagcuaaauaguuuagcugcuucaacu

SEQ ID NO: 233322 - RNA, 32 nt, Human
ucccagagcucccuccuuauggcagcagcuuc

SEQ ID NO: 233323 - RNA, 32 nt, Human
ucccagagcugagcuccuccagcgggaugacg

SEQ ID NO: 233324 - RNA, 19 nt, Human
ucccagagcugggcagugu

SEQ ID NO: 233325 - RNA, 31 nt, Human
ucccagagcugucagcaccggccucagccca

SEQ ID NO: 233326 - RNA, 19 nt, Human
ucccagaggcacccagagg

SEQ ID NO: 233327 - RNA, 32 nt, Human
ucccagaggccaccccucccaccccagacauc

SEQ ID NO: 233328 - RNA, 32 nt, Human
ucccagaggcccguggaggagcccaccagccc

SEQ ID NO: 233329 - RNA, 17 nt, Human
ucccagaggcucugagc

SEQ ID NO: 233330 - RNA, 32 nt, Human
ucccagaggcuuccaggagcacgagggccuug

SEQ ID NO: 233331 - RNA, 25 nt, Human
ucccagagggagaagauccaugagg

SEQ ID NO: 233332 - RNA, 32 nt, Human
ucccagagggccuggaguggcugaucuacacu

SEQ ID NO: 233333 - RNA, 17 nt, Human
ucccagaggggccucau

SEQ ID NO: 233334 - RNA, 21 nt, Human
ucccagaggguuuccaugggg

SEQ ID NO: 233335 - RNA, 32 nt, Human
ucccagaggucgaggcugcagugagcugugau

SEQ ID NO: 233336 - RNA, 32 nt, Human
ucccagaggugaggcaggaggcggcaguuucu

SEQ ID NO: 233337 - RNA, 32 nt, Human
ucccagagugagcuuggcagggccaggcgggg

SEQ ID NO: 233338 - RNA, 32 nt, Human
ucccagagugcuaggauuacaggccuuuugac

SEQ ID NO: 233339 - RNA, 32 nt, Human
ucccagagugcugagauuuacaggcgugagcc

SEQ ID NO: 233340 - RNA, 32 nt, Human
ucccagagugcugggauuuacaggcaugagcc

SEQ ID NO: 233341 - RNA, 21 nt, Human
ucccagaguggcccagugagg

SEQ ID NO: 233342 - RNA, 22 nt, Human
ucccagauaaggcaaugugcug

SEQ ID NO: 233343 - RNA, 32 nt, Human
ucccagauagcaccuacccaacccaggaugaa

SEQ ID NO: 233344 - RNA, 32 nt, Human
ucccagaucugagcauucuaggccuguuucac

SEQ ID NO: 233345 - RNA, 32 nt, Human
ucccagaucuuucuaacccaggaccuacuugg

SEQ ID NO: 233346 - RNA, 32 nt, Human
ucccagaugaagccuaugggagucaggacccu

SEQ ID NO: 233347 - RNA, 32 nt, Human
ucccagaugcuggggagaaugaagagcuaaaa

SEQ ID NO: 233348 - RNA, 32 nt, Human
ucccagaugggccuuggucacacuccuuggcu

SEQ ID NO: 233349 - RNA, 32 nt, Human
ucccagauguggggaagaggccagcagccuag

SEQ ID NO: 233350 - RNA, 32 nt, Human
ucccagauucaagcaacucucugccucagccu

SEQ ID NO: 233351 - RNA, 32 nt, Human
ucccagauucacgccauucuccugccucagcc

SEQ ID NO: 233352 - RNA, 32 nt, Human
ucccagauucgcugcuggagugcuggauggag

SEQ ID NO: 233353 - RNA, 32 nt, Human
ucccagcaaagaaaaagaaaaagauacgcuug

SEQ ID NO: 233354 - RNA, 21 nt, Human
ucccagcaaaucaucgggcca

SEQ ID NO: 233355 - RNA, 32 nt, Human
ucccagcaaaugccaagugcucugccugccuu

SEQ ID NO: 233356 - RNA, 32 nt, Human
ucccagcaacgcacccucagcagacccacggg

SEQ ID NO: 233357 - RNA, 32 nt, Human
ucccagcaaggccgugccaucuucccaccucc

SEQ ID NO: 233358 - RNA, 21 nt, Human
ucccagcaagguagggugcug

SEQ ID NO: 233359 - RNA, 32 nt, Human
ucccagcacaccuggaaaguucugcaaggccu

SEQ ID NO: 233360 - RNA, 32 nt, Human
ucccagcacacgugugcacgcaaggcagccuu

SEQ ID NO: 233361 - RNA, 32 nt, Human
ucccagcacagcccuuguuggagggcgcaccc

SEQ ID NO: 233362 - RNA, 32 nt, Human
ucccagcacaucucucucaaucuuugauuaag

SEQ ID NO: 233363 - RNA, 32 nt, Human
ucccagcacccacucuuggagcagcucuccag

SEQ ID NO: 233364 - RNA, 32 nt, Human
ucccagcacccgccccuuccucaccucuuccu

SEQ ID NO: 233365 - RNA, 32 nt, Human
ucccagcaccuugcagacuugggcccaucaag

SEQ ID NO: 233366 - RNA, 32 nt, Human
ucccagcacugagaggaggguagugacggauu

SEQ ID NO: 233367 - RNA, 32 nt, Human
ucccagcacugaguucugcccgggagaagccg

SEQ ID NO: 233368 - RNA, 32 nt, Human
ucccagcacugcaccccaggcagccacuccua

SEQ ID NO: 233369 - RNA, 32 nt, Human
ucccagcacugucuccuuccucccacuggcau

SEQ ID NO: 233370 - RNA, 32 nt, Human
ucccagcacuguggaaggccuaggcaggagga

SEQ ID NO: 233371 - RNA, 32 nt, Human
ucccagcacuguuucaggcaagaacuuucccu

SEQ ID NO: 233372 - RNA, 18 nt, Human
ucccagcacuuaugggag

SEQ ID NO: 233373 - RNA, 32 nt, Human
ucccagcacuuugggagccccaggugggcaga

SEQ ID NO: 233374 - RNA, 32 nt, Human
ucccagcacuuugggagcccgaggugggcaga

SEQ ID NO: 233375 - RNA, 32 nt, Human
ucccagcagacacccuguguccuccuucagcu

SEQ ID NO: 233376 - RNA, 32 nt, Human
ucccagcagaucuccaggguucuaggaaaggg

SEQ ID NO: 233377 - RNA, 32 nt, Human
ucccagcagcaggaguuaggggccugcgcuug

SEQ ID NO: 233378 - RNA, 32 nt, Human
ucccagcagccccaggcauagcaucccuucuc

SEQ ID NO: 233379 - RNA, 32 nt, Human
ucccagcagccggaacacagacaggagagagu

SEQ ID NO: 233380 - RNA, 24 nt, Human
ucccagcagccggagcccugcagg

SEQ ID NO: 233381 - RNA, 32 nt, Human
ucccagcagcuguaauguacaguuccuucuga

SEQ ID NO: 233382 - RNA, 32 nt, Human
ucccagcaguuuuccauuucuccacaguaucc

SEQ ID NO: 233383 - RNA, 32 nt, Human
ucccagcauacuuugugaaccuggcuccuucu

SEQ ID NO: 233384 - RNA, 32 nt, Human
ucccagccaaaugucugugcucucugugucac

SEQ ID NO: 233385 - RNA, 21 nt, Human
ucccagccaagaucugucuuc

SEQ ID NO: 233386 - RNA, 31 nt, Human
ucccagccacagccaggcaggagggagaagc

SEQ ID NO: 233387 - RNA, 32 nt, Human
ucccagccacugcccuugcuggaggaccgcug

SEQ ID NO: 233388 - RNA, 18 nt, Human
ucccagccagacugagaa

SEQ ID NO: 233389 - RNA, 32 nt, Human
ucccagccagcgagucaggagcaggggagaca

SEQ ID NO: 233390 - RNA, 19 nt, Human
ucccagccagcugguucua

SEQ ID NO: 233391 - RNA, 20 nt, Human
ucccagccaggcuggcuggg

SEQ ID NO: 233392 - RNA, 21 nt, Human
ucccagccauuuaucuucuuu

SEQ ID NO: 233393 - RNA, 32 nt, Human
ucccagcccaggagaacuaagagcuuccuaaa

SEQ ID NO: 233394 - RNA, 28 nt, Human
ucccagcccccugcugccuucucuaugc

SEQ ID NO: 233395 - RNA, 21 nt, Human
ucccagccccggagccucaua

SEQ ID NO: 233396 - RNA, 32 nt, Human
ucccagccccuggaaaggggcaggaacgacaa

SEQ ID NO: 233397 - RNA, 32 nt, Human
ucccagccccuggguccguggagggguugggu

SEQ ID NO: 233398 - RNA, 32 nt, Human
ucccagcccugaggcccaccccagaggcugga

SEQ ID NO: 233399 - RNA, 32 nt, Human
ucccagcccugagggguggacuaggcccuaca

SEQ ID NO: 233400 - RNA, 20 nt, Human
ucccagcccugcccagagua

SEQ ID NO: 233401 - RNA, 32 nt, Human
ucccagcccugcccggcugcucugcuuccggu

SEQ ID NO: 233402 - RNA, 32 nt, Human
ucccagcccuggagccuggagggagaccaccc

SEQ ID NO: 233403 - RNA, 21 nt, Human
ucccagcccuggccucaucac

SEQ ID NO: 233404 - RNA, 32 nt, Human
ucccagcccuggggccugcugacugcccaguc

SEQ ID NO: 233405 - RNA, 32 nt, Human
ucccagcccuggggcuaccugaucugacaaag

SEQ ID NO: 233406 - RNA, 32 nt, Human
ucccagcccugggucugcuccccacaucucuc

SEQ ID NO: 233407 - RNA, 32 nt, Human
ucccagcccuugcaguccgcuaggugagagga

SEQ ID NO: 233408 - RNA, 32 nt, Human
ucccagcccuugcccagccugggggagugggg

SEQ ID NO: 233409 - RNA, 32 nt, Human
ucccagcccuuugaccuggaaguaaguuagcg

SEQ ID NO: 233410 - RNA, 32 nt, Human
ucccagccgccaggcaguuuuacagggcucug

SEQ ID NO: 233411 - RNA, 32 nt, Human
ucccagccuagacugcuuaccccauagccaca

SEQ ID NO: 233412 - RNA, 32 nt, Human
ucccagccucacaauacuucugacccuucccc

SEQ ID NO: 233413 - RNA, 32 nt, Human
ucccagccuccagaacugagaaaugauuucug

SEQ ID NO: 233414 - RNA, 21 nt, Human
ucccagccuggaaugcagugg

SEQ ID NO: 233415 - RNA, 25 nt, Human
ucccagccugggagacagagugaga

SEQ ID NO: 233416 - RNA, 32 nt, Human
ucccagccuggggcucccucucugguuuccua

SEQ ID NO: 233417 - RNA, 32 nt, Human
ucccagccuuucuucucucuuugugugcuccc

SEQ ID NO: 233418 - RNA, 32 nt, Human
ucccagccuuucuuucuucagggagccauucu

SEQ ID NO: 233419 - RNA, 32 nt, Human
ucccagccuuugaggccgggugcaguggcuca

SEQ ID NO: 233420 - RNA, 32 nt, Human
ucccagcgauuugggagguugagcugguagga

SEQ ID NO: 233421 - RNA, 32 nt, Human
ucccagcgugaggaaaaugaagaaaggguguc

SEQ ID NO: 233422 - RNA, 32 nt, Human
ucccagcuacucaagagguugcagugagcuga

SEQ ID NO: 233423 - RNA, 31 nt, Human
ucccagcuacucaaggcugaggcaggagaau

SEQ ID NO: 233424 - RNA, 32 nt, Human
ucccagcuacucaggagguugaggugggaaga

SEQ ID NO: 233425 - RNA, 32 nt, Human
ucccagcuacucaggagguugaggugggagga

SEQ ID NO: 233426 - RNA, 32 nt, Human
ucccagcuacucgggagguugaggcaggagaa

SEQ ID NO: 233427 - RNA, 32 nt, Human
ucccagcuacucgggagguugagggaggagaa

SEQ ID NO: 233428 - RNA, 32 nt, Human
ucccagcuauauuucuccagacuugcauuuuu

SEQ ID NO: 233429 - RNA, 32 nt, Human
ucccagcuaugcagcacuagcagguguuuugu

SEQ ID NO: 233430 - RNA, 32 nt, Human
ucccagcucacccucaccccagccucuucccc

SEQ ID NO: 233431 - RNA, 32 nt, Human
ucccagcucacugcaaccuccgccuccugggu

SEQ ID NO: 233432 - RNA, 32 nt, Human
ucccagcucacugcaacuuccgccccgccagg

SEQ ID NO: 233433 - RNA, 32 nt, Human
ucccagcucacugcagccucgaccucccuggc

SEQ ID NO: 233434 - RNA, 32 nt, Human
ucccagcucaggcucucugccuuccagaggcc

SEQ ID NO: 233435 - RNA, 32 nt, Human
ucccagcucauuacagccuccaccucccaguu

SEQ ID NO: 233436 - RNA, 32 nt, Human
ucccagcuccacagggaguaagaaggagcugc

SEQ ID NO: 233437 - RNA, 20 nt, Human
ucccagcuccacccccucca

SEQ ID NO: 233438 - RNA, 32 nt, Human
ucccagcuccacccccuccacagugaugcaga

SEQ ID NO: 233439 - RNA, 32 nt, Human
ucccagcuccagagccccuuguggggucagug

SEQ ID NO: 233440 - RNA, 32 nt, Human
ucccagcucccaauccugucucaggucaaugc

SEQ ID NO: 233441 - RNA, 32 nt, Human
ucccagcucccaggacccccaggccggcagcg

SEQ ID NO: 233442 - RNA, 32 nt, Human
ucccagcucccaggcacucguggggccaccgc

SEQ ID NO: 233443 - RNA, 32 nt, Human
ucccagcuccccaaccugggagaugguucuua

SEQ ID NO: 233444 - RNA, 32 nt, Human
ucccagcucgcugcagccuccaccucccggac

SEQ ID NO: 233445 - RNA, 32 nt, Human
ucccagcucuauucuaccgucuuauggccucu

SEQ ID NO: 233446 - RNA, 32 nt, Human
ucccagcucuccuguuggcuucgugcuugggg

SEQ ID NO: 233447 - RNA, 32 nt, Human
ucccagcucugccuccugcccgccugcucucu

SEQ ID NO: 233448 - RNA, 32 nt, Human
ucccagcucugccucugacucgcuguguaccc

SEQ ID NO: 233449 - RNA, 32 nt, Human
ucccagcucugccuuugaagcacuuguggcca

SEQ ID NO: 233450 - RNA, 32 nt, Human
ucccagcucuguccugagagggcccacagccc

SEQ ID NO: 233451 - RNA, 32 nt, Human
ucccagcucuuuaggggagguggauuugaggc

SEQ ID NO: 233452 - RNA, 32 nt, Human
ucccagcugaaacucagcgggcuggucaggcc

SEQ ID NO: 233453 - RNA, 32 nt, Human
ucccagcugaaacucggaaggcuggucaggcc

SEQ ID NO: 233454 - RNA, 32 nt, Human
ucccagcugacggcaguaaauccacagugagu

SEQ ID NO: 233455 - RNA, 32 nt, Human
ucccagcugacucgcucacugccuucgaaguc

SEQ ID NO: 233456 - RNA, 32 nt, Human
ucccagcugauucuuuuucccuccagcauccu

SEQ ID NO: 233457 - RNA, 19 nt, Human
ucccagcugcagccuaggc

SEQ ID NO: 233458 - RNA, 32 nt, Human
ucccagcugccucuugccuugauaguggugcu

SEQ ID NO: 233459 - RNA, 32 nt, Human
ucccagcugccuggccagcccacccuccugca

SEQ ID NO: 233460 - RNA, 32 nt, Human
ucccagcuggagucauggagccucccaaacau

SEQ ID NO: 233461 - RNA, 32 nt, Human
ucccagcugggcuggacuguugccaacaucac

SEQ ID NO: 233462 - RNA, 32 nt, Human
ucccagcuggggaaggugcagggggccuggga

SEQ ID NO: 233463 - RNA, 32 nt, Human
ucccagcugugaggcugccaucaacacccaca

SEQ ID NO: 233464 - RNA, 32 nt, Human
ucccagcuuucccagccccagcguuuuggguc

SEQ ID NO: 233465 - RNA, 32 nt, Human
ucccagcuuuggugagaaaacuaaucuugaac

SEQ ID NO: 233466 - RNA, 32 nt, Human
ucccaggaaacacacuuggaaauaagucagcu

SEQ ID NO: 233467 - RNA, 32 nt, Human
ucccaggaaauccuacaacuucuccuuuccuu

SEQ ID NO: 233468 - RNA, 32 nt, Human
ucccaggaagcagaacucuccagaagaagggu

SEQ ID NO: 233469 - RNA, 32 nt, Human
ucccaggaagcagacaacacaggccugcgugc

SEQ ID NO: 233470 - RNA, 32 nt, Human
ucccaggaagcggacaacacagcccugcgugc

SEQ ID NO: 233471 - RNA, 32 nt, Human
ucccaggaagcggacaacacaggccugcgugc

SEQ ID NO: 233472 - RNA, 32 nt, Human
ucccaggaagcggacaacacaggccugcgugu

SEQ ID NO: 233473 - RNA, 32 nt, Human
ucccaggaagcggacaacacaggccugugugc

SEQ ID NO: 233474 - RNA, 32 nt, Human
ucccaggaauuggaauucagcaccuguuccgc

SEQ ID NO: 233475 - RNA, 32 nt, Human
ucccaggaauuugagguugcaguaagcuauga

SEQ ID NO: 233476 - RNA, 20 nt, Human
ucccaggacacccucccaca

SEQ ID NO: 233477 - RNA, 32 nt, Human
ucccaggacacugccucuucugggcagaaggc

SEQ ID NO: 233478 - RNA, 32 nt, Human
ucccaggaccugagccuggccauguccucaac

SEQ ID NO: 233479 - RNA, 32 nt, Human
ucccaggaccugcagcacagugguguacaccu

SEQ ID NO: 233480 - RNA, 32 nt, Human
ucccaggacuccaaacagggaucugucucuuu

SEQ ID NO: 233481 - RNA, 32 nt, Human
ucccaggagacagagguugcagugagccgaga

SEQ ID NO: 233482 - RNA, 32 nt, Human
ucccaggagagggaagaugggagccagggcaa

SEQ ID NO: 233483 - RNA, 32 nt, Human
ucccaggagaggggcauuucuagagcagugac

SEQ ID NO: 233484 - RNA, 32 nt, Human
ucccaggagccuccagaaggaaccuugguguu

SEQ ID NO: 233485 - RNA, 32 nt, Human
ucccaggagccugcccagcccccuggucuuug

SEQ ID NO: 233486 - RNA, 32 nt, Human
ucccaggagcuuccacucucagaccuugccuc

SEQ ID NO: 233487 - RNA, 23 nt, Human
ucccaggaggacaggaugagcca

SEQ ID NO: 233488 - RNA, 20 nt, Human
ucccaggaggcagaagcucc

SEQ ID NO: 233489 - RNA, 32 nt, Human
ucccaggaggccugugcacacaucccaggcau

SEQ ID NO: 233490 - RNA, 32 nt, Human
ucccaggaggcggagguugcagugaguugcag

SEQ ID NO: 233491 - RNA, 32 nt, Human
ucccaggaggcugaggcugcuguaucacucac

SEQ ID NO: 233492 - RNA, 32 nt, Human
ucccaggaggugcaguggagggggcaagcuuu

SEQ ID NO: 233493 - RNA, 32 nt, Human
ucccaggagucagaucauaaggcuccaugcac

SEQ ID NO: 233494 - RNA, 32 nt, Human
ucccaggauacuguuuguaaauaaucugcugu

SEQ ID NO: 233495 - RNA, 32 nt, Human
ucccaggaucaagugauucuccugccucagcc

SEQ ID NO: 233496 - RNA, 32 nt, Human
ucccaggaucugccaagaguccagguuuuuag

SEQ ID NO: 233497 - RNA, 16 nt, Human
ucccaggauggcuguu

SEQ ID NO: 233498 - RNA, 16 nt, Human
ucccaggauggguguc

SEQ ID NO: 233499 - RNA, 24 nt, Human
ucccaggauuacaggcaugagcca

SEQ ID NO: 233500 - RNA, 32 nt, Human
ucccaggcaagccuggcuguaguagcgaguga

SEQ ID NO: 233501 - RNA, 32 nt, Human
ucccaggcacacacaggugggacacaaauaag

SEQ ID NO: 233502 - RNA, 32 nt, Human
ucccaggcaccaacagcacagagcaggccagu

SEQ ID NO: 233503 - RNA, 20 nt, Human
ucccaggcagaaaaacggga

SEQ ID NO: 233504 - RNA, 32 nt, Human
ucccaggcauacacuuccacugccuucagcug

SEQ ID NO: 233505 - RNA, 32 nt, Human
ucccaggcaugcuggagggacuuggggacauu

SEQ ID NO: 233506 - RNA, 32 nt, Human
ucccaggccacaggagcuuauuggccaggagg

SEQ ID NO: 233507 - RNA, 32 nt, Human
ucccaggccacugggugcucucugcagugugc

SEQ ID NO: 233508 - RNA, 32 nt, Human
ucccaggccccgcuuuugacuuuuggcagccu

SEQ ID NO: 233509 - RNA, 32 nt, Human
ucccaggccccgcuuuugacuuuuggcggccu

SEQ ID NO: 233510 - RNA, 32 nt, Human
ucccaggcccgagaggaugaaggcgggauuac

SEQ ID NO: 233511 - RNA, 32 nt, Human
ucccaggcccuaggggucacauuugcucagga

SEQ ID NO: 233512 - RNA, 32 nt, Human
ucccaggcccucucaggauugcagaacaacac

SEQ ID NO: 233513 - RNA, 32 nt, Human
ucccaggcccugggggugagggggaggggacu

SEQ ID NO: 233514 - RNA, 22 nt, Human
ucccaggccgacuggccuuggg

SEQ ID NO: 233515 - RNA, 32 nt, Human
ucccaggccgcauggccccuccaggaacauuc

SEQ ID NO: 233516 - RNA, 21 nt, Human
ucccaggccggagugcagugg

SEQ ID NO: 233517 - RNA, 32 nt, Human
ucccaggccugggcgugguggaggaaggggug

SEQ ID NO: 233518 - RNA, 32 nt, Human
ucccaggccuguguagugucucuccccugcug

SEQ ID NO: 233519 - RNA, 32 nt, Human
ucccaggccuuggucuugguccugggccugga

SEQ ID NO: 233520 - RNA, 32 nt, Human
ucccaggcgaugacaagucugaacccacgaaa

SEQ ID NO: 233521 - RNA, 22 nt, Human
ucccaggcuacacccgcccaca

SEQ ID NO: 233522 - RNA, 21 nt, Human
ucccaggcuagagugcaaugg

SEQ ID NO: 233523 - RNA, 21 nt, Human
ucccaggcuagagugcagugg

SEQ ID NO: 233524 - RNA, 21 nt, Human
ucccaggcuaggaggaagcug

SEQ ID NO: 233525 - RNA, 32 nt, Human
ucccaggcucaagaaauccucccaccucagcc

SEQ ID NO: 233526 - RNA, 32 nt, Human
ucccaggcucaagcaauccuugugccucagcc

SEQ ID NO: 233527 - RNA, 32 nt, Human
ucccaggcucaagcaauucuccuaccucagcc

SEQ ID NO: 233528 - RNA, 32 nt, Human
ucccaggcucaagcaauucuccugccucaacc

SEQ ID NO: 233529 - RNA, 32 nt, Human
ucccaggcucaagcaauucuccugccucagcc

SEQ ID NO: 233530 - RNA, 32 nt, Human
ucccaggcucaagcaauucuuacgccucagcc

SEQ ID NO: 233531 - RNA, 32 nt, Human
ucccaggcucaagcacuuuuccugucucagcc

SEQ ID NO: 233532 - RNA, 32 nt, Human
ucccaggcucaagccaucuuuccaccucagcc

SEQ ID NO: 233533 - RNA, 32 nt, Human
ucccaggcucaagcgauccucccaccucagcu

SEQ ID NO: 233534 - RNA, 32 nt, Human
ucccaggcucaagcgauccucccagcucagcc

SEQ ID NO: 233535 - RNA, 32 nt, Human
ucccaggcucaagcgauccucccgccuuaacu

SEQ ID NO: 233536 - RNA, 32 nt, Human
ucccaggcucaagcgauccuccugccucagac

SEQ ID NO: 233537 - RNA, 32 nt, Human
ucccaggcucaagcgauccuccugccucagcc

SEQ ID NO: 233538 - RNA, 32 nt, Human
ucccaggcucaagcgauccuucugccucagcc

SEQ ID NO: 233539 - RNA, 32 nt, Human
ucccaggcucaagcgauucucucacuucagcu

SEQ ID NO: 233540 - RNA, 32 nt, Human
ucccaggcucaagcuauccuugcaccucagcc

SEQ ID NO: 233541 - RNA, 32 nt, Human
ucccaggcucaagcuguccucccaccucagcc

SEQ ID NO: 233542 - RNA, 32 nt, Human
ucccaggcucaagggauccuccugcaucagcc

SEQ ID NO: 233543 - RNA, 32 nt, Human
ucccaggcucaagggauccuccugccucggcc

SEQ ID NO: 233544 - RNA, 32 nt, Human
ucccaggcucaagggauccucucaccucagcu

SEQ ID NO: 233545 - RNA, 32 nt, Human
ucccaggcucaagugauccucccaccccagcc

SEQ ID NO: 233546 - RNA, 32 nt, Human
ucccaggcucaagugauccucccaccucagcc

SEQ ID NO: 233547 - RNA, 32 nt, Human
ucccaggcucaagugauccucccaccucaguc

SEQ ID NO: 233548 - RNA, 32 nt, Human
ucccaggcucaagugauccucccacuucagcu

SEQ ID NO: 233549 - RNA, 32 nt, Human
ucccaggcucaagugauccucccagcucucag

SEQ ID NO: 233550 - RNA, 32 nt, Human
ucccaggcucaagugauccuuccaccucagcc

SEQ ID NO: 233551 - RNA, 32 nt, Human
ucccaggcucaagugaucugcccuccucagcc

SEQ ID NO: 233552 - RNA, 32 nt, Human
ucccaggcucaagugauucuccugcuucagcc

SEQ ID NO: 233553 - RNA, 32 nt, Human
ucccaggcucaaucaagguguggcuuccauug

SEQ ID NO: 233554 - RNA, 32 nt, Human
ucccaggcucacccaggcucugcucaggcugg

SEQ ID NO: 233555 - RNA, 32 nt, Human
ucccaggcucaugugauccucccaccucagcc

SEQ ID NO: 233556 - RNA, 19 nt, Human
ucccaggcuccucuucugc

SEQ ID NO: 233557 - RNA, 21 nt, Human
ucccaggcugaagugcaguga

SEQ ID NO: 233558 - RNA, 21 nt, Human
ucccaggcugaagugcagugg

SEQ ID NO: 233559 - RNA, 19 nt, Human
ucccaggcugacccaccca

SEQ ID NO: 233560 - RNA, 32 nt, Human
ucccaggcugcaacauccaccucccagguuca

SEQ ID NO: 233561 - RNA, 32 nt, Human
ucccaggcugcccccaacaacuccaggcccug

SEQ ID NO: 233562 - RNA, 21 nt, Human
ucccaggcuggaaugcagugg

SEQ ID NO: 233563 - RNA, 21 nt, Human
ucccaggcuggaguacagugg

SEQ ID NO: 233564 - RNA, 20 nt, Human
ucccaggcuggagugcaaug

SEQ ID NO: 233565 - RNA, 21 nt, Human
ucccaggcuggagugcaaugg

SEQ ID NO: 233566 - RNA, 21 nt, Human
ucccaggcuggagugcaguga

SEQ ID NO: 233567 - RNA, 21 nt, Human
ucccaggcuggagugcagugg

SEQ ID NO: 233568 - RNA, 32 nt, Human
ucccaggcuggcgcugagaugggcaggugcug

SEQ ID NO: 233569 - RNA, 32 nt, Human
ucccaggcuggggauggaugcucugaccacag

SEQ ID NO: 233570 - RNA, 32 nt, Human
ucccaggcuggucucaaacuccugggcucaag

SEQ ID NO: 233571 - RNA, 32 nt, Human
ucccaggcuggucucgaacuccugggcucggg

SEQ ID NO: 233572 - RNA, 32 nt, Human
ucccaggcugugguggcuccugugggaacuac

SEQ ID NO: 233573 - RNA, 32 nt, Human
ucccaggcuuaggugauccuucugucucagcc

SEQ ID NO: 233574 - RNA, 32 nt, Human
ucccaggcuuccuggugggugcagcccaaucc

SEQ ID NO: 233575 - RNA, 32 nt, Human
ucccaggcuucuguguucccagucuccuguaa

SEQ ID NO: 233576 - RNA, 32 nt, Human
ucccaggcuugccccuggucagccugcgggcc

SEQ ID NO: 233577 - RNA, 32 nt, Human
ucccagggacaguggguuuggaucugucuaga

SEQ ID NO: 233578 - RNA, 32 nt, Human
ucccagggacucaggucacuaauggagguggc

SEQ ID NO: 233579 - RNA, 32 nt, Human
ucccagggagaacgggaaguggaccccagccc

SEQ ID NO: 233580 - RNA, 32 nt, Human
ucccagggagugagauggguaagggaagaugg

SEQ ID NO: 233581 - RNA, 32 nt, Human
ucccagggcaagaggaagacccugccauucca

SEQ ID NO: 233582 - RNA, 32 nt, Human
ucccagggcauuccagcucaagcugcuggcag

SEQ ID NO: 233583 - RNA, 32 nt, Human
ucccagggccaccaagcaaaccaccgugggcc

SEQ ID NO: 233584 - RNA, 32 nt, Human
ucccagggcccaaggaggagaaugcugccucc

SEQ ID NO: 233585 - RNA, 31 nt, Human
ucccagggccucucugucgcugucgccgucg

SEQ ID NO: 233586 - RNA, 32 nt, Human
ucccagggccuugaaaguccaucucugaccca

SEQ ID NO: 233587 - RNA, 32 nt, Human
ucccagggcucugccagggccuugcucagucc

SEQ ID NO: 233588 - RNA, 32 nt, Human
ucccagggcugaugcuguacagguacaggcug

SEQ ID NO: 233589 - RNA, 32 nt, Human
ucccagggcugcagaucgaaaucccuaaggau

SEQ ID NO: 233590 - RNA, 32 nt, Human
ucccagggcugcaggcgggcggagguuccagg

SEQ ID NO: 233591 - RNA, 32 nt, Human
ucccagggcuggccaagagagaagacuggacg

SEQ ID NO: 233592 - RNA, 32 nt, Human
ucccagggcuuacggcccugccuugggcccuc

SEQ ID NO: 233593 - RNA, 32 nt, Human
ucccagggcuuggaacagagccugacauauac

SEQ ID NO: 233594 - RNA, 32 nt, Human
ucccaggggaaugugucuacugccuggugguu

SEQ ID NO: 233595 - RNA, 22 nt, Human
ucccaggggagcaggucuuguc

SEQ ID NO: 233596 - RNA, 32 nt, Human
ucccaggggccugcacacauggagaggccucc

SEQ ID NO: 233597 - RNA, 23 nt, Human
ucccaggggcuccaggcaugcac

SEQ ID NO: 233598 - RNA, 32 nt, Human
ucccagggggauguccugcgccucaggguccg

SEQ ID NO: 233599 - RNA, 32 nt, Human
ucccagggggcagaggcaggggcgggaggggg

SEQ ID NO: 233600 - RNA, 26 nt, Human
ucccagggggccugauuucucucuca

SEQ ID NO: 233601 - RNA, 32 nt, Human
ucccagggguccacacuuuaccuccuguaucu

SEQ ID NO: 233602 - RNA, 32 nt, Human
ucccagggugcugagauuacaggugugagcca

SEQ ID NO: 233603 - RNA, 32 nt, Human
ucccagggugcugggauuacaggugugagcca

SEQ ID NO: 233604 - RNA, 32 nt, Human
ucccagggugggcucaggguuggggaaguccu

SEQ ID NO: 233605 - RNA, 32 nt, Human
ucccagguaaggcggaggcugcuggugugagg

SEQ ID NO: 233606 - RNA, 32 nt, Human
ucccagguacuugguaggcuguggcaggagaa

SEQ ID NO: 233607 - RNA, 32 nt, Human
ucccaggucaucucuuggaccagcgggcauca

SEQ ID NO: 233608 - RNA, 32 nt, Human
ucccaggucaucugccugcccacacgcuccug

SEQ ID NO: 233609 - RNA, 32 nt, Human
ucccaggucauugugucuguuuccgaggggcc

SEQ ID NO: 233610 - RNA, 18 nt, Human
ucccagguccugcagcuu

SEQ ID NO: 233611 - RNA, 32 nt, Human
ucccagguccugggccugguuuucuaaugcug

SEQ ID NO: 233612 - RNA, 32 nt, Human
ucccaggucucaguggaacuugcucagucuua

SEQ ID NO: 233613 - RNA, 32 nt, Human
ucccaggucugugucugauagcauacacacac

SEQ ID NO: 233614 - RNA, 32 nt, Human
ucccaggucuucccucuccucagcgccuaaga

SEQ ID NO: 233615 - RNA, 32 nt, Human
ucccaggucuuuccucacucuccuucgucuuu

SEQ ID NO: 233616 - RNA, 32 nt, Human
ucccaggugaucugguuacagugcagugcuga

SEQ ID NO: 233617 - RNA, 32 nt, Human
ucccaggugauuccggagugaguuggagcugc

SEQ ID NO: 233618 - RNA, 32 nt, Human
ucccaggugcaagugaugccccugccucagcc

SEQ ID NO: 233619 - RNA, 22 nt, Human
ucccaggugcaggcaugagcca

SEQ ID NO: 233620 - RNA, 32 nt, Human
ucccagguggcguuccagcccagauccggcca

SEQ ID NO: 233621 - RNA, 32 nt, Human
ucccagguuaucugggcauagaugcaggugag

SEQ ID NO: 233622 - RNA, 32 nt, Human
ucccagguucaaaccauucucuugccucagcc

SEQ ID NO: 233623 - RNA, 32 nt, Human
ucccagguucaaacgauucuccugccucagcc

SEQ ID NO: 233624 - RNA, 32 nt, Human
ucccagguucaaacgauucucuugccucaguc

SEQ ID NO: 233625 - RNA, 32 nt, Human
ucccagguucaaaucauucucuugccucagac

SEQ ID NO: 233626 - RNA, 32 nt, Human
ucccagguucaagcaauucucuugccucagcc

SEQ ID NO: 233627 - RNA, 32 nt, Human
ucccagguucaagcaauucucuugccucggcc

SEQ ID NO: 233628 - RNA, 32 nt, Human
ucccagguucaagcgauucuccugccucaacc

SEQ ID NO: 233629 - RNA, 32 nt, Human
ucccagguucaagcgauucuccugccucagac

SEQ ID NO: 233630 - RNA, 32 nt, Human
ucccagguucaagcgauucuccugccucagcc

SEQ ID NO: 233631 - RNA, 32 nt, Human
ucccagguucaagcgauucuccugccucagcg

SEQ ID NO: 233632 - RNA, 32 nt, Human
ucccagguucaagcgauucuccugccucaggc

SEQ ID NO: 233633 - RNA, 32 nt, Human
ucccagguucaagcgauucuccugccucaucc

SEQ ID NO: 233634 - RNA, 32 nt, Human
ucccagguucaagcgauucuccugccuccucc

SEQ ID NO: 233635 - RNA, 32 nt, Human
ucccagguucaagcgauucuccugccuuagcc

SEQ ID NO: 233636 - RNA, 32 nt, Human
ucccagguucaagcgauucucuugccucagcc

SEQ ID NO: 233637 - RNA, 32 nt, Human
ucccagguucaagcgauucucuugccucugcc

SEQ ID NO: 233638 - RNA, 32 nt, Human
ucccagguucaagcuauucuccugccucagcc

SEQ ID NO: 233639 - RNA, 32 nt, Human
ucccagguucaagugacucuccugccucagcc

SEQ ID NO: 233640 - RNA, 32 nt, Human
ucccagguucaagugagucucaugccucagcc

SEQ ID NO: 233641 - RNA, 32 nt, Human
ucccagguucaagugagucucgugccucagcc

SEQ ID NO: 233642 - RNA, 32 nt, Human
ucccagguucaagugauucccuugcuucagcc

SEQ ID NO: 233643 - RNA, 32 nt, Human
ucccagguucaagugauucucaugccucaguc

SEQ ID NO: 233644 - RNA, 32 nt, Human
ucccagguucaagugauucucccaccucagcc

SEQ ID NO: 233645 - RNA, 32 nt, Human
ucccagguucaagugauucucccugccuccgc

SEQ ID NO: 233646 - RNA, 32 nt, Human
ucccagguucaagugauucuccuaccucagcc

SEQ ID NO: 233647 - RNA, 32 nt, Human
ucccagguucaagugauucuccugccucagcc

SEQ ID NO: 233648 - RNA, 32 nt, Human
ucccagguucaagugauucuccugccucagcu

SEQ ID NO: 233649 - RNA, 32 nt, Human
ucccagguucaagugauucuccugccucaguc

SEQ ID NO: 233650 - RNA, 32 nt, Human
ucccagguucaagugauucuccugccucaucc

SEQ ID NO: 233651 - RNA, 32 nt, Human
ucccagguucaagugauucuccugccucggcc

SEQ ID NO: 233652 - RNA, 32 nt, Human
ucccagguucaagugauucuccugucucagcc

SEQ ID NO: 233653 - RNA, 32 nt, Human
ucccagguucaagugauucuccugucucaguc

SEQ ID NO: 233654 - RNA, 32 nt, Human
ucccagguucaagugauucucuugccucagcc

SEQ ID NO: 233655 - RNA, 32 nt, Human
ucccagguucaagugauucuucugccucagcc

SEQ ID NO: 233656 - RNA, 32 nt, Human
ucccagguucaagugauucuucuugccucagc

SEQ ID NO: 233657 - RNA, 32 nt, Human
ucccagguucaagugauucuugugccucagcc

SEQ ID NO: 233658 - RNA, 32 nt, Human
ucccagguucaagugauugucccauuucagcc

SEQ ID NO: 233659 - RNA, 32 nt, Human
ucccagguucacaccauucuccugccucaacc

SEQ ID NO: 233660 - RNA, 32 nt, Human
ucccagguucacaccauucuccugccucagcc

SEQ ID NO: 233661 - RNA, 32 nt, Human
ucccagguucacaccauucuccugccucagcu

SEQ ID NO: 233662 - RNA, 32 nt, Human
ucccagguucacaccauucucuugccucagcc

SEQ ID NO: 233663 - RNA, 32 nt, Human
ucccagguucacgccauccuccugccucagcu

SEQ ID NO: 233664 - RNA, 32 nt, Human
ucccagguucacgccauucuccugccucagcc

SEQ ID NO: 233665 - RNA, 32 nt, Human
ucccagguucacgccauuguccugccucagcc

SEQ ID NO: 233666 - RNA, 32 nt, Human
ucccagguucaggcgauucuccugccucagcc

SEQ ID NO: 233667 - RNA, 32 nt, Human
ucccagguucaggcgauucuccugccucaguc

SEQ ID NO: 233668 - RNA, 32 nt, Human
ucccagguucaugccauucuccugccccagcu

SEQ ID NO: 233669 - RNA, 32 nt, Human
ucccagguucaugccauucuccugccucaccc

SEQ ID NO: 233670 - RNA, 32 nt, Human
ucccagguucaugccauucuccugccucagcc

SEQ ID NO: 233671 - RNA, 32 nt, Human
ucccagguucaugucauucuccugccucagcc

SEQ ID NO: 233672 - RNA, 32 nt, Human
ucccagguucccgccauucuccugccucagcc

SEQ ID NO: 233673 - RNA, 32 nt, Human
ucccagguugaaugauuuauggauuaaaguac

SEQ ID NO: 233674 - RNA, 32 nt, Human
ucccagguugacaccauucuccugccucaccc

SEQ ID NO: 233675 - RNA, 32 nt, Human
ucccagguugcugggguuacaggugugugcca

SEQ ID NO: 233676 - RNA, 32 nt, Human
ucccagguuuaagcgauucucuugccucagcc

SEQ ID NO: 233677 - RNA, 32 nt, Human
ucccaguaaacccauuggaagucaaaugcauu

SEQ ID NO: 233678 - RNA, 32 nt, Human
ucccaguaacauggugaaaggaagcaccacca

SEQ ID NO: 233679 - RNA, 32 nt, Human
ucccaguaacuucuaccugccagcccagaggg

SEQ ID NO: 233680 - RNA, 32 nt, Human
ucccaguacauaguugcauggcaaacaauccu

SEQ ID NO: 233681 - RNA, 22 nt, Human
ucccaguaccucgggcugcaag

SEQ ID NO: 233682 - RNA, 32 nt, Human
ucccaguagcgaugaguaacagagguggcugu

SEQ ID NO: 233683 - RNA, 32 nt, Human
ucccaguaggagccagggcugaguguggaaau

SEQ ID NO: 233684 - RNA, 22 nt, Human
ucccaguauucagagcugugaa

SEQ ID NO: 233685 - RNA, 32 nt, Human
ucccagucacugcauggccucugcccauccug

SEQ ID NO: 233686 - RNA, 32 nt, Human
ucccaguccacagaaccugugaaugugaccuu

SEQ ID NO: 233687 - RNA, 32 nt, Human
ucccaguccaucuccuggaggcagacagaugg

SEQ ID NO: 233688 - RNA, 32 nt, Human
ucccaguccccaggaaccuagcucuuuaaacu

SEQ ID NO: 233689 - RNA, 17 nt, Human
ucccaguccuccuucua

SEQ ID NO: 233690 - RNA, 32 nt, Human
ucccaguccugaugugugugcguuguucucuc

SEQ ID NO: 233691 - RNA, 32 nt, Human
ucccagucuccaagugcuaacacauaaacaca

SEQ ID NO: 233692 - RNA, 32 nt, Human
ucccagucuuccugcuaagccuaauccaagcc

SEQ ID NO: 233693 - RNA, 32 nt, Human
ucccagugaaaugcugcugcugccauuucaac

SEQ ID NO: 233694 - RNA, 32 nt, Human
ucccagugaccuccccuccacaccugcuguga

SEQ ID NO: 233695 - RNA, 32 nt, Human
ucccagugacgggucuggagugcgugggggac

SEQ ID NO: 233696 - RNA, 21 nt, Human
ucccagugagaacugaccuga

SEQ ID NO: 233697 - RNA, 32 nt, Human
ucccagugaugcaccaugccaauaguggauaa

SEQ ID NO: 233698 - RNA, 20 nt, Human
ucccagugcccagccaccca

SEQ ID NO: 233699 - RNA, 32 nt, Human
ucccagugccgagaaggaagccucccacgacu

SEQ ID NO: 233700 - RNA, 32 nt, Human
ucccagugcucuggaucagugucuaaaaauca

SEQ ID NO: 233701 - RNA, 32 nt, Human
ucccagugcuuccugcagucaggcacuuccug

SEQ ID NO: 233702 - RNA, 22 nt, Human
ucccaguggaggggaaagggga

SEQ ID NO: 233703 - RNA, 32 nt, Human
ucccaguggaugagaugcuguccucugggcuc

SEQ ID NO: 233704 - RNA, 32 nt, Human
ucccagugggcgaugugggcagaggagcuccg

SEQ ID NO: 233705 - RNA, 32 nt, Human
ucccaguggugggacucagcccagacugcccu

SEQ ID NO: 233706 - RNA, 32 nt, Human
ucccaguguguacggagccaguggaauauggg

SEQ ID NO: 233707 - RNA, 32 nt, Human
ucccaguuaccugggaggcugaggcaggagaa

SEQ ID NO: 233708 - RNA, 32 nt, Human
ucccaguucauaaucacaacccuucagauuug

SEQ ID NO: 233709 - RNA, 32 nt, Human
ucccaguuccagagcaccucaggacaacccca

SEQ ID NO: 233710 - RNA, 32 nt, Human
ucccaguuccagggggaggccugcaggccccu

SEQ ID NO: 233711 - RNA, 19 nt, Human
ucccaguuccccacugcca

SEQ ID NO: 233712 - RNA, 32 nt, Human
ucccaguucuaccuccccagaagccuuccucc

SEQ ID NO: 233713 - RNA, 32 nt, Human
ucccaguucugcggcuggagugggugggugca

SEQ ID NO: 233714 - RNA, 17 nt, Human
ucccaguugcaaucuca

SEQ ID NO: 233715 - RNA, 32 nt, Human
ucccaguugcuuuuccccagauuuggugacuc

SEQ ID NO: 233716 - RNA, 32 nt, Human
ucccaguugggagcucgcucacagucuuuaag

SEQ ID NO: 233717 - RNA, 32 nt, Human
ucccaguugggcgucccggagcucagggacug

SEQ ID NO: 233718 - RNA, 32 nt, Human
ucccaguuucaagcgauucuccugccucagcc

SEQ ID NO: 233719 - RNA, 32 nt, Human
ucccaguuuccugcauaaguucuugaacagaa

SEQ ID NO: 233720 - RNA, 21 nt, Human
ucccaguuuuccagaccugaa

SEQ ID NO: 233721 - RNA, 32 nt, Human
ucccaguuuuccagaccugaaguguuuuccaa

SEQ ID NO: 233722 - RNA, 32 nt, Human
ucccaguuuuucuccccuuuugguuuaauagu

SEQ ID NO: 233723 - RNA, 32 nt, Human
ucccauaagcagcugugguggcagugagggag

SEQ ID NO: 233724 - RNA, 32 nt, Human
ucccauaagugaaauauaauauuuuucaaagu

SEQ ID NO: 233725 - RNA, 32 nt, Human
ucccauaaguuucugcugcuucucccauaacu

SEQ ID NO: 233726 - RNA, 32 nt, Human
ucccauaauagaaaugagcaugcagggcuaag

SEQ ID NO: 233727 - RNA, 24 nt, Human
ucccauaauauuuuuucuuuuuca

SEQ ID NO: 233728 - RNA, 32 nt, Human
ucccauaauuccagaaagcaaaaggcuuacaa

SEQ ID NO: 233729 - RNA, 32 nt, Human
ucccauacaagucaagguaacagaacaaaagg

SEQ ID NO: 233730 - RNA, 32 nt, Human
ucccauacacagaaacacaaaacacuuugauc

SEQ ID NO: 233731 - RNA, 32 nt, Human
ucccauacaggacauccaggcaucuaaaaggu

SEQ ID NO: 233732 - RNA, 32 nt, Human
ucccauaccuccacugcugaaguuccuccagc

SEQ ID NO: 233733 - RNA, 32 nt, Human
ucccauacuccucaggguucugagguccuugu

SEQ ID NO: 233734 - RNA, 32 nt, Human
ucccauacuguacugcuaucaguagccagugu

SEQ ID NO: 233735 - RNA, 19 nt, Human
ucccauagcacuccaugua

SEQ ID NO: 233736 - RNA, 32 nt, Human
ucccauagcuaauagacauuucccaggccuug

SEQ ID NO: 233737 - RNA, 21 nt, Human
ucccauaggaguucucaggca

SEQ ID NO: 233738 - RNA, 32 nt, Human
ucccauauaggugagggaagccugaaaaacua

SEQ ID NO: 233739 - RNA, 23 nt, Human
ucccauaugucauucauuucuca

SEQ ID NO: 233740 - RNA, 23 nt, Human
ucccauauuucugcuuccccuca

SEQ ID NO: 233741 - RNA, 32 nt, Human
ucccaucaaggccucuggagggaaggcuaagc

SEQ ID NO: 233742 - RNA, 32 nt, Human
ucccaucacagaacuguguuccaucaaaaaga

SEQ ID NO: 233743 - RNA, 25 nt, Human
ucccaucacagaagguggacagggc

SEQ ID NO: 233744 - RNA, 32 nt, Human
ucccaucacauucuggucuaaggcuuauuuau

SEQ ID NO: 233745 - RNA, 32 nt, Human
ucccaucaccaccaccaccaccaccaccauca

SEQ ID NO: 233746 - RNA, 32 nt, Human
ucccaucaccaucaccaccaccaccaccauca

SEQ ID NO: 233747 - RNA, 32 nt, Human
ucccaucaccuugcccucauugucuucccucu

SEQ ID NO: 233748 - RNA, 32 nt, Human
ucccaucagccuguccaggcccagcucaugcc

SEQ ID NO: 233749 - RNA, 32 nt, Human
ucccaucagccuguuucuccaccuuagaaaag

SEQ ID NO: 233750 - RNA, 32 nt, Human
ucccaucagcgcagaagagagcaaucuggacu

SEQ ID NO: 233751 - RNA, 32 nt, Human
ucccaucaucuacucaggaggcugaggcagga

SEQ ID NO: 233752 - RNA, 32 nt, Human
ucccaucaugggaacagugguucuuccccagu

SEQ ID NO: 233753 - RNA, 21 nt, Human
ucccauccaagugaccagaug

SEQ ID NO: 233754 - RNA, 32 nt, Human
ucccauccaccugucuguccuggccuaaugcc

SEQ ID NO: 233755 - RNA, 32 nt, Human
ucccauccaggauggauuuacccccuaaaagu

SEQ ID NO: 233756 - RNA, 32 nt, Human
ucccauccaguucuggaguucguagagaguga

SEQ ID NO: 233757 - RNA, 32 nt, Human
ucccauccaugaaaccuaauaaaagaguagaa

SEQ ID NO: 233758 - RNA, 32 nt, Human
ucccaucccauggacucccacucuggggagcc

SEQ ID NO: 233759 - RNA, 32 nt, Human
ucccaucccauugcagccuccaccaccuguaa

SEQ ID NO: 233760 - RNA, 32 nt, Human
ucccauccccaaggagcccuucagcgcgcccu

SEQ ID NO: 233761 - RNA, 32 nt, Human
ucccaucccuuuccugagucauggccucaaaa

SEQ ID NO: 233762 - RNA, 32 nt, Human
ucccauccucaggguaggagggcaguugcacg

SEQ ID NO: 233763 - RNA, 32 nt, Human
ucccauccuccacagucucccaucccaccagc

SEQ ID NO: 233764 - RNA, 32 nt, Human
ucccauccuccccugauaggccccuccuccuu

SEQ ID NO: 233765 - RNA, 19 nt, Human
ucccauccuccucucuuca

SEQ ID NO: 233766 - RNA, 32 nt, Human
ucccauccuggcucugucauuuacuuacagaa

SEQ ID NO: 233767 - RNA, 32 nt, Human
ucccauccuuguccuucucucccucagaagcc

SEQ ID NO: 233768 - RNA, 32 nt, Human
ucccauccuuucucccuggcugcccuguuaac

SEQ ID NO: 233769 - RNA, 32 nt, Human
ucccaucgaccagcaagcccagccccagggcg

SEQ ID NO: 233770 - RNA, 32 nt, Human
ucccaucgcucuguguuuccugcuccagguuu

SEQ ID NO: 233771 - RNA, 32 nt, Human
ucccaucggaggugguuggugcagauggaagu

SEQ ID NO: 233772 - RNA, 32 nt, Human
ucccaucgugggcagccagagcuccgaggcuc

SEQ ID NO: 233773 - RNA, 32 nt, Human
ucccaucuaagcugcagcuuccugucaacacu

SEQ ID NO: 233774 - RNA, 32 nt, Human
ucccaucuaccuccucuucauccaccaccaug

SEQ ID NO: 233775 - RNA, 32 nt, Human
ucccaucucaagauucaucaccgaguucccua

SEQ ID NO: 233776 - RNA, 32 nt, Human
ucccaucucaaggacuuggaaguaagggaaau

SEQ ID NO: 233777 - RNA, 32 nt, Human
ucccaucucaagguccuuaacagcauguggaa

SEQ ID NO: 233778 - RNA, 32 nt, Human
ucccaucucaaucauugagccugaaggcuuca

SEQ ID NO: 233779 - RNA, 19 nt, Human
ucccaucucagccaugagg

SEQ ID NO: 233780 - RNA, 22 nt, Human
ucccaucucagccucccaagua

SEQ ID NO: 233781 - RNA, 32 nt, Human
ucccaucuccaccccuuccugucauccucuau

SEQ ID NO: 233782 - RNA, 32 nt, Human
ucccaucucccucagugaccuggaucugaccu

SEQ ID NO: 233783 - RNA, 32 nt, Human
ucccaucuccugccauggccaggugugagaga

SEQ ID NO: 233784 - RNA, 21 nt, Human
ucccaucucggcuucccaaug

SEQ ID NO: 233785 - RNA, 32 nt, Human
ucccaucucuacaacaaaaauacaaaaauuag

SEQ ID NO: 233786 - RNA, 32 nt, Human
ucccaucucucggcguuccagcauccugucaa

SEQ ID NO: 233787 - RNA, 32 nt, Human
ucccaucucucuggauuuccuuuugcuucauu

SEQ ID NO: 233788 - RNA, 32 nt, Human
ucccaucucugccccucugucucccaucugcc

SEQ ID NO: 233789 - RNA, 32 nt, Human
ucccaucucugccucuggcacccugcuggaaa

SEQ ID NO: 233790 - RNA, 32 nt, Human
ucccaucucuuuaguucuuccuccugguuccu

SEQ ID NO: 233791 - RNA, 32 nt, Human
ucccaucugaagaguggaaauggggaacuccc

SEQ ID NO: 233792 - RNA, 32 nt, Human
ucccaucugcgcaccaggcugcagauccaagg

SEQ ID NO: 233793 - RNA, 32 nt, Human
ucccaucugcuccccaauucuugaucucuccc

SEQ ID NO: 233794 - RNA, 32 nt, Human
ucccaucuguaggagauuagugaggcaaggug

SEQ ID NO: 233795 - RNA, 32 nt, Human
ucccaucuguuuucucuguucucuuucuggaa

SEQ ID NO: 233796 - RNA, 32 nt, Human
ucccaucuuccaggauggauauuggggugggg

SEQ ID NO: 233797 - RNA, 32 nt, Human
ucccaucuuguccuagcccaucccccagacua

SEQ ID NO: 233798 - RNA, 32 nt, Human
ucccaugaagaaagggaacggugaaguacuaa

SEQ ID NO: 233799 - RNA, 32 nt, Human
ucccaugaaucuguuuacuagcuugguggaug

SEQ ID NO: 233800 - RNA, 21 nt, Human
ucccaugacaaggaccagcug

SEQ ID NO: 233801 - RNA, 32 nt, Human
ucccaugacccaccccugugcuccgugccucc

SEQ ID NO: 233802 - RNA, 32 nt, Human
ucccaugaccugugggcucugcagauggaccu

SEQ ID NO: 233803 - RNA, 32 nt, Human
ucccaugagaccaguaauacugucugccucag

SEQ ID NO: 233804 - RNA, 23 nt, Human
ucccaugaggaggcuuccaggca

SEQ ID NO: 233805 - RNA, 32 nt, Human
ucccaugaguaugcaaaucaauaguuuuaacc

SEQ ID NO: 233806 - RNA, 32 nt, Human
ucccaugagugccaagacggugcaauggguag

SEQ ID NO: 233807 - RNA, 32 nt, Human
ucccaugaucacuucaaccacaggccuuugac

SEQ ID NO: 233808 - RNA, 23 nt, Human
ucccaugcaaguagcuggcugua

SEQ ID NO: 233809 - RNA, 32 nt, Human
ucccaugcacuugcacguccaggacuccuggg

SEQ ID NO: 233810 - RNA, 32 nt, Human
ucccaugcagacaggaucaccuaacagagaug

SEQ ID NO: 233811 - RNA, 32 nt, Human
ucccaugcaguuuccccaggcaccuuugcuca

SEQ ID NO: 233812 - RNA, 32 nt, Human
ucccaugcaucagcugcucccaccccucaucc

SEQ ID NO: 233813 - RNA, 32 nt, Human
ucccaugccaaaggacaaacaggugugacauu

SEQ ID NO: 233814 - RNA, 21 nt, Human
ucccaugcccacagucaccca

SEQ ID NO: 233815 - RNA, 32 nt, Human
ucccaugcucgcuugcucacacacccuucacu

SEQ ID NO: 233816 - RNA, 22 nt, Human
ucccaugcugcaauuucuuccu

SEQ ID NO: 233817 - RNA, 32 nt, Human
ucccaugcugucacccucaggaagcaucauga

SEQ ID NO: 233818 - RNA, 32 nt, Human
ucccaugcuuacgugauccucucaccucagcc

SEQ ID NO: 233819 - RNA, 32 nt, Human
ucccaugcuugcuugcucacacacccuucacu

SEQ ID NO: 233820 - RNA, 32 nt, Human
ucccauggaaacacagcugaaaugaaauggga

SEQ ID NO: 233821 - RNA, 32 nt, Human
ucccauggaagccacguuccagaaguuuccau

SEQ ID NO: 233822 - RNA, 32 nt, Human
ucccauggaaguuuccucacaaagucagcucc

SEQ ID NO: 233823 - RNA, 25 nt, Human
ucccauggaccaugccgcagcacag

SEQ ID NO: 233824 - RNA, 32 nt, Human
ucccauggagaccaacauggccaggggagggc

SEQ ID NO: 233825 - RNA, 22 nt, Human
ucccauggaucucuucccagca

SEQ ID NO: 233826 - RNA, 32 nt, Human
ucccauggccugcucccucaggaacagcucca

SEQ ID NO: 233827 - RNA, 32 nt, Human
ucccauggcugaagcggagcagcuggauugcu

SEQ ID NO: 233828 - RNA, 32 nt, Human
ucccauggcugcaucuuaagauggaugcacgg

SEQ ID NO: 233829 - RNA, 32 nt, Human
ucccaugggaaugccgcagggagccaggcugg

SEQ ID NO: 233830 - RNA, 32 nt, Human
ucccaugggaggugggucuggccaauggagau

SEQ ID NO: 233831 - RNA, 32 nt, Human
ucccaugggagguguaggauaaggugggggcg

SEQ ID NO: 233832 - RNA, 22 nt, Human
ucccaugggcagaggaccaggc

SEQ ID NO: 233833 - RNA, 32 nt, Human
ucccaugggcagaggaccaggcuguaggaaau

SEQ ID NO: 233834 - RNA, 32 nt, Human
ucccaugggcgcagcagcacacccagcuccca

SEQ ID NO: 233835 - RNA, 19 nt, Human
ucccaugggcuggucucca

SEQ ID NO: 233836 - RNA, 20 nt, Human
ucccaugggugaggaccaga

SEQ ID NO: 233837 - RNA, 32 nt, Human
ucccaugggugaggaccagaaccagacucuga

SEQ ID NO: 233838 - RNA, 18 nt, Human
ucccaugguagacuguga

SEQ ID NO: 233839 - RNA, 20 nt, Human
ucccauggucaugccaccca

SEQ ID NO: 233840 - RNA, 32 nt, Human
ucccauggugaaggcaggggacauagacaagg

SEQ ID NO: 233841 - RNA, 32 nt, Human
ucccauguagcaggaaccacaggcaggcacca

SEQ ID NO: 233842 - RNA, 20 nt, Human
ucccauguaggcaccaagug

SEQ ID NO: 233843 - RNA, 32 nt, Human
ucccaugucacaaguccucuggccucucccug

SEQ ID NO: 233844 - RNA, 18 nt, Human
ucccaugucagccuccca

SEQ ID NO: 233845 - RNA, 22 nt, Human
ucccaugucagccucccaagua

SEQ ID NO: 233846 - RNA, 19 nt, Human
ucccauguccgaggcggug

SEQ ID NO: 233847 - RNA, 18 nt, Human
ucccauguccugaccaga

SEQ ID NO: 233848 - RNA, 18 nt, Human
ucccaugucugaaaacca

SEQ ID NO: 233849 - RNA, 32 nt, Human
ucccaugucuuagcggggcaugguacgguuuc

SEQ ID NO: 233850 - RNA, 32 nt, Human
ucccaugugcaggguucagcaguuauguggga

SEQ ID NO: 233851 - RNA, 32 nt, Human
ucccaugugggauggagcagaacugcauuauu

SEQ ID NO: 233852 - RNA, 32 nt, Human
ucccaugugucuucagcuuucuuuugcaaagg

SEQ ID NO: 233853 - RNA, 32 nt, Human
ucccauguucaagugauucuccugccucagcc

SEQ ID NO: 233854 - RNA, 32 nt, Human
ucccauguucucccauggucauggcuucccgg

SEQ ID NO: 233855 - RNA, 32 nt, Human
ucccauguucucuauagacuugggaccuuccu

SEQ ID NO: 233856 - RNA, 32 nt, Human
ucccauguugcccaggcuggucucaaauuucu

SEQ ID NO: 233857 - RNA, 32 nt, Human
ucccauguuggccaggcuggucucgaacuuau

SEQ ID NO: 233858 - RNA, 32 nt, Human
ucccauguuggccucugcaaccacacagggau

SEQ ID NO: 233859 - RNA, 32 nt, Human
ucccauguuguccuggcaugugcaguauacac

SEQ ID NO: 233860 - RNA, 32 nt, Human
ucccauuaaacuugaacuguggcuauauugaa

SEQ ID NO: 233861 - RNA, 32 nt, Human
ucccauuacgcacacacauaaugucauuucuc

SEQ ID NO: 233862 - RNA, 20 nt, Human
ucccauuaggaaaccaggug

SEQ ID NO: 233863 - RNA, 32 nt, Human
ucccauuaguuuucccuuuuuccuuuuuaaua

SEQ ID NO: 233864 - RNA, 32 nt, Human
ucccauuaucccucagcucugaguccucuugu

SEQ ID NO: 233865 - RNA, 32 nt, Human
ucccauucagcguuuuguuucuuucuguccau

SEQ ID NO: 233866 - RNA, 32 nt, Human
ucccauuccaauuugaaucuuucuauuucuuu

SEQ ID NO: 233867 - RNA, 32 nt, Human
ucccauucccaauauuuauuccaagacucagu

SEQ ID NO: 233868 - RNA, 32 nt, Human
ucccauucccccaugucuccucccaucccucc

SEQ ID NO: 233869 - RNA, 32 nt, Human
ucccauuccucagaccagcaggaaaagagggg

SEQ ID NO: 233870 - RNA, 32 nt, Human
ucccauucuaaggaggugaggugguuggaaua

SEQ ID NO: 233871 - RNA, 32 nt, Human
ucccauucucacagcccugcuggaccaaggca

SEQ ID NO: 233872 - RNA, 32 nt, Human
ucccauucucccccucucccugagaguccccu

SEQ ID NO: 233873 - RNA, 32 nt, Human
ucccauucucuagccucaccuaucuggccggu

SEQ ID NO: 233874 - RNA, 32 nt, Human
ucccauucugaaacugacaguucucuuuacaa

SEQ ID NO: 233875 - RNA, 32 nt, Human
ucccauucuguucuguucuguucuccuaauac

SEQ ID NO: 233876 - RNA, 32 nt, Human
ucccauucuuauugaauacaagcccugaucuu

SEQ ID NO: 233877 - RNA, 32 nt, Human
ucccauucuucuuuaccuggucuccuuccuuc

SEQ ID NO: 233878 - RNA, 32 nt, Human
ucccauugauugugagcaagauauuuaucucu

SEQ ID NO: 233879 - RNA, 22 nt, Human
ucccauugcaaacauuauucca

SEQ ID NO: 233880 - RNA, 32 nt, Human
ucccauugcccagccucagugcauuuggcaaa

SEQ ID NO: 233881 - RNA, 23 nt, Human
ucccauugcccuauucuagcauc

SEQ ID NO: 233882 - RNA, 23 nt, Human
ucccauugccucucccccuuucc

SEQ ID NO: 233883 - RNA, 32 nt, Human
ucccauugccucucccccuuuccucgacagcu

SEQ ID NO: 233884 - RNA, 31 nt, Human
ucccauugccucucuugagugucagcgccuc

SEQ ID NO: 233885 - RNA, 32 nt, Human
ucccauugcugucugcaggcugugggaauuuc

SEQ ID NO: 233886 - RNA, 32 nt, Human
ucccauuggccuauugaaucuuccuugcucuu

SEQ ID NO: 233887 - RNA, 32 nt, Human
ucccauuggucuuugguugcucaucccucuaa

SEQ ID NO: 233888 - RNA, 32 nt, Human
ucccauuuacccggacgccucugacaaugugu

SEQ ID NO: 233889 - RNA, 32 nt, Human
ucccauuuagaccgcaaaacagugccacaggg

SEQ ID NO: 233890 - RNA, 32 nt, Human
ucccauuucaaucaugcagaugguuucuuuuu

SEQ ID NO: 233891 - RNA, 32 nt, Human
ucccauuugacuuccuuucuucuuucaggcuu

SEQ ID NO: 233892 - RNA, 32 nt, Human
ucccauuugccucccuccagcucugcuuaggc

SEQ ID NO: 233893 - RNA, 32 nt, Human
ucccauuugucuggccagucucugugugucuu

SEQ ID NO: 233894 - RNA, 32 nt, Human
ucccauuuucccuugcugggaguagccacaug

SEQ ID NO: 233895 - RNA, 32 nt, Human
ucccauuuuccucugacguccaccuccuaccc

SEQ ID NO: 233896 - RNA, 32 nt, Human
ucccauuuucgcuuuccucugguuugaaagcc

SEQ ID NO: 233897 - RNA, 32 nt, Human
ucccauuuucucucugcuuucucuccaacugc

SEQ ID NO: 233898 - RNA, 32 nt, Human
ucccauuuugacugagaauauugacauauaag

SEQ ID NO: 233899 - RNA, 32 nt, Human
ucccauuuuuaucugcuacucuuuauuucaua

SEQ ID NO: 233900 - RNA, 32 nt, Human
uccccaaacaguaggcuucaguucccugccag

SEQ ID NO: 233901 - RNA, 32 nt, Human
uccccaaacaucucccucccuaccucccuccc

SEQ ID NO: 233902 - RNA, 32 nt, Human
uccccaaacugugcccugccuucagcuuuggu

SEQ ID NO: 233903 - RNA, 32 nt, Human
uccccaaagaccugaguggcugagggggcccc

SEQ ID NO: 233904 - RNA, 32 nt, Human
uccccaaaggagguagaagauggggaagauga

SEQ ID NO: 233905 - RNA, 32 nt, Human
uccccaaagugcugggaugacaggcaugagcc

SEQ ID NO: 233906 - RNA, 32 nt, Human
uccccaaagugcugggauuacaggcaugagcc

SEQ ID NO: 233907 - RNA, 32 nt, Human
uccccaaagugcugggauuacaggcgugagcc

SEQ ID NO: 233908 - RNA, 32 nt, Human
uccccaaagugcugggauuacagguacaauga

SEQ ID NO: 233909 - RNA, 32 nt, Human
uccccaaagugcugggauugcaggcgugagcc

SEQ ID NO: 233910 - RNA, 20 nt, Human
uccccaaauacagcaccuuc

SEQ ID NO: 233911 - RNA, 25 nt, Human
uccccaacaaggcagcugauuccag

SEQ ID NO: 233912 - RNA, 22 nt, Human
uccccaacaggcacugggcucu

SEQ ID NO: 233913 - RNA, 32 nt, Human
uccccaaccacgagaagagggccgggaagcug

SEQ ID NO: 233914 - RNA, 32 nt, Human
uccccaaccagcucccugucccugcuucuggg

SEQ ID NO: 233915 - RNA, 32 nt, Human
uccccaaccccaaaucaagaccaccuuucuuc

SEQ ID NO: 233916 - RNA, 32 nt, Human
uccccaaccccagcaccucaaggagcacaaaa

SEQ ID NO: 233917 - RNA, 32 nt, Human
uccccaacccuuuagcuccuuuugcuuugagu

SEQ ID NO: 233918 - RNA, 32 nt, Human
uccccaacuccucgcuucacuucaccugugcc

SEQ ID NO: 233919 - RNA, 32 nt, Human
uccccaacuucauuugcuucucucaacaaccu

SEQ ID NO: 233920 - RNA, 32 nt, Human
uccccaacuucuccaccugcuggugcagcucu

SEQ ID NO: 233921 - RNA, 32 nt, Human
uccccaacuuuguggcgcccucaggccgcggc

SEQ ID NO: 233922 - RNA, 32 nt, Human
uccccaacuuuugccagaaagcagaaaaaugc

SEQ ID NO: 233923 - RNA, 21 nt, Human
uccccaagaagagggaaggca

SEQ ID NO: 233924 - RNA, 32 nt, Human
uccccaagacauggggacuuugcagugagcaa

SEQ ID NO: 233925 - RNA, 22 nt, Human
uccccaagagaggaaccagaag

SEQ ID NO: 233926 - RNA, 18 nt, Human
uccccaagagcuggcacc

SEQ ID NO: 233927 - RNA, 32 nt, Human
uccccaagauucacaccugacucugaaaucug

SEQ ID NO: 233928 - RNA, 32 nt, Human
uccccaagcacacuccuagcugcuccagucuc

SEQ ID NO: 233929 - RNA, 32 nt, Human
uccccaagccugacccgagugggcgcgaacuu

SEQ ID NO: 233930 - RNA, 18 nt, Human
uccccaaggaaaguccuu

SEQ ID NO: 233931 - RNA, 20 nt, Human
uccccaaggacucccccuuc

SEQ ID NO: 233932 - RNA, 26 nt, Human
uccccaaggacugaccagggaccuuu

SEQ ID NO: 233933 - RNA, 32 nt, Human
uccccaaggauagugcuggcuuccauggaaac

SEQ ID NO: 233934 - RNA, 32 nt, Human
uccccaaggauccacucccccagcuccuuuag

SEQ ID NO: 233935 - RNA, 19 nt, Human
uccccaaggauggggcucu

SEQ ID NO: 233936 - RNA, 32 nt, Human
uccccaaggcagguggccuccacccacguucu

SEQ ID NO: 233937 - RNA, 32 nt, Human
uccccaaggcuggagugcaguggugcaaucuu

SEQ ID NO: 233938 - RNA, 32 nt, Human
uccccaagggcacucagccacagggaugaacu

SEQ ID NO: 233939 - RNA, 32 nt, Human
uccccaaguccagaaggaaggaauggagcuga

SEQ ID NO: 233940 - RNA, 32 nt, Human
uccccaagucgcuucuguggcaccccgcauuc

SEQ ID NO: 233941 - RNA, 18 nt, Human
uccccaaguggauugcag

SEQ ID NO: 233942 - RNA, 32 nt, Human
uccccaaguuccaaaagcacagacucaaaggg

SEQ ID NO: 233943 - RNA, 32 nt, Human
uccccaauaccacauuaaaucaucucaucuga

SEQ ID NO: 233944 - RNA, 32 nt, Human
uccccaauaccacauuaaaucgucucaucuga

SEQ ID NO: 233945 - RNA, 32 nt, Human
uccccaauccccaggucucuagaucauucugu

SEQ ID NO: 233946 - RNA, 19 nt, Human
uccccaaucccucugccca

SEQ ID NO: 233947 - RNA, 32 nt, Human
uccccaauccuggcaaaagcccaaagauccca

SEQ ID NO: 233948 - RNA, 32 nt, Human
uccccaaucugaauaccugcaggcucccacau

SEQ ID NO: 233949 - RNA, 32 nt, Human
uccccaaugccugugggagguggacucccugg

SEQ ID NO: 233950 - RNA, 21 nt, Human
uccccaauuacuauucccuuu

SEQ ID NO: 233951 - RNA, 32 nt, Human
uccccaauuagcacaaauacgccaagggaaca

SEQ ID NO: 233952 - RNA, 32 nt, Human
uccccaauucacugcaaggagaccucuacugu

SEQ ID NO: 233953 - RNA, 28 nt, Human
uccccacaagaugaugccucaucuccac

SEQ ID NO: 233954 - RNA, 32 nt, Human
uccccacacaacagugcccuccagaagcagcc

SEQ ID NO: 233955 - RNA, 32 nt, Human
uccccacacagcagcacagccaucacaggauu

SEQ ID NO: 233956 - RNA, 32 nt, Human
uccccacaccuacuccaaagaacagcuggacg

SEQ ID NO: 233957 - RNA, 32 nt, Human
uccccacacgugcucgcagccuggcggggcag

SEQ ID NO: 233958 - RNA, 32 nt, Human
uccccacacugcagcccugccacuugcuuguc

SEQ ID NO: 233959 - RNA, 32 nt, Human
uccccacacuguggaggaagggaccuguggca

SEQ ID NO: 233960 - RNA, 32 nt, Human
uccccacagggaacacagcggaaaguagagag

SEQ ID NO: 233961 - RNA, 32 nt, Human
uccccacaugcacacagaacucugacacagga

SEQ ID NO: 233962 - RNA, 32 nt, Human
uccccaccacacccacaccacagccgcugaau

SEQ ID NO: 233963 - RNA, 32 nt, Human
uccccaccacagugaccacacccucacuggcu

SEQ ID NO: 233964 - RNA, 23 nt, Human
uccccaccaccaaccuauagcag

SEQ ID NO: 233965 - RNA, 32 nt, Human
uccccaccaccaccaucuccaucacccaccaa

SEQ ID NO: 233966 - RNA, 32 nt, Human
uccccaccaggcuguucucugcccuuacacca

SEQ ID NO: 233967 - RNA, 32 nt, Human
uccccaccaucccagcugcugugaaaugggca

SEQ ID NO: 233968 - RNA, 19 nt, Human
uccccaccaucccuggccu

SEQ ID NO: 233969 - RNA, 32 nt, Human
uccccacccaaaucucaucuugaauucccaug

SEQ ID NO: 233970 - RNA, 32 nt, Human
uccccacccaaaucucaucuuguagcucccau

SEQ ID NO: 233971 - RNA, 32 nt, Human
uccccacccaggacugagaggcuggagacccc

SEQ ID NO: 233972 - RNA, 32 nt, Human
uccccacccaggagggagguggcacuucuuaa

SEQ ID NO: 233973 - RNA, 20 nt, Human
uccccaccccaccccuaccu

SEQ ID NO: 233974 - RNA, 32 nt, Human
uccccacccccacccaagauggagucuggcuu

SEQ ID NO: 233975 - RNA, 32 nt, Human
uccccacccccaggcuggcaguagcacugcug

SEQ ID NO: 233976 - RNA, 18 nt, Human
uccccacccccggucccc

SEQ ID NO: 233977 - RNA, 17 nt, Human
uccccacccccuccuca

SEQ ID NO: 233978 - RNA, 32 nt, Human
uccccaccccucucccccaaaugcagcugaag

SEQ ID NO: 233979 - RNA, 23 nt, Human
uccccaccccucuccucugccca

SEQ ID NO: 233980 - RNA, 32 nt, Human
uccccaccccuucugccagacugccuuugaaa

SEQ ID NO: 233981 - RNA, 32 nt, Human
uccccacccucaccuccaucccaucaaagccc

SEQ ID NO: 233982 - RNA, 32 nt, Human
uccccacccugccucaguguucccauucacac

SEQ ID NO: 233983 - RNA, 32 nt, Human
uccccacccugccuccucccugcugcuuugca

SEQ ID NO: 233984 - RNA, 20 nt, Human
uccccacccuuccugaccug

SEQ ID NO: 233985 - RNA, 32 nt, Human
uccccacccuucuccccuuccuuugcccgggg

SEQ ID NO: 233986 - RNA, 32 nt, Human
uccccacccuuggcaaguucuccccaccccca

SEQ ID NO: 233987 - RNA, 32 nt, Human
uccccaccgcuuccugucucagcggaccuacu

SEQ ID NO: 233988 - RNA, 32 nt, Human
uccccaccgcuuucagugguagaaagaauucc

SEQ ID NO: 233989 - RNA, 32 nt, Human
uccccaccuccaccuugucacuccagguucug

SEQ ID NO: 233990 - RNA, 18 nt, Human
uccccaccuccccuucca

SEQ ID NO: 233991 - RNA, 32 nt, Human
uccccaccuccuugcucuccccagccugccaa

SEQ ID NO: 233992 - RNA, 32 nt, Human
uccccaccucucagugcugacggugccuucau

SEQ ID NO: 233993 - RNA, 32 nt, Human
uccccaccuguacaacaacggaaaggugugug

SEQ ID NO: 233994 - RNA, 24 nt, Human
uccccaccugucaggccugugacc

SEQ ID NO: 233995 - RNA, 32 nt, Human
uccccaccuuuccccgcuuucuauuccacaaa

SEQ ID NO: 233996 - RNA, 22 nt, Human
uccccacgaacuggccuggcca

SEQ ID NO: 233997 - RNA, 32 nt, Human
uccccacgccgauuuauaacaaaggccccugc

SEQ ID NO: 233998 - RNA, 32 nt, Human
uccccacgcugcuccccucuuccuaagcggcc

SEQ ID NO: 233999 - RNA, 22 nt, Human
uccccacggggccucgggaccu

SEQ ID NO: 234000 - RNA, 32 nt, Human
uccccacggugccacgggaggcucccuggcag

SEQ ID NO: 234001 - RNA, 27 nt, Human
uccccacgugagcaacagcuggcccag

SEQ ID NO: 234002 - RNA, 32 nt, Human
uccccacuaauggcuaggauggcaggguaggc

SEQ ID NO: 234003 - RNA, 32 nt, Human
uccccacuagccuuauagagggacugugugag

SEQ ID NO: 234004 - RNA, 32 nt, Human
uccccacuaugaccugcugugaccucaagcuc

SEQ ID NO: 234005 - RNA, 32 nt, Human
uccccacuaugcccaggagucuucccaaguug

SEQ ID NO: 234006 - RNA, 32 nt, Human
uccccacuauuccauuagaccccacaaauguu

SEQ ID NO: 234007 - RNA, 32 nt, Human
uccccacucagaucucaucuugaauucccaug

SEQ ID NO: 234008 - RNA, 32 nt, Human
uccccacuccaccccaacccucaccccacucu

SEQ ID NO: 234009 - RNA, 20 nt, Human
uccccacuccacuccgccca

SEQ ID NO: 234010 - RNA, 19 nt, Human
uccccacuccagccccuga

SEQ ID NO: 234011 - RNA, 32 nt, Human
uccccacucccccagccccuggcaaccacaaa

SEQ ID NO: 234012 - RNA, 32 nt, Human
uccccacucccccuguccccagucccugguaa

SEQ ID NO: 234013 - RNA, 32 nt, Human
uccccacucucacuucccuucccuucacagac

SEQ ID NO: 234014 - RNA, 32 nt, Human
uccccacucucaggcuggugggguggggaaag

SEQ ID NO: 234015 - RNA, 32 nt, Human
uccccacucugaugaucuccagccuccacugc

SEQ ID NO: 234016 - RNA, 24 nt, Human
uccccacucugcccaccucucuca

SEQ ID NO: 234017 - RNA, 32 nt, Human
uccccacugagcugggacccaggucauccacc

SEQ ID NO: 234018 - RNA, 24 nt, Human
uccccacugagucaggcuggggca

SEQ ID NO: 234019 - RNA, 32 nt, Human
uccccacugccgcguuguccaucacuaggacu

SEQ ID NO: 234020 - RNA, 32 nt, Human
uccccacugccuggccagagccauuguugucc

SEQ ID NO: 234021 - RNA, 32 nt, Human
uccccacugcucaugacagggaaccccuggau

SEQ ID NO: 234022 - RNA, 32 nt, Human
uccccacuggacugcauggcgacggcgugugg

SEQ ID NO: 234023 - RNA, 32 nt, Human
uccccacuggacugugagcugccugaggucag

SEQ ID NO: 234024 - RNA, 32 nt, Human
uccccacuggccagcuggaguagaugaaguuc

SEQ ID NO: 234025 - RNA, 32 nt, Human
uccccacugggggucuuccuccaccucccacu

SEQ ID NO: 234026 - RNA, 32 nt, Human
uccccacugucacuaaaaggcuuuuuacauuu

SEQ ID NO: 234027 - RNA, 18 nt, Human
uccccacugucagcaccu

SEQ ID NO: 234028 - RNA, 32 nt, Human
uccccacugucauucagggccugggucuccag

SEQ ID NO: 234029 - RNA, 32 nt, Human
uccccacuguggucugugcucuucuucauuau

SEQ ID NO: 234030 - RNA, 32 nt, Human
uccccacuuccuccugacaacccaggcacagc

SEQ ID NO: 234031 - RNA, 32 nt, Human
uccccacuuucuccuuuuccuuccuuccuggc

SEQ ID NO: 234032 - RNA, 32 nt, Human
uccccacuuucugcuuuccuugcccauguguc

SEQ ID NO: 234033 - RNA, 18 nt, Human
uccccacuuuuccuggcc

SEQ ID NO: 234034 - RNA, 24 nt, Human
uccccacuuuuuuaaaaccagaaa

SEQ ID NO: 234035 - RNA, 32 nt, Human
uccccagaacacugcucgacauggacaccggu

SEQ ID NO: 234036 - RNA, 32 nt, Human
uccccagaacaggcacugagcugaggaaaggc

SEQ ID NO: 234037 - RNA, 32 nt, Human
uccccagaaccagcugcagauggagguuuugu

SEQ ID NO: 234038 - RNA, 32 nt, Human
uccccagaagcagggaccucaggcaggaguac

SEQ ID NO: 234039 - RNA, 32 nt, Human
uccccagaauuugaguuugaggaagaauuuag

SEQ ID NO: 234040 - RNA, 32 nt, Human
uccccagacacauucuccugugccccucagag

SEQ ID NO: 234041 - RNA, 21 nt, Human
uccccagacagguauacuucu

SEQ ID NO: 234042 - RNA, 32 nt, Human
uccccagacaguuucagccagcgcugaggaaa

SEQ ID NO: 234043 - RNA, 32 nt, Human
uccccagaccucacuugccucugccuccaucu

SEQ ID NO: 234044 - RNA, 32 nt, Human
uccccagacgcuggcuugcaagcacagcagca

SEQ ID NO: 234045 - RNA, 32 nt, Human
uccccagacuugccccagcacagcuguggggg

SEQ ID NO: 234046 - RNA, 32 nt, Human
uccccagagaacacauuugucuucugagcugc

SEQ ID NO: 234047 - RNA, 32 nt, Human
uccccagagagggaggagccggugcccggcac

SEQ ID NO: 234048 - RNA, 24 nt, Human
uccccagagcaacagcuggcccag

SEQ ID NO: 234049 - RNA, 19 nt, Human
uccccagagggcucaccuu

SEQ ID NO: 234050 - RNA, 32 nt, Human
uccccagauggaagcuuccuccaaccuucagu

SEQ ID NO: 234051 - RNA, 32 nt, Human
uccccagauggggagacugaggccguggcugu

SEQ ID NO: 234052 - RNA, 32 nt, Human
uccccagauuccagauccaaggauuuggggau

SEQ ID NO: 234053 - RNA, 22 nt, Human
uccccagcaaaucaucgggcca

SEQ ID NO: 234054 - RNA, 32 nt, Human
uccccagcaagggggugcagcccagggucagg

SEQ ID NO: 234055 - RNA, 32 nt, Human
uccccagcaaugcagagcccccauggagggca

SEQ ID NO: 234056 - RNA, 24 nt, Human
uccccagcagaugcauccuggcca

SEQ ID NO: 234057 - RNA, 32 nt, Human
uccccagcagucucacuggacuggguugcuau

SEQ ID NO: 234058 - RNA, 32 nt, Human
uccccagcauugcuugcuccugggcaaacauu

SEQ ID NO: 234059 - RNA, 22 nt, Human
uccccagccacagcacacagga

SEQ ID NO: 234060 - RNA, 32 nt, Human
uccccagccagccucacucugucuccggcccg

SEQ ID NO: 234061 - RNA, 32 nt, Human
uccccagccaggaccccaggauguagacgccc

SEQ ID NO: 234062 - RNA, 32 nt, Human
uccccagccaucaucucuuacuacggaggccc

SEQ ID NO: 234063 - RNA, 32 nt, Human
uccccagccaugagucaguuugugcccaugaa

SEQ ID NO: 234064 - RNA, 32 nt, Human
uccccagcccaccuggcucacacacagccuca

SEQ ID NO: 234065 - RNA, 32 nt, Human
uccccagcccaccuggcucacacacagccucg

SEQ ID NO: 234066 - RNA, 32 nt, Human
uccccagcccagacauugagaaacuugggaag

SEQ ID NO: 234067 - RNA, 32 nt, Human
uccccagcccagacucuagcucccucuggcug

SEQ ID NO: 234068 - RNA, 32 nt, Human
uccccagcccaggagaggcugcggagccgcag

SEQ ID NO: 234069 - RNA, 32 nt, Human
uccccagcccaggagguggcuggauugcaggg

SEQ ID NO: 234070 - RNA, 32 nt, Human
uccccagccccaucccaaacccuucagugcca

SEQ ID NO: 234071 - RNA, 18 nt, Human
uccccagcccccucagag

SEQ ID NO: 234072 - RNA, 32 nt, Human
uccccagcccgcucccccucucugugcccugg

SEQ ID NO: 234073 - RNA, 21 nt, Human
uccccagcccugaaggccaag

SEQ ID NO: 234074 - RNA, 32 nt, Human
uccccagcccuggguuucuccgucuucaagac

SEQ ID NO: 234075 - RNA, 32 nt, Human
uccccagcccuuccagcuugggaacucauggg

SEQ ID NO: 234076 - RNA, 18 nt, Human
uccccagcccuuugcagg

SEQ ID NO: 234077 - RNA, 32 nt, Human
uccccagccucagccccagccccagccccagu

SEQ ID NO: 234078 - RNA, 32 nt, Human
uccccagccuccaacucaucaccucucaggcc

SEQ ID NO: 234079 - RNA, 32 nt, Human
uccccagccugcacuccugggcgaaggcugac

SEQ ID NO: 234080 - RNA, 32 nt, Human
uccccagccugcagagaacuccauguuaguac

SEQ ID NO: 234081 - RNA, 32 nt, Human
uccccagccugcuccuagcccagaggcucuaa

SEQ ID NO: 234082 - RNA, 32 nt, Human
uccccagccugggaaagccccugccccuccuc

SEQ ID NO: 234083 - RNA, 32 nt, Human
uccccagccugggaagaugucucacuguccac

SEQ ID NO: 234084 - RNA, 32 nt, Human
uccccagccuggugucccgcagucccaggaag

SEQ ID NO: 234085 - RNA, 32 nt, Human
uccccagccuuccucuggaggcugcggaaaua

SEQ ID NO: 234086 - RNA, 32 nt, Human
uccccagccuucuuucucucccagaagccuca

SEQ ID NO: 234087 - RNA, 32 nt, Human
uccccagcgagauacuuaccacucucucuucu

SEQ ID NO: 234088 - RNA, 32 nt, Human
uccccagcgccccaccaccaccacgugcaggu

SEQ ID NO: 234089 - RNA, 32 nt, Human
uccccagcgcucgcaggaaggaagaagggagc

SEQ ID NO: 234090 - RNA, 32 nt, Human
uccccagcggcuccuggccagcuccccacgga

SEQ ID NO: 234091 - RNA, 25 nt, Human
uccccagcguggccucacugucuuc

SEQ ID NO: 234092 - RNA, 32 nt, Human
uccccagcuacacuaugccugcagagagcggu

SEQ ID NO: 234093 - RNA, 32 nt, Human
uccccagcucaagugauccucccaccucagcc

SEQ ID NO: 234094 - RNA, 32 nt, Human
uccccagcucacugcgccccuuuuccagcccg

SEQ ID NO: 234095 - RNA, 19 nt, Human
uccccagcuccaucccaca

SEQ ID NO: 234096 - RNA, 32 nt, Human
uccccagcucgccucccugccugugcuggccu

SEQ ID NO: 234097 - RNA, 32 nt, Human
uccccagcucuacaaaccaggacagcugaauc

SEQ ID NO: 234098 - RNA, 32 nt, Human
uccccagcugcuccgagagaucaaaggacaca

SEQ ID NO: 234099 - RNA, 32 nt, Human
uccccagcuguccuccccuuggugcuccucuu

SEQ ID NO: 234100 - RNA, 32 nt, Human
uccccagcugucucccugaggcuccgcccugg

SEQ ID NO: 234101 - RNA, 32 nt, Human
uccccaggaaaugaucuuccacuugagcaacc

SEQ ID NO: 234102 - RNA, 32 nt, Human
uccccaggaagaugugggggaggcucuggccc

SEQ ID NO: 234103 - RNA, 32 nt, Human
uccccaggaccuggaugacacccgccucacug

SEQ ID NO: 234104 - RNA, 32 nt, Human
uccccaggagcagaagagaguggggccugccc

SEQ ID NO: 234105 - RNA, 32 nt, Human
uccccaggagccaggggucagggaggaggcug

SEQ ID NO: 234106 - RNA, 32 nt, Human
uccccaggagccaguccucugcucgucugcag

SEQ ID NO: 234107 - RNA, 21 nt, Human
uccccaggagccucugccuca

SEQ ID NO: 234108 - RNA, 32 nt, Human
uccccaggaggccaugguuagguuaucuccaa

SEQ ID NO: 234109 - RNA, 32 nt, Human
uccccaggaucacugggcaaugccggaaagag

SEQ ID NO: 234110 - RNA, 32 nt, Human
uccccaggaucacugggcaaugcuggaaagag

SEQ ID NO: 234111 - RNA, 32 nt, Human
uccccaggcaacacugauaguaccaaaagcug

SEQ ID NO: 234112 - RNA, 23 nt, Human
uccccaggcagcucgccuggcca

SEQ ID NO: 234113 - RNA, 32 nt, Human
uccccaggcaggaugugccaggagaacugcuc

SEQ ID NO: 234114 - RNA, 32 nt, Human
uccccaggcaggcaggaggccgcggggagcac

SEQ ID NO: 234115 - RNA, 32 nt, Human
uccccaggcagugcaugcugggagggaggaug

SEQ ID NO: 234116 - RNA, 32 nt, Human
uccccaggcaguucccaugcaggugauccacg

SEQ ID NO: 234117 - RNA, 32 nt, Human
uccccaggcaucaucccuaccucugcaggcuc

SEQ ID NO: 234118 - RNA, 32 nt, Human
uccccaggccaagaugggcaggugucacaaag

SEQ ID NO: 234119 - RNA, 23 nt, Human
uccccaggccauucugggaccua

SEQ ID NO: 234120 - RNA, 32 nt, Human
uccccaggccccggacaaagagcccagaggcc

SEQ ID NO: 234121 - RNA, 21 nt, Human
uccccaggcccguggucccua

SEQ ID NO: 234122 - RNA, 19 nt, Human
uccccaggcccugugaccu

SEQ ID NO: 234123 - RNA, 22 nt, Human
uccccaggccggagugcagugg

SEQ ID NO: 234124 - RNA, 31 nt, Human
uccccaggccucucugccugaaucugccucu

SEQ ID NO: 234125 - RNA, 23 nt, Human
uccccaggccucugccagccucu

SEQ ID NO: 234126 - RNA, 32 nt, Human
uccccaggcgcucacauguucauuccaauggc

SEQ ID NO: 234127 - RNA, 32 nt, Human
uccccaggcguuuucuguguucagaaguagua

SEQ ID NO: 234128 - RNA, 19 nt, Human
uccccaggcuccagcuggg

SEQ ID NO: 234129 - RNA, 32 nt, Human
uccccaggcugaucuugaacuccugggcucaa

SEQ ID NO: 234130 - RNA, 32 nt, Human
uccccaggcugcaucggccugccuguguuucc

SEQ ID NO: 234131 - RNA, 18 nt, Human
uccccaggcuggagugca

SEQ ID NO: 234132 - RNA, 20 nt, Human
uccccaggcuggagugcaau

SEQ ID NO: 234133 - RNA, 21 nt, Human
uccccaggcuggagugcaaug

SEQ ID NO: 234134 - RNA, 22 nt, Human
uccccaggcuggagugcaaugg

SEQ ID NO: 234135 - RNA, 32 nt, Human
uccccagggaaaggagaaaagagaaaacaggc

SEQ ID NO: 234136 - RNA, 32 nt, Human
uccccagggaagcagagugcaagagcagaaga

SEQ ID NO: 234137 - RNA, 32 nt, Human
uccccagggagggcucgaaggaagugcaggga

SEQ ID NO: 234138 - RNA, 32 nt, Human
uccccagggcaggccccuggauggacgcggcg

SEQ ID NO: 234139 - RNA, 32 nt, Human
uccccagggcccggcaccuccugcugcgagac

SEQ ID NO: 234140 - RNA, 32 nt, Human
uccccagggccugaaaccuacuccaccuuccu

SEQ ID NO: 234141 - RNA, 25 nt, Human
uccccagggccuuuuccuccucugc

SEQ ID NO: 234142 - RNA, 32 nt, Human
uccccaggggagagggucuggagaagcaguga

SEQ ID NO: 234143 - RNA, 32 nt, Human
uccccaggggguacucuggagugagcaguccc

SEQ ID NO: 234144 - RNA, 32 nt, Human
uccccagggguguacgguauuucuugacucug

SEQ ID NO: 234145 - RNA, 23 nt, Human
uccccagggugagcacaggaccu

SEQ ID NO: 234146 - RNA, 32 nt, Human
uccccagggugggagagcggcuccgcggccac

SEQ ID NO: 234147 - RNA, 32 nt, Human
uccccagggugggggugccaggagcccuuguc

SEQ ID NO: 234148 - RNA, 32 nt, Human
uccccagguagaagacuuucuccuucuuaaaa

SEQ ID NO: 234149 - RNA, 32 nt, Human
uccccagguagggagagccagaggugccagcc

SEQ ID NO: 234150 - RNA, 32 nt, Human
uccccagguccccaguggggcagcccucccca

SEQ ID NO: 234151 - RNA, 32 nt, Human
uccccaggugagugguaaccaccagaaguggc

SEQ ID NO: 234152 - RNA, 32 nt, Human
uccccaggugcuggguccaugcuguuugaacc

SEQ ID NO: 234153 - RNA, 32 nt, Human
uccccaguaccuucaguuccaggauuuaaaau

SEQ ID NO: 234154 - RNA, 32 nt, Human
uccccaguagagcugggacuacagguaugcgc

SEQ ID NO: 234155 - RNA, 32 nt, Human
uccccaguagcaucugccaagaagggugcuga

SEQ ID NO: 234156 - RNA, 20 nt, Human
uccccagucaccucuucugc

SEQ ID NO: 234157 - RNA, 32 nt, Human
uccccaguccaggacaaccauuaguccugaug

SEQ ID NO: 234158 - RNA, 32 nt, Human
uccccagucgagcccuccucccuuccccugcc

SEQ ID NO: 234159 - RNA, 32 nt, Human
uccccagucuucgccuuccucuuuuuaagcug

SEQ ID NO: 234160 - RNA, 32 nt, Human
uccccagugaaaaggcaagacgaucaaucaag

SEQ ID NO: 234161 - RNA, 28 nt, Human
uccccagugaaagcugccucauucuuuu

SEQ ID NO: 234162 - RNA, 32 nt, Human
uccccaguggaggcucugaaaggucuggugga

SEQ ID NO: 234163 - RNA, 32 nt, Human
uccccaguggggcagggugagcaggggcuucc

SEQ ID NO: 234164 - RNA, 32 nt, Human
uccccagugucugggagcaucuggcuuccucu

SEQ ID NO: 234165 - RNA, 32 nt, Human
uccccaguucaagcgauucuccugccucagcc

SEQ ID NO: 234166 - RNA, 32 nt, Human
uccccaguucacacgauucuccugccucagcc

SEQ ID NO: 234167 - RNA, 32 nt, Human
uccccaguucauggaaaaugauccucauggga

SEQ ID NO: 234168 - RNA, 32 nt, Human
uccccaguuccccagcccugcugugacuucca

SEQ ID NO: 234169 - RNA, 32 nt, Human
uccccaguucucuccagcuuucccugcagcug

SEQ ID NO: 234170 - RNA, 32 nt, Human
uccccaguuuuaaacuccuaucuuuuucuuua

SEQ ID NO: 234171 - RNA, 24 nt, Human
uccccauaaggagagacccugaca

SEQ ID NO: 234172 - RNA, 18 nt, Human
uccccauacaguagccug

SEQ ID NO: 234173 - RNA, 32 nt, Human
uccccauaccaaagugcugacaggcccuccgu

SEQ ID NO: 234174 - RNA, 32 nt, Human
uccccauauaagugagaaugaacaguauuucu

SEQ ID NO: 234175 - RNA, 32 nt, Human
uccccauauaagugagaaugagcaguauuucu

SEQ ID NO: 234176 - RNA, 32 nt, Human
uccccauaucuucucucccccaccuuuaucga

SEQ ID NO: 234177 - RNA, 32 nt, Human
uccccauaugccacccuucccccaaagcugau

SEQ ID NO: 234178 - RNA, 32 nt, Human
uccccaucaaggccagccugggaacauggagu

SEQ ID NO: 234179 - RNA, 32 nt, Human
uccccaucagcacagugggcucugccugugac

SEQ ID NO: 234180 - RNA, 22 nt, Human
uccccaucaguguggccugcca

SEQ ID NO: 234181 - RNA, 32 nt, Human
uccccaucaucucuucccagcaucaauacuuu

SEQ ID NO: 234182 - RNA, 32 nt, Human
uccccauccaagugucaucuugaauucccaca

SEQ ID NO: 234183 - RNA, 32 nt, Human
uccccauccauggcccgagggggaaccuggug

SEQ ID NO: 234184 - RNA, 23 nt, Human
uccccaucccccgugucucucac

SEQ ID NO: 234185 - RNA, 32 nt, Human
uccccaucccggcaagggaggaagggacgccc

SEQ ID NO: 234186 - RNA, 32 nt, Human
uccccauccuagguauggaacagaucaaacca

SEQ ID NO: 234187 - RNA, 32 nt, Human
uccccauccuccauccccgucucccaucgccg

SEQ ID NO: 234188 - RNA, 32 nt, Human
uccccaucuccuggcccuucugauucuggucc

SEQ ID NO: 234189 - RNA, 20 nt, Human
uccccaucuccuugagucag

SEQ ID NO: 234190 - RNA, 32 nt, Human
uccccaucucuucuccuuuguaccugucaaca

SEQ ID NO: 234191 - RNA, 32 nt, Human
uccccaucugaagaauggggacaggaaaggau

SEQ ID NO: 234192 - RNA, 32 nt, Human
uccccaucuggcugguuccauuuccuuggcuc

SEQ ID NO: 234193 - RNA, 32 nt, Human
uccccaucuuggcugcuguccugccucugacc

SEQ ID NO: 234194 - RNA, 21 nt, Human
uccccaugaccccguguggcc

SEQ ID NO: 234195 - RNA, 20 nt, Human
uccccaugacccuccaccug

SEQ ID NO: 234196 - RNA, 32 nt, Human
uccccaugagcagagucuguccucugcucuuc

SEQ ID NO: 234197 - RNA, 19 nt, Human
uccccaugauguugugacc

SEQ ID NO: 234198 - RNA, 32 nt, Human
uccccaugcaccuugcucacacacccaauccc

SEQ ID NO: 234199 - RNA, 21 nt, Human
uccccaugccccuguguccug

SEQ ID NO: 234200 - RNA, 32 nt, Human
uccccaugcgcacacacauacacacaccccaa

SEQ ID NO: 234201 - RNA, 20 nt, Human
uccccaugcugcccaugacc

SEQ ID NO: 234202 - RNA, 32 nt, Human
uccccaugcugcucauccuccugggccccauc

SEQ ID NO: 234203 - RNA, 32 nt, Human
uccccaugcuguucccugcacuguuccccaug

SEQ ID NO: 234204 - RNA, 22 nt, Human
uccccauggaugaccgcaaccu

SEQ ID NO: 234205 - RNA, 32 nt, Human
uccccauggccacagcugagugccccagggag

SEQ ID NO: 234206 - RNA, 22 nt, Human
uccccaugggugggggaaccug

SEQ ID NO: 234207 - RNA, 24 nt, Human
uccccauggguuguggaaggguug

SEQ ID NO: 234208 - RNA, 20 nt, Human
uccccaugguaacugaucug

SEQ ID NO: 234209 - RNA, 23 nt, Human
uccccaugguacgucccacccug

SEQ ID NO: 234210 - RNA, 22 nt, Human
uccccauggugaagucaggccu

SEQ ID NO: 234211 - RNA, 20 nt, Human
uccccauggugaauguuacc

SEQ ID NO: 234212 - RNA, 32 nt, Human
uccccaugguuuccagcucaauccaccccuga

SEQ ID NO: 234213 - RNA, 32 nt, Human
uccccauguacauacaugcacauacucaaaca

SEQ ID NO: 234214 - RNA, 32 nt, Human
uccccauguagaagcuggaagcugcugaguuu

SEQ ID NO: 234215 - RNA, 32 nt, Human
uccccaugugcugcaucagauucccccaaaua

SEQ ID NO: 234216 - RNA, 32 nt, Human
uccccauuaaacugggugccuggugaggacac

SEQ ID NO: 234217 - RNA, 32 nt, Human
uccccauucacagagccuuuuucacaauucca

SEQ ID NO: 234218 - RNA, 23 nt, Human
uccccauucccagggccccucca

SEQ ID NO: 234219 - RNA, 32 nt, Human
uccccauuccuagcagggccugaggcccuccu

SEQ ID NO: 234220 - RNA, 24 nt, Human
uccccauuccucccuccugccaca

SEQ ID NO: 234221 - RNA, 32 nt, Human
uccccauucgaggccuucacagugucacccac

SEQ ID NO: 234222 - RNA, 32 nt, Human
uccccauucucuccuuucaccaucucuccucu

SEQ ID NO: 234223 - RNA, 18 nt, Human
uccccauucugugugcug

SEQ ID NO: 234224 - RNA, 26 nt, Human
uccccauucuugaaagcugcuggggc

SEQ ID NO: 234225 - RNA, 32 nt, Human
uccccauugggaacagggugauugaggaaagu

SEQ ID NO: 234226 - RNA, 32 nt, Human
uccccauugguggaccaggugcucugaggcug

SEQ ID NO: 234227 - RNA, 32 nt, Human
uccccauuguagauuagucucuucucacuaaa

SEQ ID NO: 234228 - RNA, 32 nt, Human
uccccauuuccagaugggaggccacuguccag

SEQ ID NO: 234229 - RNA, 32 nt, Human
uccccauuuuacaaccaaggcaucuaaagcaa

SEQ ID NO: 234230 - RNA, 32 nt, Human
ucccccaaaggguguccguucuuaauucccac

SEQ ID NO: 234231 - RNA, 32 nt, Human
ucccccaacauacacacacuucauacaccaca

SEQ ID NO: 234232 - RNA, 32 nt, Human
ucccccaaccagagauccaaggccugugggcc

SEQ ID NO: 234233 - RNA, 32 nt, Human
ucccccaaccucccccuccuguccccucuguu

SEQ ID NO: 234234 - RNA, 32 nt, Human
ucccccaacgcaucccagccagugccaugucc

SEQ ID NO: 234235 - RNA, 32 nt, Human
ucccccaacucuuaugcacagaacacaggcag

SEQ ID NO: 234236 - RNA, 32 nt, Human
ucccccaacucuugaacgaugaugauauucag

SEQ ID NO: 234237 - RNA, 32 nt, Human
ucccccaagacuugaauggcuugagugggacu

SEQ ID NO: 234238 - RNA, 19 nt, Human
ucccccaagaggccagugg

SEQ ID NO: 234239 - RNA, 32 nt, Human
ucccccaagcacuguguucuggcucggcccaa

SEQ ID NO: 234240 - RNA, 22 nt, Human
ucccccaagcuggaguacaaug

SEQ ID NO: 234241 - RNA, 22 nt, Human
ucccccaagggcccccucuaag

SEQ ID NO: 234242 - RNA, 23 nt, Human
ucccccaaucccugcugggcugc

SEQ ID NO: 234243 - RNA, 32 nt, Human
ucccccacaauacaacauugggcugcugaacc

SEQ ID NO: 234244 - RNA, 32 nt, Human
ucccccacagccucuuccucccuucccucccc

SEQ ID NO: 234245 - RNA, 32 nt, Human
ucccccacaggcaugucaaggagagaaccugc

SEQ ID NO: 234246 - RNA, 32 nt, Human
ucccccacauccuccccugaguccggagcuac

SEQ ID NO: 234247 - RNA, 32 nt, Human
ucccccacccacccauucccgcccuuugcagc

SEQ ID NO: 234248 - RNA, 32 nt, Human
ucccccaccccacaggugguguugggacaccu

SEQ ID NO: 234249 - RNA, 32 nt, Human
ucccccaccccaccaccucggcccagcgcccc

SEQ ID NO: 234250 - RNA, 32 nt, Human
ucccccaccccgaggccuggguagggacaggg

SEQ ID NO: 234251 - RNA, 32 nt, Human
ucccccacccucucuccuccccaacccuucag

SEQ ID NO: 234252 - RNA, 32 nt, Human
ucccccacccugacccucccauggcccucucc

SEQ ID NO: 234253 - RNA, 32 nt, Human
ucccccacccuuguuccaguuguuaguuacua

SEQ ID NO: 234254 - RNA, 32 nt, Human
ucccccaccgcaaccuccaucucccggguuca

SEQ ID NO: 234255 - RNA, 32 nt, Human
ucccccaccgccgccucggagcucagcacacc

SEQ ID NO: 234256 - RNA, 25 nt, Human
ucccccaccucagccagugagucag

SEQ ID NO: 234257 - RNA, 32 nt, Human
ucccccaccucuccacuaguuggaccaagguu

SEQ ID NO: 234258 - RNA, 32 nt, Human
ucccccaccugggucugugcccugccccgcgc

SEQ ID NO: 234259 - RNA, 32 nt, Human
ucccccaccuuucaccagagaagaggacguug

SEQ ID NO: 234260 - RNA, 32 nt, Human
ucccccaccuuugccugcuguugcuggaagag

SEQ ID NO: 234261 - RNA, 32 nt, Human
ucccccacuacugcagcaccuccaggccuguu

SEQ ID NO: 234262 - RNA, 32 nt, Human
ucccccacucaggccucuggaagguccaggga

SEQ ID NO: 234263 - RNA, 32 nt, Human
ucccccacugucugggacacaggacagguguu

SEQ ID NO: 234264 - RNA, 32 nt, Human
ucccccagaagaacuggagaaauaccagcaaa

SEQ ID NO: 234265 - RNA, 32 nt, Human
ucccccagaaggaaugcagccucucugacacc

SEQ ID NO: 234266 - RNA, 18 nt, Human
ucccccagaccccuccca

SEQ ID NO: 234267 - RNA, 32 nt, Human
ucccccagaccccuccugggcaggcaggugcc

SEQ ID NO: 234268 - RNA, 32 nt, Human
ucccccagacuggacagggaaucucagcuuuc

SEQ ID NO: 234269 - RNA, 32 nt, Human
ucccccagacuggagugcaauggcacgaucuc

SEQ ID NO: 234270 - RNA, 32 nt, Human
ucccccagauccaagccugggggaucccggga

SEQ ID NO: 234271 - RNA, 32 nt, Human
ucccccagauucugauucuacagcugcagaau

SEQ ID NO: 234272 - RNA, 32 nt, Human
ucccccagcacacacacauacaacacagauca

SEQ ID NO: 234273 - RNA, 32 nt, Human
ucccccagcagagccacacagccuucgugaca

SEQ ID NO: 234274 - RNA, 32 nt, Human
ucccccagcccaaacagccuugguucaucagu

SEQ ID NO: 234275 - RNA, 32 nt, Human
ucccccagccugacacccguaaagcgucugug

SEQ ID NO: 234276 - RNA, 32 nt, Human
ucccccagccugacacccguaaagggucugug

SEQ ID NO: 234277 - RNA, 32 nt, Human
ucccccagccugacaucagggacagaccacac

SEQ ID NO: 234278 - RNA, 32 nt, Human
ucccccagcgcugaagcacgggguucagcggc

SEQ ID NO: 234279 - RNA, 23 nt, Human
ucccccaggagcccaaaaccaca

SEQ ID NO: 234280 - RNA, 32 nt, Human
ucccccaggcagcagcugugugauucaucacc

SEQ ID NO: 234281 - RNA, 22 nt, Human
ucccccaggcuggagugcagug

SEQ ID NO: 234282 - RNA, 32 nt, Human
ucccccaggcuggagugcaguggcacaaugac

SEQ ID NO: 234283 - RNA, 32 nt, Human
ucccccaggcuggagugcaguggcgcgaucuu

SEQ ID NO: 234284 - RNA, 32 nt, Human
ucccccaggcuggagugcagugguacaagcac

SEQ ID NO: 234285 - RNA, 32 nt, Human
ucccccaggcuggagugcaguggugcgaucuc

SEQ ID NO: 234286 - RNA, 32 nt, Human
ucccccaggcuggagugccguggcgugaucuc

SEQ ID NO: 234287 - RNA, 22 nt, Human
ucccccaggcuggaguguagug

SEQ ID NO: 234288 - RNA, 23 nt, Human
ucccccaggcuggaguguagugg

SEQ ID NO: 234289 - RNA, 32 nt, Human
ucccccaggcuggcgugcaguagcaugaucuu

SEQ ID NO: 234290 - RNA, 32 nt, Human
ucccccaggcugguggccgagcugcagggcgc

SEQ ID NO: 234291 - RNA, 22 nt, Human
ucccccaggcuugagugcaaug

SEQ ID NO: 234292 - RNA, 32 nt, Human
ucccccagggcugaggaccccuccaggccccu

SEQ ID NO: 234293 - RNA, 32 nt, Human
ucccccagggucuugcucugucacccaggcug

SEQ ID NO: 234294 - RNA, 32 nt, Human
ucccccagugcugaucuugcugggccuuagcu

SEQ ID NO: 234295 - RNA, 32 nt, Human
ucccccaguuguucucauaguaaugaguucuc

SEQ ID NO: 234296 - RNA, 25 nt, Human
ucccccauagcaccaccgugcuggc

SEQ ID NO: 234297 - RNA, 32 nt, Human
ucccccauccacuccuguucccuuccucucuu

SEQ ID NO: 234298 - RNA, 32 nt, Human
ucccccauccccauccuccagcuucugguacu

SEQ ID NO: 234299 - RNA, 32 nt, Human
ucccccaucuccucaaauggucaauuuucuga

SEQ ID NO: 234300 - RNA, 32 nt, Human
ucccccaucuucuucuuccuccuccgucuccu

SEQ ID NO: 234301 - RNA, 32 nt, Human
ucccccaugaccuccucccacccucccccugc

SEQ ID NO: 234302 - RNA, 32 nt, Human
ucccccaugccaccacccaccccaaacuucca

SEQ ID NO: 234303 - RNA, 32 nt, Human
ucccccaugcccagguguggugaagugaaucc

SEQ ID NO: 234304 - RNA, 32 nt, Human
ucccccauguggauauuucuuauacuaauugu

SEQ ID NO: 234305 - RNA, 32 nt, Human
ucccccauuagacaccugcuccuccaagccug

SEQ ID NO: 234306 - RNA, 32 nt, Human
ucccccauuccuucuuuugggcucuagaaagu

SEQ ID NO: 234307 - RNA, 32 nt, Human
ucccccauucucccugcauccuuguccuugca

SEQ ID NO: 234308 - RNA, 32 nt, Human
ucccccauuguguuaagaacccagcaacccag

SEQ ID NO: 234309 - RNA, 19 nt, Human
uccccccaaaccccucuca

SEQ ID NO: 234310 - RNA, 17 nt, Human
uccccccaaccuccuca

SEQ ID NO: 234311 - RNA, 23 nt, Human
uccccccaaggcuugcugaccca

SEQ ID NO: 234312 - RNA, 17 nt, Human
uccccccacacugcuca

SEQ ID NO: 234313 - RNA, 21 nt, Human
uccccccaccccagggaugga

SEQ ID NO: 234314 - RNA, 18 nt, Human
uccccccacccgcugccu

SEQ ID NO: 234315 - RNA, 18 nt, Human
uccccccacggccccuca

SEQ ID NO: 234316 - RNA, 22 nt, Human
uccccccgccagcuccaucccc

SEQ ID NO: 234317 - RNA, 21 nt, Human
uccccccgccccacccgcccc

SEQ ID NO: 234318 - RNA, 32 nt, Human
ucccccgaccaccuccuccucugccucaaaga

SEQ ID NO: 234319 - RNA, 32 nt, Human
ucccccgaccgcacuccagccugggcgacaga

SEQ ID NO: 234320 - RNA, 32 nt, Human
ucccccgaguagcugggauuacagaugcccac

SEQ ID NO: 234321 - RNA, 32 nt, Human
ucccccgauuagcuggaauuacaggugccugc

SEQ ID NO: 234322 - RNA, 32 nt, Human
ucccccgcaggccucccuccccugugacuccc

SEQ ID NO: 234323 - RNA, 32 nt, Human
ucccccgccccaggcccuuccccaccgagacg

SEQ ID NO: 234324 - RNA, 32 nt, Human
ucccccggcaggcggcgcucagcuggacacug

SEQ ID NO: 234325 - RNA, 32 nt, Human
ucccccggccuggguggggagagcgagcuggg

SEQ ID NO: 234326 - RNA, 22 nt, Human
ucccccggcuucccucuucugu

SEQ ID NO: 234327 - RNA, 32 nt, Human
ucccccgggcagcuccagggauguggccucau

SEQ ID NO: 234328 - RNA, 32 nt, Human
ucccccggggcagcggcugagccccagccggg

SEQ ID NO: 234329 - RNA, 32 nt, Human
ucccccggucugagagaggggaggccgagcag

SEQ ID NO: 234330 - RNA, 32 nt, Human
ucccccgguguugggcagguucugagcugccc

SEQ ID NO: 234331 - RNA, 32 nt, Human
ucccccuaaagccacagggaugggguaucuuc

SEQ ID NO: 234332 - RNA, 32 nt, Human
ucccccuaacagccuggucaaacugggcuaua

SEQ ID NO: 234333 - RNA, 32 nt, Human
ucccccuacuucuccccaagggccaagaacug

SEQ ID NO: 234334 - RNA, 32 nt, Human
ucccccuagccugccuccccugccucaccagc

SEQ ID NO: 234335 - RNA, 32 nt, Human
ucccccucacccaagggcagugggcaugaauc

SEQ ID NO: 234336 - RNA, 32 nt, Human
ucccccucaggccaccuccuguccucacuccu

SEQ ID NO: 234337 - RNA, 23 nt, Human
ucccccucaucuccagugacuca

SEQ ID NO: 234338 - RNA, 32 nt, Human
ucccccucauuucucuuccuccucaccuccac

SEQ ID NO: 234339 - RNA, 32 nt, Human
ucccccuccagccucccacuugguagcaccuu

SEQ ID NO: 234340 - RNA, 32 nt, Human
ucccccuccaucucucagggagacaaagaacc

SEQ ID NO: 234341 - RNA, 32 nt, Human
ucccccuccaugguuuccccaggauaugaguu

SEQ ID NO: 234342 - RNA, 32 nt, Human
ucccccucccacaggacgcccccacacagcug

SEQ ID NO: 234343 - RNA, 32 nt, Human
ucccccucccccagccacuccccagccagccu

SEQ ID NO: 234344 - RNA, 32 nt, Human
ucccccucccccagcucagaccacagaggugg

SEQ ID NO: 234345 - RNA, 32 nt, Human
ucccccuccccucccccuccccaacucagauc

SEQ ID NO: 234346 - RNA, 32 nt, Human
ucccccucccuacagagagaugcugucccgug

SEQ ID NO: 234347 - RNA, 32 nt, Human
ucccccucccucauccucccaucccaguaaac

SEQ ID NO: 234348 - RNA, 31 nt, Human
ucccccuccuacucugggccucaguuucccu

SEQ ID NO: 234349 - RNA, 32 nt, Human
ucccccuccuacucugggccucaguuucccua

SEQ ID NO: 234350 - RNA, 32 nt, Human
ucccccuccuccaccccagccugcugcugcua

SEQ ID NO: 234351 - RNA, 32 nt, Human
ucccccuccucccccuccuuuccgucuucccu

SEQ ID NO: 234352 - RNA, 32 nt, Human
ucccccuccucuucucccuccucucuccucuu

SEQ ID NO: 234353 - RNA, 32 nt, Human
ucccccuccuucccccucuccccauuguauuu

SEQ ID NO: 234354 - RNA, 22 nt, Human
ucccccuccuucucucuccugc

SEQ ID NO: 234355 - RNA, 32 nt, Human
ucccccucggaggcggcgggcggaggcggcgg

SEQ ID NO: 234356 - RNA, 32 nt, Human
ucccccucggccgccuccacgacccggaguag

SEQ ID NO: 234357 - RNA, 32 nt, Human
ucccccucgguguuugcaugcgccccggcccu

SEQ ID NO: 234358 - RNA, 32 nt, Human
ucccccucgguuuuauccauuuccuugccucc

SEQ ID NO: 234359 - RNA, 32 nt, Human
ucccccucuccucucccccagguuggggcugg

SEQ ID NO: 234360 - RNA, 32 nt, Human
ucccccucucuuccaauauccaugucucauac

SEQ ID NO: 234361 - RNA, 32 nt, Human
ucccccucuggccguguucccuccccggcuca

SEQ ID NO: 234362 - RNA, 32 nt, Human
ucccccucuggcuccagcuggccgggagccug

SEQ ID NO: 234363 - RNA, 32 nt, Human
ucccccugcaacuuccgcugaggggucucgga

SEQ ID NO: 234364 - RNA, 32 nt, Human
ucccccugcacagacaugagaccauaggggac

SEQ ID NO: 234365 - RNA, 32 nt, Human
ucccccugcagcuacucuucagaucuggcucu

SEQ ID NO: 234366 - RNA, 32 nt, Human
ucccccugcauuccugucugggugaagaggag

SEQ ID NO: 234367 - RNA, 32 nt, Human
ucccccugccaagacaaaggguccagaaggcu

SEQ ID NO: 234368 - RNA, 32 nt, Human
ucccccugccgugcccuggccucccacuaacu

SEQ ID NO: 234369 - RNA, 32 nt, Human
ucccccugccuccuccuccuccucgucuuagg

SEQ ID NO: 234370 - RNA, 31 nt, Human
ucccccugccucucuggccucuugucucccc

SEQ ID NO: 234371 - RNA, 31 nt, Human
ucccccugccucuucggcuguguuuucucuu

SEQ ID NO: 234372 - RNA, 32 nt, Human
ucccccugcucaaaggagggguuggcggugca

SEQ ID NO: 234373 - RNA, 25 nt, Human
ucccccuguaagaugcuguaucauu

SEQ ID NO: 234374 - RNA, 32 nt, Human
ucccccuguaggaugaggaaaccagguggcua

SEQ ID NO: 234375 - RNA, 32 nt, Human
ucccccugucccccacccucauggcccaccuc

SEQ ID NO: 234376 - RNA, 32 nt, Human
ucccccugugccagauccuccccuaugcugac

SEQ ID NO: 234377 - RNA, 32 nt, Human
ucccccuguucccagcccuagcugcaccuccc

SEQ ID NO: 234378 - RNA, 32 nt, Human
ucccccuguucuggucccuccuggagcgcccg

SEQ ID NO: 234379 - RNA, 32 nt, Human
ucccccuuaccucccccacccccuuuaucacc

SEQ ID NO: 234380 - RNA, 32 nt, Human
ucccccuucccaaguccauucccacuguaggc

SEQ ID NO: 234381 - RNA, 32 nt, Human
ucccccuucccccuccaacacauacaccgcaa

SEQ ID NO: 234382 - RNA, 32 nt, Human
ucccccuucccuaccucuuucuccuuacugac

SEQ ID NO: 234383 - RNA, 32 nt, Human
ucccccuuccgcccucucccacccucuccucc

SEQ ID NO: 234384 - RNA, 32 nt, Human
ucccccuuccucucccccuuccucucucccuu

SEQ ID NO: 234385 - RNA, 32 nt, Human
ucccccuucuccccaucccggucuccagagac

SEQ ID NO: 234386 - RNA, 32 nt, Human
ucccccuucugagggauggcucugagagggac

SEQ ID NO: 234387 - RNA, 32 nt, Human
ucccccuucugugugucccucucccccaguua

SEQ ID NO: 234388 - RNA, 32 nt, Human
ucccccuucuuacccugucugugaucuugucu

SEQ ID NO: 234389 - RNA, 32 nt, Human
ucccccuugccuggcuccugugguggcaggcu

SEQ ID NO: 234390 - RNA, 16 nt, Human
ucccccuugcuugcca

SEQ ID NO: 234391 - RNA, 32 nt, Human
ucccccuuggucgguggcggagcugcugagcg

SEQ ID NO: 234392 - RNA, 32 nt, Human
ucccccuuguaacccaugugccagaugugugg

SEQ ID NO: 234393 - RNA, 23 nt, Human
ucccccuugucagucagcaccuu

SEQ ID NO: 234394 - RNA, 32 nt, Human
ucccccuuuauuuuccuuuuugcccaauaaau

SEQ ID NO: 234395 - RNA, 32 nt, Human
ucccccuuucaucaguccgauucgcaguuugu

SEQ ID NO: 234396 - RNA, 32 nt, Human
ucccccuuucccauaauucaugacaucaaaac

SEQ ID NO: 234397 - RNA, 32 nt, Human
ucccccuuucguacuucauuuguguucucuua

SEQ ID NO: 234398 - RNA, 32 nt, Human
ucccccuuucucuccagccugacuuggggaga

SEQ ID NO: 234399 - RNA, 32 nt, Human
ucccccuuucuguuguuugcacaugccccucu

SEQ ID NO: 234400 - RNA, 21 nt, Human
ucccccuuuucccuccucugu

SEQ ID NO: 234401 - RNA, 32 nt, Human
uccccgaagacaccugcacccuccaugcggag

SEQ ID NO: 234402 - RNA, 32 nt, Human
uccccgaauuuccucuggugcauggggcauca

SEQ ID NO: 234403 - RNA, 32 nt, Human
uccccgacacccagacagaggcugcagggcug

SEQ ID NO: 234404 - RNA, 32 nt, Human
uccccgagagacaugguuuccaugagcacagu

SEQ ID NO: 234405 - RNA, 32 nt, Human
uccccgagcacuccagccuggcagucagcacc

SEQ ID NO: 234406 - RNA, 32 nt, Human
uccccgaggacaucuuucucugcaaguuuuuc

SEQ ID NO: 234407 - RNA, 32 nt, Human
uccccgaggccggagugcaauggcgugaucuc

SEQ ID NO: 234408 - RNA, 32 nt, Human
uccccgaggcggagguugcacugagccgagau

SEQ ID NO: 234409 - RNA, 32 nt, Human
uccccgagucccgccccgugugcaguguauug

SEQ ID NO: 234410 - RNA, 32 nt, Human
uccccgagugccuguggugcccaagagcuaug

SEQ ID NO: 234411 - RNA, 32 nt, Human
uccccgaucagugugugccuguuuacagcacu

SEQ ID NO: 234412 - RNA, 32 nt, Human
uccccgauccacccaggccuuucuguaaauaa

SEQ ID NO: 234413 - RNA, 32 nt, Human
uccccgauccugggcucccucuugauuaguag

SEQ ID NO: 234414 - RNA, 32 nt, Human
uccccgauggccugggugagggcaggcuggcu

SEQ ID NO: 234415 - RNA, 32 nt, Human
uccccgauguuccucuccugaauucuggauuu

SEQ ID NO: 234416 - RNA, 32 nt, Human
uccccgauucacgccauucuccugccucagcc

SEQ ID NO: 234417 - RNA, 32 nt, Human
uccccgauucaucuacccugcugaccucccag

SEQ ID NO: 234418 - RNA, 23 nt, Human
uccccgauucugugccuggccua

SEQ ID NO: 234419 - RNA, 26 nt, Human
uccccgcaacccaccucggggaucug

SEQ ID NO: 234420 - RNA, 32 nt, Human
uccccgcacccaccuccugucucccucccucc

SEQ ID NO: 234421 - RNA, 17 nt, Human
uccccgcacccuggccu

SEQ ID NO: 234422 - RNA, 32 nt, Human
uccccgcagcaugggcaccagccucagcccga

SEQ ID NO: 234423 - RNA, 32 nt, Human
uccccgcagccccugugccggauuucauuucc

SEQ ID NO: 234424 - RNA, 32 nt, Human
uccccgcagggguggagccugagcgaggagcc

SEQ ID NO: 234425 - RNA, 18 nt, Human
uccccgcagucccugccu

SEQ ID NO: 234426 - RNA, 32 nt, Human
uccccgcaguugccuccuucucugccugccug

SEQ ID NO: 234427 - RNA, 32 nt, Human
uccccgcauuguggcaucagugcugcugcuuc

SEQ ID NO: 234428 - RNA, 18 nt, Human
uccccgccaacccugccu

SEQ ID NO: 234429 - RNA, 32 nt, Human
uccccgccaagucccgcaggucucgcagucgc

SEQ ID NO: 234430 - RNA, 32 nt, Human
uccccgccacucagaccuggguggugauaacc

SEQ ID NO: 234431 - RNA, 32 nt, Human
uccccgccagaggcggcggcggcggcggcagc

SEQ ID NO: 234432 - RNA, 18 nt, Human
uccccgccccaccuccca

SEQ ID NO: 234433 - RNA, 20 nt, Human
uccccgccccucccgccgcc

SEQ ID NO: 234434 - RNA, 18 nt, Human
uccccgccccucucccca

SEQ ID NO: 234435 - RNA, 32 nt, Human
uccccgcccuaaaaggaggcagugaggaccag

SEQ ID NO: 234436 - RNA, 19 nt, Human
uccccgcccugccccgccc

SEQ ID NO: 234437 - RNA, 32 nt, Human
uccccgccuaggacaggagcugucuggagcuc

SEQ ID NO: 234438 - RNA, 32 nt, Human
uccccgccucacugcccuucugcccaucucca

SEQ ID NO: 234439 - RNA, 32 nt, Human
uccccgccucagggaaugcacaugccucccca

SEQ ID NO: 234440 - RNA, 32 nt, Human
uccccgccuccaggacagagccucggucugca

SEQ ID NO: 234441 - RNA, 32 nt, Human
uccccgccucccucucugggcagauguguuac

SEQ ID NO: 234442 - RNA, 16 nt, Human
uccccgccucgccgcc

SEQ ID NO: 234443 - RNA, 19 nt, Human
uccccgccucucccugccc

SEQ ID NO: 234444 - RNA, 17 nt, Human
uccccgccucugcgccc

SEQ ID NO: 234445 - RNA, 18 nt, Human
uccccgccugccuggacu

SEQ ID NO: 234446 - RNA, 32 nt, Human
uccccgccugcugcagcuccucccagaaccgc

SEQ ID NO: 234447 - RNA, 32 nt, Human
uccccgccuggcgccugcccuccagggcuggg

SEQ ID NO: 234448 - RNA, 32 nt, Human
uccccgccugggagcucagcuuuccucagaac

SEQ ID NO: 234449 - RNA, 32 nt, Human
uccccgccugggcuccccuugcugcccuugcc

SEQ ID NO: 234450 - RNA, 18 nt, Human
uccccgccuguccugccu

SEQ ID NO: 234451 - RNA, 32 nt, Human
uccccgccuucccucacucuuccucauccugc

SEQ ID NO: 234452 - RNA, 32 nt, Human
uccccgcgcggcgcaucccagccugggcggga

SEQ ID NO: 234453 - RNA, 32 nt, Human
uccccgcgcuuccucuugcuccucgcugcucc

SEQ ID NO: 234454 - RNA, 32 nt, Human
uccccgcggcaggaagagucucucucugccca

SEQ ID NO: 234455 - RNA, 32 nt, Human
uccccgcggggccggugcaggcuguggcugcc

SEQ ID NO: 234456 - RNA, 32 nt, Human
uccccgcuacccccugcaccugaggcccagcg

SEQ ID NO: 234457 - RNA, 32 nt, Human
uccccgcuacccccugcaccugaggcccaggg

SEQ ID NO: 234458 - RNA, 32 nt, Human
uccccgcucagggggagcaggaggacagcugg

SEQ ID NO: 234459 - RNA, 32 nt, Human
uccccgcucagucuuugagcgagcccauuuug

SEQ ID NO: 234460 - RNA, 32 nt, Human
uccccgcucaugucccacaccugccauauuga

SEQ ID NO: 234461 - RNA, 32 nt, Human
uccccgcuccaggagacgcucgagucugcguc

SEQ ID NO: 234462 - RNA, 23 nt, Human
uccccgcucuucccagugaagga

SEQ ID NO: 234463 - RNA, 18 nt, Human
uccccgcugcccugggcu

SEQ ID NO: 234464 - RNA, 32 nt, Human
uccccgcuggcugcuuucuuccugccccugcu

SEQ ID NO: 234465 - RNA, 22 nt, Human
uccccgcugugguuggcagcca

SEQ ID NO: 234466 - RNA, 19 nt, Human
uccccgcuuuccugggccu

SEQ ID NO: 234467 - RNA, 32 nt, Human
uccccgcuuucuuuggaggcagcagcucccgc

SEQ ID NO: 234468 - RNA, 32 nt, Human
uccccgcuuuuucacucccauaccuuuaaugg

SEQ ID NO: 234469 - RNA, 32 nt, Human
uccccggacaagcccaggacacugccuuugcu

SEQ ID NO: 234470 - RNA, 18 nt, Human
uccccggaccccgacccc

SEQ ID NO: 234471 - RNA, 32 nt, Human
uccccggagaggggcagcagugcgggaggggc

SEQ ID NO: 234472 - RNA, 18 nt, Human
uccccggcaccucacucc

SEQ ID NO: 234473 - RNA, 32 nt, Human
uccccggcagugagcuauggacuuucuucccc

SEQ ID NO: 234474 - RNA, 32 nt, Human
uccccggccauguggaacucccagagacagaa

SEQ ID NO: 234475 - RNA, 32 nt, Human
uccccggcccucagaggccuggcacugcggga

SEQ ID NO: 234476 - RNA, 21 nt, Human
uccccggcuccagcccggucc

SEQ ID NO: 234477 - RNA, 32 nt, Human
uccccggcuccggacagcccagggcggccggg

SEQ ID NO: 234478 - RNA, 28 nt, Human
uccccggcuccguggcucuggggcacug

SEQ ID NO: 234479 - RNA, 32 nt, Human
uccccggcugugacacucuacccuccagaacc

SEQ ID NO: 234480 - RNA, 27 nt, Human
uccccggcuucagggcugcggggccug

SEQ ID NO: 234481 - RNA, 32 nt, Human
uccccggcuuucuccccacggagcccagccug

SEQ ID NO: 234482 - RNA, 32 nt, Human
uccccgggagaaacauggccgggagcagcgag

SEQ ID NO: 234483 - RNA, 32 nt, Human
uccccgggagagaggacgaagcgaggagaguu

SEQ ID NO: 234484 - RNA, 21 nt, Human
uccccgggaggcagcuggggc

SEQ ID NO: 234485 - RNA, 23 nt, Human
uccccgggcugcgucgggaccug

SEQ ID NO: 234486 - RNA, 32 nt, Human
uccccggggcgcugugcgucuccaguccggga

SEQ ID NO: 234487 - RNA, 32 nt, Human
uccccggggucugcaagacgccggcucagggc

SEQ ID NO: 234488 - RNA, 32 nt, Human
uccccgggugcgcccaagugaagcgcaugcgc

SEQ ID NO: 234489 - RNA, 32 nt, Human
uccccggugagccucaguuccugggcuggacg

SEQ ID NO: 234490 - RNA, 32 nt, Human
uccccggugcuccuggggcuaaggcuggggcu

SEQ ID NO: 234491 - RNA, 32 nt, Human
uccccgguggaccugcaaggaccugaggaaaa

SEQ ID NO: 234492 - RNA, 32 nt, Human
uccccgguggcgaacccagugacccagggaca

SEQ ID NO: 234493 - RNA, 32 nt, Human
uccccgguucaagugauucuccugccucagac

SEQ ID NO: 234494 - RNA, 32 nt, Human
uccccgguucaagugauucuccugccucagcc

SEQ ID NO: 234495 - RNA, 32 nt, Human
uccccgguugagaaucugucccagaggaacac

SEQ ID NO: 234496 - RNA, 23 nt, Human
uccccgucagacccacugggaga

SEQ ID NO: 234497 - RNA, 32 nt, Human
uccccgucuccucugguuguuucguuuuggcu

SEQ ID NO: 234498 - RNA, 32 nt, Human
uccccgucucugcccugggcuccucuuagcuc

SEQ ID NO: 234499 - RNA, 32 nt, Human
uccccgucucugcuuagcgucugggugagaaa

SEQ ID NO: 234500 - RNA, 20 nt, Human
uccccgucuggacccuccca

SEQ ID NO: 234501 - RNA, 21 nt, Human
uccccgucuuccccuuccugc

SEQ ID NO: 234502 - RNA, 32 nt, Human
uccccgugagugccaagcauacaguaggggcu

SEQ ID NO: 234503 - RNA, 21 nt, Human
uccccguggacccuucgccca

SEQ ID NO: 234504 - RNA, 22 nt, Human
uccccguggcccuacgaucccc

SEQ ID NO: 234505 - RNA, 32 nt, Human
uccccgugggcaagggcuuggcagcagcccug

SEQ ID NO: 234506 - RNA, 32 nt, Human
uccccguguuagccaggauggucucgaucucc

SEQ ID NO: 234507 - RNA, 32 nt, Human
uccccguuccucacuuuucccuuuucauuccc

SEQ ID NO: 234508 - RNA, 32 nt, Human
uccccguuuaauuagcagacaagcagagauau

SEQ ID NO: 234509 - RNA, 32 nt, Human
uccccuaaggggauguuuagcuuaaauugcac

SEQ ID NO: 234510 - RNA, 32 nt, Human
uccccuaagguccuggcccaggccuguccaaa

SEQ ID NO: 234511 - RNA, 32 nt, Human
uccccuaaucauuacuugguaguuauuaaucc

SEQ ID NO: 234512 - RNA, 32 nt, Human
uccccuacacacaccccacaccuucaccccuu

SEQ ID NO: 234513 - RNA, 32 nt, Human
uccccuacaccaacaaagaggaauggcugcaa

SEQ ID NO: 234514 - RNA, 32 nt, Human
uccccuacccccuccucucugccgcaauacag

SEQ ID NO: 234515 - RNA, 32 nt, Human
uccccuacccucuuuucuugccugaauaguac

SEQ ID NO: 234516 - RNA, 32 nt, Human
uccccuacccuucccuccucugucuauugccc

SEQ ID NO: 234517 - RNA, 32 nt, Human
uccccuaccucauguccucucauuugggggau

SEQ ID NO: 234518 - RNA, 32 nt, Human
uccccuaccuuccaggcaaccagugucaaucu

SEQ ID NO: 234519 - RNA, 32 nt, Human
uccccuacgcuuucuuguccuggacuccugca

SEQ ID NO: 234520 - RNA, 20 nt, Human
uccccuacuccaucuucugc

SEQ ID NO: 234521 - RNA, 32 nt, Human
uccccuacuccaucuucugcguucccccaguu

SEQ ID NO: 234522 - RNA, 32 nt, Human
uccccuacucuucaccccuuguuuucaccuau

SEQ ID NO: 234523 - RNA, 32 nt, Human
uccccuaggagcgcuuggccagcugggaaggc

SEQ ID NO: 234524 - RNA, 22 nt, Human
uccccuaggcaggcccugcagg

SEQ ID NO: 234525 - RNA, 24 nt, Human
uccccuaggccgggaaccccuccc

SEQ ID NO: 234526 - RNA, 32 nt, Human
uccccuaggcugcagugcaguggcgcgauugc

SEQ ID NO: 234527 - RNA, 32 nt, Human
uccccuagggcacaugcuggaagcccugggcc

SEQ ID NO: 234528 - RNA, 32 nt, Human
uccccuagggcacaugcuggaagcccugggcu

SEQ ID NO: 234529 - RNA, 32 nt, Human
uccccuaggucacaacucugggaaggauacag

SEQ ID NO: 234530 - RNA, 32 nt, Human
uccccuagugacuaucacaguugacugacagc

SEQ ID NO: 234531 - RNA, 32 nt, Human
uccccuauaaccaacacucaacuacaaauagg

SEQ ID NO: 234532 - RNA, 32 nt, Human
uccccuauaguuaggaggugaacucacacaug

SEQ ID NO: 234533 - RNA, 23 nt, Human
uccccuauuacauacaucuuuca

SEQ ID NO: 234534 - RNA, 32 nt, Human
uccccuauuaccuggugcaaaaugacucauca

SEQ ID NO: 234535 - RNA, 23 nt, Human
uccccuauugagacccacugcuu

SEQ ID NO: 234536 - RNA, 32 nt, Human
uccccuauuuuugcacaggggcagcagauaca

SEQ ID NO: 234537 - RNA, 32 nt, Human
uccccucaaccagguguuuucuuuucagccug

SEQ ID NO: 234538 - RNA, 32 nt, Human
uccccucaauggaaggcaauacacuuagcagg

SEQ ID NO: 234539 - RNA, 32 nt, Human
uccccucaccacccucucgugccccucauuac

SEQ ID NO: 234540 - RNA, 32 nt, Human
uccccucaccacccucugguguccccucauca

SEQ ID NO: 234541 - RNA, 32 nt, Human
uccccucacugcacauggugaagcucccuccc

SEQ ID NO: 234542 - RNA, 32 nt, Human
uccccucacugcacuuuggaccccuggggcca

SEQ ID NO: 234543 - RNA, 32 nt, Human
uccccucagcaauuccugcaaaggguuaaaaa

SEQ ID NO: 234544 - RNA, 32 nt, Human
uccccucagcuagacgcacagacucagcaaua

SEQ ID NO: 234545 - RNA, 32 nt, Human
uccccucaggacccuaccccacccucuuugaa

SEQ ID NO: 234546 - RNA, 32 nt, Human
uccccucaggaggccaccucaggaaggauuuu

SEQ ID NO: 234547 - RNA, 32 nt, Human
uccccucauccccuucucgucuccuuauuguu

SEQ ID NO: 234548 - RNA, 32 nt, Human
uccccucaucuucuccacuacuauccacauga

SEQ ID NO: 234549 - RNA, 32 nt, Human
uccccucauuuagcaaccuccauaccacaagg

SEQ ID NO: 234550 - RNA, 32 nt, Human
uccccuccaagggggcagaaauuccaccagaa

SEQ ID NO: 234551 - RNA, 23 nt, Human
uccccuccaccuguccgcuggca

SEQ ID NO: 234552 - RNA, 32 nt, Human
uccccuccagaacaccagccagggaggggugg

SEQ ID NO: 234553 - RNA, 32 nt, Human
uccccuccagccugggcgacagagugagacuu

SEQ ID NO: 234554 - RNA, 19 nt, Human
uccccuccauggcccugaa

SEQ ID NO: 234555 - RNA, 32 nt, Human
uccccucccaaaccacucuccacagcuuuuua

SEQ ID NO: 234556 - RNA, 18 nt, Human
uccccucccaccuggugc

SEQ ID NO: 234557 - RNA, 32 nt, Human
uccccucccacucugggcucaggcugucccug

SEQ ID NO: 234558 - RNA, 21 nt, Human
uccccucccaucucgugcugg

SEQ ID NO: 234559 - RNA, 24 nt, Human
uccccucccauguggcucgugcug

SEQ ID NO: 234560 - RNA, 32 nt, Human
uccccuccccacccucacccaccugccaugga

SEQ ID NO: 234561 - RNA, 20 nt, Human
uccccuccccaccuccugcc

SEQ ID NO: 234562 - RNA, 19 nt, Human
uccccuccccagacugccu

SEQ ID NO: 234563 - RNA, 32 nt, Human
uccccuccccaggacacucccaggcuuggguu

SEQ ID NO: 234564 - RNA, 21 nt, Human
uccccuccccaucuguguucu

SEQ ID NO: 234565 - RNA, 18 nt, Human
uccccucccccaccugcc

SEQ ID NO: 234566 - RNA, 32 nt, Human
uccccuccccucacuucucccaccugcagagc

SEQ ID NO: 234567 - RNA, 32 nt, Human
uccccuccccuccagcccaccccugcacagcc

SEQ ID NO: 234568 - RNA, 32 nt, Human
uccccuccccuccagggugcccccggcuuucu

SEQ ID NO: 234569 - RNA, 32 nt, Human
uccccuccccuccccuccccuccucuccuggu

SEQ ID NO: 234570 - RNA, 32 nt, Human
uccccuccccuccccucccucuuuuuaguuuu

SEQ ID NO: 234571 - RNA, 32 nt, Human
uccccuccccuccccuccucuccugguauacc

SEQ ID NO: 234572 - RNA, 32 nt, Human
uccccuccccuucuucuccaucuccauucuuu

SEQ ID NO: 234573 - RNA, 19 nt, Human
uccccuccccuuuuguccu

SEQ ID NO: 234574 - RNA, 32 nt, Human
uccccucccuccaguauugcccccucucacuu

SEQ ID NO: 234575 - RNA, 32 nt, Human
uccccucccuccauccccacuuuggcguuugc

SEQ ID NO: 234576 - RNA, 18 nt, Human
uccccucccucccagcca

SEQ ID NO: 234577 - RNA, 32 nt, Human
uccccucccucccucacuuccucccucucccc

SEQ ID NO: 234578 - RNA, 32 nt, Human
uccccucccuccugccugguuccgagcccagg

SEQ ID NO: 234579 - RNA, 32 nt, Human
uccccucccucggaccaaacagugcucaugcu

SEQ ID NO: 234580 - RNA, 32 nt, Human
uccccucccugagauguuccuccugccccagc

SEQ ID NO: 234581 - RNA, 32 nt, Human
uccccucccugccuugguuaauugacucacac

SEQ ID NO: 234582 - RNA, 32 nt, Human
uccccucccuucuccccucuuuccuucugccg

SEQ ID NO: 234583 - RNA, 32 nt, Human
uccccuccguaggagcucacagucuagauuag

SEQ ID NO: 234584 - RNA, 32 nt, Human
uccccuccuaggcucucccuguucccugcagc

SEQ ID NO: 234585 - RNA, 32 nt, Human
uccccuccucaccugcuucccuaccacuccuc

SEQ ID NO: 234586 - RNA, 32 nt, Human
uccccuccuccacucucccccacccccucccc

SEQ ID NO: 234587 - RNA, 32 nt, Human
uccccuccuccccuuuucuuuccuucccaauu

SEQ ID NO: 234588 - RNA, 32 nt, Human
uccccuccuccgugccugucauguccucuaag

SEQ ID NO: 234589 - RNA, 32 nt, Human
uccccuccuccuccucuccaauucgccucccc

SEQ ID NO: 234590 - RNA, 32 nt, Human
uccccuccuccuccuugucacuggccucccac

SEQ ID NO: 234591 - RNA, 32 nt, Human
uccccuccucuccccuccacugucuucuucag

SEQ ID NO: 234592 - RNA, 32 nt, Human
uccccuccucuccccuccccucuccuccgccc

SEQ ID NO: 234593 - RNA, 32 nt, Human
uccccuccucuucacccccagggcagguuguu

SEQ ID NO: 234594 - RNA, 32 nt, Human
uccccuccucuucccucucuccuuccuuuagc

SEQ ID NO: 234595 - RNA, 32 nt, Human
uccccuccugaggcccugucaggguccuuacc

SEQ ID NO: 234596 - RNA, 32 nt, Human
uccccuccugcucucccucccugcccaauaca

SEQ ID NO: 234597 - RNA, 32 nt, Human
uccccuccuggccggcagagggcgcaggagcc

SEQ ID NO: 234598 - RNA, 32 nt, Human
uccccuccuuccugccaaggcuggaggccgcc

SEQ ID NO: 234599 - RNA, 32 nt, Human
uccccuccuuuuccuuccuuccuuccuuuccu

SEQ ID NO: 234600 - RNA, 22 nt, Human
uccccuccuuuucgcaaaugua

SEQ ID NO: 234601 - RNA, 32 nt, Human
uccccucgacaauuuaugaugccaccagcaau

SEQ ID NO: 234602 - RNA, 32 nt, Human
uccccucgacucaagcccuuguccucauuauc

SEQ ID NO: 234603 - RNA, 32 nt, Human
uccccucgcagcgucagugguacgacccuucc

SEQ ID NO: 234604 - RNA, 32 nt, Human
uccccucgccccaggcccugagccugcguccu

SEQ ID NO: 234605 - RNA, 32 nt, Human
uccccucgcuguccugcugugugaauucccag

SEQ ID NO: 234606 - RNA, 31 nt, Human
uccccucggaaacugcuucugcuggaggaua

SEQ ID NO: 234607 - RNA, 32 nt, Human
uccccucuaaugcucacgcucccaacacaagg

SEQ ID NO: 234608 - RNA, 19 nt, Human
uccccucuacaacuccugc

SEQ ID NO: 234609 - RNA, 32 nt, Human
uccccucuaggcagccuccccuccaggcagcc

SEQ ID NO: 234610 - RNA, 32 nt, Human
uccccucuccacccaccccacagcaggccccg

SEQ ID NO: 234611 - RNA, 32 nt, Human
uccccucucccaggcugggcuggcccugggcg

SEQ ID NO: 234612 - RNA, 32 nt, Human
uccccucuccccuucucuuccccgaggcuaug

SEQ ID NO: 234613 - RNA, 32 nt, Human
uccccucucccgggcuccccugcugcauggug

SEQ ID NO: 234614 - RNA, 32 nt, Human
uccccucucccucccuccuucucucuuucuuu

SEQ ID NO: 234615 - RNA, 32 nt, Human
uccccucuccgggcacagcccagauccacccc

SEQ ID NO: 234616 - RNA, 32 nt, Human
uccccucuccguugugcccuggaccucgggca

SEQ ID NO: 234617 - RNA, 32 nt, Human
uccccucuccuccccucucuccuccuuccccc

SEQ ID NO: 234618 - RNA, 32 nt, Human
uccccucucgcucccucuacccucuauccccu

SEQ ID NO: 234619 - RNA, 32 nt, Human
uccccucucucccgccccuccuccucccuuuc

SEQ ID NO: 234620 - RNA, 32 nt, Human
uccccucucucuuguccccaggcacagccuag

SEQ ID NO: 234621 - RNA, 32 nt, Human
uccccucucuuucuaagagaccugaacugggc

SEQ ID NO: 234622 - RNA, 32 nt, Human
uccccucucuuugacccccuuugaggcaucug

SEQ ID NO: 234623 - RNA, 19 nt, Human
uccccucugaaccuccugc

SEQ ID NO: 234624 - RNA, 31 nt, Human
uccccucugaauaaauacccauugaacucug

SEQ ID NO: 234625 - RNA, 32 nt, Human
uccccucugagauucgaucaggggacuggaua

SEQ ID NO: 234626 - RNA, 32 nt, Human
uccccucugaggagccugccugccucacaacu

SEQ ID NO: 234627 - RNA, 32 nt, Human
uccccucugcaaccaaaaauccuugggguccc

SEQ ID NO: 234628 - RNA, 32 nt, Human
uccccucugcaacccccauuuugggaguugac

SEQ ID NO: 234629 - RNA, 32 nt, Human
uccccucugccucugagggcuucaguauugau

SEQ ID NO: 234630 - RNA, 32 nt, Human
uccccucugccuuuuaaacccauccccuccga

SEQ ID NO: 234631 - RNA, 32 nt, Human
uccccucugggaauugggcagcccugggcagu

SEQ ID NO: 234632 - RNA, 32 nt, Human
uccccucugggcagggccaacgggaggcucuu

SEQ ID NO: 234633 - RNA, 20 nt, Human
uccccucuucuaccuccugc

SEQ ID NO: 234634 - RNA, 32 nt, Human
uccccucuucucaugcagaagacagucaugcc

SEQ ID NO: 234635 - RNA, 32 nt, Human
uccccucuucuccuuuauugaucucugcuuuu

SEQ ID NO: 234636 - RNA, 32 nt, Human
uccccucuucuuccuucuaucuccuuccccgg

SEQ ID NO: 234637 - RNA, 32 nt, Human
uccccucuucuuucucuuucuuuucccuuugg

SEQ ID NO: 234638 - RNA, 32 nt, Human
uccccucuucuuucuuuguucucuuucauuaa

SEQ ID NO: 234639 - RNA, 32 nt, Human
uccccucuugaacucagcuggggccaggggcc

SEQ ID NO: 234640 - RNA, 32 nt, Human
uccccucuugcacuuucucuccagucaccaug

SEQ ID NO: 234641 - RNA, 32 nt, Human
uccccucuuggaugguguuugccccucucuca

SEQ ID NO: 234642 - RNA, 32 nt, Human
uccccugaacaaccucuuggaacucuccacau

SEQ ID NO: 234643 - RNA, 32 nt, Human
uccccugaaguccugccaucucuggcuggauu

SEQ ID NO: 234644 - RNA, 32 nt, Human
uccccugaagugcugggauuacaggugugagc

SEQ ID NO: 234645 - RNA, 22 nt, Human
uccccugacaaggcgcuggggc

SEQ ID NO: 234646 - RNA, 19 nt, Human
uccccugacacugcugcau

SEQ ID NO: 234647 - RNA, 23 nt, Human
uccccugaccaaaacuccuuccc

SEQ ID NO: 234648 - RNA, 32 nt, Human
uccccugaccaccacacagcagcugcggcggc

SEQ ID NO: 234649 - RNA, 32 nt, Human
uccccugaccccaagcccggugcucauuccac

SEQ ID NO: 234650 - RNA, 32 nt, Human
uccccugacucccgucuccaucugucacgugg

SEQ ID NO: 234651 - RNA, 21 nt, Human
uccccugacuccuggcucucc

SEQ ID NO: 234652 - RNA, 32 nt, Human
uccccugacuguuccacccaggaggaggaaac

SEQ ID NO: 234653 - RNA, 32 nt, Human
uccccugagaacacaggacaggccugcugaca

SEQ ID NO: 234654 - RNA, 32 nt, Human
uccccugagacaaucccccacgcccagcuaca

SEQ ID NO: 234655 - RNA, 32 nt, Human
uccccugagaugggguauggaggggcccuucc

SEQ ID NO: 234656 - RNA, 32 nt, Human
uccccugagccccagagcuggcagcuguuggg

SEQ ID NO: 234657 - RNA, 18 nt, Human
uccccugagcccucuucu

SEQ ID NO: 234658 - RNA, 32 nt, Human
uccccugagcuaacccggaggaaaggcagucc

SEQ ID NO: 234659 - RNA, 32 nt, Human
uccccugagguugggaguuaaagaccagccug

SEQ ID NO: 234660 - RNA, 32 nt, Human
uccccugauauccccuggcucaguccuaacaa

SEQ ID NO: 234661 - RNA, 32 nt, Human
uccccugauccccuaccucugccugcccucca

SEQ ID NO: 234662 - RNA, 19 nt, Human
uccccugaucuagugcuca

SEQ ID NO: 234663 - RNA, 32 nt, Human
uccccugaucucauggcugaaaagccacacca

SEQ ID NO: 234664 - RNA, 32 nt, Human
uccccugaugaagaaagugccagaggcagcaa

SEQ ID NO: 234665 - RNA, 32 nt, Human
uccccugaugaugcagccccacccucaacucu

SEQ ID NO: 234666 - RNA, 32 nt, Human
uccccugcaaacuggggguugugggaagugag

SEQ ID NO: 234667 - RNA, 32 nt, Human
uccccugcaauggcccugcugugugaugcuca

SEQ ID NO: 234668 - RNA, 32 nt, Human
uccccugcacacuguagaugacuaggacaaga

SEQ ID NO: 234669 - RNA, 32 nt, Human
uccccugcacccgcuaccacaccagcucagcc

SEQ ID NO: 234670 - RNA, 32 nt, Human
uccccugcagaggcgcuccacucccagaagcg

SEQ ID NO: 234671 - RNA, 32 nt, Human
uccccugcaggcgcugugugagcuggcccugc

SEQ ID NO: 234672 - RNA, 32 nt, Human
uccccugcaguuucuggguaacagggcacacc

SEQ ID NO: 234673 - RNA, 32 nt, Human
uccccugcaugugccccugccucuaccugucc

SEQ ID NO: 234674 - RNA, 32 nt, Human
uccccugccagaaacauauacacagauacaca

SEQ ID NO: 234675 - RNA, 32 nt, Human
uccccugccaggacucagccugaaggagcugc

SEQ ID NO: 234676 - RNA, 32 nt, Human
uccccugccaugugugcugauccugcuggcag

SEQ ID NO: 234677 - RNA, 32 nt, Human
uccccugcccaggagucugguugcaaacccug

SEQ ID NO: 234678 - RNA, 32 nt, Human
uccccugcccaugccuaccacccgccauggac

SEQ ID NO: 234679 - RNA, 32 nt, Human
uccccugccccagaggucgcagcuacccucag

SEQ ID NO: 234680 - RNA, 21 nt, Human
uccccugccccccucuccugu

SEQ ID NO: 234681 - RNA, 32 nt, Human
uccccugcccuggagcaacuuaaacaggcccu

SEQ ID NO: 234682 - RNA, 22 nt, Human
uccccugcccuugccaacaucu

SEQ ID NO: 234683 - RNA, 16 nt, Human
uccccugcccuuuucu

SEQ ID NO: 234684 - RNA, 32 nt, Human
uccccugccgcuccgguuccgauggcacucga

SEQ ID NO: 234685 - RNA, 32 nt, Human
uccccugccucaagcccugcccccagcucaag

SEQ ID NO: 234686 - RNA, 32 nt, Human
uccccugccucaccgcuuccuccucgcucuuc

SEQ ID NO: 234687 - RNA, 32 nt, Human
uccccugccugccuccugccuccccugccugc

SEQ ID NO: 234688 - RNA, 32 nt, Human
uccccugccugggaggcucucccaggggcuga

SEQ ID NO: 234689 - RNA, 32 nt, Human
uccccugccugggcacucccuccucccugcgc

SEQ ID NO: 234690 - RNA, 32 nt, Human
uccccugcguccugccaggaagcugaucagua

SEQ ID NO: 234691 - RNA, 32 nt, Human
uccccugcucacucuuccacagauauaaagaa

SEQ ID NO: 234692 - RNA, 32 nt, Human
uccccugcuccuccugccuugucugccuggca

SEQ ID NO: 234693 - RNA, 32 nt, Human
uccccugcuccuuccaggaacagugagcccag

SEQ ID NO: 234694 - RNA, 32 nt, Human
uccccugcuggguuugggaagcaguuagggag

SEQ ID NO: 234695 - RNA, 32 nt, Human
uccccugcugugguaggaacuccaguggugaa

SEQ ID NO: 234696 - RNA, 18 nt, Human
uccccugcuuccaaccuc

SEQ ID NO: 234697 - RNA, 32 nt, Human
uccccuggaagcccacagagacagagacagca

SEQ ID NO: 234698 - RNA, 32 nt, Human
uccccuggagcuccggccugcccagcagguca

SEQ ID NO: 234699 - RNA, 32 nt, Human
uccccuggcaccacucaguuuugcuuuugcga

SEQ ID NO: 234700 - RNA, 32 nt, Human
uccccuggcagcagaagugggugcaggaaggu

SEQ ID NO: 234701 - RNA, 32 nt, Human
uccccuggccacacuuggcagcccuccuccaa

SEQ ID NO: 234702 - RNA, 32 nt, Human
uccccuggccaggucccucaggguugaugcgu

SEQ ID NO: 234703 - RNA, 32 nt, Human
uccccuggcccucaugggcaccgucagcucca

SEQ ID NO: 234704 - RNA, 32 nt, Human
uccccuggccuccccgagccuccuuaggcaau

SEQ ID NO: 234705 - RNA, 32 nt, Human
uccccuggccuggacccaggagacccaggaga

SEQ ID NO: 234706 - RNA, 32 nt, Human
uccccuggcgguggugaaagagacucgggagu

SEQ ID NO: 234707 - RNA, 32 nt, Human
uccccuggcugaagagugccaaucauuacaaa

SEQ ID NO: 234708 - RNA, 32 nt, Human
uccccuggcuuaggcagguaggggaauuaggg

SEQ ID NO: 234709 - RNA, 22 nt, Human
uccccugggacccaccguggga

SEQ ID NO: 234710 - RNA, 32 nt, Human
uccccugggaccccgcccccucauccugccuc

SEQ ID NO: 234711 - RNA, 32 nt, Human
uccccugggcccuggacucggacuggggccuc

SEQ ID NO: 234712 - RNA, 32 nt, Human
uccccugggccggaagacugggaauuccugcu

SEQ ID NO: 234713 - RNA, 32 nt, Human
uccccugggcuggagugcaauggugcgaucau

SEQ ID NO: 234714 - RNA, 23 nt, Human
uccccuggggaaccaggaccucc

SEQ ID NO: 234715 - RNA, 32 nt, Human
uccccugggguuucccuuucggcgcaggcggg

SEQ ID NO: 234716 - RNA, 32 nt, Human
uccccuggucagccuggaagaagccugugucg

SEQ ID NO: 234717 - RNA, 32 nt, Human
uccccugguccucauaagauccuugaagcagg

SEQ ID NO: 234718 - RNA, 32 nt, Human
uccccuggucucacugcugaccugggcugguc

SEQ ID NO: 234719 - RNA, 32 nt, Human
uccccuggugcuuucugugccuaguaauuuuu

SEQ ID NO: 234720 - RNA, 32 nt, Human
uccccugguucaguagaggccccgguuuccca

SEQ ID NO: 234721 - RNA, 32 nt, Human
uccccugguuccugucuguuauuuguaaacug

SEQ ID NO: 234722 - RNA, 32 nt, Human
uccccuguacauuccucccuggaggugcccgg

SEQ ID NO: 234723 - RNA, 19 nt, Human
uccccuguaggaggccagg

SEQ ID NO: 234724 - RNA, 22 nt, Human
uccccugucaggucucuccugu

SEQ ID NO: 234725 - RNA, 21 nt, Human
uccccuguccccugcucuucu

SEQ ID NO: 234726 - RNA, 32 nt, Human
uccccugucuccuuuccuccuccuggguucau

SEQ ID NO: 234727 - RNA, 21 nt, Human
uccccugucuguucucuuugc

SEQ ID NO: 234728 - RNA, 32 nt, Human
uccccugugaagaaacagguguucucggcuga

SEQ ID NO: 234729 - RNA, 32 nt, Human
uccccugugcggccagcgucagagccauggcg

SEQ ID NO: 234730 - RNA, 32 nt, Human
uccccugugcucccuuucucuccucucuccuu

SEQ ID NO: 234731 - RNA, 32 nt, Human
uccccuguggcagcuguauguguaguucaaug

SEQ ID NO: 234732 - RNA, 32 nt, Human
uccccuguggugagcuggagguuggagccuga

SEQ ID NO: 234733 - RNA, 32 nt, Human
uccccugugugagagaaaagaauggaauaagc

SEQ ID NO: 234734 - RNA, 32 nt, Human
uccccuguguuuguagagaacucccuuauaca

SEQ ID NO: 234735 - RNA, 32 nt, Human
uccccuguugcccaggcuggagugcaguggga

SEQ ID NO: 234736 - RNA, 32 nt, Human
uccccuguugcucuccuuaucuuggucaucag

SEQ ID NO: 234737 - RNA, 32 nt, Human
uccccuguuuucuuccucuguaaccuugggca

SEQ ID NO: 234738 - RNA, 32 nt, Human
uccccuguuuuucugccugcguuuucuccaca

SEQ ID NO: 234739 - RNA, 32 nt, Human
uccccuuaaagaaagagacuguagcaauacaa

SEQ ID NO: 234740 - RNA, 32 nt, Human
uccccuuaccuugugggcuugggaaacacgac

SEQ ID NO: 234741 - RNA, 32 nt, Human
uccccuuagcauggcccugaccguggcuguca

SEQ ID NO: 234742 - RNA, 32 nt, Human
uccccuuagccaaccucugucuuuuugaauuu

SEQ ID NO: 234743 - RNA, 32 nt, Human
uccccuucaaagcagacugaggagggaggaga

SEQ ID NO: 234744 - RNA, 22 nt, Human
uccccuucagccccccggcuga

SEQ ID NO: 234745 - RNA, 32 nt, Human
uccccuucagcccucagguagauggaagcugc

SEQ ID NO: 234746 - RNA, 32 nt, Human
uccccuucaguuaccaagaauaacuguaaaau

SEQ ID NO: 234747 - RNA, 32 nt, Human
uccccuucauuucuucaccgcgguuccucguc

SEQ ID NO: 234748 - RNA, 32 nt, Human
uccccuuccaaaucucaucuugaauucccacg

SEQ ID NO: 234749 - RNA, 32 nt, Human
uccccuucccacccucacaucugcuuagccag

SEQ ID NO: 234750 - RNA, 32 nt, Human
uccccuucccacccuccagccaaggagcagcc

SEQ ID NO: 234751 - RNA, 32 nt, Human
uccccuucccacccucuccguuggccucagag

SEQ ID NO: 234752 - RNA, 22 nt, Human
uccccuuccccacguuccagcc

SEQ ID NO: 234753 - RNA, 32 nt, Human
uccccuuccccucccccuccccaacucagauc

SEQ ID NO: 234754 - RNA, 32 nt, Human
uccccuucccucccccuuccucucuuccuucc

SEQ ID NO: 234755 - RNA, 32 nt, Human
uccccuucccuccuccucaggguggggugaac

SEQ ID NO: 234756 - RNA, 32 nt, Human
uccccuucccuucccuucccuuccaucucuuc

SEQ ID NO: 234757 - RNA, 32 nt, Human
uccccuuccggacgcugccaucauguugaagc

SEQ ID NO: 234758 - RNA, 19 nt, Human
uccccuuccucccaccccu

SEQ ID NO: 234759 - RNA, 32 nt, Human
uccccuuccucucucccaccagggggcgcgcu

SEQ ID NO: 234760 - RNA, 32 nt, Human
uccccuuccucuucuuguuuuggugaaucugc

SEQ ID NO: 234761 - RNA, 32 nt, Human
uccccuuccuuguaggugacacaugcucugcc

SEQ ID NO: 234762 - RNA, 32 nt, Human
uccccuucgccuuccaccaugacuguaaguuu

SEQ ID NO: 234763 - RNA, 32 nt, Human
uccccuucuaccuccuccucggccagcucagg

SEQ ID NO: 234764 - RNA, 32 nt, Human
uccccuucuccccucuaaaccuucucccaucu

SEQ ID NO: 234765 - RNA, 32 nt, Human
uccccuucuccugcuucuccagccucuucggc

SEQ ID NO: 234766 - RNA, 32 nt, Human
uccccuucucucucuacauguucaauaaaagu

SEQ ID NO: 234767 - RNA, 32 nt, Human
uccccuucucucuuacuccugcucucacuaug

SEQ ID NO: 234768 - RNA, 32 nt, Human
uccccuucucugcccugcuccaggcaccaggc

SEQ ID NO: 234769 - RNA, 32 nt, Human
uccccuucugaaucagcugggaugacuggcuu

SEQ ID NO: 234770 - RNA, 32 nt, Human
uccccuucugguuccugugucucccaauaaac

SEQ ID NO: 234771 - RNA, 32 nt, Human
uccccuugagaggucagaggggccucuguggg

SEQ ID NO: 234772 - RNA, 32 nt, Human
uccccuugcaguggaggagagagccagagugg

SEQ ID NO: 234773 - RNA, 32 nt, Human
uccccuugccaccggcucugguguuuuggcuu

SEQ ID NO: 234774 - RNA, 23 nt, Human
uccccuugcccucccccagccca

SEQ ID NO: 234775 - RNA, 32 nt, Human
uccccuugccucucaggaauuuugccaggaug

SEQ ID NO: 234776 - RNA, 32 nt, Human
uccccuugccugaaucuggagugggguugagc

SEQ ID NO: 234777 - RNA, 32 nt, Human
uccccuugccuuccuaagaaccccuguguuuc

SEQ ID NO: 234778 - RNA, 32 nt, Human
uccccuuggaaaugcauguaugaacuacccua

SEQ ID NO: 234779 - RNA, 32 nt, Human
uccccuuggaccucaguuagaaccugacauuu

SEQ ID NO: 234780 - RNA, 32 nt, Human
uccccuuggagcuggguggcagaggagauaaa

SEQ ID NO: 234781 - RNA, 32 nt, Human
uccccuuggccuguccagcccagagcauccuu

SEQ ID NO: 234782 - RNA, 29 nt, Human
uccccuuggcugcucuuugccuucaauga

SEQ ID NO: 234783 - RNA, 32 nt, Human
uccccuugggcuguguuggagugagcaccucc

SEQ ID NO: 234784 - RNA, 32 nt, Human
uccccuugggggagcaggaugagaccuuugga

SEQ ID NO: 234785 - RNA, 32 nt, Human
uccccuuguauacauaucaaaauauuaccaau

SEQ ID NO: 234786 - RNA, 32 nt, Human
uccccuugugaaacuguaucauaauuucuucu

SEQ ID NO: 234787 - RNA, 32 nt, Human
uccccuuguucucgcacaaucucucuaaccug

SEQ ID NO: 234788 - RNA, 32 nt, Human
uccccuuuagagacuugcccccgucguauacc

SEQ ID NO: 234789 - RNA, 32 nt, Human
uccccuuucccuccaggcccagugccagcacc

SEQ ID NO: 234790 - RNA, 32 nt, Human
uccccuuucccuuucuugcguccuuuccucuu

SEQ ID NO: 234791 - RNA, 32 nt, Human
uccccuuuccuucuuauggccaccccaucacc

SEQ ID NO: 234792 - RNA, 32 nt, Human
uccccuuugauguucucccccaaguugggcag

SEQ ID NO: 234793 - RNA, 32 nt, Human
uccccuuugcccacccucuuccugucuccacc

SEQ ID NO: 234794 - RNA, 32 nt, Human
uccccuuugccccugcuucaucccagcucugu

SEQ ID NO: 234795 - RNA, 32 nt, Human
uccccuuugcuucuacugcucugauuuugugg

SEQ ID NO: 234796 - RNA, 32 nt, Human
uccccuuuguaaaacuaugaauccaaauaaau

SEQ ID NO: 234797 - RNA, 32 nt, Human
uccccuuugucuuccucugucuuccuuuuuac

SEQ ID NO: 234798 - RNA, 32 nt, Human
uccccuuuuauaccugcucuuguucuacugag

SEQ ID NO: 234799 - RNA, 32 nt, Human
uccccuuuucacuucacucugccuuuucaucc

SEQ ID NO: 234800 - RNA, 32 nt, Human
uccccuuuuguaguuggauaguugggcuugcc

SEQ ID NO: 234801 - RNA, 32 nt, Human
ucccgaaaccagagggauggggccggcugugc

SEQ ID NO: 234802 - RNA, 32 nt, Human
ucccgaaagccgugcucuccagccuggcugcc

SEQ ID NO: 234803 - RNA, 18 nt, Human
ucccgaaaggaggcuguc

SEQ ID NO: 234804 - RNA, 32 nt, Human
ucccgaaagugcugggauuacagucaugagcc

SEQ ID NO: 234805 - RNA, 32 nt, Human
ucccgaagccacacccucccuuuuccucacug

SEQ ID NO: 234806 - RNA, 22 nt, Human
ucccgaaggaacagcugauuca

SEQ ID NO: 234807 - RNA, 32 nt, Human
ucccgaaugugucucgcacuauuggacacuuu

SEQ ID NO: 234808 - RNA, 32 nt, Human
ucccgaauucaagugauucuccugccucagcc

SEQ ID NO: 234809 - RNA, 32 nt, Human
ucccgacagcagcaaccugauccccaagcuuu

SEQ ID NO: 234810 - RNA, 16 nt, Human
ucccgacagccugcca

SEQ ID NO: 234811 - RNA, 32 nt, Human
ucccgaccccaucccuauccauaguccugguc

SEQ ID NO: 234812 - RNA, 32 nt, Human
ucccgaccucaagugauccgcccaccuuggcc

SEQ ID NO: 234813 - RNA, 32 nt, Human
ucccgaccucaagugauccucccaccucaccc

SEQ ID NO: 234814 - RNA, 32 nt, Human
ucccgaccucaagugaucugcccgccuuggcc

SEQ ID NO: 234815 - RNA, 32 nt, Human
ucccgaccucaagugaucugucuaccucggcc

SEQ ID NO: 234816 - RNA, 32 nt, Human
uccucauaauuaucagcaccacugccuuaauu

SEQ ID NO: 234817 - RNA, 32 nt, Human
uccucauaccucagugguuagaagcaugucuc

SEQ ID NO: 234818 - RNA, 22 nt, Human
uccucauagcaucuucuuugga

SEQ ID NO: 234819 - RNA, 32 nt, Human
uccucauaggugagucuuuucacacaucugca

SEQ ID NO: 234820 - RNA, 32 nt, Human
uccucauaugcuacuacuagcaucuagcauuu

SEQ ID NO: 234821 - RNA, 32 nt, Human
uccucaucaccuccuacucccaaaaaggacaa

SEQ ID NO: 234822 - RNA, 32 nt, Human
uccucaucagccuuucauccuuaguuugagaa

SEQ ID NO: 234823 - RNA, 32 nt, Human
uccucaucaucaggcagauacagagcacugca

SEQ ID NO: 234824 - RNA, 32 nt, Human
uccucaucauccagggcaggaaaggaguguga

SEQ ID NO: 234825 - RNA, 32 nt, Human
uccucaucccacccucgccacuugccugagcu

SEQ ID NO: 234826 - RNA, 32 nt, Human
uccucauccccaggcuugaaggcacauggcuu

SEQ ID NO: 234827 - RNA, 16 nt, Human
uccucaucccucccca

SEQ ID NO: 234828 - RNA, 32 nt, Human
uccucaucccugggguggaguugggaugugug

SEQ ID NO: 234829 - RNA, 32 nt, Human
uccucauccucaucaucaucuaccuccaggga

SEQ ID NO: 234830 - RNA, 32 nt, Human
uccucauccuccuccuccuccacuugcagcga

SEQ ID NO: 234831 - RNA, 32 nt, Human
uccucauccucuuccucugauaaagccccuac

SEQ ID NO: 234832 - RNA, 32 nt, Human
uccucauccugagacggucucuacccauguuu

SEQ ID NO: 234833 - RNA, 32 nt, Human
uccucaucgccuuccaccuuuaggaaaugcua

SEQ ID NO: 234834 - RNA, 32 nt, Human
uccucaucucagcccacucugaaaaugugcag

SEQ ID NO: 234835 - RNA, 32 nt, Human
uccucaucuccaggaugugaggcuggagggga

SEQ ID NO: 234836 - RNA, 32 nt, Human
uccucaucuguaaacuggagagagcccagcac

SEQ ID NO: 234837 - RNA, 32 nt, Human
uccucaucugugugacggcaggaagcucugcc

SEQ ID NO: 234838 - RNA, 32 nt, Human
uccucaugagggcuggaugcucucguugaccc

SEQ ID NO: 234839 - RNA, 25 nt, Human
uccucaugcagcagugugcuggggc

SEQ ID NO: 234840 - RNA, 21 nt, Human
uccucaugcccaugcuggggc

SEQ ID NO: 234841 - RNA, 32 nt, Human
uccucaugccuguaucccagcacuuugggagg

SEQ ID NO: 234842 - RNA, 32 nt, Human
uccucaugccuguauucuccaggaaacuuguc

SEQ ID NO: 234843 - RNA, 32 nt, Human
uccucauggagaacccaggggacagcuggugc

SEQ ID NO: 234844 - RNA, 32 nt, Human
uccucauggcgcugcugccaucuuuccuccca

SEQ ID NO: 234845 - RNA, 23 nt, Human
uccucauggcuacggaccuauca

SEQ ID NO: 234846 - RNA, 32 nt, Human
uccucaugggaugcuccagaauuuguagcucc

SEQ ID NO: 234847 - RNA, 32 nt, Human
uccucauguaucaguccucugaaccuuugugg

SEQ ID NO: 234848 - RNA, 32 nt, Human
uccucaugucuuugagggaucccaccacaggu

SEQ ID NO: 234849 - RNA, 19 nt, Human
uccucaugugacuucuggg

SEQ ID NO: 234850 - RNA, 32 nt, Human
uccucauguuaaaaaucgaaaaaugggccagg

SEQ ID NO: 234851 - RNA, 28 nt, Human
uccucauucccagcugccucuuccuacu

SEQ ID NO: 234852 - RNA, 32 nt, Human
uccucauucccauccugucacuugcagcagaa

SEQ ID NO: 234853 - RNA, 32 nt, Human
uccucauucucuuuaccaguauccuggcaaug

SEQ ID NO: 234854 - RNA, 32 nt, Human
uccucauucugcaaauugcaaaccugagggcc

SEQ ID NO: 234855 - RNA, 32 nt, Human
uccucauucuguuccucuuuugaacuuuuccu

SEQ ID NO: 234856 - RNA, 32 nt, Human
uccucauucuuucucagaccucaggcugcaug

SEQ ID NO: 234857 - RNA, 23 nt, Human
uccucauugccuucucccuuccu

SEQ ID NO: 234858 - RNA, 32 nt, Human
uccucauuucaguuccuucugcagccugugaa

SEQ ID NO: 234859 - RNA, 32 nt, Human
uccucauuucaucagaccuaguguucucacac

SEQ ID NO: 234860 - RNA, 32 nt, Human
uccucauuucauccaaguugugcaauguauca

SEQ ID NO: 234861 - RNA, 32 nt, Human
uccucauuugucagagaaaggacagagaagau

SEQ ID NO: 234862 - RNA, 32 nt, Human
uccuccaaacccccaaacucugcaggagaaag

SEQ ID NO: 234863 - RNA, 32 nt, Human
uccuccaaagugcugggauuacaggcaugagc

SEQ ID NO: 234864 - RNA, 32 nt, Human
uccuccaacaugcugucuucauguggagcccu

SEQ ID NO: 234865 - RNA, 32 nt, Human
uccuccaaccagcagcgcugaccuaagagcuc

SEQ ID NO: 234866 - RNA, 17 nt, Human
uccuccaagcacaagga

SEQ ID NO: 234867 - RNA, 18 nt, Human
uccuccaaguacccaggg

SEQ ID NO: 234868 - RNA, 32 nt, Human
uccuccaagucccagaaccccaagaaugggca

SEQ ID NO: 234869 - RNA, 32 nt, Human
uccuccaaugaggcagagguugcagugagcug

SEQ ID NO: 234870 - RNA, 32 nt, Human
uccuccacaagccuaguccauccugccugagc

SEQ ID NO: 234871 - RNA, 32 nt, Human
uccuccacagcaccucguggcccguacucuug

SEQ ID NO: 234872 - RNA, 32 nt, Human
uccuccacagcccugagucuaagcaaaagccc

SEQ ID NO: 234873 - RNA, 32 nt, Human
uccuccacaggugaagacagggccagcaggag

SEQ ID NO: 234874 - RNA, 32 nt, Human
uccuccacagucugaauggccauguuuccucu

SEQ ID NO: 234875 - RNA, 28 nt, Human
uccuccacaguggcugccuccucauuug

SEQ ID NO: 234876 - RNA, 32 nt, Human
uccuccacccgcugcccccgccaugucugcua

SEQ ID NO: 234877 - RNA, 32 nt, Human
uccuccacccucuucccuucgcagcugugaau

SEQ ID NO: 234878 - RNA, 32 nt, Human
uccuccacccuggccucaaauggaugccagau

SEQ ID NO: 234879 - RNA, 32 nt, Human
uccuccacccuguucuggcugugugugaagga

SEQ ID NO: 234880 - RNA, 18 nt, Human
uccuccaccucccacugg

SEQ ID NO: 234881 - RNA, 32 nt, Human
uccuccaccucccagguucaagcgauucucuu

SEQ ID NO: 234882 - RNA, 32 nt, Human
uccuccaccuccuggguucaagugauucuccu

SEQ ID NO: 234883 - RNA, 19 nt, Human
uccuccaccugacaagcag

SEQ ID NO: 234884 - RNA, 32 nt, Human
uccuccaccugagacgagcacagggucuccac

SEQ ID NO: 234885 - RNA, 32 nt, Human
uccuccacggcccagcccccacugucuuacca

SEQ ID NO: 234886 - RNA, 32 nt, Human
uccuccacgucauccuccucuuccucagauga

SEQ ID NO: 234887 - RNA, 21 nt, Human
uccuccacucccucccuuccc

SEQ ID NO: 234888 - RNA, 32 nt, Human
uccuccagagaccgagagguugaugucacucc

SEQ ID NO: 234889 - RNA, 31 nt, Human
uccuccagaggggucacguguaggagugaga

SEQ ID NO: 234890 - RNA, 32 nt, Human
uccuccagcacuuuugggguaaggaggacagu

SEQ ID NO: 234891 - RNA, 32 nt, Human
uccuccagccaagaacaggaucucagcacccc

SEQ ID NO: 234892 - RNA, 32 nt, Human
uccuccagcccagcggcccucuuuccugucug

SEQ ID NO: 234893 - RNA, 32 nt, Human
uccuccagcccagcugggcuuccuuuguugga

SEQ ID NO: 234894 - RNA, 32 nt, Human
uccuccagcccugcccacccucccuccacucc

SEQ ID NO: 234895 - RNA, 32 nt, Human
uccuccagccucccuuggguuuucuuuugaua

SEQ ID NO: 234896 - RNA, 30 nt, Human
uccuccagccucucuggaugcuccaugggu

SEQ ID NO: 234897 - RNA, 19 nt, Human
uccuccagccugcccaggg

SEQ ID NO: 234898 - RNA, 32 nt, Human
uccuccagcuaccacuucauuugucuguuucu

SEQ ID NO: 234899 - RNA, 32 nt, Human
uccuccagcuggcucccuugucuccagggcuu

SEQ ID NO: 234900 - RNA, 19 nt, Human
uccuccaggacgaccagug

SEQ ID NO: 234901 - RNA, 32 nt, Human
uccuccaggccggaguccaguggugcaaucuc

SEQ ID NO: 234902 - RNA, 32 nt, Human
uccuccaggccucagcccuguuggcccaggug

SEQ ID NO: 234903 - RNA, 32 nt, Human
uccuccaggccuggccgugcccgcucaggacc

SEQ ID NO: 234904 - RNA, 32 nt, Human
uccuccaggccuggggacaggaaagccacuga

SEQ ID NO: 234905 - RNA, 32 nt, Human
uccuccaggcggggaggcccagcuggagucuc

SEQ ID NO: 234906 - RNA, 24 nt, Human
uccuccagggcccaccuggccugc

SEQ ID NO: 234907 - RNA, 32 nt, Human
uccuccagggcugcaggcaccagcacuacgcu

SEQ ID NO: 234908 - RNA, 22 nt, Human
uccuccagggcugguccauuca

SEQ ID NO: 234909 - RNA, 32 nt, Human
uccuccaggggcuuccucacuggggaauugcc

SEQ ID NO: 234910 - RNA, 32 nt, Human
uccuccaguaugggugacagagugagaccugg

SEQ ID NO: 234911 - RNA, 32 nt, Human
uccuccaguccugucucaucuccugggagagg

SEQ ID NO: 234912 - RNA, 32 nt, Human
uccuccagucgggcugcaccucugccuugcac

SEQ ID NO: 234913 - RNA, 32 nt, Human
uccuccagugccugcugaaccaucuuaggguc

SEQ ID NO: 234914 - RNA, 32 nt, Human
uccuccagugcugaucuugcugggccuuagcu

SEQ ID NO: 234915 - RNA, 32 nt, Human
uccuccaguucugaugaggcacgccugccuuc

SEQ ID NO: 234916 - RNA, 32 nt, Human
uccuccaguucuuccucuuuuacuaauuaguu

SEQ ID NO: 234917 - RNA, 20 nt, Human
uccuccaucaauuggcagaa

SEQ ID NO: 234918 - RNA, 32 nt, Human
uccuccaucagugucaucaccaaagcuggcug

SEQ ID NO: 234919 - RNA, 31 nt, Human
uccuccaucagugucauuaccaaagcuggcu

SEQ ID NO: 234920 - RNA, 19 nt, Human
uccuccauccuugaaucag

SEQ ID NO: 234921 - RNA, 20 nt, Human
uccuccaucuucagagccag

SEQ ID NO: 234922 - RNA, 32 nt, Human
uccuccaucuuccccuccuuuacccuugguuc

SEQ ID NO: 234923 - RNA, 32 nt, Human
uccuccaucuucuuccugaagaagaaccuucu

SEQ ID NO: 234924 - RNA, 32 nt, Human
uccuccaugaacaucauggacugagcuggggg

SEQ ID NO: 234925 - RNA, 25 nt, Human
uccuccaugaaucccaauggccugc

SEQ ID NO: 234926 - RNA, 32 nt, Human
uccuccaugcaaguucugcuuccucuuauaag

SEQ ID NO: 234927 - RNA, 31 nt, Human
uccuccauggccagcuaagccaacaccuccc

SEQ ID NO: 234928 - RNA, 20 nt, Human
uccuccauguauuuacucca

SEQ ID NO: 234929 - RNA, 32 nt, Human
uccuccauguggccucuccagcaggcuagcuc

SEQ ID NO: 234930 - RNA, 19 nt, Human
uccuccauucuugagucag

SEQ ID NO: 234931 - RNA, 21 nt, Human
uccuccauuucccuggccugc

SEQ ID NO: 234932 - RNA, 32 nt, Human
uccucccaaaagaaaaggcaucaggcucccca

SEQ ID NO: 234933 - RNA, 32 nt, Human
uccucccaaaggacagcagugauggagaggac

SEQ ID NO: 234934 - RNA, 32 nt, Human
uccucccaaaguagcugggacugcaggugcac

SEQ ID NO: 234935 - RNA, 32 nt, Human
uccucccaaccagacucuucugauucugcugc

SEQ ID NO: 234936 - RNA, 32 nt, Human
uccucccaacuaccgaagaggcugaggagcuu

SEQ ID NO: 234937 - RNA, 32 nt, Human
uccucccaaguuggaaaauguuuacaugaauu

SEQ ID NO: 234938 - RNA, 32 nt, Human
uccucccaauguuaccccuuccaucuuccaag

SEQ ID NO: 234939 - RNA, 32 nt, Human
uccucccaauguuagaaagaagaaaagggaga

SEQ ID NO: 234940 - RNA, 32 nt, Human
uccucccacaacacagccacagcaguggcagc

SEQ ID NO: 234941 - RNA, 22 nt, Human
uccucccacacaggcucggugg

SEQ ID NO: 234942 - RNA, 32 nt, Human
uccucccacacgugcucacccacccgcagccu

SEQ ID NO: 234943 - RNA, 32 nt, Human
uccucccaccccaccucuucucagccuugcag

SEQ ID NO: 234944 - RNA, 32 nt, Human
uccucccaccugccacacagcgcuccggggcc

SEQ ID NO: 234945 - RNA, 32 nt, Human
uccucccacgcagcaggccuccacccuagcac

SEQ ID NO: 234946 - RNA, 32 nt, Human
uccucccacugagccucugcccuucccuuuuc

SEQ ID NO: 234947 - RNA, 32 nt, Human
uccucccacugcaccagccagcagguucaugu

SEQ ID NO: 234948 - RNA, 32 nt, Human
uccucccacuggcuccugauaucuugcuguau

SEQ ID NO: 234949 - RNA, 32 nt, Human
uccucccacuucuguauccucagagaugcugc

SEQ ID NO: 234950 - RNA, 32 nt, Human
uccucccacuuuaccauccuccuuccuccccu

SEQ ID NO: 234951 - RNA, 32 nt, Human
uccucccagaagcagguccuccagugacugau

SEQ ID NO: 234952 - RNA, 32 nt, Human
uccucccagaugacagaggugccugguguuug

SEQ ID NO: 234953 - RNA, 22 nt, Human
uccucccagccagagcuggcgg

SEQ ID NO: 234954 - RNA, 19 nt, Human
uccucccagccucuuugua

SEQ ID NO: 234955 - RNA, 19 nt, Human
uccucccagccugccucag

SEQ ID NO: 234956 - RNA, 32 nt, Human
uccucccaggaagcugaauccagcaagaacaa

SEQ ID NO: 234957 - RNA, 32 nt, Human
uccucccaggagauaguuugauggauggucac

SEQ ID NO: 234958 - RNA, 32 nt, Human
uccucccagggcaggugaauggagaggguggc

SEQ ID NO: 234959 - RNA, 32 nt, Human
uccucccagggcugccacuaccagagaccugg

SEQ ID NO: 234960 - RNA, 32 nt, Human
uccucccagguggugcgggggcuggugggcgg

SEQ ID NO: 234961 - RNA, 32 nt, Human
uccucccagucugggaguauagcaggaggccc

SEQ ID NO: 234962 - RNA, 32 nt, Human
uccucccaguguccaagccccuccaggagggu

SEQ ID NO: 234963 - RNA, 32 nt, Human
uccucccauccccucaucuucuccacuacuau

SEQ ID NO: 234964 - RNA, 32 nt, Human
uccucccaucgcccuccuacucccucuccucc

SEQ ID NO: 234965 - RNA, 32 nt, Human
uccucccaugucagguggcucucagaguacag

SEQ ID NO: 234966 - RNA, 32 nt, Human
uccucccauucaaccacccuagagaacugccu

SEQ ID NO: 234967 - RNA, 32 nt, Human
uccuccccaacaaacaguaccugggauggagc

SEQ ID NO: 234968 - RNA, 32 nt, Human
uccuccccacucgccuccucuccacuagacuu

SEQ ID NO: 234969 - RNA, 32 nt, Human
uccuccccagcccuguggaaagcuguggaguc

SEQ ID NO: 234970 - RNA, 32 nt, Human
uccuccccaggcugugcccuccagaggacccu

SEQ ID NO: 234971 - RNA, 32 nt, Human
uccuccccagguggaggugccaggaagcuccc

SEQ ID NO: 234972 - RNA, 32 nt, Human
uccuccccaucuuuccauccuuccugcugagc

SEQ ID NO: 234973 - RNA, 32 nt, Human
uccuccccauuuggcccugggcucaggggacc

SEQ ID NO: 234974 - RNA, 32 nt, Human
uccucccccaccagcucuccccacagggcccc

SEQ ID NO: 234975 - RNA, 32 nt, Human
uccucccccagaccccucccagcccucuccuc

SEQ ID NO: 234976 - RNA, 32 nt, Human
uccucccccagccugggagcgggguugucaag

SEQ ID NO: 234977 - RNA, 32 nt, Human
uccucccccugccucuccucccugacccaggg

SEQ ID NO: 234978 - RNA, 32 nt, Human
uccuccccguggaggccaccuggacuuccagu

SEQ ID NO: 234979 - RNA, 32 nt, Human
uccuccccucagcccccagccuccaggccugc

SEQ ID NO: 234980 - RNA, 32 nt, Human
uccuccccuccacuccagcccaccggugacuc

SEQ ID NO: 234981 - RNA, 32 nt, Human
uccuccccuccagauccgggccccaggcugcu

SEQ ID NO: 234982 - RNA, 16 nt, Human
uccuccccuccaggua

SEQ ID NO: 234983 - RNA, 32 nt, Human
uccuccccucccccuccgcccuccuccgcucc

SEQ ID NO: 234984 - RNA, 32 nt, Human
uccuccccuccccggcccucccacagcugcug

SEQ ID NO: 234985 - RNA, 32 nt, Human
uccuccccuccccucacuucucccaccugcag

SEQ ID NO: 234986 - RNA, 32 nt, Human
uccuccccuccccucccucaguccucccuccc

SEQ ID NO: 234987 - RNA, 32 nt, Human
uccuccccuccccucccuuccucuccucccca

SEQ ID NO: 234988 - RNA, 32 nt, Human
uccuccccuccccucccuucucauuccuuuuc

SEQ ID NO: 234989 - RNA, 32 nt, Human
uccuccccuccccugacgagaucugcccuccu

SEQ ID NO: 234990 - RNA, 32 nt, Human
uccuccccuccccuucccuugcuucuccuucu

SEQ ID NO: 234991 - RNA, 32 nt, Human
uccuccccuccccuuucacucaauucucacca

SEQ ID NO: 234992 - RNA, 32 nt, Human
uccuccccuccggguuuucacacugggcgaag

SEQ ID NO: 234993 - RNA, 32 nt, Human
uccuccccucgcuccucgcccugggccucagc

SEQ ID NO: 234994 - RNA, 20 nt, Human
uccuccccuucccaccugcu

SEQ ID NO: 234995 - RNA, 32 nt, Human
uccuccccuucccauuagcaguucccuccuuu

SEQ ID NO: 234996 - RNA, 32 nt, Human
uccuccccuucccuucucccaucucugucccu

SEQ ID NO: 234997 - RNA, 32 nt, Human
uccuccccuucucuuuucuccacaugaagacg

SEQ ID NO: 234998 - RNA, 32 nt, Human
uccuccccuuuccccuucuccccaccaaagga

SEQ ID NO: 234999 - RNA, 32 nt, Human
uccuccccuuucuccccuccguccccgcuucc

SEQ ID NO: 235000 - RNA, 32 nt, Human
uccucccgaccucccggccugccgcuccggcc

SEQ ID NO: 235001 - RNA, 32 nt, Human
uccucccgacuccccucaccucucccagggaa

SEQ ID NO: 235002 - RNA, 32 nt, Human
uccucccgcaagucucaaacauucauacacug

SEQ ID NO: 235003 - RNA, 32 nt, Human
uccucccgccaucuuccuuucuuggauggauc

SEQ ID NO: 235004 - RNA, 32 nt, Human
uccucccgcccggcacuucuguggaccccuuc

SEQ ID NO: 235005 - RNA, 32 nt, Human
uccucccgcccggggccccaugggccgccgca

SEQ ID NO: 235006 - RNA, 22 nt, Human
uccucccgcccugggcuggccu

SEQ ID NO: 235007 - RNA, 32 nt, Human
uccucccggaccccuggacacacacagcccug

SEQ ID NO: 235008 - RNA, 32 nt, Human
uccucccggcacuucgaggccacugagccacc

SEQ ID NO: 235009 - RNA, 32 nt, Human
uccucccggguuuuauuucucucuuucuugag

SEQ ID NO: 235010 - RNA, 32 nt, Human
uccucccguccaccccagaggggaaguuccuc

SEQ ID NO: 235011 - RNA, 32 nt, Human
uccucccguccgccccagagggaccagacaca

SEQ ID NO: 235012 - RNA, 32 nt, Human
uccucccguggaucucccggggugggggcagg

SEQ ID NO: 235013 - RNA, 32 nt, Human
uccucccuagacaauauguugggcacuaggga

SEQ ID NO: 235014 - RNA, 32 nt, Human
uccucccuaugccucuggcaccugcgcagcaa

SEQ ID NO: 235015 - RNA, 32 nt, Human
uccucccuccaaacugaaacuaauuugauuuu

SEQ ID NO: 235016 - RNA, 32 nt, Human
uccucccuccacaguccuccagcuucggaucc

SEQ ID NO: 235017 - RNA, 32 nt, Human
uccucccuccccaaccuccuccauuuccccag

SEQ ID NO: 235018 - RNA, 32 nt, Human
uccucccuccccucuugcggccucccgcuguc

SEQ ID NO: 235019 - RNA, 32 nt, Human
uccucccucccucccucccucccucccuuucu

SEQ ID NO: 235020 - RNA, 32 nt, Human
uccucccucccucccuccuccuccuuccucgu

SEQ ID NO: 235021 - RNA, 32 nt, Human
uccucccucccucccuuccuugggcagaauga

SEQ ID NO: 235022 - RNA, 32 nt, Human
uccucccuccgccccacuuccaacacaacccc

SEQ ID NO: 235023 - RNA, 32 nt, Human
uccucccuccucccccuccucucuggcaggga

SEQ ID NO: 235024 - RNA, 32 nt, Human
uccucccuccucuccucacauccuggucccua

SEQ ID NO: 235025 - RNA, 28 nt, Human
uccucccuccuugcugccucuucccacc

SEQ ID NO: 235026 - RNA, 32 nt, Human
uccucccucuccugaaccucuacccucacccu

SEQ ID NO: 235027 - RNA, 32 nt, Human
uccucccucuccugaauccuuuucuacaugau

SEQ ID NO: 235028 - RNA, 32 nt, Human
uccucccucugccucuguucagcuccaccuug

SEQ ID NO: 235029 - RNA, 32 nt, Human
uccucccucugccuucccagugcauaaagucu

SEQ ID NO: 235030 - RNA, 16 nt, Human
uccucccucugcugcc

SEQ ID NO: 235031 - RNA, 32 nt, Human
uccucccugcaaccaggcagaugagaaauaug

SEQ ID NO: 235032 - RNA, 32 nt, Human
uccucccugccucuccgucuuguaaugaguug

SEQ ID NO: 235033 - RNA, 32 nt, Human
uccucccugcucugcaaccuuucucuucucac

SEQ ID NO: 235034 - RNA, 32 nt, Human
uccucccuggacaaaggcaucaugaguuguca

SEQ ID NO: 235035 - RNA, 32 nt, Human
uccucccuggagcuagugucuccucucuggug

SEQ ID NO: 235036 - RNA, 32 nt, Human
uccucccugggaacagggugaaggccgagaac

SEQ ID NO: 235037 - RNA, 32 nt, Human
uccucccugucaccugccuccucaucauggaa

SEQ ID NO: 235038 - RNA, 32 nt, Human
uccucccugucuggcccucccucuccagcaag

SEQ ID NO: 235039 - RNA, 32 nt, Human
uccucccugugcaggguauccuguagggugac

SEQ ID NO: 235040 - RNA, 19 nt, Human
uccucccuucccccuggca

SEQ ID NO: 235041 - RNA, 32 nt, Human
uccucccuucuuucuuugaagccuaauggccc

SEQ ID NO: 235042 - RNA, 32 nt, Human
uccucccuugcuggcccugauggggugggguc

SEQ ID NO: 235043 - RNA, 32 nt, Human
uccucccuuuuccuccccacuccuucccacca

SEQ ID NO: 235044 - RNA, 32 nt, Human
uccucccuuuucucccuauccuucugcccccu

SEQ ID NO: 235045 - RNA, 32 nt, Human
uccuccgacgcgauggggaaggugcuauccaa

SEQ ID NO: 235046 - RNA, 32 nt, Human
uccuccgacucccugguucaagcgauuguccu

SEQ ID NO: 235047 - RNA, 32 nt, Human
uccuccgagauaauggcaucagcugcuaagga

SEQ ID NO: 235048 - RNA, 20 nt, Human
uccuccgcccuuuuuguccu

SEQ ID NO: 235049 - RNA, 32 nt, Human
uccuccgccucccggguucaagcaaugcuccc

SEQ ID NO: 235050 - RNA, 32 nt, Human
uccuccgccucccggguucaagcgauucuccc

SEQ ID NO: 235051 - RNA, 32 nt, Human
uccuccgccucccggguucaagugauucucau

SEQ ID NO: 235052 - RNA, 23 nt, Human
uccuccgccuguccacagccccu

SEQ ID NO: 235053 - RNA, 32 nt, Human
uccuccgcggcggguuugggugcaguggaccc

SEQ ID NO: 235054 - RNA, 32 nt, Human
uccuccgcguggcucacuccagccucggaugu

SEQ ID NO: 235055 - RNA, 32 nt, Human
uccuccgcugcagcuuuccaucucaucuccuu

SEQ ID NO: 235056 - RNA, 32 nt, Human
uccuccggacagaaccuauuguguugaggcug

SEQ ID NO: 235057 - RNA, 32 nt, Human
uccuccgggaaugaauuccucaugaaaaugac

SEQ ID NO: 235058 - RNA, 32 nt, Human
uccuccgggggaggaggaugggguugggaacg

SEQ ID NO: 235059 - RNA, 32 nt, Human
uccuccgggggcggaggcagcugaggcgcuuc

SEQ ID NO: 235060 - RNA, 32 nt, Human
uccuccgggugaggggagcgaagguugggggu

SEQ ID NO: 235061 - RNA, 32 nt, Human
uccuccggugucucuucucuccacaucuguaa

SEQ ID NO: 235062 - RNA, 32 nt, Human
uccuccgguugacaguggaaggugcugcagca

SEQ ID NO: 235063 - RNA, 32 nt, Human
uccuccgucuucuucccuggcccuggucaggc

SEQ ID NO: 235064 - RNA, 32 nt, Human
uccuccgugggugacagagcgagaccugacuc

SEQ ID NO: 235065 - RNA, 22 nt, Human
uccuccgugugaaggcagcugg

SEQ ID NO: 235066 - RNA, 32 nt, Human
uccuccguguggacugugccucaggccagggc

SEQ ID NO: 235067 - RNA, 32 nt, Human
uccuccguuauugauuucuccuuucucccuaa

SEQ ID NO: 235068 - RNA, 32 nt, Human
uccuccguucucauuguuuccugcuuuccuuc

SEQ ID NO: 235069 - RNA, 32 nt, Human
uccuccuaccucugccauucaugagaacugug

SEQ ID NO: 235070 - RNA, 32 nt, Human
uccuccuagccacccaccacacugauccagcc

SEQ ID NO: 235071 - RNA, 32 nt, Human
uccuccuagggugcccuugagccgcaaaacug

SEQ ID NO: 235072 - RNA, 18 nt, Human
uccuccuaguucucaaga

SEQ ID NO: 235073 - RNA, 32 nt, Human
uccuccuaugccacgugcucucaccagaacug

SEQ ID NO: 235074 - RNA, 26 nt, Human
uccuccuaugccuucccaugagucag

SEQ ID NO: 235075 - RNA, 32 nt, Human
uccuccucaagagcagaggaaaagccauauaa

SEQ ID NO: 235076 - RNA, 32 nt, Human
uccuccucaccuuuuguugcuaucggcagcug

SEQ ID NO: 235077 - RNA, 32 nt, Human
uccuccucacucagcccugccgcugcccaggg

SEQ ID NO: 235078 - RNA, 32 nt, Human
uccuccucagccagcggcagaagcagggcuga

SEQ ID NO: 235079 - RNA, 32 nt, Human
uccuccucaggcucggaccauggugcaguccc

SEQ ID NO: 235080 - RNA, 32 nt, Human
uccuccucaguucugugccugagaaccacugc

SEQ ID NO: 235081 - RNA, 32 nt, Human
uccuccucauccucuucgucuuccucaucuuc

SEQ ID NO: 235082 - RNA, 20 nt, Human
uccuccucaucuaaugcuca

SEQ ID NO: 235083 - RNA, 32 nt, Human
uccuccucauucccuuccaucucccuccccuc

SEQ ID NO: 235084 - RNA, 32 nt, Human
uccuccuccacuccagucugcuccgcagaacc

SEQ ID NO: 235085 - RNA, 32 nt, Human
uccuccuccagcccccagcccgcaggguacuu

SEQ ID NO: 235086 - RNA, 24 nt, Human
uccuccuccaugcucugcaacuca

SEQ ID NO: 235087 - RNA, 32 nt, Human
uccuccuccauuuccuuuuugggauuugucac

SEQ ID NO: 235088 - RNA, 32 nt, Human
uccuccucccaaagugcugggauuacaggcgu

SEQ ID NO: 235089 - RNA, 18 nt, Human
uccuccuccccgcgcggc

SEQ ID NO: 235090 - RNA, 21 nt, Human
uccuccuccccuacgugacca

SEQ ID NO: 235091 - RNA, 32 nt, Human
uccuccuccccuccucuucccuuagccucucc

SEQ ID NO: 235092 - RNA, 32 nt, Human
uccuccuccccuggcaacugcugaucgacuuu

SEQ ID NO: 235093 - RNA, 32 nt, Human
uccuccucccuccccucugcccucucccuucc

SEQ ID NO: 235094 - RNA, 32 nt, Human
uccuccucccugccaaccuccuccucuccugc

SEQ ID NO: 235095 - RNA, 22 nt, Human
uccuccucccuuacugaaccac

SEQ ID NO: 235096 - RNA, 23 nt, Human
uccuccuccucaccaagggccca

SEQ ID NO: 235097 - RNA, 25 nt, Human
uccuccuccucaguccaagugauca

SEQ ID NO: 235098 - RNA, 21 nt, Human
uccuccuccucauucagacca

SEQ ID NO: 235099 - RNA, 32 nt, Human
uccuccuccucccuccucccccuccucucugg

SEQ ID NO: 235100 - RNA, 22 nt, Human
uccuccuccuccgagcugacuu

SEQ ID NO: 235101 - RNA, 32 nt, Human
uccuccuccuccucccggcggugggugccgcc

SEQ ID NO: 235102 - RNA, 32 nt, Human
uccuccuccuccuccggaggugggaucccaga

SEQ ID NO: 235103 - RNA, 32 nt, Human
uccuccuccuccuccuccggaggugggauccc

SEQ ID NO: 235104 - RNA, 32 nt, Human
uccuccuccuccuccuccuccggaggugggau

SEQ ID NO: 235105 - RNA, 32 nt, Human
uccuccuccucucuccccacuugaaccaugaa

SEQ ID NO: 235106 - RNA, 32 nt, Human
uccuccuccucuuccuccuccuccuccccacc

SEQ ID NO: 235107 - RNA, 32 nt, Human
uccuccuccucuuccuccuccuccuccucucc

SEQ ID NO: 235108 - RNA, 32 nt, Human
uccuccuccucuuccuccuccuccuccucucu

SEQ ID NO: 235109 - RNA, 32 nt, Human
uccuccuccucuuccuccuccucuucaauucu

SEQ ID NO: 235110 - RNA, 32 nt, Human
uccuccuccucuuccuccuccucuuccucuuc

SEQ ID NO: 235111 - RNA, 32 nt, Human
uccuccuccugccucucuucgcuucgccugca

SEQ ID NO: 235112 - RNA, 32 nt, Human
uccuccuccuguucuugccuuggaccugcagg

SEQ ID NO: 235113 - RNA, 32 nt, Human
uccuccuccuucacgugcacagacauacacac

SEQ ID NO: 235114 - RNA, 32 nt, Human
uccuccuccuucuccuccucucacccaggauc

SEQ ID NO: 235115 - RNA, 22 nt, Human
uccuccucgggguguugcacaa

SEQ ID NO: 235116 - RNA, 28 nt, Human
uccuccucguuugcugccuccuccuccu

SEQ ID NO: 235117 - RNA, 32 nt, Human
uccuccucuauagcuucugggugucccccuag

SEQ ID NO: 235118 - RNA, 32 nt, Human
uccuccucuccccucuccucuuucagagcacu

SEQ ID NO: 235119 - RNA, 32 nt, Human
uccuccucucugagaccagggcugucacuuuu

SEQ ID NO: 235120 - RNA, 32 nt, Human
uccuccucucugugugccucagucuccugccg

SEQ ID NO: 235121 - RNA, 32 nt, Human
uccuccucugaugcgucacagucacagguccu

SEQ ID NO: 235122 - RNA, 32 nt, Human
uccuccucugcaggauguaagguuuaucagcc

SEQ ID NO: 235123 - RNA, 32 nt, Human
uccuccucuuccuccuccuccuccaaacucgc

SEQ ID NO: 235124 - RNA, 32 nt, Human
uccuccucuuccuccuccuccuccaccuccgg

SEQ ID NO: 235125 - RNA, 32 nt, Human
uccuccucuuccuccuccuccuccccaccacc

SEQ ID NO: 235126 - RNA, 32 nt, Human
uccuccucuuccuccuccuccugggccgggcu

SEQ ID NO: 235127 - RNA, 32 nt, Human
uccuccucuuccuccuccucuucaauucuccc

SEQ ID NO: 235128 - RNA, 32 nt, Human
uccuccucuuccuccuuccuccuuccuccugc

SEQ ID NO: 235129 - RNA, 32 nt, Human
uccuccucuuccuggcugcagggagugcuugu

SEQ ID NO: 235130 - RNA, 32 nt, Human
uccuccucuucuccucccucuucccucaucuc

SEQ ID NO: 235131 - RNA, 32 nt, Human
uccuccucuugcuaccuccaccuccaccgcca

SEQ ID NO: 235132 - RNA, 32 nt, Human
uccuccucuuggaaggcagaacucccugaaau

SEQ ID NO: 235133 - RNA, 32 nt, Human
uccuccucuuucccucuccccgcugccaaaaa

SEQ ID NO: 235134 - RNA, 32 nt, Human
uccuccucuuucuccuccuccuuauccgaacc

SEQ ID NO: 235135 - RNA, 32 nt, Human
uccuccucuuucuccuccuucucccgcggcuu

SEQ ID NO: 235136 - RNA, 32 nt, Human
uccuccucuuucuugcuuucucuuuucccucu

SEQ ID NO: 235137 - RNA, 32 nt, Human
uccuccugaagcagucuaggagcuugcagcca

SEQ ID NO: 235138 - RNA, 32 nt, Human
uccuccugaccacccauaaccuggcugaggcg

SEQ ID NO: 235139 - RNA, 32 nt, Human
uccuccugagcagcaacccacaguagguagga

SEQ ID NO: 235140 - RNA, 32 nt, Human
uccuccugagccgcaacggcucugaggccucc

SEQ ID NO: 235141 - RNA, 32 nt, Human
uccuccugagccugauucccagggaaguguua

SEQ ID NO: 235142 - RNA, 32 nt, Human
uccuccugaggcagacauccaguaggcauggg

SEQ ID NO: 235143 - RNA, 32 nt, Human
uccuccugcaggaacuggcccaaaaggccaag

SEQ ID NO: 235144 - RNA, 32 nt, Human
uccuccugcaggagcccaacccuggcaucgag

SEQ ID NO: 235145 - RNA, 32 nt, Human
uccuccugcagggccugugagcugcucacaac

SEQ ID NO: 235146 - RNA, 32 nt, Human
uccuccugccaggggagagccacccacaggcc

SEQ ID NO: 235147 - RNA, 32 nt, Human
uccuccugccccugggcucucagggacccccu

SEQ ID NO: 235148 - RNA, 32 nt, Human
uccuccugcccuuucaaagaauaaccacagcu

SEQ ID NO: 235149 - RNA, 19 nt, Human
uccuccugccucccagugg

SEQ ID NO: 235150 - RNA, 30 nt, Human
uccuccugccucuccucugccccuguccag

SEQ ID NO: 235151 - RNA, 31 nt, Human
uccuccugccucuccucugccccuguccagu

SEQ ID NO: 235152 - RNA, 23 nt, Human
uccuccugcucccuaguggccca

SEQ ID NO: 235153 - RNA, 32 nt, Human
uccuccuggaaggggccucaugacagauucgg

SEQ ID NO: 235154 - RNA, 32 nt, Human
uccuccuggacuugggccugguggaagggcuc

SEQ ID NO: 235155 - RNA, 32 nt, Human
uccuccuggauuccugcaacuauauucucacu

SEQ ID NO: 235156 - RNA, 28 nt, Human
uccuccuggcagcccccugcugaccugu

SEQ ID NO: 235157 - RNA, 32 nt, Human
uccuccuggccccgcccugcccagccccuccc

SEQ ID NO: 235158 - RNA, 32 nt, Human
uccuccuggcugcaccuggguagggauggugg

SEQ ID NO: 235159 - RNA, 22 nt, Human
uccuccugggagccuggccugc

SEQ ID NO: 235160 - RNA, 32 nt, Human
uccuccugggcaacagagugagacccuaucac

SEQ ID NO: 235161 - RNA, 32 nt, Human
uccuccuggggcccuguucccuguggggacug

SEQ ID NO: 235162 - RNA, 32 nt, Human
uccuccuggggcuggggcccagauccugggga

SEQ ID NO: 235163 - RNA, 32 nt, Human
uccuccugucuuccuccuugucccaugaaggc

SEQ ID NO: 235164 - RNA, 32 nt, Human
uccuccuguggaaaaggagagcuguuccagaa

SEQ ID NO: 235165 - RNA, 32 nt, Human
uccuccuguggaaggaacuggauucaucccuu

SEQ ID NO: 235166 - RNA, 32 nt, Human
uccuccuguggacagaccuuccucacccgcuc

SEQ ID NO: 235167 - RNA, 32 nt, Human
uccuccuguggccucugcuuguacagaacugg

SEQ ID NO: 235168 - RNA, 32 nt, Human
uccuccuguguagcugccaccuccccgcuggg

SEQ ID NO: 235169 - RNA, 32 nt, Human
uccuccuuacucuuggauaaauaaacagccug

SEQ ID NO: 235170 - RNA, 32 nt, Human
uccuccuuccagggacugaggucuccaagcua

SEQ ID NO: 235171 - RNA, 32 nt, Human
uccuccuucccaucuucugugcuuccagagaa

SEQ ID NO: 235172 - RNA, 32 nt, Human
uccuccuuccuggucacauucaaaccuuccca

SEQ ID NO: 235173 - RNA, 32 nt, Human
uccuccuucucccgcucccucucccgugccuc

SEQ ID NO: 235174 - RNA, 32 nt, Human
uccuccuugccacccuuccagccuuccaggcu

SEQ ID NO: 235175 - RNA, 32 nt, Human
uccuccuugggagcugggcucuucugcccugg

SEQ ID NO: 235176 - RNA, 32 nt, Human
uccuccuuguaggcauuucaucuguguguguu

SEQ ID NO: 235177 - RNA, 32 nt, Human
uccuccuugucuuaaucguccugcugcugcug

SEQ ID NO: 235178 - RNA, 32 nt, Human
uccuccuuuccagugaaacuacaccugaagcc

SEQ ID NO: 235179 - RNA, 32 nt, Human
uccuccuuucccucuuauuccuccuucuccuc

SEQ ID NO: 235180 - RNA, 32 nt, Human
uccuccuuucggagucaaggaaagccuuucua

SEQ ID NO: 235181 - RNA, 32 nt, Human
uccuccuuucuuggcgggugggagacuccggg

SEQ ID NO: 235182 - RNA, 32 nt, Human
uccuccuuuguuguuucuuaauuuggaaacua

SEQ ID NO: 235183 - RNA, 32 nt, Human
uccuccuuuucuagcaggcagcucuucuaggc

SEQ ID NO: 235184 - RNA, 32 nt, Human
uccucgacagaagagugggaggugagaagccc

SEQ ID NO: 235185 - RNA, 32 nt, Human
uccucgaccccucucccccuugacuauccaaa

SEQ ID NO: 235186 - RNA, 32 nt, Human
uccucgagaacagcacguaacugcaaugcagc

SEQ ID NO: 235187 - RNA, 32 nt, Human
uccucgagaucaaacacuaggcacggggcugg

SEQ ID NO: 235188 - RNA, 32 nt, Human
uccucgagcacgucacacacacaugccagugu

SEQ ID NO: 235189 - RNA, 24 nt, Human
uccucgagcccagcuaacucggug

SEQ ID NO: 235190 - RNA, 24 nt, Human
uccucgagcccgcacggcucggug

SEQ ID NO: 235191 - RNA, 24 nt, Human
uccucgagcucagugcacucggug

SEQ ID NO: 235192 - RNA, 22 nt, Human
uccucgagcuccccggggcuug

SEQ ID NO: 235193 - RNA, 32 nt, Human
uccucgaugugcagaaguugucaguggaaaau

SEQ ID NO: 235194 - RNA, 32 nt, Human
uccucgcaacacagguaccuugucaugucaga

SEQ ID NO: 235195 - RNA, 32 nt, Human
uccucgcagguguguugugaagauuaaugcag

SEQ ID NO: 235196 - RNA, 23 nt, Human
uccucgccacccagcagcacccu

SEQ ID NO: 235197 - RNA, 32 nt, Human
uccucgccagccucgccagccugcugccagua

SEQ ID NO: 235198 - RNA, 32 nt, Human
uccucgcccaggagucaucucaugccgccgcc

SEQ ID NO: 235199 - RNA, 32 nt, Human
uccucgcccugccuccugccauucccggccug

SEQ ID NO: 235200 - RNA, 32 nt, Human
uccucgccgcccgcccagaggaguccccgcgc

SEQ ID NO: 235201 - RNA, 32 nt, Human
uccucgccuccccucuuccucauuccauugcc

SEQ ID NO: 235202 - RNA, 22 nt, Human
uccucgccuuccaccuccugcu

SEQ ID NO: 235203 - RNA, 24 nt, Human
uccucgccuuuagauauuuauuca

SEQ ID NO: 235204 - RNA, 32 nt, Human
uccucgccuuucucgcaccugcuccugcgcca

SEQ ID NO: 235205 - RNA, 32 nt, Human
uccucgccuuucuuccccgcgcaucgccagcg

SEQ ID NO: 235206 - RNA, 32 nt, Human
uccucgcuccacccacccacgcugcugucacc

SEQ ID NO: 235207 - RNA, 32 nt, Human
uccucgcugcucaugcccacagcccucccaga

SEQ ID NO: 235208 - RNA, 32 nt, Human
uccucgcuuagccugcaccuccuguccugaag

SEQ ID NO: 235209 - RNA, 32 nt, Human
uccucggacugaagcaagagacagggaaggaa

SEQ ID NO: 235210 - RNA, 32 nt, Human
uccucggaggagcagagguggccgccgugggg

SEQ ID NO: 235211 - RNA, 32 nt, Human
uccucggaguaguggugagauggccuuggguu

SEQ ID NO: 235212 - RNA, 32 nt, Human
uccucggauuacaggcaugagccaccacaccc

SEQ ID NO: 235213 - RNA, 23 nt, Human
uccucggcaggaccccagucuca

SEQ ID NO: 235214 - RNA, 32 nt, Human
uccucggccagccuggcugucaguuggggauu

SEQ ID NO: 235215 - RNA, 32 nt, Human
uccucggccaugucacugcucugcgugcgcgu

SEQ ID NO: 235216 - RNA, 32 nt, Human
uccucggccuuggagagcagcggcggcggcgg

SEQ ID NO: 235217 - RNA, 32 nt, Human
uccucggcgaacaugucucuccugaguccaga

SEQ ID NO: 235218 - RNA, 32 nt, Human
uccucggcucaagcaauccuuccuacucagcc

SEQ ID NO: 235219 - RNA, 22 nt, Human
uccucggcugcccuuggacuug

SEQ ID NO: 235220 - RNA, 32 nt, Human
uccucggcuguggucuggaugcugccacccuc

SEQ ID NO: 235221 - RNA, 32 nt, Human
uccucgggaggcaggagaaucgcuugaacccc

SEQ ID NO: 235222 - RNA, 32 nt, Human
uccucgggaggcugaggcaggagaaucgcuug

SEQ ID NO: 235223 - RNA, 32 nt, Human
uccucgggccuccugggucugggacgugccuc

SEQ ID NO: 235224 - RNA, 32 nt, Human
uccucgggccucucuucgucgaagagucuccu

SEQ ID NO: 235225 - RNA, 32 nt, Human
uccucgggcucccuaaggaccugcucucccag

SEQ ID NO: 235226 - RNA, 32 nt, Human
uccucggggccccugcagccacccaacgucac

SEQ ID NO: 235227 - RNA, 32 nt, Human
uccucgggggauguuacuccuaaugucacacg

SEQ ID NO: 235228 - RNA, 32 nt, Human
uccucgggguuuagggucgagcuguuccugau

SEQ ID NO: 235229 - RNA, 31 nt, Human
uccucgguccuucagcaccccucggcccgac

SEQ ID NO: 235230 - RNA, 32 nt, Human
uccucggugaggugagccccucuacagccagu

SEQ ID NO: 235231 - RNA, 32 nt, Human
uccucgucuccuccuccuucccacaggccggc

SEQ ID NO: 235232 - RNA, 32 nt, Human
uccucgugccugcugcucacagcccccgagag

SEQ ID NO: 235233 - RNA, 32 nt, Human
uccucgugcuguucuuguguggcuuucugggc

SEQ ID NO: 235234 - RNA, 32 nt, Human
uccucguggagcggagcaaggccaggcggccc

SEQ ID NO: 235235 - RNA, 32 nt, Human
uccucguggcagaggccugcaugugggugcca

SEQ ID NO: 235236 - RNA, 32 nt, Human
uccucgugguugccugccccacucccugccga

SEQ ID NO: 235237 - RNA, 32 nt, Human
uccucguucugugggagagaccagccuucugg

SEQ ID NO: 235238 - RNA, 32 nt, Human
uccucguugcccuguaaggacauccguguaua

SEQ ID NO: 235239 - RNA, 32 nt, Human
uccucguuucaagugauccuccugccucagcu

SEQ ID NO: 235240 - RNA, 23 nt, Human
uccucuaacuuguuuugcugcuc

SEQ ID NO: 235241 - RNA, 25 nt, Human
uccucuaagcaugcuccuggccucu

SEQ ID NO: 235242 - RNA, 32 nt, Human
uccucuacaagccuggugugcccacacaccac

SEQ ID NO: 235243 - RNA, 32 nt, Human
uccucuacaugacaaagaaagacuggaaaagu

SEQ ID NO: 235244 - RNA, 32 nt, Human
uccucuacccagcaaaaaugagugucucagaa

SEQ ID NO: 235245 - RNA, 23 nt, Human
uccucuaccugaauccagugcuc

SEQ ID NO: 235246 - RNA, 32 nt, Human
uccucuaccugcacucccgcccugaggcccgg

SEQ ID NO: 235247 - RNA, 32 nt, Human
uccucuaccuguucaacaacagccuggccucg

SEQ ID NO: 235248 - RNA, 32 nt, Human
uccucuacgcccagguuccggaagguggugag

SEQ ID NO: 235249 - RNA, 32 nt, Human
uccucuacuacugccugcucuucauuuugggc

SEQ ID NO: 235250 - RNA, 32 nt, Human
uccucuagccucauacccgugcccucacagag

SEQ ID NO: 235251 - RNA, 32 nt, Human
uccucuagccucugcuggagugcagugaggau

SEQ ID NO: 235252 - RNA, 32 nt, Human
uccucuagccugggcaguagaggaagaaaugc

SEQ ID NO: 235253 - RNA, 32 nt, Human
uccucuaguuuugagacagcugccucaaccuc

SEQ ID NO: 235254 - RNA, 32 nt, Human
uccucuauccugggcuuuuguuuugcuuuuua

SEQ ID NO: 235255 - RNA, 32 nt, Human
uccucuauguacccccugcccaccucgggccu

SEQ ID NO: 235256 - RNA, 23 nt, Human
uccucuauucuuuccuccuuccc

SEQ ID NO: 235257 - RNA, 32 nt, Human
uccucucaacucucgcugcccaaccagaaagg

SEQ ID NO: 235258 - RNA, 32 nt, Human
uccucucaagccccaggacccuucaaagggcu

SEQ ID NO: 235259 - RNA, 32 nt, Human
uccucucacagaaacacugggccaaacagugg

SEQ ID NO: 235260 - RNA, 32 nt, Human
uccucucacagccucuguaucucugcaggcca

SEQ ID NO: 235261 - RNA, 31 nt, Human
uccucucacagcuagaacugaaacaaacccu

SEQ ID NO: 235262 - RNA, 32 nt, Human
uccucucacccacaccccuggccauggcuaac

SEQ ID NO: 235263 - RNA, 23 nt, Human
uccucucaccucucccucgauca

SEQ ID NO: 235264 - RNA, 32 nt, Human
uccucucacucugccuggagauacuuccugcc

SEQ ID NO: 235265 - RNA, 31 nt, Human
uccucucacugcuagaauauucaccaagggu

SEQ ID NO: 235266 - RNA, 32 nt, Human
uccucucagagccucagcuucugggggagaca

SEQ ID NO: 235267 - RNA, 32 nt, Human
uccucucaggcaggcuugcucugucccuuccu

SEQ ID NO: 235268 - RNA, 32 nt, Human
uccucucaggggcaaauggagcacagaucuag

SEQ ID NO: 235269 - RNA, 32 nt, Human
uccucucagucauucaucaauguggccagcuu

SEQ ID NO: 235270 - RNA, 32 nt, Human
uccucucaguccuucugcaacgcccagugccu

SEQ ID NO: 235271 - RNA, 32 nt, Human
uccucucaguuguaaaagaugaacucuuugag

SEQ ID NO: 235272 - RNA, 32 nt, Human
uccucucauacucccugagacucugagaacag

SEQ ID NO: 235273 - RNA, 32 nt, Human
uccucucauccugcaucaucagccuggacuug

SEQ ID NO: 235274 - RNA, 21 nt, Human
uccucuccaaacacuucggga

SEQ ID NO: 235275 - RNA, 32 nt, Human
uccucuccaaauuuacauguugaaguccuaau

SEQ ID NO: 235276 - RNA, 31 nt, Human
uccucuccacccucugggccucagugucuug

SEQ ID NO: 235277 - RNA, 32 nt, Human
uccucuccacucccccuccucacuuuccuguc

SEQ ID NO: 235278 - RNA, 32 nt, Human
uccucuccagaacagggaaaugugguguuuac

SEQ ID NO: 235279 - RNA, 32 nt, Human
uccucuccagaacuccagaaagagcagugugc

SEQ ID NO: 235280 - RNA, 32 nt, Human
uccucuccagcaucuguuguuuccugacuuuu

SEQ ID NO: 235281 - RNA, 32 nt, Human
uccucuccagcccuauggaagucucaagguca

SEQ ID NO: 235282 - RNA, 20 nt, Human
uccucuccaggaauccgcgg

SEQ ID NO: 235283 - RNA, 32 nt, Human
uccucuccagugggguuggcuuuuauuguuuc

SEQ ID NO: 235284 - RNA, 32 nt, Human
uccucuccaucagugccuuugccugcagcuac

SEQ ID NO: 235285 - RNA, 32 nt, Human
uccucuccaugcccaagucgguuuccagccgc

SEQ ID NO: 235286 - RNA, 32 nt, Human
uccucuccauuuuucucuuucuccuccuggcc

SEQ ID NO: 235287 - RNA, 32 nt, Human
uccucucccaaguucuuucuccaucccucucc

SEQ ID NO: 235288 - RNA, 18 nt, Human
uccucucccagacuguga

SEQ ID NO: 235289 - RNA, 32 nt, Human
uccucucccagaucgucuucuccuucaguuuc

SEQ ID NO: 235290 - RNA, 32 nt, Human
uccucuccccagccugggaagaugucucacug

SEQ ID NO: 235291 - RNA, 32 nt, Human
uccucuccccaggccucuggcugcagugaugc

SEQ ID NO: 235292 - RNA, 32 nt, Human
uccucucccccgaaccucuccccagcuagucu

SEQ ID NO: 235293 - RNA, 22 nt, Human
uccucucccccucucuccuccc

SEQ ID NO: 235294 - RNA, 16 nt, Human
uccucuccccgcgccg

SEQ ID NO: 235295 - RNA, 32 nt, Human
uccucuccccucauuuccaucucccagccccc

SEQ ID NO: 235296 - RNA, 16 nt, Human
uccucuccccuccuca

SEQ ID NO: 235297 - RNA, 22 nt, Human
uccucuccccuccucccauccc

SEQ ID NO: 235298 - RNA, 32 nt, Human
uccucucccucccauugcauggcucacaccug

SEQ ID NO: 235299 - RNA, 32 nt, Human
uccucucccuccuguggauucucccaucagcc

SEQ ID NO: 235300 - RNA, 32 nt, Human
uccucucccucgggacccaaggccacaaagga

SEQ ID NO: 235301 - RNA, 32 nt, Human
uccucucccugccaagucucagaagagguugg

SEQ ID NO: 235302 - RNA, 32 nt, Human
uccucuccgcgcccuccgaccucucucggccc

SEQ ID NO: 235303 - RNA, 21 nt, Human
uccucuccggggugguggaga

SEQ ID NO: 235304 - RNA, 32 nt, Human
uccucuccgucucccuucccugccuccuuucc

SEQ ID NO: 235305 - RNA, 32 nt, Human
uccucuccgugcuccucagcaguccuccgcua

SEQ ID NO: 235306 - RNA, 23 nt, Human
uccucuccuacccacuggucugc

SEQ ID NO: 235307 - RNA, 20 nt, Human
uccucuccuaccuggcucuu

SEQ ID NO: 235308 - RNA, 32 nt, Human
uccucuccucaccuggccccagcuccugcccc

SEQ ID NO: 235309 - RNA, 32 nt, Human
uccucuccucauuccuuugguuuuggcccaaa

SEQ ID NO: 235310 - RNA, 32 nt, Human
uccucuccuccaccuuccccuaucauuuagug

SEQ ID NO: 235311 - RNA, 32 nt, Human
uccucuccuccagaggccuggaagggaggugg

SEQ ID NO: 235312 - RNA, 32 nt, Human
uccucuccuccccuacucccccagagaaccaa

SEQ ID NO: 235313 - RNA, 20 nt, Human
uccucuccuccucccuuccc

SEQ ID NO: 235314 - RNA, 32 nt, Human
uccucuccuccucccuucccuuccccucuccu

SEQ ID NO: 235315 - RNA, 32 nt, Human
uccucuccuccuccuccuccucuuccuccucc

SEQ ID NO: 235316 - RNA, 32 nt, Human
uccucuccuccuccuccuccugggucccccag

SEQ ID NO: 235317 - RNA, 32 nt, Human
uccucuccuccucugugcuccugucccucccu

SEQ ID NO: 235318 - RNA, 32 nt, Human
uccucuccuccuucccucucccucucugcuuc

SEQ ID NO: 235319 - RNA, 32 nt, Human
uccucuccucuccccucccuugcuuuccccag

SEQ ID NO: 235320 - RNA, 32 nt, Human
uccucuccucuccuauggugagcccagcgugg

SEQ ID NO: 235321 - RNA, 32 nt, Human
uccucuccucuccucucuuuccuuccuuccuu

SEQ ID NO: 235322 - RNA, 32 nt, Human
uccucuccugaauacacuccccaaaacacccc

SEQ ID NO: 235323 - RNA, 32 nt, Human
uccucuccugggccccugcucuucccaaagcu

SEQ ID NO: 235324 - RNA, 32 nt, Human
uccucuccuuccaccccucauuuccuuuuugc

SEQ ID NO: 235325 - RNA, 32 nt, Human
uccucuccuuucucuucgucuucuccucuucc

SEQ ID NO: 235326 - RNA, 32 nt, Human
uccucucgcccaggcuggagugcagugguguc

SEQ ID NO: 235327 - RNA, 32 nt, Human
uccucucgcugccacuuuggaaaauaagagac

SEQ ID NO: 235328 - RNA, 24 nt, Human
uccucucgggagccuguggccugc

SEQ ID NO: 235329 - RNA, 32 nt, Human
uccucucuaaaggguugaggcugagcuauaau

SEQ ID NO: 235330 - RNA, 32 nt, Human
uccucucuaggcagcgggugggcacagccccu

SEQ ID NO: 235331 - RNA, 32 nt, Human
uccucucucacugcuccuuccuggucucuucu

SEQ ID NO: 235332 - RNA, 32 nt, Human
uccucucucacuucccuuccucucucucaccu

SEQ ID NO: 235333 - RNA, 32 nt, Human
uccucucuccacccccucuccaacacuggccc

SEQ ID NO: 235334 - RNA, 32 nt, Human
uccucucucccaggcaggcagcugcaggcgcu

SEQ ID NO: 235335 - RNA, 32 nt, Human
uccucucuccccacuugaaccaugaaguuucc

SEQ ID NO: 235336 - RNA, 24 nt, Human
uccucucucccucucucccuuccc

SEQ ID NO: 235337 - RNA, 32 nt, Human
uccucucucccuggaccucagaggugacaccc

SEQ ID NO: 235338 - RNA, 32 nt, Human
uccucucuccuccagcucuccccaucaugaaa

SEQ ID NO: 235339 - RNA, 32 nt, Human
uccucucuccuccccuccuuccucucuccucu

SEQ ID NO: 235340 - RNA, 32 nt, Human
uccucucuccucucccccucucuccucccuuc

SEQ ID NO: 235341 - RNA, 32 nt, Human
uccucucuccuuccuuuccuuccuuuuucucu

SEQ ID NO: 235342 - RNA, 32 nt, Human
uccucucucucaaaauaaacuaaccuauucau

SEQ ID NO: 235343 - RNA, 32 nt, Human
uccucucucucccuccacuccucccaacucug

SEQ ID NO: 235344 - RNA, 22 nt, Human
uccucucucuccuccccuuccc

SEQ ID NO: 235345 - RNA, 32 nt, Human
uccucucucuuucauccacacuucuguuaacu

SEQ ID NO: 235346 - RNA, 32 nt, Human
uccucucucuuuccuuucuuuccgccuaucuu

SEQ ID NO: 235347 - RNA, 32 nt, Human
uccucucugagucccagcuauggggaacaucu

SEQ ID NO: 235348 - RNA, 32 nt, Human
uccucucugcaaugagcuuucucagcucucag

SEQ ID NO: 235349 - RNA, 32 nt, Human
uccucucugcccuucucugccaccccggggag

SEQ ID NO: 235350 - RNA, 32 nt, Human
uccucucugcucauguuaccugccuauaggac

SEQ ID NO: 235351 - RNA, 32 nt, Human
uccucucugcuccaauaccaccaccuugucca

SEQ ID NO: 235352 - RNA, 32 nt, Human
uccucucugcuugcauguguaaaguuuucauu

SEQ ID NO: 235353 - RNA, 32 nt, Human
uccucucugggagaggccgcucuggcuuuucc

SEQ ID NO: 235354 - RNA, 25 nt, Human
uccucucugugcugaacauccugug

SEQ ID NO: 235355 - RNA, 32 nt, Human
uccucucuuccaaaccuccuugcuuuggacaa

SEQ ID NO: 235356 - RNA, 24 nt, Human
uccucucuuccucacucccuuccc

SEQ ID NO: 235357 - RNA, 32 nt, Human
uccucucuuccuucccuucuuuaucaucuccc

SEQ ID NO: 235358 - RNA, 32 nt, Human
uccucucuucuccagccucucccuuucacucu

SEQ ID NO: 235359 - RNA, 32 nt, Human
uccucucuucucuccagccuugcagcguggcc

SEQ ID NO: 235360 - RNA, 32 nt, Human
uccucucuucucucccccucagccuuucucuc

SEQ ID NO: 235361 - RNA, 32 nt, Human
uccucucuucuuccucuucucucucacugcca

SEQ ID NO: 235362 - RNA, 23 nt, Human
uccucucuucuuuccucccuccc

SEQ ID NO: 235363 - RNA, 32 nt, Human
uccucucuugacuugagaaugaucagucaaua

SEQ ID NO: 235364 - RNA, 32 nt, Human
uccucucuuuuccacacacaacuaucuguuua

SEQ ID NO: 235365 - RNA, 32 nt, Human
uccucugaagcacaaaaguuaauuuugaugaa

SEQ ID NO: 235366 - RNA, 21 nt, Human
uccucugaagcccaggucuug

SEQ ID NO: 235367 - RNA, 23 nt, Human
uccucugaaguaacugccucuug

SEQ ID NO: 235368 - RNA, 32 nt, Human
uccucugacaacucacuugggguggggaaagg

SEQ ID NO: 235369 - RNA, 19 nt, Human
uccucugacaccacuggcu

SEQ ID NO: 235370 - RNA, 20 nt, Human
uccucugacaccuugacuuu

SEQ ID NO: 235371 - RNA, 32 nt, Human
uccucugacaguagugaagacaaggaugaaaa

SEQ ID NO: 235372 - RNA, 19 nt, Human
uccucugacccaucagcuc

SEQ ID NO: 235373 - RNA, 32 nt, Human
uccucugacccccaucucccccuuccuuuccc

SEQ ID NO: 235374 - RNA, 32 nt, Human
uccucugagaggcggagagugcugacuguagu

SEQ ID NO: 235375 - RNA, 32 nt, Human
uccucugagagggcagaacacacauauccaag

SEQ ID NO: 235376 - RNA, 32 nt, Human
uccucugagcccucagaaccagccucuucugc

SEQ ID NO: 235377 - RNA, 32 nt, Human
uccucugagcuucuccugcuccucucugccuc

SEQ ID NO: 235378 - RNA, 32 nt, Human
uccucugaggcugaaauucagaauauuaguga

SEQ ID NO: 235379 - RNA, 32 nt, Human
uccucugaguggggagagguugggcagugagu

SEQ ID NO: 235380 - RNA, 32 nt, Human
uccucugauacccagagcauuacgugagccag

SEQ ID NO: 235381 - RNA, 32 nt, Human
uccucugaucagcugaagcagagaaagcauau

SEQ ID NO: 235382 - RNA, 32 nt, Human
uccucugauucaccuagaaccuguucucugcc

SEQ ID NO: 235383 - RNA, 32 nt, Human
uccucugcaaaaagauuuaacaaauacauuca

SEQ ID NO: 235384 - RNA, 32 nt, Human
uccucugcaaagauguugucccuggggaacag

SEQ ID NO: 235385 - RNA, 22 nt, Human
uccucugcaauguggguugcug

SEQ ID NO: 235386 - RNA, 32 nt, Human
uccucugcagagcccaguggagccagccaugu

SEQ ID NO: 235387 - RNA, 32 nt, Human
uccucugcagaggcggauuucccugacugaag

SEQ ID NO: 235388 - RNA, 32 nt, Human
uccucugcagcaggaggcagagcugugggaug

SEQ ID NO: 235389 - RNA, 32 nt, Human
uccucugcagcaggcaagaccaaucaaucacu

SEQ ID NO: 235390 - RNA, 32 nt, Human
uccucugcagccugcagaacugugagccaauu

SEQ ID NO: 235391 - RNA, 32 nt, Human
uccucugcaguugaugugguccuggauccaga

SEQ ID NO: 235392 - RNA, 32 nt, Human
uccucugccagacuuuuuaaucucuucauuaa

SEQ ID NO: 235393 - RNA, 32 nt, Human
uccucugccaugagccuagcugugaccuuaga

SEQ ID NO: 235394 - RNA, 32 nt, Human
uccucugcccaagcccuuccuccccuccauca

SEQ ID NO: 235395 - RNA, 31 nt, Human
uccucugcccucucuggaguuugccuccccc

SEQ ID NO: 235396 - RNA, 32 nt, Human
uccucugcccugcauuggccuugaccacauga

SEQ ID NO: 235397 - RNA, 32 nt, Human
uccucugcccugcccaccagccugugauuuga

SEQ ID NO: 235398 - RNA, 32 nt, Human
uccucugccucccggguucaagcaauucuccu

SEQ ID NO: 235399 - RNA, 32 nt, Human
uccucugccucccggguucaagcaauucucug

SEQ ID NO: 235400 - RNA, 32 nt, Human
uccucugccuggggccauugagcccagccucc

SEQ ID NO: 235401 - RNA, 32 nt, Human
uccucugcucaggagaaaacuuacaaacuuuu

SEQ ID NO: 235402 - RNA, 32 nt, Human
uccucugcuccuucuaccuccacuguauccug

SEQ ID NO: 235403 - RNA, 32 nt, Human
uccucugcugacaaccucugccgcaaacugga

SEQ ID NO: 235404 - RNA, 32 nt, Human
uccucuggaaaaggaaaagaacuacgagagga

SEQ ID NO: 235405 - RNA, 32 nt, Human
uccucuggaacuugaggaagugaacauuucgg

SEQ ID NO: 235406 - RNA, 19 nt, Human
uccucuggacucugucuga

SEQ ID NO: 235407 - RNA, 32 nt, Human
uccucuggagccagccgagcaggaggccuagg

SEQ ID NO: 235408 - RNA, 32 nt, Human
uccucuggaggccugggcugagacagugcucu

SEQ ID NO: 235409 - RNA, 32 nt, Human
uccucuggagugagaggcuccacccacuacag

SEQ ID NO: 235410 - RNA, 25 nt, Human
uccucuggaguuugagacccugaca

SEQ ID NO: 235411 - RNA, 21 nt, Human
uccucuggcaaacuuuucuuu

SEQ ID NO: 235412 - RNA, 32 nt, Human
uccucuggcaacacccucacagacacacccag

SEQ ID NO: 235413 - RNA, 19 nt, Human
uccucuggccccccagguc

SEQ ID NO: 235414 - RNA, 32 nt, Human
uccucuggccucucccugcaugucuuaaguau

SEQ ID NO: 235415 - RNA, 32 nt, Human
uccucuggcugaguuugagaagcugccaugca

SEQ ID NO: 235416 - RNA, 32 nt, Human
uccucuggcugaucccagcccuaaaggaaggg

SEQ ID NO: 235417 - RNA, 32 nt, Human
uccucuggcuucucuccuccugcuggagugcc

SEQ ID NO: 235418 - RNA, 32 nt, Human
uccucugggacccccuguggcccucgcucugc

SEQ ID NO: 235419 - RNA, 32 nt, Human
uccucugggcucccugaaguccuggggagccg

SEQ ID NO: 235420 - RNA, 32 nt, Human
uccucugggcugggcccugugucuccuccuuc

SEQ ID NO: 235421 - RNA, 32 nt, Human
uccucuggggagaaggaggagcugcucacccu

SEQ ID NO: 235422 - RNA, 32 nt, Human
uccucuggggcucuaccucuccacacuucccc

SEQ ID NO: 235423 - RNA, 32 nt, Human
uccucuggguaaugucagcugcuuagugauaa

SEQ ID NO: 235424 - RNA, 25 nt, Human
uccucuggugagaagguggugaggc

SEQ ID NO: 235425 - RNA, 32 nt, Human
uccucuggugcugcagccagagcucccuguug

SEQ ID NO: 235426 - RNA, 32 nt, Human
uccucugguuagucucucaaauugaggcuguu

SEQ ID NO: 235427 - RNA, 24 nt, Human
uccucuguaauaaacuggccaaga

SEQ ID NO: 235428 - RNA, 32 nt, Human
uccucuguaguggaagggaagggaggacacac

SEQ ID NO: 235429 - RNA, 32 nt, Human
uccucugucauuuuaaccucagguggcaccca

SEQ ID NO: 235430 - RNA, 32 nt, Human
uccucugucccccauagagucaagccuagugc

SEQ ID NO: 235431 - RNA, 32 nt, Human
uccucugucgcccaggcuggagugcaauggcg

SEQ ID NO: 235432 - RNA, 32 nt, Human
uccucugucuccuaagcuggagugcaguggca

SEQ ID NO: 235433 - RNA, 32 nt, Human
uccucugucuucaagcaccacgcagaaauaca

SEQ ID NO: 235434 - RNA, 32 nt, Human
uccucugucuuuuccacaacauaggacuuuga

SEQ ID NO: 235435 - RNA, 32 nt, Human
uccucugugagcuccauguggggccucagucu

SEQ ID NO: 235436 - RNA, 32 nt, Human
uccucugugcauaguuuugucucauuuuaacg

SEQ ID NO: 235437 - RNA, 32 nt, Human
uccucugugccugguggggugggggugccagg

SEQ ID NO: 235438 - RNA, 32 nt, Human
uccucugugcgccucagacucggggugaggga

SEQ ID NO: 235439 - RNA, 32 nt, Human
uccucuguggcccaggcugaagagcaguagug

SEQ ID NO: 235440 - RNA, 32 nt, Human
uccucuguggccugggagaccucugcccagac

SEQ ID NO: 235441 - RNA, 20 nt, Human
uccucuguggcucacaccca

SEQ ID NO: 235442 - RNA, 32 nt, Human
uccucuguggggcucugaccucagggcuccca

SEQ ID NO: 235443 - RNA, 32 nt, Human
uccucuguuccuucuggccgggcaccacagca

SEQ ID NO: 235444 - RNA, 32 nt, Human
uccucuguucucuaccugucaugcuucaagag

SEQ ID NO: 235445 - RNA, 18 nt, Human
uccucuguucugagucag

SEQ ID NO: 235446 - RNA, 32 nt, Human
uccucuguugccaggcuggaaugccguggcgc

SEQ ID NO: 235447 - RNA, 32 nt, Human
uccucuguugcccaggcuggagugcaguggug

SEQ ID NO: 235448 - RNA, 32 nt, Human
uccucuguuuauuccuccucucccucccauug

SEQ ID NO: 235449 - RNA, 32 nt, Human
uccucuguuucuuccaauucucucuucugcuu

SEQ ID NO: 235450 - RNA, 32 nt, Human
uccucuuaccuuccuuucucuuuccuaacuua

SEQ ID NO: 235451 - RNA, 19 nt, Human
uccucuuagcucagcugag

SEQ ID NO: 235452 - RNA, 21 nt, Human
uccucuuauugaauuugccaa

SEQ ID NO: 235453 - RNA, 32 nt, Human
uccucuucaagcagcaauccaacccagagcag

SEQ ID NO: 235454 - RNA, 32 nt, Human
uccucuucacuagccucucugaagguguccug

SEQ ID NO: 235455 - RNA, 20 nt, Human
uccucuucagaaagagccaa

SEQ ID NO: 235456 - RNA, 32 nt, Human
uccucuucagcguagcucuccaccucuacccg

SEQ ID NO: 235457 - RNA, 32 nt, Human
uccucuucauagauuaaaugugcugcugugga

SEQ ID NO: 235458 - RNA, 32 nt, Human
uccucuucauucuucucagcugaggccccucc

SEQ ID NO: 235459 - RNA, 20 nt, Human
uccucuuccagagcucgcug

SEQ ID NO: 235460 - RNA, 32 nt, Human
uccucuuccauugcaguccugaugauccuaac

SEQ ID NO: 235461 - RNA, 32 nt, Human
uccucuuccccaacuucauuugcuucucucaa

SEQ ID NO: 235462 - RNA, 32 nt, Human
uccucuuccccaauccaaaccccacagucucu

SEQ ID NO: 235463 - RNA, 32 nt, Human
uccucuucccccaagcuaucugguguuggaaa

SEQ ID NO: 235464 - RNA, 20 nt, Human
uccucuucccugcacuuccc

SEQ ID NO: 235465 - RNA, 20 nt, Human
uccucuucccugucuucgcc

SEQ ID NO: 235466 - RNA, 32 nt, Human
uccucuucccuuagccucucccacccggccac

SEQ ID NO: 235467 - RNA, 32 nt, Human
uccucuuccgcuuggccccagaaaguuucggu

SEQ ID NO: 235468 - RNA, 32 nt, Human
uccucuuccgggcagaaacaauaaaaccacuu

SEQ ID NO: 235469 - RNA, 32 nt, Human
uccucuuccuauucugucaucucccucacuua

SEQ ID NO: 235470 - RNA, 32 nt, Human
uccucuuccucaacacacauacaugcacaaca

SEQ ID NO: 235471 - RNA, 17 nt, Human
uccucuuccuccagguc

SEQ ID NO: 235472 - RNA, 32 nt, Human
uccucuuccuccuccuccuccaaacucgcgag

SEQ ID NO: 235473 - RNA, 32 nt, Human
uccucuuccuccuccuccuccaccuccggcuu

SEQ ID NO: 235474 - RNA, 32 nt, Human
uccucuuccuccuccuccuccccaccaccacc

SEQ ID NO: 235475 - RNA, 19 nt, Human
uccucuuccuccucuuccu

SEQ ID NO: 235476 - RNA, 32 nt, Human
uccucuuccugccuccucaucucccuuaagca

SEQ ID NO: 235477 - RNA, 21 nt, Human
uccucuuccugccuccugucu

SEQ ID NO: 235478 - RNA, 32 nt, Human
uccucuuccugccucucucauggcuugggcug

SEQ ID NO: 235479 - RNA, 20 nt, Human
uccucuuccuggauccuccu

SEQ ID NO: 235480 - RNA, 32 nt, Human
uccucuuccuucugcuucugugacgguuuaga

SEQ ID NO: 235481 - RNA, 32 nt, Human
uccucuuccuuucccuuccuucucuuuucuuu

SEQ ID NO: 235482 - RNA, 21 nt, Human
uccucuuccuuuccuccuccc

SEQ ID NO: 235483 - RNA, 32 nt, Human
uccucuuccuuuucucuucacgcuucuuuaca

SEQ ID NO: 235484 - RNA, 32 nt, Human
uccucuucguccugaugcugcucuucuucacu

SEQ ID NO: 235485 - RNA, 32 nt, Human
uccucuucuaaccugcuuucugaggcuucugc

SEQ ID NO: 235486 - RNA, 32 nt, Human
uccucuucuagacugcauuagauucauucauc

SEQ ID NO: 235487 - RNA, 32 nt, Human
uccucuucucaaagcugggauuacagguguga

SEQ ID NO: 235488 - RNA, 21 nt, Human
uccucuucucagagaccuccc

SEQ ID NO: 235489 - RNA, 32 nt, Human
uccucuucucaguguuucccaaaggggcggcu

SEQ ID NO: 235490 - RNA, 32 nt, Human
uccucuucuccccucacuuuucccuacuuccu

SEQ ID NO: 235491 - RNA, 22 nt, Human
uccucuucuccucccucuuccc

SEQ ID NO: 235492 - RNA, 32 nt, Human
uccucuucuccucuccgcacaucugcaugccu

SEQ ID NO: 235493 - RNA, 19 nt, Human
uccucuucucgcccuuccc

SEQ ID NO: 235494 - RNA, 21 nt, Human
uccucuucucggagaccuccc

SEQ ID NO: 235495 - RNA, 32 nt, Human
uccucuucucugcaguugagguuucagguuuc

SEQ ID NO: 235496 - RNA, 22 nt, Human
uccucuucucuuaguucucucc

SEQ ID NO: 235497 - RNA, 32 nt, Human
uccucuucugcagugccagcugacuuaaggga

SEQ ID NO: 235498 - RNA, 32 nt, Human
uccucuucuuccuccucuuccuccuccucuug

SEQ ID NO: 235499 - RNA, 32 nt, Human
uccucuucuuguaguccaucucccagacuugu

SEQ ID NO: 235500 - RNA, 32 nt, Human
uccucuucuuugcauauuucccccucuaauua

SEQ ID NO: 235501 - RNA, 31 nt, Human
uccucuugacuucuuuuuguaacaaggauaa

SEQ ID NO: 235502 - RNA, 32 nt, Human
uccucuugaugauucuaacagaccugcuuccu

SEQ ID NO: 235503 - RNA, 21 nt, Human
uccucuugcaguaccgccugc

SEQ ID NO: 235504 - RNA, 32 nt, Human
uccucuugcccucugcuuuacucucauguggc

SEQ ID NO: 235505 - RNA, 32 nt, Human
uccucuugcccugauuucauccucccuauccc

SEQ ID NO: 235506 - RNA, 23 nt, Human
uccucuugccuacccuguccugc

SEQ ID NO: 235507 - RNA, 23 nt, Human
uccucuugcuagcucggcccagc

SEQ ID NO: 235508 - RNA, 32 nt, Human
uccucuugcugcuaaucucugcugugaacaca

SEQ ID NO: 235509 - RNA, 22 nt, Human
uccucuugcugucucugcccgc

SEQ ID NO: 235510 - RNA, 32 nt, Human
uccucuuggaaaaagcgccaaauguuugaagg

SEQ ID NO: 235511 - RNA, 32 nt, Human
uccucuuggcucuauugggagccucagggccg

SEQ ID NO: 235512 - RNA, 32 nt, Human
uccucuugucagaaugaauauagacacaugua

SEQ ID NO: 235513 - RNA, 23 nt, Human
uccucuuguccccccguugcugc

SEQ ID NO: 235514 - RNA, 22 nt, Human
uccucuugucccuccugagaaa

SEQ ID NO: 235515 - RNA, 32 nt, Human
uccucuuguccuccucagccucggugccuugg

SEQ ID NO: 235516 - RNA, 32 nt, Human
uccucuuguccugcagaggcaggcugguguga

SEQ ID NO: 235517 - RNA, 32 nt, Human
uccucuuguccuggcccuucagucugcuccac

SEQ ID NO: 235518 - RNA, 32 nt, Human
uccucuugugaugagacugagauacagaucag

SEQ ID NO: 235519 - RNA, 32 nt, Human
uccucuugugccuaguuaagugggaauguguu

SEQ ID NO: 235520 - RNA, 21 nt, Human
uccucuugugcuucuguacca

SEQ ID NO: 235521 - RNA, 24 nt, Human
uccucuuguucccugcuggccugc

SEQ ID NO: 235522 - RNA, 32 nt, Human
uccucuuuauaagaaaaggaacacgugagcaa

SEQ ID NO: 235523 - RNA, 32 nt, Human
uccucuuuauucucucccgcccuccuacaagc

SEQ ID NO: 235524 - RNA, 31 nt, Human
uccucuuucaauaaacccccauugaaacagc

SEQ ID NO: 235525 - RNA, 32 nt, Human
uccucuuucaaugugugaaccugccuaaagca

SEQ ID NO: 235526 - RNA, 32 nt, Human
uccucuuuccucucuuuguucucagcuccccc

SEQ ID NO: 235527 - RNA, 32 nt, Human
uccucuuucuccuccuccuuauccgaacccca

SEQ ID NO: 235528 - RNA, 32 nt, Human
uccucuuucuuuccuuucuuuccucccuuuuu

SEQ ID NO: 235529 - RNA, 32 nt, Human
uccucuuugcagaaguucuguguccaucucau

SEQ ID NO: 235530 - RNA, 32 nt, Human
uccucuuugccugucuucugucuuccuugucu

SEQ ID NO: 235531 - RNA, 32 nt, Human
uccucuuugcgcccuuucucucccucuuggug

SEQ ID NO: 235532 - RNA, 32 nt, Human
uccucuuugucuacuuggacagcugcagcagg

SEQ ID NO: 235533 - RNA, 32 nt, Human
uccucuuuuccaccauccaaaacccucuuaau

SEQ ID NO: 235534 - RNA, 32 nt, Human
uccucuuuucccccuucucucucccucucccu

SEQ ID NO: 235535 - RNA, 32 nt, Human
uccucuuuugccaggcuggaugcugucgucuc

SEQ ID NO: 235536 - RNA, 32 nt, Human
uccugaaaagagacuugguuuggggaccccac

SEQ ID NO: 235537 - RNA, 32 nt, Human
uccugaaaagccugcagaacugugagccaauu

SEQ ID NO: 235538 - RNA, 32 nt, Human
uccugaaaaugcugcaguauaaaagagcaaag

SEQ ID NO: 235539 - RNA, 32 nt, Human
uccugaaacagcauauaucacugugaaacuaa

SEQ ID NO: 235540 - RNA, 32 nt, Human
uccugaaacucuucucccuuguuuuaucugau

SEQ ID NO: 235541 - RNA, 32 nt, Human
uccugaaagauuccuuuccuauccauccuucc

SEQ ID NO: 235542 - RNA, 32 nt, Human
uccugaaagccuggccugcuccgcgugucccc

SEQ ID NO: 235543 - RNA, 32 nt, Human
uccugaaagcuaguaaagacugacugccaguc

SEQ ID NO: 235544 - RNA, 32 nt, Human
uccugaaaggaucuggagacaccagcuccaca

SEQ ID NO: 235545 - RNA, 26 nt, Human
uccugaaaucacagggcagggggcug

SEQ ID NO: 235546 - RNA, 32 nt, Human
uccugaaaugauuuuucuuccuaacugugguu

SEQ ID NO: 235547 - RNA, 32 nt, Human
uccugaaaugccaagugccugcuuaguagcuu

SEQ ID NO: 235548 - RNA, 32 nt, Human
uccugaaauguggacucuggcagcaguggacc

SEQ ID NO: 235549 - RNA, 32 nt, Human
uccugaaauucaugggcuuccucgggggcccg

SEQ ID NO: 235550 - RNA, 22 nt, Human
uccugaacacacccugaagaaa

SEQ ID NO: 235551 - RNA, 32 nt, Human
uccugaacacauugccuccucaucuucuuccu

SEQ ID NO: 235552 - RNA, 32 nt, Human
uccugaacacuauccugaguaauuaugaccac

SEQ ID NO: 235553 - RNA, 32 nt, Human
uccugaacaggguggaggggugugggaaagaa

SEQ ID NO: 235554 - RNA, 21 nt, Human
uccugaaccaggaggcuucau

SEQ ID NO: 235555 - RNA, 32 nt, Human
uccugaaccugcgcugucuggguggccacaca

SEQ ID NO: 235556 - RNA, 32 nt, Human
uccugaaccuggaugagguguuuaaggucaug

SEQ ID NO: 235557 - RNA, 32 nt, Human
uccugaacuauaacaccugccaccacuauaaa

SEQ ID NO: 235558 - RNA, 32 nt, Human
uccugaacucaagugauccgcccaccucagcc

SEQ ID NO: 235559 - RNA, 32 nt, Human
uccugaacucaagugauucacccaccuuagcc

SEQ ID NO: 235560 - RNA, 23 nt, Human
uccugaacugaggaauguguccu

SEQ ID NO: 235561 - RNA, 32 nt, Human
uccugaacuuucucccucaucggcccggcgcu

SEQ ID NO: 235562 - RNA, 22 nt, Human
uccugaacuuuucuuucuucca

SEQ ID NO: 235563 - RNA, 24 nt, Human
uccugaagaaacugaacacuguca

SEQ ID NO: 235564 - RNA, 32 nt, Human
uccugaagaccugaacaccgcucccauaaagc

SEQ ID NO: 235565 - RNA, 32 nt, Human
uccugaagagcugaguguucucacuuugguuu

SEQ ID NO: 235566 - RNA, 32 nt, Human
uccugaagagggcugacagcugcaggcugccu

SEQ ID NO: 235567 - RNA, 32 nt, Human
uccugaagccagccucuccaaugccucagcca

SEQ ID NO: 235568 - RNA, 32 nt, Human
uccugaagcccaacgauggaccauucucaccc

SEQ ID NO: 235569 - RNA, 32 nt, Human
uccugaagccccgggaggagaggaaggcagcg

SEQ ID NO: 235570 - RNA, 32 nt, Human
uccugaagcgcaggcagggggaucauuggcuc

SEQ ID NO: 235571 - RNA, 32 nt, Human
uccugaagcuguuucuggagagccacacauuu

SEQ ID NO: 235572 - RNA, 22 nt, Human
uccugaaggacacugacuguca

SEQ ID NO: 235573 - RNA, 32 nt, Human
uccugaaggucacugacaaagacuucauuguc

SEQ ID NO: 235574 - RNA, 32 nt, Human
uccugaaggugaagcaaagucuaaagaaaggg

SEQ ID NO: 235575 - RNA, 32 nt, Human
uccugaauagauagcuuuauuccuucaaggua

SEQ ID NO: 235576 - RNA, 32 nt, Human
uccugaauauagaaugaauaucuuuaugacaa

SEQ ID NO: 235577 - RNA, 32 nt, Human
uccugaauauuaucaaugcagaacagcugugg

SEQ ID NO: 235578 - RNA, 32 nt, Human
uccugaaucaaauucugcaguggaauggagag

SEQ ID NO: 235579 - RNA, 32 nt, Human
uccugaaugcuaggcuggaaaguggugccugu

SEQ ID NO: 235580 - RNA, 21 nt, Human
uccugaauguggcugaccugg

SEQ ID NO: 235581 - RNA, 32 nt, Human
uccugaauucaagugauucuccugccucagcc

SEQ ID NO: 235582 - RNA, 32 nt, Human
uccugaauuccaacucuccauacaucccaaug

SEQ ID NO: 235583 - RNA, 32 nt, Human
uccugacaaaggcggcuucugcgucgucacug

SEQ ID NO: 235584 - RNA, 32 nt, Human
uccugacaccugcugccugcaggcauucacug

SEQ ID NO: 235585 - RNA, 32 nt, Human
uccugacagagcaccugcuguuuuuaugaagc

SEQ ID NO: 235586 - RNA, 32 nt, Human
uccugacagccccuuuacagguuacaucauug

SEQ ID NO: 235587 - RNA, 27 nt, Human
uccugacagcgcugccugcaaaauaga

SEQ ID NO: 235588 - RNA, 32 nt, Human
uccugacagcuccgucauggcacuuuuuaacg

SEQ ID NO: 235589 - RNA, 32 nt, Human
uccugacaggaaagguuuaagggggacagagc

SEQ ID NO: 235590 - RNA, 21 nt, Human
uccugacaucaggugauccac

SEQ ID NO: 235591 - RNA, 32 nt, Human
uccugacauggaggccugggccagcagcagca

SEQ ID NO: 235592 - RNA, 19 nt, Human
uccugaccaagugauccac

SEQ ID NO: 235593 - RNA, 24 nt, Human
uccugaccacaugugguccaccca

SEQ ID NO: 235594 - RNA, 32 nt, Human
uccugaccaccccgccccagaccugcuuucuc

SEQ ID NO: 235595 - RNA, 22 nt, Human
uccugaccacgugauccgccca

SEQ ID NO: 235596 - RNA, 21 nt, Human
uccugaccagagucucagugg

SEQ ID NO: 235597 - RNA, 32 nt, Human
uccugaccagcaaccaggcccugcugcagcuu

SEQ ID NO: 235598 - RNA, 32 nt, Human
uccugaccagugaacaaagauuugagaaagac

SEQ ID NO: 235599 - RNA, 32 nt, Human
uccugaccaucuuuccccggaggucucuucca

SEQ ID NO: 235600 - RNA, 32 nt, Human
uccugaccccaauccccaaccucccaggacug

SEQ ID NO: 235601 - RNA, 24 nt, Human
uccugaccccaggugauccgccca

SEQ ID NO: 235602 - RNA, 24 nt, Human
uccugaccccaggugaucugccca

SEQ ID NO: 235603 - RNA, 22 nt, Human
uccugaccccaugauccacccg

SEQ ID NO: 235604 - RNA, 32 nt, Human
uccugacccccaccauccccagagccuggguu

SEQ ID NO: 235605 - RNA, 22 nt, Human
uccugaccccugaccucaucac

SEQ ID NO: 235606 - RNA, 32 nt, Human
uccugacccggauuggcccugccccucccccu

SEQ ID NO: 235607 - RNA, 25 nt, Human
uccugacccucaagugaucugccca

SEQ ID NO: 235608 - RNA, 19 nt, Human
uccugacccugugauccac

SEQ ID NO: 235609 - RNA, 22 nt, Human
uccugacccugugauccgcccg

SEQ ID NO: 235610 - RNA, 32 nt, Human
uccugacccuuggagccagaaguggccccucu

SEQ ID NO: 235611 - RNA, 24 nt, Human
uccugaccgcaagugauccacccg

SEQ ID NO: 235612 - RNA, 21 nt, Human
uccugaccgcaggugauccac

SEQ ID NO: 235613 - RNA, 32 nt, Human
uccugaccgcauaauccacccaccucggccuc

SEQ ID NO: 235614 - RNA, 32 nt, Human
uccugaccggcaccuggcgaggcucaugcguc

SEQ ID NO: 235615 - RNA, 32 nt, Human
uccugaccuaaccuuagaacuggauuagggug

SEQ ID NO: 235616 - RNA, 24 nt, Human
uccugaccucaaacgaucugccca

SEQ ID NO: 235617 - RNA, 21 nt, Human
uccugaccucaaaugauccac

SEQ ID NO: 235618 - RNA, 24 nt, Human
uccugaccucaacugguccacccg

SEQ ID NO: 235619 - RNA, 24 nt, Human
uccugaccucaagcgauccaccca

SEQ ID NO: 235620 - RNA, 24 nt, Human
uccugaccucaagcgaucugcccg

SEQ ID NO: 235621 - RNA, 22 nt, Human
uccugaccucaaggaucugucu

SEQ ID NO: 235622 - RNA, 32 nt, Human
uccugaccucaagggaauuggucccagguaca

SEQ ID NO: 235623 - RNA, 21 nt, Human
uccugaccucaaguaauccac

SEQ ID NO: 235624 - RNA, 32 nt, Human
uccugaccucaagugauauguucaccucagcc

SEQ ID NO: 235625 - RNA, 20 nt, Human
uccugaccucaagugaucca

SEQ ID NO: 235626 - RNA, 21 nt, Human
uccugaccucaagugauccac

SEQ ID NO: 235627 - RNA, 23 nt, Human
uccugaccucaagugauccacca

SEQ ID NO: 235628 - RNA, 32 nt, Human
uccugaccucaagugauccaccacuuccgccu

SEQ ID NO: 235629 - RNA, 24 nt, Human
uccugaccucaagugauccaccca

SEQ ID NO: 235630 - RNA, 32 nt, Human
uccugaccucaagugauccacccaccucagcc

SEQ ID NO: 235631 - RNA, 32 nt, Human
uccugaccucaagugauccacccaccucggcc

SEQ ID NO: 235632 - RNA, 32 nt, Human
uccugaccucaagugauccacccaccucgucu

SEQ ID NO: 235633 - RNA, 32 nt, Human
uccugaccucaagugauccacccaccuuggcc

SEQ ID NO: 235634 - RNA, 32 nt, Human
uccugaccucaagugauccacccacuucagcc

SEQ ID NO: 235635 - RNA, 32 nt, Human
uccugaccucaagugauccacccaucucagcc

SEQ ID NO: 235636 - RNA, 24 nt, Human
uccugaccucaagugauccacccg

SEQ ID NO: 235637 - RNA, 32 nt, Human
uccugaccucaagugauccacccgccucaguc

SEQ ID NO: 235638 - RNA, 32 nt, Human
uccugaccucaagugauccacccgccucggcc

SEQ ID NO: 235639 - RNA, 32 nt, Human
uccugaccucaagugauccacccgccuugacu

SEQ ID NO: 235640 - RNA, 32 nt, Human
uccugaccucaagugauccacccgccuuggcc

SEQ ID NO: 235641 - RNA, 32 nt, Human
uccugaccucaagugauccaccuaccuaggcc

SEQ ID NO: 235642 - RNA, 32 nt, Human
uccugaccucaagugauccaccuaccucggcc

SEQ ID NO: 235643 - RNA, 32 nt, Human
uccugaccucaagugauccaccugccucagcc

SEQ ID NO: 235644 - RNA, 32 nt, Human
uccugaccucaagugauccaccuuccuugugc

SEQ ID NO: 235645 - RNA, 22 nt, Human
uccugaccucaagugauccacu

SEQ ID NO: 235646 - RNA, 32 nt, Human
uccugaccucaagugauccacucaccucggcc

SEQ ID NO: 235647 - RNA, 32 nt, Human
uccugaccucaagugauccacugccucagccu

SEQ ID NO: 235648 - RNA, 32 nt, Human
uccugaccucaagugauccacuggccuuggcc

SEQ ID NO: 235649 - RNA, 32 nt, Human
uccugaccucaagugauccacuugccucagcc

SEQ ID NO: 235650 - RNA, 32 nt, Human
uccugaccucaagugauccacuugccucagcu

SEQ ID NO: 235651 - RNA, 21 nt, Human
uccugaccucaagugauccgc

SEQ ID NO: 235652 - RNA, 24 nt, Human
uccugaccucaagugauccgcccg

SEQ ID NO: 235653 - RNA, 32 nt, Human
uccugaccucaagugauccgcccgccuugguc

SEQ ID NO: 235654 - RNA, 32 nt, Human
uccugaccucaagugauccgcccgcuuggccu

SEQ ID NO: 235655 - RNA, 32 nt, Human
uccugaccucaagugauccgccucccuuggcc

SEQ ID NO: 235656 - RNA, 32 nt, Human
uccugaccucaagugauccgccugccucagcc

SEQ ID NO: 235657 - RNA, 32 nt, Human
uccugaccucaagugauccgccugccuuggcc

SEQ ID NO: 235658 - RNA, 32 nt, Human
uccugaccucaagugauccguccgccugggcc

SEQ ID NO: 235659 - RNA, 32 nt, Human
uccugaccucaagugauccucccaccucagcc

SEQ ID NO: 235660 - RNA, 32 nt, Human
uccugaccucaagugauccuccccaccuuggu

SEQ ID NO: 235661 - RNA, 32 nt, Human
uccugaccucaagugauccucucgccuuggcc

SEQ ID NO: 235662 - RNA, 32 nt, Human
uccugaccucaagugauccucucuccuuggcc

SEQ ID NO: 235663 - RNA, 32 nt, Human
uccugaccucaagugaucggcccaccucagcc

SEQ ID NO: 235664 - RNA, 21 nt, Human
uccugaccucaagugaucuac

SEQ ID NO: 235665 - RNA, 24 nt, Human
uccugaccucaagugaucuaccca

SEQ ID NO: 235666 - RNA, 32 nt, Human
uccugaccucaagugaucuacccaccucggcu

SEQ ID NO: 235667 - RNA, 24 nt, Human
uccugaccucaagugaucugccca

SEQ ID NO: 235668 - RNA, 32 nt, Human
uccugaccucaagugaucugcccaccucagcc

SEQ ID NO: 235669 - RNA, 32 nt, Human
uccugaccucaagugaucugcccaccuugguc

SEQ ID NO: 235670 - RNA, 32 nt, Human
uccugaccucaagugaucugcccacuucggac

SEQ ID NO: 235671 - RNA, 24 nt, Human
uccugaccucaagugaucugcccg

SEQ ID NO: 235672 - RNA, 32 nt, Human
uccugaccucaagugaucugcccgccucagcc

SEQ ID NO: 235673 - RNA, 32 nt, Human
uccugaccucaagugaucugcccgccucgacc

SEQ ID NO: 235674 - RNA, 32 nt, Human
uccugaccucaagugaucugcccgccucggcc

SEQ ID NO: 235675 - RNA, 32 nt, Human
uccugaccucaagugaucugcccgccuuggcc

SEQ ID NO: 235676 - RNA, 32 nt, Human
uccugaccucaagugaucugcccuccucagcc

SEQ ID NO: 235677 - RNA, 32 nt, Human
uccugaccucaagugaucugccuaccuuggcc

SEQ ID NO: 235678 - RNA, 32 nt, Human
uccugaccucaagugaucugccugccucagcc

SEQ ID NO: 235679 - RNA, 32 nt, Human
uccugaccucaagugaucugccugccucgucc

SEQ ID NO: 235680 - RNA, 32 nt, Human
uccugaccucaagugaucugccugccuugguc

SEQ ID NO: 235681 - RNA, 32 nt, Human
uccugaccucaagugaucuucccaccuuggcc

SEQ ID NO: 235682 - RNA, 32 nt, Human
uccugaccucaagugaucuuccggccucagcc

SEQ ID NO: 235683 - RNA, 24 nt, Human
uccugaccucaagugauuugccca

SEQ ID NO: 235684 - RNA, 32 nt, Human
uccugaccucaagugguccacccaccuuggcc

SEQ ID NO: 235685 - RNA, 32 nt, Human
uccugaccucacacaauccuccugccuuagcc

SEQ ID NO: 235686 - RNA, 20 nt, Human
uccugaccucagacucacuu

SEQ ID NO: 235687 - RNA, 21 nt, Human
uccugaccucagauaauccac

SEQ ID NO: 235688 - RNA, 24 nt, Human
uccugaccucagauaaucugcccg

SEQ ID NO: 235689 - RNA, 21 nt, Human
uccugaccucagaugacccac

SEQ ID NO: 235690 - RNA, 21 nt, Human
uccugaccucagaugauccac

SEQ ID NO: 235691 - RNA, 21 nt, Human
uccugaccucagaugauccgc

SEQ ID NO: 235692 - RNA, 23 nt, Human
uccugaccucagaugaucuacca

SEQ ID NO: 235693 - RNA, 24 nt, Human
uccugaccucagaugaucuacccg

SEQ ID NO: 235694 - RNA, 24 nt, Human
uccugaccucagaugaucugccca

SEQ ID NO: 235695 - RNA, 24 nt, Human
uccugaccucagaugauucacccg

SEQ ID NO: 235696 - RNA, 24 nt, Human
uccugaccucagaugguccaccca

SEQ ID NO: 235697 - RNA, 24 nt, Human
uccugaccucaggcaaucugcccg

SEQ ID NO: 235698 - RNA, 21 nt, Human
uccugaccucaggcgauccac

SEQ ID NO: 235699 - RNA, 24 nt, Human
uccugaccucaggcgauccgcccg

SEQ ID NO: 235700 - RNA, 24 nt, Human
uccugaccucaggcgaucuacccg

SEQ ID NO: 235701 - RNA, 24 nt, Human
uccugaccucaggcgaucugccca

SEQ ID NO: 235702 - RNA, 24 nt, Human
uccugaccucaggggauccacccg

SEQ ID NO: 235703 - RNA, 21 nt, Human
uccugaccucagguaauccac

SEQ ID NO: 235704 - RNA, 24 nt, Human
uccugaccucagguaauccgccca

SEQ ID NO: 235705 - RNA, 23 nt, Human
uccugaccucagguaauccgucu

SEQ ID NO: 235706 - RNA, 21 nt, Human
uccugaccucagguaaucgac

SEQ ID NO: 235707 - RNA, 24 nt, Human
uccugaccucaggugagccacccg

SEQ ID NO: 235708 - RNA, 21 nt, Human
uccugaccucaggugagccgc

SEQ ID NO: 235709 - RNA, 23 nt, Human
uccugaccucaggugaucaccgc

SEQ ID NO: 235710 - RNA, 19 nt, Human
uccugaccucaggugaucc

SEQ ID NO: 235711 - RNA, 23 nt, Human
uccugaccucaggugauccaacu

SEQ ID NO: 235712 - RNA, 21 nt, Human
uccugaccucaggugauccac

SEQ ID NO: 235713 - RNA, 23 nt, Human
uccugaccucaggugauccacca

SEQ ID NO: 235714 - RNA, 24 nt, Human
uccugaccucaggugauccaccca

SEQ ID NO: 235715 - RNA, 24 nt, Human
uccugaccucaggugauccacccg

SEQ ID NO: 235716 - RNA, 23 nt, Human
uccugaccucaggugauccacuc

SEQ ID NO: 235717 - RNA, 23 nt, Human
uccugaccucaggugauccauca

SEQ ID NO: 235718 - RNA, 32 nt, Human
uccugaccucaggugauccaucagccugggcc

SEQ ID NO: 235719 - RNA, 24 nt, Human
uccugaccucaggugauccgaccg

SEQ ID NO: 235720 - RNA, 21 nt, Human
uccugaccucaggugauccgc

SEQ ID NO: 235721 - RNA, 24 nt, Human
uccugaccucaggugauccgccca

SEQ ID NO: 235722 - RNA, 24 nt, Human
uccugaccucaggugauccgcccg

SEQ ID NO: 235723 - RNA, 24 nt, Human
uccugaccucaggugauccgucca

SEQ ID NO: 235724 - RNA, 23 nt, Human
uccugaccucaggugauccgucu

SEQ ID NO: 235725 - RNA, 32 nt, Human
uccugaccucaggugauccucccaccucggcc

SEQ ID NO: 235726 - RNA, 32 nt, Human
uccugaccucaggugauccucccgccucggcc

SEQ ID NO: 235727 - RNA, 32 nt, Human
uccugaccucaggugauccuccugccucggcc

SEQ ID NO: 235728 - RNA, 21 nt, Human
uccugaccucaggugaucuac

SEQ ID NO: 235729 - RNA, 24 nt, Human
uccugaccucaggugaucuaccca

SEQ ID NO: 235730 - RNA, 21 nt, Human
uccugaccucaggugaucugc

SEQ ID NO: 235731 - RNA, 24 nt, Human
uccugaccucaggugaucugccca

SEQ ID NO: 235732 - RNA, 24 nt, Human
uccugaccucaggugaucugcccg

SEQ ID NO: 235733 - RNA, 21 nt, Human
uccugaccucaggugaucugu

SEQ ID NO: 235734 - RNA, 21 nt, Human
uccugaccucaggugaugcac

SEQ ID NO: 235735 - RNA, 24 nt, Human
uccugaccucaggugaugcaccca

SEQ ID NO: 235736 - RNA, 23 nt, Human
uccugaccucaggugauucacca

SEQ ID NO: 235737 - RNA, 23 nt, Human
uccugaccucaggugauucgccg

SEQ ID NO: 235738 - RNA, 21 nt, Human
uccugaccucaggugcuccac

SEQ ID NO: 235739 - RNA, 21 nt, Human
uccugaccucaguugauccac

SEQ ID NO: 235740 - RNA, 24 nt, Human
uccugaccucaguugauccaccca

SEQ ID NO: 235741 - RNA, 24 nt, Human
uccugaccucaguugauccacccg

SEQ ID NO: 235742 - RNA, 21 nt, Human
uccugaccucaguugauccgc

SEQ ID NO: 235743 - RNA, 22 nt, Human
uccugaccucauauuccacccg

SEQ ID NO: 235744 - RNA, 22 nt, Human
uccugaccucaugagccgcccg

SEQ ID NO: 235745 - RNA, 32 nt, Human
uccugaccucaugauccacccaccucagccuc

SEQ ID NO: 235746 - RNA, 32 nt, Human
uccugaccucaugauccacccaccucagccuu

SEQ ID NO: 235747 - RNA, 32 nt, Human
uccugaccucaugauccacccaccucggccuc

SEQ ID NO: 235748 - RNA, 32 nt, Human
uccugaccucaugauccucccgccucagccuc

SEQ ID NO: 235749 - RNA, 32 nt, Human
uccugaccucaugauccucccgccucggccuc

SEQ ID NO: 235750 - RNA, 19 nt, Human
uccugaccucaugaucugc

SEQ ID NO: 235751 - RNA, 22 nt, Human
uccugaccucaugaucugccca

SEQ ID NO: 235752 - RNA, 32 nt, Human
uccugaccucaugaucugcccaccucggccuc

SEQ ID NO: 235753 - RNA, 22 nt, Human
uccugaccucaugaucugcccg

SEQ ID NO: 235754 - RNA, 24 nt, Human
uccugaccucauguaauccaccca

SEQ ID NO: 235755 - RNA, 32 nt, Human
uccugaccuccaggaugucucccgguuucuuc

SEQ ID NO: 235756 - RNA, 24 nt, Human
uccugaccuccagugaucugccca

SEQ ID NO: 235757 - RNA, 32 nt, Human
uccugaccuccccucauuguggccccacaccc

SEQ ID NO: 235758 - RNA, 32 nt, Human
uccugaccuccgagccucagcuaugcccucug

SEQ ID NO: 235759 - RNA, 24 nt, Human
uccugaccuccggugaucugccca

SEQ ID NO: 235760 - RNA, 22 nt, Human
uccugaccuccugauccaccca

SEQ ID NO: 235761 - RNA, 32 nt, Human
uccugaccuccugauccacccaccucagcguc

SEQ ID NO: 235762 - RNA, 22 nt, Human
uccugaccuccugauccgccca

SEQ ID NO: 235763 - RNA, 32 nt, Human
uccugaccuccugauccgcccaccucagccuc

SEQ ID NO: 235764 - RNA, 32 nt, Human
uccugaccuccugauccgcccaccucggccag

SEQ ID NO: 235765 - RNA, 32 nt, Human
uccugaccuccuggugggguuggagcaucugu

SEQ ID NO: 235766 - RNA, 24 nt, Human
uccugaccucgggugauccacccg

SEQ ID NO: 235767 - RNA, 19 nt, Human
uccugaccucguaauccac

SEQ ID NO: 235768 - RNA, 22 nt, Human
uccugaccucgugacccacccg

SEQ ID NO: 235769 - RNA, 21 nt, Human
uccugaccucgugagccacca

SEQ ID NO: 235770 - RNA, 32 nt, Human
uccugaccucgugaucagcccaccucagccuc

SEQ ID NO: 235771 - RNA, 32 nt, Human
uccugaccucgugauccacccaccucagccuc

SEQ ID NO: 235772 - RNA, 32 nt, Human
uccugaccucgugauccacccaccucaggaag

SEQ ID NO: 235773 - RNA, 32 nt, Human
uccugaccucgugauccacccaccucggccuc

SEQ ID NO: 235774 - RNA, 32 nt, Human
uccugaccucgugauccgcccaccucagccuc

SEQ ID NO: 235775 - RNA, 32 nt, Human
uccugaccucgugauccgcccaccucggccuc

SEQ ID NO: 235776 - RNA, 32 nt, Human
uccugaccucgugaucuacccaccucggucuc

SEQ ID NO: 235777 - RNA, 22 nt, Human
uccugaccucgugaucugccca

SEQ ID NO: 235778 - RNA, 32 nt, Human
uccugaccucgugaucugcccaccucagccuc

SEQ ID NO: 235779 - RNA, 32 nt, Human
uccugaccucgugaucugcccaccucagccug

SEQ ID NO: 235780 - RNA, 32 nt, Human
uccugaccucgugaucugcccaccucggccuc

SEQ ID NO: 235781 - RNA, 22 nt, Human
uccugaccucgugaucugcccg

SEQ ID NO: 235782 - RNA, 32 nt, Human
uccugaccucgugauucacccaccucagccuc

SEQ ID NO: 235783 - RNA, 32 nt, Human
uccugaccucgugauuggcccaccucagccuc

SEQ ID NO: 235784 - RNA, 24 nt, Human
uccugaccucugaugaucuacccg

SEQ ID NO: 235785 - RNA, 24 nt, Human
uccugaccucuggugaucugccca

SEQ ID NO: 235786 - RNA, 19 nt, Human
uccugaccucuugauccgc

SEQ ID NO: 235787 - RNA, 22 nt, Human
uccugaccucuugaucugccca

SEQ ID NO: 235788 - RNA, 21 nt, Human
uccugaccugaagugauccac

SEQ ID NO: 235789 - RNA, 32 nt, Human
uccugaccugccucccccuccccgcccgaccc

SEQ ID NO: 235790 - RNA, 21 nt, Human
uccugaccuuaagugauccac

SEQ ID NO: 235791 - RNA, 24 nt, Human
uccugaccuuaagugauccaccca

SEQ ID NO: 235792 - RNA, 32 nt, Human
uccugaccuuaagugauccacccaccucggcc

SEQ ID NO: 235793 - RNA, 32 nt, Human
uccugaccuuaagugauccacccaccuuggcc

SEQ ID NO: 235794 - RNA, 24 nt, Human
uccugaccuuacgugauccacccg

SEQ ID NO: 235795 - RNA, 23 nt, Human
uccugaccuuaggugauccacuc

SEQ ID NO: 235796 - RNA, 24 nt, Human
uccugaccuuaggugauccgcccg

SEQ ID NO: 235797 - RNA, 24 nt, Human
uccugaccuuaggugaucugccca

SEQ ID NO: 235798 - RNA, 24 nt, Human
uccugaccuuaguugaucugccca

SEQ ID NO: 235799 - RNA, 22 nt, Human
uccugaccuuauaauccgccca

SEQ ID NO: 235800 - RNA, 22 nt, Human
uccugaccuucaggugauccac

SEQ ID NO: 235801 - RNA, 24 nt, Human
uccugaccuucaucucugggcuug

SEQ ID NO: 235802 - RNA, 32 nt, Human
uccugaccuucaucucugggcuuguuccggga

SEQ ID NO: 235803 - RNA, 21 nt, Human
uccugaccuuggguaauccac

SEQ ID NO: 235804 - RNA, 23 nt, Human
uccugaccuuggugauccacccg

SEQ ID NO: 235805 - RNA, 22 nt, Human
uccugaccuugugaaccacccg

SEQ ID NO: 235806 - RNA, 32 nt, Human
uccugaccuugugauccaccuccucggccucc

SEQ ID NO: 235807 - RNA, 22 nt, Human
uccugaccuugugaucugccca

SEQ ID NO: 235808 - RNA, 22 nt, Human
uccugaccuugugaucugcccg

SEQ ID NO: 235809 - RNA, 32 nt, Human
uccugaccuugugaucugcucuccucagccuc

SEQ ID NO: 235810 - RNA, 21 nt, Human
uccugaccuuuguaucuacuc

SEQ ID NO: 235811 - RNA, 32 nt, Human
uccugacgcagggccaggacccugcccgaugc

SEQ ID NO: 235812 - RNA, 24 nt, Human
uccugacgccaggugaucugccca

SEQ ID NO: 235813 - RNA, 32 nt, Human
uccugacggccagaaccuggggugguggggag

SEQ ID NO: 235814 - RNA, 24 nt, Human
uccugacggccaggcagggaugcu

SEQ ID NO: 235815 - RNA, 32 nt, Human
uccugacggcgccuuuuuggccugugauguuu

SEQ ID NO: 235816 - RNA, 23 nt, Human
uccugacgucaagugauccauuc

SEQ ID NO: 235817 - RNA, 32 nt, Human
uccugacgucaagugauccauucgccucggcc

SEQ ID NO: 235818 - RNA, 32 nt, Human
uccugacgucaagugaucuucccgccucgacu

SEQ ID NO: 235819 - RNA, 24 nt, Human
uccugacgucaggugauccacccg

SEQ ID NO: 235820 - RNA, 24 nt, Human
uccugacgucaggugauccgccca

SEQ ID NO: 235821 - RNA, 22 nt, Human
uccugacgucgugauccacccg

SEQ ID NO: 235822 - RNA, 22 nt, Human
uccugacgucgugauccgccca

SEQ ID NO: 235823 - RNA, 24 nt, Human
uccugacucgaagugauccgccca

SEQ ID NO: 235824 - RNA, 32 nt, Human
uccugacucgaagugauccgcccaccuuggcc

SEQ ID NO: 235825 - RNA, 32 nt, Human
uccugacugcagcucuuuucauuuugccaucc

SEQ ID NO: 235826 - RNA, 32 nt, Human
uccugacuggggcuugcgacucacaggauugc

SEQ ID NO: 235827 - RNA, 24 nt, Human
uccugacuggucaggugcuacuua

SEQ ID NO: 235828 - RNA, 21 nt, Human
uccugacuucaagugauccac

SEQ ID NO: 235829 - RNA, 32 nt, Human
uccugacuucaagugauccgccugccuuggcc

SEQ ID NO: 235830 - RNA, 32 nt, Human
uccugacuucaagugaucugcccaccucugcc

SEQ ID NO: 235831 - RNA, 24 nt, Human
uccugacuucaggugacccacccg

SEQ ID NO: 235832 - RNA, 20 nt, Human
uccugacuucaggugaucca

SEQ ID NO: 235833 - RNA, 24 nt, Human
uccugacuucaggugauccacccg

SEQ ID NO: 235834 - RNA, 21 nt, Human
uccugacuucaggugauccgc

SEQ ID NO: 235835 - RNA, 23 nt, Human
uccugacuucaggugaucugucu

SEQ ID NO: 235836 - RNA, 32 nt, Human
uccugacuucaugauccacccaccucggccuc

SEQ ID NO: 235837 - RNA, 32 nt, Human
uccugacuucaugguccgccugccucagccuc

SEQ ID NO: 235838 - RNA, 23 nt, Human
uccugacuucaugugauccgcca

SEQ ID NO: 235839 - RNA, 32 nt, Human
uccugacuucauuuuguguuugccugaaaauu

SEQ ID NO: 235840 - RNA, 32 nt, Human
uccugacuuccagauuaguguuauuuuuacuu

SEQ ID NO: 235841 - RNA, 21 nt, Human
uccugacuucgcccuacugca

SEQ ID NO: 235842 - RNA, 22 nt, Human
uccugacuucguuauccacccg

SEQ ID NO: 235843 - RNA, 22 nt, Human
uccugacuucuaauaucauuca

SEQ ID NO: 235844 - RNA, 24 nt, Human
uccugacuugaaaugauccauaca

SEQ ID NO: 235845 - RNA, 32 nt, Human
uccugacuugcagccacagagauaguccugcc

SEQ ID NO: 235846 - RNA, 21 nt, Human
uccugacuuuaggugauccac

SEQ ID NO: 235847 - RNA, 23 nt, Human
uccugacuuuuuauauccaguca

SEQ ID NO: 235848 - RNA, 32 nt, Human
uccugagaaauguuaaagguucacagggguuc

SEQ ID NO: 235849 - RNA, 32 nt, Human
uccugagaacaucccucaguaacuugauauuc

SEQ ID NO: 235850 - RNA, 32 nt, Human
uccugagaagugagaguugaaagggaagcagg

SEQ ID NO: 235851 - RNA, 32 nt, Human
uccugagaauaaccuccccuccagccagagau

SEQ ID NO: 235852 - RNA, 32 nt, Human
uccugagaaugccccucccaaccacagcagcc

SEQ ID NO: 235853 - RNA, 32 nt, Human
uccugagacggggccagcggaggcagagccgg

SEQ ID NO: 235854 - RNA, 32 nt, Human
uccugagacucugcugaaguugcuuaucaggu

SEQ ID NO: 235855 - RNA, 32 nt, Human
uccugagagaggaggaggcugggcagggcccc

SEQ ID NO: 235856 - RNA, 32 nt, Human
uccugagagccccagccccacucugaccucua

SEQ ID NO: 235857 - RNA, 32 nt, Human
uccugagaggacgugggugaggggcagauuuc

SEQ ID NO: 235858 - RNA, 32 nt, Human
uccugagaguuuugagaaaaacuggcaggaag

SEQ ID NO: 235859 - RNA, 32 nt, Human
uccugagauccagcccuccaccccuucaggua

SEQ ID NO: 235860 - RNA, 32 nt, Human
uccugagaugcuguuccugggagcccccucag

SEQ ID NO: 235861 - RNA, 32 nt, Human
uccugagauggaagaucuguccucuccagacu

SEQ ID NO: 235862 - RNA, 23 nt, Human
uccugagcaacugcaucccucca

SEQ ID NO: 235863 - RNA, 22 nt, Human
uccugagcaagugacaaucuaa

SEQ ID NO: 235864 - RNA, 32 nt, Human
uccugagcagagaggaagggauggguggacuc

SEQ ID NO: 235865 - RNA, 32 nt, Human
uccugagcagccucuuuucuaggaucaauaug

SEQ ID NO: 235866 - RNA, 32 nt, Human
uccugagcagcuaaaguauuuucuccaauggc

SEQ ID NO: 235867 - RNA, 23 nt, Human
uccugagcagcugggauuacagg

SEQ ID NO: 235868 - RNA, 18 nt, Human
uccugagccaaggaggug

SEQ ID NO: 235869 - RNA, 32 nt, Human
uccugagccaaggaggugaggagcagagcagg

SEQ ID NO: 235870 - RNA, 23 nt, Human
uccugagccacugaccacggcca

SEQ ID NO: 235871 - RNA, 32 nt, Human
uccugagccacuucagaguucuggaagugacc

SEQ ID NO: 235872 - RNA, 20 nt, Human
uccugagcccaaguccccca

SEQ ID NO: 235873 - RNA, 22 nt, Human
uccugagcccaggugauccucc

SEQ ID NO: 235874 - RNA, 21 nt, Human
uccugagccccaggucucuuc

SEQ ID NO: 235875 - RNA, 32 nt, Human
uccugagccccaggucucuucagucugggcac

SEQ ID NO: 235876 - RNA, 21 nt, Human
uccugagccccgcccucuucc

SEQ ID NO: 235877 - RNA, 22 nt, Human
uccugagccccuccuggccuca

SEQ ID NO: 235878 - RNA, 24 nt, Human
uccugagcccgugucauucuucca

SEQ ID NO: 235879 - RNA, 32 nt, Human
uccugagccgaggaggagggacugcaagugga

SEQ ID NO: 235880 - RNA, 32 nt, Human
uccugagccuaaaaggccaccucugagcacuu

SEQ ID NO: 235881 - RNA, 32 nt, Human
uccugagccuccucaugcccuggaccagccug

SEQ ID NO: 235882 - RNA, 32 nt, Human
uccugagcgcaagugauccacccgucucagcc

SEQ ID NO: 235883 - RNA, 19 nt, Human
uccugagcgggcacggcca

SEQ ID NO: 235884 - RNA, 24 nt, Human
uccugagcgguuccgucuccugcu

SEQ ID NO: 235885 - RNA, 32 nt, Human
uccugagcuaacucccuguucuuucccgaggc

SEQ ID NO: 235886 - RNA, 32 nt, Human
uccugagcucaaaugauccuccugccuuggcc

SEQ ID NO: 235887 - RNA, 32 nt, Human
uccugagcucaagugauccacccaccucagcc

SEQ ID NO: 235888 - RNA, 32 nt, Human
uccugagcucaagugauccgccugccuuggcc

SEQ ID NO: 235889 - RNA, 24 nt, Human
uccugagcucaagugauccuccca

SEQ ID NO: 235890 - RNA, 32 nt, Human
uccugagcucaagugauccucccaccucagcc

SEQ ID NO: 235891 - RNA, 32 nt, Human
uccugagcucaagugauccuccuaccucaguc

SEQ ID NO: 235892 - RNA, 32 nt, Human
uccugagcucaagugauccucucuuggcuugg

SEQ ID NO: 235893 - RNA, 32 nt, Human
uccugagcucaagugauccucugccucagccu

SEQ ID NO: 235894 - RNA, 32 nt, Human
uccugagcucaagugauccuuccacccugguc

SEQ ID NO: 235895 - RNA, 32 nt, Human
uccugagcucaagugaucugcccaucucagcc

SEQ ID NO: 235896 - RNA, 32 nt, Human
uccugagcucaagugaucugcccgccucagcc

SEQ ID NO: 235897 - RNA, 32 nt, Human
uccugagcucaagugaucuuccugccuuggca

SEQ ID NO: 235898 - RNA, 24 nt, Human
uccugagcucagaugaucugccca

SEQ ID NO: 235899 - RNA, 24 nt, Human
uccugagcucaggugauccacccg

SEQ ID NO: 235900 - RNA, 24 nt, Human
uccugagcucaggugaucugccca

SEQ ID NO: 235901 - RNA, 32 nt, Human
uccugagcuccaaagauccucucaccuccacc

SEQ ID NO: 235902 - RNA, 32 nt, Human
uccugagcucugauuccucuucugucuggcug

SEQ ID NO: 235903 - RNA, 21 nt, Human
uccugagcucugccucuucca

SEQ ID NO: 235904 - RNA, 19 nt, Human
uccugagcugccacucuca

SEQ ID NO: 235905 - RNA, 22 nt, Human
uccugagcugcugcuguguuug

SEQ ID NO: 235906 - RNA, 24 nt, Human
uccugagcugcuguugcagucuaa

SEQ ID NO: 235907 - RNA, 22 nt, Human
uccugagcugcuguuuccaauc

SEQ ID NO: 235908 - RNA, 20 nt, Human
uccugagcugggauuacagg

SEQ ID NO: 235909 - RNA, 32 nt, Human
uccugagcuucagaacuagggaacugauggua

SEQ ID NO: 235910 - RNA, 32 nt, Human
uccugaggacaaagggccuggccacacuaggg

SEQ ID NO: 235911 - RNA, 22 nt, Human
uccugaggacagagacugcucu

SEQ ID NO: 235912 - RNA, 32 nt, Human
uccugaggaggaacuccaggccucccaucgug

SEQ ID NO: 235913 - RNA, 32 nt, Human
uccugaggaggcgggguuggccuaggcgaaga

SEQ ID NO: 235914 - RNA, 32 nt, Human
uccugaggauuccaggcgggacuauccagcuc

SEQ ID NO: 235915 - RNA, 32 nt, Human
uccugaggcauuucuugcccagcuggguccaa

SEQ ID NO: 235916 - RNA, 32 nt, Human
uccugaggccagcccauagcauguguuccaga

SEQ ID NO: 235917 - RNA, 32 nt, Human
uccugaggccccagaggaagagaccaugaaag

SEQ ID NO: 235918 - RNA, 32 nt, Human
uccugaggcuacacccaugcgucucuaggaac

SEQ ID NO: 235919 - RNA, 32 nt, Human
uccugaggcucccugcacugccacagcccaga

SEQ ID NO: 235920 - RNA, 32 nt, Human
uccugaggcugaggcaggaagaucacuugaac

SEQ ID NO: 235921 - RNA, 32 nt, Human
uccugagggcaccagcuguggugcaggagcca

SEQ ID NO: 235922 - RNA, 32 nt, Human
uccugagggcagcaggccugguugcagcuggc

SEQ ID NO: 235923 - RNA, 32 nt, Human
uccugagggcaguuguuugugauugccuuccc

SEQ ID NO: 235924 - RNA, 32 nt, Human
uccugagggcuggagaacacugcugggcacac

SEQ ID NO: 235925 - RNA, 32 nt, Human
uccugagggcugugucacaggccauguucacu

SEQ ID NO: 235926 - RNA, 32 nt, Human
uccugagggggaccuugggcaccuccugguau

SEQ ID NO: 235927 - RNA, 32 nt, Human
uccugaggucucauuaggaaacccucaccgcu

SEQ ID NO: 235928 - RNA, 32 nt, Human
uccugaggugucuggggagcacugcggcaaga

SEQ ID NO: 235929 - RNA, 32 nt, Human
uccugagguucccuucaccccucucucuugcc

SEQ ID NO: 235930 - RNA, 23 nt, Human
uccugaguaacuggaauugcagg

SEQ ID NO: 235931 - RNA, 23 nt, Human
uccugaguaacugggauuacagg

SEQ ID NO: 235932 - RNA, 23 nt, Human
uccugaguaccugggauuacagg

SEQ ID NO: 235933 - RNA, 32 nt, Human
uccugaguagcuggaaccacaggcaugugcca

SEQ ID NO: 235934 - RNA, 23 nt, Human
uccugaguagcugggaucacagg

SEQ ID NO: 235935 - RNA, 22 nt, Human
uccugaguagcugggauuacag

SEQ ID NO: 235936 - RNA, 23 nt, Human
uccugaguagcugggauuacagg

SEQ ID NO: 235937 - RNA, 23 nt, Human
uccugaguagcugggauugcagg

SEQ ID NO: 235938 - RNA, 32 nt, Human
uccugaguagcuggggauuacaggcgcccgcc

SEQ ID NO: 235939 - RNA, 32 nt, Human
uccugaguagcugggguugcaggugugcacca

SEQ ID NO: 235940 - RNA, 23 nt, Human
uccugaguaucugggauuacagg

SEQ ID NO: 235941 - RNA, 32 nt, Human
uccugagucaggagguugaggcugcagugagc

SEQ ID NO: 235942 - RNA, 23 nt, Human
uccugagucuccagagcucggug

SEQ ID NO: 235943 - RNA, 32 nt, Human
uccugagucugcuucagucuggagcuguuugu

SEQ ID NO: 235944 - RNA, 32 nt, Human
uccugagugcauuucccugcacugugucguca

SEQ ID NO: 235945 - RNA, 32 nt, Human
uccugagugcccaccuguccugcuucucugca

SEQ ID NO: 235946 - RNA, 23 nt, Human
uccugagugccccuuccuguccu

SEQ ID NO: 235947 - RNA, 23 nt, Human
uccugaguggcugggauuacagg

SEQ ID NO: 235948 - RNA, 23 nt, Human
uccugaguggcugggauugcagg

SEQ ID NO: 235949 - RNA, 32 nt, Human
uccugagugggccuccuuuucccacugugcca

SEQ ID NO: 235950 - RNA, 23 nt, Human
uccugagugggugccuucuccca

SEQ ID NO: 235951 - RNA, 32 nt, Human
uccugaguguccuguggguucaucucggaugg

SEQ ID NO: 235952 - RNA, 19 nt, Human
uccugaguguugccugcca

SEQ ID NO: 235953 - RNA, 32 nt, Human
uccugaguguuugcugugcuccaggcucagua

SEQ ID NO: 235954 - RNA, 32 nt, Human
uccugaguucaaaugauucuccugccucagcc

SEQ ID NO: 235955 - RNA, 32 nt, Human
uccugaguucaagcgauucuccugccucagcc

SEQ ID NO: 235956 - RNA, 32 nt, Human
uccugaguucaagucauucuccugccucagcc

SEQ ID NO: 235957 - RNA, 32 nt, Human
uccugaguucaagugauccuccugcuucagcc

SEQ ID NO: 235958 - RNA, 32 nt, Human
uccugaguucaagugauuccugugccucaguc

SEQ ID NO: 235959 - RNA, 32 nt, Human
uccugaguucacgcgauucuccugccucagcc

SEQ ID NO: 235960 - RNA, 28 nt, Human
uccugaguuugguucagauggucuguca

SEQ ID NO: 235961 - RNA, 32 nt, Human
uccugauaaauacuuucucucucaccuguacu

SEQ ID NO: 235962 - RNA, 25 nt, Human
uccugauacauggauguuucacuua

SEQ ID NO: 235963 - RNA, 32 nt, Human
uccugauacucauccugauaaucucuuaagag

SEQ ID NO: 235964 - RNA, 32 nt, Human
uccugauacucccaagagcaggccccaggggu

SEQ ID NO: 235965 - RNA, 32 nt, Human
uccugauaucaagugaucuucccgccucggcc

SEQ ID NO: 235966 - RNA, 22 nt, Human
uccugauauggcaaaaauuaaa

SEQ ID NO: 235967 - RNA, 25 nt, Human
uccugaucaccccuccccucuuccc

SEQ ID NO: 235968 - RNA, 32 nt, Human
uccugaucaccuaggcaggccugucuccaguu

SEQ ID NO: 235969 - RNA, 32 nt, Human
uccugaucacuuccuaaacugcagccuggccc

SEQ ID NO: 235970 - RNA, 32 nt, Human
uccugaucaucagaaauuucaccagaaacaac

SEQ ID NO: 235971 - RNA, 21 nt, Human
uccugaucauuauuuacccca

SEQ ID NO: 235972 - RNA, 32 nt, Human
uccugauccaagcagaacccuguuauuugaag

SEQ ID NO: 235973 - RNA, 32 nt, Human
uccugauccacggguugcacagaucuguggaa

SEQ ID NO: 235974 - RNA, 32 nt, Human
uccugaucccaucucacucucuggaccuacca

SEQ ID NO: 235975 - RNA, 32 nt, Human
uccugaucccucucccaccagacuggacucug

SEQ ID NO: 235976 - RNA, 32 nt, Human
uccugaucgagagauucacccaccucggccuc

SEQ ID NO: 235977 - RNA, 32 nt, Human
uccugaucgccaaccuuucccccaccagcuaa

SEQ ID NO: 235978 - RNA, 24 nt, Human
uccugaucucaagugaucugccca

SEQ ID NO: 235979 - RNA, 32 nt, Human
uccugaucucaagugaucugcccaccucagcc

SEQ ID NO: 235980 - RNA, 24 nt, Human
uccugaucucaggcaauccaccca

SEQ ID NO: 235981 - RNA, 24 nt, Human
uccugaucucaggugaccugccca

SEQ ID NO: 235982 - RNA, 24 nt, Human
uccugaucucaggugaucugccca

SEQ ID NO: 235983 - RNA, 32 nt, Human
uccugaucucgugguccacccaccucggcuuc

SEQ ID NO: 235984 - RNA, 23 nt, Human
uccugaucugccagggucugcuc

SEQ ID NO: 235985 - RNA, 32 nt, Human
uccugaucugucguugccaucaccuccagggg

SEQ ID NO: 235986 - RNA, 30 nt, Human
uccugaugcaccugcuggucugcgucuucg

SEQ ID NO: 235987 - RNA, 22 nt, Human
uccugaugcccuccccaccuca

SEQ ID NO: 235988 - RNA, 32 nt, Human
uccugaugcccuggugggcuuagggaaccauc

SEQ ID NO: 235989 - RNA, 32 nt, Human
uccugaugcugugcucaaucagccuggccauc

SEQ ID NO: 235990 - RNA, 27 nt, Human
uccugaugcuuuucacacuucuugucu

SEQ ID NO: 235991 - RNA, 30 nt, Human
uccugauggaguuucacuauguugcccagg

SEQ ID NO: 235992 - RNA, 32 nt, Human
uccugaugggcaaccacaccacugccuggcgc

SEQ ID NO: 235993 - RNA, 32 nt, Human
uccugauggugucauucugccugcuccaucgc

SEQ ID NO: 235994 - RNA, 32 nt, Human
uccugauguacacccaucgccaucauagcaag

SEQ ID NO: 235995 - RNA, 32 nt, Human
uccugauguagaaucauuguguugcugauuuu

SEQ ID NO: 235996 - RNA, 22 nt, Human
uccugaugucccucucccuccc

SEQ ID NO: 235997 - RNA, 32 nt, Human
uccugaugucucagcacccagcacggcuguca

SEQ ID NO: 235998 - RNA, 32 nt, Human
uccugauguuuagggacuuguccugguucauc

SEQ ID NO: 235999 - RNA, 32 nt, Human
uccugauguuuugccguggcuuggggauugua

SEQ ID NO: 236000 - RNA, 32 nt, Human
uccugauucucuucuucuaccucuacccucuc

SEQ ID NO: 236001 - RNA, 32 nt, Human
uccugauugcagcugccaugcuggcuggauau

SEQ ID NO: 236002 - RNA, 32 nt, Human
uccugauugucauuuaaaauugugacauacca

SEQ ID NO: 236003 - RNA, 32 nt, Human
uccugauuucccuaaggagccugggaugaugu

SEQ ID NO: 236004 - RNA, 32 nt, Human
uccugcaaaccuacacaccaaagcuuuauuua

SEQ ID NO: 236005 - RNA, 24 nt, Human
uccugcaaagcagaguuggcugug

SEQ ID NO: 236006 - RNA, 24 nt, Human
uccugcaaccccaggcaugaacca

SEQ ID NO: 236007 - RNA, 32 nt, Human
uccugcaacccccacugcucagccucuaggag

SEQ ID NO: 236008 - RNA, 32 nt, Human
uccugcaaccucaagagacuucccaggcgcuc

SEQ ID NO: 236009 - RNA, 21 nt, Human
uccugcaaccuccuccaccuc

SEQ ID NO: 236010 - RNA, 32 nt, Human
uccugcaaccugaaguacacagaaggaguaca

SEQ ID NO: 236011 - RNA, 32 nt, Human
uccugcaacuaaacacgagccugggcagaacc

SEQ ID NO: 236012 - RNA, 32 nt, Human
uccugcaauuggaauuccaccuuguccagccc

SEQ ID NO: 236013 - RNA, 32 nt, Human
uccugcacaagaaaccacggauucuccaguga

SEQ ID NO: 236014 - RNA, 32 nt, Human
uccugcacaagucccugcaacuggacgugcag

SEQ ID NO: 236015 - RNA, 32 nt, Human
uccugcacacucgggaccucagcuccaaggcg

SEQ ID NO: 236016 - RNA, 32 nt, Human
uccugcacacuggccuucagugguaucagcca

SEQ ID NO: 236017 - RNA, 24 nt, Human
uccugcacagcucagcccacccca

SEQ ID NO: 236018 - RNA, 32 nt, Human
uccugcaccaccagaauaaacuugccgaguuu

SEQ ID NO: 236019 - RNA, 32 nt, Human
uccugcaccagacguggggacaggguccugag

SEQ ID NO: 236020 - RNA, 32 nt, Human
uccugcaccagaggacuccugcccugccacac

SEQ ID NO: 236021 - RNA, 32 nt, Human
uccugcaccauugcugacgccuggugauccau

SEQ ID NO: 236022 - RNA, 32 nt, Human
uccugcacccacucccuucauacaaucuaguc

SEQ ID NO: 236023 - RNA, 32 nt, Human
uccugcaccgcgaccugaagcucaguaacuuc

SEQ ID NO: 236024 - RNA, 32 nt, Human
uccugcaccucacccccucggcuugguccugg

SEQ ID NO: 236025 - RNA, 23 nt, Human
uccugcaccucauccuccaccca

SEQ ID NO: 236026 - RNA, 22 nt, Human
uccugcaccuccucccucuccc

SEQ ID NO: 236027 - RNA, 24 nt, Human
uccugcacggccgcacccaccuca

SEQ ID NO: 236028 - RNA, 27 nt, Human
uccugcacggugccaccuccacacuca

SEQ ID NO: 236029 - RNA, 32 nt, Human
uccugcacuccaagggaccccuccaggggacc

SEQ ID NO: 236030 - RNA, 32 nt, Human
uccugcacucggccuggauccucauucugcac

SEQ ID NO: 236031 - RNA, 32 nt, Human
uccugcacucuuccucccucaguaaguaaaug

SEQ ID NO: 236032 - RNA, 32 nt, Human
uccugcacugaggagguggaaagaagaggauu

SEQ ID NO: 236033 - RNA, 32 nt, Human
uccugcacugcagcuuccugcuccucugacuc

SEQ ID NO: 236034 - RNA, 32 nt, Human
uccugcacugcucugacccugugaaaggacca

SEQ ID NO: 236035 - RNA, 31 nt, Human
uccugcacugugucucccacacugagaaacc

SEQ ID NO: 236036 - RNA, 32 nt, Human
uccugcagaaaagagugugaggagccagggaa

SEQ ID NO: 236037 - RNA, 32 nt, Human
uccugcagaacacacagugccuuaugccacag

SEQ ID NO: 236038 - RNA, 32 nt, Human
uccugcagaacuccaggaggcagcauucuaug

SEQ ID NO: 236039 - RNA, 21 nt, Human
uccugcagaagagacaugcag

SEQ ID NO: 236040 - RNA, 21 nt, Human
uccugcagaagcagaagugca

SEQ ID NO: 236041 - RNA, 32 nt, Human
uccugcagaccccacuccauucccgcuccugg

SEQ ID NO: 236042 - RNA, 32 nt, Human
uccugcagacuggccuaugcgcccggcccugc

SEQ ID NO: 236043 - RNA, 23 nt, Human
uccugcagagagaggagccgcag

SEQ ID NO: 236044 - RNA, 32 nt, Human
uccugcagagccucuuucccucugccacaguu

SEQ ID NO: 236045 - RNA, 32 nt, Human
uccugcagagcugcaggcaagagcagagcaau

SEQ ID NO: 236046 - RNA, 32 nt, Human
uccugcagagggucaaggagcagggauguugg

SEQ ID NO: 236047 - RNA, 21 nt, Human
uccugcagcaagagaaggcag

SEQ ID NO: 236048 - RNA, 32 nt, Human
uccugcagcacccccgggacaggcugggacca

SEQ ID NO: 236049 - RNA, 32 nt, Human
uccugcagcauggccccugccuuaggccuacc

SEQ ID NO: 236050 - RNA, 32 nt, Human
uccugcagcauggucccugccuuaggccuacc

SEQ ID NO: 236051 - RNA, 23 nt, Human
uccugcagccagugcagaugcag

SEQ ID NO: 236052 - RNA, 32 nt, Human
uccugcagccuggaaagaggagggaggccaag

SEQ ID NO: 236053 - RNA, 32 nt, Human
uccugcagccuggggaggagugugacgacggu

SEQ ID NO: 236054 - RNA, 32 nt, Human
uccugcagccuucccaguccugcugcuugugg

SEQ ID NO: 236055 - RNA, 32 nt, Human
uccugcagcucagcagaccuccuggccguggc

SEQ ID NO: 236056 - RNA, 23 nt, Human
uccugcagcucuggggagaccag

SEQ ID NO: 236057 - RNA, 32 nt, Human
uccugcagcucuggggagaccagcacagaacu

SEQ ID NO: 236058 - RNA, 32 nt, Human
uccugcagcuggcuggcuaccaguggcagcgg

SEQ ID NO: 236059 - RNA, 32 nt, Human
uccugcaggaagcaggacggggcaggcagcac

SEQ ID NO: 236060 - RNA, 32 nt, Human
uccugcaggccugagggggcuucccucugcuu

SEQ ID NO: 236061 - RNA, 32 nt, Human
uccugcaggccugcggggaucucuccccacuu

SEQ ID NO: 236062 - RNA, 32 nt, Human
uccugcaggccuggucuugcccagcugggcug

SEQ ID NO: 236063 - RNA, 32 nt, Human
uccugcaggcuggucucugagccugcccccac

SEQ ID NO: 236064 - RNA, 32 nt, Human
uccugcagggccuggagguggggaggccagag

SEQ ID NO: 236065 - RNA, 32 nt, Human
uccugcagggcuggcccuggcucgggcagggu

SEQ ID NO: 236066 - RNA, 32 nt, Human
uccugcagggugcugcucagaugccucgaccc

SEQ ID NO: 236067 - RNA, 32 nt, Human
uccugcagguguccucgggucucagguggcug

SEQ ID NO: 236068 - RNA, 32 nt, Human
uccugcagguucaagcuccucagucccaggga

SEQ ID NO: 236069 - RNA, 32 nt, Human
uccugcagguuucugugccccugugguggaag

SEQ ID NO: 236070 - RNA, 32 nt, Human
uccugcagugcccugaggacuaggcucccguc

SEQ ID NO: 236071 - RNA, 32 nt, Human
uccugcaguggaacuccaugccccgccuccca

SEQ ID NO: 236072 - RNA, 32 nt, Human
uccugcaguuuuuauccaauaacauuguggga

SEQ ID NO: 236073 - RNA, 24 nt, Human
uccugcauagcucaccccaccuca

SEQ ID NO: 236074 - RNA, 32 nt, Human
uccugcauagucuaucuuuguauaucuuugaa

SEQ ID NO: 236075 - RNA, 32 nt, Human
uccugcauaugcagaggacggagcaggcucag

SEQ ID NO: 236076 - RNA, 32 nt, Human
uccugcaucagcuacauuaauagcugauugua

SEQ ID NO: 236077 - RNA, 32 nt, Human
uccugcauccaccccugcucagagccuccaug

SEQ ID NO: 236078 - RNA, 32 nt, Human
uccugcauccagcccccaacauggugccaaag

SEQ ID NO: 236079 - RNA, 20 nt, Human
uccugcaucccucugugccu

SEQ ID NO: 236080 - RNA, 32 nt, Human
uccugcaucucccaucaccuccucaaagaaaa

SEQ ID NO: 236081 - RNA, 32 nt, Human
uccugcaucugccucuuccacuccuccagcga

SEQ ID NO: 236082 - RNA, 32 nt, Human
uccugcaugaagcacagacuucacugcuagcu

SEQ ID NO: 236083 - RNA, 32 nt, Human
uccugcaugcuccuccccuugggcucucagau

SEQ ID NO: 236084 - RNA, 32 nt, Human
uccugcauguaauauaucugcugucaucuuag

SEQ ID NO: 236085 - RNA, 20 nt, Human
uccugcaugugucaccaccc

SEQ ID NO: 236086 - RNA, 22 nt, Human
uccugcaugugucaccacccca

SEQ ID NO: 236087 - RNA, 23 nt, Human
uccugcauuccuccuccccuccu

SEQ ID NO: 236088 - RNA, 32 nt, Human
uccugcauucuagucccugcugugcugcagga

SEQ ID NO: 236089 - RNA, 22 nt, Human
uccugcauugggugaucauuca

SEQ ID NO: 236090 - RNA, 32 nt, Human
uccugccaagaguuugaccauucugcuugaga

SEQ ID NO: 236091 - RNA, 32 nt, Human
uccugccaagcauuccauugacugccuguaug

SEQ ID NO: 236092 - RNA, 32 nt, Human
uccugccacacucugcuuucuuccugccaugg

SEQ ID NO: 236093 - RNA, 32 nt, Human
uccugccacagcuuaggacagaacugggccca

SEQ ID NO: 236094 - RNA, 32 nt, Human
uccugccacauccuucucaaggugguagacug

SEQ ID NO: 236095 - RNA, 22 nt, Human
uccugccaccaagauguguucu

SEQ ID NO: 236096 - RNA, 32 nt, Human
uccugccacccacacaccacucucccuagacu

SEQ ID NO: 236097 - RNA, 18 nt, Human
uccugccaccgggaggug

SEQ ID NO: 236098 - RNA, 32 nt, Human
uccugccaccucagccucccagguacugggac

SEQ ID NO: 236099 - RNA, 32 nt, Human
uccugccaccuugugaagaugccuugguuccu

SEQ ID NO: 236100 - RNA, 32 nt, Human
uccugccacugcacaccagccugggugacaga

SEQ ID NO: 236101 - RNA, 32 nt, Human
uccugccacugcacuccagccugggcaacaga

SEQ ID NO: 236102 - RNA, 32 nt, Human
uccugccacugcacuccagccugggcgacagc

SEQ ID NO: 236103 - RNA, 32 nt, Human
uccugccacugcacuccagccugugccacaga

SEQ ID NO: 236104 - RNA, 32 nt, Human
uccugccacugcagugcucgagccccgugcag

SEQ ID NO: 236105 - RNA, 32 nt, Human
uccugccacuguaaucucuucuaauuuguaau

SEQ ID NO: 236106 - RNA, 32 nt, Human
uccugccacuucuaugucucuggaccacagga

SEQ ID NO: 236107 - RNA, 32 nt, Human
uccugccagaaagagaaugaaugacagaaaaa

SEQ ID NO: 236108 - RNA, 32 nt, Human
uccugccaggcugcccccgccugcugugcacc

SEQ ID NO: 236109 - RNA, 31 nt, Human
uccugccaggcuggauaacuguugaauggac

SEQ ID NO: 236110 - RNA, 32 nt, Human
uccugccagggugggcagacagacagauggac

SEQ ID NO: 236111 - RNA, 32 nt, Human
uccugccaguaggacaucugggcucugggcug

SEQ ID NO: 236112 - RNA, 32 nt, Human
uccugccauacccuuuuugguuccucuaauuc

SEQ ID NO: 236113 - RNA, 32 nt, Human
uccugccauagugagagaaaugggauuucauc

SEQ ID NO: 236114 - RNA, 32 nt, Human
uccugccaucaaauauuuuuaguagaaaaagc

SEQ ID NO: 236115 - RNA, 19 nt, Human
uccugccauccacacuaug

SEQ ID NO: 236116 - RNA, 32 nt, Human
uccugccauccacacuaugagcauuuugaaau

SEQ ID NO: 236117 - RNA, 32 nt, Human
uccugccaucccugcacacagccuggggagaa

SEQ ID NO: 236118 - RNA, 32 nt, Human
uccugccauucuucuguggggcgggcuuccca

SEQ ID NO: 236119 - RNA, 32 nt, Human
uccugccauuucuccccucucuuccuucaucu

SEQ ID NO: 236120 - RNA, 32 nt, Human
uccugcccaagugacagcugcggcagccccuc

SEQ ID NO: 236121 - RNA, 32 nt, Human
uccugcccaaguggacccagcggcaaagguga

SEQ ID NO: 236122 - RNA, 32 nt, Human
uccugcccacaaagaacucacagucugauuag

SEQ ID NO: 236123 - RNA, 18 nt, Human
uccugcccacagcgcccu

SEQ ID NO: 236124 - RNA, 23 nt, Human
uccugcccaccaggaaccugcuu

SEQ ID NO: 236125 - RNA, 32 nt, Human
uccugcccaccaggaaccugcuuuaguggggg

SEQ ID NO: 236126 - RNA, 32 nt, Human
uccugcccacucucugcuucaggcuggagcug

SEQ ID NO: 236127 - RNA, 32 nt, Human
uccugcccagauguggaagacugaggccuguu

SEQ ID NO: 236128 - RNA, 32 nt, Human
uccugcccagcaccugguggccucuauaugcc

SEQ ID NO: 236129 - RNA, 32 nt, Human
uccugcccagccaggccgcgcaggcagaaggg

SEQ ID NO: 236130 - RNA, 32 nt, Human
uccugcccaugaggaugaggacaggaagccag

SEQ ID NO: 236131 - RNA, 32 nt, Human
uccugccccacacaccugcuccuucccugggc

SEQ ID NO: 236132 - RNA, 19 nt, Human
uccugccccacagcccugc

SEQ ID NO: 236133 - RNA, 32 nt, Human
uccugccccacugugccugggcccauaaacaa

SEQ ID NO: 236134 - RNA, 32 nt, Human
uccugccccacugugggccauuuccagaagug

SEQ ID NO: 236135 - RNA, 32 nt, Human
uccugccccagccuccugaguagcugggauua

SEQ ID NO: 236136 - RNA, 21 nt, Human
uccugccccagccuccugucu

SEQ ID NO: 236137 - RNA, 32 nt, Human
uccugccccagccucuugaguggcugggauug

SEQ ID NO: 236138 - RNA, 32 nt, Human
uccugccccaggauuuagaucuuggcuacugu

SEQ ID NO: 236139 - RNA, 21 nt, Human
uccugcccccaagacugcucu

SEQ ID NO: 236140 - RNA, 21 nt, Human
uccugcccccaaggaggcagc

SEQ ID NO: 236141 - RNA, 22 nt, Human
uccugcccccacagcugcugcu

SEQ ID NO: 236142 - RNA, 21 nt, Human
uccugcccccagcucccuguu

SEQ ID NO: 236143 - RNA, 20 nt, Human
uccugcccccagcugcagcu

SEQ ID NO: 236144 - RNA, 19 nt, Human
uccugcccccaggcccugc

SEQ ID NO: 236145 - RNA, 19 nt, Human
uccugcccccggguccugc

SEQ ID NO: 236146 - RNA, 21 nt, Human
uccugcccccugcacccugcu

SEQ ID NO: 236147 - RNA, 22 nt, Human
uccugccccgaaagugcugacu

SEQ ID NO: 236148 - RNA, 22 nt, Human
uccugccccgaggaagugcugu

SEQ ID NO: 236149 - RNA, 19 nt, Human
uccugccccgcggcgcugc

SEQ ID NO: 236150 - RNA, 20 nt, Human
uccugccccguagugccccu

SEQ ID NO: 236151 - RNA, 32 nt, Human
uccugccccgugagcugggccuagccacucac

SEQ ID NO: 236152 - RNA, 32 nt, Human
uccugccccguggacuuaggggagcaccacgc

SEQ ID NO: 236153 - RNA, 32 nt, Human
uccugccccuccugcugugggaugcugagcac

SEQ ID NO: 236154 - RNA, 32 nt, Human
uccugccccucucugcccccucccucuguccu

SEQ ID NO: 236155 - RNA, 32 nt, Human
uccugccccuggcugcuguuucccagccuuuc

SEQ ID NO: 236156 - RNA, 32 nt, Human
uccugccccuggcugugcucuacaccuuagug

SEQ ID NO: 236157 - RNA, 32 nt, Human
uccugccccuuccucuaucccuagggcucagu

SEQ ID NO: 236158 - RNA, 32 nt, Human
uccugccccuucucagaaccaguccccugcug

SEQ ID NO: 236159 - RNA, 32 nt, Human
uccugccccuucugcccugccuugccccugca

SEQ ID NO: 236160 - RNA, 32 nt, Human
uccugcccggggucccuaugcccaguccccgu

SEQ ID NO: 236161 - RNA, 32 nt, Human
uccugcccguuccccugccccugggccgccag

SEQ ID NO: 236162 - RNA, 32 nt, Human
uccugcccucaaggcacuuacaguccaguuuc

SEQ ID NO: 236163 - RNA, 32 nt, Human
uccugcccucaaguggcuuccaccucaagugg

SEQ ID NO: 236164 - RNA, 32 nt, Human
uccugcccucacugcauucccucaccucuacc

SEQ ID NO: 236165 - RNA, 24 nt, Human
uccugcccucaggugauccaccca

SEQ ID NO: 236166 - RNA, 32 nt, Human
uccugcccucauugccuccaauccggacucuu

SEQ ID NO: 236167 - RNA, 26 nt, Human
uccugcccuccccaccuugugaccca

SEQ ID NO: 236168 - RNA, 32 nt, Human
uccugcccucccccaacccucccuuggcggcu

SEQ ID NO: 236169 - RNA, 32 nt, Human
uccugcccuccccuucacucccucccuggcuc

SEQ ID NO: 236170 - RNA, 32 nt, Human
uccugcccucccuucuggaggcuggaggggag

SEQ ID NO: 236171 - RNA, 32 nt, Human
uccugcccuccuccucuucucagggcacugca

SEQ ID NO: 236172 - RNA, 32 nt, Human
uccugcccuccugugucucaggcccguuuucc

SEQ ID NO: 236173 - RNA, 31 nt, Human
uccugcccucugccugggccucggucccucc

SEQ ID NO: 236174 - RNA, 32 nt, Human
uccugcccucuuggaguuuauaugacaugagc

SEQ ID NO: 236175 - RNA, 32 nt, Human
uccugcccugauucaggagauccccaucuauu

SEQ ID NO: 236176 - RNA, 32 nt, Human
uccugcccugcagcacgcggccuugucugggu

SEQ ID NO: 236177 - RNA, 32 nt, Human
uccugcccugcagggccuuucuacccgugucc

SEQ ID NO: 236178 - RNA, 32 nt, Human
uccugcccugccuuccuccugccuguagccca

SEQ ID NO: 236179 - RNA, 32 nt, Human
uccugcccugcucucagccauagugaaggacc

SEQ ID NO: 236180 - RNA, 32 nt, Human
uccugcccuggugcugccaguuggguggagau

SEQ ID NO: 236181 - RNA, 32 nt, Human
uccugcccuugaacccccucccugucccaggg

SEQ ID NO: 236182 - RNA, 32 nt, Human
uccugcccuugggagcacagacaggcuccuag

SEQ ID NO: 236183 - RNA, 32 nt, Human
uccugccgaggucuccggccccuucccccuuc

SEQ ID NO: 236184 - RNA, 32 nt, Human
uccugccgcccaggcaggaugucagaugagga

SEQ ID NO: 236185 - RNA, 32 nt, Human
uccugccgcccaggccuuggagguacugcugc

SEQ ID NO: 236186 - RNA, 32 nt, Human
uccugccgcccgagguggcugccuggagcccc

SEQ ID NO: 236187 - RNA, 23 nt, Human
uccugccgccgcccgggacccga

SEQ ID NO: 236188 - RNA, 20 nt, Human
uccugccgccgccgccgccg

SEQ ID NO: 236189 - RNA, 32 nt, Human
uccugccgcugcccuccacgccuccaaucccc

SEQ ID NO: 236190 - RNA, 20 nt, Human
uccugccgggcucacggcca

SEQ ID NO: 236191 - RNA, 32 nt, Human
uccugccggugggaguggcugcauuugaacca

SEQ ID NO: 236192 - RNA, 32 nt, Human
uccugccgucuguccuggaacacauugcucca

SEQ ID NO: 236193 - RNA, 32 nt, Human
uccugccgugcccugccugagcucucagggcc

SEQ ID NO: 236194 - RNA, 32 nt, Human
uccugccguggaguuugcugggggagacacau

SEQ ID NO: 236195 - RNA, 32 nt, Human
uccugccguugcuuccuauccugggcuuggaa

SEQ ID NO: 236196 - RNA, 32 nt, Human
uccugccuaacuuuucauugaaaugucuagua

SEQ ID NO: 236197 - RNA, 20 nt, Human
uccugccuacuacgugcugc

SEQ ID NO: 236198 - RNA, 32 nt, Human
uccugccuaggugacagagcaagacuccgccu

SEQ ID NO: 236199 - RNA, 27 nt, Human
uccugccuagguuucuaccuuuucucu

SEQ ID NO: 236200 - RNA, 32 nt, Human
uccugccuauaaucccagcacuuugggaggcu

SEQ ID NO: 236201 - RNA, 32 nt, Human
uccugccuaucuuuacaauaaaacucuccuua

SEQ ID NO: 236202 - RNA, 32 nt, Human
uccugccucacaggugaagauuaaagagacaa

SEQ ID NO: 236203 - RNA, 32 nt, Human
uccugccucagacaccagaguagcugggacca

SEQ ID NO: 236204 - RNA, 18 nt, Human
uccugccucagccaccca

SEQ ID NO: 236205 - RNA, 32 nt, Human
uccugccucagccucaugaauagcugggauua

SEQ ID NO: 236206 - RNA, 32 nt, Human
uccugccucagccucaugaguagcugggacua

SEQ ID NO: 236207 - RNA, 32 nt, Human
uccugccucagccucaugaguagcugggauua

SEQ ID NO: 236208 - RNA, 22 nt, Human
uccugccucagccucccaagca

SEQ ID NO: 236209 - RNA, 32 nt, Human
uccugccucagccuccccaguagcugugauua

SEQ ID NO: 236210 - RNA, 32 nt, Human
uccugccucagccucuugaauagcugggauua

SEQ ID NO: 236211 - RNA, 32 nt, Human
uccugccucagccucuugaguagcuagguaca

SEQ ID NO: 236212 - RNA, 32 nt, Human
uccugccucagccucuugaguagcugggacua

SEQ ID NO: 236213 - RNA, 32 nt, Human
uccugccucagccucuugaguagcugggauua

SEQ ID NO: 236214 - RNA, 32 nt, Human
uccugccucagccucuugaguggcugggauug

SEQ ID NO: 236215 - RNA, 32 nt, Human
uccugccucagggcuuuucggagccuggaucc

SEQ ID NO: 236216 - RNA, 32 nt, Human
uccugccucaugucucaaggcagcagcuccuc

SEQ ID NO: 236217 - RNA, 32 nt, Human
uccugccuccaaagccugccucaugucucggc

SEQ ID NO: 236218 - RNA, 23 nt, Human
uccugccuccacccaguucccca

SEQ ID NO: 236219 - RNA, 32 nt, Human
uccugccuccacccucuuucucgccgcgaagg

SEQ ID NO: 236220 - RNA, 32 nt, Human
uccugccucccuauuugccaggcuuucauuuc

SEQ ID NO: 236221 - RNA, 32 nt, Human
uccugccucccucuccccucuccaccaugggc

SEQ ID NO: 236222 - RNA, 32 nt, Human
uccugccucccugccucagccugggaccugag

SEQ ID NO: 236223 - RNA, 32 nt, Human
uccugccucccuuccccugccugcugcugggg

SEQ ID NO: 236224 - RNA, 23 nt, Human
uccugccuccucucucuccuccc

SEQ ID NO: 236225 - RNA, 17 nt, Human
uccugccuccugagaag

SEQ ID NO: 236226 - RNA, 20 nt, Human
uccugccuccugccccagca

SEQ ID NO: 236227 - RNA, 32 nt, Human
uccugccuccugccuccccugccugccuggga

SEQ ID NO: 236228 - RNA, 32 nt, Human
uccugccuccuucacauuuccuccccagcuuu

SEQ ID NO: 236229 - RNA, 32 nt, Human
uccugccucgcagcaggcuuuccaggcccagc

SEQ ID NO: 236230 - RNA, 32 nt, Human
uccugccucgcguguacauacaucacgggccc

SEQ ID NO: 236231 - RNA, 32 nt, Human
uccugccucuacugucucuccauagcccuggu

SEQ ID NO: 236232 - RNA, 32 nt, Human
uccugccucuccgccaccuccaccgcggcuua

SEQ ID NO: 236233 - RNA, 32 nt, Human
uccugccucucucccaacauguuuccagcaag

SEQ ID NO: 236234 - RNA, 32 nt, Human
uccugccucugaagccacaaaaugcuuuagac

SEQ ID NO: 236235 - RNA, 32 nt, Human
uccugccucugccucccagccccucacccagc

SEQ ID NO: 236236 - RNA, 32 nt, Human
uccugccucuggaagguggguggggcccugca

SEQ ID NO: 236237 - RNA, 32 nt, Human
uccugccucugugccccugccucucccugugu

SEQ ID NO: 236238 - RNA, 32 nt, Human
uccugccugacucuugguccuucuggcaggga

SEQ ID NO: 236239 - RNA, 32 nt, Human
uccugccugcaaccccucuccccagcuuggcg

SEQ ID NO: 236240 - RNA, 20 nt, Human
uccugccugcagagcgcugc

SEQ ID NO: 236241 - RNA, 32 nt, Human
uccugccugcaggugauucuaugggacaggca

SEQ ID NO: 236242 - RNA, 32 nt, Human
uccugccugcauuuccagagcuggugccaggg

SEQ ID NO: 236243 - RNA, 19 nt, Human
uccugccugcccugagcca

SEQ ID NO: 236244 - RNA, 32 nt, Human
uccugccugccgccucucuguacaguaacgcc

SEQ ID NO: 236245 - RNA, 32 nt, Human
uccugccugccuguaccccgccaacagcuuca

SEQ ID NO: 236246 - RNA, 32 nt, Human
uccugccugccugucugccugugaccugugua

SEQ ID NO: 236247 - RNA, 32 nt, Human
uccugccugccuuauccuugggccaucagccc

SEQ ID NO: 236248 - RNA, 32 nt, Human
uccugccugcgcccucugcccaggacucgucu

SEQ ID NO: 236249 - RNA, 20 nt, Human
uccugccugcggaccagaug

SEQ ID NO: 236250 - RNA, 32 nt, Human
uccugccugcucauuucccagcccucuucuuc

SEQ ID NO: 236251 - RNA, 32 nt, Human
uccugccugcucucccugcguugccuagggua

SEQ ID NO: 236252 - RNA, 32 nt, Human
uccugccuggccaggcagaucugugccccaug

SEQ ID NO: 236253 - RNA, 22 nt, Human
uccugccuggcccugcucccca

SEQ ID NO: 236254 - RNA, 23 nt, Human
uccugccugggaggggaaugcag

SEQ ID NO: 236255 - RNA, 32 nt, Human
uccugccugggugacaaagugagacucugucu

SEQ ID NO: 236256 - RNA, 24 nt, Human
uccugccugggugacacagcgaga

SEQ ID NO: 236257 - RNA, 32 nt, Human
uccugccugggugacagaagagacccugucuc

SEQ ID NO: 236258 - RNA, 24 nt, Human
uccugccugggugacagagcgaga

SEQ ID NO: 236259 - RNA, 21 nt, Human
uccugccugguggugucccca

SEQ ID NO: 236260 - RNA, 24 nt, Human
uccugccugguugacagagugaga

SEQ ID NO: 236261 - RNA, 32 nt, Human
uccugccuguaaucccagcacuuugggaggcc

SEQ ID NO: 236262 - RNA, 32 nt, Human
uccugccuguaaucccaucacuuugggaggcu

SEQ ID NO: 236263 - RNA, 32 nt, Human
uccugccuguaaucgcagcacuuugggaggcu

SEQ ID NO: 236264 - RNA, 31 nt, Human
uccugccuguccccauggccuguguccccac

SEQ ID NO: 236265 - RNA, 32 nt, Human
uccugccuguucccccacaccugccaggauau

SEQ ID NO: 236266 - RNA, 32 nt, Human
uccugccuguucuggcuccucugcucccacgc

SEQ ID NO: 236267 - RNA, 21 nt, Human
uccugccuuaccccugcugcu

SEQ ID NO: 236268 - RNA, 32 nt, Human
uccugccuuccauagcugucauggccucaccu

SEQ ID NO: 236269 - RNA, 32 nt, Human
uccugccuuccucccuuuucccaguccacuuc

SEQ ID NO: 236270 - RNA, 32 nt, Human
uccugccuucgccgcccugcccuccgccgcuc

SEQ ID NO: 236271 - RNA, 32 nt, Human
uccugccuugcacuugcagccugaagcggaga

SEQ ID NO: 236272 - RNA, 32 nt, Human
uccugccuuggcagaggaggaggagucaaggg

SEQ ID NO: 236273 - RNA, 32 nt, Human
uccugccuuggcugacuggguuccuggaccau

SEQ ID NO: 236274 - RNA, 32 nt, Human
uccugccuuugaggagcucacuguuuaguugg

SEQ ID NO: 236275 - RNA, 32 nt, Human
uccugcgaagcuccucccagccggucucucug

SEQ ID NO: 236276 - RNA, 32 nt, Human
uccugcgaccuugcaaccucaccuuccugugg

SEQ ID NO: 236277 - RNA, 32 nt, Human
uccugcgacgcugucuguuccugccuucugug

SEQ ID NO: 236278 - RNA, 32 nt, Human
uccugcgaucgaaggggacuugagacucaccg

SEQ ID NO: 236279 - RNA, 32 nt, Human
uccugcgaugaauccggcccuaggcaaccaga

SEQ ID NO: 236280 - RNA, 32 nt, Human
uccugcgcacugccuguuccuccuggguguca

SEQ ID NO: 236281 - RNA, 19 nt, Human
uccugcgccaaucaccacc

SEQ ID NO: 236282 - RNA, 32 nt, Human
uccugcgcccccucccccuucccggguucuga

SEQ ID NO: 236283 - RNA, 23 nt, Human
uccugcgcgcacacccccaggag

SEQ ID NO: 236284 - RNA, 22 nt, Human
uccugcgcgccugggccgugaa

SEQ ID NO: 236285 - RNA, 22 nt, Human
uccugcgcggacgacccuggaa

SEQ ID NO: 236286 - RNA, 21 nt, Human
uccugcgcggggcccccggga

SEQ ID NO: 236287 - RNA, 32 nt, Human
uccugcgcucaggugauccuccagcuucagcu

SEQ ID NO: 236288 - RNA, 32 nt, Human
uccugcgcugcagugagaccugggugaaaauc

SEQ ID NO: 236289 - RNA, 32 nt, Human
uccugcgcuggcgcccccaccuggugaugccg

SEQ ID NO: 236290 - RNA, 32 nt, Human
uccugcggccaaaucugucucccuucaugggc

SEQ ID NO: 236291 - RNA, 32 nt, Human
uccugcggccaugggccaggguugggcuacug

SEQ ID NO: 236292 - RNA, 32 nt, Human
uccugcggccggcacgcgguucccagggggcc

SEQ ID NO: 236293 - RNA, 32 nt, Human
uccugcggcuuuggugacagugugcagacagc

SEQ ID NO: 236294 - RNA, 32 nt, Human
uccugcgggcuaggcagccaggagcucugucc

SEQ ID NO: 236295 - RNA, 32 nt, Human
uccugcggggguagcagagagcucggcccacc

SEQ ID NO: 236296 - RNA, 32 nt, Human
uccugcgucaucuguguggccacucgcaggag

SEQ ID NO: 236297 - RNA, 32 nt, Human
uccugcguccugcccauguggaaagugaccac

SEQ ID NO: 236298 - RNA, 32 nt, Human
uccugcgucuuucugccugagcuuguucuuug

SEQ ID NO: 236299 - RNA, 21 nt, Human
uccugcgugcagcucacggcc

SEQ ID NO: 236300 - RNA, 20 nt, Human
uccugcgugcauccccggga

SEQ ID NO: 236301 - RNA, 32 nt, Human
uccugcguuucuuccuccugcccugggucaau

SEQ ID NO: 236302 - RNA, 32 nt, Human
uccugcuaaaaauacaaaaauuagcugggcuu

SEQ ID NO: 236303 - RNA, 32 nt, Human
uccugcuaccagucugugccuuagaggucguu

SEQ ID NO: 236304 - RNA, 32 nt, Human
uccugcuacuuagguacugggaaacaaugcuu

SEQ ID NO: 236305 - RNA, 32 nt, Human
uccugcuagggcugcacuguccuggguguugg

SEQ ID NO: 236306 - RNA, 25 nt, Human
uccugcuauaaguucuuuucuugga

SEQ ID NO: 236307 - RNA, 32 nt, Human
uccugcucacaucugaaucuccuuguuguucu

SEQ ID NO: 236308 - RNA, 32 nt, Human
uccugcucacccagcuugcuguaguggaagag

SEQ ID NO: 236309 - RNA, 32 nt, Human
uccugcucaccugggccacccucucuccagga

SEQ ID NO: 236310 - RNA, 32 nt, Human
uccugcucaccuuuugcugccugcucauggca

SEQ ID NO: 236311 - RNA, 32 nt, Human
uccugcucacucaagcaaaagcagccucuggc

SEQ ID NO: 236312 - RNA, 32 nt, Human
uccugcucaugagggcagacaggccuuuccag

SEQ ID NO: 236313 - RNA, 32 nt, Human
uccugcuccagccuuccauucccuugugugac

SEQ ID NO: 236314 - RNA, 23 nt, Human
uccugcuccagcuucccuguccu

SEQ ID NO: 236315 - RNA, 21 nt, Human
uccugcuccccaccuccuguc

SEQ ID NO: 236316 - RNA, 32 nt, Human
uccugcucccgcgauguggaagugucacacgg

SEQ ID NO: 236317 - RNA, 32 nt, Human
uccugcucccuguguucccacccuccaguguu

SEQ ID NO: 236318 - RNA, 32 nt, Human
uccugcuccgacaccaccuccacaggggaagc

SEQ ID NO: 236319 - RNA, 19 nt, Human
uccugcuccgccucugacc

SEQ ID NO: 236320 - RNA, 25 nt, Human
uccugcuccucagcucuccacccca

SEQ ID NO: 236321 - RNA, 32 nt, Human
uccugcuccucuacgcugccucaggcccccag

SEQ ID NO: 236322 - RNA, 32 nt, Human
uccugcuccucugcaaccugccccucuuuuuc

SEQ ID NO: 236323 - RNA, 32 nt, Human
uccugcucgcaaccucgcgguuccuggggugc

SEQ ID NO: 236324 - RNA, 24 nt, Human
uccugcucgccgcaccuccgggag

SEQ ID NO: 236325 - RNA, 32 nt, Human
uccugcucgugcaggguggccccaagggccca

SEQ ID NO: 236326 - RNA, 32 nt, Human
uccugcucuaagggugucacugccuggcaucc

SEQ ID NO: 236327 - RNA, 32 nt, Human
uccugcucucaagugauccuccugccucagcc

SEQ ID NO: 236328 - RNA, 32 nt, Human
uccugcucucagagguggaagagcaaggcugg

SEQ ID NO: 236329 - RNA, 32 nt, Human
uccugcucucauccuccccugcccugauguca

SEQ ID NO: 236330 - RNA, 32 nt, Human
uccugcucucccaggagcagugaguugugagu

SEQ ID NO: 236331 - RNA, 32 nt, Human
uccugcucucccaugaggguuauugaaucauu

SEQ ID NO: 236332 - RNA, 32 nt, Human
uccugcucuccuccgcagcaucauggcggagc

SEQ ID NO: 236333 - RNA, 32 nt, Human
uccugcucuccuccguggacauuucauuacca

SEQ ID NO: 236334 - RNA, 32 nt, Human
uccugcucucuccccucuuuugugaagaaagc

SEQ ID NO: 236335 - RNA, 32 nt, Human
uccugcucugcuggccugagccccaggccuug

SEQ ID NO: 236336 - RNA, 22 nt, Human
uccugcucugggaaugcugcuu

SEQ ID NO: 236337 - RNA, 24 nt, Human
uccugcucuuauaaauaaaccuua

SEQ ID NO: 236338 - RNA, 32 nt, Human
uccugcucuuuagaaaaagcagucuuugugcu

SEQ ID NO: 236339 - RNA, 32 nt, Human
uccugcucuuuccaaaaagccaggugccgccg

SEQ ID NO: 236340 - RNA, 32 nt, Human
uccugcucuuucuccccgcugugccuccccca

SEQ ID NO: 236341 - RNA, 21 nt, Human
uccugcucuuugcuguugccu

SEQ ID NO: 236342 - RNA, 32 nt, Human
uccugcugaaccacuccagccugcugcgugca

SEQ ID NO: 236343 - RNA, 32 nt, Human
uccugcugaaggagggaaggagggagaggaag

SEQ ID NO: 236344 - RNA, 32 nt, Human
uccugcugaaguaucuccauguaaucacaaua

SEQ ID NO: 236345 - RNA, 32 nt, Human
uccugcugaccugcacuguccaggccucacca

SEQ ID NO: 236346 - RNA, 32 nt, Human
uccugcugagcucuguucucuccagcaccucc

SEQ ID NO: 236347 - RNA, 19 nt, Human
uccugcugaggaccagcug

SEQ ID NO: 236348 - RNA, 32 nt, Human
uccugcugaggcggagacugcagugagcugag

SEQ ID NO: 236349 - RNA, 32 nt, Human
uccugcugagggagacaccagcaagccucuug

SEQ ID NO: 236350 - RNA, 32 nt, Human
uccugcugagguggagacugcagugagcugag

SEQ ID NO: 236351 - RNA, 32 nt, Human
uccugcugagguggagauugcagugaacuaag

SEQ ID NO: 236352 - RNA, 32 nt, Human
uccugcugcaacaucuucuccuccaggaaggc

SEQ ID NO: 236353 - RNA, 32 nt, Human
uccugcugcaccacugcccugccuucgggcug

SEQ ID NO: 236354 - RNA, 32 nt, Human
uccugcugcacuccuccgccaccgggcuaggu

SEQ ID NO: 236355 - RNA, 32 nt, Human
uccugcugcacuccugucuugccaugcacguc

SEQ ID NO: 236356 - RNA, 19 nt, Human
uccugcugcagggugcugc

SEQ ID NO: 236357 - RNA, 32 nt, Human
uccugcugcccauccaguugggaagccaugau

SEQ ID NO: 236358 - RNA, 32 nt, Human
uccugcugcccuuuaugcugcucucccagggc

SEQ ID NO: 236359 - RNA, 32 nt, Human
uccugcugccgcucugcagccuggaccugugg

SEQ ID NO: 236360 - RNA, 22 nt, Human
uccugcugccggccuccugccu

SEQ ID NO: 236361 - RNA, 32 nt, Human
uccugcugccggccuccugccugggccugccu

SEQ ID NO: 236362 - RNA, 22 nt, Human
uccugcugccucccuccugucu

SEQ ID NO: 236363 - RNA, 24 nt, Human
uccugcugccuggguccuggcccu

SEQ ID NO: 236364 - RNA, 21 nt, Human
uccugcugccuucagcugccu

SEQ ID NO: 236365 - RNA, 20 nt, Human
uccugcugccuucccacccu

SEQ ID NO: 236366 - RNA, 32 nt, Human
uccugcugcgcauuacagaaagcuuuuaacug

SEQ ID NO: 236367 - RNA, 32 nt, Human
uccugcugcggaggaagagggggaagaggccg

SEQ ID NO: 236368 - RNA, 32 nt, Human
uccugcugcucuggagugcaagcccucuucug

SEQ ID NO: 236369 - RNA, 32 nt, Human
uccugcugcugcauuuuaaagcacuuuuauag

SEQ ID NO: 236370 - RNA, 32 nt, Human
uccugcugcugccucuaccgcugcggcuaccg

SEQ ID NO: 236371 - RNA, 32 nt, Human
uccugcugcuucaccccuccccuagccugccg

SEQ ID NO: 236372 - RNA, 32 nt, Human
uccugcugcuucccagcucagaacauauacug

SEQ ID NO: 236373 - RNA, 32 nt, Human
uccugcuggacccgcaagccaccagcuauuuc

SEQ ID NO: 236374 - RNA, 32 nt, Human
uccugcuggcccucauugccuccgggggcuac

SEQ ID NO: 236375 - RNA, 29 nt, Human
uccugcuggcugcagcuggcccucgggga

SEQ ID NO: 236376 - RNA, 32 nt, Human
uccugcugggagagguaaguugaaguagcuga

SEQ ID NO: 236377 - RNA, 32 nt, Human
uccugcugggcagaggagcagcugggauuccc

SEQ ID NO: 236378 - RNA, 21 nt, Human
uccugcugggccgcuuccugc

SEQ ID NO: 236379 - RNA, 32 nt, Human
uccugcugguggggcucucagcauaaccgccc

SEQ ID NO: 236380 - RNA, 32 nt, Human
uccugcuguagugccuucugcgccaggcccgg

SEQ ID NO: 236381 - RNA, 32 nt, Human
uccugcuguccccuccccuucaggcccccgga

SEQ ID NO: 236382 - RNA, 20 nt, Human
uccugcugucccuccaccuc

SEQ ID NO: 236383 - RNA, 22 nt, Human
uccugcugucucuguccugucc

SEQ ID NO: 236384 - RNA, 21 nt, Human
uccugcugucuucucccuccu

SEQ ID NO: 236385 - RNA, 20 nt, Human
uccugcugucuucuccuucc

SEQ ID NO: 236386 - RNA, 32 nt, Human
uccugcugugccaggcccaugggcagugcagg

SEQ ID NO: 236387 - RNA, 32 nt, Human
uccugcuguggaccagcuacuccugccugagg

SEQ ID NO: 236388 - RNA, 32 nt, Human
uccugcugugugagcccuucagcugcagagcg

SEQ ID NO: 236389 - RNA, 32 nt, Human
uccugcuguuccugcugauguaccuguucacg

SEQ ID NO: 236390 - RNA, 32 nt, Human
uccugcuguugguaccuggccuagcuggaagg

SEQ ID NO: 236391 - RNA, 32 nt, Human
uccugcuuaaagauucuaguucucaaccucuc

SEQ ID NO: 236392 - RNA, 32 nt, Human
uccugcuucagccucaugaguagcugggacua

SEQ ID NO: 236393 - RNA, 32 nt, Human
uccugcuuccagcugcugcagcgcgccuucgc

SEQ ID NO: 236394 - RNA, 32 nt, Human
uccugcuucccacccccugccugcccagccug

SEQ ID NO: 236395 - RNA, 24 nt, Human
uccugcuuccuuucucuccugccu

SEQ ID NO: 236396 - RNA, 32 nt, Human
uccugcuucgcgccugcugcucugccccaacg

SEQ ID NO: 236397 - RNA, 32 nt, Human
uccugcuucucucugcacgucucccucauucu

SEQ ID NO: 236398 - RNA, 32 nt, Human
uccugcuucuggccuuguaucuugcauucaca

SEQ ID NO: 236399 - RNA, 32 nt, Human
uccugcuucuuuccuuucccuuccagagguaa

SEQ ID NO: 236400 - RNA, 22 nt, Human
uccugcuucuuuucuccucccu

SEQ ID NO: 236401 - RNA, 32 nt, Human
uccugcuugcuacuguuuugugguguugaaaa

SEQ ID NO: 236402 - RNA, 32 nt, Human
uccugcuuggcagaagagaaacugagucacca

SEQ ID NO: 236403 - RNA, 24 nt, Human
uccugcuugggcgacagagugaga

SEQ ID NO: 236404 - RNA, 32 nt, Human
uccugcuuuaucugcaucauccacccacagag

SEQ ID NO: 236405 - RNA, 32 nt, Human
uccugcuuuccuacucccuugaucccaaacuc

SEQ ID NO: 236406 - RNA, 21 nt, Human
uccugcuuuuaucuucugccu

SEQ ID NO: 236407 - RNA, 32 nt, Human
uccugcuuuucuacccuacccugccggugagg

SEQ ID NO: 236408 - RNA, 17 nt, Human
uccugcuuuucuuuccu

SEQ ID NO: 236409 - RNA, 32 nt, Human
uccuggaaauaacaugugagaaguacuuagaa

SEQ ID NO: 236410 - RNA, 32 nt, Human
uccuggaaaugagaccugguggaauauuauuu

SEQ ID NO: 236411 - RNA, 23 nt, Human
uccuggaaccaggaauucauucu

SEQ ID NO: 236412 - RNA, 24 nt, Human
uccuggaaccauaacuguaaguuc

SEQ ID NO: 236413 - RNA, 21 nt, Human
uccuggaacucugccaccuca

SEQ ID NO: 236414 - RNA, 32 nt, Human
uccuggaagaagcaggagggagaguggcgcug

SEQ ID NO: 236415 - RNA, 32 nt, Human
uccuggaagagaggugcugauuggccccaagu

SEQ ID NO: 236416 - RNA, 22 nt, Human
uccuggaagccaucugcugcuu

SEQ ID NO: 236417 - RNA, 32 nt, Human
uccuggaaggagaaccagccacccugaggacc

SEQ ID NO: 236418 - RNA, 32 nt, Human
uccuggaaggagaagggaggaacugggccugg

SEQ ID NO: 236419 - RNA, 32 nt, Human
uccuggaaguugaagguggagauggcccuugu

SEQ ID NO: 236420 - RNA, 22 nt, Human
uccuggaauaaaauguggcucu

SEQ ID NO: 236421 - RNA, 23 nt, Human
uccuggaauccagagccaagugg

SEQ ID NO: 236422 - RNA, 18 nt, Human
uccuggaaucccaaggcc

SEQ ID NO: 236423 - RNA, 32 nt, Human
uccuggacaaaccuuuccuuccugguggugga

SEQ ID NO: 236424 - RNA, 19 nt, Human
uccuggacacccccucuca

SEQ ID NO: 236425 - RNA, 32 nt, Human
uccuggacacuguacugugccucccaguuuac

SEQ ID NO: 236426 - RNA, 22 nt, Human
uccuggacauccucuucugcuu

SEQ ID NO: 236427 - RNA, 32 nt, Human
uccuggaccagcugugcuuuugccuggucauc

SEQ ID NO: 236428 - RNA, 32 nt, Human
uccuggaccucuuggcccccagccccuucccc

SEQ ID NO: 236429 - RNA, 23 nt, Human
uccuggaccuuucuucccuuccc

SEQ ID NO: 236430 - RNA, 32 nt, Human
uccuggacuaugaagcuggagaugucuccuuc

SEQ ID NO: 236431 - RNA, 32 nt, Human
uccuggacucaagcgauucuccugccucaggc

SEQ ID NO: 236432 - RNA, 32 nt, Human
uccuggacucaagugaucacccuccucagccu

SEQ ID NO: 236433 - RNA, 32 nt, Human
uccuggacucaagugauccgcccaccucggcc

SEQ ID NO: 236434 - RNA, 32 nt, Human
uccuggacucaagugauccucacaccucagcc

SEQ ID NO: 236435 - RNA, 32 nt, Human
uccuggacucaagugauccucccaccucagcc

SEQ ID NO: 236436 - RNA, 32 nt, Human
uccuggacucaagugaucggcccaccuuguca

SEQ ID NO: 236437 - RNA, 32 nt, Human
uccuggacucacaugauccucccaccuuggcc

SEQ ID NO: 236438 - RNA, 32 nt, Human
uccuggacugcgucacagcccaggucaaggag

SEQ ID NO: 236439 - RNA, 32 nt, Human
uccuggacuggcccaccugccugccacaugcc

SEQ ID NO: 236440 - RNA, 32 nt, Human
uccuggacuuccgggccucgauuucuuccgca

SEQ ID NO: 236441 - RNA, 32 nt, Human
uccuggacuuccucuugcugcaggacccggcu

SEQ ID NO: 236442 - RNA, 21 nt, Human
uccuggagaaaggggacucag

SEQ ID NO: 236443 - RNA, 32 nt, Human
uccuggagaaugcugcaugugagacccaagga

SEQ ID NO: 236444 - RNA, 22 nt, Human
uccuggagacaaaaggaguguu

SEQ ID NO: 236445 - RNA, 25 nt, Human
uccuggagacaagagcuggagacug

SEQ ID NO: 236446 - RNA, 22 nt, Human
uccuggagacagcaagaagcug

SEQ ID NO: 236447 - RNA, 21 nt, Human
uccuggagacagggggcggug

SEQ ID NO: 236448 - RNA, 23 nt, Human
uccuggagaccagccuuuugcuu

SEQ ID NO: 236449 - RNA, 32 nt, Human
uccuggagacccggaagcagauuacguggagu

SEQ ID NO: 236450 - RNA, 32 nt, Human
uccuggagacuggugcccugagcuccaaccag

SEQ ID NO: 236451 - RNA, 22 nt, Human
uccuggagacuguggcaggggc

SEQ ID NO: 236452 - RNA, 32 nt, Human
uccuggagagagaaggggagaagaauacuuuu

SEQ ID NO: 236453 - RNA, 22 nt, Human
uccuggagagccaggguggcug

SEQ ID NO: 236454 - RNA, 23 nt, Human
uccuggagaggcagauguguccu

SEQ ID NO: 236455 - RNA, 32 nt, Human
uccuggagaggcagauguguccugaggaacag

SEQ ID NO: 236456 - RNA, 21 nt, Human
uccuggagaggggagggccug

SEQ ID NO: 236457 - RNA, 32 nt, Human
uccuggagaguuucccaggguugugauaugug

SEQ ID NO: 236458 - RNA, 32 nt, Human
uccuggagauaccuuccccuccuggguacauc

SEQ ID NO: 236459 - RNA, 32 nt, Human
uccuggagauggcugaaaagccaguccagucu

SEQ ID NO: 236460 - RNA, 32 nt, Human
uccuggagauuucaguuacuuaccugcaugug

SEQ ID NO: 236461 - RNA, 32 nt, Human
uccuggagcagcagagcaacaggccugaccca

SEQ ID NO: 236462 - RNA, 24 nt, Human
uccuggagcagcuggaagaugcug

SEQ ID NO: 236463 - RNA, 20 nt, Human
uccuggagcaggccgggugc

SEQ ID NO: 236464 - RNA, 24 nt, Human
uccuggagccacguccagcacaga

SEQ ID NO: 236465 - RNA, 32 nt, Human
uccuggagccacguccagcacagaguggacgg

SEQ ID NO: 236466 - RNA, 21 nt, Human
uccuggagcccccaggagcug

SEQ ID NO: 236467 - RNA, 22 nt, Human
uccuggagcccccaggccgcug

SEQ ID NO: 236468 - RNA, 19 nt, Human
uccuggagcccugcagguc

SEQ ID NO: 236469 - RNA, 22 nt, Human
uccuggagccuccagagggcug

SEQ ID NO: 236470 - RNA, 32 nt, Human
uccuggagccugggcucuaggcugaggguccu

SEQ ID NO: 236471 - RNA, 32 nt, Human
uccuggagccuuugaauaaaaaugcacguagc

SEQ ID NO: 236472 - RNA, 32 nt, Human
uccuggagcguugucuggagguuccagggaca

SEQ ID NO: 236473 - RNA, 32 nt, Human
uccuggagcugcagccugccuggguggcugug

SEQ ID NO: 236474 - RNA, 32 nt, Human
uccuggagcugccaagugagggguuaaagaag

SEQ ID NO: 236475 - RNA, 20 nt, Human
uccuggagcuggccaggugc

SEQ ID NO: 236476 - RNA, 22 nt, Human
uccuggagcuuccuggguacug

SEQ ID NO: 236477 - RNA, 32 nt, Human
uccuggagcuucuuccuuguaguucucaggac

SEQ ID NO: 236478 - RNA, 32 nt, Human
uccuggaggaagcagacaaugaagggagcaga

SEQ ID NO: 236479 - RNA, 32 nt, Human
uccuggaggacaaggcgggugggcaggcuccg

SEQ ID NO: 236480 - RNA, 32 nt, Human
uccuggaggagaaagccaggggccgcuuuggu

SEQ ID NO: 236481 - RNA, 24 nt, Human
uccuggaggagaggcccauggcca

SEQ ID NO: 236482 - RNA, 32 nt, Human
uccuggaggagcaggagguagcaggagaggac

SEQ ID NO: 236483 - RNA, 32 nt, Human
uccuggaggagguggagcugcagcugggacug

SEQ ID NO: 236484 - RNA, 32 nt, Human
uccuggaggagguggcaucaguaaugagccug

SEQ ID NO: 236485 - RNA, 32 nt, Human
uccuggaggcagagguugcagugagcugagau

SEQ ID NO: 236486 - RNA, 32 nt, Human
uccuggaggcagcaggucggguagagugaguu

SEQ ID NO: 236487 - RNA, 32 nt, Human
uccuggaggcaguccucaccucugccucccuc

SEQ ID NO: 236488 - RNA, 24 nt, Human
uccuggagggcaguaaagacgcug

SEQ ID NO: 236489 - RNA, 32 nt, Human
uccuggagggccuggggcugggcagccuggua

SEQ ID NO: 236490 - RNA, 32 nt, Human
uccuggagggccugggucgcguggcccaggag

SEQ ID NO: 236491 - RNA, 32 nt, Human
uccuggagggcuucguggaggaagggagaauu

SEQ ID NO: 236492 - RNA, 32 nt, Human
uccuggaggggcaacuggaggaaaggggcaga

SEQ ID NO: 236493 - RNA, 32 nt, Human
uccuggagguaggagagagggccugaccaggc

SEQ ID NO: 236494 - RNA, 32 nt, Human
uccuggaggugaagguugcagugagccaagau

SEQ ID NO: 236495 - RNA, 32 nt, Human
uccuggagucaagcgauucuccugccucagcc

SEQ ID NO: 236496 - RNA, 32 nt, Human
uccuggagugauaugauccagagcagaguuua

SEQ ID NO: 236497 - RNA, 32 nt, Human
uccuggaguguagagcuugagguguacagaug

SEQ ID NO: 236498 - RNA, 32 nt, Human
uccuggaguucuagucaauucaucucauuaua

SEQ ID NO: 236499 - RNA, 32 nt, Human
uccuggauaaaaugacacccauuuuucuuagg

SEQ ID NO: 236500 - RNA, 32 nt, Human
uccuggaucccuccccauuugccuucuuuauu

SEQ ID NO: 236501 - RNA, 32 nt, Human
uccuggauccugcccugcucucagccauagug

SEQ ID NO: 236502 - RNA, 32 nt, Human
uccuggauccuuacugcucugccuugguggca

SEQ ID NO: 236503 - RNA, 23 nt, Human
uccuggauccuuccccccuucuc

SEQ ID NO: 236504 - RNA, 32 nt, Human
uccuggaugacugccuguguuauuuuguggau

SEQ ID NO: 236505 - RNA, 32 nt, Human
uccuggaugucagggaagcuggaccaccugga

SEQ ID NO: 236506 - RNA, 32 nt, Human
uccuggauuaaacggugcuuguuuucuauaau

SEQ ID NO: 236507 - RNA, 32 nt, Human
uccuggauucaagcgauucuccugccucagcc

SEQ ID NO: 236508 - RNA, 32 nt, Human
uccuggauucaagugaucccccugccucagcc

SEQ ID NO: 236509 - RNA, 32 nt, Human
uccuggauucaagugauccucccaccucagcc

SEQ ID NO: 236510 - RNA, 32 nt, Human
uccuggauucaagugauucuccugccucaacc

SEQ ID NO: 236511 - RNA, 32 nt, Human
uccuggauucaagugauucuccugccugagcc

SEQ ID NO: 236512 - RNA, 32 nt, Human
uccuggauucaaguucagccucccggguggcu

SEQ ID NO: 236513 - RNA, 32 nt, Human
uccuggauucacaccauucuccugccucagcc

SEQ ID NO: 236514 - RNA, 32 nt, Human
uccuggauugaggcuuuccagcaaaggggcug

SEQ ID NO: 236515 - RNA, 32 nt, Human
uccuggauuuugcccucuccuuagcucuuagu

SEQ ID NO: 236516 - RNA, 32 nt, Human
uccuggcaaggcaggcucucacaugccuggac

SEQ ID NO: 236517 - RNA, 32 nt, Human
uccuggcacagacugcaucccauguucccaug

SEQ ID NO: 236518 - RNA, 20 nt, Human
uccuggcaccacuuccugcc

SEQ ID NO: 236519 - RNA, 32 nt, Human
uccuggcacuccuccagggugucaguaacauc

SEQ ID NO: 236520 - RNA, 32 nt, Human
uccuggcacugcaggccaggccaggaugccca

SEQ ID NO: 236521 - RNA, 32 nt, Human
uccuggcagagggagaggacaggaggaggagc

SEQ ID NO: 236522 - RNA, 32 nt, Human
uccuggcagcagcuccagucaagaaugucacu

SEQ ID NO: 236523 - RNA, 32 nt, Human
uccuggcagccccucaaacacacaccacccca

SEQ ID NO: 236524 - RNA, 22 nt, Human
uccuggcagccgccucuucccu

SEQ ID NO: 236525 - RNA, 32 nt, Human
uccuggcagcugggccugucuccuggggccau

SEQ ID NO: 236526 - RNA, 32 nt, Human
uccuggcagcuuuuggaaugacagcaguggua

SEQ ID NO: 236527 - RNA, 32 nt, Human
uccuggcaggagaaaggagggugguuuccgug

SEQ ID NO: 236528 - RNA, 32 nt, Human
uccuggcaggagcugagccucaggugucuggc

SEQ ID NO: 236529 - RNA, 32 nt, Human
uccuggcagggacuccggggucagugagugua

SEQ ID NO: 236530 - RNA, 32 nt, Human
uccuggcaggugugggagggaagcccauggcc

SEQ ID NO: 236531 - RNA, 32 nt, Human
uccuggcauccugggaggucucuggcuuugug

SEQ ID NO: 236532 - RNA, 32 nt, Human
uccuggcauuuguggccacucacuuuguagga

SEQ ID NO: 236533 - RNA, 32 nt, Human
uccuggccacaagugaucugcccgccuuagcc

SEQ ID NO: 236534 - RNA, 20 nt, Human
uccuggccaccugugaccug

SEQ ID NO: 236535 - RNA, 22 nt, Human
uccuggccacuggccgccgccg

SEQ ID NO: 236536 - RNA, 32 nt, Human
uccuggccagaacuugagccagcugugggaug

SEQ ID NO: 236537 - RNA, 32 nt, Human
uccuggccaguuucacaaucuagcucgacaga

SEQ ID NO: 236538 - RNA, 32 nt, Human
uccuggccaucuuugcuacuuuccuagagaac

SEQ ID NO: 236539 - RNA, 20 nt, Human
uccuggcccagccacggcca

SEQ ID NO: 236540 - RNA, 32 nt, Human
uccuggcccagccugugaaugacucugcccca

SEQ ID NO: 236541 - RNA, 32 nt, Human
uccuggcccagccuuuguuccccacuggagca

SEQ ID NO: 236542 - RNA, 32 nt, Human
uccuggcccaggccucugcccucugcccaccc

SEQ ID NO: 236543 - RNA, 21 nt, Human
uccuggcccauggauccauuc

SEQ ID NO: 236544 - RNA, 23 nt, Human
uccuggcccccaggcagggucug

SEQ ID NO: 236545 - RNA, 32 nt, Human
uccuggcccccgcccuugccccggcccggacu

SEQ ID NO: 236546 - RNA, 32 nt, Human
uccuggcccccuccuuggucaggcugaauggu

SEQ ID NO: 236547 - RNA, 32 nt, Human
uccuggcccuccacuccucauccccacaaucu

SEQ ID NO: 236548 - RNA, 32 nt, Human
uccuggcccucguuccuggaacacaggagaug

SEQ ID NO: 236549 - RNA, 32 nt, Human
uccuggcccugagccagcccugugcuccuccc

SEQ ID NO: 236550 - RNA, 32 nt, Human
uccuggcccugagccucagccucugccauggg

SEQ ID NO: 236551 - RNA, 32 nt, Human
uccuggcccuggaaggugccacuccagugccc

SEQ ID NO: 236552 - RNA, 19 nt, Human
uccuggccgagacugugaa

SEQ ID NO: 236553 - RNA, 32 nt, Human
uccuggccggcagagggcgcaggagcccagga

SEQ ID NO: 236554 - RNA, 32 nt, Human
uccuggccgggcccuccuccugccuguucugg

SEQ ID NO: 236555 - RNA, 22 nt, Human
uccuggccuaaugaucugccca

SEQ ID NO: 236556 - RNA, 32 nt, Human
uccuggccucaaaugauccuccugccuuggcc

SEQ ID NO: 236557 - RNA, 24 nt, Human
uccuggccucaagagauccacccg

SEQ ID NO: 236558 - RNA, 32 nt, Human
uccuggccucaagcaauccucucuccucagcc

SEQ ID NO: 236559 - RNA, 32 nt, Human
uccuggccucaagcaauccucuugccucggcc

SEQ ID NO: 236560 - RNA, 32 nt, Human
uccuggccucaagcaauccuucugccuuggcc

SEQ ID NO: 236561 - RNA, 32 nt, Human
uccuggccucaagcaguccucucaccuugccu

SEQ ID NO: 236562 - RNA, 24 nt, Human
uccuggccucaagcgauccaccca

SEQ ID NO: 236563 - RNA, 24 nt, Human
uccuggccucaagcgauccucuca

SEQ ID NO: 236564 - RNA, 32 nt, Human
uccuggccucaagcgauccucucaucucagcc

SEQ ID NO: 236565 - RNA, 32 nt, Human
uccuggccucaagugacccuccugucucagcc

SEQ ID NO: 236566 - RNA, 21 nt, Human
uccuggccucaagugauccac

SEQ ID NO: 236567 - RNA, 24 nt, Human
uccuggccucaagugauccaccca

SEQ ID NO: 236568 - RNA, 32 nt, Human
uccuggccucaagugauccacccaccucagcc

SEQ ID NO: 236569 - RNA, 32 nt, Human
uccuggccucaagugauccacuggccucagcc

SEQ ID NO: 236570 - RNA, 32 nt, Human
uccuggccucaagugauccucccaccuaggcc

SEQ ID NO: 236571 - RNA, 32 nt, Human
uccuggccucaagugauccucccaccucagcg

SEQ ID NO: 236572 - RNA, 32 nt, Human
uccuggccucaagugauccucccaccuuggcc

SEQ ID NO: 236573 - RNA, 32 nt, Human
uccuggccucaagugauccucccuccucggcc

SEQ ID NO: 236574 - RNA, 32 nt, Human
uccuggccucaagugauccuccugccucagcc

SEQ ID NO: 236575 - RNA, 32 nt, Human
uccuggccucaagugauccuccugcuuggacc

SEQ ID NO: 236576 - RNA, 23 nt, Human
uccuggccucaagugauccucuu

SEQ ID NO: 236577 - RNA, 32 nt, Human
uccuggccucaagugauccucuugccucagcc

SEQ ID NO: 236578 - RNA, 32 nt, Human
uccuggccucaagugauccuuccaucucagcc

SEQ ID NO: 236579 - RNA, 32 nt, Human
uccuggccucaagugauccuucugccucaguc

SEQ ID NO: 236580 - RNA, 32 nt, Human
uccuggccucaagugaucugcccaccuuggcc

SEQ ID NO: 236581 - RNA, 32 nt, Human
uccuggccucaagugaucugcccgccucggcc

SEQ ID NO: 236582 - RNA, 32 nt, Human
uccuggccucaagugaucugccgccucagcuu

SEQ ID NO: 236583 - RNA, 24 nt, Human
uccuggccucaagugauucacccg

SEQ ID NO: 236584 - RNA, 32 nt, Human
uccuggccucaagugauucuaucgccucugcc

SEQ ID NO: 236585 - RNA, 32 nt, Human
uccuggccucaagugauucuccugccucagcc

SEQ ID NO: 236586 - RNA, 32 nt, Human
uccuggccucaagugguccuccugccucagcc

SEQ ID NO: 236587 - RNA, 32 nt, Human
uccuggccucaagugguccuccugccuuggcc

SEQ ID NO: 236588 - RNA, 21 nt, Human
uccuggccucaccuccaccca

SEQ ID NO: 236589 - RNA, 24 nt, Human
uccuggccucacgugaucugucca

SEQ ID NO: 236590 - RNA, 22 nt, Human
uccuggccucagacugcaccca

SEQ ID NO: 236591 - RNA, 32 nt, Human
uccuggccucagccagugccuccccggcccau

SEQ ID NO: 236592 - RNA, 20 nt, Human
uccuggccucagggccauuc

SEQ ID NO: 236593 - RNA, 24 nt, Human
uccuggccucaggugacccgcccg

SEQ ID NO: 236594 - RNA, 24 nt, Human
uccuggccucaggugauccaccca

SEQ ID NO: 236595 - RNA, 24 nt, Human
uccuggccucaggugauccacccg

SEQ ID NO: 236596 - RNA, 32 nt, Human
uccuggccucaggugauccucuugucucagcc

SEQ ID NO: 236597 - RNA, 24 nt, Human
uccuggccucaggugaucugccca

SEQ ID NO: 236598 - RNA, 26 nt, Human
uccuggccucaggugugauccgcccg

SEQ ID NO: 236599 - RNA, 21 nt, Human
uccuggccucauaugauucac

SEQ ID NO: 236600 - RNA, 24 nt, Human
uccuggccucaugugaucugccca

SEQ ID NO: 236601 - RNA, 21 nt, Human
uccuggccuccccuccugucu

SEQ ID NO: 236602 - RNA, 32 nt, Human
uccuggccucgaagcccugggcugcacagccc

SEQ ID NO: 236603 - RNA, 32 nt, Human
uccuggccucugcuuuugugucucacaaaaac

SEQ ID NO: 236604 - RNA, 32 nt, Human
uccuggccucuggaaccagccugugugccagc

SEQ ID NO: 236605 - RNA, 32 nt, Human
uccuggccugaagugauccacccgccucggcc

SEQ ID NO: 236606 - RNA, 32 nt, Human
uccuggccugaagugauccucccgccucggcc

SEQ ID NO: 236607 - RNA, 32 nt, Human
uccuggccugcccucuagacuccaguccccaa

SEQ ID NO: 236608 - RNA, 32 nt, Human
uccuggccugcucucagccugugugaugauaa

SEQ ID NO: 236609 - RNA, 32 nt, Human
uccuggccugcucucagccugugugugaugau

SEQ ID NO: 236610 - RNA, 20 nt, Human
uccuggccuggaaugcacuu

SEQ ID NO: 236611 - RNA, 25 nt, Human
uccuggccuggcaggcagggcucug

SEQ ID NO: 236612 - RNA, 32 nt, Human
uccuggccugugcagcucggguuuccgagcuu

SEQ ID NO: 236613 - RNA, 32 nt, Human
uccuggccuuaagugauccucccaccucagcc

SEQ ID NO: 236614 - RNA, 32 nt, Human
uccuggccuuaagugaucugcccaucucagcg

SEQ ID NO: 236615 - RNA, 24 nt, Human
uccuggccuuaugugauccgccca

SEQ ID NO: 236616 - RNA, 20 nt, Human
uccuggccuuauuuccauuc

SEQ ID NO: 236617 - RNA, 32 nt, Human
uccuggccuucucuuugcaaggggagcugaga

SEQ ID NO: 236618 - RNA, 32 nt, Human
uccuggccuuucuccacucucccucaagccug

SEQ ID NO: 236619 - RNA, 24 nt, Human
uccuggcgaccacugcuucugucu

SEQ ID NO: 236620 - RNA, 27 nt, Human
uccuggcgccagcuggagauccauuca

SEQ ID NO: 236621 - RNA, 18 nt, Human
uccuggcgcgagacggug

SEQ ID NO: 236622 - RNA, 32 nt, Human
uccuggcgcgagcggccgcgggccaguuucua

SEQ ID NO: 236623 - RNA, 32 nt, Human
uccuggcgcugcagguccgggaggcgcaggcg

SEQ ID NO: 236624 - RNA, 32 nt, Human
uccuggcggccuggcccaggcugccgcuguac

SEQ ID NO: 236625 - RNA, 32 nt, Human
uccuggcggccuuggucgguccacagcuuccu

SEQ ID NO: 236626 - RNA, 32 nt, Human
uccuggcguuaucaaagcaaaucaaagccuuu

SEQ ID NO: 236627 - RNA, 32 nt, Human
uccuggcuaacagugaaacccugucucuacug

SEQ ID NO: 236628 - RNA, 32 nt, Human
uccuggcuacaagugauccgccugucucagcc

SEQ ID NO: 236629 - RNA, 30 nt, Human
uccuggcuauggugaaaccccgucucuacu

SEQ ID NO: 236630 - RNA, 32 nt, Human
uccuggcucaagugaucucccacuucagccuc

SEQ ID NO: 236631 - RNA, 32 nt, Human
uccuggcucaccgcagccuccaccuccagggu

SEQ ID NO: 236632 - RNA, 32 nt, Human
uccuggcucacugcaaacucugccucccaggu

SEQ ID NO: 236633 - RNA, 32 nt, Human
uccuggcucacugcaaccuccaccucccgggu

SEQ ID NO: 236634 - RNA, 32 nt, Human
uccuggcucacugcaacugcagccucccgggu

SEQ ID NO: 236635 - RNA, 32 nt, Human
uccuggcucacugcaaucuccaucucccgggu

SEQ ID NO: 236636 - RNA, 32 nt, Human
uccuggcucacugcaaucuccgccuccccagu

SEQ ID NO: 236637 - RNA, 32 nt, Human
uccuggcucacuggcuucccccuaccaaguua

SEQ ID NO: 236638 - RNA, 32 nt, Human
uccuggcucacuguaaccucuggguucaagca

SEQ ID NO: 236639 - RNA, 18 nt, Human
uccuggcuccacacuaua

SEQ ID NO: 236640 - RNA, 32 nt, Human
uccuggcuccacccuccagcauguucucaccc

SEQ ID NO: 236641 - RNA, 32 nt, Human
uccuggcucccaacagcuucucaguucccacu

SEQ ID NO: 236642 - RNA, 32 nt, Human
uccuggcucccaggaccccaccauaggcagag

SEQ ID NO: 236643 - RNA, 32 nt, Human
uccuggcucccaggguccugggggcugcugca

SEQ ID NO: 236644 - RNA, 21 nt, Human
uccuggcuccuaucucugccu

SEQ ID NO: 236645 - RNA, 32 nt, Human
uccuggcuccuaucucugccuuccaggcaucu

SEQ ID NO: 236646 - RNA, 32 nt, Human
uccuggcuccuccucggccucagcccucuccu

SEQ ID NO: 236647 - RNA, 32 nt, Human
uccuggcuccuuccuacauccugggcuccuga

SEQ ID NO: 236648 - RNA, 31 nt, Human
uccuggcucucuauauaccugugaauaugug

SEQ ID NO: 236649 - RNA, 32 nt, Human
uccuggcucugcagagagaacagcccagaaaa

SEQ ID NO: 236650 - RNA, 32 nt, Human
uccuggcucugccugucccccaccguuguucu

SEQ ID NO: 236651 - RNA, 32 nt, Human
uccuggcucuuauuccagggccuuuucccacu

SEQ ID NO: 236652 - RNA, 32 nt, Human
uccuggcugagcgggcucugaguucuguacug

SEQ ID NO: 236653 - RNA, 19 nt, Human
uccuggcugcacagggugc

SEQ ID NO: 236654 - RNA, 32 nt, Human
uccuggcugcacucuugaacugggcgaauguc

SEQ ID NO: 236655 - RNA, 32 nt, Human
uccuggcugcagcuggacaacagaagccccau

SEQ ID NO: 236656 - RNA, 32 nt, Human
uccuggcugcuggcccauccugccugggcauc

SEQ ID NO: 236657 - RNA, 24 nt, Human
uccuggcugcuuucuccccuuccc

SEQ ID NO: 236658 - RNA, 32 nt, Human
uccuggcuggcuguguuacaagugacucuucc

SEQ ID NO: 236659 - RNA, 32 nt, Human
uccuggcugugccucccauuuccccucaccug

SEQ ID NO: 236660 - RNA, 32 nt, Human
uccuggcugugucacagcacugagcucagccc

SEQ ID NO: 236661 - RNA, 32 nt, Human
uccuggcuucaagccauucuccugccuuagcc

SEQ ID NO: 236662 - RNA, 32 nt, Human
uccuggcuucaagugauccucacaccuuagcc

SEQ ID NO: 236663 - RNA, 23 nt, Human
uccuggcuucaagugauccucuu

SEQ ID NO: 236664 - RNA, 32 nt, Human
uccuggcuucaagugauccucuugcuuuggcc

SEQ ID NO: 236665 - RNA, 32 nt, Human
uccuggcuucagcaggaagugaacaggcucag

SEQ ID NO: 236666 - RNA, 32 nt, Human
uccuggcuucccgucuggucauggcgagauuc

SEQ ID NO: 236667 - RNA, 32 nt, Human
uccuggcuucuccuggugcugcccucacuguc

SEQ ID NO: 236668 - RNA, 32 nt, Human
uccuggcuugggccugaguagggcagagaggg

SEQ ID NO: 236669 - RNA, 32 nt, Human
uccuggcuuucaaacacaagucuuccaaauua

SEQ ID NO: 236670 - RNA, 32 nt, Human
uccuggcuuuuuccuuucccuucccuucucca

SEQ ID NO: 236671 - RNA, 32 nt, Human
uccugggaaagagcauccucuggcaggugcuc

SEQ ID NO: 236672 - RNA, 32 nt, Human
uccugggaauaacaucaggcugacucacaaca

SEQ ID NO: 236673 - RNA, 32 nt, Human
uccugggaauacagagaaaagagacaacuuua

SEQ ID NO: 236674 - RNA, 32 nt, Human
uccugggaaucaggagccuggacacugccauc

SEQ ID NO: 236675 - RNA, 26 nt, Human
uccugggacaagcaaggaaaguacug

SEQ ID NO: 236676 - RNA, 32 nt, Human
uccugggacagaaaauaaacaugaacuuuagu

SEQ ID NO: 236677 - RNA, 32 nt, Human
uccugggacagaaaccuuauccuacaccauug

SEQ ID NO: 236678 - RNA, 32 nt, Human
uccugggacagugggagccaagggcaagugcu

SEQ ID NO: 236679 - RNA, 32 nt, Human
uccugggaccaagauggagaagguguuccuaa

SEQ ID NO: 236680 - RNA, 22 nt, Human
uccugggacccgccuguugcuu

SEQ ID NO: 236681 - RNA, 32 nt, Human
uccugggacucccugaggaaaagugcugccuc

SEQ ID NO: 236682 - RNA, 32 nt, Human
uccugggacugcaccagacugcuccaaacuca

SEQ ID NO: 236683 - RNA, 22 nt, Human
uccugggagacagaauguguuu

SEQ ID NO: 236684 - RNA, 32 nt, Human
uccugggagaggaggaagaugaagacgaggag

SEQ ID NO: 236685 - RNA, 21 nt, Human
uccugggagaggcgcgagcca

SEQ ID NO: 236686 - RNA, 32 nt, Human
uccugggagagggcugggcaggacagagcuga

SEQ ID NO: 236687 - RNA, 21 nt, Human
uccugggagcaaggcccugca

SEQ ID NO: 236688 - RNA, 32 nt, Human
uccugggagcauucgucgugcccagccugagc

SEQ ID NO: 236689 - RNA, 32 nt, Human
uccugggagccuagaucucacuccagggucug

SEQ ID NO: 236690 - RNA, 32 nt, Human
uccugggaggaagaggaggagacgcgggaaug

SEQ ID NO: 236691 - RNA, 32 nt, Human
uccugggaggaugaagaucugccagcucugag

SEQ ID NO: 236692 - RNA, 32 nt, Human
uccugggaggcagagguuguagugagccgaga

SEQ ID NO: 236693 - RNA, 32 nt, Human
uccugggaggcugaggcaagagaaucgcuuga

SEQ ID NO: 236694 - RNA, 32 nt, Human
uccugggauagaaauguccccagaguggagaa

SEQ ID NO: 236695 - RNA, 32 nt, Human
uccugggaucaagugauccuccugccucagcc

SEQ ID NO: 236696 - RNA, 32 nt, Human
uccugggaucaagugauucuccugccuuagcc

SEQ ID NO: 236697 - RNA, 32 nt, Human
uccugggaugccucuccagccacugggcuccc

SEQ ID NO: 236698 - RNA, 21 nt, Human
uccugggaugcuucucugucu

SEQ ID NO: 236699 - RNA, 32 nt, Human
uccugggauggcugucgggagcuguaucaccu

SEQ ID NO: 236700 - RNA, 23 nt, Human
uccugggauuacaggcaugagcu

SEQ ID NO: 236701 - RNA, 24 nt, Human
uccugggauuacaggcgcgagcca

SEQ ID NO: 236702 - RNA, 23 nt, Human
uccugggauuacaggcugagcca

SEQ ID NO: 236703 - RNA, 24 nt, Human
uccugggauuacaggugugagcca

SEQ ID NO: 236704 - RNA, 32 nt, Human
uccugggauucagacggugaagacugacuucu

SEQ ID NO: 236705 - RNA, 23 nt, Human
uccugggauucugcacauagcca

SEQ ID NO: 236706 - RNA, 32 nt, Human
uccugggcaacagagugagacuuugucucaaa

SEQ ID NO: 236707 - RNA, 32 nt, Human
uccugggcaaggaagguaggaguucugugcac

SEQ ID NO: 236708 - RNA, 32 nt, Human
uccugggcacaagugauccucccaucucugcc

SEQ ID NO: 236709 - RNA, 32 nt, Human
uccugggcacaagugauccuccugccuuagcc

SEQ ID NO: 236710 - RNA, 32 nt, Human
uccugggcacauucuuuucuucugcuucccuu

SEQ ID NO: 236711 - RNA, 21 nt, Human
uccugggcaccaccacuucca

SEQ ID NO: 236712 - RNA, 32 nt, Human
uccugggcagaagcugaaggccagcuucacau

SEQ ID NO: 236713 - RNA, 32 nt, Human
uccugggcagccacaccacagagcggggaggg

SEQ ID NO: 236714 - RNA, 32 nt, Human
uccugggcagccagggcagccaggacggcacc

SEQ ID NO: 236715 - RNA, 32 nt, Human
uccugggcaggcaggugccucucagaggccac

SEQ ID NO: 236716 - RNA, 32 nt, Human
uccugggcagugagcugcggucugaggccccu

SEQ ID NO: 236717 - RNA, 20 nt, Human
uccugggcauccccacucca

SEQ ID NO: 236718 - RNA, 32 nt, Human
uccugggcaucuucuguaaugaugccucuuuc

SEQ ID NO: 236719 - RNA, 27 nt, Human
uccugggccaaggccugccuuuugccu

SEQ ID NO: 236720 - RNA, 32 nt, Human
uccugggccacaucugcccauggggaguguuu

SEQ ID NO: 236721 - RNA, 26 nt, Human
uccugggccacccucaccgucugccu

SEQ ID NO: 236722 - RNA, 32 nt, Human
uccugggccagaggggacagcuggacaguguc

SEQ ID NO: 236723 - RNA, 31 nt, Human
uccugggccagcuagaagccaggagcugauu

SEQ ID NO: 236724 - RNA, 21 nt, Human
uccugggccagcuuccugcuu

SEQ ID NO: 236725 - RNA, 32 nt, Human
uccugggccaguguccaucagccaggugcuca

SEQ ID NO: 236726 - RNA, 32 nt, Human
uccugggcccaagugauccuuccaccucaguc

SEQ ID NO: 236727 - RNA, 32 nt, Human
uccugggcccacuguucuuucucuauacuuug

SEQ ID NO: 236728 - RNA, 19 nt, Human
uccugggcccccacugcca

SEQ ID NO: 236729 - RNA, 20 nt, Human
uccugggccccgucgugcag

SEQ ID NO: 236730 - RNA, 32 nt, Human
uccugggcccggcacuccgcagccucuccauc

SEQ ID NO: 236731 - RNA, 22 nt, Human
uccugggccgccgccuccuccu

SEQ ID NO: 236732 - RNA, 32 nt, Human
uccugggccuccagguaaagagagagagccag

SEQ ID NO: 236733 - RNA, 32 nt, Human
uccugggccugcccuggcuggccaggacccca

SEQ ID NO: 236734 - RNA, 32 nt, Human
uccugggccuggaauaugaugaagagcaucag

SEQ ID NO: 236735 - RNA, 32 nt, Human
uccugggccuuccgaggccucugacaaauaaa

SEQ ID NO: 236736 - RNA, 26 nt, Human
uccugggcgccacaugcucauggcca

SEQ ID NO: 236737 - RNA, 32 nt, Human
uccugggcggcccggcuagcucugccuacgcg

SEQ ID NO: 236738 - RNA, 32 nt, Human
uccugggcgggguguuccagggugcauguuuc

SEQ ID NO: 236739 - RNA, 32 nt, Human
uccugggcuagagacaagcaccagccugcagu

SEQ ID NO: 236740 - RNA, 32 nt, Human
uccugggcucaaaugauccucccaccucagcc

SEQ ID NO: 236741 - RNA, 32 nt, Human
uccugggcucaagagauccucccacuucagcc

SEQ ID NO: 236742 - RNA, 32 nt, Human
uccugggcucaagagauccuccugccuuggcc

SEQ ID NO: 236743 - RNA, 32 nt, Human
uccugggcucaagagauugucccaccucagcc

SEQ ID NO: 236744 - RNA, 32 nt, Human
uccugggcucaagcaacccucccaccucccau

SEQ ID NO: 236745 - RNA, 32 nt, Human
uccugggcucaagcaacccucccaccuuagcc

SEQ ID NO: 236746 - RNA, 32 nt, Human
uccugggcucaagcaacccugccaccucagcc

SEQ ID NO: 236747 - RNA, 32 nt, Human
uccugggcucaagcaaucagcccaccucugcc

SEQ ID NO: 236748 - RNA, 32 nt, Human
uccugggcucaagcaauccacccaccucugcc

SEQ ID NO: 236749 - RNA, 32 nt, Human
uccugggcucaagcaauccucacaccucagcc

SEQ ID NO: 236750 - RNA, 32 nt, Human
uccugggcucaagcaauccucccaccucagcc

SEQ ID NO: 236751 - RNA, 32 nt, Human
uccugggcucaagcaauccucccaccucccag

SEQ ID NO: 236752 - RNA, 32 nt, Human
uccugggcucaagcaauccucccaccuuggcc

SEQ ID NO: 236753 - RNA, 32 nt, Human
uccugggcucaagcaauccucccaccuuggcu

SEQ ID NO: 236754 - RNA, 32 nt, Human
uccugggcucaagcaauccucccaccuugguc

SEQ ID NO: 236755 - RNA, 32 nt, Human
uccugggcucaagcaauccucccacuucagcc

SEQ ID NO: 236756 - RNA, 32 nt, Human
uccugggcucaagcaauccucccuccucagcc

SEQ ID NO: 236757 - RNA, 32 nt, Human
uccugggcucaagcaauccuccugccucagcc

SEQ ID NO: 236758 - RNA, 32 nt, Human
uccugggcucaagcaauccuccugccucagcu

SEQ ID NO: 236759 - RNA, 32 nt, Human
uccugggcucaagcaauccuccugccucggcc

SEQ ID NO: 236760 - RNA, 32 nt, Human
uccugggcucaagcaauccuccugccucggcu

SEQ ID NO: 236761 - RNA, 32 nt, Human
uccugggcucaagcaauccuccugucuuggcc

SEQ ID NO: 236762 - RNA, 32 nt, Human
uccugggcucaagcaauccucucaccgcagcc

SEQ ID NO: 236763 - RNA, 32 nt, Human
uccugggcucaagcaauccucucaucuccacc

SEQ ID NO: 236764 - RNA, 32 nt, Human
uccugggcucaagcaaucugcccgccucugcc

SEQ ID NO: 236765 - RNA, 32 nt, Human
uccugggcucaagcaaucugcuugccuugggc

SEQ ID NO: 236766 - RNA, 32 nt, Human
uccugggcucaagcaaucuucccaccucagcc

SEQ ID NO: 236767 - RNA, 32 nt, Human
uccugggcucaagcaauucucccaccucagcc

SEQ ID NO: 236768 - RNA, 32 nt, Human
uccugggcucaagcaauucuuccaccucagcc

SEQ ID NO: 236769 - RNA, 32 nt, Human
uccugggcucaagcaauucuucugccucagcc

SEQ ID NO: 236770 - RNA, 32 nt, Human
uccugggcucaagcacucugcccaccucagcc

SEQ ID NO: 236771 - RNA, 32 nt, Human
uccugggcucaagcagucaucccaccucagcc

SEQ ID NO: 236772 - RNA, 32 nt, Human
uccugggcucaagcaguccucccaccccagcc

SEQ ID NO: 236773 - RNA, 32 nt, Human
uccugggcucaagcaguccucccacccuacca

SEQ ID NO: 236774 - RNA, 32 nt, Human
uccugggcucaagcaguccucccaccucaguc

SEQ ID NO: 236775 - RNA, 32 nt, Human
uccugggcucaagcaguccucccaccuuggcc

SEQ ID NO: 236776 - RNA, 32 nt, Human
uccugggcucaagcaguccuccugccuuggcc

SEQ ID NO: 236777 - RNA, 32 nt, Human
uccugggcucaagcaguccuccugcuucagcc

SEQ ID NO: 236778 - RNA, 32 nt, Human
uccugggcucaagcaguccuucugccuuagcc

SEQ ID NO: 236779 - RNA, 32 nt, Human
uccugggcucaagcagucuacccaccucagcc

SEQ ID NO: 236780 - RNA, 32 nt, Human
uccugggcucaagcaguucucccaccucagcc

SEQ ID NO: 236781 - RNA, 32 nt, Human
uccugggcucaagccaucccccaaccuuggcc

SEQ ID NO: 236782 - RNA, 32 nt, Human
uccugggcucaagccauccucccaccaugccu

SEQ ID NO: 236783 - RNA, 32 nt, Human
uccugggcucaagccauccucccacccuggcc

SEQ ID NO: 236784 - RNA, 32 nt, Human
uccugggcucaagccauccucccgccacagcc

SEQ ID NO: 236785 - RNA, 32 nt, Human
uccugggcucaagccauccucccuccucagcc

SEQ ID NO: 236786 - RNA, 32 nt, Human
uccugggcucaagccauccuccugccucagcc

SEQ ID NO: 236787 - RNA, 24 nt, Human
uccugggcucaagccauccuucca

SEQ ID NO: 236788 - RNA, 32 nt, Human
uccugggcucaagccauccuuccgccucagcu

SEQ ID NO: 236789 - RNA, 32 nt, Human
uccugggcucaagccaucugcccgccucaucc

SEQ ID NO: 236790 - RNA, 32 nt, Human
uccugggcucaagccaucugccugccuccacc

SEQ ID NO: 236791 - RNA, 32 nt, Human
uccugggcucaagccaucuuccuuagccuccc

SEQ ID NO: 236792 - RNA, 32 nt, Human
uccugggcucaagccguucucccgccucccac

SEQ ID NO: 236793 - RNA, 32 nt, Human
uccugggcucaagccuuccucccaccugaacc

SEQ ID NO: 236794 - RNA, 32 nt, Human
uccugggcucaagcgaacugucagccucagcc

SEQ ID NO: 236795 - RNA, 32 nt, Human
uccugggcucaagcgagccucccaccucgguc

SEQ ID NO: 236796 - RNA, 32 nt, Human
uccugggcucaagcgauccacccaccuugggc

SEQ ID NO: 236797 - RNA, 32 nt, Human
uccugggcucaagcgauccuacugcccugguc

SEQ ID NO: 236798 - RNA, 32 nt, Human
uccugggcucaagcgauccucacaccucagcg

SEQ ID NO: 236799 - RNA, 32 nt, Human
uccugggcucaagcgauccuccacccucagcc

SEQ ID NO: 236800 - RNA, 32 nt, Human
uccugggcucaagcgauccucccaccucagcc

SEQ ID NO: 236801 - RNA, 32 nt, Human
uccugggcucaagcgauccucccaccucagcu

SEQ ID NO: 236802 - RNA, 32 nt, Human
uccugggcucaagcgauccucccaucucagcc

SEQ ID NO: 236803 - RNA, 32 nt, Human
uccugggcucaagcgauccuccccgcucagcc

SEQ ID NO: 236804 - RNA, 32 nt, Human
uccugggcucaagcgauccucccuccucggcc

SEQ ID NO: 236805 - RNA, 32 nt, Human
uccugggcucaagcgauccuccugccucaguc

SEQ ID NO: 236806 - RNA, 32 nt, Human
uccugggcucaagcgauccuccugcuuuggcc

SEQ ID NO: 236807 - RNA, 32 nt, Human
uccugggcucaagcgauccuucugccucagcc

SEQ ID NO: 236808 - RNA, 32 nt, Human
uccugggcucaagcgauccuucugccuuggcc

SEQ ID NO: 236809 - RNA, 32 nt, Human
uccugggcucaagcgauccuuuggccucggcc

SEQ ID NO: 236810 - RNA, 32 nt, Human
uccugggcucaagcgaucugcccaccuaggcc

SEQ ID NO: 236811 - RNA, 32 nt, Human
uccugggcucaagcgaucugcccaccucaguc

SEQ ID NO: 236812 - RNA, 32 nt, Human
uccugggcucaagcgaucuucccccuucgacc

SEQ ID NO: 236813 - RNA, 32 nt, Human
uccugggcucaagcgaugcuccugcuucagcc

SEQ ID NO: 236814 - RNA, 32 nt, Human
uccugggcucaagcgauucucaugccucagcc

SEQ ID NO: 236815 - RNA, 32 nt, Human
uccugggcucaagcgauucuccugccucagcc

SEQ ID NO: 236816 - RNA, 32 nt, Human
uccugggcucaagcgauucuccugccucagcu

SEQ ID NO: 236817 - RNA, 32 nt, Human
uccugggcucaagcgguccaccugccuccgcc

SEQ ID NO: 236818 - RNA, 27 nt, Human
uccugggcucaagcuauccuccugccu

SEQ ID NO: 236819 - RNA, 32 nt, Human
uccugggcucaagcuauccuccugccucagcc

SEQ ID NO: 236820 - RNA, 32 nt, Human
uccugggcucaagcuucccaaguagcugcaac

SEQ ID NO: 236821 - RNA, 32 nt, Human
uccugggcucaagggauccccucuucucagcu

SEQ ID NO: 236822 - RNA, 32 nt, Human
uccugggcucaagggauccucccaucucagcc

SEQ ID NO: 236823 - RNA, 32 nt, Human
uccugggcucaagggauccuccugcuuuagcc

SEQ ID NO: 236824 - RNA, 32 nt, Human
uccugggcucaagggauccugccaccucagcu

SEQ ID NO: 236825 - RNA, 32 nt, Human
uccugggcucaagggaucuuguagccuuagcc

SEQ ID NO: 236826 - RNA, 32 nt, Human
uccugggcucaaguaauccucccaccccagcc

SEQ ID NO: 236827 - RNA, 32 nt, Human
uccugggcucaaguaauccuccucccucugcc

SEQ ID NO: 236828 - RNA, 32 nt, Human
uccugggcucaaguaauccuccugccugagcc

SEQ ID NO: 236829 - RNA, 32 nt, Human
uccugggcucaaguauccaccugccucagccu

SEQ ID NO: 236830 - RNA, 32 nt, Human
uccugggcucaagugaaccucccgccucggcc

SEQ ID NO: 236831 - RNA, 32 nt, Human
uccugggcucaagugacccuccugcaucagcu

SEQ ID NO: 236832 - RNA, 32 nt, Human
uccugggcucaagugaguauccugccuaagcu

SEQ ID NO: 236833 - RNA, 32 nt, Human
uccugggcucaagugaucaucccaccucagcc

SEQ ID NO: 236834 - RNA, 32 nt, Human
uccugggcucaagugauccacccaucuccacc

SEQ ID NO: 236835 - RNA, 32 nt, Human
uccugggcucaagugauccacccgccuugccu

SEQ ID NO: 236836 - RNA, 32 nt, Human
uccugggcucaagugauccacuugccuuggcc

SEQ ID NO: 236837 - RNA, 32 nt, Human
uccugggcucaagugauccagcagccuuagcc

SEQ ID NO: 236838 - RNA, 32 nt, Human
uccugggcucaagugaucccccagccucagcc

SEQ ID NO: 236839 - RNA, 32 nt, Human
uccugggcucaagugaucccccugccuuggcc

SEQ ID NO: 236840 - RNA, 32 nt, Human
uccugggcucaagugauccgcccgccucaguc

SEQ ID NO: 236841 - RNA, 32 nt, Human
uccugggcucaagugauccucccaccucagcc

SEQ ID NO: 236842 - RNA, 32 nt, Human
uccugggcucaagugauccucccaccucagcu

SEQ ID NO: 236843 - RNA, 32 nt, Human
uccugggcucaagugauccucccaccucugcc

SEQ ID NO: 236844 - RNA, 32 nt, Human
uccugggcucaagugauccucccacuucaccu

SEQ ID NO: 236845 - RNA, 32 nt, Human
uccugggcucaagugauccucccaucuuggcc

SEQ ID NO: 236846 - RNA, 32 nt, Human
uccugggcucaagugauccucccgccuugccc

SEQ ID NO: 236847 - RNA, 32 nt, Human
uccugggcucaagugauccucccgcuucagcc

SEQ ID NO: 236848 - RNA, 32 nt, Human
uccugggcucaagugauccucccuccucagcc

SEQ ID NO: 236849 - RNA, 32 nt, Human
uccugggcucaagugauccuccggccuuggcc

SEQ ID NO: 236850 - RNA, 32 nt, Human
uccugggcucaagugauccuccugccacagcc

SEQ ID NO: 236851 - RNA, 32 nt, Human
uccugggcucaagugauccuccugccccagcc

SEQ ID NO: 236852 - RNA, 32 nt, Human
uccugggcucaagugauccuccugccucagca

SEQ ID NO: 236853 - RNA, 32 nt, Human
uccugggcucaagugauccuccugccucagcc

SEQ ID NO: 236854 - RNA, 32 nt, Human
uccugggcucaagugauccuccugccucaguc

SEQ ID NO: 236855 - RNA, 32 nt, Human
uccugggcucaagugauccuccugccucggcc

SEQ ID NO: 236856 - RNA, 32 nt, Human
uccugggcucaagugauccuccugccugggcc

SEQ ID NO: 236857 - RNA, 32 nt, Human
uccugggcucaagugauccuccugccuuagcc

SEQ ID NO: 236858 - RNA, 32 nt, Human
uccugggcucaagugauccuccugcuuuggcc

SEQ ID NO: 236859 - RNA, 32 nt, Human
uccugggcucaagugauccuccugucucggcc

SEQ ID NO: 236860 - RNA, 32 nt, Human
uccugggcucaagugauccucucacuucagcu

SEQ ID NO: 236861 - RNA, 32 nt, Human
uccugggcucaagugauccuuccaccucagcc

SEQ ID NO: 236862 - RNA, 32 nt, Human
uccugggcucaagugauccuuccacuucagcc

SEQ ID NO: 236863 - RNA, 32 nt, Human
uccugggcucaagugauccuuccaucucacuu

SEQ ID NO: 236864 - RNA, 32 nt, Human
uccugggcucaagugauccuuccaucucagcc

SEQ ID NO: 236865 - RNA, 32 nt, Human
uccugggcucaagugauccuucuacuucagau

SEQ ID NO: 236866 - RNA, 32 nt, Human
uccugggcucaagugaucugccugccuuggug

SEQ ID NO: 236867 - RNA, 32 nt, Human
uccugggcucaagugaucuucccacgugggcc

SEQ ID NO: 236868 - RNA, 32 nt, Human
uccugggcucaagugaucuuccccuucagccu

SEQ ID NO: 236869 - RNA, 32 nt, Human
uccugggcucaagugaugcuccugcaucagcc

SEQ ID NO: 236870 - RNA, 18 nt, Human
uccugggcucaagugauu

SEQ ID NO: 236871 - RNA, 32 nt, Human
uccugggcucaagugauucucccaccuugacc

SEQ ID NO: 236872 - RNA, 32 nt, Human
uccugggcucaagugauucuccugccucagcc

SEQ ID NO: 236873 - RNA, 32 nt, Human
uccugggcucaagugauucuuccaccuaaauu

SEQ ID NO: 236874 - RNA, 32 nt, Human
uccugggcucaagugcuccuccugccuuggcc

SEQ ID NO: 236875 - RNA, 32 nt, Human
uccugggcucaagugguccuccugccucagcu

SEQ ID NO: 236876 - RNA, 32 nt, Human
uccugggcucaaguguccucccacuugagugc

SEQ ID NO: 236877 - RNA, 32 nt, Human
uccugggcucaaguguccuccuacuucagcuc

SEQ ID NO: 236878 - RNA, 32 nt, Human
uccugggcucaagugucuuccugccucagccu

SEQ ID NO: 236879 - RNA, 32 nt, Human
uccugggcucaaguguuccucucaccuuaucc

SEQ ID NO: 236880 - RNA, 23 nt, Human
uccugggcucaauacucuugccu

SEQ ID NO: 236881 - RNA, 32 nt, Human
uccugggcucacaccauucuccugccucagcc

SEQ ID NO: 236882 - RNA, 32 nt, Human
uccugggcucacgugauccucucaccucaguc

SEQ ID NO: 236883 - RNA, 32 nt, Human
uccugggcucagaaguggguaaaagaagggag

SEQ ID NO: 236884 - RNA, 21 nt, Human
uccugggcucagaugauccac

SEQ ID NO: 236885 - RNA, 27 nt, Human
uccugggcucaggccauccuccugccu

SEQ ID NO: 236886 - RNA, 32 nt, Human
uccugggcucaggccauccuccugccucggcc

SEQ ID NO: 236887 - RNA, 32 nt, Human
uccugggcucaggugauccucccgccugagcc

SEQ ID NO: 236888 - RNA, 23 nt, Human
uccugggcucaggugauccucuu

SEQ ID NO: 236889 - RNA, 18 nt, Human
uccugggcucaggugauu

SEQ ID NO: 236890 - RNA, 24 nt, Human
uccugggcucaugugauccuccca

SEQ ID NO: 236891 - RNA, 32 nt, Human
uccugggcucaugugauccucccaccucagcc

SEQ ID NO: 236892 - RNA, 32 nt, Human
uccugggcuccagugauccucccccuucagcc

SEQ ID NO: 236893 - RNA, 32 nt, Human
uccugggcuccagugauccucucaccucagcc

SEQ ID NO: 236894 - RNA, 23 nt, Human
uccugggcuccccaucuccuucu

SEQ ID NO: 236895 - RNA, 32 nt, Human
uccugggcucgaaugauccucccaccuuggcc

SEQ ID NO: 236896 - RNA, 32 nt, Human
uccugggcucgaaugguccucucacugcagcc

SEQ ID NO: 236897 - RNA, 20 nt, Human
uccugggcucgccuccugcc

SEQ ID NO: 236898 - RNA, 32 nt, Human
uccugggcucgggugauccucccaccucggcc

SEQ ID NO: 236899 - RNA, 32 nt, Human
uccugggcugaagugauccuccugcuucagcc

SEQ ID NO: 236900 - RNA, 32 nt, Human
uccugggcugaagugauucucucaccucagcc

SEQ ID NO: 236901 - RNA, 32 nt, Human
uccugggcugccaggauuuagcagggaggugg

SEQ ID NO: 236902 - RNA, 32 nt, Human
uccugggcugcccuccccuccuccgggacugc

SEQ ID NO: 236903 - RNA, 32 nt, Human
uccugggcuguugccaacaguaggccugaaga

SEQ ID NO: 236904 - RNA, 32 nt, Human
uccugggcuuaaaugacucuucugccucagcc

SEQ ID NO: 236905 - RNA, 32 nt, Human
uccugggcuuaagugauccucccaccucaguc

SEQ ID NO: 236906 - RNA, 32 nt, Human
uccugggcuuaagugaucugcccgccuuggcc

SEQ ID NO: 236907 - RNA, 18 nt, Human
uccugggcuuaagugauu

SEQ ID NO: 236908 - RNA, 32 nt, Human
uccugggcuuacuccuagcugcauaggagagu

SEQ ID NO: 236909 - RNA, 32 nt, Human
uccugggcuucauggcugcagagcagggcaug

SEQ ID NO: 236910 - RNA, 32 nt, Human
uccugggcuugugccauccacccuacugguua

SEQ ID NO: 236911 - RNA, 32 nt, Human
uccuggggaagcuccuggaagccugagcaggc

SEQ ID NO: 236912 - RNA, 26 nt, Human
uccuggggaaggcucucuuccugcuu

SEQ ID NO: 236913 - RNA, 32 nt, Human
uccuggggacaguggcccaggacuugggaugu

SEQ ID NO: 236914 - RNA, 32 nt, Human
uccuggggaccucuggagccucagccagaagu

SEQ ID NO: 236915 - RNA, 32 nt, Human
uccuggggagaugcugccagcacacaggggcc

SEQ ID NO: 236916 - RNA, 23 nt, Human
uccuggggagccugccucuguuu

SEQ ID NO: 236917 - RNA, 32 nt, Human
uccuggggaggaugagaugguccaugccgggu

SEQ ID NO: 236918 - RNA, 32 nt, Human
uccuggggaggcaggaggcacaugugaggguc

SEQ ID NO: 236919 - RNA, 21 nt, Human
uccuggggagucugccugccu

SEQ ID NO: 236920 - RNA, 32 nt, Human
uccuggggagucuguggggaagaugccaucca

SEQ ID NO: 236921 - RNA, 32 nt, Human
uccuggggaguuacuuacauguucaucugcug

SEQ ID NO: 236922 - RNA, 20 nt, Human
uccuggggaguuuccugucu

SEQ ID NO: 236923 - RNA, 32 nt, Human
uccuggggauuuaccugggaugguggcugccu

SEQ ID NO: 236924 - RNA, 32 nt, Human
uccuggggcaaugcagagucucaggccugagc

SEQ ID NO: 236925 - RNA, 32 nt, Human
uccuggggcacccuacccucucuuauuuggag

SEQ ID NO: 236926 - RNA, 22 nt, Human
uccuggggcagcaggcucagca

SEQ ID NO: 236927 - RNA, 32 nt, Human
uccuggggcagccugcaccaccccauagaguu

SEQ ID NO: 236928 - RNA, 32 nt, Human
uccuggggcaggcaggaggcagugggcuucau

SEQ ID NO: 236929 - RNA, 32 nt, Human
uccuggggccaagugauccucccaccucagcc

SEQ ID NO: 236930 - RNA, 24 nt, Human
uccuggggccucagucuccugucu

SEQ ID NO: 236931 - RNA, 32 nt, Human
uccuggggccuccagccccucacacugcuguu

SEQ ID NO: 236932 - RNA, 32 nt, Human
uccuggggccuggcuuuggcuggaggggcuag

SEQ ID NO: 236933 - RNA, 32 nt, Human
uccuggggcgugcacucgccugggcagugggg

SEQ ID NO: 236934 - RNA, 32 nt, Human
uccuggggcuggugucucaggagcaggggucu

SEQ ID NO: 236935 - RNA, 32 nt, Human
uccugggggaaugggacugauggagacagaca

SEQ ID NO: 236936 - RNA, 32 nt, Human
uccugggggagccucuucuucacuggaaaccu

SEQ ID NO: 236937 - RNA, 23 nt, Human
uccugggggcaggguuccugccu

SEQ ID NO: 236938 - RNA, 21 nt, Human
uccugggggccccgcuugucu

SEQ ID NO: 236939 - RNA, 32 nt, Human
uccugggggcucuccagaccccucucuaggac

SEQ ID NO: 236940 - RNA, 21 nt, Human
uccugggguagcuccugaccu

SEQ ID NO: 236941 - RNA, 27 nt, Human
uccuggggucaggcuguucuccugccu

SEQ ID NO: 236942 - RNA, 32 nt, Human
uccuggggugagggggaaugaguguucuugac

SEQ ID NO: 236943 - RNA, 31 nt, Human
uccugggguggacucagaugggugggacaca

SEQ ID NO: 236944 - RNA, 32 nt, Human
uccugggguggaggagaccagggcaggauaga

SEQ ID NO: 236945 - RNA, 32 nt, Human
uccuggggugggaggcacaggggcaaagcaau

SEQ ID NO: 236946 - RNA, 32 nt, Human
uccuggggugugagucggaugggaccacggcc

SEQ ID NO: 236947 - RNA, 25 nt, Human
uccugggguguucugcccuuugcuu

SEQ ID NO: 236948 - RNA, 25 nt, Human
uccugggguuugucuaucuuuguuu

SEQ ID NO: 236949 - RNA, 22 nt, Human
uccugggguuuuuuguuuguuu

SEQ ID NO: 236950 - RNA, 32 nt, Human
uccuggguaaggcuucauuugaaugaaggguu

SEQ ID NO: 236951 - RNA, 23 nt, Human
uccuggguagcugggauuacagg

SEQ ID NO: 236952 - RNA, 32 nt, Human
uccuggguagggaggucacucccucuacucac

SEQ ID NO: 236953 - RNA, 21 nt, Human
uccugggucacauuuccuucu

SEQ ID NO: 236954 - RNA, 32 nt, Human
uccugggucaggagcccagcuggcugggccca

SEQ ID NO: 236955 - RNA, 32 nt, Human
uccuggguccaagugauucuccugcuucagcc

SEQ ID NO: 236956 - RNA, 32 nt, Human
uccugggucuguucccauggaguuuuuggugc

SEQ ID NO: 236957 - RNA, 32 nt, Human
uccugggucuucccucucccugccucagccuc

SEQ ID NO: 236958 - RNA, 32 nt, Human
uccugggugaucaccacaucuuuuaggggaag

SEQ ID NO: 236959 - RNA, 22 nt, Human
uccugggugcaacugugcagcc

SEQ ID NO: 236960 - RNA, 32 nt, Human
uccugggugcacacuccucccuucccucgcug

SEQ ID NO: 236961 - RNA, 18 nt, Human
uccugggugcagccgggu

SEQ ID NO: 236962 - RNA, 19 nt, Human
uccugggugcauaggacca

SEQ ID NO: 236963 - RNA, 32 nt, Human
uccugggugcauucagucucucugccucugcc

SEQ ID NO: 236964 - RNA, 19 nt, Human
uccugggugcgugggggcc

SEQ ID NO: 236965 - RNA, 32 nt, Human
uccugggugcugcagauacugcagugaaguaa

SEQ ID NO: 236966 - RNA, 21 nt, Human
uccugggugcugggauuacag

SEQ ID NO: 236967 - RNA, 21 nt, Human
uccuggguggcacuucugccu

SEQ ID NO: 236968 - RNA, 32 nt, Human
uccuggguggcgccuucaucugcagcaugauc

SEQ ID NO: 236969 - RNA, 32 nt, Human
uccugggugggacagagcaggacaaugcaaga

SEQ ID NO: 236970 - RNA, 32 nt, Human
uccugggugggagcuuauggggugguggggca

SEQ ID NO: 236971 - RNA, 32 nt, Human
uccuggguggguggagcuggggagggcauggg

SEQ ID NO: 236972 - RNA, 32 nt, Human
uccugggugucagccagaacaugucuuucaac

SEQ ID NO: 236973 - RNA, 27 nt, Human
uccuggguucaaaccauucuccugccu

SEQ ID NO: 236974 - RNA, 32 nt, Human
uccuggguucaaaccauucuccugccucagcc

SEQ ID NO: 236975 - RNA, 32 nt, Human
uccuggguucaaacgauucuccugccucagcc

SEQ ID NO: 236976 - RNA, 32 nt, Human
uccuggguucaaacgauuguccugccucagcc

SEQ ID NO: 236977 - RNA, 32 nt, Human
uccuggguucaaaugauucuccugccucagcc

SEQ ID NO: 236978 - RNA, 32 nt, Human
uccuggguucaagcaauuuucuugccucagcc

SEQ ID NO: 236979 - RNA, 32 nt, Human
uccuggguucaagcaguucucuugccucagcc

SEQ ID NO: 236980 - RNA, 32 nt, Human
uccuggguucaagcgauucuccugccucagca

SEQ ID NO: 236981 - RNA, 32 nt, Human
uccuggguucaagcgauucuccugccucagcc

SEQ ID NO: 236982 - RNA, 32 nt, Human
uccuggguucaagcgauucuccugccucagcu

SEQ ID NO: 236983 - RNA, 32 nt, Human
uccuggguucaagcgauucuccugccucaggc

SEQ ID NO: 236984 - RNA, 32 nt, Human
uccuggguucaagcgauucuccugccucaguc

SEQ ID NO: 236985 - RNA, 32 nt, Human
uccuggguucaagcgauucuccugccucugcc

SEQ ID NO: 236986 - RNA, 32 nt, Human
uccuggguucaagcgauucucuugccucaacc

SEQ ID NO: 236987 - RNA, 32 nt, Human
uccuggguucaagcgauucucuugccucagcc

SEQ ID NO: 236988 - RNA, 32 nt, Human
uccuggguucaagcgauuguccugccucagcc

SEQ ID NO: 236989 - RNA, 32 nt, Human
uccuggguucaagcgauuuucuugccucugcc

SEQ ID NO: 236990 - RNA, 32 nt, Human
uccuggguucaagugacccucccaccucagcc

SEQ ID NO: 236991 - RNA, 32 nt, Human
uccuggguucaagugacucuugugccucagcc

SEQ ID NO: 236992 - RNA, 32 nt, Human
uccuggguucaagugaucauuccaccuuggcc

SEQ ID NO: 236993 - RNA, 32 nt, Human
uccuggguucaagugauccuuccucccaagua

SEQ ID NO: 236994 - RNA, 18 nt, Human
uccuggguucaagugauu

SEQ ID NO: 236995 - RNA, 32 nt, Human
uccuggguucaagugauucuacugccucagcc

SEQ ID NO: 236996 - RNA, 32 nt, Human
uccuggguucaagugauucucaugccucagcc

SEQ ID NO: 236997 - RNA, 32 nt, Human
uccuggguucaagugauucuccaccucagccu

SEQ ID NO: 236998 - RNA, 32 nt, Human
uccuggguucaagugauucuccagccucagcc

SEQ ID NO: 236999 - RNA, 32 nt, Human
uccuggguucaagugauucucccaccucaacc

SEQ ID NO: 237000 - RNA, 32 nt, Human
uccuggguucaagugauucuccugccucagcc

SEQ ID NO: 237001 - RNA, 32 nt, Human
uccuggguucaagugauucuccugccuuagcc

SEQ ID NO: 237002 - RNA, 32 nt, Human
uccuggguucaagugauucuccugcuucagcc

SEQ ID NO: 237003 - RNA, 32 nt, Human
uccuggguucaagugauucuccugucucagcc

SEQ ID NO: 237004 - RNA, 32 nt, Human
uccuggguucaagugauucucgugccucagcc

SEQ ID NO: 237005 - RNA, 32 nt, Human
uccuggguucaagugauucucgugcuucagcc

SEQ ID NO: 237006 - RNA, 32 nt, Human
uccuggguucaagugauucucuugccucagcc

SEQ ID NO: 237007 - RNA, 32 nt, Human
uccuggguucaagugauucucuugccucaguc

SEQ ID NO: 237008 - RNA, 32 nt, Human
uccuggguucaagugauucuucugccucaacc

SEQ ID NO: 237009 - RNA, 32 nt, Human
uccuggguucaagugauucuucugccucagcc

SEQ ID NO: 237010 - RNA, 32 nt, Human
uccuggguucaagugauucuucugcuucagcc

SEQ ID NO: 237011 - RNA, 32 nt, Human
uccuggguucaagugauucuugugccucagcc

SEQ ID NO: 237012 - RNA, 32 nt, Human
uccuggguucaagugauugucccgccucagcc

SEQ ID NO: 237013 - RNA, 32 nt, Human
uccuggguucaagugauuuuccugccucagcc

SEQ ID NO: 237014 - RNA, 27 nt, Human
uccuggguucacaccauucuccugccu

SEQ ID NO: 237015 - RNA, 32 nt, Human
uccuggguucacaccauucuccugccucagcc

SEQ ID NO: 237016 - RNA, 27 nt, Human
uccuggguucacaccauucucuugccu

SEQ ID NO: 237017 - RNA, 32 nt, Human
uccuggguucacaccauucucuugccucagcc

SEQ ID NO: 237018 - RNA, 32 nt, Human
uccuggguucacaucauucuccugccucagcc

SEQ ID NO: 237019 - RNA, 32 nt, Human
uccuggguucacaugauucuccugccucagcc

SEQ ID NO: 237020 - RNA, 32 nt, Human
uccuggguucacaugauucuccugccucagcu

SEQ ID NO: 237021 - RNA, 27 nt, Human
uccuggguucaccccauucuccuguuu

SEQ ID NO: 237022 - RNA, 32 nt, Human
uccuggguucacgcaauucuccugccucagcc

SEQ ID NO: 237023 - RNA, 27 nt, Human
uccuggguucacgccauccuccugccu

SEQ ID NO: 237024 - RNA, 32 nt, Human
uccuggguucacgccauccuccugccucggcc

SEQ ID NO: 237025 - RNA, 27 nt, Human
uccuggguucacgccauucuccugccu

SEQ ID NO: 237026 - RNA, 32 nt, Human
uccuggguucacgccauucuccugccucagcc

SEQ ID NO: 237027 - RNA, 32 nt, Human
uccuggguucacgccauucuccugccucagcu

SEQ ID NO: 237028 - RNA, 32 nt, Human
uccuggguucaggcgauucuccugccucagcc

SEQ ID NO: 237029 - RNA, 32 nt, Human
uccuggguucaggcgauucuccugccucccaa

SEQ ID NO: 237030 - RNA, 32 nt, Human
uccuggguucaggugauccuccugccucagcc

SEQ ID NO: 237031 - RNA, 27 nt, Human
uccuggguucaugccauucuccugccu

SEQ ID NO: 237032 - RNA, 32 nt, Human
uccuggguucaugccauucuccugccucagcc

SEQ ID NO: 237033 - RNA, 32 nt, Human
uccuggguucaugccauucuccugccucaguc

SEQ ID NO: 237034 - RNA, 32 nt, Human
uccuggguucaugccauucuccugccucggcc

SEQ ID NO: 237035 - RNA, 27 nt, Human
uccuggguucaugccauucuccugcuu

SEQ ID NO: 237036 - RNA, 27 nt, Human
uccuggguucaugccauuuuccugccu

SEQ ID NO: 237037 - RNA, 32 nt, Human
uccuggguucaugccauuuuccugccucagcc

SEQ ID NO: 237038 - RNA, 32 nt, Human
uccuggguucgaacgauucuccugccucagcc

SEQ ID NO: 237039 - RNA, 22 nt, Human
uccuggguucugucugcugcuu

SEQ ID NO: 237040 - RNA, 32 nt, Human
uccuggguugacaccauuuuccugccucagcc

SEQ ID NO: 237041 - RNA, 27 nt, Human
uccuggguugacgccauucuccugccu

SEQ ID NO: 237042 - RNA, 32 nt, Human
uccuggguugacgccauucuccugccucagcc

SEQ ID NO: 237043 - RNA, 32 nt, Human
uccuggguugacugagaagcggcggggaaagg

SEQ ID NO: 237044 - RNA, 27 nt, Human
uccuggguuuaagccauucuucugccu

SEQ ID NO: 237045 - RNA, 32 nt, Human
uccuggguuucugccugugugacucuggauaa

SEQ ID NO: 237046 - RNA, 32 nt, Human
uccuggguuucugucccucugaggcucaccag

SEQ ID NO: 237047 - RNA, 32 nt, Human
uccugguagcugggacuacaagugugagccac

SEQ ID NO: 237048 - RNA, 32 nt, Human
uccugguagggagugcguagcaggguggaguc

SEQ ID NO: 237049 - RNA, 32 nt, Human
uccugguaucaagccauucuccugccucagcc

SEQ ID NO: 237050 - RNA, 32 nt, Human
uccuggucacaucuuuggaucuguaaaauaua

SEQ ID NO: 237051 - RNA, 32 nt, Human
uccuggucacauucucugucuccuggaaugcu

SEQ ID NO: 237052 - RNA, 19 nt, Human
uccuggucaccacauagua

SEQ ID NO: 237053 - RNA, 32 nt, Human
uccugguccagucaccaccugcagccucggca

SEQ ID NO: 237054 - RNA, 32 nt, Human
uccugguccccggucucugggcucggacugac

SEQ ID NO: 237055 - RNA, 24 nt, Human
uccuggucucaagugauccgcccg

SEQ ID NO: 237056 - RNA, 32 nt, Human
uccuggucucaagugauccgcccgccucggcc

SEQ ID NO: 237057 - RNA, 32 nt, Human
uccuggucucaagugauccuccugccuuggcc

SEQ ID NO: 237058 - RNA, 32 nt, Human
uccuggucucaagugauccuccuuccucugcu

SEQ ID NO: 237059 - RNA, 32 nt, Human
uccuggucucaagugauucaccugccuccacc

SEQ ID NO: 237060 - RNA, 32 nt, Human
uccuggucucagaccuaugaugacuugucccu

SEQ ID NO: 237061 - RNA, 32 nt, Human
uccuggucuccagugauccuccuauuucagcc

SEQ ID NO: 237062 - RNA, 32 nt, Human
uccuggucucucucccugucaucaaucagggu

SEQ ID NO: 237063 - RNA, 32 nt, Human
uccuggucuguaacuugaauuguuucuuccac

SEQ ID NO: 237064 - RNA, 22 nt, Human
uccuggugaagcccaagguuga

SEQ ID NO: 237065 - RNA, 24 nt, Human
uccuggugagacauccucuuuaua

SEQ ID NO: 237066 - RNA, 32 nt, Human
uccuggugaggguucucuuccuggcuugcaga

SEQ ID NO: 237067 - RNA, 32 nt, Human
uccuggugagugcagcugaggggcuagggccc

SEQ ID NO: 237068 - RNA, 32 nt, Human
uccuggugcacugcugccuggugcccagcaca

SEQ ID NO: 237069 - RNA, 32 nt, Human
uccuggugcagccugguaauggggccucuuca

SEQ ID NO: 237070 - RNA, 32 nt, Human
uccuggugccaccucagaccccggggugaggg

SEQ ID NO: 237071 - RNA, 32 nt, Human
uccuggugcccugaucuccugcacugagcugu

SEQ ID NO: 237072 - RNA, 32 nt, Human
uccugguggccucugugugugucccuguggcc

SEQ ID NO: 237073 - RNA, 32 nt, Human
uccuggugggaggagagagggcacaucuccag

SEQ ID NO: 237074 - RNA, 31 nt, Human
uccugguggguggugggagucugggggaccc

SEQ ID NO: 237075 - RNA, 32 nt, Human
uccugguggguguggagagggaggcccaacag

SEQ ID NO: 237076 - RNA, 32 nt, Human
uccugguggucggcgggggaucugguggccug

SEQ ID NO: 237077 - RNA, 32 nt, Human
uccuggugucaccugggccugaccaccacuua

SEQ ID NO: 237078 - RNA, 32 nt, Human
uccuggugucaucacagccaagguuuuuaggu

SEQ ID NO: 237079 - RNA, 21 nt, Human
uccuggugucucuucuuggua

SEQ ID NO: 237080 - RNA, 32 nt, Human
uccuggugucugcccaccacuguccccuugcu

SEQ ID NO: 237081 - RNA, 31 nt, Human
uccuggugugagagaaggacauugacacuga

SEQ ID NO: 237082 - RNA, 32 nt, Human
uccugguguuacugaaaaacaggugugauccu

SEQ ID NO: 237083 - RNA, 32 nt, Human
uccugguguucgagguggagguuaggcgggug

SEQ ID NO: 237084 - RNA, 32 nt, Human
uccugguuaagcccgcucccaccagcuccugu

SEQ ID NO: 237085 - RNA, 32 nt, Human
uccugguucacugcacccucugccucccaggu

SEQ ID NO: 237086 - RNA, 32 nt, Human
uccugguuccaucucugcuauaugggaaugaa

SEQ ID NO: 237087 - RNA, 32 nt, Human
uccugguucccaagucuuguuguucaucacaa

SEQ ID NO: 237088 - RNA, 32 nt, Human
uccugguucccugaggguccucaggguggagg

SEQ ID NO: 237089 - RNA, 32 nt, Human
uccugguucuagcugcucacauguacaaauca

SEQ ID NO: 237090 - RNA, 32 nt, Human
uccugguucugaccugcacuugagugucggug

SEQ ID NO: 237091 - RNA, 32 nt, Human
uccugguucuguagcaaggcuuuugcugcaau

SEQ ID NO: 237092 - RNA, 32 nt, Human
uccugguugcaaccucucuuccucugggacuu

SEQ ID NO: 237093 - RNA, 32 nt, Human
uccugguugcagccaucguccugggcggcacg

SEQ ID NO: 237094 - RNA, 32 nt, Human
uccugguugggaauauucugugaugcucugac

SEQ ID NO: 237095 - RNA, 32 nt, Human
uccugguuggugcuggucaggcugacuagagg

SEQ ID NO: 237096 - RNA, 32 nt, Human
uccugguuucaagugaucugccugccucaguc

SEQ ID NO: 237097 - RNA, 32 nt, Human
uccugguuuccugaaggagguggguggaaacg

SEQ ID NO: 237098 - RNA, 32 nt, Human
uccugguuuguuccucucuccacugaagcuga

SEQ ID NO: 237099 - RNA, 32 nt, Human
uccugguuuucugccuuugguaucaucuuccu

SEQ ID NO: 237100 - RNA, 32 nt, Human
uccugguuuuuaauucugugcuaugucaaugg

SEQ ID NO: 237101 - RNA, 32 nt, Human
uccuguaaaccagcguuccagcauuugccaaa

SEQ ID NO: 237102 - RNA, 32 nt, Human
uccuguaaagacuucagugaaauagcuguuuu

SEQ ID NO: 237103 - RNA, 32 nt, Human
uccuguaaagccugcagaacugugagucaauu

SEQ ID NO: 237104 - RNA, 32 nt, Human
uccuguaacguuggauccuccuuuucuguccc

SEQ ID NO: 237105 - RNA, 32 nt, Human
uccuguaagccccugaauuaagcagaaagucu

SEQ ID NO: 237106 - RNA, 32 nt, Human
uccuguaagcugugcagaaccugcugcuaaca

SEQ ID NO: 237107 - RNA, 32 nt, Human
uccuguacacagugggaagauuuuaguucaca

SEQ ID NO: 237108 - RNA, 32 nt, Human
uccuguacaccucccuccuuuuucuccuuugu

SEQ ID NO: 237109 - RNA, 32 nt, Human
uccuguacagaaacccucccuggccucauccu

SEQ ID NO: 237110 - RNA, 32 nt, Human
uccuguacagccugcaaaacugugagucaauu

SEQ ID NO: 237111 - RNA, 32 nt, Human
uccuguacagccugcagaacuguggaccaauc

SEQ ID NO: 237112 - RNA, 32 nt, Human
uccuguacauuuccucaggaacccaaccugca

SEQ ID NO: 237113 - RNA, 32 nt, Human
uccuguaccaacacugaaauccagcugucaca

SEQ ID NO: 237114 - RNA, 24 nt, Human
uccuguaccuuggagguccauuca

SEQ ID NO: 237115 - RNA, 32 nt, Human
uccuguacgucaacucaucuggcuccaaggaa

SEQ ID NO: 237116 - RNA, 32 nt, Human
uccuguacuaccucacuccugaggggagaugc

SEQ ID NO: 237117 - RNA, 32 nt, Human
uccuguacuaccucacuccugaggggagaugu

SEQ ID NO: 237118 - RNA, 32 nt, Human
uccuguacucucucuucuccgugcacucaguc

SEQ ID NO: 237119 - RNA, 32 nt, Human
uccuguagaagucacuaauaaaggaguauuuu

SEQ ID NO: 237120 - RNA, 32 nt, Human
uccuguagaccuugacauucagaaagauguga

SEQ ID NO: 237121 - RNA, 32 nt, Human
uccuguagcauauggggagacuaaggccugga

SEQ ID NO: 237122 - RNA, 32 nt, Human
uccuguagcaucuuugcugggcuacgcagaag

SEQ ID NO: 237123 - RNA, 32 nt, Human
uccuguaggagaaaagucagcccugccccugg

SEQ ID NO: 237124 - RNA, 32 nt, Human
uccuguagggaucccagcuggggaaggugcag

SEQ ID NO: 237125 - RNA, 32 nt, Human
uccuguauaccuccuccagccaugaaguagag

SEQ ID NO: 237126 - RNA, 32 nt, Human
uccuguauagccugcgggacugugagucaauu

SEQ ID NO: 237127 - RNA, 32 nt, Human
uccuguauguagcacucaacugugcauugaga

SEQ ID NO: 237128 - RNA, 32 nt, Human
uccuguauuucccuuaauuccuccucccgacc

SEQ ID NO: 237129 - RNA, 32 nt, Human
uccugucaacagcaaucgcccauuuccaaagc

SEQ ID NO: 237130 - RNA, 32 nt, Human
uccugucaaccaggccaccucuccuucagugu

SEQ ID NO: 237131 - RNA, 32 nt, Human
uccugucaagagaccuaggucuacugauggca

SEQ ID NO: 237132 - RNA, 32 nt, Human
uccugucaaggccaucucaaaaggagaagcaa

SEQ ID NO: 237133 - RNA, 32 nt, Human
uccugucacccaggcuggaguacaguggcgug

SEQ ID NO: 237134 - RNA, 32 nt, Human
uccugucacugcaaucugugacauuccagaug

SEQ ID NO: 237135 - RNA, 32 nt, Human
uccugucacugcauuccaauggcagcuguacu

SEQ ID NO: 237136 - RNA, 32 nt, Human
uccugucagaaauaaaccaaggcucuaaaaga

SEQ ID NO: 237137 - RNA, 32 nt, Human
uccugucagagauaugcgaggucuccacugag

SEQ ID NO: 237138 - RNA, 32 nt, Human
uccugucagcccccucaccugcagccuguugc

SEQ ID NO: 237139 - RNA, 32 nt, Human
uccugucaggaggcagauaaugcuggugccuc

SEQ ID NO: 237140 - RNA, 19 nt, Human
uccugucagggaccagaug

SEQ ID NO: 237141 - RNA, 32 nt, Human
uccuguccaaguuugggcgcagaugguggagu

SEQ ID NO: 237142 - RNA, 32 nt, Human
uccuguccaaucucccugccauuucucuauuc

SEQ ID NO: 237143 - RNA, 22 nt, Human
uccuguccacagcuucccuuua

SEQ ID NO: 237144 - RNA, 32 nt, Human
uccuguccagcagguagugggugaauguguga

SEQ ID NO: 237145 - RNA, 32 nt, Human
uccugucccacugaggucagaguccuacagug

SEQ ID NO: 237146 - RNA, 19 nt, Human
uccuguccccagagcugua

SEQ ID NO: 237147 - RNA, 32 nt, Human
uccugucccccaggaaccucacagggguauca

SEQ ID NO: 237148 - RNA, 32 nt, Human
uccuguccccggcggggugccugcuguccguc

SEQ ID NO: 237149 - RNA, 32 nt, Human
uccuguccccuccugagauccauacuuagucc

SEQ ID NO: 237150 - RNA, 32 nt, Human
uccuguccccucuguuucccauggcccaagcc

SEQ ID NO: 237151 - RNA, 32 nt, Human
uccuguccccuuauccuuucucccucuguaaa

SEQ ID NO: 237152 - RNA, 32 nt, Human
uccugucccucaccuccuucaccaguguccgu

SEQ ID NO: 237153 - RNA, 31 nt, Human
uccugucccuccaaggaggcagggauggggg

SEQ ID NO: 237154 - RNA, 32 nt, Human
uccugucccugccugcucugggugcucaugga

SEQ ID NO: 237155 - RNA, 32 nt, Human
uccugucccugccuuuucaccccugcugccug

SEQ ID NO: 237156 - RNA, 23 nt, Human
uccugucccuuccccuucugcuu

SEQ ID NO: 237157 - RNA, 32 nt, Human
uccuguccgcccuucuccucugccauccagaa

SEQ ID NO: 237158 - RNA, 32 nt, Human
uccuguccuaucuccacugugccugccuaaau

SEQ ID NO: 237159 - RNA, 32 nt, Human
uccuguccuaugaggcccuccccauggcuuua

SEQ ID NO: 237160 - RNA, 32 nt, Human
uccuguccucaagugauccucccaccucagcc

SEQ ID NO: 237161 - RNA, 32 nt, Human
uccuguccucaccccacccugccaccaucagc

SEQ ID NO: 237162 - RNA, 32 nt, Human
uccuguccucugccagacuuuuuaaucucuuc

SEQ ID NO: 237163 - RNA, 32 nt, Human
uccuguccugaacaaggcagcggcuccuuggu

SEQ ID NO: 237164 - RNA, 32 nt, Human
uccuguccugacccucucugaauuauguuuca

SEQ ID NO: 237165 - RNA, 32 nt, Human
uccuguccuucacuguccuugccaucaccagc

SEQ ID NO: 237166 - RNA, 32 nt, Human
uccugucgcccaggcuggagugcaauggcacg

SEQ ID NO: 237167 - RNA, 32 nt, Human
uccugucggagaggaggguggacuucggagaa

SEQ ID NO: 237168 - RNA, 21 nt, Human
uccugucguccucugcggccu

SEQ ID NO: 237169 - RNA, 32 nt, Human
uccugucuacagcagcuuccucaguuuccuac

SEQ ID NO: 237170 - RNA, 32 nt, Human
uccugucuccaccucucagucccccuagaaug

SEQ ID NO: 237171 - RNA, 32 nt, Human
uccugucucccagggacauguaugcuuccagg

SEQ ID NO: 237172 - RNA, 32 nt, Human
uccugucucccgcuuuccucaccacauacagc

SEQ ID NO: 237173 - RNA, 32 nt, Human
uccugucuccucugaacgcccagcacacucag

SEQ ID NO: 237174 - RNA, 32 nt, Human
uccugucuccuggaggacaaggaugagggcuu

SEQ ID NO: 237175 - RNA, 32 nt, Human
uccugucuccuuggaccucuuugauucugugg

SEQ ID NO: 237176 - RNA, 32 nt, Human
uccugucucggccucccagagugcuggaauua

SEQ ID NO: 237177 - RNA, 32 nt, Human
uccugucucggcuguuguggguugcagguugg

SEQ ID NO: 237178 - RNA, 32 nt, Human
uccugucucucauccucuacaucuucaccaag

SEQ ID NO: 237179 - RNA, 32 nt, Human
uccugucucugccaccuccacaguucgauuga

SEQ ID NO: 237180 - RNA, 32 nt, Human
uccugucucuuuccuuucacccuagccugacu

SEQ ID NO: 237181 - RNA, 32 nt, Human
uccugucugaccacugcagaccagucucggag

SEQ ID NO: 237182 - RNA, 32 nt, Human
uccugucugacuguccugaaaaccagaaaagc

SEQ ID NO: 237183 - RNA, 32 nt, Human
uccugucugagcuugaggcccugggacuuggg

SEQ ID NO: 237184 - RNA, 32 nt, Human
uccugucugcagcugugaauagucauuugacu

SEQ ID NO: 237185 - RNA, 32 nt, Human
uccugucugccuggcuucuugucuguccugcu

SEQ ID NO: 237186 - RNA, 32 nt, Human
uccugucugcuggccucuccugcuacuuauca

SEQ ID NO: 237187 - RNA, 32 nt, Human
uccugucuggggagaucuggcagccaccaccu

SEQ ID NO: 237188 - RNA, 22 nt, Human
uccugucuguccaccuccuccu

SEQ ID NO: 237189 - RNA, 32 nt, Human
uccugucuguccuggaggugggagacaaggaa

SEQ ID NO: 237190 - RNA, 32 nt, Human
uccugucugucucggacagaaaacacgaggcu

SEQ ID NO: 237191 - RNA, 32 nt, Human
uccugucuuagcacugcccugcuagcucuucc

SEQ ID NO: 237192 - RNA, 32 nt, Human
uccugucuuauuccacugcuucucccagcauu

SEQ ID NO: 237193 - RNA, 32 nt, Human
uccugucuuccuccuugucccaugaaggccac

SEQ ID NO: 237194 - RNA, 32 nt, Human
uccugucuuucuggcccuuucuggaccagauc

SEQ ID NO: 237195 - RNA, 32 nt, Human
uccugugaacacagaggagcaccuguuugcug

SEQ ID NO: 237196 - RNA, 32 nt, Human
uccugugaacaguauugaaaaaccccaacggc

SEQ ID NO: 237197 - RNA, 32 nt, Human
uccugugaacaucuuagugaaauguuagguuc

SEQ ID NO: 237198 - RNA, 32 nt, Human
uccugugaagauuuuuaucuuuggacuacuag

SEQ ID NO: 237199 - RNA, 32 nt, Human
uccugugacugcacuguccgccugugggaugu

SEQ ID NO: 237200 - RNA, 32 nt, Human
uccugugagccccacucccggccccacucacu

SEQ ID NO: 237201 - RNA, 32 nt, Human
uccugugagccccacuccuggccccacucaca

SEQ ID NO: 237202 - RNA, 32 nt, Human
uccugugagccggggaccaugcagcccgaaac

SEQ ID NO: 237203 - RNA, 32 nt, Human
uccugugagcugggcguugcagucugcucgaa

SEQ ID NO: 237204 - RNA, 32 nt, Human
uccugugaggcagacaggacagugagguuguc

SEQ ID NO: 237205 - RNA, 32 nt, Human
uccugugaggggaauggucaguaccagcccuu

SEQ ID NO: 237206 - RNA, 32 nt, Human
uccugugaguagcuacggcacugcagcauucc

SEQ ID NO: 237207 - RNA, 32 nt, Human
uccugugagugccugcccucccuucaucuacg

SEQ ID NO: 237208 - RNA, 32 nt, Human
uccugugaguuucugggcucuggccuccugaa

SEQ ID NO: 237209 - RNA, 32 nt, Human
uccugugauaacuuaaaaggcucuuuuauguu

SEQ ID NO: 237210 - RNA, 32 nt, Human
uccugugauggaggauacuggcauccagcgag

SEQ ID NO: 237211 - RNA, 20 nt, Human
uccugugcaaacauauguua

SEQ ID NO: 237212 - RNA, 32 nt, Human
uccugugcaagggggagcuuugcuccaggaca

SEQ ID NO: 237213 - RNA, 32 nt, Human
uccugugcauuccaaguguugccugcaugccu

SEQ ID NO: 237214 - RNA, 32 nt, Human
uccugugcauugguggcaucacagaccccagc

SEQ ID NO: 237215 - RNA, 32 nt, Human
uccugugccagccuucaugcccagcccgcucu

SEQ ID NO: 237216 - RNA, 32 nt, Human
uccugugcccacuccggcuuguccucaucucu

SEQ ID NO: 237217 - RNA, 32 nt, Human
uccugugccccagcugccaaaggagagugggg

SEQ ID NO: 237218 - RNA, 19 nt, Human
uccugugccggccgagagg

SEQ ID NO: 237219 - RNA, 32 nt, Human
uccugugccucaccacagcuugcuuagagcaa

SEQ ID NO: 237220 - RNA, 30 nt, Human
uccugugccucaucacugcuccugucacca

SEQ ID NO: 237221 - RNA, 32 nt, Human
uccugugccugauucauugggucccacaccca

SEQ ID NO: 237222 - RNA, 32 nt, Human
uccugugccugugacucuccccaaauugcccu

SEQ ID NO: 237223 - RNA, 32 nt, Human
uccugugcuaucuucucuucuauccaaguaga

SEQ ID NO: 237224 - RNA, 32 nt, Human
uccugugcucaagugacccucccaccucauuc

SEQ ID NO: 237225 - RNA, 24 nt, Human
uccugugcucaagugauccgcuca

SEQ ID NO: 237226 - RNA, 32 nt, Human
uccugugcucccuccuagcgcaguggccaagc

SEQ ID NO: 237227 - RNA, 32 nt, Human
uccugugcucugaugcuacuucugccuagccc

SEQ ID NO: 237228 - RNA, 32 nt, Human
uccuguggaaggcagaggcagugagggaggug

SEQ ID NO: 237229 - RNA, 32 nt, Human
uccuguggacagcucaccuagcggcaauggcu

SEQ ID NO: 237230 - RNA, 32 nt, Human
uccuguggacagcucaccuagcugcaauggcu

SEQ ID NO: 237231 - RNA, 32 nt, Human
uccuguggacaggccaggcaggugggccucag

SEQ ID NO: 237232 - RNA, 32 nt, Human
uccuguggagcuuuuccuccugcuugggccua

SEQ ID NO: 237233 - RNA, 32 nt, Human
uccuguggagggcugggcacccguacccgcag

SEQ ID NO: 237234 - RNA, 32 nt, Human
uccuguggccaggcacagagccaggugcuuua

SEQ ID NO: 237235 - RNA, 21 nt, Human
uccuguggcccuggccucagg

SEQ ID NO: 237236 - RNA, 32 nt, Human
uccuguggcucugccaucagcuccaauaucaa

SEQ ID NO: 237237 - RNA, 32 nt, Human
uccuguggcucuggagugagggccagguucag

SEQ ID NO: 237238 - RNA, 32 nt, Human
uccuguggcuucccuuggcaggcugcauucag

SEQ ID NO: 237239 - RNA, 32 nt, Human
uccugugggcagaagagacaggaguggaccag

SEQ ID NO: 237240 - RNA, 32 nt, Human
uccugugggccacugcacaucugccucucuca

SEQ ID NO: 237241 - RNA, 32 nt, Human
uccugugggcccucuuucaaaguccagccuag

SEQ ID NO: 237242 - RNA, 32 nt, Human
uccugugggccuugcggcaucuucaucacuga

SEQ ID NO: 237243 - RNA, 32 nt, Human
uccuguggucuccgcaccucuccagcuccugc

SEQ ID NO: 237244 - RNA, 32 nt, Human
uccugugguucacagcuguaguauggagauua

SEQ ID NO: 237245 - RNA, 32 nt, Human
uccuguguaggggaucaggaccagccucgcaa

SEQ ID NO: 237246 - RNA, 23 nt, Human
uccugugucauccucggggccua

SEQ ID NO: 237247 - RNA, 32 nt, Human
uccugugucauccucggggccuaugagcuccg

SEQ ID NO: 237248 - RNA, 32 nt, Human
uccugugucccaccccucaccccuuuaccccc

SEQ ID NO: 237249 - RNA, 23 nt, Human
uccuguguccuccuccacuuccc

SEQ ID NO: 237250 - RNA, 32 nt, Human
uccugugugcaacguggagcagacagccucga

SEQ ID NO: 237251 - RNA, 32 nt, Human
uccuguguggcagaaaguaaaagaaaauuccc

SEQ ID NO: 237252 - RNA, 32 nt, Human
uccuguguuacuuuacugaucaggugacuuug

SEQ ID NO: 237253 - RNA, 32 nt, Human
uccuguguucaagugauucuugugccucagcc

SEQ ID NO: 237254 - RNA, 32 nt, Human
uccuguguucucugcaggaggcuuaucuaguu

SEQ ID NO: 237255 - RNA, 32 nt, Human
uccuguguucucuggcuucagaguuucaccug

SEQ ID NO: 237256 - RNA, 32 nt, Human
uccuguguugcccaggcugguauucaaacucc

SEQ ID NO: 237257 - RNA, 24 nt, Human
uccuguguuuagauuauccacuca

SEQ ID NO: 237258 - RNA, 32 nt, Human
uccuguguuucccauggccaguggccaugccc

SEQ ID NO: 237259 - RNA, 20 nt, Human
uccuguuaacccuccaccuc

SEQ ID NO: 237260 - RNA, 32 nt, Human
uccuguuaagccuguggaacugugaguccaau

SEQ ID NO: 237261 - RNA, 32 nt, Human
uccuguuaaugaaugagguugaucagaucaaa

SEQ ID NO: 237262 - RNA, 32 nt, Human
uccuguuacccaggcuggaggacagugaugug

SEQ ID NO: 237263 - RNA, 32 nt, Human
uccuguuacuaaacaccauccccagccuguaa

SEQ ID NO: 237264 - RNA, 32 nt, Human
uccuguuaggagagcugaggccagcugcccac

SEQ ID NO: 237265 - RNA, 32 nt, Human
uccuguuaggugcuucgucugaaagugaacuc

SEQ ID NO: 237266 - RNA, 32 nt, Human
uccuguuauuuggaggcuuuuuggcauaguug

SEQ ID NO: 237267 - RNA, 32 nt, Human
uccuguucaaagaagcuuucaccaugggcuuc

SEQ ID NO: 237268 - RNA, 32 nt, Human
uccuguucacccaggaggucaacaauggaagg

SEQ ID NO: 237269 - RNA, 32 nt, Human
uccuguucaccuaggugaggugugugcagcag

SEQ ID NO: 237270 - RNA, 32 nt, Human
uccuguucaucauagcauuggaaguucuggcc

SEQ ID NO: 237271 - RNA, 32 nt, Human
uccuguucccaaaucacaagggccugaaggug

SEQ ID NO: 237272 - RNA, 32 nt, Human
uccuguuccccucacagcuccagacaugucca

SEQ ID NO: 237273 - RNA, 32 nt, Human
uccuguucccuccugguccuggacaccuccca

SEQ ID NO: 237274 - RNA, 32 nt, Human
uccuguuccugggugcgccuccaccucccuuc

SEQ ID NO: 237275 - RNA, 32 nt, Human
uccuguucucccagcuccucaccugggcuacu

SEQ ID NO: 237276 - RNA, 32 nt, Human
uccuguucuccucauugccugccuuccauuca

SEQ ID NO: 237277 - RNA, 32 nt, Human
uccuguucuccucugcuucauucucguccagc

SEQ ID NO: 237278 - RNA, 32 nt, Human
uccuguucucuuuccuugacugugccauugga

SEQ ID NO: 237279 - RNA, 32 nt, Human
uccuguucugcaccccucuccccaugggaccu

SEQ ID NO: 237280 - RNA, 24 nt, Human
uccuguucuuccacuuuccugccu

SEQ ID NO: 237281 - RNA, 22 nt, Human
uccuguucuuucugaacgggug

SEQ ID NO: 237282 - RNA, 21 nt, Human
uccuguugcaaugacacauag

SEQ ID NO: 237283 - RNA, 32 nt, Human
uccuguugcccacugcacugccccagcccagc

SEQ ID NO: 237284 - RNA, 32 nt, Human
uccuguugcccuuuuaagcugcggcuugacag

SEQ ID NO: 237285 - RNA, 19 nt, Human
uccuguugccucuccugcc

SEQ ID NO: 237286 - RNA, 32 nt, Human
uccuguugcgcccagcccuggucucagcagcg

SEQ ID NO: 237287 - RNA, 32 nt, Human
uccuguugcugauuuucugucuugagggaaaa

SEQ ID NO: 237288 - RNA, 32 nt, Human
uccuguuggaauuuggacuugccaugaggugu

SEQ ID NO: 237289 - RNA, 32 nt, Human
uccuguugguuuucuuaucugccuauuucccg

SEQ ID NO: 237290 - RNA, 32 nt, Human
uccuguugugcaggcuggagugcaguggcaca

SEQ ID NO: 237291 - RNA, 32 nt, Human
uccuguugugcaggcuguagugcaguggcacg

SEQ ID NO: 237292 - RNA, 32 nt, Human
uccuguuguuucuguuccugaccuugggcagg

SEQ ID NO: 237293 - RNA, 32 nt, Human
uccuguuucacagcuggaggaagccuggguau

SEQ ID NO: 237294 - RNA, 32 nt, Human
uccuguuucccuucccuuccacugccucugcc

SEQ ID NO: 237295 - RNA, 32 nt, Human
uccuguuuccucugcugacccagcugggaggg

SEQ ID NO: 237296 - RNA, 28 nt, Human
uccuguuucgcucucagagguuuauuua

SEQ ID NO: 237297 - RNA, 32 nt, Human
uccuguuucucacccagcaccuggggagaucg

SEQ ID NO: 237298 - RNA, 32 nt, Human
uccuguuucucaucuguggcuucugaaacacu

SEQ ID NO: 237299 - RNA, 32 nt, Human
uccuguuucucuacauccucuucagcaucugu

SEQ ID NO: 237300 - RNA, 32 nt, Human
uccuguuucugccuuuguccucaauagaacca

SEQ ID NO: 237301 - RNA, 32 nt, Human
uccuguuucugcucuuuuccuccacggacucc

SEQ ID NO: 237302 - RNA, 27 nt, Human
uccuguuucuucccauuuccuggcaca

SEQ ID NO: 237303 - RNA, 32 nt, Human
uccuguuugaccucgucaaucaucgcagacug

SEQ ID NO: 237304 - RNA, 32 nt, Human
uccuguuuguaaggcugugccugcucagagcu

SEQ ID NO: 237305 - RNA, 32 nt, Human
uccuguuuguacaaagucuugcuuuuauaagg

SEQ ID NO: 237306 - RNA, 32 nt, Human
uccuguuugucuugugucuugagagcuuggcc

SEQ ID NO: 237307 - RNA, 32 nt, Human
uccuguuugugccuccccuuagucccuucccu

SEQ ID NO: 237308 - RNA, 32 nt, Human
uccuguuuguugcaacagaaaacucggauagu

SEQ ID NO: 237309 - RNA, 21 nt, Human
uccuguuuuagccuucugucu

SEQ ID NO: 237310 - RNA, 32 nt, Human
uccuguuuucugagcugccacaggggaggagu

SEQ ID NO: 237311 - RNA, 32 nt, Human
uccuguuuuucuucccuuugucagucuucgca

SEQ ID NO: 237312 - RNA, 32 nt, Human
uccuguuuuuguuuuguuugguguuuuguucc

SEQ ID NO: 237313 - RNA, 32 nt, Human
uccuuaaaaguggaggaggggccagcgugggg

SEQ ID NO: 237314 - RNA, 32 nt, Human
uccuuaaaccacaaaagaaaacagugaaagua

SEQ ID NO: 237315 - RNA, 32 nt, Human
uccuuaacaaauucuggcugacgaagguccag

SEQ ID NO: 237316 - RNA, 32 nt, Human
uccuuaacauauuugcacaauuuuauagcaca

SEQ ID NO: 237317 - RNA, 22 nt, Human
uccuuaacauuucuuggcaaca

SEQ ID NO: 237318 - RNA, 32 nt, Human
uccuuaagaaaugcuauauuuugugagugcaa

SEQ ID NO: 237319 - RNA, 32 nt, Human
uccuuaagaccaucuguucagggguucacaaa

SEQ ID NO: 237320 - RNA, 32 nt, Human
uccuuaaggcccagagguagcuuggacaagcc

SEQ ID NO: 237321 - RNA, 32 nt, Human
uccuuaagggaggagagcaagcagguguggcc

SEQ ID NO: 237322 - RNA, 25 nt, Human
uccuuaauccuagaugauuugcuca

SEQ ID NO: 237323 - RNA, 32 nt, Human
uccuuaaugccuccuucacugggccuuccuag

SEQ ID NO: 237324 - RNA, 32 nt, Human
uccuuacauuuguagguguucucuccauuaug

SEQ ID NO: 237325 - RNA, 32 nt, Human
uccuuacccaggagugcuggcuuauagaguua

SEQ ID NO: 237326 - RNA, 23 nt, Human
uccuuacccaugcccacggcaca

SEQ ID NO: 237327 - RNA, 32 nt, Human
uccuuacccccuuucuagcugugugauguaga

SEQ ID NO: 237328 - RNA, 32 nt, Human
uccuuaccccuuccuuuccuuaccuuguuucu

SEQ ID NO: 237329 - RNA, 32 nt, Human
uccuuacccugccuuugcccuuucaggaaggg

SEQ ID NO: 237330 - RNA, 32 nt, Human
uccuuaccuacugggaucacgugaccugaccu

SEQ ID NO: 237331 - RNA, 24 nt, Human
uccuuaccucaggugauccaccca

SEQ ID NO: 237332 - RNA, 23 nt, Human
uccuuaccucaggugaucugcuu

SEQ ID NO: 237333 - RNA, 32 nt, Human
uccuuaccugguguguuuucuauaaaucuuca

SEQ ID NO: 237334 - RNA, 32 nt, Human
uccuuaccuuaaaucucuuggcuuuuacuggg

SEQ ID NO: 237335 - RNA, 32 nt, Human
uccuuaccuugauguugaacugcgaauccucc

SEQ ID NO: 237336 - RNA, 32 nt, Human
uccuuaccuuggaaggugaaugauccugccag

SEQ ID NO: 237337 - RNA, 32 nt, Human
uccuuaccuuggaaggugaaugauccuggcag

SEQ ID NO: 237338 - RNA, 32 nt, Human
uccuuacgcagaggaauuggugugccuuaaag

SEQ ID NO: 237339 - RNA, 32 nt, Human
uccuuacuccugcauuguucuuugccagagac

SEQ ID NO: 237340 - RNA, 26 nt, Human
uccuuacuccuggguggggaguggga

SEQ ID NO: 237341 - RNA, 32 nt, Human
uccuuacucuggcuccccuccuggaugucucc

SEQ ID NO: 237342 - RNA, 21 nt, Human
uccuuacugcugaacauccug

SEQ ID NO: 237343 - RNA, 32 nt, Human
uccuuacuuccaggcugggugccguaacucac

SEQ ID NO: 237344 - RNA, 32 nt, Human
uccuuagaaagagggggaagccaauggccugu

SEQ ID NO: 237345 - RNA, 32 nt, Human
uccuuagacugaugcuuugacugaaucaucac

SEQ ID NO: 237346 - RNA, 32 nt, Human
uccuuagaguagagaagaaaaguaggggugca

SEQ ID NO: 237347 - RNA, 32 nt, Human
uccuuagcaaggggcucagaacaccccgcucu

SEQ ID NO: 237348 - RNA, 32 nt, Human
uccuuagcccgccggcucccagccuuugaugc

SEQ ID NO: 237349 - RNA, 32 nt, Human
uccuuagcccuagggcaguuucccucagacag

SEQ ID NO: 237350 - RNA, 32 nt, Human
uccuuagcccugugucaguuuacccucgaugc

SEQ ID NO: 237351 - RNA, 32 nt, Human
uccuuagccgggaagcuggcagaggagagccg

SEQ ID NO: 237352 - RNA, 32 nt, Human
ucggaccugcacacgacuccccaacucccgcc

SEQ ID NO: 237353 - RNA, 22 nt, Human
ucggaccugggcuuuucuccca

SEQ ID NO: 237354 - RNA, 32 nt, Human
ucggacgaccaggaugggaagaucguagauga

SEQ ID NO: 237355 - RNA, 32 nt, Human
ucggacgccccaggcauauacaagcugaguuu

SEQ ID NO: 237356 - RNA, 32 nt, Human
ucggacggcuacucgggagcuuauugcacaag

SEQ ID NO: 237357 - RNA, 32 nt, Human
ucggacgggaccugggcucucuccacgauucu

SEQ ID NO: 237358 - RNA, 32 nt, Human
ucggacuccauggcuaagaccacagacgggca

SEQ ID NO: 237359 - RNA, 32 nt, Human
ucggacucccaaagugcugggauuacaggcgu

SEQ ID NO: 237360 - RNA, 19 nt, Human
ucggacuccugggcucaag

SEQ ID NO: 237361 - RNA, 32 nt, Human
ucggacugcaaguggagaauggggacuguagu

SEQ ID NO: 237362 - RNA, 32 nt, Human
ucggacugccaagaaggaagaauuugaacauc

SEQ ID NO: 237363 - RNA, 32 nt, Human
ucggacugugugcagguugcagaggaagagua

SEQ ID NO: 237364 - RNA, 32 nt, Human
ucggacuuucccucagcccuuccaggccucgc

SEQ ID NO: 237365 - RNA, 28 nt, Human
ucggagaaggcucuacagggaagggguc

SEQ ID NO: 237366 - RNA, 32 nt, Human
ucggagaccacuccagcucggacggacccacu

SEQ ID NO: 237367 - RNA, 32 nt, Human
ucggagaccagccugggcaacacagggagacg

SEQ ID NO: 237368 - RNA, 32 nt, Human
ucggagaccagccugggcaacauggcgagauc

SEQ ID NO: 237369 - RNA, 32 nt, Human
ucggagacccugucuccaccucuagguuuggc

SEQ ID NO: 237370 - RNA, 32 nt, Human
ucggagagagaagacguggagggagggacaga

SEQ ID NO: 237371 - RNA, 32 nt, Human
ucggagagagaagggaaggggaguguccccag

SEQ ID NO: 237372 - RNA, 32 nt, Human
ucggagaggggacguggccuggggaagagcac

SEQ ID NO: 237373 - RNA, 32 nt, Human
ucggagaguccugguggguggugggagucugg

SEQ ID NO: 237374 - RNA, 32 nt, Human
ucggagaugaugcagcacacacacaauucccc

SEQ ID NO: 237375 - RNA, 32 nt, Human
ucggagcacggugacggcgccaugucccuaau

SEQ ID NO: 237376 - RNA, 32 nt, Human
ucggagcacuuuacagaagcugacuguacauu

SEQ ID NO: 237377 - RNA, 32 nt, Human
ucggagcaucgccgaggagaucaagaaccugg

SEQ ID NO: 237378 - RNA, 32 nt, Human
ucggagccacugcacugcuggcugcagacaca

SEQ ID NO: 237379 - RNA, 32 nt, Human
ucggagcccacguccuccucggugacacagga

SEQ ID NO: 237380 - RNA, 32 nt, Human
ucggagcccagcacuccugggucucggggucg

SEQ ID NO: 237381 - RNA, 20 nt, Human
ucggagcccuuauccaggua

SEQ ID NO: 237382 - RNA, 32 nt, Human
ucggagccuggcgauggcuuccagaaaccccu

SEQ ID NO: 237383 - RNA, 32 nt, Human
ucggagcgagagagcgcugcgccugccgccgc

SEQ ID NO: 237384 - RNA, 32 nt, Human
ucggagcgcgcaggaugcgcugggcggccgcc

SEQ ID NO: 237385 - RNA, 32 nt, Human
ucggagcuccaaccacaucugccugcaugccu

SEQ ID NO: 237386 - RNA, 32 nt, Human
ucggagcucccaguuuacuucacugcaagccg

SEQ ID NO: 237387 - RNA, 21 nt, Human
ucggagcugcgcucugagcua

SEQ ID NO: 237388 - RNA, 32 nt, Human
ucggagcugcuacccgcagacuucucccgcac

SEQ ID NO: 237389 - RNA, 32 nt, Human
ucggagcuggcuggaaucucucagccucaccu

SEQ ID NO: 237390 - RNA, 32 nt, Human
ucggaggaaagagccuugaacaguugugcgug

SEQ ID NO: 237391 - RNA, 32 nt, Human
ucggaggaaccuuccuugggggcagcagcccu

SEQ ID NO: 237392 - RNA, 23 nt, Human
ucggaggaccugcugacacugga

SEQ ID NO: 237393 - RNA, 32 nt, Human
ucggaggacgcacccucacuccccugcugccu

SEQ ID NO: 237394 - RNA, 32 nt, Human
ucggaggagccuguguccaccuccagucucgg

SEQ ID NO: 237395 - RNA, 21 nt, Human
ucggaggcacagaagcugcaa

SEQ ID NO: 237396 - RNA, 22 nt, Human
ucggaggcacuggacgccgcca

SEQ ID NO: 237397 - RNA, 32 nt, Human
ucggaggccccggagcaucggaaagggcggcu

SEQ ID NO: 237398 - RNA, 32 nt, Human
ucggaggccgggaggccggagcugcgggcgua

SEQ ID NO: 237399 - RNA, 32 nt, Human
ucggaggcgaggcgaggaagggagcuggaaua

SEQ ID NO: 237400 - RNA, 32 nt, Human
ucggaggcgugcuuccuccacccgccggcuag

SEQ ID NO: 237401 - RNA, 32 nt, Human
ucggaggcguucagcugcuucaagaugaagcu

SEQ ID NO: 237402 - RNA, 32 nt, Human
ucggaggcuacccgcuguggccggugccagcu

SEQ ID NO: 237403 - RNA, 32 nt, Human
ucggaggcucaggcccccugagcugggccucu

SEQ ID NO: 237404 - RNA, 32 nt, Human
ucggaggcugcaggaggcggccuagcuguggg

SEQ ID NO: 237405 - RNA, 32 nt, Human
ucggaggcugcugccccuuccaccucuggaaa

SEQ ID NO: 237406 - RNA, 32 nt, Human
ucggagggagauaaugaaucagaggaauuucu

SEQ ID NO: 237407 - RNA, 32 nt, Human
ucggagggagccucugugcagaugugcuuucu

SEQ ID NO: 237408 - RNA, 32 nt, Human
ucggagggaggaagugaggaagggucaaggau

SEQ ID NO: 237409 - RNA, 22 nt, Human
ucggagggaugacugcuggagg

SEQ ID NO: 237410 - RNA, 32 nt, Human
ucggaggggaaagggagaucccacgugcaagu

SEQ ID NO: 237411 - RNA, 32 nt, Human
ucggagggggccagagacugagcucuggucac

SEQ ID NO: 237412 - RNA, 23 nt, Human
ucggaggucccgggauuacggug

SEQ ID NO: 237413 - RNA, 32 nt, Human
ucggaggucuuucugccugccuguccucaugc

SEQ ID NO: 237414 - RNA, 32 nt, Human
ucggaggugggcgggguugcagugacuggugg

SEQ ID NO: 237415 - RNA, 32 nt, Human
ucggaggugguggaggaggaggaggaggagga

SEQ ID NO: 237416 - RNA, 24 nt, Human
ucggaguagcugggaucacagcug

SEQ ID NO: 237417 - RNA, 32 nt, Human
ucggagucugcacaggagagaggccuuccuuu

SEQ ID NO: 237418 - RNA, 32 nt, Human
ucggagucugggaggagagcagcugcgggcgc

SEQ ID NO: 237419 - RNA, 32 nt, Human
ucggagugcaaccuggcuggggcggggaggag

SEQ ID NO: 237420 - RNA, 32 nt, Human
ucggagugcucugggagcgggcuccacagccu

SEQ ID NO: 237421 - RNA, 32 nt, Human
ucggaguggaguuuccuagcuggugccugucc

SEQ ID NO: 237422 - RNA, 24 nt, Human
ucggaguggcugggauuacaggug

SEQ ID NO: 237423 - RNA, 32 nt, Human
ucggaguugagacuggcuuguugcuggcccca

SEQ ID NO: 237424 - RNA, 32 nt, Human
ucggauaucccuucauucuugcugaguucauc

SEQ ID NO: 237425 - RNA, 32 nt, Human
ucggaucacugcaaccuccaccuccuagguuc

SEQ ID NO: 237426 - RNA, 32 nt, Human
ucggauccuuuuucucuuuucgaguuguuagg

SEQ ID NO: 237427 - RNA, 32 nt, Human
ucggaucucagggccguggacacacacccccu

SEQ ID NO: 237428 - RNA, 32 nt, Human
ucggaucucaguccuucauggagaccuggucc

SEQ ID NO: 237429 - RNA, 32 nt, Human
ucggaucuuuucaaccugcuccuccggguugu

SEQ ID NO: 237430 - RNA, 32 nt, Human
ucggaugaagaaauggagaguaaaugggggag

SEQ ID NO: 237431 - RNA, 32 nt, Human
ucggaugcaucucuccaaaagccaccaagguc

SEQ ID NO: 237432 - RNA, 32 nt, Human
ucggaugccagcugcaccccgccuggcucgca

SEQ ID NO: 237433 - RNA, 32 nt, Human
ucggaugcgguggcucacaccuguaaucccag

SEQ ID NO: 237434 - RNA, 32 nt, Human
ucggaugcuagcacuugacacugugagcgcac

SEQ ID NO: 237435 - RNA, 32 nt, Human
ucggaugggcgcugcauaaacagccugcaggg

SEQ ID NO: 237436 - RNA, 32 nt, Human
ucggauucaaccgauucuugugccucagccuc

SEQ ID NO: 237437 - RNA, 32 nt, Human
ucggauugccuucuuucaauuuccuugugaaa

SEQ ID NO: 237438 - RNA, 32 nt, Human
ucggcaaauugcuuaucucuagguaguuuaaa

SEQ ID NO: 237439 - RNA, 32 nt, Human
ucggcaacaugccaagaccccgucucuauuuu

SEQ ID NO: 237440 - RNA, 32 nt, Human
ucggcaauuugaggaaggucuugcugucucag

SEQ ID NO: 237441 - RNA, 32 nt, Human
ucggcacacugcaaccuucgccucccagauuc

SEQ ID NO: 237442 - RNA, 32 nt, Human
ucggcacauaugcauguaugcccagguccuga

SEQ ID NO: 237443 - RNA, 32 nt, Human
ucggcaccguccuuuccuuucucccucgcguu

SEQ ID NO: 237444 - RNA, 32 nt, Human
ucggcaccuccaccauugcccccggccuaaga

SEQ ID NO: 237445 - RNA, 32 nt, Human
ucggcaccuccccuccccaacgccucugcgcc

SEQ ID NO: 237446 - RNA, 32 nt, Human
ucggcaccuggcccuggcagcacagcucucag

SEQ ID NO: 237447 - RNA, 32 nt, Human
ucggcaccuuucacccagcccaagcagcggcg

SEQ ID NO: 237448 - RNA, 32 nt, Human
ucggcacugaggcagaggaggcaagggcuggu

SEQ ID NO: 237449 - RNA, 32 nt, Human
ucggcagaaggaacuugccuugucucagauga

SEQ ID NO: 237450 - RNA, 32 nt, Human
ucggcagagucacccacccugcccuuccccag

SEQ ID NO: 237451 - RNA, 18 nt, Human
ucggcagagucuggggua

SEQ ID NO: 237452 - RNA, 32 nt, Human
ucggcagaugugggagaggauggacgagggau

SEQ ID NO: 237453 - RNA, 32 nt, Human
ucggcagcagagggaacagggaagaaaccuaa

SEQ ID NO: 237454 - RNA, 32 nt, Human
ucggcagcaucuuuaauuuaucuugcuuucca

SEQ ID NO: 237455 - RNA, 32 nt, Human
ucggcagcggccucagcacagagcaggggagc

SEQ ID NO: 237456 - RNA, 32 nt, Human
ucggcaggagccucucaauggaguccacuucc

SEQ ID NO: 237457 - RNA, 32 nt, Human
ucggcaggauguuagggcagcagcagcagcaa

SEQ ID NO: 237458 - RNA, 32 nt, Human
ucggcaggcugaagacacuagaauccugaccu

SEQ ID NO: 237459 - RNA, 32 nt, Human
ucggcaggcugcagcuguccccggguggccug

SEQ ID NO: 237460 - RNA, 32 nt, Human
ucggcagggcaggcagcuccaggagggcuucg

SEQ ID NO: 237461 - RNA, 23 nt, Human
ucggcaggggagcaggauucccg

SEQ ID NO: 237462 - RNA, 32 nt, Human
ucggcagguccuugagcaacuggugugugaaa

SEQ ID NO: 237463 - RNA, 32 nt, Human
ucggcaucagcgugccucccacccccauccug

SEQ ID NO: 237464 - RNA, 32 nt, Human
ucggcauccacccaguccaucccaccaucacc

SEQ ID NO: 237465 - RNA, 32 nt, Human
ucggcaugaccucucccuccccuggccacgug

SEQ ID NO: 237466 - RNA, 19 nt, Human
ucggccaaccaggcucuga

SEQ ID NO: 237467 - RNA, 32 nt, Human
ucggccaccagaaacgcuuagcacgucaccaa

SEQ ID NO: 237468 - RNA, 32 nt, Human
ucggccacccaaagugcugggauuacaggcgu

SEQ ID NO: 237469 - RNA, 32 nt, Human
ucggccacccaccucaacaucuccuucaacaa

SEQ ID NO: 237470 - RNA, 17 nt, Human
ucggccaccucccacca

SEQ ID NO: 237471 - RNA, 32 nt, Human
ucggccaccucgccagcucaggcacccgcugc

SEQ ID NO: 237472 - RNA, 32 nt, Human
ucggccacugcacuccgggcugggcgacagag

SEQ ID NO: 237473 - RNA, 32 nt, Human
ucggccagaacagcagcagcagcgaggagagc

SEQ ID NO: 237474 - RNA, 32 nt, Human
ucggccagagcggcgcuggcagaggagugucc

SEQ ID NO: 237475 - RNA, 32 nt, Human
ucggccagagcuggggcaggagaggggccucu

SEQ ID NO: 237476 - RNA, 32 nt, Human
ucggccagcaccucugcccuccagaaccugca

SEQ ID NO: 237477 - RNA, 32 nt, Human
ucggccagccuggcugucaguuggggauucca

SEQ ID NO: 237478 - RNA, 32 nt, Human
ucggccaggcuagagugcaguggcgcugucuc

SEQ ID NO: 237479 - RNA, 32 nt, Human
ucggccaggcuggaaugcaauggugccaacuu

SEQ ID NO: 237480 - RNA, 21 nt, Human
ucggccaggcuggagugcagu

SEQ ID NO: 237481 - RNA, 22 nt, Human
ucggccaggcuggagugcagug

SEQ ID NO: 237482 - RNA, 23 nt, Human
ucggccaggcuggagugcagugg

SEQ ID NO: 237483 - RNA, 32 nt, Human
ucggccaggcuggagugcaguggugcaaucac

SEQ ID NO: 237484 - RNA, 32 nt, Human
ucggccagguuggagugcaguggugcaaucuc

SEQ ID NO: 237485 - RNA, 32 nt, Human
ucggccaguccucgguccucaggcuuguggcu

SEQ ID NO: 237486 - RNA, 32 nt, Human
ucggccaguggcgacagcaggagcugagccua

SEQ ID NO: 237487 - RNA, 32 nt, Human
ucggccaugugggagguaugacccuggugccu

SEQ ID NO: 237488 - RNA, 27 nt, Human
ucggcccacguguauuguccgggcuca

SEQ ID NO: 237489 - RNA, 32 nt, Human
ucggcccacugaaaccuccaccucccggguuc

SEQ ID NO: 237490 - RNA, 32 nt, Human
ucggcccacugcaaccucugccuccuggguuc

SEQ ID NO: 237491 - RNA, 32 nt, Human
ucggcccacuugcuuaguucuugggcuggacc

SEQ ID NO: 237492 - RNA, 32 nt, Human
ucggcccaggagggcggggucccgugguggag

SEQ ID NO: 237493 - RNA, 32 nt, Human
ucggccccaccagaucuccauucuuugccaug

SEQ ID NO: 237494 - RNA, 32 nt, Human
ucggccccaccaugucgagccucggcgguggc

SEQ ID NO: 237495 - RNA, 32 nt, Human
ucggccccaccuaccucccacccggucuuccu

SEQ ID NO: 237496 - RNA, 21 nt, Human
ucggcccccguccgcccucuc

SEQ ID NO: 237497 - RNA, 20 nt, Human
ucggcccccuccaucgggcu

SEQ ID NO: 237498 - RNA, 32 nt, Human
ucggccccuccagccccgggccggaccuccug

SEQ ID NO: 237499 - RNA, 32 nt, Human
ucggccccucccccaagucucuucugugcaag

SEQ ID NO: 237500 - RNA, 32 nt, Human
ucggccccucuuucccugucgccugcagccac

SEQ ID NO: 237501 - RNA, 23 nt, Human
ucggccccucuuugcggccgcuc

SEQ ID NO: 237502 - RNA, 32 nt, Human
ucggccccugucccccuccacaauucagaggc

SEQ ID NO: 237503 - RNA, 32 nt, Human
ucggcccgccugccuccacuccugccuccacc

SEQ ID NO: 237504 - RNA, 32 nt, Human
ucggcccucacccagggcccugccucgggucc

SEQ ID NO: 237505 - RNA, 32 nt, Human
ucggcccuccacugcggaccucuccugagugg

SEQ ID NO: 237506 - RNA, 22 nt, Human
ucggcccucggccccggcgcuc

SEQ ID NO: 237507 - RNA, 32 nt, Human
ucggcccugcauuccuacaucuugugucugua

SEQ ID NO: 237508 - RNA, 32 nt, Human
ucggcccugcccccaguauacugaccauuccc

SEQ ID NO: 237509 - RNA, 32 nt, Human
ucggccgccugucagugcaaugcugccccaug

SEQ ID NO: 237510 - RNA, 32 nt, Human
ucggccggaagaagauaaagaaaacaacacgc

SEQ ID NO: 237511 - RNA, 32 nt, Human
ucggccgggcugcugcugcugcugcuccaggu

SEQ ID NO: 237512 - RNA, 32 nt, Human
ucggccucacaaagugcugggauuacaggcgu

SEQ ID NO: 237513 - RNA, 32 nt, Human
ucggccucacaaagugcugggauuacaggugu

SEQ ID NO: 237514 - RNA, 32 nt, Human
ucggccucaguuaagccuuuguggacuccagg

SEQ ID NO: 237515 - RNA, 32 nt, Human
ucggccuccaaaagugcugggauuacaggugu

SEQ ID NO: 237516 - RNA, 32 nt, Human
ucggccuccaaaagugcugggauuacuagcac

SEQ ID NO: 237517 - RNA, 32 nt, Human
ucggccucccaaaaugcugggauuacaagcgu

SEQ ID NO: 237518 - RNA, 32 nt, Human
ucggccucccaaaaugcugggauuacagaugu

SEQ ID NO: 237519 - RNA, 32 nt, Human
ucggccucccaaaaugcugggauuacaggccu

SEQ ID NO: 237520 - RNA, 32 nt, Human
ucggccucccaaaaugcugggauuacaggcgu

SEQ ID NO: 237521 - RNA, 32 nt, Human
ucggccucccaaaaugcugggauuacaggggu

SEQ ID NO: 237522 - RNA, 32 nt, Human
ucggccucccaaaaugcugggauuacaggugu

SEQ ID NO: 237523 - RNA, 32 nt, Human
ucggccucccaaaaugcugggauuacaugcau

SEQ ID NO: 237524 - RNA, 32 nt, Human
ucggccucccaaaaugcugggauuaccggugu

SEQ ID NO: 237525 - RNA, 32 nt, Human
ucggccucccaaaaugcugggauuagaggugu

SEQ ID NO: 237526 - RNA, 32 nt, Human
ucggccucccaaaaugcugggauugcagacau

SEQ ID NO: 237527 - RNA, 32 nt, Human
ucggccucccaaaauguugggauuacaggcau

SEQ ID NO: 237528 - RNA, 32 nt, Human
ucggccucccaaaauugcugggauuacaggug

SEQ ID NO: 237529 - RNA, 32 nt, Human
ucggccucccaaacugcugggauuacaggcgu

SEQ ID NO: 237530 - RNA, 32 nt, Human
ucggccucccaaagaacugggauuacaggcau

SEQ ID NO: 237531 - RNA, 32 nt, Human
ucggccucccaaagagcugagauuacaggcgu

SEQ ID NO: 237532 - RNA, 32 nt, Human
ucggccucccaaagagcuggaauuacaggaga

SEQ ID NO: 237533 - RNA, 32 nt, Human
ucggccucccaaagcacugggauuacaggcau

SEQ ID NO: 237534 - RNA, 32 nt, Human
ucggccucccaaagcacugggauuacaggcgu

SEQ ID NO: 237535 - RNA, 32 nt, Human
ucggccucccaaagcgcuaggauuacaggugu

SEQ ID NO: 237536 - RNA, 32 nt, Human
ucggccucccaaagcgcugggauuacaggcgu

SEQ ID NO: 237537 - RNA, 32 nt, Human
ucggccucccaaaguacugggauuacaggccu

SEQ ID NO: 237538 - RNA, 32 nt, Human
ucggccucccaaaguacugggauuacaggcgu

SEQ ID NO: 237539 - RNA, 32 nt, Human
ucggccucccaaaguacugggauuauaggcgu

SEQ ID NO: 237540 - RNA, 32 nt, Human
ucggccucccaaaguacugggauuauaggugu

SEQ ID NO: 237541 - RNA, 32 nt, Human
ucggccucccaaaguauugggauuacccgcgu

SEQ ID NO: 237542 - RNA, 32 nt, Human
ucggccucccaaagugaugggauuacaggcau

SEQ ID NO: 237543 - RNA, 32 nt, Human
ucggccucccaaagugccgggauuacaggcau

SEQ ID NO: 237544 - RNA, 32 nt, Human
ucggccucccaaagugccgggauuacaggcgu

SEQ ID NO: 237545 - RNA, 32 nt, Human
ucggccucccaaagugcuaagauuacaggcgu

SEQ ID NO: 237546 - RNA, 32 nt, Human
ucggccucccaaagugcuaggauuacagaagg

SEQ ID NO: 237547 - RNA, 32 nt, Human
ucggccucccaaagugcuaggauuacaggagu

SEQ ID NO: 237548 - RNA, 32 nt, Human
ucggccucccaaagugcuaggauuacaggcau

SEQ ID NO: 237549 - RNA, 32 nt, Human
ucggccucccaaagugcuaggauuacaggccc

SEQ ID NO: 237550 - RNA, 32 nt, Human
ucggccucccaaagugcuaggauuacaggcgu

SEQ ID NO: 237551 - RNA, 32 nt, Human
ucggccucccaaagugcuaggauuacaggugu

SEQ ID NO: 237552 - RNA, 32 nt, Human
ucggccucccaaagugcuaggauuauaggcau

SEQ ID NO: 237553 - RNA, 32 nt, Human
ucggccucccaaagugcugagauuacagaagu

SEQ ID NO: 237554 - RNA, 32 nt, Human
ucggccucccaaagugcugagauuacagacgu

SEQ ID NO: 237555 - RNA, 32 nt, Human
ucggccucccaaagugcugagauuacaggcau

SEQ ID NO: 237556 - RNA, 32 nt, Human
ucggccucccaaagugcugagauuacaggccu

SEQ ID NO: 237557 - RNA, 32 nt, Human
ucggccucccaaagugcugagauuacaggcuu

SEQ ID NO: 237558 - RNA, 32 nt, Human
ucggccucccaaagugcugagauuacaggggu

SEQ ID NO: 237559 - RNA, 32 nt, Human
ucggccucccaaagugcugagauuacaggugu

SEQ ID NO: 237560 - RNA, 32 nt, Human
ucggccucccaaagugcugagauuacgggcau

SEQ ID NO: 237561 - RNA, 32 nt, Human
ucggccucccaaagugcugcgauuacaggcau

SEQ ID NO: 237562 - RNA, 32 nt, Human
ucggccucccaaagugcuggaauuacaggcga

SEQ ID NO: 237563 - RNA, 32 nt, Human
ucggccucccaaagugcuggaauuacaggcgu

SEQ ID NO: 237564 - RNA, 32 nt, Human
ucggccucccaaagugcuggauuacaggcgug

SEQ ID NO: 237565 - RNA, 32 nt, Human
ucggccucccaaagugcuggauuacaggugug

SEQ ID NO: 237566 - RNA, 32 nt, Human
ucggccucccaaagugcuggcauuacaggugg

SEQ ID NO: 237567 - RNA, 32 nt, Human
ucggccucccaaagugcugggacuacaggcag

SEQ ID NO: 237568 - RNA, 32 nt, Human
ucggccucccaaagugcugggacuacaggcau

SEQ ID NO: 237569 - RNA, 32 nt, Human
ucggccucccaaagugcugggacuauaagugu

SEQ ID NO: 237570 - RNA, 32 nt, Human
ucggccucccaaagugcugggacugcaggcgu

SEQ ID NO: 237571 - RNA, 32 nt, Human
ucggccucccaaagugcugggaucacagacgu

SEQ ID NO: 237572 - RNA, 32 nt, Human
ucggccucccaaagugcugggaugacaggcau

SEQ ID NO: 237573 - RNA, 32 nt, Human
ucggccucccaaagugcugggaugacaggcgu

SEQ ID NO: 237574 - RNA, 32 nt, Human
ucggccucccaaagugcugggaugaccagcau

SEQ ID NO: 237575 - RNA, 32 nt, Human
ucggccucccaaagugcugggauuaaagcugu

SEQ ID NO: 237576 - RNA, 32 nt, Human
ucggccucccaaagugcugggauuaaaggcgu

SEQ ID NO: 237577 - RNA, 32 nt, Human
ucggccucccaaagugcugggauuaaggcgug

SEQ ID NO: 237578 - RNA, 32 nt, Human
ucggccucccaaagugcugggauuacaagcau

SEQ ID NO: 237579 - RNA, 32 nt, Human
ucggccucccaaagugcugggauuacaagggu

SEQ ID NO: 237580 - RNA, 32 nt, Human
ucggccucccaaagugcugggauuacacgcgu

SEQ ID NO: 237581 - RNA, 32 nt, Human
ucggccucccaaagugcugggauuacagacgu

SEQ ID NO: 237582 - RNA, 32 nt, Human
ucggccucccaaagugcugggauuacagagug

SEQ ID NO: 237583 - RNA, 32 nt, Human
ucggccucccaaagugcugggauuacagaugu

SEQ ID NO: 237584 - RNA, 32 nt, Human
ucggccucccaaagugcugggauuacagcugu

SEQ ID NO: 237585 - RNA, 32 nt, Human
ucggccucccaaagugcugggauuacaggcac

SEQ ID NO: 237586 - RNA, 32 nt, Human
ucggccucccaaagugcugggauuacaggcag

SEQ ID NO: 237587 - RNA, 32 nt, Human
ucggccucccaaagugcugggauuacaggcau

SEQ ID NO: 237588 - RNA, 32 nt, Human
ucggccucccaaagugcugggauuacaggccu

SEQ ID NO: 237589 - RNA, 32 nt, Human
ucggccucccaaagugcugggauuacaggcgc

SEQ ID NO: 237590 - RNA, 32 nt, Human
ucggccucccaaagugcugggauuacaggcgu

SEQ ID NO: 237591 - RNA, 32 nt, Human
ucggccucccaaagugcugggauuacaggcug

SEQ ID NO: 237592 - RNA, 32 nt, Human
ucggccucccaaagugcugggauuacaggcuu

SEQ ID NO: 237593 - RNA, 32 nt, Human
ucggccucccaaagugcugggauuacagggau

SEQ ID NO: 237594 - RNA, 32 nt, Human
ucggccucccaaagugcugggauuacaggugc

SEQ ID NO: 237595 - RNA, 32 nt, Human
ucggccucccaaagugcugggauuacaggugg

SEQ ID NO: 237596 - RNA, 32 nt, Human
ucggccucccaaagugcugggauuacaggugu

SEQ ID NO: 237597 - RNA, 32 nt, Human
ucggccucccaaagugcugggauuacagguuu

SEQ ID NO: 237598 - RNA, 32 nt, Human
ucggccucccaaagugcugggauuacagucau

SEQ ID NO: 237599 - RNA, 32 nt, Human
ucggccucccaaagugcugggauuacaugcgu

SEQ ID NO: 237600 - RNA, 32 nt, Human
ucggccucccaaagugcugggauuaccggcau

SEQ ID NO: 237601 - RNA, 32 nt, Human
ucggccucccaaagugcugggauuacgggcau

SEQ ID NO: 237602 - RNA, 32 nt, Human
ucggccucccaaagugcugggauuacgggugu

SEQ ID NO: 237603 - RNA, 32 nt, Human
ucggccucccaaagugcugggauuacuuuaca

SEQ ID NO: 237604 - RNA, 32 nt, Human
ucggccucccaaagugcugggauuagaggcuu

SEQ ID NO: 237605 - RNA, 32 nt, Human
ucggccucccaaagugcugggauuauacaugu

SEQ ID NO: 237606 - RNA, 32 nt, Human
ucggccucccaaagugcugggauuauagaugu

SEQ ID NO: 237607 - RNA, 32 nt, Human
ucggccucccaaagugcugggauuauaggcau

SEQ ID NO: 237608 - RNA, 32 nt, Human
ucggccucccaaagugcugggauuauaggcgu

SEQ ID NO: 237609 - RNA, 32 nt, Human
ucggccucccaaagugcugggauuauaggugu

SEQ ID NO: 237610 - RNA, 32 nt, Human
ucggccucccaaagugcugggauuccaggcgu

SEQ ID NO: 237611 - RNA, 32 nt, Human
ucggccucccaaagugcugggauuccuuucuu

SEQ ID NO: 237612 - RNA, 32 nt, Human
ucggccucccaaagugcugggauugcaggcau

SEQ ID NO: 237613 - RNA, 32 nt, Human
ucggccucccaaagugcugggauugcaggcgu

SEQ ID NO: 237614 - RNA, 32 nt, Human
ucggccucccaaagugcugggauugugggugu

SEQ ID NO: 237615 - RNA, 32 nt, Human
ucggccucccaaagugcuguaauuacaggcau

SEQ ID NO: 237616 - RNA, 32 nt, Human
ucggccucccaaagugcuuggauuacaggcau

SEQ ID NO: 237617 - RNA, 32 nt, Human
ucggccucccaaagugcuuggauuacaggugu

SEQ ID NO: 237618 - RNA, 32 nt, Human
ucggccucccaaagugcuuggauuauaggcgu

SEQ ID NO: 237619 - RNA, 32 nt, Human
ucggccucccaaaguggugggauuacagacgu

SEQ ID NO: 237620 - RNA, 32 nt, Human
ucggccucccaaaguguagggauuacaggcgu

SEQ ID NO: 237621 - RNA, 32 nt, Human
ucggccucccaaaguguggggauuacgggugu

SEQ ID NO: 237622 - RNA, 32 nt, Human
ucggccucccaaaguguugggaucacaggcgu

SEQ ID NO: 237623 - RNA, 32 nt, Human
ucggccucccaaaguguugggauuacaggcau

SEQ ID NO: 237624 - RNA, 32 nt, Human
ucggccucccaaaguguugggauuacaggcgu

SEQ ID NO: 237625 - RNA, 32 nt, Human
ucggccucccaaaguguugggauuacaggugu

SEQ ID NO: 237626 - RNA, 32 nt, Human
ucggccucccaaaguucugggauuacaaguaa

SEQ ID NO: 237627 - RNA, 32 nt, Human
ucggccucccaaaguucugggauuacaggcau

SEQ ID NO: 237628 - RNA, 32 nt, Human
ucggccucccaaaguucugggauuacaggcgu

SEQ ID NO: 237629 - RNA, 32 nt, Human
ucggccucccaaaguucugggauuacaggcuu

SEQ ID NO: 237630 - RNA, 32 nt, Human
ucggccucccaaaguucugggauuacaggggu

SEQ ID NO: 237631 - RNA, 32 nt, Human
ucggccucccaaaguucugggauuacaggugu

SEQ ID NO: 237632 - RNA, 32 nt, Human
ucggccucccaaaguucugggauuacgggcgu

SEQ ID NO: 237633 - RNA, 32 nt, Human
ucggccucccaaaguucugggauuaugggugu

SEQ ID NO: 237634 - RNA, 32 nt, Human
ucggccucccaacgugcugggauuacaggugu

SEQ ID NO: 237635 - RNA, 32 nt, Human
ucggccucccaacgugcugggauuauaggcgu

SEQ ID NO: 237636 - RNA, 32 nt, Human
ucggccucccaaggugcugggauugcaggcgu

SEQ ID NO: 237637 - RNA, 32 nt, Human
ucggccucccaaguagcugggauugcaggugc

SEQ ID NO: 237638 - RNA, 32 nt, Human
ucggccucccaauguguugggauuacaggcgu

SEQ ID NO: 237639 - RNA, 32 nt, Human
ucggccucccacagugcugggauuacaggccu

SEQ ID NO: 237640 - RNA, 32 nt, Human
ucggccucccacagugcugggauuaccggcgu

SEQ ID NO: 237641 - RNA, 32 nt, Human
ucggccucccagaaugcugggauuacaggcgu

SEQ ID NO: 237642 - RNA, 32 nt, Human
ucggccucccagagugcugggacuacaggcau

SEQ ID NO: 237643 - RNA, 32 nt, Human
ucggccucccagagugcugggauuacaggcau

SEQ ID NO: 237644 - RNA, 32 nt, Human
ucggccucccagagugcugggauuacaggcgu

SEQ ID NO: 237645 - RNA, 32 nt, Human
ucggccucccagagugcugggauuacaggugu

SEQ ID NO: 237646 - RNA, 32 nt, Human
ucggccucccagagugcugggauuauaggcgu

SEQ ID NO: 237647 - RNA, 32 nt, Human
ucggccucccagagugcugggauuuacaggca

SEQ ID NO: 237648 - RNA, 32 nt, Human
ucggccucccagguagcugggauuauaggcgu

SEQ ID NO: 237649 - RNA, 32 nt, Human
ucggccucccauaaugcugggauuacaggcgu

SEQ ID NO: 237650 - RNA, 32 nt, Human
ucggccucccauagugcugggauuacaggugu

SEQ ID NO: 237651 - RNA, 32 nt, Human
ucggccuccccaagugcugggauuauaggcau

SEQ ID NO: 237652 - RNA, 32 nt, Human
ucggccuccccaaguguugggauuacaggcgu

SEQ ID NO: 237653 - RNA, 24 nt, Human
ucggccuccccgccccaggcguca

SEQ ID NO: 237654 - RNA, 32 nt, Human
ucggccucccgaaaugcugggauuacaggcau

SEQ ID NO: 237655 - RNA, 32 nt, Human
ucggccucccgaagugcugggauuacaggcgg

SEQ ID NO: 237656 - RNA, 32 nt, Human
ucggccucccgaagugcugggauuauaggugu

SEQ ID NO: 237657 - RNA, 32 nt, Human
ucggccucccgaagugcugggauugcaggcgu

SEQ ID NO: 237658 - RNA, 32 nt, Human
ucggccucccgaguagcugggauuacaggugu

SEQ ID NO: 237659 - RNA, 32 nt, Human
ucggccucccggggugcugggauuauaggcgu

SEQ ID NO: 237660 - RNA, 32 nt, Human
ucggccucccggguggcugggauugcaggcac

SEQ ID NO: 237661 - RNA, 32 nt, Human
ucggccucccuaguagcugggauuacaggcgc

SEQ ID NO: 237662 - RNA, 18 nt, Human
ucggccucccuggcccca

SEQ ID NO: 237663 - RNA, 32 nt, Human
ucggccuccgaaaaugcugggauuacaggcgu

SEQ ID NO: 237664 - RNA, 32 nt, Human
ucggccuccgaaaaugcugggauuacaggugu

SEQ ID NO: 237665 - RNA, 32 nt, Human
ucggccuccgaaagugcugggauuacaggcgu

SEQ ID NO: 237666 - RNA, 32 nt, Human
ucggccuccuaaagugcugggauuacaggcac

SEQ ID NO: 237667 - RNA, 32 nt, Human
ucggccuccuaaagugcugggauuacaggcau

SEQ ID NO: 237668 - RNA, 32 nt, Human
ucggccuccuaaagugcugggauuacaggcgu

SEQ ID NO: 237669 - RNA, 32 nt, Human
ucggccuccuaaagugcugggauuacaggugu

SEQ ID NO: 237670 - RNA, 32 nt, Human
ucggccuccuaaaguucugggauuacaggagu

SEQ ID NO: 237671 - RNA, 32 nt, Human
ucggccuccugaagugcugggauuacaggcgu

SEQ ID NO: 237672 - RNA, 32 nt, Human
ucggccucucaaaaugcugggauuacaggugu

SEQ ID NO: 237673 - RNA, 32 nt, Human
ucggccucucaaacugcugggauuacaggcac

SEQ ID NO: 237674 - RNA, 32 nt, Human
ucggccucucaaagcacugggauuacaggugu

SEQ ID NO: 237675 - RNA, 32 nt, Human
ucggccucucaaagugcugggauuaaaggcgu

SEQ ID NO: 237676 - RNA, 32 nt, Human
ucggccucucaaagugcugggauuacaggcau

SEQ ID NO: 237677 - RNA, 32 nt, Human
ucggccucucaaagugcugggauuacaggcgu

SEQ ID NO: 237678 - RNA, 32 nt, Human
ucggccucucaaagugcugggauuacaggcuu

SEQ ID NO: 237679 - RNA, 32 nt, Human
ucggccucucaaagugcugggauuagaggcuu

SEQ ID NO: 237680 - RNA, 32 nt, Human
ucggccucucaaagugcugggauuauaggcgu

SEQ ID NO: 237681 - RNA, 32 nt, Human
ucggccucucaaaguguugggauuacaggcgu

SEQ ID NO: 237682 - RNA, 32 nt, Human
ucggccucuccccacagaauacaguucgccau

SEQ ID NO: 237683 - RNA, 32 nt, Human
ucggccucuccuggcccugccucccagcaagu

SEQ ID NO: 237684 - RNA, 32 nt, Human
ucggccucugaaagugcugggauuacaggcgu

SEQ ID NO: 237685 - RNA, 32 nt, Human
ucggccucugcagucccaacgucugccucaca

SEQ ID NO: 237686 - RNA, 32 nt, Human
ucggccucugggccgggccccucugcccugug

SEQ ID NO: 237687 - RNA, 32 nt, Human
ucggccucuuaaagugcugggauuacaggcgu

SEQ ID NO: 237688 - RNA, 32 nt, Human
ucggccugacccucgggccucuccgagucuuu

SEQ ID NO: 237689 - RNA, 32 nt, Human
ucggccugccaaacugcugggauuauaggcgu

SEQ ID NO: 237690 - RNA, 32 nt, Human
ucggccugccaaagugcugggauuacaggcuu

SEQ ID NO: 237691 - RNA, 22 nt, Human
ucggccugcggugggggcgcuu

SEQ ID NO: 237692 - RNA, 32 nt, Human
ucggccuggcugcuuagcuacuuuucacugag

SEQ ID NO: 237693 - RNA, 32 nt, Human
ucggccugggcugcgugcuggagagcggggac

SEQ ID NO: 237694 - RNA, 32 nt, Human
ucggccuuagaaccccaguaucagcagaagga

SEQ ID NO: 237695 - RNA, 32 nt, Human
ucggccuuccaaagugccgggauuacagacgu

SEQ ID NO: 237696 - RNA, 32 nt, Human
ucggccuuccaaagugcugggauuacaaguuu

SEQ ID NO: 237697 - RNA, 32 nt, Human
ucggccuuccaaagugcugggauuacaggcau

SEQ ID NO: 237698 - RNA, 32 nt, Human
ucggccuuccaaagugcugggauuacaggccu

SEQ ID NO: 237699 - RNA, 32 nt, Human
ucggccuuccaaaguguugggauuaccggcgu

SEQ ID NO: 237700 - RNA, 32 nt, Human
ucggccuuccaaaguucugggauuacaggcgu

SEQ ID NO: 237701 - RNA, 32 nt, Human
ucggccuuccgaguagcugggauugcaggcgu

SEQ ID NO: 237702 - RNA, 32 nt, Human
ucggccuugcaaaaugcugggauuacaggcau

SEQ ID NO: 237703 - RNA, 32 nt, Human
ucggccuuucaaagugcugggauuacagacau

SEQ ID NO: 237704 - RNA, 26 nt, Human
ucggccuuuguccagcgaccaggcuc

SEQ ID NO: 237705 - RNA, 32 nt, Human
ucggcgccacagagaagacccccgggaguucg

SEQ ID NO: 237706 - RNA, 32 nt, Human
ucggcgcccagggucugaggcugcagccccag

SEQ ID NO: 237707 - RNA, 32 nt, Human
ucggcgcggcucaugguccgguucgggcucgc

SEQ ID NO: 237708 - RNA, 32 nt, Human
ucggcgcucacugcucuccacgccggggacau

SEQ ID NO: 237709 - RNA, 32 nt, Human
ucggcgcucugacuucuaggagcacaagagag

SEQ ID NO: 237710 - RNA, 17 nt, Human
ucggcgcugccccgguc

SEQ ID NO: 237711 - RNA, 32 nt, Human
ucggcgcugccugggcuccugcagccucuccc

SEQ ID NO: 237712 - RNA, 32 nt, Human
ucggcgcuucccugucgucgcacuuugugguu

SEQ ID NO: 237713 - RNA, 32 nt, Human
ucggcggagacaggcagcccuagguugaccau

SEQ ID NO: 237714 - RNA, 32 nt, Human
ucggcggagcucccaccuccgcuuacagcucg

SEQ ID NO: 237715 - RNA, 32 nt, Human
ucggcggauuugaccaaauuguuuucaaguuc

SEQ ID NO: 237716 - RNA, 19 nt, Human
ucggcggcggagccucugg

SEQ ID NO: 237717 - RNA, 32 nt, Human
ucggcggcggcgggcaguugcaguggugcaga

SEQ ID NO: 237718 - RNA, 32 nt, Human
ucggcggcucacaccuguaaccccagcacuuu

SEQ ID NO: 237719 - RNA, 32 nt, Human
ucggcggcucacuacaaccucugccucaagcg

SEQ ID NO: 237720 - RNA, 32 nt, Human
ucggcggcuccuuccagcaggggcuugcgcuu

SEQ ID NO: 237721 - RNA, 32 nt, Human
ucggcgggaagcggcgauccugccaccgggag

SEQ ID NO: 237722 - RNA, 32 nt, Human
ucggcgggagcacccaguccuguacgccaagg

SEQ ID NO: 237723 - RNA, 32 nt, Human
ucggcgggcagaggagagggaggccgcggaau

SEQ ID NO: 237724 - RNA, 32 nt, Human
ucggcgguguccaggagggaaggaacgggaaa

SEQ ID NO: 237725 - RNA, 32 nt, Human
ucggcgucucaaagugcugggauuacaagcgu

SEQ ID NO: 237726 - RNA, 20 nt, Human
ucggcguggcccaaggccgg

SEQ ID NO: 237727 - RNA, 19 nt, Human
ucggcgugggagagcgaga

SEQ ID NO: 237728 - RNA, 32 nt, Human
ucggcguugagcccggguagggccagguggcu

SEQ ID NO: 237729 - RNA, 32 nt, Human
ucggcuagcagcggcucucagggaaggccugg

SEQ ID NO: 237730 - RNA, 32 nt, Human
ucggcucaacgcaaccuccgccucccagguuc

SEQ ID NO: 237731 - RNA, 32 nt, Human
ucggcucaaugcagcuuugccuccccagcuca

SEQ ID NO: 237732 - RNA, 32 nt, Human
ucggcucacagcaaccucucugccuccagaaa

SEQ ID NO: 237733 - RNA, 32 nt, Human
ucggcucacagcaaccucugccucccggauuu

SEQ ID NO: 237734 - RNA, 32 nt, Human
ucggcucacagugcaaccucugcuucccaggu

SEQ ID NO: 237735 - RNA, 32 nt, Human
ucggcucaccacaaccuccaccucccagguuc

SEQ ID NO: 237736 - RNA, 32 nt, Human
ucggcucaccacaaccuccuccucuuggguuc

SEQ ID NO: 237737 - RNA, 32 nt, Human
ucggcucaccgcaaccuccgcccccuggguuc

SEQ ID NO: 237738 - RNA, 32 nt, Human
ucggcucaccgcaaccuccgccucccagguuc

SEQ ID NO: 237739 - RNA, 32 nt, Human
ucggcucaccgcaaccuccgccucccggauuc

SEQ ID NO: 237740 - RNA, 32 nt, Human
ucggcucaccgcaaccuccgccucccggguuc

SEQ ID NO: 237741 - RNA, 32 nt, Human
ucggcucaccgcaaccuccucuucuggguuaa

SEQ ID NO: 237742 - RNA, 32 nt, Human
ucggcucaccgcaaccucugccucccaggugc

SEQ ID NO: 237743 - RNA, 32 nt, Human
ucggcucaccgcaaccucugccucccggguuc

SEQ ID NO: 237744 - RNA, 32 nt, Human
ucggcucacggcaaccuccaccucccggguuc

SEQ ID NO: 237745 - RNA, 32 nt, Human
ucggcucacuacaaccuccgccucccagguuc

SEQ ID NO: 237746 - RNA, 32 nt, Human
ucggcucacuauaaccuccaccucccagguuc

SEQ ID NO: 237747 - RNA, 32 nt, Human
ucggcucacuccaaccuccaccuacuagguuc

SEQ ID NO: 237748 - RNA, 32 nt, Human
ucggcucacuccaaucuccaccucccggauuc

SEQ ID NO: 237749 - RNA, 32 nt, Human
ucggcucacuccaccuccaccucccagguuca

SEQ ID NO: 237750 - RNA, 32 nt, Human
ucggcucacugaaccuccgccucccagguuca

SEQ ID NO: 237751 - RNA, 32 nt, Human
ucggcucacugcaaaccgccucccggguucac

SEQ ID NO: 237752 - RNA, 32 nt, Human
ucggcucacugcaaacuccgccucccagguuc

SEQ ID NO: 237753 - RNA, 32 nt, Human
ucggcucacugcaaacuccgccucccggguuc

SEQ ID NO: 237754 - RNA, 32 nt, Human
ucggcucacugcaaacuccgccuuccagguuc

SEQ ID NO: 237755 - RNA, 32 nt, Human
ucggcucacugcaaacucugccucccagguuc

SEQ ID NO: 237756 - RNA, 32 nt, Human
ucggcucacugcaaacucugccucccggguuc

SEQ ID NO: 237757 - RNA, 32 nt, Human
ucggcucacugcaaaucuccgccucccagguu

SEQ ID NO: 237758 - RNA, 32 nt, Human
ucggcucacugcaacauccaccuccuggguuc

SEQ ID NO: 237759 - RNA, 32 nt, Human
ucggcucacugcaaccaccaucucccaggaga

SEQ ID NO: 237760 - RNA, 32 nt, Human
ucggcucacugcaaccacugccucccagguuc

SEQ ID NO: 237761 - RNA, 32 nt, Human
ucggcucacugcaacccccacaucccggguuc

SEQ ID NO: 237762 - RNA, 32 nt, Human
ucggcucacugcaacccccaucucccagguuc

SEQ ID NO: 237763 - RNA, 32 nt, Human
ucggcucacugcaacccccgucucccggguuc

SEQ ID NO: 237764 - RNA, 32 nt, Human
ucggcucacugcaaccucaccucccggguuca

SEQ ID NO: 237765 - RNA, 32 nt, Human
ucggcucacugcaaccuccaacucccagguuc

SEQ ID NO: 237766 - RNA, 32 nt, Human
ucggcucacugcaaccuccacaucccauguug

SEQ ID NO: 237767 - RNA, 32 nt, Human
ucggcucacugcaaccuccaccucacagguuc

SEQ ID NO: 237768 - RNA, 32 nt, Human
ucggcucacugcaaccuccaccucccagauuc

SEQ ID NO: 237769 - RNA, 32 nt, Human
ucggcucacugcaaccuccaccucccagguca

SEQ ID NO: 237770 - RNA, 32 nt, Human
ucggcucacugcaaccuccaccucccagguuc

SEQ ID NO: 237771 - RNA, 32 nt, Human
ucggcucacugcaaccuccaccuccccaguuc

SEQ ID NO: 237772 - RNA, 32 nt, Human
ucggcucacugcaaccuccaccuccccggguu

SEQ ID NO: 237773 - RNA, 32 nt, Human
ucggcucacugcaaccuccaccucccgaguuc

SEQ ID NO: 237774 - RNA, 32 nt, Human
ucggcucacugcaaccuccaccucccggauuc
